United States Patent 11,464,842 (COMPOSITIONS AND METHOD FOR OPTIMIZED PEPTIDE VACCINES USING RESIDUE OPTIMIZATION) - sequence listing, part 6

SEQ ID NO: 79675 - protein, 9 aa, Artificial Sequence
  Description of Artificial Sequence: Synthetic peptide
  Seed: SAQSTFEGF (MAGC1_HUMAN)
SPQSTFEGW

SEQ ID NO: 79676 - protein, 10 aa, Artificial Sequence
  Description of Artificial Sequence: Synthetic peptide
  Seed: MSPLYFPQSP (MAGC1_HUMAN)
MHPLYFPQSA

SEQ ID NO: 79677 - protein, 9 aa, Artificial Sequence
  Description of Artificial Sequence: Synthetic peptide
  Seed: IPVSSSFSY (MAGC1_HUMAN)
ILVSSSFSF

SEQ ID NO: 79678 - protein, 10 aa, Artificial Sequence
  Description of Artificial Sequence: Synthetic peptide
  Seed: SFPSSTSSSL (MAGC1_HUMAN)
SHPSSTSSSL

SEQ ID NO: 79679 - protein, 9 aa, Artificial Sequence
  Description of Artificial Sequence: Synthetic peptide
  Seed: SAQSTFEGF (MAGC1_HUMAN)
SQQSTFEGL

SEQ ID NO: 79680 - protein, 9 aa, Artificial Sequence
  Description of Artificial Sequence: Synthetic peptide
  Seed: SSPEGKDSL (MAGC1_HUMAN)
SSPEGKDSV

SEQ ID NO: 79681 - protein, 9 aa, Artificial Sequence
  Description of Artificial Sequence: Synthetic peptide
  Seed: LQIPMTSSF (MAGC1_HUMAN)
LSIPMTSSI

SEQ ID NO: 79682 - protein, 9 aa, Artificial Sequence
  Description of Artificial Sequence: Synthetic peptide
  Seed: VSSFFSYTL (MAGC1_HUMAN)
VLSFFSYTM

SEQ ID NO: 79683 - protein, 9 aa, Artificial Sequence
  Description of Artificial Sequence: Synthetic peptide
  Seed: VQSPLHSPQ (MAGC1_HUMAN)
VQSPLHSPA

SEQ ID NO: 79684 - protein, 9 aa, Artificial Sequence
  Description of Artificial Sequence: Synthetic peptide
  Seed: LQNPASSFF (MAGC1_HUMAN)
LKNPASSFF

SEQ ID NO: 79685 - protein, 9 aa, Artificial Sequence
  Description of Artificial Sequence: Synthetic peptide
  Seed: LQIPMTSSF (MAGC1_HUMAN)
LYIPMTSSA

SEQ ID NO: 79686 - protein, 8 aa, Artificial Sequence
  Description of Artificial Sequence: Synthetic peptide
  Seed: FSYTLASL (MAGC1_HUMAN)
FAYTLASM

SEQ ID NO: 79687 - protein, 9 aa, Artificial Sequence
  Description of Artificial Sequence: Synthetic peptide
  Seed: NPASSFFSS (MAGC1_HUMAN)
NIASSFFSY

SEQ ID NO: 79688 - protein, 10 aa, Artificial Sequence
  Description of Artificial Sequence: Synthetic peptide
  Seed: SSPESAQSTF (MAGC1_HUMAN)
SQPESAQSTF

SEQ ID NO: 79689 - protein, 9 aa, Artificial Sequence
  Description of Artificial Sequence: Synthetic peptide
  Seed: LQIPMTSSF (MAGC1_HUMAN)
LEIPMTSSY

SEQ ID NO: 79690 - protein, 9 aa, Artificial Sequence
  Description of Artificial Sequence: Synthetic peptide
  Seed: IIDTTDDST (MAGC1_HUMAN)
ILDTTDDSF

SEQ ID NO: 79691 - protein, 11 aa, Artificial Sequence
  Description of Artificial Sequence: Synthetic peptide
  Seed: SPLQIPMTSSF (MAGC1_HUMAN)
SELQIPMTSSY

SEQ ID NO: 79692 - protein, 10 aa, Artificial Sequence
  Description of Artificial Sequence: Synthetic peptide
  Seed: SSFSSTLLSI (MAGC1_HUMAN)
SVFSSTLLSV

SEQ ID NO: 79693 - protein, 10 aa, Artificial Sequence
  Description of Artificial Sequence: Synthetic peptide
  Seed: GVRAGREHFA (MAGC1_HUMAN)
GMRAGREHFK

SEQ ID NO: 79694 - protein, 10 aa, Artificial Sequence
  Description of Artificial Sequence: Synthetic peptide
  Seed: NSSPPRYEFL (MAGC1_HUMAN)
NSSPPRYEFW

SEQ ID NO: 79695 - protein, 9 aa, Artificial Sequence
  Description of Artificial Sequence: Synthetic peptide
  Seed: SRYTGYFPV (MAGC1_HUMAN)
SMYTGYFPM

SEQ ID NO: 79696 - protein, 9 aa, Artificial Sequence
  Description of Artificial Sequence: Synthetic peptide
  Seed: STFEGFAQS (MAGC1_HUMAN)
STFEGFAQM

SEQ ID NO: 79697 - protein, 8 aa, Artificial Sequence
  Description of Artificial Sequence: Synthetic peptide
  Seed: FIEILFGI (MAGC1_HUMAN)
FQEILFGL

SEQ ID NO: 79698 - protein, 11 aa, Artificial Sequence
  Description of Artificial Sequence: Synthetic peptide
  Seed: SSFPSSTSSSL (MAGC1_HUMAN)
SMFPSSTSSSW

SEQ ID NO: 79699 - protein, 10 aa, Artificial Sequence
  Description of Artificial Sequence: Synthetic peptide
  Seed: YTGYFPVIFR (MAGC1_HUMAN)
YQGYFPVIFR

SEQ ID NO: 79700 - protein, 11 aa, Artificial Sequence
  Description of Artificial Sequence: Synthetic peptide
  Seed: REVDPDDSYVF (MAGC1_HUMAN)
RTVDPDDSYVY

SEQ ID NO: 79701 - protein, 10 aa, Artificial Sequence
  Description of Artificial Sequence: Synthetic peptide
  Seed: YTLDEKVDEL (MAGC1_HUMAN)
YVLDEKVDEL

SEQ ID NO: 79702 - protein, 9 aa, Artificial Sequence
  Description of Artificial Sequence: Synthetic peptide
  Seed: MTSSFSSTL (MAGC1_HUMAN)
MVSSFSSTW

SEQ ID NO: 79703 - protein, 9 aa, Artificial Sequence
  Description of Artificial Sequence: Synthetic peptide
  Seed: SQSPPEGPV (MAGC1_HUMAN)
SESPPEGPV

SEQ ID NO: 79704 - protein, 9 aa, Artificial Sequence
  Description of Artificial Sequence: Synthetic peptide
  Seed: SSSFSYTLL (MAGC1_HUMAN)
SASFSYTLW

SEQ ID NO: 79705 - protein, 9 aa, Artificial Sequence
  Description of Artificial Sequence: Synthetic peptide
  Seed: TTDDSTATE (MAGC1_HUMAN)
TGDDSTATV

SEQ ID NO: 79706 - protein, 10 aa, Artificial Sequence
  Description of Artificial Sequence: Synthetic peptide
  Seed: KVVEFLAMLK (MAGC1_HUMAN)
KAVEFLAMLR

SEQ ID NO: 79707 - protein, 9 aa, Artificial Sequence
  Description of Artificial Sequence: Synthetic peptide
  Seed: SPHYFPQSP (MAGC1_HUMAN)
SPHYFPQSF

SEQ ID NO: 79708 - protein, 9 aa, Artificial Sequence
  Description of Artificial Sequence: Synthetic peptide
  Seed: RPVSSFFSY (MAGC1_HUMAN)
RYVSSFFSY

SEQ ID NO: 79709 - protein, 9 aa, Artificial Sequence
  Description of Artificial Sequence: Synthetic peptide
  Seed: TLASLLQSS (MAGC1_HUMAN)
TSASLLQSV

SEQ ID NO: 79710 - protein, 9 aa, Artificial Sequence
  Description of Artificial Sequence: Synthetic peptide
  Seed: FPSSTSSSL (MAGC1_HUMAN)
FTSSTSSSF

SEQ ID NO: 79711 - protein, 10 aa, Artificial Sequence
  Description of Artificial Sequence: Synthetic peptide
  Seed: ISRYTGYFPV (MAGC1_HUMAN)
IFRYTGYFPI

SEQ ID NO: 79712 - protein, 11 aa, Artificial Sequence
  Description of Artificial Sequence: Synthetic peptide
  Seed: STFEGFPQSLL (MAGC1_HUMAN)
STFEGFPQSLF

SEQ ID NO: 79713 - protein, 11 aa, Artificial Sequence
  Description of Artificial Sequence: Synthetic peptide
  Seed: STFEGFPQSLL (MAGC1_HUMAN)
SLFEGFPQSLS

SEQ ID NO: 79714 - protein, 11 aa, Artificial Sequence
  Description of Artificial Sequence: Synthetic peptide
  Seed: FLAMLKNTVPI (MAGC1_HUMAN)
FGAMLKNTVPA

SEQ ID NO: 79715 - protein, 11 aa, Artificial Sequence
  Description of Artificial Sequence: Synthetic peptide
  Seed: KGTYASEEVIW (MAGC1_HUMAN)
KWTYASEEVIF

SEQ ID NO: 79716 - protein, 9 aa, Artificial Sequence
  Description of Artificial Sequence: Synthetic peptide
  Seed: SPLQSPVSS (MAGC1_HUMAN)
STLQSPVSI

SEQ ID NO: 79717 - protein, 11 aa, Artificial Sequence
  Description of Artificial Sequence: Synthetic peptide
  Seed: SQSSPEGKDSL (MAGC1_HUMAN)
SQSSPEGKDSY

SEQ ID NO: 79718 - protein, 10 aa, Artificial Sequence
  Description of Artificial Sequence: Synthetic peptide
  Seed: KVDELARFLL (MAGC1_HUMAN)
KQDELARFLW

SEQ ID NO: 79719 - protein, 9 aa, Artificial Sequence
  Description of Artificial Sequence: Synthetic peptide
  Seed: LQRPVSSFF (MAGC1_HUMAN)
LIRPVSSFA

SEQ ID NO: 79720 - protein, 9 aa, Artificial Sequence
  Description of Artificial Sequence: Synthetic peptide
  Seed: SSPERTHST (MAGC1_HUMAN)
SMPERTHSF

SEQ ID NO: 79721 - protein, 9 aa, Artificial Sequence
  Description of Artificial Sequence: Synthetic peptide
  Seed: GSPSFSSTL (MAGC1_HUMAN)
GAPSFSSTV

SEQ ID NO: 79722 - protein, 10 aa, Artificial Sequence
  Description of Artificial Sequence: Synthetic peptide
  Seed: SPLQIPQSPP (MAGC1_HUMAN)
SPLQIPQSPA

SEQ ID NO: 79723 - protein, 10 aa, Artificial Sequence
  Description of Artificial Sequence: Synthetic peptide
  Seed: EVIKRKVVEF (MAGC1_HUMAN)
ETIKRKVVEF

SEQ ID NO: 79724 - protein, 10 aa, Artificial Sequence
  Description of Artificial Sequence: Synthetic peptide
  Seed: MTSSFSSTLL (MAGC1_HUMAN)
MESSFSSTLM

SEQ ID NO: 79725 - protein, 9 aa, Artificial Sequence
  Description of Artificial Sequence: Synthetic peptide
  Seed: YQVKQPITK (MAGC1_HUMAN)
YFVKQPITF

SEQ ID NO: 79726 - protein, 9 aa, Artificial Sequence
  Description of Artificial Sequence: Synthetic peptide
  Seed: KDSQSPLQI (MAGC1_HUMAN)
KASQSPLQL

SEQ ID NO: 79727 - protein, 9 aa, Artificial Sequence
  Description of Artificial Sequence: Synthetic peptide
  Seed: SQSSPVSSF (MAGC1_HUMAN)
SISSPVSSW

SEQ ID NO: 79728 - protein, 11 aa, Artificial Sequence
  Description of Artificial Sequence: Synthetic peptide
  Seed: TLDEKVDELAR (MAGC1_HUMAN)
TADEKVDELAV

SEQ ID NO: 79729 - protein, 11 aa, Artificial Sequence
  Description of Artificial Sequence: Synthetic peptide
  Seed: KGTYASEEVIW (MAGC1_HUMAN)
KFTYASEEVIF

SEQ ID NO: 79730 - protein, 11 aa, Artificial Sequence
  Description of Artificial Sequence: Synthetic peptide
  Seed: IPQSPPEGENT (MAGC1_HUMAN)
IPQSPPEGENL

SEQ ID NO: 79731 - protein, 10 aa, Artificial Sequence
  Description of Artificial Sequence: Synthetic peptide
  Seed: LAMLKNTVPI (MAGC1_HUMAN)
LLMLKNTVPI

SEQ ID NO: 79732 - protein, 9 aa, Artificial Sequence
  Description of Artificial Sequence: Synthetic peptide
  Seed: LQIPVSSSS (MAGC1_HUMAN)
LCIPVSSSM

SEQ ID NO: 79733 - protein, 9 aa, Artificial Sequence
  Description of Artificial Sequence: Synthetic peptide
  Seed: KVDELARFL (MAGC1_HUMAN)
KVDELARFY

SEQ ID NO: 79734 - protein, 9 aa, Artificial Sequence
  Description of Artificial Sequence: Synthetic peptide
  Seed: IFQSSPESA (MAGC1_HUMAN)
IYQSSPESM

SEQ ID NO: 79735 - protein, 9 aa, Artificial Sequence
  Description of Artificial Sequence: Synthetic peptide
  Seed: MTSSFSSTL (MAGC1_HUMAN)
MYSSFSSTY

SEQ ID NO: 79736 - protein, 9 aa, Artificial Sequence
  Description of Artificial Sequence: Synthetic peptide
  Seed: VSPSSSSTL (MAGC1_HUMAN)
VPPSSSSTM

SEQ ID NO: 79737 - protein, 9 aa, Artificial Sequence
  Description of Artificial Sequence: Synthetic peptide
  Seed: TSLSLPQSF (MAGC1_HUMAN)
TALSLPQSL

SEQ ID NO: 79738 - protein, 10 aa, Artificial Sequence
  Description of Artificial Sequence: Synthetic peptide
  Seed: QIPVSSSFSY (MAGC1_HUMAN)
QSPVSSSFSY

SEQ ID NO: 79739 - protein, 8 aa, Artificial Sequence
  Description of Artificial Sequence: Synthetic peptide
  Seed: DSLSPLQI (MAGC1_HUMAN)
DALSPLQI

SEQ ID NO: 79740 - protein, 10 aa, Artificial Sequence
  Description of Artificial Sequence: Synthetic peptide
  Seed: SFPSSTSSSL (MAGC1_HUMAN)
SDPSSTSSSI

SEQ ID NO: 79741 - protein, 10 aa, Artificial Sequence
  Description of Artificial Sequence: Synthetic peptide
  Seed: FPQSVLQIPV (MAGC1_HUMAN)
FPQSVLQIPW

SEQ ID NO: 79742 - protein, 9 aa, Artificial Sequence
  Description of Artificial Sequence: Synthetic peptide
  Seed: SSSDTLLES (MAGC1_HUMAN)
SGSDTLLEF

SEQ ID NO: 79743 - protein, 10 aa, Artificial Sequence
  Description of Artificial Sequence: Synthetic peptide
  Seed: FFSYTLASLL (MAGC1_HUMAN)
FLSYTLASLD

SEQ ID NO: 79744 - protein, 10 aa, Artificial Sequence
  Description of Artificial Sequence: Synthetic peptide
  Seed: SRYTGYFPVI (MAGC1_HUMAN)
SPYTGYFPVL

SEQ ID NO: 79745 - protein, 9 aa, Artificial Sequence
  Description of Artificial Sequence: Synthetic peptide
  Seed: MGDKDMPTA (MAGC1_HUMAN)
MVDKDMPTV

SEQ ID NO: 79746 - protein, 10 aa, Artificial Sequence
  Description of Artificial Sequence: Synthetic peptide
  Seed: KAREFIEILF (MAGC1_HUMAN)
KLREFIEILY

SEQ ID NO: 79747 - protein, 9 aa, Artificial Sequence
  Description of Artificial Sequence: Synthetic peptide
  Seed: MGDKDMPTA (MAGC1_HUMAN)
MGDKDMPTV

SEQ ID NO: 79748 - protein, 10 aa, Artificial Sequence
  Description of Artificial Sequence: Synthetic peptide
  Seed: RAGREHFAFG (MAGC1_HUMAN)
RYGREHFAFM

SEQ ID NO: 79749 - protein, 9 aa, Artificial Sequence
  Description of Artificial Sequence: Synthetic peptide
  Seed: SSFFSSALL (MAGC1_HUMAN)
SIFFSSALY

SEQ ID NO: 79750 - protein, 9 aa, Artificial Sequence
  Description of Artificial Sequence: Synthetic peptide
  Seed: SFPSSTSSS (MAGC1_HUMAN)
SWPSSTSSY

SEQ ID NO: 79751 - protein, 9 aa, Artificial Sequence
  Description of Artificial Sequence: Synthetic peptide
  Seed: YVFVNTLDL (MAGC1_HUMAN)
YQFVNTLDY

SEQ ID NO: 79752 - protein, 10 aa, Artificial Sequence
  Description of Artificial Sequence: Synthetic peptide
  Seed: ICSSSTSLSL (MAGC1_HUMAN)
IKSSSTSLSM

SEQ ID NO: 79753 - protein, 9 aa, Artificial Sequence
  Description of Artificial Sequence: Synthetic peptide
  Seed: LQIPMTSSF (MAGC1_HUMAN)
LVIPMTSSL

SEQ ID NO: 79754 - protein, 9 aa, Artificial Sequence
  Description of Artificial Sequence: Synthetic peptide
  Seed: SFSSTLVSL (MAGC1_HUMAN)
SSSSTLVSF

SEQ ID NO: 79755 - protein, 9 aa, Artificial Sequence
  Description of Artificial Sequence: Synthetic peptide
  Seed: SICSSSTSL (MAGC1_HUMAN)
SGCSSSTSY

SEQ ID NO: 79756 - protein, 10 aa, Artificial Sequence
  Description of Artificial Sequence: Synthetic peptide
  Seed: FSSSTSLSPF (MAGC1_HUMAN)
FTSSTSLSPL

SEQ ID NO: 79757 - protein, 10 aa, Artificial Sequence
  Description of Artificial Sequence: Synthetic peptide
  Seed: SSPESAQSAF (MAGC1_HUMAN)
SGPESAQSAL

SEQ ID NO: 79758 - protein, 9 aa, Artificial Sequence
  Description of Artificial Sequence: Synthetic peptide
  Seed: RTQSTFEGF (MAGC1_HUMAN)
RFQSTFEGF

SEQ ID NO: 79759 - protein, 11 aa, Artificial Sequence
  Description of Artificial Sequence: Synthetic peptide
  Seed: SAASSSTLVSI (MAGC1_HUMAN)
STASSSTLVSY

SEQ ID NO: 79760 - protein, 9 aa, Artificial Sequence
  Description of Artificial Sequence: Synthetic peptide
  Seed: LQNPASSFF (MAGC1_HUMAN)
LQNPASSFM

SEQ ID NO: 79761 - protein, 11 aa, Artificial Sequence
  Description of Artificial Sequence: Synthetic peptide
  Seed: IIDTTDDSTAT (MAGC1_HUMAN)
ILDTTDDSTAM

SEQ ID NO: 79762 - protein, 10 aa, Artificial Sequence
  Description of Artificial Sequence: Synthetic peptide
  Seed: LQIPMTSSFS (MAGC1_HUMAN)
LMIPMTSSFE

SEQ ID NO: 79763 - protein, 8 aa, Artificial Sequence
  Description of Artificial Sequence: Synthetic peptide
  Seed: SSVMSPSF (MAGC1_HUMAN)
SMVMSPSF

SEQ ID NO: 79764 - protein, 9 aa, Artificial Sequence
  Description of Artificial Sequence: Synthetic peptide
  Seed: LQIVPSLPE (MAGC1_HUMAN)
LQIVPSLPM

SEQ ID NO: 79765 - protein, 9 aa, Artificial Sequence
  Description of Artificial Sequence: Synthetic peptide
  Seed: WVQEHYLEY (MAGC1_HUMAN)
WPQEHYLEM

SEQ ID NO: 79766 - protein, 9 aa, Artificial Sequence
  Description of Artificial Sequence: Synthetic peptide
  Seed: YVFVNTLDL (MAGC1_HUMAN)
YQFVNTLDM

SEQ ID NO: 79767 - protein, 11 aa, Artificial Sequence
  Description of Artificial Sequence: Synthetic peptide
  Seed: SPLQIPVSSSS (MAGC1_HUMAN)
SYLQIPVSSSF

SEQ ID NO: 79768 - protein, 9 aa, Artificial Sequence
  Description of Artificial Sequence: Synthetic peptide
  Seed: GSPSFSSTL (MAGC1_HUMAN)
GRPSFSSTY

SEQ ID NO: 79769 - protein, 9 aa, Artificial Sequence
  Description of Artificial Sequence: Synthetic peptide
  Seed: RSFSSTLLS (MAGC1_HUMAN)
RVFSSTLLA

SEQ ID NO: 79770 - protein, 9 aa, Artificial Sequence
  Description of Artificial Sequence: Synthetic peptide
  Seed: LQIPVSRSF (MAGC1_HUMAN)
LWIPVSRSI

SEQ ID NO: 79771 - protein, 9 aa, Artificial Sequence
  Description of Artificial Sequence: Synthetic peptide
  Seed: YQVKQPITK (MAGC1_HUMAN)
YAVKQPITL

SEQ ID NO: 79772 - protein, 10 aa, Artificial Sequence
  Description of Artificial Sequence: Synthetic peptide
  Seed: MLKNTVPITF (MAGC1_HUMAN)
MMKNTVPITM

SEQ ID NO: 79773 - protein, 10 aa, Artificial Sequence
  Description of Artificial Sequence: Synthetic peptide
  Seed: SFSYTLLSLF (MAGC1_HUMAN)
SQSYTLLSLW

SEQ ID NO: 79774 - protein, 9 aa, Artificial Sequence
  Description of Artificial Sequence: Synthetic peptide
  Seed: LSPLHFPQF (MAGC1_HUMAN)
LLPLHFPQL

SEQ ID NO: 79775 - protein, 9 aa, Artificial Sequence
  Description of Artificial Sequence: Synthetic peptide
  Seed: QFPPQGEDF (MAGC1_HUMAN)
QYPPQGEDM

SEQ ID NO: 79776 - protein, 9 aa, Artificial Sequence
  Description of Artificial Sequence: Synthetic peptide
  Seed: SFFSYTLAS (MAGC1_HUMAN)
SWFSYTLAM

SEQ ID NO: 79777 - protein, 10 aa, Artificial Sequence
  Description of Artificial Sequence: Synthetic peptide
  Seed: IPMTSSFSST (MAGC1_HUMAN)
IPMTSSFSSL

SEQ ID NO: 79778 - protein, 9 aa, Artificial Sequence
  Description of Artificial Sequence: Synthetic peptide
  Seed: TLLSLFQSF (MAGC1_HUMAN)
TYLSLFQSW

SEQ ID NO: 79779 - protein, 10 aa, Artificial Sequence
  Description of Artificial Sequence: Synthetic peptide
  Seed: SLQIPVSPSF (MAGC1_HUMAN)
SYQIPVSPSM

SEQ ID NO: 79780 - protein, 10 aa, Artificial Sequence
  Description of Artificial Sequence: Synthetic peptide
  Seed: SSPESAQSAF (MAGC1_HUMAN)
SFPESAQSAM

SEQ ID NO: 79781 - protein, 11 aa, Artificial Sequence
  Description of Artificial Sequence: Synthetic peptide
  Seed: REVPNSSPPRY (MAGC1_HUMAN)
REVPNSSPPRL

SEQ ID NO: 79782 - protein, 9 aa, Artificial Sequence
  Description of Artificial Sequence: Synthetic peptide
  Seed: SRYTGYFPV (MAGC1_HUMAN)
SVYTGYFPM

SEQ ID NO: 79783 - protein, 9 aa, Artificial Sequence
  Description of Artificial Sequence: Synthetic peptide
  Seed: TLDEKVDEL (MAGC1_HUMAN)
THDEKVDEL

SEQ ID NO: 79784 - protein, 9 aa, Artificial Sequence
  Description of Artificial Sequence: Synthetic peptide
  Seed: EFIEILFGI (MAGC1_HUMAN)
ETIEILFGG

SEQ ID NO: 79785 - protein, 10 aa, Artificial Sequence
  Description of Artificial Sequence: Synthetic peptide
  Seed: SRYTGYFPVI (MAGC1_HUMAN)
SAYTGYFPVF

SEQ ID NO: 79786 - protein, 9 aa, Artificial Sequence
  Description of Artificial Sequence: Synthetic peptide
  Seed: KVVEFLAML (MAGC1_HUMAN)
KVVEFLAMR

SEQ ID NO: 79787 - protein, 9 aa, Artificial Sequence
  Description of Artificial Sequence: Synthetic peptide
  Seed: KAREFIEIL (MAGC1_HUMAN)
KIREFIEIF

SEQ ID NO: 79788 - protein, 10 aa, Artificial Sequence
  Description of Artificial Sequence: Synthetic peptide
  Seed: TTDDSTATES (MAGC1_HUMAN)
TTDDSTATEY

SEQ ID NO: 79789 - protein, 10 aa, Artificial Sequence
  Description of Artificial Sequence: Synthetic peptide
  Seed: SSSSSTLLSL (MAGC1_HUMAN)
STSSSTLLSY

SEQ ID NO: 79790 - protein, 9 aa, Artificial Sequence
  Description of Artificial Sequence: Synthetic peptide
  Seed: SQSPPEGPV (MAGC1_HUMAN)
SASPPEGPA

SEQ ID NO: 79791 - protein, 9 aa, Artificial Sequence
  Description of Artificial Sequence: Synthetic peptide
  Seed: FFSSALLSI (MAGC1_HUMAN)
FISSALLSI

SEQ ID NO: 79792 - protein, 9 aa, Artificial Sequence
  Description of Artificial Sequence: Synthetic peptide
  Seed: SPPEGPVQS (MAGC1_HUMAN)
SAPEGPVQL

SEQ ID NO: 79793 - protein, 9 aa, Artificial Sequence
  Description of Artificial Sequence: Synthetic peptide
  Seed: SSPERTHST (MAGC1_HUMAN)
SLPERTHSF

SEQ ID NO: 79794 - protein, 10 aa, Artificial Sequence
  Description of Artificial Sequence: Synthetic peptide
  Seed: LQIPVSRSFS (MAGC1_HUMAN)
LQIPVSRSFC

SEQ ID NO: 79795 - protein, 10 aa, Artificial Sequence
  Description of Artificial Sequence: Synthetic peptide
  Seed: ILFGISLREV (MAGC1_HUMAN)
ILFGISLREI

SEQ ID NO: 79796 - protein, 9 aa, Artificial Sequence
  Description of Artificial Sequence: Synthetic peptide
  Seed: LQSPVISFS (MAGC1_HUMAN)
LVSPVISFI

SEQ ID NO: 79797 - protein, 9 aa, Artificial Sequence
  Description of Artificial Sequence: Synthetic peptide
  Seed: MPTAGMPSL (MAGC1_HUMAN)
MGTAGMPSY

SEQ ID NO: 79798 - protein, 9 aa, Artificial Sequence
  Description of Artificial Sequence: Synthetic peptide
  Seed: ISFSSSTSL (MAGC1_HUMAN)
IMFSSSTSG

SEQ ID NO: 79799 - protein, 9 aa, Artificial Sequence
  Description of Artificial Sequence: Synthetic peptide
  Seed: VSSSFSYTL (MAGC1_HUMAN)
VQSSFSYTF

SEQ ID NO: 79800 - protein, 9 aa, Artificial Sequence
  Description of Artificial Sequence: Synthetic peptide
  Seed: SSPERTQST (MAGC1_HUMAN)
SAPERTQSI

SEQ ID NO: 79801 - protein, 9 aa, Artificial Sequence
  Description of Artificial Sequence: Synthetic peptide
  Seed: RAHSEVIKR (MAGC1_HUMAN)
RMHSEVIKH

SEQ ID NO: 79802 - protein, 9 aa, Artificial Sequence
  Description of Artificial Sequence: Synthetic peptide
  Seed: KVDELARFL (MAGC1_HUMAN)
KVDELARFV

SEQ ID NO: 79803 - protein, 10 aa, Artificial Sequence
  Description of Artificial Sequence: Synthetic peptide
  Seed: MSQNRLLILI (MAGC1_HUMAN)
MSQNRLLILM

SEQ ID NO: 79804 - protein, 9 aa, Artificial Sequence
  Description of Artificial Sequence: Synthetic peptide
  Seed: MPTAGMPSL (MAGC1_HUMAN)
MMTAGMPSL

SEQ ID NO: 79805 - protein, 10 aa, Artificial Sequence
  Description of Artificial Sequence: Synthetic peptide
  Seed: SSPERTHSTF (MAGC1_HUMAN)
SIPERTHSTM

SEQ ID NO: 79806 - protein, 9 aa, Artificial Sequence
  Description of Artificial Sequence: Synthetic peptide
  Seed: SSPESPLQS (MAGC1_HUMAN)
SCPESPLQM

SEQ ID NO: 79807 - protein, 9 aa, Artificial Sequence
  Description of Artificial Sequence: Synthetic peptide
  Seed: VSPSFSSTL (MAGC1_HUMAN)
VAPSFSSTW

SEQ ID NO: 79808 - protein, 9 aa, Artificial Sequence
  Description of Artificial Sequence: Synthetic peptide
  Seed: FFSSALLSI (MAGC1_HUMAN)
FSSSALLSA

SEQ ID NO: 79809 - protein, 11 aa, Artificial Sequence
  Description of Artificial Sequence: Synthetic peptide
  Seed: SPLQIPVSPSS (MAGC1_HUMAN)
SQLQIPVSPSF

SEQ ID NO: 79810 - protein, 9 aa, Artificial Sequence
  Description of Artificial Sequence: Synthetic peptide
  Seed: IPVSPSFSS (MAGC1_HUMAN)
ITVSPSFSY

SEQ ID NO: 79811 - protein, 9 aa, Artificial Sequence
  Description of Artificial Sequence: Synthetic peptide
  Seed: SVLQIPVSA (MAGC1_HUMAN)
SMLQIPVSL

SEQ ID NO: 79812 - protein, 10 aa, Artificial Sequence
  Description of Artificial Sequence: Synthetic peptide
  Seed: KVVEFLAMLK (MAGC1_HUMAN)
KHVEFLAMLK

SEQ ID NO: 79813 - protein, 9 aa, Artificial Sequence
  Description of Artificial Sequence: Synthetic peptide
  Seed: YTGYFPVIF (MAGC1_HUMAN)
YGGYFPVIW

SEQ ID NO: 79814 - protein, 9 aa, Artificial Sequence
  Description of Artificial Sequence: Synthetic peptide
  Seed: SSTSSSLSK (MAGC1_HUMAN)
SSTSSSLSL

SEQ ID NO: 79815 - protein, 11 aa, Artificial Sequence
  Description of Artificial Sequence: Synthetic peptide
  Seed: SSFPSSTSSSL (MAGC1_HUMAN)
SNFPSSTSSSY

SEQ ID NO: 79816 - protein, 10 aa, Artificial Sequence
  Description of Artificial Sequence: Synthetic peptide
  Seed: REFIEILFGI (MAGC1_HUMAN)
RMFIEILFGC

SEQ ID NO: 79817 - protein, 9 aa, Artificial Sequence
  Description of Artificial Sequence: Synthetic peptide
  Seed: SAPEGEDSL (MAGC1_HUMAN)
STPEGEDSM

SEQ ID NO: 79818 - protein, 9 aa, Artificial Sequence
  Description of Artificial Sequence: Synthetic peptide
  Seed: FSSTLLSLF (MAGC1_HUMAN)
FFSTLLSLY

SEQ ID NO: 79819 - protein, 9 aa, Artificial Sequence
  Description of Artificial Sequence: Synthetic peptide
  Seed: SSSSTLLSL (MAGC1_HUMAN)
SMSSTLLSL

SEQ ID NO: 79820 - protein, 9 aa, Artificial Sequence
  Description of Artificial Sequence: Synthetic peptide
  Seed: RTHSTFEGF (MAGC1_HUMAN)
RWHSTFEGW

SEQ ID NO: 79821 - protein, 9 aa, Artificial Sequence
  Description of Artificial Sequence: Synthetic peptide
  Seed: LQSPVISFS (MAGC1_HUMAN)
LSSPVISFL

SEQ ID NO: 79822 - protein, 10 aa, Artificial Sequence
  Description of Artificial Sequence: Synthetic peptide
  Seed: VRAGREHFAF (MAGC1_HUMAN)
VQAGREHFAF

SEQ ID NO: 79823 - protein, 10 aa, Artificial Sequence
  Description of Artificial Sequence: Synthetic peptide
  Seed: YTLASLLQSS (MAGC1_HUMAN)
YMLASLLQSL

SEQ ID NO: 79824 - protein, 10 aa, Artificial Sequence
  Description of Artificial Sequence: Synthetic peptide
  Seed: HESPQSPPEG (MAGC1_HUMAN)
HESPQSPPEV

SEQ ID NO: 79825 - protein, 9 aa, Artificial Sequence
  Description of Artificial Sequence: Synthetic peptide
  Seed: SFSYTLLSL (MAGC1_HUMAN)
SWSYTLLSM

SEQ ID NO: 79826 - protein, 10 aa, Artificial Sequence
  Description of Artificial Sequence: Synthetic peptide
  Seed: AEMLTNVISR (MAGC1_HUMAN)
ATMLTNVISR

SEQ ID NO: 79827 - protein, 11 aa, Artificial Sequence
  Description of Artificial Sequence: Synthetic peptide
  Seed: FLAMLKNTVPI (MAGC1_HUMAN)
FWAMLKNTVPA

SEQ ID NO: 79828 - protein, 10 aa, Artificial Sequence
  Description of Artificial Sequence: Synthetic peptide
  Seed: SSFSYTLLSL (MAGC1_HUMAN)
SQFSYTLLSA

SEQ ID NO: 79829 - protein, 10 aa, Artificial Sequence
  Description of Artificial Sequence: Synthetic peptide
  Seed: LHFPQSPPEW (MAGC1_HUMAN)
LYFPQSPPEI

SEQ ID NO: 79830 - protein, 9 aa, Artificial Sequence
  Description of Artificial Sequence: Synthetic peptide
  Seed: RPVSSFFSY (MAGC1_HUMAN)
RRVSSFFSV

SEQ ID NO: 79831 - protein, 9 aa, Artificial Sequence
  Description of Artificial Sequence: Synthetic peptide
  Seed: FPSSTSSSL (MAGC1_HUMAN)
FYSSTSSSA

SEQ ID NO: 79832 - protein, 9 aa, Artificial Sequence
  Description of Artificial Sequence: Synthetic peptide
  Seed: TTDDSTATE (MAGC1_HUMAN)
TADDSTATC

SEQ ID NO: 79833 - protein, 10 aa, Artificial Sequence
  Description of Artificial Sequence: Synthetic peptide
  Seed: REVPNSSPPR (MAGC1_HUMAN)
RMVPNSSPPK

SEQ ID NO: 79834 - protein, 9 aa, Artificial Sequence
  Description of Artificial Sequence: Synthetic peptide
  Seed: RLLILILSI (MAGC1_HUMAN)
RALILILSI

SEQ ID NO: 79835 - protein, 9 aa, Artificial Sequence
  Description of Artificial Sequence: Synthetic peptide
  Seed: TKAEMLTNV (MAGC1_HUMAN)
THAEMLTNV

SEQ ID NO: 79836 - protein, 9 aa, Artificial Sequence
  Description of Artificial Sequence: Synthetic peptide
  Seed: NTVPITFPS (MAGC1_HUMAN)
NMVPITFPI

SEQ ID NO: 79837 - protein, 9 aa, Artificial Sequence
  Description of Artificial Sequence: Synthetic peptide
  Seed: VSSSSSSTL (MAGC1_HUMAN)
VASSSSSTW

SEQ ID NO: 79838 - protein, 9 aa, Artificial Sequence
  Description of Artificial Sequence: Synthetic peptide
  Seed: EDSQSPLQI (MAGC1_HUMAN)
EESQSPLQM

SEQ ID NO: 79839 - protein, 9 aa, Artificial Sequence
  Description of Artificial Sequence: Synthetic peptide
  Seed: MGDKDMPTA (MAGC1_HUMAN)
MADKDMPTV

SEQ ID NO: 79840 - protein, 9 aa, Artificial Sequence
  Description of Artificial Sequence: Synthetic peptide
  Seed: LKNTVPITF (MAGC1_HUMAN)
LVNTVPITY

SEQ ID NO: 79841 - protein, 10 aa, Artificial Sequence
  Description of Artificial Sequence: Synthetic peptide
  Seed: LQIVPSLPEW (MAGC1_HUMAN)
LGIVPSLPEY

SEQ ID NO: 79842 - protein, 9 aa, Artificial Sequence
  Description of Artificial Sequence: Synthetic peptide
  Seed: AQSPLQIPV (MAGC1_HUMAN)
AKSPLQIPF

SEQ ID NO: 79843 - protein, 9 aa, Artificial Sequence
  Description of Artificial Sequence: Synthetic peptide
  Seed: FSSTLVSLF (MAGC1_HUMAN)
FASTLVSLF

SEQ ID NO: 79844 - protein, 10 aa, Artificial Sequence
  Description of Artificial Sequence: Synthetic peptide
  Seed: SPVISFSSST (MAGC1_HUMAN)
SPVISFSSSF

SEQ ID NO: 79845 - protein, 9 aa, Artificial Sequence
  Description of Artificial Sequence: Synthetic peptide
  Seed: FSEESSSPV (MAGC1_HUMAN)
FSEESSSPF

SEQ ID NO: 79846 - protein, 9 aa, Artificial Sequence
  Description of Artificial Sequence: Synthetic peptide
  Seed: MGDKDMPTA (MAGC1_HUMAN)
MGDKDMPTL

SEQ ID NO: 79847 - protein, 11 aa, Artificial Sequence
  Description of Artificial Sequence: Synthetic peptide
  Seed: SLIESEPLFTY (MAGC1_HUMAN)
STIESEPLFTK

SEQ ID NO: 79848 - protein, 10 aa, Artificial Sequence
  Description of Artificial Sequence: Synthetic peptide
  Seed: FQSSLQSPVS (MAGC1_HUMAN)
FMSSLQSPVQ

SEQ ID NO: 79849 - protein, 9 aa, Artificial Sequence
  Description of Artificial Sequence: Synthetic peptide
  Seed: LILSIIFIK (MAGC1_HUMAN)
LSLSIIFIR

SEQ ID NO: 79850 - protein, 8 aa, Artificial Sequence
  Description of Artificial Sequence: Synthetic peptide
  Seed: RYTGYFPV (MAGC1_HUMAN)
RYTGYFPW

SEQ ID NO: 79851 - protein, 9 aa, Artificial Sequence
  Description of Artificial Sequence: Synthetic peptide
  Seed: LQIPVSRSF (MAGC1_HUMAN)
LIIPVSRSW

SEQ ID NO: 79852 - protein, 9 aa, Artificial Sequence
  Description of Artificial Sequence: Synthetic peptide
  Seed: TFEGFPQSL (MAGC1_HUMAN)
TWEGFPQSI

SEQ ID NO: 79853 - protein, 9 aa, Artificial Sequence
  Description of Artificial Sequence: Synthetic peptide
  Seed: MSQNRLLIL (MAGC1_HUMAN)
MLQNRLLIM

SEQ ID NO: 79854 - protein, 9 aa, Artificial Sequence
  Description of Artificial Sequence: Synthetic peptide
  Seed: CSSSTSLSL (MAGC1_HUMAN)
CMSSTSLSM

SEQ ID NO: 79855 - protein, 9 aa, Artificial Sequence
  Description of Artificial Sequence: Synthetic peptide
  Seed: CSSSTPSSL (MAGC1_HUMAN)
CRSSTPSSF

SEQ ID NO: 79856 - protein, 9 aa, Artificial Sequence
  Description of Artificial Sequence: Synthetic peptide
  Seed: GFPQSVLQI (MAGC1_HUMAN)
GRPQSVLQL

SEQ ID NO: 79857 - protein, 10 aa, Artificial Sequence
  Description of Artificial Sequence: Synthetic peptide
  Seed: SSFSSTLLSI (MAGC1_HUMAN)
SLFSSTLLST

SEQ ID NO: 79858 - protein, 9 aa, Artificial Sequence
  Description of Artificial Sequence: Synthetic peptide
  Seed: FTYTLDEKV (MAGC1_HUMAN)
FAYTLDEKL

SEQ ID NO: 79859 - protein, 9 aa, Artificial Sequence
  Description of Artificial Sequence: Synthetic peptide
  Seed: SSPERTHST (MAGC1_HUMAN)
SAPERTHSF

SEQ ID NO: 79860 - protein, 10 aa, Artificial Sequence
  Description of Artificial Sequence: Synthetic peptide
  Seed: SSPESTQSPF (MAGC1_HUMAN)
SCPESTQSPM

SEQ ID NO: 79861 - protein, 9 aa, Artificial Sequence
  Description of Artificial Sequence: Synthetic peptide
  Seed: EFIEILFGI (MAGC1_HUMAN)
EMIEILFGT

SEQ ID NO: 79862 - protein, 9 aa, Artificial Sequence
  Description of Artificial Sequence: Synthetic peptide
  Seed: AQSPLQSPV (MAGC1_HUMAN)
AVSPLQSPV

SEQ ID NO: 79863 - protein, 11 aa, Artificial Sequence
  Description of Artificial Sequence: Synthetic peptide
  Seed: ITFPSSYKDAL (MAGC1_HUMAN)
IAFPSSYKDAF

SEQ ID NO: 79864 - protein, 10 aa, Artificial Sequence
  Description of Artificial Sequence: Synthetic peptide
  Seed: SRYTGYFPVI (MAGC1_HUMAN)
SWYTGYFPVM

SEQ ID NO: 79865 - protein, 9 aa, Artificial Sequence
  Description of Artificial Sequence: Synthetic peptide
  Seed: FFSSALLSI (MAGC1_HUMAN)
FTSSALLSF

SEQ ID NO: 79866 - protein, 10 aa, Artificial Sequence
  Description of Artificial Sequence: Synthetic peptide
  Seed: STSLSLPQSF (MAGC1_HUMAN)
SRSLSLPQSW

SEQ ID NO: 79867 - protein, 10 aa, Artificial Sequence
  Description of Artificial Sequence: Synthetic peptide
  Seed: VISFSSSTSL (MAGC1_HUMAN)
VDSFSSSTSW

SEQ ID NO: 79868 - protein, 10 aa, Artificial Sequence
  Description of Artificial Sequence: Synthetic peptide
  Seed: SSPESTQSPF (MAGC1_HUMAN)
STPESTQSPM

SEQ ID NO: 79869 - protein, 10 aa, Artificial Sequence
  Description of Artificial Sequence: Synthetic peptide
  Seed: YTLASLLQSS (MAGC1_HUMAN)
YALASLLQSI

SEQ ID NO: 79870 - protein, 10 aa, Artificial Sequence
  Description of Artificial Sequence: Synthetic peptide
  Seed: SSPESTQSPF (MAGC1_HUMAN)
STPESTQSPL

SEQ ID NO: 79871 - protein, 9 aa, Artificial Sequence
  Description of Artificial Sequence: Synthetic peptide
  Seed: REVDPDDSY (MAGC1_HUMAN)
RRVDPDDSY

SEQ ID NO: 79872 - protein, 9 aa, Artificial Sequence
  Description of Artificial Sequence: Synthetic peptide
  Seed: SSFPSSTSS (MAGC1_HUMAN)
SAFPSSTSV

SEQ ID NO: 79873 - protein, 10 aa, Artificial Sequence
  Description of Artificial Sequence: Synthetic peptide
  Seed: YTLLSLFQSS (MAGC1_HUMAN)
YKLLSLFQSL

SEQ ID NO: 79874 - protein, 9 aa, Artificial Sequence
  Description of Artificial Sequence: Synthetic peptide
  Seed: RKAREFIEI (MAGC1_HUMAN)
RKAREFIEF

SEQ ID NO: 79875 - protein, 9 aa, Artificial Sequence
  Description of Artificial Sequence: Synthetic peptide
  Seed: FSSTLLSIL (MAGC1_HUMAN)
FTSTLLSIY

SEQ ID NO: 79876 - protein, 9 aa, Artificial Sequence
  Description of Artificial Sequence: Synthetic peptide
  Seed: SSSTLLSLF (MAGC1_HUMAN)
SHSTLLSLF

SEQ ID NO: 79877 - protein, 9 aa, Artificial Sequence
  Description of Artificial Sequence: Synthetic peptide
  Seed: IEILFGISL (MAGC1_HUMAN)
IIILFGISY

SEQ ID NO: 79878 - protein, 9 aa, Artificial Sequence
  Description of Artificial Sequence: Synthetic peptide
  Seed: CSSSTSLSL (MAGC1_HUMAN)
CTSSTSLSL

SEQ ID NO: 79879 - protein, 9 aa, Artificial Sequence
  Description of Artificial Sequence: Synthetic peptide
  Seed: SQSSPVSSF (MAGC1_HUMAN)
SVSSPVSSF

SEQ ID NO: 79880 - protein, 10 aa, Artificial Sequence
  Description of Artificial Sequence: Synthetic peptide
  Seed: GEEFQSSLQS (MAGC1_HUMAN)
GEEFQSSLQA

SEQ ID NO: 79881 - protein, 10 aa, Artificial Sequence
  Description of Artificial Sequence: Synthetic peptide
  Seed: QIPVSSSFSY (MAGC1_HUMAN)
QTPVSSSFSY

SEQ ID NO: 79882 - protein, 10 aa, Artificial Sequence
  Description of Artificial Sequence: Synthetic peptide
  Seed: SPLQRPVSSF (MAGC1_HUMAN)
SSLQRPVSSY

SEQ ID NO: 79883 - protein, 9 aa, Artificial Sequence
  Description of Artificial Sequence: Synthetic peptide
  Seed: LQNPASSFF (MAGC1_HUMAN)
LANPASSFV

SEQ ID NO: 79884 - protein, 10 aa, Artificial Sequence
  Description of Artificial Sequence: Synthetic peptide
  Seed: HSPQSPPEGM (MAGC1_HUMAN)
HMPQSPPEGL

SEQ ID NO: 79885 - protein, 10 aa, Artificial Sequence
  Description of Artificial Sequence: Synthetic peptide
  Seed: TTDDSTATES (MAGC1_HUMAN)
TFDDSTATEY

SEQ ID NO: 79886 - protein, 10 aa, Artificial Sequence
  Description of Artificial Sequence: Synthetic peptide
  Seed: FPSSTSSSLS (MAGC1_HUMAN)
FVSSTSSSLY

SEQ ID NO: 79887 - protein, 9 aa, Artificial Sequence
  Description of Artificial Sequence: Synthetic peptide
  Seed: RKVVEFLAM (MAGC1_HUMAN)
RRVVEFLAV

SEQ ID NO: 79888 - protein, 9 aa, Artificial Sequence
  Description of Artificial Sequence: Synthetic peptide
  Seed: AQSPLQRPV (MAGC1_HUMAN)
AQSPLQRPY

SEQ ID NO: 79889 - protein, 10 aa, Artificial Sequence
  Description of Artificial Sequence: Synthetic peptide
  Seed: SPLQSPVISF (MAGC1_HUMAN)
SQLQSPVISM

SEQ ID NO: 79890 - protein, 11 aa, Artificial Sequence
  Description of Artificial Sequence: Synthetic peptide
  Seed: QGEDSMSPLYF (MAGC1_HUMAN)
QTEDSMSPLYW

SEQ ID NO: 79891 - protein, 9 aa, Artificial Sequence
  Description of Artificial Sequence: Synthetic peptide
  Seed: VISRYTGYF (MAGC1_HUMAN)
VLSRYTGYF

SEQ ID NO: 79892 - protein, 9 aa, Artificial Sequence
  Description of Artificial Sequence: Synthetic peptide
  Seed: NPASSFFSS (MAGC1_HUMAN)
NAASSFFSA

SEQ ID NO: 79893 - protein, 9 aa, Artificial Sequence
  Description of Artificial Sequence: Synthetic peptide
  Seed: HFPQSPPEW (MAGC1_HUMAN)
HFPQSPPEY

SEQ ID NO: 79894 - protein, 9 aa, Artificial Sequence
  Description of Artificial Sequence: Synthetic peptide
  Seed: YTGYFPVIF (MAGC1_HUMAN)
YVGYFPVIM

SEQ ID NO: 79895 - protein, 9 aa, Artificial Sequence
  Description of Artificial Sequence: Synthetic peptide
  Seed: RYTGYFPVI (MAGC1_HUMAN)
RITGYFPVY

SEQ ID NO: 79896 - protein, 10 aa, Artificial Sequence
  Description of Artificial Sequence: Synthetic peptide
  Seed: KVVEFLAMLK (MAGC1_HUMAN)
KTVEFLAMLV

SEQ ID NO: 79897 - protein, 10 aa, Artificial Sequence
  Description of Artificial Sequence: Synthetic peptide
  Seed: ISRYTGYFPV (MAGC1_HUMAN)
IHRYTGYFPF

SEQ ID NO: 79898 - protein, 9 aa, Artificial Sequence
  Description of Artificial Sequence: Synthetic peptide
  Seed: RSFSSTLLS (MAGC1_HUMAN)
RIFSSTLLF

SEQ ID NO: 79899 - protein, 9 aa, Artificial Sequence
  Description of Artificial Sequence: Synthetic peptide
  Seed: SSFFSSALL (MAGC1_HUMAN)
SFFFSSALV

SEQ ID NO: 79900 - protein, 9 aa, Artificial Sequence
  Description of Artificial Sequence: Synthetic peptide
  Seed: TTDDSTATE (MAGC1_HUMAN)
TQDDSTATV

SEQ ID NO: 79901 - protein, 9 aa, Artificial Sequence
  Description of Artificial Sequence: Synthetic peptide
  Seed: TSLSLPQSF (MAGC1_HUMAN)
TWLSLPQSM

SEQ ID NO: 79902 - protein, 11 aa, Artificial Sequence
  Description of Artificial Sequence: Synthetic peptide
  Seed: SPLQIPVSSSS (MAGC1_HUMAN)
SPLQIPVSSSY

SEQ ID NO: 79903 - protein, 9 aa, Artificial Sequence
  Description of Artificial Sequence: Synthetic peptide
  Seed: SSSFSYTLL (MAGC1_HUMAN)
SMSFSYTLL

SEQ ID NO: 79904 - protein, 10 aa, Artificial Sequence
  Description of Artificial Sequence: Synthetic peptide
  Seed: MPTAGMPSLL (MAGC1_HUMAN)
MVTAGMPSLF

SEQ ID NO: 79905 - protein, 9 aa, Artificial Sequence
  Description of Artificial Sequence: Synthetic peptide
  Seed: RTHSTFEGF (MAGC1_HUMAN)
RTHSTFEGA

SEQ ID NO: 79906 - protein, 10 aa, Artificial Sequence
  Description of Artificial Sequence: Synthetic peptide
  Seed: REFIEILFGI (MAGC1_HUMAN)
RAFIEILFGV

SEQ ID NO: 79907 - protein, 10 aa, Artificial Sequence
  Description of Artificial Sequence: Synthetic peptide
  Seed: SPLHFPQFPP (MAGC1_HUMAN)
SPLHFPQFPA

SEQ ID NO: 79908 - protein, 9 aa, Artificial Sequence
  Description of Artificial Sequence: Synthetic peptide
  Seed: SSSTLLSLF (MAGC1_HUMAN)
SQSTLLSLL

SEQ ID NO: 79909 - protein, 10 aa, Artificial Sequence
  Description of Artificial Sequence: Synthetic peptide
  Seed: ESEPLFTYTL (MAGC1_HUMAN)
EAEPLFTYTV

SEQ ID NO: 79910 - protein, 9 aa, Artificial Sequence
  Description of Artificial Sequence: Synthetic peptide
  Seed: TLDLTSEGC (MAGC1_HUMAN)
TSDLTSEGV

SEQ ID NO: 79911 - protein, 10 aa, Artificial Sequence
  Description of Artificial Sequence: Synthetic peptide
  Seed: FPSSTSSSLS (MAGC1_HUMAN)
FPSSTSSSLI

SEQ ID NO: 79912 - protein, 9 aa, Artificial Sequence
  Description of Artificial Sequence: Synthetic peptide
  Seed: FEGFAQSSL (MAGC1_HUMAN)
FLGFAQSSY

SEQ ID NO: 79913 - protein, 9 aa, Artificial Sequence
  Description of Artificial Sequence: Synthetic peptide
  Seed: VSPSFSSTL (MAGC1_HUMAN)
VQPSFSSTL

SEQ ID NO: 79914 - protein, 9 aa, Artificial Sequence
  Description of Artificial Sequence: Synthetic peptide
  Seed: REVDPDDSY (MAGC1_HUMAN)
RVVDPDDSY

SEQ ID NO: 79915 - protein, 9 aa, Artificial Sequence
  Description of Artificial Sequence: Synthetic peptide
  Seed: FEGFAQSSL (MAGC1_HUMAN)
FQGFAQSSY

SEQ ID NO: 79916 - protein, 9 aa, Artificial Sequence
  Description of Artificial Sequence: Synthetic peptide
  Seed: SSPEGKDSL (MAGC1_HUMAN)
SRPEGKDSL

SEQ ID NO: 79917 - protein, 9 aa, Artificial Sequence
  Description of Artificial Sequence: Synthetic peptide
  Seed: SLPEWEDSL (MAGC1_HUMAN)
SFPEWEDSM

SEQ ID NO: 79918 - protein, 9 aa, Artificial Sequence
  Description of Artificial Sequence: Synthetic peptide
  Seed: FSYTLLSLF (MAGC1_HUMAN)
FAYTLLSLW

SEQ ID NO: 79919 - protein, 9 aa, Artificial Sequence
  Description of Artificial Sequence: Synthetic peptide
  Seed: SAQSAFEGF (MAGC1_HUMAN)
SMQSAFEGM

SEQ ID NO: 79920 - protein, 9 aa, Artificial Sequence
  Description of Artificial Sequence: Synthetic peptide
  Seed: AQSPLQSPV (MAGC1_HUMAN)
AASPLQSPI

SEQ ID NO: 79921 - protein, 11 aa, Artificial Sequence
  Description of Artificial Sequence: Synthetic peptide
  Seed: SPQSPPEGPAQ (MAGC1_HUMAN)
SPQSPPEGPAV

SEQ ID NO: 79922 - protein, 9 aa, Artificial Sequence
  Description of Artificial Sequence: Synthetic peptide
  Seed: LQSPVISFS (MAGC1_HUMAN)
LASPVISFL

SEQ ID NO: 79923 - protein, 9 aa, Artificial Sequence
  Description of Artificial Sequence: Synthetic peptide
  Seed: MLTNVISRY (MAGC1_HUMAN)
MITNVISRR

SEQ ID NO: 79924 - protein, 10 aa, Artificial Sequence
  Description of Artificial Sequence: Synthetic peptide
  Seed: ICSSSTSLSL (MAGC1_HUMAN)
IRSSSTSLSY

SEQ ID NO: 79925 - protein, 10 aa, Artificial Sequence
  Description of Artificial Sequence: Synthetic peptide
  Seed: MPTAGMPSLL (MAGC1_HUMAN)
MRTAGMPSLF

SEQ ID NO: 79926 - protein, 9 aa, Artificial Sequence
  Description of Artificial Sequence: Synthetic peptide
  Seed: ALLSIFQSS (MAGC1_HUMAN)
AILSIFQSA

SEQ ID NO: 79927 - protein, 9 aa, Artificial Sequence
  Description of Artificial Sequence: Synthetic peptide
  Seed: LKNTVPITF (MAGC1_HUMAN)
LANTVPITL

SEQ ID NO: 79928 - protein, 11 aa, Artificial Sequence
  Description of Artificial Sequence: Synthetic peptide
  Seed: SPQSPPEGPAQ (MAGC1_HUMAN)
SPQSPPEGPAL

SEQ ID NO: 79929 - protein, 9 aa, Artificial Sequence
  Description of Artificial Sequence: Synthetic peptide
  Seed: SSSESPQSC (MAGC1_HUMAN)
STSESPQSL

SEQ ID NO: 79930 - protein, 9 aa, Artificial Sequence
  Description of Artificial Sequence: Synthetic peptide
  Seed: SAPEGEDSL (MAGC1_HUMAN)
SYPEGEDSM

SEQ ID NO: 79931 - protein, 8 aa, Artificial Sequence
  Description of Artificial Sequence: Synthetic peptide
  Seed: AFGEPREL (MAGC1_HUMAN)
AVGEPREL

SEQ ID NO: 79932 - protein, 9 aa, Artificial Sequence
  Description of Artificial Sequence: Synthetic peptide
  Seed: FSYTLASLL (MAGC1_HUMAN)
FGYTLASLY

SEQ ID NO: 79933 - protein, 9 aa, Artificial Sequence
  Description of Artificial Sequence: Synthetic peptide
  Seed: GSPSFSSTL (MAGC1_HUMAN)
GMPSFSSTL

SEQ ID NO: 79934 - protein, 9 aa, Artificial Sequence
  Description of Artificial Sequence: Synthetic peptide
  Seed: AQSPLQIPV (MAGC1_HUMAN)
AISPLQIPY

SEQ ID NO: 79935 - protein, 9 aa, Artificial Sequence
  Description of Artificial Sequence: Synthetic peptide
  Seed: SQSSPVSSF (MAGC1_HUMAN)
SASSPVSSI

SEQ ID NO: 79936 - protein, 11 aa, Artificial Sequence
  Description of Artificial Sequence: Synthetic peptide
  Seed: SLIESEPLFTY (MAGC1_HUMAN)
SLIESEPLFTF

SEQ ID NO: 79937 - protein, 10 aa, Artificial Sequence
  Description of Artificial Sequence: Synthetic peptide
  Seed: VISFSSSTSL (MAGC1_HUMAN)
VYSFSSSTSM

SEQ ID NO: 79938 - protein, 9 aa, Artificial Sequence
  Description of Artificial Sequence: Synthetic peptide
  Seed: KVVEFLAML (MAGC1_HUMAN)
KLVEFLAMS

SEQ ID NO: 79939 - protein, 10 aa, Artificial Sequence
  Description of Artificial Sequence: Synthetic peptide
  Seed: YVFVNTLDLT (MAGC1_HUMAN)
YVFVNTLDLL

SEQ ID NO: 79940 - protein, 9 aa, Artificial Sequence
  Description of Artificial Sequence: Synthetic peptide
  Seed: FSERTQSTF (MAGC1_HUMAN)
FIERTQSTY

SEQ ID NO: 79941 - protein, 10 aa, Artificial Sequence
  Description of Artificial Sequence: Synthetic peptide
  Seed: SRYTGYFPVI (MAGC1_HUMAN)
SYYTGYFPVY

SEQ ID NO: 79942 - protein, 9 aa, Artificial Sequence
  Description of Artificial Sequence: Synthetic peptide
  Seed: KVVEFLAML (MAGC1_HUMAN)
KAVEFLAMI

SEQ ID NO: 79943 - protein, 10 aa, Artificial Sequence
  Description of Artificial Sequence: Synthetic peptide
  Seed: FPQSLLQIPM (MAGC1_HUMAN)
FFQSLLQIPV

SEQ ID NO: 79944 - protein, 10 aa, Artificial Sequence
  Description of Artificial Sequence: Synthetic peptide
  Seed: QRPVSSFFSY (MAGC1_HUMAN)
QSPVSSFFSY

SEQ ID NO: 79945 - protein, 10 aa, Artificial Sequence
  Description of Artificial Sequence: Synthetic peptide
  Seed: FFSYTLASLL (MAGC1_HUMAN)
FISYTLASLA

SEQ ID NO: 79946 - protein, 9 aa, Artificial Sequence
  Description of Artificial Sequence: Synthetic peptide
  Seed: FSSTLVSLF (MAGC1_HUMAN)
FISTLVSLW

SEQ ID NO: 79947 - protein, 9 aa, Artificial Sequence
  Description of Artificial Sequence: Synthetic peptide
  Seed: LQRPVSSFF (MAGC1_HUMAN)
LERPVSSFF

SEQ ID NO: 79948 - protein, 8 aa, Artificial Sequence
  Description of Artificial Sequence: Synthetic peptide
  Seed: SPLQSPVS (MAGC1_HUMAN)
SQLQSPVV

SEQ ID NO: 79949 - protein, 9 aa, Artificial Sequence
  Description of Artificial Sequence: Synthetic peptide
  Seed: LQIPVSSSS (MAGC1_HUMAN)
LMIPVSSSF

SEQ ID NO: 79950 - protein, 9 aa, Artificial Sequence
  Description of Artificial Sequence: Synthetic peptide
  Seed: YTLLSLFQS (MAGC1_HUMAN)
YVLLSLFQL

SEQ ID NO: 79951 - protein, 10 aa, Artificial Sequence
  Description of Artificial Sequence: Synthetic peptide
  Seed: LAMLKNTVPI (MAGC1_HUMAN)
LNMLKNTVPL

SEQ ID NO: 79952 - protein, 9 aa, Artificial Sequence
  Description of Artificial Sequence: Synthetic peptide
  Seed: YTLLSLFQS (MAGC1_HUMAN)
YALLSLFQA

SEQ ID NO: 79953 - protein, 10 aa, Artificial Sequence
  Description of Artificial Sequence: Synthetic peptide
  Seed: SFSSTLVSLF (MAGC1_HUMAN)
SYSSTLVSLL

SEQ ID NO: 79954 - protein, 9 aa, Artificial Sequence
  Description of Artificial Sequence: Synthetic peptide
  Seed: EILFGISLR (MAGC1_HUMAN)
ETLFGISLY

SEQ ID NO: 79955 - protein, 9 aa, Artificial Sequence
  Description of Artificial Sequence: Synthetic peptide
  Seed: LQIPVSRSF (MAGC1_HUMAN)
LTIPVSRSM

SEQ ID NO: 79956 - protein, 10 aa, Artificial Sequence
  Description of Artificial Sequence: Synthetic peptide
  Seed: FPQSLLQIPM (MAGC1_HUMAN)
FMQSLLQIPY

SEQ ID NO: 79957 - protein, 10 aa, Artificial Sequence
  Description of Artificial Sequence: Synthetic peptide
  Seed: SLQIPVSPSF (MAGC1_HUMAN)
SRQIPVSPSM

SEQ ID NO: 79958 - protein, 10 aa, Artificial Sequence
  Description of Artificial Sequence: Synthetic peptide
  Seed: FIEILFGISL (MAGC1_HUMAN)
FSEILFGISL

SEQ ID NO: 79959 - protein, 9 aa, Artificial Sequence
  Description of Artificial Sequence: Synthetic peptide
  Seed: RTQSTFEGF (MAGC1_HUMAN)
RSQSTFEGF

SEQ ID NO: 79960 - protein, 9 aa, Artificial Sequence
  Description of Artificial Sequence: Synthetic peptide
  Seed: LQSPVISFS (MAGC1_HUMAN)
LISPVISFI

SEQ ID NO: 79961 - protein, 11 aa, Artificial Sequence
  Description of Artificial Sequence: Synthetic peptide
  Seed: LQIPVSSSFSY (MAGC1_HUMAN)
LEIPVSSSFSF

SEQ ID NO: 79962 - protein, 9 aa, Artificial Sequence
  Description of Artificial Sequence: Synthetic peptide
  Seed: SPLQIPMTS (MAGC1_HUMAN)
SILQIPMTV

SEQ ID NO: 79963 - protein, 11 aa, Artificial Sequence
  Description of Artificial Sequence: Synthetic peptide
  Seed: RSFSSTLLSIF (MAGC1_HUMAN)
RRFSSTLLSIY

SEQ ID NO: 79964 - protein, 9 aa, Artificial Sequence
  Description of Artificial Sequence: Synthetic peptide
  Seed: VLSGIGVRA (MAGC1_HUMAN)
VISGIGVRV

SEQ ID NO: 79965 - protein, 10 aa, Artificial Sequence
  Description of Artificial Sequence: Synthetic peptide
  Seed: TGYFPVIFRK (MAGC1_HUMAN)
TTYFPVIFRY

SEQ ID NO: 79966 - protein, 10 aa, Artificial Sequence
  Description of Artificial Sequence: Synthetic peptide
  Seed: RAGREHFAFG (MAGC1_HUMAN)
RTGREHFAFA

SEQ ID NO: 79967 - protein, 9 aa, Artificial Sequence
  Description of Artificial Sequence: Synthetic peptide
  Seed: AMLKNTVPI (MAGC1_HUMAN)
AILKNTVPW

SEQ ID NO: 79968 - protein, 11 aa, Artificial Sequence
  Description of Artificial Sequence: Synthetic peptide
  Seed: FLAMLKNTVPI (MAGC1_HUMAN)
FVAMLKNTVPA

SEQ ID NO: 79969 - protein, 9 aa, Artificial Sequence
  Description of Artificial Sequence: Synthetic peptide
  Seed: SPLQNPASS (MAGC1_HUMAN)
SPLQNPASF

SEQ ID NO: 79970 - protein, 10 aa, Artificial Sequence
  Description of Artificial Sequence: Synthetic peptide
  Seed: VSSSSSSSTL (MAGC1_HUMAN)
VSSSSSSSTY

SEQ ID NO: 79971 - protein, 10 aa, Artificial Sequence
  Description of Artificial Sequence: Synthetic peptide
  Seed: LQIPVSPSFS (MAGC1_HUMAN)
LQIPVSPSFN

SEQ ID NO: 79972 - protein, 9 aa, Artificial Sequence
  Description of Artificial Sequence: Synthetic peptide
  Seed: KDSQSPLQI (MAGC1_HUMAN)
KESQSPLQI

SEQ ID NO: 79973 - protein, 9 aa, Artificial Sequence
  Description of Artificial Sequence: Synthetic peptide
  Seed: ISFSSSTSL (MAGC1_HUMAN)
IGFSSSTSL

SEQ ID NO: 79974 - protein, 9 aa, Artificial Sequence
  Description of Artificial Sequence: Synthetic peptide
  Seed: SAPEGEDSL (MAGC1_HUMAN)
SMPEGEDSY

SEQ ID NO: 79975 - protein, 10 aa, Artificial Sequence
  Description of Artificial Sequence: Synthetic peptide
  Seed: YTLLSLFQSS (MAGC1_HUMAN)
YILLSLFQSA

SEQ ID NO: 79976 - protein, 9 aa, Artificial Sequence
  Description of Artificial Sequence: Synthetic peptide
  Seed: RKVVEFLAM (MAGC1_HUMAN)
RQVVEFLAV

SEQ ID NO: 79977 - protein, 10 aa, Artificial Sequence
  Description of Artificial Sequence: Synthetic peptide
  Seed: LLQIPMTSSF (MAGC1_HUMAN)
LPQIPMTSSY

SEQ ID NO: 79978 - protein, 9 aa, Artificial Sequence
  Description of Artificial Sequence: Synthetic peptide
  Seed: KVVEFLAML (MAGC1_HUMAN)
KAVEFLAMM

SEQ ID NO: 79979 - protein, 10 aa, Artificial Sequence
  Description of Artificial Sequence: Synthetic peptide
  Seed: FQSSLQSPVS (MAGC1_HUMAN)
FMSSLQSPVE

SEQ ID NO: 79980 - protein, 10 aa, Artificial Sequence
  Description of Artificial Sequence: Synthetic peptide
  Seed: STSLSLPQSF (MAGC1_HUMAN)
SASLSLPQSW

SEQ ID NO: 79981 - protein, 10 aa, Artificial Sequence
  Description of Artificial Sequence: Synthetic peptide
  Seed: RSFSSTLLSI (MAGC1_HUMAN)
RLFSSTLLSM

SEQ ID NO: 79982 - protein, 10 aa, Artificial Sequence
  Description of Artificial Sequence: Synthetic peptide
  Seed: SFPSSTSSSL (MAGC1_HUMAN)
SHPSSTSSSM

SEQ ID NO: 79983 - protein, 10 aa, Artificial Sequence
  Description of Artificial Sequence: Synthetic peptide
  Seed: LQIPVSRSFS (MAGC1_HUMAN)
LQIPVSRSFL

SEQ ID NO: 79984 - protein, 9 aa, Artificial Sequence
  Description of Artificial Sequence: Synthetic peptide
  Seed: FAFGEPREL (MAGC1_HUMAN)
FLFGEPREI

SEQ ID NO: 79985 - protein, 10 aa, Artificial Sequence
  Description of Artificial Sequence: Synthetic peptide
  Seed: KGTYASEEVI (MAGC1_HUMAN)
KPTYASEEVY

SEQ ID NO: 79986 - protein, 11 aa, Artificial Sequence
  Description of Artificial Sequence: Synthetic peptide
  Seed: QSSPESAQSAF (MAGC1_HUMAN)
QMSPESAQSAF

SEQ ID NO: 79987 - protein, 9 aa, Artificial Sequence
  Description of Artificial Sequence: Synthetic peptide
  Seed: MSQNRLLIL (MAGC1_HUMAN)
MYQNRLLIF

SEQ ID NO: 79988 - protein, 9 aa, Artificial Sequence
  Description of Artificial Sequence: Synthetic peptide
  Seed: STQSPFEGF (MAGC1_HUMAN)
SYQSPFEGM

SEQ ID NO: 79989 - protein, 10 aa, Artificial Sequence
  Description of Artificial Sequence: Synthetic peptide
  Seed: VSPSFSSTLV (MAGC1_HUMAN)
VVPSFSSTLL

SEQ ID NO: 79990 - protein, 10 aa, Artificial Sequence
  Description of Artificial Sequence: Synthetic peptide
  Seed: VSAASSSTLV (MAGC1_HUMAN)
VMAASSSTLI

SEQ ID NO: 79991 - protein, 9 aa, Artificial Sequence
  Description of Artificial Sequence: Synthetic peptide
  Seed: RTQSTFEGF (MAGC1_HUMAN)
RVQSTFEGK

SEQ ID NO: 79992 - protein, 9 aa, Artificial Sequence
  Description of Artificial Sequence: Synthetic peptide
  Seed: MTSSFSSTL (MAGC1_HUMAN)
MWSSFSSTV

SEQ ID NO: 79993 - protein, 11 aa, Artificial Sequence
  Description of Artificial Sequence: Synthetic peptide
  Seed: SPLQIPVSSSS (MAGC1_HUMAN)
SILQIPVSSSY

SEQ ID NO: 79994 - protein, 9 aa, Artificial Sequence
  Description of Artificial Sequence: Synthetic peptide
  Seed: LSDEQGMSQ (MAGC1_HUMAN)
LSDEQGMSV

SEQ ID NO: 79995 - protein, 9 aa, Artificial Sequence
  Description of Artificial Sequence: Synthetic peptide
  Seed: LQNPASSFF (MAGC1_HUMAN)
LLNPASSFV

SEQ ID NO: 79996 - protein, 9 aa, Artificial Sequence
  Description of Artificial Sequence: Synthetic peptide
  Seed: LQIVPSLPE (MAGC1_HUMAN)
LMIVPSLPY

SEQ ID NO: 79997 - protein, 9 aa, Artificial Sequence
  Description of Artificial Sequence: Synthetic peptide
  Seed: SSSTSLSPF (MAGC1_HUMAN)
SYSTSLSPI

SEQ ID NO: 79998 - protein, 9 aa, Artificial Sequence
  Description of Artificial Sequence: Synthetic peptide
  Seed: SSFFSSALL (MAGC1_HUMAN)
SAFFSSALF

SEQ ID NO: 79999 - protein, 9 aa, Artificial Sequence
  Description of Artificial Sequence: Synthetic peptide
  Seed: TLLSLFQSF (MAGC1_HUMAN)
TWLSLFQSY

SEQ ID NO: 80000 - protein, 9 aa, Artificial Sequence
  Description of Artificial Sequence: Synthetic peptide
  Seed: YVFVNTLDL (MAGC1_HUMAN)
YSFVNTLDL

SEQ ID NO: 80001 - protein, 9 aa, Artificial Sequence
  Description of Artificial Sequence: Synthetic peptide
  Seed: SASSSVMSP (MAGC1_HUMAN)
STSSSVMSL

SEQ ID NO: 80002 - protein, 10 aa, Artificial Sequence
  Description of Artificial Sequence: Synthetic peptide
  Seed: WGPRAHSEVI (MAGC1_HUMAN)
WVPRAHSEVM

SEQ ID NO: 80003 - protein, 9 aa, Artificial Sequence
  Description of Artificial Sequence: Synthetic peptide
  Seed: REVDPDDSY (MAGC1_HUMAN)
RLVDPDDSM

SEQ ID NO: 80004 - protein, 11 aa, Artificial Sequence
  Description of Artificial Sequence: Synthetic peptide
  Seed: FQSSLQSPVSI (MAGC1_HUMAN)
FQSSLQSPVSF

SEQ ID NO: 80005 - protein, 11 aa, Artificial Sequence
  Description of Artificial Sequence: Synthetic peptide
  Seed: STFEGFAQSSL (MAGC1_HUMAN)
SSFEGFAQSSW

SEQ ID NO: 80006 - protein, 11 aa, Artificial Sequence
  Description of Artificial Sequence: Synthetic peptide
  Seed: STFEGFPQSLL (MAGC1_HUMAN)
SSFEGFPQSLM

SEQ ID NO: 80007 - protein, 9 aa, Artificial Sequence
  Description of Artificial Sequence: Synthetic peptide
  Seed: SSHESPQSP (MAGC1_HUMAN)
SVHESPQSI

SEQ ID NO: 80008 - protein, 9 aa, Artificial Sequence
  Description of Artificial Sequence: Synthetic peptide
  Seed: VSAASSSTL (MAGC1_HUMAN)
VEAASSSTM

SEQ ID NO: 80009 - protein, 9 aa, Artificial Sequence
  Description of Artificial Sequence: Synthetic peptide
  Seed: SRYTGYFPV (MAGC1_HUMAN)
SQYTGYFPW

SEQ ID NO: 80010 - protein, 10 aa, Artificial Sequence
  Description of Artificial Sequence: Synthetic peptide
  Seed: SSSSSSSTLL (MAGC1_HUMAN)
SVSSSSSTLW

SEQ ID NO: 80011 - protein, 9 aa, Artificial Sequence
  Description of Artificial Sequence: Synthetic peptide
  Seed: FAFGEPREL (MAGC1_HUMAN)
FEFGEPREY

SEQ ID NO: 80012 - protein, 9 aa, Artificial Sequence
  Description of Artificial Sequence: Synthetic peptide
  Seed: VSPSSSSTL (MAGC1_HUMAN)
VSPSSSSTF

SEQ ID NO: 80013 - protein, 9 aa, Artificial Sequence
  Description of Artificial Sequence: Synthetic peptide
  Seed: RTHSTFEGF (MAGC1_HUMAN)
RAHSTFEGF

SEQ ID NO: 80014 - protein, 9 aa, Artificial Sequence
  Description of Artificial Sequence: Synthetic peptide
  Seed: SSPESAQSA (MAGC1_HUMAN)
SIPESAQSV

SEQ ID NO: 80015 - protein, 9 aa, Artificial Sequence
  Description of Artificial Sequence: Synthetic peptide
  Seed: FSSTLLSLF (MAGC1_HUMAN)
FPSTLLSLA

SEQ ID NO: 80016 - protein, 9 aa, Artificial Sequence
  Description of Artificial Sequence: Synthetic peptide
  Seed: SRSFSSTLL (MAGC1_HUMAN)
SHSFSSTLV

SEQ ID NO: 80017 - protein, 9 aa, Artificial Sequence
  Description of Artificial Sequence: Synthetic peptide
  Seed: VIKRKVVEF (MAGC1_HUMAN)
VAKRKVVEM

SEQ ID NO: 80018 - protein, 9 aa, Artificial Sequence
  Description of Artificial Sequence: Synthetic peptide
  Seed: SFSYTLLSL (MAGC1_HUMAN)
SRSYTLLSY

SEQ ID NO: 80019 - protein, 10 aa, Artificial Sequence
  Description of Artificial Sequence: Synthetic peptide
  Seed: SFFSYTLASL (MAGC1_HUMAN)
SFFSYTLASM

SEQ ID NO: 80020 - protein, 9 aa, Artificial Sequence
  Description of Artificial Sequence: Synthetic peptide
  Seed: LQSPVISFS (MAGC1_HUMAN)
LVSPVISFL

SEQ ID NO: 80021 - protein, 8 aa, Artificial Sequence
  Description of Artificial Sequence: Synthetic peptide
  Seed: LQNPASSF (MAGC1_HUMAN)
LANPASSF

SEQ ID NO: 80022 - protein, 10 aa, Artificial Sequence
  Description of Artificial Sequence: Synthetic peptide
  Seed: FAFGEPRELL (MAGC1_HUMAN)
FTFGEPRELV

SEQ ID NO: 80023 - protein, 9 aa, Artificial Sequence
  Description of Artificial Sequence: Synthetic peptide
  Seed: KVDELARFL (MAGC1_HUMAN)
KRDELARFY

SEQ ID NO: 80024 - protein, 9 aa, Artificial Sequence
  Description of Artificial Sequence: Synthetic peptide
  Seed: LQIPVSSSS (MAGC1_HUMAN)
LIIPVSSSM

SEQ ID NO: 80025 - protein, 9 aa, Artificial Sequence
  Description of Artificial Sequence: Synthetic peptide
  Seed: IESEPLFTY (MAGC1_HUMAN)
IESEPLFTV

SEQ ID NO: 80026 - protein, 11 aa, Artificial Sequence
  Description of Artificial Sequence: Synthetic peptide
  Seed: IPVSSSSSSST (MAGC1_HUMAN)
IPVSSSSSSSA

SEQ ID NO: 80027 - protein, 9 aa, Artificial Sequence
  Description of Artificial Sequence: Synthetic peptide
  Seed: YVFVNTLDL (MAGC1_HUMAN)
YTFVNTLDM

SEQ ID NO: 80028 - protein, 11 aa, Artificial Sequence
  Description of Artificial Sequence: Synthetic peptide
  Seed: IPVSSSSSSTL (MAGC1_HUMAN)
IVVSSSSSSTW

SEQ ID NO: 80029 - protein, 9 aa, Artificial Sequence
  Description of Artificial Sequence: Synthetic peptide
  Seed: VPITFPSSY (MAGC1_HUMAN)
VLITFPSSF

SEQ ID NO: 80030 - protein, 9 aa, Artificial Sequence
  Description of Artificial Sequence: Synthetic peptide
  Seed: LQIPVSSSS (MAGC1_HUMAN)
LFIPVSSSW

SEQ ID NO: 80031 - protein, 10 aa, Artificial Sequence
  Description of Artificial Sequence: Synthetic peptide
  Seed: GSPSFSSTLL (MAGC1_HUMAN)
GAPSFSSTLY

SEQ ID NO: 80032 - protein, 11 aa, Artificial Sequence
  Description of Artificial Sequence: Synthetic peptide
  Seed: SSFPSSTSSSL (MAGC1_HUMAN)
SIFPSSTSSSH

SEQ ID NO: 80033 - protein, 10 aa, Artificial Sequence
  Description of Artificial Sequence: Synthetic peptide
  Seed: GEDSSDPLQR (MAGC1_HUMAN)
GTDSSDPLQY

SEQ ID NO: 80034 - protein, 11 aa, Artificial Sequence
  Description of Artificial Sequence: Synthetic peptide
  Seed: FPQSPLQGEEF (MAGC1_HUMAN)
FPQSPLQGEEY

SEQ ID NO: 80035 - protein, 10 aa, Artificial Sequence
  Description of Artificial Sequence: Synthetic peptide
  Seed: SFSSTLVSLF (MAGC1_HUMAN)
SVSSTLVSLW

SEQ ID NO: 80036 - protein, 9 aa, Artificial Sequence
  Description of Artificial Sequence: Synthetic peptide
  Seed: GFPQSLLQI (MAGC1_HUMAN)
GFPQSLLQL

SEQ ID NO: 80037 - protein, 11 aa, Artificial Sequence
  Description of Artificial Sequence: Synthetic peptide
  Seed: SPSFSSTLVSL (MAGC1_HUMAN)
SPSFSSTLVSY

SEQ ID NO: 80038 - protein, 9 aa, Artificial Sequence
  Description of Artificial Sequence: Synthetic peptide
  Seed: SLIESEPLF (MAGC1_HUMAN)
SMIESEPLW

SEQ ID NO: 80039 - protein, 9 aa, Artificial Sequence
  Description of Artificial Sequence: Synthetic peptide
  Seed: SSPESTQSP (MAGC1_HUMAN)
SFPESTQSL

SEQ ID NO: 80040 - protein, 9 aa, Artificial Sequence
  Description of Artificial Sequence: Synthetic peptide
  Seed: AREFIEILF (MAGC1_HUMAN)
AHEFIEILI

SEQ ID NO: 80041 - protein, 10 aa, Artificial Sequence
  Description of Artificial Sequence: Synthetic peptide
  Seed: GPAQSPLQSP (MAGC1_HUMAN)
GPAQSPLQSM

SEQ ID NO: 80042 - protein, 9 aa, Artificial Sequence
  Description of Artificial Sequence: Synthetic peptide
  Seed: FAFGEPREL (MAGC1_HUMAN)
FVFGEPREW

SEQ ID NO: 80043 - protein, 9 aa, Artificial Sequence
  Description of Artificial Sequence: Synthetic peptide
  Seed: DSYVFVNTL (MAGC1_HUMAN)
DQYVFVNTV

SEQ ID NO: 80044 - protein, 9 aa, Artificial Sequence
  Description of Artificial Sequence: Synthetic peptide
  Seed: MTSSFSSTL (MAGC1_HUMAN)
MASSFSSTI

SEQ ID NO: 80045 - protein, 9 aa, Artificial Sequence
  Description of Artificial Sequence: Synthetic peptide
  Seed: VSSSSSSTL (MAGC1_HUMAN)
VLSSSSSTM

SEQ ID NO: 80046 - protein, 9 aa, Artificial Sequence
  Description of Artificial Sequence: Synthetic peptide
  Seed: TLDEKVDEL (MAGC1_HUMAN)
TPDEKVDEM

SEQ ID NO: 80047 - protein, 9 aa, Artificial Sequence
  Description of Artificial Sequence: Synthetic peptide
  Seed: ASSSVMSPS (MAGC1_HUMAN)
AVSSVMSPK

SEQ ID NO: 80048 - protein, 9 aa, Artificial Sequence
  Description of Artificial Sequence: Synthetic peptide
  Seed: FFSSALLSI (MAGC1_HUMAN)
FSSSALLSM

SEQ ID NO: 80049 - protein, 10 aa, Artificial Sequence
  Description of Artificial Sequence: Synthetic peptide
  Seed: ICSSSTPSSL (MAGC1_HUMAN)
IISSSTPSSW

SEQ ID NO: 80050 - protein, 9 aa, Artificial Sequence
  Description of Artificial Sequence: Synthetic peptide
  Seed: SAQSTFEGF (MAGC1_HUMAN)
SFQSTFEGY

SEQ ID NO: 80051 - protein, 9 aa, Artificial Sequence
  Description of Artificial Sequence: Synthetic peptide
  Seed: TGYFPVIFR (MAGC1_HUMAN)
TTYFPVIFK

SEQ ID NO: 80052 - protein, 10 aa, Artificial Sequence
  Description of Artificial Sequence: Synthetic peptide
  Seed: SSFSSTLLSI (MAGC1_HUMAN)
SLFSSTLLSL

SEQ ID NO: 80053 - protein, 10 aa, Artificial Sequence
  Description of Artificial Sequence: Synthetic peptide
  Seed: SFSSTLLSIL (MAGC1_HUMAN)
SQSSTLLSIF

SEQ ID NO: 80054 - protein, 11 aa, Artificial Sequence
  Description of Artificial Sequence: Synthetic peptide
  Seed: SPLQIPVSRSF (MAGC1_HUMAN)
STLQIPVSRSF

SEQ ID NO: 80055 - protein, 9 aa, Artificial Sequence
  Description of Artificial Sequence: Synthetic peptide
  Seed: FFSYTLASL (MAGC1_HUMAN)
FSSYTLASL

SEQ ID NO: 80056 - protein, 9 aa, Artificial Sequence
  Description of Artificial Sequence: Synthetic peptide
  Seed: SIIFIKGTY (MAGC1_HUMAN)
SKIFIKGTY

SEQ ID NO: 80057 - protein, 9 aa, Artificial Sequence
  Description of Artificial Sequence: Synthetic peptide
  Seed: FSYTLLSLF (MAGC1_HUMAN)
FPYTLLSLM

SEQ ID NO: 80058 - protein, 9 aa, Artificial Sequence
  Description of Artificial Sequence: Synthetic peptide
  Seed: SFPSSTSSS (MAGC1_HUMAN)
SFPSSTSSI

SEQ ID NO: 80059 - protein, 9 aa, Artificial Sequence
  Description of Artificial Sequence: Synthetic peptide
  Seed: FSEESSSPV (MAGC1_HUMAN)
FFEESSSPL

SEQ ID NO: 80060 - protein, 10 aa, Artificial Sequence
  Description of Artificial Sequence: Synthetic peptide
  Seed: LAMLKNTVPI (MAGC1_HUMAN)
LVMLKNTVPI

SEQ ID NO: 80061 - protein, 9 aa, Artificial Sequence
  Description of Artificial Sequence: Synthetic peptide
  Seed: VSPSFSSTL (MAGC1_HUMAN)
VMPSFSSTF

SEQ ID NO: 80062 - protein, 9 aa, Artificial Sequence
  Description of Artificial Sequence: Synthetic peptide
  Seed: FSEESSSPV (MAGC1_HUMAN)
FIEESSSPI

SEQ ID NO: 80063 - protein, 9 aa, Artificial Sequence
  Description of Artificial Sequence: Synthetic peptide
  Seed: KVVEFLAML (MAGC1_HUMAN)
KMVEFLAMS

SEQ ID NO: 80064 - protein, 9 aa, Artificial Sequence
  Description of Artificial Sequence: Synthetic peptide
  Seed: ALKDVEERA (MAGC1_HUMAN)
ALKDVEERL

SEQ ID NO: 80065 - protein, 10 aa, Artificial Sequence
  Description of Artificial Sequence: Synthetic peptide
  Seed: SSFSYTLLSL (MAGC1_HUMAN)
SMFSYTLLSM

SEQ ID NO: 80066 - protein, 11 aa, Artificial Sequence
  Description of Artificial Sequence: Synthetic peptide
  Seed: RPVSSFFSYTL (MAGC1_HUMAN)
RIVSSFFSYTM

SEQ ID NO: 80067 - protein, 10 aa, Artificial Sequence
  Description of Artificial Sequence: Synthetic peptide
  Seed: EGPAQSPLQR (MAGC1_HUMAN)
EYPAQSPLQR

SEQ ID NO: 80068 - protein, 9 aa, Artificial Sequence
  Description of Artificial Sequence: Synthetic peptide
  Seed: LQIPVSSSS (MAGC1_HUMAN)
LVIPVSSSM

SEQ ID NO: 80069 - protein, 9 aa, Artificial Sequence
  Description of Artificial Sequence: Synthetic peptide
  Seed: SPLQSPVSS (MAGC1_HUMAN)
SPLQSPVSC

SEQ ID NO: 80070 - protein, 10 aa, Artificial Sequence
  Description of Artificial Sequence: Synthetic peptide
  Seed: VSICSSSTSL (MAGC1_HUMAN)
VLICSSSTSF

SEQ ID NO: 80071 - protein, 11 aa, Artificial Sequence
  Description of Artificial Sequence: Synthetic peptide
  Seed: STFEGFAQSSL (MAGC1_HUMAN)
SMFEGFAQSSA

SEQ ID NO: 80072 - protein, 9 aa, Artificial Sequence
  Description of Artificial Sequence: Synthetic peptide
  Seed: YTLLSLFQS (MAGC1_HUMAN)
YILLSLFQL

SEQ ID NO: 80073 - protein, 9 aa, Artificial Sequence
  Description of Artificial Sequence: Synthetic peptide
  Seed: VQSPLQNPA (MAGC1_HUMAN)
VASPLQNPV

SEQ ID NO: 80074 - protein, 10 aa, Artificial Sequence
  Description of Artificial Sequence: Synthetic peptide
  Seed: ICSSSTSLSL (MAGC1_HUMAN)
IMSSSTSLSM

SEQ ID NO: 80075 - protein, 9 aa, Artificial Sequence
  Description of Artificial Sequence: Synthetic peptide
  Seed: EDSLSPLHF (MAGC1_HUMAN)
EESLSPLHL

SEQ ID NO: 80076 - protein, 9 aa, Artificial Sequence
  Description of Artificial Sequence: Synthetic peptide
  Seed: GSPSFSSTL (MAGC1_HUMAN)
GWPSFSSTF

SEQ ID NO: 80077 - protein, 9 aa, Artificial Sequence
  Description of Artificial Sequence: Synthetic peptide
  Seed: FAFGEPREL (MAGC1_HUMAN)
FMFGEPREA

SEQ ID NO: 80078 - protein, 10 aa, Artificial Sequence
  Description of Artificial Sequence: Synthetic peptide
  Seed: ASSFFSSALL (MAGC1_HUMAN)
AVSFFSSALM

SEQ ID NO: 80079 - protein, 9 aa, Artificial Sequence
  Description of Artificial Sequence: Synthetic peptide
  Seed: MGDKDMPTA (MAGC1_HUMAN)
MSDKDMPTI

SEQ ID NO: 80080 - protein, 9 aa, Artificial Sequence
  Description of Artificial Sequence: Synthetic peptide
  Seed: VSAASSSTL (MAGC1_HUMAN)
VMAASSSTA

SEQ ID NO: 80081 - protein, 10 aa, Artificial Sequence
  Description of Artificial Sequence: Synthetic peptide
  Seed: ATESASSSVM (MAGC1_HUMAN)
AVESASSSVF

SEQ ID NO: 80082 - protein, 9 aa, Artificial Sequence
  Description of Artificial Sequence: Synthetic peptide
  Seed: SGIGVRAGR (MAGC1_HUMAN)
SSIGVRAGK

SEQ ID NO: 80083 - protein, 10 aa, Artificial Sequence
  Description of Artificial Sequence: Synthetic peptide
  Seed: FSSSTSLSPF (MAGC1_HUMAN)
FFSSTSLSPM

SEQ ID NO: 80084 - protein, 9 aa, Artificial Sequence
  Description of Artificial Sequence: Synthetic peptide
  Seed: SLIESEPLF (MAGC1_HUMAN)
SWIESEPLF

SEQ ID NO: 80085 - protein, 9 aa, Artificial Sequence
  Description of Artificial Sequence: Synthetic peptide
  Seed: TGYFPVIFR (MAGC1_HUMAN)
TIYFPVIFR

SEQ ID NO: 80086 - protein, 9 aa, Artificial Sequence
  Description of Artificial Sequence: Synthetic peptide
  Seed: MPSLLQSSS (MAGC1_HUMAN)
MPSLLQSSM

SEQ ID NO: 80087 - protein, 9 aa, Artificial Sequence
  Description of Artificial Sequence: Synthetic peptide
  Seed: ASSFFSSAL (MAGC1_HUMAN)
AISFFSSAF

SEQ ID NO: 80088 - protein, 9 aa, Artificial Sequence
  Description of Artificial Sequence: Synthetic peptide
  Seed: SEESSSPVD (MAGC1_HUMAN)
SEESSSPVM

SEQ ID NO: 80089 - protein, 11 aa, Artificial Sequence
  Description of Artificial Sequence: Synthetic peptide
  Seed: FLAMLKNTVPI (MAGC1_HUMAN)
FQAMLKNTVPA

SEQ ID NO: 80090 - protein, 9 aa, Artificial Sequence
  Description of Artificial Sequence: Synthetic peptide
  Seed: LQIPVSRSF (MAGC1_HUMAN)
LSIPVSRSM

SEQ ID NO: 80091 - protein, 10 aa, Artificial Sequence
  Description of Artificial Sequence: Synthetic peptide
  Seed: MTSSFSSTLL (MAGC1_HUMAN)
MVSSFSSTLI

SEQ ID NO: 80092 - protein, 11 aa, Artificial Sequence
  Description of Artificial Sequence: Synthetic peptide
  Seed: SICSSSTPSSL (MAGC1_HUMAN)
SQCSSSTPSSL

SEQ ID NO: 80093 - protein, 9 aa, Artificial Sequence
  Description of Artificial Sequence: Synthetic peptide
  Seed: SLFQSFSER (MAGC1_HUMAN)
SGFQSFSEL

SEQ ID NO: 80094 - protein, 11 aa, Artificial Sequence
  Description of Artificial Sequence: Synthetic peptide
  Seed: SSSSSSTLLSL (MAGC1_HUMAN)
SQSSSSTLLSW

SEQ ID NO: 80095 - protein, 9 aa, Artificial Sequence
  Description of Artificial Sequence: Synthetic peptide
  Seed: SPLQIVPSL (MAGC1_HUMAN)
SVLQIVPSI

SEQ ID NO: 80096 - protein, 10 aa, Artificial Sequence
  Description of Artificial Sequence: Synthetic peptide
  Seed: SRYTGYFPVI (MAGC1_HUMAN)
STYTGYFPVW

SEQ ID NO: 80097 - protein, 9 aa, Artificial Sequence
  Description of Artificial Sequence: Synthetic peptide
  Seed: YTGYFPVIF (MAGC1_HUMAN)
YSGYFPVIY

SEQ ID NO: 80098 - protein, 9 aa, Artificial Sequence
  Description of Artificial Sequence: Synthetic peptide
  Seed: FAFGEPREL (MAGC1_HUMAN)
FRFGEPREL

SEQ ID NO: 80099 - protein, 9 aa, Artificial Sequence
  Description of Artificial Sequence: Synthetic peptide
  Seed: ISFSSSTSL (MAGC1_HUMAN)
IFFSSSTSF

SEQ ID NO: 80100 - protein, 9 aa, Artificial Sequence
  Description of Artificial Sequence: Synthetic peptide
  Seed: LKYQVKQPI (MAGC1_HUMAN)
LMYQVKQPL

SEQ ID NO: 80101 - protein, 10 aa, Artificial Sequence
  Description of Artificial Sequence: Synthetic peptide
  Seed: SFFSYTLASL (MAGC1_HUMAN)
SQFSYTLASL

SEQ ID NO: 80102 - protein, 11 aa, Artificial Sequence
  Description of Artificial Sequence: Synthetic peptide
  Seed: TTDDSTATESA (MAGC1_HUMAN)
TADDSTATESY

SEQ ID NO: 80103 - protein, 10 aa, Artificial Sequence
  Description of Artificial Sequence: Synthetic peptide
  Seed: SSFSSTLLSI (MAGC1_HUMAN)
SMFSSTLLSV

SEQ ID NO: 80104 - protein, 11 aa, Artificial Sequence
  Description of Artificial Sequence: Synthetic peptide
  Seed: SICSSSTSLSL (MAGC1_HUMAN)
SGCSSSTSLSW

SEQ ID NO: 80105 - protein, 9 aa, Artificial Sequence
  Description of Artificial Sequence: Synthetic peptide
  Seed: SAASSSTLV (MAGC1_HUMAN)
STASSSTLF

SEQ ID NO: 80106 - protein, 10 aa, Artificial Sequence
  Description of Artificial Sequence: Synthetic peptide
  Seed: FQSSLQSPVS (MAGC1_HUMAN)
FMSSLQSPVI

SEQ ID NO: 80107 - protein, 9 aa, Artificial Sequence
  Description of Artificial Sequence: Synthetic peptide
  Seed: TLLESDSLT (MAGC1_HUMAN)
TTLESDSLV

SEQ ID NO: 80108 - protein, 9 aa, Artificial Sequence
  Description of Artificial Sequence: Synthetic peptide
  Seed: MSQNRLLIL (MAGC1_HUMAN)
MAQNRLLIK

SEQ ID NO: 80109 - protein, 9 aa, Artificial Sequence
  Description of Artificial Sequence: Synthetic peptide
  Seed: TPSSLPQSF (MAGC1_HUMAN)
THSSLPQSF

SEQ ID NO: 80110 - protein, 9 aa, Artificial Sequence
  Description of Artificial Sequence: Synthetic peptide
  Seed: AQSPLQIPV (MAGC1_HUMAN)
ALSPLQIPM

SEQ ID NO: 80111 - protein, 10 aa, Artificial Sequence
  Description of Artificial Sequence: Synthetic peptide
  Seed: SFSYTLLSLF (MAGC1_HUMAN)
SSSYTLLSLM

SEQ ID NO: 80112 - protein, 11 aa, Artificial Sequence
  Description of Artificial Sequence: Synthetic peptide
  Seed: SSFPSSTSSSL (MAGC1_HUMAN)
SAFPSSTSSSK

SEQ ID NO: 80113 - protein, 10 aa, Artificial Sequence
  Description of Artificial Sequence: Synthetic peptide
  Seed: YTLASLLQSS (MAGC1_HUMAN)
YTLASLLQSL

SEQ ID NO: 80114 - protein, 11 aa, Artificial Sequence
  Description of Artificial Sequence: Synthetic peptide
  Seed: SSFPSSTSSSL (MAGC1_HUMAN)
SYFPSSTSSSI

SEQ ID NO: 80115 - protein, 10 aa, Artificial Sequence
  Description of Artificial Sequence: Synthetic peptide
  Seed: QGEDSMSPLY (MAGC1_HUMAN)
QKEDSMSPLW

SEQ ID NO: 80116 - protein, 9 aa, Artificial Sequence
  Description of Artificial Sequence: Synthetic peptide
  Seed: NTHSPLQIV (MAGC1_HUMAN)
NVHSPLQIY

SEQ ID NO: 80117 - protein, 9 aa, Artificial Sequence
  Description of Artificial Sequence: Synthetic peptide
  Seed: TTDDSTATE (MAGC1_HUMAN)
TVDDSTATC

SEQ ID NO: 80118 - protein, 10 aa, Artificial Sequence
  Description of Artificial Sequence: Synthetic peptide
  Seed: FPQSLLQIPM (MAGC1_HUMAN)
FIQSLLQIPY

SEQ ID NO: 80119 - protein, 9 aa, Artificial Sequence
  Description of Artificial Sequence: Synthetic peptide
  Seed: FSSTLVSLF (MAGC1_HUMAN)
FTSTLVSLI

SEQ ID NO: 80120 - protein, 10 aa, Artificial Sequence
  Description of Artificial Sequence: Synthetic peptide
  Seed: ASSFFSSALL (MAGC1_HUMAN)
ALSFFSSALW

SEQ ID NO: 80121 - protein, 9 aa, Artificial Sequence
  Description of Artificial Sequence: Synthetic peptide
  Seed: AGREHFAFG (MAGC1_HUMAN)
AMREHFAFM

SEQ ID NO: 80122 - protein, 10 aa, Artificial Sequence
  Description of Artificial Sequence: Synthetic peptide
  Seed: SPERTHSTFE (MAGC1_HUMAN)
SPERTHSTFM

SEQ ID NO: 80123 - protein, 9 aa, Artificial Sequence
  Description of Artificial Sequence: Synthetic peptide
  Seed: THSPLQIVP (MAGC1_HUMAN)
THSPLQIVV

SEQ ID NO: 80124 - protein, 10 aa, Artificial Sequence
  Description of Artificial Sequence: Synthetic peptide
  Seed: TTDDSTATES (MAGC1_HUMAN)
TFDDSTATEM

SEQ ID NO: 80125 - protein, 10 aa, Artificial Sequence
  Description of Artificial Sequence: Synthetic peptide
  Seed: WGPRAHSEVI (MAGC1_HUMAN)
WVPRAHSEVF

SEQ ID NO: 80126 - protein, 10 aa, Artificial Sequence
  Description of Artificial Sequence: Synthetic peptide
  Seed: RAGREHFAFG (MAGC1_HUMAN)
RIGREHFAFA

SEQ ID NO: 80127 - protein, 9 aa, Artificial Sequence
  Description of Artificial Sequence: Synthetic peptide
  Seed: FQSSPERTH (MAGC1_HUMAN)
FKSSPERTM

SEQ ID NO: 80128 - protein, 9 aa, Artificial Sequence
  Description of Artificial Sequence: Synthetic peptide
  Seed: ATESASSSV (MAGC1_HUMAN)
AVESASSSL

SEQ ID NO: 80129 - protein, 9 aa, Artificial Sequence
  Description of Artificial Sequence: Synthetic peptide
  Seed: KVDELARFL (MAGC1_HUMAN)
KADELARFM

SEQ ID NO: 80130 - protein, 9 aa, Artificial Sequence
  Description of Artificial Sequence: Synthetic peptide
  Seed: MTSSFSSTL (MAGC1_HUMAN)
MMSSFSSTV

SEQ ID NO: 80131 - protein, 9 aa, Artificial Sequence
  Description of Artificial Sequence: Synthetic peptide
  Seed: MGDKDMPTA (MAGC1_HUMAN)
MGDKDMPTM

SEQ ID NO: 80132 - protein, 9 aa, Artificial Sequence
  Description of Artificial Sequence: Synthetic peptide
  Seed: QFPPQGEDF (MAGC1_HUMAN)
QLPPQGEDL

SEQ ID NO: 80133 - protein, 11 aa, Artificial Sequence
  Description of Artificial Sequence: Synthetic peptide
  Seed: SFFSSALLSIF (MAGC1_HUMAN)
SKFSSALLSIF

SEQ ID NO: 80134 - protein, 11 aa, Artificial Sequence
  Description of Artificial Sequence: Synthetic peptide
  Seed: SEESSSPVDEY (MAGC1_HUMAN)
SEESSSPVDEW

SEQ ID NO: 80135 - protein, 9 aa, Artificial Sequence
  Description of Artificial Sequence: Synthetic peptide
  Seed: SSPERTQST (MAGC1_HUMAN)
SAPERTQSV

SEQ ID NO: 80136 - protein, 10 aa, Artificial Sequence
  Description of Artificial Sequence: Synthetic peptide
  Seed: WGPRAHSEVI (MAGC1_HUMAN)
WTPRAHSEVF

SEQ ID NO: 80137 - protein, 9 aa, Artificial Sequence
  Description of Artificial Sequence: Synthetic peptide
  Seed: VSSSSSSTL (MAGC1_HUMAN)
VESSSSSTF

SEQ ID NO: 80138 - protein, 9 aa, Artificial Sequence
  Description of Artificial Sequence: Synthetic peptide
  Seed: SSFPSSTSS (MAGC1_HUMAN)
SVFPSSTSF

SEQ ID NO: 80139 - protein, 9 aa, Artificial Sequence
  Description of Artificial Sequence: Synthetic peptide
  Seed: RKAREFIEI (MAGC1_HUMAN)
RTAREFIEY

SEQ ID NO: 80140 - protein, 10 aa, Artificial Sequence
  Description of Artificial Sequence: Synthetic peptide
  Seed: NPASSFFSSA (MAGC1_HUMAN)
NNASSFFSSV

SEQ ID NO: 80141 - protein, 10 aa, Artificial Sequence
  Description of Artificial Sequence: Synthetic peptide
  Seed: RKAREFIEIL (MAGC1_HUMAN)
RRAREFIEIL

SEQ ID NO: 80142 - protein, 9 aa, Artificial Sequence
  Description of Artificial Sequence: Synthetic peptide
  Seed: TFEGFPQSL (MAGC1_HUMAN)
TWEGFPQSM

SEQ ID NO: 80143 - protein, 9 aa, Artificial Sequence
  Description of Artificial Sequence: Synthetic peptide
  Seed: TLDEKVDEL (MAGC1_HUMAN)
TYDEKVDEF

SEQ ID NO: 80144 - protein, 9 aa, Artificial Sequence
  Description of Artificial Sequence: Synthetic peptide
  Seed: YTSSSDTLL (MAGC1_HUMAN)
YISSSDTLF

SEQ ID NO: 80145 - protein, 9 aa, Artificial Sequence
  Description of Artificial Sequence: Synthetic peptide
  Seed: LQIPGSPSF (MAGC1_HUMAN)
LTIPGSPSV

SEQ ID NO: 80146 - protein, 9 aa, Artificial Sequence
  Description of Artificial Sequence: Synthetic peptide
  Seed: LQIPMTSSF (MAGC1_HUMAN)
LGIPMTSSY

SEQ ID NO: 80147 - protein, 9 aa, Artificial Sequence
  Description of Artificial Sequence: Synthetic peptide
  Seed: VQSPLQNPA (MAGC1_HUMAN)
VKSPLQNPF

SEQ ID NO: 80148 - protein, 9 aa, Artificial Sequence
  Description of Artificial Sequence: Synthetic peptide
  Seed: SSHESPQSP (MAGC1_HUMAN)
SIHESPQSH

SEQ ID NO: 80149 - protein, 9 aa, Artificial Sequence
  Description of Artificial Sequence: Synthetic peptide
  Seed: LQNPASSFF (MAGC1_HUMAN)
LWNPASSFY

SEQ ID NO: 80150 - protein, 9 aa, Artificial Sequence
  Description of Artificial Sequence: Synthetic peptide
  Seed: VSPSSSSTL (MAGC1_HUMAN)
VGPSSSSTL

SEQ ID NO: 80151 - protein, 10 aa, Artificial Sequence
  Description of Artificial Sequence: Synthetic peptide
  Seed: IPVSPSSSST (MAGC1_HUMAN)
IPVSPSSSSA

SEQ ID NO: 80152 - protein, 9 aa, Artificial Sequence
  Description of Artificial Sequence: Synthetic peptide
  Seed: SSFPSSTSS (MAGC1_HUMAN)
SIFPSSTSM

SEQ ID NO: 80153 - protein, 10 aa, Artificial Sequence
  Description of Artificial Sequence: Synthetic peptide
  Seed: SFPSSTSSSL (MAGC1_HUMAN)
SAPSSTSSSY

SEQ ID NO: 80154 - protein, 11 aa, Artificial Sequence
  Description of Artificial Sequence: Synthetic peptide
  Seed: IPVSSSSSSTL (MAGC1_HUMAN)
ICVSSSSSSTF

SEQ ID NO: 80155 - protein, 9 aa, Artificial Sequence
  Description of Artificial Sequence: Synthetic peptide
  Seed: FAFGEPREL (MAGC1_HUMAN)
FTFGEPREA

SEQ ID NO: 80156 - protein, 9 aa, Artificial Sequence
  Description of Artificial Sequence: Synthetic peptide
  Seed: AQSPLQIPV (MAGC1_HUMAN)
ATSPLQIPM

SEQ ID NO: 80157 - protein, 9 aa, Artificial Sequence
  Description of Artificial Sequence: Synthetic peptide
  Seed: TLLSLFQSF (MAGC1_HUMAN)
TLLSLFQSR

SEQ ID NO: 80158 - protein, 10 aa, Artificial Sequence
  Description of Artificial Sequence: Synthetic peptide
  Seed: FQSSLQSPVS (MAGC1_HUMAN)
FMSSLQSPVM

SEQ ID NO: 80159 - protein, 9 aa, Artificial Sequence
  Description of Artificial Sequence: Synthetic peptide
  Seed: VSSSSSSTL (MAGC1_HUMAN)
VTSSSSSTM

SEQ ID NO: 80160 - protein, 10 aa, Artificial Sequence
  Description of Artificial Sequence: Synthetic peptide
  Seed: LQIPVSSSFS (MAGC1_HUMAN)
LEIPVSSSFY

SEQ ID NO: 80161 - protein, 9 aa, Artificial Sequence
  Description of Artificial Sequence: Synthetic peptide
  Seed: FAFGEPREL (MAGC1_HUMAN)
FYFGEPREV

SEQ ID NO: 80162 - protein, 10 aa, Artificial Sequence
  Description of Artificial Sequence: Synthetic peptide
  Seed: KVVEFLAMLK (MAGC1_HUMAN)
KLVEFLAMLK

SEQ ID NO: 80163 - protein, 9 aa, Artificial Sequence
  Description of Artificial Sequence: Synthetic peptide
  Seed: IESEPLFTY (MAGC1_HUMAN)
IVSEPLFTL

SEQ ID NO: 80164 - protein, 9 aa, Artificial Sequence
  Description of Artificial Sequence: Synthetic peptide
  Seed: ASSSTLVSI (MAGC1_HUMAN)
AISSTLVSM

SEQ ID NO: 80165 - protein, 10 aa, Artificial Sequence
  Description of Artificial Sequence: Synthetic peptide
  Seed: SSPESAQSTF (MAGC1_HUMAN)
SMPESAQSTF

SEQ ID NO: 80166 - protein, 9 aa, Artificial Sequence
  Description of Artificial Sequence: Synthetic peptide
  Seed: DEKVDELAR (MAGC1_HUMAN)
DTKVDELAR

SEQ ID NO: 80167 - protein, 10 aa, Artificial Sequence
  Description of Artificial Sequence: Synthetic peptide
  Seed: SLSPLHFPQF (MAGC1_HUMAN)
SQSPLHFPQL

SEQ ID NO: 80168 - protein, 11 aa, Artificial Sequence
  Description of Artificial Sequence: Synthetic peptide
  Seed: SPLQIPGSPSF (MAGC1_HUMAN)
SWLQIPGSPSF

SEQ ID NO: 80169 - protein, 9 aa, Artificial Sequence
  Description of Artificial Sequence: Synthetic peptide
  Seed: AMLKNTVPI (MAGC1_HUMAN)
ALLKNTVPV

SEQ ID NO: 80170 - protein, 10 aa, Artificial Sequence
  Description of Artificial Sequence: Synthetic peptide
  Seed: STPSSLPQSF (MAGC1_HUMAN)
SRPSSLPQSF

SEQ ID NO: 80171 - protein, 9 aa, Artificial Sequence
  Description of Artificial Sequence: Synthetic peptide
  Seed: LQIVPSLPE (MAGC1_HUMAN)
LGIVPSLPY

SEQ ID NO: 80172 - protein, 10 aa, Artificial Sequence
  Description of Artificial Sequence: Synthetic peptide
  Seed: ILILSIIFIK (MAGC1_HUMAN)
ILILSIIFIR

SEQ ID NO: 80173 - protein, 9 aa, Artificial Sequence
  Description of Artificial Sequence: Synthetic peptide
  Seed: AMLKNTVPI (MAGC1_HUMAN)
AFLKNTVPY

SEQ ID NO: 80174 - protein, 9 aa, Artificial Sequence
  Description of Artificial Sequence: Synthetic peptide
  Seed: IIDTTDDST (MAGC1_HUMAN)
IQDTTDDSL

SEQ ID NO: 80175 - protein, 10 aa, Artificial Sequence
  Description of Artificial Sequence: Synthetic peptide
  Seed: SSFSSTLLSI (MAGC1_HUMAN)
STFSSTLLSA

SEQ ID NO: 80176 - protein, 9 aa, Artificial Sequence
  Description of Artificial Sequence: Synthetic peptide
  Seed: TFEGFPQSL (MAGC1_HUMAN)
TLEGFPQSY

SEQ ID NO: 80177 - protein, 10 aa, Artificial Sequence
  Description of Artificial Sequence: Synthetic peptide
  Seed: SLSPLHFPQF (MAGC1_HUMAN)
SMSPLHFPQL

SEQ ID NO: 80178 - protein, 10 aa, Artificial Sequence
  Description of Artificial Sequence: Synthetic peptide
  Seed: PLQIPMTSSF (MAGC1_HUMAN)
PVQIPMTSSF

SEQ ID NO: 80179 - protein, 10 aa, Artificial Sequence
  Description of Artificial Sequence: Synthetic peptide
  Seed: SFFSSALLSI (MAGC1_HUMAN)
SPFSSALLSF

SEQ ID NO: 80180 - protein, 10 aa, Artificial Sequence
  Description of Artificial Sequence: Synthetic peptide
  Seed: VSSSSSSSTL (MAGC1_HUMAN)
VWSSSSSSTW

SEQ ID NO: 80181 - protein, 10 aa, Artificial Sequence
  Description of Artificial Sequence: Synthetic peptide
  Seed: AEMLTNVISR (MAGC1_HUMAN)
AEMLTNVISW

SEQ ID NO: 80182 - protein, 9 aa, Artificial Sequence
  Description of Artificial Sequence: Synthetic peptide
  Seed: ASEEVIWDV (MAGC1_HUMAN)
AIEEVIWDL

SEQ ID NO: 80183 - protein, 9 aa, Artificial Sequence
  Description of Artificial Sequence: Synthetic peptide
  Seed: STFEGFAQS (MAGC1_HUMAN)
SAFEGFAQV

SEQ ID NO: 80184 - protein, 9 aa, Artificial Sequence
  Description of Artificial Sequence: Synthetic peptide
  Seed: FSSTLVSLF (MAGC1_HUMAN)
FQSTLVSLL

SEQ ID NO: 80185 - protein, 9 aa, Artificial Sequence
  Description of Artificial Sequence: Synthetic peptide
  Seed: RPVSSFFSY (MAGC1_HUMAN)
RGVSSFFSM

SEQ ID NO: 80186 - protein, 11 aa, Artificial Sequence
  Description of Artificial Sequence: Synthetic peptide
  Seed: TTDDSTATESA (MAGC1_HUMAN)
TQDDSTATESY

SEQ ID NO: 80187 - protein, 9 aa, Artificial Sequence
  Description of Artificial Sequence: Synthetic peptide
  Seed: SSSSTLLSL (MAGC1_HUMAN)
SISSTLLSV

SEQ ID NO: 80188 - protein, 9 aa, Artificial Sequence
  Description of Artificial Sequence: Synthetic peptide
  Seed: RFLLLKYQV (MAGC1_HUMAN)
RFLLLKYQW

SEQ ID NO: 80189 - protein, 10 aa, Artificial Sequence
  Description of Artificial Sequence: Synthetic peptide
  Seed: RYTGYFPVIF (MAGC1_HUMAN)
RKTGYFPVIM

SEQ ID NO: 80190 - protein, 9 aa, Artificial Sequence
  Description of Artificial Sequence: Synthetic peptide
  Seed: REVDPDDSY (MAGC1_HUMAN)
RVVDPDDSI

SEQ ID NO: 80191 - protein, 11 aa, Artificial Sequence
  Description of Artificial Sequence: Synthetic peptide
  Seed: TTDDSTATESA (MAGC1_HUMAN)
TIDDSTATESL

SEQ ID NO: 80192 - protein, 9 aa, Artificial Sequence
  Description of Artificial Sequence: Synthetic peptide
  Seed: RSFSSTLLS (MAGC1_HUMAN)
RVFSSTLLY

SEQ ID NO: 80193 - protein, 9 aa, Artificial Sequence
  Description of Artificial Sequence: Synthetic peptide
  Seed: SFSYTLLSL (MAGC1_HUMAN)
SASYTLLSI

SEQ ID NO: 80194 - protein, 9 aa, Artificial Sequence
  Description of Artificial Sequence: Synthetic peptide
  Seed: SPLQIPMTS (MAGC1_HUMAN)
SMLQIPMTL

SEQ ID NO: 80195 - protein, 9 aa, Artificial Sequence
  Description of Artificial Sequence: Synthetic peptide
  Seed: FQSSLQSPV (MAGC1_HUMAN)
FASSLQSPL

SEQ ID NO: 80196 - protein, 10 aa, Artificial Sequence
  Description of Artificial Sequence: Synthetic peptide
  Seed: YTLLSLFQSS (MAGC1_HUMAN)
YMLLSLFQSI

SEQ ID NO: 80197 - protein, 9 aa, Artificial Sequence
  Description of Artificial Sequence: Synthetic peptide
  Seed: YTSSSDTLL (MAGC1_HUMAN)
YVSSSDTLL

SEQ ID NO: 80198 - protein, 9 aa, Artificial Sequence
  Description of Artificial Sequence: Synthetic peptide
  Seed: SSSSSSSTL (MAGC1_HUMAN)
SISSSSSTV

SEQ ID NO: 80199 - protein, 10 aa, Artificial Sequence
  Description of Artificial Sequence: Synthetic peptide
  Seed: YTLASLLQSS (MAGC1_HUMAN)
YALASLLQST

SEQ ID NO: 80200 - protein, 9 aa, Artificial Sequence
  Description of Artificial Sequence: Synthetic peptide
  Seed: SSPESAQSA (MAGC1_HUMAN)
STPESAQSL

SEQ ID NO: 80201 - protein, 9 aa, Artificial Sequence
  Description of Artificial Sequence: Synthetic peptide
  Seed: SSPESTQSP (MAGC1_HUMAN)
SIPESTQSL

SEQ ID NO: 80202 - protein, 11 aa, Artificial Sequence
  Description of Artificial Sequence: Synthetic peptide
  Seed: SLFQSSPERTH (MAGC1_HUMAN)
STFQSSPERTF

SEQ ID NO: 80203 - protein, 10 aa, Artificial Sequence
  Description of Artificial Sequence: Synthetic peptide
  Seed: AASSSTLVSI (MAGC1_HUMAN)
AGSSSTLVSW

SEQ ID NO: 80204 - protein, 9 aa, Artificial Sequence
  Description of Artificial Sequence: Synthetic peptide
  Seed: STQSPFEGF (MAGC1_HUMAN)
SWQSPFEGL

SEQ ID NO: 80205 - protein, 10 aa, Artificial Sequence
  Description of Artificial Sequence: Synthetic peptide
  Seed: LLQIPMTSSF (MAGC1_HUMAN)
LSQIPMTSSF

SEQ ID NO: 80206 - protein, 9 aa, Artificial Sequence
  Description of Artificial Sequence: Synthetic peptide
  Seed: SPLQSPVSS (MAGC1_HUMAN)
SSLQSPVSM

SEQ ID NO: 80207 - protein, 10 aa, Artificial Sequence
  Description of Artificial Sequence: Synthetic peptide
  Seed: SFPSSTSSSL (MAGC1_HUMAN)
SVPSSTSSSM

SEQ ID NO: 80208 - protein, 10 aa, Artificial Sequence
  Description of Artificial Sequence: Synthetic peptide
  Seed: VSSSFSYTLL (MAGC1_HUMAN)
VLSSFSYTLY

SEQ ID NO: 80209 - protein, 10 aa, Artificial Sequence
  Description of Artificial Sequence: Synthetic peptide
  Seed: SQNRLLILIL (MAGC1_HUMAN)
SMNRLLILIY

SEQ ID NO: 80210 - protein, 10 aa, Artificial Sequence
  Description of Artificial Sequence: Synthetic peptide
  Seed: REVDPDDSYV (MAGC1_HUMAN)
RIVDPDDSYM

SEQ ID NO: 80211 - protein, 9 aa, Artificial Sequence
  Description of Artificial Sequence: Synthetic peptide
  Seed: SICSSSTSL (MAGC1_HUMAN)
SVCSSSTSF

SEQ ID NO: 80212 - protein, 9 aa, Artificial Sequence
  Description of Artificial Sequence: Synthetic peptide
  Seed: EFIEILFGI (MAGC1_HUMAN)
ECIEILFGV

SEQ ID NO: 80213 - protein, 11 aa, Artificial Sequence
  Description of Artificial Sequence: Synthetic peptide
  Seed: IPVSRSFSSTL (MAGC1_HUMAN)
IMVSRSFSSTF

SEQ ID NO: 80214 - protein, 9 aa, Artificial Sequence
  Description of Artificial Sequence: Synthetic peptide
  Seed: MGDKDMPTA (MAGC1_HUMAN)
MVDKDMPTF

SEQ ID NO: 80215 - protein, 10 aa, Artificial Sequence
  Description of Artificial Sequence: Synthetic peptide
  Seed: EMLTNVISRY (MAGC1_HUMAN)
ELLTNVISRR

SEQ ID NO: 80216 - protein, 9 aa, Artificial Sequence
  Description of Artificial Sequence: Synthetic peptide
  Seed: FSYTLLSLF (MAGC1_HUMAN)
FGYTLLSLW

SEQ ID NO: 80217 - protein, 10 aa, Artificial Sequence
  Description of Artificial Sequence: Synthetic peptide
  Seed: ICSSSTPSSL (MAGC1_HUMAN)
IYSSSTPSSW

SEQ ID NO: 80218 - protein, 9 aa, Artificial Sequence
  Description of Artificial Sequence: Synthetic peptide
  Seed: QVKQPITKA (MAGC1_HUMAN)
QAKQPITKV

SEQ ID NO: 80219 - protein, 10 aa, Artificial Sequence
  Description of Artificial Sequence: Synthetic peptide
  Seed: SMSPLYFPQS (MAGC1_HUMAN)
SISPLYFPQV

SEQ ID NO: 80220 - protein, 9 aa, Artificial Sequence
  Description of Artificial Sequence: Synthetic peptide
  Seed: SLIESEPLF (MAGC1_HUMAN)
STIESEPLY

SEQ ID NO: 80221 - protein, 10 aa, Artificial Sequence
  Description of Artificial Sequence: Synthetic peptide
  Seed: FAFGEPRELL (MAGC1_HUMAN)
FLFGEPRELL

SEQ ID NO: 80222 - protein, 9 aa, Artificial Sequence
  Description of Artificial Sequence: Synthetic peptide
  Seed: EGDDTQSPL (MAGC1_HUMAN)
EVDDTQSPL

SEQ ID NO: 80223 - protein, 10 aa, Artificial Sequence
  Description of Artificial Sequence: Synthetic peptide
  Seed: STLLSLFQSF (MAGC1_HUMAN)
SALLSLFQSF

SEQ ID NO: 80224 - protein, 11 aa, Artificial Sequence
  Description of Artificial Sequence: Synthetic peptide
  Seed: FPQSPLQIPGS (MAGC1_HUMAN)
FPQSPLQIPGA

SEQ ID NO: 80225 - protein, 9 aa, Artificial Sequence
  Description of Artificial Sequence: Synthetic peptide
  Seed: SFFSYTLAS (MAGC1_HUMAN)
SRFSYTLAM

SEQ ID NO: 80226 - protein, 11 aa, Artificial Sequence
  Description of Artificial Sequence: Synthetic peptide
  Seed: EEVIWDVLSGI (MAGC1_HUMAN)
ESVIWDVLSGV

SEQ ID NO: 80227 - protein, 9 aa, Artificial Sequence
  Description of Artificial Sequence: Synthetic peptide
  Seed: PLQSPVSSF (MAGC1_HUMAN)
PMQSPVSSY

SEQ ID NO: 80228 - protein, 9 aa, Artificial Sequence
  Description of Artificial Sequence: Synthetic peptide
  Seed: KVDELARFL (MAGC1_HUMAN)
KTDELARFI

SEQ ID NO: 80229 - protein, 11 aa, Artificial Sequence
  Description of Artificial Sequence: Synthetic peptide
  Seed: LQIPVSSSFSY (MAGC1_HUMAN)
LDIPVSSSFSF

SEQ ID NO: 80230 - protein, 9 aa, Artificial Sequence
  Description of Artificial Sequence: Synthetic peptide
  Seed: SLFQSFSER (MAGC1_HUMAN)
SMFQSFSEY

SEQ ID NO: 80231 - protein, 9 aa, Artificial Sequence
  Description of Artificial Sequence: Synthetic peptide
  Seed: TLDEKVDEL (MAGC1_HUMAN)
TNDEKVDEI

SEQ ID NO: 80232 - protein, 10 aa, Artificial Sequence
  Description of Artificial Sequence: Synthetic peptide
  Seed: KAREFIEILF (MAGC1_HUMAN)
KLREFIEILW

SEQ ID NO: 80233 - protein, 10 aa, Artificial Sequence
  Description of Artificial Sequence: Synthetic peptide
  Seed: SFPSSTSSSL (MAGC1_HUMAN)
SMPSSTSSSF

SEQ ID NO: 80234 - protein, 9 aa, Artificial Sequence
  Description of Artificial Sequence: Synthetic peptide
  Seed: AQSPLQIPV (MAGC1_HUMAN)
AVSPLQIPL

SEQ ID NO: 80235 - protein, 9 aa, Artificial Sequence
  Description of Artificial Sequence: Synthetic peptide
  Seed: SPLQSPVIS (MAGC1_HUMAN)
SPLQSPVIP

SEQ ID NO: 80236 - protein, 9 aa, Artificial Sequence
  Description of Artificial Sequence: Synthetic peptide
  Seed: VSRSFSSTL (MAGC1_HUMAN)
VKRSFSSTY

SEQ ID NO: 80237 - protein, 10 aa, Artificial Sequence
  Description of Artificial Sequence: Synthetic peptide
  Seed: RKAREFIEIL (MAGC1_HUMAN)
RRAREFIEII

SEQ ID NO: 80238 - protein, 9 aa, Artificial Sequence
  Description of Artificial Sequence: Synthetic peptide
  Seed: LLSLFQSFS (MAGC1_HUMAN)
LLSLFQSFV

SEQ ID NO: 80239 - protein, 9 aa, Artificial Sequence
  Description of Artificial Sequence: Synthetic peptide
  Seed: LQIPGSPSF (MAGC1_HUMAN)
LQIPGSPSY

SEQ ID NO: 80240 - protein, 10 aa, Artificial Sequence
  Description of Artificial Sequence: Synthetic peptide
  Seed: FLAMLKNTVP (MAGC1_HUMAN)
FLAMLKNTVL

SEQ ID NO: 80241 - protein, 10 aa, Artificial Sequence
  Description of Artificial Sequence: Synthetic peptide
  Seed: MSQNRLLILI (MAGC1_HUMAN)
MLQNRLLILI

SEQ ID NO: 80242 - protein, 9 aa, Artificial Sequence
  Description of Artificial Sequence: Synthetic peptide
  Seed: LQIPMTSSF (MAGC1_HUMAN)
LFIPMTSSY

SEQ ID NO: 80243 - protein, 10 aa, Artificial Sequence
  Description of Artificial Sequence: Synthetic peptide
  Seed: QRPVSSFFSY (MAGC1_HUMAN)
QYPVSSFFSF

SEQ ID NO: 80244 - protein, 9 aa, Artificial Sequence
  Description of Artificial Sequence: Synthetic peptide
  Seed: LQIPMTSSF (MAGC1_HUMAN)
LTIPMTSSW

SEQ ID NO: 80245 - protein, 9 aa, Artificial Sequence
  Description of Artificial Sequence: Synthetic peptide
  Seed: FSEESSSPV (MAGC1_HUMAN)
FVEESSSPL

SEQ ID NO: 80246 - protein, 9 aa, Artificial Sequence
  Description of Artificial Sequence: Synthetic peptide
  Seed: LQSPVISFS (MAGC1_HUMAN)
LSSPVISFV

SEQ ID NO: 80247 - protein, 10 aa, Artificial Sequence
  Description of Artificial Sequence: Synthetic peptide
  Seed: FPQSLLQIPM (MAGC1_HUMAN)
FPQSLLQIPI

SEQ ID NO: 80248 - protein, 9 aa, Artificial Sequence
  Description of Artificial Sequence: Synthetic peptide
  Seed: DSYVFVNTL (MAGC1_HUMAN)
DRYVFVNTL

SEQ ID NO: 80249 - protein, 9 aa, Artificial Sequence
  Description of Artificial Sequence: Synthetic peptide
  Seed: SIFQSSPER (MAGC1_HUMAN)
SMFQSSPEI

SEQ ID NO: 80250 - protein, 9 aa, Artificial Sequence
  Description of Artificial Sequence: Synthetic peptide
  Seed: AFGEPRELL (MAGC1_HUMAN)
AAGEPRELI

SEQ ID NO: 80251 - protein, 9 aa, Artificial Sequence
  Description of Artificial Sequence: Synthetic peptide
  Seed: LQSPVISFS (MAGC1_HUMAN)
LISPVISFA

SEQ ID NO: 80252 - protein, 9 aa, Artificial Sequence
  Description of Artificial Sequence: Synthetic peptide
  Seed: DSYVFVNTL (MAGC1_HUMAN)
DAYVFVNTR

SEQ ID NO: 80253 - protein, 9 aa, Artificial Sequence
  Description of Artificial Sequence: Synthetic peptide
  Seed: NTVPITFPS (MAGC1_HUMAN)
NAVPITFPA

SEQ ID NO: 80254 - protein, 9 aa, Artificial Sequence
  Description of Artificial Sequence: Synthetic peptide
  Seed: AQSSLQIPV (MAGC1_HUMAN)
ALSSLQIPL

SEQ ID NO: 80255 - protein, 10 aa, Artificial Sequence
  Description of Artificial Sequence: Synthetic peptide
  Seed: QIPVSSSFSY (MAGC1_HUMAN)
QAPVSSSFSF

SEQ ID NO: 80256 - protein, 9 aa, Artificial Sequence
  Description of Artificial Sequence: Synthetic peptide
  Seed: LQNPASSFF (MAGC1_HUMAN)
LFNPASSFW

SEQ ID NO: 80257 - protein, 9 aa, Artificial Sequence
  Description of Artificial Sequence: Synthetic peptide
  Seed: TLLSIFQSS (MAGC1_HUMAN)
TTLSIFQSV

SEQ ID NO: 80258 - protein, 9 aa, Artificial Sequence
  Description of Artificial Sequence: Synthetic peptide
  Seed: RSFSSTLLS (MAGC1_HUMAN)
RSFSSTLLH

SEQ ID NO: 80259 - protein, 9 aa, Artificial Sequence
  Description of Artificial Sequence: Synthetic peptide
  Seed: MTSSFSSTL (MAGC1_HUMAN)
MWSSFSSTF

SEQ ID NO: 80260 - protein, 10 aa, Artificial Sequence
  Description of Artificial Sequence: Synthetic peptide
  Seed: ILILSIIFIK (MAGC1_HUMAN)
IVILSIIFIR

SEQ ID NO: 80261 - protein, 9 aa, Artificial Sequence
  Description of Artificial Sequence: Synthetic peptide
  Seed: IIFIKGTYA (MAGC1_HUMAN)
IMFIKGTYK

SEQ ID NO: 80262 - protein, 8 aa, Artificial Sequence
  Description of Artificial Sequence: Synthetic peptide
  Seed: LQIPQSPL (MAGC1_HUMAN)
LKIPQSPY

SEQ ID NO: 80263 - protein, 10 aa, Artificial Sequence
  Description of Artificial Sequence: Synthetic peptide
  Seed: MTSSFSSTLL (MAGC1_HUMAN)
MISSFSSTLM

SEQ ID NO: 80264 - protein, 10 aa, Artificial Sequence
  Description of Artificial Sequence: Synthetic peptide
  Seed: FFSYTLASLL (MAGC1_HUMAN)
FDSYTLASLM

SEQ ID NO: 80265 - protein, 10 aa, Artificial Sequence
  Description of Artificial Sequence: Synthetic peptide
  Seed: VSPSFSSTLV (MAGC1_HUMAN)
VLPSFSSTLI

SEQ ID NO: 80266 - protein, 10 aa, Artificial Sequence
  Description of Artificial Sequence: Synthetic peptide
  Seed: LQIPVSRSFS (MAGC1_HUMAN)
LKIPVSRSFF

SEQ ID NO: 80267 - protein, 9 aa, Artificial Sequence
  Description of Artificial Sequence: Synthetic peptide
  Seed: LQNPASSFF (MAGC1_HUMAN)
LSNPASSFM

SEQ ID NO: 80268 - protein, 9 aa, Artificial Sequence
  Description of Artificial Sequence: Synthetic peptide
  Seed: SSPPRYEFL (MAGC1_HUMAN)
SFPPRYEFI

SEQ ID NO: 80269 - protein, 9 aa, Artificial Sequence
  Description of Artificial Sequence: Synthetic peptide
  Seed: TPSSLPQSF (MAGC1_HUMAN)
TISSLPQSL

SEQ ID NO: 80270 - protein, 9 aa, Artificial Sequence
  Description of Artificial Sequence: Synthetic peptide
  Seed: LQIPVSPSF (MAGC1_HUMAN)
LLIPVSPSY

SEQ ID NO: 80271 - protein, 9 aa, Artificial Sequence
  Description of Artificial Sequence: Synthetic peptide
  Seed: SSPESDDTL (MAGC1_HUMAN)
SAPESDDTL

SEQ ID NO: 80272 - protein, 10 aa, Artificial Sequence
  Description of Artificial Sequence: Synthetic peptide
  Seed: SPLYFPQSPL (MAGC1_HUMAN)
SLLYFPQSPL

SEQ ID NO: 80273 - protein, 10 aa, Artificial Sequence
  Description of Artificial Sequence: Synthetic peptide
  Seed: ISRYTGYFPV (MAGC1_HUMAN)
ICRYTGYFPM

SEQ ID NO: 80274 - protein, 9 aa, Artificial Sequence
  Description of Artificial Sequence: Synthetic peptide
  Seed: TTDDSTATE (MAGC1_HUMAN)
TFDDSTATL

SEQ ID NO: 80275 - protein, 9 aa, Artificial Sequence
  Description of Artificial Sequence: Synthetic peptide
  Seed: SFSYTLLSL (MAGC1_HUMAN)
SRSYTLLSL

SEQ ID NO: 80276 - protein, 8 aa, Artificial Sequence
  Description of Artificial Sequence: Synthetic peptide
  Seed: FLLLKYQV (MAGC1_HUMAN)
FMLLKYQM

SEQ ID NO: 80277 - protein, 9 aa, Artificial Sequence
  Description of Artificial Sequence: Synthetic peptide
  Seed: LQIPGSPSF (MAGC1_HUMAN)
LPIPGSPSA

SEQ ID NO: 80278 - protein, 10 aa, Artificial Sequence
  Description of Artificial Sequence: Synthetic peptide
  Seed: PMTSSFSSTL (MAGC1_HUMAN)
PMTSSFSSTV

SEQ ID NO: 80279 - protein, 9 aa, Artificial Sequence
  Description of Artificial Sequence: Synthetic peptide
  Seed: SAQSAFEGF (MAGC1_HUMAN)
SAQSAFEGW

SEQ ID NO: 80280 - protein, 9 aa, Artificial Sequence
  Description of Artificial Sequence: Synthetic peptide
  Seed: FAQSPLQIP (MAGC1_HUMAN)
FPQSPLQIA

SEQ ID NO: 80281 - protein, 9 aa, Artificial Sequence
  Description of Artificial Sequence: Synthetic peptide
  Seed: ISFSSSTSL (MAGC1_HUMAN)
ITFSSSTSV

SEQ ID NO: 80282 - protein, 11 aa, Artificial Sequence
  Description of Artificial Sequence: Synthetic peptide
  Seed: IPVSAASSSTL (MAGC1_HUMAN)
IAVSAASSSTF

SEQ ID NO: 80283 - protein, 9 aa, Artificial Sequence
  Description of Artificial Sequence: Synthetic peptide
  Seed: SQSSPVSSF (MAGC1_HUMAN)
SVSSPVSSY

SEQ ID NO: 80284 - protein, 9 aa, Artificial Sequence
  Description of Artificial Sequence: Synthetic peptide
  Seed: MLTNVISRY (MAGC1_HUMAN)
MSTNVISRF

SEQ ID NO: 80285 - protein, 9 aa, Artificial Sequence
  Description of Artificial Sequence: Synthetic peptide
  Seed: TLASLLQSS (MAGC1_HUMAN)
TIASLLQSV

SEQ ID NO: 80286 - protein, 10 aa, Artificial Sequence
  Description of Artificial Sequence: Synthetic peptide
  Seed: SSSSSSSTLL (MAGC1_HUMAN)
SDSSSSSTLW

SEQ ID NO: 80287 - protein, 9 aa, Artificial Sequence
  Description of Artificial Sequence: Synthetic peptide
  Seed: FPESPQSPP (MAGC1_HUMAN)
FPESPQSPF

SEQ ID NO: 80288 - protein, 9 aa, Artificial Sequence
  Description of Artificial Sequence: Synthetic peptide
  Seed: SSPPRYEFL (MAGC1_HUMAN)
SEPPRYEFF

SEQ ID NO: 80289 - protein, 10 aa, Artificial Sequence
  Description of Artificial Sequence: Synthetic peptide
  Seed: FSSSTSLSPF (MAGC1_HUMAN)
FVSSTSLSPM

SEQ ID NO: 80290 - protein, 9 aa, Artificial Sequence
  Description of Artificial Sequence: Synthetic peptide
  Seed: SLIESEPLF (MAGC1_HUMAN)
SVIESEPLL

SEQ ID NO: 80291 - protein, 9 aa, Artificial Sequence
  Description of Artificial Sequence: Synthetic peptide
  Seed: LQIPVSPSF (MAGC1_HUMAN)
LIIPVSPSI

SEQ ID NO: 80292 - protein, 9 aa, Artificial Sequence
  Description of Artificial Sequence: Synthetic peptide
  Seed: MTSSFSSTL (MAGC1_HUMAN)
MLSSFSSTF

SEQ ID NO: 80293 - protein, 9 aa, Artificial Sequence
  Description of Artificial Sequence: Synthetic peptide
  Seed: REVDPDDSY (MAGC1_HUMAN)
REVDPDDSL

SEQ ID NO: 80294 - protein, 11 aa, Artificial Sequence
  Description of Artificial Sequence: Synthetic peptide
  Seed: IPVSAASSSTL (MAGC1_HUMAN)
INVSAASSSTY

SEQ ID NO: 80295 - protein, 10 aa, Artificial Sequence
  Description of Artificial Sequence: Synthetic peptide
  Seed: ATESASSSVM (MAGC1_HUMAN)
AFESASSSVL

SEQ ID NO: 80296 - protein, 10 aa, Artificial Sequence
  Description of Artificial Sequence: Synthetic peptide
  Seed: YTLDEKVDEL (MAGC1_HUMAN)
YALDEKVDEF

SEQ ID NO: 80297 - protein, 11 aa, Artificial Sequence
  Description of Artificial Sequence: Synthetic peptide
  Seed: FLAMLKNTVPI (MAGC1_HUMAN)
FMAMLKNTVPI

SEQ ID NO: 80298 - protein, 9 aa, Artificial Sequence
  Description of Artificial Sequence: Synthetic peptide
  Seed: SLPQSFPES (MAGC1_HUMAN)
SMPQSFPEV

SEQ ID NO: 80299 - protein, 9 aa, Artificial Sequence
  Description of Artificial Sequence: Synthetic peptide
  Seed: NVISRYTGY (MAGC1_HUMAN)
NLISRYTGY

SEQ ID NO: 80300 - protein, 9 aa, Artificial Sequence
  Description of Artificial Sequence: Synthetic peptide
  Seed: LQIPVSPSF (MAGC1_HUMAN)
LAIPVSPSV

SEQ ID NO: 80301 - protein, 9 aa, Artificial Sequence
  Description of Artificial Sequence: Synthetic peptide
  Seed: RKVVEFLAM (MAGC1_HUMAN)
RKVVEFLAI

SEQ ID NO: 80302 - protein, 10 aa, Artificial Sequence
  Description of Artificial Sequence: Synthetic peptide
  Seed: RSFSSTLLSI (MAGC1_HUMAN)
RQFSSTLLSI

SEQ ID NO: 80303 - protein, 9 aa, Artificial Sequence
  Description of Artificial Sequence: Synthetic peptide
  Seed: VSPSFSSTL (MAGC1_HUMAN)
VMPSFSSTM

SEQ ID NO: 80304 - protein, 9 aa, Artificial Sequence
  Description of Artificial Sequence: Synthetic peptide
  Seed: VPNSSPPRY (MAGC1_HUMAN)
VLNSSPPRF

SEQ ID NO: 80305 - protein, 9 aa, Artificial Sequence
  Description of Artificial Sequence: Synthetic peptide
  Seed: TPSSLPQSF (MAGC1_HUMAN)
TYSSLPQSY

SEQ ID NO: 80306 - protein, 9 aa, Artificial Sequence
  Description of Artificial Sequence: Synthetic peptide
  Seed: TESASSSVM (MAGC1_HUMAN)
TASASSSVF

SEQ ID NO: 80307 - protein, 9 aa, Artificial Sequence
  Description of Artificial Sequence: Synthetic peptide
  Seed: SLFQSFSER (MAGC1_HUMAN)
SYFQSFSER

SEQ ID NO: 80308 - protein, 9 aa, Artificial Sequence
  Description of Artificial Sequence: Synthetic peptide
  Seed: SPLQIPQSS (MAGC1_HUMAN)
SHLQIPQSI

SEQ ID NO: 80309 - protein, 10 aa, Artificial Sequence
  Description of Artificial Sequence: Synthetic peptide
  Seed: SPESPLQSPV (MAGC1_HUMAN)
SPESPLQSPM

SEQ ID NO: 80310 - protein, 10 aa, Artificial Sequence
  Description of Artificial Sequence: Synthetic peptide
  Seed: SFSSTLVSLF (MAGC1_HUMAN)
SKSSTLVSLY

SEQ ID NO: 80311 - protein, 9 aa, Artificial Sequence
  Description of Artificial Sequence: Synthetic peptide
  Seed: TKVWVQEHY (MAGC1_HUMAN)
TYVWVQEHY

SEQ ID NO: 80312 - protein, 9 aa, Artificial Sequence
  Description of Artificial Sequence: Synthetic peptide
  Seed: GFPQSPLQI (MAGC1_HUMAN)
GRPQSPLQL

SEQ ID NO: 80313 - protein, 9 aa, Artificial Sequence
  Description of Artificial Sequence: Synthetic peptide
  Seed: SIIFIKGTY (MAGC1_HUMAN)
SAIFIKGTK

SEQ ID NO: 80314 - protein, 10 aa, Artificial Sequence
  Description of Artificial Sequence: Synthetic peptide
  Seed: MLKNTVPITF (MAGC1_HUMAN)
MFKNTVPITY

SEQ ID NO: 80315 - protein, 9 aa, Artificial Sequence
  Description of Artificial Sequence: Synthetic peptide
  Seed: SPESAQSAF (MAGC1_HUMAN)
SMESAQSAF

SEQ ID NO: 80316 - protein, 9 aa, Artificial Sequence
  Description of Artificial Sequence: Synthetic peptide
  Seed: SSSSSSTLL (MAGC1_HUMAN)
SQSSSSTLY

SEQ ID NO: 80317 - protein, 9 aa, Artificial Sequence
  Description of Artificial Sequence: Synthetic peptide
  Seed: SSFFSYTLA (MAGC1_HUMAN)
SIFFSYTLI

SEQ ID NO: 80318 - protein, 9 aa, Artificial Sequence
  Description of Artificial Sequence: Synthetic peptide
  Seed: RLLILILSI (MAGC1_HUMAN)
RTLILILSW

SEQ ID NO: 80319 - protein, 9 aa, Artificial Sequence
  Description of Artificial Sequence: Synthetic peptide
  Seed: SLIESEPLF (MAGC1_HUMAN)
SYIESEPLV

SEQ ID NO: 80320 - protein, 9 aa, Artificial Sequence
  Description of Artificial Sequence: Synthetic peptide
  Seed: RKAREFIEI (MAGC1_HUMAN)
RSAREFIEY

SEQ ID NO: 80321 - protein, 9 aa, Artificial Sequence
  Description of Artificial Sequence: Synthetic peptide
  Seed: QSPPEGEDV (MAGC1_HUMAN)
QAPPEGEDL

SEQ ID NO: 80322 - protein, 10 aa, Artificial Sequence
  Description of Artificial Sequence: Synthetic peptide
  Seed: FPQSPLQIPV (MAGC1_HUMAN)
FCQSPLQIPL

SEQ ID NO: 80323 - protein, 9 aa, Artificial Sequence
  Description of Artificial Sequence: Synthetic peptide
  Seed: SSPERTQST (MAGC1_HUMAN)
STPERTQSY

SEQ ID NO: 80324 - protein, 10 aa, Artificial Sequence
  Description of Artificial Sequence: Synthetic peptide
  Seed: EVIWDVLSGI (MAGC1_HUMAN)
EIIWDVLSGF

SEQ ID NO: 80325 - protein, 10 aa, Artificial Sequence
  Description of Artificial Sequence: Synthetic peptide
  Seed: LQIPMTSSFS (MAGC1_HUMAN)
LSIPMTSSFY

SEQ ID NO: 80326 - protein, 11 aa, Artificial Sequence
  Description of Artificial Sequence: Synthetic peptide
  Seed: EILFGISLREV (MAGC1_HUMAN)
ESLFGISLREV

SEQ ID NO: 80327 - protein, 10 aa, Artificial Sequence
  Description of Artificial Sequence: Synthetic peptide
  Seed: LQIPGSPSFS (MAGC1_HUMAN)
LMIPGSPSFW

SEQ ID NO: 80328 - protein, 9 aa, Artificial Sequence
  Description of Artificial Sequence: Synthetic peptide
  Seed: ALLSIFQSS (MAGC1_HUMAN)
ATLSIFQSL

SEQ ID NO: 80329 - protein, 9 aa, Artificial Sequence
  Description of Artificial Sequence: Synthetic peptide
  Seed: STFEGFAQS (MAGC1_HUMAN)
SMFEGFAQI

SEQ ID NO: 80330 - protein, 9 aa, Artificial Sequence
  Description of Artificial Sequence: Synthetic peptide
  Seed: SPPEGENTH (MAGC1_HUMAN)
SVPEGENTY

SEQ ID NO: 80331 - protein, 9 aa, Artificial Sequence
  Description of Artificial Sequence: Synthetic peptide
  Seed: GFPQSLLQI (MAGC1_HUMAN)
GRPQSLLQL

SEQ ID NO: 80332 - protein, 9 aa, Artificial Sequence
  Description of Artificial Sequence: Synthetic peptide
  Seed: MLKNTVPIT (MAGC1_HUMAN)
MMKNTVPIV

SEQ ID NO: 80333 - protein, 9 aa, Artificial Sequence
  Description of Artificial Sequence: Synthetic peptide
  Seed: RSFSSTLLS (MAGC1_HUMAN)
RTFSSTLLH

SEQ ID NO: 80334 - protein, 9 aa, Artificial Sequence
  Description of Artificial Sequence: Synthetic peptide
  Seed: VSSFFSYTL (MAGC1_HUMAN)
VNSFFSYTY

SEQ ID NO: 80335 - protein, 9 aa, Artificial Sequence
  Description of Artificial Sequence: Synthetic peptide
  Seed: IIFIKGTYA (MAGC1_HUMAN)
ISFIKGTYK

SEQ ID NO: 80336 - protein, 9 aa, Artificial Sequence
  Description of Artificial Sequence: Synthetic peptide
  Seed: IIDTTDDST (MAGC1_HUMAN)
ILDTTDDSV

SEQ ID NO: 80337 - protein, 9 aa, Artificial Sequence
  Description of Artificial Sequence: Synthetic peptide
  Seed: SSPERTQST (MAGC1_HUMAN)
SVPERTQSY

SEQ ID NO: 80338 - protein, 10 aa, Artificial Sequence
  Description of Artificial Sequence: Synthetic peptide
  Seed: LAMLKNTVPI (MAGC1_HUMAN)
LWMLKNTVPY

SEQ ID NO: 80339 - protein, 9 aa, Artificial Sequence
  Description of Artificial Sequence: Synthetic peptide
  Seed: ATESASSSV (MAGC1_HUMAN)
ASESASSSL

SEQ ID NO: 80340 - protein, 9 aa, Artificial Sequence
  Description of Artificial Sequence: Synthetic peptide
  Seed: HYFPQSPPQ (MAGC1_HUMAN)
HFFPQSPPM

SEQ ID NO: 80341 - protein, 9 aa, Artificial Sequence
  Description of Artificial Sequence: Synthetic peptide
  Seed: SSPESAQSA (MAGC1_HUMAN)
SCPESAQSL

SEQ ID NO: 80342 - protein, 9 aa, Artificial Sequence
  Description of Artificial Sequence: Synthetic peptide
  Seed: FFSYTLASL (MAGC1_HUMAN)
FFSYTLASV

SEQ ID NO: 80343 - protein, 10 aa, Artificial Sequence
  Description of Artificial Sequence: Synthetic peptide
  Seed: RKVVEFLAML (MAGC1_HUMAN)
RKVVEFLAMI

SEQ ID NO: 80344 - protein, 10 aa, Artificial Sequence
  Description of Artificial Sequence: Synthetic peptide
  Seed: VPITFPSSYK (MAGC1_HUMAN)
VDITFPSSYR

SEQ ID NO: 80345 - protein, 10 aa, Artificial Sequence
  Description of Artificial Sequence: Synthetic peptide
  Seed: FFSYTLASLL (MAGC1_HUMAN)
FLSYTLASLQ

SEQ ID NO: 80346 - protein, 9 aa, Artificial Sequence
  Description of Artificial Sequence: Synthetic peptide
  Seed: LSDEQGMSQ (MAGC1_HUMAN)
LSDEQGMSI

SEQ ID NO: 80347 - protein, 9 aa, Artificial Sequence
  Description of Artificial Sequence: Synthetic peptide
  Seed: EGDDTQSPL (MAGC1_HUMAN)
ELDDTQSPL

SEQ ID NO: 80348 - protein, 9 aa, Artificial Sequence
  Description of Artificial Sequence: Synthetic peptide
  Seed: RSFSSTLLS (MAGC1_HUMAN)
RCFSSTLLK

SEQ ID NO: 80349 - protein, 9 aa, Artificial Sequence
  Description of Artificial Sequence: Synthetic peptide
  Seed: NSSPPRYEF (MAGC1_HUMAN)
NTSPPRYEF

SEQ ID NO: 80350 - protein, 8 aa, Artificial Sequence
  Description of Artificial Sequence: Synthetic peptide
  Seed: FSYTLASL (MAGC1_HUMAN)
FTYTLASF

SEQ ID NO: 80351 - protein, 10 aa, Artificial Sequence
  Description of Artificial Sequence: Synthetic peptide
  Seed: RPVSSFFSYT (MAGC1_HUMAN)
RQVSSFFSYK

SEQ ID NO: 80352 - protein, 9 aa, Artificial Sequence
  Description of Artificial Sequence: Synthetic peptide
  Seed: SSSTLLSLF (MAGC1_HUMAN)
SISTLLSLY

SEQ ID NO: 80353 - protein, 10 aa, Artificial Sequence
  Description of Artificial Sequence: Synthetic peptide
  Seed: ATESASSSVM (MAGC1_HUMAN)
ADESASSSVL

SEQ ID NO: 80354 - protein, 9 aa, Artificial Sequence
  Description of Artificial Sequence: Synthetic peptide
  Seed: STFEGFPQS (MAGC1_HUMAN)
SSFEGFPQY

SEQ ID NO: 80355 - protein, 10 aa, Artificial Sequence
  Description of Artificial Sequence: Synthetic peptide
  Seed: SSPERTHSTF (MAGC1_HUMAN)
SNPERTHSTL

SEQ ID NO: 80356 - protein, 9 aa, Artificial Sequence
  Description of Artificial Sequence: Synthetic peptide
  Seed: VSSFFSYTL (MAGC1_HUMAN)
VLSFFSYTA

SEQ ID NO: 80357 - protein, 9 aa, Artificial Sequence
  Description of Artificial Sequence: Synthetic peptide
  Seed: LQIPVSSSS (MAGC1_HUMAN)
LWIPVSSSW

SEQ ID NO: 80358 - protein, 9 aa, Artificial Sequence
  Description of Artificial Sequence: Synthetic peptide
  Seed: AGREHFAFG (MAGC1_HUMAN)
AMREHFAFV

SEQ ID NO: 80359 - protein, 10 aa, Artificial Sequence
  Description of Artificial Sequence: Synthetic peptide
  Seed: LQIPGSPSFS (MAGC1_HUMAN)
LQIPGSPSFN

SEQ ID NO: 80360 - protein, 10 aa, Artificial Sequence
  Description of Artificial Sequence: Synthetic peptide
  Seed: YTLLSLFQSS (MAGC1_HUMAN)
YSLLSLFQSI

SEQ ID NO: 80361 - protein, 10 aa, Artificial Sequence
  Description of Artificial Sequence: Synthetic peptide
  Seed: LLQIPMTSSF (MAGC1_HUMAN)
LYQIPMTSSM

SEQ ID NO: 80362 - protein, 10 aa, Artificial Sequence
  Description of Artificial Sequence: Synthetic peptide
  Seed: PLQIPGSPSF (MAGC1_HUMAN)
PHQIPGSPSY

SEQ ID NO: 80363 - protein, 9 aa, Artificial Sequence
  Description of Artificial Sequence: Synthetic peptide
  Seed: SFPSSTSSS (MAGC1_HUMAN)
SYPSSTSSM

SEQ ID NO: 80364 - protein, 9 aa, Artificial Sequence
  Description of Artificial Sequence: Synthetic peptide
  Seed: SIFQSSPER (MAGC1_HUMAN)
STFQSSPEL

SEQ ID NO: 80365 - protein, 11 aa, Artificial Sequence
  Description of Artificial Sequence: Synthetic peptide
  Seed: EILFGISLREV (MAGC1_HUMAN)
EMLFGISLREV

SEQ ID NO: 80366 - protein, 9 aa, Artificial Sequence
  Description of Artificial Sequence: Synthetic peptide
  Seed: FFSSALLSI (MAGC1_HUMAN)
FQSSALLSA

SEQ ID NO: 80367 - protein, 9 aa, Artificial Sequence
  Description of Artificial Sequence: Synthetic peptide
  Seed: EFIEILFGI (MAGC1_HUMAN)
ETIEILFGF

SEQ ID NO: 80368 - protein, 10 aa, Artificial Sequence
  Description of Artificial Sequence: Synthetic peptide
  Seed: REFIEILFGI (MAGC1_HUMAN)
RTFIEILFGI

SEQ ID NO: 80369 - protein, 9 aa, Artificial Sequence
  Description of Artificial Sequence: Synthetic peptide
  Seed: SPLQIPQSS (MAGC1_HUMAN)
SHLQIPQST

SEQ ID NO: 80370 - protein, 10 aa, Artificial Sequence
  Description of Artificial Sequence: Synthetic peptide
  Seed: RSFSSTLLSI (MAGC1_HUMAN)
RMFSSTLLSW

SEQ ID NO: 80371 - protein, 9 aa, Artificial Sequence
  Description of Artificial Sequence: Synthetic peptide
  Seed: FFSYTLASL (MAGC1_HUMAN)
FASYTLASW

SEQ ID NO: 80372 - protein, 10 aa, Artificial Sequence
  Description of Artificial Sequence: Synthetic peptide
  Seed: EMLTNVISRY (MAGC1_HUMAN)
ETLTNVISRL

SEQ ID NO: 80373 - protein, 9 aa, Artificial Sequence
  Description of Artificial Sequence: Synthetic peptide
  Seed: MTSSFSSTL (MAGC1_HUMAN)
MVSSFSSTK

SEQ ID NO: 80374 - protein, 9 aa, Artificial Sequence
  Description of Artificial Sequence: Synthetic peptide
  Seed: VISRYTGYF (MAGC1_HUMAN)
VASRYTGYW

SEQ ID NO: 80375 - protein, 9 aa, Artificial Sequence
  Description of Artificial Sequence: Synthetic peptide
  Seed: SIFQSSPER (MAGC1_HUMAN)
SVFQSSPEL

SEQ ID NO: 80376 - protein, 9 aa, Artificial Sequence
  Description of Artificial Sequence: Synthetic peptide
  Seed: VSSSSSSTL (MAGC1_HUMAN)
VSSSSSSTM

SEQ ID NO: 80377 - protein, 10 aa, Artificial Sequence
  Description of Artificial Sequence: Synthetic peptide
  Seed: STPSSLPQSF (MAGC1_HUMAN)
STPSSLPQSM

SEQ ID NO: 80378 - protein, 9 aa, Artificial Sequence
  Description of Artificial Sequence: Synthetic peptide
  Seed: SSSTSLSPF (MAGC1_HUMAN)
SFSTSLSPY

SEQ ID NO: 80379 - protein, 9 aa, Artificial Sequence
  Description of Artificial Sequence: Synthetic peptide
  Seed: FSYTLASLL (MAGC1_HUMAN)
FLYTLASLL

SEQ ID NO: 80380 - protein, 9 aa, Artificial Sequence
  Description of Artificial Sequence: Synthetic peptide
  Seed: SSPERTHST (MAGC1_HUMAN)
SFPERTHSI

SEQ ID NO: 80381 - protein, 9 aa, Artificial Sequence
  Description of Artificial Sequence: Synthetic peptide
  Seed: FLAMLKNTV (MAGC1_HUMAN)
FTAMLKNTM

SEQ ID NO: 80382 - protein, 10 aa, Artificial Sequence
  Description of Artificial Sequence: Synthetic peptide
  Seed: STPSSLPQSF (MAGC1_HUMAN)
SYPSSLPQSI

SEQ ID NO: 80383 - protein, 9 aa, Artificial Sequence
  Description of Artificial Sequence: Synthetic peptide
  Seed: KVDELARFL (MAGC1_HUMAN)
KFDELARFM

SEQ ID NO: 80384 - protein, 11 aa, Artificial Sequence
  Description of Artificial Sequence: Synthetic peptide
  Seed: RPVSSFFSYTL (MAGC1_HUMAN)
RYVSSFFSYTF

SEQ ID NO: 80385 - protein, 9 aa, Artificial Sequence
  Description of Artificial Sequence: Synthetic peptide
  Seed: TLLSLFQSF (MAGC1_HUMAN)
TYLSLFQSI

SEQ ID NO: 80386 - protein, 9 aa, Artificial Sequence
  Description of Artificial Sequence: Synthetic peptide
  Seed: SPPQGEDSM (MAGC1_HUMAN)
SSPQGEDSM

SEQ ID NO: 80387 - protein, 11 aa, Artificial Sequence
  Description of Artificial Sequence: Synthetic peptide
  Seed: SSSSSSTLLSL (MAGC1_HUMAN)
SCSSSSTLLSW

SEQ ID NO: 80388 - protein, 9 aa, Artificial Sequence
  Description of Artificial Sequence: Synthetic peptide
  Seed: KVWVQEHYL (MAGC1_HUMAN)
KSWVQEHYW

SEQ ID NO: 80389 - protein, 11 aa, Artificial Sequence
  Description of Artificial Sequence: Synthetic peptide
  Seed: LQIPMTSSFSS (MAGC1_HUMAN)
LQIPMTSSFSF

SEQ ID NO: 80390 - protein, 10 aa, Artificial Sequence
  Description of Artificial Sequence: Synthetic peptide
  Seed: YTLDEKVDEL (MAGC1_HUMAN)
YQLDEKVDEF

SEQ ID NO: 80391 - protein, 9 aa, Artificial Sequence
  Description of Artificial Sequence: Synthetic peptide
  Seed: EDSLSPLHF (MAGC1_HUMAN)
EESLSPLHW

SEQ ID NO: 80392 - protein, 9 aa, Artificial Sequence
  Description of Artificial Sequence: Synthetic peptide
  Seed: LQRPVSSFF (MAGC1_HUMAN)
LWRPVSSFY

SEQ ID NO: 80393 - protein, 10 aa, Artificial Sequence
  Description of Artificial Sequence: Synthetic peptide
  Seed: STFEGFPQSL (MAGC1_HUMAN)
SPFEGFPQSA

SEQ ID NO: 80394 - protein, 9 aa, Artificial Sequence
  Description of Artificial Sequence: Synthetic peptide
  Seed: LQIPGSPSF (MAGC1_HUMAN)
LAIPGSPSV

SEQ ID NO: 80395 - protein, 8 aa, Artificial Sequence
  Description of Artificial Sequence: Synthetic peptide
  Seed: SFFSSALL (MAGC1_HUMAN)
SFFSSALM

SEQ ID NO: 80396 - protein, 10 aa, Artificial Sequence
  Description of Artificial Sequence: Synthetic peptide
  Seed: ESAQSTFEGF (MAGC1_HUMAN)
EIAQSTFEGR

SEQ ID NO: 80397 - protein, 10 aa, Artificial Sequence
  Description of Artificial Sequence: Synthetic peptide
  Seed: SSPECTQSTF (MAGC1_HUMAN)
SLPECTQSTL

SEQ ID NO: 80398 - protein, 10 aa, Artificial Sequence
  Description of Artificial Sequence: Synthetic peptide
  Seed: NRLLILILSI (MAGC1_HUMAN)
NLLLILILSV

SEQ ID NO: 80399 - protein, 10 aa, Artificial Sequence
  Description of Artificial Sequence: Synthetic peptide
  Seed: AEMLTNVISR (MAGC1_HUMAN)
AYMLTNVISR

SEQ ID NO: 80400 - protein, 9 aa, Artificial Sequence
  Description of Artificial Sequence: Synthetic peptide
  Seed: LQIPGSPSF (MAGC1_HUMAN)
LPIPGSPSI

SEQ ID NO: 80401 - protein, 9 aa, Artificial Sequence
  Description of Artificial Sequence: Synthetic peptide
  Seed: FSSTLLSLF (MAGC1_HUMAN)
FVSTLLSLM

SEQ ID NO: 80402 - protein, 11 aa, Artificial Sequence
  Description of Artificial Sequence: Synthetic peptide
  Seed: AIIDTTDDSTA (MAGC1_HUMAN)
AIIDTTDDSTL

SEQ ID NO: 80403 - protein, 9 aa, Artificial Sequence
  Description of Artificial Sequence: Synthetic peptide
  Seed: FSSALLSIF (MAGC1_HUMAN)
FTSALLSIV

SEQ ID NO: 80404 - protein, 9 aa, Artificial Sequence
  Description of Artificial Sequence: Synthetic peptide
  Seed: SSFPSSTSS (MAGC1_HUMAN)
SVFPSSTSH

SEQ ID NO: 80405 - protein, 10 aa, Artificial Sequence
  Description of Artificial Sequence: Synthetic peptide
  Seed: PLQIPGSPSF (MAGC1_HUMAN)
PAQIPGSPSY

SEQ ID NO: 80406 - protein, 9 aa, Artificial Sequence
  Description of Artificial Sequence: Synthetic peptide
  Seed: TLDEKVDEL (MAGC1_HUMAN)
TQDEKVDEL

SEQ ID NO: 80407 - protein, 9 aa, Artificial Sequence
  Description of Artificial Sequence: Synthetic peptide
  Seed: SAPEGEDSL (MAGC1_HUMAN)
SVPEGEDSI

SEQ ID NO: 80408 - protein, 9 aa, Artificial Sequence
  Description of Artificial Sequence: Synthetic peptide
  Seed: QVKQPITKA (MAGC1_HUMAN)
QAKQPITKL

SEQ ID NO: 80409 - protein, 10 aa, Artificial Sequence
  Description of Artificial Sequence: Synthetic peptide
  Seed: RAGREHFAFG (MAGC1_HUMAN)
RFGREHFAFM

SEQ ID NO: 80410 - protein, 9 aa, Artificial Sequence
  Description of Artificial Sequence: Synthetic peptide
  Seed: FQSSPERTH (MAGC1_HUMAN)
FVSSPERTY

SEQ ID NO: 80411 - protein, 9 aa, Artificial Sequence
  Description of Artificial Sequence: Synthetic peptide
  Seed: KAEMLTNVI (MAGC1_HUMAN)
KSEMLTNVW

SEQ ID NO: 80412 - protein, 9 aa, Artificial Sequence
  Description of Artificial Sequence: Synthetic peptide
  Seed: VIWDVLSGI (MAGC1_HUMAN)
VMWDVLSGT

SEQ ID NO: 80413 - protein, 9 aa, Artificial Sequence
  Description of Artificial Sequence: Synthetic peptide
  Seed: LTKVWVQEH (MAGC1_HUMAN)
LAKVWVQEM

SEQ ID NO: 80414 - protein, 9 aa, Artificial Sequence
  Description of Artificial Sequence: Synthetic peptide
  Seed: RTQSTFEGF (MAGC1_HUMAN)
RWQSTFEGW

SEQ ID NO: 80415 - protein, 9 aa, Artificial Sequence
  Description of Artificial Sequence: Synthetic peptide
  Seed: VSPSFSSTL (MAGC1_HUMAN)
VYPSFSSTL

SEQ ID NO: 80416 - protein, 9 aa, Artificial Sequence
  Description of Artificial Sequence: Synthetic peptide
  Seed: SSPEGKDSL (MAGC1_HUMAN)
SMPEGKDSY

SEQ ID NO: 80417 - protein, 9 aa, Artificial Sequence
  Description of Artificial Sequence: Synthetic peptide
  Seed: SAASSSTLV (MAGC1_HUMAN)
STASSSTLA

SEQ ID NO: 80418 - protein, 9 aa, Artificial Sequence
  Description of Artificial Sequence: Synthetic peptide
  Seed: SLFQSFSER (MAGC1_HUMAN)
SQFQSFSEY

SEQ ID NO: 80419 - protein, 9 aa, Artificial Sequence
  Description of Artificial Sequence: Synthetic peptide
  Seed: FFSSALLSI (MAGC1_HUMAN)
FQSSALLSL

SEQ ID NO: 80420 - protein, 9 aa, Artificial Sequence
  Description of Artificial Sequence: Synthetic peptide
  Seed: GFPQSPLQI (MAGC1_HUMAN)
GIPQSPLQL

SEQ ID NO: 80421 - protein, 10 aa, Artificial Sequence
  Description of Artificial Sequence: Synthetic peptide
  Seed: REFIEILFGI (MAGC1_HUMAN)
RLFIEILFGT

SEQ ID NO: 80422 - protein, 9 aa, Artificial Sequence
  Description of Artificial Sequence: Synthetic peptide
  Seed: IPVSSSFSY (MAGC1_HUMAN)
IPVSSSFSF

SEQ ID NO: 80423 - protein, 9 aa, Artificial Sequence
  Description of Artificial Sequence: Synthetic peptide
  Seed: FSSTLLSIL (MAGC1_HUMAN)
FRSTLLSIY

SEQ ID NO: 80424 - protein, 11 aa, Artificial Sequence
  Description of Artificial Sequence: Synthetic peptide
  Seed: SFFSYTLASLL (MAGC1_HUMAN)
SMFSYTLASLY

SEQ ID NO: 80425 - protein, 9 aa, Artificial Sequence
  Description of Artificial Sequence: Synthetic peptide
  Seed: VIFRKAREF (MAGC1_HUMAN)
VLFRKAREY

SEQ ID NO: 80426 - protein, 8 aa, Artificial Sequence
  Description of Artificial Sequence: Synthetic peptide
  Seed: SSPPRYEF (MAGC1_HUMAN)
SFPPRYEY

SEQ ID NO: 80427 - protein, 9 aa, Artificial Sequence
  Description of Artificial Sequence: Synthetic peptide
  Seed: STFEGFAQS (MAGC1_HUMAN)
SLFEGFAQT

SEQ ID NO: 80428 - protein, 10 aa, Artificial Sequence
  Description of Artificial Sequence: Synthetic peptide
  Seed: FAQSSLQIPV (MAGC1_HUMAN)
FRQSSLQIPI

SEQ ID NO: 80429 - protein, 10 aa, Artificial Sequence
  Description of Artificial Sequence: Synthetic peptide
  Seed: ICSSSTPSSL (MAGC1_HUMAN)
IQSSSTPSSF

SEQ ID NO: 80430 - protein, 9 aa, Artificial Sequence
  Description of Artificial Sequence: Synthetic peptide
  Seed: FAFGEPREL (MAGC1_HUMAN)
FKFGEPREM

SEQ ID NO: 80431 - protein, 8 aa, Artificial Sequence
  Description of Artificial Sequence: Synthetic peptide
  Seed: FSSTLLSL (MAGC1_HUMAN)
FQSTLLSI

SEQ ID NO: 80432 - protein, 9 aa, Artificial Sequence
  Description of Artificial Sequence: Synthetic peptide
  Seed: CSSSTSLSL (MAGC1_HUMAN)
CQSSTSLSV

SEQ ID NO: 80433 - protein, 11 aa, Artificial Sequence
  Description of Artificial Sequence: Synthetic peptide
  Seed: SICSSSTSLSL (MAGC1_HUMAN)
SQCSSSTSLSY

SEQ ID NO: 80434 - protein, 10 aa, Artificial Sequence
  Description of Artificial Sequence: Synthetic peptide
  Seed: SSSSSTLLSL (MAGC1_HUMAN)
SQSSSTLLSV

SEQ ID NO: 80435 - protein, 11 aa, Artificial Sequence
  Description of Artificial Sequence: Synthetic peptide
  Seed: KRKVVEFLAML (MAGC1_HUMAN)
KFKVVEFLAMV

SEQ ID NO: 80436 - protein, 9 aa, Artificial Sequence
  Description of Artificial Sequence: Synthetic peptide
  Seed: TLLSLFQSF (MAGC1_HUMAN)
TFLSLFQSL

SEQ ID NO: 80437 - protein, 10 aa, Artificial Sequence
  Description of Artificial Sequence: Synthetic peptide
  Seed: LQRPVSSFFS (MAGC1_HUMAN)
LQRPVSSFFY

SEQ ID NO: 80438 - protein, 9 aa, Artificial Sequence
  Description of Artificial Sequence: Synthetic peptide
  Seed: DVLSGIGVR (MAGC1_HUMAN)
DYLSGIGVR

SEQ ID NO: 80439 - protein, 9 aa, Artificial Sequence
  Description of Artificial Sequence: Synthetic peptide
  Seed: VSSFFSYTL (MAGC1_HUMAN)
VNSFFSYTF

SEQ ID NO: 80440 - protein, 9 aa, Artificial Sequence
  Description of Artificial Sequence: Synthetic peptide
  Seed: SSLSQSSPV (MAGC1_HUMAN)
SMLSQSSPA

SEQ ID NO: 80441 - protein, 9 aa, Artificial Sequence
  Description of Artificial Sequence: Synthetic peptide
  Seed: IIFIKGTYA (MAGC1_HUMAN)
ILFIKGTYL

SEQ ID NO: 80442 - protein, 9 aa, Artificial Sequence
  Description of Artificial Sequence: Synthetic peptide
  Seed: FSYTLASLL (MAGC1_HUMAN)
FHYTLASLF

SEQ ID NO: 80443 - protein, 9 aa, Artificial Sequence
  Description of Artificial Sequence: Synthetic peptide
  Seed: TLASLLQSS (MAGC1_HUMAN)
TLASLLQST

SEQ ID NO: 80444 - protein, 9 aa, Artificial Sequence
  Description of Artificial Sequence: Synthetic peptide
  Seed: HFPQSPPEW (MAGC1_HUMAN)
HTPQSPPEY

SEQ ID NO: 80445 - protein, 9 aa, Artificial Sequence
  Description of Artificial Sequence: Synthetic peptide
  Seed: SPPEGENTH (MAGC1_HUMAN)
SAPEGENTY

SEQ ID NO: 80446 - protein, 9 aa, Artificial Sequence
  Description of Artificial Sequence: Synthetic peptide
  Seed: THSPLQIVP (MAGC1_HUMAN)
THSPLQIVI

SEQ ID NO: 80447 - protein, 11 aa, Artificial Sequence
  Description of Artificial Sequence: Synthetic peptide
  Seed: LQIPVSSSFSY (MAGC1_HUMAN)
LHIPVSSSFSM

SEQ ID NO: 80448 - protein, 11 aa, Artificial Sequence
  Description of Artificial Sequence: Synthetic peptide
  Seed: SSFPSSTSSSL (MAGC1_HUMAN)
SHFPSSTSSSY

SEQ ID NO: 80449 - protein, 10 aa, Artificial Sequence
  Description of Artificial Sequence: Synthetic peptide
  Seed: YTLASLLQSS (MAGC1_HUMAN)
YFLASLLQSA

SEQ ID NO: 80450 - protein, 10 aa, Artificial Sequence
  Description of Artificial Sequence: Synthetic peptide
  Seed: FFSYTLASLL (MAGC1_HUMAN)
FVSYTLASLI

SEQ ID NO: 80451 - protein, 9 aa, Artificial Sequence
  Description of Artificial Sequence: Synthetic peptide
  Seed: AQSSLQIPV (MAGC1_HUMAN)
AQSSLQIPY

SEQ ID NO: 80452 - protein, 11 aa, Artificial Sequence
  Description of Artificial Sequence: Synthetic peptide
  Seed: SPLQIPVSSSS (MAGC1_HUMAN)
SQLQIPVSSSY

SEQ ID NO: 80453 - protein, 10 aa, Artificial Sequence
  Description of Artificial Sequence: Synthetic peptide
  Seed: SSFSSTLLSI (MAGC1_HUMAN)
SNFSSTLLSW

SEQ ID NO: 80454 - protein, 9 aa, Artificial Sequence
  Description of Artificial Sequence: Synthetic peptide
  Seed: SLFQSFSER (MAGC1_HUMAN)
SWFQSFSEY

SEQ ID NO: 80455 - protein, 11 aa, Artificial Sequence
  Description of Artificial Sequence: Synthetic peptide
  Seed: IPMTSSFSSTL (MAGC1_HUMAN)
IAMTSSFSSTW

SEQ ID NO: 80456 - protein, 10 aa, Artificial Sequence
  Description of Artificial Sequence: Synthetic peptide
  Seed: SLFQSFSERT (MAGC1_HUMAN)
SMFQSFSERV

SEQ ID NO: 80457 - protein, 9 aa, Artificial Sequence
  Description of Artificial Sequence: Synthetic peptide
  Seed: FSSTLVSLF (MAGC1_HUMAN)
FKSTLVSLM

SEQ ID NO: 80458 - protein, 9 aa, Artificial Sequence
  Description of Artificial Sequence: Synthetic peptide
  Seed: VSPSSSSTL (MAGC1_HUMAN)
VMPSSSSTY

SEQ ID NO: 80459 - protein, 10 aa, Artificial Sequence
  Description of Artificial Sequence: Synthetic peptide
  Seed: SPLQIPQSPP (MAGC1_HUMAN)
SPLQIPQSPI

SEQ ID NO: 80460 - protein, 9 aa, Artificial Sequence
  Description of Artificial Sequence: Synthetic peptide
  Seed: SPESAQSTF (MAGC1_HUMAN)
SPESAQSTM

SEQ ID NO: 80461 - protein, 9 aa, Artificial Sequence
  Description of Artificial Sequence: Synthetic peptide
  Seed: REFIEILFG (MAGC1_HUMAN)
REFIEILFI

SEQ ID NO: 80462 - protein, 10 aa, Artificial Sequence
  Description of Artificial Sequence: Synthetic peptide
  Seed: STPSSLPQSF (MAGC1_HUMAN)
SIPSSLPQSI

SEQ ID NO: 80463 - protein, 9 aa, Artificial Sequence
  Description of Artificial Sequence: Synthetic peptide
  Seed: MLTNVISRY (MAGC1_HUMAN)
MATNVISRM

SEQ ID NO: 80464 - protein, 9 aa, Artificial Sequence
  Description of Artificial Sequence: Synthetic peptide
  Seed: FQSSLQSPV (MAGC1_HUMAN)
FASSLQSPH

SEQ ID NO: 80465 - protein, 9 aa, Artificial Sequence
  Description of Artificial Sequence: Synthetic peptide
  Seed: SPLQIPQSS (MAGC1_HUMAN)
SHLQIPQSP

SEQ ID NO: 80466 - protein, 10 aa, Artificial Sequence
  Description of Artificial Sequence: Synthetic peptide
  Seed: SPLQSPVSSF (MAGC1_HUMAN)
SHLQSPVSSF

SEQ ID NO: 80467 - protein, 10 aa, Artificial Sequence
  Description of Artificial Sequence: Synthetic peptide
  Seed: KGTYASEEVI (MAGC1_HUMAN)
KATYASEEVY

SEQ ID NO: 80468 - protein, 10 aa, Artificial Sequence
  Description of Artificial Sequence: Synthetic peptide
  Seed: VSSSSSSTLL (MAGC1_HUMAN)
VHSSSSSTLW

SEQ ID NO: 80469 - protein, 9 aa, Artificial Sequence
  Description of Artificial Sequence: Synthetic peptide
  Seed: LQIPGSPSF (MAGC1_HUMAN)
LTIPGSPSL

SEQ ID NO: 80470 - protein, 10 aa, Artificial Sequence
  Description of Artificial Sequence: Synthetic peptide
  Seed: SPLQIPMTSS (MAGC1_HUMAN)
SPLQIPMTSL

SEQ ID NO: 80471 - protein, 10 aa, Artificial Sequence
  Description of Artificial Sequence: Synthetic peptide
  Seed: ASSSTLVSIF (MAGC1_HUMAN)
AISSTLVSIW

SEQ ID NO: 80472 - protein, 9 aa, Artificial Sequence
  Description of Artificial Sequence: Synthetic peptide
  Seed: FSSTLLSLF (MAGC1_HUMAN)
FNSTLLSLW

SEQ ID NO: 80473 - protein, 9 aa, Artificial Sequence
  Description of Artificial Sequence: Synthetic peptide
  Seed: FAFGEPREL (MAGC1_HUMAN)
FPFGEPREV

SEQ ID NO: 80474 - protein, 10 aa, Artificial Sequence
  Description of Artificial Sequence: Synthetic peptide
  Seed: ESAQSAFEGF (MAGC1_HUMAN)
EVAQSAFEGR

SEQ ID NO: 80475 - protein, 10 aa, Artificial Sequence
  Description of Artificial Sequence: Synthetic peptide
  Seed: FPQSLLQIPM (MAGC1_HUMAN)
FHQSLLQIPV

SEQ ID NO: 80476 - protein, 10 aa, Artificial Sequence
  Description of Artificial Sequence: Synthetic peptide
  Seed: VSSSFSYTLL (MAGC1_HUMAN)
VTSSFSYTLM

SEQ ID NO: 80477 - protein, 9 aa, Artificial Sequence
  Description of Artificial Sequence: Synthetic peptide
  Seed: FAFGEPREL (MAGC1_HUMAN)
FNFGEPREY

SEQ ID NO: 80478 - protein, 9 aa, Artificial Sequence
  Description of Artificial Sequence: Synthetic peptide
  Seed: SSSSSSTLL (MAGC1_HUMAN)
SASSSSTLM

SEQ ID NO: 80479 - protein, 10 aa, Artificial Sequence
  Description of Artificial Sequence: Synthetic peptide
  Seed: ICSSSTSLSL (MAGC1_HUMAN)
IRSSSTSLSM

SEQ ID NO: 80480 - protein, 10 aa, Artificial Sequence
  Description of Artificial Sequence: Synthetic peptide
  Seed: FFSYTLASLL (MAGC1_HUMAN)
FFSYTLASLM

SEQ ID NO: 80481 - protein, 10 aa, Artificial Sequence
  Description of Artificial Sequence: Synthetic peptide
  Seed: SLFQSSPERT (MAGC1_HUMAN)
SMFQSSPERL

SEQ ID NO: 80482 - protein, 9 aa, Artificial Sequence
  Description of Artificial Sequence: Synthetic peptide
  Seed: LQIPMTSSF (MAGC1_HUMAN)
LMIPMTSSW

SEQ ID NO: 80483 - protein, 9 aa, Artificial Sequence
  Description of Artificial Sequence: Synthetic peptide
  Seed: SLSPFSEES (MAGC1_HUMAN)
SQSPFSEEI

SEQ ID NO: 80484 - protein, 10 aa, Artificial Sequence
  Description of Artificial Sequence: Synthetic peptide
  Seed: FPQSLLQIPM (MAGC1_HUMAN)
FEQSLLQIPF

SEQ ID NO: 80485 - protein, 10 aa, Artificial Sequence
  Description of Artificial Sequence: Synthetic peptide
  Seed: EVDPDDSYVF (MAGC1_HUMAN)
EADPDDSYVY

SEQ ID NO: 80486 - protein, 10 aa, Artificial Sequence
  Description of Artificial Sequence: Synthetic peptide
  Seed: REFIEILFGI (MAGC1_HUMAN)
RAFIEILFGA

SEQ ID NO: 80487 - protein, 9 aa, Artificial Sequence
  Description of Artificial Sequence: Synthetic peptide
  Seed: KDSLSPLEI (MAGC1_HUMAN)
KMSLSPLEF

SEQ ID NO: 80488 - protein, 9 aa, Artificial Sequence
  Description of Artificial Sequence: Synthetic peptide
  Seed: QSPLQGEEF (MAGC1_HUMAN)
QYPLQGEEF

SEQ ID NO: 80489 - protein, 9 aa, Artificial Sequence
  Description of Artificial Sequence: Synthetic peptide
  Seed: YQVKQPITK (MAGC1_HUMAN)
YVVKQPITV

SEQ ID NO: 80490 - protein, 11 aa, Artificial Sequence
  Description of Artificial Sequence: Synthetic peptide
  Seed: STFEGFPQSLL (MAGC1_HUMAN)
SMFEGFPQSLV

SEQ ID NO: 80491 - protein, 9 aa, Artificial Sequence
  Description of Artificial Sequence: Synthetic peptide
  Seed: SFSERTQST (MAGC1_HUMAN)
SWSERTQSF

SEQ ID NO: 80492 - protein, 9 aa, Artificial Sequence
  Description of Artificial Sequence: Synthetic peptide
  Seed: TTDDSTATE (MAGC1_HUMAN)
TCDDSTATI

SEQ ID NO: 80493 - protein, 10 aa, Artificial Sequence
  Description of Artificial Sequence: Synthetic peptide
  Seed: FLAMLKNTVP (MAGC1_HUMAN)
FLAMLKNTVA

SEQ ID NO: 80494 - protein, 9 aa, Artificial Sequence
  Description of Artificial Sequence: Synthetic peptide
  Seed: SLIESEPLF (MAGC1_HUMAN)
SQIESEPLF

SEQ ID NO: 80495 - protein, 9 aa, Artificial Sequence
  Description of Artificial Sequence: Synthetic peptide
  Seed: FPSSYKDAL (MAGC1_HUMAN)
FASSYKDAY

SEQ ID NO: 80496 - protein, 9 aa, Artificial Sequence
  Description of Artificial Sequence: Synthetic peptide
  Seed: MTSSFSSTL (MAGC1_HUMAN)
MSSSFSSTV

SEQ ID NO: 80497 - protein, 9 aa, Artificial Sequence
  Description of Artificial Sequence: Synthetic peptide
  Seed: REHFAFGEP (MAGC1_HUMAN)
REHFAFGEF

SEQ ID NO: 80498 - protein, 11 aa, Artificial Sequence
  Description of Artificial Sequence: Synthetic peptide
  Seed: SSFSSTLLSIF (MAGC1_HUMAN)
SVFSSTLLSIY

SEQ ID NO: 80499 - protein, 9 aa, Artificial Sequence
  Description of Artificial Sequence: Synthetic peptide
  Seed: FSSTLVSLF (MAGC1_HUMAN)
FESTLVSLY

SEQ ID NO: 80500 - protein, 9 aa, Artificial Sequence
  Description of Artificial Sequence: Synthetic peptide
  Seed: MGDKDMPTA (MAGC1_HUMAN)
MFDKDMPTV

SEQ ID NO: 80501 - protein, 9 aa, Artificial Sequence
  Description of Artificial Sequence: Synthetic peptide
  Seed: GEDSLSPHY (MAGC1_HUMAN)
GADSLSPHY

SEQ ID NO: 80502 - protein, 9 aa, Artificial Sequence
  Description of Artificial Sequence: Synthetic peptide
  Seed: SSPESAQSA (MAGC1_HUMAN)
SSPESAQSM

SEQ ID NO: 80503 - protein, 9 aa, Artificial Sequence
  Description of Artificial Sequence: Synthetic peptide
  Seed: FSYTLASLL (MAGC1_HUMAN)
FLYTLASLM

SEQ ID NO: 80504 - protein, 10 aa, Artificial Sequence
  Description of Artificial Sequence: Synthetic peptide
  Seed: STFEGFPQSL (MAGC1_HUMAN)
STFEGFPQSF

SEQ ID NO: 80505 - protein, 9 aa, Artificial Sequence
  Description of Artificial Sequence: Synthetic peptide
  Seed: TGYFPVIFR (MAGC1_HUMAN)
TVYFPVIFK

SEQ ID NO: 80506 - protein, 9 aa, Artificial Sequence
  Description of Artificial Sequence: Synthetic peptide
  Seed: QPITKAEML (MAGC1_HUMAN)
QAITKAEMY

SEQ ID NO: 80507 - protein, 9 aa, Artificial Sequence
  Description of Artificial Sequence: Synthetic peptide
  Seed: AQSSLQIPV (MAGC1_HUMAN)
AISSLQIPY

SEQ ID NO: 80508 - protein, 10 aa, Artificial Sequence
  Description of Artificial Sequence: Synthetic peptide
  Seed: FFSSALLSIF (MAGC1_HUMAN)
FISSALLSIW

SEQ ID NO: 80509 - protein, 9 aa, Artificial Sequence
  Description of Artificial Sequence: Synthetic peptide
  Seed: STFEGFAQS (MAGC1_HUMAN)
STFEGFAQL

SEQ ID NO: 80510 - protein, 10 aa, Artificial Sequence
  Description of Artificial Sequence: Synthetic peptide
  Seed: IESEPLFTYT (MAGC1_HUMAN)
IESEPLFTYI

SEQ ID NO: 80511 - protein, 10 aa, Artificial Sequence
  Description of Artificial Sequence: Synthetic peptide
  Seed: TGYFPVIFRK (MAGC1_HUMAN)
TVYFPVIFRA

SEQ ID NO: 80512 - protein, 11 aa, Artificial Sequence
  Description of Artificial Sequence: Synthetic peptide
  Seed: IPVSSSSSSTL (MAGC1_HUMAN)
IDVSSSSSSTW

SEQ ID NO: 80513 - protein, 10 aa, Artificial Sequence
  Description of Artificial Sequence: Synthetic peptide
  Seed: MSQNRLLILI (MAGC1_HUMAN)
MAQNRLLILV

SEQ ID NO: 80514 - protein, 9 aa, Artificial Sequence
  Description of Artificial Sequence: Synthetic peptide
  Seed: LSPLHFPQF (MAGC1_HUMAN)
LQPLHFPQV

SEQ ID NO: 80515 - protein, 10 aa, Artificial Sequence
  Description of Artificial Sequence: Synthetic peptide
  Seed: FSSTLVSLFQ (MAGC1_HUMAN)
FTSTLVSLFF

SEQ ID NO: 80516 - protein, 10 aa, Artificial Sequence
  Description of Artificial Sequence: Synthetic peptide
  Seed: YTLDEKVDEL (MAGC1_HUMAN)
YKLDEKVDEL

SEQ ID NO: 80517 - protein, 9 aa, Artificial Sequence
  Description of Artificial Sequence: Synthetic peptide
  Seed: STQSPFEGF (MAGC1_HUMAN)
SYQSPFEGV

SEQ ID NO: 80518 - protein, 9 aa, Artificial Sequence
  Description of Artificial Sequence: Synthetic peptide
  Seed: IIDTTDDST (MAGC1_HUMAN)
ISDTTDDSF

SEQ ID NO: 80519 - protein, 9 aa, Artificial Sequence
  Description of Artificial Sequence: Synthetic peptide
  Seed: SPLQNPASS (MAGC1_HUMAN)
SPLQNPAST

SEQ ID NO: 80520 - protein, 9 aa, Artificial Sequence
  Description of Artificial Sequence: Synthetic peptide
  Seed: VSSSSSSTL (MAGC1_HUMAN)
VLSSSSSTL

SEQ ID NO: 80521 - protein, 9 aa, Artificial Sequence
  Description of Artificial Sequence: Synthetic peptide
  Seed: LFGISLREV (MAGC1_HUMAN)
LYGISLREL

SEQ ID NO: 80522 - protein, 9 aa, Artificial Sequence
  Description of Artificial Sequence: Synthetic peptide
  Seed: WVQEHYLEY (MAGC1_HUMAN)
WTQEHYLEF

SEQ ID NO: 80523 - protein, 11 aa, Artificial Sequence
  Description of Artificial Sequence: Synthetic peptide
  Seed: SPLQIPGSPSF (MAGC1_HUMAN)
SKLQIPGSPSY

SEQ ID NO: 80524 - protein, 9 aa, Artificial Sequence
  Description of Artificial Sequence: Synthetic peptide
  Seed: SICSSSTSL (MAGC1_HUMAN)
SQCSSSTSL

SEQ ID NO: 80525 - protein, 11 aa, Artificial Sequence
  Description of Artificial Sequence: Synthetic peptide
  Seed: SQSPLQSPESA (MAGC1_HUMAN)
SESPLQSPESL

SEQ ID NO: 80526 - protein, 10 aa, Artificial Sequence
  Description of Artificial Sequence: Synthetic peptide
  Seed: QGEDSMSPLY (MAGC1_HUMAN)
QTEDSMSPLW

SEQ ID NO: 80527 - protein, 9 aa, Artificial Sequence
  Description of Artificial Sequence: Synthetic peptide
  Seed: RLLILILSI (MAGC1_HUMAN)
RTLILILSM

SEQ ID NO: 80528 - protein, 9 aa, Artificial Sequence
  Description of Artificial Sequence: Synthetic peptide
  Seed: TLDEKVDEL (MAGC1_HUMAN)
TADEKVDEF

SEQ ID NO: 80529 - protein, 9 aa, Artificial Sequence
  Description of Artificial Sequence: Synthetic peptide
  Seed: FAFGEPREL (MAGC1_HUMAN)
FGFGEPREY

SEQ ID NO: 80530 - protein, 11 aa, Artificial Sequence
  Description of Artificial Sequence: Synthetic peptide
  Seed: STFEGFAQSPL (MAGC1_HUMAN)
SIFEGFAQSPV

SEQ ID NO: 80531 - protein, 10 aa, Artificial Sequence
  Description of Artificial Sequence: Synthetic peptide
  Seed: LQIPVSSSFS (MAGC1_HUMAN)
LKIPVSSSFF

SEQ ID NO: 80532 - protein, 9 aa, Artificial Sequence
  Description of Artificial Sequence: Synthetic peptide
  Seed: SPLEISQSP (MAGC1_HUMAN)
SALEISQSL

SEQ ID NO: 80533 - protein, 10 aa, Artificial Sequence
  Description of Artificial Sequence: Synthetic peptide
  Seed: RYTGYFPVIF (MAGC1_HUMAN)
RMTGYFPVIW

SEQ ID NO: 80534 - protein, 10 aa, Artificial Sequence
  Description of Artificial Sequence: Synthetic peptide
  Seed: SSSSSSSTLL (MAGC1_HUMAN)
SCSSSSSTLW

SEQ ID NO: 80535 - protein, 9 aa, Artificial Sequence
  Description of Artificial Sequence: Synthetic peptide
  Seed: ELARFLLLK (MAGC1_HUMAN)
EFARFLLLR

SEQ ID NO: 80536 - protein, 10 aa, Artificial Sequence
  Description of Artificial Sequence: Synthetic peptide
  Seed: FSSSTSLSPF (MAGC1_HUMAN)
FPSSTSLSPH

SEQ ID NO: 80537 - protein, 9 aa, Artificial Sequence
  Description of Artificial Sequence: Synthetic peptide
  Seed: AMLKNTVPI (MAGC1_HUMAN)
ARLKNTVPF

SEQ ID NO: 80538 - protein, 9 aa, Artificial Sequence
  Description of Artificial Sequence: Synthetic peptide
  Seed: SKSSPESPL (MAGC1_HUMAN)
SMSSPESPL

SEQ ID NO: 80539 - protein, 9 aa, Artificial Sequence
  Description of Artificial Sequence: Synthetic peptide
  Seed: EDSLSSLHF (MAGC1_HUMAN)
EESLSSLHY

SEQ ID NO: 80540 - protein, 10 aa, Artificial Sequence
  Description of Artificial Sequence: Synthetic peptide
  Seed: RSFSSTLLSI (MAGC1_HUMAN)
RHFSSTLLSW

SEQ ID NO: 80541 - protein, 10 aa, Artificial Sequence
  Description of Artificial Sequence: Synthetic peptide
  Seed: RKVVEFLAML (MAGC1_HUMAN)
RTVVEFLAMI

SEQ ID NO: 80542 - protein, 9 aa, Artificial Sequence
  Description of Artificial Sequence: Synthetic peptide
  Seed: LQIPVSSSS (MAGC1_HUMAN)
LKIPVSSSI

SEQ ID NO: 80543 - protein, 9 aa, Artificial Sequence
  Description of Artificial Sequence: Synthetic peptide
  Seed: VSPSSSSTL (MAGC1_HUMAN)
VWPSSSSTI

SEQ ID NO: 80544 - protein, 9 aa, Artificial Sequence
  Description of Artificial Sequence: Synthetic peptide
  Seed: LQIPVSPSF (MAGC1_HUMAN)
LIIPVSPSW

SEQ ID NO: 80545 - protein, 9 aa, Artificial Sequence
  Description of Artificial Sequence: Synthetic peptide
  Seed: ASSSTLVSI (MAGC1_HUMAN)
AQSSTLVSF

SEQ ID NO: 80546 - protein, 9 aa, Artificial Sequence
  Description of Artificial Sequence: Synthetic peptide
  Seed: ISRYTGYFP (MAGC1_HUMAN)
ITRYTGYFG

SEQ ID NO: 80547 - protein, 10 aa, Artificial Sequence
  Description of Artificial Sequence: Synthetic peptide
  Seed: LQIPVSRSFS (MAGC1_HUMAN)
LKIPVSRSFY

SEQ ID NO: 80548 - protein, 9 aa, Artificial Sequence
  Description of Artificial Sequence: Synthetic peptide
  Seed: SPQSPPEGP (MAGC1_HUMAN)
SQQSPPEGY

SEQ ID NO: 80549 - protein, 10 aa, Artificial Sequence
  Description of Artificial Sequence: Synthetic peptide
  Seed: LQIPVSPSFS (MAGC1_HUMAN)
LQIPVSPSFG

SEQ ID NO: 80550 - protein, 9 aa, Artificial Sequence
  Description of Artificial Sequence: Synthetic peptide
  Seed: YQVKQPITK (MAGC1_HUMAN)
YSVKQPITL

SEQ ID NO: 80551 - protein, 9 aa, Artificial Sequence
  Description of Artificial Sequence: Synthetic peptide
  Seed: FFSYTLASL (MAGC1_HUMAN)
FLSYTLASL

SEQ ID NO: 80552 - protein, 10 aa, Artificial Sequence
  Description of Artificial Sequence: Synthetic peptide
  Seed: ASSFFSSALL (MAGC1_HUMAN)
AKSFFSSALW

SEQ ID NO: 80553 - protein, 11 aa, Artificial Sequence
  Description of Artificial Sequence: Synthetic peptide
  Seed: SPLQIPVSRSF (MAGC1_HUMAN)
SFLQIPVSRSF

SEQ ID NO: 80554 - protein, 9 aa, Artificial Sequence
  Description of Artificial Sequence: Synthetic peptide
  Seed: YTLASLLQS (MAGC1_HUMAN)
YQLASLLQT

SEQ ID NO: 80555 - protein, 10 aa, Artificial Sequence
  Description of Artificial Sequence: Synthetic peptide
  Seed: KAREFIEILF (MAGC1_HUMAN)
KCREFIEILW

SEQ ID NO: 80556 - protein, 11 aa, Artificial Sequence
  Description of Artificial Sequence: Synthetic peptide
  Seed: QSSPESTQSPF (MAGC1_HUMAN)
QTSPESTQSPW

SEQ ID NO: 80557 - protein, 9 aa, Artificial Sequence
  Description of Artificial Sequence: Synthetic peptide
  Seed: TSSFSSTLL (MAGC1_HUMAN)
TMSFSSTLW

SEQ ID NO: 80558 - protein, 10 aa, Artificial Sequence
  Description of Artificial Sequence: Synthetic peptide
  Seed: ASSFFSSALL (MAGC1_HUMAN)
APSFFSSALM

SEQ ID NO: 80559 - protein, 10 aa, Artificial Sequence
  Description of Artificial Sequence: Synthetic peptide
  Seed: FAFGEPRELL (MAGC1_HUMAN)
FRFGEPRELY

SEQ ID NO: 80560 - protein, 9 aa, Artificial Sequence
  Description of Artificial Sequence: Synthetic peptide
  Seed: VSSSFSYTL (MAGC1_HUMAN)
VTSSFSYTL

SEQ ID NO: 80561 - protein, 11 aa, Artificial Sequence
  Description of Artificial Sequence: Synthetic peptide
  Seed: STFEGFAQSPL (MAGC1_HUMAN)
SLFEGFAQSPL

SEQ ID NO: 80562 - protein, 10 aa, Artificial Sequence
  Description of Artificial Sequence: Synthetic peptide
  Seed: STSLSLPQSF (MAGC1_HUMAN)
SLSLSLPQSW

SEQ ID NO: 80563 - protein, 9 aa, Artificial Sequence
  Description of Artificial Sequence: Synthetic peptide
  Seed: LKYQVKQPI (MAGC1_HUMAN)
LQYQVKQPL

SEQ ID NO: 80564 - protein, 10 aa, Artificial Sequence
  Description of Artificial Sequence: Synthetic peptide
  Seed: SLQIPVSPSF (MAGC1_HUMAN)
SFQIPVSPSM

SEQ ID NO: 80565 - protein, 9 aa, Artificial Sequence
  Description of Artificial Sequence: Synthetic peptide
  Seed: FSSTLVSLF (MAGC1_HUMAN)
FNSTLVSLY

SEQ ID NO: 80566 - protein, 10 aa, Artificial Sequence
  Description of Artificial Sequence: Synthetic peptide
  Seed: MPTAGMPSLL (MAGC1_HUMAN)
MWTAGMPSLY

SEQ ID NO: 80567 - protein, 9 aa, Artificial Sequence
  Description of Artificial Sequence: Synthetic peptide
  Seed: LQRPVSSFF (MAGC1_HUMAN)
LMRPVSSFL

SEQ ID NO: 80568 - protein, 11 aa, Artificial Sequence
  Description of Artificial Sequence: Synthetic peptide
  Seed: IPVSPSSSSTL (MAGC1_HUMAN)
IPVSPSSSSTF

SEQ ID NO: 80569 - protein, 9 aa, Artificial Sequence
  Description of Artificial Sequence: Synthetic peptide
  Seed: RSFSSTLLS (MAGC1_HUMAN)
RMFSSTLLG

SEQ ID NO: 80570 - protein, 10 aa, Artificial Sequence
  Description of Artificial Sequence: Synthetic peptide
  Seed: LQRPVSSFFS (MAGC1_HUMAN)
LKRPVSSFFF

SEQ ID NO: 80571 - protein, 9 aa, Artificial Sequence
  Description of Artificial Sequence: Synthetic peptide
  Seed: LQIPGSPSF (MAGC1_HUMAN)
LWIPGSPSI

SEQ ID NO: 80572 - protein, 9 aa, Artificial Sequence
  Description of Artificial Sequence: Synthetic peptide
  Seed: SSPERTHST (MAGC1_HUMAN)
SCPERTHSM

SEQ ID NO: 80573 - protein, 9 aa, Artificial Sequence
  Description of Artificial Sequence: Synthetic peptide
  Seed: SPLEGEDSL (MAGC1_HUMAN)
SHLEGEDSV

SEQ ID NO: 80574 - protein, 10 aa, Artificial Sequence
  Description of Artificial Sequence: Synthetic peptide
  Seed: RKAREFIEIL (MAGC1_HUMAN)
RMAREFIEIM

SEQ ID NO: 80575 - protein, 9 aa, Artificial Sequence
  Description of Artificial Sequence: Synthetic peptide
  Seed: STFEGFAQS (MAGC1_HUMAN)
SVFEGFAQR

SEQ ID NO: 80576 - protein, 9 aa, Artificial Sequence
  Description of Artificial Sequence: Synthetic peptide
  Seed: QSPLQGEEF (MAGC1_HUMAN)
QVPLQGEEM

SEQ ID NO: 80577 - protein, 10 aa, Artificial Sequence
  Description of Artificial Sequence: Synthetic peptide
  Seed: SSFSYTLLSL (MAGC1_HUMAN)
SIFSYTLLSW

SEQ ID NO: 80578 - protein, 9 aa, Artificial Sequence
  Description of Artificial Sequence: Synthetic peptide
  Seed: SSSESPQSC (MAGC1_HUMAN)
SGSESPQSM

SEQ ID NO: 80579 - protein, 10 aa, Artificial Sequence
  Description of Artificial Sequence: Synthetic peptide
  Seed: MSPLYFPQSP (MAGC1_HUMAN)
MNPLYFPQSV

SEQ ID NO: 80580 - protein, 10 aa, Artificial Sequence
  Description of Artificial Sequence: Synthetic peptide
  Seed: YTGYFPVIFR (MAGC1_HUMAN)
YDGYFPVIFR

SEQ ID NO: 80581 - protein, 11 aa, Artificial Sequence
  Description of Artificial Sequence: Synthetic peptide
  Seed: STFEGFAQSSL (MAGC1_HUMAN)
SMFEGFAQSSI

SEQ ID NO: 80582 - protein, 9 aa, Artificial Sequence
  Description of Artificial Sequence: Synthetic peptide
  Seed: SSPEGKDSL (MAGC1_HUMAN)
SYPEGKDSM

SEQ ID NO: 80583 - protein, 9 aa, Artificial Sequence
  Description of Artificial Sequence: Synthetic peptide
  Seed: KAREFIEIL (MAGC1_HUMAN)
KWREFIEIK

SEQ ID NO: 80584 - protein, 11 aa, Artificial Sequence
  Description of Artificial Sequence: Synthetic peptide
  Seed: STFEGFAQSPL (MAGC1_HUMAN)
SQFEGFAQSPA

SEQ ID NO: 80585 - protein, 9 aa, Artificial Sequence
  Description of Artificial Sequence: Synthetic peptide
  Seed: LLSLFQSFS (MAGC1_HUMAN)
LMSLFQSFI

SEQ ID NO: 80586 - protein, 9 aa, Artificial Sequence
  Description of Artificial Sequence: Synthetic peptide
  Seed: HFPQSPPEW (MAGC1_HUMAN)
HAPQSPPEM

SEQ ID NO: 80587 - protein, 11 aa, Artificial Sequence
  Description of Artificial Sequence: Synthetic peptide
  Seed: YTGYFPVIFRK (MAGC1_HUMAN)
YSGYFPVIFRR

SEQ ID NO: 80588 - protein, 10 aa, Artificial Sequence
  Description of Artificial Sequence: Synthetic peptide
  Seed: SSPESAQSTF (MAGC1_HUMAN)
SYPESAQSTL

SEQ ID NO: 80589 - protein, 11 aa, Artificial Sequence
  Description of Artificial Sequence: Synthetic peptide
  Seed: NTVPITFPSSY (MAGC1_HUMAN)
NVVPITFPSSK

SEQ ID NO: 80590 - protein, 11 aa, Artificial Sequence
  Description of Artificial Sequence: Synthetic peptide
  Seed: SPLQRPVSSFF (MAGC1_HUMAN)
SGLQRPVSSFY

SEQ ID NO: 80591 - protein, 10 aa, Artificial Sequence
  Description of Artificial Sequence: Synthetic peptide
  Seed: ESAQSTFEGF (MAGC1_HUMAN)
EAAQSTFEGW

SEQ ID NO: 80592 - protein, 8 aa, Artificial Sequence
  Description of Artificial Sequence: Synthetic peptide
  Seed: IWDVLSGI (MAGC1_HUMAN)
IVDVLSGL

SEQ ID NO: 80593 - protein, 10 aa, Artificial Sequence
  Description of Artificial Sequence: Synthetic peptide
  Seed: KRKVVEFLAM (MAGC1_HUMAN)
KNKVVEFLAY

SEQ ID NO: 80594 - protein, 9 aa, Artificial Sequence
  Description of Artificial Sequence: Synthetic peptide
  Seed: GYFPVIFRK (MAGC1_HUMAN)
GLFPVIFRL

SEQ ID NO: 80595 - protein, 9 aa, Artificial Sequence
  Description of Artificial Sequence: Synthetic peptide
  Seed: LQIPGSPSF (MAGC1_HUMAN)
LKIPGSPSI

SEQ ID NO: 80596 - protein, 9 aa, Artificial Sequence
  Description of Artificial Sequence: Synthetic peptide
  Seed: LQIPMTSSF (MAGC1_HUMAN)
LQIPMTSSH

SEQ ID NO: 80597 - protein, 9 aa, Artificial Sequence
  Description of Artificial Sequence: Synthetic peptide
  Seed: SPLQIVPSL (MAGC1_HUMAN)
SMLQIVPSI

SEQ ID NO: 80598 - protein, 10 aa, Artificial Sequence
  Description of Artificial Sequence: Synthetic peptide
  Seed: NTVPITFPSS (MAGC1_HUMAN)
NIVPITFPSI

SEQ ID NO: 80599 - protein, 9 aa, Artificial Sequence
  Description of Artificial Sequence: Synthetic peptide
  Seed: ISFSSSTSL (MAGC1_HUMAN)
ITFSSSTSF

SEQ ID NO: 80600 - protein, 9 aa, Artificial Sequence
  Description of Artificial Sequence: Synthetic peptide
  Seed: FPESPQSPP (MAGC1_HUMAN)
FPESPQSPA

SEQ ID NO: 80601 - protein, 9 aa, Artificial Sequence
  Description of Artificial Sequence: Synthetic peptide
  Seed: GFPQSVLQI (MAGC1_HUMAN)
GWPQSVLQF

SEQ ID NO: 80602 - protein, 9 aa, Artificial Sequence
  Description of Artificial Sequence: Synthetic peptide
  Seed: SAPEGEDSL (MAGC1_HUMAN)
SFPEGEDSL

SEQ ID NO: 80603 - protein, 10 aa, Artificial Sequence
  Description of Artificial Sequence: Synthetic peptide
  Seed: EYTSSSDTLL (MAGC1_HUMAN)
ETTSSSDTLV

SEQ ID NO: 80604 - protein, 9 aa, Artificial Sequence
  Description of Artificial Sequence: Synthetic peptide
  Seed: VSSSSSSTL (MAGC1_HUMAN)
VKSSSSSTY

SEQ ID NO: 80605 - protein, 11 aa, Artificial Sequence
  Description of Artificial Sequence: Synthetic peptide
  Seed: SPLQIPGSPSF (MAGC1_HUMAN)
SILQIPGSPSY

SEQ ID NO: 80606 - protein, 9 aa, Artificial Sequence
  Description of Artificial Sequence: Synthetic peptide
  Seed: FSERTQSTF (MAGC1_HUMAN)
FQERTQSTY

SEQ ID NO: 80607 - protein, 10 aa, Artificial Sequence
  Description of Artificial Sequence: Synthetic peptide
  Seed: SSPESAQSTF (MAGC1_HUMAN)
SLPESAQSTM

SEQ ID NO: 80608 - protein, 9 aa, Artificial Sequence
  Description of Artificial Sequence: Synthetic peptide
  Seed: FSSTLLSLF (MAGC1_HUMAN)
FYSTLLSLI

SEQ ID NO: 80609 - protein, 9 aa, Artificial Sequence
  Description of Artificial Sequence: Synthetic peptide
  Seed: YTLASLLQS (MAGC1_HUMAN)
YSLASLLQI

SEQ ID NO: 80610 - protein, 11 aa, Artificial Sequence
  Description of Artificial Sequence: Synthetic peptide
  Seed: LQIPVSSSFSY (MAGC1_HUMAN)
LQIPVSSSFSM

SEQ ID NO: 80611 - protein, 9 aa, Artificial Sequence
  Description of Artificial Sequence: Synthetic peptide
  Seed: QFPPQGEDF (MAGC1_HUMAN)
QTPPQGEDL

SEQ ID NO: 80612 - protein, 10 aa, Artificial Sequence
  Description of Artificial Sequence: Synthetic peptide
  Seed: EMLTNVISRY (MAGC1_HUMAN)
EVLTNVISRY

SEQ ID NO: 80613 - protein, 10 aa, Artificial Sequence
  Description of Artificial Sequence: Synthetic peptide
  Seed: MPTAGMPSLL (MAGC1_HUMAN)
MCTAGMPSLF

SEQ ID NO: 80614 - protein, 10 aa, Artificial Sequence
  Description of Artificial Sequence: Synthetic peptide
  Seed: SSPERTQSTF (MAGC1_HUMAN)
SQPERTQSTF

SEQ ID NO: 80615 - protein, 9 aa, Artificial Sequence
  Description of Artificial Sequence: Synthetic peptide
  Seed: VSRSFSSTL (MAGC1_HUMAN)
VNRSFSSTF

SEQ ID NO: 80616 - protein, 11 aa, Artificial Sequence
  Description of Artificial Sequence: Synthetic peptide
  Seed: SFSSSTSLSPF (MAGC1_HUMAN)
SKSSSTSLSPY

SEQ ID NO: 80617 - protein, 10 aa, Artificial Sequence
  Description of Artificial Sequence: Synthetic peptide
  Seed: SSFSYTLLSL (MAGC1_HUMAN)
SHFSYTLLSY

SEQ ID NO: 80618 - protein, 9 aa, Artificial Sequence
  Description of Artificial Sequence: Synthetic peptide
  Seed: SGIGVRAGR (MAGC1_HUMAN)
SLIGVRAGK

SEQ ID NO: 80619 - protein, 10 aa, Artificial Sequence
  Description of Artificial Sequence: Synthetic peptide
  Seed: DVLSGIGVRA (MAGC1_HUMAN)
DGLSGIGVRR

SEQ ID NO: 80620 - protein, 11 aa, Artificial Sequence
  Description of Artificial Sequence: Synthetic peptide
  Seed: SPLQRPVSSFF (MAGC1_HUMAN)
SCLQRPVSSFF

SEQ ID NO: 80621 - protein, 10 aa, Artificial Sequence
  Description of Artificial Sequence: Synthetic peptide
  Seed: SIIFIKGTYA (MAGC1_HUMAN)
STIFIKGTYV

SEQ ID NO: 80622 - protein, 9 aa, Artificial Sequence
  Description of Artificial Sequence: Synthetic peptide
  Seed: RKVVEFLAM (MAGC1_HUMAN)
RAVVEFLAL

SEQ ID NO: 80623 - protein, 9 aa, Artificial Sequence
  Description of Artificial Sequence: Synthetic peptide
  Seed: SQNRLLILI (MAGC1_HUMAN)
SANRLLILM

SEQ ID NO: 80624 - protein, 10 aa, Artificial Sequence
  Description of Artificial Sequence: Synthetic peptide
  Seed: LSIIFIKGTY (MAGC1_HUMAN)
LSIIFIKGTF

SEQ ID NO: 80625 - protein, 9 aa, Artificial Sequence
  Description of Artificial Sequence: Synthetic peptide
  Seed: LSDEQGMSQ (MAGC1_HUMAN)
LYDEQGMSI

SEQ ID NO: 80626 - protein, 10 aa, Artificial Sequence
  Description of Artificial Sequence: Synthetic peptide
  Seed: YTLLSLFQSS (MAGC1_HUMAN)
YELLSLFQSV

SEQ ID NO: 80627 - protein, 9 aa, Artificial Sequence
  Description of Artificial Sequence: Synthetic peptide
  Seed: KAREFIEIL (MAGC1_HUMAN)
KTREFIEIA

SEQ ID NO: 80628 - protein, 9 aa, Artificial Sequence
  Description of Artificial Sequence: Synthetic peptide
  Seed: FQSSLQSPV (MAGC1_HUMAN)
FISSLQSPL

SEQ ID NO: 80629 - protein, 11 aa, Artificial Sequence
  Description of Artificial Sequence: Synthetic peptide
  Seed: RYTGYFPVIFR (MAGC1_HUMAN)
RYTGYFPVIFW

SEQ ID NO: 80630 - protein, 9 aa, Artificial Sequence
  Description of Artificial Sequence: Synthetic peptide
  Seed: FFSYTLASL (MAGC1_HUMAN)
FFSYTLASI

SEQ ID NO: 80631 - protein, 9 aa, Artificial Sequence
  Description of Artificial Sequence: Synthetic peptide
  Seed: KVWVQEHYL (MAGC1_HUMAN)
KMWVQEHYF

SEQ ID NO: 80632 - protein, 9 aa, Artificial Sequence
  Description of Artificial Sequence: Synthetic peptide
  Seed: SFSERTQST (MAGC1_HUMAN)
SMSERTQSF

SEQ ID NO: 80633 - protein, 9 aa, Artificial Sequence
  Description of Artificial Sequence: Synthetic peptide
  Seed: SQSPPEGPV (MAGC1_HUMAN)
SVSPPEGPL

SEQ ID NO: 80634 - protein, 9 aa, Artificial Sequence
  Description of Artificial Sequence: Synthetic peptide
  Seed: AQSPLQIPV (MAGC1_HUMAN)
AESPLQIPC

SEQ ID NO: 80635 - protein, 9 aa, Artificial Sequence
  Description of Artificial Sequence: Synthetic peptide
  Seed: LQIPMTSSF (MAGC1_HUMAN)
LHIPMTSSV

SEQ ID NO: 80636 - protein, 9 aa, Artificial Sequence
  Description of Artificial Sequence: Synthetic peptide
  Seed: SIFQSSPER (MAGC1_HUMAN)
SFFQSSPER

SEQ ID NO: 80637 - protein, 9 aa, Artificial Sequence
  Description of Artificial Sequence: Synthetic peptide
  Seed: FLWGPRAHS (MAGC1_HUMAN)
FTWGPRAHI

SEQ ID NO: 80638 - protein, 9 aa, Artificial Sequence
  Description of Artificial Sequence: Synthetic peptide
  Seed: SSPESAQSA (MAGC1_HUMAN)
SIPESAQSL

SEQ ID NO: 80639 - protein, 9 aa, Artificial Sequence
  Description of Artificial Sequence: Synthetic peptide
  Seed: SMSPLYFPQ (MAGC1_HUMAN)
SSSPLYFPR

SEQ ID NO: 80640 - protein, 9 aa, Artificial Sequence
  Description of Artificial Sequence: Synthetic peptide
  Seed: SSPPRYEFL (MAGC1_HUMAN)
SAPPRYEFM

SEQ ID NO: 80641 - protein, 9 aa, Artificial Sequence
  Description of Artificial Sequence: Synthetic peptide
  Seed: MSQNRLLIL (MAGC1_HUMAN)
MMQNRLLIK

SEQ ID NO: 80642 - protein, 9 aa, Artificial Sequence
  Description of Artificial Sequence: Synthetic peptide
  Seed: WVQEHYLEY (MAGC1_HUMAN)
WTQEHYLEL

SEQ ID NO: 80643 - protein, 9 aa, Artificial Sequence
  Description of Artificial Sequence: Synthetic peptide
  Seed: LQIPGSPSF (MAGC1_HUMAN)
LAIPGSPSY

SEQ ID NO: 80644 - protein, 9 aa, Artificial Sequence
  Description of Artificial Sequence: Synthetic peptide
  Seed: MTSSFSSTL (MAGC1_HUMAN)
MQSSFSSTC

SEQ ID NO: 80645 - protein, 9 aa, Artificial Sequence
  Description of Artificial Sequence: Synthetic peptide
  Seed: VPITFPSSY (MAGC1_HUMAN)
VHITFPSSM

SEQ ID NO: 80646 - protein, 9 aa, Artificial Sequence
  Description of Artificial Sequence: Synthetic peptide
  Seed: FSSTLVSLF (MAGC1_HUMAN)
FYSTLVSLL

SEQ ID NO: 80647 - protein, 9 aa, Artificial Sequence
  Description of Artificial Sequence: Synthetic peptide
  Seed: YTLASLLQS (MAGC1_HUMAN)
YQLASLLQL

SEQ ID NO: 80648 - protein, 10 aa, Artificial Sequence
  Description of Artificial Sequence: Synthetic peptide
  Seed: SFSYTLLSLF (MAGC1_HUMAN)
SVSYTLLSLW

SEQ ID NO: 80649 - protein, 9 aa, Artificial Sequence
  Description of Artificial Sequence: Synthetic peptide
  Seed: LQIPGSPSF (MAGC1_HUMAN)
LQIPGSPSV

SEQ ID NO: 80650 - protein, 9 aa, Artificial Sequence
  Description of Artificial Sequence: Synthetic peptide
  Seed: SSHESPQSP (MAGC1_HUMAN)
SQHESPQSY

SEQ ID NO: 80651 - protein, 10 aa, Artificial Sequence
  Description of Artificial Sequence: Synthetic peptide
  Seed: FPQSVLQIPV (MAGC1_HUMAN)
FYQSVLQIPV

SEQ ID NO: 80652 - protein, 9 aa, Artificial Sequence
  Description of Artificial Sequence: Synthetic peptide
  Seed: FFSSALLSI (MAGC1_HUMAN)
FYSSALLSM

SEQ ID NO: 80653 - protein, 10 aa, Artificial Sequence
  Description of Artificial Sequence: Synthetic peptide
  Seed: LHFPQSPPEW (MAGC1_HUMAN)
LIFPQSPPEW

SEQ ID NO: 80654 - protein, 9 aa, Artificial Sequence
  Description of Artificial Sequence: Synthetic peptide
  Seed: VSPSFSSTL (MAGC1_HUMAN)
VGPSFSSTI

SEQ ID NO: 80655 - protein, 10 aa, Artificial Sequence
  Description of Artificial Sequence: Synthetic peptide
  Seed: FPSSYKDALK (MAGC1_HUMAN)
FPSSYKDALR

SEQ ID NO: 80656 - protein, 9 aa, Artificial Sequence
  Description of Artificial Sequence: Synthetic peptide
  Seed: GYFPVIFRK (MAGC1_HUMAN)
GIFPVIFRK

SEQ ID NO: 80657 - protein, 9 aa, Artificial Sequence
  Description of Artificial Sequence: Synthetic peptide
  Seed: TLLSILQSS (MAGC1_HUMAN)
TMLSILQSL

SEQ ID NO: 80658 - protein, 9 aa, Artificial Sequence
  Description of Artificial Sequence: Synthetic peptide
  Seed: SASSSVMSP (MAGC1_HUMAN)
SISSSVMSM

SEQ ID NO: 80659 - protein, 9 aa, Artificial Sequence
  Description of Artificial Sequence: Synthetic peptide
  Seed: LQRPVSSFF (MAGC1_HUMAN)
LVRPVSSFV

SEQ ID NO: 80660 - protein, 9 aa, Artificial Sequence
  Description of Artificial Sequence: Synthetic peptide
  Seed: SPLHFPQFP (MAGC1_HUMAN)
SPLHFPQFA

SEQ ID NO: 80661 - protein, 10 aa, Artificial Sequence
  Description of Artificial Sequence: Synthetic peptide
  Seed: VISFSSSTSL (MAGC1_HUMAN)
VHSFSSSTSL

SEQ ID NO: 80662 - protein, 9 aa, Artificial Sequence
  Description of Artificial Sequence: Synthetic peptide
  Seed: FSSALLSIF (MAGC1_HUMAN)
FQSALLSIL

SEQ ID NO: 80663 - protein, 9 aa, Artificial Sequence
  Description of Artificial Sequence: Synthetic peptide
  Seed: SASSSVMSP (MAGC1_HUMAN)
SASSSVMSM

SEQ ID NO: 80664 - protein, 11 aa, Artificial Sequence
  Description of Artificial Sequence: Synthetic peptide
  Seed: SPLQIPVSPSS (MAGC1_HUMAN)
SWLQIPVSPSY

SEQ ID NO: 80665 - protein, 9 aa, Artificial Sequence
  Description of Artificial Sequence: Synthetic peptide
  Seed: AMLKNTVPI (MAGC1_HUMAN)
AALKNTVPM

SEQ ID NO: 80666 - protein, 9 aa, Artificial Sequence
  Description of Artificial Sequence: Synthetic peptide
  Seed: STFEGFAQS (MAGC1_HUMAN)
SQFEGFAQL

SEQ ID NO: 80667 - protein, 9 aa, Artificial Sequence
  Description of Artificial Sequence: Synthetic peptide
  Seed: LQIPVSRSF (MAGC1_HUMAN)
LYIPVSRSV

SEQ ID NO: 80668 - protein, 10 aa, Artificial Sequence
  Description of Artificial Sequence: Synthetic peptide
  Seed: YTGYFPVIFR (MAGC1_HUMAN)
YMGYFPVIFK

SEQ ID NO: 80669 - protein, 9 aa, Artificial Sequence
  Description of Artificial Sequence: Synthetic peptide
  Seed: IPVSRSFSS (MAGC1_HUMAN)
IVVSRSFSY

SEQ ID NO: 80670 - protein, 10 aa, Artificial Sequence
  Description of Artificial Sequence: Synthetic peptide
  Seed: LAMLKNTVPI (MAGC1_HUMAN)
LTMLKNTVPY

SEQ ID NO: 80671 - protein, 9 aa, Artificial Sequence
  Description of Artificial Sequence: Synthetic peptide
  Seed: QFPPQGEDF (MAGC1_HUMAN)
QMPPQGEDL

SEQ ID NO: 80672 - protein, 9 aa, Artificial Sequence
  Description of Artificial Sequence: Synthetic peptide
  Seed: ELARFLLLK (MAGC1_HUMAN)
ESARFLLLR

SEQ ID NO: 80673 - protein, 11 aa, Artificial Sequence
  Description of Artificial Sequence: Synthetic peptide
  Seed: RKAREFIEILF (MAGC1_HUMAN)
RRAREFIEILF

SEQ ID NO: 80674 - protein, 10 aa, Artificial Sequence
  Description of Artificial Sequence: Synthetic peptide
  Seed: FAQSSLQIPV (MAGC1_HUMAN)
FVQSSLQIPV

SEQ ID NO: 80675 - protein, 9 aa, Artificial Sequence
  Description of Artificial Sequence: Synthetic peptide
  Seed: SPPEGENTH (MAGC1_HUMAN)
STPEGENTF

SEQ ID NO: 80676 - protein, 9 aa, Artificial Sequence
  Description of Artificial Sequence: Synthetic peptide
  Seed: SPLQIPMTS (MAGC1_HUMAN)
SLLQIPMTA

SEQ ID NO: 80677 - protein, 8 aa, Artificial Sequence
  Description of Artificial Sequence: Synthetic peptide
  Seed: SSFFSYTL (MAGC1_HUMAN)
SQFFSYTL

SEQ ID NO: 80678 - protein, 9 aa, Artificial Sequence
  Description of Artificial Sequence: Synthetic peptide
  Seed: SSFFSYTLA (MAGC1_HUMAN)
SQFFSYTLK

SEQ ID NO: 80679 - protein, 9 aa, Artificial Sequence
  Description of Artificial Sequence: Synthetic peptide
  Seed: IFQSSPESA (MAGC1_HUMAN)
ILQSSPESV

SEQ ID NO: 80680 - protein, 10 aa, Artificial Sequence
  Description of Artificial Sequence: Synthetic peptide
  Seed: KRKVVEFLAM (MAGC1_HUMAN)
KQKVVEFLAM

SEQ ID NO: 80681 - protein, 10 aa, Artificial Sequence
  Description of Artificial Sequence: Synthetic peptide
  Seed: SPLQNPASSF (MAGC1_HUMAN)
SALQNPASSF

SEQ ID NO: 80682 - protein, 10 aa, Artificial Sequence
  Description of Artificial Sequence: Synthetic peptide
  Seed: YTLLSLFQSS (MAGC1_HUMAN)
YQLLSLFQSI

SEQ ID NO: 80683 - protein, 10 aa, Artificial Sequence
  Description of Artificial Sequence: Synthetic peptide
  Seed: KVDELARFLL (MAGC1_HUMAN)
KTDELARFLW

SEQ ID NO: 80684 - protein, 9 aa, Artificial Sequence
  Description of Artificial Sequence: Synthetic peptide
  Seed: FQSSLQSPV (MAGC1_HUMAN)
FMSSLQSPF

SEQ ID NO: 80685 - protein, 11 aa, Artificial Sequence
  Description of Artificial Sequence: Synthetic peptide
  Seed: IPVSAASSSTL (MAGC1_HUMAN)
IPVSAASSSTM

SEQ ID NO: 80686 - protein, 10 aa, Artificial Sequence
  Description of Artificial Sequence: Synthetic peptide
  Seed: REVPNSSPPR (MAGC1_HUMAN)
RVVPNSSPPR

SEQ ID NO: 80687 - protein, 9 aa, Artificial Sequence
  Description of Artificial Sequence: Synthetic peptide
  Seed: SPLEGEDSL (MAGC1_HUMAN)
SHLEGEDSI

SEQ ID NO: 80688 - protein, 9 aa, Artificial Sequence
  Description of Artificial Sequence: Synthetic peptide
  Seed: SICSSSTSL (MAGC1_HUMAN)
STCSSSTSY

SEQ ID NO: 80689 - protein, 9 aa, Artificial Sequence
  Description of Artificial Sequence: Synthetic peptide
  Seed: TLDEKVDEL (MAGC1_HUMAN)
THDEKVDEF

SEQ ID NO: 80690 - protein, 10 aa, Artificial Sequence
  Description of Artificial Sequence: Synthetic peptide
  Seed: STPSSLPQSF (MAGC1_HUMAN)
SQPSSLPQSF

SEQ ID NO: 80691 - protein, 10 aa, Artificial Sequence
  Description of Artificial Sequence: Synthetic peptide
  Seed: ISRYTGYFPV (MAGC1_HUMAN)
IQRYTGYFPM

SEQ ID NO: 80692 - protein, 9 aa, Artificial Sequence
  Description of Artificial Sequence: Synthetic peptide
  Seed: GYFPVIFRK (MAGC1_HUMAN)
GYFPVIFRY

SEQ ID NO: 80693 - protein, 10 aa, Artificial Sequence
  Description of Artificial Sequence: Synthetic peptide
  Seed: YLEYREVPNS (MAGC1_HUMAN)
YLEYREVPNL

SEQ ID NO: 80694 - protein, 11 aa, Artificial Sequence
  Description of Artificial Sequence: Synthetic peptide
  Seed: REVDPDDSYVF (MAGC1_HUMAN)
RMVDPDDSYVV

SEQ ID NO: 80695 - protein, 9 aa, Artificial Sequence
  Description of Artificial Sequence: Synthetic peptide
  Seed: GSPSFSSTL (MAGC1_HUMAN)
GLPSFSSTA

SEQ ID NO: 80696 - protein, 10 aa, Artificial Sequence
  Description of Artificial Sequence: Synthetic peptide
  Seed: DVLSGIGVRA (MAGC1_HUMAN)
DTLSGIGVRY

SEQ ID NO: 80697 - protein, 9 aa, Artificial Sequence
  Description of Artificial Sequence: Synthetic peptide
  Seed: SQSSPVSSF (MAGC1_HUMAN)
SVSSPVSSM

SEQ ID NO: 80698 - protein, 10 aa, Artificial Sequence
  Description of Artificial Sequence: Synthetic peptide
  Seed: KGTYASEEVI (MAGC1_HUMAN)
KSTYASEEVF

SEQ ID NO: 80699 - protein, 9 aa, Artificial Sequence
  Description of Artificial Sequence: Synthetic peptide
  Seed: MTSSFSSTL (MAGC1_HUMAN)
MVSSFSSTA

SEQ ID NO: 80700 - protein, 9 aa, Artificial Sequence
  Description of Artificial Sequence: Synthetic peptide
  Seed: AQSSLQIPV (MAGC1_HUMAN)
AASSLQIPF

SEQ ID NO: 80701 - protein, 10 aa, Artificial Sequence
  Description of Artificial Sequence: Synthetic peptide
  Seed: SPLQSPVSSF (MAGC1_HUMAN)
SFLQSPVSSY

SEQ ID NO: 80702 - protein, 9 aa, Artificial Sequence
  Description of Artificial Sequence: Synthetic peptide
  Seed: STFEGFAQS (MAGC1_HUMAN)
SAFEGFAQI

SEQ ID NO: 80703 - protein, 9 aa, Artificial Sequence
  Description of Artificial Sequence: Synthetic peptide
  Seed: RLLILILSI (MAGC1_HUMAN)
RSLILILSF

SEQ ID NO: 80704 - protein, 10 aa, Artificial Sequence
  Description of Artificial Sequence: Synthetic peptide
  Seed: REFIEILFGI (MAGC1_HUMAN)
RIFIEILFGA

SEQ ID NO: 80705 - protein, 10 aa, Artificial Sequence
  Description of Artificial Sequence: Synthetic peptide
  Seed: RTHSTFEGFP (MAGC1_HUMAN)
RIHSTFEGFK

SEQ ID NO: 80706 - protein, 9 aa, Artificial Sequence
  Description of Artificial Sequence: Synthetic peptide
  Seed: KVVEFLAML (MAGC1_HUMAN)
KVVEFLAMI

SEQ ID NO: 80707 - protein, 9 aa, Artificial Sequence
  Description of Artificial Sequence: Synthetic peptide
  Seed: RTQSTFEGF (MAGC1_HUMAN)
RFQSTFEGI

SEQ ID NO: 80708 - protein, 9 aa, Artificial Sequence
  Description of Artificial Sequence: Synthetic peptide
  Seed: VIWDVLSGI (MAGC1_HUMAN)
VVWDVLSGI

SEQ ID NO: 80709 - protein, 11 aa, Artificial Sequence
  Description of Artificial Sequence: Synthetic peptide
  Seed: SSFSSTLLSIF (MAGC1_HUMAN)
STFSSTLLSIW

SEQ ID NO: 80710 - protein, 9 aa, Artificial Sequence
  Description of Artificial Sequence: Synthetic peptide
  Seed: VPITFPSSY (MAGC1_HUMAN)
VAITFPSSY

SEQ ID NO: 80711 - protein, 9 aa, Artificial Sequence
  Description of Artificial Sequence: Synthetic peptide
  Seed: FAFGEPREL (MAGC1_HUMAN)
FTFGEPREL

SEQ ID NO: 80712 - protein, 11 aa, Artificial Sequence
  Description of Artificial Sequence: Synthetic peptide
  Seed: SPFEGFPQSVL (MAGC1_HUMAN)
SPFEGFPQSVF

SEQ ID NO: 80713 - protein, 9 aa, Artificial Sequence
  Description of Artificial Sequence: Synthetic peptide
  Seed: VSSSSSSTL (MAGC1_HUMAN)
VHSSSSSTM

SEQ ID NO: 80714 - protein, 11 aa, Artificial Sequence
  Description of Artificial Sequence: Synthetic peptide
  Seed: STFEGFAQSSL (MAGC1_HUMAN)
SVFEGFAQSSW

SEQ ID NO: 80715 - protein, 9 aa, Artificial Sequence
  Description of Artificial Sequence: Synthetic peptide
  Seed: SFSSTLVSL (MAGC1_HUMAN)
SASSTLVSI

SEQ ID NO: 80716 - protein, 11 aa, Artificial Sequence
  Description of Artificial Sequence: Synthetic peptide
  Seed: SLIESEPLFTY (MAGC1_HUMAN)
SMIESEPLFTR

SEQ ID NO: 80717 - protein, 9 aa, Artificial Sequence
  Description of Artificial Sequence: Synthetic peptide
  Seed: FSYTLLSLF (MAGC1_HUMAN)
FSYTLLSLM

SEQ ID NO: 80718 - protein, 9 aa, Artificial Sequence
  Description of Artificial Sequence: Synthetic peptide
  Seed: YVFVNTLDL (MAGC1_HUMAN)
YTFVNTLDY

SEQ ID NO: 80719 - protein, 9 aa, Artificial Sequence
  Description of Artificial Sequence: Synthetic peptide
  Seed: MSQNRLLIL (MAGC1_HUMAN)
MPQNRLLII

SEQ ID NO: 80720 - protein, 9 aa, Artificial Sequence
  Description of Artificial Sequence: Synthetic peptide
  Seed: SSPESTQSP (MAGC1_HUMAN)
STPESTQSV

SEQ ID NO: 80721 - protein, 9 aa, Artificial Sequence
  Description of Artificial Sequence: Synthetic peptide
  Seed: FSSTLVSLF (MAGC1_HUMAN)
FWSTLVSLY

SEQ ID NO: 80722 - protein, 9 aa, Artificial Sequence
  Description of Artificial Sequence: Synthetic peptide
  Seed: LQIPVSPSF (MAGC1_HUMAN)
LEIPVSPSI

SEQ ID NO: 80723 - protein, 11 aa, Artificial Sequence
  Description of Artificial Sequence: Synthetic peptide
  Seed: STFEGFAQSPL (MAGC1_HUMAN)
SSFEGFAQSPW

SEQ ID NO: 80724 - protein, 11 aa, Artificial Sequence
  Description of Artificial Sequence: Synthetic peptide
  Seed: IPVSSSFSYTL (MAGC1_HUMAN)
IAVSSSFSYTY

SEQ ID NO: 80725 - protein, 9 aa, Artificial Sequence
  Description of Artificial Sequence: Synthetic peptide
  Seed: FTYTLDEKV (MAGC1_HUMAN)
FTYTLDEKA

SEQ ID NO: 80726 - protein, 10 aa, Artificial Sequence
  Description of Artificial Sequence: Synthetic peptide
  Seed: STPSSLPQSF (MAGC1_HUMAN)
SVPSSLPQSY

SEQ ID NO: 80727 - protein, 10 aa, Artificial Sequence
  Description of Artificial Sequence: Synthetic peptide
  Seed: VSSSFSYTLL (MAGC1_HUMAN)
VGSSFSYTLW

SEQ ID NO: 80728 - protein, 9 aa, Artificial Sequence
  Description of Artificial Sequence: Synthetic peptide
  Seed: SSSFSYTLL (MAGC1_HUMAN)
SASFSYTLI

SEQ ID NO: 80729 - protein, 10 aa, Artificial Sequence
  Description of Artificial Sequence: Synthetic peptide
  Seed: PLQIPVSSSF (MAGC1_HUMAN)
PIQIPVSSSM

SEQ ID NO: 80730 - protein, 10 aa, Artificial Sequence
  Description of Artificial Sequence: Synthetic peptide
  Seed: SFSERTQSTF (MAGC1_HUMAN)
SYSERTQSTY

SEQ ID NO: 80731 - protein, 10 aa, Artificial Sequence
  Description of Artificial Sequence: Synthetic peptide
  Seed: TGYFPVIFRK (MAGC1_HUMAN)
TVYFPVIFRV

SEQ ID NO: 80732 - protein, 9 aa, Artificial Sequence
  Description of Artificial Sequence: Synthetic peptide
  Seed: KVVEFLAML (MAGC1_HUMAN)
KLVEFLAMM

SEQ ID NO: 80733 - protein, 9 aa, Artificial Sequence
  Description of Artificial Sequence: Synthetic peptide
  Seed: LQIPVSSSS (MAGC1_HUMAN)
LDIPVSSSL

SEQ ID NO: 80734 - protein, 9 aa, Artificial Sequence
  Description of Artificial Sequence: Synthetic peptide
  Seed: RTQSTFEGF (MAGC1_HUMAN)
RWQSTFEGY

SEQ ID NO: 80735 - protein, 11 aa, Artificial Sequence
  Description of Artificial Sequence: Synthetic peptide
  Seed: SLQIPVSPSFS (MAGC1_HUMAN)
SRQIPVSPSFF

SEQ ID NO: 80736 - protein, 10 aa, Artificial Sequence
  Description of Artificial Sequence: Synthetic peptide
  Seed: SFFSSALLSI (MAGC1_HUMAN)
SYFSSALLSL

SEQ ID NO: 80737 - protein, 11 aa, Artificial Sequence
  Description of Artificial Sequence: Synthetic peptide
  Seed: IPVSRSFSSTL (MAGC1_HUMAN)
IIVSRSFSSTW

SEQ ID NO: 80738 - protein, 9 aa, Artificial Sequence
  Description of Artificial Sequence: Synthetic peptide
  Seed: MLTNVISRY (MAGC1_HUMAN)
MTTNVISRM

SEQ ID NO: 80739 - protein, 10 aa, Artificial Sequence
  Description of Artificial Sequence: Synthetic peptide
  Seed: ISRYTGYFPV (MAGC1_HUMAN)
IFRYTGYFPK

SEQ ID NO: 80740 - protein, 11 aa, Artificial Sequence
  Description of Artificial Sequence: Synthetic peptide
  Seed: SSFSYTLLSLF (MAGC1_HUMAN)
SNFSYTLLSLY

SEQ ID NO: 80741 - protein, 9 aa, Artificial Sequence
  Description of Artificial Sequence: Synthetic peptide
  Seed: AQSPLQIPV (MAGC1_HUMAN)
AVSPLQIPF

SEQ ID NO: 80742 - protein, 9 aa, Artificial Sequence
  Description of Artificial Sequence: Synthetic peptide
  Seed: TLLSLFQSF (MAGC1_HUMAN)
TSLSLFQSW

SEQ ID NO: 80743 - protein, 9 aa, Artificial Sequence
  Description of Artificial Sequence: Synthetic peptide
  Seed: FSSTLLSLF (MAGC1_HUMAN)
FASTLLSLV

SEQ ID NO: 80744 - protein, 11 aa, Artificial Sequence
  Description of Artificial Sequence: Synthetic peptide
  Seed: SFSSSTSLSPF (MAGC1_HUMAN)
SYSSSTSLSPF

SEQ ID NO: 80745 - protein, 9 aa, Artificial Sequence
  Description of Artificial Sequence: Synthetic peptide
  Seed: VSAASSSTL (MAGC1_HUMAN)
VAAASSSTF

SEQ ID NO: 80746 - protein, 9 aa, Artificial Sequence
  Description of Artificial Sequence: Synthetic peptide
  Seed: SKSSPESPL (MAGC1_HUMAN)
SMSSPESPM

SEQ ID NO: 80747 - protein, 9 aa, Artificial Sequence
  Description of Artificial Sequence: Synthetic peptide
  Seed: FAFGEPREL (MAGC1_HUMAN)
FMFGEPREY

SEQ ID NO: 80748 - protein, 9 aa, Artificial Sequence
  Description of Artificial Sequence: Synthetic peptide
  Seed: GFPQSPLQI (MAGC1_HUMAN)
GCPQSPLQL

SEQ ID NO: 80749 - protein, 9 aa, Artificial Sequence
  Description of Artificial Sequence: Synthetic peptide
  Seed: LSPLHFPQF (MAGC1_HUMAN)
LWPLHFPQW

SEQ ID NO: 80750 - protein, 10 aa, Artificial Sequence
  Description of Artificial Sequence: Synthetic peptide
  Seed: SSFSYTLLSL (MAGC1_HUMAN)
SAFSYTLLSM

SEQ ID NO: 80751 - protein, 9 aa, Artificial Sequence
  Description of Artificial Sequence: Synthetic peptide
  Seed: ASSSTLVSI (MAGC1_HUMAN)
AASSTLVSF

SEQ ID NO: 80752 - protein, 11 aa, Artificial Sequence
  Description of Artificial Sequence: Synthetic peptide
  Seed: SSFPSSTSSSL (MAGC1_HUMAN)
SQFPSSTSSSM

SEQ ID NO: 80753 - protein, 9 aa, Artificial Sequence
  Description of Artificial Sequence: Synthetic peptide
  Seed: STFEGFAQS (MAGC1_HUMAN)
SMFEGFAQL

SEQ ID NO: 80754 - protein, 9 aa, Artificial Sequence
  Description of Artificial Sequence: Synthetic peptide
  Seed: TLASLLQSS (MAGC1_HUMAN)
TTASLLQSL

SEQ ID NO: 80755 - protein, 9 aa, Artificial Sequence
  Description of Artificial Sequence: Synthetic peptide
  Seed: TSLSLPQSF (MAGC1_HUMAN)
TYLSLPQSF

SEQ ID NO: 80756 - protein, 9 aa, Artificial Sequence
  Description of Artificial Sequence: Synthetic peptide
  Seed: MTSSFSSTL (MAGC1_HUMAN)
MPSSFSSTI

SEQ ID NO: 80757 - protein, 10 aa, Artificial Sequence
  Description of Artificial Sequence: Synthetic peptide
  Seed: FQSSLQSPVS (MAGC1_HUMAN)
FMSSLQSPVS

SEQ ID NO: 80758 - protein, 10 aa, Artificial Sequence
  Description of Artificial Sequence: Synthetic peptide
  Seed: SSPPRYEFLW (MAGC1_HUMAN)
STPPRYEFLW

SEQ ID NO: 80759 - protein, 10 aa, Artificial Sequence
  Description of Artificial Sequence: Synthetic peptide
  Seed: KAEMLTNVIS (MAGC1_HUMAN)
KTEMLTNVIA

SEQ ID NO: 80760 - protein, 9 aa, Artificial Sequence
  Description of Artificial Sequence: Synthetic peptide
  Seed: SSPESAQST (MAGC1_HUMAN)
SVPESAQSF

SEQ ID NO: 80761 - protein, 9 aa, Artificial Sequence
  Description of Artificial Sequence: Synthetic peptide
  Seed: LLSLFQSFS (MAGC1_HUMAN)
LMSLFQSFM

SEQ ID NO: 80762 - protein, 11 aa, Artificial Sequence
  Description of Artificial Sequence: Synthetic peptide
  Seed: ILFGISLREVD (MAGC1_HUMAN)
ILFGISLREVI

SEQ ID NO: 80763 - protein, 9 aa, Artificial Sequence
  Description of Artificial Sequence: Synthetic peptide
  Seed: CTQSTFEGF (MAGC1_HUMAN)
CQQSTFEGM

SEQ ID NO: 80764 - protein, 10 aa, Artificial Sequence
  Description of Artificial Sequence: Synthetic peptide
  Seed: STFEGFPQSL (MAGC1_HUMAN)
SLFEGFPQSL

SEQ ID NO: 80765 - protein, 10 aa, Artificial Sequence
  Description of Artificial Sequence: Synthetic peptide
  Seed: AASSSTLVSI (MAGC1_HUMAN)
ALSSSTLVSL

SEQ ID NO: 80766 - protein, 9 aa, Artificial Sequence
  Description of Artificial Sequence: Synthetic peptide
  Seed: TLLSLFQSF (MAGC1_HUMAN)
TFLSLFQSI

SEQ ID NO: 80767 - protein, 10 aa, Artificial Sequence
  Description of Artificial Sequence: Synthetic peptide
  Seed: STLLSLFQSF (MAGC1_HUMAN)
SYLLSLFQSI

SEQ ID NO: 80768 - protein, 9 aa, Artificial Sequence
  Description of Artificial Sequence: Synthetic peptide
  Seed: VIKRKVVEF (MAGC1_HUMAN)
VLKRKVVEM

SEQ ID NO: 80769 - protein, 10 aa, Artificial Sequence
  Description of Artificial Sequence: Synthetic peptide
  Seed: TTDDSTATES (MAGC1_HUMAN)
TADDSTATEL

SEQ ID NO: 80770 - protein, 9 aa, Artificial Sequence
  Description of Artificial Sequence: Synthetic peptide
  Seed: ASSSTLVSI (MAGC1_HUMAN)
AASSTLVSL

SEQ ID NO: 80771 - protein, 9 aa, Artificial Sequence
  Description of Artificial Sequence: Synthetic peptide
  Seed: FEGFPQSLL (MAGC1_HUMAN)
FEGFPQSLV

SEQ ID NO: 80772 - protein, 9 aa, Artificial Sequence
  Description of Artificial Sequence: Synthetic peptide
  Seed: YQVKQPITK (MAGC1_HUMAN)
YEVKQPITY

SEQ ID NO: 80773 - protein, 9 aa, Artificial Sequence
  Description of Artificial Sequence: Synthetic peptide
  Seed: AQSPLQSPV (MAGC1_HUMAN)
ALSPLQSPI

SEQ ID NO: 80774 - protein, 10 aa, Artificial Sequence
  Description of Artificial Sequence: Synthetic peptide
  Seed: PLQRPVSSFF (MAGC1_HUMAN)
PFQRPVSSFF

SEQ ID NO: 80775 - protein, 10 aa, Artificial Sequence
  Description of Artificial Sequence: Synthetic peptide
  Seed: MPTAGMPSLL (MAGC1_HUMAN)
MQTAGMPSLY

SEQ ID NO: 80776 - protein, 10 aa, Artificial Sequence
  Description of Artificial Sequence: Synthetic peptide
  Seed: LSIIFIKGTY (MAGC1_HUMAN)
LQIIFIKGTY

SEQ ID NO: 80777 - protein, 9 aa, Artificial Sequence
  Description of Artificial Sequence: Synthetic peptide
  Seed: VPITFPSSY (MAGC1_HUMAN)
VIITFPSSY

SEQ ID NO: 80778 - protein, 9 aa, Artificial Sequence
  Description of Artificial Sequence: Synthetic peptide
  Seed: LQRPVSSFF (MAGC1_HUMAN)
LMRPVSSFI

SEQ ID NO: 80779 - protein, 9 aa, Artificial Sequence
  Description of Artificial Sequence: Synthetic peptide
  Seed: SPLEGEDSL (MAGC1_HUMAN)
SILEGEDSF

SEQ ID NO: 80780 - protein, 10 aa, Artificial Sequence
  Description of Artificial Sequence: Synthetic peptide
  Seed: YTLASLLQSS (MAGC1_HUMAN)
YQLASLLQSI

SEQ ID NO: 80781 - protein, 9 aa, Artificial Sequence
  Description of Artificial Sequence: Synthetic peptide
  Seed: FPSSYKDAL (MAGC1_HUMAN)
FPSSYKDAI

SEQ ID NO: 80782 - protein, 10 aa, Artificial Sequence
  Description of Artificial Sequence: Synthetic peptide
  Seed: SFSYTLLSLF (MAGC1_HUMAN)
SQSYTLLSLY

SEQ ID NO: 80783 - protein, 9 aa, Artificial Sequence
  Description of Artificial Sequence: Synthetic peptide
  Seed: RSFSSTLLS (MAGC1_HUMAN)
RIFSSTLLL

SEQ ID NO: 80784 - protein, 10 aa, Artificial Sequence
  Description of Artificial Sequence: Synthetic peptide
  Seed: SFSYTLLSLF (MAGC1_HUMAN)
SHSYTLLSLY

SEQ ID NO: 80785 - protein, 9 aa, Artificial Sequence
  Description of Artificial Sequence: Synthetic peptide
  Seed: LQIPGSPSF (MAGC1_HUMAN)
LSIPGSPSH

SEQ ID NO: 80786 - protein, 10 aa, Artificial Sequence
  Description of Artificial Sequence: Synthetic peptide
  Seed: LSIIFIKGTY (MAGC1_HUMAN)
LTIIFIKGTW

SEQ ID NO: 80787 - protein, 9 aa, Artificial Sequence
  Description of Artificial Sequence: Synthetic peptide
  Seed: LEYREVPNS (MAGC1_HUMAN)
LEYREVPNV

SEQ ID NO: 80788 - protein, 9 aa, Artificial Sequence
  Description of Artificial Sequence: Synthetic peptide
  Seed: VIKRKVVEF (MAGC1_HUMAN)
VSKRKVVEW

SEQ ID NO: 80789 - protein, 11 aa, Artificial Sequence
  Description of Artificial Sequence: Synthetic peptide
  Seed: SPLQIPVSSSS (MAGC1_HUMAN)
STLQIPVSSSM

SEQ ID NO: 80790 - protein, 10 aa, Artificial Sequence
  Description of Artificial Sequence: Synthetic peptide
  Seed: SLQIPVSPSF (MAGC1_HUMAN)
SSQIPVSPSF

SEQ ID NO: 80791 - protein, 9 aa, Artificial Sequence
  Description of Artificial Sequence: Synthetic peptide
  Seed: VSPSSSSTL (MAGC1_HUMAN)
VAPSSSSTW

SEQ ID NO: 80792 - protein, 10 aa, Artificial Sequence
  Description of Artificial Sequence: Synthetic peptide
  Seed: WGPRAHSEVI (MAGC1_HUMAN)
WFPRAHSEVF

SEQ ID NO: 80793 - protein, 10 aa, Artificial Sequence
  Description of Artificial Sequence: Synthetic peptide
  Seed: PLQIPGSPSF (MAGC1_HUMAN)
PSQIPGSPSF

SEQ ID NO: 80794 - protein, 9 aa, Artificial Sequence
  Description of Artificial Sequence: Synthetic peptide
  Seed: AQSPLQSPV (MAGC1_HUMAN)
AESPLQSPP

SEQ ID NO: 80795 - protein, 11 aa, Artificial Sequence
  Description of Artificial Sequence: Synthetic peptide
  Seed: NSSPPRYEFLW (MAGC1_HUMAN)
NASPPRYEFLW

SEQ ID NO: 80796 - protein, 10 aa, Artificial Sequence
  Description of Artificial Sequence: Synthetic peptide
  Seed: REFIEILFGI (MAGC1_HUMAN)
REFIEILFGA

SEQ ID NO: 80797 - protein, 9 aa, Artificial Sequence
  Description of Artificial Sequence: Synthetic peptide
  Seed: SQNRLLILI (MAGC1_HUMAN)
SENRLLILF

SEQ ID NO: 80798 - protein, 9 aa, Artificial Sequence
  Description of Artificial Sequence: Synthetic peptide
  Seed: FSYTLLSLF (MAGC1_HUMAN)
FVYTLLSLV

SEQ ID NO: 80799 - protein, 10 aa, Artificial Sequence
  Description of Artificial Sequence: Synthetic peptide
  Seed: SSSSSSSTLL (MAGC1_HUMAN)
SRSSSSSTLF

SEQ ID NO: 80800 - protein, 10 aa, Artificial Sequence
  Description of Artificial Sequence: Synthetic peptide
  Seed: FPSSTSSSLS (MAGC1_HUMAN)
FMSSTSSSLY

SEQ ID NO: 80801 - protein, 11 aa, Artificial Sequence
  Description of Artificial Sequence: Synthetic peptide
  Seed: SICSSSTSLSL (MAGC1_HUMAN)
SLCSSSTSLSW

SEQ ID NO: 80802 - protein, 11 aa, Artificial Sequence
  Description of Artificial Sequence: Synthetic peptide
  Seed: SPLQIPGSPSF (MAGC1_HUMAN)
SHLQIPGSPSM

SEQ ID NO: 80803 - protein, 9 aa, Artificial Sequence
  Description of Artificial Sequence: Synthetic peptide
  Seed: FSSALLSIF (MAGC1_HUMAN)
FISALLSIM

SEQ ID NO: 80804 - protein, 9 aa, Artificial Sequence
  Description of Artificial Sequence: Synthetic peptide
  Seed: MSQNRLLIL (MAGC1_HUMAN)
MVQNRLLIY

SEQ ID NO: 80805 - protein, 11 aa, Artificial Sequence
  Description of Artificial Sequence: Synthetic peptide
  Seed: TESASSSVMSP (MAGC1_HUMAN)
TESASSSVMSM

SEQ ID NO: 80806 - protein, 11 aa, Artificial Sequence
  Description of Artificial Sequence: Synthetic peptide
  Seed: RPVSSFFSYTL (MAGC1_HUMAN)
RVVSSFFSYTI

SEQ ID NO: 80807 - protein, 10 aa, Artificial Sequence
  Description of Artificial Sequence: Synthetic peptide
  Seed: RYTGYFPVIF (MAGC1_HUMAN)
RATGYFPVIW

SEQ ID NO: 80808 - protein, 9 aa, Artificial Sequence
  Description of Artificial Sequence: Synthetic peptide
  Seed: FQSSLQSPV (MAGC1_HUMAN)
FRSSLQSPV

SEQ ID NO: 80809 - protein, 9 aa, Artificial Sequence
  Description of Artificial Sequence: Synthetic peptide
  Seed: VSAASSSTL (MAGC1_HUMAN)
VTAASSSTM

SEQ ID NO: 80810 - protein, 9 aa, Artificial Sequence
  Description of Artificial Sequence: Synthetic peptide
  Seed: KVVEFLAML (MAGC1_HUMAN)
KQVEFLAMM

SEQ ID NO: 80811 - protein, 9 aa, Artificial Sequence
  Description of Artificial Sequence: Synthetic peptide
  Seed: DEQGMSQNR (MAGC1_HUMAN)
DIQGMSQNR

SEQ ID NO: 80812 - protein, 10 aa, Artificial Sequence
  Description of Artificial Sequence: Synthetic peptide
  Seed: FFSSALLSIF (MAGC1_HUMAN)
FNSSALLSIW

SEQ ID NO: 80813 - protein, 9 aa, Artificial Sequence
  Description of Artificial Sequence: Synthetic peptide
  Seed: SVLQIPVSA (MAGC1_HUMAN)
SALQIPVSY

SEQ ID NO: 80814 - protein, 9 aa, Artificial Sequence
  Description of Artificial Sequence: Synthetic peptide
  Seed: LKYQVKQPI (MAGC1_HUMAN)
LQYQVKQPY

SEQ ID NO: 80815 - protein, 9 aa, Artificial Sequence
  Description of Artificial Sequence: Synthetic peptide
  Seed: SLPQSFPES (MAGC1_HUMAN)
SLPQSFPEI

SEQ ID NO: 80816 - protein, 11 aa, Artificial Sequence
  Description of Artificial Sequence: Synthetic peptide
  Seed: AASSSTLVSIF (MAGC1_HUMAN)
AISSSTLVSIW

SEQ ID NO: 80817 - protein, 10 aa, Artificial Sequence
  Description of Artificial Sequence: Synthetic peptide
  Seed: PLQIPMTSSF (MAGC1_HUMAN)
PMQIPMTSSF

SEQ ID NO: 80818 - protein, 9 aa, Artificial Sequence
  Description of Artificial Sequence: Synthetic peptide
  Seed: SPLQIVPSL (MAGC1_HUMAN)
SLLQIVPSY

SEQ ID NO: 80819 - protein, 11 aa, Artificial Sequence
  Description of Artificial Sequence: Synthetic peptide
  Seed: PSFSSTLLSLF (MAGC1_HUMAN)
PTFSSTLLSLW

SEQ ID NO: 80820 - protein, 11 aa, Artificial Sequence
  Description of Artificial Sequence: Synthetic peptide
  Seed: SAASSSTLVSI (MAGC1_HUMAN)
SGASSSTLVSW

SEQ ID NO: 80821 - protein, 10 aa, Artificial Sequence
  Description of Artificial Sequence: Synthetic peptide
  Seed: LAMLKNTVPI (MAGC1_HUMAN)
LGMLKNTVPI

SEQ ID NO: 80822 - protein, 9 aa, Artificial Sequence
  Description of Artificial Sequence: Synthetic peptide
  Seed: MLKNTVPIT (MAGC1_HUMAN)
MMKNTVPIA

SEQ ID NO: 80823 - protein, 10 aa, Artificial Sequence
  Description of Artificial Sequence: Synthetic peptide
  Seed: RSFSSTLLSI (MAGC1_HUMAN)
RIFSSTLLSA

SEQ ID NO: 80824 - protein, 9 aa, Artificial Sequence
  Description of Artificial Sequence: Synthetic peptide
  Seed: LQNPASSFF (MAGC1_HUMAN)
LENPASSFW

SEQ ID NO: 80825 - protein, 9 aa, Artificial Sequence
  Description of Artificial Sequence: Synthetic peptide
  Seed: VSPSSSSTL (MAGC1_HUMAN)
VTPSSSSTI

SEQ ID NO: 80826 - protein, 9 aa, Artificial Sequence
  Description of Artificial Sequence: Synthetic peptide
  Seed: AEMLTNVIS (MAGC1_HUMAN)
AEMLTNVIF

SEQ ID NO: 80827 - protein, 9 aa, Artificial Sequence
  Description of Artificial Sequence: Synthetic peptide
  Seed: AMLKNTVPI (MAGC1_HUMAN)
ALLKNTVPL

SEQ ID NO: 80828 - protein, 11 aa, Artificial Sequence
  Description of Artificial Sequence: Synthetic peptide
  Seed: IPVSPSFSSTL (MAGC1_HUMAN)
IPVSPSFSSTY

SEQ ID NO: 80829 - protein, 10 aa, Artificial Sequence
  Description of Artificial Sequence: Synthetic peptide
  Seed: SQSSPVSSFP (MAGC1_HUMAN)
SMSSPVSSFM

SEQ ID NO: 80830 - protein, 10 aa, Artificial Sequence
  Description of Artificial Sequence: Synthetic peptide
  Seed: MTSSFSSTLL (MAGC1_HUMAN)
MPSSFSSTLF

SEQ ID NO: 80831 - protein, 9 aa, Artificial Sequence
  Description of Artificial Sequence: Synthetic peptide
  Seed: LQRPVSSFF (MAGC1_HUMAN)
LRRPVSSFY

SEQ ID NO: 80832 - protein, 9 aa, Artificial Sequence
  Description of Artificial Sequence: Synthetic peptide
  Seed: LQIPVSSSS (MAGC1_HUMAN)
LYIPVSSSF

SEQ ID NO: 80833 - protein, 9 aa, Artificial Sequence
  Description of Artificial Sequence: Synthetic peptide
  Seed: MSQNRLLIL (MAGC1_HUMAN)
MMQNRLLIA

SEQ ID NO: 80834 - protein, 9 aa, Artificial Sequence
  Description of Artificial Sequence: Synthetic peptide
  Seed: KDVEERAQA (MAGC1_HUMAN)
KEVEERAQT

SEQ ID NO: 80835 - protein, 9 aa, Artificial Sequence
  Description of Artificial Sequence: Synthetic peptide
  Seed: ALLSIFQSS (MAGC1_HUMAN)
AMLSIFQSA

SEQ ID NO: 80836 - protein, 9 aa, Artificial Sequence
  Description of Artificial Sequence: Synthetic peptide
  Seed: FSYTLASLL (MAGC1_HUMAN)
FVYTLASLF

SEQ ID NO: 80837 - protein, 9 aa, Artificial Sequence
  Description of Artificial Sequence: Synthetic peptide
  Seed: SPLEISQSP (MAGC1_HUMAN)
SPLEISQSA

SEQ ID NO: 80838 - protein, 10 aa, Artificial Sequence
  Description of Artificial Sequence: Synthetic peptide
  Seed: SSPESAQSTF (MAGC1_HUMAN)
SLPESAQSTF

SEQ ID NO: 80839 - protein, 9 aa, Artificial Sequence
  Description of Artificial Sequence: Synthetic peptide
  Seed: FFSSALLSI (MAGC1_HUMAN)
FGSSALLSV

SEQ ID NO: 80840 - protein, 10 aa, Artificial Sequence
  Description of Artificial Sequence: Synthetic peptide
  Seed: TGYFPVIFRK (MAGC1_HUMAN)
TTYFPVIFRC

SEQ ID NO: 80841 - protein, 10 aa, Artificial Sequence
  Description of Artificial Sequence: Synthetic peptide
  Seed: EVIWDVLSGI (MAGC1_HUMAN)
ECIWDVLSGV

SEQ ID NO: 80842 - protein, 9 aa, Artificial Sequence
  Description of Artificial Sequence: Synthetic peptide
  Seed: VPITFPSSY (MAGC1_HUMAN)
VIITFPSSM

SEQ ID NO: 80843 - protein, 11 aa, Artificial Sequence
  Description of Artificial Sequence: Synthetic peptide
  Seed: QSSPESAQSAF (MAGC1_HUMAN)
QMSPESAQSAY

SEQ ID NO: 80844 - protein, 9 aa, Artificial Sequence
  Description of Artificial Sequence: Synthetic peptide
  Seed: AMLKNTVPI (MAGC1_HUMAN)
ANLKNTVPF

SEQ ID NO: 80845 - protein, 9 aa, Artificial Sequence
  Description of Artificial Sequence: Synthetic peptide
  Seed: SRYTGYFPV (MAGC1_HUMAN)
SQYTGYFPF

SEQ ID NO: 80846 - protein, 9 aa, Artificial Sequence
  Description of Artificial Sequence: Synthetic peptide
  Seed: MGDKDMPTA (MAGC1_HUMAN)
MLDKDMPTF

SEQ ID NO: 80847 - protein, 9 aa, Artificial Sequence
  Description of Artificial Sequence: Synthetic peptide
  Seed: TLLSILQSS (MAGC1_HUMAN)
TVLSILQSI

SEQ ID NO: 80848 - protein, 10 aa, Artificial Sequence
  Description of Artificial Sequence: Synthetic peptide
  Seed: SPLQRPVSSF (MAGC1_HUMAN)
SVLQRPVSSY

SEQ ID NO: 80849 - protein, 10 aa, Artificial Sequence
  Description of Artificial Sequence: Synthetic peptide
  Seed: MTSSFSSTLL (MAGC1_HUMAN)
MESSFSSTLW

SEQ ID NO: 80850 - protein, 9 aa, Artificial Sequence
  Description of Artificial Sequence: Synthetic peptide
  Seed: LQRPVSSFF (MAGC1_HUMAN)
LCRPVSSFK

SEQ ID NO: 80851 - protein, 9 aa, Artificial Sequence
  Description of Artificial Sequence: Synthetic peptide
  Seed: LQIPGSPSF (MAGC1_HUMAN)
LKIPGSPSY

SEQ ID NO: 80852 - protein, 10 aa, Artificial Sequence
  Description of Artificial Sequence: Synthetic peptide
  Seed: SPLQSPVSSF (MAGC1_HUMAN)
SALQSPVSSY

SEQ ID NO: 80853 - protein, 11 aa, Artificial Sequence
  Description of Artificial Sequence: Synthetic peptide
  Seed: SSTPSSLPQSF (MAGC1_HUMAN)
SATPSSLPQSY

SEQ ID NO: 80854 - protein, 10 aa, Artificial Sequence
  Description of Artificial Sequence: Synthetic peptide
  Seed: SSFSSTLLSI (MAGC1_HUMAN)
SIFSSTLLSM

SEQ ID NO: 80855 - protein, 8 aa, Artificial Sequence
  Description of Artificial Sequence: Synthetic peptide
  Seed: FLLLKYQV (MAGC1_HUMAN)
FLLLKYQL

SEQ ID NO: 80856 - protein, 10 aa, Artificial Sequence
  Description of Artificial Sequence: Synthetic peptide
  Seed: FPSSTSSSLS (MAGC1_HUMAN)
FPSSTSSSLF

SEQ ID NO: 80857 - protein, 10 aa, Artificial Sequence
  Description of Artificial Sequence: Synthetic peptide
  Seed: MLKNTVPITF (MAGC1_HUMAN)
MSKNTVPITW

SEQ ID NO: 80858 - protein, 9 aa, Artificial Sequence
  Description of Artificial Sequence: Synthetic peptide
  Seed: SEVIKRKVV (MAGC1_HUMAN)
SEVIKRKVF

SEQ ID NO: 80859 - protein, 9 aa, Artificial Sequence
  Description of Artificial Sequence: Synthetic peptide
  Seed: RPVSSFFSY (MAGC1_HUMAN)
RPVSSFFSA

SEQ ID NO: 80860 - protein, 9 aa, Artificial Sequence
  Description of Artificial Sequence: Synthetic peptide
  Seed: IPVSPSFSS (MAGC1_HUMAN)
IPVSPSFSY

SEQ ID NO: 80861 - protein, 9 aa, Artificial Sequence
  Description of Artificial Sequence: Synthetic peptide
  Seed: VSRSFSSTL (MAGC1_HUMAN)
VHRSFSSTM

SEQ ID NO: 80862 - protein, 9 aa, Artificial Sequence
  Description of Artificial Sequence: Synthetic peptide
  Seed: WDVLSGIGV (MAGC1_HUMAN)
WEVLSGIGA

SEQ ID NO: 80863 - protein, 9 aa, Artificial Sequence
  Description of Artificial Sequence: Synthetic peptide
  Seed: FEGFAQSPL (MAGC1_HUMAN)
FAGFAQSPF

SEQ ID NO: 80864 - protein, 9 aa, Artificial Sequence
  Description of Artificial Sequence: Synthetic peptide
  Seed: LQIPGSPSF (MAGC1_HUMAN)
LNIPGSPSW

SEQ ID NO: 80865 - protein, 9 aa, Artificial Sequence
  Description of Artificial Sequence: Synthetic peptide
  Seed: SRYTGYFPV (MAGC1_HUMAN)
STYTGYFPF

SEQ ID NO: 80866 - protein, 10 aa, Artificial Sequence
  Description of Artificial Sequence: Synthetic peptide
  Seed: ESAQSAFEGF (MAGC1_HUMAN)
ETAQSAFEGY

SEQ ID NO: 80867 - protein, 11 aa, Artificial Sequence
  Description of Artificial Sequence: Synthetic peptide
  Seed: FLAMLKNTVPI (MAGC1_HUMAN)
FQAMLKNTVPI

SEQ ID NO: 80868 - protein, 10 aa, Artificial Sequence
  Description of Artificial Sequence: Synthetic peptide
  Seed: SSSSSTLLSL (MAGC1_HUMAN)
SPSSSTLLSW

SEQ ID NO: 80869 - protein, 9 aa, Artificial Sequence
  Description of Artificial Sequence: Synthetic peptide
  Seed: EFIEILFGI (MAGC1_HUMAN)
EGIEILFGI

SEQ ID NO: 80870 - protein, 9 aa, Artificial Sequence
  Description of Artificial Sequence: Synthetic peptide
  Seed: FSSTLLSLF (MAGC1_HUMAN)
FPSTLLSLH

SEQ ID NO: 80871 - protein, 11 aa, Artificial Sequence
  Description of Artificial Sequence: Synthetic peptide
  Seed: FLAMLKNTVPI (MAGC1_HUMAN)
FHAMLKNTVPL

SEQ ID NO: 80872 - protein, 9 aa, Artificial Sequence
  Description of Artificial Sequence: Synthetic peptide
  Seed: AMLKNTVPI (MAGC1_HUMAN)
ALLKNTVPY

SEQ ID NO: 80873 - protein, 9 aa, Artificial Sequence
  Description of Artificial Sequence: Synthetic peptide
  Seed: SPLYFPQSP (MAGC1_HUMAN)
SPLYFPQSA

SEQ ID NO: 80874 - protein, 9 aa, Artificial Sequence
  Description of Artificial Sequence: Synthetic peptide
  Seed: LQIPMTSSF (MAGC1_HUMAN)
LYIPMTSSL

SEQ ID NO: 80875 - protein, 9 aa, Artificial Sequence
  Description of Artificial Sequence: Synthetic peptide
  Seed: DSYVFVNTL (MAGC1_HUMAN)
DVYVFVNTV

SEQ ID NO: 80876 - protein, 9 aa, Artificial Sequence
  Description of Artificial Sequence: Synthetic peptide
  Seed: RTHSTFEGF (MAGC1_HUMAN)
RTHSTFEGI

SEQ ID NO: 80877 - protein, 11 aa, Artificial Sequence
  Description of Artificial Sequence: Synthetic peptide
  Seed: SASSSVMSPSF (MAGC1_HUMAN)
SQSSSVMSPSY

SEQ ID NO: 80878 - protein, 10 aa, Artificial Sequence
  Description of Artificial Sequence: Synthetic peptide
  Seed: SFSYTLLSLF (MAGC1_HUMAN)
SMSYTLLSLY

SEQ ID NO: 80879 - protein, 9 aa, Artificial Sequence
  Description of Artificial Sequence: Synthetic peptide
  Seed: SSSTSLSPF (MAGC1_HUMAN)
SYSTSLSPF

SEQ ID NO: 80880 - protein, 9 aa, Artificial Sequence
  Description of Artificial Sequence: Synthetic peptide
  Seed: YTGYFPVIF (MAGC1_HUMAN)
YAGYFPVIY

SEQ ID NO: 80881 - protein, 9 aa, Artificial Sequence
  Description of Artificial Sequence: Synthetic peptide
  Seed: VSSFFSYTL (MAGC1_HUMAN)
VMSFFSYTC

SEQ ID NO: 80882 - protein, 9 aa, Artificial Sequence
  Description of Artificial Sequence: Synthetic peptide
  Seed: TLLSLFQSF (MAGC1_HUMAN)
TVLSLFQSY

SEQ ID NO: 80883 - protein, 9 aa, Artificial Sequence
  Description of Artificial Sequence: Synthetic peptide
  Seed: YPLQSPQSR (MAGC1_HUMAN)
YFLQSPQSR

SEQ ID NO: 80884 - protein, 10 aa, Artificial Sequence
  Description of Artificial Sequence: Synthetic peptide
  Seed: SLFQSFSERT (MAGC1_HUMAN)
SIFQSFSERV

SEQ ID NO: 80885 - protein, 9 aa, Artificial Sequence
  Description of Artificial Sequence: Synthetic peptide
  Seed: SSSVMSPSF (MAGC1_HUMAN)
SASVMSPSW

SEQ ID NO: 80886 - protein, 9 aa, Artificial Sequence
  Description of Artificial Sequence: Synthetic peptide
  Seed: FQSSLQSPV (MAGC1_HUMAN)
FPSSLQSPY

SEQ ID NO: 80887 - protein, 9 aa, Artificial Sequence
  Description of Artificial Sequence: Synthetic peptide
  Seed: FSSALLSIF (MAGC1_HUMAN)
FFSALLSIY

SEQ ID NO: 80888 - protein, 9 aa, Artificial Sequence
  Description of Artificial Sequence: Synthetic peptide
  Seed: SSPESDDTL (MAGC1_HUMAN)
SHPESDDTL

SEQ ID NO: 80889 - protein, 10 aa, Artificial Sequence
  Description of Artificial Sequence: Synthetic peptide
  Seed: RSFSSTLLSI (MAGC1_HUMAN)
RIFSSTLLSV

SEQ ID NO: 80890 - protein, 9 aa, Artificial Sequence
  Description of Artificial Sequence: Synthetic peptide
  Seed: YTSSSDTLL (MAGC1_HUMAN)
YMSSSDTLM

SEQ ID NO: 80891 - protein, 10 aa, Artificial Sequence
  Description of Artificial Sequence: Synthetic peptide
  Seed: STLLSLFQSF (MAGC1_HUMAN)
SLLLSLFQSF

SEQ ID NO: 80892 - protein, 9 aa, Artificial Sequence
  Description of Artificial Sequence: Synthetic peptide
  Seed: SSSSSSSTL (MAGC1_HUMAN)
SQSSSSSTV

SEQ ID NO: 80893 - protein, 9 aa, Artificial Sequence
  Description of Artificial Sequence: Synthetic peptide
  Seed: SPPEGPAQS (MAGC1_HUMAN)
SAPEGPAQM

SEQ ID NO: 80894 - protein, 10 aa, Artificial Sequence
  Description of Artificial Sequence: Synthetic peptide
  Seed: LQRPVSSFFS (MAGC1_HUMAN)
LMRPVSSFFF

SEQ ID NO: 80895 - protein, 10 aa, Artificial Sequence
  Description of Artificial Sequence: Synthetic peptide
  Seed: YTLDEKVDEL (MAGC1_HUMAN)
YPLDEKVDEL

SEQ ID NO: 80896 - protein, 9 aa, Artificial Sequence
  Description of Artificial Sequence: Synthetic peptide
  Seed: LQIPVSSSS (MAGC1_HUMAN)
LPIPVSSSA

SEQ ID NO: 80897 - protein, 10 aa, Artificial Sequence
  Description of Artificial Sequence: Synthetic peptide
  Seed: ICSSSTSLSL (MAGC1_HUMAN)
IVSSSTSLSM

SEQ ID NO: 80898 - protein, 9 aa, Artificial Sequence
  Description of Artificial Sequence: Synthetic peptide
  Seed: AMLKNTVPI (MAGC1_HUMAN)
AQLKNTVPI

SEQ ID NO: 80899 - protein, 9 aa, Artificial Sequence
  Description of Artificial Sequence: Synthetic peptide
  Seed: SQNRLLILI (MAGC1_HUMAN)
SENRLLILV

SEQ ID NO: 80900 - protein, 9 aa, Artificial Sequence
  Description of Artificial Sequence: Synthetic peptide
  Seed: ASEEVIWDV (MAGC1_HUMAN)
ALEEVIWDV

SEQ ID NO: 80901 - protein, 11 aa, Artificial Sequence
  Description of Artificial Sequence: Synthetic peptide
  Seed: QSSPESAQSTF (MAGC1_HUMAN)
QVSPESAQSTY

SEQ ID NO: 80902 - protein, 9 aa, Artificial Sequence
  Description of Artificial Sequence: Synthetic peptide
  Seed: KVVEFLAML (MAGC1_HUMAN)
KSVEFLAMM

SEQ ID NO: 80903 - protein, 9 aa, Artificial Sequence
  Description of Artificial Sequence: Synthetic peptide
  Seed: YVFVNTLDL (MAGC1_HUMAN)
YEFVNTLDY

SEQ ID NO: 80904 - protein, 9 aa, Artificial Sequence
  Description of Artificial Sequence: Synthetic peptide
  Seed: LKYQVKQPI (MAGC1_HUMAN)
LKYQVKQPF

SEQ ID NO: 80905 - protein, 9 aa, Artificial Sequence
  Description of Artificial Sequence: Synthetic peptide
  Seed: SPVISFSSS (MAGC1_HUMAN)
SPVISFSSL

SEQ ID NO: 80906 - protein, 10 aa, Artificial Sequence
  Description of Artificial Sequence: Synthetic peptide
  Seed: SFSYTLLSLF (MAGC1_HUMAN)
SRSYTLLSLW

SEQ ID NO: 80907 - protein, 9 aa, Artificial Sequence
  Description of Artificial Sequence: Synthetic peptide
  Seed: GSPSFSSTL (MAGC1_HUMAN)
GYPSFSSTY

SEQ ID NO: 80908 - protein, 9 aa, Artificial Sequence
  Description of Artificial Sequence: Synthetic peptide
  Seed: FSYTLASLL (MAGC1_HUMAN)
FNYTLASLF

SEQ ID NO: 80909 - protein, 10 aa, Artificial Sequence
  Description of Artificial Sequence: Synthetic peptide
  Seed: STFEGFPQSL (MAGC1_HUMAN)
SSFEGFPQSM

SEQ ID NO: 80910 - protein, 9 aa, Artificial Sequence
  Description of Artificial Sequence: Synthetic peptide
  Seed: NSSPPRYEF (MAGC1_HUMAN)
NKSPPRYEY

SEQ ID NO: 80911 - protein, 10 aa, Artificial Sequence
  Description of Artificial Sequence: Synthetic peptide
  Seed: LTKVWVQEHY (MAGC1_HUMAN)
LSKVWVQEHF

SEQ ID NO: 80912 - protein, 10 aa, Artificial Sequence
  Description of Artificial Sequence: Synthetic peptide
  Seed: LSQSSPVSSF (MAGC1_HUMAN)
LQQSSPVSSW

SEQ ID NO: 80913 - protein, 11 aa, Artificial Sequence
  Description of Artificial Sequence: Synthetic peptide
  Seed: RSFSSTLLSIF (MAGC1_HUMAN)
RQFSSTLLSIL

SEQ ID NO: 80914 - protein, 9 aa, Artificial Sequence
  Description of Artificial Sequence: Synthetic peptide
  Seed: SSSESPQSC (MAGC1_HUMAN)
SVSESPQSF

SEQ ID NO: 80915 - protein, 10 aa, Artificial Sequence
  Description of Artificial Sequence: Synthetic peptide
  Seed: SFSERTQSTF (MAGC1_HUMAN)
SYSERTQSTL

SEQ ID NO: 80916 - protein, 10 aa, Artificial Sequence
  Description of Artificial Sequence: Synthetic peptide
  Seed: SSPECTQSTF (MAGC1_HUMAN)
SAPECTQSTL

SEQ ID NO: 80917 - protein, 9 aa, Artificial Sequence
  Description of Artificial Sequence: Synthetic peptide
  Seed: FSSTLLSIL (MAGC1_HUMAN)
FPSTLLSIM

SEQ ID NO: 80918 - protein, 9 aa, Artificial Sequence
  Description of Artificial Sequence: Synthetic peptide
  Seed: TFEGFPQSL (MAGC1_HUMAN)
TEEGFPQSM

SEQ ID NO: 80919 - protein, 10 aa, Artificial Sequence
  Description of Artificial Sequence: Synthetic peptide
  Seed: IIDTTDDSTA (MAGC1_HUMAN)
IIDTTDDSTL

SEQ ID NO: 80920 - protein, 9 aa, Artificial Sequence
  Description of Artificial Sequence: Synthetic peptide
  Seed: SKSSPESPL (MAGC1_HUMAN)
SASSPESPY

SEQ ID NO: 80921 - protein, 10 aa, Artificial Sequence
  Description of Artificial Sequence: Synthetic peptide
  Seed: VISFSSSTSL (MAGC1_HUMAN)
VPSFSSSTSF

SEQ ID NO: 80922 - protein, 9 aa, Artificial Sequence
  Description of Artificial Sequence: Synthetic peptide
  Seed: YQVKQPITK (MAGC1_HUMAN)
YVVKQPITL

SEQ ID NO: 80923 - protein, 10 aa, Artificial Sequence
  Description of Artificial Sequence: Synthetic peptide
  Seed: FAQSSLQIPV (MAGC1_HUMAN)
FPQSSLQIPI

SEQ ID NO: 80924 - protein, 9 aa, Artificial Sequence
  Description of Artificial Sequence: Synthetic peptide
  Seed: RTQSTFEGF (MAGC1_HUMAN)
RKQSTFEGF

SEQ ID NO: 80925 - protein, 9 aa, Artificial Sequence
  Description of Artificial Sequence: Synthetic peptide
  Seed: SVLQIPVSA (MAGC1_HUMAN)
SALQIPVSV

SEQ ID NO: 80926 - protein, 9 aa, Artificial Sequence
  Description of Artificial Sequence: Synthetic peptide
  Seed: VQSPLQNPA (MAGC1_HUMAN)
VKSPLQNPY

SEQ ID NO: 80927 - protein, 10 aa, Artificial Sequence
  Description of Artificial Sequence: Synthetic peptide
  Seed: ESAQSTFEGF (MAGC1_HUMAN)
ETAQSTFEGY

SEQ ID NO: 80928 - protein, 9 aa, Artificial Sequence
  Description of Artificial Sequence: Synthetic peptide
  Seed: SLPQSFPES (MAGC1_HUMAN)
SAPQSFPEL

SEQ ID NO: 80929 - protein, 9 aa, Artificial Sequence
  Description of Artificial Sequence: Synthetic peptide
  Seed: KQPITKAEM (MAGC1_HUMAN)
KIPITKAEM

SEQ ID NO: 80930 - protein, 9 aa, Artificial Sequence
  Description of Artificial Sequence: Synthetic peptide
  Seed: SSSVMSPSF (MAGC1_HUMAN)
SASVMSPSL

SEQ ID NO: 80931 - protein, 10 aa, Artificial Sequence
  Description of Artificial Sequence: Synthetic peptide
  Seed: KAREFIEILF (MAGC1_HUMAN)
KMREFIEILY

SEQ ID NO: 80932 - protein, 10 aa, Artificial Sequence
  Description of Artificial Sequence: Synthetic peptide
  Seed: SLQIPVSPSF (MAGC1_HUMAN)
SGQIPVSPSY

SEQ ID NO: 80933 - protein, 9 aa, Artificial Sequence
  Description of Artificial Sequence: Synthetic peptide
  Seed: LQIPVSRSF (MAGC1_HUMAN)
LEIPVSRSY

SEQ ID NO: 80934 - protein, 9 aa, Artificial Sequence
  Description of Artificial Sequence: Synthetic peptide
  Seed: YTGYFPVIF (MAGC1_HUMAN)
YYGYFPVIL

SEQ ID NO: 80935 - protein, 10 aa, Artificial Sequence
  Description of Artificial Sequence: Synthetic peptide
  Seed: SQSSPVSSFP (MAGC1_HUMAN)
SQSSPVSSFF

SEQ ID NO: 80936 - protein, 9 aa, Artificial Sequence
  Description of Artificial Sequence: Synthetic peptide
  Seed: IFRKAREFI (MAGC1_HUMAN)
ITRKAREFI

SEQ ID NO: 80937 - protein, 8 aa, Artificial Sequence
  Description of Artificial Sequence: Synthetic peptide
  Seed: SSFFSSAL (MAGC1_HUMAN)
SMFFSSAY

SEQ ID NO: 80938 - protein, 11 aa, Artificial Sequence
  Description of Artificial Sequence: Synthetic peptide
  Seed: EILFGISLREV (MAGC1_HUMAN)
EYLFGISLREL

SEQ ID NO: 80939 - protein, 9 aa, Artificial Sequence
  Description of Artificial Sequence: Synthetic peptide
  Seed: KVDELARFL (MAGC1_HUMAN)
KEDELARFM

SEQ ID NO: 80940 - protein, 9 aa, Artificial Sequence
  Description of Artificial Sequence: Synthetic peptide
  Seed: VSSSSSSTL (MAGC1_HUMAN)
VVSSSSSTW

SEQ ID NO: 80941 - protein, 9 aa, Artificial Sequence
  Description of Artificial Sequence: Synthetic peptide
  Seed: MTSSFSSTL (MAGC1_HUMAN)
MISSFSSTM

SEQ ID NO: 80942 - protein, 9 aa, Artificial Sequence
  Description of Artificial Sequence: Synthetic peptide
  Seed: SPQSPPEGP (MAGC1_HUMAN)
SPQSPPEGV

SEQ ID NO: 80943 - protein, 9 aa, Artificial Sequence
  Description of Artificial Sequence: Synthetic peptide
  Seed: FLAMLKNTV (MAGC1_HUMAN)
FTAMLKNTA

SEQ ID NO: 80944 - protein, 9 aa, Artificial Sequence
  Description of Artificial Sequence: Synthetic peptide
  Seed: QVKQPITKA (MAGC1_HUMAN)
QPKQPITKV

SEQ ID NO: 80945 - protein, 11 aa, Artificial Sequence
  Description of Artificial Sequence: Synthetic peptide
  Seed: STFEGFPQSLL (MAGC1_HUMAN)
SMFEGFPQSLQ

SEQ ID NO: 80946 - protein, 10 aa, Artificial Sequence
  Description of Artificial Sequence: Synthetic peptide
  Seed: REFIEILFGI (MAGC1_HUMAN)
RKFIEILFGF

SEQ ID NO: 80947 - protein, 9 aa, Artificial Sequence
  Description of Artificial Sequence: Synthetic peptide
  Seed: GEDSMSPLY (MAGC1_HUMAN)
GEDSMSPLM

SEQ ID NO: 80948 - protein, 9 aa, Artificial Sequence
  Description of Artificial Sequence: Synthetic peptide
  Seed: VQEHYLEYR (MAGC1_HUMAN)
VVEHYLEYY

SEQ ID NO: 80949 - protein, 10 aa, Artificial Sequence
  Description of Artificial Sequence: Synthetic peptide
  Seed: PLQRPVSSFF (MAGC1_HUMAN)
PLQRPVSSFY

SEQ ID NO: 80950 - protein, 9 aa, Artificial Sequence
  Description of Artificial Sequence: Synthetic peptide
  Seed: AGREHFAFG (MAGC1_HUMAN)
AYREHFAFM

SEQ ID NO: 80951 - protein, 11 aa, Artificial Sequence
  Description of Artificial Sequence: Synthetic peptide
  Seed: RYTGYFPVIFR (MAGC1_HUMAN)
RRTGYFPVIFR

SEQ ID NO: 80952 - protein, 10 aa, Artificial Sequence
  Description of Artificial Sequence: Synthetic peptide
  Seed: ESAQSAFEGF (MAGC1_HUMAN)
EAAQSAFEGW

SEQ ID NO: 80953 - protein, 9 aa, Artificial Sequence
  Description of Artificial Sequence: Synthetic peptide
  Seed: VSSSFSYTL (MAGC1_HUMAN)
VLSSFSYTT

SEQ ID NO: 80954 - protein, 9 aa, Artificial Sequence
  Description of Artificial Sequence: Synthetic peptide
  Seed: SGIGVRAGR (MAGC1_HUMAN)
SVIGVRAGK

SEQ ID NO: 80955 - protein, 9 aa, Artificial Sequence
  Description of Artificial Sequence: Synthetic peptide
  Seed: ASSFFSSAL (MAGC1_HUMAN)
ALSFFSSAY

SEQ ID NO: 80956 - protein, 9 aa, Artificial Sequence
  Description of Artificial Sequence: Synthetic peptide
  Seed: TTDDSTATE (MAGC1_HUMAN)
TADDSTATM

SEQ ID NO: 80957 - protein, 9 aa, Artificial Sequence
  Description of Artificial Sequence: Synthetic peptide
  Seed: SEESSSPVD (MAGC1_HUMAN)
SEESSSPVV

SEQ ID NO: 80958 - protein, 10 aa, Artificial Sequence
  Description of Artificial Sequence: Synthetic peptide
  Seed: SSPERTHSTF (MAGC1_HUMAN)
SYPERTHSTY

SEQ ID NO: 80959 - protein, 9 aa, Artificial Sequence
  Description of Artificial Sequence: Synthetic peptide
  Seed: AQSPLQIPV (MAGC1_HUMAN)
ASSPLQIPY

SEQ ID NO: 80960 - protein, 9 aa, Artificial Sequence
  Description of Artificial Sequence: Synthetic peptide
  Seed: KVDELARFL (MAGC1_HUMAN)
KADELARFL

SEQ ID NO: 80961 - protein, 11 aa, Artificial Sequence
  Description of Artificial Sequence: Synthetic peptide
  Seed: QSSPESDDTLY (MAGC1_HUMAN)
QISPESDDTLY

SEQ ID NO: 80962 - protein, 9 aa, Artificial Sequence
  Description of Artificial Sequence: Synthetic peptide
  Seed: LQNPASSFF (MAGC1_HUMAN)
LINPASSFF

SEQ ID NO: 80963 - protein, 9 aa, Artificial Sequence
  Description of Artificial Sequence: Synthetic peptide
  Seed: ISFSSSTSL (MAGC1_HUMAN)
IMFSSSTSY

SEQ ID NO: 80964 - protein, 9 aa, Artificial Sequence
  Description of Artificial Sequence: Synthetic peptide
  Seed: SSPERTHST (MAGC1_HUMAN)
SGPERTHSF

SEQ ID NO: 80965 - protein, 9 aa, Artificial Sequence
  Description of Artificial Sequence: Synthetic peptide
  Seed: RKVVEFLAM (MAGC1_HUMAN)
RMVVEFLAW

SEQ ID NO: 80966 - protein, 8 aa, Artificial Sequence
  Description of Artificial Sequence: Synthetic peptide
  Seed: SSFSYTLL (MAGC1_HUMAN)
STFSYTLY

SEQ ID NO: 80967 - protein, 10 aa, Artificial Sequence
  Description of Artificial Sequence: Synthetic peptide
  Seed: WGPRAHSEVI (MAGC1_HUMAN)
WSPRAHSEVL

SEQ ID NO: 80968 - protein, 9 aa, Artificial Sequence
  Description of Artificial Sequence: Synthetic peptide
  Seed: GPVQSPLHS (MAGC1_HUMAN)
GPVQSPLHA

SEQ ID NO: 80969 - protein, 9 aa, Artificial Sequence
  Description of Artificial Sequence: Synthetic peptide
  Seed: LQIVPSLPE (MAGC1_HUMAN)
LHIVPSLPY

SEQ ID NO: 80970 - protein, 9 aa, Artificial Sequence
  Description of Artificial Sequence: Synthetic peptide
  Seed: AMLKNTVPI (MAGC1_HUMAN)
AMLKNTVPA

SEQ ID NO: 80971 - protein, 11 aa, Artificial Sequence
  Description of Artificial Sequence: Synthetic peptide
  Seed: REVDPDDSYVF (MAGC1_HUMAN)
RTVDPDDSYVL

SEQ ID NO: 80972 - protein, 9 aa, Artificial Sequence
  Description of Artificial Sequence: Synthetic peptide
  Seed: VSSFFSYTL (MAGC1_HUMAN)
VHSFFSYTY

SEQ ID NO: 80973 - protein, 9 aa, Artificial Sequence
  Description of Artificial Sequence: Synthetic peptide
  Seed: SESPQSCPE (MAGC1_HUMAN)
SESPQSCPI

SEQ ID NO: 80974 - protein, 9 aa, Artificial Sequence
  Description of Artificial Sequence: Synthetic peptide
  Seed: SPLQIPQSS (MAGC1_HUMAN)
SALQIPQSA

SEQ ID NO: 80975 - protein, 9 aa, Artificial Sequence
  Description of Artificial Sequence: Synthetic peptide
  Seed: SLIESEPLF (MAGC1_HUMAN)
SLIESEPLV

SEQ ID NO: 80976 - protein, 10 aa, Artificial Sequence
  Description of Artificial Sequence: Synthetic peptide
  Seed: DVLSGIGVRA (MAGC1_HUMAN)
DILSGIGVRR

SEQ ID NO: 80977 - protein, 9 aa, Artificial Sequence
  Description of Artificial Sequence: Synthetic peptide
  Seed: NVISRYTGY (MAGC1_HUMAN)
NTISRYTGK

SEQ ID NO: 80978 - protein, 10 aa, Artificial Sequence
  Description of Artificial Sequence: Synthetic peptide
  Seed: LLQIPMTSSF (MAGC1_HUMAN)
LTQIPMTSSM

SEQ ID NO: 80979 - protein, 9 aa, Artificial Sequence
  Description of Artificial Sequence: Synthetic peptide
  Seed: SAPEGEDSL (MAGC1_HUMAN)
SQPEGEDSL

SEQ ID NO: 80980 - protein, 11 aa, Artificial Sequence
  Description of Artificial Sequence: Synthetic peptide
  Seed: REVDPDDSYVF (MAGC1_HUMAN)
RYVDPDDSYVF

SEQ ID NO: 80981 - protein, 9 aa, Artificial Sequence
  Description of Artificial Sequence: Synthetic peptide
  Seed: VSSSSSSTL (MAGC1_HUMAN)
VSSSSSSTF

SEQ ID NO: 80982 - protein, 9 aa, Artificial Sequence
  Description of Artificial Sequence: Synthetic peptide
  Seed: MTSSFSSTL (MAGC1_HUMAN)
MNSSFSSTV

SEQ ID NO: 80983 - protein, 9 aa, Artificial Sequence
  Description of Artificial Sequence: Synthetic peptide
  Seed: LSDEQGMSQ (MAGC1_HUMAN)
LFDEQGMSI

SEQ ID NO: 80984 - protein, 9 aa, Artificial Sequence
  Description of Artificial Sequence: Synthetic peptide
  Seed: DELARFLLL (MAGC1_HUMAN)
DQLARFLLL

SEQ ID NO: 80985 - protein, 9 aa, Artificial Sequence
  Description of Artificial Sequence: Synthetic peptide
  Seed: TLLSLFQSF (MAGC1_HUMAN)
TMLSLFQSV

SEQ ID NO: 80986 - protein, 9 aa, Artificial Sequence
  Description of Artificial Sequence: Synthetic peptide
  Seed: LQNPASSFF (MAGC1_HUMAN)
LKNPASSFY

SEQ ID NO: 80987 - protein, 10 aa, Artificial Sequence
  Description of Artificial Sequence: Synthetic peptide
  Seed: WGPRAHSEVI (MAGC1_HUMAN)
WTPRAHSEVL

SEQ ID NO: 80988 - protein, 10 aa, Artificial Sequence
  Description of Artificial Sequence: Synthetic peptide
  Seed: FPQSPLQIPV (MAGC1_HUMAN)
FKQSPLQIPV

SEQ ID NO: 80989 - protein, 10 aa, Artificial Sequence
  Description of Artificial Sequence: Synthetic peptide
  Seed: SFSSTLLSIF (MAGC1_HUMAN)
SISSTLLSIW

SEQ ID NO: 80990 - protein, 9 aa, Artificial Sequence
  Description of Artificial Sequence: Synthetic peptide
  Seed: YVFVNTLDL (MAGC1_HUMAN)
YVFVNTLDF

SEQ ID NO: 80991 - protein, 9 aa, Artificial Sequence
  Description of Artificial Sequence: Synthetic peptide
  Seed: SQNRLLILI (MAGC1_HUMAN)
SQNRLLILL

SEQ ID NO: 80992 - protein, 10 aa, Artificial Sequence
  Description of Artificial Sequence: Synthetic peptide
  Seed: STPSSLPQSF (MAGC1_HUMAN)
SVPSSLPQSL

SEQ ID NO: 80993 - protein, 9 aa, Artificial Sequence
  Description of Artificial Sequence: Synthetic peptide
  Seed: VLQIPVSAA (MAGC1_HUMAN)
VLQIPVSAL

SEQ ID NO: 80994 - protein, 10 aa, Artificial Sequence
  Description of Artificial Sequence: Synthetic peptide
  Seed: SSPECTQSTF (MAGC1_HUMAN)
SLPECTQSTY

SEQ ID NO: 80995 - protein, 11 aa, Artificial Sequence
  Description of Artificial Sequence: Synthetic peptide
  Seed: SICSSSTPSSL (MAGC1_HUMAN)
SACSSSTPSSY

SEQ ID NO: 80996 - protein, 9 aa, Artificial Sequence
  Description of Artificial Sequence: Synthetic peptide
  Seed: SQSSPVSSF (MAGC1_HUMAN)
SISSPVSSL

SEQ ID NO: 80997 - protein, 11 aa, Artificial Sequence
  Description of Artificial Sequence: Synthetic peptide
  Seed: SSFPSSTSSSL (MAGC1_HUMAN)
SIFPSSTSSSF

SEQ ID NO: 80998 - protein, 10 aa, Artificial Sequence
  Description of Artificial Sequence: Synthetic peptide
  Seed: YTLDEKVDEL (MAGC1_HUMAN)
YLLDEKVDET

SEQ ID NO: 80999 - protein, 10 aa, Artificial Sequence
  Description of Artificial Sequence: Synthetic peptide
  Seed: SSSSSTLLSL (MAGC1_HUMAN)
SYSSSTLLSF

SEQ ID NO: 81000 - protein, 11 aa, Artificial Sequence
  Description of Artificial Sequence: Synthetic peptide
  Seed: SPLQRPVSSFF (MAGC1_HUMAN)
SHLQRPVSSFF

SEQ ID NO: 81001 - protein, 11 aa, Artificial Sequence
  Description of Artificial Sequence: Synthetic peptide
  Seed: REVDPDDSYVF (MAGC1_HUMAN)
RHVDPDDSYVW

SEQ ID NO: 81002 - protein, 9 aa, Artificial Sequence
  Description of Artificial Sequence: Synthetic peptide
  Seed: LQNPASSFF (MAGC1_HUMAN)
LSNPASSFL

SEQ ID NO: 81003 - protein, 11 aa, Artificial Sequence
  Description of Artificial Sequence: Synthetic peptide
  Seed: SLIESEPLFTY (MAGC1_HUMAN)
SMIESEPLFTK

SEQ ID NO: 81004 - protein, 10 aa, Artificial Sequence
  Description of Artificial Sequence: Synthetic peptide
  Seed: PLQIPVSSSF (MAGC1_HUMAN)
PMQIPVSSSY

SEQ ID NO: 81005 - protein, 9 aa, Artificial Sequence
  Description of Artificial Sequence: Synthetic peptide
  Seed: FSSALLSIF (MAGC1_HUMAN)
FMSALLSIW

SEQ ID NO: 81006 - protein, 9 aa, Artificial Sequence
  Description of Artificial Sequence: Synthetic peptide
  Seed: TLDEKVDEL (MAGC1_HUMAN)
TIDEKVDEV

SEQ ID NO: 81007 - protein, 9 aa, Artificial Sequence
  Description of Artificial Sequence: Synthetic peptide
  Seed: YTSSSDTLL (MAGC1_HUMAN)
YLSSSDTLY

SEQ ID NO: 81008 - protein, 9 aa, Artificial Sequence
  Description of Artificial Sequence: Synthetic peptide
  Seed: SSSSTLLSL (MAGC1_HUMAN)
SASSTLLSY

SEQ ID NO: 81009 - protein, 10 aa, Artificial Sequence
  Description of Artificial Sequence: Synthetic peptide
  Seed: VISFSSSTSL (MAGC1_HUMAN)
VNSFSSSTSF

SEQ ID NO: 81010 - protein, 11 aa, Artificial Sequence
  Description of Artificial Sequence: Synthetic peptide
  Seed: AIIDTTDDSTA (MAGC1_HUMAN)
ALIDTTDDSTV

SEQ ID NO: 81011 - protein, 10 aa, Artificial Sequence
  Description of Artificial Sequence: Synthetic peptide
  Seed: SFSSTLVSLF (MAGC1_HUMAN)
SYSSTLVSLF

SEQ ID NO: 81012 - protein, 9 aa, Artificial Sequence
  Description of Artificial Sequence: Synthetic peptide
  Seed: DSYVFVNTL (MAGC1_HUMAN)
DAYVFVNTK

SEQ ID NO: 81013 - protein, 11 aa, Artificial Sequence
  Description of Artificial Sequence: Synthetic peptide
  Seed: LLQIPMTSSFS (MAGC1_HUMAN)
LLQIPMTSSFY

SEQ ID NO: 81014 - protein, 11 aa, Artificial Sequence
  Description of Artificial Sequence: Synthetic peptide
  Seed: IPVSAASSSTL (MAGC1_HUMAN)
IYVSAASSSTY

SEQ ID NO: 81015 - protein, 10 aa, Artificial Sequence
  Description of Artificial Sequence: Synthetic peptide
  Seed: ASSSTLVSIF (MAGC1_HUMAN)
ANSSTLVSIW

SEQ ID NO: 81016 - protein, 9 aa, Artificial Sequence
  Description of Artificial Sequence: Synthetic peptide
  Seed: HESPQSPPE (MAGC1_HUMAN)
HESPQSPPI

SEQ ID NO: 81017 - protein, 9 aa, Artificial Sequence
  Description of Artificial Sequence: Synthetic peptide
  Seed: SPLQIVPSL (MAGC1_HUMAN)
SRLQIVPSV

SEQ ID NO: 81018 - protein, 9 aa, Artificial Sequence
  Description of Artificial Sequence: Synthetic peptide
  Seed: AQSPLQRPV (MAGC1_HUMAN)
AMSPLQRPL

SEQ ID NO: 81019 - protein, 10 aa, Artificial Sequence
  Description of Artificial Sequence: Synthetic peptide
  Seed: LQIPVSSSFS (MAGC1_HUMAN)
LMIPVSSSFV

SEQ ID NO: 81020 - protein, 10 aa, Artificial Sequence
  Description of Artificial Sequence: Synthetic peptide
  Seed: SRYTGYFPVI (MAGC1_HUMAN)
SVYTGYFPVM

SEQ ID NO: 81021 - protein, 9 aa, Artificial Sequence
  Description of Artificial Sequence: Synthetic peptide
  Seed: KAREFIEIL (MAGC1_HUMAN)
KIREFIEIL

SEQ ID NO: 81022 - protein, 9 aa, Artificial Sequence
  Description of Artificial Sequence: Synthetic peptide
  Seed: LQIPVSSSS (MAGC1_HUMAN)
LVIPVSSSF

SEQ ID NO: 81023 - protein, 9 aa, Artificial Sequence
  Description of Artificial Sequence: Synthetic peptide
  Seed: FSSALLSIF (MAGC1_HUMAN)
FYSALLSIM

SEQ ID NO: 81024 - protein, 10 aa, Artificial Sequence
  Description of Artificial Sequence: Synthetic peptide
  Seed: FPQSPLQIPV (MAGC1_HUMAN)
FMQSPLQIPM

SEQ ID NO: 81025 - protein, 9 aa, Artificial Sequence
  Description of Artificial Sequence: Synthetic peptide
  Seed: FPQSPPQGE (MAGC1_HUMAN)
FPQSPPQGV

SEQ ID NO: 81026 - protein, 10 aa, Artificial Sequence
  Description of Artificial Sequence: Synthetic peptide
  Seed: LSQSSPVSSF (MAGC1_HUMAN)
LVQSSPVSSW

SEQ ID NO: 81027 - protein, 9 aa, Artificial Sequence
  Description of Artificial Sequence: Synthetic peptide
  Seed: NSSPPRYEF (MAGC1_HUMAN)
NYSPPRYEM

SEQ ID NO: 81028 - protein, 9 aa, Artificial Sequence
  Description of Artificial Sequence: Synthetic peptide
  Seed: VIKRKVVEF (MAGC1_HUMAN)
VSKRKVVEF

SEQ ID NO: 81029 - protein, 9 aa, Artificial Sequence
  Description of Artificial Sequence: Synthetic peptide
  Seed: MGDKDMPTA (MAGC1_HUMAN)
MVDKDMPTL

SEQ ID NO: 81030 - protein, 11 aa, Artificial Sequence
  Description of Artificial Sequence: Synthetic peptide
  Seed: FLAMLKNTVPI (MAGC1_HUMAN)
FFAMLKNTVPI

SEQ ID NO: 81031 - protein, 9 aa, Artificial Sequence
  Description of Artificial Sequence: Synthetic peptide
  Seed: FSYTLASLL (MAGC1_HUMAN)
FEYTLASLF

SEQ ID NO: 81032 - protein, 9 aa, Artificial Sequence
  Description of Artificial Sequence: Synthetic peptide
  Seed: SQSSPVSSF (MAGC1_HUMAN)
SQSSPVSSM

SEQ ID NO: 81033 - protein, 10 aa, Artificial Sequence
  Description of Artificial Sequence: Synthetic peptide
  Seed: MSPLYFPQSP (MAGC1_HUMAN)
MFPLYFPQSA

SEQ ID NO: 81034 - protein, 11 aa, Artificial Sequence
  Description of Artificial Sequence: Synthetic peptide
  Seed: YTGYFPVIFRK (MAGC1_HUMAN)
YLGYFPVIFRR

SEQ ID NO: 81035 - protein, 9 aa, Artificial Sequence
  Description of Artificial Sequence: Synthetic peptide
  Seed: AGREHFAFG (MAGC1_HUMAN)
AVREHFAFQ

SEQ ID NO: 81036 - protein, 10 aa, Artificial Sequence
  Description of Artificial Sequence: Synthetic peptide
  Seed: TGYFPVIFRK (MAGC1_HUMAN)
TWYFPVIFRK

SEQ ID NO: 81037 - protein, 11 aa, Artificial Sequence
  Description of Artificial Sequence: Synthetic peptide
  Seed: SAASSSTLVSI (MAGC1_HUMAN)
SSASSSTLVSW

SEQ ID NO: 81038 - protein, 11 aa, Artificial Sequence
  Description of Artificial Sequence: Synthetic peptide
  Seed: SSTSLSLPQSF (MAGC1_HUMAN)
SQTSLSLPQSW

SEQ ID NO: 81039 - protein, 10 aa, Artificial Sequence
  Description of Artificial Sequence: Synthetic peptide
  Seed: EMLTNVISRY (MAGC1_HUMAN)
EMLTNVISRR

SEQ ID NO: 81040 - protein, 9 aa, Artificial Sequence
  Description of Artificial Sequence: Synthetic peptide
  Seed: TFEGFPQSL (MAGC1_HUMAN)
TLEGFPQSI

SEQ ID NO: 81041 - protein, 9 aa, Artificial Sequence
  Description of Artificial Sequence: Synthetic peptide
  Seed: KAEMLTNVI (MAGC1_HUMAN)
KAEMLTNVW

SEQ ID NO: 81042 - protein, 9 aa, Artificial Sequence
  Description of Artificial Sequence: Synthetic peptide
  Seed: RLLILILSI (MAGC1_HUMAN)
RYLILILSY

SEQ ID NO: 81043 - protein, 9 aa, Artificial Sequence
  Description of Artificial Sequence: Synthetic peptide
  Seed: IESEPLFTY (MAGC1_HUMAN)
IASEPLFTV

SEQ ID NO: 81044 - protein, 9 aa, Artificial Sequence
  Description of Artificial Sequence: Synthetic peptide
  Seed: LQIPMTSSF (MAGC1_HUMAN)
LEIPMTSSL

SEQ ID NO: 81045 - protein, 9 aa, Artificial Sequence
  Description of Artificial Sequence: Synthetic peptide
  Seed: SIFQSSPER (MAGC1_HUMAN)
STFQSSPER

SEQ ID NO: 81046 - protein, 10 aa, Artificial Sequence
  Description of Artificial Sequence: Synthetic peptide
  Seed: KAREFIEILF (MAGC1_HUMAN)
KTREFIEILK

SEQ ID NO: 81047 - protein, 10 aa, Artificial Sequence
  Description of Artificial Sequence: Synthetic peptide
  Seed: SLSPLHFPQF (MAGC1_HUMAN)
SYSPLHFPQF

SEQ ID NO: 81048 - protein, 9 aa, Artificial Sequence
  Description of Artificial Sequence: Synthetic peptide
  Seed: IPMTSSFSS (MAGC1_HUMAN)
ICMTSSFSY

SEQ ID NO: 81049 - protein, 10 aa, Artificial Sequence
  Description of Artificial Sequence: Synthetic peptide
  Seed: LLQIPMTSSF (MAGC1_HUMAN)
LGQIPMTSSY

SEQ ID NO: 81050 - protein, 10 aa, Artificial Sequence
  Description of Artificial Sequence: Synthetic peptide
  Seed: LQIPVSPSFS (MAGC1_HUMAN)
LQIPVSPSFA

SEQ ID NO: 81051 - protein, 9 aa, Artificial Sequence
  Description of Artificial Sequence: Synthetic peptide
  Seed: FFSYTLASL (MAGC1_HUMAN)
FLSYTLASC

SEQ ID NO: 81052 - protein, 9 aa, Artificial Sequence
  Description of Artificial Sequence: Synthetic peptide
  Seed: FAFGEPREL (MAGC1_HUMAN)
FHFGEPREI

SEQ ID NO: 81053 - protein, 9 aa, Artificial Sequence
  Description of Artificial Sequence: Synthetic peptide
  Seed: SQSSPVSSF (MAGC1_HUMAN)
SESSPVSSF

SEQ ID NO: 81054 - protein, 9 aa, Artificial Sequence
  Description of Artificial Sequence: Synthetic peptide
  Seed: YVFVNTLDL (MAGC1_HUMAN)
YYFVNTLDH

SEQ ID NO: 81055 - protein, 9 aa, Artificial Sequence
  Description of Artificial Sequence: Synthetic peptide
  Seed: SSSDTLLES (MAGC1_HUMAN)
SISDTLLEM

SEQ ID NO: 81056 - protein, 10 aa, Artificial Sequence
  Description of Artificial Sequence: Synthetic peptide
  Seed: SSPESTQSPF (MAGC1_HUMAN)
SQPESTQSPM

SEQ ID NO: 81057 - protein, 10 aa, Artificial Sequence
  Description of Artificial Sequence: Synthetic peptide
  Seed: DVLSGIGVRA (MAGC1_HUMAN)
DALSGIGVRV

SEQ ID NO: 81058 - protein, 9 aa, Artificial Sequence
  Description of Artificial Sequence: Synthetic peptide
  Seed: QIVPSLPEW (MAGC1_HUMAN)
QMVPSLPEL

SEQ ID NO: 81059 - protein, 9 aa, Artificial Sequence
  Description of Artificial Sequence: Synthetic peptide
  Seed: LQSPVISFS (MAGC1_HUMAN)
LNSPVISFV

SEQ ID NO: 81060 - protein, 9 aa, Artificial Sequence
  Description of Artificial Sequence: Synthetic peptide
  Seed: SSPECTQST (MAGC1_HUMAN)
SFPECTQSM

SEQ ID NO: 81061 - protein, 9 aa, Artificial Sequence
  Description of Artificial Sequence: Synthetic peptide
  Seed: YTSSSDTLL (MAGC1_HUMAN)
YMSSSDTLV

SEQ ID NO: 81062 - protein, 9 aa, Artificial Sequence
  Description of Artificial Sequence: Synthetic peptide
  Seed: WGPRAHSEV (MAGC1_HUMAN)
WIPRAHSEL

SEQ ID NO: 81063 - protein, 9 aa, Artificial Sequence
  Description of Artificial Sequence: Synthetic peptide
  Seed: VIFRKAREF (MAGC1_HUMAN)
VSFRKAREW

SEQ ID NO: 81064 - protein, 10 aa, Artificial Sequence
  Description of Artificial Sequence: Synthetic peptide
  Seed: PLQIPVSSSF (MAGC1_HUMAN)
PMQIPVSSSF

SEQ ID NO: 81065 - protein, 10 aa, Artificial Sequence
  Description of Artificial Sequence: Synthetic peptide
  Seed: PMTSSFSSTL (MAGC1_HUMAN)
PFTSSFSSTV

SEQ ID NO: 81066 - protein, 9 aa, Artificial Sequence
  Description of Artificial Sequence: Synthetic peptide
  Seed: YVFVNTLDL (MAGC1_HUMAN)
YRFVNTLDL

SEQ ID NO: 81067 - protein, 10 aa, Artificial Sequence
  Description of Artificial Sequence: Synthetic peptide
  Seed: VSSSSSSTLL (MAGC1_HUMAN)
VYSSSSSTLF

SEQ ID NO: 81068 - protein, 9 aa, Artificial Sequence
  Description of Artificial Sequence: Synthetic peptide
  Seed: RTQSTFEGF (MAGC1_HUMAN)
RVQSTFEGL

SEQ ID NO: 81069 - protein, 9 aa, Artificial Sequence
  Description of Artificial Sequence: Synthetic peptide
  Seed: FSSTLLSIL (MAGC1_HUMAN)
FASTLLSIH

SEQ ID NO: 81070 - protein, 10 aa, Artificial Sequence
  Description of Artificial Sequence: Synthetic peptide
  Seed: ICSSSTSLSL (MAGC1_HUMAN)
IQSSSTSLSM

SEQ ID NO: 81071 - protein, 11 aa, Artificial Sequence
  Description of Artificial Sequence: Synthetic peptide
  Seed: LWGPRAHSEVI (MAGC1_HUMAN)
LRGPRAHSEVM

SEQ ID NO: 81072 - protein, 10 aa, Artificial Sequence
  Description of Artificial Sequence: Synthetic peptide
  Seed: VSSSSSSSTL (MAGC1_HUMAN)
VYSSSSSSTY

SEQ ID NO: 81073 - protein, 9 aa, Artificial Sequence
  Description of Artificial Sequence: Synthetic peptide
  Seed: AGREHFAFG (MAGC1_HUMAN)
AMREHFAFG

SEQ ID NO: 81074 - protein, 9 aa, Artificial Sequence
  Description of Artificial Sequence: Synthetic peptide
  Seed: SGIGVRAGR (MAGC1_HUMAN)
SWIGVRAGR

SEQ ID NO: 81075 - protein, 9 aa, Artificial Sequence
  Description of Artificial Sequence: Synthetic peptide
  Seed: VSPSSSSTL (MAGC1_HUMAN)
VGPSSSSTM

SEQ ID NO: 81076 - protein, 10 aa, Artificial Sequence
  Description of Artificial Sequence: Synthetic peptide
  Seed: SLFQSFSERT (MAGC1_HUMAN)
SSFQSFSERR

SEQ ID NO: 81077 - protein, 10 aa, Artificial Sequence
  Description of Artificial Sequence: Synthetic peptide
  Seed: RYTGYFPVIF (MAGC1_HUMAN)
RMTGYFPVIY

SEQ ID NO: 81078 - protein, 10 aa, Artificial Sequence
  Description of Artificial Sequence: Synthetic peptide
  Seed: LQIPMTSSFS (MAGC1_HUMAN)
LMIPMTSSFI

SEQ ID NO: 81079 - protein, 9 aa, Artificial Sequence
  Description of Artificial Sequence: Synthetic peptide
  Seed: SFSERTQST (MAGC1_HUMAN)
SWSERTQSM

SEQ ID NO: 81080 - protein, 11 aa, Artificial Sequence
  Description of Artificial Sequence: Synthetic peptide
  Seed: SSSSSTLLSLF (MAGC1_HUMAN)
SYSSSTLLSLW

SEQ ID NO: 81081 - protein, 9 aa, Artificial Sequence
  Description of Artificial Sequence: Synthetic peptide
  Seed: LQIPVSSSS (MAGC1_HUMAN)
LQIPVSSSV

SEQ ID NO: 81082 - protein, 11 aa, Artificial Sequence
  Description of Artificial Sequence: Synthetic peptide
  Seed: RYTGYFPVIFR (MAGC1_HUMAN)
RWTGYFPVIFW

SEQ ID NO: 81083 - protein, 9 aa, Artificial Sequence
  Description of Artificial Sequence: Synthetic peptide
  Seed: FEGFAQSPL (MAGC1_HUMAN)
FEGFAQSPI

SEQ ID NO: 81084 - protein, 9 aa, Artificial Sequence
  Description of Artificial Sequence: Synthetic peptide
  Seed: LQIPVSAAS (MAGC1_HUMAN)
LIIPVSAAF

SEQ ID NO: 81085 - protein, 9 aa, Artificial Sequence
  Description of Artificial Sequence: Synthetic peptide
  Seed: SSSVMSPSF (MAGC1_HUMAN)
SPSVMSPSW

SEQ ID NO: 81086 - protein, 9 aa, Artificial Sequence
  Description of Artificial Sequence: Synthetic peptide
  Seed: LKYQVKQPI (MAGC1_HUMAN)
LHYQVKQPM

SEQ ID NO: 81087 - protein, 9 aa, Artificial Sequence
  Description of Artificial Sequence: Synthetic peptide
  Seed: RYTGYFPVI (MAGC1_HUMAN)
RMTGYFPVF

SEQ ID NO: 81088 - protein, 9 aa, Artificial Sequence
  Description of Artificial Sequence: Synthetic peptide
  Seed: TLVSIFQSS (MAGC1_HUMAN)
TLVSIFQST

SEQ ID NO: 81089 - protein, 10 aa, Artificial Sequence
  Description of Artificial Sequence: Synthetic peptide
  Seed: TLDEKVDELA (MAGC1_HUMAN)
TVDEKVDELM

SEQ ID NO: 81090 - protein, 10 aa, Artificial Sequence
  Description of Artificial Sequence: Synthetic peptide
  Seed: LLQIPMTSSF (MAGC1_HUMAN)
LNQIPMTSSY

SEQ ID NO: 81091 - protein, 10 aa, Artificial Sequence
  Description of Artificial Sequence: Synthetic peptide
  Seed: KVVEFLAMLK (MAGC1_HUMAN)
KQVEFLAMLV

SEQ ID NO: 81092 - protein, 10 aa, Artificial Sequence
  Description of Artificial Sequence: Synthetic peptide
  Seed: YTLASLLQSS (MAGC1_HUMAN)
YFLASLLQSL

SEQ ID NO: 81093 - protein, 9 aa, Artificial Sequence
  Description of Artificial Sequence: Synthetic peptide
  Seed: SPLQRPVSS (MAGC1_HUMAN)
SNLQRPVSL

SEQ ID NO: 81094 - protein, 9 aa, Artificial Sequence
  Description of Artificial Sequence: Synthetic peptide
  Seed: ISFSSSTSL (MAGC1_HUMAN)
IFFSSSTSV

SEQ ID NO: 81095 - protein, 11 aa, Artificial Sequence
  Description of Artificial Sequence: Synthetic peptide
  Seed: MSPLYFPQSPL (MAGC1_HUMAN)
MIPLYFPQSPV

SEQ ID NO: 81096 - protein, 9 aa, Artificial Sequence
  Description of Artificial Sequence: Synthetic peptide
  Seed: YQVKQPITK (MAGC1_HUMAN)
YYVKQPITY

SEQ ID NO: 81097 - protein, 11 aa, Artificial Sequence
  Description of Artificial Sequence: Synthetic peptide
  Seed: SSFPSSTSSSL (MAGC1_HUMAN)
SMFPSSTSSSL

SEQ ID NO: 81098 - protein, 10 aa, Artificial Sequence
  Description of Artificial Sequence: Synthetic peptide
  Seed: QRPVSSFFSY (MAGC1_HUMAN)
QKPVSSFFSY

SEQ ID NO: 81099 - protein, 8 aa, Artificial Sequence
  Description of Artificial Sequence: Synthetic peptide
  Seed: LQRPVSSF (MAGC1_HUMAN)
LQRPVSSM

SEQ ID NO: 81100 - protein, 8 aa, Artificial Sequence
  Description of Artificial Sequence: Synthetic peptide
  Seed: QIPVSSSF (MAGC1_HUMAN)
QMPVSSSY

SEQ ID NO: 81101 - protein, 10 aa, Artificial Sequence
  Description of Artificial Sequence: Synthetic peptide
  Seed: SSPESAQSTF (MAGC1_HUMAN)
SMPESAQSTM

SEQ ID NO: 81102 - protein, 9 aa, Artificial Sequence
  Description of Artificial Sequence: Synthetic peptide
  Seed: AQSSLQIPV (MAGC1_HUMAN)
AQSSLQIPF

SEQ ID NO: 81103 - protein, 10 aa, Artificial Sequence
  Description of Artificial Sequence: Synthetic peptide
  Seed: SPFSEESSSP (MAGC1_HUMAN)
SPFSEESSSA

SEQ ID NO: 81104 - protein, 10 aa, Artificial Sequence
  Description of Artificial Sequence: Synthetic peptide
  Seed: RSFSSTLLSI (MAGC1_HUMAN)
RQFSSTLLSM

SEQ ID NO: 81105 - protein, 10 aa, Artificial Sequence
  Description of Artificial Sequence: Synthetic peptide
  Seed: KGTYASEEVI (MAGC1_HUMAN)
KGTYASEEVF

SEQ ID NO: 81106 - protein, 10 aa, Artificial Sequence
  Description of Artificial Sequence: Synthetic peptide
  Seed: YTGYFPVIFR (MAGC1_HUMAN)
YGGYFPVIFR

SEQ ID NO: 81107 - protein, 9 aa, Artificial Sequence
  Description of Artificial Sequence: Synthetic peptide
  Seed: EHFAFGEPR (MAGC1_HUMAN)
EFFAFGEPK

SEQ ID NO: 81108 - protein, 9 aa, Artificial Sequence
  Description of Artificial Sequence: Synthetic peptide
  Seed: RKVVEFLAM (MAGC1_HUMAN)
RMVVEFLAY

SEQ ID NO: 81109 - protein, 10 aa, Artificial Sequence
  Description of Artificial Sequence: Synthetic peptide
  Seed: TGYFPVIFRK (MAGC1_HUMAN)
TCYFPVIFRR

SEQ ID NO: 81110 - protein, 8 aa, Artificial Sequence
  Description of Artificial Sequence: Synthetic peptide
  Seed: LQNPASSF (MAGC1_HUMAN)
LANPASSY

SEQ ID NO: 81111 - protein, 9 aa, Artificial Sequence
  Description of Artificial Sequence: Synthetic peptide
  Seed: MLTNVISRY (MAGC1_HUMAN)
MMTNVISRW

SEQ ID NO: 81112 - protein, 11 aa, Artificial Sequence
  Description of Artificial Sequence: Synthetic peptide
  Seed: SPLQRPVSSFF (MAGC1_HUMAN)
SRLQRPVSSFF

SEQ ID NO: 81113 - protein, 10 aa, Artificial Sequence
  Description of Artificial Sequence: Synthetic peptide
  Seed: SSFPSSTSSS (MAGC1_HUMAN)
SAFPSSTSSY

SEQ ID NO: 81114 - protein, 10 aa, Artificial Sequence
  Description of Artificial Sequence: Synthetic peptide
  Seed: SSPESTQSPF (MAGC1_HUMAN)
SVPESTQSPL

SEQ ID NO: 81115 - protein, 9 aa, Artificial Sequence
  Description of Artificial Sequence: Synthetic peptide
  Seed: SSPESTQSP (MAGC1_HUMAN)
SAPESTQSM

SEQ ID NO: 81116 - protein, 10 aa, Artificial Sequence
  Description of Artificial Sequence: Synthetic peptide
  Seed: VSSSSSSSTL (MAGC1_HUMAN)
VDSSSSSSTF

SEQ ID NO: 81117 - protein, 9 aa, Artificial Sequence
  Description of Artificial Sequence: Synthetic peptide
  Seed: GFPQSPLQI (MAGC1_HUMAN)
GMPQSPLQM

SEQ ID NO: 81118 - protein, 8 aa, Artificial Sequence
  Description of Artificial Sequence: Synthetic peptide
  Seed: EVIKRKVV (MAGC1_HUMAN)
ELIKRKVL

SEQ ID NO: 81119 - protein, 10 aa, Artificial Sequence
  Description of Artificial Sequence: Synthetic peptide
  Seed: WGPRAHSEVI (MAGC1_HUMAN)
WTPRAHSEVV

SEQ ID NO: 81120 - protein, 10 aa, Artificial Sequence
  Description of Artificial Sequence: Synthetic peptide
  Seed: SPSFSSTLLS (MAGC1_HUMAN)
SPSFSSTLLM

SEQ ID NO: 81121 - protein, 9 aa, Artificial Sequence
  Description of Artificial Sequence: Synthetic peptide
  Seed: LQIPGSPSF (MAGC1_HUMAN)
LMIPGSPSV

SEQ ID NO: 81122 - protein, 10 aa, Artificial Sequence
  Description of Artificial Sequence: Synthetic peptide
  Seed: RSFSSTLLSI (MAGC1_HUMAN)
RYFSSTLLSK

SEQ ID NO: 81123 - protein, 9 aa, Artificial Sequence
  Description of Artificial Sequence: Synthetic peptide
  Seed: TLLSIFQSS (MAGC1_HUMAN)
TQLSIFQSI

SEQ ID NO: 81124 - protein, 9 aa, Artificial Sequence
  Description of Artificial Sequence: Synthetic peptide
  Seed: VSPSFSSTL (MAGC1_HUMAN)
VYPSFSSTM

SEQ ID NO: 81125 - protein, 9 aa, Artificial Sequence
  Description of Artificial Sequence: Synthetic peptide
  Seed: SPVSSFPSS (MAGC1_HUMAN)
SAVSSFPSF

SEQ ID NO: 81126 - protein, 9 aa, Artificial Sequence
  Description of Artificial Sequence: Synthetic peptide
  Seed: YPLQSPQSR (MAGC1_HUMAN)
YPLQSPQSM

SEQ ID NO: 81127 - protein, 9 aa, Artificial Sequence
  Description of Artificial Sequence: Synthetic peptide
  Seed: FAFGEPREL (MAGC1_HUMAN)
FGFGEPREM

SEQ ID NO: 81128 - protein, 9 aa, Artificial Sequence
  Description of Artificial Sequence: Synthetic peptide
  Seed: TSSFSSTLL (MAGC1_HUMAN)
TTSFSSTLL

SEQ ID NO: 81129 - protein, 11 aa, Artificial Sequence
  Description of Artificial Sequence: Synthetic peptide
  Seed: SPLQNPASSFF (MAGC1_HUMAN)
SCLQNPASSFF

SEQ ID NO: 81130 - protein, 9 aa, Artificial Sequence
  Description of Artificial Sequence: Synthetic peptide
  Seed: AQSSLQIPV (MAGC1_HUMAN)
AHSSLQIPY

SEQ ID NO: 81131 - protein, 9 aa, Artificial Sequence
  Description of Artificial Sequence: Synthetic peptide
  Seed: SPLQIVPSL (MAGC1_HUMAN)
SMLQIVPSV

SEQ ID NO: 81132 - protein, 9 aa, Artificial Sequence
  Description of Artificial Sequence: Synthetic peptide
  Seed: TTDDSTATE (MAGC1_HUMAN)
TLDDSTATC

SEQ ID NO: 81133 - protein, 10 aa, Artificial Sequence
  Description of Artificial Sequence: Synthetic peptide
  Seed: DELARFLLLK (MAGC1_HUMAN)
DILARFLLLR

SEQ ID NO: 81134 - protein, 10 aa, Artificial Sequence
  Description of Artificial Sequence: Synthetic peptide
  Seed: RYTGYFPVIF (MAGC1_HUMAN)
RATGYFPVIF

SEQ ID NO: 81135 - protein, 9 aa, Artificial Sequence
  Description of Artificial Sequence: Synthetic peptide
  Seed: FSSALLSIF (MAGC1_HUMAN)
FGSALLSIF

SEQ ID NO: 81136 - protein, 9 aa, Artificial Sequence
  Description of Artificial Sequence: Synthetic peptide
  Seed: AQSPLQSPV (MAGC1_HUMAN)
AHSPLQSPF

SEQ ID NO: 81137 - protein, 10 aa, Artificial Sequence
  Description of Artificial Sequence: Synthetic peptide
  Seed: TLDEKVDELA (MAGC1_HUMAN)
TADEKVDELF

SEQ ID NO: 81138 - protein, 9 aa, Artificial Sequence
  Description of Artificial Sequence: Synthetic peptide
  Seed: AQSSLQIPV (MAGC1_HUMAN)
AVSSLQIPA

SEQ ID NO: 81139 - protein, 9 aa, Artificial Sequence
  Description of Artificial Sequence: Synthetic peptide
  Seed: FSSTLLSIL (MAGC1_HUMAN)
FTSTLLSIL

SEQ ID NO: 81140 - protein, 9 aa, Artificial Sequence
  Description of Artificial Sequence: Synthetic peptide
  Seed: AQSSLQIPV (MAGC1_HUMAN)
AESSLQIPP

SEQ ID NO: 81141 - protein, 9 aa, Artificial Sequence
  Description of Artificial Sequence: Synthetic peptide
  Seed: LQIPVSRSF (MAGC1_HUMAN)
LGIPVSRSF

SEQ ID NO: 81142 - protein, 9 aa, Artificial Sequence
  Description of Artificial Sequence: Synthetic peptide
  Seed: VSSFFSYTL (MAGC1_HUMAN)
VISFFSYTF

SEQ ID NO: 81143 - protein, 9 aa, Artificial Sequence
  Description of Artificial Sequence: Synthetic peptide
  Seed: ASSFFSSAL (MAGC1_HUMAN)
ASSFFSSAF

SEQ ID NO: 81144 - protein, 9 aa, Artificial Sequence
  Description of Artificial Sequence: Synthetic peptide
  Seed: LSDEQGMSQ (MAGC1_HUMAN)
LVDEQGMSL

SEQ ID NO: 81145 - protein, 9 aa, Artificial Sequence
  Description of Artificial Sequence: Synthetic peptide
  Seed: YVFVNTLDL (MAGC1_HUMAN)
YKFVNTLDY

SEQ ID NO: 81146 - protein, 11 aa, Artificial Sequence
  Description of Artificial Sequence: Synthetic peptide
  Seed: FLAMLKNTVPI (MAGC1_HUMAN)
FKAMLKNTVPL

SEQ ID NO: 81147 - protein, 11 aa, Artificial Sequence
  Description of Artificial Sequence: Synthetic peptide
  Seed: SPLQIPVSRSF (MAGC1_HUMAN)
SSLQIPVSRSY

SEQ ID NO: 81148 - protein, 9 aa, Artificial Sequence
  Description of Artificial Sequence: Synthetic peptide
  Seed: LQIVPSLPE (MAGC1_HUMAN)
LSIVPSLPL

SEQ ID NO: 81149 - protein, 11 aa, Artificial Sequence
  Description of Artificial Sequence: Synthetic peptide
  Seed: SPLQIPVSPSS (MAGC1_HUMAN)
SYLQIPVSPSF

SEQ ID NO: 81150 - protein, 11 aa, Artificial Sequence
  Description of Artificial Sequence: Synthetic peptide
  Seed: SPLQIPVSRSF (MAGC1_HUMAN)
SMLQIPVSRSF

SEQ ID NO: 81151 - protein, 11 aa, Artificial Sequence
  Description of Artificial Sequence: Synthetic peptide
  Seed: SPLQIPMTSSF (MAGC1_HUMAN)
SVLQIPMTSSF

SEQ ID NO: 81152 - protein, 9 aa, Artificial Sequence
  Description of Artificial Sequence: Synthetic peptide
  Seed: VLQIPVSAA (MAGC1_HUMAN)
VLQIPVSAI

SEQ ID NO: 81153 - protein, 11 aa, Artificial Sequence
  Description of Artificial Sequence: Synthetic peptide
  Seed: STFEGFAQSPL (MAGC1_HUMAN)
STFEGFAQSPV

SEQ ID NO: 81154 - protein, 9 aa, Artificial Sequence
  Description of Artificial Sequence: Synthetic peptide
  Seed: SRYTGYFPV (MAGC1_HUMAN)
SMYTGYFPA

SEQ ID NO: 81155 - protein, 9 aa, Artificial Sequence
  Description of Artificial Sequence: Synthetic peptide
  Seed: MTSSFSSTL (MAGC1_HUMAN)
MMSSFSSTL

SEQ ID NO: 81156 - protein, 11 aa, Artificial Sequence
  Description of Artificial Sequence: Synthetic peptide
  Seed: IPMTSSFSSTL (MAGC1_HUMAN)
IAMTSSFSSTF

SEQ ID NO: 81157 - protein, 9 aa, Artificial Sequence
  Description of Artificial Sequence: Synthetic peptide
  Seed: LQIPVSPSF (MAGC1_HUMAN)
LQIPVSPSH

SEQ ID NO: 81158 - protein, 10 aa, Artificial Sequence
  Description of Artificial Sequence: Synthetic peptide
  Seed: DVLSGIGVRA (MAGC1_HUMAN)
DTLSGIGVRI

SEQ ID NO: 81159 - protein, 10 aa, Artificial Sequence
  Description of Artificial Sequence: Synthetic peptide
  Seed: ISRYTGYFPV (MAGC1_HUMAN)
ISRYTGYFPA

SEQ ID NO: 81160 - protein, 11 aa, Artificial Sequence
  Description of Artificial Sequence: Synthetic peptide
  Seed: REVDPDDSYVF (MAGC1_HUMAN)
RMVDPDDSYVF

SEQ ID NO: 81161 - protein, 9 aa, Artificial Sequence
  Description of Artificial Sequence: Synthetic peptide
  Seed: FSYTLASLL (MAGC1_HUMAN)
FLYTLASLS

SEQ ID NO: 81162 - protein, 11 aa, Artificial Sequence
  Description of Artificial Sequence: Synthetic peptide
  Seed: SPLQIPGSPSF (MAGC1_HUMAN)
SRLQIPGSPSY

SEQ ID NO: 81163 - protein, 11 aa, Artificial Sequence
  Description of Artificial Sequence: Synthetic peptide
  Seed: TTDDSTATESA (MAGC1_HUMAN)
TVDDSTATESM

SEQ ID NO: 81164 - protein, 9 aa, Artificial Sequence
  Description of Artificial Sequence: Synthetic peptide
  Seed: SSSTSLSPF (MAGC1_HUMAN)
SASTSLSPI

SEQ ID NO: 81165 - protein, 11 aa, Artificial Sequence
  Description of Artificial Sequence: Synthetic peptide
  Seed: SSTSLSLPQSF (MAGC1_HUMAN)
SFTSLSLPQSW

SEQ ID NO: 81166 - protein, 9 aa, Artificial Sequence
  Description of Artificial Sequence: Synthetic peptide
  Seed: KAREFIEIL (MAGC1_HUMAN)
KFREFIEIF

SEQ ID NO: 81167 - protein, 11 aa, Artificial Sequence
  Description of Artificial Sequence: Synthetic peptide
  Seed: STFEGFAQSPL (MAGC1_HUMAN)
SMFEGFAQSPA

SEQ ID NO: 81168 - protein, 9 aa, Artificial Sequence
  Description of Artificial Sequence: Synthetic peptide
  Seed: IEILFGISL (MAGC1_HUMAN)
IMILFGISY

SEQ ID NO: 81169 - protein, 9 aa, Artificial Sequence
  Description of Artificial Sequence: Synthetic peptide
  Seed: SAPEGEDSL (MAGC1_HUMAN)
SVPEGEDSM

SEQ ID NO: 81170 - protein, 9 aa, Artificial Sequence
  Description of Artificial Sequence: Synthetic peptide
  Seed: RKVVEFLAM (MAGC1_HUMAN)
RRVVEFLAI

SEQ ID NO: 81171 - protein, 10 aa, Artificial Sequence
  Description of Artificial Sequence: Synthetic peptide
  Seed: LLQIPMTSSF (MAGC1_HUMAN)
LVQIPMTSSF

SEQ ID NO: 81172 - protein, 10 aa, Artificial Sequence
  Description of Artificial Sequence: Synthetic peptide
  Seed: SPLQSPVSSF (MAGC1_HUMAN)
SVLQSPVSSY

SEQ ID NO: 81173 - protein, 9 aa, Artificial Sequence
  Description of Artificial Sequence: Synthetic peptide
  Seed: VPITFPSSY (MAGC1_HUMAN)
VPITFPSSF

SEQ ID NO: 81174 - protein, 11 aa, Artificial Sequence
  Description of Artificial Sequence: Synthetic peptide
  Seed: FQSSLQSPVSI (MAGC1_HUMAN)
FMSSLQSPVSF

SEQ ID NO: 81175 - protein, 9 aa, Artificial Sequence
  Description of Artificial Sequence: Synthetic peptide
  Seed: MSQNRLLIL (MAGC1_HUMAN)
MVQNRLLIF

SEQ ID NO: 81176 - protein, 9 aa, Artificial Sequence
  Description of Artificial Sequence: Synthetic peptide
  Seed: LQIVPSLPE (MAGC1_HUMAN)
LFIVPSLPY

SEQ ID NO: 81177 - protein, 9 aa, Artificial Sequence
  Description of Artificial Sequence: Synthetic peptide
  Seed: FAFGEPREL (MAGC1_HUMAN)
FGFGEPREW

SEQ ID NO: 81178 - protein, 11 aa, Artificial Sequence
  Description of Artificial Sequence: Synthetic peptide
  Seed: IPVSPSSSSTL (MAGC1_HUMAN)
IPVSPSSSSTW

SEQ ID NO: 81179 - protein, 10 aa, Artificial Sequence
  Description of Artificial Sequence: Synthetic peptide
  Seed: SSPERTHSTF (MAGC1_HUMAN)
SMPERTHSTY

SEQ ID NO: 81180 - protein, 9 aa, Artificial Sequence
  Description of Artificial Sequence: Synthetic peptide
  Seed: STFEGFAQS (MAGC1_HUMAN)
SMFEGFAQT

SEQ ID NO: 81181 - protein, 10 aa, Artificial Sequence
  Description of Artificial Sequence: Synthetic peptide
  Seed: MTSSFSSTLL (MAGC1_HUMAN)
MASSFSSTLF

SEQ ID NO: 81182 - protein, 10 aa, Artificial Sequence
  Description of Artificial Sequence: Synthetic peptide
  Seed: MTSSFSSTLL (MAGC1_HUMAN)
MASSFSSTLL

SEQ ID NO: 81183 - protein, 10 aa, Artificial Sequence
  Description of Artificial Sequence: Synthetic peptide
  Seed: ICSSSTSLSL (MAGC1_HUMAN)
INSSSTSLSM

SEQ ID NO: 81184 - protein, 11 aa, Artificial Sequence
  Description of Artificial Sequence: Synthetic peptide
  Seed: LQIPVSSSFSY (MAGC1_HUMAN)
LSIPVSSSFSW

SEQ ID NO: 81185 - protein, 10 aa, Artificial Sequence
  Description of Artificial Sequence: Synthetic peptide
  Seed: REFIEILFGI (MAGC1_HUMAN)
RMFIEILFGF

SEQ ID NO: 81186 - protein, 11 aa, Artificial Sequence
  Description of Artificial Sequence: Synthetic peptide
  Seed: SSFSYTLLSLF (MAGC1_HUMAN)
SFFSYTLLSLY

SEQ ID NO: 81187 - protein, 9 aa, Artificial Sequence
  Description of Artificial Sequence: Synthetic peptide
  Seed: RTHSTFEGF (MAGC1_HUMAN)
RAHSTFEGY

SEQ ID NO: 81188 - protein, 9 aa, Artificial Sequence
  Description of Artificial Sequence: Synthetic peptide
  Seed: TFEGFPQSL (MAGC1_HUMAN)
TTEGFPQSL

SEQ ID NO: 81189 - protein, 9 aa, Artificial Sequence
  Description of Artificial Sequence: Synthetic peptide
  Seed: SSPERTHST (MAGC1_HUMAN)
SSPERTHSY

SEQ ID NO: 81190 - protein, 9 aa, Artificial Sequence
  Description of Artificial Sequence: Synthetic peptide
  Seed: SLPQSFPES (MAGC1_HUMAN)
SLPQSFPEV

SEQ ID NO: 81191 - protein, 9 aa, Artificial Sequence
  Description of Artificial Sequence: Synthetic peptide
  Seed: LQIPVSPSF (MAGC1_HUMAN)
LRIPVSPSY

SEQ ID NO: 81192 - protein, 9 aa, Artificial Sequence
  Description of Artificial Sequence: Synthetic peptide
  Seed: SQNRLLILI (MAGC1_HUMAN)
SRNRLLILI

SEQ ID NO: 81193 - protein, 9 aa, Artificial Sequence
  Description of Artificial Sequence: Synthetic peptide
  Seed: YTGYFPVIF (MAGC1_HUMAN)
YMGYFPVIF

SEQ ID NO: 81194 - protein, 10 aa, Artificial Sequence
  Description of Artificial Sequence: Synthetic peptide
  Seed: LAMLKNTVPI (MAGC1_HUMAN)
LNMLKNTVPF

SEQ ID NO: 81195 - protein, 9 aa, Artificial Sequence
  Description of Artificial Sequence: Synthetic peptide
  Seed: SMSPLYFPQ (MAGC1_HUMAN)
SWSPLYFPR

SEQ ID NO: 81196 - protein, 10 aa, Artificial Sequence
  Description of Artificial Sequence: Synthetic peptide
  Seed: QIPVSSSFSY (MAGC1_HUMAN)
QQPVSSSFSF

SEQ ID NO: 81197 - protein, 9 aa, Artificial Sequence
  Description of Artificial Sequence: Synthetic peptide
  Seed: AQSPLQIPV (MAGC1_HUMAN)
ARSPLQIPF

SEQ ID NO: 81198 - protein, 9 aa, Artificial Sequence
  Description of Artificial Sequence: Synthetic peptide
  Seed: FEGFAQSPL (MAGC1_HUMAN)
FMGFAQSPL

SEQ ID NO: 81199 - protein, 10 aa, Artificial Sequence
  Description of Artificial Sequence: Synthetic peptide
  Seed: SRYTGYFPVI (MAGC1_HUMAN)
SYYTGYFPVI

SEQ ID NO: 81200 - protein, 11 aa, Artificial Sequence
  Description of Artificial Sequence: Synthetic peptide
  Seed: SPFEGFPQSVL (MAGC1_HUMAN)
SPFEGFPQSVM

SEQ ID NO: 81201 - protein, 9 aa, Artificial Sequence
  Description of Artificial Sequence: Synthetic peptide
  Seed: SLSPFSEES (MAGC1_HUMAN)
SLSPFSEEI

SEQ ID NO: 81202 - protein, 9 aa, Artificial Sequence
  Description of Artificial Sequence: Synthetic peptide
  Seed: VSRSFSSTL (MAGC1_HUMAN)
VNRSFSSTK

SEQ ID NO: 81203 - protein, 11 aa, Artificial Sequence
  Description of Artificial Sequence: Synthetic peptide
  Seed: REVPNSSPPRY (MAGC1_HUMAN)
REVPNSSPPRF

SEQ ID NO: 81204 - protein, 11 aa, Artificial Sequence
  Description of Artificial Sequence: Synthetic peptide
  Seed: STFEGFPQSLL (MAGC1_HUMAN)
SLFEGFPQSLE

SEQ ID NO: 81205 - protein, 11 aa, Artificial Sequence
  Description of Artificial Sequence: Synthetic peptide
  Seed: IPVSSSFSYTL (MAGC1_HUMAN)
IWVSSSFSYTF

SEQ ID NO: 81206 - protein, 9 aa, Artificial Sequence
  Description of Artificial Sequence: Synthetic peptide
  Seed: SSTSSSLSK (MAGC1_HUMAN)
STTSSSLSM

SEQ ID NO: 81207 - protein, 9 aa, Artificial Sequence
  Description of Artificial Sequence: Synthetic peptide
  Seed: KAREFIEIL (MAGC1_HUMAN)
KHREFIEIY

SEQ ID NO: 81208 - protein, 9 aa, Artificial Sequence
  Description of Artificial Sequence: Synthetic peptide
  Seed: VSRSFSSTL (MAGC1_HUMAN)
VMRSFSSTI

SEQ ID NO: 81209 - protein, 11 aa, Artificial Sequence
  Description of Artificial Sequence: Synthetic peptide
  Seed: YTGYFPVIFRK (MAGC1_HUMAN)
YQGYFPVIFRR

SEQ ID NO: 81210 - protein, 9 aa, Artificial Sequence
  Description of Artificial Sequence: Synthetic peptide
  Seed: SIIFIKGTY (MAGC1_HUMAN)
SPIFIKGTM

SEQ ID NO: 81211 - protein, 10 aa, Artificial Sequence
  Description of Artificial Sequence: Synthetic peptide
  Seed: FAQSSLQIPV (MAGC1_HUMAN)
FGQSSLQIPI

SEQ ID NO: 81212 - protein, 9 aa, Artificial Sequence
  Description of Artificial Sequence: Synthetic peptide
  Seed: KDSLSPLEI (MAGC1_HUMAN)
KMSLSPLEI

SEQ ID NO: 81213 - protein, 9 aa, Artificial Sequence
  Description of Artificial Sequence: Synthetic peptide
  Seed: SQSSPVSSF (MAGC1_HUMAN)
SESSPVSSV

SEQ ID NO: 81214 - protein, 10 aa, Artificial Sequence
  Description of Artificial Sequence: Synthetic peptide
  Seed: ICSSSTSLSL (MAGC1_HUMAN)
IPSSSTSLSF

SEQ ID NO: 81215 - protein, 10 aa, Artificial Sequence
  Description of Artificial Sequence: Synthetic peptide
  Seed: STLLSLFQSF (MAGC1_HUMAN)
SILLSLFQSY

SEQ ID NO: 81216 - protein, 9 aa, Artificial Sequence
  Description of Artificial Sequence: Synthetic peptide
  Seed: LQIPVSSSS (MAGC1_HUMAN)
LLIPVSSSF

SEQ ID NO: 81217 - protein, 10 aa, Artificial Sequence
  Description of Artificial Sequence: Synthetic peptide
  Seed: STLLSLFQSF (MAGC1_HUMAN)
SHLLSLFQSY

SEQ ID NO: 81218 - protein, 10 aa, Artificial Sequence
  Description of Artificial Sequence: Synthetic peptide
  Seed: KAEMLTNVIS (MAGC1_HUMAN)
KAEMLTNVIA

SEQ ID NO: 81219 - protein, 9 aa, Artificial Sequence
  Description of Artificial Sequence: Synthetic peptide
  Seed: AQSPLQRPV (MAGC1_HUMAN)
AKSPLQRPF

SEQ ID NO: 81220 - protein, 10 aa, Artificial Sequence
  Description of Artificial Sequence: Synthetic peptide
  Seed: SSFSSTLLSI (MAGC1_HUMAN)
SAFSSTLLSY

SEQ ID NO: 81221 - protein, 11 aa, Artificial Sequence
  Description of Artificial Sequence: Synthetic peptide
  Seed: SSFSYTLLSLF (MAGC1_HUMAN)
SYFSYTLLSLW

SEQ ID NO: 81222 - protein, 10 aa, Artificial Sequence
  Description of Artificial Sequence: Synthetic peptide
  Seed: AASSSTLVSI (MAGC1_HUMAN)
AQSSSTLVSF

SEQ ID NO: 81223 - protein, 9 aa, Artificial Sequence
  Description of Artificial Sequence: Synthetic peptide
  Seed: TKVWVQEHY (MAGC1_HUMAN)
TLVWVQEHY

SEQ ID NO: 81224 - protein, 9 aa, Artificial Sequence
  Description of Artificial Sequence: Synthetic peptide
  Seed: SSSFSYTLL (MAGC1_HUMAN)
SVSFSYTLI

SEQ ID NO: 81225 - protein, 10 aa, Artificial Sequence
  Description of Artificial Sequence: Synthetic peptide
  Seed: FPQSVLQIPV (MAGC1_HUMAN)
FTQSVLQIPV

SEQ ID NO: 81226 - protein, 9 aa, Artificial Sequence
  Description of Artificial Sequence: Synthetic peptide
  Seed: SSSSSSTLL (MAGC1_HUMAN)
SPSSSSTLV

SEQ ID NO: 81227 - protein, 10 aa, Artificial Sequence
  Description of Artificial Sequence: Synthetic peptide
  Seed: RSFSSTLLSI (MAGC1_HUMAN)
RVFSSTLLSL

SEQ ID NO: 81228 - protein, 9 aa, Artificial Sequence
  Description of Artificial Sequence: Synthetic peptide
  Seed: SSSESPQSC (MAGC1_HUMAN)
SSSESPQSY

SEQ ID NO: 81229 - protein, 10 aa, Artificial Sequence
  Description of Artificial Sequence: Synthetic peptide
  Seed: RSFSSTLLSI (MAGC1_HUMAN)
RGFSSTLLSW

SEQ ID NO: 81230 - protein, 11 aa, Artificial Sequence
  Description of Artificial Sequence: Synthetic peptide
  Seed: VSSSSSSSTLL (MAGC1_HUMAN)
VESSSSSSTLF

SEQ ID NO: 81231 - protein, 9 aa, Artificial Sequence
  Description of Artificial Sequence: Synthetic peptide
  Seed: VPITFPSSY (MAGC1_HUMAN)
VPITFPSSA

SEQ ID NO: 81232 - protein, 10 aa, Artificial Sequence
  Description of Artificial Sequence: Synthetic peptide
  Seed: FFSYTLASLL (MAGC1_HUMAN)
FMSYTLASLA

SEQ ID NO: 81233 - protein, 8 aa, Artificial Sequence
  Description of Artificial Sequence: Synthetic peptide
  Seed: GPRAHSEV (MAGC1_HUMAN)
GPRAHSEL

SEQ ID NO: 81234 - protein, 9 aa, Artificial Sequence
  Description of Artificial Sequence: Synthetic peptide
  Seed: VSPSFSSTL (MAGC1_HUMAN)
VIPSFSSTM

SEQ ID NO: 81235 - protein, 10 aa, Artificial Sequence
  Description of Artificial Sequence: Synthetic peptide
  Seed: LQGEEFQSSL (MAGC1_HUMAN)
LMGEEFQSSF

SEQ ID NO: 81236 - protein, 10 aa, Artificial Sequence
  Description of Artificial Sequence: Synthetic peptide
  Seed: SFSSTLVSLF (MAGC1_HUMAN)
SESSTLVSLF

SEQ ID NO: 81237 - protein, 9 aa, Artificial Sequence
  Description of Artificial Sequence: Synthetic peptide
  Seed: SVLQIPVSA (MAGC1_HUMAN)
SILQIPVSL

SEQ ID NO: 81238 - protein, 11 aa, Artificial Sequence
  Description of Artificial Sequence: Synthetic peptide
  Seed: SPLQNPASSFF (MAGC1_HUMAN)
SFLQNPASSFF

SEQ ID NO: 81239 - protein, 9 aa, Artificial Sequence
  Description of Artificial Sequence: Synthetic peptide
  Seed: FPSSTSSSL (MAGC1_HUMAN)
FTSSTSSSM

SEQ ID NO: 81240 - protein, 9 aa, Artificial Sequence
  Description of Artificial Sequence: Synthetic peptide
  Seed: VSSSFSYTL (MAGC1_HUMAN)
VVSSFSYTW

SEQ ID NO: 81241 - protein, 10 aa, Artificial Sequence
  Description of Artificial Sequence: Synthetic peptide
  Seed: LLQIPMTSSF (MAGC1_HUMAN)
LMQIPMTSSM

SEQ ID NO: 81242 - protein, 11 aa, Artificial Sequence
  Description of Artificial Sequence: Synthetic peptide
  Seed: SLSQSSPVSSF (MAGC1_HUMAN)
SYSQSSPVSSY

SEQ ID NO: 81243 - protein, 9 aa, Artificial Sequence
  Description of Artificial Sequence: Synthetic peptide
  Seed: LQIVPSLPE (MAGC1_HUMAN)
LQIVPSLPV

SEQ ID NO: 81244 - protein, 10 aa, Artificial Sequence
  Description of Artificial Sequence: Synthetic peptide
  Seed: LSQSSPVSSF (MAGC1_HUMAN)
LTQSSPVSSY

SEQ ID NO: 81245 - protein, 9 aa, Artificial Sequence
  Description of Artificial Sequence: Synthetic peptide
  Seed: YTLLSLFQS (MAGC1_HUMAN)
YMLLSLFQV

SEQ ID NO: 81246 - protein, 9 aa, Artificial Sequence
  Description of Artificial Sequence: Synthetic peptide
  Seed: VSSFFSYTL (MAGC1_HUMAN)
VNSFFSYTW

SEQ ID NO: 81247 - protein, 9 aa, Artificial Sequence
  Description of Artificial Sequence: Synthetic peptide
  Seed: MPTAGMPSL (MAGC1_HUMAN)
MVTAGMPSM

SEQ ID NO: 81248 - protein, 9 aa, Artificial Sequence
  Description of Artificial Sequence: Synthetic peptide
  Seed: LQIPGSPSF (MAGC1_HUMAN)
LFIPGSPSL

SEQ ID NO: 81249 - protein, 9 aa, Artificial Sequence
  Description of Artificial Sequence: Synthetic peptide
  Seed: SSPERTHST (MAGC1_HUMAN)
SCPERTHSI

SEQ ID NO: 81250 - protein, 9 aa, Artificial Sequence
  Description of Artificial Sequence: Synthetic peptide
  Seed: GFPQSPLQI (MAGC1_HUMAN)
GLPQSPLQM

SEQ ID NO: 81251 - protein, 9 aa, Artificial Sequence
  Description of Artificial Sequence: Synthetic peptide
  Seed: RKAREFIEI (MAGC1_HUMAN)
RLAREFIEM

SEQ ID NO: 81252 - protein, 9 aa, Artificial Sequence
  Description of Artificial Sequence: Synthetic peptide
  Seed: SAQSAFEGF (MAGC1_HUMAN)
SEQSAFEGM

SEQ ID NO: 81253 - protein, 10 aa, Artificial Sequence
  Description of Artificial Sequence: Synthetic peptide
  Seed: FSYTLLSLFQ (MAGC1_HUMAN)
FSYTLLSLFF

SEQ ID NO: 81254 - protein, 9 aa, Artificial Sequence
  Description of Artificial Sequence: Synthetic peptide
  Seed: LQIPVSRSF (MAGC1_HUMAN)
LQIPVSRSV

SEQ ID NO: 81255 - protein, 9 aa, Artificial Sequence
  Description of Artificial Sequence: Synthetic peptide
  Seed: TLVSIFQSS (MAGC1_HUMAN)
TMVSIFQSA

SEQ ID NO: 81256 - protein, 9 aa, Artificial Sequence
  Description of Artificial Sequence: Synthetic peptide
  Seed: NTVPITFPS (MAGC1_HUMAN)
NTVPITFPV

SEQ ID NO: 81257 - protein, 9 aa, Artificial Sequence
  Description of Artificial Sequence: Synthetic peptide
  Seed: SIIFIKGTY (MAGC1_HUMAN)
SSIFIKGTY

SEQ ID NO: 81258 - protein, 10 aa, Artificial Sequence
  Description of Artificial Sequence: Synthetic peptide
  Seed: DELARFLLLK (MAGC1_HUMAN)
DVLARFLLLR

SEQ ID NO: 81259 - protein, 10 aa, Artificial Sequence
  Description of Artificial Sequence: Synthetic peptide
  Seed: REFIEILFGI (MAGC1_HUMAN)
RSFIEILFGV

SEQ ID NO: 81260 - protein, 9 aa, Artificial Sequence
  Description of Artificial Sequence: Synthetic peptide
  Seed: AQSPLQSPV (MAGC1_HUMAN)
AESPLQSPM

SEQ ID NO: 81261 - protein, 9 aa, Artificial Sequence
  Description of Artificial Sequence: Synthetic peptide
  Seed: WVQEHYLEY (MAGC1_HUMAN)
WEQEHYLEF

SEQ ID NO: 81262 - protein, 10 aa, Artificial Sequence
  Description of Artificial Sequence: Synthetic peptide
  Seed: YTLLSLFQSS (MAGC1_HUMAN)
YDLLSLFQSV

SEQ ID NO: 81263 - protein, 10 aa, Artificial Sequence
  Description of Artificial Sequence: Synthetic peptide
  Seed: EILFGISLRE (MAGC1_HUMAN)
EPLFGISLRR

SEQ ID NO: 81264 - protein, 9 aa, Artificial Sequence
  Description of Artificial Sequence: Synthetic peptide
  Seed: SLIESEPLF (MAGC1_HUMAN)
SYIESEPLM

SEQ ID NO: 81265 - protein, 11 aa, Artificial Sequence
  Description of Artificial Sequence: Synthetic peptide
  Seed: MSPLYFPQSPL (MAGC1_HUMAN)
MSPLYFPQSPM

SEQ ID NO: 81266 - protein, 11 aa, Artificial Sequence
  Description of Artificial Sequence: Synthetic peptide
  Seed: RSFSSTLLSIF (MAGC1_HUMAN)
RMFSSTLLSIM

SEQ ID NO: 81267 - protein, 9 aa, Artificial Sequence
  Description of Artificial Sequence: Synthetic peptide
  Seed: LQIPVSPSF (MAGC1_HUMAN)
LSIPVSPSM

SEQ ID NO: 81268 - protein, 10 aa, Artificial Sequence
  Description of Artificial Sequence: Synthetic peptide
  Seed: LILILSIIFI (MAGC1_HUMAN)
LWLILSIIFV

SEQ ID NO: 81269 - protein, 11 aa, Artificial Sequence
  Description of Artificial Sequence: Synthetic peptide
  Seed: SPLQIPVSSSS (MAGC1_HUMAN)
SQLQIPVSSSF

SEQ ID NO: 81270 - protein, 9 aa, Artificial Sequence
  Description of Artificial Sequence: Synthetic peptide
  Seed: YTLASLLQS (MAGC1_HUMAN)
YMLASLLQA

SEQ ID NO: 81271 - protein, 9 aa, Artificial Sequence
  Description of Artificial Sequence: Synthetic peptide
  Seed: MPSLLQSSS (MAGC1_HUMAN)
MSSLLQSSY

SEQ ID NO: 81272 - protein, 10 aa, Artificial Sequence
  Description of Artificial Sequence: Synthetic peptide
  Seed: WGPRAHSEVI (MAGC1_HUMAN)
WMPRAHSEVM

SEQ ID NO: 81273 - protein, 9 aa, Artificial Sequence
  Description of Artificial Sequence: Synthetic peptide
  Seed: LQIPVSPSF (MAGC1_HUMAN)
LSIPVSPSL

SEQ ID NO: 81274 - protein, 9 aa, Artificial Sequence
  Description of Artificial Sequence: Synthetic peptide
  Seed: SSPERTQST (MAGC1_HUMAN)
SIPERTQSM

SEQ ID NO: 81275 - protein, 10 aa, Artificial Sequence
  Description of Artificial Sequence: Synthetic peptide
  Seed: VSICSSSTSL (MAGC1_HUMAN)
VAICSSSTSL

SEQ ID NO: 81276 - protein, 10 aa, Artificial Sequence
  Description of Artificial Sequence: Synthetic peptide
  Seed: YLEYREVPNS (MAGC1_HUMAN)
YQEYREVPNV

SEQ ID NO: 81277 - protein, 11 aa, Artificial Sequence
  Description of Artificial Sequence: Synthetic peptide
  Seed: RPVSSFFSYTL (MAGC1_HUMAN)
RMVSSFFSYTL

SEQ ID NO: 81278 - protein, 10 aa, Artificial Sequence
  Description of Artificial Sequence: Synthetic peptide
  Seed: VPITFPSSYK (MAGC1_HUMAN)
VKITFPSSYK

SEQ ID NO: 81279 - protein, 10 aa, Artificial Sequence
  Description of Artificial Sequence: Synthetic peptide
  Seed: FPQSLLQIPM (MAGC1_HUMAN)
FIQSLLQIPF

SEQ ID NO: 81280 - protein, 11 aa, Artificial Sequence
  Description of Artificial Sequence: Synthetic peptide
  Seed: ISRYTGYFPVI (MAGC1_HUMAN)
ICRYTGYFPVF

SEQ ID NO: 81281 - protein, 10 aa, Artificial Sequence
  Description of Artificial Sequence: Synthetic peptide
  Seed: DEYTSSSDTL (MAGC1_HUMAN)
DEYTSSSDTY

SEQ ID NO: 81282 - protein, 8 aa, Artificial Sequence
  Description of Artificial Sequence: Synthetic peptide
  Seed: IWDVLSGI (MAGC1_HUMAN)
ILDVLSGL

SEQ ID NO: 81283 - protein, 9 aa, Artificial Sequence
  Description of Artificial Sequence: Synthetic peptide
  Seed: CSSSTPSSL (MAGC1_HUMAN)
CHSSTPSSF

SEQ ID NO: 81284 - protein, 10 aa, Artificial Sequence
  Description of Artificial Sequence: Synthetic peptide
  Seed: SSFSYTLLSL (MAGC1_HUMAN)
SFFSYTLLSM

SEQ ID NO: 81285 - protein, 9 aa, Artificial Sequence
  Description of Artificial Sequence: Synthetic peptide
  Seed: SSSSSSSTL (MAGC1_HUMAN)
SESSSSSTY

SEQ ID NO: 81286 - protein, 10 aa, Artificial Sequence
  Description of Artificial Sequence: Synthetic peptide
  Seed: MPTAGMPSLL (MAGC1_HUMAN)
MSTAGMPSLF

SEQ ID NO: 81287 - protein, 9 aa, Artificial Sequence
  Description of Artificial Sequence: Synthetic peptide
  Seed: YTSSSDTLL (MAGC1_HUMAN)
YLSSSDTLL

SEQ ID NO: 81288 - protein, 9 aa, Artificial Sequence
  Description of Artificial Sequence: Synthetic peptide
  Seed: LQIPVSPSF (MAGC1_HUMAN)
LAIPVSPSI

SEQ ID NO: 81289 - protein, 10 aa, Artificial Sequence
  Description of Artificial Sequence: Synthetic peptide
  Seed: SSFSSTLLSI (MAGC1_HUMAN)
SVFSSTLLST

SEQ ID NO: 81290 - protein, 9 aa, Artificial Sequence
  Description of Artificial Sequence: Synthetic peptide
  Seed: RSFSSTLLS (MAGC1_HUMAN)
RAFSSTLLV

SEQ ID NO: 81291 - protein, 9 aa, Artificial Sequence
  Description of Artificial Sequence: Synthetic peptide
  Seed: SPLQIVPSL (MAGC1_HUMAN)
SPLQIVPSM

SEQ ID NO: 81292 - protein, 9 aa, Artificial Sequence
  Description of Artificial Sequence: Synthetic peptide
  Seed: QIVPSLPEW (MAGC1_HUMAN)
QTVPSLPEF

SEQ ID NO: 81293 - protein, 10 aa, Artificial Sequence
  Description of Artificial Sequence: Synthetic peptide
  Seed: SSPESAQSAF (MAGC1_HUMAN)
SSPESAQSAM

SEQ ID NO: 81294 - protein, 10 aa, Artificial Sequence
  Description of Artificial Sequence: Synthetic peptide
  Seed: EEFQSSLQSP (MAGC1_HUMAN)
EEFQSSLQSM

SEQ ID NO: 81295 - protein, 9 aa, Artificial Sequence
  Description of Artificial Sequence: Synthetic peptide
  Seed: FAFGEPREL (MAGC1_HUMAN)
FWFGEPREL

SEQ ID NO: 81296 - protein, 10 aa, Artificial Sequence
  Description of Artificial Sequence: Synthetic peptide
  Seed: SFSYTLLSLF (MAGC1_HUMAN)
SSSYTLLSLF

SEQ ID NO: 81297 - protein, 9 aa, Artificial Sequence
  Description of Artificial Sequence: Synthetic peptide
  Seed: LQIPMTSSF (MAGC1_HUMAN)
LWIPMTSSL

SEQ ID NO: 81298 - protein, 9 aa, Artificial Sequence
  Description of Artificial Sequence: Synthetic peptide
  Seed: SLLQSSHES (MAGC1_HUMAN)
SILQSSHEV

SEQ ID NO: 81299 - protein, 9 aa, Artificial Sequence
  Description of Artificial Sequence: Synthetic peptide
  Seed: IFQSSPESA (MAGC1_HUMAN)
IWQSSPESF

SEQ ID NO: 81300 - protein, 10 aa, Artificial Sequence
  Description of Artificial Sequence: Synthetic peptide
  Seed: LIESEPLFTY (MAGC1_HUMAN)
LSESEPLFTY

SEQ ID NO: 81301 - protein, 9 aa, Artificial Sequence
  Description of Artificial Sequence: Synthetic peptide
  Seed: RPVSSFFSY (MAGC1_HUMAN)
RSVSSFFSL

SEQ ID NO: 81302 - protein, 10 aa, Artificial Sequence
  Description of Artificial Sequence: Synthetic peptide
  Seed: REFIEILFGI (MAGC1_HUMAN)
RTFIEILFGF

SEQ ID NO: 81303 - protein, 9 aa, Artificial Sequence
  Description of Artificial Sequence: Synthetic peptide
  Seed: LQIPVSAAS (MAGC1_HUMAN)
LQIPVSAAW

SEQ ID NO: 81304 - protein, 8 aa, Artificial Sequence
  Description of Artificial Sequence: Synthetic peptide
  Seed: SSFFSSAL (MAGC1_HUMAN)
SSFFSSAY

SEQ ID NO: 81305 - protein, 9 aa, Artificial Sequence
  Description of Artificial Sequence: Synthetic peptide
  Seed: IIFIKGTYA (MAGC1_HUMAN)
IMFIKGTYI

SEQ ID NO: 81306 - protein, 10 aa, Artificial Sequence
  Description of Artificial Sequence: Synthetic peptide
  Seed: STLLSLFQSF (MAGC1_HUMAN)
SCLLSLFQSY

SEQ ID NO: 81307 - protein, 10 aa, Artificial Sequence
  Description of Artificial Sequence: Synthetic peptide
  Seed: NTVPITFPSS (MAGC1_HUMAN)
NTVPITFPSM

SEQ ID NO: 81308 - protein, 10 aa, Artificial Sequence
  Description of Artificial Sequence: Synthetic peptide
  Seed: MLKNTVPITF (MAGC1_HUMAN)
MYKNTVPITY

SEQ ID NO: 81309 - protein, 9 aa, Artificial Sequence
  Description of Artificial Sequence: Synthetic peptide
  Seed: IFQSSPESA (MAGC1_HUMAN)
IYQSSPESL

SEQ ID NO: 81310 - protein, 9 aa, Artificial Sequence
  Description of Artificial Sequence: Synthetic peptide
  Seed: FSERTQSTF (MAGC1_HUMAN)
FPERTQSTY

SEQ ID NO: 81311 - protein, 9 aa, Artificial Sequence
  Description of Artificial Sequence: Synthetic peptide
  Seed: GYFPVIFRK (MAGC1_HUMAN)
GSFPVIFRK

SEQ ID NO: 81312 - protein, 9 aa, Artificial Sequence
  Description of Artificial Sequence: Synthetic peptide
  Seed: FFSSALLSI (MAGC1_HUMAN)
FRSSALLSM

SEQ ID NO: 81313 - protein, 9 aa, Artificial Sequence
  Description of Artificial Sequence: Synthetic peptide
  Seed: FSSTLLSLF (MAGC1_HUMAN)
FGSTLLSLY

SEQ ID NO: 81314 - protein, 11 aa, Artificial Sequence
  Description of Artificial Sequence: Synthetic peptide
  Seed: SPLQRPVSSFF (MAGC1_HUMAN)
SALQRPVSSFF

SEQ ID NO: 81315 - protein, 9 aa, Artificial Sequence
  Description of Artificial Sequence: Synthetic peptide
  Seed: SSSVMSPSF (MAGC1_HUMAN)
STSVMSPSY

SEQ ID NO: 81316 - protein, 9 aa, Artificial Sequence
  Description of Artificial Sequence: Synthetic peptide
  Seed: SSLSQSSPV (MAGC1_HUMAN)
SVLSQSSPF

SEQ ID NO: 81317 - protein, 10 aa, Artificial Sequence
  Description of Artificial Sequence: Synthetic peptide
  Seed: SFSYTLLSLF (MAGC1_HUMAN)
SDSYTLLSLY

SEQ ID NO: 81318 - protein, 9 aa, Artificial Sequence
  Description of Artificial Sequence: Synthetic peptide
  Seed: CSSSTSLSL (MAGC1_HUMAN)
CASSTSLSL

SEQ ID NO: 81319 - protein, 9 aa, Artificial Sequence
  Description of Artificial Sequence: Synthetic peptide
  Seed: FSSTLLSIL (MAGC1_HUMAN)
FTSTLLSIA

SEQ ID NO: 81320 - protein, 10 aa, Artificial Sequence
  Description of Artificial Sequence: Synthetic peptide
  Seed: KGTYASEEVI (MAGC1_HUMAN)
KVTYASEEVF

SEQ ID NO: 81321 - protein, 9 aa, Artificial Sequence
  Description of Artificial Sequence: Synthetic peptide
  Seed: IKRKVVEFL (MAGC1_HUMAN)
IQRKVVEFF

SEQ ID NO: 81322 - protein, 9 aa, Artificial Sequence
  Description of Artificial Sequence: Synthetic peptide
  Seed: VSAASSSTL (MAGC1_HUMAN)
VIAASSSTL

SEQ ID NO: 81323 - protein, 10 aa, Artificial Sequence
  Description of Artificial Sequence: Synthetic peptide
  Seed: FSSSTSLSPF (MAGC1_HUMAN)
FSSSTSLSPL

SEQ ID NO: 81324 - protein, 11 aa, Artificial Sequence
  Description of Artificial Sequence: Synthetic peptide
  Seed: SSFSSTLLSIL (MAGC1_HUMAN)
SGFSSTLLSIW

SEQ ID NO: 81325 - protein, 10 aa, Artificial Sequence
  Description of Artificial Sequence: Synthetic peptide
  Seed: FPQSPLQIPV (MAGC1_HUMAN)
FPQSPLQIPW

SEQ ID NO: 81326 - protein, 9 aa, Artificial Sequence
  Description of Artificial Sequence: Synthetic peptide
  Seed: STQSPFEGF (MAGC1_HUMAN)
STQSPFEGR

SEQ ID NO: 81327 - protein, 10 aa, Artificial Sequence
  Description of Artificial Sequence: Synthetic peptide
  Seed: TTDDSTATES (MAGC1_HUMAN)
TADDSTATEM

SEQ ID NO: 81328 - protein, 11 aa, Artificial Sequence
  Description of Artificial Sequence: Synthetic peptide
  Seed: SPLQIPGSPSF (MAGC1_HUMAN)
STLQIPGSPSF

SEQ ID NO: 81329 - protein, 9 aa, Artificial Sequence
  Description of Artificial Sequence: Synthetic peptide
  Seed: MTSSFSSTL (MAGC1_HUMAN)
MQSSFSSTL

SEQ ID NO: 81330 - protein, 10 aa, Artificial Sequence
  Description of Artificial Sequence: Synthetic peptide
  Seed: LQIPGSPSFS (MAGC1_HUMAN)
LLIPGSPSFY

SEQ ID NO: 81331 - protein, 9 aa, Artificial Sequence
  Description of Artificial Sequence: Synthetic peptide
  Seed: RTHSTFEGF (MAGC1_HUMAN)
RSHSTFEGV

SEQ ID NO: 81332 - protein, 10 aa, Artificial Sequence
  Description of Artificial Sequence: Synthetic peptide
  Seed: SSSSTLLSLF (MAGC1_HUMAN)
SYSSTLLSLF

SEQ ID NO: 81333 - protein, 9 aa, Artificial Sequence
  Description of Artificial Sequence: Synthetic peptide
  Seed: VISRYTGYF (MAGC1_HUMAN)
VVSRYTGYY

SEQ ID NO: 81334 - protein, 10 aa, Artificial Sequence
  Description of Artificial Sequence: Synthetic peptide
  Seed: LQIPMTSSFS (MAGC1_HUMAN)
LMIPMTSSFW

SEQ ID NO: 81335 - protein, 10 aa, Artificial Sequence
  Description of Artificial Sequence: Synthetic peptide
  Seed: SSSSSTLLSL (MAGC1_HUMAN)
SKSSSTLLSY

SEQ ID NO: 81336 - protein, 10 aa, Artificial Sequence
  Description of Artificial Sequence: Synthetic peptide
  Seed: SLFQSFSERT (MAGC1_HUMAN)
SVFQSFSERV

SEQ ID NO: 81337 - protein, 9 aa, Artificial Sequence
  Description of Artificial Sequence: Synthetic peptide
  Seed: MSQNRLLIL (MAGC1_HUMAN)
MHQNRLLIL

SEQ ID NO: 81338 - protein, 10 aa, Artificial Sequence
  Description of Artificial Sequence: Synthetic peptide
  Seed: ISRYTGYFPV (MAGC1_HUMAN)
IVRYTGYFPL

SEQ ID NO: 81339 - protein, 10 aa, Artificial Sequence
  Description of Artificial Sequence: Synthetic peptide
  Seed: FAQSSLQIPV (MAGC1_HUMAN)
FIQSSLQIPA

SEQ ID NO: 81340 - protein, 9 aa, Artificial Sequence
  Description of Artificial Sequence: Synthetic peptide
  Seed: FSSALLSIF (MAGC1_HUMAN)
FSSALLSIY

SEQ ID NO: 81341 - protein, 9 aa, Artificial Sequence
  Description of Artificial Sequence: Synthetic peptide
  Seed: QPITKAEML (MAGC1_HUMAN)
QPITKAEMW

SEQ ID NO: 81342 - protein, 9 aa, Artificial Sequence
  Description of Artificial Sequence: Synthetic peptide
  Seed: KAREFIEIL (MAGC1_HUMAN)
KTREFIEIK

SEQ ID NO: 81343 - protein, 9 aa, Artificial Sequence
  Description of Artificial Sequence: Synthetic peptide
  Seed: LQIPVSPSF (MAGC1_HUMAN)
LKIPVSPSI

SEQ ID NO: 81344 - protein, 10 aa, Artificial Sequence
  Description of Artificial Sequence: Synthetic peptide
  Seed: EMLTNVISRY (MAGC1_HUMAN)
ELLTNVISRK

SEQ ID NO: 81345 - protein, 9 aa, Artificial Sequence
  Description of Artificial Sequence: Synthetic peptide
  Seed: VVEFLAMLK (MAGC1_HUMAN)
VMEFLAMLR

SEQ ID NO: 81346 - protein, 9 aa, Artificial Sequence
  Description of Artificial Sequence: Synthetic peptide
  Seed: SLFQSFSER (MAGC1_HUMAN)
STFQSFSEL

SEQ ID NO: 81347 - protein, 9 aa, Artificial Sequence
  Description of Artificial Sequence: Synthetic peptide
  Seed: FQSSPERTH (MAGC1_HUMAN)
FQSSPERTF

SEQ ID NO: 81348 - protein, 8 aa, Artificial Sequence
  Description of Artificial Sequence: Synthetic peptide
  Seed: HYLEYREV (MAGC1_HUMAN)
HFLEYREL

SEQ ID NO: 81349 - protein, 10 aa, Artificial Sequence
  Description of Artificial Sequence: Synthetic peptide
  Seed: SRYTGYFPVI (MAGC1_HUMAN)
SVYTGYFPVI

SEQ ID NO: 81350 - protein, 9 aa, Artificial Sequence
  Description of Artificial Sequence: Synthetic peptide
  Seed: VQSPLQNPA (MAGC1_HUMAN)
VESPLQNPT

SEQ ID NO: 81351 - protein, 10 aa, Artificial Sequence
  Description of Artificial Sequence: Synthetic peptide
  Seed: WEDSLSPHYF (MAGC1_HUMAN)
WADSLSPHYF

SEQ ID NO: 81352 - protein, 9 aa, Artificial Sequence
  Description of Artificial Sequence: Synthetic peptide
  Seed: SSSSTLLSL (MAGC1_HUMAN)
SRSSTLLSI

SEQ ID NO: 81353 - protein, 9 aa, Artificial Sequence
  Description of Artificial Sequence: Synthetic peptide
  Seed: TLDLTSEGC (MAGC1_HUMAN)
TVDLTSEGV

SEQ ID NO: 81354 - protein, 11 aa, Artificial Sequence
  Description of Artificial Sequence: Synthetic peptide
  Seed: REVDPDDSYVF (MAGC1_HUMAN)
REVDPDDSYVL

SEQ ID NO: 81355 - protein, 11 aa, Artificial Sequence
  Description of Artificial Sequence: Synthetic peptide
  Seed: SPLQIPMTSSF (MAGC1_HUMAN)
SGLQIPMTSSM

SEQ ID NO: 81356 - protein, 10 aa, Artificial Sequence
  Description of Artificial Sequence: Synthetic peptide
  Seed: SSSSTLLSLF (MAGC1_HUMAN)
SYSSTLLSLY

SEQ ID NO: 81357 - protein, 9 aa, Artificial Sequence
  Description of Artificial Sequence: Synthetic peptide
  Seed: TSLSLPQSF (MAGC1_HUMAN)
TYLSLPQSI

SEQ ID NO: 81358 - protein, 10 aa, Artificial Sequence
  Description of Artificial Sequence: Synthetic peptide
  Seed: KGTYASEEVI (MAGC1_HUMAN)
KDTYASEEVF

SEQ ID NO: 81359 - protein, 9 aa, Artificial Sequence
  Description of Artificial Sequence: Synthetic peptide
  Seed: AGREHFAFG (MAGC1_HUMAN)
AIREHFAFK

SEQ ID NO: 81360 - protein, 10 aa, Artificial Sequence
  Description of Artificial Sequence: Synthetic peptide
  Seed: SSPECTQSTF (MAGC1_HUMAN)
SPPECTQSTL

SEQ ID NO: 81361 - protein, 9 aa, Artificial Sequence
  Description of Artificial Sequence: Synthetic peptide
  Seed: VSRSFSSTL (MAGC1_HUMAN)
VQRSFSSTH

SEQ ID NO: 81362 - protein, 9 aa, Artificial Sequence
  Description of Artificial Sequence: Synthetic peptide
  Seed: KVVEFLAML (MAGC1_HUMAN)
KVVEFLAMM

SEQ ID NO: 81363 - protein, 9 aa, Artificial Sequence
  Description of Artificial Sequence: Synthetic peptide
  Seed: IPVSSSFSY (MAGC1_HUMAN)
ISVSSSFSY

SEQ ID NO: 81364 - protein, 9 aa, Artificial Sequence
  Description of Artificial Sequence: Synthetic peptide
  Seed: TPSSLPQSF (MAGC1_HUMAN)
TTSSLPQSY

SEQ ID NO: 81365 - protein, 9 aa, Artificial Sequence
  Description of Artificial Sequence: Synthetic peptide
  Seed: SSPECTQST (MAGC1_HUMAN)
SFPECTQSF

SEQ ID NO: 81366 - protein, 10 aa, Artificial Sequence
  Description of Artificial Sequence: Synthetic peptide
  Seed: YTLLSLFQSS (MAGC1_HUMAN)
YYLLSLFQSL

SEQ ID NO: 81367 - protein, 10 aa, Artificial Sequence
  Description of Artificial Sequence: Synthetic peptide
  Seed: QRPVSSFFSY (MAGC1_HUMAN)
QHPVSSFFSY

SEQ ID NO: 81368 - protein, 9 aa, Artificial Sequence
  Description of Artificial Sequence: Synthetic peptide
  Seed: FPSSYKDAL (MAGC1_HUMAN)
FQSSYKDAF

SEQ ID NO: 81369 - protein, 9 aa, Artificial Sequence
  Description of Artificial Sequence: Synthetic peptide
  Seed: TLDEKVDEL (MAGC1_HUMAN)
TSDEKVDEV

SEQ ID NO: 81370 - protein, 9 aa, Artificial Sequence
  Description of Artificial Sequence: Synthetic peptide
  Seed: TLLSLFQSF (MAGC1_HUMAN)
TILSLFQSV

SEQ ID NO: 81371 - protein, 10 aa, Artificial Sequence
  Description of Artificial Sequence: Synthetic peptide
  Seed: FPQSVLQIPV (MAGC1_HUMAN)
FTQSVLQIPL

SEQ ID NO: 81372 - protein, 9 aa, Artificial Sequence
  Description of Artificial Sequence: Synthetic peptide
  Seed: SPVISFSSS (MAGC1_HUMAN)
SPVISFSSI

SEQ ID NO: 81373 - protein, 9 aa, Artificial Sequence
  Description of Artificial Sequence: Synthetic peptide
  Seed: VSAASSSTL (MAGC1_HUMAN)
VQAASSSTA

SEQ ID NO: 81374 - protein, 9 aa, Artificial Sequence
  Description of Artificial Sequence: Synthetic peptide
  Seed: EDFQSSLQS (MAGC1_HUMAN)
EEFQSSLQY

SEQ ID NO: 81375 - protein, 11 aa, Artificial Sequence
  Description of Artificial Sequence: Synthetic peptide
  Seed: IPMTSSFSSTL (MAGC1_HUMAN)
IGMTSSFSSTF

SEQ ID NO: 81376 - protein, 10 aa, Artificial Sequence
  Description of Artificial Sequence: Synthetic peptide
  Seed: GEDSSDPLQR (MAGC1_HUMAN)
GMDSSDPLQY

SEQ ID NO: 81377 - protein, 9 aa, Artificial Sequence
  Description of Artificial Sequence: Synthetic peptide
  Seed: VSSSFSYTL (MAGC1_HUMAN)
VLSSFSYTV

SEQ ID NO: 81378 - protein, 10 aa, Artificial Sequence
  Description of Artificial Sequence: Synthetic peptide
  Seed: STPSSLPQSF (MAGC1_HUMAN)
SRPSSLPQSM

SEQ ID NO: 81379 - protein, 9 aa, Artificial Sequence
  Description of Artificial Sequence: Synthetic peptide
  Seed: SFSSTLVSL (MAGC1_HUMAN)
SQSSTLVSF

SEQ ID NO: 81380 - protein, 9 aa, Artificial Sequence
  Description of Artificial Sequence: Synthetic peptide
  Seed: AQSSLQIPV (MAGC1_HUMAN)
AMSSLQIPV

SEQ ID NO: 81381 - protein, 9 aa, Artificial Sequence
  Description of Artificial Sequence: Synthetic peptide
  Seed: SFSYTLLSL (MAGC1_HUMAN)
SWSYTLLSL

SEQ ID NO: 81382 - protein, 10 aa, Artificial Sequence
  Description of Artificial Sequence: Synthetic peptide
  Seed: FFSSALLSIF (MAGC1_HUMAN)
FLSSALLSIW

SEQ ID NO: 81383 - protein, 10 aa, Artificial Sequence
  Description of Artificial Sequence: Synthetic peptide
  Seed: FFSSALLSIF (MAGC1_HUMAN)
FWSSALLSIF

SEQ ID NO: 81384 - protein, 10 aa, Artificial Sequence
  Description of Artificial Sequence: Synthetic peptide
  Seed: STSLSLPQSF (MAGC1_HUMAN)
SHSLSLPQSW

SEQ ID NO: 81385 - protein, 9 aa, Artificial Sequence
  Description of Artificial Sequence: Synthetic peptide
  Seed: EILFGISLR (MAGC1_HUMAN)
EWLFGISLR

SEQ ID NO: 81386 - protein, 9 aa, Artificial Sequence
  Description of Artificial Sequence: Synthetic peptide
  Seed: EFIEILFGI (MAGC1_HUMAN)
EAIEILFGT

SEQ ID NO: 81387 - protein, 10 aa, Artificial Sequence
  Description of Artificial Sequence: Synthetic peptide
  Seed: RKVVEFLAML (MAGC1_HUMAN)
REVVEFLAMA

SEQ ID NO: 81388 - protein, 10 aa, Artificial Sequence
  Description of Artificial Sequence: Synthetic peptide
  Seed: RLLILILSII (MAGC1_HUMAN)
RQLILILSIV

SEQ ID NO: 81389 - protein, 9 aa, Artificial Sequence
  Description of Artificial Sequence: Synthetic peptide
  Seed: SPLEGEDSL (MAGC1_HUMAN)
SRLEGEDSI

SEQ ID NO: 81390 - protein, 9 aa, Artificial Sequence
  Description of Artificial Sequence: Synthetic peptide
  Seed: LQIPVSPSF (MAGC1_HUMAN)
LKIPVSPSF

SEQ ID NO: 81391 - protein, 10 aa, Artificial Sequence
  Description of Artificial Sequence: Synthetic peptide
  Seed: SSSSTLLSLF (MAGC1_HUMAN)
SYSSTLLSLL

SEQ ID NO: 81392 - protein, 9 aa, Artificial Sequence
  Description of Artificial Sequence: Synthetic peptide
  Seed: SSSTSLSPF (MAGC1_HUMAN)
SQSTSLSPM

SEQ ID NO: 81393 - protein, 10 aa, Artificial Sequence
  Description of Artificial Sequence: Synthetic peptide
  Seed: LLQIPMTSSF (MAGC1_HUMAN)
LQQIPMTSSY

SEQ ID NO: 81394 - protein, 9 aa, Artificial Sequence
  Description of Artificial Sequence: Synthetic peptide
  Seed: MPSLLQSSS (MAGC1_HUMAN)
MISLLQSSM

SEQ ID NO: 81395 - protein, 9 aa, Artificial Sequence
  Description of Artificial Sequence: Synthetic peptide
  Seed: YQVKQPITK (MAGC1_HUMAN)
YTVKQPITI

SEQ ID NO: 81396 - protein, 10 aa, Artificial Sequence
  Description of Artificial Sequence: Synthetic peptide
  Seed: RKVVEFLAML (MAGC1_HUMAN)
RQVVEFLAMV

SEQ ID NO: 81397 - protein, 11 aa, Artificial Sequence
  Description of Artificial Sequence: Synthetic peptide
  Seed: SLSQSSPVSSF (MAGC1_HUMAN)
SMSQSSPVSSY

SEQ ID NO: 81398 - protein, 9 aa, Artificial Sequence
  Description of Artificial Sequence: Synthetic peptide
  Seed: SSHESPQSP (MAGC1_HUMAN)
SQHESPQSM

SEQ ID NO: 81399 - protein, 9 aa, Artificial Sequence
  Description of Artificial Sequence: Synthetic peptide
  Seed: RTHSTFEGF (MAGC1_HUMAN)
RWHSTFEGY

SEQ ID NO: 81400 - protein, 9 aa, Artificial Sequence
  Description of Artificial Sequence: Synthetic peptide
  Seed: TESASSSVM (MAGC1_HUMAN)
TNSASSSVF

SEQ ID NO: 81401 - protein, 9 aa, Artificial Sequence
  Description of Artificial Sequence: Synthetic peptide
  Seed: NSSPPRYEF (MAGC1_HUMAN)
NQSPPRYEW

SEQ ID NO: 81402 - protein, 9 aa, Artificial Sequence
  Description of Artificial Sequence: Synthetic peptide
  Seed: SSFFSSALL (MAGC1_HUMAN)
SAFFSSALL

SEQ ID NO: 81403 - protein, 8 aa, Artificial Sequence
  Description of Artificial Sequence: Synthetic peptide
  Seed: LQNPASSF (MAGC1_HUMAN)
LMNPASSF

SEQ ID NO: 81404 - protein, 9 aa, Artificial Sequence
  Description of Artificial Sequence: Synthetic peptide
  Seed: SIIFIKGTY (MAGC1_HUMAN)
SIIFIKGTR

SEQ ID NO: 81405 - protein, 10 aa, Artificial Sequence
  Description of Artificial Sequence: Synthetic peptide
  Seed: RAGREHFAFG (MAGC1_HUMAN)
RNGREHFAFA

SEQ ID NO: 81406 - protein, 9 aa, Artificial Sequence
  Description of Artificial Sequence: Synthetic peptide
  Seed: TTDDSTATE (MAGC1_HUMAN)
TYDDSTATM

SEQ ID NO: 81407 - protein, 9 aa, Artificial Sequence
  Description of Artificial Sequence: Synthetic peptide
  Seed: ISFSSSTSL (MAGC1_HUMAN)
IKFSSSTSF

SEQ ID NO: 81408 - protein, 9 aa, Artificial Sequence
  Description of Artificial Sequence: Synthetic peptide
  Seed: RYTGYFPVI (MAGC1_HUMAN)
RTTGYFPVY

SEQ ID NO: 81409 - protein, 9 aa, Artificial Sequence
  Description of Artificial Sequence: Synthetic peptide
  Seed: SSPPRYEFL (MAGC1_HUMAN)
SFPPRYEFF

SEQ ID NO: 81410 - protein, 9 aa, Artificial Sequence
  Description of Artificial Sequence: Synthetic peptide
  Seed: VQSPLHSPQ (MAGC1_HUMAN)
VMSPLHSPI

SEQ ID NO: 81411 - protein, 9 aa, Artificial Sequence
  Description of Artificial Sequence: Synthetic peptide
  Seed: SRSFSSTLL (MAGC1_HUMAN)
SHSFSSTLA

SEQ ID NO: 81412 - protein, 9 aa, Artificial Sequence
  Description of Artificial Sequence: Synthetic peptide
  Seed: TLDEKVDEL (MAGC1_HUMAN)
TMDEKVDEF

SEQ ID NO: 81413 - protein, 9 aa, Artificial Sequence
  Description of Artificial Sequence: Synthetic peptide
  Seed: SPLQRPVSS (MAGC1_HUMAN)
SPLQRPVSA

SEQ ID NO: 81414 - protein, 9 aa, Artificial Sequence
  Description of Artificial Sequence: Synthetic peptide
  Seed: RTQSTFEGF (MAGC1_HUMAN)
RMQSTFEGK

SEQ ID NO: 81415 - protein, 9 aa, Artificial Sequence
  Description of Artificial Sequence: Synthetic peptide
  Seed: RTHSTFEGF (MAGC1_HUMAN)
REHSTFEGY

SEQ ID NO: 81416 - protein, 8 aa, Artificial Sequence
  Description of Artificial Sequence: Synthetic peptide
  Seed: DELARFLL (MAGC1_HUMAN)
DELARFLY

SEQ ID NO: 81417 - protein, 9 aa, Artificial Sequence
  Description of Artificial Sequence: Synthetic peptide
  Seed: VSSFFSYTL (MAGC1_HUMAN)
VWSFFSYTY

SEQ ID NO: 81418 - protein, 11 aa, Artificial Sequence
  Description of Artificial Sequence: Synthetic peptide
  Seed: RSFSSTLLSIF (MAGC1_HUMAN)
RLFSSTLLSIW

SEQ ID NO: 81419 - protein, 10 aa, Artificial Sequence
  Description of Artificial Sequence: Synthetic peptide
  Seed: FAQSSLQIPV (MAGC1_HUMAN)
FPQSSLQIPL

SEQ ID NO: 81420 - protein, 10 aa, Artificial Sequence
  Description of Artificial Sequence: Synthetic peptide
  Seed: NTVPITFPSS (MAGC1_HUMAN)
NSVPITFPSA

SEQ ID NO: 81421 - protein, 9 aa, Artificial Sequence
  Description of Artificial Sequence: Synthetic peptide
  Seed: AEMLTNVIS (MAGC1_HUMAN)
AEMLTNVIG

SEQ ID NO: 81422 - protein, 10 aa, Artificial Sequence
  Description of Artificial Sequence: Synthetic peptide
  Seed: SSPESAQSAF (MAGC1_HUMAN)
SEPESAQSAM

SEQ ID NO: 81423 - protein, 9 aa, Artificial Sequence
  Description of Artificial Sequence: Synthetic peptide
  Seed: TLASLLQSS (MAGC1_HUMAN)
TQASLLQSM

SEQ ID NO: 81424 - protein, 9 aa, Artificial Sequence
  Description of Artificial Sequence: Synthetic peptide
  Seed: TLLSLFQSF (MAGC1_HUMAN)
TTLSLFQSL

SEQ ID NO: 81425 - protein, 11 aa, Artificial Sequence
  Description of Artificial Sequence: Synthetic peptide
  Seed: SFFSYTLASLL (MAGC1_HUMAN)
SIFSYTLASLW

SEQ ID NO: 81426 - protein, 8 aa, Artificial Sequence
  Description of Artificial Sequence: Synthetic peptide
  Seed: SYVFVNTL (MAGC1_HUMAN)
SYVFVNTW

SEQ ID NO: 81427 - protein, 9 aa, Artificial Sequence
  Description of Artificial Sequence: Synthetic peptide
  Seed: FSSTLLSLF (MAGC1_HUMAN)
FTSTLLSLL

SEQ ID NO: 81428 - protein, 9 aa, Artificial Sequence
  Description of Artificial Sequence: Synthetic peptide
  Seed: KAREFIEIL (MAGC1_HUMAN)
KSREFIEIK

SEQ ID NO: 81429 - protein, 9 aa, Artificial Sequence
  Description of Artificial Sequence: Synthetic peptide
  Seed: SSHESPQSP (MAGC1_HUMAN)
STHESPQSL

SEQ ID NO: 81430 - protein, 10 aa, Artificial Sequence
  Description of Artificial Sequence: Synthetic peptide
  Seed: WGPRAHSEVI (MAGC1_HUMAN)
WVPRAHSEVV

SEQ ID NO: 81431 - protein, 9 aa, Artificial Sequence
  Description of Artificial Sequence: Synthetic peptide
  Seed: FSEESSSPV (MAGC1_HUMAN)
FQEESSSPL

SEQ ID NO: 81432 - protein, 9 aa, Artificial Sequence
  Description of Artificial Sequence: Synthetic peptide
  Seed: SSPPRYEFL (MAGC1_HUMAN)
SRPPRYEFY

SEQ ID NO: 81433 - protein, 9 aa, Artificial Sequence
  Description of Artificial Sequence: Synthetic peptide
  Seed: CSSSTSLSL (MAGC1_HUMAN)
CMSSTSLSY

SEQ ID NO: 81434 - protein, 10 aa, Artificial Sequence
  Description of Artificial Sequence: Synthetic peptide
  Seed: MTSSFSSTLL (MAGC1_HUMAN)
MCSSFSSTLL

SEQ ID NO: 81435 - protein, 9 aa, Artificial Sequence
  Description of Artificial Sequence: Synthetic peptide
  Seed: TTDDSTATE (MAGC1_HUMAN)
TTDDSTATL

SEQ ID NO: 81436 - protein, 9 aa, Artificial Sequence
  Description of Artificial Sequence: Synthetic peptide
  Seed: RTHSTFEGF (MAGC1_HUMAN)
RIHSTFEGW

SEQ ID NO: 81437 - protein, 11 aa, Artificial Sequence
  Description of Artificial Sequence: Synthetic peptide
  Seed: LQIPVSSSFSY (MAGC1_HUMAN)
LYIPVSSSFSY

SEQ ID NO: 81438 - protein, 10 aa, Artificial Sequence
  Description of Artificial Sequence: Synthetic peptide
  Seed: FLAMLKNTVP (MAGC1_HUMAN)
FLAMLKNTVF

SEQ ID NO: 81439 - protein, 9 aa, Artificial Sequence
  Description of Artificial Sequence: Synthetic peptide
  Seed: TLDLTSEGC (MAGC1_HUMAN)
TLDLTSEGF

SEQ ID NO: 81440 - protein, 9 aa, Artificial Sequence
  Description of Artificial Sequence: Synthetic peptide
  Seed: LQRPVSSFF (MAGC1_HUMAN)
LIRPVSSFK

SEQ ID NO: 81441 - protein, 10 aa, Artificial Sequence
  Description of Artificial Sequence: Synthetic peptide
  Seed: LQIPVSRSFS (MAGC1_HUMAN)
LQIPVSRSFY

SEQ ID NO: 81442 - protein, 10 aa, Artificial Sequence
  Description of Artificial Sequence: Synthetic peptide
  Seed: SVLQIPVSAA (MAGC1_HUMAN)
SMLQIPVSAI

SEQ ID NO: 81443 - protein, 9 aa, Artificial Sequence
  Description of Artificial Sequence: Synthetic peptide
  Seed: LQIPVSAAS (MAGC1_HUMAN)
LKIPVSAAW

SEQ ID NO: 81444 - protein, 10 aa, Artificial Sequence
  Description of Artificial Sequence: Synthetic peptide
  Seed: RYTGYFPVIF (MAGC1_HUMAN)
RTTGYFPVIF

SEQ ID NO: 81445 - protein, 10 aa, Artificial Sequence
  Description of Artificial Sequence: Synthetic peptide
  Seed: DVLSGIGVRA (MAGC1_HUMAN)
DILSGIGVRK

SEQ ID NO: 81446 - protein, 9 aa, Artificial Sequence
  Description of Artificial Sequence: Synthetic peptide
  Seed: KAREFIEIL (MAGC1_HUMAN)
KKREFIEIF

SEQ ID NO: 81447 - protein, 10 aa, Artificial Sequence
  Description of Artificial Sequence: Synthetic peptide
  Seed: FPQSLLQIPM (MAGC1_HUMAN)
FMQSLLQIPA

SEQ ID NO: 81448 - protein, 9 aa, Artificial Sequence
  Description of Artificial Sequence: Synthetic peptide
  Seed: VSPSFSSTL (MAGC1_HUMAN)
VTPSFSSTF

SEQ ID NO: 81449 - protein, 9 aa, Artificial Sequence
  Description of Artificial Sequence: Synthetic peptide
  Seed: KVVEFLAML (MAGC1_HUMAN)
KVVEFLAMA

SEQ ID NO: 81450 - protein, 9 aa, Artificial Sequence
  Description of Artificial Sequence: Synthetic peptide
  Seed: SSPEGKDSL (MAGC1_HUMAN)
SVPEGKDSI

SEQ ID NO: 81451 - protein, 10 aa, Artificial Sequence
  Description of Artificial Sequence: Synthetic peptide
  Seed: FFSYTLASLL (MAGC1_HUMAN)
FISYTLASLY

SEQ ID NO: 81452 - protein, 10 aa, Artificial Sequence
  Description of Artificial Sequence: Synthetic peptide
  Seed: FAQSSLQIPV (MAGC1_HUMAN)
FAQSSLQIPM

SEQ ID NO: 81453 - protein, 9 aa, Artificial Sequence
  Description of Artificial Sequence: Synthetic peptide
  Seed: LQIPMTSSF (MAGC1_HUMAN)
LVIPMTSSI

SEQ ID NO: 81454 - protein, 10 aa, Artificial Sequence
  Description of Artificial Sequence: Synthetic peptide
  Seed: YTLDEKVDEL (MAGC1_HUMAN)
YELDEKVDEL

SEQ ID NO: 81455 - protein, 11 aa, Artificial Sequence
  Description of Artificial Sequence: Synthetic peptide
  Seed: VPNSSPPRYEF (MAGC1_HUMAN)
VPNSSPPRYEL

SEQ ID NO: 81456 - protein, 9 aa, Artificial Sequence
  Description of Artificial Sequence: Synthetic peptide
  Seed: VPITFPSSY (MAGC1_HUMAN)
VLITFPSSM

SEQ ID NO: 81457 - protein, 10 aa, Artificial Sequence
  Description of Artificial Sequence: Synthetic peptide
  Seed: FFSYTLASLL (MAGC1_HUMAN)
FHSYTLASLY

SEQ ID NO: 81458 - protein, 9 aa, Artificial Sequence
  Description of Artificial Sequence: Synthetic peptide
  Seed: FTYTLDEKV (MAGC1_HUMAN)
FSYTLDEKF

SEQ ID NO: 81459 - protein, 9 aa, Artificial Sequence
  Description of Artificial Sequence: Synthetic peptide
  Seed: SPPEGENTH (MAGC1_HUMAN)
SMPEGENTY

SEQ ID NO: 81460 - protein, 11 aa, Artificial Sequence
  Description of Artificial Sequence: Synthetic peptide
  Seed: TTDDSTATESA (MAGC1_HUMAN)
TCDDSTATESL

SEQ ID NO: 81461 - protein, 9 aa, Artificial Sequence
  Description of Artificial Sequence: Synthetic peptide
  Seed: FQSSPERTH (MAGC1_HUMAN)
FVSSPERTL

SEQ ID NO: 81462 - protein, 9 aa, Artificial Sequence
  Description of Artificial Sequence: Synthetic peptide
  Seed: LQIPVSPSF (MAGC1_HUMAN)
LRIPVSPSF

SEQ ID NO: 81463 - protein, 10 aa, Artificial Sequence
  Description of Artificial Sequence: Synthetic peptide
  Seed: WEDSLSPHYF (MAGC1_HUMAN)
WMDSLSPHYL

SEQ ID NO: 81464 - protein, 9 aa, Artificial Sequence
  Description of Artificial Sequence: Synthetic peptide
  Seed: CTQSTFEGF (MAGC1_HUMAN)
CKQSTFEGY

SEQ ID NO: 81465 - protein, 10 aa, Artificial Sequence
  Description of Artificial Sequence: Synthetic peptide
  Seed: STPSSLPQSF (MAGC1_HUMAN)
SAPSSLPQSL

SEQ ID NO: 81466 - protein, 9 aa, Artificial Sequence
  Description of Artificial Sequence: Synthetic peptide
  Seed: STQSPFEGF (MAGC1_HUMAN)
SSQSPFEGW

SEQ ID NO: 81467 - protein, 9 aa, Artificial Sequence
  Description of Artificial Sequence: Synthetic peptide
  Seed: AQSPLQIPV (MAGC1_HUMAN)
AHSPLQIPL

SEQ ID NO: 81468 - protein, 9 aa, Artificial Sequence
  Description of Artificial Sequence: Synthetic peptide
  Seed: ASSFFSSAL (MAGC1_HUMAN)
AWSFFSSAL

SEQ ID NO: 81469 - protein, 9 aa, Artificial Sequence
  Description of Artificial Sequence: Synthetic peptide
  Seed: FAFGEPREL (MAGC1_HUMAN)
FIFGEPREM

SEQ ID NO: 81470 - protein, 10 aa, Artificial Sequence
  Description of Artificial Sequence: Synthetic peptide
  Seed: VSPSSSSTLL (MAGC1_HUMAN)
VAPSSSSTLF

SEQ ID NO: 81471 - protein, 9 aa, Artificial Sequence
  Description of Artificial Sequence: Synthetic peptide
  Seed: RAHSEVIKR (MAGC1_HUMAN)
RFHSEVIKR

SEQ ID NO: 81472 - protein, 10 aa, Artificial Sequence
  Description of Artificial Sequence: Synthetic peptide
  Seed: RSFSSTLLSI (MAGC1_HUMAN)
RMFSSTLLSI

SEQ ID NO: 81473 - protein, 11 aa, Artificial Sequence
  Description of Artificial Sequence: Synthetic peptide
  Seed: SFFSSALLSIF (MAGC1_HUMAN)
SMFSSALLSIW

SEQ ID NO: 81474 - protein, 9 aa, Artificial Sequence
  Description of Artificial Sequence: Synthetic peptide
  Seed: SLPEWEDSL (MAGC1_HUMAN)
SMPEWEDSL

SEQ ID NO: 81475 - protein, 10 aa, Artificial Sequence
  Description of Artificial Sequence: Synthetic peptide
  Seed: ICSSSTSLSL (MAGC1_HUMAN)
IYSSSTSLSW

SEQ ID NO: 81476 - protein, 10 aa, Artificial Sequence
  Description of Artificial Sequence: Synthetic peptide
  Seed: SIFQSSPESA (MAGC1_HUMAN)
SIFQSSPESL

SEQ ID NO: 81477 - protein, 11 aa, Artificial Sequence
  Description of Artificial Sequence: Synthetic peptide
  Seed: IPVSAASSSTL (MAGC1_HUMAN)
ILVSAASSSTY

SEQ ID NO: 81478 - protein, 9 aa, Artificial Sequence
  Description of Artificial Sequence: Synthetic peptide
  Seed: LQIPVSAAS (MAGC1_HUMAN)
LKIPVSAAI

SEQ ID NO: 81479 - protein, 9 aa, Artificial Sequence
  Description of Artificial Sequence: Synthetic peptide
  Seed: SLIESEPLF (MAGC1_HUMAN)
SIIESEPLY

SEQ ID NO: 81480 - protein, 9 aa, Artificial Sequence
  Description of Artificial Sequence: Synthetic peptide
  Seed: VIKRKVVEF (MAGC1_HUMAN)
VMKRKVVEF

SEQ ID NO: 81481 - protein, 9 aa, Artificial Sequence
  Description of Artificial Sequence: Synthetic peptide
  Seed: SPFSEESSS (MAGC1_HUMAN)
SPFSEESSA

SEQ ID NO: 81482 - protein, 11 aa, Artificial Sequence
  Description of Artificial Sequence: Synthetic peptide
  Seed: SPLQIPMTSSF (MAGC1_HUMAN)
SNLQIPMTSSY

SEQ ID NO: 81483 - protein, 9 aa, Artificial Sequence
  Description of Artificial Sequence: Synthetic peptide
  Seed: TPSSLPQSF (MAGC1_HUMAN)
TYSSLPQSM

SEQ ID NO: 81484 - protein, 9 aa, Artificial Sequence
  Description of Artificial Sequence: Synthetic peptide
  Seed: SSSTSLSPF (MAGC1_HUMAN)
SLSTSLSPF

SEQ ID NO: 81485 - protein, 9 aa, Artificial Sequence
  Description of Artificial Sequence: Synthetic peptide
  Seed: GPRAHSEVI (MAGC1_HUMAN)
GPRAHSEVA

SEQ ID NO: 81486 - protein, 10 aa, Artificial Sequence
  Description of Artificial Sequence: Synthetic peptide
  Seed: YTLLSLFQSS (MAGC1_HUMAN)
YTLLSLFQSL

SEQ ID NO: 81487 - protein, 9 aa, Artificial Sequence
  Description of Artificial Sequence: Synthetic peptide
  Seed: FLAMLKNTV (MAGC1_HUMAN)
FMAMLKNTA

SEQ ID NO: 81488 - protein, 9 aa, Artificial Sequence
  Description of Artificial Sequence: Synthetic peptide
  Seed: FTYTLDEKV (MAGC1_HUMAN)
FIYTLDEKL

SEQ ID NO: 81489 - protein, 9 aa, Artificial Sequence
  Description of Artificial Sequence: Synthetic peptide
  Seed: SSFFSSALL (MAGC1_HUMAN)
SSFFSSALF

SEQ ID NO: 81490 - protein, 9 aa, Artificial Sequence
  Description of Artificial Sequence: Synthetic peptide
  Seed: SLIESEPLF (MAGC1_HUMAN)
SQIESEPLM

SEQ ID NO: 81491 - protein, 10 aa, Artificial Sequence
  Description of Artificial Sequence: Synthetic peptide
  Seed: ISRYTGYFPV (MAGC1_HUMAN)
IMRYTGYFPV

SEQ ID NO: 81492 - protein, 10 aa, Artificial Sequence
  Description of Artificial Sequence: Synthetic peptide
  Seed: RAGREHFAFG (MAGC1_HUMAN)
RIGREHFAFG

SEQ ID NO: 81493 - protein, 10 aa, Artificial Sequence
  Description of Artificial Sequence: Synthetic peptide
  Seed: LQIPVSPSFS (MAGC1_HUMAN)
LQIPVSPSFD

SEQ ID NO: 81494 - protein, 10 aa, Artificial Sequence
  Description of Artificial Sequence: Synthetic peptide
  Seed: DVLSGIGVRA (MAGC1_HUMAN)
DQLSGIGVRR

SEQ ID NO: 81495 - protein, 10 aa, Artificial Sequence
  Description of Artificial Sequence: Synthetic peptide
  Seed: SSSSSTLLSL (MAGC1_HUMAN)
SPSSSTLLSF

SEQ ID NO: 81496 - protein, 9 aa, Artificial Sequence
  Description of Artificial Sequence: Synthetic peptide
  Seed: LQRPVSSFF (MAGC1_HUMAN)
LSRPVSSFS

SEQ ID NO: 81497 - protein, 9 aa, Artificial Sequence
  Description of Artificial Sequence: Synthetic peptide
  Seed: VIFRKAREF (MAGC1_HUMAN)
VTFRKAREY

SEQ ID NO: 81498 - protein, 10 aa, Artificial Sequence
  Description of Artificial Sequence: Synthetic peptide
  Seed: SFPSSTSSSL (MAGC1_HUMAN)
SAPSSTSSSM

SEQ ID NO: 81499 - protein, 9 aa, Artificial Sequence
  Description of Artificial Sequence: Synthetic peptide
  Seed: STFEGFPQS (MAGC1_HUMAN)
STFEGFPQF

SEQ ID NO: 81500 - protein, 10 aa, Artificial Sequence
  Description of Artificial Sequence: Synthetic peptide
  Seed: WDVLSGIGVR (MAGC1_HUMAN)
WSVLSGIGVR

SEQ ID NO: 81501 - protein, 9 aa, Artificial Sequence
  Description of Artificial Sequence: Synthetic peptide
  Seed: LSDEQGMSQ (MAGC1_HUMAN)
LEDEQGMSM

SEQ ID NO: 81502 - protein, 10 aa, Artificial Sequence
  Description of Artificial Sequence: Synthetic peptide
  Seed: SRYTGYFPVI (MAGC1_HUMAN)
STYTGYFPVL

SEQ ID NO: 81503 - protein, 9 aa, Artificial Sequence
  Description of Artificial Sequence: Synthetic peptide
  Seed: FSYTLASLL (MAGC1_HUMAN)
FRYTLASLI

SEQ ID NO: 81504 - protein, 11 aa, Artificial Sequence
  Description of Artificial Sequence: Synthetic peptide
  Seed: QSSPESAQSTF (MAGC1_HUMAN)
QLSPESAQSTY

SEQ ID NO: 81505 - protein, 9 aa, Artificial Sequence
  Description of Artificial Sequence: Synthetic peptide
  Seed: YVFVNTLDL (MAGC1_HUMAN)
YMFVNTLDF

SEQ ID NO: 81506 - protein, 10 aa, Artificial Sequence
  Description of Artificial Sequence: Synthetic peptide
  Seed: SSFSYTLLSL (MAGC1_HUMAN)
SLFSYTLLSA

SEQ ID NO: 81507 - protein, 9 aa, Artificial Sequence
  Description of Artificial Sequence: Synthetic peptide
  Seed: SSFFSYTLA (MAGC1_HUMAN)
SSFFSYTLI

SEQ ID NO: 81508 - protein, 9 aa, Artificial Sequence
  Description of Artificial Sequence: Synthetic peptide
  Seed: EGDDTQSPL (MAGC1_HUMAN)
EMDDTQSPL

SEQ ID NO: 81509 - protein, 9 aa, Artificial Sequence
  Description of Artificial Sequence: Synthetic peptide
  Seed: YTSSSDTLL (MAGC1_HUMAN)
YSSSSDTLV

SEQ ID NO: 81510 - protein, 10 aa, Artificial Sequence
  Description of Artificial Sequence: Synthetic peptide
  Seed: MPTAGMPSLL (MAGC1_HUMAN)
MTTAGMPSLY

SEQ ID NO: 81511 - protein, 9 aa, Artificial Sequence
  Description of Artificial Sequence: Synthetic peptide
  Seed: TLDLTSEGC (MAGC1_HUMAN)
TFDLTSEGF

SEQ ID NO: 81512 - protein, 8 aa, Artificial Sequence
  Description of Artificial Sequence: Synthetic peptide
  Seed: SEVIKRKV (MAGC1_HUMAN)
SDVIKRKL

SEQ ID NO: 81513 - protein, 10 aa, Artificial Sequence
  Description of Artificial Sequence: Synthetic peptide
  Seed: ASSFFSSALL (MAGC1_HUMAN)
AYSFFSSALV

SEQ ID NO: 81514 - protein, 9 aa, Artificial Sequence
  Description of Artificial Sequence: Synthetic peptide
  Seed: HYFPQSPPQ (MAGC1_HUMAN)
HWFPQSPPF

SEQ ID NO: 81515 - protein, 9 aa, Artificial Sequence
  Description of Artificial Sequence: Synthetic peptide
  Seed: LQIPVSPSF (MAGC1_HUMAN)
LHIPVSPSL

SEQ ID NO: 81516 - protein, 9 aa, Artificial Sequence
  Description of Artificial Sequence: Synthetic peptide
  Seed: SSPERTHST (MAGC1_HUMAN)
SIPERTHSI

SEQ ID NO: 81517 - protein, 9 aa, Artificial Sequence
  Description of Artificial Sequence: Synthetic peptide
  Seed: IFRKAREFI (MAGC1_HUMAN)
IFRKAREFF

SEQ ID NO: 81518 - protein, 10 aa, Artificial Sequence
  Description of Artificial Sequence: Synthetic peptide
  Seed: SRYTGYFPVI (MAGC1_HUMAN)
SIYTGYFPVI

SEQ ID NO: 81519 - protein, 9 aa, Artificial Sequence
  Description of Artificial Sequence: Synthetic peptide
  Seed: YTLASLLQS (MAGC1_HUMAN)
YLLASLLQM

SEQ ID NO: 81520 - protein, 10 aa, Artificial Sequence
  Description of Artificial Sequence: Synthetic peptide
  Seed: KVVEFLAMLK (MAGC1_HUMAN)
KLVEFLAMLA

SEQ ID NO: 81521 - protein, 9 aa, Artificial Sequence
  Description of Artificial Sequence: Synthetic peptide
  Seed: SSSDTLLES (MAGC1_HUMAN)
SASDTLLEF

SEQ ID NO: 81522 - protein, 9 aa, Artificial Sequence
  Description of Artificial Sequence: Synthetic peptide
  Seed: LQIPVSRSF (MAGC1_HUMAN)
LSIPVSRSY

SEQ ID NO: 81523 - protein, 10 aa, Artificial Sequence
  Description of Artificial Sequence: Synthetic peptide
  Seed: FPQSVLQIPV (MAGC1_HUMAN)
FLQSVLQIPL

SEQ ID NO: 81524 - protein, 9 aa, Artificial Sequence
  Description of Artificial Sequence: Synthetic peptide
  Seed: SLIESEPLF (MAGC1_HUMAN)
SSIESEPLY

SEQ ID NO: 81525 - protein, 11 aa, Artificial Sequence
  Description of Artificial Sequence: Synthetic peptide
  Seed: SSFSYTLLSLF (MAGC1_HUMAN)
SWFSYTLLSLW

SEQ ID NO: 81526 - protein, 9 aa, Artificial Sequence
  Description of Artificial Sequence: Synthetic peptide
  Seed: FSSTLLSLF (MAGC1_HUMAN)
FTSTLLSLF

SEQ ID NO: 81527 - protein, 10 aa, Artificial Sequence
  Description of Artificial Sequence: Synthetic peptide
  Seed: VSSSFSYTLL (MAGC1_HUMAN)
VPSSFSYTLF

SEQ ID NO: 81528 - protein, 9 aa, Artificial Sequence
  Description of Artificial Sequence: Synthetic peptide
  Seed: STFEGFAQS (MAGC1_HUMAN)
SCFEGFAQV

SEQ ID NO: 81529 - protein, 11 aa, Artificial Sequence
  Description of Artificial Sequence: Synthetic peptide
  Seed: TVPITFPSSYK (MAGC1_HUMAN)
TGPITFPSSYR

SEQ ID NO: 81530 - protein, 9 aa, Artificial Sequence
  Description of Artificial Sequence: Synthetic peptide
  Seed: TTDDSTATE (MAGC1_HUMAN)
TSDDSTATC

SEQ ID NO: 81531 - protein, 9 aa, Artificial Sequence
  Description of Artificial Sequence: Synthetic peptide
  Seed: SICSSSTSL (MAGC1_HUMAN)
SACSSSTSL

SEQ ID NO: 81532 - protein, 10 aa, Artificial Sequence
  Description of Artificial Sequence: Synthetic peptide
  Seed: SSPERTHSTF (MAGC1_HUMAN)
SVPERTHSTL

SEQ ID NO: 81533 - protein, 9 aa, Artificial Sequence
  Description of Artificial Sequence: Synthetic peptide
  Seed: SSSSSSTLL (MAGC1_HUMAN)
SQSSSSTLF

SEQ ID NO: 81534 - protein, 9 aa, Artificial Sequence
  Description of Artificial Sequence: Synthetic peptide
  Seed: SSFFSSALL (MAGC1_HUMAN)
SMFFSSALY

SEQ ID NO: 81535 - protein, 10 aa, Artificial Sequence
  Description of Artificial Sequence: Synthetic peptide
  Seed: ASSSTLVSIF (MAGC1_HUMAN)
AQSSTLVSIY

SEQ ID NO: 81536 - protein, 10 aa, Artificial Sequence
  Description of Artificial Sequence: Synthetic peptide
  Seed: VISFSSSTSL (MAGC1_HUMAN)
VVSFSSSTSM

SEQ ID NO: 81537 - protein, 10 aa, Artificial Sequence
  Description of Artificial Sequence: Synthetic peptide
  Seed: SSPESAQSAF (MAGC1_HUMAN)
SMPESAQSAF

SEQ ID NO: 81538 - protein, 10 aa, Artificial Sequence
  Description of Artificial Sequence: Synthetic peptide
  Seed: LSQSSPVSSF (MAGC1_HUMAN)
LGQSSPVSSY

SEQ ID NO: 81539 - protein, 9 aa, Artificial Sequence
  Description of Artificial Sequence: Synthetic peptide
  Seed: FSSTLVSLF (MAGC1_HUMAN)
FHSTLVSLF

SEQ ID NO: 81540 - protein, 9 aa, Artificial Sequence
  Description of Artificial Sequence: Synthetic peptide
  Seed: STFEGFAQS (MAGC1_HUMAN)
SLFEGFAQF

SEQ ID NO: 81541 - protein, 11 aa, Artificial Sequence
  Description of Artificial Sequence: Synthetic peptide
  Seed: SRYTGYFPVIF (MAGC1_HUMAN)
SQYTGYFPVIM

SEQ ID NO: 81542 - protein, 9 aa, Artificial Sequence
  Description of Artificial Sequence: Synthetic peptide
  Seed: LQIPMTSSF (MAGC1_HUMAN)
LTIPMTSSM

SEQ ID NO: 81543 - protein, 9 aa, Artificial Sequence
  Description of Artificial Sequence: Synthetic peptide
  Seed: REVDPDDSY (MAGC1_HUMAN)
RLVDPDDSL

SEQ ID NO: 81544 - protein, 10 aa, Artificial Sequence
  Description of Artificial Sequence: Synthetic peptide
  Seed: YTLLSLFQSS (MAGC1_HUMAN)
YCLLSLFQSV

SEQ ID NO: 81545 - protein, 10 aa, Artificial Sequence
  Description of Artificial Sequence: Synthetic peptide
  Seed: SSFSYTLLSL (MAGC1_HUMAN)
SAFSYTLLSW

SEQ ID NO: 81546 - protein, 11 aa, Artificial Sequence
  Description of Artificial Sequence: Synthetic peptide
  Seed: SPLQIPVSSSS (MAGC1_HUMAN)
SNLQIPVSSSY

SEQ ID NO: 81547 - protein, 10 aa, Artificial Sequence
  Description of Artificial Sequence: Synthetic peptide
  Seed: ASSSTLVSIF (MAGC1_HUMAN)
AMSSTLVSIF

SEQ ID NO: 81548 - protein, 11 aa, Artificial Sequence
  Description of Artificial Sequence: Synthetic peptide
  Seed: FLWGPRAHSEV (MAGC1_HUMAN)
FLWGPRAHSEM

SEQ ID NO: 81549 - protein, 10 aa, Artificial Sequence
  Description of Artificial Sequence: Synthetic peptide
  Seed: VSSSFSYTLL (MAGC1_HUMAN)
VISSFSYTLY

SEQ ID NO: 81550 - protein, 8 aa, Artificial Sequence
  Description of Artificial Sequence: Synthetic peptide
  Seed: LQSPVSSF (MAGC1_HUMAN)
LQSPVSSI

SEQ ID NO: 81551 - protein, 9 aa, Artificial Sequence
  Description of Artificial Sequence: Synthetic peptide
  Seed: TLDEKVDEL (MAGC1_HUMAN)
TSDEKVDEI

SEQ ID NO: 81552 - protein, 9 aa, Artificial Sequence
  Description of Artificial Sequence: Synthetic peptide
  Seed: VSAASSSTL (MAGC1_HUMAN)
VRAASSSTY

SEQ ID NO: 81553 - protein, 11 aa, Artificial Sequence
  Description of Artificial Sequence: Synthetic peptide
  Seed: QSSPERTHSTF (MAGC1_HUMAN)
QISPERTHSTW

SEQ ID NO: 81554 - protein, 9 aa, Artificial Sequence
  Description of Artificial Sequence: Synthetic peptide
  Seed: FFSYTLASL (MAGC1_HUMAN)
FISYTLASY

SEQ ID NO: 81555 - protein, 10 aa, Artificial Sequence
  Description of Artificial Sequence: Synthetic peptide
  Seed: SSSSSTLLSL (MAGC1_HUMAN)
SLSSSTLLSY

SEQ ID NO: 81556 - protein, 10 aa, Artificial Sequence
  Description of Artificial Sequence: Synthetic peptide
  Seed: KGTYASEEVI (MAGC1_HUMAN)
KITYASEEVY

SEQ ID NO: 81557 - protein, 9 aa, Artificial Sequence
  Description of Artificial Sequence: Synthetic peptide
  Seed: RAGREHFAF (MAGC1_HUMAN)
RMGREHFAY

SEQ ID NO: 81558 - protein, 11 aa, Artificial Sequence
  Description of Artificial Sequence: Synthetic peptide
  Seed: SQSSPEGKDSL (MAGC1_HUMAN)
SASSPEGKDSY

SEQ ID NO: 81559 - protein, 9 aa, Artificial Sequence
  Description of Artificial Sequence: Synthetic peptide
  Seed: FPSSTSSSL (MAGC1_HUMAN)
FASSTSSSM

SEQ ID NO: 81560 - protein, 11 aa, Artificial Sequence
  Description of Artificial Sequence: Synthetic peptide
  Seed: SFFSSALLSIF (MAGC1_HUMAN)
SEFSSALLSIW

SEQ ID NO: 81561 - protein, 10 aa, Artificial Sequence
  Description of Artificial Sequence: Synthetic peptide
  Seed: WGPRAHSEVI (MAGC1_HUMAN)
WPPRAHSEVL

SEQ ID NO: 81562 - protein, 10 aa, Artificial Sequence
  Description of Artificial Sequence: Synthetic peptide
  Seed: FPQSPLQIPV (MAGC1_HUMAN)
FFQSPLQIPI

SEQ ID NO: 81563 - protein, 10 aa, Artificial Sequence
  Description of Artificial Sequence: Synthetic peptide
  Seed: MTSSFSSTLL (MAGC1_HUMAN)
MLSSFSSTLE

SEQ ID NO: 81564 - protein, 9 aa, Artificial Sequence
  Description of Artificial Sequence: Synthetic peptide
  Seed: VSPSSSSTL (MAGC1_HUMAN)
VAPSSSSTV

SEQ ID NO: 81565 - protein, 10 aa, Artificial Sequence
  Description of Artificial Sequence: Synthetic peptide
  Seed: SIIFIKGTYA (MAGC1_HUMAN)
SYIFIKGTYV

SEQ ID NO: 81566 - protein, 9 aa, Artificial Sequence
  Description of Artificial Sequence: Synthetic peptide
  Seed: IEILFGISL (MAGC1_HUMAN)
IKILFGISM

SEQ ID NO: 81567 - protein, 11 aa, Artificial Sequence
  Description of Artificial Sequence: Synthetic peptide
  Seed: LQRPVSSFFSY (MAGC1_HUMAN)
LYRPVSSFFSF

SEQ ID NO: 81568 - protein, 9 aa, Artificial Sequence
  Description of Artificial Sequence: Synthetic peptide
  Seed: MTSSFSSTL (MAGC1_HUMAN)
MASSFSSTW

SEQ ID NO: 81569 - protein, 9 aa, Artificial Sequence
  Description of Artificial Sequence: Synthetic peptide
  Seed: SSPESAQSA (MAGC1_HUMAN)
SPPESAQSA

SEQ ID NO: 81570 - protein, 9 aa, Artificial Sequence
  Description of Artificial Sequence: Synthetic peptide
  Seed: TLDEKVDEL (MAGC1_HUMAN)
TTDEKVDEV

SEQ ID NO: 81571 - protein, 11 aa, Artificial Sequence
  Description of Artificial Sequence: Synthetic peptide
  Seed: SSSSSSTLLSL (MAGC1_HUMAN)
SPSSSSTLLSA

SEQ ID NO: 81572 - protein, 11 aa, Artificial Sequence
  Description of Artificial Sequence: Synthetic peptide
  Seed: SEESSSPVDEY (MAGC1_HUMAN)
SAESSSPVDEY

SEQ ID NO: 81573 - protein, 9 aa, Artificial Sequence
  Description of Artificial Sequence: Synthetic peptide
  Seed: TLDEKVDEL (MAGC1_HUMAN)
TTDEKVDEL

SEQ ID NO: 81574 - protein, 11 aa, Artificial Sequence
  Description of Artificial Sequence: Synthetic peptide
  Seed: TVPITFPSSYK (MAGC1_HUMAN)
THPITFPSSYR

SEQ ID NO: 81575 - protein, 10 aa, Artificial Sequence
  Description of Artificial Sequence: Synthetic peptide
  Seed: FPQSVLQIPV (MAGC1_HUMAN)
FIQSVLQIPV

SEQ ID NO: 81576 - protein, 9 aa, Artificial Sequence
  Description of Artificial Sequence: Synthetic peptide
  Seed: FSYTLLSLF (MAGC1_HUMAN)
FWYTLLSLY

SEQ ID NO: 81577 - protein, 8 aa, Artificial Sequence
  Description of Artificial Sequence: Synthetic peptide
  Seed: LQNPASSF (MAGC1_HUMAN)
LKNPASSF

SEQ ID NO: 81578 - protein, 9 aa, Artificial Sequence
  Description of Artificial Sequence: Synthetic peptide
  Seed: STFEGFAQS (MAGC1_HUMAN)
SIFEGFAQL

SEQ ID NO: 81579 - protein, 10 aa, Artificial Sequence
  Description of Artificial Sequence: Synthetic peptide
  Seed: SSPERTHSTF (MAGC1_HUMAN)
SFPERTHSTL

SEQ ID NO: 81580 - protein, 11 aa, Artificial Sequence
  Description of Artificial Sequence: Synthetic peptide
  Seed: TTDDSTATESA (MAGC1_HUMAN)
TIDDSTATESF

SEQ ID NO: 81581 - protein, 10 aa, Artificial Sequence
  Description of Artificial Sequence: Synthetic peptide
  Seed: YASEEVIWDV (MAGC1_HUMAN)
YISEEVIWDI

SEQ ID NO: 81582 - protein, 11 aa, Artificial Sequence
  Description of Artificial Sequence: Synthetic peptide
  Seed: SPLQIPVSSSS (MAGC1_HUMAN)
SCLQIPVSSSF

SEQ ID NO: 81583 - protein, 9 aa, Artificial Sequence
  Description of Artificial Sequence: Synthetic peptide
  Seed: TLDLTSEGC (MAGC1_HUMAN)
TTDLTSEGM

SEQ ID NO: 81584 - protein, 10 aa, Artificial Sequence
  Description of Artificial Sequence: Synthetic peptide
  Seed: SSPERTHSTF (MAGC1_HUMAN)
SRPERTHSTM

SEQ ID NO: 81585 - protein, 9 aa, Artificial Sequence
  Description of Artificial Sequence: Synthetic peptide
  Seed: FEGFPQSVL (MAGC1_HUMAN)
FVGFPQSVF

SEQ ID NO: 81586 - protein, 10 aa, Artificial Sequence
  Description of Artificial Sequence: Synthetic peptide
  Seed: VSRSFSSTLL (MAGC1_HUMAN)
VSRSFSSTLW

SEQ ID NO: 81587 - protein, 9 aa, Artificial Sequence
  Description of Artificial Sequence: Synthetic peptide
  Seed: RTHSTFEGF (MAGC1_HUMAN)
RAHSTFEGL

SEQ ID NO: 81588 - protein, 9 aa, Artificial Sequence
  Description of Artificial Sequence: Synthetic peptide
  Seed: VSSSSSSTL (MAGC1_HUMAN)
VQSSSSSTM

SEQ ID NO: 81589 - protein, 10 aa, Artificial Sequence
  Description of Artificial Sequence: Synthetic peptide
  Seed: LQIPVSSSFS (MAGC1_HUMAN)
LMIPVSSSFY

SEQ ID NO: 81590 - protein, 9 aa, Artificial Sequence
  Description of Artificial Sequence: Synthetic peptide
  Seed: LQRPVSSFF (MAGC1_HUMAN)
LARPVSSFK

SEQ ID NO: 81591 - protein, 10 aa, Artificial Sequence
  Description of Artificial Sequence: Synthetic peptide
  Seed: QIPVSSSFSY (MAGC1_HUMAN)
QFPVSSSFSY

SEQ ID NO: 81592 - protein, 10 aa, Artificial Sequence
  Description of Artificial Sequence: Synthetic peptide
  Seed: SLQIPVSPSF (MAGC1_HUMAN)
SQQIPVSPSY

SEQ ID NO: 81593 - protein, 11 aa, Artificial Sequence
  Description of Artificial Sequence: Synthetic peptide
  Seed: STFEGFPQSLL (MAGC1_HUMAN)
SLFEGFPQSLY

SEQ ID NO: 81594 - protein, 9 aa, Artificial Sequence
  Description of Artificial Sequence: Synthetic peptide
  Seed: VSPSSSSTL (MAGC1_HUMAN)
VAPSSSSTF

SEQ ID NO: 81595 - protein, 9 aa, Artificial Sequence
  Description of Artificial Sequence: Synthetic peptide
  Seed: VIKRKVVEF (MAGC1_HUMAN)
VFKRKVVEL

SEQ ID NO: 81596 - protein, 9 aa, Artificial Sequence
  Description of Artificial Sequence: Synthetic peptide
  Seed: KVWVQEHYL (MAGC1_HUMAN)
KQWVQEHYL

SEQ ID NO: 81597 - protein, 10 aa, Artificial Sequence
  Description of Artificial Sequence: Synthetic peptide
  Seed: MLKNTVPITF (MAGC1_HUMAN)
MPKNTVPITF

SEQ ID NO: 81598 - protein, 9 aa, Artificial Sequence
  Description of Artificial Sequence: Synthetic peptide
  Seed: VQSPLHSPQ (MAGC1_HUMAN)
VASPLHSPY

SEQ ID NO: 81599 - protein, 9 aa, Artificial Sequence
  Description of Artificial Sequence: Synthetic peptide
  Seed: MPSLLQSSS (MAGC1_HUMAN)
MMSLLQSSY

SEQ ID NO: 81600 - protein, 9 aa, Artificial Sequence
  Description of Artificial Sequence: Synthetic peptide
  Seed: VSSSFSYTL (MAGC1_HUMAN)
VVSSFSYTF

SEQ ID NO: 81601 - protein, 11 aa, Artificial Sequence
  Description of Artificial Sequence: Synthetic peptide
  Seed: SLREVDPDDSY (MAGC1_HUMAN)
SQREVDPDDSF

SEQ ID NO: 81602 - protein, 10 aa, Artificial Sequence
  Description of Artificial Sequence: Synthetic peptide
  Seed: FFSYTLASLL (MAGC1_HUMAN)
FLSYTLASLT

SEQ ID NO: 81603 - protein, 10 aa, Artificial Sequence
  Description of Artificial Sequence: Synthetic peptide
  Seed: KVDELARFLL (MAGC1_HUMAN)
KQDELARFLL

SEQ ID NO: 81604 - protein, 10 aa, Artificial Sequence
  Description of Artificial Sequence: Synthetic peptide
  Seed: MSQNRLLILI (MAGC1_HUMAN)
MTQNRLLILW

SEQ ID NO: 81605 - protein, 9 aa, Artificial Sequence
  Description of Artificial Sequence: Synthetic peptide
  Seed: STFEGFPQS (MAGC1_HUMAN)
SGFEGFPQY

SEQ ID NO: 81606 - protein, 10 aa, Artificial Sequence
  Description of Artificial Sequence: Synthetic peptide
  Seed: SQSSPVSSFP (MAGC1_HUMAN)
SQSSPVSSFW

SEQ ID NO: 81607 - protein, 10 aa, Artificial Sequence
  Description of Artificial Sequence: Synthetic peptide
  Seed: LQIPVSPSFS (MAGC1_HUMAN)
LMIPVSPSFH

SEQ ID NO: 81608 - protein, 9 aa, Artificial Sequence
  Description of Artificial Sequence: Synthetic peptide
  Seed: FSYTLLSLF (MAGC1_HUMAN)
FHYTLLSLF

SEQ ID NO: 81609 - protein, 9 aa, Artificial Sequence
  Description of Artificial Sequence: Synthetic peptide
  Seed: KVWVQEHYL (MAGC1_HUMAN)
KIWVQEHYV

SEQ ID NO: 81610 - protein, 9 aa, Artificial Sequence
  Description of Artificial Sequence: Synthetic peptide
  Seed: SSPEGKDSL (MAGC1_HUMAN)
SFPEGKDSY

SEQ ID NO: 81611 - protein, 9 aa, Artificial Sequence
  Description of Artificial Sequence: Synthetic peptide
  Seed: SSFFSYTLA (MAGC1_HUMAN)
SIFFSYTLV

SEQ ID NO: 81612 - protein, 10 aa, Artificial Sequence
  Description of Artificial Sequence: Synthetic peptide
  Seed: ATESASSSVM (MAGC1_HUMAN)
ACESASSSVW

SEQ ID NO: 81613 - protein, 10 aa, Artificial Sequence
  Description of Artificial Sequence: Synthetic peptide
  Seed: KRKVVEFLAM (MAGC1_HUMAN)
KLKVVEFLAF

SEQ ID NO: 81614 - protein, 9 aa, Artificial Sequence
  Description of Artificial Sequence: Synthetic peptide
  Seed: FSYTLASLL (MAGC1_HUMAN)
FYYTLASLL

SEQ ID NO: 81615 - protein, 11 aa, Artificial Sequence
  Description of Artificial Sequence: Synthetic peptide
  Seed: SRYTGYFPVIF (MAGC1_HUMAN)
SRYTGYFPVIL

SEQ ID NO: 81616 - protein, 9 aa, Artificial Sequence
  Description of Artificial Sequence: Synthetic peptide
  Seed: ASSSVMSPS (MAGC1_HUMAN)
ATSSVMSPK

SEQ ID NO: 81617 - protein, 9 aa, Artificial Sequence
  Description of Artificial Sequence: Synthetic peptide
  Seed: YPLQSPQSR (MAGC1_HUMAN)
YPLQSPQSL

SEQ ID NO: 81618 - protein, 9 aa, Artificial Sequence
  Description of Artificial Sequence: Synthetic peptide
  Seed: SSSTSLSPF (MAGC1_HUMAN)
SKSTSLSPL

SEQ ID NO: 81619 - protein, 11 aa, Artificial Sequence
  Description of Artificial Sequence: Synthetic peptide
  Seed: STFEGFAQSPL (MAGC1_HUMAN)
SIFEGFAQSPA

SEQ ID NO: 81620 - protein, 9 aa, Artificial Sequence
  Description of Artificial Sequence: Synthetic peptide
  Seed: TFEGFPQSL (MAGC1_HUMAN)
TIEGFPQSI

SEQ ID NO: 81621 - protein, 10 aa, Artificial Sequence
  Description of Artificial Sequence: Synthetic peptide
  Seed: SSPESAQSTF (MAGC1_HUMAN)
SLPESAQSTY

SEQ ID NO: 81622 - protein, 9 aa, Artificial Sequence
  Description of Artificial Sequence: Synthetic peptide
  Seed: RKVVEFLAM (MAGC1_HUMAN)
RHVVEFLAF

SEQ ID NO: 81623 - protein, 11 aa, Artificial Sequence
  Description of Artificial Sequence: Synthetic peptide
  Seed: IPVSAASSSTL (MAGC1_HUMAN)
IDVSAASSSTY

SEQ ID NO: 81624 - protein, 9 aa, Artificial Sequence
  Description of Artificial Sequence: Synthetic peptide
  Seed: VIWDVLSGI (MAGC1_HUMAN)
VQWDVLSGL

SEQ ID NO: 81625 - protein, 9 aa, Artificial Sequence
  Description of Artificial Sequence: Synthetic peptide
  Seed: CSSSTSLSL (MAGC1_HUMAN)
CVSSTSLSF

SEQ ID NO: 81626 - protein, 9 aa, Artificial Sequence
  Description of Artificial Sequence: Synthetic peptide
  Seed: SPESAQSTF (MAGC1_HUMAN)
SLESAQSTF

SEQ ID NO: 81627 - protein, 10 aa, Artificial Sequence
  Description of Artificial Sequence: Synthetic peptide
  Seed: WGPRAHSEVI (MAGC1_HUMAN)
WVPRAHSEVL

SEQ ID NO: 81628 - protein, 9 aa, Artificial Sequence
  Description of Artificial Sequence: Synthetic peptide
  Seed: FQSSLQSPV (MAGC1_HUMAN)
FASSLQSPY

SEQ ID NO: 81629 - protein, 10 aa, Artificial Sequence
  Description of Artificial Sequence: Synthetic peptide
  Seed: FPQSLLQIPM (MAGC1_HUMAN)
FVQSLLQIPA

SEQ ID NO: 81630 - protein, 10 aa, Artificial Sequence
  Description of Artificial Sequence: Synthetic peptide
  Seed: SSPESAQSTF (MAGC1_HUMAN)
SMPESAQSTY

SEQ ID NO: 81631 - protein, 9 aa, Artificial Sequence
  Description of Artificial Sequence: Synthetic peptide
  Seed: FSYTLLSLF (MAGC1_HUMAN)
FTYTLLSLL

SEQ ID NO: 81632 - protein, 9 aa, Artificial Sequence
  Description of Artificial Sequence: Synthetic peptide
  Seed: TLDEKVDEL (MAGC1_HUMAN)
TNDEKVDEV

SEQ ID NO: 81633 - protein, 10 aa, Artificial Sequence
  Description of Artificial Sequence: Synthetic peptide
  Seed: SLQIPVSPSF (MAGC1_HUMAN)
SAQIPVSPSM

SEQ ID NO: 81634 - protein, 9 aa, Artificial Sequence
  Description of Artificial Sequence: Synthetic peptide
  Seed: FSSTLVSLF (MAGC1_HUMAN)
FPSTLVSLA

SEQ ID NO: 81635 - protein, 9 aa, Artificial Sequence
  Description of Artificial Sequence: Synthetic peptide
  Seed: TLDEKVDEL (MAGC1_HUMAN)
TEDEKVDEM

SEQ ID NO: 81636 - protein, 10 aa, Artificial Sequence
  Description of Artificial Sequence: Synthetic peptide
  Seed: ILFGISLREV (MAGC1_HUMAN)
IMFGISLREM

SEQ ID NO: 81637 - protein, 11 aa, Artificial Sequence
  Description of Artificial Sequence: Synthetic peptide
  Seed: SFFSYTLASLL (MAGC1_HUMAN)
SCFSYTLASLY

SEQ ID NO: 81638 - protein, 11 aa, Artificial Sequence
  Description of Artificial Sequence: Synthetic peptide
  Seed: SSTSLSLPQSF (MAGC1_HUMAN)
SDTSLSLPQSW

SEQ ID NO: 81639 - protein, 10 aa, Artificial Sequence
  Description of Artificial Sequence: Synthetic peptide
  Seed: SLFQSFSERT (MAGC1_HUMAN)
SIFQSFSERI

SEQ ID NO: 81640 - protein, 9 aa, Artificial Sequence
  Description of Artificial Sequence: Synthetic peptide
  Seed: KVWVQEHYL (MAGC1_HUMAN)
KAWVQEHYF

SEQ ID NO: 81641 - protein, 9 aa, Artificial Sequence
  Description of Artificial Sequence: Synthetic peptide
  Seed: SFSYTLLSL (MAGC1_HUMAN)
SSSYTLLSF

SEQ ID NO: 81642 - protein, 9 aa, Artificial Sequence
  Description of Artificial Sequence: Synthetic peptide
  Seed: TFEGFPQSL (MAGC1_HUMAN)
TSEGFPQSI

SEQ ID NO: 81643 - protein, 9 aa, Artificial Sequence
  Description of Artificial Sequence: Synthetic peptide
  Seed: TLDLTSEGC (MAGC1_HUMAN)
TVDLTSEGI

SEQ ID NO: 81644 - protein, 9 aa, Artificial Sequence
  Description of Artificial Sequence: Synthetic peptide
  Seed: FSSTLLSIL (MAGC1_HUMAN)
FLSTLLSIM

SEQ ID NO: 81645 - protein, 11 aa, Artificial Sequence
  Description of Artificial Sequence: Synthetic peptide
  Seed: NTVPITFPSSY (MAGC1_HUMAN)
NAVPITFPSSY

SEQ ID NO: 81646 - protein, 11 aa, Artificial Sequence
  Description of Artificial Sequence: Synthetic peptide
  Seed: SSFPSSTSSSL (MAGC1_HUMAN)
SEFPSSTSSSL

SEQ ID NO: 81647 - protein, 9 aa, Artificial Sequence
  Description of Artificial Sequence: Synthetic peptide
  Seed: SSFFSSALL (MAGC1_HUMAN)
SWFFSSALF

SEQ ID NO: 81648 - protein, 9 aa, Artificial Sequence
  Description of Artificial Sequence: Synthetic peptide
  Seed: SSSDTLLES (MAGC1_HUMAN)
SVSDTLLEI

SEQ ID NO: 81649 - protein, 10 aa, Artificial Sequence
  Description of Artificial Sequence: Synthetic peptide
  Seed: TTDDSTATES (MAGC1_HUMAN)
TNDDSTATEM

SEQ ID NO: 81650 - protein, 9 aa, Artificial Sequence
  Description of Artificial Sequence: Synthetic peptide
  Seed: SFFSYTLAS (MAGC1_HUMAN)
SHFSYTLAF

SEQ ID NO: 81651 - protein, 9 aa, Artificial Sequence
  Description of Artificial Sequence: Synthetic peptide
  Seed: NTVPITFPS (MAGC1_HUMAN)
NCVPITFPV

SEQ ID NO: 81652 - protein, 10 aa, Artificial Sequence
  Description of Artificial Sequence: Synthetic peptide
  Seed: IIDTTDDSTA (MAGC1_HUMAN)
ISDTTDDSTI

SEQ ID NO: 81653 - protein, 9 aa, Artificial Sequence
  Description of Artificial Sequence: Synthetic peptide
  Seed: SPLQIVPSL (MAGC1_HUMAN)
SSLQIVPSM

SEQ ID NO: 81654 - protein, 9 aa, Artificial Sequence
  Description of Artificial Sequence: Synthetic peptide
  Seed: MLTNVISRY (MAGC1_HUMAN)
MMTNVISRM

SEQ ID NO: 81655 - protein, 10 aa, Artificial Sequence
  Description of Artificial Sequence: Synthetic peptide
  Seed: PLQIPMTSSF (MAGC1_HUMAN)
PAQIPMTSSY

SEQ ID NO: 81656 - protein, 9 aa, Artificial Sequence
  Description of Artificial Sequence: Synthetic peptide
  Seed: SRYTGYFPV (MAGC1_HUMAN)
SQYTGYFPY

SEQ ID NO: 81657 - protein, 9 aa, Artificial Sequence
  Description of Artificial Sequence: Synthetic peptide
  Seed: SSPERTQST (MAGC1_HUMAN)
SVPERTQSM

SEQ ID NO: 81658 - protein, 9 aa, Artificial Sequence
  Description of Artificial Sequence: Synthetic peptide
  Seed: FSSTLLSIL (MAGC1_HUMAN)
FVSTLLSIF

SEQ ID NO: 81659 - protein, 10 aa, Artificial Sequence
  Description of Artificial Sequence: Synthetic peptide
  Seed: FPESPQSPPE (MAGC1_HUMAN)
FPESPQSPPA

SEQ ID NO: 81660 - protein, 9 aa, Artificial Sequence
  Description of Artificial Sequence: Synthetic peptide
  Seed: SICSSSTSL (MAGC1_HUMAN)
SFCSSSTSL

SEQ ID NO: 81661 - protein, 9 aa, Artificial Sequence
  Description of Artificial Sequence: Synthetic peptide
  Seed: FSSTLLSIL (MAGC1_HUMAN)
FFSTLLSIY

SEQ ID NO: 81662 - protein, 9 aa, Artificial Sequence
  Description of Artificial Sequence: Synthetic peptide
  Seed: MPTAGMPSL (MAGC1_HUMAN)
MNTAGMPSY

SEQ ID NO: 81663 - protein, 9 aa, Artificial Sequence
  Description of Artificial Sequence: Synthetic peptide
  Seed: SLIESEPLF (MAGC1_HUMAN)
SMIESEPLY

SEQ ID NO: 81664 - protein, 9 aa, Artificial Sequence
  Description of Artificial Sequence: Synthetic peptide
  Seed: ASSSTLVSI (MAGC1_HUMAN)
AFSSTLVSY

SEQ ID NO: 81665 - protein, 10 aa, Artificial Sequence
  Description of Artificial Sequence: Synthetic peptide
  Seed: FPSSYKDALK (MAGC1_HUMAN)
FGSSYKDALR

SEQ ID NO: 81666 - protein, 10 aa, Artificial Sequence
  Description of Artificial Sequence: Synthetic peptide
  Seed: SSFSYTLLSL (MAGC1_HUMAN)
SGFSYTLLSW

SEQ ID NO: 81667 - protein, 9 aa, Artificial Sequence
  Description of Artificial Sequence: Synthetic peptide
  Seed: MPTAGMPSL (MAGC1_HUMAN)
MITAGMPSF

SEQ ID NO: 81668 - protein, 9 aa, Artificial Sequence
  Description of Artificial Sequence: Synthetic peptide
  Seed: IPVSSSFSY (MAGC1_HUMAN)
IFVSSSFSF

SEQ ID NO: 81669 - protein, 9 aa, Artificial Sequence
  Description of Artificial Sequence: Synthetic peptide
  Seed: LILSIIFIK (MAGC1_HUMAN)
LYLSIIFIK

SEQ ID NO: 81670 - protein, 9 aa, Artificial Sequence
  Description of Artificial Sequence: Synthetic peptide
  Seed: VSSSFSYTL (MAGC1_HUMAN)
VLSSFSYTI

SEQ ID NO: 81671 - protein, 9 aa, Artificial Sequence
  Description of Artificial Sequence: Synthetic peptide
  Seed: FPSSTSSSL (MAGC1_HUMAN)
FYSSTSSSF

SEQ ID NO: 81672 - protein, 10 aa, Artificial Sequence
  Description of Artificial Sequence: Synthetic peptide
  Seed: FPQSLLQIPM (MAGC1_HUMAN)
FTQSLLQIPI

SEQ ID NO: 81673 - protein, 9 aa, Artificial Sequence
  Description of Artificial Sequence: Synthetic peptide
  Seed: SASSSVMSP (MAGC1_HUMAN)
SLSSSVMSY

SEQ ID NO: 81674 - protein, 10 aa, Artificial Sequence
  Description of Artificial Sequence: Synthetic peptide
  Seed: TTDDSTATES (MAGC1_HUMAN)
TYDDSTATEL

SEQ ID NO: 81675 - protein, 11 aa, Artificial Sequence
  Description of Artificial Sequence: Synthetic peptide
  Seed: LQRPVSSFFSY (MAGC1_HUMAN)
LCRPVSSFFSY

SEQ ID NO: 81676 - protein, 10 aa, Artificial Sequence
  Description of Artificial Sequence: Synthetic peptide
  Seed: MTSSFSSTLL (MAGC1_HUMAN)
MESSFSSTLY

SEQ ID NO: 81677 - protein, 11 aa, Artificial Sequence
  Description of Artificial Sequence: Synthetic peptide
  Seed: SPLQIPMTSSF (MAGC1_HUMAN)
SLLQIPMTSSY

SEQ ID NO: 81678 - protein, 10 aa, Artificial Sequence
  Description of Artificial Sequence: Synthetic peptide
  Seed: KVDELARFLL (MAGC1_HUMAN)
KSDELARFLF

SEQ ID NO: 81679 - protein, 9 aa, Artificial Sequence
  Description of Artificial Sequence: Synthetic peptide
  Seed: SLSPHYFPQ (MAGC1_HUMAN)
SLSPHYFPY

SEQ ID NO: 81680 - protein, 11 aa, Artificial Sequence
  Description of Artificial Sequence: Synthetic peptide
  Seed: SPQSPPEGPAQ (MAGC1_HUMAN)
SPQSPPEGPAI

SEQ ID NO: 81681 - protein, 9 aa, Artificial Sequence
  Description of Artificial Sequence: Synthetic peptide
  Seed: RAHSEVIKR (MAGC1_HUMAN)
RAHSEVIKY

SEQ ID NO: 81682 - protein, 10 aa, Artificial Sequence
  Description of Artificial Sequence: Synthetic peptide
  Seed: REVDPDDSYV (MAGC1_HUMAN)
RLVDPDDSYM

SEQ ID NO: 81683 - protein, 9 aa, Artificial Sequence
  Description of Artificial Sequence: Synthetic peptide
  Seed: SQNRLLILI (MAGC1_HUMAN)
SMNRLLILV

SEQ ID NO: 81684 - protein, 9 aa, Artificial Sequence
  Description of Artificial Sequence: Synthetic peptide
  Seed: SFSSTLVSL (MAGC1_HUMAN)
STSSTLVSV

SEQ ID NO: 81685 - protein, 9 aa, Artificial Sequence
  Description of Artificial Sequence: Synthetic peptide
  Seed: SSPEGKDSL (MAGC1_HUMAN)
SSPEGKDSI

SEQ ID NO: 81686 - protein, 10 aa, Artificial Sequence
  Description of Artificial Sequence: Synthetic peptide
  Seed: FSSSTSLSPF (MAGC1_HUMAN)
FKSSTSLSPL

SEQ ID NO: 81687 - protein, 9 aa, Artificial Sequence
  Description of Artificial Sequence: Synthetic peptide
  Seed: KAREFIEIL (MAGC1_HUMAN)
KIREFIEIY

SEQ ID NO: 81688 - protein, 11 aa, Artificial Sequence
  Description of Artificial Sequence: Synthetic peptide
  Seed: RYTGYFPVIFR (MAGC1_HUMAN)
RSTGYFPVIFR

SEQ ID NO: 81689 - protein, 10 aa, Artificial Sequence
  Description of Artificial Sequence: Synthetic peptide
  Seed: QIPVSSSFSY (MAGC1_HUMAN)
QWPVSSSFSM

SEQ ID NO: 81690 - protein, 9 aa, Artificial Sequence
  Description of Artificial Sequence: Synthetic peptide
  Seed: EFIEILFGI (MAGC1_HUMAN)
EYIEILFGL

SEQ ID NO: 81691 - protein, 9 aa, Artificial Sequence
  Description of Artificial Sequence: Synthetic peptide
  Seed: GEDVQSPLQ (MAGC1_HUMAN)
GEDVQSPLA

SEQ ID NO: 81692 - protein, 9 aa, Artificial Sequence
  Description of Artificial Sequence: Synthetic peptide
  Seed: TTDDSTATE (MAGC1_HUMAN)
TYDDSTATV

SEQ ID NO: 81693 - protein, 9 aa, Artificial Sequence
  Description of Artificial Sequence: Synthetic peptide
  Seed: FAFGEPREL (MAGC1_HUMAN)
FAFGEPREM

SEQ ID NO: 81694 - protein, 10 aa, Artificial Sequence
  Description of Artificial Sequence: Synthetic peptide
  Seed: KAREFIEILF (MAGC1_HUMAN)
KSREFIEILS

SEQ ID NO: 81695 - protein, 8 aa, Artificial Sequence
  Description of Artificial Sequence: Synthetic peptide
  Seed: RSFSSTLL (MAGC1_HUMAN)
RSFSSTLW

SEQ ID NO: 81696 - protein, 9 aa, Artificial Sequence
  Description of Artificial Sequence: Synthetic peptide
  Seed: FAQSPLQIP (MAGC1_HUMAN)
FAQSPLQIY

SEQ ID NO: 81697 - protein, 9 aa, Artificial Sequence
  Description of Artificial Sequence: Synthetic peptide
  Seed: SQSPPEGPV (MAGC1_HUMAN)
SESPPEGPC

SEQ ID NO: 81698 - protein, 9 aa, Artificial Sequence
  Description of Artificial Sequence: Synthetic peptide
  Seed: NTVPITFPS (MAGC1_HUMAN)
NAVPITFPY

SEQ ID NO: 81699 - protein, 10 aa, Artificial Sequence
  Description of Artificial Sequence: Synthetic peptide
  Seed: SPLQSPVSSF (MAGC1_HUMAN)
SLLQSPVSSF

SEQ ID NO: 81700 - protein, 9 aa, Artificial Sequence
  Description of Artificial Sequence: Synthetic peptide
  Seed: SPLQIPMTS (MAGC1_HUMAN)
SMLQIPMTT

SEQ ID NO: 81701 - protein, 10 aa, Artificial Sequence
  Description of Artificial Sequence: Synthetic peptide
  Seed: TGYFPVIFRK (MAGC1_HUMAN)
TVYFPVIFRY

SEQ ID NO: 81702 - protein, 10 aa, Artificial Sequence
  Description of Artificial Sequence: Synthetic peptide
  Seed: FPQSLLQIPM (MAGC1_HUMAN)
FCQSLLQIPF

SEQ ID NO: 81703 - protein, 9 aa, Artificial Sequence
  Description of Artificial Sequence: Synthetic peptide
  Seed: IKRKVVEFL (MAGC1_HUMAN)
IKRKVVEFY

SEQ ID NO: 81704 - protein, 9 aa, Artificial Sequence
  Description of Artificial Sequence: Synthetic peptide
  Seed: ELARFLLLK (MAGC1_HUMAN)
EIARFLLLK

SEQ ID NO: 81705 - protein, 9 aa, Artificial Sequence
  Description of Artificial Sequence: Synthetic peptide
  Seed: LQIPVSRSF (MAGC1_HUMAN)
LWIPVSRSW

SEQ ID NO: 81706 - protein, 10 aa, Artificial Sequence
  Description of Artificial Sequence: Synthetic peptide
  Seed: YTLASLLQSS (MAGC1_HUMAN)
YPLASLLQSA

SEQ ID NO: 81707 - protein, 10 aa, Artificial Sequence
  Description of Artificial Sequence: Synthetic peptide
  Seed: SSSSSTLLSL (MAGC1_HUMAN)
SLSSSTLLSL

SEQ ID NO: 81708 - protein, 9 aa, Artificial Sequence
  Description of Artificial Sequence: Synthetic peptide
  Seed: FSSTLVSLF (MAGC1_HUMAN)
FTSTLVSLW

SEQ ID NO: 81709 - protein, 9 aa, Artificial Sequence
  Description of Artificial Sequence: Synthetic peptide
  Seed: SSHESPQSP (MAGC1_HUMAN)
SSHESPQSF

SEQ ID NO: 81710 - protein, 9 aa, Artificial Sequence
  Description of Artificial Sequence: Synthetic peptide
  Seed: SSHESPQSP (MAGC1_HUMAN)
SAHESPQSI

SEQ ID NO: 81711 - protein, 9 aa, Artificial Sequence
  Description of Artificial Sequence: Synthetic peptide
  Seed: MGDKDMPTA (MAGC1_HUMAN)
MIDKDMPTM

SEQ ID NO: 81712 - protein, 10 aa, Artificial Sequence
  Description of Artificial Sequence: Synthetic peptide
  Seed: SFFSYTLASL (MAGC1_HUMAN)
SRFSYTLASM

SEQ ID NO: 81713 - protein, 9 aa, Artificial Sequence
  Description of Artificial Sequence: Synthetic peptide
  Seed: IEILFGISL (MAGC1_HUMAN)
IHILFGISI

SEQ ID NO: 81714 - protein, 9 aa, Artificial Sequence
  Description of Artificial Sequence: Synthetic peptide
  Seed: KDSQSPLQI (MAGC1_HUMAN)
KESQSPLQF

SEQ ID NO: 81715 - protein, 9 aa, Artificial Sequence
  Description of Artificial Sequence: Synthetic peptide
  Seed: RSFSSTLLS (MAGC1_HUMAN)
RMFSSTLLL

SEQ ID NO: 81716 - protein, 11 aa, Artificial Sequence
  Description of Artificial Sequence: Synthetic peptide
  Seed: FLWGPRAHSEV (MAGC1_HUMAN)
FMWGPRAHSEL

SEQ ID NO: 81717 - protein, 9 aa, Artificial Sequence
  Description of Artificial Sequence: Synthetic peptide
  Seed: SQNRLLILI (MAGC1_HUMAN)
SVNRLLILL

SEQ ID NO: 81718 - protein, 9 aa, Artificial Sequence
  Description of Artificial Sequence: Synthetic peptide
  Seed: LQIPVSRSF (MAGC1_HUMAN)
LPIPVSRSM

SEQ ID NO: 81719 - protein, 9 aa, Artificial Sequence
  Description of Artificial Sequence: Synthetic peptide
  Seed: GFPQSLLQI (MAGC1_HUMAN)
GAPQSLLQM

SEQ ID NO: 81720 - protein, 10 aa, Artificial Sequence
  Description of Artificial Sequence: Synthetic peptide
  Seed: VISFSSSTSL (MAGC1_HUMAN)
VSSFSSSTSM

SEQ ID NO: 81721 - protein, 10 aa, Artificial Sequence
  Description of Artificial Sequence: Synthetic peptide
  Seed: SSFSSTLLSI (MAGC1_HUMAN)
SLFSSTLLSC

SEQ ID NO: 81722 - protein, 9 aa, Artificial Sequence
  Description of Artificial Sequence: Synthetic peptide
  Seed: SAQSTFEGF (MAGC1_HUMAN)
SVQSTFEGY

SEQ ID NO: 81723 - protein, 9 aa, Artificial Sequence
  Description of Artificial Sequence: Synthetic peptide
  Seed: IESEPLFTY (MAGC1_HUMAN)
ISSEPLFTM

SEQ ID NO: 81724 - protein, 9 aa, Artificial Sequence
  Description of Artificial Sequence: Synthetic peptide
  Seed: SSPPRYEFL (MAGC1_HUMAN)
SLPPRYEFW

SEQ ID NO: 81725 - protein, 11 aa, Artificial Sequence
  Description of Artificial Sequence: Synthetic peptide
  Seed: SSTPSSLPQSF (MAGC1_HUMAN)
SITPSSLPQSW

SEQ ID NO: 81726 - protein, 9 aa, Artificial Sequence
  Description of Artificial Sequence: Synthetic peptide
  Seed: SSFPSSTSS (MAGC1_HUMAN)
SLFPSSTSY

SEQ ID NO: 81727 - protein, 9 aa, Artificial Sequence
  Description of Artificial Sequence: Synthetic peptide
  Seed: ASSFFSSAL (MAGC1_HUMAN)
AKSFFSSAV

SEQ ID NO: 81728 - protein, 9 aa, Artificial Sequence
  Description of Artificial Sequence: Synthetic peptide
  Seed: VSRSFSSTL (MAGC1_HUMAN)
VGRSFSSTW

SEQ ID NO: 81729 - protein, 9 aa, Artificial Sequence
  Description of Artificial Sequence: Synthetic peptide
  Seed: SLFQSFSER (MAGC1_HUMAN)
SQFQSFSEK

SEQ ID NO: 81730 - protein, 9 aa, Artificial Sequence
  Description of Artificial Sequence: Synthetic peptide
  Seed: TLASLLQSS (MAGC1_HUMAN)
TLASLLQSL

SEQ ID NO: 81731 - protein, 9 aa, Artificial Sequence
  Description of Artificial Sequence: Synthetic peptide
  Seed: LKNTVPITF (MAGC1_HUMAN)
LWNTVPITM

SEQ ID NO: 81732 - protein, 9 aa, Artificial Sequence
  Description of Artificial Sequence: Synthetic peptide
  Seed: TTDDSTATE (MAGC1_HUMAN)
TFDDSTATC

SEQ ID NO: 81733 - protein, 9 aa, Artificial Sequence
  Description of Artificial Sequence: Synthetic peptide
  Seed: TLVSIFQSS (MAGC1_HUMAN)
TVVSIFQSA

SEQ ID NO: 81734 - protein, 11 aa, Artificial Sequence
  Description of Artificial Sequence: Synthetic peptide
  Seed: IIDTTDDSTAT (MAGC1_HUMAN)
ILDTTDDSTAL

SEQ ID NO: 81735 - protein, 11 aa, Artificial Sequence
  Description of Artificial Sequence: Synthetic peptide
  Seed: SLSQSSPVSSF (MAGC1_HUMAN)
SRSQSSPVSSY

SEQ ID NO: 81736 - protein, 10 aa, Artificial Sequence
  Description of Artificial Sequence: Synthetic peptide
  Seed: ESAQSAFEGF (MAGC1_HUMAN)
EIAQSAFEGF

SEQ ID NO: 81737 - protein, 10 aa, Artificial Sequence
  Description of Artificial Sequence: Synthetic peptide
  Seed: VSSSFSYTLL (MAGC1_HUMAN)
VFSSFSYTLY

SEQ ID NO: 81738 - protein, 9 aa, Artificial Sequence
  Description of Artificial Sequence: Synthetic peptide
  Seed: NVISRYTGY (MAGC1_HUMAN)
NVISRYTGK

SEQ ID NO: 81739 - protein, 9 aa, Artificial Sequence
  Description of Artificial Sequence: Synthetic peptide
  Seed: SVLQIPVSA (MAGC1_HUMAN)
SPLQIPVSG

SEQ ID NO: 81740 - protein, 11 aa, Artificial Sequence
  Description of Artificial Sequence: Synthetic peptide
  Seed: QSSPESDDTLY (MAGC1_HUMAN)
QMSPESDDTLW

SEQ ID NO: 81741 - protein, 10 aa, Artificial Sequence
  Description of Artificial Sequence: Synthetic peptide
  Seed: IWDVLSGIGV (MAGC1_HUMAN)
IFDVLSGIGF

SEQ ID NO: 81742 - protein, 9 aa, Artificial Sequence
  Description of Artificial Sequence: Synthetic peptide
  Seed: LSPLHFPQF (MAGC1_HUMAN)
LSPLHFPQM

SEQ ID NO: 81743 - protein, 11 aa, Artificial Sequence
  Description of Artificial Sequence: Synthetic peptide
  Seed: SSFFSSALLSI (MAGC1_HUMAN)
SSFFSSALLSL

SEQ ID NO: 81744 - protein, 9 aa, Artificial Sequence
  Description of Artificial Sequence: Synthetic peptide
  Seed: LQIPMTSSF (MAGC1_HUMAN)
LLIPMTSSF

SEQ ID NO: 81745 - protein, 9 aa, Artificial Sequence
  Description of Artificial Sequence: Synthetic peptide
  Seed: FFSSALLSI (MAGC1_HUMAN)
FWSSALLSF

SEQ ID NO: 81746 - protein, 11 aa, Artificial Sequence
  Description of Artificial Sequence: Synthetic peptide
  Seed: SSFPSSTSSSL (MAGC1_HUMAN)
SSFPSSTSSSF

SEQ ID NO: 81747 - protein, 11 aa, Artificial Sequence
  Description of Artificial Sequence: Synthetic peptide
  Seed: IIDTTDDSTAT (MAGC1_HUMAN)
ILDTTDDSTAF

SEQ ID NO: 81748 - protein, 9 aa, Artificial Sequence
  Description of Artificial Sequence: Synthetic peptide
  Seed: FQSSPERTH (MAGC1_HUMAN)
FASSPERTV

SEQ ID NO: 81749 - protein, 9 aa, Artificial Sequence
  Description of Artificial Sequence: Synthetic peptide
  Seed: TESASSSVM (MAGC1_HUMAN)
TESASSSVA

SEQ ID NO: 81750 - protein, 10 aa, Artificial Sequence
  Description of Artificial Sequence: Synthetic peptide
  Seed: MPTAGMPSLL (MAGC1_HUMAN)
MQTAGMPSLW

SEQ ID NO: 81751 - protein, 10 aa, Artificial Sequence
  Description of Artificial Sequence: Synthetic peptide
  Seed: VISFSSSTSL (MAGC1_HUMAN)
VDSFSSSTSL

SEQ ID NO: 81752 - protein, 9 aa, Artificial Sequence
  Description of Artificial Sequence: Synthetic peptide
  Seed: AQSPLQRPV (MAGC1_HUMAN)
AMSPLQRPY

SEQ ID NO: 81753 - protein, 10 aa, Artificial Sequence
  Description of Artificial Sequence: Synthetic peptide
  Seed: IIDTTDDSTA (MAGC1_HUMAN)
IMDTTDDSTM

SEQ ID NO: 81754 - protein, 10 aa, Artificial Sequence
  Description of Artificial Sequence: Synthetic peptide
  Seed: KDVEERAQAI (MAGC1_HUMAN)
KEVEERAQAA

SEQ ID NO: 81755 - protein, 9 aa, Artificial Sequence
  Description of Artificial Sequence: Synthetic peptide
  Seed: EFIEILFGI (MAGC1_HUMAN)
ESIEILFGT

SEQ ID NO: 81756 - protein, 9 aa, Artificial Sequence
  Description of Artificial Sequence: Synthetic peptide
  Seed: SEVIKRKVV (MAGC1_HUMAN)
SEVIKRKVY

SEQ ID NO: 81757 - protein, 9 aa, Artificial Sequence
  Description of Artificial Sequence: Synthetic peptide
  Seed: FQSSLQSPV (MAGC1_HUMAN)
FLSSLQSPS

SEQ ID NO: 81758 - protein, 9 aa, Artificial Sequence
  Description of Artificial Sequence: Synthetic peptide
  Seed: TLDLTSEGC (MAGC1_HUMAN)
TVDLTSEGF

SEQ ID NO: 81759 - protein, 11 aa, Artificial Sequence
  Description of Artificial Sequence: Synthetic peptide
  Seed: RKVVEFLAMLK (MAGC1_HUMAN)
RLVVEFLAMLK

SEQ ID NO: 81760 - protein, 9 aa, Artificial Sequence
  Description of Artificial Sequence: Synthetic peptide
  Seed: HFPQSPPEW (MAGC1_HUMAN)
HTPQSPPEM

SEQ ID NO: 81761 - protein, 9 aa, Artificial Sequence
  Description of Artificial Sequence: Synthetic peptide
  Seed: SLPQSFPES (MAGC1_HUMAN)
SIPQSFPEI

SEQ ID NO: 81762 - protein, 9 aa, Artificial Sequence
  Description of Artificial Sequence: Synthetic peptide
  Seed: LSDEQGMSQ (MAGC1_HUMAN)
LFDEQGMSL

SEQ ID NO: 81763 - protein, 9 aa, Artificial Sequence
  Description of Artificial Sequence: Synthetic peptide
  Seed: SLFQSFSER (MAGC1_HUMAN)
SAFQSFSEM

SEQ ID NO: 81764 - protein, 11 aa, Artificial Sequence
  Description of Artificial Sequence: Synthetic peptide
  Seed: SQSSPEGKDSL (MAGC1_HUMAN)
SESSPEGKDSM

SEQ ID NO: 81765 - protein, 9 aa, Artificial Sequence
  Description of Artificial Sequence: Synthetic peptide
  Seed: TKVWVQEHY (MAGC1_HUMAN)
TSVWVQEHY

SEQ ID NO: 81766 - protein, 10 aa, Artificial Sequence
  Description of Artificial Sequence: Synthetic peptide
  Seed: WGPRAHSEVI (MAGC1_HUMAN)
WRPRAHSEVL

SEQ ID NO: 81767 - protein, 9 aa, Artificial Sequence
  Description of Artificial Sequence: Synthetic peptide
  Seed: MTSSFSSTL (MAGC1_HUMAN)
MMSSFSSTT

SEQ ID NO: 81768 - protein, 10 aa, Artificial Sequence
  Description of Artificial Sequence: Synthetic peptide
  Seed: ICSSSTPSSL (MAGC1_HUMAN)
IDSSSTPSSF

SEQ ID NO: 81769 - protein, 9 aa, Artificial Sequence
  Description of Artificial Sequence: Synthetic peptide
  Seed: SSPESDDTL (MAGC1_HUMAN)
SYPESDDTF

SEQ ID NO: 81770 - protein, 10 aa, Artificial Sequence
  Description of Artificial Sequence: Synthetic peptide
  Seed: YTLLSLFQSS (MAGC1_HUMAN)
YVLLSLFQSA

SEQ ID NO: 81771 - protein, 9 aa, Artificial Sequence
  Description of Artificial Sequence: Synthetic peptide
  Seed: CSSSTSLSL (MAGC1_HUMAN)
CNSSTSLSF

SEQ ID NO: 81772 - protein, 9 aa, Artificial Sequence
  Description of Artificial Sequence: Synthetic peptide
  Seed: LQRPVSSFF (MAGC1_HUMAN)
LMRPVSSFA

SEQ ID NO: 81773 - protein, 9 aa, Artificial Sequence
  Description of Artificial Sequence: Synthetic peptide
  Seed: FSYTLASLL (MAGC1_HUMAN)
FTYTLASLM

SEQ ID NO: 81774 - protein, 9 aa, Artificial Sequence
  Description of Artificial Sequence: Synthetic peptide
  Seed: SSPESAQSA (MAGC1_HUMAN)
SQPESAQSY

SEQ ID NO: 81775 - protein, 9 aa, Artificial Sequence
  Description of Artificial Sequence: Synthetic peptide
  Seed: VSSSFSYTL (MAGC1_HUMAN)
VYSSFSYTY

SEQ ID NO: 81776 - protein, 9 aa, Artificial Sequence
  Description of Artificial Sequence: Synthetic peptide
  Seed: VIFRKAREF (MAGC1_HUMAN)
VVFRKAREY

SEQ ID NO: 81777 - protein, 9 aa, Artificial Sequence
  Description of Artificial Sequence: Synthetic peptide
  Seed: IESEPLFTY (MAGC1_HUMAN)
IQSEPLFTM

SEQ ID NO: 81778 - protein, 10 aa, Artificial Sequence
  Description of Artificial Sequence: Synthetic peptide
  Seed: KGTYASEEVI (MAGC1_HUMAN)
KLTYASEEVW

SEQ ID NO: 81779 - protein, 10 aa, Artificial Sequence
  Description of Artificial Sequence: Synthetic peptide
  Seed: FSSSTSLSPF (MAGC1_HUMAN)
FPSSTSLSPI

SEQ ID NO: 81780 - protein, 9 aa, Artificial Sequence
  Description of Artificial Sequence: Synthetic peptide
  Seed: LQIVPSLPE (MAGC1_HUMAN)
LMIVPSLPM

SEQ ID NO: 81781 - protein, 9 aa, Artificial Sequence
  Description of Artificial Sequence: Synthetic peptide
  Seed: RAGREHFAF (MAGC1_HUMAN)
RWGREHFAF

SEQ ID NO: 81782 - protein, 10 aa, Artificial Sequence
  Description of Artificial Sequence: Synthetic peptide
  Seed: MPTAGMPSLL (MAGC1_HUMAN)
MDTAGMPSLL

SEQ ID NO: 81783 - protein, 9 aa, Artificial Sequence
  Description of Artificial Sequence: Synthetic peptide
  Seed: SPVSSFPSS (MAGC1_HUMAN)
SVVSSFPSY

SEQ ID NO: 81784 - protein, 9 aa, Artificial Sequence
  Description of Artificial Sequence: Synthetic peptide
  Seed: RSFSSTLLS (MAGC1_HUMAN)
RMFSSTLLY

SEQ ID NO: 81785 - protein, 10 aa, Artificial Sequence
  Description of Artificial Sequence: Synthetic peptide
  Seed: YTLDEKVDEL (MAGC1_HUMAN)
YPLDEKVDEI

SEQ ID NO: 81786 - protein, 9 aa, Artificial Sequence
  Description of Artificial Sequence: Synthetic peptide
  Seed: SFFSYTLAS (MAGC1_HUMAN)
SMFSYTLAL

SEQ ID NO: 81787 - protein, 9 aa, Artificial Sequence
  Description of Artificial Sequence: Synthetic peptide
  Seed: IIFIKGTYA (MAGC1_HUMAN)
IMFIKGTYA

SEQ ID NO: 81788 - protein, 9 aa, Artificial Sequence
  Description of Artificial Sequence: Synthetic peptide
  Seed: RTHSTFEGF (MAGC1_HUMAN)
RKHSTFEGY

SEQ ID NO: 81789 - protein, 8 aa, Artificial Sequence
  Description of Artificial Sequence: Synthetic peptide
  Seed: FSSALLSI (MAGC1_HUMAN)
FASALLSM

SEQ ID NO: 81790 - protein, 9 aa, Artificial Sequence
  Description of Artificial Sequence: Synthetic peptide
  Seed: TSLSLPQSF (MAGC1_HUMAN)
TSLSLPQSV

SEQ ID NO: 81791 - protein, 9 aa, Artificial Sequence
  Description of Artificial Sequence: Synthetic peptide
  Seed: VSRSFSSTL (MAGC1_HUMAN)
VTRSFSSTM

SEQ ID NO: 81792 - protein, 10 aa, Artificial Sequence
  Description of Artificial Sequence: Synthetic peptide
  Seed: YTGYFPVIFR (MAGC1_HUMAN)
YAGYFPVIFR

SEQ ID NO: 81793 - protein, 9 aa, Artificial Sequence
  Description of Artificial Sequence: Synthetic peptide
  Seed: VQSPLHSPQ (MAGC1_HUMAN)
VKSPLHSPF

SEQ ID NO: 81794 - protein, 9 aa, Artificial Sequence
  Description of Artificial Sequence: Synthetic peptide
  Seed: SSFPSSTSS (MAGC1_HUMAN)
SSFPSSTSM

SEQ ID NO: 81795 - protein, 9 aa, Artificial Sequence
  Description of Artificial Sequence: Synthetic peptide
  Seed: SSSTLLSLF (MAGC1_HUMAN)
SASTLLSLV

SEQ ID NO: 81796 - protein, 10 aa, Artificial Sequence
  Description of Artificial Sequence: Synthetic peptide
  Seed: PLQIPVSSSF (MAGC1_HUMAN)
PAQIPVSSSF

SEQ ID NO: 81797 - protein, 10 aa, Artificial Sequence
  Description of Artificial Sequence: Synthetic peptide
  Seed: SSPESAQSAF (MAGC1_HUMAN)
SRPESAQSAY

SEQ ID NO: 81798 - protein, 10 aa, Artificial Sequence
  Description of Artificial Sequence: Synthetic peptide
  Seed: REHFAFGEPR (MAGC1_HUMAN)
RNHFAFGEPR

SEQ ID NO: 81799 - protein, 10 aa, Artificial Sequence
  Description of Artificial Sequence: Synthetic peptide
  Seed: RKVVEFLAML (MAGC1_HUMAN)
RFVVEFLAMA

SEQ ID NO: 81800 - protein, 9 aa, Artificial Sequence
  Description of Artificial Sequence: Synthetic peptide
  Seed: STFEGFAQS (MAGC1_HUMAN)
STFEGFAQA

SEQ ID NO: 81801 - protein, 9 aa, Artificial Sequence
  Description of Artificial Sequence: Synthetic peptide
  Seed: FAFGEPREL (MAGC1_HUMAN)
FWFGEPREM

SEQ ID NO: 81802 - protein, 9 aa, Artificial Sequence
  Description of Artificial Sequence: Synthetic peptide
  Seed: LSDEQGMSQ (MAGC1_HUMAN)
LTDEQGMSV

SEQ ID NO: 81803 - protein, 9 aa, Artificial Sequence
  Description of Artificial Sequence: Synthetic peptide
  Seed: KVDELARFL (MAGC1_HUMAN)
KMDELARFA

SEQ ID NO: 81804 - protein, 10 aa, Artificial Sequence
  Description of Artificial Sequence: Synthetic peptide
  Seed: FPQSPLQIPV (MAGC1_HUMAN)
FGQSPLQIPL

SEQ ID NO: 81805 - protein, 10 aa, Artificial Sequence
  Description of Artificial Sequence: Synthetic peptide
  Seed: YLEYREVPNS (MAGC1_HUMAN)
YLEYREVPNV

SEQ ID NO: 81806 - protein, 8 aa, Artificial Sequence
  Description of Artificial Sequence: Synthetic peptide
  Seed: SSFSSTLL (MAGC1_HUMAN)
SSFSSTLY

SEQ ID NO: 81807 - protein, 10 aa, Artificial Sequence
  Description of Artificial Sequence: Synthetic peptide
  Seed: FAFGEPRELL (MAGC1_HUMAN)
FIFGEPRELL

SEQ ID NO: 81808 - protein, 9 aa, Artificial Sequence
  Description of Artificial Sequence: Synthetic peptide
  Seed: FSYTLLSLF (MAGC1_HUMAN)
FYYTLLSLI

SEQ ID NO: 81809 - protein, 10 aa, Artificial Sequence
  Description of Artificial Sequence: Synthetic peptide
  Seed: GEDSSDPLQR (MAGC1_HUMAN)
GSDSSDPLQY

SEQ ID NO: 81810 - protein, 10 aa, Artificial Sequence
  Description of Artificial Sequence: Synthetic peptide
  Seed: SSPESAQSTF (MAGC1_HUMAN)
SQPESAQSTW

SEQ ID NO: 81811 - protein, 11 aa, Artificial Sequence
  Description of Artificial Sequence: Synthetic peptide
  Seed: VISRYTGYFPV (MAGC1_HUMAN)
VLSRYTGYFPV

SEQ ID NO: 81812 - protein, 9 aa, Artificial Sequence
  Description of Artificial Sequence: Synthetic peptide
  Seed: TLVSIFQSS (MAGC1_HUMAN)
TMVSIFQSI

SEQ ID NO: 81813 - protein, 9 aa, Artificial Sequence
  Description of Artificial Sequence: Synthetic peptide
  Seed: VSPSFSSTL (MAGC1_HUMAN)
VVPSFSSTW

SEQ ID NO: 81814 - protein, 10 aa, Artificial Sequence
  Description of Artificial Sequence: Synthetic peptide
  Seed: GEDSSDPLQR (MAGC1_HUMAN)
GADSSDPLQY

SEQ ID NO: 81815 - protein, 9 aa, Artificial Sequence
  Description of Artificial Sequence: Synthetic peptide
  Seed: IDTTDDSTA (MAGC1_HUMAN)
IETTDDSTA

SEQ ID NO: 81816 - protein, 10 aa, Artificial Sequence
  Description of Artificial Sequence: Synthetic peptide
  Seed: LQIVPSLPEW (MAGC1_HUMAN)
LHIVPSLPEF

SEQ ID NO: 81817 - protein, 9 aa, Artificial Sequence
  Description of Artificial Sequence: Synthetic peptide
  Seed: TSLSLPQSF (MAGC1_HUMAN)
TVLSLPQSM

SEQ ID NO: 81818 - protein, 10 aa, Artificial Sequence
  Description of Artificial Sequence: Synthetic peptide
  Seed: KGTYASEEVI (MAGC1_HUMAN)
KTTYASEEVW

SEQ ID NO: 81819 - protein, 9 aa, Artificial Sequence
  Description of Artificial Sequence: Synthetic peptide
  Seed: SIFQSSPER (MAGC1_HUMAN)
SMFQSSPET

SEQ ID NO: 81820 - protein, 9 aa, Artificial Sequence
  Description of Artificial Sequence: Synthetic peptide
  Seed: SLIESEPLF (MAGC1_HUMAN)
SIIESEPLW

SEQ ID NO: 81821 - protein, 9 aa, Artificial Sequence
  Description of Artificial Sequence: Synthetic peptide
  Seed: ASSFFSSAL (MAGC1_HUMAN)
AISFFSSAI

SEQ ID NO: 81822 - protein, 8 aa, Artificial Sequence
  Description of Artificial Sequence: Synthetic peptide
  Seed: LQSPVISF (MAGC1_HUMAN)
LQSPVISI

SEQ ID NO: 81823 - protein, 10 aa, Artificial Sequence
  Description of Artificial Sequence: Synthetic peptide
  Seed: LLQIPMTSSF (MAGC1_HUMAN)
LHQIPMTSSL

SEQ ID NO: 81824 - protein, 9 aa, Artificial Sequence
  Description of Artificial Sequence: Synthetic peptide
  Seed: ISFSSSTSL (MAGC1_HUMAN)
IPFSSSTSY

SEQ ID NO: 81825 - protein, 10 aa, Artificial Sequence
  Description of Artificial Sequence: Synthetic peptide
  Seed: YVFVNTLDLT (MAGC1_HUMAN)
YVFVNTLDLI

SEQ ID NO: 81826 - protein, 9 aa, Artificial Sequence
  Description of Artificial Sequence: Synthetic peptide
  Seed: TESASSSVM (MAGC1_HUMAN)
TVSASSSVY

SEQ ID NO: 81827 - protein, 9 aa, Artificial Sequence
  Description of Artificial Sequence: Synthetic peptide
  Seed: SAPEGEDSL (MAGC1_HUMAN)
SSPEGEDSL

SEQ ID NO: 81828 - protein, 9 aa, Artificial Sequence
  Description of Artificial Sequence: Synthetic peptide
  Seed: SPLQIVPSL (MAGC1_HUMAN)
SQLQIVPSV

SEQ ID NO: 81829 - protein, 9 aa, Artificial Sequence
  Description of Artificial Sequence: Synthetic peptide
  Seed: SQSSPVSSF (MAGC1_HUMAN)
SASSPVSSL

SEQ ID NO: 81830 - protein, 9 aa, Artificial Sequence
  Description of Artificial Sequence: Synthetic peptide
  Seed: LQIVPSLPE (MAGC1_HUMAN)
LEIVPSLPM

SEQ ID NO: 81831 - protein, 9 aa, Artificial Sequence
  Description of Artificial Sequence: Synthetic peptide
  Seed: SSPEGKDSL (MAGC1_HUMAN)
SMPEGKDSM

SEQ ID NO: 81832 - protein, 11 aa, Artificial Sequence
  Description of Artificial Sequence: Synthetic peptide
  Seed: IPVSSSFSYTL (MAGC1_HUMAN)
IWVSSSFSYTY

SEQ ID NO: 81833 - protein, 11 aa, Artificial Sequence
  Description of Artificial Sequence: Synthetic peptide
  Seed: SPLQIPMTSSF (MAGC1_HUMAN)
SCLQIPMTSSY

SEQ ID NO: 81834 - protein, 10 aa, Artificial Sequence
  Description of Artificial Sequence: Synthetic peptide
  Seed: RSFSSTLLSI (MAGC1_HUMAN)
REFSSTLLSY

SEQ ID NO: 81835 - protein, 9 aa, Artificial Sequence
  Description of Artificial Sequence: Synthetic peptide
  Seed: VPITFPSSY (MAGC1_HUMAN)
VQITFPSSL

SEQ ID NO: 81836 - protein, 10 aa, Artificial Sequence
  Description of Artificial Sequence: Synthetic peptide
  Seed: FFSSALLSIF (MAGC1_HUMAN)
FSSSALLSIM

SEQ ID NO: 81837 - protein, 10 aa, Artificial Sequence
  Description of Artificial Sequence: Synthetic peptide
  Seed: RKVVEFLAML (MAGC1_HUMAN)
RRVVEFLAMF

SEQ ID NO: 81838 - protein, 9 aa, Artificial Sequence
  Description of Artificial Sequence: Synthetic peptide
  Seed: SAPEGEDSL (MAGC1_HUMAN)
SFPEGEDSY

SEQ ID NO: 81839 - protein, 9 aa, Artificial Sequence
  Description of Artificial Sequence: Synthetic peptide
  Seed: MPTAGMPSL (MAGC1_HUMAN)
MLTAGMPSF

SEQ ID NO: 81840 - protein, 11 aa, Artificial Sequence
  Description of Artificial Sequence: Synthetic peptide
  Seed: SPLQIPGSPSF (MAGC1_HUMAN)
SWLQIPGSPSY

SEQ ID NO: 81841 - protein, 9 aa, Artificial Sequence
  Description of Artificial Sequence: Synthetic peptide
  Seed: IFQSSPESA (MAGC1_HUMAN)
IMQSSPESI

SEQ ID NO: 81842 - protein, 10 aa, Artificial Sequence
  Description of Artificial Sequence: Synthetic peptide
  Seed: RSFSSTLLSI (MAGC1_HUMAN)
RWFSSTLLSI

SEQ ID NO: 81843 - protein, 10 aa, Artificial Sequence
  Description of Artificial Sequence: Synthetic peptide
  Seed: LLQIPMTSSF (MAGC1_HUMAN)
LYQIPMTSSF

SEQ ID NO: 81844 - protein, 10 aa, Artificial Sequence
  Description of Artificial Sequence: Synthetic peptide
  Seed: TTDDSTATES (MAGC1_HUMAN)
TQDDSTATEL

SEQ ID NO: 81845 - protein, 10 aa, Artificial Sequence
  Description of Artificial Sequence: Synthetic peptide
  Seed: SPLQNPASSF (MAGC1_HUMAN)
SVLQNPASSY

SEQ ID NO: 81846 - protein, 10 aa, Artificial Sequence
  Description of Artificial Sequence: Synthetic peptide
  Seed: FFSSALLSIF (MAGC1_HUMAN)
FYSSALLSIY

SEQ ID NO: 81847 - protein, 9 aa, Artificial Sequence
  Description of Artificial Sequence: Synthetic peptide
  Seed: ASSSVMSPS (MAGC1_HUMAN)
AASSVMSPK

SEQ ID NO: 81848 - protein, 11 aa, Artificial Sequence
  Description of Artificial Sequence: Synthetic peptide
  Seed: STFEGFAQSPL (MAGC1_HUMAN)
SVFEGFAQSPL

SEQ ID NO: 81849 - protein, 10 aa, Artificial Sequence
  Description of Artificial Sequence: Synthetic peptide
  Seed: MTSSFSSTLL (MAGC1_HUMAN)
MESSFSSTLV

SEQ ID NO: 81850 - protein, 10 aa, Artificial Sequence
  Description of Artificial Sequence: Synthetic peptide
  Seed: ICSSSTPSSL (MAGC1_HUMAN)
IFSSSTPSSW

SEQ ID NO: 81851 - protein, 10 aa, Artificial Sequence
  Description of Artificial Sequence: Synthetic peptide
  Seed: MPTAGMPSLL (MAGC1_HUMAN)
MVTAGMPSLM

SEQ ID NO: 81852 - protein, 10 aa, Artificial Sequence
  Description of Artificial Sequence: Synthetic peptide
  Seed: SSPERTHSTF (MAGC1_HUMAN)
SVPERTHSTF

SEQ ID NO: 81853 - protein, 9 aa, Artificial Sequence
  Description of Artificial Sequence: Synthetic peptide
  Seed: KVVEFLAML (MAGC1_HUMAN)
KAVEFLAMY

SEQ ID NO: 81854 - protein, 8 aa, Artificial Sequence
  Description of Artificial Sequence: Synthetic peptide
  Seed: SEVIKRKV (MAGC1_HUMAN)
SQVIKRKV

SEQ ID NO: 81855 - protein, 9 aa, Artificial Sequence
  Description of Artificial Sequence: Synthetic peptide
  Seed: FSEESSSPV (MAGC1_HUMAN)
FMEESSSPL

SEQ ID NO: 81856 - protein, 9 aa, Artificial Sequence
  Description of Artificial Sequence: Synthetic peptide
  Seed: IEILFGISL (MAGC1_HUMAN)
IRILFGISM

SEQ ID NO: 81857 - protein, 9 aa, Artificial Sequence
  Description of Artificial Sequence: Synthetic peptide
  Seed: GEDSMSPLY (MAGC1_HUMAN)
GSDSMSPLY

SEQ ID NO: 81858 - protein, 9 aa, Artificial Sequence
  Description of Artificial Sequence: Synthetic peptide
  Seed: ISRYTGYFP (MAGC1_HUMAN)
ITRYTGYFY

SEQ ID NO: 81859 - protein, 9 aa, Artificial Sequence
  Description of Artificial Sequence: Synthetic peptide
  Seed: YTLLSLFQS (MAGC1_HUMAN)
YLLLSLFQV

SEQ ID NO: 81860 - protein, 9 aa, Artificial Sequence
  Description of Artificial Sequence: Synthetic peptide
  Seed: VSRSFSSTL (MAGC1_HUMAN)
VSRSFSSTR

SEQ ID NO: 81861 - protein, 10 aa, Artificial Sequence
  Description of Artificial Sequence: Synthetic peptide
  Seed: VSLFQSSPER (MAGC1_HUMAN)
VFLFQSSPER

SEQ ID NO: 81862 - protein, 9 aa, Artificial Sequence
  Description of Artificial Sequence: Synthetic peptide
  Seed: KVDELARFL (MAGC1_HUMAN)
KIDELARFI

SEQ ID NO: 81863 - protein, 10 aa, Artificial Sequence
  Description of Artificial Sequence: Synthetic peptide
  Seed: STFEGFAQSS (MAGC1_HUMAN)
STFEGFAQSI

SEQ ID NO: 81864 - protein, 9 aa, Artificial Sequence
  Description of Artificial Sequence: Synthetic peptide
  Seed: SFFSYTLAS (MAGC1_HUMAN)
SYFSYTLAL

SEQ ID NO: 81865 - protein, 9 aa, Artificial Sequence
  Description of Artificial Sequence: Synthetic peptide
  Seed: ISFSSSTSL (MAGC1_HUMAN)
IMFSSSTSR

SEQ ID NO: 81866 - protein, 9 aa, Artificial Sequence
  Description of Artificial Sequence: Synthetic peptide
  Seed: SPESAQSTF (MAGC1_HUMAN)
SAESAQSTY

SEQ ID NO: 81867 - protein, 9 aa, Artificial Sequence
  Description of Artificial Sequence: Synthetic peptide
  Seed: GFPQSPLQI (MAGC1_HUMAN)
GTPQSPLQM

SEQ ID NO: 81868 - protein, 9 aa, Artificial Sequence
  Description of Artificial Sequence: Synthetic peptide
  Seed: VSSSFSYTL (MAGC1_HUMAN)
VVSSFSYTV

SEQ ID NO: 81869 - protein, 8 aa, Artificial Sequence
  Description of Artificial Sequence: Synthetic peptide
  Seed: LTDSESLI (MAGC1_HUMAN)
LIDSESLL

SEQ ID NO: 81870 - protein, 9 aa, Artificial Sequence
  Description of Artificial Sequence: Synthetic peptide
  Seed: VISRYTGYF (MAGC1_HUMAN)
VNSRYTGYY

SEQ ID NO: 81871 - protein, 9 aa, Artificial Sequence
  Description of Artificial Sequence: Synthetic peptide
  Seed: MTSSFSSTL (MAGC1_HUMAN)
MPSSFSSTY

SEQ ID NO: 81872 - protein, 11 aa, Artificial Sequence
  Description of Artificial Sequence: Synthetic peptide
  Seed: VSSSSSSSTLL (MAGC1_HUMAN)
VISSSSSSTLW

SEQ ID NO: 81873 - protein, 10 aa, Artificial Sequence
  Description of Artificial Sequence: Synthetic peptide
  Seed: REFIEILFGI (MAGC1_HUMAN)
RVFIEILFGV

SEQ ID NO: 81874 - protein, 9 aa, Artificial Sequence
  Description of Artificial Sequence: Synthetic peptide
  Seed: IPVSSSFSY (MAGC1_HUMAN)
IAVSSSFSI

SEQ ID NO: 81875 - protein, 9 aa, Artificial Sequence
  Description of Artificial Sequence: Synthetic peptide
  Seed: GENTHSPLQ (MAGC1_HUMAN)
GENTHSPLI

SEQ ID NO: 81876 - protein, 10 aa, Artificial Sequence
  Description of Artificial Sequence: Synthetic peptide
  Seed: REVDPDDSYV (MAGC1_HUMAN)
RLVDPDDSYV

SEQ ID NO: 81877 - protein, 9 aa, Artificial Sequence
  Description of Artificial Sequence: Synthetic peptide
  Seed: KVVEFLAML (MAGC1_HUMAN)
KVVEFLAMY

SEQ ID NO: 81878 - protein, 11 aa, Artificial Sequence
  Description of Artificial Sequence: Synthetic peptide
  Seed: AMLKNTVPITF (MAGC1_HUMAN)
AMLKNTVPITW

SEQ ID NO: 81879 - protein, 9 aa, Artificial Sequence
  Description of Artificial Sequence: Synthetic peptide
  Seed: AQSPLQSPV (MAGC1_HUMAN)
ALSPLQSPY

SEQ ID NO: 81880 - protein, 9 aa, Artificial Sequence
  Description of Artificial Sequence: Synthetic peptide
  Seed: SAPEGEDSL (MAGC1_HUMAN)
SMPEGEDSF

SEQ ID NO: 81881 - protein, 11 aa, Artificial Sequence
  Description of Artificial Sequence: Synthetic peptide
  Seed: SICSSSTSLSL (MAGC1_HUMAN)
SSCSSSTSLSW

SEQ ID NO: 81882 - protein, 10 aa, Artificial Sequence
  Description of Artificial Sequence: Synthetic peptide
  Seed: MTSSFSSTLL (MAGC1_HUMAN)
MLSSFSSTLF

SEQ ID NO: 81883 - protein, 9 aa, Artificial Sequence
  Description of Artificial Sequence: Synthetic peptide
  Seed: NTVPITFPS (MAGC1_HUMAN)
NNVPITFPV

SEQ ID NO: 81884 - protein, 9 aa, Artificial Sequence
  Description of Artificial Sequence: Synthetic peptide
  Seed: TFEGFPQSL (MAGC1_HUMAN)
TMEGFPQSM

SEQ ID NO: 81885 - protein, 9 aa, Artificial Sequence
  Description of Artificial Sequence: Synthetic peptide
  Seed: FFSYTLASL (MAGC1_HUMAN)
FASYTLASF

SEQ ID NO: 81886 - protein, 9 aa, Artificial Sequence
  Description of Artificial Sequence: Synthetic peptide
  Seed: TPSSLPQSF (MAGC1_HUMAN)
TPSSLPQSL

SEQ ID NO: 81887 - protein, 9 aa, Artificial Sequence
  Description of Artificial Sequence: Synthetic peptide
  Seed: SFFSYTLAS (MAGC1_HUMAN)
SHFSYTLAM

SEQ ID NO: 81888 - protein, 9 aa, Artificial Sequence
  Description of Artificial Sequence: Synthetic peptide
  Seed: FFSSALLSI (MAGC1_HUMAN)
FMSSALLSV

SEQ ID NO: 81889 - protein, 10 aa, Artificial Sequence
  Description of Artificial Sequence: Synthetic peptide
  Seed: YTGYFPVIFR (MAGC1_HUMAN)
YIGYFPVIFR

SEQ ID NO: 81890 - protein, 9 aa, Artificial Sequence
  Description of Artificial Sequence: Synthetic peptide
  Seed: SPPEGMHSQ (MAGC1_HUMAN)
SPPEGMHSM

SEQ ID NO: 81891 - protein, 9 aa, Artificial Sequence
  Description of Artificial Sequence: Synthetic peptide
  Seed: TPSSLPQSF (MAGC1_HUMAN)
TKSSLPQSY

SEQ ID NO: 81892 - protein, 9 aa, Artificial Sequence
  Description of Artificial Sequence: Synthetic peptide
  Seed: REVDPDDSY (MAGC1_HUMAN)
REVDPDDSI

SEQ ID NO: 81893 - protein, 8 aa, Artificial Sequence
  Description of Artificial Sequence: Synthetic peptide
  Seed: QSSPVSSF (MAGC1_HUMAN)
QMSPVSSF

SEQ ID NO: 81894 - protein, 9 aa, Artificial Sequence
  Description of Artificial Sequence: Synthetic peptide
  Seed: STQSPFEGF (MAGC1_HUMAN)
SLQSPFEGF

SEQ ID NO: 81895 - protein, 11 aa, Artificial Sequence
  Description of Artificial Sequence: Synthetic peptide
  Seed: SPLQIPVSRSF (MAGC1_HUMAN)
SCLQIPVSRSF

SEQ ID NO: 81896 - protein, 9 aa, Artificial Sequence
  Description of Artificial Sequence: Synthetic peptide
  Seed: TLLSIFQSS (MAGC1_HUMAN)
TILSIFQSV

SEQ ID NO: 81897 - protein, 11 aa, Artificial Sequence
  Description of Artificial Sequence: Synthetic peptide
  Seed: STFEGFAQSPL (MAGC1_HUMAN)
SQFEGFAQSPM

SEQ ID NO: 81898 - protein, 9 aa, Artificial Sequence
  Description of Artificial Sequence: Synthetic peptide
  Seed: DEKVDELAR (MAGC1_HUMAN)
DVKVDELAR

SEQ ID NO: 81899 - protein, 9 aa, Artificial Sequence
  Description of Artificial Sequence: Synthetic peptide
  Seed: TTDDSTATE (MAGC1_HUMAN)
TADDSTATF

SEQ ID NO: 81900 - protein, 10 aa, Artificial Sequence
  Description of Artificial Sequence: Synthetic peptide
  Seed: NSSPPRYEFL (MAGC1_HUMAN)
NASPPRYEFV

SEQ ID NO: 81901 - protein, 9 aa, Artificial Sequence
  Description of Artificial Sequence: Synthetic peptide
  Seed: SSPERTQST (MAGC1_HUMAN)
SQPERTQSL

SEQ ID NO: 81902 - protein, 11 aa, Artificial Sequence
  Description of Artificial Sequence: Synthetic peptide
  Seed: QSSPECTQSTF (MAGC1_HUMAN)
QTSPECTQSTF

SEQ ID NO: 81903 - protein, 11 aa, Artificial Sequence
  Description of Artificial Sequence: Synthetic peptide
  Seed: YTGYFPVIFRK (MAGC1_HUMAN)
YFGYFPVIFRR

SEQ ID NO: 81904 - protein, 9 aa, Artificial Sequence
  Description of Artificial Sequence: Synthetic peptide
  Seed: KAREFIEIL (MAGC1_HUMAN)
KIREFIEIV

SEQ ID NO: 81905 - protein, 9 aa, Artificial Sequence
  Description of Artificial Sequence: Synthetic peptide
  Seed: SICSSSTSL (MAGC1_HUMAN)
SLCSSSTSA

SEQ ID NO: 81906 - protein, 10 aa, Artificial Sequence
  Description of Artificial Sequence: Synthetic peptide
  Seed: RKVVEFLAML (MAGC1_HUMAN)
RTVVEFLAML

SEQ ID NO: 81907 - protein, 11 aa, Artificial Sequence
  Description of Artificial Sequence: Synthetic peptide
  Seed: SLIESEPLFTY (MAGC1_HUMAN)
SWIESEPLFTY

SEQ ID NO: 81908 - protein, 10 aa, Artificial Sequence
  Description of Artificial Sequence: Synthetic peptide
  Seed: LQIVPSLPEW (MAGC1_HUMAN)
LHIVPSLPEY

SEQ ID NO: 81909 - protein, 11 aa, Artificial Sequence
  Description of Artificial Sequence: Synthetic peptide
  Seed: IPVSSSFSYTL (MAGC1_HUMAN)
IGVSSSFSYTW

SEQ ID NO: 81910 - protein, 9 aa, Artificial Sequence
  Description of Artificial Sequence: Synthetic peptide
  Seed: AQSPLQRPV (MAGC1_HUMAN)
AMSPLQRPI

SEQ ID NO: 81911 - protein, 11 aa, Artificial Sequence
  Description of Artificial Sequence: Synthetic peptide
  Seed: SSFFSSALLSI (MAGC1_HUMAN)
SVFFSSALLSW

SEQ ID NO: 81912 - protein, 10 aa, Artificial Sequence
  Description of Artificial Sequence: Synthetic peptide
  Seed: EVIWDVLSGI (MAGC1_HUMAN)
EAIWDVLSGV

SEQ ID NO: 81913 - protein, 9 aa, Artificial Sequence
  Description of Artificial Sequence: Synthetic peptide
  Seed: SQNRLLILI (MAGC1_HUMAN)
STNRLLILI

SEQ ID NO: 81914 - protein, 11 aa, Artificial Sequence
  Description of Artificial Sequence: Synthetic peptide
  Seed: VDEYTSSSDTL (MAGC1_HUMAN)
VVEYTSSSDTF

SEQ ID NO: 81915 - protein, 11 aa, Artificial Sequence
  Description of Artificial Sequence: Synthetic peptide
  Seed: SLFQSSPERTH (MAGC1_HUMAN)
SVFQSSPERTY

SEQ ID NO: 81916 - protein, 10 aa, Artificial Sequence
  Description of Artificial Sequence: Synthetic peptide
  Seed: KAREFIEILF (MAGC1_HUMAN)
KGREFIEILW

SEQ ID NO: 81917 - protein, 10 aa, Artificial Sequence
  Description of Artificial Sequence: Synthetic peptide
  Seed: ICSSSTPSSL (MAGC1_HUMAN)
IRSSSTPSSF

SEQ ID NO: 81918 - protein, 9 aa, Artificial Sequence
  Description of Artificial Sequence: Synthetic peptide
  Seed: DSYVFVNTL (MAGC1_HUMAN)
DQYVFVNTL

SEQ ID NO: 81919 - protein, 9 aa, Artificial Sequence
  Description of Artificial Sequence: Synthetic peptide
  Seed: KVVEFLAML (MAGC1_HUMAN)
KVVEFLAMW

SEQ ID NO: 81920 - protein, 9 aa, Artificial Sequence
  Description of Artificial Sequence: Synthetic peptide
  Seed: LSDEQGMSQ (MAGC1_HUMAN)
LPDEQGMSM

SEQ ID NO: 81921 - protein, 9 aa, Artificial Sequence
  Description of Artificial Sequence: Synthetic peptide
  Seed: SSPPRYEFL (MAGC1_HUMAN)
SQPPRYEFW

SEQ ID NO: 81922 - protein, 9 aa, Artificial Sequence
  Description of Artificial Sequence: Synthetic peptide
  Seed: FSYTLLSLF (MAGC1_HUMAN)
FTYTLLSLW

SEQ ID NO: 81923 - protein, 9 aa, Artificial Sequence
  Description of Artificial Sequence: Synthetic peptide
  Seed: LQIVPSLPE (MAGC1_HUMAN)
LQIVPSLPG

SEQ ID NO: 81924 - protein, 10 aa, Artificial Sequence
  Description of Artificial Sequence: Synthetic peptide
  Seed: REVDPDDSYV (MAGC1_HUMAN)
RLVDPDDSYI

SEQ ID NO: 81925 - protein, 9 aa, Artificial Sequence
  Description of Artificial Sequence: Synthetic peptide
  Seed: DALKDVEER (MAGC1_HUMAN)
DILKDVEEK

SEQ ID NO: 81926 - protein, 9 aa, Artificial Sequence
  Description of Artificial Sequence: Synthetic peptide
  Seed: LQIPVSRSF (MAGC1_HUMAN)
LEIPVSRSM

SEQ ID NO: 81927 - protein, 9 aa, Artificial Sequence
  Description of Artificial Sequence: Synthetic peptide
  Seed: RKVVEFLAM (MAGC1_HUMAN)
RQVVEFLAM

SEQ ID NO: 81928 - protein, 9 aa, Artificial Sequence
  Description of Artificial Sequence: Synthetic peptide
  Seed: FQSSPERTH (MAGC1_HUMAN)
FTSSPERTM

SEQ ID NO: 81929 - protein, 9 aa, Artificial Sequence
  Description of Artificial Sequence: Synthetic peptide
  Seed: YTGYFPVIF (MAGC1_HUMAN)
YWGYFPVIY

SEQ ID NO: 81930 - protein, 9 aa, Artificial Sequence
  Description of Artificial Sequence: Synthetic peptide
  Seed: FSSALLSIF (MAGC1_HUMAN)
FVSALLSIL

SEQ ID NO: 81931 - protein, 10 aa, Artificial Sequence
  Description of Artificial Sequence: Synthetic peptide
  Seed: SYVFVNTLDL (MAGC1_HUMAN)
SYVFVNTLDW

SEQ ID NO: 81932 - protein, 10 aa, Artificial Sequence
  Description of Artificial Sequence: Synthetic peptide
  Seed: REVDPDDSYV (MAGC1_HUMAN)
RLVDPDDSYW

SEQ ID NO: 81933 - protein, 9 aa, Artificial Sequence
  Description of Artificial Sequence: Synthetic peptide
  Seed: IPVSPSFSS (MAGC1_HUMAN)
IVVSPSFSF

SEQ ID NO: 81934 - protein, 9 aa, Artificial Sequence
  Description of Artificial Sequence: Synthetic peptide
  Seed: LQIPGSPSF (MAGC1_HUMAN)
LLIPGSPSW

SEQ ID NO: 81935 - protein, 10 aa, Artificial Sequence
  Description of Artificial Sequence: Synthetic peptide
  Seed: YTLLSLFQSS (MAGC1_HUMAN)
YWLLSLFQSL

SEQ ID NO: 81936 - protein, 10 aa, Artificial Sequence
  Description of Artificial Sequence: Synthetic peptide
  Seed: SFSYTLLSLF (MAGC1_HUMAN)
SMSYTLLSLF

SEQ ID NO: 81937 - protein, 10 aa, Artificial Sequence
  Description of Artificial Sequence: Synthetic peptide
  Seed: ESAQSTFEGF (MAGC1_HUMAN)
EVAQSTFEGW

SEQ ID NO: 81938 - protein, 10 aa, Artificial Sequence
  Description of Artificial Sequence: Synthetic peptide
  Seed: REFIEILFGI (MAGC1_HUMAN)
RIFIEILFGV

SEQ ID NO: 81939 - protein, 11 aa, Artificial Sequence
  Description of Artificial Sequence: Synthetic peptide
  Seed: SSTPSSLPQSF (MAGC1_HUMAN)
STTPSSLPQSY

SEQ ID NO: 81940 - protein, 10 aa, Artificial Sequence
  Description of Artificial Sequence: Synthetic peptide
  Seed: SVLQIPVSAA (MAGC1_HUMAN)
SMLQIPVSAA

SEQ ID NO: 81941 - protein, 10 aa, Artificial Sequence
  Description of Artificial Sequence: Synthetic peptide
  Seed: RSFSSTLLSI (MAGC1_HUMAN)
RYFSSTLLSM

SEQ ID NO: 81942 - protein, 9 aa, Artificial Sequence
  Description of Artificial Sequence: Synthetic peptide
  Seed: GYFPVIFRK (MAGC1_HUMAN)
GYFPVIFRR

SEQ ID NO: 81943 - protein, 10 aa, Artificial Sequence
  Description of Artificial Sequence: Synthetic peptide
  Seed: FFSSALLSIF (MAGC1_HUMAN)
FGSSALLSIY

SEQ ID NO: 81944 - protein, 9 aa, Artificial Sequence
  Description of Artificial Sequence: Synthetic peptide
  Seed: LLSLFQSFS (MAGC1_HUMAN)
LMSLFQSFL

SEQ ID NO: 81945 - protein, 10 aa, Artificial Sequence
  Description of Artificial Sequence: Synthetic peptide
  Seed: RKVVEFLAML (MAGC1_HUMAN)
RQVVEFLAMI

SEQ ID NO: 81946 - protein, 9 aa, Artificial Sequence
  Description of Artificial Sequence: Synthetic peptide
  Seed: LQIPVSSSS (MAGC1_HUMAN)
LLIPVSSSV

SEQ ID NO: 81947 - protein, 10 aa, Artificial Sequence
  Description of Artificial Sequence: Synthetic peptide
  Seed: VISFSSSTSL (MAGC1_HUMAN)
VASFSSSTSF

SEQ ID NO: 81948 - protein, 10 aa, Artificial Sequence
  Description of Artificial Sequence: Synthetic peptide
  Seed: LAMLKNTVPI (MAGC1_HUMAN)
LKMLKNTVPY

SEQ ID NO: 81949 - protein, 9 aa, Artificial Sequence
  Description of Artificial Sequence: Synthetic peptide
  Seed: IESEPLFTY (MAGC1_HUMAN)
IISEPLFTY

SEQ ID NO: 81950 - protein, 9 aa, Artificial Sequence
  Description of Artificial Sequence: Synthetic peptide
  Seed: SSPESAQSA (MAGC1_HUMAN)
SSPESAQSV

SEQ ID NO: 81951 - protein, 10 aa, Artificial Sequence
  Description of Artificial Sequence: Synthetic peptide
  Seed: REFIEILFGI (MAGC1_HUMAN)
RRFIEILFGC

SEQ ID NO: 81952 - protein, 9 aa, Artificial Sequence
  Description of Artificial Sequence: Synthetic peptide
  Seed: SPLQRPVSS (MAGC1_HUMAN)
SILQRPVSV

SEQ ID NO: 81953 - protein, 10 aa, Artificial Sequence
  Description of Artificial Sequence: Synthetic peptide
  Seed: STFEGFAQSS (MAGC1_HUMAN)
SVFEGFAQSV

SEQ ID NO: 81954 - protein, 9 aa, Artificial Sequence
  Description of Artificial Sequence: Synthetic peptide
  Seed: MTSSFSSTL (MAGC1_HUMAN)
MPSSFSSTM

SEQ ID NO: 81955 - protein, 9 aa, Artificial Sequence
  Description of Artificial Sequence: Synthetic peptide
  Seed: FFSSALLSI (MAGC1_HUMAN)
FFSSALLSL

SEQ ID NO: 81956 - protein, 9 aa, Artificial Sequence
  Description of Artificial Sequence: Synthetic peptide
  Seed: AGREHFAFG (MAGC1_HUMAN)
AIREHFAFY

SEQ ID NO: 81957 - protein, 9 aa, Artificial Sequence
  Description of Artificial Sequence: Synthetic peptide
  Seed: FSSALLSIF (MAGC1_HUMAN)
FASALLSIF

SEQ ID NO: 81958 - protein, 10 aa, Artificial Sequence
  Description of Artificial Sequence: Synthetic peptide
  Seed: YASEEVIWDV (MAGC1_HUMAN)
YQSEEVIWDL

SEQ ID NO: 81959 - protein, 9 aa, Artificial Sequence
  Description of Artificial Sequence: Synthetic peptide
  Seed: MPTAGMPSL (MAGC1_HUMAN)
MTTAGMPSI

SEQ ID NO: 81960 - protein, 10 aa, Artificial Sequence
  Description of Artificial Sequence: Synthetic peptide
  Seed: VISFSSSTSL (MAGC1_HUMAN)
VMSFSSSTSI

SEQ ID NO: 81961 - protein, 10 aa, Artificial Sequence
  Description of Artificial Sequence: Synthetic peptide
  Seed: LQIPVSPSFS (MAGC1_HUMAN)
LQIPVSPSFT

SEQ ID NO: 81962 - protein, 9 aa, Artificial Sequence
  Description of Artificial Sequence: Synthetic peptide
  Seed: EDSSDPLQR (MAGC1_HUMAN)
ELSSDPLQR

SEQ ID NO: 81963 - protein, 9 aa, Artificial Sequence
  Description of Artificial Sequence: Synthetic peptide
  Seed: YVFVNTLDL (MAGC1_HUMAN)
YAFVNTLDI

SEQ ID NO: 81964 - protein, 10 aa, Artificial Sequence
  Description of Artificial Sequence: Synthetic peptide
  Seed: DVLSGIGVRA (MAGC1_HUMAN)
DALSGIGVRR

SEQ ID NO: 81965 - protein, 11 aa, Artificial Sequence
  Description of Artificial Sequence: Synthetic peptide
  Seed: FQSSLQSPVSI (MAGC1_HUMAN)
FISSLQSPVSV

SEQ ID NO: 81966 - protein, 9 aa, Artificial Sequence
  Description of Artificial Sequence: Synthetic peptide
  Seed: SSSFSYTLL (MAGC1_HUMAN)
SSSFSYTLF

SEQ ID NO: 81967 - protein, 10 aa, Artificial Sequence
  Description of Artificial Sequence: Synthetic peptide
  Seed: TLDEKVDELA (MAGC1_HUMAN)
TTDEKVDELM

SEQ ID NO: 81968 - protein, 10 aa, Artificial Sequence
  Description of Artificial Sequence: Synthetic peptide
  Seed: FAQSSLQIPV (MAGC1_HUMAN)
FEQSSLQIPI

SEQ ID NO: 81969 - protein, 10 aa, Artificial Sequence
  Description of Artificial Sequence: Synthetic peptide
  Seed: TLDEKVDELA (MAGC1_HUMAN)
TMDEKVDELM

SEQ ID NO: 81970 - protein, 9 aa, Artificial Sequence
  Description of Artificial Sequence: Synthetic peptide
  Seed: SSSESPQSC (MAGC1_HUMAN)
SSSESPQSM

SEQ ID NO: 81971 - protein, 9 aa, Artificial Sequence
  Description of Artificial Sequence: Synthetic peptide
  Seed: LQIPVSSSS (MAGC1_HUMAN)
LMIPVSSSY

SEQ ID NO: 81972 - protein, 10 aa, Artificial Sequence
  Description of Artificial Sequence: Synthetic peptide
  Seed: QNSQSSPEGK (MAGC1_HUMAN)
QTSQSSPEGK

SEQ ID NO: 81973 - protein, 10 aa, Artificial Sequence
  Description of Artificial Sequence: Synthetic peptide
  Seed: RSFSSTLLSI (MAGC1_HUMAN)
RLFSSTLLSA

SEQ ID NO: 81974 - protein, 11 aa, Artificial Sequence
  Description of Artificial Sequence: Synthetic peptide
  Seed: SFFSYTLASLL (MAGC1_HUMAN)
SIFSYTLASLY

SEQ ID NO: 81975 - protein, 9 aa, Artificial Sequence
  Description of Artificial Sequence: Synthetic peptide
  Seed: MPTAGMPSL (MAGC1_HUMAN)
MATAGMPSV

SEQ ID NO: 81976 - protein, 9 aa, Artificial Sequence
  Description of Artificial Sequence: Synthetic peptide
  Seed: LQRPVSSFF (MAGC1_HUMAN)
LSRPVSSFA

SEQ ID NO: 81977 - protein, 9 aa, Artificial Sequence
  Description of Artificial Sequence: Synthetic peptide
  Seed: GMSQNRLLI (MAGC1_HUMAN)
GLSQNRLLV

SEQ ID NO: 81978 - protein, 9 aa, Artificial Sequence
  Description of Artificial Sequence: Synthetic peptide
  Seed: NVISRYTGY (MAGC1_HUMAN)
NVISRYTGW

SEQ ID NO: 81979 - protein, 9 aa, Artificial Sequence
  Description of Artificial Sequence: Synthetic peptide
  Seed: QSPLQGEEF (MAGC1_HUMAN)
QAPLQGEEM

SEQ ID NO: 81980 - protein, 10 aa, Artificial Sequence
  Description of Artificial Sequence: Synthetic peptide
  Seed: SSSSTLLSLF (MAGC1_HUMAN)
SKSSTLLSLY

SEQ ID NO: 81981 - protein, 11 aa, Artificial Sequence
  Description of Artificial Sequence: Synthetic peptide
  Seed: REVDPDDSYVF (MAGC1_HUMAN)
RMVDPDDSYVY

SEQ ID NO: 81982 - protein, 9 aa, Artificial Sequence
  Description of Artificial Sequence: Synthetic peptide
  Seed: FFSSALLSI (MAGC1_HUMAN)
FFSSALLSF

SEQ ID NO: 81983 - protein, 11 aa, Artificial Sequence
  Description of Artificial Sequence: Synthetic peptide
  Seed: FLAMLKNTVPI (MAGC1_HUMAN)
FFAMLKNTVPV

SEQ ID NO: 81984 - protein, 10 aa, Artificial Sequence
  Description of Artificial Sequence: Synthetic peptide
  Seed: SPLQIPVSPS (MAGC1_HUMAN)
SPLQIPVSPL

SEQ ID NO: 81985 - protein, 10 aa, Artificial Sequence
  Description of Artificial Sequence: Synthetic peptide
  Seed: LLQIPMTSSF (MAGC1_HUMAN)
LNQIPMTSSM

SEQ ID NO: 81986 - protein, 10 aa, Artificial Sequence
  Description of Artificial Sequence: Synthetic peptide
  Seed: FFSYTLASLL (MAGC1_HUMAN)
FSSYTLASLF

SEQ ID NO: 81987 - protein, 9 aa, Artificial Sequence
  Description of Artificial Sequence: Synthetic peptide
  Seed: SPLQRPVSS (MAGC1_HUMAN)
SQLQRPVSM

SEQ ID NO: 81988 - protein, 9 aa, Artificial Sequence
  Description of Artificial Sequence: Synthetic peptide
  Seed: SKSSPESPL (MAGC1_HUMAN)
SQSSPESPM

SEQ ID NO: 81989 - protein, 9 aa, Artificial Sequence
  Description of Artificial Sequence: Synthetic peptide
  Seed: SPLYFPQSP (MAGC1_HUMAN)
SPLYFPQSV

SEQ ID NO: 81990 - protein, 9 aa, Artificial Sequence
  Description of Artificial Sequence: Synthetic peptide
  Seed: TPSSLPQSF (MAGC1_HUMAN)
TSSSLPQSL

SEQ ID NO: 81991 - protein, 9 aa, Artificial Sequence
  Description of Artificial Sequence: Synthetic peptide
  Seed: LKNTVPITF (MAGC1_HUMAN)
LPNTVPITY

SEQ ID NO: 81992 - protein, 11 aa, Artificial Sequence
  Description of Artificial Sequence: Synthetic peptide
  Seed: IPVSSSSSSTL (MAGC1_HUMAN)
IHVSSSSSSTW

SEQ ID NO: 81993 - protein, 11 aa, Artificial Sequence
  Description of Artificial Sequence: Synthetic peptide
  Seed: ITFPSSYKDAL (MAGC1_HUMAN)
ISFPSSYKDAW

SEQ ID NO: 81994 - protein, 10 aa, Artificial Sequence
  Description of Artificial Sequence: Synthetic peptide
  Seed: SSFSYTLLSL (MAGC1_HUMAN)
SHFSYTLLSF

SEQ ID NO: 81995 - protein, 9 aa, Artificial Sequence
  Description of Artificial Sequence: Synthetic peptide
  Seed: RPVSSFFSY (MAGC1_HUMAN)
RRVSSFFSL

SEQ ID NO: 81996 - protein, 10 aa, Artificial Sequence
  Description of Artificial Sequence: Synthetic peptide
  Seed: YTLASLLQSS (MAGC1_HUMAN)
YKLASLLQSL

SEQ ID NO: 81997 - protein, 9 aa, Artificial Sequence
  Description of Artificial Sequence: Synthetic peptide
  Seed: FSSTLVSLF (MAGC1_HUMAN)
FWSTLVSLL

SEQ ID NO: 81998 - protein, 9 aa, Artificial Sequence
  Description of Artificial Sequence: Synthetic peptide
  Seed: FPSSYKDAL (MAGC1_HUMAN)
FVSSYKDAF

SEQ ID NO: 81999 - protein, 10 aa, Artificial Sequence
  Description of Artificial Sequence: Synthetic peptide
  Seed: MPTAGMPSLL (MAGC1_HUMAN)
MRTAGMPSLY

SEQ ID NO: 82000 - protein, 9 aa, Artificial Sequence
  Description of Artificial Sequence: Synthetic peptide
  Seed: MTSSFSSTL (MAGC1_HUMAN)
MSSSFSSTA

SEQ ID NO: 82001 - protein, 9 aa, Artificial Sequence
  Description of Artificial Sequence: Synthetic peptide
  Seed: SLPQSFPES (MAGC1_HUMAN)
SMPQSFPEM

SEQ ID NO: 82002 - protein, 9 aa, Artificial Sequence
  Description of Artificial Sequence: Synthetic peptide
  Seed: TLLSILQSS (MAGC1_HUMAN)
TQLSILQSA

SEQ ID NO: 82003 - protein, 9 aa, Artificial Sequence
  Description of Artificial Sequence: Synthetic peptide
  Seed: LKNTVPITF (MAGC1_HUMAN)
LPNTVPITF

SEQ ID NO: 82004 - protein, 9 aa, Artificial Sequence
  Description of Artificial Sequence: Synthetic peptide
  Seed: LQRPVSSFF (MAGC1_HUMAN)
LQRPVSSFL

SEQ ID NO: 82005 - protein, 9 aa, Artificial Sequence
  Description of Artificial Sequence: Synthetic peptide
  Seed: RTHSTFEGF (MAGC1_HUMAN)
RTHSTFEGY

SEQ ID NO: 82006 - protein, 9 aa, Artificial Sequence
  Description of Artificial Sequence: Synthetic peptide
  Seed: FLWGPRAHS (MAGC1_HUMAN)
FMWGPRAHM

SEQ ID NO: 82007 - protein, 11 aa, Artificial Sequence
  Description of Artificial Sequence: Synthetic peptide
  Seed: QSSPESAQSTF (MAGC1_HUMAN)
QQSPESAQSTM

SEQ ID NO: 82008 - protein, 9 aa, Artificial Sequence
  Description of Artificial Sequence: Synthetic peptide
  Seed: LQRPVSSFF (MAGC1_HUMAN)
LQRPVSSFY

SEQ ID NO: 82009 - protein, 10 aa, Artificial Sequence
  Description of Artificial Sequence: Synthetic peptide
  Seed: LQIPGSPSFS (MAGC1_HUMAN)
LQIPGSPSFH

SEQ ID NO: 82010 - protein, 9 aa, Artificial Sequence
  Description of Artificial Sequence: Synthetic peptide
  Seed: LQIVPSLPE (MAGC1_HUMAN)
LLIVPSLPY

SEQ ID NO: 82011 - protein, 11 aa, Artificial Sequence
  Description of Artificial Sequence: Synthetic peptide
  Seed: QSSPECTQSTF (MAGC1_HUMAN)
QVSPECTQSTW

SEQ ID NO: 82012 - protein, 10 aa, Artificial Sequence
  Description of Artificial Sequence: Synthetic peptide
  Seed: MPTAGMPSLL (MAGC1_HUMAN)
MQTAGMPSLA

SEQ ID NO: 82013 - protein, 9 aa, Artificial Sequence
  Description of Artificial Sequence: Synthetic peptide
  Seed: FFSYTLASL (MAGC1_HUMAN)
FTSYTLASY

SEQ ID NO: 82014 - protein, 9 aa, Artificial Sequence
  Description of Artificial Sequence: Synthetic peptide
  Seed: LARFLLLKY (MAGC1_HUMAN)
LTRFLLLKY

SEQ ID NO: 82015 - protein, 11 aa, Artificial Sequence
  Description of Artificial Sequence: Synthetic peptide
  Seed: SPLQRPVSSFF (MAGC1_HUMAN)
SNLQRPVSSFY

SEQ ID NO: 82016 - protein, 10 aa, Artificial Sequence
  Description of Artificial Sequence: Synthetic peptide
  Seed: MLKNTVPITF (MAGC1_HUMAN)
MYKNTVPITL

SEQ ID NO: 82017 - protein, 9 aa, Artificial Sequence
  Description of Artificial Sequence: Synthetic peptide
  Seed: SPERTQSTF (MAGC1_HUMAN)
SPERTQSTV

SEQ ID NO: 82018 - protein, 9 aa, Artificial Sequence
  Description of Artificial Sequence: Synthetic peptide
  Seed: AQSSLQIPV (MAGC1_HUMAN)
AISSLQIPF

SEQ ID NO: 82019 - protein, 8 aa, Artificial Sequence
  Description of Artificial Sequence: Synthetic peptide
  Seed: SSFSYTLL (MAGC1_HUMAN)
SAFSYTLW

SEQ ID NO: 82020 - protein, 10 aa, Artificial Sequence
  Description of Artificial Sequence: Synthetic peptide
  Seed: RPVSSFFSYT (MAGC1_HUMAN)
RCVSSFFSYK

SEQ ID NO: 82021 - protein, 9 aa, Artificial Sequence
  Description of Artificial Sequence: Synthetic peptide
  Seed: MTSSFSSTL (MAGC1_HUMAN)
MHSSFSSTY

SEQ ID NO: 82022 - protein, 9 aa, Artificial Sequence
  Description of Artificial Sequence: Synthetic peptide
  Seed: MSQNRLLIL (MAGC1_HUMAN)
MQQNRLLIW

SEQ ID NO: 82023 - protein, 9 aa, Artificial Sequence
  Description of Artificial Sequence: Synthetic peptide
  Seed: SICSSSTSL (MAGC1_HUMAN)
SSCSSSTSF

SEQ ID NO: 82024 - protein, 10 aa, Artificial Sequence
  Description of Artificial Sequence: Synthetic peptide
  Seed: EVIWDVLSGI (MAGC1_HUMAN)
EAIWDVLSGL

SEQ ID NO: 82025 - protein, 9 aa, Artificial Sequence
  Description of Artificial Sequence: Synthetic peptide
  Seed: GFPQSPLQI (MAGC1_HUMAN)
GQPQSPLQL

SEQ ID NO: 82026 - protein, 9 aa, Artificial Sequence
  Description of Artificial Sequence: Synthetic peptide
  Seed: SPERTQSTF (MAGC1_HUMAN)
SQERTQSTY

SEQ ID NO: 82027 - protein, 9 aa, Artificial Sequence
  Description of Artificial Sequence: Synthetic peptide
  Seed: SRYTGYFPV (MAGC1_HUMAN)
SMYTGYFPW

SEQ ID NO: 82028 - protein, 9 aa, Artificial Sequence
  Description of Artificial Sequence: Synthetic peptide
  Seed: SPPEGPAQS (MAGC1_HUMAN)
SPPEGPAQF

SEQ ID NO: 82029 - protein, 9 aa, Artificial Sequence
  Description of Artificial Sequence: Synthetic peptide
  Seed: SQSPPEGPV (MAGC1_HUMAN)
SISPPEGPV

SEQ ID NO: 82030 - protein, 9 aa, Artificial Sequence
  Description of Artificial Sequence: Synthetic peptide
  Seed: SPLQRPVSS (MAGC1_HUMAN)
SPLQRPVSF

SEQ ID NO: 82031 - protein, 9 aa, Artificial Sequence
  Description of Artificial Sequence: Synthetic peptide
  Seed: FSYTLASLL (MAGC1_HUMAN)
FRYTLASLL

SEQ ID NO: 82032 - protein, 9 aa, Artificial Sequence
  Description of Artificial Sequence: Synthetic peptide
  Seed: RSFSSTLLS (MAGC1_HUMAN)
RYFSSTLLV

SEQ ID NO: 82033 - protein, 9 aa, Artificial Sequence
  Description of Artificial Sequence: Synthetic peptide
  Seed: LQIPVSAAS (MAGC1_HUMAN)
LHIPVSAAY

SEQ ID NO: 82034 - protein, 9 aa, Artificial Sequence
  Description of Artificial Sequence: Synthetic peptide
  Seed: TPSSLPQSF (MAGC1_HUMAN)
TASSLPQSF

SEQ ID NO: 82035 - protein, 9 aa, Artificial Sequence
  Description of Artificial Sequence: Synthetic peptide
  Seed: SSPESTQSP (MAGC1_HUMAN)
SLPESTQSL

SEQ ID NO: 82036 - protein, 9 aa, Artificial Sequence
  Description of Artificial Sequence: Synthetic peptide
  Seed: SPLQSPESA (MAGC1_HUMAN)
SHLQSPESA

SEQ ID NO: 82037 - protein, 10 aa, Artificial Sequence
  Description of Artificial Sequence: Synthetic peptide
  Seed: MLKNTVPITF (MAGC1_HUMAN)
MGKNTVPITW

SEQ ID NO: 82038 - protein, 11 aa, Artificial Sequence
  Description of Artificial Sequence: Synthetic peptide
  Seed: IPVSSSFSYTL (MAGC1_HUMAN)
ISVSSSFSYTF

SEQ ID NO: 82039 - protein, 11 aa, Artificial Sequence
  Description of Artificial Sequence: Synthetic peptide
  Seed: SFFSSALLSIF (MAGC1_HUMAN)
SIFSSALLSIY

SEQ ID NO: 82040 - protein, 9 aa, Artificial Sequence
  Description of Artificial Sequence: Synthetic peptide
  Seed: ISFSSSTSL (MAGC1_HUMAN)
IAFSSSTSM

SEQ ID NO: 82041 - protein, 9 aa, Artificial Sequence
  Description of Artificial Sequence: Synthetic peptide
  Seed: SMSPLYFPQ (MAGC1_HUMAN)
SYSPLYFPR

SEQ ID NO: 82042 - protein, 9 aa, Artificial Sequence
  Description of Artificial Sequence: Synthetic peptide
  Seed: SPLQRPVSS (MAGC1_HUMAN)
SFLQRPVSL

SEQ ID NO: 82043 - protein, 11 aa, Artificial Sequence
  Description of Artificial Sequence: Synthetic peptide
  Seed: REVDPDDSYVF (MAGC1_HUMAN)
RSVDPDDSYVL

SEQ ID NO: 82044 - protein, 8 aa, Artificial Sequence
  Description of Artificial Sequence: Synthetic peptide
  Seed: SSFSSTLL (MAGC1_HUMAN)
SSFSSTLF

SEQ ID NO: 82045 - protein, 9 aa, Artificial Sequence
  Description of Artificial Sequence: Synthetic peptide
  Seed: IEILFGISL (MAGC1_HUMAN)
IKILFGISY

SEQ ID NO: 82046 - protein, 8 aa, Artificial Sequence
  Description of Artificial Sequence: Synthetic peptide
  Seed: SSFSYTLL (MAGC1_HUMAN)
STFSYTLF

SEQ ID NO: 82047 - protein, 10 aa, Artificial Sequence
  Description of Artificial Sequence: Synthetic peptide
  Seed: SFSYTLLSLF (MAGC1_HUMAN)
SASYTLLSLY

SEQ ID NO: 82048 - protein, 10 aa, Artificial Sequence
  Description of Artificial Sequence: Synthetic peptide
  Seed: YTLLSLFQSS (MAGC1_HUMAN)
YFLLSLFQSL

SEQ ID NO: 82049 - protein, 9 aa, Artificial Sequence
  Description of Artificial Sequence: Synthetic peptide
  Seed: SSPECTQST (MAGC1_HUMAN)
SLPECTQSI

SEQ ID NO: 82050 - protein, 9 aa, Artificial Sequence
  Description of Artificial Sequence: Synthetic peptide
  Seed: TPSSLPQSF (MAGC1_HUMAN)
TRSSLPQSM

SEQ ID NO: 82051 - protein, 9 aa, Artificial Sequence
  Description of Artificial Sequence: Synthetic peptide
  Seed: FSEESSSPV (MAGC1_HUMAN)
FAEESSSPW

SEQ ID NO: 82052 - protein, 9 aa, Artificial Sequence
  Description of Artificial Sequence: Synthetic peptide
  Seed: WVQEHYLEY (MAGC1_HUMAN)
WQQEHYLEY

SEQ ID NO: 82053 - protein, 10 aa, Artificial Sequence
  Description of Artificial Sequence: Synthetic peptide
  Seed: SVLQIPVSAA (MAGC1_HUMAN)
SVLQIPVSAV

SEQ ID NO: 82054 - protein, 9 aa, Artificial Sequence
  Description of Artificial Sequence: Synthetic peptide
  Seed: LQIPMTSSF (MAGC1_HUMAN)
LMIPMTSSM

SEQ ID NO: 82055 - protein, 10 aa, Artificial Sequence
  Description of Artificial Sequence: Synthetic peptide
  Seed: LAMLKNTVPI (MAGC1_HUMAN)
LTMLKNTVPF

SEQ ID NO: 82056 - protein, 10 aa, Artificial Sequence
  Description of Artificial Sequence: Synthetic peptide
  Seed: ICSSSTSLSL (MAGC1_HUMAN)
IHSSSTSLSM

SEQ ID NO: 82057 - protein, 10 aa, Artificial Sequence
  Description of Artificial Sequence: Synthetic peptide
  Seed: ISRYTGYFPV (MAGC1_HUMAN)
IWRYTGYFPI

SEQ ID NO: 82058 - protein, 10 aa, Artificial Sequence
  Description of Artificial Sequence: Synthetic peptide
  Seed: TGYFPVIFRK (MAGC1_HUMAN)
TIYFPVIFRY

SEQ ID NO: 82059 - protein, 10 aa, Artificial Sequence
  Description of Artificial Sequence: Synthetic peptide
  Seed: SSFPSSTSSS (MAGC1_HUMAN)
SSFPSSTSSM

SEQ ID NO: 82060 - protein, 9 aa, Artificial Sequence
  Description of Artificial Sequence: Synthetic peptide
  Seed: SQNRLLILI (MAGC1_HUMAN)
SLNRLLILM

SEQ ID NO: 82061 - protein, 9 aa, Artificial Sequence
  Description of Artificial Sequence: Synthetic peptide
  Seed: RSFSSTLLS (MAGC1_HUMAN)
RGFSSTLLL

SEQ ID NO: 82062 - protein, 9 aa, Artificial Sequence
  Description of Artificial Sequence: Synthetic peptide
  Seed: LQIPVSPSF (MAGC1_HUMAN)
LWIPVSPSY

SEQ ID NO: 82063 - protein, 11 aa, Artificial Sequence
  Description of Artificial Sequence: Synthetic peptide
  Seed: REVDPDDSYVF (MAGC1_HUMAN)
RQVDPDDSYVW

SEQ ID NO: 82064 - protein, 10 aa, Artificial Sequence
  Description of Artificial Sequence: Synthetic peptide
  Seed: ASSFFSSALL (MAGC1_HUMAN)
ANSFFSSALF

SEQ ID NO: 82065 - protein, 9 aa, Artificial Sequence
  Description of Artificial Sequence: Synthetic peptide
  Seed: FSYTLLSLF (MAGC1_HUMAN)
FAYTLLSLV

SEQ ID NO: 82066 - protein, 10 aa, Artificial Sequence
  Description of Artificial Sequence: Synthetic peptide
  Seed: SFFSSALLSI (MAGC1_HUMAN)
SWFSSALLSW

SEQ ID NO: 82067 - protein, 11 aa, Artificial Sequence
  Description of Artificial Sequence: Synthetic peptide
  Seed: SSTSLSLPQSF (MAGC1_HUMAN)
STTSLSLPQSF

SEQ ID NO: 82068 - protein, 9 aa, Artificial Sequence
  Description of Artificial Sequence: Synthetic peptide
  Seed: VSPSSSSTL (MAGC1_HUMAN)
VLPSSSSTY

SEQ ID NO: 82069 - protein, 11 aa, Artificial Sequence
  Description of Artificial Sequence: Synthetic peptide
  Seed: EILFGISLREV (MAGC1_HUMAN)
EYLFGISLREA

SEQ ID NO: 82070 - protein, 9 aa, Artificial Sequence
  Description of Artificial Sequence: Synthetic peptide
  Seed: RPVSSFFSY (MAGC1_HUMAN)
RTVSSFFSM

SEQ ID NO: 82071 - protein, 9 aa, Artificial Sequence
  Description of Artificial Sequence: Synthetic peptide
  Seed: SPLQIVPSL (MAGC1_HUMAN)
SSLQIVPSF

SEQ ID NO: 82072 - protein, 10 aa, Artificial Sequence
  Description of Artificial Sequence: Synthetic peptide
  Seed: EILFGISLRE (MAGC1_HUMAN)
ETLFGISLRK

SEQ ID NO: 82073 - protein, 9 aa, Artificial Sequence
  Description of Artificial Sequence: Synthetic peptide
  Seed: SSPEGKDSL (MAGC1_HUMAN)
SVPEGKDSM

SEQ ID NO: 82074 - protein, 9 aa, Artificial Sequence
  Description of Artificial Sequence: Synthetic peptide
  Seed: WVQEHYLEY (MAGC1_HUMAN)
WRQEHYLEF

SEQ ID NO: 82075 - protein, 9 aa, Artificial Sequence
  Description of Artificial Sequence: Synthetic peptide
  Seed: SSPERTHST (MAGC1_HUMAN)
STPERTHSI

SEQ ID NO: 82076 - protein, 11 aa, Artificial Sequence
  Description of Artificial Sequence: Synthetic peptide
  Seed: SSFPSSTSSSL (MAGC1_HUMAN)
SYFPSSTSSSM

SEQ ID NO: 82077 - protein, 9 aa, Artificial Sequence
  Description of Artificial Sequence: Synthetic peptide
  Seed: RYTGYFPVI (MAGC1_HUMAN)
RWTGYFPVI

SEQ ID NO: 82078 - protein, 9 aa, Artificial Sequence
  Description of Artificial Sequence: Synthetic peptide
  Seed: ESDDTLYPL (MAGC1_HUMAN)
EIDDTLYPV

SEQ ID NO: 82079 - protein, 10 aa, Artificial Sequence
  Description of Artificial Sequence: Synthetic peptide
  Seed: SSSSSSSTLL (MAGC1_HUMAN)
SSSSSSSTLW

SEQ ID NO: 82080 - protein, 10 aa, Artificial Sequence
  Description of Artificial Sequence: Synthetic peptide
  Seed: QGEDSMSPLY (MAGC1_HUMAN)
QREDSMSPLW

SEQ ID NO: 82081 - protein, 10 aa, Artificial Sequence
  Description of Artificial Sequence: Synthetic peptide
  Seed: VPITFPSSYK (MAGC1_HUMAN)
VNITFPSSYK

SEQ ID NO: 82082 - protein, 10 aa, Artificial Sequence
  Description of Artificial Sequence: Synthetic peptide
  Seed: FLAMLKNTVP (MAGC1_HUMAN)
FMAMLKNTVT

SEQ ID NO: 82083 - protein, 9 aa, Artificial Sequence
  Description of Artificial Sequence: Synthetic peptide
  Seed: LARFLLLKY (MAGC1_HUMAN)
LQRFLLLKY

SEQ ID NO: 82084 - protein, 9 aa, Artificial Sequence
  Description of Artificial Sequence: Synthetic peptide
  Seed: LQIVPSLPE (MAGC1_HUMAN)
LTIVPSLPM

SEQ ID NO: 82085 - protein, 9 aa, Artificial Sequence
  Description of Artificial Sequence: Synthetic peptide
  Seed: KAREFIEIL (MAGC1_HUMAN)
KAREFIEIW

SEQ ID NO: 82086 - protein, 9 aa, Artificial Sequence
  Description of Artificial Sequence: Synthetic peptide
  Seed: SSSTLVSIF (MAGC1_HUMAN)
SLSTLVSIY

SEQ ID NO: 82087 - protein, 9 aa, Artificial Sequence
  Description of Artificial Sequence: Synthetic peptide
  Seed: GSPSFSSTL (MAGC1_HUMAN)
GVPSFSSTM

SEQ ID NO: 82088 - protein, 10 aa, Artificial Sequence
  Description of Artificial Sequence: Synthetic peptide
  Seed: SSPPRYEFLW (MAGC1_HUMAN)
SWPPRYEFLF

SEQ ID NO: 82089 - protein, 10 aa, Artificial Sequence
  Description of Artificial Sequence: Synthetic peptide
  Seed: SFSSTLLSIF (MAGC1_HUMAN)
SYSSTLLSIL

SEQ ID NO: 82090 - protein, 11 aa, Artificial Sequence
  Description of Artificial Sequence: Synthetic peptide
  Seed: FLAMLKNTVPI (MAGC1_HUMAN)
FPAMLKNTVPA

SEQ ID NO: 82091 - protein, 9 aa, Artificial Sequence
  Description of Artificial Sequence: Synthetic peptide
  Seed: LQIPMTSSF (MAGC1_HUMAN)
LPIPMTSSV

SEQ ID NO: 82092 - protein, 11 aa, Artificial Sequence
  Description of Artificial Sequence: Synthetic peptide
  Seed: SPLQRPVSSFF (MAGC1_HUMAN)
SGLQRPVSSFF

SEQ ID NO: 82093 - protein, 9 aa, Artificial Sequence
  Description of Artificial Sequence: Synthetic peptide
  Seed: VSSSFSYTL (MAGC1_HUMAN)
VKSSFSYTL

SEQ ID NO: 82094 - protein, 10 aa, Artificial Sequence
  Description of Artificial Sequence: Synthetic peptide
  Seed: FFSYTLASLL (MAGC1_HUMAN)
FNSYTLASLY

SEQ ID NO: 82095 - protein, 10 aa, Artificial Sequence
  Description of Artificial Sequence: Synthetic peptide
  Seed: VWVQEHYLEY (MAGC1_HUMAN)
VMVQEHYLEY

SEQ ID NO: 82096 - protein, 10 aa, Artificial Sequence
  Description of Artificial Sequence: Synthetic peptide
  Seed: SFSYTLLSLF (MAGC1_HUMAN)
SVSYTLLSLF

SEQ ID NO: 82097 - protein, 10 aa, Artificial Sequence
  Description of Artificial Sequence: Synthetic peptide
  Seed: QGEDSLSPHY (MAGC1_HUMAN)
QMEDSLSPHY

SEQ ID NO: 82098 - protein, 9 aa, Artificial Sequence
  Description of Artificial Sequence: Synthetic peptide
  Seed: DSYVFVNTL (MAGC1_HUMAN)
DLYVFVNTY

SEQ ID NO: 82099 - protein, 9 aa, Artificial Sequence
  Description of Artificial Sequence: Synthetic peptide
  Seed: SQSSPVSSF (MAGC1_HUMAN)
SSSSPVSSM

SEQ ID NO: 82100 - protein, 10 aa, Artificial Sequence
  Description of Artificial Sequence: Synthetic peptide
  Seed: SFSSTLLSIF (MAGC1_HUMAN)
SMSSTLLSIW

SEQ ID NO: 82101 - protein, 9 aa, Artificial Sequence
  Description of Artificial Sequence: Synthetic peptide
  Seed: SPPEGENTH (MAGC1_HUMAN)
SPPEGENTY

SEQ ID NO: 82102 - protein, 10 aa, Artificial Sequence
  Description of Artificial Sequence: Synthetic peptide
  Seed: LQIVPSLPEW (MAGC1_HUMAN)
LTIVPSLPEW

SEQ ID NO: 82103 - protein, 9 aa, Artificial Sequence
  Description of Artificial Sequence: Synthetic peptide
  Seed: LQIPVSPSF (MAGC1_HUMAN)
LQIPVSPSV

SEQ ID NO: 82104 - protein, 10 aa, Artificial Sequence
  Description of Artificial Sequence: Synthetic peptide
  Seed: LQIPMTSSFS (MAGC1_HUMAN)
LQIPMTSSFV

SEQ ID NO: 82105 - protein, 11 aa, Artificial Sequence
  Description of Artificial Sequence: Synthetic peptide
  Seed: REVPNSSPPRY (MAGC1_HUMAN)
RQVPNSSPPRL

SEQ ID NO: 82106 - protein, 9 aa, Artificial Sequence
  Description of Artificial Sequence: Synthetic peptide
  Seed: YTLASLLQS (MAGC1_HUMAN)
YLLASLLQI

SEQ ID NO: 82107 - protein, 9 aa, Artificial Sequence
  Description of Artificial Sequence: Synthetic peptide
  Seed: SEESSSPVD (MAGC1_HUMAN)
SEESSSPVA

SEQ ID NO: 82108 - protein, 9 aa, Artificial Sequence
  Description of Artificial Sequence: Synthetic peptide
  Seed: VSSFFSYTL (MAGC1_HUMAN)
VASFFSYTF

SEQ ID NO: 82109 - protein, 9 aa, Artificial Sequence
  Description of Artificial Sequence: Synthetic peptide
  Seed: FLAMLKNTV (MAGC1_HUMAN)
FTAMLKNTI

SEQ ID NO: 82110 - protein, 10 aa, Artificial Sequence
  Description of Artificial Sequence: Synthetic peptide
  Seed: NSSPPRYEFL (MAGC1_HUMAN)
NISPPRYEFV

SEQ ID NO: 82111 - protein, 10 aa, Artificial Sequence
  Description of Artificial Sequence: Synthetic peptide
  Seed: MPTAGMPSLL (MAGC1_HUMAN)
MLTAGMPSLM

SEQ ID NO: 82112 - protein, 10 aa, Artificial Sequence
  Description of Artificial Sequence: Synthetic peptide
  Seed: FAQSSLQIPV (MAGC1_HUMAN)
FLQSSLQIPL

SEQ ID NO: 82113 - protein, 9 aa, Artificial Sequence
  Description of Artificial Sequence: Synthetic peptide
  Seed: FSSTLVSLF (MAGC1_HUMAN)
FNSTLVSLW

SEQ ID NO: 82114 - protein, 9 aa, Artificial Sequence
  Description of Artificial Sequence: Synthetic peptide
  Seed: QIVPSLPEW (MAGC1_HUMAN)
QQVPSLPEW

SEQ ID NO: 82115 - protein, 10 aa, Artificial Sequence
  Description of Artificial Sequence: Synthetic peptide
  Seed: SFSYTLLSLF (MAGC1_HUMAN)
SKSYTLLSLF

SEQ ID NO: 82116 - protein, 9 aa, Artificial Sequence
  Description of Artificial Sequence: Synthetic peptide
  Seed: TLVSIFQSS (MAGC1_HUMAN)
TQVSIFQSI

SEQ ID NO: 82117 - protein, 9 aa, Artificial Sequence
  Description of Artificial Sequence: Synthetic peptide
  Seed: KAREFIEIL (MAGC1_HUMAN)
KQREFIEII

SEQ ID NO: 82118 - protein, 9 aa, Artificial Sequence
  Description of Artificial Sequence: Synthetic peptide
  Seed: ASEEVIWDV (MAGC1_HUMAN)
AQEEVIWDI

SEQ ID NO: 82119 - protein, 11 aa, Artificial Sequence
  Description of Artificial Sequence: Synthetic peptide
  Seed: IPVSAASSSTL (MAGC1_HUMAN)
IRVSAASSSTF

SEQ ID NO: 82120 - protein, 11 aa, Artificial Sequence
  Description of Artificial Sequence: Synthetic peptide
  Seed: IPVSSSSSSST (MAGC1_HUMAN)
IPVSSSSSSSL

SEQ ID NO: 82121 - protein, 9 aa, Artificial Sequence
  Description of Artificial Sequence: Synthetic peptide
  Seed: FSSTLVSLF (MAGC1_HUMAN)
FKSTLVSLL

SEQ ID NO: 82122 - protein, 9 aa, Artificial Sequence
  Description of Artificial Sequence: Synthetic peptide
  Seed: SSSSTLLSL (MAGC1_HUMAN)
SSSSTLLSI

SEQ ID NO: 82123 - protein, 11 aa, Artificial Sequence
  Description of Artificial Sequence: Synthetic peptide
  Seed: SLSQSSPVSSF (MAGC1_HUMAN)
SWSQSSPVSSY

SEQ ID NO: 82124 - protein, 11 aa, Artificial Sequence
  Description of Artificial Sequence: Synthetic peptide
  Seed: IPVSAASSSTL (MAGC1_HUMAN)
IIVSAASSSTY

SEQ ID NO: 82125 - protein, 8 aa, Artificial Sequence
  Description of Artificial Sequence: Synthetic peptide
  Seed: IWDVLSGI (MAGC1_HUMAN)
IFDVLSGF

SEQ ID NO: 82126 - protein, 10 aa, Artificial Sequence
  Description of Artificial Sequence: Synthetic peptide
  Seed: YTLLSLFQSS (MAGC1_HUMAN)
YVLLSLFQSI

SEQ ID NO: 82127 - protein, 10 aa, Artificial Sequence
  Description of Artificial Sequence: Synthetic peptide
  Seed: RAGREHFAFG (MAGC1_HUMAN)
RWGREHFAFM

SEQ ID NO: 82128 - protein, 10 aa, Artificial Sequence
  Description of Artificial Sequence: Synthetic peptide
  Seed: MPTAGMPSLL (MAGC1_HUMAN)
MATAGMPSLF

SEQ ID NO: 82129 - protein, 9 aa, Artificial Sequence
  Description of Artificial Sequence: Synthetic peptide
  Seed: FSSTLLSLF (MAGC1_HUMAN)
FASTLLSLL

SEQ ID NO: 82130 - protein, 9 aa, Artificial Sequence
  Description of Artificial Sequence: Synthetic peptide
  Seed: MTSSFSSTL (MAGC1_HUMAN)
MHSSFSSTM

SEQ ID NO: 82131 - protein, 9 aa, Artificial Sequence
  Description of Artificial Sequence: Synthetic peptide
  Seed: SQNRLLILI (MAGC1_HUMAN)
SENRLLILA

SEQ ID NO: 82132 - protein, 9 aa, Artificial Sequence
  Description of Artificial Sequence: Synthetic peptide
  Seed: FSSTLLSIL (MAGC1_HUMAN)
FQSTLLSIL

SEQ ID NO: 82133 - protein, 9 aa, Artificial Sequence
  Description of Artificial Sequence: Synthetic peptide
  Seed: SAPEGEDSL (MAGC1_HUMAN)
SLPEGEDSM

SEQ ID NO: 82134 - protein, 9 aa, Artificial Sequence
  Description of Artificial Sequence: Synthetic peptide
  Seed: SSSDTLLES (MAGC1_HUMAN)
SQSDTLLEY

SEQ ID NO: 82135 - protein, 10 aa, Artificial Sequence
  Description of Artificial Sequence: Synthetic peptide
  Seed: FAFGEPRELL (MAGC1_HUMAN)
FMFGEPRELA

SEQ ID NO: 82136 - protein, 9 aa, Artificial Sequence
  Description of Artificial Sequence: Synthetic peptide
  Seed: EFIEILFGI (MAGC1_HUMAN)
EQIEILFGA

SEQ ID NO: 82137 - protein, 9 aa, Artificial Sequence
  Description of Artificial Sequence: Synthetic peptide
  Seed: VSSSFSYTL (MAGC1_HUMAN)
VFSSFSYTI

SEQ ID NO: 82138 - protein, 11 aa, Artificial Sequence
  Description of Artificial Sequence: Synthetic peptide
  Seed: SPLQIPVSSSS (MAGC1_HUMAN)
SCLQIPVSSSY

SEQ ID NO: 82139 - protein, 9 aa, Artificial Sequence
  Description of Artificial Sequence: Synthetic peptide
  Seed: SSSTSLSPF (MAGC1_HUMAN)
SKSTSLSPY

SEQ ID NO: 82140 - protein, 9 aa, Artificial Sequence
  Description of Artificial Sequence: Synthetic peptide
  Seed: AGREHFAFG (MAGC1_HUMAN)
ALREHFAFV

SEQ ID NO: 82141 - protein, 10 aa, Artificial Sequence
  Description of Artificial Sequence: Synthetic peptide
  Seed: STFEGFAQSS (MAGC1_HUMAN)
STFEGFAQSL

SEQ ID NO: 82142 - protein, 11 aa, Artificial Sequence
  Description of Artificial Sequence: Synthetic peptide
  Seed: STFEGFAQSSL (MAGC1_HUMAN)
SVFEGFAQSSV

SEQ ID NO: 82143 - protein, 10 aa, Artificial Sequence
  Description of Artificial Sequence: Synthetic peptide
  Seed: FFSSALLSIF (MAGC1_HUMAN)
FTSSALLSIF

SEQ ID NO: 82144 - protein, 9 aa, Artificial Sequence
  Description of Artificial Sequence: Synthetic peptide
  Seed: YQVKQPITK (MAGC1_HUMAN)
YAVKQPITM

SEQ ID NO: 82145 - protein, 9 aa, Artificial Sequence
  Description of Artificial Sequence: Synthetic peptide
  Seed: IPVSPSFSS (MAGC1_HUMAN)
ILVSPSFSY

SEQ ID NO: 82146 - protein, 9 aa, Artificial Sequence
  Description of Artificial Sequence: Synthetic peptide
  Seed: SSFFSSALL (MAGC1_HUMAN)
SKFFSSALL

SEQ ID NO: 82147 - protein, 9 aa, Artificial Sequence
  Description of Artificial Sequence: Synthetic peptide
  Seed: AQSPLQIPV (MAGC1_HUMAN)
AASPLQIPM

SEQ ID NO: 82148 - protein, 11 aa, Artificial Sequence
  Description of Artificial Sequence: Synthetic peptide
  Seed: VSSSSSSSTLL (MAGC1_HUMAN)
VFSSSSSSTLW

SEQ ID NO: 82149 - protein, 10 aa, Artificial Sequence
  Description of Artificial Sequence: Synthetic peptide
  Seed: RAGREHFAFG (MAGC1_HUMAN)
RVGREHFAFP

SEQ ID NO: 82150 - protein, 11 aa, Artificial Sequence
  Description of Artificial Sequence: Synthetic peptide
  Seed: SSSSSTLLSLF (MAGC1_HUMAN)
SMSSSTLLSLY

SEQ ID NO: 82151 - protein, 10 aa, Artificial Sequence
  Description of Artificial Sequence: Synthetic peptide
  Seed: NPASSFFSSA (MAGC1_HUMAN)
NIASSFFSSV

SEQ ID NO: 82152 - protein, 8 aa, Artificial Sequence
  Description of Artificial Sequence: Synthetic peptide
  Seed: RSFSSTLL (MAGC1_HUMAN)
RMFSSTLW

SEQ ID NO: 82153 - protein, 10 aa, Artificial Sequence
  Description of Artificial Sequence: Synthetic peptide
  Seed: FPSSTSSSLS (MAGC1_HUMAN)
FASSTSSSLF

SEQ ID NO: 82154 - protein, 10 aa, Artificial Sequence
  Description of Artificial Sequence: Synthetic peptide
  Seed: SSSSSSSTLL (MAGC1_HUMAN)
SYSSSSSTLF

SEQ ID NO: 82155 - protein, 10 aa, Artificial Sequence
  Description of Artificial Sequence: Synthetic peptide
  Seed: WGPRAHSEVI (MAGC1_HUMAN)
WMPRAHSEVV

SEQ ID NO: 82156 - protein, 11 aa, Artificial Sequence
  Description of Artificial Sequence: Synthetic peptide
  Seed: LQIPVSSSFSY (MAGC1_HUMAN)
LVIPVSSSFSW

SEQ ID NO: 82157 - protein, 10 aa, Artificial Sequence
  Description of Artificial Sequence: Synthetic peptide
  Seed: FFSSALLSIF (MAGC1_HUMAN)
FKSSALLSIW

SEQ ID NO: 82158 - protein, 10 aa, Artificial Sequence
  Description of Artificial Sequence: Synthetic peptide
  Seed: SRYTGYFPVI (MAGC1_HUMAN)
SRYTGYFPVL

SEQ ID NO: 82159 - protein, 9 aa, Artificial Sequence
  Description of Artificial Sequence: Synthetic peptide
  Seed: MTSSFSSTL (MAGC1_HUMAN)
MISSFSSTK

SEQ ID NO: 82160 - protein, 11 aa, Artificial Sequence
  Description of Artificial Sequence: Synthetic peptide
  Seed: SPLQIPVSRSF (MAGC1_HUMAN)
SGLQIPVSRSF

SEQ ID NO: 82161 - protein, 9 aa, Artificial Sequence
  Description of Artificial Sequence: Synthetic peptide
  Seed: SSFFSYTLA (MAGC1_HUMAN)
SGFFSYTLK

SEQ ID NO: 82162 - protein, 9 aa, Artificial Sequence
  Description of Artificial Sequence: Synthetic peptide
  Seed: ISFSSSTSL (MAGC1_HUMAN)
IAFSSSTSH

SEQ ID NO: 82163 - protein, 8 aa, Artificial Sequence
  Description of Artificial Sequence: Synthetic peptide
  Seed: SSPPRYEF (MAGC1_HUMAN)
SIPPRYEL

SEQ ID NO: 82164 - protein, 9 aa, Artificial Sequence
  Description of Artificial Sequence: Synthetic peptide
  Seed: TLVSIFQSS (MAGC1_HUMAN)
TIVSIFQSI

SEQ ID NO: 82165 - protein, 9 aa, Artificial Sequence
  Description of Artificial Sequence: Synthetic peptide
  Seed: FPSSYKDAL (MAGC1_HUMAN)
FVSSYKDAY

SEQ ID NO: 82166 - protein, 11 aa, Artificial Sequence
  Description of Artificial Sequence: Synthetic peptide
  Seed: IPVSSSFSYTL (MAGC1_HUMAN)
IMVSSSFSYTW

SEQ ID NO: 82167 - protein, 9 aa, Artificial Sequence
  Description of Artificial Sequence: Synthetic peptide
  Seed: SICSSSTSL (MAGC1_HUMAN)
SICSSSTSF

SEQ ID NO: 82168 - protein, 9 aa, Artificial Sequence
  Description of Artificial Sequence: Synthetic peptide
  Seed: VPITFPSSY (MAGC1_HUMAN)
VYITFPSSF

SEQ ID NO: 82169 - protein, 11 aa, Artificial Sequence
  Description of Artificial Sequence: Synthetic peptide
  Seed: QSSPECTQSTF (MAGC1_HUMAN)
QQSPECTQSTF

SEQ ID NO: 82170 - protein, 10 aa, Artificial Sequence
  Description of Artificial Sequence: Synthetic peptide
  Seed: SSFPSSTSSS (MAGC1_HUMAN)
SQFPSSTSSY

SEQ ID NO: 82171 - protein, 9 aa, Artificial Sequence
  Description of Artificial Sequence: Synthetic peptide
  Seed: TPSSLPQSF (MAGC1_HUMAN)
TPSSLPQSM

SEQ ID NO: 82172 - protein, 8 aa, Artificial Sequence
  Description of Artificial Sequence: Synthetic peptide
  Seed: FSSTLVSL (MAGC1_HUMAN)
FQSTLVSI

SEQ ID NO: 82173 - protein, 10 aa, Artificial Sequence
  Description of Artificial Sequence: Synthetic peptide
  Seed: AASSSTLVSI (MAGC1_HUMAN)
ALSSSTLVSM

SEQ ID NO: 82174 - protein, 9 aa, Artificial Sequence
  Description of Artificial Sequence: Synthetic peptide
  Seed: CSSSTSLSL (MAGC1_HUMAN)
CTSSTSLSM

SEQ ID NO: 82175 - protein, 11 aa, Artificial Sequence
  Description of Artificial Sequence: Synthetic peptide
  Seed: SFFSSALLSIF (MAGC1_HUMAN)
SVFSSALLSIW

SEQ ID NO: 82176 - protein, 9 aa, Artificial Sequence
  Description of Artificial Sequence: Synthetic peptide
  Seed: LKYQVKQPI (MAGC1_HUMAN)
LSYQVKQPM

SEQ ID NO: 82177 - protein, 9 aa, Artificial Sequence
  Description of Artificial Sequence: Synthetic peptide
  Seed: SLPQSFPES (MAGC1_HUMAN)
SMPQSFPEA

SEQ ID NO: 82178 - protein, 9 aa, Artificial Sequence
  Description of Artificial Sequence: Synthetic peptide
  Seed: RSFSSTLLS (MAGC1_HUMAN)
RTFSSTLLR

SEQ ID NO: 82179 - protein, 10 aa, Artificial Sequence
  Description of Artificial Sequence: Synthetic peptide
  Seed: SPVSICSSST (MAGC1_HUMAN)
SPVSICSSSA

SEQ ID NO: 82180 - protein, 9 aa, Artificial Sequence
  Description of Artificial Sequence: Synthetic peptide
  Seed: VIWDVLSGI (MAGC1_HUMAN)
VSWDVLSGA

SEQ ID NO: 82181 - protein, 9 aa, Artificial Sequence
  Description of Artificial Sequence: Synthetic peptide
  Seed: LQIPGSPSF (MAGC1_HUMAN)
LQIPGSPSH

SEQ ID NO: 82182 - protein, 9 aa, Artificial Sequence
  Description of Artificial Sequence: Synthetic peptide
  Seed: SPLQSPVIS (MAGC1_HUMAN)
SPLQSPVIA

SEQ ID NO: 82183 - protein, 11 aa, Artificial Sequence
  Description of Artificial Sequence: Synthetic peptide
  Seed: SPLQRPVSSFF (MAGC1_HUMAN)
SDLQRPVSSFY

SEQ ID NO: 82184 - protein, 9 aa, Artificial Sequence
  Description of Artificial Sequence: Synthetic peptide
  Seed: GFPQSPLQI (MAGC1_HUMAN)
GYPQSPLQM

SEQ ID NO: 82185 - protein, 9 aa, Artificial Sequence
  Description of Artificial Sequence: Synthetic peptide
  Seed: VSAASSSTL (MAGC1_HUMAN)
VVAASSSTY

SEQ ID NO: 82186 - protein, 10 aa, Artificial Sequence
  Description of Artificial Sequence: Synthetic peptide
  Seed: SSPESAQSAF (MAGC1_HUMAN)
SRPESAQSAM

SEQ ID NO: 82187 - protein, 9 aa, Artificial Sequence
  Description of Artificial Sequence: Synthetic peptide
  Seed: VSPSSSSTL (MAGC1_HUMAN)
VSPSSSSTY

SEQ ID NO: 82188 - protein, 10 aa, Artificial Sequence
  Description of Artificial Sequence: Synthetic peptide
  Seed: SFPSSTSSSL (MAGC1_HUMAN)
SCPSSTSSSV

SEQ ID NO: 82189 - protein, 10 aa, Artificial Sequence
  Description of Artificial Sequence: Synthetic peptide
  Seed: RKVVEFLAML (MAGC1_HUMAN)
RSVVEFLAMI

SEQ ID NO: 82190 - protein, 9 aa, Artificial Sequence
  Description of Artificial Sequence: Synthetic peptide
  Seed: NVISRYTGY (MAGC1_HUMAN)
NIISRYTGR

SEQ ID NO: 82191 - protein, 10 aa, Artificial Sequence
  Description of Artificial Sequence: Synthetic peptide
  Seed: LQIPGSPSFS (MAGC1_HUMAN)
LSIPGSPSFY

SEQ ID NO: 82192 - protein, 10 aa, Artificial Sequence
  Description of Artificial Sequence: Synthetic peptide
  Seed: VPITFPSSYK (MAGC1_HUMAN)
VEITFPSSYR

SEQ ID NO: 82193 - protein, 9 aa, Artificial Sequence
  Description of Artificial Sequence: Synthetic peptide
  Seed: IFRKAREFI (MAGC1_HUMAN)
IQRKAREFK

SEQ ID NO: 82194 - protein, 9 aa, Artificial Sequence
  Description of Artificial Sequence: Synthetic peptide
  Seed: SSPERTHST (MAGC1_HUMAN)
SSPERTHSL

SEQ ID NO: 82195 - protein, 10 aa, Artificial Sequence
  Description of Artificial Sequence: Synthetic peptide
  Seed: RAGREHFAFG (MAGC1_HUMAN)
RNGREHFAFK

SEQ ID NO: 82196 - protein, 10 aa, Artificial Sequence
  Description of Artificial Sequence: Synthetic peptide
  Seed: GPAQSPLQSP (MAGC1_HUMAN)
GPAQSPLQSA

SEQ ID NO: 82197 - protein, 9 aa, Artificial Sequence
  Description of Artificial Sequence: Synthetic peptide
  Seed: SAQSTFEGF (MAGC1_HUMAN)
SMQSTFEGF

SEQ ID NO: 82198 - protein, 10 aa, Artificial Sequence
  Description of Artificial Sequence: Synthetic peptide
  Seed: SFSSTLVSLF (MAGC1_HUMAN)
SMSSTLVSLM

SEQ ID NO: 82199 - protein, 9 aa, Artificial Sequence
  Description of Artificial Sequence: Synthetic peptide
  Seed: DVLSGIGVR (MAGC1_HUMAN)
DVLSGIGVY

SEQ ID NO: 82200 - protein, 10 aa, Artificial Sequence
  Description of Artificial Sequence: Synthetic peptide
  Seed: GTYASEEVIW (MAGC1_HUMAN)
GQYASEEVIW

SEQ ID NO: 82201 - protein, 9 aa, Artificial Sequence
  Description of Artificial Sequence: Synthetic peptide
  Seed: SPLQIVPSL (MAGC1_HUMAN)
SRLQIVPSY

SEQ ID NO: 82202 - protein, 10 aa, Artificial Sequence
  Description of Artificial Sequence: Synthetic peptide
  Seed: ATESASSSVM (MAGC1_HUMAN)
AVESASSSVL

SEQ ID NO: 82203 - protein, 9 aa, Artificial Sequence
  Description of Artificial Sequence: Synthetic peptide
  Seed: FSSTLLSLF (MAGC1_HUMAN)
FMSTLLSLM

SEQ ID NO: 82204 - protein, 9 aa, Artificial Sequence
  Description of Artificial Sequence: Synthetic peptide
  Seed: SFPSSTSSS (MAGC1_HUMAN)
SMPSSTSSY

SEQ ID NO: 82205 - protein, 10 aa, Artificial Sequence
  Description of Artificial Sequence: Synthetic peptide
  Seed: RYTGYFPVIF (MAGC1_HUMAN)
RTTGYFPVIM

SEQ ID NO: 82206 - protein, 11 aa, Artificial Sequence
  Description of Artificial Sequence: Synthetic peptide
  Seed: SSFSYTLLSLF (MAGC1_HUMAN)
SQFSYTLLSLM

SEQ ID NO: 82207 - protein, 11 aa, Artificial Sequence
  Description of Artificial Sequence: Synthetic peptide
  Seed: SLFQSSPERTH (MAGC1_HUMAN)
STFQSSPERTY

SEQ ID NO: 82208 - protein, 10 aa, Artificial Sequence
  Description of Artificial Sequence: Synthetic peptide
  Seed: NPASSFFSSA (MAGC1_HUMAN)
NRASSFFSSV

SEQ ID NO: 82209 - protein, 11 aa, Artificial Sequence
  Description of Artificial Sequence: Synthetic peptide
  Seed: REVDPDDSYVF (MAGC1_HUMAN)
RLVDPDDSYVM

SEQ ID NO: 82210 - protein, 9 aa, Artificial Sequence
  Description of Artificial Sequence: Synthetic peptide
  Seed: IESEPLFTY (MAGC1_HUMAN)
IVSEPLFTM

SEQ ID NO: 82211 - protein, 9 aa, Artificial Sequence
  Description of Artificial Sequence: Synthetic peptide
  Seed: RPVSSFFSY (MAGC1_HUMAN)
RQVSSFFSG

SEQ ID NO: 82212 - protein, 9 aa, Artificial Sequence
  Description of Artificial Sequence: Synthetic peptide
  Seed: FFSSALLSI (MAGC1_HUMAN)
FGSSALLSM

SEQ ID NO: 82213 - protein, 10 aa, Artificial Sequence
  Description of Artificial Sequence: Synthetic peptide
  Seed: TGYFPVIFRK (MAGC1_HUMAN)
TLYFPVIFRR

SEQ ID NO: 82214 - protein, 10 aa, Artificial Sequence
  Description of Artificial Sequence: Synthetic peptide
  Seed: SSSSSTLLSL (MAGC1_HUMAN)
SPSSSTLLSY

SEQ ID NO: 82215 - protein, 10 aa, Artificial Sequence
  Description of Artificial Sequence: Synthetic peptide
  Seed: TTDDSTATES (MAGC1_HUMAN)
TADDSTATEY

SEQ ID NO: 82216 - protein, 9 aa, Artificial Sequence
  Description of Artificial Sequence: Synthetic peptide
  Seed: LQIPGSPSF (MAGC1_HUMAN)
LHIPGSPSY

SEQ ID NO: 82217 - protein, 10 aa, Artificial Sequence
  Description of Artificial Sequence: Synthetic peptide
  Seed: ATESASSSVM (MAGC1_HUMAN)
AMESASSSVW

SEQ ID NO: 82218 - protein, 11 aa, Artificial Sequence
  Description of Artificial Sequence: Synthetic peptide
  Seed: SSFPSSTSSSL (MAGC1_HUMAN)
SWFPSSTSSSF

SEQ ID NO: 82219 - protein, 9 aa, Artificial Sequence
  Description of Artificial Sequence: Synthetic peptide
  Seed: AQSSLQIPV (MAGC1_HUMAN)
AESSLQIPL

SEQ ID NO: 82220 - protein, 9 aa, Artificial Sequence
  Description of Artificial Sequence: Synthetic peptide
  Seed: LQIPVSAAS (MAGC1_HUMAN)
LVIPVSAAY

SEQ ID NO: 82221 - protein, 9 aa, Artificial Sequence
  Description of Artificial Sequence: Synthetic peptide
  Seed: SSPEGKDSL (MAGC1_HUMAN)
SAPEGKDSL

SEQ ID NO: 82222 - protein, 9 aa, Artificial Sequence
  Description of Artificial Sequence: Synthetic peptide
  Seed: AQSPLQIPV (MAGC1_HUMAN)
ATSPLQIPY

SEQ ID NO: 82223 - protein, 10 aa, Artificial Sequence
  Description of Artificial Sequence: Synthetic peptide
  Seed: LQIPMTSSFS (MAGC1_HUMAN)
LMIPMTSSFF

SEQ ID NO: 82224 - protein, 9 aa, Artificial Sequence
  Description of Artificial Sequence: Synthetic peptide
  Seed: KVVEFLAML (MAGC1_HUMAN)
KRVEFLAMF

SEQ ID NO: 82225 - protein, 9 aa, Artificial Sequence
  Description of Artificial Sequence: Synthetic peptide
  Seed: AMLKNTVPI (MAGC1_HUMAN)
AALKNTVPF

SEQ ID NO: 82226 - protein, 10 aa, Artificial Sequence
  Description of Artificial Sequence: Synthetic peptide
  Seed: GEDSSDPLQR (MAGC1_HUMAN)
GVDSSDPLQY

SEQ ID NO: 82227 - protein, 9 aa, Artificial Sequence
  Description of Artificial Sequence: Synthetic peptide
  Seed: SPVISFSSS (MAGC1_HUMAN)
SPVISFSSF

SEQ ID NO: 82228 - protein, 11 aa, Artificial Sequence
  Description of Artificial Sequence: Synthetic peptide
  Seed: IPVSSSFSYTL (MAGC1_HUMAN)
IHVSSSFSYTY

SEQ ID NO: 82229 - protein, 9 aa, Artificial Sequence
  Description of Artificial Sequence: Synthetic peptide
  Seed: SSSESPQSC (MAGC1_HUMAN)
SASESPQSL

SEQ ID NO: 82230 - protein, 9 aa, Artificial Sequence
  Description of Artificial Sequence: Synthetic peptide
  Seed: VSSSFSYTL (MAGC1_HUMAN)
VQSSFSYTY

SEQ ID NO: 82231 - protein, 10 aa, Artificial Sequence
  Description of Artificial Sequence: Synthetic peptide
  Seed: VPITFPSSYK (MAGC1_HUMAN)
VVITFPSSYK

SEQ ID NO: 82232 - protein, 9 aa, Artificial Sequence
  Description of Artificial Sequence: Synthetic peptide
  Seed: SPLEGEDSL (MAGC1_HUMAN)
SMLEGEDSF

SEQ ID NO: 82233 - protein, 9 aa, Artificial Sequence
  Description of Artificial Sequence: Synthetic peptide
  Seed: LQIPVSSSS (MAGC1_HUMAN)
LMIPVSSSL

SEQ ID NO: 82234 - protein, 9 aa, Artificial Sequence
  Description of Artificial Sequence: Synthetic peptide
  Seed: LQIVPSLPE (MAGC1_HUMAN)
LFIVPSLPF

SEQ ID NO: 82235 - protein, 10 aa, Artificial Sequence
  Description of Artificial Sequence: Synthetic peptide
  Seed: SRYTGYFPVI (MAGC1_HUMAN)
SAYTGYFPVI

SEQ ID NO: 82236 - protein, 9 aa, Artificial Sequence
  Description of Artificial Sequence: Synthetic peptide
  Seed: RTQSTFEGF (MAGC1_HUMAN)
RYQSTFEGW

SEQ ID NO: 82237 - protein, 10 aa, Artificial Sequence
  Description of Artificial Sequence: Synthetic peptide
  Seed: LAMLKNTVPI (MAGC1_HUMAN)
LFMLKNTVPF

SEQ ID NO: 82238 - protein, 9 aa, Artificial Sequence
  Description of Artificial Sequence: Synthetic peptide
  Seed: FAFGEPREL (MAGC1_HUMAN)
FCFGEPREM

SEQ ID NO: 82239 - protein, 9 aa, Artificial Sequence
  Description of Artificial Sequence: Synthetic peptide
  Seed: IFRKAREFI (MAGC1_HUMAN)
ITRKAREFA

SEQ ID NO: 82240 - protein, 9 aa, Artificial Sequence
  Description of Artificial Sequence: Synthetic peptide
  Seed: VQSPLHSPQ (MAGC1_HUMAN)
VSSPLHSPF

SEQ ID NO: 82241 - protein, 9 aa, Artificial Sequence
  Description of Artificial Sequence: Synthetic peptide
  Seed: IFRKAREFI (MAGC1_HUMAN)
IWRKAREFF

SEQ ID NO: 82242 - protein, 10 aa, Artificial Sequence
  Description of Artificial Sequence: Synthetic peptide
  Seed: FPQSVLQIPV (MAGC1_HUMAN)
FPQSVLQIPF

SEQ ID NO: 82243 - protein, 9 aa, Artificial Sequence
  Description of Artificial Sequence: Synthetic peptide
  Seed: SSSTLLSLF (MAGC1_HUMAN)
STSTLLSLY

SEQ ID NO: 82244 - protein, 9 aa, Artificial Sequence
  Description of Artificial Sequence: Synthetic peptide
  Seed: SSPERTHST (MAGC1_HUMAN)
SDPERTHSL

SEQ ID NO: 82245 - protein, 9 aa, Artificial Sequence
  Description of Artificial Sequence: Synthetic peptide
  Seed: GYFPVIFRK (MAGC1_HUMAN)
GMFPVIFRK

SEQ ID NO: 82246 - protein, 9 aa, Artificial Sequence
  Description of Artificial Sequence: Synthetic peptide
  Seed: MTSSFSSTL (MAGC1_HUMAN)
MMSSFSSTF

SEQ ID NO: 82247 - protein, 11 aa, Artificial Sequence
  Description of Artificial Sequence: Synthetic peptide
  Seed: SPLQNPASSFF (MAGC1_HUMAN)
SNLQNPASSFF

SEQ ID NO: 82248 - protein, 10 aa, Artificial Sequence
  Description of Artificial Sequence: Synthetic peptide
  Seed: FAFGEPRELL (MAGC1_HUMAN)
FPFGEPRELF

SEQ ID NO: 82249 - protein, 9 aa, Artificial Sequence
  Description of Artificial Sequence: Synthetic peptide
  Seed: RTHSTFEGF (MAGC1_HUMAN)
RAHSTFEGW

SEQ ID NO: 82250 - protein, 10 aa, Artificial Sequence
  Description of Artificial Sequence: Synthetic peptide
  Seed: SFSSTLVSLF (MAGC1_HUMAN)
SKSSTLVSLF

SEQ ID NO: 82251 - protein, 8 aa, Artificial Sequence
  Description of Artificial Sequence: Synthetic peptide
  Seed: AFGEPREL (MAGC1_HUMAN)
AYGEPREY

SEQ ID NO: 82252 - protein, 9 aa, Artificial Sequence
  Description of Artificial Sequence: Synthetic peptide
  Seed: KVDELARFL (MAGC1_HUMAN)
KRDELARFF

SEQ ID NO: 82253 - protein, 9 aa, Artificial Sequence
  Description of Artificial Sequence: Synthetic peptide
  Seed: FQSSLQSPV (MAGC1_HUMAN)
FSSSLQSPM

SEQ ID NO: 82254 - protein, 11 aa, Artificial Sequence
  Description of Artificial Sequence: Synthetic peptide
  Seed: NPASSFFSSAL (MAGC1_HUMAN)
NPASSFFSSAM

SEQ ID NO: 82255 - protein, 10 aa, Artificial Sequence
  Description of Artificial Sequence: Synthetic peptide
  Seed: LQIPVSSSFS (MAGC1_HUMAN)
LMIPVSSSFC

SEQ ID NO: 82256 - protein, 9 aa, Artificial Sequence
  Description of Artificial Sequence: Synthetic peptide
  Seed: ESSSPVDEY (MAGC1_HUMAN)
EASSPVDEK

SEQ ID NO: 82257 - protein, 9 aa, Artificial Sequence
  Description of Artificial Sequence: Synthetic peptide
  Seed: TLDLTSEGC (MAGC1_HUMAN)
TNDLTSEGL

SEQ ID NO: 82258 - protein, 11 aa, Artificial Sequence
  Description of Artificial Sequence: Synthetic peptide
  Seed: VDEYTSSSDTL (MAGC1_HUMAN)
VDEYTSSSDTF

SEQ ID NO: 82259 - protein, 10 aa, Artificial Sequence
  Description of Artificial Sequence: Synthetic peptide
  Seed: REFIEILFGI (MAGC1_HUMAN)
RDFIEILFGF

SEQ ID NO: 82260 - protein, 10 aa, Artificial Sequence
  Description of Artificial Sequence: Synthetic peptide
  Seed: STFEGFPQSL (MAGC1_HUMAN)
SVFEGFPQSM

SEQ ID NO: 82261 - protein, 10 aa, Artificial Sequence
  Description of Artificial Sequence: Synthetic peptide
  Seed: SSPESTQSPF (MAGC1_HUMAN)
SAPESTQSPF

SEQ ID NO: 82262 - protein, 10 aa, Artificial Sequence
  Description of Artificial Sequence: Synthetic peptide
  Seed: FAQSSLQIPV (MAGC1_HUMAN)
FLQSSLQIPI

SEQ ID NO: 82263 - protein, 10 aa, Artificial Sequence
  Description of Artificial Sequence: Synthetic peptide
  Seed: AEMLTNVISR (MAGC1_HUMAN)
ALMLTNVISK

SEQ ID NO: 82264 - protein, 9 aa, Artificial Sequence
  Description of Artificial Sequence: Synthetic peptide
  Seed: RTHSTFEGF (MAGC1_HUMAN)
RQHSTFEGW

SEQ ID NO: 82265 - protein, 10 aa, Artificial Sequence
  Description of Artificial Sequence: Synthetic peptide
  Seed: VISFSSSTSL (MAGC1_HUMAN)
VASFSSSTSL

SEQ ID NO: 82266 - protein, 11 aa, Artificial Sequence
  Description of Artificial Sequence: Synthetic peptide
  Seed: VSSSSSSSTLL (MAGC1_HUMAN)
VFSSSSSSTLF

SEQ ID NO: 82267 - protein, 9 aa, Artificial Sequence
  Description of Artificial Sequence: Synthetic peptide
  Seed: NSSPPRYEF (MAGC1_HUMAN)
NASPPRYEV

SEQ ID NO: 82268 - protein, 11 aa, Artificial Sequence
  Description of Artificial Sequence: Synthetic peptide
  Seed: VWVQEHYLEYR (MAGC1_HUMAN)
VRVQEHYLEYR

SEQ ID NO: 82269 - protein, 9 aa, Artificial Sequence
  Description of Artificial Sequence: Synthetic peptide
  Seed: SRYTGYFPV (MAGC1_HUMAN)
SGYTGYFPF

SEQ ID NO: 82270 - protein, 11 aa, Artificial Sequence
  Description of Artificial Sequence: Synthetic peptide
  Seed: SSSSSSTLLSL (MAGC1_HUMAN)
SASSSSTLLSM

SEQ ID NO: 82271 - protein, 9 aa, Artificial Sequence
  Description of Artificial Sequence: Synthetic peptide
  Seed: SSSSSSSTL (MAGC1_HUMAN)
SMSSSSSTL

SEQ ID NO: 82272 - protein, 8 aa, Artificial Sequence
  Description of Artificial Sequence: Synthetic peptide
  Seed: SSFFSSAL (MAGC1_HUMAN)
SKFFSSAY

SEQ ID NO: 82273 - protein, 9 aa, Artificial Sequence
  Description of Artificial Sequence: Synthetic peptide
  Seed: LQIPGSPSF (MAGC1_HUMAN)
LCIPGSPSF

SEQ ID NO: 82274 - protein, 9 aa, Artificial Sequence
  Description of Artificial Sequence: Synthetic peptide
  Seed: RKVVEFLAM (MAGC1_HUMAN)
RHVVEFLAM

SEQ ID NO: 82275 - protein, 9 aa, Artificial Sequence
  Description of Artificial Sequence: Synthetic peptide
  Seed: VSRSFSSTL (MAGC1_HUMAN)
VWRSFSSTY

SEQ ID NO: 82276 - protein, 11 aa, Artificial Sequence
  Description of Artificial Sequence: Synthetic peptide
  Seed: IPMTSSFSSTL (MAGC1_HUMAN)
IPMTSSFSSTA

SEQ ID NO: 82277 - protein, 9 aa, Artificial Sequence
  Description of Artificial Sequence: Synthetic peptide
  Seed: TTDDSTATE (MAGC1_HUMAN)
TVDDSTATF

SEQ ID NO: 82278 - protein, 9 aa, Artificial Sequence
  Description of Artificial Sequence: Synthetic peptide
  Seed: LQIPVSAAS (MAGC1_HUMAN)
LTIPVSAAF

SEQ ID NO: 82279 - protein, 9 aa, Artificial Sequence
  Description of Artificial Sequence: Synthetic peptide
  Seed: IIFIKGTYA (MAGC1_HUMAN)
ILFIKGTYM

SEQ ID NO: 82280 - protein, 9 aa, Artificial Sequence
  Description of Artificial Sequence: Synthetic peptide
  Seed: LQIPVSAAS (MAGC1_HUMAN)
LGIPVSAAM

SEQ ID NO: 82281 - protein, 9 aa, Artificial Sequence
  Description of Artificial Sequence: Synthetic peptide
  Seed: TLDLTSEGC (MAGC1_HUMAN)
TLDLTSEGL

SEQ ID NO: 82282 - protein, 11 aa, Artificial Sequence
  Description of Artificial Sequence: Synthetic peptide
  Seed: IPVSRSFSSTL (MAGC1_HUMAN)
ILVSRSFSSTY

SEQ ID NO: 82283 - protein, 9 aa, Artificial Sequence
  Description of Artificial Sequence: Synthetic peptide
  Seed: VQSPLHSPQ (MAGC1_HUMAN)
VKSPLHSPI

SEQ ID NO: 82284 - protein, 9 aa, Artificial Sequence
  Description of Artificial Sequence: Synthetic peptide
  Seed: SFSSTLVSL (MAGC1_HUMAN)
SKSSTLVSY

SEQ ID NO: 82285 - protein, 10 aa, Artificial Sequence
  Description of Artificial Sequence: Synthetic peptide
  Seed: KVVEFLAMLK (MAGC1_HUMAN)
KMVEFLAMLK

SEQ ID NO: 82286 - protein, 9 aa, Artificial Sequence
  Description of Artificial Sequence: Synthetic peptide
  Seed: QIVPSLPEW (MAGC1_HUMAN)
QTVPSLPEY

SEQ ID NO: 82287 - protein, 9 aa, Artificial Sequence
  Description of Artificial Sequence: Synthetic peptide
  Seed: VQSPLHSPQ (MAGC1_HUMAN)
VSSPLHSPM

SEQ ID NO: 82288 - protein, 10 aa, Artificial Sequence
  Description of Artificial Sequence: Synthetic peptide
  Seed: SSPECTQSTF (MAGC1_HUMAN)
SYPECTQSTY

SEQ ID NO: 82289 - protein, 11 aa, Artificial Sequence
  Description of Artificial Sequence: Synthetic peptide
  Seed: AMLKNTVPITF (MAGC1_HUMAN)
ATLKNTVPITY

SEQ ID NO: 82290 - protein, 11 aa, Artificial Sequence
  Description of Artificial Sequence: Synthetic peptide
  Seed: RPVSSFFSYTL (MAGC1_HUMAN)
RPVSSFFSYTW

SEQ ID NO: 82291 - protein, 9 aa, Artificial Sequence
  Description of Artificial Sequence: Synthetic peptide
  Seed: SSSSSSSTL (MAGC1_HUMAN)
SLSSSSSTM

SEQ ID NO: 82292 - protein, 9 aa, Artificial Sequence
  Description of Artificial Sequence: Synthetic peptide
  Seed: VIWDVLSGI (MAGC1_HUMAN)
VLWDVLSGA

SEQ ID NO: 82293 - protein, 11 aa, Artificial Sequence
  Description of Artificial Sequence: Synthetic peptide
  Seed: IPVSSSFSYTL (MAGC1_HUMAN)
IFVSSSFSYTF

SEQ ID NO: 82294 - protein, 9 aa, Artificial Sequence
  Description of Artificial Sequence: Synthetic peptide
  Seed: VSSFFSYTL (MAGC1_HUMAN)
VSSFFSYTW

SEQ ID NO: 82295 - protein, 10 aa, Artificial Sequence
  Description of Artificial Sequence: Synthetic peptide
  Seed: FPQSPLQIPV (MAGC1_HUMAN)
FPQSPLQIPA

SEQ ID NO: 82296 - protein, 10 aa, Artificial Sequence
  Description of Artificial Sequence: Synthetic peptide
  Seed: SSFSSTLLSI (MAGC1_HUMAN)
SMFSSTLLSA

SEQ ID NO: 82297 - protein, 9 aa, Artificial Sequence
  Description of Artificial Sequence: Synthetic peptide
  Seed: AMLKNTVPI (MAGC1_HUMAN)
ATLKNTVPR

SEQ ID NO: 82298 - protein, 9 aa, Artificial Sequence
  Description of Artificial Sequence: Synthetic peptide
  Seed: SPLQIVPSL (MAGC1_HUMAN)
SQLQIVPSL

SEQ ID NO: 82299 - protein, 9 aa, Artificial Sequence
  Description of Artificial Sequence: Synthetic peptide
  Seed: IIDTTDDST (MAGC1_HUMAN)
IFDTTDDSI

SEQ ID NO: 82300 - protein, 9 aa, Artificial Sequence
  Description of Artificial Sequence: Synthetic peptide
  Seed: VIWDVLSGI (MAGC1_HUMAN)
VQWDVLSGW

SEQ ID NO: 82301 - protein, 10 aa, Artificial Sequence
  Description of Artificial Sequence: Synthetic peptide
  Seed: EVIWDVLSGI (MAGC1_HUMAN)
EIIWDVLSGI

SEQ ID NO: 82302 - protein, 9 aa, Artificial Sequence
  Description of Artificial Sequence: Synthetic peptide
  Seed: QIVPSLPEW (MAGC1_HUMAN)
QAVPSLPEF

SEQ ID NO: 82303 - protein, 11 aa, Artificial Sequence
  Description of Artificial Sequence: Synthetic peptide
  Seed: SQSSPEGKDSL (MAGC1_HUMAN)
SHSSPEGKDSI

SEQ ID NO: 82304 - protein, 9 aa, Artificial Sequence
  Description of Artificial Sequence: Synthetic peptide
  Seed: LQNPASSFF (MAGC1_HUMAN)
LKNPASSFM

SEQ ID NO: 82305 - protein, 9 aa, Artificial Sequence
  Description of Artificial Sequence: Synthetic peptide
  Seed: RPVSSFFSY (MAGC1_HUMAN)
RTVSSFFSL

SEQ ID NO: 82306 - protein, 11 aa, Artificial Sequence
  Description of Artificial Sequence: Synthetic peptide
  Seed: IKRKVVEFLAM (MAGC1_HUMAN)
IQRKVVEFLAY

SEQ ID NO: 82307 - protein, 9 aa, Artificial Sequence
  Description of Artificial Sequence: Synthetic peptide
  Seed: KVDELARFL (MAGC1_HUMAN)
KNDELARFM

SEQ ID NO: 82308 - protein, 10 aa, Artificial Sequence
  Description of Artificial Sequence: Synthetic peptide
  Seed: SSSSSTLLSL (MAGC1_HUMAN)
SSSSSTLLSV

SEQ ID NO: 82309 - protein, 10 aa, Artificial Sequence
  Description of Artificial Sequence: Synthetic peptide
  Seed: VSSSSSSTLL (MAGC1_HUMAN)
VGSSSSSTLY

SEQ ID NO: 82310 - protein, 10 aa, Artificial Sequence
  Description of Artificial Sequence: Synthetic peptide
  Seed: PLQIPMTSSF (MAGC1_HUMAN)
PIQIPMTSSY

SEQ ID NO: 82311 - protein, 10 aa, Artificial Sequence
  Description of Artificial Sequence: Synthetic peptide
  Seed: PLQIPMTSSF (MAGC1_HUMAN)
PKQIPMTSSF

SEQ ID NO: 82312 - protein, 10 aa, Artificial Sequence
  Description of Artificial Sequence: Synthetic peptide
  Seed: ATESASSSVM (MAGC1_HUMAN)
AMESASSSVF

SEQ ID NO: 82313 - protein, 9 aa, Artificial Sequence
  Description of Artificial Sequence: Synthetic peptide
  Seed: IPVSRSFSS (MAGC1_HUMAN)
IPVSRSFSI

SEQ ID NO: 82314 - protein, 11 aa, Artificial Sequence
  Description of Artificial Sequence: Synthetic peptide
  Seed: RPVSSFFSYTL (MAGC1_HUMAN)
RIVSSFFSYTF

SEQ ID NO: 82315 - protein, 9 aa, Artificial Sequence
  Description of Artificial Sequence: Synthetic peptide
  Seed: VIFRKAREF (MAGC1_HUMAN)
VIFRKAREW

SEQ ID NO: 82316 - protein, 10 aa, Artificial Sequence
  Description of Artificial Sequence: Synthetic peptide
  Seed: VISFSSSTSL (MAGC1_HUMAN)
VWSFSSSTSL

SEQ ID NO: 82317 - protein, 9 aa, Artificial Sequence
  Description of Artificial Sequence: Synthetic peptide
  Seed: SSSTSLSPF (MAGC1_HUMAN)
SFSTSLSPL

SEQ ID NO: 82318 - protein, 10 aa, Artificial Sequence
  Description of Artificial Sequence: Synthetic peptide
  Seed: RKVVEFLAML (MAGC1_HUMAN)
RVVVEFLAMA

SEQ ID NO: 82319 - protein, 11 aa, Artificial Sequence
  Description of Artificial Sequence: Synthetic peptide
  Seed: SICSSSTSLSL (MAGC1_HUMAN)
SVCSSSTSLSF

SEQ ID NO: 82320 - protein, 9 aa, Artificial Sequence
  Description of Artificial Sequence: Synthetic peptide
  Seed: RLLILILSI (MAGC1_HUMAN)
RVLILILSL

SEQ ID NO: 82321 - protein, 9 aa, Artificial Sequence
  Description of Artificial Sequence: Synthetic peptide
  Seed: FPSSTSSSL (MAGC1_HUMAN)
FNSSTSSSM

SEQ ID NO: 82322 - protein, 9 aa, Artificial Sequence
  Description of Artificial Sequence: Synthetic peptide
  Seed: SLFQSFSER (MAGC1_HUMAN)
SLFQSFSEL

SEQ ID NO: 82323 - protein, 9 aa, Artificial Sequence
  Description of Artificial Sequence: Synthetic peptide
  Seed: TLDEKVDEL (MAGC1_HUMAN)
TCDEKVDEF

SEQ ID NO: 82324 - protein, 9 aa, Artificial Sequence
  Description of Artificial Sequence: Synthetic peptide
  Seed: TLVSIFQSS (MAGC1_HUMAN)
TSVSIFQSV

SEQ ID NO: 82325 - protein, 11 aa, Artificial Sequence
  Description of Artificial Sequence: Synthetic peptide
  Seed: RPVSSFFSYTL (MAGC1_HUMAN)
RKVSSFFSYTF

SEQ ID NO: 82326 - protein, 9 aa, Artificial Sequence
  Description of Artificial Sequence: Synthetic peptide
  Seed: SSSTLVSIF (MAGC1_HUMAN)
SMSTLVSIW

SEQ ID NO: 82327 - protein, 11 aa, Artificial Sequence
  Description of Artificial Sequence: Synthetic peptide
  Seed: IPVSSSSSSTL (MAGC1_HUMAN)
IHVSSSSSSTF

SEQ ID NO: 82328 - protein, 9 aa, Artificial Sequence
  Description of Artificial Sequence: Synthetic peptide
  Seed: SSPECTQST (MAGC1_HUMAN)
SVPECTQSV

SEQ ID NO: 82329 - protein, 9 aa, Artificial Sequence
  Description of Artificial Sequence: Synthetic peptide
  Seed: FAFGEPREL (MAGC1_HUMAN)
FWFGEPREY

SEQ ID NO: 82330 - protein, 9 aa, Artificial Sequence
  Description of Artificial Sequence: Synthetic peptide
  Seed: FSSALLSIF (MAGC1_HUMAN)
FPSALLSIM

SEQ ID NO: 82331 - protein, 10 aa, Artificial Sequence
  Description of Artificial Sequence: Synthetic peptide
  Seed: YTLASLLQSS (MAGC1_HUMAN)
YDLASLLQSV

SEQ ID NO: 82332 - protein, 9 aa, Artificial Sequence
  Description of Artificial Sequence: Synthetic peptide
  Seed: RTHSTFEGF (MAGC1_HUMAN)
RVHSTFEGK

SEQ ID NO: 82333 - protein, 8 aa, Artificial Sequence
  Description of Artificial Sequence: Synthetic peptide
  Seed: SSFFSSAL (MAGC1_HUMAN)
STFFSSAW

SEQ ID NO: 82334 - protein, 9 aa, Artificial Sequence
  Description of Artificial Sequence: Synthetic peptide
  Seed: SQSSPVSSF (MAGC1_HUMAN)
SQSSPVSSI

SEQ ID NO: 82335 - protein, 11 aa, Artificial Sequence
  Description of Artificial Sequence: Synthetic peptide
  Seed: EGEDSSDPLQR (MAGC1_HUMAN)
ETEDSSDPLQR

SEQ ID NO: 82336 - protein, 9 aa, Artificial Sequence
  Description of Artificial Sequence: Synthetic peptide
  Seed: SRYTGYFPV (MAGC1_HUMAN)
SQYTGYFPI

SEQ ID NO: 82337 - protein, 9 aa, Artificial Sequence
  Description of Artificial Sequence: Synthetic peptide
  Seed: FFSSALLSI (MAGC1_HUMAN)
FVSSALLSV

SEQ ID NO: 82338 - protein, 10 aa, Artificial Sequence
  Description of Artificial Sequence: Synthetic peptide
  Seed: QRPVSSFFSY (MAGC1_HUMAN)
QLPVSSFFSF

SEQ ID NO: 82339 - protein, 11 aa, Artificial Sequence
  Description of Artificial Sequence: Synthetic peptide
  Seed: KRKVVEFLAML (MAGC1_HUMAN)
KEKVVEFLAMV

SEQ ID NO: 82340 - protein, 9 aa, Artificial Sequence
  Description of Artificial Sequence: Synthetic peptide
  Seed: FSSTLVSLF (MAGC1_HUMAN)
FHSTLVSLY

SEQ ID NO: 82341 - protein, 10 aa, Artificial Sequence
  Description of Artificial Sequence: Synthetic peptide
  Seed: ASSSTLVSIF (MAGC1_HUMAN)
ADSSTLVSIW

SEQ ID NO: 82342 - protein, 9 aa, Artificial Sequence
  Description of Artificial Sequence: Synthetic peptide
  Seed: SSPECTQST (MAGC1_HUMAN)
SMPECTQSI

SEQ ID NO: 82343 - protein, 9 aa, Artificial Sequence
  Description of Artificial Sequence: Synthetic peptide
  Seed: VSSSFSYTL (MAGC1_HUMAN)
VMSSFSYTF

SEQ ID NO: 82344 - protein, 10 aa, Artificial Sequence
  Description of Artificial Sequence: Synthetic peptide
  Seed: FAQSSLQIPV (MAGC1_HUMAN)
FIQSSLQIPL

SEQ ID NO: 82345 - protein, 9 aa, Artificial Sequence
  Description of Artificial Sequence: Synthetic peptide
  Seed: VQSPLHSPQ (MAGC1_HUMAN)
VMSPLHSPM

SEQ ID NO: 82346 - protein, 9 aa, Artificial Sequence
  Description of Artificial Sequence: Synthetic peptide
  Seed: FSSALLSIF (MAGC1_HUMAN)
FPSALLSIY

SEQ ID NO: 82347 - protein, 9 aa, Artificial Sequence
  Description of Artificial Sequence: Synthetic peptide
  Seed: ASSFFSSAL (MAGC1_HUMAN)
AASFFSSAI

SEQ ID NO: 82348 - protein, 9 aa, Artificial Sequence
  Description of Artificial Sequence: Synthetic peptide
  Seed: FPQSLLQIP (MAGC1_HUMAN)
FPQSLLQIT

SEQ ID NO: 82349 - protein, 9 aa, Artificial Sequence
  Description of Artificial Sequence: Synthetic peptide
  Seed: RAHSEVIKR (MAGC1_HUMAN)
RGHSEVIKY

SEQ ID NO: 82350 - protein, 9 aa, Artificial Sequence
  Description of Artificial Sequence: Synthetic peptide
  Seed: ISFSSSTSL (MAGC1_HUMAN)
IYFSSSTSA

SEQ ID NO: 82351 - protein, 10 aa, Artificial Sequence
  Description of Artificial Sequence: Synthetic peptide
  Seed: FSSSTSLSPF (MAGC1_HUMAN)
FVSSTSLSPL

SEQ ID NO: 82352 - protein, 9 aa, Artificial Sequence
  Description of Artificial Sequence: Synthetic peptide
  Seed: TPSSLPQSF (MAGC1_HUMAN)
TQSSLPQSF

SEQ ID NO: 82353 - protein, 9 aa, Artificial Sequence
  Description of Artificial Sequence: Synthetic peptide
  Seed: SLSPHYFPQ (MAGC1_HUMAN)
SVSPHYFPK

SEQ ID NO: 82354 - protein, 9 aa, Artificial Sequence
  Description of Artificial Sequence: Synthetic peptide
  Seed: ESSSPVDEY (MAGC1_HUMAN)
EISSPVDEW

SEQ ID NO: 82355 - protein, 10 aa, Artificial Sequence
  Description of Artificial Sequence: Synthetic peptide
  Seed: SLFQSFSERT (MAGC1_HUMAN)
SMFQSFSERK

SEQ ID NO: 82356 - protein, 9 aa, Artificial Sequence
  Description of Artificial Sequence: Synthetic peptide
  Seed: YTLASLLQS (MAGC1_HUMAN)
YQLASLLQS

SEQ ID NO: 82357 - protein, 11 aa, Artificial Sequence
  Description of Artificial Sequence: Synthetic peptide
  Seed: IPMTSSFSSTL (MAGC1_HUMAN)
IFMTSSFSSTY

SEQ ID NO: 82358 - protein, 9 aa, Artificial Sequence
  Description of Artificial Sequence: Synthetic peptide
  Seed: LQIPVSRSF (MAGC1_HUMAN)
LLIPVSRSL

SEQ ID NO: 82359 - protein, 11 aa, Artificial Sequence
  Description of Artificial Sequence: Synthetic peptide
  Seed: IPVSRSFSSTL (MAGC1_HUMAN)
IWVSRSFSSTW

SEQ ID NO: 82360 - protein, 9 aa, Artificial Sequence
  Description of Artificial Sequence: Synthetic peptide
  Seed: RTQSTFEGF (MAGC1_HUMAN)
RTQSTFEGW

SEQ ID NO: 82361 - protein, 9 aa, Artificial Sequence
  Description of Artificial Sequence: Synthetic peptide
  Seed: VLSGIGVRA (MAGC1_HUMAN)
VMSGIGVRM

SEQ ID NO: 82362 - protein, 10 aa, Artificial Sequence
  Description of Artificial Sequence: Synthetic peptide
  Seed: MTSSFSSTLL (MAGC1_HUMAN)
MMSSFSSTLP

SEQ ID NO: 82363 - protein, 10 aa, Artificial Sequence
  Description of Artificial Sequence: Synthetic peptide
  Seed: GTYASEEVIW (MAGC1_HUMAN)
GSYASEEVIW

SEQ ID NO: 82364 - protein, 11 aa, Artificial Sequence
  Description of Artificial Sequence: Synthetic peptide
  Seed: QSSPESDDTLY (MAGC1_HUMAN)
QISPESDDTLW

SEQ ID NO: 82365 - protein, 9 aa, Artificial Sequence
  Description of Artificial Sequence: Synthetic peptide
  Seed: FSYTLLSLF (MAGC1_HUMAN)
FQYTLLSLL

SEQ ID NO: 82366 - protein, 10 aa, Artificial Sequence
  Description of Artificial Sequence: Synthetic peptide
  Seed: SFSERTQSTF (MAGC1_HUMAN)
SMSERTQSTF

SEQ ID NO: 82367 - protein, 8 aa, Artificial Sequence
  Description of Artificial Sequence: Synthetic peptide
  Seed: DELARFLL (MAGC1_HUMAN)
DELARFLF

SEQ ID NO: 82368 - protein, 9 aa, Artificial Sequence
  Description of Artificial Sequence: Synthetic peptide
  Seed: TGYFPVIFR (MAGC1_HUMAN)
TPYFPVIFR

SEQ ID NO: 82369 - protein, 10 aa, Artificial Sequence
  Description of Artificial Sequence: Synthetic peptide
  Seed: FPQSVLQIPV (MAGC1_HUMAN)
FIQSVLQIPL

SEQ ID NO: 82370 - protein, 9 aa, Artificial Sequence
  Description of Artificial Sequence: Synthetic peptide
  Seed: SSSSTLLSL (MAGC1_HUMAN)
SQSSTLLSV

SEQ ID NO: 82371 - protein, 11 aa, Artificial Sequence
  Description of Artificial Sequence: Synthetic peptide
  Seed: IPVSAASSSTL (MAGC1_HUMAN)
IWVSAASSSTY

SEQ ID NO: 82372 - protein, 10 aa, Artificial Sequence
  Description of Artificial Sequence: Synthetic peptide
  Seed: MPTAGMPSLL (MAGC1_HUMAN)
MPTAGMPSLF

SEQ ID NO: 82373 - protein, 10 aa, Artificial Sequence
  Description of Artificial Sequence: Synthetic peptide
  Seed: ATESASSSVM (MAGC1_HUMAN)
AYESASSSVW

SEQ ID NO: 82374 - protein, 9 aa, Artificial Sequence
  Description of Artificial Sequence: Synthetic peptide
  Seed: TLLESDSLT (MAGC1_HUMAN)
TMLESDSLL

SEQ ID NO: 82375 - protein, 9 aa, Artificial Sequence
  Description of Artificial Sequence: Synthetic peptide
  Seed: VLQIPVSAA (MAGC1_HUMAN)
VMQIPVSAA

SEQ ID NO: 82376 - protein, 9 aa, Artificial Sequence
  Description of Artificial Sequence: Synthetic peptide
  Seed: LQIPGSPSF (MAGC1_HUMAN)
LIIPGSPSL

SEQ ID NO: 82377 - protein, 9 aa, Artificial Sequence
  Description of Artificial Sequence: Synthetic peptide
  Seed: YTLASLLQS (MAGC1_HUMAN)
YSLASLLQA

SEQ ID NO: 82378 - protein, 10 aa, Artificial Sequence
  Description of Artificial Sequence: Synthetic peptide
  Seed: FFSSALLSIF (MAGC1_HUMAN)
FYSSALLSIL

SEQ ID NO: 82379 - protein, 9 aa, Artificial Sequence
  Description of Artificial Sequence: Synthetic peptide
  Seed: FLAMLKNTV (MAGC1_HUMAN)
FAAMLKNTV

SEQ ID NO: 82380 - protein, 9 aa, Artificial Sequence
  Description of Artificial Sequence: Synthetic peptide
  Seed: FFSYTLASL (MAGC1_HUMAN)
FISYTLASI

SEQ ID NO: 82381 - protein, 10 aa, Artificial Sequence
  Description of Artificial Sequence: Synthetic peptide
  Seed: RPVSSFFSYT (MAGC1_HUMAN)
RIVSSFFSYA

SEQ ID NO: 82382 - protein, 10 aa, Artificial Sequence
  Description of Artificial Sequence: Synthetic peptide
  Seed: KAREFIEILF (MAGC1_HUMAN)
KLREFIEILK

SEQ ID NO: 82383 - protein, 11 aa, Artificial Sequence
  Description of Artificial Sequence: Synthetic peptide
  Seed: MSPLYFPQSPL (MAGC1_HUMAN)
MPPLYFPQSPV

SEQ ID NO: 82384 - protein, 9 aa, Artificial Sequence
  Description of Artificial Sequence: Synthetic peptide
  Seed: DSYVFVNTL (MAGC1_HUMAN)
DEYVFVNTV

SEQ ID NO: 82385 - protein, 10 aa, Artificial Sequence
  Description of Artificial Sequence: Synthetic peptide
  Seed: LQIPMTSSFS (MAGC1_HUMAN)
LQIPMTSSFK

SEQ ID NO: 82386 - protein, 9 aa, Artificial Sequence
  Description of Artificial Sequence: Synthetic peptide
  Seed: ASSFFSSAL (MAGC1_HUMAN)
AKSFFSSAI

SEQ ID NO: 82387 - protein, 9 aa, Artificial Sequence
  Description of Artificial Sequence: Synthetic peptide
  Seed: LQIVPSLPE (MAGC1_HUMAN)
LKIVPSLPF

SEQ ID NO: 82388 - protein, 11 aa, Artificial Sequence
  Description of Artificial Sequence: Synthetic peptide
  Seed: QSSPESTQSPF (MAGC1_HUMAN)
QSSPESTQSPW

SEQ ID NO: 82389 - protein, 9 aa, Artificial Sequence
  Description of Artificial Sequence: Synthetic peptide
  Seed: REVDPDDSY (MAGC1_HUMAN)
RMVDPDDSL

SEQ ID NO: 82390 - protein, 10 aa, Artificial Sequence
  Description of Artificial Sequence: Synthetic peptide
  Seed: MTSSFSSTLL (MAGC1_HUMAN)
MHSSFSSTLY

SEQ ID NO: 82391 - protein, 9 aa, Artificial Sequence
  Description of Artificial Sequence: Synthetic peptide
  Seed: LQIPVSSSS (MAGC1_HUMAN)
LLIPVSSSI

SEQ ID NO: 82392 - protein, 9 aa, Artificial Sequence
  Description of Artificial Sequence: Synthetic peptide
  Seed: FSEESSSPV (MAGC1_HUMAN)
FLEESSSPV

SEQ ID NO: 82393 - protein, 9 aa, Artificial Sequence
  Description of Artificial Sequence: Synthetic peptide
  Seed: WGPRAHSEV (MAGC1_HUMAN)
WMPRAHSEI

SEQ ID NO: 82394 - protein, 9 aa, Artificial Sequence
  Description of Artificial Sequence: Synthetic peptide
  Seed: SPLQSPVSS (MAGC1_HUMAN)
SPLQSPVST

SEQ ID NO: 82395 - protein, 9 aa, Artificial Sequence
  Description of Artificial Sequence: Synthetic peptide
  Seed: SPLQSPESA (MAGC1_HUMAN)
SALQSPESM

SEQ ID NO: 82396 - protein, 10 aa, Artificial Sequence
  Description of Artificial Sequence: Synthetic peptide
  Seed: KVVEFLAMLK (MAGC1_HUMAN)
KQVEFLAMLK

SEQ ID NO: 82397 - protein, 11 aa, Artificial Sequence
  Description of Artificial Sequence: Synthetic peptide
  Seed: QSSPERTHSTF (MAGC1_HUMAN)
QTSPERTHSTW

SEQ ID NO: 82398 - protein, 10 aa, Artificial Sequence
  Description of Artificial Sequence: Synthetic peptide
  Seed: MLKNTVPITF (MAGC1_HUMAN)
MDKNTVPITF

SEQ ID NO: 82399 - protein, 9 aa, Artificial Sequence
  Description of Artificial Sequence: Synthetic peptide
  Seed: FQSSLQSPV (MAGC1_HUMAN)
FLSSLQSPV

SEQ ID NO: 82400 - protein, 9 aa, Artificial Sequence
  Description of Artificial Sequence: Synthetic peptide
  Seed: MGDKDMPTA (MAGC1_HUMAN)
MIDKDMPTL

SEQ ID NO: 82401 - protein, 9 aa, Artificial Sequence
  Description of Artificial Sequence: Synthetic peptide
  Seed: SSFFSYTLA (MAGC1_HUMAN)
SVFFSYTLI

SEQ ID NO: 82402 - protein, 9 aa, Artificial Sequence
  Description of Artificial Sequence: Synthetic peptide
  Seed: FFSYTLASL (MAGC1_HUMAN)
FLSYTLASF

SEQ ID NO: 82403 - protein, 10 aa, Artificial Sequence
  Description of Artificial Sequence: Synthetic peptide
  Seed: RPVSSFFSYT (MAGC1_HUMAN)
RLVSSFFSYK

SEQ ID NO: 82404 - protein, 10 aa, Artificial Sequence
  Description of Artificial Sequence: Synthetic peptide
  Seed: RAGREHFAFG (MAGC1_HUMAN)
RRGREHFAFA

SEQ ID NO: 82405 - protein, 10 aa, Artificial Sequence
  Description of Artificial Sequence: Synthetic peptide
  Seed: LQRPVSSFFS (MAGC1_HUMAN)
LMRPVSSFFM

SEQ ID NO: 82406 - protein, 10 aa, Artificial Sequence
  Description of Artificial Sequence: Synthetic peptide
  Seed: SPLQNPASSF (MAGC1_HUMAN)
SPLQNPASSY

SEQ ID NO: 82407 - protein, 10 aa, Artificial Sequence
  Description of Artificial Sequence: Synthetic peptide
  Seed: SPLQSPVISF (MAGC1_HUMAN)
SQLQSPVISF

SEQ ID NO: 82408 - protein, 9 aa, Artificial Sequence
  Description of Artificial Sequence: Synthetic peptide
  Seed: SPLYFPQSP (MAGC1_HUMAN)
SPLYFPQSF

SEQ ID NO: 82409 - protein, 10 aa, Artificial Sequence
  Description of Artificial Sequence: Synthetic peptide
  Seed: VSRSFSSTLL (MAGC1_HUMAN)
VFRSFSSTLK

SEQ ID NO: 82410 - protein, 9 aa, Artificial Sequence
  Description of Artificial Sequence: Synthetic peptide
  Seed: SSSTSLSPF (MAGC1_HUMAN)
SHSTSLSPY

SEQ ID NO: 82411 - protein, 10 aa, Artificial Sequence
  Description of Artificial Sequence: Synthetic peptide
  Seed: STLLSLFQSF (MAGC1_HUMAN)
SMLLSLFQSM

SEQ ID NO: 82412 - protein, 9 aa, Artificial Sequence
  Description of Artificial Sequence: Synthetic peptide
  Seed: VSSSFSYTL (MAGC1_HUMAN)
VHSSFSYTY

SEQ ID NO: 82413 - protein, 9 aa, Artificial Sequence
  Description of Artificial Sequence: Synthetic peptide
  Seed: MPSLLQSSS (MAGC1_HUMAN)
MPSLLQSSC

SEQ ID NO: 82414 - protein, 9 aa, Artificial Sequence
  Description of Artificial Sequence: Synthetic peptide
  Seed: LQIPVSPSF (MAGC1_HUMAN)
LAIPVSPSM

SEQ ID NO: 82415 - protein, 9 aa, Artificial Sequence
  Description of Artificial Sequence: Synthetic peptide
  Seed: TLDEKVDEL (MAGC1_HUMAN)
TIDEKVDEC

SEQ ID NO: 82416 - protein, 10 aa, Artificial Sequence
  Description of Artificial Sequence: Synthetic peptide
  Seed: RSFSSTLLSI (MAGC1_HUMAN)
RLFSSTLLSW

SEQ ID NO: 82417 - protein, 9 aa, Artificial Sequence
  Description of Artificial Sequence: Synthetic peptide
  Seed: YVFVNTLDL (MAGC1_HUMAN)
YSFVNTLDW

SEQ ID NO: 82418 - protein, 9 aa, Artificial Sequence
  Description of Artificial Sequence: Synthetic peptide
  Seed: LQIPMTSSF (MAGC1_HUMAN)
LQIPMTSSA

SEQ ID NO: 82419 - protein, 10 aa, Artificial Sequence
  Description of Artificial Sequence: Synthetic peptide
  Seed: YASEEVIWDV (MAGC1_HUMAN)
YLSEEVIWDL

SEQ ID NO: 82420 - protein, 10 aa, Artificial Sequence
  Description of Artificial Sequence: Synthetic peptide
  Seed: EMLTNVISRY (MAGC1_HUMAN)
EVLTNVISRM

SEQ ID NO: 82421 - protein, 9 aa, Artificial Sequence
  Description of Artificial Sequence: Synthetic peptide
  Seed: FFSSALLSI (MAGC1_HUMAN)
FMSSALLSM

SEQ ID NO: 82422 - protein, 10 aa, Artificial Sequence
  Description of Artificial Sequence: Synthetic peptide
  Seed: RPVSSFFSYT (MAGC1_HUMAN)
RPVSSFFSYL

SEQ ID NO: 82423 - protein, 9 aa, Artificial Sequence
  Description of Artificial Sequence: Synthetic peptide
  Seed: SSLSQSSPV (MAGC1_HUMAN)
SVLSQSSPI

SEQ ID NO: 82424 - protein, 11 aa, Artificial Sequence
  Description of Artificial Sequence: Synthetic peptide
  Seed: IPVSPSSSSTL (MAGC1_HUMAN)
ITVSPSSSSTL

SEQ ID NO: 82425 - protein, 9 aa, Artificial Sequence
  Description of Artificial Sequence: Synthetic peptide
  Seed: TPSSLPQSF (MAGC1_HUMAN)
TSSSLPQSM

SEQ ID NO: 82426 - protein, 9 aa, Artificial Sequence
  Description of Artificial Sequence: Synthetic peptide
  Seed: SSPPRYEFL (MAGC1_HUMAN)
STPPRYEFR

SEQ ID NO: 82427 - protein, 9 aa, Artificial Sequence
  Description of Artificial Sequence: Synthetic peptide
  Seed: FEGFPQSVL (MAGC1_HUMAN)
FPGFPQSVY

SEQ ID NO: 82428 - protein, 9 aa, Artificial Sequence
  Description of Artificial Sequence: Synthetic peptide
  Seed: SSSTLVSIF (MAGC1_HUMAN)
STSTLVSII

SEQ ID NO: 82429 - protein, 11 aa, Artificial Sequence
  Description of Artificial Sequence: Synthetic peptide
  Seed: IPMTSSFSSTL (MAGC1_HUMAN)
IDMTSSFSSTF

SEQ ID NO: 82430 - protein, 10 aa, Artificial Sequence
  Description of Artificial Sequence: Synthetic peptide
  Seed: SPESPLQSPV (MAGC1_HUMAN)
SEESPLQSPA

SEQ ID NO: 82431 - protein, 11 aa, Artificial Sequence
  Description of Artificial Sequence: Synthetic peptide
  Seed: IPVSRSFSSTL (MAGC1_HUMAN)
IAVSRSFSSTF

SEQ ID NO: 82432 - protein, 10 aa, Artificial Sequence
  Description of Artificial Sequence: Synthetic peptide
  Seed: SFSYTLLSLF (MAGC1_HUMAN)
SWSYTLLSLW

SEQ ID NO: 82433 - protein, 9 aa, Artificial Sequence
  Description of Artificial Sequence: Synthetic peptide
  Seed: SGIGVRAGR (MAGC1_HUMAN)
SFIGVRAGR

SEQ ID NO: 82434 - protein, 9 aa, Artificial Sequence
  Description of Artificial Sequence: Synthetic peptide
  Seed: SPLQRPVSS (MAGC1_HUMAN)
SSLQRPVSL

SEQ ID NO: 82435 - protein, 9 aa, Artificial Sequence
  Description of Artificial Sequence: Synthetic peptide
  Seed: TESASSSVM (MAGC1_HUMAN)
TMSASSSVL

SEQ ID NO: 82436 - protein, 8 aa, Artificial Sequence
  Description of Artificial Sequence: Synthetic peptide
  Seed: FSYTLLSL (MAGC1_HUMAN)
FAYTLLSV

SEQ ID NO: 82437 - protein, 9 aa, Artificial Sequence
  Description of Artificial Sequence: Synthetic peptide
  Seed: SFFSYTLAS (MAGC1_HUMAN)
SMFSYTLAI

SEQ ID NO: 82438 - protein, 10 aa, Artificial Sequence
  Description of Artificial Sequence: Synthetic peptide
  Seed: TTDDSTATES (MAGC1_HUMAN)
TYDDSTATEF

SEQ ID NO: 82439 - protein, 9 aa, Artificial Sequence
  Description of Artificial Sequence: Synthetic peptide
  Seed: SLFQSFSER (MAGC1_HUMAN)
SLFQSFSEK

SEQ ID NO: 82440 - protein, 10 aa, Artificial Sequence
  Description of Artificial Sequence: Synthetic peptide
  Seed: LSIFQSSPER (MAGC1_HUMAN)
LYIFQSSPER

SEQ ID NO: 82441 - protein, 9 aa, Artificial Sequence
  Description of Artificial Sequence: Synthetic peptide
  Seed: ESDDTLYPL (MAGC1_HUMAN)
ELDDTLYPI

SEQ ID NO: 82442 - protein, 9 aa, Artificial Sequence
  Description of Artificial Sequence: Synthetic peptide
  Seed: SLIESEPLF (MAGC1_HUMAN)
SMIESEPLL

SEQ ID NO: 82443 - protein, 10 aa, Artificial Sequence
  Description of Artificial Sequence: Synthetic peptide
  Seed: ICSSSTSLSL (MAGC1_HUMAN)
IRSSSTSLSW

SEQ ID NO: 82444 - protein, 9 aa, Artificial Sequence
  Description of Artificial Sequence: Synthetic peptide
  Seed: SAQSTFEGF (MAGC1_HUMAN)
SKQSTFEGF

SEQ ID NO: 82445 - protein, 10 aa, Artificial Sequence
  Description of Artificial Sequence: Synthetic peptide
  Seed: PLQIPVSRSF (MAGC1_HUMAN)
PTQIPVSRSY

SEQ ID NO: 82446 - protein, 9 aa, Artificial Sequence
  Description of Artificial Sequence: Synthetic peptide
  Seed: RTHSTFEGF (MAGC1_HUMAN)
RVHSTFEGA

SEQ ID NO: 82447 - protein, 9 aa, Artificial Sequence
  Description of Artificial Sequence: Synthetic peptide
  Seed: ALKDVEERA (MAGC1_HUMAN)
AIKDVEERI

SEQ ID NO: 82448 - protein, 9 aa, Artificial Sequence
  Description of Artificial Sequence: Synthetic peptide
  Seed: DALKDVEER (MAGC1_HUMAN)
DLLKDVEER

SEQ ID NO: 82449 - protein, 9 aa, Artificial Sequence
  Description of Artificial Sequence: Synthetic peptide
  Seed: VISRYTGYF (MAGC1_HUMAN)
VTSRYTGYF

SEQ ID NO: 82450 - protein, 9 aa, Artificial Sequence
  Description of Artificial Sequence: Synthetic peptide
  Seed: TSLSLPQSF (MAGC1_HUMAN)
TQLSLPQSF

SEQ ID NO: 82451 - protein, 9 aa, Artificial Sequence
  Description of Artificial Sequence: Synthetic peptide
  Seed: EDFQSSLQS (MAGC1_HUMAN)
EQFQSSLQL

SEQ ID NO: 82452 - protein, 9 aa, Artificial Sequence
  Description of Artificial Sequence: Synthetic peptide
  Seed: SLSPFSEES (MAGC1_HUMAN)
SASPFSEEL

SEQ ID NO: 82453 - protein, 9 aa, Artificial Sequence
  Description of Artificial Sequence: Synthetic peptide
  Seed: SPESDDTLY (MAGC1_HUMAN)
SVESDDTLY

SEQ ID NO: 82454 - protein, 10 aa, Artificial Sequence
  Description of Artificial Sequence: Synthetic peptide
  Seed: QSPLQIPVSR (MAGC1_HUMAN)
QTPLQIPVSK

SEQ ID NO: 82455 - protein, 9 aa, Artificial Sequence
  Description of Artificial Sequence: Synthetic peptide
  Seed: TLLSILQSS (MAGC1_HUMAN)
TVLSILQSV

SEQ ID NO: 82456 - protein, 9 aa, Artificial Sequence
  Description of Artificial Sequence: Synthetic peptide
  Seed: IESEPLFTY (MAGC1_HUMAN)
IASEPLFTI

SEQ ID NO: 82457 - protein, 10 aa, Artificial Sequence
  Description of Artificial Sequence: Synthetic peptide
  Seed: SSSSSTLLSL (MAGC1_HUMAN)
SASSSTLLSL

SEQ ID NO: 82458 - protein, 9 aa, Artificial Sequence
  Description of Artificial Sequence: Synthetic peptide
  Seed: ILILSIIFI (MAGC1_HUMAN)
IMILSIIFA

SEQ ID NO: 82459 - protein, 9 aa, Artificial Sequence
  Description of Artificial Sequence: Synthetic peptide
  Seed: RKAREFIEI (MAGC1_HUMAN)
RLAREFIEY

SEQ ID NO: 82460 - protein, 11 aa, Artificial Sequence
  Description of Artificial Sequence: Synthetic peptide
  Seed: SSFPSSTSSSL (MAGC1_HUMAN)
SMFPSSTSSSF

SEQ ID NO: 82461 - protein, 9 aa, Artificial Sequence
  Description of Artificial Sequence: Synthetic peptide
  Seed: VSAASSSTL (MAGC1_HUMAN)
VTAASSSTL

SEQ ID NO: 82462 - protein, 11 aa, Artificial Sequence
  Description of Artificial Sequence: Synthetic peptide
  Seed: FLAMLKNTVPI (MAGC1_HUMAN)
FEAMLKNTVPA

SEQ ID NO: 82463 - protein, 9 aa, Artificial Sequence
  Description of Artificial Sequence: Synthetic peptide
  Seed: TSLSLPQSF (MAGC1_HUMAN)
TWLSLPQSY

SEQ ID NO: 82464 - protein, 9 aa, Artificial Sequence
  Description of Artificial Sequence: Synthetic peptide
  Seed: YTGYFPVIF (MAGC1_HUMAN)
YAGYFPVIW

SEQ ID NO: 82465 - protein, 10 aa, Artificial Sequence
  Description of Artificial Sequence: Synthetic peptide
  Seed: RSFSSTLLSI (MAGC1_HUMAN)
RLFSSTLLST

SEQ ID NO: 82466 - protein, 10 aa, Artificial Sequence
  Description of Artificial Sequence: Synthetic peptide
  Seed: IIDTTDDSTA (MAGC1_HUMAN)
ITDTTDDSTI

SEQ ID NO: 82467 - protein, 9 aa, Artificial Sequence
  Description of Artificial Sequence: Synthetic peptide
  Seed: SESLIESEP (MAGC1_HUMAN)
SESLIESEL

SEQ ID NO: 82468 - protein, 9 aa, Artificial Sequence
  Description of Artificial Sequence: Synthetic peptide
  Seed: KVVEFLAML (MAGC1_HUMAN)
KSVEFLAMV

SEQ ID NO: 82469 - protein, 10 aa, Artificial Sequence
  Description of Artificial Sequence: Synthetic peptide
  Seed: DVLSGIGVRA (MAGC1_HUMAN)
DVLSGIGVRY

SEQ ID NO: 82470 - protein, 10 aa, Artificial Sequence
  Description of Artificial Sequence: Synthetic peptide
  Seed: PLQIPMTSSF (MAGC1_HUMAN)
PLQIPMTSSM

SEQ ID NO: 82471 - protein, 9 aa, Artificial Sequence
  Description of Artificial Sequence: Synthetic peptide
  Seed: SICSSSTSL (MAGC1_HUMAN)
SSCSSSTSY

SEQ ID NO: 82472 - protein, 10 aa, Artificial Sequence
  Description of Artificial Sequence: Synthetic peptide
  Seed: ASSFFSSALL (MAGC1_HUMAN)
AGSFFSSALY

SEQ ID NO: 82473 - protein, 9 aa, Artificial Sequence
  Description of Artificial Sequence: Synthetic peptide
  Seed: SQNRLLILI (MAGC1_HUMAN)
SMNRLLILL

SEQ ID NO: 82474 - protein, 9 aa, Artificial Sequence
  Description of Artificial Sequence: Synthetic peptide
  Seed: EFIEILFGI (MAGC1_HUMAN)
EVIEILFGI

SEQ ID NO: 82475 - protein, 10 aa, Artificial Sequence
  Description of Artificial Sequence: Synthetic peptide
  Seed: TGYFPVIFRK (MAGC1_HUMAN)
TYYFPVIFRK

SEQ ID NO: 82476 - protein, 10 aa, Artificial Sequence
  Description of Artificial Sequence: Synthetic peptide
  Seed: QGEDSLSPHY (MAGC1_HUMAN)
QLEDSLSPHY

SEQ ID NO: 82477 - protein, 11 aa, Artificial Sequence
  Description of Artificial Sequence: Synthetic peptide
  Seed: SFFSYTLASLL (MAGC1_HUMAN)
SNFSYTLASLF

SEQ ID NO: 82478 - protein, 9 aa, Artificial Sequence
  Description of Artificial Sequence: Synthetic peptide
  Seed: NSSPPRYEF (MAGC1_HUMAN)
NRSPPRYEF

SEQ ID NO: 82479 - protein, 9 aa, Artificial Sequence
  Description of Artificial Sequence: Synthetic peptide
  Seed: VSRSFSSTL (MAGC1_HUMAN)
VRRSFSSTM

SEQ ID NO: 82480 - protein, 9 aa, Artificial Sequence
  Description of Artificial Sequence: Synthetic peptide
  Seed: DSYVFVNTL (MAGC1_HUMAN)
DQYVFVNTF

SEQ ID NO: 82481 - protein, 10 aa, Artificial Sequence
  Description of Artificial Sequence: Synthetic peptide
  Seed: MSPLYFPQSP (MAGC1_HUMAN)
MDPLYFPQSV

SEQ ID NO: 82482 - protein, 9 aa, Artificial Sequence
  Description of Artificial Sequence: Synthetic peptide
  Seed: MPSLLQSSS (MAGC1_HUMAN)
MPSLLQSST

SEQ ID NO: 82483 - protein, 9 aa, Artificial Sequence
  Description of Artificial Sequence: Synthetic peptide
  Seed: LQIPVSRSF (MAGC1_HUMAN)
LQIPVSRSI

SEQ ID NO: 82484 - protein, 9 aa, Artificial Sequence
  Description of Artificial Sequence: Synthetic peptide
  Seed: RTHSTFEGF (MAGC1_HUMAN)
RMHSTFEGM

SEQ ID NO: 82485 - protein, 10 aa, Artificial Sequence
  Description of Artificial Sequence: Synthetic peptide
  Seed: YASEEVIWDV (MAGC1_HUMAN)
YMSEEVIWDS

SEQ ID NO: 82486 - protein, 9 aa, Artificial Sequence
  Description of Artificial Sequence: Synthetic peptide
  Seed: SSPECTQST (MAGC1_HUMAN)
STPECTQSL

SEQ ID NO: 82487 - protein, 9 aa, Artificial Sequence
  Description of Artificial Sequence: Synthetic peptide
  Seed: AMLKNTVPI (MAGC1_HUMAN)
AALKNTVPV

SEQ ID NO: 82488 - protein, 9 aa, Artificial Sequence
  Description of Artificial Sequence: Synthetic peptide
  Seed: FFSYTLASL (MAGC1_HUMAN)
FVSYTLASV

SEQ ID NO: 82489 - protein, 9 aa, Artificial Sequence
  Description of Artificial Sequence: Synthetic peptide
  Seed: LSDEQGMSQ (MAGC1_HUMAN)
LADEQGMSI

SEQ ID NO: 82490 - protein, 10 aa, Artificial Sequence
  Description of Artificial Sequence: Synthetic peptide
  Seed: FSSSTSLSPF (MAGC1_HUMAN)
FISSTSLSPY

SEQ ID NO: 82491 - protein, 11 aa, Artificial Sequence
  Description of Artificial Sequence: Synthetic peptide
  Seed: SLSQSSPVSSF (MAGC1_HUMAN)
STSQSSPVSSF

SEQ ID NO: 82492 - protein, 10 aa, Artificial Sequence
  Description of Artificial Sequence: Synthetic peptide
  Seed: VISFSSSTSL (MAGC1_HUMAN)
VQSFSSSTSY

SEQ ID NO: 82493 - protein, 9 aa, Artificial Sequence
  Description of Artificial Sequence: Synthetic peptide
  Seed: YPLQSPQSR (MAGC1_HUMAN)
YYLQSPQSR

SEQ ID NO: 82494 - protein, 9 aa, Artificial Sequence
  Description of Artificial Sequence: Synthetic peptide
  Seed: IPVSSSSSS (MAGC1_HUMAN)
IPVSSSSSA

SEQ ID NO: 82495 - protein, 11 aa, Artificial Sequence
  Description of Artificial Sequence: Synthetic peptide
  Seed: REVDPDDSYVF (MAGC1_HUMAN)
RLVDPDDSYVY

SEQ ID NO: 82496 - protein, 10 aa, Artificial Sequence
  Description of Artificial Sequence: Synthetic peptide
  Seed: LQIPMTSSFS (MAGC1_HUMAN)
LQIPMTSSFE

SEQ ID NO: 82497 - protein, 11 aa, Artificial Sequence
  Description of Artificial Sequence: Synthetic peptide
  Seed: IPVSPSSSSTL (MAGC1_HUMAN)
IIVSPSSSSTY

SEQ ID NO: 82498 - protein, 10 aa, Artificial Sequence
  Description of Artificial Sequence: Synthetic peptide
  Seed: KDVEERAQAI (MAGC1_HUMAN)
KEVEERAQAL

SEQ ID NO: 82499 - protein, 9 aa, Artificial Sequence
  Description of Artificial Sequence: Synthetic peptide
  Seed: QIVPSLPEW (MAGC1_HUMAN)
QAVPSLPEY

SEQ ID NO: 82500 - protein, 11 aa, Artificial Sequence
  Description of Artificial Sequence: Synthetic peptide
  Seed: RSFSSTLLSIF (MAGC1_HUMAN)
RFFSSTLLSIF

SEQ ID NO: 82501 - protein, 11 aa, Artificial Sequence
  Description of Artificial Sequence: Synthetic peptide
  Seed: IIDTTDDSTAT (MAGC1_HUMAN)
ICDTTDDSTAM

SEQ ID NO: 82502 - protein, 9 aa, Artificial Sequence
  Description of Artificial Sequence: Synthetic peptide
  Seed: LQIPVSRSF (MAGC1_HUMAN)
LKIPVSRSF

SEQ ID NO: 82503 - protein, 11 aa, Artificial Sequence
  Description of Artificial Sequence: Synthetic peptide
  Seed: SPQSPPEGPAQ (MAGC1_HUMAN)
SPQSPPEGPAA

SEQ ID NO: 82504 - protein, 10 aa, Artificial Sequence
  Description of Artificial Sequence: Synthetic peptide
  Seed: LQIPGSPSFS (MAGC1_HUMAN)
LQIPGSPSFE

SEQ ID NO: 82505 - protein, 9 aa, Artificial Sequence
  Description of Artificial Sequence: Synthetic peptide
  Seed: SSPESAQSA (MAGC1_HUMAN)
SHPESAQSL

SEQ ID NO: 82506 - protein, 9 aa, Artificial Sequence
  Description of Artificial Sequence: Synthetic peptide
  Seed: SPLQIVPSL (MAGC1_HUMAN)
SLLQIVPSM

SEQ ID NO: 82507 - protein, 11 aa, Artificial Sequence
  Description of Artificial Sequence: Synthetic peptide
  Seed: RPVSSFFSYTL (MAGC1_HUMAN)
RMVSSFFSYTF

SEQ ID NO: 82508 - protein, 9 aa, Artificial Sequence
  Description of Artificial Sequence: Synthetic peptide
  Seed: LSDEQGMSQ (MAGC1_HUMAN)
LGDEQGMSI

SEQ ID NO: 82509 - protein, 9 aa, Artificial Sequence
  Description of Artificial Sequence: Synthetic peptide
  Seed: VIFRKAREF (MAGC1_HUMAN)
VKFRKAREF

SEQ ID NO: 82510 - protein, 11 aa, Artificial Sequence
  Description of Artificial Sequence: Synthetic peptide
  Seed: MSPLYFPQSPL (MAGC1_HUMAN)
MNPLYFPQSPV

SEQ ID NO: 82511 - protein, 11 aa, Artificial Sequence
  Description of Artificial Sequence: Synthetic peptide
  Seed: SSFPSSTSSSL (MAGC1_HUMAN)
SSFPSSTSSSY

SEQ ID NO: 82512 - protein, 8 aa, Artificial Sequence
  Description of Artificial Sequence: Synthetic peptide
  Seed: FSYTLASL (MAGC1_HUMAN)
FQYTLASL

SEQ ID NO: 82513 - protein, 10 aa, Artificial Sequence
  Description of Artificial Sequence: Synthetic peptide
  Seed: PLQIPVSSSF (MAGC1_HUMAN)
PVQIPVSSSM

SEQ ID NO: 82514 - protein, 9 aa, Artificial Sequence
  Description of Artificial Sequence: Synthetic peptide
  Seed: IEILFGISL (MAGC1_HUMAN)
IHILFGISA

SEQ ID NO: 82515 - protein, 10 aa, Artificial Sequence
  Description of Artificial Sequence: Synthetic peptide
  Seed: FSSSTSLSPF (MAGC1_HUMAN)
FWSSTSLSPF

SEQ ID NO: 82516 - protein, 11 aa, Artificial Sequence
  Description of Artificial Sequence: Synthetic peptide
  Seed: LQIPGSPSFSS (MAGC1_HUMAN)
LMIPGSPSFSY

SEQ ID NO: 82517 - protein, 10 aa, Artificial Sequence
  Description of Artificial Sequence: Synthetic peptide
  Seed: PLQIPVSSSF (MAGC1_HUMAN)
PLQIPVSSSM

SEQ ID NO: 82518 - protein, 10 aa, Artificial Sequence
  Description of Artificial Sequence: Synthetic peptide
  Seed: LQIPMTSSFS (MAGC1_HUMAN)
LEIPMTSSFF

SEQ ID NO: 82519 - protein, 9 aa, Artificial Sequence
  Description of Artificial Sequence: Synthetic peptide
  Seed: GEDSLSPHY (MAGC1_HUMAN)
GSDSLSPHY

SEQ ID NO: 82520 - protein, 9 aa, Artificial Sequence
  Description of Artificial Sequence: Synthetic peptide
  Seed: ASSFFSSAL (MAGC1_HUMAN)
AMSFFSSAW

SEQ ID NO: 82521 - protein, 10 aa, Artificial Sequence
  Description of Artificial Sequence: Synthetic peptide
  Seed: MPTAGMPSLL (MAGC1_HUMAN)
MWTAGMPSLV

SEQ ID NO: 82522 - protein, 11 aa, Artificial Sequence
  Description of Artificial Sequence: Synthetic peptide
  Seed: LQIPVSSSFSY (MAGC1_HUMAN)
LMIPVSSSFSW

SEQ ID NO: 82523 - protein, 10 aa, Artificial Sequence
  Description of Artificial Sequence: Synthetic peptide
  Seed: YTLASLLQSS (MAGC1_HUMAN)
YALASLLQSM

SEQ ID NO: 82524 - protein, 9 aa, Artificial Sequence
  Description of Artificial Sequence: Synthetic peptide
  Seed: SSFSYTLLS (MAGC1_HUMAN)
SMFSYTLLK

SEQ ID NO: 82525 - protein, 9 aa, Artificial Sequence
  Description of Artificial Sequence: Synthetic peptide
  Seed: HYFPQSPPQ (MAGC1_HUMAN)
HYFPQSPPL

SEQ ID NO: 82526 - protein, 9 aa, Artificial Sequence
  Description of Artificial Sequence: Synthetic peptide
  Seed: FSSTLVSLF (MAGC1_HUMAN)
FMSTLVSLY

SEQ ID NO: 82527 - protein, 10 aa, Artificial Sequence
  Description of Artificial Sequence: Synthetic peptide
  Seed: RYTGYFPVIF (MAGC1_HUMAN)
RMTGYFPVIF

SEQ ID NO: 82528 - protein, 9 aa, Artificial Sequence
  Description of Artificial Sequence: Synthetic peptide
  Seed: SSPECTQST (MAGC1_HUMAN)
SSPECTQSF

SEQ ID NO: 82529 - protein, 9 aa, Artificial Sequence
  Description of Artificial Sequence: Synthetic peptide
  Seed: LQIPVSRSF (MAGC1_HUMAN)
LYIPVSRSL

SEQ ID NO: 82530 - protein, 9 aa, Artificial Sequence
  Description of Artificial Sequence: Synthetic peptide
  Seed: VSRSFSSTL (MAGC1_HUMAN)
VRRSFSSTF

SEQ ID NO: 82531 - protein, 10 aa, Artificial Sequence
  Description of Artificial Sequence: Synthetic peptide
  Seed: MSPLYFPQSP (MAGC1_HUMAN)
MLPLYFPQSA

SEQ ID NO: 82532 - protein, 9 aa, Artificial Sequence
  Description of Artificial Sequence: Synthetic peptide
  Seed: VSSFFSYTL (MAGC1_HUMAN)
VESFFSYTF

SEQ ID NO: 82533 - protein, 9 aa, Artificial Sequence
  Description of Artificial Sequence: Synthetic peptide
  Seed: FQSSPERTH (MAGC1_HUMAN)
FISSPERTM

SEQ ID NO: 82534 - protein, 10 aa, Artificial Sequence
  Description of Artificial Sequence: Synthetic peptide
  Seed: SPLQIPVSPS (MAGC1_HUMAN)
SPLQIPVSPM

SEQ ID NO: 82535 - protein, 9 aa, Artificial Sequence
  Description of Artificial Sequence: Synthetic peptide
  Seed: KVDELARFL (MAGC1_HUMAN)
KMDELARFL

SEQ ID NO: 82536 - protein, 9 aa, Artificial Sequence
  Description of Artificial Sequence: Synthetic peptide
  Seed: FQSSLQSPV (MAGC1_HUMAN)
FMSSLQSPI

SEQ ID NO: 82537 - protein, 9 aa, Artificial Sequence
  Description of Artificial Sequence: Synthetic peptide
  Seed: LQNPASSFF (MAGC1_HUMAN)
LYNPASSFI

SEQ ID NO: 82538 - protein, 10 aa, Artificial Sequence
  Description of Artificial Sequence: Synthetic peptide
  Seed: SRYTGYFPVI (MAGC1_HUMAN)
SCYTGYFPVF

SEQ ID NO: 82539 - protein, 9 aa, Artificial Sequence
  Description of Artificial Sequence: Synthetic peptide
  Seed: FFSSALLSI (MAGC1_HUMAN)
FYSSALLSL

SEQ ID NO: 82540 - protein, 10 aa, Artificial Sequence
  Description of Artificial Sequence: Synthetic peptide
  Seed: FAQSSLQIPV (MAGC1_HUMAN)
FMQSSLQIPV

SEQ ID NO: 82541 - protein, 9 aa, Artificial Sequence
  Description of Artificial Sequence: Synthetic peptide
  Seed: SSHESPQSP (MAGC1_HUMAN)
SSHESPQSH

SEQ ID NO: 82542 - protein, 9 aa, Artificial Sequence
  Description of Artificial Sequence: Synthetic peptide
  Seed: TLDEKVDEL (MAGC1_HUMAN)
TWDEKVDEV

SEQ ID NO: 82543 - protein, 10 aa, Artificial Sequence
  Description of Artificial Sequence: Synthetic peptide
  Seed: EILFGISLRE (MAGC1_HUMAN)
EWLFGISLRK

SEQ ID NO: 82544 - protein, 9 aa, Artificial Sequence
  Description of Artificial Sequence: Synthetic peptide
  Seed: GTYASEEVI (MAGC1_HUMAN)
GQYASEEVV

SEQ ID NO: 82545 - protein, 8 aa, Artificial Sequence
  Description of Artificial Sequence: Synthetic peptide
  Seed: IWDVLSGI (MAGC1_HUMAN)
IADVLSGV

SEQ ID NO: 82546 - protein, 11 aa, Artificial Sequence
  Description of Artificial Sequence: Synthetic peptide
  Seed: TVPITFPSSYK (MAGC1_HUMAN)
TAPITFPSSYR

SEQ ID NO: 82547 - protein, 10 aa, Artificial Sequence
  Description of Artificial Sequence: Synthetic peptide
  Seed: SSPESTQSPF (MAGC1_HUMAN)
SMPESTQSPM

SEQ ID NO: 82548 - protein, 8 aa, Artificial Sequence
  Description of Artificial Sequence: Synthetic peptide
  Seed: AFGEPREL (MAGC1_HUMAN)
AYGEPREL

SEQ ID NO: 82549 - protein, 10 aa, Artificial Sequence
  Description of Artificial Sequence: Synthetic peptide
  Seed: ASSFFSSALL (MAGC1_HUMAN)
ANSFFSSALW

SEQ ID NO: 82550 - protein, 10 aa, Artificial Sequence
  Description of Artificial Sequence: Synthetic peptide
  Seed: LLQIPMTSSF (MAGC1_HUMAN)
LFQIPMTSSF

SEQ ID NO: 82551 - protein, 10 aa, Artificial Sequence
  Description of Artificial Sequence: Synthetic peptide
  Seed: VWVQEHYLEY (MAGC1_HUMAN)
VYVQEHYLEY

SEQ ID NO: 82552 - protein, 9 aa, Artificial Sequence
  Description of Artificial Sequence: Synthetic peptide
  Seed: SPLQRPVSS (MAGC1_HUMAN)
SLLQRPVSL

SEQ ID NO: 82553 - protein, 10 aa, Artificial Sequence
  Description of Artificial Sequence: Synthetic peptide
  Seed: FFSYTLASLL (MAGC1_HUMAN)
FQSYTLASLY

SEQ ID NO: 82554 - protein, 9 aa, Artificial Sequence
  Description of Artificial Sequence: Synthetic peptide
  Seed: ASSFFSSAL (MAGC1_HUMAN)
AFSFFSSAF

SEQ ID NO: 82555 - protein, 9 aa, Artificial Sequence
  Description of Artificial Sequence: Synthetic peptide
  Seed: LQIPVSPSF (MAGC1_HUMAN)
LTIPVSPSF

SEQ ID NO: 82556 - protein, 9 aa, Artificial Sequence
  Description of Artificial Sequence: Synthetic peptide
  Seed: FTYTLDEKV (MAGC1_HUMAN)
FMYTLDEKT

SEQ ID NO: 82557 - protein, 11 aa, Artificial Sequence
  Description of Artificial Sequence: Synthetic peptide
  Seed: SAASSSTLVSI (MAGC1_HUMAN)
SQASSSTLVSL

SEQ ID NO: 82558 - protein, 9 aa, Artificial Sequence
  Description of Artificial Sequence: Synthetic peptide
  Seed: RSFSSTLLS (MAGC1_HUMAN)
RMFSSTLLW

SEQ ID NO: 82559 - protein, 10 aa, Artificial Sequence
  Description of Artificial Sequence: Synthetic peptide
  Seed: SLQIPVSPSF (MAGC1_HUMAN)
STQIPVSPSY

SEQ ID NO: 82560 - protein, 9 aa, Artificial Sequence
  Description of Artificial Sequence: Synthetic peptide
  Seed: LQIPVSRSF (MAGC1_HUMAN)
LTIPVSRSV

SEQ ID NO: 82561 - protein, 9 aa, Artificial Sequence
  Description of Artificial Sequence: Synthetic peptide
  Seed: SQSSPVSSF (MAGC1_HUMAN)
SFSSPVSSV

SEQ ID NO: 82562 - protein, 9 aa, Artificial Sequence
  Description of Artificial Sequence: Synthetic peptide
  Seed: SSSVMSPSF (MAGC1_HUMAN)
STSVMSPSL

SEQ ID NO: 82563 - protein, 9 aa, Artificial Sequence
  Description of Artificial Sequence: Synthetic peptide
  Seed: IPVSSSFSY (MAGC1_HUMAN)
IEVSSSFSF

SEQ ID NO: 82564 - protein, 9 aa, Artificial Sequence
  Description of Artificial Sequence: Synthetic peptide
  Seed: SSSTLLSLF (MAGC1_HUMAN)
SQSTLLSLM

SEQ ID NO: 82565 - protein, 9 aa, Artificial Sequence
  Description of Artificial Sequence: Synthetic peptide
  Seed: FQSSLQSPV (MAGC1_HUMAN)
FISSLQSPV

SEQ ID NO: 82566 - protein, 11 aa, Artificial Sequence
  Description of Artificial Sequence: Synthetic peptide
  Seed: SLIESEPLFTY (MAGC1_HUMAN)
SFIESEPLFTY

SEQ ID NO: 82567 - protein, 10 aa, Artificial Sequence
  Description of Artificial Sequence: Synthetic peptide
  Seed: QIPVSSSFSY (MAGC1_HUMAN)
QEPVSSSFSY

SEQ ID NO: 82568 - protein, 8 aa, Artificial Sequence
  Description of Artificial Sequence: Synthetic peptide
  Seed: IKRKVVEF (MAGC1_HUMAN)
IQRKVVEY

SEQ ID NO: 82569 - protein, 10 aa, Artificial Sequence
  Description of Artificial Sequence: Synthetic peptide
  Seed: QIPVSSSFSY (MAGC1_HUMAN)
QHPVSSSFSY

SEQ ID NO: 82570 - protein, 11 aa, Artificial Sequence
  Description of Artificial Sequence: Synthetic peptide
  Seed: LQRPVSSFFSY (MAGC1_HUMAN)
LDRPVSSFFSY

SEQ ID NO: 82571 - protein, 10 aa, Artificial Sequence
  Description of Artificial Sequence: Synthetic peptide
  Seed: ISRYTGYFPV (MAGC1_HUMAN)
IDRYTGYFPL

SEQ ID NO: 82572 - protein, 10 aa, Artificial Sequence
  Description of Artificial Sequence: Synthetic peptide
  Seed: IIDTTDDSTA (MAGC1_HUMAN)
ITDTTDDSTL

SEQ ID NO: 82573 - protein, 9 aa, Artificial Sequence
  Description of Artificial Sequence: Synthetic peptide
  Seed: FLWGPRAHS (MAGC1_HUMAN)
FIWGPRAHV

SEQ ID NO: 82574 - protein, 9 aa, Artificial Sequence
  Description of Artificial Sequence: Synthetic peptide
  Seed: TSLSLPQSF (MAGC1_HUMAN)
TTLSLPQSM

SEQ ID NO: 82575 - protein, 9 aa, Artificial Sequence
  Description of Artificial Sequence: Synthetic peptide
  Seed: ESSSPVDEY (MAGC1_HUMAN)
EISSPVDEF

SEQ ID NO: 82576 - protein, 9 aa, Artificial Sequence
  Description of Artificial Sequence: Synthetic peptide
  Seed: MGDKDMPTA (MAGC1_HUMAN)
MGDKDMPTF

SEQ ID NO: 82577 - protein, 10 aa, Artificial Sequence
  Description of Artificial Sequence: Synthetic peptide
  Seed: MPTAGMPSLL (MAGC1_HUMAN)
MGTAGMPSLI

SEQ ID NO: 82578 - protein, 11 aa, Artificial Sequence
  Description of Artificial Sequence: Synthetic peptide
  Seed: ISRYTGYFPVI (MAGC1_HUMAN)
IVRYTGYFPVF

SEQ ID NO: 82579 - protein, 11 aa, Artificial Sequence
  Description of Artificial Sequence: Synthetic peptide
  Seed: IPVSAASSSTL (MAGC1_HUMAN)
IQVSAASSSTW

SEQ ID NO: 82580 - protein, 9 aa, Artificial Sequence
  Description of Artificial Sequence: Synthetic peptide
  Seed: FSYTLASLL (MAGC1_HUMAN)
FLYTLASLA

SEQ ID NO: 82581 - protein, 9 aa, Artificial Sequence
  Description of Artificial Sequence: Synthetic peptide
  Seed: EFIEILFGI (MAGC1_HUMAN)
ESIEILFGA

SEQ ID NO: 82582 - protein, 9 aa, Artificial Sequence
  Description of Artificial Sequence: Synthetic peptide
  Seed: SLPEWEDSL (MAGC1_HUMAN)
SHPEWEDSI

SEQ ID NO: 82583 - protein, 10 aa, Artificial Sequence
  Description of Artificial Sequence: Synthetic peptide
  Seed: LAMLKNTVPI (MAGC1_HUMAN)
LKMLKNTVPL

SEQ ID NO: 82584 - protein, 8 aa, Artificial Sequence
  Description of Artificial Sequence: Synthetic peptide
  Seed: FSSALLSI (MAGC1_HUMAN)
FASALLSY

SEQ ID NO: 82585 - protein, 9 aa, Artificial Sequence
  Description of Artificial Sequence: Synthetic peptide
  Seed: VIKRKVVEF (MAGC1_HUMAN)
VMKRKVVEI

SEQ ID NO: 82586 - protein, 9 aa, Artificial Sequence
  Description of Artificial Sequence: Synthetic peptide
  Seed: SPLQSPVSS (MAGC1_HUMAN)
SALQSPVSV

SEQ ID NO: 82587 - protein, 10 aa, Artificial Sequence
  Description of Artificial Sequence: Synthetic peptide
  Seed: WGPRAHSEVI (MAGC1_HUMAN)
WEPRAHSEVI

SEQ ID NO: 82588 - protein, 10 aa, Artificial Sequence
  Description of Artificial Sequence: Synthetic peptide
  Seed: LQIPGSPSFS (MAGC1_HUMAN)
LRIPGSPSFF

SEQ ID NO: 82589 - protein, 10 aa, Artificial Sequence
  Description of Artificial Sequence: Synthetic peptide
  Seed: VSSSSSSSTL (MAGC1_HUMAN)
VMSSSSSSTW

SEQ ID NO: 82590 - protein, 10 aa, Artificial Sequence
  Description of Artificial Sequence: Synthetic peptide
  Seed: VSSSFSYTLL (MAGC1_HUMAN)
VMSSFSYTLF

SEQ ID NO: 82591 - protein, 10 aa, Artificial Sequence
  Description of Artificial Sequence: Synthetic peptide
  Seed: SSFSSTLLSI (MAGC1_HUMAN)
SIFSSTLLSF

SEQ ID NO: 82592 - protein, 9 aa, Artificial Sequence
  Description of Artificial Sequence: Synthetic peptide
  Seed: FSSTLVSLF (MAGC1_HUMAN)
FTSTLVSLM

SEQ ID NO: 82593 - protein, 9 aa, Artificial Sequence
  Description of Artificial Sequence: Synthetic peptide
  Seed: IPVSAASSS (MAGC1_HUMAN)
IAVSAASSY

SEQ ID NO: 82594 - protein, 9 aa, Artificial Sequence
  Description of Artificial Sequence: Synthetic peptide
  Seed: YTSSSDTLL (MAGC1_HUMAN)
YMSSSDTLI

SEQ ID NO: 82595 - protein, 9 aa, Artificial Sequence
  Description of Artificial Sequence: Synthetic peptide
  Seed: SSSVMSPSF (MAGC1_HUMAN)
SMSVMSPSY

SEQ ID NO: 82596 - protein, 9 aa, Artificial Sequence
  Description of Artificial Sequence: Synthetic peptide
  Seed: EFIEILFGI (MAGC1_HUMAN)
EMIEILFGL

SEQ ID NO: 82597 - protein, 9 aa, Artificial Sequence
  Description of Artificial Sequence: Synthetic peptide
  Seed: ESSSPVDEY (MAGC1_HUMAN)
ETSSPVDEY

SEQ ID NO: 82598 - protein, 9 aa, Artificial Sequence
  Description of Artificial Sequence: Synthetic peptide
  Seed: SSSSSSSTL (MAGC1_HUMAN)
SASSSSSTL

SEQ ID NO: 82599 - protein, 9 aa, Artificial Sequence
  Description of Artificial Sequence: Synthetic peptide
  Seed: VSPSFSSTL (MAGC1_HUMAN)
VSPSFSSTF

SEQ ID NO: 82600 - protein, 9 aa, Artificial Sequence
  Description of Artificial Sequence: Synthetic peptide
  Seed: LSPLHFPQF (MAGC1_HUMAN)
LMPLHFPQL

SEQ ID NO: 82601 - protein, 9 aa, Artificial Sequence
  Description of Artificial Sequence: Synthetic peptide
  Seed: AQSPLQRPV (MAGC1_HUMAN)
AISPLQRPV

SEQ ID NO: 82602 - protein, 11 aa, Artificial Sequence
  Description of Artificial Sequence: Synthetic peptide
  Seed: SSFPSSTSSSL (MAGC1_HUMAN)
SIFPSSTSSSW

SEQ ID NO: 82603 - protein, 11 aa, Artificial Sequence
  Description of Artificial Sequence: Synthetic peptide
  Seed: SSFPSSTSSSL (MAGC1_HUMAN)
SPFPSSTSSSL

SEQ ID NO: 82604 - protein, 9 aa, Artificial Sequence
  Description of Artificial Sequence: Synthetic peptide
  Seed: VPITFPSSY (MAGC1_HUMAN)
VTITFPSSF

SEQ ID NO: 82605 - protein, 9 aa, Artificial Sequence
  Description of Artificial Sequence: Synthetic peptide
  Seed: FFSSALLSI (MAGC1_HUMAN)
FVSSALLSA

SEQ ID NO: 82606 - protein, 11 aa, Artificial Sequence
  Description of Artificial Sequence: Synthetic peptide
  Seed: SPLQIPVSPSS (MAGC1_HUMAN)
STLQIPVSPSY

SEQ ID NO: 82607 - protein, 11 aa, Artificial Sequence
  Description of Artificial Sequence: Synthetic peptide
  Seed: REVDPDDSYVF (MAGC1_HUMAN)
REVDPDDSYVA

SEQ ID NO: 82608 - protein, 10 aa, Artificial Sequence
  Description of Artificial Sequence: Synthetic peptide
  Seed: WGPRAHSEVI (MAGC1_HUMAN)
WGPRAHSEVL

SEQ ID NO: 82609 - protein, 10 aa, Artificial Sequence
  Description of Artificial Sequence: Synthetic peptide
  Seed: RYTGYFPVIF (MAGC1_HUMAN)
RYTGYFPVII

SEQ ID NO: 82610 - protein, 10 aa, Artificial Sequence
  Description of Artificial Sequence: Synthetic peptide
  Seed: ASSFFSSALL (MAGC1_HUMAN)
ATSFFSSALV

SEQ ID NO: 82611 - protein, 9 aa, Artificial Sequence
  Description of Artificial Sequence: Synthetic peptide
  Seed: LQIPGSPSF (MAGC1_HUMAN)
LNIPGSPSL

SEQ ID NO: 82612 - protein, 9 aa, Artificial Sequence
  Description of Artificial Sequence: Synthetic peptide
  Seed: SSPERTQST (MAGC1_HUMAN)
SYPERTQSF

SEQ ID NO: 82613 - protein, 10 aa, Artificial Sequence
  Description of Artificial Sequence: Synthetic peptide
  Seed: VSSSSSSTLL (MAGC1_HUMAN)
VSSSSSSTLY

SEQ ID NO: 82614 - protein, 10 aa, Artificial Sequence
  Description of Artificial Sequence: Synthetic peptide
  Seed: RSFSSTLLSI (MAGC1_HUMAN)
RLFSSTLLSV

SEQ ID NO: 82615 - protein, 8 aa, Artificial Sequence
  Description of Artificial Sequence: Synthetic peptide
  Seed: LQNPASSF (MAGC1_HUMAN)
LQNPASSM

SEQ ID NO: 82616 - protein, 10 aa, Artificial Sequence
  Description of Artificial Sequence: Synthetic peptide
  Seed: LILILSIIFI (MAGC1_HUMAN)
LVLILSIIFV

SEQ ID NO: 82617 - protein, 9 aa, Artificial Sequence
  Description of Artificial Sequence: Synthetic peptide
  Seed: TFEGFPQSL (MAGC1_HUMAN)
TSEGFPQSF

SEQ ID NO: 82618 - protein, 9 aa, Artificial Sequence
  Description of Artificial Sequence: Synthetic peptide
  Seed: KQPITKAEM (MAGC1_HUMAN)
KQPITKAEY

SEQ ID NO: 82619 - protein, 9 aa, Artificial Sequence
  Description of Artificial Sequence: Synthetic peptide
  Seed: LQIPVSPSF (MAGC1_HUMAN)
LVIPVSPSM

SEQ ID NO: 82620 - protein, 9 aa, Artificial Sequence
  Description of Artificial Sequence: Synthetic peptide
  Seed: MGDKDMPTA (MAGC1_HUMAN)
MFDKDMPTF

SEQ ID NO: 82621 - protein, 11 aa, Artificial Sequence
  Description of Artificial Sequence: Synthetic peptide
  Seed: IPVSRSFSSTL (MAGC1_HUMAN)
IWVSRSFSSTY

SEQ ID NO: 82622 - protein, 9 aa, Artificial Sequence
  Description of Artificial Sequence: Synthetic peptide
  Seed: IPVSRSFSS (MAGC1_HUMAN)
IPVSRSFSM

SEQ ID NO: 82623 - protein, 10 aa, Artificial Sequence
  Description of Artificial Sequence: Synthetic peptide
  Seed: FFSYTLASLL (MAGC1_HUMAN)
FISYTLASLM

SEQ ID NO: 82624 - protein, 10 aa, Artificial Sequence
  Description of Artificial Sequence: Synthetic peptide
  Seed: VPITFPSSYK (MAGC1_HUMAN)
VCITFPSSYR

SEQ ID NO: 82625 - protein, 9 aa, Artificial Sequence
  Description of Artificial Sequence: Synthetic peptide
  Seed: SSTSSSLSK (MAGC1_HUMAN)
SITSSSLSR

SEQ ID NO: 82626 - protein, 9 aa, Artificial Sequence
  Description of Artificial Sequence: Synthetic peptide
  Seed: ASSSTLVSI (MAGC1_HUMAN)
AMSSTLVSM

SEQ ID NO: 82627 - protein, 9 aa, Artificial Sequence
  Description of Artificial Sequence: Synthetic peptide
  Seed: SSSESPQSC (MAGC1_HUMAN)
SVSESPQSV

SEQ ID NO: 82628 - protein, 9 aa, Artificial Sequence
  Description of Artificial Sequence: Synthetic peptide
  Seed: FSSTLLSIL (MAGC1_HUMAN)
FMSTLLSIL

SEQ ID NO: 82629 - protein, 9 aa, Artificial Sequence
  Description of Artificial Sequence: Synthetic peptide
  Seed: SPPEGENTH (MAGC1_HUMAN)
SLPEGENTY

SEQ ID NO: 82630 - protein, 10 aa, Artificial Sequence
  Description of Artificial Sequence: Synthetic peptide
  Seed: KGTYASEEVI (MAGC1_HUMAN)
KKTYASEEVF

SEQ ID NO: 82631 - protein, 10 aa, Artificial Sequence
  Description of Artificial Sequence: Synthetic peptide
  Seed: LAMLKNTVPI (MAGC1_HUMAN)
LSMLKNTVPY

SEQ ID NO: 82632 - protein, 9 aa, Artificial Sequence
  Description of Artificial Sequence: Synthetic peptide
  Seed: FAFGEPREL (MAGC1_HUMAN)
FWFGEPREV

SEQ ID NO: 82633 - protein, 9 aa, Artificial Sequence
  Description of Artificial Sequence: Synthetic peptide
  Seed: KAREFIEIL (MAGC1_HUMAN)
KIREFIEIK

SEQ ID NO: 82634 - protein, 10 aa, Artificial Sequence
  Description of Artificial Sequence: Synthetic peptide
  Seed: LQIPVSRSFS (MAGC1_HUMAN)
LVIPVSRSFY

SEQ ID NO: 82635 - protein, 9 aa, Artificial Sequence
  Description of Artificial Sequence: Synthetic peptide
  Seed: LSPLHFPQF (MAGC1_HUMAN)
LIPLHFPQL

SEQ ID NO: 82636 - protein, 9 aa, Artificial Sequence
  Description of Artificial Sequence: Synthetic peptide
  Seed: TLVSLFQSS (MAGC1_HUMAN)
TMVSLFQSI

SEQ ID NO: 82637 - protein, 10 aa, Artificial Sequence
  Description of Artificial Sequence: Synthetic peptide
  Seed: LQIPVSSSFS (MAGC1_HUMAN)
LSIPVSSSFF

SEQ ID NO: 82638 - protein, 9 aa, Artificial Sequence
  Description of Artificial Sequence: Synthetic peptide
  Seed: VSSSSSSTL (MAGC1_HUMAN)
VKSSSSSTM

SEQ ID NO: 82639 - protein, 9 aa, Artificial Sequence
  Description of Artificial Sequence: Synthetic peptide
  Seed: AQSPLQSPV (MAGC1_HUMAN)
ASSPLQSPL

SEQ ID NO: 82640 - protein, 10 aa, Artificial Sequence
  Description of Artificial Sequence: Synthetic peptide
  Seed: SRYTGYFPVI (MAGC1_HUMAN)
SFYTGYFPVY

SEQ ID NO: 82641 - protein, 10 aa, Artificial Sequence
  Description of Artificial Sequence: Synthetic peptide
  Seed: QRPVSSFFSY (MAGC1_HUMAN)
QYPVSSFFSM

SEQ ID NO: 82642 - protein, 9 aa, Artificial Sequence
  Description of Artificial Sequence: Synthetic peptide
  Seed: SLTDSESLI (MAGC1_HUMAN)
SLTDSESLL

SEQ ID NO: 82643 - protein, 10 aa, Artificial Sequence
  Description of Artificial Sequence: Synthetic peptide
  Seed: SPLQNPASSF (MAGC1_HUMAN)
SILQNPASSY

SEQ ID NO: 82644 - protein, 9 aa, Artificial Sequence
  Description of Artificial Sequence: Synthetic peptide
  Seed: MSQNRLLIL (MAGC1_HUMAN)
MFQNRLLIM

SEQ ID NO: 82645 - protein, 9 aa, Artificial Sequence
  Description of Artificial Sequence: Synthetic peptide
  Seed: LQNPASSFF (MAGC1_HUMAN)
LVNPASSFL

SEQ ID NO: 82646 - protein, 10 aa, Artificial Sequence
  Description of Artificial Sequence: Synthetic peptide
  Seed: TGYFPVIFRK (MAGC1_HUMAN)
TAYFPVIFRL

SEQ ID NO: 82647 - protein, 9 aa, Artificial Sequence
  Description of Artificial Sequence: Synthetic peptide
  Seed: LQIPMTSSF (MAGC1_HUMAN)
LSIPMTSSV

SEQ ID NO: 82648 - protein, 9 aa, Artificial Sequence
  Description of Artificial Sequence: Synthetic peptide
  Seed: ASSFFSSAL (MAGC1_HUMAN)
ARSFFSSAY

SEQ ID NO: 82649 - protein, 9 aa, Artificial Sequence
  Description of Artificial Sequence: Synthetic peptide
  Seed: RLLILILSI (MAGC1_HUMAN)
RQLILILSI

SEQ ID NO: 82650 - protein, 10 aa, Artificial Sequence
  Description of Artificial Sequence: Synthetic peptide
  Seed: KAEMLTNVIS (MAGC1_HUMAN)
KREMLTNVIA

SEQ ID NO: 82651 - protein, 9 aa, Artificial Sequence
  Description of Artificial Sequence: Synthetic peptide
  Seed: SAQSAFEGF (MAGC1_HUMAN)
SLQSAFEGL

SEQ ID NO: 82652 - protein, 9 aa, Artificial Sequence
  Description of Artificial Sequence: Synthetic peptide
  Seed: VSSSFSYTL (MAGC1_HUMAN)
VKSSFSYTY

SEQ ID NO: 82653 - protein, 10 aa, Artificial Sequence
  Description of Artificial Sequence: Synthetic peptide
  Seed: SRYTGYFPVI (MAGC1_HUMAN)
SQYTGYFPVM

SEQ ID NO: 82654 - protein, 11 aa, Artificial Sequence
  Description of Artificial Sequence: Synthetic peptide
  Seed: IPVSSSSSSTL (MAGC1_HUMAN)
ITVSSSSSSTF

SEQ ID NO: 82655 - protein, 9 aa, Artificial Sequence
  Description of Artificial Sequence: Synthetic peptide
  Seed: DSYVFVNTL (MAGC1_HUMAN)
DTYVFVNTL

SEQ ID NO: 82656 - protein, 9 aa, Artificial Sequence
  Description of Artificial Sequence: Synthetic peptide
  Seed: LKNTVPITF (MAGC1_HUMAN)
LSNTVPITL

SEQ ID NO: 82657 - protein, 9 aa, Artificial Sequence
  Description of Artificial Sequence: Synthetic peptide
  Seed: FSSTLVSLF (MAGC1_HUMAN)
FLSTLVSLW

SEQ ID NO: 82658 - protein, 10 aa, Artificial Sequence
  Description of Artificial Sequence: Synthetic peptide
  Seed: EVIWDVLSGI (MAGC1_HUMAN)
EIIWDVLSGV

SEQ ID NO: 82659 - protein, 9 aa, Artificial Sequence
  Description of Artificial Sequence: Synthetic peptide
  Seed: RTHSTFEGF (MAGC1_HUMAN)
RFHSTFEGK

SEQ ID NO: 82660 - protein, 9 aa, Artificial Sequence
  Description of Artificial Sequence: Synthetic peptide
  Seed: SSPECTQST (MAGC1_HUMAN)
SLPECTQSM

SEQ ID NO: 82661 - protein, 11 aa, Artificial Sequence
  Description of Artificial Sequence: Synthetic peptide
  Seed: RSFSSTLLSIF (MAGC1_HUMAN)
RWFSSTLLSII

SEQ ID NO: 82662 - protein, 10 aa, Artificial Sequence
  Description of Artificial Sequence: Synthetic peptide
  Seed: FFSSALLSIF (MAGC1_HUMAN)
FTSSALLSIY

SEQ ID NO: 82663 - protein, 10 aa, Artificial Sequence
  Description of Artificial Sequence: Synthetic peptide
  Seed: WGPRAHSEVI (MAGC1_HUMAN)
WIPRAHSEVI

SEQ ID NO: 82664 - protein, 8 aa, Artificial Sequence
  Description of Artificial Sequence: Synthetic peptide
  Seed: FSYTLASL (MAGC1_HUMAN)
FAYTLASV

SEQ ID NO: 82665 - protein, 9 aa, Artificial Sequence
  Description of Artificial Sequence: Synthetic peptide
  Seed: FLAMLKNTV (MAGC1_HUMAN)
FQAMLKNTV

SEQ ID NO: 82666 - protein, 9 aa, Artificial Sequence
  Description of Artificial Sequence: Synthetic peptide
  Seed: VSSSFSYTL (MAGC1_HUMAN)
VISSFSYTL

SEQ ID NO: 82667 - protein, 10 aa, Artificial Sequence
  Description of Artificial Sequence: Synthetic peptide
  Seed: SSPERTHSTF (MAGC1_HUMAN)
SAPERTHSTM

SEQ ID NO: 82668 - protein, 10 aa, Artificial Sequence
  Description of Artificial Sequence: Synthetic peptide
  Seed: SFSSTLLSIF (MAGC1_HUMAN)
SHSSTLLSIF

SEQ ID NO: 82669 - protein, 10 aa, Artificial Sequence
  Description of Artificial Sequence: Synthetic peptide
  Seed: LAMLKNTVPI (MAGC1_HUMAN)
LCMLKNTVPF

SEQ ID NO: 82670 - protein, 9 aa, Artificial Sequence
  Description of Artificial Sequence: Synthetic peptide
  Seed: AQSPLQIPV (MAGC1_HUMAN)
AESPLQIPP

SEQ ID NO: 82671 - protein, 9 aa, Artificial Sequence
  Description of Artificial Sequence: Synthetic peptide
  Seed: MTSSFSSTL (MAGC1_HUMAN)
MTSSFSSTV

SEQ ID NO: 82672 - protein, 9 aa, Artificial Sequence
  Description of Artificial Sequence: Synthetic peptide
  Seed: SPLEGEDSL (MAGC1_HUMAN)
SQLEGEDSL

SEQ ID NO: 82673 - protein, 9 aa, Artificial Sequence
  Description of Artificial Sequence: Synthetic peptide
  Seed: GFPQSVLQI (MAGC1_HUMAN)
GIPQSVLQM

SEQ ID NO: 82674 - protein, 9 aa, Artificial Sequence
  Description of Artificial Sequence: Synthetic peptide
  Seed: LQIPVSAAS (MAGC1_HUMAN)
LHIPVSAAL

SEQ ID NO: 82675 - protein, 9 aa, Artificial Sequence
  Description of Artificial Sequence: Synthetic peptide
  Seed: FQSSLQSPV (MAGC1_HUMAN)
FQSSLQSPM

SEQ ID NO: 82676 - protein, 10 aa, Artificial Sequence
  Description of Artificial Sequence: Synthetic peptide
  Seed: KAREFIEILF (MAGC1_HUMAN)
KYREFIEILK

SEQ ID NO: 82677 - protein, 9 aa, Artificial Sequence
  Description of Artificial Sequence: Synthetic peptide
  Seed: SLIESEPLF (MAGC1_HUMAN)
STIESEPLF

SEQ ID NO: 82678 - protein, 9 aa, Artificial Sequence
  Description of Artificial Sequence: Synthetic peptide
  Seed: YTLLSLFQS (MAGC1_HUMAN)
YLLLSLFQS

SEQ ID NO: 82679 - protein, 9 aa, Artificial Sequence
  Description of Artificial Sequence: Synthetic peptide
  Seed: VSPSFSSTL (MAGC1_HUMAN)
VGPSFSSTL

SEQ ID NO: 82680 - protein, 9 aa, Artificial Sequence
  Description of Artificial Sequence: Synthetic peptide
  Seed: TLVSLFQSS (MAGC1_HUMAN)
TLVSLFQSI

SEQ ID NO: 82681 - protein, 9 aa, Artificial Sequence
  Description of Artificial Sequence: Synthetic peptide
  Seed: IEILFGISL (MAGC1_HUMAN)
IQILFGISV

SEQ ID NO: 82682 - protein, 11 aa, Artificial Sequence
  Description of Artificial Sequence: Synthetic peptide
  Seed: LLQIPMTSSFS (MAGC1_HUMAN)
LYQIPMTSSFF

SEQ ID NO: 82683 - protein, 9 aa, Artificial Sequence
  Description of Artificial Sequence: Synthetic peptide
  Seed: SSPPRYEFL (MAGC1_HUMAN)
SVPPRYEFL

SEQ ID NO: 82684 - protein, 9 aa, Artificial Sequence
  Description of Artificial Sequence: Synthetic peptide
  Seed: SRSFSSTLL (MAGC1_HUMAN)
SMSFSSTLY

SEQ ID NO: 82685 - protein, 10 aa, Artificial Sequence
  Description of Artificial Sequence: Synthetic peptide
  Seed: STSLSLPQSF (MAGC1_HUMAN)
SYSLSLPQSW

SEQ ID NO: 82686 - protein, 9 aa, Artificial Sequence
  Description of Artificial Sequence: Synthetic peptide
  Seed: VSPSSSSTL (MAGC1_HUMAN)
VLPSSSSTM

SEQ ID NO: 82687 - protein, 11 aa, Artificial Sequence
  Description of Artificial Sequence: Synthetic peptide
  Seed: STFEGFAQSPL (MAGC1_HUMAN)
SSFEGFAQSPF

SEQ ID NO: 82688 - protein, 9 aa, Artificial Sequence
  Description of Artificial Sequence: Synthetic peptide
  Seed: VLSGIGVRA (MAGC1_HUMAN)
VLSGIGVRV

SEQ ID NO: 82689 - protein, 9 aa, Artificial Sequence
  Description of Artificial Sequence: Synthetic peptide
  Seed: HYFPQSPPQ (MAGC1_HUMAN)
HYFPQSPPY

SEQ ID NO: 82690 - protein, 10 aa, Artificial Sequence
  Description of Artificial Sequence: Synthetic peptide
  Seed: PLQIPVSSSF (MAGC1_HUMAN)
PWQIPVSSSY

SEQ ID NO: 82691 - protein, 9 aa, Artificial Sequence
  Description of Artificial Sequence: Synthetic peptide
  Seed: KVVEFLAML (MAGC1_HUMAN)
KQVEFLAMC

SEQ ID NO: 82692 - protein, 9 aa, Artificial Sequence
  Description of Artificial Sequence: Synthetic peptide
  Seed: DSYVFVNTL (MAGC1_HUMAN)
DTYVFVNTW

SEQ ID NO: 82693 - protein, 11 aa, Artificial Sequence
  Description of Artificial Sequence: Synthetic peptide
  Seed: SSFPSSTSSSL (MAGC1_HUMAN)
SAFPSSTSSSI

SEQ ID NO: 82694 - protein, 10 aa, Artificial Sequence
  Description of Artificial Sequence: Synthetic peptide
  Seed: SRYTGYFPVI (MAGC1_HUMAN)
SDYTGYFPVM

SEQ ID NO: 82695 - protein, 9 aa, Artificial Sequence
  Description of Artificial Sequence: Synthetic peptide
  Seed: FQSSLQSPV (MAGC1_HUMAN)
FFSSLQSPY

SEQ ID NO: 82696 - protein, 9 aa, Artificial Sequence
  Description of Artificial Sequence: Synthetic peptide
  Seed: SSPERTHST (MAGC1_HUMAN)
SFPERTHSL

SEQ ID NO: 82697 - protein, 11 aa, Artificial Sequence
  Description of Artificial Sequence: Synthetic peptide
  Seed: IPVSPSFSSTL (MAGC1_HUMAN)
IPVSPSFSSTF

SEQ ID NO: 82698 - protein, 9 aa, Artificial Sequence
  Description of Artificial Sequence: Synthetic peptide
  Seed: ASSFFSSAL (MAGC1_HUMAN)
AYSFFSSAL

SEQ ID NO: 82699 - protein, 9 aa, Artificial Sequence
  Description of Artificial Sequence: Synthetic peptide
  Seed: FAFGEPREL (MAGC1_HUMAN)
FHFGEPREF

SEQ ID NO: 82700 - protein, 11 aa, Artificial Sequence
  Description of Artificial Sequence: Synthetic peptide
  Seed: QSSPERTQSTF (MAGC1_HUMAN)
QSSPERTQSTW

SEQ ID NO: 82701 - protein, 9 aa, Artificial Sequence
  Description of Artificial Sequence: Synthetic peptide
  Seed: KQPITKAEM (MAGC1_HUMAN)
KAPITKAEM

SEQ ID NO: 82702 - protein, 11 aa, Artificial Sequence
  Description of Artificial Sequence: Synthetic peptide
  Seed: SPLQIPVSPSS (MAGC1_HUMAN)
SPLQIPVSPSM

SEQ ID NO: 82703 - protein, 9 aa, Artificial Sequence
  Description of Artificial Sequence: Synthetic peptide
  Seed: AQSPLQRPV (MAGC1_HUMAN)
AMSPLQRPF

SEQ ID NO: 82704 - protein, 9 aa, Artificial Sequence
  Description of Artificial Sequence: Synthetic peptide
  Seed: LILSIIFIK (MAGC1_HUMAN)
LWLSIIFIR

SEQ ID NO: 82705 - protein, 9 aa, Artificial Sequence
  Description of Artificial Sequence: Synthetic peptide
  Seed: SLIESEPLF (MAGC1_HUMAN)
SYIESEPLY

SEQ ID NO: 82706 - protein, 11 aa, Artificial Sequence
  Description of Artificial Sequence: Synthetic peptide
  Seed: EILFGISLREV (MAGC1_HUMAN)
EFLFGISLREL

SEQ ID NO: 82707 - protein, 10 aa, Artificial Sequence
  Description of Artificial Sequence: Synthetic peptide
  Seed: RTQSTFEGFA (MAGC1_HUMAN)
RYQSTFEGFK

SEQ ID NO: 82708 - protein, 9 aa, Artificial Sequence
  Description of Artificial Sequence: Synthetic peptide
  Seed: SPPEGENTH (MAGC1_HUMAN)
SMPEGENTM

SEQ ID NO: 82709 - protein, 9 aa, Artificial Sequence
  Description of Artificial Sequence: Synthetic peptide
  Seed: AGREHFAFG (MAGC1_HUMAN)
AGREHFAFY

SEQ ID NO: 82710 - protein, 10 aa, Artificial Sequence
  Description of Artificial Sequence: Synthetic peptide
  Seed: KVDELARFLL (MAGC1_HUMAN)
KADELARFLW

SEQ ID NO: 82711 - protein, 11 aa, Artificial Sequence
  Description of Artificial Sequence: Synthetic peptide
  Seed: SSTPSSLPQSF (MAGC1_HUMAN)
SATPSSLPQSW

SEQ ID NO: 82712 - protein, 9 aa, Artificial Sequence
  Description of Artificial Sequence: Synthetic peptide
  Seed: NSSPPRYEF (MAGC1_HUMAN)
NQSPPRYEI

SEQ ID NO: 82713 - protein, 10 aa, Artificial Sequence
  Description of Artificial Sequence: Synthetic peptide
  Seed: SLIESEPLFT (MAGC1_HUMAN)
SQIESEPLFV

SEQ ID NO: 82714 - protein, 10 aa, Artificial Sequence
  Description of Artificial Sequence: Synthetic peptide
  Seed: WGPRAHSEVI (MAGC1_HUMAN)
WYPRAHSEVI

SEQ ID NO: 82715 - protein, 10 aa, Artificial Sequence
  Description of Artificial Sequence: Synthetic peptide
  Seed: STFEGFAQSS (MAGC1_HUMAN)
SVFEGFAQSI

SEQ ID NO: 82716 - protein, 10 aa, Artificial Sequence
  Description of Artificial Sequence: Synthetic peptide
  Seed: TGYFPVIFRK (MAGC1_HUMAN)
TAYFPVIFRW

SEQ ID NO: 82717 - protein, 9 aa, Artificial Sequence
  Description of Artificial Sequence: Synthetic peptide
  Seed: FFSSALLSI (MAGC1_HUMAN)
FTSSALLSL

SEQ ID NO: 82718 - protein, 9 aa, Artificial Sequence
  Description of Artificial Sequence: Synthetic peptide
  Seed: KAREFIEIL (MAGC1_HUMAN)
KTREFIEIL

SEQ ID NO: 82719 - protein, 10 aa, Artificial Sequence
  Description of Artificial Sequence: Synthetic peptide
  Seed: SLFQSFSERT (MAGC1_HUMAN)
STFQSFSERV

SEQ ID NO: 82720 - protein, 9 aa, Artificial Sequence
  Description of Artificial Sequence: Synthetic peptide
  Seed: VSSFFSYTL (MAGC1_HUMAN)
VLSFFSYTY

SEQ ID NO: 82721 - protein, 9 aa, Artificial Sequence
  Description of Artificial Sequence: Synthetic peptide
  Seed: NTVPITFPS (MAGC1_HUMAN)
NTVPITFPR

SEQ ID NO: 82722 - protein, 9 aa, Artificial Sequence
  Description of Artificial Sequence: Synthetic peptide
  Seed: TLVSIFQSS (MAGC1_HUMAN)
TLVSIFQSM

SEQ ID NO: 82723 - protein, 9 aa, Artificial Sequence
  Description of Artificial Sequence: Synthetic peptide
  Seed: YFPVIFRKA (MAGC1_HUMAN)
YYPVIFRKF

SEQ ID NO: 82724 - protein, 10 aa, Artificial Sequence
  Description of Artificial Sequence: Synthetic peptide
  Seed: LAMLKNTVPI (MAGC1_HUMAN)
LEMLKNTVPV

SEQ ID NO: 82725 - protein, 10 aa, Artificial Sequence
  Description of Artificial Sequence: Synthetic peptide
  Seed: MLKNTVPITF (MAGC1_HUMAN)
MYKNTVPITF

SEQ ID NO: 82726 - protein, 11 aa, Artificial Sequence
  Description of Artificial Sequence: Synthetic peptide
  Seed: SPLQIPVSSSS (MAGC1_HUMAN)
SNLQIPVSSSF

SEQ ID NO: 82727 - protein, 10 aa, Artificial Sequence
  Description of Artificial Sequence: Synthetic peptide
  Seed: RKVVEFLAML (MAGC1_HUMAN)
RLVVEFLAMV

SEQ ID NO: 82728 - protein, 9 aa, Artificial Sequence
  Description of Artificial Sequence: Synthetic peptide
  Seed: SSSSTLLSL (MAGC1_HUMAN)
SRSSTLLSM

SEQ ID NO: 82729 - protein, 10 aa, Artificial Sequence
  Description of Artificial Sequence: Synthetic peptide
  Seed: LILILSIIFI (MAGC1_HUMAN)
LNLILSIIFV

SEQ ID NO: 82730 - protein, 9 aa, Artificial Sequence
  Description of Artificial Sequence: Synthetic peptide
  Seed: LQIPVSAAS (MAGC1_HUMAN)
LMIPVSAAH

SEQ ID NO: 82731 - protein, 9 aa, Artificial Sequence
  Description of Artificial Sequence: Synthetic peptide
  Seed: KAREFIEIL (MAGC1_HUMAN)
KPREFIEIV

SEQ ID NO: 82732 - protein, 10 aa, Artificial Sequence
  Description of Artificial Sequence: Synthetic peptide
  Seed: SVLQIPVSAA (MAGC1_HUMAN)
SYLQIPVSAV

SEQ ID NO: 82733 - protein, 10 aa, Artificial Sequence
  Description of Artificial Sequence: Synthetic peptide
  Seed: MTSSFSSTLL (MAGC1_HUMAN)
MVSSFSSTLA

SEQ ID NO: 82734 - protein, 9 aa, Artificial Sequence
  Description of Artificial Sequence: Synthetic peptide
  Seed: FSYTLASLL (MAGC1_HUMAN)
FMYTLASLF

SEQ ID NO: 82735 - protein, 10 aa, Artificial Sequence
  Description of Artificial Sequence: Synthetic peptide
  Seed: SFPSSTSSSL (MAGC1_HUMAN)
SYPSSTSSSY

SEQ ID NO: 82736 - protein, 9 aa, Artificial Sequence
  Description of Artificial Sequence: Synthetic peptide
  Seed: KVWVQEHYL (MAGC1_HUMAN)
KIWVQEHYI

SEQ ID NO: 82737 - protein, 11 aa, Artificial Sequence
  Description of Artificial Sequence: Synthetic peptide
  Seed: KDMPTAGMPSL (MAGC1_HUMAN)
KEMPTAGMPST

SEQ ID NO: 82738 - protein, 10 aa, Artificial Sequence
  Description of Artificial Sequence: Synthetic peptide
  Seed: WEDSLSPHYF (MAGC1_HUMAN)
WADSLSPHYV

SEQ ID NO: 82739 - protein, 10 aa, Artificial Sequence
  Description of Artificial Sequence: Synthetic peptide
  Seed: RKVVEFLAML (MAGC1_HUMAN)
RYVVEFLAMV

SEQ ID NO: 82740 - protein, 9 aa, Artificial Sequence
  Description of Artificial Sequence: Synthetic peptide
  Seed: LQIPVSRSF (MAGC1_HUMAN)
LQIPVSRSH

SEQ ID NO: 82741 - protein, 9 aa, Artificial Sequence
  Description of Artificial Sequence: Synthetic peptide
  Seed: LQIPGSPSF (MAGC1_HUMAN)
LMIPGSPSW

SEQ ID NO: 82742 - protein, 10 aa, Artificial Sequence
  Description of Artificial Sequence: Synthetic peptide
  Seed: SVLQIPVSAA (MAGC1_HUMAN)
SQLQIPVSAV

SEQ ID NO: 82743 - protein, 9 aa, Artificial Sequence
  Description of Artificial Sequence: Synthetic peptide
  Seed: SSFPSSTSS (MAGC1_HUMAN)
STFPSSTSV

SEQ ID NO: 82744 - protein, 9 aa, Artificial Sequence
  Description of Artificial Sequence: Synthetic peptide
  Seed: SSPECTQST (MAGC1_HUMAN)
SAPECTQSF

SEQ ID NO: 82745 - protein, 11 aa, Artificial Sequence
  Description of Artificial Sequence: Synthetic peptide
  Seed: SSFSYTLLSLF (MAGC1_HUMAN)
SIFSYTLLSLF

SEQ ID NO: 82746 - protein, 9 aa, Artificial Sequence
  Description of Artificial Sequence: Synthetic peptide
  Seed: SLTDSESLI (MAGC1_HUMAN)
SMTDSESLI

SEQ ID NO: 82747 - protein, 9 aa, Artificial Sequence
  Description of Artificial Sequence: Synthetic peptide
  Seed: REVDPDDSY (MAGC1_HUMAN)
RTVDPDDSL

SEQ ID NO: 82748 - protein, 9 aa, Artificial Sequence
  Description of Artificial Sequence: Synthetic peptide
  Seed: SLSPHYFPQ (MAGC1_HUMAN)
SISPHYFPY

SEQ ID NO: 82749 - protein, 9 aa, Artificial Sequence
  Description of Artificial Sequence: Synthetic peptide
  Seed: SIIFIKGTY (MAGC1_HUMAN)
SMIFIKGTR

SEQ ID NO: 82750 - protein, 10 aa, Artificial Sequence
  Description of Artificial Sequence: Synthetic peptide
  Seed: FAFGEPRELL (MAGC1_HUMAN)
FMFGEPRELV

SEQ ID NO: 82751 - protein, 9 aa, Artificial Sequence
  Description of Artificial Sequence: Synthetic peptide
  Seed: TLVSIFQSS (MAGC1_HUMAN)
TTVSIFQSI

SEQ ID NO: 82752 - protein, 10 aa, Artificial Sequence
  Description of Artificial Sequence: Synthetic peptide
  Seed: LQIPVSSSFS (MAGC1_HUMAN)
LQIPVSSSFM

SEQ ID NO: 82753 - protein, 10 aa, Artificial Sequence
  Description of Artificial Sequence: Synthetic peptide
  Seed: SSPPRYEFLW (MAGC1_HUMAN)
SYPPRYEFLM

SEQ ID NO: 82754 - protein, 9 aa, Artificial Sequence
  Description of Artificial Sequence: Synthetic peptide
  Seed: GFPQSLLQI (MAGC1_HUMAN)
GYPQSLLQI

SEQ ID NO: 82755 - protein, 9 aa, Artificial Sequence
  Description of Artificial Sequence: Synthetic peptide
  Seed: EDSSDPLQR (MAGC1_HUMAN)
EISSDPLQR

SEQ ID NO: 82756 - protein, 9 aa, Artificial Sequence
  Description of Artificial Sequence: Synthetic peptide
  Seed: TLLSIFQSS (MAGC1_HUMAN)
TVLSIFQSL

SEQ ID NO: 82757 - protein, 10 aa, Artificial Sequence
  Description of Artificial Sequence: Synthetic peptide
  Seed: YLEYREVPNS (MAGC1_HUMAN)
YMEYREVPNA

SEQ ID NO: 82758 - protein, 9 aa, Artificial Sequence
  Description of Artificial Sequence: Synthetic peptide
  Seed: VIKRKVVEF (MAGC1_HUMAN)
VRKRKVVEY

SEQ ID NO: 82759 - protein, 11 aa, Artificial Sequence
  Description of Artificial Sequence: Synthetic peptide
  Seed: SFFSSALLSIF (MAGC1_HUMAN)
SAFSSALLSIY

SEQ ID NO: 82760 - protein, 9 aa, Artificial Sequence
  Description of Artificial Sequence: Synthetic peptide
  Seed: ALLSIFQSS (MAGC1_HUMAN)
AQLSIFQSA

SEQ ID NO: 82761 - protein, 10 aa, Artificial Sequence
  Description of Artificial Sequence: Synthetic peptide
  Seed: SSSSSSSTLL (MAGC1_HUMAN)
SKSSSSSTLF

SEQ ID NO: 82762 - protein, 10 aa, Artificial Sequence
  Description of Artificial Sequence: Synthetic peptide
  Seed: KVDELARFLL (MAGC1_HUMAN)
KLDELARFLL

SEQ ID NO: 82763 - protein, 9 aa, Artificial Sequence
  Description of Artificial Sequence: Synthetic peptide
  Seed: DPDDSYVFV (MAGC1_HUMAN)
DADDSYVFM

SEQ ID NO: 82764 - protein, 10 aa, Artificial Sequence
  Description of Artificial Sequence: Synthetic peptide
  Seed: AASSSTLVSI (MAGC1_HUMAN)
AMSSSTLVSV

SEQ ID NO: 82765 - protein, 9 aa, Artificial Sequence
  Description of Artificial Sequence: Synthetic peptide
  Seed: WVQEHYLEY (MAGC1_HUMAN)
WRQEHYLEY

SEQ ID NO: 82766 - protein, 9 aa, Artificial Sequence
  Description of Artificial Sequence: Synthetic peptide
  Seed: TLDEKVDEL (MAGC1_HUMAN)
TFDEKVDEY

SEQ ID NO: 82767 - protein, 9 aa, Artificial Sequence
  Description of Artificial Sequence: Synthetic peptide
  Seed: AQSSLQIPV (MAGC1_HUMAN)
AISSLQIPA

SEQ ID NO: 82768 - protein, 9 aa, Artificial Sequence
  Description of Artificial Sequence: Synthetic peptide
  Seed: WGPRAHSEV (MAGC1_HUMAN)
WMPRAHSEL

SEQ ID NO: 82769 - protein, 9 aa, Artificial Sequence
  Description of Artificial Sequence: Synthetic peptide
  Seed: YVFVNTLDL (MAGC1_HUMAN)
YVFVNTLDY

SEQ ID NO: 82770 - protein, 9 aa, Artificial Sequence
  Description of Artificial Sequence: Synthetic peptide
  Seed: SSFFSSALL (MAGC1_HUMAN)
SCFFSSALW

SEQ ID NO: 82771 - protein, 9 aa, Artificial Sequence
  Description of Artificial Sequence: Synthetic peptide
  Seed: FSYTLLSLF (MAGC1_HUMAN)
FAYTLLSLF

SEQ ID NO: 82772 - protein, 11 aa, Artificial Sequence
  Description of Artificial Sequence: Synthetic peptide
  Seed: FLAMLKNTVPI (MAGC1_HUMAN)
FPAMLKNTVPI

SEQ ID NO: 82773 - protein, 9 aa, Artificial Sequence
  Description of Artificial Sequence: Synthetic peptide
  Seed: AGREHFAFG (MAGC1_HUMAN)
ASREHFAFL

SEQ ID NO: 82774 - protein, 9 aa, Artificial Sequence
  Description of Artificial Sequence: Synthetic peptide
  Seed: WEDSLSPLH (MAGC1_HUMAN)
WEDSLSPLY

SEQ ID NO: 82775 - protein, 10 aa, Artificial Sequence
  Description of Artificial Sequence: Synthetic peptide
  Seed: KGTYASEEVI (MAGC1_HUMAN)
KSTYASEEVW

SEQ ID NO: 82776 - protein, 9 aa, Artificial Sequence
  Description of Artificial Sequence: Synthetic peptide
  Seed: ASSFFSSAL (MAGC1_HUMAN)
AVSFFSSAF

SEQ ID NO: 82777 - protein, 9 aa, Artificial Sequence
  Description of Artificial Sequence: Synthetic peptide
  Seed: FSYTLASLL (MAGC1_HUMAN)
FIYTLASLI

SEQ ID NO: 82778 - protein, 9 aa, Artificial Sequence
  Description of Artificial Sequence: Synthetic peptide
  Seed: VSPSFSSTL (MAGC1_HUMAN)
VTPSFSSTI

SEQ ID NO: 82779 - protein, 10 aa, Artificial Sequence
  Description of Artificial Sequence: Synthetic peptide
  Seed: SFPSSTSSSL (MAGC1_HUMAN)
SQPSSTSSSV

SEQ ID NO: 82780 - protein, 9 aa, Artificial Sequence
  Description of Artificial Sequence: Synthetic peptide
  Seed: AQSSLQIPV (MAGC1_HUMAN)
ALSSLQIPY

SEQ ID NO: 82781 - protein, 9 aa, Artificial Sequence
  Description of Artificial Sequence: Synthetic peptide
  Seed: VQSPLHSPQ (MAGC1_HUMAN)
VQSPLHSPW

SEQ ID NO: 82782 - protein, 10 aa, Artificial Sequence
  Description of Artificial Sequence: Synthetic peptide
  Seed: MPTAGMPSLL (MAGC1_HUMAN)
MHTAGMPSLF

SEQ ID NO: 82783 - protein, 9 aa, Artificial Sequence
  Description of Artificial Sequence: Synthetic peptide
  Seed: LQIPVSPSF (MAGC1_HUMAN)
LPIPVSPSL

SEQ ID NO: 82784 - protein, 9 aa, Artificial Sequence
  Description of Artificial Sequence: Synthetic peptide
  Seed: SSSFSYTLL (MAGC1_HUMAN)
SSSFSYTLW

SEQ ID NO: 82785 - protein, 11 aa, Artificial Sequence
  Description of Artificial Sequence: Synthetic peptide
  Seed: IIDTTDDSTAT (MAGC1_HUMAN)
IVDTTDDSTAV

SEQ ID NO: 82786 - protein, 10 aa, Artificial Sequence
  Description of Artificial Sequence: Synthetic peptide
  Seed: KRKVVEFLAM (MAGC1_HUMAN)
KQKVVEFLAF

SEQ ID NO: 82787 - protein, 9 aa, Artificial Sequence
  Description of Artificial Sequence: Synthetic peptide
  Seed: YTGYFPVIF (MAGC1_HUMAN)
YTGYFPVIW

SEQ ID NO: 82788 - protein, 10 aa, Artificial Sequence
  Description of Artificial Sequence: Synthetic peptide
  Seed: LSQSSPVSSF (MAGC1_HUMAN)
LWQSSPVSSM

SEQ ID NO: 82789 - protein, 9 aa, Artificial Sequence
  Description of Artificial Sequence: Synthetic peptide
  Seed: RPVSSFFSY (MAGC1_HUMAN)
RAVSSFFSF

SEQ ID NO: 82790 - protein, 10 aa, Artificial Sequence
  Description of Artificial Sequence: Synthetic peptide
  Seed: STFEGFPQSL (MAGC1_HUMAN)
SIFEGFPQSL

SEQ ID NO: 82791 - protein, 11 aa, Artificial Sequence
  Description of Artificial Sequence: Synthetic peptide
  Seed: REVDPDDSYVF (MAGC1_HUMAN)
RAVDPDDSYVH

SEQ ID NO: 82792 - protein, 9 aa, Artificial Sequence
  Description of Artificial Sequence: Synthetic peptide
  Seed: VIKRKVVEF (MAGC1_HUMAN)
VVKRKVVEY

SEQ ID NO: 82793 - protein, 10 aa, Artificial Sequence
  Description of Artificial Sequence: Synthetic peptide
  Seed: VSSSSSSSTL (MAGC1_HUMAN)
VVSSSSSSTF

SEQ ID NO: 82794 - protein, 10 aa, Artificial Sequence
  Description of Artificial Sequence: Synthetic peptide
  Seed: YTLDEKVDEL (MAGC1_HUMAN)
YNLDEKVDEI

SEQ ID NO: 82795 - protein, 10 aa, Artificial Sequence
  Description of Artificial Sequence: Synthetic peptide
  Seed: STFEGFPQSL (MAGC1_HUMAN)
SSFEGFPQSL

SEQ ID NO: 82796 - protein, 11 aa, Artificial Sequence
  Description of Artificial Sequence: Synthetic peptide
  Seed: SQSSPEGKDSL (MAGC1_HUMAN)
SMSSPEGKDSF

SEQ ID NO: 82797 - protein, 9 aa, Artificial Sequence
  Description of Artificial Sequence: Synthetic peptide
  Seed: IPVSSSFSY (MAGC1_HUMAN)
IAVSSSFSW

SEQ ID NO: 82798 - protein, 9 aa, Artificial Sequence
  Description of Artificial Sequence: Synthetic peptide
  Seed: QVKQPITKA (MAGC1_HUMAN)
QIKQPITKR

SEQ ID NO: 82799 - protein, 10 aa, Artificial Sequence
  Description of Artificial Sequence: Synthetic peptide
  Seed: FFSSALLSIF (MAGC1_HUMAN)
FISSALLSIF

SEQ ID NO: 82800 - protein, 9 aa, Artificial Sequence
  Description of Artificial Sequence: Synthetic peptide
  Seed: SPESAQSAF (MAGC1_HUMAN)
SLESAQSAY

SEQ ID NO: 82801 - protein, 9 aa, Artificial Sequence
  Description of Artificial Sequence: Synthetic peptide
  Seed: EMLTNVISR (MAGC1_HUMAN)
ESLTNVISK

SEQ ID NO: 82802 - protein, 9 aa, Artificial Sequence
  Description of Artificial Sequence: Synthetic peptide
  Seed: TSLSLPQSF (MAGC1_HUMAN)
TQLSLPQSW

SEQ ID NO: 82803 - protein, 9 aa, Artificial Sequence
  Description of Artificial Sequence: Synthetic peptide
  Seed: YPLQSPQSR (MAGC1_HUMAN)
YTLQSPQSK

SEQ ID NO: 82804 - protein, 10 aa, Artificial Sequence
  Description of Artificial Sequence: Synthetic peptide
  Seed: SFSSTLLSIF (MAGC1_HUMAN)
SKSSTLLSIF

SEQ ID NO: 82805 - protein, 9 aa, Artificial Sequence
  Description of Artificial Sequence: Synthetic peptide
  Seed: VSSFFSYTL (MAGC1_HUMAN)
VMSFFSYTT

SEQ ID NO: 82806 - protein, 9 aa, Artificial Sequence
  Description of Artificial Sequence: Synthetic peptide
  Seed: SKSSPESPL (MAGC1_HUMAN)
SHSSPESPY

SEQ ID NO: 82807 - protein, 10 aa, Artificial Sequence
  Description of Artificial Sequence: Synthetic peptide
  Seed: FPQSPLQIPV (MAGC1_HUMAN)
FVQSPLQIPY

SEQ ID NO: 82808 - protein, 9 aa, Artificial Sequence
  Description of Artificial Sequence: Synthetic peptide
  Seed: NSSPPRYEF (MAGC1_HUMAN)
NASPPRYEM

SEQ ID NO: 82809 - protein, 10 aa, Artificial Sequence
  Description of Artificial Sequence: Synthetic peptide
  Seed: MLTNVISRYT (MAGC1_HUMAN)
MVTNVISRYL

SEQ ID NO: 82810 - protein, 10 aa, Artificial Sequence
  Description of Artificial Sequence: Synthetic peptide
  Seed: SPLYFPQSPL (MAGC1_HUMAN)
SQLYFPQSPI

SEQ ID NO: 82811 - protein, 10 aa, Artificial Sequence
  Description of Artificial Sequence: Synthetic peptide
  Seed: FSSSTSLSPF (MAGC1_HUMAN)
FKSSTSLSPY

SEQ ID NO: 82812 - protein, 9 aa, Artificial Sequence
  Description of Artificial Sequence: Synthetic peptide
  Seed: LKYQVKQPI (MAGC1_HUMAN)
LHYQVKQPY

SEQ ID NO: 82813 - protein, 9 aa, Artificial Sequence
  Description of Artificial Sequence: Synthetic peptide
  Seed: STQSPFEGF (MAGC1_HUMAN)
SYQSPFEGW

SEQ ID NO: 82814 - protein, 9 aa, Artificial Sequence
  Description of Artificial Sequence: Synthetic peptide
  Seed: FPQSPLQGE (MAGC1_HUMAN)
FPQSPLQGT

SEQ ID NO: 82815 - protein, 10 aa, Artificial Sequence
  Description of Artificial Sequence: Synthetic peptide
  Seed: STFEGFPQSL (MAGC1_HUMAN)
SMFEGFPQSL

SEQ ID NO: 82816 - protein, 10 aa, Artificial Sequence
  Description of Artificial Sequence: Synthetic peptide
  Seed: LLQIPMTSSF (MAGC1_HUMAN)
LYQIPMTSSY

SEQ ID NO: 82817 - protein, 9 aa, Artificial Sequence
  Description of Artificial Sequence: Synthetic peptide
  Seed: IEILFGISL (MAGC1_HUMAN)
IQILFGISF

SEQ ID NO: 82818 - protein, 9 aa, Artificial Sequence
  Description of Artificial Sequence: Synthetic peptide
  Seed: SSSDTLLES (MAGC1_HUMAN)
SSSDTLLEY

SEQ ID NO: 82819 - protein, 9 aa, Artificial Sequence
  Description of Artificial Sequence: Synthetic peptide
  Seed: YFPVIFRKA (MAGC1_HUMAN)
YFPVIFRKM

SEQ ID NO: 82820 - protein, 9 aa, Artificial Sequence
  Description of Artificial Sequence: Synthetic peptide
  Seed: VPITFPSSY (MAGC1_HUMAN)
VTITFPSSY

SEQ ID NO: 82821 - protein, 10 aa, Artificial Sequence
  Description of Artificial Sequence: Synthetic peptide
  Seed: ISRYTGYFPV (MAGC1_HUMAN)
IARYTGYFPL

SEQ ID NO: 82822 - protein, 11 aa, Artificial Sequence
  Description of Artificial Sequence: Synthetic peptide
  Seed: QSSPESAQSTF (MAGC1_HUMAN)
QVSPESAQSTW

SEQ ID NO: 82823 - protein, 10 aa, Artificial Sequence
  Description of Artificial Sequence: Synthetic peptide
  Seed: QIPVSSSFSY (MAGC1_HUMAN)
QSPVSSSFSF

SEQ ID NO: 82824 - protein, 9 aa, Artificial Sequence
  Description of Artificial Sequence: Synthetic peptide
  Seed: VSAASSSTL (MAGC1_HUMAN)
VPAASSSTY

SEQ ID NO: 82825 - protein, 9 aa, Artificial Sequence
  Description of Artificial Sequence: Synthetic peptide
  Seed: ISFSSSTSL (MAGC1_HUMAN)
IGFSSSTSF

SEQ ID NO: 82826 - protein, 10 aa, Artificial Sequence
  Description of Artificial Sequence: Synthetic peptide
  Seed: GENTHSPLQI (MAGC1_HUMAN)
GENTHSPLQL

SEQ ID NO: 82827 - protein, 10 aa, Artificial Sequence
  Description of Artificial Sequence: Synthetic peptide
  Seed: KVVEFLAMLK (MAGC1_HUMAN)
KWVEFLAMLK

SEQ ID NO: 82828 - protein, 9 aa, Artificial Sequence
  Description of Artificial Sequence: Synthetic peptide
  Seed: DELARFLLL (MAGC1_HUMAN)
DHLARFLLA

SEQ ID NO: 82829 - protein, 10 aa, Artificial Sequence
  Description of Artificial Sequence: Synthetic peptide
  Seed: FAQSSLQIPV (MAGC1_HUMAN)
FLQSSLQIPA

SEQ ID NO: 82830 - protein, 10 aa, Artificial Sequence
  Description of Artificial Sequence: Synthetic peptide
  Seed: ICSSSTSLSL (MAGC1_HUMAN)
IFSSSTSLSF

SEQ ID NO: 82831 - protein, 9 aa, Artificial Sequence
  Description of Artificial Sequence: Synthetic peptide
  Seed: AGREHFAFG (MAGC1_HUMAN)
AIREHFAFI

SEQ ID NO: 82832 - protein, 9 aa, Artificial Sequence
  Description of Artificial Sequence: Synthetic peptide
  Seed: ASSSTLVSI (MAGC1_HUMAN)
AMSSTLVSY

SEQ ID NO: 82833 - protein, 10 aa, Artificial Sequence
  Description of Artificial Sequence: Synthetic peptide
  Seed: SFPSSTSSSL (MAGC1_HUMAN)
STPSSTSSSV

SEQ ID NO: 82834 - protein, 9 aa, Artificial Sequence
  Description of Artificial Sequence: Synthetic peptide
  Seed: SSSTLLSLF (MAGC1_HUMAN)
SRSTLLSLM

SEQ ID NO: 82835 - protein, 9 aa, Artificial Sequence
  Description of Artificial Sequence: Synthetic peptide
  Seed: SFSYTLLSL (MAGC1_HUMAN)
STSYTLLSL

SEQ ID NO: 82836 - protein, 9 aa, Artificial Sequence
  Description of Artificial Sequence: Synthetic peptide
  Seed: FLWGPRAHS (MAGC1_HUMAN)
FMWGPRAHL

SEQ ID NO: 82837 - protein, 10 aa, Artificial Sequence
  Description of Artificial Sequence: Synthetic peptide
  Seed: SSFSSTLLSI (MAGC1_HUMAN)
SIFSSTLLSW

SEQ ID NO: 82838 - protein, 10 aa, Artificial Sequence
  Description of Artificial Sequence: Synthetic peptide
  Seed: MTSSFSSTLL (MAGC1_HUMAN)
MSSSFSSTLM

SEQ ID NO: 82839 - protein, 9 aa, Artificial Sequence
  Description of Artificial Sequence: Synthetic peptide
  Seed: TKVWVQEHY (MAGC1_HUMAN)
TQVWVQEHF

SEQ ID NO: 82840 - protein, 9 aa, Artificial Sequence
  Description of Artificial Sequence: Synthetic peptide
  Seed: SEVIKRKVV (MAGC1_HUMAN)
SEVIKRKVA

SEQ ID NO: 82841 - protein, 10 aa, Artificial Sequence
  Description of Artificial Sequence: Synthetic peptide
  Seed: FPQSLLQIPM (MAGC1_HUMAN)
FHQSLLQIPM

SEQ ID NO: 82842 - protein, 9 aa, Artificial Sequence
  Description of Artificial Sequence: Synthetic peptide
  Seed: SLFQSFSER (MAGC1_HUMAN)
SNFQSFSER

SEQ ID NO: 82843 - protein, 11 aa, Artificial Sequence
  Description of Artificial Sequence: Synthetic peptide
  Seed: VSSSSSSSTLL (MAGC1_HUMAN)
VYSSSSSSTLF

SEQ ID NO: 82844 - protein, 9 aa, Artificial Sequence
  Description of Artificial Sequence: Synthetic peptide
  Seed: LKYQVKQPI (MAGC1_HUMAN)
LRYQVKQPM

SEQ ID NO: 82845 - protein, 10 aa, Artificial Sequence
  Description of Artificial Sequence: Synthetic peptide
  Seed: ASSFFSSALL (MAGC1_HUMAN)
ARSFFSSALM

SEQ ID NO: 82846 - protein, 8 aa, Artificial Sequence
  Description of Artificial Sequence: Synthetic peptide
  Seed: AEMLTNVI (MAGC1_HUMAN)
AEMLTNVL

SEQ ID NO: 82847 - protein, 10 aa, Artificial Sequence
  Description of Artificial Sequence: Synthetic peptide
  Seed: IIDTTDDSTA (MAGC1_HUMAN)
ITDTTDDSTF

SEQ ID NO: 82848 - protein, 10 aa, Artificial Sequence
  Description of Artificial Sequence: Synthetic peptide
  Seed: NVISRYTGYF (MAGC1_HUMAN)
NTISRYTGYY

SEQ ID NO: 82849 - protein, 9 aa, Artificial Sequence
  Description of Artificial Sequence: Synthetic peptide
  Seed: RTQSTFEGF (MAGC1_HUMAN)
RMQSTFEGM

SEQ ID NO: 82850 - protein, 9 aa, Artificial Sequence
  Description of Artificial Sequence: Synthetic peptide
  Seed: VIWDVLSGI (MAGC1_HUMAN)
VTWDVLSGM

SEQ ID NO: 82851 - protein, 9 aa, Artificial Sequence
  Description of Artificial Sequence: Synthetic peptide
  Seed: LQNPASSFF (MAGC1_HUMAN)
LQNPASSFV

SEQ ID NO: 82852 - protein, 9 aa, Artificial Sequence
  Description of Artificial Sequence: Synthetic peptide
  Seed: YTLLSLFQS (MAGC1_HUMAN)
YLLLSLFQI

SEQ ID NO: 82853 - protein, 11 aa, Artificial Sequence
  Description of Artificial Sequence: Synthetic peptide
  Seed: SSSSSSTLLSL (MAGC1_HUMAN)
SHSSSSTLLSF

SEQ ID NO: 82854 - protein, 9 aa, Artificial Sequence
  Description of Artificial Sequence: Synthetic peptide
  Seed: KVVEFLAML (MAGC1_HUMAN)
KQVEFLAMY

SEQ ID NO: 82855 - protein, 11 aa, Artificial Sequence
  Description of Artificial Sequence: Synthetic peptide
  Seed: SSSSSSTLLSL (MAGC1_HUMAN)
SPSSSSTLLSF

SEQ ID NO: 82856 - protein, 10 aa, Artificial Sequence
  Description of Artificial Sequence: Synthetic peptide
  Seed: STFEGFPQSL (MAGC1_HUMAN)
SSFEGFPQSF

SEQ ID NO: 82857 - protein, 9 aa, Artificial Sequence
  Description of Artificial Sequence: Synthetic peptide
  Seed: KRKVVEFLA (MAGC1_HUMAN)
KRKVVEFLI

SEQ ID NO: 82858 - protein, 10 aa, Artificial Sequence
  Description of Artificial Sequence: Synthetic peptide
  Seed: SSSSSTLLSL (MAGC1_HUMAN)
SLSSSTLLSA

SEQ ID NO: 82859 - protein, 9 aa, Artificial Sequence
  Description of Artificial Sequence: Synthetic peptide
  Seed: TLLSIFQSS (MAGC1_HUMAN)
TTLSIFQSI

SEQ ID NO: 82860 - protein, 9 aa, Artificial Sequence
  Description of Artificial Sequence: Synthetic peptide
  Seed: SSPERTQST (MAGC1_HUMAN)
SYPERTQSI

SEQ ID NO: 82861 - protein, 9 aa, Artificial Sequence
  Description of Artificial Sequence: Synthetic peptide
  Seed: AQSSLQIPV (MAGC1_HUMAN)
AVSSLQIPF

SEQ ID NO: 82862 - protein, 10 aa, Artificial Sequence
  Description of Artificial Sequence: Synthetic peptide
  Seed: ASSSTLVSIF (MAGC1_HUMAN)
ALSSTLVSIF

SEQ ID NO: 82863 - protein, 9 aa, Artificial Sequence
  Description of Artificial Sequence: Synthetic peptide
  Seed: MSQNRLLIL (MAGC1_HUMAN)
MEQNRLLIF

SEQ ID NO: 82864 - protein, 11 aa, Artificial Sequence
  Description of Artificial Sequence: Synthetic peptide
  Seed: IPMTSSFSSTL (MAGC1_HUMAN)
ILMTSSFSSTY

SEQ ID NO: 82865 - protein, 9 aa, Artificial Sequence
  Description of Artificial Sequence: Synthetic peptide
  Seed: SSSTSLSPF (MAGC1_HUMAN)
SASTSLSPH

SEQ ID NO: 82866 - protein, 11 aa, Artificial Sequence
  Description of Artificial Sequence: Synthetic peptide
  Seed: KVWVQEHYLEY (MAGC1_HUMAN)
KQWVQEHYLEY

SEQ ID NO: 82867 - protein, 9 aa, Artificial Sequence
  Description of Artificial Sequence: Synthetic peptide
  Seed: SPLQSPVIS (MAGC1_HUMAN)
SPLQSPVII

SEQ ID NO: 82868 - protein, 11 aa, Artificial Sequence
  Description of Artificial Sequence: Synthetic peptide
  Seed: AMLKNTVPITF (MAGC1_HUMAN)
AYLKNTVPITF

SEQ ID NO: 82869 - protein, 11 aa, Artificial Sequence
  Description of Artificial Sequence: Synthetic peptide
  Seed: IIDTTDDSTAT (MAGC1_HUMAN)
IQDTTDDSTAL

SEQ ID NO: 82870 - protein, 10 aa, Artificial Sequence
  Description of Artificial Sequence: Synthetic peptide
  Seed: YVFVNTLDLT (MAGC1_HUMAN)
YIFVNTLDLL

SEQ ID NO: 82871 - protein, 11 aa, Artificial Sequence
  Description of Artificial Sequence: Synthetic peptide
  Seed: FLWGPRAHSEV (MAGC1_HUMAN)
FIWGPRAHSEV

SEQ ID NO: 82872 - protein, 9 aa, Artificial Sequence
  Description of Artificial Sequence: Synthetic peptide
  Seed: YVFVNTLDL (MAGC1_HUMAN)
YYFVNTLDW

SEQ ID NO: 82873 - protein, 9 aa, Artificial Sequence
  Description of Artificial Sequence: Synthetic peptide
  Seed: KVVEFLAML (MAGC1_HUMAN)
KLVEFLAMK

SEQ ID NO: 82874 - protein, 9 aa, Artificial Sequence
  Description of Artificial Sequence: Synthetic peptide
  Seed: TLLSLFQSF (MAGC1_HUMAN)
TGLSLFQSY

SEQ ID NO: 82875 - protein, 9 aa, Artificial Sequence
  Description of Artificial Sequence: Synthetic peptide
  Seed: VSPSFSSTL (MAGC1_HUMAN)
VRPSFSSTF

SEQ ID NO: 82876 - protein, 9 aa, Artificial Sequence
  Description of Artificial Sequence: Synthetic peptide
  Seed: ISFSSSTSL (MAGC1_HUMAN)
IIFSSSTSF

SEQ ID NO: 82877 - protein, 9 aa, Artificial Sequence
  Description of Artificial Sequence: Synthetic peptide
  Seed: LSDEQGMSQ (MAGC1_HUMAN)
LQDEQGMSI

SEQ ID NO: 82878 - protein, 11 aa, Artificial Sequence
  Description of Artificial Sequence: Synthetic peptide
  Seed: SFFSSALLSIF (MAGC1_HUMAN)
SPFSSALLSIW

SEQ ID NO: 82879 - protein, 10 aa, Artificial Sequence
  Description of Artificial Sequence: Synthetic peptide
  Seed: LAMLKNTVPI (MAGC1_HUMAN)
LSMLKNTVPM

SEQ ID NO: 82880 - protein, 11 aa, Artificial Sequence
  Description of Artificial Sequence: Synthetic peptide
  Seed: IPVSRSFSSTL (MAGC1_HUMAN)
ICVSRSFSSTW

SEQ ID NO: 82881 - protein, 9 aa, Artificial Sequence
  Description of Artificial Sequence: Synthetic peptide
  Seed: SSPESTQSP (MAGC1_HUMAN)
SIPESTQSV

SEQ ID NO: 82882 - protein, 9 aa, Artificial Sequence
  Description of Artificial Sequence: Synthetic peptide
  Seed: RPVSSFFSY (MAGC1_HUMAN)
RAVSSFFSM

SEQ ID NO: 82883 - protein, 9 aa, Artificial Sequence
  Description of Artificial Sequence: Synthetic peptide
  Seed: SLFQSFSER (MAGC1_HUMAN)
SYFQSFSEY

SEQ ID NO: 82884 - protein, 9 aa, Artificial Sequence
  Description of Artificial Sequence: Synthetic peptide
  Seed: LQIPGSPSF (MAGC1_HUMAN)
LRIPGSPSY

SEQ ID NO: 82885 - protein, 9 aa, Artificial Sequence
  Description of Artificial Sequence: Synthetic peptide
  Seed: IEILFGISL (MAGC1_HUMAN)
IEILFGISV

SEQ ID NO: 82886 - protein, 10 aa, Artificial Sequence
  Description of Artificial Sequence: Synthetic peptide
  Seed: SFFSYTLASL (MAGC1_HUMAN)
SMFSYTLASV

SEQ ID NO: 82887 - protein, 10 aa, Artificial Sequence
  Description of Artificial Sequence: Synthetic peptide
  Seed: SRYTGYFPVI (MAGC1_HUMAN)
SSYTGYFPVI

SEQ ID NO: 82888 - protein, 9 aa, Artificial Sequence
  Description of Artificial Sequence: Synthetic peptide
  Seed: RPVSSFFSY (MAGC1_HUMAN)
RPVSSFFST

SEQ ID NO: 82889 - protein, 8 aa, Artificial Sequence
  Description of Artificial Sequence: Synthetic peptide
  Seed: FSYTLLSL (MAGC1_HUMAN)
FAYTLLSM

SEQ ID NO: 82890 - protein, 9 aa, Artificial Sequence
  Description of Artificial Sequence: Synthetic peptide
  Seed: RTQSTFEGF (MAGC1_HUMAN)
RVQSTFEGF

SEQ ID NO: 82891 - protein, 10 aa, Artificial Sequence
  Description of Artificial Sequence: Synthetic peptide
  Seed: REVDPDDSYV (MAGC1_HUMAN)
RIVDPDDSYI

SEQ ID NO: 82892 - protein, 10 aa, Artificial Sequence
  Description of Artificial Sequence: Synthetic peptide
  Seed: TGYFPVIFRK (MAGC1_HUMAN)
TSYFPVIFRY

SEQ ID NO: 82893 - protein, 9 aa, Artificial Sequence
  Description of Artificial Sequence: Synthetic peptide
  Seed: IESEPLFTY (MAGC1_HUMAN)
IMSEPLFTI

SEQ ID NO: 82894 - protein, 10 aa, Artificial Sequence
  Description of Artificial Sequence: Synthetic peptide
  Seed: EMLTNVISRY (MAGC1_HUMAN)
EALTNVISRF

SEQ ID NO: 82895 - protein, 10 aa, Artificial Sequence
  Description of Artificial Sequence: Synthetic peptide
  Seed: LQIPVSRSFS (MAGC1_HUMAN)
LIIPVSRSFF

SEQ ID NO: 82896 - protein, 9 aa, Artificial Sequence
  Description of Artificial Sequence: Synthetic peptide
  Seed: MGDKDMPTA (MAGC1_HUMAN)
MADKDMPTL

SEQ ID NO: 82897 - protein, 10 aa, Artificial Sequence
  Description of Artificial Sequence: Synthetic peptide
  Seed: LQIPGSPSFS (MAGC1_HUMAN)
LKIPGSPSFY

SEQ ID NO: 82898 - protein, 9 aa, Artificial Sequence
  Description of Artificial Sequence: Synthetic peptide
  Seed: VSRSFSSTL (MAGC1_HUMAN)
VERSFSSTM

SEQ ID NO: 82899 - protein, 9 aa, Artificial Sequence
  Description of Artificial Sequence: Synthetic peptide
  Seed: IIDTTDDST (MAGC1_HUMAN)
IADTTDDSL

SEQ ID NO: 82900 - protein, 10 aa, Artificial Sequence
  Description of Artificial Sequence: Synthetic peptide
  Seed: EESSSPVDEY (MAGC1_HUMAN)
EESSSPVDEW

SEQ ID NO: 82901 - protein, 8 aa, Artificial Sequence
  Description of Artificial Sequence: Synthetic peptide
  Seed: MSQNRLLI (MAGC1_HUMAN)
MAQNRLLL

SEQ ID NO: 82902 - protein, 9 aa, Artificial Sequence
  Description of Artificial Sequence: Synthetic peptide
  Seed: YTSSSDTLL (MAGC1_HUMAN)
YSSSSDTLW

SEQ ID NO: 82903 - protein, 9 aa, Artificial Sequence
  Description of Artificial Sequence: Synthetic peptide
  Seed: YQVKQPITK (MAGC1_HUMAN)
YTVKQPITY

SEQ ID NO: 82904 - protein, 9 aa, Artificial Sequence
  Description of Artificial Sequence: Synthetic peptide
  Seed: QVKQPITKA (MAGC1_HUMAN)
QVKQPITKM

SEQ ID NO: 82905 - protein, 9 aa, Artificial Sequence
  Description of Artificial Sequence: Synthetic peptide
  Seed: VIFRKAREF (MAGC1_HUMAN)
VMFRKAREM

SEQ ID NO: 82906 - protein, 11 aa, Artificial Sequence
  Description of Artificial Sequence: Synthetic peptide
  Seed: RPVSSFFSYTL (MAGC1_HUMAN)
RMVSSFFSYTM

SEQ ID NO: 82907 - protein, 10 aa, Artificial Sequence
  Description of Artificial Sequence: Synthetic peptide
  Seed: RAGREHFAFG (MAGC1_HUMAN)
RAGREHFAFY

SEQ ID NO: 82908 - protein, 11 aa, Artificial Sequence
  Description of Artificial Sequence: Synthetic peptide
  Seed: TLDEKVDELAR (MAGC1_HUMAN)
TVDEKVDELAM

SEQ ID NO: 82909 - protein, 9 aa, Artificial Sequence
  Description of Artificial Sequence: Synthetic peptide
  Seed: VIKRKVVEF (MAGC1_HUMAN)
VPKRKVVEV

SEQ ID NO: 82910 - protein, 9 aa, Artificial Sequence
  Description of Artificial Sequence: Synthetic peptide
  Seed: KVVEFLAML (MAGC1_HUMAN)
KTVEFLAMF

SEQ ID NO: 82911 - protein, 9 aa, Artificial Sequence
  Description of Artificial Sequence: Synthetic peptide
  Seed: SSSTLVSIF (MAGC1_HUMAN)
SVSTLVSIY

SEQ ID NO: 82912 - protein, 10 aa, Artificial Sequence
  Description of Artificial Sequence: Synthetic peptide
  Seed: TGYFPVIFRK (MAGC1_HUMAN)
TMYFPVIFRY

SEQ ID NO: 82913 - protein, 10 aa, Artificial Sequence
  Description of Artificial Sequence: Synthetic peptide
  Seed: ASSSTLVSIF (MAGC1_HUMAN)
ARSSTLVSIW

SEQ ID NO: 82914 - protein, 10 aa, Artificial Sequence
  Description of Artificial Sequence: Synthetic peptide
  Seed: RSFSSTLLSI (MAGC1_HUMAN)
REFSSTLLSM

SEQ ID NO: 82915 - protein, 9 aa, Artificial Sequence
  Description of Artificial Sequence: Synthetic peptide
  Seed: FAFGEPREL (MAGC1_HUMAN)
FIFGEPREY

SEQ ID NO: 82916 - protein, 10 aa, Artificial Sequence
  Description of Artificial Sequence: Synthetic peptide
  Seed: SRYTGYFPVI (MAGC1_HUMAN)
SDYTGYFPVI

SEQ ID NO: 82917 - protein, 11 aa, Artificial Sequence
  Description of Artificial Sequence: Synthetic peptide
  Seed: SQSSPEGKDSL (MAGC1_HUMAN)
SESSPEGKDSV

SEQ ID NO: 82918 - protein, 10 aa, Artificial Sequence
  Description of Artificial Sequence: Synthetic peptide
  Seed: VSSSSSSTLL (MAGC1_HUMAN)
VCSSSSSTLF

SEQ ID NO: 82919 - protein, 9 aa, Artificial Sequence
  Description of Artificial Sequence: Synthetic peptide
  Seed: SSFFSSALL (MAGC1_HUMAN)
SGFFSSALW

SEQ ID NO: 82920 - protein, 9 aa, Artificial Sequence
  Description of Artificial Sequence: Synthetic peptide
  Seed: RKAREFIEI (MAGC1_HUMAN)
REAREFIEF

SEQ ID NO: 82921 - protein, 10 aa, Artificial Sequence
  Description of Artificial Sequence: Synthetic peptide
  Seed: REFIEILFGI (MAGC1_HUMAN)
RKFIEILFGL

SEQ ID NO: 82922 - protein, 10 aa, Artificial Sequence
  Description of Artificial Sequence: Synthetic peptide
  Seed: LSQSSPVSSF (MAGC1_HUMAN)
LMQSSPVSSW

SEQ ID NO: 82923 - protein, 9 aa, Artificial Sequence
  Description of Artificial Sequence: Synthetic peptide
  Seed: VSRSFSSTL (MAGC1_HUMAN)
VVRSFSSTY

SEQ ID NO: 82924 - protein, 10 aa, Artificial Sequence
  Description of Artificial Sequence: Synthetic peptide
  Seed: VSRSFSSTLL (MAGC1_HUMAN)
VVRSFSSTLW

SEQ ID NO: 82925 - protein, 9 aa, Artificial Sequence
  Description of Artificial Sequence: Synthetic peptide
  Seed: YTGYFPVIF (MAGC1_HUMAN)
YKGYFPVIY

SEQ ID NO: 82926 - protein, 9 aa, Artificial Sequence
  Description of Artificial Sequence: Synthetic peptide
  Seed: ESDDTLYPL (MAGC1_HUMAN)
EMDDTLYPI

SEQ ID NO: 82927 - protein, 9 aa, Artificial Sequence
  Description of Artificial Sequence: Synthetic peptide
  Seed: IFQSSPESA (MAGC1_HUMAN)
IMQSSPESV

SEQ ID NO: 82928 - protein, 10 aa, Artificial Sequence
  Description of Artificial Sequence: Synthetic peptide
  Seed: YTLASLLQSS (MAGC1_HUMAN)
YTLASLLQSI

SEQ ID NO: 82929 - protein, 9 aa, Artificial Sequence
  Description of Artificial Sequence: Synthetic peptide
  Seed: FLWGPRAHS (MAGC1_HUMAN)
FLWGPRAHV

SEQ ID NO: 82930 - protein, 9 aa, Artificial Sequence
  Description of Artificial Sequence: Synthetic peptide
  Seed: FFSSALLSI (MAGC1_HUMAN)
FMSSALLSL

SEQ ID NO: 82931 - protein, 9 aa, Artificial Sequence
  Description of Artificial Sequence: Synthetic peptide
  Seed: SPQSPPEGP (MAGC1_HUMAN)
SPQSPPEGA

SEQ ID NO: 82932 - protein, 11 aa, Artificial Sequence
  Description of Artificial Sequence: Synthetic peptide
  Seed: SLIESEPLFTY (MAGC1_HUMAN)
SVIESEPLFTW

SEQ ID NO: 82933 - protein, 10 aa, Artificial Sequence
  Description of Artificial Sequence: Synthetic peptide
  Seed: KDVEERAQAI (MAGC1_HUMAN)
KEVEERAQAM

SEQ ID NO: 82934 - protein, 11 aa, Artificial Sequence
  Description of Artificial Sequence: Synthetic peptide
  Seed: SSFSYTLLSLF (MAGC1_HUMAN)
SVFSYTLLSLF

SEQ ID NO: 82935 - protein, 10 aa, Artificial Sequence
  Description of Artificial Sequence: Synthetic peptide
  Seed: FAQSSLQIPV (MAGC1_HUMAN)
FYQSSLQIPL

SEQ ID NO: 82936 - protein, 11 aa, Artificial Sequence
  Description of Artificial Sequence: Synthetic peptide
  Seed: IPVSAASSSTL (MAGC1_HUMAN)
IKVSAASSSTY

SEQ ID NO: 82937 - protein, 9 aa, Artificial Sequence
  Description of Artificial Sequence: Synthetic peptide
  Seed: FAFGEPREL (MAGC1_HUMAN)
FPFGEPREM

SEQ ID NO: 82938 - protein, 9 aa, Artificial Sequence
  Description of Artificial Sequence: Synthetic peptide
  Seed: VSSSFSYTL (MAGC1_HUMAN)
VISSFSYTF

SEQ ID NO: 82939 - protein, 9 aa, Artificial Sequence
  Description of Artificial Sequence: Synthetic peptide
  Seed: LKNTVPITF (MAGC1_HUMAN)
LYNTVPITL

SEQ ID NO: 82940 - protein, 9 aa, Artificial Sequence
  Description of Artificial Sequence: Synthetic peptide
  Seed: SSSTLLSLF (MAGC1_HUMAN)
SYSTLLSLF

SEQ ID NO: 82941 - protein, 11 aa, Artificial Sequence
  Description of Artificial Sequence: Synthetic peptide
  Seed: SSFSYTLLSLF (MAGC1_HUMAN)
STFSYTLLSLF

SEQ ID NO: 82942 - protein, 9 aa, Artificial Sequence
  Description of Artificial Sequence: Synthetic peptide
  Seed: FQSSLQSPV (MAGC1_HUMAN)
FKSSLQSPY

SEQ ID NO: 82943 - protein, 10 aa, Artificial Sequence
  Description of Artificial Sequence: Synthetic peptide
  Seed: IPVSSSFSYT (MAGC1_HUMAN)
IPVSSSFSYY

SEQ ID NO: 82944 - protein, 10 aa, Artificial Sequence
  Description of Artificial Sequence: Synthetic peptide
  Seed: FPQSPLQIPV (MAGC1_HUMAN)
FMQSPLQIPI

SEQ ID NO: 82945 - protein, 10 aa, Artificial Sequence
  Description of Artificial Sequence: Synthetic peptide
  Seed: KGTYASEEVI (MAGC1_HUMAN)
KFTYASEEVF

SEQ ID NO: 82946 - protein, 9 aa, Artificial Sequence
  Description of Artificial Sequence: Synthetic peptide
  Seed: SSSVMSPSF (MAGC1_HUMAN)
SASVMSPSV

SEQ ID NO: 82947 - protein, 9 aa, Artificial Sequence
  Description of Artificial Sequence: Synthetic peptide
  Seed: SPLQIPQSP (MAGC1_HUMAN)
SPLQIPQSF

SEQ ID NO: 82948 - protein, 10 aa, Artificial Sequence
  Description of Artificial Sequence: Synthetic peptide
  Seed: QIPVSSSFSY (MAGC1_HUMAN)
QKPVSSSFSY

SEQ ID NO: 82949 - protein, 11 aa, Artificial Sequence
  Description of Artificial Sequence: Synthetic peptide
  Seed: SRYTGYFPVIF (MAGC1_HUMAN)
SWYTGYFPVIW

SEQ ID NO: 82950 - protein, 9 aa, Artificial Sequence
  Description of Artificial Sequence: Synthetic peptide
  Seed: SLTDSESLI (MAGC1_HUMAN)
SATDSESLL

SEQ ID NO: 82951 - protein, 8 aa, Artificial Sequence
  Description of Artificial Sequence: Synthetic peptide
  Seed: LYFPQSPL (MAGC1_HUMAN)
LFFPQSPF

SEQ ID NO: 82952 - protein, 10 aa, Artificial Sequence
  Description of Artificial Sequence: Synthetic peptide
  Seed: STPSSLPQSF (MAGC1_HUMAN)
SHPSSLPQSL

SEQ ID NO: 82953 - protein, 9 aa, Artificial Sequence
  Description of Artificial Sequence: Synthetic peptide
  Seed: TTDDSTATE (MAGC1_HUMAN)
TNDDSTATL

SEQ ID NO: 82954 - protein, 10 aa, Artificial Sequence
  Description of Artificial Sequence: Synthetic peptide
  Seed: ASSFFSSALL (MAGC1_HUMAN)
AFSFFSSALY

SEQ ID NO: 82955 - protein, 8 aa, Artificial Sequence
  Description of Artificial Sequence: Synthetic peptide
  Seed: REFIEILF (MAGC1_HUMAN)
REFIEILL

SEQ ID NO: 82956 - protein, 9 aa, Artificial Sequence
  Description of Artificial Sequence: Synthetic peptide
  Seed: SQNRLLILI (MAGC1_HUMAN)
SENRLLILI

SEQ ID NO: 82957 - protein, 9 aa, Artificial Sequence
  Description of Artificial Sequence: Synthetic peptide
  Seed: SFSYTLLSL (MAGC1_HUMAN)
SASYTLLSV

SEQ ID NO: 82958 - protein, 10 aa, Artificial Sequence
  Description of Artificial Sequence: Synthetic peptide
  Seed: LQIPVSPSFS (MAGC1_HUMAN)
LMIPVSPSFW

SEQ ID NO: 82959 - protein, 9 aa, Artificial Sequence
  Description of Artificial Sequence: Synthetic peptide
  Seed: TFEGFPQSL (MAGC1_HUMAN)
TTEGFPQSW

SEQ ID NO: 82960 - protein, 9 aa, Artificial Sequence
  Description of Artificial Sequence: Synthetic peptide
  Seed: YVFVNTLDL (MAGC1_HUMAN)
YIFVNTLDF

SEQ ID NO: 82961 - protein, 9 aa, Artificial Sequence
  Description of Artificial Sequence: Synthetic peptide
  Seed: FFSYTLASL (MAGC1_HUMAN)
FVSYTLASM

SEQ ID NO: 82962 - protein, 10 aa, Artificial Sequence
  Description of Artificial Sequence: Synthetic peptide
  Seed: KVVEFLAMLK (MAGC1_HUMAN)
KPVEFLAMLR

SEQ ID NO: 82963 - protein, 9 aa, Artificial Sequence
  Description of Artificial Sequence: Synthetic peptide
  Seed: SSPEGKDSL (MAGC1_HUMAN)
SVPEGKDSL

SEQ ID NO: 82964 - protein, 11 aa, Artificial Sequence
  Description of Artificial Sequence: Synthetic peptide
  Seed: SSFSSTLLSIF (MAGC1_HUMAN)
STFSSTLLSIM

SEQ ID NO: 82965 - protein, 10 aa, Artificial Sequence
  Description of Artificial Sequence: Synthetic peptide
  Seed: ISRYTGYFPV (MAGC1_HUMAN)
IRRYTGYFPK

SEQ ID NO: 82966 - protein, 10 aa, Artificial Sequence
  Description of Artificial Sequence: Synthetic peptide
  Seed: SRYTGYFPVI (MAGC1_HUMAN)
SLYTGYFPVL

SEQ ID NO: 82967 - protein, 9 aa, Artificial Sequence
  Description of Artificial Sequence: Synthetic peptide
  Seed: TLDEKVDEL (MAGC1_HUMAN)
TFDEKVDEW

SEQ ID NO: 82968 - protein, 9 aa, Artificial Sequence
  Description of Artificial Sequence: Synthetic peptide
  Seed: FSSTLLSLF (MAGC1_HUMAN)
FNSTLLSLY

SEQ ID NO: 82969 - protein, 9 aa, Artificial Sequence
  Description of Artificial Sequence: Synthetic peptide
  Seed: LQIPGSPSF (MAGC1_HUMAN)
LPIPGSPSW

SEQ ID NO: 82970 - protein, 8 aa, Artificial Sequence
  Description of Artificial Sequence: Synthetic peptide
  Seed: AFGEPREL (MAGC1_HUMAN)
AAGEPREI

SEQ ID NO: 82971 - protein, 10 aa, Artificial Sequence
  Description of Artificial Sequence: Synthetic peptide
  Seed: FPQSLLQIPM (MAGC1_HUMAN)
FNQSLLQIPV

SEQ ID NO: 82972 - protein, 9 aa, Artificial Sequence
  Description of Artificial Sequence: Synthetic peptide
  Seed: VSPSSSSTL (MAGC1_HUMAN)
VIPSSSSTM

SEQ ID NO: 82973 - protein, 10 aa, Artificial Sequence
  Description of Artificial Sequence: Synthetic peptide
  Seed: RPVSSFFSYT (MAGC1_HUMAN)
RKVSSFFSYK

SEQ ID NO: 82974 - protein, 9 aa, Artificial Sequence
  Description of Artificial Sequence: Synthetic peptide
  Seed: SKSSPESPL (MAGC1_HUMAN)
SLSSPESPF

SEQ ID NO: 82975 - protein, 11 aa, Artificial Sequence
  Description of Artificial Sequence: Synthetic peptide
  Seed: IPVSSSSSSTL (MAGC1_HUMAN)
IRVSSSSSSTW

SEQ ID NO: 82976 - protein, 8 aa, Artificial Sequence
  Description of Artificial Sequence: Synthetic peptide
  Seed: AFGEPREL (MAGC1_HUMAN)
AAGEPREF

SEQ ID NO: 82977 - protein, 9 aa, Artificial Sequence
  Description of Artificial Sequence: Synthetic peptide
  Seed: ILILSIIFI (MAGC1_HUMAN)
IQILSIIFL

SEQ ID NO: 82978 - protein, 9 aa, Artificial Sequence
  Description of Artificial Sequence: Synthetic peptide
  Seed: FSSTLLSIL (MAGC1_HUMAN)
FISTLLSIW

SEQ ID NO: 82979 - protein, 10 aa, Artificial Sequence
  Description of Artificial Sequence: Synthetic peptide
  Seed: ATESASSSVM (MAGC1_HUMAN)
AHESASSSVL

SEQ ID NO: 82980 - protein, 9 aa, Artificial Sequence
  Description of Artificial Sequence: Synthetic peptide
  Seed: VPITFPSSY (MAGC1_HUMAN)
VAITFPSSV

SEQ ID NO: 82981 - protein, 10 aa, Artificial Sequence
  Description of Artificial Sequence: Synthetic peptide
  Seed: SPLYFPQSPL (MAGC1_HUMAN)
SMLYFPQSPL

SEQ ID NO: 82982 - protein, 9 aa, Artificial Sequence
  Description of Artificial Sequence: Synthetic peptide
  Seed: IGVRAGREH (MAGC1_HUMAN)
IAVRAGREY

SEQ ID NO: 82983 - protein, 10 aa, Artificial Sequence
  Description of Artificial Sequence: Synthetic peptide
  Seed: RAGREHFAFG (MAGC1_HUMAN)
RKGREHFAFV

SEQ ID NO: 82984 - protein, 9 aa, Artificial Sequence
  Description of Artificial Sequence: Synthetic peptide
  Seed: ASSFFSSAL (MAGC1_HUMAN)
AHSFFSSAF

SEQ ID NO: 82985 - protein, 9 aa, Artificial Sequence
  Description of Artificial Sequence: Synthetic peptide
  Seed: KAREFIEIL (MAGC1_HUMAN)
KLREFIEIK

SEQ ID NO: 82986 - protein, 9 aa, Artificial Sequence
  Description of Artificial Sequence: Synthetic peptide
  Seed: TSLSLPQSF (MAGC1_HUMAN)
TILSLPQSL

SEQ ID NO: 82987 - protein, 9 aa, Artificial Sequence
  Description of Artificial Sequence: Synthetic peptide
  Seed: VISRYTGYF (MAGC1_HUMAN)
VSSRYTGYL

SEQ ID NO: 82988 - protein, 10 aa, Artificial Sequence
  Description of Artificial Sequence: Synthetic peptide
  Seed: REFIEILFGI (MAGC1_HUMAN)
RWFIEILFGW

SEQ ID NO: 82989 - protein, 9 aa, Artificial Sequence
  Description of Artificial Sequence: Synthetic peptide
  Seed: ISFSSSTSL (MAGC1_HUMAN)
IAFSSSTSF

SEQ ID NO: 82990 - protein, 9 aa, Artificial Sequence
  Description of Artificial Sequence: Synthetic peptide
  Seed: ISFSSSTSL (MAGC1_HUMAN)
ILFSSSTSL

SEQ ID NO: 82991 - protein, 10 aa, Artificial Sequence
  Description of Artificial Sequence: Synthetic peptide
  Seed: VSAASSSTLV (MAGC1_HUMAN)
VAAASSSTLF

SEQ ID NO: 82992 - protein, 9 aa, Artificial Sequence
  Description of Artificial Sequence: Synthetic peptide
  Seed: LQIVPSLPE (MAGC1_HUMAN)
LAIVPSLPL

SEQ ID NO: 82993 - protein, 9 aa, Artificial Sequence
  Description of Artificial Sequence: Synthetic peptide
  Seed: FSYTLASLL (MAGC1_HUMAN)
FMYTLASLC

SEQ ID NO: 82994 - protein, 11 aa, Artificial Sequence
  Description of Artificial Sequence: Synthetic peptide
  Seed: SSFPSSTSSSL (MAGC1_HUMAN)
SQFPSSTSSSL

SEQ ID NO: 82995 - protein, 9 aa, Artificial Sequence
  Description of Artificial Sequence: Synthetic peptide
  Seed: FPSSTSSSL (MAGC1_HUMAN)
FFSSTSSSM

SEQ ID NO: 82996 - protein, 10 aa, Artificial Sequence
  Description of Artificial Sequence: Synthetic peptide
  Seed: FPQSPLQIPV (MAGC1_HUMAN)
FSQSPLQIPI

SEQ ID NO: 82997 - protein, 10 aa, Artificial Sequence
  Description of Artificial Sequence: Synthetic peptide
  Seed: MPTAGMPSLL (MAGC1_HUMAN)
MRTAGMPSLL

SEQ ID NO: 82998 - protein, 10 aa, Artificial Sequence
  Description of Artificial Sequence: Synthetic peptide
  Seed: ICSSSTPSSL (MAGC1_HUMAN)
IVSSSTPSSL

SEQ ID NO: 82999 - protein, 9 aa, Artificial Sequence
  Description of Artificial Sequence: Synthetic peptide
  Seed: SSPESDDTL (MAGC1_HUMAN)
SHPESDDTI

SEQ ID NO: 83000 - protein, 9 aa, Artificial Sequence
  Description of Artificial Sequence: Synthetic peptide
  Seed: IFQSSPESA (MAGC1_HUMAN)
ILQSSPESI

SEQ ID NO: 83001 - protein, 10 aa, Artificial Sequence
  Description of Artificial Sequence: Synthetic peptide
  Seed: EVIWDVLSGI (MAGC1_HUMAN)
EMIWDVLSGL

SEQ ID NO: 83002 - protein, 9 aa, Artificial Sequence
  Description of Artificial Sequence: Synthetic peptide
  Seed: KVDELARFL (MAGC1_HUMAN)
KLDELARFL

SEQ ID NO: 83003 - protein, 10 aa, Artificial Sequence
  Description of Artificial Sequence: Synthetic peptide
  Seed: QIPVSSSFSY (MAGC1_HUMAN)
QHPVSSSFSM

SEQ ID NO: 83004 - protein, 9 aa, Artificial Sequence
  Description of Artificial Sequence: Synthetic peptide
  Seed: YTSSSDTLL (MAGC1_HUMAN)
YSSSSDTLF

SEQ ID NO: 83005 - protein, 9 aa, Artificial Sequence
  Description of Artificial Sequence: Synthetic peptide
  Seed: SSPESTQSP (MAGC1_HUMAN)
SLPESTQSF

SEQ ID NO: 83006 - protein, 10 aa, Artificial Sequence
  Description of Artificial Sequence: Synthetic peptide
  Seed: FQSSLQSPVS (MAGC1_HUMAN)
FLSSLQSPVL

SEQ ID NO: 83007 - protein, 9 aa, Artificial Sequence
  Description of Artificial Sequence: Synthetic peptide
  Seed: LQIPMTSSF (MAGC1_HUMAN)
LMIPMTSSL

SEQ ID NO: 83008 - protein, 9 aa, Artificial Sequence
  Description of Artificial Sequence: Synthetic peptide
  Seed: YQVKQPITK (MAGC1_HUMAN)
YTVKQPITK

SEQ ID NO: 83009 - protein, 10 aa, Artificial Sequence
  Description of Artificial Sequence: Synthetic peptide
  Seed: SLSPLHFPQF (MAGC1_HUMAN)
SQSPLHFPQM

SEQ ID NO: 83010 - protein, 9 aa, Artificial Sequence
  Description of Artificial Sequence: Synthetic peptide
  Seed: NTVPITFPS (MAGC1_HUMAN)
NYVPITFPR

SEQ ID NO: 83011 - protein, 9 aa, Artificial Sequence
  Description of Artificial Sequence: Synthetic peptide
  Seed: LSPLHFPQF (MAGC1_HUMAN)
LYPLHFPQV

SEQ ID NO: 83012 - protein, 9 aa, Artificial Sequence
  Description of Artificial Sequence: Synthetic peptide
  Seed: SQSPPEGPV (MAGC1_HUMAN)
SASPPEGPM

SEQ ID NO: 83013 - protein, 9 aa, Artificial Sequence
  Description of Artificial Sequence: Synthetic peptide
  Seed: RKAREFIEI (MAGC1_HUMAN)
RRAREFIEL

SEQ ID NO: 83014 - protein, 11 aa, Artificial Sequence
  Description of Artificial Sequence: Synthetic peptide
  Seed: STFEGFPQSLL (MAGC1_HUMAN)
SMFEGFPQSLY

SEQ ID NO: 83015 - protein, 10 aa, Artificial Sequence
  Description of Artificial Sequence: Synthetic peptide
  Seed: FSSSTSLSPF (MAGC1_HUMAN)
FFSSTSLSPF

SEQ ID NO: 83016 - protein, 8 aa, Artificial Sequence
  Description of Artificial Sequence: Synthetic peptide
  Seed: RSFSSTLL (MAGC1_HUMAN)
RTFSSTLW

SEQ ID NO: 83017 - protein, 10 aa, Artificial Sequence
  Description of Artificial Sequence: Synthetic peptide
  Seed: FLAMLKNTVP (MAGC1_HUMAN)
FLAMLKNTVD

SEQ ID NO: 83018 - protein, 9 aa, Artificial Sequence
  Description of Artificial Sequence: Synthetic peptide
  Seed: FTYTLDEKV (MAGC1_HUMAN)
FMYTLDEKM

SEQ ID NO: 83019 - protein, 10 aa, Artificial Sequence
  Description of Artificial Sequence: Synthetic peptide
  Seed: SFPSSTSSSL (MAGC1_HUMAN)
SWPSSTSSSV

SEQ ID NO: 83020 - protein, 10 aa, Artificial Sequence
  Description of Artificial Sequence: Synthetic peptide
  Seed: LQIPVSPSFS (MAGC1_HUMAN)
LQIPVSPSFH

SEQ ID NO: 83021 - protein, 10 aa, Artificial Sequence
  Description of Artificial Sequence: Synthetic peptide
  Seed: TGYFPVIFRK (MAGC1_HUMAN)
TVYFPVIFRS

SEQ ID NO: 83022 - protein, 9 aa, Artificial Sequence
  Description of Artificial Sequence: Synthetic peptide
  Seed: VSSFFSYTL (MAGC1_HUMAN)
VMSFFSYTF

SEQ ID NO: 83023 - protein, 9 aa, Artificial Sequence
  Description of Artificial Sequence: Synthetic peptide
  Seed: EHFAFGEPR (MAGC1_HUMAN)
EAFAFGEPK

SEQ ID NO: 83024 - protein, 10 aa, Artificial Sequence
  Description of Artificial Sequence: Synthetic peptide
  Seed: RSFSSTLLSI (MAGC1_HUMAN)
RTFSSTLLSA

SEQ ID NO: 83025 - protein, 10 aa, Artificial Sequence
  Description of Artificial Sequence: Synthetic peptide
  Seed: ASEEVIWDVL (MAGC1_HUMAN)
AEEEVIWDVL

SEQ ID NO: 83026 - protein, 9 aa, Artificial Sequence
  Description of Artificial Sequence: Synthetic peptide
  Seed: FQSSLQSPV (MAGC1_HUMAN)
FQSSLQSPY

SEQ ID NO: 83027 - protein, 8 aa, Artificial Sequence
  Description of Artificial Sequence: Synthetic peptide
  Seed: LQNPASSF (MAGC1_HUMAN)
LMNPASSY

SEQ ID NO: 83028 - protein, 9 aa, Artificial Sequence
  Description of Artificial Sequence: Synthetic peptide
  Seed: FFSYTLASL (MAGC1_HUMAN)
FMSYTLASS

SEQ ID NO: 83029 - protein, 11 aa, Artificial Sequence
  Description of Artificial Sequence: Synthetic peptide
  Seed: SFFSSALLSIF (MAGC1_HUMAN)
SSFSSALLSIF

SEQ ID NO: 83030 - protein, 10 aa, Artificial Sequence
  Description of Artificial Sequence: Synthetic peptide
  Seed: MTSSFSSTLL (MAGC1_HUMAN)
MHSSFSSTLM

SEQ ID NO: 83031 - protein, 11 aa, Artificial Sequence
  Description of Artificial Sequence: Synthetic peptide
  Seed: IPVSAASSSTL (MAGC1_HUMAN)
IAVSAASSSTM

SEQ ID NO: 83032 - protein, 9 aa, Artificial Sequence
  Description of Artificial Sequence: Synthetic peptide
  Seed: SPPEGPVQS (MAGC1_HUMAN)
SPPEGPVQV

SEQ ID NO: 83033 - protein, 9 aa, Artificial Sequence
  Description of Artificial Sequence: Synthetic peptide
  Seed: LQIPVSSSS (MAGC1_HUMAN)
LLIPVSSSW

SEQ ID NO: 83034 - protein, 11 aa, Artificial Sequence
  Description of Artificial Sequence: Synthetic peptide
  Seed: VIWDVLSGIGV (MAGC1_HUMAN)
VMWDVLSGIGL

SEQ ID NO: 83035 - protein, 11 aa, Artificial Sequence
  Description of Artificial Sequence: Synthetic peptide
  Seed: VISRYTGYFPV (MAGC1_HUMAN)
VRSRYTGYFPL

SEQ ID NO: 83036 - protein, 10 aa, Artificial Sequence
  Description of Artificial Sequence: Synthetic peptide
  Seed: SSPECTQSTF (MAGC1_HUMAN)
SLPECTQSTM

SEQ ID NO: 83037 - protein, 10 aa, Artificial Sequence
  Description of Artificial Sequence: Synthetic peptide
  Seed: FFSYTLASLL (MAGC1_HUMAN)
FGSYTLASLY

SEQ ID NO: 83038 - protein, 9 aa, Artificial Sequence
  Description of Artificial Sequence: Synthetic peptide
  Seed: SPLQIVPSL (MAGC1_HUMAN)
SLLQIVPSA

SEQ ID NO: 83039 - protein, 9 aa, Artificial Sequence
  Description of Artificial Sequence: Synthetic peptide
  Seed: SLIESEPLF (MAGC1_HUMAN)
SKIESEPLY

SEQ ID NO: 83040 - protein, 10 aa, Artificial Sequence
  Description of Artificial Sequence: Synthetic peptide
  Seed: LQIPVSSSFS (MAGC1_HUMAN)
LIIPVSSSFY

SEQ ID NO: 83041 - protein, 9 aa, Artificial Sequence
  Description of Artificial Sequence: Synthetic peptide
  Seed: LQNPASSFF (MAGC1_HUMAN)
LVNPASSFF

SEQ ID NO: 83042 - protein, 10 aa, Artificial Sequence
  Description of Artificial Sequence: Synthetic peptide
  Seed: RKVVEFLAML (MAGC1_HUMAN)
RSVVEFLAMV

SEQ ID NO: 83043 - protein, 9 aa, Artificial Sequence
  Description of Artificial Sequence: Synthetic peptide
  Seed: SVLQIPVSA (MAGC1_HUMAN)
STLQIPVSK

SEQ ID NO: 83044 - protein, 10 aa, Artificial Sequence
  Description of Artificial Sequence: Synthetic peptide
  Seed: MPTAGMPSLL (MAGC1_HUMAN)
MRTAGMPSLA

SEQ ID NO: 83045 - protein, 10 aa, Artificial Sequence
  Description of Artificial Sequence: Synthetic peptide
  Seed: AASSSTLVSI (MAGC1_HUMAN)
AASSSTLVSM

SEQ ID NO: 83046 - protein, 10 aa, Artificial Sequence
  Description of Artificial Sequence: Synthetic peptide
  Seed: SSPECTQSTF (MAGC1_HUMAN)
SAPECTQSTW

SEQ ID NO: 83047 - protein, 11 aa, Artificial Sequence
  Description of Artificial Sequence: Synthetic peptide
  Seed: SSSSSTLLSLF (MAGC1_HUMAN)
SNSSSTLLSLW

SEQ ID NO: 83048 - protein, 10 aa, Artificial Sequence
  Description of Artificial Sequence: Synthetic peptide
  Seed: SSSSSTLLSL (MAGC1_HUMAN)
SRSSSTLLSW

SEQ ID NO: 83049 - protein, 9 aa, Artificial Sequence
  Description of Artificial Sequence: Synthetic peptide
  Seed: NSSPPRYEF (MAGC1_HUMAN)
NTSPPRYEY

SEQ ID NO: 83050 - protein, 9 aa, Artificial Sequence
  Description of Artificial Sequence: Synthetic peptide
  Seed: VSAASSSTL (MAGC1_HUMAN)
VYAASSSTY

SEQ ID NO: 83051 - protein, 9 aa, Artificial Sequence
  Description of Artificial Sequence: Synthetic peptide
  Seed: KAREFIEIL (MAGC1_HUMAN)
KIREFIEII

SEQ ID NO: 83052 - protein, 9 aa, Artificial Sequence
  Description of Artificial Sequence: Synthetic peptide
  Seed: YTLASLLQS (MAGC1_HUMAN)
YILASLLQA

SEQ ID NO: 83053 - protein, 9 aa, Artificial Sequence
  Description of Artificial Sequence: Synthetic peptide
  Seed: FPQFPPQGE (MAGC1_HUMAN)
FPQFPPQGT

SEQ ID NO: 83054 - protein, 9 aa, Artificial Sequence
  Description of Artificial Sequence: Synthetic peptide
  Seed: QIVPSLPEW (MAGC1_HUMAN)
QTVPSLPEI

SEQ ID NO: 83055 - protein, 9 aa, Artificial Sequence
  Description of Artificial Sequence: Synthetic peptide
  Seed: ASSFFSSAL (MAGC1_HUMAN)
ALSFFSSAV

SEQ ID NO: 83056 - protein, 9 aa, Artificial Sequence
  Description of Artificial Sequence: Synthetic peptide
  Seed: AMLKNTVPI (MAGC1_HUMAN)
AKLKNTVPF

SEQ ID NO: 83057 - protein, 10 aa, Artificial Sequence
  Description of Artificial Sequence: Synthetic peptide
  Seed: LQIPVSSSFS (MAGC1_HUMAN)
LEIPVSSSFF

SEQ ID NO: 83058 - protein, 9 aa, Artificial Sequence
  Description of Artificial Sequence: Synthetic peptide
  Seed: LQSPVISFS (MAGC1_HUMAN)
LGSPVISFV

SEQ ID NO: 83059 - protein, 9 aa, Artificial Sequence
  Description of Artificial Sequence: Synthetic peptide
  Seed: ISFSSSTSL (MAGC1_HUMAN)
ISFSSSTSF

SEQ ID NO: 83060 - protein, 9 aa, Artificial Sequence
  Description of Artificial Sequence: Synthetic peptide
  Seed: SSSTLLSLF (MAGC1_HUMAN)
SVSTLLSLY

SEQ ID NO: 83061 - protein, 9 aa, Artificial Sequence
  Description of Artificial Sequence: Synthetic peptide
  Seed: GTYASEEVI (MAGC1_HUMAN)
GTYASEEVY

SEQ ID NO: 83062 - protein, 9 aa, Artificial Sequence
  Description of Artificial Sequence: Synthetic peptide
  Seed: YVFVNTLDL (MAGC1_HUMAN)
YAFVNTLDW

SEQ ID NO: 83063 - protein, 9 aa, Artificial Sequence
  Description of Artificial Sequence: Synthetic peptide
  Seed: LQNPASSFF (MAGC1_HUMAN)
LGNPASSFW

SEQ ID NO: 83064 - protein, 9 aa, Artificial Sequence
  Description of Artificial Sequence: Synthetic peptide
  Seed: TESASSSVM (MAGC1_HUMAN)
TRSASSSVM

SEQ ID NO: 83065 - protein, 8 aa, Artificial Sequence
  Description of Artificial Sequence: Synthetic peptide
  Seed: LQIPQSPL (MAGC1_HUMAN)
LQIPQSPM

SEQ ID NO: 83066 - protein, 10 aa, Artificial Sequence
  Description of Artificial Sequence: Synthetic peptide
  Seed: GEDSMSPLYF (MAGC1_HUMAN)
GEDSMSPLYM

SEQ ID NO: 83067 - protein, 11 aa, Artificial Sequence
  Description of Artificial Sequence: Synthetic peptide
  Seed: STFEGFPQSLL (MAGC1_HUMAN)
SAFEGFPQSLY

SEQ ID NO: 83068 - protein, 9 aa, Artificial Sequence
  Description of Artificial Sequence: Synthetic peptide
  Seed: LQIPVSSSS (MAGC1_HUMAN)
LQIPVSSSL

SEQ ID NO: 83069 - protein, 9 aa, Artificial Sequence
  Description of Artificial Sequence: Synthetic peptide
  Seed: ASSFFSSAL (MAGC1_HUMAN)
AISFFSSAV

SEQ ID NO: 83070 - protein, 11 aa, Artificial Sequence
  Description of Artificial Sequence: Synthetic peptide
  Seed: SSTSLSLPQSF (MAGC1_HUMAN)
SYTSLSLPQSW

SEQ ID NO: 83071 - protein, 9 aa, Artificial Sequence
  Description of Artificial Sequence: Synthetic peptide
  Seed: TGYFPVIFR (MAGC1_HUMAN)
TVYFPVIFR

SEQ ID NO: 83072 - protein, 9 aa, Artificial Sequence
  Description of Artificial Sequence: Synthetic peptide
  Seed: CSSSTSLSL (MAGC1_HUMAN)
CNSSTSLSY

SEQ ID NO: 83073 - protein, 10 aa, Artificial Sequence
  Description of Artificial Sequence: Synthetic peptide
  Seed: ITKAEMLTNV (MAGC1_HUMAN)
ILKAEMLTNM

SEQ ID NO: 83074 - protein, 10 aa, Artificial Sequence
  Description of Artificial Sequence: Synthetic peptide
  Seed: FAFGEPRELL (MAGC1_HUMAN)
FTFGEPRELW

SEQ ID NO: 83075 - protein, 10 aa, Artificial Sequence
  Description of Artificial Sequence: Synthetic peptide
  Seed: FQSSLQSPVS (MAGC1_HUMAN)
FVSSLQSPVL

SEQ ID NO: 83076 - protein, 10 aa, Artificial Sequence
  Description of Artificial Sequence: Synthetic peptide
  Seed: RKVVEFLAML (MAGC1_HUMAN)
RMVVEFLAMI

SEQ ID NO: 83077 - protein, 10 aa, Artificial Sequence
  Description of Artificial Sequence: Synthetic peptide
  Seed: SFSERTQSTF (MAGC1_HUMAN)
SFSERTQSTM

SEQ ID NO: 83078 - protein, 9 aa, Artificial Sequence
  Description of Artificial Sequence: Synthetic peptide
  Seed: VSSFFSYTL (MAGC1_HUMAN)
VTSFFSYTW

SEQ ID NO: 83079 - protein, 10 aa, Artificial Sequence
  Description of Artificial Sequence: Synthetic peptide
  Seed: FFSYTLASLL (MAGC1_HUMAN)
FMSYTLASLY

SEQ ID NO: 83080 - protein, 9 aa, Artificial Sequence
  Description of Artificial Sequence: Synthetic peptide
  Seed: EHFAFGEPR (MAGC1_HUMAN)
EIFAFGEPY

SEQ ID NO: 83081 - protein, 9 aa, Artificial Sequence
  Description of Artificial Sequence: Synthetic peptide
  Seed: LKNTVPITF (MAGC1_HUMAN)
LLNTVPITY

SEQ ID NO: 83082 - protein, 11 aa, Artificial Sequence
  Description of Artificial Sequence: Synthetic peptide
  Seed: QSSPERTHSTF (MAGC1_HUMAN)
QSSPERTHSTW

SEQ ID NO: 83083 - protein, 9 aa, Artificial Sequence
  Description of Artificial Sequence: Synthetic peptide
  Seed: FFSSALLSI (MAGC1_HUMAN)
FGSSALLSL

SEQ ID NO: 83084 - protein, 9 aa, Artificial Sequence
  Description of Artificial Sequence: Synthetic peptide
  Seed: NTHSPLQIV (MAGC1_HUMAN)
NTHSPLQIY

SEQ ID NO: 83085 - protein, 9 aa, Artificial Sequence
  Description of Artificial Sequence: Synthetic peptide
  Seed: SSPESAQSA (MAGC1_HUMAN)
SMPESAQSM

SEQ ID NO: 83086 - protein, 9 aa, Artificial Sequence
  Description of Artificial Sequence: Synthetic peptide
  Seed: SPLQIPGSP (MAGC1_HUMAN)
SPLQIPGSM

SEQ ID NO: 83087 - protein, 9 aa, Artificial Sequence
  Description of Artificial Sequence: Synthetic peptide
  Seed: ISFSSSTSL (MAGC1_HUMAN)
ILFSSSTSK

SEQ ID NO: 83088 - protein, 9 aa, Artificial Sequence
  Description of Artificial Sequence: Synthetic peptide
  Seed: SPLQIVPSL (MAGC1_HUMAN)
SHLQIVPSV

SEQ ID NO: 83089 - protein, 10 aa, Artificial Sequence
  Description of Artificial Sequence: Synthetic peptide
  Seed: ICSSSTSLSL (MAGC1_HUMAN)
ICSSSTSLSF

SEQ ID NO: 83090 - protein, 9 aa, Artificial Sequence
  Description of Artificial Sequence: Synthetic peptide
  Seed: YTSSSDTLL (MAGC1_HUMAN)
YVSSSDTLY

SEQ ID NO: 83091 - protein, 10 aa, Artificial Sequence
  Description of Artificial Sequence: Synthetic peptide
  Seed: PLQIPVSSSF (MAGC1_HUMAN)
PWQIPVSSSM

SEQ ID NO: 83092 - protein, 11 aa, Artificial Sequence
  Description of Artificial Sequence: Synthetic peptide
  Seed: FPSSTSSSLSK (MAGC1_HUMAN)
FPSSTSSSLSA

SEQ ID NO: 83093 - protein, 9 aa, Artificial Sequence
  Description of Artificial Sequence: Synthetic peptide
  Seed: STQSPFEGF (MAGC1_HUMAN)
SYQSPFEGI

SEQ ID NO: 83094 - protein, 8 aa, Artificial Sequence
  Description of Artificial Sequence: Synthetic peptide
  Seed: FEGFPQSV (MAGC1_HUMAN)
FAGFPQSL

SEQ ID NO: 83095 - protein, 9 aa, Artificial Sequence
  Description of Artificial Sequence: Synthetic peptide
  Seed: SSPESPLQS (MAGC1_HUMAN)
SMPESPLQF

SEQ ID NO: 83096 - protein, 11 aa, Artificial Sequence
  Description of Artificial Sequence: Synthetic peptide
  Seed: AIIDTTDDSTA (MAGC1_HUMAN)
AIIDTTDDSTV

SEQ ID NO: 83097 - protein, 9 aa, Artificial Sequence
  Description of Artificial Sequence: Synthetic peptide
  Seed: GEDSLSPHY (MAGC1_HUMAN)
GEDSLSPHF

SEQ ID NO: 83098 - protein, 10 aa, Artificial Sequence
  Description of Artificial Sequence: Synthetic peptide
  Seed: IWDVLSGIGV (MAGC1_HUMAN)
IYDVLSGIGF

SEQ ID NO: 83099 - protein, 9 aa, Artificial Sequence
  Description of Artificial Sequence: Synthetic peptide
  Seed: IEILFGISL (MAGC1_HUMAN)
IQILFGISY

SEQ ID NO: 83100 - protein, 10 aa, Artificial Sequence
  Description of Artificial Sequence: Synthetic peptide
  Seed: SFSSTLLSIF (MAGC1_HUMAN)
SHSSTLLSIY

SEQ ID NO: 83101 - protein, 10 aa, Artificial Sequence
  Description of Artificial Sequence: Synthetic peptide
  Seed: SPLYFPQSPL (MAGC1_HUMAN)
SVLYFPQSPV

SEQ ID NO: 83102 - protein, 10 aa, Artificial Sequence
  Description of Artificial Sequence: Synthetic peptide
  Seed: LAMLKNTVPI (MAGC1_HUMAN)
LQMLKNTVPL

SEQ ID NO: 83103 - protein, 9 aa, Artificial Sequence
  Description of Artificial Sequence: Synthetic peptide
  Seed: AQSPLQSPV (MAGC1_HUMAN)
AMSPLQSPT

SEQ ID NO: 83104 - protein, 9 aa, Artificial Sequence
  Description of Artificial Sequence: Synthetic peptide
  Seed: NTHSPLQIV (MAGC1_HUMAN)
NSHSPLQIF

SEQ ID NO: 83105 - protein, 10 aa, Artificial Sequence
  Description of Artificial Sequence: Synthetic peptide
  Seed: YTGYFPVIFR (MAGC1_HUMAN)
YLGYFPVIFR

SEQ ID NO: 83106 - protein, 9 aa, Artificial Sequence
  Description of Artificial Sequence: Synthetic peptide
  Seed: TGYFPVIFR (MAGC1_HUMAN)
TTYFPVIFR

SEQ ID NO: 83107 - protein, 9 aa, Artificial Sequence
  Description of Artificial Sequence: Synthetic peptide
  Seed: SSSTLVSIF (MAGC1_HUMAN)
SQSTLVSII

SEQ ID NO: 83108 - protein, 9 aa, Artificial Sequence
  Description of Artificial Sequence: Synthetic peptide
  Seed: VQSPLHSPQ (MAGC1_HUMAN)
VGSPLHSPY

SEQ ID NO: 83109 - protein, 10 aa, Artificial Sequence
  Description of Artificial Sequence: Synthetic peptide
  Seed: LQIVPSLPEW (MAGC1_HUMAN)
LMIVPSLPEW

SEQ ID NO: 83110 - protein, 10 aa, Artificial Sequence
  Description of Artificial Sequence: Synthetic peptide
  Seed: NTVPITFPSS (MAGC1_HUMAN)
NVVPITFPSV

SEQ ID NO: 83111 - protein, 9 aa, Artificial Sequence
  Description of Artificial Sequence: Synthetic peptide
  Seed: NPASSFFSS (MAGC1_HUMAN)
NIASSFFSF

SEQ ID NO: 83112 - protein, 9 aa, Artificial Sequence
  Description of Artificial Sequence: Synthetic peptide
  Seed: TFEGFPQSL (MAGC1_HUMAN)
TLEGFPQSV

SEQ ID NO: 83113 - protein, 10 aa, Artificial Sequence
  Description of Artificial Sequence: Synthetic peptide
  Seed: SRYTGYFPVI (MAGC1_HUMAN)
SPYTGYFPVW

SEQ ID NO: 83114 - protein, 10 aa, Artificial Sequence
  Description of Artificial Sequence: Synthetic peptide
  Seed: HSPQSPPEGM (MAGC1_HUMAN)
HQPQSPPEGY

SEQ ID NO: 83115 - protein, 9 aa, Artificial Sequence
  Description of Artificial Sequence: Synthetic peptide
  Seed: FAFGEPREL (MAGC1_HUMAN)
FVFGEPREA

SEQ ID NO: 83116 - protein, 9 aa, Artificial Sequence
  Description of Artificial Sequence: Synthetic peptide
  Seed: GSPSFSSTL (MAGC1_HUMAN)
GMPSFSSTI

SEQ ID NO: 83117 - protein, 9 aa, Artificial Sequence
  Description of Artificial Sequence: Synthetic peptide
  Seed: SSSDTLLES (MAGC1_HUMAN)
SVSDTLLEH

SEQ ID NO: 83118 - protein, 11 aa, Artificial Sequence
  Description of Artificial Sequence: Synthetic peptide
  Seed: TTDDSTATESA (MAGC1_HUMAN)
TSDDSTATESI

SEQ ID NO: 83119 - protein, 11 aa, Artificial Sequence
  Description of Artificial Sequence: Synthetic peptide
  Seed: SPLQIPGSPSF (MAGC1_HUMAN)
SHLQIPGSPSY

SEQ ID NO: 83120 - protein, 9 aa, Artificial Sequence
  Description of Artificial Sequence: Synthetic peptide
  Seed: TSLSLPQSF (MAGC1_HUMAN)
TMLSLPQSL

SEQ ID NO: 83121 - protein, 9 aa, Artificial Sequence
  Description of Artificial Sequence: Synthetic peptide
  Seed: ISFSSSTSL (MAGC1_HUMAN)
IAFSSSTSY

SEQ ID NO: 83122 - protein, 9 aa, Artificial Sequence
  Description of Artificial Sequence: Synthetic peptide
  Seed: LKNTVPITF (MAGC1_HUMAN)
LTNTVPITY

SEQ ID NO: 83123 - protein, 9 aa, Artificial Sequence
  Description of Artificial Sequence: Synthetic peptide
  Seed: LSPLHFPQF (MAGC1_HUMAN)
LTPLHFPQF

SEQ ID NO: 83124 - protein, 9 aa, Artificial Sequence
  Description of Artificial Sequence: Synthetic peptide
  Seed: LLILILSII (MAGC1_HUMAN)
LVILILSIV

SEQ ID NO: 83125 - protein, 9 aa, Artificial Sequence
  Description of Artificial Sequence: Synthetic peptide
  Seed: SSFFSSALL (MAGC1_HUMAN)
SEFFSSALM

SEQ ID NO: 83126 - protein, 11 aa, Artificial Sequence
  Description of Artificial Sequence: Synthetic peptide
  Seed: KGTYASEEVIW (MAGC1_HUMAN)
KYTYASEEVIF

SEQ ID NO: 83127 - protein, 9 aa, Artificial Sequence
  Description of Artificial Sequence: Synthetic peptide
  Seed: SSHESPQSP (MAGC1_HUMAN)
SGHESPQSM

SEQ ID NO: 83128 - protein, 9 aa, Artificial Sequence
  Description of Artificial Sequence: Synthetic peptide
  Seed: VSPSFSSTL (MAGC1_HUMAN)
VSPSFSSTV

SEQ ID NO: 83129 - protein, 11 aa, Artificial Sequence
  Description of Artificial Sequence: Synthetic peptide
  Seed: SPLQIPVSRSF (MAGC1_HUMAN)
SWLQIPVSRSF

SEQ ID NO: 83130 - protein, 9 aa, Artificial Sequence
  Description of Artificial Sequence: Synthetic peptide
  Seed: IGVRAGREH (MAGC1_HUMAN)
ISVRAGREY

SEQ ID NO: 83131 - protein, 9 aa, Artificial Sequence
  Description of Artificial Sequence: Synthetic peptide
  Seed: ESSSPVDEY (MAGC1_HUMAN)
EMSSPVDEK

SEQ ID NO: 83132 - protein, 11 aa, Artificial Sequence
  Description of Artificial Sequence: Synthetic peptide
  Seed: SFFSSALLSIF (MAGC1_HUMAN)
SYFSSALLSIM

SEQ ID NO: 83133 - protein, 10 aa, Artificial Sequence
  Description of Artificial Sequence: Synthetic peptide
  Seed: FFSYTLASLL (MAGC1_HUMAN)
FLSYTLASLN

SEQ ID NO: 83134 - protein, 9 aa, Artificial Sequence
  Description of Artificial Sequence: Synthetic peptide
  Seed: LQIPMTSSF (MAGC1_HUMAN)
LLIPMTSSV

SEQ ID NO: 83135 - protein, 9 aa, Artificial Sequence
  Description of Artificial Sequence: Synthetic peptide
  Seed: SPESTQSPF (MAGC1_HUMAN)
SMESTQSPY

SEQ ID NO: 83136 - protein, 10 aa, Artificial Sequence
  Description of Artificial Sequence: Synthetic peptide
  Seed: HSPQSPPEGM (MAGC1_HUMAN)
HYPQSPPEGF

SEQ ID NO: 83137 - protein, 9 aa, Artificial Sequence
  Description of Artificial Sequence: Synthetic peptide
  Seed: IPVSAASSS (MAGC1_HUMAN)
IPVSAASSF

SEQ ID NO: 83138 - protein, 10 aa, Artificial Sequence
  Description of Artificial Sequence: Synthetic peptide
  Seed: YTLASLLQSS (MAGC1_HUMAN)
YSLASLLQST

SEQ ID NO: 83139 - protein, 9 aa, Artificial Sequence
  Description of Artificial Sequence: Synthetic peptide
  Seed: KVVEFLAML (MAGC1_HUMAN)
KLVEFLAMR

SEQ ID NO: 83140 - protein, 11 aa, Artificial Sequence
  Description of Artificial Sequence: Synthetic peptide
  Seed: IPVSAASSSTL (MAGC1_HUMAN)
IHVSAASSSTW

SEQ ID NO: 83141 - protein, 9 aa, Artificial Sequence
  Description of Artificial Sequence: Synthetic peptide
  Seed: SPQSPPEGP (MAGC1_HUMAN)
SPQSPPEGW

SEQ ID NO: 83142 - protein, 9 aa, Artificial Sequence
  Description of Artificial Sequence: Synthetic peptide
  Seed: SSSSTLLSL (MAGC1_HUMAN)
STSSTLLSF

SEQ ID NO: 83143 - protein, 9 aa, Artificial Sequence
  Description of Artificial Sequence: Synthetic peptide
  Seed: SLFQSFSER (MAGC1_HUMAN)
SGFQSFSER

SEQ ID NO: 83144 - protein, 9 aa, Artificial Sequence
  Description of Artificial Sequence: Synthetic peptide
  Seed: RAGREHFAF (MAGC1_HUMAN)
RFGREHFAY

SEQ ID NO: 83145 - protein, 9 aa, Artificial Sequence
  Description of Artificial Sequence: Synthetic peptide
  Seed: AQSPLQRPV (MAGC1_HUMAN)
AESPLQRPP

SEQ ID NO: 83146 - protein, 10 aa, Artificial Sequence
  Description of Artificial Sequence: Synthetic peptide
  Seed: ARFLLLKYQV (MAGC1_HUMAN)
ARFLLLKYQF

SEQ ID NO: 83147 - protein, 9 aa, Artificial Sequence
  Description of Artificial Sequence: Synthetic peptide
  Seed: KVWVQEHYL (MAGC1_HUMAN)
KQWVQEHYV

SEQ ID NO: 83148 - protein, 9 aa, Artificial Sequence
  Description of Artificial Sequence: Synthetic peptide
  Seed: SSSVMSPSF (MAGC1_HUMAN)
SRSVMSPSF

SEQ ID NO: 83149 - protein, 9 aa, Artificial Sequence
  Description of Artificial Sequence: Synthetic peptide
  Seed: RLLILILSI (MAGC1_HUMAN)
RQLILILSL

SEQ ID NO: 83150 - protein, 9 aa, Artificial Sequence
  Description of Artificial Sequence: Synthetic peptide
  Seed: MPTAGMPSL (MAGC1_HUMAN)
MRTAGMPSL

SEQ ID NO: 83151 - protein, 9 aa, Artificial Sequence
  Description of Artificial Sequence: Synthetic peptide
  Seed: LQIPGSPSF (MAGC1_HUMAN)
LMIPGSPSF

SEQ ID NO: 83152 - protein, 10 aa, Artificial Sequence
  Description of Artificial Sequence: Synthetic peptide
  Seed: ELARFLLLKY (MAGC1_HUMAN)
ELARFLLLKK

SEQ ID NO: 83153 - protein, 11 aa, Artificial Sequence
  Description of Artificial Sequence: Synthetic peptide
  Seed: IPVSRSFSSTL (MAGC1_HUMAN)
IPVSRSFSSTW

SEQ ID NO: 83154 - protein, 9 aa, Artificial Sequence
  Description of Artificial Sequence: Synthetic peptide
  Seed: SSPEGKDSL (MAGC1_HUMAN)
SIPEGKDSF

SEQ ID NO: 83155 - protein, 9 aa, Artificial Sequence
  Description of Artificial Sequence: Synthetic peptide
  Seed: RTQSTFEGF (MAGC1_HUMAN)
RVQSTFEGW

SEQ ID NO: 83156 - protein, 9 aa, Artificial Sequence
  Description of Artificial Sequence: Synthetic peptide
  Seed: SSSVMSPSF (MAGC1_HUMAN)
STSVMSPSM

SEQ ID NO: 83157 - protein, 10 aa, Artificial Sequence
  Description of Artificial Sequence: Synthetic peptide
  Seed: RTHSTFEGFP (MAGC1_HUMAN)
RVHSTFEGFV

SEQ ID NO: 83158 - protein, 9 aa, Artificial Sequence
  Description of Artificial Sequence: Synthetic peptide
  Seed: AMLKNTVPI (MAGC1_HUMAN)
AKLKNTVPM

SEQ ID NO: 83159 - protein, 9 aa, Artificial Sequence
  Description of Artificial Sequence: Synthetic peptide
  Seed: LQIPVSSSS (MAGC1_HUMAN)
LWIPVSSSL

SEQ ID NO: 83160 - protein, 11 aa, Artificial Sequence
  Description of Artificial Sequence: Synthetic peptide
  Seed: RYTGYFPVIFR (MAGC1_HUMAN)
RWTGYFPVIFR

SEQ ID NO: 83161 - protein, 10 aa, Artificial Sequence
  Description of Artificial Sequence: Synthetic peptide
  Seed: RKVVEFLAML (MAGC1_HUMAN)
RQVVEFLAMH

SEQ ID NO: 83162 - protein, 10 aa, Artificial Sequence
  Description of Artificial Sequence: Synthetic peptide
  Seed: SSSSSSSTLL (MAGC1_HUMAN)
SGSSSSSTLF

SEQ ID NO: 83163 - protein, 9 aa, Artificial Sequence
  Description of Artificial Sequence: Synthetic peptide
  Seed: SFSSTLVSL (MAGC1_HUMAN)
SYSSTLVSW

SEQ ID NO: 83164 - protein, 9 aa, Artificial Sequence
  Description of Artificial Sequence: Synthetic peptide
  Seed: VSPSFSSTL (MAGC1_HUMAN)
VTPSFSSTM

SEQ ID NO: 83165 - protein, 9 aa, Artificial Sequence
  Description of Artificial Sequence: Synthetic peptide
  Seed: SFPSSTSSS (MAGC1_HUMAN)
SYPSSTSSV

SEQ ID NO: 83166 - protein, 9 aa, Artificial Sequence
  Description of Artificial Sequence: Synthetic peptide
  Seed: VPITFPSSY (MAGC1_HUMAN)
VQITFPSSV

SEQ ID NO: 83167 - protein, 11 aa, Artificial Sequence
  Description of Artificial Sequence: Synthetic peptide
  Seed: SFFSYTLASLL (MAGC1_HUMAN)
SEFSYTLASLF

SEQ ID NO: 83168 - protein, 9 aa, Artificial Sequence
  Description of Artificial Sequence: Synthetic peptide
  Seed: SSSTSLSPF (MAGC1_HUMAN)
SWSTSLSPF

SEQ ID NO: 83169 - protein, 10 aa, Artificial Sequence
  Description of Artificial Sequence: Synthetic peptide
  Seed: QIPVSSSFSY (MAGC1_HUMAN)
QGPVSSSFSY

SEQ ID NO: 83170 - protein, 9 aa, Artificial Sequence
  Description of Artificial Sequence: Synthetic peptide
  Seed: SAQSAFEGF (MAGC1_HUMAN)
SKQSAFEGY

SEQ ID NO: 83171 - protein, 9 aa, Artificial Sequence
  Description of Artificial Sequence: Synthetic peptide
  Seed: MTSSFSSTL (MAGC1_HUMAN)
MISSFSSTA

SEQ ID NO: 83172 - protein, 9 aa, Artificial Sequence
  Description of Artificial Sequence: Synthetic peptide
  Seed: SLPQSFPES (MAGC1_HUMAN)
SSPQSFPEV

SEQ ID NO: 83173 - protein, 10 aa, Artificial Sequence
  Description of Artificial Sequence: Synthetic peptide
  Seed: RPVSSFFSYT (MAGC1_HUMAN)
RIVSSFFSYK

SEQ ID NO: 83174 - protein, 10 aa, Artificial Sequence
  Description of Artificial Sequence: Synthetic peptide
  Seed: FPQSLLQIPM (MAGC1_HUMAN)
FAQSLLQIPV

SEQ ID NO: 83175 - protein, 9 aa, Artificial Sequence
  Description of Artificial Sequence: Synthetic peptide
  Seed: SSSTLVSIF (MAGC1_HUMAN)
SLSTLVSIF

SEQ ID NO: 83176 - protein, 10 aa, Artificial Sequence
  Description of Artificial Sequence: Synthetic peptide
  Seed: ILILSIIFIK (MAGC1_HUMAN)
ITILSIIFIR

SEQ ID NO: 83177 - protein, 10 aa, Artificial Sequence
  Description of Artificial Sequence: Synthetic peptide
  Seed: SFFSYTLASL (MAGC1_HUMAN)
SMFSYTLASM

SEQ ID NO: 83178 - protein, 9 aa, Artificial Sequence
  Description of Artificial Sequence: Synthetic peptide
  Seed: VSRSFSSTL (MAGC1_HUMAN)
VERSFSSTF

SEQ ID NO: 83179 - protein, 9 aa, Artificial Sequence
  Description of Artificial Sequence: Synthetic peptide
  Seed: FSSALLSIF (MAGC1_HUMAN)
FHSALLSIF

SEQ ID NO: 83180 - protein, 11 aa, Artificial Sequence
  Description of Artificial Sequence: Synthetic peptide
  Seed: IPVSSSFSYTL (MAGC1_HUMAN)
IMVSSSFSYTF

SEQ ID NO: 83181 - protein, 9 aa, Artificial Sequence
  Description of Artificial Sequence: Synthetic peptide
  Seed: FSEESSSPV (MAGC1_HUMAN)
FMEESSSPF

SEQ ID NO: 83182 - protein, 10 aa, Artificial Sequence
  Description of Artificial Sequence: Synthetic peptide
  Seed: LIESEPLFTY (MAGC1_HUMAN)
LQESEPLFTF

SEQ ID NO: 83183 - protein, 10 aa, Artificial Sequence
  Description of Artificial Sequence: Synthetic peptide
  Seed: VSSSSSSTLL (MAGC1_HUMAN)
VISSSSSTLF

SEQ ID NO: 83184 - protein, 9 aa, Artificial Sequence
  Description of Artificial Sequence: Synthetic peptide
  Seed: FSYTLLSLF (MAGC1_HUMAN)
FPYTLLSLF

SEQ ID NO: 83185 - protein, 9 aa, Artificial Sequence
  Description of Artificial Sequence: Synthetic peptide
  Seed: MSQNRLLIL (MAGC1_HUMAN)
MIQNRLLIM

SEQ ID NO: 83186 - protein, 9 aa, Artificial Sequence
  Description of Artificial Sequence: Synthetic peptide
  Seed: SLPEWEDSL (MAGC1_HUMAN)
SLPEWEDSI

SEQ ID NO: 83187 - protein, 10 aa, Artificial Sequence
  Description of Artificial Sequence: Synthetic peptide
  Seed: EVIKRKVVEF (MAGC1_HUMAN)
EVIKRKVVEW

SEQ ID NO: 83188 - protein, 9 aa, Artificial Sequence
  Description of Artificial Sequence: Synthetic peptide
  Seed: DPDDSYVFV (MAGC1_HUMAN)
DFDDSYVFL

SEQ ID NO: 83189 - protein, 9 aa, Artificial Sequence
  Description of Artificial Sequence: Synthetic peptide
  Seed: AFGEPRELL (MAGC1_HUMAN)
AYGEPRELM

SEQ ID NO: 83190 - protein, 9 aa, Artificial Sequence
  Description of Artificial Sequence: Synthetic peptide
  Seed: FFSSALLSI (MAGC1_HUMAN)
FGSSALLSY

SEQ ID NO: 83191 - protein, 10 aa, Artificial Sequence
  Description of Artificial Sequence: Synthetic peptide
  Seed: STLLSLFQSF (MAGC1_HUMAN)
SFLLSLFQSW

SEQ ID NO: 83192 - protein, 11 aa, Artificial Sequence
  Description of Artificial Sequence: Synthetic peptide
  Seed: EILFGISLREV (MAGC1_HUMAN)
EYLFGISLREI

SEQ ID NO: 83193 - protein, 10 aa, Artificial Sequence
  Description of Artificial Sequence: Synthetic peptide
  Seed: RKAREFIEIL (MAGC1_HUMAN)
RRAREFIEIM

SEQ ID NO: 83194 - protein, 10 aa, Artificial Sequence
  Description of Artificial Sequence: Synthetic peptide
  Seed: SSFSSTLLSI (MAGC1_HUMAN)
SMFSSTLLSW

SEQ ID NO: 83195 - protein, 10 aa, Artificial Sequence
  Description of Artificial Sequence: Synthetic peptide
  Seed: EVIWDVLSGI (MAGC1_HUMAN)
EIIWDVLSGW

SEQ ID NO: 83196 - protein, 11 aa, Artificial Sequence
  Description of Artificial Sequence: Synthetic peptide
  Seed: RSFSSTLLSIF (MAGC1_HUMAN)
RQFSSTLLSIF

SEQ ID NO: 83197 - protein, 11 aa, Artificial Sequence
  Description of Artificial Sequence: Synthetic peptide
  Seed: MSPLYFPQSPL (MAGC1_HUMAN)
MTPLYFPQSPM

SEQ ID NO: 83198 - protein, 10 aa, Artificial Sequence
  Description of Artificial Sequence: Synthetic peptide
  Seed: YTLDEKVDEL (MAGC1_HUMAN)
YGLDEKVDEL

SEQ ID NO: 83199 - protein, 10 aa, Artificial Sequence
  Description of Artificial Sequence: Synthetic peptide
  Seed: FPSSYKDALK (MAGC1_HUMAN)
FQSSYKDALR

SEQ ID NO: 83200 - protein, 9 aa, Artificial Sequence
  Description of Artificial Sequence: Synthetic peptide
  Seed: VSSSFSYTL (MAGC1_HUMAN)
VSSSFSYTF

SEQ ID NO: 83201 - protein, 9 aa, Artificial Sequence
  Description of Artificial Sequence: Synthetic peptide
  Seed: MTSSFSSTL (MAGC1_HUMAN)
MISSFSSTL

SEQ ID NO: 83202 - protein, 10 aa, Artificial Sequence
  Description of Artificial Sequence: Synthetic peptide
  Seed: YLEYREVPNS (MAGC1_HUMAN)
YVEYREVPNV

SEQ ID NO: 83203 - protein, 10 aa, Artificial Sequence
  Description of Artificial Sequence: Synthetic peptide
  Seed: YTLDEKVDEL (MAGC1_HUMAN)
YKLDEKVDEI

SEQ ID NO: 83204 - protein, 9 aa, Artificial Sequence
  Description of Artificial Sequence: Synthetic peptide
  Seed: FFSSALLSI (MAGC1_HUMAN)
FISSALLST

SEQ ID NO: 83205 - protein, 9 aa, Artificial Sequence
  Description of Artificial Sequence: Synthetic peptide
  Seed: SSTSSSLSK (MAGC1_HUMAN)
SITSSSLSK

SEQ ID NO: 83206 - protein, 10 aa, Artificial Sequence
  Description of Artificial Sequence: Synthetic peptide
  Seed: IPVSPSFSST (MAGC1_HUMAN)
IPVSPSFSSM

SEQ ID NO: 83207 - protein, 10 aa, Artificial Sequence
  Description of Artificial Sequence: Synthetic peptide
  Seed: STFEGFPQSL (MAGC1_HUMAN)
SHFEGFPQSV

SEQ ID NO: 83208 - protein, 9 aa, Artificial Sequence
  Description of Artificial Sequence: Synthetic peptide
  Seed: MSQNRLLIL (MAGC1_HUMAN)
MYQNRLLIM

SEQ ID NO: 83209 - protein, 9 aa, Artificial Sequence
  Description of Artificial Sequence: Synthetic peptide
  Seed: VPITFPSSY (MAGC1_HUMAN)
VQITFPSSF

SEQ ID NO: 83210 - protein, 9 aa, Artificial Sequence
  Description of Artificial Sequence: Synthetic peptide
  Seed: TLLSLFQSF (MAGC1_HUMAN)
TSLSLFQSF

SEQ ID NO: 83211 - protein, 10 aa, Artificial Sequence
  Description of Artificial Sequence: Synthetic peptide
  Seed: QGEDSMSPLY (MAGC1_HUMAN)
QMEDSMSPLW

SEQ ID NO: 83212 - protein, 9 aa, Artificial Sequence
  Description of Artificial Sequence: Synthetic peptide
  Seed: AASSSTLVS (MAGC1_HUMAN)
AVSSSTLVF

SEQ ID NO: 83213 - protein, 10 aa, Artificial Sequence
  Description of Artificial Sequence: Synthetic peptide
  Seed: VSSSFSYTLL (MAGC1_HUMAN)
VFSSFSYTLF

SEQ ID NO: 83214 - protein, 10 aa, Artificial Sequence
  Description of Artificial Sequence: Synthetic peptide
  Seed: LQIVPSLPEW (MAGC1_HUMAN)
LRIVPSLPEY

SEQ ID NO: 83215 - protein, 9 aa, Artificial Sequence
  Description of Artificial Sequence: Synthetic peptide
  Seed: GEDSMSPLY (MAGC1_HUMAN)
GLDSMSPLY

SEQ ID NO: 83216 - protein, 9 aa, Artificial Sequence
  Description of Artificial Sequence: Synthetic peptide
  Seed: SFSSTLVSL (MAGC1_HUMAN)
SFSSTLVSI

SEQ ID NO: 83217 - protein, 9 aa, Artificial Sequence
  Description of Artificial Sequence: Synthetic peptide
  Seed: MLTNVISRY (MAGC1_HUMAN)
MPTNVISRF

SEQ ID NO: 83218 - protein, 11 aa, Artificial Sequence
  Description of Artificial Sequence: Synthetic peptide
  Seed: SFFSSALLSIF (MAGC1_HUMAN)
SQFSSALLSIF

SEQ ID NO: 83219 - protein, 9 aa, Artificial Sequence
  Description of Artificial Sequence: Synthetic peptide
  Seed: TLLSLFQSF (MAGC1_HUMAN)
TRLSLFQSF

SEQ ID NO: 83220 - protein, 10 aa, Artificial Sequence
  Description of Artificial Sequence: Synthetic peptide
  Seed: TGYFPVIFRK (MAGC1_HUMAN)
TPYFPVIFRR

SEQ ID NO: 83221 - protein, 10 aa, Artificial Sequence
  Description of Artificial Sequence: Synthetic peptide
  Seed: VSSSSSSTLL (MAGC1_HUMAN)
VASSSSSTLY

SEQ ID NO: 83222 - protein, 11 aa, Artificial Sequence
  Description of Artificial Sequence: Synthetic peptide
  Seed: STFEGFPQSLL (MAGC1_HUMAN)
SMFEGFPQSLC

SEQ ID NO: 83223 - protein, 10 aa, Artificial Sequence
  Description of Artificial Sequence: Synthetic peptide
  Seed: LLQIPMTSSF (MAGC1_HUMAN)
LEQIPMTSSY

SEQ ID NO: 83224 - protein, 9 aa, Artificial Sequence
  Description of Artificial Sequence: Synthetic peptide
  Seed: GFPQSLLQI (MAGC1_HUMAN)
GYPQSLLQY

SEQ ID NO: 83225 - protein, 9 aa, Artificial Sequence
  Description of Artificial Sequence: Synthetic peptide
  Seed: RKAREFIEI (MAGC1_HUMAN)
RRAREFIEV

SEQ ID NO: 83226 - protein, 9 aa, Artificial Sequence
  Description of Artificial Sequence: Synthetic peptide
  Seed: SSPERTQST (MAGC1_HUMAN)
SQPERTQSY

SEQ ID NO: 83227 - protein, 9 aa, Artificial Sequence
  Description of Artificial Sequence: Synthetic peptide
  Seed: SICSSSTSL (MAGC1_HUMAN)
STCSSSTSL

SEQ ID NO: 83228 - protein, 9 aa, Artificial Sequence
  Description of Artificial Sequence: Synthetic peptide
  Seed: AQSPLQRPV (MAGC1_HUMAN)
AESPLQRPV

SEQ ID NO: 83229 - protein, 9 aa, Artificial Sequence
  Description of Artificial Sequence: Synthetic peptide
  Seed: FSSTLLSLF (MAGC1_HUMAN)
FESTLLSLF

SEQ ID NO: 83230 - protein, 9 aa, Artificial Sequence
  Description of Artificial Sequence: Synthetic peptide
  Seed: SSPESAQSA (MAGC1_HUMAN)
SFPESAQSY

SEQ ID NO: 83231 - protein, 10 aa, Artificial Sequence
  Description of Artificial Sequence: Synthetic peptide
  Seed: LQNPASSFFS (MAGC1_HUMAN)
LMNPASSFFM

SEQ ID NO: 83232 - protein, 10 aa, Artificial Sequence
  Description of Artificial Sequence: Synthetic peptide
  Seed: LQNPASSFFS (MAGC1_HUMAN)
LQNPASSFFI

SEQ ID NO: 83233 - protein, 9 aa, Artificial Sequence
  Description of Artificial Sequence: Synthetic peptide
  Seed: KVWVQEHYL (MAGC1_HUMAN)
KMWVQEHYT

SEQ ID NO: 83234 - protein, 10 aa, Artificial Sequence
  Description of Artificial Sequence: Synthetic peptide
  Seed: SSSSSTLLSL (MAGC1_HUMAN)
SRSSSTLLSF

SEQ ID NO: 83235 - protein, 9 aa, Artificial Sequence
  Description of Artificial Sequence: Synthetic peptide
  Seed: KAREFIEIL (MAGC1_HUMAN)
KRREFIEIY

SEQ ID NO: 83236 - protein, 9 aa, Artificial Sequence
  Description of Artificial Sequence: Synthetic peptide
  Seed: SICSSSTSL (MAGC1_HUMAN)
SICSSSTSM

SEQ ID NO: 83237 - protein, 9 aa, Artificial Sequence
  Description of Artificial Sequence: Synthetic peptide
  Seed: STQSPFEGF (MAGC1_HUMAN)
SVQSPFEGR

SEQ ID NO: 83238 - protein, 9 aa, Artificial Sequence
  Description of Artificial Sequence: Synthetic peptide
  Seed: KDVEERAQA (MAGC1_HUMAN)
KDVEERAQF

SEQ ID NO: 83239 - protein, 10 aa, Artificial Sequence
  Description of Artificial Sequence: Synthetic peptide
  Seed: KVVEFLAMLK (MAGC1_HUMAN)
KGVEFLAMLK

SEQ ID NO: 83240 - protein, 11 aa, Artificial Sequence
  Description of Artificial Sequence: Synthetic peptide
  Seed: SPLQNPASSFF (MAGC1_HUMAN)
SSLQNPASSFF

SEQ ID NO: 83241 - protein, 9 aa, Artificial Sequence
  Description of Artificial Sequence: Synthetic peptide
  Seed: ISFSSSTSL (MAGC1_HUMAN)
IIFSSSTSA

SEQ ID NO: 83242 - protein, 9 aa, Artificial Sequence
  Description of Artificial Sequence: Synthetic peptide
  Seed: QIVPSLPEW (MAGC1_HUMAN)
QQVPSLPEY

SEQ ID NO: 83243 - protein, 9 aa, Artificial Sequence
  Description of Artificial Sequence: Synthetic peptide
  Seed: MSQNRLLIL (MAGC1_HUMAN)
MTQNRLLIM

SEQ ID NO: 83244 - protein, 11 aa, Artificial Sequence
  Description of Artificial Sequence: Synthetic peptide
  Seed: SSFPSSTSSSL (MAGC1_HUMAN)
SFFPSSTSSSY

SEQ ID NO: 83245 - protein, 10 aa, Artificial Sequence
  Description of Artificial Sequence: Synthetic peptide
  Seed: ASSSVMSPSF (MAGC1_HUMAN)
AMSSVMSPSY

SEQ ID NO: 83246 - protein, 9 aa, Artificial Sequence
  Description of Artificial Sequence: Synthetic peptide
  Seed: SSSSSSTLL (MAGC1_HUMAN)
SPSSSSTLI

SEQ ID NO: 83247 - protein, 9 aa, Artificial Sequence
  Description of Artificial Sequence: Synthetic peptide
  Seed: REVDPDDSY (MAGC1_HUMAN)
RAVDPDDSY

SEQ ID NO: 83248 - protein, 10 aa, Artificial Sequence
  Description of Artificial Sequence: Synthetic peptide
  Seed: RFLLLKYQVK (MAGC1_HUMAN)
RYLLLKYQVR

SEQ ID NO: 83249 - protein, 9 aa, Artificial Sequence
  Description of Artificial Sequence: Synthetic peptide
  Seed: RTHSTFEGF (MAGC1_HUMAN)
RGHSTFEGK

SEQ ID NO: 83250 - protein, 9 aa, Artificial Sequence
  Description of Artificial Sequence: Synthetic peptide
  Seed: IFQSSPESA (MAGC1_HUMAN)
IMQSSPESL

SEQ ID NO: 83251 - protein, 9 aa, Artificial Sequence
  Description of Artificial Sequence: Synthetic peptide
  Seed: FPSSYKDAL (MAGC1_HUMAN)
FPSSYKDAV

SEQ ID NO: 83252 - protein, 9 aa, Artificial Sequence
  Description of Artificial Sequence: Synthetic peptide
  Seed: SSSTSLSPF (MAGC1_HUMAN)
SMSTSLSPY

SEQ ID NO: 83253 - protein, 10 aa, Artificial Sequence
  Description of Artificial Sequence: Synthetic peptide
  Seed: YASEEVIWDV (MAGC1_HUMAN)
YQSEEVIWDV

SEQ ID NO: 83254 - protein, 10 aa, Artificial Sequence
  Description of Artificial Sequence: Synthetic peptide
  Seed: YTLASLLQSS (MAGC1_HUMAN)
YMLASLLQSV

SEQ ID NO: 83255 - protein, 9 aa, Artificial Sequence
  Description of Artificial Sequence: Synthetic peptide
  Seed: ASSSTLVSI (MAGC1_HUMAN)
AISSTLVSW

SEQ ID NO: 83256 - protein, 10 aa, Artificial Sequence
  Description of Artificial Sequence: Synthetic peptide
  Seed: RKVVEFLAML (MAGC1_HUMAN)
RCVVEFLAMA

SEQ ID NO: 83257 - protein, 10 aa, Artificial Sequence
  Description of Artificial Sequence: Synthetic peptide
  Seed: SFPSSTSSSL (MAGC1_HUMAN)
SPPSSTSSSF

SEQ ID NO: 83258 - protein, 10 aa, Artificial Sequence
  Description of Artificial Sequence: Synthetic peptide
  Seed: YTLLSLFQSS (MAGC1_HUMAN)
YVLLSLFQSV

SEQ ID NO: 83259 - protein, 9 aa, Artificial Sequence
  Description of Artificial Sequence: Synthetic peptide
  Seed: SSSTSLSPF (MAGC1_HUMAN)
SPSTSLSPF

SEQ ID NO: 83260 - protein, 10 aa, Artificial Sequence
  Description of Artificial Sequence: Synthetic peptide
  Seed: REFIEILFGI (MAGC1_HUMAN)
RWFIEILFGL

SEQ ID NO: 83261 - protein, 9 aa, Artificial Sequence
  Description of Artificial Sequence: Synthetic peptide
  Seed: RAGREHFAF (MAGC1_HUMAN)
RVGREHFAY

SEQ ID NO: 83262 - protein, 11 aa, Artificial Sequence
  Description of Artificial Sequence: Synthetic peptide
  Seed: FPQSVLQIPVS (MAGC1_HUMAN)
FPQSVLQIPVA

SEQ ID NO: 83263 - protein, 9 aa, Artificial Sequence
  Description of Artificial Sequence: Synthetic peptide
  Seed: SSSSTLLSL (MAGC1_HUMAN)
SRSSTLLSY

SEQ ID NO: 83264 - protein, 9 aa, Artificial Sequence
  Description of Artificial Sequence: Synthetic peptide
  Seed: SSFPSSTSS (MAGC1_HUMAN)
SVFPSSTSL

SEQ ID NO: 83265 - protein, 10 aa, Artificial Sequence
  Description of Artificial Sequence: Synthetic peptide
  Seed: PLQIPVSSSF (MAGC1_HUMAN)
PFQIPVSSSM

SEQ ID NO: 83266 - protein, 9 aa, Artificial Sequence
  Description of Artificial Sequence: Synthetic peptide
  Seed: MGDKDMPTA (MAGC1_HUMAN)
MQDKDMPTM

SEQ ID NO: 83267 - protein, 9 aa, Artificial Sequence
  Description of Artificial Sequence: Synthetic peptide
  Seed: SVLQIPVSA (MAGC1_HUMAN)
SILQIPVSM

SEQ ID NO: 83268 - protein, 10 aa, Artificial Sequence
  Description of Artificial Sequence: Synthetic peptide
  Seed: SFSSTLLSIF (MAGC1_HUMAN)
SMSSTLLSIM

SEQ ID NO: 83269 - protein, 9 aa, Artificial Sequence
  Description of Artificial Sequence: Synthetic peptide
  Seed: SEPLFTYTL (MAGC1_HUMAN)
SHPLFTYTA

SEQ ID NO: 83270 - protein, 10 aa, Artificial Sequence
  Description of Artificial Sequence: Synthetic peptide
  Seed: LHFPQSPPEW (MAGC1_HUMAN)
LSFPQSPPEW

SEQ ID NO: 83271 - protein, 9 aa, Artificial Sequence
  Description of Artificial Sequence: Synthetic peptide
  Seed: YTGYFPVIF (MAGC1_HUMAN)
YLGYFPVIF

SEQ ID NO: 83272 - protein, 9 aa, Artificial Sequence
  Description of Artificial Sequence: Synthetic peptide
  Seed: QVKQPITKA (MAGC1_HUMAN)
QTKQPITKY

SEQ ID NO: 83273 - protein, 10 aa, Artificial Sequence
  Description of Artificial Sequence: Synthetic peptide
  Seed: YTLASLLQSS (MAGC1_HUMAN)
YMLASLLQSM

SEQ ID NO: 83274 - protein, 10 aa, Artificial Sequence
  Description of Artificial Sequence: Synthetic peptide
  Seed: FLAMLKNTVP (MAGC1_HUMAN)
FLAMLKNTVR

SEQ ID NO: 83275 - protein, 9 aa, Artificial Sequence
  Description of Artificial Sequence: Synthetic peptide
  Seed: FPSSYKDAL (MAGC1_HUMAN)
FTSSYKDAY

SEQ ID NO: 83276 - protein, 10 aa, Artificial Sequence
  Description of Artificial Sequence: Synthetic peptide
  Seed: ILILSIIFIK (MAGC1_HUMAN)
IYILSIIFIR

SEQ ID NO: 83277 - protein, 9 aa, Artificial Sequence
  Description of Artificial Sequence: Synthetic peptide
  Seed: ASSFFSSAL (MAGC1_HUMAN)
AFSFFSSAI

SEQ ID NO: 83278 - protein, 10 aa, Artificial Sequence
  Description of Artificial Sequence: Synthetic peptide
  Seed: LLQIPMTSSF (MAGC1_HUMAN)
LMQIPMTSSW

SEQ ID NO: 83279 - protein, 9 aa, Artificial Sequence
  Description of Artificial Sequence: Synthetic peptide
  Seed: SLIESEPLF (MAGC1_HUMAN)
SYIESEPLF

SEQ ID NO: 83280 - protein, 9 aa, Artificial Sequence
  Description of Artificial Sequence: Synthetic peptide
  Seed: SAASSSTLV (MAGC1_HUMAN)
SSASSSTLY

SEQ ID NO: 83281 - protein, 9 aa, Artificial Sequence
  Description of Artificial Sequence: Synthetic peptide
  Seed: TTDDSTATE (MAGC1_HUMAN)
TTDDSTATV

SEQ ID NO: 83282 - protein, 9 aa, Artificial Sequence
  Description of Artificial Sequence: Synthetic peptide
  Seed: AGREHFAFG (MAGC1_HUMAN)
ASREHFAFF

SEQ ID NO: 83283 - protein, 9 aa, Artificial Sequence
  Description of Artificial Sequence: Synthetic peptide
  Seed: AQSPLQSPV (MAGC1_HUMAN)
AGSPLQSPY

SEQ ID NO: 83284 - protein, 10 aa, Artificial Sequence
  Description of Artificial Sequence: Synthetic peptide
  Seed: VPITFPSSYK (MAGC1_HUMAN)
VKITFPSSYR

SEQ ID NO: 83285 - protein, 9 aa, Artificial Sequence
  Description of Artificial Sequence: Synthetic peptide
  Seed: KVVEFLAML (MAGC1_HUMAN)
KQVEFLAMW

SEQ ID NO: 83286 - protein, 9 aa, Artificial Sequence
  Description of Artificial Sequence: Synthetic peptide
  Seed: RLLILILSI (MAGC1_HUMAN)
RSLILILSW

SEQ ID NO: 83287 - protein, 10 aa, Artificial Sequence
  Description of Artificial Sequence: Synthetic peptide
  Seed: MTSSFSSTLL (MAGC1_HUMAN)
MTSSFSSTLI

SEQ ID NO: 83288 - protein, 11 aa, Artificial Sequence
  Description of Artificial Sequence: Synthetic peptide
  Seed: SPLQRPVSSFF (MAGC1_HUMAN)
SILQRPVSSFF

SEQ ID NO: 83289 - protein, 10 aa, Artificial Sequence
  Description of Artificial Sequence: Synthetic peptide
  Seed: ARFLLLKYQV (MAGC1_HUMAN)
ARFLLLKYQK

SEQ ID NO: 83290 - protein, 9 aa, Artificial Sequence
  Description of Artificial Sequence: Synthetic peptide
  Seed: EDSLSPLQI (MAGC1_HUMAN)
EESLSPLQA

SEQ ID NO: 83291 - protein, 9 aa, Artificial Sequence
  Description of Artificial Sequence: Synthetic peptide
  Seed: LQIPVSRSF (MAGC1_HUMAN)
LRIPVSRSM

SEQ ID NO: 83292 - protein, 11 aa, Artificial Sequence
  Description of Artificial Sequence: Synthetic peptide
  Seed: SSFSYTLLSLF (MAGC1_HUMAN)
SYFSYTLLSLY

SEQ ID NO: 83293 - protein, 9 aa, Artificial Sequence
  Description of Artificial Sequence: Synthetic peptide
  Seed: RLLILILSI (MAGC1_HUMAN)
RMLILILSI

SEQ ID NO: 83294 - protein, 8 aa, Artificial Sequence
  Description of Artificial Sequence: Synthetic peptide
  Seed: SSFFSSAL (MAGC1_HUMAN)
SHFFSSAF

SEQ ID NO: 83295 - protein, 9 aa, Artificial Sequence
  Description of Artificial Sequence: Synthetic peptide
  Seed: TSSFSSTLL (MAGC1_HUMAN)
TASFSSTLY

SEQ ID NO: 83296 - protein, 9 aa, Artificial Sequence
  Description of Artificial Sequence: Synthetic peptide
  Seed: KDSQSPLQI (MAGC1_HUMAN)
KESQSPLQV

SEQ ID NO: 83297 - protein, 9 aa, Artificial Sequence
  Description of Artificial Sequence: Synthetic peptide
  Seed: SSSTLLSLF (MAGC1_HUMAN)
SASTLLSLI

SEQ ID NO: 83298 - protein, 10 aa, Artificial Sequence
  Description of Artificial Sequence: Synthetic peptide
  Seed: SSSSSTLLSL (MAGC1_HUMAN)
SSSSSTLLSM

SEQ ID NO: 83299 - protein, 10 aa, Artificial Sequence
  Description of Artificial Sequence: Synthetic peptide
  Seed: SLQIPVSPSF (MAGC1_HUMAN)
SCQIPVSPSF

SEQ ID NO: 83300 - protein, 9 aa, Artificial Sequence
  Description of Artificial Sequence: Synthetic peptide
  Seed: WVQEHYLEY (MAGC1_HUMAN)
WQQEHYLEM

SEQ ID NO: 83301 - protein, 10 aa, Artificial Sequence
  Description of Artificial Sequence: Synthetic peptide
  Seed: SSFSYTLLSL (MAGC1_HUMAN)
SKFSYTLLSF

SEQ ID NO: 83302 - protein, 10 aa, Artificial Sequence
  Description of Artificial Sequence: Synthetic peptide
  Seed: RAHSEVIKRK (MAGC1_HUMAN)
RVHSEVIKRR

SEQ ID NO: 83303 - protein, 9 aa, Artificial Sequence
  Description of Artificial Sequence: Synthetic peptide
  Seed: SSSTLLSLF (MAGC1_HUMAN)
SYSTLLSLL

SEQ ID NO: 83304 - protein, 10 aa, Artificial Sequence
  Description of Artificial Sequence: Synthetic peptide
  Seed: GEDSLSPLQI (MAGC1_HUMAN)
GEDSLSPLQY

SEQ ID NO: 83305 - protein, 9 aa, Artificial Sequence
  Description of Artificial Sequence: Synthetic peptide
  Seed: SSFPSSTSS (MAGC1_HUMAN)
SSFPSSTSV

SEQ ID NO: 83306 - protein, 9 aa, Artificial Sequence
  Description of Artificial Sequence: Synthetic peptide
  Seed: VPNSSPPRY (MAGC1_HUMAN)
VANSSPPRY

SEQ ID NO: 83307 - protein, 9 aa, Artificial Sequence
  Description of Artificial Sequence: Synthetic peptide
  Seed: LQIPVSAAS (MAGC1_HUMAN)
LRIPVSAAM

SEQ ID NO: 83308 - protein, 11 aa, Artificial Sequence
  Description of Artificial Sequence: Synthetic peptide
  Seed: SSFPSSTSSSL (MAGC1_HUMAN)
SDFPSSTSSSM

SEQ ID NO: 83309 - protein, 10 aa, Artificial Sequence
  Description of Artificial Sequence: Synthetic peptide
  Seed: SFPSSTSSSL (MAGC1_HUMAN)
SNPSSTSSSI

SEQ ID NO: 83310 - protein, 10 aa, Artificial Sequence
  Description of Artificial Sequence: Synthetic peptide
  Seed: IEILFGISLR (MAGC1_HUMAN)
IVILFGISLR

SEQ ID NO: 83311 - protein, 9 aa, Artificial Sequence
  Description of Artificial Sequence: Synthetic peptide
  Seed: AQSPLQSPV (MAGC1_HUMAN)
AESPLQSPA

SEQ ID NO: 83312 - protein, 9 aa, Artificial Sequence
  Description of Artificial Sequence: Synthetic peptide
  Seed: FSSTLLSLF (MAGC1_HUMAN)
FPSTLLSLW

SEQ ID NO: 83313 - protein, 9 aa, Artificial Sequence
  Description of Artificial Sequence: Synthetic peptide
  Seed: MTSSFSSTL (MAGC1_HUMAN)
MRSSFSSTL

SEQ ID NO: 83314 - protein, 10 aa, Artificial Sequence
  Description of Artificial Sequence: Synthetic peptide
  Seed: STLLSLFQSF (MAGC1_HUMAN)
SALLSLFQSW

SEQ ID NO: 83315 - protein, 10 aa, Artificial Sequence
  Description of Artificial Sequence: Synthetic peptide
  Seed: FPQSLLQIPM (MAGC1_HUMAN)
FNQSLLQIPY

SEQ ID NO: 83316 - protein, 9 aa, Artificial Sequence
  Description of Artificial Sequence: Synthetic peptide
  Seed: SIIFIKGTY (MAGC1_HUMAN)
SAIFIKGTW

SEQ ID NO: 83317 - protein, 9 aa, Artificial Sequence
  Description of Artificial Sequence: Synthetic peptide
  Seed: SQSSPVSSF (MAGC1_HUMAN)
SASSPVSSV

SEQ ID NO: 83318 - protein, 10 aa, Artificial Sequence
  Description of Artificial Sequence: Synthetic peptide
  Seed: YASEEVIWDV (MAGC1_HUMAN)
YQSEEVIWDI

SEQ ID NO: 83319 - protein, 9 aa, Artificial Sequence
  Description of Artificial Sequence: Synthetic peptide
  Seed: RTQSTFEGF (MAGC1_HUMAN)
RLQSTFEGL

SEQ ID NO: 83320 - protein, 10 aa, Artificial Sequence
  Description of Artificial Sequence: Synthetic peptide
  Seed: STLLSLFQSF (MAGC1_HUMAN)
SKLLSLFQSF

SEQ ID NO: 83321 - protein, 10 aa, Artificial Sequence
  Description of Artificial Sequence: Synthetic peptide
  Seed: IIDTTDDSTA (MAGC1_HUMAN)
IADTTDDSTL

SEQ ID NO: 83322 - protein, 10 aa, Artificial Sequence
  Description of Artificial Sequence: Synthetic peptide
  Seed: LQIPVSSSFS (MAGC1_HUMAN)
LMIPVSSSFR

SEQ ID NO: 83323 - protein, 9 aa, Artificial Sequence
  Description of Artificial Sequence: Synthetic peptide
  Seed: KDSLSPLEI (MAGC1_HUMAN)
KESLSPLEI

SEQ ID NO: 83324 - protein, 10 aa, Artificial Sequence
  Description of Artificial Sequence: Synthetic peptide
  Seed: TGYFPVIFRK (MAGC1_HUMAN)
TSYFPVIFRK

SEQ ID NO: 83325 - protein, 10 aa, Artificial Sequence
  Description of Artificial Sequence: Synthetic peptide
  Seed: TGYFPVIFRK (MAGC1_HUMAN)
TMYFPVIFRK

SEQ ID NO: 83326 - protein, 9 aa, Artificial Sequence
  Description of Artificial Sequence: Synthetic peptide
  Seed: SSHESPQSP (MAGC1_HUMAN)
SAHESPQSA

SEQ ID NO: 83327 - protein, 11 aa, Artificial Sequence
  Description of Artificial Sequence: Synthetic peptide
  Seed: SPLQNPASSFF (MAGC1_HUMAN)
SPLQNPASSFL

SEQ ID NO: 83328 - protein, 9 aa, Artificial Sequence
  Description of Artificial Sequence: Synthetic peptide
  Seed: ISFSSSTSL (MAGC1_HUMAN)
IQFSSSTSY

SEQ ID NO: 83329 - protein, 10 aa, Artificial Sequence
  Description of Artificial Sequence: Synthetic peptide
  Seed: LSQSSPVSSF (MAGC1_HUMAN)
LLQSSPVSSY

SEQ ID NO: 83330 - protein, 11 aa, Artificial Sequence
  Description of Artificial Sequence: Synthetic peptide
  Seed: SSFPSSTSSSL (MAGC1_HUMAN)
SAFPSSTSSSL

SEQ ID NO: 83331 - protein, 9 aa, Artificial Sequence
  Description of Artificial Sequence: Synthetic peptide
  Seed: LSDEQGMSQ (MAGC1_HUMAN)
LVDEQGMSM

SEQ ID NO: 83332 - protein, 10 aa, Artificial Sequence
  Description of Artificial Sequence: Synthetic peptide
  Seed: RAGREHFAFG (MAGC1_HUMAN)
RFGREHFAFR

SEQ ID NO: 83333 - protein, 9 aa, Artificial Sequence
  Description of Artificial Sequence: Synthetic peptide
  Seed: SICSSSTSL (MAGC1_HUMAN)
SMCSSSTSA

SEQ ID NO: 83334 - protein, 9 aa, Artificial Sequence
  Description of Artificial Sequence: Synthetic peptide
  Seed: FFSSALLSI (MAGC1_HUMAN)
FSSSALLSF

SEQ ID NO: 83335 - protein, 9 aa, Artificial Sequence
  Description of Artificial Sequence: Synthetic peptide
  Seed: SFSSTLVSL (MAGC1_HUMAN)
SASSTLVSL

SEQ ID NO: 83336 - protein, 10 aa, Artificial Sequence
  Description of Artificial Sequence: Synthetic peptide
  Seed: SIFQSSPESA (MAGC1_HUMAN)
SMFQSSPESM

SEQ ID NO: 83337 - protein, 10 aa, Artificial Sequence
  Description of Artificial Sequence: Synthetic peptide
  Seed: SSFSYTLLSL (MAGC1_HUMAN)
STFSYTLLSY

SEQ ID NO: 83338 - protein, 9 aa, Artificial Sequence
  Description of Artificial Sequence: Synthetic peptide
  Seed: RTHSTFEGF (MAGC1_HUMAN)
RSHSTFEGM

SEQ ID NO: 83339 - protein, 11 aa, Artificial Sequence
  Description of Artificial Sequence: Synthetic peptide
  Seed: SPSFSSTLVSL (MAGC1_HUMAN)
SPSFSSTLVSM

SEQ ID NO: 83340 - protein, 10 aa, Artificial Sequence
  Description of Artificial Sequence: Synthetic peptide
  Seed: FPQSPLQIPV (MAGC1_HUMAN)
FAQSPLQIPM

SEQ ID NO: 83341 - protein, 10 aa, Artificial Sequence
  Description of Artificial Sequence: Synthetic peptide
  Seed: FPQSLLQIPM (MAGC1_HUMAN)
FVQSLLQIPL

SEQ ID NO: 83342 - protein, 9 aa, Artificial Sequence
  Description of Artificial Sequence: Synthetic peptide
  Seed: FAFGEPREL (MAGC1_HUMAN)
FLFGEPRER

SEQ ID NO: 83343 - protein, 9 aa, Artificial Sequence
  Description of Artificial Sequence: Synthetic peptide
  Seed: KVVEFLAML (MAGC1_HUMAN)
KLVEFLAMC

SEQ ID NO: 83344 - protein, 9 aa, Artificial Sequence
  Description of Artificial Sequence: Synthetic peptide
  Seed: MTSSFSSTL (MAGC1_HUMAN)
MPSSFSSTN

SEQ ID NO: 83345 - protein, 10 aa, Artificial Sequence
  Description of Artificial Sequence: Synthetic peptide
  Seed: PLQIPVSRSF (MAGC1_HUMAN)
PWQIPVSRSF

SEQ ID NO: 83346 - protein, 9 aa, Artificial Sequence
  Description of Artificial Sequence: Synthetic peptide
  Seed: STFEGFAQS (MAGC1_HUMAN)
SLFEGFAQM

SEQ ID NO: 83347 - protein, 9 aa, Artificial Sequence
  Description of Artificial Sequence: Synthetic peptide
  Seed: SFFSYTLAS (MAGC1_HUMAN)
SFFSYTLAI

SEQ ID NO: 83348 - protein, 11 aa, Artificial Sequence
  Description of Artificial Sequence: Synthetic peptide
  Seed: SAASSSTLVSI (MAGC1_HUMAN)
SVASSSTLVSY

SEQ ID NO: 83349 - protein, 9 aa, Artificial Sequence
  Description of Artificial Sequence: Synthetic peptide
  Seed: KAREFIEIL (MAGC1_HUMAN)
KYREFIEIM

SEQ ID NO: 83350 - protein, 9 aa, Artificial Sequence
  Description of Artificial Sequence: Synthetic peptide
  Seed: LQIPGSPSF (MAGC1_HUMAN)
LHIPGSPSI

SEQ ID NO: 83351 - protein, 10 aa, Artificial Sequence
  Description of Artificial Sequence: Synthetic peptide
  Seed: YLEYREVPNS (MAGC1_HUMAN)
YIEYREVPNV

SEQ ID NO: 83352 - protein, 9 aa, Artificial Sequence
  Description of Artificial Sequence: Synthetic peptide
  Seed: ISFSSSTSL (MAGC1_HUMAN)
IQFSSSTSI

SEQ ID NO: 83353 - protein, 9 aa, Artificial Sequence
  Description of Artificial Sequence: Synthetic peptide
  Seed: LKNTVPITF (MAGC1_HUMAN)
LTNTVPITF

SEQ ID NO: 83354 - protein, 9 aa, Artificial Sequence
  Description of Artificial Sequence: Synthetic peptide
  Seed: FLAMLKNTV (MAGC1_HUMAN)
FVAMLKNTI

SEQ ID NO: 83355 - protein, 9 aa, Artificial Sequence
  Description of Artificial Sequence: Synthetic peptide
  Seed: SYKDALKDV (MAGC1_HUMAN)
SYKDALKDY

SEQ ID NO: 83356 - protein, 9 aa, Artificial Sequence
  Description of Artificial Sequence: Synthetic peptide
  Seed: FPSSTSSSL (MAGC1_HUMAN)
FASSTSSSF

SEQ ID NO: 83357 - protein, 9 aa, Artificial Sequence
  Description of Artificial Sequence: Synthetic peptide
  Seed: QSPLQGEEF (MAGC1_HUMAN)
QYPLQGEEM

SEQ ID NO: 83358 - protein, 9 aa, Artificial Sequence
  Description of Artificial Sequence: Synthetic peptide
  Seed: GYFPVIFRK (MAGC1_HUMAN)
GMFPVIFRR

SEQ ID NO: 83359 - protein, 10 aa, Artificial Sequence
  Description of Artificial Sequence: Synthetic peptide
  Seed: SSFSSTLLSI (MAGC1_HUMAN)
SQFSSTLLSA

SEQ ID NO: 83360 - protein, 9 aa, Artificial Sequence
  Description of Artificial Sequence: Synthetic peptide
  Seed: KVDELARFL (MAGC1_HUMAN)
KQDELARFM

SEQ ID NO: 83361 - protein, 9 aa, Artificial Sequence
  Description of Artificial Sequence: Synthetic peptide
  Seed: SSPERTQST (MAGC1_HUMAN)
SYPERTQSY

SEQ ID NO: 83362 - protein, 9 aa, Artificial Sequence
  Description of Artificial Sequence: Synthetic peptide
  Seed: VSPSSSSTL (MAGC1_HUMAN)
VQPSSSSTF

SEQ ID NO: 83363 - protein, 9 aa, Artificial Sequence
  Description of Artificial Sequence: Synthetic peptide
  Seed: FSEESSSPV (MAGC1_HUMAN)
FVEESSSPF

SEQ ID NO: 83364 - protein, 9 aa, Artificial Sequence
  Description of Artificial Sequence: Synthetic peptide
  Seed: SLFQSFSER (MAGC1_HUMAN)
SVFQSFSER

SEQ ID NO: 83365 - protein, 9 aa, Artificial Sequence
  Description of Artificial Sequence: Synthetic peptide
  Seed: RAHSEVIKR (MAGC1_HUMAN)
RYHSEVIKF

SEQ ID NO: 83366 - protein, 9 aa, Artificial Sequence
  Description of Artificial Sequence: Synthetic peptide
  Seed: VSAASSSTL (MAGC1_HUMAN)
VLAASSSTA

SEQ ID NO: 83367 - protein, 10 aa, Artificial Sequence
  Description of Artificial Sequence: Synthetic peptide
  Seed: FPQSLLQIPM (MAGC1_HUMAN)
FTQSLLQIPV

SEQ ID NO: 83368 - protein, 9 aa, Artificial Sequence
  Description of Artificial Sequence: Synthetic peptide
  Seed: TLASLLQSS (MAGC1_HUMAN)
TMASLLQSL

SEQ ID NO: 83369 - protein, 9 aa, Artificial Sequence
  Description of Artificial Sequence: Synthetic peptide
  Seed: SSFFSSALL (MAGC1_HUMAN)
STFFSSALK

SEQ ID NO: 83370 - protein, 10 aa, Artificial Sequence
  Description of Artificial Sequence: Synthetic peptide
  Seed: FLAMLKNTVP (MAGC1_HUMAN)
FMAMLKNTVI

SEQ ID NO: 83371 - protein, 10 aa, Artificial Sequence
  Description of Artificial Sequence: Synthetic peptide
  Seed: VSSSSSSTLL (MAGC1_HUMAN)
VKSSSSSTLY

SEQ ID NO: 83372 - protein, 9 aa, Artificial Sequence
  Description of Artificial Sequence: Synthetic peptide
  Seed: FLWGPRAHS (MAGC1_HUMAN)
FIWGPRAHL

SEQ ID NO: 83373 - protein, 9 aa, Artificial Sequence
  Description of Artificial Sequence: Synthetic peptide
  Seed: LQIPMTSSF (MAGC1_HUMAN)
LCIPMTSSF

SEQ ID NO: 83374 - protein, 9 aa, Artificial Sequence
  Description of Artificial Sequence: Synthetic peptide
  Seed: LQIPGSPSF (MAGC1_HUMAN)
LHIPGSPSL

SEQ ID NO: 83375 - protein, 9 aa, Artificial Sequence
  Description of Artificial Sequence: Synthetic peptide
  Seed: FPSSTSSSL (MAGC1_HUMAN)
FQSSTSSSM

SEQ ID NO: 83376 - protein, 10 aa, Artificial Sequence
  Description of Artificial Sequence: Synthetic peptide
  Seed: EVIWDVLSGI (MAGC1_HUMAN)
ENIWDVLSGV

SEQ ID NO: 83377 - protein, 9 aa, Artificial Sequence
  Description of Artificial Sequence: Synthetic peptide
  Seed: LQIPMTSSF (MAGC1_HUMAN)
LVIPMTSSV

SEQ ID NO: 83378 - protein, 10 aa, Artificial Sequence
  Description of Artificial Sequence: Synthetic peptide
  Seed: VISFSSSTSL (MAGC1_HUMAN)
VTSFSSSTSM

SEQ ID NO: 83379 - protein, 11 aa, Artificial Sequence
  Description of Artificial Sequence: Synthetic peptide
  Seed: SPPEGPAQSPL (MAGC1_HUMAN)
SAPEGPAQSPL

SEQ ID NO: 83380 - protein, 10 aa, Artificial Sequence
  Description of Artificial Sequence: Synthetic peptide
  Seed: SSFSSTLLSI (MAGC1_HUMAN)
SMFSSTLLSI

SEQ ID NO: 83381 - protein, 11 aa, Artificial Sequence
  Description of Artificial Sequence: Synthetic peptide
  Seed: SPLQIPVSPSS (MAGC1_HUMAN)
SQLQIPVSPSY

SEQ ID NO: 83382 - protein, 11 aa, Artificial Sequence
  Description of Artificial Sequence: Synthetic peptide
  Seed: SPLQIPMTSSF (MAGC1_HUMAN)
STLQIPMTSSF

SEQ ID NO: 83383 - protein, 9 aa, Artificial Sequence
  Description of Artificial Sequence: Synthetic peptide
  Seed: FTYTLDEKV (MAGC1_HUMAN)
FTYTLDEKF

SEQ ID NO: 83384 - protein, 9 aa, Artificial Sequence
  Description of Artificial Sequence: Synthetic peptide
  Seed: SSPESAQSA (MAGC1_HUMAN)
SIPESAQSF

SEQ ID NO: 83385 - protein, 9 aa, Artificial Sequence
  Description of Artificial Sequence: Synthetic peptide
  Seed: FSSTLLSIL (MAGC1_HUMAN)
FKSTLLSIF

SEQ ID NO: 83386 - protein, 9 aa, Artificial Sequence
  Description of Artificial Sequence: Synthetic peptide
  Seed: KVVEFLAML (MAGC1_HUMAN)
KQVEFLAMI

SEQ ID NO: 83387 - protein, 9 aa, Artificial Sequence
  Description of Artificial Sequence: Synthetic peptide
  Seed: SSSVMSPSF (MAGC1_HUMAN)
SKSVMSPSY

SEQ ID NO: 83388 - protein, 10 aa, Artificial Sequence
  Description of Artificial Sequence: Synthetic peptide
  Seed: FSSSTSLSPF (MAGC1_HUMAN)
FASSTSLSPW

SEQ ID NO: 83389 - protein, 10 aa, Artificial Sequence
  Description of Artificial Sequence: Synthetic peptide
  Seed: FPSSTSSSLS (MAGC1_HUMAN)
FPSSTSSSLM

SEQ ID NO: 83390 - protein, 9 aa, Artificial Sequence
  Description of Artificial Sequence: Synthetic peptide
  Seed: ESDDTLYPL (MAGC1_HUMAN)
EMDDTLYPL

SEQ ID NO: 83391 - protein, 9 aa, Artificial Sequence
  Description of Artificial Sequence: Synthetic peptide
  Seed: LQIPMTSSF (MAGC1_HUMAN)
LHIPMTSSF

SEQ ID NO: 83392 - protein, 10 aa, Artificial Sequence
  Description of Artificial Sequence: Synthetic peptide
  Seed: ILILSIIFIK (MAGC1_HUMAN)
IAILSIIFIR

SEQ ID NO: 83393 - protein, 10 aa, Artificial Sequence
  Description of Artificial Sequence: Synthetic peptide
  Seed: SFFSYTLASL (MAGC1_HUMAN)
SLFSYTLASM

SEQ ID NO: 83394 - protein, 9 aa, Artificial Sequence
  Description of Artificial Sequence: Synthetic peptide
  Seed: SQSSPVSSF (MAGC1_HUMAN)
SQSSPVSSH

SEQ ID NO: 83395 - protein, 9 aa, Artificial Sequence
  Description of Artificial Sequence: Synthetic peptide
  Seed: SSPESDDTL (MAGC1_HUMAN)
SMPESDDTV

SEQ ID NO: 83396 - protein, 9 aa, Artificial Sequence
  Description of Artificial Sequence: Synthetic peptide
  Seed: MTSSFSSTL (MAGC1_HUMAN)
MESSFSSTL

SEQ ID NO: 83397 - protein, 9 aa, Artificial Sequence
  Description of Artificial Sequence: Synthetic peptide
  Seed: TSLSLPQSF (MAGC1_HUMAN)
TSLSLPQSL

SEQ ID NO: 83398 - protein, 9 aa, Artificial Sequence
  Description of Artificial Sequence: Synthetic peptide
  Seed: FQSSLQSPV (MAGC1_HUMAN)
FISSLQSPF

SEQ ID NO: 83399 - protein, 9 aa, Artificial Sequence
  Description of Artificial Sequence: Synthetic peptide
  Seed: SSPERTHST (MAGC1_HUMAN)
SNPERTHSL

SEQ ID NO: 83400 - protein, 9 aa, Artificial Sequence
  Description of Artificial Sequence: Synthetic peptide
  Seed: FQSSPERTH (MAGC1_HUMAN)
FPSSPERTY

SEQ ID NO: 83401 - protein, 10 aa, Artificial Sequence
  Description of Artificial Sequence: Synthetic peptide
  Seed: EMLTNVISRY (MAGC1_HUMAN)
ETLTNVISRW

SEQ ID NO: 83402 - protein, 9 aa, Artificial Sequence
  Description of Artificial Sequence: Synthetic peptide
  Seed: TESASSSVM (MAGC1_HUMAN)
TMSASSSVI

SEQ ID NO: 83403 - protein, 9 aa, Artificial Sequence
  Description of Artificial Sequence: Synthetic peptide
  Seed: IPMTSSFSS (MAGC1_HUMAN)
IPMTSSFSA

SEQ ID NO: 83404 - protein, 9 aa, Artificial Sequence
  Description of Artificial Sequence: Synthetic peptide
  Seed: YQVKQPITK (MAGC1_HUMAN)
YWVKQPITL

SEQ ID NO: 83405 - protein, 10 aa, Artificial Sequence
  Description of Artificial Sequence: Synthetic peptide
  Seed: VSICSSSTSL (MAGC1_HUMAN)
VIICSSSTSY

SEQ ID NO: 83406 - protein, 9 aa, Artificial Sequence
  Description of Artificial Sequence: Synthetic peptide
  Seed: WVQEHYLEY (MAGC1_HUMAN)
WAQEHYLEY

SEQ ID NO: 83407 - protein, 9 aa, Artificial Sequence
  Description of Artificial Sequence: Synthetic peptide
  Seed: YTGYFPVIF (MAGC1_HUMAN)
YWGYFPVIF

SEQ ID NO: 83408 - protein, 9 aa, Artificial Sequence
  Description of Artificial Sequence: Synthetic peptide
  Seed: CSSSTPSSL (MAGC1_HUMAN)
CVSSTPSSW

SEQ ID NO: 83409 - protein, 9 aa, Artificial Sequence
  Description of Artificial Sequence: Synthetic peptide
  Seed: KAREFIEIL (MAGC1_HUMAN)
KNREFIEIY

SEQ ID NO: 83410 - protein, 9 aa, Artificial Sequence
  Description of Artificial Sequence: Synthetic peptide
  Seed: LQIPVSPSF (MAGC1_HUMAN)
LYIPVSPSW

SEQ ID NO: 83411 - protein, 9 aa, Artificial Sequence
  Description of Artificial Sequence: Synthetic peptide
  Seed: TSLSLPQSF (MAGC1_HUMAN)
TRLSLPQSM

SEQ ID NO: 83412 - protein, 9 aa, Artificial Sequence
  Description of Artificial Sequence: Synthetic peptide
  Seed: SSPPRYEFL (MAGC1_HUMAN)
SMPPRYEFM

SEQ ID NO: 83413 - protein, 10 aa, Artificial Sequence
  Description of Artificial Sequence: Synthetic peptide
  Seed: SFFSSALLSI (MAGC1_HUMAN)
SHFSSALLSF

SEQ ID NO: 83414 - protein, 9 aa, Artificial Sequence
  Description of Artificial Sequence: Synthetic peptide
  Seed: FSYTLLSLF (MAGC1_HUMAN)
FYYTLLSLY

SEQ ID NO: 83415 - protein, 10 aa, Artificial Sequence
  Description of Artificial Sequence: Synthetic peptide
  Seed: ATESASSSVM (MAGC1_HUMAN)
ALESASSSVL

SEQ ID NO: 83416 - protein, 9 aa, Artificial Sequence
  Description of Artificial Sequence: Synthetic peptide
  Seed: FPQSPLQGE (MAGC1_HUMAN)
FPQSPLQGA

SEQ ID NO: 83417 - protein, 9 aa, Artificial Sequence
  Description of Artificial Sequence: Synthetic peptide
  Seed: KVWVQEHYL (MAGC1_HUMAN)
KLWVQEHYL

SEQ ID NO: 83418 - protein, 9 aa, Artificial Sequence
  Description of Artificial Sequence: Synthetic peptide
  Seed: YTLASLLQS (MAGC1_HUMAN)
YVLASLLQI

SEQ ID NO: 83419 - protein, 9 aa, Artificial Sequence
  Description of Artificial Sequence: Synthetic peptide
  Seed: SAPEGEDSL (MAGC1_HUMAN)
SMPEGEDSL

SEQ ID NO: 83420 - protein, 10 aa, Artificial Sequence
  Description of Artificial Sequence: Synthetic peptide
  Seed: FPQSPLQIPV (MAGC1_HUMAN)
FQQSPLQIPV

SEQ ID NO: 83421 - protein, 9 aa, Artificial Sequence
  Description of Artificial Sequence: Synthetic peptide
  Seed: VIKRKVVEF (MAGC1_HUMAN)
VTKRKVVEM

SEQ ID NO: 83422 - protein, 11 aa, Artificial Sequence
  Description of Artificial Sequence: Synthetic peptide
  Seed: IPMTSSFSSTL (MAGC1_HUMAN)
IFMTSSFSSTF

SEQ ID NO: 83423 - protein, 9 aa, Artificial Sequence
  Description of Artificial Sequence: Synthetic peptide
  Seed: RTQSTFEGF (MAGC1_HUMAN)
RFQSTFEGW

SEQ ID NO: 83424 - protein, 10 aa, Artificial Sequence
  Description of Artificial Sequence: Synthetic peptide
  Seed: NPASSFFSSA (MAGC1_HUMAN)
NPASSFFSSM

SEQ ID NO: 83425 - protein, 10 aa, Artificial Sequence
  Description of Artificial Sequence: Synthetic peptide
  Seed: SFSSTLLSIL (MAGC1_HUMAN)
SQSSTLLSIW

SEQ ID NO: 83426 - protein, 9 aa, Artificial Sequence
  Description of Artificial Sequence: Synthetic peptide
  Seed: EFIEILFGI (MAGC1_HUMAN)
ESIEILFGL

SEQ ID NO: 83427 - protein, 9 aa, Artificial Sequence
  Description of Artificial Sequence: Synthetic peptide
  Seed: RSFSSTLLS (MAGC1_HUMAN)
RQFSSTLLY

SEQ ID NO: 83428 - protein, 9 aa, Artificial Sequence
  Description of Artificial Sequence: Synthetic peptide
  Seed: SQSSPVSSF (MAGC1_HUMAN)
SHSSPVSSM

SEQ ID NO: 83429 - protein, 9 aa, Artificial Sequence
  Description of Artificial Sequence: Synthetic peptide
  Seed: SAASSSTLV (MAGC1_HUMAN)
SVASSSTLV

SEQ ID NO: 83430 - protein, 9 aa, Artificial Sequence
  Description of Artificial Sequence: Synthetic peptide
  Seed: FAFGEPREL (MAGC1_HUMAN)
FWFGEPREF

SEQ ID NO: 83431 - protein, 9 aa, Artificial Sequence
  Description of Artificial Sequence: Synthetic peptide
  Seed: RSFSSTLLS (MAGC1_HUMAN)
RMFSSTLLA

SEQ ID NO: 83432 - protein, 9 aa, Artificial Sequence
  Description of Artificial Sequence: Synthetic peptide
  Seed: TLASLLQSS (MAGC1_HUMAN)
TVASLLQSA

SEQ ID NO: 83433 - protein, 10 aa, Artificial Sequence
  Description of Artificial Sequence: Synthetic peptide
  Seed: MLKNTVPITF (MAGC1_HUMAN)
MIKNTVPITY

SEQ ID NO: 83434 - protein, 11 aa, Artificial Sequence
  Description of Artificial Sequence: Synthetic peptide
  Seed: SLSQSSPVSSF (MAGC1_HUMAN)
SHSQSSPVSSY

SEQ ID NO: 83435 - protein, 9 aa, Artificial Sequence
  Description of Artificial Sequence: Synthetic peptide
  Seed: AQSSLQIPV (MAGC1_HUMAN)
ALSSLQIPF

SEQ ID NO: 83436 - protein, 9 aa, Artificial Sequence
  Description of Artificial Sequence: Synthetic peptide
  Seed: FAFGEPREL (MAGC1_HUMAN)
FLFGEPREY

SEQ ID NO: 83437 - protein, 10 aa, Artificial Sequence
  Description of Artificial Sequence: Synthetic peptide
  Seed: FQSSLQSPVS (MAGC1_HUMAN)
FMSSLQSPVN

SEQ ID NO: 83438 - protein, 10 aa, Artificial Sequence
  Description of Artificial Sequence: Synthetic peptide
  Seed: NRLLILILSI (MAGC1_HUMAN)
NFLLILILSV

SEQ ID NO: 83439 - protein, 9 aa, Artificial Sequence
  Description of Artificial Sequence: Synthetic peptide
  Seed: LQIPMTSSF (MAGC1_HUMAN)
LPIPMTSSW

SEQ ID NO: 83440 - protein, 10 aa, Artificial Sequence
  Description of Artificial Sequence: Synthetic peptide
  Seed: VSLFQSSPER (MAGC1_HUMAN)
VMLFQSSPER

SEQ ID NO: 83441 - protein, 10 aa, Artificial Sequence
  Description of Artificial Sequence: Synthetic peptide
  Seed: VWVQEHYLEY (MAGC1_HUMAN)
VLVQEHYLEY

SEQ ID NO: 83442 - protein, 9 aa, Artificial Sequence
  Description of Artificial Sequence: Synthetic peptide
  Seed: YTSSSDTLL (MAGC1_HUMAN)
YSSSSDTLY

SEQ ID NO: 83443 - protein, 10 aa, Artificial Sequence
  Description of Artificial Sequence: Synthetic peptide
  Seed: MTSSFSSTLL (MAGC1_HUMAN)
MKSSFSSTLW

SEQ ID NO: 83444 - protein, 9 aa, Artificial Sequence
  Description of Artificial Sequence: Synthetic peptide
  Seed: TLDEKVDEL (MAGC1_HUMAN)
TMDEKVDEL

SEQ ID NO: 83445 - protein, 11 aa, Artificial Sequence
  Description of Artificial Sequence: Synthetic peptide
  Seed: TTDDSTATESA (MAGC1_HUMAN)
TWDDSTATESL

SEQ ID NO: 83446 - protein, 11 aa, Artificial Sequence
  Description of Artificial Sequence: Synthetic peptide
  Seed: FLAMLKNTVPI (MAGC1_HUMAN)
FTAMLKNTVPL

SEQ ID NO: 83447 - protein, 9 aa, Artificial Sequence
  Description of Artificial Sequence: Synthetic peptide
  Seed: AQSPLQRPV (MAGC1_HUMAN)
ALSPLQRPV

SEQ ID NO: 83448 - protein, 10 aa, Artificial Sequence
  Description of Artificial Sequence: Synthetic peptide
  Seed: SRYTGYFPVI (MAGC1_HUMAN)
SCYTGYFPVI

SEQ ID NO: 83449 - protein, 9 aa, Artificial Sequence
  Description of Artificial Sequence: Synthetic peptide
  Seed: TTDDSTATE (MAGC1_HUMAN)
TSDDSTATI

SEQ ID NO: 83450 - protein, 9 aa, Artificial Sequence
  Description of Artificial Sequence: Synthetic peptide
  Seed: TSLSLPQSF (MAGC1_HUMAN)
TRLSLPQSY

SEQ ID NO: 83451 - protein, 9 aa, Artificial Sequence
  Description of Artificial Sequence: Synthetic peptide
  Seed: GSPSFSSTL (MAGC1_HUMAN)
GIPSFSSTY

SEQ ID NO: 83452 - protein, 9 aa, Artificial Sequence
  Description of Artificial Sequence: Synthetic peptide
  Seed: SSPERTHST (MAGC1_HUMAN)
SIPERTHSF

SEQ ID NO: 83453 - protein, 9 aa, Artificial Sequence
  Description of Artificial Sequence: Synthetic peptide
  Seed: LQRPVSSFF (MAGC1_HUMAN)
LQRPVSSFI

SEQ ID NO: 83454 - protein, 11 aa, Artificial Sequence
  Description of Artificial Sequence: Synthetic peptide
  Seed: RSFSSTLLSIF (MAGC1_HUMAN)
RVFSSTLLSIY

SEQ ID NO: 83455 - protein, 9 aa, Artificial Sequence
  Description of Artificial Sequence: Synthetic peptide
  Seed: SSPPRYEFL (MAGC1_HUMAN)
STPPRYEFW

SEQ ID NO: 83456 - protein, 10 aa, Artificial Sequence
  Description of Artificial Sequence: Synthetic peptide
  Seed: PLQIPVSRSF (MAGC1_HUMAN)
PYQIPVSRSM

SEQ ID NO: 83457 - protein, 10 aa, Artificial Sequence
  Description of Artificial Sequence: Synthetic peptide
  Seed: KVVEFLAMLK (MAGC1_HUMAN)
KFVEFLAMLR

SEQ ID NO: 83458 - protein, 9 aa, Artificial Sequence
  Description of Artificial Sequence: Synthetic peptide
  Seed: YPLQSPQSR (MAGC1_HUMAN)
YVLQSPQSF

SEQ ID NO: 83459 - protein, 10 aa, Artificial Sequence
  Description of Artificial Sequence: Synthetic peptide
  Seed: LQGEEFQSSL (MAGC1_HUMAN)
LQGEEFQSSY

SEQ ID NO: 83460 - protein, 11 aa, Artificial Sequence
  Description of Artificial Sequence: Synthetic peptide
  Seed: RPVSSFFSYTL (MAGC1_HUMAN)
RVVSSFFSYTM

SEQ ID NO: 83461 - protein, 10 aa, Artificial Sequence
  Description of Artificial Sequence: Synthetic peptide
  Seed: WGPRAHSEVI (MAGC1_HUMAN)
WKPRAHSEVM

SEQ ID NO: 83462 - protein, 9 aa, Artificial Sequence
  Description of Artificial Sequence: Synthetic peptide
  Seed: VIKRKVVEF (MAGC1_HUMAN)
VEKRKVVEY

SEQ ID NO: 83463 - protein, 9 aa, Artificial Sequence
  Description of Artificial Sequence: Synthetic peptide
  Seed: FSSTLLSLF (MAGC1_HUMAN)
FPSTLLSLY

SEQ ID NO: 83464 - protein, 9 aa, Artificial Sequence
  Description of Artificial Sequence: Synthetic peptide
  Seed: YPLQSPQSR (MAGC1_HUMAN)
YSLQSPQSY

SEQ ID NO: 83465 - protein, 10 aa, Artificial Sequence
  Description of Artificial Sequence: Synthetic peptide
  Seed: LQIPVSSSFS (MAGC1_HUMAN)
LMIPVSSSFW

SEQ ID NO: 83466 - protein, 9 aa, Artificial Sequence
  Description of Artificial Sequence: Synthetic peptide
  Seed: SRYTGYFPV (MAGC1_HUMAN)
SSYTGYFPF

SEQ ID NO: 83467 - protein, 10 aa, Artificial Sequence
  Description of Artificial Sequence: Synthetic peptide
  Seed: SSPESAQSTF (MAGC1_HUMAN)
SSPESAQSTL

SEQ ID NO: 83468 - protein, 9 aa, Artificial Sequence
  Description of Artificial Sequence: Synthetic peptide
  Seed: RTHSTFEGF (MAGC1_HUMAN)
RLHSTFEGI

SEQ ID NO: 83469 - protein, 10 aa, Artificial Sequence
  Description of Artificial Sequence: Synthetic peptide
  Seed: SRYTGYFPVI (MAGC1_HUMAN)
SYYTGYFPVF

SEQ ID NO: 83470 - protein, 9 aa, Artificial Sequence
  Description of Artificial Sequence: Synthetic peptide
  Seed: LQIPGSPSF (MAGC1_HUMAN)
LGIPGSPSW

SEQ ID NO: 83471 - protein, 9 aa, Artificial Sequence
  Description of Artificial Sequence: Synthetic peptide
  Seed: VSSSFSYTL (MAGC1_HUMAN)
VQSSFSYTW

SEQ ID NO: 83472 - protein, 9 aa, Artificial Sequence
  Description of Artificial Sequence: Synthetic peptide
  Seed: TTDDSTATE (MAGC1_HUMAN)
TMDDSTATY

SEQ ID NO: 83473 - protein, 9 aa, Artificial Sequence
  Description of Artificial Sequence: Synthetic peptide
  Seed: SSPERTHST (MAGC1_HUMAN)
SFPERTHSF

SEQ ID NO: 83474 - protein, 9 aa, Artificial Sequence
  Description of Artificial Sequence: Synthetic peptide
  Seed: STFEGFPQS (MAGC1_HUMAN)
STFEGFPQY

SEQ ID NO: 83475 - protein, 10 aa, Artificial Sequence
  Description of Artificial Sequence: Synthetic peptide
  Seed: TGYFPVIFRK (MAGC1_HUMAN)
TTYFPVIFRN

SEQ ID NO: 83476 - protein, 9 aa, Artificial Sequence
  Description of Artificial Sequence: Synthetic peptide
  Seed: SSSDTLLES (MAGC1_HUMAN)
SGSDTLLEY

SEQ ID NO: 83477 - protein, 10 aa, Artificial Sequence
  Description of Artificial Sequence: Synthetic peptide
  Seed: SRYTGYFPVI (MAGC1_HUMAN)
SSYTGYFPVL

SEQ ID NO: 83478 - protein, 9 aa, Artificial Sequence
  Description of Artificial Sequence: Synthetic peptide
  Seed: FSYTLLSLF (MAGC1_HUMAN)
FPYTLLSLL

SEQ ID NO: 83479 - protein, 10 aa, Artificial Sequence
  Description of Artificial Sequence: Synthetic peptide
  Seed: FLAMLKNTVP (MAGC1_HUMAN)
FMAMLKNTVV

SEQ ID NO: 83480 - protein, 9 aa, Artificial Sequence
  Description of Artificial Sequence: Synthetic peptide
  Seed: ESDDTLYPL (MAGC1_HUMAN)
EIDDTLYPL

SEQ ID NO: 83481 - protein, 9 aa, Artificial Sequence
  Description of Artificial Sequence: Synthetic peptide
  Seed: LSDEQGMSQ (MAGC1_HUMAN)
LFDEQGMSM

SEQ ID NO: 83482 - protein, 9 aa, Artificial Sequence
  Description of Artificial Sequence: Synthetic peptide
  Seed: RAHSEVIKR (MAGC1_HUMAN)
RSHSEVIKM

SEQ ID NO: 83483 - protein, 9 aa, Artificial Sequence
  Description of Artificial Sequence: Synthetic peptide
  Seed: QVKQPITKA (MAGC1_HUMAN)
QAKQPITKR

SEQ ID NO: 83484 - protein, 9 aa, Artificial Sequence
  Description of Artificial Sequence: Synthetic peptide
  Seed: TFEGFPQSL (MAGC1_HUMAN)
TFEGFPQSI

SEQ ID NO: 83485 - protein, 8 aa, Artificial Sequence
  Description of Artificial Sequence: Synthetic peptide
  Seed: IWDVLSGI (MAGC1_HUMAN)
ISDVLSGM

SEQ ID NO: 83486 - protein, 11 aa, Artificial Sequence
  Description of Artificial Sequence: Synthetic peptide
  Seed: IPVSAASSSTL (MAGC1_HUMAN)
ICVSAASSSTW

SEQ ID NO: 83487 - protein, 9 aa, Artificial Sequence
  Description of Artificial Sequence: Synthetic peptide
  Seed: YQVKQPITK (MAGC1_HUMAN)
YGVKQPITM

SEQ ID NO: 83488 - protein, 9 aa, Artificial Sequence
  Description of Artificial Sequence: Synthetic peptide
  Seed: STQSPFEGF (MAGC1_HUMAN)
SLQSPFEGR

SEQ ID NO: 83489 - protein, 10 aa, Artificial Sequence
  Description of Artificial Sequence: Synthetic peptide
  Seed: ICSSSTSLSL (MAGC1_HUMAN)
IDSSSTSLSF

SEQ ID NO: 83490 - protein, 8 aa, Artificial Sequence
  Description of Artificial Sequence: Synthetic peptide
  Seed: SSPPRYEF (MAGC1_HUMAN)
SAPPRYEV

SEQ ID NO: 83491 - protein, 9 aa, Artificial Sequence
  Description of Artificial Sequence: Synthetic peptide
  Seed: TLLSILQSS (MAGC1_HUMAN)
TTLSILQSL

SEQ ID NO: 83492 - protein, 9 aa, Artificial Sequence
  Description of Artificial Sequence: Synthetic peptide
  Seed: SSPERTQST (MAGC1_HUMAN)
SHPERTQSM

SEQ ID NO: 83493 - protein, 11 aa, Artificial Sequence
  Description of Artificial Sequence: Synthetic peptide
  Seed: IPVSSSFSYTL (MAGC1_HUMAN)
IQVSSSFSYTF

SEQ ID NO: 83494 - protein, 10 aa, Artificial Sequence
  Description of Artificial Sequence: Synthetic peptide
  Seed: SLSPLHFPQF (MAGC1_HUMAN)
SYSPLHFPQI

SEQ ID NO: 83495 - protein, 9 aa, Artificial Sequence
  Description of Artificial Sequence: Synthetic peptide
  Seed: SQNRLLILI (MAGC1_HUMAN)
SVNRLLILV

SEQ ID NO: 83496 - protein, 10 aa, Artificial Sequence
  Description of Artificial Sequence: Synthetic peptide
  Seed: EILFGISLRE (MAGC1_HUMAN)
EGLFGISLRR

SEQ ID NO: 83497 - protein, 9 aa, Artificial Sequence
  Description of Artificial Sequence: Synthetic peptide
  Seed: ILILSIIFI (MAGC1_HUMAN)
IVILSIIFV

SEQ ID NO: 83498 - protein, 11 aa, Artificial Sequence
  Description of Artificial Sequence: Synthetic peptide
  Seed: SFFSYTLASLL (MAGC1_HUMAN)
SQFSYTLASLW

SEQ ID NO: 83499 - protein, 11 aa, Artificial Sequence
  Description of Artificial Sequence: Synthetic peptide
  Seed: MSPLYFPQSPL (MAGC1_HUMAN)
MAPLYFPQSPV

SEQ ID NO: 83500 - protein, 11 aa, Artificial Sequence
  Description of Artificial Sequence: Synthetic peptide
  Seed: IPVSAASSSTL (MAGC1_HUMAN)
ISVSAASSSTF

SEQ ID NO: 83501 - protein, 10 aa, Artificial Sequence
  Description of Artificial Sequence: Synthetic peptide
  Seed: LSLFQSFSER (MAGC1_HUMAN)
LVLFQSFSER

SEQ ID NO: 83502 - protein, 9 aa, Artificial Sequence
  Description of Artificial Sequence: Synthetic peptide
  Seed: HFPQSPPEW (MAGC1_HUMAN)
HMPQSPPEL

SEQ ID NO: 83503 - protein, 10 aa, Artificial Sequence
  Description of Artificial Sequence: Synthetic peptide
  Seed: SDSLTDSESL (MAGC1_HUMAN)
SESLTDSESL

SEQ ID NO: 83504 - protein, 9 aa, Artificial Sequence
  Description of Artificial Sequence: Synthetic peptide
  Seed: LQNPASSFF (MAGC1_HUMAN)
LVNPASSFM

SEQ ID NO: 83505 - protein, 11 aa, Artificial Sequence
  Description of Artificial Sequence: Synthetic peptide
  Seed: SFFSYTLASLL (MAGC1_HUMAN)
SEFSYTLASLW

SEQ ID NO: 83506 - protein, 9 aa, Artificial Sequence
  Description of Artificial Sequence: Synthetic peptide
  Seed: IESEPLFTY (MAGC1_HUMAN)
IESEPLFTL

SEQ ID NO: 83507 - protein, 11 aa, Artificial Sequence
  Description of Artificial Sequence: Synthetic peptide
  Seed: LQRPVSSFFSY (MAGC1_HUMAN)
LTRPVSSFFSF

SEQ ID NO: 83508 - protein, 9 aa, Artificial Sequence
  Description of Artificial Sequence: Synthetic peptide
  Seed: SFSERTQST (MAGC1_HUMAN)
SWSERTQSY

SEQ ID NO: 83509 - protein, 10 aa, Artificial Sequence
  Description of Artificial Sequence: Synthetic peptide
  Seed: SPLQSPESAP (MAGC1_HUMAN)
SPLQSPESAA

SEQ ID NO: 83510 - protein, 9 aa, Artificial Sequence
  Description of Artificial Sequence: Synthetic peptide
  Seed: AQSSLQIPV (MAGC1_HUMAN)
AASSLQIPV

SEQ ID NO: 83511 - protein, 11 aa, Artificial Sequence
  Description of Artificial Sequence: Synthetic peptide
  Seed: SLSQSSPVSSF (MAGC1_HUMAN)
SISQSSPVSSY

SEQ ID NO: 83512 - protein, 10 aa, Artificial Sequence
  Description of Artificial Sequence: Synthetic peptide
  Seed: ESAQSTFEGF (MAGC1_HUMAN)
ESAQSTFEGW

SEQ ID NO: 83513 - protein, 10 aa, Artificial Sequence
  Description of Artificial Sequence: Synthetic peptide
  Seed: SSFSYTLLSL (MAGC1_HUMAN)
SLFSYTLLSF

SEQ ID NO: 83514 - protein, 9 aa, Artificial Sequence
  Description of Artificial Sequence: Synthetic peptide
  Seed: LSDEQGMSQ (MAGC1_HUMAN)
LLDEQGMSY

SEQ ID NO: 83515 - protein, 9 aa, Artificial Sequence
  Description of Artificial Sequence: Synthetic peptide
  Seed: SSSSSSSTL (MAGC1_HUMAN)
SLSSSSSTW

SEQ ID NO: 83516 - protein, 10 aa, Artificial Sequence
  Description of Artificial Sequence: Synthetic peptide
  Seed: RAGREHFAFG (MAGC1_HUMAN)
RFGREHFAFV

SEQ ID NO: 83517 - protein, 8 aa, Artificial Sequence
  Description of Artificial Sequence: Synthetic peptide
  Seed: FSSALLSI (MAGC1_HUMAN)
FASALLSL

SEQ ID NO: 83518 - protein, 10 aa, Artificial Sequence
  Description of Artificial Sequence: Synthetic peptide
  Seed: ICSSSTPSSL (MAGC1_HUMAN)
IASSSTPSSM

SEQ ID NO: 83519 - protein, 10 aa, Artificial Sequence
  Description of Artificial Sequence: Synthetic peptide
  Seed: FPQSLLQIPM (MAGC1_HUMAN)
FPQSLLQIPP

SEQ ID NO: 83520 - protein, 10 aa, Artificial Sequence
  Description of Artificial Sequence: Synthetic peptide
  Seed: SFFSSALLSI (MAGC1_HUMAN)
SYFSSALLSV

SEQ ID NO: 83521 - protein, 9 aa, Artificial Sequence
  Description of Artificial Sequence: Synthetic peptide
  Seed: SLTDSESLI (MAGC1_HUMAN)
SQTDSESLI

SEQ ID NO: 83522 - protein, 9 aa, Artificial Sequence
  Description of Artificial Sequence: Synthetic peptide
  Seed: YTSSSDTLL (MAGC1_HUMAN)
YLSSSDTLW

SEQ ID NO: 83523 - protein, 10 aa, Artificial Sequence
  Description of Artificial Sequence: Synthetic peptide
  Seed: KGTYASEEVI (MAGC1_HUMAN)
KCTYASEEVW

SEQ ID NO: 83524 - protein, 10 aa, Artificial Sequence
  Description of Artificial Sequence: Synthetic peptide
  Seed: WEDSLSPLHF (MAGC1_HUMAN)
WEDSLSPLHW

SEQ ID NO: 83525 - protein, 9 aa, Artificial Sequence
  Description of Artificial Sequence: Synthetic peptide
  Seed: ELARFLLLK (MAGC1_HUMAN)
EWARFLLLR

SEQ ID NO: 83526 - protein, 9 aa, Artificial Sequence
  Description of Artificial Sequence: Synthetic peptide
  Seed: SLIESEPLF (MAGC1_HUMAN)
SLIESEPLA

SEQ ID NO: 83527 - protein, 10 aa, Artificial Sequence
  Description of Artificial Sequence: Synthetic peptide
  Seed: FFSYTLASLL (MAGC1_HUMAN)
FISYTLASLF

SEQ ID NO: 83528 - protein, 9 aa, Artificial Sequence
  Description of Artificial Sequence: Synthetic peptide
  Seed: FQSSPERTH (MAGC1_HUMAN)
FSSSPERTL

SEQ ID NO: 83529 - protein, 9 aa, Artificial Sequence
  Description of Artificial Sequence: Synthetic peptide
  Seed: TTDDSTATE (MAGC1_HUMAN)
TIDDSTATL

SEQ ID NO: 83530 - protein, 10 aa, Artificial Sequence
  Description of Artificial Sequence: Synthetic peptide
  Seed: ICSSSTPSSL (MAGC1_HUMAN)
IVSSSTPSSF

SEQ ID NO: 83531 - protein, 9 aa, Artificial Sequence
  Description of Artificial Sequence: Synthetic peptide
  Seed: MLTNVISRY (MAGC1_HUMAN)
MQTNVISRY

SEQ ID NO: 83532 - protein, 9 aa, Artificial Sequence
  Description of Artificial Sequence: Synthetic peptide
  Seed: ISFSSSTSL (MAGC1_HUMAN)
IHFSSSTSW

SEQ ID NO: 83533 - protein, 9 aa, Artificial Sequence
  Description of Artificial Sequence: Synthetic peptide
  Seed: IPVSRSFSS (MAGC1_HUMAN)
ISVSRSFSY

SEQ ID NO: 83534 - protein, 9 aa, Artificial Sequence
  Description of Artificial Sequence: Synthetic peptide
  Seed: VPITFPSSY (MAGC1_HUMAN)
VHITFPSSY

SEQ ID NO: 83535 - protein, 11 aa, Artificial Sequence
  Description of Artificial Sequence: Synthetic peptide
  Seed: STFEGFPQSLL (MAGC1_HUMAN)
STFEGFPQSLY

SEQ ID NO: 83536 - protein, 9 aa, Artificial Sequence
  Description of Artificial Sequence: Synthetic peptide
  Seed: YTLLSLFQS (MAGC1_HUMAN)
YVLLSLFQM

SEQ ID NO: 83537 - protein, 9 aa, Artificial Sequence
  Description of Artificial Sequence: Synthetic peptide
  Seed: TLLSILQSS (MAGC1_HUMAN)
TTLSILQSV

SEQ ID NO: 83538 - protein, 10 aa, Artificial Sequence
  Description of Artificial Sequence: Synthetic peptide
  Seed: QIPVSSSFSY (MAGC1_HUMAN)
QVPVSSSFSY

SEQ ID NO: 83539 - protein, 9 aa, Artificial Sequence
  Description of Artificial Sequence: Synthetic peptide
  Seed: SSSSSSSTL (MAGC1_HUMAN)
SQSSSSSTW

SEQ ID NO: 83540 - protein, 10 aa, Artificial Sequence
  Description of Artificial Sequence: Synthetic peptide
  Seed: RAGREHFAFG (MAGC1_HUMAN)
RMGREHFAFM

SEQ ID NO: 83541 - protein, 9 aa, Artificial Sequence
  Description of Artificial Sequence: Synthetic peptide
  Seed: LQRPVSSFF (MAGC1_HUMAN)
LLRPVSSFY

SEQ ID NO: 83542 - protein, 9 aa, Artificial Sequence
  Description of Artificial Sequence: Synthetic peptide
  Seed: ASSSTLVSI (MAGC1_HUMAN)
AASSTLVSW

SEQ ID NO: 83543 - protein, 10 aa, Artificial Sequence
  Description of Artificial Sequence: Synthetic peptide
  Seed: SFPSSTSSSL (MAGC1_HUMAN)
SWPSSTSSSI

SEQ ID NO: 83544 - protein, 9 aa, Artificial Sequence
  Description of Artificial Sequence: Synthetic peptide
  Seed: VSAASSSTL (MAGC1_HUMAN)
VLAASSSTL

SEQ ID NO: 83545 - protein, 9 aa, Artificial Sequence
  Description of Artificial Sequence: Synthetic peptide
  Seed: ISFSSSTSL (MAGC1_HUMAN)
IQFSSSTSH

SEQ ID NO: 83546 - protein, 9 aa, Artificial Sequence
  Description of Artificial Sequence: Synthetic peptide
  Seed: TLVSIFQSS (MAGC1_HUMAN)
TQVSIFQSV

SEQ ID NO: 83547 - protein, 9 aa, Artificial Sequence
  Description of Artificial Sequence: Synthetic peptide
  Seed: SFFSYTLAS (MAGC1_HUMAN)
SFFSYTLAF

SEQ ID NO: 83548 - protein, 9 aa, Artificial Sequence
  Description of Artificial Sequence: Synthetic peptide
  Seed: SKSSPESPL (MAGC1_HUMAN)
SKSSPESPM

SEQ ID NO: 83549 - protein, 9 aa, Artificial Sequence
  Description of Artificial Sequence: Synthetic peptide
  Seed: REFIEILFG (MAGC1_HUMAN)
REFIEILFA

SEQ ID NO: 83550 - protein, 9 aa, Artificial Sequence
  Description of Artificial Sequence: Synthetic peptide
  Seed: FEGFPQSPL (MAGC1_HUMAN)
FEGFPQSPI

SEQ ID NO: 83551 - protein, 9 aa, Artificial Sequence
  Description of Artificial Sequence: Synthetic peptide
  Seed: LQIPGSPSF (MAGC1_HUMAN)
LCIPGSPSW

SEQ ID NO: 83552 - protein, 9 aa, Artificial Sequence
  Description of Artificial Sequence: Synthetic peptide
  Seed: FPQSVLQIP (MAGC1_HUMAN)
FPQSVLQIT

SEQ ID NO: 83553 - protein, 9 aa, Artificial Sequence
  Description of Artificial Sequence: Synthetic peptide
  Seed: ISRYTGYFP (MAGC1_HUMAN)
IVRYTGYFK

SEQ ID NO: 83554 - protein, 9 aa, Artificial Sequence
  Description of Artificial Sequence: Synthetic peptide
  Seed: AMLKNTVPI (MAGC1_HUMAN)
AMLKNTVPF

SEQ ID NO: 83555 - protein, 10 aa, Artificial Sequence
  Description of Artificial Sequence: Synthetic peptide
  Seed: SRYTGYFPVI (MAGC1_HUMAN)
SAYTGYFPVL

SEQ ID NO: 83556 - protein, 9 aa, Artificial Sequence
  Description of Artificial Sequence: Synthetic peptide
  Seed: CSSSTPSSL (MAGC1_HUMAN)
CSSSTPSSF

SEQ ID NO: 83557 - protein, 10 aa, Artificial Sequence
  Description of Artificial Sequence: Synthetic peptide
  Seed: KGTYASEEVI (MAGC1_HUMAN)
KKTYASEEVY

SEQ ID NO: 83558 - protein, 9 aa, Artificial Sequence
  Description of Artificial Sequence: Synthetic peptide
  Seed: VSSFFSYTL (MAGC1_HUMAN)
VISFFSYTW

SEQ ID NO: 83559 - protein, 9 aa, Artificial Sequence
  Description of Artificial Sequence: Synthetic peptide
  Seed: VSRSFSSTL (MAGC1_HUMAN)
VQRSFSSTY

SEQ ID NO: 83560 - protein, 9 aa, Artificial Sequence
  Description of Artificial Sequence: Synthetic peptide
  Seed: SSSDTLLES (MAGC1_HUMAN)
SQSDTLLEL

SEQ ID NO: 83561 - protein, 10 aa, Artificial Sequence
  Description of Artificial Sequence: Synthetic peptide
  Seed: SSFSSTLLSI (MAGC1_HUMAN)
STFSSTLLSL

SEQ ID NO: 83562 - protein, 11 aa, Artificial Sequence
  Description of Artificial Sequence: Synthetic peptide
  Seed: SSFPSSTSSSL (MAGC1_HUMAN)
SMFPSSTSSSM

SEQ ID NO: 83563 - protein, 10 aa, Artificial Sequence
  Description of Artificial Sequence: Synthetic peptide
  Seed: STFEGFPQSL (MAGC1_HUMAN)
STFEGFPQSV

SEQ ID NO: 83564 - protein, 9 aa, Artificial Sequence
  Description of Artificial Sequence: Synthetic peptide
  Seed: SPECTQSTF (MAGC1_HUMAN)
SMECTQSTY

SEQ ID NO: 83565 - protein, 9 aa, Artificial Sequence
  Description of Artificial Sequence: Synthetic peptide
  Seed: LQRPVSSFF (MAGC1_HUMAN)
LTRPVSSFW

SEQ ID NO: 83566 - protein, 9 aa, Artificial Sequence
  Description of Artificial Sequence: Synthetic peptide
  Seed: VSPSFSSTL (MAGC1_HUMAN)
VTPSFSSTY

SEQ ID NO: 83567 - protein, 10 aa, Artificial Sequence
  Description of Artificial Sequence: Synthetic peptide
  Seed: ASSFFSSALL (MAGC1_HUMAN)
ARSFFSSALF

SEQ ID NO: 83568 - protein, 9 aa, Artificial Sequence
  Description of Artificial Sequence: Synthetic peptide
  Seed: RTHSTFEGF (MAGC1_HUMAN)
RAHSTFEGK

SEQ ID NO: 83569 - protein, 9 aa, Artificial Sequence
  Description of Artificial Sequence: Synthetic peptide
  Seed: IFQSSPESA (MAGC1_HUMAN)
IWQSSPESL

SEQ ID NO: 83570 - protein, 9 aa, Artificial Sequence
  Description of Artificial Sequence: Synthetic peptide
  Seed: ISFSSSTSL (MAGC1_HUMAN)
IMFSSSTSW

SEQ ID NO: 83571 - protein, 10 aa, Artificial Sequence
  Description of Artificial Sequence: Synthetic peptide
  Seed: FAQSSLQIPV (MAGC1_HUMAN)
FIQSSLQIPI

SEQ ID NO: 83572 - protein, 11 aa, Artificial Sequence
  Description of Artificial Sequence: Synthetic peptide
  Seed: QSSPESAQSAF (MAGC1_HUMAN)
QPSPESAQSAF

SEQ ID NO: 83573 - protein, 9 aa, Artificial Sequence
  Description of Artificial Sequence: Synthetic peptide
  Seed: FSSTLVSLF (MAGC1_HUMAN)
FTSTLVSLY

SEQ ID NO: 83574 - protein, 9 aa, Artificial Sequence
  Description of Artificial Sequence: Synthetic peptide
  Seed: FSERTQSTF (MAGC1_HUMAN)
FSERTQSTY

SEQ ID NO: 83575 - protein, 10 aa, Artificial Sequence
  Description of Artificial Sequence: Synthetic peptide
  Seed: STLLSLFQSF (MAGC1_HUMAN)
SWLLSLFQSW

SEQ ID NO: 83576 - protein, 10 aa, Artificial Sequence
  Description of Artificial Sequence: Synthetic peptide
  Seed: GEPRELLTKV (MAGC1_HUMAN)
GEPRELLTKL

SEQ ID NO: 83577 - protein, 9 aa, Artificial Sequence
  Description of Artificial Sequence: Synthetic peptide
  Seed: RKVVEFLAM (MAGC1_HUMAN)
RVVVEFLAF

SEQ ID NO: 83578 - protein, 9 aa, Artificial Sequence
  Description of Artificial Sequence: Synthetic peptide
  Seed: SKSSPESPL (MAGC1_HUMAN)
SQSSPESPY

SEQ ID NO: 83579 - protein, 10 aa, Artificial Sequence
  Description of Artificial Sequence: Synthetic peptide
  Seed: ESAQSTFEGF (MAGC1_HUMAN)
EAAQSTFEGY

SEQ ID NO: 83580 - protein, 10 aa, Artificial Sequence
  Description of Artificial Sequence: Synthetic peptide
  Seed: ICSSSTSLSL (MAGC1_HUMAN)
ILSSSTSLSF

SEQ ID NO: 83581 - protein, 10 aa, Artificial Sequence
  Description of Artificial Sequence: Synthetic peptide
  Seed: SFFSYTLASL (MAGC1_HUMAN)
SMFSYTLASA

SEQ ID NO: 83582 - protein, 9 aa, Artificial Sequence
  Description of Artificial Sequence: Synthetic peptide
  Seed: QSPLQGEEF (MAGC1_HUMAN)
QLPLQGEEY

SEQ ID NO: 83583 - protein, 9 aa, Artificial Sequence
  Description of Artificial Sequence: Synthetic peptide
  Seed: LQIPVSSSS (MAGC1_HUMAN)
LFIPVSSSF

SEQ ID NO: 83584 - protein, 10 aa, Artificial Sequence
  Description of Artificial Sequence: Synthetic peptide
  Seed: SIIFIKGTYA (MAGC1_HUMAN)
SIIFIKGTYV

SEQ ID NO: 83585 - protein, 10 aa, Artificial Sequence
  Description of Artificial Sequence: Synthetic peptide
  Seed: ISRYTGYFPV (MAGC1_HUMAN)
INRYTGYFPM

SEQ ID NO: 83586 - protein, 10 aa, Artificial Sequence
  Description of Artificial Sequence: Synthetic peptide
  Seed: RAGREHFAFG (MAGC1_HUMAN)
RKGREHFAFA

SEQ ID NO: 83587 - protein, 9 aa, Artificial Sequence
  Description of Artificial Sequence: Synthetic peptide
  Seed: YQVKQPITK (MAGC1_HUMAN)
YSVKQPITF

SEQ ID NO: 83588 - protein, 10 aa, Artificial Sequence
  Description of Artificial Sequence: Synthetic peptide
  Seed: YTLDEKVDEL (MAGC1_HUMAN)
YVLDEKVDEA

SEQ ID NO: 83589 - protein, 9 aa, Artificial Sequence
  Description of Artificial Sequence: Synthetic peptide
  Seed: LQIPVSPSF (MAGC1_HUMAN)
LQIPVSPSA

SEQ ID NO: 83590 - protein, 9 aa, Artificial Sequence
  Description of Artificial Sequence: Synthetic peptide
  Seed: YPLQSPQSR (MAGC1_HUMAN)
YGLQSPQSY

SEQ ID NO: 83591 - protein, 9 aa, Artificial Sequence
  Description of Artificial Sequence: Synthetic peptide
  Seed: IPVSSSFSY (MAGC1_HUMAN)
IFVSSSFSY

SEQ ID NO: 83592 - protein, 10 aa, Artificial Sequence
  Description of Artificial Sequence: Synthetic peptide
  Seed: TGYFPVIFRK (MAGC1_HUMAN)
TTYFPVIFRH

SEQ ID NO: 83593 - protein, 10 aa, Artificial Sequence
  Description of Artificial Sequence: Synthetic peptide
  Seed: AASSSTLVSI (MAGC1_HUMAN)
ALSSSTLVSA

SEQ ID NO: 83594 - protein, 10 aa, Artificial Sequence
  Description of Artificial Sequence: Synthetic peptide
  Seed: SSPESAQSTF (MAGC1_HUMAN)
SFPESAQSTM

SEQ ID NO: 83595 - protein, 9 aa, Artificial Sequence
  Description of Artificial Sequence: Synthetic peptide
  Seed: RTHSTFEGF (MAGC1_HUMAN)
RLHSTFEGY

SEQ ID NO: 83596 - protein, 9 aa, Artificial Sequence
  Description of Artificial Sequence: Synthetic peptide
  Seed: RAHSEVIKR (MAGC1_HUMAN)
RLHSEVIKR

SEQ ID NO: 83597 - protein, 9 aa, Artificial Sequence
  Description of Artificial Sequence: Synthetic peptide
  Seed: KVWVQEHYL (MAGC1_HUMAN)
KMWVQEHYM

SEQ ID NO: 83598 - protein, 9 aa, Artificial Sequence
  Description of Artificial Sequence: Synthetic peptide
  Seed: SSSDTLLES (MAGC1_HUMAN)
SMSDTLLEF

SEQ ID NO: 83599 - protein, 9 aa, Artificial Sequence
  Description of Artificial Sequence: Synthetic peptide
  Seed: FSSTLLSLF (MAGC1_HUMAN)
FSSTLLSLW

SEQ ID NO: 83600 - protein, 10 aa, Artificial Sequence
  Description of Artificial Sequence: Synthetic peptide
  Seed: ILILSIIFIK (MAGC1_HUMAN)
ITILSIIFIK

SEQ ID NO: 83601 - protein, 10 aa, Artificial Sequence
  Description of Artificial Sequence: Synthetic peptide
  Seed: FPSSYKDALK (MAGC1_HUMAN)
FKSSYKDALR

SEQ ID NO: 83602 - protein, 11 aa, Artificial Sequence
  Description of Artificial Sequence: Synthetic peptide
  Seed: NSSPPRYEFLW (MAGC1_HUMAN)
NTSPPRYEFLW

SEQ ID NO: 83603 - protein, 9 aa, Artificial Sequence
  Description of Artificial Sequence: Synthetic peptide
  Seed: VISRYTGYF (MAGC1_HUMAN)
VSSRYTGYW

SEQ ID NO: 83604 - protein, 9 aa, Artificial Sequence
  Description of Artificial Sequence: Synthetic peptide
  Seed: NVISRYTGY (MAGC1_HUMAN)
NFISRYTGY

SEQ ID NO: 83605 - protein, 9 aa, Artificial Sequence
  Description of Artificial Sequence: Synthetic peptide
  Seed: RKAREFIEI (MAGC1_HUMAN)
RIAREFIEY

SEQ ID NO: 83606 - protein, 9 aa, Artificial Sequence
  Description of Artificial Sequence: Synthetic peptide
  Seed: SSPECTQST (MAGC1_HUMAN)
SLPECTQSL

SEQ ID NO: 83607 - protein, 9 aa, Artificial Sequence
  Description of Artificial Sequence: Synthetic peptide
  Seed: SASSSVMSP (MAGC1_HUMAN)
SMSSSVMSY

SEQ ID NO: 83608 - protein, 10 aa, Artificial Sequence
  Description of Artificial Sequence: Synthetic peptide
  Seed: SSFSSTLLSI (MAGC1_HUMAN)
SVFSSTLLSA

SEQ ID NO: 83609 - protein, 9 aa, Artificial Sequence
  Description of Artificial Sequence: Synthetic peptide
  Seed: SSSESPQSC (MAGC1_HUMAN)
STSESPQSM

SEQ ID NO: 83610 - protein, 10 aa, Artificial Sequence
  Description of Artificial Sequence: Synthetic peptide
  Seed: MPTAGMPSLL (MAGC1_HUMAN)
MDTAGMPSLA

SEQ ID NO: 83611 - protein, 10 aa, Artificial Sequence
  Description of Artificial Sequence: Synthetic peptide
  Seed: LSQSSPVSSF (MAGC1_HUMAN)
LMQSSPVSSY

SEQ ID NO: 83612 - protein, 9 aa, Artificial Sequence
  Description of Artificial Sequence: Synthetic peptide
  Seed: LQIPVSSSS (MAGC1_HUMAN)
LAIPVSSSF

SEQ ID NO: 83613 - protein, 11 aa, Artificial Sequence
  Description of Artificial Sequence: Synthetic peptide
  Seed: KDMPTAGMPSL (MAGC1_HUMAN)
KPMPTAGMPSI

SEQ ID NO: 83614 - protein, 10 aa, Artificial Sequence
  Description of Artificial Sequence: Synthetic peptide
  Seed: SSFSYTLLSL (MAGC1_HUMAN)
SLFSYTLLSM

SEQ ID NO: 83615 - protein, 10 aa, Artificial Sequence
  Description of Artificial Sequence: Synthetic peptide
  Seed: STFEGFPQSL (MAGC1_HUMAN)
SMFEGFPQSM

SEQ ID NO: 83616 - protein, 10 aa, Artificial Sequence
  Description of Artificial Sequence: Synthetic peptide
  Seed: SILQSSPESA (MAGC1_HUMAN)
SVLQSSPESV

SEQ ID NO: 83617 - protein, 10 aa, Artificial Sequence
  Description of Artificial Sequence: Synthetic peptide
  Seed: LAMLKNTVPI (MAGC1_HUMAN)
LRMLKNTVPM

SEQ ID NO: 83618 - protein, 11 aa, Artificial Sequence
  Description of Artificial Sequence: Synthetic peptide
  Seed: IPVSRSFSSTL (MAGC1_HUMAN)
IQVSRSFSSTF

SEQ ID NO: 83619 - protein, 9 aa, Artificial Sequence
  Description of Artificial Sequence: Synthetic peptide
  Seed: SAQSTFEGF (MAGC1_HUMAN)
SHQSTFEGF

SEQ ID NO: 83620 - protein, 11 aa, Artificial Sequence
  Description of Artificial Sequence: Synthetic peptide
  Seed: FLAMLKNTVPI (MAGC1_HUMAN)
FAAMLKNTVPA

SEQ ID NO: 83621 - protein, 9 aa, Artificial Sequence
  Description of Artificial Sequence: Synthetic peptide
  Seed: SSFFSSALL (MAGC1_HUMAN)
SMFFSSALM

SEQ ID NO: 83622 - protein, 9 aa, Artificial Sequence
  Description of Artificial Sequence: Synthetic peptide
  Seed: IIDTTDDST (MAGC1_HUMAN)
IMDTTDDSL

SEQ ID NO: 83623 - protein, 10 aa, Artificial Sequence
  Description of Artificial Sequence: Synthetic peptide
  Seed: SSPERTHSTF (MAGC1_HUMAN)
SWPERTHSTL

SEQ ID NO: 83624 - protein, 10 aa, Artificial Sequence
  Description of Artificial Sequence: Synthetic peptide
  Seed: SSPESTQSPF (MAGC1_HUMAN)
SGPESTQSPM

SEQ ID NO: 83625 - protein, 9 aa, Artificial Sequence
  Description of Artificial Sequence: Synthetic peptide
  Seed: RYTGYFPVI (MAGC1_HUMAN)
RWTGYFPVW

SEQ ID NO: 83626 - protein, 9 aa, Artificial Sequence
  Description of Artificial Sequence: Synthetic peptide
  Seed: SRYTGYFPV (MAGC1_HUMAN)
SVYTGYFPF

SEQ ID NO: 83627 - protein, 9 aa, Artificial Sequence
  Description of Artificial Sequence: Synthetic peptide
  Seed: FSYTLASLL (MAGC1_HUMAN)
FAYTLASLV

SEQ ID NO: 83628 - protein, 10 aa, Artificial Sequence
  Description of Artificial Sequence: Synthetic peptide
  Seed: FAQSSLQIPV (MAGC1_HUMAN)
FQQSSLQIPM

SEQ ID NO: 83629 - protein, 9 aa, Artificial Sequence
  Description of Artificial Sequence: Synthetic peptide
  Seed: MTSSFSSTL (MAGC1_HUMAN)
MTSSFSSTR

SEQ ID NO: 83630 - protein, 9 aa, Artificial Sequence
  Description of Artificial Sequence: Synthetic peptide
  Seed: SFSSTLVSL (MAGC1_HUMAN)
SASSTLVSY

SEQ ID NO: 83631 - protein, 10 aa, Artificial Sequence
  Description of Artificial Sequence: Synthetic peptide
  Seed: HSPQSPPEGM (MAGC1_HUMAN)
HSPQSPPEGL

SEQ ID NO: 83632 - protein, 10 aa, Artificial Sequence
  Description of Artificial Sequence: Synthetic peptide
  Seed: IIDTTDDSTA (MAGC1_HUMAN)
IIDTTDDSTI

SEQ ID NO: 83633 - protein, 11 aa, Artificial Sequence
  Description of Artificial Sequence: Synthetic peptide
  Seed: SPLQIPVSPSS (MAGC1_HUMAN)
SPLQIPVSPSA

SEQ ID NO: 83634 - protein, 9 aa, Artificial Sequence
  Description of Artificial Sequence: Synthetic peptide
  Seed: SPVISFSSS (MAGC1_HUMAN)
SPVISFSST

SEQ ID NO: 83635 - protein, 10 aa, Artificial Sequence
  Description of Artificial Sequence: Synthetic peptide
  Seed: SPSSSSTLLS (MAGC1_HUMAN)
SPSSSSTLLL

SEQ ID NO: 83636 - protein, 9 aa, Artificial Sequence
  Description of Artificial Sequence: Synthetic peptide
  Seed: TTDDSTATE (MAGC1_HUMAN)
TLDDSTATM

SEQ ID NO: 83637 - protein, 9 aa, Artificial Sequence
  Description of Artificial Sequence: Synthetic peptide
  Seed: MLTNVISRY (MAGC1_HUMAN)
MVTNVISRK

SEQ ID NO: 83638 - protein, 10 aa, Artificial Sequence
  Description of Artificial Sequence: Synthetic peptide
  Seed: SLSPLHFPQF (MAGC1_HUMAN)
STSPLHFPQY

SEQ ID NO: 83639 - protein, 9 aa, Artificial Sequence
  Description of Artificial Sequence: Synthetic peptide
  Seed: SSSSSSSTL (MAGC1_HUMAN)
SASSSSSTF

SEQ ID NO: 83640 - protein, 9 aa, Artificial Sequence
  Description of Artificial Sequence: Synthetic peptide
  Seed: EMLTNVISR (MAGC1_HUMAN)
EFLTNVISR

SEQ ID NO: 83641 - protein, 10 aa, Artificial Sequence
  Description of Artificial Sequence: Synthetic peptide
  Seed: GEDSQSPLQI (MAGC1_HUMAN)
GEDSQSPLQV

SEQ ID NO: 83642 - protein, 10 aa, Artificial Sequence
  Description of Artificial Sequence: Synthetic peptide
  Seed: PLQIPVSRSF (MAGC1_HUMAN)
PMQIPVSRSY

SEQ ID NO: 83643 - protein, 11 aa, Artificial Sequence
  Description of Artificial Sequence: Synthetic peptide
  Seed: RPVSSFFSYTL (MAGC1_HUMAN)
RQVSSFFSYTW

SEQ ID NO: 83644 - protein, 10 aa, Artificial Sequence
  Description of Artificial Sequence: Synthetic peptide
  Seed: SFFSSALLSI (MAGC1_HUMAN)
SFFSSALLSW

SEQ ID NO: 83645 - protein, 9 aa, Artificial Sequence
  Description of Artificial Sequence: Synthetic peptide
  Seed: REVPNSSPP (MAGC1_HUMAN)
REVPNSSPL

SEQ ID NO: 83646 - protein, 10 aa, Artificial Sequence
  Description of Artificial Sequence: Synthetic peptide
  Seed: DVLSGIGVRA (MAGC1_HUMAN)
DVLSGIGVRM

SEQ ID NO: 83647 - protein, 9 aa, Artificial Sequence
  Description of Artificial Sequence: Synthetic peptide
  Seed: SLSPFSEES (MAGC1_HUMAN)
STSPFSEEI

SEQ ID NO: 83648 - protein, 9 aa, Artificial Sequence
  Description of Artificial Sequence: Synthetic peptide
  Seed: FAFGEPREL (MAGC1_HUMAN)
FFFGEPREV

SEQ ID NO: 83649 - protein, 9 aa, Artificial Sequence
  Description of Artificial Sequence: Synthetic peptide
  Seed: AQSSLQIPV (MAGC1_HUMAN)
AQSSLQIPW

SEQ ID NO: 83650 - protein, 9 aa, Artificial Sequence
  Description of Artificial Sequence: Synthetic peptide
  Seed: IPVSSSFSY (MAGC1_HUMAN)
IGVSSSFSY

SEQ ID NO: 83651 - protein, 11 aa, Artificial Sequence
  Description of Artificial Sequence: Synthetic peptide
  Seed: IIDTTDDSTAT (MAGC1_HUMAN)
IADTTDDSTAM

SEQ ID NO: 83652 - protein, 9 aa, Artificial Sequence
  Description of Artificial Sequence: Synthetic peptide
  Seed: FSYTLASLL (MAGC1_HUMAN)
FQYTLASLM

SEQ ID NO: 83653 - protein, 9 aa, Artificial Sequence
  Description of Artificial Sequence: Synthetic peptide
  Seed: VPNSSPPRY (MAGC1_HUMAN)
VINSSPPRY

SEQ ID NO: 83654 - protein, 9 aa, Artificial Sequence
  Description of Artificial Sequence: Synthetic peptide
  Seed: RAGREHFAF (MAGC1_HUMAN)
RKGREHFAF

SEQ ID NO: 83655 - protein, 10 aa, Artificial Sequence
  Description of Artificial Sequence: Synthetic peptide
  Seed: EGPAQSPLQR (MAGC1_HUMAN)
EAPAQSPLQR

SEQ ID NO: 83656 - protein, 9 aa, Artificial Sequence
  Description of Artificial Sequence: Synthetic peptide
  Seed: LQIPVSRSF (MAGC1_HUMAN)
LWIPVSRSF

SEQ ID NO: 83657 - protein, 9 aa, Artificial Sequence
  Description of Artificial Sequence: Synthetic peptide
  Seed: SPLQIPQSS (MAGC1_HUMAN)
SHLQIPQSM

SEQ ID NO: 83658 - protein, 9 aa, Artificial Sequence
  Description of Artificial Sequence: Synthetic peptide
  Seed: AMLKNTVPI (MAGC1_HUMAN)
AELKNTVPM

SEQ ID NO: 83659 - protein, 9 aa, Artificial Sequence
  Description of Artificial Sequence: Synthetic peptide
  Seed: RAHSEVIKR (MAGC1_HUMAN)
RTHSEVIKR

SEQ ID NO: 83660 - protein, 11 aa, Artificial Sequence
  Description of Artificial Sequence: Synthetic peptide
  Seed: STFEGFPQSLL (MAGC1_HUMAN)
SMFEGFPQSLT

SEQ ID NO: 83661 - protein, 9 aa, Artificial Sequence
  Description of Artificial Sequence: Synthetic peptide
  Seed: SSPPRYEFL (MAGC1_HUMAN)
SWPPRYEFF

SEQ ID NO: 83662 - protein, 11 aa, Artificial Sequence
  Description of Artificial Sequence: Synthetic peptide
  Seed: IPVSAASSSTL (MAGC1_HUMAN)
IPVSAASSSTF

SEQ ID NO: 83663 - protein, 10 aa, Artificial Sequence
  Description of Artificial Sequence: Synthetic peptide
  Seed: SSPESTQSPF (MAGC1_HUMAN)
SVPESTQSPM

SEQ ID NO: 83664 - protein, 10 aa, Artificial Sequence
  Description of Artificial Sequence: Synthetic peptide
  Seed: LSQSSPVSSF (MAGC1_HUMAN)
LFQSSPVSSY

SEQ ID NO: 83665 - protein, 10 aa, Artificial Sequence
  Description of Artificial Sequence: Synthetic peptide
  Seed: REVDPDDSYV (MAGC1_HUMAN)
RQVDPDDSYF

SEQ ID NO: 83666 - protein, 9 aa, Artificial Sequence
  Description of Artificial Sequence: Synthetic peptide
  Seed: FFSSALLSI (MAGC1_HUMAN)
FFSSALLSW

SEQ ID NO: 83667 - protein, 11 aa, Artificial Sequence
  Description of Artificial Sequence: Synthetic peptide
  Seed: NTVPITFPSSY (MAGC1_HUMAN)
NQVPITFPSSY

SEQ ID NO: 83668 - protein, 10 aa, Artificial Sequence
  Description of Artificial Sequence: Synthetic peptide
  Seed: PLQIPGSPSF (MAGC1_HUMAN)
PKQIPGSPSF

SEQ ID NO: 83669 - protein, 10 aa, Artificial Sequence
  Description of Artificial Sequence: Synthetic peptide
  Seed: LSQSSPVSSF (MAGC1_HUMAN)
LCQSSPVSSY

SEQ ID NO: 83670 - protein, 10 aa, Artificial Sequence
  Description of Artificial Sequence: Synthetic peptide
  Seed: FPQSPLQIPV (MAGC1_HUMAN)
FHQSPLQIPL

SEQ ID NO: 83671 - protein, 9 aa, Artificial Sequence
  Description of Artificial Sequence: Synthetic peptide
  Seed: LQNPASSFF (MAGC1_HUMAN)
LRNPASSFF

SEQ ID NO: 83672 - protein, 9 aa, Artificial Sequence
  Description of Artificial Sequence: Synthetic peptide
  Seed: FSERTQSTF (MAGC1_HUMAN)
FPERTQSTM

SEQ ID NO: 83673 - protein, 9 aa, Artificial Sequence
  Description of Artificial Sequence: Synthetic peptide
  Seed: AGREHFAFG (MAGC1_HUMAN)
AIREHFAFV

SEQ ID NO: 83674 - protein, 11 aa, Artificial Sequence
  Description of Artificial Sequence: Synthetic peptide
  Seed: TVPITFPSSYK (MAGC1_HUMAN)
TTPITFPSSYR

SEQ ID NO: 83675 - protein, 9 aa, Artificial Sequence
  Description of Artificial Sequence: Synthetic peptide
  Seed: AQSPLQRPV (MAGC1_HUMAN)
ASSPLQRPL

SEQ ID NO: 83676 - protein, 11 aa, Artificial Sequence
  Description of Artificial Sequence: Synthetic peptide
  Seed: SSSSSTLLSLF (MAGC1_HUMAN)
SSSSSTLLSLW

SEQ ID NO: 83677 - protein, 10 aa, Artificial Sequence
  Description of Artificial Sequence: Synthetic peptide
  Seed: FSSSTSLSPF (MAGC1_HUMAN)
FPSSTSLSPA

SEQ ID NO: 83678 - protein, 9 aa, Artificial Sequence
  Description of Artificial Sequence: Synthetic peptide
  Seed: FQSSLQSPV (MAGC1_HUMAN)
FISSLQSPM

SEQ ID NO: 83679 - protein, 10 aa, Artificial Sequence
  Description of Artificial Sequence: Synthetic peptide
  Seed: FFSYTLASLL (MAGC1_HUMAN)
FPSYTLASLM

SEQ ID NO: 83680 - protein, 10 aa, Artificial Sequence
  Description of Artificial Sequence: Synthetic peptide
  Seed: LAMLKNTVPI (MAGC1_HUMAN)
LFMLKNTVPM

SEQ ID NO: 83681 - protein, 10 aa, Artificial Sequence
  Description of Artificial Sequence: Synthetic peptide
  Seed: KGTYASEEVI (MAGC1_HUMAN)
KCTYASEEVF

SEQ ID NO: 83682 - protein, 10 aa, Artificial Sequence
  Description of Artificial Sequence: Synthetic peptide
  Seed: SSSSTLLSLF (MAGC1_HUMAN)
SQSSTLLSLW

SEQ ID NO: 83683 - protein, 9 aa, Artificial Sequence
  Description of Artificial Sequence: Synthetic peptide
  Seed: SSSTSLSPF (MAGC1_HUMAN)
SFSTSLSPM

SEQ ID NO: 83684 - protein, 11 aa, Artificial Sequence
  Description of Artificial Sequence: Synthetic peptide
  Seed: STFEGFAQSSL (MAGC1_HUMAN)
STFEGFAQSSV

SEQ ID NO: 83685 - protein, 9 aa, Artificial Sequence
  Description of Artificial Sequence: Synthetic peptide
  Seed: LQIPVSRSF (MAGC1_HUMAN)
LVIPVSRSW

SEQ ID NO: 83686 - protein, 9 aa, Artificial Sequence
  Description of Artificial Sequence: Synthetic peptide
  Seed: EFIEILFGI (MAGC1_HUMAN)
ETIEILFGA

SEQ ID NO: 83687 - protein, 10 aa, Artificial Sequence
  Description of Artificial Sequence: Synthetic peptide
  Seed: SPPEGPAQSP (MAGC1_HUMAN)
SPPEGPAQSL

SEQ ID NO: 83688 - protein, 10 aa, Artificial Sequence
  Description of Artificial Sequence: Synthetic peptide
  Seed: MSPLYFPQSP (MAGC1_HUMAN)
MWPLYFPQSV

SEQ ID NO: 83689 - protein, 10 aa, Artificial Sequence
  Description of Artificial Sequence: Synthetic peptide
  Seed: ICSSSTSLSL (MAGC1_HUMAN)
IKSSSTSLSW

SEQ ID NO: 83690 - protein, 10 aa, Artificial Sequence
  Description of Artificial Sequence: Synthetic peptide
  Seed: RAGREHFAFG (MAGC1_HUMAN)
RHGREHFAFV

SEQ ID NO: 83691 - protein, 9 aa, Artificial Sequence
  Description of Artificial Sequence: Synthetic peptide
  Seed: RKVVEFLAM (MAGC1_HUMAN)
RHVVEFLAY

SEQ ID NO: 83692 - protein, 9 aa, Artificial Sequence
  Description of Artificial Sequence: Synthetic peptide
  Seed: SSSFSYTLL (MAGC1_HUMAN)
SMSFSYTLW

SEQ ID NO: 83693 - protein, 9 aa, Artificial Sequence
  Description of Artificial Sequence: Synthetic peptide
  Seed: VQSPLQNPA (MAGC1_HUMAN)
VQSPLQNPM

SEQ ID NO: 83694 - protein, 11 aa, Artificial Sequence
  Description of Artificial Sequence: Synthetic peptide
  Seed: SPLQIPVSPSS (MAGC1_HUMAN)
SKLQIPVSPSF

SEQ ID NO: 83695 - protein, 11 aa, Artificial Sequence
  Description of Artificial Sequence: Synthetic peptide
  Seed: STFEGFAQSSL (MAGC1_HUMAN)
SQFEGFAQSSL

SEQ ID NO: 83696 - protein, 10 aa, Artificial Sequence
  Description of Artificial Sequence: Synthetic peptide
  Seed: YASEEVIWDV (MAGC1_HUMAN)
YVSEEVIWDL

SEQ ID NO: 83697 - protein, 9 aa, Artificial Sequence
  Description of Artificial Sequence: Synthetic peptide
  Seed: SSSESPQSC (MAGC1_HUMAN)
SASESPQSI

SEQ ID NO: 83698 - protein, 11 aa, Artificial Sequence
  Description of Artificial Sequence: Synthetic peptide
  Seed: REVPNSSPPRY (MAGC1_HUMAN)
RQVPNSSPPRW

SEQ ID NO: 83699 - protein, 9 aa, Artificial Sequence
  Description of Artificial Sequence: Synthetic peptide
  Seed: GFPQSLLQI (MAGC1_HUMAN)
GFPQSLLQY

SEQ ID NO: 83700 - protein, 9 aa, Artificial Sequence
  Description of Artificial Sequence: Synthetic peptide
  Seed: IESEPLFTY (MAGC1_HUMAN)
IASEPLFTH

SEQ ID NO: 83701 - protein, 11 aa, Artificial Sequence
  Description of Artificial Sequence: Synthetic peptide
  Seed: LQIPVSSSFSY (MAGC1_HUMAN)
LSIPVSSSFSM

SEQ ID NO: 83702 - protein, 9 aa, Artificial Sequence
  Description of Artificial Sequence: Synthetic peptide
  Seed: SSPEGKDSL (MAGC1_HUMAN)
SSPEGKDSF

SEQ ID NO: 83703 - protein, 9 aa, Artificial Sequence
  Description of Artificial Sequence: Synthetic peptide
  Seed: KAEMLTNVI (MAGC1_HUMAN)
KVEMLTNVW

SEQ ID NO: 83704 - protein, 9 aa, Artificial Sequence
  Description of Artificial Sequence: Synthetic peptide
  Seed: RLLILILSI (MAGC1_HUMAN)
RMLILILSK

SEQ ID NO: 83705 - protein, 9 aa, Artificial Sequence
  Description of Artificial Sequence: Synthetic peptide
  Seed: TPSSLPQSF (MAGC1_HUMAN)
TVSSLPQSW

SEQ ID NO: 83706 - protein, 10 aa, Artificial Sequence
  Description of Artificial Sequence: Synthetic peptide
  Seed: MTSSFSSTLL (MAGC1_HUMAN)
MLSSFSSTLT

SEQ ID NO: 83707 - protein, 9 aa, Artificial Sequence
  Description of Artificial Sequence: Synthetic peptide
  Seed: AGREHFAFG (MAGC1_HUMAN)
AWREHFAFA

SEQ ID NO: 83708 - protein, 9 aa, Artificial Sequence
  Description of Artificial Sequence: Synthetic peptide
  Seed: SAQSTFEGF (MAGC1_HUMAN)
SHQSTFEGY

SEQ ID NO: 83709 - protein, 8 aa, Artificial Sequence
  Description of Artificial Sequence: Synthetic peptide
  Seed: LTDSESLI (MAGC1_HUMAN)
LGDSESLL

SEQ ID NO: 83710 - protein, 9 aa, Artificial Sequence
  Description of Artificial Sequence: Synthetic peptide
  Seed: ESDDTLYPL (MAGC1_HUMAN)
EMDDTLYPV

SEQ ID NO: 83711 - protein, 10 aa, Artificial Sequence
  Description of Artificial Sequence: Synthetic peptide
  Seed: FPSSYKDALK (MAGC1_HUMAN)
FESSYKDALR

SEQ ID NO: 83712 - protein, 9 aa, Artificial Sequence
  Description of Artificial Sequence: Synthetic peptide
  Seed: SSSTLLSLF (MAGC1_HUMAN)
SYSTLLSLW

SEQ ID NO: 83713 - protein, 11 aa, Artificial Sequence
  Description of Artificial Sequence: Synthetic peptide
  Seed: TLDEKVDELAR (MAGC1_HUMAN)
TADEKVDELAI

SEQ ID NO: 83714 - protein, 9 aa, Artificial Sequence
  Description of Artificial Sequence: Synthetic peptide
  Seed: KAREFIEIL (MAGC1_HUMAN)
KQREFIEIF

SEQ ID NO: 83715 - protein, 11 aa, Artificial Sequence
  Description of Artificial Sequence: Synthetic peptide
  Seed: RSFSSTLLSIF (MAGC1_HUMAN)
RFFSSTLLSIW

SEQ ID NO: 83716 - protein, 9 aa, Artificial Sequence
  Description of Artificial Sequence: Synthetic peptide
  Seed: LTKVWVQEH (MAGC1_HUMAN)
LAKVWVQEY

SEQ ID NO: 83717 - protein, 9 aa, Artificial Sequence
  Description of Artificial Sequence: Synthetic peptide
  Seed: RAHSEVIKR (MAGC1_HUMAN)
RAHSEVIKI

SEQ ID NO: 83718 - protein, 9 aa, Artificial Sequence
  Description of Artificial Sequence: Synthetic peptide
  Seed: VQSPLQNPA (MAGC1_HUMAN)
VMSPLQNPL

SEQ ID NO: 83719 - protein, 9 aa, Artificial Sequence
  Description of Artificial Sequence: Synthetic peptide
  Seed: VSAASSSTL (MAGC1_HUMAN)
VTAASSSTF

SEQ ID NO: 83720 - protein, 11 aa, Artificial Sequence
  Description of Artificial Sequence: Synthetic peptide
  Seed: AASSSTLVSIF (MAGC1_HUMAN)
AASSSTLVSIW

SEQ ID NO: 83721 - protein, 9 aa, Artificial Sequence
  Description of Artificial Sequence: Synthetic peptide
  Seed: VSPSFSSTL (MAGC1_HUMAN)
VVPSFSSTM

SEQ ID NO: 83722 - protein, 9 aa, Artificial Sequence
  Description of Artificial Sequence: Synthetic peptide
  Seed: SSPESTQSP (MAGC1_HUMAN)
SVPESTQSF

SEQ ID NO: 83723 - protein, 9 aa, Artificial Sequence
  Description of Artificial Sequence: Synthetic peptide
  Seed: NVISRYTGY (MAGC1_HUMAN)
NSISRYTGK

SEQ ID NO: 83724 - protein, 10 aa, Artificial Sequence
  Description of Artificial Sequence: Synthetic peptide
  Seed: ASSFFSSALL (MAGC1_HUMAN)
ACSFFSSALF

SEQ ID NO: 83725 - protein, 9 aa, Artificial Sequence
  Description of Artificial Sequence: Synthetic peptide
  Seed: SLTDSESLI (MAGC1_HUMAN)
SLTDSESLW

SEQ ID NO: 83726 - protein, 9 aa, Artificial Sequence
  Description of Artificial Sequence: Synthetic peptide
  Seed: SLFQSFSER (MAGC1_HUMAN)
SVFQSFSEH

SEQ ID NO: 83727 - protein, 9 aa, Artificial Sequence
  Description of Artificial Sequence: Synthetic peptide
  Seed: RSFSSTLLS (MAGC1_HUMAN)
RMFSSTLLR

SEQ ID NO: 83728 - protein, 10 aa, Artificial Sequence
  Description of Artificial Sequence: Synthetic peptide
  Seed: RLLILILSII (MAGC1_HUMAN)
RALILILSIV

SEQ ID NO: 83729 - protein, 9 aa, Artificial Sequence
  Description of Artificial Sequence: Synthetic peptide
  Seed: MTSSFSSTL (MAGC1_HUMAN)
MISSFSSTF

SEQ ID NO: 83730 - protein, 9 aa, Artificial Sequence
  Description of Artificial Sequence: Synthetic peptide
  Seed: HYFPQSPPQ (MAGC1_HUMAN)
HWFPQSPPY

SEQ ID NO: 83731 - protein, 11 aa, Artificial Sequence
  Description of Artificial Sequence: Synthetic peptide
  Seed: LWGPRAHSEVI (MAGC1_HUMAN)
LKGPRAHSEVL

SEQ ID NO: 83732 - protein, 10 aa, Artificial Sequence
  Description of Artificial Sequence: Synthetic peptide
  Seed: LSIFQSSPER (MAGC1_HUMAN)
LTIFQSSPEK

SEQ ID NO: 83733 - protein, 10 aa, Artificial Sequence
  Description of Artificial Sequence: Synthetic peptide
  Seed: FAQSSLQIPV (MAGC1_HUMAN)
FNQSSLQIPI

SEQ ID NO: 83734 - protein, 10 aa, Artificial Sequence
  Description of Artificial Sequence: Synthetic peptide
  Seed: SLQIPVSPSF (MAGC1_HUMAN)
SSQIPVSPSM

SEQ ID NO: 83735 - protein, 9 aa, Artificial Sequence
  Description of Artificial Sequence: Synthetic peptide
  Seed: RPVSSFFSY (MAGC1_HUMAN)
RKVSSFFSV

SEQ ID NO: 83736 - protein, 10 aa, Artificial Sequence
  Description of Artificial Sequence: Synthetic peptide
  Seed: IIDTTDDSTA (MAGC1_HUMAN)
IIDTTDDSTM

SEQ ID NO: 83737 - protein, 9 aa, Artificial Sequence
  Description of Artificial Sequence: Synthetic peptide
  Seed: FPESSQSPP (MAGC1_HUMAN)
FPESSQSPV

SEQ ID NO: 83738 - protein, 9 aa, Artificial Sequence
  Description of Artificial Sequence: Synthetic peptide
  Seed: VSPSFSSTL (MAGC1_HUMAN)
VYPSFSSTI

SEQ ID NO: 83739 - protein, 10 aa, Artificial Sequence
  Description of Artificial Sequence: Synthetic peptide
  Seed: MPTAGMPSLL (MAGC1_HUMAN)
METAGMPSLY

SEQ ID NO: 83740 - protein, 9 aa, Artificial Sequence
  Description of Artificial Sequence: Synthetic peptide
  Seed: ISFSSSTSL (MAGC1_HUMAN)
IQFSSSTSA

SEQ ID NO: 83741 - protein, 10 aa, Artificial Sequence
  Description of Artificial Sequence: Synthetic peptide
  Seed: EMLTNVISRY (MAGC1_HUMAN)
EVLTNVISRK

SEQ ID NO: 83742 - protein, 9 aa, Artificial Sequence
  Description of Artificial Sequence: Synthetic peptide
  Seed: VSSSSSSTL (MAGC1_HUMAN)
VKSSSSSTF

SEQ ID NO: 83743 - protein, 10 aa, Artificial Sequence
  Description of Artificial Sequence: Synthetic peptide
  Seed: MPTAGMPSLL (MAGC1_HUMAN)
MPTAGMPSLY

SEQ ID NO: 83744 - protein, 9 aa, Artificial Sequence
  Description of Artificial Sequence: Synthetic peptide
  Seed: SSSTLLSLF (MAGC1_HUMAN)
SQSTLLSLI

SEQ ID NO: 83745 - protein, 9 aa, Artificial Sequence
  Description of Artificial Sequence: Synthetic peptide
  Seed: FPSSTSSSL (MAGC1_HUMAN)
FMSSTSSSW

SEQ ID NO: 83746 - protein, 11 aa, Artificial Sequence
  Description of Artificial Sequence: Synthetic peptide
  Seed: NTVPITFPSSY (MAGC1_HUMAN)
NAVPITFPSSK

SEQ ID NO: 83747 - protein, 9 aa, Artificial Sequence
  Description of Artificial Sequence: Synthetic peptide
  Seed: SSSVMSPSF (MAGC1_HUMAN)
SKSVMSPSL

SEQ ID NO: 83748 - protein, 9 aa, Artificial Sequence
  Description of Artificial Sequence: Synthetic peptide
  Seed: SLSPHYFPQ (MAGC1_HUMAN)
SLSPHYFPK

SEQ ID NO: 83749 - protein, 9 aa, Artificial Sequence
  Description of Artificial Sequence: Synthetic peptide
  Seed: FAFGEPREL (MAGC1_HUMAN)
FGFGEPREV

SEQ ID NO: 83750 - protein, 9 aa, Artificial Sequence
  Description of Artificial Sequence: Synthetic peptide
  Seed: LTKVWVQEH (MAGC1_HUMAN)
LTKVWVQEY

SEQ ID NO: 83751 - protein, 9 aa, Artificial Sequence
  Description of Artificial Sequence: Synthetic peptide
  Seed: TLDEKVDEL (MAGC1_HUMAN)
TLDEKVDEM

SEQ ID NO: 83752 - protein, 11 aa, Artificial Sequence
  Description of Artificial Sequence: Synthetic peptide
  Seed: AASSSTLVSIF (MAGC1_HUMAN)
AKSSSTLVSIY

SEQ ID NO: 83753 - protein, 10 aa, Artificial Sequence
  Description of Artificial Sequence: Synthetic peptide
  Seed: MTSSFSSTLL (MAGC1_HUMAN)
MGSSFSSTLM

SEQ ID NO: 83754 - protein, 10 aa, Artificial Sequence
  Description of Artificial Sequence: Synthetic peptide
  Seed: ILFGISLREV (MAGC1_HUMAN)
IQFGISLREV

SEQ ID NO: 83755 - protein, 9 aa, Artificial Sequence
  Description of Artificial Sequence: Synthetic peptide
  Seed: ALLSIFQSS (MAGC1_HUMAN)
AMLSIFQSM

SEQ ID NO: 83756 - protein, 10 aa, Artificial Sequence
  Description of Artificial Sequence: Synthetic peptide
  Seed: SSSSSTLLSL (MAGC1_HUMAN)
SLSSSTLLSF

SEQ ID NO: 83757 - protein, 9 aa, Artificial Sequence
  Description of Artificial Sequence: Synthetic peptide
  Seed: SPVDEYTSS (MAGC1_HUMAN)
SPVDEYTSI

SEQ ID NO: 83758 - protein, 9 aa, Artificial Sequence
  Description of Artificial Sequence: Synthetic peptide
  Seed: QIVPSLPEW (MAGC1_HUMAN)
QSVPSLPEM

SEQ ID NO: 83759 - protein, 9 aa, Artificial Sequence
  Description of Artificial Sequence: Synthetic peptide
  Seed: ASSFFSSAL (MAGC1_HUMAN)
AQSFFSSAV

SEQ ID NO: 83760 - protein, 9 aa, Artificial Sequence
  Description of Artificial Sequence: Synthetic peptide
  Seed: ESSSPVDEY (MAGC1_HUMAN)
EISSPVDER

SEQ ID NO: 83761 - protein, 10 aa, Artificial Sequence
  Description of Artificial Sequence: Synthetic peptide
  Seed: SPLQNPASSF (MAGC1_HUMAN)
SILQNPASSF

SEQ ID NO: 83762 - protein, 9 aa, Artificial Sequence
  Description of Artificial Sequence: Synthetic peptide
  Seed: SSFFSSALL (MAGC1_HUMAN)
SSFFSSALY

SEQ ID NO: 83763 - protein, 11 aa, Artificial Sequence
  Description of Artificial Sequence: Synthetic peptide
  Seed: SFFSYTLASLL (MAGC1_HUMAN)
SYFSYTLASLL

SEQ ID NO: 83764 - protein, 10 aa, Artificial Sequence
  Description of Artificial Sequence: Synthetic peptide
  Seed: TTDDSTATES (MAGC1_HUMAN)
TIDDSTATEI

SEQ ID NO: 83765 - protein, 9 aa, Artificial Sequence
  Description of Artificial Sequence: Synthetic peptide
  Seed: RPVSSFFSY (MAGC1_HUMAN)
RHVSSFFSM

SEQ ID NO: 83766 - protein, 11 aa, Artificial Sequence
  Description of Artificial Sequence: Synthetic peptide
  Seed: LQRPVSSFFSY (MAGC1_HUMAN)
LKRPVSSFFSF

SEQ ID NO: 83767 - protein, 9 aa, Artificial Sequence
  Description of Artificial Sequence: Synthetic peptide
  Seed: AASSSTLVS (MAGC1_HUMAN)
AASSSTLVY

SEQ ID NO: 83768 - protein, 9 aa, Artificial Sequence
  Description of Artificial Sequence: Synthetic peptide
  Seed: YQVKQPITK (MAGC1_HUMAN)
YSVKQPITM

SEQ ID NO: 83769 - protein, 10 aa, Artificial Sequence
  Description of Artificial Sequence: Synthetic peptide
  Seed: YTLASLLQSS (MAGC1_HUMAN)
YNLASLLQSV

SEQ ID NO: 83770 - protein, 9 aa, Artificial Sequence
  Description of Artificial Sequence: Synthetic peptide
  Seed: NPASSFFSS (MAGC1_HUMAN)
NSASSFFSM

SEQ ID NO: 83771 - protein, 10 aa, Artificial Sequence
  Description of Artificial Sequence: Synthetic peptide
  Seed: VSAASSSTLV (MAGC1_HUMAN)
VLAASSSTLL

SEQ ID NO: 83772 - protein, 9 aa, Artificial Sequence
  Description of Artificial Sequence: Synthetic peptide
  Seed: MPSLLQSSS (MAGC1_HUMAN)
MASLLQSSF

SEQ ID NO: 83773 - protein, 9 aa, Artificial Sequence
  Description of Artificial Sequence: Synthetic peptide
  Seed: AGREHFAFG (MAGC1_HUMAN)
AGREHFAFR

SEQ ID NO: 83774 - protein, 9 aa, Artificial Sequence
  Description of Artificial Sequence: Synthetic peptide
  Seed: AMLKNTVPI (MAGC1_HUMAN)
AVLKNTVPM

SEQ ID NO: 83775 - protein, 9 aa, Artificial Sequence
  Description of Artificial Sequence: Synthetic peptide
  Seed: LQIPVSSSS (MAGC1_HUMAN)
LFIPVSSSI

SEQ ID NO: 83776 - protein, 10 aa, Artificial Sequence
  Description of Artificial Sequence: Synthetic peptide
  Seed: SSPERTHSTF (MAGC1_HUMAN)
SVPERTHSTM

SEQ ID NO: 83777 - protein, 9 aa, Artificial Sequence
  Description of Artificial Sequence: Synthetic peptide
  Seed: TPSSLPQSF (MAGC1_HUMAN)
TLSSLPQSY

SEQ ID NO: 83778 - protein, 9 aa, Artificial Sequence
  Description of Artificial Sequence: Synthetic peptide
  Seed: ISRYTGYFP (MAGC1_HUMAN)
IVRYTGYFI

SEQ ID NO: 83779 - protein, 9 aa, Artificial Sequence
  Description of Artificial Sequence: Synthetic peptide
  Seed: SSFPSSTSS (MAGC1_HUMAN)
SQFPSSTSM

SEQ ID NO: 83780 - protein, 10 aa, Artificial Sequence
  Description of Artificial Sequence: Synthetic peptide
  Seed: RSFSSTLLSI (MAGC1_HUMAN)
RIFSSTLLSL

SEQ ID NO: 83781 - protein, 9 aa, Artificial Sequence
  Description of Artificial Sequence: Synthetic peptide
  Seed: VSSSSSSTL (MAGC1_HUMAN)
VRSSSSSTF

SEQ ID NO: 83782 - protein, 9 aa, Artificial Sequence
  Description of Artificial Sequence: Synthetic peptide
  Seed: SSPESAQSA (MAGC1_HUMAN)
SPPESAQSV

SEQ ID NO: 83783 - protein, 9 aa, Artificial Sequence
  Description of Artificial Sequence: Synthetic peptide
  Seed: CSSSTPSSL (MAGC1_HUMAN)
CASSTPSSM

SEQ ID NO: 83784 - protein, 9 aa, Artificial Sequence
  Description of Artificial Sequence: Synthetic peptide
  Seed: SSSFSYTLL (MAGC1_HUMAN)
SASFSYTLY

SEQ ID NO: 83785 - protein, 9 aa, Artificial Sequence
  Description of Artificial Sequence: Synthetic peptide
  Seed: LQIPVSRSF (MAGC1_HUMAN)
LAIPVSRSH

SEQ ID NO: 83786 - protein, 11 aa, Artificial Sequence
  Description of Artificial Sequence: Synthetic peptide
  Seed: IPVSRSFSSTL (MAGC1_HUMAN)
IKVSRSFSSTW

SEQ ID NO: 83787 - protein, 10 aa, Artificial Sequence
  Description of Artificial Sequence: Synthetic peptide
  Seed: SSPESAQSTF (MAGC1_HUMAN)
SAPESAQSTM

SEQ ID NO: 83788 - protein, 9 aa, Artificial Sequence
  Description of Artificial Sequence: Synthetic peptide
  Seed: LQIPVSSSS (MAGC1_HUMAN)
LAIPVSSSH

SEQ ID NO: 83789 - protein, 11 aa, Artificial Sequence
  Description of Artificial Sequence: Synthetic peptide
  Seed: SSFPSSTSSSL (MAGC1_HUMAN)
SHFPSSTSSSL

SEQ ID NO: 83790 - protein, 9 aa, Artificial Sequence
  Description of Artificial Sequence: Synthetic peptide
  Seed: EHFAFGEPR (MAGC1_HUMAN)
ESFAFGEPY

SEQ ID NO: 83791 - protein, 9 aa, Artificial Sequence
  Description of Artificial Sequence: Synthetic peptide
  Seed: SQSSPVSSF (MAGC1_HUMAN)
SSSSPVSSH

SEQ ID NO: 83792 - protein, 10 aa, Artificial Sequence
  Description of Artificial Sequence: Synthetic peptide
  Seed: LSIIFIKGTY (MAGC1_HUMAN)
LMIIFIKGTY

SEQ ID NO: 83793 - protein, 10 aa, Artificial Sequence
  Description of Artificial Sequence: Synthetic peptide
  Seed: LLQIPMTSSF (MAGC1_HUMAN)
LNQIPMTSSW

SEQ ID NO: 83794 - protein, 9 aa, Artificial Sequence
  Description of Artificial Sequence: Synthetic peptide
  Seed: LQIPVSAAS (MAGC1_HUMAN)
LVIPVSAAL

SEQ ID NO: 83795 - protein, 10 aa, Artificial Sequence
  Description of Artificial Sequence: Synthetic peptide
  Seed: SMSPLYFPQS (MAGC1_HUMAN)
SVSPLYFPQV

SEQ ID NO: 83796 - protein, 9 aa, Artificial Sequence
  Description of Artificial Sequence: Synthetic peptide
  Seed: LQNPASSFF (MAGC1_HUMAN)
LLNPASSFY

SEQ ID NO: 83797 - protein, 9 aa, Artificial Sequence
  Description of Artificial Sequence: Synthetic peptide
  Seed: SLSPFSEES (MAGC1_HUMAN)
SLSPFSEET

SEQ ID NO: 83798 - protein, 10 aa, Artificial Sequence
  Description of Artificial Sequence: Synthetic peptide
  Seed: EVIWDVLSGI (MAGC1_HUMAN)
ESIWDVLSGM

SEQ ID NO: 83799 - protein, 11 aa, Artificial Sequence
  Description of Artificial Sequence: Synthetic peptide
  Seed: SPLQNPASSFF (MAGC1_HUMAN)
SWLQNPASSFF

SEQ ID NO: 83800 - protein, 11 aa, Artificial Sequence
  Description of Artificial Sequence: Synthetic peptide
  Seed: QSSPESAQSAF (MAGC1_HUMAN)
QASPESAQSAW

SEQ ID NO: 83801 - protein, 10 aa, Artificial Sequence
  Description of Artificial Sequence: Synthetic peptide
  Seed: RAGREHFAFG (MAGC1_HUMAN)
RSGREHFAFM

SEQ ID NO: 83802 - protein, 9 aa, Artificial Sequence
  Description of Artificial Sequence: Synthetic peptide
  Seed: IPMTSSFSS (MAGC1_HUMAN)
IPMTSSFSH

SEQ ID NO: 83803 - protein, 9 aa, Artificial Sequence
  Description of Artificial Sequence: Synthetic peptide
  Seed: WVQEHYLEY (MAGC1_HUMAN)
WTQEHYLEK

SEQ ID NO: 83804 - protein, 10 aa, Artificial Sequence
  Description of Artificial Sequence: Synthetic peptide
  Seed: SLQIPVSPSF (MAGC1_HUMAN)
SEQIPVSPSF

SEQ ID NO: 83805 - protein, 9 aa, Artificial Sequence
  Description of Artificial Sequence: Synthetic peptide
  Seed: FSSTLLSLF (MAGC1_HUMAN)
FMSTLLSLF

SEQ ID NO: 83806 - protein, 9 aa, Artificial Sequence
  Description of Artificial Sequence: Synthetic peptide
  Seed: KAREFIEIL (MAGC1_HUMAN)
KVREFIEIR

SEQ ID NO: 83807 - protein, 9 aa, Artificial Sequence
  Description of Artificial Sequence: Synthetic peptide
  Seed: SSPERTHST (MAGC1_HUMAN)
SLPERTHSM

SEQ ID NO: 83808 - protein, 11 aa, Artificial Sequence
  Description of Artificial Sequence: Synthetic peptide
  Seed: SRYTGYFPVIF (MAGC1_HUMAN)
SRYTGYFPVIM

SEQ ID NO: 83809 - protein, 9 aa, Artificial Sequence
  Description of Artificial Sequence: Synthetic peptide
  Seed: TLLSILQSS (MAGC1_HUMAN)
TILSILQSM

SEQ ID NO: 83810 - protein, 11 aa, Artificial Sequence
  Description of Artificial Sequence: Synthetic peptide
  Seed: SSTSLSLPQSF (MAGC1_HUMAN)
SETSLSLPQSW

SEQ ID NO: 83811 - protein, 9 aa, Artificial Sequence
  Description of Artificial Sequence: Synthetic peptide
  Seed: YVFVNTLDL (MAGC1_HUMAN)
YQFVNTLDI

SEQ ID NO: 83812 - protein, 10 aa, Artificial Sequence
  Description of Artificial Sequence: Synthetic peptide
  Seed: KGTYASEEVI (MAGC1_HUMAN)
KQTYASEEVY

SEQ ID NO: 83813 - protein, 10 aa, Artificial Sequence
  Description of Artificial Sequence: Synthetic peptide
  Seed: SSPESTQSPF (MAGC1_HUMAN)
SPPESTQSPM

SEQ ID NO: 83814 - protein, 9 aa, Artificial Sequence
  Description of Artificial Sequence: Synthetic peptide
  Seed: TLLSLFQSF (MAGC1_HUMAN)
TMLSLFQSM

SEQ ID NO: 83815 - protein, 10 aa, Artificial Sequence
  Description of Artificial Sequence: Synthetic peptide
  Seed: YTLLSLFQSS (MAGC1_HUMAN)
YALLSLFQSV

SEQ ID NO: 83816 - protein, 9 aa, Artificial Sequence
  Description of Artificial Sequence: Synthetic peptide
  Seed: SPLEGEDSL (MAGC1_HUMAN)
SQLEGEDSI

SEQ ID NO: 83817 - protein, 9 aa, Artificial Sequence
  Description of Artificial Sequence: Synthetic peptide
  Seed: SLFQSFSER (MAGC1_HUMAN)
SIFQSFSEK

SEQ ID NO: 83818 - protein, 11 aa, Artificial Sequence
  Description of Artificial Sequence: Synthetic peptide
  Seed: TTDDSTATESA (MAGC1_HUMAN)
TGDDSTATESM

SEQ ID NO: 83819 - protein, 11 aa, Artificial Sequence
  Description of Artificial Sequence: Synthetic peptide
  Seed: SLSQSSPVSSF (MAGC1_HUMAN)
STSQSSPVSSW

SEQ ID NO: 83820 - protein, 9 aa, Artificial Sequence
  Description of Artificial Sequence: Synthetic peptide
  Seed: KRKVVEFLA (MAGC1_HUMAN)
KRKVVEFLY

SEQ ID NO: 83821 - protein, 10 aa, Artificial Sequence
  Description of Artificial Sequence: Synthetic peptide
  Seed: REFIEILFGI (MAGC1_HUMAN)
RSFIEILFGA

SEQ ID NO: 83822 - protein, 10 aa, Artificial Sequence
  Description of Artificial Sequence: Synthetic peptide
  Seed: SSSSSSSTLL (MAGC1_HUMAN)
SSSSSSSTLY

SEQ ID NO: 83823 - protein, 10 aa, Artificial Sequence
  Description of Artificial Sequence: Synthetic peptide
  Seed: RTQSTFEGFA (MAGC1_HUMAN)
RIQSTFEGFK

SEQ ID NO: 83824 - protein, 9 aa, Artificial Sequence
  Description of Artificial Sequence: Synthetic peptide
  Seed: SSPERTHST (MAGC1_HUMAN)
SNPERTHSY

SEQ ID NO: 83825 - protein, 10 aa, Artificial Sequence
  Description of Artificial Sequence: Synthetic peptide
  Seed: MLKNTVPITF (MAGC1_HUMAN)
MTKNTVPITW

SEQ ID NO: 83826 - protein, 11 aa, Artificial Sequence
  Description of Artificial Sequence: Synthetic peptide
  Seed: SPLQIPVSRSF (MAGC1_HUMAN)
SWLQIPVSRSY

SEQ ID NO: 83827 - protein, 9 aa, Artificial Sequence
  Description of Artificial Sequence: Synthetic peptide
  Seed: TPSSLPQSF (MAGC1_HUMAN)
TPSSLPQSA

SEQ ID NO: 83828 - protein, 9 aa, Artificial Sequence
  Description of Artificial Sequence: Synthetic peptide
  Seed: NTVPITFPS (MAGC1_HUMAN)
NNVPITFPR

SEQ ID NO: 83829 - protein, 10 aa, Artificial Sequence
  Description of Artificial Sequence: Synthetic peptide
  Seed: FPQSLLQIPM (MAGC1_HUMAN)
FIQSLLQIPL

SEQ ID NO: 83830 - protein, 10 aa, Artificial Sequence
  Description of Artificial Sequence: Synthetic peptide
  Seed: FFSSALLSIF (MAGC1_HUMAN)
FNSSALLSIY

SEQ ID NO: 83831 - protein, 9 aa, Artificial Sequence
  Description of Artificial Sequence: Synthetic peptide
  Seed: HFPQSPPEW (MAGC1_HUMAN)
HYPQSPPEY

SEQ ID NO: 83832 - protein, 9 aa, Artificial Sequence
  Description of Artificial Sequence: Synthetic peptide
  Seed: FSSTLLSIL (MAGC1_HUMAN)
FASTLLSIM

SEQ ID NO: 83833 - protein, 8 aa, Artificial Sequence
  Description of Artificial Sequence: Synthetic peptide
  Seed: IWDVLSGI (MAGC1_HUMAN)
IYDVLSGF

SEQ ID NO: 83834 - protein, 10 aa, Artificial Sequence
  Description of Artificial Sequence: Synthetic peptide
  Seed: RYTGYFPVIF (MAGC1_HUMAN)
RLTGYFPVIY

SEQ ID NO: 83835 - protein, 10 aa, Artificial Sequence
  Description of Artificial Sequence: Synthetic peptide
  Seed: RKVVEFLAML (MAGC1_HUMAN)
RRVVEFLAMI

SEQ ID NO: 83836 - protein, 9 aa, Artificial Sequence
  Description of Artificial Sequence: Synthetic peptide
  Seed: LQIPVSAAS (MAGC1_HUMAN)
LRIPVSAAY

SEQ ID NO: 83837 - protein, 10 aa, Artificial Sequence
  Description of Artificial Sequence: Synthetic peptide
  Seed: SPLQNPASSF (MAGC1_HUMAN)
SPLQNPASSA

SEQ ID NO: 83838 - protein, 10 aa, Artificial Sequence
  Description of Artificial Sequence: Synthetic peptide
  Seed: PLQIPVSRSF (MAGC1_HUMAN)
PRQIPVSRSM

SEQ ID NO: 83839 - protein, 11 aa, Artificial Sequence
  Description of Artificial Sequence: Synthetic peptide
  Seed: SSSSSSTLLSL (MAGC1_HUMAN)
SPSSSSTLLSM

SEQ ID NO: 83840 - protein, 10 aa, Artificial Sequence
  Description of Artificial Sequence: Synthetic peptide
  Seed: SRYTGYFPVI (MAGC1_HUMAN)
SFYTGYFPVI

SEQ ID NO: 83841 - protein, 9 aa, Artificial Sequence
  Description of Artificial Sequence: Synthetic peptide
  Seed: ASSFFSSAL (MAGC1_HUMAN)
AASFFSSAV

SEQ ID NO: 83842 - protein, 9 aa, Artificial Sequence
  Description of Artificial Sequence: Synthetic peptide
  Seed: QSPLQGEEF (MAGC1_HUMAN)
QMPLQGEEY

SEQ ID NO: 83843 - protein, 10 aa, Artificial Sequence
  Description of Artificial Sequence: Synthetic peptide
  Seed: VSSSFSYTLL (MAGC1_HUMAN)
VTSSFSYTLF

SEQ ID NO: 83844 - protein, 9 aa, Artificial Sequence
  Description of Artificial Sequence: Synthetic peptide
  Seed: TPSSLPQSF (MAGC1_HUMAN)
TASSLPQSI

SEQ ID NO: 83845 - protein, 11 aa, Artificial Sequence
  Description of Artificial Sequence: Synthetic peptide
  Seed: KRKVVEFLAML (MAGC1_HUMAN)
KMKVVEFLAMI

SEQ ID NO: 83846 - protein, 9 aa, Artificial Sequence
  Description of Artificial Sequence: Synthetic peptide
  Seed: SSFFSSALL (MAGC1_HUMAN)
SWFFSSALY

SEQ ID NO: 83847 - protein, 9 aa, Artificial Sequence
  Description of Artificial Sequence: Synthetic peptide
  Seed: SSSDTLLES (MAGC1_HUMAN)
SMSDTLLEL

SEQ ID NO: 83848 - protein, 10 aa, Artificial Sequence
  Description of Artificial Sequence: Synthetic peptide
  Seed: SPLQIPVSSS (MAGC1_HUMAN)
SPLQIPVSSM

SEQ ID NO: 83849 - protein, 9 aa, Artificial Sequence
  Description of Artificial Sequence: Synthetic peptide
  Seed: RPVSSFFSY (MAGC1_HUMAN)
RAVSSFFSL

SEQ ID NO: 83850 - protein, 10 aa, Artificial Sequence
  Description of Artificial Sequence: Synthetic peptide
  Seed: STPSSLPQSF (MAGC1_HUMAN)
SVPSSLPQSR

SEQ ID NO: 83851 - protein, 9 aa, Artificial Sequence
  Description of Artificial Sequence: Synthetic peptide
  Seed: SFSYTLLSL (MAGC1_HUMAN)
SFSYTLLSF

SEQ ID NO: 83852 - protein, 10 aa, Artificial Sequence
  Description of Artificial Sequence: Synthetic peptide
  Seed: QRPVSSFFSY (MAGC1_HUMAN)
QCPVSSFFSY

SEQ ID NO: 83853 - protein, 9 aa, Artificial Sequence
  Description of Artificial Sequence: Synthetic peptide
  Seed: SPPEGPVQS (MAGC1_HUMAN)
SPPEGPVQF

SEQ ID NO: 83854 - protein, 10 aa, Artificial Sequence
  Description of Artificial Sequence: Synthetic peptide
  Seed: FPQSPLQIPV (MAGC1_HUMAN)
FVQSPLQIPA

SEQ ID NO: 83855 - protein, 9 aa, Artificial Sequence
  Description of Artificial Sequence: Synthetic peptide
  Seed: GFPQSVLQI (MAGC1_HUMAN)
GSPQSVLQM

SEQ ID NO: 83856 - protein, 10 aa, Artificial Sequence
  Description of Artificial Sequence: Synthetic peptide
  Seed: RPVSSFFSYT (MAGC1_HUMAN)
RPVSSFFSYA

SEQ ID NO: 83857 - protein, 11 aa, Artificial Sequence
  Description of Artificial Sequence: Synthetic peptide
  Seed: LQIPVSSSFSY (MAGC1_HUMAN)
LIIPVSSSFSY

SEQ ID NO: 83858 - protein, 9 aa, Artificial Sequence
  Description of Artificial Sequence: Synthetic peptide
  Seed: ISFSSSTSL (MAGC1_HUMAN)
IIFSSSTSW

SEQ ID NO: 83859 - protein, 10 aa, Artificial Sequence
  Description of Artificial Sequence: Synthetic peptide
  Seed: LSQSSPVSSF (MAGC1_HUMAN)
LIQSSPVSSM

SEQ ID NO: 83860 - protein, 11 aa, Artificial Sequence
  Description of Artificial Sequence: Synthetic peptide
  Seed: IPMTSSFSSTL (MAGC1_HUMAN)
IRMTSSFSSTY

SEQ ID NO: 83861 - protein, 10 aa, Artificial Sequence
  Description of Artificial Sequence: Synthetic peptide
  Seed: EVIWDVLSGI (MAGC1_HUMAN)
EIIWDVLSGR

SEQ ID NO: 83862 - protein, 9 aa, Artificial Sequence
  Description of Artificial Sequence: Synthetic peptide
  Seed: FSSTLVSLF (MAGC1_HUMAN)
FQSTLVSLM

SEQ ID NO: 83863 - protein, 9 aa, Artificial Sequence
  Description of Artificial Sequence: Synthetic peptide
  Seed: YVFVNTLDL (MAGC1_HUMAN)
YQFVNTLDH

SEQ ID NO: 83864 - protein, 10 aa, Artificial Sequence
  Description of Artificial Sequence: Synthetic peptide
  Seed: KAREFIEILF (MAGC1_HUMAN)
KVREFIEILV

SEQ ID NO: 83865 - protein, 9 aa, Artificial Sequence
  Description of Artificial Sequence: Synthetic peptide
  Seed: VSPSFSSTL (MAGC1_HUMAN)
VMPSFSSTI

SEQ ID NO: 83866 - protein, 11 aa, Artificial Sequence
  Description of Artificial Sequence: Synthetic peptide
  Seed: SASSSVMSPSF (MAGC1_HUMAN)
SMSSSVMSPSF

SEQ ID NO: 83867 - protein, 9 aa, Artificial Sequence
  Description of Artificial Sequence: Synthetic peptide
  Seed: SSLSQSSPV (MAGC1_HUMAN)
SSLSQSSPY

SEQ ID NO: 83868 - protein, 10 aa, Artificial Sequence
  Description of Artificial Sequence: Synthetic peptide
  Seed: ICSSSTPSSL (MAGC1_HUMAN)
ICSSSTPSSW

SEQ ID NO: 83869 - protein, 9 aa, Artificial Sequence
  Description of Artificial Sequence: Synthetic peptide
  Seed: SFFSYTLAS (MAGC1_HUMAN)
SQFSYTLAM

SEQ ID NO: 83870 - protein, 9 aa, Artificial Sequence
  Description of Artificial Sequence: Synthetic peptide
  Seed: MTSSFSSTL (MAGC1_HUMAN)
MQSSFSSTT

SEQ ID NO: 83871 - protein, 9 aa, Artificial Sequence
  Description of Artificial Sequence: Synthetic peptide
  Seed: QIVPSLPEW (MAGC1_HUMAN)
QMVPSLPEW

SEQ ID NO: 83872 - protein, 10 aa, Artificial Sequence
  Description of Artificial Sequence: Synthetic peptide
  Seed: REFIEILFGI (MAGC1_HUMAN)
RRFIEILFGI

SEQ ID NO: 83873 - protein, 10 aa, Artificial Sequence
  Description of Artificial Sequence: Synthetic peptide
  Seed: VSICSSSTSL (MAGC1_HUMAN)
VVICSSSTSY

SEQ ID NO: 83874 - protein, 9 aa, Artificial Sequence
  Description of Artificial Sequence: Synthetic peptide
  Seed: LQIVPSLPE (MAGC1_HUMAN)
LKIVPSLPL

SEQ ID NO: 83875 - protein, 10 aa, Artificial Sequence
  Description of Artificial Sequence: Synthetic peptide
  Seed: FAQSSLQIPV (MAGC1_HUMAN)
FKQSSLQIPL

SEQ ID NO: 83876 - protein, 9 aa, Artificial Sequence
  Description of Artificial Sequence: Synthetic peptide
  Seed: FLAMLKNTV (MAGC1_HUMAN)
FTAMLKNTL

SEQ ID NO: 83877 - protein, 9 aa, Artificial Sequence
  Description of Artificial Sequence: Synthetic peptide
  Seed: RTHSTFEGF (MAGC1_HUMAN)
RVHSTFEGF

SEQ ID NO: 83878 - protein, 9 aa, Artificial Sequence
  Description of Artificial Sequence: Synthetic peptide
  Seed: SFFSYTLAS (MAGC1_HUMAN)
SFFSYTLAY

SEQ ID NO: 83879 - protein, 9 aa, Artificial Sequence
  Description of Artificial Sequence: Synthetic peptide
  Seed: FPQSLLQIP (MAGC1_HUMAN)
FPQSLLQIM

SEQ ID NO: 83880 - protein, 9 aa, Artificial Sequence
  Description of Artificial Sequence: Synthetic peptide
  Seed: AMLKNTVPI (MAGC1_HUMAN)
ALLKNTVPT

SEQ ID NO: 83881 - protein, 10 aa, Artificial Sequence
  Description of Artificial Sequence: Synthetic peptide
  Seed: SSFSSTLLSI (MAGC1_HUMAN)
SSFSSTLLSK

SEQ ID NO: 83882 - protein, 10 aa, Artificial Sequence
  Description of Artificial Sequence: Synthetic peptide
  Seed: SSPERTHSTF (MAGC1_HUMAN)
SPPERTHSTL

SEQ ID NO: 83883 - protein, 10 aa, Artificial Sequence
  Description of Artificial Sequence: Synthetic peptide
  Seed: RAGREHFAFG (MAGC1_HUMAN)
RFGREHFAFL

SEQ ID NO: 83884 - protein, 10 aa, Artificial Sequence
  Description of Artificial Sequence: Synthetic peptide
  Seed: GEDSLSSLHF (MAGC1_HUMAN)
GEDSLSSLHL

SEQ ID NO: 83885 - protein, 11 aa, Artificial Sequence
  Description of Artificial Sequence: Synthetic peptide
  Seed: EGEDSSDPLQR (MAGC1_HUMAN)
EVEDSSDPLQR

SEQ ID NO: 83886 - protein, 10 aa, Artificial Sequence
  Description of Artificial Sequence: Synthetic peptide
  Seed: FPQSLLQIPM (MAGC1_HUMAN)
FHQSLLQIPY

SEQ ID NO: 83887 - protein, 11 aa, Artificial Sequence
  Description of Artificial Sequence: Synthetic peptide
  Seed: SPLQIPMTSSF (MAGC1_HUMAN)
SGLQIPMTSSY

SEQ ID NO: 83888 - protein, 10 aa, Artificial Sequence
  Description of Artificial Sequence: Synthetic peptide
  Seed: REHFAFGEPR (MAGC1_HUMAN)
RSHFAFGEPR

SEQ ID NO: 83889 - protein, 11 aa, Artificial Sequence
  Description of Artificial Sequence: Synthetic peptide
  Seed: TTDDSTATESA (MAGC1_HUMAN)
TQDDSTATESM

SEQ ID NO: 83890 - protein, 9 aa, Artificial Sequence
  Description of Artificial Sequence: Synthetic peptide
  Seed: RPVSSFFSY (MAGC1_HUMAN)
RHVSSFFSL

SEQ ID NO: 83891 - protein, 9 aa, Artificial Sequence
  Description of Artificial Sequence: Synthetic peptide
  Seed: SEPLFTYTL (MAGC1_HUMAN)
SEPLFTYTM

SEQ ID NO: 83892 - protein, 9 aa, Artificial Sequence
  Description of Artificial Sequence: Synthetic peptide
  Seed: CSSSTSLSL (MAGC1_HUMAN)
CASSTSLSV

SEQ ID NO: 83893 - protein, 10 aa, Artificial Sequence
  Description of Artificial Sequence: Synthetic peptide
  Seed: LQIPVSSSFS (MAGC1_HUMAN)
LQIPVSSSFV

SEQ ID NO: 83894 - protein, 11 aa, Artificial Sequence
  Description of Artificial Sequence: Synthetic peptide
  Seed: QSPLQSPVSSF (MAGC1_HUMAN)
QTPLQSPVSSW

SEQ ID NO: 83895 - protein, 9 aa, Artificial Sequence
  Description of Artificial Sequence: Synthetic peptide
  Seed: FAFGEPREL (MAGC1_HUMAN)
FGFGEPREF

SEQ ID NO: 83896 - protein, 10 aa, Artificial Sequence
  Description of Artificial Sequence: Synthetic peptide
  Seed: PLQIPVSSSF (MAGC1_HUMAN)
PGQIPVSSSY

SEQ ID NO: 83897 - protein, 9 aa, Artificial Sequence
  Description of Artificial Sequence: Synthetic peptide
  Seed: YFPVIFRKA (MAGC1_HUMAN)
YWPVIFRKM

SEQ ID NO: 83898 - protein, 9 aa, Artificial Sequence
  Description of Artificial Sequence: Synthetic peptide
  Seed: SGIGVRAGR (MAGC1_HUMAN)
SIIGVRAGK

SEQ ID NO: 83899 - protein, 9 aa, Artificial Sequence
  Description of Artificial Sequence: Synthetic peptide
  Seed: MSQNRLLIL (MAGC1_HUMAN)
MFQNRLLIL

SEQ ID NO: 83900 - protein, 9 aa, Artificial Sequence
  Description of Artificial Sequence: Synthetic peptide
  Seed: LQSPVISFS (MAGC1_HUMAN)
LISPVISFL

SEQ ID NO: 83901 - protein, 9 aa, Artificial Sequence
  Description of Artificial Sequence: Synthetic peptide
  Seed: YVFVNTLDL (MAGC1_HUMAN)
YQFVNTLDA

SEQ ID NO: 83902 - protein, 10 aa, Artificial Sequence
  Description of Artificial Sequence: Synthetic peptide
  Seed: TGYFPVIFRK (MAGC1_HUMAN)
TQYFPVIFRK

SEQ ID NO: 83903 - protein, 9 aa, Artificial Sequence
  Description of Artificial Sequence: Synthetic peptide
  Seed: LKYQVKQPI (MAGC1_HUMAN)
LMYQVKQPY

SEQ ID NO: 83904 - protein, 9 aa, Artificial Sequence
  Description of Artificial Sequence: Synthetic peptide
  Seed: VSPSFSSTL (MAGC1_HUMAN)
VPPSFSSTL

SEQ ID NO: 83905 - protein, 9 aa, Artificial Sequence
  Description of Artificial Sequence: Synthetic peptide
  Seed: FFSYTLASL (MAGC1_HUMAN)
FVSYTLASL

SEQ ID NO: 83906 - protein, 9 aa, Artificial Sequence
  Description of Artificial Sequence: Synthetic peptide
  Seed: FSEESSSPV (MAGC1_HUMAN)
FQEESSSPY

SEQ ID NO: 83907 - protein, 11 aa, Artificial Sequence
  Description of Artificial Sequence: Synthetic peptide
  Seed: GPAQSPLQSPV (MAGC1_HUMAN)
GPAQSPLQSPM

SEQ ID NO: 83908 - protein, 10 aa, Artificial Sequence
  Description of Artificial Sequence: Synthetic peptide
  Seed: SFPSSTSSSL (MAGC1_HUMAN)
STPSSTSSSL

SEQ ID NO: 83909 - protein, 10 aa, Artificial Sequence
  Description of Artificial Sequence: Synthetic peptide
  Seed: MPTAGMPSLL (MAGC1_HUMAN)
MHTAGMPSLL

SEQ ID NO: 83910 - protein, 10 aa, Artificial Sequence
  Description of Artificial Sequence: Synthetic peptide
  Seed: LQNPASSFFS (MAGC1_HUMAN)
LMNPASSFFY

SEQ ID NO: 83911 - protein, 9 aa, Artificial Sequence
  Description of Artificial Sequence: Synthetic peptide
  Seed: SLLQSSHES (MAGC1_HUMAN)
SLLQSSHEA

SEQ ID NO: 83912 - protein, 10 aa, Artificial Sequence
  Description of Artificial Sequence: Synthetic peptide
  Seed: ELARFLLLKY (MAGC1_HUMAN)
EIARFLLLKK

SEQ ID NO: 83913 - protein, 9 aa, Artificial Sequence
  Description of Artificial Sequence: Synthetic peptide
  Seed: FAFGEPREL (MAGC1_HUMAN)
FHFGEPREY

SEQ ID NO: 83914 - protein, 10 aa, Artificial Sequence
  Description of Artificial Sequence: Synthetic peptide
  Seed: SSPERTHSTF (MAGC1_HUMAN)
SRPERTHSTF

SEQ ID NO: 83915 - protein, 10 aa, Artificial Sequence
  Description of Artificial Sequence: Synthetic peptide
  Seed: SSFSYTLLSL (MAGC1_HUMAN)
SYFSYTLLSF

SEQ ID NO: 83916 - protein, 9 aa, Artificial Sequence
  Description of Artificial Sequence: Synthetic peptide
  Seed: SRYTGYFPV (MAGC1_HUMAN)
SKYTGYFPL

SEQ ID NO: 83917 - protein, 9 aa, Artificial Sequence
  Description of Artificial Sequence: Synthetic peptide
  Seed: EDSSDPLQR (MAGC1_HUMAN)
ESSSDPLQR

SEQ ID NO: 83918 - protein, 9 aa, Artificial Sequence
  Description of Artificial Sequence: Synthetic peptide
  Seed: ELARFLLLK (MAGC1_HUMAN)
ENARFLLLR

SEQ ID NO: 83919 - protein, 9 aa, Artificial Sequence
  Description of Artificial Sequence: Synthetic peptide
  Seed: SSSTLVSIF (MAGC1_HUMAN)
SISTLVSIY

SEQ ID NO: 83920 - protein, 9 aa, Artificial Sequence
  Description of Artificial Sequence: Synthetic peptide
  Seed: KVDELARFL (MAGC1_HUMAN)
KLDELARFW

SEQ ID NO: 83921 - protein, 10 aa, Artificial Sequence
  Description of Artificial Sequence: Synthetic peptide
  Seed: KAREFIEILF (MAGC1_HUMAN)
KMREFIEILW

SEQ ID NO: 83922 - protein, 10 aa, Artificial Sequence
  Description of Artificial Sequence: Synthetic peptide
  Seed: SFSYTLLSLF (MAGC1_HUMAN)
STSYTLLSLW

SEQ ID NO: 83923 - protein, 9 aa, Artificial Sequence
  Description of Artificial Sequence: Synthetic peptide
  Seed: LQIPVSRSF (MAGC1_HUMAN)
LIIPVSRSF

SEQ ID NO: 83924 - protein, 10 aa, Artificial Sequence
  Description of Artificial Sequence: Synthetic peptide
  Seed: SSFSYTLLSL (MAGC1_HUMAN)
SKFSYTLLSM

SEQ ID NO: 83925 - protein, 9 aa, Artificial Sequence
  Description of Artificial Sequence: Synthetic peptide
  Seed: LQIPVSPSF (MAGC1_HUMAN)
LYIPVSPSM

SEQ ID NO: 83926 - protein, 9 aa, Artificial Sequence
  Description of Artificial Sequence: Synthetic peptide
  Seed: ASEEVIWDV (MAGC1_HUMAN)
AMEEVIWDT

SEQ ID NO: 83927 - protein, 9 aa, Artificial Sequence
  Description of Artificial Sequence: Synthetic peptide
  Seed: SICSSSTSL (MAGC1_HUMAN)
SKCSSSTSF

SEQ ID NO: 83928 - protein, 9 aa, Artificial Sequence
  Description of Artificial Sequence: Synthetic peptide
  Seed: VSPSSSSTL (MAGC1_HUMAN)
VIPSSSSTL

SEQ ID NO: 83929 - protein, 11 aa, Artificial Sequence
  Description of Artificial Sequence: Synthetic peptide
  Seed: IPVSSSFSYTL (MAGC1_HUMAN)
IEVSSSFSYTF

SEQ ID NO: 83930 - protein, 10 aa, Artificial Sequence
  Description of Artificial Sequence: Synthetic peptide
  Seed: SSSSSTLLSL (MAGC1_HUMAN)
SASSSTLLSW

SEQ ID NO: 83931 - protein, 9 aa, Artificial Sequence
  Description of Artificial Sequence: Synthetic peptide
  Seed: FQSSLQSPV (MAGC1_HUMAN)
FMSSLQSPW

SEQ ID NO: 83932 - protein, 9 aa, Artificial Sequence
  Description of Artificial Sequence: Synthetic peptide
  Seed: TLDLTSEGC (MAGC1_HUMAN)
TCDLTSEGM

SEQ ID NO: 83933 - protein, 9 aa, Artificial Sequence
  Description of Artificial Sequence: Synthetic peptide
  Seed: TLLSIFQSS (MAGC1_HUMAN)
TVLSIFQSI

SEQ ID NO: 83934 - protein, 10 aa, Artificial Sequence
  Description of Artificial Sequence: Synthetic peptide
  Seed: MLKNTVPITF (MAGC1_HUMAN)
MQKNTVPITL

SEQ ID NO: 83935 - protein, 11 aa, Artificial Sequence
  Description of Artificial Sequence: Synthetic peptide
  Seed: RPVSSFFSYTL (MAGC1_HUMAN)
RFVSSFFSYTF

SEQ ID NO: 83936 - protein, 9 aa, Artificial Sequence
  Description of Artificial Sequence: Synthetic peptide
  Seed: SAASSSTLV (MAGC1_HUMAN)
SVASSSTLL

SEQ ID NO: 83937 - protein, 10 aa, Artificial Sequence
  Description of Artificial Sequence: Synthetic peptide
  Seed: YTLASLLQSS (MAGC1_HUMAN)
YVLASLLQSI

SEQ ID NO: 83938 - protein, 10 aa, Artificial Sequence
  Description of Artificial Sequence: Synthetic peptide
  Seed: SQNRLLILIL (MAGC1_HUMAN)
SRNRLLILII

SEQ ID NO: 83939 - protein, 9 aa, Artificial Sequence
  Description of Artificial Sequence: Synthetic peptide
  Seed: QSPLQGEEF (MAGC1_HUMAN)
QAPLQGEEY

SEQ ID NO: 83940 - protein, 9 aa, Artificial Sequence
  Description of Artificial Sequence: Synthetic peptide
  Seed: SSSTLLSLF (MAGC1_HUMAN)
SWSTLLSLI

SEQ ID NO: 83941 - protein, 10 aa, Artificial Sequence
  Description of Artificial Sequence: Synthetic peptide
  Seed: PLQIPMTSSF (MAGC1_HUMAN)
PYQIPMTSSF

SEQ ID NO: 83942 - protein, 9 aa, Artificial Sequence
  Description of Artificial Sequence: Synthetic peptide
  Seed: SSSSSSSTL (MAGC1_HUMAN)
SNSSSSSTF

SEQ ID NO: 83943 - protein, 9 aa, Artificial Sequence
  Description of Artificial Sequence: Synthetic peptide
  Seed: LQIPMTSSF (MAGC1_HUMAN)
LLIPMTSSL

SEQ ID NO: 83944 - protein, 9 aa, Artificial Sequence
  Description of Artificial Sequence: Synthetic peptide
  Seed: LQIPVSRSF (MAGC1_HUMAN)
LGIPVSRSW

SEQ ID NO: 83945 - protein, 9 aa, Artificial Sequence
  Description of Artificial Sequence: Synthetic peptide
  Seed: SLSPFSEES (MAGC1_HUMAN)
SQSPFSEEM

SEQ ID NO: 83946 - protein, 10 aa, Artificial Sequence
  Description of Artificial Sequence: Synthetic peptide
  Seed: AASSSTLVSI (MAGC1_HUMAN)
AISSSTLVSW

SEQ ID NO: 83947 - protein, 11 aa, Artificial Sequence
  Description of Artificial Sequence: Synthetic peptide
  Seed: SICSSSTSLSL (MAGC1_HUMAN)
STCSSSTSLSW

SEQ ID NO: 83948 - protein, 9 aa, Artificial Sequence
  Description of Artificial Sequence: Synthetic peptide
  Seed: AGREHFAFG (MAGC1_HUMAN)
AAREHFAFM

SEQ ID NO: 83949 - protein, 9 aa, Artificial Sequence
  Description of Artificial Sequence: Synthetic peptide
  Seed: RSFSSTLLS (MAGC1_HUMAN)
RTFSSTLLV

SEQ ID NO: 83950 - protein, 11 aa, Artificial Sequence
  Description of Artificial Sequence: Synthetic peptide
  Seed: IIDTTDDSTAT (MAGC1_HUMAN)
ICDTTDDSTAF

SEQ ID NO: 83951 - protein, 11 aa, Artificial Sequence
  Description of Artificial Sequence: Synthetic peptide
  Seed: SSFSYTLLSLF (MAGC1_HUMAN)
SNFSYTLLSLW

SEQ ID NO: 83952 - protein, 9 aa, Artificial Sequence
  Description of Artificial Sequence: Synthetic peptide
  Seed: SQNRLLILI (MAGC1_HUMAN)
SSNRLLILL

SEQ ID NO: 83953 - protein, 9 aa, Artificial Sequence
  Description of Artificial Sequence: Synthetic peptide
  Seed: FFSSALLSI (MAGC1_HUMAN)
FTSSALLSI

SEQ ID NO: 83954 - protein, 9 aa, Artificial Sequence
  Description of Artificial Sequence: Synthetic peptide
  Seed: SSTSSSLSK (MAGC1_HUMAN)
SSTSSSLSR

SEQ ID NO: 83955 - protein, 9 aa, Artificial Sequence
  Description of Artificial Sequence: Synthetic peptide
  Seed: SPLQIVPSL (MAGC1_HUMAN)
SHLQIVPSF

SEQ ID NO: 83956 - protein, 9 aa, Artificial Sequence
  Description of Artificial Sequence: Synthetic peptide
  Seed: NVISRYTGY (MAGC1_HUMAN)
NMISRYTGY

SEQ ID NO: 83957 - protein, 9 aa, Artificial Sequence
  Description of Artificial Sequence: Synthetic peptide
  Seed: YTGYFPVIF (MAGC1_HUMAN)
YPGYFPVIY

SEQ ID NO: 83958 - protein, 9 aa, Artificial Sequence
  Description of Artificial Sequence: Synthetic peptide
  Seed: SICSSSTSL (MAGC1_HUMAN)
SPCSSSTSM

SEQ ID NO: 83959 - protein, 9 aa, Artificial Sequence
  Description of Artificial Sequence: Synthetic peptide
  Seed: KVWVQEHYL (MAGC1_HUMAN)
KNWVQEHYW

SEQ ID NO: 83960 - protein, 9 aa, Artificial Sequence
  Description of Artificial Sequence: Synthetic peptide
  Seed: SSFFSSALL (MAGC1_HUMAN)
SLFFSSALM

SEQ ID NO: 83961 - protein, 8 aa, Artificial Sequence
  Description of Artificial Sequence: Synthetic peptide
  Seed: SRSFSSTL (MAGC1_HUMAN)
SPSFSSTM

SEQ ID NO: 83962 - protein, 9 aa, Artificial Sequence
  Description of Artificial Sequence: Synthetic peptide
  Seed: SRYTGYFPV (MAGC1_HUMAN)
SLYTGYFPM

SEQ ID NO: 83963 - protein, 11 aa, Artificial Sequence
  Description of Artificial Sequence: Synthetic peptide
  Seed: TTDDSTATESA (MAGC1_HUMAN)
TVDDSTATESF

SEQ ID NO: 83964 - protein, 9 aa, Artificial Sequence
  Description of Artificial Sequence: Synthetic peptide
  Seed: ASSFFSSAL (MAGC1_HUMAN)
AMSFFSSAH

SEQ ID NO: 83965 - protein, 10 aa, Artificial Sequence
  Description of Artificial Sequence: Synthetic peptide
  Seed: MLTNVISRYT (MAGC1_HUMAN)
MITNVISRYL

SEQ ID NO: 83966 - protein, 9 aa, Artificial Sequence
  Description of Artificial Sequence: Synthetic peptide
  Seed: IESEPLFTY (MAGC1_HUMAN)
IMSEPLFTM

SEQ ID NO: 83967 - protein, 9 aa, Artificial Sequence
  Description of Artificial Sequence: Synthetic peptide
  Seed: MTSSFSSTL (MAGC1_HUMAN)
MQSSFSSTM

SEQ ID NO: 83968 - protein, 9 aa, Artificial Sequence
  Description of Artificial Sequence: Synthetic peptide
  Seed: IESEPLFTY (MAGC1_HUMAN)
IMSEPLFTY

SEQ ID NO: 83969 - protein, 10 aa, Artificial Sequence
  Description of Artificial Sequence: Synthetic peptide
  Seed: FFSYTLASLL (MAGC1_HUMAN)
FTSYTLASLF

SEQ ID NO: 83970 - protein, 9 aa, Artificial Sequence
  Description of Artificial Sequence: Synthetic peptide
  Seed: RLLILILSI (MAGC1_HUMAN)
RVLILILSF

SEQ ID NO: 83971 - protein, 10 aa, Artificial Sequence
  Description of Artificial Sequence: Synthetic peptide
  Seed: ICSSSTSLSL (MAGC1_HUMAN)
IDSSSTSLSW

SEQ ID NO: 83972 - protein, 11 aa, Artificial Sequence
  Description of Artificial Sequence: Synthetic peptide
  Seed: SFFSYTLASLL (MAGC1_HUMAN)
SGFSYTLASLF

SEQ ID NO: 83973 - protein, 9 aa, Artificial Sequence
  Description of Artificial Sequence: Synthetic peptide
  Seed: ALLSIFQSS (MAGC1_HUMAN)
AMLSIFQSV

SEQ ID NO: 83974 - protein, 10 aa, Artificial Sequence
  Description of Artificial Sequence: Synthetic peptide
  Seed: KAREFIEILF (MAGC1_HUMAN)
KSREFIEILV

SEQ ID NO: 83975 - protein, 9 aa, Artificial Sequence
  Description of Artificial Sequence: Synthetic peptide
  Seed: TFEGFPQSL (MAGC1_HUMAN)
TQEGFPQSY

SEQ ID NO: 83976 - protein, 9 aa, Artificial Sequence
  Description of Artificial Sequence: Synthetic peptide
  Seed: CSSSTSLSL (MAGC1_HUMAN)
CQSSTSLSF

SEQ ID NO: 83977 - protein, 11 aa, Artificial Sequence
  Description of Artificial Sequence: Synthetic peptide
  Seed: QSFSERTQSTF (MAGC1_HUMAN)
QAFSERTQSTW

SEQ ID NO: 83978 - protein, 10 aa, Artificial Sequence
  Description of Artificial Sequence: Synthetic peptide
  Seed: FFSYTLASLL (MAGC1_HUMAN)
FFSYTLASLW

SEQ ID NO: 83979 - protein, 9 aa, Artificial Sequence
  Description of Artificial Sequence: Synthetic peptide
  Seed: LQRPVSSFF (MAGC1_HUMAN)
LQRPVSSFK

SEQ ID NO: 83980 - protein, 9 aa, Artificial Sequence
  Description of Artificial Sequence: Synthetic peptide
  Seed: SSSTLVSIF (MAGC1_HUMAN)
SSSTLVSIM

SEQ ID NO: 83981 - protein, 10 aa, Artificial Sequence
  Description of Artificial Sequence: Synthetic peptide
  Seed: QIPVSSSFSY (MAGC1_HUMAN)
QVPVSSSFSF

SEQ ID NO: 83982 - protein, 9 aa, Artificial Sequence
  Description of Artificial Sequence: Synthetic peptide
  Seed: RTHSTFEGF (MAGC1_HUMAN)
RLHSTFEGM

SEQ ID NO: 83983 - protein, 10 aa, Artificial Sequence
  Description of Artificial Sequence: Synthetic peptide
  Seed: LAMLKNTVPI (MAGC1_HUMAN)
LIMLKNTVPI

SEQ ID NO: 83984 - protein, 9 aa, Artificial Sequence
  Description of Artificial Sequence: Synthetic peptide
  Seed: ELARFLLLK (MAGC1_HUMAN)
EGARFLLLK

SEQ ID NO: 83985 - protein, 9 aa, Artificial Sequence
  Description of Artificial Sequence: Synthetic peptide
  Seed: VSSFFSYTL (MAGC1_HUMAN)
VHSFFSYTF

SEQ ID NO: 83986 - protein, 10 aa, Artificial Sequence
  Description of Artificial Sequence: Synthetic peptide
  Seed: PLQIPMTSSF (MAGC1_HUMAN)
PRQIPMTSSM

SEQ ID NO: 83987 - protein, 10 aa, Artificial Sequence
  Description of Artificial Sequence: Synthetic peptide
  Seed: ISRYTGYFPV (MAGC1_HUMAN)
IVRYTGYFPK

SEQ ID NO: 83988 - protein, 11 aa, Artificial Sequence
  Description of Artificial Sequence: Synthetic peptide
  Seed: RKAREFIEILF (MAGC1_HUMAN)
RRAREFIEILM

SEQ ID NO: 83989 - protein, 10 aa, Artificial Sequence
  Description of Artificial Sequence: Synthetic peptide
  Seed: FPQSPLQIPV (MAGC1_HUMAN)
FPQSPLQIPP

SEQ ID NO: 83990 - protein, 9 aa, Artificial Sequence
  Description of Artificial Sequence: Synthetic peptide
  Seed: TTDDSTATE (MAGC1_HUMAN)
TIDDSTATF

SEQ ID NO: 83991 - protein, 10 aa, Artificial Sequence
  Description of Artificial Sequence: Synthetic peptide
  Seed: AASSSTLVSI (MAGC1_HUMAN)
AASSSTLVSY

SEQ ID NO: 83992 - protein, 11 aa, Artificial Sequence
  Description of Artificial Sequence: Synthetic peptide
  Seed: SASSSVMSPSF (MAGC1_HUMAN)
SKSSSVMSPSF

SEQ ID NO: 83993 - protein, 9 aa, Artificial Sequence
  Description of Artificial Sequence: Synthetic peptide
  Seed: LQNPASSFF (MAGC1_HUMAN)
LSNPASSFY

SEQ ID NO: 83994 - protein, 9 aa, Artificial Sequence
  Description of Artificial Sequence: Synthetic peptide
  Seed: IPMTSSFSS (MAGC1_HUMAN)
IPMTSSFSP

SEQ ID NO: 83995 - protein, 9 aa, Artificial Sequence
  Description of Artificial Sequence: Synthetic peptide
  Seed: SSFFSSALL (MAGC1_HUMAN)
SHFFSSALL

SEQ ID NO: 83996 - protein, 9 aa, Artificial Sequence
  Description of Artificial Sequence: Synthetic peptide
  Seed: MTSSFSSTL (MAGC1_HUMAN)
MSSSFSSTK

SEQ ID NO: 83997 - protein, 11 aa, Artificial Sequence
  Description of Artificial Sequence: Synthetic peptide
  Seed: VSSSSSSSTLL (MAGC1_HUMAN)
VVSSSSSSTLW

SEQ ID NO: 83998 - protein, 10 aa, Artificial Sequence
  Description of Artificial Sequence: Synthetic peptide
  Seed: STPSSLPQSF (MAGC1_HUMAN)
SYPSSLPQSY

SEQ ID NO: 83999 - protein, 9 aa, Artificial Sequence
  Description of Artificial Sequence: Synthetic peptide
  Seed: FSSTLLSIL (MAGC1_HUMAN)
FQSTLLSIY

SEQ ID NO: 84000 - protein, 9 aa, Artificial Sequence
  Description of Artificial Sequence: Synthetic peptide
  Seed: MLTNVISRY (MAGC1_HUMAN)
MTTNVISRI

SEQ ID NO: 84001 - protein, 9 aa, Artificial Sequence
  Description of Artificial Sequence: Synthetic peptide
  Seed: AQSPLQRPV (MAGC1_HUMAN)
AESPLQRPY

SEQ ID NO: 84002 - protein, 9 aa, Artificial Sequence
  Description of Artificial Sequence: Synthetic peptide
  Seed: KAREFIEIL (MAGC1_HUMAN)
KVREFIEII

SEQ ID NO: 84003 - protein, 11 aa, Artificial Sequence
  Description of Artificial Sequence: Synthetic peptide
  Seed: IPVSAASSSTL (MAGC1_HUMAN)
IWVSAASSSTW

SEQ ID NO: 84004 - protein, 10 aa, Artificial Sequence
  Description of Artificial Sequence: Synthetic peptide
  Seed: VSSSFSYTLL (MAGC1_HUMAN)
VDSSFSYTLF

SEQ ID NO: 84005 - protein, 11 aa, Artificial Sequence
  Description of Artificial Sequence: Synthetic peptide
  Seed: TTDDSTATESA (MAGC1_HUMAN)
TLDDSTATESF

SEQ ID NO: 84006 - protein, 10 aa, Artificial Sequence
  Description of Artificial Sequence: Synthetic peptide
  Seed: ILILSIIFIK (MAGC1_HUMAN)
IAILSIIFIK

SEQ ID NO: 84007 - protein, 10 aa, Artificial Sequence
  Description of Artificial Sequence: Synthetic peptide
  Seed: FFSSALLSIF (MAGC1_HUMAN)
FPSSALLSIY

SEQ ID NO: 84008 - protein, 10 aa, Artificial Sequence
  Description of Artificial Sequence: Synthetic peptide
  Seed: SSFPSSTSSS (MAGC1_HUMAN)
SIFPSSTSSM

SEQ ID NO: 84009 - protein, 10 aa, Artificial Sequence
  Description of Artificial Sequence: Synthetic peptide
  Seed: ESAQSAFEGF (MAGC1_HUMAN)
ETAQSAFEGR

SEQ ID NO: 84010 - protein, 9 aa, Artificial Sequence
  Description of Artificial Sequence: Synthetic peptide
  Seed: LQIPGSPSF (MAGC1_HUMAN)
LPIPGSPSL

SEQ ID NO: 84011 - protein, 8 aa, Artificial Sequence
  Description of Artificial Sequence: Synthetic peptide
  Seed: LLSLFQSF (MAGC1_HUMAN)
LQSLFQSF

SEQ ID NO: 84012 - protein, 9 aa, Artificial Sequence
  Description of Artificial Sequence: Synthetic peptide
  Seed: VSSSSSSTL (MAGC1_HUMAN)
VMSSSSSTY

SEQ ID NO: 84013 - protein, 10 aa, Artificial Sequence
  Description of Artificial Sequence: Synthetic peptide
  Seed: SSSSSTLLSL (MAGC1_HUMAN)
SMSSSTLLSL

SEQ ID NO: 84014 - protein, 9 aa, Artificial Sequence
  Description of Artificial Sequence: Synthetic peptide
  Seed: VSSFFSYTL (MAGC1_HUMAN)
VSSFFSYTY

SEQ ID NO: 84015 - protein, 9 aa, Artificial Sequence
  Description of Artificial Sequence: Synthetic peptide
  Seed: TFEGFPQSL (MAGC1_HUMAN)
TEEGFPQSF

SEQ ID NO: 84016 - protein, 10 aa, Artificial Sequence
  Description of Artificial Sequence: Synthetic peptide
  Seed: FPSSYKDALK (MAGC1_HUMAN)
FASSYKDALR

SEQ ID NO: 84017 - protein, 9 aa, Artificial Sequence
  Description of Artificial Sequence: Synthetic peptide
  Seed: FSSTLLSLF (MAGC1_HUMAN)
FMSTLLSLY

SEQ ID NO: 84018 - protein, 9 aa, Artificial Sequence
  Description of Artificial Sequence: Synthetic peptide
  Seed: WEDSLSPLH (MAGC1_HUMAN)
WEDSLSPLF

SEQ ID NO: 84019 - protein, 9 aa, Artificial Sequence
  Description of Artificial Sequence: Synthetic peptide
  Seed: FSERTQSTF (MAGC1_HUMAN)
FLERTQSTF

SEQ ID NO: 84020 - protein, 9 aa, Artificial Sequence
  Description of Artificial Sequence: Synthetic peptide
  Seed: TTDDSTATE (MAGC1_HUMAN)
TVDDSTATV

SEQ ID NO: 84021 - protein, 11 aa, Artificial Sequence
  Description of Artificial Sequence: Synthetic peptide
  Seed: TTDDSTATESA (MAGC1_HUMAN)
TGDDSTATESI

SEQ ID NO: 84022 - protein, 10 aa, Artificial Sequence
  Description of Artificial Sequence: Synthetic peptide
  Seed: ICSSSTSLSL (MAGC1_HUMAN)
IDSSSTSLSM

SEQ ID NO: 84023 - protein, 10 aa, Artificial Sequence
  Description of Artificial Sequence: Synthetic peptide
  Seed: SLIESEPLFT (MAGC1_HUMAN)
SIIESEPLFL

SEQ ID NO: 84024 - protein, 9 aa, Artificial Sequence
  Description of Artificial Sequence: Synthetic peptide
  Seed: AQSPLQSPV (MAGC1_HUMAN)
ARSPLQSPY

SEQ ID NO: 84025 - protein, 9 aa, Artificial Sequence
  Description of Artificial Sequence: Synthetic peptide
  Seed: IFRKAREFI (MAGC1_HUMAN)
IGRKAREFK

SEQ ID NO: 84026 - protein, 9 aa, Artificial Sequence
  Description of Artificial Sequence: Synthetic peptide
  Seed: SPPEGMHSQ (MAGC1_HUMAN)
SPPEGMHSA

SEQ ID NO: 84027 - protein, 9 aa, Artificial Sequence
  Description of Artificial Sequence: Synthetic peptide
  Seed: SSSTLVSIF (MAGC1_HUMAN)
SYSTLVSIM

SEQ ID NO: 84028 - protein, 10 aa, Artificial Sequence
  Description of Artificial Sequence: Synthetic peptide
  Seed: MLKNTVPITF (MAGC1_HUMAN)
MQKNTVPITF

SEQ ID NO: 84029 - protein, 11 aa, Artificial Sequence
  Description of Artificial Sequence: Synthetic peptide
  Seed: STFEGFPQSLL (MAGC1_HUMAN)
SMFEGFPQSLS

SEQ ID NO: 84030 - protein, 10 aa, Artificial Sequence
  Description of Artificial Sequence: Synthetic peptide
  Seed: FPQSLLQIPM (MAGC1_HUMAN)
FYQSLLQIPF

SEQ ID NO: 84031 - protein, 9 aa, Artificial Sequence
  Description of Artificial Sequence: Synthetic peptide
  Seed: SKSSPESPL (MAGC1_HUMAN)
SSSSPESPF

SEQ ID NO: 84032 - protein, 10 aa, Artificial Sequence
  Description of Artificial Sequence: Synthetic peptide
  Seed: SRYTGYFPVI (MAGC1_HUMAN)
SYYTGYFPVM

SEQ ID NO: 84033 - protein, 9 aa, Artificial Sequence
  Description of Artificial Sequence: Synthetic peptide
  Seed: ISFSSSTSL (MAGC1_HUMAN)
ISFSSSTSH

SEQ ID NO: 84034 - protein, 10 aa, Artificial Sequence
  Description of Artificial Sequence: Synthetic peptide
  Seed: RYTGYFPVIF (MAGC1_HUMAN)
RYTGYFPVIL

SEQ ID NO: 84035 - protein, 9 aa, Artificial Sequence
  Description of Artificial Sequence: Synthetic peptide
  Seed: SSHESPQSP (MAGC1_HUMAN)
SQHESPQSL

SEQ ID NO: 84036 - protein, 10 aa, Artificial Sequence
  Description of Artificial Sequence: Synthetic peptide
  Seed: DVLSGIGVRA (MAGC1_HUMAN)
DLLSGIGVRR

SEQ ID NO: 84037 - protein, 9 aa, Artificial Sequence
  Description of Artificial Sequence: Synthetic peptide
  Seed: AQSPLQSPV (MAGC1_HUMAN)
AESPLQSPC

SEQ ID NO: 84038 - protein, 10 aa, Artificial Sequence
  Description of Artificial Sequence: Synthetic peptide
  Seed: VSSSSSSSTL (MAGC1_HUMAN)
VLSSSSSSTW

SEQ ID NO: 84039 - protein, 9 aa, Artificial Sequence
  Description of Artificial Sequence: Synthetic peptide
  Seed: SSHESPQSP (MAGC1_HUMAN)
SLHESPQSL

SEQ ID NO: 84040 - protein, 10 aa, Artificial Sequence
  Description of Artificial Sequence: Synthetic peptide
  Seed: SSSSSTLLSL (MAGC1_HUMAN)
SNSSSTLLSF

SEQ ID NO: 84041 - protein, 10 aa, Artificial Sequence
  Description of Artificial Sequence: Synthetic peptide
  Seed: ISRYTGYFPV (MAGC1_HUMAN)
ILRYTGYFPL

SEQ ID NO: 84042 - protein, 11 aa, Artificial Sequence
  Description of Artificial Sequence: Synthetic peptide
  Seed: SSFSYTLLSLF (MAGC1_HUMAN)
SEFSYTLLSLW

SEQ ID NO: 84043 - protein, 10 aa, Artificial Sequence
  Description of Artificial Sequence: Synthetic peptide
  Seed: SSFSSTLLSI (MAGC1_HUMAN)
SSFSSTLLSM

SEQ ID NO: 84044 - protein, 9 aa, Artificial Sequence
  Description of Artificial Sequence: Synthetic peptide
  Seed: KQPITKAEM (MAGC1_HUMAN)
KLPITKAEL

SEQ ID NO: 84045 - protein, 9 aa, Artificial Sequence
  Description of Artificial Sequence: Synthetic peptide
  Seed: TLLSLFQSF (MAGC1_HUMAN)
TALSLFQSW

SEQ ID NO: 84046 - protein, 9 aa, Artificial Sequence
  Description of Artificial Sequence: Synthetic peptide
  Seed: IPVSSSFSY (MAGC1_HUMAN)
IQVSSSFSM

SEQ ID NO: 84047 - protein, 9 aa, Artificial Sequence
  Description of Artificial Sequence: Synthetic peptide
  Seed: LQIVPSLPE (MAGC1_HUMAN)
LNIVPSLPF

SEQ ID NO: 84048 - protein, 9 aa, Artificial Sequence
  Description of Artificial Sequence: Synthetic peptide
  Seed: NVISRYTGY (MAGC1_HUMAN)
NAISRYTGK

SEQ ID NO: 84049 - protein, 9 aa, Artificial Sequence
  Description of Artificial Sequence: Synthetic peptide
  Seed: KDSQSPLQI (MAGC1_HUMAN)
KISQSPLQI

SEQ ID NO: 84050 - protein, 9 aa, Artificial Sequence
  Description of Artificial Sequence: Synthetic peptide
  Seed: SICSSSTSL (MAGC1_HUMAN)
SMCSSSTSL

SEQ ID NO: 84051 - protein, 11 aa, Artificial Sequence
  Description of Artificial Sequence: Synthetic peptide
  Seed: IPVSRSFSSTL (MAGC1_HUMAN)
IGVSRSFSSTY

SEQ ID NO: 84052 - protein, 9 aa, Artificial Sequence
  Description of Artificial Sequence: Synthetic peptide
  Seed: SSSVMSPSF (MAGC1_HUMAN)
SLSVMSPSY

SEQ ID NO: 84053 - protein, 10 aa, Artificial Sequence
  Description of Artificial Sequence: Synthetic peptide
  Seed: MPTAGMPSLL (MAGC1_HUMAN)
MWTAGMPSLL

SEQ ID NO: 84054 - protein, 9 aa, Artificial Sequence
  Description of Artificial Sequence: Synthetic peptide
  Seed: RTQSTFEGF (MAGC1_HUMAN)
RIQSTFEGK

SEQ ID NO: 84055 - protein, 11 aa, Artificial Sequence
  Description of Artificial Sequence: Synthetic peptide
  Seed: IPVSSSFSYTL (MAGC1_HUMAN)
IRVSSSFSYTW

SEQ ID NO: 84056 - protein, 9 aa, Artificial Sequence
  Description of Artificial Sequence: Synthetic peptide
  Seed: SSPESTQSP (MAGC1_HUMAN)
SQPESTQSM

SEQ ID NO: 84057 - protein, 10 aa, Artificial Sequence
  Description of Artificial Sequence: Synthetic peptide
  Seed: SFSSTLLSIF (MAGC1_HUMAN)
SMSSTLLSIF

SEQ ID NO: 84058 - protein, 9 aa, Artificial Sequence
  Description of Artificial Sequence: Synthetic peptide
  Seed: TLDEKVDEL (MAGC1_HUMAN)
TCDEKVDEV

SEQ ID NO: 84059 - protein, 9 aa, Artificial Sequence
  Description of Artificial Sequence: Synthetic peptide
  Seed: RSFSSTLLS (MAGC1_HUMAN)
RIFSSTLLK

SEQ ID NO: 84060 - protein, 10 aa, Artificial Sequence
  Description of Artificial Sequence: Synthetic peptide
  Seed: QIPVSSSFSY (MAGC1_HUMAN)
QYPVSSSFSF

SEQ ID NO: 84061 - protein, 9 aa, Artificial Sequence
  Description of Artificial Sequence: Synthetic peptide
  Seed: RTQSTFEGF (MAGC1_HUMAN)
RLQSTFEGK

SEQ ID NO: 84062 - protein, 9 aa, Artificial Sequence
  Description of Artificial Sequence: Synthetic peptide
  Seed: RTQSTFEGF (MAGC1_HUMAN)
RYQSTFEGM

SEQ ID NO: 84063 - protein, 10 aa, Artificial Sequence
  Description of Artificial Sequence: Synthetic peptide
  Seed: SPLYFPQSPL (MAGC1_HUMAN)
SELYFPQSPV

SEQ ID NO: 84064 - protein, 9 aa, Artificial Sequence
  Description of Artificial Sequence: Synthetic peptide
  Seed: STQSPFEGF (MAGC1_HUMAN)
SIQSPFEGF

SEQ ID NO: 84065 - protein, 9 aa, Artificial Sequence
  Description of Artificial Sequence: Synthetic peptide
  Seed: SSSTLVSIF (MAGC1_HUMAN)
SKSTLVSIF

SEQ ID NO: 84066 - protein, 9 aa, Artificial Sequence
  Description of Artificial Sequence: Synthetic peptide
  Seed: YPLQSPQSR (MAGC1_HUMAN)
YPLQSPQSP

SEQ ID NO: 84067 - protein, 9 aa, Artificial Sequence
  Description of Artificial Sequence: Synthetic peptide
  Seed: GFPQSPLQI (MAGC1_HUMAN)
GAPQSPLQI

SEQ ID NO: 84068 - protein, 9 aa, Artificial Sequence
  Description of Artificial Sequence: Synthetic peptide
  Seed: LQIPVSSSS (MAGC1_HUMAN)
LIIPVSSSV

SEQ ID NO: 84069 - protein, 9 aa, Artificial Sequence
  Description of Artificial Sequence: Synthetic peptide
  Seed: LQIPVSPSF (MAGC1_HUMAN)
LQIPVSPSY

SEQ ID NO: 84070 - protein, 9 aa, Artificial Sequence
  Description of Artificial Sequence: Synthetic peptide
  Seed: YVFVNTLDL (MAGC1_HUMAN)
YNFVNTLDY

SEQ ID NO: 84071 - protein, 9 aa, Artificial Sequence
  Description of Artificial Sequence: Synthetic peptide
  Seed: SEEVIWDVL (MAGC1_HUMAN)
SEEVIWDVV

SEQ ID NO: 84072 - protein, 10 aa, Artificial Sequence
  Description of Artificial Sequence: Synthetic peptide
  Seed: ICSSSTPSSL (MAGC1_HUMAN)
IVSSSTPSSW

SEQ ID NO: 84073 - protein, 10 aa, Artificial Sequence
  Description of Artificial Sequence: Synthetic peptide
  Seed: SSPESTQSPF (MAGC1_HUMAN)
SFPESTQSPM

SEQ ID NO: 84074 - protein, 10 aa, Artificial Sequence
  Description of Artificial Sequence: Synthetic peptide
  Seed: YTLASLLQSS (MAGC1_HUMAN)
YLLASLLQSA

SEQ ID NO: 84075 - protein, 9 aa, Artificial Sequence
  Description of Artificial Sequence: Synthetic peptide
  Seed: SSSTLLSLF (MAGC1_HUMAN)
SVSTLLSLF

SEQ ID NO: 84076 - protein, 9 aa, Artificial Sequence
  Description of Artificial Sequence: Synthetic peptide
  Seed: SPVISFSSS (MAGC1_HUMAN)
SPVISFSSV

SEQ ID NO: 84077 - protein, 9 aa, Artificial Sequence
  Description of Artificial Sequence: Synthetic peptide
  Seed: SSPEGKDSL (MAGC1_HUMAN)
STPEGKDSL

SEQ ID NO: 84078 - protein, 9 aa, Artificial Sequence
  Description of Artificial Sequence: Synthetic peptide
  Seed: VSRSFSSTL (MAGC1_HUMAN)
VSRSFSSTV

SEQ ID NO: 84079 - protein, 9 aa, Artificial Sequence
  Description of Artificial Sequence: Synthetic peptide
  Seed: VPITFPSSY (MAGC1_HUMAN)
VVITFPSSL

SEQ ID NO: 84080 - protein, 9 aa, Artificial Sequence
  Description of Artificial Sequence: Synthetic peptide
  Seed: CTQSTFEGF (MAGC1_HUMAN)
CMQSTFEGY

SEQ ID NO: 84081 - protein, 9 aa, Artificial Sequence
  Description of Artificial Sequence: Synthetic peptide
  Seed: LSDEQGMSQ (MAGC1_HUMAN)
LYDEQGMSV

SEQ ID NO: 84082 - protein, 9 aa, Artificial Sequence
  Description of Artificial Sequence: Synthetic peptide
  Seed: SSFPSSTSS (MAGC1_HUMAN)
SMFPSSTSL

SEQ ID NO: 84083 - protein, 11 aa, Artificial Sequence
  Description of Artificial Sequence: Synthetic peptide
  Seed: LQIPVSSSFSY (MAGC1_HUMAN)
LKIPVSSSFSF

SEQ ID NO: 84084 - protein, 10 aa, Artificial Sequence
  Description of Artificial Sequence: Synthetic peptide
  Seed: PLQIPVSSSF (MAGC1_HUMAN)
PQQIPVSSSF

SEQ ID NO: 84085 - protein, 9 aa, Artificial Sequence
  Description of Artificial Sequence: Synthetic peptide
  Seed: SPLQIPQSS (MAGC1_HUMAN)
SHLQIPQSA

SEQ ID NO: 84086 - protein, 11 aa, Artificial Sequence
  Description of Artificial Sequence: Synthetic peptide
  Seed: TVPITFPSSYK (MAGC1_HUMAN)
TDPITFPSSYR

SEQ ID NO: 84087 - protein, 10 aa, Artificial Sequence
  Description of Artificial Sequence: Synthetic peptide
  Seed: LLQIPMTSSF (MAGC1_HUMAN)
LTQIPMTSSW

SEQ ID NO: 84088 - protein, 9 aa, Artificial Sequence
  Description of Artificial Sequence: Synthetic peptide
  Seed: VSSSSSSTL (MAGC1_HUMAN)
VQSSSSSTY

SEQ ID NO: 84089 - protein, 9 aa, Artificial Sequence
  Description of Artificial Sequence: Synthetic peptide
  Seed: SQSPPEGPV (MAGC1_HUMAN)
SSSPPEGPM

SEQ ID NO: 84090 - protein, 10 aa, Artificial Sequence
  Description of Artificial Sequence: Synthetic peptide
  Seed: RKAREFIEIL (MAGC1_HUMAN)
RRAREFIEIV

SEQ ID NO: 84091 - protein, 9 aa, Artificial Sequence
  Description of Artificial Sequence: Synthetic peptide
  Seed: RKVVEFLAM (MAGC1_HUMAN)
RQVVEFLAW

SEQ ID NO: 84092 - protein, 9 aa, Artificial Sequence
  Description of Artificial Sequence: Synthetic peptide
  Seed: SAQSTFEGF (MAGC1_HUMAN)
SMQSTFEGW

SEQ ID NO: 84093 - protein, 10 aa, Artificial Sequence
  Description of Artificial Sequence: Synthetic peptide
  Seed: KRKVVEFLAM (MAGC1_HUMAN)
KFKVVEFLAY

SEQ ID NO: 84094 - protein, 9 aa, Artificial Sequence
  Description of Artificial Sequence: Synthetic peptide
  Seed: TLDEKVDEL (MAGC1_HUMAN)
TTDEKVDEY

SEQ ID NO: 84095 - protein, 10 aa, Artificial Sequence
  Description of Artificial Sequence: Synthetic peptide
  Seed: RAGREHFAFG (MAGC1_HUMAN)
RLGREHFAFV

SEQ ID NO: 84096 - protein, 9 aa, Artificial Sequence
  Description of Artificial Sequence: Synthetic peptide
  Seed: RPVSSFFSY (MAGC1_HUMAN)
RMVSSFFSA

SEQ ID NO: 84097 - protein, 9 aa, Artificial Sequence
  Description of Artificial Sequence: Synthetic peptide
  Seed: GFPQSVLQI (MAGC1_HUMAN)
GAPQSVLQM

SEQ ID NO: 84098 - protein, 9 aa, Artificial Sequence
  Description of Artificial Sequence: Synthetic peptide
  Seed: VPITFPSSY (MAGC1_HUMAN)
VMITFPSSY

SEQ ID NO: 84099 - protein, 10 aa, Artificial Sequence
  Description of Artificial Sequence: Synthetic peptide
  Seed: SLSPLHFPQF (MAGC1_HUMAN)
SLSPLHFPQV

SEQ ID NO: 84100 - protein, 9 aa, Artificial Sequence
  Description of Artificial Sequence: Synthetic peptide
  Seed: SQSSPVSSF (MAGC1_HUMAN)
SGSSPVSSY

SEQ ID NO: 84101 - protein, 9 aa, Artificial Sequence
  Description of Artificial Sequence: Synthetic peptide
  Seed: SFSSTLVSL (MAGC1_HUMAN)
SYSSTLVSM

SEQ ID NO: 84102 - protein, 9 aa, Artificial Sequence
  Description of Artificial Sequence: Synthetic peptide
  Seed: SSSFSYTLL (MAGC1_HUMAN)
SASFSYTLL

SEQ ID NO: 84103 - protein, 11 aa, Artificial Sequence
  Description of Artificial Sequence: Synthetic peptide
  Seed: SPFEGFPQSVL (MAGC1_HUMAN)
SAFEGFPQSVL

SEQ ID NO: 84104 - protein, 9 aa, Artificial Sequence
  Description of Artificial Sequence: Synthetic peptide
  Seed: CSSSTSLSL (MAGC1_HUMAN)
CHSSTSLSM

SEQ ID NO: 84105 - protein, 8 aa, Artificial Sequence
  Description of Artificial Sequence: Synthetic peptide
  Seed: KVDELARF (MAGC1_HUMAN)
KTDELARI

SEQ ID NO: 84106 - protein, 9 aa, Artificial Sequence
  Description of Artificial Sequence: Synthetic peptide
  Seed: FSSTLLSIL (MAGC1_HUMAN)
FVSTLLSIL

SEQ ID NO: 84107 - protein, 10 aa, Artificial Sequence
  Description of Artificial Sequence: Synthetic peptide
  Seed: KRKVVEFLAM (MAGC1_HUMAN)
KVKVVEFLAY

SEQ ID NO: 84108 - protein, 9 aa, Artificial Sequence
  Description of Artificial Sequence: Synthetic peptide
  Seed: YTGYFPVIF (MAGC1_HUMAN)
YFGYFPVIW

SEQ ID NO: 84109 - protein, 11 aa, Artificial Sequence
  Description of Artificial Sequence: Synthetic peptide
  Seed: SPLQIPGSPSF (MAGC1_HUMAN)
SYLQIPGSPSM

SEQ ID NO: 84110 - protein, 9 aa, Artificial Sequence
  Description of Artificial Sequence: Synthetic peptide
  Seed: SQSPPEGPV (MAGC1_HUMAN)
SMSPPEGPV

SEQ ID NO: 84111 - protein, 9 aa, Artificial Sequence
  Description of Artificial Sequence: Synthetic peptide
  Seed: KVDELARFL (MAGC1_HUMAN)
KQDELARFV

SEQ ID NO: 84112 - protein, 10 aa, Artificial Sequence
  Description of Artificial Sequence: Synthetic peptide
  Seed: SSPESAQSAF (MAGC1_HUMAN)
SQPESAQSAY

SEQ ID NO: 84113 - protein, 9 aa, Artificial Sequence
  Description of Artificial Sequence: Synthetic peptide
  Seed: SLTDSESLI (MAGC1_HUMAN)
SMTDSESLF

SEQ ID NO: 84114 - protein, 11 aa, Artificial Sequence
  Description of Artificial Sequence: Synthetic peptide
  Seed: IPVSPSFSSTL (MAGC1_HUMAN)
IPVSPSFSSTW

SEQ ID NO: 84115 - protein, 9 aa, Artificial Sequence
  Description of Artificial Sequence: Synthetic peptide
  Seed: FSYTLASLL (MAGC1_HUMAN)
FIYTLASLV

SEQ ID NO: 84116 - protein, 9 aa, Artificial Sequence
  Description of Artificial Sequence: Synthetic peptide
  Seed: FSSTLVSLF (MAGC1_HUMAN)
FSSTLVSLY

SEQ ID NO: 84117 - protein, 10 aa, Artificial Sequence
  Description of Artificial Sequence: Synthetic peptide
  Seed: RSFSSTLLSI (MAGC1_HUMAN)
RMFSSTLLSL

SEQ ID NO: 84118 - protein, 9 aa, Artificial Sequence
  Description of Artificial Sequence: Synthetic peptide
  Seed: LPQSFPESS (MAGC1_HUMAN)
LPQSFPEST

SEQ ID NO: 84119 - protein, 9 aa, Artificial Sequence
  Description of Artificial Sequence: Synthetic peptide
  Seed: SAQSAFEGF (MAGC1_HUMAN)
SYQSAFEGY

SEQ ID NO: 84120 - protein, 11 aa, Artificial Sequence
  Description of Artificial Sequence: Synthetic peptide
  Seed: SEVIKRKVVEF (MAGC1_HUMAN)
SEVIKRKVVEW

SEQ ID NO: 84121 - protein, 10 aa, Artificial Sequence
  Description of Artificial Sequence: Synthetic peptide
  Seed: ASSSVMSPSF (MAGC1_HUMAN)
AWSSVMSPSW

SEQ ID NO: 84122 - protein, 10 aa, Artificial Sequence
  Description of Artificial Sequence: Synthetic peptide
  Seed: LSQSSPVSSF (MAGC1_HUMAN)
LFQSSPVSSM

SEQ ID NO: 84123 - protein, 9 aa, Artificial Sequence
  Description of Artificial Sequence: Synthetic peptide
  Seed: VQSPLHSPQ (MAGC1_HUMAN)
VRSPLHSPF

SEQ ID NO: 84124 - protein, 9 aa, Artificial Sequence
  Description of Artificial Sequence: Synthetic peptide
  Seed: FFSYTLASL (MAGC1_HUMAN)
FTSYTLASI

SEQ ID NO: 84125 - protein, 10 aa, Artificial Sequence
  Description of Artificial Sequence: Synthetic peptide
  Seed: IWDVLSGIGV (MAGC1_HUMAN)
IYDVLSGIGM

SEQ ID NO: 84126 - protein, 10 aa, Artificial Sequence
  Description of Artificial Sequence: Synthetic peptide
  Seed: SSSSTLLSLF (MAGC1_HUMAN)
SESSTLLSLF

SEQ ID NO: 84127 - protein, 9 aa, Artificial Sequence
  Description of Artificial Sequence: Synthetic peptide
  Seed: VSSFFSYTL (MAGC1_HUMAN)
VFSFFSYTY

SEQ ID NO: 84128 - protein, 10 aa, Artificial Sequence
  Description of Artificial Sequence: Synthetic peptide
  Seed: TTDDSTATES (MAGC1_HUMAN)
TVDDSTATEL

SEQ ID NO: 84129 - protein, 11 aa, Artificial Sequence
  Description of Artificial Sequence: Synthetic peptide
  Seed: SLSQSSPVSSF (MAGC1_HUMAN)
SFSQSSPVSSF

SEQ ID NO: 84130 - protein, 9 aa, Artificial Sequence
  Description of Artificial Sequence: Synthetic peptide
  Seed: NTHSPLQIV (MAGC1_HUMAN)
NRHSPLQIL

SEQ ID NO: 84131 - protein, 10 aa, Artificial Sequence
  Description of Artificial Sequence: Synthetic peptide
  Seed: AASSSTLVSI (MAGC1_HUMAN)
ATSSSTLVSW

SEQ ID NO: 84132 - protein, 9 aa, Artificial Sequence
  Description of Artificial Sequence: Synthetic peptide
  Seed: TSLSLPQSF (MAGC1_HUMAN)
TQLSLPQSL

SEQ ID NO: 84133 - protein, 11 aa, Artificial Sequence
  Description of Artificial Sequence: Synthetic peptide
  Seed: VSSSSSSSTLL (MAGC1_HUMAN)
VPSSSSSSTLF

SEQ ID NO: 84134 - protein, 9 aa, Artificial Sequence
  Description of Artificial Sequence: Synthetic peptide
  Seed: AFGEPRELL (MAGC1_HUMAN)
ATGEPRELM

SEQ ID NO: 84135 - protein, 9 aa, Artificial Sequence
  Description of Artificial Sequence: Synthetic peptide
  Seed: SFSERTQST (MAGC1_HUMAN)
SYSERTQSY

SEQ ID NO: 84136 - protein, 9 aa, Artificial Sequence
  Description of Artificial Sequence: Synthetic peptide
  Seed: LQIPVSRSF (MAGC1_HUMAN)
LMIPVSRSV

SEQ ID NO: 84137 - protein, 9 aa, Artificial Sequence
  Description of Artificial Sequence: Synthetic peptide
  Seed: REHFAFGEP (MAGC1_HUMAN)
REHFAFGEA

SEQ ID NO: 84138 - protein, 11 aa, Artificial Sequence
  Description of Artificial Sequence: Synthetic peptide
  Seed: IPVSSSSSSTL (MAGC1_HUMAN)
IFVSSSSSSTF

SEQ ID NO: 84139 - protein, 9 aa, Artificial Sequence
  Description of Artificial Sequence: Synthetic peptide
  Seed: SSPERTQST (MAGC1_HUMAN)
SLPERTQSL

SEQ ID NO: 84140 - protein, 9 aa, Artificial Sequence
  Description of Artificial Sequence: Synthetic peptide
  Seed: LQNPASSFF (MAGC1_HUMAN)
LENPASSFL

SEQ ID NO: 84141 - protein, 10 aa, Artificial Sequence
  Description of Artificial Sequence: Synthetic peptide
  Seed: EVIWDVLSGI (MAGC1_HUMAN)
EAIWDVLSGM

SEQ ID NO: 84142 - protein, 9 aa, Artificial Sequence
  Description of Artificial Sequence: Synthetic peptide
  Seed: KDVEERAQA (MAGC1_HUMAN)
KEVEERAQF

SEQ ID NO: 84143 - protein, 9 aa, Artificial Sequence
  Description of Artificial Sequence: Synthetic peptide
  Seed: VSRSFSSTL (MAGC1_HUMAN)
VKRSFSSTM

SEQ ID NO: 84144 - protein, 9 aa, Artificial Sequence
  Description of Artificial Sequence: Synthetic peptide
  Seed: FSSTLLSIL (MAGC1_HUMAN)
FMSTLLSIF

SEQ ID NO: 84145 - protein, 10 aa, Artificial Sequence
  Description of Artificial Sequence: Synthetic peptide
  Seed: SSPESTQSPF (MAGC1_HUMAN)
SWPESTQSPM

SEQ ID NO: 84146 - protein, 9 aa, Artificial Sequence
  Description of Artificial Sequence: Synthetic peptide
  Seed: RSFSSTLLS (MAGC1_HUMAN)
RTFSSTLLG

SEQ ID NO: 84147 - protein, 10 aa, Artificial Sequence
  Description of Artificial Sequence: Synthetic peptide
  Seed: MTSSFSSTLL (MAGC1_HUMAN)
MSSSFSSTLF

SEQ ID NO: 84148 - protein, 9 aa, Artificial Sequence
  Description of Artificial Sequence: Synthetic peptide
  Seed: ALLSIFQSS (MAGC1_HUMAN)
ALLSIFQSA

SEQ ID NO: 84149 - protein, 9 aa, Artificial Sequence
  Description of Artificial Sequence: Synthetic peptide
  Seed: SPPEGPAQS (MAGC1_HUMAN)
SPPEGPAQM

SEQ ID NO: 84150 - protein, 9 aa, Artificial Sequence
  Description of Artificial Sequence: Synthetic peptide
  Seed: EDSSDPLQR (MAGC1_HUMAN)
EVSSDPLQK

SEQ ID NO: 84151 - protein, 10 aa, Artificial Sequence
  Description of Artificial Sequence: Synthetic peptide
  Seed: DVLSGIGVRA (MAGC1_HUMAN)
DVLSGIGVRR

SEQ ID NO: 84152 - protein, 9 aa, Artificial Sequence
  Description of Artificial Sequence: Synthetic peptide
  Seed: IIDTTDDST (MAGC1_HUMAN)
IADTTDDSM

SEQ ID NO: 84153 - protein, 10 aa, Artificial Sequence
  Description of Artificial Sequence: Synthetic peptide
  Seed: LSGIGVRAGR (MAGC1_HUMAN)
LTGIGVRAGR

SEQ ID NO: 84154 - protein, 9 aa, Artificial Sequence
  Description of Artificial Sequence: Synthetic peptide
  Seed: YVFVNTLDL (MAGC1_HUMAN)
YLFVNTLDY

SEQ ID NO: 84155 - protein, 9 aa, Artificial Sequence
  Description of Artificial Sequence: Synthetic peptide
  Seed: MTSSFSSTL (MAGC1_HUMAN)
MMSSFSSTC

SEQ ID NO: 84156 - protein, 9 aa, Artificial Sequence
  Description of Artificial Sequence: Synthetic peptide
  Seed: VSAASSSTL (MAGC1_HUMAN)
VMAASSSTF

SEQ ID NO: 84157 - protein, 9 aa, Artificial Sequence
  Description of Artificial Sequence: Synthetic peptide
  Seed: ASSFFSSAL (MAGC1_HUMAN)
AQSFFSSAF

SEQ ID NO: 84158 - protein, 9 aa, Artificial Sequence
  Description of Artificial Sequence: Synthetic peptide
  Seed: ISRYTGYFP (MAGC1_HUMAN)
IARYTGYFK

SEQ ID NO: 84159 - protein, 10 aa, Artificial Sequence
  Description of Artificial Sequence: Synthetic peptide
  Seed: VSSSFSYTLL (MAGC1_HUMAN)
VFSSFSYTLW

SEQ ID NO: 84160 - protein, 9 aa, Artificial Sequence
  Description of Artificial Sequence: Synthetic peptide
  Seed: SAQSTFEGF (MAGC1_HUMAN)
SVQSTFEGF

SEQ ID NO: 84161 - protein, 9 aa, Artificial Sequence
  Description of Artificial Sequence: Synthetic peptide
  Seed: VISRYTGYF (MAGC1_HUMAN)
VMSRYTGYY

SEQ ID NO: 84162 - protein, 11 aa, Artificial Sequence
  Description of Artificial Sequence: Synthetic peptide
  Seed: TLDEKVDELAR (MAGC1_HUMAN)
TIDEKVDELAM

SEQ ID NO: 84163 - protein, 10 aa, Artificial Sequence
  Description of Artificial Sequence: Synthetic peptide
  Seed: SLQIPVSPSF (MAGC1_HUMAN)
SEQIPVSPSM

SEQ ID NO: 84164 - protein, 9 aa, Artificial Sequence
  Description of Artificial Sequence: Synthetic peptide
  Seed: RTHSTFEGF (MAGC1_HUMAN)
RVHSTFEGW

SEQ ID NO: 84165 - protein, 9 aa, Artificial Sequence
  Description of Artificial Sequence: Synthetic peptide
  Seed: FFSSALLSI (MAGC1_HUMAN)
FASSALLSV

SEQ ID NO: 84166 - protein, 9 aa, Artificial Sequence
  Description of Artificial Sequence: Synthetic peptide
  Seed: LQIPMTSSF (MAGC1_HUMAN)
LYIPMTSSH

SEQ ID NO: 84167 - protein, 10 aa, Artificial Sequence
  Description of Artificial Sequence: Synthetic peptide
  Seed: RYTGYFPVIF (MAGC1_HUMAN)
RMTGYFPVIM

SEQ ID NO: 84168 - protein, 11 aa, Artificial Sequence
  Description of Artificial Sequence: Synthetic peptide
  Seed: REVDPDDSYVF (MAGC1_HUMAN)
RSVDPDDSYVF

SEQ ID NO: 84169 - protein, 10 aa, Artificial Sequence
  Description of Artificial Sequence: Synthetic peptide
  Seed: RSFSSTLLSI (MAGC1_HUMAN)
RMFSSTLLSM

SEQ ID NO: 84170 - protein, 11 aa, Artificial Sequence
  Description of Artificial Sequence: Synthetic peptide
  Seed: SSFFSYTLASL (MAGC1_HUMAN)
STFFSYTLASY

SEQ ID NO: 84171 - protein, 10 aa, Artificial Sequence
  Description of Artificial Sequence: Synthetic peptide
  Seed: MTSSFSSTLL (MAGC1_HUMAN)
MASSFSSTLM

SEQ ID NO: 84172 - protein, 9 aa, Artificial Sequence
  Description of Artificial Sequence: Synthetic peptide
  Seed: SFFSYTLAS (MAGC1_HUMAN)
STFSYTLAL

SEQ ID NO: 84173 - protein, 10 aa, Artificial Sequence
  Description of Artificial Sequence: Synthetic peptide
  Seed: MLTNVISRYT (MAGC1_HUMAN)
MMTNVISRYI

SEQ ID NO: 84174 - protein, 9 aa, Artificial Sequence
  Description of Artificial Sequence: Synthetic peptide
  Seed: LQIVPSLPE (MAGC1_HUMAN)
LLIVPSLPM

SEQ ID NO: 84175 - protein, 9 aa, Artificial Sequence
  Description of Artificial Sequence: Synthetic peptide
  Seed: FFSSALLSI (MAGC1_HUMAN)
FASSALLSY

SEQ ID NO: 84176 - protein, 9 aa, Artificial Sequence
  Description of Artificial Sequence: Synthetic peptide
  Seed: KVDELARFL (MAGC1_HUMAN)
KADELARFV

SEQ ID NO: 84177 - protein, 8 aa, Artificial Sequence
  Description of Artificial Sequence: Synthetic peptide
  Seed: KVDELARF (MAGC1_HUMAN)
KSDELARI

SEQ ID NO: 84178 - protein, 11 aa, Artificial Sequence
  Description of Artificial Sequence: Synthetic peptide
  Seed: SSTPSSLPQSF (MAGC1_HUMAN)
STTPSSLPQSF

SEQ ID NO: 84179 - protein, 9 aa, Artificial Sequence
  Description of Artificial Sequence: Synthetic peptide
  Seed: ASSFFSSAL (MAGC1_HUMAN)
AASFFSSAL

SEQ ID NO: 84180 - protein, 9 aa, Artificial Sequence
  Description of Artificial Sequence: Synthetic peptide
  Seed: SESPQSCPE (MAGC1_HUMAN)
SESPQSCPV

SEQ ID NO: 84181 - protein, 10 aa, Artificial Sequence
  Description of Artificial Sequence: Synthetic peptide
  Seed: FQSSLQSPVS (MAGC1_HUMAN)
FMSSLQSPVG

SEQ ID NO: 84182 - protein, 9 aa, Artificial Sequence
  Description of Artificial Sequence: Synthetic peptide
  Seed: KAREFIEIL (MAGC1_HUMAN)
KVREFIEIF

SEQ ID NO: 84183 - protein, 10 aa, Artificial Sequence
  Description of Artificial Sequence: Synthetic peptide
  Seed: NTVPITFPSS (MAGC1_HUMAN)
NTVPITFPST

SEQ ID NO: 84184 - protein, 9 aa, Artificial Sequence
  Description of Artificial Sequence: Synthetic peptide
  Seed: KVDELARFL (MAGC1_HUMAN)
KADELARFY

SEQ ID NO: 84185 - protein, 9 aa, Artificial Sequence
  Description of Artificial Sequence: Synthetic peptide
  Seed: REVDPDDSY (MAGC1_HUMAN)
RIVDPDDSL

SEQ ID NO: 84186 - protein, 10 aa, Artificial Sequence
  Description of Artificial Sequence: Synthetic peptide
  Seed: RPVSSFFSYT (MAGC1_HUMAN)
RFVSSFFSYK

SEQ ID NO: 84187 - protein, 10 aa, Artificial Sequence
  Description of Artificial Sequence: Synthetic peptide
  Seed: KAREFIEILF (MAGC1_HUMAN)
KAREFIEILV

SEQ ID NO: 84188 - protein, 9 aa, Artificial Sequence
  Description of Artificial Sequence: Synthetic peptide
  Seed: YVFVNTLDL (MAGC1_HUMAN)
YAFVNTLDL

SEQ ID NO: 84189 - protein, 9 aa, Artificial Sequence
  Description of Artificial Sequence: Synthetic peptide
  Seed: FPQSVLQIP (MAGC1_HUMAN)
FPQSVLQIL

SEQ ID NO: 84190 - protein, 10 aa, Artificial Sequence
  Description of Artificial Sequence: Synthetic peptide
  Seed: AEMLTNVISR (MAGC1_HUMAN)
AIMLTNVISK

SEQ ID NO: 84191 - protein, 9 aa, Artificial Sequence
  Description of Artificial Sequence: Synthetic peptide
  Seed: SAASSSTLV (MAGC1_HUMAN)
SAASSSTLF

SEQ ID NO: 84192 - protein, 9 aa, Artificial Sequence
  Description of Artificial Sequence: Synthetic peptide
  Seed: FFSYTLASL (MAGC1_HUMAN)
FTSYTLASF

SEQ ID NO: 84193 - protein, 11 aa, Artificial Sequence
  Description of Artificial Sequence: Synthetic peptide
  Seed: ISRYTGYFPVI (MAGC1_HUMAN)
IHRYTGYFPVF

SEQ ID NO: 84194 - protein, 9 aa, Artificial Sequence
  Description of Artificial Sequence: Synthetic peptide
  Seed: TLDEKVDEL (MAGC1_HUMAN)
TIDEKVDEA

SEQ ID NO: 84195 - protein, 9 aa, Artificial Sequence
  Description of Artificial Sequence: Synthetic peptide
  Seed: FFSYTLASL (MAGC1_HUMAN)
FGSYTLASV

SEQ ID NO: 84196 - protein, 9 aa, Artificial Sequence
  Description of Artificial Sequence: Synthetic peptide
  Seed: LQIPVSRSF (MAGC1_HUMAN)
LAIPVSRSY

SEQ ID NO: 84197 - protein, 9 aa, Artificial Sequence
  Description of Artificial Sequence: Synthetic peptide
  Seed: FSSALLSIF (MAGC1_HUMAN)
FFSALLSIL

SEQ ID NO: 84198 - protein, 11 aa, Artificial Sequence
  Description of Artificial Sequence: Synthetic peptide
  Seed: REVDPDDSYVF (MAGC1_HUMAN)
RMVDPDDSYVW

SEQ ID NO: 84199 - protein, 10 aa, Artificial Sequence
  Description of Artificial Sequence: Synthetic peptide
  Seed: FLAMLKNTVP (MAGC1_HUMAN)
FLAMLKNTVN

SEQ ID NO: 84200 - protein, 10 aa, Artificial Sequence
  Description of Artificial Sequence: Synthetic peptide
  Seed: RSFSSTLLSI (MAGC1_HUMAN)
RQFSSTLLSY

SEQ ID NO: 84201 - protein, 9 aa, Artificial Sequence
  Description of Artificial Sequence: Synthetic peptide
  Seed: KAREFIEIL (MAGC1_HUMAN)
KLREFIEIY

SEQ ID NO: 84202 - protein, 9 aa, Artificial Sequence
  Description of Artificial Sequence: Synthetic peptide
  Seed: KVVEFLAML (MAGC1_HUMAN)
KLVEFLAMV

SEQ ID NO: 84203 - protein, 10 aa, Artificial Sequence
  Description of Artificial Sequence: Synthetic peptide
  Seed: MLKNTVPITF (MAGC1_HUMAN)
MGKNTVPITF

SEQ ID NO: 84204 - protein, 10 aa, Artificial Sequence
  Description of Artificial Sequence: Synthetic peptide
  Seed: PLQIPVSSSF (MAGC1_HUMAN)
PRQIPVSSSF

SEQ ID NO: 84205 - protein, 11 aa, Artificial Sequence
  Description of Artificial Sequence: Synthetic peptide
  Seed: REVDPDDSYVF (MAGC1_HUMAN)
REVDPDDSYVY

SEQ ID NO: 84206 - protein, 9 aa, Artificial Sequence
  Description of Artificial Sequence: Synthetic peptide
  Seed: GSPSFSSTL (MAGC1_HUMAN)
GTPSFSSTM

SEQ ID NO: 84207 - protein, 9 aa, Artificial Sequence
  Description of Artificial Sequence: Synthetic peptide
  Seed: SLPQSFPES (MAGC1_HUMAN)
SVPQSFPEL

SEQ ID NO: 84208 - protein, 10 aa, Artificial Sequence
  Description of Artificial Sequence: Synthetic peptide
  Seed: RKVVEFLAML (MAGC1_HUMAN)
RNVVEFLAML

SEQ ID NO: 84209 - protein, 9 aa, Artificial Sequence
  Description of Artificial Sequence: Synthetic peptide
  Seed: SSSDTLLES (MAGC1_HUMAN)
SLSDTLLEM

SEQ ID NO: 84210 - protein, 10 aa, Artificial Sequence
  Description of Artificial Sequence: Synthetic peptide
  Seed: SLQIPVSPSF (MAGC1_HUMAN)
SYQIPVSPSY

SEQ ID NO: 84211 - protein, 10 aa, Artificial Sequence
  Description of Artificial Sequence: Synthetic peptide
  Seed: LSLFQSFSER (MAGC1_HUMAN)
LMLFQSFSEK

SEQ ID NO: 84212 - protein, 10 aa, Artificial Sequence
  Description of Artificial Sequence: Synthetic peptide
  Seed: MSQNRLLILI (MAGC1_HUMAN)
MVQNRLLILV

SEQ ID NO: 84213 - protein, 11 aa, Artificial Sequence
  Description of Artificial Sequence: Synthetic peptide
  Seed: SSFSSTLLSIF (MAGC1_HUMAN)
SVFSSTLLSIF

SEQ ID NO: 84214 - protein, 9 aa, Artificial Sequence
  Description of Artificial Sequence: Synthetic peptide
  Seed: SQSSPVSSF (MAGC1_HUMAN)
SVSSPVSSW

SEQ ID NO: 84215 - protein, 10 aa, Artificial Sequence
  Description of Artificial Sequence: Synthetic peptide
  Seed: SLFQSFSERT (MAGC1_HUMAN)
SVFQSFSERR

SEQ ID NO: 84216 - protein, 9 aa, Artificial Sequence
  Description of Artificial Sequence: Synthetic peptide
  Seed: MLTNVISRY (MAGC1_HUMAN)
MLTNVISRR

SEQ ID NO: 84217 - protein, 9 aa, Artificial Sequence
  Description of Artificial Sequence: Synthetic peptide
  Seed: VVEFLAMLK (MAGC1_HUMAN)
VLEFLAMLK

SEQ ID NO: 84218 - protein, 9 aa, Artificial Sequence
  Description of Artificial Sequence: Synthetic peptide
  Seed: FQSSPERTH (MAGC1_HUMAN)
FASSPERTL

SEQ ID NO: 84219 - protein, 9 aa, Artificial Sequence
  Description of Artificial Sequence: Synthetic peptide
  Seed: SAASSSTLV (MAGC1_HUMAN)
SIASSSTLY

SEQ ID NO: 84220 - protein, 9 aa, Artificial Sequence
  Description of Artificial Sequence: Synthetic peptide
  Seed: FSEESSSPV (MAGC1_HUMAN)
FLEESSSPL

SEQ ID NO: 84221 - protein, 9 aa, Artificial Sequence
  Description of Artificial Sequence: Synthetic peptide
  Seed: RPVSSFFSY (MAGC1_HUMAN)
RPVSSFFSF

SEQ ID NO: 84222 - protein, 10 aa, Artificial Sequence
  Description of Artificial Sequence: Synthetic peptide
  Seed: YTGYFPVIFR (MAGC1_HUMAN)
YNGYFPVIFR

SEQ ID NO: 84223 - protein, 10 aa, Artificial Sequence
  Description of Artificial Sequence: Synthetic peptide
  Seed: IEILFGISLR (MAGC1_HUMAN)
IRILFGISLR

SEQ ID NO: 84224 - protein, 10 aa, Artificial Sequence
  Description of Artificial Sequence: Synthetic peptide
  Seed: KGTYASEEVI (MAGC1_HUMAN)
KTTYASEEVF

SEQ ID NO: 84225 - protein, 10 aa, Artificial Sequence
  Description of Artificial Sequence: Synthetic peptide
  Seed: FFSYTLASLL (MAGC1_HUMAN)
FQSYTLASLA

SEQ ID NO: 84226 - protein, 10 aa, Artificial Sequence
  Description of Artificial Sequence: Synthetic peptide
  Seed: QGEDSMSPLY (MAGC1_HUMAN)
QSEDSMSPLY

SEQ ID NO: 84227 - protein, 10 aa, Artificial Sequence
  Description of Artificial Sequence: Synthetic peptide
  Seed: REVDPDDSYV (MAGC1_HUMAN)
REVDPDDSYA

SEQ ID NO: 84228 - protein, 9 aa, Artificial Sequence
  Description of Artificial Sequence: Synthetic peptide
  Seed: FAFGEPREL (MAGC1_HUMAN)
FAFGEPREV

SEQ ID NO: 84229 - protein, 11 aa, Artificial Sequence
  Description of Artificial Sequence: Synthetic peptide
  Seed: SSTSLSLPQSF (MAGC1_HUMAN)
STTSLSLPQSW

SEQ ID NO: 84230 - protein, 8 aa, Artificial Sequence
  Description of Artificial Sequence: Synthetic peptide
  Seed: LAMLKNTV (MAGC1_HUMAN)
LLMLKNTL

SEQ ID NO: 84231 - protein, 9 aa, Artificial Sequence
  Description of Artificial Sequence: Synthetic peptide
  Seed: LKNTVPITF (MAGC1_HUMAN)
LQNTVPITY

SEQ ID NO: 84232 - protein, 10 aa, Artificial Sequence
  Description of Artificial Sequence: Synthetic peptide
  Seed: NRLLILILSI (MAGC1_HUMAN)
NYLLILILSV

SEQ ID NO: 84233 - protein, 9 aa, Artificial Sequence
  Description of Artificial Sequence: Synthetic peptide
  Seed: SSPESPLQS (MAGC1_HUMAN)
SAPESPLQL

SEQ ID NO: 84234 - protein, 10 aa, Artificial Sequence
  Description of Artificial Sequence: Synthetic peptide
  Seed: STFEGFPQSL (MAGC1_HUMAN)
SQFEGFPQSL

SEQ ID NO: 84235 - protein, 10 aa, Artificial Sequence
  Description of Artificial Sequence: Synthetic peptide
  Seed: RYTGYFPVIF (MAGC1_HUMAN)
RWTGYFPVIL

SEQ ID NO: 84236 - protein, 10 aa, Artificial Sequence
  Description of Artificial Sequence: Synthetic peptide
  Seed: SLQIPVSPSF (MAGC1_HUMAN)
SGQIPVSPSF

SEQ ID NO: 84237 - protein, 10 aa, Artificial Sequence
  Description of Artificial Sequence: Synthetic peptide
  Seed: PLQRPVSSFF (MAGC1_HUMAN)
PYQRPVSSFF

SEQ ID NO: 84238 - protein, 9 aa, Artificial Sequence
  Description of Artificial Sequence: Synthetic peptide
  Seed: RKAREFIEI (MAGC1_HUMAN)
RMAREFIEM

SEQ ID NO: 84239 - protein, 10 aa, Artificial Sequence
  Description of Artificial Sequence: Synthetic peptide
  Seed: SSPERTQSTF (MAGC1_HUMAN)
SFPERTQSTF

SEQ ID NO: 84240 - protein, 11 aa, Artificial Sequence
  Description of Artificial Sequence: Synthetic peptide
  Seed: SQSSPEGKDSL (MAGC1_HUMAN)
SMSSPEGKDSW

SEQ ID NO: 84241 - protein, 9 aa, Artificial Sequence
  Description of Artificial Sequence: Synthetic peptide
  Seed: RTQSTFEGF (MAGC1_HUMAN)
RYQSTFEGY

SEQ ID NO: 84242 - protein, 10 aa, Artificial Sequence
  Description of Artificial Sequence: Synthetic peptide
  Seed: SLQIPVSPSF (MAGC1_HUMAN)
SCQIPVSPSY

SEQ ID NO: 84243 - protein, 10 aa, Artificial Sequence
  Description of Artificial Sequence: Synthetic peptide
  Seed: REVDPDDSYV (MAGC1_HUMAN)
RVVDPDDSYL

SEQ ID NO: 84244 - protein, 9 aa, Artificial Sequence
  Description of Artificial Sequence: Synthetic peptide
  Seed: FSSTLVSLF (MAGC1_HUMAN)
FMSTLVSLF

SEQ ID NO: 84245 - protein, 9 aa, Artificial Sequence
  Description of Artificial Sequence: Synthetic peptide
  Seed: WVQEHYLEY (MAGC1_HUMAN)
WKQEHYLEM

SEQ ID NO: 84246 - protein, 9 aa, Artificial Sequence
  Description of Artificial Sequence: Synthetic peptide
  Seed: NTVPITFPS (MAGC1_HUMAN)
NVVPITFPL

SEQ ID NO: 84247 - protein, 10 aa, Artificial Sequence
  Description of Artificial Sequence: Synthetic peptide
  Seed: VISFSSSTSL (MAGC1_HUMAN)
VESFSSSTSW

SEQ ID NO: 84248 - protein, 10 aa, Artificial Sequence
  Description of Artificial Sequence: Synthetic peptide
  Seed: YVFVNTLDLT (MAGC1_HUMAN)
YLFVNTLDLI

SEQ ID NO: 84249 - protein, 9 aa, Artificial Sequence
  Description of Artificial Sequence: Synthetic peptide
  Seed: TLDEKVDEL (MAGC1_HUMAN)
THDEKVDEM

SEQ ID NO: 84250 - protein, 9 aa, Artificial Sequence
  Description of Artificial Sequence: Synthetic peptide
  Seed: SSPESAQSA (MAGC1_HUMAN)
SNPESAQSM

SEQ ID NO: 84251 - protein, 9 aa, Artificial Sequence
  Description of Artificial Sequence: Synthetic peptide
  Seed: VSRSFSSTL (MAGC1_HUMAN)
VTRSFSSTT

SEQ ID NO: 84252 - protein, 9 aa, Artificial Sequence
  Description of Artificial Sequence: Synthetic peptide
  Seed: SPESAQSAF (MAGC1_HUMAN)
SLESAQSAF

SEQ ID NO: 84253 - protein, 10 aa, Artificial Sequence
  Description of Artificial Sequence: Synthetic peptide
  Seed: LSQSSPVSSF (MAGC1_HUMAN)
LEQSSPVSSM

SEQ ID NO: 84254 - protein, 9 aa, Artificial Sequence
  Description of Artificial Sequence: Synthetic peptide
  Seed: EDSSDPLQR (MAGC1_HUMAN)
ETSSDPLQK

SEQ ID NO: 84255 - protein, 9 aa, Artificial Sequence
  Description of Artificial Sequence: Synthetic peptide
  Seed: FSSALLSIF (MAGC1_HUMAN)
FLSALLSIF

SEQ ID NO: 84256 - protein, 9 aa, Artificial Sequence
  Description of Artificial Sequence: Synthetic peptide
  Seed: SSSTLVSIF (MAGC1_HUMAN)
SGSTLVSIW

SEQ ID NO: 84257 - protein, 9 aa, Artificial Sequence
  Description of Artificial Sequence: Synthetic peptide
  Seed: LQNPASSFF (MAGC1_HUMAN)
LMNPASSFF

SEQ ID NO: 84258 - protein, 11 aa, Artificial Sequence
  Description of Artificial Sequence: Synthetic peptide
  Seed: FLAMLKNTVPI (MAGC1_HUMAN)
FCAMLKNTVPV

SEQ ID NO: 84259 - protein, 9 aa, Artificial Sequence
  Description of Artificial Sequence: Synthetic peptide
  Seed: SPESAQSTF (MAGC1_HUMAN)
SAESAQSTF

SEQ ID NO: 84260 - protein, 9 aa, Artificial Sequence
  Description of Artificial Sequence: Synthetic peptide
  Seed: WVQEHYLEY (MAGC1_HUMAN)
WTQEHYLEW

SEQ ID NO: 84261 - protein, 10 aa, Artificial Sequence
  Description of Artificial Sequence: Synthetic peptide
  Seed: MSPLYFPQSP (MAGC1_HUMAN)
MAPLYFPQSA

SEQ ID NO: 84262 - protein, 10 aa, Artificial Sequence
  Description of Artificial Sequence: Synthetic peptide
  Seed: SPLYFPQSPL (MAGC1_HUMAN)
SPLYFPQSPM

SEQ ID NO: 84263 - protein, 9 aa, Artificial Sequence
  Description of Artificial Sequence: Synthetic peptide
  Seed: REVDPDDSY (MAGC1_HUMAN)
RVVDPDDSF

SEQ ID NO: 84264 - protein, 9 aa, Artificial Sequence
  Description of Artificial Sequence: Synthetic peptide
  Seed: VIWDVLSGI (MAGC1_HUMAN)
VLWDVLSGV

SEQ ID NO: 84265 - protein, 9 aa, Artificial Sequence
  Description of Artificial Sequence: Synthetic peptide
  Seed: GDKDMPTAG (MAGC1_HUMAN)
GEKDMPTAV

SEQ ID NO: 84266 - protein, 11 aa, Artificial Sequence
  Description of Artificial Sequence: Synthetic peptide
  Seed: FLAMLKNTVPI (MAGC1_HUMAN)
FYAMLKNTVPA

SEQ ID NO: 84267 - protein, 9 aa, Artificial Sequence
  Description of Artificial Sequence: Synthetic peptide
  Seed: SGIGVRAGR (MAGC1_HUMAN)
SSIGVRAGY

SEQ ID NO: 84268 - protein, 10 aa, Artificial Sequence
  Description of Artificial Sequence: Synthetic peptide
  Seed: STFEGFPQSL (MAGC1_HUMAN)
SHFEGFPQSA

SEQ ID NO: 84269 - protein, 10 aa, Artificial Sequence
  Description of Artificial Sequence: Synthetic peptide
  Seed: QGEDSMSPLY (MAGC1_HUMAN)
QIEDSMSPLY

SEQ ID NO: 84270 - protein, 9 aa, Artificial Sequence
  Description of Artificial Sequence: Synthetic peptide
  Seed: YTLASLLQS (MAGC1_HUMAN)
YVLASLLQV

SEQ ID NO: 84271 - protein, 9 aa, Artificial Sequence
  Description of Artificial Sequence: Synthetic peptide
  Seed: AQSPLQIPV (MAGC1_HUMAN)
AHSPLQIPY

SEQ ID NO: 84272 - protein, 10 aa, Artificial Sequence
  Description of Artificial Sequence: Synthetic peptide
  Seed: SIFQSSPESA (MAGC1_HUMAN)
STFQSSPESV

SEQ ID NO: 84273 - protein, 11 aa, Artificial Sequence
  Description of Artificial Sequence: Synthetic peptide
  Seed: SPQSPPEGPAQ (MAGC1_HUMAN)
SPQSPPEGPAF

SEQ ID NO: 84274 - protein, 9 aa, Artificial Sequence
  Description of Artificial Sequence: Synthetic peptide
  Seed: FLWGPRAHS (MAGC1_HUMAN)
FIWGPRAHM

SEQ ID NO: 84275 - protein, 9 aa, Artificial Sequence
  Description of Artificial Sequence: Synthetic peptide
  Seed: SPLQRPVSS (MAGC1_HUMAN)
SALQRPVSA

SEQ ID NO: 84276 - protein, 10 aa, Artificial Sequence
  Description of Artificial Sequence: Synthetic peptide
  Seed: LLQIPMTSSF (MAGC1_HUMAN)
LVQIPMTSSY

SEQ ID NO: 84277 - protein, 10 aa, Artificial Sequence
  Description of Artificial Sequence: Synthetic peptide
  Seed: FPSSYKDALK (MAGC1_HUMAN)
FDSSYKDALR

SEQ ID NO: 84278 - protein, 9 aa, Artificial Sequence
  Description of Artificial Sequence: Synthetic peptide
  Seed: FLWGPRAHS (MAGC1_HUMAN)
FVWGPRAHV

SEQ ID NO: 84279 - protein, 9 aa, Artificial Sequence
  Description of Artificial Sequence: Synthetic peptide
  Seed: FPSSYKDAL (MAGC1_HUMAN)
FPSSYKDAY

SEQ ID NO: 84280 - protein, 10 aa, Artificial Sequence
  Description of Artificial Sequence: Synthetic peptide
  Seed: MTSSFSSTLL (MAGC1_HUMAN)
MASSFSSTLW

SEQ ID NO: 84281 - protein, 10 aa, Artificial Sequence
  Description of Artificial Sequence: Synthetic peptide
  Seed: ATESASSSVM (MAGC1_HUMAN)
AQESASSSVM

SEQ ID NO: 84282 - protein, 9 aa, Artificial Sequence
  Description of Artificial Sequence: Synthetic peptide
  Seed: SSSSTLLSL (MAGC1_HUMAN)
SASSTLLSF

SEQ ID NO: 84283 - protein, 10 aa, Artificial Sequence
  Description of Artificial Sequence: Synthetic peptide
  Seed: SSPESTQSPF (MAGC1_HUMAN)
SKPESTQSPL

SEQ ID NO: 84284 - protein, 11 aa, Artificial Sequence
  Description of Artificial Sequence: Synthetic peptide
  Seed: IPVSAASSSTL (MAGC1_HUMAN)
IQVSAASSSTY

SEQ ID NO: 84285 - protein, 9 aa, Artificial Sequence
  Description of Artificial Sequence: Synthetic peptide
  Seed: SSPERTHST (MAGC1_HUMAN)
SMPERTHSM

SEQ ID NO: 84286 - protein, 9 aa, Artificial Sequence
  Description of Artificial Sequence: Synthetic peptide
  Seed: FSSTLLSLF (MAGC1_HUMAN)
FLSTLLSLY

SEQ ID NO: 84287 - protein, 9 aa, Artificial Sequence
  Description of Artificial Sequence: Synthetic peptide
  Seed: SLPEWEDSL (MAGC1_HUMAN)
SYPEWEDSF

SEQ ID NO: 84288 - protein, 9 aa, Artificial Sequence
  Description of Artificial Sequence: Synthetic peptide
  Seed: LQIPVSRSF (MAGC1_HUMAN)
LHIPVSRSL

SEQ ID NO: 84289 - protein, 11 aa, Artificial Sequence
  Description of Artificial Sequence: Synthetic peptide
  Seed: SPLQIPVSPSS (MAGC1_HUMAN)
SGLQIPVSPSF

SEQ ID NO: 84290 - protein, 10 aa, Artificial Sequence
  Description of Artificial Sequence: Synthetic peptide
  Seed: TGYFPVIFRK (MAGC1_HUMAN)
TVYFPVIFRI

SEQ ID NO: 84291 - protein, 9 aa, Artificial Sequence
  Description of Artificial Sequence: Synthetic peptide
  Seed: NTVPITFPS (MAGC1_HUMAN)
NSVPITFPV

SEQ ID NO: 84292 - protein, 9 aa, Artificial Sequence
  Description of Artificial Sequence: Synthetic peptide
  Seed: RAGREHFAF (MAGC1_HUMAN)
RYGREHFAY

SEQ ID NO: 84293 - protein, 9 aa, Artificial Sequence
  Description of Artificial Sequence: Synthetic peptide
  Seed: SPVSSFPSS (MAGC1_HUMAN)
SPVSSFPSM

SEQ ID NO: 84294 - protein, 9 aa, Artificial Sequence
  Description of Artificial Sequence: Synthetic peptide
  Seed: FSSTLVSLF (MAGC1_HUMAN)
FISTLVSLF

SEQ ID NO: 84295 - protein, 10 aa, Artificial Sequence
  Description of Artificial Sequence: Synthetic peptide
  Seed: LSQSSPVSSF (MAGC1_HUMAN)
LDQSSPVSSM

SEQ ID NO: 84296 - protein, 9 aa, Artificial Sequence
  Description of Artificial Sequence: Synthetic peptide
  Seed: FFSYTLASL (MAGC1_HUMAN)
FASYTLASY

SEQ ID NO: 84297 - protein, 10 aa, Artificial Sequence
  Description of Artificial Sequence: Synthetic peptide
  Seed: EILFGISLRE (MAGC1_HUMAN)
EQLFGISLRR

SEQ ID NO: 84298 - protein, 9 aa, Artificial Sequence
  Description of Artificial Sequence: Synthetic peptide
  Seed: LQRPVSSFF (MAGC1_HUMAN)
LTRPVSSFT

SEQ ID NO: 84299 - protein, 9 aa, Artificial Sequence
  Description of Artificial Sequence: Synthetic peptide
  Seed: SPVSSFPSS (MAGC1_HUMAN)
SPVSSFPSI

SEQ ID NO: 84300 - protein, 9 aa, Artificial Sequence
  Description of Artificial Sequence: Synthetic peptide
  Seed: ILILSIIFI (MAGC1_HUMAN)
IAILSIIFV

SEQ ID NO: 84301 - protein, 10 aa, Artificial Sequence
  Description of Artificial Sequence: Synthetic peptide
  Seed: HSPQSPPEGM (MAGC1_HUMAN)
HVPQSPPEGL

SEQ ID NO: 84302 - protein, 9 aa, Artificial Sequence
  Description of Artificial Sequence: Synthetic peptide
  Seed: DEKVDELAR (MAGC1_HUMAN)
DEKVDELAY

SEQ ID NO: 84303 - protein, 10 aa, Artificial Sequence
  Description of Artificial Sequence: Synthetic peptide
  Seed: LSQSSPVSSF (MAGC1_HUMAN)
LAQSSPVSSL

SEQ ID NO: 84304 - protein, 10 aa, Artificial Sequence
  Description of Artificial Sequence: Synthetic peptide
  Seed: SSFSYTLLSL (MAGC1_HUMAN)
SNFSYTLLSF

SEQ ID NO: 84305 - protein, 10 aa, Artificial Sequence
  Description of Artificial Sequence: Synthetic peptide
  Seed: FFSYTLASLL (MAGC1_HUMAN)
FYSYTLASLY

SEQ ID NO: 84306 - protein, 10 aa, Artificial Sequence
  Description of Artificial Sequence: Synthetic peptide
  Seed: KAREFIEILF (MAGC1_HUMAN)
KAREFIEILK

SEQ ID NO: 84307 - protein, 8 aa, Artificial Sequence
  Description of Artificial Sequence: Synthetic peptide
  Seed: SSFFSYTL (MAGC1_HUMAN)
SQFFSYTV

SEQ ID NO: 84308 - protein, 10 aa, Artificial Sequence
  Description of Artificial Sequence: Synthetic peptide
  Seed: RPVSSFFSYT (MAGC1_HUMAN)
RGVSSFFSYK

SEQ ID NO: 84309 - protein, 8 aa, Artificial Sequence
  Description of Artificial Sequence: Synthetic peptide
  Seed: LTDSESLI (MAGC1_HUMAN)
LSDSESLL

SEQ ID NO: 84310 - protein, 9 aa, Artificial Sequence
  Description of Artificial Sequence: Synthetic peptide
  Seed: LQNPASSFF (MAGC1_HUMAN)
LLNPASSFF

SEQ ID NO: 84311 - protein, 10 aa, Artificial Sequence
  Description of Artificial Sequence: Synthetic peptide
  Seed: ISRYTGYFPV (MAGC1_HUMAN)
IIRYTGYFPL

SEQ ID NO: 84312 - protein, 9 aa, Artificial Sequence
  Description of Artificial Sequence: Synthetic peptide
  Seed: SSSTSLSPF (MAGC1_HUMAN)
SQSTSLSPF

SEQ ID NO: 84313 - protein, 9 aa, Artificial Sequence
  Description of Artificial Sequence: Synthetic peptide
  Seed: DEQGMSQNR (MAGC1_HUMAN)
DMQGMSQNR

SEQ ID NO: 84314 - protein, 9 aa, Artificial Sequence
  Description of Artificial Sequence: Synthetic peptide
  Seed: FSYTLASLL (MAGC1_HUMAN)
FQYTLASLI

SEQ ID NO: 84315 - protein, 11 aa, Artificial Sequence
  Description of Artificial Sequence: Synthetic peptide
  Seed: STFEGFAQSSL (MAGC1_HUMAN)
SLFEGFAQSSA

SEQ ID NO: 84316 - protein, 9 aa, Artificial Sequence
  Description of Artificial Sequence: Synthetic peptide
  Seed: TLASLLQSS (MAGC1_HUMAN)
TIASLLQSI

SEQ ID NO: 84317 - protein, 9 aa, Artificial Sequence
  Description of Artificial Sequence: Synthetic peptide
  Seed: SSPESAQSA (MAGC1_HUMAN)
SGPESAQSM

SEQ ID NO: 84318 - protein, 9 aa, Artificial Sequence
  Description of Artificial Sequence: Synthetic peptide
  Seed: VSRSFSSTL (MAGC1_HUMAN)
VKRSFSSTI

SEQ ID NO: 84319 - protein, 11 aa, Artificial Sequence
  Description of Artificial Sequence: Synthetic peptide
  Seed: SPLQIPGSPSF (MAGC1_HUMAN)
SNLQIPGSPSM

SEQ ID NO: 84320 - protein, 10 aa, Artificial Sequence
  Description of Artificial Sequence: Synthetic peptide
  Seed: ICSSSTSLSL (MAGC1_HUMAN)
ILSSSTSLSY

SEQ ID NO: 84321 - protein, 9 aa, Artificial Sequence
  Description of Artificial Sequence: Synthetic peptide
  Seed: KVWVQEHYL (MAGC1_HUMAN)
KTWVQEHYL

SEQ ID NO: 84322 - protein, 9 aa, Artificial Sequence
  Description of Artificial Sequence: Synthetic peptide
  Seed: RSFSSTLLS (MAGC1_HUMAN)
RIFSSTLLA

SEQ ID NO: 84323 - protein, 10 aa, Artificial Sequence
  Description of Artificial Sequence: Synthetic peptide
  Seed: EVIWDVLSGI (MAGC1_HUMAN)
ELIWDVLSGV

SEQ ID NO: 84324 - protein, 9 aa, Artificial Sequence
  Description of Artificial Sequence: Synthetic peptide
  Seed: KAREFIEIL (MAGC1_HUMAN)
KVREFIEIW

SEQ ID NO: 84325 - protein, 10 aa, Artificial Sequence
  Description of Artificial Sequence: Synthetic peptide
  Seed: SSPERTQSTF (MAGC1_HUMAN)
SYPERTQSTL

SEQ ID NO: 84326 - protein, 9 aa, Artificial Sequence
  Description of Artificial Sequence: Synthetic peptide
  Seed: YPLQSPQSR (MAGC1_HUMAN)
YPLQSPQSC

SEQ ID NO: 84327 - protein, 9 aa, Artificial Sequence
  Description of Artificial Sequence: Synthetic peptide
  Seed: ASSSTLVSI (MAGC1_HUMAN)
AISSTLVSV

SEQ ID NO: 84328 - protein, 9 aa, Artificial Sequence
  Description of Artificial Sequence: Synthetic peptide
  Seed: FSYTLLSLF (MAGC1_HUMAN)
FLYTLLSLY

SEQ ID NO: 84329 - protein, 9 aa, Artificial Sequence
  Description of Artificial Sequence: Synthetic peptide
  Seed: AFGEPRELL (MAGC1_HUMAN)
AFGEPRELW

SEQ ID NO: 84330 - protein, 10 aa, Artificial Sequence
  Description of Artificial Sequence: Synthetic peptide
  Seed: LTKVWVQEHY (MAGC1_HUMAN)
LMKVWVQEHF

SEQ ID NO: 84331 - protein, 9 aa, Artificial Sequence
  Description of Artificial Sequence: Synthetic peptide
  Seed: SPVDEYTSS (MAGC1_HUMAN)
SPVDEYTSM

SEQ ID NO: 84332 - protein, 9 aa, Artificial Sequence
  Description of Artificial Sequence: Synthetic peptide
  Seed: SSSDTLLES (MAGC1_HUMAN)
SSSDTLLEL

SEQ ID NO: 84333 - protein, 11 aa, Artificial Sequence
  Description of Artificial Sequence: Synthetic peptide
  Seed: SLSQSSPVSSF (MAGC1_HUMAN)
SISQSSPVSSW

SEQ ID NO: 84334 - protein, 9 aa, Artificial Sequence
  Description of Artificial Sequence: Synthetic peptide
  Seed: AGREHFAFG (MAGC1_HUMAN)
AYREHFAFR

SEQ ID NO: 84335 - protein, 9 aa, Artificial Sequence
  Description of Artificial Sequence: Synthetic peptide
  Seed: VSRSFSSTL (MAGC1_HUMAN)
VYRSFSSTA

SEQ ID NO: 84336 - protein, 9 aa, Artificial Sequence
  Description of Artificial Sequence: Synthetic peptide
  Seed: SSSDTLLES (MAGC1_HUMAN)
SVSDTLLEV

SEQ ID NO: 84337 - protein, 10 aa, Artificial Sequence
  Description of Artificial Sequence: Synthetic peptide
  Seed: FFSYTLASLL (MAGC1_HUMAN)
FWSYTLASLW

SEQ ID NO: 84338 - protein, 10 aa, Artificial Sequence
  Description of Artificial Sequence: Synthetic peptide
  Seed: PLQRPVSSFF (MAGC1_HUMAN)
PSQRPVSSFF

SEQ ID NO: 84339 - protein, 9 aa, Artificial Sequence
  Description of Artificial Sequence: Synthetic peptide
  Seed: KDSLSPLEI (MAGC1_HUMAN)
KASLSPLEL

SEQ ID NO: 84340 - protein, 10 aa, Artificial Sequence
  Description of Artificial Sequence: Synthetic peptide
  Seed: NTVPITFPSS (MAGC1_HUMAN)
NTVPITFPSI

SEQ ID NO: 84341 - protein, 10 aa, Artificial Sequence
  Description of Artificial Sequence: Synthetic peptide
  Seed: SRYTGYFPVI (MAGC1_HUMAN)
SRYTGYFPVM

SEQ ID NO: 84342 - protein, 10 aa, Artificial Sequence
  Description of Artificial Sequence: Synthetic peptide
  Seed: PSFSSTLLSL (MAGC1_HUMAN)
PTFSSTLLSW

SEQ ID NO: 84343 - protein, 9 aa, Artificial Sequence
  Description of Artificial Sequence: Synthetic peptide
  Seed: SSSVMSPSF (MAGC1_HUMAN)
SVSVMSPSF

SEQ ID NO: 84344 - protein, 11 aa, Artificial Sequence
  Description of Artificial Sequence: Synthetic peptide
  Seed: LQIPVSSSFSY (MAGC1_HUMAN)
LTIPVSSSFSW

SEQ ID NO: 84345 - protein, 9 aa, Artificial Sequence
  Description of Artificial Sequence: Synthetic peptide
  Seed: SPVSSFPSS (MAGC1_HUMAN)
SAVSSFPSL

SEQ ID NO: 84346 - protein, 10 aa, Artificial Sequence
  Description of Artificial Sequence: Synthetic peptide
  Seed: GEDSLSPLQI (MAGC1_HUMAN)
GEDSLSPLQW

SEQ ID NO: 84347 - protein, 10 aa, Artificial Sequence
  Description of Artificial Sequence: Synthetic peptide
  Seed: SESLIESEPL (MAGC1_HUMAN)
SESLIESEPV

SEQ ID NO: 84348 - protein, 9 aa, Artificial Sequence
  Description of Artificial Sequence: Synthetic peptide
  Seed: RKAREFIEI (MAGC1_HUMAN)
RMAREFIEL

SEQ ID NO: 84349 - protein, 9 aa, Artificial Sequence
  Description of Artificial Sequence: Synthetic peptide
  Seed: FFSYTLASL (MAGC1_HUMAN)
FQSYTLASF

SEQ ID NO: 84350 - protein, 9 aa, Artificial Sequence
  Description of Artificial Sequence: Synthetic peptide
  Seed: MTSSFSSTL (MAGC1_HUMAN)
MGSSFSSTY

SEQ ID NO: 84351 - protein, 11 aa, Artificial Sequence
  Description of Artificial Sequence: Synthetic peptide
  Seed: QSFSERTQSTF (MAGC1_HUMAN)
QSFSERTQSTY

SEQ ID NO: 84352 - protein, 10 aa, Artificial Sequence
  Description of Artificial Sequence: Synthetic peptide
  Seed: YTLASLLQSS (MAGC1_HUMAN)
YILASLLQSL

SEQ ID NO: 84353 - protein, 10 aa, Artificial Sequence
  Description of Artificial Sequence: Synthetic peptide
  Seed: FPQSPLQIPV (MAGC1_HUMAN)
FMQSPLQIPT

SEQ ID NO: 84354 - protein, 9 aa, Artificial Sequence
  Description of Artificial Sequence: Synthetic peptide
  Seed: MTSSFSSTL (MAGC1_HUMAN)
MKSSFSSTW

SEQ ID NO: 84355 - protein, 9 aa, Artificial Sequence
  Description of Artificial Sequence: Synthetic peptide
  Seed: NPASSFFSS (MAGC1_HUMAN)
NAASSFFSL

SEQ ID NO: 84356 - protein, 10 aa, Artificial Sequence
  Description of Artificial Sequence: Synthetic peptide
  Seed: SSPERTQSTF (MAGC1_HUMAN)
SSPERTQSTM

SEQ ID NO: 84357 - protein, 10 aa, Artificial Sequence
  Description of Artificial Sequence: Synthetic peptide
  Seed: WEDSLSPHYF (MAGC1_HUMAN)
WVDSLSPHYM

SEQ ID NO: 84358 - protein, 9 aa, Artificial Sequence
  Description of Artificial Sequence: Synthetic peptide
  Seed: YTGYFPVIF (MAGC1_HUMAN)
YYGYFPVIW

SEQ ID NO: 84359 - protein, 10 aa, Artificial Sequence
  Description of Artificial Sequence: Synthetic peptide
  Seed: VKQPITKAEM (MAGC1_HUMAN)
VKQPITKAEY

SEQ ID NO: 84360 - protein, 11 aa, Artificial Sequence
  Description of Artificial Sequence: Synthetic peptide
  Seed: STFEGFAQSPL (MAGC1_HUMAN)
SVFEGFAQSPW

SEQ ID NO: 84361 - protein, 9 aa, Artificial Sequence
  Description of Artificial Sequence: Synthetic peptide
  Seed: LKYQVKQPI (MAGC1_HUMAN)
LVYQVKQPM

SEQ ID NO: 84362 - protein, 10 aa, Artificial Sequence
  Description of Artificial Sequence: Synthetic peptide
  Seed: MLKNTVPITF (MAGC1_HUMAN)
MCKNTVPITY

SEQ ID NO: 84363 - protein, 8 aa, Artificial Sequence
  Description of Artificial Sequence: Synthetic peptide
  Seed: HYLEYREV (MAGC1_HUMAN)
HYLEYREF

SEQ ID NO: 84364 - protein, 9 aa, Artificial Sequence
  Description of Artificial Sequence: Synthetic peptide
  Seed: TKVWVQEHY (MAGC1_HUMAN)
TMVWVQEHF

SEQ ID NO: 84365 - protein, 10 aa, Artificial Sequence
  Description of Artificial Sequence: Synthetic peptide
  Seed: WEDSLSPHYF (MAGC1_HUMAN)
WADSLSPHYL

SEQ ID NO: 84366 - protein, 9 aa, Artificial Sequence
  Description of Artificial Sequence: Synthetic peptide
  Seed: SSPESDDTL (MAGC1_HUMAN)
SYPESDDTL

SEQ ID NO: 84367 - protein, 9 aa, Artificial Sequence
  Description of Artificial Sequence: Synthetic peptide
  Seed: SQSSPVSSF (MAGC1_HUMAN)
SASSPVSSA

SEQ ID NO: 84368 - protein, 9 aa, Artificial Sequence
  Description of Artificial Sequence: Synthetic peptide
  Seed: KDSLSPLEI (MAGC1_HUMAN)
KMSLSPLEL

SEQ ID NO: 84369 - protein, 9 aa, Artificial Sequence
  Description of Artificial Sequence: Synthetic peptide
  Seed: SSSFSYTLL (MAGC1_HUMAN)
SSSFSYTLK

SEQ ID NO: 84370 - protein, 11 aa, Artificial Sequence
  Description of Artificial Sequence: Synthetic peptide
  Seed: SSSSSSTLLSL (MAGC1_HUMAN)
STSSSSTLLSW

SEQ ID NO: 84371 - protein, 11 aa, Artificial Sequence
  Description of Artificial Sequence: Synthetic peptide
  Seed: TTDDSTATESA (MAGC1_HUMAN)
TFDDSTATESM

SEQ ID NO: 84372 - protein, 10 aa, Artificial Sequence
  Description of Artificial Sequence: Synthetic peptide
  Seed: LILILSIIFI (MAGC1_HUMAN)
LALILSIIFV

SEQ ID NO: 84373 - protein, 9 aa, Artificial Sequence
  Description of Artificial Sequence: Synthetic peptide
  Seed: VSSSFSYTL (MAGC1_HUMAN)
VLSSFSYTL

SEQ ID NO: 84374 - protein, 9 aa, Artificial Sequence
  Description of Artificial Sequence: Synthetic peptide
  Seed: FPSSTSSSL (MAGC1_HUMAN)
FPSSTSSST

SEQ ID NO: 84375 - protein, 10 aa, Artificial Sequence
  Description of Artificial Sequence: Synthetic peptide
  Seed: TGYFPVIFRK (MAGC1_HUMAN)
TAYFPVIFRE

SEQ ID NO: 84376 - protein, 9 aa, Artificial Sequence
  Description of Artificial Sequence: Synthetic peptide
  Seed: FTYTLDEKV (MAGC1_HUMAN)
FQYTLDEKA

SEQ ID NO: 84377 - protein, 9 aa, Artificial Sequence
  Description of Artificial Sequence: Synthetic peptide
  Seed: TFEGFPQSL (MAGC1_HUMAN)
THEGFPQSL

SEQ ID NO: 84378 - protein, 11 aa, Artificial Sequence
  Description of Artificial Sequence: Synthetic peptide
  Seed: REVDPDDSYVF (MAGC1_HUMAN)
RQVDPDDSYVI

SEQ ID NO: 84379 - protein, 11 aa, Artificial Sequence
  Description of Artificial Sequence: Synthetic peptide
  Seed: SFFSSALLSIF (MAGC1_HUMAN)
SKFSSALLSIY

SEQ ID NO: 84380 - protein, 9 aa, Artificial Sequence
  Description of Artificial Sequence: Synthetic peptide
  Seed: VSPSFSSTL (MAGC1_HUMAN)
VVPSFSSTR

SEQ ID NO: 84381 - protein, 10 aa, Artificial Sequence
  Description of Artificial Sequence: Synthetic peptide
  Seed: MTSSFSSTLL (MAGC1_HUMAN)
MHSSFSSTLL

SEQ ID NO: 84382 - protein, 10 aa, Artificial Sequence
  Description of Artificial Sequence: Synthetic peptide
  Seed: REVDPDDSYV (MAGC1_HUMAN)
REVDPDDSYW

SEQ ID NO: 84383 - protein, 9 aa, Artificial Sequence
  Description of Artificial Sequence: Synthetic peptide
  Seed: SSPERTQST (MAGC1_HUMAN)
SGPERTQSM

SEQ ID NO: 84384 - protein, 9 aa, Artificial Sequence
  Description of Artificial Sequence: Synthetic peptide
  Seed: LSPLHFPQF (MAGC1_HUMAN)
LLPLHFPQF

SEQ ID NO: 84385 - protein, 11 aa, Artificial Sequence
  Description of Artificial Sequence: Synthetic peptide
  Seed: IPVSSSFSYTL (MAGC1_HUMAN)
IKVSSSFSYTY

SEQ ID NO: 84386 - protein, 9 aa, Artificial Sequence
  Description of Artificial Sequence: Synthetic peptide
  Seed: SMSPLYFPQ (MAGC1_HUMAN)
SMSPLYFPR

SEQ ID NO: 84387 - protein, 9 aa, Artificial Sequence
  Description of Artificial Sequence: Synthetic peptide
  Seed: IFRKAREFI (MAGC1_HUMAN)
IYRKAREFY

SEQ ID NO: 84388 - protein, 9 aa, Artificial Sequence
  Description of Artificial Sequence: Synthetic peptide
  Seed: FPSSTSSSL (MAGC1_HUMAN)
FVSSTSSSL

SEQ ID NO: 84389 - protein, 9 aa, Artificial Sequence
  Description of Artificial Sequence: Synthetic peptide
  Seed: SPESAQSAF (MAGC1_HUMAN)
SHESAQSAY

SEQ ID NO: 84390 - protein, 9 aa, Artificial Sequence
  Description of Artificial Sequence: Synthetic peptide
  Seed: EFIEILFGI (MAGC1_HUMAN)
EIIEILFGM

SEQ ID NO: 84391 - protein, 9 aa, Artificial Sequence
  Description of Artificial Sequence: Synthetic peptide
  Seed: RPVSSFFSY (MAGC1_HUMAN)
RKVSSFFSY

SEQ ID NO: 84392 - protein, 10 aa, Artificial Sequence
  Description of Artificial Sequence: Synthetic peptide
  Seed: PLQIPVSSSF (MAGC1_HUMAN)
PHQIPVSSSY

SEQ ID NO: 84393 - protein, 9 aa, Artificial Sequence
  Description of Artificial Sequence: Synthetic peptide
  Seed: VSSSSSSTL (MAGC1_HUMAN)
VTSSSSSTI

SEQ ID NO: 84394 - protein, 10 aa, Artificial Sequence
  Description of Artificial Sequence: Synthetic peptide
  Seed: FAFGEPRELL (MAGC1_HUMAN)
FAFGEPRELM

SEQ ID NO: 84395 - protein, 9 aa, Artificial Sequence
  Description of Artificial Sequence: Synthetic peptide
  Seed: FFSSALLSI (MAGC1_HUMAN)
FQSSALLSI

SEQ ID NO: 84396 - protein, 10 aa, Artificial Sequence
  Description of Artificial Sequence: Synthetic peptide
  Seed: SFPSSTSSSL (MAGC1_HUMAN)
SLPSSTSSSL

SEQ ID NO: 84397 - protein, 9 aa, Artificial Sequence
  Description of Artificial Sequence: Synthetic peptide
  Seed: TLLSILQSS (MAGC1_HUMAN)
TLLSILQSV

SEQ ID NO: 84398 - protein, 9 aa, Artificial Sequence
  Description of Artificial Sequence: Synthetic peptide
  Seed: CTQSTFEGF (MAGC1_HUMAN)
CWQSTFEGF

SEQ ID NO: 84399 - protein, 9 aa, Artificial Sequence
  Description of Artificial Sequence: Synthetic peptide
  Seed: SPESAQSTF (MAGC1_HUMAN)
SQESAQSTY

SEQ ID NO: 84400 - protein, 10 aa, Artificial Sequence
  Description of Artificial Sequence: Synthetic peptide
  Seed: LSGIGVRAGR (MAGC1_HUMAN)
LTGIGVRAGK

SEQ ID NO: 84401 - protein, 9 aa, Artificial Sequence
  Description of Artificial Sequence: Synthetic peptide
  Seed: AMLKNTVPI (MAGC1_HUMAN)
AVLKNTVPI

SEQ ID NO: 84402 - protein, 10 aa, Artificial Sequence
  Description of Artificial Sequence: Synthetic peptide
  Seed: ISRYTGYFPV (MAGC1_HUMAN)
IIRYTGYFPI

SEQ ID NO: 84403 - protein, 10 aa, Artificial Sequence
  Description of Artificial Sequence: Synthetic peptide
  Seed: MLTNVISRYT (MAGC1_HUMAN)
MITNVISRYI

SEQ ID NO: 84404 - protein, 9 aa, Artificial Sequence
  Description of Artificial Sequence: Synthetic peptide
  Seed: SSHESPQSP (MAGC1_HUMAN)
STHESPQSM

SEQ ID NO: 84405 - protein, 9 aa, Artificial Sequence
  Description of Artificial Sequence: Synthetic peptide
  Seed: VQSPLHSPQ (MAGC1_HUMAN)
VLSPLHSPM

SEQ ID NO: 84406 - protein, 9 aa, Artificial Sequence
  Description of Artificial Sequence: Synthetic peptide
  Seed: WVQEHYLEY (MAGC1_HUMAN)
WAQEHYLEW

SEQ ID NO: 84407 - protein, 9 aa, Artificial Sequence
  Description of Artificial Sequence: Synthetic peptide
  Seed: MTSSFSSTL (MAGC1_HUMAN)
MNSSFSSTF

SEQ ID NO: 84408 - protein, 10 aa, Artificial Sequence
  Description of Artificial Sequence: Synthetic peptide
  Seed: LQIPVSSSFS (MAGC1_HUMAN)
LMIPVSSSFF

SEQ ID NO: 84409 - protein, 10 aa, Artificial Sequence
  Description of Artificial Sequence: Synthetic peptide
  Seed: YTLASLLQSS (MAGC1_HUMAN)
YWLASLLQSL

SEQ ID NO: 84410 - protein, 10 aa, Artificial Sequence
  Description of Artificial Sequence: Synthetic peptide
  Seed: RAGREHFAFG (MAGC1_HUMAN)
RVGREHFAFQ

SEQ ID NO: 84411 - protein, 10 aa, Artificial Sequence
  Description of Artificial Sequence: Synthetic peptide
  Seed: NVISRYTGYF (MAGC1_HUMAN)
NQISRYTGYY

SEQ ID NO: 84412 - protein, 9 aa, Artificial Sequence
  Description of Artificial Sequence: Synthetic peptide
  Seed: SSFFSSALL (MAGC1_HUMAN)
SKFFSSALF

SEQ ID NO: 84413 - protein, 10 aa, Artificial Sequence
  Description of Artificial Sequence: Synthetic peptide
  Seed: GPVQSPLHSP (MAGC1_HUMAN)
GPVQSPLHSM

SEQ ID NO: 84414 - protein, 10 aa, Artificial Sequence
  Description of Artificial Sequence: Synthetic peptide
  Seed: FPQSVLQIPV (MAGC1_HUMAN)
FPQSVLQIPI

SEQ ID NO: 84415 - protein, 9 aa, Artificial Sequence
  Description of Artificial Sequence: Synthetic peptide
  Seed: FSYTLASLL (MAGC1_HUMAN)
FHYTLASLM

SEQ ID NO: 84416 - protein, 9 aa, Artificial Sequence
  Description of Artificial Sequence: Synthetic peptide
  Seed: FQSSPERTH (MAGC1_HUMAN)
FLSSPERTM

SEQ ID NO: 84417 - protein, 10 aa, Artificial Sequence
  Description of Artificial Sequence: Synthetic peptide
  Seed: MLKNTVPITF (MAGC1_HUMAN)
MKKNTVPITY

SEQ ID NO: 84418 - protein, 9 aa, Artificial Sequence
  Description of Artificial Sequence: Synthetic peptide
  Seed: AGREHFAFG (MAGC1_HUMAN)
ALREHFAFK

SEQ ID NO: 84419 - protein, 10 aa, Artificial Sequence
  Description of Artificial Sequence: Synthetic peptide
  Seed: KVVEFLAMLK (MAGC1_HUMAN)
KFVEFLAMLK

SEQ ID NO: 84420 - protein, 9 aa, Artificial Sequence
  Description of Artificial Sequence: Synthetic peptide
  Seed: LQNPASSFF (MAGC1_HUMAN)
LMNPASSFY

SEQ ID NO: 84421 - protein, 9 aa, Artificial Sequence
  Description of Artificial Sequence: Synthetic peptide
  Seed: AQSPLQSPV (MAGC1_HUMAN)
AKSPLQSPM

SEQ ID NO: 84422 - protein, 9 aa, Artificial Sequence
  Description of Artificial Sequence: Synthetic peptide
  Seed: IEILFGISL (MAGC1_HUMAN)
ISILFGISF

SEQ ID NO: 84423 - protein, 10 aa, Artificial Sequence
  Description of Artificial Sequence: Synthetic peptide
  Seed: FPSSTSSSLS (MAGC1_HUMAN)
FASSTSSSLY

SEQ ID NO: 84424 - protein, 11 aa, Artificial Sequence
  Description of Artificial Sequence: Synthetic peptide
  Seed: FPQSPLQGEEF (MAGC1_HUMAN)
FPQSPLQGEEW

SEQ ID NO: 84425 - protein, 9 aa, Artificial Sequence
  Description of Artificial Sequence: Synthetic peptide
  Seed: STQSPFEGF (MAGC1_HUMAN)
SQQSPFEGF

SEQ ID NO: 84426 - protein, 11 aa, Artificial Sequence
  Description of Artificial Sequence: Synthetic peptide
  Seed: KRKVVEFLAML (MAGC1_HUMAN)
KAKVVEFLAMV

SEQ ID NO: 84427 - protein, 10 aa, Artificial Sequence
  Description of Artificial Sequence: Synthetic peptide
  Seed: LAMLKNTVPI (MAGC1_HUMAN)
LQMLKNTVPM

SEQ ID NO: 84428 - protein, 8 aa, Artificial Sequence
  Description of Artificial Sequence: Synthetic peptide
  Seed: FIEILFGI (MAGC1_HUMAN)
FLEILFGM

SEQ ID NO: 84429 - protein, 10 aa, Artificial Sequence
  Description of Artificial Sequence: Synthetic peptide
  Seed: LQNPASSFFS (MAGC1_HUMAN)
LKNPASSFFF

SEQ ID NO: 84430 - protein, 11 aa, Artificial Sequence
  Description of Artificial Sequence: Synthetic peptide
  Seed: SSFPSSTSSSL (MAGC1_HUMAN)
SVFPSSTSSSM

SEQ ID NO: 84431 - protein, 10 aa, Artificial Sequence
  Description of Artificial Sequence: Synthetic peptide
  Seed: FAQSSLQIPV (MAGC1_HUMAN)
FLQSSLQIPT

SEQ ID NO: 84432 - protein, 9 aa, Artificial Sequence
  Description of Artificial Sequence: Synthetic peptide
  Seed: NPASSFFSS (MAGC1_HUMAN)
NTASSFFSF

SEQ ID NO: 84433 - protein, 11 aa, Artificial Sequence
  Description of Artificial Sequence: Synthetic peptide
  Seed: SFFSYTLASLL (MAGC1_HUMAN)
SAFSYTLASLF

SEQ ID NO: 84434 - protein, 10 aa, Artificial Sequence
  Description of Artificial Sequence: Synthetic peptide
  Seed: KRKVVEFLAM (MAGC1_HUMAN)
KTKVVEFLAY

SEQ ID NO: 84435 - protein, 9 aa, Artificial Sequence
  Description of Artificial Sequence: Synthetic peptide
  Seed: LSPLHFPQF (MAGC1_HUMAN)
LMPLHFPQF

SEQ ID NO: 84436 - protein, 8 aa, Artificial Sequence
  Description of Artificial Sequence: Synthetic peptide
  Seed: SSFSYTLL (MAGC1_HUMAN)
SQFSYTLV

SEQ ID NO: 84437 - protein, 9 aa, Artificial Sequence
  Description of Artificial Sequence: Synthetic peptide
  Seed: RLLILILSI (MAGC1_HUMAN)
RSLILILSR

SEQ ID NO: 84438 - protein, 11 aa, Artificial Sequence
  Description of Artificial Sequence: Synthetic peptide
  Seed: KRKVVEFLAML (MAGC1_HUMAN)
KTKVVEFLAMV

SEQ ID NO: 84439 - protein, 9 aa, Artificial Sequence
  Description of Artificial Sequence: Synthetic peptide
  Seed: TLLSIFQSS (MAGC1_HUMAN)
TLLSIFQSA

SEQ ID NO: 84440 - protein, 9 aa, Artificial Sequence
  Description of Artificial Sequence: Synthetic peptide
  Seed: LQIPVSRSF (MAGC1_HUMAN)
LQIPVSRSA

SEQ ID NO: 84441 - protein, 9 aa, Artificial Sequence
  Description of Artificial Sequence: Synthetic peptide
  Seed: YTLASLLQS (MAGC1_HUMAN)
YLLASLLQV

SEQ ID NO: 84442 - protein, 9 aa, Artificial Sequence
  Description of Artificial Sequence: Synthetic peptide
  Seed: SSPEGKDSL (MAGC1_HUMAN)
SRPEGKDSY

SEQ ID NO: 84443 - protein, 9 aa, Artificial Sequence
  Description of Artificial Sequence: Synthetic peptide
  Seed: EVPNSSPPR (MAGC1_HUMAN)
EVPNSSPPK

SEQ ID NO: 84444 - protein, 9 aa, Artificial Sequence
  Description of Artificial Sequence: Synthetic peptide
  Seed: TSSFSSTLL (MAGC1_HUMAN)
TTSFSSTLY

SEQ ID NO: 84445 - protein, 10 aa, Artificial Sequence
  Description of Artificial Sequence: Synthetic peptide
  Seed: ESEPLFTYTL (MAGC1_HUMAN)
ETEPLFTYTV

SEQ ID NO: 84446 - protein, 11 aa, Artificial Sequence
  Description of Artificial Sequence: Synthetic peptide
  Seed: SPLQIPMTSSF (MAGC1_HUMAN)
SKLQIPMTSSY

SEQ ID NO: 84447 - protein, 9 aa, Artificial Sequence
  Description of Artificial Sequence: Synthetic peptide
  Seed: SFSSTLVSL (MAGC1_HUMAN)
SWSSTLVSW

SEQ ID NO: 84448 - protein, 10 aa, Artificial Sequence
  Description of Artificial Sequence: Synthetic peptide
  Seed: TGYFPVIFRK (MAGC1_HUMAN)
TAYFPVIFRQ

SEQ ID NO: 84449 - protein, 10 aa, Artificial Sequence
  Description of Artificial Sequence: Synthetic peptide
  Seed: STPSSLPQSF (MAGC1_HUMAN)
SIPSSLPQSL

SEQ ID NO: 84450 - protein, 10 aa, Artificial Sequence
  Description of Artificial Sequence: Synthetic peptide
  Seed: RAGREHFAFG (MAGC1_HUMAN)
RHGREHFAFY

SEQ ID NO: 84451 - protein, 10 aa, Artificial Sequence
  Description of Artificial Sequence: Synthetic peptide
  Seed: KGTYASEEVI (MAGC1_HUMAN)
KNTYASEEVW

SEQ ID NO: 84452 - protein, 9 aa, Artificial Sequence
  Description of Artificial Sequence: Synthetic peptide
  Seed: EDFQSSLQS (MAGC1_HUMAN)
EEFQSSLQP

SEQ ID NO: 84453 - protein, 9 aa, Artificial Sequence
  Description of Artificial Sequence: Synthetic peptide
  Seed: DSYVFVNTL (MAGC1_HUMAN)
DAYVFVNTY

SEQ ID NO: 84454 - protein, 10 aa, Artificial Sequence
  Description of Artificial Sequence: Synthetic peptide
  Seed: DVLSGIGVRA (MAGC1_HUMAN)
DTLSGIGVRA

SEQ ID NO: 84455 - protein, 9 aa, Artificial Sequence
  Description of Artificial Sequence: Synthetic peptide
  Seed: CSSSTSLSL (MAGC1_HUMAN)
CSSSTSLSI

SEQ ID NO: 84456 - protein, 9 aa, Artificial Sequence
  Description of Artificial Sequence: Synthetic peptide
  Seed: VDELARFLL (MAGC1_HUMAN)
VEELARFLL

SEQ ID NO: 84457 - protein, 9 aa, Artificial Sequence
  Description of Artificial Sequence: Synthetic peptide
  Seed: LQIPMTSSF (MAGC1_HUMAN)
LIIPMTSSV

SEQ ID NO: 84458 - protein, 10 aa, Artificial Sequence
  Description of Artificial Sequence: Synthetic peptide
  Seed: SSPESAQSTF (MAGC1_HUMAN)
SSPESAQSTW

SEQ ID NO: 84459 - protein, 10 aa, Artificial Sequence
  Description of Artificial Sequence: Synthetic peptide
  Seed: VPITFPSSYK (MAGC1_HUMAN)
VAITFPSSYR

SEQ ID NO: 84460 - protein, 9 aa, Artificial Sequence
  Description of Artificial Sequence: Synthetic peptide
  Seed: KVDELARFL (MAGC1_HUMAN)
KSDELARFW

SEQ ID NO: 84461 - protein, 9 aa, Artificial Sequence
  Description of Artificial Sequence: Synthetic peptide
  Seed: LQIPVSPSF (MAGC1_HUMAN)
LMIPVSPSF

SEQ ID NO: 84462 - protein, 10 aa, Artificial Sequence
  Description of Artificial Sequence: Synthetic peptide
  Seed: FPQSLLQIPM (MAGC1_HUMAN)
FKQSLLQIPM

SEQ ID NO: 84463 - protein, 9 aa, Artificial Sequence
  Description of Artificial Sequence: Synthetic peptide
  Seed: LILILSIIF (MAGC1_HUMAN)
LMLILSIIY

SEQ ID NO: 84464 - protein, 9 aa, Artificial Sequence
  Description of Artificial Sequence: Synthetic peptide
  Seed: MTSSFSSTL (MAGC1_HUMAN)
MTSSFSSTM

SEQ ID NO: 84465 - protein, 9 aa, Artificial Sequence
  Description of Artificial Sequence: Synthetic peptide
  Seed: VIKRKVVEF (MAGC1_HUMAN)
VKKRKVVEY

SEQ ID NO: 84466 - protein, 8 aa, Artificial Sequence
  Description of Artificial Sequence: Synthetic peptide
  Seed: QIPMTSSF (MAGC1_HUMAN)
QMPMTSSY

SEQ ID NO: 84467 - protein, 11 aa, Artificial Sequence
  Description of Artificial Sequence: Synthetic peptide
  Seed: ISRYTGYFPVI (MAGC1_HUMAN)
IGRYTGYFPVF

SEQ ID NO: 84468 - protein, 10 aa, Artificial Sequence
  Description of Artificial Sequence: Synthetic peptide
  Seed: GENTHSPLQI (MAGC1_HUMAN)
GENTHSPLQY

SEQ ID NO: 84469 - protein, 10 aa, Artificial Sequence
  Description of Artificial Sequence: Synthetic peptide
  Seed: FAQSSLQIPV (MAGC1_HUMAN)
FQQSSLQIPI

SEQ ID NO: 84470 - protein, 11 aa, Artificial Sequence
  Description of Artificial Sequence: Synthetic peptide
  Seed: REVDPDDSYVF (MAGC1_HUMAN)
RAVDPDDSYVY

SEQ ID NO: 84471 - protein, 9 aa, Artificial Sequence
  Description of Artificial Sequence: Synthetic peptide
  Seed: KQPITKAEM (MAGC1_HUMAN)
KLPITKAEY

SEQ ID NO: 84472 - protein, 9 aa, Artificial Sequence
  Description of Artificial Sequence: Synthetic peptide
  Seed: RTHSTFEGF (MAGC1_HUMAN)
RWHSTFEGL

SEQ ID NO: 84473 - protein, 9 aa, Artificial Sequence
  Description of Artificial Sequence: Synthetic peptide
  Seed: SSSSSSSTL (MAGC1_HUMAN)
SLSSSSSTA

SEQ ID NO: 84474 - protein, 10 aa, Artificial Sequence
  Description of Artificial Sequence: Synthetic peptide
  Seed: STLLSLFQSF (MAGC1_HUMAN)
SYLLSLFQSV

SEQ ID NO: 84475 - protein, 9 aa, Artificial Sequence
  Description of Artificial Sequence: Synthetic peptide
  Seed: VISRYTGYF (MAGC1_HUMAN)
VMSRYTGYW

SEQ ID NO: 84476 - protein, 9 aa, Artificial Sequence
  Description of Artificial Sequence: Synthetic peptide
  Seed: VSRSFSSTL (MAGC1_HUMAN)
VYRSFSSTK

SEQ ID NO: 84477 - protein, 9 aa, Artificial Sequence
  Description of Artificial Sequence: Synthetic peptide
  Seed: TLLSLFQSF (MAGC1_HUMAN)
TQLSLFQSY

SEQ ID NO: 84478 - protein, 9 aa, Artificial Sequence
  Description of Artificial Sequence: Synthetic peptide
  Seed: AQSPLQIPV (MAGC1_HUMAN)
AMSPLQIPL

SEQ ID NO: 84479 - protein, 9 aa, Artificial Sequence
  Description of Artificial Sequence: Synthetic peptide
  Seed: SLIESEPLF (MAGC1_HUMAN)
SSIESEPLL

SEQ ID NO: 84480 - protein, 9 aa, Artificial Sequence
  Description of Artificial Sequence: Synthetic peptide
  Seed: LQIPVSPSF (MAGC1_HUMAN)
LPIPVSPSF

SEQ ID NO: 84481 - protein, 10 aa, Artificial Sequence
  Description of Artificial Sequence: Synthetic peptide
  Seed: ESAQSTFEGF (MAGC1_HUMAN)
EAAQSTFEGF

SEQ ID NO: 84482 - protein, 10 aa, Artificial Sequence
  Description of Artificial Sequence: Synthetic peptide
  Seed: YTLDEKVDEL (MAGC1_HUMAN)
YCLDEKVDEV

SEQ ID NO: 84483 - protein, 9 aa, Artificial Sequence
  Description of Artificial Sequence: Synthetic peptide
  Seed: YTSSSDTLL (MAGC1_HUMAN)
YQSSSDTLF

SEQ ID NO: 84484 - protein, 11 aa, Artificial Sequence
  Description of Artificial Sequence: Synthetic peptide
  Seed: IPVSSSFSYTL (MAGC1_HUMAN)
IDVSSSFSYTY

SEQ ID NO: 84485 - protein, 8 aa, Artificial Sequence
  Description of Artificial Sequence: Synthetic peptide
  Seed: RYTGYFPV (MAGC1_HUMAN)
RYTGYFPI

SEQ ID NO: 84486 - protein, 11 aa, Artificial Sequence
  Description of Artificial Sequence: Synthetic peptide
  Seed: STFEGFAQSSL (MAGC1_HUMAN)
SMFEGFAQSSV

SEQ ID NO: 84487 - protein, 9 aa, Artificial Sequence
  Description of Artificial Sequence: Synthetic peptide
  Seed: MPSLLQSSS (MAGC1_HUMAN)
MPSLLQSSV

SEQ ID NO: 84488 - protein, 10 aa, Artificial Sequence
  Description of Artificial Sequence: Synthetic peptide
  Seed: KVVEFLAMLK (MAGC1_HUMAN)
KMVEFLAMLA

SEQ ID NO: 84489 - protein, 9 aa, Artificial Sequence
  Description of Artificial Sequence: Synthetic peptide
  Seed: MSQNRLLIL (MAGC1_HUMAN)
MAQNRLLIF

SEQ ID NO: 84490 - protein, 11 aa, Artificial Sequence
  Description of Artificial Sequence: Synthetic peptide
  Seed: SSTSLSLPQSF (MAGC1_HUMAN)
SVTSLSLPQSW

SEQ ID NO: 84491 - protein, 11 aa, Artificial Sequence
  Description of Artificial Sequence: Synthetic peptide
  Seed: VSSSSSSSTLL (MAGC1_HUMAN)
VWSSSSSSTLF

SEQ ID NO: 84492 - protein, 9 aa, Artificial Sequence
  Description of Artificial Sequence: Synthetic peptide
  Seed: ISFSSSTSL (MAGC1_HUMAN)
IQFSSSTSW

SEQ ID NO: 84493 - protein, 9 aa, Artificial Sequence
  Description of Artificial Sequence: Synthetic peptide
  Seed: SPESAQSAF (MAGC1_HUMAN)
SPESAQSAA

SEQ ID NO: 84494 - protein, 11 aa, Artificial Sequence
  Description of Artificial Sequence: Synthetic peptide
  Seed: VSSSSSSSTLL (MAGC1_HUMAN)
VASSSSSSTLF

SEQ ID NO: 84495 - protein, 9 aa, Artificial Sequence
  Description of Artificial Sequence: Synthetic peptide
  Seed: SSFPSSTSS (MAGC1_HUMAN)
STFPSSTSL

SEQ ID NO: 84496 - protein, 9 aa, Artificial Sequence
  Description of Artificial Sequence: Synthetic peptide
  Seed: SFSSTLVSL (MAGC1_HUMAN)
SQSSTLVSI

SEQ ID NO: 84497 - protein, 9 aa, Artificial Sequence
  Description of Artificial Sequence: Synthetic peptide
  Seed: DSYVFVNTL (MAGC1_HUMAN)
DAYVFVNTW

SEQ ID NO: 84498 - protein, 9 aa, Artificial Sequence
  Description of Artificial Sequence: Synthetic peptide
  Seed: FSSTLLSLF (MAGC1_HUMAN)
FWSTLLSLF

SEQ ID NO: 84499 - protein, 9 aa, Artificial Sequence
  Description of Artificial Sequence: Synthetic peptide
  Seed: IPVSSSFSY (MAGC1_HUMAN)
IQVSSSFSF

SEQ ID NO: 84500 - protein, 10 aa, Artificial Sequence
  Description of Artificial Sequence: Synthetic peptide
  Seed: EVIKRKVVEF (MAGC1_HUMAN)
EVIKRKVVEY

SEQ ID NO: 84501 - protein, 9 aa, Artificial Sequence
  Description of Artificial Sequence: Synthetic peptide
  Seed: KAREFIEIL (MAGC1_HUMAN)
KFREFIEIY

SEQ ID NO: 84502 - protein, 9 aa, Artificial Sequence
  Description of Artificial Sequence: Synthetic peptide
  Seed: SSPESDDTL (MAGC1_HUMAN)
SFPESDDTL

SEQ ID NO: 84503 - protein, 10 aa, Artificial Sequence
  Description of Artificial Sequence: Synthetic peptide
  Seed: MLKNTVPITF (MAGC1_HUMAN)
MEKNTVPITF

SEQ ID NO: 84504 - protein, 10 aa, Artificial Sequence
  Description of Artificial Sequence: Synthetic peptide
  Seed: RAGREHFAFG (MAGC1_HUMAN)
RIGREHFAFY

SEQ ID NO: 84505 - protein, 10 aa, Artificial Sequence
  Description of Artificial Sequence: Synthetic peptide
  Seed: MTSSFSSTLL (MAGC1_HUMAN)
MESSFSSTLL

SEQ ID NO: 84506 - protein, 11 aa, Artificial Sequence
  Description of Artificial Sequence: Synthetic peptide
  Seed: IPVSRSFSSTL (MAGC1_HUMAN)
ISVSRSFSSTM

SEQ ID NO: 84507 - protein, 10 aa, Artificial Sequence
  Description of Artificial Sequence: Synthetic peptide
  Seed: LQIPVSSSFS (MAGC1_HUMAN)
LTIPVSSSFY

SEQ ID NO: 84508 - protein, 10 aa, Artificial Sequence
  Description of Artificial Sequence: Synthetic peptide
  Seed: SPLYFPQSPL (MAGC1_HUMAN)
SLLYFPQSPA

SEQ ID NO: 84509 - protein, 9 aa, Artificial Sequence
  Description of Artificial Sequence: Synthetic peptide
  Seed: LQIPVSSSS (MAGC1_HUMAN)
LPIPVSSSW

SEQ ID NO: 84510 - protein, 11 aa, Artificial Sequence
  Description of Artificial Sequence: Synthetic peptide
  Seed: SFSSSTSLSPF (MAGC1_HUMAN)
SMSSSTSLSPY

SEQ ID NO: 84511 - protein, 9 aa, Artificial Sequence
  Description of Artificial Sequence: Synthetic peptide
  Seed: LQIPGSPSF (MAGC1_HUMAN)
LPIPGSPSM

SEQ ID NO: 84512 - protein, 10 aa, Artificial Sequence
  Description of Artificial Sequence: Synthetic peptide
  Seed: FPQSLLQIPM (MAGC1_HUMAN)
FTQSLLQIPF

SEQ ID NO: 84513 - protein, 11 aa, Artificial Sequence
  Description of Artificial Sequence: Synthetic peptide
  Seed: TTDDSTATESA (MAGC1_HUMAN)
TIDDSTATESM

SEQ ID NO: 84514 - protein, 9 aa, Artificial Sequence
  Description of Artificial Sequence: Synthetic peptide
  Seed: FEGFPQSPL (MAGC1_HUMAN)
FEGFPQSPA

SEQ ID NO: 84515 - protein, 11 aa, Artificial Sequence
  Description of Artificial Sequence: Synthetic peptide
  Seed: SLSQSSPVSSF (MAGC1_HUMAN)
SKSQSSPVSSY

SEQ ID NO: 84516 - protein, 9 aa, Artificial Sequence
  Description of Artificial Sequence: Synthetic peptide
  Seed: SIIFIKGTY (MAGC1_HUMAN)
SAIFIKGTF

SEQ ID NO: 84517 - protein, 9 aa, Artificial Sequence
  Description of Artificial Sequence: Synthetic peptide
  Seed: TSLSLPQSF (MAGC1_HUMAN)
TPLSLPQSY

SEQ ID NO: 84518 - protein, 9 aa, Artificial Sequence
  Description of Artificial Sequence: Synthetic peptide
  Seed: VIKRKVVEF (MAGC1_HUMAN)
VQKRKVVEF

SEQ ID NO: 84519 - protein, 9 aa, Artificial Sequence
  Description of Artificial Sequence: Synthetic peptide
  Seed: FAFGEPREL (MAGC1_HUMAN)
FTFGEPRER

SEQ ID NO: 84520 - protein, 9 aa, Artificial Sequence
  Description of Artificial Sequence: Synthetic peptide
  Seed: TLLSLFQSF (MAGC1_HUMAN)
TKLSLFQSY

SEQ ID NO: 84521 - protein, 9 aa, Artificial Sequence
  Description of Artificial Sequence: Synthetic peptide
  Seed: FQSSLQSPV (MAGC1_HUMAN)
FQSSLQSPW

SEQ ID NO: 84522 - protein, 9 aa, Artificial Sequence
  Description of Artificial Sequence: Synthetic peptide
  Seed: VSSSFSYTL (MAGC1_HUMAN)
VVSSFSYTM

SEQ ID NO: 84523 - protein, 10 aa, Artificial Sequence
  Description of Artificial Sequence: Synthetic peptide
  Seed: LLQIPMTSSF (MAGC1_HUMAN)
LSQIPMTSSW

SEQ ID NO: 84524 - protein, 9 aa, Artificial Sequence
  Description of Artificial Sequence: Synthetic peptide
  Seed: TGYFPVIFR (MAGC1_HUMAN)
TMYFPVIFK

SEQ ID NO: 84525 - protein, 9 aa, Artificial Sequence
  Description of Artificial Sequence: Synthetic peptide
  Seed: VSSSFSYTL (MAGC1_HUMAN)
VMSSFSYTA

SEQ ID NO: 84526 - protein, 11 aa, Artificial Sequence
  Description of Artificial Sequence: Synthetic peptide
  Seed: SPLQIPVSSSS (MAGC1_HUMAN)
SMLQIPVSSSM

SEQ ID NO: 84527 - protein, 10 aa, Artificial Sequence
  Description of Artificial Sequence: Synthetic peptide
  Seed: FFSSALLSIF (MAGC1_HUMAN)
FGSSALLSIW

SEQ ID NO: 84528 - protein, 11 aa, Artificial Sequence
  Description of Artificial Sequence: Synthetic peptide
  Seed: SFFSYTLASLL (MAGC1_HUMAN)
SQFSYTLASLF

SEQ ID NO: 84529 - protein, 9 aa, Artificial Sequence
  Description of Artificial Sequence: Synthetic peptide
  Seed: LSDEQGMSQ (MAGC1_HUMAN)
LMDEQGMSC

SEQ ID NO: 84530 - protein, 9 aa, Artificial Sequence
  Description of Artificial Sequence: Synthetic peptide
  Seed: SSPERTQST (MAGC1_HUMAN)
SWPERTQSL

SEQ ID NO: 84531 - protein, 9 aa, Artificial Sequence
  Description of Artificial Sequence: Synthetic peptide
  Seed: SPERTHSTF (MAGC1_HUMAN)
SPERTHSTM

SEQ ID NO: 84532 - protein, 11 aa, Artificial Sequence
  Description of Artificial Sequence: Synthetic peptide
  Seed: RPVSSFFSYTL (MAGC1_HUMAN)
RTVSSFFSYTF

SEQ ID NO: 84533 - protein, 10 aa, Artificial Sequence
  Description of Artificial Sequence: Synthetic peptide
  Seed: KRKVVEFLAM (MAGC1_HUMAN)
KLKVVEFLAY

SEQ ID NO: 84534 - protein, 9 aa, Artificial Sequence
  Description of Artificial Sequence: Synthetic peptide
  Seed: SEPLFTYTL (MAGC1_HUMAN)
SEPLFTYTY

SEQ ID NO: 84535 - protein, 10 aa, Artificial Sequence
  Description of Artificial Sequence: Synthetic peptide
  Seed: SESLIESEPL (MAGC1_HUMAN)
SESLIESEPW

SEQ ID NO: 84536 - protein, 10 aa, Artificial Sequence
  Description of Artificial Sequence: Synthetic peptide
  Seed: SPLQSPVSSF (MAGC1_HUMAN)
SSLQSPVSSF

SEQ ID NO: 84537 - protein, 8 aa, Artificial Sequence
  Description of Artificial Sequence: Synthetic peptide
  Seed: RSFSSTLL (MAGC1_HUMAN)
RSFSSTLM

SEQ ID NO: 84538 - protein, 11 aa, Artificial Sequence
  Description of Artificial Sequence: Synthetic peptide
  Seed: SPLQIPVSPSS (MAGC1_HUMAN)
SLLQIPVSPSY

SEQ ID NO: 84539 - protein, 9 aa, Artificial Sequence
  Description of Artificial Sequence: Synthetic peptide
  Seed: FAFGEPREL (MAGC1_HUMAN)
FVFGEPREI

SEQ ID NO: 84540 - protein, 10 aa, Artificial Sequence
  Description of Artificial Sequence: Synthetic peptide
  Seed: ITKAEMLTNV (MAGC1_HUMAN)
ILKAEMLTNI

SEQ ID NO: 84541 - protein, 10 aa, Artificial Sequence
  Description of Artificial Sequence: Synthetic peptide
  Seed: SFSSTLLSIF (MAGC1_HUMAN)
STSSTLLSIY

SEQ ID NO: 84542 - protein, 10 aa, Artificial Sequence
  Description of Artificial Sequence: Synthetic peptide
  Seed: LAMLKNTVPI (MAGC1_HUMAN)
LDMLKNTVPV

SEQ ID NO: 84543 - protein, 10 aa, Artificial Sequence
  Description of Artificial Sequence: Synthetic peptide
  Seed: ICSSSTSLSL (MAGC1_HUMAN)
ITSSSTSLSL

SEQ ID NO: 84544 - protein, 9 aa, Artificial Sequence
  Description of Artificial Sequence: Synthetic peptide
  Seed: KVVEFLAML (MAGC1_HUMAN)
KMVEFLAML

SEQ ID NO: 84545 - protein, 9 aa, Artificial Sequence
  Description of Artificial Sequence: Synthetic peptide
  Seed: VLSGIGVRA (MAGC1_HUMAN)
VVSGIGVRV

SEQ ID NO: 84546 - protein, 10 aa, Artificial Sequence
  Description of Artificial Sequence: Synthetic peptide
  Seed: ICSSSTSLSL (MAGC1_HUMAN)
ILSSSTSLSM

SEQ ID NO: 84547 - protein, 10 aa, Artificial Sequence
  Description of Artificial Sequence: Synthetic peptide
  Seed: FQSSLQSPVS (MAGC1_HUMAN)
FLSSLQSPVE

SEQ ID NO: 84548 - protein, 10 aa, Artificial Sequence
  Description of Artificial Sequence: Synthetic peptide
  Seed: LQIPGSPSFS (MAGC1_HUMAN)
LQIPGSPSFF

SEQ ID NO: 84549 - protein, 11 aa, Artificial Sequence
  Description of Artificial Sequence: Synthetic peptide
  Seed: SPLQNPASSFF (MAGC1_HUMAN)
SQLQNPASSFY

SEQ ID NO: 84550 - protein, 11 aa, Artificial Sequence
  Description of Artificial Sequence: Synthetic peptide
  Seed: IPVSPSFSSTL (MAGC1_HUMAN)
IAVSPSFSSTL

SEQ ID NO: 84551 - protein, 9 aa, Artificial Sequence
  Description of Artificial Sequence: Synthetic peptide
  Seed: GYFPVIFRK (MAGC1_HUMAN)
GLFPVIFRV

SEQ ID NO: 84552 - protein, 10 aa, Artificial Sequence
  Description of Artificial Sequence: Synthetic peptide
  Seed: LAMLKNTVPI (MAGC1_HUMAN)
LSMLKNTVPL

SEQ ID NO: 84553 - protein, 11 aa, Artificial Sequence
  Description of Artificial Sequence: Synthetic peptide
  Seed: TLDEKVDELAR (MAGC1_HUMAN)
TLDEKVDELAY

SEQ ID NO: 84554 - protein, 11 aa, Artificial Sequence
  Description of Artificial Sequence: Synthetic peptide
  Seed: IPVSSSFSYTL (MAGC1_HUMAN)
IPVSSSFSYTY

SEQ ID NO: 84555 - protein, 10 aa, Artificial Sequence
  Description of Artificial Sequence: Synthetic peptide
  Seed: ISRYTGYFPV (MAGC1_HUMAN)
ILRYTGYFPM

SEQ ID NO: 84556 - protein, 9 aa, Artificial Sequence
  Description of Artificial Sequence: Synthetic peptide
  Seed: SMSPLYFPQ (MAGC1_HUMAN)
SASPLYFPR

SEQ ID NO: 84557 - protein, 10 aa, Artificial Sequence
  Description of Artificial Sequence: Synthetic peptide
  Seed: ICSSSTPSSL (MAGC1_HUMAN)
IASSSTPSSW

SEQ ID NO: 84558 - protein, 9 aa, Artificial Sequence
  Description of Artificial Sequence: Synthetic peptide
  Seed: YVFVNTLDL (MAGC1_HUMAN)
YTFVNTLDW

SEQ ID NO: 84559 - protein, 9 aa, Artificial Sequence
  Description of Artificial Sequence: Synthetic peptide
  Seed: FLAMLKNTV (MAGC1_HUMAN)
FAAMLKNTM

SEQ ID NO: 84560 - protein, 10 aa, Artificial Sequence
  Description of Artificial Sequence: Synthetic peptide
  Seed: VISFSSSTSL (MAGC1_HUMAN)
VGSFSSSTSL

SEQ ID NO: 84561 - protein, 11 aa, Artificial Sequence
  Description of Artificial Sequence: Synthetic peptide
  Seed: SPLQIPVSRSF (MAGC1_HUMAN)
SYLQIPVSRSF

SEQ ID NO: 84562 - protein, 10 aa, Artificial Sequence
  Description of Artificial Sequence: Synthetic peptide
  Seed: SSPECTQSTF (MAGC1_HUMAN)
SVPECTQSTL

SEQ ID NO: 84563 - protein, 10 aa, Artificial Sequence
  Description of Artificial Sequence: Synthetic peptide
  Seed: SSSSSSSTLL (MAGC1_HUMAN)
SWSSSSSTLW

SEQ ID NO: 84564 - protein, 9 aa, Artificial Sequence
  Description of Artificial Sequence: Synthetic peptide
  Seed: ISFSSSTSL (MAGC1_HUMAN)
IKFSSSTSI

SEQ ID NO: 84565 - protein, 9 aa, Artificial Sequence
  Description of Artificial Sequence: Synthetic peptide
  Seed: VSAASSSTL (MAGC1_HUMAN)
VYAASSSTW

SEQ ID NO: 84566 - protein, 9 aa, Artificial Sequence
  Description of Artificial Sequence: Synthetic peptide
  Seed: DVLSGIGVR (MAGC1_HUMAN)
DSLSGIGVR

SEQ ID NO: 84567 - protein, 10 aa, Artificial Sequence
  Description of Artificial Sequence: Synthetic peptide
  Seed: LQIPVSRSFS (MAGC1_HUMAN)
LSIPVSRSFF

SEQ ID NO: 84568 - protein, 11 aa, Artificial Sequence
  Description of Artificial Sequence: Synthetic peptide
  Seed: SFFSSALLSIF (MAGC1_HUMAN)
SYFSSALLSIW

SEQ ID NO: 84569 - protein, 10 aa, Artificial Sequence
  Description of Artificial Sequence: Synthetic peptide
  Seed: VSSSFSYTLL (MAGC1_HUMAN)
VHSSFSYTLF

SEQ ID NO: 84570 - protein, 9 aa, Artificial Sequence
  Description of Artificial Sequence: Synthetic peptide
  Seed: VIWDVLSGI (MAGC1_HUMAN)
VAWDVLSGL

SEQ ID NO: 84571 - protein, 11 aa, Artificial Sequence
  Description of Artificial Sequence: Synthetic peptide
  Seed: SSFPSSTSSSL (MAGC1_HUMAN)
SGFPSSTSSSW

SEQ ID NO: 84572 - protein, 9 aa, Artificial Sequence
  Description of Artificial Sequence: Synthetic peptide
  Seed: TGYFPVIFR (MAGC1_HUMAN)
TQYFPVIFR

SEQ ID NO: 84573 - protein, 9 aa, Artificial Sequence
  Description of Artificial Sequence: Synthetic peptide
  Seed: LQRPVSSFF (MAGC1_HUMAN)
LSRPVSSFM

SEQ ID NO: 84574 - protein, 9 aa, Artificial Sequence
  Description of Artificial Sequence: Synthetic peptide
  Seed: GSPSFSSTL (MAGC1_HUMAN)
GIPSFSSTM

SEQ ID NO: 84575 - protein, 9 aa, Artificial Sequence
  Description of Artificial Sequence: Synthetic peptide
  Seed: SSSTLLSLF (MAGC1_HUMAN)
SASTLLSLW

SEQ ID NO: 84576 - protein, 9 aa, Artificial Sequence
  Description of Artificial Sequence: Synthetic peptide
  Seed: KDMPTAGMP (MAGC1_HUMAN)
KEMPTAGMP

SEQ ID NO: 84577 - protein, 10 aa, Artificial Sequence
  Description of Artificial Sequence: Synthetic peptide
  Seed: EVIWDVLSGI (MAGC1_HUMAN)
ESIWDVLSGF

SEQ ID NO: 84578 - protein, 11 aa, Artificial Sequence
  Description of Artificial Sequence: Synthetic peptide
  Seed: REVDPDDSYVF (MAGC1_HUMAN)
RVVDPDDSYVF

SEQ ID NO: 84579 - protein, 9 aa, Artificial Sequence
  Description of Artificial Sequence: Synthetic peptide
  Seed: RAHSEVIKR (MAGC1_HUMAN)
RQHSEVIKR

SEQ ID NO: 84580 - protein, 9 aa, Artificial Sequence
  Description of Artificial Sequence: Synthetic peptide
  Seed: RSFSSTLLS (MAGC1_HUMAN)
RMFSSTLLK

SEQ ID NO: 84581 - protein, 10 aa, Artificial Sequence
  Description of Artificial Sequence: Synthetic peptide
  Seed: SSPESAQSTF (MAGC1_HUMAN)
SYPESAQSTF

SEQ ID NO: 84582 - protein, 9 aa, Artificial Sequence
  Description of Artificial Sequence: Synthetic peptide
  Seed: SESLIESEP (MAGC1_HUMAN)
SESLIESEA

SEQ ID NO: 84583 - protein, 11 aa, Artificial Sequence
  Description of Artificial Sequence: Synthetic peptide
  Seed: REVDPDDSYVF (MAGC1_HUMAN)
RVVDPDDSYVL

SEQ ID NO: 84584 - protein, 9 aa, Artificial Sequence
  Description of Artificial Sequence: Synthetic peptide
  Seed: LSDEQGMSQ (MAGC1_HUMAN)
LVDEQGMSY

SEQ ID NO: 84585 - protein, 11 aa, Artificial Sequence
  Description of Artificial Sequence: Synthetic peptide
  Seed: SRYTGYFPVIF (MAGC1_HUMAN)
SMYTGYFPVIY

SEQ ID NO: 84586 - protein, 11 aa, Artificial Sequence
  Description of Artificial Sequence: Synthetic peptide
  Seed: KGTYASEEVIW (MAGC1_HUMAN)
KKTYASEEVIW

SEQ ID NO: 84587 - protein, 10 aa, Artificial Sequence
  Description of Artificial Sequence: Synthetic peptide
  Seed: ARFLLLKYQV (MAGC1_HUMAN)
ARFLLLKYQM

SEQ ID NO: 84588 - protein, 10 aa, Artificial Sequence
  Description of Artificial Sequence: Synthetic peptide
  Seed: FPQSVLQIPV (MAGC1_HUMAN)
FVQSVLQIPL

SEQ ID NO: 84589 - protein, 9 aa, Artificial Sequence
  Description of Artificial Sequence: Synthetic peptide
  Seed: LLSLFQSFS (MAGC1_HUMAN)
LLSLFQSFI

SEQ ID NO: 84590 - protein, 9 aa, Artificial Sequence
  Description of Artificial Sequence: Synthetic peptide
  Seed: ASSSTLVSI (MAGC1_HUMAN)
ATSSTLVSV

SEQ ID NO: 84591 - protein, 10 aa, Artificial Sequence
  Description of Artificial Sequence: Synthetic peptide
  Seed: SFSSTLLSIL (MAGC1_HUMAN)
SESSTLLSIW

SEQ ID NO: 84592 - protein, 10 aa, Artificial Sequence
  Description of Artificial Sequence: Synthetic peptide
  Seed: REHFAFGEPR (MAGC1_HUMAN)
RMHFAFGEPR

SEQ ID NO: 84593 - protein, 10 aa, Artificial Sequence
  Description of Artificial Sequence: Synthetic peptide
  Seed: MSQNRLLILI (MAGC1_HUMAN)
MQQNRLLILI

SEQ ID NO: 84594 - protein, 10 aa, Artificial Sequence
  Description of Artificial Sequence: Synthetic peptide
  Seed: SSPESAQSTF (MAGC1_HUMAN)
SCPESAQSTL

SEQ ID NO: 84595 - protein, 9 aa, Artificial Sequence
  Description of Artificial Sequence: Synthetic peptide
  Seed: FQSSLQSPV (MAGC1_HUMAN)
FMSSLQSPL

SEQ ID NO: 84596 - protein, 9 aa, Artificial Sequence
  Description of Artificial Sequence: Synthetic peptide
  Seed: VSSSFSYTL (MAGC1_HUMAN)
VESSFSYTM

SEQ ID NO: 84597 - protein, 10 aa, Artificial Sequence
  Description of Artificial Sequence: Synthetic peptide
  Seed: FPQSPLQIPV (MAGC1_HUMAN)
FQQSPLQIPI

SEQ ID NO: 84598 - protein, 10 aa, Artificial Sequence
  Description of Artificial Sequence: Synthetic peptide
  Seed: RYTGYFPVIF (MAGC1_HUMAN)
RDTGYFPVIW

SEQ ID NO: 84599 - protein, 10 aa, Artificial Sequence
  Description of Artificial Sequence: Synthetic peptide
  Seed: SFPSSTSSSL (MAGC1_HUMAN)
SDPSSTSSSM

SEQ ID NO: 84600 - protein, 10 aa, Artificial Sequence
  Description of Artificial Sequence: Synthetic peptide
  Seed: SPESPLQSPV (MAGC1_HUMAN)
SPESPLQSPF

SEQ ID NO: 84601 - protein, 9 aa, Artificial Sequence
  Description of Artificial Sequence: Synthetic peptide
  Seed: NTVPITFPS (MAGC1_HUMAN)
NIVPITFPM

SEQ ID NO: 84602 - protein, 9 aa, Artificial Sequence
  Description of Artificial Sequence: Synthetic peptide
  Seed: VSRSFSSTL (MAGC1_HUMAN)
VMRSFSSTL

SEQ ID NO: 84603 - protein, 10 aa, Artificial Sequence
  Description of Artificial Sequence: Synthetic peptide
  Seed: SFSSTLVSLF (MAGC1_HUMAN)
SASSTLVSLW

SEQ ID NO: 84604 - protein, 10 aa, Artificial Sequence
  Description of Artificial Sequence: Synthetic peptide
  Seed: VSLFQSSPER (MAGC1_HUMAN)
VLLFQSSPEK

SEQ ID NO: 84605 - protein, 9 aa, Artificial Sequence
  Description of Artificial Sequence: Synthetic peptide
  Seed: SSPESAQSA (MAGC1_HUMAN)
SCPESAQSF

SEQ ID NO: 84606 - protein, 10 aa, Artificial Sequence
  Description of Artificial Sequence: Synthetic peptide
  Seed: AEMLTNVISR (MAGC1_HUMAN)
ASMLTNVISR

SEQ ID NO: 84607 - protein, 10 aa, Artificial Sequence
  Description of Artificial Sequence: Synthetic peptide
  Seed: VSRSFSSTLL (MAGC1_HUMAN)
VGRSFSSTLK

SEQ ID NO: 84608 - protein, 9 aa, Artificial Sequence
  Description of Artificial Sequence: Synthetic peptide
  Seed: MGDKDMPTA (MAGC1_HUMAN)
MNDKDMPTL

SEQ ID NO: 84609 - protein, 9 aa, Artificial Sequence
  Description of Artificial Sequence: Synthetic peptide
  Seed: LKYQVKQPI (MAGC1_HUMAN)
LYYQVKQPF

SEQ ID NO: 84610 - protein, 10 aa, Artificial Sequence
  Description of Artificial Sequence: Synthetic peptide
  Seed: FQSSLQSPVS (MAGC1_HUMAN)
FISSLQSPVA

SEQ ID NO: 84611 - protein, 10 aa, Artificial Sequence
  Description of Artificial Sequence: Synthetic peptide
  Seed: KVDELARFLL (MAGC1_HUMAN)
KMDELARFLA

SEQ ID NO: 84612 - protein, 9 aa, Artificial Sequence
  Description of Artificial Sequence: Synthetic peptide
  Seed: TLDEKVDEL (MAGC1_HUMAN)
THDEKVDEW

SEQ ID NO: 84613 - protein, 11 aa, Artificial Sequence
  Description of Artificial Sequence: Synthetic peptide
  Seed: VSSSSSSSTLL (MAGC1_HUMAN)
VCSSSSSSTLF

SEQ ID NO: 84614 - protein, 9 aa, Artificial Sequence
  Description of Artificial Sequence: Synthetic peptide
  Seed: SPVSICSSS (MAGC1_HUMAN)
SPVSICSSI

SEQ ID NO: 84615 - protein, 9 aa, Artificial Sequence
  Description of Artificial Sequence: Synthetic peptide
  Seed: LQIPGSPSF (MAGC1_HUMAN)
LVIPGSPSF

SEQ ID NO: 84616 - protein, 9 aa, Artificial Sequence
  Description of Artificial Sequence: Synthetic peptide
  Seed: KVWVQEHYL (MAGC1_HUMAN)
KNWVQEHYY

SEQ ID NO: 84617 - protein, 9 aa, Artificial Sequence
  Description of Artificial Sequence: Synthetic peptide
  Seed: LSDEQGMSQ (MAGC1_HUMAN)
LYDEQGMSM

SEQ ID NO: 84618 - protein, 9 aa, Artificial Sequence
  Description of Artificial Sequence: Synthetic peptide
  Seed: SSSTLVSIF (MAGC1_HUMAN)
SVSTLVSIW

SEQ ID NO: 84619 - protein, 8 aa, Artificial Sequence
  Description of Artificial Sequence: Synthetic peptide
  Seed: SPLQSPVS (MAGC1_HUMAN)
SPLQSPVA

SEQ ID NO: 84620 - protein, 10 aa, Artificial Sequence
  Description of Artificial Sequence: Synthetic peptide
  Seed: KVVEFLAMLK (MAGC1_HUMAN)
KPVEFLAMLK

SEQ ID NO: 84621 - protein, 9 aa, Artificial Sequence
  Description of Artificial Sequence: Synthetic peptide
  Seed: EHFAFGEPR (MAGC1_HUMAN)
EGFAFGEPK

SEQ ID NO: 84622 - protein, 9 aa, Artificial Sequence
  Description of Artificial Sequence: Synthetic peptide
  Seed: MPTAGMPSL (MAGC1_HUMAN)
MSTAGMPSM

SEQ ID NO: 84623 - protein, 9 aa, Artificial Sequence
  Description of Artificial Sequence: Synthetic peptide
  Seed: KVDELARFL (MAGC1_HUMAN)
KYDELARFF

SEQ ID NO: 84624 - protein, 11 aa, Artificial Sequence
  Description of Artificial Sequence: Synthetic peptide
  Seed: SSSFSYTLLSL (MAGC1_HUMAN)
SMSFSYTLLSF

SEQ ID NO: 84625 - protein, 10 aa, Artificial Sequence
  Description of Artificial Sequence: Synthetic peptide
  Seed: REVDPDDSYV (MAGC1_HUMAN)
RLVDPDDSYF

SEQ ID NO: 84626 - protein, 9 aa, Artificial Sequence
  Description of Artificial Sequence: Synthetic peptide
  Seed: MTSSFSSTL (MAGC1_HUMAN)
MCSSFSSTF

SEQ ID NO: 84627 - protein, 10 aa, Artificial Sequence
  Description of Artificial Sequence: Synthetic peptide
  Seed: DVLSGIGVRA (MAGC1_HUMAN)
DTLSGIGVRF

SEQ ID NO: 84628 - protein, 9 aa, Artificial Sequence
  Description of Artificial Sequence: Synthetic peptide
  Seed: RTQSTFEGF (MAGC1_HUMAN)
RIQSTFEGF

SEQ ID NO: 84629 - protein, 10 aa, Artificial Sequence
  Description of Artificial Sequence: Synthetic peptide
  Seed: ASSSTLVSIF (MAGC1_HUMAN)
AASSTLVSIY

SEQ ID NO: 84630 - protein, 9 aa, Artificial Sequence
  Description of Artificial Sequence: Synthetic peptide
  Seed: TLDEKVDEL (MAGC1_HUMAN)
TWDEKVDEM

SEQ ID NO: 84631 - protein, 11 aa, Artificial Sequence
  Description of Artificial Sequence: Synthetic peptide
  Seed: STFEGFAQSSL (MAGC1_HUMAN)
STFEGFAQSSY

SEQ ID NO: 84632 - protein, 9 aa, Artificial Sequence
  Description of Artificial Sequence: Synthetic peptide
  Seed: VSSSFSYTL (MAGC1_HUMAN)
VMSSFSYTV

SEQ ID NO: 84633 - protein, 10 aa, Artificial Sequence
  Description of Artificial Sequence: Synthetic peptide
  Seed: LQIPGSPSFS (MAGC1_HUMAN)
LQIPGSPSFK

SEQ ID NO: 84634 - protein, 9 aa, Artificial Sequence
  Description of Artificial Sequence: Synthetic peptide
  Seed: RKVVEFLAM (MAGC1_HUMAN)
RIVVEFLAF

SEQ ID NO: 84635 - protein, 11 aa, Artificial Sequence
  Description of Artificial Sequence: Synthetic peptide
  Seed: SSSSSSTLLSL (MAGC1_HUMAN)
SDSSSSTLLSW

SEQ ID NO: 84636 - protein, 10 aa, Artificial Sequence
  Description of Artificial Sequence: Synthetic peptide
  Seed: PLQIPVSRSF (MAGC1_HUMAN)
PHQIPVSRSY

SEQ ID NO: 84637 - protein, 9 aa, Artificial Sequence
  Description of Artificial Sequence: Synthetic peptide
  Seed: FFSYTLASL (MAGC1_HUMAN)
FRSYTLASF

SEQ ID NO: 84638 - protein, 10 aa, Artificial Sequence
  Description of Artificial Sequence: Synthetic peptide
  Seed: FPQSLLQIPM (MAGC1_HUMAN)
FPQSLLQIPY

SEQ ID NO: 84639 - protein, 11 aa, Artificial Sequence
  Description of Artificial Sequence: Synthetic peptide
  Seed: SPVSSFPSSTS (MAGC1_HUMAN)
SPVSSFPSSTV

SEQ ID NO: 84640 - protein, 9 aa, Artificial Sequence
  Description of Artificial Sequence: Synthetic peptide
  Seed: MGDKDMPTA (MAGC1_HUMAN)
MLDKDMPTV

SEQ ID NO: 84641 - protein, 10 aa, Artificial Sequence
  Description of Artificial Sequence: Synthetic peptide
  Seed: TLDEKVDELA (MAGC1_HUMAN)
TTDEKVDELL

SEQ ID NO: 84642 - protein, 11 aa, Artificial Sequence
  Description of Artificial Sequence: Synthetic peptide
  Seed: TLDEKVDELAR (MAGC1_HUMAN)
TMDEKVDELAM

SEQ ID NO: 84643 - protein, 11 aa, Artificial Sequence
  Description of Artificial Sequence: Synthetic peptide
  Seed: IPVSRSFSSTL (MAGC1_HUMAN)
ISVSRSFSSTW

SEQ ID NO: 84644 - protein, 10 aa, Artificial Sequence
  Description of Artificial Sequence: Synthetic peptide
  Seed: TVPITFPSSY (MAGC1_HUMAN)
TQPITFPSSY

SEQ ID NO: 84645 - protein, 9 aa, Artificial Sequence
  Description of Artificial Sequence: Synthetic peptide
  Seed: FQSSPERTH (MAGC1_HUMAN)
FASSPERTY

SEQ ID NO: 84646 - protein, 9 aa, Artificial Sequence
  Description of Artificial Sequence: Synthetic peptide
  Seed: AGREHFAFG (MAGC1_HUMAN)
ASREHFAFV

SEQ ID NO: 84647 - protein, 11 aa, Artificial Sequence
  Description of Artificial Sequence: Synthetic peptide
  Seed: SPLQIPVSRSF (MAGC1_HUMAN)
SLLQIPVSRSY

SEQ ID NO: 84648 - protein, 11 aa, Artificial Sequence
  Description of Artificial Sequence: Synthetic peptide
  Seed: SPLQIPVSRSF (MAGC1_HUMAN)
SNLQIPVSRSF

SEQ ID NO: 84649 - protein, 9 aa, Artificial Sequence
  Description of Artificial Sequence: Synthetic peptide
  Seed: MTSSFSSTL (MAGC1_HUMAN)
MQSSFSSTS

SEQ ID NO: 84650 - protein, 10 aa, Artificial Sequence
  Description of Artificial Sequence: Synthetic peptide
  Seed: ICSSSTSLSL (MAGC1_HUMAN)
ITSSSTSLSY

SEQ ID NO: 84651 - protein, 10 aa, Artificial Sequence
  Description of Artificial Sequence: Synthetic peptide
  Seed: SPVSSFPSST (MAGC1_HUMAN)
SPVSSFPSSF

SEQ ID NO: 84652 - protein, 10 aa, Artificial Sequence
  Description of Artificial Sequence: Synthetic peptide
  Seed: RSFSSTLLSI (MAGC1_HUMAN)
RAFSSTLLSV

SEQ ID NO: 84653 - protein, 9 aa, Artificial Sequence
  Description of Artificial Sequence: Synthetic peptide
  Seed: GSPSFSSTL (MAGC1_HUMAN)
GMPSFSSTM

SEQ ID NO: 84654 - protein, 10 aa, Artificial Sequence
  Description of Artificial Sequence: Synthetic peptide
  Seed: SSPECTQSTF (MAGC1_HUMAN)
SIPECTQSTL

SEQ ID NO: 84655 - protein, 10 aa, Artificial Sequence
  Description of Artificial Sequence: Synthetic peptide
  Seed: TTDDSTATES (MAGC1_HUMAN)
TWDDSTATEM

SEQ ID NO: 84656 - protein, 9 aa, Artificial Sequence
  Description of Artificial Sequence: Synthetic peptide
  Seed: LQRPVSSFF (MAGC1_HUMAN)
LNRPVSSFY

SEQ ID NO: 84657 - protein, 9 aa, Artificial Sequence
  Description of Artificial Sequence: Synthetic peptide
  Seed: AQSPLQRPV (MAGC1_HUMAN)
AESPLQRPL

SEQ ID NO: 84658 - protein, 9 aa, Artificial Sequence
  Description of Artificial Sequence: Synthetic peptide
  Seed: GEDSLSPLQ (MAGC1_HUMAN)
GEDSLSPLI

SEQ ID NO: 84659 - protein, 11 aa, Artificial Sequence
  Description of Artificial Sequence: Synthetic peptide
  Seed: IPVSAASSSTL (MAGC1_HUMAN)
IYVSAASSSTF

SEQ ID NO: 84660 - protein, 9 aa, Artificial Sequence
  Description of Artificial Sequence: Synthetic peptide
  Seed: SSPERTHST (MAGC1_HUMAN)
SIPERTHSV

SEQ ID NO: 84661 - protein, 9 aa, Artificial Sequence
  Description of Artificial Sequence: Synthetic peptide
  Seed: MTSSFSSTL (MAGC1_HUMAN)
MPSSFSSTS

SEQ ID NO: 84662 - protein, 10 aa, Artificial Sequence
  Description of Artificial Sequence: Synthetic peptide
  Seed: STPSSLPQSF (MAGC1_HUMAN)
SVPSSLPQSM

SEQ ID NO: 84663 - protein, 9 aa, Artificial Sequence
  Description of Artificial Sequence: Synthetic peptide
  Seed: SLPEWEDSL (MAGC1_HUMAN)
SMPEWEDSV

SEQ ID NO: 84664 - protein, 9 aa, Artificial Sequence
  Description of Artificial Sequence: Synthetic peptide
  Seed: MTSSFSSTL (MAGC1_HUMAN)
MLSSFSSTT

SEQ ID NO: 84665 - protein, 10 aa, Artificial Sequence
  Description of Artificial Sequence: Synthetic peptide
  Seed: MTSSFSSTLL (MAGC1_HUMAN)
MKSSFSSTLM

SEQ ID NO: 84666 - protein, 9 aa, Artificial Sequence
  Description of Artificial Sequence: Synthetic peptide
  Seed: VSRSFSSTL (MAGC1_HUMAN)
VTRSFSSTW

SEQ ID NO: 84667 - protein, 9 aa, Artificial Sequence
  Description of Artificial Sequence: Synthetic peptide
  Seed: TLASLLQSS (MAGC1_HUMAN)
TAASLLQSL

SEQ ID NO: 84668 - protein, 9 aa, Artificial Sequence
  Description of Artificial Sequence: Synthetic peptide
  Seed: ALLSIFQSS (MAGC1_HUMAN)
ASLSIFQSL

SEQ ID NO: 84669 - protein, 9 aa, Artificial Sequence
  Description of Artificial Sequence: Synthetic peptide
  Seed: ESDDTLYPL (MAGC1_HUMAN)
ETDDTLYPA

SEQ ID NO: 84670 - protein, 9 aa, Artificial Sequence
  Description of Artificial Sequence: Synthetic peptide
  Seed: LQRPVSSFF (MAGC1_HUMAN)
LARPVSSFL

SEQ ID NO: 84671 - protein, 11 aa, Artificial Sequence
  Description of Artificial Sequence: Synthetic peptide
  Seed: QSSPESAQSTF (MAGC1_HUMAN)
QMSPESAQSTY

SEQ ID NO: 84672 - protein, 9 aa, Artificial Sequence
  Description of Artificial Sequence: Synthetic peptide
  Seed: SPLQRPVSS (MAGC1_HUMAN)
SMLQRPVSL

SEQ ID NO: 84673 - protein, 9 aa, Artificial Sequence
  Description of Artificial Sequence: Synthetic peptide
  Seed: SSFPSSTSS (MAGC1_HUMAN)
SNFPSSTSY

SEQ ID NO: 84674 - protein, 9 aa, Artificial Sequence
  Description of Artificial Sequence: Synthetic peptide
  Seed: LILILSIIF (MAGC1_HUMAN)
LQLILSIIY

SEQ ID NO: 84675 - protein, 10 aa, Artificial Sequence
  Description of Artificial Sequence: Synthetic peptide
  Seed: FAFGEPRELL (MAGC1_HUMAN)
FPFGEPRELM

SEQ ID NO: 84676 - protein, 9 aa, Artificial Sequence
  Description of Artificial Sequence: Synthetic peptide
  Seed: FTYTLDEKV (MAGC1_HUMAN)
FRYTLDEKL

SEQ ID NO: 84677 - protein, 9 aa, Artificial Sequence
  Description of Artificial Sequence: Synthetic peptide
  Seed: FSYTLASLL (MAGC1_HUMAN)
FQYTLASLA

SEQ ID NO: 84678 - protein, 9 aa, Artificial Sequence
  Description of Artificial Sequence: Synthetic peptide
  Seed: TPSSLPQSF (MAGC1_HUMAN)
TSSSLPQSF

SEQ ID NO: 84679 - protein, 9 aa, Artificial Sequence
  Description of Artificial Sequence: Synthetic peptide
  Seed: VSRSFSSTL (MAGC1_HUMAN)
VHRSFSSTY

SEQ ID NO: 84680 - protein, 10 aa, Artificial Sequence
  Description of Artificial Sequence: Synthetic peptide
  Seed: FQSSLQSPVS (MAGC1_HUMAN)
FLSSLQSPVS

SEQ ID NO: 84681 - protein, 9 aa, Artificial Sequence
  Description of Artificial Sequence: Synthetic peptide
  Seed: SPPEGENTH (MAGC1_HUMAN)
SSPEGENTF

SEQ ID NO: 84682 - protein, 9 aa, Artificial Sequence
  Description of Artificial Sequence: Synthetic peptide
  Seed: LQIPVSPSF (MAGC1_HUMAN)
LRIPVSPSL

SEQ ID NO: 84683 - protein, 10 aa, Artificial Sequence
  Description of Artificial Sequence: Synthetic peptide
  Seed: SSSSTLLSLF (MAGC1_HUMAN)
SLSSTLLSLF

SEQ ID NO: 84684 - protein, 10 aa, Artificial Sequence
  Description of Artificial Sequence: Synthetic peptide
  Seed: SSFPSSTSSS (MAGC1_HUMAN)
SSFPSSTSSY

SEQ ID NO: 84685 - protein, 9 aa, Artificial Sequence
  Description of Artificial Sequence: Synthetic peptide
  Seed: VPNSSPPRY (MAGC1_HUMAN)
VPNSSPPRF

SEQ ID NO: 84686 - protein, 9 aa, Artificial Sequence
  Description of Artificial Sequence: Synthetic peptide
  Seed: HFPQSPPEW (MAGC1_HUMAN)
HRPQSPPEY

SEQ ID NO: 84687 - protein, 9 aa, Artificial Sequence
  Description of Artificial Sequence: Synthetic peptide
  Seed: TLLSLFQSF (MAGC1_HUMAN)
TSLSLFQSL

SEQ ID NO: 84688 - protein, 11 aa, Artificial Sequence
  Description of Artificial Sequence: Synthetic peptide
  Seed: SPLQIPGSPSF (MAGC1_HUMAN)
SVLQIPGSPSF

SEQ ID NO: 84689 - protein, 11 aa, Artificial Sequence
  Description of Artificial Sequence: Synthetic peptide
  Seed: AMLKNTVPITF (MAGC1_HUMAN)
AVLKNTVPITY

SEQ ID NO: 84690 - protein, 9 aa, Artificial Sequence
  Description of Artificial Sequence: Synthetic peptide
  Seed: IPVSSSFSY (MAGC1_HUMAN)
IKVSSSFSY

SEQ ID NO: 84691 - protein, 10 aa, Artificial Sequence
  Description of Artificial Sequence: Synthetic peptide
  Seed: SVLQIPVSAA (MAGC1_HUMAN)
SVLQIPVSAL

SEQ ID NO: 84692 - protein, 9 aa, Artificial Sequence
  Description of Artificial Sequence: Synthetic peptide
  Seed: FSSTLLSLF (MAGC1_HUMAN)
FISTLLSLI

SEQ ID NO: 84693 - protein, 9 aa, Artificial Sequence
  Description of Artificial Sequence: Synthetic peptide
  Seed: NTHSPLQIV (MAGC1_HUMAN)
NVHSPLQIL

SEQ ID NO: 84694 - protein, 9 aa, Artificial Sequence
  Description of Artificial Sequence: Synthetic peptide
  Seed: EILFGISLR (MAGC1_HUMAN)
EMLFGISLK

SEQ ID NO: 84695 - protein, 10 aa, Artificial Sequence
  Description of Artificial Sequence: Synthetic peptide
  Seed: KVVEFLAMLK (MAGC1_HUMAN)
KDVEFLAMLK

SEQ ID NO: 84696 - protein, 10 aa, Artificial Sequence
  Description of Artificial Sequence: Synthetic peptide
  Seed: VSSSSSSSTL (MAGC1_HUMAN)
VFSSSSSSTY

SEQ ID NO: 84697 - protein, 10 aa, Artificial Sequence
  Description of Artificial Sequence: Synthetic peptide
  Seed: VISFSSSTSL (MAGC1_HUMAN)
VLSFSSSTSM

SEQ ID NO: 84698 - protein, 11 aa, Artificial Sequence
  Description of Artificial Sequence: Synthetic peptide
  Seed: MSPLYFPQSPL (MAGC1_HUMAN)
MAPLYFPQSPY

SEQ ID NO: 84699 - protein, 9 aa, Artificial Sequence
  Description of Artificial Sequence: Synthetic peptide
  Seed: VSSSSSSTL (MAGC1_HUMAN)
VMSSSSSTL

SEQ ID NO: 84700 - protein, 10 aa, Artificial Sequence
  Description of Artificial Sequence: Synthetic peptide
  Seed: ITKAEMLTNV (MAGC1_HUMAN)
IMKAEMLTNA

SEQ ID NO: 84701 - protein, 9 aa, Artificial Sequence
  Description of Artificial Sequence: Synthetic peptide
  Seed: SSSSTLLSL (MAGC1_HUMAN)
SISSTLLSL

SEQ ID NO: 84702 - protein, 9 aa, Artificial Sequence
  Description of Artificial Sequence: Synthetic peptide
  Seed: IPVSRSFSS (MAGC1_HUMAN)
IPVSRSFSA

SEQ ID NO: 84703 - protein, 9 aa, Artificial Sequence
  Description of Artificial Sequence: Synthetic peptide
  Seed: TLLSLFQSF (MAGC1_HUMAN)
TWLSLFQSF

SEQ ID NO: 84704 - protein, 9 aa, Artificial Sequence
  Description of Artificial Sequence: Synthetic peptide
  Seed: VSPSSSSTL (MAGC1_HUMAN)
VAPSSSSTI

SEQ ID NO: 84705 - protein, 10 aa, Artificial Sequence
  Description of Artificial Sequence: Synthetic peptide
  Seed: SSSSSSSTLL (MAGC1_HUMAN)
SFSSSSSTLF

SEQ ID NO: 84706 - protein, 11 aa, Artificial Sequence
  Description of Artificial Sequence: Synthetic peptide
  Seed: SPLQIPVSPSS (MAGC1_HUMAN)
SILQIPVSPSY

SEQ ID NO: 84707 - protein, 11 aa, Artificial Sequence
  Description of Artificial Sequence: Synthetic peptide
  Seed: NTVPITFPSSY (MAGC1_HUMAN)
NVVPITFPSSR

SEQ ID NO: 84708 - protein, 9 aa, Artificial Sequence
  Description of Artificial Sequence: Synthetic peptide
  Seed: FSEESSSPV (MAGC1_HUMAN)
FLEESSSPA

SEQ ID NO: 84709 - protein, 9 aa, Artificial Sequence
  Description of Artificial Sequence: Synthetic peptide
  Seed: YTGYFPVIF (MAGC1_HUMAN)
YYGYFPVII

SEQ ID NO: 84710 - protein, 10 aa, Artificial Sequence
  Description of Artificial Sequence: Synthetic peptide
  Seed: LAMLKNTVPI (MAGC1_HUMAN)
LHMLKNTVPM

SEQ ID NO: 84711 - protein, 9 aa, Artificial Sequence
  Description of Artificial Sequence: Synthetic peptide
  Seed: SKSSPESPL (MAGC1_HUMAN)
SASSPESPF

SEQ ID NO: 84712 - protein, 10 aa, Artificial Sequence
  Description of Artificial Sequence: Synthetic peptide
  Seed: LSKSSPESPL (MAGC1_HUMAN)
LTKSSPESPF

SEQ ID NO: 84713 - protein, 9 aa, Artificial Sequence
  Description of Artificial Sequence: Synthetic peptide
  Seed: SPERTHSTF (MAGC1_HUMAN)
SMERTHSTY

SEQ ID NO: 84714 - protein, 11 aa, Artificial Sequence
  Description of Artificial Sequence: Synthetic peptide
  Seed: SLQIPVSPSFS (MAGC1_HUMAN)
SMQIPVSPSFF

SEQ ID NO: 84715 - protein, 9 aa, Artificial Sequence
  Description of Artificial Sequence: Synthetic peptide
  Seed: SFFSYTLAS (MAGC1_HUMAN)
SAFSYTLAY

SEQ ID NO: 84716 - protein, 11 aa, Artificial Sequence
  Description of Artificial Sequence: Synthetic peptide
  Seed: STFEGFPQSLL (MAGC1_HUMAN)
SLFEGFPQSLP

SEQ ID NO: 84717 - protein, 9 aa, Artificial Sequence
  Description of Artificial Sequence: Synthetic peptide
  Seed: SFSYTLLSL (MAGC1_HUMAN)
SWSYTLLSY

SEQ ID NO: 84718 - protein, 10 aa, Artificial Sequence
  Description of Artificial Sequence: Synthetic peptide
  Seed: FPQSVLQIPV (MAGC1_HUMAN)
FLQSVLQIPI

SEQ ID NO: 84719 - protein, 9 aa, Artificial Sequence
  Description of Artificial Sequence: Synthetic peptide
  Seed: LQIVPSLPE (MAGC1_HUMAN)
LAIVPSLPY

SEQ ID NO: 84720 - protein, 9 aa, Artificial Sequence
  Description of Artificial Sequence: Synthetic peptide
  Seed: IESEPLFTY (MAGC1_HUMAN)
ISSEPLFTL

SEQ ID NO: 84721 - protein, 11 aa, Artificial Sequence
  Description of Artificial Sequence: Synthetic peptide
  Seed: ISRYTGYFPVI (MAGC1_HUMAN)
ITRYTGYFPVK

SEQ ID NO: 84722 - protein, 10 aa, Artificial Sequence
  Description of Artificial Sequence: Synthetic peptide
  Seed: LSIIFIKGTY (MAGC1_HUMAN)
LTIIFIKGTY

SEQ ID NO: 84723 - protein, 8 aa, Artificial Sequence
  Description of Artificial Sequence: Synthetic peptide
  Seed: IKRKVVEF (MAGC1_HUMAN)
IQRKVVEF

SEQ ID NO: 84724 - protein, 11 aa, Artificial Sequence
  Description of Artificial Sequence: Synthetic peptide
  Seed: SLIESEPLFTY (MAGC1_HUMAN)
SLIESEPLFTR

SEQ ID NO: 84725 - protein, 9 aa, Artificial Sequence
  Description of Artificial Sequence: Synthetic peptide
  Seed: SQNRLLILI (MAGC1_HUMAN)
SHNRLLILL

SEQ ID NO: 84726 - protein, 9 aa, Artificial Sequence
  Description of Artificial Sequence: Synthetic peptide
  Seed: SSSDTLLES (MAGC1_HUMAN)
SGSDTLLEL

SEQ ID NO: 84727 - protein, 10 aa, Artificial Sequence
  Description of Artificial Sequence: Synthetic peptide
  Seed: LLKYQVKQPI (MAGC1_HUMAN)
LMKYQVKQPV

SEQ ID NO: 84728 - protein, 10 aa, Artificial Sequence
  Description of Artificial Sequence: Synthetic peptide
  Seed: RSFSSTLLSI (MAGC1_HUMAN)
RGFSSTLLSY

SEQ ID NO: 84729 - protein, 10 aa, Artificial Sequence
  Description of Artificial Sequence: Synthetic peptide
  Seed: VSSSFSYTLL (MAGC1_HUMAN)
VHSSFSYTLW

SEQ ID NO: 84730 - protein, 11 aa, Artificial Sequence
  Description of Artificial Sequence: Synthetic peptide
  Seed: FLAMLKNTVPI (MAGC1_HUMAN)
FGAMLKNTVPL

SEQ ID NO: 84731 - protein, 10 aa, Artificial Sequence
  Description of Artificial Sequence: Synthetic peptide
  Seed: RFLLLKYQVK (MAGC1_HUMAN)
RLLLLKYQVR

SEQ ID NO: 84732 - protein, 9 aa, Artificial Sequence
  Description of Artificial Sequence: Synthetic peptide
  Seed: FQSSLQSPV (MAGC1_HUMAN)
FLSSLQSPL

SEQ ID NO: 84733 - protein, 10 aa, Artificial Sequence
  Description of Artificial Sequence: Synthetic peptide
  Seed: REHFAFGEPR (MAGC1_HUMAN)
RIHFAFGEPR

SEQ ID NO: 84734 - protein, 9 aa, Artificial Sequence
  Description of Artificial Sequence: Synthetic peptide
  Seed: SPLQIVPSL (MAGC1_HUMAN)
STLQIVPSL

SEQ ID NO: 84735 - protein, 9 aa, Artificial Sequence
  Description of Artificial Sequence: Synthetic peptide
  Seed: VSAASSSTL (MAGC1_HUMAN)
VAAASSSTW

SEQ ID NO: 84736 - protein, 9 aa, Artificial Sequence
  Description of Artificial Sequence: Synthetic peptide
  Seed: RSFSSTLLS (MAGC1_HUMAN)
RNFSSTLLY

SEQ ID NO: 84737 - protein, 9 aa, Artificial Sequence
  Description of Artificial Sequence: Synthetic peptide
  Seed: GSPSFSSTL (MAGC1_HUMAN)
GMPSFSSTY

SEQ ID NO: 84738 - protein, 9 aa, Artificial Sequence
  Description of Artificial Sequence: Synthetic peptide
  Seed: AQSPLQIPV (MAGC1_HUMAN)
AASPLQIPL

SEQ ID NO: 84739 - protein, 9 aa, Artificial Sequence
  Description of Artificial Sequence: Synthetic peptide
  Seed: FSSALLSIF (MAGC1_HUMAN)
FSSALLSIM

SEQ ID NO: 84740 - protein, 9 aa, Artificial Sequence
  Description of Artificial Sequence: Synthetic peptide
  Seed: FPSSTSSSL (MAGC1_HUMAN)
FQSSTSSSF

SEQ ID NO: 84741 - protein, 9 aa, Artificial Sequence
  Description of Artificial Sequence: Synthetic peptide
  Seed: SSFFSSALL (MAGC1_HUMAN)
SEFFSSALY

SEQ ID NO: 84742 - protein, 9 aa, Artificial Sequence
  Description of Artificial Sequence: Synthetic peptide
  Seed: SPLQIPQSP (MAGC1_HUMAN)
SPLQIPQSL

SEQ ID NO: 84743 - protein, 10 aa, Artificial Sequence
  Description of Artificial Sequence: Synthetic peptide
  Seed: SSPERTHSTF (MAGC1_HUMAN)
SMPERTHSTI

SEQ ID NO: 84744 - protein, 9 aa, Artificial Sequence
  Description of Artificial Sequence: Synthetic peptide
  Seed: LQIPVSRSF (MAGC1_HUMAN)
LDIPVSRSL

SEQ ID NO: 84745 - protein, 9 aa, Artificial Sequence
  Description of Artificial Sequence: Synthetic peptide
  Seed: VSSSSSSTL (MAGC1_HUMAN)
VVSSSSSTF

SEQ ID NO: 84746 - protein, 9 aa, Artificial Sequence
  Description of Artificial Sequence: Synthetic peptide
  Seed: SSPEGKDSL (MAGC1_HUMAN)
SFPEGKDSF

SEQ ID NO: 84747 - protein, 10 aa, Artificial Sequence
  Description of Artificial Sequence: Synthetic peptide
  Seed: SPLQIVPSLP (MAGC1_HUMAN)
SPLQIVPSLL

SEQ ID NO: 84748 - protein, 10 aa, Artificial Sequence
  Description of Artificial Sequence: Synthetic peptide
  Seed: SSSSSTLLSL (MAGC1_HUMAN)
SVSSSTLLSA

SEQ ID NO: 84749 - protein, 11 aa, Artificial Sequence
  Description of Artificial Sequence: Synthetic peptide
  Seed: RPVSSFFSYTL (MAGC1_HUMAN)
RTVSSFFSYTW

SEQ ID NO: 84750 - protein, 9 aa, Artificial Sequence
  Description of Artificial Sequence: Synthetic peptide
  Seed: RTHSTFEGF (MAGC1_HUMAN)
RRHSTFEGF

SEQ ID NO: 84751 - protein, 10 aa, Artificial Sequence
  Description of Artificial Sequence: Synthetic peptide
  Seed: SSPESTQSPF (MAGC1_HUMAN)
SMPESTQSPF

SEQ ID NO: 84752 - protein, 10 aa, Artificial Sequence
  Description of Artificial Sequence: Synthetic peptide
  Seed: YASEEVIWDV (MAGC1_HUMAN)
YQSEEVIWDA

SEQ ID NO: 84753 - protein, 10 aa, Artificial Sequence
  Description of Artificial Sequence: Synthetic peptide
  Seed: LQIPMTSSFS (MAGC1_HUMAN)
LAIPMTSSFY

SEQ ID NO: 84754 - protein, 9 aa, Artificial Sequence
  Description of Artificial Sequence: Synthetic peptide
  Seed: SPLQSPVSS (MAGC1_HUMAN)
STLQSPVSF

SEQ ID NO: 84755 - protein, 10 aa, Artificial Sequence
  Description of Artificial Sequence: Synthetic peptide
  Seed: MPTAGMPSLL (MAGC1_HUMAN)
MHTAGMPSLI

SEQ ID NO: 84756 - protein, 10 aa, Artificial Sequence
  Description of Artificial Sequence: Synthetic peptide
  Seed: RYTGYFPVIF (MAGC1_HUMAN)
RCTGYFPVIW

SEQ ID NO: 84757 - protein, 9 aa, Artificial Sequence
  Description of Artificial Sequence: Synthetic peptide
  Seed: VSRSFSSTL (MAGC1_HUMAN)
VNRSFSSTY

SEQ ID NO: 84758 - protein, 10 aa, Artificial Sequence
  Description of Artificial Sequence: Synthetic peptide
  Seed: SSPESTQSPF (MAGC1_HUMAN)
SKPESTQSPM

SEQ ID NO: 84759 - protein, 9 aa, Artificial Sequence
  Description of Artificial Sequence: Synthetic peptide
  Seed: TLLSIFQSS (MAGC1_HUMAN)
TTLSIFQSA

SEQ ID NO: 84760 - protein, 11 aa, Artificial Sequence
  Description of Artificial Sequence: Synthetic peptide
  Seed: SPLQIPVSSSS (MAGC1_HUMAN)
SGLQIPVSSSF

SEQ ID NO: 84761 - protein, 10 aa, Artificial Sequence
  Description of Artificial Sequence: Synthetic peptide
  Seed: LQIPVSPSFS (MAGC1_HUMAN)
LQIPVSPSFM

SEQ ID NO: 84762 - protein, 11 aa, Artificial Sequence
  Description of Artificial Sequence: Synthetic peptide
  Seed: QSSPECTQSTF (MAGC1_HUMAN)
QSSPECTQSTW

SEQ ID NO: 84763 - protein, 9 aa, Artificial Sequence
  Description of Artificial Sequence: Synthetic peptide
  Seed: ISFSSSTSL (MAGC1_HUMAN)
IRFSSSTSF

SEQ ID NO: 84764 - protein, 9 aa, Artificial Sequence
  Description of Artificial Sequence: Synthetic peptide
  Seed: SAQSAFEGF (MAGC1_HUMAN)
SRQSAFEGF

SEQ ID NO: 84765 - protein, 11 aa, Artificial Sequence
  Description of Artificial Sequence: Synthetic peptide
  Seed: SPLQNPASSFF (MAGC1_HUMAN)
SQLQNPASSFF

SEQ ID NO: 84766 - protein, 11 aa, Artificial Sequence
  Description of Artificial Sequence: Synthetic peptide
  Seed: IPVSSSFSYTL (MAGC1_HUMAN)
ILVSSSFSYTF

SEQ ID NO: 84767 - protein, 10 aa, Artificial Sequence
  Description of Artificial Sequence: Synthetic peptide
  Seed: YTGYFPVIFR (MAGC1_HUMAN)
YHGYFPVIFR

SEQ ID NO: 84768 - protein, 8 aa, Artificial Sequence
  Description of Artificial Sequence: Synthetic peptide
  Seed: IWDVLSGI (MAGC1_HUMAN)
ITDVLSGI

SEQ ID NO: 84769 - protein, 10 aa, Artificial Sequence
  Description of Artificial Sequence: Synthetic peptide
  Seed: FAQSSLQIPV (MAGC1_HUMAN)
FCQSSLQIPV

SEQ ID NO: 84770 - protein, 9 aa, Artificial Sequence
  Description of Artificial Sequence: Synthetic peptide
  Seed: EGDDTQSPL (MAGC1_HUMAN)
ETDDTQSPL

SEQ ID NO: 84771 - protein, 10 aa, Artificial Sequence
  Description of Artificial Sequence: Synthetic peptide
  Seed: SSFSYTLLSL (MAGC1_HUMAN)
SAFSYTLLSV

SEQ ID NO: 84772 - protein, 11 aa, Artificial Sequence
  Description of Artificial Sequence: Synthetic peptide
  Seed: FQSSLQSPVSI (MAGC1_HUMAN)
FMSSLQSPVSY

SEQ ID NO: 84773 - protein, 10 aa, Artificial Sequence
  Description of Artificial Sequence: Synthetic peptide
  Seed: PLQNPASSFF (MAGC1_HUMAN)
PYQNPASSFY

SEQ ID NO: 84774 - protein, 10 aa, Artificial Sequence
  Description of Artificial Sequence: Synthetic peptide
  Seed: ICSSSTPSSL (MAGC1_HUMAN)
ILSSSTPSSW

SEQ ID NO: 84775 - protein, 10 aa, Artificial Sequence
  Description of Artificial Sequence: Synthetic peptide
  Seed: KGTYASEEVI (MAGC1_HUMAN)
KDTYASEEVW

SEQ ID NO: 84776 - protein, 10 aa, Artificial Sequence
  Description of Artificial Sequence: Synthetic peptide
  Seed: MTSSFSSTLL (MAGC1_HUMAN)
MMSSFSSTLA

SEQ ID NO: 84777 - protein, 11 aa, Artificial Sequence
  Description of Artificial Sequence: Synthetic peptide
  Seed: SLIESEPLFTY (MAGC1_HUMAN)
SQIESEPLFTF

SEQ ID NO: 84778 - protein, 9 aa, Artificial Sequence
  Description of Artificial Sequence: Synthetic peptide
  Seed: LSPLHFPQF (MAGC1_HUMAN)
LSPLHFPQV

SEQ ID NO: 84779 - protein, 10 aa, Artificial Sequence
  Description of Artificial Sequence: Synthetic peptide
  Seed: SSFSYTLLSL (MAGC1_HUMAN)
SLFSYTLLST

SEQ ID NO: 84780 - protein, 10 aa, Artificial Sequence
  Description of Artificial Sequence: Synthetic peptide
  Seed: KAEMLTNVIS (MAGC1_HUMAN)
KQEMLTNVIA

SEQ ID NO: 84781 - protein, 10 aa, Artificial Sequence
  Description of Artificial Sequence: Synthetic peptide
  Seed: EVIWDVLSGI (MAGC1_HUMAN)
EFIWDVLSGL

SEQ ID NO: 84782 - protein, 9 aa, Artificial Sequence
  Description of Artificial Sequence: Synthetic peptide
  Seed: IEILFGISL (MAGC1_HUMAN)
IKILFGISF

SEQ ID NO: 84783 - protein, 9 aa, Artificial Sequence
  Description of Artificial Sequence: Synthetic peptide
  Seed: KVVEFLAML (MAGC1_HUMAN)
KIVEFLAMI

SEQ ID NO: 84784 - protein, 10 aa, Artificial Sequence
  Description of Artificial Sequence: Synthetic peptide
  Seed: SLIESEPLFT (MAGC1_HUMAN)
SAIESEPLFV

SEQ ID NO: 84785 - protein, 9 aa, Artificial Sequence
  Description of Artificial Sequence: Synthetic peptide
  Seed: SSPESPLQS (MAGC1_HUMAN)
SYPESPLQL

SEQ ID NO: 84786 - protein, 10 aa, Artificial Sequence
  Description of Artificial Sequence: Synthetic peptide
  Seed: LQIPGSPSFS (MAGC1_HUMAN)
LMIPGSPSFA

SEQ ID NO: 84787 - protein, 9 aa, Artificial Sequence
  Description of Artificial Sequence: Synthetic peptide
  Seed: AQSPLQSPV (MAGC1_HUMAN)
AASPLQSPV

SEQ ID NO: 84788 - protein, 9 aa, Artificial Sequence
  Description of Artificial Sequence: Synthetic peptide
  Seed: DSYVFVNTL (MAGC1_HUMAN)
DAYVFVNTV

SEQ ID NO: 84789 - protein, 10 aa, Artificial Sequence
  Description of Artificial Sequence: Synthetic peptide
  Seed: PLQIPVSRSF (MAGC1_HUMAN)
PSQIPVSRSY

SEQ ID NO: 84790 - protein, 10 aa, Artificial Sequence
  Description of Artificial Sequence: Synthetic peptide
  Seed: VSSSFSYTLL (MAGC1_HUMAN)
VHSSFSYTLY

SEQ ID NO: 84791 - protein, 10 aa, Artificial Sequence
  Description of Artificial Sequence: Synthetic peptide
  Seed: SFSSTLVSLF (MAGC1_HUMAN)
SMSSTLVSLW

SEQ ID NO: 84792 - protein, 11 aa, Artificial Sequence
  Description of Artificial Sequence: Synthetic peptide
  Seed: IPMTSSFSSTL (MAGC1_HUMAN)
IRMTSSFSSTW

SEQ ID NO: 84793 - protein, 11 aa, Artificial Sequence
  Description of Artificial Sequence: Synthetic peptide
  Seed: REVDPDDSYVF (MAGC1_HUMAN)
RVVDPDDSYVI

SEQ ID NO: 84794 - protein, 9 aa, Artificial Sequence
  Description of Artificial Sequence: Synthetic peptide
  Seed: SSFFSSALL (MAGC1_HUMAN)
SLFFSSALA

SEQ ID NO: 84795 - protein, 9 aa, Artificial Sequence
  Description of Artificial Sequence: Synthetic peptide
  Seed: KAREFIEIL (MAGC1_HUMAN)
KYREFIEIA

SEQ ID NO: 84796 - protein, 9 aa, Artificial Sequence
  Description of Artificial Sequence: Synthetic peptide
  Seed: FLWGPRAHS (MAGC1_HUMAN)
FMWGPRAHV

SEQ ID NO: 84797 - protein, 11 aa, Artificial Sequence
  Description of Artificial Sequence: Synthetic peptide
  Seed: MSPLYFPQSPL (MAGC1_HUMAN)
MYPLYFPQSPV

SEQ ID NO: 84798 - protein, 9 aa, Artificial Sequence
  Description of Artificial Sequence: Synthetic peptide
  Seed: SFFSYTLAS (MAGC1_HUMAN)
SLFSYTLAM

SEQ ID NO: 84799 - protein, 9 aa, Artificial Sequence
  Description of Artificial Sequence: Synthetic peptide
  Seed: FPSSTSSSL (MAGC1_HUMAN)
FKSSTSSSF

SEQ ID NO: 84800 - protein, 9 aa, Artificial Sequence
  Description of Artificial Sequence: Synthetic peptide
  Seed: EDFQSSLQS (MAGC1_HUMAN)
EEFQSSLQV

SEQ ID NO: 84801 - protein, 9 aa, Artificial Sequence
  Description of Artificial Sequence: Synthetic peptide
  Seed: SRYTGYFPV (MAGC1_HUMAN)
SHYTGYFPA

SEQ ID NO: 84802 - protein, 10 aa, Artificial Sequence
  Description of Artificial Sequence: Synthetic peptide
  Seed: FPQSLLQIPM (MAGC1_HUMAN)
FLQSLLQIPI

SEQ ID NO: 84803 - protein, 9 aa, Artificial Sequence
  Description of Artificial Sequence: Synthetic peptide
  Seed: KVVEFLAML (MAGC1_HUMAN)
KIVEFLAMV

SEQ ID NO: 84804 - protein, 9 aa, Artificial Sequence
  Description of Artificial Sequence: Synthetic peptide
  Seed: FSEESSSPV (MAGC1_HUMAN)
FIEESSSPL

SEQ ID NO: 84805 - protein, 9 aa, Artificial Sequence
  Description of Artificial Sequence: Synthetic peptide
  Seed: AQSSLQIPV (MAGC1_HUMAN)
AMSSLQIPY

SEQ ID NO: 84806 - protein, 9 aa, Artificial Sequence
  Description of Artificial Sequence: Synthetic peptide
  Seed: RAHSEVIKR (MAGC1_HUMAN)
RVHSEVIKK

SEQ ID NO: 84807 - protein, 9 aa, Artificial Sequence
  Description of Artificial Sequence: Synthetic peptide
  Seed: FQSSLQSPV (MAGC1_HUMAN)
FTSSLQSPY

SEQ ID NO: 84808 - protein, 9 aa, Artificial Sequence
  Description of Artificial Sequence: Synthetic peptide
  Seed: DEQGMSQNR (MAGC1_HUMAN)
DFQGMSQNR

SEQ ID NO: 84809 - protein, 9 aa, Artificial Sequence
  Description of Artificial Sequence: Synthetic peptide
  Seed: SSPERTHST (MAGC1_HUMAN)
SVPERTHSM

SEQ ID NO: 84810 - protein, 9 aa, Artificial Sequence
  Description of Artificial Sequence: Synthetic peptide
  Seed: AFGEPRELL (MAGC1_HUMAN)
AFGEPRELF

SEQ ID NO: 84811 - protein, 10 aa, Artificial Sequence
  Description of Artificial Sequence: Synthetic peptide
  Seed: SFFSYTLASL (MAGC1_HUMAN)
SWFSYTLASF

SEQ ID NO: 84812 - protein, 11 aa, Artificial Sequence
  Description of Artificial Sequence: Synthetic peptide
  Seed: SSFPSSTSSSL (MAGC1_HUMAN)
SPFPSSTSSSY

SEQ ID NO: 84813 - protein, 10 aa, Artificial Sequence
  Description of Artificial Sequence: Synthetic peptide
  Seed: TTDDSTATES (MAGC1_HUMAN)
TTDDSTATEF

SEQ ID NO: 84814 - protein, 10 aa, Artificial Sequence
  Description of Artificial Sequence: Synthetic peptide
  Seed: LSQSSPVSSF (MAGC1_HUMAN)
LDQSSPVSSY

SEQ ID NO: 84815 - protein, 9 aa, Artificial Sequence
  Description of Artificial Sequence: Synthetic peptide
  Seed: YTSSSDTLL (MAGC1_HUMAN)
YLSSSDTLI

SEQ ID NO: 84816 - protein, 11 aa, Artificial Sequence
  Description of Artificial Sequence: Synthetic peptide
  Seed: IPMTSSFSSTL (MAGC1_HUMAN)
IEMTSSFSSTW

SEQ ID NO: 84817 - protein, 9 aa, Artificial Sequence
  Description of Artificial Sequence: Synthetic peptide
  Seed: SQSPPEGPV (MAGC1_HUMAN)
SQSPPEGPL

SEQ ID NO: 84818 - protein, 10 aa, Artificial Sequence
  Description of Artificial Sequence: Synthetic peptide
  Seed: SSFSSTLLSI (MAGC1_HUMAN)
SQFSSTLLSL

SEQ ID NO: 84819 - protein, 10 aa, Artificial Sequence
  Description of Artificial Sequence: Synthetic peptide
  Seed: GENTHSPLQI (MAGC1_HUMAN)
GENTHSPLQM

SEQ ID NO: 84820 - protein, 9 aa, Artificial Sequence
  Description of Artificial Sequence: Synthetic peptide
  Seed: SSSTLVSIF (MAGC1_HUMAN)
STSTLVSIY

SEQ ID NO: 84821 - protein, 11 aa, Artificial Sequence
  Description of Artificial Sequence: Synthetic peptide
  Seed: IPVSSSFSYTL (MAGC1_HUMAN)
ISVSSSFSYTM

SEQ ID NO: 84822 - protein, 9 aa, Artificial Sequence
  Description of Artificial Sequence: Synthetic peptide
  Seed: IEILFGISL (MAGC1_HUMAN)
IRILFGISY

SEQ ID NO: 84823 - protein, 9 aa, Artificial Sequence
  Description of Artificial Sequence: Synthetic peptide
  Seed: QIVPSLPEW (MAGC1_HUMAN)
QLVPSLPEL

SEQ ID NO: 84824 - protein, 9 aa, Artificial Sequence
  Description of Artificial Sequence: Synthetic peptide
  Seed: AMLKNTVPI (MAGC1_HUMAN)
AELKNTVPF

SEQ ID NO: 84825 - protein, 10 aa, Artificial Sequence
  Description of Artificial Sequence: Synthetic peptide
  Seed: FPQSPLQIPV (MAGC1_HUMAN)
FMQSPLQIPL

SEQ ID NO: 84826 - protein, 8 aa, Artificial Sequence
  Description of Artificial Sequence: Synthetic peptide
  Seed: FGEPRELL (MAGC1_HUMAN)
FSEPRELL

SEQ ID NO: 84827 - protein, 9 aa, Artificial Sequence
  Description of Artificial Sequence: Synthetic peptide
  Seed: LQIPGSPSF (MAGC1_HUMAN)
LYIPGSPSM

SEQ ID NO: 84828 - protein, 9 aa, Artificial Sequence
  Description of Artificial Sequence: Synthetic peptide
  Seed: VQSPLQNPA (MAGC1_HUMAN)
VESPLQNPL

SEQ ID NO: 84829 - protein, 9 aa, Artificial Sequence
  Description of Artificial Sequence: Synthetic peptide
  Seed: MTSSFSSTL (MAGC1_HUMAN)
MLSSFSSTL

SEQ ID NO: 84830 - protein, 10 aa, Artificial Sequence
  Description of Artificial Sequence: Synthetic peptide
  Seed: MPTAGMPSLL (MAGC1_HUMAN)
MITAGMPSLY

SEQ ID NO: 84831 - protein, 11 aa, Artificial Sequence
  Description of Artificial Sequence: Synthetic peptide
  Seed: RYTGYFPVIFR (MAGC1_HUMAN)
RWTGYFPVIFF

SEQ ID NO: 84832 - protein, 9 aa, Artificial Sequence
  Description of Artificial Sequence: Synthetic peptide
  Seed: DSYVFVNTL (MAGC1_HUMAN)
DVYVFVNTY

SEQ ID NO: 84833 - protein, 9 aa, Artificial Sequence
  Description of Artificial Sequence: Synthetic peptide
  Seed: SASSSVMSP (MAGC1_HUMAN)
STSSSVMSY

SEQ ID NO: 84834 - protein, 10 aa, Artificial Sequence
  Description of Artificial Sequence: Synthetic peptide
  Seed: EVIWDVLSGI (MAGC1_HUMAN)
EVIWDVLSGV

SEQ ID NO: 84835 - protein, 9 aa, Artificial Sequence
  Description of Artificial Sequence: Synthetic peptide
  Seed: VSSSSSSTL (MAGC1_HUMAN)
VKSSSSSTL

SEQ ID NO: 84836 - protein, 10 aa, Artificial Sequence
  Description of Artificial Sequence: Synthetic peptide
  Seed: FFSYTLASLL (MAGC1_HUMAN)
FRSYTLASLF

SEQ ID NO: 84837 - protein, 10 aa, Artificial Sequence
  Description of Artificial Sequence: Synthetic peptide
  Seed: VISFSSSTSL (MAGC1_HUMAN)
VGSFSSSTSY

SEQ ID NO: 84838 - protein, 9 aa, Artificial Sequence
  Description of Artificial Sequence: Synthetic peptide
  Seed: AQSPLQSPV (MAGC1_HUMAN)
AISPLQSPY

SEQ ID NO: 84839 - protein, 9 aa, Artificial Sequence
  Description of Artificial Sequence: Synthetic peptide
  Seed: GYFPVIFRK (MAGC1_HUMAN)
GGFPVIFRR

SEQ ID NO: 84840 - protein, 10 aa, Artificial Sequence
  Description of Artificial Sequence: Synthetic peptide
  Seed: SSPESAQSAF (MAGC1_HUMAN)
SKPESAQSAM

SEQ ID NO: 84841 - protein, 10 aa, Artificial Sequence
  Description of Artificial Sequence: Synthetic peptide
  Seed: ASSFFSSALL (MAGC1_HUMAN)
AWSFFSSALY

SEQ ID NO: 84842 - protein, 9 aa, Artificial Sequence
  Description of Artificial Sequence: Synthetic peptide
  Seed: KDVEERAQA (MAGC1_HUMAN)
KEVEERAQI

SEQ ID NO: 84843 - protein, 10 aa, Artificial Sequence
  Description of Artificial Sequence: Synthetic peptide
  Seed: RPVSSFFSYT (MAGC1_HUMAN)
RPVSSFFSYI

SEQ ID NO: 84844 - protein, 9 aa, Artificial Sequence
  Description of Artificial Sequence: Synthetic peptide
  Seed: SPPEGMHSQ (MAGC1_HUMAN)
SPPEGMHSV

SEQ ID NO: 84845 - protein, 9 aa, Artificial Sequence
  Description of Artificial Sequence: Synthetic peptide
  Seed: SSSVMSPSF (MAGC1_HUMAN)
SQSVMSPSW

SEQ ID NO: 84846 - protein, 9 aa, Artificial Sequence
  Description of Artificial Sequence: Synthetic peptide
  Seed: SPPQGEDSL (MAGC1_HUMAN)
SLPQGEDSM

SEQ ID NO: 84847 - protein, 9 aa, Artificial Sequence
  Description of Artificial Sequence: Synthetic peptide
  Seed: SFPSSTSSS (MAGC1_HUMAN)
SYPSSTSSA

SEQ ID NO: 84848 - protein, 9 aa, Artificial Sequence
  Description of Artificial Sequence: Synthetic peptide
  Seed: TLDEKVDEL (MAGC1_HUMAN)
TSDEKVDEY

SEQ ID NO: 84849 - protein, 9 aa, Artificial Sequence
  Description of Artificial Sequence: Synthetic peptide
  Seed: VQSPLHSPQ (MAGC1_HUMAN)
VKSPLHSPM

SEQ ID NO: 84850 - protein, 9 aa, Artificial Sequence
  Description of Artificial Sequence: Synthetic peptide
  Seed: SFSERTQST (MAGC1_HUMAN)
SYSERTQSV

SEQ ID NO: 84851 - protein, 10 aa, Artificial Sequence
  Description of Artificial Sequence: Synthetic peptide
  Seed: VSSSSSSSTL (MAGC1_HUMAN)
VASSSSSSTW

SEQ ID NO: 84852 - protein, 9 aa, Artificial Sequence
  Description of Artificial Sequence: Synthetic peptide
  Seed: SSPERTHST (MAGC1_HUMAN)
SMPERTHSY

SEQ ID NO: 84853 - protein, 9 aa, Artificial Sequence
  Description of Artificial Sequence: Synthetic peptide
  Seed: RTHSTFEGF (MAGC1_HUMAN)
RSHSTFEGA

SEQ ID NO: 84854 - protein, 9 aa, Artificial Sequence
  Description of Artificial Sequence: Synthetic peptide
  Seed: HYFPQSPPQ (MAGC1_HUMAN)
HYFPQSPPI

SEQ ID NO: 84855 - protein, 9 aa, Artificial Sequence
  Description of Artificial Sequence: Synthetic peptide
  Seed: TLDEKVDEL (MAGC1_HUMAN)
TGDEKVDEF

SEQ ID NO: 84856 - protein, 9 aa, Artificial Sequence
  Description of Artificial Sequence: Synthetic peptide
  Seed: SSPPRYEFL (MAGC1_HUMAN)
SVPPRYEFI

SEQ ID NO: 84857 - protein, 9 aa, Artificial Sequence
  Description of Artificial Sequence: Synthetic peptide
  Seed: NTHSPLQIV (MAGC1_HUMAN)
NAHSPLQIH

SEQ ID NO: 84858 - protein, 9 aa, Artificial Sequence
  Description of Artificial Sequence: Synthetic peptide
  Seed: ASSSTLVSI (MAGC1_HUMAN)
AQSSTLVSW

SEQ ID NO: 84859 - protein, 9 aa, Artificial Sequence
  Description of Artificial Sequence: Synthetic peptide
  Seed: AGREHFAFG (MAGC1_HUMAN)
AMREHFAFS

SEQ ID NO: 84860 - protein, 9 aa, Artificial Sequence
  Description of Artificial Sequence: Synthetic peptide
  Seed: KDSQSPLQI (MAGC1_HUMAN)
KDSQSPLQL

SEQ ID NO: 84861 - protein, 11 aa, Artificial Sequence
  Description of Artificial Sequence: Synthetic peptide
  Seed: SSFPSSTSSSL (MAGC1_HUMAN)
SLFPSSTSSSL

SEQ ID NO: 84862 - protein, 9 aa, Artificial Sequence
  Description of Artificial Sequence: Synthetic peptide
  Seed: FSYTLLSLF (MAGC1_HUMAN)
FWYTLLSLW

SEQ ID NO: 84863 - protein, 9 aa, Artificial Sequence
  Description of Artificial Sequence: Synthetic peptide
  Seed: KVVEFLAML (MAGC1_HUMAN)
KTVEFLAMA

SEQ ID NO: 84864 - protein, 10 aa, Artificial Sequence
  Description of Artificial Sequence: Synthetic peptide
  Seed: NPASSFFSSA (MAGC1_HUMAN)
NVASSFFSSA

SEQ ID NO: 84865 - protein, 10 aa, Artificial Sequence
  Description of Artificial Sequence: Synthetic peptide
  Seed: SFSSTLVSLF (MAGC1_HUMAN)
SHSSTLVSLW

SEQ ID NO: 84866 - protein, 8 aa, Artificial Sequence
  Description of Artificial Sequence: Synthetic peptide
  Seed: SSFFSSAL (MAGC1_HUMAN)
SMFFSSAF

SEQ ID NO: 84867 - protein, 9 aa, Artificial Sequence
  Description of Artificial Sequence: Synthetic peptide
  Seed: MTSSFSSTL (MAGC1_HUMAN)
MKSSFSSTL

SEQ ID NO: 84868 - protein, 9 aa, Artificial Sequence
  Description of Artificial Sequence: Synthetic peptide
  Seed: VQSPLQNPA (MAGC1_HUMAN)
VASPLQNPF

SEQ ID NO: 84869 - protein, 9 aa, Artificial Sequence
  Description of Artificial Sequence: Synthetic peptide
  Seed: LQIPVSSSS (MAGC1_HUMAN)
LEIPVSSSF

SEQ ID NO: 84870 - protein, 9 aa, Artificial Sequence
  Description of Artificial Sequence: Synthetic peptide
  Seed: REVDPDDSY (MAGC1_HUMAN)
REVDPDDSV

SEQ ID NO: 84871 - protein, 10 aa, Artificial Sequence
  Description of Artificial Sequence: Synthetic peptide
  Seed: RKVVEFLAML (MAGC1_HUMAN)
RPVVEFLAMV

SEQ ID NO: 84872 - protein, 9 aa, Artificial Sequence
  Description of Artificial Sequence: Synthetic peptide
  Seed: FSSTLLSIL (MAGC1_HUMAN)
FPSTLLSII

SEQ ID NO: 84873 - protein, 9 aa, Artificial Sequence
  Description of Artificial Sequence: Synthetic peptide
  Seed: MPSLLQSSS (MAGC1_HUMAN)
MPSLLQSSY

SEQ ID NO: 84874 - protein, 9 aa, Artificial Sequence
  Description of Artificial Sequence: Synthetic peptide
  Seed: CTQSTFEGF (MAGC1_HUMAN)
CAQSTFEGW

SEQ ID NO: 84875 - protein, 9 aa, Artificial Sequence
  Description of Artificial Sequence: Synthetic peptide
  Seed: SSPESPLQS (MAGC1_HUMAN)
SVPESPLQI

SEQ ID NO: 84876 - protein, 10 aa, Artificial Sequence
  Description of Artificial Sequence: Synthetic peptide
  Seed: SLQIPVSPSF (MAGC1_HUMAN)
SWQIPVSPSY

SEQ ID NO: 84877 - protein, 9 aa, Artificial Sequence
  Description of Artificial Sequence: Synthetic peptide
  Seed: SPLQIVPSL (MAGC1_HUMAN)
SHLQIVPSL

SEQ ID NO: 84878 - protein, 11 aa, Artificial Sequence
  Description of Artificial Sequence: Synthetic peptide
  Seed: SPLQIPGSPSF (MAGC1_HUMAN)
SFLQIPGSPSY

SEQ ID NO: 84879 - protein, 11 aa, Artificial Sequence
  Description of Artificial Sequence: Synthetic peptide
  Seed: SLFQSSPERTH (MAGC1_HUMAN)
SLFQSSPERTF

SEQ ID NO: 84880 - protein, 9 aa, Artificial Sequence
  Description of Artificial Sequence: Synthetic peptide
  Seed: LQIPVSSSS (MAGC1_HUMAN)
LPIPVSSSY

SEQ ID NO: 84881 - protein, 9 aa, Artificial Sequence
  Description of Artificial Sequence: Synthetic peptide
  Seed: SQSPPEGPV (MAGC1_HUMAN)
SGSPPEGPY

SEQ ID NO: 84882 - protein, 10 aa, Artificial Sequence
  Description of Artificial Sequence: Synthetic peptide
  Seed: SPLQIPVSPS (MAGC1_HUMAN)
SPLQIPVSPF

SEQ ID NO: 84883 - protein, 9 aa, Artificial Sequence
  Description of Artificial Sequence: Synthetic peptide
  Seed: LQIPGSPSF (MAGC1_HUMAN)
LEIPGSPSY

SEQ ID NO: 84884 - protein, 9 aa, Artificial Sequence
  Description of Artificial Sequence: Synthetic peptide
  Seed: LQIPVSPSF (MAGC1_HUMAN)
LSIPVSPSV

SEQ ID NO: 84885 - protein, 10 aa, Artificial Sequence
  Description of Artificial Sequence: Synthetic peptide
  Seed: KAREFIEILF (MAGC1_HUMAN)
KSREFIEILY

SEQ ID NO: 84886 - protein, 9 aa, Artificial Sequence
  Description of Artificial Sequence: Synthetic peptide
  Seed: SSLSQSSPV (MAGC1_HUMAN)
SVLSQSSPL

SEQ ID NO: 84887 - protein, 8 aa, Artificial Sequence
  Description of Artificial Sequence: Synthetic peptide
  Seed: KVDELARF (MAGC1_HUMAN)
KADELARL

SEQ ID NO: 84888 - protein, 9 aa, Artificial Sequence
  Description of Artificial Sequence: Synthetic peptide
  Seed: VSSFFSYTL (MAGC1_HUMAN)
VQSFFSYTF

SEQ ID NO: 84889 - protein, 10 aa, Artificial Sequence
  Description of Artificial Sequence: Synthetic peptide
  Seed: SSSSSTLLSL (MAGC1_HUMAN)
SISSSTLLSF

SEQ ID NO: 84890 - protein, 10 aa, Artificial Sequence
  Description of Artificial Sequence: Synthetic peptide
  Seed: ASSSTLVSIF (MAGC1_HUMAN)
AMSSTLVSIY

SEQ ID NO: 84891 - protein, 9 aa, Artificial Sequence
  Description of Artificial Sequence: Synthetic peptide
  Seed: FFSYTLASL (MAGC1_HUMAN)
FVSYTLASI

SEQ ID NO: 84892 - protein, 9 aa, Artificial Sequence
  Description of Artificial Sequence: Synthetic peptide
  Seed: KVDELARFL (MAGC1_HUMAN)
KGDELARFV

SEQ ID NO: 84893 - protein, 10 aa, Artificial Sequence
  Description of Artificial Sequence: Synthetic peptide
  Seed: FPQSLLQIPM (MAGC1_HUMAN)
FTQSLLQIPA

SEQ ID NO: 84894 - protein, 10 aa, Artificial Sequence
  Description of Artificial Sequence: Synthetic peptide
  Seed: STPSSLPQSF (MAGC1_HUMAN)
SMPSSLPQSM

SEQ ID NO: 84895 - protein, 10 aa, Artificial Sequence
  Description of Artificial Sequence: Synthetic peptide
  Seed: LSQSSPVSSF (MAGC1_HUMAN)
LCQSSPVSSF

SEQ ID NO: 84896 - protein, 10 aa, Artificial Sequence
  Description of Artificial Sequence: Synthetic peptide
  Seed: SLQIPVSPSF (MAGC1_HUMAN)
SDQIPVSPSF

SEQ ID NO: 84897 - protein, 10 aa, Artificial Sequence
  Description of Artificial Sequence: Synthetic peptide
  Seed: KVDELARFLL (MAGC1_HUMAN)
KMDELARFLM

SEQ ID NO: 84898 - protein, 9 aa, Artificial Sequence
  Description of Artificial Sequence: Synthetic peptide
  Seed: RTHSTFEGF (MAGC1_HUMAN)
RWHSTFEGI

SEQ ID NO: 84899 - protein, 10 aa, Artificial Sequence
  Description of Artificial Sequence: Synthetic peptide
  Seed: FFSSALLSIF (MAGC1_HUMAN)
FGSSALLSIF

SEQ ID NO: 84900 - protein, 11 aa, Artificial Sequence
  Description of Artificial Sequence: Synthetic peptide
  Seed: FLAMLKNTVPI (MAGC1_HUMAN)
FHAMLKNTVPV

SEQ ID NO: 84901 - protein, 9 aa, Artificial Sequence
  Description of Artificial Sequence: Synthetic peptide
  Seed: SSPESDDTL (MAGC1_HUMAN)
SHPESDDTM

SEQ ID NO: 84902 - protein, 9 aa, Artificial Sequence
  Description of Artificial Sequence: Synthetic peptide
  Seed: SLPEWEDSL (MAGC1_HUMAN)
STPEWEDSV

SEQ ID NO: 84903 - protein, 9 aa, Artificial Sequence
  Description of Artificial Sequence: Synthetic peptide
  Seed: SSSESPQSC (MAGC1_HUMAN)
SASESPQSF

SEQ ID NO: 84904 - protein, 11 aa, Artificial Sequence
  Description of Artificial Sequence: Synthetic peptide
  Seed: SPLQNPASSFF (MAGC1_HUMAN)
SPLQNPASSFW

SEQ ID NO: 84905 - protein, 10 aa, Artificial Sequence
  Description of Artificial Sequence: Synthetic peptide
  Seed: RPVSSFFSYT (MAGC1_HUMAN)
RWVSSFFSYA

SEQ ID NO: 84906 - protein, 9 aa, Artificial Sequence
  Description of Artificial Sequence: Synthetic peptide
  Seed: DVLSGIGVR (MAGC1_HUMAN)
DTLSGIGVY

SEQ ID NO: 84907 - protein, 10 aa, Artificial Sequence
  Description of Artificial Sequence: Synthetic peptide
  Seed: SLFQSSPERT (MAGC1_HUMAN)
SLFQSSPERL

SEQ ID NO: 84908 - protein, 10 aa, Artificial Sequence
  Description of Artificial Sequence: Synthetic peptide
  Seed: RLLILILSII (MAGC1_HUMAN)
RLLILILSIV

SEQ ID NO: 84909 - protein, 10 aa, Artificial Sequence
  Description of Artificial Sequence: Synthetic peptide
  Seed: RSFSSTLLSI (MAGC1_HUMAN)
RFFSSTLLSI

SEQ ID NO: 84910 - protein, 9 aa, Artificial Sequence
  Description of Artificial Sequence: Synthetic peptide
  Seed: SPLQIPMTS (MAGC1_HUMAN)
STLQIPMTV

SEQ ID NO: 84911 - protein, 9 aa, Artificial Sequence
  Description of Artificial Sequence: Synthetic peptide
  Seed: SSPERTQST (MAGC1_HUMAN)
SMPERTQSY

SEQ ID NO: 84912 - protein, 9 aa, Artificial Sequence
  Description of Artificial Sequence: Synthetic peptide
  Seed: FSSALLSIF (MAGC1_HUMAN)
FESALLSIM

SEQ ID NO: 84913 - protein, 9 aa, Artificial Sequence
  Description of Artificial Sequence: Synthetic peptide
  Seed: VSPSSSSTL (MAGC1_HUMAN)
VIPSSSSTF

SEQ ID NO: 84914 - protein, 10 aa, Artificial Sequence
  Description of Artificial Sequence: Synthetic peptide
  Seed: SPSFSSTLLS (MAGC1_HUMAN)
SPSFSSTLLL

SEQ ID NO: 84915 - protein, 9 aa, Artificial Sequence
  Description of Artificial Sequence: Synthetic peptide
  Seed: YTLLSLFQS (MAGC1_HUMAN)
YMLLSLFQM

SEQ ID NO: 84916 - protein, 9 aa, Artificial Sequence
  Description of Artificial Sequence: Synthetic peptide
  Seed: WVQEHYLEY (MAGC1_HUMAN)
WAQEHYLEV

SEQ ID NO: 84917 - protein, 9 aa, Artificial Sequence
  Description of Artificial Sequence: Synthetic peptide
  Seed: IPVSSSFSY (MAGC1_HUMAN)
IEVSSSFSY

SEQ ID NO: 84918 - protein, 10 aa, Artificial Sequence
  Description of Artificial Sequence: Synthetic peptide
  Seed: LQIPGSPSFS (MAGC1_HUMAN)
LQIPGSPSFV

SEQ ID NO: 84919 - protein, 9 aa, Artificial Sequence
  Description of Artificial Sequence: Synthetic peptide
  Seed: SPLQIPMTS (MAGC1_HUMAN)
SILQIPMTI

SEQ ID NO: 84920 - protein, 9 aa, Artificial Sequence
  Description of Artificial Sequence: Synthetic peptide
  Seed: VVEFLAMLK (MAGC1_HUMAN)
VSEFLAMLY

SEQ ID NO: 84921 - protein, 9 aa, Artificial Sequence
  Description of Artificial Sequence: Synthetic peptide
  Seed: SLIESEPLF (MAGC1_HUMAN)
SAIESEPLM

SEQ ID NO: 84922 - protein, 11 aa, Artificial Sequence
  Description of Artificial Sequence: Synthetic peptide
  Seed: SPLQIPVSSSS (MAGC1_HUMAN)
SGLQIPVSSSY

SEQ ID NO: 84923 - protein, 10 aa, Artificial Sequence
  Description of Artificial Sequence: Synthetic peptide
  Seed: FPQSLLQIPM (MAGC1_HUMAN)
FGQSLLQIPV

SEQ ID NO: 84924 - protein, 9 aa, Artificial Sequence
  Description of Artificial Sequence: Synthetic peptide
  Seed: SSSSTLLSL (MAGC1_HUMAN)
SRSSTLLSL

SEQ ID NO: 84925 - protein, 10 aa, Artificial Sequence
  Description of Artificial Sequence: Synthetic peptide
  Seed: FPQSPLQIPV (MAGC1_HUMAN)
FYQSPLQIPV

SEQ ID NO: 84926 - protein, 10 aa, Artificial Sequence
  Description of Artificial Sequence: Synthetic peptide
  Seed: LQIPVSSSFS (MAGC1_HUMAN)
LMIPVSSSFS

SEQ ID NO: 84927 - protein, 10 aa, Artificial Sequence
  Description of Artificial Sequence: Synthetic peptide
  Seed: SPLQNPASSF (MAGC1_HUMAN)
SALQNPASSM

SEQ ID NO: 84928 - protein, 10 aa, Artificial Sequence
  Description of Artificial Sequence: Synthetic peptide
  Seed: ICSSSTSLSL (MAGC1_HUMAN)
IISSSTSLSW

SEQ ID NO: 84929 - protein, 9 aa, Artificial Sequence
  Description of Artificial Sequence: Synthetic peptide
  Seed: KVVEFLAML (MAGC1_HUMAN)
KLVEFLAMI

SEQ ID NO: 84930 - protein, 9 aa, Artificial Sequence
  Description of Artificial Sequence: Synthetic peptide
  Seed: IIDTTDDST (MAGC1_HUMAN)
INDTTDDSM

SEQ ID NO: 84931 - protein, 10 aa, Artificial Sequence
  Description of Artificial Sequence: Synthetic peptide
  Seed: ICSSSTSLSL (MAGC1_HUMAN)
IESSSTSLSM

SEQ ID NO: 84932 - protein, 10 aa, Artificial Sequence
  Description of Artificial Sequence: Synthetic peptide
  Seed: TGYFPVIFRK (MAGC1_HUMAN)
TAYFPVIFRT

SEQ ID NO: 84933 - protein, 10 aa, Artificial Sequence
  Description of Artificial Sequence: Synthetic peptide
  Seed: YTLLSLFQSS (MAGC1_HUMAN)
YVLLSLFQSL

SEQ ID NO: 84934 - protein, 9 aa, Artificial Sequence
  Description of Artificial Sequence: Synthetic peptide
  Seed: VSRSFSSTL (MAGC1_HUMAN)
VLRSFSSTF

SEQ ID NO: 84935 - protein, 9 aa, Artificial Sequence
  Description of Artificial Sequence: Synthetic peptide
  Seed: WVQEHYLEY (MAGC1_HUMAN)
WPQEHYLEF

SEQ ID NO: 84936 - protein, 9 aa, Artificial Sequence
  Description of Artificial Sequence: Synthetic peptide
  Seed: FSYTLLSLF (MAGC1_HUMAN)
FEYTLLSLF

SEQ ID NO: 84937 - protein, 9 aa, Artificial Sequence
  Description of Artificial Sequence: Synthetic peptide
  Seed: LTKVWVQEH (MAGC1_HUMAN)
LVKVWVQEY

SEQ ID NO: 84938 - protein, 10 aa, Artificial Sequence
  Description of Artificial Sequence: Synthetic peptide
  Seed: TGYFPVIFRK (MAGC1_HUMAN)
TGYFPVIFRR

SEQ ID NO: 84939 - protein, 9 aa, Artificial Sequence
  Description of Artificial Sequence: Synthetic peptide
  Seed: MTSSFSSTL (MAGC1_HUMAN)
MRSSFSSTM

SEQ ID NO: 84940 - protein, 10 aa, Artificial Sequence
  Description of Artificial Sequence: Synthetic peptide
  Seed: RSFSSTLLSI (MAGC1_HUMAN)
RYFSSTLLSY

SEQ ID NO: 84941 - protein, 9 aa, Artificial Sequence
  Description of Artificial Sequence: Synthetic peptide
  Seed: VIWDVLSGI (MAGC1_HUMAN)
VSWDVLSGR

SEQ ID NO: 84942 - protein, 9 aa, Artificial Sequence
  Description of Artificial Sequence: Synthetic peptide
  Seed: FPSSYKDAL (MAGC1_HUMAN)
FLSSYKDAY

SEQ ID NO: 84943 - protein, 9 aa, Artificial Sequence
  Description of Artificial Sequence: Synthetic peptide
  Seed: SLSPHYFPQ (MAGC1_HUMAN)
SMSPHYFPL

SEQ ID NO: 84944 - protein, 9 aa, Artificial Sequence
  Description of Artificial Sequence: Synthetic peptide
  Seed: LQIPVSPSF (MAGC1_HUMAN)
LTIPVSPSW

SEQ ID NO: 84945 - protein, 9 aa, Artificial Sequence
  Description of Artificial Sequence: Synthetic peptide
  Seed: SSPESTQSP (MAGC1_HUMAN)
SSPESTQSV

SEQ ID NO: 84946 - protein, 10 aa, Artificial Sequence
  Description of Artificial Sequence: Synthetic peptide
  Seed: MLKNTVPITF (MAGC1_HUMAN)
MHKNTVPITY

SEQ ID NO: 84947 - protein, 9 aa, Artificial Sequence
  Description of Artificial Sequence: Synthetic peptide
  Seed: NTHSPLQIV (MAGC1_HUMAN)
NTHSPLQIF

SEQ ID NO: 84948 - protein, 9 aa, Artificial Sequence
  Description of Artificial Sequence: Synthetic peptide
  Seed: MLTNVISRY (MAGC1_HUMAN)
MATNVISRY

SEQ ID NO: 84949 - protein, 9 aa, Artificial Sequence
  Description of Artificial Sequence: Synthetic peptide
  Seed: SAPEGEDSL (MAGC1_HUMAN)
SLPEGEDSV

SEQ ID NO: 84950 - protein, 10 aa, Artificial Sequence
  Description of Artificial Sequence: Synthetic peptide
  Seed: PLQIPVSRSF (MAGC1_HUMAN)
PMQIPVSRSM

SEQ ID NO: 84951 - protein, 9 aa, Artificial Sequence
  Description of Artificial Sequence: Synthetic peptide
  Seed: RSFSSTLLS (MAGC1_HUMAN)
RVFSSTLLI

SEQ ID NO: 84952 - protein, 11 aa, Artificial Sequence
  Description of Artificial Sequence: Synthetic peptide
  Seed: QSSPECTQSTF (MAGC1_HUMAN)
QGSPECTQSTW

SEQ ID NO: 84953 - protein, 9 aa, Artificial Sequence
  Description of Artificial Sequence: Synthetic peptide
  Seed: HFPQSPPEW (MAGC1_HUMAN)
HMPQSPPEF

SEQ ID NO: 84954 - protein, 9 aa, Artificial Sequence
  Description of Artificial Sequence: Synthetic peptide
  Seed: SPHYFPQSP (MAGC1_HUMAN)
SPHYFPQSA

SEQ ID NO: 84955 - protein, 10 aa, Artificial Sequence
  Description of Artificial Sequence: Synthetic peptide
  Seed: YTLASLLQSS (MAGC1_HUMAN)
YYLASLLQSM

SEQ ID NO: 84956 - protein, 8 aa, Artificial Sequence
  Description of Artificial Sequence: Synthetic peptide
  Seed: SSFSSTLL (MAGC1_HUMAN)
SQFSSTLV

SEQ ID NO: 84957 - protein, 9 aa, Artificial Sequence
  Description of Artificial Sequence: Synthetic peptide
  Seed: TLDEKVDEL (MAGC1_HUMAN)
TFDEKVDEA

SEQ ID NO: 84958 - protein, 10 aa, Artificial Sequence
  Description of Artificial Sequence: Synthetic peptide
  Seed: FPQSPLQIPV (MAGC1_HUMAN)
FHQSPLQIPV

SEQ ID NO: 84959 - protein, 10 aa, Artificial Sequence
  Description of Artificial Sequence: Synthetic peptide
  Seed: LQIVPSLPEW (MAGC1_HUMAN)
LVIVPSLPEF

SEQ ID NO: 84960 - protein, 10 aa, Artificial Sequence
  Description of Artificial Sequence: Synthetic peptide
  Seed: WGPRAHSEVI (MAGC1_HUMAN)
WQPRAHSEVI

SEQ ID NO: 84961 - protein, 8 aa, Artificial Sequence
  Description of Artificial Sequence: Synthetic peptide
  Seed: AFGEPREL (MAGC1_HUMAN)
AYGEPREF

SEQ ID NO: 84962 - protein, 11 aa, Artificial Sequence
  Description of Artificial Sequence: Synthetic peptide
  Seed: ISRYTGYFPVI (MAGC1_HUMAN)
IFRYTGYFPVF

SEQ ID NO: 84963 - protein, 9 aa, Artificial Sequence
  Description of Artificial Sequence: Synthetic peptide
  Seed: YQVKQPITK (MAGC1_HUMAN)
YLVKQPITL

SEQ ID NO: 84964 - protein, 9 aa, Artificial Sequence
  Description of Artificial Sequence: Synthetic peptide
  Seed: AQSPLQSPV (MAGC1_HUMAN)
AISPLQSPV

SEQ ID NO: 84965 - protein, 10 aa, Artificial Sequence
  Description of Artificial Sequence: Synthetic peptide
  Seed: LSQSSPVSSF (MAGC1_HUMAN)
LAQSSPVSSW

SEQ ID NO: 84966 - protein, 9 aa, Artificial Sequence
  Description of Artificial Sequence: Synthetic peptide
  Seed: AQSPLQSPV (MAGC1_HUMAN)
AHSPLQSPY

SEQ ID NO: 84967 - protein, 9 aa, Artificial Sequence
  Description of Artificial Sequence: Synthetic peptide
  Seed: SSFFSSALL (MAGC1_HUMAN)
SYFFSSALI

SEQ ID NO: 84968 - protein, 9 aa, Artificial Sequence
  Description of Artificial Sequence: Synthetic peptide
  Seed: STQSPFEGF (MAGC1_HUMAN)
SLQSPFEGW

SEQ ID NO: 84969 - protein, 9 aa, Artificial Sequence
  Description of Artificial Sequence: Synthetic peptide
  Seed: VSSSFSYTL (MAGC1_HUMAN)
VFSSFSYTF

SEQ ID NO: 84970 - protein, 11 aa, Artificial Sequence
  Description of Artificial Sequence: Synthetic peptide
  Seed: SPLQNPASSFF (MAGC1_HUMAN)
SYLQNPASSFF

SEQ ID NO: 84971 - protein, 9 aa, Artificial Sequence
  Description of Artificial Sequence: Synthetic peptide
  Seed: VSRSFSSTL (MAGC1_HUMAN)
VTRSFSSTI

SEQ ID NO: 84972 - protein, 9 aa, Artificial Sequence
  Description of Artificial Sequence: Synthetic peptide
  Seed: RTHSTFEGF (MAGC1_HUMAN)
REHSTFEGF

SEQ ID NO: 84973 - protein, 8 aa, Artificial Sequence
  Description of Artificial Sequence: Synthetic peptide
  Seed: LQSPVISF (MAGC1_HUMAN)
LQSPVISY

SEQ ID NO: 84974 - protein, 9 aa, Artificial Sequence
  Description of Artificial Sequence: Synthetic peptide
  Seed: FQSSLQSPV (MAGC1_HUMAN)
FVSSLQSPI

SEQ ID NO: 84975 - protein, 9 aa, Artificial Sequence
  Description of Artificial Sequence: Synthetic peptide
  Seed: FFSYTLASL (MAGC1_HUMAN)
FGSYTLASF

SEQ ID NO: 84976 - protein, 10 aa, Artificial Sequence
  Description of Artificial Sequence: Synthetic peptide
  Seed: EVIWDVLSGI (MAGC1_HUMAN)
ETIWDVLSGK

SEQ ID NO: 84977 - protein, 11 aa, Artificial Sequence
  Description of Artificial Sequence: Synthetic peptide
  Seed: SSTPSSLPQSF (MAGC1_HUMAN)
SRTPSSLPQSF

SEQ ID NO: 84978 - protein, 9 aa, Artificial Sequence
  Description of Artificial Sequence: Synthetic peptide
  Seed: FQSSPERTH (MAGC1_HUMAN)
FSSSPERTF

SEQ ID NO: 84979 - protein, 10 aa, Artificial Sequence
  Description of Artificial Sequence: Synthetic peptide
  Seed: ATESASSSVM (MAGC1_HUMAN)
AAESASSSVF

SEQ ID NO: 84980 - protein, 9 aa, Artificial Sequence
  Description of Artificial Sequence: Synthetic peptide
  Seed: ILILSIIFI (MAGC1_HUMAN)
IQILSIIFV

SEQ ID NO: 84981 - protein, 10 aa, Artificial Sequence
  Description of Artificial Sequence: Synthetic peptide
  Seed: RLLILILSII (MAGC1_HUMAN)
RMLILILSIV

SEQ ID NO: 84982 - protein, 10 aa, Artificial Sequence
  Description of Artificial Sequence: Synthetic peptide
  Seed: FAQSSLQIPV (MAGC1_HUMAN)
FMQSSLQIPA

SEQ ID NO: 84983 - protein, 9 aa, Artificial Sequence
  Description of Artificial Sequence: Synthetic peptide
  Seed: SAQSAFEGF (MAGC1_HUMAN)
SSQSAFEGY

SEQ ID NO: 84984 - protein, 9 aa, Artificial Sequence
  Description of Artificial Sequence: Synthetic peptide
  Seed: VIKRKVVEF (MAGC1_HUMAN)
VVKRKVVEM

SEQ ID NO: 84985 - protein, 9 aa, Artificial Sequence
  Description of Artificial Sequence: Synthetic peptide
  Seed: SFSERTQST (MAGC1_HUMAN)
SFSERTQSV

SEQ ID NO: 84986 - protein, 9 aa, Artificial Sequence
  Description of Artificial Sequence: Synthetic peptide
  Seed: LQIPMTSSF (MAGC1_HUMAN)
LKIPMTSSI

SEQ ID NO: 84987 - protein, 9 aa, Artificial Sequence
  Description of Artificial Sequence: Synthetic peptide
  Seed: IPMTSSFSS (MAGC1_HUMAN)
IVMTSSFSM

SEQ ID NO: 84988 - protein, 9 aa, Artificial Sequence
  Description of Artificial Sequence: Synthetic peptide
  Seed: VSSSSSSTL (MAGC1_HUMAN)
VQSSSSSTI

SEQ ID NO: 84989 - protein, 9 aa, Artificial Sequence
  Description of Artificial Sequence: Synthetic peptide
  Seed: VSPSFSSTL (MAGC1_HUMAN)
VYPSFSSTV

SEQ ID NO: 84990 - protein, 9 aa, Artificial Sequence
  Description of Artificial Sequence: Synthetic peptide
  Seed: VSAASSSTL (MAGC1_HUMAN)
VMAASSSTW

SEQ ID NO: 84991 - protein, 9 aa, Artificial Sequence
  Description of Artificial Sequence: Synthetic peptide
  Seed: IEILFGISL (MAGC1_HUMAN)
ILILFGISY

SEQ ID NO: 84992 - protein, 9 aa, Artificial Sequence
  Description of Artificial Sequence: Synthetic peptide
  Seed: HESPQSPPE (MAGC1_HUMAN)
HESPQSPPV

SEQ ID NO: 84993 - protein, 9 aa, Artificial Sequence
  Description of Artificial Sequence: Synthetic peptide
  Seed: SSSTLLSLF (MAGC1_HUMAN)
SWSTLLSLY

SEQ ID NO: 84994 - protein, 9 aa, Artificial Sequence
  Description of Artificial Sequence: Synthetic peptide
  Seed: LQIPVSPSF (MAGC1_HUMAN)
LSIPVSPSF

SEQ ID NO: 84995 - protein, 8 aa, Artificial Sequence
  Description of Artificial Sequence: Synthetic peptide
  Seed: FSSTLVSL (MAGC1_HUMAN)
FSSTLVSM

SEQ ID NO: 84996 - protein, 10 aa, Artificial Sequence
  Description of Artificial Sequence: Synthetic peptide
  Seed: YTLLSLFQSS (MAGC1_HUMAN)
YALLSLFQSA

SEQ ID NO: 84997 - protein, 10 aa, Artificial Sequence
  Description of Artificial Sequence: Synthetic peptide
  Seed: FAFGEPRELL (MAGC1_HUMAN)
FAFGEPRELW

SEQ ID NO: 84998 - protein, 9 aa, Artificial Sequence
  Description of Artificial Sequence: Synthetic peptide
  Seed: FSYTLASLL (MAGC1_HUMAN)
FWYTLASLM

SEQ ID NO: 84999 - protein, 9 aa, Artificial Sequence
  Description of Artificial Sequence: Synthetic peptide
  Seed: ESDDTLYPL (MAGC1_HUMAN)
EADDTLYPV

SEQ ID NO: 85000 - protein, 11 aa, Artificial Sequence
  Description of Artificial Sequence: Synthetic peptide
  Seed: IPVSSSSSSTL (MAGC1_HUMAN)
IDVSSSSSSTF

SEQ ID NO: 85001 - protein, 9 aa, Artificial Sequence
  Description of Artificial Sequence: Synthetic peptide
  Seed: LQIPMTSSF (MAGC1_HUMAN)
LQIPMTSSW

SEQ ID NO: 85002 - protein, 10 aa, Artificial Sequence
  Description of Artificial Sequence: Synthetic peptide
  Seed: STPSSLPQSF (MAGC1_HUMAN)
SWPSSLPQSW

SEQ ID NO: 85003 - protein, 10 aa, Artificial Sequence
  Description of Artificial Sequence: Synthetic peptide
  Seed: STLLSLFQSF (MAGC1_HUMAN)
SNLLSLFQSY

SEQ ID NO: 85004 - protein, 10 aa, Artificial Sequence
  Description of Artificial Sequence: Synthetic peptide
  Seed: TVPITFPSSY (MAGC1_HUMAN)
TAPITFPSSY

SEQ ID NO: 85005 - protein, 9 aa, Artificial Sequence
  Description of Artificial Sequence: Synthetic peptide
  Seed: YQVKQPITK (MAGC1_HUMAN)
YRVKQPITY

SEQ ID NO: 85006 - protein, 9 aa, Artificial Sequence
  Description of Artificial Sequence: Synthetic peptide
  Seed: KQPITKAEM (MAGC1_HUMAN)
KTPITKAEL

SEQ ID NO: 85007 - protein, 10 aa, Artificial Sequence
  Description of Artificial Sequence: Synthetic peptide
  Seed: SPLQRPVSSF (MAGC1_HUMAN)
SPLQRPVSSM

SEQ ID NO: 85008 - protein, 9 aa, Artificial Sequence
  Description of Artificial Sequence: Synthetic peptide
  Seed: AQSPLQSPV (MAGC1_HUMAN)
AVSPLQSPL

SEQ ID NO: 85009 - protein, 9 aa, Artificial Sequence
  Description of Artificial Sequence: Synthetic peptide
  Seed: ISFSSSTSL (MAGC1_HUMAN)
IPFSSSTSI

SEQ ID NO: 85010 - protein, 10 aa, Artificial Sequence
  Description of Artificial Sequence: Synthetic peptide
  Seed: KAREFIEILF (MAGC1_HUMAN)
KAREFIEILA

SEQ ID NO: 85011 - protein, 10 aa, Artificial Sequence
  Description of Artificial Sequence: Synthetic peptide
  Seed: VISFSSSTSL (MAGC1_HUMAN)
VLSFSSSTSI

SEQ ID NO: 85012 - protein, 9 aa, Artificial Sequence
  Description of Artificial Sequence: Synthetic peptide
  Seed: REVDPDDSY (MAGC1_HUMAN)
REVDPDDSP

SEQ ID NO: 85013 - protein, 9 aa, Artificial Sequence
  Description of Artificial Sequence: Synthetic peptide
  Seed: HFPQSPPEW (MAGC1_HUMAN)
HVPQSPPEL

SEQ ID NO: 85014 - protein, 9 aa, Artificial Sequence
  Description of Artificial Sequence: Synthetic peptide
  Seed: QIVPSLPEW (MAGC1_HUMAN)
QLVPSLPEY

SEQ ID NO: 85015 - protein, 9 aa, Artificial Sequence
  Description of Artificial Sequence: Synthetic peptide
  Seed: SLIESEPLF (MAGC1_HUMAN)
SLIESEPLL

SEQ ID NO: 85016 - protein, 10 aa, Artificial Sequence
  Description of Artificial Sequence: Synthetic peptide
  Seed: TLDEKVDELA (MAGC1_HUMAN)
TTDEKVDELF

SEQ ID NO: 85017 - protein, 10 aa, Artificial Sequence
  Description of Artificial Sequence: Synthetic peptide
  Seed: LQIVPSLPEW (MAGC1_HUMAN)
LSIVPSLPEF

SEQ ID NO: 85018 - protein, 9 aa, Artificial Sequence
  Description of Artificial Sequence: Synthetic peptide
  Seed: NSSPPRYEF (MAGC1_HUMAN)
NQSPPRYEM

SEQ ID NO: 85019 - protein, 9 aa, Artificial Sequence
  Description of Artificial Sequence: Synthetic peptide
  Seed: STFEGFAQS (MAGC1_HUMAN)
SFFEGFAQV

SEQ ID NO: 85020 - protein, 9 aa, Artificial Sequence
  Description of Artificial Sequence: Synthetic peptide
  Seed: SSPERTHST (MAGC1_HUMAN)
SSPERTHSF

SEQ ID NO: 85021 - protein, 9 aa, Artificial Sequence
  Description of Artificial Sequence: Synthetic peptide
  Seed: FSYTLASLL (MAGC1_HUMAN)
FKYTLASLF

SEQ ID NO: 85022 - protein, 10 aa, Artificial Sequence
  Description of Artificial Sequence: Synthetic peptide
  Seed: STLLSLFQSF (MAGC1_HUMAN)
SWLLSLFQSY

SEQ ID NO: 85023 - protein, 9 aa, Artificial Sequence
  Description of Artificial Sequence: Synthetic peptide
  Seed: FAFGEPREL (MAGC1_HUMAN)
FAFGEPREC

SEQ ID NO: 85024 - protein, 10 aa, Artificial Sequence
  Description of Artificial Sequence: Synthetic peptide
  Seed: YVFVNTLDLT (MAGC1_HUMAN)
YVFVNTLDLV

SEQ ID NO: 85025 - protein, 9 aa, Artificial Sequence
  Description of Artificial Sequence: Synthetic peptide
  Seed: AQSPLQSPV (MAGC1_HUMAN)
AISPLQSPL

SEQ ID NO: 85026 - protein, 9 aa, Artificial Sequence
  Description of Artificial Sequence: Synthetic peptide
  Seed: FSEESSSPV (MAGC1_HUMAN)
FMEESSSPM

SEQ ID NO: 85027 - protein, 10 aa, Artificial Sequence
  Description of Artificial Sequence: Synthetic peptide
  Seed: TTDDSTATES (MAGC1_HUMAN)
TLDDSTATEM

SEQ ID NO: 85028 - protein, 11 aa, Artificial Sequence
  Description of Artificial Sequence: Synthetic peptide
  Seed: LQIPVSSSFSY (MAGC1_HUMAN)
LGIPVSSSFSW

SEQ ID NO: 85029 - protein, 9 aa, Artificial Sequence
  Description of Artificial Sequence: Synthetic peptide
  Seed: IIDTTDDST (MAGC1_HUMAN)
ILDTTDDSM

SEQ ID NO: 85030 - protein, 9 aa, Artificial Sequence
  Description of Artificial Sequence: Synthetic peptide
  Seed: NSSPPRYEF (MAGC1_HUMAN)
NISPPRYEW

SEQ ID NO: 85031 - protein, 10 aa, Artificial Sequence
  Description of Artificial Sequence: Synthetic peptide
  Seed: SSPESAQSAF (MAGC1_HUMAN)
SPPESAQSAY

SEQ ID NO: 85032 - protein, 9 aa, Artificial Sequence
  Description of Artificial Sequence: Synthetic peptide
  Seed: IESEPLFTY (MAGC1_HUMAN)
IESEPLFTW

SEQ ID NO: 85033 - protein, 9 aa, Artificial Sequence
  Description of Artificial Sequence: Synthetic peptide
  Seed: NTVPITFPS (MAGC1_HUMAN)
NTVPITFPM

SEQ ID NO: 85034 - protein, 9 aa, Artificial Sequence
  Description of Artificial Sequence: Synthetic peptide
  Seed: MSQNRLLIL (MAGC1_HUMAN)
MSQNRLLIW

SEQ ID NO: 85035 - protein, 9 aa, Artificial Sequence
  Description of Artificial Sequence: Synthetic peptide
  Seed: DPDDSYVFV (MAGC1_HUMAN)
DMDDSYVFM

SEQ ID NO: 85036 - protein, 10 aa, Artificial Sequence
  Description of Artificial Sequence: Synthetic peptide
  Seed: MPTAGMPSLL (MAGC1_HUMAN)
METAGMPSLA

SEQ ID NO: 85037 - protein, 9 aa, Artificial Sequence
  Description of Artificial Sequence: Synthetic peptide
  Seed: LILSIIFIK (MAGC1_HUMAN)
LTLSIIFIR

SEQ ID NO: 85038 - protein, 11 aa, Artificial Sequence
  Description of Artificial Sequence: Synthetic peptide
  Seed: IPVSSSSSSTL (MAGC1_HUMAN)
IYVSSSSSSTF

SEQ ID NO: 85039 - protein, 10 aa, Artificial Sequence
  Description of Artificial Sequence: Synthetic peptide
  Seed: SSFSSTLLSI (MAGC1_HUMAN)
SSFSSTLLSY

SEQ ID NO: 85040 - protein, 11 aa, Artificial Sequence
  Description of Artificial Sequence: Synthetic peptide
  Seed: FQSSLQSPVSI (MAGC1_HUMAN)
FLSSLQSPVSL

SEQ ID NO: 85041 - protein, 10 aa, Artificial Sequence
  Description of Artificial Sequence: Synthetic peptide
  Seed: FSSSTSLSPF (MAGC1_HUMAN)
FASSTSLSPI

SEQ ID NO: 85042 - protein, 11 aa, Artificial Sequence
  Description of Artificial Sequence: Synthetic peptide
  Seed: YTGYFPVIFRK (MAGC1_HUMAN)
YIGYFPVIFRR

SEQ ID NO: 85043 - protein, 9 aa, Artificial Sequence
  Description of Artificial Sequence: Synthetic peptide
  Seed: DSYVFVNTL (MAGC1_HUMAN)
DLYVFVNTR

SEQ ID NO: 85044 - protein, 9 aa, Artificial Sequence
  Description of Artificial Sequence: Synthetic peptide
  Seed: SAQSTFEGF (MAGC1_HUMAN)
SKQSTFEGY

SEQ ID NO: 85045 - protein, 9 aa, Artificial Sequence
  Description of Artificial Sequence: Synthetic peptide
  Seed: ASSFFSSAL (MAGC1_HUMAN)
ATSFFSSAL

SEQ ID NO: 85046 - protein, 9 aa, Artificial Sequence
  Description of Artificial Sequence: Synthetic peptide
  Seed: LSPLHFPQF (MAGC1_HUMAN)
LQPLHFPQY

SEQ ID NO: 85047 - protein, 9 aa, Artificial Sequence
  Description of Artificial Sequence: Synthetic peptide
  Seed: FSYTLLSLF (MAGC1_HUMAN)
FPYTLLSLW

SEQ ID NO: 85048 - protein, 11 aa, Artificial Sequence
  Description of Artificial Sequence: Synthetic peptide
  Seed: SSFSYTLLSLF (MAGC1_HUMAN)
SIFSYTLLSLW

SEQ ID NO: 85049 - protein, 9 aa, Artificial Sequence
  Description of Artificial Sequence: Synthetic peptide
  Seed: SPLHSPQSP (MAGC1_HUMAN)
SPLHSPQSF

SEQ ID NO: 85050 - protein, 9 aa, Artificial Sequence
  Description of Artificial Sequence: Synthetic peptide
  Seed: FQSSLQSPV (MAGC1_HUMAN)
FESSLQSPM

SEQ ID NO: 85051 - protein, 9 aa, Artificial Sequence
  Description of Artificial Sequence: Synthetic peptide
  Seed: SSPECTQST (MAGC1_HUMAN)
SYPECTQSL

SEQ ID NO: 85052 - protein, 9 aa, Artificial Sequence
  Description of Artificial Sequence: Synthetic peptide
  Seed: GMSQNRLLI (MAGC1_HUMAN)
GQSQNRLLV

SEQ ID NO: 85053 - protein, 10 aa, Artificial Sequence
  Description of Artificial Sequence: Synthetic peptide
  Seed: SLIESEPLFT (MAGC1_HUMAN)
SVIESEPLFL

SEQ ID NO: 85054 - protein, 9 aa, Artificial Sequence
  Description of Artificial Sequence: Synthetic peptide
  Seed: IEILFGISL (MAGC1_HUMAN)
IMILFGISF

SEQ ID NO: 85055 - protein, 10 aa, Artificial Sequence
  Description of Artificial Sequence: Synthetic peptide
  Seed: LQIPVSPSFS (MAGC1_HUMAN)
LSIPVSPSFY

SEQ ID NO: 85056 - protein, 9 aa, Artificial Sequence
  Description of Artificial Sequence: Synthetic peptide
  Seed: MSQNRLLIL (MAGC1_HUMAN)
MYQNRLLIL

SEQ ID NO: 85057 - protein, 10 aa, Artificial Sequence
  Description of Artificial Sequence: Synthetic peptide
  Seed: SSFSSTLLSI (MAGC1_HUMAN)
SMFSSTLLSM

SEQ ID NO: 85058 - protein, 10 aa, Artificial Sequence
  Description of Artificial Sequence: Synthetic peptide
  Seed: MSPLYFPQSP (MAGC1_HUMAN)
MCPLYFPQSA

SEQ ID NO: 85059 - protein, 9 aa, Artificial Sequence
  Description of Artificial Sequence: Synthetic peptide
  Seed: TLLSLFQSF (MAGC1_HUMAN)
TTLSLFQSW

SEQ ID NO: 85060 - protein, 9 aa, Artificial Sequence
  Description of Artificial Sequence: Synthetic peptide
  Seed: FTYTLDEKV (MAGC1_HUMAN)
FVYTLDEKY

SEQ ID NO: 85061 - protein, 10 aa, Artificial Sequence
  Description of Artificial Sequence: Synthetic peptide
  Seed: EVIWDVLSGI (MAGC1_HUMAN)
ESIWDVLSGA

SEQ ID NO: 85062 - protein, 9 aa, Artificial Sequence
  Description of Artificial Sequence: Synthetic peptide
  Seed: MGDKDMPTA (MAGC1_HUMAN)
MQDKDMPTL

SEQ ID NO: 85063 - protein, 10 aa, Artificial Sequence
  Description of Artificial Sequence: Synthetic peptide
  Seed: RYTGYFPVIF (MAGC1_HUMAN)
RSTGYFPVIF

SEQ ID NO: 85064 - protein, 9 aa, Artificial Sequence
  Description of Artificial Sequence: Synthetic peptide
  Seed: ESSSPVDEY (MAGC1_HUMAN)
EASSPVDER

SEQ ID NO: 85065 - protein, 9 aa, Artificial Sequence
  Description of Artificial Sequence: Synthetic peptide
  Seed: IPMTSSFSS (MAGC1_HUMAN)
ILMTSSFSY

SEQ ID NO: 85066 - protein, 9 aa, Artificial Sequence
  Description of Artificial Sequence: Synthetic peptide
  Seed: TLLSILQSS (MAGC1_HUMAN)
TQLSILQSL

SEQ ID NO: 85067 - protein, 9 aa, Artificial Sequence
  Description of Artificial Sequence: Synthetic peptide
  Seed: VVEFLAMLK (MAGC1_HUMAN)
VTEFLAMLK

SEQ ID NO: 85068 - protein, 10 aa, Artificial Sequence
  Description of Artificial Sequence: Synthetic peptide
  Seed: ASSSTLVSIF (MAGC1_HUMAN)
ALSSTLVSIY

SEQ ID NO: 85069 - protein, 10 aa, Artificial Sequence
  Description of Artificial Sequence: Synthetic peptide
  Seed: ASSSVMSPSF (MAGC1_HUMAN)
AVSSVMSPSY

SEQ ID NO: 85070 - protein, 10 aa, Artificial Sequence
  Description of Artificial Sequence: Synthetic peptide
  Seed: RKVVEFLAML (MAGC1_HUMAN)
RAVVEFLAMI

SEQ ID NO: 85071 - protein, 9 aa, Artificial Sequence
  Description of Artificial Sequence: Synthetic peptide
  Seed: SAASSSTLV (MAGC1_HUMAN)
SLASSSTLV

SEQ ID NO: 85072 - protein, 9 aa, Artificial Sequence
  Description of Artificial Sequence: Synthetic peptide
  Seed: YTGYFPVIF (MAGC1_HUMAN)
YSGYFPVIM

SEQ ID NO: 85073 - protein, 9 aa, Artificial Sequence
  Description of Artificial Sequence: Synthetic peptide
  Seed: LQIPGSPSF (MAGC1_HUMAN)
LIIPGSPSV

SEQ ID NO: 85074 - protein, 9 aa, Artificial Sequence
  Description of Artificial Sequence: Synthetic peptide
  Seed: LKNTVPITF (MAGC1_HUMAN)
LVNTVPITF

SEQ ID NO: 85075 - protein, 11 aa, Artificial Sequence
  Description of Artificial Sequence: Synthetic peptide
  Seed: LQRPVSSFFSY (MAGC1_HUMAN)
LMRPVSSFFSM

SEQ ID NO: 85076 - protein, 9 aa, Artificial Sequence
  Description of Artificial Sequence: Synthetic peptide
  Seed: VIKRKVVEF (MAGC1_HUMAN)
VYKRKVVEL

SEQ ID NO: 85077 - protein, 9 aa, Artificial Sequence
  Description of Artificial Sequence: Synthetic peptide
  Seed: FSSTLLSLF (MAGC1_HUMAN)
FLSTLLSLA

SEQ ID NO: 85078 - protein, 10 aa, Artificial Sequence
  Description of Artificial Sequence: Synthetic peptide
  Seed: SPLQRPVSSF (MAGC1_HUMAN)
SPLQRPVSSL

SEQ ID NO: 85079 - protein, 9 aa, Artificial Sequence
  Description of Artificial Sequence: Synthetic peptide
  Seed: AMLKNTVPI (MAGC1_HUMAN)
AVLKNTVPW

SEQ ID NO: 85080 - protein, 9 aa, Artificial Sequence
  Description of Artificial Sequence: Synthetic peptide
  Seed: MTSSFSSTL (MAGC1_HUMAN)
MYSSFSSTI

SEQ ID NO: 85081 - protein, 11 aa, Artificial Sequence
  Description of Artificial Sequence: Synthetic peptide
  Seed: TTDDSTATESA (MAGC1_HUMAN)
TADDSTATESV

SEQ ID NO: 85082 - protein, 10 aa, Artificial Sequence
  Description of Artificial Sequence: Synthetic peptide
  Seed: MLKNTVPITF (MAGC1_HUMAN)
MCKNTVPITF

SEQ ID NO: 85083 - protein, 9 aa, Artificial Sequence
  Description of Artificial Sequence: Synthetic peptide
  Seed: AQSPLQSPV (MAGC1_HUMAN)
AVSPLQSPY

SEQ ID NO: 85084 - protein, 9 aa, Artificial Sequence
  Description of Artificial Sequence: Synthetic peptide
  Seed: RFLLLKYQV (MAGC1_HUMAN)
RYLLLKYQW

SEQ ID NO: 85085 - protein, 9 aa, Artificial Sequence
  Description of Artificial Sequence: Synthetic peptide
  Seed: SPVDEYTSS (MAGC1_HUMAN)
SAVDEYTSM

SEQ ID NO: 85086 - protein, 11 aa, Artificial Sequence
  Description of Artificial Sequence: Synthetic peptide
  Seed: IPVSSSFSYTL (MAGC1_HUMAN)
IPVSSSFSYTW

SEQ ID NO: 85087 - protein, 9 aa, Artificial Sequence
  Description of Artificial Sequence: Synthetic peptide
  Seed: TLDEKVDEL (MAGC1_HUMAN)
TEDEKVDEL

SEQ ID NO: 85088 - protein, 9 aa, Artificial Sequence
  Description of Artificial Sequence: Synthetic peptide
  Seed: VIFRKAREF (MAGC1_HUMAN)
VRFRKAREF

SEQ ID NO: 85089 - protein, 10 aa, Artificial Sequence
  Description of Artificial Sequence: Synthetic peptide
  Seed: SPLQSPVSSF (MAGC1_HUMAN)
SLLQSPVSSY

SEQ ID NO: 85090 - protein, 10 aa, Artificial Sequence
  Description of Artificial Sequence: Synthetic peptide
  Seed: FPSSYKDALK (MAGC1_HUMAN)
FCSSYKDALR

SEQ ID NO: 85091 - protein, 9 aa, Artificial Sequence
  Description of Artificial Sequence: Synthetic peptide
  Seed: KDSLSPLEI (MAGC1_HUMAN)
KESLSPLEP

SEQ ID NO: 85092 - protein, 11 aa, Artificial Sequence
  Description of Artificial Sequence: Synthetic peptide
  Seed: AIIDTTDDSTA (MAGC1_HUMAN)
ALIDTTDDSTL

SEQ ID NO: 85093 - protein, 10 aa, Artificial Sequence
  Description of Artificial Sequence: Synthetic peptide
  Seed: RSFSSTLLSI (MAGC1_HUMAN)
RAFSSTLLSL

SEQ ID NO: 85094 - protein, 9 aa, Artificial Sequence
  Description of Artificial Sequence: Synthetic peptide
  Seed: TPSSLPQSF (MAGC1_HUMAN)
TQSSLPQSL

SEQ ID NO: 85095 - protein, 9 aa, Artificial Sequence
  Description of Artificial Sequence: Synthetic peptide
  Seed: ASEEVIWDV (MAGC1_HUMAN)
AIEEVIWDI

SEQ ID NO: 85096 - protein, 10 aa, Artificial Sequence
  Description of Artificial Sequence: Synthetic peptide
  Seed: SSFSYTLLSL (MAGC1_HUMAN)
SVFSYTLLSI

SEQ ID NO: 85097 - protein, 9 aa, Artificial Sequence
  Description of Artificial Sequence: Synthetic peptide
  Seed: GYFPVIFRK (MAGC1_HUMAN)
GMFPVIFRY

SEQ ID NO: 85098 - protein, 10 aa, Artificial Sequence
  Description of Artificial Sequence: Synthetic peptide
  Seed: SSFPSSTSSS (MAGC1_HUMAN)
STFPSSTSSF

SEQ ID NO: 85099 - protein, 9 aa, Artificial Sequence
  Description of Artificial Sequence: Synthetic peptide
  Seed: VQSPLHSPQ (MAGC1_HUMAN)
VRSPLHSPM

SEQ ID NO: 85100 - protein, 9 aa, Artificial Sequence
  Description of Artificial Sequence: Synthetic peptide
  Seed: NVISRYTGY (MAGC1_HUMAN)
NPISRYTGF

SEQ ID NO: 85101 - protein, 10 aa, Artificial Sequence
  Description of Artificial Sequence: Synthetic peptide
  Seed: REFIEILFGI (MAGC1_HUMAN)
RRFIEILFGV

SEQ ID NO: 85102 - protein, 8 aa, Artificial Sequence
  Description of Artificial Sequence: Synthetic peptide
  Seed: SDDTLYPL (MAGC1_HUMAN)
SEDTLYPL

SEQ ID NO: 85103 - protein, 9 aa, Artificial Sequence
  Description of Artificial Sequence: Synthetic peptide
  Seed: FFSSALLSI (MAGC1_HUMAN)
FQSSALLST

SEQ ID NO: 85104 - protein, 10 aa, Artificial Sequence
  Description of Artificial Sequence: Synthetic peptide
  Seed: FPQSPLQIPV (MAGC1_HUMAN)
FYQSPLQIPI

SEQ ID NO: 85105 - protein, 10 aa, Artificial Sequence
  Description of Artificial Sequence: Synthetic peptide
  Seed: GEDSLSPHYF (MAGC1_HUMAN)
GEDSLSPHYW

SEQ ID NO: 85106 - protein, 9 aa, Artificial Sequence
  Description of Artificial Sequence: Synthetic peptide
  Seed: LSPLHFPQF (MAGC1_HUMAN)
LMPLHFPQY

SEQ ID NO: 85107 - protein, 10 aa, Artificial Sequence
  Description of Artificial Sequence: Synthetic peptide
  Seed: SLSPLHFPQF (MAGC1_HUMAN)
SSSPLHFPQY

SEQ ID NO: 85108 - protein, 9 aa, Artificial Sequence
  Description of Artificial Sequence: Synthetic peptide
  Seed: HFPQSPPEW (MAGC1_HUMAN)
HRPQSPPEM

SEQ ID NO: 85109 - protein, 10 aa, Artificial Sequence
  Description of Artificial Sequence: Synthetic peptide
  Seed: SSPPRYEFLW (MAGC1_HUMAN)
SFPPRYEFLW

SEQ ID NO: 85110 - protein, 9 aa, Artificial Sequence
  Description of Artificial Sequence: Synthetic peptide
  Seed: SPLEGEDSL (MAGC1_HUMAN)
SALEGEDSW

SEQ ID NO: 85111 - protein, 9 aa, Artificial Sequence
  Description of Artificial Sequence: Synthetic peptide
  Seed: SSSSSSSTL (MAGC1_HUMAN)
SESSSSSTM

SEQ ID NO: 85112 - protein, 9 aa, Artificial Sequence
  Description of Artificial Sequence: Synthetic peptide
  Seed: RAGREHFAF (MAGC1_HUMAN)
RTGREHFAF

SEQ ID NO: 85113 - protein, 10 aa, Artificial Sequence
  Description of Artificial Sequence: Synthetic peptide
  Seed: LAMLKNTVPI (MAGC1_HUMAN)
LHMLKNTVPF

SEQ ID NO: 85114 - protein, 8 aa, Artificial Sequence
  Description of Artificial Sequence: Synthetic peptide
  Seed: DSLSPLQI (MAGC1_HUMAN)
DALSPLQV

SEQ ID NO: 85115 - protein, 9 aa, Artificial Sequence
  Description of Artificial Sequence: Synthetic peptide
  Seed: KVDELARFL (MAGC1_HUMAN)
KMDELARFW

SEQ ID NO: 85116 - protein, 9 aa, Artificial Sequence
  Description of Artificial Sequence: Synthetic peptide
  Seed: LQIPGSPSF (MAGC1_HUMAN)
LAIPGSPSH

SEQ ID NO: 85117 - protein, 9 aa, Artificial Sequence
  Description of Artificial Sequence: Synthetic peptide
  Seed: KAREFIEIL (MAGC1_HUMAN)
KRREFIEIL

SEQ ID NO: 85118 - protein, 10 aa, Artificial Sequence
  Description of Artificial Sequence: Synthetic peptide
  Seed: HSPLQIVPSL (MAGC1_HUMAN)
HSPLQIVPSF

SEQ ID NO: 85119 - protein, 10 aa, Artificial Sequence
  Description of Artificial Sequence: Synthetic peptide
  Seed: ASSFFSSALL (MAGC1_HUMAN)
AISFFSSALY

SEQ ID NO: 85120 - protein, 9 aa, Artificial Sequence
  Description of Artificial Sequence: Synthetic peptide
  Seed: TLLSLFQSF (MAGC1_HUMAN)
TQLSLFQSV

SEQ ID NO: 85121 - protein, 11 aa, Artificial Sequence
  Description of Artificial Sequence: Synthetic peptide
  Seed: SAASSSTLVSI (MAGC1_HUMAN)
SMASSSTLVSL

SEQ ID NO: 85122 - protein, 9 aa, Artificial Sequence
  Description of Artificial Sequence: Synthetic peptide
  Seed: FLAMLKNTV (MAGC1_HUMAN)
FMAMLKNTM

SEQ ID NO: 85123 - protein, 9 aa, Artificial Sequence
  Description of Artificial Sequence: Synthetic peptide
  Seed: NTVPITFPS (MAGC1_HUMAN)
NAVPITFPL

SEQ ID NO: 85124 - protein, 9 aa, Artificial Sequence
  Description of Artificial Sequence: Synthetic peptide
  Seed: YQVKQPITK (MAGC1_HUMAN)
YVVKQPITK

SEQ ID NO: 85125 - protein, 9 aa, Artificial Sequence
  Description of Artificial Sequence: Synthetic peptide
  Seed: GSPSFSSTL (MAGC1_HUMAN)
GFPSFSSTF

SEQ ID NO: 85126 - protein, 10 aa, Artificial Sequence
  Description of Artificial Sequence: Synthetic peptide
  Seed: FPQSPLQIPV (MAGC1_HUMAN)
FPQSPLQIPH

SEQ ID NO: 85127 - protein, 9 aa, Artificial Sequence
  Description of Artificial Sequence: Synthetic peptide
  Seed: RTHSTFEGF (MAGC1_HUMAN)
RTHSTFEGW

SEQ ID NO: 85128 - protein, 9 aa, Artificial Sequence
  Description of Artificial Sequence: Synthetic peptide
  Seed: SPLEGEDSL (MAGC1_HUMAN)
SHLEGEDSF

SEQ ID NO: 85129 - protein, 10 aa, Artificial Sequence
  Description of Artificial Sequence: Synthetic peptide
  Seed: FFSYTLASLL (MAGC1_HUMAN)
FMSYTLASLT

SEQ ID NO: 85130 - protein, 9 aa, Artificial Sequence
  Description of Artificial Sequence: Synthetic peptide
  Seed: WVQEHYLEY (MAGC1_HUMAN)
WYQEHYLEM

SEQ ID NO: 85131 - protein, 9 aa, Artificial Sequence
  Description of Artificial Sequence: Synthetic peptide
  Seed: VSRSFSSTL (MAGC1_HUMAN)
VSRSFSSTI

SEQ ID NO: 85132 - protein, 9 aa, Artificial Sequence
  Description of Artificial Sequence: Synthetic peptide
  Seed: SSPERTQST (MAGC1_HUMAN)
SSPERTQSI

SEQ ID NO: 85133 - protein, 9 aa, Artificial Sequence
  Description of Artificial Sequence: Synthetic peptide
  Seed: LQIPMTSSF (MAGC1_HUMAN)
LHIPMTSSL

SEQ ID NO: 85134 - protein, 9 aa, Artificial Sequence
  Description of Artificial Sequence: Synthetic peptide
  Seed: FAFGEPREL (MAGC1_HUMAN)
FGFGEPREL

SEQ ID NO: 85135 - protein, 10 aa, Artificial Sequence
  Description of Artificial Sequence: Synthetic peptide
  Seed: SMSPLYFPQS (MAGC1_HUMAN)
SLSPLYFPQV

SEQ ID NO: 85136 - protein, 9 aa, Artificial Sequence
  Description of Artificial Sequence: Synthetic peptide
  Seed: TPSSLPQSF (MAGC1_HUMAN)
TYSSLPQSF

SEQ ID NO: 85137 - protein, 9 aa, Artificial Sequence
  Description of Artificial Sequence: Synthetic peptide
  Seed: FSSTLLSLF (MAGC1_HUMAN)
FMSTLLSLT

SEQ ID NO: 85138 - protein, 11 aa, Artificial Sequence
  Description of Artificial Sequence: Synthetic peptide
  Seed: REVDPDDSYVF (MAGC1_HUMAN)
RIVDPDDSYVI

SEQ ID NO: 85139 - protein, 10 aa, Artificial Sequence
  Description of Artificial Sequence: Synthetic peptide
  Seed: SFPSSTSSSL (MAGC1_HUMAN)
SRPSSTSSSL

SEQ ID NO: 85140 - protein, 9 aa, Artificial Sequence
  Description of Artificial Sequence: Synthetic peptide
  Seed: LQIPVSRSF (MAGC1_HUMAN)
LEIPVSRSI

SEQ ID NO: 85141 - protein, 10 aa, Artificial Sequence
  Description of Artificial Sequence: Synthetic peptide
  Seed: FPQSVLQIPV (MAGC1_HUMAN)
FPQSVLQIPL

SEQ ID NO: 85142 - protein, 10 aa, Artificial Sequence
  Description of Artificial Sequence: Synthetic peptide
  Seed: SRYTGYFPVI (MAGC1_HUMAN)
SRYTGYFPVV

SEQ ID NO: 85143 - protein, 9 aa, Artificial Sequence
  Description of Artificial Sequence: Synthetic peptide
  Seed: LQIPGSPSF (MAGC1_HUMAN)
LEIPGSPSL

SEQ ID NO: 85144 - protein, 9 aa, Artificial Sequence
  Description of Artificial Sequence: Synthetic peptide
  Seed: LQIPVSRSF (MAGC1_HUMAN)
LMIPVSRSF

SEQ ID NO: 85145 - protein, 10 aa, Artificial Sequence
  Description of Artificial Sequence: Synthetic peptide
  Seed: QIPVSSSFSY (MAGC1_HUMAN)
QYPVSSSFSM

SEQ ID NO: 85146 - protein, 9 aa, Artificial Sequence
  Description of Artificial Sequence: Synthetic peptide
  Seed: YVFVNTLDL (MAGC1_HUMAN)
YLFVNTLDI

SEQ ID NO: 85147 - protein, 10 aa, Artificial Sequence
  Description of Artificial Sequence: Synthetic peptide
  Seed: VISFSSSTSL (MAGC1_HUMAN)
VMSFSSSTSM

SEQ ID NO: 85148 - protein, 9 aa, Artificial Sequence
  Description of Artificial Sequence: Synthetic peptide
  Seed: AQSPLQIPV (MAGC1_HUMAN)
AMSPLQIPW

SEQ ID NO: 85149 - protein, 9 aa, Artificial Sequence
  Description of Artificial Sequence: Synthetic peptide
  Seed: LQIPVSPSF (MAGC1_HUMAN)
LGIPVSPSW

SEQ ID NO: 85150 - protein, 9 aa, Artificial Sequence
  Description of Artificial Sequence: Synthetic peptide
  Seed: FSYTLASLL (MAGC1_HUMAN)
FEYTLASLM

SEQ ID NO: 85151 - protein, 9 aa, Artificial Sequence
  Description of Artificial Sequence: Synthetic peptide
  Seed: RKVVEFLAM (MAGC1_HUMAN)
RTVVEFLAY

SEQ ID NO: 85152 - protein, 9 aa, Artificial Sequence
  Description of Artificial Sequence: Synthetic peptide
  Seed: MTSSFSSTL (MAGC1_HUMAN)
MVSSFSSTV

SEQ ID NO: 85153 - protein, 11 aa, Artificial Sequence
  Description of Artificial Sequence: Synthetic peptide
  Seed: REVDPDDSYVF (MAGC1_HUMAN)
RIVDPDDSYVL

SEQ ID NO: 85154 - protein, 10 aa, Artificial Sequence
  Description of Artificial Sequence: Synthetic peptide
  Seed: SFPSSTSSSL (MAGC1_HUMAN)
SVPSSTSSSL

SEQ ID NO: 85155 - protein, 9 aa, Artificial Sequence
  Description of Artificial Sequence: Synthetic peptide
  Seed: FSYTLASLL (MAGC1_HUMAN)
FSYTLASLW

SEQ ID NO: 85156 - protein, 9 aa, Artificial Sequence
  Description of Artificial Sequence: Synthetic peptide
  Seed: SYKDALKDV (MAGC1_HUMAN)
SYKDALKDL

SEQ ID NO: 85157 - protein, 9 aa, Artificial Sequence
  Description of Artificial Sequence: Synthetic peptide
  Seed: STFEGFAQS (MAGC1_HUMAN)
SVFEGFAQL

SEQ ID NO: 85158 - protein, 10 aa, Artificial Sequence
  Description of Artificial Sequence: Synthetic peptide
  Seed: VPITFPSSYK (MAGC1_HUMAN)
VRITFPSSYR

SEQ ID NO: 85159 - protein, 9 aa, Artificial Sequence
  Description of Artificial Sequence: Synthetic peptide
  Seed: KQPITKAEM (MAGC1_HUMAN)
KRPITKAEM

SEQ ID NO: 85160 - protein, 10 aa, Artificial Sequence
  Description of Artificial Sequence: Synthetic peptide
  Seed: SSPESTQSPF (MAGC1_HUMAN)
SMPESTQSPY

SEQ ID NO: 85161 - protein, 9 aa, Artificial Sequence
  Description of Artificial Sequence: Synthetic peptide
  Seed: SPECTQSTF (MAGC1_HUMAN)
SPECTQSTM

SEQ ID NO: 85162 - protein, 9 aa, Artificial Sequence
  Description of Artificial Sequence: Synthetic peptide
  Seed: LQIPMTSSF (MAGC1_HUMAN)
LKIPMTSSY

SEQ ID NO: 85163 - protein, 11 aa, Artificial Sequence
  Description of Artificial Sequence: Synthetic peptide
  Seed: SFFSYTLASLL (MAGC1_HUMAN)
SIFSYTLASLF

SEQ ID NO: 85164 - protein, 11 aa, Artificial Sequence
  Description of Artificial Sequence: Synthetic peptide
  Seed: IPMTSSFSSTL (MAGC1_HUMAN)
IEMTSSFSSTF

SEQ ID NO: 85165 - protein, 9 aa, Artificial Sequence
  Description of Artificial Sequence: Synthetic peptide
  Seed: LKNTVPITF (MAGC1_HUMAN)
LMNTVPITL

SEQ ID NO: 85166 - protein, 9 aa, Artificial Sequence
  Description of Artificial Sequence: Synthetic peptide
  Seed: VIWDVLSGI (MAGC1_HUMAN)
VTWDVLSGV

SEQ ID NO: 85167 - protein, 9 aa, Artificial Sequence
  Description of Artificial Sequence: Synthetic peptide
  Seed: SIIFIKGTY (MAGC1_HUMAN)
STIFIKGTR

SEQ ID NO: 85168 - protein, 10 aa, Artificial Sequence
  Description of Artificial Sequence: Synthetic peptide
  Seed: EVIWDVLSGI (MAGC1_HUMAN)
EGIWDVLSGV

SEQ ID NO: 85169 - protein, 9 aa, Artificial Sequence
  Description of Artificial Sequence: Synthetic peptide
  Seed: SSSESPQSC (MAGC1_HUMAN)
SMSESPQSM

SEQ ID NO: 85170 - protein, 9 aa, Artificial Sequence
  Description of Artificial Sequence: Synthetic peptide
  Seed: AGREHFAFG (MAGC1_HUMAN)
ASREHFAFM

SEQ ID NO: 85171 - protein, 9 aa, Artificial Sequence
  Description of Artificial Sequence: Synthetic peptide
  Seed: TPSSLPQSF (MAGC1_HUMAN)
TMSSLPQSY

SEQ ID NO: 85172 - protein, 11 aa, Artificial Sequence
  Description of Artificial Sequence: Synthetic peptide
  Seed: EILFGISLREV (MAGC1_HUMAN)
EWLFGISLREV

SEQ ID NO: 85173 - protein, 8 aa, Artificial Sequence
  Description of Artificial Sequence: Synthetic peptide
  Seed: LTDSESLI (MAGC1_HUMAN)
LVDSESLL

SEQ ID NO: 85174 - protein, 11 aa, Artificial Sequence
  Description of Artificial Sequence: Synthetic peptide
  Seed: TVPITFPSSYK (MAGC1_HUMAN)
TIPITFPSSYR

SEQ ID NO: 85175 - protein, 9 aa, Artificial Sequence
  Description of Artificial Sequence: Synthetic peptide
  Seed: EVDPDDSYV (MAGC1_HUMAN)
EFDPDDSYM

SEQ ID NO: 85176 - protein, 9 aa, Artificial Sequence
  Description of Artificial Sequence: Synthetic peptide
  Seed: ASSFFSSAL (MAGC1_HUMAN)
AASFFSSAY

SEQ ID NO: 85177 - protein, 9 aa, Artificial Sequence
  Description of Artificial Sequence: Synthetic peptide
  Seed: GYFPVIFRK (MAGC1_HUMAN)
GMFPVIFRF

SEQ ID NO: 85178 - protein, 9 aa, Artificial Sequence
  Description of Artificial Sequence: Synthetic peptide
  Seed: FPSSTSSSL (MAGC1_HUMAN)
FESSTSSSY

SEQ ID NO: 85179 - protein, 9 aa, Artificial Sequence
  Description of Artificial Sequence: Synthetic peptide
  Seed: SASSSVMSP (MAGC1_HUMAN)
SVSSSVMSY

SEQ ID NO: 85180 - protein, 9 aa, Artificial Sequence
  Description of Artificial Sequence: Synthetic peptide
  Seed: FSSALLSIF (MAGC1_HUMAN)
FPSALLSIL

SEQ ID NO: 85181 - protein, 9 aa, Artificial Sequence
  Description of Artificial Sequence: Synthetic peptide
  Seed: EILFGISLR (MAGC1_HUMAN)
EVLFGISLR

SEQ ID NO: 85182 - protein, 10 aa, Artificial Sequence
  Description of Artificial Sequence: Synthetic peptide
  Seed: RPVSSFFSYT (MAGC1_HUMAN)
RMVSSFFSYK

SEQ ID NO: 85183 - protein, 8 aa, Artificial Sequence
  Description of Artificial Sequence: Synthetic peptide
  Seed: ITFPSSYK (MAGC1_HUMAN)
ILFPSSYK

SEQ ID NO: 85184 - protein, 9 aa, Artificial Sequence
  Description of Artificial Sequence: Synthetic peptide
  Seed: LQRPVSSFF (MAGC1_HUMAN)
LRRPVSSFF

SEQ ID NO: 85185 - protein, 9 aa, Artificial Sequence
  Description of Artificial Sequence: Synthetic peptide
  Seed: MSQNRLLIL (MAGC1_HUMAN)
MIQNRLLIY

SEQ ID NO: 85186 - protein, 9 aa, Artificial Sequence
  Description of Artificial Sequence: Synthetic peptide
  Seed: MGDKDMPTA (MAGC1_HUMAN)
MVDKDMPTM

SEQ ID NO: 85187 - protein, 11 aa, Artificial Sequence
  Description of Artificial Sequence: Synthetic peptide
  Seed: VSSSSSSSTLL (MAGC1_HUMAN)
VTSSSSSSTLF

SEQ ID NO: 85188 - protein, 9 aa, Artificial Sequence
  Description of Artificial Sequence: Synthetic peptide
  Seed: SSPESTQSP (MAGC1_HUMAN)
SAPESTQSI

SEQ ID NO: 85189 - protein, 11 aa, Artificial Sequence
  Description of Artificial Sequence: Synthetic peptide
  Seed: SSSSSTLLSLF (MAGC1_HUMAN)
SSSSSTLLSLY

SEQ ID NO: 85190 - protein, 9 aa, Artificial Sequence
  Description of Artificial Sequence: Synthetic peptide
  Seed: SSFPSSTSS (MAGC1_HUMAN)
SGFPSSTSY

SEQ ID NO: 85191 - protein, 9 aa, Artificial Sequence
  Description of Artificial Sequence: Synthetic peptide
  Seed: VSRSFSSTL (MAGC1_HUMAN)
VGRSFSSTK

SEQ ID NO: 85192 - protein, 10 aa, Artificial Sequence
  Description of Artificial Sequence: Synthetic peptide
  Seed: MLTNVISRYT (MAGC1_HUMAN)
MMTNVISRYV

SEQ ID NO: 85193 - protein, 9 aa, Artificial Sequence
  Description of Artificial Sequence: Synthetic peptide
  Seed: FSYTLASLL (MAGC1_HUMAN)
FFYTLASLM

SEQ ID NO: 85194 - protein, 10 aa, Artificial Sequence
  Description of Artificial Sequence: Synthetic peptide
  Seed: LAMLKNTVPI (MAGC1_HUMAN)
LIMLKNTVPY

SEQ ID NO: 85195 - protein, 9 aa, Artificial Sequence
  Description of Artificial Sequence: Synthetic peptide
  Seed: LQIPVSPSF (MAGC1_HUMAN)
LTIPVSPSI

SEQ ID NO: 85196 - protein, 9 aa, Artificial Sequence
  Description of Artificial Sequence: Synthetic peptide
  Seed: SPLQIVPSL (MAGC1_HUMAN)
STLQIVPSY

SEQ ID NO: 85197 - protein, 9 aa, Artificial Sequence
  Description of Artificial Sequence: Synthetic peptide
  Seed: KVVEFLAML (MAGC1_HUMAN)
KAVEFLAMA

SEQ ID NO: 85198 - protein, 9 aa, Artificial Sequence
  Description of Artificial Sequence: Synthetic peptide
  Seed: LQIPVSSSS (MAGC1_HUMAN)
LCIPVSSSW

SEQ ID NO: 85199 - protein, 9 aa, Artificial Sequence
  Description of Artificial Sequence: Synthetic peptide
  Seed: SPLQIVPSL (MAGC1_HUMAN)
SHLQIVPSA

SEQ ID NO: 85200 - protein, 8 aa, Artificial Sequence
  Description of Artificial Sequence: Synthetic peptide
  Seed: HYLEYREV (MAGC1_HUMAN)
HYLEYREL

SEQ ID NO: 85201 - protein, 9 aa, Artificial Sequence
  Description of Artificial Sequence: Synthetic peptide
  Seed: SPVSICSSS (MAGC1_HUMAN)
SPVSICSSL

SEQ ID NO: 85202 - protein, 10 aa, Artificial Sequence
  Description of Artificial Sequence: Synthetic peptide
  Seed: SSPERTQSTF (MAGC1_HUMAN)
SSPERTQSTW

SEQ ID NO: 85203 - protein, 9 aa, Artificial Sequence
  Description of Artificial Sequence: Synthetic peptide
  Seed: SPLQIVPSL (MAGC1_HUMAN)
SHLQIVPSY

SEQ ID NO: 85204 - protein, 10 aa, Artificial Sequence
  Description of Artificial Sequence: Synthetic peptide
  Seed: VPITFPSSYK (MAGC1_HUMAN)
VQITFPSSYK

SEQ ID NO: 85205 - protein, 11 aa, Artificial Sequence
  Description of Artificial Sequence: Synthetic peptide
  Seed: SLSQSSPVSSF (MAGC1_HUMAN)
SISQSSPVSSF

SEQ ID NO: 85206 - protein, 10 aa, Artificial Sequence
  Description of Artificial Sequence: Synthetic peptide
  Seed: SSFSSTLLSI (MAGC1_HUMAN)
SAFSSTLLSA

SEQ ID NO: 85207 - protein, 9 aa, Artificial Sequence
  Description of Artificial Sequence: Synthetic peptide
  Seed: EVPNSSPPR (MAGC1_HUMAN)
ETPNSSPPR

SEQ ID NO: 85208 - protein, 9 aa, Artificial Sequence
  Description of Artificial Sequence: Synthetic peptide
  Seed: VSPSFSSTL (MAGC1_HUMAN)
VYPSFSSTF

SEQ ID NO: 85209 - protein, 9 aa, Artificial Sequence
  Description of Artificial Sequence: Synthetic peptide
  Seed: HYFPQSPPQ (MAGC1_HUMAN)
HWFPQSPPL

SEQ ID NO: 85210 - protein, 9 aa, Artificial Sequence
  Description of Artificial Sequence: Synthetic peptide
  Seed: SRSFSSTLL (MAGC1_HUMAN)
SPSFSSTLI

SEQ ID NO: 85211 - protein, 10 aa, Artificial Sequence
  Description of Artificial Sequence: Synthetic peptide
  Seed: LLQIPMTSSF (MAGC1_HUMAN)
LAQIPMTSSL

SEQ ID NO: 85212 - protein, 10 aa, Artificial Sequence
  Description of Artificial Sequence: Synthetic peptide
  Seed: NPASSFFSSA (MAGC1_HUMAN)
NKASSFFSSV

SEQ ID NO: 85213 - protein, 11 aa, Artificial Sequence
  Description of Artificial Sequence: Synthetic peptide
  Seed: SQSSPEGKDSL (MAGC1_HUMAN)
SLSSPEGKDSF

SEQ ID NO: 85214 - protein, 11 aa, Artificial Sequence
  Description of Artificial Sequence: Synthetic peptide
  Seed: SSFSYTLLSLF (MAGC1_HUMAN)
SGFSYTLLSLY

SEQ ID NO: 85215 - protein, 9 aa, Artificial Sequence
  Description of Artificial Sequence: Synthetic peptide
  Seed: KDSQSPLQI (MAGC1_HUMAN)
KLSQSPLQW

SEQ ID NO: 85216 - protein, 10 aa, Artificial Sequence
  Description of Artificial Sequence: Synthetic peptide
  Seed: VSRSFSSTLL (MAGC1_HUMAN)
VARSFSSTLY

SEQ ID NO: 85217 - protein, 9 aa, Artificial Sequence
  Description of Artificial Sequence: Synthetic peptide
  Seed: TLLSLFQSF (MAGC1_HUMAN)
TLLSLFQSY

SEQ ID NO: 85218 - protein, 10 aa, Artificial Sequence
  Description of Artificial Sequence: Synthetic peptide
  Seed: ICSSSTSLSL (MAGC1_HUMAN)
IFSSSTSLSY

SEQ ID NO: 85219 - protein, 10 aa, Artificial Sequence
  Description of Artificial Sequence: Synthetic peptide
  Seed: REFIEILFGI (MAGC1_HUMAN)
RLFIEILFGL

SEQ ID NO: 85220 - protein, 9 aa, Artificial Sequence
  Description of Artificial Sequence: Synthetic peptide
  Seed: SPPEGENTH (MAGC1_HUMAN)
SIPEGENTL

SEQ ID NO: 85221 - protein, 9 aa, Artificial Sequence
  Description of Artificial Sequence: Synthetic peptide
  Seed: TTDDSTATE (MAGC1_HUMAN)
TDDDSTATL

SEQ ID NO: 85222 - protein, 11 aa, Artificial Sequence
  Description of Artificial Sequence: Synthetic peptide
  Seed: LQIPVSSSFSY (MAGC1_HUMAN)
LWIPVSSSFSF

SEQ ID NO: 85223 - protein, 9 aa, Artificial Sequence
  Description of Artificial Sequence: Synthetic peptide
  Seed: TLLSLFQSF (MAGC1_HUMAN)
TALSLFQSL

SEQ ID NO: 85224 - protein, 9 aa, Artificial Sequence
  Description of Artificial Sequence: Synthetic peptide
  Seed: SICSSSTSL (MAGC1_HUMAN)
SYCSSSTSF

SEQ ID NO: 85225 - protein, 9 aa, Artificial Sequence
  Description of Artificial Sequence: Synthetic peptide
  Seed: AGREHFAFG (MAGC1_HUMAN)
AIREHFAFG

SEQ ID NO: 85226 - protein, 9 aa, Artificial Sequence
  Description of Artificial Sequence: Synthetic peptide
  Seed: SSPECTQST (MAGC1_HUMAN)
SAPECTQSL

SEQ ID NO: 85227 - protein, 9 aa, Artificial Sequence
  Description of Artificial Sequence: Synthetic peptide
  Seed: SSSSSSTLL (MAGC1_HUMAN)
SHSSSSTLL

SEQ ID NO: 85228 - protein, 9 aa, Artificial Sequence
  Description of Artificial Sequence: Synthetic peptide
  Seed: SSPESDDTL (MAGC1_HUMAN)
SLPESDDTV

SEQ ID NO: 85229 - protein, 8 aa, Artificial Sequence
  Description of Artificial Sequence: Synthetic peptide
  Seed: QIPGSPSF (MAGC1_HUMAN)
QYPGSPSY

SEQ ID NO: 85230 - protein, 9 aa, Artificial Sequence
  Description of Artificial Sequence: Synthetic peptide
  Seed: FPQSPPQGE (MAGC1_HUMAN)
FPQSPPQGA

SEQ ID NO: 85231 - protein, 9 aa, Artificial Sequence
  Description of Artificial Sequence: Synthetic peptide
  Seed: GDKDMPTAG (MAGC1_HUMAN)
GEKDMPTAT

SEQ ID NO: 85232 - protein, 9 aa, Artificial Sequence
  Description of Artificial Sequence: Synthetic peptide
  Seed: SSLSQSSPV (MAGC1_HUMAN)
SSLSQSSPM

SEQ ID NO: 85233 - protein, 9 aa, Artificial Sequence
  Description of Artificial Sequence: Synthetic peptide
  Seed: LQIPVSSSS (MAGC1_HUMAN)
LGIPVSSSF

SEQ ID NO: 85234 - protein, 9 aa, Artificial Sequence
  Description of Artificial Sequence: Synthetic peptide
  Seed: FLAMLKNTV (MAGC1_HUMAN)
FVAMLKNTV

SEQ ID NO: 85235 - protein, 11 aa, Artificial Sequence
  Description of Artificial Sequence: Synthetic peptide
  Seed: SASSSVMSPSF (MAGC1_HUMAN)
STSSSVMSPSW

SEQ ID NO: 85236 - protein, 10 aa, Artificial Sequence
  Description of Artificial Sequence: Synthetic peptide
  Seed: RAGREHFAFG (MAGC1_HUMAN)
RVGREHFAFK

SEQ ID NO: 85237 - protein, 9 aa, Artificial Sequence
  Description of Artificial Sequence: Synthetic peptide
  Seed: SSSSTLLSL (MAGC1_HUMAN)
SWSSTLLSM

SEQ ID NO: 85238 - protein, 10 aa, Artificial Sequence
  Description of Artificial Sequence: Synthetic peptide
  Seed: SSPERTHSTF (MAGC1_HUMAN)
SAPERTHSTF

SEQ ID NO: 85239 - protein, 10 aa, Artificial Sequence
  Description of Artificial Sequence: Synthetic peptide
  Seed: LQIPGSPSFS (MAGC1_HUMAN)
LIIPGSPSFY

SEQ ID NO: 85240 - protein, 9 aa, Artificial Sequence
  Description of Artificial Sequence: Synthetic peptide
  Seed: EVPNSSPPR (MAGC1_HUMAN)
EIPNSSPPR

SEQ ID NO: 85241 - protein, 10 aa, Artificial Sequence
  Description of Artificial Sequence: Synthetic peptide
  Seed: RSFSSTLLSI (MAGC1_HUMAN)
RIFSSTLLSI

SEQ ID NO: 85242 - protein, 10 aa, Artificial Sequence
  Description of Artificial Sequence: Synthetic peptide
  Seed: REFIEILFGI (MAGC1_HUMAN)
RMFIEILFGL

SEQ ID NO: 85243 - protein, 10 aa, Artificial Sequence
  Description of Artificial Sequence: Synthetic peptide
  Seed: FIEILFGISL (MAGC1_HUMAN)
FAEILFGISL

SEQ ID NO: 85244 - protein, 9 aa, Artificial Sequence
  Description of Artificial Sequence: Synthetic peptide
  Seed: DVLSGIGVR (MAGC1_HUMAN)
DALSGIGVY

SEQ ID NO: 85245 - protein, 10 aa, Artificial Sequence
  Description of Artificial Sequence: Synthetic peptide
  Seed: RYTGYFPVIF (MAGC1_HUMAN)
RFTGYFPVIW

SEQ ID NO: 85246 - protein, 9 aa, Artificial Sequence
  Description of Artificial Sequence: Synthetic peptide
  Seed: EVDPDDSYV (MAGC1_HUMAN)
EMDPDDSYL

SEQ ID NO: 85247 - protein, 11 aa, Artificial Sequence
  Description of Artificial Sequence: Synthetic peptide
  Seed: IPMTSSFSSTL (MAGC1_HUMAN)
IRMTSSFSSTF

SEQ ID NO: 85248 - protein, 9 aa, Artificial Sequence
  Description of Artificial Sequence: Synthetic peptide
  Seed: FSYTLLSLF (MAGC1_HUMAN)
FGYTLLSLF

SEQ ID NO: 85249 - protein, 9 aa, Artificial Sequence
  Description of Artificial Sequence: Synthetic peptide
  Seed: LQIPGSPSF (MAGC1_HUMAN)
LSIPGSPSV

SEQ ID NO: 85250 - protein, 9 aa, Artificial Sequence
  Description of Artificial Sequence: Synthetic peptide
  Seed: RTQSTFEGF (MAGC1_HUMAN)
RQQSTFEGI

SEQ ID NO: 85251 - protein, 9 aa, Artificial Sequence
  Description of Artificial Sequence: Synthetic peptide
  Seed: IPVSPSSSS (MAGC1_HUMAN)
IPVSPSSSY

SEQ ID NO: 85252 - protein, 11 aa, Artificial Sequence
  Description of Artificial Sequence: Synthetic peptide
  Seed: SPLQIPGSPSF (MAGC1_HUMAN)
SPLQIPGSPSI

SEQ ID NO: 85253 - protein, 9 aa, Artificial Sequence
  Description of Artificial Sequence: Synthetic peptide
  Seed: FFSSALLSI (MAGC1_HUMAN)
FGSSALLSF

SEQ ID NO: 85254 - protein, 9 aa, Artificial Sequence
  Description of Artificial Sequence: Synthetic peptide
  Seed: RAGREHFAF (MAGC1_HUMAN)
RTGREHFAY

SEQ ID NO: 85255 - protein, 11 aa, Artificial Sequence
  Description of Artificial Sequence: Synthetic peptide
  Seed: LWGPRAHSEVI (MAGC1_HUMAN)
LQGPRAHSEVL

SEQ ID NO: 85256 - protein, 10 aa, Artificial Sequence
  Description of Artificial Sequence: Synthetic peptide
  Seed: KAEMLTNVIS (MAGC1_HUMAN)
KLEMLTNVIA

SEQ ID NO: 85257 - protein, 10 aa, Artificial Sequence
  Description of Artificial Sequence: Synthetic peptide
  Seed: MPTAGMPSLL (MAGC1_HUMAN)
MDTAGMPSLF

SEQ ID NO: 85258 - protein, 9 aa, Artificial Sequence
  Description of Artificial Sequence: Synthetic peptide
  Seed: FFSYTLASL (MAGC1_HUMAN)
FTSYTLASV

SEQ ID NO: 85259 - protein, 10 aa, Artificial Sequence
  Description of Artificial Sequence: Synthetic peptide
  Seed: RSFSSTLLSI (MAGC1_HUMAN)
RRFSSTLLSY

SEQ ID NO: 85260 - protein, 9 aa, Artificial Sequence
  Description of Artificial Sequence: Synthetic peptide
  Seed: EDSLSPLQI (MAGC1_HUMAN)
EESLSPLQM

SEQ ID NO: 85261 - protein, 9 aa, Artificial Sequence
  Description of Artificial Sequence: Synthetic peptide
  Seed: TSLSLPQSF (MAGC1_HUMAN)
TVLSLPQSF

SEQ ID NO: 85262 - protein, 11 aa, Artificial Sequence
  Description of Artificial Sequence: Synthetic peptide
  Seed: SERTQSTFEGF (MAGC1_HUMAN)
SERTQSTFEGY

SEQ ID NO: 85263 - protein, 9 aa, Artificial Sequence
  Description of Artificial Sequence: Synthetic peptide
  Seed: LQIPVSRSF (MAGC1_HUMAN)
LRIPVSRSY

SEQ ID NO: 85264 - protein, 9 aa, Artificial Sequence
  Description of Artificial Sequence: Synthetic peptide
  Seed: DSYVFVNTL (MAGC1_HUMAN)
DQYVFVNTY

SEQ ID NO: 85265 - protein, 9 aa, Artificial Sequence
  Description of Artificial Sequence: Synthetic peptide
  Seed: LQIPVSAAS (MAGC1_HUMAN)
LYIPVSAAY

SEQ ID NO: 85266 - protein, 10 aa, Artificial Sequence
  Description of Artificial Sequence: Synthetic peptide
  Seed: KAREFIEILF (MAGC1_HUMAN)
KGREFIEILK

SEQ ID NO: 85267 - protein, 9 aa, Artificial Sequence
  Description of Artificial Sequence: Synthetic peptide
  Seed: FFSYTLASL (MAGC1_HUMAN)
FMSYTLASC

SEQ ID NO: 85268 - protein, 9 aa, Artificial Sequence
  Description of Artificial Sequence: Synthetic peptide
  Seed: LQIPVSRSF (MAGC1_HUMAN)
LFIPVSRSM

SEQ ID NO: 85269 - protein, 9 aa, Artificial Sequence
  Description of Artificial Sequence: Synthetic peptide
  Seed: TLDEKVDEL (MAGC1_HUMAN)
TIDEKVDEM

SEQ ID NO: 85270 - protein, 9 aa, Artificial Sequence
  Description of Artificial Sequence: Synthetic peptide
  Seed: GSPSFSSTL (MAGC1_HUMAN)
GSPSFSSTW

SEQ ID NO: 85271 - protein, 9 aa, Artificial Sequence
  Description of Artificial Sequence: Synthetic peptide
  Seed: KQPITKAEM (MAGC1_HUMAN)
KAPITKAEY

SEQ ID NO: 85272 - protein, 9 aa, Artificial Sequence
  Description of Artificial Sequence: Synthetic peptide
  Seed: LSDEQGMSQ (MAGC1_HUMAN)
LLDEQGMSC

SEQ ID NO: 85273 - protein, 11 aa, Artificial Sequence
  Description of Artificial Sequence: Synthetic peptide
  Seed: SPLQNPASSFF (MAGC1_HUMAN)
SRLQNPASSFF

SEQ ID NO: 85274 - protein, 11 aa, Artificial Sequence
  Description of Artificial Sequence: Synthetic peptide
  Seed: SPLQIPVSPSS (MAGC1_HUMAN)
SYLQIPVSPSY

SEQ ID NO: 85275 - protein, 9 aa, Artificial Sequence
  Description of Artificial Sequence: Synthetic peptide
  Seed: SSPESDDTL (MAGC1_HUMAN)
SFPESDDTM

SEQ ID NO: 85276 - protein, 10 aa, Artificial Sequence
  Description of Artificial Sequence: Synthetic peptide
  Seed: ICSSSTPSSL (MAGC1_HUMAN)
IMSSSTPSSL

SEQ ID NO: 85277 - protein, 9 aa, Artificial Sequence
  Description of Artificial Sequence: Synthetic peptide
  Seed: SSSTLVSIF (MAGC1_HUMAN)
STSTLVSIM

SEQ ID NO: 85278 - protein, 10 aa, Artificial Sequence
  Description of Artificial Sequence: Synthetic peptide
  Seed: SSPESAQSTF (MAGC1_HUMAN)
SRPESAQSTF

SEQ ID NO: 85279 - protein, 9 aa, Artificial Sequence
  Description of Artificial Sequence: Synthetic peptide
  Seed: SPPQGEDSM (MAGC1_HUMAN)
SVPQGEDSL

SEQ ID NO: 85280 - protein, 10 aa, Artificial Sequence
  Description of Artificial Sequence: Synthetic peptide
  Seed: RAGREHFAFG (MAGC1_HUMAN)
RVGREHFAFM

SEQ ID NO: 85281 - protein, 9 aa, Artificial Sequence
  Description of Artificial Sequence: Synthetic peptide
  Seed: SSFFSSALL (MAGC1_HUMAN)
SIFFSSALW

SEQ ID NO: 85282 - protein, 10 aa, Artificial Sequence
  Description of Artificial Sequence: Synthetic peptide
  Seed: LAMLKNTVPI (MAGC1_HUMAN)
LPMLKNTVPV

SEQ ID NO: 85283 - protein, 9 aa, Artificial Sequence
  Description of Artificial Sequence: Synthetic peptide
  Seed: RAGREHFAF (MAGC1_HUMAN)
RQGREHFAF

SEQ ID NO: 85284 - protein, 9 aa, Artificial Sequence
  Description of Artificial Sequence: Synthetic peptide
  Seed: SSFPSSTSS (MAGC1_HUMAN)
SAFPSSTSM

SEQ ID NO: 85285 - protein, 9 aa, Artificial Sequence
  Description of Artificial Sequence: Synthetic peptide
  Seed: RSFSSTLLS (MAGC1_HUMAN)
RLFSSTLLW

SEQ ID NO: 85286 - protein, 10 aa, Artificial Sequence
  Description of Artificial Sequence: Synthetic peptide
  Seed: YTLDEKVDEL (MAGC1_HUMAN)
YYLDEKVDEV

SEQ ID NO: 85287 - protein, 10 aa, Artificial Sequence
  Description of Artificial Sequence: Synthetic peptide
  Seed: LAMLKNTVPI (MAGC1_HUMAN)
LRMLKNTVPL

SEQ ID NO: 85288 - protein, 9 aa, Artificial Sequence
  Description of Artificial Sequence: Synthetic peptide
  Seed: VSSSFSYTL (MAGC1_HUMAN)
VLSSFSYTY

SEQ ID NO: 85289 - protein, 10 aa, Artificial Sequence
  Description of Artificial Sequence: Synthetic peptide
  Seed: KVDELARFLL (MAGC1_HUMAN)
KTDELARFLF

SEQ ID NO: 85290 - protein, 10 aa, Artificial Sequence
  Description of Artificial Sequence: Synthetic peptide
  Seed: FPQSLLQIPM (MAGC1_HUMAN)
FDQSLLQIPY

SEQ ID NO: 85291 - protein, 9 aa, Artificial Sequence
  Description of Artificial Sequence: Synthetic peptide
  Seed: SPERTHSTF (MAGC1_HUMAN)
SPERTHSTA

SEQ ID NO: 85292 - protein, 9 aa, Artificial Sequence
  Description of Artificial Sequence: Synthetic peptide
  Seed: SSPERTHST (MAGC1_HUMAN)
SAPERTHSY

SEQ ID NO: 85293 - protein, 9 aa, Artificial Sequence
  Description of Artificial Sequence: Synthetic peptide
  Seed: VSAASSSTL (MAGC1_HUMAN)
VVAASSSTW

SEQ ID NO: 85294 - protein, 10 aa, Artificial Sequence
  Description of Artificial Sequence: Synthetic peptide
  Seed: LQIVPSLPEW (MAGC1_HUMAN)
LKIVPSLPEM

SEQ ID NO: 85295 - protein, 9 aa, Artificial Sequence
  Description of Artificial Sequence: Synthetic peptide
  Seed: NSSPPRYEF (MAGC1_HUMAN)
NISPPRYEF

SEQ ID NO: 85296 - protein, 9 aa, Artificial Sequence
  Description of Artificial Sequence: Synthetic peptide
  Seed: RAHSEVIKR (MAGC1_HUMAN)
RMHSEVIKR

SEQ ID NO: 85297 - protein, 9 aa, Artificial Sequence
  Description of Artificial Sequence: Synthetic peptide
  Seed: LQIPVSRSF (MAGC1_HUMAN)
LRIPVSRSV

SEQ ID NO: 85298 - protein, 9 aa, Artificial Sequence
  Description of Artificial Sequence: Synthetic peptide
  Seed: EHFAFGEPR (MAGC1_HUMAN)
EIFAFGEPR

SEQ ID NO: 85299 - protein, 11 aa, Artificial Sequence
  Description of Artificial Sequence: Synthetic peptide
  Seed: IIDTTDDSTAT (MAGC1_HUMAN)
IIDTTDDSTAF

SEQ ID NO: 85300 - protein, 10 aa, Artificial Sequence
  Description of Artificial Sequence: Synthetic peptide
  Seed: SSPESTQSPF (MAGC1_HUMAN)
SLPESTQSPY

SEQ ID NO: 85301 - protein, 9 aa, Artificial Sequence
  Description of Artificial Sequence: Synthetic peptide
  Seed: SLIESEPLF (MAGC1_HUMAN)
SWIESEPLL

SEQ ID NO: 85302 - protein, 9 aa, Artificial Sequence
  Description of Artificial Sequence: Synthetic peptide
  Seed: RAGREHFAF (MAGC1_HUMAN)
RAGREHFAY

SEQ ID NO: 85303 - protein, 8 aa, Artificial Sequence
  Description of Artificial Sequence: Synthetic peptide
  Seed: QIPMTSSF (MAGC1_HUMAN)
QFPMTSSF

SEQ ID NO: 85304 - protein, 9 aa, Artificial Sequence
  Description of Artificial Sequence: Synthetic peptide
  Seed: SSPPRYEFL (MAGC1_HUMAN)
SFPPRYEFW

SEQ ID NO: 85305 - protein, 9 aa, Artificial Sequence
  Description of Artificial Sequence: Synthetic peptide
  Seed: YQVKQPITK (MAGC1_HUMAN)
YAVKQPITV

SEQ ID NO: 85306 - protein, 9 aa, Artificial Sequence
  Description of Artificial Sequence: Synthetic peptide
  Seed: TLDEKVDEL (MAGC1_HUMAN)
TMDEKVDEY

SEQ ID NO: 85307 - protein, 9 aa, Artificial Sequence
  Description of Artificial Sequence: Synthetic peptide
  Seed: REVDPDDSY (MAGC1_HUMAN)
RQVDPDDSW

SEQ ID NO: 85308 - protein, 9 aa, Artificial Sequence
  Description of Artificial Sequence: Synthetic peptide
  Seed: SGIGVRAGR (MAGC1_HUMAN)
SQIGVRAGR

SEQ ID NO: 85309 - protein, 9 aa, Artificial Sequence
  Description of Artificial Sequence: Synthetic peptide
  Seed: SSPEGKDSL (MAGC1_HUMAN)
SIPEGKDSI

SEQ ID NO: 85310 - protein, 10 aa, Artificial Sequence
  Description of Artificial Sequence: Synthetic peptide
  Seed: REFIEILFGI (MAGC1_HUMAN)
RQFIEILFGT

SEQ ID NO: 85311 - protein, 10 aa, Artificial Sequence
  Description of Artificial Sequence: Synthetic peptide
  Seed: STPSSLPQSF (MAGC1_HUMAN)
SYPSSLPQSW

SEQ ID NO: 85312 - protein, 10 aa, Artificial Sequence
  Description of Artificial Sequence: Synthetic peptide
  Seed: FAFGEPRELL (MAGC1_HUMAN)
FLFGEPRELI

SEQ ID NO: 85313 - protein, 9 aa, Artificial Sequence
  Description of Artificial Sequence: Synthetic peptide
  Seed: FSSTLLSLF (MAGC1_HUMAN)
FPSTLLSLM

SEQ ID NO: 85314 - protein, 9 aa, Artificial Sequence
  Description of Artificial Sequence: Synthetic peptide
  Seed: SSSDTLLES (MAGC1_HUMAN)
STSDTLLEF

SEQ ID NO: 85315 - protein, 10 aa, Artificial Sequence
  Description of Artificial Sequence: Synthetic peptide
  Seed: RSFSSTLLSI (MAGC1_HUMAN)
RIFSSTLLSW

SEQ ID NO: 85316 - protein, 10 aa, Artificial Sequence
  Description of Artificial Sequence: Synthetic peptide
  Seed: FFSYTLASLL (MAGC1_HUMAN)
FKSYTLASLW

SEQ ID NO: 85317 - protein, 9 aa, Artificial Sequence
  Description of Artificial Sequence: Synthetic peptide
  Seed: SSPESAQST (MAGC1_HUMAN)
SVPESAQSY

SEQ ID NO: 85318 - protein, 11 aa, Artificial Sequence
  Description of Artificial Sequence: Synthetic peptide
  Seed: LQIPVSSSFSY (MAGC1_HUMAN)
LFIPVSSSFSW

SEQ ID NO: 85319 - protein, 11 aa, Artificial Sequence
  Description of Artificial Sequence: Synthetic peptide
  Seed: SSFSYTLLSLF (MAGC1_HUMAN)
SSFSYTLLSLW

SEQ ID NO: 85320 - protein, 9 aa, Artificial Sequence
  Description of Artificial Sequence: Synthetic peptide
  Seed: LQIPVSPSF (MAGC1_HUMAN)
LYIPVSPSV

SEQ ID NO: 85321 - protein, 10 aa, Artificial Sequence
  Description of Artificial Sequence: Synthetic peptide
  Seed: LQIPVSSSFS (MAGC1_HUMAN)
LQIPVSSSFN

SEQ ID NO: 85322 - protein, 10 aa, Artificial Sequence
  Description of Artificial Sequence: Synthetic peptide
  Seed: VSSSSSSSTL (MAGC1_HUMAN)
VVSSSSSSTY

SEQ ID NO: 85323 - protein, 10 aa, Artificial Sequence
  Description of Artificial Sequence: Synthetic peptide
  Seed: FPQSLLQIPM (MAGC1_HUMAN)
FYQSLLQIPV

SEQ ID NO: 85324 - protein, 10 aa, Artificial Sequence
  Description of Artificial Sequence: Synthetic peptide
  Seed: IIDTTDDSTA (MAGC1_HUMAN)
IADTTDDSTV

SEQ ID NO: 85325 - protein, 11 aa, Artificial Sequence
  Description of Artificial Sequence: Synthetic peptide
  Seed: SPLQIPVSRSF (MAGC1_HUMAN)
SALQIPVSRSY

SEQ ID NO: 85326 - protein, 9 aa, Artificial Sequence
  Description of Artificial Sequence: Synthetic peptide
  Seed: LQRPVSSFF (MAGC1_HUMAN)
LTRPVSSFM

SEQ ID NO: 85327 - protein, 9 aa, Artificial Sequence
  Description of Artificial Sequence: Synthetic peptide
  Seed: YQVKQPITK (MAGC1_HUMAN)
YAVKQPITI

SEQ ID NO: 85328 - protein, 9 aa, Artificial Sequence
  Description of Artificial Sequence: Synthetic peptide
  Seed: SSPESAQST (MAGC1_HUMAN)
SYPESAQSM

SEQ ID NO: 85329 - protein, 11 aa, Artificial Sequence
  Description of Artificial Sequence: Synthetic peptide
  Seed: SICSSSTPSSL (MAGC1_HUMAN)
SQCSSSTPSSF

SEQ ID NO: 85330 - protein, 10 aa, Artificial Sequence
  Description of Artificial Sequence: Synthetic peptide
  Seed: ISRYTGYFPV (MAGC1_HUMAN)
IIRYTGYFPV

SEQ ID NO: 85331 - protein, 10 aa, Artificial Sequence
  Description of Artificial Sequence: Synthetic peptide
  Seed: FAFGEPRELL (MAGC1_HUMAN)
FYFGEPRELY

SEQ ID NO: 85332 - protein, 10 aa, Artificial Sequence
  Description of Artificial Sequence: Synthetic peptide
  Seed: ASSSTLVSIF (MAGC1_HUMAN)
AESSTLVSIW

SEQ ID NO: 85333 - protein, 10 aa, Artificial Sequence
  Description of Artificial Sequence: Synthetic peptide
  Seed: VSRSFSSTLL (MAGC1_HUMAN)
VVRSFSSTLK

SEQ ID NO: 85334 - protein, 9 aa, Artificial Sequence
  Description of Artificial Sequence: Synthetic peptide
  Seed: SSFFSYTLA (MAGC1_HUMAN)
SQFFSYTLI

SEQ ID NO: 85335 - protein, 10 aa, Artificial Sequence
  Description of Artificial Sequence: Synthetic peptide
  Seed: SPLQRPVSSF (MAGC1_HUMAN)
STLQRPVSSY

SEQ ID NO: 85336 - protein, 9 aa, Artificial Sequence
  Description of Artificial Sequence: Synthetic peptide
  Seed: FSYTLLSLF (MAGC1_HUMAN)
FVYTLLSLY

SEQ ID NO: 85337 - protein, 9 aa, Artificial Sequence
  Description of Artificial Sequence: Synthetic peptide
  Seed: NVISRYTGY (MAGC1_HUMAN)
NIISRYTGY

SEQ ID NO: 85338 - protein, 10 aa, Artificial Sequence
  Description of Artificial Sequence: Synthetic peptide
  Seed: SFFSSALLSI (MAGC1_HUMAN)
SFFSSALLSM

SEQ ID NO: 85339 - protein, 9 aa, Artificial Sequence
  Description of Artificial Sequence: Synthetic peptide
  Seed: SPLQNSQSS (MAGC1_HUMAN)
SPLQNSQSA

SEQ ID NO: 85340 - protein, 11 aa, Artificial Sequence
  Description of Artificial Sequence: Synthetic peptide
  Seed: SPLQIPGSPSF (MAGC1_HUMAN)
SKLQIPGSPSF

SEQ ID NO: 85341 - protein, 9 aa, Artificial Sequence
  Description of Artificial Sequence: Synthetic peptide
  Seed: DSYVFVNTL (MAGC1_HUMAN)
DIYVFVNTW

SEQ ID NO: 85342 - protein, 10 aa, Artificial Sequence
  Description of Artificial Sequence: Synthetic peptide
  Seed: EVIWDVLSGI (MAGC1_HUMAN)
ERIWDVLSGV

SEQ ID NO: 85343 - protein, 9 aa, Artificial Sequence
  Description of Artificial Sequence: Synthetic peptide
  Seed: SPLQRPVSS (MAGC1_HUMAN)
SPLQRPVSL

SEQ ID NO: 85344 - protein, 9 aa, Artificial Sequence
  Description of Artificial Sequence: Synthetic peptide
  Seed: TSLSLPQSF (MAGC1_HUMAN)
TYLSLPQSW

SEQ ID NO: 85345 - protein, 10 aa, Artificial Sequence
  Description of Artificial Sequence: Synthetic peptide
  Seed: FPQSVLQIPV (MAGC1_HUMAN)
FSQSVLQIPV

SEQ ID NO: 85346 - protein, 9 aa, Artificial Sequence
  Description of Artificial Sequence: Synthetic peptide
  Seed: ISFSSSTSL (MAGC1_HUMAN)
IVFSSSTSM

SEQ ID NO: 85347 - protein, 10 aa, Artificial Sequence
  Description of Artificial Sequence: Synthetic peptide
  Seed: SSPERTQSTF (MAGC1_HUMAN)
STPERTQSTL

SEQ ID NO: 85348 - protein, 10 aa, Artificial Sequence
  Description of Artificial Sequence: Synthetic peptide
  Seed: YTLASLLQSS (MAGC1_HUMAN)
YGLASLLQST

SEQ ID NO: 85349 - protein, 9 aa, Artificial Sequence
  Description of Artificial Sequence: Synthetic peptide
  Seed: IEILFGISL (MAGC1_HUMAN)
IVILFGISF

SEQ ID NO: 85350 - protein, 11 aa, Artificial Sequence
  Description of Artificial Sequence: Synthetic peptide
  Seed: SLIESEPLFTY (MAGC1_HUMAN)
STIESEPLFTR

SEQ ID NO: 85351 - protein, 10 aa, Artificial Sequence
  Description of Artificial Sequence: Synthetic peptide
  Seed: RYTGYFPVIF (MAGC1_HUMAN)
RATGYFPVIY

SEQ ID NO: 85352 - protein, 9 aa, Artificial Sequence
  Description of Artificial Sequence: Synthetic peptide
  Seed: SSSTLLSLF (MAGC1_HUMAN)
STSTLLSLI

SEQ ID NO: 85353 - protein, 11 aa, Artificial Sequence
  Description of Artificial Sequence: Synthetic peptide
  Seed: SSFSYTLLSLF (MAGC1_HUMAN)
SDFSYTLLSLY

SEQ ID NO: 85354 - protein, 10 aa, Artificial Sequence
  Description of Artificial Sequence: Synthetic peptide
  Seed: PLQIPVSSSF (MAGC1_HUMAN)
PTQIPVSSSY

SEQ ID NO: 85355 - protein, 9 aa, Artificial Sequence
  Description of Artificial Sequence: Synthetic peptide
  Seed: SLPEWEDSL (MAGC1_HUMAN)
SFPEWEDSY

SEQ ID NO: 85356 - protein, 10 aa, Artificial Sequence
  Description of Artificial Sequence: Synthetic peptide
  Seed: SFFSSALLSI (MAGC1_HUMAN)
SWFSSALLSF

SEQ ID NO: 85357 - protein, 9 aa, Artificial Sequence
  Description of Artificial Sequence: Synthetic peptide
  Seed: VPITFPSSY (MAGC1_HUMAN)
VTITFPSSL

SEQ ID NO: 85358 - protein, 10 aa, Artificial Sequence
  Description of Artificial Sequence: Synthetic peptide
  Seed: SSPESAQSAF (MAGC1_HUMAN)
STPESAQSAL

SEQ ID NO: 85359 - protein, 9 aa, Artificial Sequence
  Description of Artificial Sequence: Synthetic peptide
  Seed: HFPQSPPEW (MAGC1_HUMAN)
HAPQSPPEY

SEQ ID NO: 85360 - protein, 10 aa, Artificial Sequence
  Description of Artificial Sequence: Synthetic peptide
  Seed: FFSYTLASLL (MAGC1_HUMAN)
FMSYTLASLS

SEQ ID NO: 85361 - protein, 9 aa, Artificial Sequence
  Description of Artificial Sequence: Synthetic peptide
  Seed: YVFVNTLDL (MAGC1_HUMAN)
YAFVNTLDM

SEQ ID NO: 85362 - protein, 10 aa, Artificial Sequence
  Description of Artificial Sequence: Synthetic peptide
  Seed: EILFGISLRE (MAGC1_HUMAN)
EDLFGISLRK

SEQ ID NO: 85363 - protein, 11 aa, Artificial Sequence
  Description of Artificial Sequence: Synthetic peptide
  Seed: VSSSSSSSTLL (MAGC1_HUMAN)
VWSSSSSSTLW

SEQ ID NO: 85364 - protein, 10 aa, Artificial Sequence
  Description of Artificial Sequence: Synthetic peptide
  Seed: LSQSSPVSSF (MAGC1_HUMAN)
LDQSSPVSSF

SEQ ID NO: 85365 - protein, 10 aa, Artificial Sequence
  Description of Artificial Sequence: Synthetic peptide
  Seed: QRPVSSFFSY (MAGC1_HUMAN)
QEPVSSFFSY

SEQ ID NO: 85366 - protein, 9 aa, Artificial Sequence
  Description of Artificial Sequence: Synthetic peptide
  Seed: SAPEGEDSL (MAGC1_HUMAN)
SYPEGEDSF

SEQ ID NO: 85367 - protein, 9 aa, Artificial Sequence
  Description of Artificial Sequence: Synthetic peptide
  Seed: FPQSPLQGE (MAGC1_HUMAN)
FPQSPLQGV

SEQ ID NO: 85368 - protein, 9 aa, Artificial Sequence
  Description of Artificial Sequence: Synthetic peptide
  Seed: ALLSIFQSS (MAGC1_HUMAN)
AVLSIFQSI

SEQ ID NO: 85369 - protein, 9 aa, Artificial Sequence
  Description of Artificial Sequence: Synthetic peptide
  Seed: SSFFSSALL (MAGC1_HUMAN)
SWFFSSALM

SEQ ID NO: 85370 - protein, 9 aa, Artificial Sequence
  Description of Artificial Sequence: Synthetic peptide
  Seed: MSQNRLLIL (MAGC1_HUMAN)
MFQNRLLIY

SEQ ID NO: 85371 - protein, 9 aa, Artificial Sequence
  Description of Artificial Sequence: Synthetic peptide
  Seed: IIFIKGTYA (MAGC1_HUMAN)
IAFIKGTYK

SEQ ID NO: 85372 - protein, 10 aa, Artificial Sequence
  Description of Artificial Sequence: Synthetic peptide
  Seed: FSSSTSLSPF (MAGC1_HUMAN)
FESSTSLSPW

SEQ ID NO: 85373 - protein, 11 aa, Artificial Sequence
  Description of Artificial Sequence: Synthetic peptide
  Seed: REVPNSSPPRY (MAGC1_HUMAN)
RLVPNSSPPRY

SEQ ID NO: 85374 - protein, 10 aa, Artificial Sequence
  Description of Artificial Sequence: Synthetic peptide
  Seed: LAMLKNTVPI (MAGC1_HUMAN)
LFMLKNTVPV

SEQ ID NO: 85375 - protein, 10 aa, Artificial Sequence
  Description of Artificial Sequence: Synthetic peptide
  Seed: EVPNSSPPRY (MAGC1_HUMAN)
EVPNSSPPRW

SEQ ID NO: 85376 - protein, 10 aa, Artificial Sequence
  Description of Artificial Sequence: Synthetic peptide
  Seed: SLSPLHFPQF (MAGC1_HUMAN)
SVSPLHFPQR

SEQ ID NO: 85377 - protein, 11 aa, Artificial Sequence
  Description of Artificial Sequence: Synthetic peptide
  Seed: LQIPGSPSFSS (MAGC1_HUMAN)
LQIPGSPSFSY

SEQ ID NO: 85378 - protein, 9 aa, Artificial Sequence
  Description of Artificial Sequence: Synthetic peptide
  Seed: ISFSSSTSL (MAGC1_HUMAN)
ISFSSSTSY

SEQ ID NO: 85379 - protein, 9 aa, Artificial Sequence
  Description of Artificial Sequence: Synthetic peptide
  Seed: EFIEILFGI (MAGC1_HUMAN)
EAIEILFGM

SEQ ID NO: 85380 - protein, 10 aa, Artificial Sequence
  Description of Artificial Sequence: Synthetic peptide
  Seed: WGPRAHSEVI (MAGC1_HUMAN)
WEPRAHSEVL

SEQ ID NO: 85381 - protein, 9 aa, Artificial Sequence
  Description of Artificial Sequence: Synthetic peptide
  Seed: SSHESPQSP (MAGC1_HUMAN)
SSHESPQSL

SEQ ID NO: 85382 - protein, 9 aa, Artificial Sequence
  Description of Artificial Sequence: Synthetic peptide
  Seed: SVLQIPVSA (MAGC1_HUMAN)
SPLQIPVSL

SEQ ID NO: 85383 - protein, 9 aa, Artificial Sequence
  Description of Artificial Sequence: Synthetic peptide
  Seed: TLDLTSEGC (MAGC1_HUMAN)
TIDLTSEGM

SEQ ID NO: 85384 - protein, 9 aa, Artificial Sequence
  Description of Artificial Sequence: Synthetic peptide
  Seed: SSHESPQSP (MAGC1_HUMAN)
SVHESPQSV

SEQ ID NO: 85385 - protein, 9 aa, Artificial Sequence
  Description of Artificial Sequence: Synthetic peptide
  Seed: SPLQIVPSL (MAGC1_HUMAN)
SYLQIVPSL

SEQ ID NO: 85386 - protein, 11 aa, Artificial Sequence
  Description of Artificial Sequence: Synthetic peptide
  Seed: FLAMLKNTVPI (MAGC1_HUMAN)
FDAMLKNTVPV

SEQ ID NO: 85387 - protein, 11 aa, Artificial Sequence
  Description of Artificial Sequence: Synthetic peptide
  Seed: SPLQIPVSPSS (MAGC1_HUMAN)
SELQIPVSPSF

SEQ ID NO: 85388 - protein, 9 aa, Artificial Sequence
  Description of Artificial Sequence: Synthetic peptide
  Seed: SGIGVRAGR (MAGC1_HUMAN)
SSIGVRAGF

SEQ ID NO: 85389 - protein, 11 aa, Artificial Sequence
  Description of Artificial Sequence: Synthetic peptide
  Seed: SLIESEPLFTY (MAGC1_HUMAN)
STIESEPLFTY

SEQ ID NO: 85390 - protein, 9 aa, Artificial Sequence
  Description of Artificial Sequence: Synthetic peptide
  Seed: TTDDSTATE (MAGC1_HUMAN)
TIDDSTATA

SEQ ID NO: 85391 - protein, 10 aa, Artificial Sequence
  Description of Artificial Sequence: Synthetic peptide
  Seed: VPITFPSSYK (MAGC1_HUMAN)
VSITFPSSYR

SEQ ID NO: 85392 - protein, 8 aa, Artificial Sequence
  Description of Artificial Sequence: Synthetic peptide
  Seed: QIPVSPSF (MAGC1_HUMAN)
QYPVSPSY

SEQ ID NO: 85393 - protein, 9 aa, Artificial Sequence
  Description of Artificial Sequence: Synthetic peptide
  Seed: SPFSEESSS (MAGC1_HUMAN)
SPFSEESSV

SEQ ID NO: 85394 - protein, 9 aa, Artificial Sequence
  Description of Artificial Sequence: Synthetic peptide
  Seed: MLTNVISRY (MAGC1_HUMAN)
MMTNVISRY

SEQ ID NO: 85395 - protein, 9 aa, Artificial Sequence
  Description of Artificial Sequence: Synthetic peptide
  Seed: CTQSTFEGF (MAGC1_HUMAN)
CWQSTFEGI

SEQ ID NO: 85396 - protein, 10 aa, Artificial Sequence
  Description of Artificial Sequence: Synthetic peptide
  Seed: ICSSSTSLSL (MAGC1_HUMAN)
INSSSTSLSW

SEQ ID NO: 85397 - protein, 10 aa, Artificial Sequence
  Description of Artificial Sequence: Synthetic peptide
  Seed: FSSSTSLSPF (MAGC1_HUMAN)
FCSSTSLSPM

SEQ ID NO: 85398 - protein, 10 aa, Artificial Sequence
  Description of Artificial Sequence: Synthetic peptide
  Seed: PLQIPGSPSF (MAGC1_HUMAN)
PQQIPGSPSY

SEQ ID NO: 85399 - protein, 9 aa, Artificial Sequence
  Description of Artificial Sequence: Synthetic peptide
  Seed: YVFVNTLDL (MAGC1_HUMAN)
YPFVNTLDM

SEQ ID NO: 85400 - protein, 9 aa, Artificial Sequence
  Description of Artificial Sequence: Synthetic peptide
  Seed: MLTNVISRY (MAGC1_HUMAN)
MVTNVISRM

SEQ ID NO: 85401 - protein, 9 aa, Artificial Sequence
  Description of Artificial Sequence: Synthetic peptide
  Seed: AQSPLQIPV (MAGC1_HUMAN)
ASSPLQIPV

SEQ ID NO: 85402 - protein, 9 aa, Artificial Sequence
  Description of Artificial Sequence: Synthetic peptide
  Seed: SSHESPQSP (MAGC1_HUMAN)
SVHESPQSY

SEQ ID NO: 85403 - protein, 11 aa, Artificial Sequence
  Description of Artificial Sequence: Synthetic peptide
  Seed: REVDPDDSYVF (MAGC1_HUMAN)
RKVDPDDSYVY

SEQ ID NO: 85404 - protein, 10 aa, Artificial Sequence
  Description of Artificial Sequence: Synthetic peptide
  Seed: FAQSSLQIPV (MAGC1_HUMAN)
FDQSSLQIPL

SEQ ID NO: 85405 - protein, 9 aa, Artificial Sequence
  Description of Artificial Sequence: Synthetic peptide
  Seed: FSYTLLSLF (MAGC1_HUMAN)
FSYTLLSLL

SEQ ID NO: 85406 - protein, 10 aa, Artificial Sequence
  Description of Artificial Sequence: Synthetic peptide
  Seed: FSSTLVSLFQ (MAGC1_HUMAN)
FTSTLVSLFW

SEQ ID NO: 85407 - protein, 10 aa, Artificial Sequence
  Description of Artificial Sequence: Synthetic peptide
  Seed: LSQSSPVSSF (MAGC1_HUMAN)
LSQSSPVSSM

SEQ ID NO: 85408 - protein, 10 aa, Artificial Sequence
  Description of Artificial Sequence: Synthetic peptide
  Seed: EVIWDVLSGI (MAGC1_HUMAN)
ETIWDVLSGL

SEQ ID NO: 85409 - protein, 10 aa, Artificial Sequence
  Description of Artificial Sequence: Synthetic peptide
  Seed: STFEGFPQSL (MAGC1_HUMAN)
SHFEGFPQST

SEQ ID NO: 85410 - protein, 9 aa, Artificial Sequence
  Description of Artificial Sequence: Synthetic peptide
  Seed: LQIPVSAAS (MAGC1_HUMAN)
LSIPVSAAY

SEQ ID NO: 85411 - protein, 9 aa, Artificial Sequence
  Description of Artificial Sequence: Synthetic peptide
  Seed: FFSYTLASL (MAGC1_HUMAN)
FSSYTLASF

SEQ ID NO: 85412 - protein, 10 aa, Artificial Sequence
  Description of Artificial Sequence: Synthetic peptide
  Seed: LEGEDSLSSL (MAGC1_HUMAN)
LEGEDSLSSW

SEQ ID NO: 85413 - protein, 9 aa, Artificial Sequence
  Description of Artificial Sequence: Synthetic peptide
  Seed: FSSALLSIF (MAGC1_HUMAN)
FASALLSII

SEQ ID NO: 85414 - protein, 9 aa, Artificial Sequence
  Description of Artificial Sequence: Synthetic peptide
  Seed: MPTAGMPSL (MAGC1_HUMAN)
MATAGMPSL

SEQ ID NO: 85415 - protein, 10 aa, Artificial Sequence
  Description of Artificial Sequence: Synthetic peptide
  Seed: SSFSYTLLSL (MAGC1_HUMAN)
SMFSYTLLSW

SEQ ID NO: 85416 - protein, 10 aa, Artificial Sequence
  Description of Artificial Sequence: Synthetic peptide
  Seed: FFSSALLSIF (MAGC1_HUMAN)
FESSALLSIY

SEQ ID NO: 85417 - protein, 9 aa, Artificial Sequence
  Description of Artificial Sequence: Synthetic peptide
  Seed: KAREFIEIL (MAGC1_HUMAN)
KTREFIEIS

SEQ ID NO: 85418 - protein, 9 aa, Artificial Sequence
  Description of Artificial Sequence: Synthetic peptide
  Seed: SSSTSLSPF (MAGC1_HUMAN)
SYSTSLSPY

SEQ ID NO: 85419 - protein, 9 aa, Artificial Sequence
  Description of Artificial Sequence: Synthetic peptide
  Seed: LQIPVSAAS (MAGC1_HUMAN)
LQIPVSAAV

SEQ ID NO: 85420 - protein, 9 aa, Artificial Sequence
  Description of Artificial Sequence: Synthetic peptide
  Seed: FEGFAQSPL (MAGC1_HUMAN)
FHGFAQSPF

SEQ ID NO: 85421 - protein, 10 aa, Artificial Sequence
  Description of Artificial Sequence: Synthetic peptide
  Seed: SSSSSSSTLL (MAGC1_HUMAN)
SWSSSSSTLF

SEQ ID NO: 85422 - protein, 10 aa, Artificial Sequence
  Description of Artificial Sequence: Synthetic peptide
  Seed: YTLLSLFQSS (MAGC1_HUMAN)
YFLLSLFQSV

SEQ ID NO: 85423 - protein, 9 aa, Artificial Sequence
  Description of Artificial Sequence: Synthetic peptide
  Seed: SVLQIPVSA (MAGC1_HUMAN)
SGLQIPVSR

SEQ ID NO: 85424 - protein, 9 aa, Artificial Sequence
  Description of Artificial Sequence: Synthetic peptide
  Seed: LQIPMTSSF (MAGC1_HUMAN)
LSIPMTSSF

SEQ ID NO: 85425 - protein, 9 aa, Artificial Sequence
  Description of Artificial Sequence: Synthetic peptide
  Seed: VIWDVLSGI (MAGC1_HUMAN)
VSWDVLSGV

SEQ ID NO: 85426 - protein, 10 aa, Artificial Sequence
  Description of Artificial Sequence: Synthetic peptide
  Seed: VISFSSSTSL (MAGC1_HUMAN)
VTSFSSSTSI

SEQ ID NO: 85427 - protein, 9 aa, Artificial Sequence
  Description of Artificial Sequence: Synthetic peptide
  Seed: SEVIKRKVV (MAGC1_HUMAN)
SEVIKRKVL

SEQ ID NO: 85428 - protein, 9 aa, Artificial Sequence
  Description of Artificial Sequence: Synthetic peptide
  Seed: LQIPVSRSF (MAGC1_HUMAN)
LMIPVSRSL

SEQ ID NO: 85429 - protein, 9 aa, Artificial Sequence
  Description of Artificial Sequence: Synthetic peptide
  Seed: LQIPGSPSF (MAGC1_HUMAN)
LLIPGSPSY

SEQ ID NO: 85430 - protein, 9 aa, Artificial Sequence
  Description of Artificial Sequence: Synthetic peptide
  Seed: VIKRKVVEF (MAGC1_HUMAN)
VLKRKVVEY

SEQ ID NO: 85431 - protein, 11 aa, Artificial Sequence
  Description of Artificial Sequence: Synthetic peptide
  Seed: AASSSTLVSIF (MAGC1_HUMAN)
AQSSSTLVSIM

SEQ ID NO: 85432 - protein, 10 aa, Artificial Sequence
  Description of Artificial Sequence: Synthetic peptide
  Seed: FPQSPLQIPV (MAGC1_HUMAN)
FLQSPLQIPA

SEQ ID NO: 85433 - protein, 9 aa, Artificial Sequence
  Description of Artificial Sequence: Synthetic peptide
  Seed: KVWVQEHYL (MAGC1_HUMAN)
KGWVQEHYY

SEQ ID NO: 85434 - protein, 10 aa, Artificial Sequence
  Description of Artificial Sequence: Synthetic peptide
  Seed: SSSSSTLLSL (MAGC1_HUMAN)
SVSSSTLLSW

SEQ ID NO: 85435 - protein, 9 aa, Artificial Sequence
  Description of Artificial Sequence: Synthetic peptide
  Seed: RKAREFIEI (MAGC1_HUMAN)
RAAREFIEM

SEQ ID NO: 85436 - protein, 9 aa, Artificial Sequence
  Description of Artificial Sequence: Synthetic peptide
  Seed: WVQEHYLEY (MAGC1_HUMAN)
WYQEHYLEI

SEQ ID NO: 85437 - protein, 10 aa, Artificial Sequence
  Description of Artificial Sequence: Synthetic peptide
  Seed: SLSPLHFPQF (MAGC1_HUMAN)
SMSPLHFPQV

SEQ ID NO: 85438 - protein, 10 aa, Artificial Sequence
  Description of Artificial Sequence: Synthetic peptide
  Seed: AASSSTLVSI (MAGC1_HUMAN)
AMSSSTLVST

SEQ ID NO: 85439 - protein, 9 aa, Artificial Sequence
  Description of Artificial Sequence: Synthetic peptide
  Seed: GVRAGREHF (MAGC1_HUMAN)
GKRAGREHY

SEQ ID NO: 85440 - protein, 10 aa, Artificial Sequence
  Description of Artificial Sequence: Synthetic peptide
  Seed: RSFSSTLLSI (MAGC1_HUMAN)
RVFSSTLLSK

SEQ ID NO: 85441 - protein, 9 aa, Artificial Sequence
  Description of Artificial Sequence: Synthetic peptide
  Seed: LQRPVSSFF (MAGC1_HUMAN)
LARPVSSFW

SEQ ID NO: 85442 - protein, 10 aa, Artificial Sequence
  Description of Artificial Sequence: Synthetic peptide
  Seed: YTLASLLQSS (MAGC1_HUMAN)
YCLASLLQSV

SEQ ID NO: 85443 - protein, 9 aa, Artificial Sequence
  Description of Artificial Sequence: Synthetic peptide
  Seed: TLASLLQSS (MAGC1_HUMAN)
TTASLLQSV

SEQ ID NO: 85444 - protein, 9 aa, Artificial Sequence
  Description of Artificial Sequence: Synthetic peptide
  Seed: AQSPLQRPV (MAGC1_HUMAN)
ARSPLQRPM

SEQ ID NO: 85445 - protein, 9 aa, Artificial Sequence
  Description of Artificial Sequence: Synthetic peptide
  Seed: VIFRKAREF (MAGC1_HUMAN)
VTFRKAREF

SEQ ID NO: 85446 - protein, 10 aa, Artificial Sequence
  Description of Artificial Sequence: Synthetic peptide
  Seed: YTLASLLQSS (MAGC1_HUMAN)
YDLASLLQSI

SEQ ID NO: 85447 - protein, 9 aa, Artificial Sequence
  Description of Artificial Sequence: Synthetic peptide
  Seed: IFRKAREFI (MAGC1_HUMAN)
IYRKAREFK

SEQ ID NO: 85448 - protein, 9 aa, Artificial Sequence
  Description of Artificial Sequence: Synthetic peptide
  Seed: FQSSPERTH (MAGC1_HUMAN)
FMSSPERTF

SEQ ID NO: 85449 - protein, 9 aa, Artificial Sequence
  Description of Artificial Sequence: Synthetic peptide
  Seed: AGREHFAFG (MAGC1_HUMAN)
AKREHFAFK

SEQ ID NO: 85450 - protein, 10 aa, Artificial Sequence
  Description of Artificial Sequence: Synthetic peptide
  Seed: MSQNRLLILI (MAGC1_HUMAN)
MSQNRLLILY

SEQ ID NO: 85451 - protein, 9 aa, Artificial Sequence
  Description of Artificial Sequence: Synthetic peptide
  Seed: CSSSTSLSL (MAGC1_HUMAN)
CMSSTSLSI

SEQ ID NO: 85452 - protein, 9 aa, Artificial Sequence
  Description of Artificial Sequence: Synthetic peptide
  Seed: FSYTLLSLF (MAGC1_HUMAN)
FSYTLLSLY

SEQ ID NO: 85453 - protein, 9 aa, Artificial Sequence
  Description of Artificial Sequence: Synthetic peptide
  Seed: AGREHFAFG (MAGC1_HUMAN)
ASREHFAFC

SEQ ID NO: 85454 - protein, 10 aa, Artificial Sequence
  Description of Artificial Sequence: Synthetic peptide
  Seed: LQIPGSPSFS (MAGC1_HUMAN)
LMIPGSPSFK

SEQ ID NO: 85455 - protein, 10 aa, Artificial Sequence
  Description of Artificial Sequence: Synthetic peptide
  Seed: ILILSIIFIK (MAGC1_HUMAN)
IQILSIIFIK

SEQ ID NO: 85456 - protein, 9 aa, Artificial Sequence
  Description of Artificial Sequence: Synthetic peptide
  Seed: LQIPVSSSS (MAGC1_HUMAN)
LYIPVSSSM

SEQ ID NO: 85457 - protein, 11 aa, Artificial Sequence
  Description of Artificial Sequence: Synthetic peptide
  Seed: SPLQRPVSSFF (MAGC1_HUMAN)
SKLQRPVSSFY

SEQ ID NO: 85458 - protein, 9 aa, Artificial Sequence
  Description of Artificial Sequence: Synthetic peptide
  Seed: IESEPLFTY (MAGC1_HUMAN)
ITSEPLFTM

SEQ ID NO: 85459 - protein, 10 aa, Artificial Sequence
  Description of Artificial Sequence: Synthetic peptide
  Seed: LQIVPSLPEW (MAGC1_HUMAN)
LSIVPSLPEW

SEQ ID NO: 85460 - protein, 10 aa, Artificial Sequence
  Description of Artificial Sequence: Synthetic peptide
  Seed: KVDELARFLL (MAGC1_HUMAN)
KLDELARFLM

SEQ ID NO: 85461 - protein, 9 aa, Artificial Sequence
  Description of Artificial Sequence: Synthetic peptide
  Seed: TLLSIFQSS (MAGC1_HUMAN)
TMLSIFQSL

SEQ ID NO: 85462 - protein, 9 aa, Artificial Sequence
  Description of Artificial Sequence: Synthetic peptide
  Seed: SLSPHYFPQ (MAGC1_HUMAN)
SLSPHYFPR

SEQ ID NO: 85463 - protein, 10 aa, Artificial Sequence
  Description of Artificial Sequence: Synthetic peptide
  Seed: YVFVNTLDLT (MAGC1_HUMAN)
YMFVNTLDLI

SEQ ID NO: 85464 - protein, 9 aa, Artificial Sequence
  Description of Artificial Sequence: Synthetic peptide
  Seed: AQSPLQRPV (MAGC1_HUMAN)
AESPLQRPC

SEQ ID NO: 85465 - protein, 10 aa, Artificial Sequence
  Description of Artificial Sequence: Synthetic peptide
  Seed: RYTGYFPVIF (MAGC1_HUMAN)
RSTGYFPVIY

SEQ ID NO: 85466 - protein, 10 aa, Artificial Sequence
  Description of Artificial Sequence: Synthetic peptide
  Seed: EVIWDVLSGI (MAGC1_HUMAN)
EIIWDVLSGK

SEQ ID NO: 85467 - protein, 9 aa, Artificial Sequence
  Description of Artificial Sequence: Synthetic peptide
  Seed: IIDTTDDST (MAGC1_HUMAN)
IVDTTDDSM

SEQ ID NO: 85468 - protein, 9 aa, Artificial Sequence
  Description of Artificial Sequence: Synthetic peptide
  Seed: LSDEQGMSQ (MAGC1_HUMAN)
LLDEQGMSI

SEQ ID NO: 85469 - protein, 11 aa, Artificial Sequence
  Description of Artificial Sequence: Synthetic peptide
  Seed: REVPNSSPPRY (MAGC1_HUMAN)
RFVPNSSPPRY

SEQ ID NO: 85470 - protein, 10 aa, Artificial Sequence
  Description of Artificial Sequence: Synthetic peptide
  Seed: IPGSPSFSST (MAGC1_HUMAN)
IPGSPSFSSA

SEQ ID NO: 85471 - protein, 10 aa, Artificial Sequence
  Description of Artificial Sequence: Synthetic peptide
  Seed: STSLSLPQSF (MAGC1_HUMAN)
SKSLSLPQSY

SEQ ID NO: 85472 - protein, 9 aa, Artificial Sequence
  Description of Artificial Sequence: Synthetic peptide
  Seed: YTGYFPVIF (MAGC1_HUMAN)
YQGYFPVIM

SEQ ID NO: 85473 - protein, 9 aa, Artificial Sequence
  Description of Artificial Sequence: Synthetic peptide
  Seed: IIDTTDDST (MAGC1_HUMAN)
IGDTTDDSI

SEQ ID NO: 85474 - protein, 9 aa, Artificial Sequence
  Description of Artificial Sequence: Synthetic peptide
  Seed: LSDEQGMSQ (MAGC1_HUMAN)
LCDEQGMSL

SEQ ID NO: 85475 - protein, 10 aa, Artificial Sequence
  Description of Artificial Sequence: Synthetic peptide
  Seed: RAGREHFAFG (MAGC1_HUMAN)
RTGREHFAFC

SEQ ID NO: 85476 - protein, 9 aa, Artificial Sequence
  Description of Artificial Sequence: Synthetic peptide
  Seed: LQIPMTSSF (MAGC1_HUMAN)
LWIPMTSSF

SEQ ID NO: 85477 - protein, 10 aa, Artificial Sequence
  Description of Artificial Sequence: Synthetic peptide
  Seed: SPVSICSSST (MAGC1_HUMAN)
SPVSICSSSI

SEQ ID NO: 85478 - protein, 9 aa, Artificial Sequence
  Description of Artificial Sequence: Synthetic peptide
  Seed: TLDEKVDEL (MAGC1_HUMAN)
TEDEKVDEI

SEQ ID NO: 85479 - protein, 10 aa, Artificial Sequence
  Description of Artificial Sequence: Synthetic peptide
  Seed: SPLYFPQSPL (MAGC1_HUMAN)
SMLYFPQSPA

SEQ ID NO: 85480 - protein, 10 aa, Artificial Sequence
  Description of Artificial Sequence: Synthetic peptide
  Seed: LQIPGSPSFS (MAGC1_HUMAN)
LTIPGSPSFF

SEQ ID NO: 85481 - protein, 10 aa, Artificial Sequence
  Description of Artificial Sequence: Synthetic peptide
  Seed: SSFPSSTSSS (MAGC1_HUMAN)
SAFPSSTSSF

SEQ ID NO: 85482 - protein, 9 aa, Artificial Sequence
  Description of Artificial Sequence: Synthetic peptide
  Seed: YTSSSDTLL (MAGC1_HUMAN)
YLSSSDTLA

SEQ ID NO: 85483 - protein, 9 aa, Artificial Sequence
  Description of Artificial Sequence: Synthetic peptide
  Seed: NSSPPRYEF (MAGC1_HUMAN)
NVSPPRYEW

SEQ ID NO: 85484 - protein, 9 aa, Artificial Sequence
  Description of Artificial Sequence: Synthetic peptide
  Seed: FSSTLLSLF (MAGC1_HUMAN)
FASTLLSLA

SEQ ID NO: 85485 - protein, 10 aa, Artificial Sequence
  Description of Artificial Sequence: Synthetic peptide
  Seed: ESAQSTFEGF (MAGC1_HUMAN)
ESAQSTFEGK

SEQ ID NO: 85486 - protein, 10 aa, Artificial Sequence
  Description of Artificial Sequence: Synthetic peptide
  Seed: MTSSFSSTLL (MAGC1_HUMAN)
MYSSFSSTLM

SEQ ID NO: 85487 - protein, 11 aa, Artificial Sequence
  Description of Artificial Sequence: Synthetic peptide
  Seed: SSFPSSTSSSL (MAGC1_HUMAN)
SGFPSSTSSSL

SEQ ID NO: 85488 - protein, 9 aa, Artificial Sequence
  Description of Artificial Sequence: Synthetic peptide
  Seed: VSRSFSSTL (MAGC1_HUMAN)
VPRSFSSTI

SEQ ID NO: 85489 - protein, 9 aa, Artificial Sequence
  Description of Artificial Sequence: Synthetic peptide
  Seed: LQRPVSSFF (MAGC1_HUMAN)
LSRPVSSFW

SEQ ID NO: 85490 - protein, 10 aa, Artificial Sequence
  Description of Artificial Sequence: Synthetic peptide
  Seed: FFSYTLASLL (MAGC1_HUMAN)
FLSYTLASLF

SEQ ID NO: 85491 - protein, 9 aa, Artificial Sequence
  Description of Artificial Sequence: Synthetic peptide
  Seed: ISFSSSTSL (MAGC1_HUMAN)
IHFSSSTSI

SEQ ID NO: 85492 - protein, 9 aa, Artificial Sequence
  Description of Artificial Sequence: Synthetic peptide
  Seed: FAFGEPREL (MAGC1_HUMAN)
FMFGEPRET

SEQ ID NO: 85493 - protein, 10 aa, Artificial Sequence
  Description of Artificial Sequence: Synthetic peptide
  Seed: PLQIPVSRSF (MAGC1_HUMAN)
PKQIPVSRSY

SEQ ID NO: 85494 - protein, 9 aa, Artificial Sequence
  Description of Artificial Sequence: Synthetic peptide
  Seed: RSFSSTLLS (MAGC1_HUMAN)
RSFSSTLLR

SEQ ID NO: 85495 - protein, 9 aa, Artificial Sequence
  Description of Artificial Sequence: Synthetic peptide
  Seed: SRYTGYFPV (MAGC1_HUMAN)
SSYTGYFPL

SEQ ID NO: 85496 - protein, 9 aa, Artificial Sequence
  Description of Artificial Sequence: Synthetic peptide
  Seed: SSSVMSPSF (MAGC1_HUMAN)
SASVMSPSF

SEQ ID NO: 85497 - protein, 9 aa, Artificial Sequence
  Description of Artificial Sequence: Synthetic peptide
  Seed: ISFSSSTSL (MAGC1_HUMAN)
IMFSSSTSF

SEQ ID NO: 85498 - protein, 9 aa, Artificial Sequence
  Description of Artificial Sequence: Synthetic peptide
  Seed: YTSSSDTLL (MAGC1_HUMAN)
YTSSSDTLW

SEQ ID NO: 85499 - protein, 11 aa, Artificial Sequence
  Description of Artificial Sequence: Synthetic peptide
  Seed: QSSPESAQSAF (MAGC1_HUMAN)
QPSPESAQSAW

SEQ ID NO: 85500 - protein, 10 aa, Artificial Sequence
  Description of Artificial Sequence: Synthetic peptide
  Seed: ICSSSTPSSL (MAGC1_HUMAN)
ISSSSTPSSY

SEQ ID NO: 85501 - protein, 9 aa, Artificial Sequence
  Description of Artificial Sequence: Synthetic peptide
  Seed: SLPEWEDSL (MAGC1_HUMAN)
SRPEWEDSF

SEQ ID NO: 85502 - protein, 10 aa, Artificial Sequence
  Description of Artificial Sequence: Synthetic peptide
  Seed: KRKVVEFLAM (MAGC1_HUMAN)
KTKVVEFLAF

SEQ ID NO: 85503 - protein, 9 aa, Artificial Sequence
  Description of Artificial Sequence: Synthetic peptide
  Seed: TSLSLPQSF (MAGC1_HUMAN)
TVLSLPQSL

SEQ ID NO: 85504 - protein, 9 aa, Artificial Sequence
  Description of Artificial Sequence: Synthetic peptide
  Seed: FQSSPERTH (MAGC1_HUMAN)
FSSSPERTY

SEQ ID NO: 85505 - protein, 10 aa, Artificial Sequence
  Description of Artificial Sequence: Synthetic peptide
  Seed: SSFSSTLLSI (MAGC1_HUMAN)
SAFSSTLLSI

SEQ ID NO: 85506 - protein, 11 aa, Artificial Sequence
  Description of Artificial Sequence: Synthetic peptide
  Seed: NTVPITFPSSY (MAGC1_HUMAN)
NAVPITFPSSR

SEQ ID NO: 85507 - protein, 9 aa, Artificial Sequence
  Description of Artificial Sequence: Synthetic peptide
  Seed: SSSSSSSTL (MAGC1_HUMAN)
SVSSSSSTM

SEQ ID NO: 85508 - protein, 10 aa, Artificial Sequence
  Description of Artificial Sequence: Synthetic peptide
  Seed: TTDDSTATES (MAGC1_HUMAN)
TLDDSTATEV

SEQ ID NO: 85509 - protein, 9 aa, Artificial Sequence
  Description of Artificial Sequence: Synthetic peptide
  Seed: SLSPFSEES (MAGC1_HUMAN)
SMSPFSEEV

SEQ ID NO: 85510 - protein, 9 aa, Artificial Sequence
  Description of Artificial Sequence: Synthetic peptide
  Seed: LQIPVSPSF (MAGC1_HUMAN)
LEIPVSPSY

SEQ ID NO: 85511 - protein, 9 aa, Artificial Sequence
  Description of Artificial Sequence: Synthetic peptide
  Seed: TLLESDSLT (MAGC1_HUMAN)
TQLESDSLV

SEQ ID NO: 85512 - protein, 9 aa, Artificial Sequence
  Description of Artificial Sequence: Synthetic peptide
  Seed: FPSSTSSSL (MAGC1_HUMAN)
FISSTSSSF

SEQ ID NO: 85513 - protein, 11 aa, Artificial Sequence
  Description of Artificial Sequence: Synthetic peptide
  Seed: LQIPVSSSFSY (MAGC1_HUMAN)
LRIPVSSSFSM

SEQ ID NO: 85514 - protein, 10 aa, Artificial Sequence
  Description of Artificial Sequence: Synthetic peptide
  Seed: KAEMLTNVIS (MAGC1_HUMAN)
KYEMLTNVIA

SEQ ID NO: 85515 - protein, 9 aa, Artificial Sequence
  Description of Artificial Sequence: Synthetic peptide
  Seed: SLTDSESLI (MAGC1_HUMAN)
SQTDSESLW

SEQ ID NO: 85516 - protein, 10 aa, Artificial Sequence
  Description of Artificial Sequence: Synthetic peptide
  Seed: FPQSLLQIPM (MAGC1_HUMAN)
FQQSLLQIPV

SEQ ID NO: 85517 - protein, 9 aa, Artificial Sequence
  Description of Artificial Sequence: Synthetic peptide
  Seed: SPLQIVPSL (MAGC1_HUMAN)
SPLQIVPSC

SEQ ID NO: 85518 - protein, 9 aa, Artificial Sequence
  Description of Artificial Sequence: Synthetic peptide
  Seed: SSSSSSSTL (MAGC1_HUMAN)
SKSSSSSTL

SEQ ID NO: 85519 - protein, 9 aa, Artificial Sequence
  Description of Artificial Sequence: Synthetic peptide
  Seed: EFIEILFGI (MAGC1_HUMAN)
EQIEILFGL

SEQ ID NO: 85520 - protein, 10 aa, Artificial Sequence
  Description of Artificial Sequence: Synthetic peptide
  Seed: MPTAGMPSLL (MAGC1_HUMAN)
MMTAGMPSLA

SEQ ID NO: 85521 - protein, 9 aa, Artificial Sequence
  Description of Artificial Sequence: Synthetic peptide
  Seed: SSSTSLSPF (MAGC1_HUMAN)
SFSTSLSPF

SEQ ID NO: 85522 - protein, 10 aa, Artificial Sequence
  Description of Artificial Sequence: Synthetic peptide
  Seed: SSSSTLLSLF (MAGC1_HUMAN)
SYSSTLLSLW

SEQ ID NO: 85523 - protein, 9 aa, Artificial Sequence
  Description of Artificial Sequence: Synthetic peptide
  Seed: IIDTTDDST (MAGC1_HUMAN)
ILDTTDDSL

SEQ ID NO: 85524 - protein, 10 aa, Artificial Sequence
  Description of Artificial Sequence: Synthetic peptide
  Seed: STLLSLFQSF (MAGC1_HUMAN)
SYLLSLFQSW

SEQ ID NO: 85525 - protein, 10 aa, Artificial Sequence
  Description of Artificial Sequence: Synthetic peptide
  Seed: ICSSSTSLSL (MAGC1_HUMAN)
INSSSTSLSY

SEQ ID NO: 85526 - protein, 9 aa, Artificial Sequence
  Description of Artificial Sequence: Synthetic peptide
  Seed: TTDDSTATE (MAGC1_HUMAN)
TNDDSTATI

SEQ ID NO: 85527 - protein, 10 aa, Artificial Sequence
  Description of Artificial Sequence: Synthetic peptide
  Seed: MSPLYFPQSP (MAGC1_HUMAN)
MIPLYFPQSV

SEQ ID NO: 85528 - protein, 9 aa, Artificial Sequence
  Description of Artificial Sequence: Synthetic peptide
  Seed: KAREFIEIL (MAGC1_HUMAN)
KVREFIEIK

SEQ ID NO: 85529 - protein, 9 aa, Artificial Sequence
  Description of Artificial Sequence: Synthetic peptide
  Seed: FEGFAQSPL (MAGC1_HUMAN)
FLGFAQSPY

SEQ ID NO: 85530 - protein, 10 aa, Artificial Sequence
  Description of Artificial Sequence: Synthetic peptide
  Seed: KAREFIEILF (MAGC1_HUMAN)
KMREFIEILK

SEQ ID NO: 85531 - protein, 9 aa, Artificial Sequence
  Description of Artificial Sequence: Synthetic peptide
  Seed: SFSSTLVSL (MAGC1_HUMAN)
SVSSTLVSI

SEQ ID NO: 85532 - protein, 9 aa, Artificial Sequence
  Description of Artificial Sequence: Synthetic peptide
  Seed: FSYTLLSLF (MAGC1_HUMAN)
FHYTLLSLM

SEQ ID NO: 85533 - protein, 9 aa, Artificial Sequence
  Description of Artificial Sequence: Synthetic peptide
  Seed: GFPQSPLQI (MAGC1_HUMAN)
GYPQSPLQW

SEQ ID NO: 85534 - protein, 9 aa, Artificial Sequence
  Description of Artificial Sequence: Synthetic peptide
  Seed: VQSPLQNPA (MAGC1_HUMAN)
VQSPLQNPV

SEQ ID NO: 85535 - protein, 11 aa, Artificial Sequence
  Description of Artificial Sequence: Synthetic peptide
  Seed: RPVSSFFSYTL (MAGC1_HUMAN)
RVVSSFFSYTF

SEQ ID NO: 85536 - protein, 10 aa, Artificial Sequence
  Description of Artificial Sequence: Synthetic peptide
  Seed: LHFPQSPPEW (MAGC1_HUMAN)
LMFPQSPPEW

SEQ ID NO: 85537 - protein, 10 aa, Artificial Sequence
  Description of Artificial Sequence: Synthetic peptide
  Seed: SSPESAQSTF (MAGC1_HUMAN)
SIPESAQSTL

SEQ ID NO: 85538 - protein, 10 aa, Artificial Sequence
  Description of Artificial Sequence: Synthetic peptide
  Seed: VSSSSSSTLL (MAGC1_HUMAN)
VHSSSSSTLF

SEQ ID NO: 85539 - protein, 10 aa, Artificial Sequence
  Description of Artificial Sequence: Synthetic peptide
  Seed: GEDSLSPLQI (MAGC1_HUMAN)
GEDSLSPLQV

SEQ ID NO: 85540 - protein, 11 aa, Artificial Sequence
  Description of Artificial Sequence: Synthetic peptide
  Seed: SPLQIPMTSSF (MAGC1_HUMAN)
SPLQIPMTSSY

SEQ ID NO: 85541 - protein, 10 aa, Artificial Sequence
  Description of Artificial Sequence: Synthetic peptide
  Seed: YTLDEKVDEL (MAGC1_HUMAN)
YQLDEKVDEI

SEQ ID NO: 85542 - protein, 9 aa, Artificial Sequence
  Description of Artificial Sequence: Synthetic peptide
  Seed: SSFFSSALL (MAGC1_HUMAN)
SFFFSSALI

SEQ ID NO: 85543 - protein, 9 aa, Artificial Sequence
  Description of Artificial Sequence: Synthetic peptide
  Seed: VIWDVLSGI (MAGC1_HUMAN)
VTWDVLSGF

SEQ ID NO: 85544 - protein, 9 aa, Artificial Sequence
  Description of Artificial Sequence: Synthetic peptide
  Seed: TESASSSVM (MAGC1_HUMAN)
TESASSSVW

SEQ ID NO: 85545 - protein, 10 aa, Artificial Sequence
  Description of Artificial Sequence: Synthetic peptide
  Seed: MPTAGMPSLL (MAGC1_HUMAN)
MATAGMPSLW

SEQ ID NO: 85546 - protein, 10 aa, Artificial Sequence
  Description of Artificial Sequence: Synthetic peptide
  Seed: ISRYTGYFPV (MAGC1_HUMAN)
IKRYTGYFPF

SEQ ID NO: 85547 - protein, 8 aa, Artificial Sequence
  Description of Artificial Sequence: Synthetic peptide
  Seed: SSFFSYTL (MAGC1_HUMAN)
STFFSYTW

SEQ ID NO: 85548 - protein, 9 aa, Artificial Sequence
  Description of Artificial Sequence: Synthetic peptide
  Seed: VPNSSPPRY (MAGC1_HUMAN)
VANSSPPRF

SEQ ID NO: 85549 - protein, 9 aa, Artificial Sequence
  Description of Artificial Sequence: Synthetic peptide
  Seed: SSPEGKDSL (MAGC1_HUMAN)
SSPEGKDSY

SEQ ID NO: 85550 - protein, 10 aa, Artificial Sequence
  Description of Artificial Sequence: Synthetic peptide
  Seed: AEMLTNVISR (MAGC1_HUMAN)
AEMLTNVISY

SEQ ID NO: 85551 - protein, 10 aa, Artificial Sequence
  Description of Artificial Sequence: Synthetic peptide
  Seed: PLQIPGSPSF (MAGC1_HUMAN)
PRQIPGSPSM

SEQ ID NO: 85552 - protein, 9 aa, Artificial Sequence
  Description of Artificial Sequence: Synthetic peptide
  Seed: STFEGFPQS (MAGC1_HUMAN)
SAFEGFPQM

SEQ ID NO: 85553 - protein, 9 aa, Artificial Sequence
  Description of Artificial Sequence: Synthetic peptide
  Seed: VQSPLQNPA (MAGC1_HUMAN)
VSSPLQNPF

SEQ ID NO: 85554 - protein, 10 aa, Artificial Sequence
  Description of Artificial Sequence: Synthetic peptide
  Seed: SPLQSPVISF (MAGC1_HUMAN)
SALQSPVISY

SEQ ID NO: 85555 - protein, 9 aa, Artificial Sequence
  Description of Artificial Sequence: Synthetic peptide
  Seed: SEVIKRKVV (MAGC1_HUMAN)
SEVIKRKVM

SEQ ID NO: 85556 - protein, 11 aa, Artificial Sequence
  Description of Artificial Sequence: Synthetic peptide
  Seed: STFEGFAQSPL (MAGC1_HUMAN)
SIFEGFAQSPI

SEQ ID NO: 85557 - protein, 10 aa, Artificial Sequence
  Description of Artificial Sequence: Synthetic peptide
  Seed: FFSSALLSIF (MAGC1_HUMAN)
FVSSALLSIY

SEQ ID NO: 85558 - protein, 9 aa, Artificial Sequence
  Description of Artificial Sequence: Synthetic peptide
  Seed: RKVVEFLAM (MAGC1_HUMAN)
RKVVEFLAY

SEQ ID NO: 85559 - protein, 10 aa, Artificial Sequence
  Description of Artificial Sequence: Synthetic peptide
  Seed: SSPERTHSTF (MAGC1_HUMAN)
SEPERTHSTM

SEQ ID NO: 85560 - protein, 10 aa, Artificial Sequence
  Description of Artificial Sequence: Synthetic peptide
  Seed: ATESASSSVM (MAGC1_HUMAN)
AIESASSSVL

SEQ ID NO: 85561 - protein, 9 aa, Artificial Sequence
  Description of Artificial Sequence: Synthetic peptide
  Seed: FSYTLLSLF (MAGC1_HUMAN)
FFYTLLSLL

SEQ ID NO: 85562 - protein, 9 aa, Artificial Sequence
  Description of Artificial Sequence: Synthetic peptide
  Seed: AQSPLQSPV (MAGC1_HUMAN)
AMSPLQSPL

SEQ ID NO: 85563 - protein, 10 aa, Artificial Sequence
  Description of Artificial Sequence: Synthetic peptide
  Seed: PLQIPVSSSF (MAGC1_HUMAN)
PAQIPVSSSM

SEQ ID NO: 85564 - protein, 10 aa, Artificial Sequence
  Description of Artificial Sequence: Synthetic peptide
  Seed: PLQNPASSFF (MAGC1_HUMAN)
PWQNPASSFF

SEQ ID NO: 85565 - protein, 11 aa, Artificial Sequence
  Description of Artificial Sequence: Synthetic peptide
  Seed: RSFSSTLLSIF (MAGC1_HUMAN)
RCFSSTLLSIF

SEQ ID NO: 85566 - protein, 9 aa, Artificial Sequence
  Description of Artificial Sequence: Synthetic peptide
  Seed: QVKQPITKA (MAGC1_HUMAN)
QAKQPITKY

SEQ ID NO: 85567 - protein, 9 aa, Artificial Sequence
  Description of Artificial Sequence: Synthetic peptide
  Seed: RKVVEFLAM (MAGC1_HUMAN)
RMVVEFLAL

SEQ ID NO: 85568 - protein, 11 aa, Artificial Sequence
  Description of Artificial Sequence: Synthetic peptide
  Seed: IPVSSSSSSTL (MAGC1_HUMAN)
IYVSSSSSSTW

SEQ ID NO: 85569 - protein, 9 aa, Artificial Sequence
  Description of Artificial Sequence: Synthetic peptide
  Seed: ALKDVEERA (MAGC1_HUMAN)
AVKDVEERV

SEQ ID NO: 85570 - protein, 11 aa, Artificial Sequence
  Description of Artificial Sequence: Synthetic peptide
  Seed: IPMTSSFSSTL (MAGC1_HUMAN)
IWMTSSFSSTW

SEQ ID NO: 85571 - protein, 11 aa, Artificial Sequence
  Description of Artificial Sequence: Synthetic peptide
  Seed: ISRYTGYFPVI (MAGC1_HUMAN)
ISRYTGYFPVF

SEQ ID NO: 85572 - protein, 10 aa, Artificial Sequence
  Description of Artificial Sequence: Synthetic peptide
  Seed: REVDPDDSYV (MAGC1_HUMAN)
RQVDPDDSYY

SEQ ID NO: 85573 - protein, 9 aa, Artificial Sequence
  Description of Artificial Sequence: Synthetic peptide
  Seed: FSERTQSTF (MAGC1_HUMAN)
FAERTQSTF

SEQ ID NO: 85574 - protein, 10 aa, Artificial Sequence
  Description of Artificial Sequence: Synthetic peptide
  Seed: SFSSTLVSLF (MAGC1_HUMAN)
SCSSTLVSLW

SEQ ID NO: 85575 - protein, 9 aa, Artificial Sequence
  Description of Artificial Sequence: Synthetic peptide
  Seed: SAPEGEDSL (MAGC1_HUMAN)
SIPEGEDSF

SEQ ID NO: 85576 - protein, 9 aa, Artificial Sequence
  Description of Artificial Sequence: Synthetic peptide
  Seed: QSPLQGEEF (MAGC1_HUMAN)
QFPLQGEEM

SEQ ID NO: 85577 - protein, 10 aa, Artificial Sequence
  Description of Artificial Sequence: Synthetic peptide
  Seed: PLQNPASSFF (MAGC1_HUMAN)
PSQNPASSFF

SEQ ID NO: 85578 - protein, 10 aa, Artificial Sequence
  Description of Artificial Sequence: Synthetic peptide
  Seed: SSPESAQSAF (MAGC1_HUMAN)
SVPESAQSAM

SEQ ID NO: 85579 - protein, 10 aa, Artificial Sequence
  Description of Artificial Sequence: Synthetic peptide
  Seed: LAMLKNTVPI (MAGC1_HUMAN)
LHMLKNTVPI

SEQ ID NO: 85580 - protein, 9 aa, Artificial Sequence
  Description of Artificial Sequence: Synthetic peptide
  Seed: GYFPVIFRK (MAGC1_HUMAN)
GQFPVIFRR

SEQ ID NO: 85581 - protein, 9 aa, Artificial Sequence
  Description of Artificial Sequence: Synthetic peptide
  Seed: RTHSTFEGF (MAGC1_HUMAN)
RMHSTFEGY

SEQ ID NO: 85582 - protein, 9 aa, Artificial Sequence
  Description of Artificial Sequence: Synthetic peptide
  Seed: LQIPMTSSF (MAGC1_HUMAN)
LNIPMTSSW

SEQ ID NO: 85583 - protein, 9 aa, Artificial Sequence
  Description of Artificial Sequence: Synthetic peptide
  Seed: TLVSIFQSS (MAGC1_HUMAN)
TIVSIFQSA

SEQ ID NO: 85584 - protein, 10 aa, Artificial Sequence
  Description of Artificial Sequence: Synthetic peptide
  Seed: ASSSTLVSIF (MAGC1_HUMAN)
AKSSTLVSIY

SEQ ID NO: 85585 - protein, 10 aa, Artificial Sequence
  Description of Artificial Sequence: Synthetic peptide
  Seed: SLIESEPLFT (MAGC1_HUMAN)
SVIESEPLFV

SEQ ID NO: 85586 - protein, 9 aa, Artificial Sequence
  Description of Artificial Sequence: Synthetic peptide
  Seed: TLLSIFQSS (MAGC1_HUMAN)
TLLSIFQSV

SEQ ID NO: 85587 - protein, 9 aa, Artificial Sequence
  Description of Artificial Sequence: Synthetic peptide
  Seed: SSPECTQST (MAGC1_HUMAN)
SIPECTQSF

SEQ ID NO: 85588 - protein, 9 aa, Artificial Sequence
  Description of Artificial Sequence: Synthetic peptide
  Seed: SSFPSSTSS (MAGC1_HUMAN)
SAFPSSTSA

SEQ ID NO: 85589 - protein, 10 aa, Artificial Sequence
  Description of Artificial Sequence: Synthetic peptide
  Seed: SPLQIPVSSS (MAGC1_HUMAN)
SPLQIPVSSF

SEQ ID NO: 85590 - protein, 9 aa, Artificial Sequence
  Description of Artificial Sequence: Synthetic peptide
  Seed: VSRSFSSTL (MAGC1_HUMAN)
VKRSFSSTL

SEQ ID NO: 85591 - protein, 11 aa, Artificial Sequence
  Description of Artificial Sequence: Synthetic peptide
  Seed: LQRPVSSFFSY (MAGC1_HUMAN)
LCRPVSSFFSF

SEQ ID NO: 85592 - protein, 9 aa, Artificial Sequence
  Description of Artificial Sequence: Synthetic peptide
  Seed: MTSSFSSTL (MAGC1_HUMAN)
MLSSFSSTK

SEQ ID NO: 85593 - protein, 9 aa, Artificial Sequence
  Description of Artificial Sequence: Synthetic peptide
  Seed: TLLSLFQSF (MAGC1_HUMAN)
TSLSLFQSM

SEQ ID NO: 85594 - protein, 9 aa, Artificial Sequence
  Description of Artificial Sequence: Synthetic peptide
  Seed: GENTHSPLQ (MAGC1_HUMAN)
GENTHSPLL

SEQ ID NO: 85595 - protein, 9 aa, Artificial Sequence
  Description of Artificial Sequence: Synthetic peptide
  Seed: LQIPVSPSF (MAGC1_HUMAN)
LNIPVSPSF

SEQ ID NO: 85596 - protein, 9 aa, Artificial Sequence
  Description of Artificial Sequence: Synthetic peptide
  Seed: QVKQPITKA (MAGC1_HUMAN)
QLKQPITKK

SEQ ID NO: 85597 - protein, 11 aa, Artificial Sequence
  Description of Artificial Sequence: Synthetic peptide
  Seed: NTLDLTSEGCL (MAGC1_HUMAN)
NTLDLTSEGCW

SEQ ID NO: 85598 - protein, 11 aa, Artificial Sequence
  Description of Artificial Sequence: Synthetic peptide
  Seed: LSDEQGMSQNR (MAGC1_HUMAN)
LTDEQGMSQNY

SEQ ID NO: 85599 - protein, 10 aa, Artificial Sequence
  Description of Artificial Sequence: Synthetic peptide
  Seed: YTLLSLFQSS (MAGC1_HUMAN)
YQLLSLFQSV

SEQ ID NO: 85600 - protein, 9 aa, Artificial Sequence
  Description of Artificial Sequence: Synthetic peptide
  Seed: LKYQVKQPI (MAGC1_HUMAN)
LMYQVKQPH

SEQ ID NO: 85601 - protein, 11 aa, Artificial Sequence
  Description of Artificial Sequence: Synthetic peptide
  Seed: RPVSSFFSYTL (MAGC1_HUMAN)
RMVSSFFSYTI

SEQ ID NO: 85602 - protein, 9 aa, Artificial Sequence
  Description of Artificial Sequence: Synthetic peptide
  Seed: KAREFIEIL (MAGC1_HUMAN)
KAREFIEIF

SEQ ID NO: 85603 - protein, 10 aa, Artificial Sequence
  Description of Artificial Sequence: Synthetic peptide
  Seed: YTGYFPVIFR (MAGC1_HUMAN)
YAGYFPVIFK

SEQ ID NO: 85604 - protein, 10 aa, Artificial Sequence
  Description of Artificial Sequence: Synthetic peptide
  Seed: SFSSTLVSLF (MAGC1_HUMAN)
SGSSTLVSLF

SEQ ID NO: 85605 - protein, 9 aa, Artificial Sequence
  Description of Artificial Sequence: Synthetic peptide
  Seed: SPLQIPQSS (MAGC1_HUMAN)
SQLQIPQSA

SEQ ID NO: 85606 - protein, 9 aa, Artificial Sequence
  Description of Artificial Sequence: Synthetic peptide
  Seed: FSYTLASLL (MAGC1_HUMAN)
FIYTLASLM

SEQ ID NO: 85607 - protein, 11 aa, Artificial Sequence
  Description of Artificial Sequence: Synthetic peptide
  Seed: SSFFSSALLSI (MAGC1_HUMAN)
STFFSSALLSM

SEQ ID NO: 85608 - protein, 9 aa, Artificial Sequence
  Description of Artificial Sequence: Synthetic peptide
  Seed: SQSSPVSSF (MAGC1_HUMAN)
SHSSPVSSV

SEQ ID NO: 85609 - protein, 10 aa, Artificial Sequence
  Description of Artificial Sequence: Synthetic peptide
  Seed: VSSSSSSSTL (MAGC1_HUMAN)
VRSSSSSSTF

SEQ ID NO: 85610 - protein, 9 aa, Artificial Sequence
  Description of Artificial Sequence: Synthetic peptide
  Seed: ISFSSSTSL (MAGC1_HUMAN)
IYFSSSTSY

SEQ ID NO: 85611 - protein, 10 aa, Artificial Sequence
  Description of Artificial Sequence: Synthetic peptide
  Seed: LQIPVSRSFS (MAGC1_HUMAN)
LQIPVSRSFF

SEQ ID NO: 85612 - protein, 9 aa, Artificial Sequence
  Description of Artificial Sequence: Synthetic peptide
  Seed: LQIPVSPSF (MAGC1_HUMAN)
LPIPVSPSV

SEQ ID NO: 85613 - protein, 9 aa, Artificial Sequence
  Description of Artificial Sequence: Synthetic peptide
  Seed: SQSPPEGPV (MAGC1_HUMAN)
SVSPPEGPY

SEQ ID NO: 85614 - protein, 10 aa, Artificial Sequence
  Description of Artificial Sequence: Synthetic peptide
  Seed: TGYFPVIFRK (MAGC1_HUMAN)
TQYFPVIFRR

SEQ ID NO: 85615 - protein, 9 aa, Artificial Sequence
  Description of Artificial Sequence: Synthetic peptide
  Seed: REVDPDDSY (MAGC1_HUMAN)
RRVDPDDSL

SEQ ID NO: 85616 - protein, 9 aa, Artificial Sequence
  Description of Artificial Sequence: Synthetic peptide
  Seed: SSLSQSSPV (MAGC1_HUMAN)
STLSQSSPI

SEQ ID NO: 85617 - protein, 9 aa, Artificial Sequence
  Description of Artificial Sequence: Synthetic peptide
  Seed: SPVISFSSS (MAGC1_HUMAN)
SPVISFSSA

SEQ ID NO: 85618 - protein, 11 aa, Artificial Sequence
  Description of Artificial Sequence: Synthetic peptide
  Seed: LLQIPMTSSFS (MAGC1_HUMAN)
LFQIPMTSSFY

SEQ ID NO: 85619 - protein, 9 aa, Artificial Sequence
  Description of Artificial Sequence: Synthetic peptide
  Seed: FQSSLQSPV (MAGC1_HUMAN)
FTSSLQSPM

SEQ ID NO: 85620 - protein, 10 aa, Artificial Sequence
  Description of Artificial Sequence: Synthetic peptide
  Seed: NTVPITFPSS (MAGC1_HUMAN)
NSVPITFPSL

SEQ ID NO: 85621 - protein, 10 aa, Artificial Sequence
  Description of Artificial Sequence: Synthetic peptide
  Seed: QRPVSSFFSY (MAGC1_HUMAN)
QNPVSSFFSY

SEQ ID NO: 85622 - protein, 9 aa, Artificial Sequence
  Description of Artificial Sequence: Synthetic peptide
  Seed: VSRSFSSTL (MAGC1_HUMAN)
VARSFSSTM

SEQ ID NO: 85623 - protein, 9 aa, Artificial Sequence
  Description of Artificial Sequence: Synthetic peptide
  Seed: SSPESAQST (MAGC1_HUMAN)
SVPESAQSM

SEQ ID NO: 85624 - protein, 10 aa, Artificial Sequence
  Description of Artificial Sequence: Synthetic peptide
  Seed: REFIEILFGI (MAGC1_HUMAN)
RAFIEILFGI

SEQ ID NO: 85625 - protein, 10 aa, Artificial Sequence
  Description of Artificial Sequence: Synthetic peptide
  Seed: SFPSSTSSSL (MAGC1_HUMAN)
SKPSSTSSSI

SEQ ID NO: 85626 - protein, 10 aa, Artificial Sequence
  Description of Artificial Sequence: Synthetic peptide
  Seed: ESAQSAFEGF (MAGC1_HUMAN)
EAAQSAFEGR

SEQ ID NO: 85627 - protein, 10 aa, Artificial Sequence
  Description of Artificial Sequence: Synthetic peptide
  Seed: SMSPLYFPQS (MAGC1_HUMAN)
SMSPLYFPQV

SEQ ID NO: 85628 - protein, 9 aa, Artificial Sequence
  Description of Artificial Sequence: Synthetic peptide
  Seed: FPSSTSSSL (MAGC1_HUMAN)
FQSSTSSSY

SEQ ID NO: 85629 - protein, 9 aa, Artificial Sequence
  Description of Artificial Sequence: Synthetic peptide
  Seed: EFIEILFGI (MAGC1_HUMAN)
ETIEILFGM

SEQ ID NO: 85630 - protein, 9 aa, Artificial Sequence
  Description of Artificial Sequence: Synthetic peptide
  Seed: SPLQRPVSS (MAGC1_HUMAN)
SGLQRPVSL

SEQ ID NO: 85631 - protein, 10 aa, Artificial Sequence
  Description of Artificial Sequence: Synthetic peptide
  Seed: SFSSTLVSLF (MAGC1_HUMAN)
STSSTLVSLY

SEQ ID NO: 85632 - protein, 10 aa, Artificial Sequence
  Description of Artificial Sequence: Synthetic peptide
  Seed: LQIPMTSSFS (MAGC1_HUMAN)
LKIPMTSSFF

SEQ ID NO: 85633 - protein, 10 aa, Artificial Sequence
  Description of Artificial Sequence: Synthetic peptide
  Seed: SSSSSTLLSL (MAGC1_HUMAN)
SASSSTLLSY

SEQ ID NO: 85634 - protein, 10 aa, Artificial Sequence
  Description of Artificial Sequence: Synthetic peptide
  Seed: FFSYTLASLL (MAGC1_HUMAN)
FWSYTLASLM

SEQ ID NO: 85635 - protein, 11 aa, Artificial Sequence
  Description of Artificial Sequence: Synthetic peptide
  Seed: SLSQSSPVSSF (MAGC1_HUMAN)
SFSQSSPVSSY

SEQ ID NO: 85636 - protein, 11 aa, Artificial Sequence
  Description of Artificial Sequence: Synthetic peptide
  Seed: FLAMLKNTVPI (MAGC1_HUMAN)
FNAMLKNTVPI

SEQ ID NO: 85637 - protein, 9 aa, Artificial Sequence
  Description of Artificial Sequence: Synthetic peptide
  Seed: RAGREHFAF (MAGC1_HUMAN)
RTGREHFAM

SEQ ID NO: 85638 - protein, 9 aa, Artificial Sequence
  Description of Artificial Sequence: Synthetic peptide
  Seed: FAQSPLQIP (MAGC1_HUMAN)
FPQSPLQII

SEQ ID NO: 85639 - protein, 10 aa, Artificial Sequence
  Description of Artificial Sequence: Synthetic peptide
  Seed: LQIPMTSSFS (MAGC1_HUMAN)
LQIPMTSSFA

SEQ ID NO: 85640 - protein, 10 aa, Artificial Sequence
  Description of Artificial Sequence: Synthetic peptide
  Seed: SSFSSTLLSI (MAGC1_HUMAN)
STFSSTLLSY

SEQ ID NO: 85641 - protein, 9 aa, Artificial Sequence
  Description of Artificial Sequence: Synthetic peptide
  Seed: TPSSLPQSF (MAGC1_HUMAN)
TMSSLPQSM

SEQ ID NO: 85642 - protein, 10 aa, Artificial Sequence
  Description of Artificial Sequence: Synthetic peptide
  Seed: LQIPVSSSFS (MAGC1_HUMAN)
LMIPVSSSFE

SEQ ID NO: 85643 - protein, 11 aa, Artificial Sequence
  Description of Artificial Sequence: Synthetic peptide
  Seed: IPVSAASSSTL (MAGC1_HUMAN)
IFVSAASSSTY

SEQ ID NO: 85644 - protein, 8 aa, Artificial Sequence
  Description of Artificial Sequence: Synthetic peptide
  Seed: SSFFSSAL (MAGC1_HUMAN)
SQFFSSAI

SEQ ID NO: 85645 - protein, 9 aa, Artificial Sequence
  Description of Artificial Sequence: Synthetic peptide
  Seed: SGIGVRAGR (MAGC1_HUMAN)
SAIGVRAGR

SEQ ID NO: 85646 - protein, 10 aa, Artificial Sequence
  Description of Artificial Sequence: Synthetic peptide
  Seed: EEFQSSLQSP (MAGC1_HUMAN)
EEFQSSLQSV

SEQ ID NO: 85647 - protein, 10 aa, Artificial Sequence
  Description of Artificial Sequence: Synthetic peptide
  Seed: FSSSTSLSPF (MAGC1_HUMAN)
FWSSTSLSPY

SEQ ID NO: 85648 - protein, 9 aa, Artificial Sequence
  Description of Artificial Sequence: Synthetic peptide
  Seed: LKYQVKQPI (MAGC1_HUMAN)
LHYQVKQPF

SEQ ID NO: 85649 - protein, 11 aa, Artificial Sequence
  Description of Artificial Sequence: Synthetic peptide
  Seed: SFFSYTLASLL (MAGC1_HUMAN)
SMFSYTLASLF

SEQ ID NO: 85650 - protein, 9 aa, Artificial Sequence
  Description of Artificial Sequence: Synthetic peptide
  Seed: FLAMLKNTV (MAGC1_HUMAN)
FSAMLKNTV

SEQ ID NO: 85651 - protein, 9 aa, Artificial Sequence
  Description of Artificial Sequence: Synthetic peptide
  Seed: SSSTLVSIF (MAGC1_HUMAN)
SASTLVSIV

SEQ ID NO: 85652 - protein, 11 aa, Artificial Sequence
  Description of Artificial Sequence: Synthetic peptide
  Seed: TTDDSTATESA (MAGC1_HUMAN)
TSDDSTATESF

SEQ ID NO: 85653 - protein, 9 aa, Artificial Sequence
  Description of Artificial Sequence: Synthetic peptide
  Seed: LQIPVSPSF (MAGC1_HUMAN)
LYIPVSPSY

SEQ ID NO: 85654 - protein, 9 aa, Artificial Sequence
  Description of Artificial Sequence: Synthetic peptide
  Seed: LQNPASSFF (MAGC1_HUMAN)
LRNPASSFM

SEQ ID NO: 85655 - protein, 8 aa, Artificial Sequence
  Description of Artificial Sequence: Synthetic peptide
  Seed: SSFFSSAL (MAGC1_HUMAN)
STFFSSAF

SEQ ID NO: 85656 - protein, 9 aa, Artificial Sequence
  Description of Artificial Sequence: Synthetic peptide
  Seed: SFSSTLVSL (MAGC1_HUMAN)
SQSSTLVSL

SEQ ID NO: 85657 - protein, 9 aa, Artificial Sequence
  Description of Artificial Sequence: Synthetic peptide
  Seed: LARFLLLKY (MAGC1_HUMAN)
LMRFLLLKF

SEQ ID NO: 85658 - protein, 9 aa, Artificial Sequence
  Description of Artificial Sequence: Synthetic peptide
  Seed: LQRPVSSFF (MAGC1_HUMAN)
LTRPVSSFI

SEQ ID NO: 85659 - protein, 10 aa, Artificial Sequence
  Description of Artificial Sequence: Synthetic peptide
  Seed: SFSSTLVSLF (MAGC1_HUMAN)
SISSTLVSLF

SEQ ID NO: 85660 - protein, 9 aa, Artificial Sequence
  Description of Artificial Sequence: Synthetic peptide
  Seed: NTVPITFPS (MAGC1_HUMAN)
NVVPITFPV

SEQ ID NO: 85661 - protein, 11 aa, Artificial Sequence
  Description of Artificial Sequence: Synthetic peptide
  Seed: TTDDSTATESA (MAGC1_HUMAN)
TGDDSTATESV

SEQ ID NO: 85662 - protein, 10 aa, Artificial Sequence
  Description of Artificial Sequence: Synthetic peptide
  Seed: FSSSTSLSPF (MAGC1_HUMAN)
FMSSTSLSPL

SEQ ID NO: 85663 - protein, 10 aa, Artificial Sequence
  Description of Artificial Sequence: Synthetic peptide
  Seed: GEDSLSPHYF (MAGC1_HUMAN)
GQDSLSPHYF

SEQ ID NO: 85664 - protein, 9 aa, Artificial Sequence
  Description of Artificial Sequence: Synthetic peptide
  Seed: LQSPVISFS (MAGC1_HUMAN)
LTSPVISFI

SEQ ID NO: 85665 - protein, 9 aa, Artificial Sequence
  Description of Artificial Sequence: Synthetic peptide
  Seed: SFPSSTSSS (MAGC1_HUMAN)
SWPSSTSSL

SEQ ID NO: 85666 - protein, 10 aa, Artificial Sequence
  Description of Artificial Sequence: Synthetic peptide
  Seed: REHFAFGEPR (MAGC1_HUMAN)
RTHFAFGEPR

SEQ ID NO: 85667 - protein, 9 aa, Artificial Sequence
  Description of Artificial Sequence: Synthetic peptide
  Seed: VSRSFSSTL (MAGC1_HUMAN)
VLRSFSSTY

SEQ ID NO: 85668 - protein, 9 aa, Artificial Sequence
  Description of Artificial Sequence: Synthetic peptide
  Seed: FPSSTSSSL (MAGC1_HUMAN)
FFSSTSSSF

SEQ ID NO: 85669 - protein, 9 aa, Artificial Sequence
  Description of Artificial Sequence: Synthetic peptide
  Seed: SPLQIVPSL (MAGC1_HUMAN)
SILQIVPSF

SEQ ID NO: 85670 - protein, 11 aa, Artificial Sequence
  Description of Artificial Sequence: Synthetic peptide
  Seed: REVDPDDSYVF (MAGC1_HUMAN)
RLVDPDDSYVW

SEQ ID NO: 85671 - protein, 9 aa, Artificial Sequence
  Description of Artificial Sequence: Synthetic peptide
  Seed: NTVPITFPS (MAGC1_HUMAN)
NAVPITFPM

SEQ ID NO: 85672 - protein, 10 aa, Artificial Sequence
  Description of Artificial Sequence: Synthetic peptide
  Seed: YTLDEKVDEL (MAGC1_HUMAN)
YRLDEKVDEY

SEQ ID NO: 85673 - protein, 9 aa, Artificial Sequence
  Description of Artificial Sequence: Synthetic peptide
  Seed: VSRSFSSTL (MAGC1_HUMAN)
VFRSFSSTI

SEQ ID NO: 85674 - protein, 9 aa, Artificial Sequence
  Description of Artificial Sequence: Synthetic peptide
  Seed: REVDPDDSY (MAGC1_HUMAN)
RAVDPDDSL

SEQ ID NO: 85675 - protein, 10 aa, Artificial Sequence
  Description of Artificial Sequence: Synthetic peptide
  Seed: RAGREHFAFG (MAGC1_HUMAN)
RAGREHFAFV

SEQ ID NO: 85676 - protein, 9 aa, Artificial Sequence
  Description of Artificial Sequence: Synthetic peptide
  Seed: HFPQSPPEW (MAGC1_HUMAN)
HIPQSPPEM

SEQ ID NO: 85677 - protein, 9 aa, Artificial Sequence
  Description of Artificial Sequence: Synthetic peptide
  Seed: VIWDVLSGI (MAGC1_HUMAN)
VAWDVLSGV

SEQ ID NO: 85678 - protein, 10 aa, Artificial Sequence
  Description of Artificial Sequence: Synthetic peptide
  Seed: STPSSLPQSF (MAGC1_HUMAN)
SFPSSLPQSL

SEQ ID NO: 85679 - protein, 10 aa, Artificial Sequence
  Description of Artificial Sequence: Synthetic peptide
  Seed: FLAMLKNTVP (MAGC1_HUMAN)
FMAMLKNTVA

SEQ ID NO: 85680 - protein, 9 aa, Artificial Sequence
  Description of Artificial Sequence: Synthetic peptide
  Seed: LQIPMTSSF (MAGC1_HUMAN)
LSIPMTSSY

SEQ ID NO: 85681 - protein, 9 aa, Artificial Sequence
  Description of Artificial Sequence: Synthetic peptide
  Seed: SPLQRPVSS (MAGC1_HUMAN)
SGLQRPVSM

SEQ ID NO: 85682 - protein, 10 aa, Artificial Sequence
  Description of Artificial Sequence: Synthetic peptide
  Seed: SFSSTLLSIF (MAGC1_HUMAN)
SLSSTLLSIW

SEQ ID NO: 85683 - protein, 10 aa, Artificial Sequence
  Description of Artificial Sequence: Synthetic peptide
  Seed: SSPECTQSTF (MAGC1_HUMAN)
SAPECTQSTM

SEQ ID NO: 85684 - protein, 9 aa, Artificial Sequence
  Description of Artificial Sequence: Synthetic peptide
  Seed: YTGYFPVIF (MAGC1_HUMAN)
YRGYFPVIY

SEQ ID NO: 85685 - protein, 9 aa, Artificial Sequence
  Description of Artificial Sequence: Synthetic peptide
  Seed: LQIPVSPSF (MAGC1_HUMAN)
LHIPVSPSI

SEQ ID NO: 85686 - protein, 10 aa, Artificial Sequence
  Description of Artificial Sequence: Synthetic peptide
  Seed: MTSSFSSTLL (MAGC1_HUMAN)
MLSSFSSTLG

SEQ ID NO: 85687 - protein, 9 aa, Artificial Sequence
  Description of Artificial Sequence: Synthetic peptide
  Seed: SPESDDTLY (MAGC1_HUMAN)
SIESDDTLY

SEQ ID NO: 85688 - protein, 11 aa, Artificial Sequence
  Description of Artificial Sequence: Synthetic peptide
  Seed: IPVSAASSSTL (MAGC1_HUMAN)
IDVSAASSSTW

SEQ ID NO: 85689 - protein, 9 aa, Artificial Sequence
  Description of Artificial Sequence: Synthetic peptide
  Seed: GSPSFSSTL (MAGC1_HUMAN)
GRPSFSSTF

SEQ ID NO: 85690 - protein, 9 aa, Artificial Sequence
  Description of Artificial Sequence: Synthetic peptide
  Seed: SSSTLVSIF (MAGC1_HUMAN)
SQSTLVSIY

SEQ ID NO: 85691 - protein, 9 aa, Artificial Sequence
  Description of Artificial Sequence: Synthetic peptide
  Seed: SQSSPVSSF (MAGC1_HUMAN)
SLSSPVSSI

SEQ ID NO: 85692 - protein, 9 aa, Artificial Sequence
  Description of Artificial Sequence: Synthetic peptide
  Seed: YTLLSLFQS (MAGC1_HUMAN)
YQLLSLFQA

SEQ ID NO: 85693 - protein, 9 aa, Artificial Sequence
  Description of Artificial Sequence: Synthetic peptide
  Seed: TLDEKVDEL (MAGC1_HUMAN)
TQDEKVDEW

SEQ ID NO: 85694 - protein, 9 aa, Artificial Sequence
  Description of Artificial Sequence: Synthetic peptide
  Seed: ISFSSSTSL (MAGC1_HUMAN)
IVFSSSTSY

SEQ ID NO: 85695 - protein, 9 aa, Artificial Sequence
  Description of Artificial Sequence: Synthetic peptide
  Seed: YTLASLLQS (MAGC1_HUMAN)
YLLASLLQL

SEQ ID NO: 85696 - protein, 9 aa, Artificial Sequence
  Description of Artificial Sequence: Synthetic peptide
  Seed: SICSSSTSL (MAGC1_HUMAN)
SMCSSSTSM

SEQ ID NO: 85697 - protein, 9 aa, Artificial Sequence
  Description of Artificial Sequence: Synthetic peptide
  Seed: SPLQRPVSS (MAGC1_HUMAN)
SPLQRPVSM

SEQ ID NO: 85698 - protein, 9 aa, Artificial Sequence
  Description of Artificial Sequence: Synthetic peptide
  Seed: SSPERTQST (MAGC1_HUMAN)
SVPERTQSL

SEQ ID NO: 85699 - protein, 9 aa, Artificial Sequence
  Description of Artificial Sequence: Synthetic peptide
  Seed: SQSSPVSSF (MAGC1_HUMAN)
SASSPVSSM

SEQ ID NO: 85700 - protein, 11 aa, Artificial Sequence
  Description of Artificial Sequence: Synthetic peptide
  Seed: RPVSSFFSYTL (MAGC1_HUMAN)
RCVSSFFSYTF

SEQ ID NO: 85701 - protein, 9 aa, Artificial Sequence
  Description of Artificial Sequence: Synthetic peptide
  Seed: MTSSFSSTL (MAGC1_HUMAN)
MGSSFSSTL

SEQ ID NO: 85702 - protein, 9 aa, Artificial Sequence
  Description of Artificial Sequence: Synthetic peptide
  Seed: SSFFSSALL (MAGC1_HUMAN)
SYFFSSALK

SEQ ID NO: 85703 - protein, 10 aa, Artificial Sequence
  Description of Artificial Sequence: Synthetic peptide
  Seed: FSSSTSLSPF (MAGC1_HUMAN)
FKSSTSLSPM

SEQ ID NO: 85704 - protein, 8 aa, Artificial Sequence
  Description of Artificial Sequence: Synthetic peptide
  Seed: SSSFSYTL (MAGC1_HUMAN)
SASFSYTY

SEQ ID NO: 85705 - protein, 9 aa, Artificial Sequence
  Description of Artificial Sequence: Synthetic peptide
  Seed: FFSSALLSI (MAGC1_HUMAN)
FRSSALLSF

SEQ ID NO: 85706 - protein, 9 aa, Artificial Sequence
  Description of Artificial Sequence: Synthetic peptide
  Seed: FSSALLSIF (MAGC1_HUMAN)
FPSALLSIV

SEQ ID NO: 85707 - protein, 10 aa, Artificial Sequence
  Description of Artificial Sequence: Synthetic peptide
  Seed: LQIPVSPSFS (MAGC1_HUMAN)
LSIPVSPSFF

SEQ ID NO: 85708 - protein, 11 aa, Artificial Sequence
  Description of Artificial Sequence: Synthetic peptide
  Seed: ISRYTGYFPVI (MAGC1_HUMAN)
IYRYTGYFPVW

SEQ ID NO: 85709 - protein, 9 aa, Artificial Sequence
  Description of Artificial Sequence: Synthetic peptide
  Seed: LQIPVSSSS (MAGC1_HUMAN)
LMIPVSSSA

SEQ ID NO: 85710 - protein, 10 aa, Artificial Sequence
  Description of Artificial Sequence: Synthetic peptide
  Seed: SFFSYTLASL (MAGC1_HUMAN)
SLFSYTLASV

SEQ ID NO: 85711 - protein, 9 aa, Artificial Sequence
  Description of Artificial Sequence: Synthetic peptide
  Seed: LQIPVSSSS (MAGC1_HUMAN)
LIIPVSSSY

SEQ ID NO: 85712 - protein, 10 aa, Artificial Sequence
  Description of Artificial Sequence: Synthetic peptide
  Seed: FPQSLLQIPM (MAGC1_HUMAN)
FHQSLLQIPF

SEQ ID NO: 85713 - protein, 9 aa, Artificial Sequence
  Description of Artificial Sequence: Synthetic peptide
  Seed: YTSSSDTLL (MAGC1_HUMAN)
YQSSSDTLY

SEQ ID NO: 85714 - protein, 11 aa, Artificial Sequence
  Description of Artificial Sequence: Synthetic peptide
  Seed: SPLQIPVSSSS (MAGC1_HUMAN)
SCLQIPVSSSM

SEQ ID NO: 85715 - protein, 9 aa, Artificial Sequence
  Description of Artificial Sequence: Synthetic peptide
  Seed: SVLQIPVSA (MAGC1_HUMAN)
SPLQIPVSV

SEQ ID NO: 85716 - protein, 9 aa, Artificial Sequence
  Description of Artificial Sequence: Synthetic peptide
  Seed: REVPNSSPP (MAGC1_HUMAN)
REVPNSSPI

SEQ ID NO: 85717 - protein, 9 aa, Artificial Sequence
  Description of Artificial Sequence: Synthetic peptide
  Seed: TFEGFPQSL (MAGC1_HUMAN)
TYEGFPQSI

SEQ ID NO: 85718 - protein, 9 aa, Artificial Sequence
  Description of Artificial Sequence: Synthetic peptide
  Seed: FQSSLQSPV (MAGC1_HUMAN)
FNSSLQSPF

SEQ ID NO: 85719 - protein, 9 aa, Artificial Sequence
  Description of Artificial Sequence: Synthetic peptide
  Seed: AQSPLQSPV (MAGC1_HUMAN)
AQSPLQSPW

SEQ ID NO: 85720 - protein, 9 aa, Artificial Sequence
  Description of Artificial Sequence: Synthetic peptide
  Seed: SICSSSTSL (MAGC1_HUMAN)
SLCSSSTSI

SEQ ID NO: 85721 - protein, 9 aa, Artificial Sequence
  Description of Artificial Sequence: Synthetic peptide
  Seed: SSSDTLLES (MAGC1_HUMAN)
SLSDTLLEF

SEQ ID NO: 85722 - protein, 11 aa, Artificial Sequence
  Description of Artificial Sequence: Synthetic peptide
  Seed: IPVSAASSSTL (MAGC1_HUMAN)
IQVSAASSSTF

SEQ ID NO: 85723 - protein, 9 aa, Artificial Sequence
  Description of Artificial Sequence: Synthetic peptide
  Seed: SSSVMSPSF (MAGC1_HUMAN)
SSSVMSPSL

SEQ ID NO: 85724 - protein, 10 aa, Artificial Sequence
  Description of Artificial Sequence: Synthetic peptide
  Seed: YTLLSLFQSS (MAGC1_HUMAN)
YQLLSLFQSM

SEQ ID NO: 85725 - protein, 9 aa, Artificial Sequence
  Description of Artificial Sequence: Synthetic peptide
  Seed: IEILFGISL (MAGC1_HUMAN)
IKILFGISL

SEQ ID NO: 85726 - protein, 10 aa, Artificial Sequence
  Description of Artificial Sequence: Synthetic peptide
  Seed: SPLQSPVISF (MAGC1_HUMAN)
SMLQSPVISF

SEQ ID NO: 85727 - protein, 10 aa, Artificial Sequence
  Description of Artificial Sequence: Synthetic peptide
  Seed: TGYFPVIFRK (MAGC1_HUMAN)
TAYFPVIFRN

SEQ ID NO: 85728 - protein, 10 aa, Artificial Sequence
  Description of Artificial Sequence: Synthetic peptide
  Seed: RAGREHFAFG (MAGC1_HUMAN)
RIGREHFAFS

SEQ ID NO: 85729 - protein, 9 aa, Artificial Sequence
  Description of Artificial Sequence: Synthetic peptide
  Seed: FAFGEPREL (MAGC1_HUMAN)
FVFGEPREV

SEQ ID NO: 85730 - protein, 9 aa, Artificial Sequence
  Description of Artificial Sequence: Synthetic peptide
  Seed: FAFGEPREL (MAGC1_HUMAN)
FCFGEPREF

SEQ ID NO: 85731 - protein, 9 aa, Artificial Sequence
  Description of Artificial Sequence: Synthetic peptide
  Seed: SFFSYTLAS (MAGC1_HUMAN)
STFSYTLAY

SEQ ID NO: 85732 - protein, 10 aa, Artificial Sequence
  Description of Artificial Sequence: Synthetic peptide
  Seed: PLQIPVSSSF (MAGC1_HUMAN)
PCQIPVSSSY

SEQ ID NO: 85733 - protein, 10 aa, Artificial Sequence
  Description of Artificial Sequence: Synthetic peptide
  Seed: FPQSLLQIPM (MAGC1_HUMAN)
FRQSLLQIPY

SEQ ID NO: 85734 - protein, 9 aa, Artificial Sequence
  Description of Artificial Sequence: Synthetic peptide
  Seed: SSHESPQSP (MAGC1_HUMAN)
SAHESPQSH

SEQ ID NO: 85735 - protein, 10 aa, Artificial Sequence
  Description of Artificial Sequence: Synthetic peptide
  Seed: YTLASLLQSS (MAGC1_HUMAN)
YYLASLLQSI

SEQ ID NO: 85736 - protein, 9 aa, Artificial Sequence
  Description of Artificial Sequence: Synthetic peptide
  Seed: MTSSFSSTL (MAGC1_HUMAN)
MPSSFSSTW

SEQ ID NO: 85737 - protein, 9 aa, Artificial Sequence
  Description of Artificial Sequence: Synthetic peptide
  Seed: EFIEILFGI (MAGC1_HUMAN)
ETIEILFGI

SEQ ID NO: 85738 - protein, 11 aa, Artificial Sequence
  Description of Artificial Sequence: Synthetic peptide
  Seed: LQIPVSSSFSY (MAGC1_HUMAN)
LSIPVSSSFSY

SEQ ID NO: 85739 - protein, 9 aa, Artificial Sequence
  Description of Artificial Sequence: Synthetic peptide
  Seed: ILILSIIFI (MAGC1_HUMAN)
ITILSIIFV

SEQ ID NO: 85740 - protein, 9 aa, Artificial Sequence
  Description of Artificial Sequence: Synthetic peptide
  Seed: ELARFLLLK (MAGC1_HUMAN)
ELARFLLLR

SEQ ID NO: 85741 - protein, 10 aa, Artificial Sequence
  Description of Artificial Sequence: Synthetic peptide
  Seed: ISRYTGYFPV (MAGC1_HUMAN)
ICRYTGYFPF

SEQ ID NO: 85742 - protein, 10 aa, Artificial Sequence
  Description of Artificial Sequence: Synthetic peptide
  Seed: MSQNRLLILI (MAGC1_HUMAN)
MCQNRLLILW

SEQ ID NO: 85743 - protein, 11 aa, Artificial Sequence
  Description of Artificial Sequence: Synthetic peptide
  Seed: SAASSSTLVSI (MAGC1_HUMAN)
SAASSSTLVSF

SEQ ID NO: 85744 - protein, 10 aa, Artificial Sequence
  Description of Artificial Sequence: Synthetic peptide
  Seed: LAMLKNTVPI (MAGC1_HUMAN)
LMMLKNTVPA

SEQ ID NO: 85745 - protein, 10 aa, Artificial Sequence
  Description of Artificial Sequence: Synthetic peptide
  Seed: SSPESAQSAF (MAGC1_HUMAN)
SHPESAQSAL

SEQ ID NO: 85746 - protein, 10 aa, Artificial Sequence
  Description of Artificial Sequence: Synthetic peptide
  Seed: FPSSYKDALK (MAGC1_HUMAN)
FNSSYKDALR

SEQ ID NO: 85747 - protein, 9 aa, Artificial Sequence
  Description of Artificial Sequence: Synthetic peptide
  Seed: TLDEKVDEL (MAGC1_HUMAN)
TRDEKVDEL

SEQ ID NO: 85748 - protein, 11 aa, Artificial Sequence
  Description of Artificial Sequence: Synthetic peptide
  Seed: SPLQIPMTSSF (MAGC1_HUMAN)
SCLQIPMTSSF

SEQ ID NO: 85749 - protein, 9 aa, Artificial Sequence
  Description of Artificial Sequence: Synthetic peptide
  Seed: TSLSLPQSF (MAGC1_HUMAN)
TQLSLPQSM

SEQ ID NO: 85750 - protein, 10 aa, Artificial Sequence
  Description of Artificial Sequence: Synthetic peptide
  Seed: SFSYTLLSLF (MAGC1_HUMAN)
SASYTLLSLM

SEQ ID NO: 85751 - protein, 10 aa, Artificial Sequence
  Description of Artificial Sequence: Synthetic peptide
  Seed: LLQIPMTSSF (MAGC1_HUMAN)
LSQIPMTSSM

SEQ ID NO: 85752 - protein, 10 aa, Artificial Sequence
  Description of Artificial Sequence: Synthetic peptide
  Seed: TTDDSTATES (MAGC1_HUMAN)
TMDDSTATEV

SEQ ID NO: 85753 - protein, 11 aa, Artificial Sequence
  Description of Artificial Sequence: Synthetic peptide
  Seed: VIWDVLSGIGV (MAGC1_HUMAN)
VMWDVLSGIGV

SEQ ID NO: 85754 - protein, 9 aa, Artificial Sequence
  Description of Artificial Sequence: Synthetic peptide
  Seed: SRYTGYFPV (MAGC1_HUMAN)
SSYTGYFPM

SEQ ID NO: 85755 - protein, 9 aa, Artificial Sequence
  Description of Artificial Sequence: Synthetic peptide
  Seed: EPRELLTKV (MAGC1_HUMAN)
EPRELLTKM

SEQ ID NO: 85756 - protein, 9 aa, Artificial Sequence
  Description of Artificial Sequence: Synthetic peptide
  Seed: RTQSTFEGF (MAGC1_HUMAN)
RIQSTFEGW

SEQ ID NO: 85757 - protein, 9 aa, Artificial Sequence
  Description of Artificial Sequence: Synthetic peptide
  Seed: FLWGPRAHS (MAGC1_HUMAN)
FQWGPRAHL

SEQ ID NO: 85758 - protein, 9 aa, Artificial Sequence
  Description of Artificial Sequence: Synthetic peptide
  Seed: SPLYFPQSP (MAGC1_HUMAN)
SPLYFPQSL

SEQ ID NO: 85759 - protein, 10 aa, Artificial Sequence
  Description of Artificial Sequence: Synthetic peptide
  Seed: STPSSLPQSF (MAGC1_HUMAN)
SEPSSLPQSL

SEQ ID NO: 85760 - protein, 9 aa, Artificial Sequence
  Description of Artificial Sequence: Synthetic peptide
  Seed: SSPEGKDSL (MAGC1_HUMAN)
SGPEGKDSL

SEQ ID NO: 85761 - protein, 9 aa, Artificial Sequence
  Description of Artificial Sequence: Synthetic peptide
  Seed: VSSFFSYTL (MAGC1_HUMAN)
VRSFFSYTM

SEQ ID NO: 85762 - protein, 10 aa, Artificial Sequence
  Description of Artificial Sequence: Synthetic peptide
  Seed: KVVEFLAMLK (MAGC1_HUMAN)
KQVEFLAMLM

SEQ ID NO: 85763 - protein, 10 aa, Artificial Sequence
  Description of Artificial Sequence: Synthetic peptide
  Seed: WVQEHYLEYR (MAGC1_HUMAN)
WTQEHYLEYR

SEQ ID NO: 85764 - protein, 9 aa, Artificial Sequence
  Description of Artificial Sequence: Synthetic peptide
  Seed: STFEGFAQS (MAGC1_HUMAN)
SLFEGFAQS

SEQ ID NO: 85765 - protein, 9 aa, Artificial Sequence
  Description of Artificial Sequence: Synthetic peptide
  Seed: LKYQVKQPI (MAGC1_HUMAN)
LTYQVKQPF

SEQ ID NO: 85766 - protein, 9 aa, Artificial Sequence
  Description of Artificial Sequence: Synthetic peptide
  Seed: IPVSPSFSS (MAGC1_HUMAN)
ISVSPSFSY

SEQ ID NO: 85767 - protein, 9 aa, Artificial Sequence
  Description of Artificial Sequence: Synthetic peptide
  Seed: VPITFPSSY (MAGC1_HUMAN)
VPITFPSST

SEQ ID NO: 85768 - protein, 10 aa, Artificial Sequence
  Description of Artificial Sequence: Synthetic peptide
  Seed: RAGREHFAFG (MAGC1_HUMAN)
RQGREHFAFI

SEQ ID NO: 85769 - protein, 9 aa, Artificial Sequence
  Description of Artificial Sequence: Synthetic peptide
  Seed: FSYTLLSLF (MAGC1_HUMAN)
FSYTLLSLI

SEQ ID NO: 85770 - protein, 10 aa, Artificial Sequence
  Description of Artificial Sequence: Synthetic peptide
  Seed: YTLASLLQSS (MAGC1_HUMAN)
YNLASLLQST

SEQ ID NO: 85771 - protein, 9 aa, Artificial Sequence
  Description of Artificial Sequence: Synthetic peptide
  Seed: LQIPGSPSF (MAGC1_HUMAN)
LSIPGSPSF

SEQ ID NO: 85772 - protein, 9 aa, Artificial Sequence
  Description of Artificial Sequence: Synthetic peptide
  Seed: FFSYTLASL (MAGC1_HUMAN)
FYSYTLASA

SEQ ID NO: 85773 - protein, 9 aa, Artificial Sequence
  Description of Artificial Sequence: Synthetic peptide
  Seed: TPSSLPQSF (MAGC1_HUMAN)
TTSSLPQSF

SEQ ID NO: 85774 - protein, 9 aa, Artificial Sequence
  Description of Artificial Sequence: Synthetic peptide
  Seed: IESEPLFTY (MAGC1_HUMAN)
IQSEPLFTL

SEQ ID NO: 85775 - protein, 11 aa, Artificial Sequence
  Description of Artificial Sequence: Synthetic peptide
  Seed: SSSSSSTLLSL (MAGC1_HUMAN)
SYSSSSTLLSF

SEQ ID NO: 85776 - protein, 9 aa, Artificial Sequence
  Description of Artificial Sequence: Synthetic peptide
  Seed: LQIPVSSSS (MAGC1_HUMAN)
LSIPVSSSF

SEQ ID NO: 85777 - protein, 9 aa, Artificial Sequence
  Description of Artificial Sequence: Synthetic peptide
  Seed: FEGFAQSPL (MAGC1_HUMAN)
FAGFAQSPY

SEQ ID NO: 85778 - protein, 9 aa, Artificial Sequence
  Description of Artificial Sequence: Synthetic peptide
  Seed: LLILILSII (MAGC1_HUMAN)
LQILILSIV

SEQ ID NO: 85779 - protein, 9 aa, Artificial Sequence
  Description of Artificial Sequence: Synthetic peptide
  Seed: SSPESTQSP (MAGC1_HUMAN)
SLPESTQSM

SEQ ID NO: 85780 - protein, 10 aa, Artificial Sequence
  Description of Artificial Sequence: Synthetic peptide
  Seed: KRKVVEFLAM (MAGC1_HUMAN)
KCKVVEFLAY

SEQ ID NO: 85781 - protein, 9 aa, Artificial Sequence
  Description of Artificial Sequence: Synthetic peptide
  Seed: MPSLLQSSS (MAGC1_HUMAN)
MPSLLQSSI

SEQ ID NO: 85782 - protein, 11 aa, Artificial Sequence
  Description of Artificial Sequence: Synthetic peptide
  Seed: FLAMLKNTVPI (MAGC1_HUMAN)
FAAMLKNTVPI

SEQ ID NO: 85783 - protein, 10 aa, Artificial Sequence
  Description of Artificial Sequence: Synthetic peptide
  Seed: ATESASSSVM (MAGC1_HUMAN)
AHESASSSVY

SEQ ID NO: 85784 - protein, 10 aa, Artificial Sequence
  Description of Artificial Sequence: Synthetic peptide
  Seed: LLQIPMTSSF (MAGC1_HUMAN)
LIQIPMTSSW

SEQ ID NO: 85785 - protein, 9 aa, Artificial Sequence
  Description of Artificial Sequence: Synthetic peptide
  Seed: SLFQSFSER (MAGC1_HUMAN)
SSFQSFSEK

SEQ ID NO: 85786 - protein, 10 aa, Artificial Sequence
  Description of Artificial Sequence: Synthetic peptide
  Seed: YASEEVIWDV (MAGC1_HUMAN)
YTSEEVIWDL

SEQ ID NO: 85787 - protein, 10 aa, Artificial Sequence
  Description of Artificial Sequence: Synthetic peptide
  Seed: QRPVSSFFSY (MAGC1_HUMAN)
QWPVSSFFSY

SEQ ID NO: 85788 - protein, 10 aa, Artificial Sequence
  Description of Artificial Sequence: Synthetic peptide
  Seed: SSSSTLLSLF (MAGC1_HUMAN)
SQSSTLLSLF

SEQ ID NO: 85789 - protein, 10 aa, Artificial Sequence
  Description of Artificial Sequence: Synthetic peptide
  Seed: MSPLYFPQSP (MAGC1_HUMAN)
MYPLYFPQSV

SEQ ID NO: 85790 - protein, 11 aa, Artificial Sequence
  Description of Artificial Sequence: Synthetic peptide
  Seed: SSSSSSTLLSL (MAGC1_HUMAN)
SHSSSSTLLSW

SEQ ID NO: 85791 - protein, 10 aa, Artificial Sequence
  Description of Artificial Sequence: Synthetic peptide
  Seed: MTSSFSSTLL (MAGC1_HUMAN)
MRSSFSSTLV

SEQ ID NO: 85792 - protein, 9 aa, Artificial Sequence
  Description of Artificial Sequence: Synthetic peptide
  Seed: MTSSFSSTL (MAGC1_HUMAN)
MASSFSSTH

SEQ ID NO: 85793 - protein, 9 aa, Artificial Sequence
  Description of Artificial Sequence: Synthetic peptide
  Seed: VSSSFSYTL (MAGC1_HUMAN)
VASSFSYTY

SEQ ID NO: 85794 - protein, 9 aa, Artificial Sequence
  Description of Artificial Sequence: Synthetic peptide
  Seed: RKVVEFLAM (MAGC1_HUMAN)
RRVVEFLAY

SEQ ID NO: 85795 - protein, 9 aa, Artificial Sequence
  Description of Artificial Sequence: Synthetic peptide
  Seed: VSPSFSSTL (MAGC1_HUMAN)
VLPSFSSTM

SEQ ID NO: 85796 - protein, 9 aa, Artificial Sequence
  Description of Artificial Sequence: Synthetic peptide
  Seed: SSPECTQST (MAGC1_HUMAN)
SGPECTQSI

SEQ ID NO: 85797 - protein, 9 aa, Artificial Sequence
  Description of Artificial Sequence: Synthetic peptide
  Seed: FQSSLQSPV (MAGC1_HUMAN)
FVSSLQSPV

SEQ ID NO: 85798 - protein, 9 aa, Artificial Sequence
  Description of Artificial Sequence: Synthetic peptide
  Seed: SSSSTLLSL (MAGC1_HUMAN)
SRSSTLLSV

SEQ ID NO: 85799 - protein, 9 aa, Artificial Sequence
  Description of Artificial Sequence: Synthetic peptide
  Seed: FSSALLSIF (MAGC1_HUMAN)
FVSALLSIM

SEQ ID NO: 85800 - protein, 10 aa, Artificial Sequence
  Description of Artificial Sequence: Synthetic peptide
  Seed: TATESASSSV (MAGC1_HUMAN)
TTTESASSSV

SEQ ID NO: 85801 - protein, 9 aa, Artificial Sequence
  Description of Artificial Sequence: Synthetic peptide
  Seed: IESEPLFTY (MAGC1_HUMAN)
IESEPLFTI

SEQ ID NO: 85802 - protein, 9 aa, Artificial Sequence
  Description of Artificial Sequence: Synthetic peptide
  Seed: LLSLFQSFS (MAGC1_HUMAN)
LVSLFQSFI

SEQ ID NO: 85803 - protein, 9 aa, Artificial Sequence
  Description of Artificial Sequence: Synthetic peptide
  Seed: SSSESPQSC (MAGC1_HUMAN)
SSSESPQSL

SEQ ID NO: 85804 - protein, 9 aa, Artificial Sequence
  Description of Artificial Sequence: Synthetic peptide
  Seed: TSLSLPQSF (MAGC1_HUMAN)
TTLSLPQSL

SEQ ID NO: 85805 - protein, 9 aa, Artificial Sequence
  Description of Artificial Sequence: Synthetic peptide
  Seed: NSSPPRYEF (MAGC1_HUMAN)
NFSPPRYEL

SEQ ID NO: 85806 - protein, 9 aa, Artificial Sequence
  Description of Artificial Sequence: Synthetic peptide
  Seed: FSSTLVSLF (MAGC1_HUMAN)
FISTLVSLV

SEQ ID NO: 85807 - protein, 9 aa, Artificial Sequence
  Description of Artificial Sequence: Synthetic peptide
  Seed: GVRAGREHF (MAGC1_HUMAN)
GMRAGREHF

SEQ ID NO: 85808 - protein, 9 aa, Artificial Sequence
  Description of Artificial Sequence: Synthetic peptide
  Seed: TPSSLPQSF (MAGC1_HUMAN)
THSSLPQSY

SEQ ID NO: 85809 - protein, 9 aa, Artificial Sequence
  Description of Artificial Sequence: Synthetic peptide
  Seed: IPVSAASSS (MAGC1_HUMAN)
IAVSAASSM

SEQ ID NO: 85810 - protein, 10 aa, Artificial Sequence
  Description of Artificial Sequence: Synthetic peptide
  Seed: SFSSTLVSLF (MAGC1_HUMAN)
SPSSTLVSLF

SEQ ID NO: 85811 - protein, 9 aa, Artificial Sequence
  Description of Artificial Sequence: Synthetic peptide
  Seed: SIFQSSPER (MAGC1_HUMAN)
SAFQSSPEV

SEQ ID NO: 85812 - protein, 10 aa, Artificial Sequence
  Description of Artificial Sequence: Synthetic peptide
  Seed: KVVEFLAMLK (MAGC1_HUMAN)
KYVEFLAMLR

SEQ ID NO: 85813 - protein, 9 aa, Artificial Sequence
  Description of Artificial Sequence: Synthetic peptide
  Seed: VIFRKAREF (MAGC1_HUMAN)
VAFRKAREI

SEQ ID NO: 85814 - protein, 10 aa, Artificial Sequence
  Description of Artificial Sequence: Synthetic peptide
  Seed: ATESASSSVM (MAGC1_HUMAN)
ADESASSSVF

SEQ ID NO: 85815 - protein, 9 aa, Artificial Sequence
  Description of Artificial Sequence: Synthetic peptide
  Seed: RSFSSTLLS (MAGC1_HUMAN)
RSFSSTLLM

SEQ ID NO: 85816 - protein, 10 aa, Artificial Sequence
  Description of Artificial Sequence: Synthetic peptide
  Seed: ASSSVMSPSF (MAGC1_HUMAN)
AISSVMSPSW

SEQ ID NO: 85817 - protein, 11 aa, Artificial Sequence
  Description of Artificial Sequence: Synthetic peptide
  Seed: IPVSPSSSSTL (MAGC1_HUMAN)
IAVSPSSSSTF

SEQ ID NO: 85818 - protein, 10 aa, Artificial Sequence
  Description of Artificial Sequence: Synthetic peptide
  Seed: SFSSTLVSLF (MAGC1_HUMAN)
SDSSTLVSLW

SEQ ID NO: 85819 - protein, 10 aa, Artificial Sequence
  Description of Artificial Sequence: Synthetic peptide
  Seed: SLFQSSPECT (MAGC1_HUMAN)
SMFQSSPECA

SEQ ID NO: 85820 - protein, 9 aa, Artificial Sequence
  Description of Artificial Sequence: Synthetic peptide
  Seed: FAFGEPREL (MAGC1_HUMAN)
FLFGEPREK

SEQ ID NO: 85821 - protein, 10 aa, Artificial Sequence
  Description of Artificial Sequence: Synthetic peptide
  Seed: VSSSFSYTLL (MAGC1_HUMAN)
VLSSFSYTLF

SEQ ID NO: 85822 - protein, 11 aa, Artificial Sequence
  Description of Artificial Sequence: Synthetic peptide
  Seed: VISRYTGYFPV (MAGC1_HUMAN)
VMSRYTGYFPV

SEQ ID NO: 85823 - protein, 10 aa, Artificial Sequence
  Description of Artificial Sequence: Synthetic peptide
  Seed: FQSSLQSPVS (MAGC1_HUMAN)
FMSSLQSPVA

SEQ ID NO: 85824 - protein, 11 aa, Artificial Sequence
  Description of Artificial Sequence: Synthetic peptide
  Seed: SSSFSYTLLSL (MAGC1_HUMAN)
SSSFSYTLLSF

SEQ ID NO: 85825 - protein, 10 aa, Artificial Sequence
  Description of Artificial Sequence: Synthetic peptide
  Seed: VWVQEHYLEY (MAGC1_HUMAN)
VYVQEHYLEL

SEQ ID NO: 85826 - protein, 11 aa, Artificial Sequence
  Description of Artificial Sequence: Synthetic peptide
  Seed: REVPNSSPPRY (MAGC1_HUMAN)
REVPNSSPPRC

SEQ ID NO: 85827 - protein, 10 aa, Artificial Sequence
  Description of Artificial Sequence: Synthetic peptide
  Seed: VISFSSSTSL (MAGC1_HUMAN)
VFSFSSSTSM

SEQ ID NO: 85828 - protein, 10 aa, Artificial Sequence
  Description of Artificial Sequence: Synthetic peptide
  Seed: EILFGISLRE (MAGC1_HUMAN)
EYLFGISLRR

SEQ ID NO: 85829 - protein, 10 aa, Artificial Sequence
  Description of Artificial Sequence: Synthetic peptide
  Seed: SSSSTLLSLF (MAGC1_HUMAN)
SMSSTLLSLY

SEQ ID NO: 85830 - protein, 11 aa, Artificial Sequence
  Description of Artificial Sequence: Synthetic peptide
  Seed: IPVSRSFSSTL (MAGC1_HUMAN)
IDVSRSFSSTF

SEQ ID NO: 85831 - protein, 10 aa, Artificial Sequence
  Description of Artificial Sequence: Synthetic peptide
  Seed: STLLSLFQSF (MAGC1_HUMAN)
SYLLSLFQSM

SEQ ID NO: 85832 - protein, 9 aa, Artificial Sequence
  Description of Artificial Sequence: Synthetic peptide
  Seed: SSSTLLSLF (MAGC1_HUMAN)
SFSTLLSLW

SEQ ID NO: 85833 - protein, 9 aa, Artificial Sequence
  Description of Artificial Sequence: Synthetic peptide
  Seed: SPLQIPQSP (MAGC1_HUMAN)
SPLQIPQSV

SEQ ID NO: 85834 - protein, 9 aa, Artificial Sequence
  Description of Artificial Sequence: Synthetic peptide
  Seed: SPQSPPEGP (MAGC1_HUMAN)
SVQSPPEGL

SEQ ID NO: 85835 - protein, 10 aa, Artificial Sequence
  Description of Artificial Sequence: Synthetic peptide
  Seed: EVIWDVLSGI (MAGC1_HUMAN)
EVIWDVLSGK

SEQ ID NO: 85836 - protein, 9 aa, Artificial Sequence
  Description of Artificial Sequence: Synthetic peptide
  Seed: LDEKVDELA (MAGC1_HUMAN)
LEEKVDELV

SEQ ID NO: 85837 - protein, 10 aa, Artificial Sequence
  Description of Artificial Sequence: Synthetic peptide
  Seed: YTGYFPVIFR (MAGC1_HUMAN)
YVGYFPVIFR

SEQ ID NO: 85838 - protein, 9 aa, Artificial Sequence
  Description of Artificial Sequence: Synthetic peptide
  Seed: SEEVIWDVL (MAGC1_HUMAN)
SEEVIWDVW

SEQ ID NO: 85839 - protein, 9 aa, Artificial Sequence
  Description of Artificial Sequence: Synthetic peptide
  Seed: FAFGEPREL (MAGC1_HUMAN)
FAFGEPREA

SEQ ID NO: 85840 - protein, 9 aa, Artificial Sequence
  Description of Artificial Sequence: Synthetic peptide
  Seed: TPSSLPQSF (MAGC1_HUMAN)
TYSSLPQSL

SEQ ID NO: 85841 - protein, 9 aa, Artificial Sequence
  Description of Artificial Sequence: Synthetic peptide
  Seed: FSSALLSIF (MAGC1_HUMAN)
FKSALLSIL

SEQ ID NO: 85842 - protein, 9 aa, Artificial Sequence
  Description of Artificial Sequence: Synthetic peptide
  Seed: AQSSLQIPV (MAGC1_HUMAN)
ASSSLQIPY

SEQ ID NO: 85843 - protein, 10 aa, Artificial Sequence
  Description of Artificial Sequence: Synthetic peptide
  Seed: LAMLKNTVPI (MAGC1_HUMAN)
LFMLKNTVPI

SEQ ID NO: 85844 - protein, 10 aa, Artificial Sequence
  Description of Artificial Sequence: Synthetic peptide
  Seed: STPSSLPQSF (MAGC1_HUMAN)
SPPSSLPQSL

SEQ ID NO: 85845 - protein, 9 aa, Artificial Sequence
  Description of Artificial Sequence: Synthetic peptide
  Seed: HFPQSPPEW (MAGC1_HUMAN)
HRPQSPPEL

SEQ ID NO: 85846 - protein, 10 aa, Artificial Sequence
  Description of Artificial Sequence: Synthetic peptide
  Seed: FFSSALLSIF (MAGC1_HUMAN)
FPSSALLSIW

SEQ ID NO: 85847 - protein, 10 aa, Artificial Sequence
  Description of Artificial Sequence: Synthetic peptide
  Seed: SFFSSALLSI (MAGC1_HUMAN)
SFFSSALLSL

SEQ ID NO: 85848 - protein, 10 aa, Artificial Sequence
  Description of Artificial Sequence: Synthetic peptide
  Seed: KAREFIEILF (MAGC1_HUMAN)
KSREFIEILK

SEQ ID NO: 85849 - protein, 11 aa, Artificial Sequence
  Description of Artificial Sequence: Synthetic peptide
  Seed: SSFPSSTSSSL (MAGC1_HUMAN)
SRFPSSTSSSL

SEQ ID NO: 85850 - protein, 10 aa, Artificial Sequence
  Description of Artificial Sequence: Synthetic peptide
  Seed: SFSSTLVSLF (MAGC1_HUMAN)
SESSTLVSLW

SEQ ID NO: 85851 - protein, 10 aa, Artificial Sequence
  Description of Artificial Sequence: Synthetic peptide
  Seed: SSPECTQSTF (MAGC1_HUMAN)
SSPECTQSTL

SEQ ID NO: 85852 - protein, 9 aa, Artificial Sequence
  Description of Artificial Sequence: Synthetic peptide
  Seed: SSSVMSPSF (MAGC1_HUMAN)
SSSVMSPSW

SEQ ID NO: 85853 - protein, 9 aa, Artificial Sequence
  Description of Artificial Sequence: Synthetic peptide
  Seed: FSYTLASLL (MAGC1_HUMAN)
FYYTLASLY

SEQ ID NO: 85854 - protein, 9 aa, Artificial Sequence
  Description of Artificial Sequence: Synthetic peptide
  Seed: SSPPRYEFL (MAGC1_HUMAN)
SYPPRYEFY

SEQ ID NO: 85855 - protein, 9 aa, Artificial Sequence
  Description of Artificial Sequence: Synthetic peptide
  Seed: SPLQIVPSL (MAGC1_HUMAN)
SSLQIVPSY

SEQ ID NO: 85856 - protein, 10 aa, Artificial Sequence
  Description of Artificial Sequence: Synthetic peptide
  Seed: TTDDSTATES (MAGC1_HUMAN)
TFDDSTATEI

SEQ ID NO: 85857 - protein, 9 aa, Artificial Sequence
  Description of Artificial Sequence: Synthetic peptide
  Seed: AMLKNTVPI (MAGC1_HUMAN)
ATLKNTVPV

SEQ ID NO: 85858 - protein, 9 aa, Artificial Sequence
  Description of Artificial Sequence: Synthetic peptide
  Seed: SGIGVRAGR (MAGC1_HUMAN)
SLIGVRAGR

SEQ ID NO: 85859 - protein, 11 aa, Artificial Sequence
  Description of Artificial Sequence: Synthetic peptide
  Seed: SPLQIPGSPSF (MAGC1_HUMAN)
SVLQIPGSPSY

SEQ ID NO: 85860 - protein, 9 aa, Artificial Sequence
  Description of Artificial Sequence: Synthetic peptide
  Seed: SSPPRYEFL (MAGC1_HUMAN)
SVPPRYEFY

SEQ ID NO: 85861 - protein, 10 aa, Artificial Sequence
  Description of Artificial Sequence: Synthetic peptide
  Seed: QGEDSMSPLY (MAGC1_HUMAN)
QTEDSMSPLY

SEQ ID NO: 85862 - protein, 10 aa, Artificial Sequence
  Description of Artificial Sequence: Synthetic peptide
  Seed: SRYTGYFPVI (MAGC1_HUMAN)
SWYTGYFPVF

SEQ ID NO: 85863 - protein, 11 aa, Artificial Sequence
  Description of Artificial Sequence: Synthetic peptide
  Seed: FLAMLKNTVPI (MAGC1_HUMAN)
FLAMLKNTVPA

SEQ ID NO: 85864 - protein, 9 aa, Artificial Sequence
  Description of Artificial Sequence: Synthetic peptide
  Seed: SSFPSSTSS (MAGC1_HUMAN)
SQFPSSTSY

SEQ ID NO: 85865 - protein, 10 aa, Artificial Sequence
  Description of Artificial Sequence: Synthetic peptide
  Seed: FQSSLQSPVS (MAGC1_HUMAN)
FLSSLQSPVG

SEQ ID NO: 85866 - protein, 11 aa, Artificial Sequence
  Description of Artificial Sequence: Synthetic peptide
  Seed: IPVSSSFSYTL (MAGC1_HUMAN)
IVVSSSFSYTW

SEQ ID NO: 85867 - protein, 9 aa, Artificial Sequence
  Description of Artificial Sequence: Synthetic peptide
  Seed: SSSESPQSC (MAGC1_HUMAN)
SLSESPQSM

SEQ ID NO: 85868 - protein, 9 aa, Artificial Sequence
  Description of Artificial Sequence: Synthetic peptide
  Seed: SSHESPQSP (MAGC1_HUMAN)
SVHESPQSH

SEQ ID NO: 85869 - protein, 9 aa, Artificial Sequence
  Description of Artificial Sequence: Synthetic peptide
  Seed: GSPSFSSTL (MAGC1_HUMAN)
GGPSFSSTL

SEQ ID NO: 85870 - protein, 9 aa, Artificial Sequence
  Description of Artificial Sequence: Synthetic peptide
  Seed: YTLASLLQS (MAGC1_HUMAN)
YALASLLQV

SEQ ID NO: 85871 - protein, 11 aa, Artificial Sequence
  Description of Artificial Sequence: Synthetic peptide
  Seed: IIDTTDDSTAT (MAGC1_HUMAN)
ITDTTDDSTAL

SEQ ID NO: 85872 - protein, 10 aa, Artificial Sequence
  Description of Artificial Sequence: Synthetic peptide
  Seed: ICSSSTPSSL (MAGC1_HUMAN)
IDSSSTPSSW

SEQ ID NO: 85873 - protein, 9 aa, Artificial Sequence
  Description of Artificial Sequence: Synthetic peptide
  Seed: VSSSFSYTL (MAGC1_HUMAN)
VVSSFSYTA

SEQ ID NO: 85874 - protein, 9 aa, Artificial Sequence
  Description of Artificial Sequence: Synthetic peptide
  Seed: MGDKDMPTA (MAGC1_HUMAN)
MFDKDMPTM

SEQ ID NO: 85875 - protein, 10 aa, Artificial Sequence
  Description of Artificial Sequence: Synthetic peptide
  Seed: SLQIPVSPSF (MAGC1_HUMAN)
SKQIPVSPSF

SEQ ID NO: 85876 - protein, 9 aa, Artificial Sequence
  Description of Artificial Sequence: Synthetic peptide
  Seed: FPVIFRKAR (MAGC1_HUMAN)
FYVIFRKAR

SEQ ID NO: 85877 - protein, 9 aa, Artificial Sequence
  Description of Artificial Sequence: Synthetic peptide
  Seed: SLIESEPLF (MAGC1_HUMAN)
SFIESEPLY

SEQ ID NO: 85878 - protein, 9 aa, Artificial Sequence
  Description of Artificial Sequence: Synthetic peptide
  Seed: MSQNRLLIL (MAGC1_HUMAN)
MMQNRLLIY

SEQ ID NO: 85879 - protein, 11 aa, Artificial Sequence
  Description of Artificial Sequence: Synthetic peptide
  Seed: LQRPVSSFFSY (MAGC1_HUMAN)
LARPVSSFFSY

SEQ ID NO: 85880 - protein, 9 aa, Artificial Sequence
  Description of Artificial Sequence: Synthetic peptide
  Seed: TESASSSVM (MAGC1_HUMAN)
TLSASSSVM

SEQ ID NO: 85881 - protein, 9 aa, Artificial Sequence
  Description of Artificial Sequence: Synthetic peptide
  Seed: KVVEFLAML (MAGC1_HUMAN)
KRVEFLAML

SEQ ID NO: 85882 - protein, 9 aa, Artificial Sequence
  Description of Artificial Sequence: Synthetic peptide
  Seed: VPITFPSSY (MAGC1_HUMAN)
VVITFPSSF

SEQ ID NO: 85883 - protein, 10 aa, Artificial Sequence
  Description of Artificial Sequence: Synthetic peptide
  Seed: ISRYTGYFPV (MAGC1_HUMAN)
ISRYTGYFPK

SEQ ID NO: 85884 - protein, 10 aa, Artificial Sequence
  Description of Artificial Sequence: Synthetic peptide
  Seed: RKVVEFLAML (MAGC1_HUMAN)
RQVVEFLAMA

SEQ ID NO: 85885 - protein, 11 aa, Artificial Sequence
  Description of Artificial Sequence: Synthetic peptide
  Seed: QSSPESAQSTF (MAGC1_HUMAN)
QLSPESAQSTW

SEQ ID NO: 85886 - protein, 9 aa, Artificial Sequence
  Description of Artificial Sequence: Synthetic peptide
  Seed: SICSSSTSL (MAGC1_HUMAN)
SPCSSSTSL

SEQ ID NO: 85887 - protein, 9 aa, Artificial Sequence
  Description of Artificial Sequence: Synthetic peptide
  Seed: SGIGVRAGR (MAGC1_HUMAN)
SNIGVRAGR

SEQ ID NO: 85888 - protein, 10 aa, Artificial Sequence
  Description of Artificial Sequence: Synthetic peptide
  Seed: PLQIPMTSSF (MAGC1_HUMAN)
PTQIPMTSSF

SEQ ID NO: 85889 - protein, 9 aa, Artificial Sequence
  Description of Artificial Sequence: Synthetic peptide
  Seed: KAEMLTNVI (MAGC1_HUMAN)
KAEMLTNVM

SEQ ID NO: 85890 - protein, 9 aa, Artificial Sequence
  Description of Artificial Sequence: Synthetic peptide
  Seed: LQIPVSSSS (MAGC1_HUMAN)
LLIPVSSSL

SEQ ID NO: 85891 - protein, 9 aa, Artificial Sequence
  Description of Artificial Sequence: Synthetic peptide
  Seed: VSSSFSYTL (MAGC1_HUMAN)
VASSFSYTM

SEQ ID NO: 85892 - protein, 10 aa, Artificial Sequence
  Description of Artificial Sequence: Synthetic peptide
  Seed: MSPLYFPQSP (MAGC1_HUMAN)
MEPLYFPQSA

SEQ ID NO: 85893 - protein, 10 aa, Artificial Sequence
  Description of Artificial Sequence: Synthetic peptide
  Seed: SSSSTLLSLF (MAGC1_HUMAN)
SESSTLLSLW

SEQ ID NO: 85894 - protein, 10 aa, Artificial Sequence
  Description of Artificial Sequence: Synthetic peptide
  Seed: VSICSSSTSL (MAGC1_HUMAN)
VMICSSSTSW

SEQ ID NO: 85895 - protein, 11 aa, Artificial Sequence
  Description of Artificial Sequence: Synthetic peptide
  Seed: IPVSRSFSSTL (MAGC1_HUMAN)
IYVSRSFSSTF

SEQ ID NO: 85896 - protein, 9 aa, Artificial Sequence
  Description of Artificial Sequence: Synthetic peptide
  Seed: MTSSFSSTL (MAGC1_HUMAN)
MYSSFSSTH

SEQ ID NO: 85897 - protein, 9 aa, Artificial Sequence
  Description of Artificial Sequence: Synthetic peptide
  Seed: SRYTGYFPV (MAGC1_HUMAN)
SEYTGYFPY

SEQ ID NO: 85898 - protein, 9 aa, Artificial Sequence
  Description of Artificial Sequence: Synthetic peptide
  Seed: NSSPPRYEF (MAGC1_HUMAN)
NPSPPRYEY

SEQ ID NO: 85899 - protein, 9 aa, Artificial Sequence
  Description of Artificial Sequence: Synthetic peptide
  Seed: RKVVEFLAM (MAGC1_HUMAN)
RQVVEFLAI

SEQ ID NO: 85900 - protein, 9 aa, Artificial Sequence
  Description of Artificial Sequence: Synthetic peptide
  Seed: FQSSLQSPV (MAGC1_HUMAN)
FGSSLQSPM

SEQ ID NO: 85901 - protein, 9 aa, Artificial Sequence
  Description of Artificial Sequence: Synthetic peptide
  Seed: LQIPMTSSF (MAGC1_HUMAN)
LQIPMTSSV

SEQ ID NO: 85902 - protein, 11 aa, Artificial Sequence
  Description of Artificial Sequence: Synthetic peptide
  Seed: SLSQSSPVSSF (MAGC1_HUMAN)
SYSQSSPVSSF

SEQ ID NO: 85903 - protein, 9 aa, Artificial Sequence
  Description of Artificial Sequence: Synthetic peptide
  Seed: CSSSTSLSL (MAGC1_HUMAN)
CASSTSLSF

SEQ ID NO: 85904 - protein, 9 aa, Artificial Sequence
  Description of Artificial Sequence: Synthetic peptide
  Seed: AQSSLQIPV (MAGC1_HUMAN)
AESSLQIPT

SEQ ID NO: 85905 - protein, 9 aa, Artificial Sequence
  Description of Artificial Sequence: Synthetic peptide
  Seed: VISRYTGYF (MAGC1_HUMAN)
VGSRYTGYY

SEQ ID NO: 85906 - protein, 10 aa, Artificial Sequence
  Description of Artificial Sequence: Synthetic peptide
  Seed: SSFSYTLLSL (MAGC1_HUMAN)
SIFSYTLLSA

SEQ ID NO: 85907 - protein, 9 aa, Artificial Sequence
  Description of Artificial Sequence: Synthetic peptide
  Seed: LQIPGSPSF (MAGC1_HUMAN)
LCIPGSPSY

SEQ ID NO: 85908 - protein, 9 aa, Artificial Sequence
  Description of Artificial Sequence: Synthetic peptide
  Seed: AQSPLQRPV (MAGC1_HUMAN)
AESPLQRPA

SEQ ID NO: 85909 - protein, 10 aa, Artificial Sequence
  Description of Artificial Sequence: Synthetic peptide
  Seed: FAFGEPRELL (MAGC1_HUMAN)
FSFGEPRELM

SEQ ID NO: 85910 - protein, 9 aa, Artificial Sequence
  Description of Artificial Sequence: Synthetic peptide
  Seed: IFRKAREFI (MAGC1_HUMAN)
IYRKAREFF

SEQ ID NO: 85911 - protein, 9 aa, Artificial Sequence
  Description of Artificial Sequence: Synthetic peptide
  Seed: SRYTGYFPV (MAGC1_HUMAN)
SQYTGYFPH

SEQ ID NO: 85912 - protein, 10 aa, Artificial Sequence
  Description of Artificial Sequence: Synthetic peptide
  Seed: MLKNTVPITF (MAGC1_HUMAN)
MQKNTVPITW

SEQ ID NO: 85913 - protein, 11 aa, Artificial Sequence
  Description of Artificial Sequence: Synthetic peptide
  Seed: SPLQIPMTSSF (MAGC1_HUMAN)
SRLQIPMTSSF

SEQ ID NO: 85914 - protein, 9 aa, Artificial Sequence
  Description of Artificial Sequence: Synthetic peptide
  Seed: REVDPDDSY (MAGC1_HUMAN)
RQVDPDDSV

SEQ ID NO: 85915 - protein, 10 aa, Artificial Sequence
  Description of Artificial Sequence: Synthetic peptide
  Seed: STSLSLPQSF (MAGC1_HUMAN)
STSLSLPQSW

SEQ ID NO: 85916 - protein, 9 aa, Artificial Sequence
  Description of Artificial Sequence: Synthetic peptide
  Seed: SQSSPVSSF (MAGC1_HUMAN)
SSSSPVSSF

SEQ ID NO: 85917 - protein, 11 aa, Artificial Sequence
  Description of Artificial Sequence: Synthetic peptide
  Seed: REVDPDDSYVF (MAGC1_HUMAN)
RSVDPDDSYVY

SEQ ID NO: 85918 - protein, 9 aa, Artificial Sequence
  Description of Artificial Sequence: Synthetic peptide
  Seed: VSAASSSTL (MAGC1_HUMAN)
VEAASSSTF

SEQ ID NO: 85919 - protein, 9 aa, Artificial Sequence
  Description of Artificial Sequence: Synthetic peptide
  Seed: TLLSLFQSF (MAGC1_HUMAN)
TLLSLFQSA

SEQ ID NO: 85920 - protein, 9 aa, Artificial Sequence
  Description of Artificial Sequence: Synthetic peptide
  Seed: FQSSLQSPV (MAGC1_HUMAN)
FASSLQSPF

SEQ ID NO: 85921 - protein, 9 aa, Artificial Sequence
  Description of Artificial Sequence: Synthetic peptide
  Seed: TLDLTSEGC (MAGC1_HUMAN)
TMDLTSEGL

SEQ ID NO: 85922 - protein, 10 aa, Artificial Sequence
  Description of Artificial Sequence: Synthetic peptide
  Seed: LQIPVSPSFS (MAGC1_HUMAN)
LQIPVSPSFP

SEQ ID NO: 85923 - protein, 11 aa, Artificial Sequence
  Description of Artificial Sequence: Synthetic peptide
  Seed: SFFSYTLASLL (MAGC1_HUMAN)
SPFSYTLASLY

SEQ ID NO: 85924 - protein, 9 aa, Artificial Sequence
  Description of Artificial Sequence: Synthetic peptide
  Seed: VSPSFSSTL (MAGC1_HUMAN)
VWPSFSSTY

SEQ ID NO: 85925 - protein, 10 aa, Artificial Sequence
  Description of Artificial Sequence: Synthetic peptide
  Seed: EVIKRKVVEF (MAGC1_HUMAN)
ETIKRKVVER

SEQ ID NO: 85926 - protein, 9 aa, Artificial Sequence
  Description of Artificial Sequence: Synthetic peptide
  Seed: SSPPRYEFL (MAGC1_HUMAN)
STPPRYEFF

SEQ ID NO: 85927 - protein, 9 aa, Artificial Sequence
  Description of Artificial Sequence: Synthetic peptide
  Seed: STFEGFPQS (MAGC1_HUMAN)
SPFEGFPQF

SEQ ID NO: 85928 - protein, 9 aa, Artificial Sequence
  Description of Artificial Sequence: Synthetic peptide
  Seed: LSDEQGMSQ (MAGC1_HUMAN)
LCDEQGMSM

SEQ ID NO: 85929 - protein, 10 aa, Artificial Sequence
  Description of Artificial Sequence: Synthetic peptide
  Seed: EILFGISLRE (MAGC1_HUMAN)
EHLFGISLRR

SEQ ID NO: 85930 - protein, 9 aa, Artificial Sequence
  Description of Artificial Sequence: Synthetic peptide
  Seed: NPASSFFSS (MAGC1_HUMAN)
NPASSFFSF

SEQ ID NO: 85931 - protein, 10 aa, Artificial Sequence
  Description of Artificial Sequence: Synthetic peptide
  Seed: ILILSIIFIK (MAGC1_HUMAN)
IIILSIIFIR

SEQ ID NO: 85932 - protein, 10 aa, Artificial Sequence
  Description of Artificial Sequence: Synthetic peptide
  Seed: FFSYTLASLL (MAGC1_HUMAN)
FESYTLASLM

SEQ ID NO: 85933 - protein, 10 aa, Artificial Sequence
  Description of Artificial Sequence: Synthetic peptide
  Seed: LHFPQSPPEW (MAGC1_HUMAN)
LYFPQSPPEF

SEQ ID NO: 85934 - protein, 10 aa, Artificial Sequence
  Description of Artificial Sequence: Synthetic peptide
  Seed: FPSSYKDALK (MAGC1_HUMAN)
FVSSYKDALR

SEQ ID NO: 85935 - protein, 9 aa, Artificial Sequence
  Description of Artificial Sequence: Synthetic peptide
  Seed: FFSSALLSI (MAGC1_HUMAN)
FMSSALLSF

SEQ ID NO: 85936 - protein, 10 aa, Artificial Sequence
  Description of Artificial Sequence: Synthetic peptide
  Seed: LILILSIIFI (MAGC1_HUMAN)
LKLILSIIFV

SEQ ID NO: 85937 - protein, 10 aa, Artificial Sequence
  Description of Artificial Sequence: Synthetic peptide
  Seed: LQIPVSPSFS (MAGC1_HUMAN)
LMIPVSPSFF

SEQ ID NO: 85938 - protein, 10 aa, Artificial Sequence
  Description of Artificial Sequence: Synthetic peptide
  Seed: SSSSSTLLSL (MAGC1_HUMAN)
SWSSSTLLSF

SEQ ID NO: 85939 - protein, 10 aa, Artificial Sequence
  Description of Artificial Sequence: Synthetic peptide
  Seed: RSFSSTLLSI (MAGC1_HUMAN)
RSFSSTLLSM

SEQ ID NO: 85940 - protein, 9 aa, Artificial Sequence
  Description of Artificial Sequence: Synthetic peptide
  Seed: MPTAGMPSL (MAGC1_HUMAN)
MLTAGMPSY

SEQ ID NO: 85941 - protein, 10 aa, Artificial Sequence
  Description of Artificial Sequence: Synthetic peptide
  Seed: LSGIGVRAGR (MAGC1_HUMAN)
LFGIGVRAGR

SEQ ID NO: 85942 - protein, 10 aa, Artificial Sequence
  Description of Artificial Sequence: Synthetic peptide
  Seed: SFSYTLLSLF (MAGC1_HUMAN)
STSYTLLSLF

SEQ ID NO: 85943 - protein, 9 aa, Artificial Sequence
  Description of Artificial Sequence: Synthetic peptide
  Seed: SMSPLYFPQ (MAGC1_HUMAN)
SVSPLYFPK

SEQ ID NO: 85944 - protein, 9 aa, Artificial Sequence
  Description of Artificial Sequence: Synthetic peptide
  Seed: SSFFSSALL (MAGC1_HUMAN)
SAFFSSALY

SEQ ID NO: 85945 - protein, 9 aa, Artificial Sequence
  Description of Artificial Sequence: Synthetic peptide
  Seed: RSFSSTLLS (MAGC1_HUMAN)
RVFSSTLLL

SEQ ID NO: 85946 - protein, 9 aa, Artificial Sequence
  Description of Artificial Sequence: Synthetic peptide
  Seed: SAQSTFEGF (MAGC1_HUMAN)
SQQSTFEGW

SEQ ID NO: 85947 - protein, 9 aa, Artificial Sequence
  Description of Artificial Sequence: Synthetic peptide
  Seed: TLVSIFQSS (MAGC1_HUMAN)
TAVSIFQSI

SEQ ID NO: 85948 - protein, 11 aa, Artificial Sequence
  Description of Artificial Sequence: Synthetic peptide
  Seed: MSPLYFPQSPL (MAGC1_HUMAN)
MWPLYFPQSPV

SEQ ID NO: 85949 - protein, 9 aa, Artificial Sequence
  Description of Artificial Sequence: Synthetic peptide
  Seed: VIWDVLSGI (MAGC1_HUMAN)
VTWDVLSGI

SEQ ID NO: 85950 - protein, 10 aa, Artificial Sequence
  Description of Artificial Sequence: Synthetic peptide
  Seed: STPSSLPQSF (MAGC1_HUMAN)
SYPSSLPQSF

SEQ ID NO: 85951 - protein, 10 aa, Artificial Sequence
  Description of Artificial Sequence: Synthetic peptide
  Seed: YASEEVIWDV (MAGC1_HUMAN)
YLSEEVIWDC

SEQ ID NO: 85952 - protein, 9 aa, Artificial Sequence
  Description of Artificial Sequence: Synthetic peptide
  Seed: SSPPRYEFL (MAGC1_HUMAN)
SLPPRYEFL

SEQ ID NO: 85953 - protein, 9 aa, Artificial Sequence
  Description of Artificial Sequence: Synthetic peptide
  Seed: GFPQSVLQI (MAGC1_HUMAN)
GAPQSVLQV

SEQ ID NO: 85954 - protein, 9 aa, Artificial Sequence
  Description of Artificial Sequence: Synthetic peptide
  Seed: SSPESAQSA (MAGC1_HUMAN)
SMPESAQSY

SEQ ID NO: 85955 - protein, 9 aa, Artificial Sequence
  Description of Artificial Sequence: Synthetic peptide
  Seed: VISRYTGYF (MAGC1_HUMAN)
VQSRYTGYL

SEQ ID NO: 85956 - protein, 9 aa, Artificial Sequence
  Description of Artificial Sequence: Synthetic peptide
  Seed: LQIPVSPSF (MAGC1_HUMAN)
LKIPVSPSY

SEQ ID NO: 85957 - protein, 9 aa, Artificial Sequence
  Description of Artificial Sequence: Synthetic peptide
  Seed: RPVSSFFSY (MAGC1_HUMAN)
RYVSSFFSF

SEQ ID NO: 85958 - protein, 9 aa, Artificial Sequence
  Description of Artificial Sequence: Synthetic peptide
  Seed: RSFSSTLLS (MAGC1_HUMAN)
RCFSSTLLY

SEQ ID NO: 85959 - protein, 10 aa, Artificial Sequence
  Description of Artificial Sequence: Synthetic peptide
  Seed: REFIEILFGI (MAGC1_HUMAN)
RLFIEILFGA

SEQ ID NO: 85960 - protein, 11 aa, Artificial Sequence
  Description of Artificial Sequence: Synthetic peptide
  Seed: LQIPVSSSFSY (MAGC1_HUMAN)
LKIPVSSSFSM

SEQ ID NO: 85961 - protein, 10 aa, Artificial Sequence
  Description of Artificial Sequence: Synthetic peptide
  Seed: YTLASLLQSS (MAGC1_HUMAN)
YTLASLLQSM

SEQ ID NO: 85962 - protein, 10 aa, Artificial Sequence
  Description of Artificial Sequence: Synthetic peptide
  Seed: ASSFFSSALL (MAGC1_HUMAN)
AHSFFSSALY

SEQ ID NO: 85963 - protein, 10 aa, Artificial Sequence
  Description of Artificial Sequence: Synthetic peptide
  Seed: MSQNRLLILI (MAGC1_HUMAN)
MMQNRLLILV

SEQ ID NO: 85964 - protein, 9 aa, Artificial Sequence
  Description of Artificial Sequence: Synthetic peptide
  Seed: FSSTLLSLF (MAGC1_HUMAN)
FTSTLLSLA

SEQ ID NO: 85965 - protein, 10 aa, Artificial Sequence
  Description of Artificial Sequence: Synthetic peptide
  Seed: RAGREHFAFG (MAGC1_HUMAN)
RTGREHFAFQ

SEQ ID NO: 85966 - protein, 9 aa, Artificial Sequence
  Description of Artificial Sequence: Synthetic peptide
  Seed: LKNTVPITF (MAGC1_HUMAN)
LHNTVPITF

SEQ ID NO: 85967 - protein, 9 aa, Artificial Sequence
  Description of Artificial Sequence: Synthetic peptide
  Seed: RLLILILSI (MAGC1_HUMAN)
RMLILILSF

SEQ ID NO: 85968 - protein, 9 aa, Artificial Sequence
  Description of Artificial Sequence: Synthetic peptide
  Seed: VSPSFSSTL (MAGC1_HUMAN)
VMPSFSSTA

SEQ ID NO: 85969 - protein, 9 aa, Artificial Sequence
  Description of Artificial Sequence: Synthetic peptide
  Seed: FSSTLLSLF (MAGC1_HUMAN)
FVSTLLSLW

SEQ ID NO: 85970 - protein, 11 aa, Artificial Sequence
  Description of Artificial Sequence: Synthetic peptide
  Seed: VIWDVLSGIGV (MAGC1_HUMAN)
VMWDVLSGIGI

SEQ ID NO: 85971 - protein, 9 aa, Artificial Sequence
  Description of Artificial Sequence: Synthetic peptide
  Seed: SLFQSFSER (MAGC1_HUMAN)
SAFQSFSEI

SEQ ID NO: 85972 - protein, 10 aa, Artificial Sequence
  Description of Artificial Sequence: Synthetic peptide
  Seed: SFPSSTSSSL (MAGC1_HUMAN)
SSPSSTSSSL

SEQ ID NO: 85973 - protein, 9 aa, Artificial Sequence
  Description of Artificial Sequence: Synthetic peptide
  Seed: NTVPITFPS (MAGC1_HUMAN)
NMVPITFPV

SEQ ID NO: 85974 - protein, 9 aa, Artificial Sequence
  Description of Artificial Sequence: Synthetic peptide
  Seed: VSRSFSSTL (MAGC1_HUMAN)
VTRSFSSTS

SEQ ID NO: 85975 - protein, 10 aa, Artificial Sequence
  Description of Artificial Sequence: Synthetic peptide
  Seed: ICSSSTSLSL (MAGC1_HUMAN)
IISSSTSLSY

SEQ ID NO: 85976 - protein, 9 aa, Artificial Sequence
  Description of Artificial Sequence: Synthetic peptide
  Seed: VIWDVLSGI (MAGC1_HUMAN)
VVWDVLSGV

SEQ ID NO: 85977 - protein, 9 aa, Artificial Sequence
  Description of Artificial Sequence: Synthetic peptide
  Seed: FSSALLSIF (MAGC1_HUMAN)
FNSALLSIW

SEQ ID NO: 85978 - protein, 10 aa, Artificial Sequence
  Description of Artificial Sequence: Synthetic peptide
  Seed: LAMLKNTVPI (MAGC1_HUMAN)
LYMLKNTVPV

SEQ ID NO: 85979 - protein, 9 aa, Artificial Sequence
  Description of Artificial Sequence: Synthetic peptide
  Seed: SSPEGKDSL (MAGC1_HUMAN)
SLPEGKDSV

SEQ ID NO: 85980 - protein, 10 aa, Artificial Sequence
  Description of Artificial Sequence: Synthetic peptide
  Seed: RAGREHFAFG (MAGC1_HUMAN)
RLGREHFAFY

SEQ ID NO: 85981 - protein, 11 aa, Artificial Sequence
  Description of Artificial Sequence: Synthetic peptide
  Seed: SSFPSSTSSSL (MAGC1_HUMAN)
SAFPSSTSSSF

SEQ ID NO: 85982 - protein, 11 aa, Artificial Sequence
  Description of Artificial Sequence: Synthetic peptide
  Seed: SFFSSALLSIF (MAGC1_HUMAN)
SWFSSALLSIW

SEQ ID NO: 85983 - protein, 10 aa, Artificial Sequence
  Description of Artificial Sequence: Synthetic peptide
  Seed: SLSPLHFPQF (MAGC1_HUMAN)
SFSPLHFPQF

SEQ ID NO: 85984 - protein, 9 aa, Artificial Sequence
  Description of Artificial Sequence: Synthetic peptide
  Seed: SFSSTLVSL (MAGC1_HUMAN)
SPSSTLVSF

SEQ ID NO: 85985 - protein, 10 aa, Artificial Sequence
  Description of Artificial Sequence: Synthetic peptide
  Seed: REFIEILFGI (MAGC1_HUMAN)
REFIEILFGW

SEQ ID NO: 85986 - protein, 9 aa, Artificial Sequence
  Description of Artificial Sequence: Synthetic peptide
  Seed: KAREFIEIL (MAGC1_HUMAN)
KQREFIEIM

SEQ ID NO: 85987 - protein, 10 aa, Artificial Sequence
  Description of Artificial Sequence: Synthetic peptide
  Seed: FSSSTSLSPF (MAGC1_HUMAN)
FTSSTSLSPW

SEQ ID NO: 85988 - protein, 9 aa, Artificial Sequence
  Description of Artificial Sequence: Synthetic peptide
  Seed: SSPERTHST (MAGC1_HUMAN)
SYPERTHSI

SEQ ID NO: 85989 - protein, 9 aa, Artificial Sequence
  Description of Artificial Sequence: Synthetic peptide
  Seed: FSSTLLSLF (MAGC1_HUMAN)
FESTLLSLY

SEQ ID NO: 85990 - protein, 10 aa, Artificial Sequence
  Description of Artificial Sequence: Synthetic peptide
  Seed: FPQSLLQIPM (MAGC1_HUMAN)
FIQSLLQIPA

SEQ ID NO: 85991 - protein, 9 aa, Artificial Sequence
  Description of Artificial Sequence: Synthetic peptide
  Seed: LQIVPSLPE (MAGC1_HUMAN)
LKIVPSLPY

SEQ ID NO: 85992 - protein, 10 aa, Artificial Sequence
  Description of Artificial Sequence: Synthetic peptide
  Seed: RKVVEFLAML (MAGC1_HUMAN)
RLVVEFLAML

SEQ ID NO: 85993 - protein, 9 aa, Artificial Sequence
  Description of Artificial Sequence: Synthetic peptide
  Seed: VSSSSSSTL (MAGC1_HUMAN)
VISSSSSTL

SEQ ID NO: 85994 - protein, 11 aa, Artificial Sequence
  Description of Artificial Sequence: Synthetic peptide
  Seed: SLFQSSPERTH (MAGC1_HUMAN)
SSFQSSPERTF

SEQ ID NO: 85995 - protein, 10 aa, Artificial Sequence
  Description of Artificial Sequence: Synthetic peptide
  Seed: SSPERTHSTF (MAGC1_HUMAN)
SFPERTHSTY

SEQ ID NO: 85996 - protein, 9 aa, Artificial Sequence
  Description of Artificial Sequence: Synthetic peptide
  Seed: ASEEVIWDV (MAGC1_HUMAN)
AMEEVIWDI

SEQ ID NO: 85997 - protein, 9 aa, Artificial Sequence
  Description of Artificial Sequence: Synthetic peptide
  Seed: FPSSYKDAL (MAGC1_HUMAN)
FPSSYKDAW

SEQ ID NO: 85998 - protein, 10 aa, Artificial Sequence
  Description of Artificial Sequence: Synthetic peptide
  Seed: WVQEHYLEYR (MAGC1_HUMAN)
WYQEHYLEYR

SEQ ID NO: 85999 - protein, 9 aa, Artificial Sequence
  Description of Artificial Sequence: Synthetic peptide
  Seed: LQSPVISFS (MAGC1_HUMAN)
LMSPVISFA

SEQ ID NO: 86000 - protein, 9 aa, Artificial Sequence
  Description of Artificial Sequence: Synthetic peptide
  Seed: FSSTLLSLF (MAGC1_HUMAN)
FCSTLLSLW

SEQ ID NO: 86001 - protein, 10 aa, Artificial Sequence
  Description of Artificial Sequence: Synthetic peptide
  Seed: VSICSSSTSL (MAGC1_HUMAN)
VVICSSSTSW

SEQ ID NO: 86002 - protein, 9 aa, Artificial Sequence
  Description of Artificial Sequence: Synthetic peptide
  Seed: STQSPFEGF (MAGC1_HUMAN)
SFQSPFEGW

SEQ ID NO: 86003 - protein, 9 aa, Artificial Sequence
  Description of Artificial Sequence: Synthetic peptide
  Seed: REFIEILFG (MAGC1_HUMAN)
REFIEILFT

SEQ ID NO: 86004 - protein, 9 aa, Artificial Sequence
  Description of Artificial Sequence: Synthetic peptide
  Seed: SSSVMSPSF (MAGC1_HUMAN)
SASVMSPSI

SEQ ID NO: 86005 - protein, 11 aa, Artificial Sequence
  Description of Artificial Sequence: Synthetic peptide
  Seed: SEESSSPVDEY (MAGC1_HUMAN)
SEESSSPVDEF

SEQ ID NO: 86006 - protein, 9 aa, Artificial Sequence
  Description of Artificial Sequence: Synthetic peptide
  Seed: ASSSTLVSI (MAGC1_HUMAN)
AISSTLVSF

SEQ ID NO: 86007 - protein, 9 aa, Artificial Sequence
  Description of Artificial Sequence: Synthetic peptide
  Seed: LQIPVSRSF (MAGC1_HUMAN)
LEIPVSRSL

SEQ ID NO: 86008 - protein, 9 aa, Artificial Sequence
  Description of Artificial Sequence: Synthetic peptide
  Seed: AMLKNTVPI (MAGC1_HUMAN)
AQLKNTVPW

SEQ ID NO: 86009 - protein, 9 aa, Artificial Sequence
  Description of Artificial Sequence: Synthetic peptide
  Seed: SSLSQSSPV (MAGC1_HUMAN)
SILSQSSPW

SEQ ID NO: 86010 - protein, 10 aa, Artificial Sequence
  Description of Artificial Sequence: Synthetic peptide
  Seed: RAGREHFAFG (MAGC1_HUMAN)
RGGREHFAFA

SEQ ID NO: 86011 - protein, 9 aa, Artificial Sequence
  Description of Artificial Sequence: Synthetic peptide
  Seed: SPLQRPVSS (MAGC1_HUMAN)
SQLQRPVSL

SEQ ID NO: 86012 - protein, 10 aa, Artificial Sequence
  Description of Artificial Sequence: Synthetic peptide
  Seed: NPASSFFSSA (MAGC1_HUMAN)
NFASSFFSSV

SEQ ID NO: 86013 - protein, 9 aa, Artificial Sequence
  Description of Artificial Sequence: Synthetic peptide
  Seed: WGPRAHSEV (MAGC1_HUMAN)
WMPRAHSEM

SEQ ID NO: 86014 - protein, 10 aa, Artificial Sequence
  Description of Artificial Sequence: Synthetic peptide
  Seed: VISFSSSTSL (MAGC1_HUMAN)
VLSFSSSTSL

SEQ ID NO: 86015 - protein, 11 aa, Artificial Sequence
  Description of Artificial Sequence: Synthetic peptide
  Seed: RSFSSTLLSIF (MAGC1_HUMAN)
RHFSSTLLSIF

SEQ ID NO: 86016 - protein, 10 aa, Artificial Sequence
  Description of Artificial Sequence: Synthetic peptide
  Seed: SSSSTLLSLF (MAGC1_HUMAN)
SFSSTLLSLW

SEQ ID NO: 86017 - protein, 10 aa, Artificial Sequence
  Description of Artificial Sequence: Synthetic peptide
  Seed: SSFSYTLLSL (MAGC1_HUMAN)
SQFSYTLLSI

SEQ ID NO: 86018 - protein, 10 aa, Artificial Sequence
  Description of Artificial Sequence: Synthetic peptide
  Seed: VPITFPSSYK (MAGC1_HUMAN)
VIITFPSSYR

SEQ ID NO: 86019 - protein, 10 aa, Artificial Sequence
  Description of Artificial Sequence: Synthetic peptide
  Seed: FFSYTLASLL (MAGC1_HUMAN)
FMSYTLASLG

SEQ ID NO: 86020 - protein, 10 aa, Artificial Sequence
  Description of Artificial Sequence: Synthetic peptide
  Seed: VSSSSSSSTL (MAGC1_HUMAN)
VVSSSSSSTW

SEQ ID NO: 86021 - protein, 9 aa, Artificial Sequence
  Description of Artificial Sequence: Synthetic peptide
  Seed: TTDDSTATE (MAGC1_HUMAN)
TVDDSTATI

SEQ ID NO: 86022 - protein, 10 aa, Artificial Sequence
  Description of Artificial Sequence: Synthetic peptide
  Seed: LQIPVSRSFS (MAGC1_HUMAN)
LHIPVSRSFF

SEQ ID NO: 86023 - protein, 9 aa, Artificial Sequence
  Description of Artificial Sequence: Synthetic peptide
  Seed: RTQSTFEGF (MAGC1_HUMAN)
RYQSTFEGI

SEQ ID NO: 86024 - protein, 9 aa, Artificial Sequence
  Description of Artificial Sequence: Synthetic peptide
  Seed: SPLQRPVSS (MAGC1_HUMAN)
SPLQRPVSV

SEQ ID NO: 86025 - protein, 9 aa, Artificial Sequence
  Description of Artificial Sequence: Synthetic peptide
  Seed: LQIPMTSSF (MAGC1_HUMAN)
LPIPMTSSL

SEQ ID NO: 86026 - protein, 11 aa, Artificial Sequence
  Description of Artificial Sequence: Synthetic peptide
  Seed: IPMTSSFSSTL (MAGC1_HUMAN)
ITMTSSFSSTW

SEQ ID NO: 86027 - protein, 10 aa, Artificial Sequence
  Description of Artificial Sequence: Synthetic peptide
  Seed: VSSSSSSSTL (MAGC1_HUMAN)
VKSSSSSSTW

SEQ ID NO: 86028 - protein, 9 aa, Artificial Sequence
  Description of Artificial Sequence: Synthetic peptide
  Seed: GEDSLSPLQ (MAGC1_HUMAN)
GEDSLSPLA

SEQ ID NO: 86029 - protein, 10 aa, Artificial Sequence
  Description of Artificial Sequence: Synthetic peptide
  Seed: MTSSFSSTLL (MAGC1_HUMAN)
MQSSFSSTLL

SEQ ID NO: 86030 - protein, 11 aa, Artificial Sequence
  Description of Artificial Sequence: Synthetic peptide
  Seed: QSSPESAQSTF (MAGC1_HUMAN)
QPSPESAQSTY

SEQ ID NO: 86031 - protein, 10 aa, Artificial Sequence
  Description of Artificial Sequence: Synthetic peptide
  Seed: SPLQSPVSSF (MAGC1_HUMAN)
SCLQSPVSSY

SEQ ID NO: 86032 - protein, 9 aa, Artificial Sequence
  Description of Artificial Sequence: Synthetic peptide
  Seed: SQSPPEGPV (MAGC1_HUMAN)
SISPPEGPM

SEQ ID NO: 86033 - protein, 9 aa, Artificial Sequence
  Description of Artificial Sequence: Synthetic peptide
  Seed: STFEGFAQS (MAGC1_HUMAN)
SLFEGFAQL

SEQ ID NO: 86034 - protein, 10 aa, Artificial Sequence
  Description of Artificial Sequence: Synthetic peptide
  Seed: ILFGISLREV (MAGC1_HUMAN)
IMFGISLREI

SEQ ID NO: 86035 - protein, 9 aa, Artificial Sequence
  Description of Artificial Sequence: Synthetic peptide
  Seed: SAPEGEDSL (MAGC1_HUMAN)
SVPEGEDSV

SEQ ID NO: 86036 - protein, 10 aa, Artificial Sequence
  Description of Artificial Sequence: Synthetic peptide
  Seed: WEDSLSPLHF (MAGC1_HUMAN)
WEDSLSPLHL

SEQ ID NO: 86037 - protein, 9 aa, Artificial Sequence
  Description of Artificial Sequence: Synthetic peptide
  Seed: FPSSTSSSL (MAGC1_HUMAN)
FASSTSSSA

SEQ ID NO: 86038 - protein, 9 aa, Artificial Sequence
  Description of Artificial Sequence: Synthetic peptide
  Seed: TLDEKVDEL (MAGC1_HUMAN)
TQDEKVDEI

SEQ ID NO: 86039 - protein, 9 aa, Artificial Sequence
  Description of Artificial Sequence: Synthetic peptide
  Seed: LQIPGSPSF (MAGC1_HUMAN)
LKIPGSPSW

SEQ ID NO: 86040 - protein, 9 aa, Artificial Sequence
  Description of Artificial Sequence: Synthetic peptide
  Seed: TLDEKVDEL (MAGC1_HUMAN)
TFDEKVDEF

SEQ ID NO: 86041 - protein, 9 aa, Artificial Sequence
  Description of Artificial Sequence: Synthetic peptide
  Seed: VSSFFSYTL (MAGC1_HUMAN)
VASFFSYTM

SEQ ID NO: 86042 - protein, 9 aa, Artificial Sequence
  Description of Artificial Sequence: Synthetic peptide
  Seed: FPSSTSSSL (MAGC1_HUMAN)
FHSSTSSSL

SEQ ID NO: 86043 - protein, 9 aa, Artificial Sequence
  Description of Artificial Sequence: Synthetic peptide
  Seed: YPLQSPQSR (MAGC1_HUMAN)
YPLQSPQSI

SEQ ID NO: 86044 - protein, 9 aa, Artificial Sequence
  Description of Artificial Sequence: Synthetic peptide
  Seed: TGYFPVIFR (MAGC1_HUMAN)
TTYFPVIFH

SEQ ID NO: 86045 - protein, 10 aa, Artificial Sequence
  Description of Artificial Sequence: Synthetic peptide
  Seed: ASSFFSSALL (MAGC1_HUMAN)
AASFFSSALM

SEQ ID NO: 86046 - protein, 10 aa, Artificial Sequence
  Description of Artificial Sequence: Synthetic peptide
  Seed: FPQSPLQIPV (MAGC1_HUMAN)
FLQSPLQIPV

SEQ ID NO: 86047 - protein, 11 aa, Artificial Sequence
  Description of Artificial Sequence: Synthetic peptide
  Seed: LQIPVSSSFSY (MAGC1_HUMAN)
LSIPVSSSFSF

SEQ ID NO: 86048 - protein, 11 aa, Artificial Sequence
  Description of Artificial Sequence: Synthetic peptide
  Seed: IPVSPSSSSTL (MAGC1_HUMAN)
IPVSPSSSSTV

SEQ ID NO: 86049 - protein, 9 aa, Artificial Sequence
  Description of Artificial Sequence: Synthetic peptide
  Seed: AQSPLQSPV (MAGC1_HUMAN)
ASSPLQSPY

SEQ ID NO: 86050 - protein, 10 aa, Artificial Sequence
  Description of Artificial Sequence: Synthetic peptide
  Seed: SSPESAQSAF (MAGC1_HUMAN)
SNPESAQSAL

SEQ ID NO: 86051 - protein, 11 aa, Artificial Sequence
  Description of Artificial Sequence: Synthetic peptide
  Seed: FLAMLKNTVPI (MAGC1_HUMAN)
FMAMLKNTVPL

SEQ ID NO: 86052 - protein, 9 aa, Artificial Sequence
  Description of Artificial Sequence: Synthetic peptide
  Seed: EVDPDDSYV (MAGC1_HUMAN)
ETDPDDSYM

SEQ ID NO: 86053 - protein, 9 aa, Artificial Sequence
  Description of Artificial Sequence: Synthetic peptide
  Seed: EDSQSPLQI (MAGC1_HUMAN)
EESQSPLQI

SEQ ID NO: 86054 - protein, 9 aa, Artificial Sequence
  Description of Artificial Sequence: Synthetic peptide
  Seed: LQIPVSPSF (MAGC1_HUMAN)
LYIPVSPSL

SEQ ID NO: 86055 - protein, 8 aa, Artificial Sequence
  Description of Artificial Sequence: Synthetic peptide
  Seed: ARFLLLKY (MAGC1_HUMAN)
AQFLLLKY

SEQ ID NO: 86056 - protein, 8 aa, Artificial Sequence
  Description of Artificial Sequence: Synthetic peptide
  Seed: AEMLTNVI (MAGC1_HUMAN)
AEMLTNVF

SEQ ID NO: 86057 - protein, 11 aa, Artificial Sequence
  Description of Artificial Sequence: Synthetic peptide
  Seed: FLAMLKNTVPI (MAGC1_HUMAN)
FIAMLKNTVPL

SEQ ID NO: 86058 - protein, 9 aa, Artificial Sequence
  Description of Artificial Sequence: Synthetic peptide
  Seed: SSSSSSSTL (MAGC1_HUMAN)
SSSSSSSTW

SEQ ID NO: 86059 - protein, 9 aa, Artificial Sequence
  Description of Artificial Sequence: Synthetic peptide
  Seed: SLIESEPLF (MAGC1_HUMAN)
SMIESEPLM

SEQ ID NO: 86060 - protein, 9 aa, Artificial Sequence
  Description of Artificial Sequence: Synthetic peptide
  Seed: SSTSSSLSK (MAGC1_HUMAN)
SMTSSSLSR

SEQ ID NO: 86061 - protein, 9 aa, Artificial Sequence
  Description of Artificial Sequence: Synthetic peptide
  Seed: VSRSFSSTL (MAGC1_HUMAN)
VKRSFSSTF

SEQ ID NO: 86062 - protein, 11 aa, Artificial Sequence
  Description of Artificial Sequence: Synthetic peptide
  Seed: VSSSSSSSTLL (MAGC1_HUMAN)
VPSSSSSSTLW

SEQ ID NO: 86063 - protein, 9 aa, Artificial Sequence
  Description of Artificial Sequence: Synthetic peptide
  Seed: YPLQSPQSR (MAGC1_HUMAN)
YILQSPQSR

SEQ ID NO: 86064 - protein, 10 aa, Artificial Sequence
  Description of Artificial Sequence: Synthetic peptide
  Seed: YTLDEKVDEL (MAGC1_HUMAN)
YTLDEKVDEW

SEQ ID NO: 86065 - protein, 10 aa, Artificial Sequence
  Description of Artificial Sequence: Synthetic peptide
  Seed: STPSSLPQSF (MAGC1_HUMAN)
SIPSSLPQSY

SEQ ID NO: 86066 - protein, 9 aa, Artificial Sequence
  Description of Artificial Sequence: Synthetic peptide
  Seed: TLLSILQSS (MAGC1_HUMAN)
TLLSILQSA

SEQ ID NO: 86067 - protein, 10 aa, Artificial Sequence
  Description of Artificial Sequence: Synthetic peptide
  Seed: RAGREHFAFG (MAGC1_HUMAN)
RIGREHFAFK

SEQ ID NO: 86068 - protein, 11 aa, Artificial Sequence
  Description of Artificial Sequence: Synthetic peptide
  Seed: LTNVISRYTGY (MAGC1_HUMAN)
LSNVISRYTGW

SEQ ID NO: 86069 - protein, 9 aa, Artificial Sequence
  Description of Artificial Sequence: Synthetic peptide
  Seed: SAQSTFEGF (MAGC1_HUMAN)
SQQSTFEGM

SEQ ID NO: 86070 - protein, 11 aa, Artificial Sequence
  Description of Artificial Sequence: Synthetic peptide
  Seed: LQIPVSSSFSY (MAGC1_HUMAN)
LWIPVSSSFSM

SEQ ID NO: 86071 - protein, 9 aa, Artificial Sequence
  Description of Artificial Sequence: Synthetic peptide
  Seed: KVWVQEHYL (MAGC1_HUMAN)
KQWVQEHYI

SEQ ID NO: 86072 - protein, 10 aa, Artificial Sequence
  Description of Artificial Sequence: Synthetic peptide
  Seed: TGYFPVIFRK (MAGC1_HUMAN)
TTYFPVIFRR

SEQ ID NO: 86073 - protein, 9 aa, Artificial Sequence
  Description of Artificial Sequence: Synthetic peptide
  Seed: KDSQSPLQI (MAGC1_HUMAN)
KESQSPLQL

SEQ ID NO: 86074 - protein, 10 aa, Artificial Sequence
  Description of Artificial Sequence: Synthetic peptide
  Seed: SFSSTLVSLF (MAGC1_HUMAN)
SLSSTLVSLW

SEQ ID NO: 86075 - protein, 9 aa, Artificial Sequence
  Description of Artificial Sequence: Synthetic peptide
  Seed: NTHSPLQIV (MAGC1_HUMAN)
NLHSPLQIV

SEQ ID NO: 86076 - protein, 9 aa, Artificial Sequence
  Description of Artificial Sequence: Synthetic peptide
  Seed: KAREFIEIL (MAGC1_HUMAN)
KLREFIEII

SEQ ID NO: 86077 - protein, 9 aa, Artificial Sequence
  Description of Artificial Sequence: Synthetic peptide
  Seed: RAHSEVIKR (MAGC1_HUMAN)
RAHSEVIKK

SEQ ID NO: 86078 - protein, 9 aa, Artificial Sequence
  Description of Artificial Sequence: Synthetic peptide
  Seed: SSFFSSALL (MAGC1_HUMAN)
SMFFSSALA

SEQ ID NO: 86079 - protein, 9 aa, Artificial Sequence
  Description of Artificial Sequence: Synthetic peptide
  Seed: SSPESDDTL (MAGC1_HUMAN)
SLPESDDTL

SEQ ID NO: 86080 - protein, 9 aa, Artificial Sequence
  Description of Artificial Sequence: Synthetic peptide
  Seed: TTDDSTATE (MAGC1_HUMAN)
TMDDSTATM

SEQ ID NO: 86081 - protein, 9 aa, Artificial Sequence
  Description of Artificial Sequence: Synthetic peptide
  Seed: VSSFFSYTL (MAGC1_HUMAN)
VLSFFSYTV

SEQ ID NO: 86082 - protein, 9 aa, Artificial Sequence
  Description of Artificial Sequence: Synthetic peptide
  Seed: GFPQSPLQI (MAGC1_HUMAN)
GAPQSPLQM

SEQ ID NO: 86083 - protein, 9 aa, Artificial Sequence
  Description of Artificial Sequence: Synthetic peptide
  Seed: SPLQIPGSP (MAGC1_HUMAN)
SPLQIPGSL

SEQ ID NO: 86084 - protein, 9 aa, Artificial Sequence
  Description of Artificial Sequence: Synthetic peptide
  Seed: AGREHFAFG (MAGC1_HUMAN)
AYREHFAFV

SEQ ID NO: 86085 - protein, 9 aa, Artificial Sequence
  Description of Artificial Sequence: Synthetic peptide
  Seed: RTHSTFEGF (MAGC1_HUMAN)
RFHSTFEGF

SEQ ID NO: 86086 - protein, 11 aa, Artificial Sequence
  Description of Artificial Sequence: Synthetic peptide
  Seed: SICSSSTSLSL (MAGC1_HUMAN)
SQCSSSTSLSW

SEQ ID NO: 86087 - protein, 11 aa, Artificial Sequence
  Description of Artificial Sequence: Synthetic peptide
  Seed: SSFPSSTSSSL (MAGC1_HUMAN)
SQFPSSTSSSF

SEQ ID NO: 86088 - protein, 10 aa, Artificial Sequence
  Description of Artificial Sequence: Synthetic peptide
  Seed: STPSSLPQSF (MAGC1_HUMAN)
SSPSSLPQSF

SEQ ID NO: 86089 - protein, 9 aa, Artificial Sequence
  Description of Artificial Sequence: Synthetic peptide
  Seed: LQIPMTSSF (MAGC1_HUMAN)
LFIPMTSSW

SEQ ID NO: 86090 - protein, 9 aa, Artificial Sequence
  Description of Artificial Sequence: Synthetic peptide
  Seed: SPLQIPQSS (MAGC1_HUMAN)
SALQIPQSM

SEQ ID NO: 86091 - protein, 10 aa, Artificial Sequence
  Description of Artificial Sequence: Synthetic peptide
  Seed: VSPSFSSTLV (MAGC1_HUMAN)
VMPSFSSTLI

SEQ ID NO: 86092 - protein, 9 aa, Artificial Sequence
  Description of Artificial Sequence: Synthetic peptide
  Seed: KQPITKAEM (MAGC1_HUMAN)
KFPITKAEM

SEQ ID NO: 86093 - protein, 10 aa, Artificial Sequence
  Description of Artificial Sequence: Synthetic peptide
  Seed: PLQNPASSFF (MAGC1_HUMAN)
PWQNPASSFY

SEQ ID NO: 86094 - protein, 10 aa, Artificial Sequence
  Description of Artificial Sequence: Synthetic peptide
  Seed: LQIVPSLPEW (MAGC1_HUMAN)
LQIVPSLPEY

SEQ ID NO: 86095 - protein, 9 aa, Artificial Sequence
  Description of Artificial Sequence: Synthetic peptide
  Seed: LQRPVSSFF (MAGC1_HUMAN)
LFRPVSSFY

SEQ ID NO: 86096 - protein, 9 aa, Artificial Sequence
  Description of Artificial Sequence: Synthetic peptide
  Seed: QIVPSLPEW (MAGC1_HUMAN)
QAVPSLPEW

SEQ ID NO: 86097 - protein, 9 aa, Artificial Sequence
  Description of Artificial Sequence: Synthetic peptide
  Seed: TESASSSVM (MAGC1_HUMAN)
TKSASSSVF

SEQ ID NO: 86098 - protein, 10 aa, Artificial Sequence
  Description of Artificial Sequence: Synthetic peptide
  Seed: ILILSIIFIK (MAGC1_HUMAN)
IMILSIIFIR

SEQ ID NO: 86099 - protein, 9 aa, Artificial Sequence
  Description of Artificial Sequence: Synthetic peptide
  Seed: NSSPPRYEF (MAGC1_HUMAN)
NPSPPRYEW

SEQ ID NO: 86100 - protein, 9 aa, Artificial Sequence
  Description of Artificial Sequence: Synthetic peptide
  Seed: VQEHYLEYR (MAGC1_HUMAN)
VTEHYLEYR

SEQ ID NO: 86101 - protein, 10 aa, Artificial Sequence
  Description of Artificial Sequence: Synthetic peptide
  Seed: YTLDEKVDEL (MAGC1_HUMAN)
YMLDEKVDEI

SEQ ID NO: 86102 - protein, 11 aa, Artificial Sequence
  Description of Artificial Sequence: Synthetic peptide
  Seed: LQIPVSSSFSY (MAGC1_HUMAN)
LNIPVSSSFSY

SEQ ID NO: 86103 - protein, 9 aa, Artificial Sequence
  Description of Artificial Sequence: Synthetic peptide
  Seed: SPESAQSTF (MAGC1_HUMAN)
SLESAQSTY

SEQ ID NO: 86104 - protein, 9 aa, Artificial Sequence
  Description of Artificial Sequence: Synthetic peptide
  Seed: SSFPSSTSS (MAGC1_HUMAN)
SVFPSSTSY

SEQ ID NO: 86105 - protein, 9 aa, Artificial Sequence
  Description of Artificial Sequence: Synthetic peptide
  Seed: GFPQSVLQI (MAGC1_HUMAN)
GYPQSVLQL

SEQ ID NO: 86106 - protein, 10 aa, Artificial Sequence
  Description of Artificial Sequence: Synthetic peptide
  Seed: SFSERTQSTF (MAGC1_HUMAN)
SYSERTQSTW

SEQ ID NO: 86107 - protein, 9 aa, Artificial Sequence
  Description of Artificial Sequence: Synthetic peptide
  Seed: SLSPHYFPQ (MAGC1_HUMAN)
SMSPHYFPY

SEQ ID NO: 86108 - protein, 10 aa, Artificial Sequence
  Description of Artificial Sequence: Synthetic peptide
  Seed: VSSSFSYTLL (MAGC1_HUMAN)
VSSSFSYTLW

SEQ ID NO: 86109 - protein, 10 aa, Artificial Sequence
  Description of Artificial Sequence: Synthetic peptide
  Seed: RAHSEVIKRK (MAGC1_HUMAN)
RVHSEVIKRK

SEQ ID NO: 86110 - protein, 10 aa, Artificial Sequence
  Description of Artificial Sequence: Synthetic peptide
  Seed: SRYTGYFPVI (MAGC1_HUMAN)
SEYTGYFPVF

SEQ ID NO: 86111 - protein, 9 aa, Artificial Sequence
  Description of Artificial Sequence: Synthetic peptide
  Seed: SSFFSSALL (MAGC1_HUMAN)
STFFSSALL

SEQ ID NO: 86112 - protein, 9 aa, Artificial Sequence
  Description of Artificial Sequence: Synthetic peptide
  Seed: TLDEKVDEL (MAGC1_HUMAN)
TMDEKVDEM

SEQ ID NO: 86113 - protein, 9 aa, Artificial Sequence
  Description of Artificial Sequence: Synthetic peptide
  Seed: MTSSFSSTL (MAGC1_HUMAN)
MQSSFSSTI

SEQ ID NO: 86114 - protein, 10 aa, Artificial Sequence
  Description of Artificial Sequence: Synthetic peptide
  Seed: RSFSSTLLSI (MAGC1_HUMAN)
RSFSSTLLSW

SEQ ID NO: 86115 - protein, 11 aa, Artificial Sequence
  Description of Artificial Sequence: Synthetic peptide
  Seed: SFSSSTSLSPF (MAGC1_HUMAN)
SWSSSTSLSPF

SEQ ID NO: 86116 - protein, 9 aa, Artificial Sequence
  Description of Artificial Sequence: Synthetic peptide
  Seed: FSERTQSTF (MAGC1_HUMAN)
FKERTQSTF

SEQ ID NO: 86117 - protein, 9 aa, Artificial Sequence
  Description of Artificial Sequence: Synthetic peptide
  Seed: EPRELLTKV (MAGC1_HUMAN)
EARELLTKI

SEQ ID NO: 86118 - protein, 11 aa, Artificial Sequence
  Description of Artificial Sequence: Synthetic peptide
  Seed: SPLQIPVSSSS (MAGC1_HUMAN)
SSLQIPVSSSF

SEQ ID NO: 86119 - protein, 9 aa, Artificial Sequence
  Description of Artificial Sequence: Synthetic peptide
  Seed: TTDDSTATE (MAGC1_HUMAN)
TIDDSTATM

SEQ ID NO: 86120 - protein, 9 aa, Artificial Sequence
  Description of Artificial Sequence: Synthetic peptide
  Seed: GEDSLSPHY (MAGC1_HUMAN)
GEDSLSPHV

SEQ ID NO: 86121 - protein, 9 aa, Artificial Sequence
  Description of Artificial Sequence: Synthetic peptide
  Seed: VSSFFSYTL (MAGC1_HUMAN)
VMSFFSYTI

SEQ ID NO: 86122 - protein, 9 aa, Artificial Sequence
  Description of Artificial Sequence: Synthetic peptide
  Seed: YPLQSPQSR (MAGC1_HUMAN)
YALQSPQSY

SEQ ID NO: 86123 - protein, 9 aa, Artificial Sequence
  Description of Artificial Sequence: Synthetic peptide
  Seed: RAHSEVIKR (MAGC1_HUMAN)
RQHSEVIKY

SEQ ID NO: 86124 - protein, 9 aa, Artificial Sequence
  Description of Artificial Sequence: Synthetic peptide
  Seed: ASSFFSSAL (MAGC1_HUMAN)
AHSFFSSAY

SEQ ID NO: 86125 - protein, 9 aa, Artificial Sequence
  Description of Artificial Sequence: Synthetic peptide
  Seed: FAFGEPREL (MAGC1_HUMAN)
FLFGEPRES

SEQ ID NO: 86126 - protein, 10 aa, Artificial Sequence
  Description of Artificial Sequence: Synthetic peptide
  Seed: PLQIPMTSSF (MAGC1_HUMAN)
PGQIPMTSSF

SEQ ID NO: 86127 - protein, 11 aa, Artificial Sequence
  Description of Artificial Sequence: Synthetic peptide
  Seed: IIDTTDDSTAT (MAGC1_HUMAN)
IADTTDDSTAI

SEQ ID NO: 86128 - protein, 9 aa, Artificial Sequence
  Description of Artificial Sequence: Synthetic peptide
  Seed: MTSSFSSTL (MAGC1_HUMAN)
MNSSFSSTM

SEQ ID NO: 86129 - protein, 9 aa, Artificial Sequence
  Description of Artificial Sequence: Synthetic peptide
  Seed: FSSALLSIF (MAGC1_HUMAN)
FLSALLSIW

SEQ ID NO: 86130 - protein, 10 aa, Artificial Sequence
  Description of Artificial Sequence: Synthetic peptide
  Seed: MTSSFSSTLL (MAGC1_HUMAN)
MISSFSSTLV

SEQ ID NO: 86131 - protein, 9 aa, Artificial Sequence
  Description of Artificial Sequence: Synthetic peptide
  Seed: TKVWVQEHY (MAGC1_HUMAN)
TQVWVQEHY

SEQ ID NO: 86132 - protein, 9 aa, Artificial Sequence
  Description of Artificial Sequence: Synthetic peptide
  Seed: IIFIKGTYA (MAGC1_HUMAN)
IIFIKGTYI

SEQ ID NO: 86133 - protein, 11 aa, Artificial Sequence
  Description of Artificial Sequence: Synthetic peptide
  Seed: STFEGFPQSLL (MAGC1_HUMAN)
SQFEGFPQSLV

SEQ ID NO: 86134 - protein, 9 aa, Artificial Sequence
  Description of Artificial Sequence: Synthetic peptide
  Seed: LQIPMTSSF (MAGC1_HUMAN)
LDIPMTSSL

SEQ ID NO: 86135 - protein, 9 aa, Artificial Sequence
  Description of Artificial Sequence: Synthetic peptide
  Seed: TSLSLPQSF (MAGC1_HUMAN)
TSLSLPQSM

SEQ ID NO: 86136 - protein, 10 aa, Artificial Sequence
  Description of Artificial Sequence: Synthetic peptide
  Seed: ASSFFSSALL (MAGC1_HUMAN)
AASFFSSALY

SEQ ID NO: 86137 - protein, 10 aa, Artificial Sequence
  Description of Artificial Sequence: Synthetic peptide
  Seed: SVLQIPVSAA (MAGC1_HUMAN)
SMLQIPVSAV

SEQ ID NO: 86138 - protein, 10 aa, Artificial Sequence
  Description of Artificial Sequence: Synthetic peptide
  Seed: MLKNTVPITF (MAGC1_HUMAN)
MQKNTVPITY

SEQ ID NO: 86139 - protein, 10 aa, Artificial Sequence
  Description of Artificial Sequence: Synthetic peptide
  Seed: SLIESEPLFT (MAGC1_HUMAN)
SLIESEPLFL

SEQ ID NO: 86140 - protein, 11 aa, Artificial Sequence
  Description of Artificial Sequence: Synthetic peptide
  Seed: REVDPDDSYVF (MAGC1_HUMAN)
REVDPDDSYVV

SEQ ID NO: 86141 - protein, 8 aa, Artificial Sequence
  Description of Artificial Sequence: Synthetic peptide
  Seed: FAQSSLQI (MAGC1_HUMAN)
FAQSSLQL

SEQ ID NO: 86142 - protein, 10 aa, Artificial Sequence
  Description of Artificial Sequence: Synthetic peptide
  Seed: FPQSVLQIPV (MAGC1_HUMAN)
FDQSVLQIPV

SEQ ID NO: 86143 - protein, 9 aa, Artificial Sequence
  Description of Artificial Sequence: Synthetic peptide
  Seed: SQNRLLILI (MAGC1_HUMAN)
SQNRLLILF

SEQ ID NO: 86144 - protein, 10 aa, Artificial Sequence
  Description of Artificial Sequence: Synthetic peptide
  Seed: VSPSFSSTLV (MAGC1_HUMAN)
VLPSFSSTLV

SEQ ID NO: 86145 - protein, 10 aa, Artificial Sequence
  Description of Artificial Sequence: Synthetic peptide
  Seed: ICSSSTPSSL (MAGC1_HUMAN)
ILSSSTPSSF

SEQ ID NO: 86146 - protein, 10 aa, Artificial Sequence
  Description of Artificial Sequence: Synthetic peptide
  Seed: RSFSSTLLSI (MAGC1_HUMAN)
RVFSSTLLSV

SEQ ID NO: 86147 - protein, 10 aa, Artificial Sequence
  Description of Artificial Sequence: Synthetic peptide
  Seed: SPLYFPQSPL (MAGC1_HUMAN)
SFLYFPQSPL

SEQ ID NO: 86148 - protein, 11 aa, Artificial Sequence
  Description of Artificial Sequence: Synthetic peptide
  Seed: KVWVQEHYLEY (MAGC1_HUMAN)
KQWVQEHYLEF

SEQ ID NO: 86149 - protein, 9 aa, Artificial Sequence
  Description of Artificial Sequence: Synthetic peptide
  Seed: RTQSTFEGF (MAGC1_HUMAN)
RMQSTFEGW

SEQ ID NO: 86150 - protein, 11 aa, Artificial Sequence
  Description of Artificial Sequence: Synthetic peptide
  Seed: STFEGFPQSLL (MAGC1_HUMAN)
SLFEGFPQSLG

SEQ ID NO: 86151 - protein, 9 aa, Artificial Sequence
  Description of Artificial Sequence: Synthetic peptide
  Seed: TTDDSTATE (MAGC1_HUMAN)
TDDDSTATM

SEQ ID NO: 86152 - protein, 10 aa, Artificial Sequence
  Description of Artificial Sequence: Synthetic peptide
  Seed: WDVLSGIGVR (MAGC1_HUMAN)
WAVLSGIGVR

SEQ ID NO: 86153 - protein, 11 aa, Artificial Sequence
  Description of Artificial Sequence: Synthetic peptide
  Seed: MSPLYFPQSPL (MAGC1_HUMAN)
MPPLYFPQSPI

SEQ ID NO: 86154 - protein, 9 aa, Artificial Sequence
  Description of Artificial Sequence: Synthetic peptide
  Seed: SSSTLLSLF (MAGC1_HUMAN)
SYSTLLSLY

SEQ ID NO: 86155 - protein, 9 aa, Artificial Sequence
  Description of Artificial Sequence: Synthetic peptide
  Seed: AQSSLQIPV (MAGC1_HUMAN)
AISSLQIPL

SEQ ID NO: 86156 - protein, 9 aa, Artificial Sequence
  Description of Artificial Sequence: Synthetic peptide
  Seed: YTGYFPVIF (MAGC1_HUMAN)
YVGYFPVIY

SEQ ID NO: 86157 - protein, 9 aa, Artificial Sequence
  Description of Artificial Sequence: Synthetic peptide
  Seed: YPLQSPQSR (MAGC1_HUMAN)
YMLQSPQSR

SEQ ID NO: 86158 - protein, 10 aa, Artificial Sequence
  Description of Artificial Sequence: Synthetic peptide
  Seed: SSSSTLLSLF (MAGC1_HUMAN)
SGSSTLLSLF

SEQ ID NO: 86159 - protein, 9 aa, Artificial Sequence
  Description of Artificial Sequence: Synthetic peptide
  Seed: EFIEILFGI (MAGC1_HUMAN)
EIIEILFGI

SEQ ID NO: 86160 - protein, 10 aa, Artificial Sequence
  Description of Artificial Sequence: Synthetic peptide
  Seed: TGYFPVIFRK (MAGC1_HUMAN)
TTYFPVIFRK

SEQ ID NO: 86161 - protein, 9 aa, Artificial Sequence
  Description of Artificial Sequence: Synthetic peptide
  Seed: FSYTLASLL (MAGC1_HUMAN)
FMYTLASLL

SEQ ID NO: 86162 - protein, 10 aa, Artificial Sequence
  Description of Artificial Sequence: Synthetic peptide
  Seed: SSPESAQSAF (MAGC1_HUMAN)
SLPESAQSAL

SEQ ID NO: 86163 - protein, 11 aa, Artificial Sequence
  Description of Artificial Sequence: Synthetic peptide
  Seed: STFEGFPQSPL (MAGC1_HUMAN)
SPFEGFPQSPY

SEQ ID NO: 86164 - protein, 10 aa, Artificial Sequence
  Description of Artificial Sequence: Synthetic peptide
  Seed: YTLDEKVDEL (MAGC1_HUMAN)
YMLDEKVDEL

SEQ ID NO: 86165 - protein, 9 aa, Artificial Sequence
  Description of Artificial Sequence: Synthetic peptide
  Seed: GSPSFSSTL (MAGC1_HUMAN)
GQPSFSSTF

SEQ ID NO: 86166 - protein, 10 aa, Artificial Sequence
  Description of Artificial Sequence: Synthetic peptide
  Seed: ASSFFSSALL (MAGC1_HUMAN)
ARSFFSSALW

SEQ ID NO: 86167 - protein, 10 aa, Artificial Sequence
  Description of Artificial Sequence: Synthetic peptide
  Seed: SPLQSPESAP (MAGC1_HUMAN)
SPLQSPESAV

SEQ ID NO: 86168 - protein, 10 aa, Artificial Sequence
  Description of Artificial Sequence: Synthetic peptide
  Seed: VSAASSSTLV (MAGC1_HUMAN)
VVAASSSTLV

SEQ ID NO: 86169 - protein, 10 aa, Artificial Sequence
  Description of Artificial Sequence: Synthetic peptide
  Seed: SPLQIPQSPP (MAGC1_HUMAN)
SPLQIPQSPF

SEQ ID NO: 86170 - protein, 9 aa, Artificial Sequence
  Description of Artificial Sequence: Synthetic peptide
  Seed: FSSTLLSLF (MAGC1_HUMAN)
FYSTLLSLW

SEQ ID NO: 86171 - protein, 10 aa, Artificial Sequence
  Description of Artificial Sequence: Synthetic peptide
  Seed: GEDSQSPLQI (MAGC1_HUMAN)
GEDSQSPLQL

SEQ ID NO: 86172 - protein, 10 aa, Artificial Sequence
  Description of Artificial Sequence: Synthetic peptide
  Seed: FPQSVLQIPV (MAGC1_HUMAN)
FIQSVLQIPA

SEQ ID NO: 86173 - protein, 10 aa, Artificial Sequence
  Description of Artificial Sequence: Synthetic peptide
  Seed: YASEEVIWDV (MAGC1_HUMAN)
YISEEVIWDV

SEQ ID NO: 86174 - protein, 9 aa, Artificial Sequence
  Description of Artificial Sequence: Synthetic peptide
  Seed: KVWVQEHYL (MAGC1_HUMAN)
KTWVQEHYF

SEQ ID NO: 86175 - protein, 10 aa, Artificial Sequence
  Description of Artificial Sequence: Synthetic peptide
  Seed: SRYTGYFPVI (MAGC1_HUMAN)
SEYTGYFPVI

SEQ ID NO: 86176 - protein, 11 aa, Artificial Sequence
  Description of Artificial Sequence: Synthetic peptide
  Seed: VSSSSSSSTLL (MAGC1_HUMAN)
VDSSSSSSTLF

SEQ ID NO: 86177 - protein, 9 aa, Artificial Sequence
  Description of Artificial Sequence: Synthetic peptide
  Seed: FPQFPPQGE (MAGC1_HUMAN)
FPQFPPQGA

SEQ ID NO: 86178 - protein, 11 aa, Artificial Sequence
  Description of Artificial Sequence: Synthetic peptide
  Seed: SICSSSTSLSL (MAGC1_HUMAN)
SMCSSSTSLSW

SEQ ID NO: 86179 - protein, 9 aa, Artificial Sequence
  Description of Artificial Sequence: Synthetic peptide
  Seed: IPMTSSFSS (MAGC1_HUMAN)
IPMTSSFSM

SEQ ID NO: 86180 - protein, 10 aa, Artificial Sequence
  Description of Artificial Sequence: Synthetic peptide
  Seed: SQSSPVSSFP (MAGC1_HUMAN)
SLSSPVSSFF

SEQ ID NO: 86181 - protein, 9 aa, Artificial Sequence
  Description of Artificial Sequence: Synthetic peptide
  Seed: TFEGFPQSL (MAGC1_HUMAN)
TGEGFPQSL

SEQ ID NO: 86182 - protein, 9 aa, Artificial Sequence
  Description of Artificial Sequence: Synthetic peptide
  Seed: SSPESAQSA (MAGC1_HUMAN)
SIPESAQSI

SEQ ID NO: 86183 - protein, 9 aa, Artificial Sequence
  Description of Artificial Sequence: Synthetic peptide
  Seed: MTSSFSSTL (MAGC1_HUMAN)
MASSFSSTA

SEQ ID NO: 86184 - protein, 10 aa, Artificial Sequence
  Description of Artificial Sequence: Synthetic peptide
  Seed: YTLDEKVDEL (MAGC1_HUMAN)
YLLDEKVDEV

SEQ ID NO: 86185 - protein, 9 aa, Artificial Sequence
  Description of Artificial Sequence: Synthetic peptide
  Seed: RPVSSFFSY (MAGC1_HUMAN)
RQVSSFFSY

SEQ ID NO: 86186 - protein, 10 aa, Artificial Sequence
  Description of Artificial Sequence: Synthetic peptide
  Seed: MLTNVISRYT (MAGC1_HUMAN)
MMTNVISRYL

SEQ ID NO: 86187 - protein, 9 aa, Artificial Sequence
  Description of Artificial Sequence: Synthetic peptide
  Seed: SSPERTQST (MAGC1_HUMAN)
SSPERTQSV

SEQ ID NO: 86188 - protein, 9 aa, Artificial Sequence
  Description of Artificial Sequence: Synthetic peptide
  Seed: FAFGEPREL (MAGC1_HUMAN)
FLFGEPREL

SEQ ID NO: 86189 - protein, 8 aa, Artificial Sequence
  Description of Artificial Sequence: Synthetic peptide
  Seed: VEERAQAI (MAGC1_HUMAN)
VEERAQAL

SEQ ID NO: 86190 - protein, 10 aa, Artificial Sequence
  Description of Artificial Sequence: Synthetic peptide
  Seed: RSFSSTLLSI (MAGC1_HUMAN)
RIFSSTLLSM

SEQ ID NO: 86191 - protein, 9 aa, Artificial Sequence
  Description of Artificial Sequence: Synthetic peptide
  Seed: SSPESAQSA (MAGC1_HUMAN)
STPESAQSM

SEQ ID NO: 86192 - protein, 9 aa, Artificial Sequence
  Description of Artificial Sequence: Synthetic peptide
  Seed: SSPERTHST (MAGC1_HUMAN)
SVPERTHSI

SEQ ID NO: 86193 - protein, 9 aa, Artificial Sequence
  Description of Artificial Sequence: Synthetic peptide
  Seed: SSPESPLQS (MAGC1_HUMAN)
SCPESPLQV

SEQ ID NO: 86194 - protein, 10 aa, Artificial Sequence
  Description of Artificial Sequence: Synthetic peptide
  Seed: TGYFPVIFRK (MAGC1_HUMAN)
TTYFPVIFRF

SEQ ID NO: 86195 - protein, 9 aa, Artificial Sequence
  Description of Artificial Sequence: Synthetic peptide
  Seed: SFPSSTSSS (MAGC1_HUMAN)
SFPSSTSSV

SEQ ID NO: 86196 - protein, 11 aa, Artificial Sequence
  Description of Artificial Sequence: Synthetic peptide
  Seed: SSFFSYTLASL (MAGC1_HUMAN)
STFFSYTLASW

SEQ ID NO: 86197 - protein, 10 aa, Artificial Sequence
  Description of Artificial Sequence: Synthetic peptide
  Seed: SRYTGYFPVI (MAGC1_HUMAN)
STYTGYFPVI

SEQ ID NO: 86198 - protein, 10 aa, Artificial Sequence
  Description of Artificial Sequence: Synthetic peptide
  Seed: RFLLLKYQVK (MAGC1_HUMAN)
RYLLLKYQVK

SEQ ID NO: 86199 - protein, 11 aa, Artificial Sequence
  Description of Artificial Sequence: Synthetic peptide
  Seed: AIIDTTDDSTA (MAGC1_HUMAN)
AMIDTTDDSTM

SEQ ID NO: 86200 - protein, 9 aa, Artificial Sequence
  Description of Artificial Sequence: Synthetic peptide
  Seed: RPVSSFFSY (MAGC1_HUMAN)
RQVSSFFST

SEQ ID NO: 86201 - protein, 10 aa, Artificial Sequence
  Description of Artificial Sequence: Synthetic peptide
  Seed: FPQSVLQIPV (MAGC1_HUMAN)
FPQSVLQIPS

SEQ ID NO: 86202 - protein, 10 aa, Artificial Sequence
  Description of Artificial Sequence: Synthetic peptide
  Seed: LQNPASSFFS (MAGC1_HUMAN)
LQNPASSFFW

SEQ ID NO: 86203 - protein, 9 aa, Artificial Sequence
  Description of Artificial Sequence: Synthetic peptide
  Seed: LQNPASSFF (MAGC1_HUMAN)
LLNPASSFM

SEQ ID NO: 86204 - protein, 10 aa, Artificial Sequence
  Description of Artificial Sequence: Synthetic peptide
  Seed: KVVEFLAMLK (MAGC1_HUMAN)
KIVEFLAMLL

SEQ ID NO: 86205 - protein, 10 aa, Artificial Sequence
  Description of Artificial Sequence: Synthetic peptide
  Seed: MPTAGMPSLL (MAGC1_HUMAN)
MLTAGMPSLI

SEQ ID NO: 86206 - protein, 9 aa, Artificial Sequence
  Description of Artificial Sequence: Synthetic peptide
  Seed: SSSSSSSTL (MAGC1_HUMAN)
SSSSSSSTI

SEQ ID NO: 86207 - protein, 9 aa, Artificial Sequence
  Description of Artificial Sequence: Synthetic peptide
  Seed: FSSTLLSIL (MAGC1_HUMAN)
FGSTLLSIF

SEQ ID NO: 86208 - protein, 9 aa, Artificial Sequence
  Description of Artificial Sequence: Synthetic peptide
  Seed: MSQNRLLIL (MAGC1_HUMAN)
MPQNRLLIV

SEQ ID NO: 86209 - protein, 9 aa, Artificial Sequence
  Description of Artificial Sequence: Synthetic peptide
  Seed: SFSYTLLSL (MAGC1_HUMAN)
SYSYTLLSI

SEQ ID NO: 86210 - protein, 9 aa, Artificial Sequence
  Description of Artificial Sequence: Synthetic peptide
  Seed: SSFPSSTSS (MAGC1_HUMAN)
SSFPSSTSY

SEQ ID NO: 86211 - protein, 9 aa, Artificial Sequence
  Description of Artificial Sequence: Synthetic peptide
  Seed: STQSPFEGF (MAGC1_HUMAN)
SSQSPFEGR

SEQ ID NO: 86212 - protein, 9 aa, Artificial Sequence
  Description of Artificial Sequence: Synthetic peptide
  Seed: FAFGEPREL (MAGC1_HUMAN)
FLFGEPRET

SEQ ID NO: 86213 - protein, 11 aa, Artificial Sequence
  Description of Artificial Sequence: Synthetic peptide
  Seed: SPLQRPVSSFF (MAGC1_HUMAN)
SSLQRPVSSFF

SEQ ID NO: 86214 - protein, 10 aa, Artificial Sequence
  Description of Artificial Sequence: Synthetic peptide
  Seed: VISFSSSTSL (MAGC1_HUMAN)
VISFSSSTSF

SEQ ID NO: 86215 - protein, 9 aa, Artificial Sequence
  Description of Artificial Sequence: Synthetic peptide
  Seed: SFSERTQST (MAGC1_HUMAN)
SFSERTQSL

SEQ ID NO: 86216 - protein, 9 aa, Artificial Sequence
  Description of Artificial Sequence: Synthetic peptide
  Seed: EILFGISLR (MAGC1_HUMAN)
EVLFGISLK

SEQ ID NO: 86217 - protein, 10 aa, Artificial Sequence
  Description of Artificial Sequence: Synthetic peptide
  Seed: MPTAGMPSLL (MAGC1_HUMAN)
MSTAGMPSLM

SEQ ID NO: 86218 - protein, 10 aa, Artificial Sequence
  Description of Artificial Sequence: Synthetic peptide
  Seed: STSLSLPQSF (MAGC1_HUMAN)
SMSLSLPQSY

SEQ ID NO: 86219 - protein, 9 aa, Artificial Sequence
  Description of Artificial Sequence: Synthetic peptide
  Seed: QSPQGEDSL (MAGC1_HUMAN)
QAPQGEDSL

SEQ ID NO: 86220 - protein, 8 aa, Artificial Sequence
  Description of Artificial Sequence: Synthetic peptide
  Seed: SSPPRYEF (MAGC1_HUMAN)
SAPPRYEY

SEQ ID NO: 86221 - protein, 11 aa, Artificial Sequence
  Description of Artificial Sequence: Synthetic peptide
  Seed: FLAMLKNTVPI (MAGC1_HUMAN)
FCAMLKNTVPA

SEQ ID NO: 86222 - protein, 10 aa, Artificial Sequence
  Description of Artificial Sequence: Synthetic peptide
  Seed: FSSSTSLSPF (MAGC1_HUMAN)
FPSSTSLSPY

SEQ ID NO: 86223 - protein, 9 aa, Artificial Sequence
  Description of Artificial Sequence: Synthetic peptide
  Seed: VSPSSSSTL (MAGC1_HUMAN)
VSPSSSSTV

SEQ ID NO: 86224 - protein, 9 aa, Artificial Sequence
  Description of Artificial Sequence: Synthetic peptide
  Seed: SPLQIVPSL (MAGC1_HUMAN)
SMLQIVPST

SEQ ID NO: 86225 - protein, 10 aa, Artificial Sequence
  Description of Artificial Sequence: Synthetic peptide
  Seed: YTGYFPVIFR (MAGC1_HUMAN)
YLGYFPVIFK

SEQ ID NO: 86226 - protein, 11 aa, Artificial Sequence
  Description of Artificial Sequence: Synthetic peptide
  Seed: LQIPVSSSFSY (MAGC1_HUMAN)
LYIPVSSSFSM

SEQ ID NO: 86227 - protein, 11 aa, Artificial Sequence
  Description of Artificial Sequence: Synthetic peptide
  Seed: AASSSTLVSIF (MAGC1_HUMAN)
ATSSSTLVSIW

SEQ ID NO: 86228 - protein, 9 aa, Artificial Sequence
  Description of Artificial Sequence: Synthetic peptide
  Seed: CSSSTSLSL (MAGC1_HUMAN)
CKSSTSLSF

SEQ ID NO: 86229 - protein, 9 aa, Artificial Sequence
  Description of Artificial Sequence: Synthetic peptide
  Seed: SFPSSTSSS (MAGC1_HUMAN)
SMPSSTSSL

SEQ ID NO: 86230 - protein, 11 aa, Artificial Sequence
  Description of Artificial Sequence: Synthetic peptide
  Seed: ILFGISLREVD (MAGC1_HUMAN)
ILFGISLREVA

SEQ ID NO: 86231 - protein, 11 aa, Artificial Sequence
  Description of Artificial Sequence: Synthetic peptide
  Seed: LQIPVSSSFSY (MAGC1_HUMAN)
LDIPVSSSFSM

SEQ ID NO: 86232 - protein, 9 aa, Artificial Sequence
  Description of Artificial Sequence: Synthetic peptide
  Seed: ISFSSSTSL (MAGC1_HUMAN)
IHFSSSTSF

SEQ ID NO: 86233 - protein, 9 aa, Artificial Sequence
  Description of Artificial Sequence: Synthetic peptide
  Seed: RPVSSFFSY (MAGC1_HUMAN)
RLVSSFFSY

SEQ ID NO: 86234 - protein, 9 aa, Artificial Sequence
  Description of Artificial Sequence: Synthetic peptide
  Seed: VSRSFSSTL (MAGC1_HUMAN)
VARSFSSTI

SEQ ID NO: 86235 - protein, 9 aa, Artificial Sequence
  Description of Artificial Sequence: Synthetic peptide
  Seed: LQIPVSSSS (MAGC1_HUMAN)
LHIPVSSSL

SEQ ID NO: 86236 - protein, 10 aa, Artificial Sequence
  Description of Artificial Sequence: Synthetic peptide
  Seed: VSSSSSSSTL (MAGC1_HUMAN)
VGSSSSSSTF

SEQ ID NO: 86237 - protein, 9 aa, Artificial Sequence
  Description of Artificial Sequence: Synthetic peptide
  Seed: YQVKQPITK (MAGC1_HUMAN)
YWVKQPITM

SEQ ID NO: 86238 - protein, 9 aa, Artificial Sequence
  Description of Artificial Sequence: Synthetic peptide
  Seed: TLASLLQSS (MAGC1_HUMAN)
TMASLLQSV

SEQ ID NO: 86239 - protein, 11 aa, Artificial Sequence
  Description of Artificial Sequence: Synthetic peptide
  Seed: SICSSSTPSSL (MAGC1_HUMAN)
SICSSSTPSSY

SEQ ID NO: 86240 - protein, 9 aa, Artificial Sequence
  Description of Artificial Sequence: Synthetic peptide
  Seed: LKYQVKQPI (MAGC1_HUMAN)
LRYQVKQPF

SEQ ID NO: 86241 - protein, 9 aa, Artificial Sequence
  Description of Artificial Sequence: Synthetic peptide
  Seed: SPLQNPASS (MAGC1_HUMAN)
SALQNPASL

SEQ ID NO: 86242 - protein, 10 aa, Artificial Sequence
  Description of Artificial Sequence: Synthetic peptide
  Seed: SFPSSTSSSL (MAGC1_HUMAN)
SYPSSTSSSW

SEQ ID NO: 86243 - protein, 10 aa, Artificial Sequence
  Description of Artificial Sequence: Synthetic peptide
  Seed: LQIPVSPSFS (MAGC1_HUMAN)
LQIPVSPSFE

SEQ ID NO: 86244 - protein, 10 aa, Artificial Sequence
  Description of Artificial Sequence: Synthetic peptide
  Seed: KRKVVEFLAM (MAGC1_HUMAN)
KKKVVEFLAM

SEQ ID NO: 86245 - protein, 9 aa, Artificial Sequence
  Description of Artificial Sequence: Synthetic peptide
  Seed: GDKDMPTAG (MAGC1_HUMAN)
GEKDMPTAL

SEQ ID NO: 86246 - protein, 9 aa, Artificial Sequence
  Description of Artificial Sequence: Synthetic peptide
  Seed: GYFPVIFRK (MAGC1_HUMAN)
GTFPVIFRR

SEQ ID NO: 86247 - protein, 10 aa, Artificial Sequence
  Description of Artificial Sequence: Synthetic peptide
  Seed: FQSSLQSPVS (MAGC1_HUMAN)
FMSSLQSPVC

SEQ ID NO: 86248 - protein, 10 aa, Artificial Sequence
  Description of Artificial Sequence: Synthetic peptide
  Seed: KAREFIEILF (MAGC1_HUMAN)
KTREFIEILY

SEQ ID NO: 86249 - protein, 10 aa, Artificial Sequence
  Description of Artificial Sequence: Synthetic peptide
  Seed: GMSQNRLLIL (MAGC1_HUMAN)
GLSQNRLLIV

SEQ ID NO: 86250 - protein, 9 aa, Artificial Sequence
  Description of Artificial Sequence: Synthetic peptide
  Seed: KVDELARFL (MAGC1_HUMAN)
KMDELARFV

SEQ ID NO: 86251 - protein, 9 aa, Artificial Sequence
  Description of Artificial Sequence: Synthetic peptide
  Seed: SICSSSTSL (MAGC1_HUMAN)
SPCSSSTSV

SEQ ID NO: 86252 - protein, 9 aa, Artificial Sequence
  Description of Artificial Sequence: Synthetic peptide
  Seed: IPVSPSFSS (MAGC1_HUMAN)
IPVSPSFSM

SEQ ID NO: 86253 - protein, 9 aa, Artificial Sequence
  Description of Artificial Sequence: Synthetic peptide
  Seed: LKNTVPITF (MAGC1_HUMAN)
LKNTVPITM

SEQ ID NO: 86254 - protein, 9 aa, Artificial Sequence
  Description of Artificial Sequence: Synthetic peptide
  Seed: LQIPVSPSF (MAGC1_HUMAN)
LWIPVSPSF

SEQ ID NO: 86255 - protein, 9 aa, Artificial Sequence
  Description of Artificial Sequence: Synthetic peptide
  Seed: SPLQSPVSS (MAGC1_HUMAN)
SSLQSPVSW

SEQ ID NO: 86256 - protein, 11 aa, Artificial Sequence
  Description of Artificial Sequence: Synthetic peptide
  Seed: QSSPESTQSPF (MAGC1_HUMAN)
QMSPESTQSPY

SEQ ID NO: 86257 - protein, 11 aa, Artificial Sequence
  Description of Artificial Sequence: Synthetic peptide
  Seed: SLFQSSPERTH (MAGC1_HUMAN)
SVFQSSPERTF

SEQ ID NO: 86258 - protein, 9 aa, Artificial Sequence
  Description of Artificial Sequence: Synthetic peptide
  Seed: LQIPVSSSS (MAGC1_HUMAN)
LHIPVSSSV

SEQ ID NO: 86259 - protein, 9 aa, Artificial Sequence
  Description of Artificial Sequence: Synthetic peptide
  Seed: LQIPGSPSF (MAGC1_HUMAN)
LEIPGSPSF

SEQ ID NO: 86260 - protein, 10 aa, Artificial Sequence
  Description of Artificial Sequence: Synthetic peptide
  Seed: KVVEFLAMLK (MAGC1_HUMAN)
KQVEFLAMLT

SEQ ID NO: 86261 - protein, 10 aa, Artificial Sequence
  Description of Artificial Sequence: Synthetic peptide
  Seed: ICSSSTPSSL (MAGC1_HUMAN)
IWSSSTPSSF

SEQ ID NO: 86262 - protein, 9 aa, Artificial Sequence
  Description of Artificial Sequence: Synthetic peptide
  Seed: FSSTLVSLF (MAGC1_HUMAN)
FQSTLVSLA

SEQ ID NO: 86263 - protein, 9 aa, Artificial Sequence
  Description of Artificial Sequence: Synthetic peptide
  Seed: VLSGIGVRA (MAGC1_HUMAN)
VTSGIGVRV

SEQ ID NO: 86264 - protein, 11 aa, Artificial Sequence
  Description of Artificial Sequence: Synthetic peptide
  Seed: SRYTGYFPVIF (MAGC1_HUMAN)
SYYTGYFPVIW

SEQ ID NO: 86265 - protein, 10 aa, Artificial Sequence
  Description of Artificial Sequence: Synthetic peptide
  Seed: YTLLSLFQSS (MAGC1_HUMAN)
YCLLSLFQSL

SEQ ID NO: 86266 - protein, 9 aa, Artificial Sequence
  Description of Artificial Sequence: Synthetic peptide
  Seed: WVQEHYLEY (MAGC1_HUMAN)
WLQEHYLEF

SEQ ID NO: 86267 - protein, 9 aa, Artificial Sequence
  Description of Artificial Sequence: Synthetic peptide
  Seed: FAFGEPREL (MAGC1_HUMAN)
FFFGEPREM

SEQ ID NO: 86268 - protein, 10 aa, Artificial Sequence
  Description of Artificial Sequence: Synthetic peptide
  Seed: FAQSSLQIPV (MAGC1_HUMAN)
FPQSSLQIPV

SEQ ID NO: 86269 - protein, 10 aa, Artificial Sequence
  Description of Artificial Sequence: Synthetic peptide
  Seed: SFSYTLLSLF (MAGC1_HUMAN)
SHSYTLLSLW

SEQ ID NO: 86270 - protein, 9 aa, Artificial Sequence
  Description of Artificial Sequence: Synthetic peptide
  Seed: FSSTLVSLF (MAGC1_HUMAN)
FMSTLVSLI

SEQ ID NO: 86271 - protein, 9 aa, Artificial Sequence
  Description of Artificial Sequence: Synthetic peptide
  Seed: SPLQSPVSS (MAGC1_HUMAN)
SALQSPVSL

SEQ ID NO: 86272 - protein, 9 aa, Artificial Sequence
  Description of Artificial Sequence: Synthetic peptide
  Seed: HFPQSPPEW (MAGC1_HUMAN)
HAPQSPPEI

SEQ ID NO: 86273 - protein, 10 aa, Artificial Sequence
  Description of Artificial Sequence: Synthetic peptide
  Seed: FPQSPLQIPV (MAGC1_HUMAN)
FQQSPLQIPL

SEQ ID NO: 86274 - protein, 11 aa, Artificial Sequence
  Description of Artificial Sequence: Synthetic peptide
  Seed: IIDTTDDSTAT (MAGC1_HUMAN)
ICDTTDDSTAL

SEQ ID NO: 86275 - protein, 9 aa, Artificial Sequence
  Description of Artificial Sequence: Synthetic peptide
  Seed: RTQSTFEGF (MAGC1_HUMAN)
RMQSTFEGL

SEQ ID NO: 86276 - protein, 10 aa, Artificial Sequence
  Description of Artificial Sequence: Synthetic peptide
  Seed: LQIPVSPSFS (MAGC1_HUMAN)
LVIPVSPSFF

SEQ ID NO: 86277 - protein, 9 aa, Artificial Sequence
  Description of Artificial Sequence: Synthetic peptide
  Seed: FSSALLSIF (MAGC1_HUMAN)
FTSALLSIW

SEQ ID NO: 86278 - protein, 9 aa, Artificial Sequence
  Description of Artificial Sequence: Synthetic peptide
  Seed: TLLSLFQSF (MAGC1_HUMAN)
TSLSLFQSY

SEQ ID NO: 86279 - protein, 10 aa, Artificial Sequence
  Description of Artificial Sequence: Synthetic peptide
  Seed: YVFVNTLDLT (MAGC1_HUMAN)
YMFVNTLDLV

SEQ ID NO: 86280 - protein, 9 aa, Artificial Sequence
  Description of Artificial Sequence: Synthetic peptide
  Seed: VPITFPSSY (MAGC1_HUMAN)
VRITFPSSF

SEQ ID NO: 86281 - protein, 9 aa, Artificial Sequence
  Description of Artificial Sequence: Synthetic peptide
  Seed: FSEESSSPV (MAGC1_HUMAN)
FSEESSSPM

SEQ ID NO: 86282 - protein, 9 aa, Artificial Sequence
  Description of Artificial Sequence: Synthetic peptide
  Seed: SSPERTQST (MAGC1_HUMAN)
SIPERTQSI

SEQ ID NO: 86283 - protein, 10 aa, Artificial Sequence
  Description of Artificial Sequence: Synthetic peptide
  Seed: RAGREHFAFG (MAGC1_HUMAN)
RVGREHFAFG

SEQ ID NO: 86284 - protein, 9 aa, Artificial Sequence
  Description of Artificial Sequence: Synthetic peptide
  Seed: RPVSSFFSY (MAGC1_HUMAN)
RFVSSFFSM

SEQ ID NO: 86285 - protein, 11 aa, Artificial Sequence
  Description of Artificial Sequence: Synthetic peptide
  Seed: LWGPRAHSEVI (MAGC1_HUMAN)
LVGPRAHSEVL

SEQ ID NO: 86286 - protein, 9 aa, Artificial Sequence
  Description of Artificial Sequence: Synthetic peptide
  Seed: LQIPMTSSF (MAGC1_HUMAN)
LYIPMTSSV

SEQ ID NO: 86287 - protein, 11 aa, Artificial Sequence
  Description of Artificial Sequence: Synthetic peptide
  Seed: EGEDSSDPLQR (MAGC1_HUMAN)
EIEDSSDPLQY

SEQ ID NO: 86288 - protein, 10 aa, Artificial Sequence
  Description of Artificial Sequence: Synthetic peptide
  Seed: ASSFFSSALL (MAGC1_HUMAN)
AMSFFSSALM

SEQ ID NO: 86289 - protein, 10 aa, Artificial Sequence
  Description of Artificial Sequence: Synthetic peptide
  Seed: VSSSSSSTLL (MAGC1_HUMAN)
VFSSSSSTLF

SEQ ID NO: 86290 - protein, 9 aa, Artificial Sequence
  Description of Artificial Sequence: Synthetic peptide
  Seed: ASSFFSSAL (MAGC1_HUMAN)
AMSFFSSAA

SEQ ID NO: 86291 - protein, 9 aa, Artificial Sequence
  Description of Artificial Sequence: Synthetic peptide
  Seed: KVDELARFL (MAGC1_HUMAN)
KTDELARFF

SEQ ID NO: 86292 - protein, 9 aa, Artificial Sequence
  Description of Artificial Sequence: Synthetic peptide
  Seed: LILSIIFIK (MAGC1_HUMAN)
LALSIIFIR

SEQ ID NO: 86293 - protein, 8 aa, Artificial Sequence
  Description of Artificial Sequence: Synthetic peptide
  Seed: SSPPRYEF (MAGC1_HUMAN)
SVPPRYEL

SEQ ID NO: 86294 - protein, 9 aa, Artificial Sequence
  Description of Artificial Sequence: Synthetic peptide
  Seed: SFPSSTSSS (MAGC1_HUMAN)
SLPSSTSSM

SEQ ID NO: 86295 - protein, 9 aa, Artificial Sequence
  Description of Artificial Sequence: Synthetic peptide
  Seed: SSPPRYEFL (MAGC1_HUMAN)
SMPPRYEFI

SEQ ID NO: 86296 - protein, 11 aa, Artificial Sequence
  Description of Artificial Sequence: Synthetic peptide
  Seed: SSSSSSTLLSL (MAGC1_HUMAN)
SDSSSSTLLSF

SEQ ID NO: 86297 - protein, 11 aa, Artificial Sequence
  Description of Artificial Sequence: Synthetic peptide
  Seed: SPHYFPQSPQG (MAGC1_HUMAN)
SPHYFPQSPQA

SEQ ID NO: 86298 - protein, 9 aa, Artificial Sequence
  Description of Artificial Sequence: Synthetic peptide
  Seed: TTDDSTATE (MAGC1_HUMAN)
TCDDSTATM

SEQ ID NO: 86299 - protein, 10 aa, Artificial Sequence
  Description of Artificial Sequence: Synthetic peptide
  Seed: PLQIPVSSSF (MAGC1_HUMAN)
PCQIPVSSSF

SEQ ID NO: 86300 - protein, 9 aa, Artificial Sequence
  Description of Artificial Sequence: Synthetic peptide
  Seed: VSPSSSSTL (MAGC1_HUMAN)
VRPSSSSTM

SEQ ID NO: 86301 - protein, 10 aa, Artificial Sequence
  Description of Artificial Sequence: Synthetic peptide
  Seed: MPTAGMPSLL (MAGC1_HUMAN)
MTTAGMPSLI

SEQ ID NO: 86302 - protein, 9 aa, Artificial Sequence
  Description of Artificial Sequence: Synthetic peptide
  Seed: YREVPNSSP (MAGC1_HUMAN)
YHEVPNSSA

SEQ ID NO: 86303 - protein, 10 aa, Artificial Sequence
  Description of Artificial Sequence: Synthetic peptide
  Seed: RKVVEFLAML (MAGC1_HUMAN)
RDVVEFLAMA

SEQ ID NO: 86304 - protein, 10 aa, Artificial Sequence
  Description of Artificial Sequence: Synthetic peptide
  Seed: QGEDSMSPLY (MAGC1_HUMAN)
QDEDSMSPLW

SEQ ID NO: 86305 - protein, 9 aa, Artificial Sequence
  Description of Artificial Sequence: Synthetic peptide
  Seed: SPESAQSTF (MAGC1_HUMAN)
SQESAQSTF

SEQ ID NO: 86306 - protein, 9 aa, Artificial Sequence
  Description of Artificial Sequence: Synthetic peptide
  Seed: SSFFSSALL (MAGC1_HUMAN)
SIFFSSALF

SEQ ID NO: 86307 - protein, 9 aa, Artificial Sequence
  Description of Artificial Sequence: Synthetic peptide
  Seed: SPVSSFPSS (MAGC1_HUMAN)
SPVSSFPST

SEQ ID NO: 86308 - protein, 9 aa, Artificial Sequence
  Description of Artificial Sequence: Synthetic peptide
  Seed: SSPESPLQS (MAGC1_HUMAN)
SSPESPLQM

SEQ ID NO: 86309 - protein, 9 aa, Artificial Sequence
  Description of Artificial Sequence: Synthetic peptide
  Seed: SSPPRYEFL (MAGC1_HUMAN)
SRPPRYEFL

SEQ ID NO: 86310 - protein, 11 aa, Artificial Sequence
  Description of Artificial Sequence: Synthetic peptide
  Seed: LQIPMTSSFSS (MAGC1_HUMAN)
LKIPMTSSFSY

SEQ ID NO: 86311 - protein, 9 aa, Artificial Sequence
  Description of Artificial Sequence: Synthetic peptide
  Seed: RAGREHFAF (MAGC1_HUMAN)
RRGREHFAF

SEQ ID NO: 86312 - protein, 9 aa, Artificial Sequence
  Description of Artificial Sequence: Synthetic peptide
  Seed: NVISRYTGY (MAGC1_HUMAN)
NVISRYTGR

SEQ ID NO: 86313 - protein, 10 aa, Artificial Sequence
  Description of Artificial Sequence: Synthetic peptide
  Seed: PLQIPGSPSF (MAGC1_HUMAN)
PGQIPGSPSF

SEQ ID NO: 86314 - protein, 10 aa, Artificial Sequence
  Description of Artificial Sequence: Synthetic peptide
  Seed: ICSSSTSLSL (MAGC1_HUMAN)
IPSSSTSLSY

SEQ ID NO: 86315 - protein, 8 aa, Artificial Sequence
  Description of Artificial Sequence: Synthetic peptide
  Seed: DSLSPLEI (MAGC1_HUMAN)
DALSPLEI

SEQ ID NO: 86316 - protein, 11 aa, Artificial Sequence
  Description of Artificial Sequence: Synthetic peptide
  Seed: GEEFQSSLQSP (MAGC1_HUMAN)
GEEFQSSLQSA

SEQ ID NO: 86317 - protein, 9 aa, Artificial Sequence
  Description of Artificial Sequence: Synthetic peptide
  Seed: LQIPVSAAS (MAGC1_HUMAN)
LKIPVSAAF

SEQ ID NO: 86318 - protein, 10 aa, Artificial Sequence
  Description of Artificial Sequence: Synthetic peptide
  Seed: VSSSSSSTLL (MAGC1_HUMAN)
VSSSSSSTLF

SEQ ID NO: 86319 - protein, 10 aa, Artificial Sequence
  Description of Artificial Sequence: Synthetic peptide
  Seed: NTVPITFPSS (MAGC1_HUMAN)
NSVPITFPSI

SEQ ID NO: 86320 - protein, 9 aa, Artificial Sequence
  Description of Artificial Sequence: Synthetic peptide
  Seed: LARFLLLKY (MAGC1_HUMAN)
LQRFLLLKF

SEQ ID NO: 86321 - protein, 10 aa, Artificial Sequence
  Description of Artificial Sequence: Synthetic peptide
  Seed: LSQSSPVSSF (MAGC1_HUMAN)
LSQSSPVSSW

SEQ ID NO: 86322 - protein, 9 aa, Artificial Sequence
  Description of Artificial Sequence: Synthetic peptide
  Seed: FSSALLSIF (MAGC1_HUMAN)
FHSALLSIM

SEQ ID NO: 86323 - protein, 11 aa, Artificial Sequence
  Description of Artificial Sequence: Synthetic peptide
  Seed: RPVSSFFSYTL (MAGC1_HUMAN)
RHVSSFFSYTF

SEQ ID NO: 86324 - protein, 10 aa, Artificial Sequence
  Description of Artificial Sequence: Synthetic peptide
  Seed: HSPQSPPEGM (MAGC1_HUMAN)
HLPQSPPEGY

SEQ ID NO: 86325 - protein, 9 aa, Artificial Sequence
  Description of Artificial Sequence: Synthetic peptide
  Seed: IPVSSSFSY (MAGC1_HUMAN)
IMVSSSFSL

SEQ ID NO: 86326 - protein, 9 aa, Artificial Sequence
  Description of Artificial Sequence: Synthetic peptide
  Seed: RAHSEVIKR (MAGC1_HUMAN)
RYHSEVIKY

SEQ ID NO: 86327 - protein, 10 aa, Artificial Sequence
  Description of Artificial Sequence: Synthetic peptide
  Seed: FFSSALLSIF (MAGC1_HUMAN)
FESSALLSIF

SEQ ID NO: 86328 - protein, 11 aa, Artificial Sequence
  Description of Artificial Sequence: Synthetic peptide
  Seed: SICSSSTSLSL (MAGC1_HUMAN)
SACSSSTSLSW

SEQ ID NO: 86329 - protein, 10 aa, Artificial Sequence
  Description of Artificial Sequence: Synthetic peptide
  Seed: SSPESTQSPF (MAGC1_HUMAN)
SNPESTQSPM

SEQ ID NO: 86330 - protein, 9 aa, Artificial Sequence
  Description of Artificial Sequence: Synthetic peptide
  Seed: AEMLTNVIS (MAGC1_HUMAN)
AEMLTNVIL

SEQ ID NO: 86331 - protein, 11 aa, Artificial Sequence
  Description of Artificial Sequence: Synthetic peptide
  Seed: VSSSSSSSTLL (MAGC1_HUMAN)
VMSSSSSSTLF

SEQ ID NO: 86332 - protein, 10 aa, Artificial Sequence
  Description of Artificial Sequence: Synthetic peptide
  Seed: FPQSPLQIPV (MAGC1_HUMAN)
FKQSPLQIPI

SEQ ID NO: 86333 - protein, 11 aa, Artificial Sequence
  Description of Artificial Sequence: Synthetic peptide
  Seed: RSFSSTLLSIF (MAGC1_HUMAN)
RHFSSTLLSIY

SEQ ID NO: 86334 - protein, 9 aa, Artificial Sequence
  Description of Artificial Sequence: Synthetic peptide
  Seed: FFSYTLASL (MAGC1_HUMAN)
FYSYTLASM

SEQ ID NO: 86335 - protein, 9 aa, Artificial Sequence
  Description of Artificial Sequence: Synthetic peptide
  Seed: EHYLEYREV (MAGC1_HUMAN)
EQYLEYREI

SEQ ID NO: 86336 - protein, 9 aa, Artificial Sequence
  Description of Artificial Sequence: Synthetic peptide
  Seed: SSSVMSPSF (MAGC1_HUMAN)
SVSVMSPSW

SEQ ID NO: 86337 - protein, 10 aa, Artificial Sequence
  Description of Artificial Sequence: Synthetic peptide
  Seed: SSFSYTLLSL (MAGC1_HUMAN)
SVFSYTLLSY

SEQ ID NO: 86338 - protein, 9 aa, Artificial Sequence
  Description of Artificial Sequence: Synthetic peptide
  Seed: VSSFFSYTL (MAGC1_HUMAN)
VKSFFSYTF

SEQ ID NO: 86339 - protein, 10 aa, Artificial Sequence
  Description of Artificial Sequence: Synthetic peptide
  Seed: YTLASLLQSS (MAGC1_HUMAN)
YRLASLLQSI

SEQ ID NO: 86340 - protein, 9 aa, Artificial Sequence
  Description of Artificial Sequence: Synthetic peptide
  Seed: FSERTQSTF (MAGC1_HUMAN)
FSERTQSTL

SEQ ID NO: 86341 - protein, 10 aa, Artificial Sequence
  Description of Artificial Sequence: Synthetic peptide
  Seed: WEDSLSPHYF (MAGC1_HUMAN)
WADSLSPHYI

SEQ ID NO: 86342 - protein, 9 aa, Artificial Sequence
  Description of Artificial Sequence: Synthetic peptide
  Seed: EDSSDPLQR (MAGC1_HUMAN)
EYSSDPLQR

SEQ ID NO: 86343 - protein, 10 aa, Artificial Sequence
  Description of Artificial Sequence: Synthetic peptide
  Seed: YVFVNTLDLT (MAGC1_HUMAN)
YMFVNTLDLM

SEQ ID NO: 86344 - protein, 10 aa, Artificial Sequence
  Description of Artificial Sequence: Synthetic peptide
  Seed: SSPECTQSTF (MAGC1_HUMAN)
STPECTQSTW

SEQ ID NO: 86345 - protein, 9 aa, Artificial Sequence
  Description of Artificial Sequence: Synthetic peptide
  Seed: LQIPVSSSS (MAGC1_HUMAN)
LLIPVSSSY

SEQ ID NO: 86346 - protein, 9 aa, Artificial Sequence
  Description of Artificial Sequence: Synthetic peptide
  Seed: FSSTLVSLF (MAGC1_HUMAN)
FWSTLVSLW

SEQ ID NO: 86347 - protein, 10 aa, Artificial Sequence
  Description of Artificial Sequence: Synthetic peptide
  Seed: LAMLKNTVPI (MAGC1_HUMAN)
LPMLKNTVPI

SEQ ID NO: 86348 - protein, 11 aa, Artificial Sequence
  Description of Artificial Sequence: Synthetic peptide
  Seed: IPVSRSFSSTL (MAGC1_HUMAN)
IPVSRSFSSTY

SEQ ID NO: 86349 - protein, 10 aa, Artificial Sequence
  Description of Artificial Sequence: Synthetic peptide
  Seed: EVIWDVLSGI (MAGC1_HUMAN)
EVIWDVLSGR

SEQ ID NO: 86350 - protein, 9 aa, Artificial Sequence
  Description of Artificial Sequence: Synthetic peptide
  Seed: IPVSRSFSS (MAGC1_HUMAN)
IAVSRSFSF

SEQ ID NO: 86351 - protein, 9 aa, Artificial Sequence
  Description of Artificial Sequence: Synthetic peptide
  Seed: IPVSSSFSY (MAGC1_HUMAN)
IPVSSSFSM

SEQ ID NO: 86352 - protein, 9 aa, Artificial Sequence
  Description of Artificial Sequence: Synthetic peptide
  Seed: IPVSSSFSY (MAGC1_HUMAN)
IIVSSSFSF

SEQ ID NO: 86353 - protein, 9 aa, Artificial Sequence
  Description of Artificial Sequence: Synthetic peptide
  Seed: DALKDVEER (MAGC1_HUMAN)
DALKDVEEK

SEQ ID NO: 86354 - protein, 9 aa, Artificial Sequence
  Description of Artificial Sequence: Synthetic peptide
  Seed: AQSSLQIPV (MAGC1_HUMAN)
AHSSLQIPA

SEQ ID NO: 86355 - protein, 8 aa, Artificial Sequence
  Description of Artificial Sequence: Synthetic peptide
  Seed: SSFSYTLL (MAGC1_HUMAN)
SSFSYTLW

SEQ ID NO: 86356 - protein, 9 aa, Artificial Sequence
  Description of Artificial Sequence: Synthetic peptide
  Seed: SQNRLLILI (MAGC1_HUMAN)
SRNRLLILM

SEQ ID NO: 86357 - protein, 9 aa, Artificial Sequence
  Description of Artificial Sequence: Synthetic peptide
  Seed: GFPQSPLQI (MAGC1_HUMAN)
GAPQSPLQF

SEQ ID NO: 86358 - protein, 10 aa, Artificial Sequence
  Description of Artificial Sequence: Synthetic peptide
  Seed: VSICSSSTSL (MAGC1_HUMAN)
VMICSSSTSF

SEQ ID NO: 86359 - protein, 10 aa, Artificial Sequence
  Description of Artificial Sequence: Synthetic peptide
  Seed: YTLDEKVDEL (MAGC1_HUMAN)
YGLDEKVDEV

SEQ ID NO: 86360 - protein, 9 aa, Artificial Sequence
  Description of Artificial Sequence: Synthetic peptide
  Seed: SSSDTLLES (MAGC1_HUMAN)
SLSDTLLEL

SEQ ID NO: 86361 - protein, 9 aa, Artificial Sequence
  Description of Artificial Sequence: Synthetic peptide
  Seed: SPESAQSTF (MAGC1_HUMAN)
SVESAQSTF

SEQ ID NO: 86362 - protein, 10 aa, Artificial Sequence
  Description of Artificial Sequence: Synthetic peptide
  Seed: LSQSSPVSSF (MAGC1_HUMAN)
LCQSSPVSSM

SEQ ID NO: 86363 - protein, 9 aa, Artificial Sequence
  Description of Artificial Sequence: Synthetic peptide
  Seed: RTHSTFEGF (MAGC1_HUMAN)
RIHSTFEGK

SEQ ID NO: 86364 - protein, 9 aa, Artificial Sequence
  Description of Artificial Sequence: Synthetic peptide
  Seed: FPQSLLQIP (MAGC1_HUMAN)
FPQSLLQIL

SEQ ID NO: 86365 - protein, 9 aa, Artificial Sequence
  Description of Artificial Sequence: Synthetic peptide
  Seed: VLSGIGVRA (MAGC1_HUMAN)
VMSGIGVRA

SEQ ID NO: 86366 - protein, 9 aa, Artificial Sequence
  Description of Artificial Sequence: Synthetic peptide
  Seed: SEPLFTYTL (MAGC1_HUMAN)
SHPLFTYTL

SEQ ID NO: 86367 - protein, 10 aa, Artificial Sequence
  Description of Artificial Sequence: Synthetic peptide
  Seed: SPLYFPQSPL (MAGC1_HUMAN)
SALYFPQSPV

SEQ ID NO: 86368 - protein, 10 aa, Artificial Sequence
  Description of Artificial Sequence: Synthetic peptide
  Seed: STSLSLPQSF (MAGC1_HUMAN)
SQSLSLPQSW

SEQ ID NO: 86369 - protein, 9 aa, Artificial Sequence
  Description of Artificial Sequence: Synthetic peptide
  Seed: IIFIKGTYA (MAGC1_HUMAN)
ILFIKGTYI

SEQ ID NO: 86370 - protein, 10 aa, Artificial Sequence
  Description of Artificial Sequence: Synthetic peptide
  Seed: VSSSFSYTLL (MAGC1_HUMAN)
VLSSFSYTLW

SEQ ID NO: 86371 - protein, 9 aa, Artificial Sequence
  Description of Artificial Sequence: Synthetic peptide
  Seed: NTVPITFPS (MAGC1_HUMAN)
NVVPITFPA

SEQ ID NO: 86372 - protein, 9 aa, Artificial Sequence
  Description of Artificial Sequence: Synthetic peptide
  Seed: SSPERTQST (MAGC1_HUMAN)
SRPERTQSI

SEQ ID NO: 86373 - protein, 10 aa, Artificial Sequence
  Description of Artificial Sequence: Synthetic peptide
  Seed: SPVSSFPSST (MAGC1_HUMAN)
SPVSSFPSSA

SEQ ID NO: 86374 - protein, 9 aa, Artificial Sequence
  Description of Artificial Sequence: Synthetic peptide
  Seed: IIDTTDDST (MAGC1_HUMAN)
IMDTTDDSI

SEQ ID NO: 86375 - protein, 10 aa, Artificial Sequence
  Description of Artificial Sequence: Synthetic peptide
  Seed: ICSSSTSLSL (MAGC1_HUMAN)
IGSSSTSLSY

SEQ ID NO: 86376 - protein, 9 aa, Artificial Sequence
  Description of Artificial Sequence: Synthetic peptide
  Seed: LSPLHFPQF (MAGC1_HUMAN)
LYPLHFPQM

SEQ ID NO: 86377 - protein, 9 aa, Artificial Sequence
  Description of Artificial Sequence: Synthetic peptide
  Seed: IGVRAGREH (MAGC1_HUMAN)
IAVRAGREL

SEQ ID NO: 86378 - protein, 9 aa, Artificial Sequence
  Description of Artificial Sequence: Synthetic peptide
  Seed: ELARFLLLK (MAGC1_HUMAN)
EVARFLLLH

SEQ ID NO: 86379 - protein, 9 aa, Artificial Sequence
  Description of Artificial Sequence: Synthetic peptide
  Seed: ISFSSSTSL (MAGC1_HUMAN)
IVFSSSTSR

SEQ ID NO: 86380 - protein, 10 aa, Artificial Sequence
  Description of Artificial Sequence: Synthetic peptide
  Seed: KVVEFLAMLK (MAGC1_HUMAN)
KRVEFLAMLK

SEQ ID NO: 86381 - protein, 10 aa, Artificial Sequence
  Description of Artificial Sequence: Synthetic peptide
  Seed: KRKVVEFLAM (MAGC1_HUMAN)
KQKVVEFLAY

SEQ ID NO: 86382 - protein, 9 aa, Artificial Sequence
  Description of Artificial Sequence: Synthetic peptide
  Seed: WVQEHYLEY (MAGC1_HUMAN)
WPQEHYLEL

SEQ ID NO: 86383 - protein, 9 aa, Artificial Sequence
  Description of Artificial Sequence: Synthetic peptide
  Seed: SLIESEPLF (MAGC1_HUMAN)
SKIESEPLF

SEQ ID NO: 86384 - protein, 9 aa, Artificial Sequence
  Description of Artificial Sequence: Synthetic peptide
  Seed: LQIPMTSSF (MAGC1_HUMAN)
LWIPMTSSI

SEQ ID NO: 86385 - protein, 10 aa, Artificial Sequence
  Description of Artificial Sequence: Synthetic peptide
  Seed: YTLLSLFQSS (MAGC1_HUMAN)
YTLLSLFQSA

SEQ ID NO: 86386 - protein, 9 aa, Artificial Sequence
  Description of Artificial Sequence: Synthetic peptide
  Seed: TLDEKVDEL (MAGC1_HUMAN)
TADEKVDEA

SEQ ID NO: 86387 - protein, 9 aa, Artificial Sequence
  Description of Artificial Sequence: Synthetic peptide
  Seed: AQSPLQIPV (MAGC1_HUMAN)
ARSPLQIPY

SEQ ID NO: 86388 - protein, 10 aa, Artificial Sequence
  Description of Artificial Sequence: Synthetic peptide
  Seed: VSSSSSSTLL (MAGC1_HUMAN)
VRSSSSSTLY

SEQ ID NO: 86389 - protein, 11 aa, Artificial Sequence
  Description of Artificial Sequence: Synthetic peptide
  Seed: VIWDVLSGIGV (MAGC1_HUMAN)
VLWDVLSGIGI

SEQ ID NO: 86390 - protein, 11 aa, Artificial Sequence
  Description of Artificial Sequence: Synthetic peptide
  Seed: IIDTTDDSTAT (MAGC1_HUMAN)
ISDTTDDSTAL

SEQ ID NO: 86391 - protein, 11 aa, Artificial Sequence
  Description of Artificial Sequence: Synthetic peptide
  Seed: SLIESEPLFTY (MAGC1_HUMAN)
SMIESEPLFTF

SEQ ID NO: 86392 - protein, 10 aa, Artificial Sequence
  Description of Artificial Sequence: Synthetic peptide
  Seed: TTDDSTATES (MAGC1_HUMAN)
TSDDSTATEL

SEQ ID NO: 86393 - protein, 9 aa, Artificial Sequence
  Description of Artificial Sequence: Synthetic peptide
  Seed: FSEESSSPV (MAGC1_HUMAN)
FTEESSSPV

SEQ ID NO: 86394 - protein, 10 aa, Artificial Sequence
  Description of Artificial Sequence: Synthetic peptide
  Seed: SPLQSPVSSF (MAGC1_HUMAN)
SELQSPVSSY

SEQ ID NO: 86395 - protein, 10 aa, Artificial Sequence
  Description of Artificial Sequence: Synthetic peptide
  Seed: SPVISFSSST (MAGC1_HUMAN)
SPVISFSSSI

SEQ ID NO: 86396 - protein, 9 aa, Artificial Sequence
  Description of Artificial Sequence: Synthetic peptide
  Seed: ISFSSSTSL (MAGC1_HUMAN)
IFFSSSTSM

SEQ ID NO: 86397 - protein, 9 aa, Artificial Sequence
  Description of Artificial Sequence: Synthetic peptide
  Seed: SSLSQSSPV (MAGC1_HUMAN)
SVLSQSSPV

SEQ ID NO: 86398 - protein, 10 aa, Artificial Sequence
  Description of Artificial Sequence: Synthetic peptide
  Seed: AASSSTLVSI (MAGC1_HUMAN)
AVSSSTLVSL

SEQ ID NO: 86399 - protein, 9 aa, Artificial Sequence
  Description of Artificial Sequence: Synthetic peptide
  Seed: FSSTLLSLF (MAGC1_HUMAN)
FASTLLSLY

SEQ ID NO: 86400 - protein, 9 aa, Artificial Sequence
  Description of Artificial Sequence: Synthetic peptide
  Seed: SQNRLLILI (MAGC1_HUMAN)
SLNRLLILV

SEQ ID NO: 86401 - protein, 10 aa, Artificial Sequence
  Description of Artificial Sequence: Synthetic peptide
  Seed: VSICSSSTSL (MAGC1_HUMAN)
VLICSSSTSY

SEQ ID NO: 86402 - protein, 8 aa, Artificial Sequence
  Description of Artificial Sequence: Synthetic peptide
  Seed: KVDELARF (MAGC1_HUMAN)
KSDELARL

SEQ ID NO: 86403 - protein, 11 aa, Artificial Sequence
  Description of Artificial Sequence: Synthetic peptide
  Seed: QSSPESAQSTF (MAGC1_HUMAN)
QMSPESAQSTL

SEQ ID NO: 86404 - protein, 9 aa, Artificial Sequence
  Description of Artificial Sequence: Synthetic peptide
  Seed: SICSSSTSL (MAGC1_HUMAN)
STCSSSTSV

SEQ ID NO: 86405 - protein, 11 aa, Artificial Sequence
  Description of Artificial Sequence: Synthetic peptide
  Seed: FLAMLKNTVPI (MAGC1_HUMAN)
FLAMLKNTVPM

SEQ ID NO: 86406 - protein, 9 aa, Artificial Sequence
  Description of Artificial Sequence: Synthetic peptide
  Seed: FSYTLLSLF (MAGC1_HUMAN)
FYYTLLSLF

SEQ ID NO: 86407 - protein, 9 aa, Artificial Sequence
  Description of Artificial Sequence: Synthetic peptide
  Seed: STFEGFAQS (MAGC1_HUMAN)
SMFEGFAQM

SEQ ID NO: 86408 - protein, 10 aa, Artificial Sequence
  Description of Artificial Sequence: Synthetic peptide
  Seed: MSPLYFPQSP (MAGC1_HUMAN)
MKPLYFPQSA

SEQ ID NO: 86409 - protein, 9 aa, Artificial Sequence
  Description of Artificial Sequence: Synthetic peptide
  Seed: FFSSALLSI (MAGC1_HUMAN)
FVSSALLST

SEQ ID NO: 86410 - protein, 9 aa, Artificial Sequence
  Description of Artificial Sequence: Synthetic peptide
  Seed: KVDELARFL (MAGC1_HUMAN)
KGDELARFL

SEQ ID NO: 86411 - protein, 10 aa, Artificial Sequence
  Description of Artificial Sequence: Synthetic peptide
  Seed: LAMLKNTVPI (MAGC1_HUMAN)
LRMLKNTVPY

SEQ ID NO: 86412 - protein, 10 aa, Artificial Sequence
  Description of Artificial Sequence: Synthetic peptide
  Seed: TVPITFPSSY (MAGC1_HUMAN)
TVPITFPSSK

SEQ ID NO: 86413 - protein, 10 aa, Artificial Sequence
  Description of Artificial Sequence: Synthetic peptide
  Seed: SFSSTLLSIL (MAGC1_HUMAN)
SGSSTLLSIW

SEQ ID NO: 86414 - protein, 9 aa, Artificial Sequence
  Description of Artificial Sequence: Synthetic peptide
  Seed: GYFPVIFRK (MAGC1_HUMAN)
GGFPVIFRY

SEQ ID NO: 86415 - protein, 9 aa, Artificial Sequence
  Description of Artificial Sequence: Synthetic peptide
  Seed: SFSYTLLSL (MAGC1_HUMAN)
SASYTLLSF

SEQ ID NO: 86416 - protein, 11 aa, Artificial Sequence
  Description of Artificial Sequence: Synthetic peptide
  Seed: STFEGFAQSPL (MAGC1_HUMAN)
SAFEGFAQSPV

SEQ ID NO: 86417 - protein, 9 aa, Artificial Sequence
  Description of Artificial Sequence: Synthetic peptide
  Seed: KAREFIEIL (MAGC1_HUMAN)
KVREFIEIV

SEQ ID NO: 86418 - protein, 9 aa, Artificial Sequence
  Description of Artificial Sequence: Synthetic peptide
  Seed: FSSALLSIF (MAGC1_HUMAN)
FMSALLSIM

SEQ ID NO: 86419 - protein, 9 aa, Artificial Sequence
  Description of Artificial Sequence: Synthetic peptide
  Seed: SIFQSSPER (MAGC1_HUMAN)
SSFQSSPER

SEQ ID NO: 86420 - protein, 10 aa, Artificial Sequence
  Description of Artificial Sequence: Synthetic peptide
  Seed: KGTYASEEVI (MAGC1_HUMAN)
KYTYASEEVW

SEQ ID NO: 86421 - protein, 9 aa, Artificial Sequence
  Description of Artificial Sequence: Synthetic peptide
  Seed: TLDLTSEGC (MAGC1_HUMAN)
TTDLTSEGF

SEQ ID NO: 86422 - protein, 9 aa, Artificial Sequence
  Description of Artificial Sequence: Synthetic peptide
  Seed: MPTAGMPSL (MAGC1_HUMAN)
MPTAGMPSF

SEQ ID NO: 86423 - protein, 9 aa, Artificial Sequence
  Description of Artificial Sequence: Synthetic peptide
  Seed: FPSSTSSSL (MAGC1_HUMAN)
FFSSTSSSY

SEQ ID NO: 86424 - protein, 9 aa, Artificial Sequence
  Description of Artificial Sequence: Synthetic peptide
  Seed: SFSSTLVSL (MAGC1_HUMAN)
SSSSTLVSM

SEQ ID NO: 86425 - protein, 9 aa, Artificial Sequence
  Description of Artificial Sequence: Synthetic peptide
  Seed: MGDKDMPTA (MAGC1_HUMAN)
MLDKDMPTI

SEQ ID NO: 86426 - protein, 11 aa, Artificial Sequence
  Description of Artificial Sequence: Synthetic peptide
  Seed: QSSPERTQSTF (MAGC1_HUMAN)
QGSPERTQSTW

SEQ ID NO: 86427 - protein, 10 aa, Artificial Sequence
  Description of Artificial Sequence: Synthetic peptide
  Seed: ILFGISLREV (MAGC1_HUMAN)
IIFGISLREI

SEQ ID NO: 86428 - protein, 9 aa, Artificial Sequence
  Description of Artificial Sequence: Synthetic peptide
  Seed: SLIESEPLF (MAGC1_HUMAN)
SWIESEPLY

SEQ ID NO: 86429 - protein, 11 aa, Artificial Sequence
  Description of Artificial Sequence: Synthetic peptide
  Seed: LWGPRAHSEVI (MAGC1_HUMAN)
LMGPRAHSEVL

SEQ ID NO: 86430 - protein, 9 aa, Artificial Sequence
  Description of Artificial Sequence: Synthetic peptide
  Seed: VSSSFSYTL (MAGC1_HUMAN)
VYSSFSYTV

SEQ ID NO: 86431 - protein, 9 aa, Artificial Sequence
  Description of Artificial Sequence: Synthetic peptide
  Seed: IEILFGISL (MAGC1_HUMAN)
IRILFGISL

SEQ ID NO: 86432 - protein, 11 aa, Artificial Sequence
  Description of Artificial Sequence: Synthetic peptide
  Seed: TLDEKVDELAR (MAGC1_HUMAN)
TADEKVDELAY

SEQ ID NO: 86433 - protein, 9 aa, Artificial Sequence
  Description of Artificial Sequence: Synthetic peptide
  Seed: EFIEILFGI (MAGC1_HUMAN)
ETIEILFGP

SEQ ID NO: 86434 - protein, 9 aa, Artificial Sequence
  Description of Artificial Sequence: Synthetic peptide
  Seed: NTVPITFPS (MAGC1_HUMAN)
NVVPITFPK

SEQ ID NO: 86435 - protein, 10 aa, Artificial Sequence
  Description of Artificial Sequence: Synthetic peptide
  Seed: LQIPVSSSFS (MAGC1_HUMAN)
LRIPVSSSFF

SEQ ID NO: 86436 - protein, 10 aa, Artificial Sequence
  Description of Artificial Sequence: Synthetic peptide
  Seed: SFPSSTSSSL (MAGC1_HUMAN)
SGPSSTSSSI

SEQ ID NO: 86437 - protein, 11 aa, Artificial Sequence
  Description of Artificial Sequence: Synthetic peptide
  Seed: LQIPMTSSFSS (MAGC1_HUMAN)
LHIPMTSSFSY

SEQ ID NO: 86438 - protein, 9 aa, Artificial Sequence
  Description of Artificial Sequence: Synthetic peptide
  Seed: CSSSTSLSL (MAGC1_HUMAN)
CASSTSLSI

SEQ ID NO: 86439 - protein, 9 aa, Artificial Sequence
  Description of Artificial Sequence: Synthetic peptide
  Seed: VSRSFSSTL (MAGC1_HUMAN)
VMRSFSSTH

SEQ ID NO: 86440 - protein, 9 aa, Artificial Sequence
  Description of Artificial Sequence: Synthetic peptide
  Seed: SRYTGYFPV (MAGC1_HUMAN)
SRYTGYFPY

SEQ ID NO: 86441 - protein, 9 aa, Artificial Sequence
  Description of Artificial Sequence: Synthetic peptide
  Seed: LQIPVSPSF (MAGC1_HUMAN)
LMIPVSPSW

SEQ ID NO: 86442 - protein, 9 aa, Artificial Sequence
  Description of Artificial Sequence: Synthetic peptide
  Seed: SLFQSFSER (MAGC1_HUMAN)
SAFQSFSEF

SEQ ID NO: 86443 - protein, 9 aa, Artificial Sequence
  Description of Artificial Sequence: Synthetic peptide
  Seed: LQIPVSRSF (MAGC1_HUMAN)
LGIPVSRSL

SEQ ID NO: 86444 - protein, 9 aa, Artificial Sequence
  Description of Artificial Sequence: Synthetic peptide
  Seed: IPMTSSFSS (MAGC1_HUMAN)
IPMTSSFSF

SEQ ID NO: 86445 - protein, 10 aa, Artificial Sequence
  Description of Artificial Sequence: Synthetic peptide
  Seed: FAQSSLQIPV (MAGC1_HUMAN)
FQQSSLQIPL

SEQ ID NO: 86446 - protein, 10 aa, Artificial Sequence
  Description of Artificial Sequence: Synthetic peptide
  Seed: LQNPASSFFS (MAGC1_HUMAN)
LQNPASSFFF

SEQ ID NO: 86447 - protein, 9 aa, Artificial Sequence
  Description of Artificial Sequence: Synthetic peptide
  Seed: SGIGVRAGR (MAGC1_HUMAN)
STIGVRAGK

SEQ ID NO: 86448 - protein, 10 aa, Artificial Sequence
  Description of Artificial Sequence: Synthetic peptide
  Seed: HSPQSPPEGM (MAGC1_HUMAN)
HLPQSPPEGM

SEQ ID NO: 86449 - protein, 9 aa, Artificial Sequence
  Description of Artificial Sequence: Synthetic peptide
  Seed: AGREHFAFG (MAGC1_HUMAN)
ACREHFAFK

SEQ ID NO: 86450 - protein, 10 aa, Artificial Sequence
  Description of Artificial Sequence: Synthetic peptide
  Seed: ICSSSTSLSL (MAGC1_HUMAN)
IRSSSTSLSF

SEQ ID NO: 86451 - protein, 11 aa, Artificial Sequence
  Description of Artificial Sequence: Synthetic peptide
  Seed: STFEGFAQSPL (MAGC1_HUMAN)
SLFEGFAQSPI

SEQ ID NO: 86452 - protein, 10 aa, Artificial Sequence
  Description of Artificial Sequence: Synthetic peptide
  Seed: IPMTSSFSST (MAGC1_HUMAN)
IPMTSSFSSV

SEQ ID NO: 86453 - protein, 9 aa, Artificial Sequence
  Description of Artificial Sequence: Synthetic peptide
  Seed: EVPNSSPPR (MAGC1_HUMAN)
ESPNSSPPR

SEQ ID NO: 86454 - protein, 9 aa, Artificial Sequence
  Description of Artificial Sequence: Synthetic peptide
  Seed: LQNPASSFF (MAGC1_HUMAN)
LQNPASSFH

SEQ ID NO: 86455 - protein, 9 aa, Artificial Sequence
  Description of Artificial Sequence: Synthetic peptide
  Seed: FFSSALLSI (MAGC1_HUMAN)
FISSALLSM

SEQ ID NO: 86456 - protein, 9 aa, Artificial Sequence
  Description of Artificial Sequence: Synthetic peptide
  Seed: SPVDEYTSS (MAGC1_HUMAN)
SPVDEYTSL

SEQ ID NO: 86457 - protein, 10 aa, Artificial Sequence
  Description of Artificial Sequence: Synthetic peptide
  Seed: GEDSLSPLQI (MAGC1_HUMAN)
GEDSLSPLQM

SEQ ID NO: 86458 - protein, 9 aa, Artificial Sequence
  Description of Artificial Sequence: Synthetic peptide
  Seed: MPTAGMPSL (MAGC1_HUMAN)
MHTAGMPSL

SEQ ID NO: 86459 - protein, 9 aa, Artificial Sequence
  Description of Artificial Sequence: Synthetic peptide
  Seed: LLILILSII (MAGC1_HUMAN)
LMILILSIA

SEQ ID NO: 86460 - protein, 10 aa, Artificial Sequence
  Description of Artificial Sequence: Synthetic peptide
  Seed: SFSSTLVSLF (MAGC1_HUMAN)
SYSSTLVSLY

SEQ ID NO: 86461 - protein, 9 aa, Artificial Sequence
  Description of Artificial Sequence: Synthetic peptide
  Seed: FSSTLLSLF (MAGC1_HUMAN)
FISTLLSLL

SEQ ID NO: 86462 - protein, 8 aa, Artificial Sequence
  Description of Artificial Sequence: Synthetic peptide
  Seed: SPLQRPVS (MAGC1_HUMAN)
SPLQRPVL

SEQ ID NO: 86463 - protein, 10 aa, Artificial Sequence
  Description of Artificial Sequence: Synthetic peptide
  Seed: EVIKRKVVEF (MAGC1_HUMAN)
EAIKRKVVER

SEQ ID NO: 86464 - protein, 10 aa, Artificial Sequence
  Description of Artificial Sequence: Synthetic peptide
  Seed: ATESASSSVM (MAGC1_HUMAN)
AWESASSSVF

SEQ ID NO: 86465 - protein, 10 aa, Artificial Sequence
  Description of Artificial Sequence: Synthetic peptide
  Seed: RAGREHFAFG (MAGC1_HUMAN)
RYGREHFAFI

SEQ ID NO: 86466 - protein, 9 aa, Artificial Sequence
  Description of Artificial Sequence: Synthetic peptide
  Seed: AFGEPRELL (MAGC1_HUMAN)
AWGEPRELF

SEQ ID NO: 86467 - protein, 10 aa, Artificial Sequence
  Description of Artificial Sequence: Synthetic peptide
  Seed: SLSPLHFPQF (MAGC1_HUMAN)
SLSPLHFPQL

SEQ ID NO: 86468 - protein, 9 aa, Artificial Sequence
  Description of Artificial Sequence: Synthetic peptide
  Seed: SRYTGYFPV (MAGC1_HUMAN)
SHYTGYFPY

SEQ ID NO: 86469 - protein, 9 aa, Artificial Sequence
  Description of Artificial Sequence: Synthetic peptide
  Seed: FFSYTLASL (MAGC1_HUMAN)
FWSYTLASM

SEQ ID NO: 86470 - protein, 10 aa, Artificial Sequence
  Description of Artificial Sequence: Synthetic peptide
  Seed: SIIFIKGTYA (MAGC1_HUMAN)
SLIFIKGTYV

SEQ ID NO: 86471 - protein, 10 aa, Artificial Sequence
  Description of Artificial Sequence: Synthetic peptide
  Seed: MTSSFSSTLL (MAGC1_HUMAN)
MMSSFSSTLR

SEQ ID NO: 86472 - protein, 9 aa, Artificial Sequence
  Description of Artificial Sequence: Synthetic peptide
  Seed: ALKDVEERA (MAGC1_HUMAN)
AMKDVEERI

SEQ ID NO: 86473 - protein, 10 aa, Artificial Sequence
  Description of Artificial Sequence: Synthetic peptide
  Seed: REFIEILFGI (MAGC1_HUMAN)
REFIEILFGV

SEQ ID NO: 86474 - protein, 11 aa, Artificial Sequence
  Description of Artificial Sequence: Synthetic peptide
  Seed: SSSSSTLLSLF (MAGC1_HUMAN)
SFSSSTLLSLW

SEQ ID NO: 86475 - protein, 9 aa, Artificial Sequence
  Description of Artificial Sequence: Synthetic peptide
  Seed: ASSSTLVSI (MAGC1_HUMAN)
ACSSTLVSW

SEQ ID NO: 86476 - protein, 11 aa, Artificial Sequence
  Description of Artificial Sequence: Synthetic peptide
  Seed: VDEYTSSSDTL (MAGC1_HUMAN)
VMEYTSSSDTF

SEQ ID NO: 86477 - protein, 11 aa, Artificial Sequence
  Description of Artificial Sequence: Synthetic peptide
  Seed: KRKVVEFLAML (MAGC1_HUMAN)
KVKVVEFLAMV

SEQ ID NO: 86478 - protein, 9 aa, Artificial Sequence
  Description of Artificial Sequence: Synthetic peptide
  Seed: SSPESAQSA (MAGC1_HUMAN)
STPESAQSV

SEQ ID NO: 86479 - protein, 10 aa, Artificial Sequence
  Description of Artificial Sequence: Synthetic peptide
  Seed: QIPVSSSFSY (MAGC1_HUMAN)
QNPVSSSFSY

SEQ ID NO: 86480 - protein, 11 aa, Artificial Sequence
  Description of Artificial Sequence: Synthetic peptide
  Seed: SPLQIPVSRSF (MAGC1_HUMAN)
SILQIPVSRSY

SEQ ID NO: 86481 - protein, 9 aa, Artificial Sequence
  Description of Artificial Sequence: Synthetic peptide
  Seed: SSPESAQSA (MAGC1_HUMAN)
SLPESAQSF

SEQ ID NO: 86482 - protein, 9 aa, Artificial Sequence
  Description of Artificial Sequence: Synthetic peptide
  Seed: KDSLSPLEI (MAGC1_HUMAN)
KLSLSPLEW

SEQ ID NO: 86483 - protein, 10 aa, Artificial Sequence
  Description of Artificial Sequence: Synthetic peptide
  Seed: RPVSSFFSYT (MAGC1_HUMAN)
RNVSSFFSYK

SEQ ID NO: 86484 - protein, 9 aa, Artificial Sequence
  Description of Artificial Sequence: Synthetic peptide
  Seed: MSQNRLLIL (MAGC1_HUMAN)
MIQNRLLIW

SEQ ID NO: 86485 - protein, 9 aa, Artificial Sequence
  Description of Artificial Sequence: Synthetic peptide
  Seed: SSPPRYEFL (MAGC1_HUMAN)
SLPPRYEFA

SEQ ID NO: 86486 - protein, 10 aa, Artificial Sequence
  Description of Artificial Sequence: Synthetic peptide
  Seed: SFFSYTLASL (MAGC1_HUMAN)
SFFSYTLASW

SEQ ID NO: 86487 - protein, 10 aa, Artificial Sequence
  Description of Artificial Sequence: Synthetic peptide
  Seed: YTLASLLQSS (MAGC1_HUMAN)
YELASLLQSV

SEQ ID NO: 86488 - protein, 10 aa, Artificial Sequence
  Description of Artificial Sequence: Synthetic peptide
  Seed: SFFSSALLSI (MAGC1_HUMAN)
SYFSSALLSM

SEQ ID NO: 86489 - protein, 9 aa, Artificial Sequence
  Description of Artificial Sequence: Synthetic peptide
  Seed: SSPEGKDSL (MAGC1_HUMAN)
STPEGKDSI

SEQ ID NO: 86490 - protein, 9 aa, Artificial Sequence
  Description of Artificial Sequence: Synthetic peptide
  Seed: SFFSYTLAS (MAGC1_HUMAN)
SYFSYTLAW

SEQ ID NO: 86491 - protein, 10 aa, Artificial Sequence
  Description of Artificial Sequence: Synthetic peptide
  Seed: LQIPVSPSFS (MAGC1_HUMAN)
LQIPVSPSFY

SEQ ID NO: 86492 - protein, 9 aa, Artificial Sequence
  Description of Artificial Sequence: Synthetic peptide
  Seed: ASSSTLVSI (MAGC1_HUMAN)
AQSSTLVSM

SEQ ID NO: 86493 - protein, 9 aa, Artificial Sequence
  Description of Artificial Sequence: Synthetic peptide
  Seed: SSLSQSSPV (MAGC1_HUMAN)
SMLSQSSPI

SEQ ID NO: 86494 - protein, 10 aa, Artificial Sequence
  Description of Artificial Sequence: Synthetic peptide
  Seed: VSSSSSSTLL (MAGC1_HUMAN)
VWSSSSSTLY

SEQ ID NO: 86495 - protein, 10 aa, Artificial Sequence
  Description of Artificial Sequence: Synthetic peptide
  Seed: MPTAGMPSLL (MAGC1_HUMAN)
MQTAGMPSLF

SEQ ID NO: 86496 - protein, 9 aa, Artificial Sequence
  Description of Artificial Sequence: Synthetic peptide
  Seed: FSYTLASLL (MAGC1_HUMAN)
FAYTLASLY

SEQ ID NO: 86497 - protein, 9 aa, Artificial Sequence
  Description of Artificial Sequence: Synthetic peptide
  Seed: IPVSSSFSY (MAGC1_HUMAN)
IPVSSSFSH

SEQ ID NO: 86498 - protein, 11 aa, Artificial Sequence
  Description of Artificial Sequence: Synthetic peptide
  Seed: SFFSSALLSIF (MAGC1_HUMAN)
SSFSSALLSIL

SEQ ID NO: 86499 - protein, 10 aa, Artificial Sequence
  Description of Artificial Sequence: Synthetic peptide
  Seed: YTLASLLQSS (MAGC1_HUMAN)
YHLASLLQSL

SEQ ID NO: 86500 - protein, 10 aa, Artificial Sequence
  Description of Artificial Sequence: Synthetic peptide
  Seed: TTDDSTATES (MAGC1_HUMAN)
TCDDSTATEM

SEQ ID NO: 86501 - protein, 9 aa, Artificial Sequence
  Description of Artificial Sequence: Synthetic peptide
  Seed: QIVPSLPEW (MAGC1_HUMAN)
QQVPSLPEL

SEQ ID NO: 86502 - protein, 9 aa, Artificial Sequence
  Description of Artificial Sequence: Synthetic peptide
  Seed: SPLQIVPSL (MAGC1_HUMAN)
SPLQIVPSS

SEQ ID NO: 86503 - protein, 9 aa, Artificial Sequence
  Description of Artificial Sequence: Synthetic peptide
  Seed: EHYLEYREV (MAGC1_HUMAN)
EHYLEYREL

SEQ ID NO: 86504 - protein, 9 aa, Artificial Sequence
  Description of Artificial Sequence: Synthetic peptide
  Seed: SPESAQSTF (MAGC1_HUMAN)
SPESAQSTI

SEQ ID NO: 86505 - protein, 9 aa, Artificial Sequence
  Description of Artificial Sequence: Synthetic peptide
  Seed: SSSFSYTLL (MAGC1_HUMAN)
SSSFSYTLY

SEQ ID NO: 86506 - protein, 9 aa, Artificial Sequence
  Description of Artificial Sequence: Synthetic peptide
  Seed: SPPEGENTH (MAGC1_HUMAN)
SAPEGENTI

SEQ ID NO: 86507 - protein, 9 aa, Artificial Sequence
  Description of Artificial Sequence: Synthetic peptide
  Seed: FSEESSSPV (MAGC1_HUMAN)
FGEESSSPY

SEQ ID NO: 86508 - protein, 10 aa, Artificial Sequence
  Description of Artificial Sequence: Synthetic peptide
  Seed: MTSSFSSTLL (MAGC1_HUMAN)
MPSSFSSTLM

SEQ ID NO: 86509 - protein, 9 aa, Artificial Sequence
  Description of Artificial Sequence: Synthetic peptide
  Seed: DEQGMSQNR (MAGC1_HUMAN)
DTQGMSQNR

SEQ ID NO: 86510 - protein, 9 aa, Artificial Sequence
  Description of Artificial Sequence: Synthetic peptide
  Seed: YTGYFPVIF (MAGC1_HUMAN)
YFGYFPVIY

SEQ ID NO: 86511 - protein, 9 aa, Artificial Sequence
  Description of Artificial Sequence: Synthetic peptide
  Seed: SFFSYTLAS (MAGC1_HUMAN)
SFFSYTLAM

SEQ ID NO: 86512 - protein, 10 aa, Artificial Sequence
  Description of Artificial Sequence: Synthetic peptide
  Seed: ATESASSSVM (MAGC1_HUMAN)
AWESASSSVW

SEQ ID NO: 86513 - protein, 9 aa, Artificial Sequence
  Description of Artificial Sequence: Synthetic peptide
  Seed: LLSLFQSFS (MAGC1_HUMAN)
LLSLFQSFA

SEQ ID NO: 86514 - protein, 11 aa, Artificial Sequence
  Description of Artificial Sequence: Synthetic peptide
  Seed: NTVPITFPSSY (MAGC1_HUMAN)
NSVPITFPSSR

SEQ ID NO: 86515 - protein, 10 aa, Artificial Sequence
  Description of Artificial Sequence: Synthetic peptide
  Seed: SLQIPVSPSF (MAGC1_HUMAN)
SIQIPVSPSM

SEQ ID NO: 86516 - protein, 9 aa, Artificial Sequence
  Description of Artificial Sequence: Synthetic peptide
  Seed: TFEGFPQSL (MAGC1_HUMAN)
TREGFPQSL

SEQ ID NO: 86517 - protein, 9 aa, Artificial Sequence
  Description of Artificial Sequence: Synthetic peptide
  Seed: SIIFIKGTY (MAGC1_HUMAN)
SPIFIKGTF

SEQ ID NO: 86518 - protein, 10 aa, Artificial Sequence
  Description of Artificial Sequence: Synthetic peptide
  Seed: VSSSFSYTLL (MAGC1_HUMAN)
VWSSFSYTLY

SEQ ID NO: 86519 - protein, 9 aa, Artificial Sequence
  Description of Artificial Sequence: Synthetic peptide
  Seed: FSYTLLSLF (MAGC1_HUMAN)
FPYTLLSLY

SEQ ID NO: 86520 - protein, 9 aa, Artificial Sequence
  Description of Artificial Sequence: Synthetic peptide
  Seed: STFEGFAQS (MAGC1_HUMAN)
SIFEGFAQA

SEQ ID NO: 86521 - protein, 9 aa, Artificial Sequence
  Description of Artificial Sequence: Synthetic peptide
  Seed: LQNPASSFF (MAGC1_HUMAN)
LTNPASSFM

SEQ ID NO: 86522 - protein, 9 aa, Artificial Sequence
  Description of Artificial Sequence: Synthetic peptide
  Seed: MTSSFSSTL (MAGC1_HUMAN)
MLSSFSSTR

SEQ ID NO: 86523 - protein, 8 aa, Artificial Sequence
  Description of Artificial Sequence: Synthetic peptide
  Seed: FIEILFGI (MAGC1_HUMAN)
FLEILFGL

SEQ ID NO: 86524 - protein, 9 aa, Artificial Sequence
  Description of Artificial Sequence: Synthetic peptide
  Seed: LQIPVSRSF (MAGC1_HUMAN)
LKIPVSRSL

SEQ ID NO: 86525 - protein, 9 aa, Artificial Sequence
  Description of Artificial Sequence: Synthetic peptide
  Seed: SFSERTQST (MAGC1_HUMAN)
SYSERTQSM

SEQ ID NO: 86526 - protein, 10 aa, Artificial Sequence
  Description of Artificial Sequence: Synthetic peptide
  Seed: REFIEILFGI (MAGC1_HUMAN)
RLFIEILFGI

SEQ ID NO: 86527 - protein, 9 aa, Artificial Sequence
  Description of Artificial Sequence: Synthetic peptide
  Seed: FTYTLDEKV (MAGC1_HUMAN)
FSYTLDEKL

SEQ ID NO: 86528 - protein, 10 aa, Artificial Sequence
  Description of Artificial Sequence: Synthetic peptide
  Seed: SSPESAQSAF (MAGC1_HUMAN)
SEPESAQSAL

SEQ ID NO: 86529 - protein, 9 aa, Artificial Sequence
  Description of Artificial Sequence: Synthetic peptide
  Seed: ISFSSSTSL (MAGC1_HUMAN)
IWFSSSTSL

SEQ ID NO: 86530 - protein, 9 aa, Artificial Sequence
  Description of Artificial Sequence: Synthetic peptide
  Seed: TLLSLFQSF (MAGC1_HUMAN)
TMLSLFQSK

SEQ ID NO: 86531 - protein, 10 aa, Artificial Sequence
  Description of Artificial Sequence: Synthetic peptide
  Seed: LQIPVSSSFS (MAGC1_HUMAN)
LSIPVSSSFY

SEQ ID NO: 86532 - protein, 9 aa, Artificial Sequence
  Description of Artificial Sequence: Synthetic peptide
  Seed: VSAASSSTL (MAGC1_HUMAN)
VGAASSSTY

SEQ ID NO: 86533 - protein, 9 aa, Artificial Sequence
  Description of Artificial Sequence: Synthetic peptide
  Seed: GEDSQSPLQ (MAGC1_HUMAN)
GEDSQSPLV

SEQ ID NO: 86534 - protein, 9 aa, Artificial Sequence
  Description of Artificial Sequence: Synthetic peptide
  Seed: SRSFSSTLL (MAGC1_HUMAN)
SHSFSSTLL

SEQ ID NO: 86535 - protein, 9 aa, Artificial Sequence
  Description of Artificial Sequence: Synthetic peptide
  Seed: SSSTLVSIF (MAGC1_HUMAN)
SASTLVSIH

SEQ ID NO: 86536 - protein, 11 aa, Artificial Sequence
  Description of Artificial Sequence: Synthetic peptide
  Seed: STFEGFPQSLL (MAGC1_HUMAN)
SMFEGFPQSLH

SEQ ID NO: 86537 - protein, 9 aa, Artificial Sequence
  Description of Artificial Sequence: Synthetic peptide
  Seed: FFSYTLASL (MAGC1_HUMAN)
FLSYTLASY

SEQ ID NO: 86538 - protein, 10 aa, Artificial Sequence
  Description of Artificial Sequence: Synthetic peptide
  Seed: QGEDSMSPLY (MAGC1_HUMAN)
QFEDSMSPLW

SEQ ID NO: 86539 - protein, 10 aa, Artificial Sequence
  Description of Artificial Sequence: Synthetic peptide
  Seed: SFSSTLVSLF (MAGC1_HUMAN)
SLSSTLVSLY

SEQ ID NO: 86540 - protein, 10 aa, Artificial Sequence
  Description of Artificial Sequence: Synthetic peptide
  Seed: WGPRAHSEVI (MAGC1_HUMAN)
WEPRAHSEVV

SEQ ID NO: 86541 - protein, 10 aa, Artificial Sequence
  Description of Artificial Sequence: Synthetic peptide
  Seed: FIEILFGISL (MAGC1_HUMAN)
FGEILFGISL

SEQ ID NO: 86542 - protein, 10 aa, Artificial Sequence
  Description of Artificial Sequence: Synthetic peptide
  Seed: FPQSVLQIPV (MAGC1_HUMAN)
FRQSVLQIPV

SEQ ID NO: 86543 - protein, 9 aa, Artificial Sequence
  Description of Artificial Sequence: Synthetic peptide
  Seed: SAASSSTLV (MAGC1_HUMAN)
SSASSSTLI

SEQ ID NO: 86544 - protein, 9 aa, Artificial Sequence
  Description of Artificial Sequence: Synthetic peptide
  Seed: FAFGEPREL (MAGC1_HUMAN)
FVFGEPREL

SEQ ID NO: 86545 - protein, 9 aa, Artificial Sequence
  Description of Artificial Sequence: Synthetic peptide
  Seed: SSPERTHST (MAGC1_HUMAN)
SQPERTHSF

SEQ ID NO: 86546 - protein, 10 aa, Artificial Sequence
  Description of Artificial Sequence: Synthetic peptide
  Seed: EMLTNVISRY (MAGC1_HUMAN)
ETLTNVISRM

SEQ ID NO: 86547 - protein, 11 aa, Artificial Sequence
  Description of Artificial Sequence: Synthetic peptide
  Seed: IIDTTDDSTAT (MAGC1_HUMAN)
IIDTTDDSTAL

SEQ ID NO: 86548 - protein, 9 aa, Artificial Sequence
  Description of Artificial Sequence: Synthetic peptide
  Seed: VQSPLHSPQ (MAGC1_HUMAN)
VASPLHSPF

SEQ ID NO: 86549 - protein, 9 aa, Artificial Sequence
  Description of Artificial Sequence: Synthetic peptide
  Seed: GMSQNRLLI (MAGC1_HUMAN)
GQSQNRLLI

SEQ ID NO: 86550 - protein, 10 aa, Artificial Sequence
  Description of Artificial Sequence: Synthetic peptide
  Seed: ISRYTGYFPV (MAGC1_HUMAN)
IERYTGYFPM

SEQ ID NO: 86551 - protein, 10 aa, Artificial Sequence
  Description of Artificial Sequence: Synthetic peptide
  Seed: SPLQNPASSF (MAGC1_HUMAN)
SQLQNPASSF

SEQ ID NO: 86552 - protein, 9 aa, Artificial Sequence
  Description of Artificial Sequence: Synthetic peptide
  Seed: RFLLLKYQV (MAGC1_HUMAN)
RWLLLKYQL

SEQ ID NO: 86553 - protein, 9 aa, Artificial Sequence
  Description of Artificial Sequence: Synthetic peptide
  Seed: SSPERTHST (MAGC1_HUMAN)
SNPERTHSM

SEQ ID NO: 86554 - protein, 11 aa, Artificial Sequence
  Description of Artificial Sequence: Synthetic peptide
  Seed: SSFPSSTSSSL (MAGC1_HUMAN)
SFFPSSTSSSL

SEQ ID NO: 86555 - protein, 11 aa, Artificial Sequence
  Description of Artificial Sequence: Synthetic peptide
  Seed: IPVSRSFSSTL (MAGC1_HUMAN)
ITVSRSFSSTY

SEQ ID NO: 86556 - protein, 9 aa, Artificial Sequence
  Description of Artificial Sequence: Synthetic peptide
  Seed: SFPSSTSSS (MAGC1_HUMAN)
SFPSSTSSL

SEQ ID NO: 86557 - protein, 9 aa, Artificial Sequence
  Description of Artificial Sequence: Synthetic peptide
  Seed: TFEGFPQSL (MAGC1_HUMAN)
TAEGFPQSV

SEQ ID NO: 86558 - protein, 9 aa, Artificial Sequence
  Description of Artificial Sequence: Synthetic peptide
  Seed: FSSTLVSLF (MAGC1_HUMAN)
FSSTLVSLL

SEQ ID NO: 86559 - protein, 9 aa, Artificial Sequence
  Description of Artificial Sequence: Synthetic peptide
  Seed: LQIVPSLPE (MAGC1_HUMAN)
LQIVPSLPA

SEQ ID NO: 86560 - protein, 9 aa, Artificial Sequence
  Description of Artificial Sequence: Synthetic peptide
  Seed: GMSQNRLLI (MAGC1_HUMAN)
GQSQNRLLW

SEQ ID NO: 86561 - protein, 11 aa, Artificial Sequence
  Description of Artificial Sequence: Synthetic peptide
  Seed: STFEGFAQSPL (MAGC1_HUMAN)
SQFEGFAQSPL

SEQ ID NO: 86562 - protein, 10 aa, Artificial Sequence
  Description of Artificial Sequence: Synthetic peptide
  Seed: MTSSFSSTLL (MAGC1_HUMAN)
MMSSFSSTLC

SEQ ID NO: 86563 - protein, 10 aa, Artificial Sequence
  Description of Artificial Sequence: Synthetic peptide
  Seed: KAEMLTNVIS (MAGC1_HUMAN)
KSEMLTNVIA

SEQ ID NO: 86564 - protein, 10 aa, Artificial Sequence
  Description of Artificial Sequence: Synthetic peptide
  Seed: VSSSSSSSTL (MAGC1_HUMAN)
VCSSSSSSTY

SEQ ID NO: 86565 - protein, 10 aa, Artificial Sequence
  Description of Artificial Sequence: Synthetic peptide
  Seed: MPTAGMPSLL (MAGC1_HUMAN)
MPTAGMPSLA

SEQ ID NO: 86566 - protein, 9 aa, Artificial Sequence
  Description of Artificial Sequence: Synthetic peptide
  Seed: EDFQSSLQS (MAGC1_HUMAN)
EEFQSSLQF

SEQ ID NO: 86567 - protein, 9 aa, Artificial Sequence
  Description of Artificial Sequence: Synthetic peptide
  Seed: KAREFIEIL (MAGC1_HUMAN)
KIREFIEIA

SEQ ID NO: 86568 - protein, 11 aa, Artificial Sequence
  Description of Artificial Sequence: Synthetic peptide
  Seed: FPVIFRKAREF (MAGC1_HUMAN)
FPVIFRKAREL

SEQ ID NO: 86569 - protein, 10 aa, Artificial Sequence
  Description of Artificial Sequence: Synthetic peptide
  Seed: SPLQRPVSSF (MAGC1_HUMAN)
SALQRPVSSY

SEQ ID NO: 86570 - protein, 10 aa, Artificial Sequence
  Description of Artificial Sequence: Synthetic peptide
  Seed: FAQSSLQIPV (MAGC1_HUMAN)
FGQSSLQIPV

SEQ ID NO: 86571 - protein, 10 aa, Artificial Sequence
  Description of Artificial Sequence: Synthetic peptide
  Seed: NSSPPRYEFL (MAGC1_HUMAN)
NTSPPRYEFW

SEQ ID NO: 86572 - protein, 9 aa, Artificial Sequence
  Description of Artificial Sequence: Synthetic peptide
  Seed: SSFFSSALL (MAGC1_HUMAN)
SMFFSSALL

SEQ ID NO: 86573 - protein, 9 aa, Artificial Sequence
  Description of Artificial Sequence: Synthetic peptide
  Seed: AQSPLQSPV (MAGC1_HUMAN)
ATSPLQSPL

SEQ ID NO: 86574 - protein, 11 aa, Artificial Sequence
  Description of Artificial Sequence: Synthetic peptide
  Seed: IPVSRSFSSTL (MAGC1_HUMAN)
ILVSRSFSSTF

SEQ ID NO: 86575 - protein, 9 aa, Artificial Sequence
  Description of Artificial Sequence: Synthetic peptide
  Seed: LQIPMTSSF (MAGC1_HUMAN)
LLIPMTSSM

SEQ ID NO: 86576 - protein, 9 aa, Artificial Sequence
  Description of Artificial Sequence: Synthetic peptide
  Seed: LQIPGSPSF (MAGC1_HUMAN)
LKIPGSPSF

SEQ ID NO: 86577 - protein, 9 aa, Artificial Sequence
  Description of Artificial Sequence: Synthetic peptide
  Seed: SSPEGKDSL (MAGC1_HUMAN)
SQPEGKDSL

SEQ ID NO: 86578 - protein, 9 aa, Artificial Sequence
  Description of Artificial Sequence: Synthetic peptide
  Seed: MLTNVISRY (MAGC1_HUMAN)
MWTNVISRY

SEQ ID NO: 86579 - protein, 9 aa, Artificial Sequence
  Description of Artificial Sequence: Synthetic peptide
  Seed: NVISRYTGY (MAGC1_HUMAN)
NVISRYTGF

SEQ ID NO: 86580 - protein, 9 aa, Artificial Sequence
  Description of Artificial Sequence: Synthetic peptide
  Seed: YQVKQPITK (MAGC1_HUMAN)
YTVKQPITM

SEQ ID NO: 86581 - protein, 9 aa, Artificial Sequence
  Description of Artificial Sequence: Synthetic peptide
  Seed: LQIVPSLPE (MAGC1_HUMAN)
LQIVPSLPF

SEQ ID NO: 86582 - protein, 9 aa, Artificial Sequence
  Description of Artificial Sequence: Synthetic peptide
  Seed: YTLLSLFQS (MAGC1_HUMAN)
YALLSLFQL

SEQ ID NO: 86583 - protein, 11 aa, Artificial Sequence
  Description of Artificial Sequence: Synthetic peptide
  Seed: RPVSSFFSYTL (MAGC1_HUMAN)
RFVSSFFSYTW

SEQ ID NO: 86584 - protein, 10 aa, Artificial Sequence
  Description of Artificial Sequence: Synthetic peptide
  Seed: SSFSYTLLSL (MAGC1_HUMAN)
SYFSYTLLSL

SEQ ID NO: 86585 - protein, 10 aa, Artificial Sequence
  Description of Artificial Sequence: Synthetic peptide
  Seed: VSSSSSSSTL (MAGC1_HUMAN)
VPSSSSSSTW

SEQ ID NO: 86586 - protein, 9 aa, Artificial Sequence
  Description of Artificial Sequence: Synthetic peptide
  Seed: MSQNRLLIL (MAGC1_HUMAN)
MLQNRLLIL

SEQ ID NO: 86587 - protein, 9 aa, Artificial Sequence
  Description of Artificial Sequence: Synthetic peptide
  Seed: MPTAGMPSL (MAGC1_HUMAN)
MPTAGMPSC

SEQ ID NO: 86588 - protein, 10 aa, Artificial Sequence
  Description of Artificial Sequence: Synthetic peptide
  Seed: ASSSVMSPSF (MAGC1_HUMAN)
AHSSVMSPSW

SEQ ID NO: 86589 - protein, 9 aa, Artificial Sequence
  Description of Artificial Sequence: Synthetic peptide
  Seed: RLLILILSI (MAGC1_HUMAN)
RALILILSL

SEQ ID NO: 86590 - protein, 11 aa, Artificial Sequence
  Description of Artificial Sequence: Synthetic peptide
  Seed: TLDEKVDELAR (MAGC1_HUMAN)
TIDEKVDELAL

SEQ ID NO: 86591 - protein, 10 aa, Artificial Sequence
  Description of Artificial Sequence: Synthetic peptide
  Seed: YTLDEKVDEL (MAGC1_HUMAN)
YILDEKVDEF

SEQ ID NO: 86592 - protein, 9 aa, Artificial Sequence
  Description of Artificial Sequence: Synthetic peptide
  Seed: ASSSTLVSI (MAGC1_HUMAN)
AASSTLVSH

SEQ ID NO: 86593 - protein, 10 aa, Artificial Sequence
  Description of Artificial Sequence: Synthetic peptide
  Seed: AEMLTNVISR (MAGC1_HUMAN)
AMMLTNVISK

SEQ ID NO: 86594 - protein, 10 aa, Artificial Sequence
  Description of Artificial Sequence: Synthetic peptide
  Seed: VSPSSSSTLL (MAGC1_HUMAN)
VTPSSSSTLF

SEQ ID NO: 86595 - protein, 11 aa, Artificial Sequence
  Description of Artificial Sequence: Synthetic peptide
  Seed: VSSSSSSSTLL (MAGC1_HUMAN)
VSSSSSSSTLW

SEQ ID NO: 86596 - protein, 11 aa, Artificial Sequence
  Description of Artificial Sequence: Synthetic peptide
  Seed: SLSQSSPVSSF (MAGC1_HUMAN)
SLSQSSPVSSY

SEQ ID NO: 86597 - protein, 10 aa, Artificial Sequence
  Description of Artificial Sequence: Synthetic peptide
  Seed: MPTAGMPSLL (MAGC1_HUMAN)
MTTAGMPSLA

SEQ ID NO: 86598 - protein, 9 aa, Artificial Sequence
  Description of Artificial Sequence: Synthetic peptide
  Seed: HFPQSPPEW (MAGC1_HUMAN)
HSPQSPPEY

SEQ ID NO: 86599 - protein, 10 aa, Artificial Sequence
  Description of Artificial Sequence: Synthetic peptide
  Seed: REFIEILFGI (MAGC1_HUMAN)
RLFIEILFGC

SEQ ID NO: 86600 - protein, 10 aa, Artificial Sequence
  Description of Artificial Sequence: Synthetic peptide
  Seed: SFPSSTSSSL (MAGC1_HUMAN)
SAPSSTSSSL

SEQ ID NO: 86601 - protein, 9 aa, Artificial Sequence
  Description of Artificial Sequence: Synthetic peptide
  Seed: CTQSTFEGF (MAGC1_HUMAN)
CYQSTFEGV

SEQ ID NO: 86602 - protein, 9 aa, Artificial Sequence
  Description of Artificial Sequence: Synthetic peptide
  Seed: SGIGVRAGR (MAGC1_HUMAN)
SMIGVRAGK

SEQ ID NO: 86603 - protein, 9 aa, Artificial Sequence
  Description of Artificial Sequence: Synthetic peptide
  Seed: RTHSTFEGF (MAGC1_HUMAN)
RLHSTFEGK

SEQ ID NO: 86604 - protein, 10 aa, Artificial Sequence
  Description of Artificial Sequence: Synthetic peptide
  Seed: ISRYTGYFPV (MAGC1_HUMAN)
IERYTGYFPF

SEQ ID NO: 86605 - protein, 9 aa, Artificial Sequence
  Description of Artificial Sequence: Synthetic peptide
  Seed: ISRYTGYFP (MAGC1_HUMAN)
ISRYTGYFV

SEQ ID NO: 86606 - protein, 9 aa, Artificial Sequence
  Description of Artificial Sequence: Synthetic peptide
  Seed: FSSTLLSLF (MAGC1_HUMAN)
FSSTLLSLI

SEQ ID NO: 86607 - protein, 10 aa, Artificial Sequence
  Description of Artificial Sequence: Synthetic peptide
  Seed: SSSSSTLLSL (MAGC1_HUMAN)
SFSSSTLLSW

SEQ ID NO: 86608 - protein, 10 aa, Artificial Sequence
  Description of Artificial Sequence: Synthetic peptide
  Seed: SFPSSTSSSL (MAGC1_HUMAN)
SLPSSTSSSF

SEQ ID NO: 86609 - protein, 10 aa, Artificial Sequence
  Description of Artificial Sequence: Synthetic peptide
  Seed: SSPESTQSPF (MAGC1_HUMAN)
SMPESTQSPL

SEQ ID NO: 86610 - protein, 9 aa, Artificial Sequence
  Description of Artificial Sequence: Synthetic peptide
  Seed: SIIFIKGTY (MAGC1_HUMAN)
SLIFIKGTF

SEQ ID NO: 86611 - protein, 9 aa, Artificial Sequence
  Description of Artificial Sequence: Synthetic peptide
  Seed: FAFGEPREL (MAGC1_HUMAN)
FSFGEPREI

SEQ ID NO: 86612 - protein, 9 aa, Artificial Sequence
  Description of Artificial Sequence: Synthetic peptide
  Seed: SPLQSPVSS (MAGC1_HUMAN)
STLQSPVSM

SEQ ID NO: 86613 - protein, 9 aa, Artificial Sequence
  Description of Artificial Sequence: Synthetic peptide
  Seed: FSSALLSIF (MAGC1_HUMAN)
FQSALLSIH

SEQ ID NO: 86614 - protein, 10 aa, Artificial Sequence
  Description of Artificial Sequence: Synthetic peptide
  Seed: SSSSSTLLSL (MAGC1_HUMAN)
SSSSSTLLSF

SEQ ID NO: 86615 - protein, 11 aa, Artificial Sequence
  Description of Artificial Sequence: Synthetic peptide
  Seed: SSSSSSTLLSL (MAGC1_HUMAN)
SCSSSSTLLSF

SEQ ID NO: 86616 - protein, 9 aa, Artificial Sequence
  Description of Artificial Sequence: Synthetic peptide
  Seed: TLDEKVDEL (MAGC1_HUMAN)
TLDEKVDEC

SEQ ID NO: 86617 - protein, 9 aa, Artificial Sequence
  Description of Artificial Sequence: Synthetic peptide
  Seed: VIKRKVVEF (MAGC1_HUMAN)
VVKRKVVEL

SEQ ID NO: 86618 - protein, 10 aa, Artificial Sequence
  Description of Artificial Sequence: Synthetic peptide
  Seed: SFSSTLVSLF (MAGC1_HUMAN)
SFSSTLVSLW

SEQ ID NO: 86619 - protein, 10 aa, Artificial Sequence
  Description of Artificial Sequence: Synthetic peptide
  Seed: ICSSSTSLSL (MAGC1_HUMAN)
IGSSSTSLSW

SEQ ID NO: 86620 - protein, 10 aa, Artificial Sequence
  Description of Artificial Sequence: Synthetic peptide
  Seed: SPLQRPVSSF (MAGC1_HUMAN)
SPLQRPVSSA

SEQ ID NO: 86621 - protein, 10 aa, Artificial Sequence
  Description of Artificial Sequence: Synthetic peptide
  Seed: VISFSSSTSL (MAGC1_HUMAN)
VISFSSSTSW

SEQ ID NO: 86622 - protein, 9 aa, Artificial Sequence
  Description of Artificial Sequence: Synthetic peptide
  Seed: AGREHFAFG (MAGC1_HUMAN)
ATREHFAFK

SEQ ID NO: 86623 - protein, 10 aa, Artificial Sequence
  Description of Artificial Sequence: Synthetic peptide
  Seed: FSSSTSLSPF (MAGC1_HUMAN)
FPSSTSLSPF

SEQ ID NO: 86624 - protein, 10 aa, Artificial Sequence
  Description of Artificial Sequence: Synthetic peptide
  Seed: ISRYTGYFPV (MAGC1_HUMAN)
IVRYTGYFPF

SEQ ID NO: 86625 - protein, 9 aa, Artificial Sequence
  Description of Artificial Sequence: Synthetic peptide
  Seed: CSSSTPSSL (MAGC1_HUMAN)
CQSSTPSSM

SEQ ID NO: 86626 - protein, 9 aa, Artificial Sequence
  Description of Artificial Sequence: Synthetic peptide
  Seed: SSPERTHST (MAGC1_HUMAN)
STPERTHSY

SEQ ID NO: 86627 - protein, 10 aa, Artificial Sequence
  Description of Artificial Sequence: Synthetic peptide
  Seed: TFPSSYKDAL (MAGC1_HUMAN)
TYPSSYKDAM

SEQ ID NO: 86628 - protein, 9 aa, Artificial Sequence
  Description of Artificial Sequence: Synthetic peptide
  Seed: TLDEKVDEL (MAGC1_HUMAN)
TVDEKVDEV

SEQ ID NO: 86629 - protein, 9 aa, Artificial Sequence
  Description of Artificial Sequence: Synthetic peptide
  Seed: LQIPVSSSS (MAGC1_HUMAN)
LTIPVSSSV

SEQ ID NO: 86630 - protein, 9 aa, Artificial Sequence
  Description of Artificial Sequence: Synthetic peptide
  Seed: SPLQSPVSS (MAGC1_HUMAN)
SSLQSPVSF

SEQ ID NO: 86631 - protein, 9 aa, Artificial Sequence
  Description of Artificial Sequence: Synthetic peptide
  Seed: FPSSTSSSL (MAGC1_HUMAN)
FISSTSSSM

SEQ ID NO: 86632 - protein, 11 aa, Artificial Sequence
  Description of Artificial Sequence: Synthetic peptide
  Seed: SPLQIPVSRSF (MAGC1_HUMAN)
SRLQIPVSRSY

SEQ ID NO: 86633 - protein, 9 aa, Artificial Sequence
  Description of Artificial Sequence: Synthetic peptide
  Seed: YVFVNTLDL (MAGC1_HUMAN)
YPFVNTLDF

SEQ ID NO: 86634 - protein, 9 aa, Artificial Sequence
  Description of Artificial Sequence: Synthetic peptide
  Seed: STFEGFPQS (MAGC1_HUMAN)
SAFEGFPQV

SEQ ID NO: 86635 - protein, 9 aa, Artificial Sequence
  Description of Artificial Sequence: Synthetic peptide
  Seed: SSPESAQSA (MAGC1_HUMAN)
SGPESAQSF

SEQ ID NO: 86636 - protein, 9 aa, Artificial Sequence
  Description of Artificial Sequence: Synthetic peptide
  Seed: RELLTKVWV (MAGC1_HUMAN)
RQLLTKVWV

SEQ ID NO: 86637 - protein, 10 aa, Artificial Sequence
  Description of Artificial Sequence: Synthetic peptide
  Seed: RSFSSTLLSI (MAGC1_HUMAN)
REFSSTLLSI

SEQ ID NO: 86638 - protein, 11 aa, Artificial Sequence
  Description of Artificial Sequence: Synthetic peptide
  Seed: IPMTSSFSSTL (MAGC1_HUMAN)
ISMTSSFSSTW

SEQ ID NO: 86639 - protein, 10 aa, Artificial Sequence
  Description of Artificial Sequence: Synthetic peptide
  Seed: MTSSFSSTLL (MAGC1_HUMAN)
MKSSFSSTLY

SEQ ID NO: 86640 - protein, 8 aa, Artificial Sequence
  Description of Artificial Sequence: Synthetic peptide
  Seed: AFGEPREL (MAGC1_HUMAN)
AAGEPREM

SEQ ID NO: 86641 - protein, 11 aa, Artificial Sequence
  Description of Artificial Sequence: Synthetic peptide
  Seed: SSSFSYTLLSL (MAGC1_HUMAN)
SRSFSYTLLSY

SEQ ID NO: 86642 - protein, 11 aa, Artificial Sequence
  Description of Artificial Sequence: Synthetic peptide
  Seed: SSFSYTLLSLF (MAGC1_HUMAN)
SRFSYTLLSLW

SEQ ID NO: 86643 - protein, 10 aa, Artificial Sequence
  Description of Artificial Sequence: Synthetic peptide
  Seed: SSSSSTLLSL (MAGC1_HUMAN)
SASSSTLLSF

SEQ ID NO: 86644 - protein, 9 aa, Artificial Sequence
  Description of Artificial Sequence: Synthetic peptide
  Seed: SLFQSFSER (MAGC1_HUMAN)
SAFQSFSEK

SEQ ID NO: 86645 - protein, 10 aa, Artificial Sequence
  Description of Artificial Sequence: Synthetic peptide
  Seed: MTSSFSSTLL (MAGC1_HUMAN)
MISSFSSTLA

SEQ ID NO: 86646 - protein, 9 aa, Artificial Sequence
  Description of Artificial Sequence: Synthetic peptide
  Seed: VSAASSSTL (MAGC1_HUMAN)
VHAASSSTM

SEQ ID NO: 86647 - protein, 9 aa, Artificial Sequence
  Description of Artificial Sequence: Synthetic peptide
  Seed: SPPEGENTH (MAGC1_HUMAN)
SIPEGENTM

SEQ ID NO: 86648 - protein, 9 aa, Artificial Sequence
  Description of Artificial Sequence: Synthetic peptide
  Seed: LQIPVSAAS (MAGC1_HUMAN)
LLIPVSAAM

SEQ ID NO: 86649 - protein, 8 aa, Artificial Sequence
  Description of Artificial Sequence: Synthetic peptide
  Seed: IWDVLSGI (MAGC1_HUMAN)
IYDVLSGL

SEQ ID NO: 86650 - protein, 10 aa, Artificial Sequence
  Description of Artificial Sequence: Synthetic peptide
  Seed: SSFSSTLLSI (MAGC1_HUMAN)
SIFSSTLLSI

SEQ ID NO: 86651 - protein, 11 aa, Artificial Sequence
  Description of Artificial Sequence: Synthetic peptide
  Seed: SFFSSALLSIF (MAGC1_HUMAN)
SQFSSALLSIY

SEQ ID NO: 86652 - protein, 9 aa, Artificial Sequence
  Description of Artificial Sequence: Synthetic peptide
  Seed: TLDEKVDEL (MAGC1_HUMAN)
TADEKVDEW

SEQ ID NO: 86653 - protein, 9 aa, Artificial Sequence
  Description of Artificial Sequence: Synthetic peptide
  Seed: STFEGFAQS (MAGC1_HUMAN)
SIFEGFAQC

SEQ ID NO: 86654 - protein, 9 aa, Artificial Sequence
  Description of Artificial Sequence: Synthetic peptide
  Seed: EGDDTQSPL (MAGC1_HUMAN)
ELDDTQSPM

SEQ ID NO: 86655 - protein, 9 aa, Artificial Sequence
  Description of Artificial Sequence: Synthetic peptide
  Seed: VSSSSSSTL (MAGC1_HUMAN)
VQSSSSSTL

SEQ ID NO: 86656 - protein, 9 aa, Artificial Sequence
  Description of Artificial Sequence: Synthetic peptide
  Seed: RSFSSTLLS (MAGC1_HUMAN)
RAFSSTLLM

SEQ ID NO: 86657 - protein, 10 aa, Artificial Sequence
  Description of Artificial Sequence: Synthetic peptide
  Seed: SLQIPVSPSF (MAGC1_HUMAN)
SMQIPVSPSF

SEQ ID NO: 86658 - protein, 9 aa, Artificial Sequence
  Description of Artificial Sequence: Synthetic peptide
  Seed: TLLSLFQSF (MAGC1_HUMAN)
TVLSLFQSW

SEQ ID NO: 86659 - protein, 11 aa, Artificial Sequence
  Description of Artificial Sequence: Synthetic peptide
  Seed: SFFSSALLSIF (MAGC1_HUMAN)
SAFSSALLSIF

SEQ ID NO: 86660 - protein, 9 aa, Artificial Sequence
  Description of Artificial Sequence: Synthetic peptide
  Seed: ISFSSSTSL (MAGC1_HUMAN)
ILFSSSTSM

SEQ ID NO: 86661 - protein, 9 aa, Artificial Sequence
  Description of Artificial Sequence: Synthetic peptide
  Seed: FSSTLLSLF (MAGC1_HUMAN)
FPSTLLSLF

SEQ ID NO: 86662 - protein, 11 aa, Artificial Sequence
  Description of Artificial Sequence: Synthetic peptide
  Seed: LQRPVSSFFSY (MAGC1_HUMAN)
LGRPVSSFFSY

SEQ ID NO: 86663 - protein, 10 aa, Artificial Sequence
  Description of Artificial Sequence: Synthetic peptide
  Seed: IPVSSSFSYT (MAGC1_HUMAN)
IPVSSSFSYM

SEQ ID NO: 86664 - protein, 10 aa, Artificial Sequence
  Description of Artificial Sequence: Synthetic peptide
  Seed: QRPVSSFFSY (MAGC1_HUMAN)
QPPVSSFFSY

SEQ ID NO: 86665 - protein, 10 aa, Artificial Sequence
  Description of Artificial Sequence: Synthetic peptide
  Seed: REFIEILFGI (MAGC1_HUMAN)
RCFIEILFGF

SEQ ID NO: 86666 - protein, 9 aa, Artificial Sequence
  Description of Artificial Sequence: Synthetic peptide
  Seed: CSSSTSLSL (MAGC1_HUMAN)
CQSSTSLSI

SEQ ID NO: 86667 - protein, 9 aa, Artificial Sequence
  Description of Artificial Sequence: Synthetic peptide
  Seed: KVDELARFL (MAGC1_HUMAN)
KLDELARFA

SEQ ID NO: 86668 - protein, 11 aa, Artificial Sequence
  Description of Artificial Sequence: Synthetic peptide
  Seed: SPLQIPGSPSF (MAGC1_HUMAN)
SALQIPGSPSF

SEQ ID NO: 86669 - protein, 10 aa, Artificial Sequence
  Description of Artificial Sequence: Synthetic peptide
  Seed: FSSSTSLSPF (MAGC1_HUMAN)
FMSSTSLSPM

SEQ ID NO: 86670 - protein, 9 aa, Artificial Sequence
  Description of Artificial Sequence: Synthetic peptide
  Seed: REVDPDDSY (MAGC1_HUMAN)
RMVDPDDSM

SEQ ID NO: 86671 - protein, 9 aa, Artificial Sequence
  Description of Artificial Sequence: Synthetic peptide
  Seed: THSPLQIVP (MAGC1_HUMAN)
THSPLQIVM

SEQ ID NO: 86672 - protein, 10 aa, Artificial Sequence
  Description of Artificial Sequence: Synthetic peptide
  Seed: LSQSSPVSSF (MAGC1_HUMAN)
LLQSSPVSSF

SEQ ID NO: 86673 - protein, 10 aa, Artificial Sequence
  Description of Artificial Sequence: Synthetic peptide
  Seed: KRKVVEFLAM (MAGC1_HUMAN)
KAKVVEFLAF

SEQ ID NO: 86674 - protein, 10 aa, Artificial Sequence
  Description of Artificial Sequence: Synthetic peptide
  Seed: SPLQIPGSPS (MAGC1_HUMAN)
SPLQIPGSPT

SEQ ID NO: 86675 - protein, 10 aa, Artificial Sequence
  Description of Artificial Sequence: Synthetic peptide
  Seed: EILFGISLRE (MAGC1_HUMAN)
ESLFGISLRR

SEQ ID NO: 86676 - protein, 11 aa, Artificial Sequence
  Description of Artificial Sequence: Synthetic peptide
  Seed: LQIPVSSSFSY (MAGC1_HUMAN)
LNIPVSSSFSF

SEQ ID NO: 86677 - protein, 9 aa, Artificial Sequence
  Description of Artificial Sequence: Synthetic peptide
  Seed: FFSYTLASL (MAGC1_HUMAN)
FRSYTLASM

SEQ ID NO: 86678 - protein, 9 aa, Artificial Sequence
  Description of Artificial Sequence: Synthetic peptide
  Seed: TFEGFPQSL (MAGC1_HUMAN)
TPEGFPQSL

SEQ ID NO: 86679 - protein, 9 aa, Artificial Sequence
  Description of Artificial Sequence: Synthetic peptide
  Seed: VISRYTGYF (MAGC1_HUMAN)
VKSRYTGYY

SEQ ID NO: 86680 - protein, 9 aa, Artificial Sequence
  Description of Artificial Sequence: Synthetic peptide
  Seed: SSPERTQST (MAGC1_HUMAN)
SYPERTQSM

SEQ ID NO: 86681 - protein, 9 aa, Artificial Sequence
  Description of Artificial Sequence: Synthetic peptide
  Seed: WVQEHYLEY (MAGC1_HUMAN)
WYQEHYLEF

SEQ ID NO: 86682 - protein, 10 aa, Artificial Sequence
  Description of Artificial Sequence: Synthetic peptide
  Seed: MLKNTVPITF (MAGC1_HUMAN)
MAKNTVPITM

SEQ ID NO: 86683 - protein, 9 aa, Artificial Sequence
  Description of Artificial Sequence: Synthetic peptide
  Seed: EGDDTQSPL (MAGC1_HUMAN)
EFDDTQSPM

SEQ ID NO: 86684 - protein, 11 aa, Artificial Sequence
  Description of Artificial Sequence: Synthetic peptide
  Seed: IPMTSSFSSTL (MAGC1_HUMAN)
ITMTSSFSSTY

SEQ ID NO: 86685 - protein, 9 aa, Artificial Sequence
  Description of Artificial Sequence: Synthetic peptide
  Seed: LQSPVISFS (MAGC1_HUMAN)
LVSPVISFA

SEQ ID NO: 86686 - protein, 10 aa, Artificial Sequence
  Description of Artificial Sequence: Synthetic peptide
  Seed: WGPRAHSEVI (MAGC1_HUMAN)
WKPRAHSEVV

SEQ ID NO: 86687 - protein, 9 aa, Artificial Sequence
  Description of Artificial Sequence: Synthetic peptide
  Seed: LQSPVISFS (MAGC1_HUMAN)
LLSPVISFA

SEQ ID NO: 86688 - protein, 9 aa, Artificial Sequence
  Description of Artificial Sequence: Synthetic peptide
  Seed: IEILFGISL (MAGC1_HUMAN)
ILILFGISF

SEQ ID NO: 86689 - protein, 9 aa, Artificial Sequence
  Description of Artificial Sequence: Synthetic peptide
  Seed: YTLASLLQS (MAGC1_HUMAN)
YILASLLQV

SEQ ID NO: 86690 - protein, 9 aa, Artificial Sequence
  Description of Artificial Sequence: Synthetic peptide
  Seed: SAQSAFEGF (MAGC1_HUMAN)
SQQSAFEGI

SEQ ID NO: 86691 - protein, 9 aa, Artificial Sequence
  Description of Artificial Sequence: Synthetic peptide
  Seed: NSSPPRYEF (MAGC1_HUMAN)
NVSPPRYEF

SEQ ID NO: 86692 - protein, 9 aa, Artificial Sequence
  Description of Artificial Sequence: Synthetic peptide
  Seed: SQSPPEGPV (MAGC1_HUMAN)
SASPPEGPI

SEQ ID NO: 86693 - protein, 10 aa, Artificial Sequence
  Description of Artificial Sequence: Synthetic peptide
  Seed: REVPNSSPPR (MAGC1_HUMAN)
RLVPNSSPPR

SEQ ID NO: 86694 - protein, 10 aa, Artificial Sequence
  Description of Artificial Sequence: Synthetic peptide
  Seed: LQGEEFQSSL (MAGC1_HUMAN)
LMGEEFQSSV

SEQ ID NO: 86695 - protein, 11 aa, Artificial Sequence
  Description of Artificial Sequence: Synthetic peptide
  Seed: SFFSYTLASLL (MAGC1_HUMAN)
SWFSYTLASLY

SEQ ID NO: 86696 - protein, 9 aa, Artificial Sequence
  Description of Artificial Sequence: Synthetic peptide
  Seed: FFSYTLASL (MAGC1_HUMAN)
FLSYTLASA

SEQ ID NO: 86697 - protein, 11 aa, Artificial Sequence
  Description of Artificial Sequence: Synthetic peptide
  Seed: SPLQIPVSSSS (MAGC1_HUMAN)
SWLQIPVSSSY

SEQ ID NO: 86698 - protein, 9 aa, Artificial Sequence
  Description of Artificial Sequence: Synthetic peptide
  Seed: EFIEILFGI (MAGC1_HUMAN)
EIIEILFGA

SEQ ID NO: 86699 - protein, 8 aa, Artificial Sequence
  Description of Artificial Sequence: Synthetic peptide
  Seed: LYFPQSPL (MAGC1_HUMAN)
LFFPQSPM

SEQ ID NO: 86700 - protein, 10 aa, Artificial Sequence
  Description of Artificial Sequence: Synthetic peptide
  Seed: MTSSFSSTLL (MAGC1_HUMAN)
MHSSFSSTLW

SEQ ID NO: 86701 - protein, 9 aa, Artificial Sequence
  Description of Artificial Sequence: Synthetic peptide
  Seed: RKVVEFLAM (MAGC1_HUMAN)
RRVVEFLAM

SEQ ID NO: 86702 - protein, 11 aa, Artificial Sequence
  Description of Artificial Sequence: Synthetic peptide
  Seed: TLYPLQSPQSR (MAGC1_HUMAN)
TTYPLQSPQSK

SEQ ID NO: 86703 - protein, 9 aa, Artificial Sequence
  Description of Artificial Sequence: Synthetic peptide
  Seed: FSYTLLSLF (MAGC1_HUMAN)
FGYTLLSLY

SEQ ID NO: 86704 - protein, 11 aa, Artificial Sequence
  Description of Artificial Sequence: Synthetic peptide
  Seed: FLAMLKNTVPI (MAGC1_HUMAN)
FVAMLKNTVPV

SEQ ID NO: 86705 - protein, 9 aa, Artificial Sequence
  Description of Artificial Sequence: Synthetic peptide
  Seed: ISFSSSTSL (MAGC1_HUMAN)
IQFSSSTSC

SEQ ID NO: 86706 - protein, 9 aa, Artificial Sequence
  Description of Artificial Sequence: Synthetic peptide
  Seed: MPTAGMPSL (MAGC1_HUMAN)
MVTAGMPSY

SEQ ID NO: 86707 - protein, 9 aa, Artificial Sequence
  Description of Artificial Sequence: Synthetic peptide
  Seed: VSSFFSYTL (MAGC1_HUMAN)
VVSFFSYTV

SEQ ID NO: 86708 - protein, 10 aa, Artificial Sequence
  Description of Artificial Sequence: Synthetic peptide
  Seed: SFSSTLLSIF (MAGC1_HUMAN)
SISSTLLSIY

SEQ ID NO: 86709 - protein, 9 aa, Artificial Sequence
  Description of Artificial Sequence: Synthetic peptide
  Seed: RTHSTFEGF (MAGC1_HUMAN)
RVHSTFEGL

SEQ ID NO: 86710 - protein, 9 aa, Artificial Sequence
  Description of Artificial Sequence: Synthetic peptide
  Seed: SSSDTLLES (MAGC1_HUMAN)
STSDTLLEL

SEQ ID NO: 86711 - protein, 11 aa, Artificial Sequence
  Description of Artificial Sequence: Synthetic peptide
  Seed: SPLQIPMTSSF (MAGC1_HUMAN)
SELQIPMTSSF

SEQ ID NO: 86712 - protein, 9 aa, Artificial Sequence
  Description of Artificial Sequence: Synthetic peptide
  Seed: SSPERTQST (MAGC1_HUMAN)
SGPERTQSY

SEQ ID NO: 86713 - protein, 9 aa, Artificial Sequence
  Description of Artificial Sequence: Synthetic peptide
  Seed: VSSSFSYTL (MAGC1_HUMAN)
VISSFSYTI

SEQ ID NO: 86714 - protein, 9 aa, Artificial Sequence
  Description of Artificial Sequence: Synthetic peptide
  Seed: SLSPFSEES (MAGC1_HUMAN)
SASPFSEEV

SEQ ID NO: 86715 - protein, 9 aa, Artificial Sequence
  Description of Artificial Sequence: Synthetic peptide
  Seed: GFPQSVLQI (MAGC1_HUMAN)
GSPQSVLQL

SEQ ID NO: 86716 - protein, 10 aa, Artificial Sequence
  Description of Artificial Sequence: Synthetic peptide
  Seed: KVVEFLAMLK (MAGC1_HUMAN)
KSVEFLAMLK

SEQ ID NO: 86717 - protein, 11 aa, Artificial Sequence
  Description of Artificial Sequence: Synthetic peptide
  Seed: SLFQSSPERTH (MAGC1_HUMAN)
SAFQSSPERTL

SEQ ID NO: 86718 - protein, 10 aa, Artificial Sequence
  Description of Artificial Sequence: Synthetic peptide
  Seed: IIDTTDDSTA (MAGC1_HUMAN)
ILDTTDDSTL

SEQ ID NO: 86719 - protein, 10 aa, Artificial Sequence
  Description of Artificial Sequence: Synthetic peptide
  Seed: ISRYTGYFPV (MAGC1_HUMAN)
IRRYTGYFPR

SEQ ID NO: 86720 - protein, 9 aa, Artificial Sequence
  Description of Artificial Sequence: Synthetic peptide
  Seed: VSPSSSSTL (MAGC1_HUMAN)
VFPSSSSTY

SEQ ID NO: 86721 - protein, 8 aa, Artificial Sequence
  Description of Artificial Sequence: Synthetic peptide
  Seed: SSFFSSAL (MAGC1_HUMAN)
SAFFSSAY

SEQ ID NO: 86722 - protein, 10 aa, Artificial Sequence
  Description of Artificial Sequence: Synthetic peptide
  Seed: YASEEVIWDV (MAGC1_HUMAN)
YISEEVIWDA

SEQ ID NO: 86723 - protein, 9 aa, Artificial Sequence
  Description of Artificial Sequence: Synthetic peptide
  Seed: SSLSQSSPV (MAGC1_HUMAN)
SQLSQSSPL

SEQ ID NO: 86724 - protein, 9 aa, Artificial Sequence
  Description of Artificial Sequence: Synthetic peptide
  Seed: SSSTLVSIF (MAGC1_HUMAN)
SPSTLVSIY

SEQ ID NO: 86725 - protein, 9 aa, Artificial Sequence
  Description of Artificial Sequence: Synthetic peptide
  Seed: KAREFIEIL (MAGC1_HUMAN)
KFREFIEIL

SEQ ID NO: 86726 - protein, 9 aa, Artificial Sequence
  Description of Artificial Sequence: Synthetic peptide
  Seed: VSRSFSSTL (MAGC1_HUMAN)
VPRSFSSTF

SEQ ID NO: 86727 - protein, 9 aa, Artificial Sequence
  Description of Artificial Sequence: Synthetic peptide
  Seed: FSSALLSIF (MAGC1_HUMAN)
FPSALLSIH

SEQ ID NO: 86728 - protein, 9 aa, Artificial Sequence
  Description of Artificial Sequence: Synthetic peptide
  Seed: LQIPVSRSF (MAGC1_HUMAN)
LAIPVSRSI

SEQ ID NO: 86729 - protein, 10 aa, Artificial Sequence
  Description of Artificial Sequence: Synthetic peptide
  Seed: ESAQSTFEGF (MAGC1_HUMAN)
EIAQSTFEGK

SEQ ID NO: 86730 - protein, 9 aa, Artificial Sequence
  Description of Artificial Sequence: Synthetic peptide
  Seed: VSPSFSSTL (MAGC1_HUMAN)
VAPSFSSTI

SEQ ID NO: 86731 - protein, 9 aa, Artificial Sequence
  Description of Artificial Sequence: Synthetic peptide
  Seed: TLVSIFQSS (MAGC1_HUMAN)
TIVSIFQSM

SEQ ID NO: 86732 - protein, 11 aa, Artificial Sequence
  Description of Artificial Sequence: Synthetic peptide
  Seed: STFEGFPQSLL (MAGC1_HUMAN)
SAFEGFPQSLW

SEQ ID NO: 86733 - protein, 9 aa, Artificial Sequence
  Description of Artificial Sequence: Synthetic peptide
  Seed: LQIPVSSSS (MAGC1_HUMAN)
LVIPVSSSL

SEQ ID NO: 86734 - protein, 9 aa, Artificial Sequence
  Description of Artificial Sequence: Synthetic peptide
  Seed: SFSSTLVSL (MAGC1_HUMAN)
SLSSTLVSV

SEQ ID NO: 86735 - protein, 9 aa, Artificial Sequence
  Description of Artificial Sequence: Synthetic peptide
  Seed: LQIPGSPSF (MAGC1_HUMAN)
LIIPGSPSY

SEQ ID NO: 86736 - protein, 9 aa, Artificial Sequence
  Description of Artificial Sequence: Synthetic peptide
  Seed: REVDPDDSY (MAGC1_HUMAN)
RMVDPDDSF

SEQ ID NO: 86737 - protein, 9 aa, Artificial Sequence
  Description of Artificial Sequence: Synthetic peptide
  Seed: VSSSFSYTL (MAGC1_HUMAN)
VLSSFSYTF

SEQ ID NO: 86738 - protein, 9 aa, Artificial Sequence
  Description of Artificial Sequence: Synthetic peptide
  Seed: TLLSLFQSF (MAGC1_HUMAN)
TWLSLFQSI

SEQ ID NO: 86739 - protein, 9 aa, Artificial Sequence
  Description of Artificial Sequence: Synthetic peptide
  Seed: ISFSSSTSL (MAGC1_HUMAN)
IMFSSSTSH

SEQ ID NO: 86740 - protein, 11 aa, Artificial Sequence
  Description of Artificial Sequence: Synthetic peptide
  Seed: SPLQSPVSSFP (MAGC1_HUMAN)
SPLQSPVSSFA

SEQ ID NO: 86741 - protein, 10 aa, Artificial Sequence
  Description of Artificial Sequence: Synthetic peptide
  Seed: SFPSSTSSSL (MAGC1_HUMAN)
SQPSSTSSSI

SEQ ID NO: 86742 - protein, 9 aa, Artificial Sequence
  Description of Artificial Sequence: Synthetic peptide
  Seed: FPSSYKDAL (MAGC1_HUMAN)
FHSSYKDAA

SEQ ID NO: 86743 - protein, 11 aa, Artificial Sequence
  Description of Artificial Sequence: Synthetic peptide
  Seed: EGEDSSDPLQR (MAGC1_HUMAN)
ESEDSSDPLQY

SEQ ID NO: 86744 - protein, 9 aa, Artificial Sequence
  Description of Artificial Sequence: Synthetic peptide
  Seed: SFPSSTSSS (MAGC1_HUMAN)
SVPSSTSSM

SEQ ID NO: 86745 - protein, 9 aa, Artificial Sequence
  Description of Artificial Sequence: Synthetic peptide
  Seed: YTGYFPVIF (MAGC1_HUMAN)
YWGYFPVII

SEQ ID NO: 86746 - protein, 10 aa, Artificial Sequence
  Description of Artificial Sequence: Synthetic peptide
  Seed: SPLYFPQSPL (MAGC1_HUMAN)
SILYFPQSPI

SEQ ID NO: 86747 - protein, 9 aa, Artificial Sequence
  Description of Artificial Sequence: Synthetic peptide
  Seed: SSFFSSALL (MAGC1_HUMAN)
SKFFSSALW

SEQ ID NO: 86748 - protein, 9 aa, Artificial Sequence
  Description of Artificial Sequence: Synthetic peptide
  Seed: TLVSLFQSS (MAGC1_HUMAN)
TIVSLFQSV

SEQ ID NO: 86749 - protein, 10 aa, Artificial Sequence
  Description of Artificial Sequence: Synthetic peptide
  Seed: SSPERTHSTF (MAGC1_HUMAN)
SVPERTHSTI

SEQ ID NO: 86750 - protein, 8 aa, Artificial Sequence
  Description of Artificial Sequence: Synthetic peptide
  Seed: SDDTLYPL (MAGC1_HUMAN)
STDTLYPL

SEQ ID NO: 86751 - protein, 10 aa, Artificial Sequence
  Description of Artificial Sequence: Synthetic peptide
  Seed: LAMLKNTVPI (MAGC1_HUMAN)
LVMLKNTVPY

SEQ ID NO: 86752 - protein, 10 aa, Artificial Sequence
  Description of Artificial Sequence: Synthetic peptide
  Seed: VISFSSSTSL (MAGC1_HUMAN)
VASFSSSTSW

SEQ ID NO: 86753 - protein, 10 aa, Artificial Sequence
  Description of Artificial Sequence: Synthetic peptide
  Seed: YTLLSLFQSS (MAGC1_HUMAN)
YILLSLFQSI

SEQ ID NO: 86754 - protein, 9 aa, Artificial Sequence
  Description of Artificial Sequence: Synthetic peptide
  Seed: SSPESAQSA (MAGC1_HUMAN)
SLPESAQSI

SEQ ID NO: 86755 - protein, 9 aa, Artificial Sequence
  Description of Artificial Sequence: Synthetic peptide
  Seed: EDSLSPHYF (MAGC1_HUMAN)
EQSLSPHYW

SEQ ID NO: 86756 - protein, 10 aa, Artificial Sequence
  Description of Artificial Sequence: Synthetic peptide
  Seed: SIFQSSPESA (MAGC1_HUMAN)
SVFQSSPESL

SEQ ID NO: 86757 - protein, 10 aa, Artificial Sequence
  Description of Artificial Sequence: Synthetic peptide
  Seed: REVDPDDSYV (MAGC1_HUMAN)
RVVDPDDSYF

SEQ ID NO: 86758 - protein, 9 aa, Artificial Sequence
  Description of Artificial Sequence: Synthetic peptide
  Seed: ASSFFSSAL (MAGC1_HUMAN)
ALSFFSSAI

SEQ ID NO: 86759 - protein, 9 aa, Artificial Sequence
  Description of Artificial Sequence: Synthetic peptide
  Seed: QVKQPITKA (MAGC1_HUMAN)
QIKQPITKK

SEQ ID NO: 86760 - protein, 9 aa, Artificial Sequence
  Description of Artificial Sequence: Synthetic peptide
  Seed: LQIPGSPSF (MAGC1_HUMAN)
LWIPGSPSL

SEQ ID NO: 86761 - protein, 10 aa, Artificial Sequence
  Description of Artificial Sequence: Synthetic peptide
  Seed: REFIEILFGI (MAGC1_HUMAN)
RRFIEILFGL

SEQ ID NO: 86762 - protein, 10 aa, Artificial Sequence
  Description of Artificial Sequence: Synthetic peptide
  Seed: LSQSSPVSSF (MAGC1_HUMAN)
LSQSSPVSSY

SEQ ID NO: 86763 - protein, 9 aa, Artificial Sequence
  Description of Artificial Sequence: Synthetic peptide
  Seed: GFPQSLLQI (MAGC1_HUMAN)
GRPQSLLQF

SEQ ID NO: 86764 - protein, 9 aa, Artificial Sequence
  Description of Artificial Sequence: Synthetic peptide
  Seed: SSPERTHST (MAGC1_HUMAN)
SSPERTHSM

SEQ ID NO: 86765 - protein, 9 aa, Artificial Sequence
  Description of Artificial Sequence: Synthetic peptide
  Seed: FSEESSSPV (MAGC1_HUMAN)
FIEESSSPV

SEQ ID NO: 86766 - protein, 9 aa, Artificial Sequence
  Description of Artificial Sequence: Synthetic peptide
  Seed: SICSSSTSL (MAGC1_HUMAN)
SPCSSSTSF

SEQ ID NO: 86767 - protein, 9 aa, Artificial Sequence
  Description of Artificial Sequence: Synthetic peptide
  Seed: TESASSSVM (MAGC1_HUMAN)
TQSASSSVV

SEQ ID NO: 86768 - protein, 10 aa, Artificial Sequence
  Description of Artificial Sequence: Synthetic peptide
  Seed: SPLQSPVISF (MAGC1_HUMAN)
SPLQSPVISV

SEQ ID NO: 86769 - protein, 11 aa, Artificial Sequence
  Description of Artificial Sequence: Synthetic peptide
  Seed: REVDPDDSYVF (MAGC1_HUMAN)
RQVDPDDSYVF

SEQ ID NO: 86770 - protein, 10 aa, Artificial Sequence
  Description of Artificial Sequence: Synthetic peptide
  Seed: GPAQSPLQSP (MAGC1_HUMAN)
GPAQSPLQSF

SEQ ID NO: 86771 - protein, 9 aa, Artificial Sequence
  Description of Artificial Sequence: Synthetic peptide
  Seed: FQSSLQSPV (MAGC1_HUMAN)
FSSSLQSPV

SEQ ID NO: 86772 - protein, 11 aa, Artificial Sequence
  Description of Artificial Sequence: Synthetic peptide
  Seed: SPLQIPVSSSS (MAGC1_HUMAN)
SHLQIPVSSSM

SEQ ID NO: 86773 - protein, 10 aa, Artificial Sequence
  Description of Artificial Sequence: Synthetic peptide
  Seed: LAMLKNTVPI (MAGC1_HUMAN)
LMMLKNTVPI

SEQ ID NO: 86774 - protein, 9 aa, Artificial Sequence
  Description of Artificial Sequence: Synthetic peptide
  Seed: SSSSSSTLL (MAGC1_HUMAN)
SASSSSTLF

SEQ ID NO: 86775 - protein, 9 aa, Artificial Sequence
  Description of Artificial Sequence: Synthetic peptide
  Seed: YVFVNTLDL (MAGC1_HUMAN)
YSFVNTLDV

SEQ ID NO: 86776 - protein, 8 aa, Artificial Sequence
  Description of Artificial Sequence: Synthetic peptide
  Seed: SSPPRYEF (MAGC1_HUMAN)
SFPPRYEF

SEQ ID NO: 86777 - protein, 9 aa, Artificial Sequence
  Description of Artificial Sequence: Synthetic peptide
  Seed: LQIPVSAAS (MAGC1_HUMAN)
LEIPVSAAY

SEQ ID NO: 86778 - protein, 11 aa, Artificial Sequence
  Description of Artificial Sequence: Synthetic peptide
  Seed: FLAMLKNTVPI (MAGC1_HUMAN)
FTAMLKNTVPV

SEQ ID NO: 86779 - protein, 9 aa, Artificial Sequence
  Description of Artificial Sequence: Synthetic peptide
  Seed: SPPQGEDSL (MAGC1_HUMAN)
SIPQGEDSL

SEQ ID NO: 86780 - protein, 11 aa, Artificial Sequence
  Description of Artificial Sequence: Synthetic peptide
  Seed: VDEYTSSSDTL (MAGC1_HUMAN)
VIEYTSSSDTF

SEQ ID NO: 86781 - protein, 9 aa, Artificial Sequence
  Description of Artificial Sequence: Synthetic peptide
  Seed: ISFSSSTSL (MAGC1_HUMAN)
ISFSSSTSW

SEQ ID NO: 86782 - protein, 10 aa, Artificial Sequence
  Description of Artificial Sequence: Synthetic peptide
  Seed: FSSSTSLSPF (MAGC1_HUMAN)
FDSSTSLSPF

SEQ ID NO: 86783 - protein, 10 aa, Artificial Sequence
  Description of Artificial Sequence: Synthetic peptide
  Seed: ASSSVMSPSF (MAGC1_HUMAN)
AQSSVMSPSM

SEQ ID NO: 86784 - protein, 9 aa, Artificial Sequence
  Description of Artificial Sequence: Synthetic peptide
  Seed: QIVPSLPEW (MAGC1_HUMAN)
QMVPSLPEI

SEQ ID NO: 86785 - protein, 9 aa, Artificial Sequence
  Description of Artificial Sequence: Synthetic peptide
  Seed: SPESAQSAF (MAGC1_HUMAN)
SPESAQSAV

SEQ ID NO: 86786 - protein, 9 aa, Artificial Sequence
  Description of Artificial Sequence: Synthetic peptide
  Seed: NTVPITFPS (MAGC1_HUMAN)
NCVPITFPR

SEQ ID NO: 86787 - protein, 10 aa, Artificial Sequence
  Description of Artificial Sequence: Synthetic peptide
  Seed: SSSSSTLLSL (MAGC1_HUMAN)
SVSSSTLLSI

SEQ ID NO: 86788 - protein, 9 aa, Artificial Sequence
  Description of Artificial Sequence: Synthetic peptide
  Seed: TLVSLFQSS (MAGC1_HUMAN)
TMVSLFQSL

SEQ ID NO: 86789 - protein, 11 aa, Artificial Sequence
  Description of Artificial Sequence: Synthetic peptide
  Seed: SAASSSTLVSI (MAGC1_HUMAN)
SVASSSTLVSW

SEQ ID NO: 86790 - protein, 9 aa, Artificial Sequence
  Description of Artificial Sequence: Synthetic peptide
  Seed: VIKRKVVEF (MAGC1_HUMAN)
VYKRKVVEM

SEQ ID NO: 86791 - protein, 10 aa, Artificial Sequence
  Description of Artificial Sequence: Synthetic peptide
  Seed: TTDDSTATES (MAGC1_HUMAN)
TWDDSTATEI

SEQ ID NO: 86792 - protein, 11 aa, Artificial Sequence
  Description of Artificial Sequence: Synthetic peptide
  Seed: SPLQIPGSPSF (MAGC1_HUMAN)
SELQIPGSPSF

SEQ ID NO: 86793 - protein, 9 aa, Artificial Sequence
  Description of Artificial Sequence: Synthetic peptide
  Seed: LQNPASSFF (MAGC1_HUMAN)
LTNPASSFI

SEQ ID NO: 86794 - protein, 9 aa, Artificial Sequence
  Description of Artificial Sequence: Synthetic peptide
  Seed: SSHESPQSP (MAGC1_HUMAN)
SSHESPQSM

SEQ ID NO: 86795 - protein, 9 aa, Artificial Sequence
  Description of Artificial Sequence: Synthetic peptide
  Seed: RAGREHFAF (MAGC1_HUMAN)
RLGREHFAY

SEQ ID NO: 86796 - protein, 11 aa, Artificial Sequence
  Description of Artificial Sequence: Synthetic peptide
  Seed: QSSPESAQSAF (MAGC1_HUMAN)
QISPESAQSAW

SEQ ID NO: 86797 - protein, 9 aa, Artificial Sequence
  Description of Artificial Sequence: Synthetic peptide
  Seed: SICSSSTSL (MAGC1_HUMAN)
SLCSSSTSM

SEQ ID NO: 86798 - protein, 11 aa, Artificial Sequence
  Description of Artificial Sequence: Synthetic peptide
  Seed: IPVSSSFSYTL (MAGC1_HUMAN)
IPVSSSFSYTF

SEQ ID NO: 86799 - protein, 11 aa, Artificial Sequence
  Description of Artificial Sequence: Synthetic peptide
  Seed: SPLQIPVSSSS (MAGC1_HUMAN)
SILQIPVSSSF

SEQ ID NO: 86800 - protein, 9 aa, Artificial Sequence
  Description of Artificial Sequence: Synthetic peptide
  Seed: MTSSFSSTL (MAGC1_HUMAN)
MASSFSSTV

SEQ ID NO: 86801 - protein, 9 aa, Artificial Sequence
  Description of Artificial Sequence: Synthetic peptide
  Seed: SSPECTQST (MAGC1_HUMAN)
SGPECTQSV

SEQ ID NO: 86802 - protein, 9 aa, Artificial Sequence
  Description of Artificial Sequence: Synthetic peptide
  Seed: TLLSLFQSF (MAGC1_HUMAN)
TPLSLFQSY

SEQ ID NO: 86803 - protein, 9 aa, Artificial Sequence
  Description of Artificial Sequence: Synthetic peptide
  Seed: AASSSTLVS (MAGC1_HUMAN)
ASSSSTLVF

SEQ ID NO: 86804 - protein, 10 aa, Artificial Sequence
  Description of Artificial Sequence: Synthetic peptide
  Seed: YTLDEKVDEL (MAGC1_HUMAN)
YELDEKVDEV

SEQ ID NO: 86805 - protein, 9 aa, Artificial Sequence
  Description of Artificial Sequence: Synthetic peptide
  Seed: SQSSPVSSF (MAGC1_HUMAN)
SPSSPVSSM

SEQ ID NO: 86806 - protein, 9 aa, Artificial Sequence
  Description of Artificial Sequence: Synthetic peptide
  Seed: RKVVEFLAM (MAGC1_HUMAN)
RMVVEFLAV

SEQ ID NO: 86807 - protein, 9 aa, Artificial Sequence
  Description of Artificial Sequence: Synthetic peptide
  Seed: SAASSSTLV (MAGC1_HUMAN)
SSASSSTLM

SEQ ID NO: 86808 - protein, 9 aa, Artificial Sequence
  Description of Artificial Sequence: Synthetic peptide
  Seed: SSPEGKDSL (MAGC1_HUMAN)
SVPEGKDSF

SEQ ID NO: 86809 - protein, 10 aa, Artificial Sequence
  Description of Artificial Sequence: Synthetic peptide
  Seed: SSSSSTLLSL (MAGC1_HUMAN)
STSSSTLLSL

SEQ ID NO: 86810 - protein, 11 aa, Artificial Sequence
  Description of Artificial Sequence: Synthetic peptide
  Seed: KRKVVEFLAML (MAGC1_HUMAN)
KLKVVEFLAMA

SEQ ID NO: 86811 - protein, 10 aa, Artificial Sequence
  Description of Artificial Sequence: Synthetic peptide
  Seed: SSPERTQSTF (MAGC1_HUMAN)
SSPERTQSTL

SEQ ID NO: 86812 - protein, 9 aa, Artificial Sequence
  Description of Artificial Sequence: Synthetic peptide
  Seed: FFSYTLASL (MAGC1_HUMAN)
FQSYTLAST

SEQ ID NO: 86813 - protein, 9 aa, Artificial Sequence
  Description of Artificial Sequence: Synthetic peptide
  Seed: SSSTLLSLF (MAGC1_HUMAN)
SYSTLLSLI

SEQ ID NO: 86814 - protein, 10 aa, Artificial Sequence
  Description of Artificial Sequence: Synthetic peptide
  Seed: RSFSSTLLSI (MAGC1_HUMAN)
RIFSSTLLSF

SEQ ID NO: 86815 - protein, 9 aa, Artificial Sequence
  Description of Artificial Sequence: Synthetic peptide
  Seed: VSSSSSSTL (MAGC1_HUMAN)
VNSSSSSTY

SEQ ID NO: 86816 - protein, 10 aa, Artificial Sequence
  Description of Artificial Sequence: Synthetic peptide
  Seed: SLSPLHFPQF (MAGC1_HUMAN)
SSSPLHFPQW

SEQ ID NO: 86817 - protein, 10 aa, Artificial Sequence
  Description of Artificial Sequence: Synthetic peptide
  Seed: ATESASSSVM (MAGC1_HUMAN)
ALESASSSVF

SEQ ID NO: 86818 - protein, 10 aa, Artificial Sequence
  Description of Artificial Sequence: Synthetic peptide
  Seed: FSSSTSLSPF (MAGC1_HUMAN)
FCSSTSLSPF

SEQ ID NO: 86819 - protein, 10 aa, Artificial Sequence
  Description of Artificial Sequence: Synthetic peptide
  Seed: MPTAGMPSLL (MAGC1_HUMAN)
METAGMPSLI

SEQ ID NO: 86820 - protein, 10 aa, Artificial Sequence
  Description of Artificial Sequence: Synthetic peptide
  Seed: YTLLSLFQSS (MAGC1_HUMAN)
YPLLSLFQSV

SEQ ID NO: 86821 - protein, 9 aa, Artificial Sequence
  Description of Artificial Sequence: Synthetic peptide
  Seed: FSSTLVSLF (MAGC1_HUMAN)
FVSTLVSLW

SEQ ID NO: 86822 - protein, 9 aa, Artificial Sequence
  Description of Artificial Sequence: Synthetic peptide
  Seed: LQIVPSLPE (MAGC1_HUMAN)
LIIVPSLPY

SEQ ID NO: 86823 - protein, 9 aa, Artificial Sequence
  Description of Artificial Sequence: Synthetic peptide
  Seed: TSLSLPQSF (MAGC1_HUMAN)
TMLSLPQSW

SEQ ID NO: 86824 - protein, 10 aa, Artificial Sequence
  Description of Artificial Sequence: Synthetic peptide
  Seed: WGPRAHSEVI (MAGC1_HUMAN)
WNPRAHSEVV

SEQ ID NO: 86825 - protein, 9 aa, Artificial Sequence
  Description of Artificial Sequence: Synthetic peptide
  Seed: EFIEILFGI (MAGC1_HUMAN)
EMIEILFGA

SEQ ID NO: 86826 - protein, 9 aa, Artificial Sequence
  Description of Artificial Sequence: Synthetic peptide
  Seed: ASSFFSSAL (MAGC1_HUMAN)
AKSFFSSAL

SEQ ID NO: 86827 - protein, 9 aa, Artificial Sequence
  Description of Artificial Sequence: Synthetic peptide
  Seed: FSSTLVSLF (MAGC1_HUMAN)
FLSTLVSLV

SEQ ID NO: 86828 - protein, 11 aa, Artificial Sequence
  Description of Artificial Sequence: Synthetic peptide
  Seed: IPVSSSSSSTL (MAGC1_HUMAN)
IFVSSSSSSTW

SEQ ID NO: 86829 - protein, 9 aa, Artificial Sequence
  Description of Artificial Sequence: Synthetic peptide
  Seed: LQIPVSRSF (MAGC1_HUMAN)
LAIPVSRSV

SEQ ID NO: 86830 - protein, 11 aa, Artificial Sequence
  Description of Artificial Sequence: Synthetic peptide
  Seed: SPLQIPMTSSF (MAGC1_HUMAN)
SFLQIPMTSSM

SEQ ID NO: 86831 - protein, 9 aa, Artificial Sequence
  Description of Artificial Sequence: Synthetic peptide
  Seed: SVLQIPVSA (MAGC1_HUMAN)
SALQIPVSF

SEQ ID NO: 86832 - protein, 10 aa, Artificial Sequence
  Description of Artificial Sequence: Synthetic peptide
  Seed: PLQIPGSPSF (MAGC1_HUMAN)
PTQIPGSPSY

SEQ ID NO: 86833 - protein, 9 aa, Artificial Sequence
  Description of Artificial Sequence: Synthetic peptide
  Seed: SQSPPEGPV (MAGC1_HUMAN)
SISPPEGPF

SEQ ID NO: 86834 - protein, 9 aa, Artificial Sequence
  Description of Artificial Sequence: Synthetic peptide
  Seed: IESEPLFTY (MAGC1_HUMAN)
ILSEPLFTL

SEQ ID NO: 86835 - protein, 10 aa, Artificial Sequence
  Description of Artificial Sequence: Synthetic peptide
  Seed: EVPNSSPPRY (MAGC1_HUMAN)
EIPNSSPPRR

SEQ ID NO: 86836 - protein, 9 aa, Artificial Sequence
  Description of Artificial Sequence: Synthetic peptide
  Seed: FSSTLLSLF (MAGC1_HUMAN)
FLSTLLSLV

SEQ ID NO: 86837 - protein, 9 aa, Artificial Sequence
  Description of Artificial Sequence: Synthetic peptide
  Seed: SSPESAQST (MAGC1_HUMAN)
SWPESAQSL

SEQ ID NO: 86838 - protein, 8 aa, Artificial Sequence
  Description of Artificial Sequence: Synthetic peptide
  Seed: LQIPQSPL (MAGC1_HUMAN)
LQIPQSPF

SEQ ID NO: 86839 - protein, 10 aa, Artificial Sequence
  Description of Artificial Sequence: Synthetic peptide
  Seed: MLKNTVPITF (MAGC1_HUMAN)
MQKNTVPITM

SEQ ID NO: 86840 - protein, 9 aa, Artificial Sequence
  Description of Artificial Sequence: Synthetic peptide
  Seed: VSRSFSSTL (MAGC1_HUMAN)
VPRSFSSTT

SEQ ID NO: 86841 - protein, 9 aa, Artificial Sequence
  Description of Artificial Sequence: Synthetic peptide
  Seed: MPSLLQSSS (MAGC1_HUMAN)
MPSLLQSSP

SEQ ID NO: 86842 - protein, 9 aa, Artificial Sequence
  Description of Artificial Sequence: Synthetic peptide
  Seed: AGREHFAFG (MAGC1_HUMAN)
ATREHFAFY

SEQ ID NO: 86843 - protein, 10 aa, Artificial Sequence
  Description of Artificial Sequence: Synthetic peptide
  Seed: MSPLYFPQSP (MAGC1_HUMAN)
MKPLYFPQSV

SEQ ID NO: 86844 - protein, 9 aa, Artificial Sequence
  Description of Artificial Sequence: Synthetic peptide
  Seed: SSFFSSALL (MAGC1_HUMAN)
SMFFSSALW

SEQ ID NO: 86845 - protein, 10 aa, Artificial Sequence
  Description of Artificial Sequence: Synthetic peptide
  Seed: SSPESAQSAF (MAGC1_HUMAN)
SNPESAQSAM

SEQ ID NO: 86846 - protein, 10 aa, Artificial Sequence
  Description of Artificial Sequence: Synthetic peptide
  Seed: LQIPVSSSFS (MAGC1_HUMAN)
LKIPVSSSFM

SEQ ID NO: 86847 - protein, 10 aa, Artificial Sequence
  Description of Artificial Sequence: Synthetic peptide
  Seed: RAGREHFAFG (MAGC1_HUMAN)
RSGREHFAFT

SEQ ID NO: 86848 - protein, 9 aa, Artificial Sequence
  Description of Artificial Sequence: Synthetic peptide
  Seed: SVLQIPVSA (MAGC1_HUMAN)
STLQIPVSR

SEQ ID NO: 86849 - protein, 9 aa, Artificial Sequence
  Description of Artificial Sequence: Synthetic peptide
  Seed: RPVSSFFSY (MAGC1_HUMAN)
RNVSSFFSM

SEQ ID NO: 86850 - protein, 9 aa, Artificial Sequence
  Description of Artificial Sequence: Synthetic peptide
  Seed: EILFGISLR (MAGC1_HUMAN)
ETLFGISLM

SEQ ID NO: 86851 - protein, 11 aa, Artificial Sequence
  Description of Artificial Sequence: Synthetic peptide
  Seed: FLAMLKNTVPI (MAGC1_HUMAN)
FDAMLKNTVPA

SEQ ID NO: 86852 - protein, 11 aa, Artificial Sequence
  Description of Artificial Sequence: Synthetic peptide
  Seed: IPVSSSFSYTL (MAGC1_HUMAN)
IYVSSSFSYTW

SEQ ID NO: 86853 - protein, 9 aa, Artificial Sequence
  Description of Artificial Sequence: Synthetic peptide
  Seed: VSSFFSYTL (MAGC1_HUMAN)
VQSFFSYTA

SEQ ID NO: 86854 - protein, 11 aa, Artificial Sequence
  Description of Artificial Sequence: Synthetic peptide
  Seed: IIDTTDDSTAT (MAGC1_HUMAN)
IVDTTDDSTAI

SEQ ID NO: 86855 - protein, 10 aa, Artificial Sequence
  Description of Artificial Sequence: Synthetic peptide
  Seed: TLDEKVDELA (MAGC1_HUMAN)
TADEKVDELV

SEQ ID NO: 86856 - protein, 10 aa, Artificial Sequence
  Description of Artificial Sequence: Synthetic peptide
  Seed: FSSSTSLSPF (MAGC1_HUMAN)
FASSTSLSPL

SEQ ID NO: 86857 - protein, 9 aa, Artificial Sequence
  Description of Artificial Sequence: Synthetic peptide
  Seed: RAHSEVIKR (MAGC1_HUMAN)
RIHSEVIKR

SEQ ID NO: 86858 - protein, 9 aa, Artificial Sequence
  Description of Artificial Sequence: Synthetic peptide
  Seed: FSSALLSIF (MAGC1_HUMAN)
FPSALLSIA

SEQ ID NO: 86859 - protein, 10 aa, Artificial Sequence
  Description of Artificial Sequence: Synthetic peptide
  Seed: MTSSFSSTLL (MAGC1_HUMAN)
MDSSFSSTLV

SEQ ID NO: 86860 - protein, 9 aa, Artificial Sequence
  Description of Artificial Sequence: Synthetic peptide
  Seed: FEGFAQSPL (MAGC1_HUMAN)
FLGFAQSPF

SEQ ID NO: 86861 - protein, 10 aa, Artificial Sequence
  Description of Artificial Sequence: Synthetic peptide
  Seed: VSSSFSYTLL (MAGC1_HUMAN)
VCSSFSYTLF

SEQ ID NO: 86862 - protein, 9 aa, Artificial Sequence
  Description of Artificial Sequence: Synthetic peptide
  Seed: LSPLHFPQF (MAGC1_HUMAN)
LRPLHFPQM

SEQ ID NO: 86863 - protein, 10 aa, Artificial Sequence
  Description of Artificial Sequence: Synthetic peptide
  Seed: STLLSLFQSF (MAGC1_HUMAN)
SMLLSLFQSF

SEQ ID NO: 86864 - protein, 9 aa, Artificial Sequence
  Description of Artificial Sequence: Synthetic peptide
  Seed: SAPEGEDSL (MAGC1_HUMAN)
SIPEGEDSY

SEQ ID NO: 86865 - protein, 9 aa, Artificial Sequence
  Description of Artificial Sequence: Synthetic peptide
  Seed: IESEPLFTY (MAGC1_HUMAN)
IQSEPLFTF

SEQ ID NO: 86866 - protein, 9 aa, Artificial Sequence
  Description of Artificial Sequence: Synthetic peptide
  Seed: LQIPVSSSS (MAGC1_HUMAN)
LVIPVSSSY

SEQ ID NO: 86867 - protein, 9 aa, Artificial Sequence
  Description of Artificial Sequence: Synthetic peptide
  Seed: LQSPVISFS (MAGC1_HUMAN)
LASPVISFV

SEQ ID NO: 86868 - protein, 9 aa, Artificial Sequence
  Description of Artificial Sequence: Synthetic peptide
  Seed: VLSGIGVRA (MAGC1_HUMAN)
VQSGIGVRL

SEQ ID NO: 86869 - protein, 9 aa, Artificial Sequence
  Description of Artificial Sequence: Synthetic peptide
  Seed: FFSYTLASL (MAGC1_HUMAN)
FHSYTLASM

SEQ ID NO: 86870 - protein, 9 aa, Artificial Sequence
  Description of Artificial Sequence: Synthetic peptide
  Seed: SSPESTQSP (MAGC1_HUMAN)
SVPESTQSM

SEQ ID NO: 86871 - protein, 10 aa, Artificial Sequence
  Description of Artificial Sequence: Synthetic peptide
  Seed: STPSSLPQSF (MAGC1_HUMAN)
STPSSLPQSW

SEQ ID NO: 86872 - protein, 9 aa, Artificial Sequence
  Description of Artificial Sequence: Synthetic peptide
  Seed: DSYVFVNTL (MAGC1_HUMAN)
DHYVFVNTM

SEQ ID NO: 86873 - protein, 9 aa, Artificial Sequence
  Description of Artificial Sequence: Synthetic peptide
  Seed: STFEGFAQS (MAGC1_HUMAN)
STFEGFAQV

SEQ ID NO: 86874 - protein, 9 aa, Artificial Sequence
  Description of Artificial Sequence: Synthetic peptide
  Seed: SSSFSYTLL (MAGC1_HUMAN)
SQSFSYTLV

SEQ ID NO: 86875 - protein, 11 aa, Artificial Sequence
  Description of Artificial Sequence: Synthetic peptide
  Seed: AMLKNTVPITF (MAGC1_HUMAN)
AMLKNTVPITY

SEQ ID NO: 86876 - protein, 9 aa, Artificial Sequence
  Description of Artificial Sequence: Synthetic peptide
  Seed: SQSSPVSSF (MAGC1_HUMAN)
SMSSPVSSI

SEQ ID NO: 86877 - protein, 9 aa, Artificial Sequence
  Description of Artificial Sequence: Synthetic peptide
  Seed: FSERTQSTF (MAGC1_HUMAN)
FAERTQSTL

SEQ ID NO: 86878 - protein, 11 aa, Artificial Sequence
  Description of Artificial Sequence: Synthetic peptide
  Seed: SSFPSSTSSSL (MAGC1_HUMAN)
SEFPSSTSSSM

SEQ ID NO: 86879 - protein, 11 aa, Artificial Sequence
  Description of Artificial Sequence: Synthetic peptide
  Seed: ISRYTGYFPVI (MAGC1_HUMAN)
IYRYTGYFPVF

SEQ ID NO: 86880 - protein, 9 aa, Artificial Sequence
  Description of Artificial Sequence: Synthetic peptide
  Seed: SAQSTFEGF (MAGC1_HUMAN)
STQSTFEGW

SEQ ID NO: 86881 - protein, 10 aa, Artificial Sequence
  Description of Artificial Sequence: Synthetic peptide
  Seed: HSPLQIVPSL (MAGC1_HUMAN)
HSPLQIVPSW

SEQ ID NO: 86882 - protein, 10 aa, Artificial Sequence
  Description of Artificial Sequence: Synthetic peptide
  Seed: SFPSSTSSSL (MAGC1_HUMAN)
SGPSSTSSSF

SEQ ID NO: 86883 - protein, 10 aa, Artificial Sequence
  Description of Artificial Sequence: Synthetic peptide
  Seed: SSPPRYEFLW (MAGC1_HUMAN)
SQPPRYEFLF

SEQ ID NO: 86884 - protein, 9 aa, Artificial Sequence
  Description of Artificial Sequence: Synthetic peptide
  Seed: GSPSFSSTL (MAGC1_HUMAN)
GLPSFSSTY

SEQ ID NO: 86885 - protein, 11 aa, Artificial Sequence
  Description of Artificial Sequence: Synthetic peptide
  Seed: IPVSAASSSTL (MAGC1_HUMAN)
IHVSAASSSTF

SEQ ID NO: 86886 - protein, 9 aa, Artificial Sequence
  Description of Artificial Sequence: Synthetic peptide
  Seed: SQSSPVSSF (MAGC1_HUMAN)
SSSSPVSSV

SEQ ID NO: 86887 - protein, 10 aa, Artificial Sequence
  Description of Artificial Sequence: Synthetic peptide
  Seed: FPQSVLQIPV (MAGC1_HUMAN)
FFQSVLQIPV

SEQ ID NO: 86888 - protein, 11 aa, Artificial Sequence
  Description of Artificial Sequence: Synthetic peptide
  Seed: SPLQNPASSFF (MAGC1_HUMAN)
SMLQNPASSFY

SEQ ID NO: 86889 - protein, 9 aa, Artificial Sequence
  Description of Artificial Sequence: Synthetic peptide
  Seed: SPPQGEDSM (MAGC1_HUMAN)
SPPQGEDSY

SEQ ID NO: 86890 - protein, 10 aa, Artificial Sequence
  Description of Artificial Sequence: Synthetic peptide
  Seed: DELARFLLLK (MAGC1_HUMAN)
DSLARFLLLR

SEQ ID NO: 86891 - protein, 11 aa, Artificial Sequence
  Description of Artificial Sequence: Synthetic peptide
  Seed: QSSPESAQSAF (MAGC1_HUMAN)
QQSPESAQSAW

SEQ ID NO: 86892 - protein, 9 aa, Artificial Sequence
  Description of Artificial Sequence: Synthetic peptide
  Seed: VSPSFSSTL (MAGC1_HUMAN)
VPPSFSSTV

SEQ ID NO: 86893 - protein, 10 aa, Artificial Sequence
  Description of Artificial Sequence: Synthetic peptide
  Seed: SSPPRYEFLW (MAGC1_HUMAN)
SYPPRYEFLF

SEQ ID NO: 86894 - protein, 10 aa, Artificial Sequence
  Description of Artificial Sequence: Synthetic peptide
  Seed: VISFSSSTSL (MAGC1_HUMAN)
VTSFSSSTSF

SEQ ID NO: 86895 - protein, 10 aa, Artificial Sequence
  Description of Artificial Sequence: Synthetic peptide
  Seed: WEDSLSPHYF (MAGC1_HUMAN)
WEDSLSPHYW

SEQ ID NO: 86896 - protein, 10 aa, Artificial Sequence
  Description of Artificial Sequence: Synthetic peptide
  Seed: VSSSFSYTLL (MAGC1_HUMAN)
VMSSFSYTLY

SEQ ID NO: 86897 - protein, 10 aa, Artificial Sequence
  Description of Artificial Sequence: Synthetic peptide
  Seed: IIDTTDDSTA (MAGC1_HUMAN)
IVDTTDDSTF

SEQ ID NO: 86898 - protein, 9 aa, Artificial Sequence
  Description of Artificial Sequence: Synthetic peptide
  Seed: LLSLFQSFS (MAGC1_HUMAN)
LLSLFQSFT

SEQ ID NO: 86899 - protein, 8 aa, Artificial Sequence
  Description of Artificial Sequence: Synthetic peptide
  Seed: ALKDVEER (MAGC1_HUMAN)
AAKDVEEY

SEQ ID NO: 86900 - protein, 9 aa, Artificial Sequence
  Description of Artificial Sequence: Synthetic peptide
  Seed: FFSSALLSI (MAGC1_HUMAN)
FTSSALLSM

SEQ ID NO: 86901 - protein, 9 aa, Artificial Sequence
  Description of Artificial Sequence: Synthetic peptide
  Seed: DELARFLLL (MAGC1_HUMAN)
DELARFLLF

SEQ ID NO: 86902 - protein, 9 aa, Artificial Sequence
  Description of Artificial Sequence: Synthetic peptide
  Seed: SSSTLVSIF (MAGC1_HUMAN)
STSTLVSIW

SEQ ID NO: 86903 - protein, 9 aa, Artificial Sequence
  Description of Artificial Sequence: Synthetic peptide
  Seed: LQIVPSLPE (MAGC1_HUMAN)
LMIVPSLPF

SEQ ID NO: 86904 - protein, 9 aa, Artificial Sequence
  Description of Artificial Sequence: Synthetic peptide
  Seed: LQNPASSFF (MAGC1_HUMAN)
LQNPASSFW

SEQ ID NO: 86905 - protein, 10 aa, Artificial Sequence
  Description of Artificial Sequence: Synthetic peptide
  Seed: STPSSLPQSF (MAGC1_HUMAN)
SLPSSLPQSY

SEQ ID NO: 86906 - protein, 10 aa, Artificial Sequence
  Description of Artificial Sequence: Synthetic peptide
  Seed: KGTYASEEVI (MAGC1_HUMAN)
KWTYASEEVW

SEQ ID NO: 86907 - protein, 9 aa, Artificial Sequence
  Description of Artificial Sequence: Synthetic peptide
  Seed: KVDELARFL (MAGC1_HUMAN)
KFDELARFV

SEQ ID NO: 86908 - protein, 9 aa, Artificial Sequence
  Description of Artificial Sequence: Synthetic peptide
  Seed: SPESAQSTF (MAGC1_HUMAN)
SPESAQSTW

SEQ ID NO: 86909 - protein, 9 aa, Artificial Sequence
  Description of Artificial Sequence: Synthetic peptide
  Seed: YQVKQPITK (MAGC1_HUMAN)
YVVKQPITY

SEQ ID NO: 86910 - protein, 9 aa, Artificial Sequence
  Description of Artificial Sequence: Synthetic peptide
  Seed: RPVSSFFSY (MAGC1_HUMAN)
RLVSSFFSM

SEQ ID NO: 86911 - protein, 8 aa, Artificial Sequence
  Description of Artificial Sequence: Synthetic peptide
  Seed: LQSPVSSF (MAGC1_HUMAN)
LQSPVSSY

SEQ ID NO: 86912 - protein, 9 aa, Artificial Sequence
  Description of Artificial Sequence: Synthetic peptide
  Seed: FAFGEPREL (MAGC1_HUMAN)
FSFGEPREA

SEQ ID NO: 86913 - protein, 9 aa, Artificial Sequence
  Description of Artificial Sequence: Synthetic peptide
  Seed: VSPSSSSTL (MAGC1_HUMAN)
VTPSSSSTM

SEQ ID NO: 86914 - protein, 9 aa, Artificial Sequence
  Description of Artificial Sequence: Synthetic peptide
  Seed: EFIEILFGI (MAGC1_HUMAN)
ECIEILFGI

SEQ ID NO: 86915 - protein, 9 aa, Artificial Sequence
  Description of Artificial Sequence: Synthetic peptide
  Seed: TLDEKVDEL (MAGC1_HUMAN)
TYDEKVDEC

SEQ ID NO: 86916 - protein, 10 aa, Artificial Sequence
  Description of Artificial Sequence: Synthetic peptide
  Seed: MPTAGMPSLL (MAGC1_HUMAN)
MNTAGMPSLV

SEQ ID NO: 86917 - protein, 11 aa, Artificial Sequence
  Description of Artificial Sequence: Synthetic peptide
  Seed: GENTHSPLQIV (MAGC1_HUMAN)
GENTHSPLQIM

SEQ ID NO: 86918 - protein, 10 aa, Artificial Sequence
  Description of Artificial Sequence: Synthetic peptide
  Seed: FPQSLLQIPM (MAGC1_HUMAN)
FPQSLLQIPT

SEQ ID NO: 86919 - protein, 10 aa, Artificial Sequence
  Description of Artificial Sequence: Synthetic peptide
  Seed: FPSSYKDALK (MAGC1_HUMAN)
FASSYKDALK

SEQ ID NO: 86920 - protein, 9 aa, Artificial Sequence
  Description of Artificial Sequence: Synthetic peptide
  Seed: FAFGEPREL (MAGC1_HUMAN)
FQFGEPREI

SEQ ID NO: 86921 - protein, 9 aa, Artificial Sequence
  Description of Artificial Sequence: Synthetic peptide
  Seed: TLDLTSEGC (MAGC1_HUMAN)
TIDLTSEGF

SEQ ID NO: 86922 - protein, 9 aa, Artificial Sequence
  Description of Artificial Sequence: Synthetic peptide
  Seed: TLLSILQSS (MAGC1_HUMAN)
TMLSILQSV

SEQ ID NO: 86923 - protein, 11 aa, Artificial Sequence
  Description of Artificial Sequence: Synthetic peptide
  Seed: TLDEKVDELAR (MAGC1_HUMAN)
TLDEKVDELAM

SEQ ID NO: 86924 - protein, 10 aa, Artificial Sequence
  Description of Artificial Sequence: Synthetic peptide
  Seed: PLQIPVSRSF (MAGC1_HUMAN)
PWQIPVSRSY

SEQ ID NO: 86925 - protein, 9 aa, Artificial Sequence
  Description of Artificial Sequence: Synthetic peptide
  Seed: SSPEGKDSL (MAGC1_HUMAN)
SAPEGKDSM

SEQ ID NO: 86926 - protein, 11 aa, Artificial Sequence
  Description of Artificial Sequence: Synthetic peptide
  Seed: IPVSSSSSSTL (MAGC1_HUMAN)
IPVSSSSSSTM

SEQ ID NO: 86927 - protein, 9 aa, Artificial Sequence
  Description of Artificial Sequence: Synthetic peptide
  Seed: VSRSFSSTL (MAGC1_HUMAN)
VLRSFSSTM

SEQ ID NO: 86928 - protein, 8 aa, Artificial Sequence
  Description of Artificial Sequence: Synthetic peptide
  Seed: RYTGYFPV (MAGC1_HUMAN)
RYTGYFPF

SEQ ID NO: 86929 - protein, 9 aa, Artificial Sequence
  Description of Artificial Sequence: Synthetic peptide
  Seed: YVFVNTLDL (MAGC1_HUMAN)
YIFVNTLDI

SEQ ID NO: 86930 - protein, 9 aa, Artificial Sequence
  Description of Artificial Sequence: Synthetic peptide
  Seed: LQIPGSPSF (MAGC1_HUMAN)
LRIPGSPSF

SEQ ID NO: 86931 - protein, 9 aa, Artificial Sequence
  Description of Artificial Sequence: Synthetic peptide
  Seed: TPSSLPQSF (MAGC1_HUMAN)
TTSSLPQSW

SEQ ID NO: 86932 - protein, 9 aa, Artificial Sequence
  Description of Artificial Sequence: Synthetic peptide
  Seed: STFEGFAQS (MAGC1_HUMAN)
SQFEGFAQM

SEQ ID NO: 86933 - protein, 10 aa, Artificial Sequence
  Description of Artificial Sequence: Synthetic peptide
  Seed: QIPVSSSFSY (MAGC1_HUMAN)
QWPVSSSFSF

SEQ ID NO: 86934 - protein, 10 aa, Artificial Sequence
  Description of Artificial Sequence: Synthetic peptide
  Seed: SSSSSTLLSL (MAGC1_HUMAN)
SISSSTLLSY

SEQ ID NO: 86935 - protein, 9 aa, Artificial Sequence
  Description of Artificial Sequence: Synthetic peptide
  Seed: MPTAGMPSL (MAGC1_HUMAN)
MSTAGMPSL

SEQ ID NO: 86936 - protein, 11 aa, Artificial Sequence
  Description of Artificial Sequence: Synthetic peptide
  Seed: LQIPVSSSFSY (MAGC1_HUMAN)
LMIPVSSSFSM

SEQ ID NO: 86937 - protein, 9 aa, Artificial Sequence
  Description of Artificial Sequence: Synthetic peptide
  Seed: FSYTLLSLF (MAGC1_HUMAN)
FTYTLLSLF

SEQ ID NO: 86938 - protein, 9 aa, Artificial Sequence
  Description of Artificial Sequence: Synthetic peptide
  Seed: TLDEKVDEL (MAGC1_HUMAN)
TQDEKVDEF

SEQ ID NO: 86939 - protein, 8 aa, Artificial Sequence
  Description of Artificial Sequence: Synthetic peptide
  Seed: THSPLQIV (MAGC1_HUMAN)
THSPLQIA

SEQ ID NO: 86940 - protein, 9 aa, Artificial Sequence
  Description of Artificial Sequence: Synthetic peptide
  Seed: IEILFGISL (MAGC1_HUMAN)
IEILFGISA

SEQ ID NO: 86941 - protein, 9 aa, Artificial Sequence
  Description of Artificial Sequence: Synthetic peptide
  Seed: SSSVMSPSF (MAGC1_HUMAN)
SKSVMSPSF

SEQ ID NO: 86942 - protein, 9 aa, Artificial Sequence
  Description of Artificial Sequence: Synthetic peptide
  Seed: LQIPVSRSF (MAGC1_HUMAN)
LVIPVSRSI

SEQ ID NO: 86943 - protein, 9 aa, Artificial Sequence
  Description of Artificial Sequence: Synthetic peptide
  Seed: TLDEKVDEL (MAGC1_HUMAN)
TLDEKVDEV

SEQ ID NO: 86944 - protein, 9 aa, Artificial Sequence
  Description of Artificial Sequence: Synthetic peptide
  Seed: FSSTLLSIL (MAGC1_HUMAN)
FISTLLSIF

SEQ ID NO: 86945 - protein, 9 aa, Artificial Sequence
  Description of Artificial Sequence: Synthetic peptide
  Seed: VSSSFSYTL (MAGC1_HUMAN)
VRSSFSYTL

SEQ ID NO: 86946 - protein, 9 aa, Artificial Sequence
  Description of Artificial Sequence: Synthetic peptide
  Seed: SSPEGKDSL (MAGC1_HUMAN)
SFPEGKDSL

SEQ ID NO: 86947 - protein, 9 aa, Artificial Sequence
  Description of Artificial Sequence: Synthetic peptide
  Seed: TFEGFPQSL (MAGC1_HUMAN)
TYEGFPQSY

SEQ ID NO: 86948 - protein, 10 aa, Artificial Sequence
  Description of Artificial Sequence: Synthetic peptide
  Seed: SSSSSTLLSL (MAGC1_HUMAN)
SMSSSTLLSA

SEQ ID NO: 86949 - protein, 10 aa, Artificial Sequence
  Description of Artificial Sequence: Synthetic peptide
  Seed: STSLSLPQSF (MAGC1_HUMAN)
SLSLSLPQSY

SEQ ID NO: 86950 - protein, 9 aa, Artificial Sequence
  Description of Artificial Sequence: Synthetic peptide
  Seed: VSSFFSYTL (MAGC1_HUMAN)
VQSFFSYTV

SEQ ID NO: 86951 - protein, 9 aa, Artificial Sequence
  Description of Artificial Sequence: Synthetic peptide
  Seed: LQIPVSPSF (MAGC1_HUMAN)
LLIPVSPSW

SEQ ID NO: 86952 - protein, 9 aa, Artificial Sequence
  Description of Artificial Sequence: Synthetic peptide
  Seed: TSLSLPQSF (MAGC1_HUMAN)
TMLSLPQSY

SEQ ID NO: 86953 - protein, 11 aa, Artificial Sequence
  Description of Artificial Sequence: Synthetic peptide
  Seed: REVDPDDSYVF (MAGC1_HUMAN)
RHVDPDDSYVL

SEQ ID NO: 86954 - protein, 9 aa, Artificial Sequence
  Description of Artificial Sequence: Synthetic peptide
  Seed: SSPESAQSA (MAGC1_HUMAN)
SFPESAQSI

SEQ ID NO: 86955 - protein, 10 aa, Artificial Sequence
  Description of Artificial Sequence: Synthetic peptide
  Seed: SFPSSTSSSL (MAGC1_HUMAN)
SMPSSTSSSM

SEQ ID NO: 86956 - protein, 10 aa, Artificial Sequence
  Description of Artificial Sequence: Synthetic peptide
  Seed: FAFGEPRELL (MAGC1_HUMAN)
FTFGEPRELA

SEQ ID NO: 86957 - protein, 10 aa, Artificial Sequence
  Description of Artificial Sequence: Synthetic peptide
  Seed: SRYTGYFPVI (MAGC1_HUMAN)
SSYTGYFPVW

SEQ ID NO: 86958 - protein, 10 aa, Artificial Sequence
  Description of Artificial Sequence: Synthetic peptide
  Seed: YTLDEKVDEL (MAGC1_HUMAN)
YNLDEKVDEL

SEQ ID NO: 86959 - protein, 10 aa, Artificial Sequence
  Description of Artificial Sequence: Synthetic peptide
  Seed: ASSSVMSPSF (MAGC1_HUMAN)
AFSSVMSPSW

SEQ ID NO: 86960 - protein, 9 aa, Artificial Sequence
  Description of Artificial Sequence: Synthetic peptide
  Seed: SPLQIVPSL (MAGC1_HUMAN)
SYLQIVPSF

SEQ ID NO: 86961 - protein, 9 aa, Artificial Sequence
  Description of Artificial Sequence: Synthetic peptide
  Seed: VIWDVLSGI (MAGC1_HUMAN)
VMWDVLSGR

SEQ ID NO: 86962 - protein, 10 aa, Artificial Sequence
  Description of Artificial Sequence: Synthetic peptide
  Seed: FSSSTSLSPF (MAGC1_HUMAN)
FSSSTSLSPY

SEQ ID NO: 86963 - protein, 10 aa, Artificial Sequence
  Description of Artificial Sequence: Synthetic peptide
  Seed: MPTAGMPSLL (MAGC1_HUMAN)
MQTAGMPSLL

SEQ ID NO: 86964 - protein, 10 aa, Artificial Sequence
  Description of Artificial Sequence: Synthetic peptide
  Seed: PLQIPGSPSF (MAGC1_HUMAN)
PWQIPGSPSY

SEQ ID NO: 86965 - protein, 10 aa, Artificial Sequence
  Description of Artificial Sequence: Synthetic peptide
  Seed: ISRYTGYFPV (MAGC1_HUMAN)
IPRYTGYFPM

SEQ ID NO: 86966 - protein, 11 aa, Artificial Sequence
  Description of Artificial Sequence: Synthetic peptide
  Seed: SLREVDPDDSY (MAGC1_HUMAN)
SLREVDPDDSF

SEQ ID NO: 86967 - protein, 10 aa, Artificial Sequence
  Description of Artificial Sequence: Synthetic peptide
  Seed: LQIVPSLPEW (MAGC1_HUMAN)
LKIVPSLPEF

SEQ ID NO: 86968 - protein, 10 aa, Artificial Sequence
  Description of Artificial Sequence: Synthetic peptide
  Seed: ATESASSSVM (MAGC1_HUMAN)
ATESASSSVF

SEQ ID NO: 86969 - protein, 10 aa, Artificial Sequence
  Description of Artificial Sequence: Synthetic peptide
  Seed: REFIEILFGI (MAGC1_HUMAN)
RMFIEILFGM

SEQ ID NO: 86970 - protein, 9 aa, Artificial Sequence
  Description of Artificial Sequence: Synthetic peptide
  Seed: LSDEQGMSQ (MAGC1_HUMAN)
LQDEQGMSL

SEQ ID NO: 86971 - protein, 9 aa, Artificial Sequence
  Description of Artificial Sequence: Synthetic peptide
  Seed: NPASSFFSS (MAGC1_HUMAN)
NMASSFFSF

SEQ ID NO: 86972 - protein, 8 aa, Artificial Sequence
  Description of Artificial Sequence: Synthetic peptide
  Seed: FSSTLVSL (MAGC1_HUMAN)
FASTLVSF

SEQ ID NO: 86973 - protein, 9 aa, Artificial Sequence
  Description of Artificial Sequence: Synthetic peptide
  Seed: ISFSSSTSL (MAGC1_HUMAN)
IKFSSSTSY

SEQ ID NO: 86974 - protein, 9 aa, Artificial Sequence
  Description of Artificial Sequence: Synthetic peptide
  Seed: WVQEHYLEY (MAGC1_HUMAN)
WYQEHYLEY

SEQ ID NO: 86975 - protein, 10 aa, Artificial Sequence
  Description of Artificial Sequence: Synthetic peptide
  Seed: RAGREHFAFG (MAGC1_HUMAN)
RSGREHFAFR

SEQ ID NO: 86976 - protein, 9 aa, Artificial Sequence
  Description of Artificial Sequence: Synthetic peptide
  Seed: VSSSFSYTL (MAGC1_HUMAN)
VCSSFSYTW

SEQ ID NO: 86977 - protein, 10 aa, Artificial Sequence
  Description of Artificial Sequence: Synthetic peptide
  Seed: SILQSSPESA (MAGC1_HUMAN)
STLQSSPESV

SEQ ID NO: 86978 - protein, 9 aa, Artificial Sequence
  Description of Artificial Sequence: Synthetic peptide
  Seed: CSSSTPSSL (MAGC1_HUMAN)
CQSSTPSSL

SEQ ID NO: 86979 - protein, 10 aa, Artificial Sequence
  Description of Artificial Sequence: Synthetic peptide
  Seed: LSGIGVRAGR (MAGC1_HUMAN)
LAGIGVRAGK

SEQ ID NO: 86980 - protein, 11 aa, Artificial Sequence
  Description of Artificial Sequence: Synthetic peptide
  Seed: FPQSPLQIPMT (MAGC1_HUMAN)
FPQSPLQIPMA

SEQ ID NO: 86981 - protein, 9 aa, Artificial Sequence
  Description of Artificial Sequence: Synthetic peptide
  Seed: FSYTLLSLF (MAGC1_HUMAN)
FPYTLLSLI

SEQ ID NO: 86982 - protein, 9 aa, Artificial Sequence
  Description of Artificial Sequence: Synthetic peptide
  Seed: LQIPVSPSF (MAGC1_HUMAN)
LIIPVSPSY

SEQ ID NO: 86983 - protein, 9 aa, Artificial Sequence
  Description of Artificial Sequence: Synthetic peptide
  Seed: FSSTLLSLF (MAGC1_HUMAN)
FHSTLLSLY

SEQ ID NO: 86984 - protein, 9 aa, Artificial Sequence
  Description of Artificial Sequence: Synthetic peptide
  Seed: SSPESAQSA (MAGC1_HUMAN)
SSPESAQSL

SEQ ID NO: 86985 - protein, 9 aa, Artificial Sequence
  Description of Artificial Sequence: Synthetic peptide
  Seed: SSSDTLLES (MAGC1_HUMAN)
SVSDTLLEY

SEQ ID NO: 86986 - protein, 10 aa, Artificial Sequence
  Description of Artificial Sequence: Synthetic peptide
  Seed: TTDDSTATES (MAGC1_HUMAN)
TNDDSTATEI

SEQ ID NO: 86987 - protein, 9 aa, Artificial Sequence
  Description of Artificial Sequence: Synthetic peptide
  Seed: ALLSIFQSS (MAGC1_HUMAN)
AALSIFQSI

SEQ ID NO: 86988 - protein, 10 aa, Artificial Sequence
  Description of Artificial Sequence: Synthetic peptide
  Seed: VISFSSSTSL (MAGC1_HUMAN)
VCSFSSSTSW

SEQ ID NO: 86989 - protein, 10 aa, Artificial Sequence
  Description of Artificial Sequence: Synthetic peptide
  Seed: STPSSLPQSF (MAGC1_HUMAN)
SWPSSLPQSM

SEQ ID NO: 86990 - protein, 9 aa, Artificial Sequence
  Description of Artificial Sequence: Synthetic peptide
  Seed: SSPESPLQS (MAGC1_HUMAN)
SMPESPLQM

SEQ ID NO: 86991 - protein, 11 aa, Artificial Sequence
  Description of Artificial Sequence: Synthetic peptide
  Seed: MSPLYFPQSPL (MAGC1_HUMAN)
MHPLYFPQSPV

SEQ ID NO: 86992 - protein, 9 aa, Artificial Sequence
  Description of Artificial Sequence: Synthetic peptide
  Seed: VSSSSSSTL (MAGC1_HUMAN)
VQSSSSSTF

SEQ ID NO: 86993 - protein, 9 aa, Artificial Sequence
  Description of Artificial Sequence: Synthetic peptide
  Seed: KDSQSPLQI (MAGC1_HUMAN)
KMSQSPLQV

SEQ ID NO: 86994 - protein, 9 aa, Artificial Sequence
  Description of Artificial Sequence: Synthetic peptide
  Seed: KAREFIEIL (MAGC1_HUMAN)
KSREFIEIM

SEQ ID NO: 86995 - protein, 9 aa, Artificial Sequence
  Description of Artificial Sequence: Synthetic peptide
  Seed: LQIPVSAAS (MAGC1_HUMAN)
LLIPVSAAV

SEQ ID NO: 86996 - protein, 9 aa, Artificial Sequence
  Description of Artificial Sequence: Synthetic peptide
  Seed: SRYTGYFPV (MAGC1_HUMAN)
SQYTGYFPA

SEQ ID NO: 86997 - protein, 9 aa, Artificial Sequence
  Description of Artificial Sequence: Synthetic peptide
  Seed: SSSSTLLSL (MAGC1_HUMAN)
SYSSTLLSM

SEQ ID NO: 86998 - protein, 9 aa, Artificial Sequence
  Description of Artificial Sequence: Synthetic peptide
  Seed: MTSSFSSTL (MAGC1_HUMAN)
MGSSFSSTW

SEQ ID NO: 86999 - protein, 9 aa, Artificial Sequence
  Description of Artificial Sequence: Synthetic peptide
  Seed: MTSSFSSTL (MAGC1_HUMAN)
MISSFSSTW

SEQ ID NO: 87000 - protein, 10 aa, Artificial Sequence
  Description of Artificial Sequence: Synthetic peptide
  Seed: QRPVSSFFSY (MAGC1_HUMAN)
QKPVSSFFSF

SEQ ID NO: 87001 - protein, 10 aa, Artificial Sequence
  Description of Artificial Sequence: Synthetic peptide
  Seed: VISFSSSTSL (MAGC1_HUMAN)
VDSFSSSTSM

SEQ ID NO: 87002 - protein, 9 aa, Artificial Sequence
  Description of Artificial Sequence: Synthetic peptide
  Seed: RKVVEFLAM (MAGC1_HUMAN)
RMVVEFLAM

SEQ ID NO: 87003 - protein, 10 aa, Artificial Sequence
  Description of Artificial Sequence: Synthetic peptide
  Seed: ASSSTLVSIF (MAGC1_HUMAN)
AQSSTLVSIM

SEQ ID NO: 87004 - protein, 9 aa, Artificial Sequence
  Description of Artificial Sequence: Synthetic peptide
  Seed: LQRPVSSFF (MAGC1_HUMAN)
LVRPVSSFM

SEQ ID NO: 87005 - protein, 9 aa, Artificial Sequence
  Description of Artificial Sequence: Synthetic peptide
  Seed: AASSSTLVS (MAGC1_HUMAN)
AASSSTLVM

SEQ ID NO: 87006 - protein, 10 aa, Artificial Sequence
  Description of Artificial Sequence: Synthetic peptide
  Seed: NPASSFFSSA (MAGC1_HUMAN)
NSASSFFSSI

SEQ ID NO: 87007 - protein, 9 aa, Artificial Sequence
  Description of Artificial Sequence: Synthetic peptide
  Seed: IESEPLFTY (MAGC1_HUMAN)
ISSEPLFTI

SEQ ID NO: 87008 - protein, 9 aa, Artificial Sequence
  Description of Artificial Sequence: Synthetic peptide
  Seed: YTLASLLQS (MAGC1_HUMAN)
YSLASLLQL

SEQ ID NO: 87009 - protein, 9 aa, Artificial Sequence
  Description of Artificial Sequence: Synthetic peptide
  Seed: FAFGEPREL (MAGC1_HUMAN)
FKFGEPREF

SEQ ID NO: 87010 - protein, 8 aa, Artificial Sequence
  Description of Artificial Sequence: Synthetic peptide
  Seed: FSYTLLSL (MAGC1_HUMAN)
FTYTLLSM

SEQ ID NO: 87011 - protein, 9 aa, Artificial Sequence
  Description of Artificial Sequence: Synthetic peptide
  Seed: FSERTQSTF (MAGC1_HUMAN)
FAERTQSTY

SEQ ID NO: 87012 - protein, 9 aa, Artificial Sequence
  Description of Artificial Sequence: Synthetic peptide
  Seed: FSSTLVSLF (MAGC1_HUMAN)
FQSTLVSLW

SEQ ID NO: 87013 - protein, 9 aa, Artificial Sequence
  Description of Artificial Sequence: Synthetic peptide
  Seed: LKYQVKQPI (MAGC1_HUMAN)
LNYQVKQPY

SEQ ID NO: 87014 - protein, 10 aa, Artificial Sequence
  Description of Artificial Sequence: Synthetic peptide
  Seed: SSFSSTLLSI (MAGC1_HUMAN)
SAFSSTLLSW

SEQ ID NO: 87015 - protein, 9 aa, Artificial Sequence
  Description of Artificial Sequence: Synthetic peptide
  Seed: AGREHFAFG (MAGC1_HUMAN)
AHREHFAFK

SEQ ID NO: 87016 - protein, 9 aa, Artificial Sequence
  Description of Artificial Sequence: Synthetic peptide
  Seed: GYFPVIFRK (MAGC1_HUMAN)
GNFPVIFRR

SEQ ID NO: 87017 - protein, 9 aa, Artificial Sequence
  Description of Artificial Sequence: Synthetic peptide
  Seed: SSSVMSPSF (MAGC1_HUMAN)
SASVMSPSM

SEQ ID NO: 87018 - protein, 10 aa, Artificial Sequence
  Description of Artificial Sequence: Synthetic peptide
  Seed: VSSSFSYTLL (MAGC1_HUMAN)
VTSSFSYTLY

SEQ ID NO: 87019 - protein, 9 aa, Artificial Sequence
  Description of Artificial Sequence: Synthetic peptide
  Seed: VSAASSSTL (MAGC1_HUMAN)
VAAASSSTV

SEQ ID NO: 87020 - protein, 9 aa, Artificial Sequence
  Description of Artificial Sequence: Synthetic peptide
  Seed: RTHSTFEGF (MAGC1_HUMAN)
RIHSTFEGL

SEQ ID NO: 87021 - protein, 10 aa, Artificial Sequence
  Description of Artificial Sequence: Synthetic peptide
  Seed: QIPVSSSFSY (MAGC1_HUMAN)
QMPVSSSFSF

SEQ ID NO: 87022 - protein, 10 aa, Artificial Sequence
  Description of Artificial Sequence: Synthetic peptide
  Seed: SSPECTQSTF (MAGC1_HUMAN)
SLPECTQSTF

SEQ ID NO: 87023 - protein, 9 aa, Artificial Sequence
  Description of Artificial Sequence: Synthetic peptide
  Seed: TESASSSVM (MAGC1_HUMAN)
TESASSSVP

SEQ ID NO: 87024 - protein, 9 aa, Artificial Sequence
  Description of Artificial Sequence: Synthetic peptide
  Seed: ELARFLLLK (MAGC1_HUMAN)
ETARFLLLR

SEQ ID NO: 87025 - protein, 10 aa, Artificial Sequence
  Description of Artificial Sequence: Synthetic peptide
  Seed: SFFSYTLASL (MAGC1_HUMAN)
STFSYTLASV

SEQ ID NO: 87026 - protein, 9 aa, Artificial Sequence
  Description of Artificial Sequence: Synthetic peptide
  Seed: FQSSLQSPV (MAGC1_HUMAN)
FTSSLQSPV

SEQ ID NO: 87027 - protein, 10 aa, Artificial Sequence
  Description of Artificial Sequence: Synthetic peptide
  Seed: YVFVNTLDLT (MAGC1_HUMAN)
YMFVNTLDLL

SEQ ID NO: 87028 - protein, 9 aa, Artificial Sequence
  Description of Artificial Sequence: Synthetic peptide
  Seed: SLFQSFSER (MAGC1_HUMAN)
SQFQSFSER

SEQ ID NO: 87029 - protein, 9 aa, Artificial Sequence
  Description of Artificial Sequence: Synthetic peptide
  Seed: SSSVMSPSF (MAGC1_HUMAN)
SYSVMSPSY

SEQ ID NO: 87030 - protein, 10 aa, Artificial Sequence
  Description of Artificial Sequence: Synthetic peptide
  Seed: TGYFPVIFRK (MAGC1_HUMAN)
TAYFPVIFRS

SEQ ID NO: 87031 - protein, 9 aa, Artificial Sequence
  Description of Artificial Sequence: Synthetic peptide
  Seed: AQSPLQSPV (MAGC1_HUMAN)
AKSPLQSPY

SEQ ID NO: 87032 - protein, 9 aa, Artificial Sequence
  Description of Artificial Sequence: Synthetic peptide
  Seed: FSYTLLSLF (MAGC1_HUMAN)
FYYTLLSLM

SEQ ID NO: 87033 - protein, 9 aa, Artificial Sequence
  Description of Artificial Sequence: Synthetic peptide
  Seed: TLLSLFQSF (MAGC1_HUMAN)
TILSLFQSI

SEQ ID NO: 87034 - protein, 9 aa, Artificial Sequence
  Description of Artificial Sequence: Synthetic peptide
  Seed: GFPQSVLQI (MAGC1_HUMAN)
GIPQSVLQL

SEQ ID NO: 87035 - protein, 9 aa, Artificial Sequence
  Description of Artificial Sequence: Synthetic peptide
  Seed: SQSSPVSSF (MAGC1_HUMAN)
SHSSPVSSF

SEQ ID NO: 87036 - protein, 9 aa, Artificial Sequence
  Description of Artificial Sequence: Synthetic peptide
  Seed: QSPLQGEEF (MAGC1_HUMAN)
QVPLQGEEL

SEQ ID NO: 87037 - protein, 9 aa, Artificial Sequence
  Description of Artificial Sequence: Synthetic peptide
  Seed: EMLTNVISR (MAGC1_HUMAN)
EVLTNVISK

SEQ ID NO: 87038 - protein, 10 aa, Artificial Sequence
  Description of Artificial Sequence: Synthetic peptide
  Seed: SPLQRPVSSF (MAGC1_HUMAN)
SPLQRPVSSI

SEQ ID NO: 87039 - protein, 11 aa, Artificial Sequence
  Description of Artificial Sequence: Synthetic peptide
  Seed: NTVPITFPSSY (MAGC1_HUMAN)
NTVPITFPSSK

SEQ ID NO: 87040 - protein, 9 aa, Artificial Sequence
  Description of Artificial Sequence: Synthetic peptide
  Seed: LKYQVKQPI (MAGC1_HUMAN)
LGYQVKQPY

SEQ ID NO: 87041 - protein, 9 aa, Artificial Sequence
  Description of Artificial Sequence: Synthetic peptide
  Seed: EFIEILFGI (MAGC1_HUMAN)
EIIEILFGV

SEQ ID NO: 87042 - protein, 11 aa, Artificial Sequence
  Description of Artificial Sequence: Synthetic peptide
  Seed: PSFSSTLVSLF (MAGC1_HUMAN)
PSFSSTLVSLW

SEQ ID NO: 87043 - protein, 9 aa, Artificial Sequence
  Description of Artificial Sequence: Synthetic peptide
  Seed: LSPLHFPQF (MAGC1_HUMAN)
LTPLHFPQM

SEQ ID NO: 87044 - protein, 9 aa, Artificial Sequence
  Description of Artificial Sequence: Synthetic peptide
  Seed: FSSTLLSLF (MAGC1_HUMAN)
FSSTLLSLV

SEQ ID NO: 87045 - protein, 9 aa, Artificial Sequence
  Description of Artificial Sequence: Synthetic peptide
  Seed: SAASSSTLV (MAGC1_HUMAN)
SVASSSTLI

SEQ ID NO: 87046 - protein, 11 aa, Artificial Sequence
  Description of Artificial Sequence: Synthetic peptide
  Seed: SPLQIPVSRSF (MAGC1_HUMAN)
SALQIPVSRSF

SEQ ID NO: 87047 - protein, 9 aa, Artificial Sequence
  Description of Artificial Sequence: Synthetic peptide
  Seed: REHFAFGEP (MAGC1_HUMAN)
REHFAFGEL

SEQ ID NO: 87048 - protein, 9 aa, Artificial Sequence
  Description of Artificial Sequence: Synthetic peptide
  Seed: DSYVFVNTL (MAGC1_HUMAN)
DIYVFVNTV

SEQ ID NO: 87049 - protein, 10 aa, Artificial Sequence
  Description of Artificial Sequence: Synthetic peptide
  Seed: PLQIPMTSSF (MAGC1_HUMAN)
PFQIPMTSSF

SEQ ID NO: 87050 - protein, 11 aa, Artificial Sequence
  Description of Artificial Sequence: Synthetic peptide
  Seed: ITFPSSYKDAL (MAGC1_HUMAN)
ITFPSSYKDAF

SEQ ID NO: 87051 - protein, 9 aa, Artificial Sequence
  Description of Artificial Sequence: Synthetic peptide
  Seed: SLLQSSHES (MAGC1_HUMAN)
SVLQSSHEV

SEQ ID NO: 87052 - protein, 9 aa, Artificial Sequence
  Description of Artificial Sequence: Synthetic peptide
  Seed: SSSDTLLES (MAGC1_HUMAN)
SASDTLLEY

SEQ ID NO: 87053 - protein, 10 aa, Artificial Sequence
  Description of Artificial Sequence: Synthetic peptide
  Seed: TGYFPVIFRK (MAGC1_HUMAN)
TTYFPVIFRD

SEQ ID NO: 87054 - protein, 9 aa, Artificial Sequence
  Description of Artificial Sequence: Synthetic peptide
  Seed: IPVSSSFSY (MAGC1_HUMAN)
IVVSSSFSM

SEQ ID NO: 87055 - protein, 9 aa, Artificial Sequence
  Description of Artificial Sequence: Synthetic peptide
  Seed: SVLQIPVSA (MAGC1_HUMAN)
SGLQIPVSY

SEQ ID NO: 87056 - protein, 9 aa, Artificial Sequence
  Description of Artificial Sequence: Synthetic peptide
  Seed: SSSFSYTLL (MAGC1_HUMAN)
SISFSYTLI

SEQ ID NO: 87057 - protein, 9 aa, Artificial Sequence
  Description of Artificial Sequence: Synthetic peptide
  Seed: TGYFPVIFR (MAGC1_HUMAN)
TNYFPVIFK

SEQ ID NO: 87058 - protein, 9 aa, Artificial Sequence
  Description of Artificial Sequence: Synthetic peptide
  Seed: VSSSFSYTL (MAGC1_HUMAN)
VGSSFSYTF

SEQ ID NO: 87059 - protein, 11 aa, Artificial Sequence
  Description of Artificial Sequence: Synthetic peptide
  Seed: IPVSRSFSSTL (MAGC1_HUMAN)
IAVSRSFSSTW

SEQ ID NO: 87060 - protein, 11 aa, Artificial Sequence
  Description of Artificial Sequence: Synthetic peptide
  Seed: SPLQIPMTSSF (MAGC1_HUMAN)
SGLQIPMTSSF

SEQ ID NO: 87061 - protein, 9 aa, Artificial Sequence
  Description of Artificial Sequence: Synthetic peptide
  Seed: FPSSTSSSL (MAGC1_HUMAN)
FISSTSSSY

SEQ ID NO: 87062 - protein, 10 aa, Artificial Sequence
  Description of Artificial Sequence: Synthetic peptide
  Seed: KRKVVEFLAM (MAGC1_HUMAN)
KYKVVEFLAY

SEQ ID NO: 87063 - protein, 9 aa, Artificial Sequence
  Description of Artificial Sequence: Synthetic peptide
  Seed: LQIPGSPSF (MAGC1_HUMAN)
LIIPGSPSI

SEQ ID NO: 87064 - protein, 9 aa, Artificial Sequence
  Description of Artificial Sequence: Synthetic peptide
  Seed: VSSSFSYTL (MAGC1_HUMAN)
VQSSFSYTI

SEQ ID NO: 87065 - protein, 10 aa, Artificial Sequence
  Description of Artificial Sequence: Synthetic peptide
  Seed: VSSSSSSTLL (MAGC1_HUMAN)
VNSSSSSTLY

SEQ ID NO: 87066 - protein, 11 aa, Artificial Sequence
  Description of Artificial Sequence: Synthetic peptide
  Seed: IPVSPSSSSTL (MAGC1_HUMAN)
IAVSPSSSSTL

SEQ ID NO: 87067 - protein, 9 aa, Artificial Sequence
  Description of Artificial Sequence: Synthetic peptide
  Seed: SPLQIVPSL (MAGC1_HUMAN)
SRLQIVPSF

SEQ ID NO: 87068 - protein, 9 aa, Artificial Sequence
  Description of Artificial Sequence: Synthetic peptide
  Seed: SLPEWEDSL (MAGC1_HUMAN)
SQPEWEDSY

SEQ ID NO: 87069 - protein, 11 aa, Artificial Sequence
  Description of Artificial Sequence: Synthetic peptide
  Seed: SLREVDPDDSY (MAGC1_HUMAN)
SMREVDPDDSF

SEQ ID NO: 87070 - protein, 9 aa, Artificial Sequence
  Description of Artificial Sequence: Synthetic peptide
  Seed: LQIPVSPSF (MAGC1_HUMAN)
LQIPVSPSI

SEQ ID NO: 87071 - protein, 9 aa, Artificial Sequence
  Description of Artificial Sequence: Synthetic peptide
  Seed: GDKDMPTAG (MAGC1_HUMAN)
GEKDMPTAC

SEQ ID NO: 87072 - protein, 11 aa, Artificial Sequence
  Description of Artificial Sequence: Synthetic peptide
  Seed: SLIESEPLFTY (MAGC1_HUMAN)
SAIESEPLFTY

SEQ ID NO: 87073 - protein, 10 aa, Artificial Sequence
  Description of Artificial Sequence: Synthetic peptide
  Seed: ILILSIIFIK (MAGC1_HUMAN)
IFILSIIFIR

SEQ ID NO: 87074 - protein, 9 aa, Artificial Sequence
  Description of Artificial Sequence: Synthetic peptide
  Seed: VQSPLQNPA (MAGC1_HUMAN)
VQSPLQNPL

SEQ ID NO: 87075 - protein, 10 aa, Artificial Sequence
  Description of Artificial Sequence: Synthetic peptide
  Seed: KGTYASEEVI (MAGC1_HUMAN)
KITYASEEVW

SEQ ID NO: 87076 - protein, 9 aa, Artificial Sequence
  Description of Artificial Sequence: Synthetic peptide
  Seed: SSPESAQSA (MAGC1_HUMAN)
SAPESAQSF

SEQ ID NO: 87077 - protein, 9 aa, Artificial Sequence
  Description of Artificial Sequence: Synthetic peptide
  Seed: LQIPMTSSF (MAGC1_HUMAN)
LTIPMTSSV

SEQ ID NO: 87078 - protein, 11 aa, Artificial Sequence
  Description of Artificial Sequence: Synthetic peptide
  Seed: SSSSSSTLLSL (MAGC1_HUMAN)
SFSSSSTLLSW

SEQ ID NO: 87079 - protein, 9 aa, Artificial Sequence
  Description of Artificial Sequence: Synthetic peptide
  Seed: ASSSVMSPS (MAGC1_HUMAN)
ASSSVMSPK

SEQ ID NO: 87080 - protein, 11 aa, Artificial Sequence
  Description of Artificial Sequence: Synthetic peptide
  Seed: RSFSSTLLSIF (MAGC1_HUMAN)
RAFSSTLLSIW

SEQ ID NO: 87081 - protein, 11 aa, Artificial Sequence
  Description of Artificial Sequence: Synthetic peptide
  Seed: SFSSSTSLSPF (MAGC1_HUMAN)
STSSSTSLSPW

SEQ ID NO: 87082 - protein, 9 aa, Artificial Sequence
  Description of Artificial Sequence: Synthetic peptide
  Seed: SSFPSSTSS (MAGC1_HUMAN)
SQFPSSTSF

SEQ ID NO: 87083 - protein, 9 aa, Artificial Sequence
  Description of Artificial Sequence: Synthetic peptide
  Seed: SAPEGEDSL (MAGC1_HUMAN)
SHPEGEDSV

SEQ ID NO: 87084 - protein, 10 aa, Artificial Sequence
  Description of Artificial Sequence: Synthetic peptide
  Seed: FSSSTSLSPF (MAGC1_HUMAN)
FKSSTSLSPW

SEQ ID NO: 87085 - protein, 9 aa, Artificial Sequence
  Description of Artificial Sequence: Synthetic peptide
  Seed: SAQSAFEGF (MAGC1_HUMAN)
SLQSAFEGY

SEQ ID NO: 87086 - protein, 10 aa, Artificial Sequence
  Description of Artificial Sequence: Synthetic peptide
  Seed: RAGREHFAFG (MAGC1_HUMAN)
RTGREHFAFI

SEQ ID NO: 87087 - protein, 9 aa, Artificial Sequence
  Description of Artificial Sequence: Synthetic peptide
  Seed: ASSFFSSAL (MAGC1_HUMAN)
AASFFSSAM

SEQ ID NO: 87088 - protein, 8 aa, Artificial Sequence
  Description of Artificial Sequence: Synthetic peptide
  Seed: SQNRLLIL (MAGC1_HUMAN)
SENRLLIL

SEQ ID NO: 87089 - protein, 9 aa, Artificial Sequence
  Description of Artificial Sequence: Synthetic peptide
  Seed: SSSTSLSPF (MAGC1_HUMAN)
SMSTSLSPW

SEQ ID NO: 87090 - protein, 10 aa, Artificial Sequence
  Description of Artificial Sequence: Synthetic peptide
  Seed: STSLSLPQSF (MAGC1_HUMAN)
SSSLSLPQSY

SEQ ID NO: 87091 - protein, 10 aa, Artificial Sequence
  Description of Artificial Sequence: Synthetic peptide
  Seed: RSFSSTLLSI (MAGC1_HUMAN)
RVFSSTLLSA

SEQ ID NO: 87092 - protein, 9 aa, Artificial Sequence
  Description of Artificial Sequence: Synthetic peptide
  Seed: SPLQIVPSL (MAGC1_HUMAN)
SMLQIVPSM

SEQ ID NO: 87093 - protein, 9 aa, Artificial Sequence
  Description of Artificial Sequence: Synthetic peptide
  Seed: EILFGISLR (MAGC1_HUMAN)
EQLFGISLR

SEQ ID NO: 87094 - protein, 9 aa, Artificial Sequence
  Description of Artificial Sequence: Synthetic peptide
  Seed: TLDLTSEGC (MAGC1_HUMAN)
TTDLTSEGV

SEQ ID NO: 87095 - protein, 9 aa, Artificial Sequence
  Description of Artificial Sequence: Synthetic peptide
  Seed: TLLSLFQSF (MAGC1_HUMAN)
TFLSLFQSF

SEQ ID NO: 87096 - protein, 9 aa, Artificial Sequence
  Description of Artificial Sequence: Synthetic peptide
  Seed: EMLTNVISR (MAGC1_HUMAN)
EVLTNVISR

SEQ ID NO: 87097 - protein, 11 aa, Artificial Sequence
  Description of Artificial Sequence: Synthetic peptide
  Seed: SSSFSYTLLSL (MAGC1_HUMAN)
SYSFSYTLLSW

SEQ ID NO: 87098 - protein, 10 aa, Artificial Sequence
  Description of Artificial Sequence: Synthetic peptide
  Seed: LQIPMTSSFS (MAGC1_HUMAN)
LQIPMTSSFN

SEQ ID NO: 87099 - protein, 10 aa, Artificial Sequence
  Description of Artificial Sequence: Synthetic peptide
  Seed: SSPPRYEFLW (MAGC1_HUMAN)
SFPPRYEFLI

SEQ ID NO: 87100 - protein, 9 aa, Artificial Sequence
  Description of Artificial Sequence: Synthetic peptide
  Seed: RSFSSTLLS (MAGC1_HUMAN)
RMFSSTLLV

SEQ ID NO: 87101 - protein, 11 aa, Artificial Sequence
  Description of Artificial Sequence: Synthetic peptide
  Seed: LQIPVSSSFSY (MAGC1_HUMAN)
LMIPVSSSFSY

SEQ ID NO: 87102 - protein, 9 aa, Artificial Sequence
  Description of Artificial Sequence: Synthetic peptide
  Seed: FQSSLQSPV (MAGC1_HUMAN)
FMSSLQSPM

SEQ ID NO: 87103 - protein, 9 aa, Artificial Sequence
  Description of Artificial Sequence: Synthetic peptide
  Seed: KVDELARFL (MAGC1_HUMAN)
KMDELARFY

SEQ ID NO: 87104 - protein, 10 aa, Artificial Sequence
  Description of Artificial Sequence: Synthetic peptide
  Seed: ISRYTGYFPV (MAGC1_HUMAN)
IERYTGYFPL

SEQ ID NO: 87105 - protein, 9 aa, Artificial Sequence
  Description of Artificial Sequence: Synthetic peptide
  Seed: KVVEFLAML (MAGC1_HUMAN)
KNVEFLAMW

SEQ ID NO: 87106 - protein, 10 aa, Artificial Sequence
  Description of Artificial Sequence: Synthetic peptide
  Seed: STPSSLPQSF (MAGC1_HUMAN)
SWPSSLPQSL

SEQ ID NO: 87107 - protein, 9 aa, Artificial Sequence
  Description of Artificial Sequence: Synthetic peptide
  Seed: EYTSSSDTL (MAGC1_HUMAN)
EHTSSSDTI

SEQ ID NO: 87108 - protein, 8 aa, Artificial Sequence
  Description of Artificial Sequence: Synthetic peptide
  Seed: SSFSYTLL (MAGC1_HUMAN)
SSFSYTLY

SEQ ID NO: 87109 - protein, 8 aa, Artificial Sequence
  Description of Artificial Sequence: Synthetic peptide
  Seed: AFGEPREL (MAGC1_HUMAN)
AFGEPREF

SEQ ID NO: 87110 - protein, 10 aa, Artificial Sequence
  Description of Artificial Sequence: Synthetic peptide
  Seed: ASSFFSSALL (MAGC1_HUMAN)
AASFFSSALF

SEQ ID NO: 87111 - protein, 11 aa, Artificial Sequence
  Description of Artificial Sequence: Synthetic peptide
  Seed: SFFSSALLSIF (MAGC1_HUMAN)
SLFSSALLSIW

SEQ ID NO: 87112 - protein, 10 aa, Artificial Sequence
  Description of Artificial Sequence: Synthetic peptide
  Seed: LQIPMTSSFS (MAGC1_HUMAN)
LLIPMTSSFF

SEQ ID NO: 87113 - protein, 9 aa, Artificial Sequence
  Description of Artificial Sequence: Synthetic peptide
  Seed: KVVEFLAML (MAGC1_HUMAN)
KSVEFLAMF

SEQ ID NO: 87114 - protein, 9 aa, Artificial Sequence
  Description of Artificial Sequence: Synthetic peptide
  Seed: NTVPITFPS (MAGC1_HUMAN)
NLVPITFPL

SEQ ID NO: 87115 - protein, 9 aa, Artificial Sequence
  Description of Artificial Sequence: Synthetic peptide
  Seed: YTLLSLFQS (MAGC1_HUMAN)
YILLSLFQV

SEQ ID NO: 87116 - protein, 9 aa, Artificial Sequence
  Description of Artificial Sequence: Synthetic peptide
  Seed: LQNPASSFF (MAGC1_HUMAN)
LPNPASSFW

SEQ ID NO: 87117 - protein, 9 aa, Artificial Sequence
  Description of Artificial Sequence: Synthetic peptide
  Seed: NSSPPRYEF (MAGC1_HUMAN)
NFSPPRYEY

SEQ ID NO: 87118 - protein, 9 aa, Artificial Sequence
  Description of Artificial Sequence: Synthetic peptide
  Seed: KVWVQEHYL (MAGC1_HUMAN)
KMWVQEHYR

SEQ ID NO: 87119 - protein, 9 aa, Artificial Sequence
  Description of Artificial Sequence: Synthetic peptide
  Seed: FFSSALLSI (MAGC1_HUMAN)
FTSSALLSA

SEQ ID NO: 87120 - protein, 10 aa, Artificial Sequence
  Description of Artificial Sequence: Synthetic peptide
  Seed: SFFSSALLSI (MAGC1_HUMAN)
SSFSSALLSF

SEQ ID NO: 87121 - protein, 9 aa, Artificial Sequence
  Description of Artificial Sequence: Synthetic peptide
  Seed: SSPERTHST (MAGC1_HUMAN)
SHPERTHSL

SEQ ID NO: 87122 - protein, 10 aa, Artificial Sequence
  Description of Artificial Sequence: Synthetic peptide
  Seed: QIPVSSSFSY (MAGC1_HUMAN)
QQPVSSSFSM

SEQ ID NO: 87123 - protein, 9 aa, Artificial Sequence
  Description of Artificial Sequence: Synthetic peptide
  Seed: SLPQSFPES (MAGC1_HUMAN)
SMPQSFPEL

SEQ ID NO: 87124 - protein, 9 aa, Artificial Sequence
  Description of Artificial Sequence: Synthetic peptide
  Seed: EHFAFGEPR (MAGC1_HUMAN)
ENFAFGEPR

SEQ ID NO: 87125 - protein, 11 aa, Artificial Sequence
  Description of Artificial Sequence: Synthetic peptide
  Seed: STFEGFAQSSL (MAGC1_HUMAN)
SIFEGFAQSSL

SEQ ID NO: 87126 - protein, 9 aa, Artificial Sequence
  Description of Artificial Sequence: Synthetic peptide
  Seed: SAASSSTLV (MAGC1_HUMAN)
STASSSTLV

SEQ ID NO: 87127 - protein, 10 aa, Artificial Sequence
  Description of Artificial Sequence: Synthetic peptide
  Seed: ICSSSTSLSL (MAGC1_HUMAN)
IKSSSTSLSY

SEQ ID NO: 87128 - protein, 9 aa, Artificial Sequence
  Description of Artificial Sequence: Synthetic peptide
  Seed: VIKRKVVEF (MAGC1_HUMAN)
VAKRKVVEV

SEQ ID NO: 87129 - protein, 11 aa, Artificial Sequence
  Description of Artificial Sequence: Synthetic peptide
  Seed: SSFSYTLLSLF (MAGC1_HUMAN)
SCFSYTLLSLW

SEQ ID NO: 87130 - protein, 10 aa, Artificial Sequence
  Description of Artificial Sequence: Synthetic peptide
  Seed: VSSSSSSTLL (MAGC1_HUMAN)
VQSSSSSTLY

SEQ ID NO: 87131 - protein, 10 aa, Artificial Sequence
  Description of Artificial Sequence: Synthetic peptide
  Seed: SRYTGYFPVI (MAGC1_HUMAN)
SCYTGYFPVM

SEQ ID NO: 87132 - protein, 9 aa, Artificial Sequence
  Description of Artificial Sequence: Synthetic peptide
  Seed: WVQEHYLEY (MAGC1_HUMAN)
WSQEHYLEV

SEQ ID NO: 87133 - protein, 9 aa, Artificial Sequence
  Description of Artificial Sequence: Synthetic peptide
  Seed: SQSPPEGPV (MAGC1_HUMAN)
SMSPPEGPL

SEQ ID NO: 87134 - protein, 10 aa, Artificial Sequence
  Description of Artificial Sequence: Synthetic peptide
  Seed: SSSSTLLSLF (MAGC1_HUMAN)
SQSSTLLSLM

SEQ ID NO: 87135 - protein, 9 aa, Artificial Sequence
  Description of Artificial Sequence: Synthetic peptide
  Seed: SRSFSSTLL (MAGC1_HUMAN)
SQSFSSTLF

SEQ ID NO: 87136 - protein, 11 aa, Artificial Sequence
  Description of Artificial Sequence: Synthetic peptide
  Seed: KRKVVEFLAML (MAGC1_HUMAN)
KLKVVEFLAMV

SEQ ID NO: 87137 - protein, 10 aa, Artificial Sequence
  Description of Artificial Sequence: Synthetic peptide
  Seed: WGPRAHSEVI (MAGC1_HUMAN)
WNPRAHSEVI

SEQ ID NO: 87138 - protein, 9 aa, Artificial Sequence
  Description of Artificial Sequence: Synthetic peptide
  Seed: SPPQGEDSM (MAGC1_HUMAN)
STPQGEDSM

SEQ ID NO: 87139 - protein, 10 aa, Artificial Sequence
  Description of Artificial Sequence: Synthetic peptide
  Seed: VSICSSSTSL (MAGC1_HUMAN)
VSICSSSTSW

SEQ ID NO: 87140 - protein, 9 aa, Artificial Sequence
  Description of Artificial Sequence: Synthetic peptide
  Seed: VSPSFSSTL (MAGC1_HUMAN)
VPPSFSSTI

SEQ ID NO: 87141 - protein, 10 aa, Artificial Sequence
  Description of Artificial Sequence: Synthetic peptide
  Seed: LQIPVSRSFS (MAGC1_HUMAN)
LAIPVSRSFY

SEQ ID NO: 87142 - protein, 9 aa, Artificial Sequence
  Description of Artificial Sequence: Synthetic peptide
  Seed: SSFPSSTSS (MAGC1_HUMAN)
SSFPSSTSI

SEQ ID NO: 87143 - protein, 9 aa, Artificial Sequence
  Description of Artificial Sequence: Synthetic peptide
  Seed: VSPSSSSTL (MAGC1_HUMAN)
VTPSSSSTV

SEQ ID NO: 87144 - protein, 10 aa, Artificial Sequence
  Description of Artificial Sequence: Synthetic peptide
  Seed: ASSFFSSALL (MAGC1_HUMAN)
ASSFFSSALM

SEQ ID NO: 87145 - protein, 9 aa, Artificial Sequence
  Description of Artificial Sequence: Synthetic peptide
  Seed: SSPECTQST (MAGC1_HUMAN)
SMPECTQSF

SEQ ID NO: 87146 - protein, 9 aa, Artificial Sequence
  Description of Artificial Sequence: Synthetic peptide
  Seed: TFEGFPQSL (MAGC1_HUMAN)
TREGFPQSM

SEQ ID NO: 87147 - protein, 11 aa, Artificial Sequence
  Description of Artificial Sequence: Synthetic peptide
  Seed: AASSSTLVSIF (MAGC1_HUMAN)
AMSSSTLVSIY

SEQ ID NO: 87148 - protein, 9 aa, Artificial Sequence
  Description of Artificial Sequence: Synthetic peptide
  Seed: DALKDVEER (MAGC1_HUMAN)
DILKDVEER

SEQ ID NO: 87149 - protein, 9 aa, Artificial Sequence
  Description of Artificial Sequence: Synthetic peptide
  Seed: LQIVPSLPE (MAGC1_HUMAN)
LMIVPSLPL

SEQ ID NO: 87150 - protein, 10 aa, Artificial Sequence
  Description of Artificial Sequence: Synthetic peptide
  Seed: EVIWDVLSGI (MAGC1_HUMAN)
EVIWDVLSGT

SEQ ID NO: 87151 - protein, 11 aa, Artificial Sequence
  Description of Artificial Sequence: Synthetic peptide
  Seed: SFFSYTLASLL (MAGC1_HUMAN)
SCFSYTLASLW

SEQ ID NO: 87152 - protein, 11 aa, Artificial Sequence
  Description of Artificial Sequence: Synthetic peptide
  Seed: IPVSSSFSYTL (MAGC1_HUMAN)
ICVSSSFSYTF

SEQ ID NO: 87153 - protein, 9 aa, Artificial Sequence
  Description of Artificial Sequence: Synthetic peptide
  Seed: STFEGFPQS (MAGC1_HUMAN)
SPFEGFPQP

SEQ ID NO: 87154 - protein, 10 aa, Artificial Sequence
  Description of Artificial Sequence: Synthetic peptide
  Seed: VWVQEHYLEY (MAGC1_HUMAN)
VQVQEHYLEF

SEQ ID NO: 87155 - protein, 9 aa, Artificial Sequence
  Description of Artificial Sequence: Synthetic peptide
  Seed: SRYTGYFPV (MAGC1_HUMAN)
SHYTGYFPF

SEQ ID NO: 87156 - protein, 9 aa, Artificial Sequence
  Description of Artificial Sequence: Synthetic peptide
  Seed: ISRYTGYFP (MAGC1_HUMAN)
ILRYTGYFK

SEQ ID NO: 87157 - protein, 9 aa, Artificial Sequence
  Description of Artificial Sequence: Synthetic peptide
  Seed: EFIEILFGI (MAGC1_HUMAN)
ENIEILFGL

SEQ ID NO: 87158 - protein, 9 aa, Artificial Sequence
  Description of Artificial Sequence: Synthetic peptide
  Seed: ESSSPVDEY (MAGC1_HUMAN)
ELSSPVDEK

SEQ ID NO: 87159 - protein, 9 aa, Artificial Sequence
  Description of Artificial Sequence: Synthetic peptide
  Seed: MPSLLQSSS (MAGC1_HUMAN)
MISLLQSSF

SEQ ID NO: 87160 - protein, 9 aa, Artificial Sequence
  Description of Artificial Sequence: Synthetic peptide
  Seed: FTYTLDEKV (MAGC1_HUMAN)
FQYTLDEKV

SEQ ID NO: 87161 - protein, 9 aa, Artificial Sequence
  Description of Artificial Sequence: Synthetic peptide
  Seed: LSDEQGMSQ (MAGC1_HUMAN)
LNDEQGMSF

SEQ ID NO: 87162 - protein, 9 aa, Artificial Sequence
  Description of Artificial Sequence: Synthetic peptide
  Seed: EGDDTQSPL (MAGC1_HUMAN)
EYDDTQSPL

SEQ ID NO: 87163 - protein, 9 aa, Artificial Sequence
  Description of Artificial Sequence: Synthetic peptide
  Seed: NVISRYTGY (MAGC1_HUMAN)
NTISRYTGF

SEQ ID NO: 87164 - protein, 10 aa, Artificial Sequence
  Description of Artificial Sequence: Synthetic peptide
  Seed: SSFSSTLLSI (MAGC1_HUMAN)
SSFSSTLLSA

SEQ ID NO: 87165 - protein, 11 aa, Artificial Sequence
  Description of Artificial Sequence: Synthetic peptide
  Seed: QSSPERTHSTF (MAGC1_HUMAN)
QTSPERTHSTF

SEQ ID NO: 87166 - protein, 9 aa, Artificial Sequence
  Description of Artificial Sequence: Synthetic peptide
  Seed: ESSSPVDEY (MAGC1_HUMAN)
EASSPVDEF

SEQ ID NO: 87167 - protein, 10 aa, Artificial Sequence
  Description of Artificial Sequence: Synthetic peptide
  Seed: LQIPMTSSFS (MAGC1_HUMAN)
LQIPMTSSFM

SEQ ID NO: 87168 - protein, 10 aa, Artificial Sequence
  Description of Artificial Sequence: Synthetic peptide
  Seed: SRYTGYFPVI (MAGC1_HUMAN)
STYTGYFPVM

SEQ ID NO: 87169 - protein, 9 aa, Artificial Sequence
  Description of Artificial Sequence: Synthetic peptide
  Seed: SSPESAQST (MAGC1_HUMAN)
SVPESAQSL

SEQ ID NO: 87170 - protein, 10 aa, Artificial Sequence
  Description of Artificial Sequence: Synthetic peptide
  Seed: PMTSSFSSTL (MAGC1_HUMAN)
PETSSFSSTV

SEQ ID NO: 87171 - protein, 10 aa, Artificial Sequence
  Description of Artificial Sequence: Synthetic peptide
  Seed: ICSSSTPSSL (MAGC1_HUMAN)
IMSSSTPSSF

SEQ ID NO: 87172 - protein, 9 aa, Artificial Sequence
  Description of Artificial Sequence: Synthetic peptide
  Seed: AQSPLQIPV (MAGC1_HUMAN)
AKSPLQIPY

SEQ ID NO: 87173 - protein, 10 aa, Artificial Sequence
  Description of Artificial Sequence: Synthetic peptide
  Seed: SLFQSFSERT (MAGC1_HUMAN)
SMFQSFSERR

SEQ ID NO: 87174 - protein, 9 aa, Artificial Sequence
  Description of Artificial Sequence: Synthetic peptide
  Seed: SSSVMSPSF (MAGC1_HUMAN)
SQSVMSPSY

SEQ ID NO: 87175 - protein, 10 aa, Artificial Sequence
  Description of Artificial Sequence: Synthetic peptide
  Seed: FLAMLKNTVP (MAGC1_HUMAN)
FLAMLKNTVY

SEQ ID NO: 87176 - protein, 9 aa, Artificial Sequence
  Description of Artificial Sequence: Synthetic peptide
  Seed: VIFRKAREF (MAGC1_HUMAN)
VMFRKAREF

SEQ ID NO: 87177 - protein, 10 aa, Artificial Sequence
  Description of Artificial Sequence: Synthetic peptide
  Seed: TGYFPVIFRK (MAGC1_HUMAN)
TYYFPVIFRR

SEQ ID NO: 87178 - protein, 11 aa, Artificial Sequence
  Description of Artificial Sequence: Synthetic peptide
  Seed: KDMPTAGMPSL (MAGC1_HUMAN)
KPMPTAGMPSF

SEQ ID NO: 87179 - protein, 9 aa, Artificial Sequence
  Description of Artificial Sequence: Synthetic peptide
  Seed: TESASSSVM (MAGC1_HUMAN)
TQSASSSVH

SEQ ID NO: 87180 - protein, 11 aa, Artificial Sequence
  Description of Artificial Sequence: Synthetic peptide
  Seed: SLIESEPLFTY (MAGC1_HUMAN)
SLIESEPLFTW

SEQ ID NO: 87181 - protein, 10 aa, Artificial Sequence
  Description of Artificial Sequence: Synthetic peptide
  Seed: MTSSFSSTLL (MAGC1_HUMAN)
MFSSFSSTLM

SEQ ID NO: 87182 - protein, 10 aa, Artificial Sequence
  Description of Artificial Sequence: Synthetic peptide
  Seed: IPVSPSFSST (MAGC1_HUMAN)
IPVSPSFSSI

SEQ ID NO: 87183 - protein, 10 aa, Artificial Sequence
  Description of Artificial Sequence: Synthetic peptide
  Seed: VISFSSSTSL (MAGC1_HUMAN)
VSSFSSSTSY

SEQ ID NO: 87184 - protein, 9 aa, Artificial Sequence
  Description of Artificial Sequence: Synthetic peptide
  Seed: LQSPVISFS (MAGC1_HUMAN)
LQSPVISFT

SEQ ID NO: 87185 - protein, 9 aa, Artificial Sequence
  Description of Artificial Sequence: Synthetic peptide
  Seed: FTYTLDEKV (MAGC1_HUMAN)
FIYTLDEKV

SEQ ID NO: 87186 - protein, 10 aa, Artificial Sequence
  Description of Artificial Sequence: Synthetic peptide
  Seed: FFSSALLSIF (MAGC1_HUMAN)
FQSSALLSIL

SEQ ID NO: 87187 - protein, 9 aa, Artificial Sequence
  Description of Artificial Sequence: Synthetic peptide
  Seed: AFGEPRELL (MAGC1_HUMAN)
ATGEPRELL

SEQ ID NO: 87188 - protein, 9 aa, Artificial Sequence
  Description of Artificial Sequence: Synthetic peptide
  Seed: ASSSTLVSI (MAGC1_HUMAN)
AQSSTLVSA

SEQ ID NO: 87189 - protein, 10 aa, Artificial Sequence
  Description of Artificial Sequence: Synthetic peptide
  Seed: YTGYFPVIFR (MAGC1_HUMAN)
YVGYFPVIFK

SEQ ID NO: 87190 - protein, 9 aa, Artificial Sequence
  Description of Artificial Sequence: Synthetic peptide
  Seed: MSQNRLLIL (MAGC1_HUMAN)
MEQNRLLIL

SEQ ID NO: 87191 - protein, 9 aa, Artificial Sequence
  Description of Artificial Sequence: Synthetic peptide
  Seed: KVDELARFL (MAGC1_HUMAN)
KYDELARFY

SEQ ID NO: 87192 - protein, 9 aa, Artificial Sequence
  Description of Artificial Sequence: Synthetic peptide
  Seed: AQSPLQSPV (MAGC1_HUMAN)
ATSPLQSPI

SEQ ID NO: 87193 - protein, 9 aa, Artificial Sequence
  Description of Artificial Sequence: Synthetic peptide
  Seed: LSDEQGMSQ (MAGC1_HUMAN)
LADEQGMSC

SEQ ID NO: 87194 - protein, 10 aa, Artificial Sequence
  Description of Artificial Sequence: Synthetic peptide
  Seed: WGPRAHSEVI (MAGC1_HUMAN)
WYPRAHSEVM

SEQ ID NO: 87195 - protein, 9 aa, Artificial Sequence
  Description of Artificial Sequence: Synthetic peptide
  Seed: DSYVFVNTL (MAGC1_HUMAN)
DSYVFVNTR

SEQ ID NO: 87196 - protein, 9 aa, Artificial Sequence
  Description of Artificial Sequence: Synthetic peptide
  Seed: WVQEHYLEY (MAGC1_HUMAN)
WPQEHYLEY

SEQ ID NO: 87197 - protein, 11 aa, Artificial Sequence
  Description of Artificial Sequence: Synthetic peptide
  Seed: QSSPESAQSAF (MAGC1_HUMAN)
QTSPESAQSAY

SEQ ID NO: 87198 - protein, 10 aa, Artificial Sequence
  Description of Artificial Sequence: Synthetic peptide
  Seed: AASSSTLVSI (MAGC1_HUMAN)
AMSSSTLVSF

SEQ ID NO: 87199 - protein, 9 aa, Artificial Sequence
  Description of Artificial Sequence: Synthetic peptide
  Seed: FSSALLSIF (MAGC1_HUMAN)
FGSALLSIY

SEQ ID NO: 87200 - protein, 11 aa, Artificial Sequence
  Description of Artificial Sequence: Synthetic peptide
  Seed: RSFSSTLLSIF (MAGC1_HUMAN)
RTFSSTLLSIF

SEQ ID NO: 87201 - protein, 11 aa, Artificial Sequence
  Description of Artificial Sequence: Synthetic peptide
  Seed: EILFGISLREV (MAGC1_HUMAN)
EMLFGISLREL

SEQ ID NO: 87202 - protein, 10 aa, Artificial Sequence
  Description of Artificial Sequence: Synthetic peptide
  Seed: SRYTGYFPVI (MAGC1_HUMAN)
SLYTGYFPVW

SEQ ID NO: 87203 - protein, 9 aa, Artificial Sequence
  Description of Artificial Sequence: Synthetic peptide
  Seed: SPPQGEDSL (MAGC1_HUMAN)
SGPQGEDSL

SEQ ID NO: 87204 - protein, 10 aa, Artificial Sequence
  Description of Artificial Sequence: Synthetic peptide
  Seed: VSPSFSSTLV (MAGC1_HUMAN)
VIPSFSSTLL

SEQ ID NO: 87205 - protein, 9 aa, Artificial Sequence
  Description of Artificial Sequence: Synthetic peptide
  Seed: SYKDALKDV (MAGC1_HUMAN)
SFKDALKDF

SEQ ID NO: 87206 - protein, 9 aa, Artificial Sequence
  Description of Artificial Sequence: Synthetic peptide
  Seed: AQSPLQSPV (MAGC1_HUMAN)
AESPLQSPV

SEQ ID NO: 87207 - protein, 10 aa, Artificial Sequence
  Description of Artificial Sequence: Synthetic peptide
  Seed: SSFSYTLLSL (MAGC1_HUMAN)
SMFSYTLLSV

SEQ ID NO: 87208 - protein, 9 aa, Artificial Sequence
  Description of Artificial Sequence: Synthetic peptide
  Seed: SFSSTLVSL (MAGC1_HUMAN)
SASSTLVSM

SEQ ID NO: 87209 - protein, 10 aa, Artificial Sequence
  Description of Artificial Sequence: Synthetic peptide
  Seed: LSIFQSSPER (MAGC1_HUMAN)
LTIFQSSPER

SEQ ID NO: 87210 - protein, 10 aa, Artificial Sequence
  Description of Artificial Sequence: Synthetic peptide
  Seed: EVIWDVLSGI (MAGC1_HUMAN)
EQIWDVLSGV

SEQ ID NO: 87211 - protein, 10 aa, Artificial Sequence
  Description of Artificial Sequence: Synthetic peptide
  Seed: LQIPVSPSFS (MAGC1_HUMAN)
LAIPVSPSFY

SEQ ID NO: 87212 - protein, 10 aa, Artificial Sequence
  Description of Artificial Sequence: Synthetic peptide
  Seed: RKVVEFLAML (MAGC1_HUMAN)
REVVEFLAMV

SEQ ID NO: 87213 - protein, 10 aa, Artificial Sequence
  Description of Artificial Sequence: Synthetic peptide
  Seed: FPQSPLQIPV (MAGC1_HUMAN)
FDQSPLQIPV

SEQ ID NO: 87214 - protein, 10 aa, Artificial Sequence
  Description of Artificial Sequence: Synthetic peptide
  Seed: FFSYTLASLL (MAGC1_HUMAN)
FQSYTLASLM

SEQ ID NO: 87215 - protein, 10 aa, Artificial Sequence
  Description of Artificial Sequence: Synthetic peptide
  Seed: WGPRAHSEVI (MAGC1_HUMAN)
WHPRAHSEVI

SEQ ID NO: 87216 - protein, 9 aa, Artificial Sequence
  Description of Artificial Sequence: Synthetic peptide
  Seed: LQIPVSPSF (MAGC1_HUMAN)
LLIPVSPSI

SEQ ID NO: 87217 - protein, 9 aa, Artificial Sequence
  Description of Artificial Sequence: Synthetic peptide
  Seed: ASSSTLVSI (MAGC1_HUMAN)
ATSSTLVSY

SEQ ID NO: 87218 - protein, 10 aa, Artificial Sequence
  Description of Artificial Sequence: Synthetic peptide
  Seed: DELARFLLLK (MAGC1_HUMAN)
DALARFLLLK

SEQ ID NO: 87219 - protein, 9 aa, Artificial Sequence
  Description of Artificial Sequence: Synthetic peptide
  Seed: TFEGFPQSL (MAGC1_HUMAN)
TMEGFPQSY

SEQ ID NO: 87220 - protein, 10 aa, Artificial Sequence
  Description of Artificial Sequence: Synthetic peptide
  Seed: ISRYTGYFPV (MAGC1_HUMAN)
IPRYTGYFPF

SEQ ID NO: 87221 - protein, 9 aa, Artificial Sequence
  Description of Artificial Sequence: Synthetic peptide
  Seed: SRYTGYFPV (MAGC1_HUMAN)
SKYTGYFPM

SEQ ID NO: 87222 - protein, 9 aa, Artificial Sequence
  Description of Artificial Sequence: Synthetic peptide
  Seed: SSPPRYEFL (MAGC1_HUMAN)
SVPPRYEFR

SEQ ID NO: 87223 - protein, 9 aa, Artificial Sequence
  Description of Artificial Sequence: Synthetic peptide
  Seed: FAFGEPREL (MAGC1_HUMAN)
FLFGEPREC

SEQ ID NO: 87224 - protein, 9 aa, Artificial Sequence
  Description of Artificial Sequence: Synthetic peptide
  Seed: HYFPQSPPQ (MAGC1_HUMAN)
HFFPQSPPF

SEQ ID NO: 87225 - protein, 9 aa, Artificial Sequence
  Description of Artificial Sequence: Synthetic peptide
  Seed: LQIVPSLPE (MAGC1_HUMAN)
LEIVPSLPF

SEQ ID NO: 87226 - protein, 10 aa, Artificial Sequence
  Description of Artificial Sequence: Synthetic peptide
  Seed: ATESASSSVM (MAGC1_HUMAN)
ADESASSSVW

SEQ ID NO: 87227 - protein, 9 aa, Artificial Sequence
  Description of Artificial Sequence: Synthetic peptide
  Seed: KDSLSPLEI (MAGC1_HUMAN)
KESLSPLEV

SEQ ID NO: 87228 - protein, 10 aa, Artificial Sequence
  Description of Artificial Sequence: Synthetic peptide
  Seed: VSSSSSSTLL (MAGC1_HUMAN)
VMSSSSSTLY

SEQ ID NO: 87229 - protein, 10 aa, Artificial Sequence
  Description of Artificial Sequence: Synthetic peptide
  Seed: YTLDEKVDEL (MAGC1_HUMAN)
YRLDEKVDEL

SEQ ID NO: 87230 - protein, 9 aa, Artificial Sequence
  Description of Artificial Sequence: Synthetic peptide
  Seed: MTSSFSSTL (MAGC1_HUMAN)
MFSSFSSTY

SEQ ID NO: 87231 - protein, 10 aa, Artificial Sequence
  Description of Artificial Sequence: Synthetic peptide
  Seed: FLAMLKNTVP (MAGC1_HUMAN)
FLAMLKNTVH

SEQ ID NO: 87232 - protein, 9 aa, Artificial Sequence
  Description of Artificial Sequence: Synthetic peptide
  Seed: ASSFFSSAL (MAGC1_HUMAN)
AKSFFSSAM

SEQ ID NO: 87233 - protein, 10 aa, Artificial Sequence
  Description of Artificial Sequence: Synthetic peptide
  Seed: SSFSYTLLSL (MAGC1_HUMAN)
SMFSYTLLSL

SEQ ID NO: 87234 - protein, 9 aa, Artificial Sequence
  Description of Artificial Sequence: Synthetic peptide
  Seed: HFPQSPPEW (MAGC1_HUMAN)
HFPQSPPEM

SEQ ID NO: 87235 - protein, 9 aa, Artificial Sequence
  Description of Artificial Sequence: Synthetic peptide
  Seed: ISFSSSTSL (MAGC1_HUMAN)
IVFSSSTSW

SEQ ID NO: 87236 - protein, 9 aa, Artificial Sequence
  Description of Artificial Sequence: Synthetic peptide
  Seed: FAFGEPREL (MAGC1_HUMAN)
FVFGEPREF

SEQ ID NO: 87237 - protein, 10 aa, Artificial Sequence
  Description of Artificial Sequence: Synthetic peptide
  Seed: SLFQSFSERT (MAGC1_HUMAN)
SIFQSFSERL

SEQ ID NO: 87238 - protein, 10 aa, Artificial Sequence
  Description of Artificial Sequence: Synthetic peptide
  Seed: AEMLTNVISR (MAGC1_HUMAN)
AVMLTNVISR

SEQ ID NO: 87239 - protein, 10 aa, Artificial Sequence
  Description of Artificial Sequence: Synthetic peptide
  Seed: SFSSTLVSLF (MAGC1_HUMAN)
SISSTLVSLY

SEQ ID NO: 87240 - protein, 9 aa, Artificial Sequence
  Description of Artificial Sequence: Synthetic peptide
  Seed: SFSSTLVSL (MAGC1_HUMAN)
SLSSTLVSF

SEQ ID NO: 87241 - protein, 9 aa, Artificial Sequence
  Description of Artificial Sequence: Synthetic peptide
  Seed: GFPQSLLQI (MAGC1_HUMAN)
GFPQSLLQF

SEQ ID NO: 87242 - protein, 9 aa, Artificial Sequence
  Description of Artificial Sequence: Synthetic peptide
  Seed: FSYTLLSLF (MAGC1_HUMAN)
FFYTLLSLF

SEQ ID NO: 87243 - protein, 9 aa, Artificial Sequence
  Description of Artificial Sequence: Synthetic peptide
  Seed: RKVVEFLAM (MAGC1_HUMAN)
RKVVEFLAW

SEQ ID NO: 87244 - protein, 10 aa, Artificial Sequence
  Description of Artificial Sequence: Synthetic peptide
  Seed: SSPPRYEFLW (MAGC1_HUMAN)
SMPPRYEFLF

SEQ ID NO: 87245 - protein, 11 aa, Artificial Sequence
  Description of Artificial Sequence: Synthetic peptide
  Seed: MSPLYFPQSPL (MAGC1_HUMAN)
MMPLYFPQSPI

SEQ ID NO: 87246 - protein, 10 aa, Artificial Sequence
  Description of Artificial Sequence: Synthetic peptide
  Seed: SSPESAQSAF (MAGC1_HUMAN)
SFPESAQSAF

SEQ ID NO: 87247 - protein, 9 aa, Artificial Sequence
  Description of Artificial Sequence: Synthetic peptide
  Seed: FSYTLLSLF (MAGC1_HUMAN)
FIYTLLSLY

SEQ ID NO: 87248 - protein, 10 aa, Artificial Sequence
  Description of Artificial Sequence: Synthetic peptide
  Seed: EFLAMLKNTV (MAGC1_HUMAN)
EYLAMLKNTV

SEQ ID NO: 87249 - protein, 10 aa, Artificial Sequence
  Description of Artificial Sequence: Synthetic peptide
  Seed: VSSSFSYTLL (MAGC1_HUMAN)
VVSSFSYTLF

SEQ ID NO: 87250 - protein, 10 aa, Artificial Sequence
  Description of Artificial Sequence: Synthetic peptide
  Seed: LLQIPMTSSF (MAGC1_HUMAN)
LKQIPMTSSY

SEQ ID NO: 87251 - protein, 9 aa, Artificial Sequence
  Description of Artificial Sequence: Synthetic peptide
  Seed: FTYTLDEKV (MAGC1_HUMAN)
FVYTLDEKW

SEQ ID NO: 87252 - protein, 10 aa, Artificial Sequence
  Description of Artificial Sequence: Synthetic peptide
  Seed: SSPERTHSTF (MAGC1_HUMAN)
SWPERTHSTM

SEQ ID NO: 87253 - protein, 9 aa, Artificial Sequence
  Description of Artificial Sequence: Synthetic peptide
  Seed: FPSSTSSSL (MAGC1_HUMAN)
FRSSTSSSL

SEQ ID NO: 87254 - protein, 11 aa, Artificial Sequence
  Description of Artificial Sequence: Synthetic peptide
  Seed: SFFSYTLASLL (MAGC1_HUMAN)
SHFSYTLASLW

SEQ ID NO: 87255 - protein, 9 aa, Artificial Sequence
  Description of Artificial Sequence: Synthetic peptide
  Seed: FTYTLDEKV (MAGC1_HUMAN)
FVYTLDEKL

SEQ ID NO: 87256 - protein, 11 aa, Artificial Sequence
  Description of Artificial Sequence: Synthetic peptide
  Seed: QSSPESAQSTF (MAGC1_HUMAN)
QASPESAQSTY

SEQ ID NO: 87257 - protein, 10 aa, Artificial Sequence
  Description of Artificial Sequence: Synthetic peptide
  Seed: SLSPLHFPQF (MAGC1_HUMAN)
SFSPLHFPQY

SEQ ID NO: 87258 - protein, 11 aa, Artificial Sequence
  Description of Artificial Sequence: Synthetic peptide
  Seed: SFFSYTLASLL (MAGC1_HUMAN)
SPFSYTLASLW

SEQ ID NO: 87259 - protein, 9 aa, Artificial Sequence
  Description of Artificial Sequence: Synthetic peptide
  Seed: KVWVQEHYL (MAGC1_HUMAN)
KLWVQEHYK

SEQ ID NO: 87260 - protein, 11 aa, Artificial Sequence
  Description of Artificial Sequence: Synthetic peptide
  Seed: QSSPESDDTLY (MAGC1_HUMAN)
QVSPESDDTLW

SEQ ID NO: 87261 - protein, 10 aa, Artificial Sequence
  Description of Artificial Sequence: Synthetic peptide
  Seed: LSQSSPVSSF (MAGC1_HUMAN)
LYQSSPVSSF

SEQ ID NO: 87262 - protein, 11 aa, Artificial Sequence
  Description of Artificial Sequence: Synthetic peptide
  Seed: SSSSSTLLSLF (MAGC1_HUMAN)
SQSSSTLLSLW

SEQ ID NO: 87263 - protein, 11 aa, Artificial Sequence
  Description of Artificial Sequence: Synthetic peptide
  Seed: ISRYTGYFPVI (MAGC1_HUMAN)
IRRYTGYFPVF

SEQ ID NO: 87264 - protein, 10 aa, Artificial Sequence
  Description of Artificial Sequence: Synthetic peptide
  Seed: YTLASLLQSS (MAGC1_HUMAN)
YRLASLLQSA

SEQ ID NO: 87265 - protein, 10 aa, Artificial Sequence
  Description of Artificial Sequence: Synthetic peptide
  Seed: VSSSFSYTLL (MAGC1_HUMAN)
VCSSFSYTLY

SEQ ID NO: 87266 - protein, 10 aa, Artificial Sequence
  Description of Artificial Sequence: Synthetic peptide
  Seed: YTLDEKVDEL (MAGC1_HUMAN)
YMLDEKVDEM

SEQ ID NO: 87267 - protein, 10 aa, Artificial Sequence
  Description of Artificial Sequence: Synthetic peptide
  Seed: FPSSYKDALK (MAGC1_HUMAN)
FWSSYKDALR

SEQ ID NO: 87268 - protein, 10 aa, Artificial Sequence
  Description of Artificial Sequence: Synthetic peptide
  Seed: STLLSLFQSF (MAGC1_HUMAN)
SYLLSLFQSY

SEQ ID NO: 87269 - protein, 10 aa, Artificial Sequence
  Description of Artificial Sequence: Synthetic peptide
  Seed: LQIPVSSSFS (MAGC1_HUMAN)
LQIPVSSSFT

SEQ ID NO: 87270 - protein, 9 aa, Artificial Sequence
  Description of Artificial Sequence: Synthetic peptide
  Seed: LQIPMTSSF (MAGC1_HUMAN)
LLIPMTSSI

SEQ ID NO: 87271 - protein, 10 aa, Artificial Sequence
  Description of Artificial Sequence: Synthetic peptide
  Seed: MLKNTVPITF (MAGC1_HUMAN)
MHKNTVPITM

SEQ ID NO: 87272 - protein, 10 aa, Artificial Sequence
  Description of Artificial Sequence: Synthetic peptide
  Seed: VSSSSSSTLL (MAGC1_HUMAN)
VRSSSSSTLF

SEQ ID NO: 87273 - protein, 10 aa, Artificial Sequence
  Description of Artificial Sequence: Synthetic peptide
  Seed: SRYTGYFPVI (MAGC1_HUMAN)
SYYTGYFPVW

SEQ ID NO: 87274 - protein, 10 aa, Artificial Sequence
  Description of Artificial Sequence: Synthetic peptide
  Seed: SRYTGYFPVI (MAGC1_HUMAN)
SGYTGYFPVI

SEQ ID NO: 87275 - protein, 9 aa, Artificial Sequence
  Description of Artificial Sequence: Synthetic peptide
  Seed: IFQSSPESA (MAGC1_HUMAN)
IWQSSPESM

SEQ ID NO: 87276 - protein, 9 aa, Artificial Sequence
  Description of Artificial Sequence: Synthetic peptide
  Seed: KVVEFLAML (MAGC1_HUMAN)
KFVEFLAMV

SEQ ID NO: 87277 - protein, 10 aa, Artificial Sequence
  Description of Artificial Sequence: Synthetic peptide
  Seed: SSFSYTLLSL (MAGC1_HUMAN)
SYFSYTLLSY

SEQ ID NO: 87278 - protein, 9 aa, Artificial Sequence
  Description of Artificial Sequence: Synthetic peptide
  Seed: ILILSIIFI (MAGC1_HUMAN)
IIILSIIFV

SEQ ID NO: 87279 - protein, 9 aa, Artificial Sequence
  Description of Artificial Sequence: Synthetic peptide
  Seed: SPLEISQSP (MAGC1_HUMAN)
SPLEISQST

SEQ ID NO: 87280 - protein, 11 aa, Artificial Sequence
  Description of Artificial Sequence: Synthetic peptide
  Seed: LQIPVSSSFSY (MAGC1_HUMAN)
LWIPVSSSFSY

SEQ ID NO: 87281 - protein, 11 aa, Artificial Sequence
  Description of Artificial Sequence: Synthetic peptide
  Seed: SPLQIPVSSSS (MAGC1_HUMAN)
SRLQIPVSSSM

SEQ ID NO: 87282 - protein, 9 aa, Artificial Sequence
  Description of Artificial Sequence: Synthetic peptide
  Seed: SPLQIPMTS (MAGC1_HUMAN)
SVLQIPMTI

SEQ ID NO: 87283 - protein, 9 aa, Artificial Sequence
  Description of Artificial Sequence: Synthetic peptide
  Seed: LQSPVISFS (MAGC1_HUMAN)
LSSPVISFI

SEQ ID NO: 87284 - protein, 10 aa, Artificial Sequence
  Description of Artificial Sequence: Synthetic peptide
  Seed: SSFSSTLLSI (MAGC1_HUMAN)
SMFSSTLLSL

SEQ ID NO: 87285 - protein, 8 aa, Artificial Sequence
  Description of Artificial Sequence: Synthetic peptide
  Seed: IWDVLSGI (MAGC1_HUMAN)
IADVLSGF

SEQ ID NO: 87286 - protein, 10 aa, Artificial Sequence
  Description of Artificial Sequence: Synthetic peptide
  Seed: VSSSFSYTLL (MAGC1_HUMAN)
VKSSFSYTLY

SEQ ID NO: 87287 - protein, 11 aa, Artificial Sequence
  Description of Artificial Sequence: Synthetic peptide
  Seed: TESASSSVMSP (MAGC1_HUMAN)
TESASSSVMSL

SEQ ID NO: 87288 - protein, 10 aa, Artificial Sequence
  Description of Artificial Sequence: Synthetic peptide
  Seed: LLQIPMTSSF (MAGC1_HUMAN)
LMQIPMTSSF

SEQ ID NO: 87289 - protein, 9 aa, Artificial Sequence
  Description of Artificial Sequence: Synthetic peptide
  Seed: FPSSTSSSL (MAGC1_HUMAN)
FHSSTSSSI

SEQ ID NO: 87290 - protein, 8 aa, Artificial Sequence
  Description of Artificial Sequence: Synthetic peptide
  Seed: YTGYFPVI (MAGC1_HUMAN)
YSGYFPVL

SEQ ID NO: 87291 - protein, 10 aa, Artificial Sequence
  Description of Artificial Sequence: Synthetic peptide
  Seed: RPVSSFFSYT (MAGC1_HUMAN)
RRVSSFFSYK

SEQ ID NO: 87292 - protein, 10 aa, Artificial Sequence
  Description of Artificial Sequence: Synthetic peptide
  Seed: KGTYASEEVI (MAGC1_HUMAN)
KMTYASEEVY

SEQ ID NO: 87293 - protein, 9 aa, Artificial Sequence
  Description of Artificial Sequence: Synthetic peptide
  Seed: SFSSTLVSL (MAGC1_HUMAN)
SFSSTLVSF

SEQ ID NO: 87294 - protein, 10 aa, Artificial Sequence
  Description of Artificial Sequence: Synthetic peptide
  Seed: LEISQSPPEG (MAGC1_HUMAN)
LEISQSPPEV

SEQ ID NO: 87295 - protein, 11 aa, Artificial Sequence
  Description of Artificial Sequence: Synthetic peptide
  Seed: STFEGFPQSLL (MAGC1_HUMAN)
STFEGFPQSLM

SEQ ID NO: 87296 - protein, 11 aa, Artificial Sequence
  Description of Artificial Sequence: Synthetic peptide
  Seed: LLQIPMTSSFS (MAGC1_HUMAN)
LMQIPMTSSFF

SEQ ID NO: 87297 - protein, 9 aa, Artificial Sequence
  Description of Artificial Sequence: Synthetic peptide
  Seed: FPQSLLQIP (MAGC1_HUMAN)
FPQSLLQIA

SEQ ID NO: 87298 - protein, 10 aa, Artificial Sequence
  Description of Artificial Sequence: Synthetic peptide
  Seed: LLQIPMTSSF (MAGC1_HUMAN)
LIQIPMTSSY

SEQ ID NO: 87299 - protein, 9 aa, Artificial Sequence
  Description of Artificial Sequence: Synthetic peptide
  Seed: MTSSFSSTL (MAGC1_HUMAN)
MYSSFSSTA

SEQ ID NO: 87300 - protein, 10 aa, Artificial Sequence
  Description of Artificial Sequence: Synthetic peptide
  Seed: REFIEILFGI (MAGC1_HUMAN)
RRFIEILFGF

SEQ ID NO: 87301 - protein, 10 aa, Artificial Sequence
  Description of Artificial Sequence: Synthetic peptide
  Seed: SSPERTHSTF (MAGC1_HUMAN)
SPPERTHSTM

SEQ ID NO: 87302 - protein, 9 aa, Artificial Sequence
  Description of Artificial Sequence: Synthetic peptide
  Seed: SPLQSPESA (MAGC1_HUMAN)
STLQSPESL

SEQ ID NO: 87303 - protein, 9 aa, Artificial Sequence
  Description of Artificial Sequence: Synthetic peptide
  Seed: FSYTLASLL (MAGC1_HUMAN)
FFYTLASLF

SEQ ID NO: 87304 - protein, 9 aa, Artificial Sequence
  Description of Artificial Sequence: Synthetic peptide
  Seed: KVWVQEHYL (MAGC1_HUMAN)
KSWVQEHYL

SEQ ID NO: 87305 - protein, 11 aa, Artificial Sequence
  Description of Artificial Sequence: Synthetic peptide
  Seed: KVWVQEHYLEY (MAGC1_HUMAN)
KQWVQEHYLEM

SEQ ID NO: 87306 - protein, 9 aa, Artificial Sequence
  Description of Artificial Sequence: Synthetic peptide
  Seed: SAQSAFEGF (MAGC1_HUMAN)
SQQSAFEGM

SEQ ID NO: 87307 - protein, 9 aa, Artificial Sequence
  Description of Artificial Sequence: Synthetic peptide
  Seed: EILFGISLR (MAGC1_HUMAN)
EFLFGISLR

SEQ ID NO: 87308 - protein, 9 aa, Artificial Sequence
  Description of Artificial Sequence: Synthetic peptide
  Seed: TLLSLFQSF (MAGC1_HUMAN)
TFLSLFQSM

SEQ ID NO: 87309 - protein, 9 aa, Artificial Sequence
  Description of Artificial Sequence: Synthetic peptide
  Seed: FSYTLLSLF (MAGC1_HUMAN)
FKYTLLSLF

SEQ ID NO: 87310 - protein, 9 aa, Artificial Sequence
  Description of Artificial Sequence: Synthetic peptide
  Seed: AMLKNTVPI (MAGC1_HUMAN)
AQLKNTVPM

SEQ ID NO: 87311 - protein, 9 aa, Artificial Sequence
  Description of Artificial Sequence: Synthetic peptide
  Seed: RPVSSFFSY (MAGC1_HUMAN)
RRVSSFFSY

SEQ ID NO: 87312 - protein, 10 aa, Artificial Sequence
  Description of Artificial Sequence: Synthetic peptide
  Seed: FPQSPLQIPV (MAGC1_HUMAN)
FSQSPLQIPV

SEQ ID NO: 87313 - protein, 9 aa, Artificial Sequence
  Description of Artificial Sequence: Synthetic peptide
  Seed: NTVPITFPS (MAGC1_HUMAN)
NFVPITFPR

SEQ ID NO: 87314 - protein, 9 aa, Artificial Sequence
  Description of Artificial Sequence: Synthetic peptide
  Seed: LQIPVSRSF (MAGC1_HUMAN)
LAIPVSRSA

SEQ ID NO: 87315 - protein, 9 aa, Artificial Sequence
  Description of Artificial Sequence: Synthetic peptide
  Seed: SIFQSSPER (MAGC1_HUMAN)
SQFQSSPEK

SEQ ID NO: 87316 - protein, 9 aa, Artificial Sequence
  Description of Artificial Sequence: Synthetic peptide
  Seed: AQSPLQSPV (MAGC1_HUMAN)
ALSPLQSPM

SEQ ID NO: 87317 - protein, 9 aa, Artificial Sequence
  Description of Artificial Sequence: Synthetic peptide
  Seed: IIFIKGTYA (MAGC1_HUMAN)
IMFIKGTYV

SEQ ID NO: 87318 - protein, 10 aa, Artificial Sequence
  Description of Artificial Sequence: Synthetic peptide
  Seed: SSFSSTLLSI (MAGC1_HUMAN)
SVFSSTLLSF

SEQ ID NO: 87319 - protein, 11 aa, Artificial Sequence
  Description of Artificial Sequence: Synthetic peptide
  Seed: SFFSSALLSIF (MAGC1_HUMAN)
STFSSALLSIM

SEQ ID NO: 87320 - protein, 10 aa, Artificial Sequence
  Description of Artificial Sequence: Synthetic peptide
  Seed: EVPNSSPPRY (MAGC1_HUMAN)
EVPNSSPPRK

SEQ ID NO: 87321 - protein, 10 aa, Artificial Sequence
  Description of Artificial Sequence: Synthetic peptide
  Seed: YVFVNTLDLT (MAGC1_HUMAN)
YLFVNTLDLM

SEQ ID NO: 87322 - protein, 9 aa, Artificial Sequence
  Description of Artificial Sequence: Synthetic peptide
  Seed: RSFSSTLLS (MAGC1_HUMAN)
RTFSSTLLM

SEQ ID NO: 87323 - protein, 9 aa, Artificial Sequence
  Description of Artificial Sequence: Synthetic peptide
  Seed: LQIPVSSSS (MAGC1_HUMAN)
LIIPVSSSW

SEQ ID NO: 87324 - protein, 10 aa, Artificial Sequence
  Description of Artificial Sequence: Synthetic peptide
  Seed: RLLILILSII (MAGC1_HUMAN)
RMLILILSII

SEQ ID NO: 87325 - protein, 10 aa, Artificial Sequence
  Description of Artificial Sequence: Synthetic peptide
  Seed: VISFSSSTSL (MAGC1_HUMAN)
VMSFSSSTSW

SEQ ID NO: 87326 - protein, 9 aa, Artificial Sequence
  Description of Artificial Sequence: Synthetic peptide
  Seed: SLIESEPLF (MAGC1_HUMAN)
SWIESEPLW

SEQ ID NO: 87327 - protein, 10 aa, Artificial Sequence
  Description of Artificial Sequence: Synthetic peptide
  Seed: SSPERTHSTF (MAGC1_HUMAN)
SKPERTHSTM

SEQ ID NO: 87328 - protein, 9 aa, Artificial Sequence
  Description of Artificial Sequence: Synthetic peptide
  Seed: VSRSFSSTL (MAGC1_HUMAN)
VMRSFSSTY

SEQ ID NO: 87329 - protein, 9 aa, Artificial Sequence
  Description of Artificial Sequence: Synthetic peptide
  Seed: KDSLSPLEI (MAGC1_HUMAN)
KISLSPLEF

SEQ ID NO: 87330 - protein, 8 aa, Artificial Sequence
  Description of Artificial Sequence: Synthetic peptide
  Seed: AFGEPREL (MAGC1_HUMAN)
AAGEPREL

SEQ ID NO: 87331 - protein, 9 aa, Artificial Sequence
  Description of Artificial Sequence: Synthetic peptide
  Seed: NTVPITFPS (MAGC1_HUMAN)
NVVPITFPI

SEQ ID NO: 87332 - protein, 11 aa, Artificial Sequence
  Description of Artificial Sequence: Synthetic peptide
  Seed: KRKVVEFLAML (MAGC1_HUMAN)
KDKVVEFLAMV

SEQ ID NO: 87333 - protein, 9 aa, Artificial Sequence
  Description of Artificial Sequence: Synthetic peptide
  Seed: FQSSPERTH (MAGC1_HUMAN)
FQSSPERTM

SEQ ID NO: 87334 - protein, 9 aa, Artificial Sequence
  Description of Artificial Sequence: Synthetic peptide
  Seed: DDSTATESA (MAGC1_HUMAN)
DESTATESA

SEQ ID NO: 87335 - protein, 9 aa, Artificial Sequence
  Description of Artificial Sequence: Synthetic peptide
  Seed: SSPECTQST (MAGC1_HUMAN)
SFPECTQSI

SEQ ID NO: 87336 - protein, 9 aa, Artificial Sequence
  Description of Artificial Sequence: Synthetic peptide
  Seed: LQNPASSFF (MAGC1_HUMAN)
LRNPASSFY

SEQ ID NO: 87337 - protein, 10 aa, Artificial Sequence
  Description of Artificial Sequence: Synthetic peptide
  Seed: SFFSSALLSI (MAGC1_HUMAN)
SYFSSALLSW

SEQ ID NO: 87338 - protein, 8 aa, Artificial Sequence
  Description of Artificial Sequence: Synthetic peptide
  Seed: LQRPVSSF (MAGC1_HUMAN)
LARPVSSL

SEQ ID NO: 87339 - protein, 10 aa, Artificial Sequence
  Description of Artificial Sequence: Synthetic peptide
  Seed: SSPESAQSAF (MAGC1_HUMAN)
SYPESAQSAM

SEQ ID NO: 87340 - protein, 9 aa, Artificial Sequence
  Description of Artificial Sequence: Synthetic peptide
  Seed: MTSSFSSTL (MAGC1_HUMAN)
MKSSFSSTH

SEQ ID NO: 87341 - protein, 10 aa, Artificial Sequence
  Description of Artificial Sequence: Synthetic peptide
  Seed: NTVPITFPSS (MAGC1_HUMAN)
NTVPITFPSL

SEQ ID NO: 87342 - protein, 9 aa, Artificial Sequence
  Description of Artificial Sequence: Synthetic peptide
  Seed: IPVSSSFSY (MAGC1_HUMAN)
IYVSSSFSF

SEQ ID NO: 87343 - protein, 11 aa, Artificial Sequence
  Description of Artificial Sequence: Synthetic peptide
  Seed: LQIPVSSSFSY (MAGC1_HUMAN)
LIIPVSSSFSW

SEQ ID NO: 87344 - protein, 9 aa, Artificial Sequence
  Description of Artificial Sequence: Synthetic peptide
  Seed: VSRSFSSTL (MAGC1_HUMAN)
VVRSFSSTK

SEQ ID NO: 87345 - protein, 9 aa, Artificial Sequence
  Description of Artificial Sequence: Synthetic peptide
  Seed: SEESSSPVD (MAGC1_HUMAN)
SEESSSPVT

SEQ ID NO: 87346 - protein, 10 aa, Artificial Sequence
  Description of Artificial Sequence: Synthetic peptide
  Seed: SSPERTHSTF (MAGC1_HUMAN)
SQPERTHSTF

SEQ ID NO: 87347 - protein, 10 aa, Artificial Sequence
  Description of Artificial Sequence: Synthetic peptide
  Seed: RYTGYFPVIF (MAGC1_HUMAN)
RNTGYFPVIW

SEQ ID NO: 87348 - protein, 9 aa, Artificial Sequence
  Description of Artificial Sequence: Synthetic peptide
  Seed: LQIPMTSSF (MAGC1_HUMAN)
LEIPMTSSF

SEQ ID NO: 87349 - protein, 9 aa, Artificial Sequence
  Description of Artificial Sequence: Synthetic peptide
  Seed: SMSPLYFPQ (MAGC1_HUMAN)
SFSPLYFPR

SEQ ID NO: 87350 - protein, 9 aa, Artificial Sequence
  Description of Artificial Sequence: Synthetic peptide
  Seed: LKYQVKQPI (MAGC1_HUMAN)
LMYQVKQPV

SEQ ID NO: 87351 - protein, 9 aa, Artificial Sequence
  Description of Artificial Sequence: Synthetic peptide
  Seed: KVWVQEHYL (MAGC1_HUMAN)
KLWVQEHYA

SEQ ID NO: 87352 - protein, 9 aa, Artificial Sequence
  Description of Artificial Sequence: Synthetic peptide
  Seed: KDSQSPLQI (MAGC1_HUMAN)
KVSQSPLQF

SEQ ID NO: 87353 - protein, 11 aa, Artificial Sequence
  Description of Artificial Sequence: Synthetic peptide
  Seed: GPAQSPLQSPV (MAGC1_HUMAN)
GPAQSPLQSPA

SEQ ID NO: 87354 - protein, 10 aa, Artificial Sequence
  Description of Artificial Sequence: Synthetic peptide
  Seed: FSSTLVSLFQ (MAGC1_HUMAN)
FRSTLVSLFW

SEQ ID NO: 87355 - protein, 9 aa, Artificial Sequence
  Description of Artificial Sequence: Synthetic peptide
  Seed: MTSSFSSTL (MAGC1_HUMAN)
MRSSFSSTW

SEQ ID NO: 87356 - protein, 9 aa, Artificial Sequence
  Description of Artificial Sequence: Synthetic peptide
  Seed: YTLASLLQS (MAGC1_HUMAN)
YTLASLLQM

SEQ ID NO: 87357 - protein, 10 aa, Artificial Sequence
  Description of Artificial Sequence: Synthetic peptide
  Seed: ASSFFSSALL (MAGC1_HUMAN)
ATSFFSSALM

SEQ ID NO: 87358 - protein, 9 aa, Artificial Sequence
  Description of Artificial Sequence: Synthetic peptide
  Seed: YVFVNTLDL (MAGC1_HUMAN)
YEFVNTLDF

SEQ ID NO: 87359 - protein, 10 aa, Artificial Sequence
  Description of Artificial Sequence: Synthetic peptide
  Seed: VSSSSSSSTL (MAGC1_HUMAN)
VASSSSSSTY

SEQ ID NO: 87360 - protein, 11 aa, Artificial Sequence
  Description of Artificial Sequence: Synthetic peptide
  Seed: GYFPVIFRKAR (MAGC1_HUMAN)
GFFPVIFRKAR

SEQ ID NO: 87361 - protein, 11 aa, Artificial Sequence
  Description of Artificial Sequence: Synthetic peptide
  Seed: NTVPITFPSSY (MAGC1_HUMAN)
NTVPITFPSSW

SEQ ID NO: 87362 - protein, 9 aa, Artificial Sequence
  Description of Artificial Sequence: Synthetic peptide
  Seed: STFEGFPQS (MAGC1_HUMAN)
SSFEGFPQF

SEQ ID NO: 87363 - protein, 11 aa, Artificial Sequence
  Description of Artificial Sequence: Synthetic peptide
  Seed: IPVSAASSSTL (MAGC1_HUMAN)
IKVSAASSSTF

SEQ ID NO: 87364 - protein, 9 aa, Artificial Sequence
  Description of Artificial Sequence: Synthetic peptide
  Seed: SQNRLLILI (MAGC1_HUMAN)
SLNRLLILA

SEQ ID NO: 87365 - protein, 9 aa, Artificial Sequence
  Description of Artificial Sequence: Synthetic peptide
  Seed: MLTNVISRY (MAGC1_HUMAN)
MHTNVISRF

SEQ ID NO: 87366 - protein, 11 aa, Artificial Sequence
  Description of Artificial Sequence: Synthetic peptide
  Seed: MSPLYFPQSPL (MAGC1_HUMAN)
MEPLYFPQSPV

SEQ ID NO: 87367 - protein, 10 aa, Artificial Sequence
  Description of Artificial Sequence: Synthetic peptide
  Seed: VSRSFSSTLL (MAGC1_HUMAN)
VLRSFSSTLK

SEQ ID NO: 87368 - protein, 9 aa, Artificial Sequence
  Description of Artificial Sequence: Synthetic peptide
  Seed: KVWVQEHYL (MAGC1_HUMAN)
KYWVQEHYY

SEQ ID NO: 87369 - protein, 9 aa, Artificial Sequence
  Description of Artificial Sequence: Synthetic peptide
  Seed: SPLQIPMTS (MAGC1_HUMAN)
SLLQIPMTV

SEQ ID NO: 87370 - protein, 10 aa, Artificial Sequence
  Description of Artificial Sequence: Synthetic peptide
  Seed: SSFSSTLLSI (MAGC1_HUMAN)
SAFSSTLLSL

SEQ ID NO: 87371 - protein, 10 aa, Artificial Sequence
  Description of Artificial Sequence: Synthetic peptide
  Seed: WGPRAHSEVI (MAGC1_HUMAN)
WDPRAHSEVV

SEQ ID NO: 87372 - protein, 9 aa, Artificial Sequence
  Description of Artificial Sequence: Synthetic peptide
  Seed: KVDELARFL (MAGC1_HUMAN)
KWDELARFF

SEQ ID NO: 87373 - protein, 10 aa, Artificial Sequence
  Description of Artificial Sequence: Synthetic peptide
  Seed: LLQIPMTSSF (MAGC1_HUMAN)
LRQIPMTSSW

SEQ ID NO: 87374 - protein, 9 aa, Artificial Sequence
  Description of Artificial Sequence: Synthetic peptide
  Seed: CSSSTPSSL (MAGC1_HUMAN)
CQSSTPSSI

SEQ ID NO: 87375 - protein, 9 aa, Artificial Sequence
  Description of Artificial Sequence: Synthetic peptide
  Seed: AQSPLQSPV (MAGC1_HUMAN)
ALSPLQSPV

SEQ ID NO: 87376 - protein, 9 aa, Artificial Sequence
  Description of Artificial Sequence: Synthetic peptide
  Seed: LQNPASSFF (MAGC1_HUMAN)
LNNPASSFY

SEQ ID NO: 87377 - protein, 9 aa, Artificial Sequence
  Description of Artificial Sequence: Synthetic peptide
  Seed: RTQSTFEGF (MAGC1_HUMAN)
RSQSTFEGW

SEQ ID NO: 87378 - protein, 9 aa, Artificial Sequence
  Description of Artificial Sequence: Synthetic peptide
  Seed: REVPNSSPP (MAGC1_HUMAN)
REVPNSSPA

SEQ ID NO: 87379 - protein, 11 aa, Artificial Sequence
  Description of Artificial Sequence: Synthetic peptide
  Seed: RSFSSTLLSIF (MAGC1_HUMAN)
REFSSTLLSIW

SEQ ID NO: 87380 - protein, 9 aa, Artificial Sequence
  Description of Artificial Sequence: Synthetic peptide
  Seed: ISFSSSTSL (MAGC1_HUMAN)
IAFSSSTSI

SEQ ID NO: 87381 - protein, 10 aa, Artificial Sequence
  Description of Artificial Sequence: Synthetic peptide
  Seed: SFPSSTSSSL (MAGC1_HUMAN)
SEPSSTSSSV

SEQ ID NO: 87382 - protein, 9 aa, Artificial Sequence
  Description of Artificial Sequence: Synthetic peptide
  Seed: SPESAQSTF (MAGC1_HUMAN)
SMESAQSTY

SEQ ID NO: 87383 - protein, 10 aa, Artificial Sequence
  Description of Artificial Sequence: Synthetic peptide
  Seed: IPVSPSSSST (MAGC1_HUMAN)
IPVSPSSSSV

SEQ ID NO: 87384 - protein, 9 aa, Artificial Sequence
  Description of Artificial Sequence: Synthetic peptide
  Seed: EGDDTQSPL (MAGC1_HUMAN)
EWDDTQSPM

SEQ ID NO: 87385 - protein, 9 aa, Artificial Sequence
  Description of Artificial Sequence: Synthetic peptide
  Seed: VIKRKVVEF (MAGC1_HUMAN)
VNKRKVVEL

SEQ ID NO: 87386 - protein, 9 aa, Artificial Sequence
  Description of Artificial Sequence: Synthetic peptide
  Seed: SRYTGYFPV (MAGC1_HUMAN)
SRYTGYFPF

SEQ ID NO: 87387 - protein, 9 aa, Artificial Sequence
  Description of Artificial Sequence: Synthetic peptide
  Seed: SSFSYTLLS (MAGC1_HUMAN)
SSFSYTLLK

SEQ ID NO: 87388 - protein, 9 aa, Artificial Sequence
  Description of Artificial Sequence: Synthetic peptide
  Seed: WVQEHYLEY (MAGC1_HUMAN)
WVQEHYLEF

SEQ ID NO: 87389 - protein, 11 aa, Artificial Sequence
  Description of Artificial Sequence: Synthetic peptide
  Seed: SFFSSALLSIF (MAGC1_HUMAN)
SYFSSALLSIY

SEQ ID NO: 87390 - protein, 9 aa, Artificial Sequence
  Description of Artificial Sequence: Synthetic peptide
  Seed: SIIFIKGTY (MAGC1_HUMAN)
SSIFIKGTW

SEQ ID NO: 87391 - protein, 11 aa, Artificial Sequence
  Description of Artificial Sequence: Synthetic peptide
  Seed: AIIDTTDDSTA (MAGC1_HUMAN)
ALIDTTDDSTM

SEQ ID NO: 87392 - protein, 9 aa, Artificial Sequence
  Description of Artificial Sequence: Synthetic peptide
  Seed: SAPEGEDSL (MAGC1_HUMAN)
SSPEGEDSM

SEQ ID NO: 87393 - protein, 9 aa, Artificial Sequence
  Description of Artificial Sequence: Synthetic peptide
  Seed: RYTGYFPVI (MAGC1_HUMAN)
RFTGYFPVL

SEQ ID NO: 87394 - protein, 11 aa, Artificial Sequence
  Description of Artificial Sequence: Synthetic peptide
  Seed: IPVSRSFSSTL (MAGC1_HUMAN)
IVVSRSFSSTW

SEQ ID NO: 87395 - protein, 9 aa, Artificial Sequence
  Description of Artificial Sequence: Synthetic peptide
  Seed: SPPEGMHSQ (MAGC1_HUMAN)
SPPEGMHSI

SEQ ID NO: 87396 - protein, 9 aa, Artificial Sequence
  Description of Artificial Sequence: Synthetic peptide
  Seed: SSPPRYEFL (MAGC1_HUMAN)
SLPPRYEFI

SEQ ID NO: 87397 - protein, 9 aa, Artificial Sequence
  Description of Artificial Sequence: Synthetic peptide
  Seed: LSPLHFPQF (MAGC1_HUMAN)
LWPLHFPQM

SEQ ID NO: 87398 - protein, 9 aa, Artificial Sequence
  Description of Artificial Sequence: Synthetic peptide
  Seed: TLLSLFQSF (MAGC1_HUMAN)
TWLSLFQSW

SEQ ID NO: 87399 - protein, 9 aa, Artificial Sequence
  Description of Artificial Sequence: Synthetic peptide
  Seed: ASSFFSSAL (MAGC1_HUMAN)
ASSFFSSAW

SEQ ID NO: 87400 - protein, 11 aa, Artificial Sequence
  Description of Artificial Sequence: Synthetic peptide
  Seed: QSSPESAQSTF (MAGC1_HUMAN)
QISPESAQSTW

SEQ ID NO: 87401 - protein, 9 aa, Artificial Sequence
  Description of Artificial Sequence: Synthetic peptide
  Seed: AQSPLQIPV (MAGC1_HUMAN)
AMSPLQIPF

SEQ ID NO: 87402 - protein, 11 aa, Artificial Sequence
  Description of Artificial Sequence: Synthetic peptide
  Seed: ILFGISLREVD (MAGC1_HUMAN)
ILFGISLREVM

SEQ ID NO: 87403 - protein, 11 aa, Artificial Sequence
  Description of Artificial Sequence: Synthetic peptide
  Seed: REVDPDDSYVF (MAGC1_HUMAN)
RSVDPDDSYVW

SEQ ID NO: 87404 - protein, 9 aa, Artificial Sequence
  Description of Artificial Sequence: Synthetic peptide
  Seed: RAGREHFAF (MAGC1_HUMAN)
RFGREHFAW

SEQ ID NO: 87405 - protein, 9 aa, Artificial Sequence
  Description of Artificial Sequence: Synthetic peptide
  Seed: SPVDEYTSS (MAGC1_HUMAN)
SPVDEYTSF

SEQ ID NO: 87406 - protein, 9 aa, Artificial Sequence
  Description of Artificial Sequence: Synthetic peptide
  Seed: FEGFAQSPL (MAGC1_HUMAN)
FKGFAQSPF

SEQ ID NO: 87407 - protein, 10 aa, Artificial Sequence
  Description of Artificial Sequence: Synthetic peptide
  Seed: VSSSSSSTLL (MAGC1_HUMAN)
VGSSSSSTLW

SEQ ID NO: 87408 - protein, 9 aa, Artificial Sequence
  Description of Artificial Sequence: Synthetic peptide
  Seed: ALKDVEERA (MAGC1_HUMAN)
AQKDVEERM

SEQ ID NO: 87409 - protein, 10 aa, Artificial Sequence
  Description of Artificial Sequence: Synthetic peptide
  Seed: VSSSFSYTLL (MAGC1_HUMAN)
VNSSFSYTLF

SEQ ID NO: 87410 - protein, 9 aa, Artificial Sequence
  Description of Artificial Sequence: Synthetic peptide
  Seed: SAQSAFEGF (MAGC1_HUMAN)
SDQSAFEGF

SEQ ID NO: 87411 - protein, 9 aa, Artificial Sequence
  Description of Artificial Sequence: Synthetic peptide
  Seed: AQSPLQRPV (MAGC1_HUMAN)
ATSPLQRPY

SEQ ID NO: 87412 - protein, 11 aa, Artificial Sequence
  Description of Artificial Sequence: Synthetic peptide
  Seed: SFFSYTLASLL (MAGC1_HUMAN)
STFSYTLASLY

SEQ ID NO: 87413 - protein, 9 aa, Artificial Sequence
  Description of Artificial Sequence: Synthetic peptide
  Seed: SSSTLLSLF (MAGC1_HUMAN)
SMSTLLSLM

SEQ ID NO: 87414 - protein, 11 aa, Artificial Sequence
  Description of Artificial Sequence: Synthetic peptide
  Seed: SPLQIPGSPSF (MAGC1_HUMAN)
SFLQIPGSPSF

SEQ ID NO: 87415 - protein, 9 aa, Artificial Sequence
  Description of Artificial Sequence: Synthetic peptide
  Seed: AQSPLQIPV (MAGC1_HUMAN)
ALSPLQIPA

SEQ ID NO: 87416 - protein, 10 aa, Artificial Sequence
  Description of Artificial Sequence: Synthetic peptide
  Seed: SSPERTHSTF (MAGC1_HUMAN)
SSPERTHSTL

SEQ ID NO: 87417 - protein, 9 aa, Artificial Sequence
  Description of Artificial Sequence: Synthetic peptide
  Seed: KVWVQEHYL (MAGC1_HUMAN)
KMWVQEHYC

SEQ ID NO: 87418 - protein, 11 aa, Artificial Sequence
  Description of Artificial Sequence: Synthetic peptide
  Seed: SFFSSALLSIF (MAGC1_HUMAN)
STFSSALLSIW

SEQ ID NO: 87419 - protein, 9 aa, Artificial Sequence
  Description of Artificial Sequence: Synthetic peptide
  Seed: TSSFSSTLL (MAGC1_HUMAN)
TSSFSSTLF

SEQ ID NO: 87420 - protein, 9 aa, Artificial Sequence
  Description of Artificial Sequence: Synthetic peptide
  Seed: HFPQSPPEW (MAGC1_HUMAN)
HFPQSPPEI

SEQ ID NO: 87421 - protein, 10 aa, Artificial Sequence
  Description of Artificial Sequence: Synthetic peptide
  Seed: REVDPDDSYV (MAGC1_HUMAN)
REVDPDDSYC

SEQ ID NO: 87422 - protein, 9 aa, Artificial Sequence
  Description of Artificial Sequence: Synthetic peptide
  Seed: FSSTLVSLF (MAGC1_HUMAN)
FGSTLVSLW

SEQ ID NO: 87423 - protein, 10 aa, Artificial Sequence
  Description of Artificial Sequence: Synthetic peptide
  Seed: MTSSFSSTLL (MAGC1_HUMAN)
MLSSFSSTLW

SEQ ID NO: 87424 - protein, 9 aa, Artificial Sequence
  Description of Artificial Sequence: Synthetic peptide
  Seed: SSSDTLLES (MAGC1_HUMAN)
STSDTLLEY

SEQ ID NO: 87425 - protein, 9 aa, Artificial Sequence
  Description of Artificial Sequence: Synthetic peptide
  Seed: EFIEILFGI (MAGC1_HUMAN)
EVIEILFGA

SEQ ID NO: 87426 - protein, 9 aa, Artificial Sequence
  Description of Artificial Sequence: Synthetic peptide
  Seed: SFSSTLVSL (MAGC1_HUMAN)
SQSSTLVSV

SEQ ID NO: 87427 - protein, 8 aa, Artificial Sequence
  Description of Artificial Sequence: Synthetic peptide
  Seed: FIEILFGI (MAGC1_HUMAN)
FTEILFGV

SEQ ID NO: 87428 - protein, 11 aa, Artificial Sequence
  Description of Artificial Sequence: Synthetic peptide
  Seed: SPLQIPVSSSS (MAGC1_HUMAN)
SELQIPVSSSM

SEQ ID NO: 87429 - protein, 11 aa, Artificial Sequence
  Description of Artificial Sequence: Synthetic peptide
  Seed: STFEGFAQSSL (MAGC1_HUMAN)
SQFEGFAQSSV

SEQ ID NO: 87430 - protein, 9 aa, Artificial Sequence
  Description of Artificial Sequence: Synthetic peptide
  Seed: ELARFLLLK (MAGC1_HUMAN)
EMARFLLLK

SEQ ID NO: 87431 - protein, 9 aa, Artificial Sequence
  Description of Artificial Sequence: Synthetic peptide
  Seed: YVFVNTLDL (MAGC1_HUMAN)
YVFVNTLDW

SEQ ID NO: 87432 - protein, 9 aa, Artificial Sequence
  Description of Artificial Sequence: Synthetic peptide
  Seed: FPSSTSSSL (MAGC1_HUMAN)
FSSSTSSSH

SEQ ID NO: 87433 - protein, 9 aa, Artificial Sequence
  Description of Artificial Sequence: Synthetic peptide
  Seed: VSRSFSSTL (MAGC1_HUMAN)
VIRSFSSTW

SEQ ID NO: 87434 - protein, 10 aa, Artificial Sequence
  Description of Artificial Sequence: Synthetic peptide
  Seed: EVPNSSPPRY (MAGC1_HUMAN)
EVPNSSPPRR

SEQ ID NO: 87435 - protein, 10 aa, Artificial Sequence
  Description of Artificial Sequence: Synthetic peptide
  Seed: RKVVEFLAML (MAGC1_HUMAN)
RSVVEFLAMA

SEQ ID NO: 87436 - protein, 10 aa, Artificial Sequence
  Description of Artificial Sequence: Synthetic peptide
  Seed: GEDSQSPLQI (MAGC1_HUMAN)
GEDSQSPLQW

SEQ ID NO: 87437 - protein, 10 aa, Artificial Sequence
  Description of Artificial Sequence: Synthetic peptide
  Seed: FPQSLLQIPM (MAGC1_HUMAN)
FPQSLLQIPF

SEQ ID NO: 87438 - protein, 11 aa, Artificial Sequence
  Description of Artificial Sequence: Synthetic peptide
  Seed: SLIESEPLFTY (MAGC1_HUMAN)
SLIESEPLFTM

SEQ ID NO: 87439 - protein, 11 aa, Artificial Sequence
  Description of Artificial Sequence: Synthetic peptide
  Seed: AMLKNTVPITF (MAGC1_HUMAN)
ALLKNTVPITW

SEQ ID NO: 87440 - protein, 9 aa, Artificial Sequence
  Description of Artificial Sequence: Synthetic peptide
  Seed: VQSPLHSPQ (MAGC1_HUMAN)
VTSPLHSPF

SEQ ID NO: 87441 - protein, 10 aa, Artificial Sequence
  Description of Artificial Sequence: Synthetic peptide
  Seed: ESAQSAFEGF (MAGC1_HUMAN)
EIAQSAFEGW

SEQ ID NO: 87442 - protein, 8 aa, Artificial Sequence
  Description of Artificial Sequence: Synthetic peptide
  Seed: FSSTLLSL (MAGC1_HUMAN)
FASTLLSY

SEQ ID NO: 87443 - protein, 9 aa, Artificial Sequence
  Description of Artificial Sequence: Synthetic peptide
  Seed: IPVSAASSS (MAGC1_HUMAN)
IPVSAASSV

SEQ ID NO: 87444 - protein, 9 aa, Artificial Sequence
  Description of Artificial Sequence: Synthetic peptide
  Seed: SSSVMSPSF (MAGC1_HUMAN)
SPSVMSPSY

SEQ ID NO: 87445 - protein, 9 aa, Artificial Sequence
  Description of Artificial Sequence: Synthetic peptide
  Seed: FSSTLVSLF (MAGC1_HUMAN)
FVSTLVSLY

SEQ ID NO: 87446 - protein, 9 aa, Artificial Sequence
  Description of Artificial Sequence: Synthetic peptide
  Seed: FAFGEPREL (MAGC1_HUMAN)
FPFGEPREL

SEQ ID NO: 87447 - protein, 10 aa, Artificial Sequence
  Description of Artificial Sequence: Synthetic peptide
  Seed: VISFSSSTSL (MAGC1_HUMAN)
VNSFSSSTSL

SEQ ID NO: 87448 - protein, 9 aa, Artificial Sequence
  Description of Artificial Sequence: Synthetic peptide
  Seed: MHSQSPLQS (MAGC1_HUMAN)
MHSQSPLQA

SEQ ID NO: 87449 - protein, 9 aa, Artificial Sequence
  Description of Artificial Sequence: Synthetic peptide
  Seed: QSPQGEDSL (MAGC1_HUMAN)
QIPQGEDSL

SEQ ID NO: 87450 - protein, 10 aa, Artificial Sequence
  Description of Artificial Sequence: Synthetic peptide
  Seed: SLQIPVSPSF (MAGC1_HUMAN)
SVQIPVSPSM

SEQ ID NO: 87451 - protein, 9 aa, Artificial Sequence
  Description of Artificial Sequence: Synthetic peptide
  Seed: RSFSSTLLS (MAGC1_HUMAN)
RTFSSTLLK

SEQ ID NO: 87452 - protein, 9 aa, Artificial Sequence
  Description of Artificial Sequence: Synthetic peptide
  Seed: LSPLHFPQF (MAGC1_HUMAN)
LAPLHFPQI

SEQ ID NO: 87453 - protein, 9 aa, Artificial Sequence
  Description of Artificial Sequence: Synthetic peptide
  Seed: MPSLLQSSS (MAGC1_HUMAN)
MSSLLQSSM

SEQ ID NO: 87454 - protein, 10 aa, Artificial Sequence
  Description of Artificial Sequence: Synthetic peptide
  Seed: LQIPVSPSFS (MAGC1_HUMAN)
LKIPVSPSFF

SEQ ID NO: 87455 - protein, 9 aa, Artificial Sequence
  Description of Artificial Sequence: Synthetic peptide
  Seed: SSSVMSPSF (MAGC1_HUMAN)
SMSVMSPSW

SEQ ID NO: 87456 - protein, 9 aa, Artificial Sequence
  Description of Artificial Sequence: Synthetic peptide
  Seed: WVQEHYLEY (MAGC1_HUMAN)
WNQEHYLEY

SEQ ID NO: 87457 - protein, 9 aa, Artificial Sequence
  Description of Artificial Sequence: Synthetic peptide
  Seed: LKYQVKQPI (MAGC1_HUMAN)
LSYQVKQPY

SEQ ID NO: 87458 - protein, 9 aa, Artificial Sequence
  Description of Artificial Sequence: Synthetic peptide
  Seed: ALLSIFQSS (MAGC1_HUMAN)
ASLSIFQSI

SEQ ID NO: 87459 - protein, 9 aa, Artificial Sequence
  Description of Artificial Sequence: Synthetic peptide
  Seed: LQIVPSLPE (MAGC1_HUMAN)
LMIVPSLPA

SEQ ID NO: 87460 - protein, 10 aa, Artificial Sequence
  Description of Artificial Sequence: Synthetic peptide
  Seed: ASSSVMSPSF (MAGC1_HUMAN)
AHSSVMSPSY

SEQ ID NO: 87461 - protein, 9 aa, Artificial Sequence
  Description of Artificial Sequence: Synthetic peptide
  Seed: GSPSFSSTL (MAGC1_HUMAN)
GVPSFSSTV

SEQ ID NO: 87462 - protein, 9 aa, Artificial Sequence
  Description of Artificial Sequence: Synthetic peptide
  Seed: FFSSALLSI (MAGC1_HUMAN)
FYSSALLSW

SEQ ID NO: 87463 - protein, 10 aa, Artificial Sequence
  Description of Artificial Sequence: Synthetic peptide
  Seed: SPLQSPVISF (MAGC1_HUMAN)
SILQSPVISY

SEQ ID NO: 87464 - protein, 10 aa, Artificial Sequence
  Description of Artificial Sequence: Synthetic peptide
  Seed: FPQSVLQIPV (MAGC1_HUMAN)
FWQSVLQIPV

SEQ ID NO: 87465 - protein, 11 aa, Artificial Sequence
  Description of Artificial Sequence: Synthetic peptide
  Seed: SPLQIPMTSSF (MAGC1_HUMAN)
SFLQIPMTSSY

SEQ ID NO: 87466 - protein, 9 aa, Artificial Sequence
  Description of Artificial Sequence: Synthetic peptide
  Seed: VSSSFSYTL (MAGC1_HUMAN)
VMSSFSYTC

SEQ ID NO: 87467 - protein, 9 aa, Artificial Sequence
  Description of Artificial Sequence: Synthetic peptide
  Seed: VQSPLQNPA (MAGC1_HUMAN)
VMSPLQNPI

SEQ ID NO: 87468 - protein, 10 aa, Artificial Sequence
  Description of Artificial Sequence: Synthetic peptide
  Seed: ASSFFSSALL (MAGC1_HUMAN)
AFSFFSSALF

SEQ ID NO: 87469 - protein, 9 aa, Artificial Sequence
  Description of Artificial Sequence: Synthetic peptide
  Seed: SSPERTQST (MAGC1_HUMAN)
SFPERTQSV

SEQ ID NO: 87470 - protein, 9 aa, Artificial Sequence
  Description of Artificial Sequence: Synthetic peptide
  Seed: SSPERTQST (MAGC1_HUMAN)
SFPERTQSL

SEQ ID NO: 87471 - protein, 9 aa, Artificial Sequence
  Description of Artificial Sequence: Synthetic peptide
  Seed: FEGFAQSPL (MAGC1_HUMAN)
FSGFAQSPF

SEQ ID NO: 87472 - protein, 10 aa, Artificial Sequence
  Description of Artificial Sequence: Synthetic peptide
  Seed: SSSSTLLSLF (MAGC1_HUMAN)
STSSTLLSLW

SEQ ID NO: 87473 - protein, 9 aa, Artificial Sequence
  Description of Artificial Sequence: Synthetic peptide
  Seed: EHFAFGEPR (MAGC1_HUMAN)
ELFAFGEPR

SEQ ID NO: 87474 - protein, 9 aa, Artificial Sequence
  Description of Artificial Sequence: Synthetic peptide
  Seed: EFIEILFGI (MAGC1_HUMAN)
EAIEILFGV

SEQ ID NO: 87475 - protein, 10 aa, Artificial Sequence
  Description of Artificial Sequence: Synthetic peptide
  Seed: WGPRAHSEVI (MAGC1_HUMAN)
WHPRAHSEVL

SEQ ID NO: 87476 - protein, 9 aa, Artificial Sequence
  Description of Artificial Sequence: Synthetic peptide
  Seed: TTDDSTATE (MAGC1_HUMAN)
TVDDSTATL

SEQ ID NO: 87477 - protein, 10 aa, Artificial Sequence
  Description of Artificial Sequence: Synthetic peptide
  Seed: RSFSSTLLSI (MAGC1_HUMAN)
RSFSSTLLSV

SEQ ID NO: 87478 - protein, 9 aa, Artificial Sequence
  Description of Artificial Sequence: Synthetic peptide
  Seed: VPITFPSSY (MAGC1_HUMAN)
VAITFPSSH

SEQ ID NO: 87479 - protein, 9 aa, Artificial Sequence
  Description of Artificial Sequence: Synthetic peptide
  Seed: SSSTLVSIF (MAGC1_HUMAN)
SRSTLVSIM

SEQ ID NO: 87480 - protein, 10 aa, Artificial Sequence
  Description of Artificial Sequence: Synthetic peptide
  Seed: SRYTGYFPVI (MAGC1_HUMAN)
SFYTGYFPVM

SEQ ID NO: 87481 - protein, 11 aa, Artificial Sequence
  Description of Artificial Sequence: Synthetic peptide
  Seed: FLAMLKNTVPI (MAGC1_HUMAN)
FMAMLKNTVPV

SEQ ID NO: 87482 - protein, 11 aa, Artificial Sequence
  Description of Artificial Sequence: Synthetic peptide
  Seed: SPLQIPGSPSF (MAGC1_HUMAN)
SPLQIPGSPSA

SEQ ID NO: 87483 - protein, 9 aa, Artificial Sequence
  Description of Artificial Sequence: Synthetic peptide
  Seed: IPVSPSSSS (MAGC1_HUMAN)
IPVSPSSSL

SEQ ID NO: 87484 - protein, 9 aa, Artificial Sequence
  Description of Artificial Sequence: Synthetic peptide
  Seed: EILFGISLR (MAGC1_HUMAN)
EGLFGISLK

SEQ ID NO: 87485 - protein, 10 aa, Artificial Sequence
  Description of Artificial Sequence: Synthetic peptide
  Seed: KRKVVEFLAM (MAGC1_HUMAN)
KDKVVEFLAF

SEQ ID NO: 87486 - protein, 9 aa, Artificial Sequence
  Description of Artificial Sequence: Synthetic peptide
  Seed: LQIPGSPSF (MAGC1_HUMAN)
LQIPGSPSA

SEQ ID NO: 87487 - protein, 9 aa, Artificial Sequence
  Description of Artificial Sequence: Synthetic peptide
  Seed: LQIPVSSSS (MAGC1_HUMAN)
LQIPVSSSI

SEQ ID NO: 87488 - protein, 9 aa, Artificial Sequence
  Description of Artificial Sequence: Synthetic peptide
  Seed: LQIPMTSSF (MAGC1_HUMAN)
LTIPMTSSF

SEQ ID NO: 87489 - protein, 10 aa, Artificial Sequence
  Description of Artificial Sequence: Synthetic peptide
  Seed: VPITFPSSYK (MAGC1_HUMAN)
VHITFPSSYK

SEQ ID NO: 87490 - protein, 9 aa, Artificial Sequence
  Description of Artificial Sequence: Synthetic peptide
  Seed: IESEPLFTY (MAGC1_HUMAN)
IVSEPLFTY

SEQ ID NO: 87491 - protein, 9 aa, Artificial Sequence
  Description of Artificial Sequence: Synthetic peptide
  Seed: SLFQSFSER (MAGC1_HUMAN)
SAFQSFSER

SEQ ID NO: 87492 - protein, 9 aa, Artificial Sequence
  Description of Artificial Sequence: Synthetic peptide
  Seed: KVWVQEHYL (MAGC1_HUMAN)
KMWVQEHYY

SEQ ID NO: 87493 - protein, 9 aa, Artificial Sequence
  Description of Artificial Sequence: Synthetic peptide
  Seed: TTDDSTATE (MAGC1_HUMAN)
TWDDSTATL

SEQ ID NO: 87494 - protein, 10 aa, Artificial Sequence
  Description of Artificial Sequence: Synthetic peptide
  Seed: LQNPASSFFS (MAGC1_HUMAN)
LQNPASSFFV

SEQ ID NO: 87495 - protein, 10 aa, Artificial Sequence
  Description of Artificial Sequence: Synthetic peptide
  Seed: LSIFQSSPER (MAGC1_HUMAN)
LVIFQSSPER

SEQ ID NO: 87496 - protein, 8 aa, Artificial Sequence
  Description of Artificial Sequence: Synthetic peptide
  Seed: LLSLFQSF (MAGC1_HUMAN)
LMSLFQSY

SEQ ID NO: 87497 - protein, 10 aa, Artificial Sequence
  Description of Artificial Sequence: Synthetic peptide
  Seed: LQIVPSLPEW (MAGC1_HUMAN)
LTIVPSLPEF

SEQ ID NO: 87498 - protein, 11 aa, Artificial Sequence
  Description of Artificial Sequence: Synthetic peptide
  Seed: LQIPVSSSFSY (MAGC1_HUMAN)
LEIPVSSSFSY

SEQ ID NO: 87499 - protein, 9 aa, Artificial Sequence
  Description of Artificial Sequence: Synthetic peptide
  Seed: FEGFAQSSL (MAGC1_HUMAN)
FPGFAQSSY

SEQ ID NO: 87500 - protein, 11 aa, Artificial Sequence
  Description of Artificial Sequence: Synthetic peptide
  Seed: QSSPESDDTLY (MAGC1_HUMAN)
QASPESDDTLW

SEQ ID NO: 87501 - protein, 11 aa, Artificial Sequence
  Description of Artificial Sequence: Synthetic peptide
  Seed: SPLQIPGSPSF (MAGC1_HUMAN)
SPLQIPGSPST

SEQ ID NO: 87502 - protein, 9 aa, Artificial Sequence
  Description of Artificial Sequence: Synthetic peptide
  Seed: REVDPDDSY (MAGC1_HUMAN)
RMVDPDDSY

SEQ ID NO: 87503 - protein, 9 aa, Artificial Sequence
  Description of Artificial Sequence: Synthetic peptide
  Seed: FFSYTLASL (MAGC1_HUMAN)
FMSYTLASP

SEQ ID NO: 87504 - protein, 10 aa, Artificial Sequence
  Description of Artificial Sequence: Synthetic peptide
  Seed: TGYFPVIFRK (MAGC1_HUMAN)
TVYFPVIFRD

SEQ ID NO: 87505 - protein, 9 aa, Artificial Sequence
  Description of Artificial Sequence: Synthetic peptide
  Seed: FPSSTSSSL (MAGC1_HUMAN)
FTSSTSSSL

SEQ ID NO: 87506 - protein, 9 aa, Artificial Sequence
  Description of Artificial Sequence: Synthetic peptide
  Seed: FSYTLASLL (MAGC1_HUMAN)
FIYTLASLL

SEQ ID NO: 87507 - protein, 10 aa, Artificial Sequence
  Description of Artificial Sequence: Synthetic peptide
  Seed: VSSSFSYTLL (MAGC1_HUMAN)
VESSFSYTLY

SEQ ID NO: 87508 - protein, 10 aa, Artificial Sequence
  Description of Artificial Sequence: Synthetic peptide
  Seed: PLQIPVSRSF (MAGC1_HUMAN)
PYQIPVSRSY

SEQ ID NO: 87509 - protein, 10 aa, Artificial Sequence
  Description of Artificial Sequence: Synthetic peptide
  Seed: VISFSSSTSL (MAGC1_HUMAN)
VRSFSSSTSY

SEQ ID NO: 87510 - protein, 9 aa, Artificial Sequence
  Description of Artificial Sequence: Synthetic peptide
  Seed: SSSFSYTLL (MAGC1_HUMAN)
STSFSYTLY

SEQ ID NO: 87511 - protein, 9 aa, Artificial Sequence
  Description of Artificial Sequence: Synthetic peptide
  Seed: LQIPGSPSF (MAGC1_HUMAN)
LRIPGSPSI

SEQ ID NO: 87512 - protein, 10 aa, Artificial Sequence
  Description of Artificial Sequence: Synthetic peptide
  Seed: MPTAGMPSLL (MAGC1_HUMAN)
MGTAGMPSLY

SEQ ID NO: 87513 - protein, 9 aa, Artificial Sequence
  Description of Artificial Sequence: Synthetic peptide
  Seed: LQIPGSPSF (MAGC1_HUMAN)
LQIPGSPSW

SEQ ID NO: 87514 - protein, 11 aa, Artificial Sequence
  Description of Artificial Sequence: Synthetic peptide
  Seed: SPLQIPGSPSF (MAGC1_HUMAN)
SQLQIPGSPSF

SEQ ID NO: 87515 - protein, 9 aa, Artificial Sequence
  Description of Artificial Sequence: Synthetic peptide
  Seed: VLQIPVSAA (MAGC1_HUMAN)
VLQIPVSAV

SEQ ID NO: 87516 - protein, 9 aa, Artificial Sequence
  Description of Artificial Sequence: Synthetic peptide
  Seed: AGREHFAFG (MAGC1_HUMAN)
ASREHFAFS

SEQ ID NO: 87517 - protein, 10 aa, Artificial Sequence
  Description of Artificial Sequence: Synthetic peptide
  Seed: EILFGISLRE (MAGC1_HUMAN)
EELFGISLRR

SEQ ID NO: 87518 - protein, 9 aa, Artificial Sequence
  Description of Artificial Sequence: Synthetic peptide
  Seed: GPRAHSEVI (MAGC1_HUMAN)
GPRAHSEVL

SEQ ID NO: 87519 - protein, 9 aa, Artificial Sequence
  Description of Artificial Sequence: Synthetic peptide
  Seed: QVKQPITKA (MAGC1_HUMAN)
QYKQPITKK

SEQ ID NO: 87520 - protein, 11 aa, Artificial Sequence
  Description of Artificial Sequence: Synthetic peptide
  Seed: SPLQNPASSFF (MAGC1_HUMAN)
SELQNPASSFF

SEQ ID NO: 87521 - protein, 9 aa, Artificial Sequence
  Description of Artificial Sequence: Synthetic peptide
  Seed: AQSSLQIPV (MAGC1_HUMAN)
ALSSLQIPI

SEQ ID NO: 87522 - protein, 9 aa, Artificial Sequence
  Description of Artificial Sequence: Synthetic peptide
  Seed: ALKDVEERA (MAGC1_HUMAN)
AMKDVEERL

SEQ ID NO: 87523 - protein, 9 aa, Artificial Sequence
  Description of Artificial Sequence: Synthetic peptide
  Seed: IPVSSSFSY (MAGC1_HUMAN)
IAVSSSFSY

SEQ ID NO: 87524 - protein, 10 aa, Artificial Sequence
  Description of Artificial Sequence: Synthetic peptide
  Seed: WGPRAHSEVI (MAGC1_HUMAN)
WLPRAHSEVM

SEQ ID NO: 87525 - protein, 9 aa, Artificial Sequence
  Description of Artificial Sequence: Synthetic peptide
  Seed: SPVSSFPSS (MAGC1_HUMAN)
SPVSSFPSC

SEQ ID NO: 87526 - protein, 9 aa, Artificial Sequence
  Description of Artificial Sequence: Synthetic peptide
  Seed: MTSSFSSTL (MAGC1_HUMAN)
MPSSFSSTE

SEQ ID NO: 87527 - protein, 11 aa, Artificial Sequence
  Description of Artificial Sequence: Synthetic peptide
  Seed: SFSSSTSLSPF (MAGC1_HUMAN)
SKSSSTSLSPF

SEQ ID NO: 87528 - protein, 11 aa, Artificial Sequence
  Description of Artificial Sequence: Synthetic peptide
  Seed: SPQSPPEGMHS (MAGC1_HUMAN)
SPQSPPEGMHA

SEQ ID NO: 87529 - protein, 10 aa, Artificial Sequence
  Description of Artificial Sequence: Synthetic peptide
  Seed: MTSSFSSTLL (MAGC1_HUMAN)
MVSSFSSTLM

SEQ ID NO: 87530 - protein, 10 aa, Artificial Sequence
  Description of Artificial Sequence: Synthetic peptide
  Seed: SPLQSPVSSF (MAGC1_HUMAN)
SALQSPVSSM

SEQ ID NO: 87531 - protein, 9 aa, Artificial Sequence
  Description of Artificial Sequence: Synthetic peptide
  Seed: SRYTGYFPV (MAGC1_HUMAN)
STYTGYFPM

SEQ ID NO: 87532 - protein, 9 aa, Artificial Sequence
  Description of Artificial Sequence: Synthetic peptide
  Seed: ISFSSSTSL (MAGC1_HUMAN)
IHFSSSTSY

SEQ ID NO: 87533 - protein, 9 aa, Artificial Sequence
  Description of Artificial Sequence: Synthetic peptide
  Seed: VIFRKAREF (MAGC1_HUMAN)
VAFRKAREY

SEQ ID NO: 87534 - protein, 9 aa, Artificial Sequence
  Description of Artificial Sequence: Synthetic peptide
  Seed: SSPESAQSA (MAGC1_HUMAN)
SMPESAQSL

SEQ ID NO: 87535 - protein, 9 aa, Artificial Sequence
  Description of Artificial Sequence: Synthetic peptide
  Seed: FPSSTSSSL (MAGC1_HUMAN)
FVSSTSSSI

SEQ ID NO: 87536 - protein, 9 aa, Artificial Sequence
  Description of Artificial Sequence: Synthetic peptide
  Seed: FTYTLDEKV (MAGC1_HUMAN)
FIYTLDEKW

SEQ ID NO: 87537 - protein, 9 aa, Artificial Sequence
  Description of Artificial Sequence: Synthetic peptide
  Seed: VIKRKVVEF (MAGC1_HUMAN)
VRKRKVVEF

SEQ ID NO: 87538 - protein, 9 aa, Artificial Sequence
  Description of Artificial Sequence: Synthetic peptide
  Seed: SSSESPQSC (MAGC1_HUMAN)
SVSESPQSM

SEQ ID NO: 87539 - protein, 9 aa, Artificial Sequence
  Description of Artificial Sequence: Synthetic peptide
  Seed: FAQSPLQIP (MAGC1_HUMAN)
FPQSPLQIL

SEQ ID NO: 87540 - protein, 9 aa, Artificial Sequence
  Description of Artificial Sequence: Synthetic peptide
  Seed: RTHSTFEGF (MAGC1_HUMAN)
RKHSTFEGF

SEQ ID NO: 87541 - protein, 9 aa, Artificial Sequence
  Description of Artificial Sequence: Synthetic peptide
  Seed: QVKQPITKA (MAGC1_HUMAN)
QVKQPITKL

SEQ ID NO: 87542 - protein, 9 aa, Artificial Sequence
  Description of Artificial Sequence: Synthetic peptide
  Seed: SLIESEPLF (MAGC1_HUMAN)
STIESEPLW

SEQ ID NO: 87543 - protein, 10 aa, Artificial Sequence
  Description of Artificial Sequence: Synthetic peptide
  Seed: WEDSLSPHYF (MAGC1_HUMAN)
WIDSLSPHYL

SEQ ID NO: 87544 - protein, 9 aa, Artificial Sequence
  Description of Artificial Sequence: Synthetic peptide
  Seed: KVDELARFL (MAGC1_HUMAN)
KLDELARFY

SEQ ID NO: 87545 - protein, 9 aa, Artificial Sequence
  Description of Artificial Sequence: Synthetic peptide
  Seed: RPVSSFFSY (MAGC1_HUMAN)
RIVSSFFSM

SEQ ID NO: 87546 - protein, 9 aa, Artificial Sequence
  Description of Artificial Sequence: Synthetic peptide
  Seed: SSSSSSSTL (MAGC1_HUMAN)
SLSSSSSTL

SEQ ID NO: 87547 - protein, 10 aa, Artificial Sequence
  Description of Artificial Sequence: Synthetic peptide
  Seed: SFPSSTSSSL (MAGC1_HUMAN)
SKPSSTSSSL

SEQ ID NO: 87548 - protein, 10 aa, Artificial Sequence
  Description of Artificial Sequence: Synthetic peptide
  Seed: VISFSSSTSL (MAGC1_HUMAN)
VRSFSSSTSW

SEQ ID NO: 87549 - protein, 9 aa, Artificial Sequence
  Description of Artificial Sequence: Synthetic peptide
  Seed: SSSTLVSIF (MAGC1_HUMAN)
SHSTLVSIY

SEQ ID NO: 87550 - protein, 9 aa, Artificial Sequence
  Description of Artificial Sequence: Synthetic peptide
  Seed: EFIEILFGI (MAGC1_HUMAN)
ELIEILFGA

SEQ ID NO: 87551 - protein, 9 aa, Artificial Sequence
  Description of Artificial Sequence: Synthetic peptide
  Seed: AQSSLQIPV (MAGC1_HUMAN)
ASSSLQIPF

SEQ ID NO: 87552 - protein, 11 aa, Artificial Sequence
  Description of Artificial Sequence: Synthetic peptide
  Seed: MSPLYFPQSPL (MAGC1_HUMAN)
MMPLYFPQSPL

SEQ ID NO: 87553 - protein, 11 aa, Artificial Sequence
  Description of Artificial Sequence: Synthetic peptide
  Seed: SFFSYTLASLL (MAGC1_HUMAN)
SQFSYTLASLY

SEQ ID NO: 87554 - protein, 10 aa, Artificial Sequence
  Description of Artificial Sequence: Synthetic peptide
  Seed: SIIFIKGTYA (MAGC1_HUMAN)
SSIFIKGTYV

SEQ ID NO: 87555 - protein, 9 aa, Artificial Sequence
  Description of Artificial Sequence: Synthetic peptide
  Seed: LKNTVPITF (MAGC1_HUMAN)
LRNTVPITI

SEQ ID NO: 87556 - protein, 11 aa, Artificial Sequence
  Description of Artificial Sequence: Synthetic peptide
  Seed: KRKVVEFLAML (MAGC1_HUMAN)
KNKVVEFLAMV

SEQ ID NO: 87557 - protein, 9 aa, Artificial Sequence
  Description of Artificial Sequence: Synthetic peptide
  Seed: TTDDSTATE (MAGC1_HUMAN)
TMDDSTATI

SEQ ID NO: 87558 - protein, 9 aa, Artificial Sequence
  Description of Artificial Sequence: Synthetic peptide
  Seed: CSSSTSLSL (MAGC1_HUMAN)
CQSSTSLSM

SEQ ID NO: 87559 - protein, 9 aa, Artificial Sequence
  Description of Artificial Sequence: Synthetic peptide
  Seed: VPITFPSSY (MAGC1_HUMAN)
VMITFPSSF

SEQ ID NO: 87560 - protein, 10 aa, Artificial Sequence
  Description of Artificial Sequence: Synthetic peptide
  Seed: RAGREHFAFG (MAGC1_HUMAN)
RTGREHFAFV

SEQ ID NO: 87561 - protein, 11 aa, Artificial Sequence
  Description of Artificial Sequence: Synthetic peptide
  Seed: LQIPVSSSFSY (MAGC1_HUMAN)
LAIPVSSSFSY

SEQ ID NO: 87562 - protein, 10 aa, Artificial Sequence
  Description of Artificial Sequence: Synthetic peptide
  Seed: QGEDSMSPLY (MAGC1_HUMAN)
QPEDSMSPLW

SEQ ID NO: 87563 - protein, 11 aa, Artificial Sequence
  Description of Artificial Sequence: Synthetic peptide
  Seed: SSSFSYTLLSL (MAGC1_HUMAN)
SMSFSYTLLSY

SEQ ID NO: 87564 - protein, 10 aa, Artificial Sequence
  Description of Artificial Sequence: Synthetic peptide
  Seed: SFPSSTSSSL (MAGC1_HUMAN)
SIPSSTSSSV

SEQ ID NO: 87565 - protein, 11 aa, Artificial Sequence
  Description of Artificial Sequence: Synthetic peptide
  Seed: SPLQIPVSSSS (MAGC1_HUMAN)
SQLQIPVSSSM

SEQ ID NO: 87566 - protein, 9 aa, Artificial Sequence
  Description of Artificial Sequence: Synthetic peptide
  Seed: SSPERTHST (MAGC1_HUMAN)
SQPERTHSY

SEQ ID NO: 87567 - protein, 9 aa, Artificial Sequence
  Description of Artificial Sequence: Synthetic peptide
  Seed: SSSESPQSC (MAGC1_HUMAN)
SISESPQSL

SEQ ID NO: 87568 - protein, 8 aa, Artificial Sequence
  Description of Artificial Sequence: Synthetic peptide
  Seed: LQRPVSSF (MAGC1_HUMAN)
LMRPVSSY

SEQ ID NO: 87569 - protein, 9 aa, Artificial Sequence
  Description of Artificial Sequence: Synthetic peptide
  Seed: ESDDTLYPL (MAGC1_HUMAN)
ELDDTLYPV

SEQ ID NO: 87570 - protein, 11 aa, Artificial Sequence
  Description of Artificial Sequence: Synthetic peptide
  Seed: IPVSSSFSYTL (MAGC1_HUMAN)
ICVSSSFSYTY

SEQ ID NO: 87571 - protein, 9 aa, Artificial Sequence
  Description of Artificial Sequence: Synthetic peptide
  Seed: LQIPVSSSS (MAGC1_HUMAN)
LGIPVSSSM

SEQ ID NO: 87572 - protein, 9 aa, Artificial Sequence
  Description of Artificial Sequence: Synthetic peptide
  Seed: GFPQSVLQI (MAGC1_HUMAN)
GAPQSVLQF

SEQ ID NO: 87573 - protein, 9 aa, Artificial Sequence
  Description of Artificial Sequence: Synthetic peptide
  Seed: VIKRKVVEF (MAGC1_HUMAN)
VAKRKVVEF

SEQ ID NO: 87574 - protein, 9 aa, Artificial Sequence
  Description of Artificial Sequence: Synthetic peptide
  Seed: TFEGFPQSL (MAGC1_HUMAN)
TEEGFPQSL

SEQ ID NO: 87575 - protein, 10 aa, Artificial Sequence
  Description of Artificial Sequence: Synthetic peptide
  Seed: VSPSSSSTLL (MAGC1_HUMAN)
VSPSSSSTLY

SEQ ID NO: 87576 - protein, 9 aa, Artificial Sequence
  Description of Artificial Sequence: Synthetic peptide
  Seed: FTYTLDEKV (MAGC1_HUMAN)
FIYTLDEKM

SEQ ID NO: 87577 - protein, 9 aa, Artificial Sequence
  Description of Artificial Sequence: Synthetic peptide
  Seed: SQNRLLILI (MAGC1_HUMAN)
SRNRLLILL

SEQ ID NO: 87578 - protein, 9 aa, Artificial Sequence
  Description of Artificial Sequence: Synthetic peptide
  Seed: ASSFFSSAL (MAGC1_HUMAN)
AASFFSSAW

SEQ ID NO: 87579 - protein, 8 aa, Artificial Sequence
  Description of Artificial Sequence: Synthetic peptide
  Seed: IWDVLSGI (MAGC1_HUMAN)
ISDVLSGI

SEQ ID NO: 87580 - protein, 9 aa, Artificial Sequence
  Description of Artificial Sequence: Synthetic peptide
  Seed: NSSPPRYEF (MAGC1_HUMAN)
NVSPPRYEY

SEQ ID NO: 87581 - protein, 10 aa, Artificial Sequence
  Description of Artificial Sequence: Synthetic peptide
  Seed: SFSSTLVSLF (MAGC1_HUMAN)
STSSTLVSLW

SEQ ID NO: 87582 - protein, 9 aa, Artificial Sequence
  Description of Artificial Sequence: Synthetic peptide
  Seed: TSLSLPQSF (MAGC1_HUMAN)
TSLSLPQSY

SEQ ID NO: 87583 - protein, 9 aa, Artificial Sequence
  Description of Artificial Sequence: Synthetic peptide
  Seed: SSSTSLSPF (MAGC1_HUMAN)
SVSTSLSPF

SEQ ID NO: 87584 - protein, 11 aa, Artificial Sequence
  Description of Artificial Sequence: Synthetic peptide
  Seed: STFEGFAQSSL (MAGC1_HUMAN)
SAFEGFAQSSY

SEQ ID NO: 87585 - protein, 9 aa, Artificial Sequence
  Description of Artificial Sequence: Synthetic peptide
  Seed: LARFLLLKY (MAGC1_HUMAN)
LMRFLLLKY

SEQ ID NO: 87586 - protein, 9 aa, Artificial Sequence
  Description of Artificial Sequence: Synthetic peptide
  Seed: SSSFSYTLL (MAGC1_HUMAN)
SLSFSYTLL

SEQ ID NO: 87587 - protein, 9 aa, Artificial Sequence
  Description of Artificial Sequence: Synthetic peptide
  Seed: YQVKQPITK (MAGC1_HUMAN)
YAVKQPITY

SEQ ID NO: 87588 - protein, 9 aa, Artificial Sequence
  Description of Artificial Sequence: Synthetic peptide
  Seed: LQIPVSPSF (MAGC1_HUMAN)
LAIPVSPSW

SEQ ID NO: 87589 - protein, 9 aa, Artificial Sequence
  Description of Artificial Sequence: Synthetic peptide
  Seed: YPLQSPQSR (MAGC1_HUMAN)
YPLQSPQSV

SEQ ID NO: 87590 - protein, 10 aa, Artificial Sequence
  Description of Artificial Sequence: Synthetic peptide
  Seed: SLQIPVSPSF (MAGC1_HUMAN)
SFQIPVSPSW

SEQ ID NO: 87591 - protein, 9 aa, Artificial Sequence
  Description of Artificial Sequence: Synthetic peptide
  Seed: LQIVPSLPE (MAGC1_HUMAN)
LLIVPSLPL

SEQ ID NO: 87592 - protein, 9 aa, Artificial Sequence
  Description of Artificial Sequence: Synthetic peptide
  Seed: VSSFFSYTL (MAGC1_HUMAN)
VQSFFSYTM

SEQ ID NO: 87593 - protein, 9 aa, Artificial Sequence
  Description of Artificial Sequence: Synthetic peptide
  Seed: LQIPMTSSF (MAGC1_HUMAN)
LAIPMTSSW

SEQ ID NO: 87594 - protein, 9 aa, Artificial Sequence
  Description of Artificial Sequence: Synthetic peptide
  Seed: EDSLSPHYF (MAGC1_HUMAN)
EESLSPHYF

SEQ ID NO: 87595 - protein, 9 aa, Artificial Sequence
  Description of Artificial Sequence: Synthetic peptide
  Seed: NTVPITFPS (MAGC1_HUMAN)
NSVPITFPT

SEQ ID NO: 87596 - protein, 9 aa, Artificial Sequence
  Description of Artificial Sequence: Synthetic peptide
  Seed: EHFAFGEPR (MAGC1_HUMAN)
EVFAFGEPK

SEQ ID NO: 87597 - protein, 9 aa, Artificial Sequence
  Description of Artificial Sequence: Synthetic peptide
  Seed: VQSPLHSPQ (MAGC1_HUMAN)
VQSPLHSPL

SEQ ID NO: 87598 - protein, 11 aa, Artificial Sequence
  Description of Artificial Sequence: Synthetic peptide
  Seed: SSSSSSTLLSL (MAGC1_HUMAN)
SSSSSSTLLSW

SEQ ID NO: 87599 - protein, 11 aa, Artificial Sequence
  Description of Artificial Sequence: Synthetic peptide
  Seed: IPVSAASSSTL (MAGC1_HUMAN)
IIVSAASSSTF

SEQ ID NO: 87600 - protein, 10 aa, Artificial Sequence
  Description of Artificial Sequence: Synthetic peptide
  Seed: QRPVSSFFSY (MAGC1_HUMAN)
QAPVSSFFSF

SEQ ID NO: 87601 - protein, 9 aa, Artificial Sequence
  Description of Artificial Sequence: Synthetic peptide
  Seed: RPVSSFFSY (MAGC1_HUMAN)
RMVSSFFSL

SEQ ID NO: 87602 - protein, 9 aa, Artificial Sequence
  Description of Artificial Sequence: Synthetic peptide
  Seed: SSPEGKDSL (MAGC1_HUMAN)
SMPEGKDSL

SEQ ID NO: 87603 - protein, 9 aa, Artificial Sequence
  Description of Artificial Sequence: Synthetic peptide
  Seed: KAREFIEIL (MAGC1_HUMAN)
KAREFIEIH

SEQ ID NO: 87604 - protein, 10 aa, Artificial Sequence
  Description of Artificial Sequence: Synthetic peptide
  Seed: SFFSYTLASL (MAGC1_HUMAN)
SWFSYTLASM

SEQ ID NO: 87605 - protein, 9 aa, Artificial Sequence
  Description of Artificial Sequence: Synthetic peptide
  Seed: EDSMSPLYF (MAGC1_HUMAN)
EESMSPLYY

SEQ ID NO: 87606 - protein, 10 aa, Artificial Sequence
  Description of Artificial Sequence: Synthetic peptide
  Seed: TVPITFPSSY (MAGC1_HUMAN)
TFPITFPSSF

SEQ ID NO: 87607 - protein, 9 aa, Artificial Sequence
  Description of Artificial Sequence: Synthetic peptide
  Seed: VSSSFSYTL (MAGC1_HUMAN)
VSSSFSYTM

SEQ ID NO: 87608 - protein, 9 aa, Artificial Sequence
  Description of Artificial Sequence: Synthetic peptide
  Seed: GPRAHSEVI (MAGC1_HUMAN)
GPRAHSEVF

SEQ ID NO: 87609 - protein, 10 aa, Artificial Sequence
  Description of Artificial Sequence: Synthetic peptide
  Seed: RSFSSTLLSI (MAGC1_HUMAN)
RHFSSTLLSF

SEQ ID NO: 87610 - protein, 9 aa, Artificial Sequence
  Description of Artificial Sequence: Synthetic peptide
  Seed: IIDTTDDST (MAGC1_HUMAN)
IFDTTDDSL

SEQ ID NO: 87611 - protein, 11 aa, Artificial Sequence
  Description of Artificial Sequence: Synthetic peptide
  Seed: LQIPVSSSFSY (MAGC1_HUMAN)
LHIPVSSSFSF

SEQ ID NO: 87612 - protein, 9 aa, Artificial Sequence
  Description of Artificial Sequence: Synthetic peptide
  Seed: SQSSPVSSF (MAGC1_HUMAN)
SFSSPVSSW

SEQ ID NO: 87613 - protein, 9 aa, Artificial Sequence
  Description of Artificial Sequence: Synthetic peptide
  Seed: VLSGIGVRA (MAGC1_HUMAN)
VISGIGVRL

SEQ ID NO: 87614 - protein, 9 aa, Artificial Sequence
  Description of Artificial Sequence: Synthetic peptide
  Seed: SQNRLLILI (MAGC1_HUMAN)
SANRLLILL

SEQ ID NO: 87615 - protein, 10 aa, Artificial Sequence
  Description of Artificial Sequence: Synthetic peptide
  Seed: RAGREHFAFG (MAGC1_HUMAN)
RHGREHFAFK

SEQ ID NO: 87616 - protein, 9 aa, Artificial Sequence
  Description of Artificial Sequence: Synthetic peptide
  Seed: IPMTSSFSS (MAGC1_HUMAN)
IGMTSSFSY

SEQ ID NO: 87617 - protein, 9 aa, Artificial Sequence
  Description of Artificial Sequence: Synthetic peptide
  Seed: TLDLTSEGC (MAGC1_HUMAN)
TSDLTSEGI

SEQ ID NO: 87618 - protein, 9 aa, Artificial Sequence
  Description of Artificial Sequence: Synthetic peptide
  Seed: ISFSSSTSL (MAGC1_HUMAN)
IMFSSSTSV

SEQ ID NO: 87619 - protein, 10 aa, Artificial Sequence
  Description of Artificial Sequence: Synthetic peptide
  Seed: SPLYFPQSPL (MAGC1_HUMAN)
SYLYFPQSPI

SEQ ID NO: 87620 - protein, 9 aa, Artificial Sequence
  Description of Artificial Sequence: Synthetic peptide
  Seed: QIVPSLPEW (MAGC1_HUMAN)
QCVPSLPEW

SEQ ID NO: 87621 - protein, 10 aa, Artificial Sequence
  Description of Artificial Sequence: Synthetic peptide
  Seed: TGYFPVIFRK (MAGC1_HUMAN)
TIYFPVIFRR

SEQ ID NO: 87622 - protein, 9 aa, Artificial Sequence
  Description of Artificial Sequence: Synthetic peptide
  Seed: SSFFSSALL (MAGC1_HUMAN)
SAFFSSALI

SEQ ID NO: 87623 - protein, 9 aa, Artificial Sequence
  Description of Artificial Sequence: Synthetic peptide
  Seed: IFRKAREFI (MAGC1_HUMAN)
IMRKAREFA

SEQ ID NO: 87624 - protein, 9 aa, Artificial Sequence
  Description of Artificial Sequence: Synthetic peptide
  Seed: AGREHFAFG (MAGC1_HUMAN)
AIREHFAFL

SEQ ID NO: 87625 - protein, 9 aa, Artificial Sequence
  Description of Artificial Sequence: Synthetic peptide
  Seed: NSSPPRYEF (MAGC1_HUMAN)
NFSPPRYEM

SEQ ID NO: 87626 - protein, 9 aa, Artificial Sequence
  Description of Artificial Sequence: Synthetic peptide
  Seed: MSQNRLLIL (MAGC1_HUMAN)
MRQNRLLIM

SEQ ID NO: 87627 - protein, 9 aa, Artificial Sequence
  Description of Artificial Sequence: Synthetic peptide
  Seed: TLLESDSLT (MAGC1_HUMAN)
TILESDSLV

SEQ ID NO: 87628 - protein, 10 aa, Artificial Sequence
  Description of Artificial Sequence: Synthetic peptide
  Seed: SFSSTLVSLF (MAGC1_HUMAN)
SGSSTLVSLW

SEQ ID NO: 87629 - protein, 8 aa, Artificial Sequence
  Description of Artificial Sequence: Synthetic peptide
  Seed: MPTAGMPS (MAGC1_HUMAN)
MPTAGMPA

SEQ ID NO: 87630 - protein, 9 aa, Artificial Sequence
  Description of Artificial Sequence: Synthetic peptide
  Seed: VQSPLQNPA (MAGC1_HUMAN)
VVSPLQNPL

SEQ ID NO: 87631 - protein, 10 aa, Artificial Sequence
  Description of Artificial Sequence: Synthetic peptide
  Seed: MLTNVISRYT (MAGC1_HUMAN)
MMTNVISRYA

SEQ ID NO: 87632 - protein, 8 aa, Artificial Sequence
  Description of Artificial Sequence: Synthetic peptide
  Seed: SFFSSALL (MAGC1_HUMAN)
SYFSSALF

SEQ ID NO: 87633 - protein, 9 aa, Artificial Sequence
  Description of Artificial Sequence: Synthetic peptide
  Seed: SSSTLVSIF (MAGC1_HUMAN)
SQSTLVSIM

SEQ ID NO: 87634 - protein, 11 aa, Artificial Sequence
  Description of Artificial Sequence: Synthetic peptide
  Seed: FLAMLKNTVPI (MAGC1_HUMAN)
FEAMLKNTVPI

SEQ ID NO: 87635 - protein, 9 aa, Artificial Sequence
  Description of Artificial Sequence: Synthetic peptide
  Seed: SSPERTHST (MAGC1_HUMAN)
SAPERTHSL

SEQ ID NO: 87636 - protein, 10 aa, Artificial Sequence
  Description of Artificial Sequence: Synthetic peptide
  Seed: SSPESAQSAF (MAGC1_HUMAN)
SCPESAQSAL

SEQ ID NO: 87637 - protein, 10 aa, Artificial Sequence
  Description of Artificial Sequence: Synthetic peptide
  Seed: LQIVPSLPEW (MAGC1_HUMAN)
LLIVPSLPEY

SEQ ID NO: 87638 - protein, 10 aa, Artificial Sequence
  Description of Artificial Sequence: Synthetic peptide
  Seed: KAREFIEILF (MAGC1_HUMAN)
KRREFIEILF

SEQ ID NO: 87639 - protein, 9 aa, Artificial Sequence
  Description of Artificial Sequence: Synthetic peptide
  Seed: ATESASSSV (MAGC1_HUMAN)
ATESASSSL

SEQ ID NO: 87640 - protein, 9 aa, Artificial Sequence
  Description of Artificial Sequence: Synthetic peptide
  Seed: SPPEGPVQS (MAGC1_HUMAN)
SAPEGPVQI

SEQ ID NO: 87641 - protein, 11 aa, Artificial Sequence
  Description of Artificial Sequence: Synthetic peptide
  Seed: SSSSSTLLSLF (MAGC1_HUMAN)
SLSSSTLLSLW

SEQ ID NO: 87642 - protein, 9 aa, Artificial Sequence
  Description of Artificial Sequence: Synthetic peptide
  Seed: SAASSSTLV (MAGC1_HUMAN)
SSASSSTLF

SEQ ID NO: 87643 - protein, 9 aa, Artificial Sequence
  Description of Artificial Sequence: Synthetic peptide
  Seed: SAQSAFEGF (MAGC1_HUMAN)
SPQSAFEGY

SEQ ID NO: 87644 - protein, 9 aa, Artificial Sequence
  Description of Artificial Sequence: Synthetic peptide
  Seed: VSRSFSSTL (MAGC1_HUMAN)
VARSFSSTA

SEQ ID NO: 87645 - protein, 10 aa, Artificial Sequence
  Description of Artificial Sequence: Synthetic peptide
  Seed: FSSSTSLSPF (MAGC1_HUMAN)
FISSTSLSPF

SEQ ID NO: 87646 - protein, 9 aa, Artificial Sequence
  Description of Artificial Sequence: Synthetic peptide
  Seed: STFEGFAQS (MAGC1_HUMAN)
SLFEGFAQV

SEQ ID NO: 87647 - protein, 10 aa, Artificial Sequence
  Description of Artificial Sequence: Synthetic peptide
  Seed: SIFQSSPESA (MAGC1_HUMAN)
SLFQSSPESL

SEQ ID NO: 87648 - protein, 9 aa, Artificial Sequence
  Description of Artificial Sequence: Synthetic peptide
  Seed: IESEPLFTY (MAGC1_HUMAN)
IKSEPLFTF

SEQ ID NO: 87649 - protein, 10 aa, Artificial Sequence
  Description of Artificial Sequence: Synthetic peptide
  Seed: DVLSGIGVRA (MAGC1_HUMAN)
DALSGIGVRK

SEQ ID NO: 87650 - protein, 9 aa, Artificial Sequence
  Description of Artificial Sequence: Synthetic peptide
  Seed: VSRSFSSTL (MAGC1_HUMAN)
VSRSFSSTW

SEQ ID NO: 87651 - protein, 9 aa, Artificial Sequence
  Description of Artificial Sequence: Synthetic peptide
  Seed: VVEFLAMLK (MAGC1_HUMAN)
VFEFLAMLR

SEQ ID NO: 87652 - protein, 9 aa, Artificial Sequence
  Description of Artificial Sequence: Synthetic peptide
  Seed: SSTSSSLSK (MAGC1_HUMAN)
SMTSSSLSK

SEQ ID NO: 87653 - protein, 9 aa, Artificial Sequence
  Description of Artificial Sequence: Synthetic peptide
  Seed: SPLQNPASS (MAGC1_HUMAN)
SPLQNPASM

SEQ ID NO: 87654 - protein, 9 aa, Artificial Sequence
  Description of Artificial Sequence: Synthetic peptide
  Seed: VSRSFSSTL (MAGC1_HUMAN)
VIRSFSSTK

SEQ ID NO: 87655 - protein, 10 aa, Artificial Sequence
  Description of Artificial Sequence: Synthetic peptide
  Seed: LQIPVSSSFS (MAGC1_HUMAN)
LQIPVSSSFF

SEQ ID NO: 87656 - protein, 10 aa, Artificial Sequence
  Description of Artificial Sequence: Synthetic peptide
  Seed: VISFSSSTSL (MAGC1_HUMAN)
VWSFSSSTSW

SEQ ID NO: 87657 - protein, 9 aa, Artificial Sequence
  Description of Artificial Sequence: Synthetic peptide
  Seed: CSSSTPSSL (MAGC1_HUMAN)
CASSTPSSY

SEQ ID NO: 87658 - protein, 10 aa, Artificial Sequence
  Description of Artificial Sequence: Synthetic peptide
  Seed: IIDTTDDSTA (MAGC1_HUMAN)
ITDTTDDSTM

SEQ ID NO: 87659 - protein, 9 aa, Artificial Sequence
  Description of Artificial Sequence: Synthetic peptide
  Seed: IPMTSSFSS (MAGC1_HUMAN)
IPMTSSFST

SEQ ID NO: 87660 - protein, 10 aa, Artificial Sequence
  Description of Artificial Sequence: Synthetic peptide
  Seed: KVVEFLAMLK (MAGC1_HUMAN)
KMVEFLAMLV

SEQ ID NO: 87661 - protein, 9 aa, Artificial Sequence
  Description of Artificial Sequence: Synthetic peptide
  Seed: IIDTTDDST (MAGC1_HUMAN)
ICDTTDDSL

SEQ ID NO: 87662 - protein, 9 aa, Artificial Sequence
  Description of Artificial Sequence: Synthetic peptide
  Seed: MTSSFSSTL (MAGC1_HUMAN)
MYSSFSSTM

SEQ ID NO: 87663 - protein, 10 aa, Artificial Sequence
  Description of Artificial Sequence: Synthetic peptide
  Seed: IPVSSSFSYT (MAGC1_HUMAN)
IAVSSSFSYY

SEQ ID NO: 87664 - protein, 9 aa, Artificial Sequence
  Description of Artificial Sequence: Synthetic peptide
  Seed: SSFSSTLLS (MAGC1_HUMAN)
SFFSSTLLK

SEQ ID NO: 87665 - protein, 9 aa, Artificial Sequence
  Description of Artificial Sequence: Synthetic peptide
  Seed: SSSVMSPSF (MAGC1_HUMAN)
SPSVMSPSM

SEQ ID NO: 87666 - protein, 9 aa, Artificial Sequence
  Description of Artificial Sequence: Synthetic peptide
  Seed: TLDEKVDEL (MAGC1_HUMAN)
TGDEKVDEL

SEQ ID NO: 87667 - protein, 9 aa, Artificial Sequence
  Description of Artificial Sequence: Synthetic peptide
  Seed: SPPQGEDSL (MAGC1_HUMAN)
SAPQGEDSM

SEQ ID NO: 87668 - protein, 9 aa, Artificial Sequence
  Description of Artificial Sequence: Synthetic peptide
  Seed: AQSPLQSPV (MAGC1_HUMAN)
AESPLQSPY

SEQ ID NO: 87669 - protein, 8 aa, Artificial Sequence
  Description of Artificial Sequence: Synthetic peptide
  Seed: SSFSSTLL (MAGC1_HUMAN)
STFSSTLY

SEQ ID NO: 87670 - protein, 9 aa, Artificial Sequence
  Description of Artificial Sequence: Synthetic peptide
  Seed: VIWDVLSGI (MAGC1_HUMAN)
VTWDVLSGR

SEQ ID NO: 87671 - protein, 9 aa, Artificial Sequence
  Description of Artificial Sequence: Synthetic peptide
  Seed: FPSSTSSSL (MAGC1_HUMAN)
FGSSTSSSM

SEQ ID NO: 87672 - protein, 10 aa, Artificial Sequence
  Description of Artificial Sequence: Synthetic peptide
  Seed: PLQIPVSRSF (MAGC1_HUMAN)
PVQIPVSRSY

SEQ ID NO: 87673 - protein, 9 aa, Artificial Sequence
  Description of Artificial Sequence: Synthetic peptide
  Seed: SPLQSPESA (MAGC1_HUMAN)
SALQSPESL

SEQ ID NO: 87674 - protein, 9 aa, Artificial Sequence
  Description of Artificial Sequence: Synthetic peptide
  Seed: SAASSSTLV (MAGC1_HUMAN)
SMASSSTLI

SEQ ID NO: 87675 - protein, 9 aa, Artificial Sequence
  Description of Artificial Sequence: Synthetic peptide
  Seed: SLLQSSHES (MAGC1_HUMAN)
SMLQSSHEA

SEQ ID NO: 87676 - protein, 9 aa, Artificial Sequence
  Description of Artificial Sequence: Synthetic peptide
  Seed: RKVVEFLAM (MAGC1_HUMAN)
RRVVEFLAL

SEQ ID NO: 87677 - protein, 9 aa, Artificial Sequence
  Description of Artificial Sequence: Synthetic peptide
  Seed: VSSSSSSTL (MAGC1_HUMAN)
VFSSSSSTF

SEQ ID NO: 87678 - protein, 10 aa, Artificial Sequence
  Description of Artificial Sequence: Synthetic peptide
  Seed: MPTAGMPSLL (MAGC1_HUMAN)
MSTAGMPSLW

SEQ ID NO: 87679 - protein, 10 aa, Artificial Sequence
  Description of Artificial Sequence: Synthetic peptide
  Seed: SFSSTLVSLF (MAGC1_HUMAN)
SWSSTLVSLF

SEQ ID NO: 87680 - protein, 10 aa, Artificial Sequence
  Description of Artificial Sequence: Synthetic peptide
  Seed: SSFSYTLLSL (MAGC1_HUMAN)
SKFSYTLLSY

SEQ ID NO: 87681 - protein, 9 aa, Artificial Sequence
  Description of Artificial Sequence: Synthetic peptide
  Seed: NSSPPRYEF (MAGC1_HUMAN)
NISPPRYEY

SEQ ID NO: 87682 - protein, 9 aa, Artificial Sequence
  Description of Artificial Sequence: Synthetic peptide
  Seed: SASSSVMSP (MAGC1_HUMAN)
STSSSVMSM

SEQ ID NO: 87683 - protein, 10 aa, Artificial Sequence
  Description of Artificial Sequence: Synthetic peptide
  Seed: KRKVVEFLAM (MAGC1_HUMAN)
KVKVVEFLAF

SEQ ID NO: 87684 - protein, 9 aa, Artificial Sequence
  Description of Artificial Sequence: Synthetic peptide
  Seed: AMLKNTVPI (MAGC1_HUMAN)
AILKNTVPF

SEQ ID NO: 87685 - protein, 9 aa, Artificial Sequence
  Description of Artificial Sequence: Synthetic peptide
  Seed: LQIPVSAAS (MAGC1_HUMAN)
LIIPVSAAV

SEQ ID NO: 87686 - protein, 10 aa, Artificial Sequence
  Description of Artificial Sequence: Synthetic peptide
  Seed: LSGIGVRAGR (MAGC1_HUMAN)
LVGIGVRAGR

SEQ ID NO: 87687 - protein, 9 aa, Artificial Sequence
  Description of Artificial Sequence: Synthetic peptide
  Seed: SMSPLYFPQ (MAGC1_HUMAN)
STSPLYFPK

SEQ ID NO: 87688 - protein, 9 aa, Artificial Sequence
  Description of Artificial Sequence: Synthetic peptide
  Seed: ASSFFSSAL (MAGC1_HUMAN)
ASSFFSSAM

SEQ ID NO: 87689 - protein, 9 aa, Artificial Sequence
  Description of Artificial Sequence: Synthetic peptide
  Seed: SQSSPVSSF (MAGC1_HUMAN)
SRSSPVSSM

SEQ ID NO: 87690 - protein, 9 aa, Artificial Sequence
  Description of Artificial Sequence: Synthetic peptide
  Seed: ISRYTGYFP (MAGC1_HUMAN)
IMRYTGYFK

SEQ ID NO: 87691 - protein, 9 aa, Artificial Sequence
  Description of Artificial Sequence: Synthetic peptide
  Seed: VSSSFSYTL (MAGC1_HUMAN)
VYSSFSYTL

SEQ ID NO: 87692 - protein, 10 aa, Artificial Sequence
  Description of Artificial Sequence: Synthetic peptide
  Seed: DELARFLLLK (MAGC1_HUMAN)
DTLARFLLLK

SEQ ID NO: 87693 - protein, 10 aa, Artificial Sequence
  Description of Artificial Sequence: Synthetic peptide
  Seed: VSSSSSSSTL (MAGC1_HUMAN)
VISSSSSSTF

SEQ ID NO: 87694 - protein, 10 aa, Artificial Sequence
  Description of Artificial Sequence: Synthetic peptide
  Seed: SFSSTLLSIL (MAGC1_HUMAN)
SNSSTLLSIW

SEQ ID NO: 87695 - protein, 9 aa, Artificial Sequence
  Description of Artificial Sequence: Synthetic peptide
  Seed: ELARFLLLK (MAGC1_HUMAN)
EVARFLLLK

SEQ ID NO: 87696 - protein, 9 aa, Artificial Sequence
  Description of Artificial Sequence: Synthetic peptide
  Seed: SSPERTHST (MAGC1_HUMAN)
SYPERTHSL

SEQ ID NO: 87697 - protein, 9 aa, Artificial Sequence
  Description of Artificial Sequence: Synthetic peptide
  Seed: SLIESEPLF (MAGC1_HUMAN)
SYIESEPLW

SEQ ID NO: 87698 - protein, 9 aa, Artificial Sequence
  Description of Artificial Sequence: Synthetic peptide
  Seed: TLVSLFQSS (MAGC1_HUMAN)
TMVSLFQSV

SEQ ID NO: 87699 - protein, 10 aa, Artificial Sequence
  Description of Artificial Sequence: Synthetic peptide
  Seed: TLDEKVDELA (MAGC1_HUMAN)
TVDEKVDELF

SEQ ID NO: 87700 - protein, 10 aa, Artificial Sequence
  Description of Artificial Sequence: Synthetic peptide
  Seed: SPPEGPAQSP (MAGC1_HUMAN)
SPPEGPAQSM

SEQ ID NO: 87701 - protein, 10 aa, Artificial Sequence
  Description of Artificial Sequence: Synthetic peptide
  Seed: FPSSYKDALK (MAGC1_HUMAN)
FISSYKDALR

SEQ ID NO: 87702 - protein, 9 aa, Artificial Sequence
  Description of Artificial Sequence: Synthetic peptide
  Seed: RSFSSTLLS (MAGC1_HUMAN)
RFFSSTLLK

SEQ ID NO: 87703 - protein, 10 aa, Artificial Sequence
  Description of Artificial Sequence: Synthetic peptide
  Seed: QGEDSMSPLY (MAGC1_HUMAN)
QLEDSMSPLW

SEQ ID NO: 87704 - protein, 9 aa, Artificial Sequence
  Description of Artificial Sequence: Synthetic peptide
  Seed: VIKRKVVEF (MAGC1_HUMAN)
VAKRKVVEW

SEQ ID NO: 87705 - protein, 9 aa, Artificial Sequence
  Description of Artificial Sequence: Synthetic peptide
  Seed: NTHSPLQIV (MAGC1_HUMAN)
NSHSPLQIM

SEQ ID NO: 87706 - protein, 10 aa, Artificial Sequence
  Description of Artificial Sequence: Synthetic peptide
  Seed: MPTAGMPSLL (MAGC1_HUMAN)
MCTAGMPSLV

SEQ ID NO: 87707 - protein, 9 aa, Artificial Sequence
  Description of Artificial Sequence: Synthetic peptide
  Seed: TFEGFPQSL (MAGC1_HUMAN)
TFEGFPQSM

SEQ ID NO: 87708 - protein, 9 aa, Artificial Sequence
  Description of Artificial Sequence: Synthetic peptide
  Seed: RKAREFIEI (MAGC1_HUMAN)
RSAREFIEM

SEQ ID NO: 87709 - protein, 9 aa, Artificial Sequence
  Description of Artificial Sequence: Synthetic peptide
  Seed: LQIPVSSSS (MAGC1_HUMAN)
LYIPVSSSL

SEQ ID NO: 87710 - protein, 9 aa, Artificial Sequence
  Description of Artificial Sequence: Synthetic peptide
  Seed: GFPQSLLQI (MAGC1_HUMAN)
GVPQSLLQL

SEQ ID NO: 87711 - protein, 9 aa, Artificial Sequence
  Description of Artificial Sequence: Synthetic peptide
  Seed: SPLQSPVSS (MAGC1_HUMAN)
STLQSPVSY

SEQ ID NO: 87712 - protein, 11 aa, Artificial Sequence
  Description of Artificial Sequence: Synthetic peptide
  Seed: VSSSSSSSTLL (MAGC1_HUMAN)
VLSSSSSSTLW

SEQ ID NO: 87713 - protein, 9 aa, Artificial Sequence
  Description of Artificial Sequence: Synthetic peptide
  Seed: LQIPVSRSF (MAGC1_HUMAN)
LMIPVSRSY

SEQ ID NO: 87714 - protein, 11 aa, Artificial Sequence
  Description of Artificial Sequence: Synthetic peptide
  Seed: SSSSSTLLSLF (MAGC1_HUMAN)
SASSSTLLSLW

SEQ ID NO: 87715 - protein, 11 aa, Artificial Sequence
  Description of Artificial Sequence: Synthetic peptide
  Seed: REVDPDDSYVF (MAGC1_HUMAN)
RAVDPDDSYVL

SEQ ID NO: 87716 - protein, 10 aa, Artificial Sequence
  Description of Artificial Sequence: Synthetic peptide
  Seed: RAGREHFAFG (MAGC1_HUMAN)
RSGREHFAFI

SEQ ID NO: 87717 - protein, 9 aa, Artificial Sequence
  Description of Artificial Sequence: Synthetic peptide
  Seed: DVLSGIGVR (MAGC1_HUMAN)
DVLSGIGVK

SEQ ID NO: 87718 - protein, 9 aa, Artificial Sequence
  Description of Artificial Sequence: Synthetic peptide
  Seed: EMLTNVISR (MAGC1_HUMAN)
EQLTNVISR

SEQ ID NO: 87719 - protein, 9 aa, Artificial Sequence
  Description of Artificial Sequence: Synthetic peptide
  Seed: LSPLHFPQF (MAGC1_HUMAN)
LAPLHFPQY

SEQ ID NO: 87720 - protein, 11 aa, Artificial Sequence
  Description of Artificial Sequence: Synthetic peptide
  Seed: SPLQIPGSPSF (MAGC1_HUMAN)
SDLQIPGSPSM

SEQ ID NO: 87721 - protein, 9 aa, Artificial Sequence
  Description of Artificial Sequence: Synthetic peptide
  Seed: DSYVFVNTL (MAGC1_HUMAN)
DRYVFVNTI

SEQ ID NO: 87722 - protein, 9 aa, Artificial Sequence
  Description of Artificial Sequence: Synthetic peptide
  Seed: FSEESSSPV (MAGC1_HUMAN)
FAEESSSPF

SEQ ID NO: 87723 - protein, 11 aa, Artificial Sequence
  Description of Artificial Sequence: Synthetic peptide
  Seed: SPLQIPGSPSF (MAGC1_HUMAN)
SHLQIPGSPSF

SEQ ID NO: 87724 - protein, 10 aa, Artificial Sequence
  Description of Artificial Sequence: Synthetic peptide
  Seed: FAFGEPRELL (MAGC1_HUMAN)
FMFGEPRELM

SEQ ID NO: 87725 - protein, 9 aa, Artificial Sequence
  Description of Artificial Sequence: Synthetic peptide
  Seed: TSLSLPQSF (MAGC1_HUMAN)
TQLSLPQSI

SEQ ID NO: 87726 - protein, 10 aa, Artificial Sequence
  Description of Artificial Sequence: Synthetic peptide
  Seed: RAGREHFAFG (MAGC1_HUMAN)
RIGREHFAFI

SEQ ID NO: 87727 - protein, 9 aa, Artificial Sequence
  Description of Artificial Sequence: Synthetic peptide
  Seed: FSSALLSIF (MAGC1_HUMAN)
FTSALLSIF

SEQ ID NO: 87728 - protein, 10 aa, Artificial Sequence
  Description of Artificial Sequence: Synthetic peptide
  Seed: SSSSTLLSLF (MAGC1_HUMAN)
SHSSTLLSLW

SEQ ID NO: 87729 - protein, 10 aa, Artificial Sequence
  Description of Artificial Sequence: Synthetic peptide
  Seed: FFSSALLSIF (MAGC1_HUMAN)
FESSALLSIW

SEQ ID NO: 87730 - protein, 9 aa, Artificial Sequence
  Description of Artificial Sequence: Synthetic peptide
  Seed: SPLQIPMTS (MAGC1_HUMAN)
SVLQIPMTL

SEQ ID NO: 87731 - protein, 9 aa, Artificial Sequence
  Description of Artificial Sequence: Synthetic peptide
  Seed: SSSVMSPSF (MAGC1_HUMAN)
SLSVMSPSW

SEQ ID NO: 87732 - protein, 10 aa, Artificial Sequence
  Description of Artificial Sequence: Synthetic peptide
  Seed: SSSSTLLSLF (MAGC1_HUMAN)
SLSSTLLSLY

SEQ ID NO: 87733 - protein, 9 aa, Artificial Sequence
  Description of Artificial Sequence: Synthetic peptide
  Seed: MSQNRLLIL (MAGC1_HUMAN)
MTQNRLLII

SEQ ID NO: 87734 - protein, 10 aa, Artificial Sequence
  Description of Artificial Sequence: Synthetic peptide
  Seed: LQIPGSPSFS (MAGC1_HUMAN)
LQIPGSPSFR

SEQ ID NO: 87735 - protein, 9 aa, Artificial Sequence
  Description of Artificial Sequence: Synthetic peptide
  Seed: KVDELARFL (MAGC1_HUMAN)
KLDELARFM

SEQ ID NO: 87736 - protein, 9 aa, Artificial Sequence
  Description of Artificial Sequence: Synthetic peptide
  Seed: VSSFFSYTL (MAGC1_HUMAN)
VASFFSYTV

SEQ ID NO: 87737 - protein, 11 aa, Artificial Sequence
  Description of Artificial Sequence: Synthetic peptide
  Seed: SSTSLSLPQSF (MAGC1_HUMAN)
SNTSLSLPQSW

SEQ ID NO: 87738 - protein, 9 aa, Artificial Sequence
  Description of Artificial Sequence: Synthetic peptide
  Seed: RSFSSTLLS (MAGC1_HUMAN)
RTFSSTLLT

SEQ ID NO: 87739 - protein, 9 aa, Artificial Sequence
  Description of Artificial Sequence: Synthetic peptide
  Seed: SSSSSSSTL (MAGC1_HUMAN)
SVSSSSSTW

SEQ ID NO: 87740 - protein, 9 aa, Artificial Sequence
  Description of Artificial Sequence: Synthetic peptide
  Seed: FAFGEPREL (MAGC1_HUMAN)
FMFGEPREL

SEQ ID NO: 87741 - protein, 10 aa, Artificial Sequence
  Description of Artificial Sequence: Synthetic peptide
  Seed: FSSSTSLSPF (MAGC1_HUMAN)
FTSSTSLSPM

SEQ ID NO: 87742 - protein, 10 aa, Artificial Sequence
  Description of Artificial Sequence: Synthetic peptide
  Seed: SSPERTHSTF (MAGC1_HUMAN)
STPERTHSTM

SEQ ID NO: 87743 - protein, 9 aa, Artificial Sequence
  Description of Artificial Sequence: Synthetic peptide
  Seed: RTHSTFEGF (MAGC1_HUMAN)
RFHSTFEGL

SEQ ID NO: 87744 - protein, 10 aa, Artificial Sequence
  Description of Artificial Sequence: Synthetic peptide
  Seed: GVRAGREHFA (MAGC1_HUMAN)
GTRAGREHFK

SEQ ID NO: 87745 - protein, 10 aa, Artificial Sequence
  Description of Artificial Sequence: Synthetic peptide
  Seed: SSSSSTLLSL (MAGC1_HUMAN)
STSSSTLLSI

SEQ ID NO: 87746 - protein, 9 aa, Artificial Sequence
  Description of Artificial Sequence: Synthetic peptide
  Seed: LQIPGSPSF (MAGC1_HUMAN)
LYIPGSPSL

SEQ ID NO: 87747 - protein, 10 aa, Artificial Sequence
  Description of Artificial Sequence: Synthetic peptide
  Seed: STPSSLPQSF (MAGC1_HUMAN)
SGPSSLPQSL

SEQ ID NO: 87748 - protein, 9 aa, Artificial Sequence
  Description of Artificial Sequence: Synthetic peptide
  Seed: SPLQIVPSL (MAGC1_HUMAN)
SILQIVPSL

SEQ ID NO: 87749 - protein, 10 aa, Artificial Sequence
  Description of Artificial Sequence: Synthetic peptide
  Seed: LQIPVSRSFS (MAGC1_HUMAN)
LLIPVSRSFY

SEQ ID NO: 87750 - protein, 9 aa, Artificial Sequence
  Description of Artificial Sequence: Synthetic peptide
  Seed: SLFQSFSER (MAGC1_HUMAN)
SFFQSFSEK

SEQ ID NO: 87751 - protein, 10 aa, Artificial Sequence
  Description of Artificial Sequence: Synthetic peptide
  Seed: YTLLSLFQSS (MAGC1_HUMAN)
YILLSLFQSL

SEQ ID NO: 87752 - protein, 9 aa, Artificial Sequence
  Description of Artificial Sequence: Synthetic peptide
  Seed: LQNPASSFF (MAGC1_HUMAN)
LWNPASSFL

SEQ ID NO: 87753 - protein, 9 aa, Artificial Sequence
  Description of Artificial Sequence: Synthetic peptide
  Seed: CSSSTPSSL (MAGC1_HUMAN)
CVSSTPSSY

SEQ ID NO: 87754 - protein, 10 aa, Artificial Sequence
  Description of Artificial Sequence: Synthetic peptide
  Seed: KVVEFLAMLK (MAGC1_HUMAN)
KKVEFLAMLR

SEQ ID NO: 87755 - protein, 10 aa, Artificial Sequence
  Description of Artificial Sequence: Synthetic peptide
  Seed: LQIPVSPSFS (MAGC1_HUMAN)
LAIPVSPSFF

SEQ ID NO: 87756 - protein, 9 aa, Artificial Sequence
  Description of Artificial Sequence: Synthetic peptide
  Seed: SSFFSSALL (MAGC1_HUMAN)
SNFFSSALF

SEQ ID NO: 87757 - protein, 9 aa, Artificial Sequence
  Description of Artificial Sequence: Synthetic peptide
  Seed: DSYVFVNTL (MAGC1_HUMAN)
DIYVFVNTR

SEQ ID NO: 87758 - protein, 10 aa, Artificial Sequence
  Description of Artificial Sequence: Synthetic peptide
  Seed: MLKNTVPITF (MAGC1_HUMAN)
MLKNTVPITW

SEQ ID NO: 87759 - protein, 11 aa, Artificial Sequence
  Description of Artificial Sequence: Synthetic peptide
  Seed: AIIDTTDDSTA (MAGC1_HUMAN)
AVIDTTDDSTV

SEQ ID NO: 87760 - protein, 9 aa, Artificial Sequence
  Description of Artificial Sequence: Synthetic peptide
  Seed: TTDDSTATE (MAGC1_HUMAN)
TQDDSTATI

SEQ ID NO: 87761 - protein, 10 aa, Artificial Sequence
  Description of Artificial Sequence: Synthetic peptide
  Seed: AASSSTLVSI (MAGC1_HUMAN)
ATSSSTLVSI

SEQ ID NO: 87762 - protein, 9 aa, Artificial Sequence
  Description of Artificial Sequence: Synthetic peptide
  Seed: LSDEQGMSQ (MAGC1_HUMAN)
LNDEQGMSI

SEQ ID NO: 87763 - protein, 9 aa, Artificial Sequence
  Description of Artificial Sequence: Synthetic peptide
  Seed: SFSSTLVSL (MAGC1_HUMAN)
SGSSTLVSY

SEQ ID NO: 87764 - protein, 9 aa, Artificial Sequence
  Description of Artificial Sequence: Synthetic peptide
  Seed: YTLASLLQS (MAGC1_HUMAN)
YVLASLLQT

SEQ ID NO: 87765 - protein, 9 aa, Artificial Sequence
  Description of Artificial Sequence: Synthetic peptide
  Seed: RKVVEFLAM (MAGC1_HUMAN)
RIVVEFLAY

SEQ ID NO: 87766 - protein, 10 aa, Artificial Sequence
  Description of Artificial Sequence: Synthetic peptide
  Seed: NPASSFFSSA (MAGC1_HUMAN)
NVASSFFSSI

SEQ ID NO: 87767 - protein, 10 aa, Artificial Sequence
  Description of Artificial Sequence: Synthetic peptide
  Seed: FFSYTLASLL (MAGC1_HUMAN)
FWSYTLASLF

SEQ ID NO: 87768 - protein, 9 aa, Artificial Sequence
  Description of Artificial Sequence: Synthetic peptide
  Seed: SPLHSPQSP (MAGC1_HUMAN)
SPLHSPQSI

SEQ ID NO: 87769 - protein, 10 aa, Artificial Sequence
  Description of Artificial Sequence: Synthetic peptide
  Seed: LLQIPMTSSF (MAGC1_HUMAN)
LIQIPMTSSF

SEQ ID NO: 87770 - protein, 10 aa, Artificial Sequence
  Description of Artificial Sequence: Synthetic peptide
  Seed: VSSSSSSTLL (MAGC1_HUMAN)
VQSSSSSTLW

SEQ ID NO: 87771 - protein, 9 aa, Artificial Sequence
  Description of Artificial Sequence: Synthetic peptide
  Seed: SIIFIKGTY (MAGC1_HUMAN)
SLIFIKGTW

SEQ ID NO: 87772 - protein, 10 aa, Artificial Sequence
  Description of Artificial Sequence: Synthetic peptide
  Seed: FPQSLLQIPM (MAGC1_HUMAN)
FQQSLLQIPF

SEQ ID NO: 87773 - protein, 10 aa, Artificial Sequence
  Description of Artificial Sequence: Synthetic peptide
  Seed: SRYTGYFPVI (MAGC1_HUMAN)
SIYTGYFPVL

SEQ ID NO: 87774 - protein, 9 aa, Artificial Sequence
  Description of Artificial Sequence: Synthetic peptide
  Seed: LLSLFQSFS (MAGC1_HUMAN)
LQSLFQSFV

SEQ ID NO: 87775 - protein, 9 aa, Artificial Sequence
  Description of Artificial Sequence: Synthetic peptide
  Seed: STQSPFEGF (MAGC1_HUMAN)
SYQSPFEGL

SEQ ID NO: 87776 - protein, 10 aa, Artificial Sequence
  Description of Artificial Sequence: Synthetic peptide
  Seed: MPTAGMPSLL (MAGC1_HUMAN)
MTTAGMPSLF

SEQ ID NO: 87777 - protein, 10 aa, Artificial Sequence
  Description of Artificial Sequence: Synthetic peptide
  Seed: LAMLKNTVPI (MAGC1_HUMAN)
LYMLKNTVPL

SEQ ID NO: 87778 - protein, 10 aa, Artificial Sequence
  Description of Artificial Sequence: Synthetic peptide
  Seed: MPTAGMPSLL (MAGC1_HUMAN)
METAGMPSLV

SEQ ID NO: 87779 - protein, 11 aa, Artificial Sequence
  Description of Artificial Sequence: Synthetic peptide
  Seed: SPLQIPVSPSS (MAGC1_HUMAN)
SNLQIPVSPSF

SEQ ID NO: 87780 - protein, 9 aa, Artificial Sequence
  Description of Artificial Sequence: Synthetic peptide
  Seed: ALLSIFQSS (MAGC1_HUMAN)
AALSIFQSV

SEQ ID NO: 87781 - protein, 9 aa, Artificial Sequence
  Description of Artificial Sequence: Synthetic peptide
  Seed: RSFSSTLLS (MAGC1_HUMAN)
RVFSSTLLS

SEQ ID NO: 87782 - protein, 9 aa, Artificial Sequence
  Description of Artificial Sequence: Synthetic peptide
  Seed: VSRSFSSTL (MAGC1_HUMAN)
VTRSFSSTR

SEQ ID NO: 87783 - protein, 9 aa, Artificial Sequence
  Description of Artificial Sequence: Synthetic peptide
  Seed: VSRSFSSTL (MAGC1_HUMAN)
VPRSFSSTA

SEQ ID NO: 87784 - protein, 10 aa, Artificial Sequence
  Description of Artificial Sequence: Synthetic peptide
  Seed: FAQSSLQIPV (MAGC1_HUMAN)
FSQSSLQIPM

SEQ ID NO: 87785 - protein, 9 aa, Artificial Sequence
  Description of Artificial Sequence: Synthetic peptide
  Seed: MSQNRLLIL (MAGC1_HUMAN)
MQQNRLLIF

SEQ ID NO: 87786 - protein, 9 aa, Artificial Sequence
  Description of Artificial Sequence: Synthetic peptide
  Seed: QVKQPITKA (MAGC1_HUMAN)
QTKQPITKK

SEQ ID NO: 87787 - protein, 10 aa, Artificial Sequence
  Description of Artificial Sequence: Synthetic peptide
  Seed: AASSSTLVSI (MAGC1_HUMAN)
AASSSTLVSW

SEQ ID NO: 87788 - protein, 10 aa, Artificial Sequence
  Description of Artificial Sequence: Synthetic peptide
  Seed: YTLLSLFQSS (MAGC1_HUMAN)
YMLLSLFQSV

SEQ ID NO: 87789 - protein, 9 aa, Artificial Sequence
  Description of Artificial Sequence: Synthetic peptide
  Seed: SAPEGEDSL (MAGC1_HUMAN)
SAPEGEDSV

SEQ ID NO: 87790 - protein, 11 aa, Artificial Sequence
  Description of Artificial Sequence: Synthetic peptide
  Seed: SPLQIPMTSSF (MAGC1_HUMAN)
SYLQIPMTSSM

SEQ ID NO: 87791 - protein, 10 aa, Artificial Sequence
  Description of Artificial Sequence: Synthetic peptide
  Seed: RPVSSFFSYT (MAGC1_HUMAN)
RPVSSFFSYM

SEQ ID NO: 87792 - protein, 9 aa, Artificial Sequence
  Description of Artificial Sequence: Synthetic peptide
  Seed: YQVKQPITK (MAGC1_HUMAN)
YHVKQPITY

SEQ ID NO: 87793 - protein, 9 aa, Artificial Sequence
  Description of Artificial Sequence: Synthetic peptide
  Seed: SEVIKRKVV (MAGC1_HUMAN)
SEVIKRKVI

SEQ ID NO: 87794 - protein, 9 aa, Artificial Sequence
  Description of Artificial Sequence: Synthetic peptide
  Seed: VSRSFSSTL (MAGC1_HUMAN)
VVRSFSSTA

SEQ ID NO: 87795 - protein, 10 aa, Artificial Sequence
  Description of Artificial Sequence: Synthetic peptide
  Seed: YTLASLLQSS (MAGC1_HUMAN)
YGLASLLQSI

SEQ ID NO: 87796 - protein, 10 aa, Artificial Sequence
  Description of Artificial Sequence: Synthetic peptide
  Seed: ASSFFSSALL (MAGC1_HUMAN)
AYSFFSSALF

SEQ ID NO: 87797 - protein, 9 aa, Artificial Sequence
  Description of Artificial Sequence: Synthetic peptide
  Seed: IPVSSSSSS (MAGC1_HUMAN)
IPVSSSSSL

SEQ ID NO: 87798 - protein, 11 aa, Artificial Sequence
  Description of Artificial Sequence: Synthetic peptide
  Seed: REVPNSSPPRY (MAGC1_HUMAN)
RMVPNSSPPRY

SEQ ID NO: 87799 - protein, 10 aa, Artificial Sequence
  Description of Artificial Sequence: Synthetic peptide
  Seed: KAREFIEILF (MAGC1_HUMAN)
KFREFIEILA

SEQ ID NO: 87800 - protein, 9 aa, Artificial Sequence
  Description of Artificial Sequence: Synthetic peptide
  Seed: STFEGFAQS (MAGC1_HUMAN)
SIFEGFAQM

SEQ ID NO: 87801 - protein, 10 aa, Artificial Sequence
  Description of Artificial Sequence: Synthetic peptide
  Seed: EVIWDVLSGI (MAGC1_HUMAN)
EFIWDVLSGV

SEQ ID NO: 87802 - protein, 11 aa, Artificial Sequence
  Description of Artificial Sequence: Synthetic peptide
  Seed: RKVVEFLAMLK (MAGC1_HUMAN)
RMVVEFLAMLK

SEQ ID NO: 87803 - protein, 9 aa, Artificial Sequence
  Description of Artificial Sequence: Synthetic peptide
  Seed: YQVKQPITK (MAGC1_HUMAN)
YLVKQPITY

SEQ ID NO: 87804 - protein, 9 aa, Artificial Sequence
  Description of Artificial Sequence: Synthetic peptide
  Seed: SPLQIPMTS (MAGC1_HUMAN)
SLLQIPMTM

SEQ ID NO: 87805 - protein, 10 aa, Artificial Sequence
  Description of Artificial Sequence: Synthetic peptide
  Seed: EVIWDVLSGI (MAGC1_HUMAN)
EAIWDVLSGK

SEQ ID NO: 87806 - protein, 10 aa, Artificial Sequence
  Description of Artificial Sequence: Synthetic peptide
  Seed: FQSSLQSPVS (MAGC1_HUMAN)
FLSSLQSPVC

SEQ ID NO: 87807 - protein, 10 aa, Artificial Sequence
  Description of Artificial Sequence: Synthetic peptide
  Seed: QEHYLEYREV (MAGC1_HUMAN)
QEHYLEYREW

SEQ ID NO: 87808 - protein, 10 aa, Artificial Sequence
  Description of Artificial Sequence: Synthetic peptide
  Seed: SSPESAQSTF (MAGC1_HUMAN)
SSPESAQSTM

SEQ ID NO: 87809 - protein, 9 aa, Artificial Sequence
  Description of Artificial Sequence: Synthetic peptide
  Seed: QPITKAEML (MAGC1_HUMAN)
QPITKAEMY

SEQ ID NO: 87810 - protein, 9 aa, Artificial Sequence
  Description of Artificial Sequence: Synthetic peptide
  Seed: YTLLSLFQS (MAGC1_HUMAN)
YQLLSLFQV

SEQ ID NO: 87811 - protein, 11 aa, Artificial Sequence
  Description of Artificial Sequence: Synthetic peptide
  Seed: KVWVQEHYLEY (MAGC1_HUMAN)
KTWVQEHYLEY

SEQ ID NO: 87812 - protein, 9 aa, Artificial Sequence
  Description of Artificial Sequence: Synthetic peptide
  Seed: FSSALLSIF (MAGC1_HUMAN)
FRSALLSIY

SEQ ID NO: 87813 - protein, 10 aa, Artificial Sequence
  Description of Artificial Sequence: Synthetic peptide
  Seed: FFSYTLASLL (MAGC1_HUMAN)
FESYTLASLF

SEQ ID NO: 87814 - protein, 9 aa, Artificial Sequence
  Description of Artificial Sequence: Synthetic peptide
  Seed: NTVPITFPS (MAGC1_HUMAN)
NMVPITFPL

SEQ ID NO: 87815 - protein, 9 aa, Artificial Sequence
  Description of Artificial Sequence: Synthetic peptide
  Seed: SLFQSFSER (MAGC1_HUMAN)
STFQSFSEF

SEQ ID NO: 87816 - protein, 10 aa, Artificial Sequence
  Description of Artificial Sequence: Synthetic peptide
  Seed: ICSSSTPSSL (MAGC1_HUMAN)
IISSSTPSSL

SEQ ID NO: 87817 - protein, 10 aa, Artificial Sequence
  Description of Artificial Sequence: Synthetic peptide
  Seed: STPSSLPQSF (MAGC1_HUMAN)
SLPSSLPQSL

SEQ ID NO: 87818 - protein, 9 aa, Artificial Sequence
  Description of Artificial Sequence: Synthetic peptide
  Seed: FTYTLDEKV (MAGC1_HUMAN)
FSYTLDEKY

SEQ ID NO: 87819 - protein, 10 aa, Artificial Sequence
  Description of Artificial Sequence: Synthetic peptide
  Seed: VISFSSSTSL (MAGC1_HUMAN)
VDSFSSSTSY

SEQ ID NO: 87820 - protein, 9 aa, Artificial Sequence
  Description of Artificial Sequence: Synthetic peptide
  Seed: IESEPLFTY (MAGC1_HUMAN)
IPSEPLFTF

SEQ ID NO: 87821 - protein, 10 aa, Artificial Sequence
  Description of Artificial Sequence: Synthetic peptide
  Seed: ICSSSTPSSL (MAGC1_HUMAN)
IKSSSTPSSW

SEQ ID NO: 87822 - protein, 11 aa, Artificial Sequence
  Description of Artificial Sequence: Synthetic peptide
  Seed: SFFSYTLASLL (MAGC1_HUMAN)
SPFSYTLASLF

SEQ ID NO: 87823 - protein, 10 aa, Artificial Sequence
  Description of Artificial Sequence: Synthetic peptide
  Seed: MSQNRLLILI (MAGC1_HUMAN)
MGQNRLLILW

SEQ ID NO: 87824 - protein, 10 aa, Artificial Sequence
  Description of Artificial Sequence: Synthetic peptide
  Seed: FFSYTLASLL (MAGC1_HUMAN)
FMSYTLASLL

SEQ ID NO: 87825 - protein, 9 aa, Artificial Sequence
  Description of Artificial Sequence: Synthetic peptide
  Seed: SVLQIPVSA (MAGC1_HUMAN)
SVLQIPVSR

SEQ ID NO: 87826 - protein, 9 aa, Artificial Sequence
  Description of Artificial Sequence: Synthetic peptide
  Seed: IPVSSSFSY (MAGC1_HUMAN)
IIVSSSFSM

SEQ ID NO: 87827 - protein, 10 aa, Artificial Sequence
  Description of Artificial Sequence: Synthetic peptide
  Seed: RTHSTFEGFP (MAGC1_HUMAN)
RTHSTFEGFM

SEQ ID NO: 87828 - protein, 10 aa, Artificial Sequence
  Description of Artificial Sequence: Synthetic peptide
  Seed: SPLQIPVSSS (MAGC1_HUMAN)
SPLQIPVSSL

SEQ ID NO: 87829 - protein, 11 aa, Artificial Sequence
  Description of Artificial Sequence: Synthetic peptide
  Seed: SPLQIPVSSSS (MAGC1_HUMAN)
STLQIPVSSSY

SEQ ID NO: 87830 - protein, 9 aa, Artificial Sequence
  Description of Artificial Sequence: Synthetic peptide
  Seed: LQIPGSPSF (MAGC1_HUMAN)
LAIPGSPSL

SEQ ID NO: 87831 - protein, 10 aa, Artificial Sequence
  Description of Artificial Sequence: Synthetic peptide
  Seed: YTLDEKVDEL (MAGC1_HUMAN)
YRLDEKVDEF

SEQ ID NO: 87832 - protein, 9 aa, Artificial Sequence
  Description of Artificial Sequence: Synthetic peptide
  Seed: IPVSPSFSS (MAGC1_HUMAN)
IPVSPSFSA

SEQ ID NO: 87833 - protein, 9 aa, Artificial Sequence
  Description of Artificial Sequence: Synthetic peptide
  Seed: RSFSSTLLS (MAGC1_HUMAN)
RGFSSTLLK

SEQ ID NO: 87834 - protein, 9 aa, Artificial Sequence
  Description of Artificial Sequence: Synthetic peptide
  Seed: ISFSSSTSL (MAGC1_HUMAN)
ISFSSSTSV

SEQ ID NO: 87835 - protein, 9 aa, Artificial Sequence
  Description of Artificial Sequence: Synthetic peptide
  Seed: HFPQSPPEW (MAGC1_HUMAN)
HYPQSPPEW

SEQ ID NO: 87836 - protein, 10 aa, Artificial Sequence
  Description of Artificial Sequence: Synthetic peptide
  Seed: IIDTTDDSTA (MAGC1_HUMAN)
IMDTTDDSTL

SEQ ID NO: 87837 - protein, 11 aa, Artificial Sequence
  Description of Artificial Sequence: Synthetic peptide
  Seed: SSFPSSTSSSL (MAGC1_HUMAN)
SEFPSSTSSSF

SEQ ID NO: 87838 - protein, 9 aa, Artificial Sequence
  Description of Artificial Sequence: Synthetic peptide
  Seed: ASSFFSSAL (MAGC1_HUMAN)
ATSFFSSAW

SEQ ID NO: 87839 - protein, 10 aa, Artificial Sequence
  Description of Artificial Sequence: Synthetic peptide
  Seed: RKVVEFLAML (MAGC1_HUMAN)
RWVVEFLAML

SEQ ID NO: 87840 - protein, 10 aa, Artificial Sequence
  Description of Artificial Sequence: Synthetic peptide
  Seed: EGPAQSPLQR (MAGC1_HUMAN)
ELPAQSPLQR

SEQ ID NO: 87841 - protein, 9 aa, Artificial Sequence
  Description of Artificial Sequence: Synthetic peptide
  Seed: VSPSSSSTL (MAGC1_HUMAN)
VYPSSSSTI

SEQ ID NO: 87842 - protein, 10 aa, Artificial Sequence
  Description of Artificial Sequence: Synthetic peptide
  Seed: KVVEFLAMLK (MAGC1_HUMAN)
KMVEFLAMLI

SEQ ID NO: 87843 - protein, 9 aa, Artificial Sequence
  Description of Artificial Sequence: Synthetic peptide
  Seed: LARFLLLKY (MAGC1_HUMAN)
LPRFLLLKY

SEQ ID NO: 87844 - protein, 9 aa, Artificial Sequence
  Description of Artificial Sequence: Synthetic peptide
  Seed: SQSSPVSSF (MAGC1_HUMAN)
SLSSPVSSM

SEQ ID NO: 87845 - protein, 9 aa, Artificial Sequence
  Description of Artificial Sequence: Synthetic peptide
  Seed: SAASSSTLV (MAGC1_HUMAN)
SVASSSTLY

SEQ ID NO: 87846 - protein, 11 aa, Artificial Sequence
  Description of Artificial Sequence: Synthetic peptide
  Seed: LQRPVSSFFSY (MAGC1_HUMAN)
LQRPVSSFFSM

SEQ ID NO: 87847 - protein, 9 aa, Artificial Sequence
  Description of Artificial Sequence: Synthetic peptide
  Seed: SSPESPLQS (MAGC1_HUMAN)
SAPESPLQA

SEQ ID NO: 87848 - protein, 9 aa, Artificial Sequence
  Description of Artificial Sequence: Synthetic peptide
  Seed: VSSSSSSTL (MAGC1_HUMAN)
VSSSSSSTI

SEQ ID NO: 87849 - protein, 9 aa, Artificial Sequence
  Description of Artificial Sequence: Synthetic peptide
  Seed: IESEPLFTY (MAGC1_HUMAN)
IASEPLFTF

SEQ ID NO: 87850 - protein, 10 aa, Artificial Sequence
  Description of Artificial Sequence: Synthetic peptide
  Seed: REVPNSSPPR (MAGC1_HUMAN)
RIVPNSSPPR

SEQ ID NO: 87851 - protein, 11 aa, Artificial Sequence
  Description of Artificial Sequence: Synthetic peptide
  Seed: TTDDSTATESA (MAGC1_HUMAN)
TTDDSTATESF

SEQ ID NO: 87852 - protein, 10 aa, Artificial Sequence
  Description of Artificial Sequence: Synthetic peptide
  Seed: EILFGISLRE (MAGC1_HUMAN)
EILFGISLRR

SEQ ID NO: 87853 - protein, 9 aa, Artificial Sequence
  Description of Artificial Sequence: Synthetic peptide
  Seed: REVDPDDSY (MAGC1_HUMAN)
RLVDPDDSV

SEQ ID NO: 87854 - protein, 9 aa, Artificial Sequence
  Description of Artificial Sequence: Synthetic peptide
  Seed: VIWDVLSGI (MAGC1_HUMAN)
VFWDVLSGV

SEQ ID NO: 87855 - protein, 11 aa, Artificial Sequence
  Description of Artificial Sequence: Synthetic peptide
  Seed: RSFSSTLLSIF (MAGC1_HUMAN)
RTFSSTLLSII

SEQ ID NO: 87856 - protein, 9 aa, Artificial Sequence
  Description of Artificial Sequence: Synthetic peptide
  Seed: ATESASSSV (MAGC1_HUMAN)
AAESASSSL

SEQ ID NO: 87857 - protein, 9 aa, Artificial Sequence
  Description of Artificial Sequence: Synthetic peptide
  Seed: KVVEFLAML (MAGC1_HUMAN)
KMVEFLAMR

SEQ ID NO: 87858 - protein, 9 aa, Artificial Sequence
  Description of Artificial Sequence: Synthetic peptide
  Seed: FSSTLLSLF (MAGC1_HUMAN)
FISTLLSLV

SEQ ID NO: 87859 - protein, 9 aa, Artificial Sequence
  Description of Artificial Sequence: Synthetic peptide
  Seed: VSSSFSYTL (MAGC1_HUMAN)
VNSSFSYTY

SEQ ID NO: 87860 - protein, 9 aa, Artificial Sequence
  Description of Artificial Sequence: Synthetic peptide
  Seed: RKVVEFLAM (MAGC1_HUMAN)
RQVVEFLAF

SEQ ID NO: 87861 - protein, 9 aa, Artificial Sequence
  Description of Artificial Sequence: Synthetic peptide
  Seed: IPVSSSFSY (MAGC1_HUMAN)
ILVSSSFSY

SEQ ID NO: 87862 - protein, 9 aa, Artificial Sequence
  Description of Artificial Sequence: Synthetic peptide
  Seed: SLIESEPLF (MAGC1_HUMAN)
SQIESEPLW

SEQ ID NO: 87863 - protein, 9 aa, Artificial Sequence
  Description of Artificial Sequence: Synthetic peptide
  Seed: FSSTLLSLF (MAGC1_HUMAN)
FQSTLLSLY

SEQ ID NO: 87864 - protein, 9 aa, Artificial Sequence
  Description of Artificial Sequence: Synthetic peptide
  Seed: VSSSFSYTL (MAGC1_HUMAN)
VTSSFSYTA

SEQ ID NO: 87865 - protein, 9 aa, Artificial Sequence
  Description of Artificial Sequence: Synthetic peptide
  Seed: IEILFGISL (MAGC1_HUMAN)
IHILFGISL

SEQ ID NO: 87866 - protein, 10 aa, Artificial Sequence
  Description of Artificial Sequence: Synthetic peptide
  Seed: KAREFIEILF (MAGC1_HUMAN)
KTREFIEILS

SEQ ID NO: 87867 - protein, 11 aa, Artificial Sequence
  Description of Artificial Sequence: Synthetic peptide
  Seed: SFFSYTLASLL (MAGC1_HUMAN)
SRFSYTLASLY

SEQ ID NO: 87868 - protein, 9 aa, Artificial Sequence
  Description of Artificial Sequence: Synthetic peptide
  Seed: RKVVEFLAM (MAGC1_HUMAN)
RAVVEFLAM

SEQ ID NO: 87869 - protein, 9 aa, Artificial Sequence
  Description of Artificial Sequence: Synthetic peptide
  Seed: IPVSSSFSY (MAGC1_HUMAN)
IHVSSSFSM

SEQ ID NO: 87870 - protein, 11 aa, Artificial Sequence
  Description of Artificial Sequence: Synthetic peptide
  Seed: SLFQSSPERTH (MAGC1_HUMAN)
SSFQSSPERTY

SEQ ID NO: 87871 - protein, 9 aa, Artificial Sequence
  Description of Artificial Sequence: Synthetic peptide
  Seed: TESASSSVM (MAGC1_HUMAN)
TASASSSVY

SEQ ID NO: 87872 - protein, 10 aa, Artificial Sequence
  Description of Artificial Sequence: Synthetic peptide
  Seed: LQIPGSPSFS (MAGC1_HUMAN)
LQIPGSPSFL

SEQ ID NO: 87873 - protein, 9 aa, Artificial Sequence
  Description of Artificial Sequence: Synthetic peptide
  Seed: TLDLTSEGC (MAGC1_HUMAN)
TADLTSEGF

SEQ ID NO: 87874 - protein, 10 aa, Artificial Sequence
  Description of Artificial Sequence: Synthetic peptide
  Seed: FFSYTLASLL (MAGC1_HUMAN)
FKSYTLASLM

SEQ ID NO: 87875 - protein, 9 aa, Artificial Sequence
  Description of Artificial Sequence: Synthetic peptide
  Seed: RLLILILSI (MAGC1_HUMAN)
RMLILILSM

SEQ ID NO: 87876 - protein, 9 aa, Artificial Sequence
  Description of Artificial Sequence: Synthetic peptide
  Seed: SSSTSLSPF (MAGC1_HUMAN)
SWSTSLSPL

SEQ ID NO: 87877 - protein, 9 aa, Artificial Sequence
  Description of Artificial Sequence: Synthetic peptide
  Seed: SSSDTLLES (MAGC1_HUMAN)
SQSDTLLEF

SEQ ID NO: 87878 - protein, 9 aa, Artificial Sequence
  Description of Artificial Sequence: Synthetic peptide
  Seed: SPLEISQSP (MAGC1_HUMAN)
SPLEISQSS

SEQ ID NO: 87879 - protein, 9 aa, Artificial Sequence
  Description of Artificial Sequence: Synthetic peptide
  Seed: FAFGEPREL (MAGC1_HUMAN)
FAFGEPREY

SEQ ID NO: 87880 - protein, 9 aa, Artificial Sequence
  Description of Artificial Sequence: Synthetic peptide
  Seed: FFSSALLSI (MAGC1_HUMAN)
FASSALLSI

SEQ ID NO: 87881 - protein, 10 aa, Artificial Sequence
  Description of Artificial Sequence: Synthetic peptide
  Seed: VSSSSSSTLL (MAGC1_HUMAN)
VDSSSSSTLF

SEQ ID NO: 87882 - protein, 9 aa, Artificial Sequence
  Description of Artificial Sequence: Synthetic peptide
  Seed: VIWDVLSGI (MAGC1_HUMAN)
VMWDVLSGI

SEQ ID NO: 87883 - protein, 10 aa, Artificial Sequence
  Description of Artificial Sequence: Synthetic peptide
  Seed: LLQIPMTSSF (MAGC1_HUMAN)
LHQIPMTSSM

SEQ ID NO: 87884 - protein, 10 aa, Artificial Sequence
  Description of Artificial Sequence: Synthetic peptide
  Seed: TTDDSTATES (MAGC1_HUMAN)
TFDDSTATEF

SEQ ID NO: 87885 - protein, 9 aa, Artificial Sequence
  Description of Artificial Sequence: Synthetic peptide
  Seed: SSSVMSPSF (MAGC1_HUMAN)
SQSVMSPSI

SEQ ID NO: 87886 - protein, 10 aa, Artificial Sequence
  Description of Artificial Sequence: Synthetic peptide
  Seed: RKVVEFLAML (MAGC1_HUMAN)
RRVVEFLAML

SEQ ID NO: 87887 - protein, 10 aa, Artificial Sequence
  Description of Artificial Sequence: Synthetic peptide
  Seed: FSSSTSLSPF (MAGC1_HUMAN)
FDSSTSLSPY

SEQ ID NO: 87888 - protein, 9 aa, Artificial Sequence
  Description of Artificial Sequence: Synthetic peptide
  Seed: RTHSTFEGF (MAGC1_HUMAN)
RQHSTFEGL

SEQ ID NO: 87889 - protein, 11 aa, Artificial Sequence
  Description of Artificial Sequence: Synthetic peptide
  Seed: VPNSSPPRYEF (MAGC1_HUMAN)
VPNSSPPRYEA

SEQ ID NO: 87890 - protein, 10 aa, Artificial Sequence
  Description of Artificial Sequence: Synthetic peptide
  Seed: EMLTNVISRY (MAGC1_HUMAN)
ESLTNVISRK

SEQ ID NO: 87891 - protein, 10 aa, Artificial Sequence
  Description of Artificial Sequence: Synthetic peptide
  Seed: ILFGISLREV (MAGC1_HUMAN)
IMFGISLREA

SEQ ID NO: 87892 - protein, 9 aa, Artificial Sequence
  Description of Artificial Sequence: Synthetic peptide
  Seed: LQIPVSPSF (MAGC1_HUMAN)
LDIPVSPSL

SEQ ID NO: 87893 - protein, 9 aa, Artificial Sequence
  Description of Artificial Sequence: Synthetic peptide
  Seed: SQSSPVSSF (MAGC1_HUMAN)
STSSPVSSI

SEQ ID NO: 87894 - protein, 10 aa, Artificial Sequence
  Description of Artificial Sequence: Synthetic peptide
  Seed: ICSSSTSLSL (MAGC1_HUMAN)
IESSSTSLSF

SEQ ID NO: 87895 - protein, 10 aa, Artificial Sequence
  Description of Artificial Sequence: Synthetic peptide
  Seed: ESAQSTFEGF (MAGC1_HUMAN)
EVAQSTFEGK

SEQ ID NO: 87896 - protein, 10 aa, Artificial Sequence
  Description of Artificial Sequence: Synthetic peptide
  Seed: SLSPLHFPQF (MAGC1_HUMAN)
SQSPLHFPQF

SEQ ID NO: 87897 - protein, 9 aa, Artificial Sequence
  Description of Artificial Sequence: Synthetic peptide
  Seed: RAGREHFAF (MAGC1_HUMAN)
RIGREHFAW

SEQ ID NO: 87898 - protein, 9 aa, Artificial Sequence
  Description of Artificial Sequence: Synthetic peptide
  Seed: TLDEKVDEL (MAGC1_HUMAN)
TCDEKVDEL

SEQ ID NO: 87899 - protein, 9 aa, Artificial Sequence
  Description of Artificial Sequence: Synthetic peptide
  Seed: HFPQSPPEW (MAGC1_HUMAN)
HFPQSPPEL

SEQ ID NO: 87900 - protein, 9 aa, Artificial Sequence
  Description of Artificial Sequence: Synthetic peptide
  Seed: VPITFPSSY (MAGC1_HUMAN)
VYITFPSSL

SEQ ID NO: 87901 - protein, 10 aa, Artificial Sequence
  Description of Artificial Sequence: Synthetic peptide
  Seed: FPQSPLQIPV (MAGC1_HUMAN)
FIQSPLQIPA

SEQ ID NO: 87902 - protein, 9 aa, Artificial Sequence
  Description of Artificial Sequence: Synthetic peptide
  Seed: LQIPGSPSF (MAGC1_HUMAN)
LCIPGSPSL

SEQ ID NO: 87903 - protein, 10 aa, Artificial Sequence
  Description of Artificial Sequence: Synthetic peptide
  Seed: RPVSSFFSYT (MAGC1_HUMAN)
RTVSSFFSYK

SEQ ID NO: 87904 - protein, 9 aa, Artificial Sequence
  Description of Artificial Sequence: Synthetic peptide
  Seed: SSSTSLSPF (MAGC1_HUMAN)
SRSTSLSPM

SEQ ID NO: 87905 - protein, 9 aa, Artificial Sequence
  Description of Artificial Sequence: Synthetic peptide
  Seed: SSPESTQSP (MAGC1_HUMAN)
SCPESTQSM

SEQ ID NO: 87906 - protein, 9 aa, Artificial Sequence
  Description of Artificial Sequence: Synthetic peptide
  Seed: SSFFSSALL (MAGC1_HUMAN)
SMFFSSALI

SEQ ID NO: 87907 - protein, 9 aa, Artificial Sequence
  Description of Artificial Sequence: Synthetic peptide
  Seed: IPMTSSFSS (MAGC1_HUMAN)
IAMTSSFSM

SEQ ID NO: 87908 - protein, 8 aa, Artificial Sequence
  Description of Artificial Sequence: Synthetic peptide
  Seed: FSYTLLSL (MAGC1_HUMAN)
FAYTLLSF

SEQ ID NO: 87909 - protein, 9 aa, Artificial Sequence
  Description of Artificial Sequence: Synthetic peptide
  Seed: SVLQIPVSA (MAGC1_HUMAN)
SPLQIPVST

SEQ ID NO: 87910 - protein, 9 aa, Artificial Sequence
  Description of Artificial Sequence: Synthetic peptide
  Seed: SSPERTQST (MAGC1_HUMAN)
SRPERTQSF

SEQ ID NO: 87911 - protein, 10 aa, Artificial Sequence
  Description of Artificial Sequence: Synthetic peptide
  Seed: ASSFFSSALL (MAGC1_HUMAN)
AISFFSSALW

SEQ ID NO: 87912 - protein, 10 aa, Artificial Sequence
  Description of Artificial Sequence: Synthetic peptide
  Seed: RYTGYFPVIF (MAGC1_HUMAN)
RQTGYFPVIF

SEQ ID NO: 87913 - protein, 9 aa, Artificial Sequence
  Description of Artificial Sequence: Synthetic peptide
  Seed: MGDKDMPTA (MAGC1_HUMAN)
MFDKDMPTI

SEQ ID NO: 87914 - protein, 9 aa, Artificial Sequence
  Description of Artificial Sequence: Synthetic peptide
  Seed: RTHSTFEGF (MAGC1_HUMAN)
RWHSTFEGM

SEQ ID NO: 87915 - protein, 9 aa, Artificial Sequence
  Description of Artificial Sequence: Synthetic peptide
  Seed: SSHESPQSP (MAGC1_HUMAN)
SAHESPQSL

SEQ ID NO: 87916 - protein, 10 aa, Artificial Sequence
  Description of Artificial Sequence: Synthetic peptide
  Seed: NPASSFFSSA (MAGC1_HUMAN)
NIASSFFSSI

SEQ ID NO: 87917 - protein, 10 aa, Artificial Sequence
  Description of Artificial Sequence: Synthetic peptide
  Seed: KAREFIEILF (MAGC1_HUMAN)
KVREFIEILY

SEQ ID NO: 87918 - protein, 9 aa, Artificial Sequence
  Description of Artificial Sequence: Synthetic peptide
  Seed: SLSPFSEES (MAGC1_HUMAN)
SVSPFSEEI

SEQ ID NO: 87919 - protein, 11 aa, Artificial Sequence
  Description of Artificial Sequence: Synthetic peptide
  Seed: IPVSPSSSSTL (MAGC1_HUMAN)
IVVSPSSSSTF

SEQ ID NO: 87920 - protein, 9 aa, Artificial Sequence
  Description of Artificial Sequence: Synthetic peptide
  Seed: KVDELARFL (MAGC1_HUMAN)
KWDELARFM

SEQ ID NO: 87921 - protein, 9 aa, Artificial Sequence
  Description of Artificial Sequence: Synthetic peptide
  Seed: LSDEQGMSQ (MAGC1_HUMAN)
LGDEQGMSF

SEQ ID NO: 87922 - protein, 9 aa, Artificial Sequence
  Description of Artificial Sequence: Synthetic peptide
  Seed: SLFQSFSER (MAGC1_HUMAN)
SIFQSFSEF

SEQ ID NO: 87923 - protein, 9 aa, Artificial Sequence
  Description of Artificial Sequence: Synthetic peptide
  Seed: QIVPSLPEW (MAGC1_HUMAN)
QPVPSLPEF

SEQ ID NO: 87924 - protein, 10 aa, Artificial Sequence
  Description of Artificial Sequence: Synthetic peptide
  Seed: SFSYTLLSLF (MAGC1_HUMAN)
SASYTLLSLW

SEQ ID NO: 87925 - protein, 10 aa, Artificial Sequence
  Description of Artificial Sequence: Synthetic peptide
  Seed: LSLFQSFSER (MAGC1_HUMAN)
LVLFQSFSEK

SEQ ID NO: 87926 - protein, 10 aa, Artificial Sequence
  Description of Artificial Sequence: Synthetic peptide
  Seed: FPQSPLQIPV (MAGC1_HUMAN)
FEQSPLQIPI

SEQ ID NO: 87927 - protein, 10 aa, Artificial Sequence
  Description of Artificial Sequence: Synthetic peptide
  Seed: RYTGYFPVIF (MAGC1_HUMAN)
RTTGYFPVIW

SEQ ID NO: 87928 - protein, 9 aa, Artificial Sequence
  Description of Artificial Sequence: Synthetic peptide
  Seed: LQIPMTSSF (MAGC1_HUMAN)
LFIPMTSSI

SEQ ID NO: 87929 - protein, 11 aa, Artificial Sequence
  Description of Artificial Sequence: Synthetic peptide
  Seed: ILFGISLREVD (MAGC1_HUMAN)
ILFGISLREVL

SEQ ID NO: 87930 - protein, 9 aa, Artificial Sequence
  Description of Artificial Sequence: Synthetic peptide
  Seed: TTDDSTATE (MAGC1_HUMAN)
TYDDSTATL

SEQ ID NO: 87931 - protein, 10 aa, Artificial Sequence
  Description of Artificial Sequence: Synthetic peptide
  Seed: RAGREHFAFG (MAGC1_HUMAN)
RSGREHFAFK

SEQ ID NO: 87932 - protein, 10 aa, Artificial Sequence
  Description of Artificial Sequence: Synthetic peptide
  Seed: ICSSSTSLSL (MAGC1_HUMAN)
IWSSSTSLSF

SEQ ID NO: 87933 - protein, 9 aa, Artificial Sequence
  Description of Artificial Sequence: Synthetic peptide
  Seed: SPLQNSQSS (MAGC1_HUMAN)
SPLQNSQSL

SEQ ID NO: 87934 - protein, 10 aa, Artificial Sequence
  Description of Artificial Sequence: Synthetic peptide
  Seed: SQSPPEGEDV (MAGC1_HUMAN)
SHSPPEGEDV

SEQ ID NO: 87935 - protein, 11 aa, Artificial Sequence
  Description of Artificial Sequence: Synthetic peptide
  Seed: RSFSSTLLSIF (MAGC1_HUMAN)
RYFSSTLLSIL

SEQ ID NO: 87936 - protein, 9 aa, Artificial Sequence
  Description of Artificial Sequence: Synthetic peptide
  Seed: FFSSALLSI (MAGC1_HUMAN)
FMSSALLST

SEQ ID NO: 87937 - protein, 9 aa, Artificial Sequence
  Description of Artificial Sequence: Synthetic peptide
  Seed: LQIPVSRSF (MAGC1_HUMAN)
LAIPVSRSW

SEQ ID NO: 87938 - protein, 9 aa, Artificial Sequence
  Description of Artificial Sequence: Synthetic peptide
  Seed: MSQNRLLIL (MAGC1_HUMAN)
MQQNRLLIV

SEQ ID NO: 87939 - protein, 10 aa, Artificial Sequence
  Description of Artificial Sequence: Synthetic peptide
  Seed: MTSSFSSTLL (MAGC1_HUMAN)
MDSSFSSTLL

SEQ ID NO: 87940 - protein, 9 aa, Artificial Sequence
  Description of Artificial Sequence: Synthetic peptide
  Seed: VPITFPSSY (MAGC1_HUMAN)
VAITFPSSW

SEQ ID NO: 87941 - protein, 9 aa, Artificial Sequence
  Description of Artificial Sequence: Synthetic peptide
  Seed: IIFIKGTYA (MAGC1_HUMAN)
ITFIKGTYK

SEQ ID NO: 87942 - protein, 10 aa, Artificial Sequence
  Description of Artificial Sequence: Synthetic peptide
  Seed: MSPLYFPQSP (MAGC1_HUMAN)
MTPLYFPQSA

SEQ ID NO: 87943 - protein, 10 aa, Artificial Sequence
  Description of Artificial Sequence: Synthetic peptide
  Seed: RSFSSTLLSI (MAGC1_HUMAN)
RFFSSTLLSL

SEQ ID NO: 87944 - protein, 9 aa, Artificial Sequence
  Description of Artificial Sequence: Synthetic peptide
  Seed: LQIPMTSSF (MAGC1_HUMAN)
LPIPMTSSM

SEQ ID NO: 87945 - protein, 9 aa, Artificial Sequence
  Description of Artificial Sequence: Synthetic peptide
  Seed: SAQSAFEGF (MAGC1_HUMAN)
SQQSAFEGW

SEQ ID NO: 87946 - protein, 9 aa, Artificial Sequence
  Description of Artificial Sequence: Synthetic peptide
  Seed: KAREFIEIL (MAGC1_HUMAN)
KWREFIEIY

SEQ ID NO: 87947 - protein, 9 aa, Artificial Sequence
  Description of Artificial Sequence: Synthetic peptide
  Seed: ISFSSSTSL (MAGC1_HUMAN)
IWFSSSTSF

SEQ ID NO: 87948 - protein, 11 aa, Artificial Sequence
  Description of Artificial Sequence: Synthetic peptide
  Seed: SQSPLQSPESA (MAGC1_HUMAN)
SESPLQSPESC

SEQ ID NO: 87949 - protein, 11 aa, Artificial Sequence
  Description of Artificial Sequence: Synthetic peptide
  Seed: TVPITFPSSYK (MAGC1_HUMAN)
TNPITFPSSYR

SEQ ID NO: 87950 - protein, 10 aa, Artificial Sequence
  Description of Artificial Sequence: Synthetic peptide
  Seed: IIDTTDDSTA (MAGC1_HUMAN)
IMDTTDDSTF

SEQ ID NO: 87951 - protein, 9 aa, Artificial Sequence
  Description of Artificial Sequence: Synthetic peptide
  Seed: MSQNRLLIL (MAGC1_HUMAN)
MPQNRLLIL

SEQ ID NO: 87952 - protein, 9 aa, Artificial Sequence
  Description of Artificial Sequence: Synthetic peptide
  Seed: RPVSSFFSY (MAGC1_HUMAN)
RPVSSFFSM

SEQ ID NO: 87953 - protein, 9 aa, Artificial Sequence
  Description of Artificial Sequence: Synthetic peptide
  Seed: GFPQSVLQI (MAGC1_HUMAN)
GVPQSVLQL

SEQ ID NO: 87954 - protein, 10 aa, Artificial Sequence
  Description of Artificial Sequence: Synthetic peptide
  Seed: KGTYASEEVI (MAGC1_HUMAN)
KMTYASEEVF

SEQ ID NO: 87955 - protein, 11 aa, Artificial Sequence
  Description of Artificial Sequence: Synthetic peptide
  Seed: SSFPSSTSSSL (MAGC1_HUMAN)
SLFPSSTSSSF

SEQ ID NO: 87956 - protein, 10 aa, Artificial Sequence
  Description of Artificial Sequence: Synthetic peptide
  Seed: LQRPVSSFFS (MAGC1_HUMAN)
LKRPVSSFFY

SEQ ID NO: 87957 - protein, 11 aa, Artificial Sequence
  Description of Artificial Sequence: Synthetic peptide
  Seed: PSFSSTLVSLF (MAGC1_HUMAN)
PTFSSTLVSLW

SEQ ID NO: 87958 - protein, 9 aa, Artificial Sequence
  Description of Artificial Sequence: Synthetic peptide
  Seed: VSAASSSTL (MAGC1_HUMAN)
VLAASSSTY

SEQ ID NO: 87959 - protein, 10 aa, Artificial Sequence
  Description of Artificial Sequence: Synthetic peptide
  Seed: SPLQSPVSSF (MAGC1_HUMAN)
SALQSPVSSL

SEQ ID NO: 87960 - protein, 9 aa, Artificial Sequence
  Description of Artificial Sequence: Synthetic peptide
  Seed: LQRPVSSFF (MAGC1_HUMAN)
LLRPVSSFK

SEQ ID NO: 87961 - protein, 9 aa, Artificial Sequence
  Description of Artificial Sequence: Synthetic peptide
  Seed: SICSSSTSL (MAGC1_HUMAN)
SQCSSSTSV

SEQ ID NO: 87962 - protein, 10 aa, Artificial Sequence
  Description of Artificial Sequence: Synthetic peptide
  Seed: WEDSLSPLHF (MAGC1_HUMAN)
WMDSLSPLHY

SEQ ID NO: 87963 - protein, 11 aa, Artificial Sequence
  Description of Artificial Sequence: Synthetic peptide
  Seed: TLYPLQSPQSR (MAGC1_HUMAN)
TMYPLQSPQSK

SEQ ID NO: 87964 - protein, 11 aa, Artificial Sequence
  Description of Artificial Sequence: Synthetic peptide
  Seed: SFFSYTLASLL (MAGC1_HUMAN)
SNFSYTLASLY

SEQ ID NO: 87965 - protein, 10 aa, Artificial Sequence
  Description of Artificial Sequence: Synthetic peptide
  Seed: FSSSTSLSPF (MAGC1_HUMAN)
FLSSTSLSPM

SEQ ID NO: 87966 - protein, 9 aa, Artificial Sequence
  Description of Artificial Sequence: Synthetic peptide
  Seed: WVQEHYLEY (MAGC1_HUMAN)
WLQEHYLEY

SEQ ID NO: 87967 - protein, 9 aa, Artificial Sequence
  Description of Artificial Sequence: Synthetic peptide
  Seed: SPPQGEDSL (MAGC1_HUMAN)
SMPQGEDSM

SEQ ID NO: 87968 - protein, 11 aa, Artificial Sequence
  Description of Artificial Sequence: Synthetic peptide
  Seed: TLDEKVDELAR (MAGC1_HUMAN)
TVDEKVDELAY

SEQ ID NO: 87969 - protein, 9 aa, Artificial Sequence
  Description of Artificial Sequence: Synthetic peptide
  Seed: VSPSFSSTL (MAGC1_HUMAN)
VTPSFSSTR

SEQ ID NO: 87970 - protein, 9 aa, Artificial Sequence
  Description of Artificial Sequence: Synthetic peptide
  Seed: SSSTLVSIF (MAGC1_HUMAN)
SISTLVSIF

SEQ ID NO: 87971 - protein, 10 aa, Artificial Sequence
  Description of Artificial Sequence: Synthetic peptide
  Seed: LLQIPMTSSF (MAGC1_HUMAN)
LYQIPMTSSL

SEQ ID NO: 87972 - protein, 11 aa, Artificial Sequence
  Description of Artificial Sequence: Synthetic peptide
  Seed: QSSPESAQSAF (MAGC1_HUMAN)
QASPESAQSAF

SEQ ID NO: 87973 - protein, 10 aa, Artificial Sequence
  Description of Artificial Sequence: Synthetic peptide
  Seed: EVIWDVLSGI (MAGC1_HUMAN)
ETIWDVLSGI

SEQ ID NO: 87974 - protein, 9 aa, Artificial Sequence
  Description of Artificial Sequence: Synthetic peptide
  Seed: FQSSLQSPV (MAGC1_HUMAN)
FGSSLQSPF

SEQ ID NO: 87975 - protein, 10 aa, Artificial Sequence
  Description of Artificial Sequence: Synthetic peptide
  Seed: SFSSTLVSLF (MAGC1_HUMAN)
SVSSTLVSLF

SEQ ID NO: 87976 - protein, 9 aa, Artificial Sequence
  Description of Artificial Sequence: Synthetic peptide
  Seed: IESEPLFTY (MAGC1_HUMAN)
ITSEPLFTL

SEQ ID NO: 87977 - protein, 9 aa, Artificial Sequence
  Description of Artificial Sequence: Synthetic peptide
  Seed: SPLQIVPSL (MAGC1_HUMAN)
SPLQIVPSY

SEQ ID NO: 87978 - protein, 9 aa, Artificial Sequence
  Description of Artificial Sequence: Synthetic peptide
  Seed: SSSVMSPSF (MAGC1_HUMAN)
SLSVMSPSL

SEQ ID NO: 87979 - protein, 10 aa, Artificial Sequence
  Description of Artificial Sequence: Synthetic peptide
  Seed: PLQIPGSPSF (MAGC1_HUMAN)
PGQIPGSPSY

SEQ ID NO: 87980 - protein, 9 aa, Artificial Sequence
  Description of Artificial Sequence: Synthetic peptide
  Seed: TLDEKVDEL (MAGC1_HUMAN)
TMDEKVDEC

SEQ ID NO: 87981 - protein, 9 aa, Artificial Sequence
  Description of Artificial Sequence: Synthetic peptide
  Seed: AMLKNTVPI (MAGC1_HUMAN)
AKLKNTVPY

SEQ ID NO: 87982 - protein, 10 aa, Artificial Sequence
  Description of Artificial Sequence: Synthetic peptide
  Seed: MLKNTVPITF (MAGC1_HUMAN)
MTKNTVPITF

SEQ ID NO: 87983 - protein, 11 aa, Artificial Sequence
  Description of Artificial Sequence: Synthetic peptide
  Seed: SPLQRPVSSFF (MAGC1_HUMAN)
SMLQRPVSSFF

SEQ ID NO: 87984 - protein, 9 aa, Artificial Sequence
  Description of Artificial Sequence: Synthetic peptide
  Seed: SAPEGEDSL (MAGC1_HUMAN)
SAPEGEDSF

SEQ ID NO: 87985 - protein, 9 aa, Artificial Sequence
  Description of Artificial Sequence: Synthetic peptide
  Seed: SSPESPLQS (MAGC1_HUMAN)
SLPESPLQM

SEQ ID NO: 87986 - protein, 10 aa, Artificial Sequence
  Description of Artificial Sequence: Synthetic peptide
  Seed: MPTAGMPSLL (MAGC1_HUMAN)
MFTAGMPSLV

SEQ ID NO: 87987 - protein, 9 aa, Artificial Sequence
  Description of Artificial Sequence: Synthetic peptide
  Seed: SSPEGKDSL (MAGC1_HUMAN)
SMPEGKDSF

SEQ ID NO: 87988 - protein, 10 aa, Artificial Sequence
  Description of Artificial Sequence: Synthetic peptide
  Seed: FFSYTLASLL (MAGC1_HUMAN)
FLSYTLASLS

SEQ ID NO: 87989 - protein, 9 aa, Artificial Sequence
  Description of Artificial Sequence: Synthetic peptide
  Seed: RTHSTFEGF (MAGC1_HUMAN)
RVHSTFEGV

SEQ ID NO: 87990 - protein, 9 aa, Artificial Sequence
  Description of Artificial Sequence: Synthetic peptide
  Seed: AQSPLQSPV (MAGC1_HUMAN)
ARSPLQSPL

SEQ ID NO: 87991 - protein, 10 aa, Artificial Sequence
  Description of Artificial Sequence: Synthetic peptide
  Seed: SFSERTQSTF (MAGC1_HUMAN)
SWSERTQSTF

SEQ ID NO: 87992 - protein, 8 aa, Artificial Sequence
  Description of Artificial Sequence: Synthetic peptide
  Seed: HYLEYREV (MAGC1_HUMAN)
HYLEYREM

SEQ ID NO: 87993 - protein, 11 aa, Artificial Sequence
  Description of Artificial Sequence: Synthetic peptide
  Seed: IPVSAASSSTL (MAGC1_HUMAN)
IGVSAASSSTY

SEQ ID NO: 87994 - protein, 11 aa, Artificial Sequence
  Description of Artificial Sequence: Synthetic peptide
  Seed: REVPNSSPPRY (MAGC1_HUMAN)
RAVPNSSPPRY

SEQ ID NO: 87995 - protein, 9 aa, Artificial Sequence
  Description of Artificial Sequence: Synthetic peptide
  Seed: CSSSTSLSL (MAGC1_HUMAN)
CASSTSLSW

SEQ ID NO: 87996 - protein, 10 aa, Artificial Sequence
  Description of Artificial Sequence: Synthetic peptide
  Seed: SFSERTQSTF (MAGC1_HUMAN)
SYSERTQSTM

SEQ ID NO: 87997 - protein, 9 aa, Artificial Sequence
  Description of Artificial Sequence: Synthetic peptide
  Seed: SAPEGEDSL (MAGC1_HUMAN)
SFPEGEDSF

SEQ ID NO: 87998 - protein, 10 aa, Artificial Sequence
  Description of Artificial Sequence: Synthetic peptide
  Seed: RSFSSTLLSI (MAGC1_HUMAN)
RTFSSTLLSM

SEQ ID NO: 87999 - protein, 9 aa, Artificial Sequence
  Description of Artificial Sequence: Synthetic peptide
  Seed: FSERTQSTF (MAGC1_HUMAN)
FIERTQSTF

SEQ ID NO: 88000 - protein, 11 aa, Artificial Sequence
  Description of Artificial Sequence: Synthetic peptide
  Seed: RSFSSTLLSIF (MAGC1_HUMAN)
RIFSSTLLSIF

SEQ ID NO: 88001 - protein, 10 aa, Artificial Sequence
  Description of Artificial Sequence: Synthetic peptide
  Seed: SLFQSSPECT (MAGC1_HUMAN)
SMFQSSPECV

SEQ ID NO: 88002 - protein, 9 aa, Artificial Sequence
  Description of Artificial Sequence: Synthetic peptide
  Seed: FEGFAQSSL (MAGC1_HUMAN)
FIGFAQSSY

SEQ ID NO: 88003 - protein, 10 aa, Artificial Sequence
  Description of Artificial Sequence: Synthetic peptide
  Seed: QGEDSMSPLY (MAGC1_HUMAN)
QAEDSMSPLY

SEQ ID NO: 88004 - protein, 9 aa, Artificial Sequence
  Description of Artificial Sequence: Synthetic peptide
  Seed: FFSSALLSI (MAGC1_HUMAN)
FVSSALLSY

SEQ ID NO: 88005 - protein, 10 aa, Artificial Sequence
  Description of Artificial Sequence: Synthetic peptide
  Seed: KAEMLTNVIS (MAGC1_HUMAN)
KFEMLTNVIA

SEQ ID NO: 88006 - protein, 9 aa, Artificial Sequence
  Description of Artificial Sequence: Synthetic peptide
  Seed: ASSFFSSAL (MAGC1_HUMAN)
AFSFFSSAY

SEQ ID NO: 88007 - protein, 9 aa, Artificial Sequence
  Description of Artificial Sequence: Synthetic peptide
  Seed: HESPQSPPE (MAGC1_HUMAN)
HESPQSPPF

SEQ ID NO: 88008 - protein, 11 aa, Artificial Sequence
  Description of Artificial Sequence: Synthetic peptide
  Seed: SPQSPPEGPAQ (MAGC1_HUMAN)
SPQSPPEGPAC

SEQ ID NO: 88009 - protein, 9 aa, Artificial Sequence
  Description of Artificial Sequence: Synthetic peptide
  Seed: ALKDVEERA (MAGC1_HUMAN)
AQKDVEERV

SEQ ID NO: 88010 - protein, 9 aa, Artificial Sequence
  Description of Artificial Sequence: Synthetic peptide
  Seed: SSLSQSSPV (MAGC1_HUMAN)
SMLSQSSPW

SEQ ID NO: 88011 - protein, 9 aa, Artificial Sequence
  Description of Artificial Sequence: Synthetic peptide
  Seed: SPLQRPVSS (MAGC1_HUMAN)
SPLQRPVSP

SEQ ID NO: 88012 - protein, 9 aa, Artificial Sequence
  Description of Artificial Sequence: Synthetic peptide
  Seed: SSSFSYTLL (MAGC1_HUMAN)
SISFSYTLV

SEQ ID NO: 88013 - protein, 9 aa, Artificial Sequence
  Description of Artificial Sequence: Synthetic peptide
  Seed: HFPQSPPEW (MAGC1_HUMAN)
HAPQSPPEV

SEQ ID NO: 88014 - protein, 9 aa, Artificial Sequence
  Description of Artificial Sequence: Synthetic peptide
  Seed: LQIPVSPSF (MAGC1_HUMAN)
LMIPVSPSY

SEQ ID NO: 88015 - protein, 9 aa, Artificial Sequence
  Description of Artificial Sequence: Synthetic peptide
  Seed: SSSESPQSC (MAGC1_HUMAN)
SISESPQSM

SEQ ID NO: 88016 - protein, 10 aa, Artificial Sequence
  Description of Artificial Sequence: Synthetic peptide
  Seed: REFIEILFGI (MAGC1_HUMAN)
RNFIEILFGF

SEQ ID NO: 88017 - protein, 10 aa, Artificial Sequence
  Description of Artificial Sequence: Synthetic peptide
  Seed: GTYASEEVIW (MAGC1_HUMAN)
GAYASEEVIW

SEQ ID NO: 88018 - protein, 8 aa, Artificial Sequence
  Description of Artificial Sequence: Synthetic peptide
  Seed: LAMLKNTV (MAGC1_HUMAN)
LPMLKNTM

SEQ ID NO: 88019 - protein, 9 aa, Artificial Sequence
  Description of Artificial Sequence: Synthetic peptide
  Seed: SAASSSTLV (MAGC1_HUMAN)
SLASSSTLA

SEQ ID NO: 88020 - protein, 9 aa, Artificial Sequence
  Description of Artificial Sequence: Synthetic peptide
  Seed: SSPESAQSA (MAGC1_HUMAN)
SGPESAQSV

SEQ ID NO: 88021 - protein, 10 aa, Artificial Sequence
  Description of Artificial Sequence: Synthetic peptide
  Seed: SSPESAQSAF (MAGC1_HUMAN)
SLPESAQSAM

SEQ ID NO: 88022 - protein, 8 aa, Artificial Sequence
  Description of Artificial Sequence: Synthetic peptide
  Seed: LQRPVSSF (MAGC1_HUMAN)
LMRPVSSF

SEQ ID NO: 88023 - protein, 10 aa, Artificial Sequence
  Description of Artificial Sequence: Synthetic peptide
  Seed: LSIFQSSPER (MAGC1_HUMAN)
LAIFQSSPER

SEQ ID NO: 88024 - protein, 11 aa, Artificial Sequence
  Description of Artificial Sequence: Synthetic peptide
  Seed: EEVIWDVLSGI (MAGC1_HUMAN)
ETVIWDVLSGA

SEQ ID NO: 88025 - protein, 10 aa, Artificial Sequence
  Description of Artificial Sequence: Synthetic peptide
  Seed: MPTAGMPSLL (MAGC1_HUMAN)
MFTAGMPSLL

SEQ ID NO: 88026 - protein, 9 aa, Artificial Sequence
  Description of Artificial Sequence: Synthetic peptide
  Seed: FSYTLLSLF (MAGC1_HUMAN)
FQYTLLSLW

SEQ ID NO: 88027 - protein, 10 aa, Artificial Sequence
  Description of Artificial Sequence: Synthetic peptide
  Seed: ATESASSSVM (MAGC1_HUMAN)
ARESASSSVY

SEQ ID NO: 88028 - protein, 10 aa, Artificial Sequence
  Description of Artificial Sequence: Synthetic peptide
  Seed: SPLQSPVISF (MAGC1_HUMAN)
SPLQSPVISY

SEQ ID NO: 88029 - protein, 10 aa, Artificial Sequence
  Description of Artificial Sequence: Synthetic peptide
  Seed: VSSSSSSSTL (MAGC1_HUMAN)
VASSSSSSTF

SEQ ID NO: 88030 - protein, 9 aa, Artificial Sequence
  Description of Artificial Sequence: Synthetic peptide
  Seed: SQNRLLILI (MAGC1_HUMAN)
SLNRLLILF

SEQ ID NO: 88031 - protein, 9 aa, Artificial Sequence
  Description of Artificial Sequence: Synthetic peptide
  Seed: FSSTLLSIL (MAGC1_HUMAN)
FMSTLLSIM

SEQ ID NO: 88032 - protein, 9 aa, Artificial Sequence
  Description of Artificial Sequence: Synthetic peptide
  Seed: FFSYTLASL (MAGC1_HUMAN)
FQSYTLASY

SEQ ID NO: 88033 - protein, 11 aa, Artificial Sequence
  Description of Artificial Sequence: Synthetic peptide
  Seed: REVPNSSPPRY (MAGC1_HUMAN)
RQVPNSSPPRF

SEQ ID NO: 88034 - protein, 9 aa, Artificial Sequence
  Description of Artificial Sequence: Synthetic peptide
  Seed: VIFRKAREF (MAGC1_HUMAN)
VVFRKAREW

SEQ ID NO: 88035 - protein, 9 aa, Artificial Sequence
  Description of Artificial Sequence: Synthetic peptide
  Seed: IPVSPSSSS (MAGC1_HUMAN)
IVVSPSSSF

SEQ ID NO: 88036 - protein, 9 aa, Artificial Sequence
  Description of Artificial Sequence: Synthetic peptide
  Seed: FSSTLLSLF (MAGC1_HUMAN)
FYSTLLSLY

SEQ ID NO: 88037 - protein, 9 aa, Artificial Sequence
  Description of Artificial Sequence: Synthetic peptide
  Seed: SICSSSTSL (MAGC1_HUMAN)
SICSSSTSI

SEQ ID NO: 88038 - protein, 9 aa, Artificial Sequence
  Description of Artificial Sequence: Synthetic peptide
  Seed: LQIVPSLPE (MAGC1_HUMAN)
LEIVPSLPY

SEQ ID NO: 88039 - protein, 11 aa, Artificial Sequence
  Description of Artificial Sequence: Synthetic peptide
  Seed: SSTLLSLFQSF (MAGC1_HUMAN)
SATLLSLFQSW

SEQ ID NO: 88040 - protein, 10 aa, Artificial Sequence
  Description of Artificial Sequence: Synthetic peptide
  Seed: SSPERTHSTF (MAGC1_HUMAN)
SQPERTHSTM

SEQ ID NO: 88041 - protein, 9 aa, Artificial Sequence
  Description of Artificial Sequence: Synthetic peptide
  Seed: SPLQSPVSS (MAGC1_HUMAN)
SPLQSPVSL

SEQ ID NO: 88042 - protein, 9 aa, Artificial Sequence
  Description of Artificial Sequence: Synthetic peptide
  Seed: YTLLSLFQS (MAGC1_HUMAN)
YVLLSLFQV

SEQ ID NO: 88043 - protein, 9 aa, Artificial Sequence
  Description of Artificial Sequence: Synthetic peptide
  Seed: YTLASLLQS (MAGC1_HUMAN)
YALASLLQL

SEQ ID NO: 88044 - protein, 9 aa, Artificial Sequence
  Description of Artificial Sequence: Synthetic peptide
  Seed: SSSTLVSIF (MAGC1_HUMAN)
SSSTLVSIW

SEQ ID NO: 88045 - protein, 9 aa, Artificial Sequence
  Description of Artificial Sequence: Synthetic peptide
  Seed: SRSFSSTLL (MAGC1_HUMAN)
SRSFSSTLM

SEQ ID NO: 88046 - protein, 10 aa, Artificial Sequence
  Description of Artificial Sequence: Synthetic peptide
  Seed: VPITFPSSYK (MAGC1_HUMAN)
VGITFPSSYK

SEQ ID NO: 88047 - protein, 10 aa, Artificial Sequence
  Description of Artificial Sequence: Synthetic peptide
  Seed: FSSTLVSLFQ (MAGC1_HUMAN)
FTSTLVSLFY

SEQ ID NO: 88048 - protein, 10 aa, Artificial Sequence
  Description of Artificial Sequence: Synthetic peptide
  Seed: MPTAGMPSLL (MAGC1_HUMAN)
MFTAGMPSLW

SEQ ID NO: 88049 - protein, 10 aa, Artificial Sequence
  Description of Artificial Sequence: Synthetic peptide
  Seed: KRKVVEFLAM (MAGC1_HUMAN)
KIKVVEFLAY

SEQ ID NO: 88050 - protein, 9 aa, Artificial Sequence
  Description of Artificial Sequence: Synthetic peptide
  Seed: SPQSPPEGP (MAGC1_HUMAN)
SPQSPPEGI

SEQ ID NO: 88051 - protein, 11 aa, Artificial Sequence
  Description of Artificial Sequence: Synthetic peptide
  Seed: SFFSYTLASLL (MAGC1_HUMAN)
SFFSYTLASLF

SEQ ID NO: 88052 - protein, 10 aa, Artificial Sequence
  Description of Artificial Sequence: Synthetic peptide
  Seed: RKVVEFLAML (MAGC1_HUMAN)
RWVVEFLAMI

SEQ ID NO: 88053 - protein, 9 aa, Artificial Sequence
  Description of Artificial Sequence: Synthetic peptide
  Seed: NVISRYTGY (MAGC1_HUMAN)
NQISRYTGM

SEQ ID NO: 88054 - protein, 11 aa, Artificial Sequence
  Description of Artificial Sequence: Synthetic peptide
  Seed: STFEGFAQSPL (MAGC1_HUMAN)
SSFEGFAQSPV

SEQ ID NO: 88055 - protein, 9 aa, Artificial Sequence
  Description of Artificial Sequence: Synthetic peptide
  Seed: RPVSSFFSY (MAGC1_HUMAN)
RTVSSFFSY

SEQ ID NO: 88056 - protein, 9 aa, Artificial Sequence
  Description of Artificial Sequence: Synthetic peptide
  Seed: WGPRAHSEV (MAGC1_HUMAN)
WLPRAHSEL

SEQ ID NO: 88057 - protein, 9 aa, Artificial Sequence
  Description of Artificial Sequence: Synthetic peptide
  Seed: TGYFPVIFR (MAGC1_HUMAN)
TAYFPVIFR

SEQ ID NO: 88058 - protein, 9 aa, Artificial Sequence
  Description of Artificial Sequence: Synthetic peptide
  Seed: SLSPHYFPQ (MAGC1_HUMAN)
SISPHYFPK

SEQ ID NO: 88059 - protein, 9 aa, Artificial Sequence
  Description of Artificial Sequence: Synthetic peptide
  Seed: DVLSGIGVR (MAGC1_HUMAN)
DTLSGIGVR

SEQ ID NO: 88060 - protein, 10 aa, Artificial Sequence
  Description of Artificial Sequence: Synthetic peptide
  Seed: STFEGFAQSS (MAGC1_HUMAN)
SSFEGFAQSV

SEQ ID NO: 88061 - protein, 9 aa, Artificial Sequence
  Description of Artificial Sequence: Synthetic peptide
  Seed: REFIEILFG (MAGC1_HUMAN)
REFIEILFP

SEQ ID NO: 88062 - protein, 10 aa, Artificial Sequence
  Description of Artificial Sequence: Synthetic peptide
  Seed: GVRAGREHFA (MAGC1_HUMAN)
GVRAGREHFK

SEQ ID NO: 88063 - protein, 9 aa, Artificial Sequence
  Description of Artificial Sequence: Synthetic peptide
  Seed: VSPSFSSTL (MAGC1_HUMAN)
VAPSFSSTV

SEQ ID NO: 88064 - protein, 10 aa, Artificial Sequence
  Description of Artificial Sequence: Synthetic peptide
  Seed: SPLQNPASSF (MAGC1_HUMAN)
SPLQNPASSW

SEQ ID NO: 88065 - protein, 10 aa, Artificial Sequence
  Description of Artificial Sequence: Synthetic peptide
  Seed: KRKVVEFLAM (MAGC1_HUMAN)
KHKVVEFLAY

SEQ ID NO: 88066 - protein, 10 aa, Artificial Sequence
  Description of Artificial Sequence: Synthetic peptide
  Seed: SSPESAQSTF (MAGC1_HUMAN)
STPESAQSTM

SEQ ID NO: 88067 - protein, 9 aa, Artificial Sequence
  Description of Artificial Sequence: Synthetic peptide
  Seed: ISFSSSTSL (MAGC1_HUMAN)
ILFSSSTSA

SEQ ID NO: 88068 - protein, 9 aa, Artificial Sequence
  Description of Artificial Sequence: Synthetic peptide
  Seed: SSPPRYEFL (MAGC1_HUMAN)
SWPPRYEFW

SEQ ID NO: 88069 - protein, 9 aa, Artificial Sequence
  Description of Artificial Sequence: Synthetic peptide
  Seed: SSSSSSTLL (MAGC1_HUMAN)
SPSSSSTLY

SEQ ID NO: 88070 - protein, 9 aa, Artificial Sequence
  Description of Artificial Sequence: Synthetic peptide
  Seed: RTQSTFEGF (MAGC1_HUMAN)
RQQSTFEGW

SEQ ID NO: 88071 - protein, 10 aa, Artificial Sequence
  Description of Artificial Sequence: Synthetic peptide
  Seed: SSFPSSTSSS (MAGC1_HUMAN)
SLFPSSTSSF

SEQ ID NO: 88072 - protein, 11 aa, Artificial Sequence
  Description of Artificial Sequence: Synthetic peptide
  Seed: IPVSSSSSSTL (MAGC1_HUMAN)
IPVSSSSSSTW

SEQ ID NO: 88073 - protein, 9 aa, Artificial Sequence
  Description of Artificial Sequence: Synthetic peptide
  Seed: SSPERTQST (MAGC1_HUMAN)
SAPERTQSY

SEQ ID NO: 88074 - protein, 10 aa, Artificial Sequence
  Description of Artificial Sequence: Synthetic peptide
  Seed: RSFSSTLLSI (MAGC1_HUMAN)
RSFSSTLLSA

SEQ ID NO: 88075 - protein, 10 aa, Artificial Sequence
  Description of Artificial Sequence: Synthetic peptide
  Seed: LQRPVSSFFS (MAGC1_HUMAN)
LVRPVSSFFY

SEQ ID NO: 88076 - protein, 11 aa, Artificial Sequence
  Description of Artificial Sequence: Synthetic peptide
  Seed: SPLQIPMTSSF (MAGC1_HUMAN)
SDLQIPMTSSY

SEQ ID NO: 88077 - protein, 10 aa, Artificial Sequence
  Description of Artificial Sequence: Synthetic peptide
  Seed: VISFSSSTSL (MAGC1_HUMAN)
VDSFSSSTSF

SEQ ID NO: 88078 - protein, 10 aa, Artificial Sequence
  Description of Artificial Sequence: Synthetic peptide
  Seed: YTLLSLFQSS (MAGC1_HUMAN)
YSLLSLFQSV

SEQ ID NO: 88079 - protein, 9 aa, Artificial Sequence
  Description of Artificial Sequence: Synthetic peptide
  Seed: SSPESPLQS (MAGC1_HUMAN)
SAPESPLQC

SEQ ID NO: 88080 - protein, 10 aa, Artificial Sequence
  Description of Artificial Sequence: Synthetic peptide
  Seed: SRYTGYFPVI (MAGC1_HUMAN)
SSYTGYFPVM

SEQ ID NO: 88081 - protein, 9 aa, Artificial Sequence
  Description of Artificial Sequence: Synthetic peptide
  Seed: YQVKQPITK (MAGC1_HUMAN)
YLVKQPITR

SEQ ID NO: 88082 - protein, 9 aa, Artificial Sequence
  Description of Artificial Sequence: Synthetic peptide
  Seed: FQSSLQSPV (MAGC1_HUMAN)
FQSSLQSPA

SEQ ID NO: 88083 - protein, 10 aa, Artificial Sequence
  Description of Artificial Sequence: Synthetic peptide
  Seed: SSSSSTLLSL (MAGC1_HUMAN)
SMSSSTLLSI

SEQ ID NO: 88084 - protein, 9 aa, Artificial Sequence
  Description of Artificial Sequence: Synthetic peptide
  Seed: CSSSTSLSL (MAGC1_HUMAN)
CISSTSLSF

SEQ ID NO: 88085 - protein, 10 aa, Artificial Sequence
  Description of Artificial Sequence: Synthetic peptide
  Seed: SSPERTQSTF (MAGC1_HUMAN)
SYPERTQSTF

SEQ ID NO: 88086 - protein, 9 aa, Artificial Sequence
  Description of Artificial Sequence: Synthetic peptide
  Seed: VSPSSSSTL (MAGC1_HUMAN)
VCPSSSSTL

SEQ ID NO: 88087 - protein, 9 aa, Artificial Sequence
  Description of Artificial Sequence: Synthetic peptide
  Seed: LQNPASSFF (MAGC1_HUMAN)
LWNPASSFW

SEQ ID NO: 88088 - protein, 10 aa, Artificial Sequence
  Description of Artificial Sequence: Synthetic peptide
  Seed: SFSERTQSTF (MAGC1_HUMAN)
SLSERTQSTF

SEQ ID NO: 88089 - protein, 9 aa, Artificial Sequence
  Description of Artificial Sequence: Synthetic peptide
  Seed: GYFPVIFRK (MAGC1_HUMAN)
GFFPVIFRK

SEQ ID NO: 88090 - protein, 9 aa, Artificial Sequence
  Description of Artificial Sequence: Synthetic peptide
  Seed: MLTNVISRY (MAGC1_HUMAN)
MITNVISRY

SEQ ID NO: 88091 - protein, 9 aa, Artificial Sequence
  Description of Artificial Sequence: Synthetic peptide
  Seed: STQSPFEGF (MAGC1_HUMAN)
SFQSPFEGY

SEQ ID NO: 88092 - protein, 10 aa, Artificial Sequence
  Description of Artificial Sequence: Synthetic peptide
  Seed: LQIPGSPSFS (MAGC1_HUMAN)
LQIPGSPSFW

SEQ ID NO: 88093 - protein, 10 aa, Artificial Sequence
  Description of Artificial Sequence: Synthetic peptide
  Seed: VSRSFSSTLL (MAGC1_HUMAN)
VARSFSSTLW

SEQ ID NO: 88094 - protein, 9 aa, Artificial Sequence
  Description of Artificial Sequence: Synthetic peptide
  Seed: DELARFLLL (MAGC1_HUMAN)
DMLARFLLL

SEQ ID NO: 88095 - protein, 9 aa, Artificial Sequence
  Description of Artificial Sequence: Synthetic peptide
  Seed: CSSSTSLSL (MAGC1_HUMAN)
CRSSTSLSY

SEQ ID NO: 88096 - protein, 9 aa, Artificial Sequence
  Description of Artificial Sequence: Synthetic peptide
  Seed: LILILSIIF (MAGC1_HUMAN)
LSLILSIIW

SEQ ID NO: 88097 - protein, 9 aa, Artificial Sequence
  Description of Artificial Sequence: Synthetic peptide
  Seed: SMSPLYFPQ (MAGC1_HUMAN)
SNSPLYFPR

SEQ ID NO: 88098 - protein, 10 aa, Artificial Sequence
  Description of Artificial Sequence: Synthetic peptide
  Seed: RSFSSTLLSI (MAGC1_HUMAN)
RFFSSTLLSY

SEQ ID NO: 88099 - protein, 9 aa, Artificial Sequence
  Description of Artificial Sequence: Synthetic peptide
  Seed: LQNPASSFF (MAGC1_HUMAN)
LFNPASSFY

SEQ ID NO: 88100 - protein, 9 aa, Artificial Sequence
  Description of Artificial Sequence: Synthetic peptide
  Seed: SICSSSTSL (MAGC1_HUMAN)
SQCSSSTSI

SEQ ID NO: 88101 - protein, 9 aa, Artificial Sequence
  Description of Artificial Sequence: Synthetic peptide
  Seed: FSYTLASLL (MAGC1_HUMAN)
FFYTLASLL

SEQ ID NO: 88102 - protein, 9 aa, Artificial Sequence
  Description of Artificial Sequence: Synthetic peptide
  Seed: IIFIKGTYA (MAGC1_HUMAN)
ITFIKGTYV

SEQ ID NO: 88103 - protein, 9 aa, Artificial Sequence
  Description of Artificial Sequence: Synthetic peptide
  Seed: FFSSALLSI (MAGC1_HUMAN)
FQSSALLSM

SEQ ID NO: 88104 - protein, 9 aa, Artificial Sequence
  Description of Artificial Sequence: Synthetic peptide
  Seed: SSFSYTLLS (MAGC1_HUMAN)
SLFSYTLLK

SEQ ID NO: 88105 - protein, 9 aa, Artificial Sequence
  Description of Artificial Sequence: Synthetic peptide
  Seed: VISRYTGYF (MAGC1_HUMAN)
VISRYTGYY

SEQ ID NO: 88106 - protein, 9 aa, Artificial Sequence
  Description of Artificial Sequence: Synthetic peptide
  Seed: MPTAGMPSL (MAGC1_HUMAN)
MQTAGMPSV

SEQ ID NO: 88107 - protein, 9 aa, Artificial Sequence
  Description of Artificial Sequence: Synthetic peptide
  Seed: SSSSTLLSL (MAGC1_HUMAN)
SASSTLLSV

SEQ ID NO: 88108 - protein, 10 aa, Artificial Sequence
  Description of Artificial Sequence: Synthetic peptide
  Seed: SPLQSPVSSF (MAGC1_HUMAN)
SYLQSPVSSY

SEQ ID NO: 88109 - protein, 11 aa, Artificial Sequence
  Description of Artificial Sequence: Synthetic peptide
  Seed: SPLQIPMTSSF (MAGC1_HUMAN)
SALQIPMTSSM

SEQ ID NO: 88110 - protein, 9 aa, Artificial Sequence
  Description of Artificial Sequence: Synthetic peptide
  Seed: NTVPITFPS (MAGC1_HUMAN)
NTVPITFPC

SEQ ID NO: 88111 - protein, 10 aa, Artificial Sequence
  Description of Artificial Sequence: Synthetic peptide
  Seed: SLSPLHFPQF (MAGC1_HUMAN)
SMSPLHFPQR

SEQ ID NO: 88112 - protein, 10 aa, Artificial Sequence
  Description of Artificial Sequence: Synthetic peptide
  Seed: PLQIPGSPSF (MAGC1_HUMAN)
PFQIPGSPSM

SEQ ID NO: 88113 - protein, 9 aa, Artificial Sequence
  Description of Artificial Sequence: Synthetic peptide
  Seed: VSAASSSTL (MAGC1_HUMAN)
VRAASSSTM

SEQ ID NO: 88114 - protein, 9 aa, Artificial Sequence
  Description of Artificial Sequence: Synthetic peptide
  Seed: FSSTLLSIL (MAGC1_HUMAN)
FPSTLLSIL

SEQ ID NO: 88115 - protein, 9 aa, Artificial Sequence
  Description of Artificial Sequence: Synthetic peptide
  Seed: SRYTGYFPV (MAGC1_HUMAN)
SGYTGYFPY

SEQ ID NO: 88116 - protein, 10 aa, Artificial Sequence
  Description of Artificial Sequence: Synthetic peptide
  Seed: VISFSSSTSL (MAGC1_HUMAN)
VYSFSSSTSL

SEQ ID NO: 88117 - protein, 10 aa, Artificial Sequence
  Description of Artificial Sequence: Synthetic peptide
  Seed: SSPESAQSTF (MAGC1_HUMAN)
SLPESAQSTL

SEQ ID NO: 88118 - protein, 9 aa, Artificial Sequence
  Description of Artificial Sequence: Synthetic peptide
  Seed: SSFFSSALL (MAGC1_HUMAN)
SHFFSSALF

SEQ ID NO: 88119 - protein, 11 aa, Artificial Sequence
  Description of Artificial Sequence: Synthetic peptide
  Seed: REVDPDDSYVF (MAGC1_HUMAN)
RWVDPDDSYVY

SEQ ID NO: 88120 - protein, 10 aa, Artificial Sequence
  Description of Artificial Sequence: Synthetic peptide
  Seed: KAREFIEILF (MAGC1_HUMAN)
KRREFIEILL

SEQ ID NO: 88121 - protein, 9 aa, Artificial Sequence
  Description of Artificial Sequence: Synthetic peptide
  Seed: LQIPGSPSF (MAGC1_HUMAN)
LAIPGSPSW

SEQ ID NO: 88122 - protein, 10 aa, Artificial Sequence
  Description of Artificial Sequence: Synthetic peptide
  Seed: REFIEILFGI (MAGC1_HUMAN)
RVFIEILFGM

SEQ ID NO: 88123 - protein, 9 aa, Artificial Sequence
  Description of Artificial Sequence: Synthetic peptide
  Seed: TSLSLPQSF (MAGC1_HUMAN)
TMLSLPQSM

SEQ ID NO: 88124 - protein, 10 aa, Artificial Sequence
  Description of Artificial Sequence: Synthetic peptide
  Seed: SRYTGYFPVI (MAGC1_HUMAN)
SPYTGYFPVF

SEQ ID NO: 88125 - protein, 9 aa, Artificial Sequence
  Description of Artificial Sequence: Synthetic peptide
  Seed: YVFVNTLDL (MAGC1_HUMAN)
YKFVNTLDI

SEQ ID NO: 88126 - protein, 10 aa, Artificial Sequence
  Description of Artificial Sequence: Synthetic peptide
  Seed: MTSSFSSTLL (MAGC1_HUMAN)
MMSSFSSTLW

SEQ ID NO: 88127 - protein, 9 aa, Artificial Sequence
  Description of Artificial Sequence: Synthetic peptide
  Seed: AGREHFAFG (MAGC1_HUMAN)
AFREHFAFA

SEQ ID NO: 88128 - protein, 10 aa, Artificial Sequence
  Description of Artificial Sequence: Synthetic peptide
  Seed: WGPRAHSEVI (MAGC1_HUMAN)
WAPRAHSEVI

SEQ ID NO: 88129 - protein, 9 aa, Artificial Sequence
  Description of Artificial Sequence: Synthetic peptide
  Seed: AQSPLQIPV (MAGC1_HUMAN)
AQSPLQIPM

SEQ ID NO: 88130 - protein, 9 aa, Artificial Sequence
  Description of Artificial Sequence: Synthetic peptide
  Seed: TSLSLPQSF (MAGC1_HUMAN)
TYLSLPQSM

SEQ ID NO: 88131 - protein, 10 aa, Artificial Sequence
  Description of Artificial Sequence: Synthetic peptide
  Seed: TGYFPVIFRK (MAGC1_HUMAN)
TAYFPVIFRM

SEQ ID NO: 88132 - protein, 9 aa, Artificial Sequence
  Description of Artificial Sequence: Synthetic peptide
  Seed: SQSPPEGPV (MAGC1_HUMAN)
SASPPEGPF

SEQ ID NO: 88133 - protein, 9 aa, Artificial Sequence
  Description of Artificial Sequence: Synthetic peptide
  Seed: SSPESAQST (MAGC1_HUMAN)
SYPESAQSF

SEQ ID NO: 88134 - protein, 9 aa, Artificial Sequence
  Description of Artificial Sequence: Synthetic peptide
  Seed: RSFSSTLLS (MAGC1_HUMAN)
RSFSSTLLW

SEQ ID NO: 88135 - protein, 10 aa, Artificial Sequence
  Description of Artificial Sequence: Synthetic peptide
  Seed: RAGREHFAFG (MAGC1_HUMAN)
RMGREHFAFA

SEQ ID NO: 88136 - protein, 9 aa, Artificial Sequence
  Description of Artificial Sequence: Synthetic peptide
  Seed: FSSTLLSIL (MAGC1_HUMAN)
FPSTLLSIA

SEQ ID NO: 88137 - protein, 9 aa, Artificial Sequence
  Description of Artificial Sequence: Synthetic peptide
  Seed: VSSSSSSTL (MAGC1_HUMAN)
VNSSSSSTF

SEQ ID NO: 88138 - protein, 10 aa, Artificial Sequence
  Description of Artificial Sequence: Synthetic peptide
  Seed: LAMLKNTVPI (MAGC1_HUMAN)
LTMLKNTVPI

SEQ ID NO: 88139 - protein, 9 aa, Artificial Sequence
  Description of Artificial Sequence: Synthetic peptide
  Seed: STFEGFAQS (MAGC1_HUMAN)
SAFEGFAQM

SEQ ID NO: 88140 - protein, 10 aa, Artificial Sequence
  Description of Artificial Sequence: Synthetic peptide
  Seed: LQGEEFQSSL (MAGC1_HUMAN)
LHGEEFQSSF

SEQ ID NO: 88141 - protein, 9 aa, Artificial Sequence
  Description of Artificial Sequence: Synthetic peptide
  Seed: RSFSSTLLS (MAGC1_HUMAN)
RIFSSTLLM

SEQ ID NO: 88142 - protein, 9 aa, Artificial Sequence
  Description of Artificial Sequence: Synthetic peptide
  Seed: SQNRLLILI (MAGC1_HUMAN)
SANRLLILV

SEQ ID NO: 88143 - protein, 9 aa, Artificial Sequence
  Description of Artificial Sequence: Synthetic peptide
  Seed: RYTGYFPVI (MAGC1_HUMAN)
RFTGYFPVM

SEQ ID NO: 88144 - protein, 9 aa, Artificial Sequence
  Description of Artificial Sequence: Synthetic peptide
  Seed: MSQNRLLIL (MAGC1_HUMAN)
MPQNRLLIF

SEQ ID NO: 88145 - protein, 10 aa, Artificial Sequence
  Description of Artificial Sequence: Synthetic peptide
  Seed: RYTGYFPVIF (MAGC1_HUMAN)
RSTGYFPVIW

SEQ ID NO: 88146 - protein, 10 aa, Artificial Sequence
  Description of Artificial Sequence: Synthetic peptide
  Seed: PLQRPVSSFF (MAGC1_HUMAN)
PRQRPVSSFF

SEQ ID NO: 88147 - protein, 9 aa, Artificial Sequence
  Description of Artificial Sequence: Synthetic peptide
  Seed: REVDPDDSY (MAGC1_HUMAN)
REVDPDDSA

SEQ ID NO: 88148 - protein, 9 aa, Artificial Sequence
  Description of Artificial Sequence: Synthetic peptide
  Seed: SLPEWEDSL (MAGC1_HUMAN)
SIPEWEDSI

SEQ ID NO: 88149 - protein, 10 aa, Artificial Sequence
  Description of Artificial Sequence: Synthetic peptide
  Seed: FFSYTLASLL (MAGC1_HUMAN)
FTSYTLASLL

SEQ ID NO: 88150 - protein, 9 aa, Artificial Sequence
  Description of Artificial Sequence: Synthetic peptide
  Seed: KVVEFLAML (MAGC1_HUMAN)
KRVEFLAMY

SEQ ID NO: 88151 - protein, 10 aa, Artificial Sequence
  Description of Artificial Sequence: Synthetic peptide
  Seed: RPVSSFFSYT (MAGC1_HUMAN)
RWVSSFFSYK

SEQ ID NO: 88152 - protein, 9 aa, Artificial Sequence
  Description of Artificial Sequence: Synthetic peptide
  Seed: VSSSFSYTL (MAGC1_HUMAN)
VMSSFSYTI

SEQ ID NO: 88153 - protein, 10 aa, Artificial Sequence
  Description of Artificial Sequence: Synthetic peptide
  Seed: RKVVEFLAML (MAGC1_HUMAN)
RQVVEFLAMF

SEQ ID NO: 88154 - protein, 9 aa, Artificial Sequence
  Description of Artificial Sequence: Synthetic peptide
  Seed: VSRSFSSTL (MAGC1_HUMAN)
VPRSFSSTL

SEQ ID NO: 88155 - protein, 9 aa, Artificial Sequence
  Description of Artificial Sequence: Synthetic peptide
  Seed: SPPQGEDSM (MAGC1_HUMAN)
SMPQGEDSY

SEQ ID NO: 88156 - protein, 9 aa, Artificial Sequence
  Description of Artificial Sequence: Synthetic peptide
  Seed: REHFAFGEP (MAGC1_HUMAN)
REHFAFGEI

SEQ ID NO: 88157 - protein, 9 aa, Artificial Sequence
  Description of Artificial Sequence: Synthetic peptide
  Seed: ISRYTGYFP (MAGC1_HUMAN)
ITRYTGYFA

SEQ ID NO: 88158 - protein, 10 aa, Artificial Sequence
  Description of Artificial Sequence: Synthetic peptide
  Seed: SFPSSTSSSL (MAGC1_HUMAN)
SWPSSTSSSM

SEQ ID NO: 88159 - protein, 10 aa, Artificial Sequence
  Description of Artificial Sequence: Synthetic peptide
  Seed: SFFSSALLSI (MAGC1_HUMAN)
SCFSSALLSF

SEQ ID NO: 88160 - protein, 10 aa, Artificial Sequence
  Description of Artificial Sequence: Synthetic peptide
  Seed: ATESASSSVM (MAGC1_HUMAN)
ASESASSSVF

SEQ ID NO: 88161 - protein, 10 aa, Artificial Sequence
  Description of Artificial Sequence: Synthetic peptide
  Seed: SMSPLYFPQS (MAGC1_HUMAN)
SLSPLYFPQI

SEQ ID NO: 88162 - protein, 9 aa, Artificial Sequence
  Description of Artificial Sequence: Synthetic peptide
  Seed: IIDTTDDST (MAGC1_HUMAN)
IIDTTDDSF

SEQ ID NO: 88163 - protein, 9 aa, Artificial Sequence
  Description of Artificial Sequence: Synthetic peptide
  Seed: FFSYTLASL (MAGC1_HUMAN)
FVSYTLAST

SEQ ID NO: 88164 - protein, 9 aa, Artificial Sequence
  Description of Artificial Sequence: Synthetic peptide
  Seed: FSSTLVSLF (MAGC1_HUMAN)
FRSTLVSLF

SEQ ID NO: 88165 - protein, 9 aa, Artificial Sequence
  Description of Artificial Sequence: Synthetic peptide
  Seed: EVDPDDSYV (MAGC1_HUMAN)
EIDPDDSYL

SEQ ID NO: 88166 - protein, 9 aa, Artificial Sequence
  Description of Artificial Sequence: Synthetic peptide
  Seed: ASSSTLVSI (MAGC1_HUMAN)
AASSTLVSV

SEQ ID NO: 88167 - protein, 9 aa, Artificial Sequence
  Description of Artificial Sequence: Synthetic peptide
  Seed: YFPVIFRKA (MAGC1_HUMAN)
YYPVIFRKM

SEQ ID NO: 88168 - protein, 10 aa, Artificial Sequence
  Description of Artificial Sequence: Synthetic peptide
  Seed: LLQIPMTSSF (MAGC1_HUMAN)
LTQIPMTSSY

SEQ ID NO: 88169 - protein, 11 aa, Artificial Sequence
  Description of Artificial Sequence: Synthetic peptide
  Seed: SSFPSSTSSSL (MAGC1_HUMAN)
SYFPSSTSSSY

SEQ ID NO: 88170 - protein, 10 aa, Artificial Sequence
  Description of Artificial Sequence: Synthetic peptide
  Seed: MSPLYFPQSP (MAGC1_HUMAN)
MPPLYFPQSV

SEQ ID NO: 88171 - protein, 10 aa, Artificial Sequence
  Description of Artificial Sequence: Synthetic peptide
  Seed: SSPESAQSTF (MAGC1_HUMAN)
SFPESAQSTF

SEQ ID NO: 88172 - protein, 9 aa, Artificial Sequence
  Description of Artificial Sequence: Synthetic peptide
  Seed: TYASEEVIW (MAGC1_HUMAN)
TWASEEVIF

SEQ ID NO: 88173 - protein, 10 aa, Artificial Sequence
  Description of Artificial Sequence: Synthetic peptide
  Seed: PLQRPVSSFF (MAGC1_HUMAN)
PFQRPVSSFY

SEQ ID NO: 88174 - protein, 9 aa, Artificial Sequence
  Description of Artificial Sequence: Synthetic peptide
  Seed: VSRSFSSTL (MAGC1_HUMAN)
VQRSFSSTA

SEQ ID NO: 88175 - protein, 9 aa, Artificial Sequence
  Description of Artificial Sequence: Synthetic peptide
  Seed: SSSTLVSIF (MAGC1_HUMAN)
SMSTLVSIY

SEQ ID NO: 88176 - protein, 9 aa, Artificial Sequence
  Description of Artificial Sequence: Synthetic peptide
  Seed: YQVKQPITK (MAGC1_HUMAN)
YGVKQPITF

SEQ ID NO: 88177 - protein, 9 aa, Artificial Sequence
  Description of Artificial Sequence: Synthetic peptide
  Seed: RAGREHFAF (MAGC1_HUMAN)
RAGREHFAW

SEQ ID NO: 88178 - protein, 10 aa, Artificial Sequence
  Description of Artificial Sequence: Synthetic peptide
  Seed: YVFVNTLDLT (MAGC1_HUMAN)
YMFVNTLDLA

SEQ ID NO: 88179 - protein, 9 aa, Artificial Sequence
  Description of Artificial Sequence: Synthetic peptide
  Seed: FAFGEPREL (MAGC1_HUMAN)
FKFGEPREL

SEQ ID NO: 88180 - protein, 9 aa, Artificial Sequence
  Description of Artificial Sequence: Synthetic peptide
  Seed: KAREFIEIL (MAGC1_HUMAN)
KLREFIEIW

SEQ ID NO: 88181 - protein, 9 aa, Artificial Sequence
  Description of Artificial Sequence: Synthetic peptide
  Seed: EDSLSSLHF (MAGC1_HUMAN)
EESLSSLHF

SEQ ID NO: 88182 - protein, 11 aa, Artificial Sequence
  Description of Artificial Sequence: Synthetic peptide
  Seed: QSSPESAQSAF (MAGC1_HUMAN)
QQSPESAQSAY

SEQ ID NO: 88183 - protein, 9 aa, Artificial Sequence
  Description of Artificial Sequence: Synthetic peptide
  Seed: VPITFPSSY (MAGC1_HUMAN)
VRITFPSSM

SEQ ID NO: 88184 - protein, 9 aa, Artificial Sequence
  Description of Artificial Sequence: Synthetic peptide
  Seed: SSFFSSALL (MAGC1_HUMAN)
SMFFSSALV

SEQ ID NO: 88185 - protein, 10 aa, Artificial Sequence
  Description of Artificial Sequence: Synthetic peptide
  Seed: YTLLSLFQSS (MAGC1_HUMAN)
YKLLSLFQSV

SEQ ID NO: 88186 - protein, 9 aa, Artificial Sequence
  Description of Artificial Sequence: Synthetic peptide
  Seed: YVFVNTLDL (MAGC1_HUMAN)
YLFVNTLDF

SEQ ID NO: 88187 - protein, 10 aa, Artificial Sequence
  Description of Artificial Sequence: Synthetic peptide
  Seed: SSSSTLLSLF (MAGC1_HUMAN)
SWSSTLLSLF

SEQ ID NO: 88188 - protein, 9 aa, Artificial Sequence
  Description of Artificial Sequence: Synthetic peptide
  Seed: ISFSSSTSL (MAGC1_HUMAN)
IPFSSSTSL

SEQ ID NO: 88189 - protein, 9 aa, Artificial Sequence
  Description of Artificial Sequence: Synthetic peptide
  Seed: NSSPPRYEF (MAGC1_HUMAN)
NPSPPRYEF

SEQ ID NO: 88190 - protein, 11 aa, Artificial Sequence
  Description of Artificial Sequence: Synthetic peptide
  Seed: MSPLYFPQSPL (MAGC1_HUMAN)
MTPLYFPQSPV

SEQ ID NO: 88191 - protein, 10 aa, Artificial Sequence
  Description of Artificial Sequence: Synthetic peptide
  Seed: SPLQIPQSSP (MAGC1_HUMAN)
SPLQIPQSSV

SEQ ID NO: 88192 - protein, 9 aa, Artificial Sequence
  Description of Artificial Sequence: Synthetic peptide
  Seed: QVKQPITKA (MAGC1_HUMAN)
QQKQPITKY

SEQ ID NO: 88193 - protein, 11 aa, Artificial Sequence
  Description of Artificial Sequence: Synthetic peptide
  Seed: SEESSSPVDEY (MAGC1_HUMAN)
SEESSSPVDEA

SEQ ID NO: 88194 - protein, 10 aa, Artificial Sequence
  Description of Artificial Sequence: Synthetic peptide
  Seed: WGPRAHSEVI (MAGC1_HUMAN)
WPPRAHSEVI

SEQ ID NO: 88195 - protein, 10 aa, Artificial Sequence
  Description of Artificial Sequence: Synthetic peptide
  Seed: SSPESTQSPF (MAGC1_HUMAN)
SEPESTQSPL

SEQ ID NO: 88196 - protein, 9 aa, Artificial Sequence
  Description of Artificial Sequence: Synthetic peptide
  Seed: MLTNVISRY (MAGC1_HUMAN)
MPTNVISRY

SEQ ID NO: 88197 - protein, 9 aa, Artificial Sequence
  Description of Artificial Sequence: Synthetic peptide
  Seed: LQIPMTSSF (MAGC1_HUMAN)
LSIPMTSSW

SEQ ID NO: 88198 - protein, 9 aa, Artificial Sequence
  Description of Artificial Sequence: Synthetic peptide
  Seed: FSYTLASLL (MAGC1_HUMAN)
FMYTLASLW

SEQ ID NO: 88199 - protein, 11 aa, Artificial Sequence
  Description of Artificial Sequence: Synthetic peptide
  Seed: SSSSSSTLLSL (MAGC1_HUMAN)
SMSSSSTLLSF

SEQ ID NO: 88200 - protein, 11 aa, Artificial Sequence
  Description of Artificial Sequence: Synthetic peptide
  Seed: IPVSSSFSYTL (MAGC1_HUMAN)
ILVSSSFSYTY

SEQ ID NO: 88201 - protein, 9 aa, Artificial Sequence
  Description of Artificial Sequence: Synthetic peptide
  Seed: RSFSSTLLS (MAGC1_HUMAN)
RSFSSTLLV

SEQ ID NO: 88202 - protein, 9 aa, Artificial Sequence
  Description of Artificial Sequence: Synthetic peptide
  Seed: SSSVMSPSF (MAGC1_HUMAN)
SMSVMSPSM

SEQ ID NO: 88203 - protein, 8 aa, Artificial Sequence
  Description of Artificial Sequence: Synthetic peptide
  Seed: KAREFIEI (MAGC1_HUMAN)
KQREFIEI

SEQ ID NO: 88204 - protein, 11 aa, Artificial Sequence
  Description of Artificial Sequence: Synthetic peptide
  Seed: REVDPDDSYVF (MAGC1_HUMAN)
RIVDPDDSYVF

SEQ ID NO: 88205 - protein, 9 aa, Artificial Sequence
  Description of Artificial Sequence: Synthetic peptide
  Seed: EHFAFGEPR (MAGC1_HUMAN)
EQFAFGEPR

SEQ ID NO: 88206 - protein, 9 aa, Artificial Sequence
  Description of Artificial Sequence: Synthetic peptide
  Seed: MTSSFSSTL (MAGC1_HUMAN)
MLSSFSSTV

SEQ ID NO: 88207 - protein, 9 aa, Artificial Sequence
  Description of Artificial Sequence: Synthetic peptide
  Seed: MTSSFSSTL (MAGC1_HUMAN)
MQSSFSSTF

SEQ ID NO: 88208 - protein, 10 aa, Artificial Sequence
  Description of Artificial Sequence: Synthetic peptide
  Seed: ASSFFSSALL (MAGC1_HUMAN)
AGSFFSSALW

SEQ ID NO: 88209 - protein, 10 aa, Artificial Sequence
  Description of Artificial Sequence: Synthetic peptide
  Seed: ASSSVMSPSF (MAGC1_HUMAN)
AISSVMSPSY

SEQ ID NO: 88210 - protein, 11 aa, Artificial Sequence
  Description of Artificial Sequence: Synthetic peptide
  Seed: SSSSSSTLLSL (MAGC1_HUMAN)
SNSSSSTLLSF

SEQ ID NO: 88211 - protein, 9 aa, Artificial Sequence
  Description of Artificial Sequence: Synthetic peptide
  Seed: FSSALLSIF (MAGC1_HUMAN)
FRSALLSIL

SEQ ID NO: 88212 - protein, 10 aa, Artificial Sequence
  Description of Artificial Sequence: Synthetic peptide
  Seed: SQSPPEGEDV (MAGC1_HUMAN)
SLSPPEGEDW

SEQ ID NO: 88213 - protein, 11 aa, Artificial Sequence
  Description of Artificial Sequence: Synthetic peptide
  Seed: IPVSAASSSTL (MAGC1_HUMAN)
IGVSAASSSTW

SEQ ID NO: 88214 - protein, 9 aa, Artificial Sequence
  Description of Artificial Sequence: Synthetic peptide
  Seed: IPVSSSFSY (MAGC1_HUMAN)
IMVSSSFSI

SEQ ID NO: 88215 - protein, 10 aa, Artificial Sequence
  Description of Artificial Sequence: Synthetic peptide
  Seed: RSFSSTLLSI (MAGC1_HUMAN)
RNFSSTLLSY

SEQ ID NO: 88216 - protein, 9 aa, Artificial Sequence
  Description of Artificial Sequence: Synthetic peptide
  Seed: VSPSSSSTL (MAGC1_HUMAN)
VTPSSSSTL

SEQ ID NO: 88217 - protein, 10 aa, Artificial Sequence
  Description of Artificial Sequence: Synthetic peptide
  Seed: RSFSSTLLSI (MAGC1_HUMAN)
RVFSSTLLSM

SEQ ID NO: 88218 - protein, 10 aa, Artificial Sequence
  Description of Artificial Sequence: Synthetic peptide
  Seed: PLQIPVSRSF (MAGC1_HUMAN)
PMQIPVSRSF

SEQ ID NO: 88219 - protein, 9 aa, Artificial Sequence
  Description of Artificial Sequence: Synthetic peptide
  Seed: TLLSILQSS (MAGC1_HUMAN)
TILSILQSL

SEQ ID NO: 88220 - protein, 10 aa, Artificial Sequence
  Description of Artificial Sequence: Synthetic peptide
  Seed: SFSYTLLSLF (MAGC1_HUMAN)
SPSYTLLSLW

SEQ ID NO: 88221 - protein, 9 aa, Artificial Sequence
  Description of Artificial Sequence: Synthetic peptide
  Seed: LQRPVSSFF (MAGC1_HUMAN)
LMRPVSSFM

SEQ ID NO: 88222 - protein, 9 aa, Artificial Sequence
  Description of Artificial Sequence: Synthetic peptide
  Seed: STFEGFAQS (MAGC1_HUMAN)
SQFEGFAQC

SEQ ID NO: 88223 - protein, 10 aa, Artificial Sequence
  Description of Artificial Sequence: Synthetic peptide
  Seed: NPASSFFSSA (MAGC1_HUMAN)
NTASSFFSSV

SEQ ID NO: 88224 - protein, 9 aa, Artificial Sequence
  Description of Artificial Sequence: Synthetic peptide
  Seed: SSSFSYTLL (MAGC1_HUMAN)
SASFSYTLM

SEQ ID NO: 88225 - protein, 10 aa, Artificial Sequence
  Description of Artificial Sequence: Synthetic peptide
  Seed: SPLQSPVSSF (MAGC1_HUMAN)
SQLQSPVSSM

SEQ ID NO: 88226 - protein, 10 aa, Artificial Sequence
  Description of Artificial Sequence: Synthetic peptide
  Seed: VSSSSSSTLL (MAGC1_HUMAN)
VGSSSSSTLF

SEQ ID NO: 88227 - protein, 11 aa, Artificial Sequence
  Description of Artificial Sequence: Synthetic peptide
  Seed: SSFSSTLLSIF (MAGC1_HUMAN)
SSFSSTLLSIY

SEQ ID NO: 88228 - protein, 9 aa, Artificial Sequence
  Description of Artificial Sequence: Synthetic peptide
  Seed: FAFGEPREL (MAGC1_HUMAN)
FEFGEPREM

SEQ ID NO: 88229 - protein, 9 aa, Artificial Sequence
  Description of Artificial Sequence: Synthetic peptide
  Seed: LQIPMTSSF (MAGC1_HUMAN)
LPIPMTSSI

SEQ ID NO: 88230 - protein, 10 aa, Artificial Sequence
  Description of Artificial Sequence: Synthetic peptide
  Seed: SFSYTLLSLF (MAGC1_HUMAN)
SLSYTLLSLF

SEQ ID NO: 88231 - protein, 9 aa, Artificial Sequence
  Description of Artificial Sequence: Synthetic peptide
  Seed: SPVDEYTSS (MAGC1_HUMAN)
SAVDEYTSL

SEQ ID NO: 88232 - protein, 9 aa, Artificial Sequence
  Description of Artificial Sequence: Synthetic peptide
  Seed: LQIPVSSSS (MAGC1_HUMAN)
LTIPVSSSI

SEQ ID NO: 88233 - protein, 9 aa, Artificial Sequence
  Description of Artificial Sequence: Synthetic peptide
  Seed: LSPLHFPQF (MAGC1_HUMAN)
LWPLHFPQF

SEQ ID NO: 88234 - protein, 8 aa, Artificial Sequence
  Description of Artificial Sequence: Synthetic peptide
  Seed: QSSPVSSF (MAGC1_HUMAN)
QMSPVSSY

SEQ ID NO: 88235 - protein, 8 aa, Artificial Sequence
  Description of Artificial Sequence: Synthetic peptide
  Seed: SSFSYTLL (MAGC1_HUMAN)
SSFSYTLF

SEQ ID NO: 88236 - protein, 10 aa, Artificial Sequence
  Description of Artificial Sequence: Synthetic peptide
  Seed: RLLILILSII (MAGC1_HUMAN)
RKLILILSIV

SEQ ID NO: 88237 - protein, 10 aa, Artificial Sequence
  Description of Artificial Sequence: Synthetic peptide
  Seed: VSSSSSSSTL (MAGC1_HUMAN)
VWSSSSSSTY

SEQ ID NO: 88238 - protein, 9 aa, Artificial Sequence
  Description of Artificial Sequence: Synthetic peptide
  Seed: IIDTTDDST (MAGC1_HUMAN)
IVDTTDDSF

SEQ ID NO: 88239 - protein, 11 aa, Artificial Sequence
  Description of Artificial Sequence: Synthetic peptide
  Seed: SSFPSSTSSSL (MAGC1_HUMAN)
SGFPSSTSSSF

SEQ ID NO: 88240 - protein, 9 aa, Artificial Sequence
  Description of Artificial Sequence: Synthetic peptide
  Seed: FQSSPERTH (MAGC1_HUMAN)
FISSPERTY

SEQ ID NO: 88241 - protein, 10 aa, Artificial Sequence
  Description of Artificial Sequence: Synthetic peptide
  Seed: KAREFIEILF (MAGC1_HUMAN)
KSREFIEILI

SEQ ID NO: 88242 - protein, 9 aa, Artificial Sequence
  Description of Artificial Sequence: Synthetic peptide
  Seed: STFEGFAQS (MAGC1_HUMAN)
SVFEGFAQC

SEQ ID NO: 88243 - protein, 9 aa, Artificial Sequence
  Description of Artificial Sequence: Synthetic peptide
  Seed: IPVSPSSSS (MAGC1_HUMAN)
IVVSPSSSY

SEQ ID NO: 88244 - protein, 10 aa, Artificial Sequence
  Description of Artificial Sequence: Synthetic peptide
  Seed: VSAASSSTLV (MAGC1_HUMAN)
VAAASSSTLW

SEQ ID NO: 88245 - protein, 11 aa, Artificial Sequence
  Description of Artificial Sequence: Synthetic peptide
  Seed: SLIESEPLFTY (MAGC1_HUMAN)
SMIESEPLFTV

SEQ ID NO: 88246 - protein, 8 aa, Artificial Sequence
  Description of Artificial Sequence: Synthetic peptide
  Seed: AFGEPREL (MAGC1_HUMAN)
AFGEPREM

SEQ ID NO: 88247 - protein, 9 aa, Artificial Sequence
  Description of Artificial Sequence: Synthetic peptide
  Seed: MLTNVISRY (MAGC1_HUMAN)
MSTNVISRM

SEQ ID NO: 88248 - protein, 10 aa, Artificial Sequence
  Description of Artificial Sequence: Synthetic peptide
  Seed: WGPRAHSEVI (MAGC1_HUMAN)
WAPRAHSEVV

SEQ ID NO: 88249 - protein, 9 aa, Artificial Sequence
  Description of Artificial Sequence: Synthetic peptide
  Seed: RSFSSTLLS (MAGC1_HUMAN)
RTFSSTLLF

SEQ ID NO: 88250 - protein, 9 aa, Artificial Sequence
  Description of Artificial Sequence: Synthetic peptide
  Seed: SSPEGKDSL (MAGC1_HUMAN)
SYPEGKDSY

SEQ ID NO: 88251 - protein, 9 aa, Artificial Sequence
  Description of Artificial Sequence: Synthetic peptide
  Seed: LKYQVKQPI (MAGC1_HUMAN)
LVYQVKQPF

SEQ ID NO: 88252 - protein, 10 aa, Artificial Sequence
  Description of Artificial Sequence: Synthetic peptide
  Seed: SRYTGYFPVI (MAGC1_HUMAN)
SCYTGYFPVL

SEQ ID NO: 88253 - protein, 9 aa, Artificial Sequence
  Description of Artificial Sequence: Synthetic peptide
  Seed: SLFQSFSER (MAGC1_HUMAN)
SAFQSFSEH

SEQ ID NO: 88254 - protein, 9 aa, Artificial Sequence
  Description of Artificial Sequence: Synthetic peptide
  Seed: LFGISLREV (MAGC1_HUMAN)
LYGISLREF

SEQ ID NO: 88255 - protein, 9 aa, Artificial Sequence
  Description of Artificial Sequence: Synthetic peptide
  Seed: NSSPPRYEF (MAGC1_HUMAN)
NYSPPRYEF

SEQ ID NO: 88256 - protein, 10 aa, Artificial Sequence
  Description of Artificial Sequence: Synthetic peptide
  Seed: SRYTGYFPVI (MAGC1_HUMAN)
SRYTGYFPVY

SEQ ID NO: 88257 - protein, 9 aa, Artificial Sequence
  Description of Artificial Sequence: Synthetic peptide
  Seed: IPVSPSSSS (MAGC1_HUMAN)
ISVSPSSSY

SEQ ID NO: 88258 - protein, 11 aa, Artificial Sequence
  Description of Artificial Sequence: Synthetic peptide
  Seed: KGTYASEEVIW (MAGC1_HUMAN)
KRTYASEEVIW

SEQ ID NO: 88259 - protein, 9 aa, Artificial Sequence
  Description of Artificial Sequence: Synthetic peptide
  Seed: FSYTLASLL (MAGC1_HUMAN)
FGYTLASLF

SEQ ID NO: 88260 - protein, 9 aa, Artificial Sequence
  Description of Artificial Sequence: Synthetic peptide
  Seed: SSSTLVSIF (MAGC1_HUMAN)
SQSTLVSIW

SEQ ID NO: 88261 - protein, 9 aa, Artificial Sequence
  Description of Artificial Sequence: Synthetic peptide
  Seed: IPVSPSFSS (MAGC1_HUMAN)
IPVSPSFSF

SEQ ID NO: 88262 - protein, 10 aa, Artificial Sequence
  Description of Artificial Sequence: Synthetic peptide
  Seed: SFPSSTSSSL (MAGC1_HUMAN)
SMPSSTSSSY

SEQ ID NO: 88263 - protein, 9 aa, Artificial Sequence
  Description of Artificial Sequence: Synthetic peptide
  Seed: SLSPFSEES (MAGC1_HUMAN)
SISPFSEEM

SEQ ID NO: 88264 - protein, 8 aa, Artificial Sequence
  Description of Artificial Sequence: Synthetic peptide
  Seed: SSFFSSAL (MAGC1_HUMAN)
SAFFSSAL

SEQ ID NO: 88265 - protein, 9 aa, Artificial Sequence
  Description of Artificial Sequence: Synthetic peptide
  Seed: LQIPVSPSF (MAGC1_HUMAN)
LPIPVSPSI

SEQ ID NO: 88266 - protein, 11 aa, Artificial Sequence
  Description of Artificial Sequence: Synthetic peptide
  Seed: KDMPTAGMPSL (MAGC1_HUMAN)
KEMPTAGMPSV

SEQ ID NO: 88267 - protein, 9 aa, Artificial Sequence
  Description of Artificial Sequence: Synthetic peptide
  Seed: YQVKQPITK (MAGC1_HUMAN)
YMVKQPITL

SEQ ID NO: 88268 - protein, 9 aa, Artificial Sequence
  Description of Artificial Sequence: Synthetic peptide
  Seed: QIVPSLPEW (MAGC1_HUMAN)
QPVPSLPEY

SEQ ID NO: 88269 - protein, 9 aa, Artificial Sequence
  Description of Artificial Sequence: Synthetic peptide
  Seed: SSPESTQSP (MAGC1_HUMAN)
SIPESTQSI

SEQ ID NO: 88270 - protein, 10 aa, Artificial Sequence
  Description of Artificial Sequence: Synthetic peptide
  Seed: SSPESAQSAF (MAGC1_HUMAN)
SLPESAQSAY

SEQ ID NO: 88271 - protein, 9 aa, Artificial Sequence
  Description of Artificial Sequence: Synthetic peptide
  Seed: MTSSFSSTL (MAGC1_HUMAN)
MVSSFSSTI

SEQ ID NO: 88272 - protein, 9 aa, Artificial Sequence
  Description of Artificial Sequence: Synthetic peptide
  Seed: RKAREFIEI (MAGC1_HUMAN)
RVAREFIEF

SEQ ID NO: 88273 - protein, 9 aa, Artificial Sequence
  Description of Artificial Sequence: Synthetic peptide
  Seed: VSSSFSYTL (MAGC1_HUMAN)
VRSSFSYTM

SEQ ID NO: 88274 - protein, 9 aa, Artificial Sequence
  Description of Artificial Sequence: Synthetic peptide
  Seed: FAFGEPREL (MAGC1_HUMAN)
FPFGEPREP

SEQ ID NO: 88275 - protein, 11 aa, Artificial Sequence
  Description of Artificial Sequence: Synthetic peptide
  Seed: SLSQSSPVSSF (MAGC1_HUMAN)
SGSQSSPVSSF

SEQ ID NO: 88276 - protein, 9 aa, Artificial Sequence
  Description of Artificial Sequence: Synthetic peptide
  Seed: SSPESAQSA (MAGC1_HUMAN)
SAPESAQSL

SEQ ID NO: 88277 - protein, 9 aa, Artificial Sequence
  Description of Artificial Sequence: Synthetic peptide
  Seed: ISRYTGYFP (MAGC1_HUMAN)
ITRYTGYFL

SEQ ID NO: 88278 - protein, 10 aa, Artificial Sequence
  Description of Artificial Sequence: Synthetic peptide
  Seed: YTLDEKVDEL (MAGC1_HUMAN)
YALDEKVDEI

SEQ ID NO: 88279 - protein, 11 aa, Artificial Sequence
  Description of Artificial Sequence: Synthetic peptide
  Seed: VDEYTSSSDTL (MAGC1_HUMAN)
VCEYTSSSDTF

SEQ ID NO: 88280 - protein, 9 aa, Artificial Sequence
  Description of Artificial Sequence: Synthetic peptide
  Seed: FEGFAQSSL (MAGC1_HUMAN)
FEGFAQSSI

SEQ ID NO: 88281 - protein, 9 aa, Artificial Sequence
  Description of Artificial Sequence: Synthetic peptide
  Seed: STQSPFEGF (MAGC1_HUMAN)
SVQSPFEGY

SEQ ID NO: 88282 - protein, 9 aa, Artificial Sequence
  Description of Artificial Sequence: Synthetic peptide
  Seed: SPPQGEDSM (MAGC1_HUMAN)
STPQGEDSL

SEQ ID NO: 88283 - protein, 9 aa, Artificial Sequence
  Description of Artificial Sequence: Synthetic peptide
  Seed: SSPESAQSA (MAGC1_HUMAN)
SAPESAQSY

SEQ ID NO: 88284 - protein, 9 aa, Artificial Sequence
  Description of Artificial Sequence: Synthetic peptide
  Seed: SSFFSSALL (MAGC1_HUMAN)
SVFFSSALM

SEQ ID NO: 88285 - protein, 10 aa, Artificial Sequence
  Description of Artificial Sequence: Synthetic peptide
  Seed: YVFVNTLDLT (MAGC1_HUMAN)
YLFVNTLDLV

SEQ ID NO: 88286 - protein, 9 aa, Artificial Sequence
  Description of Artificial Sequence: Synthetic peptide
  Seed: DSYVFVNTL (MAGC1_HUMAN)
DVYVFVNTK

SEQ ID NO: 88287 - protein, 9 aa, Artificial Sequence
  Description of Artificial Sequence: Synthetic peptide
  Seed: RAGREHFAF (MAGC1_HUMAN)
RLGREHFAW

SEQ ID NO: 88288 - protein, 10 aa, Artificial Sequence
  Description of Artificial Sequence: Synthetic peptide
  Seed: YVFVNTLDLT (MAGC1_HUMAN)
YTFVNTLDLI

SEQ ID NO: 88289 - protein, 10 aa, Artificial Sequence
  Description of Artificial Sequence: Synthetic peptide
  Seed: RKVVEFLAML (MAGC1_HUMAN)
RIVVEFLAMA

SEQ ID NO: 88290 - protein, 8 aa, Artificial Sequence
  Description of Artificial Sequence: Synthetic peptide
  Seed: SSFFSYTL (MAGC1_HUMAN)
SQFFSYTI

SEQ ID NO: 88291 - protein, 10 aa, Artificial Sequence
  Description of Artificial Sequence: Synthetic peptide
  Seed: SFPSSTSSSL (MAGC1_HUMAN)
SDPSSTSSSV

SEQ ID NO: 88292 - protein, 10 aa, Artificial Sequence
  Description of Artificial Sequence: Synthetic peptide
  Seed: ASSFFSSALL (MAGC1_HUMAN)
AVSFFSSALY

SEQ ID NO: 88293 - protein, 11 aa, Artificial Sequence
  Description of Artificial Sequence: Synthetic peptide
  Seed: VIWDVLSGIGV (MAGC1_HUMAN)
VQWDVLSGIGV

SEQ ID NO: 88294 - protein, 10 aa, Artificial Sequence
  Description of Artificial Sequence: Synthetic peptide
  Seed: ATESASSSVM (MAGC1_HUMAN)
AQESASSSVW

SEQ ID NO: 88295 - protein, 9 aa, Artificial Sequence
  Description of Artificial Sequence: Synthetic peptide
  Seed: REVPNSSPP (MAGC1_HUMAN)
REVPNSSPV

SEQ ID NO: 88296 - protein, 10 aa, Artificial Sequence
  Description of Artificial Sequence: Synthetic peptide
  Seed: TNVISRYTGY (MAGC1_HUMAN)
TMVISRYTGY

SEQ ID NO: 88297 - protein, 9 aa, Artificial Sequence
  Description of Artificial Sequence: Synthetic peptide
  Seed: SIIFIKGTY (MAGC1_HUMAN)
SVIFIKGTF

SEQ ID NO: 88298 - protein, 10 aa, Artificial Sequence
  Description of Artificial Sequence: Synthetic peptide
  Seed: MSPLYFPQSP (MAGC1_HUMAN)
MNPLYFPQSA

SEQ ID NO: 88299 - protein, 10 aa, Artificial Sequence
  Description of Artificial Sequence: Synthetic peptide
  Seed: SSSSSTLLSL (MAGC1_HUMAN)
SWSSSTLLSY

SEQ ID NO: 88300 - protein, 10 aa, Artificial Sequence
  Description of Artificial Sequence: Synthetic peptide
  Seed: ASSFFSSALL (MAGC1_HUMAN)
AESFFSSALV

SEQ ID NO: 88301 - protein, 9 aa, Artificial Sequence
  Description of Artificial Sequence: Synthetic peptide
  Seed: FAFGEPREL (MAGC1_HUMAN)
FTFGEPREY

SEQ ID NO: 88302 - protein, 10 aa, Artificial Sequence
  Description of Artificial Sequence: Synthetic peptide
  Seed: HSPLQIVPSL (MAGC1_HUMAN)
HTPLQIVPSW

SEQ ID NO: 88303 - protein, 10 aa, Artificial Sequence
  Description of Artificial Sequence: Synthetic peptide
  Seed: ASSSVMSPSF (MAGC1_HUMAN)
AASSVMSPSY

SEQ ID NO: 88304 - protein, 9 aa, Artificial Sequence
  Description of Artificial Sequence: Synthetic peptide
  Seed: KVVEFLAML (MAGC1_HUMAN)
KIVEFLAMM

SEQ ID NO: 88305 - protein, 8 aa, Artificial Sequence
  Description of Artificial Sequence: Synthetic peptide
  Seed: FSYTLLSL (MAGC1_HUMAN)
FAYTLLSI

SEQ ID NO: 88306 - protein, 11 aa, Artificial Sequence
  Description of Artificial Sequence: Synthetic peptide
  Seed: SPLQIPVSPSS (MAGC1_HUMAN)
STLQIPVSPSW

SEQ ID NO: 88307 - protein, 10 aa, Artificial Sequence
  Description of Artificial Sequence: Synthetic peptide
  Seed: STPSSLPQSF (MAGC1_HUMAN)
SNPSSLPQSL

SEQ ID NO: 88308 - protein, 9 aa, Artificial Sequence
  Description of Artificial Sequence: Synthetic peptide
  Seed: SFSSTLVSL (MAGC1_HUMAN)
SASSTLVSF

SEQ ID NO: 88309 - protein, 11 aa, Artificial Sequence
  Description of Artificial Sequence: Synthetic peptide
  Seed: SFSSSTSLSPF (MAGC1_HUMAN)
SYSSSTSLSPM

SEQ ID NO: 88310 - protein, 9 aa, Artificial Sequence
  Description of Artificial Sequence: Synthetic peptide
  Seed: FSSTLVSLF (MAGC1_HUMAN)
FSSTLVSLW

SEQ ID NO: 88311 - protein, 10 aa, Artificial Sequence
  Description of Artificial Sequence: Synthetic peptide
  Seed: SSSSSTLLSL (MAGC1_HUMAN)
SKSSSTLLSF

SEQ ID NO: 88312 - protein, 9 aa, Artificial Sequence
  Description of Artificial Sequence: Synthetic peptide
  Seed: YTLLSLFQS (MAGC1_HUMAN)
YILLSLFQA

SEQ ID NO: 88313 - protein, 10 aa, Artificial Sequence
  Description of Artificial Sequence: Synthetic peptide
  Seed: LQRPVSSFFS (MAGC1_HUMAN)
LLRPVSSFFY

SEQ ID NO: 88314 - protein, 9 aa, Artificial Sequence
  Description of Artificial Sequence: Synthetic peptide
  Seed: IESEPLFTY (MAGC1_HUMAN)
IESEPLFTP

SEQ ID NO: 88315 - protein, 10 aa, Artificial Sequence
  Description of Artificial Sequence: Synthetic peptide
  Seed: LQIPVSPSFS (MAGC1_HUMAN)
LQIPVSPSFV

SEQ ID NO: 88316 - protein, 9 aa, Artificial Sequence
  Description of Artificial Sequence: Synthetic peptide
  Seed: SFPSSTSSS (MAGC1_HUMAN)
SMPSSTSSM

SEQ ID NO: 88317 - protein, 9 aa, Artificial Sequence
  Description of Artificial Sequence: Synthetic peptide
  Seed: GPRAHSEVI (MAGC1_HUMAN)
GPRAHSEVV

SEQ ID NO: 88318 - protein, 11 aa, Artificial Sequence
  Description of Artificial Sequence: Synthetic peptide
  Seed: SSFFSSALLSI (MAGC1_HUMAN)
STFFSSALLSF

SEQ ID NO: 88319 - protein, 9 aa, Artificial Sequence
  Description of Artificial Sequence: Synthetic peptide
  Seed: FSYTLLSLF (MAGC1_HUMAN)
FRYTLLSLI

SEQ ID NO: 88320 - protein, 8 aa, Artificial Sequence
  Description of Artificial Sequence: Synthetic peptide
  Seed: FSSTLVSL (MAGC1_HUMAN)
FASTLVSL

SEQ ID NO: 88321 - protein, 9 aa, Artificial Sequence
  Description of Artificial Sequence: Synthetic peptide
  Seed: SQSPPEGPV (MAGC1_HUMAN)
SASPPEGPL

SEQ ID NO: 88322 - protein, 9 aa, Artificial Sequence
  Description of Artificial Sequence: Synthetic peptide
  Seed: AQSSLQIPV (MAGC1_HUMAN)
AHSSLQIPF

SEQ ID NO: 88323 - protein, 9 aa, Artificial Sequence
  Description of Artificial Sequence: Synthetic peptide
  Seed: SQSSPVSSF (MAGC1_HUMAN)
SDSSPVSSF

SEQ ID NO: 88324 - protein, 10 aa, Artificial Sequence
  Description of Artificial Sequence: Synthetic peptide
  Seed: FAFGEPRELL (MAGC1_HUMAN)
FAFGEPRELF

SEQ ID NO: 88325 - protein, 10 aa, Artificial Sequence
  Description of Artificial Sequence: Synthetic peptide
  Seed: TNVISRYTGY (MAGC1_HUMAN)
TVVISRYTGK

SEQ ID NO: 88326 - protein, 9 aa, Artificial Sequence
  Description of Artificial Sequence: Synthetic peptide
  Seed: VIKRKVVEF (MAGC1_HUMAN)
VMKRKVVEV

SEQ ID NO: 88327 - protein, 9 aa, Artificial Sequence
  Description of Artificial Sequence: Synthetic peptide
  Seed: SPLQRPVSS (MAGC1_HUMAN)
SPLQRPVST

SEQ ID NO: 88328 - protein, 9 aa, Artificial Sequence
  Description of Artificial Sequence: Synthetic peptide
  Seed: MLTNVISRY (MAGC1_HUMAN)
MGTNVISRW

SEQ ID NO: 88329 - protein, 9 aa, Artificial Sequence
  Description of Artificial Sequence: Synthetic peptide
  Seed: TFEGFPQSL (MAGC1_HUMAN)
TFEGFPQSF

SEQ ID NO: 88330 - protein, 9 aa, Artificial Sequence
  Description of Artificial Sequence: Synthetic peptide
  Seed: NPASSFFSS (MAGC1_HUMAN)
NGASSFFSY

SEQ ID NO: 88331 - protein, 9 aa, Artificial Sequence
  Description of Artificial Sequence: Synthetic peptide
  Seed: SSFFSYTLA (MAGC1_HUMAN)
STFFSYTLK

SEQ ID NO: 88332 - protein, 9 aa, Artificial Sequence
  Description of Artificial Sequence: Synthetic peptide
  Seed: SPVISFSSS (MAGC1_HUMAN)
SPVISFSSM

SEQ ID NO: 88333 - protein, 10 aa, Artificial Sequence
  Description of Artificial Sequence: Synthetic peptide
  Seed: AASSSTLVSI (MAGC1_HUMAN)
ATSSSTLVSY

SEQ ID NO: 88334 - protein, 10 aa, Artificial Sequence
  Description of Artificial Sequence: Synthetic peptide
  Seed: FFSYTLASLL (MAGC1_HUMAN)
FLSYTLASLW

SEQ ID NO: 88335 - protein, 9 aa, Artificial Sequence
  Description of Artificial Sequence: Synthetic peptide
  Seed: GYFPVIFRK (MAGC1_HUMAN)
GAFPVIFRK

SEQ ID NO: 88336 - protein, 9 aa, Artificial Sequence
  Description of Artificial Sequence: Synthetic peptide
  Seed: SIFQSSPER (MAGC1_HUMAN)
SIFQSSPEM

SEQ ID NO: 88337 - protein, 11 aa, Artificial Sequence
  Description of Artificial Sequence: Synthetic peptide
  Seed: SPLQIPVSSSS (MAGC1_HUMAN)
SPLQIPVSSSL

SEQ ID NO: 88338 - protein, 9 aa, Artificial Sequence
  Description of Artificial Sequence: Synthetic peptide
  Seed: SPQSPPEGP (MAGC1_HUMAN)
SLQSPPEGY

SEQ ID NO: 88339 - protein, 10 aa, Artificial Sequence
  Description of Artificial Sequence: Synthetic peptide
  Seed: SSSSSTLLSL (MAGC1_HUMAN)
SMSSSTLLSM

SEQ ID NO: 88340 - protein, 9 aa, Artificial Sequence
  Description of Artificial Sequence: Synthetic peptide
  Seed: SQNRLLILI (MAGC1_HUMAN)
SMNRLLILY

SEQ ID NO: 88341 - protein, 9 aa, Artificial Sequence
  Description of Artificial Sequence: Synthetic peptide
  Seed: AGREHFAFG (MAGC1_HUMAN)
AYREHFAFA

SEQ ID NO: 88342 - protein, 10 aa, Artificial Sequence
  Description of Artificial Sequence: Synthetic peptide
  Seed: EMLTNVISRY (MAGC1_HUMAN)
ETLTNVISRY

SEQ ID NO: 88343 - protein, 9 aa, Artificial Sequence
  Description of Artificial Sequence: Synthetic peptide
  Seed: SMSPLYFPQ (MAGC1_HUMAN)
SFSPLYFPK

SEQ ID NO: 88344 - protein, 11 aa, Artificial Sequence
  Description of Artificial Sequence: Synthetic peptide
  Seed: IPVSRSFSSTL (MAGC1_HUMAN)
IAVSRSFSSTY

SEQ ID NO: 88345 - protein, 9 aa, Artificial Sequence
  Description of Artificial Sequence: Synthetic peptide
  Seed: SSPESPLQS (MAGC1_HUMAN)
SIPESPLQF

SEQ ID NO: 88346 - protein, 9 aa, Artificial Sequence
  Description of Artificial Sequence: Synthetic peptide
  Seed: LQIPMTSSF (MAGC1_HUMAN)
LHIPMTSSY

SEQ ID NO: 88347 - protein, 9 aa, Artificial Sequence
  Description of Artificial Sequence: Synthetic peptide
  Seed: CSSSTPSSL (MAGC1_HUMAN)
CLSSTPSSY

SEQ ID NO: 88348 - protein, 10 aa, Artificial Sequence
  Description of Artificial Sequence: Synthetic peptide
  Seed: PLQIPVSSSF (MAGC1_HUMAN)
PMQIPVSSSW

SEQ ID NO: 88349 - protein, 9 aa, Artificial Sequence
  Description of Artificial Sequence: Synthetic peptide
  Seed: LQIPGSPSF (MAGC1_HUMAN)
LPIPGSPSH

SEQ ID NO: 88350 - protein, 8 aa, Artificial Sequence
  Description of Artificial Sequence: Synthetic peptide
  Seed: SSFFSSAL (MAGC1_HUMAN)
SLFFSSAF

SEQ ID NO: 88351 - protein, 9 aa, Artificial Sequence
  Description of Artificial Sequence: Synthetic peptide
  Seed: SSSVMSPSF (MAGC1_HUMAN)
SLSVMSPSF

SEQ ID NO: 88352 - protein, 10 aa, Artificial Sequence
  Description of Artificial Sequence: Synthetic peptide
  Seed: MPTAGMPSLL (MAGC1_HUMAN)
MITAGMPSLW

SEQ ID NO: 88353 - protein, 9 aa, Artificial Sequence
  Description of Artificial Sequence: Synthetic peptide
  Seed: ESDDTLYPL (MAGC1_HUMAN)
EVDDTLYPA

SEQ ID NO: 88354 - protein, 10 aa, Artificial Sequence
  Description of Artificial Sequence: Synthetic peptide
  Seed: ISRYTGYFPV (MAGC1_HUMAN)
IQRYTGYFPV

SEQ ID NO: 88355 - protein, 9 aa, Artificial Sequence
  Description of Artificial Sequence: Synthetic peptide
  Seed: LQNPASSFF (MAGC1_HUMAN)
LMNPASSFA

SEQ ID NO: 88356 - protein, 10 aa, Artificial Sequence
  Description of Artificial Sequence: Synthetic peptide
  Seed: YTLASLLQSS (MAGC1_HUMAN)
YPLASLLQST

SEQ ID NO: 88357 - protein, 9 aa, Artificial Sequence
  Description of Artificial Sequence: Synthetic peptide
  Seed: KVWVQEHYL (MAGC1_HUMAN)
KLWVQEHYF

SEQ ID NO: 88358 - protein, 10 aa, Artificial Sequence
  Description of Artificial Sequence: Synthetic peptide
  Seed: KAEMLTNVIS (MAGC1_HUMAN)
KDEMLTNVIA

SEQ ID NO: 88359 - protein, 9 aa, Artificial Sequence
  Description of Artificial Sequence: Synthetic peptide
  Seed: IFRKAREFI (MAGC1_HUMAN)
ISRKAREFK

SEQ ID NO: 88360 - protein, 11 aa, Artificial Sequence
  Description of Artificial Sequence: Synthetic peptide
  Seed: SSFFSYTLASL (MAGC1_HUMAN)
SAFFSYTLASF

SEQ ID NO: 88361 - protein, 9 aa, Artificial Sequence
  Description of Artificial Sequence: Synthetic peptide
  Seed: VQSPLQNPA (MAGC1_HUMAN)
VQSPLQNPI

SEQ ID NO: 88362 - protein, 9 aa, Artificial Sequence
  Description of Artificial Sequence: Synthetic peptide
  Seed: SSLSQSSPV (MAGC1_HUMAN)
SILSQSSPV

SEQ ID NO: 88363 - protein, 11 aa, Artificial Sequence
  Description of Artificial Sequence: Synthetic peptide
  Seed: SPLQIPVSSSS (MAGC1_HUMAN)
SMLQIPVSSSY

SEQ ID NO: 88364 - protein, 10 aa, Artificial Sequence
  Description of Artificial Sequence: Synthetic peptide
  Seed: SFPSSTSSSL (MAGC1_HUMAN)
SVPSSTSSSI

SEQ ID NO: 88365 - protein, 11 aa, Artificial Sequence
  Description of Artificial Sequence: Synthetic peptide
  Seed: KVWVQEHYLEY (MAGC1_HUMAN)
KTWVQEHYLEF

SEQ ID NO: 88366 - protein, 10 aa, Artificial Sequence
  Description of Artificial Sequence: Synthetic peptide
  Seed: ICSSSTSLSL (MAGC1_HUMAN)
IASSSTSLSY

SEQ ID NO: 88367 - protein, 9 aa, Artificial Sequence
  Description of Artificial Sequence: Synthetic peptide
  Seed: ALKDVEERA (MAGC1_HUMAN)
AVKDVEERI

SEQ ID NO: 88368 - protein, 9 aa, Artificial Sequence
  Description of Artificial Sequence: Synthetic peptide
  Seed: FSSALLSIF (MAGC1_HUMAN)
FASALLSIH

SEQ ID NO: 88369 - protein, 9 aa, Artificial Sequence
  Description of Artificial Sequence: Synthetic peptide
  Seed: GYFPVIFRK (MAGC1_HUMAN)
GWFPVIFRK

SEQ ID NO: 88370 - protein, 10 aa, Artificial Sequence
  Description of Artificial Sequence: Synthetic peptide
  Seed: LILILSIIFI (MAGC1_HUMAN)
LHLILSIIFV

SEQ ID NO: 88371 - protein, 9 aa, Artificial Sequence
  Description of Artificial Sequence: Synthetic peptide
  Seed: TLLSILQSS (MAGC1_HUMAN)
TLLSILQST

SEQ ID NO: 88372 - protein, 10 aa, Artificial Sequence
  Description of Artificial Sequence: Synthetic peptide
  Seed: MPTAGMPSLL (MAGC1_HUMAN)
MITAGMPSLF

SEQ ID NO: 88373 - protein, 10 aa, Artificial Sequence
  Description of Artificial Sequence: Synthetic peptide
  Seed: ASSFFSSALL (MAGC1_HUMAN)
AHSFFSSALW

SEQ ID NO: 88374 - protein, 9 aa, Artificial Sequence
  Description of Artificial Sequence: Synthetic peptide
  Seed: FQSSPERTH (MAGC1_HUMAN)
FASSPERTF

SEQ ID NO: 88375 - protein, 11 aa, Artificial Sequence
  Description of Artificial Sequence: Synthetic peptide
  Seed: TTDDSTATESA (MAGC1_HUMAN)
TMDDSTATESY

SEQ ID NO: 88376 - protein, 9 aa, Artificial Sequence
  Description of Artificial Sequence: Synthetic peptide
  Seed: RSFSSTLLS (MAGC1_HUMAN)
RLFSSTLLK

SEQ ID NO: 88377 - protein, 10 aa, Artificial Sequence
  Description of Artificial Sequence: Synthetic peptide
  Seed: FAFGEPRELL (MAGC1_HUMAN)
FAFGEPRELY

SEQ ID NO: 88378 - protein, 10 aa, Artificial Sequence
  Description of Artificial Sequence: Synthetic peptide
  Seed: FFSYTLASLL (MAGC1_HUMAN)
FPSYTLASLY

SEQ ID NO: 88379 - protein, 10 aa, Artificial Sequence
  Description of Artificial Sequence: Synthetic peptide
  Seed: ATESASSSVM (MAGC1_HUMAN)
AKESASSSVY

SEQ ID NO: 88380 - protein, 11 aa, Artificial Sequence
  Description of Artificial Sequence: Synthetic peptide
  Seed: AEMLTNVISRY (MAGC1_HUMAN)
AEMLTNVISRW

SEQ ID NO: 88381 - protein, 11 aa, Artificial Sequence
  Description of Artificial Sequence: Synthetic peptide
  Seed: SQSSPEGKDSL (MAGC1_HUMAN)
SESSPEGKDSF

SEQ ID NO: 88382 - protein, 9 aa, Artificial Sequence
  Description of Artificial Sequence: Synthetic peptide
  Seed: VPITFPSSY (MAGC1_HUMAN)
VKITFPSSI

SEQ ID NO: 88383 - protein, 9 aa, Artificial Sequence
  Description of Artificial Sequence: Synthetic peptide
  Seed: SSPECTQST (MAGC1_HUMAN)
SLPECTQSV

SEQ ID NO: 88384 - protein, 8 aa, Artificial Sequence
  Description of Artificial Sequence: Synthetic peptide
  Seed: FIEILFGI (MAGC1_HUMAN)
FMEILFGL

SEQ ID NO: 88385 - protein, 9 aa, Artificial Sequence
  Description of Artificial Sequence: Synthetic peptide
  Seed: FAFGEPREL (MAGC1_HUMAN)
FAFGEPRER

SEQ ID NO: 88386 - protein, 10 aa, Artificial Sequence
  Description of Artificial Sequence: Synthetic peptide
  Seed: GEDSLSPHYF (MAGC1_HUMAN)
GQDSLSPHYW

SEQ ID NO: 88387 - protein, 9 aa, Artificial Sequence
  Description of Artificial Sequence: Synthetic peptide
  Seed: LSDEQGMSQ (MAGC1_HUMAN)
LTDEQGMSM

SEQ ID NO: 88388 - protein, 9 aa, Artificial Sequence
  Description of Artificial Sequence: Synthetic peptide
  Seed: KVDELARFL (MAGC1_HUMAN)
KIDELARFY

SEQ ID NO: 88389 - protein, 9 aa, Artificial Sequence
  Description of Artificial Sequence: Synthetic peptide
  Seed: LQIPVSRSF (MAGC1_HUMAN)
LSIPVSRSI

SEQ ID NO: 88390 - protein, 8 aa, Artificial Sequence
  Description of Artificial Sequence: Synthetic peptide
  Seed: IFRKAREF (MAGC1_HUMAN)
IFRKAREL

SEQ ID NO: 88391 - protein, 9 aa, Artificial Sequence
  Description of Artificial Sequence: Synthetic peptide
  Seed: SSFFSYTLA (MAGC1_HUMAN)
SVFFSYTLK

SEQ ID NO: 88392 - protein, 8 aa, Artificial Sequence
  Description of Artificial Sequence: Synthetic peptide
  Seed: SSFFSSAL (MAGC1_HUMAN)
SAFFSSAF

SEQ ID NO: 88393 - protein, 9 aa, Artificial Sequence
  Description of Artificial Sequence: Synthetic peptide
  Seed: LQIPVSSSS (MAGC1_HUMAN)
LNIPVSSSW

SEQ ID NO: 88394 - protein, 11 aa, Artificial Sequence
  Description of Artificial Sequence: Synthetic peptide
  Seed: IPVSRSFSSTL (MAGC1_HUMAN)
ISVSRSFSSTF

SEQ ID NO: 88395 - protein, 9 aa, Artificial Sequence
  Description of Artificial Sequence: Synthetic peptide
  Seed: RKVVEFLAM (MAGC1_HUMAN)
RRVVEFLAF

SEQ ID NO: 88396 - protein, 8 aa, Artificial Sequence
  Description of Artificial Sequence: Synthetic peptide
  Seed: FSYTLASL (MAGC1_HUMAN)
FSYTLASW

SEQ ID NO: 88397 - protein, 9 aa, Artificial Sequence
  Description of Artificial Sequence: Synthetic peptide
  Seed: SSFPSSTSS (MAGC1_HUMAN)
SIFPSSTSY

SEQ ID NO: 88398 - protein, 8 aa, Artificial Sequence
  Description of Artificial Sequence: Synthetic peptide
  Seed: FGEPRELL (MAGC1_HUMAN)
FYEPRELL

SEQ ID NO: 88399 - protein, 10 aa, Artificial Sequence
  Description of Artificial Sequence: Synthetic peptide
  Seed: VISFSSSTSL (MAGC1_HUMAN)
VVSFSSSTSL

SEQ ID NO: 88400 - protein, 9 aa, Artificial Sequence
  Description of Artificial Sequence: Synthetic peptide
  Seed: SSPEGKDSL (MAGC1_HUMAN)
SLPEGKDSL

SEQ ID NO: 88401 - protein, 10 aa, Artificial Sequence
  Description of Artificial Sequence: Synthetic peptide
  Seed: SPLYFPQSPL (MAGC1_HUMAN)
SMLYFPQSPV

SEQ ID NO: 88402 - protein, 10 aa, Artificial Sequence
  Description of Artificial Sequence: Synthetic peptide
  Seed: SIFQSSPESA (MAGC1_HUMAN)
SVFQSSPESI

SEQ ID NO: 88403 - protein, 9 aa, Artificial Sequence
  Description of Artificial Sequence: Synthetic peptide
  Seed: RYTGYFPVI (MAGC1_HUMAN)
RYTGYFPVL

SEQ ID NO: 88404 - protein, 9 aa, Artificial Sequence
  Description of Artificial Sequence: Synthetic peptide
  Seed: RYTGYFPVI (MAGC1_HUMAN)
RTTGYFPVF

SEQ ID NO: 88405 - protein, 9 aa, Artificial Sequence
  Description of Artificial Sequence: Synthetic peptide
  Seed: ELARFLLLK (MAGC1_HUMAN)
EVARFLLLR

SEQ ID NO: 88406 - protein, 10 aa, Artificial Sequence
  Description of Artificial Sequence: Synthetic peptide
  Seed: SPQSPPEGPA (MAGC1_HUMAN)
SPQSPPEGPM

SEQ ID NO: 88407 - protein, 10 aa, Artificial Sequence
  Description of Artificial Sequence: Synthetic peptide
  Seed: ASSFFSSALL (MAGC1_HUMAN)
AKSFFSSALM

SEQ ID NO: 88408 - protein, 10 aa, Artificial Sequence
  Description of Artificial Sequence: Synthetic peptide
  Seed: SVLQIPVSAA (MAGC1_HUMAN)
SPLQIPVSAT

SEQ ID NO: 88409 - protein, 9 aa, Artificial Sequence
  Description of Artificial Sequence: Synthetic peptide
  Seed: AMLKNTVPI (MAGC1_HUMAN)
AILKNTVPI

SEQ ID NO: 88410 - protein, 10 aa, Artificial Sequence
  Description of Artificial Sequence: Synthetic peptide
  Seed: RKVVEFLAML (MAGC1_HUMAN)
RMVVEFLAML

SEQ ID NO: 88411 - protein, 9 aa, Artificial Sequence
  Description of Artificial Sequence: Synthetic peptide
  Seed: SVLQIPVSA (MAGC1_HUMAN)
SALQIPVSA

SEQ ID NO: 88412 - protein, 9 aa, Artificial Sequence
  Description of Artificial Sequence: Synthetic peptide
  Seed: GFPQSVLQI (MAGC1_HUMAN)
GRPQSVLQY

SEQ ID NO: 88413 - protein, 9 aa, Artificial Sequence
  Description of Artificial Sequence: Synthetic peptide
  Seed: TESASSSVM (MAGC1_HUMAN)
THSASSSVM

SEQ ID NO: 88414 - protein, 9 aa, Artificial Sequence
  Description of Artificial Sequence: Synthetic peptide
  Seed: NTHSPLQIV (MAGC1_HUMAN)
NIHSPLQIY

SEQ ID NO: 88415 - protein, 9 aa, Artificial Sequence
  Description of Artificial Sequence: Synthetic peptide
  Seed: FEGFAQSPL (MAGC1_HUMAN)
FKGFAQSPL

SEQ ID NO: 88416 - protein, 9 aa, Artificial Sequence
  Description of Artificial Sequence: Synthetic peptide
  Seed: SSSSSSSTL (MAGC1_HUMAN)
SSSSSSSTY

SEQ ID NO: 88417 - protein, 10 aa, Artificial Sequence
  Description of Artificial Sequence: Synthetic peptide
  Seed: SFSYTLLSLF (MAGC1_HUMAN)
SRSYTLLSLY

SEQ ID NO: 88418 - protein, 9 aa, Artificial Sequence
  Description of Artificial Sequence: Synthetic peptide
  Seed: LQSPVISFS (MAGC1_HUMAN)
LQSPVISFM

SEQ ID NO: 88419 - protein, 10 aa, Artificial Sequence
  Description of Artificial Sequence: Synthetic peptide
  Seed: TLDEKVDELA (MAGC1_HUMAN)
TLDEKVDELM

SEQ ID NO: 88420 - protein, 11 aa, Artificial Sequence
  Description of Artificial Sequence: Synthetic peptide
  Seed: IPVSSSSSSTL (MAGC1_HUMAN)
IQVSSSSSSTY

SEQ ID NO: 88421 - protein, 9 aa, Artificial Sequence
  Description of Artificial Sequence: Synthetic peptide
  Seed: KDSQSPLQI (MAGC1_HUMAN)
KESQSPLQA

SEQ ID NO: 88422 - protein, 9 aa, Artificial Sequence
  Description of Artificial Sequence: Synthetic peptide
  Seed: LSPLHFPQF (MAGC1_HUMAN)
LRPLHFPQF

SEQ ID NO: 88423 - protein, 9 aa, Artificial Sequence
  Description of Artificial Sequence: Synthetic peptide
  Seed: RSFSSTLLS (MAGC1_HUMAN)
RYFSSTLLA

SEQ ID NO: 88424 - protein, 10 aa, Artificial Sequence
  Description of Artificial Sequence: Synthetic peptide
  Seed: FAFGEPRELL (MAGC1_HUMAN)
FIFGEPRELA

SEQ ID NO: 88425 - protein, 8 aa, Artificial Sequence
  Description of Artificial Sequence: Synthetic peptide
  Seed: KVDELARF (MAGC1_HUMAN)
KLDELARL

SEQ ID NO: 88426 - protein, 9 aa, Artificial Sequence
  Description of Artificial Sequence: Synthetic peptide
  Seed: VSSFFSYTL (MAGC1_HUMAN)
VVSFFSYTL

SEQ ID NO: 88427 - protein, 11 aa, Artificial Sequence
  Description of Artificial Sequence: Synthetic peptide
  Seed: SPLQNPASSFF (MAGC1_HUMAN)
SVLQNPASSFF

SEQ ID NO: 88428 - protein, 9 aa, Artificial Sequence
  Description of Artificial Sequence: Synthetic peptide
  Seed: SPESDDTLY (MAGC1_HUMAN)
SSESDDTLY

SEQ ID NO: 88429 - protein, 9 aa, Artificial Sequence
  Description of Artificial Sequence: Synthetic peptide
  Seed: SSSESPQSC (MAGC1_HUMAN)
SISESPQSF

SEQ ID NO: 88430 - protein, 9 aa, Artificial Sequence
  Description of Artificial Sequence: Synthetic peptide
  Seed: VSPSSSSTL (MAGC1_HUMAN)
VQPSSSSTL

SEQ ID NO: 88431 - protein, 9 aa, Artificial Sequence
  Description of Artificial Sequence: Synthetic peptide
  Seed: SSSTSLSPF (MAGC1_HUMAN)
SYSTSLSPV

SEQ ID NO: 88432 - protein, 9 aa, Artificial Sequence
  Description of Artificial Sequence: Synthetic peptide
  Seed: VQSPLQNPA (MAGC1_HUMAN)
VESPLQNPI

SEQ ID NO: 88433 - protein, 9 aa, Artificial Sequence
  Description of Artificial Sequence: Synthetic peptide
  Seed: FLWGPRAHS (MAGC1_HUMAN)
FTWGPRAHV

SEQ ID NO: 88434 - protein, 9 aa, Artificial Sequence
  Description of Artificial Sequence: Synthetic peptide
  Seed: FQSSLQSPV (MAGC1_HUMAN)
FYSSLQSPF

SEQ ID NO: 88435 - protein, 10 aa, Artificial Sequence
  Description of Artificial Sequence: Synthetic peptide
  Seed: STLLSLFQSF (MAGC1_HUMAN)
SSLLSLFQSF

SEQ ID NO: 88436 - protein, 9 aa, Artificial Sequence
  Description of Artificial Sequence: Synthetic peptide
  Seed: VSPSFSSTL (MAGC1_HUMAN)
VLPSFSSTF

SEQ ID NO: 88437 - protein, 9 aa, Artificial Sequence
  Description of Artificial Sequence: Synthetic peptide
  Seed: EMLTNVISR (MAGC1_HUMAN)
ELLTNVISK

SEQ ID NO: 88438 - protein, 9 aa, Artificial Sequence
  Description of Artificial Sequence: Synthetic peptide
  Seed: LQRPVSSFF (MAGC1_HUMAN)
LSRPVSSFL

SEQ ID NO: 88439 - protein, 9 aa, Artificial Sequence
  Description of Artificial Sequence: Synthetic peptide
  Seed: VQSPLQNPA (MAGC1_HUMAN)
VMSPLQNPY

SEQ ID NO: 88440 - protein, 11 aa, Artificial Sequence
  Description of Artificial Sequence: Synthetic peptide
  Seed: RPVSSFFSYTL (MAGC1_HUMAN)
REVSSFFSYTF

SEQ ID NO: 88441 - protein, 9 aa, Artificial Sequence
  Description of Artificial Sequence: Synthetic peptide
  Seed: FEGFAQSPL (MAGC1_HUMAN)
FMGFAQSPF

SEQ ID NO: 88442 - protein, 9 aa, Artificial Sequence
  Description of Artificial Sequence: Synthetic peptide
  Seed: GTYASEEVI (MAGC1_HUMAN)
GQYASEEVL

SEQ ID NO: 88443 - protein, 9 aa, Artificial Sequence
  Description of Artificial Sequence: Synthetic peptide
  Seed: IIDTTDDST (MAGC1_HUMAN)
IADTTDDSI

SEQ ID NO: 88444 - protein, 11 aa, Artificial Sequence
  Description of Artificial Sequence: Synthetic peptide
  Seed: SPLQIPVSRSF (MAGC1_HUMAN)
SDLQIPVSRSF

SEQ ID NO: 88445 - protein, 9 aa, Artificial Sequence
  Description of Artificial Sequence: Synthetic peptide
  Seed: SLTDSESLI (MAGC1_HUMAN)
SLTDSESLF

SEQ ID NO: 88446 - protein, 10 aa, Artificial Sequence
  Description of Artificial Sequence: Synthetic peptide
  Seed: YTLASLLQSS (MAGC1_HUMAN)
YWLASLLQSM

SEQ ID NO: 88447 - protein, 10 aa, Artificial Sequence
  Description of Artificial Sequence: Synthetic peptide
  Seed: LQIVPSLPEW (MAGC1_HUMAN)
LTIVPSLPEY

SEQ ID NO: 88448 - protein, 9 aa, Artificial Sequence
  Description of Artificial Sequence: Synthetic peptide
  Seed: VQEHYLEYR (MAGC1_HUMAN)
VLEHYLEYY

SEQ ID NO: 88449 - protein, 10 aa, Artificial Sequence
  Description of Artificial Sequence: Synthetic peptide
  Seed: ISRYTGYFPV (MAGC1_HUMAN)
IMRYTGYFPF

SEQ ID NO: 88450 - protein, 9 aa, Artificial Sequence
  Description of Artificial Sequence: Synthetic peptide
  Seed: SPVSICSSS (MAGC1_HUMAN)
SPVSICSSF

SEQ ID NO: 88451 - protein, 9 aa, Artificial Sequence
  Description of Artificial Sequence: Synthetic peptide
  Seed: LILSIIFIK (MAGC1_HUMAN)
LVLSIIFIK

SEQ ID NO: 88452 - protein, 10 aa, Artificial Sequence
  Description of Artificial Sequence: Synthetic peptide
  Seed: SPLQSPVSSF (MAGC1_HUMAN)
SQLQSPVSSF

SEQ ID NO: 88453 - protein, 9 aa, Artificial Sequence
  Description of Artificial Sequence: Synthetic peptide
  Seed: LLSLFQSFS (MAGC1_HUMAN)
LMSLFQSFV

SEQ ID NO: 88454 - protein, 9 aa, Artificial Sequence
  Description of Artificial Sequence: Synthetic peptide
  Seed: SFFSYTLAS (MAGC1_HUMAN)
SMFSYTLAM

SEQ ID NO: 88455 - protein, 9 aa, Artificial Sequence
  Description of Artificial Sequence: Synthetic peptide
  Seed: ISFSSSTSL (MAGC1_HUMAN)
IVFSSSTSV

SEQ ID NO: 88456 - protein, 10 aa, Artificial Sequence
  Description of Artificial Sequence: Synthetic peptide
  Seed: WGPRAHSEVI (MAGC1_HUMAN)
WNPRAHSEVM

SEQ ID NO: 88457 - protein, 9 aa, Artificial Sequence
  Description of Artificial Sequence: Synthetic peptide
  Seed: IPVSSSFSY (MAGC1_HUMAN)
IRVSSSFSY

SEQ ID NO: 88458 - protein, 10 aa, Artificial Sequence
  Description of Artificial Sequence: Synthetic peptide
  Seed: FSSSTSLSPF (MAGC1_HUMAN)
FLSSTSLSPW

SEQ ID NO: 88459 - protein, 11 aa, Artificial Sequence
  Description of Artificial Sequence: Synthetic peptide
  Seed: TTDDSTATESA (MAGC1_HUMAN)
TADDSTATESF

SEQ ID NO: 88460 - protein, 10 aa, Artificial Sequence
  Description of Artificial Sequence: Synthetic peptide
  Seed: EMLTNVISRY (MAGC1_HUMAN)
ETLTNVISRF

SEQ ID NO: 88461 - protein, 9 aa, Artificial Sequence
  Description of Artificial Sequence: Synthetic peptide
  Seed: TLDEKVDEL (MAGC1_HUMAN)
TNDEKVDEF

SEQ ID NO: 88462 - protein, 9 aa, Artificial Sequence
  Description of Artificial Sequence: Synthetic peptide
  Seed: VSPSSSSTL (MAGC1_HUMAN)
VTPSSSSTF

SEQ ID NO: 88463 - protein, 9 aa, Artificial Sequence
  Description of Artificial Sequence: Synthetic peptide
  Seed: FFSYTLASL (MAGC1_HUMAN)
FWSYTLASY

SEQ ID NO: 88464 - protein, 11 aa, Artificial Sequence
  Description of Artificial Sequence: Synthetic peptide
  Seed: SPLQIPMTSSF (MAGC1_HUMAN)
SHLQIPMTSSF

SEQ ID NO: 88465 - protein, 11 aa, Artificial Sequence
  Description of Artificial Sequence: Synthetic peptide
  Seed: SICSSSTSLSL (MAGC1_HUMAN)
SQCSSSTSLSL

SEQ ID NO: 88466 - protein, 9 aa, Artificial Sequence
  Description of Artificial Sequence: Synthetic peptide
  Seed: SICSSSTSL (MAGC1_HUMAN)
SYCSSSTSY

SEQ ID NO: 88467 - protein, 9 aa, Artificial Sequence
  Description of Artificial Sequence: Synthetic peptide
  Seed: TLVSIFQSS (MAGC1_HUMAN)
TAVSIFQSL

SEQ ID NO: 88468 - protein, 10 aa, Artificial Sequence
  Description of Artificial Sequence: Synthetic peptide
  Seed: VSAASSSTLV (MAGC1_HUMAN)
VMAASSSTLV

SEQ ID NO: 88469 - protein, 10 aa, Artificial Sequence
  Description of Artificial Sequence: Synthetic peptide
  Seed: RAHSEVIKRK (MAGC1_HUMAN)
RMHSEVIKRK

SEQ ID NO: 88470 - protein, 9 aa, Artificial Sequence
  Description of Artificial Sequence: Synthetic peptide
  Seed: VSPSFSSTL (MAGC1_HUMAN)
VQPSFSSTF

SEQ ID NO: 88471 - protein, 8 aa, Artificial Sequence
  Description of Artificial Sequence: Synthetic peptide
  Seed: SLSLPQSF (MAGC1_HUMAN)
SASLPQSL

SEQ ID NO: 88472 - protein, 9 aa, Artificial Sequence
  Description of Artificial Sequence: Synthetic peptide
  Seed: HFPQSPPEW (MAGC1_HUMAN)
HQPQSPPEL

SEQ ID NO: 88473 - protein, 9 aa, Artificial Sequence
  Description of Artificial Sequence: Synthetic peptide
  Seed: AQSPLQSPV (MAGC1_HUMAN)
AISPLQSPF

SEQ ID NO: 88474 - protein, 9 aa, Artificial Sequence
  Description of Artificial Sequence: Synthetic peptide
  Seed: KAREFIEIL (MAGC1_HUMAN)
KSREFIEIV

SEQ ID NO: 88475 - protein, 9 aa, Artificial Sequence
  Description of Artificial Sequence: Synthetic peptide
  Seed: LQIPMTSSF (MAGC1_HUMAN)
LNIPMTSSF

SEQ ID NO: 88476 - protein, 10 aa, Artificial Sequence
  Description of Artificial Sequence: Synthetic peptide
  Seed: SPLQSPVSSF (MAGC1_HUMAN)
SPLQSPVSST

SEQ ID NO: 88477 - protein, 9 aa, Artificial Sequence
  Description of Artificial Sequence: Synthetic peptide
  Seed: SLIESEPLF (MAGC1_HUMAN)
SLIESEPLY

SEQ ID NO: 88478 - protein, 10 aa, Artificial Sequence
  Description of Artificial Sequence: Synthetic peptide
  Seed: FAQSSLQIPV (MAGC1_HUMAN)
FRQSSLQIPV

SEQ ID NO: 88479 - protein, 8 aa, Artificial Sequence
  Description of Artificial Sequence: Synthetic peptide
  Seed: SSPPRYEF (MAGC1_HUMAN)
SSPPRYEY

SEQ ID NO: 88480 - protein, 9 aa, Artificial Sequence
  Description of Artificial Sequence: Synthetic peptide
  Seed: VLSGIGVRA (MAGC1_HUMAN)
VTSGIGVRI

SEQ ID NO: 88481 - protein, 9 aa, Artificial Sequence
  Description of Artificial Sequence: Synthetic peptide
  Seed: STFEGFAQS (MAGC1_HUMAN)
SEFEGFAQV

SEQ ID NO: 88482 - protein, 11 aa, Artificial Sequence
  Description of Artificial Sequence: Synthetic peptide
  Seed: SPLQIPGSPSF (MAGC1_HUMAN)
SPLQIPGSPSW

SEQ ID NO: 88483 - protein, 10 aa, Artificial Sequence
  Description of Artificial Sequence: Synthetic peptide
  Seed: MSPLYFPQSP (MAGC1_HUMAN)
MMPLYFPQSA

SEQ ID NO: 88484 - protein, 9 aa, Artificial Sequence
  Description of Artificial Sequence: Synthetic peptide
  Seed: KDVEERAQA (MAGC1_HUMAN)
KEVEERAQV

SEQ ID NO: 88485 - protein, 9 aa, Artificial Sequence
  Description of Artificial Sequence: Synthetic peptide
  Seed: SLPEWEDSL (MAGC1_HUMAN)
SHPEWEDSM

SEQ ID NO: 88486 - protein, 9 aa, Artificial Sequence
  Description of Artificial Sequence: Synthetic peptide
  Seed: RFLLLKYQV (MAGC1_HUMAN)
RWLLLKYQV

SEQ ID NO: 88487 - protein, 10 aa, Artificial Sequence
  Description of Artificial Sequence: Synthetic peptide
  Seed: SSPERTHSTF (MAGC1_HUMAN)
SLPERTHSTI

SEQ ID NO: 88488 - protein, 9 aa, Artificial Sequence
  Description of Artificial Sequence: Synthetic peptide
  Seed: LQIPMTSSF (MAGC1_HUMAN)
LKIPMTSSF

SEQ ID NO: 88489 - protein, 10 aa, Artificial Sequence
  Description of Artificial Sequence: Synthetic peptide
  Seed: ATESASSSVM (MAGC1_HUMAN)
ACESASSSVL

SEQ ID NO: 88490 - protein, 10 aa, Artificial Sequence
  Description of Artificial Sequence: Synthetic peptide
  Seed: SSFSSTLLSI (MAGC1_HUMAN)
STFSSTLLSK

SEQ ID NO: 88491 - protein, 9 aa, Artificial Sequence
  Description of Artificial Sequence: Synthetic peptide
  Seed: YTLASLLQS (MAGC1_HUMAN)
YMLASLLQV

SEQ ID NO: 88492 - protein, 9 aa, Artificial Sequence
  Description of Artificial Sequence: Synthetic peptide
  Seed: SPPEGENTH (MAGC1_HUMAN)
STPEGENTY

SEQ ID NO: 88493 - protein, 9 aa, Artificial Sequence
  Description of Artificial Sequence: Synthetic peptide
  Seed: VSSSFSYTL (MAGC1_HUMAN)
VKSSFSYTF

SEQ ID NO: 88494 - protein, 9 aa, Artificial Sequence
  Description of Artificial Sequence: Synthetic peptide
  Seed: ASSSTLVSI (MAGC1_HUMAN)
ATSSTLVSF

SEQ ID NO: 88495 - protein, 9 aa, Artificial Sequence
  Description of Artificial Sequence: Synthetic peptide
  Seed: SLIESEPLF (MAGC1_HUMAN)
SQIESEPLV

SEQ ID NO: 88496 - protein, 9 aa, Artificial Sequence
  Description of Artificial Sequence: Synthetic peptide
  Seed: VSSSFSYTL (MAGC1_HUMAN)
VQSSFSYTL

SEQ ID NO: 88497 - protein, 9 aa, Artificial Sequence
  Description of Artificial Sequence: Synthetic peptide
  Seed: EDSLSPHYF (MAGC1_HUMAN)
EESLSPHYY

SEQ ID NO: 88498 - protein, 9 aa, Artificial Sequence
  Description of Artificial Sequence: Synthetic peptide
  Seed: TTDDSTATE (MAGC1_HUMAN)
TIDDSTATC

SEQ ID NO: 88499 - protein, 9 aa, Artificial Sequence
  Description of Artificial Sequence: Synthetic peptide
  Seed: LQIPMTSSF (MAGC1_HUMAN)
LGIPMTSSL

SEQ ID NO: 88500 - protein, 9 aa, Artificial Sequence
  Description of Artificial Sequence: Synthetic peptide
  Seed: GSPSFSSTL (MAGC1_HUMAN)
GQPSFSSTV

SEQ ID NO: 88501 - protein, 11 aa, Artificial Sequence
  Description of Artificial Sequence: Synthetic peptide
  Seed: SPLQIPGSPSF (MAGC1_HUMAN)
SQLQIPGSPSY

SEQ ID NO: 88502 - protein, 10 aa, Artificial Sequence
  Description of Artificial Sequence: Synthetic peptide
  Seed: REHFAFGEPR (MAGC1_HUMAN)
RGHFAFGEPR

SEQ ID NO: 88503 - protein, 9 aa, Artificial Sequence
  Description of Artificial Sequence: Synthetic peptide
  Seed: SPLQRPVSS (MAGC1_HUMAN)
SVLQRPVSI

SEQ ID NO: 88504 - protein, 9 aa, Artificial Sequence
  Description of Artificial Sequence: Synthetic peptide
  Seed: VIFRKAREF (MAGC1_HUMAN)
VAFRKAREV

SEQ ID NO: 88505 - protein, 9 aa, Artificial Sequence
  Description of Artificial Sequence: Synthetic peptide
  Seed: NPASSFFSS (MAGC1_HUMAN)
NVASSFFSM

SEQ ID NO: 88506 - protein, 10 aa, Artificial Sequence
  Description of Artificial Sequence: Synthetic peptide
  Seed: SSPECTQSTF (MAGC1_HUMAN)
SYPECTQSTF

SEQ ID NO: 88507 - protein, 9 aa, Artificial Sequence
  Description of Artificial Sequence: Synthetic peptide
  Seed: ASSFFSSAL (MAGC1_HUMAN)
ALSFFSSAA

SEQ ID NO: 88508 - protein, 9 aa, Artificial Sequence
  Description of Artificial Sequence: Synthetic peptide
  Seed: WVQEHYLEY (MAGC1_HUMAN)
WWQEHYLEL

SEQ ID NO: 88509 - protein, 9 aa, Artificial Sequence
  Description of Artificial Sequence: Synthetic peptide
  Seed: FQSSLQSPV (MAGC1_HUMAN)
FTSSLQSPA

SEQ ID NO: 88510 - protein, 10 aa, Artificial Sequence
  Description of Artificial Sequence: Synthetic peptide
  Seed: SYVFVNTLDL (MAGC1_HUMAN)
SYVFVNTLDI

SEQ ID NO: 88511 - protein, 10 aa, Artificial Sequence
  Description of Artificial Sequence: Synthetic peptide
  Seed: QGEDSLSPHY (MAGC1_HUMAN)
QSEDSLSPHY

SEQ ID NO: 88512 - protein, 9 aa, Artificial Sequence
  Description of Artificial Sequence: Synthetic peptide
  Seed: SASSSVMSP (MAGC1_HUMAN)
SASSSVMSY

SEQ ID NO: 88513 - protein, 9 aa, Artificial Sequence
  Description of Artificial Sequence: Synthetic peptide
  Seed: SAQSTFEGF (MAGC1_HUMAN)
SLQSTFEGF

SEQ ID NO: 88514 - protein, 9 aa, Artificial Sequence
  Description of Artificial Sequence: Synthetic peptide
  Seed: VSPSSSSTL (MAGC1_HUMAN)
VWPSSSSTL

SEQ ID NO: 88515 - protein, 9 aa, Artificial Sequence
  Description of Artificial Sequence: Synthetic peptide
  Seed: LQIPVSPSF (MAGC1_HUMAN)
LHIPVSPSM

SEQ ID NO: 88516 - protein, 10 aa, Artificial Sequence
  Description of Artificial Sequence: Synthetic peptide
  Seed: PLQIPGSPSF (MAGC1_HUMAN)
PHQIPGSPSF

SEQ ID NO: 88517 - protein, 9 aa, Artificial Sequence
  Description of Artificial Sequence: Synthetic peptide
  Seed: MTSSFSSTL (MAGC1_HUMAN)
MASSFSSTY

SEQ ID NO: 88518 - protein, 11 aa, Artificial Sequence
  Description of Artificial Sequence: Synthetic peptide
  Seed: KRKVVEFLAML (MAGC1_HUMAN)
KHKVVEFLAMV

SEQ ID NO: 88519 - protein, 9 aa, Artificial Sequence
  Description of Artificial Sequence: Synthetic peptide
  Seed: FEGFPQSVL (MAGC1_HUMAN)
FQGFPQSVY

SEQ ID NO: 88520 - protein, 9 aa, Artificial Sequence
  Description of Artificial Sequence: Synthetic peptide
  Seed: ASSSTLVSI (MAGC1_HUMAN)
ASSSTLVSM

SEQ ID NO: 88521 - protein, 9 aa, Artificial Sequence
  Description of Artificial Sequence: Synthetic peptide
  Seed: SSSTLLSLF (MAGC1_HUMAN)
STSTLLSLM

SEQ ID NO: 88522 - protein, 9 aa, Artificial Sequence
  Description of Artificial Sequence: Synthetic peptide
  Seed: MSQNRLLIL (MAGC1_HUMAN)
MFQNRLLIF

SEQ ID NO: 88523 - protein, 8 aa, Artificial Sequence
  Description of Artificial Sequence: Synthetic peptide
  Seed: SQNRLLIL (MAGC1_HUMAN)
SQNRLLIF

SEQ ID NO: 88524 - protein, 9 aa, Artificial Sequence
  Description of Artificial Sequence: Synthetic peptide
  Seed: TFEGFPQSL (MAGC1_HUMAN)
THEGFPQSM

SEQ ID NO: 88525 - protein, 11 aa, Artificial Sequence
  Description of Artificial Sequence: Synthetic peptide
  Seed: EGEDSSDPLQR (MAGC1_HUMAN)
EVEDSSDPLQK

SEQ ID NO: 88526 - protein, 9 aa, Artificial Sequence
  Description of Artificial Sequence: Synthetic peptide
  Seed: LQRPVSSFF (MAGC1_HUMAN)
LVRPVSSFY

SEQ ID NO: 88527 - protein, 10 aa, Artificial Sequence
  Description of Artificial Sequence: Synthetic peptide
  Seed: LLQIPMTSSF (MAGC1_HUMAN)
LCQIPMTSSF

SEQ ID NO: 88528 - protein, 9 aa, Artificial Sequence
  Description of Artificial Sequence: Synthetic peptide
  Seed: VSSFFSYTL (MAGC1_HUMAN)
VLSFFSYTT

SEQ ID NO: 88529 - protein, 9 aa, Artificial Sequence
  Description of Artificial Sequence: Synthetic peptide
  Seed: FFSSALLSI (MAGC1_HUMAN)
FTSSALLSV

SEQ ID NO: 88530 - protein, 10 aa, Artificial Sequence
  Description of Artificial Sequence: Synthetic peptide
  Seed: SPLQSPVSSF (MAGC1_HUMAN)
SVLQSPVSSF

SEQ ID NO: 88531 - protein, 10 aa, Artificial Sequence
  Description of Artificial Sequence: Synthetic peptide
  Seed: SFSYTLLSLF (MAGC1_HUMAN)
SESYTLLSLF

SEQ ID NO: 88532 - protein, 10 aa, Artificial Sequence
  Description of Artificial Sequence: Synthetic peptide
  Seed: LLQIPMTSSF (MAGC1_HUMAN)
LAQIPMTSSY

SEQ ID NO: 88533 - protein, 11 aa, Artificial Sequence
  Description of Artificial Sequence: Synthetic peptide
  Seed: SQSPLQSPESA (MAGC1_HUMAN)
SESPLQSPESA

SEQ ID NO: 88534 - protein, 10 aa, Artificial Sequence
  Description of Artificial Sequence: Synthetic peptide
  Seed: YASEEVIWDV (MAGC1_HUMAN)
YMSEEVIWDT

SEQ ID NO: 88535 - protein, 9 aa, Artificial Sequence
  Description of Artificial Sequence: Synthetic peptide
  Seed: FSSALLSIF (MAGC1_HUMAN)
FSSALLSIV

SEQ ID NO: 88536 - protein, 9 aa, Artificial Sequence
  Description of Artificial Sequence: Synthetic peptide
  Seed: SPLQSPVIS (MAGC1_HUMAN)
SPLQSPVIL

SEQ ID NO: 88537 - protein, 9 aa, Artificial Sequence
  Description of Artificial Sequence: Synthetic peptide
  Seed: TFEGFPQSL (MAGC1_HUMAN)
TREGFPQSY

SEQ ID NO: 88538 - protein, 9 aa, Artificial Sequence
  Description of Artificial Sequence: Synthetic peptide
  Seed: SPLQSPVSS (MAGC1_HUMAN)
SPLQSPVSF

SEQ ID NO: 88539 - protein, 10 aa, Artificial Sequence
  Description of Artificial Sequence: Synthetic peptide
  Seed: MTSSFSSTLL (MAGC1_HUMAN)
MMSSFSSTLK

SEQ ID NO: 88540 - protein, 11 aa, Artificial Sequence
  Description of Artificial Sequence: Synthetic peptide
  Seed: KRKVVEFLAML (MAGC1_HUMAN)
KRKVVEFLAMV

SEQ ID NO: 88541 - protein, 9 aa, Artificial Sequence
  Description of Artificial Sequence: Synthetic peptide
  Seed: SPLQIVPSL (MAGC1_HUMAN)
SPLQIVPSP

SEQ ID NO: 88542 - protein, 9 aa, Artificial Sequence
  Description of Artificial Sequence: Synthetic peptide
  Seed: TLDLTSEGC (MAGC1_HUMAN)
TIDLTSEGL

SEQ ID NO: 88543 - protein, 11 aa, Artificial Sequence
  Description of Artificial Sequence: Synthetic peptide
  Seed: LQIPMTSSFSS (MAGC1_HUMAN)
LMIPMTSSFSY

SEQ ID NO: 88544 - protein, 10 aa, Artificial Sequence
  Description of Artificial Sequence: Synthetic peptide
  Seed: SIIFIKGTYA (MAGC1_HUMAN)
SMIFIKGTYL

SEQ ID NO: 88545 - protein, 9 aa, Artificial Sequence
  Description of Artificial Sequence: Synthetic peptide
  Seed: VQSPLHSPQ (MAGC1_HUMAN)
VNSPLHSPF

SEQ ID NO: 88546 - protein, 9 aa, Artificial Sequence
  Description of Artificial Sequence: Synthetic peptide
  Seed: SAASSSTLV (MAGC1_HUMAN)
SQASSSTLV

SEQ ID NO: 88547 - protein, 10 aa, Artificial Sequence
  Description of Artificial Sequence: Synthetic peptide
  Seed: LQIVPSLPEW (MAGC1_HUMAN)
LAIVPSLPEW

SEQ ID NO: 88548 - protein, 10 aa, Artificial Sequence
  Description of Artificial Sequence: Synthetic peptide
  Seed: RAGREHFAFG (MAGC1_HUMAN)
RTGREHFAFS

SEQ ID NO: 88549 - protein, 9 aa, Artificial Sequence
  Description of Artificial Sequence: Synthetic peptide
  Seed: FQSSPERTH (MAGC1_HUMAN)
FVSSPERTF

SEQ ID NO: 88550 - protein, 9 aa, Artificial Sequence
  Description of Artificial Sequence: Synthetic peptide
  Seed: VSRSFSSTL (MAGC1_HUMAN)
VYRSFSSTL

SEQ ID NO: 88551 - protein, 9 aa, Artificial Sequence
  Description of Artificial Sequence: Synthetic peptide
  Seed: LSDEQGMSQ (MAGC1_HUMAN)
LVDEQGMSA

SEQ ID NO: 88552 - protein, 10 aa, Artificial Sequence
  Description of Artificial Sequence: Synthetic peptide
  Seed: IEILFGISLR (MAGC1_HUMAN)
IIILFGISLR

SEQ ID NO: 88553 - protein, 10 aa, Artificial Sequence
  Description of Artificial Sequence: Synthetic peptide
  Seed: VSICSSSTSL (MAGC1_HUMAN)
VTICSSSTSW

SEQ ID NO: 88554 - protein, 9 aa, Artificial Sequence
  Description of Artificial Sequence: Synthetic peptide
  Seed: LQIPGSPSF (MAGC1_HUMAN)
LIIPGSPSF

SEQ ID NO: 88555 - protein, 9 aa, Artificial Sequence
  Description of Artificial Sequence: Synthetic peptide
  Seed: SPPEGMHSQ (MAGC1_HUMAN)
SPPEGMHST

SEQ ID NO: 88556 - protein, 9 aa, Artificial Sequence
  Description of Artificial Sequence: Synthetic peptide
  Seed: LILSIIFIK (MAGC1_HUMAN)
LMLSIIFIK

SEQ ID NO: 88557 - protein, 9 aa, Artificial Sequence
  Description of Artificial Sequence: Synthetic peptide
  Seed: ALLSIFQSS (MAGC1_HUMAN)
AILSIFQSL

SEQ ID NO: 88558 - protein, 10 aa, Artificial Sequence
  Description of Artificial Sequence: Synthetic peptide
  Seed: SSFSYTLLSL (MAGC1_HUMAN)
STFSYTLLSL

SEQ ID NO: 88559 - protein, 9 aa, Artificial Sequence
  Description of Artificial Sequence: Synthetic peptide
  Seed: SQSSPVSSF (MAGC1_HUMAN)
SLSSPVSSY

SEQ ID NO: 88560 - protein, 11 aa, Artificial Sequence
  Description of Artificial Sequence: Synthetic peptide
  Seed: SRYTGYFPVIF (MAGC1_HUMAN)
SYYTGYFPVIF

SEQ ID NO: 88561 - protein, 9 aa, Artificial Sequence
  Description of Artificial Sequence: Synthetic peptide
  Seed: NTHSPLQIV (MAGC1_HUMAN)
NAHSPLQIL

SEQ ID NO: 88562 - protein, 10 aa, Artificial Sequence
  Description of Artificial Sequence: Synthetic peptide
  Seed: SSPERTQSTF (MAGC1_HUMAN)
SFPERTQSTY

SEQ ID NO: 88563 - protein, 9 aa, Artificial Sequence
  Description of Artificial Sequence: Synthetic peptide
  Seed: YVFVNTLDL (MAGC1_HUMAN)
YLFVNTLDA

SEQ ID NO: 88564 - protein, 10 aa, Artificial Sequence
  Description of Artificial Sequence: Synthetic peptide
  Seed: SFPSSTSSSL (MAGC1_HUMAN)
SNPSSTSSSV

SEQ ID NO: 88565 - protein, 9 aa, Artificial Sequence
  Description of Artificial Sequence: Synthetic peptide
  Seed: SAQSAFEGF (MAGC1_HUMAN)
SSQSAFEGW

SEQ ID NO: 88566 - protein, 10 aa, Artificial Sequence
  Description of Artificial Sequence: Synthetic peptide
  Seed: SLQIPVSPSF (MAGC1_HUMAN)
SWQIPVSPSW

SEQ ID NO: 88567 - protein, 9 aa, Artificial Sequence
  Description of Artificial Sequence: Synthetic peptide
  Seed: VSSSSSSTL (MAGC1_HUMAN)
VVSSSSSTM

SEQ ID NO: 88568 - protein, 9 aa, Artificial Sequence
  Description of Artificial Sequence: Synthetic peptide
  Seed: ISRYTGYFP (MAGC1_HUMAN)
ISRYTGYFI

SEQ ID NO: 88569 - protein, 10 aa, Artificial Sequence
  Description of Artificial Sequence: Synthetic peptide
  Seed: YTLASLLQSS (MAGC1_HUMAN)
YPLASLLQSV

SEQ ID NO: 88570 - protein, 10 aa, Artificial Sequence
  Description of Artificial Sequence: Synthetic peptide
  Seed: ISRYTGYFPV (MAGC1_HUMAN)
IFRYTGYFPF

SEQ ID NO: 88571 - protein, 9 aa, Artificial Sequence
  Description of Artificial Sequence: Synthetic peptide
  Seed: DSYVFVNTL (MAGC1_HUMAN)
DVYVFVNTR

SEQ ID NO: 88572 - protein, 10 aa, Artificial Sequence
  Description of Artificial Sequence: Synthetic peptide
  Seed: RKVVEFLAML (MAGC1_HUMAN)
RHVVEFLAMA

SEQ ID NO: 88573 - protein, 10 aa, Artificial Sequence
  Description of Artificial Sequence: Synthetic peptide
  Seed: SSPESAQSTF (MAGC1_HUMAN)
SYPESAQSTM

SEQ ID NO: 88574 - protein, 11 aa, Artificial Sequence
  Description of Artificial Sequence: Synthetic peptide
  Seed: QSSPECTQSTF (MAGC1_HUMAN)
QTSPECTQSTW

SEQ ID NO: 88575 - protein, 10 aa, Artificial Sequence
  Description of Artificial Sequence: Synthetic peptide
  Seed: FPQSLLQIPM (MAGC1_HUMAN)
FWQSLLQIPF

SEQ ID NO: 88576 - protein, 9 aa, Artificial Sequence
  Description of Artificial Sequence: Synthetic peptide
  Seed: TLLSIFQSS (MAGC1_HUMAN)
TTLSIFQSL

SEQ ID NO: 88577 - protein, 9 aa, Artificial Sequence
  Description of Artificial Sequence: Synthetic peptide
  Seed: VSSSSSSTL (MAGC1_HUMAN)
VRSSSSSTY

SEQ ID NO: 88578 - protein, 10 aa, Artificial Sequence
  Description of Artificial Sequence: Synthetic peptide
  Seed: SLFQSFSERT (MAGC1_HUMAN)
SWFQSFSERR

SEQ ID NO: 88579 - protein, 10 aa, Artificial Sequence
  Description of Artificial Sequence: Synthetic peptide
  Seed: PLQRPVSSFF (MAGC1_HUMAN)
PAQRPVSSFY

SEQ ID NO: 88580 - protein, 9 aa, Artificial Sequence
  Description of Artificial Sequence: Synthetic peptide
  Seed: NVISRYTGY (MAGC1_HUMAN)
NQISRYTGF

SEQ ID NO: 88581 - protein, 9 aa, Artificial Sequence
  Description of Artificial Sequence: Synthetic peptide
  Seed: VIKRKVVEF (MAGC1_HUMAN)
VYKRKVVEY

SEQ ID NO: 88582 - protein, 11 aa, Artificial Sequence
  Description of Artificial Sequence: Synthetic peptide
  Seed: SLREVDPDDSY (MAGC1_HUMAN)
SQREVDPDDSY

SEQ ID NO: 88583 - protein, 9 aa, Artificial Sequence
  Description of Artificial Sequence: Synthetic peptide
  Seed: VPITFPSSY (MAGC1_HUMAN)
VPITFPSSI

SEQ ID NO: 88584 - protein, 11 aa, Artificial Sequence
  Description of Artificial Sequence: Synthetic peptide
  Seed: IPVSSSSSSTL (MAGC1_HUMAN)
ILVSSSSSSTW

SEQ ID NO: 88585 - protein, 11 aa, Artificial Sequence
  Description of Artificial Sequence: Synthetic peptide
  Seed: IPVSRSFSSTL (MAGC1_HUMAN)
ILVSRSFSSTW

SEQ ID NO: 88586 - protein, 11 aa, Artificial Sequence
  Description of Artificial Sequence: Synthetic peptide
  Seed: MSPLYFPQSPL (MAGC1_HUMAN)
MAPLYFPQSPW

SEQ ID NO: 88587 - protein, 9 aa, Artificial Sequence
  Description of Artificial Sequence: Synthetic peptide
  Seed: SSPESPLQS (MAGC1_HUMAN)
SVPESPLQL

SEQ ID NO: 88588 - protein, 10 aa, Artificial Sequence
  Description of Artificial Sequence: Synthetic peptide
  Seed: EVIWDVLSGI (MAGC1_HUMAN)
EAIWDVLSGA

SEQ ID NO: 88589 - protein, 9 aa, Artificial Sequence
  Description of Artificial Sequence: Synthetic peptide
  Seed: GSPSFSSTL (MAGC1_HUMAN)
GLPSFSSTF

SEQ ID NO: 88590 - protein, 10 aa, Artificial Sequence
  Description of Artificial Sequence: Synthetic peptide
  Seed: SLIESEPLFT (MAGC1_HUMAN)
SQIESEPLFL

SEQ ID NO: 88591 - protein, 10 aa, Artificial Sequence
  Description of Artificial Sequence: Synthetic peptide
  Seed: RAGREHFAFG (MAGC1_HUMAN)
RYGREHFAFY

SEQ ID NO: 88592 - protein, 11 aa, Artificial Sequence
  Description of Artificial Sequence: Synthetic peptide
  Seed: ITFPSSYKDAL (MAGC1_HUMAN)
ISFPSSYKDAM

SEQ ID NO: 88593 - protein, 9 aa, Artificial Sequence
  Description of Artificial Sequence: Synthetic peptide
  Seed: LQIPVSRSF (MAGC1_HUMAN)
LVIPVSRSY

SEQ ID NO: 88594 - protein, 9 aa, Artificial Sequence
  Description of Artificial Sequence: Synthetic peptide
  Seed: VQSPLHSPQ (MAGC1_HUMAN)
VLSPLHSPF

SEQ ID NO: 88595 - protein, 9 aa, Artificial Sequence
  Description of Artificial Sequence: Synthetic peptide
  Seed: RPVSSFFSY (MAGC1_HUMAN)
RMVSSFFSH

SEQ ID NO: 88596 - protein, 8 aa, Artificial Sequence
  Description of Artificial Sequence: Synthetic peptide
  Seed: SSFFSSAL (MAGC1_HUMAN)
SSFFSSAF

SEQ ID NO: 88597 - protein, 9 aa, Artificial Sequence
  Description of Artificial Sequence: Synthetic peptide
  Seed: YTGYFPVIF (MAGC1_HUMAN)
YYGYFPVIV

SEQ ID NO: 88598 - protein, 9 aa, Artificial Sequence
  Description of Artificial Sequence: Synthetic peptide
  Seed: ASSSTLVSI (MAGC1_HUMAN)
AQSSTLVSV

SEQ ID NO: 88599 - protein, 11 aa, Artificial Sequence
  Description of Artificial Sequence: Synthetic peptide
  Seed: QSSPESAQSTF (MAGC1_HUMAN)
QMSPESAQSTW

SEQ ID NO: 88600 - protein, 9 aa, Artificial Sequence
  Description of Artificial Sequence: Synthetic peptide
  Seed: KVWVQEHYL (MAGC1_HUMAN)
KIWVQEHYY

SEQ ID NO: 88601 - protein, 9 aa, Artificial Sequence
  Description of Artificial Sequence: Synthetic peptide
  Seed: SQSSPVSSF (MAGC1_HUMAN)
STSSPVSSY

SEQ ID NO: 88602 - protein, 9 aa, Artificial Sequence
  Description of Artificial Sequence: Synthetic peptide
  Seed: LQIPVSAAS (MAGC1_HUMAN)
LCIPVSAAY

SEQ ID NO: 88603 - protein, 9 aa, Artificial Sequence
  Description of Artificial Sequence: Synthetic peptide
  Seed: GSPSFSSTL (MAGC1_HUMAN)
GWPSFSSTL

SEQ ID NO: 88604 - protein, 9 aa, Artificial Sequence
  Description of Artificial Sequence: Synthetic peptide
  Seed: MPTAGMPSL (MAGC1_HUMAN)
MPTAGMPSP

SEQ ID NO: 88605 - protein, 9 aa, Artificial Sequence
  Description of Artificial Sequence: Synthetic peptide
  Seed: SFSYTLLSL (MAGC1_HUMAN)
SFSYTLLSW

SEQ ID NO: 88606 - protein, 9 aa, Artificial Sequence
  Description of Artificial Sequence: Synthetic peptide
  Seed: IPVSPSFSS (MAGC1_HUMAN)
IAVSPSFSY

SEQ ID NO: 88607 - protein, 10 aa, Artificial Sequence
  Description of Artificial Sequence: Synthetic peptide
  Seed: MPTAGMPSLL (MAGC1_HUMAN)
MHTAGMPSLV

SEQ ID NO: 88608 - protein, 9 aa, Artificial Sequence
  Description of Artificial Sequence: Synthetic peptide
  Seed: SQSSPVSSF (MAGC1_HUMAN)
SWSSPVSSL

SEQ ID NO: 88609 - protein, 9 aa, Artificial Sequence
  Description of Artificial Sequence: Synthetic peptide
  Seed: FSSTLLSLF (MAGC1_HUMAN)
FQSTLLSLM

SEQ ID NO: 88610 - protein, 9 aa, Artificial Sequence
  Description of Artificial Sequence: Synthetic peptide
  Seed: FPSSTSSSL (MAGC1_HUMAN)
FSSSTSSSW

SEQ ID NO: 88611 - protein, 9 aa, Artificial Sequence
  Description of Artificial Sequence: Synthetic peptide
  Seed: FSSALLSIF (MAGC1_HUMAN)
FKSALLSIF

SEQ ID NO: 88612 - protein, 10 aa, Artificial Sequence
  Description of Artificial Sequence: Synthetic peptide
  Seed: QRPVSSFFSY (MAGC1_HUMAN)
QNPVSSFFSF

SEQ ID NO: 88613 - protein, 10 aa, Artificial Sequence
  Description of Artificial Sequence: Synthetic peptide
  Seed: STFEGFPQSL (MAGC1_HUMAN)
SQFEGFPQSV

SEQ ID NO: 88614 - protein, 9 aa, Artificial Sequence
  Description of Artificial Sequence: Synthetic peptide
  Seed: SQSPPEGPV (MAGC1_HUMAN)
STSPPEGPF

SEQ ID NO: 88615 - protein, 9 aa, Artificial Sequence
  Description of Artificial Sequence: Synthetic peptide
  Seed: KAEMLTNVI (MAGC1_HUMAN)
KAEMLTNVY

SEQ ID NO: 88616 - protein, 9 aa, Artificial Sequence
  Description of Artificial Sequence: Synthetic peptide
  Seed: FFSYTLASL (MAGC1_HUMAN)
FLSYTLASV

SEQ ID NO: 88617 - protein, 9 aa, Artificial Sequence
  Description of Artificial Sequence: Synthetic peptide
  Seed: FAFGEPREL (MAGC1_HUMAN)
FMFGEPREF

SEQ ID NO: 88618 - protein, 11 aa, Artificial Sequence
  Description of Artificial Sequence: Synthetic peptide
  Seed: TLDEKVDELAR (MAGC1_HUMAN)
TIDEKVDELAF

SEQ ID NO: 88619 - protein, 11 aa, Artificial Sequence
  Description of Artificial Sequence: Synthetic peptide
  Seed: SPLQIPVSRSF (MAGC1_HUMAN)
SHLQIPVSRSF

SEQ ID NO: 88620 - protein, 11 aa, Artificial Sequence
  Description of Artificial Sequence: Synthetic peptide
  Seed: MGDKDMPTAGM (MAGC1_HUMAN)
MSDKDMPTAGL

SEQ ID NO: 88621 - protein, 9 aa, Artificial Sequence
  Description of Artificial Sequence: Synthetic peptide
  Seed: ASSSTLVSI (MAGC1_HUMAN)
AVSSTLVSM

SEQ ID NO: 88622 - protein, 8 aa, Artificial Sequence
  Description of Artificial Sequence: Synthetic peptide
  Seed: SPLQIPVS (MAGC1_HUMAN)
SPLQIPVA

SEQ ID NO: 88623 - protein, 9 aa, Artificial Sequence
  Description of Artificial Sequence: Synthetic peptide
  Seed: FSYTLASLL (MAGC1_HUMAN)
FMYTLASLS

SEQ ID NO: 88624 - protein, 10 aa, Artificial Sequence
  Description of Artificial Sequence: Synthetic peptide
  Seed: IPVSRSFSST (MAGC1_HUMAN)
IPVSRSFSSL

SEQ ID NO: 88625 - protein, 10 aa, Artificial Sequence
  Description of Artificial Sequence: Synthetic peptide
  Seed: LQIPGSPSFS (MAGC1_HUMAN)
LMIPGSPSFH

SEQ ID NO: 88626 - protein, 11 aa, Artificial Sequence
  Description of Artificial Sequence: Synthetic peptide
  Seed: VPNSSPPRYEF (MAGC1_HUMAN)
VPNSSPPRYEM

SEQ ID NO: 88627 - protein, 10 aa, Artificial Sequence
  Description of Artificial Sequence: Synthetic peptide
  Seed: LQIPVSRSFS (MAGC1_HUMAN)
LQIPVSRSFH

SEQ ID NO: 88628 - protein, 9 aa, Artificial Sequence
  Description of Artificial Sequence: Synthetic peptide
  Seed: TLLSIFQSS (MAGC1_HUMAN)
TVLSIFQSV

SEQ ID NO: 88629 - protein, 10 aa, Artificial Sequence
  Description of Artificial Sequence: Synthetic peptide
  Seed: IPVSRSFSST (MAGC1_HUMAN)
IPVSRSFSSM

SEQ ID NO: 88630 - protein, 9 aa, Artificial Sequence
  Description of Artificial Sequence: Synthetic peptide
  Seed: LQNPASSFF (MAGC1_HUMAN)
LVNPASSFY

SEQ ID NO: 88631 - protein, 10 aa, Artificial Sequence
  Description of Artificial Sequence: Synthetic peptide
  Seed: SSFSYTLLSL (MAGC1_HUMAN)
SQFSYTLLSY

SEQ ID NO: 88632 - protein, 10 aa, Artificial Sequence
  Description of Artificial Sequence: Synthetic peptide
  Seed: RKVVEFLAML (MAGC1_HUMAN)
RRVVEFLAMA

SEQ ID NO: 88633 - protein, 9 aa, Artificial Sequence
  Description of Artificial Sequence: Synthetic peptide
  Seed: SSSDTLLES (MAGC1_HUMAN)
SSSDTLLEF

SEQ ID NO: 88634 - protein, 8 aa, Artificial Sequence
  Description of Artificial Sequence: Synthetic peptide
  Seed: IWDVLSGI (MAGC1_HUMAN)
ISDVLSGL

SEQ ID NO: 88635 - protein, 10 aa, Artificial Sequence
  Description of Artificial Sequence: Synthetic peptide
  Seed: SFSSTLLSIF (MAGC1_HUMAN)
SSSSTLLSIF

SEQ ID NO: 88636 - protein, 9 aa, Artificial Sequence
  Description of Artificial Sequence: Synthetic peptide
  Seed: AQSPLQSPV (MAGC1_HUMAN)
AISPLQSPI

SEQ ID NO: 88637 - protein, 9 aa, Artificial Sequence
  Description of Artificial Sequence: Synthetic peptide
  Seed: KVDELARFL (MAGC1_HUMAN)
KMDELARFF

SEQ ID NO: 88638 - protein, 9 aa, Artificial Sequence
  Description of Artificial Sequence: Synthetic peptide
  Seed: VPITFPSSY (MAGC1_HUMAN)
VFITFPSSF

SEQ ID NO: 88639 - protein, 11 aa, Artificial Sequence
  Description of Artificial Sequence: Synthetic peptide
  Seed: QSSPECTQSTF (MAGC1_HUMAN)
QMSPECTQSTW

SEQ ID NO: 88640 - protein, 10 aa, Artificial Sequence
  Description of Artificial Sequence: Synthetic peptide
  Seed: SPVISFSSST (MAGC1_HUMAN)
SPVISFSSSA

SEQ ID NO: 88641 - protein, 9 aa, Artificial Sequence
  Description of Artificial Sequence: Synthetic peptide
  Seed: TLDEKVDEL (MAGC1_HUMAN)
TMDEKVDEI

SEQ ID NO: 88642 - protein, 9 aa, Artificial Sequence
  Description of Artificial Sequence: Synthetic peptide
  Seed: LKNTVPITF (MAGC1_HUMAN)
LVNTVPITM

SEQ ID NO: 88643 - protein, 9 aa, Artificial Sequence
  Description of Artificial Sequence: Synthetic peptide
  Seed: YVFVNTLDL (MAGC1_HUMAN)
YGFVNTLDF

SEQ ID NO: 88644 - protein, 11 aa, Artificial Sequence
  Description of Artificial Sequence: Synthetic peptide
  Seed: IPVSSSFSYTL (MAGC1_HUMAN)
IVVSSSFSYTY

SEQ ID NO: 88645 - protein, 10 aa, Artificial Sequence
  Description of Artificial Sequence: Synthetic peptide
  Seed: SSSSTLLSLF (MAGC1_HUMAN)
SISSTLLSLW

SEQ ID NO: 88646 - protein, 10 aa, Artificial Sequence
  Description of Artificial Sequence: Synthetic peptide
  Seed: YTLASLLQSS (MAGC1_HUMAN)
YHLASLLQSM

SEQ ID NO: 88647 - protein, 10 aa, Artificial Sequence
  Description of Artificial Sequence: Synthetic peptide
  Seed: FFSSALLSIF (MAGC1_HUMAN)
FKSSALLSIM

SEQ ID NO: 88648 - protein, 9 aa, Artificial Sequence
  Description of Artificial Sequence: Synthetic peptide
  Seed: SSPEGKDSL (MAGC1_HUMAN)
STPEGKDSF

SEQ ID NO: 88649 - protein, 9 aa, Artificial Sequence
  Description of Artificial Sequence: Synthetic peptide
  Seed: MTSSFSSTL (MAGC1_HUMAN)
MHSSFSSTI

SEQ ID NO: 88650 - protein, 9 aa, Artificial Sequence
  Description of Artificial Sequence: Synthetic peptide
  Seed: EDFQSSLQS (MAGC1_HUMAN)
EQFQSSLQW

SEQ ID NO: 88651 - protein, 10 aa, Artificial Sequence
  Description of Artificial Sequence: Synthetic peptide
  Seed: ISRYTGYFPV (MAGC1_HUMAN)
INRYTGYFPL

SEQ ID NO: 88652 - protein, 11 aa, Artificial Sequence
  Description of Artificial Sequence: Synthetic peptide
  Seed: SLFQSSPERTH (MAGC1_HUMAN)
SAFQSSPERTM

SEQ ID NO: 88653 - protein, 11 aa, Artificial Sequence
  Description of Artificial Sequence: Synthetic peptide
  Seed: SFFSYTLASLL (MAGC1_HUMAN)
SVFSYTLASLW

SEQ ID NO: 88654 - protein, 8 aa, Artificial Sequence
  Description of Artificial Sequence: Synthetic peptide
  Seed: FLLLKYQV (MAGC1_HUMAN)
FMLLKYQL

SEQ ID NO: 88655 - protein, 10 aa, Artificial Sequence
  Description of Artificial Sequence: Synthetic peptide
  Seed: FPQSVLQIPV (MAGC1_HUMAN)
FNQSVLQIPV

SEQ ID NO: 88656 - protein, 10 aa, Artificial Sequence
  Description of Artificial Sequence: Synthetic peptide
  Seed: STLLSLFQSF (MAGC1_HUMAN)
STLLSLFQSW

SEQ ID NO: 88657 - protein, 11 aa, Artificial Sequence
  Description of Artificial Sequence: Synthetic peptide
  Seed: SSSSSTLLSLF (MAGC1_HUMAN)
SMSSSTLLSLW

SEQ ID NO: 88658 - protein, 10 aa, Artificial Sequence
  Description of Artificial Sequence: Synthetic peptide
  Seed: FFSSALLSIF (MAGC1_HUMAN)
FQSSALLSIF

SEQ ID NO: 88659 - protein, 9 aa, Artificial Sequence
  Description of Artificial Sequence: Synthetic peptide
  Seed: IFRKAREFI (MAGC1_HUMAN)
IFRKAREFK

SEQ ID NO: 88660 - protein, 10 aa, Artificial Sequence
  Description of Artificial Sequence: Synthetic peptide
  Seed: ATESASSSVM (MAGC1_HUMAN)
AKESASSSVM

SEQ ID NO: 88661 - protein, 9 aa, Artificial Sequence
  Description of Artificial Sequence: Synthetic peptide
  Seed: FAFGEPREL (MAGC1_HUMAN)
FLFGEPREM

SEQ ID NO: 88662 - protein, 9 aa, Artificial Sequence
  Description of Artificial Sequence: Synthetic peptide
  Seed: RKVVEFLAM (MAGC1_HUMAN)
REVVEFLAY

SEQ ID NO: 88663 - protein, 10 aa, Artificial Sequence
  Description of Artificial Sequence: Synthetic peptide
  Seed: SPLQSPVSSF (MAGC1_HUMAN)
SKLQSPVSSM

SEQ ID NO: 88664 - protein, 9 aa, Artificial Sequence
  Description of Artificial Sequence: Synthetic peptide
  Seed: ASSFFSSAL (MAGC1_HUMAN)
AVSFFSSAY

SEQ ID NO: 88665 - protein, 11 aa, Artificial Sequence
  Description of Artificial Sequence: Synthetic peptide
  Seed: SFFSSALLSIF (MAGC1_HUMAN)
SQFSSALLSIL

SEQ ID NO: 88666 - protein, 9 aa, Artificial Sequence
  Description of Artificial Sequence: Synthetic peptide
  Seed: FSSTLLSLF (MAGC1_HUMAN)
FASTLLSLM

SEQ ID NO: 88667 - protein, 9 aa, Artificial Sequence
  Description of Artificial Sequence: Synthetic peptide
  Seed: SSSSTLLSL (MAGC1_HUMAN)
SVSSTLLSI

SEQ ID NO: 88668 - protein, 10 aa, Artificial Sequence
  Description of Artificial Sequence: Synthetic peptide
  Seed: SRYTGYFPVI (MAGC1_HUMAN)
SMYTGYFPVW

SEQ ID NO: 88669 - protein, 9 aa, Artificial Sequence
  Description of Artificial Sequence: Synthetic peptide
  Seed: EILFGISLR (MAGC1_HUMAN)
ELLFGISLR

SEQ ID NO: 88670 - protein, 9 aa, Artificial Sequence
  Description of Artificial Sequence: Synthetic peptide
  Seed: SVLQIPVSA (MAGC1_HUMAN)
SPLQIPVSA

SEQ ID NO: 88671 - protein, 10 aa, Artificial Sequence
  Description of Artificial Sequence: Synthetic peptide
  Seed: WDVLSGIGVR (MAGC1_HUMAN)
WTVLSGIGVR

SEQ ID NO: 88672 - protein, 9 aa, Artificial Sequence
  Description of Artificial Sequence: Synthetic peptide
  Seed: AQSPLQSPV (MAGC1_HUMAN)
ALSPLQSPF

SEQ ID NO: 88673 - protein, 9 aa, Artificial Sequence
  Description of Artificial Sequence: Synthetic peptide
  Seed: MGDKDMPTA (MAGC1_HUMAN)
MMDKDMPTI

SEQ ID NO: 88674 - protein, 9 aa, Artificial Sequence
  Description of Artificial Sequence: Synthetic peptide
  Seed: GTYASEEVI (MAGC1_HUMAN)
GTYASEEVF

SEQ ID NO: 88675 - protein, 9 aa, Artificial Sequence
  Description of Artificial Sequence: Synthetic peptide
  Seed: SSFSYTLLS (MAGC1_HUMAN)
SFFSYTLLK

SEQ ID NO: 88676 - protein, 10 aa, Artificial Sequence
  Description of Artificial Sequence: Synthetic peptide
  Seed: LSQSSPVSSF (MAGC1_HUMAN)
LPQSSPVSSY

SEQ ID NO: 88677 - protein, 10 aa, Artificial Sequence
  Description of Artificial Sequence: Synthetic peptide
  Seed: MTSSFSSTLL (MAGC1_HUMAN)
MTSSFSSTLW

SEQ ID NO: 88678 - protein, 10 aa, Artificial Sequence
  Description of Artificial Sequence: Synthetic peptide
  Seed: FFSSALLSIF (MAGC1_HUMAN)
FDSSALLSIW

SEQ ID NO: 88679 - protein, 10 aa, Artificial Sequence
  Description of Artificial Sequence: Synthetic peptide
  Seed: SSSSSTLLSL (MAGC1_HUMAN)
SFSSSTLLSF

SEQ ID NO: 88680 - protein, 9 aa, Artificial Sequence
  Description of Artificial Sequence: Synthetic peptide
  Seed: RAHSEVIKR (MAGC1_HUMAN)
RMHSEVIKY

SEQ ID NO: 88681 - protein, 9 aa, Artificial Sequence
  Description of Artificial Sequence: Synthetic peptide
  Seed: TFEGFPQSL (MAGC1_HUMAN)
TFEGFPQSY

SEQ ID NO: 88682 - protein, 10 aa, Artificial Sequence
  Description of Artificial Sequence: Synthetic peptide
  Seed: LSGIGVRAGR (MAGC1_HUMAN)
LVGIGVRAGK

SEQ ID NO: 88683 - protein, 9 aa, Artificial Sequence
  Description of Artificial Sequence: Synthetic peptide
  Seed: ASEEVIWDV (MAGC1_HUMAN)
AAEEVIWDL

SEQ ID NO: 88684 - protein, 9 aa, Artificial Sequence
  Description of Artificial Sequence: Synthetic peptide
  Seed: STFEGFAQS (MAGC1_HUMAN)
SQFEGFAQI

SEQ ID NO: 88685 - protein, 9 aa, Artificial Sequence
  Description of Artificial Sequence: Synthetic peptide
  Seed: SSSSSSTLL (MAGC1_HUMAN)
SASSSSTLY

SEQ ID NO: 88686 - protein, 10 aa, Artificial Sequence
  Description of Artificial Sequence: Synthetic peptide
  Seed: RTHSTFEGFP (MAGC1_HUMAN)
RTHSTFEGFK

SEQ ID NO: 88687 - protein, 9 aa, Artificial Sequence
  Description of Artificial Sequence: Synthetic peptide
  Seed: SFSYTLLSL (MAGC1_HUMAN)
SASYTLLSL

SEQ ID NO: 88688 - protein, 8 aa, Artificial Sequence
  Description of Artificial Sequence: Synthetic peptide
  Seed: FEGFPQSV (MAGC1_HUMAN)
FAGFPQSM

SEQ ID NO: 88689 - protein, 11 aa, Artificial Sequence
  Description of Artificial Sequence: Synthetic peptide
  Seed: SLIESEPLFTY (MAGC1_HUMAN)
SQIESEPLFTL

SEQ ID NO: 88690 - protein, 9 aa, Artificial Sequence
  Description of Artificial Sequence: Synthetic peptide
  Seed: ISFSSSTSL (MAGC1_HUMAN)
IIFSSSTSR

SEQ ID NO: 88691 - protein, 10 aa, Artificial Sequence
  Description of Artificial Sequence: Synthetic peptide
  Seed: RSFSSTLLSI (MAGC1_HUMAN)
RTFSSTLLSL

SEQ ID NO: 88692 - protein, 10 aa, Artificial Sequence
  Description of Artificial Sequence: Synthetic peptide
  Seed: SLSPLHFPQF (MAGC1_HUMAN)
SQSPLHFPQY

SEQ ID NO: 88693 - protein, 10 aa, Artificial Sequence
  Description of Artificial Sequence: Synthetic peptide
  Seed: MPTAGMPSLL (MAGC1_HUMAN)
MPTAGMPSLV

SEQ ID NO: 88694 - protein, 9 aa, Artificial Sequence
  Description of Artificial Sequence: Synthetic peptide
  Seed: FAQSPLQIP (MAGC1_HUMAN)
FPQSPLQIF

SEQ ID NO: 88695 - protein, 10 aa, Artificial Sequence
  Description of Artificial Sequence: Synthetic peptide
  Seed: TLDEKVDELA (MAGC1_HUMAN)
TMDEKVDELV

SEQ ID NO: 88696 - protein, 9 aa, Artificial Sequence
  Description of Artificial Sequence: Synthetic peptide
  Seed: AQSPLQIPV (MAGC1_HUMAN)
AQSPLQIPW

SEQ ID NO: 88697 - protein, 10 aa, Artificial Sequence
  Description of Artificial Sequence: Synthetic peptide
  Seed: LSQSSPVSSF (MAGC1_HUMAN)
LYQSSPVSSM

SEQ ID NO: 88698 - protein, 10 aa, Artificial Sequence
  Description of Artificial Sequence: Synthetic peptide
  Seed: PLQIPGSPSF (MAGC1_HUMAN)
PVQIPGSPSF

SEQ ID NO: 88699 - protein, 10 aa, Artificial Sequence
  Description of Artificial Sequence: Synthetic peptide
  Seed: MTSSFSSTLL (MAGC1_HUMAN)
MLSSFSSTLD

SEQ ID NO: 88700 - protein, 10 aa, Artificial Sequence
  Description of Artificial Sequence: Synthetic peptide
  Seed: STPSSLPQSF (MAGC1_HUMAN)
SDPSSLPQSL

SEQ ID NO: 88701 - protein, 10 aa, Artificial Sequence
  Description of Artificial Sequence: Synthetic peptide
  Seed: SFSYTLLSLF (MAGC1_HUMAN)
SYSYTLLSLY

SEQ ID NO: 88702 - protein, 9 aa, Artificial Sequence
  Description of Artificial Sequence: Synthetic peptide
  Seed: SSPERTQST (MAGC1_HUMAN)
SEPERTQSL

SEQ ID NO: 88703 - protein, 9 aa, Artificial Sequence
  Description of Artificial Sequence: Synthetic peptide
  Seed: EHFAFGEPR (MAGC1_HUMAN)
ENFAFGEPK

SEQ ID NO: 88704 - protein, 9 aa, Artificial Sequence
  Description of Artificial Sequence: Synthetic peptide
  Seed: AFGEPRELL (MAGC1_HUMAN)
AYGEPRELW

SEQ ID NO: 88705 - protein, 9 aa, Artificial Sequence
  Description of Artificial Sequence: Synthetic peptide
  Seed: ISFSSSTSL (MAGC1_HUMAN)
ITFSSSTSM

SEQ ID NO: 88706 - protein, 11 aa, Artificial Sequence
  Description of Artificial Sequence: Synthetic peptide
  Seed: STFEGFAQSPL (MAGC1_HUMAN)
SSFEGFAQSPY

SEQ ID NO: 88707 - protein, 11 aa, Artificial Sequence
  Description of Artificial Sequence: Synthetic peptide
  Seed: IIDTTDDSTAT (MAGC1_HUMAN)
IMDTTDDSTAM

SEQ ID NO: 88708 - protein, 9 aa, Artificial Sequence
  Description of Artificial Sequence: Synthetic peptide
  Seed: EFIEILFGI (MAGC1_HUMAN)
ESIEILFGM

SEQ ID NO: 88709 - protein, 10 aa, Artificial Sequence
  Description of Artificial Sequence: Synthetic peptide
  Seed: SLQIPVSPSF (MAGC1_HUMAN)
SIQIPVSPSY

SEQ ID NO: 88710 - protein, 9 aa, Artificial Sequence
  Description of Artificial Sequence: Synthetic peptide
  Seed: SEPLFTYTL (MAGC1_HUMAN)
SHPLFTYTF

SEQ ID NO: 88711 - protein, 10 aa, Artificial Sequence
  Description of Artificial Sequence: Synthetic peptide
  Seed: VPITFPSSYK (MAGC1_HUMAN)
VTITFPSSYR

SEQ ID NO: 88712 - protein, 9 aa, Artificial Sequence
  Description of Artificial Sequence: Synthetic peptide
  Seed: DSYVFVNTL (MAGC1_HUMAN)
DPYVFVNTY

SEQ ID NO: 88713 - protein, 11 aa, Artificial Sequence
  Description of Artificial Sequence: Synthetic peptide
  Seed: SPLQIPVSRSF (MAGC1_HUMAN)
SCLQIPVSRSY

SEQ ID NO: 88714 - protein, 9 aa, Artificial Sequence
  Description of Artificial Sequence: Synthetic peptide
  Seed: KDSLSPLEI (MAGC1_HUMAN)
KESLSPLEF

SEQ ID NO: 88715 - protein, 9 aa, Artificial Sequence
  Description of Artificial Sequence: Synthetic peptide
  Seed: IESEPLFTY (MAGC1_HUMAN)
IPSEPLFTY

SEQ ID NO: 88716 - protein, 9 aa, Artificial Sequence
  Description of Artificial Sequence: Synthetic peptide
  Seed: HFPQSPPEW (MAGC1_HUMAN)
HYPQSPPEL

SEQ ID NO: 88717 - protein, 9 aa, Artificial Sequence
  Description of Artificial Sequence: Synthetic peptide
  Seed: VQSPLHSPQ (MAGC1_HUMAN)
VQSPLHSPV

SEQ ID NO: 88718 - protein, 9 aa, Artificial Sequence
  Description of Artificial Sequence: Synthetic peptide
  Seed: VIWDVLSGI (MAGC1_HUMAN)
VIWDVLSGV

SEQ ID NO: 88719 - protein, 9 aa, Artificial Sequence
  Description of Artificial Sequence: Synthetic peptide
  Seed: SPLQNPASS (MAGC1_HUMAN)
SPLQNPASP

SEQ ID NO: 88720 - protein, 9 aa, Artificial Sequence
  Description of Artificial Sequence: Synthetic peptide
  Seed: ASSSTLVSI (MAGC1_HUMAN)
ATSSTLVSM

SEQ ID NO: 88721 - protein, 9 aa, Artificial Sequence
  Description of Artificial Sequence: Synthetic peptide
  Seed: FEGFAQSPL (MAGC1_HUMAN)
FQGFAQSPM

SEQ ID NO: 88722 - protein, 9 aa, Artificial Sequence
  Description of Artificial Sequence: Synthetic peptide
  Seed: LQIPMTSSF (MAGC1_HUMAN)
LRIPMTSSL

SEQ ID NO: 88723 - protein, 10 aa, Artificial Sequence
  Description of Artificial Sequence: Synthetic peptide
  Seed: RAGREHFAFG (MAGC1_HUMAN)
RQGREHFAFA

SEQ ID NO: 88724 - protein, 9 aa, Artificial Sequence
  Description of Artificial Sequence: Synthetic peptide
  Seed: FSSTLLSIL (MAGC1_HUMAN)
FQSTLLSIH

SEQ ID NO: 88725 - protein, 10 aa, Artificial Sequence
  Description of Artificial Sequence: Synthetic peptide
  Seed: YTLASLLQSS (MAGC1_HUMAN)
YELASLLQSL

SEQ ID NO: 88726 - protein, 10 aa, Artificial Sequence
  Description of Artificial Sequence: Synthetic peptide
  Seed: MPTAGMPSLL (MAGC1_HUMAN)
MKTAGMPSLL

SEQ ID NO: 88727 - protein, 9 aa, Artificial Sequence
  Description of Artificial Sequence: Synthetic peptide
  Seed: GYFPVIFRK (MAGC1_HUMAN)
GWFPVIFRR

SEQ ID NO: 88728 - protein, 9 aa, Artificial Sequence
  Description of Artificial Sequence: Synthetic peptide
  Seed: SSSTSLSPF (MAGC1_HUMAN)
SISTSLSPF

SEQ ID NO: 88729 - protein, 10 aa, Artificial Sequence
  Description of Artificial Sequence: Synthetic peptide
  Seed: FPQSLLQIPM (MAGC1_HUMAN)
FQQSLLQIPL

SEQ ID NO: 88730 - protein, 10 aa, Artificial Sequence
  Description of Artificial Sequence: Synthetic peptide
  Seed: SFSSTLVSLF (MAGC1_HUMAN)
SQSSTLVSLY

SEQ ID NO: 88731 - protein, 9 aa, Artificial Sequence
  Description of Artificial Sequence: Synthetic peptide
  Seed: KAREFIEIL (MAGC1_HUMAN)
KMREFIEIY

SEQ ID NO: 88732 - protein, 9 aa, Artificial Sequence
  Description of Artificial Sequence: Synthetic peptide
  Seed: SPPEGPAQS (MAGC1_HUMAN)
SAPEGPAQL

SEQ ID NO: 88733 - protein, 9 aa, Artificial Sequence
  Description of Artificial Sequence: Synthetic peptide
  Seed: QIVPSLPEW (MAGC1_HUMAN)
QSVPSLPEI

SEQ ID NO: 88734 - protein, 10 aa, Artificial Sequence
  Description of Artificial Sequence: Synthetic peptide
  Seed: ASSFFSSALL (MAGC1_HUMAN)
AWSFFSSALW

SEQ ID NO: 88735 - protein, 9 aa, Artificial Sequence
  Description of Artificial Sequence: Synthetic peptide
  Seed: LLSLFQSFS (MAGC1_HUMAN)
LQSLFQSFI

SEQ ID NO: 88736 - protein, 9 aa, Artificial Sequence
  Description of Artificial Sequence: Synthetic peptide
  Seed: ALLSIFQSS (MAGC1_HUMAN)
ATLSIFQSI

SEQ ID NO: 88737 - protein, 9 aa, Artificial Sequence
  Description of Artificial Sequence: Synthetic peptide
  Seed: LQIPVSSSS (MAGC1_HUMAN)
LTIPVSSSM

SEQ ID NO: 88738 - protein, 9 aa, Artificial Sequence
  Description of Artificial Sequence: Synthetic peptide
  Seed: LSDEQGMSQ (MAGC1_HUMAN)
LYDEQGMSL

SEQ ID NO: 88739 - protein, 9 aa, Artificial Sequence
  Description of Artificial Sequence: Synthetic peptide
  Seed: LQIPVSPSF (MAGC1_HUMAN)
LQIPVSPSM

SEQ ID NO: 88740 - protein, 9 aa, Artificial Sequence
  Description of Artificial Sequence: Synthetic peptide
  Seed: LQIPGSPSF (MAGC1_HUMAN)
LLIPGSPSV

SEQ ID NO: 88741 - protein, 11 aa, Artificial Sequence
  Description of Artificial Sequence: Synthetic peptide
  Seed: SAASSSTLVSI (MAGC1_HUMAN)
SLASSSTLVSV

SEQ ID NO: 88742 - protein, 9 aa, Artificial Sequence
  Description of Artificial Sequence: Synthetic peptide
  Seed: VSSFFSYTL (MAGC1_HUMAN)
VESFFSYTM

SEQ ID NO: 88743 - protein, 11 aa, Artificial Sequence
  Description of Artificial Sequence: Synthetic peptide
  Seed: RPVSSFFSYTL (MAGC1_HUMAN)
RWVSSFFSYTF

SEQ ID NO: 88744 - protein, 9 aa, Artificial Sequence
  Description of Artificial Sequence: Synthetic peptide
  Seed: FEGFAQSPL (MAGC1_HUMAN)
FKGFAQSPY

SEQ ID NO: 88745 - protein, 9 aa, Artificial Sequence
  Description of Artificial Sequence: Synthetic peptide
  Seed: AMLKNTVPI (MAGC1_HUMAN)
AMLKNTVPM

SEQ ID NO: 88746 - protein, 10 aa, Artificial Sequence
  Description of Artificial Sequence: Synthetic peptide
  Seed: LLQIPMTSSF (MAGC1_HUMAN)
LLQIPMTSSW

SEQ ID NO: 88747 - protein, 10 aa, Artificial Sequence
  Description of Artificial Sequence: Synthetic peptide
  Seed: QRPVSSFFSY (MAGC1_HUMAN)
QMPVSSFFSF

SEQ ID NO: 88748 - protein, 9 aa, Artificial Sequence
  Description of Artificial Sequence: Synthetic peptide
  Seed: LQIPVSAAS (MAGC1_HUMAN)
LQIPVSAAF

SEQ ID NO: 88749 - protein, 11 aa, Artificial Sequence
  Description of Artificial Sequence: Synthetic peptide
  Seed: IPVSSSSSSTL (MAGC1_HUMAN)
IWVSSSSSSTF

SEQ ID NO: 88750 - protein, 10 aa, Artificial Sequence
  Description of Artificial Sequence: Synthetic peptide
  Seed: EMLTNVISRY (MAGC1_HUMAN)
EVLTNVISRF

SEQ ID NO: 88751 - protein, 9 aa, Artificial Sequence
  Description of Artificial Sequence: Synthetic peptide
  Seed: MSQNRLLIL (MAGC1_HUMAN)
MLQNRLLIF

SEQ ID NO: 88752 - protein, 9 aa, Artificial Sequence
  Description of Artificial Sequence: Synthetic peptide
  Seed: LQIPVSAAS (MAGC1_HUMAN)
LVIPVSAAA

SEQ ID NO: 88753 - protein, 9 aa, Artificial Sequence
  Description of Artificial Sequence: Synthetic peptide
  Seed: ASSFFSSAL (MAGC1_HUMAN)
ALSFFSSAM

SEQ ID NO: 88754 - protein, 9 aa, Artificial Sequence
  Description of Artificial Sequence: Synthetic peptide
  Seed: MTSSFSSTL (MAGC1_HUMAN)
MHSSFSSTF

SEQ ID NO: 88755 - protein, 9 aa, Artificial Sequence
  Description of Artificial Sequence: Synthetic peptide
  Seed: LQIPVSAAS (MAGC1_HUMAN)
LSIPVSAAM

SEQ ID NO: 88756 - protein, 9 aa, Artificial Sequence
  Description of Artificial Sequence: Synthetic peptide
  Seed: SSPESAQSA (MAGC1_HUMAN)
SLPESAQSV

SEQ ID NO: 88757 - protein, 9 aa, Artificial Sequence
  Description of Artificial Sequence: Synthetic peptide
  Seed: TLLSIFQSS (MAGC1_HUMAN)
TQLSIFQSM

SEQ ID NO: 88758 - protein, 11 aa, Artificial Sequence
  Description of Artificial Sequence: Synthetic peptide
  Seed: LQIPVSSSFSY (MAGC1_HUMAN)
LCIPVSSSFSY

SEQ ID NO: 88759 - protein, 10 aa, Artificial Sequence
  Description of Artificial Sequence: Synthetic peptide
  Seed: LHFPQSPPEW (MAGC1_HUMAN)
LTFPQSPPEW

SEQ ID NO: 88760 - protein, 11 aa, Artificial Sequence
  Description of Artificial Sequence: Synthetic peptide
  Seed: SLIESEPLFTY (MAGC1_HUMAN)
SIIESEPLFTY

SEQ ID NO: 88761 - protein, 10 aa, Artificial Sequence
  Description of Artificial Sequence: Synthetic peptide
  Seed: LQIPVSRSFS (MAGC1_HUMAN)
LTIPVSRSFY

SEQ ID NO: 88762 - protein, 10 aa, Artificial Sequence
  Description of Artificial Sequence: Synthetic peptide
  Seed: TVPITFPSSY (MAGC1_HUMAN)
TLPITFPSSF

SEQ ID NO: 88763 - protein, 9 aa, Artificial Sequence
  Description of Artificial Sequence: Synthetic peptide
  Seed: WEDSLSPHY (MAGC1_HUMAN)
WLDSLSPHY

SEQ ID NO: 88764 - protein, 8 aa, Artificial Sequence
  Description of Artificial Sequence: Synthetic peptide
  Seed: SSSTLVSI (MAGC1_HUMAN)
SQSTLVSI

SEQ ID NO: 88765 - protein, 10 aa, Artificial Sequence
  Description of Artificial Sequence: Synthetic peptide
  Seed: PLQNPASSFF (MAGC1_HUMAN)
PRQNPASSFY

SEQ ID NO: 88766 - protein, 11 aa, Artificial Sequence
  Description of Artificial Sequence: Synthetic peptide
  Seed: SSTSLSLPQSF (MAGC1_HUMAN)
SKTSLSLPQSW

SEQ ID NO: 88767 - protein, 9 aa, Artificial Sequence
  Description of Artificial Sequence: Synthetic peptide
  Seed: TLLSIFQSS (MAGC1_HUMAN)
TQLSIFQSV

SEQ ID NO: 88768 - protein, 9 aa, Artificial Sequence
  Description of Artificial Sequence: Synthetic peptide
  Seed: LQIPVSPSF (MAGC1_HUMAN)
LLIPVSPSL

SEQ ID NO: 88769 - protein, 9 aa, Artificial Sequence
  Description of Artificial Sequence: Synthetic peptide
  Seed: VSRSFSSTL (MAGC1_HUMAN)
VIRSFSSTY

SEQ ID NO: 88770 - protein, 9 aa, Artificial Sequence
  Description of Artificial Sequence: Synthetic peptide
  Seed: AGREHFAFG (MAGC1_HUMAN)
AMREHFAFR

SEQ ID NO: 88771 - protein, 10 aa, Artificial Sequence
  Description of Artificial Sequence: Synthetic peptide
  Seed: FAQSSLQIPV (MAGC1_HUMAN)
FQQSSLQIPA

SEQ ID NO: 88772 - protein, 9 aa, Artificial Sequence
  Description of Artificial Sequence: Synthetic peptide
  Seed: SQNRLLILI (MAGC1_HUMAN)
SENRLLILP

SEQ ID NO: 88773 - protein, 10 aa, Artificial Sequence
  Description of Artificial Sequence: Synthetic peptide
  Seed: SSFPSSTSSS (MAGC1_HUMAN)
STFPSSTSSY

SEQ ID NO: 88774 - protein, 11 aa, Artificial Sequence
  Description of Artificial Sequence: Synthetic peptide
  Seed: SPLQRPVSSFF (MAGC1_HUMAN)
SWLQRPVSSFF

SEQ ID NO: 88775 - protein, 9 aa, Artificial Sequence
  Description of Artificial Sequence: Synthetic peptide
  Seed: FSSTLLSLF (MAGC1_HUMAN)
FGSTLLSLW

SEQ ID NO: 88776 - protein, 10 aa, Artificial Sequence
  Description of Artificial Sequence: Synthetic peptide
  Seed: KAEMLTNVIS (MAGC1_HUMAN)
KEEMLTNVIA

SEQ ID NO: 88777 - protein, 10 aa, Artificial Sequence
  Description of Artificial Sequence: Synthetic peptide
  Seed: IEILFGISLR (MAGC1_HUMAN)
IWILFGISLR

SEQ ID NO: 88778 - protein, 9 aa, Artificial Sequence
  Description of Artificial Sequence: Synthetic peptide
  Seed: VSRSFSSTL (MAGC1_HUMAN)
VTRSFSSTA

SEQ ID NO: 88779 - protein, 9 aa, Artificial Sequence
  Description of Artificial Sequence: Synthetic peptide
  Seed: GFPQSPLQI (MAGC1_HUMAN)
GFPQSPLQM

SEQ ID NO: 88780 - protein, 9 aa, Artificial Sequence
  Description of Artificial Sequence: Synthetic peptide
  Seed: NTHSPLQIV (MAGC1_HUMAN)
NAHSPLQII

SEQ ID NO: 88781 - protein, 9 aa, Artificial Sequence
  Description of Artificial Sequence: Synthetic peptide
  Seed: CSSSTSLSL (MAGC1_HUMAN)
CTSSTSLSF

SEQ ID NO: 88782 - protein, 10 aa, Artificial Sequence
  Description of Artificial Sequence: Synthetic peptide
  Seed: SFPSSTSSSL (MAGC1_HUMAN)
SCPSSTSSSL

SEQ ID NO: 88783 - protein, 9 aa, Artificial Sequence
  Description of Artificial Sequence: Synthetic peptide
  Seed: SQNRLLILI (MAGC1_HUMAN)
SMNRLLILW

SEQ ID NO: 88784 - protein, 11 aa, Artificial Sequence
  Description of Artificial Sequence: Synthetic peptide
  Seed: KGTYASEEVIW (MAGC1_HUMAN)
KMTYASEEVIW

SEQ ID NO: 88785 - protein, 10 aa, Artificial Sequence
  Description of Artificial Sequence: Synthetic peptide
  Seed: PLQIPGSPSF (MAGC1_HUMAN)
PSQIPGSPSM

SEQ ID NO: 88786 - protein, 11 aa, Artificial Sequence
  Description of Artificial Sequence: Synthetic peptide
  Seed: LQIPVSSSFSY (MAGC1_HUMAN)
LFIPVSSSFSM

SEQ ID NO: 88787 - protein, 9 aa, Artificial Sequence
  Description of Artificial Sequence: Synthetic peptide
  Seed: VSPSSSSTL (MAGC1_HUMAN)
VPPSSSSTL

SEQ ID NO: 88788 - protein, 10 aa, Artificial Sequence
  Description of Artificial Sequence: Synthetic peptide
  Seed: MTSSFSSTLL (MAGC1_HUMAN)
MDSSFSSTLW

SEQ ID NO: 88789 - protein, 11 aa, Artificial Sequence
  Description of Artificial Sequence: Synthetic peptide
  Seed: SFFSYTLASLL (MAGC1_HUMAN)
SAFSYTLASLY

SEQ ID NO: 88790 - protein, 9 aa, Artificial Sequence
  Description of Artificial Sequence: Synthetic peptide
  Seed: SPLQSPVSS (MAGC1_HUMAN)
STLQSPVSW

SEQ ID NO: 88791 - protein, 10 aa, Artificial Sequence
  Description of Artificial Sequence: Synthetic peptide
  Seed: SPLYFPQSPL (MAGC1_HUMAN)
SYLYFPQSPA

SEQ ID NO: 88792 - protein, 11 aa, Artificial Sequence
  Description of Artificial Sequence: Synthetic peptide
  Seed: RPVSSFFSYTL (MAGC1_HUMAN)
RDVSSFFSYTF

SEQ ID NO: 88793 - protein, 11 aa, Artificial Sequence
  Description of Artificial Sequence: Synthetic peptide
  Seed: SPLQIPVSRSF (MAGC1_HUMAN)
SNLQIPVSRSY

SEQ ID NO: 88794 - protein, 11 aa, Artificial Sequence
  Description of Artificial Sequence: Synthetic peptide
  Seed: SPLQRPVSSFF (MAGC1_HUMAN)
STLQRPVSSFF

SEQ ID NO: 88795 - protein, 10 aa, Artificial Sequence
  Description of Artificial Sequence: Synthetic peptide
  Seed: LAMLKNTVPI (MAGC1_HUMAN)
LCMLKNTVPL

SEQ ID NO: 88796 - protein, 9 aa, Artificial Sequence
  Description of Artificial Sequence: Synthetic peptide
  Seed: AQSPLQIPV (MAGC1_HUMAN)
AYSPLQIPL

SEQ ID NO: 88797 - protein, 9 aa, Artificial Sequence
  Description of Artificial Sequence: Synthetic peptide
  Seed: SAPEGEDSL (MAGC1_HUMAN)
SVPEGEDSL

SEQ ID NO: 88798 - protein, 9 aa, Artificial Sequence
  Description of Artificial Sequence: Synthetic peptide
  Seed: QFPPQGEDF (MAGC1_HUMAN)
QAPPQGEDL

SEQ ID NO: 88799 - protein, 11 aa, Artificial Sequence
  Description of Artificial Sequence: Synthetic peptide
  Seed: NTVPITFPSSY (MAGC1_HUMAN)
NPVPITFPSSF

SEQ ID NO: 88800 - protein, 9 aa, Artificial Sequence
  Description of Artificial Sequence: Synthetic peptide
  Seed: RPVSSFFSY (MAGC1_HUMAN)
RMVSSFFSV

SEQ ID NO: 88801 - protein, 9 aa, Artificial Sequence
  Description of Artificial Sequence: Synthetic peptide
  Seed: FSEESSSPV (MAGC1_HUMAN)
FQEESSSPF

SEQ ID NO: 88802 - protein, 10 aa, Artificial Sequence
  Description of Artificial Sequence: Synthetic peptide
  Seed: PLQIPMTSSF (MAGC1_HUMAN)
PYQIPMTSSY

SEQ ID NO: 88803 - protein, 9 aa, Artificial Sequence
  Description of Artificial Sequence: Synthetic peptide
  Seed: AQSPLQRPV (MAGC1_HUMAN)
AVSPLQRPF

SEQ ID NO: 88804 - protein, 10 aa, Artificial Sequence
  Description of Artificial Sequence: Synthetic peptide
  Seed: SMSPLYFPQS (MAGC1_HUMAN)
SMSPLYFPQL

SEQ ID NO: 88805 - protein, 9 aa, Artificial Sequence
  Description of Artificial Sequence: Synthetic peptide
  Seed: VSSSFSYTL (MAGC1_HUMAN)
VMSSFSYTY

SEQ ID NO: 88806 - protein, 9 aa, Artificial Sequence
  Description of Artificial Sequence: Synthetic peptide
  Seed: KAREFIEIL (MAGC1_HUMAN)
KEREFIEIY

SEQ ID NO: 88807 - protein, 10 aa, Artificial Sequence
  Description of Artificial Sequence: Synthetic peptide
  Seed: FSSSTSLSPF (MAGC1_HUMAN)
FRSSTSLSPW

SEQ ID NO: 88808 - protein, 10 aa, Artificial Sequence
  Description of Artificial Sequence: Synthetic peptide
  Seed: ISRYTGYFPV (MAGC1_HUMAN)
IKRYTGYFPM

SEQ ID NO: 88809 - protein, 10 aa, Artificial Sequence
  Description of Artificial Sequence: Synthetic peptide
  Seed: RAGREHFAFG (MAGC1_HUMAN)
RSGREHFAFP

SEQ ID NO: 88810 - protein, 9 aa, Artificial Sequence
  Description of Artificial Sequence: Synthetic peptide
  Seed: YQVKQPITK (MAGC1_HUMAN)
YLVKQPITF

SEQ ID NO: 88811 - protein, 9 aa, Artificial Sequence
  Description of Artificial Sequence: Synthetic peptide
  Seed: AASSSTLVS (MAGC1_HUMAN)
ATSSSTLVF

SEQ ID NO: 88812 - protein, 10 aa, Artificial Sequence
  Description of Artificial Sequence: Synthetic peptide
  Seed: LSQSSPVSSF (MAGC1_HUMAN)
LVQSSPVSSY

SEQ ID NO: 88813 - protein, 10 aa, Artificial Sequence
  Description of Artificial Sequence: Synthetic peptide
  Seed: LAMLKNTVPI (MAGC1_HUMAN)
LRMLKNTVPI

SEQ ID NO: 88814 - protein, 9 aa, Artificial Sequence
  Description of Artificial Sequence: Synthetic peptide
  Seed: EILFGISLR (MAGC1_HUMAN)
ETLFGISLR

SEQ ID NO: 88815 - protein, 9 aa, Artificial Sequence
  Description of Artificial Sequence: Synthetic peptide
  Seed: VQEHYLEYR (MAGC1_HUMAN)
VMEHYLEYY

SEQ ID NO: 88816 - protein, 9 aa, Artificial Sequence
  Description of Artificial Sequence: Synthetic peptide
  Seed: SSPESTQSP (MAGC1_HUMAN)
SQPESTQSL

SEQ ID NO: 88817 - protein, 9 aa, Artificial Sequence
  Description of Artificial Sequence: Synthetic peptide
  Seed: SPPEGENTH (MAGC1_HUMAN)
SAPEGENTF

SEQ ID NO: 88818 - protein, 9 aa, Artificial Sequence
  Description of Artificial Sequence: Synthetic peptide
  Seed: AQSPLQRPV (MAGC1_HUMAN)
AISPLQRPY

SEQ ID NO: 88819 - protein, 10 aa, Artificial Sequence
  Description of Artificial Sequence: Synthetic peptide
  Seed: FFSYTLASLL (MAGC1_HUMAN)
FQSYTLASLL

SEQ ID NO: 88820 - protein, 9 aa, Artificial Sequence
  Description of Artificial Sequence: Synthetic peptide
  Seed: ISRYTGYFP (MAGC1_HUMAN)
IARYTGYFA

SEQ ID NO: 88821 - protein, 9 aa, Artificial Sequence
  Description of Artificial Sequence: Synthetic peptide
  Seed: VSSSSSSTL (MAGC1_HUMAN)
VASSSSSTV

SEQ ID NO: 88822 - protein, 9 aa, Artificial Sequence
  Description of Artificial Sequence: Synthetic peptide
  Seed: AGREHFAFG (MAGC1_HUMAN)
AMREHFAFA

SEQ ID NO: 88823 - protein, 11 aa, Artificial Sequence
  Description of Artificial Sequence: Synthetic peptide
  Seed: IPMTSSFSSTL (MAGC1_HUMAN)
ISMTSSFSSTF

SEQ ID NO: 88824 - protein, 11 aa, Artificial Sequence
  Description of Artificial Sequence: Synthetic peptide
  Seed: SPLQIPMTSSF (MAGC1_HUMAN)
STLQIPMTSSM

SEQ ID NO: 88825 - protein, 10 aa, Artificial Sequence
  Description of Artificial Sequence: Synthetic peptide
  Seed: LQIVPSLPEW (MAGC1_HUMAN)
LSIVPSLPEL

SEQ ID NO: 88826 - protein, 9 aa, Artificial Sequence
  Description of Artificial Sequence: Synthetic peptide
  Seed: LLSLFQSFS (MAGC1_HUMAN)
LVSLFQSFV

SEQ ID NO: 88827 - protein, 11 aa, Artificial Sequence
  Description of Artificial Sequence: Synthetic peptide
  Seed: SSFPSSTSSSL (MAGC1_HUMAN)
SCFPSSTSSSW

SEQ ID NO: 88828 - protein, 8 aa, Artificial Sequence
  Description of Artificial Sequence: Synthetic peptide
  Seed: SSSFSYTL (MAGC1_HUMAN)
SASFSYTL

SEQ ID NO: 88829 - protein, 9 aa, Artificial Sequence
  Description of Artificial Sequence: Synthetic peptide
  Seed: EVDPDDSYV (MAGC1_HUMAN)
ETDPDDSYL

SEQ ID NO: 88830 - protein, 11 aa, Artificial Sequence
  Description of Artificial Sequence: Synthetic peptide
  Seed: SPLQIPVSSSS (MAGC1_HUMAN)
SVLQIPVSSSF

SEQ ID NO: 88831 - protein, 9 aa, Artificial Sequence
  Description of Artificial Sequence: Synthetic peptide
  Seed: MTSSFSSTL (MAGC1_HUMAN)
MGSSFSSTF

SEQ ID NO: 88832 - protein, 9 aa, Artificial Sequence
  Description of Artificial Sequence: Synthetic peptide
  Seed: AEMLTNVIS (MAGC1_HUMAN)
AEMLTNVIA

SEQ ID NO: 88833 - protein, 10 aa, Artificial Sequence
  Description of Artificial Sequence: Synthetic peptide
  Seed: VISFSSSTSL (MAGC1_HUMAN)
VWSFSSSTSM

SEQ ID NO: 88834 - protein, 8 aa, Artificial Sequence
  Description of Artificial Sequence: Synthetic peptide
  Seed: GPRAHSEV (MAGC1_HUMAN)
GPRAHSEM

SEQ ID NO: 88835 - protein, 9 aa, Artificial Sequence
  Description of Artificial Sequence: Synthetic peptide
  Seed: LQIPVSAAS (MAGC1_HUMAN)
LNIPVSAAF

SEQ ID NO: 88836 - protein, 10 aa, Artificial Sequence
  Description of Artificial Sequence: Synthetic peptide
  Seed: SLQIPVSPSF (MAGC1_HUMAN)
SWQIPVSPSF

SEQ ID NO: 88837 - protein, 11 aa, Artificial Sequence
  Description of Artificial Sequence: Synthetic peptide
  Seed: RPVSSFFSYTL (MAGC1_HUMAN)
RIVSSFFSYTW

SEQ ID NO: 88838 - protein, 9 aa, Artificial Sequence
  Description of Artificial Sequence: Synthetic peptide
  Seed: VPITFPSSY (MAGC1_HUMAN)
VYITFPSSY

SEQ ID NO: 88839 - protein, 9 aa, Artificial Sequence
  Description of Artificial Sequence: Synthetic peptide
  Seed: MTSSFSSTL (MAGC1_HUMAN)
MQSSFSSTG

SEQ ID NO: 88840 - protein, 9 aa, Artificial Sequence
  Description of Artificial Sequence: Synthetic peptide
  Seed: SSSSTLLSL (MAGC1_HUMAN)
SYSSTLLSI

SEQ ID NO: 88841 - protein, 11 aa, Artificial Sequence
  Description of Artificial Sequence: Synthetic peptide
  Seed: QSSPESAQSAF (MAGC1_HUMAN)
QQSPESAQSAF

SEQ ID NO: 88842 - protein, 10 aa, Artificial Sequence
  Description of Artificial Sequence: Synthetic peptide
  Seed: SSPERTQSTF (MAGC1_HUMAN)
SLPERTQSTF

SEQ ID NO: 88843 - protein, 9 aa, Artificial Sequence
  Description of Artificial Sequence: Synthetic peptide
  Seed: SKSSPESPL (MAGC1_HUMAN)
SHSSPESPF

SEQ ID NO: 88844 - protein, 9 aa, Artificial Sequence
  Description of Artificial Sequence: Synthetic peptide
  Seed: TLDEKVDEL (MAGC1_HUMAN)
TQDEKVDEM

SEQ ID NO: 88845 - protein, 9 aa, Artificial Sequence
  Description of Artificial Sequence: Synthetic peptide
  Seed: SSPEGKDSL (MAGC1_HUMAN)
SAPEGKDSI

SEQ ID NO: 88846 - protein, 9 aa, Artificial Sequence
  Description of Artificial Sequence: Synthetic peptide
  Seed: FSSTLLSLF (MAGC1_HUMAN)
FHSTLLSLF

SEQ ID NO: 88847 - protein, 10 aa, Artificial Sequence
  Description of Artificial Sequence: Synthetic peptide
  Seed: AASSSTLVSI (MAGC1_HUMAN)
AQSSSTLVSW

SEQ ID NO: 88848 - protein, 10 aa, Artificial Sequence
  Description of Artificial Sequence: Synthetic peptide
  Seed: MPTAGMPSLL (MAGC1_HUMAN)
MATAGMPSLA

SEQ ID NO: 88849 - protein, 9 aa, Artificial Sequence
  Description of Artificial Sequence: Synthetic peptide
  Seed: ASSSTLVSI (MAGC1_HUMAN)
ALSSTLVSM

SEQ ID NO: 88850 - protein, 9 aa, Artificial Sequence
  Description of Artificial Sequence: Synthetic peptide
  Seed: VSPSFSSTL (MAGC1_HUMAN)
VWPSFSSTW

SEQ ID NO: 88851 - protein, 10 aa, Artificial Sequence
  Description of Artificial Sequence: Synthetic peptide
  Seed: ATESASSSVM (MAGC1_HUMAN)
AQESASSSVY

SEQ ID NO: 88852 - protein, 9 aa, Artificial Sequence
  Description of Artificial Sequence: Synthetic peptide
  Seed: LLSLFQSFS (MAGC1_HUMAN)
LMSLFQSFA

SEQ ID NO: 88853 - protein, 9 aa, Artificial Sequence
  Description of Artificial Sequence: Synthetic peptide
  Seed: SAASSSTLV (MAGC1_HUMAN)
SAASSSTLY

SEQ ID NO: 88854 - protein, 9 aa, Artificial Sequence
  Description of Artificial Sequence: Synthetic peptide
  Seed: EMLTNVISR (MAGC1_HUMAN)
EGLTNVISR

SEQ ID NO: 88855 - protein, 8 aa, Artificial Sequence
  Description of Artificial Sequence: Synthetic peptide
  Seed: LQNPASSF (MAGC1_HUMAN)
LANPASSM

SEQ ID NO: 88856 - protein, 10 aa, Artificial Sequence
  Description of Artificial Sequence: Synthetic peptide
  Seed: VSRSFSSTLL (MAGC1_HUMAN)
VIRSFSSTLK

SEQ ID NO: 88857 - protein, 10 aa, Artificial Sequence
  Description of Artificial Sequence: Synthetic peptide
  Seed: LLQIPMTSSF (MAGC1_HUMAN)
LQQIPMTSSL

SEQ ID NO: 88858 - protein, 10 aa, Artificial Sequence
  Description of Artificial Sequence: Synthetic peptide
  Seed: FFSYTLASLL (MAGC1_HUMAN)
FTSYTLASLI

SEQ ID NO: 88859 - protein, 9 aa, Artificial Sequence
  Description of Artificial Sequence: Synthetic peptide
  Seed: RTQSTFEGF (MAGC1_HUMAN)
RGQSTFEGY

SEQ ID NO: 88860 - protein, 10 aa, Artificial Sequence
  Description of Artificial Sequence: Synthetic peptide
  Seed: TGYFPVIFRK (MAGC1_HUMAN)
TVYFPVIFRM

SEQ ID NO: 88861 - protein, 9 aa, Artificial Sequence
  Description of Artificial Sequence: Synthetic peptide
  Seed: MLTNVISRY (MAGC1_HUMAN)
MSTNVISRR

SEQ ID NO: 88862 - protein, 9 aa, Artificial Sequence
  Description of Artificial Sequence: Synthetic peptide
  Seed: LQIPVSRSF (MAGC1_HUMAN)
LYIPVSRSI

SEQ ID NO: 88863 - protein, 9 aa, Artificial Sequence
  Description of Artificial Sequence: Synthetic peptide
  Seed: LQIPVSPSF (MAGC1_HUMAN)
LHIPVSPSY

SEQ ID NO: 88864 - protein, 11 aa, Artificial Sequence
  Description of Artificial Sequence: Synthetic peptide
  Seed: SAASSSTLVSI (MAGC1_HUMAN)
SIASSSTLVSY

SEQ ID NO: 88865 - protein, 9 aa, Artificial Sequence
  Description of Artificial Sequence: Synthetic peptide
  Seed: TLDEKVDEL (MAGC1_HUMAN)
TADEKVDEI

SEQ ID NO: 88866 - protein, 9 aa, Artificial Sequence
  Description of Artificial Sequence: Synthetic peptide
  Seed: SSSSTLLSL (MAGC1_HUMAN)
SWSSTLLSY

SEQ ID NO: 88867 - protein, 9 aa, Artificial Sequence
  Description of Artificial Sequence: Synthetic peptide
  Seed: SSPESDDTL (MAGC1_HUMAN)
SFPESDDTF

SEQ ID NO: 88868 - protein, 10 aa, Artificial Sequence
  Description of Artificial Sequence: Synthetic peptide
  Seed: LQIPGSPSFS (MAGC1_HUMAN)
LMIPGSPSFG

SEQ ID NO: 88869 - protein, 9 aa, Artificial Sequence
  Description of Artificial Sequence: Synthetic peptide
  Seed: SSSESPQSC (MAGC1_HUMAN)
SASESPQSH

SEQ ID NO: 88870 - protein, 9 aa, Artificial Sequence
  Description of Artificial Sequence: Synthetic peptide
  Seed: KDSLSPLEI (MAGC1_HUMAN)
KESLSPLEC

SEQ ID NO: 88871 - protein, 9 aa, Artificial Sequence
  Description of Artificial Sequence: Synthetic peptide
  Seed: VIFRKAREF (MAGC1_HUMAN)
VKFRKAREY

SEQ ID NO: 88872 - protein, 9 aa, Artificial Sequence
  Description of Artificial Sequence: Synthetic peptide
  Seed: LQNPASSFF (MAGC1_HUMAN)
LTNPASSFY

SEQ ID NO: 88873 - protein, 11 aa, Artificial Sequence
  Description of Artificial Sequence: Synthetic peptide
  Seed: FLAMLKNTVPI (MAGC1_HUMAN)
FMAMLKNTVPM

SEQ ID NO: 88874 - protein, 9 aa, Artificial Sequence
  Description of Artificial Sequence: Synthetic peptide
  Seed: IPVSSSSSS (MAGC1_HUMAN)
IPVSSSSSI

SEQ ID NO: 88875 - protein, 11 aa, Artificial Sequence
  Description of Artificial Sequence: Synthetic peptide
  Seed: KRKVVEFLAML (MAGC1_HUMAN)
KGKVVEFLAMV

SEQ ID NO: 88876 - protein, 10 aa, Artificial Sequence
  Description of Artificial Sequence: Synthetic peptide
  Seed: RAGREHFAFG (MAGC1_HUMAN)
RVGREHFAFF

SEQ ID NO: 88877 - protein, 9 aa, Artificial Sequence
  Description of Artificial Sequence: Synthetic peptide
  Seed: GSPSFSSTL (MAGC1_HUMAN)
GYPSFSSTM

SEQ ID NO: 88878 - protein, 9 aa, Artificial Sequence
  Description of Artificial Sequence: Synthetic peptide
  Seed: AFGEPRELL (MAGC1_HUMAN)
AYGEPRELY

SEQ ID NO: 88879 - protein, 9 aa, Artificial Sequence
  Description of Artificial Sequence: Synthetic peptide
  Seed: FFSYTLASL (MAGC1_HUMAN)
FLSYTLASS

SEQ ID NO: 88880 - protein, 10 aa, Artificial Sequence
  Description of Artificial Sequence: Synthetic peptide
  Seed: SLQIPVSPSF (MAGC1_HUMAN)
SYQIPVSPSW

SEQ ID NO: 88881 - protein, 10 aa, Artificial Sequence
  Description of Artificial Sequence: Synthetic peptide
  Seed: MPTAGMPSLL (MAGC1_HUMAN)
MCTAGMPSLY

SEQ ID NO: 88882 - protein, 9 aa, Artificial Sequence
  Description of Artificial Sequence: Synthetic peptide
  Seed: GEDSQSPLQ (MAGC1_HUMAN)
GEDSQSPLA

SEQ ID NO: 88883 - protein, 10 aa, Artificial Sequence
  Description of Artificial Sequence: Synthetic peptide
  Seed: SFFSSALLSI (MAGC1_HUMAN)
SWFSSALLSI

SEQ ID NO: 88884 - protein, 9 aa, Artificial Sequence
  Description of Artificial Sequence: Synthetic peptide
  Seed: TSLSLPQSF (MAGC1_HUMAN)
TKLSLPQSF

SEQ ID NO: 88885 - protein, 9 aa, Artificial Sequence
  Description of Artificial Sequence: Synthetic peptide
  Seed: FPSSTSSSL (MAGC1_HUMAN)
FTSSTSSSV

SEQ ID NO: 88886 - protein, 10 aa, Artificial Sequence
  Description of Artificial Sequence: Synthetic peptide
  Seed: FFSSALLSIF (MAGC1_HUMAN)
FASSALLSIF

SEQ ID NO: 88887 - protein, 9 aa, Artificial Sequence
  Description of Artificial Sequence: Synthetic peptide
  Seed: FSYTLASLL (MAGC1_HUMAN)
FTYTLASLV

SEQ ID NO: 88888 - protein, 9 aa, Artificial Sequence
  Description of Artificial Sequence: Synthetic peptide
  Seed: SSFFSSALL (MAGC1_HUMAN)
SYFFSSALF

SEQ ID NO: 88889 - protein, 11 aa, Artificial Sequence
  Description of Artificial Sequence: Synthetic peptide
  Seed: IPVSSSFSYTL (MAGC1_HUMAN)
IIVSSSFSYTW

SEQ ID NO: 88890 - protein, 10 aa, Artificial Sequence
  Description of Artificial Sequence: Synthetic peptide
  Seed: QRPVSSFFSY (MAGC1_HUMAN)
QYPVSSFFSY

SEQ ID NO: 88891 - protein, 9 aa, Artificial Sequence
  Description of Artificial Sequence: Synthetic peptide
  Seed: LQIPVSAAS (MAGC1_HUMAN)
LLIPVSAAF

SEQ ID NO: 88892 - protein, 9 aa, Artificial Sequence
  Description of Artificial Sequence: Synthetic peptide
  Seed: RKVVEFLAM (MAGC1_HUMAN)
RMVVEFLAA

SEQ ID NO: 88893 - protein, 10 aa, Artificial Sequence
  Description of Artificial Sequence: Synthetic peptide
  Seed: EGPAQSPLQR (MAGC1_HUMAN)
EAPAQSPLQK

SEQ ID NO: 88894 - protein, 9 aa, Artificial Sequence
  Description of Artificial Sequence: Synthetic peptide
  Seed: TLDEKVDEL (MAGC1_HUMAN)
TSDEKVDEF

SEQ ID NO: 88895 - protein, 10 aa, Artificial Sequence
  Description of Artificial Sequence: Synthetic peptide
  Seed: ILILSIIFIK (MAGC1_HUMAN)
IHILSIIFIR

SEQ ID NO: 88896 - protein, 9 aa, Artificial Sequence
  Description of Artificial Sequence: Synthetic peptide
  Seed: LKNTVPITF (MAGC1_HUMAN)
LINTVPITM

SEQ ID NO: 88897 - protein, 9 aa, Artificial Sequence
  Description of Artificial Sequence: Synthetic peptide
  Seed: AGREHFAFG (MAGC1_HUMAN)
AQREHFAFA

SEQ ID NO: 88898 - protein, 10 aa, Artificial Sequence
  Description of Artificial Sequence: Synthetic peptide
  Seed: EESSSPVDEY (MAGC1_HUMAN)
EESSSPVDEF

SEQ ID NO: 88899 - protein, 10 aa, Artificial Sequence
  Description of Artificial Sequence: Synthetic peptide
  Seed: LAMLKNTVPI (MAGC1_HUMAN)
LWMLKNTVPI

SEQ ID NO: 88900 - protein, 9 aa, Artificial Sequence
  Description of Artificial Sequence: Synthetic peptide
  Seed: TSSFSSTLL (MAGC1_HUMAN)
TISFSSTLW

SEQ ID NO: 88901 - protein, 9 aa, Artificial Sequence
  Description of Artificial Sequence: Synthetic peptide
  Seed: CSSSTSLSL (MAGC1_HUMAN)
CMSSTSLSW

SEQ ID NO: 88902 - protein, 9 aa, Artificial Sequence
  Description of Artificial Sequence: Synthetic peptide
  Seed: LQIPVSSSS (MAGC1_HUMAN)
LCIPVSSSF

SEQ ID NO: 88903 - protein, 9 aa, Artificial Sequence
  Description of Artificial Sequence: Synthetic peptide
  Seed: SSFFSSALL (MAGC1_HUMAN)
SQFFSSALF

SEQ ID NO: 88904 - protein, 11 aa, Artificial Sequence
  Description of Artificial Sequence: Synthetic peptide
  Seed: TTDDSTATESA (MAGC1_HUMAN)
TVDDSTATESI

SEQ ID NO: 88905 - protein, 9 aa, Artificial Sequence
  Description of Artificial Sequence: Synthetic peptide
  Seed: NPASSFFSS (MAGC1_HUMAN)
NCASSFFSY

SEQ ID NO: 88906 - protein, 8 aa, Artificial Sequence
  Description of Artificial Sequence: Synthetic peptide
  Seed: QIPVSRSF (MAGC1_HUMAN)
QYPVSRSF

SEQ ID NO: 88907 - protein, 8 aa, Artificial Sequence
  Description of Artificial Sequence: Synthetic peptide
  Seed: SSFFSSAL (MAGC1_HUMAN)
SQFFSSAL

SEQ ID NO: 88908 - protein, 9 aa, Artificial Sequence
  Description of Artificial Sequence: Synthetic peptide
  Seed: LQIPGSPSF (MAGC1_HUMAN)
LSIPGSPSW

SEQ ID NO: 88909 - protein, 10 aa, Artificial Sequence
  Description of Artificial Sequence: Synthetic peptide
  Seed: VPITFPSSYK (MAGC1_HUMAN)
VWITFPSSYK

SEQ ID NO: 88910 - protein, 11 aa, Artificial Sequence
  Description of Artificial Sequence: Synthetic peptide
  Seed: IIDTTDDSTAT (MAGC1_HUMAN)
IVDTTDDSTAM

SEQ ID NO: 88911 - protein, 10 aa, Artificial Sequence
  Description of Artificial Sequence: Synthetic peptide
  Seed: IEILFGISLR (MAGC1_HUMAN)
ITILFGISLR

SEQ ID NO: 88912 - protein, 10 aa, Artificial Sequence
  Description of Artificial Sequence: Synthetic peptide
  Seed: SPQSPPEGPA (MAGC1_HUMAN)
SPQSPPEGPF

SEQ ID NO: 88913 - protein, 9 aa, Artificial Sequence
  Description of Artificial Sequence: Synthetic peptide
  Seed: SSPECTQST (MAGC1_HUMAN)
SCPECTQSM

SEQ ID NO: 88914 - protein, 10 aa, Artificial Sequence
  Description of Artificial Sequence: Synthetic peptide
  Seed: MTSSFSSTLL (MAGC1_HUMAN)
MASSFSSTLY

SEQ ID NO: 88915 - protein, 10 aa, Artificial Sequence
  Description of Artificial Sequence: Synthetic peptide
  Seed: SPLQIPQSSP (MAGC1_HUMAN)
SPLQIPQSSM

SEQ ID NO: 88916 - protein, 11 aa, Artificial Sequence
  Description of Artificial Sequence: Synthetic peptide
  Seed: SPPEGPAQSPL (MAGC1_HUMAN)
SMPEGPAQSPL

SEQ ID NO: 88917 - protein, 9 aa, Artificial Sequence
  Description of Artificial Sequence: Synthetic peptide
  Seed: SSSFSYTLL (MAGC1_HUMAN)
SQSFSYTLF

SEQ ID NO: 88918 - protein, 9 aa, Artificial Sequence
  Description of Artificial Sequence: Synthetic peptide
  Seed: LQIPMTSSF (MAGC1_HUMAN)
LHIPMTSSI

SEQ ID NO: 88919 - protein, 9 aa, Artificial Sequence
  Description of Artificial Sequence: Synthetic peptide
  Seed: SSPERTHST (MAGC1_HUMAN)
SCPERTHSV

SEQ ID NO: 88920 - protein, 9 aa, Artificial Sequence
  Description of Artificial Sequence: Synthetic peptide
  Seed: VSPSFSSTL (MAGC1_HUMAN)
VFPSFSSTI

SEQ ID NO: 88921 - protein, 9 aa, Artificial Sequence
  Description of Artificial Sequence: Synthetic peptide
  Seed: SSPPRYEFL (MAGC1_HUMAN)
SYPPRYEFM

SEQ ID NO: 88922 - protein, 10 aa, Artificial Sequence
  Description of Artificial Sequence: Synthetic peptide
  Seed: STPSSLPQSF (MAGC1_HUMAN)
SIPSSLPQSF

SEQ ID NO: 88923 - protein, 9 aa, Artificial Sequence
  Description of Artificial Sequence: Synthetic peptide
  Seed: LQIPVSSSS (MAGC1_HUMAN)
LPIPVSSSM

SEQ ID NO: 88924 - protein, 10 aa, Artificial Sequence
  Description of Artificial Sequence: Synthetic peptide
  Seed: PLQNPASSFF (MAGC1_HUMAN)
PMQNPASSFF

SEQ ID NO: 88925 - protein, 10 aa, Artificial Sequence
  Description of Artificial Sequence: Synthetic peptide
  Seed: LTKVWVQEHY (MAGC1_HUMAN)
LAKVWVQEHW

SEQ ID NO: 88926 - protein, 9 aa, Artificial Sequence
  Description of Artificial Sequence: Synthetic peptide
  Seed: LKYQVKQPI (MAGC1_HUMAN)
LFYQVKQPF

SEQ ID NO: 88927 - protein, 10 aa, Artificial Sequence
  Description of Artificial Sequence: Synthetic peptide
  Seed: SVLQIPVSAA (MAGC1_HUMAN)
SILQIPVSAV

SEQ ID NO: 88928 - protein, 9 aa, Artificial Sequence
  Description of Artificial Sequence: Synthetic peptide
  Seed: SASSSVMSP (MAGC1_HUMAN)
SISSSVMSL

SEQ ID NO: 88929 - protein, 10 aa, Artificial Sequence
  Description of Artificial Sequence: Synthetic peptide
  Seed: LQIPGSPSFS (MAGC1_HUMAN)
LMIPGSPSFE

SEQ ID NO: 88930 - protein, 10 aa, Artificial Sequence
  Description of Artificial Sequence: Synthetic peptide
  Seed: SSPERTQSTF (MAGC1_HUMAN)
SAPERTQSTL

SEQ ID NO: 88931 - protein, 9 aa, Artificial Sequence
  Description of Artificial Sequence: Synthetic peptide
  Seed: EILFGISLR (MAGC1_HUMAN)
ENLFGISLR

SEQ ID NO: 88932 - protein, 9 aa, Artificial Sequence
  Description of Artificial Sequence: Synthetic peptide
  Seed: TLLSILQSS (MAGC1_HUMAN)
TTLSILQSA

SEQ ID NO: 88933 - protein, 8 aa, Artificial Sequence
  Description of Artificial Sequence: Synthetic peptide
  Seed: FSSALLSI (MAGC1_HUMAN)
FASALLSF

SEQ ID NO: 88934 - protein, 10 aa, Artificial Sequence
  Description of Artificial Sequence: Synthetic peptide
  Seed: MPTAGMPSLL (MAGC1_HUMAN)
MRTAGMPSLV

SEQ ID NO: 88935 - protein, 9 aa, Artificial Sequence
  Description of Artificial Sequence: Synthetic peptide
  Seed: TLASLLQSS (MAGC1_HUMAN)
TTASLLQSI

SEQ ID NO: 88936 - protein, 9 aa, Artificial Sequence
  Description of Artificial Sequence: Synthetic peptide
  Seed: LQRPVSSFF (MAGC1_HUMAN)
LTRPVSSFV

SEQ ID NO: 88937 - protein, 9 aa, Artificial Sequence
  Description of Artificial Sequence: Synthetic peptide
  Seed: FAFGEPREL (MAGC1_HUMAN)
FIFGEPREL

SEQ ID NO: 88938 - protein, 10 aa, Artificial Sequence
  Description of Artificial Sequence: Synthetic peptide
  Seed: RKVVEFLAML (MAGC1_HUMAN)
RCVVEFLAMV

SEQ ID NO: 88939 - protein, 9 aa, Artificial Sequence
  Description of Artificial Sequence: Synthetic peptide
  Seed: SSPESTQSP (MAGC1_HUMAN)
SIPESTQSF

SEQ ID NO: 88940 - protein, 9 aa, Artificial Sequence
  Description of Artificial Sequence: Synthetic peptide
  Seed: FSSTLLSLF (MAGC1_HUMAN)
FYSTLLSLF

SEQ ID NO: 88941 - protein, 10 aa, Artificial Sequence
  Description of Artificial Sequence: Synthetic peptide
  Seed: RSFSSTLLSI (MAGC1_HUMAN)
RAFSSTLLSW

SEQ ID NO: 88942 - protein, 11 aa, Artificial Sequence
  Description of Artificial Sequence: Synthetic peptide
  Seed: LHSPQSPPEGM (MAGC1_HUMAN)
LHSPQSPPEGL

SEQ ID NO: 88943 - protein, 9 aa, Artificial Sequence
  Description of Artificial Sequence: Synthetic peptide
  Seed: VIFRKAREF (MAGC1_HUMAN)
VPFRKAREL

SEQ ID NO: 88944 - protein, 10 aa, Artificial Sequence
  Description of Artificial Sequence: Synthetic peptide
  Seed: RKVVEFLAML (MAGC1_HUMAN)
RMVVEFLAMT

SEQ ID NO: 88945 - protein, 9 aa, Artificial Sequence
  Description of Artificial Sequence: Synthetic peptide
  Seed: LSDEQGMSQ (MAGC1_HUMAN)
LSDEQGMSM

SEQ ID NO: 88946 - protein, 9 aa, Artificial Sequence
  Description of Artificial Sequence: Synthetic peptide
  Seed: TLVSIFQSS (MAGC1_HUMAN)
TLVSIFQSL

SEQ ID NO: 88947 - protein, 11 aa, Artificial Sequence
  Description of Artificial Sequence: Synthetic peptide
  Seed: RSFSSTLLSIF (MAGC1_HUMAN)
RLFSSTLLSIF

SEQ ID NO: 88948 - protein, 10 aa, Artificial Sequence
  Description of Artificial Sequence: Synthetic peptide
  Seed: SSPPRYEFLW (MAGC1_HUMAN)
SYPPRYEFLL

SEQ ID NO: 88949 - protein, 10 aa, Artificial Sequence
  Description of Artificial Sequence: Synthetic peptide
  Seed: LQIPMTSSFS (MAGC1_HUMAN)
LLIPMTSSFY

SEQ ID NO: 88950 - protein, 9 aa, Artificial Sequence
  Description of Artificial Sequence: Synthetic peptide
  Seed: DSYVFVNTL (MAGC1_HUMAN)
DQYVFVNTI

SEQ ID NO: 88951 - protein, 11 aa, Artificial Sequence
  Description of Artificial Sequence: Synthetic peptide
  Seed: RSFSSTLLSIF (MAGC1_HUMAN)
RNFSSTLLSIY

SEQ ID NO: 88952 - protein, 10 aa, Artificial Sequence
  Description of Artificial Sequence: Synthetic peptide
  Seed: KGTYASEEVI (MAGC1_HUMAN)
KVTYASEEVY

SEQ ID NO: 88953 - protein, 11 aa, Artificial Sequence
  Description of Artificial Sequence: Synthetic peptide
  Seed: LQIPVSSSFSY (MAGC1_HUMAN)
LLIPVSSSFSY

SEQ ID NO: 88954 - protein, 9 aa, Artificial Sequence
  Description of Artificial Sequence: Synthetic peptide
  Seed: IPMTSSFSS (MAGC1_HUMAN)
ISMTSSFSF

SEQ ID NO: 88955 - protein, 9 aa, Artificial Sequence
  Description of Artificial Sequence: Synthetic peptide
  Seed: TLLSLFQSF (MAGC1_HUMAN)
TVLSLFQSF

SEQ ID NO: 88956 - protein, 9 aa, Artificial Sequence
  Description of Artificial Sequence: Synthetic peptide
  Seed: VPITFPSSY (MAGC1_HUMAN)
VAITFPSSF

SEQ ID NO: 88957 - protein, 11 aa, Artificial Sequence
  Description of Artificial Sequence: Synthetic peptide
  Seed: LQRPVSSFFSY (MAGC1_HUMAN)
LRRPVSSFFSY

SEQ ID NO: 88958 - protein, 10 aa, Artificial Sequence
  Description of Artificial Sequence: Synthetic peptide
  Seed: SSFSYTLLSL (MAGC1_HUMAN)
SIFSYTLLSL

SEQ ID NO: 88959 - protein, 9 aa, Artificial Sequence
  Description of Artificial Sequence: Synthetic peptide
  Seed: LQIPVSAAS (MAGC1_HUMAN)
LQIPVSAAH

SEQ ID NO: 88960 - protein, 9 aa, Artificial Sequence
  Description of Artificial Sequence: Synthetic peptide
  Seed: NTHSPLQIV (MAGC1_HUMAN)
NQHSPLQIL

SEQ ID NO: 88961 - protein, 10 aa, Artificial Sequence
  Description of Artificial Sequence: Synthetic peptide
  Seed: LAMLKNTVPI (MAGC1_HUMAN)
LCMLKNTVPM

SEQ ID NO: 88962 - protein, 10 aa, Artificial Sequence
  Description of Artificial Sequence: Synthetic peptide
  Seed: FAQSSLQIPV (MAGC1_HUMAN)
FAQSSLQIPL

SEQ ID NO: 88963 - protein, 9 aa, Artificial Sequence
  Description of Artificial Sequence: Synthetic peptide
  Seed: SAQSAFEGF (MAGC1_HUMAN)
SHQSAFEGY

SEQ ID NO: 88964 - protein, 11 aa, Artificial Sequence
  Description of Artificial Sequence: Synthetic peptide
  Seed: FLAMLKNTVPI (MAGC1_HUMAN)
FPAMLKNTVPV

SEQ ID NO: 88965 - protein, 9 aa, Artificial Sequence
  Description of Artificial Sequence: Synthetic peptide
  Seed: MTSSFSSTL (MAGC1_HUMAN)
MVSSFSSTM

SEQ ID NO: 88966 - protein, 9 aa, Artificial Sequence
  Description of Artificial Sequence: Synthetic peptide
  Seed: VSPSFSSTL (MAGC1_HUMAN)
VIPSFSSTF

SEQ ID NO: 88967 - protein, 9 aa, Artificial Sequence
  Description of Artificial Sequence: Synthetic peptide
  Seed: GTYASEEVI (MAGC1_HUMAN)
GQYASEEVM

SEQ ID NO: 88968 - protein, 9 aa, Artificial Sequence
  Description of Artificial Sequence: Synthetic peptide
  Seed: SSPPRYEFL (MAGC1_HUMAN)
SAPPRYEFW

SEQ ID NO: 88969 - protein, 9 aa, Artificial Sequence
  Description of Artificial Sequence: Synthetic peptide
  Seed: MTSSFSSTL (MAGC1_HUMAN)
MPSSFSSTG

SEQ ID NO: 88970 - protein, 9 aa, Artificial Sequence
  Description of Artificial Sequence: Synthetic peptide
  Seed: LQIPVSRSF (MAGC1_HUMAN)
LSIPVSRSV

SEQ ID NO: 88971 - protein, 10 aa, Artificial Sequence
  Description of Artificial Sequence: Synthetic peptide
  Seed: SSPESTQSPF (MAGC1_HUMAN)
SRPESTQSPL

SEQ ID NO: 88972 - protein, 9 aa, Artificial Sequence
  Description of Artificial Sequence: Synthetic peptide
  Seed: RSFSSTLLS (MAGC1_HUMAN)
RMFSSTLLI

SEQ ID NO: 88973 - protein, 9 aa, Artificial Sequence
  Description of Artificial Sequence: Synthetic peptide
  Seed: ELARFLLLK (MAGC1_HUMAN)
ESARFLLLK

SEQ ID NO: 88974 - protein, 9 aa, Artificial Sequence
  Description of Artificial Sequence: Synthetic peptide
  Seed: LQIPGSPSF (MAGC1_HUMAN)
LLIPGSPSF

SEQ ID NO: 88975 - protein, 9 aa, Artificial Sequence
  Description of Artificial Sequence: Synthetic peptide
  Seed: FTYTLDEKV (MAGC1_HUMAN)
FGYTLDEKW

SEQ ID NO: 88976 - protein, 9 aa, Artificial Sequence
  Description of Artificial Sequence: Synthetic peptide
  Seed: SSSDTLLES (MAGC1_HUMAN)
SASDTLLEV

SEQ ID NO: 88977 - protein, 9 aa, Artificial Sequence
  Description of Artificial Sequence: Synthetic peptide
  Seed: VSSFFSYTL (MAGC1_HUMAN)
VGSFFSYTF

SEQ ID NO: 88978 - protein, 9 aa, Artificial Sequence
  Description of Artificial Sequence: Synthetic peptide
  Seed: VIWDVLSGI (MAGC1_HUMAN)
VQWDVLSGV

SEQ ID NO: 88979 - protein, 11 aa, Artificial Sequence
  Description of Artificial Sequence: Synthetic peptide
  Seed: SICSSSTSLSL (MAGC1_HUMAN)
SLCSSSTSLSY

SEQ ID NO: 88980 - protein, 10 aa, Artificial Sequence
  Description of Artificial Sequence: Synthetic peptide
  Seed: VSICSSSTSL (MAGC1_HUMAN)
VMICSSSTSY

SEQ ID NO: 88981 - protein, 9 aa, Artificial Sequence
  Description of Artificial Sequence: Synthetic peptide
  Seed: GTYASEEVI (MAGC1_HUMAN)
GSYASEEVW

SEQ ID NO: 88982 - protein, 9 aa, Artificial Sequence
  Description of Artificial Sequence: Synthetic peptide
  Seed: TTDDSTATE (MAGC1_HUMAN)
TSDDSTATA

SEQ ID NO: 88983 - protein, 10 aa, Artificial Sequence
  Description of Artificial Sequence: Synthetic peptide
  Seed: EILFGISLRE (MAGC1_HUMAN)
EILFGISLRK

SEQ ID NO: 88984 - protein, 9 aa, Artificial Sequence
  Description of Artificial Sequence: Synthetic peptide
  Seed: LQIPVSPSF (MAGC1_HUMAN)
LPIPVSPSY

SEQ ID NO: 88985 - protein, 11 aa, Artificial Sequence
  Description of Artificial Sequence: Synthetic peptide
  Seed: IPMTSSFSSTL (MAGC1_HUMAN)
ITMTSSFSSTM

SEQ ID NO: 88986 - protein, 9 aa, Artificial Sequence
  Description of Artificial Sequence: Synthetic peptide
  Seed: FEGFAQSSL (MAGC1_HUMAN)
FEGFAQSSY

SEQ ID NO: 88987 - protein, 10 aa, Artificial Sequence
  Description of Artificial Sequence: Synthetic peptide
  Seed: KRKVVEFLAM (MAGC1_HUMAN)
KYKVVEFLAM

SEQ ID NO: 88988 - protein, 10 aa, Artificial Sequence
  Description of Artificial Sequence: Synthetic peptide
  Seed: MTSSFSSTLL (MAGC1_HUMAN)
MGSSFSSTLF

SEQ ID NO: 88989 - protein, 9 aa, Artificial Sequence
  Description of Artificial Sequence: Synthetic peptide
  Seed: AQSPLQSPV (MAGC1_HUMAN)
ARSPLQSPF

SEQ ID NO: 88990 - protein, 10 aa, Artificial Sequence
  Description of Artificial Sequence: Synthetic peptide
  Seed: MPTAGMPSLL (MAGC1_HUMAN)
MGTAGMPSLL

SEQ ID NO: 88991 - protein, 9 aa, Artificial Sequence
  Description of Artificial Sequence: Synthetic peptide
  Seed: LQIPVSSSS (MAGC1_HUMAN)
LNIPVSSSM

SEQ ID NO: 88992 - protein, 9 aa, Artificial Sequence
  Description of Artificial Sequence: Synthetic peptide
  Seed: ISRYTGYFP (MAGC1_HUMAN)
ISRYTGYFK

SEQ ID NO: 88993 - protein, 10 aa, Artificial Sequence
  Description of Artificial Sequence: Synthetic peptide
  Seed: SIIFIKGTYA (MAGC1_HUMAN)
SVIFIKGTYV

SEQ ID NO: 88994 - protein, 11 aa, Artificial Sequence
  Description of Artificial Sequence: Synthetic peptide
  Seed: RPVSSFFSYTL (MAGC1_HUMAN)
RFVSSFFSYTY

SEQ ID NO: 88995 - protein, 9 aa, Artificial Sequence
  Description of Artificial Sequence: Synthetic peptide
  Seed: VPITFPSSY (MAGC1_HUMAN)
VKITFPSSF

SEQ ID NO: 88996 - protein, 11 aa, Artificial Sequence
  Description of Artificial Sequence: Synthetic peptide
  Seed: AMLKNTVPITF (MAGC1_HUMAN)
AQLKNTVPITW

SEQ ID NO: 88997 - protein, 9 aa, Artificial Sequence
  Description of Artificial Sequence: Synthetic peptide
  Seed: NTHSPLQIV (MAGC1_HUMAN)
NPHSPLQIV

SEQ ID NO: 88998 - protein, 11 aa, Artificial Sequence
  Description of Artificial Sequence: Synthetic peptide
  Seed: SPLQRPVSSFF (MAGC1_HUMAN)
SCLQRPVSSFY

SEQ ID NO: 88999 - protein, 10 aa, Artificial Sequence
  Description of Artificial Sequence: Synthetic peptide
  Seed: REFIEILFGI (MAGC1_HUMAN)
RTFIEILFGM

SEQ ID NO: 89000 - protein, 11 aa, Artificial Sequence
  Description of Artificial Sequence: Synthetic peptide
  Seed: MGDKDMPTAGM (MAGC1_HUMAN)
MADKDMPTAGM

SEQ ID NO: 89001 - protein, 10 aa, Artificial Sequence
  Description of Artificial Sequence: Synthetic peptide
  Seed: FPQSVLQIPV (MAGC1_HUMAN)
FPQSVLQIPA

SEQ ID NO: 89002 - protein, 9 aa, Artificial Sequence
  Description of Artificial Sequence: Synthetic peptide
  Seed: LQIPVSSSS (MAGC1_HUMAN)
LSIPVSSSM

SEQ ID NO: 89003 - protein, 9 aa, Artificial Sequence
  Description of Artificial Sequence: Synthetic peptide
  Seed: SSFFSYTLA (MAGC1_HUMAN)
SMFFSYTLL

SEQ ID NO: 89004 - protein, 10 aa, Artificial Sequence
  Description of Artificial Sequence: Synthetic peptide
  Seed: FFSYTLASLL (MAGC1_HUMAN)
FRSYTLASLY

SEQ ID NO: 89005 - protein, 10 aa, Artificial Sequence
  Description of Artificial Sequence: Synthetic peptide
  Seed: RAGREHFAFG (MAGC1_HUMAN)
RWGREHFAFY

SEQ ID NO: 89006 - protein, 8 aa, Artificial Sequence
  Description of Artificial Sequence: Synthetic peptide
  Seed: SSVMSPSF (MAGC1_HUMAN)
STVMSPSW

SEQ ID NO: 89007 - protein, 9 aa, Artificial Sequence
  Description of Artificial Sequence: Synthetic peptide
  Seed: LKYQVKQPI (MAGC1_HUMAN)
LGYQVKQPF

SEQ ID NO: 89008 - protein, 9 aa, Artificial Sequence
  Description of Artificial Sequence: Synthetic peptide
  Seed: SSPERTQST (MAGC1_HUMAN)
SLPERTQSY

SEQ ID NO: 89009 - protein, 10 aa, Artificial Sequence
  Description of Artificial Sequence: Synthetic peptide
  Seed: SSSSSTLLSL (MAGC1_HUMAN)
SSSSSTLLSY

SEQ ID NO: 89010 - protein, 8 aa, Artificial Sequence
  Description of Artificial Sequence: Synthetic peptide
  Seed: REFIEILF (MAGC1_HUMAN)
REFIEILM

SEQ ID NO: 89011 - protein, 9 aa, Artificial Sequence
  Description of Artificial Sequence: Synthetic peptide
  Seed: CTQSTFEGF (MAGC1_HUMAN)
CYQSTFEGL

SEQ ID NO: 89012 - protein, 10 aa, Artificial Sequence
  Description of Artificial Sequence: Synthetic peptide
  Seed: KAREFIEILF (MAGC1_HUMAN)
KVREFIEILA

SEQ ID NO: 89013 - protein, 10 aa, Artificial Sequence
  Description of Artificial Sequence: Synthetic peptide
  Seed: SLQIPVSPSF (MAGC1_HUMAN)
SAQIPVSPSF

SEQ ID NO: 89014 - protein, 10 aa, Artificial Sequence
  Description of Artificial Sequence: Synthetic peptide
  Seed: RKVVEFLAML (MAGC1_HUMAN)
RPVVEFLAML

SEQ ID NO: 89015 - protein, 10 aa, Artificial Sequence
  Description of Artificial Sequence: Synthetic peptide
  Seed: PLQIPVSSSF (MAGC1_HUMAN)
PHQIPVSSSF

SEQ ID NO: 89016 - protein, 9 aa, Artificial Sequence
  Description of Artificial Sequence: Synthetic peptide
  Seed: TLDEKVDEL (MAGC1_HUMAN)
THDEKVDEV

SEQ ID NO: 89017 - protein, 9 aa, Artificial Sequence
  Description of Artificial Sequence: Synthetic peptide
  Seed: AQSPLQIPV (MAGC1_HUMAN)
AQSPLQIPF

SEQ ID NO: 89018 - protein, 10 aa, Artificial Sequence
  Description of Artificial Sequence: Synthetic peptide
  Seed: RAGREHFAFG (MAGC1_HUMAN)
RRGREHFAFK

SEQ ID NO: 89019 - protein, 10 aa, Artificial Sequence
  Description of Artificial Sequence: Synthetic peptide
  Seed: SFPSSTSSSL (MAGC1_HUMAN)
SCPSSTSSSM

SEQ ID NO: 89020 - protein, 9 aa, Artificial Sequence
  Description of Artificial Sequence: Synthetic peptide
  Seed: VIFRKAREF (MAGC1_HUMAN)
VTFRKAREL

SEQ ID NO: 89021 - protein, 9 aa, Artificial Sequence
  Description of Artificial Sequence: Synthetic peptide
  Seed: LQRPVSSFF (MAGC1_HUMAN)
LMRPVSSFW

SEQ ID NO: 89022 - protein, 9 aa, Artificial Sequence
  Description of Artificial Sequence: Synthetic peptide
  Seed: QVKQPITKA (MAGC1_HUMAN)
QAKQPITKK

SEQ ID NO: 89023 - protein, 9 aa, Artificial Sequence
  Description of Artificial Sequence: Synthetic peptide
  Seed: VIWDVLSGI (MAGC1_HUMAN)
VMWDVLSGL

SEQ ID NO: 89024 - protein, 9 aa, Artificial Sequence
  Description of Artificial Sequence: Synthetic peptide
  Seed: AFGEPRELL (MAGC1_HUMAN)
ASGEPRELM

SEQ ID NO: 89025 - protein, 9 aa, Artificial Sequence
  Description of Artificial Sequence: Synthetic peptide
  Seed: DSYVFVNTL (MAGC1_HUMAN)
DSYVFVNTK

SEQ ID NO: 89026 - protein, 9 aa, Artificial Sequence
  Description of Artificial Sequence: Synthetic peptide
  Seed: KVWVQEHYL (MAGC1_HUMAN)
KAWVQEHYL

SEQ ID NO: 89027 - protein, 9 aa, Artificial Sequence
  Description of Artificial Sequence: Synthetic peptide
  Seed: KVWVQEHYL (MAGC1_HUMAN)
KLWVQEHYY

SEQ ID NO: 89028 - protein, 9 aa, Artificial Sequence
  Description of Artificial Sequence: Synthetic peptide
  Seed: SEPLFTYTL (MAGC1_HUMAN)
SAPLFTYTL

SEQ ID NO: 89029 - protein, 9 aa, Artificial Sequence
  Description of Artificial Sequence: Synthetic peptide
  Seed: LQIPGSPSF (MAGC1_HUMAN)
LRIPGSPSM

SEQ ID NO: 89030 - protein, 9 aa, Artificial Sequence
  Description of Artificial Sequence: Synthetic peptide
  Seed: AGREHFAFG (MAGC1_HUMAN)
AMREHFAFK

SEQ ID NO: 89031 - protein, 10 aa, Artificial Sequence
  Description of Artificial Sequence: Synthetic peptide
  Seed: FPSSTSSSLS (MAGC1_HUMAN)
FPSSTSSSLL

SEQ ID NO: 89032 - protein, 10 aa, Artificial Sequence
  Description of Artificial Sequence: Synthetic peptide
  Seed: RSFSSTLLSI (MAGC1_HUMAN)
RTFSSTLLSF

SEQ ID NO: 89033 - protein, 9 aa, Artificial Sequence
  Description of Artificial Sequence: Synthetic peptide
  Seed: TLASLLQSS (MAGC1_HUMAN)
TMASLLQSA

SEQ ID NO: 89034 - protein, 11 aa, Artificial Sequence
  Description of Artificial Sequence: Synthetic peptide
  Seed: SSFPSSTSSSL (MAGC1_HUMAN)
SLFPSSTSSSW

SEQ ID NO: 89035 - protein, 9 aa, Artificial Sequence
  Description of Artificial Sequence: Synthetic peptide
  Seed: RKAREFIEI (MAGC1_HUMAN)
RRAREFIEI

SEQ ID NO: 89036 - protein, 9 aa, Artificial Sequence
  Description of Artificial Sequence: Synthetic peptide
  Seed: VSAASSSTL (MAGC1_HUMAN)
VAAASSSTM

SEQ ID NO: 89037 - protein, 9 aa, Artificial Sequence
  Description of Artificial Sequence: Synthetic peptide
  Seed: MSQNRLLIL (MAGC1_HUMAN)
MPQNRLLIA

SEQ ID NO: 89038 - protein, 9 aa, Artificial Sequence
  Description of Artificial Sequence: Synthetic peptide
  Seed: GFPQSLLQI (MAGC1_HUMAN)
GYPQSLLQF

SEQ ID NO: 89039 - protein, 10 aa, Artificial Sequence
  Description of Artificial Sequence: Synthetic peptide
  Seed: KAREFIEILF (MAGC1_HUMAN)
KWREFIEILK

SEQ ID NO: 89040 - protein, 9 aa, Artificial Sequence
  Description of Artificial Sequence: Synthetic peptide
  Seed: STQSPFEGF (MAGC1_HUMAN)
SAQSPFEGF

SEQ ID NO: 89041 - protein, 10 aa, Artificial Sequence
  Description of Artificial Sequence: Synthetic peptide
  Seed: QRPVSSFFSY (MAGC1_HUMAN)
QGPVSSFFSY

SEQ ID NO: 89042 - protein, 9 aa, Artificial Sequence
  Description of Artificial Sequence: Synthetic peptide
  Seed: TLLSLFQSF (MAGC1_HUMAN)
TLLSLFQSL

SEQ ID NO: 89043 - protein, 10 aa, Artificial Sequence
  Description of Artificial Sequence: Synthetic peptide
  Seed: LAMLKNTVPI (MAGC1_HUMAN)
LFMLKNTVPY

SEQ ID NO: 89044 - protein, 9 aa, Artificial Sequence
  Description of Artificial Sequence: Synthetic peptide
  Seed: AGREHFAFG (MAGC1_HUMAN)
AVREHFAFF

SEQ ID NO: 89045 - protein, 9 aa, Artificial Sequence
  Description of Artificial Sequence: Synthetic peptide
  Seed: EFIEILFGI (MAGC1_HUMAN)
EVIEILFGM

SEQ ID NO: 89046 - protein, 9 aa, Artificial Sequence
  Description of Artificial Sequence: Synthetic peptide
  Seed: FSYTLLSLF (MAGC1_HUMAN)
FPYTLLSLH

SEQ ID NO: 89047 - protein, 10 aa, Artificial Sequence
  Description of Artificial Sequence: Synthetic peptide
  Seed: VSSFFSYTLA (MAGC1_HUMAN)
VMSFFSYTLV

SEQ ID NO: 89048 - protein, 9 aa, Artificial Sequence
  Description of Artificial Sequence: Synthetic peptide
  Seed: GEDSMSPLY (MAGC1_HUMAN)
GEDSMSPLL

SEQ ID NO: 89049 - protein, 9 aa, Artificial Sequence
  Description of Artificial Sequence: Synthetic peptide
  Seed: KVVEFLAML (MAGC1_HUMAN)
KSVEFLAMW

SEQ ID NO: 89050 - protein, 9 aa, Artificial Sequence
  Description of Artificial Sequence: Synthetic peptide
  Seed: STFEGFAQS (MAGC1_HUMAN)
SVFEGFAQA

SEQ ID NO: 89051 - protein, 9 aa, Artificial Sequence
  Description of Artificial Sequence: Synthetic peptide
  Seed: IPVSAASSS (MAGC1_HUMAN)
IPVSAASSA

SEQ ID NO: 89052 - protein, 9 aa, Artificial Sequence
  Description of Artificial Sequence: Synthetic peptide
  Seed: TLVSIFQSS (MAGC1_HUMAN)
TTVSIFQSL

SEQ ID NO: 89053 - protein, 9 aa, Artificial Sequence
  Description of Artificial Sequence: Synthetic peptide
  Seed: SSPERTHST (MAGC1_HUMAN)
SVPERTHSV

SEQ ID NO: 89054 - protein, 11 aa, Artificial Sequence
  Description of Artificial Sequence: Synthetic peptide
  Seed: SPLQIPMTSSF (MAGC1_HUMAN)
SWLQIPMTSSY

SEQ ID NO: 89055 - protein, 9 aa, Artificial Sequence
  Description of Artificial Sequence: Synthetic peptide
  Seed: ISFSSSTSL (MAGC1_HUMAN)
ISFSSSTSM

SEQ ID NO: 89056 - protein, 9 aa, Artificial Sequence
  Description of Artificial Sequence: Synthetic peptide
  Seed: SQSSPVSSF (MAGC1_HUMAN)
SISSPVSSF

SEQ ID NO: 89057 - protein, 11 aa, Artificial Sequence
  Description of Artificial Sequence: Synthetic peptide
  Seed: STFEGFPQSLL (MAGC1_HUMAN)
SMFEGFPQSLA

SEQ ID NO: 89058 - protein, 9 aa, Artificial Sequence
  Description of Artificial Sequence: Synthetic peptide
  Seed: CSSSTSLSL (MAGC1_HUMAN)
CHSSTSLSF

SEQ ID NO: 89059 - protein, 9 aa, Artificial Sequence
  Description of Artificial Sequence: Synthetic peptide
  Seed: VSSSFSYTL (MAGC1_HUMAN)
VKSSFSYTM

SEQ ID NO: 89060 - protein, 9 aa, Artificial Sequence
  Description of Artificial Sequence: Synthetic peptide
  Seed: MLTNVISRY (MAGC1_HUMAN)
MLTNVISRW

SEQ ID NO: 89061 - protein, 10 aa, Artificial Sequence
  Description of Artificial Sequence: Synthetic peptide
  Seed: EVIWDVLSGI (MAGC1_HUMAN)
ESIWDVLSGY

SEQ ID NO: 89062 - protein, 10 aa, Artificial Sequence
  Description of Artificial Sequence: Synthetic peptide
  Seed: YTLASLLQSS (MAGC1_HUMAN)
YPLASLLQSI

SEQ ID NO: 89063 - protein, 9 aa, Artificial Sequence
  Description of Artificial Sequence: Synthetic peptide
  Seed: KVDELARFL (MAGC1_HUMAN)
KRDELARFL

SEQ ID NO: 89064 - protein, 9 aa, Artificial Sequence
  Description of Artificial Sequence: Synthetic peptide
  Seed: KVDELARFL (MAGC1_HUMAN)
KSDELARFY

SEQ ID NO: 89065 - protein, 9 aa, Artificial Sequence
  Description of Artificial Sequence: Synthetic peptide
  Seed: SYKDALKDV (MAGC1_HUMAN)
SYKDALKDF

SEQ ID NO: 89066 - protein, 11 aa, Artificial Sequence
  Description of Artificial Sequence: Synthetic peptide
  Seed: IPVSAASSSTL (MAGC1_HUMAN)
IYVSAASSSTW

SEQ ID NO: 89067 - protein, 10 aa, Artificial Sequence
  Description of Artificial Sequence: Synthetic peptide
  Seed: KVVEFLAMLK (MAGC1_HUMAN)
KNVEFLAMLR

SEQ ID NO: 89068 - protein, 9 aa, Artificial Sequence
  Description of Artificial Sequence: Synthetic peptide
  Seed: LQIPVSSSS (MAGC1_HUMAN)
LWIPVSSSF

SEQ ID NO: 89069 - protein, 9 aa, Artificial Sequence
  Description of Artificial Sequence: Synthetic peptide
  Seed: DSLTDSESL (MAGC1_HUMAN)
DALTDSESI

SEQ ID NO: 89070 - protein, 9 aa, Artificial Sequence
  Description of Artificial Sequence: Synthetic peptide
  Seed: VSAASSSTL (MAGC1_HUMAN)
VMAASSSTV

SEQ ID NO: 89071 - protein, 10 aa, Artificial Sequence
  Description of Artificial Sequence: Synthetic peptide
  Seed: SLQIPVSPSF (MAGC1_HUMAN)
SYQIPVSPSL

SEQ ID NO: 89072 - protein, 9 aa, Artificial Sequence
  Description of Artificial Sequence: Synthetic peptide
  Seed: ISFSSSTSL (MAGC1_HUMAN)
IKFSSSTSV

SEQ ID NO: 89073 - protein, 8 aa, Artificial Sequence
  Description of Artificial Sequence: Synthetic peptide
  Seed: FIEILFGI (MAGC1_HUMAN)
FMEILFGI

SEQ ID NO: 89074 - protein, 10 aa, Artificial Sequence
  Description of Artificial Sequence: Synthetic peptide
  Seed: LQIVPSLPEW (MAGC1_HUMAN)
LAIVPSLPEY

SEQ ID NO: 89075 - protein, 9 aa, Artificial Sequence
  Description of Artificial Sequence: Synthetic peptide
  Seed: FFSYTLASL (MAGC1_HUMAN)
FTSYTLASM

SEQ ID NO: 89076 - protein, 9 aa, Artificial Sequence
  Description of Artificial Sequence: Synthetic peptide
  Seed: LQRPVSSFF (MAGC1_HUMAN)
LQRPVSSFM

SEQ ID NO: 89077 - protein, 9 aa, Artificial Sequence
  Description of Artificial Sequence: Synthetic peptide
  Seed: SAQSAFEGF (MAGC1_HUMAN)
SMQSAFEGY

SEQ ID NO: 89078 - protein, 10 aa, Artificial Sequence
  Description of Artificial Sequence: Synthetic peptide
  Seed: VSICSSSTSL (MAGC1_HUMAN)
VTICSSSTSF

SEQ ID NO: 89079 - protein, 9 aa, Artificial Sequence
  Description of Artificial Sequence: Synthetic peptide
  Seed: SSPERTHST (MAGC1_HUMAN)
SVPERTHSL

SEQ ID NO: 89080 - protein, 9 aa, Artificial Sequence
  Description of Artificial Sequence: Synthetic peptide
  Seed: FSEESSSPV (MAGC1_HUMAN)
FGEESSSPM

SEQ ID NO: 89081 - protein, 10 aa, Artificial Sequence
  Description of Artificial Sequence: Synthetic peptide
  Seed: FFSYTLASLL (MAGC1_HUMAN)
FYSYTLASLM

SEQ ID NO: 89082 - protein, 9 aa, Artificial Sequence
  Description of Artificial Sequence: Synthetic peptide
  Seed: RAHSEVIKR (MAGC1_HUMAN)
RMHSEVIKF

SEQ ID NO: 89083 - protein, 9 aa, Artificial Sequence
  Description of Artificial Sequence: Synthetic peptide
  Seed: TSLSLPQSF (MAGC1_HUMAN)
TTLSLPQSF

SEQ ID NO: 89084 - protein, 11 aa, Artificial Sequence
  Description of Artificial Sequence: Synthetic peptide
  Seed: SPLQIPMTSSF (MAGC1_HUMAN)
SYLQIPMTSSF

SEQ ID NO: 89085 - protein, 9 aa, Artificial Sequence
  Description of Artificial Sequence: Synthetic peptide
  Seed: SASSSVMSP (MAGC1_HUMAN)
SVSSSVMSL

SEQ ID NO: 89086 - protein, 9 aa, Artificial Sequence
  Description of Artificial Sequence: Synthetic peptide
  Seed: RAGREHFAF (MAGC1_HUMAN)
RFGREHFAF

SEQ ID NO: 89087 - protein, 10 aa, Artificial Sequence
  Description of Artificial Sequence: Synthetic peptide
  Seed: EWEDSLSPHY (MAGC1_HUMAN)
ETEDSLSPHY

SEQ ID NO: 89088 - protein, 9 aa, Artificial Sequence
  Description of Artificial Sequence: Synthetic peptide
  Seed: ALLSIFQSS (MAGC1_HUMAN)
AVLSIFQSV

SEQ ID NO: 89089 - protein, 10 aa, Artificial Sequence
  Description of Artificial Sequence: Synthetic peptide
  Seed: ASSFFSSALL (MAGC1_HUMAN)
ASSFFSSALY

SEQ ID NO: 89090 - protein, 10 aa, Artificial Sequence
  Description of Artificial Sequence: Synthetic peptide
  Seed: LQIVPSLPEW (MAGC1_HUMAN)
LAIVPSLPEF

SEQ ID NO: 89091 - protein, 11 aa, Artificial Sequence
  Description of Artificial Sequence: Synthetic peptide
  Seed: SSFSSTLLSIF (MAGC1_HUMAN)
STFSSTLLSIL

SEQ ID NO: 89092 - protein, 10 aa, Artificial Sequence
  Description of Artificial Sequence: Synthetic peptide
  Seed: KGTYASEEVI (MAGC1_HUMAN)
KETYASEEVF

SEQ ID NO: 89093 - protein, 10 aa, Artificial Sequence
  Description of Artificial Sequence: Synthetic peptide
  Seed: FFSSALLSIF (MAGC1_HUMAN)
FMSSALLSIW

SEQ ID NO: 89094 - protein, 9 aa, Artificial Sequence
  Description of Artificial Sequence: Synthetic peptide
  Seed: VSSSFSYTL (MAGC1_HUMAN)
VTSSFSYTI

SEQ ID NO: 89095 - protein, 9 aa, Artificial Sequence
  Description of Artificial Sequence: Synthetic peptide
  Seed: LQIPVSRSF (MAGC1_HUMAN)
LAIPVSRSF

SEQ ID NO: 89096 - protein, 11 aa, Artificial Sequence
  Description of Artificial Sequence: Synthetic peptide
  Seed: SLIESEPLFTY (MAGC1_HUMAN)
SQIESEPLFTW

SEQ ID NO: 89097 - protein, 9 aa, Artificial Sequence
  Description of Artificial Sequence: Synthetic peptide
  Seed: TTDDSTATE (MAGC1_HUMAN)
TQDDSTATY

SEQ ID NO: 89098 - protein, 11 aa, Artificial Sequence
  Description of Artificial Sequence: Synthetic peptide
  Seed: RYTGYFPVIFR (MAGC1_HUMAN)
RKTGYFPVIFR

SEQ ID NO: 89099 - protein, 11 aa, Artificial Sequence
  Description of Artificial Sequence: Synthetic peptide
  Seed: NTVPITFPSSY (MAGC1_HUMAN)
NIVPITFPSSR

SEQ ID NO: 89100 - protein, 10 aa, Artificial Sequence
  Description of Artificial Sequence: Synthetic peptide
  Seed: LAMLKNTVPI (MAGC1_HUMAN)
LLMLKNTVPF

SEQ ID NO: 89101 - protein, 9 aa, Artificial Sequence
  Description of Artificial Sequence: Synthetic peptide
  Seed: TLLSIFQSS (MAGC1_HUMAN)
TILSIFQSI

SEQ ID NO: 89102 - protein, 9 aa, Artificial Sequence
  Description of Artificial Sequence: Synthetic peptide
  Seed: VSPSSSSTL (MAGC1_HUMAN)
VWPSSSSTM

SEQ ID NO: 89103 - protein, 9 aa, Artificial Sequence
  Description of Artificial Sequence: Synthetic peptide
  Seed: SIIFIKGTY (MAGC1_HUMAN)
STIFIKGTK

SEQ ID NO: 89104 - protein, 10 aa, Artificial Sequence
  Description of Artificial Sequence: Synthetic peptide
  Seed: FSSSTSLSPF (MAGC1_HUMAN)
FRSSTSLSPY

SEQ ID NO: 89105 - protein, 9 aa, Artificial Sequence
  Description of Artificial Sequence: Synthetic peptide
  Seed: SSPESTQSP (MAGC1_HUMAN)
SMPESTQSI

SEQ ID NO: 89106 - protein, 9 aa, Artificial Sequence
  Description of Artificial Sequence: Synthetic peptide
  Seed: LQIPMTSSF (MAGC1_HUMAN)
LMIPMTSSY

SEQ ID NO: 89107 - protein, 9 aa, Artificial Sequence
  Description of Artificial Sequence: Synthetic peptide
  Seed: SSHESPQSP (MAGC1_HUMAN)
SIHESPQSM

SEQ ID NO: 89108 - protein, 9 aa, Artificial Sequence
  Description of Artificial Sequence: Synthetic peptide
  Seed: TTDDSTATE (MAGC1_HUMAN)
TPDDSTATV

SEQ ID NO: 89109 - protein, 10 aa, Artificial Sequence
  Description of Artificial Sequence: Synthetic peptide
  Seed: RSFSSTLLSI (MAGC1_HUMAN)
RTFSSTLLSK

SEQ ID NO: 89110 - protein, 10 aa, Artificial Sequence
  Description of Artificial Sequence: Synthetic peptide
  Seed: RPVSSFFSYT (MAGC1_HUMAN)
RPVSSFFSYK

SEQ ID NO: 89111 - protein, 9 aa, Artificial Sequence
  Description of Artificial Sequence: Synthetic peptide
  Seed: SRYTGYFPV (MAGC1_HUMAN)
SSYTGYFPY

SEQ ID NO: 89112 - protein, 10 aa, Artificial Sequence
  Description of Artificial Sequence: Synthetic peptide
  Seed: LSQSSPVSSF (MAGC1_HUMAN)
LMQSSPVSSF

SEQ ID NO: 89113 - protein, 10 aa, Artificial Sequence
  Description of Artificial Sequence: Synthetic peptide
  Seed: SSPESAQSTF (MAGC1_HUMAN)
SVPESAQSTI

SEQ ID NO: 89114 - protein, 9 aa, Artificial Sequence
  Description of Artificial Sequence: Synthetic peptide
  Seed: FSSTLVSLF (MAGC1_HUMAN)
FGSTLVSLY

SEQ ID NO: 89115 - protein, 9 aa, Artificial Sequence
  Description of Artificial Sequence: Synthetic peptide
  Seed: VSSFFSYTL (MAGC1_HUMAN)
VGSFFSYTM

SEQ ID NO: 89116 - protein, 9 aa, Artificial Sequence
  Description of Artificial Sequence: Synthetic peptide
  Seed: AQSPLQIPV (MAGC1_HUMAN)
AVSPLQIPI

SEQ ID NO: 89117 - protein, 9 aa, Artificial Sequence
  Description of Artificial Sequence: Synthetic peptide
  Seed: RTHSTFEGF (MAGC1_HUMAN)
RFHSTFEGY

SEQ ID NO: 89118 - protein, 9 aa, Artificial Sequence
  Description of Artificial Sequence: Synthetic peptide
  Seed: KAREFIEIL (MAGC1_HUMAN)
KMREFIEII

SEQ ID NO: 89119 - protein, 8 aa, Artificial Sequence
  Description of Artificial Sequence: Synthetic peptide
  Seed: SYTLASLL (MAGC1_HUMAN)
SYTLASLM

SEQ ID NO: 89120 - protein, 11 aa, Artificial Sequence
  Description of Artificial Sequence: Synthetic peptide
  Seed: SLREVDPDDSY (MAGC1_HUMAN)
SQREVDPDDSL

SEQ ID NO: 89121 - protein, 9 aa, Artificial Sequence
  Description of Artificial Sequence: Synthetic peptide
  Seed: SLFQSFSER (MAGC1_HUMAN)
SSFQSFSER

SEQ ID NO: 89122 - protein, 11 aa, Artificial Sequence
  Description of Artificial Sequence: Synthetic peptide
  Seed: SLSQSSPVSSF (MAGC1_HUMAN)
SPSQSSPVSSY

SEQ ID NO: 89123 - protein, 10 aa, Artificial Sequence
  Description of Artificial Sequence: Synthetic peptide
  Seed: SFSSTLVSLF (MAGC1_HUMAN)
SASSTLVSLF

SEQ ID NO: 89124 - protein, 9 aa, Artificial Sequence
  Description of Artificial Sequence: Synthetic peptide
  Seed: LSPLHFPQF (MAGC1_HUMAN)
LFPLHFPQL

SEQ ID NO: 89125 - protein, 9 aa, Artificial Sequence
  Description of Artificial Sequence: Synthetic peptide
  Seed: LQIPVSSSS (MAGC1_HUMAN)
LPIPVSSSI

SEQ ID NO: 89126 - protein, 9 aa, Artificial Sequence
  Description of Artificial Sequence: Synthetic peptide
  Seed: MSQNRLLIL (MAGC1_HUMAN)
MMQNRLLII

SEQ ID NO: 89127 - protein, 9 aa, Artificial Sequence
  Description of Artificial Sequence: Synthetic peptide
  Seed: NSSPPRYEF (MAGC1_HUMAN)
NQSPPRYEL

SEQ ID NO: 89128 - protein, 9 aa, Artificial Sequence
  Description of Artificial Sequence: Synthetic peptide
  Seed: YPLQSPQSR (MAGC1_HUMAN)
YPLQSPQSY

SEQ ID NO: 89129 - protein, 9 aa, Artificial Sequence
  Description of Artificial Sequence: Synthetic peptide
  Seed: EMLTNVISR (MAGC1_HUMAN)
EALTNVISK

SEQ ID NO: 89130 - protein, 9 aa, Artificial Sequence
  Description of Artificial Sequence: Synthetic peptide
  Seed: MPTAGMPSL (MAGC1_HUMAN)
MPTAGMPSW

SEQ ID NO: 89131 - protein, 9 aa, Artificial Sequence
  Description of Artificial Sequence: Synthetic peptide
  Seed: AQSPLQRPV (MAGC1_HUMAN)
AQSPLQRPW

SEQ ID NO: 89132 - protein, 9 aa, Artificial Sequence
  Description of Artificial Sequence: Synthetic peptide
  Seed: SPLQIVPSL (MAGC1_HUMAN)
SPLQIVPSI

SEQ ID NO: 89133 - protein, 11 aa, Artificial Sequence
  Description of Artificial Sequence: Synthetic peptide
  Seed: IIDTTDDSTAT (MAGC1_HUMAN)
IMDTTDDSTAL

SEQ ID NO: 89134 - protein, 9 aa, Artificial Sequence
  Description of Artificial Sequence: Synthetic peptide
  Seed: LQSPVISFS (MAGC1_HUMAN)
LASPVISFI

SEQ ID NO: 89135 - protein, 9 aa, Artificial Sequence
  Description of Artificial Sequence: Synthetic peptide
  Seed: FTYTLDEKV (MAGC1_HUMAN)
FRYTLDEKV

SEQ ID NO: 89136 - protein, 11 aa, Artificial Sequence
  Description of Artificial Sequence: Synthetic peptide
  Seed: LQRPVSSFFSY (MAGC1_HUMAN)
LHRPVSSFFSY

SEQ ID NO: 89137 - protein, 11 aa, Artificial Sequence
  Description of Artificial Sequence: Synthetic peptide
  Seed: IPMTSSFSSTL (MAGC1_HUMAN)
ISMTSSFSSTL

SEQ ID NO: 89138 - protein, 9 aa, Artificial Sequence
  Description of Artificial Sequence: Synthetic peptide
  Seed: RLLILILSI (MAGC1_HUMAN)
RWLILILSY

SEQ ID NO: 89139 - protein, 9 aa, Artificial Sequence
  Description of Artificial Sequence: Synthetic peptide
  Seed: YTSSSDTLL (MAGC1_HUMAN)
YASSSDTLY

SEQ ID NO: 89140 - protein, 10 aa, Artificial Sequence
  Description of Artificial Sequence: Synthetic peptide
  Seed: LAMLKNTVPI (MAGC1_HUMAN)
LHMLKNTVPV

SEQ ID NO: 89141 - protein, 10 aa, Artificial Sequence
  Description of Artificial Sequence: Synthetic peptide
  Seed: FPQSLLQIPM (MAGC1_HUMAN)
FSQSLLQIPY

SEQ ID NO: 89142 - protein, 9 aa, Artificial Sequence
  Description of Artificial Sequence: Synthetic peptide
  Seed: AFGEPRELL (MAGC1_HUMAN)
AAGEPRELV

SEQ ID NO: 89143 - protein, 9 aa, Artificial Sequence
  Description of Artificial Sequence: Synthetic peptide
  Seed: FQSSLQSPV (MAGC1_HUMAN)
FMSSLQSPV

SEQ ID NO: 89144 - protein, 9 aa, Artificial Sequence
  Description of Artificial Sequence: Synthetic peptide
  Seed: ASSFFSSAL (MAGC1_HUMAN)
ATSFFSSAI

SEQ ID NO: 89145 - protein, 9 aa, Artificial Sequence
  Description of Artificial Sequence: Synthetic peptide
  Seed: SSPERTQST (MAGC1_HUMAN)
SMPERTQSM

SEQ ID NO: 89146 - protein, 9 aa, Artificial Sequence
  Description of Artificial Sequence: Synthetic peptide
  Seed: TPSSLPQSF (MAGC1_HUMAN)
TRSSLPQSF

SEQ ID NO: 89147 - protein, 9 aa, Artificial Sequence
  Description of Artificial Sequence: Synthetic peptide
  Seed: RKAREFIEI (MAGC1_HUMAN)
RVAREFIEY

SEQ ID NO: 89148 - protein, 11 aa, Artificial Sequence
  Description of Artificial Sequence: Synthetic peptide
  Seed: PSSSSTLLSLF (MAGC1_HUMAN)
PTSSSTLLSLW

SEQ ID NO: 89149 - protein, 9 aa, Artificial Sequence
  Description of Artificial Sequence: Synthetic peptide
  Seed: GTYASEEVI (MAGC1_HUMAN)
GTYASEEVW

SEQ ID NO: 89150 - protein, 9 aa, Artificial Sequence
  Description of Artificial Sequence: Synthetic peptide
  Seed: LQIPVSAAS (MAGC1_HUMAN)
LTIPVSAAM

SEQ ID NO: 89151 - protein, 9 aa, Artificial Sequence
  Description of Artificial Sequence: Synthetic peptide
  Seed: AQSPLQSPV (MAGC1_HUMAN)
AKSPLQSPF

SEQ ID NO: 89152 - protein, 11 aa, Artificial Sequence
  Description of Artificial Sequence: Synthetic peptide
  Seed: SPLQIPVSSSS (MAGC1_HUMAN)
SFLQIPVSSSY

SEQ ID NO: 89153 - protein, 9 aa, Artificial Sequence
  Description of Artificial Sequence: Synthetic peptide
  Seed: VSSFFSYTL (MAGC1_HUMAN)
VSSFFSYTM

SEQ ID NO: 89154 - protein, 10 aa, Artificial Sequence
  Description of Artificial Sequence: Synthetic peptide
  Seed: EVPNSSPPRY (MAGC1_HUMAN)
ESPNSSPPRR

SEQ ID NO: 89155 - protein, 9 aa, Artificial Sequence
  Description of Artificial Sequence: Synthetic peptide
  Seed: LQIPGSPSF (MAGC1_HUMAN)
LFIPGSPSI

SEQ ID NO: 89156 - protein, 11 aa, Artificial Sequence
  Description of Artificial Sequence: Synthetic peptide
  Seed: SFFSYTLASLL (MAGC1_HUMAN)
SHFSYTLASLF

SEQ ID NO: 89157 - protein, 10 aa, Artificial Sequence
  Description of Artificial Sequence: Synthetic peptide
  Seed: TTDDSTATES (MAGC1_HUMAN)
TTDDSTATEM

SEQ ID NO: 89158 - protein, 11 aa, Artificial Sequence
  Description of Artificial Sequence: Synthetic peptide
  Seed: IPVSPSSSSTL (MAGC1_HUMAN)
IVVSPSSSSTY

SEQ ID NO: 89159 - protein, 10 aa, Artificial Sequence
  Description of Artificial Sequence: Synthetic peptide
  Seed: SSSSTLLSLF (MAGC1_HUMAN)
SRSSTLLSLF

SEQ ID NO: 89160 - protein, 11 aa, Artificial Sequence
  Description of Artificial Sequence: Synthetic peptide
  Seed: SFFSSALLSIF (MAGC1_HUMAN)
SQFSSALLSIW

SEQ ID NO: 89161 - protein, 9 aa, Artificial Sequence
  Description of Artificial Sequence: Synthetic peptide
  Seed: RPVSSFFSY (MAGC1_HUMAN)
RVVSSFFSL

SEQ ID NO: 89162 - protein, 9 aa, Artificial Sequence
  Description of Artificial Sequence: Synthetic peptide
  Seed: VSRSFSSTL (MAGC1_HUMAN)
VFRSFSSTL

SEQ ID NO: 89163 - protein, 9 aa, Artificial Sequence
  Description of Artificial Sequence: Synthetic peptide
  Seed: SSPECTQST (MAGC1_HUMAN)
SLPECTQSF

SEQ ID NO: 89164 - protein, 9 aa, Artificial Sequence
  Description of Artificial Sequence: Synthetic peptide
  Seed: TFEGFPQSL (MAGC1_HUMAN)
TSEGFPQSW

SEQ ID NO: 89165 - protein, 11 aa, Artificial Sequence
  Description of Artificial Sequence: Synthetic peptide
  Seed: IPVSSSSSSTL (MAGC1_HUMAN)
ITVSSSSSSTY

SEQ ID NO: 89166 - protein, 8 aa, Artificial Sequence
  Description of Artificial Sequence: Synthetic peptide
  Seed: LLSLFQSF (MAGC1_HUMAN)
LQSLFQSM

SEQ ID NO: 89167 - protein, 11 aa, Artificial Sequence
  Description of Artificial Sequence: Synthetic peptide
  Seed: SPLQIPMTSSF (MAGC1_HUMAN)
SWLQIPMTSSM

SEQ ID NO: 89168 - protein, 9 aa, Artificial Sequence
  Description of Artificial Sequence: Synthetic peptide
  Seed: IEILFGISL (MAGC1_HUMAN)
IAILFGISY

SEQ ID NO: 89169 - protein, 9 aa, Artificial Sequence
  Description of Artificial Sequence: Synthetic peptide
  Seed: FPSSTSSSL (MAGC1_HUMAN)
FVSSTSSSV

SEQ ID NO: 89170 - protein, 9 aa, Artificial Sequence
  Description of Artificial Sequence: Synthetic peptide
  Seed: IPGSPSFSS (MAGC1_HUMAN)
IPGSPSFSI

SEQ ID NO: 89171 - protein, 9 aa, Artificial Sequence
  Description of Artificial Sequence: Synthetic peptide
  Seed: SSFFSSALL (MAGC1_HUMAN)
STFFSSALI

SEQ ID NO: 89172 - protein, 9 aa, Artificial Sequence
  Description of Artificial Sequence: Synthetic peptide
  Seed: QFPPQGEDF (MAGC1_HUMAN)
QIPPQGEDL

SEQ ID NO: 89173 - protein, 11 aa, Artificial Sequence
  Description of Artificial Sequence: Synthetic peptide
  Seed: SQSSPEGKDSL (MAGC1_HUMAN)
SQSSPEGKDSI

SEQ ID NO: 89174 - protein, 10 aa, Artificial Sequence
  Description of Artificial Sequence: Synthetic peptide
  Seed: KVVEFLAMLK (MAGC1_HUMAN)
KQVEFLAMLA

SEQ ID NO: 89175 - protein, 9 aa, Artificial Sequence
  Description of Artificial Sequence: Synthetic peptide
  Seed: SSSESPQSC (MAGC1_HUMAN)
SASESPQSY

SEQ ID NO: 89176 - protein, 9 aa, Artificial Sequence
  Description of Artificial Sequence: Synthetic peptide
  Seed: NTHSPLQIV (MAGC1_HUMAN)
NAHSPLQIV

SEQ ID NO: 89177 - protein, 9 aa, Artificial Sequence
  Description of Artificial Sequence: Synthetic peptide
  Seed: SPPQGEDSL (MAGC1_HUMAN)
SIPQGEDSM

SEQ ID NO: 89178 - protein, 9 aa, Artificial Sequence
  Description of Artificial Sequence: Synthetic peptide
  Seed: TSLSLPQSF (MAGC1_HUMAN)
TALSLPQSY

SEQ ID NO: 89179 - protein, 10 aa, Artificial Sequence
  Description of Artificial Sequence: Synthetic peptide
  Seed: FFSSALLSIF (MAGC1_HUMAN)
FVSSALLSIW

SEQ ID NO: 89180 - protein, 10 aa, Artificial Sequence
  Description of Artificial Sequence: Synthetic peptide
  Seed: MPTAGMPSLL (MAGC1_HUMAN)
MYTAGMPSLA

SEQ ID NO: 89181 - protein, 9 aa, Artificial Sequence
  Description of Artificial Sequence: Synthetic peptide
  Seed: KVVEFLAML (MAGC1_HUMAN)
KMVEFLAMV

SEQ ID NO: 89182 - protein, 11 aa, Artificial Sequence
  Description of Artificial Sequence: Synthetic peptide
  Seed: RSFSSTLLSIF (MAGC1_HUMAN)
RSFSSTLLSIL

SEQ ID NO: 89183 - protein, 9 aa, Artificial Sequence
  Description of Artificial Sequence: Synthetic peptide
  Seed: DALKDVEER (MAGC1_HUMAN)
DFLKDVEER

SEQ ID NO: 89184 - protein, 10 aa, Artificial Sequence
  Description of Artificial Sequence: Synthetic peptide
  Seed: SSPERTHSTF (MAGC1_HUMAN)
SHPERTHSTM

SEQ ID NO: 89185 - protein, 11 aa, Artificial Sequence
  Description of Artificial Sequence: Synthetic peptide
  Seed: LQRPVSSFFSY (MAGC1_HUMAN)
LYRPVSSFFSY

SEQ ID NO: 89186 - protein, 9 aa, Artificial Sequence
  Description of Artificial Sequence: Synthetic peptide
  Seed: VPITFPSSY (MAGC1_HUMAN)
VKITFPSSY

SEQ ID NO: 89187 - protein, 10 aa, Artificial Sequence
  Description of Artificial Sequence: Synthetic peptide
  Seed: SIFQSSPESA (MAGC1_HUMAN)
STFQSSPESI

SEQ ID NO: 89188 - protein, 9 aa, Artificial Sequence
  Description of Artificial Sequence: Synthetic peptide
  Seed: AQSPLQIPV (MAGC1_HUMAN)
AHSPLQIPA

SEQ ID NO: 89189 - protein, 8 aa, Artificial Sequence
  Description of Artificial Sequence: Synthetic peptide
  Seed: FSYTLASL (MAGC1_HUMAN)
FSYTLASF

SEQ ID NO: 89190 - protein, 9 aa, Artificial Sequence
  Description of Artificial Sequence: Synthetic peptide
  Seed: TLLSIFQSS (MAGC1_HUMAN)
TALSIFQSV

SEQ ID NO: 89191 - protein, 9 aa, Artificial Sequence
  Description of Artificial Sequence: Synthetic peptide
  Seed: SQSPPEGPV (MAGC1_HUMAN)
SVSPPEGPM

SEQ ID NO: 89192 - protein, 10 aa, Artificial Sequence
  Description of Artificial Sequence: Synthetic peptide
  Seed: YTGYFPVIFR (MAGC1_HUMAN)
YTGYFPVIFK

SEQ ID NO: 89193 - protein, 9 aa, Artificial Sequence
  Description of Artificial Sequence: Synthetic peptide
  Seed: RLLILILSI (MAGC1_HUMAN)
RQLILILSV

SEQ ID NO: 89194 - protein, 9 aa, Artificial Sequence
  Description of Artificial Sequence: Synthetic peptide
  Seed: SSPECTQST (MAGC1_HUMAN)
SAPECTQSM

SEQ ID NO: 89195 - protein, 10 aa, Artificial Sequence
  Description of Artificial Sequence: Synthetic peptide
  Seed: HSPQSPPEGM (MAGC1_HUMAN)
HMPQSPPEGY

SEQ ID NO: 89196 - protein, 9 aa, Artificial Sequence
  Description of Artificial Sequence: Synthetic peptide
  Seed: GEDSMSPLY (MAGC1_HUMAN)
GADSMSPLY

SEQ ID NO: 89197 - protein, 9 aa, Artificial Sequence
  Description of Artificial Sequence: Synthetic peptide
  Seed: WEDSLSPHY (MAGC1_HUMAN)
WYDSLSPHY

SEQ ID NO: 89198 - protein, 11 aa, Artificial Sequence
  Description of Artificial Sequence: Synthetic peptide
  Seed: FLWGPRAHSEV (MAGC1_HUMAN)
FLWGPRAHSEI

SEQ ID NO: 89199 - protein, 10 aa, Artificial Sequence
  Description of Artificial Sequence: Synthetic peptide
  Seed: IPGSPSFSST (MAGC1_HUMAN)
IPGSPSFSSM

SEQ ID NO: 89200 - protein, 9 aa, Artificial Sequence
  Description of Artificial Sequence: Synthetic peptide
  Seed: ALLSIFQSS (MAGC1_HUMAN)
ATLSIFQSA

SEQ ID NO: 89201 - protein, 9 aa, Artificial Sequence
  Description of Artificial Sequence: Synthetic peptide
  Seed: VSAASSSTL (MAGC1_HUMAN)
VMAASSSTH

SEQ ID NO: 89202 - protein, 9 aa, Artificial Sequence
  Description of Artificial Sequence: Synthetic peptide
  Seed: AQSPLQIPV (MAGC1_HUMAN)
ASSPLQIPL

SEQ ID NO: 89203 - protein, 10 aa, Artificial Sequence
  Description of Artificial Sequence: Synthetic peptide
  Seed: REVDPDDSYV (MAGC1_HUMAN)
RMVDPDDSYL

SEQ ID NO: 89204 - protein, 9 aa, Artificial Sequence
  Description of Artificial Sequence: Synthetic peptide
  Seed: YQVKQPITK (MAGC1_HUMAN)
YQVKQPITY

SEQ ID NO: 89205 - protein, 9 aa, Artificial Sequence
  Description of Artificial Sequence: Synthetic peptide
  Seed: SSPESTQSP (MAGC1_HUMAN)
SNPESTQSL

SEQ ID NO: 89206 - protein, 10 aa, Artificial Sequence
  Description of Artificial Sequence: Synthetic peptide
  Seed: STPSSLPQSF (MAGC1_HUMAN)
SSPSSLPQSY

SEQ ID NO: 89207 - protein, 10 aa, Artificial Sequence
  Description of Artificial Sequence: Synthetic peptide
  Seed: KRKVVEFLAM (MAGC1_HUMAN)
KMKVVEFLAY

SEQ ID NO: 89208 - protein, 11 aa, Artificial Sequence
  Description of Artificial Sequence: Synthetic peptide
  Seed: REVDPDDSYVF (MAGC1_HUMAN)
RKVDPDDSYVF

SEQ ID NO: 89209 - protein, 9 aa, Artificial Sequence
  Description of Artificial Sequence: Synthetic peptide
  Seed: LQIPVSPSF (MAGC1_HUMAN)
LKIPVSPSL

SEQ ID NO: 89210 - protein, 9 aa, Artificial Sequence
  Description of Artificial Sequence: Synthetic peptide
  Seed: VSAASSSTL (MAGC1_HUMAN)
VMAASSSTY

SEQ ID NO: 89211 - protein, 10 aa, Artificial Sequence
  Description of Artificial Sequence: Synthetic peptide
  Seed: ISRYTGYFPV (MAGC1_HUMAN)
IRRYTGYFPL

SEQ ID NO: 89212 - protein, 8 aa, Artificial Sequence
  Description of Artificial Sequence: Synthetic peptide
  Seed: RSFSSTLL (MAGC1_HUMAN)
RAFSSTLW

SEQ ID NO: 89213 - protein, 9 aa, Artificial Sequence
  Description of Artificial Sequence: Synthetic peptide
  Seed: SFFSYTLAS (MAGC1_HUMAN)
SMFSYTLAV

SEQ ID NO: 89214 - protein, 9 aa, Artificial Sequence
  Description of Artificial Sequence: Synthetic peptide
  Seed: GFPQSVLQI (MAGC1_HUMAN)
GFPQSVLQL

SEQ ID NO: 89215 - protein, 10 aa, Artificial Sequence
  Description of Artificial Sequence: Synthetic peptide
  Seed: WGPRAHSEVI (MAGC1_HUMAN)
WFPRAHSEVV

SEQ ID NO: 89216 - protein, 9 aa, Artificial Sequence
  Description of Artificial Sequence: Synthetic peptide
  Seed: IESEPLFTY (MAGC1_HUMAN)
IESEPLFTM

SEQ ID NO: 89217 - protein, 10 aa, Artificial Sequence
  Description of Artificial Sequence: Synthetic peptide
  Seed: MPTAGMPSLL (MAGC1_HUMAN)
MGTAGMPSLF

SEQ ID NO: 89218 - protein, 9 aa, Artificial Sequence
  Description of Artificial Sequence: Synthetic peptide
  Seed: VSPSFSSTL (MAGC1_HUMAN)
VGPSFSSTF

SEQ ID NO: 89219 - protein, 9 aa, Artificial Sequence
  Description of Artificial Sequence: Synthetic peptide
  Seed: VSSSSSSTL (MAGC1_HUMAN)
VGSSSSSTF

SEQ ID NO: 89220 - protein, 9 aa, Artificial Sequence
  Description of Artificial Sequence: Synthetic peptide
  Seed: VSAASSSTL (MAGC1_HUMAN)
VHAASSSTF

SEQ ID NO: 89221 - protein, 9 aa, Artificial Sequence
  Description of Artificial Sequence: Synthetic peptide
  Seed: ISRYTGYFP (MAGC1_HUMAN)
IIRYTGYFV

SEQ ID NO: 89222 - protein, 10 aa, Artificial Sequence
  Description of Artificial Sequence: Synthetic peptide
  Seed: ISRYTGYFPV (MAGC1_HUMAN)
IKRYTGYFPL

SEQ ID NO: 89223 - protein, 11 aa, Artificial Sequence
  Description of Artificial Sequence: Synthetic peptide
  Seed: STFEGFPQSLL (MAGC1_HUMAN)
SLFEGFPQSLD

SEQ ID NO: 89224 - protein, 9 aa, Artificial Sequence
  Description of Artificial Sequence: Synthetic peptide
  Seed: SPLQRPVSS (MAGC1_HUMAN)
SVLQRPVSM

SEQ ID NO: 89225 - protein, 10 aa, Artificial Sequence
  Description of Artificial Sequence: Synthetic peptide
  Seed: VDELARFLLL (MAGC1_HUMAN)
VRELARFLLL

SEQ ID NO: 89226 - protein, 9 aa, Artificial Sequence
  Description of Artificial Sequence: Synthetic peptide
  Seed: LSDEQGMSQ (MAGC1_HUMAN)
LSDEQGMSL

SEQ ID NO: 89227 - protein, 9 aa, Artificial Sequence
  Description of Artificial Sequence: Synthetic peptide
  Seed: LKNTVPITF (MAGC1_HUMAN)
LLNTVPITF

SEQ ID NO: 89228 - protein, 9 aa, Artificial Sequence
  Description of Artificial Sequence: Synthetic peptide
  Seed: MSQNRLLIL (MAGC1_HUMAN)
MQQNRLLIL

SEQ ID NO: 89229 - protein, 10 aa, Artificial Sequence
  Description of Artificial Sequence: Synthetic peptide
  Seed: SSPERTQSTF (MAGC1_HUMAN)
SLPERTQSTY

SEQ ID NO: 89230 - protein, 9 aa, Artificial Sequence
  Description of Artificial Sequence: Synthetic peptide
  Seed: FFSSALLSI (MAGC1_HUMAN)
FLSSALLST

SEQ ID NO: 89231 - protein, 10 aa, Artificial Sequence
  Description of Artificial Sequence: Synthetic peptide
  Seed: REHFAFGEPR (MAGC1_HUMAN)
RVHFAFGEPR

SEQ ID NO: 89232 - protein, 9 aa, Artificial Sequence
  Description of Artificial Sequence: Synthetic peptide
  Seed: LQIPVSAAS (MAGC1_HUMAN)
LVIPVSAAI

SEQ ID NO: 89233 - protein, 10 aa, Artificial Sequence
  Description of Artificial Sequence: Synthetic peptide
  Seed: MTSSFSSTLL (MAGC1_HUMAN)
MNSSFSSTLW

SEQ ID NO: 89234 - protein, 11 aa, Artificial Sequence
  Description of Artificial Sequence: Synthetic peptide
  Seed: REVPNSSPPRY (MAGC1_HUMAN)
REVPNSSPPRA

SEQ ID NO: 89235 - protein, 9 aa, Artificial Sequence
  Description of Artificial Sequence: Synthetic peptide
  Seed: YVFVNTLDL (MAGC1_HUMAN)
YQFVNTLDL

SEQ ID NO: 89236 - protein, 9 aa, Artificial Sequence
  Description of Artificial Sequence: Synthetic peptide
  Seed: FEGFAQSPL (MAGC1_HUMAN)
FQGFAQSPF

SEQ ID NO: 89237 - protein, 9 aa, Artificial Sequence
  Description of Artificial Sequence: Synthetic peptide
  Seed: SQSSPVSSF (MAGC1_HUMAN)
SASSPVSSY

SEQ ID NO: 89238 - protein, 11 aa, Artificial Sequence
  Description of Artificial Sequence: Synthetic peptide
  Seed: SPLQIPMTSSF (MAGC1_HUMAN)
SSLQIPMTSSY

SEQ ID NO: 89239 - protein, 9 aa, Artificial Sequence
  Description of Artificial Sequence: Synthetic peptide
  Seed: VSPSSSSTL (MAGC1_HUMAN)
VYPSSSSTF

SEQ ID NO: 89240 - protein, 9 aa, Artificial Sequence
  Description of Artificial Sequence: Synthetic peptide
  Seed: SPLQIVPSL (MAGC1_HUMAN)
SHLQIVPSM

SEQ ID NO: 89241 - protein, 10 aa, Artificial Sequence
  Description of Artificial Sequence: Synthetic peptide
  Seed: FFSYTLASLL (MAGC1_HUMAN)
FTSYTLASLW

SEQ ID NO: 89242 - protein, 10 aa, Artificial Sequence
  Description of Artificial Sequence: Synthetic peptide
  Seed: DVLSGIGVRA (MAGC1_HUMAN)
DSLSGIGVRV

SEQ ID NO: 89243 - protein, 10 aa, Artificial Sequence
  Description of Artificial Sequence: Synthetic peptide
  Seed: MTSSFSSTLL (MAGC1_HUMAN)
MLSSFSSTLR

SEQ ID NO: 89244 - protein, 10 aa, Artificial Sequence
  Description of Artificial Sequence: Synthetic peptide
  Seed: ASSFFSSALL (MAGC1_HUMAN)
ALSFFSSALF

SEQ ID NO: 89245 - protein, 9 aa, Artificial Sequence
  Description of Artificial Sequence: Synthetic peptide
  Seed: SSPPRYEFL (MAGC1_HUMAN)
SWPPRYEFI

SEQ ID NO: 89246 - protein, 9 aa, Artificial Sequence
  Description of Artificial Sequence: Synthetic peptide
  Seed: LQIPVSPSF (MAGC1_HUMAN)
LMIPVSPSA

SEQ ID NO: 89247 - protein, 10 aa, Artificial Sequence
  Description of Artificial Sequence: Synthetic peptide
  Seed: RAGREHFAFG (MAGC1_HUMAN)
RKGREHFAFK

SEQ ID NO: 89248 - protein, 9 aa, Artificial Sequence
  Description of Artificial Sequence: Synthetic peptide
  Seed: VSPSSSSTL (MAGC1_HUMAN)
VVPSSSSTM

SEQ ID NO: 89249 - protein, 11 aa, Artificial Sequence
  Description of Artificial Sequence: Synthetic peptide
  Seed: LSDEQGMSQNR (MAGC1_HUMAN)
LSDEQGMSQNY

SEQ ID NO: 89250 - protein, 9 aa, Artificial Sequence
  Description of Artificial Sequence: Synthetic peptide
  Seed: ISFSSSTSL (MAGC1_HUMAN)
IYFSSSTSI

SEQ ID NO: 89251 - protein, 10 aa, Artificial Sequence
  Description of Artificial Sequence: Synthetic peptide
  Seed: WGPRAHSEVI (MAGC1_HUMAN)
WQPRAHSEVV

SEQ ID NO: 89252 - protein, 11 aa, Artificial Sequence
  Description of Artificial Sequence: Synthetic peptide
  Seed: FLAMLKNTVPI (MAGC1_HUMAN)
FRAMLKNTVPA

SEQ ID NO: 89253 - protein, 9 aa, Artificial Sequence
  Description of Artificial Sequence: Synthetic peptide
  Seed: FFSYTLASL (MAGC1_HUMAN)
FASYTLASM

SEQ ID NO: 89254 - protein, 10 aa, Artificial Sequence
  Description of Artificial Sequence: Synthetic peptide
  Seed: AASSSTLVSI (MAGC1_HUMAN)
ASSSSTLVSF

SEQ ID NO: 89255 - protein, 9 aa, Artificial Sequence
  Description of Artificial Sequence: Synthetic peptide
  Seed: RTHSTFEGF (MAGC1_HUMAN)
RTHSTFEGV

SEQ ID NO: 89256 - protein, 9 aa, Artificial Sequence
  Description of Artificial Sequence: Synthetic peptide
  Seed: RYTGYFPVI (MAGC1_HUMAN)
RMTGYFPVY

SEQ ID NO: 89257 - protein, 9 aa, Artificial Sequence
  Description of Artificial Sequence: Synthetic peptide
  Seed: DSYVFVNTL (MAGC1_HUMAN)
DVYVFVNTI

SEQ ID NO: 89258 - protein, 9 aa, Artificial Sequence
  Description of Artificial Sequence: Synthetic peptide
  Seed: SVLQIPVSA (MAGC1_HUMAN)
SSLQIPVSM

SEQ ID NO: 89259 - protein, 10 aa, Artificial Sequence
  Description of Artificial Sequence: Synthetic peptide
  Seed: SSFPSSTSSS (MAGC1_HUMAN)
SGFPSSTSSM

SEQ ID NO: 89260 - protein, 11 aa, Artificial Sequence
  Description of Artificial Sequence: Synthetic peptide
  Seed: SPLQIPVSRSF (MAGC1_HUMAN)
SILQIPVSRSF

SEQ ID NO: 89261 - protein, 9 aa, Artificial Sequence
  Description of Artificial Sequence: Synthetic peptide
  Seed: ALLSIFQSS (MAGC1_HUMAN)
ALLSIFQST

SEQ ID NO: 89262 - protein, 9 aa, Artificial Sequence
  Description of Artificial Sequence: Synthetic peptide
  Seed: FEGFPQSPL (MAGC1_HUMAN)
FEGFPQSPM

SEQ ID NO: 89263 - protein, 9 aa, Artificial Sequence
  Description of Artificial Sequence: Synthetic peptide
  Seed: FSSTLLSLF (MAGC1_HUMAN)
FWSTLLSLW

SEQ ID NO: 89264 - protein, 10 aa, Artificial Sequence
  Description of Artificial Sequence: Synthetic peptide
  Seed: KVVEFLAMLK (MAGC1_HUMAN)
KDVEFLAMLR

SEQ ID NO: 89265 - protein, 10 aa, Artificial Sequence
  Description of Artificial Sequence: Synthetic peptide
  Seed: QGEDSMSPLY (MAGC1_HUMAN)
QLEDSMSPLY

SEQ ID NO: 89266 - protein, 9 aa, Artificial Sequence
  Description of Artificial Sequence: Synthetic peptide
  Seed: KVVEFLAML (MAGC1_HUMAN)
KLVEFLAMT

SEQ ID NO: 89267 - protein, 10 aa, Artificial Sequence
  Description of Artificial Sequence: Synthetic peptide
  Seed: RYTGYFPVIF (MAGC1_HUMAN)
RWTGYFPVII

SEQ ID NO: 89268 - protein, 9 aa, Artificial Sequence
  Description of Artificial Sequence: Synthetic peptide
  Seed: LQIVPSLPE (MAGC1_HUMAN)
LQIVPSLPI

SEQ ID NO: 89269 - protein, 9 aa, Artificial Sequence
  Description of Artificial Sequence: Synthetic peptide
  Seed: EFIEILFGI (MAGC1_HUMAN)
ESIEILFGC

SEQ ID NO: 89270 - protein, 9 aa, Artificial Sequence
  Description of Artificial Sequence: Synthetic peptide
  Seed: LQIPMTSSF (MAGC1_HUMAN)
LAIPMTSSI

SEQ ID NO: 89271 - protein, 9 aa, Artificial Sequence
  Description of Artificial Sequence: Synthetic peptide
  Seed: SAASSSTLV (MAGC1_HUMAN)
STASSSTLY

SEQ ID NO: 89272 - protein, 9 aa, Artificial Sequence
  Description of Artificial Sequence: Synthetic peptide
  Seed: AGREHFAFG (MAGC1_HUMAN)
AAREHFAFA

SEQ ID NO: 89273 - protein, 10 aa, Artificial Sequence
  Description of Artificial Sequence: Synthetic peptide
  Seed: ISRYTGYFPV (MAGC1_HUMAN)
IKRYTGYFPI

SEQ ID NO: 89274 - protein, 9 aa, Artificial Sequence
  Description of Artificial Sequence: Synthetic peptide
  Seed: TTDDSTATE (MAGC1_HUMAN)
TTDDSTATM

SEQ ID NO: 89275 - protein, 9 aa, Artificial Sequence
  Description of Artificial Sequence: Synthetic peptide
  Seed: LQIPMTSSF (MAGC1_HUMAN)
LYIPMTSSI

SEQ ID NO: 89276 - protein, 10 aa, Artificial Sequence
  Description of Artificial Sequence: Synthetic peptide
  Seed: EVIWDVLSGI (MAGC1_HUMAN)
ESIWDVLSGV

SEQ ID NO: 89277 - protein, 9 aa, Artificial Sequence
  Description of Artificial Sequence: Synthetic peptide
  Seed: SLIESEPLF (MAGC1_HUMAN)
SLIESEPLI

SEQ ID NO: 89278 - protein, 9 aa, Artificial Sequence
  Description of Artificial Sequence: Synthetic peptide
  Seed: SPPEGPAQS (MAGC1_HUMAN)
SPPEGPAQA

SEQ ID NO: 89279 - protein, 9 aa, Artificial Sequence
  Description of Artificial Sequence: Synthetic peptide
  Seed: QSPQGEDSL (MAGC1_HUMAN)
QVPQGEDSL

SEQ ID NO: 89280 - protein, 9 aa, Artificial Sequence
  Description of Artificial Sequence: Synthetic peptide
  Seed: VIKRKVVEF (MAGC1_HUMAN)
VVKRKVVEV

SEQ ID NO: 89281 - protein, 10 aa, Artificial Sequence
  Description of Artificial Sequence: Synthetic peptide
  Seed: SSPERTHSTF (MAGC1_HUMAN)
SQPERTHSTY

SEQ ID NO: 89282 - protein, 11 aa, Artificial Sequence
  Description of Artificial Sequence: Synthetic peptide
  Seed: IPVSAASSSTL (MAGC1_HUMAN)
INVSAASSSTF

SEQ ID NO: 89283 - protein, 10 aa, Artificial Sequence
  Description of Artificial Sequence: Synthetic peptide
  Seed: TGYFPVIFRK (MAGC1_HUMAN)
TTYFPVIFRG

SEQ ID NO: 89284 - protein, 9 aa, Artificial Sequence
  Description of Artificial Sequence: Synthetic peptide
  Seed: KDSQSPLQI (MAGC1_HUMAN)
KQSQSPLQM

SEQ ID NO: 89285 - protein, 9 aa, Artificial Sequence
  Description of Artificial Sequence: Synthetic peptide
  Seed: LQIPVSPSF (MAGC1_HUMAN)
LGIPVSPSL

SEQ ID NO: 89286 - protein, 9 aa, Artificial Sequence
  Description of Artificial Sequence: Synthetic peptide
  Seed: KAREFIEIL (MAGC1_HUMAN)
KVREFIEIM

SEQ ID NO: 89287 - protein, 9 aa, Artificial Sequence
  Description of Artificial Sequence: Synthetic peptide
  Seed: LQRPVSSFF (MAGC1_HUMAN)
LYRPVSSFY

SEQ ID NO: 89288 - protein, 10 aa, Artificial Sequence
  Description of Artificial Sequence: Synthetic peptide
  Seed: YTLDEKVDEL (MAGC1_HUMAN)
YHLDEKVDEL

SEQ ID NO: 89289 - protein, 9 aa, Artificial Sequence
  Description of Artificial Sequence: Synthetic peptide
  Seed: VIFRKAREF (MAGC1_HUMAN)
VRFRKAREL

SEQ ID NO: 89290 - protein, 10 aa, Artificial Sequence
  Description of Artificial Sequence: Synthetic peptide
  Seed: SLFQSFSERT (MAGC1_HUMAN)
SIFQSFSERR

SEQ ID NO: 89291 - protein, 8 aa, Artificial Sequence
  Description of Artificial Sequence: Synthetic peptide
  Seed: FLLLKYQV (MAGC1_HUMAN)
FMLLKYQV

SEQ ID NO: 89292 - protein, 9 aa, Artificial Sequence
  Description of Artificial Sequence: Synthetic peptide
  Seed: FSERTQSTF (MAGC1_HUMAN)
FSERTQSTM

SEQ ID NO: 89293 - protein, 9 aa, Artificial Sequence
  Description of Artificial Sequence: Synthetic peptide
  Seed: FPESPQSPP (MAGC1_HUMAN)
FPESPQSPL

SEQ ID NO: 89294 - protein, 11 aa, Artificial Sequence
  Description of Artificial Sequence: Synthetic peptide
  Seed: REVDPDDSYVF (MAGC1_HUMAN)
RHVDPDDSYVV

SEQ ID NO: 89295 - protein, 9 aa, Artificial Sequence
  Description of Artificial Sequence: Synthetic peptide
  Seed: SRYTGYFPV (MAGC1_HUMAN)
SFYTGYFPY

SEQ ID NO: 89296 - protein, 9 aa, Artificial Sequence
  Description of Artificial Sequence: Synthetic peptide
  Seed: QVKQPITKA (MAGC1_HUMAN)
QTKQPITKF

SEQ ID NO: 89297 - protein, 10 aa, Artificial Sequence
  Description of Artificial Sequence: Synthetic peptide
  Seed: EVDPDDSYVF (MAGC1_HUMAN)
EMDPDDSYVY

SEQ ID NO: 89298 - protein, 10 aa, Artificial Sequence
  Description of Artificial Sequence: Synthetic peptide
  Seed: FSSSTSLSPF (MAGC1_HUMAN)
FFSSTSLSPY

SEQ ID NO: 89299 - protein, 9 aa, Artificial Sequence
  Description of Artificial Sequence: Synthetic peptide
  Seed: SSPERTQST (MAGC1_HUMAN)
SFPERTQSI

SEQ ID NO: 89300 - protein, 10 aa, Artificial Sequence
  Description of Artificial Sequence: Synthetic peptide
  Seed: VSSSFSYTLL (MAGC1_HUMAN)
VKSSFSYTLW

SEQ ID NO: 89301 - protein, 10 aa, Artificial Sequence
  Description of Artificial Sequence: Synthetic peptide
  Seed: MPTAGMPSLL (MAGC1_HUMAN)
MFTAGMPSLA

SEQ ID NO: 89302 - protein, 8 aa, Artificial Sequence
  Description of Artificial Sequence: Synthetic peptide
  Seed: DSLSPLEI (MAGC1_HUMAN)
DALSPLEV

SEQ ID NO: 89303 - protein, 10 aa, Artificial Sequence
  Description of Artificial Sequence: Synthetic peptide
  Seed: YTLASLLQSS (MAGC1_HUMAN)
YLLASLLQSI

SEQ ID NO: 89304 - protein, 9 aa, Artificial Sequence
  Description of Artificial Sequence: Synthetic peptide
  Seed: SSSSSSSTL (MAGC1_HUMAN)
SESSSSSTF

SEQ ID NO: 89305 - protein, 9 aa, Artificial Sequence
  Description of Artificial Sequence: Synthetic peptide
  Seed: SSSSTLLSL (MAGC1_HUMAN)
SISSTLLSI

SEQ ID NO: 89306 - protein, 11 aa, Artificial Sequence
  Description of Artificial Sequence: Synthetic peptide
  Seed: RSFSSTLLSIF (MAGC1_HUMAN)
RVFSSTLLSIF

SEQ ID NO: 89307 - protein, 10 aa, Artificial Sequence
  Description of Artificial Sequence: Synthetic peptide
  Seed: SIIFIKGTYA (MAGC1_HUMAN)
SVIFIKGTYI

SEQ ID NO: 89308 - protein, 10 aa, Artificial Sequence
  Description of Artificial Sequence: Synthetic peptide
  Seed: VSICSSSTSL (MAGC1_HUMAN)
VTICSSSTSM

SEQ ID NO: 89309 - protein, 9 aa, Artificial Sequence
  Description of Artificial Sequence: Synthetic peptide
  Seed: SSSFSYTLL (MAGC1_HUMAN)
SLSFSYTLI

SEQ ID NO: 89310 - protein, 9 aa, Artificial Sequence
  Description of Artificial Sequence: Synthetic peptide
  Seed: FPSSYKDAL (MAGC1_HUMAN)
FASSYKDAV

SEQ ID NO: 89311 - protein, 10 aa, Artificial Sequence
  Description of Artificial Sequence: Synthetic peptide
  Seed: LLQIPMTSSF (MAGC1_HUMAN)
LKQIPMTSSM

SEQ ID NO: 89312 - protein, 9 aa, Artificial Sequence
  Description of Artificial Sequence: Synthetic peptide
  Seed: SSPERTQST (MAGC1_HUMAN)
SMPERTQSL

SEQ ID NO: 89313 - protein, 10 aa, Artificial Sequence
  Description of Artificial Sequence: Synthetic peptide
  Seed: LAMLKNTVPI (MAGC1_HUMAN)
LDMLKNTVPL

SEQ ID NO: 89314 - protein, 11 aa, Artificial Sequence
  Description of Artificial Sequence: Synthetic peptide
  Seed: IPVSSSFSYTL (MAGC1_HUMAN)
IFVSSSFSYTY

SEQ ID NO: 89315 - protein, 9 aa, Artificial Sequence
  Description of Artificial Sequence: Synthetic peptide
  Seed: FSEESSSPV (MAGC1_HUMAN)
FTEESSSPY

SEQ ID NO: 89316 - protein, 10 aa, Artificial Sequence
  Description of Artificial Sequence: Synthetic peptide
  Seed: FSSSTSLSPF (MAGC1_HUMAN)
FQSSTSLSPI

SEQ ID NO: 89317 - protein, 9 aa, Artificial Sequence
  Description of Artificial Sequence: Synthetic peptide
  Seed: GTYASEEVI (MAGC1_HUMAN)
GQYASEEVF

SEQ ID NO: 89318 - protein, 9 aa, Artificial Sequence
  Description of Artificial Sequence: Synthetic peptide
  Seed: FSSTLVSLF (MAGC1_HUMAN)
FPSTLVSLF

SEQ ID NO: 89319 - protein, 9 aa, Artificial Sequence
  Description of Artificial Sequence: Synthetic peptide
  Seed: YQVKQPITK (MAGC1_HUMAN)
YYVKQPITL

SEQ ID NO: 89320 - protein, 10 aa, Artificial Sequence
  Description of Artificial Sequence: Synthetic peptide
  Seed: WGPRAHSEVI (MAGC1_HUMAN)
WGPRAHSEVF

SEQ ID NO: 89321 - protein, 9 aa, Artificial Sequence
  Description of Artificial Sequence: Synthetic peptide
  Seed: LEGEDSLSS (MAGC1_HUMAN)
LEGEDSLSA

SEQ ID NO: 89322 - protein, 9 aa, Artificial Sequence
  Description of Artificial Sequence: Synthetic peptide
  Seed: YQVKQPITK (MAGC1_HUMAN)
YTVKQPITF

SEQ ID NO: 89323 - protein, 9 aa, Artificial Sequence
  Description of Artificial Sequence: Synthetic peptide
  Seed: VPNSSPPRY (MAGC1_HUMAN)
VMNSSPPRY

SEQ ID NO: 89324 - protein, 10 aa, Artificial Sequence
  Description of Artificial Sequence: Synthetic peptide
  Seed: PLQNPASSFF (MAGC1_HUMAN)
PMQNPASSFY

SEQ ID NO: 89325 - protein, 10 aa, Artificial Sequence
  Description of Artificial Sequence: Synthetic peptide
  Seed: EVIWDVLSGI (MAGC1_HUMAN)
ESIWDVLSGK

SEQ ID NO: 89326 - protein, 9 aa, Artificial Sequence
  Description of Artificial Sequence: Synthetic peptide
  Seed: MGDKDMPTA (MAGC1_HUMAN)
MMDKDMPTM

SEQ ID NO: 89327 - protein, 10 aa, Artificial Sequence
  Description of Artificial Sequence: Synthetic peptide
  Seed: IIDTTDDSTA (MAGC1_HUMAN)
ISDTTDDSTL

SEQ ID NO: 89328 - protein, 10 aa, Artificial Sequence
  Description of Artificial Sequence: Synthetic peptide
  Seed: SRYTGYFPVI (MAGC1_HUMAN)
SCYTGYFPVW

SEQ ID NO: 89329 - protein, 11 aa, Artificial Sequence
  Description of Artificial Sequence: Synthetic peptide
  Seed: IPVSSSSSSTL (MAGC1_HUMAN)
IRVSSSSSSTF

SEQ ID NO: 89330 - protein, 10 aa, Artificial Sequence
  Description of Artificial Sequence: Synthetic peptide
  Seed: SSPPRYEFLW (MAGC1_HUMAN)
SYPPRYEFLW

SEQ ID NO: 89331 - protein, 11 aa, Artificial Sequence
  Description of Artificial Sequence: Synthetic peptide
  Seed: SLSQSSPVSSF (MAGC1_HUMAN)
SNSQSSPVSSY

SEQ ID NO: 89332 - protein, 9 aa, Artificial Sequence
  Description of Artificial Sequence: Synthetic peptide
  Seed: SSFPSSTSS (MAGC1_HUMAN)
SVFPSSTSV

SEQ ID NO: 89333 - protein, 10 aa, Artificial Sequence
  Description of Artificial Sequence: Synthetic peptide
  Seed: SSSSSSSTLL (MAGC1_HUMAN)
SGSSSSSTLW

SEQ ID NO: 89334 - protein, 9 aa, Artificial Sequence
  Description of Artificial Sequence: Synthetic peptide
  Seed: ASSFFSSAL (MAGC1_HUMAN)
AQSFFSSAY

SEQ ID NO: 89335 - protein, 9 aa, Artificial Sequence
  Description of Artificial Sequence: Synthetic peptide
  Seed: FSYTLASLL (MAGC1_HUMAN)
FLYTLASLY

SEQ ID NO: 89336 - protein, 9 aa, Artificial Sequence
  Description of Artificial Sequence: Synthetic peptide
  Seed: GEDSMSPLY (MAGC1_HUMAN)
GEDSMSPLA

SEQ ID NO: 89337 - protein, 11 aa, Artificial Sequence
  Description of Artificial Sequence: Synthetic peptide
  Seed: EGEDSSDPLQR (MAGC1_HUMAN)
ETEDSSDPLQY

SEQ ID NO: 89338 - protein, 10 aa, Artificial Sequence
  Description of Artificial Sequence: Synthetic peptide
  Seed: VISFSSSTSL (MAGC1_HUMAN)
VYSFSSSTSW

SEQ ID NO: 89339 - protein, 9 aa, Artificial Sequence
  Description of Artificial Sequence: Synthetic peptide
  Seed: EFIEILFGI (MAGC1_HUMAN)
ELIEILFGV

SEQ ID NO: 89340 - protein, 9 aa, Artificial Sequence
  Description of Artificial Sequence: Synthetic peptide
  Seed: KVWVQEHYL (MAGC1_HUMAN)
KLWVQEHYT

SEQ ID NO: 89341 - protein, 10 aa, Artificial Sequence
  Description of Artificial Sequence: Synthetic peptide
  Seed: STLLSLFQSF (MAGC1_HUMAN)
SQLLSLFQSF

SEQ ID NO: 89342 - protein, 10 aa, Artificial Sequence
  Description of Artificial Sequence: Synthetic peptide
  Seed: REFIEILFGI (MAGC1_HUMAN)
RLFIEILFGM

SEQ ID NO: 89343 - protein, 9 aa, Artificial Sequence
  Description of Artificial Sequence: Synthetic peptide
  Seed: TLDEKVDEL (MAGC1_HUMAN)
TNDEKVDEM

SEQ ID NO: 89344 - protein, 9 aa, Artificial Sequence
  Description of Artificial Sequence: Synthetic peptide
  Seed: LQNPASSFF (MAGC1_HUMAN)
LINPASSFV

SEQ ID NO: 89345 - protein, 9 aa, Artificial Sequence
  Description of Artificial Sequence: Synthetic peptide
  Seed: LQIPGSPSF (MAGC1_HUMAN)
LRIPGSPSL

SEQ ID NO: 89346 - protein, 9 aa, Artificial Sequence
  Description of Artificial Sequence: Synthetic peptide
  Seed: YTLLSLFQS (MAGC1_HUMAN)
YLLLSLFQL

SEQ ID NO: 89347 - protein, 10 aa, Artificial Sequence
  Description of Artificial Sequence: Synthetic peptide
  Seed: SSPERTHSTF (MAGC1_HUMAN)
SSPERTHSTY

SEQ ID NO: 89348 - protein, 9 aa, Artificial Sequence
  Description of Artificial Sequence: Synthetic peptide
  Seed: LQIPVSAAS (MAGC1_HUMAN)
LMIPVSAAI

SEQ ID NO: 89349 - protein, 9 aa, Artificial Sequence
  Description of Artificial Sequence: Synthetic peptide
  Seed: SQNRLLILI (MAGC1_HUMAN)
SKNRLLILY

SEQ ID NO: 89350 - protein, 9 aa, Artificial Sequence
  Description of Artificial Sequence: Synthetic peptide
  Seed: SYKDALKDV (MAGC1_HUMAN)
SYKDALKDM

SEQ ID NO: 89351 - protein, 9 aa, Artificial Sequence
  Description of Artificial Sequence: Synthetic peptide
  Seed: AMLKNTVPI (MAGC1_HUMAN)
ALLKNTVPA

SEQ ID NO: 89352 - protein, 9 aa, Artificial Sequence
  Description of Artificial Sequence: Synthetic peptide
  Seed: VSSSFSYTL (MAGC1_HUMAN)
VGSSFSYTM

SEQ ID NO: 89353 - protein, 9 aa, Artificial Sequence
  Description of Artificial Sequence: Synthetic peptide
  Seed: MTSSFSSTL (MAGC1_HUMAN)
MWSSFSSTM

SEQ ID NO: 89354 - protein, 9 aa, Artificial Sequence
  Description of Artificial Sequence: Synthetic peptide
  Seed: SIIFIKGTY (MAGC1_HUMAN)
SVIFIKGTR

SEQ ID NO: 89355 - protein, 9 aa, Artificial Sequence
  Description of Artificial Sequence: Synthetic peptide
  Seed: RAHSEVIKR (MAGC1_HUMAN)
RSHSEVIKF

SEQ ID NO: 89356 - protein, 9 aa, Artificial Sequence
  Description of Artificial Sequence: Synthetic peptide
  Seed: SSPESTQSP (MAGC1_HUMAN)
SPPESTQSL

SEQ ID NO: 89357 - protein, 9 aa, Artificial Sequence
  Description of Artificial Sequence: Synthetic peptide
  Seed: LQIPVSPSF (MAGC1_HUMAN)
LSIPVSPSY

SEQ ID NO: 89358 - protein, 9 aa, Artificial Sequence
  Description of Artificial Sequence: Synthetic peptide
  Seed: GSPSFSSTL (MAGC1_HUMAN)
GQPSFSSTI

SEQ ID NO: 89359 - protein, 9 aa, Artificial Sequence
  Description of Artificial Sequence: Synthetic peptide
  Seed: SSSTSLSPF (MAGC1_HUMAN)
SYSTSLSPM

SEQ ID NO: 89360 - protein, 11 aa, Artificial Sequence
  Description of Artificial Sequence: Synthetic peptide
  Seed: SSFPSSTSSSL (MAGC1_HUMAN)
SAFPSSTSSSY

SEQ ID NO: 89361 - protein, 10 aa, Artificial Sequence
  Description of Artificial Sequence: Synthetic peptide
  Seed: PLQIPMTSSF (MAGC1_HUMAN)
PVQIPMTSSY

SEQ ID NO: 89362 - protein, 9 aa, Artificial Sequence
  Description of Artificial Sequence: Synthetic peptide
  Seed: LQNPASSFF (MAGC1_HUMAN)
LYNPASSFM

SEQ ID NO: 89363 - protein, 10 aa, Artificial Sequence
  Description of Artificial Sequence: Synthetic peptide
  Seed: VSSSFSYTLL (MAGC1_HUMAN)
VPSSFSYTLW

SEQ ID NO: 89364 - protein, 9 aa, Artificial Sequence
  Description of Artificial Sequence: Synthetic peptide
  Seed: EHFAFGEPR (MAGC1_HUMAN)
ETFAFGEPK

SEQ ID NO: 89365 - protein, 11 aa, Artificial Sequence
  Description of Artificial Sequence: Synthetic peptide
  Seed: REVDPDDSYVF (MAGC1_HUMAN)
RRVDPDDSYVW

SEQ ID NO: 89366 - protein, 11 aa, Artificial Sequence
  Description of Artificial Sequence: Synthetic peptide
  Seed: SPLQIPVSSSS (MAGC1_HUMAN)
SYLQIPVSSSY

SEQ ID NO: 89367 - protein, 10 aa, Artificial Sequence
  Description of Artificial Sequence: Synthetic peptide
  Seed: VISFSSSTSL (MAGC1_HUMAN)
VFSFSSSTSL

SEQ ID NO: 89368 - protein, 10 aa, Artificial Sequence
  Description of Artificial Sequence: Synthetic peptide
  Seed: KGTYASEEVI (MAGC1_HUMAN)
KHTYASEEVF

SEQ ID NO: 89369 - protein, 10 aa, Artificial Sequence
  Description of Artificial Sequence: Synthetic peptide
  Seed: GPVQSPLHSP (MAGC1_HUMAN)
GPVQSPLHSL

SEQ ID NO: 89370 - protein, 9 aa, Artificial Sequence
  Description of Artificial Sequence: Synthetic peptide
  Seed: LQRPVSSFF (MAGC1_HUMAN)
LVRPVSSFL

SEQ ID NO: 89371 - protein, 9 aa, Artificial Sequence
  Description of Artificial Sequence: Synthetic peptide
  Seed: FSSTLLSLF (MAGC1_HUMAN)
FTSTLLSLM

SEQ ID NO: 89372 - protein, 9 aa, Artificial Sequence
  Description of Artificial Sequence: Synthetic peptide
  Seed: SPLQIVPSL (MAGC1_HUMAN)
SLLQIVPST

SEQ ID NO: 89373 - protein, 9 aa, Artificial Sequence
  Description of Artificial Sequence: Synthetic peptide
  Seed: FSYTLASLL (MAGC1_HUMAN)
FQYTLASLF

SEQ ID NO: 89374 - protein, 10 aa, Artificial Sequence
  Description of Artificial Sequence: Synthetic peptide
  Seed: EMLTNVISRY (MAGC1_HUMAN)
EVLTNVISRR

SEQ ID NO: 89375 - protein, 9 aa, Artificial Sequence
  Description of Artificial Sequence: Synthetic peptide
  Seed: TLDLTSEGC (MAGC1_HUMAN)
TSDLTSEGL

SEQ ID NO: 89376 - protein, 9 aa, Artificial Sequence
  Description of Artificial Sequence: Synthetic peptide
  Seed: FFSYTLASL (MAGC1_HUMAN)
FASYTLASH

SEQ ID NO: 89377 - protein, 11 aa, Artificial Sequence
  Description of Artificial Sequence: Synthetic peptide
  Seed: KVWVQEHYLEY (MAGC1_HUMAN)
KAWVQEHYLEW

SEQ ID NO: 89378 - protein, 9 aa, Artificial Sequence
  Description of Artificial Sequence: Synthetic peptide
  Seed: SSPPRYEFL (MAGC1_HUMAN)
SYPPRYEFW

SEQ ID NO: 89379 - protein, 9 aa, Artificial Sequence
  Description of Artificial Sequence: Synthetic peptide
  Seed: LQRPVSSFF (MAGC1_HUMAN)
LGRPVSSFK

SEQ ID NO: 89380 - protein, 9 aa, Artificial Sequence
  Description of Artificial Sequence: Synthetic peptide
  Seed: SQSSPVSSF (MAGC1_HUMAN)
SGSSPVSSF

SEQ ID NO: 89381 - protein, 9 aa, Artificial Sequence
  Description of Artificial Sequence: Synthetic peptide
  Seed: FSYTLASLL (MAGC1_HUMAN)
FIYTLASLF

SEQ ID NO: 89382 - protein, 9 aa, Artificial Sequence
  Description of Artificial Sequence: Synthetic peptide
  Seed: NTVPITFPS (MAGC1_HUMAN)
NTVPITFPA

SEQ ID NO: 89383 - protein, 9 aa, Artificial Sequence
  Description of Artificial Sequence: Synthetic peptide
  Seed: STQSPFEGF (MAGC1_HUMAN)
SAQSPFEGM

SEQ ID NO: 89384 - protein, 10 aa, Artificial Sequence
  Description of Artificial Sequence: Synthetic peptide
  Seed: LQIPMTSSFS (MAGC1_HUMAN)
LQIPMTSSFR

SEQ ID NO: 89385 - protein, 9 aa, Artificial Sequence
  Description of Artificial Sequence: Synthetic peptide
  Seed: SSLSQSSPV (MAGC1_HUMAN)
SALSQSSPW

SEQ ID NO: 89386 - protein, 9 aa, Artificial Sequence
  Description of Artificial Sequence: Synthetic peptide
  Seed: SAASSSTLV (MAGC1_HUMAN)
SLASSSTLM

SEQ ID NO: 89387 - protein, 9 aa, Artificial Sequence
  Description of Artificial Sequence: Synthetic peptide
  Seed: FSYTLASLL (MAGC1_HUMAN)
FAYTLASLM

SEQ ID NO: 89388 - protein, 10 aa, Artificial Sequence
  Description of Artificial Sequence: Synthetic peptide
  Seed: FPQSPLQIPV (MAGC1_HUMAN)
FLQSPLQIPL

SEQ ID NO: 89389 - protein, 9 aa, Artificial Sequence
  Description of Artificial Sequence: Synthetic peptide
  Seed: TFEGFPQSL (MAGC1_HUMAN)
TAEGFPQSL

SEQ ID NO: 89390 - protein, 9 aa, Artificial Sequence
  Description of Artificial Sequence: Synthetic peptide
  Seed: AGREHFAFG (MAGC1_HUMAN)
AAREHFAFI

SEQ ID NO: 89391 - protein, 9 aa, Artificial Sequence
  Description of Artificial Sequence: Synthetic peptide
  Seed: LQRPVSSFF (MAGC1_HUMAN)
LKRPVSSFM

SEQ ID NO: 89392 - protein, 11 aa, Artificial Sequence
  Description of Artificial Sequence: Synthetic peptide
  Seed: RSFSSTLLSIF (MAGC1_HUMAN)
RFFSSTLLSIY

SEQ ID NO: 89393 - protein, 9 aa, Artificial Sequence
  Description of Artificial Sequence: Synthetic peptide
  Seed: VIWDVLSGI (MAGC1_HUMAN)
VQWDVLSGA

SEQ ID NO: 89394 - protein, 9 aa, Artificial Sequence
  Description of Artificial Sequence: Synthetic peptide
  Seed: YVFVNTLDL (MAGC1_HUMAN)
YGFVNTLDW

SEQ ID NO: 89395 - protein, 9 aa, Artificial Sequence
  Description of Artificial Sequence: Synthetic peptide
  Seed: SICSSSTSL (MAGC1_HUMAN)
SVCSSSTSI

SEQ ID NO: 89396 - protein, 10 aa, Artificial Sequence
  Description of Artificial Sequence: Synthetic peptide
  Seed: SESLIESEPL (MAGC1_HUMAN)
SESLIESEPM

SEQ ID NO: 89397 - protein, 10 aa, Artificial Sequence
  Description of Artificial Sequence: Synthetic peptide
  Seed: SQNRLLILIL (MAGC1_HUMAN)
SQNRLLILIF

SEQ ID NO: 89398 - protein, 9 aa, Artificial Sequence
  Description of Artificial Sequence: Synthetic peptide
  Seed: YPLQSPQSR (MAGC1_HUMAN)
YILQSPQSY

SEQ ID NO: 89399 - protein, 10 aa, Artificial Sequence
  Description of Artificial Sequence: Synthetic peptide
  Seed: LQIPGSPSFS (MAGC1_HUMAN)
LMIPGSPSFV

SEQ ID NO: 89400 - protein, 10 aa, Artificial Sequence
  Description of Artificial Sequence: Synthetic peptide
  Seed: FPQSPLQIPV (MAGC1_HUMAN)
FIQSPLQIPL

SEQ ID NO: 89401 - protein, 9 aa, Artificial Sequence
  Description of Artificial Sequence: Synthetic peptide
  Seed: RSFSSTLLS (MAGC1_HUMAN)
RAFSSTLLW

SEQ ID NO: 89402 - protein, 9 aa, Artificial Sequence
  Description of Artificial Sequence: Synthetic peptide
  Seed: FEGFPQSVL (MAGC1_HUMAN)
FEGFPQSVM

SEQ ID NO: 89403 - protein, 10 aa, Artificial Sequence
  Description of Artificial Sequence: Synthetic peptide
  Seed: RSFSSTLLSI (MAGC1_HUMAN)
REFSSTLLSF

SEQ ID NO: 89404 - protein, 11 aa, Artificial Sequence
  Description of Artificial Sequence: Synthetic peptide
  Seed: STFEGFPQSLL (MAGC1_HUMAN)
SLFEGFPQSLQ

SEQ ID NO: 89405 - protein, 10 aa, Artificial Sequence
  Description of Artificial Sequence: Synthetic peptide
  Seed: LSLFQSSPER (MAGC1_HUMAN)
LYLFQSSPER

SEQ ID NO: 89406 - protein, 9 aa, Artificial Sequence
  Description of Artificial Sequence: Synthetic peptide
  Seed: KVDELARFL (MAGC1_HUMAN)
KFDELARFL

SEQ ID NO: 89407 - protein, 9 aa, Artificial Sequence
  Description of Artificial Sequence: Synthetic peptide
  Seed: KVDELARFL (MAGC1_HUMAN)
KFDELARFW

SEQ ID NO: 89408 - protein, 9 aa, Artificial Sequence
  Description of Artificial Sequence: Synthetic peptide
  Seed: IPMTSSFSS (MAGC1_HUMAN)
IMMTSSFSY

SEQ ID NO: 89409 - protein, 9 aa, Artificial Sequence
  Description of Artificial Sequence: Synthetic peptide
  Seed: MPTAGMPSL (MAGC1_HUMAN)
MRTAGMPSM

SEQ ID NO: 89410 - protein, 10 aa, Artificial Sequence
  Description of Artificial Sequence: Synthetic peptide
  Seed: MSPLYFPQSP (MAGC1_HUMAN)
MAPLYFPQSV

SEQ ID NO: 89411 - protein, 9 aa, Artificial Sequence
  Description of Artificial Sequence: Synthetic peptide
  Seed: GYFPVIFRK (MAGC1_HUMAN)
GNFPVIFRY

SEQ ID NO: 89412 - protein, 10 aa, Artificial Sequence
  Description of Artificial Sequence: Synthetic peptide
  Seed: LSQSSPVSSF (MAGC1_HUMAN)
LPQSSPVSSM

SEQ ID NO: 89413 - protein, 11 aa, Artificial Sequence
  Description of Artificial Sequence: Synthetic peptide
  Seed: RPVSSFFSYTL (MAGC1_HUMAN)
RHVSSFFSYTW

SEQ ID NO: 89414 - protein, 9 aa, Artificial Sequence
  Description of Artificial Sequence: Synthetic peptide
  Seed: FSSTLLSIL (MAGC1_HUMAN)
FTSTLLSIF

SEQ ID NO: 89415 - protein, 9 aa, Artificial Sequence
  Description of Artificial Sequence: Synthetic peptide
  Seed: CSSSTPSSL (MAGC1_HUMAN)
CSSSTPSSM

SEQ ID NO: 89416 - protein, 10 aa, Artificial Sequence
  Description of Artificial Sequence: Synthetic peptide
  Seed: KGTYASEEVI (MAGC1_HUMAN)
KVTYASEEVW

SEQ ID NO: 89417 - protein, 9 aa, Artificial Sequence
  Description of Artificial Sequence: Synthetic peptide
  Seed: SKSSPESPL (MAGC1_HUMAN)
SQSSPESPL

SEQ ID NO: 89418 - protein, 9 aa, Artificial Sequence
  Description of Artificial Sequence: Synthetic peptide
  Seed: TPSSLPQSF (MAGC1_HUMAN)
TISSLPQSW

SEQ ID NO: 89419 - protein, 9 aa, Artificial Sequence
  Description of Artificial Sequence: Synthetic peptide
  Seed: LQRPVSSFF (MAGC1_HUMAN)
LTRPVSSFF

SEQ ID NO: 89420 - protein, 9 aa, Artificial Sequence
  Description of Artificial Sequence: Synthetic peptide
  Seed: RTHSTFEGF (MAGC1_HUMAN)
RAHSTFEGM

SEQ ID NO: 89421 - protein, 10 aa, Artificial Sequence
  Description of Artificial Sequence: Synthetic peptide
  Seed: ASSFFSSALL (MAGC1_HUMAN)
ATSFFSSALI

SEQ ID NO: 89422 - protein, 9 aa, Artificial Sequence
  Description of Artificial Sequence: Synthetic peptide
  Seed: KVVEFLAML (MAGC1_HUMAN)
KMVEFLAMI

SEQ ID NO: 89423 - protein, 10 aa, Artificial Sequence
  Description of Artificial Sequence: Synthetic peptide
  Seed: RYTGYFPVIF (MAGC1_HUMAN)
RITGYFPVIW

SEQ ID NO: 89424 - protein, 10 aa, Artificial Sequence
  Description of Artificial Sequence: Synthetic peptide
  Seed: HESPQSPPEG (MAGC1_HUMAN)
HESPQSPPEI

SEQ ID NO: 89425 - protein, 9 aa, Artificial Sequence
  Description of Artificial Sequence: Synthetic peptide
  Seed: STFEGFPQS (MAGC1_HUMAN)
SLFEGFPQY

SEQ ID NO: 89426 - protein, 11 aa, Artificial Sequence
  Description of Artificial Sequence: Synthetic peptide
  Seed: SPLQIPVSSSS (MAGC1_HUMAN)
SLLQIPVSSSY

SEQ ID NO: 89427 - protein, 10 aa, Artificial Sequence
  Description of Artificial Sequence: Synthetic peptide
  Seed: STLLSLFQSF (MAGC1_HUMAN)
SSLLSLFQSW

SEQ ID NO: 89428 - protein, 10 aa, Artificial Sequence
  Description of Artificial Sequence: Synthetic peptide
  Seed: FFSSALLSIF (MAGC1_HUMAN)
FHSSALLSIY

SEQ ID NO: 89429 - protein, 9 aa, Artificial Sequence
  Description of Artificial Sequence: Synthetic peptide
  Seed: WGPRAHSEV (MAGC1_HUMAN)
WTPRAHSEL

SEQ ID NO: 89430 - protein, 9 aa, Artificial Sequence
  Description of Artificial Sequence: Synthetic peptide
  Seed: IPMTSSFSS (MAGC1_HUMAN)
ISMTSSFSM

SEQ ID NO: 89431 - protein, 9 aa, Artificial Sequence
  Description of Artificial Sequence: Synthetic peptide
  Seed: LILSIIFIK (MAGC1_HUMAN)
LGLSIIFIR

SEQ ID NO: 89432 - protein, 9 aa, Artificial Sequence
  Description of Artificial Sequence: Synthetic peptide
  Seed: REVDPDDSY (MAGC1_HUMAN)
REVDPDDSM

SEQ ID NO: 89433 - protein, 9 aa, Artificial Sequence
  Description of Artificial Sequence: Synthetic peptide
  Seed: KVWVQEHYL (MAGC1_HUMAN)
KAWVQEHYY

SEQ ID NO: 89434 - protein, 9 aa, Artificial Sequence
  Description of Artificial Sequence: Synthetic peptide
  Seed: VPITFPSSY (MAGC1_HUMAN)
VLITFPSSY

SEQ ID NO: 89435 - protein, 9 aa, Artificial Sequence
  Description of Artificial Sequence: Synthetic peptide
  Seed: SSPESAQSA (MAGC1_HUMAN)
SRPESAQSM

SEQ ID NO: 89436 - protein, 9 aa, Artificial Sequence
  Description of Artificial Sequence: Synthetic peptide
  Seed: WVQEHYLEY (MAGC1_HUMAN)
WQQEHYLEH

SEQ ID NO: 89437 - protein, 9 aa, Artificial Sequence
  Description of Artificial Sequence: Synthetic peptide
  Seed: VSRSFSSTL (MAGC1_HUMAN)
VFRSFSSTK

SEQ ID NO: 89438 - protein, 10 aa, Artificial Sequence
  Description of Artificial Sequence: Synthetic peptide
  Seed: MPTAGMPSLL (MAGC1_HUMAN)
MHTAGMPSLY

SEQ ID NO: 89439 - protein, 9 aa, Artificial Sequence
  Description of Artificial Sequence: Synthetic peptide
  Seed: FSSTLLSIL (MAGC1_HUMAN)
FRSTLLSIM

SEQ ID NO: 89440 - protein, 9 aa, Artificial Sequence
  Description of Artificial Sequence: Synthetic peptide
  Seed: FSSTLVSLF (MAGC1_HUMAN)
FMSTLVSLW

SEQ ID NO: 89441 - protein, 9 aa, Artificial Sequence
  Description of Artificial Sequence: Synthetic peptide
  Seed: SSLSQSSPV (MAGC1_HUMAN)
SLLSQSSPA

SEQ ID NO: 89442 - protein, 9 aa, Artificial Sequence
  Description of Artificial Sequence: Synthetic peptide
  Seed: TPSSLPQSF (MAGC1_HUMAN)
TSSSLPQSW

SEQ ID NO: 89443 - protein, 10 aa, Artificial Sequence
  Description of Artificial Sequence: Synthetic peptide
  Seed: SPLYFPQSPL (MAGC1_HUMAN)
SRLYFPQSPV

SEQ ID NO: 89444 - protein, 9 aa, Artificial Sequence
  Description of Artificial Sequence: Synthetic peptide
  Seed: VIFRKAREF (MAGC1_HUMAN)
VHFRKAREY

SEQ ID NO: 89445 - protein, 9 aa, Artificial Sequence
  Description of Artificial Sequence: Synthetic peptide
  Seed: VIKRKVVEF (MAGC1_HUMAN)
VFKRKVVEF

SEQ ID NO: 89446 - protein, 10 aa, Artificial Sequence
  Description of Artificial Sequence: Synthetic peptide
  Seed: MTSSFSSTLL (MAGC1_HUMAN)
MMSSFSSTLG

SEQ ID NO: 89447 - protein, 10 aa, Artificial Sequence
  Description of Artificial Sequence: Synthetic peptide
  Seed: PLQRPVSSFF (MAGC1_HUMAN)
PIQRPVSSFF

SEQ ID NO: 89448 - protein, 10 aa, Artificial Sequence
  Description of Artificial Sequence: Synthetic peptide
  Seed: GEDSLSSLHF (MAGC1_HUMAN)
GEDSLSSLHA

SEQ ID NO: 89449 - protein, 9 aa, Artificial Sequence
  Description of Artificial Sequence: Synthetic peptide
  Seed: SAASSSTLV (MAGC1_HUMAN)
SAASSSTLL

SEQ ID NO: 89450 - protein, 9 aa, Artificial Sequence
  Description of Artificial Sequence: Synthetic peptide
  Seed: SVLQIPVSA (MAGC1_HUMAN)
SVLQIPVSK

SEQ ID NO: 89451 - protein, 9 aa, Artificial Sequence
  Description of Artificial Sequence: Synthetic peptide
  Seed: LSDEQGMSQ (MAGC1_HUMAN)
LLDEQGMSV

SEQ ID NO: 89452 - protein, 9 aa, Artificial Sequence
  Description of Artificial Sequence: Synthetic peptide
  Seed: KVVEFLAML (MAGC1_HUMAN)
KQVEFLAMS

SEQ ID NO: 89453 - protein, 10 aa, Artificial Sequence
  Description of Artificial Sequence: Synthetic peptide
  Seed: KAREFIEILF (MAGC1_HUMAN)
KVREFIEILK

SEQ ID NO: 89454 - protein, 9 aa, Artificial Sequence
  Description of Artificial Sequence: Synthetic peptide
  Seed: FEGFPQSVL (MAGC1_HUMAN)
FVGFPQSVY

SEQ ID NO: 89455 - protein, 8 aa, Artificial Sequence
  Description of Artificial Sequence: Synthetic peptide
  Seed: SSFFSSAL (MAGC1_HUMAN)
SAFFSSAM

SEQ ID NO: 89456 - protein, 11 aa, Artificial Sequence
  Description of Artificial Sequence: Synthetic peptide
  Seed: LWGPRAHSEVI (MAGC1_HUMAN)
LAGPRAHSEVL

SEQ ID NO: 89457 - protein, 11 aa, Artificial Sequence
  Description of Artificial Sequence: Synthetic peptide
  Seed: STFEGFAQSSL (MAGC1_HUMAN)
STFEGFAQSSW

SEQ ID NO: 89458 - protein, 10 aa, Artificial Sequence
  Description of Artificial Sequence: Synthetic peptide
  Seed: RAGREHFAFG (MAGC1_HUMAN)
RFGREHFAFI

SEQ ID NO: 89459 - protein, 9 aa, Artificial Sequence
  Description of Artificial Sequence: Synthetic peptide
  Seed: CSSSTSLSL (MAGC1_HUMAN)
CASSTSLSM

SEQ ID NO: 89460 - protein, 10 aa, Artificial Sequence
  Description of Artificial Sequence: Synthetic peptide
  Seed: VSSSSSSTLL (MAGC1_HUMAN)
VPSSSSSTLW

SEQ ID NO: 89461 - protein, 9 aa, Artificial Sequence
  Description of Artificial Sequence: Synthetic peptide
  Seed: SSFPSSTSS (MAGC1_HUMAN)
SLFPSSTSL

SEQ ID NO: 89462 - protein, 9 aa, Artificial Sequence
  Description of Artificial Sequence: Synthetic peptide
  Seed: SAPEGEDSL (MAGC1_HUMAN)
SYPEGEDSL

SEQ ID NO: 89463 - protein, 10 aa, Artificial Sequence
  Description of Artificial Sequence: Synthetic peptide
  Seed: SFSSTLLSIF (MAGC1_HUMAN)
SKSSTLLSIW

SEQ ID NO: 89464 - protein, 9 aa, Artificial Sequence
  Description of Artificial Sequence: Synthetic peptide
  Seed: VPITFPSSY (MAGC1_HUMAN)
VTITFPSSM

SEQ ID NO: 89465 - protein, 10 aa, Artificial Sequence
  Description of Artificial Sequence: Synthetic peptide
  Seed: RPVSSFFSYT (MAGC1_HUMAN)
RQVSSFFSYA

SEQ ID NO: 89466 - protein, 9 aa, Artificial Sequence
  Description of Artificial Sequence: Synthetic peptide
  Seed: NTVPITFPS (MAGC1_HUMAN)
NSVPITFPY

SEQ ID NO: 89467 - protein, 10 aa, Artificial Sequence
  Description of Artificial Sequence: Synthetic peptide
  Seed: NTVPITFPSS (MAGC1_HUMAN)
NSVPITFPSV

SEQ ID NO: 89468 - protein, 10 aa, Artificial Sequence
  Description of Artificial Sequence: Synthetic peptide
  Seed: FFSYTLASLL (MAGC1_HUMAN)
FCSYTLASLY

SEQ ID NO: 89469 - protein, 10 aa, Artificial Sequence
  Description of Artificial Sequence: Synthetic peptide
  Seed: KRKVVEFLAM (MAGC1_HUMAN)
KMKVVEFLAM

SEQ ID NO: 89470 - protein, 9 aa, Artificial Sequence
  Description of Artificial Sequence: Synthetic peptide
  Seed: WGPRAHSEV (MAGC1_HUMAN)
WLPRAHSEM

SEQ ID NO: 89471 - protein, 9 aa, Artificial Sequence
  Description of Artificial Sequence: Synthetic peptide
  Seed: TLLSLFQSF (MAGC1_HUMAN)
TTLSLFQSF

SEQ ID NO: 89472 - protein, 9 aa, Artificial Sequence
  Description of Artificial Sequence: Synthetic peptide
  Seed: ASEEVIWDV (MAGC1_HUMAN)
AQEEVIWDL

SEQ ID NO: 89473 - protein, 9 aa, Artificial Sequence
  Description of Artificial Sequence: Synthetic peptide
  Seed: GYFPVIFRK (MAGC1_HUMAN)
GGFPVIFRK

SEQ ID NO: 89474 - protein, 10 aa, Artificial Sequence
  Description of Artificial Sequence: Synthetic peptide
  Seed: KVVEFLAMLK (MAGC1_HUMAN)
KAVEFLAMLV

SEQ ID NO: 89475 - protein, 10 aa, Artificial Sequence
  Description of Artificial Sequence: Synthetic peptide
  Seed: MSPLYFPQSP (MAGC1_HUMAN)
MLPLYFPQSV

SEQ ID NO: 89476 - protein, 11 aa, Artificial Sequence
  Description of Artificial Sequence: Synthetic peptide
  Seed: IPMTSSFSSTL (MAGC1_HUMAN)
IVMTSSFSSTY

SEQ ID NO: 89477 - protein, 9 aa, Artificial Sequence
  Description of Artificial Sequence: Synthetic peptide
  Seed: AQSPLQSPV (MAGC1_HUMAN)
AESPLQSPI

SEQ ID NO: 89478 - protein, 9 aa, Artificial Sequence
  Description of Artificial Sequence: Synthetic peptide
  Seed: KVVEFLAML (MAGC1_HUMAN)
KVVEFLAMV

SEQ ID NO: 89479 - protein, 10 aa, Artificial Sequence
  Description of Artificial Sequence: Synthetic peptide
  Seed: SPLQNPASSF (MAGC1_HUMAN)
SQLQNPASSM

SEQ ID NO: 89480 - protein, 9 aa, Artificial Sequence
  Description of Artificial Sequence: Synthetic peptide
  Seed: SSPPRYEFL (MAGC1_HUMAN)
STPPRYEFL

SEQ ID NO: 89481 - protein, 9 aa, Artificial Sequence
  Description of Artificial Sequence: Synthetic peptide
  Seed: FSSTLLSIL (MAGC1_HUMAN)
FQSTLLSIW

SEQ ID NO: 89482 - protein, 10 aa, Artificial Sequence
  Description of Artificial Sequence: Synthetic peptide
  Seed: FFSYTLASLL (MAGC1_HUMAN)
FTSYTLASLA

SEQ ID NO: 89483 - protein, 10 aa, Artificial Sequence
  Description of Artificial Sequence: Synthetic peptide
  Seed: VSICSSSTSL (MAGC1_HUMAN)
VSICSSSTSM

SEQ ID NO: 89484 - protein, 9 aa, Artificial Sequence
  Description of Artificial Sequence: Synthetic peptide
  Seed: FSYTLLSLF (MAGC1_HUMAN)
FAYTLLSLI

SEQ ID NO: 89485 - protein, 9 aa, Artificial Sequence
  Description of Artificial Sequence: Synthetic peptide
  Seed: SSPESPLQS (MAGC1_HUMAN)
SMPESPLQL

SEQ ID NO: 89486 - protein, 10 aa, Artificial Sequence
  Description of Artificial Sequence: Synthetic peptide
  Seed: LAMLKNTVPI (MAGC1_HUMAN)
LRMLKNTVPF

SEQ ID NO: 89487 - protein, 10 aa, Artificial Sequence
  Description of Artificial Sequence: Synthetic peptide
  Seed: RAGREHFAFG (MAGC1_HUMAN)
RSGREHFAFA

SEQ ID NO: 89488 - protein, 9 aa, Artificial Sequence
  Description of Artificial Sequence: Synthetic peptide
  Seed: FSSTLVSLF (MAGC1_HUMAN)
FYSTLVSLY

SEQ ID NO: 89489 - protein, 10 aa, Artificial Sequence
  Description of Artificial Sequence: Synthetic peptide
  Seed: SSSSTLLSLF (MAGC1_HUMAN)
SRSSTLLSLY

SEQ ID NO: 89490 - protein, 10 aa, Artificial Sequence
  Description of Artificial Sequence: Synthetic peptide
  Seed: EMLTNVISRY (MAGC1_HUMAN)
EVLTNVISRW

SEQ ID NO: 89491 - protein, 11 aa, Artificial Sequence
  Description of Artificial Sequence: Synthetic peptide
  Seed: RSFSSTLLSIF (MAGC1_HUMAN)
RYFSSTLLSIW

SEQ ID NO: 89492 - protein, 9 aa, Artificial Sequence
  Description of Artificial Sequence: Synthetic peptide
  Seed: MSQNRLLIL (MAGC1_HUMAN)
MMQNRLLIL

SEQ ID NO: 89493 - protein, 9 aa, Artificial Sequence
  Description of Artificial Sequence: Synthetic peptide
  Seed: VSSFFSYTL (MAGC1_HUMAN)
VQSFFSYTL

SEQ ID NO: 89494 - protein, 9 aa, Artificial Sequence
  Description of Artificial Sequence: Synthetic peptide
  Seed: STQSPFEGF (MAGC1_HUMAN)
STQSPFEGW

SEQ ID NO: 89495 - protein, 9 aa, Artificial Sequence
  Description of Artificial Sequence: Synthetic peptide
  Seed: SIIFIKGTY (MAGC1_HUMAN)
SQIFIKGTY

SEQ ID NO: 89496 - protein, 10 aa, Artificial Sequence
  Description of Artificial Sequence: Synthetic peptide
  Seed: RKVVEFLAML (MAGC1_HUMAN)
RAVVEFLAMF

SEQ ID NO: 89497 - protein, 9 aa, Artificial Sequence
  Description of Artificial Sequence: Synthetic peptide
  Seed: SSSSTLLSL (MAGC1_HUMAN)
SVSSTLLSM

SEQ ID NO: 89498 - protein, 9 aa, Artificial Sequence
  Description of Artificial Sequence: Synthetic peptide
  Seed: AQSPLQRPV (MAGC1_HUMAN)
AASPLQRPH

SEQ ID NO: 89499 - protein, 11 aa, Artificial Sequence
  Description of Artificial Sequence: Synthetic peptide
  Seed: SSFSYTLLSLF (MAGC1_HUMAN)
SDFSYTLLSLW

SEQ ID NO: 89500 - protein, 9 aa, Artificial Sequence
  Description of Artificial Sequence: Synthetic peptide
  Seed: KVWVQEHYL (MAGC1_HUMAN)
KIWVQEHYL

SEQ ID NO: 89501 - protein, 9 aa, Artificial Sequence
  Description of Artificial Sequence: Synthetic peptide
  Seed: STFEGFAQS (MAGC1_HUMAN)
SVFEGFAQT

SEQ ID NO: 89502 - protein, 11 aa, Artificial Sequence
  Description of Artificial Sequence: Synthetic peptide
  Seed: AEMLTNVISRY (MAGC1_HUMAN)
AQMLTNVISRF

SEQ ID NO: 89503 - protein, 9 aa, Artificial Sequence
  Description of Artificial Sequence: Synthetic peptide
  Seed: SSPERTQST (MAGC1_HUMAN)
SCPERTQSF

SEQ ID NO: 89504 - protein, 9 aa, Artificial Sequence
  Description of Artificial Sequence: Synthetic peptide
  Seed: SPLQIVPSL (MAGC1_HUMAN)
SHLQIVPSP

SEQ ID NO: 89505 - protein, 10 aa, Artificial Sequence
  Description of Artificial Sequence: Synthetic peptide
  Seed: KDVEERAQAI (MAGC1_HUMAN)
KEVEERAQAP

SEQ ID NO: 89506 - protein, 10 aa, Artificial Sequence
  Description of Artificial Sequence: Synthetic peptide
  Seed: FSSSTSLSPF (MAGC1_HUMAN)
FNSSTSLSPW

SEQ ID NO: 89507 - protein, 9 aa, Artificial Sequence
  Description of Artificial Sequence: Synthetic peptide
  Seed: SPLEGEDSL (MAGC1_HUMAN)
SVLEGEDSF

SEQ ID NO: 89508 - protein, 9 aa, Artificial Sequence
  Description of Artificial Sequence: Synthetic peptide
  Seed: SLFQSFSER (MAGC1_HUMAN)
SMFQSFSER

SEQ ID NO: 89509 - protein, 9 aa, Artificial Sequence
  Description of Artificial Sequence: Synthetic peptide
  Seed: LEYREVPNS (MAGC1_HUMAN)
LEYREVPNM

SEQ ID NO: 89510 - protein, 10 aa, Artificial Sequence
  Description of Artificial Sequence: Synthetic peptide
  Seed: KAREFIEILF (MAGC1_HUMAN)
KQREFIEILK

SEQ ID NO: 89511 - protein, 9 aa, Artificial Sequence
  Description of Artificial Sequence: Synthetic peptide
  Seed: WGPRAHSEV (MAGC1_HUMAN)
WAPRAHSEI

SEQ ID NO: 89512 - protein, 11 aa, Artificial Sequence
  Description of Artificial Sequence: Synthetic peptide
  Seed: IPVSRSFSSTL (MAGC1_HUMAN)
INVSRSFSSTW

SEQ ID NO: 89513 - protein, 10 aa, Artificial Sequence
  Description of Artificial Sequence: Synthetic peptide
  Seed: YLEYREVPNS (MAGC1_HUMAN)
YLEYREVPNA

SEQ ID NO: 89514 - protein, 10 aa, Artificial Sequence
  Description of Artificial Sequence: Synthetic peptide
  Seed: GVRAGREHFA (MAGC1_HUMAN)
GSRAGREHFK

SEQ ID NO: 89515 - protein, 10 aa, Artificial Sequence
  Description of Artificial Sequence: Synthetic peptide
  Seed: MPTAGMPSLL (MAGC1_HUMAN)
MGTAGMPSLV

SEQ ID NO: 89516 - protein, 9 aa, Artificial Sequence
  Description of Artificial Sequence: Synthetic peptide
  Seed: RSFSSTLLS (MAGC1_HUMAN)
RVFSSTLLK

SEQ ID NO: 89517 - protein, 10 aa, Artificial Sequence
  Description of Artificial Sequence: Synthetic peptide
  Seed: LQIPGSPSFS (MAGC1_HUMAN)
LVIPGSPSFF

SEQ ID NO: 89518 - protein, 10 aa, Artificial Sequence
  Description of Artificial Sequence: Synthetic peptide
  Seed: RKVVEFLAML (MAGC1_HUMAN)
RQVVEFLAMY

SEQ ID NO: 89519 - protein, 10 aa, Artificial Sequence
  Description of Artificial Sequence: Synthetic peptide
  Seed: SFSYTLLSLF (MAGC1_HUMAN)
SCSYTLLSLF

SEQ ID NO: 89520 - protein, 9 aa, Artificial Sequence
  Description of Artificial Sequence: Synthetic peptide
  Seed: SSPERTHST (MAGC1_HUMAN)
SPPERTHSL

SEQ ID NO: 89521 - protein, 9 aa, Artificial Sequence
  Description of Artificial Sequence: Synthetic peptide
  Seed: LQIPGSPSF (MAGC1_HUMAN)
LVIPGSPSY

SEQ ID NO: 89522 - protein, 9 aa, Artificial Sequence
  Description of Artificial Sequence: Synthetic peptide
  Seed: LARFLLLKY (MAGC1_HUMAN)
LTRFLLLKM

SEQ ID NO: 89523 - protein, 11 aa, Artificial Sequence
  Description of Artificial Sequence: Synthetic peptide
  Seed: IPVSAASSSTL (MAGC1_HUMAN)
IEVSAASSSTF

SEQ ID NO: 89524 - protein, 11 aa, Artificial Sequence
  Description of Artificial Sequence: Synthetic peptide
  Seed: RSFSSTLLSIF (MAGC1_HUMAN)
RLFSSTLLSIY

SEQ ID NO: 89525 - protein, 10 aa, Artificial Sequence
  Description of Artificial Sequence: Synthetic peptide
  Seed: TGYFPVIFRK (MAGC1_HUMAN)
TVYFPVIFRH

SEQ ID NO: 89526 - protein, 10 aa, Artificial Sequence
  Description of Artificial Sequence: Synthetic peptide
  Seed: FAFGEPRELL (MAGC1_HUMAN)
FRFGEPRELF

SEQ ID NO: 89527 - protein, 11 aa, Artificial Sequence
  Description of Artificial Sequence: Synthetic peptide
  Seed: SSSSSTLLSLF (MAGC1_HUMAN)
SWSSSTLLSLW

SEQ ID NO: 89528 - protein, 10 aa, Artificial Sequence
  Description of Artificial Sequence: Synthetic peptide
  Seed: ILILSIIFIK (MAGC1_HUMAN)
IVILSIIFIK

SEQ ID NO: 89529 - protein, 9 aa, Artificial Sequence
  Description of Artificial Sequence: Synthetic peptide
  Seed: FSSTLVSLF (MAGC1_HUMAN)
FVSTLVSLM

SEQ ID NO: 89530 - protein, 9 aa, Artificial Sequence
  Description of Artificial Sequence: Synthetic peptide
  Seed: DALKDVEER (MAGC1_HUMAN)
DYLKDVEER

SEQ ID NO: 89531 - protein, 10 aa, Artificial Sequence
  Description of Artificial Sequence: Synthetic peptide
  Seed: VSICSSSTSL (MAGC1_HUMAN)
VSICSSSTSY

SEQ ID NO: 89532 - protein, 9 aa, Artificial Sequence
  Description of Artificial Sequence: Synthetic peptide
  Seed: ASSFFSSAL (MAGC1_HUMAN)
AQSFFSSAH

SEQ ID NO: 89533 - protein, 9 aa, Artificial Sequence
  Description of Artificial Sequence: Synthetic peptide
  Seed: ALLSIFQSS (MAGC1_HUMAN)
AVLSIFQSA

SEQ ID NO: 89534 - protein, 10 aa, Artificial Sequence
  Description of Artificial Sequence: Synthetic peptide
  Seed: AASSSTLVSI (MAGC1_HUMAN)
ALSSSTLVSI

SEQ ID NO: 89535 - protein, 10 aa, Artificial Sequence
  Description of Artificial Sequence: Synthetic peptide
  Seed: RAGREHFAFG (MAGC1_HUMAN)
RAGREHFAFI

SEQ ID NO: 89536 - protein, 10 aa, Artificial Sequence
  Description of Artificial Sequence: Synthetic peptide
  Seed: SFFSYTLASL (MAGC1_HUMAN)
SWFSYTLASL

SEQ ID NO: 89537 - protein, 9 aa, Artificial Sequence
  Description of Artificial Sequence: Synthetic peptide
  Seed: ASSSTLVSI (MAGC1_HUMAN)
AMSSTLVSW

SEQ ID NO: 89538 - protein, 9 aa, Artificial Sequence
  Description of Artificial Sequence: Synthetic peptide
  Seed: AQSPLQRPV (MAGC1_HUMAN)
AYSPLQRPF

SEQ ID NO: 89539 - protein, 9 aa, Artificial Sequence
  Description of Artificial Sequence: Synthetic peptide
  Seed: LKYQVKQPI (MAGC1_HUMAN)
LNYQVKQPF

SEQ ID NO: 89540 - protein, 9 aa, Artificial Sequence
  Description of Artificial Sequence: Synthetic peptide
  Seed: SSSVMSPSF (MAGC1_HUMAN)
SMSVMSPSL

SEQ ID NO: 89541 - protein, 9 aa, Artificial Sequence
  Description of Artificial Sequence: Synthetic peptide
  Seed: ISFSSSTSL (MAGC1_HUMAN)
IRFSSSTSM

SEQ ID NO: 89542 - protein, 11 aa, Artificial Sequence
  Description of Artificial Sequence: Synthetic peptide
  Seed: SPLQIPVSPSS (MAGC1_HUMAN)
SPLQIPVSPSV

SEQ ID NO: 89543 - protein, 9 aa, Artificial Sequence
  Description of Artificial Sequence: Synthetic peptide
  Seed: MPTAGMPSL (MAGC1_HUMAN)
MHTAGMPSY

SEQ ID NO: 89544 - protein, 9 aa, Artificial Sequence
  Description of Artificial Sequence: Synthetic peptide
  Seed: DSYVFVNTL (MAGC1_HUMAN)
DRYVFVNTV

SEQ ID NO: 89545 - protein, 9 aa, Artificial Sequence
  Description of Artificial Sequence: Synthetic peptide
  Seed: YTSSSDTLL (MAGC1_HUMAN)
YQSSSDTLL

SEQ ID NO: 89546 - protein, 11 aa, Artificial Sequence
  Description of Artificial Sequence: Synthetic peptide
  Seed: ITFPSSYKDAL (MAGC1_HUMAN)
ITFPSSYKDAY

SEQ ID NO: 89547 - protein, 10 aa, Artificial Sequence
  Description of Artificial Sequence: Synthetic peptide
  Seed: TTDDSTATES (MAGC1_HUMAN)
TIDDSTATEV

SEQ ID NO: 89548 - protein, 10 aa, Artificial Sequence
  Description of Artificial Sequence: Synthetic peptide
  Seed: SRYTGYFPVI (MAGC1_HUMAN)
SNYTGYFPVI

SEQ ID NO: 89549 - protein, 9 aa, Artificial Sequence
  Description of Artificial Sequence: Synthetic peptide
  Seed: VSSFFSYTL (MAGC1_HUMAN)
VQSFFSYTH

SEQ ID NO: 89550 - protein, 10 aa, Artificial Sequence
  Description of Artificial Sequence: Synthetic peptide
  Seed: IPVSRSFSST (MAGC1_HUMAN)
IPVSRSFSSI

SEQ ID NO: 89551 - protein, 9 aa, Artificial Sequence
  Description of Artificial Sequence: Synthetic peptide
  Seed: SLPQSFPES (MAGC1_HUMAN)
SAPQSFPEV

SEQ ID NO: 89552 - protein, 9 aa, Artificial Sequence
  Description of Artificial Sequence: Synthetic peptide
  Seed: LQIPVSAAS (MAGC1_HUMAN)
LKIPVSAAY

SEQ ID NO: 89553 - protein, 10 aa, Artificial Sequence
  Description of Artificial Sequence: Synthetic peptide
  Seed: NPASSFFSSA (MAGC1_HUMAN)
NSASSFFSSV

SEQ ID NO: 89554 - protein, 10 aa, Artificial Sequence
  Description of Artificial Sequence: Synthetic peptide
  Seed: IPVSAASSST (MAGC1_HUMAN)
IPVSAASSSL

SEQ ID NO: 89555 - protein, 9 aa, Artificial Sequence
  Description of Artificial Sequence: Synthetic peptide
  Seed: IFRKAREFI (MAGC1_HUMAN)
IIRKAREFA

SEQ ID NO: 89556 - protein, 9 aa, Artificial Sequence
  Description of Artificial Sequence: Synthetic peptide
  Seed: VSPSFSSTL (MAGC1_HUMAN)
VEPSFSSTL

SEQ ID NO: 89557 - protein, 9 aa, Artificial Sequence
  Description of Artificial Sequence: Synthetic peptide
  Seed: LQIPVSSSS (MAGC1_HUMAN)
LPIPVSSSL

SEQ ID NO: 89558 - protein, 9 aa, Artificial Sequence
  Description of Artificial Sequence: Synthetic peptide
  Seed: MTSSFSSTL (MAGC1_HUMAN)
MNSSFSSTY

SEQ ID NO: 89559 - protein, 9 aa, Artificial Sequence
  Description of Artificial Sequence: Synthetic peptide
  Seed: AGREHFAFG (MAGC1_HUMAN)
AAREHFAFV

SEQ ID NO: 89560 - protein, 10 aa, Artificial Sequence
  Description of Artificial Sequence: Synthetic peptide
  Seed: SSPERTHSTF (MAGC1_HUMAN)
SSPERTHSTM

SEQ ID NO: 89561 - protein, 9 aa, Artificial Sequence
  Description of Artificial Sequence: Synthetic peptide
  Seed: VSSSSSSTL (MAGC1_HUMAN)
VTSSSSSTF

SEQ ID NO: 89562 - protein, 10 aa, Artificial Sequence
  Description of Artificial Sequence: Synthetic peptide
  Seed: GEDSQSPLQI (MAGC1_HUMAN)
GEDSQSPLQF

SEQ ID NO: 89563 - protein, 9 aa, Artificial Sequence
  Description of Artificial Sequence: Synthetic peptide
  Seed: SSFFSSALL (MAGC1_HUMAN)
SFFFSSALM

SEQ ID NO: 89564 - protein, 11 aa, Artificial Sequence
  Description of Artificial Sequence: Synthetic peptide
  Seed: SLIESEPLFTY (MAGC1_HUMAN)
SIIESEPLFTR

SEQ ID NO: 89565 - protein, 9 aa, Artificial Sequence
  Description of Artificial Sequence: Synthetic peptide
  Seed: CSSSTSLSL (MAGC1_HUMAN)
CQSSTSLSL

SEQ ID NO: 89566 - protein, 10 aa, Artificial Sequence
  Description of Artificial Sequence: Synthetic peptide
  Seed: STLLSLFQSF (MAGC1_HUMAN)
SVLLSLFQSY

SEQ ID NO: 89567 - protein, 9 aa, Artificial Sequence
  Description of Artificial Sequence: Synthetic peptide
  Seed: FLAMLKNTV (MAGC1_HUMAN)
FTAMLKNTF

SEQ ID NO: 89568 - protein, 10 aa, Artificial Sequence
  Description of Artificial Sequence: Synthetic peptide
  Seed: STPSSLPQSF (MAGC1_HUMAN)
SMPSSLPQSI

SEQ ID NO: 89569 - protein, 11 aa, Artificial Sequence
  Description of Artificial Sequence: Synthetic peptide
  Seed: QSSPESDDTLY (MAGC1_HUMAN)
QSSPESDDTLF

SEQ ID NO: 89570 - protein, 10 aa, Artificial Sequence
  Description of Artificial Sequence: Synthetic peptide
  Seed: SPLQSPVSSF (MAGC1_HUMAN)
SILQSPVSSF

SEQ ID NO: 89571 - protein, 9 aa, Artificial Sequence
  Description of Artificial Sequence: Synthetic peptide
  Seed: AMLKNTVPI (MAGC1_HUMAN)
AHLKNTVPM

SEQ ID NO: 89572 - protein, 10 aa, Artificial Sequence
  Description of Artificial Sequence: Synthetic peptide
  Seed: SSPESAQSAF (MAGC1_HUMAN)
SWPESAQSAM

SEQ ID NO: 89573 - protein, 9 aa, Artificial Sequence
  Description of Artificial Sequence: Synthetic peptide
  Seed: SSSSSSSTL (MAGC1_HUMAN)
STSSSSSTV

SEQ ID NO: 89574 - protein, 9 aa, Artificial Sequence
  Description of Artificial Sequence: Synthetic peptide
  Seed: LQIPVSPSF (MAGC1_HUMAN)
LQIPVSPSL

SEQ ID NO: 89575 - protein, 9 aa, Artificial Sequence
  Description of Artificial Sequence: Synthetic peptide
  Seed: DSYVFVNTL (MAGC1_HUMAN)
DGYVFVNTI

SEQ ID NO: 89576 - protein, 9 aa, Artificial Sequence
  Description of Artificial Sequence: Synthetic peptide
  Seed: FSSTLLSIL (MAGC1_HUMAN)
FMSTLLSIY

SEQ ID NO: 89577 - protein, 9 aa, Artificial Sequence
  Description of Artificial Sequence: Synthetic peptide
  Seed: KVVEFLAML (MAGC1_HUMAN)
KFVEFLAMY

SEQ ID NO: 89578 - protein, 11 aa, Artificial Sequence
  Description of Artificial Sequence: Synthetic peptide
  Seed: FQSSLQSPVSI (MAGC1_HUMAN)
FQSSLQSPVSM

SEQ ID NO: 89579 - protein, 9 aa, Artificial Sequence
  Description of Artificial Sequence: Synthetic peptide
  Seed: SSLSQSSPV (MAGC1_HUMAN)
STLSQSSPK

SEQ ID NO: 89580 - protein, 9 aa, Artificial Sequence
  Description of Artificial Sequence: Synthetic peptide
  Seed: IPVSAASSS (MAGC1_HUMAN)
IPVSAASSM

SEQ ID NO: 89581 - protein, 9 aa, Artificial Sequence
  Description of Artificial Sequence: Synthetic peptide
  Seed: LDEKVDELA (MAGC1_HUMAN)
LEEKVDELI

SEQ ID NO: 89582 - protein, 9 aa, Artificial Sequence
  Description of Artificial Sequence: Synthetic peptide
  Seed: FSYTLASLL (MAGC1_HUMAN)
FNYTLASLY

SEQ ID NO: 89583 - protein, 9 aa, Artificial Sequence
  Description of Artificial Sequence: Synthetic peptide
  Seed: RAGREHFAF (MAGC1_HUMAN)
RFGREHFAL

SEQ ID NO: 89584 - protein, 11 aa, Artificial Sequence
  Description of Artificial Sequence: Synthetic peptide
  Seed: IPMTSSFSSTL (MAGC1_HUMAN)
IIMTSSFSSTY

SEQ ID NO: 89585 - protein, 9 aa, Artificial Sequence
  Description of Artificial Sequence: Synthetic peptide
  Seed: GFPQSPLQI (MAGC1_HUMAN)
GYPQSPLQF

SEQ ID NO: 89586 - protein, 10 aa, Artificial Sequence
  Description of Artificial Sequence: Synthetic peptide
  Seed: LILILSIIFI (MAGC1_HUMAN)
LILILSIIFV

SEQ ID NO: 89587 - protein, 11 aa, Artificial Sequence
  Description of Artificial Sequence: Synthetic peptide
  Seed: SAASSSTLVSI (MAGC1_HUMAN)
SVASSSTLVSF

SEQ ID NO: 89588 - protein, 8 aa, Artificial Sequence
  Description of Artificial Sequence: Synthetic peptide
  Seed: LLSLFQSF (MAGC1_HUMAN)
LMSLFQSF

SEQ ID NO: 89589 - protein, 9 aa, Artificial Sequence
  Description of Artificial Sequence: Synthetic peptide
  Seed: LSDEQGMSQ (MAGC1_HUMAN)
LIDEQGMSL

SEQ ID NO: 89590 - protein, 9 aa, Artificial Sequence
  Description of Artificial Sequence: Synthetic peptide
  Seed: TLDEKVDEL (MAGC1_HUMAN)
TCDEKVDEM

SEQ ID NO: 89591 - protein, 9 aa, Artificial Sequence
  Description of Artificial Sequence: Synthetic peptide
  Seed: RPVSSFFSY (MAGC1_HUMAN)
RVVSSFFSY

SEQ ID NO: 89592 - protein, 9 aa, Artificial Sequence
  Description of Artificial Sequence: Synthetic peptide
  Seed: RTHSTFEGF (MAGC1_HUMAN)
RMHSTFEGI

SEQ ID NO: 89593 - protein, 10 aa, Artificial Sequence
  Description of Artificial Sequence: Synthetic peptide
  Seed: RPVSSFFSYT (MAGC1_HUMAN)
RSVSSFFSYV

SEQ ID NO: 89594 - protein, 9 aa, Artificial Sequence
  Description of Artificial Sequence: Synthetic peptide
  Seed: FSSALLSIF (MAGC1_HUMAN)
FSSALLSIW

SEQ ID NO: 89595 - protein, 10 aa, Artificial Sequence
  Description of Artificial Sequence: Synthetic peptide
  Seed: REFIEILFGI (MAGC1_HUMAN)
RQFIEILFGI

SEQ ID NO: 89596 - protein, 10 aa, Artificial Sequence
  Description of Artificial Sequence: Synthetic peptide
  Seed: LSLFQSFSER (MAGC1_HUMAN)
LRLFQSFSER

SEQ ID NO: 89597 - protein, 11 aa, Artificial Sequence
  Description of Artificial Sequence: Synthetic peptide
  Seed: SAASSSTLVSI (MAGC1_HUMAN)
SAASSSTLVSH

SEQ ID NO: 89598 - protein, 9 aa, Artificial Sequence
  Description of Artificial Sequence: Synthetic peptide
  Seed: SSSTLLSLF (MAGC1_HUMAN)
SGSTLLSLY

SEQ ID NO: 89599 - protein, 9 aa, Artificial Sequence
  Description of Artificial Sequence: Synthetic peptide
  Seed: SSPERTHST (MAGC1_HUMAN)
SHPERTHSF

SEQ ID NO: 89600 - protein, 9 aa, Artificial Sequence
  Description of Artificial Sequence: Synthetic peptide
  Seed: SSSTLLSLF (MAGC1_HUMAN)
SRSTLLSLF

SEQ ID NO: 89601 - protein, 10 aa, Artificial Sequence
  Description of Artificial Sequence: Synthetic peptide
  Seed: KGTYASEEVI (MAGC1_HUMAN)
KLTYASEEVF

SEQ ID NO: 89602 - protein, 9 aa, Artificial Sequence
  Description of Artificial Sequence: Synthetic peptide
  Seed: NPASSFFSS (MAGC1_HUMAN)
NPASSFFSW

SEQ ID NO: 89603 - protein, 9 aa, Artificial Sequence
  Description of Artificial Sequence: Synthetic peptide
  Seed: VSSSFSYTL (MAGC1_HUMAN)
VISSFSYTW

SEQ ID NO: 89604 - protein, 10 aa, Artificial Sequence
  Description of Artificial Sequence: Synthetic peptide
  Seed: LQIPMTSSFS (MAGC1_HUMAN)
LMIPMTSSFG

SEQ ID NO: 89605 - protein, 9 aa, Artificial Sequence
  Description of Artificial Sequence: Synthetic peptide
  Seed: FSSTLVSLF (MAGC1_HUMAN)
FESTLVSLF

SEQ ID NO: 89606 - protein, 10 aa, Artificial Sequence
  Description of Artificial Sequence: Synthetic peptide
  Seed: SRYTGYFPVI (MAGC1_HUMAN)
SHYTGYFPVA

SEQ ID NO: 89607 - protein, 9 aa, Artificial Sequence
  Description of Artificial Sequence: Synthetic peptide
  Seed: ASSFFSSAL (MAGC1_HUMAN)
AFSFFSSAV

SEQ ID NO: 89608 - protein, 9 aa, Artificial Sequence
  Description of Artificial Sequence: Synthetic peptide
  Seed: SSPPRYEFL (MAGC1_HUMAN)
SLPPRYEFV

SEQ ID NO: 89609 - protein, 10 aa, Artificial Sequence
  Description of Artificial Sequence: Synthetic peptide
  Seed: RPVSSFFSYT (MAGC1_HUMAN)
RPVSSFFSYF

SEQ ID NO: 89610 - protein, 9 aa, Artificial Sequence
  Description of Artificial Sequence: Synthetic peptide
  Seed: RTHSTFEGF (MAGC1_HUMAN)
RMHSTFEGK

SEQ ID NO: 89611 - protein, 11 aa, Artificial Sequence
  Description of Artificial Sequence: Synthetic peptide
  Seed: MSPLYFPQSPL (MAGC1_HUMAN)
MSPLYFPQSPW

SEQ ID NO: 89612 - protein, 10 aa, Artificial Sequence
  Description of Artificial Sequence: Synthetic peptide
  Seed: SSPERTHSTF (MAGC1_HUMAN)
SMPERTHSTL

SEQ ID NO: 89613 - protein, 11 aa, Artificial Sequence
  Description of Artificial Sequence: Synthetic peptide
  Seed: TESASSSVMSP (MAGC1_HUMAN)
TESASSSVMSA

SEQ ID NO: 89614 - protein, 9 aa, Artificial Sequence
  Description of Artificial Sequence: Synthetic peptide
  Seed: VSSFFSYTL (MAGC1_HUMAN)
VKSFFSYTI

SEQ ID NO: 89615 - protein, 9 aa, Artificial Sequence
  Description of Artificial Sequence: Synthetic peptide
  Seed: ESPLQSPVI (MAGC1_HUMAN)
EAPLQSPVI

SEQ ID NO: 89616 - protein, 9 aa, Artificial Sequence
  Description of Artificial Sequence: Synthetic peptide
  Seed: RYTGYFPVI (MAGC1_HUMAN)
RVTGYFPVF

SEQ ID NO: 89617 - protein, 9 aa, Artificial Sequence
  Description of Artificial Sequence: Synthetic peptide
  Seed: FFSYTLASL (MAGC1_HUMAN)
FSSYTLASI

SEQ ID NO: 89618 - protein, 10 aa, Artificial Sequence
  Description of Artificial Sequence: Synthetic peptide
  Seed: RKVVEFLAML (MAGC1_HUMAN)
RCVVEFLAML

SEQ ID NO: 89619 - protein, 10 aa, Artificial Sequence
  Description of Artificial Sequence: Synthetic peptide
  Seed: SPLQSPVISF (MAGC1_HUMAN)
SPLQSPVISM

SEQ ID NO: 89620 - protein, 11 aa, Artificial Sequence
  Description of Artificial Sequence: Synthetic peptide
  Seed: SPLQIPVSRSF (MAGC1_HUMAN)
SQLQIPVSRSY

SEQ ID NO: 89621 - protein, 9 aa, Artificial Sequence
  Description of Artificial Sequence: Synthetic peptide
  Seed: FFSSALLSI (MAGC1_HUMAN)
FASSALLSL

SEQ ID NO: 89622 - protein, 9 aa, Artificial Sequence
  Description of Artificial Sequence: Synthetic peptide
  Seed: TLLSILQSS (MAGC1_HUMAN)
TQLSILQSM

SEQ ID NO: 89623 - protein, 9 aa, Artificial Sequence
  Description of Artificial Sequence: Synthetic peptide
  Seed: NVISRYTGY (MAGC1_HUMAN)
NTISRYTGR

SEQ ID NO: 89624 - protein, 10 aa, Artificial Sequence
  Description of Artificial Sequence: Synthetic peptide
  Seed: SLSPLHFPQF (MAGC1_HUMAN)
SMSPLHFPQF

SEQ ID NO: 89625 - protein, 10 aa, Artificial Sequence
  Description of Artificial Sequence: Synthetic peptide
  Seed: WGPRAHSEVI (MAGC1_HUMAN)
WEPRAHSEVM

SEQ ID NO: 89626 - protein, 9 aa, Artificial Sequence
  Description of Artificial Sequence: Synthetic peptide
  Seed: SQSSPVSSF (MAGC1_HUMAN)
SVSSPVSSL

SEQ ID NO: 89627 - protein, 10 aa, Artificial Sequence
  Description of Artificial Sequence: Synthetic peptide
  Seed: ILFGISLREV (MAGC1_HUMAN)
IVFGISLREI

SEQ ID NO: 89628 - protein, 10 aa, Artificial Sequence
  Description of Artificial Sequence: Synthetic peptide
  Seed: FQSSLQSPVS (MAGC1_HUMAN)
FLSSLQSPVR

SEQ ID NO: 89629 - protein, 9 aa, Artificial Sequence
  Description of Artificial Sequence: Synthetic peptide
  Seed: AQSPLQIPV (MAGC1_HUMAN)
ATSPLQIPL

SEQ ID NO: 89630 - protein, 10 aa, Artificial Sequence
  Description of Artificial Sequence: Synthetic peptide
  Seed: LQIPVSSSFS (MAGC1_HUMAN)
LQIPVSSSFE

SEQ ID NO: 89631 - protein, 9 aa, Artificial Sequence
  Description of Artificial Sequence: Synthetic peptide
  Seed: LQIPMTSSF (MAGC1_HUMAN)
LGIPMTSSM

SEQ ID NO: 89632 - protein, 9 aa, Artificial Sequence
  Description of Artificial Sequence: Synthetic peptide
  Seed: FSSTLLSIL (MAGC1_HUMAN)
FTSTLLSIM

SEQ ID NO: 89633 - protein, 9 aa, Artificial Sequence
  Description of Artificial Sequence: Synthetic peptide
  Seed: YTSSSDTLL (MAGC1_HUMAN)
YISSSDTLI

SEQ ID NO: 89634 - protein, 9 aa, Artificial Sequence
  Description of Artificial Sequence: Synthetic peptide
  Seed: SSLSQSSPV (MAGC1_HUMAN)
SSLSQSSPF

SEQ ID NO: 89635 - protein, 9 aa, Artificial Sequence
  Description of Artificial Sequence: Synthetic peptide
  Seed: YTLASLLQS (MAGC1_HUMAN)
YGLASLLQV

SEQ ID NO: 89636 - protein, 9 aa, Artificial Sequence
  Description of Artificial Sequence: Synthetic peptide
  Seed: RAGREHFAF (MAGC1_HUMAN)
RWGREHFAI

SEQ ID NO: 89637 - protein, 8 aa, Artificial Sequence
  Description of Artificial Sequence: Synthetic peptide
  Seed: SERTQSTF (MAGC1_HUMAN)
SQRTQSTY

SEQ ID NO: 89638 - protein, 10 aa, Artificial Sequence
  Description of Artificial Sequence: Synthetic peptide
  Seed: LQIPVSPSFS (MAGC1_HUMAN)
LMIPVSPSFM

SEQ ID NO: 89639 - protein, 9 aa, Artificial Sequence
  Description of Artificial Sequence: Synthetic peptide
  Seed: FSSTLVSLF (MAGC1_HUMAN)
FFSTLVSLM

SEQ ID NO: 89640 - protein, 9 aa, Artificial Sequence
  Description of Artificial Sequence: Synthetic peptide
  Seed: RPVSSFFSY (MAGC1_HUMAN)
RLVSSFFSL

SEQ ID NO: 89641 - protein, 10 aa, Artificial Sequence
  Description of Artificial Sequence: Synthetic peptide
  Seed: SRYTGYFPVI (MAGC1_HUMAN)
SHYTGYFPVW

SEQ ID NO: 89642 - protein, 10 aa, Artificial Sequence
  Description of Artificial Sequence: Synthetic peptide
  Seed: SPVSICSSST (MAGC1_HUMAN)
SPVSICSSSM

SEQ ID NO: 89643 - protein, 9 aa, Artificial Sequence
  Description of Artificial Sequence: Synthetic peptide
  Seed: LQIVPSLPE (MAGC1_HUMAN)
LKIVPSLPV

SEQ ID NO: 89644 - protein, 11 aa, Artificial Sequence
  Description of Artificial Sequence: Synthetic peptide
  Seed: FQSSLQSPVSI (MAGC1_HUMAN)
FMSSLQSPVSI

SEQ ID NO: 89645 - protein, 10 aa, Artificial Sequence
  Description of Artificial Sequence: Synthetic peptide
  Seed: MPTAGMPSLL (MAGC1_HUMAN)
MQTAGMPSLI

SEQ ID NO: 89646 - protein, 10 aa, Artificial Sequence
  Description of Artificial Sequence: Synthetic peptide
  Seed: MPTAGMPSLL (MAGC1_HUMAN)
MCTAGMPSLI

SEQ ID NO: 89647 - protein, 9 aa, Artificial Sequence
  Description of Artificial Sequence: Synthetic peptide
  Seed: SSPECTQST (MAGC1_HUMAN)
SSPECTQSL

SEQ ID NO: 89648 - protein, 10 aa, Artificial Sequence
  Description of Artificial Sequence: Synthetic peptide
  Seed: MPTAGMPSLL (MAGC1_HUMAN)
MNTAGMPSLA

SEQ ID NO: 89649 - protein, 11 aa, Artificial Sequence
  Description of Artificial Sequence: Synthetic peptide
  Seed: SRSFSSTLLSI (MAGC1_HUMAN)
SPSFSSTLLSM

SEQ ID NO: 89650 - protein, 9 aa, Artificial Sequence
  Description of Artificial Sequence: Synthetic peptide
  Seed: SSPESPLQS (MAGC1_HUMAN)
SAPESPLQV

SEQ ID NO: 89651 - protein, 9 aa, Artificial Sequence
  Description of Artificial Sequence: Synthetic peptide
  Seed: VIFRKAREF (MAGC1_HUMAN)
VTFRKAREM

SEQ ID NO: 89652 - protein, 9 aa, Artificial Sequence
  Description of Artificial Sequence: Synthetic peptide
  Seed: VLQIPVSAA (MAGC1_HUMAN)
VMQIPVSAI

SEQ ID NO: 89653 - protein, 10 aa, Artificial Sequence
  Description of Artificial Sequence: Synthetic peptide
  Seed: ICSSSTPSSL (MAGC1_HUMAN)
IGSSSTPSSF

SEQ ID NO: 89654 - protein, 9 aa, Artificial Sequence
  Description of Artificial Sequence: Synthetic peptide
  Seed: VSSSFSYTL (MAGC1_HUMAN)
VYSSFSYTI

SEQ ID NO: 89655 - protein, 11 aa, Artificial Sequence
  Description of Artificial Sequence: Synthetic peptide
  Seed: LQRPVSSFFSY (MAGC1_HUMAN)
LWRPVSSFFSF

SEQ ID NO: 89656 - protein, 9 aa, Artificial Sequence
  Description of Artificial Sequence: Synthetic peptide
  Seed: FSYTLLSLF (MAGC1_HUMAN)
FRYTLLSLF

SEQ ID NO: 89657 - protein, 11 aa, Artificial Sequence
  Description of Artificial Sequence: Synthetic peptide
  Seed: FPQSPLQIPVS (MAGC1_HUMAN)
FPQSPLQIPVA

SEQ ID NO: 89658 - protein, 9 aa, Artificial Sequence
  Description of Artificial Sequence: Synthetic peptide
  Seed: AMLKNTVPI (MAGC1_HUMAN)
AVLKNTVPL

SEQ ID NO: 89659 - protein, 11 aa, Artificial Sequence
  Description of Artificial Sequence: Synthetic peptide
  Seed: SSFPSSTSSSL (MAGC1_HUMAN)
SSFPSSTSSSW

SEQ ID NO: 89660 - protein, 11 aa, Artificial Sequence
  Description of Artificial Sequence: Synthetic peptide
  Seed: LQIPVSSSFSY (MAGC1_HUMAN)
LRIPVSSSFSY

SEQ ID NO: 89661 - protein, 8 aa, Artificial Sequence
  Description of Artificial Sequence: Synthetic peptide
  Seed: LQNPASSF (MAGC1_HUMAN)
LANPASSL

SEQ ID NO: 89662 - protein, 10 aa, Artificial Sequence
  Description of Artificial Sequence: Synthetic peptide
  Seed: SLFQSFSERT (MAGC1_HUMAN)
SLFQSFSERR

SEQ ID NO: 89663 - protein, 10 aa, Artificial Sequence
  Description of Artificial Sequence: Synthetic peptide
  Seed: FFSYTLASLL (MAGC1_HUMAN)
FASYTLASLW

SEQ ID NO: 89664 - protein, 11 aa, Artificial Sequence
  Description of Artificial Sequence: Synthetic peptide
  Seed: LWGPRAHSEVI (MAGC1_HUMAN)
LLGPRAHSEVL

SEQ ID NO: 89665 - protein, 9 aa, Artificial Sequence
  Description of Artificial Sequence: Synthetic peptide
  Seed: NSSPPRYEF (MAGC1_HUMAN)
NLSPPRYEY

SEQ ID NO: 89666 - protein, 9 aa, Artificial Sequence
  Description of Artificial Sequence: Synthetic peptide
  Seed: EHFAFGEPR (MAGC1_HUMAN)
EAFAFGEPR

SEQ ID NO: 89667 - protein, 9 aa, Artificial Sequence
  Description of Artificial Sequence: Synthetic peptide
  Seed: SIIFIKGTY (MAGC1_HUMAN)
SSIFIKGTR

SEQ ID NO: 89668 - protein, 9 aa, Artificial Sequence
  Description of Artificial Sequence: Synthetic peptide
  Seed: SSPERTHST (MAGC1_HUMAN)
STPERTHSV

SEQ ID NO: 89669 - protein, 9 aa, Artificial Sequence
  Description of Artificial Sequence: Synthetic peptide
  Seed: WEDSLSPHY (MAGC1_HUMAN)
WTDSLSPHY

SEQ ID NO: 89670 - protein, 10 aa, Artificial Sequence
  Description of Artificial Sequence: Synthetic peptide
  Seed: ESEPLFTYTL (MAGC1_HUMAN)
ESEPLFTYTV

SEQ ID NO: 89671 - protein, 9 aa, Artificial Sequence
  Description of Artificial Sequence: Synthetic peptide
  Seed: SQSSPVSSF (MAGC1_HUMAN)
SFSSPVSSL

SEQ ID NO: 89672 - protein, 10 aa, Artificial Sequence
  Description of Artificial Sequence: Synthetic peptide
  Seed: MPTAGMPSLL (MAGC1_HUMAN)
MITAGMPSLL

SEQ ID NO: 89673 - protein, 9 aa, Artificial Sequence
  Description of Artificial Sequence: Synthetic peptide
  Seed: TTDDSTATE (MAGC1_HUMAN)
TLDDSTATY

SEQ ID NO: 89674 - protein, 10 aa, Artificial Sequence
  Description of Artificial Sequence: Synthetic peptide
  Seed: SFSYTLLSLF (MAGC1_HUMAN)
SNSYTLLSLF

SEQ ID NO: 89675 - protein, 10 aa, Artificial Sequence
  Description of Artificial Sequence: Synthetic peptide
  Seed: VISFSSSTSL (MAGC1_HUMAN)
VWSFSSSTSY

SEQ ID NO: 89676 - protein, 10 aa, Artificial Sequence
  Description of Artificial Sequence: Synthetic peptide
  Seed: TGYFPVIFRK (MAGC1_HUMAN)
TAYFPVIFRK

SEQ ID NO: 89677 - protein, 9 aa, Artificial Sequence
  Description of Artificial Sequence: Synthetic peptide
  Seed: SSFFSYTLA (MAGC1_HUMAN)
SQFFSYTLL

SEQ ID NO: 89678 - protein, 9 aa, Artificial Sequence
  Description of Artificial Sequence: Synthetic peptide
  Seed: MTSSFSSTL (MAGC1_HUMAN)
MMSSFSSTI

SEQ ID NO: 89679 - protein, 9 aa, Artificial Sequence
  Description of Artificial Sequence: Synthetic peptide
  Seed: TGYFPVIFR (MAGC1_HUMAN)
TYYFPVIFK

SEQ ID NO: 89680 - protein, 9 aa, Artificial Sequence
  Description of Artificial Sequence: Synthetic peptide
  Seed: RTQSTFEGF (MAGC1_HUMAN)
RLQSTFEGW

SEQ ID NO: 89681 - protein, 10 aa, Artificial Sequence
  Description of Artificial Sequence: Synthetic peptide
  Seed: ISRYTGYFPV (MAGC1_HUMAN)
ITRYTGYFPL

SEQ ID NO: 89682 - protein, 10 aa, Artificial Sequence
  Description of Artificial Sequence: Synthetic peptide
  Seed: SSSSTLLSLF (MAGC1_HUMAN)
SMSSTLLSLF

SEQ ID NO: 89683 - protein, 9 aa, Artificial Sequence
  Description of Artificial Sequence: Synthetic peptide
  Seed: FSSTLLSIL (MAGC1_HUMAN)
FHSTLLSIF

SEQ ID NO: 89684 - protein, 8 aa, Artificial Sequence
  Description of Artificial Sequence: Synthetic peptide
  Seed: SSPPRYEF (MAGC1_HUMAN)
SYPPRYEL

SEQ ID NO: 89685 - protein, 10 aa, Artificial Sequence
  Description of Artificial Sequence: Synthetic peptide
  Seed: FFSSALLSIF (MAGC1_HUMAN)
FMSSALLSIF

SEQ ID NO: 89686 - protein, 9 aa, Artificial Sequence
  Description of Artificial Sequence: Synthetic peptide
  Seed: REVDPDDSY (MAGC1_HUMAN)
RRVDPDDSM

SEQ ID NO: 89687 - protein, 9 aa, Artificial Sequence
  Description of Artificial Sequence: Synthetic peptide
  Seed: TLDEKVDEL (MAGC1_HUMAN)
TWDEKVDEY

SEQ ID NO: 89688 - protein, 11 aa, Artificial Sequence
  Description of Artificial Sequence: Synthetic peptide
  Seed: SSFPSSTSSSL (MAGC1_HUMAN)
SVFPSSTSSSH

SEQ ID NO: 89689 - protein, 11 aa, Artificial Sequence
  Description of Artificial Sequence: Synthetic peptide
  Seed: SFFSYTLASLL (MAGC1_HUMAN)
SRFSYTLASLW

SEQ ID NO: 89690 - protein, 9 aa, Artificial Sequence
  Description of Artificial Sequence: Synthetic peptide
  Seed: FPSSTSSSL (MAGC1_HUMAN)
FWSSTSSSY

SEQ ID NO: 89691 - protein, 9 aa, Artificial Sequence
  Description of Artificial Sequence: Synthetic peptide
  Seed: SSSTSLSPF (MAGC1_HUMAN)
SNSTSLSPF

SEQ ID NO: 89692 - protein, 9 aa, Artificial Sequence
  Description of Artificial Sequence: Synthetic peptide
  Seed: SICSSSTSL (MAGC1_HUMAN)
STCSSSTSF

SEQ ID NO: 89693 - protein, 9 aa, Artificial Sequence
  Description of Artificial Sequence: Synthetic peptide
  Seed: KQPITKAEM (MAGC1_HUMAN)
KYPITKAEY

SEQ ID NO: 89694 - protein, 10 aa, Artificial Sequence
  Description of Artificial Sequence: Synthetic peptide
  Seed: SILQSSPESA (MAGC1_HUMAN)
SLLQSSPESL

SEQ ID NO: 89695 - protein, 9 aa, Artificial Sequence
  Description of Artificial Sequence: Synthetic peptide
  Seed: YVFVNTLDL (MAGC1_HUMAN)
YTFVNTLDV

SEQ ID NO: 89696 - protein, 9 aa, Artificial Sequence
  Description of Artificial Sequence: Synthetic peptide
  Seed: SAPEGEDSL (MAGC1_HUMAN)
SQPEGEDSF

SEQ ID NO: 89697 - protein, 10 aa, Artificial Sequence
  Description of Artificial Sequence: Synthetic peptide
  Seed: MPTAGMPSLL (MAGC1_HUMAN)
MRTAGMPSLW

SEQ ID NO: 89698 - protein, 10 aa, Artificial Sequence
  Description of Artificial Sequence: Synthetic peptide
  Seed: ASSFFSSALL (MAGC1_HUMAN)
AISFFSSALM

SEQ ID NO: 89699 - protein, 10 aa, Artificial Sequence
  Description of Artificial Sequence: Synthetic peptide
  Seed: STPSSLPQSF (MAGC1_HUMAN)
SWPSSLPQSF

SEQ ID NO: 89700 - protein, 9 aa, Artificial Sequence
  Description of Artificial Sequence: Synthetic peptide
  Seed: SQNRLLILI (MAGC1_HUMAN)
SQNRLLILV

SEQ ID NO: 89701 - protein, 9 aa, Artificial Sequence
  Description of Artificial Sequence: Synthetic peptide
  Seed: TTDDSTATE (MAGC1_HUMAN)
TCDDSTATF

SEQ ID NO: 89702 - protein, 9 aa, Artificial Sequence
  Description of Artificial Sequence: Synthetic peptide
  Seed: SLFQSFSER (MAGC1_HUMAN)
SSFQSFSEF

SEQ ID NO: 89703 - protein, 9 aa, Artificial Sequence
  Description of Artificial Sequence: Synthetic peptide
  Seed: SSPERTQST (MAGC1_HUMAN)
SHPERTQSL

SEQ ID NO: 89704 - protein, 9 aa, Artificial Sequence
  Description of Artificial Sequence: Synthetic peptide
  Seed: LQIPVSRSF (MAGC1_HUMAN)
LQIPVSRSM

SEQ ID NO: 89705 - protein, 9 aa, Artificial Sequence
  Description of Artificial Sequence: Synthetic peptide
  Seed: LQIPVSRSF (MAGC1_HUMAN)
LTIPVSRSF

SEQ ID NO: 89706 - protein, 9 aa, Artificial Sequence
  Description of Artificial Sequence: Synthetic peptide
  Seed: IIDTTDDST (MAGC1_HUMAN)
ISDTTDDSM

SEQ ID NO: 89707 - protein, 10 aa, Artificial Sequence
  Description of Artificial Sequence: Synthetic peptide
  Seed: TTDDSTATES (MAGC1_HUMAN)
TVDDSTATEV

SEQ ID NO: 89708 - protein, 10 aa, Artificial Sequence
  Description of Artificial Sequence: Synthetic peptide
  Seed: FAFGEPRELL (MAGC1_HUMAN)
FSFGEPRELF

SEQ ID NO: 89709 - protein, 9 aa, Artificial Sequence
  Description of Artificial Sequence: Synthetic peptide
  Seed: AGREHFAFG (MAGC1_HUMAN)
ATREHFAFF

SEQ ID NO: 89710 - protein, 9 aa, Artificial Sequence
  Description of Artificial Sequence: Synthetic peptide
  Seed: RKVVEFLAM (MAGC1_HUMAN)
RAVVEFLAF

SEQ ID NO: 89711 - protein, 9 aa, Artificial Sequence
  Description of Artificial Sequence: Synthetic peptide
  Seed: SSTSSSLSK (MAGC1_HUMAN)
SSTSSSLSY

SEQ ID NO: 89712 - protein, 9 aa, Artificial Sequence
  Description of Artificial Sequence: Synthetic peptide
  Seed: LLILILSII (MAGC1_HUMAN)
LTILILSIV

SEQ ID NO: 89713 - protein, 9 aa, Artificial Sequence
  Description of Artificial Sequence: Synthetic peptide
  Seed: SLPEWEDSL (MAGC1_HUMAN)
SQPEWEDSF

SEQ ID NO: 89714 - protein, 8 aa, Artificial Sequence
  Description of Artificial Sequence: Synthetic peptide
  Seed: SSFFSSAL (MAGC1_HUMAN)
SQFFSSAF

SEQ ID NO: 89715 - protein, 9 aa, Artificial Sequence
  Description of Artificial Sequence: Synthetic peptide
  Seed: YTLASLLQS (MAGC1_HUMAN)
YALASLLQI

SEQ ID NO: 89716 - protein, 11 aa, Artificial Sequence
  Description of Artificial Sequence: Synthetic peptide
  Seed: SFFSYTLASLL (MAGC1_HUMAN)
SKFSYTLASLY

SEQ ID NO: 89717 - protein, 10 aa, Artificial Sequence
  Description of Artificial Sequence: Synthetic peptide
  Seed: YTLLSLFQSS (MAGC1_HUMAN)
YHLLSLFQSI

SEQ ID NO: 89718 - protein, 10 aa, Artificial Sequence
  Description of Artificial Sequence: Synthetic peptide
  Seed: LQIPMTSSFS (MAGC1_HUMAN)
LRIPMTSSFF

SEQ ID NO: 89719 - protein, 10 aa, Artificial Sequence
  Description of Artificial Sequence: Synthetic peptide
  Seed: YTLLSLFQSS (MAGC1_HUMAN)
YTLLSLFQSV

SEQ ID NO: 89720 - protein, 9 aa, Artificial Sequence
  Description of Artificial Sequence: Synthetic peptide
  Seed: LQIPMTSSF (MAGC1_HUMAN)
LVIPMTSSY

SEQ ID NO: 89721 - protein, 10 aa, Artificial Sequence
  Description of Artificial Sequence: Synthetic peptide
  Seed: FPSSYKDALK (MAGC1_HUMAN)
FLSSYKDALR

SEQ ID NO: 89722 - protein, 10 aa, Artificial Sequence
  Description of Artificial Sequence: Synthetic peptide
  Seed: TTDDSTATES (MAGC1_HUMAN)
TCDDSTATEV

SEQ ID NO: 89723 - protein, 9 aa, Artificial Sequence
  Description of Artificial Sequence: Synthetic peptide
  Seed: SPLQIVPSL (MAGC1_HUMAN)
SQLQIVPSM

SEQ ID NO: 89724 - protein, 9 aa, Artificial Sequence
  Description of Artificial Sequence: Synthetic peptide
  Seed: NTHSPLQIV (MAGC1_HUMAN)
NGHSPLQIY

SEQ ID NO: 89725 - protein, 9 aa, Artificial Sequence
  Description of Artificial Sequence: Synthetic peptide
  Seed: ILILSIIFI (MAGC1_HUMAN)
IMILSIIFL

SEQ ID NO: 89726 - protein, 9 aa, Artificial Sequence
  Description of Artificial Sequence: Synthetic peptide
  Seed: SSPPRYEFL (MAGC1_HUMAN)
SSPPRYEFW

SEQ ID NO: 89727 - protein, 10 aa, Artificial Sequence
  Description of Artificial Sequence: Synthetic peptide
  Seed: REVPNSSPPR (MAGC1_HUMAN)
RSVPNSSPPR

SEQ ID NO: 89728 - protein, 9 aa, Artificial Sequence
  Description of Artificial Sequence: Synthetic peptide
  Seed: FSEESSSPV (MAGC1_HUMAN)
FGEESSSPL

SEQ ID NO: 89729 - protein, 9 aa, Artificial Sequence
  Description of Artificial Sequence: Synthetic peptide
  Seed: TLLSLFQSF (MAGC1_HUMAN)
TLLSLFQSM

SEQ ID NO: 89730 - protein, 9 aa, Artificial Sequence
  Description of Artificial Sequence: Synthetic peptide
  Seed: REVDPDDSY (MAGC1_HUMAN)
RLVDPDDSI

SEQ ID NO: 89731 - protein, 10 aa, Artificial Sequence
  Description of Artificial Sequence: Synthetic peptide
  Seed: PLQIPVSSSF (MAGC1_HUMAN)
PRQIPVSSSM

SEQ ID NO: 89732 - protein, 9 aa, Artificial Sequence
  Description of Artificial Sequence: Synthetic peptide
  Seed: TLLSIFQSS (MAGC1_HUMAN)
TVLSIFQSA

SEQ ID NO: 89733 - protein, 11 aa, Artificial Sequence
  Description of Artificial Sequence: Synthetic peptide
  Seed: IPMTSSFSSTL (MAGC1_HUMAN)
ICMTSSFSSTY

SEQ ID NO: 89734 - protein, 9 aa, Artificial Sequence
  Description of Artificial Sequence: Synthetic peptide
  Seed: REHFAFGEP (MAGC1_HUMAN)
REHFAFGEM

SEQ ID NO: 89735 - protein, 9 aa, Artificial Sequence
  Description of Artificial Sequence: Synthetic peptide
  Seed: LQIPGSPSF (MAGC1_HUMAN)
LMIPGSPSM

SEQ ID NO: 89736 - protein, 9 aa, Artificial Sequence
  Description of Artificial Sequence: Synthetic peptide
  Seed: SSLSQSSPV (MAGC1_HUMAN)
SALSQSSPL

SEQ ID NO: 89737 - protein, 9 aa, Artificial Sequence
  Description of Artificial Sequence: Synthetic peptide
  Seed: NPASSFFSS (MAGC1_HUMAN)
NIASSFFSM

SEQ ID NO: 89738 - protein, 10 aa, Artificial Sequence
  Description of Artificial Sequence: Synthetic peptide
  Seed: SSPERTHSTF (MAGC1_HUMAN)
SFPERTHSTM

SEQ ID NO: 89739 - protein, 11 aa, Artificial Sequence
  Description of Artificial Sequence: Synthetic peptide
  Seed: AIIDTTDDSTA (MAGC1_HUMAN)
AMIDTTDDSTV

SEQ ID NO: 89740 - protein, 9 aa, Artificial Sequence
  Description of Artificial Sequence: Synthetic peptide
  Seed: VSPSFSSTL (MAGC1_HUMAN)
VMPSFSSTL

SEQ ID NO: 89741 - protein, 8 aa, Artificial Sequence
  Description of Artificial Sequence: Synthetic peptide
  Seed: SSSTLLSL (MAGC1_HUMAN)
SQSTLLSV

SEQ ID NO: 89742 - protein, 10 aa, Artificial Sequence
  Description of Artificial Sequence: Synthetic peptide
  Seed: AASSSTLVSI (MAGC1_HUMAN)
AVSSSTLVSI

SEQ ID NO: 89743 - protein, 9 aa, Artificial Sequence
  Description of Artificial Sequence: Synthetic peptide
  Seed: FEGFPQSVL (MAGC1_HUMAN)
FEGFPQSVV

SEQ ID NO: 89744 - protein, 9 aa, Artificial Sequence
  Description of Artificial Sequence: Synthetic peptide
  Seed: VPITFPSSY (MAGC1_HUMAN)
VAITFPSSI

SEQ ID NO: 89745 - protein, 10 aa, Artificial Sequence
  Description of Artificial Sequence: Synthetic peptide
  Seed: GENTHSPLQI (MAGC1_HUMAN)
GENTHSPLQF

SEQ ID NO: 89746 - protein, 10 aa, Artificial Sequence
  Description of Artificial Sequence: Synthetic peptide
  Seed: STLLSLFQSF (MAGC1_HUMAN)
SGLLSLFQSY

SEQ ID NO: 89747 - protein, 9 aa, Artificial Sequence
  Description of Artificial Sequence: Synthetic peptide
  Seed: SSSTLLSLF (MAGC1_HUMAN)
SFSTLLSLF

SEQ ID NO: 89748 - protein, 9 aa, Artificial Sequence
  Description of Artificial Sequence: Synthetic peptide
  Seed: SLSPFSEES (MAGC1_HUMAN)
SISPFSEEV

SEQ ID NO: 89749 - protein, 8 aa, Artificial Sequence
  Description of Artificial Sequence: Synthetic peptide
  Seed: FGISLREV (MAGC1_HUMAN)
FPISLREI

SEQ ID NO: 89750 - protein, 9 aa, Artificial Sequence
  Description of Artificial Sequence: Synthetic peptide
  Seed: WVQEHYLEY (MAGC1_HUMAN)
WHQEHYLEF

SEQ ID NO: 89751 - protein, 11 aa, Artificial Sequence
  Description of Artificial Sequence: Synthetic peptide
  Seed: SPLQIPVSSSS (MAGC1_HUMAN)
SGLQIPVSSSM

SEQ ID NO: 89752 - protein, 9 aa, Artificial Sequence
  Description of Artificial Sequence: Synthetic peptide
  Seed: RTHSTFEGF (MAGC1_HUMAN)
RKHSTFEGM

SEQ ID NO: 89753 - protein, 10 aa, Artificial Sequence
  Description of Artificial Sequence: Synthetic peptide
  Seed: VSSSFSYTLL (MAGC1_HUMAN)
VWSSFSYTLW

SEQ ID NO: 89754 - protein, 10 aa, Artificial Sequence
  Description of Artificial Sequence: Synthetic peptide
  Seed: FFSSALLSIF (MAGC1_HUMAN)
FHSSALLSIW

SEQ ID NO: 89755 - protein, 9 aa, Artificial Sequence
  Description of Artificial Sequence: Synthetic peptide
  Seed: FFSSALLSI (MAGC1_HUMAN)
FISSALLSV

SEQ ID NO: 89756 - protein, 9 aa, Artificial Sequence
  Description of Artificial Sequence: Synthetic peptide
  Seed: SPLQIVPSL (MAGC1_HUMAN)
SMLQIVPSF

SEQ ID NO: 89757 - protein, 9 aa, Artificial Sequence
  Description of Artificial Sequence: Synthetic peptide
  Seed: SSSTLVSIF (MAGC1_HUMAN)
SISTLVSIL

SEQ ID NO: 89758 - protein, 10 aa, Artificial Sequence
  Description of Artificial Sequence: Synthetic peptide
  Seed: YTLDEKVDEL (MAGC1_HUMAN)
YTLDEKVDEY

SEQ ID NO: 89759 - protein, 9 aa, Artificial Sequence
  Description of Artificial Sequence: Synthetic peptide
  Seed: FSSTLLSIL (MAGC1_HUMAN)
FPSTLLSIH

SEQ ID NO: 89760 - protein, 10 aa, Artificial Sequence
  Description of Artificial Sequence: Synthetic peptide
  Seed: EVIWDVLSGI (MAGC1_HUMAN)
EIIWDVLSGL

SEQ ID NO: 89761 - protein, 9 aa, Artificial Sequence
  Description of Artificial Sequence: Synthetic peptide
  Seed: STFEGFAQS (MAGC1_HUMAN)
SQFEGFAQS

SEQ ID NO: 89762 - protein, 10 aa, Artificial Sequence
  Description of Artificial Sequence: Synthetic peptide
  Seed: FSSSTSLSPF (MAGC1_HUMAN)
FPSSTSLSPM

SEQ ID NO: 89763 - protein, 9 aa, Artificial Sequence
  Description of Artificial Sequence: Synthetic peptide
  Seed: FPSSTSSSL (MAGC1_HUMAN)
FPSSTSSSP

SEQ ID NO: 89764 - protein, 9 aa, Artificial Sequence
  Description of Artificial Sequence: Synthetic peptide
  Seed: SPLQNPASS (MAGC1_HUMAN)
SPLQNPASL

SEQ ID NO: 89765 - protein, 10 aa, Artificial Sequence
  Description of Artificial Sequence: Synthetic peptide
  Seed: YTGYFPVIFR (MAGC1_HUMAN)
YIGYFPVIFK

SEQ ID NO: 89766 - protein, 10 aa, Artificial Sequence
  Description of Artificial Sequence: Synthetic peptide
  Seed: SSFSYTLLSL (MAGC1_HUMAN)
SIFSYTLLSV

SEQ ID NO: 89767 - protein, 9 aa, Artificial Sequence
  Description of Artificial Sequence: Synthetic peptide
  Seed: SAQSAFEGF (MAGC1_HUMAN)
SAQSAFEGM

SEQ ID NO: 89768 - protein, 9 aa, Artificial Sequence
  Description of Artificial Sequence: Synthetic peptide
  Seed: YQVKQPITK (MAGC1_HUMAN)
YRVKQPITL

SEQ ID NO: 89769 - protein, 9 aa, Artificial Sequence
  Description of Artificial Sequence: Synthetic peptide
  Seed: MGDKDMPTA (MAGC1_HUMAN)
MSDKDMPTV

SEQ ID NO: 89770 - protein, 11 aa, Artificial Sequence
  Description of Artificial Sequence: Synthetic peptide
  Seed: FLAMLKNTVPI (MAGC1_HUMAN)
FKAMLKNTVPV

SEQ ID NO: 89771 - protein, 11 aa, Artificial Sequence
  Description of Artificial Sequence: Synthetic peptide
  Seed: RPVSSFFSYTL (MAGC1_HUMAN)
RKVSSFFSYTY

SEQ ID NO: 89772 - protein, 11 aa, Artificial Sequence
  Description of Artificial Sequence: Synthetic peptide
  Seed: STFEGFPQSLL (MAGC1_HUMAN)
SLFEGFPQSLR

SEQ ID NO: 89773 - protein, 10 aa, Artificial Sequence
  Description of Artificial Sequence: Synthetic peptide
  Seed: SSFSYTLLSL (MAGC1_HUMAN)
SRFSYTLLSY

SEQ ID NO: 89774 - protein, 9 aa, Artificial Sequence
  Description of Artificial Sequence: Synthetic peptide
  Seed: SSFSSTLLS (MAGC1_HUMAN)
SAFSSTLLK

SEQ ID NO: 89775 - protein, 9 aa, Artificial Sequence
  Description of Artificial Sequence: Synthetic peptide
  Seed: SSPPRYEFL (MAGC1_HUMAN)
SSPPRYEFY

SEQ ID NO: 89776 - protein, 9 aa, Artificial Sequence
  Description of Artificial Sequence: Synthetic peptide
  Seed: SSFFSYTLA (MAGC1_HUMAN)
SVFFSYTLA

SEQ ID NO: 89777 - protein, 9 aa, Artificial Sequence
  Description of Artificial Sequence: Synthetic peptide
  Seed: RAGREHFAF (MAGC1_HUMAN)
RWGREHFAW

SEQ ID NO: 89778 - protein, 11 aa, Artificial Sequence
  Description of Artificial Sequence: Synthetic peptide
  Seed: SPEGKDSLSPL (MAGC1_HUMAN)
SPEGKDSLSPM

SEQ ID NO: 89779 - protein, 9 aa, Artificial Sequence
  Description of Artificial Sequence: Synthetic peptide
  Seed: SSSVMSPSF (MAGC1_HUMAN)
STSVMSPSF

SEQ ID NO: 89780 - protein, 10 aa, Artificial Sequence
  Description of Artificial Sequence: Synthetic peptide
  Seed: WEDSLSPHYF (MAGC1_HUMAN)
WSDSLSPHYL

SEQ ID NO: 89781 - protein, 10 aa, Artificial Sequence
  Description of Artificial Sequence: Synthetic peptide
  Seed: PLQIPGSPSF (MAGC1_HUMAN)
PWQIPGSPSF

SEQ ID NO: 89782 - protein, 10 aa, Artificial Sequence
  Description of Artificial Sequence: Synthetic peptide
  Seed: LSIIFIKGTY (MAGC1_HUMAN)
LKIIFIKGTY

SEQ ID NO: 89783 - protein, 9 aa, Artificial Sequence
  Description of Artificial Sequence: Synthetic peptide
  Seed: HFPQSPPEW (MAGC1_HUMAN)
HYPQSPPEI

SEQ ID NO: 89784 - protein, 10 aa, Artificial Sequence
  Description of Artificial Sequence: Synthetic peptide
  Seed: FSYTLLSLFQ (MAGC1_HUMAN)
FTYTLLSLFY

SEQ ID NO: 89785 - protein, 9 aa, Artificial Sequence
  Description of Artificial Sequence: Synthetic peptide
  Seed: FTYTLDEKV (MAGC1_HUMAN)
FSYTLDEKW

SEQ ID NO: 89786 - protein, 10 aa, Artificial Sequence
  Description of Artificial Sequence: Synthetic peptide
  Seed: SPLQSPVSSF (MAGC1_HUMAN)
SNLQSPVSSY

SEQ ID NO: 89787 - protein, 10 aa, Artificial Sequence
  Description of Artificial Sequence: Synthetic peptide
  Seed: YTLASLLQSS (MAGC1_HUMAN)
YILASLLQST

SEQ ID NO: 89788 - protein, 8 aa, Artificial Sequence
  Description of Artificial Sequence: Synthetic peptide
  Seed: SFFSSALL (MAGC1_HUMAN)
SYFSSALY

SEQ ID NO: 89789 - protein, 9 aa, Artificial Sequence
  Description of Artificial Sequence: Synthetic peptide
  Seed: SSHESPQSP (MAGC1_HUMAN)
SGHESPQSF

SEQ ID NO: 89790 - protein, 9 aa, Artificial Sequence
  Description of Artificial Sequence: Synthetic peptide
  Seed: LQIPVSSSS (MAGC1_HUMAN)
LYIPVSSSA

SEQ ID NO: 89791 - protein, 10 aa, Artificial Sequence
  Description of Artificial Sequence: Synthetic peptide
  Seed: MTSSFSSTLL (MAGC1_HUMAN)
MLSSFSSTLH

SEQ ID NO: 89792 - protein, 10 aa, Artificial Sequence
  Description of Artificial Sequence: Synthetic peptide
  Seed: LAMLKNTVPI (MAGC1_HUMAN)
LQMLKNTVPY

SEQ ID NO: 89793 - protein, 10 aa, Artificial Sequence
  Description of Artificial Sequence: Synthetic peptide
  Seed: MPTAGMPSLL (MAGC1_HUMAN)
MVTAGMPSLY

SEQ ID NO: 89794 - protein, 9 aa, Artificial Sequence
  Description of Artificial Sequence: Synthetic peptide
  Seed: LQNPASSFF (MAGC1_HUMAN)
LGNPASSFY

SEQ ID NO: 89795 - protein, 11 aa, Artificial Sequence
  Description of Artificial Sequence: Synthetic peptide
  Seed: SSFFSYTLASL (MAGC1_HUMAN)
SSFFSYTLASF

SEQ ID NO: 89796 - protein, 10 aa, Artificial Sequence
  Description of Artificial Sequence: Synthetic peptide
  Seed: KVDELARFLL (MAGC1_HUMAN)
KLDELARFLA

SEQ ID NO: 89797 - protein, 11 aa, Artificial Sequence
  Description of Artificial Sequence: Synthetic peptide
  Seed: SSFSSTLLSIL (MAGC1_HUMAN)
SQFSSTLLSIF

SEQ ID NO: 89798 - protein, 9 aa, Artificial Sequence
  Description of Artificial Sequence: Synthetic peptide
  Seed: SSFFSSALL (MAGC1_HUMAN)
SSFFSSALV

SEQ ID NO: 89799 - protein, 9 aa, Artificial Sequence
  Description of Artificial Sequence: Synthetic peptide
  Seed: SPESTQSPF (MAGC1_HUMAN)
SAESTQSPY

SEQ ID NO: 89800 - protein, 9 aa, Artificial Sequence
  Description of Artificial Sequence: Synthetic peptide
  Seed: SGIGVRAGR (MAGC1_HUMAN)
SAIGVRAGL

SEQ ID NO: 89801 - protein, 10 aa, Artificial Sequence
  Description of Artificial Sequence: Synthetic peptide
  Seed: SFSSTLVSLF (MAGC1_HUMAN)
SRSSTLVSLW

SEQ ID NO: 89802 - protein, 9 aa, Artificial Sequence
  Description of Artificial Sequence: Synthetic peptide
  Seed: LLILILSII (MAGC1_HUMAN)
LLILILSIV

SEQ ID NO: 89803 - protein, 9 aa, Artificial Sequence
  Description of Artificial Sequence: Synthetic peptide
  Seed: GFPQSPLQI (MAGC1_HUMAN)
GMPQSPLQL

SEQ ID NO: 89804 - protein, 9 aa, Artificial Sequence
  Description of Artificial Sequence: Synthetic peptide
  Seed: LKNTVPITF (MAGC1_HUMAN)
LSNTVPITF

SEQ ID NO: 89805 - protein, 9 aa, Artificial Sequence
  Description of Artificial Sequence: Synthetic peptide
  Seed: ASSSTLVSI (MAGC1_HUMAN)
ALSSTLVSA

SEQ ID NO: 89806 - protein, 9 aa, Artificial Sequence
  Description of Artificial Sequence: Synthetic peptide
  Seed: FSSTLVSLF (MAGC1_HUMAN)
FVSTLVSLF

SEQ ID NO: 89807 - protein, 11 aa, Artificial Sequence
  Description of Artificial Sequence: Synthetic peptide
  Seed: GEDSSDPLQRP (MAGC1_HUMAN)
GEDSSDPLQRA

SEQ ID NO: 89808 - protein, 9 aa, Artificial Sequence
  Description of Artificial Sequence: Synthetic peptide
  Seed: FFSYTLASL (MAGC1_HUMAN)
FVSYTLASA

SEQ ID NO: 89809 - protein, 10 aa, Artificial Sequence
  Description of Artificial Sequence: Synthetic peptide
  Seed: LQIPVSSSFS (MAGC1_HUMAN)
LQIPVSSSFQ

SEQ ID NO: 89810 - protein, 9 aa, Artificial Sequence
  Description of Artificial Sequence: Synthetic peptide
  Seed: FAFGEPREL (MAGC1_HUMAN)
FPFGEPRET

SEQ ID NO: 89811 - protein, 11 aa, Artificial Sequence
  Description of Artificial Sequence: Synthetic peptide
  Seed: SSFPSSTSSSL (MAGC1_HUMAN)
SPFPSSTSSSA

SEQ ID NO: 89812 - protein, 10 aa, Artificial Sequence
  Description of Artificial Sequence: Synthetic peptide
  Seed: SLSPLHFPQF (MAGC1_HUMAN)
SMSPLHFPQW

SEQ ID NO: 89813 - protein, 9 aa, Artificial Sequence
  Description of Artificial Sequence: Synthetic peptide
  Seed: TSLSLPQSF (MAGC1_HUMAN)
THLSLPQSY

SEQ ID NO: 89814 - protein, 10 aa, Artificial Sequence
  Description of Artificial Sequence: Synthetic peptide
  Seed: NPASSFFSSA (MAGC1_HUMAN)
NPASSFFSSL

SEQ ID NO: 89815 - protein, 10 aa, Artificial Sequence
  Description of Artificial Sequence: Synthetic peptide
  Seed: MPTAGMPSLL (MAGC1_HUMAN)
MSTAGMPSLV

SEQ ID NO: 89816 - protein, 9 aa, Artificial Sequence
  Description of Artificial Sequence: Synthetic peptide
  Seed: MGDKDMPTA (MAGC1_HUMAN)
MSDKDMPTL

SEQ ID NO: 89817 - protein, 9 aa, Artificial Sequence
  Description of Artificial Sequence: Synthetic peptide
  Seed: LQRPVSSFF (MAGC1_HUMAN)
LQRPVSSFW

SEQ ID NO: 89818 - protein, 10 aa, Artificial Sequence
  Description of Artificial Sequence: Synthetic peptide
  Seed: RTHSTFEGFP (MAGC1_HUMAN)
RLHSTFEGFK

SEQ ID NO: 89819 - protein, 9 aa, Artificial Sequence
  Description of Artificial Sequence: Synthetic peptide
  Seed: RTQSTFEGF (MAGC1_HUMAN)
RIQSTFEGL

SEQ ID NO: 89820 - protein, 11 aa, Artificial Sequence
  Description of Artificial Sequence: Synthetic peptide
  Seed: KVWVQEHYLEY (MAGC1_HUMAN)
KTWVQEHYLEW

SEQ ID NO: 89821 - protein, 9 aa, Artificial Sequence
  Description of Artificial Sequence: Synthetic peptide
  Seed: NTHSPLQIV (MAGC1_HUMAN)
NMHSPLQIV

SEQ ID NO: 89822 - protein, 9 aa, Artificial Sequence
  Description of Artificial Sequence: Synthetic peptide
  Seed: SRYTGYFPV (MAGC1_HUMAN)
SMYTGYFPI

SEQ ID NO: 89823 - protein, 10 aa, Artificial Sequence
  Description of Artificial Sequence: Synthetic peptide
  Seed: FSYTLLSLFQ (MAGC1_HUMAN)
FAYTLLSLFW

SEQ ID NO: 89824 - protein, 10 aa, Artificial Sequence
  Description of Artificial Sequence: Synthetic peptide
  Seed: SSPESAQSAF (MAGC1_HUMAN)
SYPESAQSAY

SEQ ID NO: 89825 - protein, 9 aa, Artificial Sequence
  Description of Artificial Sequence: Synthetic peptide
  Seed: GSPSFSSTL (MAGC1_HUMAN)
GRPSFSSTL

SEQ ID NO: 89826 - protein, 9 aa, Artificial Sequence
  Description of Artificial Sequence: Synthetic peptide
  Seed: SAASSSTLV (MAGC1_HUMAN)
SMASSSTLV

SEQ ID NO: 89827 - protein, 10 aa, Artificial Sequence
  Description of Artificial Sequence: Synthetic peptide
  Seed: ISRYTGYFPV (MAGC1_HUMAN)
IYRYTGYFPM

SEQ ID NO: 89828 - protein, 11 aa, Artificial Sequence
  Description of Artificial Sequence: Synthetic peptide
  Seed: IPMTSSFSSTL (MAGC1_HUMAN)
INMTSSFSSTF

SEQ ID NO: 89829 - protein, 9 aa, Artificial Sequence
  Description of Artificial Sequence: Synthetic peptide
  Seed: AGREHFAFG (MAGC1_HUMAN)
ALREHFAFI

SEQ ID NO: 89830 - protein, 10 aa, Artificial Sequence
  Description of Artificial Sequence: Synthetic peptide
  Seed: FAQSSLQIPV (MAGC1_HUMAN)
FSQSSLQIPY

SEQ ID NO: 89831 - protein, 10 aa, Artificial Sequence
  Description of Artificial Sequence: Synthetic peptide
  Seed: IIDTTDDSTA (MAGC1_HUMAN)
IGDTTDDSTL

SEQ ID NO: 89832 - protein, 9 aa, Artificial Sequence
  Description of Artificial Sequence: Synthetic peptide
  Seed: MPTAGMPSL (MAGC1_HUMAN)
MPTAGMPSY

SEQ ID NO: 89833 - protein, 10 aa, Artificial Sequence
  Description of Artificial Sequence: Synthetic peptide
  Seed: FQSSLQSPVS (MAGC1_HUMAN)
FISSLQSPVL

SEQ ID NO: 89834 - protein, 9 aa, Artificial Sequence
  Description of Artificial Sequence: Synthetic peptide
  Seed: YTSSSDTLL (MAGC1_HUMAN)
YASSSDTLL

SEQ ID NO: 89835 - protein, 9 aa, Artificial Sequence
  Description of Artificial Sequence: Synthetic peptide
  Seed: SSSTSLSPF (MAGC1_HUMAN)
SASTSLSPV

SEQ ID NO: 89836 - protein, 10 aa, Artificial Sequence
  Description of Artificial Sequence: Synthetic peptide
  Seed: RKAREFIEIL (MAGC1_HUMAN)
RMAREFIEIY

SEQ ID NO: 89837 - protein, 9 aa, Artificial Sequence
  Description of Artificial Sequence: Synthetic peptide
  Seed: SAQSAFEGF (MAGC1_HUMAN)
SEQSAFEGL

SEQ ID NO: 89838 - protein, 11 aa, Artificial Sequence
  Description of Artificial Sequence: Synthetic peptide
  Seed: SPLQIPVSRSF (MAGC1_HUMAN)
SVLQIPVSRSF

SEQ ID NO: 89839 - protein, 9 aa, Artificial Sequence
  Description of Artificial Sequence: Synthetic peptide
  Seed: KVDELARFL (MAGC1_HUMAN)
KLDELARFI

SEQ ID NO: 89840 - protein, 11 aa, Artificial Sequence
  Description of Artificial Sequence: Synthetic peptide
  Seed: EILFGISLREV (MAGC1_HUMAN)
EYLFGISLREV

SEQ ID NO: 89841 - protein, 9 aa, Artificial Sequence
  Description of Artificial Sequence: Synthetic peptide
  Seed: RTHSTFEGF (MAGC1_HUMAN)
RMHSTFEGW

SEQ ID NO: 89842 - protein, 9 aa, Artificial Sequence
  Description of Artificial Sequence: Synthetic peptide
  Seed: YVFVNTLDL (MAGC1_HUMAN)
YHFVNTLDM

SEQ ID NO: 89843 - protein, 9 aa, Artificial Sequence
  Description of Artificial Sequence: Synthetic peptide
  Seed: TSLSLPQSF (MAGC1_HUMAN)
TQLSLPQSY

SEQ ID NO: 89844 - protein, 8 aa, Artificial Sequence
  Description of Artificial Sequence: Synthetic peptide
  Seed: FAQSSLQI (MAGC1_HUMAN)
FAQSSLQM

SEQ ID NO: 89845 - protein, 8 aa, Artificial Sequence
  Description of Artificial Sequence: Synthetic peptide
  Seed: FSYTLASL (MAGC1_HUMAN)
FTYTLASM

SEQ ID NO: 89846 - protein, 9 aa, Artificial Sequence
  Description of Artificial Sequence: Synthetic peptide
  Seed: GSPSFSSTL (MAGC1_HUMAN)
GRPSFSSTM

SEQ ID NO: 89847 - protein, 9 aa, Artificial Sequence
  Description of Artificial Sequence: Synthetic peptide
  Seed: SQNRLLILI (MAGC1_HUMAN)
SANRLLILI

SEQ ID NO: 89848 - protein, 9 aa, Artificial Sequence
  Description of Artificial Sequence: Synthetic peptide
  Seed: YPLQSPQSR (MAGC1_HUMAN)
YALQSPQSR

SEQ ID NO: 89849 - protein, 9 aa, Artificial Sequence
  Description of Artificial Sequence: Synthetic peptide
  Seed: RKVVEFLAM (MAGC1_HUMAN)
RSVVEFLAL

SEQ ID NO: 89850 - protein, 10 aa, Artificial Sequence
  Description of Artificial Sequence: Synthetic peptide
  Seed: SSSSSSSTLL (MAGC1_HUMAN)
SRSSSSSTLW

SEQ ID NO: 89851 - protein, 9 aa, Artificial Sequence
  Description of Artificial Sequence: Synthetic peptide
  Seed: LQIPVSRSF (MAGC1_HUMAN)
LVIPVSRSM

SEQ ID NO: 89852 - protein, 9 aa, Artificial Sequence
  Description of Artificial Sequence: Synthetic peptide
  Seed: IIDTTDDST (MAGC1_HUMAN)
ITDTTDDSV

SEQ ID NO: 89853 - protein, 9 aa, Artificial Sequence
  Description of Artificial Sequence: Synthetic peptide
  Seed: FSSTLLSLF (MAGC1_HUMAN)
FMSTLLSLW

SEQ ID NO: 89854 - protein, 11 aa, Artificial Sequence
  Description of Artificial Sequence: Synthetic peptide
  Seed: SQSSPEGKDSL (MAGC1_HUMAN)
SESSPEGKDSY

SEQ ID NO: 89855 - protein, 10 aa, Artificial Sequence
  Description of Artificial Sequence: Synthetic peptide
  Seed: IPVSSSSSST (MAGC1_HUMAN)
IPVSSSSSSA

SEQ ID NO: 89856 - protein, 9 aa, Artificial Sequence
  Description of Artificial Sequence: Synthetic peptide
  Seed: SLSPHYFPQ (MAGC1_HUMAN)
SQSPHYFPK

SEQ ID NO: 89857 - protein, 10 aa, Artificial Sequence
  Description of Artificial Sequence: Synthetic peptide
  Seed: LSQSSPVSSF (MAGC1_HUMAN)
LAQSSPVSSM

SEQ ID NO: 89858 - protein, 10 aa, Artificial Sequence
  Description of Artificial Sequence: Synthetic peptide
  Seed: ASSFFSSALL (MAGC1_HUMAN)
ATSFFSSALF

SEQ ID NO: 89859 - protein, 9 aa, Artificial Sequence
  Description of Artificial Sequence: Synthetic peptide
  Seed: SSLSQSSPV (MAGC1_HUMAN)
SALSQSSPI

SEQ ID NO: 89860 - protein, 9 aa, Artificial Sequence
  Description of Artificial Sequence: Synthetic peptide
  Seed: IIDTTDDST (MAGC1_HUMAN)
ISDTTDDSI

SEQ ID NO: 89861 - protein, 10 aa, Artificial Sequence
  Description of Artificial Sequence: Synthetic peptide
  Seed: SSPECTQSTF (MAGC1_HUMAN)
SMPECTQSTM

SEQ ID NO: 89862 - protein, 9 aa, Artificial Sequence
  Description of Artificial Sequence: Synthetic peptide
  Seed: SSPPRYEFL (MAGC1_HUMAN)
STPPRYEFY

SEQ ID NO: 89863 - protein, 10 aa, Artificial Sequence
  Description of Artificial Sequence: Synthetic peptide
  Seed: RAGREHFAFG (MAGC1_HUMAN)
RSGREHFAFV

SEQ ID NO: 89864 - protein, 10 aa, Artificial Sequence
  Description of Artificial Sequence: Synthetic peptide
  Seed: SSPERTHSTF (MAGC1_HUMAN)
SHPERTHSTL

SEQ ID NO: 89865 - protein, 10 aa, Artificial Sequence
  Description of Artificial Sequence: Synthetic peptide
  Seed: KRKVVEFLAM (MAGC1_HUMAN)
KGKVVEFLAF

SEQ ID NO: 89866 - protein, 11 aa, Artificial Sequence
  Description of Artificial Sequence: Synthetic peptide
  Seed: QSSPESDDTLY (MAGC1_HUMAN)
QTSPESDDTLW

SEQ ID NO: 89867 - protein, 9 aa, Artificial Sequence
  Description of Artificial Sequence: Synthetic peptide
  Seed: FFSSALLSI (MAGC1_HUMAN)
FTSSALLSY

SEQ ID NO: 89868 - protein, 10 aa, Artificial Sequence
  Description of Artificial Sequence: Synthetic peptide
  Seed: LSQSSPVSSF (MAGC1_HUMAN)
LHQSSPVSSF

SEQ ID NO: 89869 - protein, 10 aa, Artificial Sequence
  Description of Artificial Sequence: Synthetic peptide
  Seed: VSSSSSSSTL (MAGC1_HUMAN)
VWSSSSSSTF

SEQ ID NO: 89870 - protein, 9 aa, Artificial Sequence
  Description of Artificial Sequence: Synthetic peptide
  Seed: ASSFFSSAL (MAGC1_HUMAN)
ANSFFSSAF

SEQ ID NO: 89871 - protein, 11 aa, Artificial Sequence
  Description of Artificial Sequence: Synthetic peptide
  Seed: RPVSSFFSYTL (MAGC1_HUMAN)
RDVSSFFSYTY

SEQ ID NO: 89872 - protein, 10 aa, Artificial Sequence
  Description of Artificial Sequence: Synthetic peptide
  Seed: RKVVEFLAML (MAGC1_HUMAN)
RLVVEFLAMA

SEQ ID NO: 89873 - protein, 10 aa, Artificial Sequence
  Description of Artificial Sequence: Synthetic peptide
  Seed: VISFSSSTSL (MAGC1_HUMAN)
VFSFSSSTSY

SEQ ID NO: 89874 - protein, 10 aa, Artificial Sequence
  Description of Artificial Sequence: Synthetic peptide
  Seed: ESAQSTFEGF (MAGC1_HUMAN)
EIAQSTFEGW

SEQ ID NO: 89875 - protein, 9 aa, Artificial Sequence
  Description of Artificial Sequence: Synthetic peptide
  Seed: FPQSLLQIP (MAGC1_HUMAN)
FPQSLLQIS

SEQ ID NO: 89876 - protein, 9 aa, Artificial Sequence
  Description of Artificial Sequence: Synthetic peptide
  Seed: LSDEQGMSQ (MAGC1_HUMAN)
LMDEQGMSV

SEQ ID NO: 89877 - protein, 11 aa, Artificial Sequence
  Description of Artificial Sequence: Synthetic peptide
  Seed: SFFSYTLASLL (MAGC1_HUMAN)
SKFSYTLASLW

SEQ ID NO: 89878 - protein, 9 aa, Artificial Sequence
  Description of Artificial Sequence: Synthetic peptide
  Seed: SVLQIPVSA (MAGC1_HUMAN)
SALQIPVSI

SEQ ID NO: 89879 - protein, 9 aa, Artificial Sequence
  Description of Artificial Sequence: Synthetic peptide
  Seed: YTSSSDTLL (MAGC1_HUMAN)
YVSSSDTLI

SEQ ID NO: 89880 - protein, 9 aa, Artificial Sequence
  Description of Artificial Sequence: Synthetic peptide
  Seed: RAHSEVIKR (MAGC1_HUMAN)
RAHSEVIKF

SEQ ID NO: 89881 - protein, 9 aa, Artificial Sequence
  Description of Artificial Sequence: Synthetic peptide
  Seed: MLKNTVPIT (MAGC1_HUMAN)
MMKNTVPII

SEQ ID NO: 89882 - protein, 10 aa, Artificial Sequence
  Description of Artificial Sequence: Synthetic peptide
  Seed: RSFSSTLLSI (MAGC1_HUMAN)
RQFSSTLLSV

SEQ ID NO: 89883 - protein, 10 aa, Artificial Sequence
  Description of Artificial Sequence: Synthetic peptide
  Seed: YTGYFPVIFR (MAGC1_HUMAN)
YYGYFPVIFR

SEQ ID NO: 89884 - protein, 10 aa, Artificial Sequence
  Description of Artificial Sequence: Synthetic peptide
  Seed: SPPEGPAQSP (MAGC1_HUMAN)
SPPEGPAQSV

SEQ ID NO: 89885 - protein, 10 aa, Artificial Sequence
  Description of Artificial Sequence: Synthetic peptide
  Seed: EVIWDVLSGI (MAGC1_HUMAN)
EMIWDVLSGR

SEQ ID NO: 89886 - protein, 9 aa, Artificial Sequence
  Description of Artificial Sequence: Synthetic peptide
  Seed: SMSPLYFPQ (MAGC1_HUMAN)
SMSPLYFPH

SEQ ID NO: 89887 - protein, 9 aa, Artificial Sequence
  Description of Artificial Sequence: Synthetic peptide
  Seed: ASEEVIWDV (MAGC1_HUMAN)
AMEEVIWDL

SEQ ID NO: 89888 - protein, 9 aa, Artificial Sequence
  Description of Artificial Sequence: Synthetic peptide
  Seed: IPMTSSFSS (MAGC1_HUMAN)
IVMTSSFSY

SEQ ID NO: 89889 - protein, 10 aa, Artificial Sequence
  Description of Artificial Sequence: Synthetic peptide
  Seed: SSSSSTLLSL (MAGC1_HUMAN)
SISSSTLLSI

SEQ ID NO: 89890 - protein, 11 aa, Artificial Sequence
  Description of Artificial Sequence: Synthetic peptide
  Seed: VLSGIGVRAGR (MAGC1_HUMAN)
VTSGIGVRAGK

SEQ ID NO: 89891 - protein, 11 aa, Artificial Sequence
  Description of Artificial Sequence: Synthetic peptide
  Seed: RPVSSFFSYTL (MAGC1_HUMAN)
RVVSSFFSYTW

SEQ ID NO: 89892 - protein, 9 aa, Artificial Sequence
  Description of Artificial Sequence: Synthetic peptide
  Seed: GSPSFSSTL (MAGC1_HUMAN)
GMPSFSSTF

SEQ ID NO: 89893 - protein, 9 aa, Artificial Sequence
  Description of Artificial Sequence: Synthetic peptide
  Seed: VPITFPSSY (MAGC1_HUMAN)
VMITFPSSV

SEQ ID NO: 89894 - protein, 9 aa, Artificial Sequence
  Description of Artificial Sequence: Synthetic peptide
  Seed: KQPITKAEM (MAGC1_HUMAN)
KMPITKAEY

SEQ ID NO: 89895 - protein, 10 aa, Artificial Sequence
  Description of Artificial Sequence: Synthetic peptide
  Seed: VISFSSSTSL (MAGC1_HUMAN)
VHSFSSSTSF

SEQ ID NO: 89896 - protein, 10 aa, Artificial Sequence
  Description of Artificial Sequence: Synthetic peptide
  Seed: LQRPVSSFFS (MAGC1_HUMAN)
LLRPVSSFFF

SEQ ID NO: 89897 - protein, 10 aa, Artificial Sequence
  Description of Artificial Sequence: Synthetic peptide
  Seed: VISFSSSTSL (MAGC1_HUMAN)
VESFSSSTSF

SEQ ID NO: 89898 - protein, 10 aa, Artificial Sequence
  Description of Artificial Sequence: Synthetic peptide
  Seed: YTGYFPVIFR (MAGC1_HUMAN)
YSGYFPVIFR

SEQ ID NO: 89899 - protein, 9 aa, Artificial Sequence
  Description of Artificial Sequence: Synthetic peptide
  Seed: SLPQSFPES (MAGC1_HUMAN)
SQPQSFPEI

SEQ ID NO: 89900 - protein, 9 aa, Artificial Sequence
  Description of Artificial Sequence: Synthetic peptide
  Seed: FSSTLVSLF (MAGC1_HUMAN)
FRSTLVSLV

SEQ ID NO: 89901 - protein, 11 aa, Artificial Sequence
  Description of Artificial Sequence: Synthetic peptide
  Seed: SPLQIPVSSSS (MAGC1_HUMAN)
SPLQIPVSSSM

SEQ ID NO: 89902 - protein, 10 aa, Artificial Sequence
  Description of Artificial Sequence: Synthetic peptide
  Seed: SFFSSALLSI (MAGC1_HUMAN)
SDFSSALLSF

SEQ ID NO: 89903 - protein, 9 aa, Artificial Sequence
  Description of Artificial Sequence: Synthetic peptide
  Seed: LQIPVSPSF (MAGC1_HUMAN)
LLIPVSPSF

SEQ ID NO: 89904 - protein, 9 aa, Artificial Sequence
  Description of Artificial Sequence: Synthetic peptide
  Seed: NSSPPRYEF (MAGC1_HUMAN)
NLSPPRYEF

SEQ ID NO: 89905 - protein, 10 aa, Artificial Sequence
  Description of Artificial Sequence: Synthetic peptide
  Seed: FPQSVLQIPV (MAGC1_HUMAN)
FMQSVLQIPI

SEQ ID NO: 89906 - protein, 11 aa, Artificial Sequence
  Description of Artificial Sequence: Synthetic peptide
  Seed: QSFSERTQSTF (MAGC1_HUMAN)
QVFSERTQSTW

SEQ ID NO: 89907 - protein, 9 aa, Artificial Sequence
  Description of Artificial Sequence: Synthetic peptide
  Seed: ISFSSSTSL (MAGC1_HUMAN)
IPFSSSTSM

SEQ ID NO: 89908 - protein, 9 aa, Artificial Sequence
  Description of Artificial Sequence: Synthetic peptide
  Seed: FQSSLQSPV (MAGC1_HUMAN)
FASSLQSPW

SEQ ID NO: 89909 - protein, 9 aa, Artificial Sequence
  Description of Artificial Sequence: Synthetic peptide
  Seed: MTSSFSSTL (MAGC1_HUMAN)
MRSSFSSTI

SEQ ID NO: 89910 - protein, 10 aa, Artificial Sequence
  Description of Artificial Sequence: Synthetic peptide
  Seed: VSSSFSYTLL (MAGC1_HUMAN)
VTSSFSYTLW

SEQ ID NO: 89911 - protein, 10 aa, Artificial Sequence
  Description of Artificial Sequence: Synthetic peptide
  Seed: SFPSSTSSSL (MAGC1_HUMAN)
SIPSSTSSSL

SEQ ID NO: 89912 - protein, 9 aa, Artificial Sequence
  Description of Artificial Sequence: Synthetic peptide
  Seed: SLSPFSEES (MAGC1_HUMAN)
SMSPFSEEL

SEQ ID NO: 89913 - protein, 9 aa, Artificial Sequence
  Description of Artificial Sequence: Synthetic peptide
  Seed: SASSSVMSP (MAGC1_HUMAN)
SISSSVMSF

SEQ ID NO: 89914 - protein, 9 aa, Artificial Sequence
  Description of Artificial Sequence: Synthetic peptide
  Seed: FLAMLKNTV (MAGC1_HUMAN)
FLAMLKNTI

SEQ ID NO: 89915 - protein, 10 aa, Artificial Sequence
  Description of Artificial Sequence: Synthetic peptide
  Seed: SSFSYTLLSL (MAGC1_HUMAN)
SSFSYTLLSY

SEQ ID NO: 89916 - protein, 10 aa, Artificial Sequence
  Description of Artificial Sequence: Synthetic peptide
  Seed: RAGREHFAFG (MAGC1_HUMAN)
RNGREHFAFV

SEQ ID NO: 89917 - protein, 9 aa, Artificial Sequence
  Description of Artificial Sequence: Synthetic peptide
  Seed: SSPERTHST (MAGC1_HUMAN)
SQPERTHSV

SEQ ID NO: 89918 - protein, 10 aa, Artificial Sequence
  Description of Artificial Sequence: Synthetic peptide
  Seed: SFPSSTSSSL (MAGC1_HUMAN)
SFPSSTSSSV

SEQ ID NO: 89919 - protein, 9 aa, Artificial Sequence
  Description of Artificial Sequence: Synthetic peptide
  Seed: KVDELARFL (MAGC1_HUMAN)
KTDELARFM

SEQ ID NO: 89920 - protein, 9 aa, Artificial Sequence
  Description of Artificial Sequence: Synthetic peptide
  Seed: AQSSLQIPV (MAGC1_HUMAN)
ATSSLQIPF

SEQ ID NO: 89921 - protein, 9 aa, Artificial Sequence
  Description of Artificial Sequence: Synthetic peptide
  Seed: SEPLFTYTL (MAGC1_HUMAN)
SEPLFTYTI

SEQ ID NO: 89922 - protein, 9 aa, Artificial Sequence
  Description of Artificial Sequence: Synthetic peptide
  Seed: ASSFFSSAL (MAGC1_HUMAN)
AMSFFSSAV

SEQ ID NO: 89923 - protein, 9 aa, Artificial Sequence
  Description of Artificial Sequence: Synthetic peptide
  Seed: LQIVPSLPE (MAGC1_HUMAN)
LTIVPSLPF

SEQ ID NO: 89924 - protein, 10 aa, Artificial Sequence
  Description of Artificial Sequence: Synthetic peptide
  Seed: ASSSTLVSIF (MAGC1_HUMAN)
AKSSTLVSIF

SEQ ID NO: 89925 - protein, 11 aa, Artificial Sequence
  Description of Artificial Sequence: Synthetic peptide
  Seed: QSSPESAQSAF (MAGC1_HUMAN)
QTSPESAQSAF

SEQ ID NO: 89926 - protein, 9 aa, Artificial Sequence
  Description of Artificial Sequence: Synthetic peptide
  Seed: NPASSFFSS (MAGC1_HUMAN)
NPASSFFSM

SEQ ID NO: 89927 - protein, 10 aa, Artificial Sequence
  Description of Artificial Sequence: Synthetic peptide
  Seed: TTDDSTATES (MAGC1_HUMAN)
TIDDSTATEY

SEQ ID NO: 89928 - protein, 10 aa, Artificial Sequence
  Description of Artificial Sequence: Synthetic peptide
  Seed: ASSSVMSPSF (MAGC1_HUMAN)
ARSSVMSPSW

SEQ ID NO: 89929 - protein, 9 aa, Artificial Sequence
  Description of Artificial Sequence: Synthetic peptide
  Seed: YVFVNTLDL (MAGC1_HUMAN)
YSFVNTLDF

SEQ ID NO: 89930 - protein, 11 aa, Artificial Sequence
  Description of Artificial Sequence: Synthetic peptide
  Seed: STFEGFAQSSL (MAGC1_HUMAN)
SMFEGFAQSSL

SEQ ID NO: 89931 - protein, 9 aa, Artificial Sequence
  Description of Artificial Sequence: Synthetic peptide
  Seed: FPSSYKDAL (MAGC1_HUMAN)
FHSSYKDAL

SEQ ID NO: 89932 - protein, 10 aa, Artificial Sequence
  Description of Artificial Sequence: Synthetic peptide
  Seed: FPQSLLQIPM (MAGC1_HUMAN)
FAQSLLQIPM

SEQ ID NO: 89933 - protein, 10 aa, Artificial Sequence
  Description of Artificial Sequence: Synthetic peptide
  Seed: ASSSVMSPSF (MAGC1_HUMAN)
ASSSVMSPSW

SEQ ID NO: 89934 - protein, 9 aa, Artificial Sequence
  Description of Artificial Sequence: Synthetic peptide
  Seed: SPLQRPVSS (MAGC1_HUMAN)
SVLQRPVSL

SEQ ID NO: 89935 - protein, 10 aa, Artificial Sequence
  Description of Artificial Sequence: Synthetic peptide
  Seed: KAREFIEILF (MAGC1_HUMAN)
KTREFIEILI

SEQ ID NO: 89936 - protein, 8 aa, Artificial Sequence
  Description of Artificial Sequence: Synthetic peptide
  Seed: SSFFSSAL (MAGC1_HUMAN)
SSFFSSAW

SEQ ID NO: 89937 - protein, 11 aa, Artificial Sequence
  Description of Artificial Sequence: Synthetic peptide
  Seed: IPVSRSFSSTL (MAGC1_HUMAN)
IMVSRSFSSTY

SEQ ID NO: 89938 - protein, 10 aa, Artificial Sequence
  Description of Artificial Sequence: Synthetic peptide
  Seed: KAREFIEILF (MAGC1_HUMAN)
KTREFIEILV

SEQ ID NO: 89939 - protein, 11 aa, Artificial Sequence
  Description of Artificial Sequence: Synthetic peptide
  Seed: TLDEKVDELAR (MAGC1_HUMAN)
TADEKVDELAL

SEQ ID NO: 89940 - protein, 10 aa, Artificial Sequence
  Description of Artificial Sequence: Synthetic peptide
  Seed: ASSSVMSPSF (MAGC1_HUMAN)
ALSSVMSPSF

SEQ ID NO: 89941 - protein, 10 aa, Artificial Sequence
  Description of Artificial Sequence: Synthetic peptide
  Seed: DELARFLLLK (MAGC1_HUMAN)
DALARFLLLR

SEQ ID NO: 89942 - protein, 10 aa, Artificial Sequence
  Description of Artificial Sequence: Synthetic peptide
  Seed: LQIPMTSSFS (MAGC1_HUMAN)
LRIPMTSSFY

SEQ ID NO: 89943 - protein, 9 aa, Artificial Sequence
  Description of Artificial Sequence: Synthetic peptide
  Seed: WVQEHYLEY (MAGC1_HUMAN)
WPQEHYLEH

SEQ ID NO: 89944 - protein, 10 aa, Artificial Sequence
  Description of Artificial Sequence: Synthetic peptide
  Seed: YTLASLLQSS (MAGC1_HUMAN)
YSLASLLQSM

SEQ ID NO: 89945 - protein, 10 aa, Artificial Sequence
  Description of Artificial Sequence: Synthetic peptide
  Seed: SSSSTLLSLF (MAGC1_HUMAN)
SVSSTLLSLW

SEQ ID NO: 89946 - protein, 9 aa, Artificial Sequence
  Description of Artificial Sequence: Synthetic peptide
  Seed: TLDEKVDEL (MAGC1_HUMAN)
TLDEKVDEI

SEQ ID NO: 89947 - protein, 9 aa, Artificial Sequence
  Description of Artificial Sequence: Synthetic peptide
  Seed: LSDEQGMSQ (MAGC1_HUMAN)
LIDEQGMSM

SEQ ID NO: 89948 - protein, 8 aa, Artificial Sequence
  Description of Artificial Sequence: Synthetic peptide
  Seed: ITFPSSYK (MAGC1_HUMAN)
IFFPSSYR

SEQ ID NO: 89949 - protein, 9 aa, Artificial Sequence
  Description of Artificial Sequence: Synthetic peptide
  Seed: FEGFPQSLL (MAGC1_HUMAN)
FEGFPQSLI

SEQ ID NO: 89950 - protein, 8 aa, Artificial Sequence
  Description of Artificial Sequence: Synthetic peptide
  Seed: IFRKAREF (MAGC1_HUMAN)
IYRKAREF

SEQ ID NO: 89951 - protein, 10 aa, Artificial Sequence
  Description of Artificial Sequence: Synthetic peptide
  Seed: WEDSLSPHYF (MAGC1_HUMAN)
WGDSLSPHYL

SEQ ID NO: 89952 - protein, 10 aa, Artificial Sequence
  Description of Artificial Sequence: Synthetic peptide
  Seed: SLSPLHFPQF (MAGC1_HUMAN)
SYSPLHFPQV

SEQ ID NO: 89953 - protein, 10 aa, Artificial Sequence
  Description of Artificial Sequence: Synthetic peptide
  Seed: MSQNRLLILI (MAGC1_HUMAN)
MIQNRLLILV

SEQ ID NO: 89954 - protein, 9 aa, Artificial Sequence
  Description of Artificial Sequence: Synthetic peptide
  Seed: SSSSSSTLL (MAGC1_HUMAN)
SISSSSTLF

SEQ ID NO: 89955 - protein, 9 aa, Artificial Sequence
  Description of Artificial Sequence: Synthetic peptide
  Seed: TTDDSTATE (MAGC1_HUMAN)
TEDDSTATM

SEQ ID NO: 89956 - protein, 10 aa, Artificial Sequence
  Description of Artificial Sequence: Synthetic peptide
  Seed: SFSSTLVSLF (MAGC1_HUMAN)
SWSSTLVSLY

SEQ ID NO: 89957 - protein, 9 aa, Artificial Sequence
  Description of Artificial Sequence: Synthetic peptide
  Seed: SSSTLLSLF (MAGC1_HUMAN)
SSSTLLSLL

SEQ ID NO: 89958 - protein, 9 aa, Artificial Sequence
  Description of Artificial Sequence: Synthetic peptide
  Seed: TLLSLFQSF (MAGC1_HUMAN)
TRLSLFQSL

SEQ ID NO: 89959 - protein, 9 aa, Artificial Sequence
  Description of Artificial Sequence: Synthetic peptide
  Seed: FSERTQSTF (MAGC1_HUMAN)
FVERTQSTY

SEQ ID NO: 89960 - protein, 9 aa, Artificial Sequence
  Description of Artificial Sequence: Synthetic peptide
  Seed: KAREFIEIL (MAGC1_HUMAN)
KGREFIEIK

SEQ ID NO: 89961 - protein, 9 aa, Artificial Sequence
  Description of Artificial Sequence: Synthetic peptide
  Seed: SSFSSTLLS (MAGC1_HUMAN)
SMFSSTLLK

SEQ ID NO: 89962 - protein, 10 aa, Artificial Sequence
  Description of Artificial Sequence: Synthetic peptide
  Seed: STPSSLPQSF (MAGC1_HUMAN)
SKPSSLPQSL

SEQ ID NO: 89963 - protein, 9 aa, Artificial Sequence
  Description of Artificial Sequence: Synthetic peptide
  Seed: VSRSFSSTL (MAGC1_HUMAN)
VPRSFSSTM

SEQ ID NO: 89964 - protein, 10 aa, Artificial Sequence
  Description of Artificial Sequence: Synthetic peptide
  Seed: SSPERTHSTF (MAGC1_HUMAN)
SWPERTHSTF

SEQ ID NO: 89965 - protein, 10 aa, Artificial Sequence
  Description of Artificial Sequence: Synthetic peptide
  Seed: SPLQIPQSSP (MAGC1_HUMAN)
SPLQIPQSSA

SEQ ID NO: 89966 - protein, 10 aa, Artificial Sequence
  Description of Artificial Sequence: Synthetic peptide
  Seed: FFSYTLASLL (MAGC1_HUMAN)
FPSYTLASLF

SEQ ID NO: 89967 - protein, 11 aa, Artificial Sequence
  Description of Artificial Sequence: Synthetic peptide
  Seed: SPLQIPVSPSS (MAGC1_HUMAN)
SPLQIPVSPSY

SEQ ID NO: 89968 - protein, 11 aa, Artificial Sequence
  Description of Artificial Sequence: Synthetic peptide
  Seed: SSSFSYTLLSL (MAGC1_HUMAN)
SSSFSYTLLSY

SEQ ID NO: 89969 - protein, 9 aa, Artificial Sequence
  Description of Artificial Sequence: Synthetic peptide
  Seed: TSSFSSTLL (MAGC1_HUMAN)
TSSFSSTLV

SEQ ID NO: 89970 - protein, 9 aa, Artificial Sequence
  Description of Artificial Sequence: Synthetic peptide
  Seed: FSSALLSIF (MAGC1_HUMAN)
FPSALLSIT

SEQ ID NO: 89971 - protein, 9 aa, Artificial Sequence
  Description of Artificial Sequence: Synthetic peptide
  Seed: LQIPVSAAS (MAGC1_HUMAN)
LAIPVSAAM

SEQ ID NO: 89972 - protein, 9 aa, Artificial Sequence
  Description of Artificial Sequence: Synthetic peptide
  Seed: SFPSSTSSS (MAGC1_HUMAN)
SHPSSTSSF

SEQ ID NO: 89973 - protein, 10 aa, Artificial Sequence
  Description of Artificial Sequence: Synthetic peptide
  Seed: LQIPMTSSFS (MAGC1_HUMAN)
LAIPMTSSFF

SEQ ID NO: 89974 - protein, 9 aa, Artificial Sequence
  Description of Artificial Sequence: Synthetic peptide
  Seed: MGDKDMPTA (MAGC1_HUMAN)
MNDKDMPTM

SEQ ID NO: 89975 - protein, 8 aa, Artificial Sequence
  Description of Artificial Sequence: Synthetic peptide
  Seed: LTDSESLI (MAGC1_HUMAN)
LSDSESLM

SEQ ID NO: 89976 - protein, 9 aa, Artificial Sequence
  Description of Artificial Sequence: Synthetic peptide
  Seed: SAQSAFEGF (MAGC1_HUMAN)
SQQSAFEGF

SEQ ID NO: 89977 - protein, 10 aa, Artificial Sequence
  Description of Artificial Sequence: Synthetic peptide
  Seed: EILFGISLRE (MAGC1_HUMAN)
ENLFGISLRK

SEQ ID NO: 89978 - protein, 10 aa, Artificial Sequence
  Description of Artificial Sequence: Synthetic peptide
  Seed: RSFSSTLLSI (MAGC1_HUMAN)
RLFSSTLLSK

SEQ ID NO: 89979 - protein, 10 aa, Artificial Sequence
  Description of Artificial Sequence: Synthetic peptide
  Seed: VSSSSSSSTL (MAGC1_HUMAN)
VTSSSSSSTW

SEQ ID NO: 89980 - protein, 9 aa, Artificial Sequence
  Description of Artificial Sequence: Synthetic peptide
  Seed: SLSPFSEES (MAGC1_HUMAN)
SMSPFSEEI

SEQ ID NO: 89981 - protein, 9 aa, Artificial Sequence
  Description of Artificial Sequence: Synthetic peptide
  Seed: LKYQVKQPI (MAGC1_HUMAN)
LQYQVKQPA

SEQ ID NO: 89982 - protein, 10 aa, Artificial Sequence
  Description of Artificial Sequence: Synthetic peptide
  Seed: LTKVWVQEHY (MAGC1_HUMAN)
LGKVWVQEHW

SEQ ID NO: 89983 - protein, 9 aa, Artificial Sequence
  Description of Artificial Sequence: Synthetic peptide
  Seed: SIFQSSPER (MAGC1_HUMAN)
SMFQSSPEK

SEQ ID NO: 89984 - protein, 9 aa, Artificial Sequence
  Description of Artificial Sequence: Synthetic peptide
  Seed: FQSSLQSPV (MAGC1_HUMAN)
FLSSLQSPY

SEQ ID NO: 89985 - protein, 9 aa, Artificial Sequence
  Description of Artificial Sequence: Synthetic peptide
  Seed: RPVSSFFSY (MAGC1_HUMAN)
RGVSSFFSY

SEQ ID NO: 89986 - protein, 9 aa, Artificial Sequence
  Description of Artificial Sequence: Synthetic peptide
  Seed: AGREHFAFG (MAGC1_HUMAN)
AQREHFAFK

SEQ ID NO: 89987 - protein, 9 aa, Artificial Sequence
  Description of Artificial Sequence: Synthetic peptide
  Seed: FTYTLDEKV (MAGC1_HUMAN)
FLYTLDEKM

SEQ ID NO: 89988 - protein, 10 aa, Artificial Sequence
  Description of Artificial Sequence: Synthetic peptide
  Seed: FLAMLKNTVP (MAGC1_HUMAN)
FLAMLKNTVQ

SEQ ID NO: 89989 - protein, 9 aa, Artificial Sequence
  Description of Artificial Sequence: Synthetic peptide
  Seed: ISFSSSTSL (MAGC1_HUMAN)
IYFSSSTSF

SEQ ID NO: 89990 - protein, 9 aa, Artificial Sequence
  Description of Artificial Sequence: Synthetic peptide
  Seed: VQEHYLEYR (MAGC1_HUMAN)
VMEHYLEYR

SEQ ID NO: 89991 - protein, 10 aa, Artificial Sequence
  Description of Artificial Sequence: Synthetic peptide
  Seed: SRYTGYFPVI (MAGC1_HUMAN)
SSYTGYFPVF

SEQ ID NO: 89992 - protein, 10 aa, Artificial Sequence
  Description of Artificial Sequence: Synthetic peptide
  Seed: YVFVNTLDLT (MAGC1_HUMAN)
YVFVNTLDLA

SEQ ID NO: 89993 - protein, 9 aa, Artificial Sequence
  Description of Artificial Sequence: Synthetic peptide
  Seed: MSQNRLLIL (MAGC1_HUMAN)
MIQNRLLIF

SEQ ID NO: 89994 - protein, 10 aa, Artificial Sequence
  Description of Artificial Sequence: Synthetic peptide
  Seed: VISFSSSTSL (MAGC1_HUMAN)
VCSFSSSTSM

SEQ ID NO: 89995 - protein, 10 aa, Artificial Sequence
  Description of Artificial Sequence: Synthetic peptide
  Seed: SFSSTLLSIF (MAGC1_HUMAN)
SMSSTLLSIY

SEQ ID NO: 89996 - protein, 10 aa, Artificial Sequence
  Description of Artificial Sequence: Synthetic peptide
  Seed: FPQSLLQIPM (MAGC1_HUMAN)
FLQSLLQIPA

SEQ ID NO: 89997 - protein, 9 aa, Artificial Sequence
  Description of Artificial Sequence: Synthetic peptide
  Seed: MTSSFSSTL (MAGC1_HUMAN)
MPSSFSSTT

SEQ ID NO: 89998 - protein, 9 aa, Artificial Sequence
  Description of Artificial Sequence: Synthetic peptide
  Seed: KQPITKAEM (MAGC1_HUMAN)
KIPITKAEL

SEQ ID NO: 89999 - protein, 10 aa, Artificial Sequence
  Description of Artificial Sequence: Synthetic peptide
  Seed: LQIPVSPSFS (MAGC1_HUMAN)
LQIPVSPSFL

SEQ ID NO: 90000 - protein, 9 aa, Artificial Sequence
  Description of Artificial Sequence: Synthetic peptide
  Seed: VIWDVLSGI (MAGC1_HUMAN)
VAWDVLSGR

SEQ ID NO: 90001 - protein, 9 aa, Artificial Sequence
  Description of Artificial Sequence: Synthetic peptide
  Seed: HFPQSPPEW (MAGC1_HUMAN)
HQPQSPPEM

SEQ ID NO: 90002 - protein, 10 aa, Artificial Sequence
  Description of Artificial Sequence: Synthetic peptide
  Seed: MLKNTVPITF (MAGC1_HUMAN)
MAKNTVPITY

SEQ ID NO: 90003 - protein, 10 aa, Artificial Sequence
  Description of Artificial Sequence: Synthetic peptide
  Seed: SSPECTQSTF (MAGC1_HUMAN)
SMPECTQSTL

SEQ ID NO: 90004 - protein, 10 aa, Artificial Sequence
  Description of Artificial Sequence: Synthetic peptide
  Seed: YTLLSLFQSS (MAGC1_HUMAN)
YLLLSLFQSV

SEQ ID NO: 90005 - protein, 9 aa, Artificial Sequence
  Description of Artificial Sequence: Synthetic peptide
  Seed: FSSTLVSLF (MAGC1_HUMAN)
FQSTLVSLV

SEQ ID NO: 90006 - protein, 9 aa, Artificial Sequence
  Description of Artificial Sequence: Synthetic peptide
  Seed: VSSSFSYTL (MAGC1_HUMAN)
VWSSFSYTY

SEQ ID NO: 90007 - protein, 8 aa, Artificial Sequence
  Description of Artificial Sequence: Synthetic peptide
  Seed: RSFSSTLL (MAGC1_HUMAN)
RIFSSTLW

SEQ ID NO: 90008 - protein, 9 aa, Artificial Sequence
  Description of Artificial Sequence: Synthetic peptide
  Seed: TSLSLPQSF (MAGC1_HUMAN)
TSLSLPQSW

SEQ ID NO: 90009 - protein, 10 aa, Artificial Sequence
  Description of Artificial Sequence: Synthetic peptide
  Seed: AMLKNTVPIT (MAGC1_HUMAN)
AMLKNTVPIL

SEQ ID NO: 90010 - protein, 9 aa, Artificial Sequence
  Description of Artificial Sequence: Synthetic peptide
  Seed: VSSSFSYTL (MAGC1_HUMAN)
VQSSFSYTM

SEQ ID NO: 90011 - protein, 9 aa, Artificial Sequence
  Description of Artificial Sequence: Synthetic peptide
  Seed: SPPQGEDSL (MAGC1_HUMAN)
SLPQGEDSL

SEQ ID NO: 90012 - protein, 9 aa, Artificial Sequence
  Description of Artificial Sequence: Synthetic peptide
  Seed: SQSSPVSSF (MAGC1_HUMAN)
SESSPVSSM

SEQ ID NO: 90013 - protein, 9 aa, Artificial Sequence
  Description of Artificial Sequence: Synthetic peptide
  Seed: LQIPMTSSF (MAGC1_HUMAN)
LRIPMTSSI

SEQ ID NO: 90014 - protein, 10 aa, Artificial Sequence
  Description of Artificial Sequence: Synthetic peptide
  Seed: GEDSSDPLQR (MAGC1_HUMAN)
GEDSSDPLQW

SEQ ID NO: 90015 - protein, 11 aa, Artificial Sequence
  Description of Artificial Sequence: Synthetic peptide
  Seed: RSFSSTLLSIF (MAGC1_HUMAN)
RRFSSTLLSIW

SEQ ID NO: 90016 - protein, 11 aa, Artificial Sequence
  Description of Artificial Sequence: Synthetic peptide
  Seed: SLREVDPDDSY (MAGC1_HUMAN)
SAREVDPDDSY

SEQ ID NO: 90017 - protein, 10 aa, Artificial Sequence
  Description of Artificial Sequence: Synthetic peptide
  Seed: YTLASLLQSS (MAGC1_HUMAN)
YALASLLQSL

SEQ ID NO: 90018 - protein, 9 aa, Artificial Sequence
  Description of Artificial Sequence: Synthetic peptide
  Seed: TLDEKVDEL (MAGC1_HUMAN)
TFDEKVDEL

SEQ ID NO: 90019 - protein, 10 aa, Artificial Sequence
  Description of Artificial Sequence: Synthetic peptide
  Seed: FSSSTSLSPF (MAGC1_HUMAN)
FYSSTSLSPF

SEQ ID NO: 90020 - protein, 10 aa, Artificial Sequence
  Description of Artificial Sequence: Synthetic peptide
  Seed: FFSYTLASLL (MAGC1_HUMAN)
FLSYTLASLE

SEQ ID NO: 90021 - protein, 9 aa, Artificial Sequence
  Description of Artificial Sequence: Synthetic peptide
  Seed: VSSFFSYTL (MAGC1_HUMAN)
VISFFSYTV

SEQ ID NO: 90022 - protein, 9 aa, Artificial Sequence
  Description of Artificial Sequence: Synthetic peptide
  Seed: GSPSFSSTL (MAGC1_HUMAN)
GCPSFSSTL

SEQ ID NO: 90023 - protein, 10 aa, Artificial Sequence
  Description of Artificial Sequence: Synthetic peptide
  Seed: KVVEFLAMLK (MAGC1_HUMAN)
KQVEFLAMLI

SEQ ID NO: 90024 - protein, 10 aa, Artificial Sequence
  Description of Artificial Sequence: Synthetic peptide
  Seed: LQIPMTSSFS (MAGC1_HUMAN)
LQIPMTSSFC

SEQ ID NO: 90025 - protein, 9 aa, Artificial Sequence
  Description of Artificial Sequence: Synthetic peptide
  Seed: FLAMLKNTV (MAGC1_HUMAN)
FIAMLKNTV

SEQ ID NO: 90026 - protein, 10 aa, Artificial Sequence
  Description of Artificial Sequence: Synthetic peptide
  Seed: TTDDSTATES (MAGC1_HUMAN)
TWDDSTATEF

SEQ ID NO: 90027 - protein, 10 aa, Artificial Sequence
  Description of Artificial Sequence: Synthetic peptide
  Seed: SFSYTLLSLF (MAGC1_HUMAN)
SGSYTLLSLW

SEQ ID NO: 90028 - protein, 10 aa, Artificial Sequence
  Description of Artificial Sequence: Synthetic peptide
  Seed: VISFSSSTSL (MAGC1_HUMAN)
VCSFSSSTSF

SEQ ID NO: 90029 - protein, 10 aa, Artificial Sequence
  Description of Artificial Sequence: Synthetic peptide
  Seed: FQSSLQSPVS (MAGC1_HUMAN)
FMSSLQSPVK

SEQ ID NO: 90030 - protein, 10 aa, Artificial Sequence
  Description of Artificial Sequence: Synthetic peptide
  Seed: REFIEILFGI (MAGC1_HUMAN)
RIFIEILFGF

SEQ ID NO: 90031 - protein, 11 aa, Artificial Sequence
  Description of Artificial Sequence: Synthetic peptide
  Seed: SEVIKRKVVEF (MAGC1_HUMAN)
SEVIKRKVVEY

SEQ ID NO: 90032 - protein, 9 aa, Artificial Sequence
  Description of Artificial Sequence: Synthetic peptide
  Seed: VSSFFSYTL (MAGC1_HUMAN)
VESFFSYTY

SEQ ID NO: 90033 - protein, 9 aa, Artificial Sequence
  Description of Artificial Sequence: Synthetic peptide
  Seed: MTSSFSSTL (MAGC1_HUMAN)
MFSSFSSTW

SEQ ID NO: 90034 - protein, 9 aa, Artificial Sequence
  Description of Artificial Sequence: Synthetic peptide
  Seed: GFPQSPLQI (MAGC1_HUMAN)
GLPQSPLQL

SEQ ID NO: 90035 - protein, 9 aa, Artificial Sequence
  Description of Artificial Sequence: Synthetic peptide
  Seed: SPLQRPVSS (MAGC1_HUMAN)
SILQRPVSL

SEQ ID NO: 90036 - protein, 9 aa, Artificial Sequence
  Description of Artificial Sequence: Synthetic peptide
  Seed: VSPSFSSTL (MAGC1_HUMAN)
VQPSFSSTY

SEQ ID NO: 90037 - protein, 11 aa, Artificial Sequence
  Description of Artificial Sequence: Synthetic peptide
  Seed: IPVSSSSSSTL (MAGC1_HUMAN)
IPVSSSSSSTY

SEQ ID NO: 90038 - protein, 11 aa, Artificial Sequence
  Description of Artificial Sequence: Synthetic peptide
  Seed: RSFSSTLLSIF (MAGC1_HUMAN)
RSFSSTLLSII

SEQ ID NO: 90039 - protein, 8 aa, Artificial Sequence
  Description of Artificial Sequence: Synthetic peptide
  Seed: SPLQRPVS (MAGC1_HUMAN)
SPLQRPVA

SEQ ID NO: 90040 - protein, 9 aa, Artificial Sequence
  Description of Artificial Sequence: Synthetic peptide
  Seed: IIDTTDDST (MAGC1_HUMAN)
ITDTTDDSM

SEQ ID NO: 90041 - protein, 11 aa, Artificial Sequence
  Description of Artificial Sequence: Synthetic peptide
  Seed: QSSPESAQSAF (MAGC1_HUMAN)
QQSPESAQSAL

SEQ ID NO: 90042 - protein, 9 aa, Artificial Sequence
  Description of Artificial Sequence: Synthetic peptide
  Seed: SQSSPVSSF (MAGC1_HUMAN)
SQSSPVSSY

SEQ ID NO: 90043 - protein, 10 aa, Artificial Sequence
  Description of Artificial Sequence: Synthetic peptide
  Seed: SSFSSTLLSI (MAGC1_HUMAN)
SCFSSTLLSW

SEQ ID NO: 90044 - protein, 9 aa, Artificial Sequence
  Description of Artificial Sequence: Synthetic peptide
  Seed: VIWDVLSGI (MAGC1_HUMAN)
VQWDVLSGM

SEQ ID NO: 90045 - protein, 9 aa, Artificial Sequence
  Description of Artificial Sequence: Synthetic peptide
  Seed: SSPPRYEFL (MAGC1_HUMAN)
SFPPRYEFY

SEQ ID NO: 90046 - protein, 11 aa, Artificial Sequence
  Description of Artificial Sequence: Synthetic peptide
  Seed: RSFSSTLLSIF (MAGC1_HUMAN)
RRFSSTLLSIF

SEQ ID NO: 90047 - protein, 10 aa, Artificial Sequence
  Description of Artificial Sequence: Synthetic peptide
  Seed: TTDDSTATES (MAGC1_HUMAN)
TLDDSTATEY

SEQ ID NO: 90048 - protein, 10 aa, Artificial Sequence
  Description of Artificial Sequence: Synthetic peptide
  Seed: SPLYFPQSPL (MAGC1_HUMAN)
SSLYFPQSPV

SEQ ID NO: 90049 - protein, 9 aa, Artificial Sequence
  Description of Artificial Sequence: Synthetic peptide
  Seed: LSDEQGMSQ (MAGC1_HUMAN)
LWDEQGMSF

SEQ ID NO: 90050 - protein, 11 aa, Artificial Sequence
  Description of Artificial Sequence: Synthetic peptide
  Seed: SFFSYTLASLL (MAGC1_HUMAN)
SNFSYTLASLW

SEQ ID NO: 90051 - protein, 11 aa, Artificial Sequence
  Description of Artificial Sequence: Synthetic peptide
  Seed: SLIESEPLFTY (MAGC1_HUMAN)
SMIESEPLFTL

SEQ ID NO: 90052 - protein, 9 aa, Artificial Sequence
  Description of Artificial Sequence: Synthetic peptide
  Seed: SSPESTQSP (MAGC1_HUMAN)
SGPESTQSV

SEQ ID NO: 90053 - protein, 10 aa, Artificial Sequence
  Description of Artificial Sequence: Synthetic peptide
  Seed: LLQIPMTSSF (MAGC1_HUMAN)
LKQIPMTSSL

SEQ ID NO: 90054 - protein, 11 aa, Artificial Sequence
  Description of Artificial Sequence: Synthetic peptide
  Seed: NTVPITFPSSY (MAGC1_HUMAN)
NAVPITFPSSW

SEQ ID NO: 90055 - protein, 11 aa, Artificial Sequence
  Description of Artificial Sequence: Synthetic peptide
  Seed: KDMPTAGMPSL (MAGC1_HUMAN)
KEMPTAGMPSI

SEQ ID NO: 90056 - protein, 10 aa, Artificial Sequence
  Description of Artificial Sequence: Synthetic peptide
  Seed: MSQNRLLILI (MAGC1_HUMAN)
MLQNRLLILV

SEQ ID NO: 90057 - protein, 9 aa, Artificial Sequence
  Description of Artificial Sequence: Synthetic peptide
  Seed: MPTAGMPSL (MAGC1_HUMAN)
MTTAGMPSV

SEQ ID NO: 90058 - protein, 9 aa, Artificial Sequence
  Description of Artificial Sequence: Synthetic peptide
  Seed: NTVPITFPS (MAGC1_HUMAN)
NQVPITFPL

SEQ ID NO: 90059 - protein, 11 aa, Artificial Sequence
  Description of Artificial Sequence: Synthetic peptide
  Seed: LQIPMTSSFSS (MAGC1_HUMAN)
LQIPMTSSFSY

SEQ ID NO: 90060 - protein, 9 aa, Artificial Sequence
  Description of Artificial Sequence: Synthetic peptide
  Seed: IESEPLFTY (MAGC1_HUMAN)
IWSEPLFTY

SEQ ID NO: 90061 - protein, 9 aa, Artificial Sequence
  Description of Artificial Sequence: Synthetic peptide
  Seed: ISRYTGYFP (MAGC1_HUMAN)
IVRYTGYFV

SEQ ID NO: 90062 - protein, 9 aa, Artificial Sequence
  Description of Artificial Sequence: Synthetic peptide
  Seed: CSSSTPSSL (MAGC1_HUMAN)
CMSSTPSSL

SEQ ID NO: 90063 - protein, 11 aa, Artificial Sequence
  Description of Artificial Sequence: Synthetic peptide
  Seed: VSSSSSSSTLL (MAGC1_HUMAN)
VNSSSSSSTLW

SEQ ID NO: 90064 - protein, 9 aa, Artificial Sequence
  Description of Artificial Sequence: Synthetic peptide
  Seed: FPSSTSSSL (MAGC1_HUMAN)
FASSTSSSI

SEQ ID NO: 90065 - protein, 9 aa, Artificial Sequence
  Description of Artificial Sequence: Synthetic peptide
  Seed: ISRYTGYFP (MAGC1_HUMAN)
INRYTGYFK

SEQ ID NO: 90066 - protein, 9 aa, Artificial Sequence
  Description of Artificial Sequence: Synthetic peptide
  Seed: RKAREFIEI (MAGC1_HUMAN)
RSAREFIEF

SEQ ID NO: 90067 - protein, 10 aa, Artificial Sequence
  Description of Artificial Sequence: Synthetic peptide
  Seed: VISFSSSTSL (MAGC1_HUMAN)
VASFSSSTSM

SEQ ID NO: 90068 - protein, 9 aa, Artificial Sequence
  Description of Artificial Sequence: Synthetic peptide
  Seed: FSEESSSPV (MAGC1_HUMAN)
FLEESSSPI

SEQ ID NO: 90069 - protein, 11 aa, Artificial Sequence
  Description of Artificial Sequence: Synthetic peptide
  Seed: TLYPLQSPQSR (MAGC1_HUMAN)
TVYPLQSPQSK

SEQ ID NO: 90070 - protein, 9 aa, Artificial Sequence
  Description of Artificial Sequence: Synthetic peptide
  Seed: REVDPDDSY (MAGC1_HUMAN)
REVDPDDSW

SEQ ID NO: 90071 - protein, 10 aa, Artificial Sequence
  Description of Artificial Sequence: Synthetic peptide
  Seed: LQIPMTSSFS (MAGC1_HUMAN)
LQIPMTSSFW

SEQ ID NO: 90072 - protein, 9 aa, Artificial Sequence
  Description of Artificial Sequence: Synthetic peptide
  Seed: ISFSSSTSL (MAGC1_HUMAN)
IPFSSSTSV

SEQ ID NO: 90073 - protein, 9 aa, Artificial Sequence
  Description of Artificial Sequence: Synthetic peptide
  Seed: SPERTHSTF (MAGC1_HUMAN)
SPERTHSTV

SEQ ID NO: 90074 - protein, 10 aa, Artificial Sequence
  Description of Artificial Sequence: Synthetic peptide
  Seed: EILFGISLRE (MAGC1_HUMAN)
EMLFGISLRR

SEQ ID NO: 90075 - protein, 10 aa, Artificial Sequence
  Description of Artificial Sequence: Synthetic peptide
  Seed: MLKNTVPITF (MAGC1_HUMAN)
MRKNTVPITY

SEQ ID NO: 90076 - protein, 9 aa, Artificial Sequence
  Description of Artificial Sequence: Synthetic peptide
  Seed: QSPLQGEEF (MAGC1_HUMAN)
QLPLQGEEL

SEQ ID NO: 90077 - protein, 9 aa, Artificial Sequence
  Description of Artificial Sequence: Synthetic peptide
  Seed: KVDELARFL (MAGC1_HUMAN)
KYDELARFM

SEQ ID NO: 90078 - protein, 9 aa, Artificial Sequence
  Description of Artificial Sequence: Synthetic peptide
  Seed: FSYTLASLL (MAGC1_HUMAN)
FMYTLASLY

SEQ ID NO: 90079 - protein, 10 aa, Artificial Sequence
  Description of Artificial Sequence: Synthetic peptide
  Seed: IPMTSSFSST (MAGC1_HUMAN)
IPMTSSFSSA

SEQ ID NO: 90080 - protein, 11 aa, Artificial Sequence
  Description of Artificial Sequence: Synthetic peptide
  Seed: IPMTSSFSSTL (MAGC1_HUMAN)
IYMTSSFSSTF

SEQ ID NO: 90081 - protein, 11 aa, Artificial Sequence
  Description of Artificial Sequence: Synthetic peptide
  Seed: SSFFSSALLSI (MAGC1_HUMAN)
SAFFSSALLSY

SEQ ID NO: 90082 - protein, 9 aa, Artificial Sequence
  Description of Artificial Sequence: Synthetic peptide
  Seed: SAQSAFEGF (MAGC1_HUMAN)
STQSAFEGF

SEQ ID NO: 90083 - protein, 9 aa, Artificial Sequence
  Description of Artificial Sequence: Synthetic peptide
  Seed: VSSFFSYTL (MAGC1_HUMAN)
VSSFFSYTI

SEQ ID NO: 90084 - protein, 9 aa, Artificial Sequence
  Description of Artificial Sequence: Synthetic peptide
  Seed: YFPVIFRKA (MAGC1_HUMAN)
YFPVIFRKL

SEQ ID NO: 90085 - protein, 9 aa, Artificial Sequence
  Description of Artificial Sequence: Synthetic peptide
  Seed: YVFVNTLDL (MAGC1_HUMAN)
YMFVNTLDA

SEQ ID NO: 90086 - protein, 8 aa, Artificial Sequence
  Description of Artificial Sequence: Synthetic peptide
  Seed: KVDELARF (MAGC1_HUMAN)
KTDELARL

SEQ ID NO: 90087 - protein, 10 aa, Artificial Sequence
  Description of Artificial Sequence: Synthetic peptide
  Seed: YTLLSLFQSS (MAGC1_HUMAN)
YKLLSLFQSI

SEQ ID NO: 90088 - protein, 10 aa, Artificial Sequence
  Description of Artificial Sequence: Synthetic peptide
  Seed: MPTAGMPSLL (MAGC1_HUMAN)
MITAGMPSLI

SEQ ID NO: 90089 - protein, 9 aa, Artificial Sequence
  Description of Artificial Sequence: Synthetic peptide
  Seed: MSQNRLLIL (MAGC1_HUMAN)
MLQNRLLIY

SEQ ID NO: 90090 - protein, 9 aa, Artificial Sequence
  Description of Artificial Sequence: Synthetic peptide
  Seed: TSLSLPQSF (MAGC1_HUMAN)
TFLSLPQSL

SEQ ID NO: 90091 - protein, 9 aa, Artificial Sequence
  Description of Artificial Sequence: Synthetic peptide
  Seed: MLTNVISRY (MAGC1_HUMAN)
MVTNVISRF

SEQ ID NO: 90092 - protein, 9 aa, Artificial Sequence
  Description of Artificial Sequence: Synthetic peptide
  Seed: THSPLQIVP (MAGC1_HUMAN)
TRSPLQIVA

SEQ ID NO: 90093 - protein, 9 aa, Artificial Sequence
  Description of Artificial Sequence: Synthetic peptide
  Seed: LQIPVSSSS (MAGC1_HUMAN)
LEIPVSSSI

SEQ ID NO: 90094 - protein, 10 aa, Artificial Sequence
  Description of Artificial Sequence: Synthetic peptide
  Seed: SSSSTLLSLF (MAGC1_HUMAN)
SFSSTLLSLY

SEQ ID NO: 90095 - protein, 9 aa, Artificial Sequence
  Description of Artificial Sequence: Synthetic peptide
  Seed: SPLQIPGSP (MAGC1_HUMAN)
SPLQIPGSA

SEQ ID NO: 90096 - protein, 10 aa, Artificial Sequence
  Description of Artificial Sequence: Synthetic peptide
  Seed: FFSSALLSIF (MAGC1_HUMAN)
FWSSALLSIW

SEQ ID NO: 90097 - protein, 9 aa, Artificial Sequence
  Description of Artificial Sequence: Synthetic peptide
  Seed: SSPESAQSA (MAGC1_HUMAN)
SFPESAQSL

SEQ ID NO: 90098 - protein, 9 aa, Artificial Sequence
  Description of Artificial Sequence: Synthetic peptide
  Seed: SSSTLLSLF (MAGC1_HUMAN)
SGSTLLSLW

SEQ ID NO: 90099 - protein, 9 aa, Artificial Sequence
  Description of Artificial Sequence: Synthetic peptide
  Seed: SIFQSSPER (MAGC1_HUMAN)
SSFQSSPEL

SEQ ID NO: 90100 - protein, 11 aa, Artificial Sequence
  Description of Artificial Sequence: Synthetic peptide
  Seed: SPLQIPMTSSF (MAGC1_HUMAN)
SQLQIPMTSSM

SEQ ID NO: 90101 - protein, 9 aa, Artificial Sequence
  Description of Artificial Sequence: Synthetic peptide
  Seed: ASSSTLVSI (MAGC1_HUMAN)
AVSSTLVSV

SEQ ID NO: 90102 - protein, 11 aa, Artificial Sequence
  Description of Artificial Sequence: Synthetic peptide
  Seed: KGTYASEEVIW (MAGC1_HUMAN)
KTTYASEEVIW

SEQ ID NO: 90103 - protein, 10 aa, Artificial Sequence
  Description of Artificial Sequence: Synthetic peptide
  Seed: EILFGISLRE (MAGC1_HUMAN)
ETLFGISLRH

SEQ ID NO: 90104 - protein, 9 aa, Artificial Sequence
  Description of Artificial Sequence: Synthetic peptide
  Seed: LQIPMTSSF (MAGC1_HUMAN)
LKIPMTSSM

SEQ ID NO: 90105 - protein, 10 aa, Artificial Sequence
  Description of Artificial Sequence: Synthetic peptide
  Seed: FSSTLVSLFQ (MAGC1_HUMAN)
FSSTLVSLFW

SEQ ID NO: 90106 - protein, 9 aa, Artificial Sequence
  Description of Artificial Sequence: Synthetic peptide
  Seed: LQSPVISFS (MAGC1_HUMAN)
LQSPVISFV

SEQ ID NO: 90107 - protein, 10 aa, Artificial Sequence
  Description of Artificial Sequence: Synthetic peptide
  Seed: PLQIPGSPSF (MAGC1_HUMAN)
PRQIPGSPSF

SEQ ID NO: 90108 - protein, 9 aa, Artificial Sequence
  Description of Artificial Sequence: Synthetic peptide
  Seed: SPESPLQSP (MAGC1_HUMAN)
SPESPLQSM

SEQ ID NO: 90109 - protein, 9 aa, Artificial Sequence
  Description of Artificial Sequence: Synthetic peptide
  Seed: CSSSTSLSL (MAGC1_HUMAN)
CESSTSLSF

SEQ ID NO: 90110 - protein, 10 aa, Artificial Sequence
  Description of Artificial Sequence: Synthetic peptide
  Seed: SPVSSFPSST (MAGC1_HUMAN)
SPVSSFPSSI

SEQ ID NO: 90111 - protein, 10 aa, Artificial Sequence
  Description of Artificial Sequence: Synthetic peptide
  Seed: SFSYTLLSLF (MAGC1_HUMAN)
SCSYTLLSLW

SEQ ID NO: 90112 - protein, 11 aa, Artificial Sequence
  Description of Artificial Sequence: Synthetic peptide
  Seed: DEQGMSQNRLL (MAGC1_HUMAN)
DEQGMSQNRLW

SEQ ID NO: 90113 - protein, 10 aa, Artificial Sequence
  Description of Artificial Sequence: Synthetic peptide
  Seed: RPVSSFFSYT (MAGC1_HUMAN)
RVVSSFFSYA

SEQ ID NO: 90114 - protein, 10 aa, Artificial Sequence
  Description of Artificial Sequence: Synthetic peptide
  Seed: ISRYTGYFPV (MAGC1_HUMAN)
IRRYTGYFPI

SEQ ID NO: 90115 - protein, 9 aa, Artificial Sequence
  Description of Artificial Sequence: Synthetic peptide
  Seed: KAREFIEIL (MAGC1_HUMAN)
KCREFIEIW

SEQ ID NO: 90116 - protein, 10 aa, Artificial Sequence
  Description of Artificial Sequence: Synthetic peptide
  Seed: FPQSVLQIPV (MAGC1_HUMAN)
FEQSVLQIPV

SEQ ID NO: 90117 - protein, 11 aa, Artificial Sequence
  Description of Artificial Sequence: Synthetic peptide
  Seed: IPVSRSFSSTL (MAGC1_HUMAN)
ITVSRSFSSTF

SEQ ID NO: 90118 - protein, 10 aa, Artificial Sequence
  Description of Artificial Sequence: Synthetic peptide
  Seed: YASEEVIWDV (MAGC1_HUMAN)
YMSEEVIWDC

SEQ ID NO: 90119 - protein, 9 aa, Artificial Sequence
  Description of Artificial Sequence: Synthetic peptide
  Seed: YTLASLLQS (MAGC1_HUMAN)
YQLASLLQM

SEQ ID NO: 90120 - protein, 9 aa, Artificial Sequence
  Description of Artificial Sequence: Synthetic peptide
  Seed: IEILFGISL (MAGC1_HUMAN)
IQILFGISM

SEQ ID NO: 90121 - protein, 10 aa, Artificial Sequence
  Description of Artificial Sequence: Synthetic peptide
  Seed: MTSSFSSTLL (MAGC1_HUMAN)
MPSSFSSTLY

SEQ ID NO: 90122 - protein, 9 aa, Artificial Sequence
  Description of Artificial Sequence: Synthetic peptide
  Seed: FLWGPRAHS (MAGC1_HUMAN)
FQWGPRAHV

SEQ ID NO: 90123 - protein, 9 aa, Artificial Sequence
  Description of Artificial Sequence: Synthetic peptide
  Seed: KDVEERAQA (MAGC1_HUMAN)
KEVEERAQC

SEQ ID NO: 90124 - protein, 9 aa, Artificial Sequence
  Description of Artificial Sequence: Synthetic peptide
  Seed: LQIPVSRSF (MAGC1_HUMAN)
LRIPVSRSI

SEQ ID NO: 90125 - protein, 9 aa, Artificial Sequence
  Description of Artificial Sequence: Synthetic peptide
  Seed: SSSESPQSC (MAGC1_HUMAN)
STSESPQSI

SEQ ID NO: 90126 - protein, 9 aa, Artificial Sequence
  Description of Artificial Sequence: Synthetic peptide
  Seed: SLFQSFSER (MAGC1_HUMAN)
SSFQSFSEY

SEQ ID NO: 90127 - protein, 11 aa, Artificial Sequence
  Description of Artificial Sequence: Synthetic peptide
  Seed: SSFFSYTLASL (MAGC1_HUMAN)
STFFSYTLASF

SEQ ID NO: 90128 - protein, 11 aa, Artificial Sequence
  Description of Artificial Sequence: Synthetic peptide
  Seed: SSFPSSTSSSL (MAGC1_HUMAN)
SNFPSSTSSSW

SEQ ID NO: 90129 - protein, 9 aa, Artificial Sequence
  Description of Artificial Sequence: Synthetic peptide
  Seed: HFPQSPPEW (MAGC1_HUMAN)
HTPQSPPEF

SEQ ID NO: 90130 - protein, 9 aa, Artificial Sequence
  Description of Artificial Sequence: Synthetic peptide
  Seed: NTVPITFPS (MAGC1_HUMAN)
NVVPITFPM

SEQ ID NO: 90131 - protein, 10 aa, Artificial Sequence
  Description of Artificial Sequence: Synthetic peptide
  Seed: SSSSSTLLSL (MAGC1_HUMAN)
SKSSSTLLSW

SEQ ID NO: 90132 - protein, 10 aa, Artificial Sequence
  Description of Artificial Sequence: Synthetic peptide
  Seed: MTSSFSSTLL (MAGC1_HUMAN)
MMSSFSSTLH

SEQ ID NO: 90133 - protein, 9 aa, Artificial Sequence
  Description of Artificial Sequence: Synthetic peptide
  Seed: KAREFIEIL (MAGC1_HUMAN)
KSREFIEIY

SEQ ID NO: 90134 - protein, 11 aa, Artificial Sequence
  Description of Artificial Sequence: Synthetic peptide
  Seed: FQSSLQSPVSI (MAGC1_HUMAN)
FMSSLQSPVSA

SEQ ID NO: 90135 - protein, 11 aa, Artificial Sequence
  Description of Artificial Sequence: Synthetic peptide
  Seed: SPLQIPVSSSS (MAGC1_HUMAN)
SLLQIPVSSSF

SEQ ID NO: 90136 - protein, 9 aa, Artificial Sequence
  Description of Artificial Sequence: Synthetic peptide
  Seed: LILSIIFIK (MAGC1_HUMAN)
LTLSIIFIK

SEQ ID NO: 90137 - protein, 10 aa, Artificial Sequence
  Description of Artificial Sequence: Synthetic peptide
  Seed: SSFPSSTSSS (MAGC1_HUMAN)
STFPSSTSSM

SEQ ID NO: 90138 - protein, 10 aa, Artificial Sequence
  Description of Artificial Sequence: Synthetic peptide
  Seed: SIIFIKGTYA (MAGC1_HUMAN)
STIFIKGTYI

SEQ ID NO: 90139 - protein, 9 aa, Artificial Sequence
  Description of Artificial Sequence: Synthetic peptide
  Seed: ASSSTLVSI (MAGC1_HUMAN)
ALSSTLVSI

SEQ ID NO: 90140 - protein, 9 aa, Artificial Sequence
  Description of Artificial Sequence: Synthetic peptide
  Seed: KQPITKAEM (MAGC1_HUMAN)
KGPITKAEL

SEQ ID NO: 90141 - protein, 11 aa, Artificial Sequence
  Description of Artificial Sequence: Synthetic peptide
  Seed: SFFSSALLSIF (MAGC1_HUMAN)
SDFSSALLSIW

SEQ ID NO: 90142 - protein, 9 aa, Artificial Sequence
  Description of Artificial Sequence: Synthetic peptide
  Seed: LQRPVSSFF (MAGC1_HUMAN)
LSRPVSSFK

SEQ ID NO: 90143 - protein, 11 aa, Artificial Sequence
  Description of Artificial Sequence: Synthetic peptide
  Seed: SSSSSTLLSLF (MAGC1_HUMAN)
STSSSTLLSLF

SEQ ID NO: 90144 - protein, 9 aa, Artificial Sequence
  Description of Artificial Sequence: Synthetic peptide
  Seed: TSLSLPQSF (MAGC1_HUMAN)
TILSLPQSW

SEQ ID NO: 90145 - protein, 9 aa, Artificial Sequence
  Description of Artificial Sequence: Synthetic peptide
  Seed: RPVSSFFSY (MAGC1_HUMAN)
RPVSSFFSL

SEQ ID NO: 90146 - protein, 11 aa, Artificial Sequence
  Description of Artificial Sequence: Synthetic peptide
  Seed: STFEGFAQSSL (MAGC1_HUMAN)
SLFEGFAQSSV

SEQ ID NO: 90147 - protein, 9 aa, Artificial Sequence
  Description of Artificial Sequence: Synthetic peptide
  Seed: WVQEHYLEY (MAGC1_HUMAN)
WTQEHYLEM

SEQ ID NO: 90148 - protein, 9 aa, Artificial Sequence
  Description of Artificial Sequence: Synthetic peptide
  Seed: SSFFSSALL (MAGC1_HUMAN)
SYFFSSALL

SEQ ID NO: 90149 - protein, 10 aa, Artificial Sequence
  Description of Artificial Sequence: Synthetic peptide
  Seed: FFSSALLSIF (MAGC1_HUMAN)
FASSALLSIY

SEQ ID NO: 90150 - protein, 11 aa, Artificial Sequence
  Description of Artificial Sequence: Synthetic peptide
  Seed: SSFSYTLLSLF (MAGC1_HUMAN)
SWFSYTLLSLY

SEQ ID NO: 90151 - protein, 10 aa, Artificial Sequence
  Description of Artificial Sequence: Synthetic peptide
  Seed: LQIPGSPSFS (MAGC1_HUMAN)
LMIPGSPSFI

SEQ ID NO: 90152 - protein, 9 aa, Artificial Sequence
  Description of Artificial Sequence: Synthetic peptide
  Seed: LQRPVSSFF (MAGC1_HUMAN)
LGRPVSSFY

SEQ ID NO: 90153 - protein, 10 aa, Artificial Sequence
  Description of Artificial Sequence: Synthetic peptide
  Seed: MLKNTVPITF (MAGC1_HUMAN)
MAKNTVPITL

SEQ ID NO: 90154 - protein, 9 aa, Artificial Sequence
  Description of Artificial Sequence: Synthetic peptide
  Seed: SFSYTLLSL (MAGC1_HUMAN)
SWSYTLLSI

SEQ ID NO: 90155 - protein, 10 aa, Artificial Sequence
  Description of Artificial Sequence: Synthetic peptide
  Seed: WGPRAHSEVI (MAGC1_HUMAN)
WLPRAHSEVL

SEQ ID NO: 90156 - protein, 10 aa, Artificial Sequence
  Description of Artificial Sequence: Synthetic peptide
  Seed: RAGREHFAFG (MAGC1_HUMAN)
RTGREHFAFF

SEQ ID NO: 90157 - protein, 9 aa, Artificial Sequence
  Description of Artificial Sequence: Synthetic peptide
  Seed: RKAREFIEI (MAGC1_HUMAN)
RMAREFIEY

SEQ ID NO: 90158 - protein, 9 aa, Artificial Sequence
  Description of Artificial Sequence: Synthetic peptide
  Seed: TYASEEVIW (MAGC1_HUMAN)
TYASEEVIF

SEQ ID NO: 90159 - protein, 9 aa, Artificial Sequence
  Description of Artificial Sequence: Synthetic peptide
  Seed: YVFVNTLDL (MAGC1_HUMAN)
YRFVNTLDM

SEQ ID NO: 90160 - protein, 10 aa, Artificial Sequence
  Description of Artificial Sequence: Synthetic peptide
  Seed: PLQIPMTSSF (MAGC1_HUMAN)
PMQIPMTSSM

SEQ ID NO: 90161 - protein, 11 aa, Artificial Sequence
  Description of Artificial Sequence: Synthetic peptide
  Seed: LQIPVSSSFSY (MAGC1_HUMAN)
LQIPVSSSFSF

SEQ ID NO: 90162 - protein, 11 aa, Artificial Sequence
  Description of Artificial Sequence: Synthetic peptide
  Seed: LQIPVSSSFSY (MAGC1_HUMAN)
LFIPVSSSFSY

SEQ ID NO: 90163 - protein, 10 aa, Artificial Sequence
  Description of Artificial Sequence: Synthetic peptide
  Seed: KGTYASEEVI (MAGC1_HUMAN)
KTTYASEEVY

SEQ ID NO: 90164 - protein, 11 aa, Artificial Sequence
  Description of Artificial Sequence: Synthetic peptide
  Seed: TLDEKVDELAR (MAGC1_HUMAN)
TMDEKVDELAL

SEQ ID NO: 90165 - protein, 9 aa, Artificial Sequence
  Description of Artificial Sequence: Synthetic peptide
  Seed: VISRYTGYF (MAGC1_HUMAN)
VISRYTGYW

SEQ ID NO: 90166 - protein, 9 aa, Artificial Sequence
  Description of Artificial Sequence: Synthetic peptide
  Seed: SQSSPVSSF (MAGC1_HUMAN)
SMSSPVSSV

SEQ ID NO: 90167 - protein, 9 aa, Artificial Sequence
  Description of Artificial Sequence: Synthetic peptide
  Seed: RKVVEFLAM (MAGC1_HUMAN)
RLVVEFLAM

SEQ ID NO: 90168 - protein, 11 aa, Artificial Sequence
  Description of Artificial Sequence: Synthetic peptide
  Seed: SPLQIPVSSSS (MAGC1_HUMAN)
SFLQIPVSSSF

SEQ ID NO: 90169 - protein, 10 aa, Artificial Sequence
  Description of Artificial Sequence: Synthetic peptide
  Seed: FPSSYKDALK (MAGC1_HUMAN)
FISSYKDALK

SEQ ID NO: 90170 - protein, 9 aa, Artificial Sequence
  Description of Artificial Sequence: Synthetic peptide
  Seed: SFPSSTSSS (MAGC1_HUMAN)
SFPSSTSSM

SEQ ID NO: 90171 - protein, 9 aa, Artificial Sequence
  Description of Artificial Sequence: Synthetic peptide
  Seed: VSPSSSSTL (MAGC1_HUMAN)
VNPSSSSTL

SEQ ID NO: 90172 - protein, 10 aa, Artificial Sequence
  Description of Artificial Sequence: Synthetic peptide
  Seed: HSPQSPPEGM (MAGC1_HUMAN)
HIPQSPPEGM

SEQ ID NO: 90173 - protein, 9 aa, Artificial Sequence
  Description of Artificial Sequence: Synthetic peptide
  Seed: SICSSSTSL (MAGC1_HUMAN)
SQCSSSTSW

SEQ ID NO: 90174 - protein, 10 aa, Artificial Sequence
  Description of Artificial Sequence: Synthetic peptide
  Seed: YTGYFPVIFR (MAGC1_HUMAN)
YKGYFPVIFR

SEQ ID NO: 90175 - protein, 9 aa, Artificial Sequence
  Description of Artificial Sequence: Synthetic peptide
  Seed: FPSSTSSSL (MAGC1_HUMAN)
FISSTSSSL

SEQ ID NO: 90176 - protein, 11 aa, Artificial Sequence
  Description of Artificial Sequence: Synthetic peptide
  Seed: TTDDSTATESA (MAGC1_HUMAN)
TVDDSTATESL

SEQ ID NO: 90177 - protein, 9 aa, Artificial Sequence
  Description of Artificial Sequence: Synthetic peptide
  Seed: MTSSFSSTL (MAGC1_HUMAN)
MLSSFSSTW

SEQ ID NO: 90178 - protein, 10 aa, Artificial Sequence
  Description of Artificial Sequence: Synthetic peptide
  Seed: WGPRAHSEVI (MAGC1_HUMAN)
WCPRAHSEVV

SEQ ID NO: 90179 - protein, 9 aa, Artificial Sequence
  Description of Artificial Sequence: Synthetic peptide
  Seed: SSFSSTLLS (MAGC1_HUMAN)
SIFSSTLLK

SEQ ID NO: 90180 - protein, 10 aa, Artificial Sequence
  Description of Artificial Sequence: Synthetic peptide
  Seed: MLKNTVPITF (MAGC1_HUMAN)
MPKNTVPITY

SEQ ID NO: 90181 - protein, 10 aa, Artificial Sequence
  Description of Artificial Sequence: Synthetic peptide
  Seed: RSFSSTLLSI (MAGC1_HUMAN)
RGFSSTLLSF

SEQ ID NO: 90182 - protein, 9 aa, Artificial Sequence
  Description of Artificial Sequence: Synthetic peptide
  Seed: FSSALLSIF (MAGC1_HUMAN)
FWSALLSIY

SEQ ID NO: 90183 - protein, 9 aa, Artificial Sequence
  Description of Artificial Sequence: Synthetic peptide
  Seed: SFFSYTLAS (MAGC1_HUMAN)
SFFSYTLAV

SEQ ID NO: 90184 - protein, 9 aa, Artificial Sequence
  Description of Artificial Sequence: Synthetic peptide
  Seed: FSYTLASLL (MAGC1_HUMAN)
FFYTLASLY

SEQ ID NO: 90185 - protein, 9 aa, Artificial Sequence
  Description of Artificial Sequence: Synthetic peptide
  Seed: RKVVEFLAM (MAGC1_HUMAN)
RIVVEFLAM

SEQ ID NO: 90186 - protein, 9 aa, Artificial Sequence
  Description of Artificial Sequence: Synthetic peptide
  Seed: CSSSTPSSL (MAGC1_HUMAN)
CQSSTPSSY

SEQ ID NO: 90187 - protein, 10 aa, Artificial Sequence
  Description of Artificial Sequence: Synthetic peptide
  Seed: SSSSSSSTLL (MAGC1_HUMAN)
SYSSSSSTLW

SEQ ID NO: 90188 - protein, 9 aa, Artificial Sequence
  Description of Artificial Sequence: Synthetic peptide
  Seed: AQSPLQSPV (MAGC1_HUMAN)
AQSPLQSPF

SEQ ID NO: 90189 - protein, 10 aa, Artificial Sequence
  Description of Artificial Sequence: Synthetic peptide
  Seed: WGPRAHSEVI (MAGC1_HUMAN)
WYPRAHSEVF

SEQ ID NO: 90190 - protein, 9 aa, Artificial Sequence
  Description of Artificial Sequence: Synthetic peptide
  Seed: LQIPVSSSS (MAGC1_HUMAN)
LNIPVSSSY

SEQ ID NO: 90191 - protein, 9 aa, Artificial Sequence
  Description of Artificial Sequence: Synthetic peptide
  Seed: KAREFIEIL (MAGC1_HUMAN)
KNREFIEIK

SEQ ID NO: 90192 - protein, 9 aa, Artificial Sequence
  Description of Artificial Sequence: Synthetic peptide
  Seed: VQSPLQNPA (MAGC1_HUMAN)
VHSPLQNPA

SEQ ID NO: 90193 - protein, 9 aa, Artificial Sequence
  Description of Artificial Sequence: Synthetic peptide
  Seed: VSSFFSYTL (MAGC1_HUMAN)
VISFFSYTL

SEQ ID NO: 90194 - protein, 10 aa, Artificial Sequence
  Description of Artificial Sequence: Synthetic peptide
  Seed: LQIPVSRSFS (MAGC1_HUMAN)
LHIPVSRSFY

SEQ ID NO: 90195 - protein, 10 aa, Artificial Sequence
  Description of Artificial Sequence: Synthetic peptide
  Seed: YTLASLLQSS (MAGC1_HUMAN)
YELASLLQSI

SEQ ID NO: 90196 - protein, 9 aa, Artificial Sequence
  Description of Artificial Sequence: Synthetic peptide
  Seed: FPSSYKDAL (MAGC1_HUMAN)
FASSYKDAM

SEQ ID NO: 90197 - protein, 11 aa, Artificial Sequence
  Description of Artificial Sequence: Synthetic peptide
  Seed: STFEGFAQSPL (MAGC1_HUMAN)
SLFEGFAQSPT

SEQ ID NO: 90198 - protein, 9 aa, Artificial Sequence
  Description of Artificial Sequence: Synthetic peptide
  Seed: AGREHFAFG (MAGC1_HUMAN)
AFREHFAFK

SEQ ID NO: 90199 - protein, 9 aa, Artificial Sequence
  Description of Artificial Sequence: Synthetic peptide
  Seed: SSPPRYEFL (MAGC1_HUMAN)
SMPPRYEFA

SEQ ID NO: 90200 - protein, 10 aa, Artificial Sequence
  Description of Artificial Sequence: Synthetic peptide
  Seed: LSIIFIKGTY (MAGC1_HUMAN)
LSIIFIKGTW

SEQ ID NO: 90201 - protein, 10 aa, Artificial Sequence
  Description of Artificial Sequence: Synthetic peptide
  Seed: LQIPMTSSFS (MAGC1_HUMAN)
LQIPMTSSFH

SEQ ID NO: 90202 - protein, 11 aa, Artificial Sequence
  Description of Artificial Sequence: Synthetic peptide
  Seed: TTDDSTATESA (MAGC1_HUMAN)
TLDDSTATESM

SEQ ID NO: 90203 - protein, 10 aa, Artificial Sequence
  Description of Artificial Sequence: Synthetic peptide
  Seed: SRYTGYFPVI (MAGC1_HUMAN)
STYTGYFPVF

SEQ ID NO: 90204 - protein, 9 aa, Artificial Sequence
  Description of Artificial Sequence: Synthetic peptide
  Seed: AQSSLQIPV (MAGC1_HUMAN)
AMSSLQIPA

SEQ ID NO: 90205 - protein, 9 aa, Artificial Sequence
  Description of Artificial Sequence: Synthetic peptide
  Seed: LKNTVPITF (MAGC1_HUMAN)
LRNTVPITF

SEQ ID NO: 90206 - protein, 9 aa, Artificial Sequence
  Description of Artificial Sequence: Synthetic peptide
  Seed: LKYQVKQPI (MAGC1_HUMAN)
LTYQVKQPY

SEQ ID NO: 90207 - protein, 9 aa, Artificial Sequence
  Description of Artificial Sequence: Synthetic peptide
  Seed: RTHSTFEGF (MAGC1_HUMAN)
RWHSTFEGF

SEQ ID NO: 90208 - protein, 9 aa, Artificial Sequence
  Description of Artificial Sequence: Synthetic peptide
  Seed: VSAASSSTL (MAGC1_HUMAN)
VLAASSSTM

SEQ ID NO: 90209 - protein, 9 aa, Artificial Sequence
  Description of Artificial Sequence: Synthetic peptide
  Seed: SPESPLQSP (MAGC1_HUMAN)
SPESPLQSI

SEQ ID NO: 90210 - protein, 10 aa, Artificial Sequence
  Description of Artificial Sequence: Synthetic peptide
  Seed: STPSSLPQSF (MAGC1_HUMAN)
SFPSSLPQSY

SEQ ID NO: 90211 - protein, 10 aa, Artificial Sequence
  Description of Artificial Sequence: Synthetic peptide
  Seed: SSPECTQSTF (MAGC1_HUMAN)
SAPECTQSTY

SEQ ID NO: 90212 - protein, 9 aa, Artificial Sequence
  Description of Artificial Sequence: Synthetic peptide
  Seed: AGREHFAFG (MAGC1_HUMAN)
ATREHFAFP

SEQ ID NO: 90213 - protein, 10 aa, Artificial Sequence
  Description of Artificial Sequence: Synthetic peptide
  Seed: SRYTGYFPVI (MAGC1_HUMAN)
SVYTGYFPVF

SEQ ID NO: 90214 - protein, 9 aa, Artificial Sequence
  Description of Artificial Sequence: Synthetic peptide
  Seed: LSDEQGMSQ (MAGC1_HUMAN)
LIDEQGMSV

SEQ ID NO: 90215 - protein, 9 aa, Artificial Sequence
  Description of Artificial Sequence: Synthetic peptide
  Seed: KDSQSPLQI (MAGC1_HUMAN)
KVSQSPLQV

SEQ ID NO: 90216 - protein, 9 aa, Artificial Sequence
  Description of Artificial Sequence: Synthetic peptide
  Seed: FSSTLLSLF (MAGC1_HUMAN)
FVSTLLSLI

SEQ ID NO: 90217 - protein, 10 aa, Artificial Sequence
  Description of Artificial Sequence: Synthetic peptide
  Seed: SFFSYTLASL (MAGC1_HUMAN)
SQFSYTLASV

SEQ ID NO: 90218 - protein, 9 aa, Artificial Sequence
  Description of Artificial Sequence: Synthetic peptide
  Seed: NPASSFFSS (MAGC1_HUMAN)
NAASSFFSM

SEQ ID NO: 90219 - protein, 9 aa, Artificial Sequence
  Description of Artificial Sequence: Synthetic peptide
  Seed: SEESSSPVD (MAGC1_HUMAN)
SEESSSPVL

SEQ ID NO: 90220 - protein, 9 aa, Artificial Sequence
  Description of Artificial Sequence: Synthetic peptide
  Seed: TESASSSVM (MAGC1_HUMAN)
TMSASSSVY

SEQ ID NO: 90221 - protein, 9 aa, Artificial Sequence
  Description of Artificial Sequence: Synthetic peptide
  Seed: RSFSSTLLS (MAGC1_HUMAN)
RTFSSTLLI

SEQ ID NO: 90222 - protein, 9 aa, Artificial Sequence
  Description of Artificial Sequence: Synthetic peptide
  Seed: VSRSFSSTL (MAGC1_HUMAN)
VQRSFSSTK

SEQ ID NO: 90223 - protein, 9 aa, Artificial Sequence
  Description of Artificial Sequence: Synthetic peptide
  Seed: TLASLLQSS (MAGC1_HUMAN)
TLASLLQSI

SEQ ID NO: 90224 - protein, 9 aa, Artificial Sequence
  Description of Artificial Sequence: Synthetic peptide
  Seed: FFSYTLASL (MAGC1_HUMAN)
FMSYTLASL

SEQ ID NO: 90225 - protein, 9 aa, Artificial Sequence
  Description of Artificial Sequence: Synthetic peptide
  Seed: SSSDTLLES (MAGC1_HUMAN)
SVSDTLLEL

SEQ ID NO: 90226 - protein, 8 aa, Artificial Sequence
  Description of Artificial Sequence: Synthetic peptide
  Seed: SSPPRYEF (MAGC1_HUMAN)
SSPPRYEM

SEQ ID NO: 90227 - protein, 10 aa, Artificial Sequence
  Description of Artificial Sequence: Synthetic peptide
  Seed: SFFSYTLASL (MAGC1_HUMAN)
SMFSYTLASI

SEQ ID NO: 90228 - protein, 10 aa, Artificial Sequence
  Description of Artificial Sequence: Synthetic peptide
  Seed: ISRYTGYFPV (MAGC1_HUMAN)
IMRYTGYFPA

SEQ ID NO: 90229 - protein, 10 aa, Artificial Sequence
  Description of Artificial Sequence: Synthetic peptide
  Seed: ASSFFSSALL (MAGC1_HUMAN)
ANSFFSSALV

SEQ ID NO: 90230 - protein, 10 aa, Artificial Sequence
  Description of Artificial Sequence: Synthetic peptide
  Seed: SSPESAQSAF (MAGC1_HUMAN)
SMPESAQSAI

SEQ ID NO: 90231 - protein, 8 aa, Artificial Sequence
  Description of Artificial Sequence: Synthetic peptide
  Seed: SSPPRYEF (MAGC1_HUMAN)
SYPPRYEF

SEQ ID NO: 90232 - protein, 9 aa, Artificial Sequence
  Description of Artificial Sequence: Synthetic peptide
  Seed: CSSSTSLSL (MAGC1_HUMAN)
CVSSTSLSM

SEQ ID NO: 90233 - protein, 9 aa, Artificial Sequence
  Description of Artificial Sequence: Synthetic peptide
  Seed: QSPLQGEEF (MAGC1_HUMAN)
QMPLQGEEL

SEQ ID NO: 90234 - protein, 9 aa, Artificial Sequence
  Description of Artificial Sequence: Synthetic peptide
  Seed: SPLQSPVSS (MAGC1_HUMAN)
SMLQSPVSW

SEQ ID NO: 90235 - protein, 10 aa, Artificial Sequence
  Description of Artificial Sequence: Synthetic peptide
  Seed: SLFQSSPERT (MAGC1_HUMAN)
SQFQSSPERV

SEQ ID NO: 90236 - protein, 10 aa, Artificial Sequence
  Description of Artificial Sequence: Synthetic peptide
  Seed: VSSSSSSTLL (MAGC1_HUMAN)
VASSSSSTLW

SEQ ID NO: 90237 - protein, 9 aa, Artificial Sequence
  Description of Artificial Sequence: Synthetic peptide
  Seed: SVLQIPVSA (MAGC1_HUMAN)
SPLQIPVSY

SEQ ID NO: 90238 - protein, 9 aa, Artificial Sequence
  Description of Artificial Sequence: Synthetic peptide
  Seed: AGREHFAFG (MAGC1_HUMAN)
ARREHFAFK

SEQ ID NO: 90239 - protein, 9 aa, Artificial Sequence
  Description of Artificial Sequence: Synthetic peptide
  Seed: LQIPVSPSF (MAGC1_HUMAN)
LGIPVSPSY

SEQ ID NO: 90240 - protein, 11 aa, Artificial Sequence
  Description of Artificial Sequence: Synthetic peptide
  Seed: STFEGFPQSLL (MAGC1_HUMAN)
SLFEGFPQSLL

SEQ ID NO: 90241 - protein, 10 aa, Artificial Sequence
  Description of Artificial Sequence: Synthetic peptide
  Seed: RPVSSFFSYT (MAGC1_HUMAN)
RYVSSFFSYK

SEQ ID NO: 90242 - protein, 9 aa, Artificial Sequence
  Description of Artificial Sequence: Synthetic peptide
  Seed: LQIPMTSSF (MAGC1_HUMAN)
LGIPMTSSW

SEQ ID NO: 90243 - protein, 9 aa, Artificial Sequence
  Description of Artificial Sequence: Synthetic peptide
  Seed: DSYVFVNTL (MAGC1_HUMAN)
DMYVFVNTF

SEQ ID NO: 90244 - protein, 9 aa, Artificial Sequence
  Description of Artificial Sequence: Synthetic peptide
  Seed: KDSLSPLEI (MAGC1_HUMAN)
KDSLSPLEL

SEQ ID NO: 90245 - protein, 9 aa, Artificial Sequence
  Description of Artificial Sequence: Synthetic peptide
  Seed: FPSSTSSSL (MAGC1_HUMAN)
FWSSTSSSV

SEQ ID NO: 90246 - protein, 10 aa, Artificial Sequence
  Description of Artificial Sequence: Synthetic peptide
  Seed: ASSFFSSALL (MAGC1_HUMAN)
ASSFFSSALW

SEQ ID NO: 90247 - protein, 9 aa, Artificial Sequence
  Description of Artificial Sequence: Synthetic peptide
  Seed: SFSSTLVSL (MAGC1_HUMAN)
SRSSTLVSI

SEQ ID NO: 90248 - protein, 10 aa, Artificial Sequence
  Description of Artificial Sequence: Synthetic peptide
  Seed: FFSYTLASLL (MAGC1_HUMAN)
FNSYTLASLF

SEQ ID NO: 90249 - protein, 9 aa, Artificial Sequence
  Description of Artificial Sequence: Synthetic peptide
  Seed: FPSSTSSSL (MAGC1_HUMAN)
FPSSTSSSQ

SEQ ID NO: 90250 - protein, 11 aa, Artificial Sequence
  Description of Artificial Sequence: Synthetic peptide
  Seed: RSFSSTLLSIF (MAGC1_HUMAN)
RYFSSTLLSIF

SEQ ID NO: 90251 - protein, 9 aa, Artificial Sequence
  Description of Artificial Sequence: Synthetic peptide
  Seed: LQIPVSAAS (MAGC1_HUMAN)
LEIPVSAAF

SEQ ID NO: 90252 - protein, 10 aa, Artificial Sequence
  Description of Artificial Sequence: Synthetic peptide
  Seed: FFSYTLASLL (MAGC1_HUMAN)
FSSYTLASLL

SEQ ID NO: 90253 - protein, 9 aa, Artificial Sequence
  Description of Artificial Sequence: Synthetic peptide
  Seed: IPVSSSFSY (MAGC1_HUMAN)
IQVSSSFSL

SEQ ID NO: 90254 - protein, 9 aa, Artificial Sequence
  Description of Artificial Sequence: Synthetic peptide
  Seed: EILFGISLR (MAGC1_HUMAN)
EFLFGISLK

SEQ ID NO: 90255 - protein, 10 aa, Artificial Sequence
  Description of Artificial Sequence: Synthetic peptide
  Seed: VSSFFSYTLA (MAGC1_HUMAN)
VTSFFSYTLI

SEQ ID NO: 90256 - protein, 9 aa, Artificial Sequence
  Description of Artificial Sequence: Synthetic peptide
  Seed: SFFSYTLAS (MAGC1_HUMAN)
SHFSYTLAL

SEQ ID NO: 90257 - protein, 9 aa, Artificial Sequence
  Description of Artificial Sequence: Synthetic peptide
  Seed: TLVSIFQSS (MAGC1_HUMAN)
TLVSIFQSV

SEQ ID NO: 90258 - protein, 9 aa, Artificial Sequence
  Description of Artificial Sequence: Synthetic peptide
  Seed: SFSSTLVSL (MAGC1_HUMAN)
SVSSTLVSL

SEQ ID NO: 90259 - protein, 9 aa, Artificial Sequence
  Description of Artificial Sequence: Synthetic peptide
  Seed: ISFSSSTSL (MAGC1_HUMAN)
IKFSSSTSL

SEQ ID NO: 90260 - protein, 9 aa, Artificial Sequence
  Description of Artificial Sequence: Synthetic peptide
  Seed: LQIPGSPSF (MAGC1_HUMAN)
LFIPGSPSY

SEQ ID NO: 90261 - protein, 9 aa, Artificial Sequence
  Description of Artificial Sequence: Synthetic peptide
  Seed: YTGYFPVIF (MAGC1_HUMAN)
YRGYFPVIF

SEQ ID NO: 90262 - protein, 9 aa, Artificial Sequence
  Description of Artificial Sequence: Synthetic peptide
  Seed: RTQSTFEGF (MAGC1_HUMAN)
RTQSTFEGY

SEQ ID NO: 90263 - protein, 11 aa, Artificial Sequence
  Description of Artificial Sequence: Synthetic peptide
  Seed: SSSSSSTLLSL (MAGC1_HUMAN)
STSSSSTLLSF

SEQ ID NO: 90264 - protein, 9 aa, Artificial Sequence
  Description of Artificial Sequence: Synthetic peptide
  Seed: GSPSFSSTL (MAGC1_HUMAN)
GTPSFSSTL

SEQ ID NO: 90265 - protein, 8 aa, Artificial Sequence
  Description of Artificial Sequence: Synthetic peptide
  Seed: SSFSYTLL (MAGC1_HUMAN)
STFSYTLW

SEQ ID NO: 90266 - protein, 9 aa, Artificial Sequence
  Description of Artificial Sequence: Synthetic peptide
  Seed: SQSSPVSSF (MAGC1_HUMAN)
SESSPVSSA

SEQ ID NO: 90267 - protein, 9 aa, Artificial Sequence
  Description of Artificial Sequence: Synthetic peptide
  Seed: VQSPLHSPQ (MAGC1_HUMAN)
VESPLHSPY

SEQ ID NO: 90268 - protein, 9 aa, Artificial Sequence
  Description of Artificial Sequence: Synthetic peptide
  Seed: EFIEILFGI (MAGC1_HUMAN)
ETIEILFGL

SEQ ID NO: 90269 - protein, 9 aa, Artificial Sequence
  Description of Artificial Sequence: Synthetic peptide
  Seed: SICSSSTSL (MAGC1_HUMAN)
SECSSSTSF

SEQ ID NO: 90270 - protein, 10 aa, Artificial Sequence
  Description of Artificial Sequence: Synthetic peptide
  Seed: MTSSFSSTLL (MAGC1_HUMAN)
MQSSFSSTLI

SEQ ID NO: 90271 - protein, 9 aa, Artificial Sequence
  Description of Artificial Sequence: Synthetic peptide
  Seed: TLLSLFQSF (MAGC1_HUMAN)
TWLSLFQSL

SEQ ID NO: 90272 - protein, 10 aa, Artificial Sequence
  Description of Artificial Sequence: Synthetic peptide
  Seed: TTDDSTATES (MAGC1_HUMAN)
TVDDSTATEI

SEQ ID NO: 90273 - protein, 9 aa, Artificial Sequence
  Description of Artificial Sequence: Synthetic peptide
  Seed: RTQSTFEGF (MAGC1_HUMAN)
RVQSTFEGY

SEQ ID NO: 90274 - protein, 10 aa, Artificial Sequence
  Description of Artificial Sequence: Synthetic peptide
  Seed: NRLLILILSI (MAGC1_HUMAN)
NMLLILILSV

SEQ ID NO: 90275 - protein, 9 aa, Artificial Sequence
  Description of Artificial Sequence: Synthetic peptide
  Seed: SPLQIVPSL (MAGC1_HUMAN)
SRLQIVPSL

SEQ ID NO: 90276 - protein, 9 aa, Artificial Sequence
  Description of Artificial Sequence: Synthetic peptide
  Seed: LLSLFQSFS (MAGC1_HUMAN)
LMSLFQSFT

SEQ ID NO: 90277 - protein, 9 aa, Artificial Sequence
  Description of Artificial Sequence: Synthetic peptide
  Seed: VSPSSSSTL (MAGC1_HUMAN)
VCPSSSSTM

SEQ ID NO: 90278 - protein, 10 aa, Artificial Sequence
  Description of Artificial Sequence: Synthetic peptide
  Seed: KVVEFLAMLK (MAGC1_HUMAN)
KIVEFLAMLA

SEQ ID NO: 90279 - protein, 10 aa, Artificial Sequence
  Description of Artificial Sequence: Synthetic peptide
  Seed: RAGREHFAFG (MAGC1_HUMAN)
RWGREHFAFL

SEQ ID NO: 90280 - protein, 9 aa, Artificial Sequence
  Description of Artificial Sequence: Synthetic peptide
  Seed: KAREFIEIL (MAGC1_HUMAN)
KAREFIEII

SEQ ID NO: 90281 - protein, 11 aa, Artificial Sequence
  Description of Artificial Sequence: Synthetic peptide
  Seed: TVPITFPSSYK (MAGC1_HUMAN)
TKPITFPSSYR

SEQ ID NO: 90282 - protein, 11 aa, Artificial Sequence
  Description of Artificial Sequence: Synthetic peptide
  Seed: SSFSSTLLSIL (MAGC1_HUMAN)
SAFSSTLLSIY

SEQ ID NO: 90283 - protein, 9 aa, Artificial Sequence
  Description of Artificial Sequence: Synthetic peptide
  Seed: SRYTGYFPV (MAGC1_HUMAN)
SKYTGYFPI

SEQ ID NO: 90284 - protein, 9 aa, Artificial Sequence
  Description of Artificial Sequence: Synthetic peptide
  Seed: EDFQSSLQS (MAGC1_HUMAN)
EEFQSSLQA

SEQ ID NO: 90285 - protein, 11 aa, Artificial Sequence
  Description of Artificial Sequence: Synthetic peptide
  Seed: SLFQSSPERTH (MAGC1_HUMAN)
SQFQSSPERTF

SEQ ID NO: 90286 - protein, 10 aa, Artificial Sequence
  Description of Artificial Sequence: Synthetic peptide
  Seed: SFSSTLLSIL (MAGC1_HUMAN)
SDSSTLLSIF

SEQ ID NO: 90287 - protein, 9 aa, Artificial Sequence
  Description of Artificial Sequence: Synthetic peptide
  Seed: RKAREFIEI (MAGC1_HUMAN)
RHAREFIEF

SEQ ID NO: 90288 - protein, 9 aa, Artificial Sequence
  Description of Artificial Sequence: Synthetic peptide
  Seed: SSHESPQSP (MAGC1_HUMAN)
SVHESPQSL

SEQ ID NO: 90289 - protein, 9 aa, Artificial Sequence
  Description of Artificial Sequence: Synthetic peptide
  Seed: AFGEPRELL (MAGC1_HUMAN)
AYGEPRELL

SEQ ID NO: 90290 - protein, 9 aa, Artificial Sequence
  Description of Artificial Sequence: Synthetic peptide
  Seed: VVEFLAMLK (MAGC1_HUMAN)
VVEFLAMLR

SEQ ID NO: 90291 - protein, 9 aa, Artificial Sequence
  Description of Artificial Sequence: Synthetic peptide
  Seed: LSDEQGMSQ (MAGC1_HUMAN)
LVDEQGMSC

SEQ ID NO: 90292 - protein, 10 aa, Artificial Sequence
  Description of Artificial Sequence: Synthetic peptide
  Seed: MTSSFSSTLL (MAGC1_HUMAN)
MCSSFSSTLF

SEQ ID NO: 90293 - protein, 9 aa, Artificial Sequence
  Description of Artificial Sequence: Synthetic peptide
  Seed: AGREHFAFG (MAGC1_HUMAN)
AVREHFAFV

SEQ ID NO: 90294 - protein, 10 aa, Artificial Sequence
  Description of Artificial Sequence: Synthetic peptide
  Seed: RKVVEFLAML (MAGC1_HUMAN)
RHVVEFLAMY

SEQ ID NO: 90295 - protein, 9 aa, Artificial Sequence
  Description of Artificial Sequence: Synthetic peptide
  Seed: TLDLTSEGC (MAGC1_HUMAN)
TLDLTSEGV

SEQ ID NO: 90296 - protein, 10 aa, Artificial Sequence
  Description of Artificial Sequence: Synthetic peptide
  Seed: KGTYASEEVI (MAGC1_HUMAN)
KYTYASEEVF

SEQ ID NO: 90297 - protein, 11 aa, Artificial Sequence
  Description of Artificial Sequence: Synthetic peptide
  Seed: KRKVVEFLAML (MAGC1_HUMAN)
KMKVVEFLAML

SEQ ID NO: 90298 - protein, 10 aa, Artificial Sequence
  Description of Artificial Sequence: Synthetic peptide
  Seed: LAMLKNTVPI (MAGC1_HUMAN)
LSMLKNTVPV

SEQ ID NO: 90299 - protein, 9 aa, Artificial Sequence
  Description of Artificial Sequence: Synthetic peptide
  Seed: SPLQSPVSS (MAGC1_HUMAN)
SSLQSPVSY

SEQ ID NO: 90300 - protein, 10 aa, Artificial Sequence
  Description of Artificial Sequence: Synthetic peptide
  Seed: KVVEFLAMLK (MAGC1_HUMAN)
KNVEFLAMLK

SEQ ID NO: 90301 - protein, 10 aa, Artificial Sequence
  Description of Artificial Sequence: Synthetic peptide
  Seed: YTLDEKVDEL (MAGC1_HUMAN)
YNLDEKVDEV

SEQ ID NO: 90302 - protein, 9 aa, Artificial Sequence
  Description of Artificial Sequence: Synthetic peptide
  Seed: SLSPHYFPQ (MAGC1_HUMAN)
SQSPHYFPR

SEQ ID NO: 90303 - protein, 9 aa, Artificial Sequence
  Description of Artificial Sequence: Synthetic peptide
  Seed: LQIPVSPSF (MAGC1_HUMAN)
LSIPVSPSI

SEQ ID NO: 90304 - protein, 9 aa, Artificial Sequence
  Description of Artificial Sequence: Synthetic peptide
  Seed: KDSQSPLQI (MAGC1_HUMAN)
KMSQSPLQI

SEQ ID NO: 90305 - protein, 8 aa, Artificial Sequence
  Description of Artificial Sequence: Synthetic peptide
  Seed: ITFPSSYK (MAGC1_HUMAN)
IMFPSSYR

SEQ ID NO: 90306 - protein, 10 aa, Artificial Sequence
  Description of Artificial Sequence: Synthetic peptide
  Seed: SRYTGYFPVI (MAGC1_HUMAN)
SHYTGYFPVF

SEQ ID NO: 90307 - protein, 9 aa, Artificial Sequence
  Description of Artificial Sequence: Synthetic peptide
  Seed: LSDEQGMSQ (MAGC1_HUMAN)
LFDEQGMSF

SEQ ID NO: 90308 - protein, 10 aa, Artificial Sequence
  Description of Artificial Sequence: Synthetic peptide
  Seed: LAMLKNTVPI (MAGC1_HUMAN)
LYMLKNTVPY

SEQ ID NO: 90309 - protein, 9 aa, Artificial Sequence
  Description of Artificial Sequence: Synthetic peptide
  Seed: SRYTGYFPV (MAGC1_HUMAN)
SYYTGYFPM

SEQ ID NO: 90310 - protein, 9 aa, Artificial Sequence
  Description of Artificial Sequence: Synthetic peptide
  Seed: SPVSSFPSS (MAGC1_HUMAN)
SPVSSFPSY

SEQ ID NO: 90311 - protein, 10 aa, Artificial Sequence
  Description of Artificial Sequence: Synthetic peptide
  Seed: MPTAGMPSLL (MAGC1_HUMAN)
MPTAGMPSLI

SEQ ID NO: 90312 - protein, 10 aa, Artificial Sequence
  Description of Artificial Sequence: Synthetic peptide
  Seed: LLQIPMTSSF (MAGC1_HUMAN)
LPQIPMTSSF

SEQ ID NO: 90313 - protein, 10 aa, Artificial Sequence
  Description of Artificial Sequence: Synthetic peptide
  Seed: PLQNPASSFF (MAGC1_HUMAN)
PKQNPASSFF

SEQ ID NO: 90314 - protein, 10 aa, Artificial Sequence
  Description of Artificial Sequence: Synthetic peptide
  Seed: SSFSYTLLSL (MAGC1_HUMAN)
SMFSYTLLST

SEQ ID NO: 90315 - protein, 10 aa, Artificial Sequence
  Description of Artificial Sequence: Synthetic peptide
  Seed: REFIEILFGI (MAGC1_HUMAN)
RYFIEILFGL

SEQ ID NO: 90316 - protein, 10 aa, Artificial Sequence
  Description of Artificial Sequence: Synthetic peptide
  Seed: RAGREHFAFG (MAGC1_HUMAN)
REGREHFAFA

SEQ ID NO: 90317 - protein, 10 aa, Artificial Sequence
  Description of Artificial Sequence: Synthetic peptide
  Seed: LQIPVSSSFS (MAGC1_HUMAN)
LTIPVSSSFF

SEQ ID NO: 90318 - protein, 10 aa, Artificial Sequence
  Description of Artificial Sequence: Synthetic peptide
  Seed: SSSSSTLLSL (MAGC1_HUMAN)
SVSSSTLLSL

SEQ ID NO: 90319 - protein, 9 aa, Artificial Sequence
  Description of Artificial Sequence: Synthetic peptide
  Seed: FPSSTSSSL (MAGC1_HUMAN)
FGSSTSSSL

SEQ ID NO: 90320 - protein, 9 aa, Artificial Sequence
  Description of Artificial Sequence: Synthetic peptide
  Seed: YTLASLLQS (MAGC1_HUMAN)
YLLASLLQA

SEQ ID NO: 90321 - protein, 9 aa, Artificial Sequence
  Description of Artificial Sequence: Synthetic peptide
  Seed: RAGREHFAF (MAGC1_HUMAN)
RMGREHFAF

SEQ ID NO: 90322 - protein, 9 aa, Artificial Sequence
  Description of Artificial Sequence: Synthetic peptide
  Seed: VSSSFSYTL (MAGC1_HUMAN)
VRSSFSYTY

SEQ ID NO: 90323 - protein, 11 aa, Artificial Sequence
  Description of Artificial Sequence: Synthetic peptide
  Seed: TATESASSSVM (MAGC1_HUMAN)
TATESASSSVY

SEQ ID NO: 90324 - protein, 10 aa, Artificial Sequence
  Description of Artificial Sequence: Synthetic peptide
  Seed: IPMTSSFSST (MAGC1_HUMAN)
IPMTSSFSSM

SEQ ID NO: 90325 - protein, 10 aa, Artificial Sequence
  Description of Artificial Sequence: Synthetic peptide
  Seed: LILILSIIFI (MAGC1_HUMAN)
LPLILSIIFV

SEQ ID NO: 90326 - protein, 10 aa, Artificial Sequence
  Description of Artificial Sequence: Synthetic peptide
  Seed: FFSYTLASLL (MAGC1_HUMAN)
FMSYTLASLM

SEQ ID NO: 90327 - protein, 11 aa, Artificial Sequence
  Description of Artificial Sequence: Synthetic peptide
  Seed: SPLQIPMTSSF (MAGC1_HUMAN)
SPLQIPMTSSM

SEQ ID NO: 90328 - protein, 10 aa, Artificial Sequence
  Description of Artificial Sequence: Synthetic peptide
  Seed: TGYFPVIFRK (MAGC1_HUMAN)
TTYFPVIFRP

SEQ ID NO: 90329 - protein, 10 aa, Artificial Sequence
  Description of Artificial Sequence: Synthetic peptide
  Seed: SFFSYTLASL (MAGC1_HUMAN)
SVFSYTLASL

SEQ ID NO: 90330 - protein, 9 aa, Artificial Sequence
  Description of Artificial Sequence: Synthetic peptide
  Seed: IIFIKGTYA (MAGC1_HUMAN)
IMFIKGTYM

SEQ ID NO: 90331 - protein, 11 aa, Artificial Sequence
  Description of Artificial Sequence: Synthetic peptide
  Seed: TVPITFPSSYK (MAGC1_HUMAN)
TMPITFPSSYR

SEQ ID NO: 90332 - protein, 10 aa, Artificial Sequence
  Description of Artificial Sequence: Synthetic peptide
  Seed: VISFSSSTSL (MAGC1_HUMAN)
VMSFSSSTSF

SEQ ID NO: 90333 - protein, 9 aa, Artificial Sequence
  Description of Artificial Sequence: Synthetic peptide
  Seed: SSPERTQST (MAGC1_HUMAN)
SPPERTQSL

SEQ ID NO: 90334 - protein, 9 aa, Artificial Sequence
  Description of Artificial Sequence: Synthetic peptide
  Seed: TPSSLPQSF (MAGC1_HUMAN)
TVSSLPQSF

SEQ ID NO: 90335 - protein, 11 aa, Artificial Sequence
  Description of Artificial Sequence: Synthetic peptide
  Seed: IPVSSSFSYTL (MAGC1_HUMAN)
INVSSSFSYTY

SEQ ID NO: 90336 - protein, 9 aa, Artificial Sequence
  Description of Artificial Sequence: Synthetic peptide
  Seed: VIWDVLSGI (MAGC1_HUMAN)
VIWDVLSGT

SEQ ID NO: 90337 - protein, 9 aa, Artificial Sequence
  Description of Artificial Sequence: Synthetic peptide
  Seed: VIKRKVVEF (MAGC1_HUMAN)
VSKRKVVEM

SEQ ID NO: 90338 - protein, 10 aa, Artificial Sequence
  Description of Artificial Sequence: Synthetic peptide
  Seed: LQIPMTSSFS (MAGC1_HUMAN)
LHIPMTSSFF

SEQ ID NO: 90339 - protein, 11 aa, Artificial Sequence
  Description of Artificial Sequence: Synthetic peptide
  Seed: REVDPDDSYVF (MAGC1_HUMAN)
RIVDPDDSYVM

SEQ ID NO: 90340 - protein, 9 aa, Artificial Sequence
  Description of Artificial Sequence: Synthetic peptide
  Seed: SSSSSSTLL (MAGC1_HUMAN)
SLSSSSTLY

SEQ ID NO: 90341 - protein, 10 aa, Artificial Sequence
  Description of Artificial Sequence: Synthetic peptide
  Seed: STSLSLPQSF (MAGC1_HUMAN)
SQSLSLPQSF

SEQ ID NO: 90342 - protein, 9 aa, Artificial Sequence
  Description of Artificial Sequence: Synthetic peptide
  Seed: SSPERTHST (MAGC1_HUMAN)
SVPERTHSY

SEQ ID NO: 90343 - protein, 9 aa, Artificial Sequence
  Description of Artificial Sequence: Synthetic peptide
  Seed: FPSSYKDAL (MAGC1_HUMAN)
FQSSYKDAY

SEQ ID NO: 90344 - protein, 10 aa, Artificial Sequence
  Description of Artificial Sequence: Synthetic peptide
  Seed: KYQVKQPITK (MAGC1_HUMAN)
KTQVKQPITR

SEQ ID NO: 90345 - protein, 9 aa, Artificial Sequence
  Description of Artificial Sequence: Synthetic peptide
  Seed: SSSSSSSTL (MAGC1_HUMAN)
SPSSSSSTY

SEQ ID NO: 90346 - protein, 10 aa, Artificial Sequence
  Description of Artificial Sequence: Synthetic peptide
  Seed: SSFSSTLLSI (MAGC1_HUMAN)
SLFSSTLLSI

SEQ ID NO: 90347 - protein, 9 aa, Artificial Sequence
  Description of Artificial Sequence: Synthetic peptide
  Seed: SSPERTHST (MAGC1_HUMAN)
SLPERTHSV

SEQ ID NO: 90348 - protein, 9 aa, Artificial Sequence
  Description of Artificial Sequence: Synthetic peptide
  Seed: SSSTLLSLF (MAGC1_HUMAN)
SLSTLLSLY

SEQ ID NO: 90349 - protein, 9 aa, Artificial Sequence
  Description of Artificial Sequence: Synthetic peptide
  Seed: YTSSSDTLL (MAGC1_HUMAN)
YTSSSDTLF

SEQ ID NO: 90350 - protein, 9 aa, Artificial Sequence
  Description of Artificial Sequence: Synthetic peptide
  Seed: EHFAFGEPR (MAGC1_HUMAN)
EMFAFGEPR

SEQ ID NO: 90351 - protein, 9 aa, Artificial Sequence
  Description of Artificial Sequence: Synthetic peptide
  Seed: MPSLLQSSS (MAGC1_HUMAN)
MLSLLQSSY

SEQ ID NO: 90352 - protein, 9 aa, Artificial Sequence
  Description of Artificial Sequence: Synthetic peptide
  Seed: MTSSFSSTL (MAGC1_HUMAN)
MASSFSSTM

SEQ ID NO: 90353 - protein, 9 aa, Artificial Sequence
  Description of Artificial Sequence: Synthetic peptide
  Seed: LQIPMTSSF (MAGC1_HUMAN)
LIIPMTSSL

SEQ ID NO: 90354 - protein, 11 aa, Artificial Sequence
  Description of Artificial Sequence: Synthetic peptide
  Seed: SFSSSTSLSPF (MAGC1_HUMAN)
SMSSSTSLSPW

SEQ ID NO: 90355 - protein, 9 aa, Artificial Sequence
  Description of Artificial Sequence: Synthetic peptide
  Seed: IFQSSPESA (MAGC1_HUMAN)
IYQSSPESI

SEQ ID NO: 90356 - protein, 11 aa, Artificial Sequence
  Description of Artificial Sequence: Synthetic peptide
  Seed: KVWVQEHYLEY (MAGC1_HUMAN)
KSWVQEHYLEF

SEQ ID NO: 90357 - protein, 10 aa, Artificial Sequence
  Description of Artificial Sequence: Synthetic peptide
  Seed: KGTYASEEVI (MAGC1_HUMAN)
KKTYASEEVW

SEQ ID NO: 90358 - protein, 9 aa, Artificial Sequence
  Description of Artificial Sequence: Synthetic peptide
  Seed: YQVKQPITK (MAGC1_HUMAN)
YNVKQPITF

SEQ ID NO: 90359 - protein, 9 aa, Artificial Sequence
  Description of Artificial Sequence: Synthetic peptide
  Seed: SSPEGKDSL (MAGC1_HUMAN)
SHPEGKDSL

SEQ ID NO: 90360 - protein, 9 aa, Artificial Sequence
  Description of Artificial Sequence: Synthetic peptide
  Seed: NTHSPLQIV (MAGC1_HUMAN)
NSHSPLQIY

SEQ ID NO: 90361 - protein, 9 aa, Artificial Sequence
  Description of Artificial Sequence: Synthetic peptide
  Seed: SSSFSYTLL (MAGC1_HUMAN)
SQSFSYTLL

SEQ ID NO: 90362 - protein, 9 aa, Artificial Sequence
  Description of Artificial Sequence: Synthetic peptide
  Seed: VLSGIGVRA (MAGC1_HUMAN)
VASGIGVRV

SEQ ID NO: 90363 - protein, 9 aa, Artificial Sequence
  Description of Artificial Sequence: Synthetic peptide
  Seed: SFFSYTLAS (MAGC1_HUMAN)
STFSYTLAM

SEQ ID NO: 90364 - protein, 10 aa, Artificial Sequence
  Description of Artificial Sequence: Synthetic peptide
  Seed: YTLASLLQSS (MAGC1_HUMAN)
YELASLLQST

SEQ ID NO: 90365 - protein, 9 aa, Artificial Sequence
  Description of Artificial Sequence: Synthetic peptide
  Seed: LSPLHFPQF (MAGC1_HUMAN)
LSPLHFPQI

SEQ ID NO: 90366 - protein, 10 aa, Artificial Sequence
  Description of Artificial Sequence: Synthetic peptide
  Seed: WGPRAHSEVI (MAGC1_HUMAN)
WHPRAHSEVV

SEQ ID NO: 90367 - protein, 8 aa, Artificial Sequence
  Description of Artificial Sequence: Synthetic peptide
  Seed: MPSLLQSS (MAGC1_HUMAN)
MPSLLQSA

SEQ ID NO: 90368 - protein, 10 aa, Artificial Sequence
  Description of Artificial Sequence: Synthetic peptide
  Seed: RAGREHFAFG (MAGC1_HUMAN)
RTGREHFAFK

SEQ ID NO: 90369 - protein, 9 aa, Artificial Sequence
  Description of Artificial Sequence: Synthetic peptide
  Seed: LSPLHFPQF (MAGC1_HUMAN)
LAPLHFPQL

SEQ ID NO: 90370 - protein, 9 aa, Artificial Sequence
  Description of Artificial Sequence: Synthetic peptide
  Seed: TSLSLPQSF (MAGC1_HUMAN)
TWLSLPQSF

SEQ ID NO: 90371 - protein, 9 aa, Artificial Sequence
  Description of Artificial Sequence: Synthetic peptide
  Seed: LSPLHFPQF (MAGC1_HUMAN)
LAPLHFPQV

SEQ ID NO: 90372 - protein, 9 aa, Artificial Sequence
  Description of Artificial Sequence: Synthetic peptide
  Seed: EGDDTQSPL (MAGC1_HUMAN)
EADDTQSPL

SEQ ID NO: 90373 - protein, 9 aa, Artificial Sequence
  Description of Artificial Sequence: Synthetic peptide
  Seed: SLLQSSHES (MAGC1_HUMAN)
SLLQSSHEM

SEQ ID NO: 90374 - protein, 11 aa, Artificial Sequence
  Description of Artificial Sequence: Synthetic peptide
  Seed: SPLQIPGSPSF (MAGC1_HUMAN)
STLQIPGSPSM

SEQ ID NO: 90375 - protein, 11 aa, Artificial Sequence
  Description of Artificial Sequence: Synthetic peptide
  Seed: SSFSSTLLSIL (MAGC1_HUMAN)
SMFSSTLLSIW

SEQ ID NO: 90376 - protein, 9 aa, Artificial Sequence
  Description of Artificial Sequence: Synthetic peptide
  Seed: SSPESPLQS (MAGC1_HUMAN)
SWPESPLQL

SEQ ID NO: 90377 - protein, 10 aa, Artificial Sequence
  Description of Artificial Sequence: Synthetic peptide
  Seed: VWVQEHYLEY (MAGC1_HUMAN)
VFVQEHYLEY

SEQ ID NO: 90378 - protein, 10 aa, Artificial Sequence
  Description of Artificial Sequence: Synthetic peptide
  Seed: YTLASLLQSS (MAGC1_HUMAN)
YRLASLLQSV

SEQ ID NO: 90379 - protein, 9 aa, Artificial Sequence
  Description of Artificial Sequence: Synthetic peptide
  Seed: FQSSLQSPV (MAGC1_HUMAN)
FKSSLQSPM

SEQ ID NO: 90380 - protein, 9 aa, Artificial Sequence
  Description of Artificial Sequence: Synthetic peptide
  Seed: SMSPLYFPQ (MAGC1_HUMAN)
SCSPLYFPR

SEQ ID NO: 90381 - protein, 10 aa, Artificial Sequence
  Description of Artificial Sequence: Synthetic peptide
  Seed: SSFSSTLLSI (MAGC1_HUMAN)
SMFSSTLLSF

SEQ ID NO: 90382 - protein, 9 aa, Artificial Sequence
  Description of Artificial Sequence: Synthetic peptide
  Seed: LQIVPSLPE (MAGC1_HUMAN)
LYIVPSLPF

SEQ ID NO: 90383 - protein, 9 aa, Artificial Sequence
  Description of Artificial Sequence: Synthetic peptide
  Seed: VPITFPSSY (MAGC1_HUMAN)
VSITFPSSL

SEQ ID NO: 90384 - protein, 9 aa, Artificial Sequence
  Description of Artificial Sequence: Synthetic peptide
  Seed: VSSSSSSTL (MAGC1_HUMAN)
VLSSSSSTW

SEQ ID NO: 90385 - protein, 11 aa, Artificial Sequence
  Description of Artificial Sequence: Synthetic peptide
  Seed: QSSPESDDTLY (MAGC1_HUMAN)
QPSPESDDTLY

SEQ ID NO: 90386 - protein, 10 aa, Artificial Sequence
  Description of Artificial Sequence: Synthetic peptide
  Seed: FPQSLLQIPM (MAGC1_HUMAN)
FLQSLLQIPF

SEQ ID NO: 90387 - protein, 9 aa, Artificial Sequence
  Description of Artificial Sequence: Synthetic peptide
  Seed: SSPESDDTL (MAGC1_HUMAN)
SLPESDDTM

SEQ ID NO: 90388 - protein, 10 aa, Artificial Sequence
  Description of Artificial Sequence: Synthetic peptide
  Seed: LSLFQSFSER (MAGC1_HUMAN)
LFLFQSFSER

SEQ ID NO: 90389 - protein, 9 aa, Artificial Sequence
  Description of Artificial Sequence: Synthetic peptide
  Seed: TTDDSTATE (MAGC1_HUMAN)
TVDDSTATM

SEQ ID NO: 90390 - protein, 9 aa, Artificial Sequence
  Description of Artificial Sequence: Synthetic peptide
  Seed: RAHSEVIKR (MAGC1_HUMAN)
RVHSEVIKR

SEQ ID NO: 90391 - protein, 9 aa, Artificial Sequence
  Description of Artificial Sequence: Synthetic peptide
  Seed: LQIPMTSSF (MAGC1_HUMAN)
LQIPMTSSM

SEQ ID NO: 90392 - protein, 10 aa, Artificial Sequence
  Description of Artificial Sequence: Synthetic peptide
  Seed: ILILSIIFIK (MAGC1_HUMAN)
IIILSIIFIK

SEQ ID NO: 90393 - protein, 10 aa, Artificial Sequence
  Description of Artificial Sequence: Synthetic peptide
  Seed: AASSSTLVSI (MAGC1_HUMAN)
AVSSSTLVSA

SEQ ID NO: 90394 - protein, 10 aa, Artificial Sequence
  Description of Artificial Sequence: Synthetic peptide
  Seed: TTDDSTATES (MAGC1_HUMAN)
TLDDSTATEL

SEQ ID NO: 90395 - protein, 11 aa, Artificial Sequence
  Description of Artificial Sequence: Synthetic peptide
  Seed: IPVSRSFSSTL (MAGC1_HUMAN)
IYVSRSFSSTY

SEQ ID NO: 90396 - protein, 9 aa, Artificial Sequence
  Description of Artificial Sequence: Synthetic peptide
  Seed: FFSYTLASL (MAGC1_HUMAN)
FYSYTLASH

SEQ ID NO: 90397 - protein, 10 aa, Artificial Sequence
  Description of Artificial Sequence: Synthetic peptide
  Seed: FAFGEPRELL (MAGC1_HUMAN)
FMFGEPRELI

SEQ ID NO: 90398 - protein, 9 aa, Artificial Sequence
  Description of Artificial Sequence: Synthetic peptide
  Seed: SSFFSSALL (MAGC1_HUMAN)
SFFFSSALK

SEQ ID NO: 90399 - protein, 9 aa, Artificial Sequence
  Description of Artificial Sequence: Synthetic peptide
  Seed: FEGFAQSSL (MAGC1_HUMAN)
FHGFAQSSL

SEQ ID NO: 90400 - protein, 10 aa, Artificial Sequence
  Description of Artificial Sequence: Synthetic peptide
  Seed: MTSSFSSTLL (MAGC1_HUMAN)
MWSSFSSTLY

SEQ ID NO: 90401 - protein, 11 aa, Artificial Sequence
  Description of Artificial Sequence: Synthetic peptide
  Seed: SAASSSTLVSI (MAGC1_HUMAN)
STASSSTLVSF

SEQ ID NO: 90402 - protein, 9 aa, Artificial Sequence
  Description of Artificial Sequence: Synthetic peptide
  Seed: LSDEQGMSQ (MAGC1_HUMAN)
LADEQGMST

SEQ ID NO: 90403 - protein, 9 aa, Artificial Sequence
  Description of Artificial Sequence: Synthetic peptide
  Seed: SLFQSFSER (MAGC1_HUMAN)
SPFQSFSER

SEQ ID NO: 90404 - protein, 9 aa, Artificial Sequence
  Description of Artificial Sequence: Synthetic peptide
  Seed: SSPERTQST (MAGC1_HUMAN)
SQPERTQSF

SEQ ID NO: 90405 - protein, 9 aa, Artificial Sequence
  Description of Artificial Sequence: Synthetic peptide
  Seed: ASSFFSSAL (MAGC1_HUMAN)
ATSFFSSAF

SEQ ID NO: 90406 - protein, 11 aa, Artificial Sequence
  Description of Artificial Sequence: Synthetic peptide
  Seed: SSFPSSTSSSL (MAGC1_HUMAN)
SVFPSSTSSSW

SEQ ID NO: 90407 - protein, 10 aa, Artificial Sequence
  Description of Artificial Sequence: Synthetic peptide
  Seed: FFSYTLASLL (MAGC1_HUMAN)
FLSYTLASLC

SEQ ID NO: 90408 - protein, 9 aa, Artificial Sequence
  Description of Artificial Sequence: Synthetic peptide
  Seed: RLLILILSI (MAGC1_HUMAN)
RVLILILSW

SEQ ID NO: 90409 - protein, 10 aa, Artificial Sequence
  Description of Artificial Sequence: Synthetic peptide
  Seed: FQSSLQSPVS (MAGC1_HUMAN)
FLSSLQSPVW

SEQ ID NO: 90410 - protein, 10 aa, Artificial Sequence
  Description of Artificial Sequence: Synthetic peptide
  Seed: IPVSPSFSST (MAGC1_HUMAN)
IPVSPSFSSL

SEQ ID NO: 90411 - protein, 9 aa, Artificial Sequence
  Description of Artificial Sequence: Synthetic peptide
  Seed: SPPEGENTH (MAGC1_HUMAN)
SPPEGENTF

SEQ ID NO: 90412 - protein, 10 aa, Artificial Sequence
  Description of Artificial Sequence: Synthetic peptide
  Seed: SSPERTQSTF (MAGC1_HUMAN)
SVPERTQSTM

SEQ ID NO: 90413 - protein, 9 aa, Artificial Sequence
  Description of Artificial Sequence: Synthetic peptide
  Seed: SPERTQSTF (MAGC1_HUMAN)
SPERTQSTM

SEQ ID NO: 90414 - protein, 10 aa, Artificial Sequence
  Description of Artificial Sequence: Synthetic peptide
  Seed: YTLASLLQSS (MAGC1_HUMAN)
YYLASLLQSV

SEQ ID NO: 90415 - protein, 9 aa, Artificial Sequence
  Description of Artificial Sequence: Synthetic peptide
  Seed: SSSSTLLSL (MAGC1_HUMAN)
SWSSTLLSI

SEQ ID NO: 90416 - protein, 9 aa, Artificial Sequence
  Description of Artificial Sequence: Synthetic peptide
  Seed: SSSSSSSTL (MAGC1_HUMAN)
SMSSSSSTY

SEQ ID NO: 90417 - protein, 9 aa, Artificial Sequence
  Description of Artificial Sequence: Synthetic peptide
  Seed: RLLILILSI (MAGC1_HUMAN)
RLLILILSR

SEQ ID NO: 90418 - protein, 9 aa, Artificial Sequence
  Description of Artificial Sequence: Synthetic peptide
  Seed: LLSLFQSFS (MAGC1_HUMAN)
LVSLFQSFL

SEQ ID NO: 90419 - protein, 9 aa, Artificial Sequence
  Description of Artificial Sequence: Synthetic peptide
  Seed: LQIPVSAAS (MAGC1_HUMAN)
LKIPVSAAM

SEQ ID NO: 90420 - protein, 10 aa, Artificial Sequence
  Description of Artificial Sequence: Synthetic peptide
  Seed: VISFSSSTSL (MAGC1_HUMAN)
VHSFSSSTSW

SEQ ID NO: 90421 - protein, 9 aa, Artificial Sequence
  Description of Artificial Sequence: Synthetic peptide
  Seed: GFPQSPLQI (MAGC1_HUMAN)
GTPQSPLQL

SEQ ID NO: 90422 - protein, 10 aa, Artificial Sequence
  Description of Artificial Sequence: Synthetic peptide
  Seed: QIPVSSSFSY (MAGC1_HUMAN)
QDPVSSSFSY

SEQ ID NO: 90423 - protein, 10 aa, Artificial Sequence
  Description of Artificial Sequence: Synthetic peptide
  Seed: EMLTNVISRY (MAGC1_HUMAN)
EALTNVISRK

SEQ ID NO: 90424 - protein, 10 aa, Artificial Sequence
  Description of Artificial Sequence: Synthetic peptide
  Seed: ICSSSTSLSL (MAGC1_HUMAN)
IVSSSTSLSY

SEQ ID NO: 90425 - protein, 9 aa, Artificial Sequence
  Description of Artificial Sequence: Synthetic peptide
  Seed: FSYTLASLL (MAGC1_HUMAN)
FRYTLASLM

SEQ ID NO: 90426 - protein, 9 aa, Artificial Sequence
  Description of Artificial Sequence: Synthetic peptide
  Seed: IIDTTDDST (MAGC1_HUMAN)
IMDTTDDSV

SEQ ID NO: 90427 - protein, 9 aa, Artificial Sequence
  Description of Artificial Sequence: Synthetic peptide
  Seed: REVPNSSPP (MAGC1_HUMAN)
REVPNSSPM

SEQ ID NO: 90428 - protein, 9 aa, Artificial Sequence
  Description of Artificial Sequence: Synthetic peptide
  Seed: MTSSFSSTL (MAGC1_HUMAN)
MFSSFSSTL

SEQ ID NO: 90429 - protein, 9 aa, Artificial Sequence
  Description of Artificial Sequence: Synthetic peptide
  Seed: FEGFAQSPL (MAGC1_HUMAN)
FQGFAQSPW

SEQ ID NO: 90430 - protein, 9 aa, Artificial Sequence
  Description of Artificial Sequence: Synthetic peptide
  Seed: HFPQSPPEW (MAGC1_HUMAN)
HLPQSPPEM

SEQ ID NO: 90431 - protein, 10 aa, Artificial Sequence
  Description of Artificial Sequence: Synthetic peptide
  Seed: SFSSTLLSIL (MAGC1_HUMAN)
SCSSTLLSIW

SEQ ID NO: 90432 - protein, 10 aa, Artificial Sequence
  Description of Artificial Sequence: Synthetic peptide
  Seed: QGEDSMSPLY (MAGC1_HUMAN)
QYEDSMSPLW

SEQ ID NO: 90433 - protein, 11 aa, Artificial Sequence
  Description of Artificial Sequence: Synthetic peptide
  Seed: LQIPVSSSFSY (MAGC1_HUMAN)
LRIPVSSSFSW

SEQ ID NO: 90434 - protein, 9 aa, Artificial Sequence
  Description of Artificial Sequence: Synthetic peptide
  Seed: VSRSFSSTL (MAGC1_HUMAN)
VWRSFSSTK

SEQ ID NO: 90435 - protein, 9 aa, Artificial Sequence
  Description of Artificial Sequence: Synthetic peptide
  Seed: RTQSTFEGF (MAGC1_HUMAN)
RLQSTFEGY

SEQ ID NO: 90436 - protein, 10 aa, Artificial Sequence
  Description of Artificial Sequence: Synthetic peptide
  Seed: SSPERTHSTF (MAGC1_HUMAN)
SYPERTHSTM

SEQ ID NO: 90437 - protein, 9 aa, Artificial Sequence
  Description of Artificial Sequence: Synthetic peptide
  Seed: SQNRLLILI (MAGC1_HUMAN)
SHNRLLILF

SEQ ID NO: 90438 - protein, 11 aa, Artificial Sequence
  Description of Artificial Sequence: Synthetic peptide
  Seed: KVWVQEHYLEY (MAGC1_HUMAN)
KTWVQEHYLEM

SEQ ID NO: 90439 - protein, 10 aa, Artificial Sequence
  Description of Artificial Sequence: Synthetic peptide
  Seed: MTSSFSSTLL (MAGC1_HUMAN)
MTSSFSSTLV

SEQ ID NO: 90440 - protein, 9 aa, Artificial Sequence
  Description of Artificial Sequence: Synthetic peptide
  Seed: AGREHFAFG (MAGC1_HUMAN)
AFREHFAFV

SEQ ID NO: 90441 - protein, 9 aa, Artificial Sequence
  Description of Artificial Sequence: Synthetic peptide
  Seed: SQNRLLILI (MAGC1_HUMAN)
SQNRLLILW

SEQ ID NO: 90442 - protein, 9 aa, Artificial Sequence
  Description of Artificial Sequence: Synthetic peptide
  Seed: WVQEHYLEY (MAGC1_HUMAN)
WVQEHYLER

SEQ ID NO: 90443 - protein, 9 aa, Artificial Sequence
  Description of Artificial Sequence: Synthetic peptide
  Seed: MSQNRLLIL (MAGC1_HUMAN)
MRQNRLLIY

SEQ ID NO: 90444 - protein, 10 aa, Artificial Sequence
  Description of Artificial Sequence: Synthetic peptide
  Seed: SFSERTQSTF (MAGC1_HUMAN)
SYSERTQSTI

SEQ ID NO: 90445 - protein, 10 aa, Artificial Sequence
  Description of Artificial Sequence: Synthetic peptide
  Seed: PLQIPGSPSF (MAGC1_HUMAN)
PYQIPGSPSY

SEQ ID NO: 90446 - protein, 9 aa, Artificial Sequence
  Description of Artificial Sequence: Synthetic peptide
  Seed: SAASSSTLV (MAGC1_HUMAN)
SSASSSTLV

SEQ ID NO: 90447 - protein, 10 aa, Artificial Sequence
  Description of Artificial Sequence: Synthetic peptide
  Seed: VSSSSSSTLL (MAGC1_HUMAN)
VMSSSSSTLF

SEQ ID NO: 90448 - protein, 11 aa, Artificial Sequence
  Description of Artificial Sequence: Synthetic peptide
  Seed: SSFPSSTSSSL (MAGC1_HUMAN)
SVFPSSTSSSY

SEQ ID NO: 90449 - protein, 11 aa, Artificial Sequence
  Description of Artificial Sequence: Synthetic peptide
  Seed: SSFSYTLLSLF (MAGC1_HUMAN)
SVFSYTLLSLW

SEQ ID NO: 90450 - protein, 10 aa, Artificial Sequence
  Description of Artificial Sequence: Synthetic peptide
  Seed: RTHSTFEGFP (MAGC1_HUMAN)
RGHSTFEGFK

SEQ ID NO: 90451 - protein, 11 aa, Artificial Sequence
  Description of Artificial Sequence: Synthetic peptide
  Seed: LQIPVSSSFSY (MAGC1_HUMAN)
LVIPVSSSFSY

SEQ ID NO: 90452 - protein, 9 aa, Artificial Sequence
  Description of Artificial Sequence: Synthetic peptide
  Seed: SSSSTLLSL (MAGC1_HUMAN)
SLSSTLLSA

SEQ ID NO: 90453 - protein, 9 aa, Artificial Sequence
  Description of Artificial Sequence: Synthetic peptide
  Seed: AQSPLQIPV (MAGC1_HUMAN)
AASPLQIPI

SEQ ID NO: 90454 - protein, 10 aa, Artificial Sequence
  Description of Artificial Sequence: Synthetic peptide
  Seed: EVIWDVLSGI (MAGC1_HUMAN)
ETIWDVLSGS

SEQ ID NO: 90455 - protein, 10 aa, Artificial Sequence
  Description of Artificial Sequence: Synthetic peptide
  Seed: LQNPASSFFS (MAGC1_HUMAN)
LLNPASSFFF

SEQ ID NO: 90456 - protein, 11 aa, Artificial Sequence
  Description of Artificial Sequence: Synthetic peptide
  Seed: GYFPVIFRKAR (MAGC1_HUMAN)
GMFPVIFRKAR

SEQ ID NO: 90457 - protein, 10 aa, Artificial Sequence
  Description of Artificial Sequence: Synthetic peptide
  Seed: VSSSFSYTLL (MAGC1_HUMAN)
VISSFSYTLF

SEQ ID NO: 90458 - protein, 11 aa, Artificial Sequence
  Description of Artificial Sequence: Synthetic peptide
  Seed: SPLQIPGSPSF (MAGC1_HUMAN)
SILQIPGSPSF

SEQ ID NO: 90459 - protein, 9 aa, Artificial Sequence
  Description of Artificial Sequence: Synthetic peptide
  Seed: KVVEFLAML (MAGC1_HUMAN)
KIVEFLAMW

SEQ ID NO: 90460 - protein, 9 aa, Artificial Sequence
  Description of Artificial Sequence: Synthetic peptide
  Seed: LQIPVSAAS (MAGC1_HUMAN)
LMIPVSAAV

SEQ ID NO: 90461 - protein, 9 aa, Artificial Sequence
  Description of Artificial Sequence: Synthetic peptide
  Seed: VSAASSSTL (MAGC1_HUMAN)
VSAASSSTI

SEQ ID NO: 90462 - protein, 9 aa, Artificial Sequence
  Description of Artificial Sequence: Synthetic peptide
  Seed: NTVPITFPS (MAGC1_HUMAN)
NVVPITFPT

SEQ ID NO: 90463 - protein, 9 aa, Artificial Sequence
  Description of Artificial Sequence: Synthetic peptide
  Seed: IPMTSSFSS (MAGC1_HUMAN)
IAMTSSFSY

SEQ ID NO: 90464 - protein, 9 aa, Artificial Sequence
  Description of Artificial Sequence: Synthetic peptide
  Seed: CSSSTPSSL (MAGC1_HUMAN)
CQSSTPSSF

SEQ ID NO: 90465 - protein, 9 aa, Artificial Sequence
  Description of Artificial Sequence: Synthetic peptide
  Seed: ASSFFSSAL (MAGC1_HUMAN)
AMSFFSSAI

SEQ ID NO: 90466 - protein, 10 aa, Artificial Sequence
  Description of Artificial Sequence: Synthetic peptide
  Seed: KAREFIEILF (MAGC1_HUMAN)
KWREFIEILY

SEQ ID NO: 90467 - protein, 9 aa, Artificial Sequence
  Description of Artificial Sequence: Synthetic peptide
  Seed: VISRYTGYF (MAGC1_HUMAN)
VMSRYTGYM

SEQ ID NO: 90468 - protein, 10 aa, Artificial Sequence
  Description of Artificial Sequence: Synthetic peptide
  Seed: REVDPDDSYV (MAGC1_HUMAN)
RIVDPDDSYW

SEQ ID NO: 90469 - protein, 9 aa, Artificial Sequence
  Description of Artificial Sequence: Synthetic peptide
  Seed: TFEGFPQSL (MAGC1_HUMAN)
TWEGFPQSL

SEQ ID NO: 90470 - protein, 9 aa, Artificial Sequence
  Description of Artificial Sequence: Synthetic peptide
  Seed: TYASEEVIW (MAGC1_HUMAN)
TSASEEVIW

SEQ ID NO: 90471 - protein, 10 aa, Artificial Sequence
  Description of Artificial Sequence: Synthetic peptide
  Seed: SLQIPVSPSF (MAGC1_HUMAN)
SFQIPVSPSF

SEQ ID NO: 90472 - protein, 10 aa, Artificial Sequence
  Description of Artificial Sequence: Synthetic peptide
  Seed: KVVEFLAMLK (MAGC1_HUMAN)
KLVEFLAMLR

SEQ ID NO: 90473 - protein, 10 aa, Artificial Sequence
  Description of Artificial Sequence: Synthetic peptide
  Seed: SSPESAQSAF (MAGC1_HUMAN)
SAPESAQSAI

SEQ ID NO: 90474 - protein, 10 aa, Artificial Sequence
  Description of Artificial Sequence: Synthetic peptide
  Seed: SQSSPVSSFP (MAGC1_HUMAN)
SMSSPVSSFF

SEQ ID NO: 90475 - protein, 9 aa, Artificial Sequence
  Description of Artificial Sequence: Synthetic peptide
  Seed: LKYQVKQPI (MAGC1_HUMAN)
LRYQVKQPY

SEQ ID NO: 90476 - protein, 9 aa, Artificial Sequence
  Description of Artificial Sequence: Synthetic peptide
  Seed: LKNTVPITF (MAGC1_HUMAN)
LQNTVPITF

SEQ ID NO: 90477 - protein, 11 aa, Artificial Sequence
  Description of Artificial Sequence: Synthetic peptide
  Seed: IPVSRSFSSTL (MAGC1_HUMAN)
IDVSRSFSSTY

SEQ ID NO: 90478 - protein, 9 aa, Artificial Sequence
  Description of Artificial Sequence: Synthetic peptide
  Seed: ESDDTLYPL (MAGC1_HUMAN)
EADDTLYPI

SEQ ID NO: 90479 - protein, 8 aa, Artificial Sequence
  Description of Artificial Sequence: Synthetic peptide
  Seed: RSFSSTLL (MAGC1_HUMAN)
RVFSSTLF

SEQ ID NO: 90480 - protein, 9 aa, Artificial Sequence
  Description of Artificial Sequence: Synthetic peptide
  Seed: SPPEGENTH (MAGC1_HUMAN)
SLPEGENTL

SEQ ID NO: 90481 - protein, 9 aa, Artificial Sequence
  Description of Artificial Sequence: Synthetic peptide
  Seed: AQSPLQRPV (MAGC1_HUMAN)
ASSPLQRPY

SEQ ID NO: 90482 - protein, 9 aa, Artificial Sequence
  Description of Artificial Sequence: Synthetic peptide
  Seed: VSRSFSSTL (MAGC1_HUMAN)
VERSFSSTY

SEQ ID NO: 90483 - protein, 9 aa, Artificial Sequence
  Description of Artificial Sequence: Synthetic peptide
  Seed: LQIPMTSSF (MAGC1_HUMAN)
LAIPMTSSM

SEQ ID NO: 90484 - protein, 11 aa, Artificial Sequence
  Description of Artificial Sequence: Synthetic peptide
  Seed: AMLKNTVPITF (MAGC1_HUMAN)
AWLKNTVPITF

SEQ ID NO: 90485 - protein, 10 aa, Artificial Sequence
  Description of Artificial Sequence: Synthetic peptide
  Seed: PLQIPVSSSF (MAGC1_HUMAN)
PHQIPVSSSM

SEQ ID NO: 90486 - protein, 10 aa, Artificial Sequence
  Description of Artificial Sequence: Synthetic peptide
  Seed: SSSSSTLLSL (MAGC1_HUMAN)
SLSSSTLLSI

SEQ ID NO: 90487 - protein, 10 aa, Artificial Sequence
  Description of Artificial Sequence: Synthetic peptide
  Seed: TTDDSTATES (MAGC1_HUMAN)
TIDDSTATEM

SEQ ID NO: 90488 - protein, 9 aa, Artificial Sequence
  Description of Artificial Sequence: Synthetic peptide
  Seed: GFPQSVLQI (MAGC1_HUMAN)
GLPQSVLQL

SEQ ID NO: 90489 - protein, 11 aa, Artificial Sequence
  Description of Artificial Sequence: Synthetic peptide
  Seed: IPVSAASSSTL (MAGC1_HUMAN)
IRVSAASSSTW

SEQ ID NO: 90490 - protein, 9 aa, Artificial Sequence
  Description of Artificial Sequence: Synthetic peptide
  Seed: SSTSSSLSK (MAGC1_HUMAN)
STTSSSLSY

SEQ ID NO: 90491 - protein, 10 aa, Artificial Sequence
  Description of Artificial Sequence: Synthetic peptide
  Seed: MPTAGMPSLL (MAGC1_HUMAN)
MSTAGMPSLI

SEQ ID NO: 90492 - protein, 10 aa, Artificial Sequence
  Description of Artificial Sequence: Synthetic peptide
  Seed: RAGREHFAFG (MAGC1_HUMAN)
RAGREHFAFS

SEQ ID NO: 90493 - protein, 10 aa, Artificial Sequence
  Description of Artificial Sequence: Synthetic peptide
  Seed: FPQSPLQIPV (MAGC1_HUMAN)
FDQSPLQIPL

SEQ ID NO: 90494 - protein, 10 aa, Artificial Sequence
  Description of Artificial Sequence: Synthetic peptide
  Seed: PLQIPMTSSF (MAGC1_HUMAN)
PLQIPMTSSY

SEQ ID NO: 90495 - protein, 9 aa, Artificial Sequence
  Description of Artificial Sequence: Synthetic peptide
  Seed: MGDKDMPTA (MAGC1_HUMAN)
MYDKDMPTM

SEQ ID NO: 90496 - protein, 9 aa, Artificial Sequence
  Description of Artificial Sequence: Synthetic peptide
  Seed: FSSALLSIF (MAGC1_HUMAN)
FMSALLSIY

SEQ ID NO: 90497 - protein, 10 aa, Artificial Sequence
  Description of Artificial Sequence: Synthetic peptide
  Seed: LLQIPMTSSF (MAGC1_HUMAN)
LTQIPMTSSL

SEQ ID NO: 90498 - protein, 9 aa, Artificial Sequence
  Description of Artificial Sequence: Synthetic peptide
  Seed: KVVEFLAML (MAGC1_HUMAN)
KSVEFLAMA

SEQ ID NO: 90499 - protein, 9 aa, Artificial Sequence
  Description of Artificial Sequence: Synthetic peptide
  Seed: TLDEKVDEL (MAGC1_HUMAN)
TMDEKVDEV

SEQ ID NO: 90500 - protein, 9 aa, Artificial Sequence
  Description of Artificial Sequence: Synthetic peptide
  Seed: FQSSLQSPV (MAGC1_HUMAN)
FTSSLQSPF

SEQ ID NO: 90501 - protein, 9 aa, Artificial Sequence
  Description of Artificial Sequence: Synthetic peptide
  Seed: LQIPMTSSF (MAGC1_HUMAN)
LAIPMTSSH

SEQ ID NO: 90502 - protein, 10 aa, Artificial Sequence
  Description of Artificial Sequence: Synthetic peptide
  Seed: SRYTGYFPVI (MAGC1_HUMAN)
SFYTGYFPVF

SEQ ID NO: 90503 - protein, 10 aa, Artificial Sequence
  Description of Artificial Sequence: Synthetic peptide
  Seed: YTLDEKVDEL (MAGC1_HUMAN)
YILDEKVDEV

SEQ ID NO: 90504 - protein, 9 aa, Artificial Sequence
  Description of Artificial Sequence: Synthetic peptide
  Seed: SLSPFSEES (MAGC1_HUMAN)
SLSPFSEEM

SEQ ID NO: 90505 - protein, 10 aa, Artificial Sequence
  Description of Artificial Sequence: Synthetic peptide
  Seed: ATESASSSVM (MAGC1_HUMAN)
AGESASSSVF

SEQ ID NO: 90506 - protein, 10 aa, Artificial Sequence
  Description of Artificial Sequence: Synthetic peptide
  Seed: VSAASSSTLV (MAGC1_HUMAN)
VIAASSSTLV

SEQ ID NO: 90507 - protein, 9 aa, Artificial Sequence
  Description of Artificial Sequence: Synthetic peptide
  Seed: KAREFIEIL (MAGC1_HUMAN)
KFREFIEIM

SEQ ID NO: 90508 - protein, 11 aa, Artificial Sequence
  Description of Artificial Sequence: Synthetic peptide
  Seed: NTVPITFPSSY (MAGC1_HUMAN)
NSVPITFPSSF

SEQ ID NO: 90509 - protein, 9 aa, Artificial Sequence
  Description of Artificial Sequence: Synthetic peptide
  Seed: VSSSFSYTL (MAGC1_HUMAN)
VTSSFSYTW

SEQ ID NO: 90510 - protein, 10 aa, Artificial Sequence
  Description of Artificial Sequence: Synthetic peptide
  Seed: YTLASLLQSS (MAGC1_HUMAN)
YTLASLLQST

SEQ ID NO: 90511 - protein, 10 aa, Artificial Sequence
  Description of Artificial Sequence: Synthetic peptide
  Seed: LLQIPMTSSF (MAGC1_HUMAN)
LFQIPMTSSM

SEQ ID NO: 90512 - protein, 9 aa, Artificial Sequence
  Description of Artificial Sequence: Synthetic peptide
  Seed: SSSSTLLSL (MAGC1_HUMAN)
SASSTLLSI

SEQ ID NO: 90513 - protein, 10 aa, Artificial Sequence
  Description of Artificial Sequence: Synthetic peptide
  Seed: SLSPLHFPQF (MAGC1_HUMAN)
SWSPLHFPQI

SEQ ID NO: 90514 - protein, 9 aa, Artificial Sequence
  Description of Artificial Sequence: Synthetic peptide
  Seed: FPSSYKDAL (MAGC1_HUMAN)
FPSSYKDAM

SEQ ID NO: 90515 - protein, 11 aa, Artificial Sequence
  Description of Artificial Sequence: Synthetic peptide
  Seed: SSTPSSLPQSF (MAGC1_HUMAN)
SQTPSSLPQSY

SEQ ID NO: 90516 - protein, 9 aa, Artificial Sequence
  Description of Artificial Sequence: Synthetic peptide
  Seed: SSPECTQST (MAGC1_HUMAN)
SQPECTQSL

SEQ ID NO: 90517 - protein, 9 aa, Artificial Sequence
  Description of Artificial Sequence: Synthetic peptide
  Seed: ELARFLLLK (MAGC1_HUMAN)
ETARFLLLK

SEQ ID NO: 90518 - protein, 9 aa, Artificial Sequence
  Description of Artificial Sequence: Synthetic peptide
  Seed: EILFGISLR (MAGC1_HUMAN)
EILFGISLK

SEQ ID NO: 90519 - protein, 11 aa, Artificial Sequence
  Description of Artificial Sequence: Synthetic peptide
  Seed: SPLQRPVSSFF (MAGC1_HUMAN)
SDLQRPVSSFF

SEQ ID NO: 90520 - protein, 9 aa, Artificial Sequence
  Description of Artificial Sequence: Synthetic peptide
  Seed: SLIESEPLF (MAGC1_HUMAN)
SIIESEPLI

SEQ ID NO: 90521 - protein, 9 aa, Artificial Sequence
  Description of Artificial Sequence: Synthetic peptide
  Seed: ISFSSSTSL (MAGC1_HUMAN)
IWFSSSTSI

SEQ ID NO: 90522 - protein, 9 aa, Artificial Sequence
  Description of Artificial Sequence: Synthetic peptide
  Seed: FAFGEPREL (MAGC1_HUMAN)
FDFGEPREF

SEQ ID NO: 90523 - protein, 10 aa, Artificial Sequence
  Description of Artificial Sequence: Synthetic peptide
  Seed: KRKVVEFLAM (MAGC1_HUMAN)
KGKVVEFLAY

SEQ ID NO: 90524 - protein, 10 aa, Artificial Sequence
  Description of Artificial Sequence: Synthetic peptide
  Seed: FQSSLQSPVS (MAGC1_HUMAN)
FLSSLQSPVH

SEQ ID NO: 90525 - protein, 9 aa, Artificial Sequence
  Description of Artificial Sequence: Synthetic peptide
  Seed: HFPQSPPEW (MAGC1_HUMAN)
HFPQSPPEV

SEQ ID NO: 90526 - protein, 9 aa, Artificial Sequence
  Description of Artificial Sequence: Synthetic peptide
  Seed: TLDLTSEGC (MAGC1_HUMAN)
TFDLTSEGM

SEQ ID NO: 90527 - protein, 10 aa, Artificial Sequence
  Description of Artificial Sequence: Synthetic peptide
  Seed: FFSYTLASLL (MAGC1_HUMAN)
FASYTLASLV

SEQ ID NO: 90528 - protein, 10 aa, Artificial Sequence
  Description of Artificial Sequence: Synthetic peptide
  Seed: LQIPMTSSFS (MAGC1_HUMAN)
LHIPMTSSFY

SEQ ID NO: 90529 - protein, 9 aa, Artificial Sequence
  Description of Artificial Sequence: Synthetic peptide
  Seed: SSSSTLLSL (MAGC1_HUMAN)
STSSTLLSI

SEQ ID NO: 90530 - protein, 9 aa, Artificial Sequence
  Description of Artificial Sequence: Synthetic peptide
  Seed: TTDDSTATE (MAGC1_HUMAN)
TPDDSTATM

SEQ ID NO: 90531 - protein, 9 aa, Artificial Sequence
  Description of Artificial Sequence: Synthetic peptide
  Seed: MLTNVISRY (MAGC1_HUMAN)
MATNVISRF

SEQ ID NO: 90532 - protein, 9 aa, Artificial Sequence
  Description of Artificial Sequence: Synthetic peptide
  Seed: LSDEQGMSQ (MAGC1_HUMAN)
LQDEQGMSV

SEQ ID NO: 90533 - protein, 9 aa, Artificial Sequence
  Description of Artificial Sequence: Synthetic peptide
  Seed: VSSFFSYTL (MAGC1_HUMAN)
VVSFFSYTF

SEQ ID NO: 90534 - protein, 9 aa, Artificial Sequence
  Description of Artificial Sequence: Synthetic peptide
  Seed: SSLSQSSPV (MAGC1_HUMAN)
SALSQSSPF

SEQ ID NO: 90535 - protein, 9 aa, Artificial Sequence
  Description of Artificial Sequence: Synthetic peptide
  Seed: TLDEKVDEL (MAGC1_HUMAN)
TWDEKVDEF

SEQ ID NO: 90536 - protein, 11 aa, Artificial Sequence
  Description of Artificial Sequence: Synthetic peptide
  Seed: SFSSSTSLSPF (MAGC1_HUMAN)
SSSSSTSLSPF

SEQ ID NO: 90537 - protein, 9 aa, Artificial Sequence
  Description of Artificial Sequence: Synthetic peptide
  Seed: VSAASSSTL (MAGC1_HUMAN)
VQAASSSTH

SEQ ID NO: 90538 - protein, 10 aa, Artificial Sequence
  Description of Artificial Sequence: Synthetic peptide
  Seed: EVIWDVLSGI (MAGC1_HUMAN)
ESIWDVLSGL

SEQ ID NO: 90539 - protein, 9 aa, Artificial Sequence
  Description of Artificial Sequence: Synthetic peptide
  Seed: SSPERTHST (MAGC1_HUMAN)
SYPERTHSY

SEQ ID NO: 90540 - protein, 10 aa, Artificial Sequence
  Description of Artificial Sequence: Synthetic peptide
  Seed: SSPERTQSTF (MAGC1_HUMAN)
SYPERTQSTY

SEQ ID NO: 90541 - protein, 9 aa, Artificial Sequence
  Description of Artificial Sequence: Synthetic peptide
  Seed: SSFFSSALL (MAGC1_HUMAN)
SIFFSSALK

SEQ ID NO: 90542 - protein, 9 aa, Artificial Sequence
  Description of Artificial Sequence: Synthetic peptide
  Seed: AQSPLQSPV (MAGC1_HUMAN)
AHSPLQSPA

SEQ ID NO: 90543 - protein, 10 aa, Artificial Sequence
  Description of Artificial Sequence: Synthetic peptide
  Seed: SSPESAQSAF (MAGC1_HUMAN)
SVPESAQSAI

SEQ ID NO: 90544 - protein, 9 aa, Artificial Sequence
  Description of Artificial Sequence: Synthetic peptide
  Seed: STFEGFPQS (MAGC1_HUMAN)
SPFEGFPQV

SEQ ID NO: 90545 - protein, 11 aa, Artificial Sequence
  Description of Artificial Sequence: Synthetic peptide
  Seed: IPVSRSFSSTL (MAGC1_HUMAN)
IIVSRSFSSTY

SEQ ID NO: 90546 - protein, 10 aa, Artificial Sequence
  Description of Artificial Sequence: Synthetic peptide
  Seed: LTKVWVQEHY (MAGC1_HUMAN)
LMKVWVQEHY

SEQ ID NO: 90547 - protein, 10 aa, Artificial Sequence
  Description of Artificial Sequence: Synthetic peptide
  Seed: FPQSPLQIPV (MAGC1_HUMAN)
FFQSPLQIPL

SEQ ID NO: 90548 - protein, 9 aa, Artificial Sequence
  Description of Artificial Sequence: Synthetic peptide
  Seed: LQIVPSLPE (MAGC1_HUMAN)
LQIVPSLPW

SEQ ID NO: 90549 - protein, 10 aa, Artificial Sequence
  Description of Artificial Sequence: Synthetic peptide
  Seed: SPLYFPQSPL (MAGC1_HUMAN)
SCLYFPQSPV

SEQ ID NO: 90550 - protein, 9 aa, Artificial Sequence
  Description of Artificial Sequence: Synthetic peptide
  Seed: MTSSFSSTL (MAGC1_HUMAN)
MTSSFSSTK

SEQ ID NO: 90551 - protein, 9 aa, Artificial Sequence
  Description of Artificial Sequence: Synthetic peptide
  Seed: VIWDVLSGI (MAGC1_HUMAN)
VVWDVLSGA

SEQ ID NO: 90552 - protein, 10 aa, Artificial Sequence
  Description of Artificial Sequence: Synthetic peptide
  Seed: ILILSIIFIK (MAGC1_HUMAN)
IWILSIIFIR

SEQ ID NO: 90553 - protein, 11 aa, Artificial Sequence
  Description of Artificial Sequence: Synthetic peptide
  Seed: SASSSVMSPSF (MAGC1_HUMAN)
STSSSVMSPSF

SEQ ID NO: 90554 - protein, 10 aa, Artificial Sequence
  Description of Artificial Sequence: Synthetic peptide
  Seed: FAFGEPRELL (MAGC1_HUMAN)
FVFGEPRELL

SEQ ID NO: 90555 - protein, 9 aa, Artificial Sequence
  Description of Artificial Sequence: Synthetic peptide
  Seed: IFRKAREFI (MAGC1_HUMAN)
IFRKAREFM

SEQ ID NO: 90556 - protein, 10 aa, Artificial Sequence
  Description of Artificial Sequence: Synthetic peptide
  Seed: LLQIPMTSSF (MAGC1_HUMAN)
LSQIPMTSSL

SEQ ID NO: 90557 - protein, 10 aa, Artificial Sequence
  Description of Artificial Sequence: Synthetic peptide
  Seed: LAMLKNTVPI (MAGC1_HUMAN)
LPMLKNTVPF

SEQ ID NO: 90558 - protein, 10 aa, Artificial Sequence
  Description of Artificial Sequence: Synthetic peptide
  Seed: SQSSPVSSFP (MAGC1_HUMAN)
SMSSPVSSFY

SEQ ID NO: 90559 - protein, 11 aa, Artificial Sequence
  Description of Artificial Sequence: Synthetic peptide
  Seed: SFFSYTLASLL (MAGC1_HUMAN)
SEFSYTLASLY

SEQ ID NO: 90560 - protein, 10 aa, Artificial Sequence
  Description of Artificial Sequence: Synthetic peptide
  Seed: SSFSYTLLSL (MAGC1_HUMAN)
SVFSYTLLSW

SEQ ID NO: 90561 - protein, 10 aa, Artificial Sequence
  Description of Artificial Sequence: Synthetic peptide
  Seed: ATESASSSVM (MAGC1_HUMAN)
AFESASSSVF

SEQ ID NO: 90562 - protein, 9 aa, Artificial Sequence
  Description of Artificial Sequence: Synthetic peptide
  Seed: FAFGEPREL (MAGC1_HUMAN)
FMFGEPREW

SEQ ID NO: 90563 - protein, 11 aa, Artificial Sequence
  Description of Artificial Sequence: Synthetic peptide
  Seed: RPVSSFFSYTL (MAGC1_HUMAN)
RLVSSFFSYTI

SEQ ID NO: 90564 - protein, 11 aa, Artificial Sequence
  Description of Artificial Sequence: Synthetic peptide
  Seed: SPLQIPGSPSF (MAGC1_HUMAN)
SWLQIPGSPSM

SEQ ID NO: 90565 - protein, 10 aa, Artificial Sequence
  Description of Artificial Sequence: Synthetic peptide
  Seed: RAGREHFAFG (MAGC1_HUMAN)
RLGREHFAFI

SEQ ID NO: 90566 - protein, 9 aa, Artificial Sequence
  Description of Artificial Sequence: Synthetic peptide
  Seed: SLIESEPLF (MAGC1_HUMAN)
STIESEPLM

SEQ ID NO: 90567 - protein, 11 aa, Artificial Sequence
  Description of Artificial Sequence: Synthetic peptide
  Seed: VSSSSSSSTLL (MAGC1_HUMAN)
VYSSSSSSTLW

SEQ ID NO: 90568 - protein, 9 aa, Artificial Sequence
  Description of Artificial Sequence: Synthetic peptide
  Seed: SSPPRYEFL (MAGC1_HUMAN)
SAPPRYEFV

SEQ ID NO: 90569 - protein, 10 aa, Artificial Sequence
  Description of Artificial Sequence: Synthetic peptide
  Seed: SSSSSTLLSL (MAGC1_HUMAN)
SNSSSTLLSW

SEQ ID NO: 90570 - protein, 10 aa, Artificial Sequence
  Description of Artificial Sequence: Synthetic peptide
  Seed: FPQSVLQIPV (MAGC1_HUMAN)
FAQSVLQIPM

SEQ ID NO: 90571 - protein, 11 aa, Artificial Sequence
  Description of Artificial Sequence: Synthetic peptide
  Seed: SPSFSSTLVSL (MAGC1_HUMAN)
SPSFSSTLVSA

SEQ ID NO: 90572 - protein, 10 aa, Artificial Sequence
  Description of Artificial Sequence: Synthetic peptide
  Seed: SPVSSFPSST (MAGC1_HUMAN)
SPVSSFPSSL

SEQ ID NO: 90573 - protein, 9 aa, Artificial Sequence
  Description of Artificial Sequence: Synthetic peptide
  Seed: FSYTLLSLF (MAGC1_HUMAN)
FKYTLLSLL

SEQ ID NO: 90574 - protein, 9 aa, Artificial Sequence
  Description of Artificial Sequence: Synthetic peptide
  Seed: FSSTLVSLF (MAGC1_HUMAN)
FLSTLVSLI

SEQ ID NO: 90575 - protein, 9 aa, Artificial Sequence
  Description of Artificial Sequence: Synthetic peptide
  Seed: GVRAGREHF (MAGC1_HUMAN)
GQRAGREHF

SEQ ID NO: 90576 - protein, 10 aa, Artificial Sequence
  Description of Artificial Sequence: Synthetic peptide
  Seed: RKVVEFLAML (MAGC1_HUMAN)
RGVVEFLAMV

SEQ ID NO: 90577 - protein, 11 aa, Artificial Sequence
  Description of Artificial Sequence: Synthetic peptide
  Seed: STFEGFPQSLL (MAGC1_HUMAN)
SIFEGFPQSLL

SEQ ID NO: 90578 - protein, 10 aa, Artificial Sequence
  Description of Artificial Sequence: Synthetic peptide
  Seed: SSFSYTLLSL (MAGC1_HUMAN)
SNFSYTLLSY

SEQ ID NO: 90579 - protein, 9 aa, Artificial Sequence
  Description of Artificial Sequence: Synthetic peptide
  Seed: NTHSPLQIV (MAGC1_HUMAN)
NLHSPLQIY

SEQ ID NO: 90580 - protein, 10 aa, Artificial Sequence
  Description of Artificial Sequence: Synthetic peptide
  Seed: ICSSSTSLSL (MAGC1_HUMAN)
IYSSSTSLSM

SEQ ID NO: 90581 - protein, 10 aa, Artificial Sequence
  Description of Artificial Sequence: Synthetic peptide
  Seed: SSFPSSTSSS (MAGC1_HUMAN)
SMFPSSTSSL

SEQ ID NO: 90582 - protein, 10 aa, Artificial Sequence
  Description of Artificial Sequence: Synthetic peptide
  Seed: ATESASSSVM (MAGC1_HUMAN)
AQESASSSVL

SEQ ID NO: 90583 - protein, 10 aa, Artificial Sequence
  Description of Artificial Sequence: Synthetic peptide
  Seed: EVIWDVLSGI (MAGC1_HUMAN)
ESIWDVLSGT

SEQ ID NO: 90584 - protein, 11 aa, Artificial Sequence
  Description of Artificial Sequence: Synthetic peptide
  Seed: EEVIWDVLSGI (MAGC1_HUMAN)
EAVIWDVLSGV

SEQ ID NO: 90585 - protein, 10 aa, Artificial Sequence
  Description of Artificial Sequence: Synthetic peptide
  Seed: SPLQRPVSSF (MAGC1_HUMAN)
SMLQRPVSSF

SEQ ID NO: 90586 - protein, 9 aa, Artificial Sequence
  Description of Artificial Sequence: Synthetic peptide
  Seed: RELLTKVWV (MAGC1_HUMAN)
RQLLTKVWI

SEQ ID NO: 90587 - protein, 10 aa, Artificial Sequence
  Description of Artificial Sequence: Synthetic peptide
  Seed: ASSSVMSPSF (MAGC1_HUMAN)
ACSSVMSPSW

SEQ ID NO: 90588 - protein, 9 aa, Artificial Sequence
  Description of Artificial Sequence: Synthetic peptide
  Seed: SSHESPQSP (MAGC1_HUMAN)
SAHESPQSM

SEQ ID NO: 90589 - protein, 9 aa, Artificial Sequence
  Description of Artificial Sequence: Synthetic peptide
  Seed: FPSSTSSSL (MAGC1_HUMAN)
FHSSTSSSA

SEQ ID NO: 90590 - protein, 9 aa, Artificial Sequence
  Description of Artificial Sequence: Synthetic peptide
  Seed: SSSESPQSC (MAGC1_HUMAN)
STSESPQSY

SEQ ID NO: 90591 - protein, 9 aa, Artificial Sequence
  Description of Artificial Sequence: Synthetic peptide
  Seed: AMLKNTVPI (MAGC1_HUMAN)
AMLKNTVPL

SEQ ID NO: 90592 - protein, 10 aa, Artificial Sequence
  Description of Artificial Sequence: Synthetic peptide
  Seed: SFSYTLLSLF (MAGC1_HUMAN)
SPSYTLLSLF

SEQ ID NO: 90593 - protein, 9 aa, Artificial Sequence
  Description of Artificial Sequence: Synthetic peptide
  Seed: KAREFIEIL (MAGC1_HUMAN)
KMREFIEIV

SEQ ID NO: 90594 - protein, 9 aa, Artificial Sequence
  Description of Artificial Sequence: Synthetic peptide
  Seed: VQSPLHSPQ (MAGC1_HUMAN)
VTSPLHSPY

SEQ ID NO: 90595 - protein, 9 aa, Artificial Sequence
  Description of Artificial Sequence: Synthetic peptide
  Seed: GFPQSPLQI (MAGC1_HUMAN)
GFPQSPLQL

SEQ ID NO: 90596 - protein, 10 aa, Artificial Sequence
  Description of Artificial Sequence: Synthetic peptide
  Seed: YTGYFPVIFR (MAGC1_HUMAN)
YRGYFPVIFR

SEQ ID NO: 90597 - protein, 11 aa, Artificial Sequence
  Description of Artificial Sequence: Synthetic peptide
  Seed: SSTPSSLPQSF (MAGC1_HUMAN)
SATPSSLPQSL

SEQ ID NO: 90598 - protein, 11 aa, Artificial Sequence
  Description of Artificial Sequence: Synthetic peptide
  Seed: REVPNSSPPRY (MAGC1_HUMAN)
RKVPNSSPPRY

SEQ ID NO: 90599 - protein, 9 aa, Artificial Sequence
  Description of Artificial Sequence: Synthetic peptide
  Seed: MSQNRLLIL (MAGC1_HUMAN)
MAQNRLLIY

SEQ ID NO: 90600 - protein, 9 aa, Artificial Sequence
  Description of Artificial Sequence: Synthetic peptide
  Seed: SSFFSYTLA (MAGC1_HUMAN)
SIFFSYTLK

SEQ ID NO: 90601 - protein, 9 aa, Artificial Sequence
  Description of Artificial Sequence: Synthetic peptide
  Seed: SPLQIVPSL (MAGC1_HUMAN)
SYLQIVPSM

SEQ ID NO: 90602 - protein, 9 aa, Artificial Sequence
  Description of Artificial Sequence: Synthetic peptide
  Seed: TLLSILQSS (MAGC1_HUMAN)
TALSILQSL

SEQ ID NO: 90603 - protein, 10 aa, Artificial Sequence
  Description of Artificial Sequence: Synthetic peptide
  Seed: EVIWDVLSGI (MAGC1_HUMAN)
EVIWDVLSGF

SEQ ID NO: 90604 - protein, 9 aa, Artificial Sequence
  Description of Artificial Sequence: Synthetic peptide
  Seed: TSLSLPQSF (MAGC1_HUMAN)
TTLSLPQSY

SEQ ID NO: 90605 - protein, 10 aa, Artificial Sequence
  Description of Artificial Sequence: Synthetic peptide
  Seed: LQIPVSSSFS (MAGC1_HUMAN)
LRIPVSSSFY

SEQ ID NO: 90606 - protein, 9 aa, Artificial Sequence
  Description of Artificial Sequence: Synthetic peptide
  Seed: LQIPVSAAS (MAGC1_HUMAN)
LMIPVSAAY

SEQ ID NO: 90607 - protein, 11 aa, Artificial Sequence
  Description of Artificial Sequence: Synthetic peptide
  Seed: SSFSYTLLSLF (MAGC1_HUMAN)
SMFSYTLLSLF

SEQ ID NO: 90608 - protein, 9 aa, Artificial Sequence
  Description of Artificial Sequence: Synthetic peptide
  Seed: SSSVMSPSF (MAGC1_HUMAN)
SHSVMSPSY

SEQ ID NO: 90609 - protein, 11 aa, Artificial Sequence
  Description of Artificial Sequence: Synthetic peptide
  Seed: SPLQIPVSRSF (MAGC1_HUMAN)
SELQIPVSRSY

SEQ ID NO: 90610 - protein, 9 aa, Artificial Sequence
  Description of Artificial Sequence: Synthetic peptide
  Seed: SSPESPLQS (MAGC1_HUMAN)
SAPESPLQM

SEQ ID NO: 90611 - protein, 9 aa, Artificial Sequence
  Description of Artificial Sequence: Synthetic peptide
  Seed: EHFAFGEPR (MAGC1_HUMAN)
EGFAFGEPR

SEQ ID NO: 90612 - protein, 11 aa, Artificial Sequence
  Description of Artificial Sequence: Synthetic peptide
  Seed: FLWGPRAHSEV (MAGC1_HUMAN)
FLWGPRAHSEA

SEQ ID NO: 90613 - protein, 10 aa, Artificial Sequence
  Description of Artificial Sequence: Synthetic peptide
  Seed: NVISRYTGYF (MAGC1_HUMAN)
NQISRYTGYF

SEQ ID NO: 90614 - protein, 9 aa, Artificial Sequence
  Description of Artificial Sequence: Synthetic peptide
  Seed: SLSPHYFPQ (MAGC1_HUMAN)
SASPHYFPK

SEQ ID NO: 90615 - protein, 9 aa, Artificial Sequence
  Description of Artificial Sequence: Synthetic peptide
  Seed: SPLQIPGSP (MAGC1_HUMAN)
SPLQIPGSI

SEQ ID NO: 90616 - protein, 10 aa, Artificial Sequence
  Description of Artificial Sequence: Synthetic peptide
  Seed: MSPLYFPQSP (MAGC1_HUMAN)
MSPLYFPQSV

SEQ ID NO: 90617 - protein, 8 aa, Artificial Sequence
  Description of Artificial Sequence: Synthetic peptide
  Seed: FLLLKYQV (MAGC1_HUMAN)
FPLLKYQL

SEQ ID NO: 90618 - protein, 9 aa, Artificial Sequence
  Description of Artificial Sequence: Synthetic peptide
  Seed: VQSPLQNPA (MAGC1_HUMAN)
VMSPLQNPV

SEQ ID NO: 90619 - protein, 11 aa, Artificial Sequence
  Description of Artificial Sequence: Synthetic peptide
  Seed: NPASSFFSSAL (MAGC1_HUMAN)
NPASSFFSSAY

SEQ ID NO: 90620 - protein, 9 aa, Artificial Sequence
  Description of Artificial Sequence: Synthetic peptide
  Seed: SLPEWEDSL (MAGC1_HUMAN)
SVPEWEDSL

SEQ ID NO: 90621 - protein, 9 aa, Artificial Sequence
  Description of Artificial Sequence: Synthetic peptide
  Seed: IEILFGISL (MAGC1_HUMAN)
IIILFGISF

SEQ ID NO: 90622 - protein, 10 aa, Artificial Sequence
  Description of Artificial Sequence: Synthetic peptide
  Seed: SFFSYTLASL (MAGC1_HUMAN)
SRFSYTLASY

SEQ ID NO: 90623 - protein, 10 aa, Artificial Sequence
  Description of Artificial Sequence: Synthetic peptide
  Seed: FAQSSLQIPV (MAGC1_HUMAN)
FLQSSLQIPM

SEQ ID NO: 90624 - protein, 9 aa, Artificial Sequence
  Description of Artificial Sequence: Synthetic peptide
  Seed: TPSSLPQSF (MAGC1_HUMAN)
TASSLPQSM

SEQ ID NO: 90625 - protein, 9 aa, Artificial Sequence
  Description of Artificial Sequence: Synthetic peptide
  Seed: TLDLTSEGC (MAGC1_HUMAN)
TQDLTSEGM

SEQ ID NO: 90626 - protein, 9 aa, Artificial Sequence
  Description of Artificial Sequence: Synthetic peptide
  Seed: SSPESTQSP (MAGC1_HUMAN)
SGPESTQSL

SEQ ID NO: 90627 - protein, 9 aa, Artificial Sequence
  Description of Artificial Sequence: Synthetic peptide
  Seed: VIKRKVVEF (MAGC1_HUMAN)
VMKRKVVEM

SEQ ID NO: 90628 - protein, 10 aa, Artificial Sequence
  Description of Artificial Sequence: Synthetic peptide
  Seed: SSSSTLLSLF (MAGC1_HUMAN)
SKSSTLLSLW

SEQ ID NO: 90629 - protein, 9 aa, Artificial Sequence
  Description of Artificial Sequence: Synthetic peptide
  Seed: SPLQSPESA (MAGC1_HUMAN)
SHLQSPESV

SEQ ID NO: 90630 - protein, 11 aa, Artificial Sequence
  Description of Artificial Sequence: Synthetic peptide
  Seed: SPLQIPGSPSF (MAGC1_HUMAN)
SPLQIPGSPSY

SEQ ID NO: 90631 - protein, 10 aa, Artificial Sequence
  Description of Artificial Sequence: Synthetic peptide
  Seed: SSFPSSTSSS (MAGC1_HUMAN)
SGFPSSTSSF

SEQ ID NO: 90632 - protein, 11 aa, Artificial Sequence
  Description of Artificial Sequence: Synthetic peptide
  Seed: FLAMLKNTVPI (MAGC1_HUMAN)
FYAMLKNTVPI

SEQ ID NO: 90633 - protein, 9 aa, Artificial Sequence
  Description of Artificial Sequence: Synthetic peptide
  Seed: NSSPPRYEF (MAGC1_HUMAN)
NSSPPRYEL

SEQ ID NO: 90634 - protein, 9 aa, Artificial Sequence
  Description of Artificial Sequence: Synthetic peptide
  Seed: KAREFIEIL (MAGC1_HUMAN)
KMREFIEIR

SEQ ID NO: 90635 - protein, 9 aa, Artificial Sequence
  Description of Artificial Sequence: Synthetic peptide
  Seed: WEDSLSPHY (MAGC1_HUMAN)
WMDSLSPHY

SEQ ID NO: 90636 - protein, 10 aa, Artificial Sequence
  Description of Artificial Sequence: Synthetic peptide
  Seed: FPQSVLQIPV (MAGC1_HUMAN)
FMQSVLQIPT

SEQ ID NO: 90637 - protein, 11 aa, Artificial Sequence
  Description of Artificial Sequence: Synthetic peptide
  Seed: LQIPVSSSFSY (MAGC1_HUMAN)
LHIPVSSSFSY

SEQ ID NO: 90638 - protein, 9 aa, Artificial Sequence
  Description of Artificial Sequence: Synthetic peptide
  Seed: VISRYTGYF (MAGC1_HUMAN)
VVSRYTGYF

SEQ ID NO: 90639 - protein, 9 aa, Artificial Sequence
  Description of Artificial Sequence: Synthetic peptide
  Seed: RTHSTFEGF (MAGC1_HUMAN)
RLHSTFEGR

SEQ ID NO: 90640 - protein, 9 aa, Artificial Sequence
  Description of Artificial Sequence: Synthetic peptide
  Seed: FPSSYKDAL (MAGC1_HUMAN)
FLSSYKDAF

SEQ ID NO: 90641 - protein, 9 aa, Artificial Sequence
  Description of Artificial Sequence: Synthetic peptide
  Seed: LQRPVSSFF (MAGC1_HUMAN)
LVRPVSSFW

SEQ ID NO: 90642 - protein, 10 aa, Artificial Sequence
  Description of Artificial Sequence: Synthetic peptide
  Seed: FPQSLLQIPM (MAGC1_HUMAN)
FRQSLLQIPV

SEQ ID NO: 90643 - protein, 9 aa, Artificial Sequence
  Description of Artificial Sequence: Synthetic peptide
  Seed: KVWVQEHYL (MAGC1_HUMAN)
KVWVQEHYY

SEQ ID NO: 90644 - protein, 10 aa, Artificial Sequence
  Description of Artificial Sequence: Synthetic peptide
  Seed: LAMLKNTVPI (MAGC1_HUMAN)
LDMLKNTVPF

SEQ ID NO: 90645 - protein, 10 aa, Artificial Sequence
  Description of Artificial Sequence: Synthetic peptide
  Seed: SPLQNSQSSP (MAGC1_HUMAN)
SPLQNSQSSA

SEQ ID NO: 90646 - protein, 9 aa, Artificial Sequence
  Description of Artificial Sequence: Synthetic peptide
  Seed: SLSPFSEES (MAGC1_HUMAN)
SQSPFSEEV

SEQ ID NO: 90647 - protein, 9 aa, Artificial Sequence
  Description of Artificial Sequence: Synthetic peptide
  Seed: SAASSSTLV (MAGC1_HUMAN)
SAASSSTLI

SEQ ID NO: 90648 - protein, 9 aa, Artificial Sequence
  Description of Artificial Sequence: Synthetic peptide
  Seed: FSSTLLSLF (MAGC1_HUMAN)
FWSTLLSLI

SEQ ID NO: 90649 - protein, 9 aa, Artificial Sequence
  Description of Artificial Sequence: Synthetic peptide
  Seed: SSSFSYTLL (MAGC1_HUMAN)
SVSFSYTLL

SEQ ID NO: 90650 - protein, 11 aa, Artificial Sequence
  Description of Artificial Sequence: Synthetic peptide
  Seed: FPQSPQGEDSL (MAGC1_HUMAN)
FPQSPQGEDSW

SEQ ID NO: 90651 - protein, 9 aa, Artificial Sequence
  Description of Artificial Sequence: Synthetic peptide
  Seed: FPSSTSSSL (MAGC1_HUMAN)
FFSSTSSSL

SEQ ID NO: 90652 - protein, 10 aa, Artificial Sequence
  Description of Artificial Sequence: Synthetic peptide
  Seed: QRPVSSFFSY (MAGC1_HUMAN)
QDPVSSFFSY

SEQ ID NO: 90653 - protein, 9 aa, Artificial Sequence
  Description of Artificial Sequence: Synthetic peptide
  Seed: YVFVNTLDL (MAGC1_HUMAN)
YVFVNTLDI

SEQ ID NO: 90654 - protein, 9 aa, Artificial Sequence
  Description of Artificial Sequence: Synthetic peptide
  Seed: SPESAQSAF (MAGC1_HUMAN)
SQESAQSAY

SEQ ID NO: 90655 - protein, 10 aa, Artificial Sequence
  Description of Artificial Sequence: Synthetic peptide
  Seed: VSLFQSSPER (MAGC1_HUMAN)
VMLFQSSPEK

SEQ ID NO: 90656 - protein, 11 aa, Artificial Sequence
  Description of Artificial Sequence: Synthetic peptide
  Seed: TSSFSSTLLSI (MAGC1_HUMAN)
TSSFSSTLLSF

SEQ ID NO: 90657 - protein, 11 aa, Artificial Sequence
  Description of Artificial Sequence: Synthetic peptide
  Seed: IIDTTDDSTAT (MAGC1_HUMAN)
ISDTTDDSTAF

SEQ ID NO: 90658 - protein, 9 aa, Artificial Sequence
  Description of Artificial Sequence: Synthetic peptide
  Seed: AQSPLQRPV (MAGC1_HUMAN)
AQSPLQRPL

SEQ ID NO: 90659 - protein, 10 aa, Artificial Sequence
  Description of Artificial Sequence: Synthetic peptide
  Seed: MLKNTVPITF (MAGC1_HUMAN)
MMKNTVPITF

SEQ ID NO: 90660 - protein, 9 aa, Artificial Sequence
  Description of Artificial Sequence: Synthetic peptide
  Seed: NTVPITFPS (MAGC1_HUMAN)
NTVPITFPQ

SEQ ID NO: 90661 - protein, 10 aa, Artificial Sequence
  Description of Artificial Sequence: Synthetic peptide
  Seed: FPQSPLQIPV (MAGC1_HUMAN)
FVQSPLQIPV

SEQ ID NO: 90662 - protein, 9 aa, Artificial Sequence
  Description of Artificial Sequence: Synthetic peptide
  Seed: RTHSTFEGF (MAGC1_HUMAN)
RFHSTFEGI

SEQ ID NO: 90663 - protein, 9 aa, Artificial Sequence
  Description of Artificial Sequence: Synthetic peptide
  Seed: SQSSPVSSF (MAGC1_HUMAN)
SWSSPVSSW

SEQ ID NO: 90664 - protein, 11 aa, Artificial Sequence
  Description of Artificial Sequence: Synthetic peptide
  Seed: ISRYTGYFPVI (MAGC1_HUMAN)
IERYTGYFPVF

SEQ ID NO: 90665 - protein, 10 aa, Artificial Sequence
  Description of Artificial Sequence: Synthetic peptide
  Seed: RPVSSFFSYT (MAGC1_HUMAN)
RFVSSFFSYA

SEQ ID NO: 90666 - protein, 9 aa, Artificial Sequence
  Description of Artificial Sequence: Synthetic peptide
  Seed: LSPLHFPQF (MAGC1_HUMAN)
LAPLHFPQM

SEQ ID NO: 90667 - protein, 10 aa, Artificial Sequence
  Description of Artificial Sequence: Synthetic peptide
  Seed: RSFSSTLLSI (MAGC1_HUMAN)
RVFSSTLLSI

SEQ ID NO: 90668 - protein, 11 aa, Artificial Sequence
  Description of Artificial Sequence: Synthetic peptide
  Seed: FLAMLKNTVPI (MAGC1_HUMAN)
FEAMLKNTVPL

SEQ ID NO: 90669 - protein, 9 aa, Artificial Sequence
  Description of Artificial Sequence: Synthetic peptide
  Seed: SESPQSCPE (MAGC1_HUMAN)
SESPQSCPA

SEQ ID NO: 90670 - protein, 10 aa, Artificial Sequence
  Description of Artificial Sequence: Synthetic peptide
  Seed: SSPESAQSTF (MAGC1_HUMAN)
SIPESAQSTY

SEQ ID NO: 90671 - protein, 9 aa, Artificial Sequence
  Description of Artificial Sequence: Synthetic peptide
  Seed: SSSSTLLSL (MAGC1_HUMAN)
SVSSTLLSV

SEQ ID NO: 90672 - protein, 9 aa, Artificial Sequence
  Description of Artificial Sequence: Synthetic peptide
  Seed: FPSSTSSSL (MAGC1_HUMAN)
FVSSTSSSW

SEQ ID NO: 90673 - protein, 9 aa, Artificial Sequence
  Description of Artificial Sequence: Synthetic peptide
  Seed: SSSTLVSIF (MAGC1_HUMAN)
SHSTLVSIF

SEQ ID NO: 90674 - protein, 11 aa, Artificial Sequence
  Description of Artificial Sequence: Synthetic peptide
  Seed: QSSPESAQSTF (MAGC1_HUMAN)
QPSPESAQSTW

SEQ ID NO: 90675 - protein, 9 aa, Artificial Sequence
  Description of Artificial Sequence: Synthetic peptide
  Seed: FFSSALLSI (MAGC1_HUMAN)
FWSSALLSY

SEQ ID NO: 90676 - protein, 9 aa, Artificial Sequence
  Description of Artificial Sequence: Synthetic peptide
  Seed: FSSTLLSLF (MAGC1_HUMAN)
FQSTLLSLV

SEQ ID NO: 90677 - protein, 9 aa, Artificial Sequence
  Description of Artificial Sequence: Synthetic peptide
  Seed: SPQSPPEGP (MAGC1_HUMAN)
SVQSPPEGY

SEQ ID NO: 90678 - protein, 10 aa, Artificial Sequence
  Description of Artificial Sequence: Synthetic peptide
  Seed: VSICSSSTSL (MAGC1_HUMAN)
VAICSSSTSM

SEQ ID NO: 90679 - protein, 9 aa, Artificial Sequence
  Description of Artificial Sequence: Synthetic peptide
  Seed: SQSSPVSSF (MAGC1_HUMAN)
SMSSPVSSW

SEQ ID NO: 90680 - protein, 10 aa, Artificial Sequence
  Description of Artificial Sequence: Synthetic peptide
  Seed: VISFSSSTSL (MAGC1_HUMAN)
VKSFSSSTSF

SEQ ID NO: 90681 - protein, 11 aa, Artificial Sequence
  Description of Artificial Sequence: Synthetic peptide
  Seed: IPVSRSFSSTL (MAGC1_HUMAN)
INVSRSFSSTF

SEQ ID NO: 90682 - protein, 9 aa, Artificial Sequence
  Description of Artificial Sequence: Synthetic peptide
  Seed: GSPSFSSTL (MAGC1_HUMAN)
GIPSFSSTI

SEQ ID NO: 90683 - protein, 10 aa, Artificial Sequence
  Description of Artificial Sequence: Synthetic peptide
  Seed: SFSSTLLSIF (MAGC1_HUMAN)
SVSSTLLSIW

SEQ ID NO: 90684 - protein, 11 aa, Artificial Sequence
  Description of Artificial Sequence: Synthetic peptide
  Seed: SRYTGYFPVIF (MAGC1_HUMAN)
SRYTGYFPVII

SEQ ID NO: 90685 - protein, 11 aa, Artificial Sequence
  Description of Artificial Sequence: Synthetic peptide
  Seed: QSSPESAQSTF (MAGC1_HUMAN)
QLSPESAQSTF

SEQ ID NO: 90686 - protein, 9 aa, Artificial Sequence
  Description of Artificial Sequence: Synthetic peptide
  Seed: TSLSLPQSF (MAGC1_HUMAN)
THLSLPQSF

SEQ ID NO: 90687 - protein, 9 aa, Artificial Sequence
  Description of Artificial Sequence: Synthetic peptide
  Seed: FQSSPERTH (MAGC1_HUMAN)
FRSSPERTY

SEQ ID NO: 90688 - protein, 9 aa, Artificial Sequence
  Description of Artificial Sequence: Synthetic peptide
  Seed: SRYTGYFPV (MAGC1_HUMAN)
SIYTGYFPM

SEQ ID NO: 90689 - protein, 9 aa, Artificial Sequence
  Description of Artificial Sequence: Synthetic peptide
  Seed: SSSTSLSPF (MAGC1_HUMAN)
SQSTSLSPI

SEQ ID NO: 90690 - protein, 11 aa, Artificial Sequence
  Description of Artificial Sequence: Synthetic peptide
  Seed: TLYPLQSPQSR (MAGC1_HUMAN)
TIYPLQSPQSR

SEQ ID NO: 90691 - protein, 10 aa, Artificial Sequence
  Description of Artificial Sequence: Synthetic peptide
  Seed: PLQNPASSFF (MAGC1_HUMAN)
PRQNPASSFF

SEQ ID NO: 90692 - protein, 10 aa, Artificial Sequence
  Description of Artificial Sequence: Synthetic peptide
  Seed: MPTAGMPSLL (MAGC1_HUMAN)
MGTAGMPSLA

SEQ ID NO: 90693 - protein, 9 aa, Artificial Sequence
  Description of Artificial Sequence: Synthetic peptide
  Seed: VISRYTGYF (MAGC1_HUMAN)
VTSRYTGYL

SEQ ID NO: 90694 - protein, 10 aa, Artificial Sequence
  Description of Artificial Sequence: Synthetic peptide
  Seed: RSFSSTLLSI (MAGC1_HUMAN)
RYFSSTLLSI

SEQ ID NO: 90695 - protein, 10 aa, Artificial Sequence
  Description of Artificial Sequence: Synthetic peptide
  Seed: TTDDSTATES (MAGC1_HUMAN)
TYDDSTATEM

SEQ ID NO: 90696 - protein, 9 aa, Artificial Sequence
  Description of Artificial Sequence: Synthetic peptide
  Seed: RLLILILSI (MAGC1_HUMAN)
RMLILILSL

SEQ ID NO: 90697 - protein, 10 aa, Artificial Sequence
  Description of Artificial Sequence: Synthetic peptide
  Seed: LSLFQSFSER (MAGC1_HUMAN)
LMLFQSFSER

SEQ ID NO: 90698 - protein, 9 aa, Artificial Sequence
  Description of Artificial Sequence: Synthetic peptide
  Seed: FAFGEPREL (MAGC1_HUMAN)
FPFGEPREH

SEQ ID NO: 90699 - protein, 11 aa, Artificial Sequence
  Description of Artificial Sequence: Synthetic peptide
  Seed: SFFSYTLASLL (MAGC1_HUMAN)
SYFSYTLASLI

SEQ ID NO: 90700 - protein, 9 aa, Artificial Sequence
  Description of Artificial Sequence: Synthetic peptide
  Seed: SSPESAQSA (MAGC1_HUMAN)
SPPESAQSL

SEQ ID NO: 90701 - protein, 9 aa, Artificial Sequence
  Description of Artificial Sequence: Synthetic peptide
  Seed: SMSPLYFPQ (MAGC1_HUMAN)
SLSPLYFPK

SEQ ID NO: 90702 - protein, 9 aa, Artificial Sequence
  Description of Artificial Sequence: Synthetic peptide
  Seed: TTDDSTATE (MAGC1_HUMAN)
TTDDSTATF

SEQ ID NO: 90703 - protein, 11 aa, Artificial Sequence
  Description of Artificial Sequence: Synthetic peptide
  Seed: FLAMLKNTVPI (MAGC1_HUMAN)
FTAMLKNTVPA

SEQ ID NO: 90704 - protein, 9 aa, Artificial Sequence
  Description of Artificial Sequence: Synthetic peptide
  Seed: FSSTLLSLF (MAGC1_HUMAN)
FFSTLLSLW

SEQ ID NO: 90705 - protein, 11 aa, Artificial Sequence
  Description of Artificial Sequence: Synthetic peptide
  Seed: SQSSPEGKDSL (MAGC1_HUMAN)
SESSPEGKDSW

SEQ ID NO: 90706 - protein, 9 aa, Artificial Sequence
  Description of Artificial Sequence: Synthetic peptide
  Seed: REVDPDDSY (MAGC1_HUMAN)
RQVDPDDSI

SEQ ID NO: 90707 - protein, 9 aa, Artificial Sequence
  Description of Artificial Sequence: Synthetic peptide
  Seed: SSSSTLLSL (MAGC1_HUMAN)
SGSSTLLSM

SEQ ID NO: 90708 - protein, 10 aa, Artificial Sequence
  Description of Artificial Sequence: Synthetic peptide
  Seed: FAQSSLQIPV (MAGC1_HUMAN)
FNQSSLQIPL

SEQ ID NO: 90709 - protein, 9 aa, Artificial Sequence
  Description of Artificial Sequence: Synthetic peptide
  Seed: TLDLTSEGC (MAGC1_HUMAN)
TVDLTSEGL

SEQ ID NO: 90710 - protein, 9 aa, Artificial Sequence
  Description of Artificial Sequence: Synthetic peptide
  Seed: LQIPGSPSF (MAGC1_HUMAN)
LNIPGSPSY

SEQ ID NO: 90711 - protein, 9 aa, Artificial Sequence
  Description of Artificial Sequence: Synthetic peptide
  Seed: LQIPVSPSF (MAGC1_HUMAN)
LGIPVSPSM

SEQ ID NO: 90712 - protein, 9 aa, Artificial Sequence
  Description of Artificial Sequence: Synthetic peptide
  Seed: SMSPLYFPQ (MAGC1_HUMAN)
SWSPLYFPK

SEQ ID NO: 90713 - protein, 10 aa, Artificial Sequence
  Description of Artificial Sequence: Synthetic peptide
  Seed: YTLDEKVDEL (MAGC1_HUMAN)
YSLDEKVDEL

SEQ ID NO: 90714 - protein, 8 aa, Artificial Sequence
  Description of Artificial Sequence: Synthetic peptide
  Seed: LAMLKNTV (MAGC1_HUMAN)
LIMLKNTL

SEQ ID NO: 90715 - protein, 9 aa, Artificial Sequence
  Description of Artificial Sequence: Synthetic peptide
  Seed: LQIPMTSSF (MAGC1_HUMAN)
LFIPMTSSV

SEQ ID NO: 90716 - protein, 9 aa, Artificial Sequence
  Description of Artificial Sequence: Synthetic peptide
  Seed: VIWDVLSGI (MAGC1_HUMAN)
VIWDVLSGM

SEQ ID NO: 90717 - protein, 11 aa, Artificial Sequence
  Description of Artificial Sequence: Synthetic peptide
  Seed: SSSSSTLLSLF (MAGC1_HUMAN)
STSSSTLLSLY

SEQ ID NO: 90718 - protein, 9 aa, Artificial Sequence
  Description of Artificial Sequence: Synthetic peptide
  Seed: SSPESAQSA (MAGC1_HUMAN)
SSPESAQSY

SEQ ID NO: 90719 - protein, 9 aa, Artificial Sequence
  Description of Artificial Sequence: Synthetic peptide
  Seed: VSRSFSSTL (MAGC1_HUMAN)
VYRSFSSTW

SEQ ID NO: 90720 - protein, 10 aa, Artificial Sequence
  Description of Artificial Sequence: Synthetic peptide
  Seed: RFLLLKYQVK (MAGC1_HUMAN)
RTLLLKYQVR

SEQ ID NO: 90721 - protein, 10 aa, Artificial Sequence
  Description of Artificial Sequence: Synthetic peptide
  Seed: SSPESAQSAF (MAGC1_HUMAN)
STPESAQSAM

SEQ ID NO: 90722 - protein, 9 aa, Artificial Sequence
  Description of Artificial Sequence: Synthetic peptide
  Seed: MLTNVISRY (MAGC1_HUMAN)
MVTNVISRW

SEQ ID NO: 90723 - protein, 9 aa, Artificial Sequence
  Description of Artificial Sequence: Synthetic peptide
  Seed: SSPESTQSP (MAGC1_HUMAN)
SIPESTQSM

SEQ ID NO: 90724 - protein, 11 aa, Artificial Sequence
  Description of Artificial Sequence: Synthetic peptide
  Seed: IPGSPSFSSTL (MAGC1_HUMAN)
IAGSPSFSSTL

SEQ ID NO: 90725 - protein, 9 aa, Artificial Sequence
  Description of Artificial Sequence: Synthetic peptide
  Seed: AMLKNTVPI (MAGC1_HUMAN)
ARLKNTVPY

SEQ ID NO: 90726 - protein, 9 aa, Artificial Sequence
  Description of Artificial Sequence: Synthetic peptide
  Seed: HFPQSPPEW (MAGC1_HUMAN)
HTPQSPPEI

SEQ ID NO: 90727 - protein, 11 aa, Artificial Sequence
  Description of Artificial Sequence: Synthetic peptide
  Seed: FQSSLQSPVSI (MAGC1_HUMAN)
FMSSLQSPVSV

SEQ ID NO: 90728 - protein, 10 aa, Artificial Sequence
  Description of Artificial Sequence: Synthetic peptide
  Seed: AMLKNTVPIT (MAGC1_HUMAN)
AMLKNTVPII

SEQ ID NO: 90729 - protein, 10 aa, Artificial Sequence
  Description of Artificial Sequence: Synthetic peptide
  Seed: STPSSLPQSF (MAGC1_HUMAN)
SFPSSLPQSW

SEQ ID NO: 90730 - protein, 9 aa, Artificial Sequence
  Description of Artificial Sequence: Synthetic peptide
  Seed: SSPERTQST (MAGC1_HUMAN)
SMPERTQSV

SEQ ID NO: 90731 - protein, 9 aa, Artificial Sequence
  Description of Artificial Sequence: Synthetic peptide
  Seed: FSSTLLSLF (MAGC1_HUMAN)
FRSTLLSLL

SEQ ID NO: 90732 - protein, 9 aa, Artificial Sequence
  Description of Artificial Sequence: Synthetic peptide
  Seed: YQVKQPITK (MAGC1_HUMAN)
YIVKQPITF

SEQ ID NO: 90733 - protein, 9 aa, Artificial Sequence
  Description of Artificial Sequence: Synthetic peptide
  Seed: SLFQSFSER (MAGC1_HUMAN)
SNFQSFSEY

SEQ ID NO: 90734 - protein, 10 aa, Artificial Sequence
  Description of Artificial Sequence: Synthetic peptide
  Seed: SSSSTLLSLF (MAGC1_HUMAN)
SHSSTLLSLY

SEQ ID NO: 90735 - protein, 10 aa, Artificial Sequence
  Description of Artificial Sequence: Synthetic peptide
  Seed: SRYTGYFPVI (MAGC1_HUMAN)
SWYTGYFPVI

SEQ ID NO: 90736 - protein, 9 aa, Artificial Sequence
  Description of Artificial Sequence: Synthetic peptide
  Seed: SSPESTQSP (MAGC1_HUMAN)
SFPESTQSI

SEQ ID NO: 90737 - protein, 11 aa, Artificial Sequence
  Description of Artificial Sequence: Synthetic peptide
  Seed: IPVSPSFSSTL (MAGC1_HUMAN)
IAVSPSFSSTM

SEQ ID NO: 90738 - protein, 9 aa, Artificial Sequence
  Description of Artificial Sequence: Synthetic peptide
  Seed: LQIPMTSSF (MAGC1_HUMAN)
LVIPMTSSF

SEQ ID NO: 90739 - protein, 11 aa, Artificial Sequence
  Description of Artificial Sequence: Synthetic peptide
  Seed: QSFSERTQSTF (MAGC1_HUMAN)
QQFSERTQSTF

SEQ ID NO: 90740 - protein, 9 aa, Artificial Sequence
  Description of Artificial Sequence: Synthetic peptide
  Seed: VSAASSSTL (MAGC1_HUMAN)
VYAASSSTI

SEQ ID NO: 90741 - protein, 10 aa, Artificial Sequence
  Description of Artificial Sequence: Synthetic peptide
  Seed: MSPLYFPQSP (MAGC1_HUMAN)
MQPLYFPQSA

SEQ ID NO: 90742 - protein, 9 aa, Artificial Sequence
  Description of Artificial Sequence: Synthetic peptide
  Seed: ISFSSSTSL (MAGC1_HUMAN)
IIFSSSTSY

SEQ ID NO: 90743 - protein, 10 aa, Artificial Sequence
  Description of Artificial Sequence: Synthetic peptide
  Seed: SSFSYTLLSL (MAGC1_HUMAN)
SLFSYTLLSL

SEQ ID NO: 90744 - protein, 10 aa, Artificial Sequence
  Description of Artificial Sequence: Synthetic peptide
  Seed: SSPESAQSAF (MAGC1_HUMAN)
SDPESAQSAL

SEQ ID NO: 90745 - protein, 9 aa, Artificial Sequence
  Description of Artificial Sequence: Synthetic peptide
  Seed: VSRSFSSTL (MAGC1_HUMAN)
VARSFSSTY

SEQ ID NO: 90746 - protein, 9 aa, Artificial Sequence
  Description of Artificial Sequence: Synthetic peptide
  Seed: SSPPRYEFL (MAGC1_HUMAN)
SQPPRYEFL

SEQ ID NO: 90747 - protein, 9 aa, Artificial Sequence
  Description of Artificial Sequence: Synthetic peptide
  Seed: TSLSLPQSF (MAGC1_HUMAN)
TILSLPQSF

SEQ ID NO: 90748 - protein, 9 aa, Artificial Sequence
  Description of Artificial Sequence: Synthetic peptide
  Seed: RSFSSTLLS (MAGC1_HUMAN)
RSFSSTLLI

SEQ ID NO: 90749 - protein, 11 aa, Artificial Sequence
  Description of Artificial Sequence: Synthetic peptide
  Seed: SSFPSSTSSSL (MAGC1_HUMAN)
SWFPSSTSSSY

SEQ ID NO: 90750 - protein, 9 aa, Artificial Sequence
  Description of Artificial Sequence: Synthetic peptide
  Seed: AQSPLQRPV (MAGC1_HUMAN)
AESPLQRPM

SEQ ID NO: 90751 - protein, 9 aa, Artificial Sequence
  Description of Artificial Sequence: Synthetic peptide
  Seed: SSSDTLLES (MAGC1_HUMAN)
SMSDTLLEM

SEQ ID NO: 90752 - protein, 10 aa, Artificial Sequence
  Description of Artificial Sequence: Synthetic peptide
  Seed: SSPESTQSPF (MAGC1_HUMAN)
SQPESTQSPL

SEQ ID NO: 90753 - protein, 9 aa, Artificial Sequence
  Description of Artificial Sequence: Synthetic peptide
  Seed: RAHSEVIKR (MAGC1_HUMAN)
RYHSEVIKK

SEQ ID NO: 90754 - protein, 9 aa, Artificial Sequence
  Description of Artificial Sequence: Synthetic peptide
  Seed: ASSSTLVSI (MAGC1_HUMAN)
AGSSTLVSY

SEQ ID NO: 90755 - protein, 8 aa, Artificial Sequence
  Description of Artificial Sequence: Synthetic peptide
  Seed: RSFSSTLL (MAGC1_HUMAN)
RTFSSTLY

SEQ ID NO: 90756 - protein, 9 aa, Artificial Sequence
  Description of Artificial Sequence: Synthetic peptide
  Seed: ISFSSSTSL (MAGC1_HUMAN)
IMFSSSTSA

SEQ ID NO: 90757 - protein, 10 aa, Artificial Sequence
  Description of Artificial Sequence: Synthetic peptide
  Seed: SSFPSSTSSS (MAGC1_HUMAN)
SAFPSSTSSV

SEQ ID NO: 90758 - protein, 9 aa, Artificial Sequence
  Description of Artificial Sequence: Synthetic peptide
  Seed: RKAREFIEI (MAGC1_HUMAN)
RAAREFIEY

SEQ ID NO: 90759 - protein, 9 aa, Artificial Sequence
  Description of Artificial Sequence: Synthetic peptide
  Seed: GYFPVIFRK (MAGC1_HUMAN)
GVFPVIFRY

SEQ ID NO: 90760 - protein, 9 aa, Artificial Sequence
  Description of Artificial Sequence: Synthetic peptide
  Seed: TPSSLPQSF (MAGC1_HUMAN)
TPSSLPQSW

SEQ ID NO: 90761 - protein, 9 aa, Artificial Sequence
  Description of Artificial Sequence: Synthetic peptide
  Seed: SPHYFPQSP (MAGC1_HUMAN)
SPHYFPQSM

SEQ ID NO: 90762 - protein, 10 aa, Artificial Sequence
  Description of Artificial Sequence: Synthetic peptide
  Seed: SIFQSSPESA (MAGC1_HUMAN)
SQFQSSPESV

SEQ ID NO: 90763 - protein, 11 aa, Artificial Sequence
  Description of Artificial Sequence: Synthetic peptide
  Seed: SPFSEESSSPV (MAGC1_HUMAN)
SPFSEESSSPM

SEQ ID NO: 90764 - protein, 11 aa, Artificial Sequence
  Description of Artificial Sequence: Synthetic peptide
  Seed: SLFQSSPERTH (MAGC1_HUMAN)
SQFQSSPERTY

SEQ ID NO: 90765 - protein, 8 aa, Artificial Sequence
  Description of Artificial Sequence: Synthetic peptide
  Seed: SSPPRYEF (MAGC1_HUMAN)
SGPPRYEL

SEQ ID NO: 90766 - protein, 9 aa, Artificial Sequence
  Description of Artificial Sequence: Synthetic peptide
  Seed: SRSFSSTLL (MAGC1_HUMAN)
SPSFSSTLY

SEQ ID NO: 90767 - protein, 11 aa, Artificial Sequence
  Description of Artificial Sequence: Synthetic peptide
  Seed: SSFPSSTSSSL (MAGC1_HUMAN)
SWFPSSTSSSM

SEQ ID NO: 90768 - protein, 9 aa, Artificial Sequence
  Description of Artificial Sequence: Synthetic peptide
  Seed: AQSSLQIPV (MAGC1_HUMAN)
ALSSLQIPV

SEQ ID NO: 90769 - protein, 9 aa, Artificial Sequence
  Description of Artificial Sequence: Synthetic peptide
  Seed: SAASSSTLV (MAGC1_HUMAN)
SIASSSTLL

SEQ ID NO: 90770 - protein, 9 aa, Artificial Sequence
  Description of Artificial Sequence: Synthetic peptide
  Seed: VSSSSSSTL (MAGC1_HUMAN)
VGSSSSSTW

SEQ ID NO: 90771 - protein, 8 aa, Artificial Sequence
  Description of Artificial Sequence: Synthetic peptide
  Seed: SFSSSTSL (MAGC1_HUMAN)
SYSSSTSF

SEQ ID NO: 90772 - protein, 9 aa, Artificial Sequence
  Description of Artificial Sequence: Synthetic peptide
  Seed: LQIPVSAAS (MAGC1_HUMAN)
LFIPVSAAM

SEQ ID NO: 90773 - protein, 11 aa, Artificial Sequence
  Description of Artificial Sequence: Synthetic peptide
  Seed: STFEGFAQSPL (MAGC1_HUMAN)
SVFEGFAQSPA

SEQ ID NO: 90774 - protein, 9 aa, Artificial Sequence
  Description of Artificial Sequence: Synthetic peptide
  Seed: SPLHSPQSP (MAGC1_HUMAN)
SPLHSPQSA

SEQ ID NO: 90775 - protein, 9 aa, Artificial Sequence
  Description of Artificial Sequence: Synthetic peptide
  Seed: LQIPGSPSF (MAGC1_HUMAN)
LAIPGSPSI

SEQ ID NO: 90776 - protein, 9 aa, Artificial Sequence
  Description of Artificial Sequence: Synthetic peptide
  Seed: SFSERTQST (MAGC1_HUMAN)
SFSERTQSI

SEQ ID NO: 90777 - protein, 10 aa, Artificial Sequence
  Description of Artificial Sequence: Synthetic peptide
  Seed: REFIEILFGI (MAGC1_HUMAN)
RAFIEILFGL

SEQ ID NO: 90778 - protein, 9 aa, Artificial Sequence
  Description of Artificial Sequence: Synthetic peptide
  Seed: NTVPITFPS (MAGC1_HUMAN)
NGVPITFPR

SEQ ID NO: 90779 - protein, 9 aa, Artificial Sequence
  Description of Artificial Sequence: Synthetic peptide
  Seed: GFPQSPLQI (MAGC1_HUMAN)
GRPQSPLQF

SEQ ID NO: 90780 - protein, 11 aa, Artificial Sequence
  Description of Artificial Sequence: Synthetic peptide
  Seed: IPVSAASSSTL (MAGC1_HUMAN)
IGVSAASSSTF

SEQ ID NO: 90781 - protein, 11 aa, Artificial Sequence
  Description of Artificial Sequence: Synthetic peptide
  Seed: STFEGFAQSPL (MAGC1_HUMAN)
STFEGFAQSPW

SEQ ID NO: 90782 - protein, 8 aa, Artificial Sequence
  Description of Artificial Sequence: Synthetic peptide
  Seed: FGEPRELL (MAGC1_HUMAN)
FFEPRELL

SEQ ID NO: 90783 - protein, 9 aa, Artificial Sequence
  Description of Artificial Sequence: Synthetic peptide
  Seed: VISRYTGYF (MAGC1_HUMAN)
VTSRYTGYM

SEQ ID NO: 90784 - protein, 9 aa, Artificial Sequence
  Description of Artificial Sequence: Synthetic peptide
  Seed: VSSSFSYTL (MAGC1_HUMAN)
VYSSFSYTM

SEQ ID NO: 90785 - protein, 10 aa, Artificial Sequence
  Description of Artificial Sequence: Synthetic peptide
  Seed: ASSSTLVSIF (MAGC1_HUMAN)
AQSSTLVSIF

SEQ ID NO: 90786 - protein, 9 aa, Artificial Sequence
  Description of Artificial Sequence: Synthetic peptide
  Seed: LARFLLLKY (MAGC1_HUMAN)
LSRFLLLKF

SEQ ID NO: 90787 - protein, 10 aa, Artificial Sequence
  Description of Artificial Sequence: Synthetic peptide
  Seed: WGPRAHSEVI (MAGC1_HUMAN)
WAPRAHSEVL

SEQ ID NO: 90788 - protein, 10 aa, Artificial Sequence
  Description of Artificial Sequence: Synthetic peptide
  Seed: SSPESAQSTF (MAGC1_HUMAN)
SVPESAQSTW

SEQ ID NO: 90789 - protein, 11 aa, Artificial Sequence
  Description of Artificial Sequence: Synthetic peptide
  Seed: SPLQIPMTSSF (MAGC1_HUMAN)
SILQIPMTSSM

SEQ ID NO: 90790 - protein, 10 aa, Artificial Sequence
  Description of Artificial Sequence: Synthetic peptide
  Seed: GEDSSDPLQR (MAGC1_HUMAN)
GIDSSDPLQY

SEQ ID NO: 90791 - protein, 9 aa, Artificial Sequence
  Description of Artificial Sequence: Synthetic peptide
  Seed: CTQSTFEGF (MAGC1_HUMAN)
CQQSTFEGF

SEQ ID NO: 90792 - protein, 10 aa, Artificial Sequence
  Description of Artificial Sequence: Synthetic peptide
  Seed: EVIWDVLSGI (MAGC1_HUMAN)
EYIWDVLSGL

SEQ ID NO: 90793 - protein, 9 aa, Artificial Sequence
  Description of Artificial Sequence: Synthetic peptide
  Seed: FFSSALLSI (MAGC1_HUMAN)
FLSSALLSC

SEQ ID NO: 90794 - protein, 9 aa, Artificial Sequence
  Description of Artificial Sequence: Synthetic peptide
  Seed: GFPQSPLQI (MAGC1_HUMAN)
GAPQSPLQV

SEQ ID NO: 90795 - protein, 10 aa, Artificial Sequence
  Description of Artificial Sequence: Synthetic peptide
  Seed: MPTAGMPSLL (MAGC1_HUMAN)
MMTAGMPSLI

SEQ ID NO: 90796 - protein, 11 aa, Artificial Sequence
  Description of Artificial Sequence: Synthetic peptide
  Seed: LHSPQSPPEGM (MAGC1_HUMAN)
LHSPQSPPEGF

SEQ ID NO: 90797 - protein, 9 aa, Artificial Sequence
  Description of Artificial Sequence: Synthetic peptide
  Seed: VSAASSSTL (MAGC1_HUMAN)
VKAASSSTI

SEQ ID NO: 90798 - protein, 10 aa, Artificial Sequence
  Description of Artificial Sequence: Synthetic peptide
  Seed: FQSSLQSPVS (MAGC1_HUMAN)
FMSSLQSPVD

SEQ ID NO: 90799 - protein, 10 aa, Artificial Sequence
  Description of Artificial Sequence: Synthetic peptide
  Seed: SLFQSFSERT (MAGC1_HUMAN)
SMFQSFSERA

SEQ ID NO: 90800 - protein, 9 aa, Artificial Sequence
  Description of Artificial Sequence: Synthetic peptide
  Seed: AQSPLQIPV (MAGC1_HUMAN)
AESPLQIPS

SEQ ID NO: 90801 - protein, 9 aa, Artificial Sequence
  Description of Artificial Sequence: Synthetic peptide
  Seed: ISFSSSTSL (MAGC1_HUMAN)
ICFSSSTSY

SEQ ID NO: 90802 - protein, 10 aa, Artificial Sequence
  Description of Artificial Sequence: Synthetic peptide
  Seed: RSFSSTLLSI (MAGC1_HUMAN)
RYFSSTLLSF

SEQ ID NO: 90803 - protein, 9 aa, Artificial Sequence
  Description of Artificial Sequence: Synthetic peptide
  Seed: FAFGEPREL (MAGC1_HUMAN)
FIFGEPREF

SEQ ID NO: 90804 - protein, 9 aa, Artificial Sequence
  Description of Artificial Sequence: Synthetic peptide
  Seed: SSSSSSSTL (MAGC1_HUMAN)
SQSSSSSTF

SEQ ID NO: 90805 - protein, 10 aa, Artificial Sequence
  Description of Artificial Sequence: Synthetic peptide
  Seed: FQSSLQSPVS (MAGC1_HUMAN)
FMSSLQSPVY

SEQ ID NO: 90806 - protein, 9 aa, Artificial Sequence
  Description of Artificial Sequence: Synthetic peptide
  Seed: QVKQPITKA (MAGC1_HUMAN)
QIKQPITKY

SEQ ID NO: 90807 - protein, 10 aa, Artificial Sequence
  Description of Artificial Sequence: Synthetic peptide
  Seed: ASSSVMSPSF (MAGC1_HUMAN)
AVSSVMSPSF

SEQ ID NO: 90808 - protein, 9 aa, Artificial Sequence
  Description of Artificial Sequence: Synthetic peptide
  Seed: KVDELARFL (MAGC1_HUMAN)
KIDELARFV

SEQ ID NO: 90809 - protein, 11 aa, Artificial Sequence
  Description of Artificial Sequence: Synthetic peptide
  Seed: FIKGTYASEEV (MAGC1_HUMAN)
FLKGTYASEEV

SEQ ID NO: 90810 - protein, 9 aa, Artificial Sequence
  Description of Artificial Sequence: Synthetic peptide
  Seed: IGVRAGREH (MAGC1_HUMAN)
IAVRAGREF

SEQ ID NO: 90811 - protein, 9 aa, Artificial Sequence
  Description of Artificial Sequence: Synthetic peptide
  Seed: FQSSPERTH (MAGC1_HUMAN)
FASSPERTM

SEQ ID NO: 90812 - protein, 10 aa, Artificial Sequence
  Description of Artificial Sequence: Synthetic peptide
  Seed: YASEEVIWDV (MAGC1_HUMAN)
YMSEEVIWDV

SEQ ID NO: 90813 - protein, 9 aa, Artificial Sequence
  Description of Artificial Sequence: Synthetic peptide
  Seed: NPASSFFSS (MAGC1_HUMAN)
NTASSFFSY

SEQ ID NO: 90814 - protein, 10 aa, Artificial Sequence
  Description of Artificial Sequence: Synthetic peptide
  Seed: SSSSTLLSLF (MAGC1_HUMAN)
SYSSTLLSLI

SEQ ID NO: 90815 - protein, 9 aa, Artificial Sequence
  Description of Artificial Sequence: Synthetic peptide
  Seed: LQIPGSPSF (MAGC1_HUMAN)
LHIPGSPSM

SEQ ID NO: 90816 - protein, 10 aa, Artificial Sequence
  Description of Artificial Sequence: Synthetic peptide
  Seed: SSPESTQSPF (MAGC1_HUMAN)
SSPESTQSPM

SEQ ID NO: 90817 - protein, 10 aa, Artificial Sequence
  Description of Artificial Sequence: Synthetic peptide
  Seed: ILFGISLREV (MAGC1_HUMAN)
ILFGISLREL

SEQ ID NO: 90818 - protein, 10 aa, Artificial Sequence
  Description of Artificial Sequence: Synthetic peptide
  Seed: FFSSALLSIF (MAGC1_HUMAN)
FLSSALLSIY

SEQ ID NO: 90819 - protein, 9 aa, Artificial Sequence
  Description of Artificial Sequence: Synthetic peptide
  Seed: FSYTLASLL (MAGC1_HUMAN)
FRYTLASLY

SEQ ID NO: 90820 - protein, 10 aa, Artificial Sequence
  Description of Artificial Sequence: Synthetic peptide
  Seed: SSPESAQSTF (MAGC1_HUMAN)
SAPESAQSTI

SEQ ID NO: 90821 - protein, 9 aa, Artificial Sequence
  Description of Artificial Sequence: Synthetic peptide
  Seed: VSAASSSTL (MAGC1_HUMAN)
VQAASSSTY

SEQ ID NO: 90822 - protein, 10 aa, Artificial Sequence
  Description of Artificial Sequence: Synthetic peptide
  Seed: EGPAQSPLQR (MAGC1_HUMAN)
EVPAQSPLQR

SEQ ID NO: 90823 - protein, 11 aa, Artificial Sequence
  Description of Artificial Sequence: Synthetic peptide
  Seed: REVPNSSPPRY (MAGC1_HUMAN)
RWVPNSSPPRY

SEQ ID NO: 90824 - protein, 11 aa, Artificial Sequence
  Description of Artificial Sequence: Synthetic peptide
  Seed: SPLQIPMTSSF (MAGC1_HUMAN)
SMLQIPMTSSM

SEQ ID NO: 90825 - protein, 9 aa, Artificial Sequence
  Description of Artificial Sequence: Synthetic peptide
  Seed: STFEGFPQS (MAGC1_HUMAN)
SVFEGFPQF

SEQ ID NO: 90826 - protein, 9 aa, Artificial Sequence
  Description of Artificial Sequence: Synthetic peptide
  Seed: STFEGFAQS (MAGC1_HUMAN)
SSFEGFAQV

SEQ ID NO: 90827 - protein, 9 aa, Artificial Sequence
  Description of Artificial Sequence: Synthetic peptide
  Seed: LQNPASSFF (MAGC1_HUMAN)
LANPASSFF

SEQ ID NO: 90828 - protein, 9 aa, Artificial Sequence
  Description of Artificial Sequence: Synthetic peptide
  Seed: QIVPSLPEW (MAGC1_HUMAN)
QLVPSLPEW

SEQ ID NO: 90829 - protein, 9 aa, Artificial Sequence
  Description of Artificial Sequence: Synthetic peptide
  Seed: SSFFSSALL (MAGC1_HUMAN)
SCFFSSALF

SEQ ID NO: 90830 - protein, 9 aa, Artificial Sequence
  Description of Artificial Sequence: Synthetic peptide
  Seed: YPLQSPQSR (MAGC1_HUMAN)
YVLQSPQSY

SEQ ID NO: 90831 - protein, 10 aa, Artificial Sequence
  Description of Artificial Sequence: Synthetic peptide
  Seed: LQIPGSPSFS (MAGC1_HUMAN)
LTIPGSPSFY

SEQ ID NO: 90832 - protein, 10 aa, Artificial Sequence
  Description of Artificial Sequence: Synthetic peptide
  Seed: RKVVEFLAML (MAGC1_HUMAN)
RNVVEFLAMI

SEQ ID NO: 90833 - protein, 9 aa, Artificial Sequence
  Description of Artificial Sequence: Synthetic peptide
  Seed: SSFSYTLLS (MAGC1_HUMAN)
SIFSYTLLK

SEQ ID NO: 90834 - protein, 10 aa, Artificial Sequence
  Description of Artificial Sequence: Synthetic peptide
  Seed: SSPESAQSAF (MAGC1_HUMAN)
SAPESAQSAF

SEQ ID NO: 90835 - protein, 9 aa, Artificial Sequence
  Description of Artificial Sequence: Synthetic peptide
  Seed: YVFVNTLDL (MAGC1_HUMAN)
YCFVNTLDY

SEQ ID NO: 90836 - protein, 11 aa, Artificial Sequence
  Description of Artificial Sequence: Synthetic peptide
  Seed: SICSSSTPSSL (MAGC1_HUMAN)
SLCSSSTPSSY

SEQ ID NO: 90837 - protein, 9 aa, Artificial Sequence
  Description of Artificial Sequence: Synthetic peptide
  Seed: AGREHFAFG (MAGC1_HUMAN)
AVREHFAFR

SEQ ID NO: 90838 - protein, 10 aa, Artificial Sequence
  Description of Artificial Sequence: Synthetic peptide
  Seed: YTLASLLQSS (MAGC1_HUMAN)
YMLASLLQSI

SEQ ID NO: 90839 - protein, 9 aa, Artificial Sequence
  Description of Artificial Sequence: Synthetic peptide
  Seed: ISRYTGYFP (MAGC1_HUMAN)
ITRYTGYFI

SEQ ID NO: 90840 - protein, 8 aa, Artificial Sequence
  Description of Artificial Sequence: Synthetic peptide
  Seed: FSYTLLSL (MAGC1_HUMAN)
FAYTLLSY

SEQ ID NO: 90841 - protein, 10 aa, Artificial Sequence
  Description of Artificial Sequence: Synthetic peptide
  Seed: FSYTLLSLFQ (MAGC1_HUMAN)
FTYTLLSLFW

SEQ ID NO: 90842 - protein, 9 aa, Artificial Sequence
  Description of Artificial Sequence: Synthetic peptide
  Seed: LQSPVISFS (MAGC1_HUMAN)
LMSPVISFL

SEQ ID NO: 90843 - protein, 11 aa, Artificial Sequence
  Description of Artificial Sequence: Synthetic peptide
  Seed: SSFPSSTSSSL (MAGC1_HUMAN)
SEFPSSTSSSY

SEQ ID NO: 90844 - protein, 9 aa, Artificial Sequence
  Description of Artificial Sequence: Synthetic peptide
  Seed: EDSQSPLQI (MAGC1_HUMAN)
EESQSPLQF

SEQ ID NO: 90845 - protein, 10 aa, Artificial Sequence
  Description of Artificial Sequence: Synthetic peptide
  Seed: PLQIPVSSSF (MAGC1_HUMAN)
PKQIPVSSSF

SEQ ID NO: 90846 - protein, 10 aa, Artificial Sequence
  Description of Artificial Sequence: Synthetic peptide
  Seed: VSSSSSSSTL (MAGC1_HUMAN)
VKSSSSSSTF

SEQ ID NO: 90847 - protein, 9 aa, Artificial Sequence
  Description of Artificial Sequence: Synthetic peptide
  Seed: FPSSTSSSL (MAGC1_HUMAN)
FCSSTSSSF

SEQ ID NO: 90848 - protein, 11 aa, Artificial Sequence
  Description of Artificial Sequence: Synthetic peptide
  Seed: SPLQIPVSSSS (MAGC1_HUMAN)
SVLQIPVSSSY

SEQ ID NO: 90849 - protein, 10 aa, Artificial Sequence
  Description of Artificial Sequence: Synthetic peptide
  Seed: NTVPITFPSS (MAGC1_HUMAN)
NVVPITFPSI

SEQ ID NO: 90850 - protein, 10 aa, Artificial Sequence
  Description of Artificial Sequence: Synthetic peptide
  Seed: FPSSYKDALK (MAGC1_HUMAN)
FTSSYKDALR

SEQ ID NO: 90851 - protein, 9 aa, Artificial Sequence
  Description of Artificial Sequence: Synthetic peptide
  Seed: SSSSSSSTL (MAGC1_HUMAN)
SVSSSSSTL

SEQ ID NO: 90852 - protein, 9 aa, Artificial Sequence
  Description of Artificial Sequence: Synthetic peptide
  Seed: RTHSTFEGF (MAGC1_HUMAN)
RNHSTFEGY

SEQ ID NO: 90853 - protein, 9 aa, Artificial Sequence
  Description of Artificial Sequence: Synthetic peptide
  Seed: MTSSFSSTL (MAGC1_HUMAN)
MPSSFSSTF

SEQ ID NO: 90854 - protein, 9 aa, Artificial Sequence
  Description of Artificial Sequence: Synthetic peptide
  Seed: FAFGEPREL (MAGC1_HUMAN)
FNFGEPREL

SEQ ID NO: 90855 - protein, 9 aa, Artificial Sequence
  Description of Artificial Sequence: Synthetic peptide
  Seed: ALLSIFQSS (MAGC1_HUMAN)
AQLSIFQSL

SEQ ID NO: 90856 - protein, 9 aa, Artificial Sequence
  Description of Artificial Sequence: Synthetic peptide
  Seed: SRSFSSTLL (MAGC1_HUMAN)
SPSFSSTLF

SEQ ID NO: 90857 - protein, 10 aa, Artificial Sequence
  Description of Artificial Sequence: Synthetic peptide
  Seed: YTLLSLFQSS (MAGC1_HUMAN)
YRLLSLFQSV

SEQ ID NO: 90858 - protein, 9 aa, Artificial Sequence
  Description of Artificial Sequence: Synthetic peptide
  Seed: SFFSYTLAS (MAGC1_HUMAN)
SWFSYTLAI

SEQ ID NO: 90859 - protein, 9 aa, Artificial Sequence
  Description of Artificial Sequence: Synthetic peptide
  Seed: FSYTLASLL (MAGC1_HUMAN)
FMYTLASLH

SEQ ID NO: 90860 - protein, 8 aa, Artificial Sequence
  Description of Artificial Sequence: Synthetic peptide
  Seed: SDDTLYPL (MAGC1_HUMAN)
SADTLYPL

SEQ ID NO: 90861 - protein, 8 aa, Artificial Sequence
  Description of Artificial Sequence: Synthetic peptide
  Seed: YTGYFPVI (MAGC1_HUMAN)
YAGYFPVM

SEQ ID NO: 90862 - protein, 9 aa, Artificial Sequence
  Description of Artificial Sequence: Synthetic peptide
  Seed: TFEGFPQSL (MAGC1_HUMAN)
TCEGFPQSL

SEQ ID NO: 90863 - protein, 9 aa, Artificial Sequence
  Description of Artificial Sequence: Synthetic peptide
  Seed: SSSTSLSPF (MAGC1_HUMAN)
SSSTSLSPW

SEQ ID NO: 90864 - protein, 9 aa, Artificial Sequence
  Description of Artificial Sequence: Synthetic peptide
  Seed: TLASLLQSS (MAGC1_HUMAN)
TVASLLQSM

SEQ ID NO: 90865 - protein, 9 aa, Artificial Sequence
  Description of Artificial Sequence: Synthetic peptide
  Seed: YQVKQPITK (MAGC1_HUMAN)
YGVKQPITL

SEQ ID NO: 90866 - protein, 9 aa, Artificial Sequence
  Description of Artificial Sequence: Synthetic peptide
  Seed: VLSGIGVRA (MAGC1_HUMAN)
VMSGIGVRL

SEQ ID NO: 90867 - protein, 10 aa, Artificial Sequence
  Description of Artificial Sequence: Synthetic peptide
  Seed: VISFSSSTSL (MAGC1_HUMAN)
VTSFSSSTSY

SEQ ID NO: 90868 - protein, 10 aa, Artificial Sequence
  Description of Artificial Sequence: Synthetic peptide
  Seed: FPQSLLQIPM (MAGC1_HUMAN)
FVQSLLQIPY

SEQ ID NO: 90869 - protein, 10 aa, Artificial Sequence
  Description of Artificial Sequence: Synthetic peptide
  Seed: SPLQIPMTSS (MAGC1_HUMAN)
SPLQIPMTSA

SEQ ID NO: 90870 - protein, 9 aa, Artificial Sequence
  Description of Artificial Sequence: Synthetic peptide
  Seed: FSERTQSTF (MAGC1_HUMAN)
FAERTQSTM

SEQ ID NO: 90871 - protein, 11 aa, Artificial Sequence
  Description of Artificial Sequence: Synthetic peptide
  Seed: SFSSSTSLSPF (MAGC1_HUMAN)
SQSSSTSLSPY

SEQ ID NO: 90872 - protein, 11 aa, Artificial Sequence
  Description of Artificial Sequence: Synthetic peptide
  Seed: TLDEKVDELAR (MAGC1_HUMAN)
TLDEKVDELAL

SEQ ID NO: 90873 - protein, 11 aa, Artificial Sequence
  Description of Artificial Sequence: Synthetic peptide
  Seed: IPMTSSFSSTL (MAGC1_HUMAN)
IMMTSSFSSTF

SEQ ID NO: 90874 - protein, 11 aa, Artificial Sequence
  Description of Artificial Sequence: Synthetic peptide
  Seed: SSFPSSTSSSL (MAGC1_HUMAN)
SYFPSSTSSSW

SEQ ID NO: 90875 - protein, 10 aa, Artificial Sequence
  Description of Artificial Sequence: Synthetic peptide
  Seed: MTSSFSSTLL (MAGC1_HUMAN)
MFSSFSSTLW

SEQ ID NO: 90876 - protein, 9 aa, Artificial Sequence
  Description of Artificial Sequence: Synthetic peptide
  Seed: VVEFLAMLK (MAGC1_HUMAN)
VIEFLAMLR

SEQ ID NO: 90877 - protein, 9 aa, Artificial Sequence
  Description of Artificial Sequence: Synthetic peptide
  Seed: SSPESPLQS (MAGC1_HUMAN)
SPPESPLQL

SEQ ID NO: 90878 - protein, 9 aa, Artificial Sequence
  Description of Artificial Sequence: Synthetic peptide
  Seed: LQIPGSPSF (MAGC1_HUMAN)
LAIPGSPSM

SEQ ID NO: 90879 - protein, 9 aa, Artificial Sequence
  Description of Artificial Sequence: Synthetic peptide
  Seed: FPVIFRKAR (MAGC1_HUMAN)
FTVIFRKAR

SEQ ID NO: 90880 - protein, 9 aa, Artificial Sequence
  Description of Artificial Sequence: Synthetic peptide
  Seed: GEDSLSPLQ (MAGC1_HUMAN)
GEDSLSPLL

SEQ ID NO: 90881 - protein, 11 aa, Artificial Sequence
  Description of Artificial Sequence: Synthetic peptide
  Seed: QSSPESAQSTF (MAGC1_HUMAN)
QGSPESAQSTW

SEQ ID NO: 90882 - protein, 9 aa, Artificial Sequence
  Description of Artificial Sequence: Synthetic peptide
  Seed: EFIEILFGI (MAGC1_HUMAN)
EAIEILFGS

SEQ ID NO: 90883 - protein, 10 aa, Artificial Sequence
  Description of Artificial Sequence: Synthetic peptide
  Seed: YTLASLLQSS (MAGC1_HUMAN)
YRLASLLQSM

SEQ ID NO: 90884 - protein, 11 aa, Artificial Sequence
  Description of Artificial Sequence: Synthetic peptide
  Seed: REVPNSSPPRY (MAGC1_HUMAN)
REVPNSSPPRM

SEQ ID NO: 90885 - protein, 9 aa, Artificial Sequence
  Description of Artificial Sequence: Synthetic peptide
  Seed: KVWVQEHYL (MAGC1_HUMAN)
KLWVQEHYC

SEQ ID NO: 90886 - protein, 11 aa, Artificial Sequence
  Description of Artificial Sequence: Synthetic peptide
  Seed: SFFSYTLASLL (MAGC1_HUMAN)
SSFSYTLASLM

SEQ ID NO: 90887 - protein, 9 aa, Artificial Sequence
  Description of Artificial Sequence: Synthetic peptide
  Seed: SSPERTQST (MAGC1_HUMAN)
SGPERTQSF

SEQ ID NO: 90888 - protein, 9 aa, Artificial Sequence
  Description of Artificial Sequence: Synthetic peptide
  Seed: LQIPGSPSF (MAGC1_HUMAN)
LFIPGSPSM

SEQ ID NO: 90889 - protein, 9 aa, Artificial Sequence
  Description of Artificial Sequence: Synthetic peptide
  Seed: SSPPRYEFL (MAGC1_HUMAN)
SYPPRYEFI

SEQ ID NO: 90890 - protein, 10 aa, Artificial Sequence
  Description of Artificial Sequence: Synthetic peptide
  Seed: TVPITFPSSY (MAGC1_HUMAN)
TMPITFPSSF

SEQ ID NO: 90891 - protein, 9 aa, Artificial Sequence
  Description of Artificial Sequence: Synthetic peptide
  Seed: SPPEGENTH (MAGC1_HUMAN)
SMPEGENTF

SEQ ID NO: 90892 - protein, 9 aa, Artificial Sequence
  Description of Artificial Sequence: Synthetic peptide
  Seed: RTHSTFEGF (MAGC1_HUMAN)
RQHSTFEGI

SEQ ID NO: 90893 - protein, 11 aa, Artificial Sequence
  Description of Artificial Sequence: Synthetic peptide
  Seed: STFEGFAQSPL (MAGC1_HUMAN)
STFEGFAQSPI

SEQ ID NO: 90894 - protein, 9 aa, Artificial Sequence
  Description of Artificial Sequence: Synthetic peptide
  Seed: RPVSSFFSY (MAGC1_HUMAN)
RPVSSFFSI

SEQ ID NO: 90895 - protein, 10 aa, Artificial Sequence
  Description of Artificial Sequence: Synthetic peptide
  Seed: VSPSSSSTLL (MAGC1_HUMAN)
VVPSSSSTLL

SEQ ID NO: 90896 - protein, 10 aa, Artificial Sequence
  Description of Artificial Sequence: Synthetic peptide
  Seed: RYTGYFPVIF (MAGC1_HUMAN)
RHTGYFPVIY

SEQ ID NO: 90897 - protein, 10 aa, Artificial Sequence
  Description of Artificial Sequence: Synthetic peptide
  Seed: SPLYFPQSPL (MAGC1_HUMAN)
SGLYFPQSPV

SEQ ID NO: 90898 - protein, 9 aa, Artificial Sequence
  Description of Artificial Sequence: Synthetic peptide
  Seed: RKAREFIEI (MAGC1_HUMAN)
RTAREFIEF

SEQ ID NO: 90899 - protein, 10 aa, Artificial Sequence
  Description of Artificial Sequence: Synthetic peptide
  Seed: SFSYTLLSLF (MAGC1_HUMAN)
SSSYTLLSLY

SEQ ID NO: 90900 - protein, 9 aa, Artificial Sequence
  Description of Artificial Sequence: Synthetic peptide
  Seed: VISRYTGYF (MAGC1_HUMAN)
VQSRYTGYM

SEQ ID NO: 90901 - protein, 11 aa, Artificial Sequence
  Description of Artificial Sequence: Synthetic peptide
  Seed: IPVSRSFSSTL (MAGC1_HUMAN)
IPVSRSFSSTF

SEQ ID NO: 90902 - protein, 9 aa, Artificial Sequence
  Description of Artificial Sequence: Synthetic peptide
  Seed: MSQNRLLIL (MAGC1_HUMAN)
MSQNRLLIK

SEQ ID NO: 90903 - protein, 9 aa, Artificial Sequence
  Description of Artificial Sequence: Synthetic peptide
  Seed: SSSTSLSPF (MAGC1_HUMAN)
SQSTSLSPV

SEQ ID NO: 90904 - protein, 10 aa, Artificial Sequence
  Description of Artificial Sequence: Synthetic peptide
  Seed: EVIWDVLSGI (MAGC1_HUMAN)
EVIWDVLSGL

SEQ ID NO: 90905 - protein, 9 aa, Artificial Sequence
  Description of Artificial Sequence: Synthetic peptide
  Seed: STQSPFEGF (MAGC1_HUMAN)
SAQSPFEGL

SEQ ID NO: 90906 - protein, 10 aa, Artificial Sequence
  Description of Artificial Sequence: Synthetic peptide
  Seed: VSSSSSSTLL (MAGC1_HUMAN)
VYSSSSSTLW

SEQ ID NO: 90907 - protein, 10 aa, Artificial Sequence
  Description of Artificial Sequence: Synthetic peptide
  Seed: EMLTNVISRY (MAGC1_HUMAN)
EILTNVISRR

SEQ ID NO: 90908 - protein, 9 aa, Artificial Sequence
  Description of Artificial Sequence: Synthetic peptide
  Seed: TLASLLQSS (MAGC1_HUMAN)
TVASLLQSI

SEQ ID NO: 90909 - protein, 9 aa, Artificial Sequence
  Description of Artificial Sequence: Synthetic peptide
  Seed: DSYVFVNTL (MAGC1_HUMAN)
DTYVFVNTI

SEQ ID NO: 90910 - protein, 9 aa, Artificial Sequence
  Description of Artificial Sequence: Synthetic peptide
  Seed: LQIPVSAAS (MAGC1_HUMAN)
LFIPVSAAF

SEQ ID NO: 90911 - protein, 10 aa, Artificial Sequence
  Description of Artificial Sequence: Synthetic peptide
  Seed: MLKNTVPITF (MAGC1_HUMAN)
MKKNTVPITF

SEQ ID NO: 90912 - protein, 11 aa, Artificial Sequence
  Description of Artificial Sequence: Synthetic peptide
  Seed: SFFSYTLASLL (MAGC1_HUMAN)
SVFSYTLASLF

SEQ ID NO: 90913 - protein, 9 aa, Artificial Sequence
  Description of Artificial Sequence: Synthetic peptide
  Seed: CSSSTSLSL (MAGC1_HUMAN)
CSSSTSLSF

SEQ ID NO: 90914 - protein, 11 aa, Artificial Sequence
  Description of Artificial Sequence: Synthetic peptide
  Seed: STFEGFPQSLL (MAGC1_HUMAN)
SSFEGFPQSLF

SEQ ID NO: 90915 - protein, 11 aa, Artificial Sequence
  Description of Artificial Sequence: Synthetic peptide
  Seed: REVPNSSPPRY (MAGC1_HUMAN)
RQVPNSSPPRI

SEQ ID NO: 90916 - protein, 8 aa, Artificial Sequence
  Description of Artificial Sequence: Synthetic peptide
  Seed: LAMLKNTV (MAGC1_HUMAN)
LLMLKNTM

SEQ ID NO: 90917 - protein, 10 aa, Artificial Sequence
  Description of Artificial Sequence: Synthetic peptide
  Seed: SFPSSTSSSL (MAGC1_HUMAN)
SFPSSTSSSY

SEQ ID NO: 90918 - protein, 10 aa, Artificial Sequence
  Description of Artificial Sequence: Synthetic peptide
  Seed: ASSSVMSPSF (MAGC1_HUMAN)
AMSSVMSPSW

SEQ ID NO: 90919 - protein, 10 aa, Artificial Sequence
  Description of Artificial Sequence: Synthetic peptide
  Seed: FSSSTSLSPF (MAGC1_HUMAN)
FTSSTSLSPF

SEQ ID NO: 90920 - protein, 9 aa, Artificial Sequence
  Description of Artificial Sequence: Synthetic peptide
  Seed: YTLLSLFQS (MAGC1_HUMAN)
YGLLSLFQV

SEQ ID NO: 90921 - protein, 9 aa, Artificial Sequence
  Description of Artificial Sequence: Synthetic peptide
  Seed: LTKVWVQEH (MAGC1_HUMAN)
LAKVWVQEF

SEQ ID NO: 90922 - protein, 9 aa, Artificial Sequence
  Description of Artificial Sequence: Synthetic peptide
  Seed: VPITFPSSY (MAGC1_HUMAN)
VQITFPSSM

SEQ ID NO: 90923 - protein, 10 aa, Artificial Sequence
  Description of Artificial Sequence: Synthetic peptide
  Seed: LQIPVSPSFS (MAGC1_HUMAN)
LIIPVSPSFF

SEQ ID NO: 90924 - protein, 9 aa, Artificial Sequence
  Description of Artificial Sequence: Synthetic peptide
  Seed: NTVPITFPS (MAGC1_HUMAN)
NLVPITFPR

SEQ ID NO: 90925 - protein, 10 aa, Artificial Sequence
  Description of Artificial Sequence: Synthetic peptide
  Seed: MTSSFSSTLL (MAGC1_HUMAN)
MVSSFSSTLF

SEQ ID NO: 90926 - protein, 11 aa, Artificial Sequence
  Description of Artificial Sequence: Synthetic peptide
  Seed: IPVSPSSSSTL (MAGC1_HUMAN)
ISVSPSSSSTM

SEQ ID NO: 90927 - protein, 9 aa, Artificial Sequence
  Description of Artificial Sequence: Synthetic peptide
  Seed: SFPSSTSSS (MAGC1_HUMAN)
SWPSSTSSM

SEQ ID NO: 90928 - protein, 10 aa, Artificial Sequence
  Description of Artificial Sequence: Synthetic peptide
  Seed: SFFSSALLSI (MAGC1_HUMAN)
SEFSSALLSF

SEQ ID NO: 90929 - protein, 9 aa, Artificial Sequence
  Description of Artificial Sequence: Synthetic peptide
  Seed: SSFSSTLLS (MAGC1_HUMAN)
SSFSSTLLK

SEQ ID NO: 90930 - protein, 9 aa, Artificial Sequence
  Description of Artificial Sequence: Synthetic peptide
  Seed: VSSFFSYTL (MAGC1_HUMAN)
VKSFFSYTM

SEQ ID NO: 90931 - protein, 9 aa, Artificial Sequence
  Description of Artificial Sequence: Synthetic peptide
  Seed: AFGEPRELL (MAGC1_HUMAN)
AAGEPRELF

SEQ ID NO: 90932 - protein, 10 aa, Artificial Sequence
  Description of Artificial Sequence: Synthetic peptide
  Seed: ASSFFSSALL (MAGC1_HUMAN)
ARSFFSSALL

SEQ ID NO: 90933 - protein, 11 aa, Artificial Sequence
  Description of Artificial Sequence: Synthetic peptide
  Seed: SSTPSSLPQSF (MAGC1_HUMAN)
SQTPSSLPQSM

SEQ ID NO: 90934 - protein, 9 aa, Artificial Sequence
  Description of Artificial Sequence: Synthetic peptide
  Seed: AQSPLQIPV (MAGC1_HUMAN)
ATSPLQIPI

SEQ ID NO: 90935 - protein, 10 aa, Artificial Sequence
  Description of Artificial Sequence: Synthetic peptide
  Seed: RKVVEFLAML (MAGC1_HUMAN)
RFVVEFLAMI

SEQ ID NO: 90936 - protein, 10 aa, Artificial Sequence
  Description of Artificial Sequence: Synthetic peptide
  Seed: MTSSFSSTLL (MAGC1_HUMAN)
MSSSFSSTLI

SEQ ID NO: 90937 - protein, 10 aa, Artificial Sequence
  Description of Artificial Sequence: Synthetic peptide
  Seed: SSPESTQSPF (MAGC1_HUMAN)
SGPESTQSPL

SEQ ID NO: 90938 - protein, 9 aa, Artificial Sequence
  Description of Artificial Sequence: Synthetic peptide
  Seed: EFIEILFGI (MAGC1_HUMAN)
EQIEILFGI

SEQ ID NO: 90939 - protein, 10 aa, Artificial Sequence
  Description of Artificial Sequence: Synthetic peptide
  Seed: YTLLSLFQSS (MAGC1_HUMAN)
YQLLSLFQSA

SEQ ID NO: 90940 - protein, 9 aa, Artificial Sequence
  Description of Artificial Sequence: Synthetic peptide
  Seed: TFEGFPQSL (MAGC1_HUMAN)
TQEGFPQSL

SEQ ID NO: 90941 - protein, 9 aa, Artificial Sequence
  Description of Artificial Sequence: Synthetic peptide
  Seed: LQSPVISFS (MAGC1_HUMAN)
LLSPVISFM

SEQ ID NO: 90942 - protein, 10 aa, Artificial Sequence
  Description of Artificial Sequence: Synthetic peptide
  Seed: SSFSSTLLSI (MAGC1_HUMAN)
SSFSSTLLSW

SEQ ID NO: 90943 - protein, 9 aa, Artificial Sequence
  Description of Artificial Sequence: Synthetic peptide
  Seed: TPSSLPQSF (MAGC1_HUMAN)
TVSSLPQSM

SEQ ID NO: 90944 - protein, 9 aa, Artificial Sequence
  Description of Artificial Sequence: Synthetic peptide
  Seed: AGREHFAFG (MAGC1_HUMAN)
AQREHFAFM

SEQ ID NO: 90945 - protein, 10 aa, Artificial Sequence
  Description of Artificial Sequence: Synthetic peptide
  Seed: LQIPVSRSFS (MAGC1_HUMAN)
LQIPVSRSFP

SEQ ID NO: 90946 - protein, 8 aa, Artificial Sequence
  Description of Artificial Sequence: Synthetic peptide
  Seed: AEMLTNVI (MAGC1_HUMAN)
AEMLTNVA

SEQ ID NO: 90947 - protein, 9 aa, Artificial Sequence
  Description of Artificial Sequence: Synthetic peptide
  Seed: KQPITKAEM (MAGC1_HUMAN)
KMPITKAEF

SEQ ID NO: 90948 - protein, 9 aa, Artificial Sequence
  Description of Artificial Sequence: Synthetic peptide
  Seed: LQIPMTSSF (MAGC1_HUMAN)
LMIPMTSSF

SEQ ID NO: 90949 - protein, 11 aa, Artificial Sequence
  Description of Artificial Sequence: Synthetic peptide
  Seed: STFEGFAQSSL (MAGC1_HUMAN)
SQFEGFAQSSI

SEQ ID NO: 90950 - protein, 11 aa, Artificial Sequence
  Description of Artificial Sequence: Synthetic peptide
  Seed: TLYPLQSPQSR (MAGC1_HUMAN)
TYYPLQSPQSR

SEQ ID NO: 90951 - protein, 9 aa, Artificial Sequence
  Description of Artificial Sequence: Synthetic peptide
  Seed: TLLSLFQSF (MAGC1_HUMAN)
TQLSLFQSL

SEQ ID NO: 90952 - protein, 10 aa, Artificial Sequence
  Description of Artificial Sequence: Synthetic peptide
  Seed: STSLSLPQSF (MAGC1_HUMAN)
SKSLSLPQSW

SEQ ID NO: 90953 - protein, 9 aa, Artificial Sequence
  Description of Artificial Sequence: Synthetic peptide
  Seed: SSSTSLSPF (MAGC1_HUMAN)
SFSTSLSPI

SEQ ID NO: 90954 - protein, 9 aa, Artificial Sequence
  Description of Artificial Sequence: Synthetic peptide
  Seed: KAREFIEIL (MAGC1_HUMAN)
KGREFIEIY

SEQ ID NO: 90955 - protein, 9 aa, Artificial Sequence
  Description of Artificial Sequence: Synthetic peptide
  Seed: VEERAQAII (MAGC1_HUMAN)
VEERAQAIV

SEQ ID NO: 90956 - protein, 10 aa, Artificial Sequence
  Description of Artificial Sequence: Synthetic peptide
  Seed: RAGREHFAFG (MAGC1_HUMAN)
REGREHFAFK

SEQ ID NO: 90957 - protein, 8 aa, Artificial Sequence
  Description of Artificial Sequence: Synthetic peptide
  Seed: FPQFPPQG (MAGC1_HUMAN)
FPQFPPQA

SEQ ID NO: 90958 - protein, 10 aa, Artificial Sequence
  Description of Artificial Sequence: Synthetic peptide
  Seed: FPQSVLQIPV (MAGC1_HUMAN)
FPQSVLQIPY

SEQ ID NO: 90959 - protein, 9 aa, Artificial Sequence
  Description of Artificial Sequence: Synthetic peptide
  Seed: IPGSPSFSS (MAGC1_HUMAN)
IPGSPSFSL

SEQ ID NO: 90960 - protein, 9 aa, Artificial Sequence
  Description of Artificial Sequence: Synthetic peptide
  Seed: LQIPVSAAS (MAGC1_HUMAN)
LSIPVSAAV

SEQ ID NO: 90961 - protein, 10 aa, Artificial Sequence
  Description of Artificial Sequence: Synthetic peptide
  Seed: MTSSFSSTLL (MAGC1_HUMAN)
MDSSFSSTLF

SEQ ID NO: 90962 - protein, 9 aa, Artificial Sequence
  Description of Artificial Sequence: Synthetic peptide
  Seed: LQIPVSAAS (MAGC1_HUMAN)
LTIPVSAAV

SEQ ID NO: 90963 - protein, 9 aa, Artificial Sequence
  Description of Artificial Sequence: Synthetic peptide
  Seed: SPESPLQSP (MAGC1_HUMAN)
SPESPLQSA

SEQ ID NO: 90964 - protein, 10 aa, Artificial Sequence
  Description of Artificial Sequence: Synthetic peptide
  Seed: ISRYTGYFPV (MAGC1_HUMAN)
IQRYTGYFPF

SEQ ID NO: 90965 - protein, 10 aa, Artificial Sequence
  Description of Artificial Sequence: Synthetic peptide
  Seed: SFSYTLLSLF (MAGC1_HUMAN)
SISYTLLSLF

SEQ ID NO: 90966 - protein, 10 aa, Artificial Sequence
  Description of Artificial Sequence: Synthetic peptide
  Seed: YTLASLLQSS (MAGC1_HUMAN)
YILASLLQSI

SEQ ID NO: 90967 - protein, 9 aa, Artificial Sequence
  Description of Artificial Sequence: Synthetic peptide
  Seed: LQIPMTSSF (MAGC1_HUMAN)
LFIPMTSSL

SEQ ID NO: 90968 - protein, 9 aa, Artificial Sequence
  Description of Artificial Sequence: Synthetic peptide
  Seed: FQSSLQSPV (MAGC1_HUMAN)
FASSLQSPV

SEQ ID NO: 90969 - protein, 10 aa, Artificial Sequence
  Description of Artificial Sequence: Synthetic peptide
  Seed: SILQSSPESA (MAGC1_HUMAN)
SQLQSSPESV

SEQ ID NO: 90970 - protein, 9 aa, Artificial Sequence
  Description of Artificial Sequence: Synthetic peptide
  Seed: LQIPMTSSF (MAGC1_HUMAN)
LSIPMTSSM

SEQ ID NO: 90971 - protein, 9 aa, Artificial Sequence
  Description of Artificial Sequence: Synthetic peptide
  Seed: SMSPLYFPQ (MAGC1_HUMAN)
SQSPLYFPK

SEQ ID NO: 90972 - protein, 9 aa, Artificial Sequence
  Description of Artificial Sequence: Synthetic peptide
  Seed: KVVEFLAML (MAGC1_HUMAN)
KVVEFLAMT

SEQ ID NO: 90973 - protein, 9 aa, Artificial Sequence
  Description of Artificial Sequence: Synthetic peptide
  Seed: SRSFSSTLL (MAGC1_HUMAN)
SKSFSSTLY

SEQ ID NO: 90974 - protein, 9 aa, Artificial Sequence
  Description of Artificial Sequence: Synthetic peptide
  Seed: SPLQIPMTS (MAGC1_HUMAN)
SMLQIPMTV

SEQ ID NO: 90975 - protein, 9 aa, Artificial Sequence
  Description of Artificial Sequence: Synthetic peptide
  Seed: FQSSLQSPV (MAGC1_HUMAN)
FKSSLQSPW

SEQ ID NO: 90976 - protein, 9 aa, Artificial Sequence
  Description of Artificial Sequence: Synthetic peptide
  Seed: SSPESPLQS (MAGC1_HUMAN)
SNPESPLQM

SEQ ID NO: 90977 - protein, 9 aa, Artificial Sequence
  Description of Artificial Sequence: Synthetic peptide
  Seed: QIVPSLPEW (MAGC1_HUMAN)
QQVPSLPEV

SEQ ID NO: 90978 - protein, 10 aa, Artificial Sequence
  Description of Artificial Sequence: Synthetic peptide
  Seed: LIESEPLFTY (MAGC1_HUMAN)
LQESEPLFTY

SEQ ID NO: 90979 - protein, 10 aa, Artificial Sequence
  Description of Artificial Sequence: Synthetic peptide
  Seed: SPPEGPAQSP (MAGC1_HUMAN)
SPPEGPAQSI

SEQ ID NO: 90980 - protein, 9 aa, Artificial Sequence
  Description of Artificial Sequence: Synthetic peptide
  Seed: LQIPVSPSF (MAGC1_HUMAN)
LMIPVSPSV

SEQ ID NO: 90981 - protein, 9 aa, Artificial Sequence
  Description of Artificial Sequence: Synthetic peptide
  Seed: ASSSTLVSI (MAGC1_HUMAN)
AGSSTLVSW

SEQ ID NO: 90982 - protein, 10 aa, Artificial Sequence
  Description of Artificial Sequence: Synthetic peptide
  Seed: YTLASLLQSS (MAGC1_HUMAN)
YALASLLQSV

SEQ ID NO: 90983 - protein, 10 aa, Artificial Sequence
  Description of Artificial Sequence: Synthetic peptide
  Seed: LLQIPMTSSF (MAGC1_HUMAN)
LVQIPMTSSL

SEQ ID NO: 90984 - protein, 9 aa, Artificial Sequence
  Description of Artificial Sequence: Synthetic peptide
  Seed: SSLSQSSPV (MAGC1_HUMAN)
SLLSQSSPM

SEQ ID NO: 90985 - protein, 11 aa, Artificial Sequence
  Description of Artificial Sequence: Synthetic peptide
  Seed: SSSSSSTLLSL (MAGC1_HUMAN)
SRSSSSTLLSW

SEQ ID NO: 90986 - protein, 11 aa, Artificial Sequence
  Description of Artificial Sequence: Synthetic peptide
  Seed: SERTQSTFEGF (MAGC1_HUMAN)
SERTQSTFEGW

SEQ ID NO: 90987 - protein, 10 aa, Artificial Sequence
  Description of Artificial Sequence: Synthetic peptide
  Seed: ATESASSSVM (MAGC1_HUMAN)
AIESASSSVF

SEQ ID NO: 90988 - protein, 9 aa, Artificial Sequence
  Description of Artificial Sequence: Synthetic peptide
  Seed: LQIPVSSSS (MAGC1_HUMAN)
LVIPVSSSW

SEQ ID NO: 90989 - protein, 9 aa, Artificial Sequence
  Description of Artificial Sequence: Synthetic peptide
  Seed: FSSTLVSLF (MAGC1_HUMAN)
FASTLVSLM

SEQ ID NO: 90990 - protein, 9 aa, Artificial Sequence
  Description of Artificial Sequence: Synthetic peptide
  Seed: LQIPVSRSF (MAGC1_HUMAN)
LSIPVSRSL

SEQ ID NO: 90991 - protein, 9 aa, Artificial Sequence
  Description of Artificial Sequence: Synthetic peptide
  Seed: SSSTLVSIF (MAGC1_HUMAN)
SASTLVSIW

SEQ ID NO: 90992 - protein, 10 aa, Artificial Sequence
  Description of Artificial Sequence: Synthetic peptide
  Seed: YTLLSLFQSS (MAGC1_HUMAN)
YDLLSLFQSL

SEQ ID NO: 90993 - protein, 9 aa, Artificial Sequence
  Description of Artificial Sequence: Synthetic peptide
  Seed: TLDEKVDEL (MAGC1_HUMAN)
TVDEKVDEC

SEQ ID NO: 90994 - protein, 10 aa, Artificial Sequence
  Description of Artificial Sequence: Synthetic peptide
  Seed: VISFSSSTSL (MAGC1_HUMAN)
VKSFSSSTSW

SEQ ID NO: 90995 - protein, 9 aa, Artificial Sequence
  Description of Artificial Sequence: Synthetic peptide
  Seed: TFEGFPQSL (MAGC1_HUMAN)
TSEGFPQSV

SEQ ID NO: 90996 - protein, 10 aa, Artificial Sequence
  Description of Artificial Sequence: Synthetic peptide
  Seed: SQSPPEGEDV (MAGC1_HUMAN)
SESPPEGEDV

SEQ ID NO: 90997 - protein, 11 aa, Artificial Sequence
  Description of Artificial Sequence: Synthetic peptide
  Seed: SPLQIPGSPSF (MAGC1_HUMAN)
SNLQIPGSPSF

SEQ ID NO: 90998 - protein, 10 aa, Artificial Sequence
  Description of Artificial Sequence: Synthetic peptide
  Seed: LQIPMTSSFS (MAGC1_HUMAN)
LMIPMTSSFT

SEQ ID NO: 90999 - protein, 9 aa, Artificial Sequence
  Description of Artificial Sequence: Synthetic peptide
  Seed: IEILFGISL (MAGC1_HUMAN)
IEILFGISP

SEQ ID NO: 91000 - protein, 10 aa, Artificial Sequence
  Description of Artificial Sequence: Synthetic peptide
  Seed: FSSTLVSLFQ (MAGC1_HUMAN)
FASTLVSLFF

SEQ ID NO: 91001 - protein, 9 aa, Artificial Sequence
  Description of Artificial Sequence: Synthetic peptide
  Seed: VQEHYLEYR (MAGC1_HUMAN)
VIEHYLEYY

SEQ ID NO: 91002 - protein, 9 aa, Artificial Sequence
  Description of Artificial Sequence: Synthetic peptide
  Seed: AQSSLQIPV (MAGC1_HUMAN)
ATSSLQIPV

SEQ ID NO: 91003 - protein, 10 aa, Artificial Sequence
  Description of Artificial Sequence: Synthetic peptide
  Seed: FFSYTLASLL (MAGC1_HUMAN)
FMSYTLASLN

SEQ ID NO: 91004 - protein, 10 aa, Artificial Sequence
  Description of Artificial Sequence: Synthetic peptide
  Seed: EVIWDVLSGI (MAGC1_HUMAN)
ETIWDVLSGY

SEQ ID NO: 91005 - protein, 9 aa, Artificial Sequence
  Description of Artificial Sequence: Synthetic peptide
  Seed: ESSSPVDEY (MAGC1_HUMAN)
EPSSPVDEF

SEQ ID NO: 91006 - protein, 9 aa, Artificial Sequence
  Description of Artificial Sequence: Synthetic peptide
  Seed: TLDEKVDEL (MAGC1_HUMAN)
TLDEKVDEY

SEQ ID NO: 91007 - protein, 9 aa, Artificial Sequence
  Description of Artificial Sequence: Synthetic peptide
  Seed: MTSSFSSTL (MAGC1_HUMAN)
MKSSFSSTF

SEQ ID NO: 91008 - protein, 10 aa, Artificial Sequence
  Description of Artificial Sequence: Synthetic peptide
  Seed: RPVSSFFSYT (MAGC1_HUMAN)
RHVSSFFSYK

SEQ ID NO: 91009 - protein, 9 aa, Artificial Sequence
  Description of Artificial Sequence: Synthetic peptide
  Seed: RAGREHFAF (MAGC1_HUMAN)
RKGREHFAY

SEQ ID NO: 91010 - protein, 11 aa, Artificial Sequence
  Description of Artificial Sequence: Synthetic peptide
  Seed: SSFPSSTSSSL (MAGC1_HUMAN)
SAFPSSTSSSM

SEQ ID NO: 91011 - protein, 9 aa, Artificial Sequence
  Description of Artificial Sequence: Synthetic peptide
  Seed: SPPEGPVQS (MAGC1_HUMAN)
SPPEGPVQM

SEQ ID NO: 91012 - protein, 10 aa, Artificial Sequence
  Description of Artificial Sequence: Synthetic peptide
  Seed: SRYTGYFPVI (MAGC1_HUMAN)
SNYTGYFPVL

SEQ ID NO: 91013 - protein, 9 aa, Artificial Sequence
  Description of Artificial Sequence: Synthetic peptide
  Seed: LQIPMTSSF (MAGC1_HUMAN)
LYIPMTSSW

SEQ ID NO: 91014 - protein, 9 aa, Artificial Sequence
  Description of Artificial Sequence: Synthetic peptide
  Seed: RAGREHFAF (MAGC1_HUMAN)
RLGREHFAF

SEQ ID NO: 91015 - protein, 9 aa, Artificial Sequence
  Description of Artificial Sequence: Synthetic peptide
  Seed: SSFPSSTSS (MAGC1_HUMAN)
SAFPSSTSY

SEQ ID NO: 91016 - protein, 10 aa, Artificial Sequence
  Description of Artificial Sequence: Synthetic peptide
  Seed: LLQIPMTSSF (MAGC1_HUMAN)
LDQIPMTSSY

SEQ ID NO: 91017 - protein, 10 aa, Artificial Sequence
  Description of Artificial Sequence: Synthetic peptide
  Seed: ESAQSAFEGF (MAGC1_HUMAN)
EVAQSAFEGK

SEQ ID NO: 91018 - protein, 11 aa, Artificial Sequence
  Description of Artificial Sequence: Synthetic peptide
  Seed: VSSSSSSSTLL (MAGC1_HUMAN)
VTSSSSSSTLW

SEQ ID NO: 91019 - protein, 9 aa, Artificial Sequence
  Description of Artificial Sequence: Synthetic peptide
  Seed: VSSFFSYTL (MAGC1_HUMAN)
VLSFFSYTL

SEQ ID NO: 91020 - protein, 11 aa, Artificial Sequence
  Description of Artificial Sequence: Synthetic peptide
  Seed: FPSSTSSSLSQ (MAGC1_HUMAN)
FVSSTSSSLSL

SEQ ID NO: 91021 - protein, 9 aa, Artificial Sequence
  Description of Artificial Sequence: Synthetic peptide
  Seed: CSSSTPSSL (MAGC1_HUMAN)
CASSTPSSW

SEQ ID NO: 91022 - protein, 9 aa, Artificial Sequence
  Description of Artificial Sequence: Synthetic peptide
  Seed: AQSPLQIPV (MAGC1_HUMAN)
AISPLQIPI

SEQ ID NO: 91023 - protein, 10 aa, Artificial Sequence
  Description of Artificial Sequence: Synthetic peptide
  Seed: FAFGEPRELL (MAGC1_HUMAN)
FPFGEPRELL

SEQ ID NO: 91024 - protein, 11 aa, Artificial Sequence
  Description of Artificial Sequence: Synthetic peptide
  Seed: SPVSSFPSSTS (MAGC1_HUMAN)
SPVSSFPSSTA

SEQ ID NO: 91025 - protein, 9 aa, Artificial Sequence
  Description of Artificial Sequence: Synthetic peptide
  Seed: SSSDTLLES (MAGC1_HUMAN)
SVSDTLLEM

SEQ ID NO: 91026 - protein, 9 aa, Artificial Sequence
  Description of Artificial Sequence: Synthetic peptide
  Seed: VSSSFSYTL (MAGC1_HUMAN)
VVSSFSYTL

SEQ ID NO: 91027 - protein, 9 aa, Artificial Sequence
  Description of Artificial Sequence: Synthetic peptide
  Seed: KVDELARFL (MAGC1_HUMAN)
KQDELARFI

SEQ ID NO: 91028 - protein, 9 aa, Artificial Sequence
  Description of Artificial Sequence: Synthetic peptide
  Seed: SSSESPQSC (MAGC1_HUMAN)
SLSESPQSL

SEQ ID NO: 91029 - protein, 10 aa, Artificial Sequence
  Description of Artificial Sequence: Synthetic peptide
  Seed: SFPSSTSSSL (MAGC1_HUMAN)
SNPSSTSSSL

SEQ ID NO: 91030 - protein, 11 aa, Artificial Sequence
  Description of Artificial Sequence: Synthetic peptide
  Seed: SPLQIPVSPSS (MAGC1_HUMAN)
SHLQIPVSPSY

SEQ ID NO: 91031 - protein, 11 aa, Artificial Sequence
  Description of Artificial Sequence: Synthetic peptide
  Seed: SFFSYTLASLL (MAGC1_HUMAN)
SHFSYTLASLY

SEQ ID NO: 91032 - protein, 10 aa, Artificial Sequence
  Description of Artificial Sequence: Synthetic peptide
  Seed: LQIPVSSSFS (MAGC1_HUMAN)
LQIPVSSSFK

SEQ ID NO: 91033 - protein, 9 aa, Artificial Sequence
  Description of Artificial Sequence: Synthetic peptide
  Seed: SFPSSTSSS (MAGC1_HUMAN)
SWPSSTSSV

SEQ ID NO: 91034 - protein, 9 aa, Artificial Sequence
  Description of Artificial Sequence: Synthetic peptide
  Seed: SSLSQSSPV (MAGC1_HUMAN)
STLSQSSPM

SEQ ID NO: 91035 - protein, 10 aa, Artificial Sequence
  Description of Artificial Sequence: Synthetic peptide
  Seed: IEILFGISLR (MAGC1_HUMAN)
IAILFGISLR

SEQ ID NO: 91036 - protein, 9 aa, Artificial Sequence
  Description of Artificial Sequence: Synthetic peptide
  Seed: LQIPVSRSF (MAGC1_HUMAN)
LKIPVSRSY

SEQ ID NO: 91037 - protein, 10 aa, Artificial Sequence
  Description of Artificial Sequence: Synthetic peptide
  Seed: SFFSYTLASL (MAGC1_HUMAN)
SRFSYTLASF

SEQ ID NO: 91038 - protein, 10 aa, Artificial Sequence
  Description of Artificial Sequence: Synthetic peptide
  Seed: PLQIPGSPSF (MAGC1_HUMAN)
PIQIPGSPSY

SEQ ID NO: 91039 - protein, 10 aa, Artificial Sequence
  Description of Artificial Sequence: Synthetic peptide
  Seed: YTGYFPVIFR (MAGC1_HUMAN)
YPGYFPVIFR

SEQ ID NO: 91040 - protein, 10 aa, Artificial Sequence
  Description of Artificial Sequence: Synthetic peptide
  Seed: LQNPASSFFS (MAGC1_HUMAN)
LQNPASSFFL

SEQ ID NO: 91041 - protein, 9 aa, Artificial Sequence
  Description of Artificial Sequence: Synthetic peptide
  Seed: MTSSFSSTL (MAGC1_HUMAN)
MESSFSSTM

SEQ ID NO: 91042 - protein, 11 aa, Artificial Sequence
  Description of Artificial Sequence: Synthetic peptide
  Seed: RSFSSTLLSIF (MAGC1_HUMAN)
RSFSSTLLSIY

SEQ ID NO: 91043 - protein, 9 aa, Artificial Sequence
  Description of Artificial Sequence: Synthetic peptide
  Seed: TKVWVQEHY (MAGC1_HUMAN)
TTVWVQEHY

SEQ ID NO: 91044 - protein, 9 aa, Artificial Sequence
  Description of Artificial Sequence: Synthetic peptide
  Seed: FQSSLQSPV (MAGC1_HUMAN)
FHSSLQSPA

SEQ ID NO: 91045 - protein, 10 aa, Artificial Sequence
  Description of Artificial Sequence: Synthetic peptide
  Seed: REFIEILFGI (MAGC1_HUMAN)
RVFIEILFGF

SEQ ID NO: 91046 - protein, 10 aa, Artificial Sequence
  Description of Artificial Sequence: Synthetic peptide
  Seed: WGPRAHSEVI (MAGC1_HUMAN)
WDPRAHSEVL

SEQ ID NO: 91047 - protein, 10 aa, Artificial Sequence
  Description of Artificial Sequence: Synthetic peptide
  Seed: FPQSLLQIPM (MAGC1_HUMAN)
FMQSLLQIPT

SEQ ID NO: 91048 - protein, 9 aa, Artificial Sequence
  Description of Artificial Sequence: Synthetic peptide
  Seed: FQSSLQSPV (MAGC1_HUMAN)
FCSSLQSPY

SEQ ID NO: 91049 - protein, 9 aa, Artificial Sequence
  Description of Artificial Sequence: Synthetic peptide
  Seed: SPLHSPQSP (MAGC1_HUMAN)
SPLHSPQSL

SEQ ID NO: 91050 - protein, 9 aa, Artificial Sequence
  Description of Artificial Sequence: Synthetic peptide
  Seed: NPASSFFSS (MAGC1_HUMAN)
NLASSFFSY

SEQ ID NO: 91051 - protein, 9 aa, Artificial Sequence
  Description of Artificial Sequence: Synthetic peptide
  Seed: ISRYTGYFP (MAGC1_HUMAN)
ITRYTGYFM

SEQ ID NO: 91052 - protein, 10 aa, Artificial Sequence
  Description of Artificial Sequence: Synthetic peptide
  Seed: FFSSALLSIF (MAGC1_HUMAN)
FKSSALLSIY

SEQ ID NO: 91053 - protein, 11 aa, Artificial Sequence
  Description of Artificial Sequence: Synthetic peptide
  Seed: QSSPESAQSTF (MAGC1_HUMAN)
QTSPESAQSTY

SEQ ID NO: 91054 - protein, 10 aa, Artificial Sequence
  Description of Artificial Sequence: Synthetic peptide
  Seed: HSPQSPPEGM (MAGC1_HUMAN)
HRPQSPPEGF

SEQ ID NO: 91055 - protein, 9 aa, Artificial Sequence
  Description of Artificial Sequence: Synthetic peptide
  Seed: IESEPLFTY (MAGC1_HUMAN)
IISEPLFTL

SEQ ID NO: 91056 - protein, 9 aa, Artificial Sequence
  Description of Artificial Sequence: Synthetic peptide
  Seed: VIKRKVVEF (MAGC1_HUMAN)
VFKRKVVEM

SEQ ID NO: 91057 - protein, 10 aa, Artificial Sequence
  Description of Artificial Sequence: Synthetic peptide
  Seed: SFSSTLVSLF (MAGC1_HUMAN)
SLSSTLVSLF

SEQ ID NO: 91058 - protein, 9 aa, Artificial Sequence
  Description of Artificial Sequence: Synthetic peptide
  Seed: EDSLSSLHF (MAGC1_HUMAN)
EESLSSLHW

SEQ ID NO: 91059 - protein, 9 aa, Artificial Sequence
  Description of Artificial Sequence: Synthetic peptide
  Seed: LQRPVSSFF (MAGC1_HUMAN)
LIRPVSSFF

SEQ ID NO: 91060 - protein, 10 aa, Artificial Sequence
  Description of Artificial Sequence: Synthetic peptide
  Seed: ESEPLFTYTL (MAGC1_HUMAN)
ETEPLFTYTI

SEQ ID NO: 91061 - protein, 9 aa, Artificial Sequence
  Description of Artificial Sequence: Synthetic peptide
  Seed: LSPLHFPQF (MAGC1_HUMAN)
LQPLHFPQL

SEQ ID NO: 91062 - protein, 9 aa, Artificial Sequence
  Description of Artificial Sequence: Synthetic peptide
  Seed: FAFGEPREL (MAGC1_HUMAN)
FEFGEPREV

SEQ ID NO: 91063 - protein, 11 aa, Artificial Sequence
  Description of Artificial Sequence: Synthetic peptide
  Seed: REVPNSSPPRY (MAGC1_HUMAN)
REVPNSSPPRV

SEQ ID NO: 91064 - protein, 9 aa, Artificial Sequence
  Description of Artificial Sequence: Synthetic peptide
  Seed: NPASSFFSS (MAGC1_HUMAN)
NPASSFFSA

SEQ ID NO: 91065 - protein, 9 aa, Artificial Sequence
  Description of Artificial Sequence: Synthetic peptide
  Seed: VSSSFSYTL (MAGC1_HUMAN)
VYSSFSYTW

SEQ ID NO: 91066 - protein, 9 aa, Artificial Sequence
  Description of Artificial Sequence: Synthetic peptide
  Seed: MPSLLQSSS (MAGC1_HUMAN)
MPSLLQSSL

SEQ ID NO: 91067 - protein, 10 aa, Artificial Sequence
  Description of Artificial Sequence: Synthetic peptide
  Seed: LQIPMTSSFS (MAGC1_HUMAN)
LQIPMTSSFF

SEQ ID NO: 91068 - protein, 10 aa, Artificial Sequence
  Description of Artificial Sequence: Synthetic peptide
  Seed: REHFAFGEPR (MAGC1_HUMAN)
RLHFAFGEPK

SEQ ID NO: 91069 - protein, 9 aa, Artificial Sequence
  Description of Artificial Sequence: Synthetic peptide
  Seed: SSHESPQSP (MAGC1_HUMAN)
SSHESPQSY

SEQ ID NO: 91070 - protein, 9 aa, Artificial Sequence
  Description of Artificial Sequence: Synthetic peptide
  Seed: FPSSTSSSL (MAGC1_HUMAN)
FHSSTSSSV

SEQ ID NO: 91071 - protein, 9 aa, Artificial Sequence
  Description of Artificial Sequence: Synthetic peptide
  Seed: LQIPGSPSF (MAGC1_HUMAN)
LSIPGSPSM

SEQ ID NO: 91072 - protein, 10 aa, Artificial Sequence
  Description of Artificial Sequence: Synthetic peptide
  Seed: MSQNRLLILI (MAGC1_HUMAN)
MQQNRLLILV

SEQ ID NO: 91073 - protein, 9 aa, Artificial Sequence
  Description of Artificial Sequence: Synthetic peptide
  Seed: LQIPVSSSS (MAGC1_HUMAN)
LRIPVSSSF

SEQ ID NO: 91074 - protein, 9 aa, Artificial Sequence
  Description of Artificial Sequence: Synthetic peptide
  Seed: RSFSSTLLS (MAGC1_HUMAN)
RQFSSTLLK

SEQ ID NO: 91075 - protein, 11 aa, Artificial Sequence
  Description of Artificial Sequence: Synthetic peptide
  Seed: SFFSYTLASLL (MAGC1_HUMAN)
SRFSYTLASLF

SEQ ID NO: 91076 - protein, 9 aa, Artificial Sequence
  Description of Artificial Sequence: Synthetic peptide
  Seed: SEPLFTYTL (MAGC1_HUMAN)
SQPLFTYTL

SEQ ID NO: 91077 - protein, 9 aa, Artificial Sequence
  Description of Artificial Sequence: Synthetic peptide
  Seed: FEGFAQSSL (MAGC1_HUMAN)
FAGFAQSSF

SEQ ID NO: 91078 - protein, 9 aa, Artificial Sequence
  Description of Artificial Sequence: Synthetic peptide
  Seed: VQSPLHSPQ (MAGC1_HUMAN)
VESPLHSPF

SEQ ID NO: 91079 - protein, 9 aa, Artificial Sequence
  Description of Artificial Sequence: Synthetic peptide
  Seed: SSFPSSTSS (MAGC1_HUMAN)
STFPSSTSF

SEQ ID NO: 91080 - protein, 10 aa, Artificial Sequence
  Description of Artificial Sequence: Synthetic peptide
  Seed: LAMLKNTVPI (MAGC1_HUMAN)
LIMLKNTVPL

SEQ ID NO: 91081 - protein, 9 aa, Artificial Sequence
  Description of Artificial Sequence: Synthetic peptide
  Seed: LQNPASSFF (MAGC1_HUMAN)
LWNPASSFI

SEQ ID NO: 91082 - protein, 9 aa, Artificial Sequence
  Description of Artificial Sequence: Synthetic peptide
  Seed: TSLSLPQSF (MAGC1_HUMAN)
TALSLPQSF

SEQ ID NO: 91083 - protein, 10 aa, Artificial Sequence
  Description of Artificial Sequence: Synthetic peptide
  Seed: VISFSSSTSL (MAGC1_HUMAN)
VSSFSSSTSL

SEQ ID NO: 91084 - protein, 9 aa, Artificial Sequence
  Description of Artificial Sequence: Synthetic peptide
  Seed: FPSSTSSSL (MAGC1_HUMAN)
FGSSTSSSF

SEQ ID NO: 91085 - protein, 10 aa, Artificial Sequence
  Description of Artificial Sequence: Synthetic peptide
  Seed: FQSSLQSPVS (MAGC1_HUMAN)
FMSSLQSPVR

SEQ ID NO: 91086 - protein, 9 aa, Artificial Sequence
  Description of Artificial Sequence: Synthetic peptide
  Seed: LKNTVPITF (MAGC1_HUMAN)
LQNTVPITM

SEQ ID NO: 91087 - protein, 11 aa, Artificial Sequence
  Description of Artificial Sequence: Synthetic peptide
  Seed: SSSSSSTLLSL (MAGC1_HUMAN)
SYSSSSTLLSW

SEQ ID NO: 91088 - protein, 10 aa, Artificial Sequence
  Description of Artificial Sequence: Synthetic peptide
  Seed: FFSSALLSIF (MAGC1_HUMAN)
FCSSALLSIF

SEQ ID NO: 91089 - protein, 9 aa, Artificial Sequence
  Description of Artificial Sequence: Synthetic peptide
  Seed: SLSPFSEES (MAGC1_HUMAN)
SVSPFSEEL

SEQ ID NO: 91090 - protein, 9 aa, Artificial Sequence
  Description of Artificial Sequence: Synthetic peptide
  Seed: LQIPVSRSF (MAGC1_HUMAN)
LIIPVSRSY

SEQ ID NO: 91091 - protein, 9 aa, Artificial Sequence
  Description of Artificial Sequence: Synthetic peptide
  Seed: LKYQVKQPI (MAGC1_HUMAN)
LLYQVKQPM

SEQ ID NO: 91092 - protein, 10 aa, Artificial Sequence
  Description of Artificial Sequence: Synthetic peptide
  Seed: LQIPGSPSFS (MAGC1_HUMAN)
LMIPGSPSFL

SEQ ID NO: 91093 - protein, 8 aa, Artificial Sequence
  Description of Artificial Sequence: Synthetic peptide
  Seed: AFGEPREL (MAGC1_HUMAN)
AIGEPREL

SEQ ID NO: 91094 - protein, 10 aa, Artificial Sequence
  Description of Artificial Sequence: Synthetic peptide
  Seed: SFPSSTSSSL (MAGC1_HUMAN)
SGPSSTSSSL

SEQ ID NO: 91095 - protein, 9 aa, Artificial Sequence
  Description of Artificial Sequence: Synthetic peptide
  Seed: FLWGPRAHS (MAGC1_HUMAN)
FTWGPRAHL

SEQ ID NO: 91096 - protein, 10 aa, Artificial Sequence
  Description of Artificial Sequence: Synthetic peptide
  Seed: EMLTNVISRY (MAGC1_HUMAN)
EMLTNVISRK

SEQ ID NO: 91097 - protein, 10 aa, Artificial Sequence
  Description of Artificial Sequence: Synthetic peptide
  Seed: SSPERTHSTF (MAGC1_HUMAN)
SGPERTHSTL

SEQ ID NO: 91098 - protein, 9 aa, Artificial Sequence
  Description of Artificial Sequence: Synthetic peptide
  Seed: SRYTGYFPV (MAGC1_HUMAN)
SHYTGYFPI

SEQ ID NO: 91099 - protein, 9 aa, Artificial Sequence
  Description of Artificial Sequence: Synthetic peptide
  Seed: SSPPRYEFL (MAGC1_HUMAN)
STPPRYEFM

SEQ ID NO: 91100 - protein, 9 aa, Artificial Sequence
  Description of Artificial Sequence: Synthetic peptide
  Seed: KVVEFLAML (MAGC1_HUMAN)
KGVEFLAMW

SEQ ID NO: 91101 - protein, 10 aa, Artificial Sequence
  Description of Artificial Sequence: Synthetic peptide
  Seed: KRKVVEFLAM (MAGC1_HUMAN)
KEKVVEFLAY

SEQ ID NO: 91102 - protein, 9 aa, Artificial Sequence
  Description of Artificial Sequence: Synthetic peptide
  Seed: STFEGFPQS (MAGC1_HUMAN)
SPFEGFPQT

SEQ ID NO: 91103 - protein, 9 aa, Artificial Sequence
  Description of Artificial Sequence: Synthetic peptide
  Seed: WVQEHYLEY (MAGC1_HUMAN)
WMQEHYLER

SEQ ID NO: 91104 - protein, 10 aa, Artificial Sequence
  Description of Artificial Sequence: Synthetic peptide
  Seed: RPVSSFFSYT (MAGC1_HUMAN)
RTVSSFFSYA

SEQ ID NO: 91105 - protein, 9 aa, Artificial Sequence
  Description of Artificial Sequence: Synthetic peptide
  Seed: RLLILILSI (MAGC1_HUMAN)
RTLILILSV

SEQ ID NO: 91106 - protein, 10 aa, Artificial Sequence
  Description of Artificial Sequence: Synthetic peptide
  Seed: LLQIPMTSSF (MAGC1_HUMAN)
LMQIPMTSSL

SEQ ID NO: 91107 - protein, 9 aa, Artificial Sequence
  Description of Artificial Sequence: Synthetic peptide
  Seed: HFPQSPPEW (MAGC1_HUMAN)
HAPQSPPEF

SEQ ID NO: 91108 - protein, 9 aa, Artificial Sequence
  Description of Artificial Sequence: Synthetic peptide
  Seed: NVISRYTGY (MAGC1_HUMAN)
NLISRYTGK

SEQ ID NO: 91109 - protein, 9 aa, Artificial Sequence
  Description of Artificial Sequence: Synthetic peptide
  Seed: MLTNVISRY (MAGC1_HUMAN)
MITNVISRF

SEQ ID NO: 91110 - protein, 11 aa, Artificial Sequence
  Description of Artificial Sequence: Synthetic peptide
  Seed: SSFPSSTSSSL (MAGC1_HUMAN)
STFPSSTSSSL

SEQ ID NO: 91111 - protein, 9 aa, Artificial Sequence
  Description of Artificial Sequence: Synthetic peptide
  Seed: ASSSTLVSI (MAGC1_HUMAN)
AASSTLVSM

SEQ ID NO: 91112 - protein, 9 aa, Artificial Sequence
  Description of Artificial Sequence: Synthetic peptide
  Seed: SAQSTFEGF (MAGC1_HUMAN)
SLQSTFEGY

SEQ ID NO: 91113 - protein, 9 aa, Artificial Sequence
  Description of Artificial Sequence: Synthetic peptide
  Seed: FFSSALLSI (MAGC1_HUMAN)
FWSSALLSW

SEQ ID NO: 91114 - protein, 11 aa, Artificial Sequence
  Description of Artificial Sequence: Synthetic peptide
  Seed: RYTGYFPVIFR (MAGC1_HUMAN)
RQTGYFPVIFR

SEQ ID NO: 91115 - protein, 9 aa, Artificial Sequence
  Description of Artificial Sequence: Synthetic peptide
  Seed: FSSALLSIF (MAGC1_HUMAN)
FPSALLSIS

SEQ ID NO: 91116 - protein, 10 aa, Artificial Sequence
  Description of Artificial Sequence: Synthetic peptide
  Seed: RKVVEFLAML (MAGC1_HUMAN)
RDVVEFLAMI

SEQ ID NO: 91117 - protein, 9 aa, Artificial Sequence
  Description of Artificial Sequence: Synthetic peptide
  Seed: KVDELARFL (MAGC1_HUMAN)
KTDELARFL

SEQ ID NO: 91118 - protein, 9 aa, Artificial Sequence
  Description of Artificial Sequence: Synthetic peptide
  Seed: LSDEQGMSQ (MAGC1_HUMAN)
LGDEQGMSL

SEQ ID NO: 91119 - protein, 9 aa, Artificial Sequence
  Description of Artificial Sequence: Synthetic peptide
  Seed: ASSFFSSAL (MAGC1_HUMAN)
AVSFFSSAW

SEQ ID NO: 91120 - protein, 9 aa, Artificial Sequence
  Description of Artificial Sequence: Synthetic peptide
  Seed: MTSSFSSTL (MAGC1_HUMAN)
MSSSFSSTY

SEQ ID NO: 91121 - protein, 9 aa, Artificial Sequence
  Description of Artificial Sequence: Synthetic peptide
  Seed: STFEGFAQS (MAGC1_HUMAN)
SQFEGFAQT

SEQ ID NO: 91122 - protein, 10 aa, Artificial Sequence
  Description of Artificial Sequence: Synthetic peptide
  Seed: SFSSTLLSIF (MAGC1_HUMAN)
SHSSTLLSIW

SEQ ID NO: 91123 - protein, 9 aa, Artificial Sequence
  Description of Artificial Sequence: Synthetic peptide
  Seed: STFEGFAQS (MAGC1_HUMAN)
SMFEGFAQA

SEQ ID NO: 91124 - protein, 9 aa, Artificial Sequence
  Description of Artificial Sequence: Synthetic peptide
  Seed: SSSTLLSLF (MAGC1_HUMAN)
SWSTLLSLL

SEQ ID NO: 91125 - protein, 9 aa, Artificial Sequence
  Description of Artificial Sequence: Synthetic peptide
  Seed: DDSTATESA (MAGC1_HUMAN)
DESTATESV

SEQ ID NO: 91126 - protein, 9 aa, Artificial Sequence
  Description of Artificial Sequence: Synthetic peptide
  Seed: LQRPVSSFF (MAGC1_HUMAN)
LARPVSSFF

SEQ ID NO: 91127 - protein, 9 aa, Artificial Sequence
  Description of Artificial Sequence: Synthetic peptide
  Seed: FEGFAQSSL (MAGC1_HUMAN)
FVGFAQSSY

SEQ ID NO: 91128 - protein, 9 aa, Artificial Sequence
  Description of Artificial Sequence: Synthetic peptide
  Seed: SAQSTFEGF (MAGC1_HUMAN)
STQSTFEGY

SEQ ID NO: 91129 - protein, 10 aa, Artificial Sequence
  Description of Artificial Sequence: Synthetic peptide
  Seed: FFSYTLASLL (MAGC1_HUMAN)
FLSYTLASLK

SEQ ID NO: 91130 - protein, 9 aa, Artificial Sequence
  Description of Artificial Sequence: Synthetic peptide
  Seed: EQGMSQNRL (MAGC1_HUMAN)
EHGMSQNRL

SEQ ID NO: 91131 - protein, 10 aa, Artificial Sequence
  Description of Artificial Sequence: Synthetic peptide
  Seed: STFEGFAQSS (MAGC1_HUMAN)
STFEGFAQSA

SEQ ID NO: 91132 - protein, 9 aa, Artificial Sequence
  Description of Artificial Sequence: Synthetic peptide
  Seed: YVFVNTLDL (MAGC1_HUMAN)
YLFVNTLDT

SEQ ID NO: 91133 - protein, 9 aa, Artificial Sequence
  Description of Artificial Sequence: Synthetic peptide
  Seed: VIFRKAREF (MAGC1_HUMAN)
VYFRKAREL

SEQ ID NO: 91134 - protein, 9 aa, Artificial Sequence
  Description of Artificial Sequence: Synthetic peptide
  Seed: KVDELARFL (MAGC1_HUMAN)
KSDELARFF

SEQ ID NO: 91135 - protein, 9 aa, Artificial Sequence
  Description of Artificial Sequence: Synthetic peptide
  Seed: AMLKNTVPI (MAGC1_HUMAN)
AILKNTVPL

SEQ ID NO: 91136 - protein, 10 aa, Artificial Sequence
  Description of Artificial Sequence: Synthetic peptide
  Seed: RYTGYFPVIF (MAGC1_HUMAN)
RQTGYFPVIL

SEQ ID NO: 91137 - protein, 9 aa, Artificial Sequence
  Description of Artificial Sequence: Synthetic peptide
  Seed: VSSSFSYTL (MAGC1_HUMAN)
VISSFSYTY

SEQ ID NO: 91138 - protein, 11 aa, Artificial Sequence
  Description of Artificial Sequence: Synthetic peptide
  Seed: REVPNSSPPRY (MAGC1_HUMAN)
RTVPNSSPPRY

SEQ ID NO: 91139 - protein, 9 aa, Artificial Sequence
  Description of Artificial Sequence: Synthetic peptide
  Seed: VSPSFSSTL (MAGC1_HUMAN)
VAPSFSSTM

SEQ ID NO: 91140 - protein, 9 aa, Artificial Sequence
  Description of Artificial Sequence: Synthetic peptide
  Seed: FSSTLLSIL (MAGC1_HUMAN)
FTSTLLSII

SEQ ID NO: 91141 - protein, 9 aa, Artificial Sequence
  Description of Artificial Sequence: Synthetic peptide
  Seed: FFSYTLASL (MAGC1_HUMAN)
FSSYTLASM

SEQ ID NO: 91142 - protein, 9 aa, Artificial Sequence
  Description of Artificial Sequence: Synthetic peptide
  Seed: SPLQSPVSS (MAGC1_HUMAN)
SPLQSPVSM

SEQ ID NO: 91143 - protein, 10 aa, Artificial Sequence
  Description of Artificial Sequence: Synthetic peptide
  Seed: LAMLKNTVPI (MAGC1_HUMAN)
LLMLKNTVPL

SEQ ID NO: 91144 - protein, 9 aa, Artificial Sequence
  Description of Artificial Sequence: Synthetic peptide
  Seed: SPPEGPVQS (MAGC1_HUMAN)
SPPEGPVQI

SEQ ID NO: 91145 - protein, 9 aa, Artificial Sequence
  Description of Artificial Sequence: Synthetic peptide
  Seed: MSQNRLLIL (MAGC1_HUMAN)
MTQNRLLIW

SEQ ID NO: 91146 - protein, 11 aa, Artificial Sequence
  Description of Artificial Sequence: Synthetic peptide
  Seed: RPVSSFFSYTL (MAGC1_HUMAN)
RTVSSFFSYTM

SEQ ID NO: 91147 - protein, 11 aa, Artificial Sequence
  Description of Artificial Sequence: Synthetic peptide
  Seed: SASSSVMSPSF (MAGC1_HUMAN)
SSSSSVMSPSW

SEQ ID NO: 91148 - protein, 9 aa, Artificial Sequence
  Description of Artificial Sequence: Synthetic peptide
  Seed: VQEHYLEYR (MAGC1_HUMAN)
VTEHYLEYY

SEQ ID NO: 91149 - protein, 11 aa, Artificial Sequence
  Description of Artificial Sequence: Synthetic peptide
  Seed: IPVSSSSSSTL (MAGC1_HUMAN)
IPVSSSSSSTF

SEQ ID NO: 91150 - protein, 11 aa, Artificial Sequence
  Description of Artificial Sequence: Synthetic peptide
  Seed: KRKVVEFLAML (MAGC1_HUMAN)
KIKVVEFLAMV

SEQ ID NO: 91151 - protein, 9 aa, Artificial Sequence
  Description of Artificial Sequence: Synthetic peptide
  Seed: MTSSFSSTL (MAGC1_HUMAN)
MMSSFSSTY

SEQ ID NO: 91152 - protein, 9 aa, Artificial Sequence
  Description of Artificial Sequence: Synthetic peptide
  Seed: FSSTLLSLF (MAGC1_HUMAN)
FLSTLLSLW

SEQ ID NO: 91153 - protein, 10 aa, Artificial Sequence
  Description of Artificial Sequence: Synthetic peptide
  Seed: AASSSTLVSI (MAGC1_HUMAN)
ALSSSTLVSW

SEQ ID NO: 91154 - protein, 9 aa, Artificial Sequence
  Description of Artificial Sequence: Synthetic peptide
  Seed: FQSSLQSPV (MAGC1_HUMAN)
FGSSLQSPL

SEQ ID NO: 91155 - protein, 10 aa, Artificial Sequence
  Description of Artificial Sequence: Synthetic peptide
  Seed: FSSSTSLSPF (MAGC1_HUMAN)
FNSSTSLSPY

SEQ ID NO: 91156 - protein, 11 aa, Artificial Sequence
  Description of Artificial Sequence: Synthetic peptide
  Seed: LQIPVSSSFSY (MAGC1_HUMAN)
LYIPVSSSFSF

SEQ ID NO: 91157 - protein, 9 aa, Artificial Sequence
  Description of Artificial Sequence: Synthetic peptide
  Seed: SSFFSSALL (MAGC1_HUMAN)
SSFFSSALI

SEQ ID NO: 91158 - protein, 10 aa, Artificial Sequence
  Description of Artificial Sequence: Synthetic peptide
  Seed: SSPESAQSTF (MAGC1_HUMAN)
SIPESAQSTM

SEQ ID NO: 91159 - protein, 10 aa, Artificial Sequence
  Description of Artificial Sequence: Synthetic peptide
  Seed: SSSSTLLSLF (MAGC1_HUMAN)
SMSSTLLSLW

SEQ ID NO: 91160 - protein, 10 aa, Artificial Sequence
  Description of Artificial Sequence: Synthetic peptide
  Seed: GEDSMSPLYF (MAGC1_HUMAN)
GEDSMSPLYL

SEQ ID NO: 91161 - protein, 9 aa, Artificial Sequence
  Description of Artificial Sequence: Synthetic peptide
  Seed: STFEGFPQS (MAGC1_HUMAN)
SAFEGFPQA

SEQ ID NO: 91162 - protein, 9 aa, Artificial Sequence
  Description of Artificial Sequence: Synthetic peptide
  Seed: YQVKQPITK (MAGC1_HUMAN)
YSVKQPITK

SEQ ID NO: 91163 - protein, 9 aa, Artificial Sequence
  Description of Artificial Sequence: Synthetic peptide
  Seed: SSPERTHST (MAGC1_HUMAN)
SYPERTHSM

SEQ ID NO: 91164 - protein, 9 aa, Artificial Sequence
  Description of Artificial Sequence: Synthetic peptide
  Seed: VSPSFSSTL (MAGC1_HUMAN)
VQPSFSSTV

SEQ ID NO: 91165 - protein, 9 aa, Artificial Sequence
  Description of Artificial Sequence: Synthetic peptide
  Seed: FSYTLASLL (MAGC1_HUMAN)
FIYTLASLW

SEQ ID NO: 91166 - protein, 9 aa, Artificial Sequence
  Description of Artificial Sequence: Synthetic peptide
  Seed: FSYTLLSLF (MAGC1_HUMAN)
FMYTLLSLY

SEQ ID NO: 91167 - protein, 10 aa, Artificial Sequence
  Description of Artificial Sequence: Synthetic peptide
  Seed: LQIPVSSSFS (MAGC1_HUMAN)
LMIPVSSSFD

SEQ ID NO: 91168 - protein, 9 aa, Artificial Sequence
  Description of Artificial Sequence: Synthetic peptide
  Seed: EMLTNVISR (MAGC1_HUMAN)
EWLTNVISR

SEQ ID NO: 91169 - protein, 10 aa, Artificial Sequence
  Description of Artificial Sequence: Synthetic peptide
  Seed: ITKAEMLTNV (MAGC1_HUMAN)
IMKAEMLTNI

SEQ ID NO: 91170 - protein, 10 aa, Artificial Sequence
  Description of Artificial Sequence: Synthetic peptide
  Seed: WGPRAHSEVI (MAGC1_HUMAN)
WDPRAHSEVI

SEQ ID NO: 91171 - protein, 9 aa, Artificial Sequence
  Description of Artificial Sequence: Synthetic peptide
  Seed: LQSPVISFS (MAGC1_HUMAN)
LISPVISFT

SEQ ID NO: 91172 - protein, 9 aa, Artificial Sequence
  Description of Artificial Sequence: Synthetic peptide
  Seed: TLLSLFQSF (MAGC1_HUMAN)
TALSLFQSY

SEQ ID NO: 91173 - protein, 9 aa, Artificial Sequence
  Description of Artificial Sequence: Synthetic peptide
  Seed: SSFFSSALL (MAGC1_HUMAN)
SYFFSSALY

SEQ ID NO: 91174 - protein, 10 aa, Artificial Sequence
  Description of Artificial Sequence: Synthetic peptide
  Seed: ITKAEMLTNV (MAGC1_HUMAN)
IQKAEMLTNV

SEQ ID NO: 91175 - protein, 9 aa, Artificial Sequence
  Description of Artificial Sequence: Synthetic peptide
  Seed: SSSTLLSLF (MAGC1_HUMAN)
SYSTLLSLM

SEQ ID NO: 91176 - protein, 9 aa, Artificial Sequence
  Description of Artificial Sequence: Synthetic peptide
  Seed: EDSLSPHYF (MAGC1_HUMAN)
EESLSPHYV

SEQ ID NO: 91177 - protein, 10 aa, Artificial Sequence
  Description of Artificial Sequence: Synthetic peptide
  Seed: ASSSVMSPSF (MAGC1_HUMAN)
AMSSVMSPSM

SEQ ID NO: 91178 - protein, 9 aa, Artificial Sequence
  Description of Artificial Sequence: Synthetic peptide
  Seed: SSHESPQSP (MAGC1_HUMAN)
SMHESPQSY

SEQ ID NO: 91179 - protein, 9 aa, Artificial Sequence
  Description of Artificial Sequence: Synthetic peptide
  Seed: SAQSTFEGF (MAGC1_HUMAN)
SIQSTFEGY

SEQ ID NO: 91180 - protein, 10 aa, Artificial Sequence
  Description of Artificial Sequence: Synthetic peptide
  Seed: LQIVPSLPEW (MAGC1_HUMAN)
LLIVPSLPEF

SEQ ID NO: 91181 - protein, 9 aa, Artificial Sequence
  Description of Artificial Sequence: Synthetic peptide
  Seed: RTQSTFEGF (MAGC1_HUMAN)
RMQSTFEGY

SEQ ID NO: 91182 - protein, 9 aa, Artificial Sequence
  Description of Artificial Sequence: Synthetic peptide
  Seed: SPLQSPVSS (MAGC1_HUMAN)
SPLQSPVSI

SEQ ID NO: 91183 - protein, 9 aa, Artificial Sequence
  Description of Artificial Sequence: Synthetic peptide
  Seed: EVDPDDSYV (MAGC1_HUMAN)
EMDPDDSYM

SEQ ID NO: 91184 - protein, 10 aa, Artificial Sequence
  Description of Artificial Sequence: Synthetic peptide
  Seed: SFPSSTSSSL (MAGC1_HUMAN)
SYPSSTSSSM

SEQ ID NO: 91185 - protein, 10 aa, Artificial Sequence
  Description of Artificial Sequence: Synthetic peptide
  Seed: GEDSLSPHYF (MAGC1_HUMAN)
GEDSLSPHYC

SEQ ID NO: 91186 - protein, 9 aa, Artificial Sequence
  Description of Artificial Sequence: Synthetic peptide
  Seed: FSYTLLSLF (MAGC1_HUMAN)
FQYTLLSLM

SEQ ID NO: 91187 - protein, 10 aa, Artificial Sequence
  Description of Artificial Sequence: Synthetic peptide
  Seed: EVIWDVLSGI (MAGC1_HUMAN)
ETIWDVLSGA

SEQ ID NO: 91188 - protein, 11 aa, Artificial Sequence
  Description of Artificial Sequence: Synthetic peptide
  Seed: REVDPDDSYVF (MAGC1_HUMAN)
RAVDPDDSYVF

SEQ ID NO: 91189 - protein, 9 aa, Artificial Sequence
  Description of Artificial Sequence: Synthetic peptide
  Seed: SQSPPEGPV (MAGC1_HUMAN)
SLSPPEGPY

SEQ ID NO: 91190 - protein, 9 aa, Artificial Sequence
  Description of Artificial Sequence: Synthetic peptide
  Seed: VSRSFSSTL (MAGC1_HUMAN)
VIRSFSSTA

SEQ ID NO: 91191 - protein, 9 aa, Artificial Sequence
  Description of Artificial Sequence: Synthetic peptide
  Seed: RSFSSTLLS (MAGC1_HUMAN)
RIFSSTLLV

SEQ ID NO: 91192 - protein, 11 aa, Artificial Sequence
  Description of Artificial Sequence: Synthetic peptide
  Seed: LWGPRAHSEVI (MAGC1_HUMAN)
LNGPRAHSEVL

SEQ ID NO: 91193 - protein, 9 aa, Artificial Sequence
  Description of Artificial Sequence: Synthetic peptide
  Seed: TSSFSSTLL (MAGC1_HUMAN)
TVSFSSTLI

SEQ ID NO: 91194 - protein, 9 aa, Artificial Sequence
  Description of Artificial Sequence: Synthetic peptide
  Seed: SSSTSLSPF (MAGC1_HUMAN)
SQSTSLSPW

SEQ ID NO: 91195 - protein, 9 aa, Artificial Sequence
  Description of Artificial Sequence: Synthetic peptide
  Seed: YTGYFPVIF (MAGC1_HUMAN)
YSGYFPVIF

SEQ ID NO: 91196 - protein, 10 aa, Artificial Sequence
  Description of Artificial Sequence: Synthetic peptide
  Seed: STLLSLFQSF (MAGC1_HUMAN)
SVLLSLFQSW

SEQ ID NO: 91197 - protein, 11 aa, Artificial Sequence
  Description of Artificial Sequence: Synthetic peptide
  Seed: LLQIPMTSSFS (MAGC1_HUMAN)
LQQIPMTSSFY

SEQ ID NO: 91198 - protein, 10 aa, Artificial Sequence
  Description of Artificial Sequence: Synthetic peptide
  Seed: ASSFFSSALL (MAGC1_HUMAN)
ARSFFSSALY

SEQ ID NO: 91199 - protein, 11 aa, Artificial Sequence
  Description of Artificial Sequence: Synthetic peptide
  Seed: SSSSSSTLLSL (MAGC1_HUMAN)
SASSSSTLLSW

SEQ ID NO: 91200 - protein, 9 aa, Artificial Sequence
  Description of Artificial Sequence: Synthetic peptide
  Seed: TLVSLFQSS (MAGC1_HUMAN)
TLVSLFQSL

SEQ ID NO: 91201 - protein, 10 aa, Artificial Sequence
  Description of Artificial Sequence: Synthetic peptide
  Seed: VSSSFSYTLL (MAGC1_HUMAN)
VYSSFSYTLF

SEQ ID NO: 91202 - protein, 10 aa, Artificial Sequence
  Description of Artificial Sequence: Synthetic peptide
  Seed: SSFPSSTSSS (MAGC1_HUMAN)
SIFPSSTSSF

SEQ ID NO: 91203 - protein, 10 aa, Artificial Sequence
  Description of Artificial Sequence: Synthetic peptide
  Seed: SSSSSSSTLL (MAGC1_HUMAN)
SMSSSSSTLF

SEQ ID NO: 91204 - protein, 9 aa, Artificial Sequence
  Description of Artificial Sequence: Synthetic peptide
  Seed: FSSTLVSLF (MAGC1_HUMAN)
FKSTLVSLF

SEQ ID NO: 91205 - protein, 10 aa, Artificial Sequence
  Description of Artificial Sequence: Synthetic peptide
  Seed: HFAFGEPREL (MAGC1_HUMAN)
HYAFGEPREL

SEQ ID NO: 91206 - protein, 10 aa, Artificial Sequence
  Description of Artificial Sequence: Synthetic peptide
  Seed: SFPSSTSSSL (MAGC1_HUMAN)
SCPSSTSSSI

SEQ ID NO: 91207 - protein, 11 aa, Artificial Sequence
  Description of Artificial Sequence: Synthetic peptide
  Seed: SPFSEESSSPV (MAGC1_HUMAN)
SPFSEESSSPA

SEQ ID NO: 91208 - protein, 10 aa, Artificial Sequence
  Description of Artificial Sequence: Synthetic peptide
  Seed: SFPSSTSSSL (MAGC1_HUMAN)
SPPSSTSSSV

SEQ ID NO: 91209 - protein, 9 aa, Artificial Sequence
  Description of Artificial Sequence: Synthetic peptide
  Seed: SSSTLLSLF (MAGC1_HUMAN)
SRSTLLSLL

SEQ ID NO: 91210 - protein, 11 aa, Artificial Sequence
  Description of Artificial Sequence: Synthetic peptide
  Seed: IIDTTDDSTAT (MAGC1_HUMAN)
IGDTTDDSTAL

SEQ ID NO: 91211 - protein, 10 aa, Artificial Sequence
  Description of Artificial Sequence: Synthetic peptide
  Seed: LQIPVSPSFS (MAGC1_HUMAN)
LKIPVSPSFM

SEQ ID NO: 91212 - protein, 9 aa, Artificial Sequence
  Description of Artificial Sequence: Synthetic peptide
  Seed: LQIPVSRSF (MAGC1_HUMAN)
LQIPVSRSL

SEQ ID NO: 91213 - protein, 10 aa, Artificial Sequence
  Description of Artificial Sequence: Synthetic peptide
  Seed: REHFAFGEPR (MAGC1_HUMAN)
RMHFAFGEPK

SEQ ID NO: 91214 - protein, 9 aa, Artificial Sequence
  Description of Artificial Sequence: Synthetic peptide
  Seed: TESASSSVM (MAGC1_HUMAN)
TKSASSSVM

SEQ ID NO: 91215 - protein, 11 aa, Artificial Sequence
  Description of Artificial Sequence: Synthetic peptide
  Seed: LWGPRAHSEVI (MAGC1_HUMAN)
LSGPRAHSEVL

SEQ ID NO: 91216 - protein, 9 aa, Artificial Sequence
  Description of Artificial Sequence: Synthetic peptide
  Seed: SAASSSTLV (MAGC1_HUMAN)
SMASSSTLM

SEQ ID NO: 91217 - protein, 10 aa, Artificial Sequence
  Description of Artificial Sequence: Synthetic peptide
  Seed: SSPESAQSAF (MAGC1_HUMAN)
SLPESAQSAF

SEQ ID NO: 91218 - protein, 9 aa, Artificial Sequence
  Description of Artificial Sequence: Synthetic peptide
  Seed: KVWVQEHYL (MAGC1_HUMAN)
KMWVQEHYI

SEQ ID NO: 91219 - protein, 9 aa, Artificial Sequence
  Description of Artificial Sequence: Synthetic peptide
  Seed: RKVVEFLAM (MAGC1_HUMAN)
RQVVEFLAG

SEQ ID NO: 91220 - protein, 10 aa, Artificial Sequence
  Description of Artificial Sequence: Synthetic peptide
  Seed: SSPESTQSPF (MAGC1_HUMAN)
SQPESTQSPY

SEQ ID NO: 91221 - protein, 9 aa, Artificial Sequence
  Description of Artificial Sequence: Synthetic peptide
  Seed: QVKQPITKA (MAGC1_HUMAN)
QVKQPITKY

SEQ ID NO: 91222 - protein, 9 aa, Artificial Sequence
  Description of Artificial Sequence: Synthetic peptide
  Seed: YVFVNTLDL (MAGC1_HUMAN)
YEFVNTLDM

SEQ ID NO: 91223 - protein, 9 aa, Artificial Sequence
  Description of Artificial Sequence: Synthetic peptide
  Seed: LQIPMTSSF (MAGC1_HUMAN)
LFIPMTSSM

SEQ ID NO: 91224 - protein, 10 aa, Artificial Sequence
  Description of Artificial Sequence: Synthetic peptide
  Seed: SPLQSPVSSF (MAGC1_HUMAN)
SWLQSPVSSY

SEQ ID NO: 91225 - protein, 10 aa, Artificial Sequence
  Description of Artificial Sequence: Synthetic peptide
  Seed: STLLSLFQSF (MAGC1_HUMAN)
SKLLSLFQSM

SEQ ID NO: 91226 - protein, 9 aa, Artificial Sequence
  Description of Artificial Sequence: Synthetic peptide
  Seed: RLLILILSI (MAGC1_HUMAN)
RMLILILSR

SEQ ID NO: 91227 - protein, 9 aa, Artificial Sequence
  Description of Artificial Sequence: Synthetic peptide
  Seed: GEDSLSPHY (MAGC1_HUMAN)
GEDSLSPHM

SEQ ID NO: 91228 - protein, 9 aa, Artificial Sequence
  Description of Artificial Sequence: Synthetic peptide
  Seed: FFSSALLSI (MAGC1_HUMAN)
FASSALLSF

SEQ ID NO: 91229 - protein, 9 aa, Artificial Sequence
  Description of Artificial Sequence: Synthetic peptide
  Seed: YVFVNTLDL (MAGC1_HUMAN)
YVFVNTLDM

SEQ ID NO: 91230 - protein, 10 aa, Artificial Sequence
  Description of Artificial Sequence: Synthetic peptide
  Seed: MSQNRLLILI (MAGC1_HUMAN)
MNQNRLLILW

SEQ ID NO: 91231 - protein, 10 aa, Artificial Sequence
  Description of Artificial Sequence: Synthetic peptide
  Seed: VISFSSSTSL (MAGC1_HUMAN)
VKSFSSSTSL

SEQ ID NO: 91232 - protein, 11 aa, Artificial Sequence
  Description of Artificial Sequence: Synthetic peptide
  Seed: LQIPVSSSFSY (MAGC1_HUMAN)
LLIPVSSSFSM

SEQ ID NO: 91233 - protein, 10 aa, Artificial Sequence
  Description of Artificial Sequence: Synthetic peptide
  Seed: MPTAGMPSLL (MAGC1_HUMAN)
MYTAGMPSLL

SEQ ID NO: 91234 - protein, 9 aa, Artificial Sequence
  Description of Artificial Sequence: Synthetic peptide
  Seed: NTVPITFPS (MAGC1_HUMAN)
NMVPITFPK

SEQ ID NO: 91235 - protein, 9 aa, Artificial Sequence
  Description of Artificial Sequence: Synthetic peptide
  Seed: SSSVMSPSF (MAGC1_HUMAN)
SRSVMSPSY

SEQ ID NO: 91236 - protein, 9 aa, Artificial Sequence
  Description of Artificial Sequence: Synthetic peptide
  Seed: LQIPVSPSF (MAGC1_HUMAN)
LTIPVSPSM

SEQ ID NO: 91237 - protein, 10 aa, Artificial Sequence
  Description of Artificial Sequence: Synthetic peptide
  Seed: SLFQSSPECT (MAGC1_HUMAN)
SVFQSSPECI

SEQ ID NO: 91238 - protein, 9 aa, Artificial Sequence
  Description of Artificial Sequence: Synthetic peptide
  Seed: SSHESPQSP (MAGC1_HUMAN)
SMHESPQSM

SEQ ID NO: 91239 - protein, 9 aa, Artificial Sequence
  Description of Artificial Sequence: Synthetic peptide
  Seed: TLASLLQSS (MAGC1_HUMAN)
TQASLLQSV

SEQ ID NO: 91240 - protein, 9 aa, Artificial Sequence
  Description of Artificial Sequence: Synthetic peptide
  Seed: ASSFFSSAL (MAGC1_HUMAN)
ARSFFSSAM

SEQ ID NO: 91241 - protein, 10 aa, Artificial Sequence
  Description of Artificial Sequence: Synthetic peptide
  Seed: LQIPGSPSFS (MAGC1_HUMAN)
LQIPGSPSFT

SEQ ID NO: 91242 - protein, 9 aa, Artificial Sequence
  Description of Artificial Sequence: Synthetic peptide
  Seed: QSPPEGEDV (MAGC1_HUMAN)
QLPPEGEDL

SEQ ID NO: 91243 - protein, 9 aa, Artificial Sequence
  Description of Artificial Sequence: Synthetic peptide
  Seed: EDSLSPLHF (MAGC1_HUMAN)
EESLSPLHF

SEQ ID NO: 91244 - protein, 11 aa, Artificial Sequence
  Description of Artificial Sequence: Synthetic peptide
  Seed: GPAQSPLQRPV (MAGC1_HUMAN)
GPAQSPLQRPL

SEQ ID NO: 91245 - protein, 9 aa, Artificial Sequence
  Description of Artificial Sequence: Synthetic peptide
  Seed: FQSSPERTH (MAGC1_HUMAN)
FTSSPERTF

SEQ ID NO: 91246 - protein, 9 aa, Artificial Sequence
  Description of Artificial Sequence: Synthetic peptide
  Seed: RYTGYFPVI (MAGC1_HUMAN)
RGTGYFPVY

SEQ ID NO: 91247 - protein, 9 aa, Artificial Sequence
  Description of Artificial Sequence: Synthetic peptide
  Seed: SSSSSSTLL (MAGC1_HUMAN)
SASSSSTLW

SEQ ID NO: 91248 - protein, 10 aa, Artificial Sequence
  Description of Artificial Sequence: Synthetic peptide
  Seed: MTSSFSSTLL (MAGC1_HUMAN)
MLSSFSSTLS

SEQ ID NO: 91249 - protein, 10 aa, Artificial Sequence
  Description of Artificial Sequence: Synthetic peptide
  Seed: SSPESAQSAF (MAGC1_HUMAN)
SQPESAQSAF

SEQ ID NO: 91250 - protein, 9 aa, Artificial Sequence
  Description of Artificial Sequence: Synthetic peptide
  Seed: QSPPEGEDV (MAGC1_HUMAN)
QIPPEGEDL

SEQ ID NO: 91251 - protein, 9 aa, Artificial Sequence
  Description of Artificial Sequence: Synthetic peptide
  Seed: VLSGIGVRA (MAGC1_HUMAN)
VSSGIGVRV

SEQ ID NO: 91252 - protein, 11 aa, Artificial Sequence
  Description of Artificial Sequence: Synthetic peptide
  Seed: STFEGFPQSLL (MAGC1_HUMAN)
SSFEGFPQSLL

SEQ ID NO: 91253 - protein, 9 aa, Artificial Sequence
  Description of Artificial Sequence: Synthetic peptide
  Seed: FSYTLASLL (MAGC1_HUMAN)
FVYTLASLV

SEQ ID NO: 91254 - protein, 9 aa, Artificial Sequence
  Description of Artificial Sequence: Synthetic peptide
  Seed: SQSPPEGPV (MAGC1_HUMAN)
SQSPPEGPY

SEQ ID NO: 91255 - protein, 9 aa, Artificial Sequence
  Description of Artificial Sequence: Synthetic peptide
  Seed: SPLQIVPSL (MAGC1_HUMAN)
SVLQIVPSL

SEQ ID NO: 91256 - protein, 9 aa, Artificial Sequence
  Description of Artificial Sequence: Synthetic peptide
  Seed: LQIPVSRSF (MAGC1_HUMAN)
LYIPVSRSF

SEQ ID NO: 91257 - protein, 10 aa, Artificial Sequence
  Description of Artificial Sequence: Synthetic peptide
  Seed: RSFSSTLLSI (MAGC1_HUMAN)
RMFSSTLLSY

SEQ ID NO: 91258 - protein, 9 aa, Artificial Sequence
  Description of Artificial Sequence: Synthetic peptide
  Seed: VSAASSSTL (MAGC1_HUMAN)
VAAASSSTI

SEQ ID NO: 91259 - protein, 9 aa, Artificial Sequence
  Description of Artificial Sequence: Synthetic peptide
  Seed: MPTAGMPSL (MAGC1_HUMAN)
MPTAGMPSI

SEQ ID NO: 91260 - protein, 9 aa, Artificial Sequence
  Description of Artificial Sequence: Synthetic peptide
  Seed: FPSSTSSSL (MAGC1_HUMAN)
FMSSTSSSF

SEQ ID NO: 91261 - protein, 9 aa, Artificial Sequence
  Description of Artificial Sequence: Synthetic peptide
  Seed: YTLLSLFQS (MAGC1_HUMAN)
YMLLSLFQI

SEQ ID NO: 91262 - protein, 9 aa, Artificial Sequence
  Description of Artificial Sequence: Synthetic peptide
  Seed: FSSTLLSIL (MAGC1_HUMAN)
FASTLLSIF

SEQ ID NO: 91263 - protein, 10 aa, Artificial Sequence
  Description of Artificial Sequence: Synthetic peptide
  Seed: ISRYTGYFPV (MAGC1_HUMAN)
ISRYTGYFPF

SEQ ID NO: 91264 - protein, 10 aa, Artificial Sequence
  Description of Artificial Sequence: Synthetic peptide
  Seed: ATESASSSVM (MAGC1_HUMAN)
AIESASSSVW

SEQ ID NO: 91265 - protein, 10 aa, Artificial Sequence
  Description of Artificial Sequence: Synthetic peptide
  Seed: VSPSSSSTLL (MAGC1_HUMAN)
VTPSSSSTLW

SEQ ID NO: 91266 - protein, 11 aa, Artificial Sequence
  Description of Artificial Sequence: Synthetic peptide
  Seed: SFFSSALLSIF (MAGC1_HUMAN)
SIFSSALLSIW

SEQ ID NO: 91267 - protein, 9 aa, Artificial Sequence
  Description of Artificial Sequence: Synthetic peptide
  Seed: LQIPVSSSS (MAGC1_HUMAN)
LTIPVSSSY

SEQ ID NO: 91268 - protein, 10 aa, Artificial Sequence
  Description of Artificial Sequence: Synthetic peptide
  Seed: WGPRAHSEVI (MAGC1_HUMAN)
WAPRAHSEVM

SEQ ID NO: 91269 - protein, 9 aa, Artificial Sequence
  Description of Artificial Sequence: Synthetic peptide
  Seed: CSSSTSLSL (MAGC1_HUMAN)
CISSTSLSY

SEQ ID NO: 91270 - protein, 9 aa, Artificial Sequence
  Description of Artificial Sequence: Synthetic peptide
  Seed: WVQEHYLEY (MAGC1_HUMAN)
WQQEHYLEF

SEQ ID NO: 91271 - protein, 8 aa, Artificial Sequence
  Description of Artificial Sequence: Synthetic peptide
  Seed: QIPGSPSF (MAGC1_HUMAN)
QFPGSPSY

SEQ ID NO: 91272 - protein, 10 aa, Artificial Sequence
  Description of Artificial Sequence: Synthetic peptide
  Seed: SLSPLHFPQF (MAGC1_HUMAN)
SLSPLHFPQY

SEQ ID NO: 91273 - protein, 9 aa, Artificial Sequence
  Description of Artificial Sequence: Synthetic peptide
  Seed: SFSSTLVSL (MAGC1_HUMAN)
STSSTLVSY

SEQ ID NO: 91274 - protein, 9 aa, Artificial Sequence
  Description of Artificial Sequence: Synthetic peptide
  Seed: FAFGEPREL (MAGC1_HUMAN)
FWFGEPREI

SEQ ID NO: 91275 - protein, 9 aa, Artificial Sequence
  Description of Artificial Sequence: Synthetic peptide
  Seed: REVDPDDSY (MAGC1_HUMAN)
RAVDPDDSM

SEQ ID NO: 91276 - protein, 9 aa, Artificial Sequence
  Description of Artificial Sequence: Synthetic peptide
  Seed: LLILILSII (MAGC1_HUMAN)
LMILILSIV

SEQ ID NO: 91277 - protein, 9 aa, Artificial Sequence
  Description of Artificial Sequence: Synthetic peptide
  Seed: TSLSLPQSF (MAGC1_HUMAN)
TPLSLPQSF

SEQ ID NO: 91278 - protein, 11 aa, Artificial Sequence
  Description of Artificial Sequence: Synthetic peptide
  Seed: RPVSSFFSYTL (MAGC1_HUMAN)
RGVSSFFSYTY

SEQ ID NO: 91279 - protein, 11 aa, Artificial Sequence
  Description of Artificial Sequence: Synthetic peptide
  Seed: SSSSSSTLLSL (MAGC1_HUMAN)
SASSSSTLLSL

SEQ ID NO: 91280 - protein, 9 aa, Artificial Sequence
  Description of Artificial Sequence: Synthetic peptide
  Seed: SAQSAFEGF (MAGC1_HUMAN)
SAQSAFEGY

SEQ ID NO: 91281 - protein, 9 aa, Artificial Sequence
  Description of Artificial Sequence: Synthetic peptide
  Seed: FSSALLSIF (MAGC1_HUMAN)
FTSALLSIL

SEQ ID NO: 91282 - protein, 9 aa, Artificial Sequence
  Description of Artificial Sequence: Synthetic peptide
  Seed: SSPEGKDSL (MAGC1_HUMAN)
SVPEGKDSV

SEQ ID NO: 91283 - protein, 9 aa, Artificial Sequence
  Description of Artificial Sequence: Synthetic peptide
  Seed: SPLQSPESA (MAGC1_HUMAN)
SPLQSPESY

SEQ ID NO: 91284 - protein, 10 aa, Artificial Sequence
  Description of Artificial Sequence: Synthetic peptide
  Seed: RAGREHFAFG (MAGC1_HUMAN)
RVGREHFAFT

SEQ ID NO: 91285 - protein, 9 aa, Artificial Sequence
  Description of Artificial Sequence: Synthetic peptide
  Seed: SSPERTQST (MAGC1_HUMAN)
SAPERTQSM

SEQ ID NO: 91286 - protein, 9 aa, Artificial Sequence
  Description of Artificial Sequence: Synthetic peptide
  Seed: SRYTGYFPV (MAGC1_HUMAN)
SAYTGYFPM

SEQ ID NO: 91287 - protein, 9 aa, Artificial Sequence
  Description of Artificial Sequence: Synthetic peptide
  Seed: FSSALLSIF (MAGC1_HUMAN)
FYSALLSII

SEQ ID NO: 91288 - protein, 9 aa, Artificial Sequence
  Description of Artificial Sequence: Synthetic peptide
  Seed: FEGFAQSPL (MAGC1_HUMAN)
FSGFAQSPY

SEQ ID NO: 91289 - protein, 9 aa, Artificial Sequence
  Description of Artificial Sequence: Synthetic peptide
  Seed: SPLQRPVSS (MAGC1_HUMAN)
SLLQRPVSM

SEQ ID NO: 91290 - protein, 10 aa, Artificial Sequence
  Description of Artificial Sequence: Synthetic peptide
  Seed: WGPRAHSEVI (MAGC1_HUMAN)
WYPRAHSEVL

SEQ ID NO: 91291 - protein, 9 aa, Artificial Sequence
  Description of Artificial Sequence: Synthetic peptide
  Seed: SLPQSFPES (MAGC1_HUMAN)
SQPQSFPEV

SEQ ID NO: 91292 - protein, 11 aa, Artificial Sequence
  Description of Artificial Sequence: Synthetic peptide
  Seed: IPMTSSFSSTL (MAGC1_HUMAN)
ILMTSSFSSTW

SEQ ID NO: 91293 - protein, 9 aa, Artificial Sequence
  Description of Artificial Sequence: Synthetic peptide
  Seed: TPSSLPQSF (MAGC1_HUMAN)
TFSSLPQSM

SEQ ID NO: 91294 - protein, 9 aa, Artificial Sequence
  Description of Artificial Sequence: Synthetic peptide
  Seed: SYKDALKDV (MAGC1_HUMAN)
SFKDALKDM

SEQ ID NO: 91295 - protein, 10 aa, Artificial Sequence
  Description of Artificial Sequence: Synthetic peptide
  Seed: VSSSSSSTLL (MAGC1_HUMAN)
VQSSSSSTLF

SEQ ID NO: 91296 - protein, 9 aa, Artificial Sequence
  Description of Artificial Sequence: Synthetic peptide
  Seed: VPITFPSSY (MAGC1_HUMAN)
VQITFPSSW

SEQ ID NO: 91297 - protein, 9 aa, Artificial Sequence
  Description of Artificial Sequence: Synthetic peptide
  Seed: TLDEKVDEL (MAGC1_HUMAN)
THDEKVDEI

SEQ ID NO: 91298 - protein, 9 aa, Artificial Sequence
  Description of Artificial Sequence: Synthetic peptide
  Seed: FQSSLQSPV (MAGC1_HUMAN)
FVSSLQSPL

SEQ ID NO: 91299 - protein, 9 aa, Artificial Sequence
  Description of Artificial Sequence: Synthetic peptide
  Seed: LSDEQGMSQ (MAGC1_HUMAN)
LADEQGMSA

SEQ ID NO: 91300 - protein, 10 aa, Artificial Sequence
  Description of Artificial Sequence: Synthetic peptide
  Seed: ATESASSSVM (MAGC1_HUMAN)
ACESASSSVF

SEQ ID NO: 91301 - protein, 9 aa, Artificial Sequence
  Description of Artificial Sequence: Synthetic peptide
  Seed: GYFPVIFRK (MAGC1_HUMAN)
GWFPVIFRY

SEQ ID NO: 91302 - protein, 9 aa, Artificial Sequence
  Description of Artificial Sequence: Synthetic peptide
  Seed: YTLASLLQS (MAGC1_HUMAN)
YMLASLLQF

SEQ ID NO: 91303 - protein, 9 aa, Artificial Sequence
  Description of Artificial Sequence: Synthetic peptide
  Seed: IPVSSSFSY (MAGC1_HUMAN)
IEVSSSFSM

SEQ ID NO: 91304 - protein, 9 aa, Artificial Sequence
  Description of Artificial Sequence: Synthetic peptide
  Seed: GENTHSPLQ (MAGC1_HUMAN)
GENTHSPLM

SEQ ID NO: 91305 - protein, 9 aa, Artificial Sequence
  Description of Artificial Sequence: Synthetic peptide
  Seed: TTDDSTATE (MAGC1_HUMAN)
TTDDSTATY

SEQ ID NO: 91306 - protein, 10 aa, Artificial Sequence
  Description of Artificial Sequence: Synthetic peptide
  Seed: REFIEILFGI (MAGC1_HUMAN)
RTFIEILFGA

SEQ ID NO: 91307 - protein, 10 aa, Artificial Sequence
  Description of Artificial Sequence: Synthetic peptide
  Seed: SFFSYTLASL (MAGC1_HUMAN)
SMFSYTLASL

SEQ ID NO: 91308 - protein, 11 aa, Artificial Sequence
  Description of Artificial Sequence: Synthetic peptide
  Seed: AEMLTNVISRY (MAGC1_HUMAN)
AQMLTNVISRY

SEQ ID NO: 91309 - protein, 9 aa, Artificial Sequence
  Description of Artificial Sequence: Synthetic peptide
  Seed: EFIEILFGI (MAGC1_HUMAN)
EYIEILFGF

SEQ ID NO: 91310 - protein, 8 aa, Artificial Sequence
  Description of Artificial Sequence: Synthetic peptide
  Seed: SSFFSSAL (MAGC1_HUMAN)
SQFFSSAM

SEQ ID NO: 91311 - protein, 10 aa, Artificial Sequence
  Description of Artificial Sequence: Synthetic peptide
  Seed: NTVPITFPSS (MAGC1_HUMAN)
NAVPITFPSV

SEQ ID NO: 91312 - protein, 9 aa, Artificial Sequence
  Description of Artificial Sequence: Synthetic peptide
  Seed: FSYTLLSLF (MAGC1_HUMAN)
FAYTLLSLY

SEQ ID NO: 91313 - protein, 9 aa, Artificial Sequence
  Description of Artificial Sequence: Synthetic peptide
  Seed: LQIPGSPSF (MAGC1_HUMAN)
LMIPGSPSA

SEQ ID NO: 91314 - protein, 10 aa, Artificial Sequence
  Description of Artificial Sequence: Synthetic peptide
  Seed: WGPRAHSEVI (MAGC1_HUMAN)
WQPRAHSEVM

SEQ ID NO: 91315 - protein, 9 aa, Artificial Sequence
  Description of Artificial Sequence: Synthetic peptide
  Seed: KAREFIEIL (MAGC1_HUMAN)
KVREFIEIY

SEQ ID NO: 91316 - protein, 10 aa, Artificial Sequence
  Description of Artificial Sequence: Synthetic peptide
  Seed: SRYTGYFPVI (MAGC1_HUMAN)
SPYTGYFPVM

SEQ ID NO: 91317 - protein, 9 aa, Artificial Sequence
  Description of Artificial Sequence: Synthetic peptide
  Seed: SMSPLYFPQ (MAGC1_HUMAN)
SISPLYFPK

SEQ ID NO: 91318 - protein, 11 aa, Artificial Sequence
  Description of Artificial Sequence: Synthetic peptide
  Seed: AIIDTTDDSTA (MAGC1_HUMAN)
ALIDTTDDSTI

SEQ ID NO: 91319 - protein, 9 aa, Artificial Sequence
  Description of Artificial Sequence: Synthetic peptide
  Seed: ALLSIFQSS (MAGC1_HUMAN)
AQLSIFQSM

SEQ ID NO: 91320 - protein, 9 aa, Artificial Sequence
  Description of Artificial Sequence: Synthetic peptide
  Seed: SSPERTHST (MAGC1_HUMAN)
SGPERTHSM

SEQ ID NO: 91321 - protein, 9 aa, Artificial Sequence
  Description of Artificial Sequence: Synthetic peptide
  Seed: MGDKDMPTA (MAGC1_HUMAN)
MWDKDMPTL

SEQ ID NO: 91322 - protein, 9 aa, Artificial Sequence
  Description of Artificial Sequence: Synthetic peptide
  Seed: VSRSFSSTL (MAGC1_HUMAN)
VYRSFSSTI

SEQ ID NO: 91323 - protein, 9 aa, Artificial Sequence
  Description of Artificial Sequence: Synthetic peptide
  Seed: LQIPMTSSF (MAGC1_HUMAN)
LVIPMTSSM

SEQ ID NO: 91324 - protein, 10 aa, Artificial Sequence
  Description of Artificial Sequence: Synthetic peptide
  Seed: FQSSLQSPVS (MAGC1_HUMAN)
FLSSLQSPVD

SEQ ID NO: 91325 - protein, 9 aa, Artificial Sequence
  Description of Artificial Sequence: Synthetic peptide
  Seed: FQSSPERTH (MAGC1_HUMAN)
FLSSPERTY

SEQ ID NO: 91326 - protein, 10 aa, Artificial Sequence
  Description of Artificial Sequence: Synthetic peptide
  Seed: LQIPGSPSFS (MAGC1_HUMAN)
LLIPGSPSFF

SEQ ID NO: 91327 - protein, 9 aa, Artificial Sequence
  Description of Artificial Sequence: Synthetic peptide
  Seed: SSPEGKDSL (MAGC1_HUMAN)
SHPEGKDSM

SEQ ID NO: 91328 - protein, 9 aa, Artificial Sequence
  Description of Artificial Sequence: Synthetic peptide
  Seed: AQSSLQIPV (MAGC1_HUMAN)
AVSSLQIPV

SEQ ID NO: 91329 - protein, 9 aa, Artificial Sequence
  Description of Artificial Sequence: Synthetic peptide
  Seed: VSRSFSSTL (MAGC1_HUMAN)
VLRSFSSTW

SEQ ID NO: 91330 - protein, 9 aa, Artificial Sequence
  Description of Artificial Sequence: Synthetic peptide
  Seed: SPLQSPESA (MAGC1_HUMAN)
SVLQSPESY

SEQ ID NO: 91331 - protein, 8 aa, Artificial Sequence
  Description of Artificial Sequence: Synthetic peptide
  Seed: SSFFSYTL (MAGC1_HUMAN)
SAFFSYTM

SEQ ID NO: 91332 - protein, 9 aa, Artificial Sequence
  Description of Artificial Sequence: Synthetic peptide
  Seed: SSPPRYEFL (MAGC1_HUMAN)
SAPPRYEFF

SEQ ID NO: 91333 - protein, 10 aa, Artificial Sequence
  Description of Artificial Sequence: Synthetic peptide
  Seed: ISRYTGYFPV (MAGC1_HUMAN)
IARYTGYFPK

SEQ ID NO: 91334 - protein, 9 aa, Artificial Sequence
  Description of Artificial Sequence: Synthetic peptide
  Seed: FQSSLQSPV (MAGC1_HUMAN)
FSSSLQSPI

SEQ ID NO: 91335 - protein, 10 aa, Artificial Sequence
  Description of Artificial Sequence: Synthetic peptide
  Seed: FPQSPLQIPV (MAGC1_HUMAN)
FEQSPLQIPL

SEQ ID NO: 91336 - protein, 10 aa, Artificial Sequence
  Description of Artificial Sequence: Synthetic peptide
  Seed: FPQSPLQIPV (MAGC1_HUMAN)
FCQSPLQIPV

SEQ ID NO: 91337 - protein, 10 aa, Artificial Sequence
  Description of Artificial Sequence: Synthetic peptide
  Seed: SRYTGYFPVI (MAGC1_HUMAN)
SNYTGYFPVW

SEQ ID NO: 91338 - protein, 10 aa, Artificial Sequence
  Description of Artificial Sequence: Synthetic peptide
  Seed: PLQIPVSRSF (MAGC1_HUMAN)
PIQIPVSRSY

SEQ ID NO: 91339 - protein, 9 aa, Artificial Sequence
  Description of Artificial Sequence: Synthetic peptide
  Seed: SFFSYTLAS (MAGC1_HUMAN)
SFFSYTLAA

SEQ ID NO: 91340 - protein, 11 aa, Artificial Sequence
  Description of Artificial Sequence: Synthetic peptide
  Seed: FLAMLKNTVPI (MAGC1_HUMAN)
FWAMLKNTVPV

SEQ ID NO: 91341 - protein, 9 aa, Artificial Sequence
  Description of Artificial Sequence: Synthetic peptide
  Seed: VIKRKVVEF (MAGC1_HUMAN)
VTKRKVVEF

SEQ ID NO: 91342 - protein, 10 aa, Artificial Sequence
  Description of Artificial Sequence: Synthetic peptide
  Seed: EVIWDVLSGI (MAGC1_HUMAN)
EVIWDVLSGY

SEQ ID NO: 91343 - protein, 10 aa, Artificial Sequence
  Description of Artificial Sequence: Synthetic peptide
  Seed: SSSSTLLSLF (MAGC1_HUMAN)
SKSSTLLSLF

SEQ ID NO: 91344 - protein, 11 aa, Artificial Sequence
  Description of Artificial Sequence: Synthetic peptide
  Seed: KRKVVEFLAML (MAGC1_HUMAN)
KKKVVEFLAMV

SEQ ID NO: 91345 - protein, 9 aa, Artificial Sequence
  Description of Artificial Sequence: Synthetic peptide
  Seed: VIKRKVVEF (MAGC1_HUMAN)
VVKRKVVEW

SEQ ID NO: 91346 - protein, 10 aa, Artificial Sequence
  Description of Artificial Sequence: Synthetic peptide
  Seed: ESEPLFTYTL (MAGC1_HUMAN)
EVEPLFTYTI

SEQ ID NO: 91347 - protein, 9 aa, Artificial Sequence
  Description of Artificial Sequence: Synthetic peptide
  Seed: SSHESPQSP (MAGC1_HUMAN)
SAHESPQSV

SEQ ID NO: 91348 - protein, 10 aa, Artificial Sequence
  Description of Artificial Sequence: Synthetic peptide
  Seed: YTLASLLQSS (MAGC1_HUMAN)
YKLASLLQST

SEQ ID NO: 91349 - protein, 9 aa, Artificial Sequence
  Description of Artificial Sequence: Synthetic peptide
  Seed: SSPPRYEFL (MAGC1_HUMAN)
SLPPRYEFM

SEQ ID NO: 91350 - protein, 9 aa, Artificial Sequence
  Description of Artificial Sequence: Synthetic peptide
  Seed: LQIPGSPSF (MAGC1_HUMAN)
LEIPGSPSI

SEQ ID NO: 91351 - protein, 10 aa, Artificial Sequence
  Description of Artificial Sequence: Synthetic peptide
  Seed: SSSSTLLSLF (MAGC1_HUMAN)
SVSSTLLSLF

SEQ ID NO: 91352 - protein, 9 aa, Artificial Sequence
  Description of Artificial Sequence: Synthetic peptide
  Seed: LQIPMTSSF (MAGC1_HUMAN)
LQIPMTSSY

SEQ ID NO: 91353 - protein, 9 aa, Artificial Sequence
  Description of Artificial Sequence: Synthetic peptide
  Seed: SQSPPEGPV (MAGC1_HUMAN)
SKSPPEGPF

SEQ ID NO: 91354 - protein, 9 aa, Artificial Sequence
  Description of Artificial Sequence: Synthetic peptide
  Seed: LQIPVSPSF (MAGC1_HUMAN)
LEIPVSPSA

SEQ ID NO: 91355 - protein, 9 aa, Artificial Sequence
  Description of Artificial Sequence: Synthetic peptide
  Seed: SVLQIPVSA (MAGC1_HUMAN)
SLLQIPVSK

SEQ ID NO: 91356 - protein, 9 aa, Artificial Sequence
  Description of Artificial Sequence: Synthetic peptide
  Seed: SMSPLYFPQ (MAGC1_HUMAN)
SQSPLYFPR

SEQ ID NO: 91357 - protein, 9 aa, Artificial Sequence
  Description of Artificial Sequence: Synthetic peptide
  Seed: LDEKVDELA (MAGC1_HUMAN)
LEEKVDELL

SEQ ID NO: 91358 - protein, 10 aa, Artificial Sequence
  Description of Artificial Sequence: Synthetic peptide
  Seed: RAGREHFAFG (MAGC1_HUMAN)
RVGREHFAFI

SEQ ID NO: 91359 - protein, 9 aa, Artificial Sequence
  Description of Artificial Sequence: Synthetic peptide
  Seed: TSLSLPQSF (MAGC1_HUMAN)
TGLSLPQSY

SEQ ID NO: 91360 - protein, 9 aa, Artificial Sequence
  Description of Artificial Sequence: Synthetic peptide
  Seed: RAHSEVIKR (MAGC1_HUMAN)
RWHSEVIKR

SEQ ID NO: 91361 - protein, 10 aa, Artificial Sequence
  Description of Artificial Sequence: Synthetic peptide
  Seed: MSPLYFPQSP (MAGC1_HUMAN)
MRPLYFPQSA

SEQ ID NO: 91362 - protein, 9 aa, Artificial Sequence
  Description of Artificial Sequence: Synthetic peptide
  Seed: GENTHSPLQ (MAGC1_HUMAN)
GENTHSPLA

SEQ ID NO: 91363 - protein, 9 aa, Artificial Sequence
  Description of Artificial Sequence: Synthetic peptide
  Seed: KVDELARFL (MAGC1_HUMAN)
KQDELARFW

SEQ ID NO: 91364 - protein, 9 aa, Artificial Sequence
  Description of Artificial Sequence: Synthetic peptide
  Seed: RKVVEFLAM (MAGC1_HUMAN)
RKVVEFLAF

SEQ ID NO: 91365 - protein, 9 aa, Artificial Sequence
  Description of Artificial Sequence: Synthetic peptide
  Seed: VSPSSSSTL (MAGC1_HUMAN)
VRPSSSSTF

SEQ ID NO: 91366 - protein, 9 aa, Artificial Sequence
  Description of Artificial Sequence: Synthetic peptide
  Seed: SQSSPVSSF (MAGC1_HUMAN)
SDSSPVSSL

SEQ ID NO: 91367 - protein, 10 aa, Artificial Sequence
  Description of Artificial Sequence: Synthetic peptide
  Seed: SSSSTLLSLF (MAGC1_HUMAN)
SASSTLLSLY

SEQ ID NO: 91368 - protein, 11 aa, Artificial Sequence
  Description of Artificial Sequence: Synthetic peptide
  Seed: IPVSRSFSSTL (MAGC1_HUMAN)
IIVSRSFSSTF

SEQ ID NO: 91369 - protein, 10 aa, Artificial Sequence
  Description of Artificial Sequence: Synthetic peptide
  Seed: FPQSPLQIPV (MAGC1_HUMAN)
FAQSPLQIPF

SEQ ID NO: 91370 - protein, 10 aa, Artificial Sequence
  Description of Artificial Sequence: Synthetic peptide
  Seed: TTDDSTATES (MAGC1_HUMAN)
TFDDSTATEV

SEQ ID NO: 91371 - protein, 11 aa, Artificial Sequence
  Description of Artificial Sequence: Synthetic peptide
  Seed: SPLQRPVSSFF (MAGC1_HUMAN)
SNLQRPVSSFF

SEQ ID NO: 91372 - protein, 10 aa, Artificial Sequence
  Description of Artificial Sequence: Synthetic peptide
  Seed: SSPESAQSAF (MAGC1_HUMAN)
SIPESAQSAM

SEQ ID NO: 91373 - protein, 10 aa, Artificial Sequence
  Description of Artificial Sequence: Synthetic peptide
  Seed: MLTNVISRYT (MAGC1_HUMAN)
MLTNVISRYV

SEQ ID NO: 91374 - protein, 9 aa, Artificial Sequence
  Description of Artificial Sequence: Synthetic peptide
  Seed: KQPITKAEM (MAGC1_HUMAN)
KVPITKAEM

SEQ ID NO: 91375 - protein, 11 aa, Artificial Sequence
  Description of Artificial Sequence: Synthetic peptide
  Seed: LQRPVSSFFSY (MAGC1_HUMAN)
LLRPVSSFFSY

SEQ ID NO: 91376 - protein, 9 aa, Artificial Sequence
  Description of Artificial Sequence: Synthetic peptide
  Seed: FSYTLLSLF (MAGC1_HUMAN)
FVYTLLSLL

SEQ ID NO: 91377 - protein, 10 aa, Artificial Sequence
  Description of Artificial Sequence: Synthetic peptide
  Seed: SSSSSTLLSL (MAGC1_HUMAN)
SQSSSTLLSI

SEQ ID NO: 91378 - protein, 10 aa, Artificial Sequence
  Description of Artificial Sequence: Synthetic peptide
  Seed: VISFSSSTSL (MAGC1_HUMAN)
VPSFSSSTSW

SEQ ID NO: 91379 - protein, 9 aa, Artificial Sequence
  Description of Artificial Sequence: Synthetic peptide
  Seed: TESASSSVM (MAGC1_HUMAN)
TMSASSSVW

SEQ ID NO: 91380 - protein, 9 aa, Artificial Sequence
  Description of Artificial Sequence: Synthetic peptide
  Seed: SSPESPLQS (MAGC1_HUMAN)
SSPESPLQL

SEQ ID NO: 91381 - protein, 10 aa, Artificial Sequence
  Description of Artificial Sequence: Synthetic peptide
  Seed: TVPITFPSSY (MAGC1_HUMAN)
TKPITFPSSY

SEQ ID NO: 91382 - protein, 10 aa, Artificial Sequence
  Description of Artificial Sequence: Synthetic peptide
  Seed: KRKVVEFLAM (MAGC1_HUMAN)
KRKVVEFLAI

SEQ ID NO: 91383 - protein, 9 aa, Artificial Sequence
  Description of Artificial Sequence: Synthetic peptide
  Seed: SGIGVRAGR (MAGC1_HUMAN)
SSIGVRAGL

SEQ ID NO: 91384 - protein, 10 aa, Artificial Sequence
  Description of Artificial Sequence: Synthetic peptide
  Seed: LSQSSPVSSF (MAGC1_HUMAN)
LLQSSPVSSM

SEQ ID NO: 91385 - protein, 9 aa, Artificial Sequence
  Description of Artificial Sequence: Synthetic peptide
  Seed: MTSSFSSTL (MAGC1_HUMAN)
MKSSFSSTA

SEQ ID NO: 91386 - protein, 10 aa, Artificial Sequence
  Description of Artificial Sequence: Synthetic peptide
  Seed: TVPITFPSSY (MAGC1_HUMAN)
THPITFPSSY

SEQ ID NO: 91387 - protein, 9 aa, Artificial Sequence
  Description of Artificial Sequence: Synthetic peptide
  Seed: SQSSPVSSF (MAGC1_HUMAN)
SQSSPVSSL

SEQ ID NO: 91388 - protein, 11 aa, Artificial Sequence
  Description of Artificial Sequence: Synthetic peptide
  Seed: REVPNSSPPRY (MAGC1_HUMAN)
RIVPNSSPPRY

SEQ ID NO: 91389 - protein, 9 aa, Artificial Sequence
  Description of Artificial Sequence: Synthetic peptide
  Seed: MLKNTVPIT (MAGC1_HUMAN)
MVKNTVPIV

SEQ ID NO: 91390 - protein, 9 aa, Artificial Sequence
  Description of Artificial Sequence: Synthetic peptide
  Seed: SQSSPVSSF (MAGC1_HUMAN)
SISSPVSSH

SEQ ID NO: 91391 - protein, 9 aa, Artificial Sequence
  Description of Artificial Sequence: Synthetic peptide
  Seed: TLLESDSLT (MAGC1_HUMAN)
TLLESDSLI

SEQ ID NO: 91392 - protein, 10 aa, Artificial Sequence
  Description of Artificial Sequence: Synthetic peptide
  Seed: SPLQSPVSSF (MAGC1_HUMAN)
STLQSPVSSF

SEQ ID NO: 91393 - protein, 10 aa, Artificial Sequence
  Description of Artificial Sequence: Synthetic peptide
  Seed: FPQSPLQIPV (MAGC1_HUMAN)
FVQSPLQIPI

SEQ ID NO: 91394 - protein, 9 aa, Artificial Sequence
  Description of Artificial Sequence: Synthetic peptide
  Seed: MLTNVISRY (MAGC1_HUMAN)
MSTNVISRW

SEQ ID NO: 91395 - protein, 10 aa, Artificial Sequence
  Description of Artificial Sequence: Synthetic peptide
  Seed: HSPQSPPEGM (MAGC1_HUMAN)
HTPQSPPEGL

SEQ ID NO: 91396 - protein, 9 aa, Artificial Sequence
  Description of Artificial Sequence: Synthetic peptide
  Seed: GEDSMSPLY (MAGC1_HUMAN)
GMDSMSPLY

SEQ ID NO: 91397 - protein, 9 aa, Artificial Sequence
  Description of Artificial Sequence: Synthetic peptide
  Seed: MTSSFSSTL (MAGC1_HUMAN)
MWSSFSSTI

SEQ ID NO: 91398 - protein, 11 aa, Artificial Sequence
  Description of Artificial Sequence: Synthetic peptide
  Seed: SFFSYTLASLL (MAGC1_HUMAN)
STFSYTLASLM

SEQ ID NO: 91399 - protein, 9 aa, Artificial Sequence
  Description of Artificial Sequence: Synthetic peptide
  Seed: ISFSSSTSL (MAGC1_HUMAN)
IQFSSSTSS

SEQ ID NO: 91400 - protein, 9 aa, Artificial Sequence
  Description of Artificial Sequence: Synthetic peptide
  Seed: RFLLLKYQV (MAGC1_HUMAN)
RYLLLKYQL

SEQ ID NO: 91401 - protein, 9 aa, Artificial Sequence
  Description of Artificial Sequence: Synthetic peptide
  Seed: ASSFFSSAL (MAGC1_HUMAN)
ALSFFSSAF

SEQ ID NO: 91402 - protein, 8 aa, Artificial Sequence
  Description of Artificial Sequence: Synthetic peptide
  Seed: FSYTLASL (MAGC1_HUMAN)
FQYTLASI

SEQ ID NO: 91403 - protein, 11 aa, Artificial Sequence
  Description of Artificial Sequence: Synthetic peptide
  Seed: LLLKYQVKQPI (MAGC1_HUMAN)
LMLKYQVKQPV

SEQ ID NO: 91404 - protein, 9 aa, Artificial Sequence
  Description of Artificial Sequence: Synthetic peptide
  Seed: HFPQSPPEW (MAGC1_HUMAN)
HVPQSPPEY

SEQ ID NO: 91405 - protein, 10 aa, Artificial Sequence
  Description of Artificial Sequence: Synthetic peptide
  Seed: ASSFFSSALL (MAGC1_HUMAN)
AGSFFSSALM

SEQ ID NO: 91406 - protein, 9 aa, Artificial Sequence
  Description of Artificial Sequence: Synthetic peptide
  Seed: TTDDSTATE (MAGC1_HUMAN)
TADDSTATY

SEQ ID NO: 91407 - protein, 11 aa, Artificial Sequence
  Description of Artificial Sequence: Synthetic peptide
  Seed: AMLKNTVPITF (MAGC1_HUMAN)
AQLKNTVPITL

SEQ ID NO: 91408 - protein, 9 aa, Artificial Sequence
  Description of Artificial Sequence: Synthetic peptide
  Seed: ASSSTLVSI (MAGC1_HUMAN)
ASSSTLVSF

SEQ ID NO: 91409 - protein, 9 aa, Artificial Sequence
  Description of Artificial Sequence: Synthetic peptide
  Seed: LILILSIIF (MAGC1_HUMAN)
LTLILSIIW

SEQ ID NO: 91410 - protein, 9 aa, Artificial Sequence
  Description of Artificial Sequence: Synthetic peptide
  Seed: GFPQSLLQI (MAGC1_HUMAN)
GRPQSLLQM

SEQ ID NO: 91411 - protein, 9 aa, Artificial Sequence
  Description of Artificial Sequence: Synthetic peptide
  Seed: KVVEFLAML (MAGC1_HUMAN)
KLVEFLAMW

SEQ ID NO: 91412 - protein, 9 aa, Artificial Sequence
  Description of Artificial Sequence: Synthetic peptide
  Seed: FQSSLQSPV (MAGC1_HUMAN)
FQSSLQSPF

SEQ ID NO: 91413 - protein, 11 aa, Artificial Sequence
  Description of Artificial Sequence: Synthetic peptide
  Seed: IPVSPSSSSTL (MAGC1_HUMAN)
ILVSPSSSSTY

SEQ ID NO: 91414 - protein, 11 aa, Artificial Sequence
  Description of Artificial Sequence: Synthetic peptide
  Seed: SPLQIPVSSSS (MAGC1_HUMAN)
SSLQIPVSSSM

SEQ ID NO: 91415 - protein, 9 aa, Artificial Sequence
  Description of Artificial Sequence: Synthetic peptide
  Seed: EYTSSSDTL (MAGC1_HUMAN)
EHTSSSDTL

SEQ ID NO: 91416 - protein, 9 aa, Artificial Sequence
  Description of Artificial Sequence: Synthetic peptide
  Seed: SSLSQSSPV (MAGC1_HUMAN)
SVLSQSSPW

SEQ ID NO: 91417 - protein, 11 aa, Artificial Sequence
  Description of Artificial Sequence: Synthetic peptide
  Seed: TVPITFPSSYK (MAGC1_HUMAN)
TRPITFPSSYR

SEQ ID NO: 91418 - protein, 9 aa, Artificial Sequence
  Description of Artificial Sequence: Synthetic peptide
  Seed: MLTNVISRY (MAGC1_HUMAN)
MQTNVISRL

SEQ ID NO: 91419 - protein, 9 aa, Artificial Sequence
  Description of Artificial Sequence: Synthetic peptide
  Seed: SEPLFTYTL (MAGC1_HUMAN)
SRPLFTYTM

SEQ ID NO: 91420 - protein, 9 aa, Artificial Sequence
  Description of Artificial Sequence: Synthetic peptide
  Seed: RYTGYFPVI (MAGC1_HUMAN)
RWTGYFPVL

SEQ ID NO: 91421 - protein, 10 aa, Artificial Sequence
  Description of Artificial Sequence: Synthetic peptide
  Seed: LLQIPMTSSF (MAGC1_HUMAN)
LQQIPMTSSF

SEQ ID NO: 91422 - protein, 11 aa, Artificial Sequence
  Description of Artificial Sequence: Synthetic peptide
  Seed: VDEYTSSSDTL (MAGC1_HUMAN)
VAEYTSSSDTF

SEQ ID NO: 91423 - protein, 9 aa, Artificial Sequence
  Description of Artificial Sequence: Synthetic peptide
  Seed: SPPEGPVQS (MAGC1_HUMAN)
SAPEGPVQF

SEQ ID NO: 91424 - protein, 9 aa, Artificial Sequence
  Description of Artificial Sequence: Synthetic peptide
  Seed: FPSSYKDAL (MAGC1_HUMAN)
FKSSYKDAL

SEQ ID NO: 91425 - protein, 10 aa, Artificial Sequence
  Description of Artificial Sequence: Synthetic peptide
  Seed: SPLQSPVSSF (MAGC1_HUMAN)
SKLQSPVSSY

SEQ ID NO: 91426 - protein, 9 aa, Artificial Sequence
  Description of Artificial Sequence: Synthetic peptide
  Seed: SLLQSSHES (MAGC1_HUMAN)
SMLQSSHEI

SEQ ID NO: 91427 - protein, 10 aa, Artificial Sequence
  Description of Artificial Sequence: Synthetic peptide
  Seed: LSLFQSFSER (MAGC1_HUMAN)
LLLFQSFSEK

SEQ ID NO: 91428 - protein, 9 aa, Artificial Sequence
  Description of Artificial Sequence: Synthetic peptide
  Seed: SFFSYTLAS (MAGC1_HUMAN)
SYFSYTLAI

SEQ ID NO: 91429 - protein, 9 aa, Artificial Sequence
  Description of Artificial Sequence: Synthetic peptide
  Seed: SSPESAQST (MAGC1_HUMAN)
SVPESAQSI

SEQ ID NO: 91430 - protein, 9 aa, Artificial Sequence
  Description of Artificial Sequence: Synthetic peptide
  Seed: RTHSTFEGF (MAGC1_HUMAN)
RYHSTFEGM

SEQ ID NO: 91431 - protein, 10 aa, Artificial Sequence
  Description of Artificial Sequence: Synthetic peptide
  Seed: SSSSSSSTLL (MAGC1_HUMAN)
SPSSSSSTLF

SEQ ID NO: 91432 - protein, 10 aa, Artificial Sequence
  Description of Artificial Sequence: Synthetic peptide
  Seed: TTDDSTATES (MAGC1_HUMAN)
TSDDSTATEY

SEQ ID NO: 91433 - protein, 9 aa, Artificial Sequence
  Description of Artificial Sequence: Synthetic peptide
  Seed: FPSSYKDAL (MAGC1_HUMAN)
FMSSYKDAY

SEQ ID NO: 91434 - protein, 9 aa, Artificial Sequence
  Description of Artificial Sequence: Synthetic peptide
  Seed: SSSSSSSTL (MAGC1_HUMAN)
SNSSSSSTY

SEQ ID NO: 91435 - protein, 11 aa, Artificial Sequence
  Description of Artificial Sequence: Synthetic peptide
  Seed: SLSQSSPVSSF (MAGC1_HUMAN)
SSSQSSPVSSY

SEQ ID NO: 91436 - protein, 9 aa, Artificial Sequence
  Description of Artificial Sequence: Synthetic peptide
  Seed: SSSTSLSPF (MAGC1_HUMAN)
SRSTSLSPY

SEQ ID NO: 91437 - protein, 9 aa, Artificial Sequence
  Description of Artificial Sequence: Synthetic peptide
  Seed: VSPSFSSTL (MAGC1_HUMAN)
VVPSFSSTL

SEQ ID NO: 91438 - protein, 9 aa, Artificial Sequence
  Description of Artificial Sequence: Synthetic peptide
  Seed: SSSSSSSTL (MAGC1_HUMAN)
SLSSSSSTF

SEQ ID NO: 91439 - protein, 9 aa, Artificial Sequence
  Description of Artificial Sequence: Synthetic peptide
  Seed: VSAASSSTL (MAGC1_HUMAN)
VAAASSSTL

SEQ ID NO: 91440 - protein, 11 aa, Artificial Sequence
  Description of Artificial Sequence: Synthetic peptide
  Seed: SSSSSSTLLSL (MAGC1_HUMAN)
SWSSSSTLLSW

SEQ ID NO: 91441 - protein, 9 aa, Artificial Sequence
  Description of Artificial Sequence: Synthetic peptide
  Seed: SFPSSTSSS (MAGC1_HUMAN)
SYPSSTSSL

SEQ ID NO: 91442 - protein, 9 aa, Artificial Sequence
  Description of Artificial Sequence: Synthetic peptide
  Seed: STQSPFEGF (MAGC1_HUMAN)
SVQSPFEGF

SEQ ID NO: 91443 - protein, 10 aa, Artificial Sequence
  Description of Artificial Sequence: Synthetic peptide
  Seed: RYTGYFPVIF (MAGC1_HUMAN)
RLTGYFPVIW

SEQ ID NO: 91444 - protein, 9 aa, Artificial Sequence
  Description of Artificial Sequence: Synthetic peptide
  Seed: SPESPLQSP (MAGC1_HUMAN)
SPESPLQSL

SEQ ID NO: 91445 - protein, 9 aa, Artificial Sequence
  Description of Artificial Sequence: Synthetic peptide
  Seed: TKAEMLTNV (MAGC1_HUMAN)
THAEMLTNI

SEQ ID NO: 91446 - protein, 9 aa, Artificial Sequence
  Description of Artificial Sequence: Synthetic peptide
  Seed: SAPEGEDSL (MAGC1_HUMAN)
SHPEGEDSF

SEQ ID NO: 91447 - protein, 10 aa, Artificial Sequence
  Description of Artificial Sequence: Synthetic peptide
  Seed: KGTYASEEVI (MAGC1_HUMAN)
KCTYASEEVY

SEQ ID NO: 91448 - protein, 9 aa, Artificial Sequence
  Description of Artificial Sequence: Synthetic peptide
  Seed: RPVSSFFSY (MAGC1_HUMAN)
RHVSSFFSF

SEQ ID NO: 91449 - protein, 9 aa, Artificial Sequence
  Description of Artificial Sequence: Synthetic peptide
  Seed: YVFVNTLDL (MAGC1_HUMAN)
YMFVNTLDY

SEQ ID NO: 91450 - protein, 10 aa, Artificial Sequence
  Description of Artificial Sequence: Synthetic peptide
  Seed: EVIKRKVVEF (MAGC1_HUMAN)
ETIKRKVVEY

SEQ ID NO: 91451 - protein, 10 aa, Artificial Sequence
  Description of Artificial Sequence: Synthetic peptide
  Seed: VSSSSSSSTL (MAGC1_HUMAN)
VPSSSSSSTF

SEQ ID NO: 91452 - protein, 10 aa, Artificial Sequence
  Description of Artificial Sequence: Synthetic peptide
  Seed: SSSSSTLLSL (MAGC1_HUMAN)
SHSSSTLLSF

SEQ ID NO: 91453 - protein, 10 aa, Artificial Sequence
  Description of Artificial Sequence: Synthetic peptide
  Seed: LQIPVSSSFS (MAGC1_HUMAN)
LLIPVSSSFF

SEQ ID NO: 91454 - protein, 11 aa, Artificial Sequence
  Description of Artificial Sequence: Synthetic peptide
  Seed: SSSSSTLLSLF (MAGC1_HUMAN)
SESSSTLLSLW

SEQ ID NO: 91455 - protein, 9 aa, Artificial Sequence
  Description of Artificial Sequence: Synthetic peptide
  Seed: LQNPASSFF (MAGC1_HUMAN)
LINPASSFL

SEQ ID NO: 91456 - protein, 10 aa, Artificial Sequence
  Description of Artificial Sequence: Synthetic peptide
  Seed: SSSSSTLLSL (MAGC1_HUMAN)
SMSSSTLLSY

SEQ ID NO: 91457 - protein, 10 aa, Artificial Sequence
  Description of Artificial Sequence: Synthetic peptide
  Seed: LLQIPMTSSF (MAGC1_HUMAN)
LPQIPMTSSL

SEQ ID NO: 91458 - protein, 10 aa, Artificial Sequence
  Description of Artificial Sequence: Synthetic peptide
  Seed: SSFSSTLLSI (MAGC1_HUMAN)
SQFSSTLLSW

SEQ ID NO: 91459 - protein, 9 aa, Artificial Sequence
  Description of Artificial Sequence: Synthetic peptide
  Seed: SIFQSSPER (MAGC1_HUMAN)
SYFQSSPER

SEQ ID NO: 91460 - protein, 9 aa, Artificial Sequence
  Description of Artificial Sequence: Synthetic peptide
  Seed: YTGYFPVIF (MAGC1_HUMAN)
YSGYFPVIL

SEQ ID NO: 91461 - protein, 8 aa, Artificial Sequence
  Description of Artificial Sequence: Synthetic peptide
  Seed: IWDVLSGI (MAGC1_HUMAN)
IYDVLSGM

SEQ ID NO: 91462 - protein, 9 aa, Artificial Sequence
  Description of Artificial Sequence: Synthetic peptide
  Seed: DPDDSYVFV (MAGC1_HUMAN)
DVDDSYVFL

SEQ ID NO: 91463 - protein, 10 aa, Artificial Sequence
  Description of Artificial Sequence: Synthetic peptide
  Seed: REVDPDDSYV (MAGC1_HUMAN)
RMVDPDDSYF

SEQ ID NO: 91464 - protein, 9 aa, Artificial Sequence
  Description of Artificial Sequence: Synthetic peptide
  Seed: YTGYFPVIF (MAGC1_HUMAN)
YVGYFPVIW

SEQ ID NO: 91465 - protein, 10 aa, Artificial Sequence
  Description of Artificial Sequence: Synthetic peptide
  Seed: TGYFPVIFRK (MAGC1_HUMAN)
TMYFPVIFRH

SEQ ID NO: 91466 - protein, 9 aa, Artificial Sequence
  Description of Artificial Sequence: Synthetic peptide
  Seed: ASSFFSSAL (MAGC1_HUMAN)
AASFFSSAF

SEQ ID NO: 91467 - protein, 9 aa, Artificial Sequence
  Description of Artificial Sequence: Synthetic peptide
  Seed: VSAASSSTL (MAGC1_HUMAN)
VRAASSSTF

SEQ ID NO: 91468 - protein, 9 aa, Artificial Sequence
  Description of Artificial Sequence: Synthetic peptide
  Seed: ALKDVEERA (MAGC1_HUMAN)
AIKDVEERV

SEQ ID NO: 91469 - protein, 9 aa, Artificial Sequence
  Description of Artificial Sequence: Synthetic peptide
  Seed: RFLLLKYQV (MAGC1_HUMAN)
RYLLLKYQI

SEQ ID NO: 91470 - protein, 9 aa, Artificial Sequence
  Description of Artificial Sequence: Synthetic peptide
  Seed: GSPSFSSTL (MAGC1_HUMAN)
GTPSFSSTW

SEQ ID NO: 91471 - protein, 9 aa, Artificial Sequence
  Description of Artificial Sequence: Synthetic peptide
  Seed: YTLLSLFQS (MAGC1_HUMAN)
YLLLSLFQM

SEQ ID NO: 91472 - protein, 9 aa, Artificial Sequence
  Description of Artificial Sequence: Synthetic peptide
  Seed: LQSPVISFS (MAGC1_HUMAN)
LMSPVISFI

SEQ ID NO: 91473 - protein, 11 aa, Artificial Sequence
  Description of Artificial Sequence: Synthetic peptide
  Seed: RPVSSFFSYTL (MAGC1_HUMAN)
RWVSSFFSYTY

SEQ ID NO: 91474 - protein, 10 aa, Artificial Sequence
  Description of Artificial Sequence: Synthetic peptide
  Seed: TTDDSTATES (MAGC1_HUMAN)
TSDDSTATEV

SEQ ID NO: 91475 - protein, 9 aa, Artificial Sequence
  Description of Artificial Sequence: Synthetic peptide
  Seed: SIIFIKGTY (MAGC1_HUMAN)
SPIFIKGTY

SEQ ID NO: 91476 - protein, 9 aa, Artificial Sequence
  Description of Artificial Sequence: Synthetic peptide
  Seed: VIFRKAREF (MAGC1_HUMAN)
VFFRKAREY

SEQ ID NO: 91477 - protein, 10 aa, Artificial Sequence
  Description of Artificial Sequence: Synthetic peptide
  Seed: SSFSSTLLSI (MAGC1_HUMAN)
SMFSSTLLSC

SEQ ID NO: 91478 - protein, 9 aa, Artificial Sequence
  Description of Artificial Sequence: Synthetic peptide
  Seed: SRYTGYFPV (MAGC1_HUMAN)
SVYTGYFPY

SEQ ID NO: 91479 - protein, 11 aa, Artificial Sequence
  Description of Artificial Sequence: Synthetic peptide
  Seed: RPVSSFFSYTL (MAGC1_HUMAN)
RMVSSFFSYTW

SEQ ID NO: 91480 - protein, 9 aa, Artificial Sequence
  Description of Artificial Sequence: Synthetic peptide
  Seed: SESLIESEP (MAGC1_HUMAN)
SESLIESEF

SEQ ID NO: 91481 - protein, 8 aa, Artificial Sequence
  Description of Artificial Sequence: Synthetic peptide
  Seed: SSVMSPSF (MAGC1_HUMAN)
SQVMSPSY

SEQ ID NO: 91482 - protein, 9 aa, Artificial Sequence
  Description of Artificial Sequence: Synthetic peptide
  Seed: SLFQSFSER (MAGC1_HUMAN)
SVFQSFSEF

SEQ ID NO: 91483 - protein, 9 aa, Artificial Sequence
  Description of Artificial Sequence: Synthetic peptide
  Seed: SAQSTFEGF (MAGC1_HUMAN)
STQSTFEGF

SEQ ID NO: 91484 - protein, 10 aa, Artificial Sequence
  Description of Artificial Sequence: Synthetic peptide
  Seed: ILFGISLREV (MAGC1_HUMAN)
ILFGISLREM

SEQ ID NO: 91485 - protein, 9 aa, Artificial Sequence
  Description of Artificial Sequence: Synthetic peptide
  Seed: EHFAFGEPR (MAGC1_HUMAN)
ETFAFGEPR

SEQ ID NO: 91486 - protein, 10 aa, Artificial Sequence
  Description of Artificial Sequence: Synthetic peptide
  Seed: MTSSFSSTLL (MAGC1_HUMAN)
MYSSFSSTLW

SEQ ID NO: 91487 - protein, 10 aa, Artificial Sequence
  Description of Artificial Sequence: Synthetic peptide
  Seed: SSSSTLLSLF (MAGC1_HUMAN)
SCSSTLLSLW

SEQ ID NO: 91488 - protein, 9 aa, Artificial Sequence
  Description of Artificial Sequence: Synthetic peptide
  Seed: AFGEPRELL (MAGC1_HUMAN)
ARGEPRELY

SEQ ID NO: 91489 - protein, 10 aa, Artificial Sequence
  Description of Artificial Sequence: Synthetic peptide
  Seed: LQNPASSFFS (MAGC1_HUMAN)
LQNPASSFFM

SEQ ID NO: 91490 - protein, 10 aa, Artificial Sequence
  Description of Artificial Sequence: Synthetic peptide
  Seed: FQSSLQSPVS (MAGC1_HUMAN)
FLSSLQSPVN

SEQ ID NO: 91491 - protein, 9 aa, Artificial Sequence
  Description of Artificial Sequence: Synthetic peptide
  Seed: AMLKNTVPI (MAGC1_HUMAN)
AQLKNTVPL

SEQ ID NO: 91492 - protein, 9 aa, Artificial Sequence
  Description of Artificial Sequence: Synthetic peptide
  Seed: SSSSTLLSL (MAGC1_HUMAN)
SYSSTLLSF

SEQ ID NO: 91493 - protein, 10 aa, Artificial Sequence
  Description of Artificial Sequence: Synthetic peptide
  Seed: SSPESAQSAF (MAGC1_HUMAN)
SLPESAQSAI

SEQ ID NO: 91494 - protein, 10 aa, Artificial Sequence
  Description of Artificial Sequence: Synthetic peptide
  Seed: SSSSTLLSLF (MAGC1_HUMAN)
SMSSTLLSLM

SEQ ID NO: 91495 - protein, 9 aa, Artificial Sequence
  Description of Artificial Sequence: Synthetic peptide
  Seed: YTGYFPVIF (MAGC1_HUMAN)
YFGYFPVIF

SEQ ID NO: 91496 - protein, 9 aa, Artificial Sequence
  Description of Artificial Sequence: Synthetic peptide
  Seed: DVLSGIGVR (MAGC1_HUMAN)
DMLSGIGVR

SEQ ID NO: 91497 - protein, 9 aa, Artificial Sequence
  Description of Artificial Sequence: Synthetic peptide
  Seed: KDSLSPLEI (MAGC1_HUMAN)
KQSLSPLEL

SEQ ID NO: 91498 - protein, 9 aa, Artificial Sequence
  Description of Artificial Sequence: Synthetic peptide
  Seed: EFIEILFGI (MAGC1_HUMAN)
ESIEILFGI

SEQ ID NO: 91499 - protein, 9 aa, Artificial Sequence
  Description of Artificial Sequence: Synthetic peptide
  Seed: SSSTLLSLF (MAGC1_HUMAN)
SKSTLLSLF

SEQ ID NO: 91500 - protein, 10 aa, Artificial Sequence
  Description of Artificial Sequence: Synthetic peptide
  Seed: REVDPDDSYV (MAGC1_HUMAN)
RQVDPDDSYV

SEQ ID NO: 91501 - protein, 9 aa, Artificial Sequence
  Description of Artificial Sequence: Synthetic peptide
  Seed: KVWVQEHYL (MAGC1_HUMAN)
KVWVQEHYF

SEQ ID NO: 91502 - protein, 9 aa, Artificial Sequence
  Description of Artificial Sequence: Synthetic peptide
  Seed: DSYVFVNTL (MAGC1_HUMAN)
DIYVFVNTF

SEQ ID NO: 91503 - protein, 9 aa, Artificial Sequence
  Description of Artificial Sequence: Synthetic peptide
  Seed: SLIESEPLF (MAGC1_HUMAN)
SLIESEPLM

SEQ ID NO: 91504 - protein, 9 aa, Artificial Sequence
  Description of Artificial Sequence: Synthetic peptide
  Seed: IPVSAASSS (MAGC1_HUMAN)
IPVSAASST

SEQ ID NO: 91505 - protein, 10 aa, Artificial Sequence
  Description of Artificial Sequence: Synthetic peptide
  Seed: GEDSLSSLHF (MAGC1_HUMAN)
GEDSLSSLHM

SEQ ID NO: 91506 - protein, 10 aa, Artificial Sequence
  Description of Artificial Sequence: Synthetic peptide
  Seed: RKVVEFLAML (MAGC1_HUMAN)
RRVVEFLAMM

SEQ ID NO: 91507 - protein, 9 aa, Artificial Sequence
  Description of Artificial Sequence: Synthetic peptide
  Seed: FAFGEPREL (MAGC1_HUMAN)
FCFGEPREY

SEQ ID NO: 91508 - protein, 11 aa, Artificial Sequence
  Description of Artificial Sequence: Synthetic peptide
  Seed: SPLQIPVSRSF (MAGC1_HUMAN)
SLLQIPVSRSF

SEQ ID NO: 91509 - protein, 11 aa, Artificial Sequence
  Description of Artificial Sequence: Synthetic peptide
  Seed: SPLQIPGSPSF (MAGC1_HUMAN)
SPLQIPGSPSC

SEQ ID NO: 91510 - protein, 9 aa, Artificial Sequence
  Description of Artificial Sequence: Synthetic peptide
  Seed: SSPERTHST (MAGC1_HUMAN)
SMPERTHSI

SEQ ID NO: 91511 - protein, 10 aa, Artificial Sequence
  Description of Artificial Sequence: Synthetic peptide
  Seed: PLQIPGSPSF (MAGC1_HUMAN)
PWQIPGSPSM

SEQ ID NO: 91512 - protein, 9 aa, Artificial Sequence
  Description of Artificial Sequence: Synthetic peptide
  Seed: VSSSSSSTL (MAGC1_HUMAN)
VISSSSSTF

SEQ ID NO: 91513 - protein, 9 aa, Artificial Sequence
  Description of Artificial Sequence: Synthetic peptide
  Seed: SSSVMSPSF (MAGC1_HUMAN)
STSVMSPSW

SEQ ID NO: 91514 - protein, 10 aa, Artificial Sequence
  Description of Artificial Sequence: Synthetic peptide
  Seed: SRYTGYFPVI (MAGC1_HUMAN)
SWYTGYFPVW

SEQ ID NO: 91515 - protein, 9 aa, Artificial Sequence
  Description of Artificial Sequence: Synthetic peptide
  Seed: STFEGFPQS (MAGC1_HUMAN)
SPFEGFPQG

SEQ ID NO: 91516 - protein, 9 aa, Artificial Sequence
  Description of Artificial Sequence: Synthetic peptide
  Seed: SSPESAQSA (MAGC1_HUMAN)
SGPESAQSL

SEQ ID NO: 91517 - protein, 9 aa, Artificial Sequence
  Description of Artificial Sequence: Synthetic peptide
  Seed: AQSSLQIPV (MAGC1_HUMAN)
ARSSLQIPY

SEQ ID NO: 91518 - protein, 10 aa, Artificial Sequence
  Description of Artificial Sequence: Synthetic peptide
  Seed: VISFSSSTSL (MAGC1_HUMAN)
VPSFSSSTSM

SEQ ID NO: 91519 - protein, 9 aa, Artificial Sequence
  Description of Artificial Sequence: Synthetic peptide
  Seed: SSPERTQST (MAGC1_HUMAN)
SSPERTQSY

SEQ ID NO: 91520 - protein, 10 aa, Artificial Sequence
  Description of Artificial Sequence: Synthetic peptide
  Seed: SSPESDDTLY (MAGC1_HUMAN)
SMPESDDTLY

SEQ ID NO: 91521 - protein, 9 aa, Artificial Sequence
  Description of Artificial Sequence: Synthetic peptide
  Seed: AGREHFAFG (MAGC1_HUMAN)
ATREHFAFT

SEQ ID NO: 91522 - protein, 9 aa, Artificial Sequence
  Description of Artificial Sequence: Synthetic peptide
  Seed: FSEESSSPV (MAGC1_HUMAN)
FGEESSSPF

SEQ ID NO: 91523 - protein, 10 aa, Artificial Sequence
  Description of Artificial Sequence: Synthetic peptide
  Seed: ATESASSSVM (MAGC1_HUMAN)
AWESASSSVL

SEQ ID NO: 91524 - protein, 9 aa, Artificial Sequence
  Description of Artificial Sequence: Synthetic peptide
  Seed: VISRYTGYF (MAGC1_HUMAN)
VASRYTGYY

SEQ ID NO: 91525 - protein, 9 aa, Artificial Sequence
  Description of Artificial Sequence: Synthetic peptide
  Seed: TLLSLFQSF (MAGC1_HUMAN)
TRLSLFQSM

SEQ ID NO: 91526 - protein, 9 aa, Artificial Sequence
  Description of Artificial Sequence: Synthetic peptide
  Seed: SFSSTLVSL (MAGC1_HUMAN)
SQSSTLVSY

SEQ ID NO: 91527 - protein, 10 aa, Artificial Sequence
  Description of Artificial Sequence: Synthetic peptide
  Seed: RAGREHFAFG (MAGC1_HUMAN)
RSGREHFAFF

SEQ ID NO: 91528 - protein, 9 aa, Artificial Sequence
  Description of Artificial Sequence: Synthetic peptide
  Seed: SSFFSSALL (MAGC1_HUMAN)
SSFFSSALM

SEQ ID NO: 91529 - protein, 9 aa, Artificial Sequence
  Description of Artificial Sequence: Synthetic peptide
  Seed: FSSTLLSLF (MAGC1_HUMAN)
FTSTLLSLI

SEQ ID NO: 91530 - protein, 11 aa, Artificial Sequence
  Description of Artificial Sequence: Synthetic peptide
  Seed: SLSQSSPVSSF (MAGC1_HUMAN)
SASQSSPVSSY

SEQ ID NO: 91531 - protein, 9 aa, Artificial Sequence
  Description of Artificial Sequence: Synthetic peptide
  Seed: SFPSSTSSS (MAGC1_HUMAN)
SFPSSTSSW

SEQ ID NO: 91532 - protein, 9 aa, Artificial Sequence
  Description of Artificial Sequence: Synthetic peptide
  Seed: SSSSSSTLL (MAGC1_HUMAN)
SPSSSSTLF

SEQ ID NO: 91533 - protein, 10 aa, Artificial Sequence
  Description of Artificial Sequence: Synthetic peptide
  Seed: FQSSLQSPVS (MAGC1_HUMAN)
FLSSLQSPVI

SEQ ID NO: 91534 - protein, 11 aa, Artificial Sequence
  Description of Artificial Sequence: Synthetic peptide
  Seed: IPVSSSFSYTL (MAGC1_HUMAN)
IAVSSSFSYTF

SEQ ID NO: 91535 - protein, 9 aa, Artificial Sequence
  Description of Artificial Sequence: Synthetic peptide
  Seed: DSYVFVNTL (MAGC1_HUMAN)
DVYVFVNTF

SEQ ID NO: 91536 - protein, 10 aa, Artificial Sequence
  Description of Artificial Sequence: Synthetic peptide
  Seed: SPLYFPQSPL (MAGC1_HUMAN)
SILYFPQSPV

SEQ ID NO: 91537 - protein, 9 aa, Artificial Sequence
  Description of Artificial Sequence: Synthetic peptide
  Seed: TLDLTSEGC (MAGC1_HUMAN)
TMDLTSEGF

SEQ ID NO: 91538 - protein, 10 aa, Artificial Sequence
  Description of Artificial Sequence: Synthetic peptide
  Seed: LQIPVSSSFS (MAGC1_HUMAN)
LQIPVSSSFW

SEQ ID NO: 91539 - protein, 11 aa, Artificial Sequence
  Description of Artificial Sequence: Synthetic peptide
  Seed: EGEDSSDPLQR (MAGC1_HUMAN)
EAEDSSDPLQR

SEQ ID NO: 91540 - protein, 11 aa, Artificial Sequence
  Description of Artificial Sequence: Synthetic peptide
  Seed: SSFFSYTLASL (MAGC1_HUMAN)
SAFFSYTLASY

SEQ ID NO: 91541 - protein, 11 aa, Artificial Sequence
  Description of Artificial Sequence: Synthetic peptide
  Seed: STFEGFAQSPL (MAGC1_HUMAN)
SVFEGFAQSPI

SEQ ID NO: 91542 - protein, 9 aa, Artificial Sequence
  Description of Artificial Sequence: Synthetic peptide
  Seed: ISFSSSTSL (MAGC1_HUMAN)
IEFSSSTSI

SEQ ID NO: 91543 - protein, 10 aa, Artificial Sequence
  Description of Artificial Sequence: Synthetic peptide
  Seed: TGYFPVIFRK (MAGC1_HUMAN)
TVYFPVIFRG

SEQ ID NO: 91544 - protein, 9 aa, Artificial Sequence
  Description of Artificial Sequence: Synthetic peptide
  Seed: LQIPGSPSF (MAGC1_HUMAN)
LPIPGSPSY

SEQ ID NO: 91545 - protein, 9 aa, Artificial Sequence
  Description of Artificial Sequence: Synthetic peptide
  Seed: GFPQSVLQI (MAGC1_HUMAN)
GYPQSVLQM

SEQ ID NO: 91546 - protein, 10 aa, Artificial Sequence
  Description of Artificial Sequence: Synthetic peptide
  Seed: YTLDEKVDEL (MAGC1_HUMAN)
YQLDEKVDEL

SEQ ID NO: 91547 - protein, 9 aa, Artificial Sequence
  Description of Artificial Sequence: Synthetic peptide
  Seed: LQIPGSPSF (MAGC1_HUMAN)
LAIPGSPSA

SEQ ID NO: 91548 - protein, 10 aa, Artificial Sequence
  Description of Artificial Sequence: Synthetic peptide
  Seed: YTLDEKVDEL (MAGC1_HUMAN)
YVLDEKVDEV

SEQ ID NO: 91549 - protein, 9 aa, Artificial Sequence
  Description of Artificial Sequence: Synthetic peptide
  Seed: VSRSFSSTL (MAGC1_HUMAN)
VYRSFSSTM

SEQ ID NO: 91550 - protein, 9 aa, Artificial Sequence
  Description of Artificial Sequence: Synthetic peptide
  Seed: SAQSAFEGF (MAGC1_HUMAN)
SPQSAFEGF

SEQ ID NO: 91551 - protein, 9 aa, Artificial Sequence
  Description of Artificial Sequence: Synthetic peptide
  Seed: LQIPVSSSS (MAGC1_HUMAN)
LGIPVSSSY

SEQ ID NO: 91552 - protein, 10 aa, Artificial Sequence
  Description of Artificial Sequence: Synthetic peptide
  Seed: YTLDEKVDEL (MAGC1_HUMAN)
YVLDEKVDEI

SEQ ID NO: 91553 - protein, 9 aa, Artificial Sequence
  Description of Artificial Sequence: Synthetic peptide
  Seed: SQSSPVSSF (MAGC1_HUMAN)
SSSSPVSSI

SEQ ID NO: 91554 - protein, 9 aa, Artificial Sequence
  Description of Artificial Sequence: Synthetic peptide
  Seed: SSSTLLSLF (MAGC1_HUMAN)
SSSTLLSLM

SEQ ID NO: 91555 - protein, 9 aa, Artificial Sequence
  Description of Artificial Sequence: Synthetic peptide
  Seed: AMLKNTVPI (MAGC1_HUMAN)
AALKNTVPR

SEQ ID NO: 91556 - protein, 9 aa, Artificial Sequence
  Description of Artificial Sequence: Synthetic peptide
  Seed: SPLQNPASS (MAGC1_HUMAN)
SPLQNPASI

SEQ ID NO: 91557 - protein, 11 aa, Artificial Sequence
  Description of Artificial Sequence: Synthetic peptide
  Seed: LLQIPMTSSFS (MAGC1_HUMAN)
LYQIPMTSSFY

SEQ ID NO: 91558 - protein, 9 aa, Artificial Sequence
  Description of Artificial Sequence: Synthetic peptide
  Seed: FSSALLSIF (MAGC1_HUMAN)
FASALLSIV

SEQ ID NO: 91559 - protein, 9 aa, Artificial Sequence
  Description of Artificial Sequence: Synthetic peptide
  Seed: GEDSLSPHY (MAGC1_HUMAN)
GMDSLSPHY

SEQ ID NO: 91560 - protein, 10 aa, Artificial Sequence
  Description of Artificial Sequence: Synthetic peptide
  Seed: PLQIPMTSSF (MAGC1_HUMAN)
PMQIPMTSSY

SEQ ID NO: 91561 - protein, 10 aa, Artificial Sequence
  Description of Artificial Sequence: Synthetic peptide
  Seed: SSFSSTLLSI (MAGC1_HUMAN)
SAFSSTLLSV

SEQ ID NO: 91562 - protein, 9 aa, Artificial Sequence
  Description of Artificial Sequence: Synthetic peptide
  Seed: SLSPFSEES (MAGC1_HUMAN)
SASPFSEEI

SEQ ID NO: 91563 - protein, 10 aa, Artificial Sequence
  Description of Artificial Sequence: Synthetic peptide
  Seed: YVFVNTLDLT (MAGC1_HUMAN)
YQFVNTLDLL

SEQ ID NO: 91564 - protein, 9 aa, Artificial Sequence
  Description of Artificial Sequence: Synthetic peptide
  Seed: FSERTQSTF (MAGC1_HUMAN)
FVERTQSTW

SEQ ID NO: 91565 - protein, 9 aa, Artificial Sequence
  Description of Artificial Sequence: Synthetic peptide
  Seed: IPVSSSFSY (MAGC1_HUMAN)
ITVSSSFSF

SEQ ID NO: 91566 - protein, 9 aa, Artificial Sequence
  Description of Artificial Sequence: Synthetic peptide
  Seed: SQNRLLILI (MAGC1_HUMAN)
SINRLLILV

SEQ ID NO: 91567 - protein, 9 aa, Artificial Sequence
  Description of Artificial Sequence: Synthetic peptide
  Seed: KVDELARFL (MAGC1_HUMAN)
KEDELARFF

SEQ ID NO: 91568 - protein, 9 aa, Artificial Sequence
  Description of Artificial Sequence: Synthetic peptide
  Seed: SSPESPLQS (MAGC1_HUMAN)
SAPESPLQF

SEQ ID NO: 91569 - protein, 8 aa, Artificial Sequence
  Description of Artificial Sequence: Synthetic peptide
  Seed: RSFSSTLL (MAGC1_HUMAN)
RSFSSTLY

SEQ ID NO: 91570 - protein, 11 aa, Artificial Sequence
  Description of Artificial Sequence: Synthetic peptide
  Seed: IPVSPSSSSTL (MAGC1_HUMAN)
IPVSPSSSSTI

SEQ ID NO: 91571 - protein, 9 aa, Artificial Sequence
  Description of Artificial Sequence: Synthetic peptide
  Seed: FFSYTLASL (MAGC1_HUMAN)
FFSYTLASM

SEQ ID NO: 91572 - protein, 10 aa, Artificial Sequence
  Description of Artificial Sequence: Synthetic peptide
  Seed: EILFGISLRE (MAGC1_HUMAN)
ECLFGISLRK

SEQ ID NO: 91573 - protein, 9 aa, Artificial Sequence
  Description of Artificial Sequence: Synthetic peptide
  Seed: ESSSPVDEY (MAGC1_HUMAN)
EMSSPVDEY

SEQ ID NO: 91574 - protein, 10 aa, Artificial Sequence
  Description of Artificial Sequence: Synthetic peptide
  Seed: FPQSVLQIPV (MAGC1_HUMAN)
FTQSVLQIPA

SEQ ID NO: 91575 - protein, 10 aa, Artificial Sequence
  Description of Artificial Sequence: Synthetic peptide
  Seed: LQIVPSLPEW (MAGC1_HUMAN)
LQIVPSLPEL

SEQ ID NO: 91576 - protein, 10 aa, Artificial Sequence
  Description of Artificial Sequence: Synthetic peptide
  Seed: ASSFFSSALL (MAGC1_HUMAN)
AMSFFSSALF

SEQ ID NO: 91577 - protein, 10 aa, Artificial Sequence
  Description of Artificial Sequence: Synthetic peptide
  Seed: MLKNTVPITF (MAGC1_HUMAN)
MVKNTVPITW

SEQ ID NO: 91578 - protein, 9 aa, Artificial Sequence
  Description of Artificial Sequence: Synthetic peptide
  Seed: TPSSLPQSF (MAGC1_HUMAN)
TVSSLPQSL

SEQ ID NO: 91579 - protein, 9 aa, Artificial Sequence
  Description of Artificial Sequence: Synthetic peptide
  Seed: KDSLSPLEI (MAGC1_HUMAN)
KLSLSPLEI

SEQ ID NO: 91580 - protein, 10 aa, Artificial Sequence
  Description of Artificial Sequence: Synthetic peptide
  Seed: QGEDSMSPLY (MAGC1_HUMAN)
QVEDSMSPLW

SEQ ID NO: 91581 - protein, 10 aa, Artificial Sequence
  Description of Artificial Sequence: Synthetic peptide
  Seed: REVPNSSPPR (MAGC1_HUMAN)
RTVPNSSPPR

SEQ ID NO: 91582 - protein, 9 aa, Artificial Sequence
  Description of Artificial Sequence: Synthetic peptide
  Seed: IPVSSSFSY (MAGC1_HUMAN)
IPVSSSFSA

SEQ ID NO: 91583 - protein, 9 aa, Artificial Sequence
  Description of Artificial Sequence: Synthetic peptide
  Seed: FPQSVLQIP (MAGC1_HUMAN)
FPQSVLQIF

SEQ ID NO: 91584 - protein, 9 aa, Artificial Sequence
  Description of Artificial Sequence: Synthetic peptide
  Seed: FSYTLASLL (MAGC1_HUMAN)
FAYTLASLL

SEQ ID NO: 91585 - protein, 10 aa, Artificial Sequence
  Description of Artificial Sequence: Synthetic peptide
  Seed: SMSPLYFPQS (MAGC1_HUMAN)
SLSPLYFPQL

SEQ ID NO: 91586 - protein, 9 aa, Artificial Sequence
  Description of Artificial Sequence: Synthetic peptide
  Seed: MTSSFSSTL (MAGC1_HUMAN)
MLSSFSSTA

SEQ ID NO: 91587 - protein, 9 aa, Artificial Sequence
  Description of Artificial Sequence: Synthetic peptide
  Seed: LQIPVSPSF (MAGC1_HUMAN)
LHIPVSPSF

SEQ ID NO: 91588 - protein, 9 aa, Artificial Sequence
  Description of Artificial Sequence: Synthetic peptide
  Seed: EFIEILFGI (MAGC1_HUMAN)
EMIEILFGV

SEQ ID NO: 91589 - protein, 10 aa, Artificial Sequence
  Description of Artificial Sequence: Synthetic peptide
  Seed: AEMLTNVISR (MAGC1_HUMAN)
AMMLTNVISR

SEQ ID NO: 91590 - protein, 9 aa, Artificial Sequence
  Description of Artificial Sequence: Synthetic peptide
  Seed: ISFSSSTSL (MAGC1_HUMAN)
ITFSSSTSY

SEQ ID NO: 91591 - protein, 9 aa, Artificial Sequence
  Description of Artificial Sequence: Synthetic peptide
  Seed: FFSSALLSI (MAGC1_HUMAN)
FSSSALLSY

SEQ ID NO: 91592 - protein, 10 aa, Artificial Sequence
  Description of Artificial Sequence: Synthetic peptide
  Seed: EGPAQSPLQR (MAGC1_HUMAN)
EVPAQSPLQK

SEQ ID NO: 91593 - protein, 10 aa, Artificial Sequence
  Description of Artificial Sequence: Synthetic peptide
  Seed: RSFSSTLLSI (MAGC1_HUMAN)
RQFSSTLLSK

SEQ ID NO: 91594 - protein, 9 aa, Artificial Sequence
  Description of Artificial Sequence: Synthetic peptide
  Seed: RKVVEFLAM (MAGC1_HUMAN)
RSVVEFLAF

SEQ ID NO: 91595 - protein, 10 aa, Artificial Sequence
  Description of Artificial Sequence: Synthetic peptide
  Seed: LQNPASSFFS (MAGC1_HUMAN)
LQNPASSFFY

SEQ ID NO: 91596 - protein, 9 aa, Artificial Sequence
  Description of Artificial Sequence: Synthetic peptide
  Seed: DSLTDSESL (MAGC1_HUMAN)
DALTDSESV

SEQ ID NO: 91597 - protein, 10 aa, Artificial Sequence
  Description of Artificial Sequence: Synthetic peptide
  Seed: LAMLKNTVPI (MAGC1_HUMAN)
LIMLKNTVPM

SEQ ID NO: 91598 - protein, 11 aa, Artificial Sequence
  Description of Artificial Sequence: Synthetic peptide
  Seed: SPPEGPAQSPL (MAGC1_HUMAN)
SPPEGPAQSPM

SEQ ID NO: 91599 - protein, 9 aa, Artificial Sequence
  Description of Artificial Sequence: Synthetic peptide
  Seed: LSPLHFPQF (MAGC1_HUMAN)
LMPLHFPQM

SEQ ID NO: 91600 - protein, 9 aa, Artificial Sequence
  Description of Artificial Sequence: Synthetic peptide
  Seed: LSPLHFPQF (MAGC1_HUMAN)
LTPLHFPQW

SEQ ID NO: 91601 - protein, 10 aa, Artificial Sequence
  Description of Artificial Sequence: Synthetic peptide
  Seed: SFPSSTSSSL (MAGC1_HUMAN)
SMPSSTSSSI

SEQ ID NO: 91602 - protein, 10 aa, Artificial Sequence
  Description of Artificial Sequence: Synthetic peptide
  Seed: TLDEKVDELA (MAGC1_HUMAN)
TSDEKVDELL

SEQ ID NO: 91603 - protein, 10 aa, Artificial Sequence
  Description of Artificial Sequence: Synthetic peptide
  Seed: KAEMLTNVIS (MAGC1_HUMAN)
KGEMLTNVIA

SEQ ID NO: 91604 - protein, 10 aa, Artificial Sequence
  Description of Artificial Sequence: Synthetic peptide
  Seed: LQIPMTSSFS (MAGC1_HUMAN)
LMIPMTSSFP

SEQ ID NO: 91605 - protein, 9 aa, Artificial Sequence
  Description of Artificial Sequence: Synthetic peptide
  Seed: ASSSTLVSI (MAGC1_HUMAN)
ALSSTLVSF

SEQ ID NO: 91606 - protein, 9 aa, Artificial Sequence
  Description of Artificial Sequence: Synthetic peptide
  Seed: SIIFIKGTY (MAGC1_HUMAN)
SKIFIKGTF

SEQ ID NO: 91607 - protein, 10 aa, Artificial Sequence
  Description of Artificial Sequence: Synthetic peptide
  Seed: RSFSSTLLSI (MAGC1_HUMAN)
RMFSSTLLSH

SEQ ID NO: 91608 - protein, 10 aa, Artificial Sequence
  Description of Artificial Sequence: Synthetic peptide
  Seed: KVVEFLAMLK (MAGC1_HUMAN)
KWVEFLAMLR

SEQ ID NO: 91609 - protein, 10 aa, Artificial Sequence
  Description of Artificial Sequence: Synthetic peptide
  Seed: YTGYFPVIFR (MAGC1_HUMAN)
YWGYFPVIFR

SEQ ID NO: 91610 - protein, 8 aa, Artificial Sequence
  Description of Artificial Sequence: Synthetic peptide
  Seed: SEVIKRKV (MAGC1_HUMAN)
SQVIKRKI

SEQ ID NO: 91611 - protein, 10 aa, Artificial Sequence
  Description of Artificial Sequence: Synthetic peptide
  Seed: KRKVVEFLAM (MAGC1_HUMAN)
KWKVVEFLAY

SEQ ID NO: 91612 - protein, 11 aa, Artificial Sequence
  Description of Artificial Sequence: Synthetic peptide
  Seed: FLAMLKNTVPI (MAGC1_HUMAN)
FGAMLKNTVPV

SEQ ID NO: 91613 - protein, 9 aa, Artificial Sequence
  Description of Artificial Sequence: Synthetic peptide
  Seed: VISRYTGYF (MAGC1_HUMAN)
VQSRYTGYF

SEQ ID NO: 91614 - protein, 9 aa, Artificial Sequence
  Description of Artificial Sequence: Synthetic peptide
  Seed: RTQSTFEGF (MAGC1_HUMAN)
RLQSTFEGI

SEQ ID NO: 91615 - protein, 10 aa, Artificial Sequence
  Description of Artificial Sequence: Synthetic peptide
  Seed: ASSFFSSALL (MAGC1_HUMAN)
AMSFFSSALY

SEQ ID NO: 91616 - protein, 9 aa, Artificial Sequence
  Description of Artificial Sequence: Synthetic peptide
  Seed: TFEGFPQSL (MAGC1_HUMAN)
TAEGFPQSI

SEQ ID NO: 91617 - protein, 9 aa, Artificial Sequence
  Description of Artificial Sequence: Synthetic peptide
  Seed: SLIESEPLF (MAGC1_HUMAN)
SMIESEPLA

SEQ ID NO: 91618 - protein, 10 aa, Artificial Sequence
  Description of Artificial Sequence: Synthetic peptide
  Seed: LLQIPMTSSF (MAGC1_HUMAN)
LWQIPMTSSY

SEQ ID NO: 91619 - protein, 9 aa, Artificial Sequence
  Description of Artificial Sequence: Synthetic peptide
  Seed: LQSPVISFS (MAGC1_HUMAN)
LTSPVISFL

SEQ ID NO: 91620 - protein, 11 aa, Artificial Sequence
  Description of Artificial Sequence: Synthetic peptide
  Seed: RSFSSTLLSIF (MAGC1_HUMAN)
RQFSSTLLSIM

SEQ ID NO: 91621 - protein, 9 aa, Artificial Sequence
  Description of Artificial Sequence: Synthetic peptide
  Seed: LSDEQGMSQ (MAGC1_HUMAN)
LIDEQGMSY

SEQ ID NO: 91622 - protein, 9 aa, Artificial Sequence
  Description of Artificial Sequence: Synthetic peptide
  Seed: SSPECTQST (MAGC1_HUMAN)
SYPECTQSM

SEQ ID NO: 91623 - protein, 9 aa, Artificial Sequence
  Description of Artificial Sequence: Synthetic peptide
  Seed: ALLSIFQSS (MAGC1_HUMAN)
AVLSIFQSM

SEQ ID NO: 91624 - protein, 9 aa, Artificial Sequence
  Description of Artificial Sequence: Synthetic peptide
  Seed: SLIESEPLF (MAGC1_HUMAN)
SPIESEPLY

SEQ ID NO: 91625 - protein, 9 aa, Artificial Sequence
  Description of Artificial Sequence: Synthetic peptide
  Seed: FSEESSSPV (MAGC1_HUMAN)
FMEESSSPV

SEQ ID NO: 91626 - protein, 10 aa, Artificial Sequence
  Description of Artificial Sequence: Synthetic peptide
  Seed: SPLYFPQSPL (MAGC1_HUMAN)
SPLYFPQSPV

SEQ ID NO: 91627 - protein, 10 aa, Artificial Sequence
  Description of Artificial Sequence: Synthetic peptide
  Seed: TGYFPVIFRK (MAGC1_HUMAN)
TSYFPVIFRR

SEQ ID NO: 91628 - protein, 9 aa, Artificial Sequence
  Description of Artificial Sequence: Synthetic peptide
  Seed: NTHSPLQIV (MAGC1_HUMAN)
NTHSPLQIL

SEQ ID NO: 91629 - protein, 9 aa, Artificial Sequence
  Description of Artificial Sequence: Synthetic peptide
  Seed: SSPECTQST (MAGC1_HUMAN)
SSPECTQSM

SEQ ID NO: 91630 - protein, 10 aa, Artificial Sequence
  Description of Artificial Sequence: Synthetic peptide
  Seed: SPVISFSSST (MAGC1_HUMAN)
SPVISFSSSL

SEQ ID NO: 91631 - protein, 10 aa, Artificial Sequence
  Description of Artificial Sequence: Synthetic peptide
  Seed: LQIPGSPSFS (MAGC1_HUMAN)
LKIPGSPSFF

SEQ ID NO: 91632 - protein, 9 aa, Artificial Sequence
  Description of Artificial Sequence: Synthetic peptide
  Seed: REVDPDDSY (MAGC1_HUMAN)
RYVDPDDSF

SEQ ID NO: 91633 - protein, 11 aa, Artificial Sequence
  Description of Artificial Sequence: Synthetic peptide
  Seed: SPLQRPVSSFF (MAGC1_HUMAN)
SYLQRPVSSFF

SEQ ID NO: 91634 - protein, 11 aa, Artificial Sequence
  Description of Artificial Sequence: Synthetic peptide
  Seed: SLIESEPLFTY (MAGC1_HUMAN)
SEIESEPLFTW

SEQ ID NO: 91635 - protein, 10 aa, Artificial Sequence
  Description of Artificial Sequence: Synthetic peptide
  Seed: PLQIPGSPSF (MAGC1_HUMAN)
PKQIPGSPSY

SEQ ID NO: 91636 - protein, 10 aa, Artificial Sequence
  Description of Artificial Sequence: Synthetic peptide
  Seed: EILFGISLRE (MAGC1_HUMAN)
EFLFGISLRK

SEQ ID NO: 91637 - protein, 10 aa, Artificial Sequence
  Description of Artificial Sequence: Synthetic peptide
  Seed: TTDDSTATES (MAGC1_HUMAN)
TCDDSTATEF

SEQ ID NO: 91638 - protein, 9 aa, Artificial Sequence
  Description of Artificial Sequence: Synthetic peptide
  Seed: DALKDVEER (MAGC1_HUMAN)
DMLKDVEER

SEQ ID NO: 91639 - protein, 11 aa, Artificial Sequence
  Description of Artificial Sequence: Synthetic peptide
  Seed: SPLQGEEFQSS (MAGC1_HUMAN)
SPLQGEEFQSA

SEQ ID NO: 91640 - protein, 9 aa, Artificial Sequence
  Description of Artificial Sequence: Synthetic peptide
  Seed: LKYQVKQPI (MAGC1_HUMAN)
LMYQVKQPI

SEQ ID NO: 91641 - protein, 9 aa, Artificial Sequence
  Description of Artificial Sequence: Synthetic peptide
  Seed: MLTNVISRY (MAGC1_HUMAN)
MITNVISRK

SEQ ID NO: 91642 - protein, 10 aa, Artificial Sequence
  Description of Artificial Sequence: Synthetic peptide
  Seed: VSRSFSSTLL (MAGC1_HUMAN)
VMRSFSSTLW

SEQ ID NO: 91643 - protein, 9 aa, Artificial Sequence
  Description of Artificial Sequence: Synthetic peptide
  Seed: KVVEFLAML (MAGC1_HUMAN)
KLVEFLAMA

SEQ ID NO: 91644 - protein, 11 aa, Artificial Sequence
  Description of Artificial Sequence: Synthetic peptide
  Seed: SPLQIPMTSSF (MAGC1_HUMAN)
SWLQIPMTSSF

SEQ ID NO: 91645 - protein, 9 aa, Artificial Sequence
  Description of Artificial Sequence: Synthetic peptide
  Seed: SSSTSLSPF (MAGC1_HUMAN)
SQSTSLSPL

SEQ ID NO: 91646 - protein, 9 aa, Artificial Sequence
  Description of Artificial Sequence: Synthetic peptide
  Seed: SSPPRYEFL (MAGC1_HUMAN)
STPPRYEFI

SEQ ID NO: 91647 - protein, 9 aa, Artificial Sequence
  Description of Artificial Sequence: Synthetic peptide
  Seed: VSPSSSSTL (MAGC1_HUMAN)
VMPSSSSTI

SEQ ID NO: 91648 - protein, 9 aa, Artificial Sequence
  Description of Artificial Sequence: Synthetic peptide
  Seed: NVISRYTGY (MAGC1_HUMAN)
NSISRYTGY

SEQ ID NO: 91649 - protein, 9 aa, Artificial Sequence
  Description of Artificial Sequence: Synthetic peptide
  Seed: FSSTLVSLF (MAGC1_HUMAN)
FFSTLVSLL

SEQ ID NO: 91650 - protein, 9 aa, Artificial Sequence
  Description of Artificial Sequence: Synthetic peptide
  Seed: VSPSSSSTL (MAGC1_HUMAN)
VTPSSSSTW

SEQ ID NO: 91651 - protein, 11 aa, Artificial Sequence
  Description of Artificial Sequence: Synthetic peptide
  Seed: SPLQIPGSPSF (MAGC1_HUMAN)
SRLQIPGSPSM

SEQ ID NO: 91652 - protein, 11 aa, Artificial Sequence
  Description of Artificial Sequence: Synthetic peptide
  Seed: IPVSSSFSYTL (MAGC1_HUMAN)
IQVSSSFSYTY

SEQ ID NO: 91653 - protein, 9 aa, Artificial Sequence
  Description of Artificial Sequence: Synthetic peptide
  Seed: SIIFIKGTY (MAGC1_HUMAN)
SRIFIKGTY

SEQ ID NO: 91654 - protein, 9 aa, Artificial Sequence
  Description of Artificial Sequence: Synthetic peptide
  Seed: VSPSFSSTL (MAGC1_HUMAN)
VRPSFSSTY

SEQ ID NO: 91655 - protein, 9 aa, Artificial Sequence
  Description of Artificial Sequence: Synthetic peptide
  Seed: FSYTLLSLF (MAGC1_HUMAN)
FFYTLLSLM

SEQ ID NO: 91656 - protein, 10 aa, Artificial Sequence
  Description of Artificial Sequence: Synthetic peptide
  Seed: VSLFQSSPER (MAGC1_HUMAN)
VYLFQSSPER

SEQ ID NO: 91657 - protein, 9 aa, Artificial Sequence
  Description of Artificial Sequence: Synthetic peptide
  Seed: LQIPVSAAS (MAGC1_HUMAN)
LRIPVSAAF

SEQ ID NO: 91658 - protein, 11 aa, Artificial Sequence
  Description of Artificial Sequence: Synthetic peptide
  Seed: LQRPVSSFFSY (MAGC1_HUMAN)
LKRPVSSFFSY

SEQ ID NO: 91659 - protein, 10 aa, Artificial Sequence
  Description of Artificial Sequence: Synthetic peptide
  Seed: FLAMLKNTVP (MAGC1_HUMAN)
FVAMLKNTVV

SEQ ID NO: 91660 - protein, 9 aa, Artificial Sequence
  Description of Artificial Sequence: Synthetic peptide
  Seed: IPVSSSFSY (MAGC1_HUMAN)
IKVSSSFSM

SEQ ID NO: 91661 - protein, 9 aa, Artificial Sequence
  Description of Artificial Sequence: Synthetic peptide
  Seed: SSPESPLQS (MAGC1_HUMAN)
STPESPLQF

SEQ ID NO: 91662 - protein, 9 aa, Artificial Sequence
  Description of Artificial Sequence: Synthetic peptide
  Seed: VSPSFSSTL (MAGC1_HUMAN)
VVPSFSSTI

SEQ ID NO: 91663 - protein, 9 aa, Artificial Sequence
  Description of Artificial Sequence: Synthetic peptide
  Seed: SPERTHSTF (MAGC1_HUMAN)
SHERTHSTY

SEQ ID NO: 91664 - protein, 10 aa, Artificial Sequence
  Description of Artificial Sequence: Synthetic peptide
  Seed: ESAQSAFEGF (MAGC1_HUMAN)
EVAQSAFEGY

SEQ ID NO: 91665 - protein, 9 aa, Artificial Sequence
  Description of Artificial Sequence: Synthetic peptide
  Seed: LQNPASSFF (MAGC1_HUMAN)
LANPASSFI

SEQ ID NO: 91666 - protein, 9 aa, Artificial Sequence
  Description of Artificial Sequence: Synthetic peptide
  Seed: LQRPVSSFF (MAGC1_HUMAN)
LARPVSSFI

SEQ ID NO: 91667 - protein, 9 aa, Artificial Sequence
  Description of Artificial Sequence: Synthetic peptide
  Seed: NTVPITFPS (MAGC1_HUMAN)
NIVPITFPA

SEQ ID NO: 91668 - protein, 11 aa, Artificial Sequence
  Description of Artificial Sequence: Synthetic peptide
  Seed: LQIPVSSSFSY (MAGC1_HUMAN)
LTIPVSSSFSM

SEQ ID NO: 91669 - protein, 9 aa, Artificial Sequence
  Description of Artificial Sequence: Synthetic peptide
  Seed: IIDTTDDST (MAGC1_HUMAN)
ITDTTDDSI

SEQ ID NO: 91670 - protein, 11 aa, Artificial Sequence
  Description of Artificial Sequence: Synthetic peptide
  Seed: EILFGISLREV (MAGC1_HUMAN)
EFLFGISLREI

SEQ ID NO: 91671 - protein, 10 aa, Artificial Sequence
  Description of Artificial Sequence: Synthetic peptide
  Seed: VSPSFSSTLV (MAGC1_HUMAN)
VMPSFSSTLV

SEQ ID NO: 91672 - protein, 9 aa, Artificial Sequence
  Description of Artificial Sequence: Synthetic peptide
  Seed: TFEGFPQSL (MAGC1_HUMAN)
TREGFPQSF

SEQ ID NO: 91673 - protein, 10 aa, Artificial Sequence
  Description of Artificial Sequence: Synthetic peptide
  Seed: FPQSPLQIPV (MAGC1_HUMAN)
FKQSPLQIPL

SEQ ID NO: 91674 - protein, 10 aa, Artificial Sequence
  Description of Artificial Sequence: Synthetic peptide
  Seed: SIIFIKGTYA (MAGC1_HUMAN)
SQIFIKGTYV

SEQ ID NO: 91675 - protein, 10 aa, Artificial Sequence
  Description of Artificial Sequence: Synthetic peptide
  Seed: LSQSSPVSSF (MAGC1_HUMAN)
LKQSSPVSSF

SEQ ID NO: 91676 - protein, 11 aa, Artificial Sequence
  Description of Artificial Sequence: Synthetic peptide
  Seed: MSPLYFPQSPL (MAGC1_HUMAN)
MPPLYFPQSPF

SEQ ID NO: 91677 - protein, 9 aa, Artificial Sequence
  Description of Artificial Sequence: Synthetic peptide
  Seed: AQSPLQRPV (MAGC1_HUMAN)
AVSPLQRPY

SEQ ID NO: 91678 - protein, 10 aa, Artificial Sequence
  Description of Artificial Sequence: Synthetic peptide
  Seed: SPLQIPGSPS (MAGC1_HUMAN)
SPLQIPGSPL

SEQ ID NO: 91679 - protein, 10 aa, Artificial Sequence
  Description of Artificial Sequence: Synthetic peptide
  Seed: SSPERTHSTF (MAGC1_HUMAN)
SMPERTHSTF

SEQ ID NO: 91680 - protein, 9 aa, Artificial Sequence
  Description of Artificial Sequence: Synthetic peptide
  Seed: TLASLLQSS (MAGC1_HUMAN)
TIASLLQSM

SEQ ID NO: 91681 - protein, 9 aa, Artificial Sequence
  Description of Artificial Sequence: Synthetic peptide
  Seed: EFIEILFGI (MAGC1_HUMAN)
ETIEILFGS

SEQ ID NO: 91682 - protein, 9 aa, Artificial Sequence
  Description of Artificial Sequence: Synthetic peptide
  Seed: VSAASSSTL (MAGC1_HUMAN)
VVAASSSTI

SEQ ID NO: 91683 - protein, 11 aa, Artificial Sequence
  Description of Artificial Sequence: Synthetic peptide
  Seed: QSSPESAQSTF (MAGC1_HUMAN)
QTSPESAQSTW

SEQ ID NO: 91684 - protein, 10 aa, Artificial Sequence
  Description of Artificial Sequence: Synthetic peptide
  Seed: STLLSLFQSF (MAGC1_HUMAN)
SNLLSLFQSF

SEQ ID NO: 91685 - protein, 9 aa, Artificial Sequence
  Description of Artificial Sequence: Synthetic peptide
  Seed: FPSSTSSSL (MAGC1_HUMAN)
FASSTSSSW

SEQ ID NO: 91686 - protein, 9 aa, Artificial Sequence
  Description of Artificial Sequence: Synthetic peptide
  Seed: AQSPLQRPV (MAGC1_HUMAN)
AISPLQRPF

SEQ ID NO: 91687 - protein, 11 aa, Artificial Sequence
  Description of Artificial Sequence: Synthetic peptide
  Seed: SSFPSSTSSSL (MAGC1_HUMAN)
SMFPSSTSSSV

SEQ ID NO: 91688 - protein, 11 aa, Artificial Sequence
  Description of Artificial Sequence: Synthetic peptide
  Seed: IPVSRSFSSTL (MAGC1_HUMAN)
IVVSRSFSSTY

SEQ ID NO: 91689 - protein, 11 aa, Artificial Sequence
  Description of Artificial Sequence: Synthetic peptide
  Seed: SLIESEPLFTY (MAGC1_HUMAN)
SMIESEPLFTW

SEQ ID NO: 91690 - protein, 9 aa, Artificial Sequence
  Description of Artificial Sequence: Synthetic peptide
  Seed: SSHESPQSP (MAGC1_HUMAN)
STHESPQSF

SEQ ID NO: 91691 - protein, 10 aa, Artificial Sequence
  Description of Artificial Sequence: Synthetic peptide
  Seed: REHFAFGEPR (MAGC1_HUMAN)
RAHFAFGEPR

SEQ ID NO: 91692 - protein, 9 aa, Artificial Sequence
  Description of Artificial Sequence: Synthetic peptide
  Seed: TLLSLFQSF (MAGC1_HUMAN)
TALSLFQSF

SEQ ID NO: 91693 - protein, 10 aa, Artificial Sequence
  Description of Artificial Sequence: Synthetic peptide
  Seed: LAMLKNTVPI (MAGC1_HUMAN)
LAMLKNTVPF

SEQ ID NO: 91694 - protein, 10 aa, Artificial Sequence
  Description of Artificial Sequence: Synthetic peptide
  Seed: FAQSSLQIPV (MAGC1_HUMAN)
FSQSSLQIPF

SEQ ID NO: 91695 - protein, 9 aa, Artificial Sequence
  Description of Artificial Sequence: Synthetic peptide
  Seed: MTSSFSSTL (MAGC1_HUMAN)
MLSSFSSTM

SEQ ID NO: 91696 - protein, 11 aa, Artificial Sequence
  Description of Artificial Sequence: Synthetic peptide
  Seed: RSFSSTLLSIF (MAGC1_HUMAN)
RSFSSTLLSIM

SEQ ID NO: 91697 - protein, 9 aa, Artificial Sequence
  Description of Artificial Sequence: Synthetic peptide
  Seed: VIWDVLSGI (MAGC1_HUMAN)
VTWDVLSGK

SEQ ID NO: 91698 - protein, 9 aa, Artificial Sequence
  Description of Artificial Sequence: Synthetic peptide
  Seed: VIKRKVVEF (MAGC1_HUMAN)
VLKRKVVEF

SEQ ID NO: 91699 - protein, 10 aa, Artificial Sequence
  Description of Artificial Sequence: Synthetic peptide
  Seed: SFPSSTSSSL (MAGC1_HUMAN)
SSPSSTSSSF

SEQ ID NO: 91700 - protein, 10 aa, Artificial Sequence
  Description of Artificial Sequence: Synthetic peptide
  Seed: VSSSSSSSTL (MAGC1_HUMAN)
VASSSSSSTL

SEQ ID NO: 91701 - protein, 11 aa, Artificial Sequence
  Description of Artificial Sequence: Synthetic peptide
  Seed: QSFSERTQSTF (MAGC1_HUMAN)
QTFSERTQSTW

SEQ ID NO: 91702 - protein, 11 aa, Artificial Sequence
  Description of Artificial Sequence: Synthetic peptide
  Seed: RPVSSFFSYTL (MAGC1_HUMAN)
RSVSSFFSYTF

SEQ ID NO: 91703 - protein, 10 aa, Artificial Sequence
  Description of Artificial Sequence: Synthetic peptide
  Seed: ASSSTLVSIF (MAGC1_HUMAN)
AKSSTLVSIW

SEQ ID NO: 91704 - protein, 10 aa, Artificial Sequence
  Description of Artificial Sequence: Synthetic peptide
  Seed: RYTGYFPVIF (MAGC1_HUMAN)
RVTGYFPVIW

SEQ ID NO: 91705 - protein, 11 aa, Artificial Sequence
  Description of Artificial Sequence: Synthetic peptide
  Seed: SLIESEPLFTY (MAGC1_HUMAN)
SYIESEPLFTY

SEQ ID NO: 91706 - protein, 9 aa, Artificial Sequence
  Description of Artificial Sequence: Synthetic peptide
  Seed: SSFFSYTLA (MAGC1_HUMAN)
SAFFSYTLK

SEQ ID NO: 91707 - protein, 9 aa, Artificial Sequence
  Description of Artificial Sequence: Synthetic peptide
  Seed: SSSVMSPSF (MAGC1_HUMAN)
SKSVMSPSM

SEQ ID NO: 91708 - protein, 10 aa, Artificial Sequence
  Description of Artificial Sequence: Synthetic peptide
  Seed: YTLASLLQSS (MAGC1_HUMAN)
YKLASLLQSM

SEQ ID NO: 91709 - protein, 10 aa, Artificial Sequence
  Description of Artificial Sequence: Synthetic peptide
  Seed: YTLLSLFQSS (MAGC1_HUMAN)
YYLLSLFQSV

SEQ ID NO: 91710 - protein, 9 aa, Artificial Sequence
  Description of Artificial Sequence: Synthetic peptide
  Seed: LQRPVSSFF (MAGC1_HUMAN)
LARPVSSFH

SEQ ID NO: 91711 - protein, 10 aa, Artificial Sequence
  Description of Artificial Sequence: Synthetic peptide
  Seed: MTSSFSSTLL (MAGC1_HUMAN)
MVSSFSSTLY

SEQ ID NO: 91712 - protein, 10 aa, Artificial Sequence
  Description of Artificial Sequence: Synthetic peptide
  Seed: SFSYTLLSLF (MAGC1_HUMAN)
SFSYTLLSLY

SEQ ID NO: 91713 - protein, 10 aa, Artificial Sequence
  Description of Artificial Sequence: Synthetic peptide
  Seed: KRKVVEFLAM (MAGC1_HUMAN)
KHKVVEFLAF

SEQ ID NO: 91714 - protein, 9 aa, Artificial Sequence
  Description of Artificial Sequence: Synthetic peptide
  Seed: SSPERTQST (MAGC1_HUMAN)
SAPERTQSA

SEQ ID NO: 91715 - protein, 10 aa, Artificial Sequence
  Description of Artificial Sequence: Synthetic peptide
  Seed: SSPESAQSAF (MAGC1_HUMAN)
SRPESAQSAF

SEQ ID NO: 91716 - protein, 9 aa, Artificial Sequence
  Description of Artificial Sequence: Synthetic peptide
  Seed: TTDDSTATE (MAGC1_HUMAN)
TYDDSTATI

SEQ ID NO: 91717 - protein, 9 aa, Artificial Sequence
  Description of Artificial Sequence: Synthetic peptide
  Seed: FSSTLLSLF (MAGC1_HUMAN)
FWSTLLSLL

SEQ ID NO: 91718 - protein, 11 aa, Artificial Sequence
  Description of Artificial Sequence: Synthetic peptide
  Seed: IPMTSSFSSTL (MAGC1_HUMAN)
IMMTSSFSSTW

SEQ ID NO: 91719 - protein, 8 aa, Artificial Sequence
  Description of Artificial Sequence: Synthetic peptide
  Seed: KVDELARF (MAGC1_HUMAN)
KVDELARL

SEQ ID NO: 91720 - protein, 10 aa, Artificial Sequence
  Description of Artificial Sequence: Synthetic peptide
  Seed: VKQPITKAEM (MAGC1_HUMAN)
VQQPITKAEY

SEQ ID NO: 91721 - protein, 9 aa, Artificial Sequence
  Description of Artificial Sequence: Synthetic peptide
  Seed: AQSPLQIPV (MAGC1_HUMAN)
AESPLQIPI

SEQ ID NO: 91722 - protein, 9 aa, Artificial Sequence
  Description of Artificial Sequence: Synthetic peptide
  Seed: VLSGIGVRA (MAGC1_HUMAN)
VVSGIGVRA

SEQ ID NO: 91723 - protein, 9 aa, Artificial Sequence
  Description of Artificial Sequence: Synthetic peptide
  Seed: KDSLSPLEI (MAGC1_HUMAN)
KDSLSPLEM

SEQ ID NO: 91724 - protein, 9 aa, Artificial Sequence
  Description of Artificial Sequence: Synthetic peptide
  Seed: SLPEWEDSL (MAGC1_HUMAN)
SFPEWEDSL

SEQ ID NO: 91725 - protein, 9 aa, Artificial Sequence
  Description of Artificial Sequence: Synthetic peptide
  Seed: SVLQIPVSA (MAGC1_HUMAN)
SVLQIPVSF

SEQ ID NO: 91726 - protein, 10 aa, Artificial Sequence
  Description of Artificial Sequence: Synthetic peptide
  Seed: ISRYTGYFPV (MAGC1_HUMAN)
IQRYTGYFPI

SEQ ID NO: 91727 - protein, 10 aa, Artificial Sequence
  Description of Artificial Sequence: Synthetic peptide
  Seed: YTLLSLFQSS (MAGC1_HUMAN)
YELLSLFQSL

SEQ ID NO: 91728 - protein, 9 aa, Artificial Sequence
  Description of Artificial Sequence: Synthetic peptide
  Seed: STFEGFPQS (MAGC1_HUMAN)
SPFEGFPQA

SEQ ID NO: 91729 - protein, 10 aa, Artificial Sequence
  Description of Artificial Sequence: Synthetic peptide
  Seed: IPGSPSFSST (MAGC1_HUMAN)
IPGSPSFSSL

SEQ ID NO: 91730 - protein, 9 aa, Artificial Sequence
  Description of Artificial Sequence: Synthetic peptide
  Seed: VSRSFSSTL (MAGC1_HUMAN)
VMRSFSSTV

SEQ ID NO: 91731 - protein, 9 aa, Artificial Sequence
  Description of Artificial Sequence: Synthetic peptide
  Seed: SSPECTQST (MAGC1_HUMAN)
SCPECTQSL

SEQ ID NO: 91732 - protein, 8 aa, Artificial Sequence
  Description of Artificial Sequence: Synthetic peptide
  Seed: FSSTLLSL (MAGC1_HUMAN)
FASTLLSM

SEQ ID NO: 91733 - protein, 9 aa, Artificial Sequence
  Description of Artificial Sequence: Synthetic peptide
  Seed: TLLSLFQSF (MAGC1_HUMAN)
TVLSLFQSR

SEQ ID NO: 91734 - protein, 9 aa, Artificial Sequence
  Description of Artificial Sequence: Synthetic peptide
  Seed: ISFSSSTSL (MAGC1_HUMAN)
IFFSSSTSL

SEQ ID NO: 91735 - protein, 9 aa, Artificial Sequence
  Description of Artificial Sequence: Synthetic peptide
  Seed: TLLSLFQSF (MAGC1_HUMAN)
TYLSLFQSF

SEQ ID NO: 91736 - protein, 9 aa, Artificial Sequence
  Description of Artificial Sequence: Synthetic peptide
  Seed: RAGREHFAF (MAGC1_HUMAN)
RYGREHFAF

SEQ ID NO: 91737 - protein, 9 aa, Artificial Sequence
  Description of Artificial Sequence: Synthetic peptide
  Seed: GSPSFSSTL (MAGC1_HUMAN)
GAPSFSSTI

SEQ ID NO: 91738 - protein, 10 aa, Artificial Sequence
  Description of Artificial Sequence: Synthetic peptide
  Seed: ATESASSSVM (MAGC1_HUMAN)
AAESASSSVL

SEQ ID NO: 91739 - protein, 11 aa, Artificial Sequence
  Description of Artificial Sequence: Synthetic peptide
  Seed: FLAMLKNTVPI (MAGC1_HUMAN)
FWAMLKNTVPI

SEQ ID NO: 91740 - protein, 9 aa, Artificial Sequence
  Description of Artificial Sequence: Synthetic peptide
  Seed: RELLTKVWV (MAGC1_HUMAN)
RELLTKVWL

SEQ ID NO: 91741 - protein, 10 aa, Artificial Sequence
  Description of Artificial Sequence: Synthetic peptide
  Seed: VSICSSSTSL (MAGC1_HUMAN)
VAICSSSTSW

SEQ ID NO: 91742 - protein, 9 aa, Artificial Sequence
  Description of Artificial Sequence: Synthetic peptide
  Seed: SASSSVMSP (MAGC1_HUMAN)
SASSSVMSF

SEQ ID NO: 91743 - protein, 9 aa, Artificial Sequence
  Description of Artificial Sequence: Synthetic peptide
  Seed: KDSQSPLQI (MAGC1_HUMAN)
KQSQSPLQF

SEQ ID NO: 91744 - protein, 10 aa, Artificial Sequence
  Description of Artificial Sequence: Synthetic peptide
  Seed: SLSPLHFPQF (MAGC1_HUMAN)
SFSPLHFPQW

SEQ ID NO: 91745 - protein, 10 aa, Artificial Sequence
  Description of Artificial Sequence: Synthetic peptide
  Seed: QIPVSSSFSY (MAGC1_HUMAN)
QFPVSSSFSM

SEQ ID NO: 91746 - protein, 9 aa, Artificial Sequence
  Description of Artificial Sequence: Synthetic peptide
  Seed: SPLQRPVSS (MAGC1_HUMAN)
SALQRPVSI

SEQ ID NO: 91747 - protein, 9 aa, Artificial Sequence
  Description of Artificial Sequence: Synthetic peptide
  Seed: RKVVEFLAM (MAGC1_HUMAN)
RVVVEFLAY

SEQ ID NO: 91748 - protein, 9 aa, Artificial Sequence
  Description of Artificial Sequence: Synthetic peptide
  Seed: TPSSLPQSF (MAGC1_HUMAN)
TKSSLPQSF

SEQ ID NO: 91749 - protein, 9 aa, Artificial Sequence
  Description of Artificial Sequence: Synthetic peptide
  Seed: SFSSTLVSL (MAGC1_HUMAN)
SISSTLVSI

SEQ ID NO: 91750 - protein, 11 aa, Artificial Sequence
  Description of Artificial Sequence: Synthetic peptide
  Seed: RSFSSTLLSIF (MAGC1_HUMAN)
RGFSSTLLSIY

SEQ ID NO: 91751 - protein, 9 aa, Artificial Sequence
  Description of Artificial Sequence: Synthetic peptide
  Seed: SSSSTLLSL (MAGC1_HUMAN)
SVSSTLLSF

SEQ ID NO: 91752 - protein, 9 aa, Artificial Sequence
  Description of Artificial Sequence: Synthetic peptide
  Seed: FAFGEPREL (MAGC1_HUMAN)
FMFGEPREI

SEQ ID NO: 91753 - protein, 10 aa, Artificial Sequence
  Description of Artificial Sequence: Synthetic peptide
  Seed: LQIPVSRSFS (MAGC1_HUMAN)
LQIPVSRSFA

SEQ ID NO: 91754 - protein, 9 aa, Artificial Sequence
  Description of Artificial Sequence: Synthetic peptide
  Seed: FFSYTLASL (MAGC1_HUMAN)
FFSYTLASY

SEQ ID NO: 91755 - protein, 10 aa, Artificial Sequence
  Description of Artificial Sequence: Synthetic peptide
  Seed: FPQSLLQIPM (MAGC1_HUMAN)
FWQSLLQIPV

SEQ ID NO: 91756 - protein, 9 aa, Artificial Sequence
  Description of Artificial Sequence: Synthetic peptide
  Seed: YFPVIFRKA (MAGC1_HUMAN)
YYPVIFRKL

SEQ ID NO: 91757 - protein, 11 aa, Artificial Sequence
  Description of Artificial Sequence: Synthetic peptide
  Seed: STFEGFPQSLL (MAGC1_HUMAN)
STFEGFPQSLV

SEQ ID NO: 91758 - protein, 10 aa, Artificial Sequence
  Description of Artificial Sequence: Synthetic peptide
  Seed: SSPESAQSAF (MAGC1_HUMAN)
STPESAQSAW

SEQ ID NO: 91759 - protein, 9 aa, Artificial Sequence
  Description of Artificial Sequence: Synthetic peptide
  Seed: SPLQNSQSS (MAGC1_HUMAN)
SPLQNSQSV

SEQ ID NO: 91760 - protein, 9 aa, Artificial Sequence
  Description of Artificial Sequence: Synthetic peptide
  Seed: VSPSFSSTL (MAGC1_HUMAN)
VLPSFSSTY

SEQ ID NO: 91761 - protein, 9 aa, Artificial Sequence
  Description of Artificial Sequence: Synthetic peptide
  Seed: LQIVPSLPE (MAGC1_HUMAN)
LQIVPSLPH

SEQ ID NO: 91762 - protein, 10 aa, Artificial Sequence
  Description of Artificial Sequence: Synthetic peptide
  Seed: ICSSSTPSSL (MAGC1_HUMAN)
ISSSSTPSSF

SEQ ID NO: 91763 - protein, 9 aa, Artificial Sequence
  Description of Artificial Sequence: Synthetic peptide
  Seed: TTDDSTATE (MAGC1_HUMAN)
TFDDSTATF

SEQ ID NO: 91764 - protein, 10 aa, Artificial Sequence
  Description of Artificial Sequence: Synthetic peptide
  Seed: SSPERTHSTF (MAGC1_HUMAN)
SVPERTHSTW

SEQ ID NO: 91765 - protein, 11 aa, Artificial Sequence
  Description of Artificial Sequence: Synthetic peptide
  Seed: IPVSRSFSSTL (MAGC1_HUMAN)
IRVSRSFSSTW

SEQ ID NO: 91766 - protein, 9 aa, Artificial Sequence
  Description of Artificial Sequence: Synthetic peptide
  Seed: RLLILILSI (MAGC1_HUMAN)
RTLILILSR

SEQ ID NO: 91767 - protein, 9 aa, Artificial Sequence
  Description of Artificial Sequence: Synthetic peptide
  Seed: TLLSLFQSF (MAGC1_HUMAN)
TYLSLFQSL

SEQ ID NO: 91768 - protein, 11 aa, Artificial Sequence
  Description of Artificial Sequence: Synthetic peptide
  Seed: EEVIWDVLSGI (MAGC1_HUMAN)
EVVIWDVLSGI

SEQ ID NO: 91769 - protein, 11 aa, Artificial Sequence
  Description of Artificial Sequence: Synthetic peptide
  Seed: SLSQSSPVSSF (MAGC1_HUMAN)
SKSQSSPVSSF

SEQ ID NO: 91770 - protein, 9 aa, Artificial Sequence
  Description of Artificial Sequence: Synthetic peptide
  Seed: LQIPVSSSS (MAGC1_HUMAN)
LSIPVSSSV

SEQ ID NO: 91771 - protein, 10 aa, Artificial Sequence
  Description of Artificial Sequence: Synthetic peptide
  Seed: FSSSTSLSPF (MAGC1_HUMAN)
FQSSTSLSPL

SEQ ID NO: 91772 - protein, 10 aa, Artificial Sequence
  Description of Artificial Sequence: Synthetic peptide
  Seed: ILILSIIFIK (MAGC1_HUMAN)
ISILSIIFIK

SEQ ID NO: 91773 - protein, 9 aa, Artificial Sequence
  Description of Artificial Sequence: Synthetic peptide
  Seed: LQIPVSAAS (MAGC1_HUMAN)
LYIPVSAAM

SEQ ID NO: 91774 - protein, 9 aa, Artificial Sequence
  Description of Artificial Sequence: Synthetic peptide
  Seed: STFEGFPQS (MAGC1_HUMAN)
SAFEGFPQY

SEQ ID NO: 91775 - protein, 10 aa, Artificial Sequence
  Description of Artificial Sequence: Synthetic peptide
  Seed: REFIEILFGI (MAGC1_HUMAN)
RTFIEILFGL

SEQ ID NO: 91776 - protein, 9 aa, Artificial Sequence
  Description of Artificial Sequence: Synthetic peptide
  Seed: FTYTLDEKV (MAGC1_HUMAN)
FIYTLDEKA

SEQ ID NO: 91777 - protein, 10 aa, Artificial Sequence
  Description of Artificial Sequence: Synthetic peptide
  Seed: TGYFPVIFRK (MAGC1_HUMAN)
TAYFPVIFRR

SEQ ID NO: 91778 - protein, 10 aa, Artificial Sequence
  Description of Artificial Sequence: Synthetic peptide
  Seed: WGPRAHSEVI (MAGC1_HUMAN)
WNPRAHSEVF

SEQ ID NO: 91779 - protein, 9 aa, Artificial Sequence
  Description of Artificial Sequence: Synthetic peptide
  Seed: TLLSILQSS (MAGC1_HUMAN)
TLLSILQSI

SEQ ID NO: 91780 - protein, 10 aa, Artificial Sequence
  Description of Artificial Sequence: Synthetic peptide
  Seed: RKAREFIEIL (MAGC1_HUMAN)
RKAREFIEIF

SEQ ID NO: 91781 - protein, 9 aa, Artificial Sequence
  Description of Artificial Sequence: Synthetic peptide
  Seed: TSLSLPQSF (MAGC1_HUMAN)
TYLSLPQSV

SEQ ID NO: 91782 - protein, 11 aa, Artificial Sequence
  Description of Artificial Sequence: Synthetic peptide
  Seed: QSSPERTQSTF (MAGC1_HUMAN)
QQSPERTQSTY

SEQ ID NO: 91783 - protein, 9 aa, Artificial Sequence
  Description of Artificial Sequence: Synthetic peptide
  Seed: SPQSPPEGP (MAGC1_HUMAN)
SPQSPPEGF

SEQ ID NO: 91784 - protein, 11 aa, Artificial Sequence
  Description of Artificial Sequence: Synthetic peptide
  Seed: SPLQNPASSFF (MAGC1_HUMAN)
SILQNPASSFF

SEQ ID NO: 91785 - protein, 9 aa, Artificial Sequence
  Description of Artificial Sequence: Synthetic peptide
  Seed: SFSSTLVSL (MAGC1_HUMAN)
SLSSTLVSM

SEQ ID NO: 91786 - protein, 10 aa, Artificial Sequence
  Description of Artificial Sequence: Synthetic peptide
  Seed: FPQSVLQIPV (MAGC1_HUMAN)
FAQSVLQIPF

SEQ ID NO: 91787 - protein, 9 aa, Artificial Sequence
  Description of Artificial Sequence: Synthetic peptide
  Seed: QVKQPITKA (MAGC1_HUMAN)
QPKQPITKM

SEQ ID NO: 91788 - protein, 9 aa, Artificial Sequence
  Description of Artificial Sequence: Synthetic peptide
  Seed: FSSTLLSLF (MAGC1_HUMAN)
FMSTLLSLI

SEQ ID NO: 91789 - protein, 10 aa, Artificial Sequence
  Description of Artificial Sequence: Synthetic peptide
  Seed: ITKAEMLTNV (MAGC1_HUMAN)
IMKAEMLTNL

SEQ ID NO: 91790 - protein, 9 aa, Artificial Sequence
  Description of Artificial Sequence: Synthetic peptide
  Seed: VLSGIGVRA (MAGC1_HUMAN)
VVSGIGVRI

SEQ ID NO: 91791 - protein, 10 aa, Artificial Sequence
  Description of Artificial Sequence: Synthetic peptide
  Seed: MSPLYFPQSP (MAGC1_HUMAN)
MMPLYFPQSV

SEQ ID NO: 91792 - protein, 10 aa, Artificial Sequence
  Description of Artificial Sequence: Synthetic peptide
  Seed: SRYTGYFPVI (MAGC1_HUMAN)
SGYTGYFPVF

SEQ ID NO: 91793 - protein, 9 aa, Artificial Sequence
  Description of Artificial Sequence: Synthetic peptide
  Seed: SAASSSTLV (MAGC1_HUMAN)
SVASSSTLF

SEQ ID NO: 91794 - protein, 9 aa, Artificial Sequence
  Description of Artificial Sequence: Synthetic peptide
  Seed: FSSTLLSLF (MAGC1_HUMAN)
FKSTLLSLY

SEQ ID NO: 91795 - protein, 9 aa, Artificial Sequence
  Description of Artificial Sequence: Synthetic peptide
  Seed: SSSTLLSLF (MAGC1_HUMAN)
SVSTLLSLW

SEQ ID NO: 91796 - protein, 9 aa, Artificial Sequence
  Description of Artificial Sequence: Synthetic peptide
  Seed: LQIVPSLPE (MAGC1_HUMAN)
LSIVPSLPM

SEQ ID NO: 91797 - protein, 9 aa, Artificial Sequence
  Description of Artificial Sequence: Synthetic peptide
  Seed: ISFSSSTSL (MAGC1_HUMAN)
IFFSSSTSW

SEQ ID NO: 91798 - protein, 11 aa, Artificial Sequence
  Description of Artificial Sequence: Synthetic peptide
  Seed: SEESSSPVDEY (MAGC1_HUMAN)
STESSSPVDEY

SEQ ID NO: 91799 - protein, 9 aa, Artificial Sequence
  Description of Artificial Sequence: Synthetic peptide
  Seed: RLLILILSI (MAGC1_HUMAN)
RQLILILSF

SEQ ID NO: 91800 - protein, 11 aa, Artificial Sequence
  Description of Artificial Sequence: Synthetic peptide
  Seed: AMLKNTVPITF (MAGC1_HUMAN)
ALLKNTVPITY

SEQ ID NO: 91801 - protein, 9 aa, Artificial Sequence
  Description of Artificial Sequence: Synthetic peptide
  Seed: MTSSFSSTL (MAGC1_HUMAN)
MSSSFSSTL

SEQ ID NO: 91802 - protein, 9 aa, Artificial Sequence
  Description of Artificial Sequence: Synthetic peptide
  Seed: FFSYTLASL (MAGC1_HUMAN)
FLSYTLAST

SEQ ID NO: 91803 - protein, 10 aa, Artificial Sequence
  Description of Artificial Sequence: Synthetic peptide
  Seed: SPLQSPVSSF (MAGC1_HUMAN)
STLQSPVSSY

SEQ ID NO: 91804 - protein, 10 aa, Artificial Sequence
  Description of Artificial Sequence: Synthetic peptide
  Seed: YTLDEKVDEL (MAGC1_HUMAN)
YMLDEKVDEF

SEQ ID NO: 91805 - protein, 10 aa, Artificial Sequence
  Description of Artificial Sequence: Synthetic peptide
  Seed: SSSSSTLLSL (MAGC1_HUMAN)
SESSSTLLSF

SEQ ID NO: 91806 - protein, 10 aa, Artificial Sequence
  Description of Artificial Sequence: Synthetic peptide
  Seed: SSFPSSTSSS (MAGC1_HUMAN)
SAFPSSTSSI

SEQ ID NO: 91807 - protein, 10 aa, Artificial Sequence
  Description of Artificial Sequence: Synthetic peptide
  Seed: WGPRAHSEVI (MAGC1_HUMAN)
WWPRAHSEVL

SEQ ID NO: 91808 - protein, 10 aa, Artificial Sequence
  Description of Artificial Sequence: Synthetic peptide
  Seed: SLFQSFSERT (MAGC1_HUMAN)
SQFQSFSERR

SEQ ID NO: 91809 - protein, 10 aa, Artificial Sequence
  Description of Artificial Sequence: Synthetic peptide
  Seed: SRYTGYFPVI (MAGC1_HUMAN)
SKYTGYFPVI

SEQ ID NO: 91810 - protein, 10 aa, Artificial Sequence
  Description of Artificial Sequence: Synthetic peptide
  Seed: STLLSLFQSF (MAGC1_HUMAN)
SDLLSLFQSY

SEQ ID NO: 91811 - protein, 10 aa, Artificial Sequence
  Description of Artificial Sequence: Synthetic peptide
  Seed: RYTGYFPVIF (MAGC1_HUMAN)
RETGYFPVIW

SEQ ID NO: 91812 - protein, 9 aa, Artificial Sequence
  Description of Artificial Sequence: Synthetic peptide
  Seed: ESDDTLYPL (MAGC1_HUMAN)
EVDDTLYPI

SEQ ID NO: 91813 - protein, 8 aa, Artificial Sequence
  Description of Artificial Sequence: Synthetic peptide
  Seed: LTDSESLI (MAGC1_HUMAN)
LLDSESLL

SEQ ID NO: 91814 - protein, 10 aa, Artificial Sequence
  Description of Artificial Sequence: Synthetic peptide
  Seed: YTLASLLQSS (MAGC1_HUMAN)
YFLASLLQST

SEQ ID NO: 91815 - protein, 9 aa, Artificial Sequence
  Description of Artificial Sequence: Synthetic peptide
  Seed: TTDDSTATE (MAGC1_HUMAN)
TSDDSTATY

SEQ ID NO: 91816 - protein, 9 aa, Artificial Sequence
  Description of Artificial Sequence: Synthetic peptide
  Seed: SSSSSSTLL (MAGC1_HUMAN)
SPSSSSTLA

SEQ ID NO: 91817 - protein, 9 aa, Artificial Sequence
  Description of Artificial Sequence: Synthetic peptide
  Seed: ELARFLLLK (MAGC1_HUMAN)
ETARFLLLY

SEQ ID NO: 91818 - protein, 10 aa, Artificial Sequence
  Description of Artificial Sequence: Synthetic peptide
  Seed: TGYFPVIFRK (MAGC1_HUMAN)
TVYFPVIFRP

SEQ ID NO: 91819 - protein, 9 aa, Artificial Sequence
  Description of Artificial Sequence: Synthetic peptide
  Seed: YTLASLLQS (MAGC1_HUMAN)
YQLASLLQI

SEQ ID NO: 91820 - protein, 10 aa, Artificial Sequence
  Description of Artificial Sequence: Synthetic peptide
  Seed: TVPITFPSSY (MAGC1_HUMAN)
TMPITFPSSY

SEQ ID NO: 91821 - protein, 10 aa, Artificial Sequence
  Description of Artificial Sequence: Synthetic peptide
  Seed: VSSSSSSSTL (MAGC1_HUMAN)
VCSSSSSSTF

SEQ ID NO: 91822 - protein, 11 aa, Artificial Sequence
  Description of Artificial Sequence: Synthetic peptide
  Seed: HESPQSPPEGP (MAGC1_HUMAN)
HESPQSPPEGL

SEQ ID NO: 91823 - protein, 10 aa, Artificial Sequence
  Description of Artificial Sequence: Synthetic peptide
  Seed: YTLDEKVDEL (MAGC1_HUMAN)
YYLDEKVDEI

SEQ ID NO: 91824 - protein, 10 aa, Artificial Sequence
  Description of Artificial Sequence: Synthetic peptide
  Seed: FPQSVLQIPV (MAGC1_HUMAN)
FLQSVLQIPV

SEQ ID NO: 91825 - protein, 9 aa, Artificial Sequence
  Description of Artificial Sequence: Synthetic peptide
  Seed: TLDEKVDEL (MAGC1_HUMAN)
TPDEKVDEF

SEQ ID NO: 91826 - protein, 10 aa, Artificial Sequence
  Description of Artificial Sequence: Synthetic peptide
  Seed: FAFGEPRELL (MAGC1_HUMAN)
FIFGEPRELV

SEQ ID NO: 91827 - protein, 9 aa, Artificial Sequence
  Description of Artificial Sequence: Synthetic peptide
  Seed: FPSSTSSSL (MAGC1_HUMAN)
FQSSTSSSL

SEQ ID NO: 91828 - protein, 9 aa, Artificial Sequence
  Description of Artificial Sequence: Synthetic peptide
  Seed: SPPRYEFLW (MAGC1_HUMAN)
SVPRYEFLW

SEQ ID NO: 91829 - protein, 11 aa, Artificial Sequence
  Description of Artificial Sequence: Synthetic peptide
  Seed: SSFPSSTSSSL (MAGC1_HUMAN)
SPFPSSTSSSM

SEQ ID NO: 91830 - protein, 10 aa, Artificial Sequence
  Description of Artificial Sequence: Synthetic peptide
  Seed: FPQSPLQIPV (MAGC1_HUMAN)
FPQSPLQIPY

SEQ ID NO: 91831 - protein, 9 aa, Artificial Sequence
  Description of Artificial Sequence: Synthetic peptide
  Seed: SIIFIKGTY (MAGC1_HUMAN)
SMIFIKGTW

SEQ ID NO: 91832 - protein, 9 aa, Artificial Sequence
  Description of Artificial Sequence: Synthetic peptide
  Seed: TSSFSSTLL (MAGC1_HUMAN)
TVSFSSTLF

SEQ ID NO: 91833 - protein, 9 aa, Artificial Sequence
  Description of Artificial Sequence: Synthetic peptide
  Seed: FAFGEPREL (MAGC1_HUMAN)
FQFGEPREV

SEQ ID NO: 91834 - protein, 11 aa, Artificial Sequence
  Description of Artificial Sequence: Synthetic peptide
  Seed: SLSQSSPVSSF (MAGC1_HUMAN)
SASQSSPVSSM

SEQ ID NO: 91835 - protein, 9 aa, Artificial Sequence
  Description of Artificial Sequence: Synthetic peptide
  Seed: FAQSPLQIP (MAGC1_HUMAN)
FPQSPLQIM

SEQ ID NO: 91836 - protein, 9 aa, Artificial Sequence
  Description of Artificial Sequence: Synthetic peptide
  Seed: SIIFIKGTY (MAGC1_HUMAN)
SKIFIKGTM

SEQ ID NO: 91837 - protein, 11 aa, Artificial Sequence
  Description of Artificial Sequence: Synthetic peptide
  Seed: IPMTSSFSSTL (MAGC1_HUMAN)
ILMTSSFSSTF

SEQ ID NO: 91838 - protein, 9 aa, Artificial Sequence
  Description of Artificial Sequence: Synthetic peptide
  Seed: SQSSPVSSF (MAGC1_HUMAN)
SMSSPVSSL

SEQ ID NO: 91839 - protein, 10 aa, Artificial Sequence
  Description of Artificial Sequence: Synthetic peptide
  Seed: STLLSLFQSF (MAGC1_HUMAN)
SMLLSLFQSY

SEQ ID NO: 91840 - protein, 10 aa, Artificial Sequence
  Description of Artificial Sequence: Synthetic peptide
  Seed: MPTAGMPSLL (MAGC1_HUMAN)
METAGMPSLW

SEQ ID NO: 91841 - protein, 11 aa, Artificial Sequence
  Description of Artificial Sequence: Synthetic peptide
  Seed: SEESSSPVDEY (MAGC1_HUMAN)
SIESSSPVDEY

SEQ ID NO: 91842 - protein, 9 aa, Artificial Sequence
  Description of Artificial Sequence: Synthetic peptide
  Seed: SPPEGPVQS (MAGC1_HUMAN)
SPPEGPVQY

SEQ ID NO: 91843 - protein, 9 aa, Artificial Sequence
  Description of Artificial Sequence: Synthetic peptide
  Seed: KVWVQEHYL (MAGC1_HUMAN)
KTWVQEHYY

SEQ ID NO: 91844 - protein, 10 aa, Artificial Sequence
  Description of Artificial Sequence: Synthetic peptide
  Seed: MLKNTVPITF (MAGC1_HUMAN)
MSKNTVPITY

SEQ ID NO: 91845 - protein, 9 aa, Artificial Sequence
  Description of Artificial Sequence: Synthetic peptide
  Seed: RKAREFIEI (MAGC1_HUMAN)
RHAREFIEY

SEQ ID NO: 91846 - protein, 9 aa, Artificial Sequence
  Description of Artificial Sequence: Synthetic peptide
  Seed: VPITFPSSY (MAGC1_HUMAN)
VAITFPSSM

SEQ ID NO: 91847 - protein, 9 aa, Artificial Sequence
  Description of Artificial Sequence: Synthetic peptide
  Seed: YTLLSLFQS (MAGC1_HUMAN)
YSLLSLFQA

SEQ ID NO: 91848 - protein, 9 aa, Artificial Sequence
  Description of Artificial Sequence: Synthetic peptide
  Seed: SLPEWEDSL (MAGC1_HUMAN)
SYPEWEDSM

SEQ ID NO: 91849 - protein, 9 aa, Artificial Sequence
  Description of Artificial Sequence: Synthetic peptide
  Seed: SLPEWEDSL (MAGC1_HUMAN)
SMPEWEDSY

SEQ ID NO: 91850 - protein, 8 aa, Artificial Sequence
  Description of Artificial Sequence: Synthetic peptide
  Seed: PSSTSSSL (MAGC1_HUMAN)
PMSTSSSL

SEQ ID NO: 91851 - protein, 9 aa, Artificial Sequence
  Description of Artificial Sequence: Synthetic peptide
  Seed: SPLQSPVSS (MAGC1_HUMAN)
STLQSPVSL

SEQ ID NO: 91852 - protein, 9 aa, Artificial Sequence
  Description of Artificial Sequence: Synthetic peptide
  Seed: MSQNRLLIL (MAGC1_HUMAN)
MAQNRLLIV

SEQ ID NO: 91853 - protein, 9 aa, Artificial Sequence
  Description of Artificial Sequence: Synthetic peptide
  Seed: VSAASSSTL (MAGC1_HUMAN)
VWAASSSTF

SEQ ID NO: 91854 - protein, 10 aa, Artificial Sequence
  Description of Artificial Sequence: Synthetic peptide
  Seed: SFSYTLLSLF (MAGC1_HUMAN)
SPSYTLLSLY

SEQ ID NO: 91855 - protein, 9 aa, Artificial Sequence
  Description of Artificial Sequence: Synthetic peptide
  Seed: SPLQRPVSS (MAGC1_HUMAN)
SALQRPVSL

SEQ ID NO: 91856 - protein, 9 aa, Artificial Sequence
  Description of Artificial Sequence: Synthetic peptide
  Seed: TLLSLFQSF (MAGC1_HUMAN)
TGLSLFQSW

SEQ ID NO: 91857 - protein, 8 aa, Artificial Sequence
  Description of Artificial Sequence: Synthetic peptide
  Seed: FSYTLLSL (MAGC1_HUMAN)
FSYTLLSW

SEQ ID NO: 91858 - protein, 11 aa, Artificial Sequence
  Description of Artificial Sequence: Synthetic peptide
  Seed: LQIPVSSSFSY (MAGC1_HUMAN)
LCIPVSSSFSM

SEQ ID NO: 91859 - protein, 10 aa, Artificial Sequence
  Description of Artificial Sequence: Synthetic peptide
  Seed: SRYTGYFPVI (MAGC1_HUMAN)
SFYTGYFPVW

SEQ ID NO: 91860 - protein, 10 aa, Artificial Sequence
  Description of Artificial Sequence: Synthetic peptide
  Seed: QRPVSSFFSY (MAGC1_HUMAN)
QFPVSSFFSF

SEQ ID NO: 91861 - protein, 11 aa, Artificial Sequence
  Description of Artificial Sequence: Synthetic peptide
  Seed: LQIPGSPSFSS (MAGC1_HUMAN)
LMIPGSPSFSF

SEQ ID NO: 91862 - protein, 9 aa, Artificial Sequence
  Description of Artificial Sequence: Synthetic peptide
  Seed: RAHSEVIKR (MAGC1_HUMAN)
RTHSEVIKI

SEQ ID NO: 91863 - protein, 9 aa, Artificial Sequence
  Description of Artificial Sequence: Synthetic peptide
  Seed: VSPSSSSTL (MAGC1_HUMAN)
VYPSSSSTL

SEQ ID NO: 91864 - protein, 11 aa, Artificial Sequence
  Description of Artificial Sequence: Synthetic peptide
  Seed: GEDSQSPLQIP (MAGC1_HUMAN)
GEDSQSPLQIA

SEQ ID NO: 91865 - protein, 8 aa, Artificial Sequence
  Description of Artificial Sequence: Synthetic peptide
  Seed: SFSSSTSL (MAGC1_HUMAN)
SYSSSTSL

SEQ ID NO: 91866 - protein, 9 aa, Artificial Sequence
  Description of Artificial Sequence: Synthetic peptide
  Seed: SSHESPQSP (MAGC1_HUMAN)
STHESPQSH

SEQ ID NO: 91867 - protein, 9 aa, Artificial Sequence
  Description of Artificial Sequence: Synthetic peptide
  Seed: FAFGEPREL (MAGC1_HUMAN)
FNFGEPREM

SEQ ID NO: 91868 - protein, 9 aa, Artificial Sequence
  Description of Artificial Sequence: Synthetic peptide
  Seed: SSSSSSSTL (MAGC1_HUMAN)
SESSSSSTL

SEQ ID NO: 91869 - protein, 9 aa, Artificial Sequence
  Description of Artificial Sequence: Synthetic peptide
  Seed: FFSSALLSI (MAGC1_HUMAN)
FVSSALLSM

SEQ ID NO: 91870 - protein, 8 aa, Artificial Sequence
  Description of Artificial Sequence: Synthetic peptide
  Seed: FPQSPPQG (MAGC1_HUMAN)
FPQSPPQA

SEQ ID NO: 91871 - protein, 9 aa, Artificial Sequence
  Description of Artificial Sequence: Synthetic peptide
  Seed: ALLSIFQSS (MAGC1_HUMAN)
ALLSIFQSM

SEQ ID NO: 91872 - protein, 9 aa, Artificial Sequence
  Description of Artificial Sequence: Synthetic peptide
  Seed: GYFPVIFRK (MAGC1_HUMAN)
GVFPVIFRK

SEQ ID NO: 91873 - protein, 9 aa, Artificial Sequence
  Description of Artificial Sequence: Synthetic peptide
  Seed: KVDELARFL (MAGC1_HUMAN)
KVDELARFW

SEQ ID NO: 91874 - protein, 9 aa, Artificial Sequence
  Description of Artificial Sequence: Synthetic peptide
  Seed: SAASSSTLV (MAGC1_HUMAN)
STASSSTLL

SEQ ID NO: 91875 - protein, 9 aa, Artificial Sequence
  Description of Artificial Sequence: Synthetic peptide
  Seed: LQIPVSPSF (MAGC1_HUMAN)
LFIPVSPSM

SEQ ID NO: 91876 - protein, 10 aa, Artificial Sequence
  Description of Artificial Sequence: Synthetic peptide
  Seed: REVDPDDSYV (MAGC1_HUMAN)
REVDPDDSYL

SEQ ID NO: 91877 - protein, 10 aa, Artificial Sequence
  Description of Artificial Sequence: Synthetic peptide
  Seed: RAGREHFAFG (MAGC1_HUMAN)
RSGREHFAFQ

SEQ ID NO: 91878 - protein, 9 aa, Artificial Sequence
  Description of Artificial Sequence: Synthetic peptide
  Seed: TFEGFPQSL (MAGC1_HUMAN)
TAEGFPQSW

SEQ ID NO: 91879 - protein, 11 aa, Artificial Sequence
  Description of Artificial Sequence: Synthetic peptide
  Seed: KDMPTAGMPSL (MAGC1_HUMAN)
KQMPTAGMPSW

SEQ ID NO: 91880 - protein, 8 aa, Artificial Sequence
  Description of Artificial Sequence: Synthetic peptide
  Seed: SSFFSSAL (MAGC1_HUMAN)
SSFFSSAM

SEQ ID NO: 91881 - protein, 9 aa, Artificial Sequence
  Description of Artificial Sequence: Synthetic peptide
  Seed: IIFIKGTYA (MAGC1_HUMAN)
IVFIKGTYV

SEQ ID NO: 91882 - protein, 11 aa, Artificial Sequence
  Description of Artificial Sequence: Synthetic peptide
  Seed: SSSSSSTLLSL (MAGC1_HUMAN)
SGSSSSTLLSF

SEQ ID NO: 91883 - protein, 11 aa, Artificial Sequence
  Description of Artificial Sequence: Synthetic peptide
  Seed: LQRPVSSFFSY (MAGC1_HUMAN)
LHRPVSSFFSF

SEQ ID NO: 91884 - protein, 10 aa, Artificial Sequence
  Description of Artificial Sequence: Synthetic peptide
  Seed: ICSSSTSLSL (MAGC1_HUMAN)
IASSSTSLSF

SEQ ID NO: 91885 - protein, 9 aa, Artificial Sequence
  Description of Artificial Sequence: Synthetic peptide
  Seed: RLLILILSI (MAGC1_HUMAN)
RLLILILSL

SEQ ID NO: 91886 - protein, 10 aa, Artificial Sequence
  Description of Artificial Sequence: Synthetic peptide
  Seed: FIEILFGISL (MAGC1_HUMAN)
FQEILFGISL

SEQ ID NO: 91887 - protein, 9 aa, Artificial Sequence
  Description of Artificial Sequence: Synthetic peptide
  Seed: VSPSSSSTL (MAGC1_HUMAN)
VVPSSSSTV

SEQ ID NO: 91888 - protein, 9 aa, Artificial Sequence
  Description of Artificial Sequence: Synthetic peptide
  Seed: NSSPPRYEF (MAGC1_HUMAN)
NYSPPRYEL

SEQ ID NO: 91889 - protein, 10 aa, Artificial Sequence
  Description of Artificial Sequence: Synthetic peptide
  Seed: SLFQSSPECT (MAGC1_HUMAN)
SMFQSSPECL

SEQ ID NO: 91890 - protein, 9 aa, Artificial Sequence
  Description of Artificial Sequence: Synthetic peptide
  Seed: SFFSYTLAS (MAGC1_HUMAN)
SFFSYTLAW

SEQ ID NO: 91891 - protein, 9 aa, Artificial Sequence
  Description of Artificial Sequence: Synthetic peptide
  Seed: SSPERTHST (MAGC1_HUMAN)
SKPERTHSL

SEQ ID NO: 91892 - protein, 11 aa, Artificial Sequence
  Description of Artificial Sequence: Synthetic peptide
  Seed: TVPITFPSSYK (MAGC1_HUMAN)
TLPITFPSSYR

SEQ ID NO: 91893 - protein, 10 aa, Artificial Sequence
  Description of Artificial Sequence: Synthetic peptide
  Seed: STLLSLFQSF (MAGC1_HUMAN)
SRLLSLFQSY

SEQ ID NO: 91894 - protein, 9 aa, Artificial Sequence
  Description of Artificial Sequence: Synthetic peptide
  Seed: ASEEVIWDV (MAGC1_HUMAN)
ALEEVIWDL

SEQ ID NO: 91895 - protein, 9 aa, Artificial Sequence
  Description of Artificial Sequence: Synthetic peptide
  Seed: AQSPLQIPV (MAGC1_HUMAN)
AQSPLQIPY

SEQ ID NO: 91896 - protein, 9 aa, Artificial Sequence
  Description of Artificial Sequence: Synthetic peptide
  Seed: YTSSSDTLL (MAGC1_HUMAN)
YISSSDTLW

SEQ ID NO: 91897 - protein, 10 aa, Artificial Sequence
  Description of Artificial Sequence: Synthetic peptide
  Seed: SSSSTLLSLF (MAGC1_HUMAN)
SGSSTLLSLW

SEQ ID NO: 91898 - protein, 9 aa, Artificial Sequence
  Description of Artificial Sequence: Synthetic peptide
  Seed: HFPQSPPEW (MAGC1_HUMAN)
HYPQSPPEM

SEQ ID NO: 91899 - protein, 10 aa, Artificial Sequence
  Description of Artificial Sequence: Synthetic peptide
  Seed: YTLLSLFQSS (MAGC1_HUMAN)
YSLLSLFQSA

SEQ ID NO: 91900 - protein, 10 aa, Artificial Sequence
  Description of Artificial Sequence: Synthetic peptide
  Seed: MTSSFSSTLL (MAGC1_HUMAN)
MGSSFSSTLY

SEQ ID NO: 91901 - protein, 9 aa, Artificial Sequence
  Description of Artificial Sequence: Synthetic peptide
  Seed: SPQSPPEGP (MAGC1_HUMAN)
SPQSPPEGL

SEQ ID NO: 91902 - protein, 9 aa, Artificial Sequence
  Description of Artificial Sequence: Synthetic peptide
  Seed: SSFFSSALL (MAGC1_HUMAN)
SKFFSSALM

SEQ ID NO: 91903 - protein, 10 aa, Artificial Sequence
  Description of Artificial Sequence: Synthetic peptide
  Seed: NTVPITFPSS (MAGC1_HUMAN)
NMVPITFPSV

SEQ ID NO: 91904 - protein, 9 aa, Artificial Sequence
  Description of Artificial Sequence: Synthetic peptide
  Seed: YQVKQPITK (MAGC1_HUMAN)
YMVKQPITR

SEQ ID NO: 91905 - protein, 9 aa, Artificial Sequence
  Description of Artificial Sequence: Synthetic peptide
  Seed: ASSFFSSAL (MAGC1_HUMAN)
AMSFFSSAY

SEQ ID NO: 91906 - protein, 9 aa, Artificial Sequence
  Description of Artificial Sequence: Synthetic peptide
  Seed: FSYTLASLL (MAGC1_HUMAN)
FEYTLASLY

SEQ ID NO: 91907 - protein, 11 aa, Artificial Sequence
  Description of Artificial Sequence: Synthetic peptide
  Seed: IPVSAASSSTL (MAGC1_HUMAN)
IVVSAASSSTW

SEQ ID NO: 91908 - protein, 9 aa, Artificial Sequence
  Description of Artificial Sequence: Synthetic peptide
  Seed: FSSALLSIF (MAGC1_HUMAN)
FPSALLSIG

SEQ ID NO: 91909 - protein, 9 aa, Artificial Sequence
  Description of Artificial Sequence: Synthetic peptide
  Seed: LQIPVSRSF (MAGC1_HUMAN)
LLIPVSRSY

SEQ ID NO: 91910 - protein, 9 aa, Artificial Sequence
  Description of Artificial Sequence: Synthetic peptide
  Seed: SSPEGKDSL (MAGC1_HUMAN)
SAPEGKDSY

SEQ ID NO: 91911 - protein, 10 aa, Artificial Sequence
  Description of Artificial Sequence: Synthetic peptide
  Seed: SSSSSTLLSL (MAGC1_HUMAN)
SGSSSTLLSW

SEQ ID NO: 91912 - protein, 10 aa, Artificial Sequence
  Description of Artificial Sequence: Synthetic peptide
  Seed: KRKVVEFLAM (MAGC1_HUMAN)
KNKVVEFLAF

SEQ ID NO: 91913 - protein, 11 aa, Artificial Sequence
  Description of Artificial Sequence: Synthetic peptide
  Seed: IPVSPSSSSTL (MAGC1_HUMAN)
IGVSPSSSSTY

SEQ ID NO: 91914 - protein, 9 aa, Artificial Sequence
  Description of Artificial Sequence: Synthetic peptide
  Seed: FSSTLVSLF (MAGC1_HUMAN)
FTSTLVSLA

SEQ ID NO: 91915 - protein, 9 aa, Artificial Sequence
  Description of Artificial Sequence: Synthetic peptide
  Seed: RAGREHFAF (MAGC1_HUMAN)
RFGREHFAM

SEQ ID NO: 91916 - protein, 9 aa, Artificial Sequence
  Description of Artificial Sequence: Synthetic peptide
  Seed: LQNPASSFF (MAGC1_HUMAN)
LYNPASSFW

SEQ ID NO: 91917 - protein, 9 aa, Artificial Sequence
  Description of Artificial Sequence: Synthetic peptide
  Seed: LQIPVSRSF (MAGC1_HUMAN)
LFIPVSRSL

SEQ ID NO: 91918 - protein, 11 aa, Artificial Sequence
  Description of Artificial Sequence: Synthetic peptide
  Seed: IPVSSSFSYTL (MAGC1_HUMAN)
IMVSSSFSYTY

SEQ ID NO: 91919 - protein, 9 aa, Artificial Sequence
  Description of Artificial Sequence: Synthetic peptide
  Seed: QVKQPITKA (MAGC1_HUMAN)
QSKQPITKM

SEQ ID NO: 91920 - protein, 9 aa, Artificial Sequence
  Description of Artificial Sequence: Synthetic peptide
  Seed: SPVSICSSS (MAGC1_HUMAN)
SPVSICSSA

SEQ ID NO: 91921 - protein, 11 aa, Artificial Sequence
  Description of Artificial Sequence: Synthetic peptide
  Seed: LQRPVSSFFSY (MAGC1_HUMAN)
LMRPVSSFFSY

SEQ ID NO: 91922 - protein, 9 aa, Artificial Sequence
  Description of Artificial Sequence: Synthetic peptide
  Seed: VSSSFSYTL (MAGC1_HUMAN)
VSSSFSYTY

SEQ ID NO: 91923 - protein, 9 aa, Artificial Sequence
  Description of Artificial Sequence: Synthetic peptide
  Seed: SFSSTLVSL (MAGC1_HUMAN)
SASSTLVSH

SEQ ID NO: 91924 - protein, 10 aa, Artificial Sequence
  Description of Artificial Sequence: Synthetic peptide
  Seed: KRKVVEFLAM (MAGC1_HUMAN)
KKKVVEFLAF

SEQ ID NO: 91925 - protein, 9 aa, Artificial Sequence
  Description of Artificial Sequence: Synthetic peptide
  Seed: SSFSYTLLS (MAGC1_HUMAN)
SAFSYTLLK

SEQ ID NO: 91926 - protein, 9 aa, Artificial Sequence
  Description of Artificial Sequence: Synthetic peptide
  Seed: SFFSYTLAS (MAGC1_HUMAN)
SMFSYTLAF

SEQ ID NO: 91927 - protein, 11 aa, Artificial Sequence
  Description of Artificial Sequence: Synthetic peptide
  Seed: IPVSPSSSSTL (MAGC1_HUMAN)
IAVSPSSSSTH

SEQ ID NO: 91928 - protein, 9 aa, Artificial Sequence
  Description of Artificial Sequence: Synthetic peptide
  Seed: AQSSLQIPV (MAGC1_HUMAN)
AESSLQIPF

SEQ ID NO: 91929 - protein, 9 aa, Artificial Sequence
  Description of Artificial Sequence: Synthetic peptide
  Seed: DVLSGIGVR (MAGC1_HUMAN)
DTLSGIGVF

SEQ ID NO: 91930 - protein, 9 aa, Artificial Sequence
  Description of Artificial Sequence: Synthetic peptide
  Seed: KAREFIEIL (MAGC1_HUMAN)
KLREFIEIV

SEQ ID NO: 91931 - protein, 9 aa, Artificial Sequence
  Description of Artificial Sequence: Synthetic peptide
  Seed: SSSESPQSC (MAGC1_HUMAN)
SVSESPQSI

SEQ ID NO: 91932 - protein, 9 aa, Artificial Sequence
  Description of Artificial Sequence: Synthetic peptide
  Seed: SPESTQSPF (MAGC1_HUMAN)
SPESTQSPI

SEQ ID NO: 91933 - protein, 11 aa, Artificial Sequence
  Description of Artificial Sequence: Synthetic peptide
  Seed: SSFSYTLLSLF (MAGC1_HUMAN)
SLFSYTLLSLW

SEQ ID NO: 91934 - protein, 10 aa, Artificial Sequence
  Description of Artificial Sequence: Synthetic peptide
  Seed: ISRYTGYFPV (MAGC1_HUMAN)
ITRYTGYFPF

SEQ ID NO: 91935 - protein, 10 aa, Artificial Sequence
  Description of Artificial Sequence: Synthetic peptide
  Seed: MSQNRLLILI (MAGC1_HUMAN)
MLQNRLLILL

SEQ ID NO: 91936 - protein, 10 aa, Artificial Sequence
  Description of Artificial Sequence: Synthetic peptide
  Seed: LSLFQSFSER (MAGC1_HUMAN)
LTLFQSFSER

SEQ ID NO: 91937 - protein, 11 aa, Artificial Sequence
  Description of Artificial Sequence: Synthetic peptide
  Seed: IIDTTDDSTAT (MAGC1_HUMAN)
ITDTTDDSTAI

SEQ ID NO: 91938 - protein, 10 aa, Artificial Sequence
  Description of Artificial Sequence: Synthetic peptide
  Seed: SSPESAQSAF (MAGC1_HUMAN)
SSPESAQSAY

SEQ ID NO: 91939 - protein, 9 aa, Artificial Sequence
  Description of Artificial Sequence: Synthetic peptide
  Seed: FPSSTSSSL (MAGC1_HUMAN)
FFSSTSSSW

SEQ ID NO: 91940 - protein, 9 aa, Artificial Sequence
  Description of Artificial Sequence: Synthetic peptide
  Seed: MTSSFSSTL (MAGC1_HUMAN)
MTSSFSSTI

SEQ ID NO: 91941 - protein, 11 aa, Artificial Sequence
  Description of Artificial Sequence: Synthetic peptide
  Seed: RSFSSTLLSIF (MAGC1_HUMAN)
RTFSSTLLSIM

SEQ ID NO: 91942 - protein, 9 aa, Artificial Sequence
  Description of Artificial Sequence: Synthetic peptide
  Seed: KVWVQEHYL (MAGC1_HUMAN)
KLWVQEHYI

SEQ ID NO: 91943 - protein, 9 aa, Artificial Sequence
  Description of Artificial Sequence: Synthetic peptide
  Seed: SICSSSTSL (MAGC1_HUMAN)
SMCSSSTSR

SEQ ID NO: 91944 - protein, 10 aa, Artificial Sequence
  Description of Artificial Sequence: Synthetic peptide
  Seed: SLSPLHFPQF (MAGC1_HUMAN)
SMSPLHFPQI

SEQ ID NO: 91945 - protein, 10 aa, Artificial Sequence
  Description of Artificial Sequence: Synthetic peptide
  Seed: SSPERTQSTF (MAGC1_HUMAN)
SVPERTQSTL

SEQ ID NO: 91946 - protein, 10 aa, Artificial Sequence
  Description of Artificial Sequence: Synthetic peptide
  Seed: LQIPVSSSFS (MAGC1_HUMAN)
LHIPVSSSFY

SEQ ID NO: 91947 - protein, 10 aa, Artificial Sequence
  Description of Artificial Sequence: Synthetic peptide
  Seed: TTDDSTATES (MAGC1_HUMAN)
TMDDSTATEF

SEQ ID NO: 91948 - protein, 9 aa, Artificial Sequence
  Description of Artificial Sequence: Synthetic peptide
  Seed: FQSSLQSPV (MAGC1_HUMAN)
FQSSLQSPI

SEQ ID NO: 91949 - protein, 9 aa, Artificial Sequence
  Description of Artificial Sequence: Synthetic peptide
  Seed: SRYTGYFPV (MAGC1_HUMAN)
SMYTGYFPF

SEQ ID NO: 91950 - protein, 9 aa, Artificial Sequence
  Description of Artificial Sequence: Synthetic peptide
  Seed: FFSYTLASL (MAGC1_HUMAN)
FMSYTLASV

SEQ ID NO: 91951 - protein, 10 aa, Artificial Sequence
  Description of Artificial Sequence: Synthetic peptide
  Seed: FPQSLLQIPM (MAGC1_HUMAN)
FLQSLLQIPT

SEQ ID NO: 91952 - protein, 11 aa, Artificial Sequence
  Description of Artificial Sequence: Synthetic peptide
  Seed: QSSPESDDTLY (MAGC1_HUMAN)
QMSPESDDTLY

SEQ ID NO: 91953 - protein, 9 aa, Artificial Sequence
  Description of Artificial Sequence: Synthetic peptide
  Seed: KAREFIEIL (MAGC1_HUMAN)
KSREFIEIW

SEQ ID NO: 91954 - protein, 9 aa, Artificial Sequence
  Description of Artificial Sequence: Synthetic peptide
  Seed: SRSFSSTLL (MAGC1_HUMAN)
SHSFSSTLY

SEQ ID NO: 91955 - protein, 10 aa, Artificial Sequence
  Description of Artificial Sequence: Synthetic peptide
  Seed: DVLSGIGVRA (MAGC1_HUMAN)
DLLSGIGVRK

SEQ ID NO: 91956 - protein, 10 aa, Artificial Sequence
  Description of Artificial Sequence: Synthetic peptide
  Seed: RAGREHFAFG (MAGC1_HUMAN)
RIGREHFAFM

SEQ ID NO: 91957 - protein, 9 aa, Artificial Sequence
  Description of Artificial Sequence: Synthetic peptide
  Seed: SFPSSTSSS (MAGC1_HUMAN)
SYPSSTSSI

SEQ ID NO: 91958 - protein, 9 aa, Artificial Sequence
  Description of Artificial Sequence: Synthetic peptide
  Seed: SSLSQSSPV (MAGC1_HUMAN)
SSLSQSSPW

SEQ ID NO: 91959 - protein, 9 aa, Artificial Sequence
  Description of Artificial Sequence: Synthetic peptide
  Seed: GFPQSPLQI (MAGC1_HUMAN)
GVPQSPLQM

SEQ ID NO: 91960 - protein, 9 aa, Artificial Sequence
  Description of Artificial Sequence: Synthetic peptide
  Seed: ISFSSSTSL (MAGC1_HUMAN)
IIFSSSTSV

SEQ ID NO: 91961 - protein, 9 aa, Artificial Sequence
  Description of Artificial Sequence: Synthetic peptide
  Seed: SFPSSTSSS (MAGC1_HUMAN)
SYPSSTSSH

SEQ ID NO: 91962 - protein, 9 aa, Artificial Sequence
  Description of Artificial Sequence: Synthetic peptide
  Seed: SSFFSSALL (MAGC1_HUMAN)
SHFFSSALM

SEQ ID NO: 91963 - protein, 9 aa, Artificial Sequence
  Description of Artificial Sequence: Synthetic peptide
  Seed: GDKDMPTAG (MAGC1_HUMAN)
GEKDMPTAI

SEQ ID NO: 91964 - protein, 10 aa, Artificial Sequence
  Description of Artificial Sequence: Synthetic peptide
  Seed: ISRYTGYFPV (MAGC1_HUMAN)
ILRYTGYFPF

SEQ ID NO: 91965 - protein, 9 aa, Artificial Sequence
  Description of Artificial Sequence: Synthetic peptide
  Seed: VSAASSSTL (MAGC1_HUMAN)
VLAASSSTF

SEQ ID NO: 91966 - protein, 9 aa, Artificial Sequence
  Description of Artificial Sequence: Synthetic peptide
  Seed: KAREFIEIL (MAGC1_HUMAN)
KRREFIEIM

SEQ ID NO: 91967 - protein, 11 aa, Artificial Sequence
  Description of Artificial Sequence: Synthetic peptide
  Seed: FLAMLKNTVPI (MAGC1_HUMAN)
FHAMLKNTVPI

SEQ ID NO: 91968 - protein, 8 aa, Artificial Sequence
  Description of Artificial Sequence: Synthetic peptide
  Seed: FSYTLASL (MAGC1_HUMAN)
FSYTLASM

SEQ ID NO: 91969 - protein, 11 aa, Artificial Sequence
  Description of Artificial Sequence: Synthetic peptide
  Seed: QSSPERTQSTF (MAGC1_HUMAN)
QISPERTQSTW

SEQ ID NO: 91970 - protein, 9 aa, Artificial Sequence
  Description of Artificial Sequence: Synthetic peptide
  Seed: LQNPASSFF (MAGC1_HUMAN)
LINPASSFW

SEQ ID NO: 91971 - protein, 10 aa, Artificial Sequence
  Description of Artificial Sequence: Synthetic peptide
  Seed: EVIWDVLSGI (MAGC1_HUMAN)
EVIWDVLSGM

SEQ ID NO: 91972 - protein, 9 aa, Artificial Sequence
  Description of Artificial Sequence: Synthetic peptide
  Seed: NTVPITFPS (MAGC1_HUMAN)
NGVPITFPV

SEQ ID NO: 91973 - protein, 9 aa, Artificial Sequence
  Description of Artificial Sequence: Synthetic peptide
  Seed: LQIPVSSSS (MAGC1_HUMAN)
LMIPVSSSW

SEQ ID NO: 91974 - protein, 9 aa, Artificial Sequence
  Description of Artificial Sequence: Synthetic peptide
  Seed: FSYTLASLL (MAGC1_HUMAN)
FWYTLASLY

SEQ ID NO: 91975 - protein, 11 aa, Artificial Sequence
  Description of Artificial Sequence: Synthetic peptide
  Seed: QSSPESDDTLY (MAGC1_HUMAN)
QTSPESDDTLY

SEQ ID NO: 91976 - protein, 10 aa, Artificial Sequence
  Description of Artificial Sequence: Synthetic peptide
  Seed: EILFGISLRE (MAGC1_HUMAN)
ERLFGISLRK

SEQ ID NO: 91977 - protein, 9 aa, Artificial Sequence
  Description of Artificial Sequence: Synthetic peptide
  Seed: FPSSYKDAL (MAGC1_HUMAN)
FVSSYKDAM

SEQ ID NO: 91978 - protein, 9 aa, Artificial Sequence
  Description of Artificial Sequence: Synthetic peptide
  Seed: SLFQSFSER (MAGC1_HUMAN)
STFQSFSEM

SEQ ID NO: 91979 - protein, 11 aa, Artificial Sequence
  Description of Artificial Sequence: Synthetic peptide
  Seed: EGEDSSDPLQR (MAGC1_HUMAN)
ETEDSSDPLQK

SEQ ID NO: 91980 - protein, 10 aa, Artificial Sequence
  Description of Artificial Sequence: Synthetic peptide
  Seed: SQSPPEGEDV (MAGC1_HUMAN)
SQSPPEGEDW

SEQ ID NO: 91981 - protein, 9 aa, Artificial Sequence
  Description of Artificial Sequence: Synthetic peptide
  Seed: EVDPDDSYV (MAGC1_HUMAN)
ESDPDDSYL

SEQ ID NO: 91982 - protein, 9 aa, Artificial Sequence
  Description of Artificial Sequence: Synthetic peptide
  Seed: MSQNRLLIL (MAGC1_HUMAN)
MQQNRLLIH

SEQ ID NO: 91983 - protein, 10 aa, Artificial Sequence
  Description of Artificial Sequence: Synthetic peptide
  Seed: ASSFFSSALL (MAGC1_HUMAN)
AMSFFSSALL

SEQ ID NO: 91984 - protein, 9 aa, Artificial Sequence
  Description of Artificial Sequence: Synthetic peptide
  Seed: KAREFIEIL (MAGC1_HUMAN)
KIREFIEIW

SEQ ID NO: 91985 - protein, 10 aa, Artificial Sequence
  Description of Artificial Sequence: Synthetic peptide
  Seed: FFSYTLASLL (MAGC1_HUMAN)
FVSYTLASLY

SEQ ID NO: 91986 - protein, 10 aa, Artificial Sequence
  Description of Artificial Sequence: Synthetic peptide
  Seed: ICSSSTSLSL (MAGC1_HUMAN)
ISSSSTSLSM

SEQ ID NO: 91987 - protein, 10 aa, Artificial Sequence
  Description of Artificial Sequence: Synthetic peptide
  Seed: ICSSSTSLSL (MAGC1_HUMAN)
ISSSSTSLSY

SEQ ID NO: 91988 - protein, 9 aa, Artificial Sequence
  Description of Artificial Sequence: Synthetic peptide
  Seed: TFEGFPQSL (MAGC1_HUMAN)
TAEGFPQSM

SEQ ID NO: 91989 - protein, 9 aa, Artificial Sequence
  Description of Artificial Sequence: Synthetic peptide
  Seed: NSSPPRYEF (MAGC1_HUMAN)
NMSPPRYEF

SEQ ID NO: 91990 - protein, 9 aa, Artificial Sequence
  Description of Artificial Sequence: Synthetic peptide
  Seed: SQNRLLILI (MAGC1_HUMAN)
STNRLLILV

SEQ ID NO: 91991 - protein, 11 aa, Artificial Sequence
  Description of Artificial Sequence: Synthetic peptide
  Seed: LQRPVSSFFSY (MAGC1_HUMAN)
LLRPVSSFFSF

SEQ ID NO: 91992 - protein, 9 aa, Artificial Sequence
  Description of Artificial Sequence: Synthetic peptide
  Seed: SSSSSSSTL (MAGC1_HUMAN)
SRSSSSSTF

SEQ ID NO: 91993 - protein, 9 aa, Artificial Sequence
  Description of Artificial Sequence: Synthetic peptide
  Seed: LQNPASSFF (MAGC1_HUMAN)
LTNPASSFV

SEQ ID NO: 91994 - protein, 11 aa, Artificial Sequence
  Description of Artificial Sequence: Synthetic peptide
  Seed: SSTSLSLPQSF (MAGC1_HUMAN)
SRTSLSLPQSW

SEQ ID NO: 91995 - protein, 10 aa, Artificial Sequence
  Description of Artificial Sequence: Synthetic peptide
  Seed: MTSSFSSTLL (MAGC1_HUMAN)
MISSFSSTLI

SEQ ID NO: 91996 - protein, 10 aa, Artificial Sequence
  Description of Artificial Sequence: Synthetic peptide
  Seed: ASSSVMSPSF (MAGC1_HUMAN)
APSSVMSPSW

SEQ ID NO: 91997 - protein, 9 aa, Artificial Sequence
  Description of Artificial Sequence: Synthetic peptide
  Seed: AQSPLQIPV (MAGC1_HUMAN)
ARSPLQIPM

SEQ ID NO: 91998 - protein, 10 aa, Artificial Sequence
  Description of Artificial Sequence: Synthetic peptide
  Seed: SSPERTHSTF (MAGC1_HUMAN)
SRPERTHSTY

SEQ ID NO: 91999 - protein, 11 aa, Artificial Sequence
  Description of Artificial Sequence: Synthetic peptide
  Seed: LLLKYQVKQPI (MAGC1_HUMAN)
LLLKYQVKQPV

SEQ ID NO: 92000 - protein, 9 aa, Artificial Sequence
  Description of Artificial Sequence: Synthetic peptide
  Seed: GEDSLSPHY (MAGC1_HUMAN)
GLDSLSPHY

SEQ ID NO: 92001 - protein, 11 aa, Artificial Sequence
  Description of Artificial Sequence: Synthetic peptide
  Seed: REVDPDDSYVF (MAGC1_HUMAN)
RHVDPDDSYVM

SEQ ID NO: 92002 - protein, 9 aa, Artificial Sequence
  Description of Artificial Sequence: Synthetic peptide
  Seed: STFEGFPQS (MAGC1_HUMAN)
SAFEGFPQL

SEQ ID NO: 92003 - protein, 9 aa, Artificial Sequence
  Description of Artificial Sequence: Synthetic peptide
  Seed: VSRSFSSTL (MAGC1_HUMAN)
VARSFSSTF

SEQ ID NO: 92004 - protein, 9 aa, Artificial Sequence
  Description of Artificial Sequence: Synthetic peptide
  Seed: YTLASLLQS (MAGC1_HUMAN)
YILASLLQM

SEQ ID NO: 92005 - protein, 9 aa, Artificial Sequence
  Description of Artificial Sequence: Synthetic peptide
  Seed: FPSSYKDAL (MAGC1_HUMAN)
FISSYKDAY

SEQ ID NO: 92006 - protein, 10 aa, Artificial Sequence
  Description of Artificial Sequence: Synthetic peptide
  Seed: REHFAFGEPR (MAGC1_HUMAN)
RTHFAFGEPK

SEQ ID NO: 92007 - protein, 9 aa, Artificial Sequence
  Description of Artificial Sequence: Synthetic peptide
  Seed: VQSPLQNPA (MAGC1_HUMAN)
VMSPLQNPM

SEQ ID NO: 92008 - protein, 9 aa, Artificial Sequence
  Description of Artificial Sequence: Synthetic peptide
  Seed: TLDEKVDEL (MAGC1_HUMAN)
TVDEKVDEM

SEQ ID NO: 92009 - protein, 9 aa, Artificial Sequence
  Description of Artificial Sequence: Synthetic peptide
  Seed: FFSYTLASL (MAGC1_HUMAN)
FFSYTLASW

SEQ ID NO: 92010 - protein, 10 aa, Artificial Sequence
  Description of Artificial Sequence: Synthetic peptide
  Seed: SSFSSTLLSI (MAGC1_HUMAN)
SIFSSTLLSA

SEQ ID NO: 92011 - protein, 10 aa, Artificial Sequence
  Description of Artificial Sequence: Synthetic peptide
  Seed: WEDSLSPLHF (MAGC1_HUMAN)
WEDSLSPLHM

SEQ ID NO: 92012 - protein, 10 aa, Artificial Sequence
  Description of Artificial Sequence: Synthetic peptide
  Seed: YLEYREVPNS (MAGC1_HUMAN)
YLEYREVPNM

SEQ ID NO: 92013 - protein, 9 aa, Artificial Sequence
  Description of Artificial Sequence: Synthetic peptide
  Seed: SICSSSTSL (MAGC1_HUMAN)
SYCSSSTSL

SEQ ID NO: 92014 - protein, 9 aa, Artificial Sequence
  Description of Artificial Sequence: Synthetic peptide
  Seed: GTYASEEVI (MAGC1_HUMAN)
GVYASEEVW

SEQ ID NO: 92015 - protein, 10 aa, Artificial Sequence
  Description of Artificial Sequence: Synthetic peptide
  Seed: TGYFPVIFRK (MAGC1_HUMAN)
TTYFPVIFRS

SEQ ID NO: 92016 - protein, 9 aa, Artificial Sequence
  Description of Artificial Sequence: Synthetic peptide
  Seed: SSLSQSSPV (MAGC1_HUMAN)
SLLSQSSPI

SEQ ID NO: 92017 - protein, 9 aa, Artificial Sequence
  Description of Artificial Sequence: Synthetic peptide
  Seed: SSPPRYEFL (MAGC1_HUMAN)
SRPPRYEFV

SEQ ID NO: 92018 - protein, 10 aa, Artificial Sequence
  Description of Artificial Sequence: Synthetic peptide
  Seed: LILILSIIFI (MAGC1_HUMAN)
LDLILSIIFV

SEQ ID NO: 92019 - protein, 10 aa, Artificial Sequence
  Description of Artificial Sequence: Synthetic peptide
  Seed: SFFSSALLSI (MAGC1_HUMAN)
STFSSALLSF

SEQ ID NO: 92020 - protein, 10 aa, Artificial Sequence
  Description of Artificial Sequence: Synthetic peptide
  Seed: SSSSSTLLSL (MAGC1_HUMAN)
SVSSSTLLSV

SEQ ID NO: 92021 - protein, 10 aa, Artificial Sequence
  Description of Artificial Sequence: Synthetic peptide
  Seed: VPITFPSSYK (MAGC1_HUMAN)
VMITFPSSYR

SEQ ID NO: 92022 - protein, 10 aa, Artificial Sequence
  Description of Artificial Sequence: Synthetic peptide
  Seed: SQSSPVSSFP (MAGC1_HUMAN)
SQSSPVSSFL

SEQ ID NO: 92023 - protein, 9 aa, Artificial Sequence
  Description of Artificial Sequence: Synthetic peptide
  Seed: YTLASLLQS (MAGC1_HUMAN)
YTLASLLQL

SEQ ID NO: 92024 - protein, 11 aa, Artificial Sequence
  Description of Artificial Sequence: Synthetic peptide
  Seed: IPVSSSSSSTL (MAGC1_HUMAN)
IKVSSSSSSTF

SEQ ID NO: 92025 - protein, 10 aa, Artificial Sequence
  Description of Artificial Sequence: Synthetic peptide
  Seed: SSPESAQSTF (MAGC1_HUMAN)
SAPESAQSTL

SEQ ID NO: 92026 - protein, 10 aa, Artificial Sequence
  Description of Artificial Sequence: Synthetic peptide
  Seed: RKAREFIEIL (MAGC1_HUMAN)
RQAREFIEIY

SEQ ID NO: 92027 - protein, 11 aa, Artificial Sequence
  Description of Artificial Sequence: Synthetic peptide
  Seed: SPLQIPVSPSS (MAGC1_HUMAN)
SHLQIPVSPSF

SEQ ID NO: 92028 - protein, 10 aa, Artificial Sequence
  Description of Artificial Sequence: Synthetic peptide
  Seed: VSSSFSYTLL (MAGC1_HUMAN)
VVSSFSYTLY

SEQ ID NO: 92029 - protein, 10 aa, Artificial Sequence
  Description of Artificial Sequence: Synthetic peptide
  Seed: SSPESAQSAF (MAGC1_HUMAN)
SIPESAQSAF

SEQ ID NO: 92030 - protein, 9 aa, Artificial Sequence
  Description of Artificial Sequence: Synthetic peptide
  Seed: RLLILILSI (MAGC1_HUMAN)
RQLILILSM

SEQ ID NO: 92031 - protein, 11 aa, Artificial Sequence
  Description of Artificial Sequence: Synthetic peptide
  Seed: SRYTGYFPVIF (MAGC1_HUMAN)
SYYTGYFPVIM

SEQ ID NO: 92032 - protein, 9 aa, Artificial Sequence
  Description of Artificial Sequence: Synthetic peptide
  Seed: SPLQSPESA (MAGC1_HUMAN)
SALQSPESF

SEQ ID NO: 92033 - protein, 9 aa, Artificial Sequence
  Description of Artificial Sequence: Synthetic peptide
  Seed: NTVPITFPS (MAGC1_HUMAN)
NSVPITFPK

SEQ ID NO: 92034 - protein, 9 aa, Artificial Sequence
  Description of Artificial Sequence: Synthetic peptide
  Seed: EILFGISLR (MAGC1_HUMAN)
EYLFGISLR

SEQ ID NO: 92035 - protein, 10 aa, Artificial Sequence
  Description of Artificial Sequence: Synthetic peptide
  Seed: LQIVPSLPEW (MAGC1_HUMAN)
LMIVPSLPEM

SEQ ID NO: 92036 - protein, 11 aa, Artificial Sequence
  Description of Artificial Sequence: Synthetic peptide
  Seed: REVDPDDSYVF (MAGC1_HUMAN)
RFVDPDDSYVY

SEQ ID NO: 92037 - protein, 9 aa, Artificial Sequence
  Description of Artificial Sequence: Synthetic peptide
  Seed: SQNRLLILI (MAGC1_HUMAN)
SMNRLLILI

SEQ ID NO: 92038 - protein, 10 aa, Artificial Sequence
  Description of Artificial Sequence: Synthetic peptide
  Seed: LILILSIIFI (MAGC1_HUMAN)
LSLILSIIFV

SEQ ID NO: 92039 - protein, 9 aa, Artificial Sequence
  Description of Artificial Sequence: Synthetic peptide
  Seed: ISRYTGYFP (MAGC1_HUMAN)
IIRYTGYFA

SEQ ID NO: 92040 - protein, 10 aa, Artificial Sequence
  Description of Artificial Sequence: Synthetic peptide
  Seed: SFSYTLLSLF (MAGC1_HUMAN)
SWSYTLLSLY

SEQ ID NO: 92041 - protein, 10 aa, Artificial Sequence
  Description of Artificial Sequence: Synthetic peptide
  Seed: SSPESAQSAF (MAGC1_HUMAN)
SWPESAQSAF

SEQ ID NO: 92042 - protein, 11 aa, Artificial Sequence
  Description of Artificial Sequence: Synthetic peptide
  Seed: SPPEGPAQSPL (MAGC1_HUMAN)
SAPEGPAQSPM

SEQ ID NO: 92043 - protein, 9 aa, Artificial Sequence
  Description of Artificial Sequence: Synthetic peptide
  Seed: VIWDVLSGI (MAGC1_HUMAN)
VIWDVLSGA

SEQ ID NO: 92044 - protein, 9 aa, Artificial Sequence
  Description of Artificial Sequence: Synthetic peptide
  Seed: YTLLSLFQS (MAGC1_HUMAN)
YSLLSLFQI

SEQ ID NO: 92045 - protein, 10 aa, Artificial Sequence
  Description of Artificial Sequence: Synthetic peptide
  Seed: FPQSLLQIPM (MAGC1_HUMAN)
FKQSLLQIPF

SEQ ID NO: 92046 - protein, 10 aa, Artificial Sequence
  Description of Artificial Sequence: Synthetic peptide
  Seed: SIIFIKGTYA (MAGC1_HUMAN)
SAIFIKGTYV

SEQ ID NO: 92047 - protein, 9 aa, Artificial Sequence
  Description of Artificial Sequence: Synthetic peptide
  Seed: RKVVEFLAM (MAGC1_HUMAN)
RKVVEFLAV

SEQ ID NO: 92048 - protein, 10 aa, Artificial Sequence
  Description of Artificial Sequence: Synthetic peptide
  Seed: LQIPGSPSFS (MAGC1_HUMAN)
LVIPGSPSFY

SEQ ID NO: 92049 - protein, 10 aa, Artificial Sequence
  Description of Artificial Sequence: Synthetic peptide
  Seed: SSFPSSTSSS (MAGC1_HUMAN)
SLFPSSTSSM

SEQ ID NO: 92050 - protein, 9 aa, Artificial Sequence
  Description of Artificial Sequence: Synthetic peptide
  Seed: LFGISLREV (MAGC1_HUMAN)
LYGISLREY

SEQ ID NO: 92051 - protein, 9 aa, Artificial Sequence
  Description of Artificial Sequence: Synthetic peptide
  Seed: AASSSTLVS (MAGC1_HUMAN)
AISSSTLVY

SEQ ID NO: 92052 - protein, 9 aa, Artificial Sequence
  Description of Artificial Sequence: Synthetic peptide
  Seed: EVDPDDSYV (MAGC1_HUMAN)
EADPDDSYL

SEQ ID NO: 92053 - protein, 9 aa, Artificial Sequence
  Description of Artificial Sequence: Synthetic peptide
  Seed: SLIESEPLF (MAGC1_HUMAN)
SIIESEPLV

SEQ ID NO: 92054 - protein, 9 aa, Artificial Sequence
  Description of Artificial Sequence: Synthetic peptide
  Seed: FAFGEPREL (MAGC1_HUMAN)
FNFGEPREV

SEQ ID NO: 92055 - protein, 10 aa, Artificial Sequence
  Description of Artificial Sequence: Synthetic peptide
  Seed: QIPVSSSFSY (MAGC1_HUMAN)
QAPVSSSFSY

SEQ ID NO: 92056 - protein, 10 aa, Artificial Sequence
  Description of Artificial Sequence: Synthetic peptide
  Seed: PLQIPGSPSF (MAGC1_HUMAN)
PYQIPGSPSM

SEQ ID NO: 92057 - protein, 9 aa, Artificial Sequence
  Description of Artificial Sequence: Synthetic peptide
  Seed: SPLEGEDSL (MAGC1_HUMAN)
SALEGEDSY

SEQ ID NO: 92058 - protein, 9 aa, Artificial Sequence
  Description of Artificial Sequence: Synthetic peptide
  Seed: SLFQSFSER (MAGC1_HUMAN)
SFFQSFSEY

SEQ ID NO: 92059 - protein, 9 aa, Artificial Sequence
  Description of Artificial Sequence: Synthetic peptide
  Seed: FPSSYKDAL (MAGC1_HUMAN)
FPSSYKDAH

SEQ ID NO: 92060 - protein, 10 aa, Artificial Sequence
  Description of Artificial Sequence: Synthetic peptide
  Seed: EVIWDVLSGI (MAGC1_HUMAN)
EYIWDVLSGV

SEQ ID NO: 92061 - protein, 9 aa, Artificial Sequence
  Description of Artificial Sequence: Synthetic peptide
  Seed: LSDEQGMSQ (MAGC1_HUMAN)
LTDEQGMSI

SEQ ID NO: 92062 - protein, 10 aa, Artificial Sequence
  Description of Artificial Sequence: Synthetic peptide
  Seed: SFFSYTLASL (MAGC1_HUMAN)
SLFSYTLASI

SEQ ID NO: 92063 - protein, 10 aa, Artificial Sequence
  Description of Artificial Sequence: Synthetic peptide
  Seed: MSPLYFPQSP (MAGC1_HUMAN)
MDPLYFPQSA

SEQ ID NO: 92064 - protein, 9 aa, Artificial Sequence
  Description of Artificial Sequence: Synthetic peptide
  Seed: TLLSLFQSF (MAGC1_HUMAN)
TMLSLFQSY

SEQ ID NO: 92065 - protein, 10 aa, Artificial Sequence
  Description of Artificial Sequence: Synthetic peptide
  Seed: QRPVSSFFSY (MAGC1_HUMAN)
QAPVSSFFSY

SEQ ID NO: 92066 - protein, 9 aa, Artificial Sequence
  Description of Artificial Sequence: Synthetic peptide
  Seed: AQSPLQIPV (MAGC1_HUMAN)
AESPLQIPT

SEQ ID NO: 92067 - protein, 9 aa, Artificial Sequence
  Description of Artificial Sequence: Synthetic peptide
  Seed: KDSLSPLEI (MAGC1_HUMAN)
KQSLSPLEF

SEQ ID NO: 92068 - protein, 9 aa, Artificial Sequence
  Description of Artificial Sequence: Synthetic peptide
  Seed: FAFGEPREL (MAGC1_HUMAN)
FMFGEPREK

SEQ ID NO: 92069 - protein, 9 aa, Artificial Sequence
  Description of Artificial Sequence: Synthetic peptide
  Seed: KAREFIEIL (MAGC1_HUMAN)
KSREFIEII

SEQ ID NO: 92070 - protein, 10 aa, Artificial Sequence
  Description of Artificial Sequence: Synthetic peptide
  Seed: RYTGYFPVIF (MAGC1_HUMAN)
RYTGYFPVIM

SEQ ID NO: 92071 - protein, 9 aa, Artificial Sequence
  Description of Artificial Sequence: Synthetic peptide
  Seed: YQVKQPITK (MAGC1_HUMAN)
YVVKQPITM

SEQ ID NO: 92072 - protein, 9 aa, Artificial Sequence
  Description of Artificial Sequence: Synthetic peptide
  Seed: SQSSPVSSF (MAGC1_HUMAN)
SPSSPVSSY

SEQ ID NO: 92073 - protein, 9 aa, Artificial Sequence
  Description of Artificial Sequence: Synthetic peptide
  Seed: RAGREHFAF (MAGC1_HUMAN)
RRGREHFAM

SEQ ID NO: 92074 - protein, 9 aa, Artificial Sequence
  Description of Artificial Sequence: Synthetic peptide
  Seed: SSLSQSSPV (MAGC1_HUMAN)
SSLSQSSPK

SEQ ID NO: 92075 - protein, 9 aa, Artificial Sequence
  Description of Artificial Sequence: Synthetic peptide
  Seed: NTVPITFPS (MAGC1_HUMAN)
NLVPITFPK

SEQ ID NO: 92076 - protein, 10 aa, Artificial Sequence
  Description of Artificial Sequence: Synthetic peptide
  Seed: WGPRAHSEVI (MAGC1_HUMAN)
WFPRAHSEVI

SEQ ID NO: 92077 - protein, 9 aa, Artificial Sequence
  Description of Artificial Sequence: Synthetic peptide
  Seed: IIFIKGTYA (MAGC1_HUMAN)
IMFIKGTYL

SEQ ID NO: 92078 - protein, 9 aa, Artificial Sequence
  Description of Artificial Sequence: Synthetic peptide
  Seed: LQIPMTSSF (MAGC1_HUMAN)
LWIPMTSSY

SEQ ID NO: 92079 - protein, 9 aa, Artificial Sequence
  Description of Artificial Sequence: Synthetic peptide
  Seed: QVKQPITKA (MAGC1_HUMAN)
QPKQPITKL

SEQ ID NO: 92080 - protein, 9 aa, Artificial Sequence
  Description of Artificial Sequence: Synthetic peptide
  Seed: SICSSSTSL (MAGC1_HUMAN)
SICSSSTSY

SEQ ID NO: 92081 - protein, 9 aa, Artificial Sequence
  Description of Artificial Sequence: Synthetic peptide
  Seed: SFSSTLVSL (MAGC1_HUMAN)
SISSTLVSM

SEQ ID NO: 92082 - protein, 11 aa, Artificial Sequence
  Description of Artificial Sequence: Synthetic peptide
  Seed: TTDDSTATESA (MAGC1_HUMAN)
TGDDSTATESF

SEQ ID NO: 92083 - protein, 10 aa, Artificial Sequence
  Description of Artificial Sequence: Synthetic peptide
  Seed: LLQIPMTSSF (MAGC1_HUMAN)
LNQIPMTSSF

SEQ ID NO: 92084 - protein, 10 aa, Artificial Sequence
  Description of Artificial Sequence: Synthetic peptide
  Seed: MPTAGMPSLL (MAGC1_HUMAN)
MVTAGMPSLA

SEQ ID NO: 92085 - protein, 10 aa, Artificial Sequence
  Description of Artificial Sequence: Synthetic peptide
  Seed: FSSSTSLSPF (MAGC1_HUMAN)
FGSSTSLSPY

SEQ ID NO: 92086 - protein, 10 aa, Artificial Sequence
  Description of Artificial Sequence: Synthetic peptide
  Seed: FAQSSLQIPV (MAGC1_HUMAN)
FTQSSLQIPL

SEQ ID NO: 92087 - protein, 9 aa, Artificial Sequence
  Description of Artificial Sequence: Synthetic peptide
  Seed: ESSSPVDEY (MAGC1_HUMAN)
EISSPVDEY

SEQ ID NO: 92088 - protein, 9 aa, Artificial Sequence
  Description of Artificial Sequence: Synthetic peptide
  Seed: SLPQSFPES (MAGC1_HUMAN)
SVPQSFPEV

SEQ ID NO: 92089 - protein, 9 aa, Artificial Sequence
  Description of Artificial Sequence: Synthetic peptide
  Seed: SSPPRYEFL (MAGC1_HUMAN)
SHPPRYEFY

SEQ ID NO: 92090 - protein, 9 aa, Artificial Sequence
  Description of Artificial Sequence: Synthetic peptide
  Seed: SSPPRYEFL (MAGC1_HUMAN)
SYPPRYEFL

SEQ ID NO: 92091 - protein, 10 aa, Artificial Sequence
  Description of Artificial Sequence: Synthetic peptide
  Seed: SQSPPEGEDV (MAGC1_HUMAN)
SHSPPEGEDF

SEQ ID NO: 92092 - protein, 9 aa, Artificial Sequence
  Description of Artificial Sequence: Synthetic peptide
  Seed: KVVEFLAML (MAGC1_HUMAN)
KQVEFLAMR

SEQ ID NO: 92093 - protein, 9 aa, Artificial Sequence
  Description of Artificial Sequence: Synthetic peptide
  Seed: KVDELARFL (MAGC1_HUMAN)
KTDELARFY

SEQ ID NO: 92094 - protein, 9 aa, Artificial Sequence
  Description of Artificial Sequence: Synthetic peptide
  Seed: SSHESPQSP (MAGC1_HUMAN)
SVHESPQSM

SEQ ID NO: 92095 - protein, 9 aa, Artificial Sequence
  Description of Artificial Sequence: Synthetic peptide
  Seed: IPVSSSFSY (MAGC1_HUMAN)
IKVSSSFSI

SEQ ID NO: 92096 - protein, 9 aa, Artificial Sequence
  Description of Artificial Sequence: Synthetic peptide
  Seed: RTHSTFEGF (MAGC1_HUMAN)
RQHSTFEGM

SEQ ID NO: 92097 - protein, 10 aa, Artificial Sequence
  Description of Artificial Sequence: Synthetic peptide
  Seed: TGYFPVIFRK (MAGC1_HUMAN)
TTYFPVIFRL

SEQ ID NO: 92098 - protein, 11 aa, Artificial Sequence
  Description of Artificial Sequence: Synthetic peptide
  Seed: SFFSSALLSIF (MAGC1_HUMAN)
STFSSALLSIF

SEQ ID NO: 92099 - protein, 9 aa, Artificial Sequence
  Description of Artificial Sequence: Synthetic peptide
  Seed: VSSSFSYTL (MAGC1_HUMAN)
VFSSFSYTY

SEQ ID NO: 92100 - protein, 9 aa, Artificial Sequence
  Description of Artificial Sequence: Synthetic peptide
  Seed: FTYTLDEKV (MAGC1_HUMAN)
FMYTLDEKL

SEQ ID NO: 92101 - protein, 9 aa, Artificial Sequence
  Description of Artificial Sequence: Synthetic peptide
  Seed: ASSFFSSAL (MAGC1_HUMAN)
AWSFFSSAF

SEQ ID NO: 92102 - protein, 9 aa, Artificial Sequence
  Description of Artificial Sequence: Synthetic peptide
  Seed: YTSSSDTLL (MAGC1_HUMAN)
YISSSDTLM

SEQ ID NO: 92103 - protein, 11 aa, Artificial Sequence
  Description of Artificial Sequence: Synthetic peptide
  Seed: RSFSSTLLSIF (MAGC1_HUMAN)
RLFSSTLLSIM

SEQ ID NO: 92104 - protein, 10 aa, Artificial Sequence
  Description of Artificial Sequence: Synthetic peptide
  Seed: RKVVEFLAML (MAGC1_HUMAN)
RTVVEFLAMV

SEQ ID NO: 92105 - protein, 10 aa, Artificial Sequence
  Description of Artificial Sequence: Synthetic peptide
  Seed: LLKYQVKQPI (MAGC1_HUMAN)
LLKYQVKQPV

SEQ ID NO: 92106 - protein, 9 aa, Artificial Sequence
  Description of Artificial Sequence: Synthetic peptide
  Seed: RAGREHFAF (MAGC1_HUMAN)
RMGREHFAW

SEQ ID NO: 92107 - protein, 10 aa, Artificial Sequence
  Description of Artificial Sequence: Synthetic peptide
  Seed: DVLSGIGVRA (MAGC1_HUMAN)
DTLSGIGVRV

SEQ ID NO: 92108 - protein, 9 aa, Artificial Sequence
  Description of Artificial Sequence: Synthetic peptide
  Seed: TLLSIFQSS (MAGC1_HUMAN)
TLLSIFQSL

SEQ ID NO: 92109 - protein, 9 aa, Artificial Sequence
  Description of Artificial Sequence: Synthetic peptide
  Seed: VIWDVLSGI (MAGC1_HUMAN)
VSWDVLSGI

SEQ ID NO: 92110 - protein, 9 aa, Artificial Sequence
  Description of Artificial Sequence: Synthetic peptide
  Seed: FSEESSSPV (MAGC1_HUMAN)
FMEESSSPA

SEQ ID NO: 92111 - protein, 10 aa, Artificial Sequence
  Description of Artificial Sequence: Synthetic peptide
  Seed: MSQNRLLILI (MAGC1_HUMAN)
MMQNRLLILL

SEQ ID NO: 92112 - protein, 10 aa, Artificial Sequence
  Description of Artificial Sequence: Synthetic peptide
  Seed: SPLQSPVSSF (MAGC1_HUMAN)
SMLQSPVSSF

SEQ ID NO: 92113 - protein, 9 aa, Artificial Sequence
  Description of Artificial Sequence: Synthetic peptide
  Seed: FQSSLQSPV (MAGC1_HUMAN)
FMSSLQSPA

SEQ ID NO: 92114 - protein, 11 aa, Artificial Sequence
  Description of Artificial Sequence: Synthetic peptide
  Seed: IPVSSSSSSTL (MAGC1_HUMAN)
IAVSSSSSSTY

SEQ ID NO: 92115 - protein, 11 aa, Artificial Sequence
  Description of Artificial Sequence: Synthetic peptide
  Seed: SPLQIPMTSSF (MAGC1_HUMAN)
SMLQIPMTSSY

SEQ ID NO: 92116 - protein, 9 aa, Artificial Sequence
  Description of Artificial Sequence: Synthetic peptide
  Seed: SSSSSSSTL (MAGC1_HUMAN)
SASSSSSTW

SEQ ID NO: 92117 - protein, 9 aa, Artificial Sequence
  Description of Artificial Sequence: Synthetic peptide
  Seed: RAHSEVIKR (MAGC1_HUMAN)
RTHSEVIKF

SEQ ID NO: 92118 - protein, 10 aa, Artificial Sequence
  Description of Artificial Sequence: Synthetic peptide
  Seed: YTGYFPVIFR (MAGC1_HUMAN)
YSGYFPVIFK

SEQ ID NO: 92119 - protein, 9 aa, Artificial Sequence
  Description of Artificial Sequence: Synthetic peptide
  Seed: VLSGIGVRA (MAGC1_HUMAN)
VLSGIGVRI

SEQ ID NO: 92120 - protein, 9 aa, Artificial Sequence
  Description of Artificial Sequence: Synthetic peptide
  Seed: MPSLLQSSS (MAGC1_HUMAN)
MTSLLQSSM

SEQ ID NO: 92121 - protein, 11 aa, Artificial Sequence
  Description of Artificial Sequence: Synthetic peptide
  Seed: MGDKDMPTAGM (MAGC1_HUMAN)
MADKDMPTAGL

SEQ ID NO: 92122 - protein, 10 aa, Artificial Sequence
  Description of Artificial Sequence: Synthetic peptide
  Seed: PLQIPVSSSF (MAGC1_HUMAN)
PYQIPVSSSM

SEQ ID NO: 92123 - protein, 9 aa, Artificial Sequence
  Description of Artificial Sequence: Synthetic peptide
  Seed: SSSSTLLSL (MAGC1_HUMAN)
SYSSTLLSY

SEQ ID NO: 92124 - protein, 9 aa, Artificial Sequence
  Description of Artificial Sequence: Synthetic peptide
  Seed: AQSPLQSPV (MAGC1_HUMAN)
AVSPLQSPI

SEQ ID NO: 92125 - protein, 9 aa, Artificial Sequence
  Description of Artificial Sequence: Synthetic peptide
  Seed: GSPSFSSTL (MAGC1_HUMAN)
GSPSFSSTM

SEQ ID NO: 92126 - protein, 10 aa, Artificial Sequence
  Description of Artificial Sequence: Synthetic peptide
  Seed: NTVPITFPSS (MAGC1_HUMAN)
NAVPITFPSI

SEQ ID NO: 92127 - protein, 9 aa, Artificial Sequence
  Description of Artificial Sequence: Synthetic peptide
  Seed: SSPECTQST (MAGC1_HUMAN)
SPPECTQSL

SEQ ID NO: 92128 - protein, 10 aa, Artificial Sequence
  Description of Artificial Sequence: Synthetic peptide
  Seed: VSSSSSSTLL (MAGC1_HUMAN)
VLSSSSSTLF

SEQ ID NO: 92129 - protein, 10 aa, Artificial Sequence
  Description of Artificial Sequence: Synthetic peptide
  Seed: LSQSSPVSSF (MAGC1_HUMAN)
LTQSSPVSSM

SEQ ID NO: 92130 - protein, 10 aa, Artificial Sequence
  Description of Artificial Sequence: Synthetic peptide
  Seed: RAGREHFAFG (MAGC1_HUMAN)
RWGREHFAFI

SEQ ID NO: 92131 - protein, 10 aa, Artificial Sequence
  Description of Artificial Sequence: Synthetic peptide
  Seed: RYTGYFPVIF (MAGC1_HUMAN)
RKTGYFPVIW

SEQ ID NO: 92132 - protein, 9 aa, Artificial Sequence
  Description of Artificial Sequence: Synthetic peptide
  Seed: YQVKQPITK (MAGC1_HUMAN)
YYVKQPITM

SEQ ID NO: 92133 - protein, 9 aa, Artificial Sequence
  Description of Artificial Sequence: Synthetic peptide
  Seed: KVWVQEHYL (MAGC1_HUMAN)
KSWVQEHYM

SEQ ID NO: 92134 - protein, 9 aa, Artificial Sequence
  Description of Artificial Sequence: Synthetic peptide
  Seed: SLIESEPLF (MAGC1_HUMAN)
SSIESEPLF

SEQ ID NO: 92135 - protein, 9 aa, Artificial Sequence
  Description of Artificial Sequence: Synthetic peptide
  Seed: GFPQSVLQI (MAGC1_HUMAN)
GFPQSVLQM

SEQ ID NO: 92136 - protein, 11 aa, Artificial Sequence
  Description of Artificial Sequence: Synthetic peptide
  Seed: SSSSSSTLLSL (MAGC1_HUMAN)
SPSSSSTLLSW

SEQ ID NO: 92137 - protein, 10 aa, Artificial Sequence
  Description of Artificial Sequence: Synthetic peptide
  Seed: EEFQSSLQSP (MAGC1_HUMAN)
EEFQSSLQSI

SEQ ID NO: 92138 - protein, 9 aa, Artificial Sequence
  Description of Artificial Sequence: Synthetic peptide
  Seed: SQSSPVSSF (MAGC1_HUMAN)
SCSSPVSSL

SEQ ID NO: 92139 - protein, 9 aa, Artificial Sequence
  Description of Artificial Sequence: Synthetic peptide
  Seed: RYTGYFPVI (MAGC1_HUMAN)
RRTGYFPVM

SEQ ID NO: 92140 - protein, 10 aa, Artificial Sequence
  Description of Artificial Sequence: Synthetic peptide
  Seed: SVLQIPVSAA (MAGC1_HUMAN)
SILQIPVSAL

SEQ ID NO: 92141 - protein, 9 aa, Artificial Sequence
  Description of Artificial Sequence: Synthetic peptide
  Seed: FSEESSSPV (MAGC1_HUMAN)
FQEESSSPI

SEQ ID NO: 92142 - protein, 10 aa, Artificial Sequence
  Description of Artificial Sequence: Synthetic peptide
  Seed: SLFQSSPERT (MAGC1_HUMAN)
SVFQSSPERL

SEQ ID NO: 92143 - protein, 9 aa, Artificial Sequence
  Description of Artificial Sequence: Synthetic peptide
  Seed: SPLQNSQSS (MAGC1_HUMAN)
SPLQNSQSF

SEQ ID NO: 92144 - protein, 10 aa, Artificial Sequence
  Description of Artificial Sequence: Synthetic peptide
  Seed: ITKAEMLTNV (MAGC1_HUMAN)
IVKAEMLTNV

SEQ ID NO: 92145 - protein, 9 aa, Artificial Sequence
  Description of Artificial Sequence: Synthetic peptide
  Seed: TTDDSTATE (MAGC1_HUMAN)
TLDDSTATF

SEQ ID NO: 92146 - protein, 9 aa, Artificial Sequence
  Description of Artificial Sequence: Synthetic peptide
  Seed: IIDTTDDST (MAGC1_HUMAN)
IGDTTDDSM

SEQ ID NO: 92147 - protein, 9 aa, Artificial Sequence
  Description of Artificial Sequence: Synthetic peptide
  Seed: SSPECTQST (MAGC1_HUMAN)
STPECTQSM

SEQ ID NO: 92148 - protein, 9 aa, Artificial Sequence
  Description of Artificial Sequence: Synthetic peptide
  Seed: FSSALLSIF (MAGC1_HUMAN)
FTSALLSII

SEQ ID NO: 92149 - protein, 11 aa, Artificial Sequence
  Description of Artificial Sequence: Synthetic peptide
  Seed: IPMTSSFSSTL (MAGC1_HUMAN)
IFMTSSFSSTW

SEQ ID NO: 92150 - protein, 9 aa, Artificial Sequence
  Description of Artificial Sequence: Synthetic peptide
  Seed: FQSSPERTH (MAGC1_HUMAN)
FMSSPERTY

SEQ ID NO: 92151 - protein, 10 aa, Artificial Sequence
  Description of Artificial Sequence: Synthetic peptide
  Seed: SPSSSSTLLS (MAGC1_HUMAN)
SPSSSSTLLA

SEQ ID NO: 92152 - protein, 10 aa, Artificial Sequence
  Description of Artificial Sequence: Synthetic peptide
  Seed: RLLILILSII (MAGC1_HUMAN)
RSLILILSIV

SEQ ID NO: 92153 - protein, 9 aa, Artificial Sequence
  Description of Artificial Sequence: Synthetic peptide
  Seed: IPVSSSFSY (MAGC1_HUMAN)
IHVSSSFSY

SEQ ID NO: 92154 - protein, 9 aa, Artificial Sequence
  Description of Artificial Sequence: Synthetic peptide
  Seed: WVQEHYLEY (MAGC1_HUMAN)
WAQEHYLER

SEQ ID NO: 92155 - protein, 11 aa, Artificial Sequence
  Description of Artificial Sequence: Synthetic peptide
  Seed: QSSPESAQSTF (MAGC1_HUMAN)
QQSPESAQSTY

SEQ ID NO: 92156 - protein, 10 aa, Artificial Sequence
  Description of Artificial Sequence: Synthetic peptide
  Seed: SLQIPVSPSF (MAGC1_HUMAN)
SGQIPVSPSM

SEQ ID NO: 92157 - protein, 9 aa, Artificial Sequence
  Description of Artificial Sequence: Synthetic peptide
  Seed: TSLSLPQSF (MAGC1_HUMAN)
TLLSLPQSW

SEQ ID NO: 92158 - protein, 10 aa, Artificial Sequence
  Description of Artificial Sequence: Synthetic peptide
  Seed: EMLTNVISRY (MAGC1_HUMAN)
EALTNVISRW

SEQ ID NO: 92159 - protein, 10 aa, Artificial Sequence
  Description of Artificial Sequence: Synthetic peptide
  Seed: AASSSTLVSI (MAGC1_HUMAN)
ASSSSTLVSW

SEQ ID NO: 92160 - protein, 11 aa, Artificial Sequence
  Description of Artificial Sequence: Synthetic peptide
  Seed: RSFSSTLLSIF (MAGC1_HUMAN)
RQFSSTLLSIH

SEQ ID NO: 92161 - protein, 10 aa, Artificial Sequence
  Description of Artificial Sequence: Synthetic peptide
  Seed: IIDTTDDSTA (MAGC1_HUMAN)
IVDTTDDSTL

SEQ ID NO: 92162 - protein, 9 aa, Artificial Sequence
  Description of Artificial Sequence: Synthetic peptide
  Seed: SSFFSSALL (MAGC1_HUMAN)
SKFFSSALI

SEQ ID NO: 92163 - protein, 9 aa, Artificial Sequence
  Description of Artificial Sequence: Synthetic peptide
  Seed: LQIPVSSSS (MAGC1_HUMAN)
LWIPVSSSY

SEQ ID NO: 92164 - protein, 10 aa, Artificial Sequence
  Description of Artificial Sequence: Synthetic peptide
  Seed: FPQSPLQIPV (MAGC1_HUMAN)
FIQSPLQIPY

SEQ ID NO: 92165 - protein, 9 aa, Artificial Sequence
  Description of Artificial Sequence: Synthetic peptide
  Seed: GFPQSVLQI (MAGC1_HUMAN)
GYPQSVLQY

SEQ ID NO: 92166 - protein, 9 aa, Artificial Sequence
  Description of Artificial Sequence: Synthetic peptide
  Seed: SRSFSSTLL (MAGC1_HUMAN)
SPSFSSTLM

SEQ ID NO: 92167 - protein, 10 aa, Artificial Sequence
  Description of Artificial Sequence: Synthetic peptide
  Seed: VSSSSSSSTL (MAGC1_HUMAN)
VQSSSSSSTW

SEQ ID NO: 92168 - protein, 10 aa, Artificial Sequence
  Description of Artificial Sequence: Synthetic peptide
  Seed: EVIWDVLSGI (MAGC1_HUMAN)
EAIWDVLSGR

SEQ ID NO: 92169 - protein, 9 aa, Artificial Sequence
  Description of Artificial Sequence: Synthetic peptide
  Seed: WVQEHYLEY (MAGC1_HUMAN)
WPQEHYLEW

SEQ ID NO: 92170 - protein, 9 aa, Artificial Sequence
  Description of Artificial Sequence: Synthetic peptide
  Seed: LSDEQGMSQ (MAGC1_HUMAN)
LADEQGMSL

SEQ ID NO: 92171 - protein, 9 aa, Artificial Sequence
  Description of Artificial Sequence: Synthetic peptide
  Seed: MTSSFSSTL (MAGC1_HUMAN)
MVSSFSSTF

SEQ ID NO: 92172 - protein, 9 aa, Artificial Sequence
  Description of Artificial Sequence: Synthetic peptide
  Seed: FPSSTSSSL (MAGC1_HUMAN)
FHSSTSSSF

SEQ ID NO: 92173 - protein, 9 aa, Artificial Sequence
  Description of Artificial Sequence: Synthetic peptide
  Seed: FSSTLVSLF (MAGC1_HUMAN)
FPSTLVSLI

SEQ ID NO: 92174 - protein, 10 aa, Artificial Sequence
  Description of Artificial Sequence: Synthetic peptide
  Seed: FFSYTLASLL (MAGC1_HUMAN)
FTSYTLASLM

SEQ ID NO: 92175 - protein, 10 aa, Artificial Sequence
  Description of Artificial Sequence: Synthetic peptide
  Seed: SFFSYTLASL (MAGC1_HUMAN)
SIFSYTLASI

SEQ ID NO: 92176 - protein, 9 aa, Artificial Sequence
  Description of Artificial Sequence: Synthetic peptide
  Seed: TLDEKVDEL (MAGC1_HUMAN)
TYDEKVDEY

SEQ ID NO: 92177 - protein, 9 aa, Artificial Sequence
  Description of Artificial Sequence: Synthetic peptide
  Seed: LQIPVSAAS (MAGC1_HUMAN)
LVIPVSAAM

SEQ ID NO: 92178 - protein, 9 aa, Artificial Sequence
  Description of Artificial Sequence: Synthetic peptide
  Seed: VSAASSSTL (MAGC1_HUMAN)
VIAASSSTM

SEQ ID NO: 92179 - protein, 10 aa, Artificial Sequence
  Description of Artificial Sequence: Synthetic peptide
  Seed: VISFSSSTSL (MAGC1_HUMAN)
VVSFSSSTSY

SEQ ID NO: 92180 - protein, 9 aa, Artificial Sequence
  Description of Artificial Sequence: Synthetic peptide
  Seed: TSSFSSTLL (MAGC1_HUMAN)
TSSFSSTLM

SEQ ID NO: 92181 - protein, 9 aa, Artificial Sequence
  Description of Artificial Sequence: Synthetic peptide
  Seed: LPQSFPESS (MAGC1_HUMAN)
LPQSFPESF

SEQ ID NO: 92182 - protein, 9 aa, Artificial Sequence
  Description of Artificial Sequence: Synthetic peptide
  Seed: VEERAQAII (MAGC1_HUMAN)
VEERAQAIM

SEQ ID NO: 92183 - protein, 9 aa, Artificial Sequence
  Description of Artificial Sequence: Synthetic peptide
  Seed: FSSTLLSIL (MAGC1_HUMAN)
FSSTLLSII

SEQ ID NO: 92184 - protein, 9 aa, Artificial Sequence
  Description of Artificial Sequence: Synthetic peptide
  Seed: SLFQSFSER (MAGC1_HUMAN)
SVFQSFSEK

SEQ ID NO: 92185 - protein, 9 aa, Artificial Sequence
  Description of Artificial Sequence: Synthetic peptide
  Seed: SAPEGEDSL (MAGC1_HUMAN)
SAPEGEDSI

SEQ ID NO: 92186 - protein, 11 aa, Artificial Sequence
  Description of Artificial Sequence: Synthetic peptide
  Seed: SASSSVMSPSF (MAGC1_HUMAN)
SVSSSVMSPSW

SEQ ID NO: 92187 - protein, 9 aa, Artificial Sequence
  Description of Artificial Sequence: Synthetic peptide
  Seed: FSYTLASLL (MAGC1_HUMAN)
FTYTLASLI

SEQ ID NO: 92188 - protein, 10 aa, Artificial Sequence
  Description of Artificial Sequence: Synthetic peptide
  Seed: HFAFGEPREL (MAGC1_HUMAN)
HYAFGEPREM

SEQ ID NO: 92189 - protein, 9 aa, Artificial Sequence
  Description of Artificial Sequence: Synthetic peptide
  Seed: EFIEILFGI (MAGC1_HUMAN)
EQIEILFGM

SEQ ID NO: 92190 - protein, 9 aa, Artificial Sequence
  Description of Artificial Sequence: Synthetic peptide
  Seed: GTYASEEVI (MAGC1_HUMAN)
GSYASEEVY

SEQ ID NO: 92191 - protein, 10 aa, Artificial Sequence
  Description of Artificial Sequence: Synthetic peptide
  Seed: FFSYTLASLL (MAGC1_HUMAN)
FSSYTLASLM

SEQ ID NO: 92192 - protein, 10 aa, Artificial Sequence
  Description of Artificial Sequence: Synthetic peptide
  Seed: RKVVEFLAML (MAGC1_HUMAN)
RHVVEFLAMI

SEQ ID NO: 92193 - protein, 9 aa, Artificial Sequence
  Description of Artificial Sequence: Synthetic peptide
  Seed: FEGFPQSVL (MAGC1_HUMAN)
FEGFPQSVY

SEQ ID NO: 92194 - protein, 10 aa, Artificial Sequence
  Description of Artificial Sequence: Synthetic peptide
  Seed: YTLLSLFQSS (MAGC1_HUMAN)
YNLLSLFQSI

SEQ ID NO: 92195 - protein, 11 aa, Artificial Sequence
  Description of Artificial Sequence: Synthetic peptide
  Seed: QSSPERTQSTF (MAGC1_HUMAN)
QASPERTQSTW

SEQ ID NO: 92196 - protein, 9 aa, Artificial Sequence
  Description of Artificial Sequence: Synthetic peptide
  Seed: SSFFSSALL (MAGC1_HUMAN)
SVFFSSALL

SEQ ID NO: 92197 - protein, 9 aa, Artificial Sequence
  Description of Artificial Sequence: Synthetic peptide
  Seed: SLSPHYFPQ (MAGC1_HUMAN)
SLSPHYFPL

SEQ ID NO: 92198 - protein, 9 aa, Artificial Sequence
  Description of Artificial Sequence: Synthetic peptide
  Seed: HFPQSPPEW (MAGC1_HUMAN)
HWPQSPPEF

SEQ ID NO: 92199 - protein, 9 aa, Artificial Sequence
  Description of Artificial Sequence: Synthetic peptide
  Seed: CTQSTFEGF (MAGC1_HUMAN)
CFQSTFEGW

SEQ ID NO: 92200 - protein, 10 aa, Artificial Sequence
  Description of Artificial Sequence: Synthetic peptide
  Seed: SPLQSPVSSF (MAGC1_HUMAN)
SKLQSPVSSF

SEQ ID NO: 92201 - protein, 9 aa, Artificial Sequence
  Description of Artificial Sequence: Synthetic peptide
  Seed: FLAMLKNTV (MAGC1_HUMAN)
FAAMLKNTL

SEQ ID NO: 92202 - protein, 9 aa, Artificial Sequence
  Description of Artificial Sequence: Synthetic peptide
  Seed: FSERTQSTF (MAGC1_HUMAN)
FMERTQSTY

SEQ ID NO: 92203 - protein, 10 aa, Artificial Sequence
  Description of Artificial Sequence: Synthetic peptide
  Seed: ICSSSTSLSL (MAGC1_HUMAN)
IYSSSTSLSY

SEQ ID NO: 92204 - protein, 9 aa, Artificial Sequence
  Description of Artificial Sequence: Synthetic peptide
  Seed: SSSSSSSTL (MAGC1_HUMAN)
SVSSSSSTY

SEQ ID NO: 92205 - protein, 9 aa, Artificial Sequence
  Description of Artificial Sequence: Synthetic peptide
  Seed: RAGREHFAF (MAGC1_HUMAN)
RVGREHFAF

SEQ ID NO: 92206 - protein, 10 aa, Artificial Sequence
  Description of Artificial Sequence: Synthetic peptide
  Seed: GTYASEEVIW (MAGC1_HUMAN)
GQYASEEVIF

SEQ ID NO: 92207 - protein, 9 aa, Artificial Sequence
  Description of Artificial Sequence: Synthetic peptide
  Seed: FSSTLLSIL (MAGC1_HUMAN)
FVSTLLSII

SEQ ID NO: 92208 - protein, 9 aa, Artificial Sequence
  Description of Artificial Sequence: Synthetic peptide
  Seed: FFSYTLASL (MAGC1_HUMAN)
FASYTLASL

SEQ ID NO: 92209 - protein, 11 aa, Artificial Sequence
  Description of Artificial Sequence: Synthetic peptide
  Seed: LQIPVSSSFSY (MAGC1_HUMAN)
LWIPVSSSFSW

SEQ ID NO: 92210 - protein, 9 aa, Artificial Sequence
  Description of Artificial Sequence: Synthetic peptide
  Seed: SSFFSSALL (MAGC1_HUMAN)
SVFFSSALA

SEQ ID NO: 92211 - protein, 9 aa, Artificial Sequence
  Description of Artificial Sequence: Synthetic peptide
  Seed: SESLIESEP (MAGC1_HUMAN)
SESLIESEC

SEQ ID NO: 92212 - protein, 9 aa, Artificial Sequence
  Description of Artificial Sequence: Synthetic peptide
  Seed: YTSSSDTLL (MAGC1_HUMAN)
YASSSDTLV

SEQ ID NO: 92213 - protein, 9 aa, Artificial Sequence
  Description of Artificial Sequence: Synthetic peptide
  Seed: SSFFSSALL (MAGC1_HUMAN)
SQFFSSALG

SEQ ID NO: 92214 - protein, 9 aa, Artificial Sequence
  Description of Artificial Sequence: Synthetic peptide
  Seed: SQSSPVSSF (MAGC1_HUMAN)
SLSSPVSSL

SEQ ID NO: 92215 - protein, 10 aa, Artificial Sequence
  Description of Artificial Sequence: Synthetic peptide
  Seed: PLQIPVSRSF (MAGC1_HUMAN)
PRQIPVSRSY

SEQ ID NO: 92216 - protein, 9 aa, Artificial Sequence
  Description of Artificial Sequence: Synthetic peptide
  Seed: AEMLTNVIS (MAGC1_HUMAN)
AEMLTNVIT

SEQ ID NO: 92217 - protein, 9 aa, Artificial Sequence
  Description of Artificial Sequence: Synthetic peptide
  Seed: GYFPVIFRK (MAGC1_HUMAN)
GFFPVIFRY

SEQ ID NO: 92218 - protein, 10 aa, Artificial Sequence
  Description of Artificial Sequence: Synthetic peptide
  Seed: SRYTGYFPVI (MAGC1_HUMAN)
SGYTGYFPVW

SEQ ID NO: 92219 - protein, 11 aa, Artificial Sequence
  Description of Artificial Sequence: Synthetic peptide
  Seed: SASSSVMSPSF (MAGC1_HUMAN)
SQSSSVMSPSM

SEQ ID NO: 92220 - protein, 9 aa, Artificial Sequence
  Description of Artificial Sequence: Synthetic peptide
  Seed: SSSESPQSC (MAGC1_HUMAN)
SSSESPQSF

SEQ ID NO: 92221 - protein, 10 aa, Artificial Sequence
  Description of Artificial Sequence: Synthetic peptide
  Seed: SFPSSTSSSL (MAGC1_HUMAN)
SEPSSTSSSM

SEQ ID NO: 92222 - protein, 10 aa, Artificial Sequence
  Description of Artificial Sequence: Synthetic peptide
  Seed: HSPQSPPEGM (MAGC1_HUMAN)
HAPQSPPEGY

SEQ ID NO: 92223 - protein, 10 aa, Artificial Sequence
  Description of Artificial Sequence: Synthetic peptide
  Seed: SPLQIPMTSS (MAGC1_HUMAN)
SPLQIPMTSV

SEQ ID NO: 92224 - protein, 10 aa, Artificial Sequence
  Description of Artificial Sequence: Synthetic peptide
  Seed: VPITFPSSYK (MAGC1_HUMAN)
VSITFPSSYK

SEQ ID NO: 92225 - protein, 8 aa, Artificial Sequence
  Description of Artificial Sequence: Synthetic peptide
  Seed: SSPPRYEF (MAGC1_HUMAN)
STPPRYEL

SEQ ID NO: 92226 - protein, 8 aa, Artificial Sequence
  Description of Artificial Sequence: Synthetic peptide
  Seed: SFSSSTSL (MAGC1_HUMAN)
SFSSSTSM

SEQ ID NO: 92227 - protein, 9 aa, Artificial Sequence
  Description of Artificial Sequence: Synthetic peptide
  Seed: AQSPLQIPV (MAGC1_HUMAN)
AISPLQIPV

SEQ ID NO: 92228 - protein, 9 aa, Artificial Sequence
  Description of Artificial Sequence: Synthetic peptide
  Seed: SPVSICSSS (MAGC1_HUMAN)
SPVSICSSV

SEQ ID NO: 92229 - protein, 9 aa, Artificial Sequence
  Description of Artificial Sequence: Synthetic peptide
  Seed: IESEPLFTY (MAGC1_HUMAN)
ITSEPLFTY

SEQ ID NO: 92230 - protein, 8 aa, Artificial Sequence
  Description of Artificial Sequence: Synthetic peptide
  Seed: FPQSPPEW (MAGC1_HUMAN)
FPQSPPEY

SEQ ID NO: 92231 - protein, 11 aa, Artificial Sequence
  Description of Artificial Sequence: Synthetic peptide
  Seed: SLSQSSPVSSF (MAGC1_HUMAN)
SQSQSSPVSSL

SEQ ID NO: 92232 - protein, 9 aa, Artificial Sequence
  Description of Artificial Sequence: Synthetic peptide
  Seed: HFPQSPPEW (MAGC1_HUMAN)
HYPQSPPEV

SEQ ID NO: 92233 - protein, 11 aa, Artificial Sequence
  Description of Artificial Sequence: Synthetic peptide
  Seed: SICSSSTSLSL (MAGC1_HUMAN)
STCSSSTSLSF

SEQ ID NO: 92234 - protein, 10 aa, Artificial Sequence
  Description of Artificial Sequence: Synthetic peptide
  Seed: SIIFIKGTYA (MAGC1_HUMAN)
SMIFIKGTYA

SEQ ID NO: 92235 - protein, 10 aa, Artificial Sequence
  Description of Artificial Sequence: Synthetic peptide
  Seed: VSSSSSSSTL (MAGC1_HUMAN)
VLSSSSSSTY

SEQ ID NO: 92236 - protein, 9 aa, Artificial Sequence
  Description of Artificial Sequence: Synthetic peptide
  Seed: ISFSSSTSL (MAGC1_HUMAN)
ITFSSSTSW

SEQ ID NO: 92237 - protein, 9 aa, Artificial Sequence
  Description of Artificial Sequence: Synthetic peptide
  Seed: TLDEKVDEL (MAGC1_HUMAN)
TPDEKVDEY

SEQ ID NO: 92238 - protein, 9 aa, Artificial Sequence
  Description of Artificial Sequence: Synthetic peptide
  Seed: SSFFSSALL (MAGC1_HUMAN)
SRFFSSALM

SEQ ID NO: 92239 - protein, 9 aa, Artificial Sequence
  Description of Artificial Sequence: Synthetic peptide
  Seed: VSRSFSSTL (MAGC1_HUMAN)
VQRSFSSTL

SEQ ID NO: 92240 - protein, 11 aa, Artificial Sequence
  Description of Artificial Sequence: Synthetic peptide
  Seed: SPLQIPGSPSF (MAGC1_HUMAN)
SFLQIPGSPSM

SEQ ID NO: 92241 - protein, 9 aa, Artificial Sequence
  Description of Artificial Sequence: Synthetic peptide
  Seed: FSSALLSIF (MAGC1_HUMAN)
FASALLSIW

SEQ ID NO: 92242 - protein, 11 aa, Artificial Sequence
  Description of Artificial Sequence: Synthetic peptide
  Seed: SPLQIPVSPSS (MAGC1_HUMAN)
SMLQIPVSPSF

SEQ ID NO: 92243 - protein, 9 aa, Artificial Sequence
  Description of Artificial Sequence: Synthetic peptide
  Seed: TLDEKVDEL (MAGC1_HUMAN)
TWDEKVDEI

SEQ ID NO: 92244 - protein, 10 aa, Artificial Sequence
  Description of Artificial Sequence: Synthetic peptide
  Seed: FSSSTSLSPF (MAGC1_HUMAN)
FCSSTSLSPY

SEQ ID NO: 92245 - protein, 9 aa, Artificial Sequence
  Description of Artificial Sequence: Synthetic peptide
  Seed: TLLSLFQSF (MAGC1_HUMAN)
TQLSLFQSF

SEQ ID NO: 92246 - protein, 11 aa, Artificial Sequence
  Description of Artificial Sequence: Synthetic peptide
  Seed: SLSQSSPVSSF (MAGC1_HUMAN)
SCSQSSPVSSF

SEQ ID NO: 92247 - protein, 9 aa, Artificial Sequence
  Description of Artificial Sequence: Synthetic peptide
  Seed: AQSPLQSPV (MAGC1_HUMAN)
AESPLQSPT

SEQ ID NO: 92248 - protein, 11 aa, Artificial Sequence
  Description of Artificial Sequence: Synthetic peptide
  Seed: SICSSSTPSSL (MAGC1_HUMAN)
SMCSSSTPSSF

SEQ ID NO: 92249 - protein, 9 aa, Artificial Sequence
  Description of Artificial Sequence: Synthetic peptide
  Seed: KAREFIEIL (MAGC1_HUMAN)
KPREFIEII

SEQ ID NO: 92250 - protein, 11 aa, Artificial Sequence
  Description of Artificial Sequence: Synthetic peptide
  Seed: SFFSYTLASLL (MAGC1_HUMAN)
SDFSYTLASLF

SEQ ID NO: 92251 - protein, 9 aa, Artificial Sequence
  Description of Artificial Sequence: Synthetic peptide
  Seed: NSSPPRYEF (MAGC1_HUMAN)
NQSPPRYEV

SEQ ID NO: 92252 - protein, 10 aa, Artificial Sequence
  Description of Artificial Sequence: Synthetic peptide
  Seed: SQNRLLILIL (MAGC1_HUMAN)
SQNRLLILIY

SEQ ID NO: 92253 - protein, 10 aa, Artificial Sequence
  Description of Artificial Sequence: Synthetic peptide
  Seed: ICSSSTSLSL (MAGC1_HUMAN)
IMSSSTSLSW

SEQ ID NO: 92254 - protein, 9 aa, Artificial Sequence
  Description of Artificial Sequence: Synthetic peptide
  Seed: FSYTLASLL (MAGC1_HUMAN)
FFYTLASLV

SEQ ID NO: 92255 - protein, 9 aa, Artificial Sequence
  Description of Artificial Sequence: Synthetic peptide
  Seed: SSPECTQST (MAGC1_HUMAN)
SSPECTQSI

SEQ ID NO: 92256 - protein, 9 aa, Artificial Sequence
  Description of Artificial Sequence: Synthetic peptide
  Seed: LQRPVSSFF (MAGC1_HUMAN)
LSRPVSSFY

SEQ ID NO: 92257 - protein, 11 aa, Artificial Sequence
  Description of Artificial Sequence: Synthetic peptide
  Seed: TSSFSSTLLSI (MAGC1_HUMAN)
TASFSSTLLSW

SEQ ID NO: 92258 - protein, 9 aa, Artificial Sequence
  Description of Artificial Sequence: Synthetic peptide
  Seed: MSQNRLLIL (MAGC1_HUMAN)
MQQNRLLIM

SEQ ID NO: 92259 - protein, 9 aa, Artificial Sequence
  Description of Artificial Sequence: Synthetic peptide
  Seed: VQSPLHSPQ (MAGC1_HUMAN)
VESPLHSPM

SEQ ID NO: 92260 - protein, 9 aa, Artificial Sequence
  Description of Artificial Sequence: Synthetic peptide
  Seed: KRKVVEFLA (MAGC1_HUMAN)
KRKVVEFLM

SEQ ID NO: 92261 - protein, 9 aa, Artificial Sequence
  Description of Artificial Sequence: Synthetic peptide
  Seed: ALLSIFQSS (MAGC1_HUMAN)
AVLSIFQSL

SEQ ID NO: 92262 - protein, 10 aa, Artificial Sequence
  Description of Artificial Sequence: Synthetic peptide
  Seed: VSRSFSSTLL (MAGC1_HUMAN)
VSRSFSSTLY

SEQ ID NO: 92263 - protein, 9 aa, Artificial Sequence
  Description of Artificial Sequence: Synthetic peptide
  Seed: TPSSLPQSF (MAGC1_HUMAN)
TQSSLPQSY

SEQ ID NO: 92264 - protein, 10 aa, Artificial Sequence
  Description of Artificial Sequence: Synthetic peptide
  Seed: VSSSSSSSTL (MAGC1_HUMAN)
VQSSSSSSTY

SEQ ID NO: 92265 - protein, 10 aa, Artificial Sequence
  Description of Artificial Sequence: Synthetic peptide
  Seed: SSPERTQSTF (MAGC1_HUMAN)
SPPERTQSTL

SEQ ID NO: 92266 - protein, 10 aa, Artificial Sequence
  Description of Artificial Sequence: Synthetic peptide
  Seed: LQIPVSPSFS (MAGC1_HUMAN)
LVIPVSPSFY

SEQ ID NO: 92267 - protein, 9 aa, Artificial Sequence
  Description of Artificial Sequence: Synthetic peptide
  Seed: SPLYFPQSP (MAGC1_HUMAN)
SPLYFPQST

SEQ ID NO: 92268 - protein, 9 aa, Artificial Sequence
  Description of Artificial Sequence: Synthetic peptide
  Seed: SPVSSFPSS (MAGC1_HUMAN)
SPVSSFPSA

SEQ ID NO: 92269 - protein, 11 aa, Artificial Sequence
  Description of Artificial Sequence: Synthetic peptide
  Seed: SFSSSTSLSPF (MAGC1_HUMAN)
SQSSSTSLSPM

SEQ ID NO: 92270 - protein, 10 aa, Artificial Sequence
  Description of Artificial Sequence: Synthetic peptide
  Seed: SPESPLQSPV (MAGC1_HUMAN)
SPESPLQSPL

SEQ ID NO: 92271 - protein, 10 aa, Artificial Sequence
  Description of Artificial Sequence: Synthetic peptide
  Seed: KGTYASEEVI (MAGC1_HUMAN)
KHTYASEEVY

SEQ ID NO: 92272 - protein, 10 aa, Artificial Sequence
  Description of Artificial Sequence: Synthetic peptide
  Seed: SPLQSPVISF (MAGC1_HUMAN)
SPLQSPVISA

SEQ ID NO: 92273 - protein, 10 aa, Artificial Sequence
  Description of Artificial Sequence: Synthetic peptide
  Seed: FFSYTLASLL (MAGC1_HUMAN)
FLSYTLASLR

SEQ ID NO: 92274 - protein, 11 aa, Artificial Sequence
  Description of Artificial Sequence: Synthetic peptide
  Seed: SLSQSSPVSSF (MAGC1_HUMAN)
SSSQSSPVSSF

SEQ ID NO: 92275 - protein, 9 aa, Artificial Sequence
  Description of Artificial Sequence: Synthetic peptide
  Seed: FPSSTSSSL (MAGC1_HUMAN)
FNSSTSSSL

SEQ ID NO: 92276 - protein, 10 aa, Artificial Sequence
  Description of Artificial Sequence: Synthetic peptide
  Seed: TGYFPVIFRK (MAGC1_HUMAN)
TKYFPVIFRK

SEQ ID NO: 92277 - protein, 11 aa, Artificial Sequence
  Description of Artificial Sequence: Synthetic peptide
  Seed: VSSSSSSSTLL (MAGC1_HUMAN)
VCSSSSSSTLW

SEQ ID NO: 92278 - protein, 11 aa, Artificial Sequence
  Description of Artificial Sequence: Synthetic peptide
  Seed: RKVVEFLAMLK (MAGC1_HUMAN)
RTVVEFLAMLK

SEQ ID NO: 92279 - protein, 10 aa, Artificial Sequence
  Description of Artificial Sequence: Synthetic peptide
  Seed: SSPERTQSTF (MAGC1_HUMAN)
SMPERTQSTY

SEQ ID NO: 92280 - protein, 10 aa, Artificial Sequence
  Description of Artificial Sequence: Synthetic peptide
  Seed: SSPERTQSTF (MAGC1_HUMAN)
SFPERTQSTM

SEQ ID NO: 92281 - protein, 9 aa, Artificial Sequence
  Description of Artificial Sequence: Synthetic peptide
  Seed: IPVSPSSSS (MAGC1_HUMAN)
IPVSPSSSV

SEQ ID NO: 92282 - protein, 9 aa, Artificial Sequence
  Description of Artificial Sequence: Synthetic peptide
  Seed: FPSSTSSSL (MAGC1_HUMAN)
FSSSTSSSV

SEQ ID NO: 92283 - protein, 9 aa, Artificial Sequence
  Description of Artificial Sequence: Synthetic peptide
  Seed: FQSSLQSPV (MAGC1_HUMAN)
FNSSLQSPY

SEQ ID NO: 92284 - protein, 11 aa, Artificial Sequence
  Description of Artificial Sequence: Synthetic peptide
  Seed: SPPEGPAQSPL (MAGC1_HUMAN)
SVPEGPAQSPL

SEQ ID NO: 92285 - protein, 9 aa, Artificial Sequence
  Description of Artificial Sequence: Synthetic peptide
  Seed: SSSSSSSTL (MAGC1_HUMAN)
STSSSSSTW

SEQ ID NO: 92286 - protein, 9 aa, Artificial Sequence
  Description of Artificial Sequence: Synthetic peptide
  Seed: SSPESDDTL (MAGC1_HUMAN)
SYPESDDTY

SEQ ID NO: 92287 - protein, 10 aa, Artificial Sequence
  Description of Artificial Sequence: Synthetic peptide
  Seed: RFLLLKYQVK (MAGC1_HUMAN)
RSLLLKYQVR

SEQ ID NO: 92288 - protein, 9 aa, Artificial Sequence
  Description of Artificial Sequence: Synthetic peptide
  Seed: VSRSFSSTL (MAGC1_HUMAN)
VARSFSSTL

SEQ ID NO: 92289 - protein, 10 aa, Artificial Sequence
  Description of Artificial Sequence: Synthetic peptide
  Seed: LQIPMTSSFS (MAGC1_HUMAN)
LKIPMTSSFM

SEQ ID NO: 92290 - protein, 9 aa, Artificial Sequence
  Description of Artificial Sequence: Synthetic peptide
  Seed: GFAQSSLQI (MAGC1_HUMAN)
GYAQSSLQF

SEQ ID NO: 92291 - protein, 9 aa, Artificial Sequence
  Description of Artificial Sequence: Synthetic peptide
  Seed: SPLQRPVSS (MAGC1_HUMAN)
SVLQRPVSV

SEQ ID NO: 92292 - protein, 11 aa, Artificial Sequence
  Description of Artificial Sequence: Synthetic peptide
  Seed: SSFSSTLLSIF (MAGC1_HUMAN)
SSFSSTLLSIW

SEQ ID NO: 92293 - protein, 10 aa, Artificial Sequence
  Description of Artificial Sequence: Synthetic peptide
  Seed: LAMLKNTVPI (MAGC1_HUMAN)
LNMLKNTVPY

SEQ ID NO: 92294 - protein, 10 aa, Artificial Sequence
  Description of Artificial Sequence: Synthetic peptide
  Seed: SFPSSTSSSL (MAGC1_HUMAN)
SYPSSTSSSL

SEQ ID NO: 92295 - protein, 9 aa, Artificial Sequence
  Description of Artificial Sequence: Synthetic peptide
  Seed: LQIPVSAAS (MAGC1_HUMAN)
LNIPVSAAY

SEQ ID NO: 92296 - protein, 10 aa, Artificial Sequence
  Description of Artificial Sequence: Synthetic peptide
  Seed: KAREFIEILF (MAGC1_HUMAN)
KSREFIEILM

SEQ ID NO: 92297 - protein, 11 aa, Artificial Sequence
  Description of Artificial Sequence: Synthetic peptide
  Seed: FLAMLKNTVPI (MAGC1_HUMAN)
FKAMLKNTVPA

SEQ ID NO: 92298 - protein, 9 aa, Artificial Sequence
  Description of Artificial Sequence: Synthetic peptide
  Seed: RAGREHFAF (MAGC1_HUMAN)
RWGREHFAL

SEQ ID NO: 92299 - protein, 9 aa, Artificial Sequence
  Description of Artificial Sequence: Synthetic peptide
  Seed: LQIPVSAAS (MAGC1_HUMAN)
LCIPVSAAF

SEQ ID NO: 92300 - protein, 9 aa, Artificial Sequence
  Description of Artificial Sequence: Synthetic peptide
  Seed: TLLESDSLT (MAGC1_HUMAN)
TMLESDSLA

SEQ ID NO: 92301 - protein, 10 aa, Artificial Sequence
  Description of Artificial Sequence: Synthetic peptide
  Seed: ASSSVMSPSF (MAGC1_HUMAN)
AESSVMSPSW

SEQ ID NO: 92302 - protein, 9 aa, Artificial Sequence
  Description of Artificial Sequence: Synthetic peptide
  Seed: FFSSALLSI (MAGC1_HUMAN)
FVSSALLSL

SEQ ID NO: 92303 - protein, 10 aa, Artificial Sequence
  Description of Artificial Sequence: Synthetic peptide
  Seed: SSPESAQSAF (MAGC1_HUMAN)
SKPESAQSAL

SEQ ID NO: 92304 - protein, 9 aa, Artificial Sequence
  Description of Artificial Sequence: Synthetic peptide
  Seed: VQSPLQNPA (MAGC1_HUMAN)
VLSPLQNPL

SEQ ID NO: 92305 - protein, 9 aa, Artificial Sequence
  Description of Artificial Sequence: Synthetic peptide
  Seed: LQIPVSPSF (MAGC1_HUMAN)
LGIPVSPSF

SEQ ID NO: 92306 - protein, 9 aa, Artificial Sequence
  Description of Artificial Sequence: Synthetic peptide
  Seed: SLIESEPLF (MAGC1_HUMAN)
SQIESEPLY

SEQ ID NO: 92307 - protein, 9 aa, Artificial Sequence
  Description of Artificial Sequence: Synthetic peptide
  Seed: RTHSTFEGF (MAGC1_HUMAN)
RYHSTFEGF

SEQ ID NO: 92308 - protein, 10 aa, Artificial Sequence
  Description of Artificial Sequence: Synthetic peptide
  Seed: REVDPDDSYV (MAGC1_HUMAN)
RQVDPDDSYI

SEQ ID NO: 92309 - protein, 9 aa, Artificial Sequence
  Description of Artificial Sequence: Synthetic peptide
  Seed: LSDEQGMSQ (MAGC1_HUMAN)
LADEQGMSY

SEQ ID NO: 92310 - protein, 9 aa, Artificial Sequence
  Description of Artificial Sequence: Synthetic peptide
  Seed: MTSSFSSTL (MAGC1_HUMAN)
MHSSFSSTL

SEQ ID NO: 92311 - protein, 9 aa, Artificial Sequence
  Description of Artificial Sequence: Synthetic peptide
  Seed: SICSSSTSL (MAGC1_HUMAN)
SQCSSSTSM

SEQ ID NO: 92312 - protein, 10 aa, Artificial Sequence
  Description of Artificial Sequence: Synthetic peptide
  Seed: YTLDEKVDEL (MAGC1_HUMAN)
YLLDEKVDEF

SEQ ID NO: 92313 - protein, 10 aa, Artificial Sequence
  Description of Artificial Sequence: Synthetic peptide
  Seed: KAEMLTNVIS (MAGC1_HUMAN)
KPEMLTNVIA

SEQ ID NO: 92314 - protein, 9 aa, Artificial Sequence
  Description of Artificial Sequence: Synthetic peptide
  Seed: LQIPVSSSS (MAGC1_HUMAN)
LEIPVSSSY

SEQ ID NO: 92315 - protein, 10 aa, Artificial Sequence
  Description of Artificial Sequence: Synthetic peptide
  Seed: RSFSSTLLSI (MAGC1_HUMAN)
RFFSSTLLSF

SEQ ID NO: 92316 - protein, 8 aa, Artificial Sequence
  Description of Artificial Sequence: Synthetic peptide
  Seed: SPLQIPMT (MAGC1_HUMAN)
SPLQIPMA

SEQ ID NO: 92317 - protein, 9 aa, Artificial Sequence
  Description of Artificial Sequence: Synthetic peptide
  Seed: SICSSSTSL (MAGC1_HUMAN)
SPCSSSTSI

SEQ ID NO: 92318 - protein, 9 aa, Artificial Sequence
  Description of Artificial Sequence: Synthetic peptide
  Seed: KDSQSPLQI (MAGC1_HUMAN)
KQSQSPLQL

SEQ ID NO: 92319 - protein, 9 aa, Artificial Sequence
  Description of Artificial Sequence: Synthetic peptide
  Seed: STFEGFAQS (MAGC1_HUMAN)
STFEGFAQI

SEQ ID NO: 92320 - protein, 11 aa, Artificial Sequence
  Description of Artificial Sequence: Synthetic peptide
  Seed: SPLQIPVSSSS (MAGC1_HUMAN)
SHLQIPVSSSY

SEQ ID NO: 92321 - protein, 9 aa, Artificial Sequence
  Description of Artificial Sequence: Synthetic peptide
  Seed: VSSSFSYTL (MAGC1_HUMAN)
VASSFSYTI

SEQ ID NO: 92322 - protein, 10 aa, Artificial Sequence
  Description of Artificial Sequence: Synthetic peptide
  Seed: ESAQSAFEGF (MAGC1_HUMAN)
ESAQSAFEGR

SEQ ID NO: 92323 - protein, 10 aa, Artificial Sequence
  Description of Artificial Sequence: Synthetic peptide
  Seed: YTLASLLQSS (MAGC1_HUMAN)
YTLASLLQSV

SEQ ID NO: 92324 - protein, 9 aa, Artificial Sequence
  Description of Artificial Sequence: Synthetic peptide
  Seed: SSSESPQSC (MAGC1_HUMAN)
SLSESPQSY

SEQ ID NO: 92325 - protein, 10 aa, Artificial Sequence
  Description of Artificial Sequence: Synthetic peptide
  Seed: ASSSTLVSIF (MAGC1_HUMAN)
AWSSTLVSIW

SEQ ID NO: 92326 - protein, 10 aa, Artificial Sequence
  Description of Artificial Sequence: Synthetic peptide
  Seed: TVPITFPSSY (MAGC1_HUMAN)
TQPITFPSSF

SEQ ID NO: 92327 - protein, 9 aa, Artificial Sequence
  Description of Artificial Sequence: Synthetic peptide
  Seed: LSPLHFPQF (MAGC1_HUMAN)
LRPLHFPQL

SEQ ID NO: 92328 - protein, 10 aa, Artificial Sequence
  Description of Artificial Sequence: Synthetic peptide
  Seed: EVIWDVLSGI (MAGC1_HUMAN)
ETIWDVLSGR

SEQ ID NO: 92329 - protein, 9 aa, Artificial Sequence
  Description of Artificial Sequence: Synthetic peptide
  Seed: MSQNRLLIL (MAGC1_HUMAN)
MKQNRLLIF

SEQ ID NO: 92330 - protein, 9 aa, Artificial Sequence
  Description of Artificial Sequence: Synthetic peptide
  Seed: FEGFPQSVL (MAGC1_HUMAN)
FQGFPQSVF

SEQ ID NO: 92331 - protein, 10 aa, Artificial Sequence
  Description of Artificial Sequence: Synthetic peptide
  Seed: PLQIPMTSSF (MAGC1_HUMAN)
PCQIPMTSSY

SEQ ID NO: 92332 - protein, 8 aa, Artificial Sequence
  Description of Artificial Sequence: Synthetic peptide
  Seed: FGISLREV (MAGC1_HUMAN)
FQISLREL

SEQ ID NO: 92333 - protein, 9 aa, Artificial Sequence
  Description of Artificial Sequence: Synthetic peptide
  Seed: RTQSTFEGF (MAGC1_HUMAN)
RLQSTFEGF

SEQ ID NO: 92334 - protein, 9 aa, Artificial Sequence
  Description of Artificial Sequence: Synthetic peptide
  Seed: SSSTLVSIF (MAGC1_HUMAN)
SMSTLVSIM

SEQ ID NO: 92335 - protein, 10 aa, Artificial Sequence
  Description of Artificial Sequence: Synthetic peptide
  Seed: MTSSFSSTLL (MAGC1_HUMAN)
MNSSFSSTLF

SEQ ID NO: 92336 - protein, 11 aa, Artificial Sequence
  Description of Artificial Sequence: Synthetic peptide
  Seed: VDEYTSSSDTL (MAGC1_HUMAN)
VWEYTSSSDTF

SEQ ID NO: 92337 - protein, 10 aa, Artificial Sequence
  Description of Artificial Sequence: Synthetic peptide
  Seed: FPQSPLQIPV (MAGC1_HUMAN)
FPQSPLQIPI

SEQ ID NO: 92338 - protein, 9 aa, Artificial Sequence
  Description of Artificial Sequence: Synthetic peptide
  Seed: FPSSTSSSL (MAGC1_HUMAN)
FTSSTSSSY

SEQ ID NO: 92339 - protein, 8 aa, Artificial Sequence
  Description of Artificial Sequence: Synthetic peptide
  Seed: SSFFSSAL (MAGC1_HUMAN)
SHFFSSAY

SEQ ID NO: 92340 - protein, 10 aa, Artificial Sequence
  Description of Artificial Sequence: Synthetic peptide
  Seed: RAGREHFAFG (MAGC1_HUMAN)
RHGREHFAFA

SEQ ID NO: 92341 - protein, 9 aa, Artificial Sequence
  Description of Artificial Sequence: Synthetic peptide
  Seed: TLLESDSLT (MAGC1_HUMAN)
TLLESDSLV

SEQ ID NO: 92342 - protein, 10 aa, Artificial Sequence
  Description of Artificial Sequence: Synthetic peptide
  Seed: RTQSTFEGFA (MAGC1_HUMAN)
RTQSTFEGFK

SEQ ID NO: 92343 - protein, 9 aa, Artificial Sequence
  Description of Artificial Sequence: Synthetic peptide
  Seed: LTKVWVQEH (MAGC1_HUMAN)
LTKVWVQEF

SEQ ID NO: 92344 - protein, 9 aa, Artificial Sequence
  Description of Artificial Sequence: Synthetic peptide
  Seed: VQSPLHSPQ (MAGC1_HUMAN)
VVSPLHSPF

SEQ ID NO: 92345 - protein, 10 aa, Artificial Sequence
  Description of Artificial Sequence: Synthetic peptide
  Seed: RPVSSFFSYT (MAGC1_HUMAN)
RGVSSFFSYA

SEQ ID NO: 92346 - protein, 11 aa, Artificial Sequence
  Description of Artificial Sequence: Synthetic peptide
  Seed: TLDEKVDELAR (MAGC1_HUMAN)
TTDEKVDELAM

SEQ ID NO: 92347 - protein, 11 aa, Artificial Sequence
  Description of Artificial Sequence: Synthetic peptide
  Seed: TTDDSTATESA (MAGC1_HUMAN)
TIDDSTATESY

SEQ ID NO: 92348 - protein, 9 aa, Artificial Sequence
  Description of Artificial Sequence: Synthetic peptide
  Seed: SSPERTHST (MAGC1_HUMAN)
STPERTHSM

SEQ ID NO: 92349 - protein, 9 aa, Artificial Sequence
  Description of Artificial Sequence: Synthetic peptide
  Seed: MTSSFSSTL (MAGC1_HUMAN)
MMSSFSSTG

SEQ ID NO: 92350 - protein, 9 aa, Artificial Sequence
  Description of Artificial Sequence: Synthetic peptide
  Seed: EMLTNVISR (MAGC1_HUMAN)
EALTNVISR

SEQ ID NO: 92351 - protein, 11 aa, Artificial Sequence
  Description of Artificial Sequence: Synthetic peptide
  Seed: SSTLLSLFQSF (MAGC1_HUMAN)
SSTLLSLFQSW

SEQ ID NO: 92352 - protein, 10 aa, Artificial Sequence
  Description of Artificial Sequence: Synthetic peptide
  Seed: ISRYTGYFPV (MAGC1_HUMAN)
ITRYTGYFPV

SEQ ID NO: 92353 - protein, 9 aa, Artificial Sequence
  Description of Artificial Sequence: Synthetic peptide
  Seed: FSYTLLSLF (MAGC1_HUMAN)
FMYTLLSLM

SEQ ID NO: 92354 - protein, 11 aa, Artificial Sequence
  Description of Artificial Sequence: Synthetic peptide
  Seed: VLSGIGVRAGR (MAGC1_HUMAN)
VTSGIGVRAGR

SEQ ID NO: 92355 - protein, 9 aa, Artificial Sequence
  Description of Artificial Sequence: Synthetic peptide
  Seed: AQSPLQRPV (MAGC1_HUMAN)
AKSPLQRPM

SEQ ID NO: 92356 - protein, 10 aa, Artificial Sequence
  Description of Artificial Sequence: Synthetic peptide
  Seed: MTSSFSSTLL (MAGC1_HUMAN)
MFSSFSSTLF

SEQ ID NO: 92357 - protein, 9 aa, Artificial Sequence
  Description of Artificial Sequence: Synthetic peptide
  Seed: FSSTLVSLF (MAGC1_HUMAN)
FPSTLVSLH

SEQ ID NO: 92358 - protein, 9 aa, Artificial Sequence
  Description of Artificial Sequence: Synthetic peptide
  Seed: IESEPLFTY (MAGC1_HUMAN)
IASEPLFTL

SEQ ID NO: 92359 - protein, 9 aa, Artificial Sequence
  Description of Artificial Sequence: Synthetic peptide
  Seed: SSTSSSLSK (MAGC1_HUMAN)
STTSSSLSK

SEQ ID NO: 92360 - protein, 9 aa, Artificial Sequence
  Description of Artificial Sequence: Synthetic peptide
  Seed: YQVKQPITK (MAGC1_HUMAN)
YFVKQPITL

SEQ ID NO: 92361 - protein, 10 aa, Artificial Sequence
  Description of Artificial Sequence: Synthetic peptide
  Seed: EVIWDVLSGI (MAGC1_HUMAN)
ETIWDVLSGF

SEQ ID NO: 92362 - protein, 9 aa, Artificial Sequence
  Description of Artificial Sequence: Synthetic peptide
  Seed: KVDELARFL (MAGC1_HUMAN)
KWDELARFL

SEQ ID NO: 92363 - protein, 9 aa, Artificial Sequence
  Description of Artificial Sequence: Synthetic peptide
  Seed: RTHSTFEGF (MAGC1_HUMAN)
RYHSTFEGY

SEQ ID NO: 92364 - protein, 9 aa, Artificial Sequence
  Description of Artificial Sequence: Synthetic peptide
  Seed: FFSSALLSI (MAGC1_HUMAN)
FWSSALLSI

SEQ ID NO: 92365 - protein, 10 aa, Artificial Sequence
  Description of Artificial Sequence: Synthetic peptide
  Seed: ASSFFSSALL (MAGC1_HUMAN)
AFSFFSSALW

SEQ ID NO: 92366 - protein, 9 aa, Artificial Sequence
  Description of Artificial Sequence: Synthetic peptide
  Seed: NTHSPLQIV (MAGC1_HUMAN)
NVHSPLQIF

SEQ ID NO: 92367 - protein, 9 aa, Artificial Sequence
  Description of Artificial Sequence: Synthetic peptide
  Seed: TESASSSVM (MAGC1_HUMAN)
TQSASSSVM

SEQ ID NO: 92368 - protein, 9 aa, Artificial Sequence
  Description of Artificial Sequence: Synthetic peptide
  Seed: FSYTLASLL (MAGC1_HUMAN)
FTYTLASLL

SEQ ID NO: 92369 - protein, 10 aa, Artificial Sequence
  Description of Artificial Sequence: Synthetic peptide
  Seed: SSSSSSSTLL (MAGC1_HUMAN)
SKSSSSSTLW

SEQ ID NO: 92370 - protein, 10 aa, Artificial Sequence
  Description of Artificial Sequence: Synthetic peptide
  Seed: SPLQIPVSRS (MAGC1_HUMAN)
SPLQIPVSRA

SEQ ID NO: 92371 - protein, 10 aa, Artificial Sequence
  Description of Artificial Sequence: Synthetic peptide
  Seed: RSFSSTLLSI (MAGC1_HUMAN)
RLFSSTLLSF

SEQ ID NO: 92372 - protein, 9 aa, Artificial Sequence
  Description of Artificial Sequence: Synthetic peptide
  Seed: ASSSTLVSI (MAGC1_HUMAN)
AVSSTLVSA

SEQ ID NO: 92373 - protein, 9 aa, Artificial Sequence
  Description of Artificial Sequence: Synthetic peptide
  Seed: FAFGEPREL (MAGC1_HUMAN)
FYFGEPREL

SEQ ID NO: 92374 - protein, 9 aa, Artificial Sequence
  Description of Artificial Sequence: Synthetic peptide
  Seed: IESEPLFTY (MAGC1_HUMAN)
IMSEPLFTL

SEQ ID NO: 92375 - protein, 9 aa, Artificial Sequence
  Description of Artificial Sequence: Synthetic peptide
  Seed: ISFSSSTSL (MAGC1_HUMAN)
IKFSSSTSH

SEQ ID NO: 92376 - protein, 10 aa, Artificial Sequence
  Description of Artificial Sequence: Synthetic peptide
  Seed: STSLSLPQSF (MAGC1_HUMAN)
SISLSLPQSW

SEQ ID NO: 92377 - protein, 9 aa, Artificial Sequence
  Description of Artificial Sequence: Synthetic peptide
  Seed: STQSPFEGF (MAGC1_HUMAN)
SLQSPFEGY

SEQ ID NO: 92378 - protein, 9 aa, Artificial Sequence
  Description of Artificial Sequence: Synthetic peptide
  Seed: AQSPLQIPV (MAGC1_HUMAN)
ALSPLQIPY

SEQ ID NO: 92379 - protein, 8 aa, Artificial Sequence
  Description of Artificial Sequence: Synthetic peptide
  Seed: SSPPRYEF (MAGC1_HUMAN)
SYPPRYEY

SEQ ID NO: 92380 - protein, 11 aa, Artificial Sequence
  Description of Artificial Sequence: Synthetic peptide
  Seed: SLSQSSPVSSF (MAGC1_HUMAN)
SPSQSSPVSSF

SEQ ID NO: 92381 - protein, 9 aa, Artificial Sequence
  Description of Artificial Sequence: Synthetic peptide
  Seed: VSSSFSYTL (MAGC1_HUMAN)
VWSSFSYTF

SEQ ID NO: 92382 - protein, 11 aa, Artificial Sequence
  Description of Artificial Sequence: Synthetic peptide
  Seed: QSSPESAQSAF (MAGC1_HUMAN)
QSSPESAQSAW

SEQ ID NO: 92383 - protein, 9 aa, Artificial Sequence
  Description of Artificial Sequence: Synthetic peptide
  Seed: KVDELARFL (MAGC1_HUMAN)
KCDELARFL

SEQ ID NO: 92384 - protein, 9 aa, Artificial Sequence
  Description of Artificial Sequence: Synthetic peptide
  Seed: SSPESTQSP (MAGC1_HUMAN)
STPESTQSF

SEQ ID NO: 92385 - protein, 9 aa, Artificial Sequence
  Description of Artificial Sequence: Synthetic peptide
  Seed: TSLSLPQSF (MAGC1_HUMAN)
TFLSLPQSY

SEQ ID NO: 92386 - protein, 9 aa, Artificial Sequence
  Description of Artificial Sequence: Synthetic peptide
  Seed: YQVKQPITK (MAGC1_HUMAN)
YIVKQPITK

SEQ ID NO: 92387 - protein, 9 aa, Artificial Sequence
  Description of Artificial Sequence: Synthetic peptide
  Seed: LQIPGSPSF (MAGC1_HUMAN)
LYIPGSPSF

SEQ ID NO: 92388 - protein, 11 aa, Artificial Sequence
  Description of Artificial Sequence: Synthetic peptide
  Seed: SFFSSALLSIF (MAGC1_HUMAN)
SNFSSALLSIW

SEQ ID NO: 92389 - protein, 9 aa, Artificial Sequence
  Description of Artificial Sequence: Synthetic peptide
  Seed: FSYTLASLL (MAGC1_HUMAN)
FMYTLASLA

SEQ ID NO: 92390 - protein, 9 aa, Artificial Sequence
  Description of Artificial Sequence: Synthetic peptide
  Seed: SSFFSSALL (MAGC1_HUMAN)
SAFFSSALM

SEQ ID NO: 92391 - protein, 9 aa, Artificial Sequence
  Description of Artificial Sequence: Synthetic peptide
  Seed: SPLQIVPSL (MAGC1_HUMAN)
SVLQIVPSA

SEQ ID NO: 92392 - protein, 9 aa, Artificial Sequence
  Description of Artificial Sequence: Synthetic peptide
  Seed: ASSSTLVSI (MAGC1_HUMAN)
AISSTLVSL

SEQ ID NO: 92393 - protein, 10 aa, Artificial Sequence
  Description of Artificial Sequence: Synthetic peptide
  Seed: SFSSTLLSIF (MAGC1_HUMAN)
SWSSTLLSIY

SEQ ID NO: 92394 - protein, 9 aa, Artificial Sequence
  Description of Artificial Sequence: Synthetic peptide
  Seed: AQSSLQIPV (MAGC1_HUMAN)
AMSSLQIPL

SEQ ID NO: 92395 - protein, 9 aa, Artificial Sequence
  Description of Artificial Sequence: Synthetic peptide
  Seed: FSYTLASLL (MAGC1_HUMAN)
FQYTLASLH

SEQ ID NO: 92396 - protein, 9 aa, Artificial Sequence
  Description of Artificial Sequence: Synthetic peptide
  Seed: SEVIKRKVV (MAGC1_HUMAN)
SHVIKRKVL

SEQ ID NO: 92397 - protein, 9 aa, Artificial Sequence
  Description of Artificial Sequence: Synthetic peptide
  Seed: KDSQSPLQI (MAGC1_HUMAN)
KESQSPLQM

SEQ ID NO: 92398 - protein, 9 aa, Artificial Sequence
  Description of Artificial Sequence: Synthetic peptide
  Seed: STFEGFAQS (MAGC1_HUMAN)
SNFEGFAQV

SEQ ID NO: 92399 - protein, 9 aa, Artificial Sequence
  Description of Artificial Sequence: Synthetic peptide
  Seed: YQVKQPITK (MAGC1_HUMAN)
YFVKQPITY

SEQ ID NO: 92400 - protein, 10 aa, Artificial Sequence
  Description of Artificial Sequence: Synthetic peptide
  Seed: KAREFIEILF (MAGC1_HUMAN)
KTREFIEILW

SEQ ID NO: 92401 - protein, 10 aa, Artificial Sequence
  Description of Artificial Sequence: Synthetic peptide
  Seed: RAGREHFAFG (MAGC1_HUMAN)
RTGREHFAFH

SEQ ID NO: 92402 - protein, 9 aa, Artificial Sequence
  Description of Artificial Sequence: Synthetic peptide
  Seed: SLPEWEDSL (MAGC1_HUMAN)
SIPEWEDSV

SEQ ID NO: 92403 - protein, 10 aa, Artificial Sequence
  Description of Artificial Sequence: Synthetic peptide
  Seed: DVLSGIGVRA (MAGC1_HUMAN)
DTLSGIGVRR

SEQ ID NO: 92404 - protein, 10 aa, Artificial Sequence
  Description of Artificial Sequence: Synthetic peptide
  Seed: NRLLILILSI (MAGC1_HUMAN)
NRLLILILSL

SEQ ID NO: 92405 - protein, 10 aa, Artificial Sequence
  Description of Artificial Sequence: Synthetic peptide
  Seed: GPAQSPLQSP (MAGC1_HUMAN)
GPAQSPLQSV

SEQ ID NO: 92406 - protein, 9 aa, Artificial Sequence
  Description of Artificial Sequence: Synthetic peptide
  Seed: TLLSIFQSS (MAGC1_HUMAN)
TALSIFQSI

SEQ ID NO: 92407 - protein, 10 aa, Artificial Sequence
  Description of Artificial Sequence: Synthetic peptide
  Seed: GMSQNRLLIL (MAGC1_HUMAN)
GMSQNRLLIV

SEQ ID NO: 92408 - protein, 10 aa, Artificial Sequence
  Description of Artificial Sequence: Synthetic peptide
  Seed: TVPITFPSSY (MAGC1_HUMAN)
TWPITFPSSY

SEQ ID NO: 92409 - protein, 9 aa, Artificial Sequence
  Description of Artificial Sequence: Synthetic peptide
  Seed: RKAREFIEI (MAGC1_HUMAN)
RAAREFIEL

SEQ ID NO: 92410 - protein, 10 aa, Artificial Sequence
  Description of Artificial Sequence: Synthetic peptide
  Seed: YTLASLLQSS (MAGC1_HUMAN)
YVLASLLQSA

SEQ ID NO: 92411 - protein, 9 aa, Artificial Sequence
  Description of Artificial Sequence: Synthetic peptide
  Seed: ASSFFSSAL (MAGC1_HUMAN)
ASSFFSSAI

SEQ ID NO: 92412 - protein, 11 aa, Artificial Sequence
  Description of Artificial Sequence: Synthetic peptide
  Seed: IPMTSSFSSTL (MAGC1_HUMAN)
IWMTSSFSSTY

SEQ ID NO: 92413 - protein, 11 aa, Artificial Sequence
  Description of Artificial Sequence: Synthetic peptide
  Seed: IPMTSSFSSTL (MAGC1_HUMAN)
ISMTSSFSSTY

SEQ ID NO: 92414 - protein, 10 aa, Artificial Sequence
  Description of Artificial Sequence: Synthetic peptide
  Seed: FSYTLLSLFQ (MAGC1_HUMAN)
FAYTLLSLFY

SEQ ID NO: 92415 - protein, 9 aa, Artificial Sequence
  Description of Artificial Sequence: Synthetic peptide
  Seed: VSAASSSTL (MAGC1_HUMAN)
VSAASSSTF

SEQ ID NO: 92416 - protein, 9 aa, Artificial Sequence
  Description of Artificial Sequence: Synthetic peptide
  Seed: VSPSSSSTL (MAGC1_HUMAN)
VFPSSSSTM

SEQ ID NO: 92417 - protein, 11 aa, Artificial Sequence
  Description of Artificial Sequence: Synthetic peptide
  Seed: STFEGFAQSPL (MAGC1_HUMAN)
SQFEGFAQSPI

SEQ ID NO: 92418 - protein, 9 aa, Artificial Sequence
  Description of Artificial Sequence: Synthetic peptide
  Seed: AMLKNTVPI (MAGC1_HUMAN)
AILKNTVPV

SEQ ID NO: 92419 - protein, 9 aa, Artificial Sequence
  Description of Artificial Sequence: Synthetic peptide
  Seed: RPVSSFFSY (MAGC1_HUMAN)
RWVSSFFSF

SEQ ID NO: 92420 - protein, 11 aa, Artificial Sequence
  Description of Artificial Sequence: Synthetic peptide
  Seed: SFFSSALLSIF (MAGC1_HUMAN)
SMFSSALLSIY

SEQ ID NO: 92421 - protein, 9 aa, Artificial Sequence
  Description of Artificial Sequence: Synthetic peptide
  Seed: ASSSTLVSI (MAGC1_HUMAN)
AMSSTLVSI

SEQ ID NO: 92422 - protein, 10 aa, Artificial Sequence
  Description of Artificial Sequence: Synthetic peptide
  Seed: SLFQSFSERT (MAGC1_HUMAN)
SVFQSFSERL

SEQ ID NO: 92423 - protein, 9 aa, Artificial Sequence
  Description of Artificial Sequence: Synthetic peptide
  Seed: LQIPVSSSS (MAGC1_HUMAN)
LIIPVSSSL

SEQ ID NO: 92424 - protein, 9 aa, Artificial Sequence
  Description of Artificial Sequence: Synthetic peptide
  Seed: IPVSSSFSY (MAGC1_HUMAN)
ITVSSSFSY

SEQ ID NO: 92425 - protein, 9 aa, Artificial Sequence
  Description of Artificial Sequence: Synthetic peptide
  Seed: LQIPVSPSF (MAGC1_HUMAN)
LDIPVSPSM

SEQ ID NO: 92426 - protein, 11 aa, Artificial Sequence
  Description of Artificial Sequence: Synthetic peptide
  Seed: RSFSSTLLSIF (MAGC1_HUMAN)
RKFSSTLLSIW

SEQ ID NO: 92427 - protein, 10 aa, Artificial Sequence
  Description of Artificial Sequence: Synthetic peptide
  Seed: LQIPVSPSFS (MAGC1_HUMAN)
LHIPVSPSFF

SEQ ID NO: 92428 - protein, 11 aa, Artificial Sequence
  Description of Artificial Sequence: Synthetic peptide
  Seed: REVDPDDSYVF (MAGC1_HUMAN)
RHVDPDDSYVF

SEQ ID NO: 92429 - protein, 9 aa, Artificial Sequence
  Description of Artificial Sequence: Synthetic peptide
  Seed: MSQNRLLIL (MAGC1_HUMAN)
MSQNRLLIY

SEQ ID NO: 92430 - protein, 11 aa, Artificial Sequence
  Description of Artificial Sequence: Synthetic peptide
  Seed: SSFSYTLLSLF (MAGC1_HUMAN)
SAFSYTLLSLY

SEQ ID NO: 92431 - protein, 9 aa, Artificial Sequence
  Description of Artificial Sequence: Synthetic peptide
  Seed: ASSSTLVSI (MAGC1_HUMAN)
ASSSTLVSV

SEQ ID NO: 92432 - protein, 9 aa, Artificial Sequence
  Description of Artificial Sequence: Synthetic peptide
  Seed: SSPESDDTL (MAGC1_HUMAN)
STPESDDTL

SEQ ID NO: 92433 - protein, 10 aa, Artificial Sequence
  Description of Artificial Sequence: Synthetic peptide
  Seed: WGPRAHSEVI (MAGC1_HUMAN)
WMPRAHSEVF

SEQ ID NO: 92434 - protein, 9 aa, Artificial Sequence
  Description of Artificial Sequence: Synthetic peptide
  Seed: SPPEGENTH (MAGC1_HUMAN)
STPEGENTM

SEQ ID NO: 92435 - protein, 10 aa, Artificial Sequence
  Description of Artificial Sequence: Synthetic peptide
  Seed: SPLQIPQSSP (MAGC1_HUMAN)
SPLQIPQSSL

SEQ ID NO: 92436 - protein, 9 aa, Artificial Sequence
  Description of Artificial Sequence: Synthetic peptide
  Seed: LQIPGSPSF (MAGC1_HUMAN)
LWIPGSPSM

SEQ ID NO: 92437 - protein, 11 aa, Artificial Sequence
  Description of Artificial Sequence: Synthetic peptide
  Seed: VSSSSSSSTLL (MAGC1_HUMAN)
VQSSSSSSTLF

SEQ ID NO: 92438 - protein, 9 aa, Artificial Sequence
  Description of Artificial Sequence: Synthetic peptide
  Seed: TLDEKVDEL (MAGC1_HUMAN)
TIDEKVDEL

SEQ ID NO: 92439 - protein, 9 aa, Artificial Sequence
  Description of Artificial Sequence: Synthetic peptide
  Seed: FEGFAQSSL (MAGC1_HUMAN)
FEGFAQSSA

SEQ ID NO: 92440 - protein, 10 aa, Artificial Sequence
  Description of Artificial Sequence: Synthetic peptide
  Seed: LQIPMTSSFS (MAGC1_HUMAN)
LMIPMTSSFC

SEQ ID NO: 92441 - protein, 10 aa, Artificial Sequence
  Description of Artificial Sequence: Synthetic peptide
  Seed: YTLLSLFQSS (MAGC1_HUMAN)
YLLLSLFQSI

SEQ ID NO: 92442 - protein, 10 aa, Artificial Sequence
  Description of Artificial Sequence: Synthetic peptide
  Seed: VPITFPSSYK (MAGC1_HUMAN)
VHITFPSSYR

SEQ ID NO: 92443 - protein, 10 aa, Artificial Sequence
  Description of Artificial Sequence: Synthetic peptide
  Seed: YTLDEKVDEL (MAGC1_HUMAN)
YMLDEKVDEA

SEQ ID NO: 92444 - protein, 9 aa, Artificial Sequence
  Description of Artificial Sequence: Synthetic peptide
  Seed: FFSSALLSI (MAGC1_HUMAN)
FMSSALLSY

SEQ ID NO: 92445 - protein, 11 aa, Artificial Sequence
  Description of Artificial Sequence: Synthetic peptide
  Seed: SLQIPVSPSFS (MAGC1_HUMAN)
SRQIPVSPSFY

SEQ ID NO: 92446 - protein, 10 aa, Artificial Sequence
  Description of Artificial Sequence: Synthetic peptide
  Seed: FFSYTLASLL (MAGC1_HUMAN)
FRSYTLASLM

SEQ ID NO: 92447 - protein, 10 aa, Artificial Sequence
  Description of Artificial Sequence: Synthetic peptide
  Seed: VSSSSSSTLL (MAGC1_HUMAN)
VKSSSSSTLW

SEQ ID NO: 92448 - protein, 9 aa, Artificial Sequence
  Description of Artificial Sequence: Synthetic peptide
  Seed: TLVSIFQSS (MAGC1_HUMAN)
TQVSIFQSM

SEQ ID NO: 92449 - protein, 9 aa, Artificial Sequence
  Description of Artificial Sequence: Synthetic peptide
  Seed: SPVDEYTSS (MAGC1_HUMAN)
SPVDEYTSA

SEQ ID NO: 92450 - protein, 9 aa, Artificial Sequence
  Description of Artificial Sequence: Synthetic peptide
  Seed: STQSPFEGF (MAGC1_HUMAN)
SYQSPFEGF

SEQ ID NO: 92451 - protein, 10 aa, Artificial Sequence
  Description of Artificial Sequence: Synthetic peptide
  Seed: FPQSPLQIPV (MAGC1_HUMAN)
FSQSPLQIPY

SEQ ID NO: 92452 - protein, 9 aa, Artificial Sequence
  Description of Artificial Sequence: Synthetic peptide
  Seed: SLSPFSEES (MAGC1_HUMAN)
SVSPFSEEA

SEQ ID NO: 92453 - protein, 9 aa, Artificial Sequence
  Description of Artificial Sequence: Synthetic peptide
  Seed: SFSYTLLSL (MAGC1_HUMAN)
SYSYTLLSF

SEQ ID NO: 92454 - protein, 9 aa, Artificial Sequence
  Description of Artificial Sequence: Synthetic peptide
  Seed: LQIVPSLPE (MAGC1_HUMAN)
LMIVPSLPW

SEQ ID NO: 92455 - protein, 10 aa, Artificial Sequence
  Description of Artificial Sequence: Synthetic peptide
  Seed: RAGREHFAFG (MAGC1_HUMAN)
RSGREHFAFH

SEQ ID NO: 92456 - protein, 9 aa, Artificial Sequence
  Description of Artificial Sequence: Synthetic peptide
  Seed: LQIPVSAAS (MAGC1_HUMAN)
LIIPVSAAI

SEQ ID NO: 92457 - protein, 9 aa, Artificial Sequence
  Description of Artificial Sequence: Synthetic peptide
  Seed: CSSSTPSSL (MAGC1_HUMAN)
CISSTPSSF

SEQ ID NO: 92458 - protein, 10 aa, Artificial Sequence
  Description of Artificial Sequence: Synthetic peptide
  Seed: VPITFPSSYK (MAGC1_HUMAN)
VPITFPSSYR

SEQ ID NO: 92459 - protein, 11 aa, Artificial Sequence
  Description of Artificial Sequence: Synthetic peptide
  Seed: TLYPLQSPQSR (MAGC1_HUMAN)
TSYPLQSPQSK

SEQ ID NO: 92460 - protein, 10 aa, Artificial Sequence
  Description of Artificial Sequence: Synthetic peptide
  Seed: LLQIPMTSSF (MAGC1_HUMAN)
LWQIPMTSSM

SEQ ID NO: 92461 - protein, 9 aa, Artificial Sequence
  Description of Artificial Sequence: Synthetic peptide
  Seed: AQSPLQIPV (MAGC1_HUMAN)
ALSPLQIPV

SEQ ID NO: 92462 - protein, 9 aa, Artificial Sequence
  Description of Artificial Sequence: Synthetic peptide
  Seed: LQIPGSPSF (MAGC1_HUMAN)
LYIPGSPSI

SEQ ID NO: 92463 - protein, 9 aa, Artificial Sequence
  Description of Artificial Sequence: Synthetic peptide
  Seed: GFPQSLLQI (MAGC1_HUMAN)
GSPQSLLQL

SEQ ID NO: 92464 - protein, 9 aa, Artificial Sequence
  Description of Artificial Sequence: Synthetic peptide
  Seed: VSPSSSSTL (MAGC1_HUMAN)
VAPSSSSTL

SEQ ID NO: 92465 - protein, 9 aa, Artificial Sequence
  Description of Artificial Sequence: Synthetic peptide
  Seed: EHFAFGEPR (MAGC1_HUMAN)
ESFAFGEPK

SEQ ID NO: 92466 - protein, 9 aa, Artificial Sequence
  Description of Artificial Sequence: Synthetic peptide
  Seed: SFSERTQST (MAGC1_HUMAN)
SYSERTQSI

SEQ ID NO: 92467 - protein, 10 aa, Artificial Sequence
  Description of Artificial Sequence: Synthetic peptide
  Seed: ASSFFSSALL (MAGC1_HUMAN)
ASSFFSSALV

SEQ ID NO: 92468 - protein, 9 aa, Artificial Sequence
  Description of Artificial Sequence: Synthetic peptide
  Seed: FAFGEPREL (MAGC1_HUMAN)
FYFGEPREA

SEQ ID NO: 92469 - protein, 9 aa, Artificial Sequence
  Description of Artificial Sequence: Synthetic peptide
  Seed: LQIVPSLPE (MAGC1_HUMAN)
LRIVPSLPL

SEQ ID NO: 92470 - protein, 10 aa, Artificial Sequence
  Description of Artificial Sequence: Synthetic peptide
  Seed: SSSSSSSTLL (MAGC1_HUMAN)
STSSSSSTLF

SEQ ID NO: 92471 - protein, 11 aa, Artificial Sequence
  Description of Artificial Sequence: Synthetic peptide
  Seed: VSSSSSSSTLL (MAGC1_HUMAN)
VLSSSSSSTLF

SEQ ID NO: 92472 - protein, 10 aa, Artificial Sequence
  Description of Artificial Sequence: Synthetic peptide
  Seed: ICSSSTSLSL (MAGC1_HUMAN)
IWSSSTSLSY

SEQ ID NO: 92473 - protein, 10 aa, Artificial Sequence
  Description of Artificial Sequence: Synthetic peptide
  Seed: YTLLSLFQSS (MAGC1_HUMAN)
YWLLSLFQSV

SEQ ID NO: 92474 - protein, 10 aa, Artificial Sequence
  Description of Artificial Sequence: Synthetic peptide
  Seed: REFIEILFGI (MAGC1_HUMAN)
RVFIEILFGI

SEQ ID NO: 92475 - protein, 10 aa, Artificial Sequence
  Description of Artificial Sequence: Synthetic peptide
  Seed: SFSSTLLSIF (MAGC1_HUMAN)
SFSSTLLSIW

SEQ ID NO: 92476 - protein, 10 aa, Artificial Sequence
  Description of Artificial Sequence: Synthetic peptide
  Seed: SSPESAQSTF (MAGC1_HUMAN)
SQPESAQSTY

SEQ ID NO: 92477 - protein, 10 aa, Artificial Sequence
  Description of Artificial Sequence: Synthetic peptide
  Seed: MPTAGMPSLL (MAGC1_HUMAN)
MYTAGMPSLY

SEQ ID NO: 92478 - protein, 11 aa, Artificial Sequence
  Description of Artificial Sequence: Synthetic peptide
  Seed: FQSSLQSPVSI (MAGC1_HUMAN)
FLSSLQSPVSM

SEQ ID NO: 92479 - protein, 9 aa, Artificial Sequence
  Description of Artificial Sequence: Synthetic peptide
  Seed: FFSYTLASL (MAGC1_HUMAN)
FMSYTLASA

SEQ ID NO: 92480 - protein, 10 aa, Artificial Sequence
  Description of Artificial Sequence: Synthetic peptide
  Seed: SVLQIPVSAA (MAGC1_HUMAN)
SLLQIPVSAA

SEQ ID NO: 92481 - protein, 9 aa, Artificial Sequence
  Description of Artificial Sequence: Synthetic peptide
  Seed: SSSTSLSPF (MAGC1_HUMAN)
SPSTSLSPM

SEQ ID NO: 92482 - protein, 10 aa, Artificial Sequence
  Description of Artificial Sequence: Synthetic peptide
  Seed: SSPPRYEFLW (MAGC1_HUMAN)
SFPPRYEFLF

SEQ ID NO: 92483 - protein, 9 aa, Artificial Sequence
  Description of Artificial Sequence: Synthetic peptide
  Seed: VSRSFSSTL (MAGC1_HUMAN)
VTRSFSSTF

SEQ ID NO: 92484 - protein, 9 aa, Artificial Sequence
  Description of Artificial Sequence: Synthetic peptide
  Seed: VSPSSSSTL (MAGC1_HUMAN)
VAPSSSSTM

SEQ ID NO: 92485 - protein, 10 aa, Artificial Sequence
  Description of Artificial Sequence: Synthetic peptide
  Seed: VSSSSSSTLL (MAGC1_HUMAN)
VFSSSSSTLY

SEQ ID NO: 92486 - protein, 10 aa, Artificial Sequence
  Description of Artificial Sequence: Synthetic peptide
  Seed: STPSSLPQSF (MAGC1_HUMAN)
SMPSSLPQSL

SEQ ID NO: 92487 - protein, 9 aa, Artificial Sequence
  Description of Artificial Sequence: Synthetic peptide
  Seed: VSSSSSSTL (MAGC1_HUMAN)
VMSSSSSTI

SEQ ID NO: 92488 - protein, 10 aa, Artificial Sequence
  Description of Artificial Sequence: Synthetic peptide
  Seed: VSSSFSYTLL (MAGC1_HUMAN)
VSSSFSYTLY

SEQ ID NO: 92489 - protein, 9 aa, Artificial Sequence
  Description of Artificial Sequence: Synthetic peptide
  Seed: KDSQSPLQI (MAGC1_HUMAN)
KQSQSPLQW

SEQ ID NO: 92490 - protein, 10 aa, Artificial Sequence
  Description of Artificial Sequence: Synthetic peptide
  Seed: FFSYTLASLL (MAGC1_HUMAN)
FSSYTLASLY

SEQ ID NO: 92491 - protein, 9 aa, Artificial Sequence
  Description of Artificial Sequence: Synthetic peptide
  Seed: SFFSYTLAS (MAGC1_HUMAN)
SWFSYTLAL

SEQ ID NO: 92492 - protein, 9 aa, Artificial Sequence
  Description of Artificial Sequence: Synthetic peptide
  Seed: AQSSLQIPV (MAGC1_HUMAN)
AVSSLQIPY

SEQ ID NO: 92493 - protein, 11 aa, Artificial Sequence
  Description of Artificial Sequence: Synthetic peptide
  Seed: NPASSFFSSAL (MAGC1_HUMAN)
NPASSFFSSAF

SEQ ID NO: 92494 - protein, 9 aa, Artificial Sequence
  Description of Artificial Sequence: Synthetic peptide
  Seed: SSPESTQSP (MAGC1_HUMAN)
SSPESTQSI

SEQ ID NO: 92495 - protein, 10 aa, Artificial Sequence
  Description of Artificial Sequence: Synthetic peptide
  Seed: FFSYTLASLL (MAGC1_HUMAN)
FGSYTLASLM

SEQ ID NO: 92496 - protein, 9 aa, Artificial Sequence
  Description of Artificial Sequence: Synthetic peptide
  Seed: SPESAQSTF (MAGC1_HUMAN)
SPESAQSTL

SEQ ID NO: 92497 - protein, 9 aa, Artificial Sequence
  Description of Artificial Sequence: Synthetic peptide
  Seed: SSPESAQSA (MAGC1_HUMAN)
SQPESAQSM

SEQ ID NO: 92498 - protein, 9 aa, Artificial Sequence
  Description of Artificial Sequence: Synthetic peptide
  Seed: SSSSSSSTL (MAGC1_HUMAN)
SMSSSSSTW

SEQ ID NO: 92499 - protein, 10 aa, Artificial Sequence
  Description of Artificial Sequence: Synthetic peptide
  Seed: EMLTNVISRY (MAGC1_HUMAN)
EILTNVISRY

SEQ ID NO: 92500 - protein, 9 aa, Artificial Sequence
  Description of Artificial Sequence: Synthetic peptide
  Seed: RKAREFIEI (MAGC1_HUMAN)
RQAREFIEI

SEQ ID NO: 92501 - protein, 10 aa, Artificial Sequence
  Description of Artificial Sequence: Synthetic peptide
  Seed: VKQPITKAEM (MAGC1_HUMAN)
VQQPITKAEF

SEQ ID NO: 92502 - protein, 11 aa, Artificial Sequence
  Description of Artificial Sequence: Synthetic peptide
  Seed: SSFFSSALLSI (MAGC1_HUMAN)
SSFFSSALLSF

SEQ ID NO: 92503 - protein, 9 aa, Artificial Sequence
  Description of Artificial Sequence: Synthetic peptide
  Seed: VIFRKAREF (MAGC1_HUMAN)
VQFRKAREF

SEQ ID NO: 92504 - protein, 10 aa, Artificial Sequence
  Description of Artificial Sequence: Synthetic peptide
  Seed: TLDEKVDELA (MAGC1_HUMAN)
TMDEKVDELL

SEQ ID NO: 92505 - protein, 9 aa, Artificial Sequence
  Description of Artificial Sequence: Synthetic peptide
  Seed: CSSSTPSSL (MAGC1_HUMAN)
CASSTPSSL

SEQ ID NO: 92506 - protein, 11 aa, Artificial Sequence
  Description of Artificial Sequence: Synthetic peptide
  Seed: SFPSSTSSSLS (MAGC1_HUMAN)
SRPSSTSSSLL

SEQ ID NO: 92507 - protein, 9 aa, Artificial Sequence
  Description of Artificial Sequence: Synthetic peptide
  Seed: IIDTTDDST (MAGC1_HUMAN)
ICDTTDDSM

SEQ ID NO: 92508 - protein, 10 aa, Artificial Sequence
  Description of Artificial Sequence: Synthetic peptide
  Seed: TTDDSTATES (MAGC1_HUMAN)
TMDDSTATEI

SEQ ID NO: 92509 - protein, 9 aa, Artificial Sequence
  Description of Artificial Sequence: Synthetic peptide
  Seed: LQIPVSSSS (MAGC1_HUMAN)
LQIPVSSSH

SEQ ID NO: 92510 - protein, 9 aa, Artificial Sequence
  Description of Artificial Sequence: Synthetic peptide
  Seed: LILSIIFIK (MAGC1_HUMAN)
LLLSIIFIR

SEQ ID NO: 92511 - protein, 10 aa, Artificial Sequence
  Description of Artificial Sequence: Synthetic peptide
  Seed: FAQSSLQIPV (MAGC1_HUMAN)
FMQSSLQIPT

SEQ ID NO: 92512 - protein, 10 aa, Artificial Sequence
  Description of Artificial Sequence: Synthetic peptide
  Seed: SSPERTHSTF (MAGC1_HUMAN)
SMPERTHSTM

SEQ ID NO: 92513 - protein, 9 aa, Artificial Sequence
  Description of Artificial Sequence: Synthetic peptide
  Seed: KDSLSPLEI (MAGC1_HUMAN)
KRSLSPLEL

SEQ ID NO: 92514 - protein, 9 aa, Artificial Sequence
  Description of Artificial Sequence: Synthetic peptide
  Seed: FFSYTLASL (MAGC1_HUMAN)
FCSYTLASF

SEQ ID NO: 92515 - protein, 9 aa, Artificial Sequence
  Description of Artificial Sequence: Synthetic peptide
  Seed: EFIEILFGI (MAGC1_HUMAN)
ETIEILFGC

SEQ ID NO: 92516 - protein, 10 aa, Artificial Sequence
  Description of Artificial Sequence: Synthetic peptide
  Seed: KVVEFLAMLK (MAGC1_HUMAN)
KEVEFLAMLK

SEQ ID NO: 92517 - protein, 10 aa, Artificial Sequence
  Description of Artificial Sequence: Synthetic peptide
  Seed: VISFSSSTSL (MAGC1_HUMAN)
VRSFSSSTSL

SEQ ID NO: 92518 - protein, 9 aa, Artificial Sequence
  Description of Artificial Sequence: Synthetic peptide
  Seed: DALKDVEER (MAGC1_HUMAN)
DTLKDVEEK

SEQ ID NO: 92519 - protein, 9 aa, Artificial Sequence
  Description of Artificial Sequence: Synthetic peptide
  Seed: MLKNTVPIT (MAGC1_HUMAN)
MMKNTVPIL

SEQ ID NO: 92520 - protein, 10 aa, Artificial Sequence
  Description of Artificial Sequence: Synthetic peptide
  Seed: ICSSSTSLSL (MAGC1_HUMAN)
IWSSSTSLSW

SEQ ID NO: 92521 - protein, 9 aa, Artificial Sequence
  Description of Artificial Sequence: Synthetic peptide
  Seed: LSDEQGMSQ (MAGC1_HUMAN)
LMDEQGMSL

SEQ ID NO: 92522 - protein, 11 aa, Artificial Sequence
  Description of Artificial Sequence: Synthetic peptide
  Seed: VDEYTSSSDTL (MAGC1_HUMAN)
VTEYTSSSDTF

SEQ ID NO: 92523 - protein, 11 aa, Artificial Sequence
  Description of Artificial Sequence: Synthetic peptide
  Seed: FLWGPRAHSEV (MAGC1_HUMAN)
FMWGPRAHSEV

SEQ ID NO: 92524 - protein, 9 aa, Artificial Sequence
  Description of Artificial Sequence: Synthetic peptide
  Seed: SRSFSSTLL (MAGC1_HUMAN)
SHSFSSTLM

SEQ ID NO: 92525 - protein, 9 aa, Artificial Sequence
  Description of Artificial Sequence: Synthetic peptide
  Seed: RYTGYFPVI (MAGC1_HUMAN)
RYTGYFPVV

SEQ ID NO: 92526 - protein, 9 aa, Artificial Sequence
  Description of Artificial Sequence: Synthetic peptide
  Seed: SSSTLVSIF (MAGC1_HUMAN)
STSTLVSIV

SEQ ID NO: 92527 - protein, 9 aa, Artificial Sequence
  Description of Artificial Sequence: Synthetic peptide
  Seed: VISRYTGYF (MAGC1_HUMAN)
VMSRYTGYF

SEQ ID NO: 92528 - protein, 9 aa, Artificial Sequence
  Description of Artificial Sequence: Synthetic peptide
  Seed: MGDKDMPTA (MAGC1_HUMAN)
MADKDMPTF

SEQ ID NO: 92529 - protein, 9 aa, Artificial Sequence
  Description of Artificial Sequence: Synthetic peptide
  Seed: TFEGFPQSL (MAGC1_HUMAN)
TVEGFPQSL

SEQ ID NO: 92530 - protein, 9 aa, Artificial Sequence
  Description of Artificial Sequence: Synthetic peptide
  Seed: ASSFFSSAL (MAGC1_HUMAN)
AYSFFSSAI

SEQ ID NO: 92531 - protein, 9 aa, Artificial Sequence
  Description of Artificial Sequence: Synthetic peptide
  Seed: VSPSSSSTL (MAGC1_HUMAN)
VVPSSSSTI

SEQ ID NO: 92532 - protein, 10 aa, Artificial Sequence
  Description of Artificial Sequence: Synthetic peptide
  Seed: SPLQSPVSSF (MAGC1_HUMAN)
SALQSPVSSF

SEQ ID NO: 92533 - protein, 9 aa, Artificial Sequence
  Description of Artificial Sequence: Synthetic peptide
  Seed: SPFSEESSS (MAGC1_HUMAN)
SPFSEESSM

SEQ ID NO: 92534 - protein, 9 aa, Artificial Sequence
  Description of Artificial Sequence: Synthetic peptide
  Seed: SSLSQSSPV (MAGC1_HUMAN)
SLLSQSSPV

SEQ ID NO: 92535 - protein, 9 aa, Artificial Sequence
  Description of Artificial Sequence: Synthetic peptide
  Seed: LLILILSII (MAGC1_HUMAN)
LMILILSII

SEQ ID NO: 92536 - protein, 9 aa, Artificial Sequence
  Description of Artificial Sequence: Synthetic peptide
  Seed: SFSERTQST (MAGC1_HUMAN)
SYSERTQSL

SEQ ID NO: 92537 - protein, 9 aa, Artificial Sequence
  Description of Artificial Sequence: Synthetic peptide
  Seed: DPDDSYVFV (MAGC1_HUMAN)
DADDSYVFL

SEQ ID NO: 92538 - protein, 10 aa, Artificial Sequence
  Description of Artificial Sequence: Synthetic peptide
  Seed: KAREFIEILF (MAGC1_HUMAN)
KTREFIEILM

SEQ ID NO: 92539 - protein, 9 aa, Artificial Sequence
  Description of Artificial Sequence: Synthetic peptide
  Seed: YTLLSLFQS (MAGC1_HUMAN)
YALLSLFQI

SEQ ID NO: 92540 - protein, 10 aa, Artificial Sequence
  Description of Artificial Sequence: Synthetic peptide
  Seed: SFSSTLLSIF (MAGC1_HUMAN)
SWSSTLLSIF

SEQ ID NO: 92541 - protein, 11 aa, Artificial Sequence
  Description of Artificial Sequence: Synthetic peptide
  Seed: SPLQIPVSPSS (MAGC1_HUMAN)
SVLQIPVSPSY

SEQ ID NO: 92542 - protein, 10 aa, Artificial Sequence
  Description of Artificial Sequence: Synthetic peptide
  Seed: EILFGISLRE (MAGC1_HUMAN)
EWLFGISLRR

SEQ ID NO: 92543 - protein, 9 aa, Artificial Sequence
  Description of Artificial Sequence: Synthetic peptide
  Seed: TTDDSTATE (MAGC1_HUMAN)
TWDDSTATI

SEQ ID NO: 92544 - protein, 10 aa, Artificial Sequence
  Description of Artificial Sequence: Synthetic peptide
  Seed: REHFAFGEPR (MAGC1_HUMAN)
RSHFAFGEPK

SEQ ID NO: 92545 - protein, 10 aa, Artificial Sequence
  Description of Artificial Sequence: Synthetic peptide
  Seed: FFSYTLASLL (MAGC1_HUMAN)
FCSYTLASLF

SEQ ID NO: 92546 - protein, 10 aa, Artificial Sequence
  Description of Artificial Sequence: Synthetic peptide
  Seed: SSFSYTLLSL (MAGC1_HUMAN)
SVFSYTLLSA

SEQ ID NO: 92547 - protein, 9 aa, Artificial Sequence
  Description of Artificial Sequence: Synthetic peptide
  Seed: FSSTLLSLF (MAGC1_HUMAN)
FLSTLLSLT

SEQ ID NO: 92548 - protein, 9 aa, Artificial Sequence
  Description of Artificial Sequence: Synthetic peptide
  Seed: KVVEFLAML (MAGC1_HUMAN)
KMVEFLAMW

SEQ ID NO: 92549 - protein, 11 aa, Artificial Sequence
  Description of Artificial Sequence: Synthetic peptide
  Seed: TSSFSSTLLSI (MAGC1_HUMAN)
TVSFSSTLLSW

SEQ ID NO: 92550 - protein, 9 aa, Artificial Sequence
  Description of Artificial Sequence: Synthetic peptide
  Seed: SSFFSSALL (MAGC1_HUMAN)
SQFFSSALV

SEQ ID NO: 92551 - protein, 10 aa, Artificial Sequence
  Description of Artificial Sequence: Synthetic peptide
  Seed: LQIPVSSSFS (MAGC1_HUMAN)
LVIPVSSSFY

SEQ ID NO: 92552 - protein, 8 aa, Artificial Sequence
  Description of Artificial Sequence: Synthetic peptide
  Seed: AFGEPREL (MAGC1_HUMAN)
AYGEPREM

SEQ ID NO: 92553 - protein, 10 aa, Artificial Sequence
  Description of Artificial Sequence: Synthetic peptide
  Seed: LQIPVSSSFS (MAGC1_HUMAN)
LMIPVSSSFM

SEQ ID NO: 92554 - protein, 9 aa, Artificial Sequence
  Description of Artificial Sequence: Synthetic peptide
  Seed: SSSVMSPSF (MAGC1_HUMAN)
SQSVMSPSF

SEQ ID NO: 92555 - protein, 10 aa, Artificial Sequence
  Description of Artificial Sequence: Synthetic peptide
  Seed: RAHSEVIKRK (MAGC1_HUMAN)
RTHSEVIKRK

SEQ ID NO: 92556 - protein, 9 aa, Artificial Sequence
  Description of Artificial Sequence: Synthetic peptide
  Seed: RKVVEFLAM (MAGC1_HUMAN)
RNVVEFLAM

SEQ ID NO: 92557 - protein, 10 aa, Artificial Sequence
  Description of Artificial Sequence: Synthetic peptide
  Seed: KRKVVEFLAM (MAGC1_HUMAN)
KRKVVEFLAF

SEQ ID NO: 92558 - protein, 9 aa, Artificial Sequence
  Description of Artificial Sequence: Synthetic peptide
  Seed: VSPSFSSTL (MAGC1_HUMAN)
VLPSFSSTV

SEQ ID NO: 92559 - protein, 10 aa, Artificial Sequence
  Description of Artificial Sequence: Synthetic peptide
  Seed: SSSSSTLLSL (MAGC1_HUMAN)
SCSSSTLLSY

SEQ ID NO: 92560 - protein, 9 aa, Artificial Sequence
  Description of Artificial Sequence: Synthetic peptide
  Seed: FFSSALLSI (MAGC1_HUMAN)
FRSSALLSY

SEQ ID NO: 92561 - protein, 10 aa, Artificial Sequence
  Description of Artificial Sequence: Synthetic peptide
  Seed: SPLYFPQSPL (MAGC1_HUMAN)
SPLYFPQSPF

SEQ ID NO: 92562 - protein, 11 aa, Artificial Sequence
  Description of Artificial Sequence: Synthetic peptide
  Seed: SPLQIPVSPSS (MAGC1_HUMAN)
SPLQIPVSPSL

SEQ ID NO: 92563 - protein, 10 aa, Artificial Sequence
  Description of Artificial Sequence: Synthetic peptide
  Seed: SSPESAQSAF (MAGC1_HUMAN)
SAPESAQSAL

SEQ ID NO: 92564 - protein, 9 aa, Artificial Sequence
  Description of Artificial Sequence: Synthetic peptide
  Seed: SSFFSSALL (MAGC1_HUMAN)
SVFFSSALK

SEQ ID NO: 92565 - protein, 9 aa, Artificial Sequence
  Description of Artificial Sequence: Synthetic peptide
  Seed: FSYTLLSLF (MAGC1_HUMAN)
FWYTLLSLF

SEQ ID NO: 92566 - protein, 10 aa, Artificial Sequence
  Description of Artificial Sequence: Synthetic peptide
  Seed: EVIWDVLSGI (MAGC1_HUMAN)
ELIWDVLSGR

SEQ ID NO: 92567 - protein, 11 aa, Artificial Sequence
  Description of Artificial Sequence: Synthetic peptide
  Seed: FLWGPRAHSEV (MAGC1_HUMAN)
FVWGPRAHSEV

SEQ ID NO: 92568 - protein, 9 aa, Artificial Sequence
  Description of Artificial Sequence: Synthetic peptide
  Seed: RTQSTFEGF (MAGC1_HUMAN)
RIQSTFEGI

SEQ ID NO: 92569 - protein, 11 aa, Artificial Sequence
  Description of Artificial Sequence: Synthetic peptide
  Seed: IPVSPSSSSTL (MAGC1_HUMAN)
IMVSPSSSSTF

SEQ ID NO: 92570 - protein, 8 aa, Artificial Sequence
  Description of Artificial Sequence: Synthetic peptide
  Seed: RSFSSTLL (MAGC1_HUMAN)
RAFSSTLF

SEQ ID NO: 92571 - protein, 9 aa, Artificial Sequence
  Description of Artificial Sequence: Synthetic peptide
  Seed: SAQSAFEGF (MAGC1_HUMAN)
SKQSAFEGF

SEQ ID NO: 92572 - protein, 10 aa, Artificial Sequence
  Description of Artificial Sequence: Synthetic peptide
  Seed: SSSSSSSTLL (MAGC1_HUMAN)
SASSSSSTLF

SEQ ID NO: 92573 - protein, 9 aa, Artificial Sequence
  Description of Artificial Sequence: Synthetic peptide
  Seed: AASSSTLVS (MAGC1_HUMAN)
ASSSSTLVY

SEQ ID NO: 92574 - protein, 11 aa, Artificial Sequence
  Description of Artificial Sequence: Synthetic peptide
  Seed: RSFSSTLLSIF (MAGC1_HUMAN)
RIFSSTLLSIY

SEQ ID NO: 92575 - protein, 11 aa, Artificial Sequence
  Description of Artificial Sequence: Synthetic peptide
  Seed: IPMTSSFSSTL (MAGC1_HUMAN)
IWMTSSFSSTF

SEQ ID NO: 92576 - protein, 10 aa, Artificial Sequence
  Description of Artificial Sequence: Synthetic peptide
  Seed: IPVSPSFSST (MAGC1_HUMAN)
IPVSPSFSSF

SEQ ID NO: 92577 - protein, 10 aa, Artificial Sequence
  Description of Artificial Sequence: Synthetic peptide
  Seed: FPQSLLQIPM (MAGC1_HUMAN)
FLQSLLQIPL

SEQ ID NO: 92578 - protein, 10 aa, Artificial Sequence
  Description of Artificial Sequence: Synthetic peptide
  Seed: SRYTGYFPVI (MAGC1_HUMAN)
SKYTGYFPVF

SEQ ID NO: 92579 - protein, 10 aa, Artificial Sequence
  Description of Artificial Sequence: Synthetic peptide
  Seed: YTLASLLQSS (MAGC1_HUMAN)
YNLASLLQSM

SEQ ID NO: 92580 - protein, 9 aa, Artificial Sequence
  Description of Artificial Sequence: Synthetic peptide
  Seed: AQSPLQRPV (MAGC1_HUMAN)
AASPLQRPM

SEQ ID NO: 92581 - protein, 10 aa, Artificial Sequence
  Description of Artificial Sequence: Synthetic peptide
  Seed: VISFSSSTSL (MAGC1_HUMAN)
VISFSSSTSY

SEQ ID NO: 92582 - protein, 11 aa, Artificial Sequence
  Description of Artificial Sequence: Synthetic peptide
  Seed: MSPLYFPQSPL (MAGC1_HUMAN)
MPPLYFPQSPM

SEQ ID NO: 92583 - protein, 10 aa, Artificial Sequence
  Description of Artificial Sequence: Synthetic peptide
  Seed: ICSSSTSLSL (MAGC1_HUMAN)
IISSSTSLSM

SEQ ID NO: 92584 - protein, 10 aa, Artificial Sequence
  Description of Artificial Sequence: Synthetic peptide
  Seed: FFSSALLSIF (MAGC1_HUMAN)
FMSSALLSIY

SEQ ID NO: 92585 - protein, 9 aa, Artificial Sequence
  Description of Artificial Sequence: Synthetic peptide
  Seed: IIDTTDDST (MAGC1_HUMAN)
IWDTTDDSL

SEQ ID NO: 92586 - protein, 9 aa, Artificial Sequence
  Description of Artificial Sequence: Synthetic peptide
  Seed: FPSSTSSSL (MAGC1_HUMAN)
FLSSTSSSY

SEQ ID NO: 92587 - protein, 9 aa, Artificial Sequence
  Description of Artificial Sequence: Synthetic peptide
  Seed: NSSPPRYEF (MAGC1_HUMAN)
NPSPPRYEM

SEQ ID NO: 92588 - protein, 10 aa, Artificial Sequence
  Description of Artificial Sequence: Synthetic peptide
  Seed: QIPVSSSFSY (MAGC1_HUMAN)
QLPVSSSFSY

SEQ ID NO: 92589 - protein, 10 aa, Artificial Sequence
  Description of Artificial Sequence: Synthetic peptide
  Seed: SSFSYTLLSL (MAGC1_HUMAN)
SQFSYTLLSM

SEQ ID NO: 92590 - protein, 9 aa, Artificial Sequence
  Description of Artificial Sequence: Synthetic peptide
  Seed: MTSSFSSTL (MAGC1_HUMAN)
MYSSFSSTF

SEQ ID NO: 92591 - protein, 11 aa, Artificial Sequence
  Description of Artificial Sequence: Synthetic peptide
  Seed: KRKVVEFLAML (MAGC1_HUMAN)
KLKVVEFLAML

SEQ ID NO: 92592 - protein, 10 aa, Artificial Sequence
  Description of Artificial Sequence: Synthetic peptide
  Seed: RAGREHFAFG (MAGC1_HUMAN)
RQGREHFAFK

SEQ ID NO: 92593 - protein, 9 aa, Artificial Sequence
  Description of Artificial Sequence: Synthetic peptide
  Seed: IPMTSSFSS (MAGC1_HUMAN)
ITMTSSFSF

SEQ ID NO: 92594 - protein, 11 aa, Artificial Sequence
  Description of Artificial Sequence: Synthetic peptide
  Seed: QSSPESAQSAF (MAGC1_HUMAN)
QLSPESAQSAW

SEQ ID NO: 92595 - protein, 9 aa, Artificial Sequence
  Description of Artificial Sequence: Synthetic peptide
  Seed: VISRYTGYF (MAGC1_HUMAN)
VSSRYTGYM

SEQ ID NO: 92596 - protein, 9 aa, Artificial Sequence
  Description of Artificial Sequence: Synthetic peptide
  Seed: ISRYTGYFP (MAGC1_HUMAN)
IMRYTGYFA

SEQ ID NO: 92597 - protein, 11 aa, Artificial Sequence
  Description of Artificial Sequence: Synthetic peptide
  Seed: SSFPSSTSSSL (MAGC1_HUMAN)
SVFPSSTSSSL

SEQ ID NO: 92598 - protein, 10 aa, Artificial Sequence
  Description of Artificial Sequence: Synthetic peptide
  Seed: SLIESEPLFT (MAGC1_HUMAN)
SIIESEPLFV

SEQ ID NO: 92599 - protein, 10 aa, Artificial Sequence
  Description of Artificial Sequence: Synthetic peptide
  Seed: RLLILILSII (MAGC1_HUMAN)
RFLILILSIV

SEQ ID NO: 92600 - protein, 9 aa, Artificial Sequence
  Description of Artificial Sequence: Synthetic peptide
  Seed: RSFSSTLLS (MAGC1_HUMAN)
RYFSSTLLK

SEQ ID NO: 92601 - protein, 9 aa, Artificial Sequence
  Description of Artificial Sequence: Synthetic peptide
  Seed: EHFAFGEPR (MAGC1_HUMAN)
ETFAFGEPY

SEQ ID NO: 92602 - protein, 10 aa, Artificial Sequence
  Description of Artificial Sequence: Synthetic peptide
  Seed: VSSSSSSSTL (MAGC1_HUMAN)
VNSSSSSSTY

SEQ ID NO: 92603 - protein, 11 aa, Artificial Sequence
  Description of Artificial Sequence: Synthetic peptide
  Seed: SASSSVMSPSF (MAGC1_HUMAN)
SQSSSVMSPSF

SEQ ID NO: 92604 - protein, 10 aa, Artificial Sequence
  Description of Artificial Sequence: Synthetic peptide
  Seed: STFEGFPQSL (MAGC1_HUMAN)
SLFEGFPQSM

SEQ ID NO: 92605 - protein, 9 aa, Artificial Sequence
  Description of Artificial Sequence: Synthetic peptide
  Seed: SSPERTHST (MAGC1_HUMAN)
SNPERTHSF

SEQ ID NO: 92606 - protein, 11 aa, Artificial Sequence
  Description of Artificial Sequence: Synthetic peptide
  Seed: SSFPSSTSSSL (MAGC1_HUMAN)
SSFPSSTSSSH

SEQ ID NO: 92607 - protein, 10 aa, Artificial Sequence
  Description of Artificial Sequence: Synthetic peptide
  Seed: VSAASSSTLV (MAGC1_HUMAN)
VSAASSSTLW

SEQ ID NO: 92608 - protein, 9 aa, Artificial Sequence
  Description of Artificial Sequence: Synthetic peptide
  Seed: SEVIKRKVV (MAGC1_HUMAN)
SQVIKRKVV

SEQ ID NO: 92609 - protein, 9 aa, Artificial Sequence
  Description of Artificial Sequence: Synthetic peptide
  Seed: ISRYTGYFP (MAGC1_HUMAN)
IMRYTGYFV

SEQ ID NO: 92610 - protein, 9 aa, Artificial Sequence
  Description of Artificial Sequence: Synthetic peptide
  Seed: ISFSSSTSL (MAGC1_HUMAN)
IYFSSSTSW

SEQ ID NO: 92611 - protein, 9 aa, Artificial Sequence
  Description of Artificial Sequence: Synthetic peptide
  Seed: RAHSEVIKR (MAGC1_HUMAN)
RTHSEVIKV

SEQ ID NO: 92612 - protein, 9 aa, Artificial Sequence
  Description of Artificial Sequence: Synthetic peptide
  Seed: DEQGMSQNR (MAGC1_HUMAN)
DAQGMSQNR

SEQ ID NO: 92613 - protein, 9 aa, Artificial Sequence
  Description of Artificial Sequence: Synthetic peptide
  Seed: MTSSFSSTL (MAGC1_HUMAN)
MSSSFSSTW

SEQ ID NO: 92614 - protein, 11 aa, Artificial Sequence
  Description of Artificial Sequence: Synthetic peptide
  Seed: SQSSPEGKDSL (MAGC1_HUMAN)
SMSSPEGKDSY

SEQ ID NO: 92615 - protein, 9 aa, Artificial Sequence
  Description of Artificial Sequence: Synthetic peptide
  Seed: SAASSSTLV (MAGC1_HUMAN)
SLASSSTLI

SEQ ID NO: 92616 - protein, 10 aa, Artificial Sequence
  Description of Artificial Sequence: Synthetic peptide
  Seed: FAFGEPRELL (MAGC1_HUMAN)
FVFGEPRELY

SEQ ID NO: 92617 - protein, 10 aa, Artificial Sequence
  Description of Artificial Sequence: Synthetic peptide
  Seed: ASSFFSSALL (MAGC1_HUMAN)
AKSFFSSALY

SEQ ID NO: 92618 - protein, 10 aa, Artificial Sequence
  Description of Artificial Sequence: Synthetic peptide
  Seed: ATESASSSVM (MAGC1_HUMAN)
ARESASSSVL

SEQ ID NO: 92619 - protein, 10 aa, Artificial Sequence
  Description of Artificial Sequence: Synthetic peptide
  Seed: QSSPEGKDSL (MAGC1_HUMAN)
QTSPEGKDSW

SEQ ID NO: 92620 - protein, 9 aa, Artificial Sequence
  Description of Artificial Sequence: Synthetic peptide
  Seed: LQIPGSPSF (MAGC1_HUMAN)
LLIPGSPSA

SEQ ID NO: 92621 - protein, 9 aa, Artificial Sequence
  Description of Artificial Sequence: Synthetic peptide
  Seed: ISFSSSTSL (MAGC1_HUMAN)
ILFSSSTSI

SEQ ID NO: 92622 - protein, 9 aa, Artificial Sequence
  Description of Artificial Sequence: Synthetic peptide
  Seed: LQIPVSPSF (MAGC1_HUMAN)
LAIPVSPSF

SEQ ID NO: 92623 - protein, 10 aa, Artificial Sequence
  Description of Artificial Sequence: Synthetic peptide
  Seed: ICSSSTSLSL (MAGC1_HUMAN)
ISSSSTSLSW

SEQ ID NO: 92624 - protein, 10 aa, Artificial Sequence
  Description of Artificial Sequence: Synthetic peptide
  Seed: YTLASLLQSS (MAGC1_HUMAN)
YNLASLLQSL

SEQ ID NO: 92625 - protein, 10 aa, Artificial Sequence
  Description of Artificial Sequence: Synthetic peptide
  Seed: SSPPRYEFLW (MAGC1_HUMAN)
SLPPRYEFLF

SEQ ID NO: 92626 - protein, 9 aa, Artificial Sequence
  Description of Artificial Sequence: Synthetic peptide
  Seed: NVISRYTGY (MAGC1_HUMAN)
NLISRYTGF

SEQ ID NO: 92627 - protein, 9 aa, Artificial Sequence
  Description of Artificial Sequence: Synthetic peptide
  Seed: AQSPLQRPV (MAGC1_HUMAN)
ATSPLQRPV

SEQ ID NO: 92628 - protein, 9 aa, Artificial Sequence
  Description of Artificial Sequence: Synthetic peptide
  Seed: EDSLSPLQI (MAGC1_HUMAN)
EESLSPLQI

SEQ ID NO: 92629 - protein, 10 aa, Artificial Sequence
  Description of Artificial Sequence: Synthetic peptide
  Seed: ASSFFSSALL (MAGC1_HUMAN)
ACSFFSSALM

SEQ ID NO: 92630 - protein, 9 aa, Artificial Sequence
  Description of Artificial Sequence: Synthetic peptide
  Seed: FSYTLASLL (MAGC1_HUMAN)
FSYTLASLY

SEQ ID NO: 92631 - protein, 11 aa, Artificial Sequence
  Description of Artificial Sequence: Synthetic peptide
  Seed: REVDPDDSYVF (MAGC1_HUMAN)
RLVDPDDSYVF

SEQ ID NO: 92632 - protein, 11 aa, Artificial Sequence
  Description of Artificial Sequence: Synthetic peptide
  Seed: LQIPVSSSFSY (MAGC1_HUMAN)
LAIPVSSSFSW

SEQ ID NO: 92633 - protein, 9 aa, Artificial Sequence
  Description of Artificial Sequence: Synthetic peptide
  Seed: KDSLSPLEI (MAGC1_HUMAN)
KQSLSPLEW

SEQ ID NO: 92634 - protein, 9 aa, Artificial Sequence
  Description of Artificial Sequence: Synthetic peptide
  Seed: FSYTLLSLF (MAGC1_HUMAN)
FRYTLLSLY

SEQ ID NO: 92635 - protein, 10 aa, Artificial Sequence
  Description of Artificial Sequence: Synthetic peptide
  Seed: LAMLKNTVPI (MAGC1_HUMAN)
LGMLKNTVPY

SEQ ID NO: 92636 - protein, 9 aa, Artificial Sequence
  Description of Artificial Sequence: Synthetic peptide
  Seed: KVWVQEHYL (MAGC1_HUMAN)
KMWVQEHYV

SEQ ID NO: 92637 - protein, 9 aa, Artificial Sequence
  Description of Artificial Sequence: Synthetic peptide
  Seed: SPLQIVPSL (MAGC1_HUMAN)
SILQIVPSY

SEQ ID NO: 92638 - protein, 10 aa, Artificial Sequence
  Description of Artificial Sequence: Synthetic peptide
  Seed: VSSSSSSTLL (MAGC1_HUMAN)
VPSSSSSTLF

SEQ ID NO: 92639 - protein, 9 aa, Artificial Sequence
  Description of Artificial Sequence: Synthetic peptide
  Seed: SPERTHSTF (MAGC1_HUMAN)
SLERTHSTY

SEQ ID NO: 92640 - protein, 10 aa, Artificial Sequence
  Description of Artificial Sequence: Synthetic peptide
  Seed: LAMLKNTVPI (MAGC1_HUMAN)
LIMLKNTVPV

SEQ ID NO: 92641 - protein, 9 aa, Artificial Sequence
  Description of Artificial Sequence: Synthetic peptide
  Seed: TESASSSVM (MAGC1_HUMAN)
TESASSSVL

SEQ ID NO: 92642 - protein, 9 aa, Artificial Sequence
  Description of Artificial Sequence: Synthetic peptide
  Seed: KVWVQEHYL (MAGC1_HUMAN)
KAWVQEHYR

SEQ ID NO: 92643 - protein, 10 aa, Artificial Sequence
  Description of Artificial Sequence: Synthetic peptide
  Seed: LQIPVSSSFS (MAGC1_HUMAN)
LLIPVSSSFY

SEQ ID NO: 92644 - protein, 9 aa, Artificial Sequence
  Description of Artificial Sequence: Synthetic peptide
  Seed: MTSSFSSTL (MAGC1_HUMAN)
MKSSFSSTY

SEQ ID NO: 92645 - protein, 9 aa, Artificial Sequence
  Description of Artificial Sequence: Synthetic peptide
  Seed: LQIPGSPSF (MAGC1_HUMAN)
LGIPGSPSY

SEQ ID NO: 92646 - protein, 9 aa, Artificial Sequence
  Description of Artificial Sequence: Synthetic peptide
  Seed: RLLILILSI (MAGC1_HUMAN)
RALILILSY

SEQ ID NO: 92647 - protein, 10 aa, Artificial Sequence
  Description of Artificial Sequence: Synthetic peptide
  Seed: YQVKQPITKA (MAGC1_HUMAN)
YIVKQPITKV

SEQ ID NO: 92648 - protein, 11 aa, Artificial Sequence
  Description of Artificial Sequence: Synthetic peptide
  Seed: QSSPESAQSTF (MAGC1_HUMAN)
QSSPESAQSTW

SEQ ID NO: 92649 - protein, 10 aa, Artificial Sequence
  Description of Artificial Sequence: Synthetic peptide
  Seed: TGYFPVIFRK (MAGC1_HUMAN)
TAYFPVIFRF

SEQ ID NO: 92650 - protein, 10 aa, Artificial Sequence
  Description of Artificial Sequence: Synthetic peptide
  Seed: SPVSSFPSST (MAGC1_HUMAN)
SPVSSFPSSM

SEQ ID NO: 92651 - protein, 9 aa, Artificial Sequence
  Description of Artificial Sequence: Synthetic peptide
  Seed: KVVEFLAML (MAGC1_HUMAN)
KMVEFLAMF

SEQ ID NO: 92652 - protein, 9 aa, Artificial Sequence
  Description of Artificial Sequence: Synthetic peptide
  Seed: YTSSSDTLL (MAGC1_HUMAN)
YSSSSDTLL

SEQ ID NO: 92653 - protein, 10 aa, Artificial Sequence
  Description of Artificial Sequence: Synthetic peptide
  Seed: MTSSFSSTLL (MAGC1_HUMAN)
MFSSFSSTLY

SEQ ID NO: 92654 - protein, 10 aa, Artificial Sequence
  Description of Artificial Sequence: Synthetic peptide
  Seed: SFSERTQSTF (MAGC1_HUMAN)
STSERTQSTY

SEQ ID NO: 92655 - protein, 10 aa, Artificial Sequence
  Description of Artificial Sequence: Synthetic peptide
  Seed: LQNPASSFFS (MAGC1_HUMAN)
LVNPASSFFY

SEQ ID NO: 92656 - protein, 10 aa, Artificial Sequence
  Description of Artificial Sequence: Synthetic peptide
  Seed: MPTAGMPSLL (MAGC1_HUMAN)
MWTAGMPSLI

SEQ ID NO: 92657 - protein, 10 aa, Artificial Sequence
  Description of Artificial Sequence: Synthetic peptide
  Seed: TVPITFPSSY (MAGC1_HUMAN)
TKPITFPSSF

SEQ ID NO: 92658 - protein, 9 aa, Artificial Sequence
  Description of Artificial Sequence: Synthetic peptide
  Seed: EHYLEYREV (MAGC1_HUMAN)
EHYLEYREA

SEQ ID NO: 92659 - protein, 10 aa, Artificial Sequence
  Description of Artificial Sequence: Synthetic peptide
  Seed: REFIEILFGI (MAGC1_HUMAN)
RSFIEILFGI

SEQ ID NO: 92660 - protein, 9 aa, Artificial Sequence
  Description of Artificial Sequence: Synthetic peptide
  Seed: FLWGPRAHS (MAGC1_HUMAN)
FAWGPRAHL

SEQ ID NO: 92661 - protein, 10 aa, Artificial Sequence
  Description of Artificial Sequence: Synthetic peptide
  Seed: FPSSTSSSLS (MAGC1_HUMAN)
FPSSTSSSLA

SEQ ID NO: 92662 - protein, 9 aa, Artificial Sequence
  Description of Artificial Sequence: Synthetic peptide
  Seed: QIVPSLPEW (MAGC1_HUMAN)
QQVPSLPEI

SEQ ID NO: 92663 - protein, 10 aa, Artificial Sequence
  Description of Artificial Sequence: Synthetic peptide
  Seed: VISFSSSTSL (MAGC1_HUMAN)
VLSFSSSTSY

SEQ ID NO: 92664 - protein, 10 aa, Artificial Sequence
  Description of Artificial Sequence: Synthetic peptide
  Seed: LLQIPMTSSF (MAGC1_HUMAN)
LGQIPMTSSW

SEQ ID NO: 92665 - protein, 10 aa, Artificial Sequence
  Description of Artificial Sequence: Synthetic peptide
  Seed: MTSSFSSTLL (MAGC1_HUMAN)
MASSFSSTLI

SEQ ID NO: 92666 - protein, 10 aa, Artificial Sequence
  Description of Artificial Sequence: Synthetic peptide
  Seed: TGYFPVIFRK (MAGC1_HUMAN)
TVYFPVIFRC

SEQ ID NO: 92667 - protein, 9 aa, Artificial Sequence
  Description of Artificial Sequence: Synthetic peptide
  Seed: TTDDSTATE (MAGC1_HUMAN)
TLDDSTATA

SEQ ID NO: 92668 - protein, 9 aa, Artificial Sequence
  Description of Artificial Sequence: Synthetic peptide
  Seed: LPQSFPESS (MAGC1_HUMAN)
LPQSFPESV

SEQ ID NO: 92669 - protein, 9 aa, Artificial Sequence
  Description of Artificial Sequence: Synthetic peptide
  Seed: SSPERTHST (MAGC1_HUMAN)
STPERTHSF

SEQ ID NO: 92670 - protein, 9 aa, Artificial Sequence
  Description of Artificial Sequence: Synthetic peptide
  Seed: YTLASLLQS (MAGC1_HUMAN)
YMLASLLQS

SEQ ID NO: 92671 - protein, 10 aa, Artificial Sequence
  Description of Artificial Sequence: Synthetic peptide
  Seed: YVFVNTLDLT (MAGC1_HUMAN)
YQFVNTLDLV

SEQ ID NO: 92672 - protein, 10 aa, Artificial Sequence
  Description of Artificial Sequence: Synthetic peptide
  Seed: LQIPGSPSFS (MAGC1_HUMAN)
LQIPGSPSFI

SEQ ID NO: 92673 - protein, 9 aa, Artificial Sequence
  Description of Artificial Sequence: Synthetic peptide
  Seed: SEPLFTYTL (MAGC1_HUMAN)
SRPLFTYTY

SEQ ID NO: 92674 - protein, 10 aa, Artificial Sequence
  Description of Artificial Sequence: Synthetic peptide
  Seed: RKVVEFLAML (MAGC1_HUMAN)
RFVVEFLAML

SEQ ID NO: 92675 - protein, 10 aa, Artificial Sequence
  Description of Artificial Sequence: Synthetic peptide
  Seed: NRLLILILSI (MAGC1_HUMAN)
NKLLILILSV

SEQ ID NO: 92676 - protein, 10 aa, Artificial Sequence
  Description of Artificial Sequence: Synthetic peptide
  Seed: KGTYASEEVI (MAGC1_HUMAN)
KFTYASEEVY

SEQ ID NO: 92677 - protein, 9 aa, Artificial Sequence
  Description of Artificial Sequence: Synthetic peptide
  Seed: SASSSVMSP (MAGC1_HUMAN)
SASSSVMSI

SEQ ID NO: 92678 - protein, 11 aa, Artificial Sequence
  Description of Artificial Sequence: Synthetic peptide
  Seed: RSFSSTLLSIF (MAGC1_HUMAN)
RGFSSTLLSIW

SEQ ID NO: 92679 - protein, 9 aa, Artificial Sequence
  Description of Artificial Sequence: Synthetic peptide
  Seed: IPVSSSFSY (MAGC1_HUMAN)
IMVSSSFSY

SEQ ID NO: 92680 - protein, 9 aa, Artificial Sequence
  Description of Artificial Sequence: Synthetic peptide
  Seed: YTLLSLFQS (MAGC1_HUMAN)
YMLLSLFQS

SEQ ID NO: 92681 - protein, 9 aa, Artificial Sequence
  Description of Artificial Sequence: Synthetic peptide
  Seed: VPITFPSSY (MAGC1_HUMAN)
VQITFPSSA

SEQ ID NO: 92682 - protein, 10 aa, Artificial Sequence
  Description of Artificial Sequence: Synthetic peptide
  Seed: KRKVVEFLAM (MAGC1_HUMAN)
KFKVVEFLAF

SEQ ID NO: 92683 - protein, 9 aa, Artificial Sequence
  Description of Artificial Sequence: Synthetic peptide
  Seed: TLLSLFQSF (MAGC1_HUMAN)
TTLSLFQSR

SEQ ID NO: 92684 - protein, 10 aa, Artificial Sequence
  Description of Artificial Sequence: Synthetic peptide
  Seed: REFIEILFGI (MAGC1_HUMAN)
RQFIEILFGA

SEQ ID NO: 92685 - protein, 8 aa, Artificial Sequence
  Description of Artificial Sequence: Synthetic peptide
  Seed: LQSPVSSF (MAGC1_HUMAN)
LMSPVSSY

SEQ ID NO: 92686 - protein, 9 aa, Artificial Sequence
  Description of Artificial Sequence: Synthetic peptide
  Seed: SLLQSSHES (MAGC1_HUMAN)
SQLQSSHEV

SEQ ID NO: 92687 - protein, 11 aa, Artificial Sequence
  Description of Artificial Sequence: Synthetic peptide
  Seed: KVWVQEHYLEY (MAGC1_HUMAN)
KSWVQEHYLEW

SEQ ID NO: 92688 - protein, 9 aa, Artificial Sequence
  Description of Artificial Sequence: Synthetic peptide
  Seed: FPQSVLQIP (MAGC1_HUMAN)
FPQSVLQIM

SEQ ID NO: 92689 - protein, 9 aa, Artificial Sequence
  Description of Artificial Sequence: Synthetic peptide
  Seed: VSSSFSYTL (MAGC1_HUMAN)
VGSSFSYTY

SEQ ID NO: 92690 - protein, 9 aa, Artificial Sequence
  Description of Artificial Sequence: Synthetic peptide
  Seed: CTQSTFEGF (MAGC1_HUMAN)
CYQSTFEGF

SEQ ID NO: 92691 - protein, 10 aa, Artificial Sequence
  Description of Artificial Sequence: Synthetic peptide
  Seed: SFSERTQSTF (MAGC1_HUMAN)
SQSERTQSTY

SEQ ID NO: 92692 - protein, 9 aa, Artificial Sequence
  Description of Artificial Sequence: Synthetic peptide
  Seed: SFSYTLLSL (MAGC1_HUMAN)
SYSYTLLSL

SEQ ID NO: 92693 - protein, 9 aa, Artificial Sequence
  Description of Artificial Sequence: Synthetic peptide
  Seed: SSPEGKDSL (MAGC1_HUMAN)
SMPEGKDSV

SEQ ID NO: 92694 - protein, 9 aa, Artificial Sequence
  Description of Artificial Sequence: Synthetic peptide
  Seed: RPVSSFFSY (MAGC1_HUMAN)
RFVSSFFSY

SEQ ID NO: 92695 - protein, 10 aa, Artificial Sequence
  Description of Artificial Sequence: Synthetic peptide
  Seed: RKVVEFLAML (MAGC1_HUMAN)
RKVVEFLAMA

SEQ ID NO: 92696 - protein, 10 aa, Artificial Sequence
  Description of Artificial Sequence: Synthetic peptide
  Seed: YTLASLLQSS (MAGC1_HUMAN)
YKLASLLQSI

SEQ ID NO: 92697 - protein, 9 aa, Artificial Sequence
  Description of Artificial Sequence: Synthetic peptide
  Seed: FSYTLLSLF (MAGC1_HUMAN)
FRYTLLSLM

SEQ ID NO: 92698 - protein, 9 aa, Artificial Sequence
  Description of Artificial Sequence: Synthetic peptide
  Seed: GYFPVIFRK (MAGC1_HUMAN)
GTFPVIFRF

SEQ ID NO: 92699 - protein, 9 aa, Artificial Sequence
  Description of Artificial Sequence: Synthetic peptide
  Seed: SSSTSLSPF (MAGC1_HUMAN)
SMSTSLSPL

SEQ ID NO: 92700 - protein, 9 aa, Artificial Sequence
  Description of Artificial Sequence: Synthetic peptide
  Seed: SAPEGEDSL (MAGC1_HUMAN)
SYPEGEDSY

SEQ ID NO: 92701 - protein, 9 aa, Artificial Sequence
  Description of Artificial Sequence: Synthetic peptide
  Seed: YTGYFPVIF (MAGC1_HUMAN)
YAGYFPVIL

SEQ ID NO: 92702 - protein, 10 aa, Artificial Sequence
  Description of Artificial Sequence: Synthetic peptide
  Seed: FPQSLLQIPM (MAGC1_HUMAN)
FVQSLLQIPI

SEQ ID NO: 92703 - protein, 9 aa, Artificial Sequence
  Description of Artificial Sequence: Synthetic peptide
  Seed: SSSSSSTLL (MAGC1_HUMAN)
SLSSSSTLF

SEQ ID NO: 92704 - protein, 9 aa, Artificial Sequence
  Description of Artificial Sequence: Synthetic peptide
  Seed: RLLILILSI (MAGC1_HUMAN)
RALILILSW

SEQ ID NO: 92705 - protein, 9 aa, Artificial Sequence
  Description of Artificial Sequence: Synthetic peptide
  Seed: TSLSLPQSF (MAGC1_HUMAN)
TMLSLPQSF

SEQ ID NO: 92706 - protein, 10 aa, Artificial Sequence
  Description of Artificial Sequence: Synthetic peptide
  Seed: FPQSVLQIPV (MAGC1_HUMAN)
FMQSVLQIPA

SEQ ID NO: 92707 - protein, 11 aa, Artificial Sequence
  Description of Artificial Sequence: Synthetic peptide
  Seed: TTDDSTATESA (MAGC1_HUMAN)
TGDDSTATESL

SEQ ID NO: 92708 - protein, 9 aa, Artificial Sequence
  Description of Artificial Sequence: Synthetic peptide
  Seed: VQSPLQNPA (MAGC1_HUMAN)
VMSPLQNPF

SEQ ID NO: 92709 - protein, 9 aa, Artificial Sequence
  Description of Artificial Sequence: Synthetic peptide
  Seed: SPLQIVPSL (MAGC1_HUMAN)
SVLQIVPSY

SEQ ID NO: 92710 - protein, 10 aa, Artificial Sequence
  Description of Artificial Sequence: Synthetic peptide
  Seed: VSSFFSYTLA (MAGC1_HUMAN)
VTSFFSYTLV

SEQ ID NO: 92711 - protein, 10 aa, Artificial Sequence
  Description of Artificial Sequence: Synthetic peptide
  Seed: ICSSSTSLSL (MAGC1_HUMAN)
IASSSTSLSL

SEQ ID NO: 92712 - protein, 9 aa, Artificial Sequence
  Description of Artificial Sequence: Synthetic peptide
  Seed: SSSSSSSTL (MAGC1_HUMAN)
SSSSSSSTM

SEQ ID NO: 92713 - protein, 9 aa, Artificial Sequence
  Description of Artificial Sequence: Synthetic peptide
  Seed: PITFPSSYK (MAGC1_HUMAN)
PVTFPSSYR

SEQ ID NO: 92714 - protein, 9 aa, Artificial Sequence
  Description of Artificial Sequence: Synthetic peptide
  Seed: LQIPGSPSF (MAGC1_HUMAN)
LPIPGSPSV

SEQ ID NO: 92715 - protein, 11 aa, Artificial Sequence
  Description of Artificial Sequence: Synthetic peptide
  Seed: VISRYTGYFPV (MAGC1_HUMAN)
VLSRYTGYFPI

SEQ ID NO: 92716 - protein, 9 aa, Artificial Sequence
  Description of Artificial Sequence: Synthetic peptide
  Seed: TLDLTSEGC (MAGC1_HUMAN)
TQDLTSEGL

SEQ ID NO: 92717 - protein, 9 aa, Artificial Sequence
  Description of Artificial Sequence: Synthetic peptide
  Seed: SFSSTLVSL (MAGC1_HUMAN)
SMSSTLVSL

SEQ ID NO: 92718 - protein, 9 aa, Artificial Sequence
  Description of Artificial Sequence: Synthetic peptide
  Seed: VPITFPSSY (MAGC1_HUMAN)
VGITFPSSF

SEQ ID NO: 92719 - protein, 11 aa, Artificial Sequence
  Description of Artificial Sequence: Synthetic peptide
  Seed: SSFPSSTSSSL (MAGC1_HUMAN)
SKFPSSTSSSY

SEQ ID NO: 92720 - protein, 10 aa, Artificial Sequence
  Description of Artificial Sequence: Synthetic peptide
  Seed: KVVEFLAMLK (MAGC1_HUMAN)
KMVEFLAMLR

SEQ ID NO: 92721 - protein, 9 aa, Artificial Sequence
  Description of Artificial Sequence: Synthetic peptide
  Seed: LQIPGSPSF (MAGC1_HUMAN)
LTIPGSPSF

SEQ ID NO: 92722 - protein, 9 aa, Artificial Sequence
  Description of Artificial Sequence: Synthetic peptide
  Seed: SQSPPEGPV (MAGC1_HUMAN)
SQSPPEGPM

SEQ ID NO: 92723 - protein, 11 aa, Artificial Sequence
  Description of Artificial Sequence: Synthetic peptide
  Seed: HESPQSPPEGP (MAGC1_HUMAN)
HESPQSPPEGV

SEQ ID NO: 92724 - protein, 10 aa, Artificial Sequence
  Description of Artificial Sequence: Synthetic peptide
  Seed: ASSSTLVSIF (MAGC1_HUMAN)
ACSSTLVSIW

SEQ ID NO: 92725 - protein, 9 aa, Artificial Sequence
  Description of Artificial Sequence: Synthetic peptide
  Seed: SSFFSYTLA (MAGC1_HUMAN)
STFFSYTLA

SEQ ID NO: 92726 - protein, 11 aa, Artificial Sequence
  Description of Artificial Sequence: Synthetic peptide
  Seed: REVDPDDSYVF (MAGC1_HUMAN)
REVDPDDSYVT

SEQ ID NO: 92727 - protein, 9 aa, Artificial Sequence
  Description of Artificial Sequence: Synthetic peptide
  Seed: LKNTVPITF (MAGC1_HUMAN)
LRNTVPITL

SEQ ID NO: 92728 - protein, 9 aa, Artificial Sequence
  Description of Artificial Sequence: Synthetic peptide
  Seed: TLASLLQSS (MAGC1_HUMAN)
TQASLLQSA

SEQ ID NO: 92729 - protein, 9 aa, Artificial Sequence
  Description of Artificial Sequence: Synthetic peptide
  Seed: VVEFLAMLK (MAGC1_HUMAN)
VIEFLAMLK

SEQ ID NO: 92730 - protein, 9 aa, Artificial Sequence
  Description of Artificial Sequence: Synthetic peptide
  Seed: FSYTLLSLF (MAGC1_HUMAN)
FNYTLLSLY

SEQ ID NO: 92731 - protein, 10 aa, Artificial Sequence
  Description of Artificial Sequence: Synthetic peptide
  Seed: MSPLYFPQSP (MAGC1_HUMAN)
MYPLYFPQSA

SEQ ID NO: 92732 - protein, 10 aa, Artificial Sequence
  Description of Artificial Sequence: Synthetic peptide
  Seed: SFSSTLVSLF (MAGC1_HUMAN)
SKSSTLVSLW

SEQ ID NO: 92733 - protein, 9 aa, Artificial Sequence
  Description of Artificial Sequence: Synthetic peptide
  Seed: FSSALLSIF (MAGC1_HUMAN)
FLSALLSIM

SEQ ID NO: 92734 - protein, 9 aa, Artificial Sequence
  Description of Artificial Sequence: Synthetic peptide
  Seed: RTHSTFEGF (MAGC1_HUMAN)
RMHSTFEGR

SEQ ID NO: 92735 - protein, 9 aa, Artificial Sequence
  Description of Artificial Sequence: Synthetic peptide
  Seed: FPSSTSSSL (MAGC1_HUMAN)
FPSSTSSSI

SEQ ID NO: 92736 - protein, 9 aa, Artificial Sequence
  Description of Artificial Sequence: Synthetic peptide
  Seed: FSYTLASLL (MAGC1_HUMAN)
FMYTLASLI

SEQ ID NO: 92737 - protein, 9 aa, Artificial Sequence
  Description of Artificial Sequence: Synthetic peptide
  Seed: LQRPVSSFF (MAGC1_HUMAN)
LARPVSSFY

SEQ ID NO: 92738 - protein, 9 aa, Artificial Sequence
  Description of Artificial Sequence: Synthetic peptide
  Seed: YQVKQPITK (MAGC1_HUMAN)
YKVKQPITY

SEQ ID NO: 92739 - protein, 9 aa, Artificial Sequence
  Description of Artificial Sequence: Synthetic peptide
  Seed: SSSSSSSTL (MAGC1_HUMAN)
SKSSSSSTF

SEQ ID NO: 92740 - protein, 11 aa, Artificial Sequence
  Description of Artificial Sequence: Synthetic peptide
  Seed: LQIPVSSSFSY (MAGC1_HUMAN)
LVIPVSSSFSF

SEQ ID NO: 92741 - protein, 10 aa, Artificial Sequence
  Description of Artificial Sequence: Synthetic peptide
  Seed: RAGREHFAFG (MAGC1_HUMAN)
RCGREHFAFK

SEQ ID NO: 92742 - protein, 9 aa, Artificial Sequence
  Description of Artificial Sequence: Synthetic peptide
  Seed: SPLQSPVSS (MAGC1_HUMAN)
SALQSPVSF

SEQ ID NO: 92743 - protein, 10 aa, Artificial Sequence
  Description of Artificial Sequence: Synthetic peptide
  Seed: SSPECTQSTF (MAGC1_HUMAN)
SGPECTQSTL

SEQ ID NO: 92744 - protein, 9 aa, Artificial Sequence
  Description of Artificial Sequence: Synthetic peptide
  Seed: SLIESEPLF (MAGC1_HUMAN)
SAIESEPLY

SEQ ID NO: 92745 - protein, 10 aa, Artificial Sequence
  Description of Artificial Sequence: Synthetic peptide
  Seed: ERTQSTFEGF (MAGC1_HUMAN)
EHTQSTFEGL

SEQ ID NO: 92746 - protein, 10 aa, Artificial Sequence
  Description of Artificial Sequence: Synthetic peptide
  Seed: SFFSYTLASL (MAGC1_HUMAN)
SWFSYTLASI

SEQ ID NO: 92747 - protein, 9 aa, Artificial Sequence
  Description of Artificial Sequence: Synthetic peptide
  Seed: SSSFSYTLL (MAGC1_HUMAN)
SMSFSYTLV

SEQ ID NO: 92748 - protein, 9 aa, Artificial Sequence
  Description of Artificial Sequence: Synthetic peptide
  Seed: SSPESAQSA (MAGC1_HUMAN)
SMPESAQSF

SEQ ID NO: 92749 - protein, 11 aa, Artificial Sequence
  Description of Artificial Sequence: Synthetic peptide
  Seed: STFEGFAQSSL (MAGC1_HUMAN)
SVFEGFAQSSY

SEQ ID NO: 92750 - protein, 11 aa, Artificial Sequence
  Description of Artificial Sequence: Synthetic peptide
  Seed: STFEGFAQSSL (MAGC1_HUMAN)
SLFEGFAQSSL

SEQ ID NO: 92751 - protein, 10 aa, Artificial Sequence
  Description of Artificial Sequence: Synthetic peptide
  Seed: SPLQSPVISF (MAGC1_HUMAN)
SPLQSPVIST

SEQ ID NO: 92752 - protein, 9 aa, Artificial Sequence
  Description of Artificial Sequence: Synthetic peptide
  Seed: SSPEGKDSL (MAGC1_HUMAN)
SIPEGKDSM

SEQ ID NO: 92753 - protein, 9 aa, Artificial Sequence
  Description of Artificial Sequence: Synthetic peptide
  Seed: LQIPVSAAS (MAGC1_HUMAN)
LVIPVSAAV

SEQ ID NO: 92754 - protein, 9 aa, Artificial Sequence
  Description of Artificial Sequence: Synthetic peptide
  Seed: SLSPFSEES (MAGC1_HUMAN)
SLSPFSEEA

SEQ ID NO: 92755 - protein, 10 aa, Artificial Sequence
  Description of Artificial Sequence: Synthetic peptide
  Seed: SRYTGYFPVI (MAGC1_HUMAN)
SMYTGYFPVM

SEQ ID NO: 92756 - protein, 10 aa, Artificial Sequence
  Description of Artificial Sequence: Synthetic peptide
  Seed: SSFSYTLLSL (MAGC1_HUMAN)
SAFSYTLLSI

SEQ ID NO: 92757 - protein, 9 aa, Artificial Sequence
  Description of Artificial Sequence: Synthetic peptide
  Seed: LQIPVSPSF (MAGC1_HUMAN)
LCIPVSPSW

SEQ ID NO: 92758 - protein, 9 aa, Artificial Sequence
  Description of Artificial Sequence: Synthetic peptide
  Seed: LSDEQGMSQ (MAGC1_HUMAN)
LCDEQGMSI

SEQ ID NO: 92759 - protein, 11 aa, Artificial Sequence
  Description of Artificial Sequence: Synthetic peptide
  Seed: LQIPVSSSFSY (MAGC1_HUMAN)
LGIPVSSSFSF

SEQ ID NO: 92760 - protein, 9 aa, Artificial Sequence
  Description of Artificial Sequence: Synthetic peptide
  Seed: SFSSTLVSL (MAGC1_HUMAN)
SQSSTLVSM

SEQ ID NO: 92761 - protein, 9 aa, Artificial Sequence
  Description of Artificial Sequence: Synthetic peptide
  Seed: AFGEPRELL (MAGC1_HUMAN)
ATGEPRELV

SEQ ID NO: 92762 - protein, 11 aa, Artificial Sequence
  Description of Artificial Sequence: Synthetic peptide
  Seed: FPQSPLQIPQS (MAGC1_HUMAN)
FPQSPLQIPQA

SEQ ID NO: 92763 - protein, 10 aa, Artificial Sequence
  Description of Artificial Sequence: Synthetic peptide
  Seed: SSPESAQSAF (MAGC1_HUMAN)
SVPESAQSAF

SEQ ID NO: 92764 - protein, 10 aa, Artificial Sequence
  Description of Artificial Sequence: Synthetic peptide
  Seed: TGYFPVIFRK (MAGC1_HUMAN)
TVYFPVIFRE

SEQ ID NO: 92765 - protein, 11 aa, Artificial Sequence
  Description of Artificial Sequence: Synthetic peptide
  Seed: SLFQSSPERTH (MAGC1_HUMAN)
SLFQSSPERTY

SEQ ID NO: 92766 - protein, 9 aa, Artificial Sequence
  Description of Artificial Sequence: Synthetic peptide
  Seed: TTDDSTATE (MAGC1_HUMAN)
TWDDSTATM

SEQ ID NO: 92767 - protein, 9 aa, Artificial Sequence
  Description of Artificial Sequence: Synthetic peptide
  Seed: TSLSLPQSF (MAGC1_HUMAN)
TGLSLPQSW

SEQ ID NO: 92768 - protein, 9 aa, Artificial Sequence
  Description of Artificial Sequence: Synthetic peptide
  Seed: REVDPDDSY (MAGC1_HUMAN)
REVDPDDST

SEQ ID NO: 92769 - protein, 11 aa, Artificial Sequence
  Description of Artificial Sequence: Synthetic peptide
  Seed: SSFSYTLLSLF (MAGC1_HUMAN)
SSFSYTLLSLL

SEQ ID NO: 92770 - protein, 9 aa, Artificial Sequence
  Description of Artificial Sequence: Synthetic peptide
  Seed: SFSYTLLSL (MAGC1_HUMAN)
SASYTLLSY

SEQ ID NO: 92771 - protein, 9 aa, Artificial Sequence
  Description of Artificial Sequence: Synthetic peptide
  Seed: FEGFPQSLL (MAGC1_HUMAN)
FEGFPQSLW

SEQ ID NO: 92772 - protein, 9 aa, Artificial Sequence
  Description of Artificial Sequence: Synthetic peptide
  Seed: SSFFSSALL (MAGC1_HUMAN)
SSFFSSALW

SEQ ID NO: 92773 - protein, 9 aa, Artificial Sequence
  Description of Artificial Sequence: Synthetic peptide
  Seed: TFEGFPQSL (MAGC1_HUMAN)
TQEGFPQSF

SEQ ID NO: 92774 - protein, 9 aa, Artificial Sequence
  Description of Artificial Sequence: Synthetic peptide
  Seed: DALKDVEER (MAGC1_HUMAN)
DTLKDVEER

SEQ ID NO: 92775 - protein, 9 aa, Artificial Sequence
  Description of Artificial Sequence: Synthetic peptide
  Seed: EDSQSPLQI (MAGC1_HUMAN)
EESQSPLQV

SEQ ID NO: 92776 - protein, 9 aa, Artificial Sequence
  Description of Artificial Sequence: Synthetic peptide
  Seed: EHFAFGEPR (MAGC1_HUMAN)
EWFAFGEPR

SEQ ID NO: 92777 - protein, 9 aa, Artificial Sequence
  Description of Artificial Sequence: Synthetic peptide
  Seed: FFSSALLSI (MAGC1_HUMAN)
FYSSALLSY

SEQ ID NO: 92778 - protein, 9 aa, Artificial Sequence
  Description of Artificial Sequence: Synthetic peptide
  Seed: AFGEPRELL (MAGC1_HUMAN)
ARGEPRELF

SEQ ID NO: 92779 - protein, 9 aa, Artificial Sequence
  Description of Artificial Sequence: Synthetic peptide
  Seed: SPERTHSTF (MAGC1_HUMAN)
SQERTHSTY

SEQ ID NO: 92780 - protein, 9 aa, Artificial Sequence
  Description of Artificial Sequence: Synthetic peptide
  Seed: HFPQSPPEW (MAGC1_HUMAN)
HWPQSPPEY

SEQ ID NO: 92781 - protein, 10 aa, Artificial Sequence
  Description of Artificial Sequence: Synthetic peptide
  Seed: LAMLKNTVPI (MAGC1_HUMAN)
LEMLKNTVPY

SEQ ID NO: 92782 - protein, 11 aa, Artificial Sequence
  Description of Artificial Sequence: Synthetic peptide
  Seed: SLSQSSPVSSF (MAGC1_HUMAN)
SNSQSSPVSSF

SEQ ID NO: 92783 - protein, 10 aa, Artificial Sequence
  Description of Artificial Sequence: Synthetic peptide
  Seed: LSLFQSFSER (MAGC1_HUMAN)
LILFQSFSEK

SEQ ID NO: 92784 - protein, 9 aa, Artificial Sequence
  Description of Artificial Sequence: Synthetic peptide
  Seed: SAASSSTLV (MAGC1_HUMAN)
SLASSSTLL

SEQ ID NO: 92785 - protein, 8 aa, Artificial Sequence
  Description of Artificial Sequence: Synthetic peptide
  Seed: SSSTLVSI (MAGC1_HUMAN)
SQSTLVSV

SEQ ID NO: 92786 - protein, 8 aa, Artificial Sequence
  Description of Artificial Sequence: Synthetic peptide
  Seed: EVIKRKVV (MAGC1_HUMAN)
EMIKRKVL

SEQ ID NO: 92787 - protein, 10 aa, Artificial Sequence
  Description of Artificial Sequence: Synthetic peptide
  Seed: ASSFFSSALL (MAGC1_HUMAN)
ASSFFSSALF

SEQ ID NO: 92788 - protein, 9 aa, Artificial Sequence
  Description of Artificial Sequence: Synthetic peptide
  Seed: TPSSLPQSF (MAGC1_HUMAN)
TFSSLPQSF

SEQ ID NO: 92789 - protein, 11 aa, Artificial Sequence
  Description of Artificial Sequence: Synthetic peptide
  Seed: VDEYTSSSDTL (MAGC1_HUMAN)
VQEYTSSSDTF

SEQ ID NO: 92790 - protein, 9 aa, Artificial Sequence
  Description of Artificial Sequence: Synthetic peptide
  Seed: FSERTQSTF (MAGC1_HUMAN)
FQERTQSTF

SEQ ID NO: 92791 - protein, 10 aa, Artificial Sequence
  Description of Artificial Sequence: Synthetic peptide
  Seed: IPVSRSFSST (MAGC1_HUMAN)
IPVSRSFSSV

SEQ ID NO: 92792 - protein, 9 aa, Artificial Sequence
  Description of Artificial Sequence: Synthetic peptide
  Seed: VSSSFSYTL (MAGC1_HUMAN)
VESSFSYTF

SEQ ID NO: 92793 - protein, 9 aa, Artificial Sequence
  Description of Artificial Sequence: Synthetic peptide
  Seed: FSSTLVSLF (MAGC1_HUMAN)
FPSTLVSLY

SEQ ID NO: 92794 - protein, 10 aa, Artificial Sequence
  Description of Artificial Sequence: Synthetic peptide
  Seed: RKVVEFLAML (MAGC1_HUMAN)
REVVEFLAML

SEQ ID NO: 92795 - protein, 9 aa, Artificial Sequence
  Description of Artificial Sequence: Synthetic peptide
  Seed: SSFFSYTLA (MAGC1_HUMAN)
SLFFSYTLI

SEQ ID NO: 92796 - protein, 9 aa, Artificial Sequence
  Description of Artificial Sequence: Synthetic peptide
  Seed: LQIPVSPSF (MAGC1_HUMAN)
LTIPVSPSY

SEQ ID NO: 92797 - protein, 9 aa, Artificial Sequence
  Description of Artificial Sequence: Synthetic peptide
  Seed: LKNTVPITF (MAGC1_HUMAN)
LWNTVPITL

SEQ ID NO: 92798 - protein, 10 aa, Artificial Sequence
  Description of Artificial Sequence: Synthetic peptide
  Seed: SIIFIKGTYA (MAGC1_HUMAN)
STIFIKGTYL

SEQ ID NO: 92799 - protein, 9 aa, Artificial Sequence
  Description of Artificial Sequence: Synthetic peptide
  Seed: LQIPVSPSF (MAGC1_HUMAN)
LMIPVSPST

SEQ ID NO: 92800 - protein, 10 aa, Artificial Sequence
  Description of Artificial Sequence: Synthetic peptide
  Seed: VSSSSSSSTL (MAGC1_HUMAN)
VHSSSSSSTW

SEQ ID NO: 92801 - protein, 10 aa, Artificial Sequence
  Description of Artificial Sequence: Synthetic peptide
  Seed: LAMLKNTVPI (MAGC1_HUMAN)
LCMLKNTVPI

SEQ ID NO: 92802 - protein, 9 aa, Artificial Sequence
  Description of Artificial Sequence: Synthetic peptide
  Seed: LQIPMTSSF (MAGC1_HUMAN)
LYIPMTSSM

SEQ ID NO: 92803 - protein, 9 aa, Artificial Sequence
  Description of Artificial Sequence: Synthetic peptide
  Seed: VSSFFSYTL (MAGC1_HUMAN)
VTSFFSYTL

SEQ ID NO: 92804 - protein, 10 aa, Artificial Sequence
  Description of Artificial Sequence: Synthetic peptide
  Seed: ISRYTGYFPV (MAGC1_HUMAN)
ILRYTGYFPV

SEQ ID NO: 92805 - protein, 10 aa, Artificial Sequence
  Description of Artificial Sequence: Synthetic peptide
  Seed: SPLQIPVSSS (MAGC1_HUMAN)
SPLQIPVSSI

SEQ ID NO: 92806 - protein, 10 aa, Artificial Sequence
  Description of Artificial Sequence: Synthetic peptide
  Seed: YTLDEKVDEL (MAGC1_HUMAN)
YSLDEKVDEV

SEQ ID NO: 92807 - protein, 10 aa, Artificial Sequence
  Description of Artificial Sequence: Synthetic peptide
  Seed: LSKSSPESPL (MAGC1_HUMAN)
LAKSSPESPY

SEQ ID NO: 92808 - protein, 10 aa, Artificial Sequence
  Description of Artificial Sequence: Synthetic peptide
  Seed: PLQIPMTSSF (MAGC1_HUMAN)
PRQIPMTSSY

SEQ ID NO: 92809 - protein, 9 aa, Artificial Sequence
  Description of Artificial Sequence: Synthetic peptide
  Seed: SAPEGEDSL (MAGC1_HUMAN)
SAPEGEDSM

SEQ ID NO: 92810 - protein, 11 aa, Artificial Sequence
  Description of Artificial Sequence: Synthetic peptide
  Seed: REVPNSSPPRY (MAGC1_HUMAN)
RSVPNSSPPRY

SEQ ID NO: 92811 - protein, 10 aa, Artificial Sequence
  Description of Artificial Sequence: Synthetic peptide
  Seed: ICSSSTPSSL (MAGC1_HUMAN)
ILSSSTPSSL

SEQ ID NO: 92812 - protein, 9 aa, Artificial Sequence
  Description of Artificial Sequence: Synthetic peptide
  Seed: SSPESTQSP (MAGC1_HUMAN)
STPESTQSI

SEQ ID NO: 92813 - protein, 11 aa, Artificial Sequence
  Description of Artificial Sequence: Synthetic peptide
  Seed: SSFPSSTSSSL (MAGC1_HUMAN)
SAFPSSTSSSV

SEQ ID NO: 92814 - protein, 9 aa, Artificial Sequence
  Description of Artificial Sequence: Synthetic peptide
  Seed: VSRSFSSTL (MAGC1_HUMAN)
VIRSFSSTL

SEQ ID NO: 92815 - protein, 9 aa, Artificial Sequence
  Description of Artificial Sequence: Synthetic peptide
  Seed: SLPEWEDSL (MAGC1_HUMAN)
SMPEWEDSA

SEQ ID NO: 92816 - protein, 11 aa, Artificial Sequence
  Description of Artificial Sequence: Synthetic peptide
  Seed: REVPNSSPPRY (MAGC1_HUMAN)
REVPNSSPPRW

SEQ ID NO: 92817 - protein, 9 aa, Artificial Sequence
  Description of Artificial Sequence: Synthetic peptide
  Seed: NSSPPRYEF (MAGC1_HUMAN)
NTSPPRYEM

SEQ ID NO: 92818 - protein, 9 aa, Artificial Sequence
  Description of Artificial Sequence: Synthetic peptide
  Seed: SRSFSSTLL (MAGC1_HUMAN)
SRSFSSTLF

SEQ ID NO: 92819 - protein, 10 aa, Artificial Sequence
  Description of Artificial Sequence: Synthetic peptide
  Seed: LQIPMTSSFS (MAGC1_HUMAN)
LKIPMTSSFL

SEQ ID NO: 92820 - protein, 10 aa, Artificial Sequence
  Description of Artificial Sequence: Synthetic peptide
  Seed: LQIPVSSSFS (MAGC1_HUMAN)
LHIPVSSSFF

SEQ ID NO: 92821 - protein, 9 aa, Artificial Sequence
  Description of Artificial Sequence: Synthetic peptide
  Seed: TLDEKVDEL (MAGC1_HUMAN)
TCDEKVDEI

SEQ ID NO: 92822 - protein, 9 aa, Artificial Sequence
  Description of Artificial Sequence: Synthetic peptide
  Seed: SSPERTQST (MAGC1_HUMAN)
SQPERTQSM

SEQ ID NO: 92823 - protein, 9 aa, Artificial Sequence
  Description of Artificial Sequence: Synthetic peptide
  Seed: VSAASSSTL (MAGC1_HUMAN)
VNAASSSTF

SEQ ID NO: 92824 - protein, 9 aa, Artificial Sequence
  Description of Artificial Sequence: Synthetic peptide
  Seed: VSPSFSSTL (MAGC1_HUMAN)
VYPSFSSTA

SEQ ID NO: 92825 - protein, 10 aa, Artificial Sequence
  Description of Artificial Sequence: Synthetic peptide
  Seed: TNVISRYTGY (MAGC1_HUMAN)
TMVISRYTGF

SEQ ID NO: 92826 - protein, 9 aa, Artificial Sequence
  Description of Artificial Sequence: Synthetic peptide
  Seed: TLDLTSEGC (MAGC1_HUMAN)
TIDLTSEGV

SEQ ID NO: 92827 - protein, 10 aa, Artificial Sequence
  Description of Artificial Sequence: Synthetic peptide
  Seed: QRPVSSFFSY (MAGC1_HUMAN)
QRPVSSFFSL

SEQ ID NO: 92828 - protein, 9 aa, Artificial Sequence
  Description of Artificial Sequence: Synthetic peptide
  Seed: TFEGFPQSL (MAGC1_HUMAN)
TTEGFPQSV

SEQ ID NO: 92829 - protein, 9 aa, Artificial Sequence
  Description of Artificial Sequence: Synthetic peptide
  Seed: IIFIKGTYA (MAGC1_HUMAN)
IIFIKGTYV

SEQ ID NO: 92830 - protein, 9 aa, Artificial Sequence
  Description of Artificial Sequence: Synthetic peptide
  Seed: GTYASEEVI (MAGC1_HUMAN)
GLYASEEVW

SEQ ID NO: 92831 - protein, 10 aa, Artificial Sequence
  Description of Artificial Sequence: Synthetic peptide
  Seed: SSPECTQSTF (MAGC1_HUMAN)
SMPECTQSTF

SEQ ID NO: 92832 - protein, 10 aa, Artificial Sequence
  Description of Artificial Sequence: Synthetic peptide
  Seed: MSQNRLLILI (MAGC1_HUMAN)
MTQNRLLILV

SEQ ID NO: 92833 - protein, 9 aa, Artificial Sequence
  Description of Artificial Sequence: Synthetic peptide
  Seed: SSSSSSSTL (MAGC1_HUMAN)
SFSSSSSTF

SEQ ID NO: 92834 - protein, 10 aa, Artificial Sequence
  Description of Artificial Sequence: Synthetic peptide
  Seed: ISRYTGYFPV (MAGC1_HUMAN)
IYRYTGYFPF

SEQ ID NO: 92835 - protein, 9 aa, Artificial Sequence
  Description of Artificial Sequence: Synthetic peptide
  Seed: MSQNRLLIL (MAGC1_HUMAN)
MQQNRLLIY

SEQ ID NO: 92836 - protein, 9 aa, Artificial Sequence
  Description of Artificial Sequence: Synthetic peptide
  Seed: PITFPSSYK (MAGC1_HUMAN)
PTTFPSSYR

SEQ ID NO: 92837 - protein, 9 aa, Artificial Sequence
  Description of Artificial Sequence: Synthetic peptide
  Seed: VPITFPSSY (MAGC1_HUMAN)
VPITFPSSW

SEQ ID NO: 92838 - protein, 10 aa, Artificial Sequence
  Description of Artificial Sequence: Synthetic peptide
  Seed: LQNPASSFFS (MAGC1_HUMAN)
LVNPASSFFF

SEQ ID NO: 92839 - protein, 9 aa, Artificial Sequence
  Description of Artificial Sequence: Synthetic peptide
  Seed: FSYTLLSLF (MAGC1_HUMAN)
FVYTLLSLM

SEQ ID NO: 92840 - protein, 9 aa, Artificial Sequence
  Description of Artificial Sequence: Synthetic peptide
  Seed: SIFQSSPER (MAGC1_HUMAN)
STFQSSPEY

SEQ ID NO: 92841 - protein, 9 aa, Artificial Sequence
  Description of Artificial Sequence: Synthetic peptide
  Seed: LILSIIFIK (MAGC1_HUMAN)
LQLSIIFIK

SEQ ID NO: 92842 - protein, 9 aa, Artificial Sequence
  Description of Artificial Sequence: Synthetic peptide
  Seed: SPLQIVPSL (MAGC1_HUMAN)
SALQIVPSV

SEQ ID NO: 92843 - protein, 10 aa, Artificial Sequence
  Description of Artificial Sequence: Synthetic peptide
  Seed: FQSSLQSPVS (MAGC1_HUMAN)
FLSSLQSPVV

SEQ ID NO: 92844 - protein, 11 aa, Artificial Sequence
  Description of Artificial Sequence: Synthetic peptide
  Seed: GENTHSPLQIV (MAGC1_HUMAN)
GENTHSPLQIA

SEQ ID NO: 92845 - protein, 9 aa, Artificial Sequence
  Description of Artificial Sequence: Synthetic peptide
  Seed: LQIPVSRSF (MAGC1_HUMAN)
LGIPVSRSY

SEQ ID NO: 92846 - protein, 9 aa, Artificial Sequence
  Description of Artificial Sequence: Synthetic peptide
  Seed: VVEFLAMLK (MAGC1_HUMAN)
VTEFLAMLR

SEQ ID NO: 92847 - protein, 10 aa, Artificial Sequence
  Description of Artificial Sequence: Synthetic peptide
  Seed: SSFSYTLLSL (MAGC1_HUMAN)
SMFSYTLLSY

SEQ ID NO: 92848 - protein, 9 aa, Artificial Sequence
  Description of Artificial Sequence: Synthetic peptide
  Seed: SSSSTLLSL (MAGC1_HUMAN)
SSSSTLLSF

SEQ ID NO: 92849 - protein, 10 aa, Artificial Sequence
  Description of Artificial Sequence: Synthetic peptide
  Seed: LQIPMTSSFS (MAGC1_HUMAN)
LQIPMTSSFD

SEQ ID NO: 92850 - protein, 11 aa, Artificial Sequence
  Description of Artificial Sequence: Synthetic peptide
  Seed: IKRKVVEFLAM (MAGC1_HUMAN)
IQRKVVEFLAM

SEQ ID NO: 92851 - protein, 9 aa, Artificial Sequence
  Description of Artificial Sequence: Synthetic peptide
  Seed: SSPESTQSP (MAGC1_HUMAN)
SVPESTQSI

SEQ ID NO: 92852 - protein, 9 aa, Artificial Sequence
  Description of Artificial Sequence: Synthetic peptide
  Seed: IPVSSSFSY (MAGC1_HUMAN)
ITVSSSFSL

SEQ ID NO: 92853 - protein, 9 aa, Artificial Sequence
  Description of Artificial Sequence: Synthetic peptide
  Seed: VIWDVLSGI (MAGC1_HUMAN)
VAWDVLSGM

SEQ ID NO: 92854 - protein, 9 aa, Artificial Sequence
  Description of Artificial Sequence: Synthetic peptide
  Seed: SEPLFTYTL (MAGC1_HUMAN)
SQPLFTYTF

SEQ ID NO: 92855 - protein, 9 aa, Artificial Sequence
  Description of Artificial Sequence: Synthetic peptide
  Seed: SVLQIPVSA (MAGC1_HUMAN)
SVLQIPVSM

SEQ ID NO: 92856 - protein, 9 aa, Artificial Sequence
  Description of Artificial Sequence: Synthetic peptide
  Seed: FQSSPERTH (MAGC1_HUMAN)
FSSSPERTM

SEQ ID NO: 92857 - protein, 11 aa, Artificial Sequence
  Description of Artificial Sequence: Synthetic peptide
  Seed: SSFFSYTLASL (MAGC1_HUMAN)
SAFFSYTLASW

SEQ ID NO: 92858 - protein, 9 aa, Artificial Sequence
  Description of Artificial Sequence: Synthetic peptide
  Seed: IFRKAREFI (MAGC1_HUMAN)
ILRKAREFK

SEQ ID NO: 92859 - protein, 9 aa, Artificial Sequence
  Description of Artificial Sequence: Synthetic peptide
  Seed: LQRPVSSFF (MAGC1_HUMAN)
LFRPVSSFA

SEQ ID NO: 92860 - protein, 9 aa, Artificial Sequence
  Description of Artificial Sequence: Synthetic peptide
  Seed: RAGREHFAF (MAGC1_HUMAN)
RYGREHFAI

SEQ ID NO: 92861 - protein, 10 aa, Artificial Sequence
  Description of Artificial Sequence: Synthetic peptide
  Seed: SSPERTHSTF (MAGC1_HUMAN)
SYPERTHSTF

SEQ ID NO: 92862 - protein, 9 aa, Artificial Sequence
  Description of Artificial Sequence: Synthetic peptide
  Seed: RSFSSTLLS (MAGC1_HUMAN)
RIFSSTLLY

SEQ ID NO: 92863 - protein, 11 aa, Artificial Sequence
  Description of Artificial Sequence: Synthetic peptide
  Seed: STFEGFPQSLL (MAGC1_HUMAN)
SMFEGFPQSLD

SEQ ID NO: 92864 - protein, 9 aa, Artificial Sequence
  Description of Artificial Sequence: Synthetic peptide
  Seed: LQIPGSPSF (MAGC1_HUMAN)
LKIPGSPSM

SEQ ID NO: 92865 - protein, 9 aa, Artificial Sequence
  Description of Artificial Sequence: Synthetic peptide
  Seed: VSAASSSTL (MAGC1_HUMAN)
VYAASSSTL

SEQ ID NO: 92866 - protein, 8 aa, Artificial Sequence
  Description of Artificial Sequence: Synthetic peptide
  Seed: SSFSSTLL (MAGC1_HUMAN)
STFSSTLW

SEQ ID NO: 92867 - protein, 9 aa, Artificial Sequence
  Description of Artificial Sequence: Synthetic peptide
  Seed: NTHSPLQIV (MAGC1_HUMAN)
NAHSPLQIM

SEQ ID NO: 92868 - protein, 9 aa, Artificial Sequence
  Description of Artificial Sequence: Synthetic peptide
  Seed: SLPQSFPES (MAGC1_HUMAN)
SVPQSFPEM

SEQ ID NO: 92869 - protein, 11 aa, Artificial Sequence
  Description of Artificial Sequence: Synthetic peptide
  Seed: SPLQIPVSPSS (MAGC1_HUMAN)
SWLQIPVSPSF

SEQ ID NO: 92870 - protein, 10 aa, Artificial Sequence
  Description of Artificial Sequence: Synthetic peptide
  Seed: VRAGREHFAF (MAGC1_HUMAN)
VMAGREHFAF

SEQ ID NO: 92871 - protein, 9 aa, Artificial Sequence
  Description of Artificial Sequence: Synthetic peptide
  Seed: RSFSSTLLS (MAGC1_HUMAN)
RNFSSTLLW

SEQ ID NO: 92872 - protein, 9 aa, Artificial Sequence
  Description of Artificial Sequence: Synthetic peptide
  Seed: NSQSSPEGK (MAGC1_HUMAN)
NVQSSPEGR

SEQ ID NO: 92873 - protein, 10 aa, Artificial Sequence
  Description of Artificial Sequence: Synthetic peptide
  Seed: VSSSSSSSTL (MAGC1_HUMAN)
VISSSSSSTW

SEQ ID NO: 92874 - protein, 10 aa, Artificial Sequence
  Description of Artificial Sequence: Synthetic peptide
  Seed: SSFSYTLLSL (MAGC1_HUMAN)
SRFSYTLLSF

SEQ ID NO: 92875 - protein, 10 aa, Artificial Sequence
  Description of Artificial Sequence: Synthetic peptide
  Seed: LLQIPMTSSF (MAGC1_HUMAN)
LHQIPMTSSF

SEQ ID NO: 92876 - protein, 10 aa, Artificial Sequence
  Description of Artificial Sequence: Synthetic peptide
  Seed: ASSSVMSPSF (MAGC1_HUMAN)
ADSSVMSPSW

SEQ ID NO: 92877 - protein, 10 aa, Artificial Sequence
  Description of Artificial Sequence: Synthetic peptide
  Seed: REFIEILFGI (MAGC1_HUMAN)
RYFIEILFGW

SEQ ID NO: 92878 - protein, 10 aa, Artificial Sequence
  Description of Artificial Sequence: Synthetic peptide
  Seed: RTHSTFEGFP (MAGC1_HUMAN)
RMHSTFEGFK

SEQ ID NO: 92879 - protein, 11 aa, Artificial Sequence
  Description of Artificial Sequence: Synthetic peptide
  Seed: IPVSSSFSYTL (MAGC1_HUMAN)
INVSSSFSYTF

SEQ ID NO: 92880 - protein, 9 aa, Artificial Sequence
  Description of Artificial Sequence: Synthetic peptide
  Seed: AMLKNTVPI (MAGC1_HUMAN)
ALLKNTVPF

SEQ ID NO: 92881 - protein, 9 aa, Artificial Sequence
  Description of Artificial Sequence: Synthetic peptide
  Seed: IIDTTDDST (MAGC1_HUMAN)
IGDTTDDSF

SEQ ID NO: 92882 - protein, 9 aa, Artificial Sequence
  Description of Artificial Sequence: Synthetic peptide
  Seed: AMLKNTVPI (MAGC1_HUMAN)
AVLKNTVPV

SEQ ID NO: 92883 - protein, 9 aa, Artificial Sequence
  Description of Artificial Sequence: Synthetic peptide
  Seed: SFPSSTSSS (MAGC1_HUMAN)
SAPSSTSSF

SEQ ID NO: 92884 - protein, 9 aa, Artificial Sequence
  Description of Artificial Sequence: Synthetic peptide
  Seed: SLIESEPLF (MAGC1_HUMAN)
SRIESEPLY

SEQ ID NO: 92885 - protein, 9 aa, Artificial Sequence
  Description of Artificial Sequence: Synthetic peptide
  Seed: FSSALLSIF (MAGC1_HUMAN)
FASALLSIY

SEQ ID NO: 92886 - protein, 9 aa, Artificial Sequence
  Description of Artificial Sequence: Synthetic peptide
  Seed: YTLASLLQS (MAGC1_HUMAN)
YVLASLLQL

SEQ ID NO: 92887 - protein, 10 aa, Artificial Sequence
  Description of Artificial Sequence: Synthetic peptide
  Seed: VSSSFSYTLL (MAGC1_HUMAN)
VNSSFSYTLY

SEQ ID NO: 92888 - protein, 9 aa, Artificial Sequence
  Description of Artificial Sequence: Synthetic peptide
  Seed: LQIPVSRSF (MAGC1_HUMAN)
LTIPVSRSW

SEQ ID NO: 92889 - protein, 9 aa, Artificial Sequence
  Description of Artificial Sequence: Synthetic peptide
  Seed: VIWDVLSGI (MAGC1_HUMAN)
VLWDVLSGL

SEQ ID NO: 92890 - protein, 10 aa, Artificial Sequence
  Description of Artificial Sequence: Synthetic peptide
  Seed: ILILSIIFIK (MAGC1_HUMAN)
IMILSIIFIK

SEQ ID NO: 92891 - protein, 11 aa, Artificial Sequence
  Description of Artificial Sequence: Synthetic peptide
  Seed: SPLQIPGSPSF (MAGC1_HUMAN)
SALQIPGSPSY

SEQ ID NO: 92892 - protein, 10 aa, Artificial Sequence
  Description of Artificial Sequence: Synthetic peptide
  Seed: FAQSSLQIPV (MAGC1_HUMAN)
FMQSSLQIPM

SEQ ID NO: 92893 - protein, 9 aa, Artificial Sequence
  Description of Artificial Sequence: Synthetic peptide
  Seed: VIWDVLSGI (MAGC1_HUMAN)
VVWDVLSGT

SEQ ID NO: 92894 - protein, 10 aa, Artificial Sequence
  Description of Artificial Sequence: Synthetic peptide
  Seed: NPASSFFSSA (MAGC1_HUMAN)
NTASSFFSSI

SEQ ID NO: 92895 - protein, 10 aa, Artificial Sequence
  Description of Artificial Sequence: Synthetic peptide
  Seed: PLQIPMTSSF (MAGC1_HUMAN)
PWQIPMTSSF

SEQ ID NO: 92896 - protein, 9 aa, Artificial Sequence
  Description of Artificial Sequence: Synthetic peptide
  Seed: VPITFPSSY (MAGC1_HUMAN)
VWITFPSSY

SEQ ID NO: 92897 - protein, 9 aa, Artificial Sequence
  Description of Artificial Sequence: Synthetic peptide
  Seed: SSPERTQST (MAGC1_HUMAN)
STPERTQSL

SEQ ID NO: 92898 - protein, 9 aa, Artificial Sequence
  Description of Artificial Sequence: Synthetic peptide
  Seed: KVDELARFL (MAGC1_HUMAN)
KFDELARFI

SEQ ID NO: 92899 - protein, 9 aa, Artificial Sequence
  Description of Artificial Sequence: Synthetic peptide
  Seed: LQIPVSSSS (MAGC1_HUMAN)
LMIPVSSSV

SEQ ID NO: 92900 - protein, 9 aa, Artificial Sequence
  Description of Artificial Sequence: Synthetic peptide
  Seed: MGDKDMPTA (MAGC1_HUMAN)
MSDKDMPTM

SEQ ID NO: 92901 - protein, 10 aa, Artificial Sequence
  Description of Artificial Sequence: Synthetic peptide
  Seed: FPSSYKDALK (MAGC1_HUMAN)
FVSSYKDALK

SEQ ID NO: 92902 - protein, 9 aa, Artificial Sequence
  Description of Artificial Sequence: Synthetic peptide
  Seed: IIDTTDDST (MAGC1_HUMAN)
IMDTTDDSF

SEQ ID NO: 92903 - protein, 11 aa, Artificial Sequence
  Description of Artificial Sequence: Synthetic peptide
  Seed: STFEGFPQSLL (MAGC1_HUMAN)
SQFEGFPQSLM

SEQ ID NO: 92904 - protein, 10 aa, Artificial Sequence
  Description of Artificial Sequence: Synthetic peptide
  Seed: KRKVVEFLAM (MAGC1_HUMAN)
KAKVVEFLAM

SEQ ID NO: 92905 - protein, 11 aa, Artificial Sequence
  Description of Artificial Sequence: Synthetic peptide
  Seed: TSSFSSTLLSI (MAGC1_HUMAN)
TTSFSSTLLSW

SEQ ID NO: 92906 - protein, 9 aa, Artificial Sequence
  Description of Artificial Sequence: Synthetic peptide
  Seed: LQIVPSLPE (MAGC1_HUMAN)
LRIVPSLPF

SEQ ID NO: 92907 - protein, 9 aa, Artificial Sequence
  Description of Artificial Sequence: Synthetic peptide
  Seed: SAASSSTLV (MAGC1_HUMAN)
SQASSSTLI

SEQ ID NO: 92908 - protein, 9 aa, Artificial Sequence
  Description of Artificial Sequence: Synthetic peptide
  Seed: SQNRLLILI (MAGC1_HUMAN)
SHNRLLILA

SEQ ID NO: 92909 - protein, 10 aa, Artificial Sequence
  Description of Artificial Sequence: Synthetic peptide
  Seed: TGYFPVIFRK (MAGC1_HUMAN)
TIYFPVIFRK

SEQ ID NO: 92910 - protein, 9 aa, Artificial Sequence
  Description of Artificial Sequence: Synthetic peptide
  Seed: YTSSSDTLL (MAGC1_HUMAN)
YASSSDTLF

SEQ ID NO: 92911 - protein, 9 aa, Artificial Sequence
  Description of Artificial Sequence: Synthetic peptide
  Seed: SSPPRYEFL (MAGC1_HUMAN)
SQPPRYEFV

SEQ ID NO: 92912 - protein, 11 aa, Artificial Sequence
  Description of Artificial Sequence: Synthetic peptide
  Seed: LWGPRAHSEVI (MAGC1_HUMAN)
LTGPRAHSEVL

SEQ ID NO: 92913 - protein, 9 aa, Artificial Sequence
  Description of Artificial Sequence: Synthetic peptide
  Seed: TFEGFPQSL (MAGC1_HUMAN)
TFEGFPQSV

SEQ ID NO: 92914 - protein, 9 aa, Artificial Sequence
  Description of Artificial Sequence: Synthetic peptide
  Seed: GFPQSLLQI (MAGC1_HUMAN)
GWPQSLLQW

SEQ ID NO: 92915 - protein, 10 aa, Artificial Sequence
  Description of Artificial Sequence: Synthetic peptide
  Seed: ICSSSTSLSL (MAGC1_HUMAN)
IPSSSTSLSW

SEQ ID NO: 92916 - protein, 9 aa, Artificial Sequence
  Description of Artificial Sequence: Synthetic peptide
  Seed: VSSSSSSTL (MAGC1_HUMAN)
VISSSSSTW

SEQ ID NO: 92917 - protein, 9 aa, Artificial Sequence
  Description of Artificial Sequence: Synthetic peptide
  Seed: SSSTSLSPF (MAGC1_HUMAN)
SASTSLSPY

SEQ ID NO: 92918 - protein, 9 aa, Artificial Sequence
  Description of Artificial Sequence: Synthetic peptide
  Seed: KAREFIEIL (MAGC1_HUMAN)
KIREFIEIM

SEQ ID NO: 92919 - protein, 10 aa, Artificial Sequence
  Description of Artificial Sequence: Synthetic peptide
  Seed: SFFSYTLASL (MAGC1_HUMAN)
SWFSYTLASW

SEQ ID NO: 92920 - protein, 10 aa, Artificial Sequence
  Description of Artificial Sequence: Synthetic peptide
  Seed: KAREFIEILF (MAGC1_HUMAN)
KFREFIEILK

SEQ ID NO: 92921 - protein, 9 aa, Artificial Sequence
  Description of Artificial Sequence: Synthetic peptide
  Seed: FAQSPLQIP (MAGC1_HUMAN)
FPQSPLQIV

SEQ ID NO: 92922 - protein, 9 aa, Artificial Sequence
  Description of Artificial Sequence: Synthetic peptide
  Seed: IPVSSSFSY (MAGC1_HUMAN)
IMVSSSFSW

SEQ ID NO: 92923 - protein, 9 aa, Artificial Sequence
  Description of Artificial Sequence: Synthetic peptide
  Seed: FPQFPPQGE (MAGC1_HUMAN)
FPQFPPQGI

SEQ ID NO: 92924 - protein, 10 aa, Artificial Sequence
  Description of Artificial Sequence: Synthetic peptide
  Seed: SFSSTLLSIF (MAGC1_HUMAN)
SYSSTLLSIW

SEQ ID NO: 92925 - protein, 9 aa, Artificial Sequence
  Description of Artificial Sequence: Synthetic peptide
  Seed: KQPITKAEM (MAGC1_HUMAN)
KRPITKAEL

SEQ ID NO: 92926 - protein, 10 aa, Artificial Sequence
  Description of Artificial Sequence: Synthetic peptide
  Seed: LQIPVSSSFS (MAGC1_HUMAN)
LQIPVSSSFY

SEQ ID NO: 92927 - protein, 9 aa, Artificial Sequence
  Description of Artificial Sequence: Synthetic peptide
  Seed: HESPQSPPE (MAGC1_HUMAN)
HESPQSPPP

SEQ ID NO: 92928 - protein, 9 aa, Artificial Sequence
  Description of Artificial Sequence: Synthetic peptide
  Seed: IIDTTDDST (MAGC1_HUMAN)
IADTTDDSV

SEQ ID NO: 92929 - protein, 9 aa, Artificial Sequence
  Description of Artificial Sequence: Synthetic peptide
  Seed: FSYTLLSLF (MAGC1_HUMAN)
FSYTLLSLV

SEQ ID NO: 92930 - protein, 9 aa, Artificial Sequence
  Description of Artificial Sequence: Synthetic peptide
  Seed: SFSSTLVSL (MAGC1_HUMAN)
SSSSTLVSI

SEQ ID NO: 92931 - protein, 9 aa, Artificial Sequence
  Description of Artificial Sequence: Synthetic peptide
  Seed: SRYTGYFPV (MAGC1_HUMAN)
SLYTGYFPL

SEQ ID NO: 92932 - protein, 10 aa, Artificial Sequence
  Description of Artificial Sequence: Synthetic peptide
  Seed: SSSSTLLSLF (MAGC1_HUMAN)
SCSSTLLSLF

SEQ ID NO: 92933 - protein, 9 aa, Artificial Sequence
  Description of Artificial Sequence: Synthetic peptide
  Seed: AQSPLQIPV (MAGC1_HUMAN)
AASPLQIPY

SEQ ID NO: 92934 - protein, 10 aa, Artificial Sequence
  Description of Artificial Sequence: Synthetic peptide
  Seed: SPLQNPASSF (MAGC1_HUMAN)
SMLQNPASSM

SEQ ID NO: 92935 - protein, 9 aa, Artificial Sequence
  Description of Artificial Sequence: Synthetic peptide
  Seed: ISFSSSTSL (MAGC1_HUMAN)
ILFSSSTSW

SEQ ID NO: 92936 - protein, 9 aa, Artificial Sequence
  Description of Artificial Sequence: Synthetic peptide
  Seed: TLDEKVDEL (MAGC1_HUMAN)
TYDEKVDEV

SEQ ID NO: 92937 - protein, 9 aa, Artificial Sequence
  Description of Artificial Sequence: Synthetic peptide
  Seed: HESPQSPPE (MAGC1_HUMAN)
HESPQSPPM

SEQ ID NO: 92938 - protein, 9 aa, Artificial Sequence
  Description of Artificial Sequence: Synthetic peptide
  Seed: SPPQGEDSL (MAGC1_HUMAN)
SAPQGEDSF

SEQ ID NO: 92939 - protein, 11 aa, Artificial Sequence
  Description of Artificial Sequence: Synthetic peptide
  Seed: SFFSSALLSIF (MAGC1_HUMAN)
SRFSSALLSIW

SEQ ID NO: 92940 - protein, 8 aa, Artificial Sequence
  Description of Artificial Sequence: Synthetic peptide
  Seed: SSSTPSSL (MAGC1_HUMAN)
SASTPSSL

SEQ ID NO: 92941 - protein, 10 aa, Artificial Sequence
  Description of Artificial Sequence: Synthetic peptide
  Seed: YLEYREVPNS (MAGC1_HUMAN)
YMEYREVPNI

SEQ ID NO: 92942 - protein, 9 aa, Artificial Sequence
  Description of Artificial Sequence: Synthetic peptide
  Seed: SPLQIVPSL (MAGC1_HUMAN)
SLLQIVPSI

SEQ ID NO: 92943 - protein, 10 aa, Artificial Sequence
  Description of Artificial Sequence: Synthetic peptide
  Seed: STFEGFPQSL (MAGC1_HUMAN)
SVFEGFPQSY

SEQ ID NO: 92944 - protein, 10 aa, Artificial Sequence
  Description of Artificial Sequence: Synthetic peptide
  Seed: YASEEVIWDV (MAGC1_HUMAN)
YTSEEVIWDV

SEQ ID NO: 92945 - protein, 9 aa, Artificial Sequence
  Description of Artificial Sequence: Synthetic peptide
  Seed: SLPEWEDSL (MAGC1_HUMAN)
SIPEWEDSM

SEQ ID NO: 92946 - protein, 11 aa, Artificial Sequence
  Description of Artificial Sequence: Synthetic peptide
  Seed: NTVPITFPSSY (MAGC1_HUMAN)
NSVPITFPSSK

SEQ ID NO: 92947 - protein, 9 aa, Artificial Sequence
  Description of Artificial Sequence: Synthetic peptide
  Seed: SAQSAFEGF (MAGC1_HUMAN)
SIQSAFEGY

SEQ ID NO: 92948 - protein, 10 aa, Artificial Sequence
  Description of Artificial Sequence: Synthetic peptide
  Seed: LLQIPMTSSF (MAGC1_HUMAN)
LHQIPMTSSW

SEQ ID NO: 92949 - protein, 9 aa, Artificial Sequence
  Description of Artificial Sequence: Synthetic peptide
  Seed: SSSTSLSPF (MAGC1_HUMAN)
SASTSLSPM

SEQ ID NO: 92950 - protein, 11 aa, Artificial Sequence
  Description of Artificial Sequence: Synthetic peptide
  Seed: SSFPSSTSSSL (MAGC1_HUMAN)
SPFPSSTSSSI

SEQ ID NO: 92951 - protein, 9 aa, Artificial Sequence
  Description of Artificial Sequence: Synthetic peptide
  Seed: FSSTLVSLF (MAGC1_HUMAN)
FSSTLVSLV

SEQ ID NO: 92952 - protein, 10 aa, Artificial Sequence
  Description of Artificial Sequence: Synthetic peptide
  Seed: SFPSSTSSSL (MAGC1_HUMAN)
SSPSSTSSSV

SEQ ID NO: 92953 - protein, 9 aa, Artificial Sequence
  Description of Artificial Sequence: Synthetic peptide
  Seed: VISRYTGYF (MAGC1_HUMAN)
VSSRYTGYF

SEQ ID NO: 92954 - protein, 8 aa, Artificial Sequence
  Description of Artificial Sequence: Synthetic peptide
  Seed: SSPPRYEF (MAGC1_HUMAN)
SAPPRYEI

SEQ ID NO: 92955 - protein, 10 aa, Artificial Sequence
  Description of Artificial Sequence: Synthetic peptide
  Seed: FPQSVLQIPV (MAGC1_HUMAN)
FVQSVLQIPA

SEQ ID NO: 92956 - protein, 9 aa, Artificial Sequence
  Description of Artificial Sequence: Synthetic peptide
  Seed: FPQFPPQGE (MAGC1_HUMAN)
FPQFPPQGM

SEQ ID NO: 92957 - protein, 10 aa, Artificial Sequence
  Description of Artificial Sequence: Synthetic peptide
  Seed: EILFGISLRE (MAGC1_HUMAN)
EALFGISLRK

SEQ ID NO: 92958 - protein, 10 aa, Artificial Sequence
  Description of Artificial Sequence: Synthetic peptide
  Seed: FPQSPLQIPV (MAGC1_HUMAN)
FMQSPLQIPA

SEQ ID NO: 92959 - protein, 10 aa, Artificial Sequence
  Description of Artificial Sequence: Synthetic peptide
  Seed: ESTQSPFEGF (MAGC1_HUMAN)
EVTQSPFEGF

SEQ ID NO: 92960 - protein, 10 aa, Artificial Sequence
  Description of Artificial Sequence: Synthetic peptide
  Seed: SSPERTHSTF (MAGC1_HUMAN)
STPERTHSTY

SEQ ID NO: 92961 - protein, 9 aa, Artificial Sequence
  Description of Artificial Sequence: Synthetic peptide
  Seed: SQSSPVSSF (MAGC1_HUMAN)
SSSSPVSSL

SEQ ID NO: 92962 - protein, 9 aa, Artificial Sequence
  Description of Artificial Sequence: Synthetic peptide
  Seed: FSSTLVSLF (MAGC1_HUMAN)
FMSTLVSLL

SEQ ID NO: 92963 - protein, 9 aa, Artificial Sequence
  Description of Artificial Sequence: Synthetic peptide
  Seed: SPLQIVPSL (MAGC1_HUMAN)
SMLQIVPSY

SEQ ID NO: 92964 - protein, 10 aa, Artificial Sequence
  Description of Artificial Sequence: Synthetic peptide
  Seed: REHFAFGEPR (MAGC1_HUMAN)
RYHFAFGEPR

SEQ ID NO: 92965 - protein, 10 aa, Artificial Sequence
  Description of Artificial Sequence: Synthetic peptide
  Seed: YTLASLLQSS (MAGC1_HUMAN)
YILASLLQSA

SEQ ID NO: 92966 - protein, 9 aa, Artificial Sequence
  Description of Artificial Sequence: Synthetic peptide
  Seed: GFPQSLLQI (MAGC1_HUMAN)
GMPQSLLQL

SEQ ID NO: 92967 - protein, 9 aa, Artificial Sequence
  Description of Artificial Sequence: Synthetic peptide
  Seed: AQSPLQIPV (MAGC1_HUMAN)
AESPLQIPL

SEQ ID NO: 92968 - protein, 10 aa, Artificial Sequence
  Description of Artificial Sequence: Synthetic peptide
  Seed: ESAQSTFEGF (MAGC1_HUMAN)
EAAQSTFEGR

SEQ ID NO: 92969 - protein, 9 aa, Artificial Sequence
  Description of Artificial Sequence: Synthetic peptide
  Seed: RFLLLKYQV (MAGC1_HUMAN)
RFLLLKYQF

SEQ ID NO: 92970 - protein, 9 aa, Artificial Sequence
  Description of Artificial Sequence: Synthetic peptide
  Seed: SPLQIPMTS (MAGC1_HUMAN)
SLLQIPMTL

SEQ ID NO: 92971 - protein, 9 aa, Artificial Sequence
  Description of Artificial Sequence: Synthetic peptide
  Seed: SSSTLVSIF (MAGC1_HUMAN)
SCSTLVSIW

SEQ ID NO: 92972 - protein, 11 aa, Artificial Sequence
  Description of Artificial Sequence: Synthetic peptide
  Seed: IPVSAASSSTL (MAGC1_HUMAN)
IVVSAASSSTF

SEQ ID NO: 92973 - protein, 10 aa, Artificial Sequence
  Description of Artificial Sequence: Synthetic peptide
  Seed: NPASSFFSSA (MAGC1_HUMAN)
NHASSFFSSV

SEQ ID NO: 92974 - protein, 9 aa, Artificial Sequence
  Description of Artificial Sequence: Synthetic peptide
  Seed: SSPEGKDSL (MAGC1_HUMAN)
SLPEGKDSM

SEQ ID NO: 92975 - protein, 11 aa, Artificial Sequence
  Description of Artificial Sequence: Synthetic peptide
  Seed: REVPNSSPPRY (MAGC1_HUMAN)
RQVPNSSPPRM

SEQ ID NO: 92976 - protein, 9 aa, Artificial Sequence
  Description of Artificial Sequence: Synthetic peptide
  Seed: AQSPLQIPV (MAGC1_HUMAN)
AISPLQIPF

SEQ ID NO: 92977 - protein, 9 aa, Artificial Sequence
  Description of Artificial Sequence: Synthetic peptide
  Seed: AQSSLQIPV (MAGC1_HUMAN)
AKSSLQIPF

SEQ ID NO: 92978 - protein, 9 aa, Artificial Sequence
  Description of Artificial Sequence: Synthetic peptide
  Seed: SPPEGENTH (MAGC1_HUMAN)
SVPEGENTM

SEQ ID NO: 92979 - protein, 9 aa, Artificial Sequence
  Description of Artificial Sequence: Synthetic peptide
  Seed: SPLQSPVSS (MAGC1_HUMAN)
SVLQSPVSF

SEQ ID NO: 92980 - protein, 8 aa, Artificial Sequence
  Description of Artificial Sequence: Synthetic peptide
  Seed: IWDVLSGI (MAGC1_HUMAN)
IIDVLSGL

SEQ ID NO: 92981 - protein, 11 aa, Artificial Sequence
  Description of Artificial Sequence: Synthetic peptide
  Seed: LLQIPMTSSFS (MAGC1_HUMAN)
LKQIPMTSSFF

SEQ ID NO: 92982 - protein, 11 aa, Artificial Sequence
  Description of Artificial Sequence: Synthetic peptide
  Seed: STFEGFPQSPL (MAGC1_HUMAN)
SAFEGFPQSPY

SEQ ID NO: 92983 - protein, 10 aa, Artificial Sequence
  Description of Artificial Sequence: Synthetic peptide
  Seed: LQIPVSSSFS (MAGC1_HUMAN)
LVIPVSSSFF

SEQ ID NO: 92984 - protein, 9 aa, Artificial Sequence
  Description of Artificial Sequence: Synthetic peptide
  Seed: ATESASSSV (MAGC1_HUMAN)
AIESASSSL

SEQ ID NO: 92985 - protein, 10 aa, Artificial Sequence
  Description of Artificial Sequence: Synthetic peptide
  Seed: STPSSLPQSF (MAGC1_HUMAN)
SVPSSLPQSW

SEQ ID NO: 92986 - protein, 11 aa, Artificial Sequence
  Description of Artificial Sequence: Synthetic peptide
  Seed: AMLKNTVPITF (MAGC1_HUMAN)
ASLKNTVPITW

SEQ ID NO: 92987 - protein, 9 aa, Artificial Sequence
  Description of Artificial Sequence: Synthetic peptide
  Seed: FSSTLVSLF (MAGC1_HUMAN)
FSSTLVSLM

SEQ ID NO: 92988 - protein, 11 aa, Artificial Sequence
  Description of Artificial Sequence: Synthetic peptide
  Seed: MSPLYFPQSPL (MAGC1_HUMAN)
MDPLYFPQSPV

SEQ ID NO: 92989 - protein, 8 aa, Artificial Sequence
  Description of Artificial Sequence: Synthetic peptide
  Seed: IWDVLSGI (MAGC1_HUMAN)
ITDVLSGL

SEQ ID NO: 92990 - protein, 10 aa, Artificial Sequence
  Description of Artificial Sequence: Synthetic peptide
  Seed: LSLFQSFSER (MAGC1_HUMAN)
LYLFQSFSER

SEQ ID NO: 92991 - protein, 9 aa, Artificial Sequence
  Description of Artificial Sequence: Synthetic peptide
  Seed: AQSSLQIPV (MAGC1_HUMAN)
ARSSLQIPL

SEQ ID NO: 92992 - protein, 10 aa, Artificial Sequence
  Description of Artificial Sequence: Synthetic peptide
  Seed: FFSSALLSIF (MAGC1_HUMAN)
FRSSALLSIW

SEQ ID NO: 92993 - protein, 10 aa, Artificial Sequence
  Description of Artificial Sequence: Synthetic peptide
  Seed: SFPSSTSSSL (MAGC1_HUMAN)
SMPSSTSSSV

SEQ ID NO: 92994 - protein, 9 aa, Artificial Sequence
  Description of Artificial Sequence: Synthetic peptide
  Seed: FAFGEPREL (MAGC1_HUMAN)
FNFGEPREI

SEQ ID NO: 92995 - protein, 10 aa, Artificial Sequence
  Description of Artificial Sequence: Synthetic peptide
  Seed: SQNRLLILIL (MAGC1_HUMAN)
SRNRLLILIL

SEQ ID NO: 92996 - protein, 10 aa, Artificial Sequence
  Description of Artificial Sequence: Synthetic peptide
  Seed: FLAMLKNTVP (MAGC1_HUMAN)
FMAMLKNTVL

SEQ ID NO: 92997 - protein, 10 aa, Artificial Sequence
  Description of Artificial Sequence: Synthetic peptide
  Seed: SPLQNPASSF (MAGC1_HUMAN)
SPLQNPASSV

SEQ ID NO: 92998 - protein, 9 aa, Artificial Sequence
  Description of Artificial Sequence: Synthetic peptide
  Seed: AQSPLQRPV (MAGC1_HUMAN)
AHSPLQRPY

SEQ ID NO: 92999 - protein, 9 aa, Artificial Sequence
  Description of Artificial Sequence: Synthetic peptide
  Seed: LQIPMTSSF (MAGC1_HUMAN)
LPIPMTSSA

SEQ ID NO: 93000 - protein, 10 aa, Artificial Sequence
  Description of Artificial Sequence: Synthetic peptide
  Seed: MTSSFSSTLL (MAGC1_HUMAN)
MYSSFSSTLY

SEQ ID NO: 93001 - protein, 9 aa, Artificial Sequence
  Description of Artificial Sequence: Synthetic peptide
  Seed: SSPERTHST (MAGC1_HUMAN)
SNPERTHSI

SEQ ID NO: 93002 - protein, 9 aa, Artificial Sequence
  Description of Artificial Sequence: Synthetic peptide
  Seed: FSSTLLSLF (MAGC1_HUMAN)
FISTLLSLM

SEQ ID NO: 93003 - protein, 11 aa, Artificial Sequence
  Description of Artificial Sequence: Synthetic peptide
  Seed: LWGPRAHSEVI (MAGC1_HUMAN)
LHGPRAHSEVL

SEQ ID NO: 93004 - protein, 10 aa, Artificial Sequence
  Description of Artificial Sequence: Synthetic peptide
  Seed: KAREFIEILF (MAGC1_HUMAN)
KMREFIEILF

SEQ ID NO: 93005 - protein, 10 aa, Artificial Sequence
  Description of Artificial Sequence: Synthetic peptide
  Seed: LSIIFIKGTY (MAGC1_HUMAN)
LAIIFIKGTW

SEQ ID NO: 93006 - protein, 10 aa, Artificial Sequence
  Description of Artificial Sequence: Synthetic peptide
  Seed: SSSSSSSTLL (MAGC1_HUMAN)
SISSSSSTLF

SEQ ID NO: 93007 - protein, 9 aa, Artificial Sequence
  Description of Artificial Sequence: Synthetic peptide
  Seed: SVLQIPVSA (MAGC1_HUMAN)
SWLQIPVSR

SEQ ID NO: 93008 - protein, 9 aa, Artificial Sequence
  Description of Artificial Sequence: Synthetic peptide
  Seed: SSPESPLQS (MAGC1_HUMAN)
SGPESPLQV

SEQ ID NO: 93009 - protein, 10 aa, Artificial Sequence
  Description of Artificial Sequence: Synthetic peptide
  Seed: KAEMLTNVIS (MAGC1_HUMAN)
KWEMLTNVIA

SEQ ID NO: 93010 - protein, 8 aa, Artificial Sequence
  Description of Artificial Sequence: Synthetic peptide
  Seed: FSSTLVSL (MAGC1_HUMAN)
FTSTLVSL

SEQ ID NO: 93011 - protein, 9 aa, Artificial Sequence
  Description of Artificial Sequence: Synthetic peptide
  Seed: NPASSFFSS (MAGC1_HUMAN)
NVASSFFSY

SEQ ID NO: 93012 - protein, 11 aa, Artificial Sequence
  Description of Artificial Sequence: Synthetic peptide
  Seed: MSPLYFPQSPL (MAGC1_HUMAN)
MVPLYFPQSPV

SEQ ID NO: 93013 - protein, 9 aa, Artificial Sequence
  Description of Artificial Sequence: Synthetic peptide
  Seed: SSSTLVSIF (MAGC1_HUMAN)
SMSTLVSIF

SEQ ID NO: 93014 - protein, 9 aa, Artificial Sequence
  Description of Artificial Sequence: Synthetic peptide
  Seed: VIWDVLSGI (MAGC1_HUMAN)
VMWDVLSGF

SEQ ID NO: 93015 - protein, 10 aa, Artificial Sequence
  Description of Artificial Sequence: Synthetic peptide
  Seed: VPITFPSSYK (MAGC1_HUMAN)
VEITFPSSYK

SEQ ID NO: 93016 - protein, 9 aa, Artificial Sequence
  Description of Artificial Sequence: Synthetic peptide
  Seed: IESEPLFTY (MAGC1_HUMAN)
IRSEPLFTY

SEQ ID NO: 93017 - protein, 10 aa, Artificial Sequence
  Description of Artificial Sequence: Synthetic peptide
  Seed: MPTAGMPSLL (MAGC1_HUMAN)
MMTAGMPSLY

SEQ ID NO: 93018 - protein, 9 aa, Artificial Sequence
  Description of Artificial Sequence: Synthetic peptide
  Seed: SLPQSFPES (MAGC1_HUMAN)
SIPQSFPEL

SEQ ID NO: 93019 - protein, 9 aa, Artificial Sequence
  Description of Artificial Sequence: Synthetic peptide
  Seed: SAASSSTLV (MAGC1_HUMAN)
SIASSSTLF

SEQ ID NO: 93020 - protein, 9 aa, Artificial Sequence
  Description of Artificial Sequence: Synthetic peptide
  Seed: VVEFLAMLK (MAGC1_HUMAN)
VMEFLAMLY

SEQ ID NO: 93021 - protein, 11 aa, Artificial Sequence
  Description of Artificial Sequence: Synthetic peptide
  Seed: QSSPESAQSTF (MAGC1_HUMAN)
QQSPESAQSTI

SEQ ID NO: 93022 - protein, 9 aa, Artificial Sequence
  Description of Artificial Sequence: Synthetic peptide
  Seed: LKYQVKQPI (MAGC1_HUMAN)
LIYQVKQPF

SEQ ID NO: 93023 - protein, 10 aa, Artificial Sequence
  Description of Artificial Sequence: Synthetic peptide
  Seed: LQIPVSSSFS (MAGC1_HUMAN)
LQIPVSSSFD

SEQ ID NO: 93024 - protein, 9 aa, Artificial Sequence
  Description of Artificial Sequence: Synthetic peptide
  Seed: MPSLLQSSS (MAGC1_HUMAN)
MCSLLQSSY

SEQ ID NO: 93025 - protein, 10 aa, Artificial Sequence
  Description of Artificial Sequence: Synthetic peptide
  Seed: SSPESTQSPF (MAGC1_HUMAN)
SSPESTQSPL

SEQ ID NO: 93026 - protein, 11 aa, Artificial Sequence
  Description of Artificial Sequence: Synthetic peptide
  Seed: RPVSSFFSYTL (MAGC1_HUMAN)
RPVSSFFSYTF

SEQ ID NO: 93027 - protein, 10 aa, Artificial Sequence
  Description of Artificial Sequence: Synthetic peptide
  Seed: FLAMLKNTVP (MAGC1_HUMAN)
FIAMLKNTVV

SEQ ID NO: 93028 - protein, 11 aa, Artificial Sequence
  Description of Artificial Sequence: Synthetic peptide
  Seed: IPMTSSFSSTL (MAGC1_HUMAN)
IQMTSSFSSTY

SEQ ID NO: 93029 - protein, 9 aa, Artificial Sequence
  Description of Artificial Sequence: Synthetic peptide
  Seed: SQSPPEGPV (MAGC1_HUMAN)
SESPPEGPM

SEQ ID NO: 93030 - protein, 9 aa, Artificial Sequence
  Description of Artificial Sequence: Synthetic peptide
  Seed: LQIPVSAAS (MAGC1_HUMAN)
LHIPVSAAM

SEQ ID NO: 93031 - protein, 10 aa, Artificial Sequence
  Description of Artificial Sequence: Synthetic peptide
  Seed: LSQSSPVSSF (MAGC1_HUMAN)
LQQSSPVSSM

SEQ ID NO: 93032 - protein, 9 aa, Artificial Sequence
  Description of Artificial Sequence: Synthetic peptide
  Seed: VQSPLQNPA (MAGC1_HUMAN)
VQSPLQNPF

SEQ ID NO: 93033 - protein, 10 aa, Artificial Sequence
  Description of Artificial Sequence: Synthetic peptide
  Seed: YTLASLLQSS (MAGC1_HUMAN)
YQLASLLQSV

SEQ ID NO: 93034 - protein, 9 aa, Artificial Sequence
  Description of Artificial Sequence: Synthetic peptide
  Seed: FPVIFRKAR (MAGC1_HUMAN)
FSVIFRKAR

SEQ ID NO: 93035 - protein, 9 aa, Artificial Sequence
  Description of Artificial Sequence: Synthetic peptide
  Seed: VISRYTGYF (MAGC1_HUMAN)
VASRYTGYF

SEQ ID NO: 93036 - protein, 9 aa, Artificial Sequence
  Description of Artificial Sequence: Synthetic peptide
  Seed: RKAREFIEI (MAGC1_HUMAN)
RMAREFIEF

SEQ ID NO: 93037 - protein, 10 aa, Artificial Sequence
  Description of Artificial Sequence: Synthetic peptide
  Seed: SFPSSTSSSL (MAGC1_HUMAN)
SQPSSTSSSF

SEQ ID NO: 93038 - protein, 9 aa, Artificial Sequence
  Description of Artificial Sequence: Synthetic peptide
  Seed: IIDTTDDST (MAGC1_HUMAN)
IQDTTDDSM

SEQ ID NO: 93039 - protein, 10 aa, Artificial Sequence
  Description of Artificial Sequence: Synthetic peptide
  Seed: REVDPDDSYV (MAGC1_HUMAN)
REVDPDDSYF

SEQ ID NO: 93040 - protein, 9 aa, Artificial Sequence
  Description of Artificial Sequence: Synthetic peptide
  Seed: SPLQIPGSP (MAGC1_HUMAN)
SPLQIPGSV

SEQ ID NO: 93041 - protein, 9 aa, Artificial Sequence
  Description of Artificial Sequence: Synthetic peptide
  Seed: NSSPPRYEF (MAGC1_HUMAN)
NASPPRYEW

SEQ ID NO: 93042 - protein, 9 aa, Artificial Sequence
  Description of Artificial Sequence: Synthetic peptide
  Seed: EFIEILFGI (MAGC1_HUMAN)
EPIEILFGV

SEQ ID NO: 93043 - protein, 9 aa, Artificial Sequence
  Description of Artificial Sequence: Synthetic peptide
  Seed: SSPPRYEFL (MAGC1_HUMAN)
SSPPRYEFF

SEQ ID NO: 93044 - protein, 11 aa, Artificial Sequence
  Description of Artificial Sequence: Synthetic peptide
  Seed: TTDDSTATESA (MAGC1_HUMAN)
TIDDSTATESI

SEQ ID NO: 93045 - protein, 9 aa, Artificial Sequence
  Description of Artificial Sequence: Synthetic peptide
  Seed: FFSSALLSI (MAGC1_HUMAN)
FFSSALLSV

SEQ ID NO: 93046 - protein, 11 aa, Artificial Sequence
  Description of Artificial Sequence: Synthetic peptide
  Seed: STFEGFPQSPL (MAGC1_HUMAN)
SPFEGFPQSPA

SEQ ID NO: 93047 - protein, 10 aa, Artificial Sequence
  Description of Artificial Sequence: Synthetic peptide
  Seed: PLQIPVSSSF (MAGC1_HUMAN)
PVQIPVSSSY

SEQ ID NO: 93048 - protein, 10 aa, Artificial Sequence
  Description of Artificial Sequence: Synthetic peptide
  Seed: VSSSFSYTLL (MAGC1_HUMAN)
VSSSFSYTLM

SEQ ID NO: 93049 - protein, 9 aa, Artificial Sequence
  Description of Artificial Sequence: Synthetic peptide
  Seed: SIIFIKGTY (MAGC1_HUMAN)
SWIFIKGTY

SEQ ID NO: 93050 - protein, 10 aa, Artificial Sequence
  Description of Artificial Sequence: Synthetic peptide
  Seed: KRKVVEFLAM (MAGC1_HUMAN)
KDKVVEFLAY

SEQ ID NO: 93051 - protein, 9 aa, Artificial Sequence
  Description of Artificial Sequence: Synthetic peptide
  Seed: AGREHFAFG (MAGC1_HUMAN)
AMREHFAFY

SEQ ID NO: 93052 - protein, 9 aa, Artificial Sequence
  Description of Artificial Sequence: Synthetic peptide
  Seed: VSRSFSSTL (MAGC1_HUMAN)
VVRSFSSTF

SEQ ID NO: 93053 - protein, 10 aa, Artificial Sequence
  Description of Artificial Sequence: Synthetic peptide
  Seed: SLFQSSPECT (MAGC1_HUMAN)
SVFQSSPECV

SEQ ID NO: 93054 - protein, 9 aa, Artificial Sequence
  Description of Artificial Sequence: Synthetic peptide
  Seed: SPLQSPVSS (MAGC1_HUMAN)
SSLQSPVSL

SEQ ID NO: 93055 - protein, 10 aa, Artificial Sequence
  Description of Artificial Sequence: Synthetic peptide
  Seed: MPTAGMPSLL (MAGC1_HUMAN)
MATAGMPSLV

SEQ ID NO: 93056 - protein, 10 aa, Artificial Sequence
  Description of Artificial Sequence: Synthetic peptide
  Seed: LQIVPSLPEW (MAGC1_HUMAN)
LSIVPSLPEI

SEQ ID NO: 93057 - protein, 9 aa, Artificial Sequence
  Description of Artificial Sequence: Synthetic peptide
  Seed: FFSSALLSI (MAGC1_HUMAN)
FSSSALLSL

SEQ ID NO: 93058 - protein, 11 aa, Artificial Sequence
  Description of Artificial Sequence: Synthetic peptide
  Seed: LQIPMTSSFSS (MAGC1_HUMAN)
LKIPMTSSFSM

SEQ ID NO: 93059 - protein, 10 aa, Artificial Sequence
  Description of Artificial Sequence: Synthetic peptide
  Seed: SLIESEPLFT (MAGC1_HUMAN)
SMIESEPLFL

SEQ ID NO: 93060 - protein, 9 aa, Artificial Sequence
  Description of Artificial Sequence: Synthetic peptide
  Seed: QIVPSLPEW (MAGC1_HUMAN)
QLVPSLPEF

SEQ ID NO: 93061 - protein, 9 aa, Artificial Sequence
  Description of Artificial Sequence: Synthetic peptide
  Seed: SPPEGPVQS (MAGC1_HUMAN)
SPPEGPVQL

SEQ ID NO: 93062 - protein, 9 aa, Artificial Sequence
  Description of Artificial Sequence: Synthetic peptide
  Seed: ASSFFSSAL (MAGC1_HUMAN)
AWSFFSSAM

SEQ ID NO: 93063 - protein, 10 aa, Artificial Sequence
  Description of Artificial Sequence: Synthetic peptide
  Seed: PLQIPVSRSF (MAGC1_HUMAN)
PVQIPVSRSF

SEQ ID NO: 93064 - protein, 9 aa, Artificial Sequence
  Description of Artificial Sequence: Synthetic peptide
  Seed: LQIPVSPSF (MAGC1_HUMAN)
LPIPVSPSH

SEQ ID NO: 93065 - protein, 9 aa, Artificial Sequence
  Description of Artificial Sequence: Synthetic peptide
  Seed: RAHSEVIKR (MAGC1_HUMAN)
RLHSEVIKK

SEQ ID NO: 93066 - protein, 9 aa, Artificial Sequence
  Description of Artificial Sequence: Synthetic peptide
  Seed: SPESTQSPF (MAGC1_HUMAN)
SPESTQSPL

SEQ ID NO: 93067 - protein, 9 aa, Artificial Sequence
  Description of Artificial Sequence: Synthetic peptide
  Seed: ISFSSSTSL (MAGC1_HUMAN)
IQFSSSTSV

SEQ ID NO: 93068 - protein, 10 aa, Artificial Sequence
  Description of Artificial Sequence: Synthetic peptide
  Seed: QRPVSSFFSY (MAGC1_HUMAN)
QQPVSSFFSM

SEQ ID NO: 93069 - protein, 11 aa, Artificial Sequence
  Description of Artificial Sequence: Synthetic peptide
  Seed: SPLQRPVSSFF (MAGC1_HUMAN)
SWLQRPVSSFY

SEQ ID NO: 93070 - protein, 10 aa, Artificial Sequence
  Description of Artificial Sequence: Synthetic peptide
  Seed: TTDDSTATES (MAGC1_HUMAN)
TGDDSTATEL

SEQ ID NO: 93071 - protein, 9 aa, Artificial Sequence
  Description of Artificial Sequence: Synthetic peptide
  Seed: EFIEILFGI (MAGC1_HUMAN)
EIIEILFGL

SEQ ID NO: 93072 - protein, 9 aa, Artificial Sequence
  Description of Artificial Sequence: Synthetic peptide
  Seed: VQSPLQNPA (MAGC1_HUMAN)
VKSPLQNPM

SEQ ID NO: 93073 - protein, 9 aa, Artificial Sequence
  Description of Artificial Sequence: Synthetic peptide
  Seed: TLLSLFQSF (MAGC1_HUMAN)
TLLSLFQSK

SEQ ID NO: 93074 - protein, 9 aa, Artificial Sequence
  Description of Artificial Sequence: Synthetic peptide
  Seed: YQVKQPITK (MAGC1_HUMAN)
YTVKQPITL

SEQ ID NO: 93075 - protein, 9 aa, Artificial Sequence
  Description of Artificial Sequence: Synthetic peptide
  Seed: FEGFAQSPL (MAGC1_HUMAN)
FEGFAQSPA

SEQ ID NO: 93076 - protein, 11 aa, Artificial Sequence
  Description of Artificial Sequence: Synthetic peptide
  Seed: IPMTSSFSSTL (MAGC1_HUMAN)
IDMTSSFSSTW

SEQ ID NO: 93077 - protein, 10 aa, Artificial Sequence
  Description of Artificial Sequence: Synthetic peptide
  Seed: WGPRAHSEVI (MAGC1_HUMAN)
WIPRAHSEVL

SEQ ID NO: 93078 - protein, 9 aa, Artificial Sequence
  Description of Artificial Sequence: Synthetic peptide
  Seed: TLLSLFQSF (MAGC1_HUMAN)
TALSLFQSI

SEQ ID NO: 93079 - protein, 9 aa, Artificial Sequence
  Description of Artificial Sequence: Synthetic peptide
  Seed: LKNTVPITF (MAGC1_HUMAN)
LFNTVPITL

SEQ ID NO: 93080 - protein, 9 aa, Artificial Sequence
  Description of Artificial Sequence: Synthetic peptide
  Seed: SSFFSYTLA (MAGC1_HUMAN)
SMFFSYTLI

SEQ ID NO: 93081 - protein, 8 aa, Artificial Sequence
  Description of Artificial Sequence: Synthetic peptide
  Seed: FGISLREV (MAGC1_HUMAN)
FSISLREL

SEQ ID NO: 93082 - protein, 10 aa, Artificial Sequence
  Description of Artificial Sequence: Synthetic peptide
  Seed: KDVEERAQAI (MAGC1_HUMAN)
KEVEERAQAI

SEQ ID NO: 93083 - protein, 10 aa, Artificial Sequence
  Description of Artificial Sequence: Synthetic peptide
  Seed: SRYTGYFPVI (MAGC1_HUMAN)
SQYTGYFPVF

SEQ ID NO: 93084 - protein, 9 aa, Artificial Sequence
  Description of Artificial Sequence: Synthetic peptide
  Seed: SFFSYTLAS (MAGC1_HUMAN)
SVFSYTLAL

SEQ ID NO: 93085 - protein, 9 aa, Artificial Sequence
  Description of Artificial Sequence: Synthetic peptide
  Seed: MLTNVISRY (MAGC1_HUMAN)
MMTNVISRF

SEQ ID NO: 93086 - protein, 9 aa, Artificial Sequence
  Description of Artificial Sequence: Synthetic peptide
  Seed: FPQSPPQGE (MAGC1_HUMAN)
FPQSPPQGL

SEQ ID NO: 93087 - protein, 11 aa, Artificial Sequence
  Description of Artificial Sequence: Synthetic peptide
  Seed: SLSQSSPVSSF (MAGC1_HUMAN)
SCSQSSPVSSY

SEQ ID NO: 93088 - protein, 8 aa, Artificial Sequence
  Description of Artificial Sequence: Synthetic peptide
  Seed: LLSLFQSF (MAGC1_HUMAN)
LQSLFQSY

SEQ ID NO: 93089 - protein, 9 aa, Artificial Sequence
  Description of Artificial Sequence: Synthetic peptide
  Seed: MSQNRLLIL (MAGC1_HUMAN)
MRQNRLLIF

SEQ ID NO: 93090 - protein, 10 aa, Artificial Sequence
  Description of Artificial Sequence: Synthetic peptide
  Seed: KGTYASEEVI (MAGC1_HUMAN)
KETYASEEVY

SEQ ID NO: 93091 - protein, 9 aa, Artificial Sequence
  Description of Artificial Sequence: Synthetic peptide
  Seed: FSYTLASLL (MAGC1_HUMAN)
FAYTLASLA

SEQ ID NO: 93092 - protein, 10 aa, Artificial Sequence
  Description of Artificial Sequence: Synthetic peptide
  Seed: SFSYTLLSLF (MAGC1_HUMAN)
SASYTLLSLF

SEQ ID NO: 93093 - protein, 10 aa, Artificial Sequence
  Description of Artificial Sequence: Synthetic peptide
  Seed: LQRPVSSFFS (MAGC1_HUMAN)
LQRPVSSFFM

SEQ ID NO: 93094 - protein, 9 aa, Artificial Sequence
  Description of Artificial Sequence: Synthetic peptide
  Seed: FSSTLLSLF (MAGC1_HUMAN)
FVSTLLSLA

SEQ ID NO: 93095 - protein, 10 aa, Artificial Sequence
  Description of Artificial Sequence: Synthetic peptide
  Seed: SLSPLHFPQF (MAGC1_HUMAN)
SSSPLHFPQF

SEQ ID NO: 93096 - protein, 10 aa, Artificial Sequence
  Description of Artificial Sequence: Synthetic peptide
  Seed: VSPSSSSTLL (MAGC1_HUMAN)
VIPSSSSTLL

SEQ ID NO: 93097 - protein, 9 aa, Artificial Sequence
  Description of Artificial Sequence: Synthetic peptide
  Seed: MTSSFSSTL (MAGC1_HUMAN)
MVSSFSSTR

SEQ ID NO: 93098 - protein, 10 aa, Artificial Sequence
  Description of Artificial Sequence: Synthetic peptide
  Seed: RKVVEFLAML (MAGC1_HUMAN)
RGVVEFLAMA

SEQ ID NO: 93099 - protein, 9 aa, Artificial Sequence
  Description of Artificial Sequence: Synthetic peptide
  Seed: VSSSFSYTL (MAGC1_HUMAN)
VWSSFSYTI

SEQ ID NO: 93100 - protein, 10 aa, Artificial Sequence
  Description of Artificial Sequence: Synthetic peptide
  Seed: SSSSSTLLSL (MAGC1_HUMAN)
SISSSTLLSA

SEQ ID NO: 93101 - protein, 9 aa, Artificial Sequence
  Description of Artificial Sequence: Synthetic peptide
  Seed: NTVPITFPS (MAGC1_HUMAN)
NIVPITFPV

SEQ ID NO: 93102 - protein, 9 aa, Artificial Sequence
  Description of Artificial Sequence: Synthetic peptide
  Seed: KQPITKAEM (MAGC1_HUMAN)
KVPITKAEL

SEQ ID NO: 93103 - protein, 9 aa, Artificial Sequence
  Description of Artificial Sequence: Synthetic peptide
  Seed: FSYTLLSLF (MAGC1_HUMAN)
FLYTLLSLF

SEQ ID NO: 93104 - protein, 10 aa, Artificial Sequence
  Description of Artificial Sequence: Synthetic peptide
  Seed: VSSSSSSSTL (MAGC1_HUMAN)
VSSSSSSSTF

SEQ ID NO: 93105 - protein, 11 aa, Artificial Sequence
  Description of Artificial Sequence: Synthetic peptide
  Seed: QSSPERTQSTF (MAGC1_HUMAN)
QTSPERTQSTW

SEQ ID NO: 93106 - protein, 9 aa, Artificial Sequence
  Description of Artificial Sequence: Synthetic peptide
  Seed: MLTNVISRY (MAGC1_HUMAN)
MKTNVISRY

SEQ ID NO: 93107 - protein, 11 aa, Artificial Sequence
  Description of Artificial Sequence: Synthetic peptide
  Seed: AASSSTLVSIF (MAGC1_HUMAN)
AQSSSTLVSIY

SEQ ID NO: 93108 - protein, 11 aa, Artificial Sequence
  Description of Artificial Sequence: Synthetic peptide
  Seed: IPVSSSFSYTL (MAGC1_HUMAN)
IDVSSSFSYTW

SEQ ID NO: 93109 - protein, 10 aa, Artificial Sequence
  Description of Artificial Sequence: Synthetic peptide
  Seed: LQIPMTSSFS (MAGC1_HUMAN)
LMIPMTSSFV

SEQ ID NO: 93110 - protein, 9 aa, Artificial Sequence
  Description of Artificial Sequence: Synthetic peptide
  Seed: SSSSSSTLL (MAGC1_HUMAN)
SPSSSSTLM

SEQ ID NO: 93111 - protein, 9 aa, Artificial Sequence
  Description of Artificial Sequence: Synthetic peptide
  Seed: SSPPRYEFL (MAGC1_HUMAN)
SFPPRYEFL

SEQ ID NO: 93112 - protein, 10 aa, Artificial Sequence
  Description of Artificial Sequence: Synthetic peptide
  Seed: SSFSSTLLSI (MAGC1_HUMAN)
SIFSSTLLSY

SEQ ID NO: 93113 - protein, 9 aa, Artificial Sequence
  Description of Artificial Sequence: Synthetic peptide
  Seed: SSLSQSSPV (MAGC1_HUMAN)
SQLSQSSPV

SEQ ID NO: 93114 - protein, 9 aa, Homo sapiens
  Native (MAGC1_HUMAN)
FEGFPQSPL

SEQ ID NO: 93115 - protein, 10 aa, Homo sapiens
  Native (MAGC1_HUMAN)
STPSSLPQSF

SEQ ID NO: 93116 - protein, 9 aa, Homo sapiens
  Native (MAGC1_HUMAN)
PESPLQSPV

SEQ ID NO: 93117 - protein, 9 aa, Homo sapiens
  Native (MAGC1_HUMAN)
DALKDVEER

SEQ ID NO: 93118 - protein, 8 aa, Homo sapiens
  Native (MAGC1_HUMAN)
SSFFSYTL

SEQ ID NO: 93119 - protein, 9 aa, Homo sapiens
  Native (MAGC1_HUMAN)
GFPQSVLQI

SEQ ID NO: 93120 - protein, 9 aa, Homo sapiens
  Native (MAGC1_HUMAN)
SSSTLLSLF

SEQ ID NO: 93121 - protein, 8 aa, Homo sapiens
  Native (MAGC1_HUMAN)
SPLQIVPS

SEQ ID NO: 93122 - protein, 9 aa, Homo sapiens
  Native (MAGC1_HUMAN)
SFPSSTSSS

SEQ ID NO: 93123 - protein, 9 aa, Homo sapiens
  Native (MAGC1_HUMAN)
EVDPDDSYV

SEQ ID NO: 93124 - protein, 9 aa, Homo sapiens
  Native (MAGC1_HUMAN)
LQIPVSAAS

SEQ ID NO: 93125 - protein, 9 aa, Homo sapiens
  Native (MAGC1_HUMAN)
IIFIKGTYA

SEQ ID NO: 93126 - protein, 11 aa, Homo sapiens
  Native (MAGC1_HUMAN)
SPFEGFPQSVL

SEQ ID NO: 93127 - protein, 10 aa, Homo sapiens
  Native (MAGC1_HUMAN)
FPQSPQGEDS

SEQ ID NO: 93128 - protein, 11 aa, Homo sapiens
  Native (MAGC1_HUMAN)
GYFPVIFRKAR

SEQ ID NO: 93129 - protein, 10 aa, Homo sapiens
  Native (MAGC1_HUMAN)
EVIWDVLSGI

SEQ ID NO: 93130 - protein, 9 aa, Homo sapiens
  Native (MAGC1_HUMAN)
LEGEDSLSS

SEQ ID NO: 93131 - protein, 10 aa, Homo sapiens
  Native (MAGC1_HUMAN)
VSSSSSSSTL

SEQ ID NO: 93132 - protein, 10 aa, Homo sapiens
  Native (MAGC1_HUMAN)
WDVLSGIGVR

SEQ ID NO: 93133 - protein, 10 aa, Homo sapiens
  Native (MAGC1_HUMAN)
EEFQSSLQSP

SEQ ID NO: 93134 - protein, 9 aa, Homo sapiens
  Native (MAGC1_HUMAN)
SPPRYEFLW

SEQ ID NO: 93135 - protein, 10 aa, Homo sapiens
  Native (MAGC1_HUMAN)
SERTQSTFEG

SEQ ID NO: 93136 - protein, 9 aa, Homo sapiens
  Native (MAGC1_HUMAN)
NRLLILILS

SEQ ID NO: 93137 - protein, 8 aa, Homo sapiens
  Native (MAGC1_HUMAN)
QVKQPITK

SEQ ID NO: 93138 - protein, 8 aa, Homo sapiens
  Native (MAGC1_HUMAN)
SPSSSSTL

SEQ ID NO: 93139 - protein, 10 aa, Homo sapiens
  Native (MAGC1_HUMAN)
LQRPVSSFFS

SEQ ID NO: 93140 - protein, 11 aa, Homo sapiens
  Native (MAGC1_HUMAN)
YTGYFPVIFRK

SEQ ID NO: 93141 - protein, 10 aa, Homo sapiens
  Native (MAGC1_HUMAN)
YTGYFPVIFR

SEQ ID NO: 93142 - protein, 10 aa, Homo sapiens
  Native (MAGC1_HUMAN)
TDDSTATESA

SEQ ID NO: 93143 - protein, 9 aa, Homo sapiens
  Native (MAGC1_HUMAN)
SPPEGPVQS

SEQ ID NO: 93144 - protein, 11 aa, Homo sapiens
  Native (MAGC1_HUMAN)
TESASSSVMSP

SEQ ID NO: 93145 - protein, 10 aa, Homo sapiens
  Native (MAGC1_HUMAN)
HSPQSPPEGM

SEQ ID NO: 93146 - protein, 11 aa, Homo sapiens
  Native (MAGC1_HUMAN)
SLFQSSPERTH

SEQ ID NO: 93147 - protein, 11 aa, Homo sapiens
  Native (MAGC1_HUMAN)
ESPLQSPVISF

SEQ ID NO: 93148 - protein, 11 aa, Homo sapiens
  Native (MAGC1_HUMAN)
EEFQSSLQSPV

SEQ ID NO: 93149 - protein, 8 aa, Homo sapiens
  Native (MAGC1_HUMAN)
IPVSPSSS

SEQ ID NO: 93150 - protein, 8 aa, Homo sapiens
  Native (MAGC1_HUMAN)
SSYKDALK

SEQ ID NO: 93151 - protein, 9 aa, Homo sapiens
  Native (MAGC1_HUMAN)
LQIPVSPSS

SEQ ID NO: 93152 - protein, 11 aa, Homo sapiens
  Native (MAGC1_HUMAN)
STATESASSSV

SEQ ID NO: 93153 - protein, 10 aa, Homo sapiens
  Native (MAGC1_HUMAN)
GEDFQSSLQS

SEQ ID NO: 93154 - protein, 8 aa, Homo sapiens
  Native (MAGC1_HUMAN)
SRSFSSTL

SEQ ID NO: 93155 - protein, 10 aa, Homo sapiens
  Native (MAGC1_HUMAN)
QSSPESDDTL

SEQ ID NO: 93156 - protein, 9 aa, Homo sapiens
  Native (MAGC1_HUMAN)
CTQSTFEGF

SEQ ID NO: 93157 - protein, 9 aa, Homo sapiens
  Native (MAGC1_HUMAN)
YQVKQPITK

SEQ ID NO: 93158 - protein, 10 aa, Homo sapiens
  Native (MAGC1_HUMAN)
MSPLYFPQSP

SEQ ID NO: 93159 - protein, 10 aa, Homo sapiens
  Native (MAGC1_HUMAN)
MHSQSPLQSP

SEQ ID NO: 93160 - protein, 9 aa, Homo sapiens
  Native (MAGC1_HUMAN)
LDLTSEGCL

SEQ ID NO: 93161 - protein, 9 aa, Homo sapiens
  Native (MAGC1_HUMAN)
ASSSVMSPS

SEQ ID NO: 93162 - protein, 8 aa, Homo sapiens
  Native (MAGC1_HUMAN)
SSSTLVSI

SEQ ID NO: 93163 - protein, 10 aa, Homo sapiens
  Native (MAGC1_HUMAN)
LSIFQSSPER

SEQ ID NO: 93164 - protein, 9 aa, Homo sapiens
  Native (MAGC1_HUMAN)
TTDDSTATE

SEQ ID NO: 93165 - protein, 9 aa, Homo sapiens
  Native (MAGC1_HUMAN)
EDSLSPLHF

SEQ ID NO: 93166 - protein, 10 aa, Homo sapiens
  Native (MAGC1_HUMAN)
SFPSSTSSSL

SEQ ID NO: 93167 - protein, 8 aa, Homo sapiens
  Native (MAGC1_HUMAN)
SSTLVSLF

SEQ ID NO: 93168 - protein, 10 aa, Homo sapiens
  Native (MAGC1_HUMAN)
YREVPNSSPP

SEQ ID NO: 93169 - protein, 10 aa, Homo sapiens
  Native (MAGC1_HUMAN)
SPLQIPQSPL

SEQ ID NO: 93170 - protein, 11 aa, Homo sapiens
  Native (MAGC1_HUMAN)
SPFEGFPQSPL

SEQ ID NO: 93171 - protein, 10 aa, Homo sapiens
  Native (MAGC1_HUMAN)
PSFSSTLLSL

SEQ ID NO: 93172 - protein, 11 aa, Homo sapiens
  Native (MAGC1_HUMAN)
GFAQSPLQIPV

SEQ ID NO: 93173 - protein, 10 aa, Homo sapiens
  Native (MAGC1_HUMAN)
IPVSRSFSST

SEQ ID NO: 93174 - protein, 9 aa, Homo sapiens
  Native (MAGC1_HUMAN)
GFAQSPLQI

SEQ ID NO: 93175 - protein, 11 aa, Homo sapiens
  Native (MAGC1_HUMAN)
AIIDTTDDSTA

SEQ ID NO: 93176 - protein, 11 aa, Homo sapiens
  Native (MAGC1_HUMAN)
GEDSMSPLYFP

SEQ ID NO: 93177 - protein, 8 aa, Homo sapiens
  Native (MAGC1_HUMAN)
PSSTSSSL

SEQ ID NO: 93178 - protein, 9 aa, Homo sapiens
  Native (MAGC1_HUMAN)
GPAQSPLQS

SEQ ID NO: 93179 - protein, 11 aa, Homo sapiens
  Native (MAGC1_HUMAN)
SSFSSTLLSIF

SEQ ID NO: 93180 - protein, 9 aa, Homo sapiens
  Native (MAGC1_HUMAN)
REFIEILFG

SEQ ID NO: 93181 - protein, 9 aa, Homo sapiens
  Native (MAGC1_HUMAN)
EDSSDPLQR

SEQ ID NO: 93182 - protein, 8 aa, Homo sapiens
  Native (MAGC1_HUMAN)
GEEFQSSL

SEQ ID NO: 93183 - protein, 11 aa, Homo sapiens
  Native (MAGC1_HUMAN)
LLQIPMTSSFS

SEQ ID NO: 93184 - protein, 11 aa, Homo sapiens
  Native (MAGC1_HUMAN)
SLSKSSPESPL

SEQ ID NO: 93185 - protein, 8 aa, Homo sapiens
  Native (MAGC1_HUMAN)
SYTLLSLF

SEQ ID NO: 93186 - protein, 11 aa, Homo sapiens
  Native (MAGC1_HUMAN)
QSFSERTQSTF

SEQ ID NO: 93187 - protein, 11 aa, Homo sapiens
  Native (MAGC1_HUMAN)
RKVVEFLAMLK

SEQ ID NO: 93188 - protein, 9 aa, Homo sapiens
  Native (MAGC1_HUMAN)
ILQSSPESA

SEQ ID NO: 93189 - protein, 8 aa, Homo sapiens
  Native (MAGC1_HUMAN)
MPTAGMPS

SEQ ID NO: 93190 - protein, 11 aa, Homo sapiens
  Native (MAGC1_HUMAN)
EWEDSLSPHYF

SEQ ID NO: 93191 - protein, 10 aa, Homo sapiens
  Native (MAGC1_HUMAN)
LQIPGSPSFS

SEQ ID NO: 93192 - protein, 11 aa, Homo sapiens
  Native (MAGC1_HUMAN)
GFAQSSLQIPV

SEQ ID NO: 93193 - protein, 10 aa, Homo sapiens
  Native (MAGC1_HUMAN)
EESSSPVDEY

SEQ ID NO: 93194 - protein, 11 aa, Homo sapiens
  Native (MAGC1_HUMAN)
ESDSLTDSESL

SEQ ID NO: 93195 - protein, 9 aa, Homo sapiens
  Native (MAGC1_HUMAN)
IFQSSPESA

SEQ ID NO: 93196 - protein, 9 aa, Homo sapiens
  Native (MAGC1_HUMAN)
PLQSPVISF

SEQ ID NO: 93197 - protein, 8 aa, Homo sapiens
  Native (MAGC1_HUMAN)
DPDDSYVF

SEQ ID NO: 93198 - protein, 8 aa, Homo sapiens
  Native (MAGC1_HUMAN)
SSSFSYTL

SEQ ID NO: 93199 - protein, 11 aa, Homo sapiens
  Native (MAGC1_HUMAN)
QSSPESAQSAF

SEQ ID NO: 93200 - protein, 8 aa, Homo sapiens
  Native (MAGC1_HUMAN)
SSPPRYEF

SEQ ID NO: 93201 - protein, 9 aa, Homo sapiens
  Native (MAGC1_HUMAN)
SPPEGPAQS

SEQ ID NO: 93202 - protein, 10 aa, Homo sapiens
  Native (MAGC1_HUMAN)
SSSSTLLSLF

SEQ ID NO: 93203 - protein, 9 aa, Homo sapiens
  Native (MAGC1_HUMAN)
KVDELARFL

SEQ ID NO: 93204 - protein, 10 aa, Homo sapiens
  Native (MAGC1_HUMAN)
GMSQNRLLIL

SEQ ID NO: 93205 - protein, 9 aa, Homo sapiens
  Native (MAGC1_HUMAN)
SESLIESEP

SEQ ID NO: 93206 - protein, 11 aa, Homo sapiens
  Native (MAGC1_HUMAN)
QSSPECTQSTF

SEQ ID NO: 93207 - protein, 9 aa, Homo sapiens
  Native (MAGC1_HUMAN)
PFEGFPQSV

SEQ ID NO: 93208 - protein, 11 aa, Homo sapiens
  Native (MAGC1_HUMAN)
IPVSSSSSSTL

SEQ ID NO: 93209 - protein, 10 aa, Homo sapiens
  Native (MAGC1_HUMAN)
SSFSSTLLSI

SEQ ID NO: 93210 - protein, 9 aa, Homo sapiens
  Native (MAGC1_HUMAN)
SASSSVMSP

SEQ ID NO: 93211 - protein, 10 aa, Homo sapiens
  Native (MAGC1_HUMAN)
GEDSMSPLYF

SEQ ID NO: 93212 - protein, 11 aa, Homo sapiens
  Native (MAGC1_HUMAN)
SLHFPQSPPEW

SEQ ID NO: 93213 - protein, 11 aa, Homo sapiens
  Native (MAGC1_HUMAN)
SPPQGEDSMSP

SEQ ID NO: 93214 - protein, 11 aa, Homo sapiens
  Native (MAGC1_HUMAN)
SQSSPEGKDSL

SEQ ID NO: 93215 - protein, 11 aa, Homo sapiens
  Native (MAGC1_HUMAN)
DEQGMSQNRLL

SEQ ID NO: 93216 - protein, 8 aa, Homo sapiens
  Native (MAGC1_HUMAN)
FGISLREV

SEQ ID NO: 93217 - protein, 10 aa, Homo sapiens
  Native (MAGC1_HUMAN)
VSICSSSTSL

SEQ ID NO: 93218 - protein, 10 aa, Homo sapiens
  Native (MAGC1_HUMAN)
ISRYTGYFPV

SEQ ID NO: 93219 - protein, 9 aa, Homo sapiens
  Native (MAGC1_HUMAN)
SPESTQSPF

SEQ ID NO: 93220 - protein, 10 aa, Homo sapiens
  Native (MAGC1_HUMAN)
PEWEDSLSPL

SEQ ID NO: 93221 - protein, 8 aa, Homo sapiens
  Native (MAGC1_HUMAN)
SPLQGEEF

SEQ ID NO: 93222 - protein, 8 aa, Homo sapiens
  Native (MAGC1_HUMAN)
MPSLLQSS

SEQ ID NO: 93223 - protein, 10 aa, Homo sapiens
  Native (MAGC1_HUMAN)
FFSSALLSIF

SEQ ID NO: 93224 - protein, 9 aa, Homo sapiens
  Native (MAGC1_HUMAN)
GTYASEEVI

SEQ ID NO: 93225 - protein, 9 aa, Homo sapiens
  Native (MAGC1_HUMAN)
SGIGVRAGR

SEQ ID NO: 93226 - protein, 11 aa, Homo sapiens
  Native (MAGC1_HUMAN)
GPAQSPLQRPV

SEQ ID NO: 93227 - protein, 8 aa, Homo sapiens
  Native (MAGC1_HUMAN)
LDEKVDEL

SEQ ID NO: 93228 - protein, 9 aa, Homo sapiens
  Native (MAGC1_HUMAN)
SPLQIPMTS

SEQ ID NO: 93229 - protein, 9 aa, Homo sapiens
  Native (MAGC1_HUMAN)
LQIPGSPSF

SEQ ID NO: 93230 - protein, 11 aa, Homo sapiens
  Native (MAGC1_HUMAN)
ITFPSSYKDAL

SEQ ID NO: 93231 - protein, 9 aa, Homo sapiens
  Native (MAGC1_HUMAN)
SSSTSLSPF

SEQ ID NO: 93232 - protein, 11 aa, Homo sapiens
  Native (MAGC1_HUMAN)
TTDDSTATESA

SEQ ID NO: 93233 - protein, 10 aa, Homo sapiens
  Native (MAGC1_HUMAN)
PSSTSSSLSK

SEQ ID NO: 93234 - protein, 9 aa, Homo sapiens
  Native (MAGC1_HUMAN)
THSPLQIVP

SEQ ID NO: 93235 - protein, 9 aa, Homo sapiens
  Native (MAGC1_HUMAN)
FSSTLLSIF

SEQ ID NO: 93236 - protein, 10 aa, Homo sapiens
  Native (MAGC1_HUMAN)
EFLAMLKNTV

SEQ ID NO: 93237 - protein, 9 aa, Homo sapiens
  Native (MAGC1_HUMAN)
EMLTNVISR

SEQ ID NO: 93238 - protein, 10 aa, Homo sapiens
  Native (MAGC1_HUMAN)
IPMTSSFSST

SEQ ID NO: 93239 - protein, 11 aa, Homo sapiens
  Native (MAGC1_HUMAN)
SPESPLQSPVI

SEQ ID NO: 93240 - protein, 10 aa, Homo sapiens
  Native (MAGC1_HUMAN)
ESTQSPFEGF

SEQ ID NO: 93241 - protein, 11 aa, Homo sapiens
  Native (MAGC1_HUMAN)
ILFGISLREVD

SEQ ID NO: 93242 - protein, 9 aa, Homo sapiens
  Native (MAGC1_HUMAN)
SSSVMSPSF

SEQ ID NO: 93243 - protein, 9 aa, Homo sapiens
  Native (MAGC1_HUMAN)
AGREHFAFG

SEQ ID NO: 93244 - protein, 10 aa, Homo sapiens
  Native (MAGC1_HUMAN)
QRPVSSFFSY

SEQ ID NO: 93245 - protein, 11 aa, Homo sapiens
  Native (MAGC1_HUMAN)
GEDFQSSLQSP

SEQ ID NO: 93246 - protein, 11 aa, Homo sapiens
  Native (MAGC1_HUMAN)
LPQSFPESSQS

SEQ ID NO: 93247 - protein, 8 aa, Homo sapiens
  Native (MAGC1_HUMAN)
VRAGREHF

SEQ ID NO: 93248 - protein, 10 aa, Homo sapiens
  Native (MAGC1_HUMAN)
FAQSPLQIPV

SEQ ID NO: 93249 - protein, 9 aa, Homo sapiens
  Native (MAGC1_HUMAN)
LQSPVISFS

SEQ ID NO: 93250 - protein, 9 aa, Homo sapiens
  Native (MAGC1_HUMAN)
SPVISFSSS

SEQ ID NO: 93251 - protein, 8 aa, Homo sapiens
  Native (MAGC1_HUMAN)
SEPLFTYT

SEQ ID NO: 93252 - protein, 9 aa, Homo sapiens
  Native (MAGC1_HUMAN)
FQSSPERTH

SEQ ID NO: 93253 - protein, 8 aa, Homo sapiens
  Native (MAGC1_HUMAN)
SLSLPQSF

SEQ ID NO: 93254 - protein, 10 aa, Homo sapiens
  Native (MAGC1_HUMAN)
FAFGEPRELL

SEQ ID NO: 93255 - protein, 10 aa, Homo sapiens
  Native (MAGC1_HUMAN)
SPFEGFPQSP

SEQ ID NO: 93256 - protein, 9 aa, Homo sapiens
  Native (MAGC1_HUMAN)
DEQGMSQNR

SEQ ID NO: 93257 - protein, 10 aa, Homo sapiens
  Native (MAGC1_HUMAN)
SEEVIWDVLS

SEQ ID NO: 93258 - protein, 8 aa, Homo sapiens
  Native (MAGC1_HUMAN)
VLSGIGVR

SEQ ID NO: 93259 - protein, 9 aa, Homo sapiens
  Native (MAGC1_HUMAN)
YTLLSLFQS

SEQ ID NO: 93260 - protein, 10 aa, Homo sapiens
  Native (MAGC1_HUMAN)
IPVSSSSSSS

SEQ ID NO: 93261 - protein, 9 aa, Homo sapiens
  Native (MAGC1_HUMAN)
SPLQSPVIS

SEQ ID NO: 93262 - protein, 11 aa, Homo sapiens
  Native (MAGC1_HUMAN)
IPVSSSSSSST

SEQ ID NO: 93263 - protein, 8 aa, Homo sapiens
  Native (MAGC1_HUMAN)
SSSTSLSL

SEQ ID NO: 93264 - protein, 10 aa, Homo sapiens
  Native (MAGC1_HUMAN)
LQIPVSRSFS

SEQ ID NO: 93265 - protein, 11 aa, Homo sapiens
  Native (MAGC1_HUMAN)
SSSSSTLLSLF

SEQ ID NO: 93266 - protein, 9 aa, Homo sapiens
  Native (MAGC1_HUMAN)
NSSPPRYEF

SEQ ID NO: 93267 - protein, 8 aa, Homo sapiens
  Native (MAGC1_HUMAN)
LQIPQSPL

SEQ ID NO: 93268 - protein, 11 aa, Homo sapiens
  Native (MAGC1_HUMAN)
SRYTGYFPVIF

SEQ ID NO: 93269 - protein, 8 aa, Homo sapiens
  Native (MAGC1_HUMAN)
FPSSYKDA

SEQ ID NO: 93270 - protein, 9 aa, Homo sapiens
  Native (MAGC1_HUMAN)
HSEVIKRKV

SEQ ID NO: 93271 - protein, 8 aa, Homo sapiens
  Native (MAGC1_HUMAN)
PSSLPQSF

SEQ ID NO: 93272 - protein, 9 aa, Homo sapiens
  Native (MAGC1_HUMAN)
KGTYASEEV

SEQ ID NO: 93273 - protein, 10 aa, Homo sapiens
  Native (MAGC1_HUMAN)
ARFLLLKYQV

SEQ ID NO: 93274 - protein, 9 aa, Homo sapiens
  Native (MAGC1_HUMAN)
DDSTATESA

SEQ ID NO: 93275 - protein, 9 aa, Homo sapiens
  Native (MAGC1_HUMAN)
PEGEDSLSP

SEQ ID NO: 93276 - protein, 11 aa, Homo sapiens
  Native (MAGC1_HUMAN)
MSQNRLLILIL

SEQ ID NO: 93277 - protein, 8 aa, Homo sapiens
  Native (MAGC1_HUMAN)
DELARFLL

SEQ ID NO: 93278 - protein, 9 aa, Homo sapiens
  Native (MAGC1_HUMAN)
TESASSSVM

SEQ ID NO: 93279 - protein, 9 aa, Homo sapiens
  Native (MAGC1_HUMAN)
FPESSQSPP

SEQ ID NO: 93280 - protein, 9 aa, Homo sapiens
  Native (MAGC1_HUMAN)
LQIPVSSSS

SEQ ID NO: 93281 - protein, 10 aa, Homo sapiens
  Native (MAGC1_HUMAN)
YEFLWGPRAH

SEQ ID NO: 93282 - protein, 8 aa, Homo sapiens
  Native (MAGC1_HUMAN)
IESEPLFT

SEQ ID NO: 93283 - protein, 10 aa, Homo sapiens
  Native (MAGC1_HUMAN)
LQIPVSPSFS

SEQ ID NO: 93284 - protein, 8 aa, Homo sapiens
  Native (MAGC1_HUMAN)
RELLTKVW

SEQ ID NO: 93285 - protein, 9 aa, Homo sapiens
  Native (MAGC1_HUMAN)
YTLASLLQS

SEQ ID NO: 93286 - protein, 11 aa, Homo sapiens
  Native (MAGC1_HUMAN)
SEGCLSDEQGM

SEQ ID NO: 93287 - protein, 11 aa, Homo sapiens
  Native (MAGC1_HUMAN)
VIWDVLSGIGV

SEQ ID NO: 93288 - protein, 10 aa, Homo sapiens
  Native (MAGC1_HUMAN)
AFEGFPQSPL

SEQ ID NO: 93289 - protein, 10 aa, Homo sapiens
  Native (MAGC1_HUMAN)
GEDSQSPLQI

SEQ ID NO: 93290 - protein, 10 aa, Homo sapiens
  Native (MAGC1_HUMAN)
YPLQSPQSRS

SEQ ID NO: 93291 - protein, 10 aa, Homo sapiens
  Native (MAGC1_HUMAN)
NSSPPRYEFL

SEQ ID NO: 93292 - protein, 9 aa, Homo sapiens
  Native (MAGC1_HUMAN)
FEGFPQSLL

SEQ ID NO: 93293 - protein, 10 aa, Homo sapiens
  Native (MAGC1_HUMAN)
QSPPQGEDSL

SEQ ID NO: 93294 - protein, 11 aa, Homo sapiens
  Native (MAGC1_HUMAN)
FIKGTYASEEV

SEQ ID NO: 93295 - protein, 10 aa, Homo sapiens
  Native (MAGC1_HUMAN)
FSSTLVSLFQ

SEQ ID NO: 93296 - protein, 9 aa, Homo sapiens
  Native (MAGC1_HUMAN)
ESSSPVDEY

SEQ ID NO: 93297 - protein, 9 aa, Homo sapiens
  Native (MAGC1_HUMAN)
EDSLSSLHF

SEQ ID NO: 93298 - protein, 9 aa, Homo sapiens
  Native (MAGC1_HUMAN)
SSLQSPVSI

SEQ ID NO: 93299 - protein, 9 aa, Homo sapiens
  Native (MAGC1_HUMAN)
WEDSLSPHY

SEQ ID NO: 93300 - protein, 10 aa, Homo sapiens
  Native (MAGC1_HUMAN)
FPSSYKDALK

SEQ ID NO: 93301 - protein, 9 aa, Homo sapiens
  Native (MAGC1_HUMAN)
MLKNTVPIT

SEQ ID NO: 93302 - protein, 10 aa, Homo sapiens
  Native (MAGC1_HUMAN)
TVPITFPSSY

SEQ ID NO: 93303 - protein, 10 aa, Homo sapiens
  Native (MAGC1_HUMAN)
YTLDEKVDEL

SEQ ID NO: 93304 - protein, 9 aa, Homo sapiens
  Native (MAGC1_HUMAN)
EGEDSLSPL

SEQ ID NO: 93305 - protein, 11 aa, Homo sapiens
  Native (MAGC1_HUMAN)
KVWVQEHYLEY

SEQ ID NO: 93306 - protein, 9 aa, Homo sapiens
  Native (MAGC1_HUMAN)
FLLLKYQVK

SEQ ID NO: 93307 - protein, 11 aa, Homo sapiens
  Native (MAGC1_HUMAN)
ARFLLLKYQVK

SEQ ID NO: 93308 - protein, 10 aa, Homo sapiens
  Native (MAGC1_HUMAN)
LHFPQSPPEW

SEQ ID NO: 93309 - protein, 11 aa, Homo sapiens
  Native (MAGC1_HUMAN)
IWDVLSGIGVR

SEQ ID NO: 93310 - protein, 10 aa, Homo sapiens
  Native (MAGC1_HUMAN)
SPSFSSTLVS

SEQ ID NO: 93311 - protein, 10 aa, Homo sapiens
  Native (MAGC1_HUMAN)
VWVQEHYLEY

SEQ ID NO: 93312 - protein, 9 aa, Homo sapiens
  Native (MAGC1_HUMAN)
IPVSPSSSS

SEQ ID NO: 93313 - protein, 9 aa, Homo sapiens
  Native (MAGC1_HUMAN)
RAGREHFAF

SEQ ID NO: 93314 - protein, 8 aa, Homo sapiens
  Native (MAGC1_HUMAN)
EGFPQSVL

SEQ ID NO: 93315 - protein, 9 aa, Homo sapiens
  Native (MAGC1_HUMAN)
ISRYTGYFP

SEQ ID NO: 93316 - protein, 8 aa, Homo sapiens
  Native (MAGC1_HUMAN)
SQNRLLIL

SEQ ID NO: 93317 - protein, 8 aa, Homo sapiens
  Native (MAGC1_HUMAN)
SERTQSTF

SEQ ID NO: 93318 - protein, 11 aa, Homo sapiens
  Native (MAGC1_HUMAN)
GEDSLSSLHFP

SEQ ID NO: 93319 - protein, 11 aa, Homo sapiens
  Native (MAGC1_HUMAN)
QSPLQRPVSSF

SEQ ID NO: 93320 - protein, 10 aa, Homo sapiens
  Native (MAGC1_HUMAN)
SFSERTQSTF

SEQ ID NO: 93321 - protein, 8 aa, Homo sapiens
  Native (MAGC1_HUMAN)
SFSSSTSL

SEQ ID NO: 93322 - protein, 9 aa, Homo sapiens
  Native (MAGC1_HUMAN)
VQEHYLEYR

SEQ ID NO: 93323 - protein, 10 aa, Homo sapiens
  Native (MAGC1_HUMAN)
YTLASLLQSS

SEQ ID NO: 93324 - protein, 11 aa, Homo sapiens
  Native (MAGC1_HUMAN)
SSFFSSALLSI

SEQ ID NO: 93325 - protein, 11 aa, Homo sapiens
  Native (MAGC1_HUMAN)
FRKAREFIEIL

SEQ ID NO: 93326 - protein, 11 aa, Homo sapiens
  Native (MAGC1_HUMAN)
FQSSLQSPVSI

SEQ ID NO: 93327 - protein, 8 aa, Homo sapiens
  Native (MAGC1_HUMAN)
FEGFPQSP

SEQ ID NO: 93328 - protein, 8 aa, Homo sapiens
  Native (MAGC1_HUMAN)
EVDPDDSY

SEQ ID NO: 93329 - protein, 10 aa, Homo sapiens
  Native (MAGC1_HUMAN)
LTKVWVQEHY

SEQ ID NO: 93330 - protein, 10 aa, Homo sapiens
  Native (MAGC1_HUMAN)
ESLIESEPLF

SEQ ID NO: 93331 - protein, 11 aa, Homo sapiens
  Native (MAGC1_HUMAN)
NPASSFFSSAL

SEQ ID NO: 93332 - protein, 10 aa, Homo sapiens
  Native (MAGC1_HUMAN)
FSSSTSLSPF

SEQ ID NO: 93333 - protein, 11 aa, Homo sapiens
  Native (MAGC1_HUMAN)
LWGPRAHSEVI

SEQ ID NO: 93334 - protein, 9 aa, Homo sapiens
  Native (MAGC1_HUMAN)
RELLTKVWV

SEQ ID NO: 93335 - protein, 8 aa, Homo sapiens
  Native (MAGC1_HUMAN)
AREFIEIL

SEQ ID NO: 93336 - protein, 8 aa, Homo sapiens
  Native (MAGC1_HUMAN)
MLTNVISR

SEQ ID NO: 93337 - protein, 11 aa, Homo sapiens
  Native (MAGC1_HUMAN)
LLSIFQSSPER

SEQ ID NO: 93338 - protein, 9 aa, Homo sapiens
  Native (MAGC1_HUMAN)
GFPQSLLQI

SEQ ID NO: 93339 - protein, 9 aa, Homo sapiens
  Native (MAGC1_HUMAN)
EEVIWDVLS

SEQ ID NO: 93340 - protein, 8 aa, Homo sapiens
  Native (MAGC1_HUMAN)
SPLQSPVS

SEQ ID NO: 93341 - protein, 10 aa, Homo sapiens
  Native (MAGC1_HUMAN)
IPVSAASSST

SEQ ID NO: 93342 - protein, 10 aa, Homo sapiens
  Native (MAGC1_HUMAN)
PQSPLQGEEF

SEQ ID NO: 93343 - protein, 10 aa, Homo sapiens
  Native (MAGC1_HUMAN)
SPLQIPQSSP

SEQ ID NO: 93344 - protein, 8 aa, Homo sapiens
  Native (MAGC1_HUMAN)
FLLLKYQV

SEQ ID NO: 93345 - protein, 10 aa, Homo sapiens
  Native (MAGC1_HUMAN)
AHSEVIKRKV

SEQ ID NO: 93346 - protein, 9 aa, Homo sapiens
  Native (MAGC1_HUMAN)
AFGEPRELL

SEQ ID NO: 93347 - protein, 9 aa, Homo sapiens
  Native (MAGC1_HUMAN)
PQSPLQIPM

SEQ ID NO: 93348 - protein, 11 aa, Homo sapiens
  Native (MAGC1_HUMAN)
SPPEGMHSQSP

SEQ ID NO: 93349 - protein, 9 aa, Homo sapiens
  Native (MAGC1_HUMAN)
SPSFSSTLL

SEQ ID NO: 93350 - protein, 9 aa, Homo sapiens
  Native (MAGC1_HUMAN)
GEDSQSPLQ

SEQ ID NO: 93351 - protein, 10 aa, Homo sapiens
  Native (MAGC1_HUMAN)
IWDVLSGIGV

SEQ ID NO: 93352 - protein, 10 aa, Homo sapiens
  Native (MAGC1_HUMAN)
RSFSSTLLSI

SEQ ID NO: 93353 - protein, 11 aa, Homo sapiens
  Native (MAGC1_HUMAN)
PEWEDSLSPHY

SEQ ID NO: 93354 - protein, 8 aa, Homo sapiens
  Native (MAGC1_HUMAN)
LPQSFPES

SEQ ID NO: 93355 - protein, 8 aa, Homo sapiens
  Native (MAGC1_HUMAN)
GEDFQSSL

SEQ ID NO: 93356 - protein, 10 aa, Homo sapiens
  Native (MAGC1_HUMAN)
REFIEILFGI

SEQ ID NO: 93357 - protein, 10 aa, Homo sapiens
  Native (MAGC1_HUMAN)
GEDSLSSLHF

SEQ ID NO: 93358 - protein, 11 aa, Homo sapiens
  Native (MAGC1_HUMAN)
PSSSSTLLSLF

SEQ ID NO: 93359 - protein, 9 aa, Homo sapiens
  Native (MAGC1_HUMAN)
SPQSPPEGM

SEQ ID NO: 93360 - protein, 11 aa, Homo sapiens
  Native (MAGC1_HUMAN)
SLLQIPMTSSF

SEQ ID NO: 93361 - protein, 10 aa, Homo sapiens
  Native (MAGC1_HUMAN)
SPLQIPMTSS

SEQ ID NO: 93362 - protein, 10 aa, Homo sapiens
  Native (MAGC1_HUMAN)
SSPESDDTLY

SEQ ID NO: 93363 - protein, 9 aa, Homo sapiens
  Native (MAGC1_HUMAN)
SPESPLQSP

SEQ ID NO: 93364 - protein, 10 aa, Homo sapiens
  Native (MAGC1_HUMAN)
SSSSSTLLSL

SEQ ID NO: 93365 - protein, 9 aa, Homo sapiens
  Native (MAGC1_HUMAN)
VIWDVLSGI

SEQ ID NO: 93366 - protein, 9 aa, Homo sapiens
  Native (MAGC1_HUMAN)
LEYREVPNS

SEQ ID NO: 93367 - protein, 9 aa, Homo sapiens
  Native (MAGC1_HUMAN)
GPAQSPLQR

SEQ ID NO: 93368 - protein, 9 aa, Homo sapiens
  Native (MAGC1_HUMAN)
FPQSPPQGE

SEQ ID NO: 93369 - protein, 9 aa, Homo sapiens
  Native (MAGC1_HUMAN)
SSPESDDTL

SEQ ID NO: 93370 - protein, 8 aa, Homo sapiens
  Native (MAGC1_HUMAN)
VDELARFL

SEQ ID NO: 93371 - protein, 10 aa, Homo sapiens
  Native (MAGC1_HUMAN)
FFSYTLASLL

SEQ ID NO: 93372 - protein, 8 aa, Homo sapiens
  Native (MAGC1_HUMAN)
AEMLTNVI

SEQ ID NO: 93373 - protein, 11 aa, Homo sapiens
  Native (MAGC1_HUMAN)
MGDKDMPTAGM

SEQ ID NO: 93374 - protein, 8 aa, Homo sapiens
  Native (MAGC1_HUMAN)
STSSSLSK

SEQ ID NO: 93375 - protein, 9 aa, Homo sapiens
  Native (MAGC1_HUMAN)
QSPLQGEEF

SEQ ID NO: 93376 - protein, 9 aa, Homo sapiens
  Native (MAGC1_HUMAN)
SQSPPEGPV

SEQ ID NO: 93377 - protein, 10 aa, Homo sapiens
  Native (MAGC1_HUMAN)
LQIPMTSSFS

SEQ ID NO: 93378 - protein, 11 aa, Homo sapiens
  Native (MAGC1_HUMAN)
TSSFSSTLLSI

SEQ ID NO: 93379 - protein, 8 aa, Homo sapiens
  Native (MAGC1_HUMAN)
SSFSYTLL

SEQ ID NO: 93380 - protein, 11 aa, Homo sapiens
  Native (MAGC1_HUMAN)
SPEGDDTQSPL

SEQ ID NO: 93381 - protein, 11 aa, Homo sapiens
  Native (MAGC1_HUMAN)
TATESASSSVM

SEQ ID NO: 93382 - protein, 9 aa, Homo sapiens
  Native (MAGC1_HUMAN)
MSQNRLLIL

SEQ ID NO: 93383 - protein, 8 aa, Homo sapiens
  Native (MAGC1_HUMAN)
GEDSLSSL

SEQ ID NO: 93384 - protein, 11 aa, Homo sapiens
  Native (MAGC1_HUMAN)
SPLQIPQSPLE

SEQ ID NO: 93385 - protein, 10 aa, Homo sapiens
  Native (MAGC1_HUMAN)
SPSSSSTLLS

SEQ ID NO: 93386 - protein, 10 aa, Homo sapiens
  Native (MAGC1_HUMAN)
ICSSSTPSSL

SEQ ID NO: 93387 - protein, 11 aa, Homo sapiens
  Native (MAGC1_HUMAN)
THSPLQIVPSL

SEQ ID NO: 93388 - protein, 10 aa, Homo sapiens
  Native (MAGC1_HUMAN)
SESPQSCPEG

SEQ ID NO: 93389 - protein, 10 aa, Homo sapiens
  Native (MAGC1_HUMAN)
RYTGYFPVIF

SEQ ID NO: 93390 - protein, 9 aa, Homo sapiens
  Native (MAGC1_HUMAN)
SPESDDTLY

SEQ ID NO: 93391 - protein, 9 aa, Homo sapiens
  Native (MAGC1_HUMAN)
NTVPITFPS

SEQ ID NO: 93392 - protein, 10 aa, Homo sapiens
  Native (MAGC1_HUMAN)
SRYTGYFPVI

SEQ ID NO: 93393 - protein, 11 aa, Homo sapiens
  Native (MAGC1_HUMAN)
HSPQSPPEGMH

SEQ ID NO: 93394 - protein, 11 aa, Homo sapiens
  Native (MAGC1_HUMAN)
GPAQSPLQSPV

SEQ ID NO: 93395 - protein, 8 aa, Homo sapiens
  Native (MAGC1_HUMAN)
HSEVIKRK

SEQ ID NO: 93396 - protein, 11 aa, Homo sapiens
  Native (MAGC1_HUMAN)
VDELARFLLLK

SEQ ID NO: 93397 - protein, 11 aa, Homo sapiens
  Native (MAGC1_HUMAN)
FPQSPLQIPVS

SEQ ID NO: 93398 - protein, 10 aa, Homo sapiens
  Native (MAGC1_HUMAN)
SPLQNSQSSP

SEQ ID NO: 93399 - protein, 11 aa, Homo sapiens
  Native (MAGC1_HUMAN)
SEESSSPVDEY

SEQ ID NO: 93400 - protein, 11 aa, Homo sapiens
  Native (MAGC1_HUMAN)
VPSLPEWEDSL

SEQ ID NO: 93401 - protein, 9 aa, Homo sapiens
  Native (MAGC1_HUMAN)
MPSLLQSSS

SEQ ID NO: 93402 - protein, 8 aa, Homo sapiens
  Native (MAGC1_HUMAN)
SEVIKRKV

SEQ ID NO: 93403 - protein, 11 aa, Homo sapiens
  Native (MAGC1_HUMAN)
IKRKVVEFLAM

SEQ ID NO: 93404 - protein, 8 aa, Homo sapiens
  Native (MAGC1_HUMAN)
SSSSSSTL

SEQ ID NO: 93405 - protein, 11 aa, Homo sapiens
  Native (MAGC1_HUMAN)
SDEQGMSQNRL

SEQ ID NO: 93406 - protein, 10 aa, Homo sapiens
  Native (MAGC1_HUMAN)
SPHYFPQSPP

SEQ ID NO: 93407 - protein, 11 aa, Homo sapiens
  Native (MAGC1_HUMAN)
SPFSEESSSPV

SEQ ID NO: 93408 - protein, 10 aa, Homo sapiens
  Native (MAGC1_HUMAN)
PLFTYTLDEK

SEQ ID NO: 93409 - protein, 10 aa, Homo sapiens
  Native (MAGC1_HUMAN)
VDELARFLLL

SEQ ID NO: 93410 - protein, 10 aa, Homo sapiens
  Native (MAGC1_HUMAN)
IPVSPSSSST

SEQ ID NO: 93411 - protein, 9 aa, Homo sapiens
  Native (MAGC1_HUMAN)
TLLSIFQSS

SEQ ID NO: 93412 - protein, 9 aa, Homo sapiens
  Native (MAGC1_HUMAN)
SFSYTLLSL

SEQ ID NO: 93413 - protein, 10 aa, Homo sapiens
  Native (MAGC1_HUMAN)
ERTQSTFEGF

SEQ ID NO: 93414 - protein, 9 aa, Homo sapiens
  Native (MAGC1_HUMAN)
EGDDTQSPL

SEQ ID NO: 93415 - protein, 11 aa, Homo sapiens
  Native (MAGC1_HUMAN)
SPSFSSTLLSL

SEQ ID NO: 93416 - protein, 10 aa, Homo sapiens
  Native (MAGC1_HUMAN)
SLFQSFSERT

SEQ ID NO: 93417 - protein, 10 aa, Homo sapiens
  Native (MAGC1_HUMAN)
TPSSLPQSFP

SEQ ID NO: 93418 - protein, 8 aa, Homo sapiens
  Native (MAGC1_HUMAN)
ILFGISLR

SEQ ID NO: 93419 - protein, 10 aa, Homo sapiens
  Native (MAGC1_HUMAN)
MSQNRLLILI

SEQ ID NO: 93420 - protein, 11 aa, Homo sapiens
  Native (MAGC1_HUMAN)
AREFIEILFGI

SEQ ID NO: 93421 - protein, 9 aa, Homo sapiens
  Native (MAGC1_HUMAN)
SSPESTQSP

SEQ ID NO: 93422 - protein, 11 aa, Homo sapiens
  Native (MAGC1_HUMAN)
SSTSLSLPQSF

SEQ ID NO: 93423 - protein, 10 aa, Homo sapiens
  Native (MAGC1_HUMAN)
AASSSTLVSI

SEQ ID NO: 93424 - protein, 11 aa, Homo sapiens
  Native (MAGC1_HUMAN)
LVSLFQSSPER

SEQ ID NO: 93425 - protein, 10 aa, Homo sapiens
  Native (MAGC1_HUMAN)
REHFAFGEPR

SEQ ID NO: 93426 - protein, 9 aa, Homo sapiens
  Native (MAGC1_HUMAN)
VPNSSPPRY

SEQ ID NO: 93427 - protein, 9 aa, Homo sapiens
  Native (MAGC1_HUMAN)
SLTDSESLI

SEQ ID NO: 93428 - protein, 10 aa, Homo sapiens
  Native (MAGC1_HUMAN)
EGPAQSPLQR

SEQ ID NO: 93429 - protein, 8 aa, Homo sapiens
  Native (MAGC1_HUMAN)
GYFPVIFR

SEQ ID NO: 93430 - protein, 11 aa, Homo sapiens
  Native (MAGC1_HUMAN)
FLAMLKNTVPI

SEQ ID NO: 93431 - protein, 11 aa, Homo sapiens
  Native (MAGC1_HUMAN)
LQIPMTSSFSS

SEQ ID NO: 93432 - protein, 10 aa, Homo sapiens
  Native (MAGC1_HUMAN)
SPPEGMHSQS

SEQ ID NO: 93433 - protein, 8 aa, Homo sapiens
  Native (MAGC1_HUMAN)
SFFSSALL

SEQ ID NO: 93434 - protein, 10 aa, Homo sapiens
  Native (MAGC1_HUMAN)
FPQSPLQIPQ

SEQ ID NO: 93435 - protein, 8 aa, Homo sapiens
  Native (MAGC1_HUMAN)
LQSPVSSF

SEQ ID NO: 93436 - protein, 9 aa, Homo sapiens
  Native (MAGC1_HUMAN)
FPQSPLQIP

SEQ ID NO: 93437 - protein, 9 aa, Homo sapiens
  Native (MAGC1_HUMAN)
SSFFSYTLA

SEQ ID NO: 93438 - protein, 11 aa, Homo sapiens
  Native (MAGC1_HUMAN)
VSSSSSSSTLL

SEQ ID NO: 93439 - protein, 10 aa, Homo sapiens
  Native (MAGC1_HUMAN)
SPVSSFPSST

SEQ ID NO: 93440 - protein, 10 aa, Homo sapiens
  Native (MAGC1_HUMAN)
SSPESAQSTF

SEQ ID NO: 93441 - protein, 9 aa, Homo sapiens
  Native (MAGC1_HUMAN)
SLPEWEDSL

SEQ ID NO: 93442 - protein, 10 aa, Homo sapiens
  Native (MAGC1_HUMAN)
GEDSLSPLQI

SEQ ID NO: 93443 - protein, 11 aa, Homo sapiens
  Native (MAGC1_HUMAN)
KDMPTAGMPSL

SEQ ID NO: 93444 - protein, 9 aa, Homo sapiens
  Native (MAGC1_HUMAN)
YTGYFPVIF

SEQ ID NO: 93445 - protein, 11 aa, Homo sapiens
  Native (MAGC1_HUMAN)
SPLQSPVSSFP

SEQ ID NO: 93446 - protein, 10 aa, Homo sapiens
  Native (MAGC1_HUMAN)
MPTAGMPSLL

SEQ ID NO: 93447 - protein, 9 aa, Homo sapiens
  Native (MAGC1_HUMAN)
LASLLQSSH

SEQ ID NO: 93448 - protein, 10 aa, Homo sapiens
  Native (MAGC1_HUMAN)
STSLSLPQSF

SEQ ID NO: 93449 - protein, 8 aa, Homo sapiens
  Native (MAGC1_HUMAN)
SDDTLYPL

SEQ ID NO: 93450 - protein, 11 aa, Homo sapiens
  Native (MAGC1_HUMAN)
PPQGEDSMSPL

SEQ ID NO: 93451 - protein, 11 aa, Homo sapiens
  Native (MAGC1_HUMAN)
SPPEGPAQSPL

SEQ ID NO: 93452 - protein, 9 aa, Homo sapiens
  Native (MAGC1_HUMAN)
AASSSTLVS

SEQ ID NO: 93453 - protein, 10 aa, Homo sapiens
  Native (MAGC1_HUMAN)
LEYREVPNSS

SEQ ID NO: 93454 - protein, 8 aa, Homo sapiens
  Native (MAGC1_HUMAN)
SPLEISQS

SEQ ID NO: 93455 - protein, 8 aa, Homo sapiens
  Native (MAGC1_HUMAN)
SPLQRPVS

SEQ ID NO: 93456 - protein, 11 aa, Homo sapiens
  Native (MAGC1_HUMAN)
SAFEGFPQSPL

SEQ ID NO: 93457 - protein, 8 aa, Homo sapiens
  Native (MAGC1_HUMAN)
EERAQAII

SEQ ID NO: 93458 - protein, 8 aa, Homo sapiens
  Native (MAGC1_HUMAN)
FSSTLLSI

SEQ ID NO: 93459 - protein, 9 aa, Homo sapiens
  Native (MAGC1_HUMAN)
EDSLSPHYF

SEQ ID NO: 93460 - protein, 10 aa, Homo sapiens
  Native (MAGC1_HUMAN)
VSPSFSSTLV

SEQ ID NO: 93461 - protein, 9 aa, Homo sapiens
  Native (MAGC1_HUMAN)
EKVDELARF

SEQ ID NO: 93462 - protein, 8 aa, Homo sapiens
  Native (MAGC1_HUMAN)
ITFPSSYK

SEQ ID NO: 93463 - protein, 10 aa, Homo sapiens
  Native (MAGC1_HUMAN)
SLIESEPLFT

SEQ ID NO: 93464 - protein, 11 aa, Homo sapiens
  Native (MAGC1_HUMAN)
LLSLFQSSPER

SEQ ID NO: 93465 - protein, 10 aa, Homo sapiens
  Native (MAGC1_HUMAN)
SPFSEESSSP

SEQ ID NO: 93466 - protein, 9 aa, Homo sapiens
  Native (MAGC1_HUMAN)
KDSLSPLEI

SEQ ID NO: 93467 - protein, 11 aa, Homo sapiens
  Native (MAGC1_HUMAN)
NTVPITFPSSY

SEQ ID NO: 93468 - protein, 9 aa, Homo sapiens
  Native (MAGC1_HUMAN)
SAQSAFEGF

SEQ ID NO: 93469 - protein, 9 aa, Homo sapiens
  Native (MAGC1_HUMAN)
ASEEVIWDV

SEQ ID NO: 93470 - protein, 11 aa, Homo sapiens
  Native (MAGC1_HUMAN)
SICSSSTSLSL

SEQ ID NO: 93471 - protein, 8 aa, Homo sapiens
  Native (MAGC1_HUMAN)
QRPVSSFF

SEQ ID NO: 93472 - protein, 8 aa, Homo sapiens
  Native (MAGC1_HUMAN)
FPQFPPQG

SEQ ID NO: 93473 - protein, 10 aa, Homo sapiens
  Native (MAGC1_HUMAN)
SQSPPEGEDV

SEQ ID NO: 93474 - protein, 10 aa, Homo sapiens
  Native (MAGC1_HUMAN)
SFSSTLLSIL

SEQ ID NO: 93475 - protein, 10 aa, Homo sapiens
  Native (MAGC1_HUMAN)
SPLQSPVISF

SEQ ID NO: 93476 - protein, 10 aa, Homo sapiens
  Native (MAGC1_HUMAN)
MLTNVISRYT

SEQ ID NO: 93477 - protein, 11 aa, Homo sapiens
  Native (MAGC1_HUMAN)
LTNVISRYTGY

SEQ ID NO: 93478 - protein, 9 aa, Homo sapiens
  Native (MAGC1_HUMAN)
SPVDEYTSS

SEQ ID NO: 93479 - protein, 9 aa, Homo sapiens
  Native (MAGC1_HUMAN)
SPVSICSSS

SEQ ID NO: 93480 - protein, 9 aa, Homo sapiens
  Native (MAGC1_HUMAN)
VIFRKAREF

SEQ ID NO: 93481 - protein, 10 aa, Homo sapiens
  Native (MAGC1_HUMAN)
LEGEDSLSSL

SEQ ID NO: 93482 - protein, 11 aa, Homo sapiens
  Native (MAGC1_HUMAN)
LQIPGSPSFSS

SEQ ID NO: 93483 - protein, 8 aa, Homo sapiens
  Native (MAGC1_HUMAN)
SSTLLSIF

SEQ ID NO: 93484 - protein, 9 aa, Homo sapiens
  Native (MAGC1_HUMAN)
SSPERTQST

SEQ ID NO: 93485 - protein, 11 aa, Homo sapiens
  Native (MAGC1_HUMAN)
PSFSSTLLSLF

SEQ ID NO: 93486 - protein, 11 aa, Homo sapiens
  Native (MAGC1_HUMAN)
SPVSICSSSTS

SEQ ID NO: 93487 - protein, 9 aa, Homo sapiens
  Native (MAGC1_HUMAN)
VVEFLAMLK

SEQ ID NO: 93488 - protein, 10 aa, Homo sapiens
  Native (MAGC1_HUMAN)
IESEPLFTYT

SEQ ID NO: 93489 - protein, 11 aa, Homo sapiens
  Native (MAGC1_HUMAN)
IIDTTDDSTAT

SEQ ID NO: 93490 - protein, 10 aa, Homo sapiens
  Native (MAGC1_HUMAN)
SEGCLSDEQG

SEQ ID NO: 93491 - protein, 9 aa, Homo sapiens
  Native (MAGC1_HUMAN)
SPLQNSQSS

SEQ ID NO: 93492 - protein, 10 aa, Homo sapiens
  Native (MAGC1_HUMAN)
ICSSSTSLSL

SEQ ID NO: 93493 - protein, 9 aa, Homo sapiens
  Native (MAGC1_HUMAN)
VSRSFSSTL

SEQ ID NO: 93494 - protein, 9 aa, Homo sapiens
  Native (MAGC1_HUMAN)
LPQSFPESP

SEQ ID NO: 93495 - protein, 10 aa, Homo sapiens
  Native (MAGC1_HUMAN)
EWEDSLSPHY

SEQ ID NO: 93496 - protein, 8 aa, Homo sapiens
  Native (MAGC1_HUMAN)
HESPQSPP

SEQ ID NO: 93497 - protein, 8 aa, Homo sapiens
  Native (MAGC1_HUMAN)
SSFFSSAL

SEQ ID NO: 93498 - protein, 11 aa, Homo sapiens
  Native (MAGC1_HUMAN)
IPMTSSFSSTL

SEQ ID NO: 93499 - protein, 9 aa, Homo sapiens
  Native (MAGC1_HUMAN)
EGEDSLSSL

SEQ ID NO: 93500 - protein, 11 aa, Homo sapiens
  Native (MAGC1_HUMAN)
PQSPPQGEDSL

SEQ ID NO: 93501 - protein, 11 aa, Homo sapiens
  Native (MAGC1_HUMAN)
SQSPPEGEDVQ

SEQ ID NO: 93502 - protein, 11 aa, Homo sapiens
  Native (MAGC1_HUMAN)
SSSFSYTLLSL

SEQ ID NO: 93503 - protein, 8 aa, Homo sapiens
  Native (MAGC1_HUMAN)
KAREFIEI

SEQ ID NO: 93504 - protein, 11 aa, Homo sapiens
  Native (MAGC1_HUMAN)
SPQSPPEGPAQ

SEQ ID NO: 93505 - protein, 9 aa, Homo sapiens
  Native (MAGC1_HUMAN)
VSSSSSSTL

SEQ ID NO: 93506 - protein, 11 aa, Homo sapiens
  Native (MAGC1_HUMAN)
IPQSPPEGENT

SEQ ID NO: 93507 - protein, 9 aa, Homo sapiens
  Native (MAGC1_HUMAN)
TLASLLQSS

SEQ ID NO: 93508 - protein, 10 aa, Homo sapiens
  Native (MAGC1_HUMAN)
ASSSVMSPSF

SEQ ID NO: 93509 - protein, 10 aa, Homo sapiens
  Native (MAGC1_HUMAN)
SPSFSSTLLS

SEQ ID NO: 93510 - protein, 10 aa, Homo sapiens
  Native (MAGC1_HUMAN)
LLKYQVKQPI

SEQ ID NO: 93511 - protein, 11 aa, Homo sapiens
  Native (MAGC1_HUMAN)
SDPLQRPPEGK

SEQ ID NO: 93512 - protein, 9 aa, Homo sapiens
  Native (MAGC1_HUMAN)
PEGPAQSPL

SEQ ID NO: 93513 - protein, 9 aa, Homo sapiens
  Native (MAGC1_HUMAN)
EWEDSLSPL

SEQ ID NO: 93514 - protein, 9 aa, Homo sapiens
  Native (MAGC1_HUMAN)
FSYTLLSLF

SEQ ID NO: 93515 - protein, 9 aa, Homo sapiens
  Native (MAGC1_HUMAN)
FSSTLLSLF

SEQ ID NO: 93516 - protein, 11 aa, Homo sapiens
  Native (MAGC1_HUMAN)
EERAQAIIDTT

SEQ ID NO: 93517 - protein, 8 aa, Homo sapiens
  Native (MAGC1_HUMAN)
SSSSSTLL

SEQ ID NO: 93518 - protein, 9 aa, Homo sapiens
  Native (MAGC1_HUMAN)
SEEVIWDVL

SEQ ID NO: 93519 - protein, 10 aa, Homo sapiens
  Native (MAGC1_HUMAN)
SVLQIPVSAA

SEQ ID NO: 93520 - protein, 8 aa, Homo sapiens
  Native (MAGC1_HUMAN)
FPVIFRKA

SEQ ID NO: 93521 - protein, 8 aa, Homo sapiens
  Native (MAGC1_HUMAN)
SPPEGEDV

SEQ ID NO: 93522 - protein, 11 aa, Homo sapiens
  Native (MAGC1_HUMAN)
RPPEGKDSQSP

SEQ ID NO: 93523 - protein, 10 aa, Homo sapiens
  Native (MAGC1_HUMAN)
EVIKRKVVEF

SEQ ID NO: 93524 - protein, 8 aa, Homo sapiens
  Native (MAGC1_HUMAN)
DSLSPLEI

SEQ ID NO: 93525 - protein, 9 aa, Homo sapiens
  Native (MAGC1_HUMAN)
TLLSLFQSF

SEQ ID NO: 93526 - protein, 11 aa, Homo sapiens
  Native (MAGC1_HUMAN)
GEDSQSPLQIP

SEQ ID NO: 93527 - protein, 9 aa, Homo sapiens
  Native (MAGC1_HUMAN)
FLWGPRAHS

SEQ ID NO: 93528 - protein, 11 aa, Homo sapiens
  Native (MAGC1_HUMAN)
FEGFPQSLLQI

SEQ ID NO: 93529 - protein, 8 aa, Homo sapiens
  Native (MAGC1_HUMAN)
SSVMSPSF

SEQ ID NO: 93530 - protein, 11 aa, Homo sapiens
  Native (MAGC1_HUMAN)
GEDSSDPLQRP

SEQ ID NO: 93531 - protein, 9 aa, Homo sapiens
  Native (MAGC1_HUMAN)
WGPRAHSEV

SEQ ID NO: 93532 - protein, 9 aa, Homo sapiens
  Native (MAGC1_HUMAN)
SHESPQSPP

SEQ ID NO: 93533 - protein, 10 aa, Homo sapiens
  Native (MAGC1_HUMAN)
ASSFFSSALL

SEQ ID NO: 93534 - protein, 11 aa, Homo sapiens
  Native (MAGC1_HUMAN)
SPEGKDSLSPL

SEQ ID NO: 93535 - protein, 9 aa, Homo sapiens
  Native (MAGC1_HUMAN)
FSERTQSTF

SEQ ID NO: 93536 - protein, 10 aa, Homo sapiens
  Native (MAGC1_HUMAN)
IPGSPSFSST

SEQ ID NO: 93537 - protein, 8 aa, Homo sapiens
  Native (MAGC1_HUMAN)
IFRKAREF

SEQ ID NO: 93538 - protein, 10 aa, Homo sapiens
  Native (MAGC1_HUMAN)
EFQSSLQSPV

SEQ ID NO: 93539 - protein, 9 aa, Homo sapiens
  Native (MAGC1_HUMAN)
EDSLSPLQI

SEQ ID NO: 93540 - protein, 11 aa, Homo sapiens
  Native (MAGC1_HUMAN)
QSSPERTHSTF

SEQ ID NO: 93541 - protein, 8 aa, Homo sapiens
  Native (MAGC1_HUMAN)
LAMLKNTV

SEQ ID NO: 93542 - protein, 9 aa, Homo sapiens
  Native (MAGC1_HUMAN)
KDSQSPLQI

SEQ ID NO: 93543 - protein, 10 aa, Homo sapiens
  Native (MAGC1_HUMAN)
SSFPSSTSSS

SEQ ID NO: 93544 - protein, 11 aa, Homo sapiens
  Native (MAGC1_HUMAN)
SPLYFPQSPLQ

SEQ ID NO: 93545 - protein, 10 aa, Homo sapiens
  Native (MAGC1_HUMAN)
LEISQSPPEG

SEQ ID NO: 93546 - protein, 8 aa, Homo sapiens
  Native (MAGC1_HUMAN)
GENTHSPL

SEQ ID NO: 93547 - protein, 9 aa, Homo sapiens
  Native (MAGC1_HUMAN)
IPVSSSFSY

SEQ ID NO: 93548 - protein, 9 aa, Homo sapiens
  Native (MAGC1_HUMAN)
NTHSPLQIV

SEQ ID NO: 93549 - protein, 11 aa, Homo sapiens
  Native (MAGC1_HUMAN)
AASSSTLVSIF

SEQ ID NO: 93550 - protein, 11 aa, Homo sapiens
  Native (MAGC1_HUMAN)
VDEYTSSSDTL

SEQ ID NO: 93551 - protein, 9 aa, Homo sapiens
  Native (MAGC1_HUMAN)
HESPQSPPE

SEQ ID NO: 93552 - protein, 9 aa, Homo sapiens
  Native (MAGC1_HUMAN)
VQSPLQNPA

SEQ ID NO: 93553 - protein, 9 aa, Homo sapiens
  Native (MAGC1_HUMAN)
DVEERAQAI

SEQ ID NO: 93554 - protein, 9 aa, Homo sapiens
  Native (MAGC1_HUMAN)
VLSGIGVRA

SEQ ID NO: 93555 - protein, 10 aa, Homo sapiens
  Native (MAGC1_HUMAN)
IPVSSSFSYT

SEQ ID NO: 93556 - protein, 10 aa, Homo sapiens
  Native (MAGC1_HUMAN)
ESAQSAFEGF

SEQ ID NO: 93557 - protein, 10 aa, Homo sapiens
  Native (MAGC1_HUMAN)
SLQIPVSPSF

SEQ ID NO: 93558 - protein, 8 aa, Homo sapiens
  Native (MAGC1_HUMAN)
EEVIWDVL

SEQ ID NO: 93559 - protein, 9 aa, Homo sapiens
  Native (MAGC1_HUMAN)
QGEDSMSPL

SEQ ID NO: 93560 - protein, 8 aa, Homo sapiens
  Native (MAGC1_HUMAN)
SPHYFPQS

SEQ ID NO: 93561 - protein, 11 aa, Homo sapiens
  Native (MAGC1_HUMAN)
IPVSAASSSTL

SEQ ID NO: 93562 - protein, 10 aa, Homo sapiens
  Native (MAGC1_HUMAN)
PLQIPGSPSF

SEQ ID NO: 93563 - protein, 10 aa, Homo sapiens
  Native (MAGC1_HUMAN)
YLEYREVPNS

SEQ ID NO: 93564 - protein, 11 aa, Homo sapiens
  Native (MAGC1_HUMAN)
MPSLLQSSSES

SEQ ID NO: 93565 - protein, 10 aa, Homo sapiens
  Native (MAGC1_HUMAN)
SAFEGFPQSP

SEQ ID NO: 93566 - protein, 9 aa, Homo sapiens
  Native (MAGC1_HUMAN)
TSLSLPQSF

SEQ ID NO: 93567 - protein, 9 aa, Homo sapiens
  Native (MAGC1_HUMAN)
FEGFAQSPL

SEQ ID NO: 93568 - protein, 10 aa, Homo sapiens
  Native (MAGC1_HUMAN)
MLKNTVPITF

SEQ ID NO: 93569 - protein, 8 aa, Homo sapiens
  Native (MAGC1_HUMAN)
KVDELARF

SEQ ID NO: 93570 - protein, 11 aa, Homo sapiens
  Native (MAGC1_HUMAN)
SSTPSSLPQSF

SEQ ID NO: 93571 - protein, 8 aa, Homo sapiens
  Native (MAGC1_HUMAN)
AFGEPREL

SEQ ID NO: 93572 - protein, 10 aa, Homo sapiens
  Native (MAGC1_HUMAN)
VISFSSSTSL

SEQ ID NO: 93573 - protein, 9 aa, Homo sapiens
  Native (MAGC1_HUMAN)
ARFLLLKYQ

SEQ ID NO: 93574 - protein, 11 aa, Homo sapiens
  Native (MAGC1_HUMAN)
QSPLQSPVSSF

SEQ ID NO: 93575 - protein, 8 aa, Homo sapiens
  Native (MAGC1_HUMAN)
TQSTFEGF

SEQ ID NO: 93576 - protein, 10 aa, Homo sapiens
  Native (MAGC1_HUMAN)
HSPLQIVPSL

SEQ ID NO: 93577 - protein, 9 aa, Homo sapiens
  Native (MAGC1_HUMAN)
SPLEGEDSL

SEQ ID NO: 93578 - protein, 11 aa, Homo sapiens
  Native (MAGC1_HUMAN)
FEGFAQSPLQI

SEQ ID NO: 93579 - protein, 9 aa, Homo sapiens
  Native (MAGC1_HUMAN)
ASSFFSSAL

SEQ ID NO: 93580 - protein, 9 aa, Homo sapiens
  Native (MAGC1_HUMAN)
SPLQIPGSP

SEQ ID NO: 93581 - protein, 9 aa, Homo sapiens
  Native (MAGC1_HUMAN)
SPLQIPVSP

SEQ ID NO: 93582 - protein, 10 aa, Homo sapiens
  Native (MAGC1_HUMAN)
TFEGFPQSPL

SEQ ID NO: 93583 - protein, 9 aa, Homo sapiens
  Native (MAGC1_HUMAN)
SPPEGMHSQ

SEQ ID NO: 93584 - protein, 8 aa, Homo sapiens
  Native (MAGC1_HUMAN)
FGEPRELL

SEQ ID NO: 93585 - protein, 10 aa, Homo sapiens
  Native (MAGC1_HUMAN)
LYPLQSPQSR

SEQ ID NO: 93586 - protein, 8 aa, Homo sapiens
  Native (MAGC1_HUMAN)
SPEGKDSL

SEQ ID NO: 93587 - protein, 8 aa, Homo sapiens
  Native (MAGC1_HUMAN)
SPLQNPAS

SEQ ID NO: 93588 - protein, 10 aa, Homo sapiens
  Native (MAGC1_HUMAN)
YQVKQPITKA

SEQ ID NO: 93589 - protein, 9 aa, Homo sapiens
  Native (MAGC1_HUMAN)
SLLQSSHES

SEQ ID NO: 93590 - protein, 10 aa, Homo sapiens
  Native (MAGC1_HUMAN)
SPLEISQSPP

SEQ ID NO: 93591 - protein, 10 aa, Homo sapiens
  Native (MAGC1_HUMAN)
LQNPASSFFS

SEQ ID NO: 93592 - protein, 9 aa, Homo sapiens
  Native (MAGC1_HUMAN)
SQSSPVSSF

SEQ ID NO: 93593 - protein, 9 aa, Homo sapiens
  Native (MAGC1_HUMAN)
SEVIKRKVV

SEQ ID NO: 93594 - protein, 8 aa, Homo sapiens
  Native (MAGC1_HUMAN)
GEDSSDPL

SEQ ID NO: 93595 - protein, 10 aa, Homo sapiens
  Native (MAGC1_HUMAN)
VRAGREHFAF

SEQ ID NO: 93596 - protein, 11 aa, Homo sapiens
  Native (MAGC1_HUMAN)
GVRAGREHFAF

SEQ ID NO: 93597 - protein, 8 aa, Homo sapiens
  Native (MAGC1_HUMAN)
GEDSQSPL

SEQ ID NO: 93598 - protein, 9 aa, Homo sapiens
  Native (MAGC1_HUMAN)
IKRKVVEFL

SEQ ID NO: 93599 - protein, 11 aa, Homo sapiens
  Native (MAGC1_HUMAN)
GFPQSPLQIPM

SEQ ID NO: 93600 - protein, 11 aa, Homo sapiens
  Native (MAGC1_HUMAN)
FPQSPLQIPQS

SEQ ID NO: 93601 - protein, 8 aa, Homo sapiens
  Native (MAGC1_HUMAN)
LQNPASSF

SEQ ID NO: 93602 - protein, 9 aa, Homo sapiens
  Native (MAGC1_HUMAN)
SPFEGFPQS

SEQ ID NO: 93603 - protein, 9 aa, Homo sapiens
  Native (MAGC1_HUMAN)
KAEMLTNVI

SEQ ID NO: 93604 - protein, 9 aa, Homo sapiens
  Native (MAGC1_HUMAN)
SLLQIPMTS

SEQ ID NO: 93605 - protein, 9 aa, Homo sapiens
  Native (MAGC1_HUMAN)
SPLQIPQSS

SEQ ID NO: 93606 - protein, 9 aa, Homo sapiens
  Native (MAGC1_HUMAN)
SSTSSSLSK

SEQ ID NO: 93607 - protein, 8 aa, Homo sapiens
  Native (MAGC1_HUMAN)
SEEVIWDV

SEQ ID NO: 93608 - protein, 8 aa, Homo sapiens
  Native (MAGC1_HUMAN)
VQEHYLEY

SEQ ID NO: 93609 - protein, 10 aa, Homo sapiens
  Native (MAGC1_HUMAN)
DFQSSLQSPV

SEQ ID NO: 93610 - protein, 11 aa, Homo sapiens
  Native (MAGC1_HUMAN)
SPPEGEDVQSP

SEQ ID NO: 93611 - protein, 10 aa, Homo sapiens
  Native (MAGC1_HUMAN)
NVISRYTGYF

SEQ ID NO: 93612 - protein, 9 aa, Homo sapiens
  Native (MAGC1_HUMAN)
SLPQSFPES

SEQ ID NO: 93613 - protein, 11 aa, Homo sapiens
  Native (MAGC1_HUMAN)
SPLQGEEFQSS

SEQ ID NO: 93614 - protein, 8 aa, Homo sapiens
  Native (MAGC1_HUMAN)
NTHSPLQI

SEQ ID NO: 93615 - protein, 8 aa, Homo sapiens
  Native (MAGC1_HUMAN)
TGYFPVIF

SEQ ID NO: 93616 - protein, 10 aa, Homo sapiens
  Native (MAGC1_HUMAN)
SPLQIPVSRS

SEQ ID NO: 93617 - protein, 10 aa, Homo sapiens
  Native (MAGC1_HUMAN)
KAREFIEILF

SEQ ID NO: 93618 - protein, 8 aa, Homo sapiens
  Native (MAGC1_HUMAN)
RSFSSTLL

SEQ ID NO: 93619 - protein, 8 aa, Homo sapiens
  Native (MAGC1_HUMAN)
IWDVLSGI

SEQ ID NO: 93620 - protein, 8 aa, Homo sapiens
  Native (MAGC1_HUMAN)
MLKNTVPI

SEQ ID NO: 93621 - protein, 11 aa, Homo sapiens
  Native (MAGC1_HUMAN)
SSFSYTLLSLF

SEQ ID NO: 93622 - protein, 8 aa, Homo sapiens
  Native (MAGC1_HUMAN)
FSYTLASL

SEQ ID NO: 93623 - protein, 10 aa, Homo sapiens
  Native (MAGC1_HUMAN)
QSPLQIPVSR

SEQ ID NO: 93624 - protein, 8 aa, Homo sapiens
  Native (MAGC1_HUMAN)
THSPLQIV

SEQ ID NO: 93625 - protein, 10 aa, Homo sapiens
  Native (MAGC1_HUMAN)
SPLYFPQSPL

SEQ ID NO: 93626 - protein, 9 aa, Homo sapiens
  Native (MAGC1_HUMAN)
MGDKDMPTA

SEQ ID NO: 93627 - protein, 10 aa, Homo sapiens
  Native (MAGC1_HUMAN)
ILILSIIFIK

SEQ ID NO: 93628 - protein, 10 aa, Homo sapiens
  Native (MAGC1_HUMAN)
SSPECTQSTF

SEQ ID NO: 93629 - protein, 9 aa, Homo sapiens
  Native (MAGC1_HUMAN)
QSPQGEDSL

SEQ ID NO: 93630 - protein, 9 aa, Homo sapiens
  Native (MAGC1_HUMAN)
LTKVWVQEH

SEQ ID NO: 93631 - protein, 8 aa, Homo sapiens
  Native (MAGC1_HUMAN)
AQSAFEGF

SEQ ID NO: 93632 - protein, 9 aa, Homo sapiens
  Native (MAGC1_HUMAN)
TLLESDSLT

SEQ ID NO: 93633 - protein, 10 aa, Homo sapiens
  Native (MAGC1_HUMAN)
GSPSFSSTLL

SEQ ID NO: 93634 - protein, 10 aa, Homo sapiens
  Native (MAGC1_HUMAN)
SPLQIPGSPS

SEQ ID NO: 93635 - protein, 10 aa, Homo sapiens
  Native (MAGC1_HUMAN)
GPAQSPLQRP

SEQ ID NO: 93636 - protein, 10 aa, Homo sapiens
  Native (MAGC1_HUMAN)
YTLLSLFQSS

SEQ ID NO: 93637 - protein, 9 aa, Homo sapiens
  Native (MAGC1_HUMAN)
TKAEMLTNV

SEQ ID NO: 93638 - protein, 9 aa, Homo sapiens
  Native (MAGC1_HUMAN)
SLSPHYFPQ

SEQ ID NO: 93639 - protein, 10 aa, Homo sapiens
  Native (MAGC1_HUMAN)
GENTHSPLQI

SEQ ID NO: 93640 - protein, 11 aa, Homo sapiens
  Native (MAGC1_HUMAN)
IPVSRSFSSTL

SEQ ID NO: 93641 - protein, 11 aa, Homo sapiens
  Native (MAGC1_HUMAN)
STFEGFPQSLL

SEQ ID NO: 93642 - protein, 11 aa, Homo sapiens
  Native (MAGC1_HUMAN)
RPVSSFFSYTL

SEQ ID NO: 93643 - protein, 10 aa, Homo sapiens
  Native (MAGC1_HUMAN)
EYTSSSDTLL

SEQ ID NO: 93644 - protein, 11 aa, Homo sapiens
  Native (MAGC1_HUMAN)
QGEDSMSPLYF

SEQ ID NO: 93645 - protein, 11 aa, Homo sapiens
  Native (MAGC1_HUMAN)
AFGEPRELLTK

SEQ ID NO: 93646 - protein, 9 aa, Homo sapiens
  Native (MAGC1_HUMAN)
SAQSTFEGF

SEQ ID NO: 93647 - protein, 10 aa, Homo sapiens
  Native (MAGC1_HUMAN)
SPPEGENTHS

SEQ ID NO: 93648 - protein, 9 aa, Homo sapiens
  Native (MAGC1_HUMAN)
FPQSVLQIP

SEQ ID NO: 93649 - protein, 8 aa, Homo sapiens
  Native (MAGC1_HUMAN)
KVWVQEHY

SEQ ID NO: 93650 - protein, 8 aa, Homo sapiens
  Native (MAGC1_HUMAN)
EDSLSPHY

SEQ ID NO: 93651 - protein, 9 aa, Homo sapiens
  Native (MAGC1_HUMAN)
STFEGFPQS

SEQ ID NO: 93652 - protein, 8 aa, Homo sapiens
  Native (MAGC1_HUMAN)
WEDSLSPL

SEQ ID NO: 93653 - protein, 10 aa, Homo sapiens
  Native (MAGC1_HUMAN)
QGEDSLSPHY

SEQ ID NO: 93654 - protein, 8 aa, Homo sapiens
  Native (MAGC1_HUMAN)
QIPVSSSF

SEQ ID NO: 93655 - protein, 9 aa, Homo sapiens
  Native (MAGC1_HUMAN)
IIDTTDDST

SEQ ID NO: 93656 - protein, 8 aa, Homo sapiens
  Native (MAGC1_HUMAN)
FEGFPQSL

SEQ ID NO: 93657 - protein, 10 aa, Homo sapiens
  Native (MAGC1_HUMAN)
LAMLKNTVPI

SEQ ID NO: 93658 - protein, 11 aa, Homo sapiens
  Native (MAGC1_HUMAN)
RKAREFIEILF

SEQ ID NO: 93659 - protein, 10 aa, Homo sapiens
  Native (MAGC1_HUMAN)
PLQNPASSFF

SEQ ID NO: 93660 - protein, 10 aa, Homo sapiens
  Native (MAGC1_HUMAN)
ERAQAIIDTT

SEQ ID NO: 93661 - protein, 11 aa, Homo sapiens
  Native (MAGC1_HUMAN)
SESLIESEPLF

SEQ ID NO: 93662 - protein, 11 aa, Homo sapiens
  Native (MAGC1_HUMAN)
SFFSSALLSIF

SEQ ID NO: 93663 - protein, 11 aa, Homo sapiens
  Native (MAGC1_HUMAN)
GFPQSPLQIPV

SEQ ID NO: 93664 - protein, 8 aa, Homo sapiens
  Native (MAGC1_HUMAN)
SSSPVDEY

SEQ ID NO: 93665 - protein, 11 aa, Homo sapiens
  Native (MAGC1_HUMAN)
STFEGFAQSSL

SEQ ID NO: 93666 - protein, 10 aa, Homo sapiens
  Native (MAGC1_HUMAN)
SFFSYTLASL

SEQ ID NO: 93667 - protein, 9 aa, Homo sapiens
  Native (MAGC1_HUMAN)
FEGFAQSSL

SEQ ID NO: 93668 - protein, 9 aa, Homo sapiens
  Native (MAGC1_HUMAN)
VSSFFSYTL

SEQ ID NO: 93669 - protein, 10 aa, Homo sapiens
  Native (MAGC1_HUMAN)
KVDELARFLL

SEQ ID NO: 93670 - protein, 9 aa, Homo sapiens
  Native (MAGC1_HUMAN)
PEGENTHSP

SEQ ID NO: 93671 - protein, 9 aa, Homo sapiens
  Native (MAGC1_HUMAN)
LFGISLREV

SEQ ID NO: 93672 - protein, 9 aa, Homo sapiens
  Native (MAGC1_HUMAN)
EHFAFGEPR

SEQ ID NO: 93673 - protein, 10 aa, Homo sapiens
  Native (MAGC1_HUMAN)
SIFQSSPESA

SEQ ID NO: 93674 - protein, 10 aa, Homo sapiens
  Native (MAGC1_HUMAN)
SPVSICSSST

SEQ ID NO: 93675 - protein, 10 aa, Homo sapiens
  Native (MAGC1_HUMAN)
VIKRKVVEFL

SEQ ID NO: 93676 - protein, 11 aa, Homo sapiens
  Native (MAGC1_HUMAN)
KVDELARFLLL

SEQ ID NO: 93677 - protein, 10 aa, Homo sapiens
  Native (MAGC1_HUMAN)
AMLKNTVPIT

SEQ ID NO: 93678 - protein, 9 aa, Homo sapiens
  Native (MAGC1_HUMAN)
SKSSPESPL

SEQ ID NO: 93679 - protein, 10 aa, Homo sapiens
  Native (MAGC1_HUMAN)
ATESASSSVM

SEQ ID NO: 93680 - protein, 9 aa, Homo sapiens
  Native (MAGC1_HUMAN)
GEDSLSSLH

SEQ ID NO: 93681 - protein, 11 aa, Homo sapiens
  Native (MAGC1_HUMAN)
SSLQIPVSPSF

SEQ ID NO: 93682 - protein, 11 aa, Homo sapiens
  Native (MAGC1_HUMAN)
SPLQIPGSPSF

SEQ ID NO: 93683 - protein, 10 aa, Homo sapiens
  Native (MAGC1_HUMAN)
KQPITKAEML

SEQ ID NO: 93684 - protein, 10 aa, Homo sapiens
  Native (MAGC1_HUMAN)
KDVEERAQAI

SEQ ID NO: 93685 - protein, 10 aa, Homo sapiens
  Native (MAGC1_HUMAN)
RPPEGKDSQS

SEQ ID NO: 93686 - protein, 8 aa, Homo sapiens
  Native (MAGC1_HUMAN)
QSPLQIPV

SEQ ID NO: 93687 - protein, 11 aa, Homo sapiens
  Native (MAGC1_HUMAN)
PESAPEGEDSL

SEQ ID NO: 93688 - protein, 10 aa, Homo sapiens
  Native (MAGC1_HUMAN)
LSQSSPVSSF

SEQ ID NO: 93689 - protein, 10 aa, Homo sapiens
  Native (MAGC1_HUMAN)
SSSLSQSSPV

SEQ ID NO: 93690 - protein, 9 aa, Homo sapiens
  Native (MAGC1_HUMAN)
SSFSYTLLS

SEQ ID NO: 93691 - protein, 10 aa, Homo sapiens
  Native (MAGC1_HUMAN)
KRKVVEFLAM

SEQ ID NO: 93692 - protein, 10 aa, Homo sapiens
  Native (MAGC1_HUMAN)
QNSQSSPEGK

SEQ ID NO: 93693 - protein, 10 aa, Homo sapiens
  Native (MAGC1_HUMAN)
QIPVSSSFSY

SEQ ID NO: 93694 - protein, 11 aa, Homo sapiens
  Native (MAGC1_HUMAN)
ALKDVEERAQA

SEQ ID NO: 93695 - protein, 10 aa, Homo sapiens
  Native (MAGC1_HUMAN)
RLLILILSII

SEQ ID NO: 93696 - protein, 9 aa, Homo sapiens
  Native (MAGC1_HUMAN)
SQNRLLILI

SEQ ID NO: 93697 - protein, 10 aa, Homo sapiens
  Native (MAGC1_HUMAN)
FRKAREFIEI

SEQ ID NO: 93698 - protein, 8 aa, Homo sapiens
  Native (MAGC1_HUMAN)
SPLQIPQS

SEQ ID NO: 93699 - protein, 11 aa, Homo sapiens
  Native (MAGC1_HUMAN)
SPLQRPVSSFF

SEQ ID NO: 93700 - protein, 8 aa, Homo sapiens
  Native (MAGC1_HUMAN)
DSLSPHYF

SEQ ID NO: 93701 - protein, 10 aa, Homo sapiens
  Native (MAGC1_HUMAN)
PLQIPVSSSF

SEQ ID NO: 93702 - protein, 8 aa, Homo sapiens
  Native (MAGC1_HUMAN)
SSSTPSSL

SEQ ID NO: 93703 - protein, 9 aa, Homo sapiens
  Native (MAGC1_HUMAN)
SFFSYTLAS

SEQ ID NO: 93704 - protein, 9 aa, Homo sapiens
  Native (MAGC1_HUMAN)
SPERTQSTF

SEQ ID NO: 93705 - protein, 10 aa, Homo sapiens
  Native (MAGC1_HUMAN)
GDKDMPTAGM

SEQ ID NO: 93706 - protein, 9 aa, Homo sapiens
  Native (MAGC1_HUMAN)
DPLQRPPEG

SEQ ID NO: 93707 - protein, 11 aa, Homo sapiens
  Native (MAGC1_HUMAN)
VLSGIGVRAGR

SEQ ID NO: 93708 - protein, 9 aa, Homo sapiens
  Native (MAGC1_HUMAN)
PTAGMPSLL

SEQ ID NO: 93709 - protein, 8 aa, Homo sapiens
  Native (MAGC1_HUMAN)
FSSTLLSL

SEQ ID NO: 93710 - protein, 9 aa, Homo sapiens
  Native (MAGC1_HUMAN)
AREFIEILF

SEQ ID NO: 93711 - protein, 9 aa, Homo sapiens
  Native (MAGC1_HUMAN)
ALLSIFQSS

SEQ ID NO: 93712 - protein, 9 aa, Homo sapiens
  Native (MAGC1_HUMAN)
LILSIIFIK

SEQ ID NO: 93713 - protein, 10 aa, Homo sapiens
  Native (MAGC1_HUMAN)
VSPSSSSTLL

SEQ ID NO: 93714 - protein, 10 aa, Homo sapiens
  Native (MAGC1_HUMAN)
PSFSSTLVSL

SEQ ID NO: 93715 - protein, 10 aa, Homo sapiens
  Native (MAGC1_HUMAN)
VSRSFSSTLL

SEQ ID NO: 93716 - protein, 8 aa, Homo sapiens
  Native (MAGC1_HUMAN)
GDKDMPTA

SEQ ID NO: 93717 - protein, 10 aa, Homo sapiens
  Native (MAGC1_HUMAN)
ASEEVIWDVL

SEQ ID NO: 93718 - protein, 11 aa, Homo sapiens
  Native (MAGC1_HUMAN)
IPVSPSSSSTL

SEQ ID NO: 93719 - protein, 9 aa, Homo sapiens
  Native (MAGC1_HUMAN)
SPLHFPQFP

SEQ ID NO: 93720 - protein, 8 aa, Homo sapiens
  Native (MAGC1_HUMAN)
SSTLLSIL

SEQ ID NO: 93721 - protein, 9 aa, Homo sapiens
  Native (MAGC1_HUMAN)
ESDDTLYPL

SEQ ID NO: 93722 - protein, 9 aa, Homo sapiens
  Native (MAGC1_HUMAN)
SPPEGENTH

SEQ ID NO: 93723 - protein, 8 aa, Homo sapiens
  Native (MAGC1_HUMAN)
DSLSPLQI

SEQ ID NO: 93724 - protein, 10 aa, Homo sapiens
  Native (MAGC1_HUMAN)
SIIFIKGTYA

SEQ ID NO: 93725 - protein, 11 aa, Homo sapiens
  Native (MAGC1_HUMAN)
QGEDSLSPHYF

SEQ ID NO: 93726 - protein, 10 aa, Homo sapiens
  Native (MAGC1_HUMAN)
SPLHFPQFPP

SEQ ID NO: 93727 - protein, 9 aa, Homo sapiens
  Native (MAGC1_HUMAN)
SPLQIPQSP

SEQ ID NO: 93728 - protein, 9 aa, Homo sapiens
  Native (MAGC1_HUMAN)
HFPQSPPEW

SEQ ID NO: 93729 - protein, 10 aa, Homo sapiens
  Native (MAGC1_HUMAN)
GEDSSDPLQR

SEQ ID NO: 93730 - protein, 8 aa, Homo sapiens
  Native (MAGC1_HUMAN)
EHFAFGEP

SEQ ID NO: 93731 - protein, 11 aa, Homo sapiens
  Native (MAGC1_HUMAN)
FEGFAQSSLQI

SEQ ID NO: 93732 - protein, 10 aa, Homo sapiens
  Native (MAGC1_HUMAN)
DEQGMSQNRL

SEQ ID NO: 93733 - protein, 10 aa, Homo sapiens
  Native (MAGC1_HUMAN)
IEILFGISLR

SEQ ID NO: 93734 - protein, 8 aa, Homo sapiens
  Native (MAGC1_HUMAN)
HYLEYREV

SEQ ID NO: 93735 - protein, 11 aa, Homo sapiens
  Native (MAGC1_HUMAN)
IPGSPSFSSTL

SEQ ID NO: 93736 - protein, 9 aa, Homo sapiens
  Native (MAGC1_HUMAN)
ERAQAIIDT

SEQ ID NO: 93737 - protein, 9 aa, Homo sapiens
  Native (MAGC1_HUMAN)
FEGFPQSVL

SEQ ID NO: 93738 - protein, 9 aa, Homo sapiens
  Native (MAGC1_HUMAN)
VIKRKVVEF

SEQ ID NO: 93739 - protein, 9 aa, Homo sapiens
  Native (MAGC1_HUMAN)
QVKQPITKA

SEQ ID NO: 93740 - protein, 10 aa, Homo sapiens
  Native (MAGC1_HUMAN)
FQSSLQSPVS

SEQ ID NO: 93741 - protein, 10 aa, Homo sapiens
  Native (MAGC1_HUMAN)
GEPRELLTKV

SEQ ID NO: 93742 - protein, 10 aa, Homo sapiens
  Native (MAGC1_HUMAN)
SPERTHSTFE

SEQ ID NO: 93743 - protein, 10 aa, Homo sapiens
  Native (MAGC1_HUMAN)
PPEGPAQSPL

SEQ ID NO: 93744 - protein, 9 aa, Homo sapiens
  Native (MAGC1_HUMAN)
IPGSPSFSS

SEQ ID NO: 93745 - protein, 9 aa, Homo sapiens
  Native (MAGC1_HUMAN)
SSPERTHST

SEQ ID NO: 93746 - protein, 8 aa, Homo sapiens
  Native (MAGC1_HUMAN)
SPLYFPQS

SEQ ID NO: 93747 - protein, 10 aa, Homo sapiens
  Native (MAGC1_HUMAN)
ERTHSTFEGF

SEQ ID NO: 93748 - protein, 11 aa, Homo sapiens
  Native (MAGC1_HUMAN)
MSPLYFPQSPL

SEQ ID NO: 93749 - protein, 9 aa, Homo sapiens
  Native (MAGC1_HUMAN)
STFEGFAQS

SEQ ID NO: 93750 - protein, 9 aa, Homo sapiens
  Native (MAGC1_HUMAN)
YFPVIFRKA

SEQ ID NO: 93751 - protein, 10 aa, Homo sapiens
  Native (MAGC1_HUMAN)
RAHSEVIKRK

SEQ ID NO: 93752 - protein, 9 aa, Homo sapiens
  Native (MAGC1_HUMAN)
PLQRPVSSF

SEQ ID NO: 93753 - protein, 10 aa, Homo sapiens
  Native (MAGC1_HUMAN)
NTVPITFPSS

SEQ ID NO: 93754 - protein, 10 aa, Homo sapiens
  Native (MAGC1_HUMAN)
GEEFQSSLQS

SEQ ID NO: 93755 - protein, 10 aa, Homo sapiens
  Native (MAGC1_HUMAN)
TFEGFAQSSL

SEQ ID NO: 93756 - protein, 10 aa, Homo sapiens
  Native (MAGC1_HUMAN)
SPPEGPAQSP

SEQ ID NO: 93757 - protein, 9 aa, Homo sapiens
  Native (MAGC1_HUMAN)
LLSLFQSFS

SEQ ID NO: 93758 - protein, 8 aa, Homo sapiens
  Native (MAGC1_HUMAN)
SESPQSCP

SEQ ID NO: 93759 - protein, 9 aa, Homo sapiens
  Native (MAGC1_HUMAN)
GEPRELLTK

SEQ ID NO: 93760 - protein, 11 aa, Homo sapiens
  Native (MAGC1_HUMAN)
EVDPDDSYVFV

SEQ ID NO: 93761 - protein, 9 aa, Homo sapiens
  Native (MAGC1_HUMAN)
VISRYTGYF

SEQ ID NO: 93762 - protein, 10 aa, Homo sapiens
  Native (MAGC1_HUMAN)
STFEGFPQSL

SEQ ID NO: 93763 - protein, 10 aa, Homo sapiens
  Native (MAGC1_HUMAN)
SMSPLYFPQS

SEQ ID NO: 93764 - protein, 10 aa, Homo sapiens
  Native (MAGC1_HUMAN)
SPLQRPVSSF

SEQ ID NO: 93765 - protein, 11 aa, Homo sapiens
  Native (MAGC1_HUMAN)
SSFPSSTSSSL

SEQ ID NO: 93766 - protein, 9 aa, Homo sapiens
  Native (MAGC1_HUMAN)
VDPDDSYVF

SEQ ID NO: 93767 - protein, 9 aa, Homo sapiens
  Native (MAGC1_HUMAN)
NPASSFFSS

SEQ ID NO: 93768 - protein, 10 aa, Homo sapiens
  Native (MAGC1_HUMAN)
SSPERTHSTF

SEQ ID NO: 93769 - protein, 10 aa, Homo sapiens
  Native (MAGC1_HUMAN)
EPRELLTKVW

SEQ ID NO: 93770 - protein, 9 aa, Homo sapiens
  Native (MAGC1_HUMAN)
SVLQIPVSA

SEQ ID NO: 93771 - protein, 9 aa, Homo sapiens
  Native (MAGC1_HUMAN)
DEKVDELAR

SEQ ID NO: 93772 - protein, 9 aa, Homo sapiens
  Native (MAGC1_HUMAN)
HYFPQSPPQ

SEQ ID NO: 93773 - protein, 8 aa, Homo sapiens
  Native (MAGC1_HUMAN)
LQSPVISF

SEQ ID NO: 93774 - protein, 9 aa, Homo sapiens
  Native (MAGC1_HUMAN)
VEERAQAII

SEQ ID NO: 93775 - protein, 11 aa, Homo sapiens
  Native (MAGC1_HUMAN)
SPQGEDSLSPH

SEQ ID NO: 93776 - protein, 11 aa, Homo sapiens
  Native (MAGC1_HUMAN)
FEGFPQSPLQI

SEQ ID NO: 93777 - protein, 11 aa, Homo sapiens
  Native (MAGC1_HUMAN)
FPQSPLQIPMT

SEQ ID NO: 93778 - protein, 9 aa, Homo sapiens
  Native (MAGC1_HUMAN)
LKNTVPITF

SEQ ID NO: 93779 - protein, 10 aa, Homo sapiens
  Native (MAGC1_HUMAN)
PEGDDTQSPL

SEQ ID NO: 93780 - protein, 11 aa, Homo sapiens
  Native (MAGC1_HUMAN)
GEEFQSSLQSP

SEQ ID NO: 93781 - protein, 11 aa, Homo sapiens
  Native (MAGC1_HUMAN)
SSFSSTLLSIL

SEQ ID NO: 93782 - protein, 9 aa, Homo sapiens
  Native (MAGC1_HUMAN)
GEDVQSPLQ

SEQ ID NO: 93783 - protein, 11 aa, Homo sapiens
  Native (MAGC1_HUMAN)
EEVIWDVLSGI

SEQ ID NO: 93784 - protein, 10 aa, Homo sapiens
  Native (MAGC1_HUMAN)
ELARFLLLKY

SEQ ID NO: 93785 - protein, 10 aa, Homo sapiens
  Native (MAGC1_HUMAN)
LILILSIIFI

SEQ ID NO: 93786 - protein, 10 aa, Homo sapiens
  Native (MAGC1_HUMAN)
RKVVEFLAML

SEQ ID NO: 93787 - protein, 9 aa, Homo sapiens
  Native (MAGC1_HUMAN)
LQIPMTSSF

SEQ ID NO: 93788 - protein, 9 aa, Homo sapiens
  Native (MAGC1_HUMAN)
IPMTSSFSS

SEQ ID NO: 93789 - protein, 11 aa, Homo sapiens
  Native (MAGC1_HUMAN)
QSSPESTQSPF

SEQ ID NO: 93790 - protein, 9 aa, Homo sapiens
  Native (MAGC1_HUMAN)
EHYLEYREV

SEQ ID NO: 93791 - protein, 9 aa, Homo sapiens
  Native (MAGC1_HUMAN)
EEFQSSLQS

SEQ ID NO: 93792 - protein, 9 aa, Homo sapiens
  Native (MAGC1_HUMAN)
TLDLTSEGC

SEQ ID NO: 93793 - protein, 8 aa, Homo sapiens
  Native (MAGC1_HUMAN)
ISRYTGYF

SEQ ID NO: 93794 - protein, 10 aa, Homo sapiens
  Native (MAGC1_HUMAN)
VSLFQSSPER

SEQ ID NO: 93795 - protein, 11 aa, Homo sapiens
  Native (MAGC1_HUMAN)
SPLQIPMTSSF

SEQ ID NO: 93796 - protein, 8 aa, Homo sapiens
  Native (MAGC1_HUMAN)
TQSPFEGF

SEQ ID NO: 93797 - protein, 11 aa, Homo sapiens
  Native (MAGC1_HUMAN)
FPQSVLQIPVS

SEQ ID NO: 93798 - protein, 10 aa, Homo sapiens
  Native (MAGC1_HUMAN)
FPQSPLQIPV

SEQ ID NO: 93799 - protein, 11 aa, Homo sapiens
  Native (MAGC1_HUMAN)
SSPESPLQSPV

SEQ ID NO: 93800 - protein, 8 aa, Homo sapiens
  Native (MAGC1_HUMAN)
ARFLLLKY

SEQ ID NO: 93801 - protein, 9 aa, Homo sapiens
  Native (MAGC1_HUMAN)
YTSSSDTLL

SEQ ID NO: 93802 - protein, 9 aa, Homo sapiens
  Native (MAGC1_HUMAN)
SSSTLVSIF

SEQ ID NO: 93803 - protein, 11 aa, Homo sapiens
  Native (MAGC1_HUMAN)
NTLDLTSEGCL

SEQ ID NO: 93804 - protein, 8 aa, Homo sapiens
  Native (MAGC1_HUMAN)
KSSPESPL

SEQ ID NO: 93805 - protein, 10 aa, Homo sapiens
  Native (MAGC1_HUMAN)
QSPPEGENTH

SEQ ID NO: 93806 - protein, 9 aa, Homo sapiens
  Native (MAGC1_HUMAN)
SSPESAQSA

SEQ ID NO: 93807 - protein, 10 aa, Homo sapiens
  Native (MAGC1_HUMAN)
YFPVIFRKAR

SEQ ID NO: 93808 - protein, 9 aa, Homo sapiens
  Native (MAGC1_HUMAN)
SSPEGKDSL

SEQ ID NO: 93809 - protein, 11 aa, Homo sapiens
  Native (MAGC1_HUMAN)
PPQGEDFQSSL

SEQ ID NO: 93810 - protein, 9 aa, Homo sapiens
  Native (MAGC1_HUMAN)
FPVIFRKAR

SEQ ID NO: 93811 - protein, 9 aa, Homo sapiens
  Native (MAGC1_HUMAN)
SPLYFPQSP

SEQ ID NO: 93812 - protein, 9 aa, Homo sapiens
  Native (MAGC1_HUMAN)
KRKVVEFLA

SEQ ID NO: 93813 - protein, 10 aa, Homo sapiens
  Native (MAGC1_HUMAN)
SSPERTQSTF

SEQ ID NO: 93814 - protein, 10 aa, Homo sapiens
  Native (MAGC1_HUMAN)
DELARFLLLK

SEQ ID NO: 93815 - protein, 9 aa, Homo sapiens
  Native (MAGC1_HUMAN)
EQGMSQNRL

SEQ ID NO: 93816 - protein, 10 aa, Homo sapiens
  Native (MAGC1_HUMAN)
SEGEDSSDPL

SEQ ID NO: 93817 - protein, 9 aa, Homo sapiens
  Native (MAGC1_HUMAN)
RPVSSFFSY

SEQ ID NO: 93818 - protein, 9 aa, Homo sapiens
  Native (MAGC1_HUMAN)
FPESPQSPP

SEQ ID NO: 93819 - protein, 11 aa, Homo sapiens
  Native (MAGC1_HUMAN)
IPVSPSFSSTL

SEQ ID NO: 93820 - protein, 8 aa, Homo sapiens
  Native (MAGC1_HUMAN)
PVSSSFSY

SEQ ID NO: 93821 - protein, 10 aa, Homo sapiens
  Native (MAGC1_HUMAN)
QSPPEWEDSL

SEQ ID NO: 93822 - protein, 11 aa, Homo sapiens
  Native (MAGC1_HUMAN)
GEDSLSPLQIP

SEQ ID NO: 93823 - protein, 8 aa, Homo sapiens
  Native (MAGC1_HUMAN)
YTGYFPVI

SEQ ID NO: 93824 - protein, 11 aa, Homo sapiens
  Native (MAGC1_HUMAN)
SRSFSSTLLSI

SEQ ID NO: 93825 - protein, 11 aa, Homo sapiens
  Native (MAGC1_HUMAN)
GEDVQSPLQNP

SEQ ID NO: 93826 - protein, 11 aa, Homo sapiens
  Native (MAGC1_HUMAN)
PESAQSAFEGF

SEQ ID NO: 93827 - protein, 10 aa, Homo sapiens
  Native (MAGC1_HUMAN)
PLQIPVSRSF

SEQ ID NO: 93828 - protein, 8 aa, Homo sapiens
  Native (MAGC1_HUMAN)
ALKDVEER

SEQ ID NO: 93829 - protein, 9 aa, Homo sapiens
  Native (MAGC1_HUMAN)
KQPITKAEM

SEQ ID NO: 93830 - protein, 11 aa, Homo sapiens
  Native (MAGC1_HUMAN)
RYTGYFPVIFR

SEQ ID NO: 93831 - protein, 8 aa, Homo sapiens
  Native (MAGC1_HUMAN)
VEERAQAI

SEQ ID NO: 93832 - protein, 9 aa, Homo sapiens
  Native (MAGC1_HUMAN)
SFSERTQST

SEQ ID NO: 93833 - protein, 10 aa, Homo sapiens
  Native (MAGC1_HUMAN)
SYVFVNTLDL

SEQ ID NO: 93834 - protein, 8 aa, Homo sapiens
  Native (MAGC1_HUMAN)
MSQNRLLI

SEQ ID NO: 93835 - protein, 10 aa, Homo sapiens
  Native (MAGC1_HUMAN)
TLDLTSEGCL

SEQ ID NO: 93836 - protein, 8 aa, Homo sapiens
  Native (MAGC1_HUMAN)
TESASSSV

SEQ ID NO: 93837 - protein, 9 aa, Homo sapiens
  Native (MAGC1_HUMAN)
SPLQIPVSS

SEQ ID NO: 93838 - protein, 8 aa, Homo sapiens
  Native (MAGC1_HUMAN)
SPSFSSTL

SEQ ID NO: 93839 - protein, 9 aa, Homo sapiens
  Native (MAGC1_HUMAN)
LLILILSII

SEQ ID NO: 93840 - protein, 11 aa, Homo sapiens
  Native (MAGC1_HUMAN)
GREHFAFGEPR

SEQ ID NO: 93841 - protein, 8 aa, Homo sapiens
  Native (MAGC1_HUMAN)
FAQSSLQI

SEQ ID NO: 93842 - protein, 9 aa, Homo sapiens
  Native (MAGC1_HUMAN)
SPLQSPESA

SEQ ID NO: 93843 - protein, 9 aa, Homo sapiens
  Native (MAGC1_HUMAN)
CSSSTSLSL

SEQ ID NO: 93844 - protein, 10 aa, Homo sapiens
  Native (MAGC1_HUMAN)
SPPEGPVQSP

SEQ ID NO: 93845 - protein, 9 aa, Homo sapiens
  Native (MAGC1_HUMAN)
RKVVEFLAM

SEQ ID NO: 93846 - protein, 11 aa, Homo sapiens
  Native (MAGC1_HUMAN)
SLREVDPDDSY

SEQ ID NO: 93847 - protein, 8 aa, Homo sapiens
  Native (MAGC1_HUMAN)
LFQSFSER

SEQ ID NO: 93848 - protein, 8 aa, Homo sapiens
  Native (MAGC1_HUMAN)
KRKVVEFL

SEQ ID NO: 93849 - protein, 8 aa, Homo sapiens
  Native (MAGC1_HUMAN)
IIFIKGTY

SEQ ID NO: 93850 - protein, 9 aa, Homo sapiens
  Native (MAGC1_HUMAN)
ISFSSSTSL

SEQ ID NO: 93851 - protein, 9 aa, Homo sapiens
  Native (MAGC1_HUMAN)
QPITKAEML

SEQ ID NO: 93852 - protein, 11 aa, Homo sapiens
  Native (MAGC1_HUMAN)
EHFAFGEPREL

SEQ ID NO: 93853 - protein, 11 aa, Homo sapiens
  Native (MAGC1_HUMAN)
FPPQGEDFQSS

SEQ ID NO: 93854 - protein, 9 aa, Homo sapiens
  Native (MAGC1_HUMAN)
WDVLSGIGV

SEQ ID NO: 93855 - protein, 9 aa, Homo sapiens
  Native (MAGC1_HUMAN)
DEYTSSSDT

SEQ ID NO: 93856 - protein, 10 aa, Homo sapiens
  Native (MAGC1_HUMAN)
FSYTLLSLFQ

SEQ ID NO: 93857 - protein, 9 aa, Homo sapiens
  Native (MAGC1_HUMAN)
EDFQSSLQS

SEQ ID NO: 93858 - protein, 8 aa, Homo sapiens
  Native (MAGC1_HUMAN)
FPQSPPEW

SEQ ID NO: 93859 - protein, 9 aa, Homo sapiens
  Native (MAGC1_HUMAN)
KVVEFLAML

SEQ ID NO: 93860 - protein, 9 aa, Homo sapiens
  Native (MAGC1_HUMAN)
SLIESEPLF

SEQ ID NO: 93861 - protein, 9 aa, Homo sapiens
  Native (MAGC1_HUMAN)
LDEKVDELA

SEQ ID NO: 93862 - protein, 11 aa, Homo sapiens
  Native (MAGC1_HUMAN)
SPVISFSSSTS

SEQ ID NO: 93863 - protein, 11 aa, Homo sapiens
  Native (MAGC1_HUMAN)
SFFSYTLASLL

SEQ ID NO: 93864 - protein, 10 aa, Homo sapiens
  Native (MAGC1_HUMAN)
ESAQSTFEGF

SEQ ID NO: 93865 - protein, 10 aa, Homo sapiens
  Native (MAGC1_HUMAN)
GPAQSPLQSP

SEQ ID NO: 93866 - protein, 9 aa, Homo sapiens
  Native (MAGC1_HUMAN)
WEDSLSPLH

SEQ ID NO: 93867 - protein, 8 aa, Homo sapiens
  Native (MAGC1_HUMAN)
SLSQSSPV

SEQ ID NO: 93868 - protein, 9 aa, Homo sapiens
  Native (MAGC1_HUMAN)
IPVSSSSSS

SEQ ID NO: 93869 - protein, 10 aa, Homo sapiens
  Native (MAGC1_HUMAN)
DMPTAGMPSL

SEQ ID NO: 93870 - protein, 11 aa, Homo sapiens
  Native (MAGC1_HUMAN)
DEYTSSSDTLL

SEQ ID NO: 93871 - protein, 8 aa, Homo sapiens
  Native (MAGC1_HUMAN)
SPLQIPGS

SEQ ID NO: 93872 - protein, 8 aa, Homo sapiens
  Native (MAGC1_HUMAN)
QPITKAEM

SEQ ID NO: 93873 - protein, 10 aa, Homo sapiens
  Native (MAGC1_HUMAN)
SSFSYTLLSL

SEQ ID NO: 93874 - protein, 11 aa, Homo sapiens
  Native (MAGC1_HUMAN)
SPPEGPVQSPL

SEQ ID NO: 93875 - protein, 11 aa, Homo sapiens
  Native (MAGC1_HUMAN)
SEEVIWDVLSG

SEQ ID NO: 93876 - protein, 10 aa, Homo sapiens
  Native (MAGC1_HUMAN)
FAQSSLQIPV

SEQ ID NO: 93877 - protein, 10 aa, Homo sapiens
  Native (MAGC1_HUMAN)
YVFVNTLDLT

SEQ ID NO: 93878 - protein, 10 aa, Homo sapiens
  Native (MAGC1_HUMAN)
LSLFQSFSER

SEQ ID NO: 93879 - protein, 9 aa, Homo sapiens
  Native (MAGC1_HUMAN)
VRAGREHFA

SEQ ID NO: 93880 - protein, 9 aa, Homo sapiens
  Native (MAGC1_HUMAN)
QGMSQNRLL

SEQ ID NO: 93881 - protein, 9 aa, Homo sapiens
  Native (MAGC1_HUMAN)
EDSQSPLQI

SEQ ID NO: 93882 - protein, 9 aa, Homo sapiens
  Native (MAGC1_HUMAN)
SPHYFPQSP

SEQ ID NO: 93883 - protein, 10 aa, Homo sapiens
  Native (MAGC1_HUMAN)
KGTYASEEVI

SEQ ID NO: 93884 - protein, 11 aa, Homo sapiens
  Native (MAGC1_HUMAN)
SPLQSPVISFS

SEQ ID NO: 93885 - protein, 9 aa, Homo sapiens
  Native (MAGC1_HUMAN)
EFIEILFGI

SEQ ID NO: 93886 - protein, 9 aa, Homo sapiens
  Native (MAGC1_HUMAN)
SLSPFSEES

SEQ ID NO: 93887 - protein, 11 aa, Homo sapiens
  Native (MAGC1_HUMAN)
KGTYASEEVIW

SEQ ID NO: 93888 - protein, 8 aa, Homo sapiens
  Native (MAGC1_HUMAN)
FTYTLDEK

SEQ ID NO: 93889 - protein, 11 aa, Homo sapiens
  Native (MAGC1_HUMAN)
IPVSSSFSYTL

SEQ ID NO: 93890 - protein, 10 aa, Homo sapiens
  Native (MAGC1_HUMAN)
TATESASSSV

SEQ ID NO: 93891 - protein, 10 aa, Homo sapiens
  Native (MAGC1_HUMAN)
HESPQSPPEG

SEQ ID NO: 93892 - protein, 9 aa, Homo sapiens
  Native (MAGC1_HUMAN)
SFSSTLVSL

SEQ ID NO: 93893 - protein, 10 aa, Homo sapiens
  Native (MAGC1_HUMAN)
RKAREFIEIL

SEQ ID NO: 93894 - protein, 8 aa, Homo sapiens
  Native (MAGC1_HUMAN)
SPLQIPVS

SEQ ID NO: 93895 - protein, 9 aa, Homo sapiens
  Native (MAGC1_HUMAN)
SPQSPPEGP

SEQ ID NO: 93896 - protein, 11 aa, Homo sapiens
  Native (MAGC1_HUMAN)
EESSSPVDEYT

SEQ ID NO: 93897 - protein, 11 aa, Homo sapiens
  Native (MAGC1_HUMAN)
SLSQSSPVSSF

SEQ ID NO: 93898 - protein, 10 aa, Homo sapiens
  Native (MAGC1_HUMAN)
TFPSSYKDAL

SEQ ID NO: 93899 - protein, 9 aa, Homo sapiens
  Native (MAGC1_HUMAN)
PEGPVQSPL

SEQ ID NO: 93900 - protein, 10 aa, Homo sapiens
  Native (MAGC1_HUMAN)
TESASSSVMS

SEQ ID NO: 93901 - protein, 8 aa, Homo sapiens
  Native (MAGC1_HUMAN)
LTNVISRY

SEQ ID NO: 93902 - protein, 9 aa, Homo sapiens
  Native (MAGC1_HUMAN)
AQSPLQSPV

SEQ ID NO: 93903 - protein, 8 aa, Homo sapiens
  Native (MAGC1_HUMAN)
REFIEILF

SEQ ID NO: 93904 - protein, 8 aa, Homo sapiens
  Native (MAGC1_HUMAN)
SYTLASLL

SEQ ID NO: 93905 - protein, 9 aa, Homo sapiens
  Native (MAGC1_HUMAN)
SPECTQSTF

SEQ ID NO: 93906 - protein, 8 aa, Homo sapiens
  Native (MAGC1_HUMAN)
DEKVDELA

SEQ ID NO: 93907 - protein, 8 aa, Homo sapiens
  Native (MAGC1_HUMAN)
QIPMTSSF

SEQ ID NO: 93908 - protein, 8 aa, Homo sapiens
  Native (MAGC1_HUMAN)
GEDVQSPL

SEQ ID NO: 93909 - protein, 11 aa, Homo sapiens
  Native (MAGC1_HUMAN)
SICSSSTPSSL

SEQ ID NO: 93910 - protein, 9 aa, Homo sapiens
  Native (MAGC1_HUMAN)
FPQFPPQGE

SEQ ID NO: 93911 - protein, 9 aa, Homo sapiens
  Native (MAGC1_HUMAN)
FSSTLLSIL

SEQ ID NO: 93912 - protein, 9 aa, Homo sapiens
  Native (MAGC1_HUMAN)
QNRLLILIL

SEQ ID NO: 93913 - protein, 9 aa, Homo sapiens
  Native (MAGC1_HUMAN)
IPVSPSFSS

SEQ ID NO: 93914 - protein, 11 aa, Homo sapiens
  Native (MAGC1_HUMAN)
ILSIIFIKGTY

SEQ ID NO: 93915 - protein, 9 aa, Homo sapiens
  Native (MAGC1_HUMAN)
SSFSSTLLS

SEQ ID NO: 93916 - protein, 11 aa, Homo sapiens
  Native (MAGC1_HUMAN)
SASSSVMSPSF

SEQ ID NO: 93917 - protein, 11 aa, Homo sapiens
  Native (MAGC1_HUMAN)
SFSSSTSLSPF

SEQ ID NO: 93918 - protein, 8 aa, Homo sapiens
  Native (MAGC1_HUMAN)
SSALLSIF

SEQ ID NO: 93919 - protein, 9 aa, Homo sapiens
  Native (MAGC1_HUMAN)
AEMLTNVIS

SEQ ID NO: 93920 - protein, 9 aa, Homo sapiens
  Native (MAGC1_HUMAN)
SYKDALKDV

SEQ ID NO: 93921 - protein, 11 aa, Homo sapiens
  Native (MAGC1_HUMAN)
SPPQGEDSLSP

SEQ ID NO: 93922 - protein, 8 aa, Homo sapiens
  Native (MAGC1_HUMAN)
FAQSPLQI

SEQ ID NO: 93923 - protein, 8 aa, Homo sapiens
  Native (MAGC1_HUMAN)
YTSSSDTL

SEQ ID NO: 93924 - protein, 11 aa, Homo sapiens
  Native (MAGC1_HUMAN)
VEFLAMLKNTV

SEQ ID NO: 93925 - protein, 10 aa, Homo sapiens
  Native (MAGC1_HUMAN)
LSIIFIKGTY

SEQ ID NO: 93926 - protein, 10 aa, Homo sapiens
  Native (MAGC1_HUMAN)
NRLLILILSI

SEQ ID NO: 93927 - protein, 9 aa, Homo sapiens
  Native (MAGC1_HUMAN)
LQIPVSPSF

SEQ ID NO: 93928 - protein, 11 aa, Homo sapiens
  Native (MAGC1_HUMAN)
LQNSQSSPEGK

SEQ ID NO: 93929 - protein, 8 aa, Homo sapiens
  Native (MAGC1_HUMAN)
QIPVSRSF

SEQ ID NO: 93930 - protein, 9 aa, Homo sapiens
  Native (MAGC1_HUMAN)
GYFPVIFRK

SEQ ID NO: 93931 - protein, 10 aa, Homo sapiens
  Native (MAGC1_HUMAN)
AEMLTNVISR

SEQ ID NO: 93932 - protein, 8 aa, Homo sapiens
  Native (MAGC1_HUMAN)
LQRPVSSF

SEQ ID NO: 93933 - protein, 10 aa, Homo sapiens
  Native (MAGC1_HUMAN)
ESEPLFTYTL

SEQ ID NO: 93934 - protein, 11 aa, Homo sapiens
  Native (MAGC1_HUMAN)
REVPNSSPPRY

SEQ ID NO: 93935 - protein, 9 aa, Homo sapiens
  Native (MAGC1_HUMAN)
LPQSFPESS

SEQ ID NO: 93936 - protein, 9 aa, Homo sapiens
  Native (MAGC1_HUMAN)
FSYTLASLL

SEQ ID NO: 93937 - protein, 8 aa, Homo sapiens
  Native (MAGC1_HUMAN)
YPLQSPQS

SEQ ID NO: 93938 - protein, 11 aa, Homo sapiens
  Native (MAGC1_HUMAN)
SPLQIPVSRSF

SEQ ID NO: 93939 - protein, 11 aa, Homo sapiens
  Native (MAGC1_HUMAN)
LSPLQIPQSPL

SEQ ID NO: 93940 - protein, 11 aa, Homo sapiens
  Native (MAGC1_HUMAN)
STFEGFAQSPL

SEQ ID NO: 93941 - protein, 8 aa, Homo sapiens
  Native (MAGC1_HUMAN)
EVIKRKVV

SEQ ID NO: 93942 - protein, 8 aa, Homo sapiens
  Native (MAGC1_HUMAN)
AASSSTLV

SEQ ID NO: 93943 - protein, 8 aa, Homo sapiens
  Native (MAGC1_HUMAN)
SPPRYEFL

SEQ ID NO: 93944 - protein, 11 aa, Homo sapiens
  Native (MAGC1_HUMAN)
SLQIPVSPSFS

SEQ ID NO: 93945 - protein, 8 aa, Homo sapiens
  Native (MAGC1_HUMAN)
SPLQSPVI

SEQ ID NO: 93946 - protein, 9 aa, Homo sapiens
  Native (MAGC1_HUMAN)
LESDSLTDS

SEQ ID NO: 93947 - protein, 9 aa, Homo sapiens
  Native (MAGC1_HUMAN)
TKVWVQEHY

SEQ ID NO: 93948 - protein, 10 aa, Homo sapiens
  Native (MAGC1_HUMAN)
FPESPQSPPE

SEQ ID NO: 93949 - protein, 9 aa, Homo sapiens
  Native (MAGC1_HUMAN)
SPVSSFPSS

SEQ ID NO: 93950 - protein, 11 aa, Homo sapiens
  Native (MAGC1_HUMAN)
FPESPQSPPEG

SEQ ID NO: 93951 - protein, 11 aa, Homo sapiens
  Native (MAGC1_HUMAN)
QSSPESAQSTF

SEQ ID NO: 93952 - protein, 10 aa, Homo sapiens
  Native (MAGC1_HUMAN)
QEHYLEYREV

SEQ ID NO: 93953 - protein, 9 aa, Homo sapiens
  Native (MAGC1_HUMAN)
SMSPLYFPQ

SEQ ID NO: 93954 - protein, 10 aa, Homo sapiens
  Native (MAGC1_HUMAN)
STFEGFAQSS

SEQ ID NO: 93955 - protein, 10 aa, Homo sapiens
  Native (MAGC1_HUMAN)
EVDPDDSYVF

SEQ ID NO: 93956 - protein, 11 aa, Homo sapiens
  Native (MAGC1_HUMAN)
LEYREVPNSSP

SEQ ID NO: 93957 - protein, 10 aa, Homo sapiens
  Native (MAGC1_HUMAN)
SPQSPPEGPA

SEQ ID NO: 93958 - protein, 11 aa, Homo sapiens
  Native (MAGC1_HUMAN)
KAEMLTNVISR

SEQ ID NO: 93959 - protein, 8 aa, Homo sapiens
  Native (MAGC1_HUMAN)
LLILILSI

SEQ ID NO: 93960 - protein, 11 aa, Homo sapiens
  Native (MAGC1_HUMAN)
VWVQEHYLEYR

SEQ ID NO: 93961 - protein, 10 aa, Homo sapiens
  Native (MAGC1_HUMAN)
QGEDSMSPLY

SEQ ID NO: 93962 - protein, 10 aa, Homo sapiens
  Native (MAGC1_HUMAN)
ILFGISLREV

SEQ ID NO: 93963 - protein, 9 aa, Homo sapiens
  Native (MAGC1_HUMAN)
PLYFPQSPL

SEQ ID NO: 93964 - protein, 10 aa, Homo sapiens
  Native (MAGC1_HUMAN)
TGYFPVIFRK

SEQ ID NO: 93965 - protein, 9 aa, Homo sapiens
  Native (MAGC1_HUMAN)
SLFQSSPER

SEQ ID NO: 93966 - protein, 10 aa, Homo sapiens
  Native (MAGC1_HUMAN)
GEDSLSPHYF

SEQ ID NO: 93967 - protein, 10 aa, Homo sapiens
  Native (MAGC1_HUMAN)
SPFEGFPQSV

SEQ ID NO: 93968 - protein, 11 aa, Homo sapiens
  Native (MAGC1_HUMAN)
LSDEQGMSQNR

SEQ ID NO: 93969 - protein, 9 aa, Homo sapiens
  Native (MAGC1_HUMAN)
SAASSSTLV

SEQ ID NO: 93970 - protein, 11 aa, Homo sapiens
  Native (MAGC1_HUMAN)
EILFGISLREV

SEQ ID NO: 93971 - protein, 10 aa, Homo sapiens
  Native (MAGC1_HUMAN)
QSPPQGEDSM

SEQ ID NO: 93972 - protein, 10 aa, Homo sapiens
  Native (MAGC1_HUMAN)
SPLQIPQSPP

SEQ ID NO: 93973 - protein, 8 aa, Homo sapiens
  Native (MAGC1_HUMAN)
DSSDPLQR

SEQ ID NO: 93974 - protein, 11 aa, Homo sapiens
  Native (MAGC1_HUMAN)
VISRYTGYFPV

SEQ ID NO: 93975 - protein, 10 aa, Homo sapiens
  Native (MAGC1_HUMAN)
TNVISRYTGY

SEQ ID NO: 93976 - protein, 8 aa, Homo sapiens
  Native (MAGC1_HUMAN)
FPQSVLQI

SEQ ID NO: 93977 - protein, 11 aa, Homo sapiens
  Native (MAGC1_HUMAN)
TVPITFPSSYK

SEQ ID NO: 93978 - protein, 8 aa, Homo sapiens
  Native (MAGC1_HUMAN)
SSTLVSIF

SEQ ID NO: 93979 - protein, 10 aa, Homo sapiens
  Native (MAGC1_HUMAN)
SPVDEYTSSS

SEQ ID NO: 93980 - protein, 9 aa, Homo sapiens
  Native (MAGC1_HUMAN)
ALKDVEERA

SEQ ID NO: 93981 - protein, 11 aa, Homo sapiens
  Native (MAGC1_HUMAN)
FPQSPQGEDSL

SEQ ID NO: 93982 - protein, 8 aa, Homo sapiens
  Native (MAGC1_HUMAN)
VFVNTLDL

SEQ ID NO: 93983 - protein, 9 aa, Homo sapiens
  Native (MAGC1_HUMAN)
FAQSPLQIP

SEQ ID NO: 93984 - protein, 11 aa, Homo sapiens
  Native (MAGC1_HUMAN)
QSPLQNPASSF

SEQ ID NO: 93985 - protein, 9 aa, Homo sapiens
  Native (MAGC1_HUMAN)
GENTHSPLQ

SEQ ID NO: 93986 - protein, 8 aa, Homo sapiens
  Native (MAGC1_HUMAN)
SPLQIPMT

SEQ ID NO: 93987 - protein, 9 aa, Homo sapiens
  Native (MAGC1_HUMAN)
YVFVNTLDL

SEQ ID NO: 93988 - protein, 10 aa, Homo sapiens
  Native (MAGC1_HUMAN)
LSLFQSSPER

SEQ ID NO: 93989 - protein, 8 aa, Homo sapiens
  Native (MAGC1_HUMAN)
IVPSLPEW

SEQ ID NO: 93990 - protein, 8 aa, Homo sapiens
  Native (MAGC1_HUMAN)
THSTFEGF

SEQ ID NO: 93991 - protein, 9 aa, Homo sapiens
  Native (MAGC1_HUMAN)
PLQNPASSF

SEQ ID NO: 93992 - protein, 11 aa, Homo sapiens
  Native (MAGC1_HUMAN)
SSDTLLESDSL

SEQ ID NO: 93993 - protein, 9 aa, Homo sapiens
  Native (MAGC1_HUMAN)
SIIFIKGTY

SEQ ID NO: 93994 - protein, 10 aa, Homo sapiens
  Native (MAGC1_HUMAN)
VKQPITKAEM

SEQ ID NO: 93995 - protein, 11 aa, Homo sapiens
  Native (MAGC1_HUMAN)
GEPRELLTKVW

SEQ ID NO: 93996 - protein, 9 aa, Homo sapiens
  Native (MAGC1_HUMAN)
EVPNSSPPR

SEQ ID NO: 93997 - protein, 11 aa, Homo sapiens
  Native (MAGC1_HUMAN)
LLLKYQVKQPI

SEQ ID NO: 93998 - protein, 9 aa, Homo sapiens
  Native (MAGC1_HUMAN)
RAHSEVIKR

SEQ ID NO: 93999 - protein, 8 aa, Homo sapiens
  Native (MAGC1_HUMAN)
SLIESEPL

SEQ ID NO: 94000 - protein, 8 aa, Homo sapiens
  Native (MAGC1_HUMAN)
EPLFTYTL

SEQ ID NO: 94001 - protein, 8 aa, Homo sapiens
  Native (MAGC1_HUMAN)
SEESSSPV

SEQ ID NO: 94002 - protein, 10 aa, Homo sapiens
  Native (MAGC1_HUMAN)
LSGIGVRAGR

SEQ ID NO: 94003 - protein, 8 aa, Homo sapiens
  Native (MAGC1_HUMAN)
YASEEVIW

SEQ ID NO: 94004 - protein, 9 aa, Homo sapiens
  Native (MAGC1_HUMAN)
LQNPASSFF

SEQ ID NO: 94005 - protein, 10 aa, Homo sapiens
  Native (MAGC1_HUMAN)
PMTSSFSSTL

SEQ ID NO: 94006 - protein, 9 aa, Homo sapiens
  Native (MAGC1_HUMAN)
SPPEWEDSL

SEQ ID NO: 94007 - protein, 9 aa, Homo sapiens
  Native (MAGC1_HUMAN)
SPPQGEDSL

SEQ ID NO: 94008 - protein, 10 aa, Homo sapiens
  Native (MAGC1_HUMAN)
SDSLTDSESL

SEQ ID NO: 94009 - protein, 9 aa, Homo sapiens
  Native (MAGC1_HUMAN)
SPERTHSTF

SEQ ID NO: 94010 - protein, 11 aa, Homo sapiens
  Native (MAGC1_HUMAN)
SPHYFPQSPQG

SEQ ID NO: 94011 - protein, 9 aa, Homo sapiens
  Native (MAGC1_HUMAN)
LQIVPSLPE

SEQ ID NO: 94012 - protein, 8 aa, Homo sapiens
  Native (MAGC1_HUMAN)
SSFSSTLL

SEQ ID NO: 94013 - protein, 11 aa, Homo sapiens
  Native (MAGC1_HUMAN)
GEDSLSPHYFP

SEQ ID NO: 94014 - protein, 11 aa, Homo sapiens
  Native (MAGC1_HUMAN)
GFPQSLLQIPM

SEQ ID NO: 94015 - protein, 11 aa, Homo sapiens
  Native (MAGC1_HUMAN)
FPSSTSSSLSK

SEQ ID NO: 94016 - protein, 10 aa, Homo sapiens
  Native (MAGC1_HUMAN)
PRYEFLWGPR

SEQ ID NO: 94017 - protein, 11 aa, Homo sapiens
  Native (MAGC1_HUMAN)
AMLKNTVPITF

SEQ ID NO: 94018 - protein, 10 aa, Homo sapiens
  Native (MAGC1_HUMAN)
EILFGISLRE

SEQ ID NO: 94019 - protein, 10 aa, Homo sapiens
  Native (MAGC1_HUMAN)
EERAQAIIDT

SEQ ID NO: 94020 - protein, 9 aa, Homo sapiens
  Native (MAGC1_HUMAN)
ESPLQSPVI

SEQ ID NO: 94021 - protein, 9 aa, Homo sapiens
  Native (MAGC1_HUMAN)
QGEEFQSSL

SEQ ID NO: 94022 - protein, 9 aa, Homo sapiens
  Native (MAGC1_HUMAN)
KVWVQEHYL

SEQ ID NO: 94023 - protein, 9 aa, Homo sapiens
  Native (MAGC1_HUMAN)
VDELARFLL

SEQ ID NO: 94024 - protein, 9 aa, Homo sapiens
  Native (MAGC1_HUMAN)
SPLHSPQSP

SEQ ID NO: 94025 - protein, 8 aa, Homo sapiens
  Native (MAGC1_HUMAN)
GDDTQSPL

SEQ ID NO: 94026 - protein, 10 aa, Homo sapiens
  Native (MAGC1_HUMAN)
DEYTSSSDTL

SEQ ID NO: 94027 - protein, 10 aa, Homo sapiens
  Native (MAGC1_HUMAN)
RTHSTFEGFP

SEQ ID NO: 94028 - protein, 8 aa, Homo sapiens
  Native (MAGC1_HUMAN)
SPLHSPQS

SEQ ID NO: 94029 - protein, 9 aa, Homo sapiens
  Native (MAGC1_HUMAN)
EDSMSPLYF

SEQ ID NO: 94030 - protein, 10 aa, Homo sapiens
  Native (MAGC1_HUMAN)
PLQIPMTSSF

SEQ ID NO: 94031 - protein, 10 aa, Homo sapiens
  Native (MAGC1_HUMAN)
LQGEEFQSSL

SEQ ID NO: 94032 - protein, 9 aa, Homo sapiens
  Native (MAGC1_HUMAN)
SRYTGYFPV

SEQ ID NO: 94033 - protein, 10 aa, Homo sapiens
  Native (MAGC1_HUMAN)
VSAASSSTLV

SEQ ID NO: 94034 - protein, 8 aa, Homo sapiens
  Native (MAGC1_HUMAN)
ELARFLLL

SEQ ID NO: 94035 - protein, 11 aa, Homo sapiens
  Native (MAGC1_HUMAN)
SPQSPPEGMHS

SEQ ID NO: 94036 - protein, 9 aa, Homo sapiens
  Native (MAGC1_HUMAN)
SPLEISQSP

SEQ ID NO: 94037 - protein, 9 aa, Homo sapiens
  Native (MAGC1_HUMAN)
TLVSLFQSS

SEQ ID NO: 94038 - protein, 10 aa, Homo sapiens
  Native (MAGC1_HUMAN)
SLSPLHFPQF

SEQ ID NO: 94039 - protein, 10 aa, Homo sapiens
  Native (MAGC1_HUMAN)
LSKSSPESPL

SEQ ID NO: 94040 - protein, 8 aa, Homo sapiens
  Native (MAGC1_HUMAN)
FSYTLLSL

SEQ ID NO: 94041 - protein, 9 aa, Homo sapiens
  Native (MAGC1_HUMAN)
IPVSAASSS

SEQ ID NO: 94042 - protein, 9 aa, Homo sapiens
  Native (MAGC1_HUMAN)
GFPQSPLQI

SEQ ID NO: 94043 - protein, 9 aa, Homo sapiens
  Native (MAGC1_HUMAN)
RSFSSTLLS

SEQ ID NO: 94044 - protein, 10 aa, Homo sapiens
  Native (MAGC1_HUMAN)
TFEGFPQSLL

SEQ ID NO: 94045 - protein, 9 aa, Homo sapiens
  Native (MAGC1_HUMAN)
YPLQSPQSR

SEQ ID NO: 94046 - protein, 11 aa, Homo sapiens
  Native (MAGC1_HUMAN)
KRKVVEFLAML

SEQ ID NO: 94047 - protein, 10 aa, Homo sapiens
  Native (MAGC1_HUMAN)
PVSPSFSSTL

SEQ ID NO: 94048 - protein, 11 aa, Homo sapiens
  Native (MAGC1_HUMAN)
FPQFPPQGEDF

SEQ ID NO: 94049 - protein, 10 aa, Homo sapiens
  Native (MAGC1_HUMAN)
FPQSPLQIPG

SEQ ID NO: 94050 - protein, 9 aa, Homo sapiens
  Native (MAGC1_HUMAN)
SSPPRYEFL

SEQ ID NO: 94051 - protein, 10 aa, Homo sapiens
  Native (MAGC1_HUMAN)
SSPPRYEFLW

SEQ ID NO: 94052 - protein, 11 aa, Homo sapiens
  Native (MAGC1_HUMAN)
QSSPERTQSTF

SEQ ID NO: 94053 - protein, 9 aa, Homo sapiens
  Native (MAGC1_HUMAN)
PASSFFSSA

SEQ ID NO: 94054 - protein, 8 aa, Homo sapiens
  Native (MAGC1_HUMAN)
ESEPLFTY

SEQ ID NO: 94055 - protein, 11 aa, Homo sapiens
  Native (MAGC1_HUMAN)
IESEPLFTYTL

SEQ ID NO: 94056 - protein, 9 aa, Homo sapiens
  Native (MAGC1_HUMAN)
SSPESPLQS

SEQ ID NO: 94057 - protein, 11 aa, Homo sapiens
  Native (MAGC1_HUMAN)
LQRPVSSFFSY

SEQ ID NO: 94058 - protein, 8 aa, Homo sapiens
  Native (MAGC1_HUMAN)
NRLLILIL

SEQ ID NO: 94059 - protein, 9 aa, Homo sapiens
  Native (MAGC1_HUMAN)
DPDDSYVFV

SEQ ID NO: 94060 - protein, 11 aa, Homo sapiens
  Native (MAGC1_HUMAN)
PESAQSTFEGF

SEQ ID NO: 94061 - protein, 10 aa, Homo sapiens
  Native (MAGC1_HUMAN)
EMLTNVISRY

SEQ ID NO: 94062 - protein, 8 aa, Homo sapiens
  Native (MAGC1_HUMAN)
GEDSLSPL

SEQ ID NO: 94063 - protein, 11 aa, Homo sapiens
  Native (MAGC1_HUMAN)
PQSSPESDDTL

SEQ ID NO: 94064 - protein, 9 aa, Homo sapiens
  Native (MAGC1_HUMAN)
QSPPEGEDV

SEQ ID NO: 94065 - protein, 11 aa, Homo sapiens
  Native (MAGC1_HUMAN)
STFEGFPQSPL

SEQ ID NO: 94066 - protein, 10 aa, Homo sapiens
  Native (MAGC1_HUMAN)
FPQSVLQIPV

SEQ ID NO: 94067 - protein, 11 aa, Homo sapiens
  Native (MAGC1_HUMAN)
SSFFSYTLASL

SEQ ID NO: 94068 - protein, 9 aa, Homo sapiens
  Native (MAGC1_HUMAN)
SLFQSSPEC

SEQ ID NO: 94069 - protein, 11 aa, Homo sapiens
  Native (MAGC1_HUMAN)
SPSFSSTLVSL

SEQ ID NO: 94070 - protein, 11 aa, Homo sapiens
  Native (MAGC1_HUMAN)
FPQSLLQIPMT

SEQ ID NO: 94071 - protein, 8 aa, Homo sapiens
  Native (MAGC1_HUMAN)
RYTGYFPV

SEQ ID NO: 94072 - protein, 10 aa, Homo sapiens
  Native (MAGC1_HUMAN)
KAEMLTNVIS

SEQ ID NO: 94073 - protein, 10 aa, Homo sapiens
  Native (MAGC1_HUMAN)
GPVQSPLHSP

SEQ ID NO: 94074 - protein, 9 aa, Homo sapiens
  Native (MAGC1_HUMAN)
DELARFLLL

SEQ ID NO: 94075 - protein, 11 aa, Homo sapiens
  Native (MAGC1_HUMAN)
FEGFPQSVLQI

SEQ ID NO: 94076 - protein, 11 aa, Homo sapiens
  Native (MAGC1_HUMAN)
REVDPDDSYVF

SEQ ID NO: 94077 - protein, 9 aa, Homo sapiens
  Native (MAGC1_HUMAN)
SESPQSCPE

SEQ ID NO: 94078 - protein, 10 aa, Homo sapiens
  Native (MAGC1_HUMAN)
TLDEKVDELA

SEQ ID NO: 94079 - protein, 10 aa, Homo sapiens
  Native (MAGC1_HUMAN)
PLQRPVSSFF

SEQ ID NO: 94080 - protein, 9 aa, Homo sapiens
  Native (MAGC1_HUMAN)
FFSSALLSI

SEQ ID NO: 94081 - protein, 10 aa, Homo sapiens
  Native (MAGC1_HUMAN)
IIDTTDDSTA

SEQ ID NO: 94082 - protein, 9 aa, Homo sapiens
  Native (MAGC1_HUMAN)
SSSFSYTLL

SEQ ID NO: 94083 - protein, 10 aa, Homo sapiens
  Native (MAGC1_HUMAN)
SPLQSPESAP

SEQ ID NO: 94084 - protein, 9 aa, Homo sapiens
  Native (MAGC1_HUMAN)
CSSSTPSSL

SEQ ID NO: 94085 - protein, 11 aa, Homo sapiens
  Native (MAGC1_HUMAN)
FPQSPPEWEDS

SEQ ID NO: 94086 - protein, 10 aa, Homo sapiens
  Native (MAGC1_HUMAN)
LQIVPSLPEW

SEQ ID NO: 94087 - protein, 9 aa, Homo sapiens
  Native (MAGC1_HUMAN)
IFRKAREFI

SEQ ID NO: 94088 - protein, 11 aa, Homo sapiens
  Native (MAGC1_HUMAN)
APEGEDSLSPL

SEQ ID NO: 94089 - protein, 8 aa, Homo sapiens
  Native (MAGC1_HUMAN)
TSSFSSTL

SEQ ID NO: 94090 - protein, 8 aa, Homo sapiens
  Native (MAGC1_HUMAN)
FIEILFGI

SEQ ID NO: 94091 - protein, 11 aa, Homo sapiens
  Native (MAGC1_HUMAN)
FPQSPPQGEDS

SEQ ID NO: 94092 - protein, 10 aa, Homo sapiens
  Native (MAGC1_HUMAN)
DVLSGIGVRA

SEQ ID NO: 94093 - protein, 9 aa, Homo sapiens
  Native (MAGC1_HUMAN)
AQSPLQRPV

SEQ ID NO: 94094 - protein, 8 aa, Homo sapiens
  Native (MAGC1_HUMAN)
QIPVSPSF

SEQ ID NO: 94095 - protein, 10 aa, Homo sapiens
  Native (MAGC1_HUMAN)
QSSPEGKDSL

SEQ ID NO: 94096 - protein, 9 aa, Homo sapiens
  Native (MAGC1_HUMAN)
VSSSFSYTL

SEQ ID NO: 94097 - protein, 10 aa, Homo sapiens
  Native (MAGC1_HUMAN)
KYQVKQPITK

SEQ ID NO: 94098 - protein, 10 aa, Homo sapiens
  Native (MAGC1_HUMAN)
HFAFGEPREL

SEQ ID NO: 94099 - protein, 10 aa, Homo sapiens
  Native (MAGC1_HUMAN)
SPLQIPVSSS

SEQ ID NO: 94100 - protein, 9 aa, Homo sapiens
  Native (MAGC1_HUMAN)
SPFSEESSS

SEQ ID NO: 94101 - protein, 11 aa, Homo sapiens
  Native (MAGC1_HUMAN)
SEVIKRKVVEF

SEQ ID NO: 94102 - protein, 9 aa, Homo sapiens
  Native (MAGC1_HUMAN)
RLLILILSI

SEQ ID NO: 94103 - protein, 11 aa, Homo sapiens
  Native (MAGC1_HUMAN)
SPVSSFPSSTS

SEQ ID NO: 94104 - protein, 9 aa, Homo sapiens
  Native (MAGC1_HUMAN)
REVPNSSPP

SEQ ID NO: 94105 - protein, 11 aa, Homo sapiens
  Native (MAGC1_HUMAN)
PESTQSPFEGF

SEQ ID NO: 94106 - protein, 11 aa, Homo sapiens
  Native (MAGC1_HUMAN)
PSFSSTLVSLF

SEQ ID NO: 94107 - protein, 11 aa, Homo sapiens
  Native (MAGC1_HUMAN)
YASEEVIWDVL

SEQ ID NO: 94108 - protein, 11 aa, Homo sapiens
  Native (MAGC1_HUMAN)
SSTLLSLFQSF

SEQ ID NO: 94109 - protein, 10 aa, Homo sapiens
  Native (MAGC1_HUMAN)
LIESEPLFTY

SEQ ID NO: 94110 - protein, 10 aa, Homo sapiens
  Native (MAGC1_HUMAN)
SIFQSSPEST

SEQ ID NO: 94111 - protein, 9 aa, Homo sapiens
  Native (MAGC1_HUMAN)
GEDSMSPLY

SEQ ID NO: 94112 - protein, 8 aa, Homo sapiens
  Native (MAGC1_HUMAN)
LLSLFQSF

SEQ ID NO: 94113 - protein, 9 aa, Homo sapiens
  Native (MAGC1_HUMAN)
ASSSTLVSI

SEQ ID NO: 94114 - protein, 9 aa, Homo sapiens
  Native (MAGC1_HUMAN)
DTLLESDSL

SEQ ID NO: 94115 - protein, 10 aa, Homo sapiens
  Native (MAGC1_HUMAN)
IPVSPSFSST

SEQ ID NO: 94116 - protein, 11 aa, Homo sapiens
  Native (MAGC1_HUMAN)
SFPSSTSSSLS

SEQ ID NO: 94117 - protein, 9 aa, Homo sapiens
  Native (MAGC1_HUMAN)
SSSSSSTLL

SEQ ID NO: 94118 - protein, 10 aa, Homo sapiens
  Native (MAGC1_HUMAN)
SPVISFSSST

SEQ ID NO: 94119 - protein, 8 aa, Homo sapiens
  Native (MAGC1_HUMAN)
FPQSPPQG

SEQ ID NO: 94120 - protein, 9 aa, Homo sapiens
  Native (MAGC1_HUMAN)
GPRAHSEVI

SEQ ID NO: 94121 - protein, 10 aa, Homo sapiens
  Native (MAGC1_HUMAN)
SFSSTLVSLF

SEQ ID NO: 94122 - protein, 10 aa, Homo sapiens
  Native (MAGC1_HUMAN)
RFLLLKYQVK

SEQ ID NO: 94123 - protein, 10 aa, Homo sapiens
  Native (MAGC1_HUMAN)
FPSSTSSSLS

SEQ ID NO: 94124 - protein, 9 aa, Homo sapiens
  Native (MAGC1_HUMAN)
EPRELLTKV

SEQ ID NO: 94125 - protein, 10 aa, Homo sapiens
  Native (MAGC1_HUMAN)
LLQIPMTSSF

SEQ ID NO: 94126 - protein, 9 aa, Homo sapiens
  Native (MAGC1_HUMAN)
PQSPLQIPV

SEQ ID NO: 94127 - protein, 9 aa, Homo sapiens
  Native (MAGC1_HUMAN)
FPQSPLQGE

SEQ ID NO: 94128 - protein, 8 aa, Homo sapiens
  Native (MAGC1_HUMAN)
SPLHFPQF

SEQ ID NO: 94129 - protein, 10 aa, Homo sapiens
  Native (MAGC1_HUMAN)
SPLQSPVSSF

SEQ ID NO: 94130 - protein, 9 aa, Homo sapiens
  Native (MAGC1_HUMAN)
EGKDSLSPL

SEQ ID NO: 94131 - protein, 10 aa, Homo sapiens
  Native (MAGC1_HUMAN)
FLAMLKNTVP

SEQ ID NO: 94132 - protein, 8 aa, Homo sapiens
  Native (MAGC1_HUMAN)
EDSMSPLY

SEQ ID NO: 94133 - protein, 11 aa, Homo sapiens
  Native (MAGC1_HUMAN)
EGEDSSDPLQR

SEQ ID NO: 94134 - protein, 11 aa, Homo sapiens
  Native (MAGC1_HUMAN)
LQIPVSSSFSY

SEQ ID NO: 94135 - protein, 9 aa, Homo sapiens
  Native (MAGC1_HUMAN)
IDTTDDSTA

SEQ ID NO: 94136 - protein, 9 aa, Homo sapiens
  Native (MAGC1_HUMAN)
SICSSSTSL

SEQ ID NO: 94137 - protein, 10 aa, Homo sapiens
  Native (MAGC1_HUMAN)
IPVSSSSSST

SEQ ID NO: 94138 - protein, 9 aa, Homo sapiens
  Native (MAGC1_HUMAN)
PESDDTLYP

SEQ ID NO: 94139 - protein, 11 aa, Homo sapiens
  Native (MAGC1_HUMAN)
CPEGEDSQSPL

SEQ ID NO: 94140 - protein, 9 aa, Homo sapiens
  Native (MAGC1_HUMAN)
QFPPQGEDF

SEQ ID NO: 94141 - protein, 10 aa, Homo sapiens
  Native (MAGC1_HUMAN)
NPASSFFSSA

SEQ ID NO: 94142 - protein, 10 aa, Homo sapiens
  Native (MAGC1_HUMAN)
ITKAEMLTNV

SEQ ID NO: 94143 - protein, 9 aa, Homo sapiens
  Native (MAGC1_HUMAN)
RKAREFIEI

SEQ ID NO: 94144 - protein, 9 aa, Homo sapiens
  Native (MAGC1_HUMAN)
SPESAQSTF

SEQ ID NO: 94145 - protein, 9 aa, Homo sapiens
  Native (MAGC1_HUMAN)
SEGEDSSDP

SEQ ID NO: 94146 - protein, 9 aa, Homo sapiens
  Native (MAGC1_HUMAN)
IPVSRSFSS

SEQ ID NO: 94147 - protein, 8 aa, Homo sapiens
  Native (MAGC1_HUMAN)
REVPNSSP

SEQ ID NO: 94148 - protein, 9 aa, Homo sapiens
  Native (MAGC1_HUMAN)
MHSQSPLQS

SEQ ID NO: 94149 - protein, 8 aa, Homo sapiens
  Native (MAGC1_HUMAN)
QSPLQRPV

SEQ ID NO: 94150 - protein, 9 aa, Homo sapiens
  Native (MAGC1_HUMAN)
SPLQNPASS

SEQ ID NO: 94151 - protein, 10 aa, Homo sapiens
  Native (MAGC1_HUMAN)
SSPESTQSPF

SEQ ID NO: 94152 - protein, 9 aa, Homo sapiens
  Native (MAGC1_HUMAN)
SSFPSSTSS

SEQ ID NO: 94153 - protein, 9 aa, Homo sapiens
  Native (MAGC1_HUMAN)
LSPLHFPQF

SEQ ID NO: 94154 - protein, 9 aa, Homo sapiens
  Native (MAGC1_HUMAN)
KDMPTAGMP

SEQ ID NO: 94155 - protein, 9 aa, Homo sapiens
  Native (MAGC1_HUMAN)
PEGMHSQSP

SEQ ID NO: 94156 - protein, 8 aa, Homo sapiens
  Native (MAGC1_HUMAN)
GPRAHSEV

SEQ ID NO: 94157 - protein, 10 aa, Homo sapiens
  Native (MAGC1_HUMAN)
REVPNSSPPR

SEQ ID NO: 94158 - protein, 9 aa, Homo sapiens
  Native (MAGC1_HUMAN)
SSFFSSALL

SEQ ID NO: 94159 - protein, 9 aa, Homo sapiens
  Native (MAGC1_HUMAN)
NSQSSPEGK

SEQ ID NO: 94160 - protein, 9 aa, Homo sapiens
  Native (MAGC1_HUMAN)
SSPECTQST

SEQ ID NO: 94161 - protein, 10 aa, Homo sapiens
  Native (MAGC1_HUMAN)
SQSSPVSSFP

SEQ ID NO: 94162 - protein, 8 aa, Homo sapiens
  Native (MAGC1_HUMAN)
FEGFAQSP

SEQ ID NO: 94163 - protein, 8 aa, Homo sapiens
  Native (MAGC1_HUMAN)
HFAFGEPR

SEQ ID NO: 94164 - protein, 11 aa, Homo sapiens
  Native (MAGC1_HUMAN)
SAASSSTLVSI

SEQ ID NO: 94165 - protein, 8 aa, Homo sapiens
  Native (MAGC1_HUMAN)
LTDSESLI

SEQ ID NO: 94166 - protein, 8 aa, Homo sapiens
  Native (MAGC1_HUMAN)
PVSSFFSY

SEQ ID NO: 94167 - protein, 11 aa, Homo sapiens
  Native (MAGC1_HUMAN)
HSTFEGFPQSL

SEQ ID NO: 94168 - protein, 9 aa, Homo sapiens
  Native (MAGC1_HUMAN)
SPSSSSTLL

SEQ ID NO: 94169 - protein, 9 aa, Homo sapiens
  Native (MAGC1_HUMAN)
GEDSLSPHY

SEQ ID NO: 94170 - protein, 10 aa, Homo sapiens
  Native (MAGC1_HUMAN)
WEDSLSPLHF

SEQ ID NO: 94171 - protein, 11 aa, Homo sapiens
  Native (MAGC1_HUMAN)
SLIESEPLFTY

SEQ ID NO: 94172 - protein, 10 aa, Homo sapiens
  Native (MAGC1_HUMAN)
VSSSSSSTLL

SEQ ID NO: 94173 - protein, 8 aa, Homo sapiens
  Native (MAGC1_HUMAN)
LQIPVSAA

SEQ ID NO: 94174 - protein, 8 aa, Homo sapiens
  Native (MAGC1_HUMAN)
FSSALLSI

SEQ ID NO: 94175 - protein, 11 aa, Homo sapiens
  Native (MAGC1_HUMAN)
SPLQIPVSPSS

SEQ ID NO: 94176 - protein, 9 aa, Homo sapiens
  Native (MAGC1_HUMAN)
GMSQNRLLI

SEQ ID NO: 94177 - protein, 11 aa, Homo sapiens
  Native (MAGC1_HUMAN)
SPVSICSSSTP

SEQ ID NO: 94178 - protein, 8 aa, Homo sapiens
  Native (MAGC1_HUMAN)
AQSTFEGF

SEQ ID NO: 94179 - protein, 10 aa, Homo sapiens
  Native (MAGC1_HUMAN)
WGPRAHSEVI

SEQ ID NO: 94180 - protein, 9 aa, Homo sapiens
  Native (MAGC1_HUMAN)
DSLTDSESL

SEQ ID NO: 94181 - protein, 8 aa, Homo sapiens
  Native (MAGC1_HUMAN)
KDMPTAGM

SEQ ID NO: 94182 - protein, 9 aa, Homo sapiens
  Native (MAGC1_HUMAN)
VQSPLHSPQ

SEQ ID NO: 94183 - protein, 10 aa, Homo sapiens
  Native (MAGC1_HUMAN)
VSSSFSYTLL

SEQ ID NO: 94184 - protein, 9 aa, Homo sapiens
  Native (MAGC1_HUMAN)
REHFAFGEP

SEQ ID NO: 94185 - protein, 9 aa, Homo sapiens
  Native (MAGC1_HUMAN)
SSLSQSSPV

SEQ ID NO: 94186 - protein, 9 aa, Homo sapiens
  Native (MAGC1_HUMAN)
PLQSPVSSF

SEQ ID NO: 94187 - protein, 10 aa, Homo sapiens
  Native (MAGC1_HUMAN)
PESDDTLYPL

SEQ ID NO: 94188 - protein, 9 aa, Homo sapiens
  Native (MAGC1_HUMAN)
TYASEEVIW

SEQ ID NO: 94189 - protein, 9 aa, Homo sapiens
  Native (MAGC1_HUMAN)
LQRPVSSFF

SEQ ID NO: 94190 - protein, 10 aa, Homo sapiens
  Native (MAGC1_HUMAN)
SESLIESEPL

SEQ ID NO: 94191 - protein, 9 aa, Homo sapiens
  Native (MAGC1_HUMAN)
LARFLLLKY

SEQ ID NO: 94192 - protein, 11 aa, Homo sapiens
  Native (MAGC1_HUMAN)
FPVIFRKAREF

SEQ ID NO: 94193 - protein, 10 aa, Homo sapiens
  Native (MAGC1_HUMAN)
SLFQSSPECT

SEQ ID NO: 94194 - protein, 8 aa, Homo sapiens
  Native (MAGC1_HUMAN)
FEGFPQSV

SEQ ID NO: 94195 - protein, 8 aa, Homo sapiens
  Native (MAGC1_HUMAN)
SPLQSPES

SEQ ID NO: 94196 - protein, 10 aa, Homo sapiens
  Native (MAGC1_HUMAN)
SILQSSPESA

SEQ ID NO: 94197 - protein, 10 aa, Homo sapiens
  Native (MAGC1_HUMAN)
SPESPLQSPV

SEQ ID NO: 94198 - protein, 9 aa, Homo sapiens
  Native (MAGC1_HUMAN)
IGVRAGREH

SEQ ID NO: 94199 - protein, 9 aa, Homo sapiens
  Native (MAGC1_HUMAN)
LQIPVSSSF

SEQ ID NO: 94200 - protein, 9 aa, Homo sapiens
  Native (MAGC1_HUMAN)
FPQSLLQIP

SEQ ID NO: 94201 - protein, 11 aa, Homo sapiens
  Native (MAGC1_HUMAN)
SPLQNPASSFF

SEQ ID NO: 94202 - protein, 9 aa, Homo sapiens
  Native (MAGC1_HUMAN)
SSSSSSSTL

SEQ ID NO: 94203 - protein, 9 aa, Homo sapiens
  Native (MAGC1_HUMAN)
SSPESAQST

SEQ ID NO: 94204 - protein, 10 aa, Homo sapiens
  Native (MAGC1_HUMAN)
ASSSTLVSIF

SEQ ID NO: 94205 - protein, 11 aa, Homo sapiens
  Native (MAGC1_HUMAN)
DEKVDELARFL

SEQ ID NO: 94206 - protein, 10 aa, Homo sapiens
  Native (MAGC1_HUMAN)
SSPESAQSAF

SEQ ID NO: 94207 - protein, 10 aa, Homo sapiens
  Native (MAGC1_HUMAN)
LQIPVSSSFS

SEQ ID NO: 94208 - protein, 10 aa, Homo sapiens
  Native (MAGC1_HUMAN)
SSSSSSSTLL

SEQ ID NO: 94209 - protein, 9 aa, Homo sapiens
  Native (MAGC1_HUMAN)
FPSSYKDAL

SEQ ID NO: 94210 - protein, 9 aa, Homo sapiens
  Native (MAGC1_HUMAN)
GVRAGREHF

SEQ ID NO: 94211 - protein, 11 aa, Homo sapiens
  Native (MAGC1_HUMAN)
FPQSPLQGEEF

SEQ ID NO: 94212 - protein, 9 aa, Homo sapiens
  Native (MAGC1_HUMAN)
SEESSSPVD

SEQ ID NO: 94213 - protein, 11 aa, Homo sapiens
  Native (MAGC1_HUMAN)
TLDEKVDELAR

SEQ ID NO: 94214 - protein, 11 aa, Homo sapiens
  Native (MAGC1_HUMAN)
ISQSPPEGEDV

SEQ ID NO: 94215 - protein, 11 aa, Homo sapiens
  Native (MAGC1_HUMAN)
TLYPLQSPQSR

SEQ ID NO: 94216 - protein, 9 aa, Homo sapiens
  Native (MAGC1_HUMAN)
SPLQIPVSR

SEQ ID NO: 94217 - protein, 8 aa, Homo sapiens
  Native (MAGC1_HUMAN)
QNPASSFF

SEQ ID NO: 94218 - protein, 11 aa, Homo sapiens
  Native (MAGC1_HUMAN)
SPLEGEDSLSS

SEQ ID NO: 94219 - protein, 11 aa, Homo sapiens
  Native (MAGC1_HUMAN)
SESPQSCPEGE

SEQ ID NO: 94220 - protein, 9 aa, Homo sapiens
  Native (MAGC1_HUMAN)
SSHESPQSP

SEQ ID NO: 94221 - protein, 9 aa, Homo sapiens
  Native (MAGC1_HUMAN)
SPLQSPVSS

SEQ ID NO: 94222 - protein, 10 aa, Homo sapiens
  Native (MAGC1_HUMAN)
THSPLQIVPS

SEQ ID NO: 94223 - protein, 10 aa, Homo sapiens
  Native (MAGC1_HUMAN)
TTDDSTATES

SEQ ID NO: 94224 - protein, 10 aa, Homo sapiens
  Native (MAGC1_HUMAN)
VSSFFSYTLA

SEQ ID NO: 94225 - protein, 9 aa, Homo sapiens
  Native (MAGC1_HUMAN)
KDVEERAQA

SEQ ID NO: 94226 - protein, 10 aa, Homo sapiens
  Native (MAGC1_HUMAN)
PEGEDVQSPL

SEQ ID NO: 94227 - protein, 10 aa, Homo sapiens
  Native (MAGC1_HUMAN)
SPLHSPQSPP

SEQ ID NO: 94228 - protein, 9 aa, Homo sapiens
  Native (MAGC1_HUMAN)
RTQSTFEGF

SEQ ID NO: 94229 - protein, 10 aa, Homo sapiens
  Native (MAGC1_HUMAN)
RPVSSFFSYT

SEQ ID NO: 94230 - protein, 10 aa, Homo sapiens
  Native (MAGC1_HUMAN)
EVPNSSPPRY

SEQ ID NO: 94231 - protein, 10 aa, Homo sapiens
  Native (MAGC1_HUMAN)
SPLQNPASSF

SEQ ID NO: 94232 - protein, 11 aa, Homo sapiens
  Native (MAGC1_HUMAN)
SPSSSSTLLSL

SEQ ID NO: 94233 - protein, 11 aa, Homo sapiens
  Native (MAGC1_HUMAN)
LHSPQSPPEGM

SEQ ID NO: 94234 - protein, 9 aa, Homo sapiens
  Native (MAGC1_HUMAN)
VLQIPVSAA

SEQ ID NO: 94235 - protein, 9 aa, Homo sapiens
  Native (MAGC1_HUMAN)
GFAQSSLQI

SEQ ID NO: 94236 - protein, 9 aa, Homo sapiens
  Native (MAGC1_HUMAN)
TSSFSSTLL

SEQ ID NO: 94237 - protein, 11 aa, Homo sapiens
  Native (MAGC1_HUMAN)
PQSPLEGEDSL

SEQ ID NO: 94238 - protein, 9 aa, Homo sapiens
  Native (MAGC1_HUMAN)
ILILSIIFI

SEQ ID NO: 94239 - protein, 8 aa, Homo sapiens
  Native (MAGC1_HUMAN)
IKRKVVEF

SEQ ID NO: 94240 - protein, 11 aa, Homo sapiens
  Native (MAGC1_HUMAN)
LLSLFQSFSER

SEQ ID NO: 94241 - protein, 8 aa, Homo sapiens
  Native (MAGC1_HUMAN)
FPQSPLQI

SEQ ID NO: 94242 - protein, 10 aa, Homo sapiens
  Native (MAGC1_HUMAN)
FPQSLLQIPM

SEQ ID NO: 94243 - protein, 9 aa, Homo sapiens
  Native (MAGC1_HUMAN)
FFSYTLASL

SEQ ID NO: 94244 - protein, 10 aa, Homo sapiens
  Native (MAGC1_HUMAN)
GVRAGREHFA

SEQ ID NO: 94245 - protein, 11 aa, Homo sapiens
  Native (MAGC1_HUMAN)
FLWGPRAHSEV

SEQ ID NO: 94246 - protein, 11 aa, Homo sapiens
  Native (MAGC1_HUMAN)
SERTQSTFEGF

SEQ ID NO: 94247 - protein, 8 aa, Homo sapiens
  Native (MAGC1_HUMAN)
QIPGSPSF

SEQ ID NO: 94248 - protein, 10 aa, Homo sapiens
  Native (MAGC1_HUMAN)
ENTHSPLQIV

SEQ ID NO: 94249 - protein, 10 aa, Homo sapiens
  Native (MAGC1_HUMAN)
SFSSTLLSIF

SEQ ID NO: 94250 - protein, 9 aa, Homo sapiens
  Native (MAGC1_HUMAN)
SPLQRPVSS

SEQ ID NO: 94251 - protein, 9 aa, Homo sapiens
  Native (MAGC1_HUMAN)
SSSESPQSC

SEQ ID NO: 94252 - protein, 8 aa, Homo sapiens
  Native (MAGC1_HUMAN)
FPPQGEDF

SEQ ID NO: 94253 - protein, 10 aa, Homo sapiens
  Native (MAGC1_HUMAN)
PVSPSSSSTL

SEQ ID NO: 94254 - protein, 9 aa, Homo sapiens
  Native (MAGC1_HUMAN)
LILILSIIF

SEQ ID NO: 94255 - protein, 11 aa, Homo sapiens
  Native (MAGC1_HUMAN)
EWEDSLSPLHF

SEQ ID NO: 94256 - protein, 9 aa, Homo sapiens
  Native (MAGC1_HUMAN)
TLLSILQSS

SEQ ID NO: 94257 - protein, 9 aa, Homo sapiens
  Native (MAGC1_HUMAN)
SFSSTLLSI

SEQ ID NO: 94258 - protein, 8 aa, Homo sapiens
  Native (MAGC1_HUMAN)
QSSPVSSF

SEQ ID NO: 94259 - protein, 10 aa, Homo sapiens
  Native (MAGC1_HUMAN)
WEDSLSPHYF

SEQ ID NO: 94260 - protein, 11 aa, Homo sapiens
  Native (MAGC1_HUMAN)
VPNSSPPRYEF

SEQ ID NO: 94261 - protein, 10 aa, Homo sapiens
  Native (MAGC1_HUMAN)
PESPLQSPVI

SEQ ID NO: 94262 - protein, 10 aa, Homo sapiens
  Native (MAGC1_HUMAN)
SPQGEDSLSP

SEQ ID NO: 94263 - protein, 10 aa, Homo sapiens
  Native (MAGC1_HUMAN)
VEFLAMLKNT

SEQ ID NO: 94264 - protein, 11 aa, Homo sapiens
  Native (MAGC1_HUMAN)
SPLQIPVSSSF

SEQ ID NO: 94265 - protein, 9 aa, Homo sapiens
  Native (MAGC1_HUMAN)
ATESASSSV

SEQ ID NO: 94266 - protein, 10 aa, Homo sapiens
  Native (MAGC1_HUMAN)
STLLSLFQSF

SEQ ID NO: 94267 - protein, 10 aa, Homo sapiens
  Native (MAGC1_HUMAN)
DEKVDELARF

SEQ ID NO: 94268 - protein, 9 aa, Homo sapiens
  Native (MAGC1_HUMAN)
GDKDMPTAG

SEQ ID NO: 94269 - protein, 10 aa, Homo sapiens
  Native (MAGC1_HUMAN)
FIEILFGISL

SEQ ID NO: 94270 - protein, 9 aa, Homo sapiens
  Native (MAGC1_HUMAN)
TLVSIFQSS

SEQ ID NO: 94271 - protein, 11 aa, Homo sapiens
  Native (MAGC1_HUMAN)
ISRYTGYFPVI

SEQ ID NO: 94272 - protein, 8 aa, Homo sapiens
  Native (MAGC1_HUMAN)
GEDSMSPL

SEQ ID NO: 94273 - protein, 8 aa, Homo sapiens
  Native (MAGC1_HUMAN)
EGFPQSLL

SEQ ID NO: 94274 - protein, 10 aa, Homo sapiens
  Native (MAGC1_HUMAN)
SFFSSALLSI

SEQ ID NO: 94275 - protein, 9 aa, Homo sapiens
  Native (MAGC1_HUMAN)
VSAASSSTL

SEQ ID NO: 94276 - protein, 10 aa, Homo sapiens
  Native (MAGC1_HUMAN)
WVQEHYLEYR

SEQ ID NO: 94277 - protein, 9 aa, Homo sapiens
  Native (MAGC1_HUMAN)
VPITFPSSY

SEQ ID NO: 94278 - protein, 8 aa, Homo sapiens
  Native (MAGC1_HUMAN)
SSTLLSLF

SEQ ID NO: 94279 - protein, 11 aa, Homo sapiens
  Native (MAGC1_HUMAN)
DELARFLLLKY

SEQ ID NO: 94280 - protein, 9 aa, Homo sapiens
  Native (MAGC1_HUMAN)
SSSDTLLES

SEQ ID NO: 94281 - protein, 9 aa, Homo sapiens
  Native (MAGC1_HUMAN)
PEGEDVQSP

SEQ ID NO: 94282 - protein, 9 aa, Homo sapiens
  Native (MAGC1_HUMAN)
STQSPFEGF

SEQ ID NO: 94283 - protein, 11 aa, Homo sapiens
  Native (MAGC1_HUMAN)
FIEILFGISLR

SEQ ID NO: 94284 - protein, 11 aa, Homo sapiens
  Native (MAGC1_HUMAN)
SPPEGENTHSP

SEQ ID NO: 94285 - protein, 10 aa, Homo sapiens
  Native (MAGC1_HUMAN)
RAGREHFAFG

SEQ ID NO: 94286 - protein, 9 aa, Homo sapiens
  Native (MAGC1_HUMAN)
PITFPSSYK

SEQ ID NO: 94287 - protein, 8 aa, Homo sapiens
  Native (MAGC1_HUMAN)
VPITFPSS

SEQ ID NO: 94288 - protein, 9 aa, Homo sapiens
  Native (MAGC1_HUMAN)
EILFGISLR

SEQ ID NO: 94289 - protein, 11 aa, Homo sapiens
  Native (MAGC1_HUMAN)
AEMLTNVISRY

SEQ ID NO: 94290 - protein, 10 aa, Homo sapiens
  Native (MAGC1_HUMAN)
PQFPPQGEDF

SEQ ID NO: 94291 - protein, 8 aa, Homo sapiens
  Native (MAGC1_HUMAN)
FSSTLVSL

SEQ ID NO: 94292 - protein, 8 aa, Homo sapiens
  Native (MAGC1_HUMAN)
SSTSLSPF

SEQ ID NO: 94293 - protein, 8 aa, Homo sapiens
  Native (MAGC1_HUMAN)
SSSTLLSL

SEQ ID NO: 94294 - protein, 8 aa, Homo sapiens
  Native (MAGC1_HUMAN)
LYFPQSPL

SEQ ID NO: 94295 - protein, 11 aa, Homo sapiens
  Native (MAGC1_HUMAN)
HESPQSPPEGP

SEQ ID NO: 94296 - protein, 9 aa, Homo sapiens
  Native (MAGC1_HUMAN)
EYTSSSDTL

SEQ ID NO: 94297 - protein, 9 aa, Homo sapiens
  Native (MAGC1_HUMAN)
DVLSGIGVR

SEQ ID NO: 94298 - protein, 9 aa, Homo sapiens
  Native (MAGC1_HUMAN)
PEWEDSLSP

SEQ ID NO: 94299 - protein, 10 aa, Homo sapiens
  Native (MAGC1_HUMAN)
PSSSSTLLSL

SEQ ID NO: 94300 - protein, 8 aa, Homo sapiens
  Native (MAGC1_HUMAN)
SAASSSTL

SEQ ID NO: 94301 - protein, 10 aa, Homo sapiens
  Native (MAGC1_HUMAN)
SPLQIVPSLP

SEQ ID NO: 94302 - protein, 11 aa, Homo sapiens
  Native (MAGC1_HUMAN)
FPESSQSPPEG

SEQ ID NO: 94303 - protein, 11 aa, Homo sapiens
  Native (MAGC1_HUMAN)
SSSSSSTLLSL

SEQ ID NO: 94304 - protein, 11 aa, Homo sapiens
  Native (MAGC1_HUMAN)
SPESDDTLYPL

SEQ ID NO: 94305 - protein, 9 aa, Homo sapiens
  Native (MAGC1_HUMAN)
SAFEGFPQS

SEQ ID NO: 94306 - protein, 10 aa, Homo sapiens
  Native (MAGC1_HUMAN)
YASEEVIWDV

SEQ ID NO: 94307 - protein, 11 aa, Homo sapiens
  Native (MAGC1_HUMAN)
FPQSPLQIPGS

SEQ ID NO: 94308 - protein, 10 aa, Homo sapiens
  Native (MAGC1_HUMAN)
SPLQIPVSPS

SEQ ID NO: 94309 - protein, 9 aa, Homo sapiens
  Native (MAGC1_HUMAN)
YREVPNSSP

SEQ ID NO: 94310 - protein, 9 aa, Homo sapiens
  Native (MAGC1_HUMAN)
DSYVFVNTL

SEQ ID NO: 94311 - protein, 9 aa, Homo sapiens
  Native (MAGC1_HUMAN)
LKYQVKQPI

SEQ ID NO: 94312 - protein, 11 aa, Homo sapiens
  Native (MAGC1_HUMAN)
GENTHSPLQIV

SEQ ID NO: 94313 - protein, 9 aa, Homo sapiens
  Native (MAGC1_HUMAN)
RFLLLKYQV

SEQ ID NO: 94314 - protein, 10 aa, Homo sapiens
  Native (MAGC1_HUMAN)
PPEGPVQSPL

SEQ ID NO: 94315 - protein, 8 aa, Homo sapiens
  Native (MAGC1_HUMAN)
TAGMPSLL

SEQ ID NO: 94316 - protein, 9 aa, Homo sapiens
  Native (MAGC1_HUMAN)
GPVQSPLHS

SEQ ID NO: 94317 - protein, 10 aa, Homo sapiens
  Native (MAGC1_HUMAN)
SQNRLLILIL

SEQ ID NO: 94318 - protein, 8 aa, Homo sapiens
  Native (MAGC1_HUMAN)
FPQSLLQI

SEQ ID NO: 94319 - protein, 11 aa, Homo sapiens
  Native (MAGC1_HUMAN)
FPSSTSSSLSQ

SEQ ID NO: 94320 - protein, 9 aa, Homo sapiens
  Native (MAGC1_HUMAN)
LSDEQGMSQ

SEQ ID NO: 94321 - protein, 10 aa, Homo sapiens
  Native (MAGC1_HUMAN)
SLFQSSPERT

SEQ ID NO: 94322 - protein, 9 aa, Homo sapiens
  Native (MAGC1_HUMAN)
GEDSLSPLQ

SEQ ID NO: 94323 - protein, 11 aa, Homo sapiens
  Native (MAGC1_HUMAN)
SPLQIPVSSSS

SEQ ID NO: 94324 - protein, 10 aa, Homo sapiens
  Native (MAGC1_HUMAN)
MTSSFSSTLL

SEQ ID NO: 94325 - protein, 9 aa, Homo sapiens
  Native (MAGC1_HUMAN)
QGEDFQSSL

SEQ ID NO: 94326 - protein, 11 aa, Homo sapiens
  Native (MAGC1_HUMAN)
SQSPLQSPESA

SEQ ID NO: 94327 - protein, 10 aa, Homo sapiens
  Native (MAGC1_HUMAN)
TFEGFAQSPL

SEQ ID NO: 94328 - protein, 8 aa, Homo sapiens
  Native (MAGC1_HUMAN)
SYVFVNTL

SEQ ID NO: 94329 - protein, 9 aa, Homo sapiens
  Native (MAGC1_HUMAN)
SPSFSSTLV

SEQ ID NO: 94330 - protein, 9 aa, Homo sapiens
  Native (MAGC1_HUMAN)
SPPQGEDSM

SEQ ID NO: 94331 - protein, 8 aa, Homo sapiens
  Native (MAGC1_HUMAN)
SPESAQSA

SEQ ID NO: 94332 - protein, 9 aa, Homo sapiens
  Native (MAGC1_HUMAN)
SPESAQSAF

SEQ ID NO: 94333 - protein, 10 aa, Homo sapiens
  Native (MAGC1_HUMAN)
REVDPDDSYV

SEQ ID NO: 94334 - protein, 8 aa, Homo sapiens
  Native (MAGC1_HUMAN)
AGREHFAF

SEQ ID NO: 94335 - protein, 11 aa, Homo sapiens
  Native (MAGC1_HUMAN)
LPQSFPESPQS

SEQ ID NO: 94336 - protein, 9 aa, Homo sapiens
  Native (MAGC1_HUMAN)
REVDPDDSY

SEQ ID NO: 94337 - protein, 8 aa, Artificial Sequence
  Description of Artificial Sequence: Synthetic peptide
  Seed: AASSSTLV (MAGC1_HUMAN)
  misc_feature (2)..(2): Xaa can be Ala, Ser, or Thr
  misc_feature (8)..(8): Xaa can be Phe, Met, Ile, Leu, Tyr, or Val
AXSSSTLX

SEQ ID NO: 94338 - protein, 9 aa, Artificial Sequence
  Description of Artificial Sequence: Synthetic peptide
  Seed: AASSSTLVS (MAGC1_HUMAN)
  misc_feature (2)..(2): Xaa can be Ala, Thr, Ser, Ile, Val, Gln, Gly, Met, Leu, Asn, Glu, Cys, Pro, Phe, Asp, Lys, or Tyr
  misc_feature (9)..(9): Xaa can be Tyr, Phe, Met, Leu, His, Ile, Val, Trp, Ala, Ser, Pro, Lys, Asn, Gln, Cys, Gly, Arg, or Th r
AXSSSTLVX

SEQ ID NO: 94339 - protein, 10 aa, Artificial Sequence
  Description of Artificial Sequence: Synthetic peptide
  Seed: AASSSTLVSI (MAGC1_HUMAN)
  misc_feature (2)..(2): Xaa can be Ala, Gln, Met, Leu, Val, Ile, Ser, Thr, Gly, Glu, Pro, Asn, Arg, Cys, Phe, Tyr, Asp, His, Lys, or Trp
  misc_feature (10)..(10): Xaa can be Trp, Phe, Leu, Tyr, Met, Val, Lys, Ile, Arg, His, Ala, Thr, Cys, or Gln
AXSSSTLVSX

SEQ ID NO: 94340 - protein, 11 aa, Artificial Sequence
  Description of Artificial Sequence: Synthetic peptide
  Seed: AASSSTLVSIF (MAGC1_HUMAN)
  misc_feature (2)..(2): Xaa can be Ala, Thr, Ser, Val, Ile, Gly, Gln, Met, Leu, Asn, Glu, Lys, Cys, Asp, Tyr, Pro, His, Arg, Trp, or Phe
  misc_feature (11)..(11): Xaa can be Phe, Trp, Tyr, Lys, Arg, Met, Leu, His, Ile, or Val
AXSSSTLVSIX

SEQ ID NO: 94341 - protein, 8 aa, Artificial Sequence
  Description of Artificial Sequence: Synthetic peptide
  Seed: AEMLTNVI (MAGC1_HUMAN)
  misc_feature (2)..(2): Xaa can be Glu, Asp, Gln, Ser, Met, Gly, Ala, Asn, Ile, Val, Leu, Thr, or Pro
  misc_feature (8)..(8): Xaa can be Ile, Val, Leu, Phe, Trp, Met, Cys, Tyr, Ala, His, Gly, Ser, Pro, or Thr
AXMLTNVX

SEQ ID NO: 94342 - protein, 9 aa, Artificial Sequence
  Description of Artificial Sequence: Synthetic peptide
  Seed: AEMLTNVIS (MAGC1_HUMAN)
  misc_feature (2)..(2): Xaa can be Glu, Asp, or Gln
  misc_feature (9)..(9): Xaa can be Cys, Leu, Phe, Ile, Val, Ala, Pro, Met, Ser, Thr, Gly, Glu, His, Lys, Trp, Tyr, Arg, Gln, Asn, or Asp
AXMLTNVIX

SEQ ID NO: 94343 - protein, 10 aa, Artificial Sequence
  Description of Artificial Sequence: Synthetic peptide
  Seed: AEMLTNVISR (MAGC1_HUMAN)
  misc_feature (2)..(2): Xaa can be Glu, Gln, Asp, Arg, Met, Val, His, Tyr, Leu, Gly, Ser, Cys, Pro, Asn, Phe, Ile, Lys, Trp, Thr, or Ala
  misc_feature (10)..(10): Xaa can be Lys, Arg, Tyr, Phe, Trp, Met, Leu, Ala, Val, His, Ile, or Cys
AXMLTNVISX

SEQ ID NO: 94344 - protein, 11 aa, Artificial Sequence
  Description of Artificial Sequence: Synthetic peptide
  Seed: AEMLTNVISRY (MAGC1_HUMAN)
  misc_feature (2)..(2): Xaa can be Glu, Gln, Met, Asp, Ser, Ile, Lys, Thr, Leu, Ala, Val, Pro, Arg, Gly, or His
  misc_feature (11)..(11): Xaa can be Tyr, Phe, Met, Trp, Leu, Ile, His, Cys, or Val
AXMLTNVISRX

SEQ ID NO: 94345 - protein, 10 aa, Artificial Sequence
  Description of Artificial Sequence: Synthetic peptide
  Seed: AFEGFPQSPL (MAGC1_HUMAN)
  misc_feature (2)..(2): Xaa can be Glu, Trp, Phe, Arg, Tyr, Gln, Met, Ile, Leu, Ser, Asn, Gly, Thr, Pro, Asp, His, Cys, Ala, Val, or Lys
  misc_feature (10)..(10): Xaa can be Met, Leu, Phe, Ile, Tyr, or Val
AXEGFPQSPX

SEQ ID NO: 94346 - protein, 8 aa, Artificial Sequence
  Description of Artificial Sequence: Synthetic peptide
  Seed: AFGEPREL (MAGC1_HUMAN)
  misc_feature (2)..(2): Xaa can be Ala, Ile, Ser, Val, Thr, Gly, Leu, Tyr, Gln, Phe, Arg, Trp, His, Asn, Cys, Met, Glu, Pro, Lys, or Asp
  misc_feature (8)..(8): Xaa can be Leu, Met, Ile, Phe, Tyr, Val, Lys, Trp, Arg, His, or Ala
AXGEPREX

SEQ ID NO: 94347 - protein, 9 aa, Artificial Sequence
  Description of Artificial Sequence: Synthetic peptide
  Seed: AFGEPRELL (MAGC1_HUMAN)
  misc_feature (2)..(2): Xaa can be Ala, Arg, Tyr, Phe, Ile, Met, Val, Ser, Thr, Gln, Leu, Asn, Glu, Gly, Trp, Cys, His, Lys, Asp, or Pro
  misc_feature (9)..(9): Xaa can be Leu, Met, Phe, Val, Tyr, Ile, Lys, Arg, Trp, His, Cys, or Ala
AXGEPRELX

SEQ ID NO: 94348 - protein, 11 aa, Artificial Sequence
  Description of Artificial Sequence: Synthetic peptide
  Seed: AFGEPRELLTK (MAGC1_HUMAN)
  misc_feature (2)..(2): Xaa can be Leu, Met, Ile, Ser, Phe, Ala, Thr, Gln, Val, or Gly
  misc_feature (11)..(11): Xaa can be Arg, Lys, Tyr, or Leu
AXGEPRELLTX

SEQ ID NO: 94349 - protein, 8 aa, Artificial Sequence
  Description of Artificial Sequence: Synthetic peptide
  Seed: AGREHFAF (MAGC1_HUMAN)
  misc_feature (2)..(2): Xaa can be Ala, Ser, Gly, Thr, Val, Phe, or Ile
  misc_feature (8)..(8): Xaa can be Leu, Tyr, Phe, Met, Ile, Val, or Trp
AXREHFAX

SEQ ID NO: 94350 - protein, 9 aa, Artificial Sequence
  Description of Artificial Sequence: Synthetic peptide
  Seed: AGREHFAFG (MAGC1_HUMAN)
  misc_feature (2)..(2): Xaa can be Thr, Val, Ser, Ile, Ala, Met, Gln, Leu, Tyr, Phe, Gly, Trp, Asn, Cys, Lys, Arg, His, Glu, Pro, or Asp
  misc_feature (9)..(9): Xaa can be Lys, Ala, Arg, Tyr, Ile, Val, Leu, Met, Pro, Thr, His, Phe, Ser, Gly, Gln, Cys, Asn, Glu, Trp, or Asp
AXREHFAFX

SEQ ID NO: 94351 - protein, 10 aa, Artificial Sequence
  Description of Artificial Sequence: Synthetic peptide
  Seed: AHSEVIKRKV (MAGC1_HUMAN)
  misc_feature (2)..(2): Xaa can be , or His
  misc_feature (10)..(10): Xaa can be Phe, Trp, Leu, Met, Ala, Val, Cys, or Ile
AXSEVIKRKX

SEQ ID NO: 94352 - protein, 11 aa, Artificial Sequence
  Description of Artificial Sequence: Synthetic peptide
  Seed: AIIDTTDDSTA (MAGC1_HUMAN)
  misc_feature (2)..(2): Xaa can be Met, Leu, Ile, Val, Gln, Thr, Ala, Ser, or Cys
  misc_feature (11)..(11): Xaa can be Leu, Val, Ile, Met, Ala, Phe, Thr, Cys, or Tyr
AXIDTTDDSTX

SEQ ID NO: 94353 - protein, 8 aa, Artificial Sequence
  Description of Artificial Sequence: Synthetic peptide
  Seed: ALKDVEER (MAGC1_HUMAN)
  misc_feature (2)..(2): Xaa can be Ala, Thr, Ser, Val, Met, Leu, Ile, Gln, Gly, Asn, Phe, Glu, Asp, Cys, or Pro
  misc_feature (8)..(8): Xaa can be Tyr, Lys, Arg, Phe, Leu, Met, His, Ile, Val, Trp, or Ala
AXKDVEEX

SEQ ID NO: 94354 - protein, 9 aa, Artificial Sequence
  Description of Artificial Sequence: Synthetic peptide
  Seed: ALKDVEERA (MAGC1_HUMAN)
  misc_feature (2)..(2): Xaa can be Gln, Met, Leu, Val, Ile, Glu, Ala, Thr, Ser, Asn, Lys, Gly, Asp, or His
  misc_feature (9)..(9): Xaa can be Val, Ile, Leu, Met, Phe, Ala, Trp, Thr, Cys, or Tyr
AXKDVEERX

SEQ ID NO: 94355 - protein, 11 aa, Artificial Sequence
  Description of Artificial Sequence: Synthetic peptide
  Seed: ALKDVEERAQA (MAGC1_HUMAN)
  misc_feature (2)..(2): Xaa can be Leu, Met, Ile, Val, or Gln
  misc_feature (11)..(11): Xaa can be Val, Ile, Leu, Met, or Ala
AXKDVEERAQX

SEQ ID NO: 94356 - protein, 9 aa, Artificial Sequence
  Description of Artificial Sequence: Synthetic peptide
  Seed: ALLSIFQSS (MAGC1_HUMAN)
  misc_feature (2)..(2): Xaa can be Leu, Met, Gln, Ile, Val, Thr, Ser, Ala, Asn, Gly, Phe, Cys, Glu, Asp, or Tyr
  misc_feature (9)..(9): Xaa can be Val, Leu, Ile, Ala, Met, Thr, Cys, Phe, Ser, Gly, Lys, Arg, or Tyr
AXLSIFQSX

SEQ ID NO: 94357 - protein, 9 aa, Artificial Sequence
  Description of Artificial Sequence: Synthetic peptide
  Seed: AMLKNTVPI (MAGC1_HUMAN)
  misc_feature (2)..(2): Xaa can be Gln, Met, Leu, Val, Ala, Ile, Ser, Glu, Thr, Lys, Gly, Asn, His, Arg, Phe, Tyr, Asp, Cys, Trp, or Pro
  misc_feature (9)..(9): Xaa can be Phe, Tyr, Met, Arg, Val, Trp, Ile, Lys, Leu, His, Ala, Thr, Cys, Ser, or Gly
AXLKNTVPX

SEQ ID NO: 94358 - protein, 10 aa, Artificial Sequence
  Description of Artificial Sequence: Synthetic peptide
  Seed: AMLKNTVPIT (MAGC1_HUMAN)
  misc_feature (2)..(2): Xaa can be Leu, Met, Gln, Ile, Val, Tyr, Phe, His, Lys, Pro, Asn, Asp, Thr, Trp, Cys, Arg, Glu, Ala, Ser, or Gly
  misc_feature (10)..(10): Xaa can be Val, Leu, Ile, Ala, Thr, Met, Phe, Ser, Cys, Asn, Lys, Trp, Glu, Arg, Asp, Gly, Tyr, Gln, Pro, or His
AXLKNTVPIX

SEQ ID NO: 94359 - protein, 11 aa, Artificial Sequence
  Description of Artificial Sequence: Synthetic peptide
  Seed: AMLKNTVPITF (MAGC1_HUMAN)
  misc_feature (2)..(2): Xaa can be Gln, Thr, Ser, Tyr, Phe, Ala, Met, Trp, Ile, Leu, Glu, Val, Lys, Gly, Asn, Cys, Pro, His, Arg, or Asp
  misc_feature (11)..(11): Xaa can be Tyr, Phe, Trp, Leu, Ile, Met, Val, Cys, or His
AXLKNTVPITX

SEQ ID NO: 94360 - protein, 11 aa, Artificial Sequence
  Description of Artificial Sequence: Synthetic peptide
  Seed: APEGEDSLSPL (MAGC1_HUMAN)
  misc_feature (2)..(2): Xaa can be Pro, or Ala
  misc_feature (11)..(11): Xaa can be Tyr, Ile, Cys, Met, Val, Phe, Leu, Ala, or Trp
AXEGEDSLSPX

SEQ ID NO: 94361 - protein, 8 aa, Artificial Sequence
  Description of Artificial Sequence: Synthetic peptide
  Seed: AQSAFEGF (MAGC1_HUMAN)
  misc_feature (2)..(2): Xaa can be Gln, or Met
  misc_feature (8)..(8): Xaa can be Phe, Tyr, or Met
AXSAFEGX

SEQ ID NO: 94362 - protein, 9 aa, Artificial Sequence
  Description of Artificial Sequence: Synthetic peptide
  Seed: AQSPLQIPV (MAGC1_HUMAN)
  misc_feature (2)..(2): Xaa can be Glu, Arg, Gln, His, Asp, Met, Leu, Ser, Ala, Val, Ile, Thr, Lys, Tyr, Pro, Asn, Gly, Cys, Phe, or Trp
  misc_feature (9)..(9): Xaa can be Met, Phe, Tyr, Leu, Val, Ile, Trp, Ala, His, Cys, Thr, Ser, Gly, Pro, Arg, Lys, Gln, Glu, Asp, or Asn
AXSPLQIPX

SEQ ID NO: 94363 - protein, 9 aa, Artificial Sequence
  Description of Artificial Sequence: Synthetic peptide
  Seed: AQSPLQRPV (MAGC1_HUMAN)
  misc_feature (2)..(2): Xaa can be Glu, Ala, His, Arg, Asp, Gln, Leu, Met, Ile, Ser, Val, Thr, Lys, Tyr, Asn, Gly, Cys, Phe, Pro, or Trp
  misc_feature (9)..(9): Xaa can be Met, Leu, Phe, Tyr, Ile, Val, Trp, Ala, His, Thr, Cys, Pro, Ser, Gly, Arg, Gln, Lys, Glu, Asp, or Asn
AXSPLQRPX

SEQ ID NO: 94364 - protein, 9 aa, Artificial Sequence
  Description of Artificial Sequence: Synthetic peptide
  Seed: AQSPLQSPV (MAGC1_HUMAN)
  misc_feature (2)..(2): Xaa can be Glu, Gln, Leu, Met, His, Asp, Arg, Ala, Ile, Val, Lys, Thr, Ser, Asn, Cys, Tyr, Pro, Gly, Phe, or Trp
  misc_feature (9)..(9): Xaa can be Leu, Phe, Tyr, Met, Val, Ile, Ala, Trp, Thr, His, Cys, Pro, Ser, Gly, Lys, Asp, Glu, Gln, Asn, or Arg
AXSPLQSPX

SEQ ID NO: 94365 - protein, 9 aa, Artificial Sequence
  Description of Artificial Sequence: Synthetic peptide
  Seed: AQSSLQIPV (MAGC1_HUMAN)
  misc_feature (2)..(2): Xaa can be Glu, Gln, Leu, Met, His, Asp, Arg, Ile, Ala, Val, Lys, Thr, Asn, Ser, Gly, Phe, Tyr, Pro, Cys, or Trp
  misc_feature (9)..(9): Xaa can be Phe, Tyr, Met, Leu, Val, Ile, Trp, Ala, Thr, Cys, Gly, His, Pro, Ser, Glu, Asp, Asn, Lys, Arg, or Gln
AXSSLQIPX

SEQ ID NO: 94366 - protein, 8 aa, Artificial Sequence
  Description of Artificial Sequence: Synthetic peptide
  Seed: AQSTFEGF (MAGC1_HUMAN)
  misc_feature (2)..(2): Xaa can be Met, or Gln
  misc_feature (8)..(8): Xaa can be Tyr, or Phe
AXSTFEGX

SEQ ID NO: 94367 - protein, 8 aa, Artificial Sequence
  Description of Artificial Sequence: Synthetic peptide
  Seed: AREFIEIL (MAGC1_HUMAN)
  misc_feature (2)..(2): Xaa can be , or Arg
  misc_feature (8)..(8): Xaa can be , or Leu
AXEFIEIX

SEQ ID NO: 94368 - protein, 9 aa, Artificial Sequence
  Description of Artificial Sequence: Synthetic peptide
  Seed: AREFIEILF (MAGC1_HUMAN)
  misc_feature (2)..(2): Xaa can be Arg, His, Gln, Glu, Tyr, Phe, Met, Lys, Ala, Ser, Trp, Thr, Gly, or Asn
  misc_feature (9)..(9): Xaa can be Leu, Met, Phe, Tyr, Ile, Trp, Arg, Lys, Val, Cys, Gln, Ala, or His
AXEFIEILX

SEQ ID NO: 94369 - protein, 11 aa, Artificial Sequence
  Description of Artificial Sequence: Synthetic peptide
  Seed: AREFIEILFGI (MAGC1_HUMAN)
  misc_feature (2)..(2): Xaa can be , or Arg
  misc_feature (11)..(11): Xaa can be Met, Phe, Ile, Tyr, Lys, Val, Leu, Arg, or Ala
AXEFIEILFGX

SEQ ID NO: 94370 - protein, 8 aa, Artificial Sequence
  Description of Artificial Sequence: Synthetic peptide
  Seed: ARFLLLKY (MAGC1_HUMAN)
  misc_feature (2)..(2): Xaa can be Arg, Gln, His, Tyr, Glu, Lys, Met, Ala, Ser, Val, Pro, Gly, Leu, Asn, Ile, or Thr
  misc_feature (8)..(8): Xaa can be Tyr, Phe, Leu, Met, His, Trp, Val, Ile, Arg, or Lys
AXFLLLKX

SEQ ID NO: 94371 - protein, 9 aa, Artificial Sequence
  Description of Artificial Sequence: Synthetic peptide
  Seed: ARFLLLKYQ (MAGC1_HUMAN)
  misc_feature (2)..(2): Xaa can be Arg, or Gln
  misc_feature (9)..(9): Xaa can be Leu, Trp, His, Met, Ala, Val, Phe, Lys, Gln, Arg, Ile, Tyr, Thr, or Cys
AXFLLLKYX

SEQ ID NO: 94372 - protein, 10 aa, Artificial Sequence
  Description of Artificial Sequence: Synthetic peptide
  Seed: ARFLLLKYQV (MAGC1_HUMAN)
  misc_feature (2)..(2): Xaa can be Arg, Gln, or Lys
  misc_feature (10)..(10): Xaa can be Leu, Gln, Arg, Ile, Thr, His, Phe, Met, Val, Tyr, Ala, Ser, Asn, Cys, Gly, Trp, or Lys
AXFLLLKYQX

SEQ ID NO: 94373 - protein, 11 aa, Artificial Sequence
  Description of Artificial Sequence: Synthetic peptide
  Seed: ARFLLLKYQVK (MAGC1_HUMAN)
  misc_feature (2)..(2): Xaa can be , or Arg
  misc_feature (11)..(11): Xaa can be Trp, His, Arg, Met, Lys, Ile, Leu, Phe, or Tyr
AXFLLLKYQVX

SEQ ID NO: 94374 - protein, 9 aa, Artificial Sequence
  Description of Artificial Sequence: Synthetic peptide
  Seed: ASEEVIWDV (MAGC1_HUMAN)
  misc_feature (2)..(2): Xaa can be Leu, Met, Val, Ile, Ala, Thr, Gln, Phe, Ser, Cys, Gly, Tyr, Trp, or Asn
  misc_feature (9)..(9): Xaa can be Leu, Met, Val, Ile, Phe, Ala, Thr, Cys, or Ser
AXEEVIWDX

SEQ ID NO: 94375 - protein, 10 aa, Artificial Sequence
  Description of Artificial Sequence: Synthetic peptide
  Seed: ASEEVIWDVL (MAGC1_HUMAN)
  misc_feature (2)..(2): Xaa can be Glu, Ala, Thr, Ser, Arg, Gln, Cys, Ile, Tyr, Val, Gly, Phe, His, Asp, Met, Asn, Pro, Trp, Lys, or Leu
  misc_feature (10)..(10): Xaa can be Met, Leu, Phe, Val, Ala, or Ile
AXEEVIWDVX

SEQ ID NO: 94376 - protein, 9 aa, Artificial Sequence
  Description of Artificial Sequence: Synthetic peptide
  Seed: ASSFFSSAL (MAGC1_HUMAN)
  misc_feature (2)..(2): Xaa can be Gln, Ala, Leu, Met, Tyr, Val, Gly, Ile, Thr, Lys, Phe, Ser, Glu, Arg, His, Asn, Trp, Pro, Cys, or Asp
  misc_feature (9)..(9): Xaa can be Leu, Phe, Tyr, Trp, Met, Val, Ile, His, Ala, Thr, Cys, Gly, Lys, Pro, Ser, Gln, Arg, or As n
AXSFFSSAX

SEQ ID NO: 94377 - protein, 10 aa, Artificial Sequence
  Description of Artificial Sequence: Synthetic peptide
  Seed: ASSFFSSALL (MAGC1_HUMAN)
  misc_feature (2)..(2): Xaa can be Thr, Tyr, Ile, Asn, Val, Ala, Ser, Glu, His, Leu, Gln, Met, Phe, Gly, Asp, Cys, Lys, Trp, Pro, or Arg
  misc_feature (10)..(10): Xaa can be Leu, Tyr, Ile, Phe, Trp, Val, Met, or Ala
AXSFFSSALX

SEQ ID NO: 94378 - protein, 9 aa, Artificial Sequence
  Description of Artificial Sequence: Synthetic peptide
  Seed: ASSSTLVSI (MAGC1_HUMAN)
  misc_feature (2)..(2): Xaa can be Ala, Leu, Met, Gln, Val, Thr, Ile, Ser, Pro, Glu, Gly, Asn, Cys, Phe, Arg, Asp, His, Tyr, Lys, or Trp
  misc_feature (9)..(9): Xaa can be Leu, Phe, Trp, Tyr, Met, Ile, Val, Lys, Arg, His, Ala, Cys, Thr, Ser, Gly, Asn, Pro, or Gl n
AXSSTLVSX

SEQ ID NO: 94379 - protein, 10 aa, Artificial Sequence
  Description of Artificial Sequence: Synthetic peptide
  Seed: ASSSTLVSIF (MAGC1_HUMAN)
  misc_feature (2)..(2): Xaa can be Ala, Ser, Thr, Val, Gln, Lys, Met, Gly, Phe, His, Tyr, Ile, Leu, Glu, Arg, Cys, Asn, Pro, Asp, or Trp
  misc_feature (10)..(10): Xaa can be Phe, Tyr, Trp, Met, Leu, Lys, His, Ile, Val, or Arg
AXSSTLVSIX

SEQ ID NO: 94380 - protein, 9 aa, Artificial Sequence
  Description of Artificial Sequence: Synthetic peptide
  Seed: ASSSVMSPS (MAGC1_HUMAN)
  misc_feature (2)..(2): Xaa can be Thr, Ser, Val, Ala, Ile, Tyr, Met, Gln, Asn, Cys, Gly, Phe, Trp, or Leu
  misc_feature (9)..(9): Xaa can be Lys, Ala, Val, Ile, Ser, Arg, Leu, Met, Tyr, or Gly
AXSSVMSPX

SEQ ID NO: 94381 - protein, 10 aa, Artificial Sequence
  Description of Artificial Sequence: Synthetic peptide
  Seed: ASSSVMSPSF (MAGC1_HUMAN)
  misc_feature (2)..(2): Xaa can be Ala, Ser, Thr, Gln, Val, Met, Leu, Lys, Gly, Tyr, His, Phe, Trp, Asn, Cys, Glu, Ile, Arg, Asp, or Pro
  misc_feature (10)..(10): Xaa can be Met, Trp, Tyr, Phe, Leu, His, Ile, Val, or Ala
AXSSVMSPSX

SEQ ID NO: 94382 - protein, 9 aa, Artificial Sequence
  Description of Artificial Sequence: Synthetic peptide
  Seed: ATESASSSV (MAGC1_HUMAN)
  misc_feature (2)..(2): Xaa can be Ala, Cys, Val, Leu, Ser, Thr, Ile, Gly, Met, Phe, Trp, Asn, Gln, Tyr, Pro, or Asp
  misc_feature (9)..(9): Xaa can be Leu, Met, Ile, Val, Phe, Cys, or Tyr
AXESASSSX

SEQ ID NO: 94383 - protein, 10 aa, Artificial Sequence
  Description of Artificial Sequence: Synthetic peptide
  Seed: ATESASSSVM (MAGC1_HUMAN)
  misc_feature (2)..(2): Xaa can be Ala, Gly, Val, Ile, Gln, Leu, His, Pro, Glu, Arg, Asn, Ser, Phe, Thr, Trp, Met, Lys, Asp, Cys, or Tyr
  misc_feature (10)..(10): Xaa can be Met, Tyr, Leu, Phe, Trp, Ile, Val, Lys, Arg, or His
AXESASSSVX

SEQ ID NO: 94384 - protein, 11 aa, Artificial Sequence
  Description of Artificial Sequence: Synthetic peptide
  Seed: CPEGEDSQSPL (MAGC1_HUMAN)
  misc_feature (2)..(2): Xaa can be Pro, or Ala
  misc_feature (11)..(11): Xaa can be Phe, Tyr, Ala, Trp, Leu, Val, Ile, or Met
CXEGEDSQSPX

SEQ ID NO: 94385 - protein, 9 aa, Artificial Sequence
  Description of Artificial Sequence: Synthetic peptide
  Seed: CSSSTPSSL (MAGC1_HUMAN)
  misc_feature (2)..(2): Xaa can be Ala, Met, Ser, Gln, Val, Leu, Thr, Ile, Gly, Lys, Phe, Tyr, Arg, Glu, Pro, Asn, Asp, Cys, Trp, or His
  misc_feature (9)..(9): Xaa can be Leu, Phe, Tyr, Met, Trp, Val, Ile, Lys, His, Arg, Ala, Cys, or Thr
CXSSTPSSX

SEQ ID NO: 94386 - protein, 9 aa, Artificial Sequence
  Description of Artificial Sequence: Synthetic peptide
  Seed: CSSSTSLSL (MAGC1_HUMAN)
  misc_feature (2)..(2): Xaa can be Gln, Ala, Arg, Ile, Val, Gly, Lys, Ser, Leu, Met, Thr, His, Glu, Phe, Tyr, Asn, Trp, Pro, Cys, or Asp
  misc_feature (9)..(9): Xaa can be Leu, Trp, Phe, Tyr, Met, Val, Ile, His, Lys, Arg, Ala, Cys, Gly, Ser, or Thr
CXSSTSLSX

SEQ ID NO: 94387 - protein, 9 aa, Artificial Sequence
  Description of Artificial Sequence: Synthetic peptide
  Seed: CTQSTFEGF (MAGC1_HUMAN)
  misc_feature (2)..(2): Xaa can be Thr, Ser, Trp, Gln, Tyr, Ala, Phe, Ile, Val, Met, Leu, Gly, Pro, Asp, Cys, Glu, Asn, Lys, His, or Arg
  misc_feature (9)..(9): Xaa can be Tyr, Phe, Trp, Met, Lys, Leu, Ile, Arg, Val, or His
CXQSTFEGX

SEQ ID NO: 94388 - protein, 9 aa, Artificial Sequence
  Description of Artificial Sequence: Synthetic peptide
  Seed: DALKDVEER (MAGC1_HUMAN)
  misc_feature (2)..(2): Xaa can be Val, Thr, Arg, Ile, Ala, Ser, Met, Gln, Leu, Tyr, Glu, Phe, Gly, Trp, Pro, Asn, Cys, Lys, His, or Asp
  misc_feature (9)..(9): Xaa can be Lys, Arg, Tyr, Phe, Met, Leu, His, Val, Gln, or Ile
DXLKDVEEX

SEQ ID NO: 94389 - protein, 9 aa, Artificial Sequence
  Description of Artificial Sequence: Synthetic peptide
  Seed: DDSTATESA (MAGC1_HUMAN)
  misc_feature (2)..(2): Xaa can be Glu, Gln, or Asp
  misc_feature (9)..(9): Xaa can be Ile, Leu, Ala, Val, Met, Cys, Tyr, Pro, Phe, Gly, Thr, or Ser
DXSTATESX

SEQ ID NO: 94390 - protein, 8 aa, Artificial Sequence
  Description of Artificial Sequence: Synthetic peptide
  Seed: DEKVDELA (MAGC1_HUMAN)
  misc_feature (2)..(2): Xaa can be , or Glu
  misc_feature (8)..(8): Xaa can be Ala, Val, Met, Leu, or Ile
DXKVDELX

SEQ ID NO: 94391 - protein, 9 aa, Artificial Sequence
  Description of Artificial Sequence: Synthetic peptide
  Seed: DEKVDELAR (MAGC1_HUMAN)
  misc_feature (2)..(2): Xaa can be Glu, Gln, Thr, Val, Asp, Ile, Tyr, Leu, Phe, Ser, Asn, Trp, Ala, Met, Gly, Cys, or His
  misc_feature (9)..(9): Xaa can be Arg, Lys, Tyr, Phe, His, Leu, Met, Gln, Ile, Cys, Val, Thr, Ala, or Trp
DXKVDELAX

SEQ ID NO: 94392 - protein, 10 aa, Artificial Sequence
  Description of Artificial Sequence: Synthetic peptide
  Seed: DEKVDELARF (MAGC1_HUMAN)
  misc_feature (2)..(2): Xaa can be Glu, or Gln
  misc_feature (10)..(10): Xaa can be Trp, Phe, Tyr, Met, or Leu
DXKVDELARX

SEQ ID NO: 94393 - protein, 11 aa, Artificial Sequence
  Description of Artificial Sequence: Synthetic peptide
  Seed: DEKVDELARFL (MAGC1_HUMAN)
  misc_feature (2)..(2): Xaa can be Glu, or Gln
  misc_feature (11)..(11): Xaa can be Trp, Leu, Phe, or Tyr
DXKVDELARFX

SEQ ID NO: 94394 - protein, 8 aa, Artificial Sequence
  Description of Artificial Sequence: Synthetic peptide
  Seed: DELARFLL (MAGC1_HUMAN)
  misc_feature (2)..(2): Xaa can be Glu, Gln, Arg, His, Asp, Lys, or Asn
  misc_feature (8)..(8): Xaa can be Leu, Phe, Ile, Val, Met, Tyr, His, Trp, or Ala
DXLARFLX

SEQ ID NO: 94395 - protein, 9 aa, Artificial Sequence
  Description of Artificial Sequence: Synthetic peptide
  Seed: DELARFLLL (MAGC1_HUMAN)
  misc_feature (2)..(2): Xaa can be Glu, His, Arg, Gln, Asp, Lys, Pro, Leu, Met, Ala, Val, Ile, Gly, Asn, Ser, Thr, Cys, Phe, Tyr, or Trp
  misc_feature (9)..(9): Xaa can be Leu, Ile, Met, Val, Phe, Ala, Cys, Tyr, Thr, Pro, Trp, Gly, Ser, Gln, His, Arg, or Lys
DXLARFLLX

SEQ ID NO: 94396 - protein, 10 aa, Artificial Sequence
  Description of Artificial Sequence: Synthetic peptide
  Seed: DELARFLLLK (MAGC1_HUMAN)
  misc_feature (2)..(2): Xaa can be Met, Val, Ile, Ser, Thr, Gln, Gly, Trp, Phe, Pro, Arg, Tyr, Lys, Cys, Ala, Asn, His, Leu, Asp, or Glu
  misc_feature (10)..(10): Xaa can be Lys, Arg, or Tyr
DXLARFLLLX

SEQ ID NO: 94397 - protein, 11 aa, Artificial Sequence
  Description of Artificial Sequence: Synthetic peptide
  Seed: DELARFLLLKY (MAGC1_HUMAN)
  misc_feature (2)..(2): Xaa can be , or Glu
  misc_feature (11)..(11): Xaa can be Met, Tyr, or Phe
DXLARFLLLKX

SEQ ID NO: 94398 - protein, 9 aa, Artificial Sequence
  Description of Artificial Sequence: Synthetic peptide
  Seed: DEQGMSQNR (MAGC1_HUMAN)
  misc_feature (2)..(2): Xaa can be Thr, Val, Ile, Ser, Ala, Gly, Phe, Pro, Asn, Gln, Met, Trp, Tyr, Leu, His, Glu, Asp, or Cy s
  misc_feature (9)..(9): Xaa can be Arg, Lys, Tyr, Phe, Leu, His, or Met
DXQGMSQNX

SEQ ID NO: 94399 - protein, 10 aa, Artificial Sequence
  Description of Artificial Sequence: Synthetic peptide
  Seed: DEQGMSQNRL (MAGC1_HUMAN)
  misc_feature (2)..(2): Xaa can be Glu, or Gln
  misc_feature (10)..(10): Xaa can be Tyr, Trp, Phe, Leu, Val, Met, Cys, Ile, or Ala
DXQGMSQNRX

SEQ ID NO: 94400 - protein, 11 aa, Artificial Sequence
  Description of Artificial Sequence: Synthetic peptide
  Seed: DEQGMSQNRLL (MAGC1_HUMAN)
  misc_feature (2)..(2): Xaa can be Glu, or Gln
  misc_feature (11)..(11): Xaa can be Phe, Tyr, Trp, Ile, Met, Ala, Cys, Leu, or Val
DXQGMSQNRLX

SEQ ID NO: 94401 - protein, 9 aa, Artificial Sequence
  Description of Artificial Sequence: Synthetic peptide
  Seed: DEYTSSSDT (MAGC1_HUMAN)
  misc_feature (2)..(2): Xaa can be Glu, Asp, or Gln
  misc_feature (9)..(9): Xaa can be Ala, Val, Ile, Met, Ser, Thr, Cys, Pro, Phe, or Leu
DXYTSSSDX

SEQ ID NO: 94402 - protein, 10 aa, Artificial Sequence
  Description of Artificial Sequence: Synthetic peptide
  Seed: DEYTSSSDTL (MAGC1_HUMAN)
  misc_feature (2)..(2): Xaa can be Glu, or Gln
  misc_feature (10)..(10): Xaa can be Trp, Tyr, Ala, Cys, Pro, Leu, Met, Ser, Val, Thr, His, Ile, or Phe
DXYTSSSDTX

SEQ ID NO: 94403 - protein, 11 aa, Artificial Sequence
  Description of Artificial Sequence: Synthetic peptide
  Seed: DEYTSSSDTLL (MAGC1_HUMAN)
  misc_feature (2)..(2): Xaa can be Glu, Gln, or Asp
  misc_feature (11)..(11): Xaa can be Trp, Tyr, Ala, Thr, His, Ile, Val, Phe, Met, Leu, Pro, or Cys
DXYTSSSDTLX

SEQ ID NO: 94404 - protein, 10 aa, Artificial Sequence
  Description of Artificial Sequence: Synthetic peptide
  Seed: DFQSSLQSPV (MAGC1_HUMAN)
  misc_feature (2)..(2): Xaa can be Phe, Met, Tyr, or Leu
  misc_feature (10)..(10): Xaa can be Val, Leu, or Ile
DXQSSLQSPX

SEQ ID NO: 94405 - protein, 10 aa, Artificial Sequence
  Description of Artificial Sequence: Synthetic peptide
  Seed: DMPTAGMPSL (MAGC1_HUMAN)
  misc_feature (2)..(2): Xaa can be Ala, Val, Thr, Arg, Met, Leu, Ile, Ser, Phe, Tyr, Lys, His, Gly, or Trp
  misc_feature (10)..(10): Xaa can be Leu, Met, Ile, Val, Phe, or Ala
DXPTAGMPSX

SEQ ID NO: 94406 - protein, 8 aa, Artificial Sequence
  Description of Artificial Sequence: Synthetic peptide
  Seed: DPDDSYVF (MAGC1_HUMAN)
  misc_feature (2)..(2): Xaa can be Pro, Ala, Val, or Ser
  misc_feature (8)..(8): Xaa can be Tyr, Phe, Leu, or Met
DXDDSYVX

SEQ ID NO: 94407 - protein, 9 aa, Artificial Sequence
  Description of Artificial Sequence: Synthetic peptide
  Seed: DPDDSYVFV (MAGC1_HUMAN)
  misc_feature (2)..(2): Xaa can be Ala, Leu, Met, Phe, Ile, Val, Ser, Thr, Pro, Gln, Trp, Cys, Gly, Tyr, Asn, His, Lys, Glu, Arg, or Asp
  misc_feature (9)..(9): Xaa can be Leu, Met, Phe, Ile, Val, Tyr, Ala, Cys, Trp, or Thr
DXDDSYVFX

SEQ ID NO: 94408 - protein, 9 aa, Artificial Sequence
  Description of Artificial Sequence: Synthetic peptide
  Seed: DPLQRPPEG (MAGC1_HUMAN)
  misc_feature (2)..(2): Xaa can be Pro, Ala, Val, Gln, Ser, Gly, Leu, Thr, Ile, or Met
  misc_feature (9)..(9): Xaa can be Ala, Val, Leu, Met, Ile, Thr, Pro, Cys, Ser, Phe, Gly, or Tyr
DXLQRPPEX

SEQ ID NO: 94409 - protein, 8 aa, Artificial Sequence
  Description of Artificial Sequence: Synthetic peptide
  Seed: DSLSPHYF (MAGC1_HUMAN)
  misc_feature (2)..(2): Xaa can be Thr, Ser, Ala, or Val
  misc_feature (8)..(8): Xaa can be Trp, or Phe
DXLSPHYX

SEQ ID NO: 94410 - protein, 8 aa, Artificial Sequence
  Description of Artificial Sequence: Synthetic peptide
  Seed: DSLSPLEI (MAGC1_HUMAN)
  misc_feature (2)..(2): Xaa can be Ala, Pro, Gln, Gly, Glu, Met, Ser, Thr, Asn, Ile, Leu, or Val
  misc_feature (8)..(8): Xaa can be Ile, Val, Leu, Met, Phe, or Cys
DXLSPLEX

SEQ ID NO: 94411 - protein, 8 aa, Artificial Sequence
  Description of Artificial Sequence: Synthetic peptide
  Seed: DSLSPLQI (MAGC1_HUMAN)
  misc_feature (2)..(2): Xaa can be Gln, Ala, Pro, Ser, Met, Gly, Glu, Leu, Val, Ile, or Asn
  misc_feature (8)..(8): Xaa can be Val, Ile, Leu, or Met
DXLSPLQX

SEQ ID NO: 94412 - protein, 9 aa, Artificial Sequence
  Description of Artificial Sequence: Synthetic peptide
  Seed: DSLTDSESL (MAGC1_HUMAN)
  misc_feature (2)..(2): Xaa can be Ala, Pro, Val, Thr, Ser, Gly, or Ile
  misc_feature (9)..(9): Xaa can be Val, Ile, Leu, Met, Phe, Ala, Cys, or Tyr
DXLTDSESX

SEQ ID NO: 94413 - protein, 8 aa, Artificial Sequence
  Description of Artificial Sequence: Synthetic peptide
  Seed: DSSDPLQR (MAGC1_HUMAN)
  misc_feature (2)..(2): Xaa can be Ala, Ser, Thr, Ile, Val, Trp, Asn, Phe, Gly, Tyr, Gln, Met, Leu, Cys, Asp, or Glu
  misc_feature (8)..(8): Xaa can be Lys, Arg, Phe, Leu, Tyr, or Met
DXSDPLQX

SEQ ID NO: 94414 - protein, 9 aa, Artificial Sequence
  Description of Artificial Sequence: Synthetic peptide
  Seed: DSYVFVNTL (MAGC1_HUMAN)
  misc_feature (2)..(2): Xaa can be Ala, Thr, Glu, Pro, Gln, Val, Arg, Ile, Ser, Met, His, Leu, Gly, Asp, Cys, Asn, Tyr, Phe, Lys, or Trp
  misc_feature (9)..(9): Xaa can be Phe, Tyr, Ile, Val, Met, Leu, Arg, Trp, Lys, Ala, Cys, Thr, His, Pro, Ser, Gln, or Gly
DXYVFVNTX

SEQ ID NO: 94415 - protein, 9 aa, Artificial Sequence
  Description of Artificial Sequence: Synthetic peptide
  Seed: DTLLESDSL (MAGC1_HUMAN)
  misc_feature (2)..(2): Xaa can be Thr, Val, Ile, Ser, Ala, or Met
  misc_feature (9)..(9): Xaa can be Trp, Phe, Val, Tyr, Leu, or Ile
DXLLESDSX

SEQ ID NO: 94416 - protein, 9 aa, Artificial Sequence
  Description of Artificial Sequence: Synthetic peptide
  Seed: DVEERAQAI (MAGC1_HUMAN)
  misc_feature (2)..(2): Xaa can be Glu, Met, Ala, Gln, Pro, Val, Trp, Arg, Phe, Ile, Asp, Leu, Ser, Tyr, Thr, Gly, Asn, His, Lys, or Cys
  misc_feature (9)..(9): Xaa can be Leu, Met, Ile, Val, Phe, Ala, Cys, Tyr, Trp, Thr, or Pro
DXEERAQAX

SEQ ID NO: 94417 - protein, 9 aa, Artificial Sequence
  Description of Artificial Sequence: Synthetic peptide
  Seed: DVLSGIGVR (MAGC1_HUMAN)
  misc_feature (2)..(2): Xaa can be Thr, Val, Ile, Ser, Ala, Leu, Met, Gly, Asn, Gln, Phe, Trp, Pro, Tyr, His, Asp, Cys, Glu, Arg, or Lys
  misc_feature (9)..(9): Xaa can be Arg, Lys, Tyr, Met, His, Phe, Leu, Val, Gln, Ile, Trp, or Ala
DXLSGIGVX

SEQ ID NO: 94418 - protein, 10 aa, Artificial Sequence
  Description of Artificial Sequence: Synthetic peptide
  Seed: DVLSGIGVRA (MAGC1_HUMAN)
  misc_feature (2)..(2): Xaa can be Thr, Val, Ile, Ala, Ser, Leu, Met, Gln, Gly, Asn, Trp, Asp, Pro, Lys, Glu, Tyr, Phe, Cys, or His
  misc_feature (10)..(10): Xaa can be Arg, Lys, Val, Met, Tyr, Leu, Phe, His, Ala, Ile, Gln, Trp, Glu, Asn, Cys, Ser, Gly, Thr, or Pro
DXLSGIGVRX

SEQ ID NO: 94419 - protein, 9 aa, Artificial Sequence
  Description of Artificial Sequence: Synthetic peptide
  Seed: EDFQSSLQS (MAGC1_HUMAN)
  misc_feature (2)..(2): Xaa can be Glu, Gln, Asp, Ala, Lys, Asn, His, Ser, Leu, Arg, Pro, Val, Ile, Met, or Gly
  misc_feature (9)..(9): Xaa can be Leu, Tyr, Trp, Phe, Ile, Val, Met, Cys, Ala, Pro, Ser, Thr, His, Gly, Asn, Arg, Gln, Asp, Glu, or Lys
EXFQSSLQX

SEQ ID NO: 94420 - protein, 8 aa, Artificial Sequence
  Description of Artificial Sequence: Synthetic peptide
  Seed: EDSLSPHY (MAGC1_HUMAN)
  misc_feature (2)..(2): Xaa can be Glu, Asp, or Gln
  misc_feature (8)..(8): Xaa can be Tyr, Val, Phe, Met, Trp, Ile, His, or Leu
EXSLSPHX

SEQ ID NO: 94421 - protein, 9 aa, Artificial Sequence
  Description of Artificial Sequence: Synthetic peptide
  Seed: EDSLSPHYF (MAGC1_HUMAN)
  misc_feature (2)..(2): Xaa can be Glu, Asp, Gln, Ser, Val, Ala, Lys, Asn, His, Met, Thr, Leu, Arg, or Ile
  misc_feature (9)..(9): Xaa can be Trp, Leu, Ile, Tyr, Val, Met, Phe, Arg, Cys, Pro, His, Thr, Lys, or Ala
EXSLSPHYX

SEQ ID NO: 94422 - protein, 9 aa, Artificial Sequence
  Description of Artificial Sequence: Synthetic peptide
  Seed: EDSLSPLHF (MAGC1_HUMAN)
  misc_feature (2)..(2): Xaa can be Glu, Asp, Gln, Ala, Asn, Lys, Ser, Thr, Val, Arg, or His
  misc_feature (9)..(9): Xaa can be Trp, Leu, Phe, Tyr, Ile, Met, Val, Pro, Cys, Lys, Ala, Arg, Thr, or His
EXSLSPLHX

SEQ ID NO: 94423 - protein, 9 aa, Artificial Sequence
  Description of Artificial Sequence: Synthetic peptide
  Seed: EDSLSPLQI (MAGC1_HUMAN)
  misc_feature (2)..(2): Xaa can be Glu, Asp, Gln, Ser, Ala, or Asn
  misc_feature (9)..(9): Xaa can be Leu, Met, Phe, Val, Ile, Ala, Cys, Pro, Tyr, Thr, Asp, Glu, Lys, Ser, Trp, or Gly
EXSLSPLQX

SEQ ID NO: 94424 - protein, 9 aa, Artificial Sequence
  Description of Artificial Sequence: Synthetic peptide
  Seed: EDSLSSLHF (MAGC1_HUMAN)
  misc_feature (2)..(2): Xaa can be Glu, Gln, Asp, Asn, Thr, Lys, His, Ala, Ser, or Arg
  misc_feature (9)..(9): Xaa can be Trp, Ile, Phe, Val, Leu, Tyr, Met, Cys, Lys, or His
EXSLSSLHX

SEQ ID NO: 94425 - protein, 8 aa, Artificial Sequence
  Description of Artificial Sequence: Synthetic peptide
  Seed: EDSMSPLY (MAGC1_HUMAN)
  misc_feature (2)..(2): Xaa can be Glu, Gln, or Asp
  misc_feature (8)..(8): Xaa can be Tyr, Met, His, Ile, Leu, Trp, Val, or Phe
EXSMSPLX

SEQ ID NO: 94426 - protein, 9 aa, Artificial Sequence
  Description of Artificial Sequence: Synthetic peptide
  Seed: EDSMSPLYF (MAGC1_HUMAN)
  misc_feature (2)..(2): Xaa can be Glu, Gln, Asp, Lys, Ser, or Ala
  misc_feature (9)..(9): Xaa can be Trp, Val, Tyr, Met, Ile, Phe, Leu, Cys, Arg, His, Ala, or Lys
EXSMSPLYX

SEQ ID NO: 94427 - protein, 9 aa, Artificial Sequence
  Description of Artificial Sequence: Synthetic peptide
  Seed: EDSQSPLQI (MAGC1_HUMAN)
  misc_feature (2)..(2): Xaa can be Glu, Gln, Asp, Val, Asn, Ala, Ile, or Ser
  misc_feature (9)..(9): Xaa can be Leu, Cys, Pro, Ile, Val, Ala, Met, Phe, Thr, Trp, Tyr, Arg, Ser, Gly, Gln, Asp, His, Glu, or Lys
EXSQSPLQX

SEQ ID NO: 94428 - protein, 9 aa, Artificial Sequence
  Description of Artificial Sequence: Synthetic peptide
  Seed: EDSSDPLQR (MAGC1_HUMAN)
  misc_feature (2)..(2): Xaa can be Val, Ala, Thr, Ser, Ile, Gln, Leu, Met, Gly, Glu, Trp, Asn, Phe, Asp, Cys, Tyr, Pro, Lys, or His
  misc_feature (9)..(9): Xaa can be Arg, Lys, Tyr, Phe, Met, Leu, His, Ile, Val, or Gln
EXSSDPLQX

SEQ ID NO: 94429 - protein, 9 aa, Artificial Sequence
  Description of Artificial Sequence: Synthetic peptide
  Seed: EEFQSSLQS (MAGC1_HUMAN)
  misc_feature (2)..(2): Xaa can be Asp, or Glu
  misc_feature (9)..(9): Xaa can be , or Ser
EXFQSSLQX

SEQ ID NO: 94430 - protein, 10 aa, Artificial Sequence
  Description of Artificial Sequence: Synthetic peptide
  Seed: EEFQSSLQSP (MAGC1_HUMAN)
  misc_feature (2)..(2): Xaa can be Glu, Asp, or Gln
  misc_feature (10)..(10): Xaa can be Ala, Phe, Leu, Val, Ile, Cys, Met, Thr, Asp, Gly, Pro, Ser, Glu, Lys, Tyr, or Trp
EXFQSSLQSX

SEQ ID NO: 94431 - protein, 11 aa, Artificial Sequence
  Description of Artificial Sequence: Synthetic peptide
  Seed: EEFQSSLQSPV (MAGC1_HUMAN)
  misc_feature (2)..(2): Xaa can be , or Glu
  misc_feature (11)..(11): Xaa can be Ser, Leu, Ile, Trp, Ala, Cys, Pro, Tyr, Thr, Val, Phe, Met, or Gly
EXFQSSLQSPX

SEQ ID NO: 94432 - protein, 8 aa, Artificial Sequence
  Description of Artificial Sequence: Synthetic peptide
  Seed: EERAQAII (MAGC1_HUMAN)
  misc_feature (2)..(2): Xaa can be Glu, or Asp
  misc_feature (8)..(8): Xaa can be Leu, Ala, Met, Ile, Val, or Phe
EXRAQAIX

SEQ ID NO: 94433 - protein, 10 aa, Artificial Sequence
  Description of Artificial Sequence: Synthetic peptide
  Seed: EERAQAIIDT (MAGC1_HUMAN)
  misc_feature (2)..(2): Xaa can be , or Glu
  misc_feature (10)..(10): Xaa can be Ala, Pro, Met, Cys, Ile, Leu, Thr, or Val
EXRAQAIIDX

SEQ ID NO: 94434 - protein, 11 aa, Artificial Sequence
  Description of Artificial Sequence: Synthetic peptide
  Seed: EERAQAIIDTT (MAGC1_HUMAN)
  misc_feature (2)..(2): Xaa can be , or Glu
  misc_feature (11)..(11): Xaa can be Phe, Val, Ile, Cys, Thr, Pro, Met, Leu, or Ala
EXRAQAIIDTX

SEQ ID NO: 94435 - protein, 10 aa, Artificial Sequence
  Description of Artificial Sequence: Synthetic peptide
  Seed: EESSSPVDEY (MAGC1_HUMAN)
  misc_feature (2)..(2): Xaa can be Glu, Gln, Thr, Met, Val, Ile, Leu, Ala, Asp, Phe, Pro, Arg, Ser, or Lys
  misc_feature (10)..(10): Xaa can be Tyr, Phe, Trp, Val, Met, Ala, Leu, Thr, Ser, Pro, Gly, Cys, or Ile
EXSSSPVDEX

SEQ ID NO: 94436 - protein, 11 aa, Artificial Sequence
  Description of Artificial Sequence: Synthetic peptide
  Seed: EESSSPVDEYT (MAGC1_HUMAN)
  misc_feature (2)..(2): Xaa can be , or Glu
  misc_feature (11)..(11): Xaa can be Ala, Thr, Met, Pro, Cys, Ile, Phe, Leu, or Val
EXSSSPVDEYX

SEQ ID NO: 94437 - protein, 8 aa, Artificial Sequence
  Description of Artificial Sequence: Synthetic peptide
  Seed: EEVIWDVL (MAGC1_HUMAN)
  misc_feature (2)..(2): Xaa can be Glu, or Asp
  misc_feature (8)..(8): Xaa can be Tyr, Phe, Val, Trp, Ile, Ala, Leu, His, or Met
EXVIWDVX

SEQ ID NO: 94438 - protein, 9 aa, Artificial Sequence
  Description of Artificial Sequence: Synthetic peptide
  Seed: EEVIWDVLS (MAGC1_HUMAN)
  misc_feature (2)..(2): Xaa can be Glu, Asp, or Gln
  misc_feature (9)..(9): Xaa can be Leu, Ile, Ala, Val, Gly, Cys, Ser, Met, Pro, Phe, or Thr
EXVIWDVLX

SEQ ID NO: 94439 - protein, 11 aa, Artificial Sequence
  Description of Artificial Sequence: Synthetic peptide
  Seed: EEVIWDVLSGI (MAGC1_HUMAN)
  misc_feature (2)..(2): Xaa can be Thr, Glu, Ala, Ser, Val, Ile, Leu, Asn, Met, Phe, Pro, Arg, Lys, Gln, Gly, His, Cys, Asp, Tyr, or Trp
  misc_feature (11)..(11): Xaa can be Val, Ile, Leu, Ala, Met, Thr, or Cys
EXVIWDVLSGX

SEQ ID NO: 94440 - protein, 9 aa, Artificial Sequence
  Description of Artificial Sequence: Synthetic peptide
  Seed: EFIEILFGI (MAGC1_HUMAN)
  misc_feature (2)..(2): Xaa can be Thr, Val, Ala, Met, Ile, Ser, Leu, Gln, Phe, Tyr, Gly, Asn, Cys, Trp, Pro, Asp, Glu, Lys, His, or Arg
  misc_feature (9)..(9): Xaa can be Val, Leu, Ile, Met, Ala, Thr, Phe, Ser, Cys, Gly, Pro, Trp, Arg, Tyr, Asn, Glu, Asp, or Ly s
EXIEILFGX

SEQ ID NO: 94441 - protein, 10 aa, Artificial Sequence
  Description of Artificial Sequence: Synthetic peptide
  Seed: EFLAMLKNTV (MAGC1_HUMAN)
  misc_feature (2)..(2): Xaa can be Phe, Tyr, Leu, Met, Ile, Ser, Ala, Trp, Thr, Arg, Lys, Gly, Val, Cys, Gln, or His
  misc_feature (10)..(10): Xaa can be Val, Leu, Ile, Ala, or Met
EXLAMLKNTX

SEQ ID NO: 94442 - protein, 10 aa, Artificial Sequence
  Description of Artificial Sequence: Synthetic peptide
  Seed: EFQSSLQSPV (MAGC1_HUMAN)
  misc_feature (2)..(2): Xaa can be Leu, Met, Tyr, Phe, Val, Ser, or Ile
  misc_feature (10)..(10): Xaa can be Val, Ile, Leu, or Ala
EXQSSLQSPX

SEQ ID NO: 94443 - protein, 9 aa, Artificial Sequence
  Description of Artificial Sequence: Synthetic peptide
  Seed: EGDDTQSPL (MAGC1_HUMAN)
  misc_feature (2)..(2): Xaa can be Phe, Ala, Tyr, Trp, Ser, Thr, Leu, Ile, Gly, Val, Arg, Gln, Cys, Met, Asn, His, Asp, Pro, or Glu
  misc_feature (9)..(9): Xaa can be Leu, Met, Phe, Ile, Val, Tyr, Trp, Cys, or Ala
EXDDTQSPX

SEQ ID NO: 94444 - protein, 9 aa, Artificial Sequence
  Description of Artificial Sequence: Synthetic peptide
  Seed: EGEDSLSPL (MAGC1_HUMAN)
  misc_feature (2)..(2): Xaa can be Tyr, Phe, Arg, Ala, Trp, Gly, or Gln
  misc_feature (9)..(9): Xaa can be Leu, Met, Phe, Val, or Ile
EXEDSLSPX

SEQ ID NO: 94445 - protein, 9 aa, Artificial Sequence
  Description of Artificial Sequence: Synthetic peptide
  Seed: EGEDSLSSL (MAGC1_HUMAN)
  misc_feature (2)..(2): Xaa can be Glu, Gln, Ala, Thr, Leu, Met, Ile, Tyr, Ser, Trp, Val, Arg, Asp, Phe, Gly, Cys, His, Asn, or Pro
  misc_feature (9)..(9): Xaa can be Leu, Met, Phe, Ile, Val, Trp, Lys, or Tyr
EXEDSLSSX

SEQ ID NO: 94446 - protein, 11 aa, Artificial Sequence
  Description of Artificial Sequence: Synthetic peptide
  Seed: EGEDSSDPLQR (MAGC1_HUMAN)
  misc_feature (2)..(2): Xaa can be Thr, Val, Ile, Ser, Phe, Met, Ala, Leu, Tyr, Gln, Trp, Arg, Gly, Asn, Cys, Asp, Glu, His, Pro, or Lys
  misc_feature (11)..(11): Xaa can be Lys, Tyr, Arg, Phe, Met, His, Trp, Leu, or Gln
EXEDSSDPLQX

SEQ ID NO: 94447 - protein, 8 aa, Artificial Sequence
  Description of Artificial Sequence: Synthetic peptide
  Seed: EGFPQSLL (MAGC1_HUMAN)
  misc_feature (2)..(2): Xaa can be Gln, Ala, Ser, Gly, Glu, Met, Leu, or Asn
  misc_feature (8)..(8): Xaa can be Val, Ile, Leu, Met, or Phe
EXFPQSLX

SEQ ID NO: 94448 - protein, 8 aa, Artificial Sequence
  Description of Artificial Sequence: Synthetic peptide
  Seed: EGFPQSVL (MAGC1_HUMAN)
  misc_feature (2)..(2): Xaa can be Gln, Ser, Gly, Ala, Leu, Glu, Met, Asn, or Ile
  misc_feature (8)..(8): Xaa can be Ile, Val, Leu, Met, or Phe
EXFPQSVX

SEQ ID NO: 94449 - protein, 9 aa, Artificial Sequence
  Description of Artificial Sequence: Synthetic peptide
  Seed: EGKDSLSPL (MAGC1_HUMAN)
  misc_feature (2)..(2): Xaa can be Ala, Val, Ile, Ser, Leu, Gly, Thr, Met, Gln, Asn, Cys, Glu, Phe, Tyr, Pro, or Arg
  misc_feature (9)..(9): Xaa can be Tyr, Phe, Leu, Lys, Met, His, Val, Arg, Ile, Trp, or Ala
EXKDSLSPX

SEQ ID NO: 94450 - protein, 10 aa, Artificial Sequence
  Description of Artificial Sequence: Synthetic peptide
  Seed: EGPAQSPLQR (MAGC1_HUMAN)
  misc_feature (2)..(2): Xaa can be Thr, Val, Ile, Met, Ala, Glu, Gln, Cys, Asp, Leu, Tyr, Pro, Phe, Asn, Trp, Ser, Gly, or Hi s
  misc_feature (10)..(10): Xaa can be Arg, Lys, Leu, Tyr, Met, His, or Phe
EXPAQSPLQX

SEQ ID NO: 94451 - protein, 8 aa, Artificial Sequence
  Description of Artificial Sequence: Synthetic peptide
  Seed: EHFAFGEP (MAGC1_HUMAN)
  misc_feature (2)..(2): Xaa can be His, Arg, or Gln
  misc_feature (8)..(8): Xaa can be Leu, Ala, Ile, Val, Thr, Met, Cys, Pro, or Phe
EXFAFGEX

SEQ ID NO: 94452 - protein, 9 aa, Artificial Sequence
  Description of Artificial Sequence: Synthetic peptide
  Seed: EHFAFGEPR (MAGC1_HUMAN)
  misc_feature (2)..(2): Xaa can be Thr, Val, Ala, Ile, Ser, Met, Leu, Tyr, Gly, Glu, Asp, Trp, Pro, Phe, His, Gln, Asn, Cys, Arg, or Lys
  misc_feature (9)..(9): Xaa can be Arg, Lys, Tyr, His, Met, Leu, Gln, Phe, Val, Asn, Glu, Ala, Ile, or Ser
EXFAFGEPX

SEQ ID NO: 94453 - protein, 11 aa, Artificial Sequence
  Description of Artificial Sequence: Synthetic peptide
  Seed: EHFAFGEPREL (MAGC1_HUMAN)
  misc_feature (2)..(2): Xaa can be His, Arg, or Gln
  misc_feature (11)..(11): Xaa can be Tyr, Phe, Val, Ala, Leu, Cys, Ile, Met, Thr, or Trp
EXFAFGEPREX

SEQ ID NO: 94454 - protein, 9 aa, Artificial Sequence
  Description of Artificial Sequence: Synthetic peptide
  Seed: EHYLEYREV (MAGC1_HUMAN)
  misc_feature (2)..(2): Xaa can be His, Arg, Gln, Glu, Lys, Ser, Met, Ala, Ile, Thr, Val, Gly, Leu, Asn, Asp, or Pro
  misc_feature (9)..(9): Xaa can be Leu, Ile, Val, Met, Ala, Thr, Cys, Phe, Pro, Gly, Trp, Tyr, or Ser
EXYLEYREX

SEQ ID NO: 94455 - protein, 9 aa, Artificial Sequence
  Description of Artificial Sequence: Synthetic peptide
  Seed: EILFGISLR (MAGC1_HUMAN)
  misc_feature (2)..(2): Xaa can be Thr, Ala, Val, Ile, Ser, Leu, Met, Tyr, Asn, Trp, Cys, Glu, Lys, Pro, Gly, Gln, His, Phe, Asp, or Arg
  misc_feature (9)..(9): Xaa can be Arg, Lys, His, Tyr, Met, Leu, Phe, Ile, Val, Gln, Ala, or Thr
EXLFGISLX

SEQ ID NO: 94456 - protein, 10 aa, Artificial Sequence
  Description of Artificial Sequence: Synthetic peptide
  Seed: EILFGISLRE (MAGC1_HUMAN)
  misc_feature (2)..(2): Xaa can be Ser, Val, Thr, Ile, Ala, Met, Leu, Lys, Phe, Tyr, Gln, Gly, Arg, Trp, Asp, His, Asn, Cys, Glu, or Pro
  misc_feature (10)..(10): Xaa can be Arg, Lys, Tyr, Cys, Met, Gln, Leu, Thr, Glu, Gly, Asp, His, Val, Phe, Ala, Asn, Ser, Ile, Pro, or Trp
EXLFGISLRX

SEQ ID NO: 94457 - protein, 11 aa, Artificial Sequence
  Description of Artificial Sequence: Synthetic peptide
  Seed: EILFGISLREV (MAGC1_HUMAN)
  misc_feature (2)..(2): Xaa can be Phe, Tyr, Lys, Met, Arg, Ala, Leu, Ile, Gly, Thr, Ser, Trp, His, Val, Gln, Asn, or Cys
  misc_feature (11)..(11): Xaa can be Val, Leu, Ile, Ala, Met, or Thr
EXLFGISLREX

SEQ ID NO: 94458 - protein, 9 aa, Artificial Sequence
  Description of Artificial Sequence: Synthetic peptide
  Seed: EKVDELARF (MAGC1_HUMAN)
  misc_feature (2)..(2): Xaa can be His, Gln, Arg, Met, Leu, Lys, Glu, or Ala
  misc_feature (9)..(9): Xaa can be Tyr, Phe, Met, Trp, Leu, or His
EXVDELARX

SEQ ID NO: 94459 - protein, 8 aa, Artificial Sequence
  Description of Artificial Sequence: Synthetic peptide
  Seed: ELARFLLL (MAGC1_HUMAN)
  misc_feature (2)..(2): Xaa can be Met, Phe, Trp, Ile, Glu, Ala, Arg, Tyr, Asn, Gln, Leu, or His
  misc_feature (8)..(8): Xaa can be Leu, Ile, Met, Phe, or Val
EXARFLLX

SEQ ID NO: 94460 - protein, 9 aa, Artificial Sequence
  Description of Artificial Sequence: Synthetic peptide
  Seed: ELARFLLLK (MAGC1_HUMAN)
  misc_feature (2)..(2): Xaa can be Thr, Val, Ala, Ile, Ser, Leu, Met, Gln, Gly, Tyr, Asn, Cys, Glu, Asp, His, Trp, Lys, Phe, Pro, or Arg
  misc_feature (9)..(9): Xaa can be Arg, Lys, His, Tyr, Met, Leu, Val, Phe, Gln, Ile, or Ala
EXARFLLLX

SEQ ID NO: 94461 - protein, 10 aa, Artificial Sequence
  Description of Artificial Sequence: Synthetic peptide
  Seed: ELARFLLLKY (MAGC1_HUMAN)
  misc_feature (2)..(2): Xaa can be Thr, Val, Ile, Met, Leu, Ala, Gln, Ser, Phe, Tyr, Trp, Glu, Asn, Gly, Cys, or Asp
  misc_feature (10)..(10): Xaa can be Lys, Tyr, Arg, His, Phe, Met, Leu, or Gln
EXARFLLLKX

SEQ ID NO: 94462 - protein, 9 aa, Artificial Sequence
  Description of Artificial Sequence: Synthetic peptide
  Seed: EMLTNVISR (MAGC1_HUMAN)
  misc_feature (2)..(2): Xaa can be Val, Thr, Ile, Ala, Leu, Ser, Met, Gly, Tyr, Cys, His, Glu, Trp, Gln, Asn, Asp, Phe, Pro, Arg, or Lys
  misc_feature (9)..(9): Xaa can be Arg, Lys, His, Leu, Tyr, Met, Phe, Gln, Val, Ile, or Ala
EXLTNVISX

SEQ ID NO: 94463 - protein, 10 aa, Artificial Sequence
  Description of Artificial Sequence: Synthetic peptide
  Seed: EMLTNVISRY (MAGC1_HUMAN)
  misc_feature (2)..(2): Xaa can be Thr, Val, Ile, Ala, Ser, Met, Leu, Glu, Gln, Asp, Asn, Gly, Cys, Tyr, Phe, Pro, Trp, Lys, Arg, or His
  misc_feature (10)..(10): Xaa can be Tyr, Lys, Arg, Trp, Phe, Leu, Met, His, Val, Gln, Ile, Cys, Thr, or Ala
EXLTNVISRX

SEQ ID NO: 94464 - protein, 10 aa, Artificial Sequence
  Description of Artificial Sequence: Synthetic peptide
  Seed: ENTHSPLQIV (MAGC1_HUMAN)
  misc_feature (2)..(2): Xaa can be Thr, Val, Leu, Gly, Lys, Tyr, Asp, Ile, Ser, Cys, His, Phe, Asn, Gln, Glu, Trp, Pro, Ala, Met, or Arg
  misc_feature (10)..(10): Xaa can be Val, Ile, or Leu
EXTHSPLQIX

SEQ ID NO: 94465 - protein, 8 aa, Artificial Sequence
  Description of Artificial Sequence: Synthetic peptide
  Seed: EPLFTYTL (MAGC1_HUMAN)
  misc_feature (2)..(2): Xaa can be Pro, or Ala
  misc_feature (8)..(8): Xaa can be Leu, Val, Ile, or Ala
EXLFTYTX

SEQ ID NO: 94466 - protein, 9 aa, Artificial Sequence
  Description of Artificial Sequence: Synthetic peptide
  Seed: EPRELLTKV (MAGC1_HUMAN)
  misc_feature (2)..(2): Xaa can be Pro, Ala, Ile, Met, Val, Gly, Leu, Gln, Asp, Asn, Ser, Glu, Thr, Cys, Phe, Arg, or Tyr
  misc_feature (9)..(9): Xaa can be Leu, Val, Ile, Met, Phe, Ala, Cys, Thr, Gly, Ser, Tyr, or Pro
EXRELLTKX

SEQ ID NO: 94467 - protein, 10 aa, Artificial Sequence
  Description of Artificial Sequence: Synthetic peptide
  Seed: EPRELLTKVW (MAGC1_HUMAN)
  misc_feature (2)..(2): Xaa can be Ala, or Pro
  misc_feature (10)..(10): Xaa can be , or Trp
EXRELLTKVX

SEQ ID NO: 94468 - protein, 9 aa, Artificial Sequence
  Description of Artificial Sequence: Synthetic peptide
  Seed: EQGMSQNRL (MAGC1_HUMAN)
  misc_feature (2)..(2): Xaa can be His, Glu, Asp, Arg, or Gln
  misc_feature (9)..(9): Xaa can be Leu, Phe, Met, Ile, Val, or Trp
EXGMSQNRX

SEQ ID NO: 94469 - protein, 9 aa, Artificial Sequence
  Description of Artificial Sequence: Synthetic peptide
  Seed: ERAQAIIDT (MAGC1_HUMAN)
  misc_feature (2)..(2): Xaa can be His, Arg, or Gln
  misc_feature (9)..(9): Xaa can be Ala, Val, Ile, Leu, Met, Cys, Thr, Pro, Gly, Phe, or Ser
EXAQAIIDX

SEQ ID NO: 94470 - protein, 10 aa, Artificial Sequence
  Description of Artificial Sequence: Synthetic peptide
  Seed: ERAQAIIDTT (MAGC1_HUMAN)
  misc_feature (2)..(2): Xaa can be , or Arg
  misc_feature (10)..(10): Xaa can be Phe, Ile, Pro, Ala, Leu, Cys, Val, Thr, or Met
EXAQAIIDTX

SEQ ID NO: 94471 - protein, 10 aa, Artificial Sequence
  Description of Artificial Sequence: Synthetic peptide
  Seed: ERTHSTFEGF (MAGC1_HUMAN)
  misc_feature (2)..(2): Xaa can be Arg, Val, Thr, Ile, Phe, Asn, Gly, Gln, Tyr, Trp, Leu, Glu, His, Ser, Pro, Met, Ala, Asp, Cys, or Lys
  misc_feature (10)..(10): Xaa can be Phe, Tyr, Met, Leu, Trp, or Lys
EXTHSTFEGX

SEQ ID NO: 94472 - protein, 10 aa, Artificial Sequence
  Description of Artificial Sequence: Synthetic peptide
  Seed: ERTQSTFEGF (MAGC1_HUMAN)
  misc_feature (2)..(2): Xaa can be Arg, or His
  misc_feature (10)..(10): Xaa can be Phe, Met, Leu, Ile, Trp, Tyr, Lys, Val, or Arg
EXTQSTFEGX

SEQ ID NO: 94473 - protein, 10 aa, Artificial Sequence
  Description of Artificial Sequence: Synthetic peptide
  Seed: ESAQSAFEGF (MAGC1_HUMAN)
  misc_feature (2)..(2): Xaa can be Thr, Val, Ile, Ser, Met, Ala, Leu, Gln, Glu, Gly, Tyr, Phe, Asn, Pro, Cys, or Trp
  misc_feature (10)..(10): Xaa can be Trp, Arg, Tyr, Phe, Lys, Met, Leu, His, Val, or Ile
EXAQSAFEGX

SEQ ID NO: 94474 - protein, 10 aa, Artificial Sequence
  Description of Artificial Sequence: Synthetic peptide
  Seed: ESAQSTFEGF (MAGC1_HUMAN)
  misc_feature (2)..(2): Xaa can be Thr, Val, Ile, Ala, Leu, Ser, Met, Gln, Glu, Gly, Asn, Phe, Pro, Tyr, Asp, Cys, Trp, His, or Lys
  misc_feature (10)..(10): Xaa can be Arg, Trp, Lys, Tyr, Phe, Met, Leu, His, Val, Ile, Gln, or Ala
EXAQSTFEGX

SEQ ID NO: 94475 - protein, 9 aa, Artificial Sequence
  Description of Artificial Sequence: Synthetic peptide
  Seed: ESDDTLYPL (MAGC1_HUMAN)
  misc_feature (2)..(2): Xaa can be Thr, Val, Tyr, Ala, Phe, Ile, Leu, Met, Ser, Glu, Trp, Gly, Asn, Gln, Asp, Cys, Arg, Pro, His, or Lys
  misc_feature (9)..(9): Xaa can be Leu, Met, Val, Phe, Ile, Lys, Arg, Tyr, Ala, Cys, Thr, Trp, or Ser
EXDDTLYPX

SEQ ID NO: 94476 - protein, 11 aa, Artificial Sequence
  Description of Artificial Sequence: Synthetic peptide
  Seed: ESDSLTDSESL (MAGC1_HUMAN)
  misc_feature (2)..(2): Xaa can be Ala, Ile, Val, Thr, Ser, Leu, Met, Gly, Phe, Trp, Tyr, Cys, Gln, Pro, or Asn
  misc_feature (11)..(11): Xaa can be Leu, Phe, Met, Ile, Val, Lys, Trp, or Tyr
EXDSLTDSESX

SEQ ID NO: 94477 - protein, 8 aa, Artificial Sequence
  Description of Artificial Sequence: Synthetic peptide
  Seed: ESEPLFTY (MAGC1_HUMAN)
  misc_feature (2)..(2): Xaa can be Ser, Thr, Ile, Val, or Leu
  misc_feature (8)..(8): Xaa can be Lys, or Tyr
EXEPLFTX

SEQ ID NO: 94478 - protein, 10 aa, Artificial Sequence
  Description of Artificial Sequence: Synthetic peptide
  Seed: ESEPLFTYTL (MAGC1_HUMAN)
  misc_feature (2)..(2): Xaa can be Val, Thr, Ala, Ser, Ile, Leu, or Met
  misc_feature (10)..(10): Xaa can be Val, Ala, Ile, Leu, Thr, or Met
EXEPLFTYTX

SEQ ID NO: 94479 - protein, 10 aa, Artificial Sequence
  Description of Artificial Sequence: Synthetic peptide
  Seed: ESLIESEPLF (MAGC1_HUMAN)
  misc_feature (2)..(2): Xaa can be Thr, Ser, Ala, Val, Ile, Cys, Leu, Met, or Gly
  misc_feature (10)..(10): Xaa can be Trp, or Phe
EXLIESEPLX

SEQ ID NO: 94480 - protein, 9 aa, Artificial Sequence
  Description of Artificial Sequence: Synthetic peptide
  Seed: ESPLQSPVI (MAGC1_HUMAN)
  misc_feature (2)..(2): Xaa can be Pro, Ala, Ile, Thr, Met, Val, Leu, Ser, Gln, Phe, Gly, Cys, Glu, Asn, Tyr, Asp, or His
  misc_feature (9)..(9): Xaa can be Val, Leu, Ile, Met, Phe, Cys, Ala, or Thr
EXPLQSPVX

SEQ ID NO: 94481 - protein, 11 aa, Artificial Sequence
  Description of Artificial Sequence: Synthetic peptide
  Seed: ESPLQSPVISF (MAGC1_HUMAN)
  misc_feature (2)..(2): Xaa can be Ala, Thr, Ser, Gly, Cys, Val, Asn, Met, Leu, or Ile
  misc_feature (11)..(11): Xaa can be Trp, or Phe
EXPLQSPVISX

SEQ ID NO: 94482 - protein, 9 aa, Artificial Sequence
  Description of Artificial Sequence: Synthetic peptide
  Seed: ESSSPVDEY (MAGC1_HUMAN)
  misc_feature (2)..(2): Xaa can be Val, Ile, Thr, Ala, Pro, Leu, Ser, Met, Gln, Phe, Gly, Glu, Tyr, Trp, His, Asn, Cys, Lys, Asp, or Arg
  misc_feature (9)..(9): Xaa can be Tyr, Arg, Lys, Phe, Met, Leu, Trp, His, Ile, Val, Gln, or Ala
EXSSPVDEX

SEQ ID NO: 94483 - protein, 10 aa, Artificial Sequence
  Description of Artificial Sequence: Synthetic peptide
  Seed: ESTQSPFEGF (MAGC1_HUMAN)
  misc_feature (2)..(2): Xaa can be Val, Ala, Thr, Ser, Ile, Met, Cys, Leu, or Gly
  misc_feature (10)..(10): Xaa can be Trp, Tyr, Phe, or Leu
EXTQSPFEGX

SEQ ID NO: 94484 - protein, 8 aa, Artificial Sequence
  Description of Artificial Sequence: Synthetic peptide
  Seed: EVDPDDSY (MAGC1_HUMAN)
  misc_feature (2)..(2): Xaa can be Thr, Val, Met, Ala, Ser, Ile, or Leu
  misc_feature (8)..(8): Xaa can be , or Tyr
EXDPDDSX

SEQ ID NO: 94485 - protein, 9 aa, Artificial Sequence
  Description of Artificial Sequence: Synthetic peptide
  Seed: EVDPDDSYV (MAGC1_HUMAN)
  misc_feature (2)..(2): Xaa can be Ala, Val, Ile, Leu, Met, Phe, Ser, Thr, Cys, Tyr, Trp, Asn, Gly, Gln, Pro, Arg, Glu, or As p
  misc_feature (9)..(9): Xaa can be Leu, Met, Phe, Val, Ile, Tyr, Lys, Cys, Ala, or Trp
EXDPDDSYX

SEQ ID NO: 94486 - protein, 10 aa, Artificial Sequence
  Description of Artificial Sequence: Synthetic peptide
  Seed: EVDPDDSYVF (MAGC1_HUMAN)
  misc_feature (2)..(2): Xaa can be Ser, Thr, Leu, Ile, Ala, Met, Val, Trp, Phe, Tyr, Gln, Gly, Cys, Asn, Pro, Glu, Asp, Lys, or His
  misc_feature (10)..(10): Xaa can be Tyr, Trp, Lys, Phe, Leu, Met, Arg, Ile, Val, or His
EXDPDDSYVX

SEQ ID NO: 94487 - protein, 11 aa, Artificial Sequence
  Description of Artificial Sequence: Synthetic peptide
  Seed: EVDPDDSYVFV (MAGC1_HUMAN)
  misc_feature (2)..(2): Xaa can be Ala, Leu, Ile, Ser, Met, Gly, Val, Thr, Cys, Phe, Asn, Trp, Gln, Tyr, or Pro
  misc_feature (11)..(11): Xaa can be Leu, Met, Phe, Val, Ile, Lys, Tyr, Trp, or Cys
EXDPDDSYVFX

SEQ ID NO: 94488 - protein, 8 aa, Artificial Sequence
  Description of Artificial Sequence: Synthetic peptide
  Seed: EVIKRKVV (MAGC1_HUMAN)
  misc_feature (2)..(2): Xaa can be Ala, Pro, Gly, Leu, Ile, Met, Gln, Val, Ser, Thr, Asn, Phe, Trp, Cys, Glu, Tyr, Lys, His, Asp, or Arg
  misc_feature (8)..(8): Xaa can be Leu, Met, Ile, Val, or Phe
EXIKRKVX

SEQ ID NO: 94489 - protein, 10 aa, Artificial Sequence
  Description of Artificial Sequence: Synthetic peptide
  Seed: EVIKRKVVEF (MAGC1_HUMAN)
  misc_feature (2)..(2): Xaa can be Thr, Val, Ala, Ile, Gln, Leu, Ser, Met, Glu, Gly, Pro, Cys, Asp, Phe, or Asn
  misc_feature (10)..(10): Xaa can be Arg, Tyr, Phe, Lys, Trp, Met, Leu, His, Val, or Ile
EXIKRKVVEX

SEQ ID NO: 94490 - protein, 10 aa, Artificial Sequence
  Description of Artificial Sequence: Synthetic peptide
  Seed: EVIWDVLSGI (MAGC1_HUMAN)
  misc_feature (2)..(2): Xaa can be Thr, Val, Ser, Ala, Ile, Met, Leu, Gln, Gly, Cys, Pro, Asn, Phe, Asp, Trp, Tyr, Glu, His, Lys, or Arg
  misc_feature (10)..(10): Xaa can be Met, Val, Ala, Leu, Ile, Tyr, Phe, Arg, Lys, Trp, Thr, Ser, His, Cys, Gln, Glu, Pro, or Gl y
EXIWDVLSGX

SEQ ID NO: 94491 - protein, 9 aa, Artificial Sequence
  Description of Artificial Sequence: Synthetic peptide
  Seed: EVPNSSPPR (MAGC1_HUMAN)
  misc_feature (2)..(2): Xaa can be Ile, Thr, Val, Ala, Leu, Ser, Glu, Gln, Gly, Pro, Phe, Tyr, Met, Cys, Trp, Asp, or Asn
  misc_feature (9)..(9): Xaa can be Lys, Arg, Leu, Met, Tyr, Phe, Val, Ile, or His
EXPNSSPPX

SEQ ID NO: 94492 - protein, 10 aa, Artificial Sequence
  Description of Artificial Sequence: Synthetic peptide
  Seed: EVPNSSPPRY (MAGC1_HUMAN)
  misc_feature (2)..(2): Xaa can be Thr, Val, Ile, Ala, Ser, Met, Leu, Gln, Phe, Glu, Pro, Asn, Tyr, Trp, Asp, Gly, or Cys
  misc_feature (10)..(10): Xaa can be Lys, Arg, Tyr, Trp, Phe, Leu, Met, Val, Ile, His, Gln, or Ala
EXPNSSPPRX

SEQ ID NO: 94493 - protein, 10 aa, Artificial Sequence
  Description of Artificial Sequence: Synthetic peptide
  Seed: EWEDSLSPHY (MAGC1_HUMAN)
  misc_feature (2)..(2): Xaa can be Thr, Ser, Met, Ile, Val, Leu, Gly, Asn, Ala, Gln, Phe, Asp, Trp, Glu, Cys, or Tyr
  misc_feature (10)..(10): Xaa can be Tyr, Lys, Arg, Phe, or Trp
EXEDSLSPHX

SEQ ID NO: 94494 - protein, 11 aa, Artificial Sequence
  Description of Artificial Sequence: Synthetic peptide
  Seed: EWEDSLSPHYF (MAGC1_HUMAN)
  misc_feature (2)..(2): Xaa can be Tyr, Trp, or Phe
  misc_feature (11)..(11): Xaa can be Phe, Ile, Trp, or Leu
EXEDSLSPHYX

SEQ ID NO: 94495 - protein, 9 aa, Artificial Sequence
  Description of Artificial Sequence: Synthetic peptide
  Seed: EWEDSLSPL (MAGC1_HUMAN)
  misc_feature (2)..(2): Xaa can be , or Trp
  misc_feature (9)..(9): Xaa can be , or Leu
EXEDSLSPX

SEQ ID NO: 94496 - protein, 11 aa, Artificial Sequence
  Description of Artificial Sequence: Synthetic peptide
  Seed: EWEDSLSPLHF (MAGC1_HUMAN)
  misc_feature (2)..(2): Xaa can be Tyr, Trp, or Phe
  misc_feature (11)..(11): Xaa can be Phe, Trp, Ile, or Leu
EXEDSLSPLHX

SEQ ID NO: 94497 - protein, 9 aa, Artificial Sequence
  Description of Artificial Sequence: Synthetic peptide
  Seed: EYTSSSDTL (MAGC1_HUMAN)
  misc_feature (2)..(2): Xaa can be His, Tyr, Arg, Gln, Phe, Trp, Lys, Asn, or Glu
  misc_feature (9)..(9): Xaa can be Leu, Phe, Met, Trp, Ile, Val, Tyr, or Cys
EXTSSSDTX

SEQ ID NO: 94498 - protein, 10 aa, Artificial Sequence
  Description of Artificial Sequence: Synthetic peptide
  Seed: EYTSSSDTLL (MAGC1_HUMAN)
  misc_feature (2)..(2): Xaa can be Tyr, Trp, Thr, Phe, His, Met, Ala, Leu, Asn, Arg, Glu, Gly, Asp, Pro, Ile, Ser, Cys, Gln, Val, or Lys
  misc_feature (10)..(10): Xaa can be Leu, Ile, Val, Phe, Trp, or Ala
EXTSSSDTLX

SEQ ID NO: 94499 - protein, 9 aa, Artificial Sequence
  Description of Artificial Sequence: Synthetic peptide
  Seed: FAFGEPREL (MAGC1_HUMAN)
  misc_feature (2)..(2): Xaa can be Pro, Tyr, Ala, Arg, Ser, Val, Glu, Met, Gln, Leu, His, Thr, Ile, Phe, Gly, Trp, Asp, Asn, Cys, or Lys
  misc_feature (9)..(9): Xaa can be Leu, Tyr, His, Ala, Lys, Met, Trp, Phe, Ile, Val, Arg, Cys, Thr, Ser, Gln, Pro, Gly, Glu, Asn, or Asp
FXFGEPREX

SEQ ID NO: 94500 - protein, 10 aa, Artificial Sequence
  Description of Artificial Sequence: Synthetic peptide
  Seed: FAFGEPRELL (MAGC1_HUMAN)
  misc_feature (2)..(2): Xaa can be Ala, Pro, Met, Leu, Thr, Val, Gln, Arg, Ile, Ser, Gly, Asn, Glu, Tyr, Cys, Phe, Lys, Trp, His, or Asp
  misc_feature (10)..(10): Xaa can be Tyr, Leu, Phe, Trp, Met, Val, Lys, Ile, Ala, Arg, His, Thr, Cys, Ser, Gly, Pro, Asn, Glu, Gln, or Asp
FXFGEPRELX

SEQ ID NO: 94501 - protein, 8 aa, Artificial Sequence
  Description of Artificial Sequence: Synthetic peptide
  Seed: FAQSPLQI (MAGC1_HUMAN)
  misc_feature (2)..(2): Xaa can be Pro, Ala, Gln, or Glu
  misc_feature (8)..(8): Xaa can be Ile, Val, Leu, Pro, Ala, Thr, Cys, Met, Ser, Phe, or Tyr
FXQSPLQX

SEQ ID NO: 94502 - protein, 9 aa, Artificial Sequence
  Description of Artificial Sequence: Synthetic peptide
  Seed: FAQSPLQIP (MAGC1_HUMAN)
  misc_feature (2)..(2): Xaa can be Pro, Ala, Val, Ser, Ile, Gly, Met, Thr, Leu, Phe, Gln, Asp, or Cys
  misc_feature (9)..(9): Xaa can be Tyr, Phe, Leu, Ile, Val, Met, Ala, Trp, His, Cys, Lys, Asp, Gly, Gln, Arg, Ser, Thr, Pro, Glu, or Asn
FXQSPLQIX

SEQ ID NO: 94503 - protein, 10 aa, Artificial Sequence
  Description of Artificial Sequence: Synthetic peptide
  Seed: FAQSPLQIPV (MAGC1_HUMAN)
  misc_feature (2)..(2): Xaa can be Pro, or Ala
  misc_feature (10)..(10): Xaa can be , or Val
FXQSPLQIPX

SEQ ID NO: 94504 - protein, 8 aa, Artificial Sequence
  Description of Artificial Sequence: Synthetic peptide
  Seed: FAQSSLQI (MAGC1_HUMAN)
  misc_feature (2)..(2): Xaa can be Ala, Ser, Thr, Gly, Val, Ile, Gln, Phe, Pro, Tyr, Glu, Met, Leu, Asn, Asp, Arg, Trp, or Hi s
  misc_feature (8)..(8): Xaa can be Leu, Met, Tyr, Lys, Phe, Ile, Val, Arg, His, or Trp
FXQSSLQX

SEQ ID NO: 94505 - protein, 10 aa, Artificial Sequence
  Description of Artificial Sequence: Synthetic peptide
  Seed: FAQSSLQIPV (MAGC1_HUMAN)
  misc_feature (2)..(2): Xaa can be Leu, Met, Gln, Ala, Val, Ile, Thr, Ser, Arg, His, Gly, Cys, Phe, Asn, Trp, Tyr, Pro, Glu, Asp, or Lys
  misc_feature (10)..(10): Xaa can be Met, Leu, Ile, Ala, Val, Phe, Tyr, Thr, Ser, Cys, Pro, Gly, or Trp
FXQSSLQIPX

SEQ ID NO: 94506 - protein, 8 aa, Artificial Sequence
  Description of Artificial Sequence: Synthetic peptide
  Seed: FEGFAQSP (MAGC1_HUMAN)
  misc_feature (2)..(2): Xaa can be Glu, or Asp
  misc_feature (8)..(8): Xaa can be Val, Leu, Pro, Phe, Met, Ile, Cys, Ala, or Thr
FXGFAQSX

SEQ ID NO: 94507 - protein, 9 aa, Artificial Sequence
  Description of Artificial Sequence: Synthetic peptide
  Seed: FEGFAQSPL (MAGC1_HUMAN)
  misc_feature (2)..(2): Xaa can be Glu, Gln, Lys, Met, Asp, His, Arg, Ala, Thr, Ser, Phe, Tyr, Val, Leu, Asn, Ile, Gly, or Pr o
  misc_feature (9)..(9): Xaa can be Phe, Tyr, Met, Leu, Trp, Ile, Val, His, Ala, Ser, Cys, Pro, Gly, or Thr
FXGFAQSPX

SEQ ID NO: 94508 - protein, 11 aa, Artificial Sequence
  Description of Artificial Sequence: Synthetic peptide
  Seed: FEGFAQSPLQI (MAGC1_HUMAN)
  misc_feature (2)..(2): Xaa can be , or Glu
  misc_feature (11)..(11): Xaa can be Val, Met, Ile, Cys, Phe, Leu, or Ala
FXGFAQSPLQX

SEQ ID NO: 94509 - protein, 9 aa, Artificial Sequence
  Description of Artificial Sequence: Synthetic peptide
  Seed: FEGFAQSSL (MAGC1_HUMAN)
  misc_feature (2)..(2): Xaa can be Glu, His, Asp, Ala, Gln, Tyr, Phe, Pro, Ser, Arg, Met, Val, Ile, Thr, Asn, Leu, Gly, Trp, Cys, or Lys
  misc_feature (9)..(9): Xaa can be Phe, Tyr, Leu, Met, Ile, Trp, Val, Ala, Cys, Gly, Ser, His, Thr, or Pro
FXGFAQSSX

SEQ ID NO: 94510 - protein, 11 aa, Artificial Sequence
  Description of Artificial Sequence: Synthetic peptide
  Seed: FEGFAQSSLQI (MAGC1_HUMAN)
  misc_feature (2)..(2): Xaa can be , or Glu
  misc_feature (11)..(11): Xaa can be Phe, Met, Ala, Val, Ile, Leu, or Cys
FXGFAQSSLQX

SEQ ID NO: 94511 - protein, 9 aa, Artificial Sequence
  Description of Artificial Sequence: Synthetic peptide
  Seed: FEGFPQSLL (MAGC1_HUMAN)
  misc_feature (2)..(2): Xaa can be Glu, Asp, Gln, Ala, Tyr, Arg, Phe, Ser, Val, Trp, Ile, Gly, His, Leu, Met, Asn, Thr, Lys, Pro, or Cys
  misc_feature (9)..(9): Xaa can be Leu, Met, Ile, Phe, Val, Trp, Ala, Tyr, Ser, Thr, Cys, Gly, or Pro
FXGFPQSLX

SEQ ID NO: 94512 - protein, 11 aa, Artificial Sequence
  Description of Artificial Sequence: Synthetic peptide
  Seed: FEGFPQSLLQI (MAGC1_HUMAN)
  misc_feature (2)..(2): Xaa can be , or Glu
  misc_feature (11)..(11): Xaa can be Ile, Leu, Val, Cys, Ala, Met, or Phe
FXGFPQSLLQX

SEQ ID NO: 94513 - protein, 8 aa, Artificial Sequence
  Description of Artificial Sequence: Synthetic peptide
  Seed: FEGFPQSP (MAGC1_HUMAN)
  misc_feature (2)..(2): Xaa can be Glu, Gln, Gly, Ile, His, Leu, Met, Lys, or Cys
  misc_feature (8)..(8): Xaa can be Leu, Met, Ile, Phe, Val, Trp, Tyr, Thr, Ala, Cys, or Pro
FXGFPQSX

SEQ ID NO: 94514 - protein, 9 aa, Artificial Sequence
  Description of Artificial Sequence: Synthetic peptide
  Seed: FEGFPQSPL (MAGC1_HUMAN)
  misc_feature (2)..(2): Xaa can be Glu, Asp, His, Arg, Ala, Gln, Tyr, Ser, Phe, Gly, Ile, Thr, Met, Asn, Val, Leu, Pro, Lys, Trp, or Cys
  misc_feature (9)..(9): Xaa can be Leu, Met, Phe, Ile, Val, Ala, Tyr, Cys, Pro, Ser, Gly, Thr, Trp, or His
FXGFPQSPX

SEQ ID NO: 94515 - protein, 11 aa, Artificial Sequence
  Description of Artificial Sequence: Synthetic peptide
  Seed: FEGFPQSPLQI (MAGC1_HUMAN)
  misc_feature (2)..(2): Xaa can be , or Glu
  misc_feature (11)..(11): Xaa can be Val, Cys, Ile, Leu, Met, Phe, or Ala
FXGFPQSPLQX

SEQ ID NO: 94516 - protein, 8 aa, Artificial Sequence
  Description of Artificial Sequence: Synthetic peptide
  Seed: FEGFPQSV (MAGC1_HUMAN)
  misc_feature (2)..(2): Xaa can be Ala, Asp, Arg, Asn, Ser, or Glu
  misc_feature (8)..(8): Xaa can be Val, Ile, Leu, Phe, Met, Trp, Tyr, or Ala
FXGFPQSX

SEQ ID NO: 94517 - protein, 9 aa, Artificial Sequence
  Description of Artificial Sequence: Synthetic peptide
  Seed: FEGFPQSVL (MAGC1_HUMAN)
  misc_feature (2)..(2): Xaa can be Glu, Asp, His, Gln, Met, Ala, Arg, Tyr, Gly, Phe, Ser, Val, Leu, Thr, Pro, Asn, Cys, Lys, Trp, or Ile
  misc_feature (9)..(9): Xaa can be Leu, Phe, Met, Tyr, Ile, Val, Trp, Ala, Cys, His, Pro, Thr, Gly, or Ser
FXGFPQSVX

SEQ ID NO: 94518 - protein, 11 aa, Artificial Sequence
  Description of Artificial Sequence: Synthetic peptide
  Seed: FEGFPQSVLQI (MAGC1_HUMAN)
  misc_feature (2)..(2): Xaa can be , or Glu
  misc_feature (11)..(11): Xaa can be Cys, Ile, Phe, Ala, Met, Val, Leu, or Thr
FXGFPQSVLQX

SEQ ID NO: 94519 - protein, 9 aa, Artificial Sequence
  Description of Artificial Sequence: Synthetic peptide
  Seed: FFSSALLSI (MAGC1_HUMAN)
  misc_feature (2)..(2): Xaa can be Met, Leu, Ala, Tyr, Ile, Val, Gln, Arg, Thr, Ser, Phe, Gly, Asn, Pro, Asp, Cys, Trp, His, Glu, or Lys
  misc_feature (9)..(9): Xaa can be Tyr, Leu, Ile, Met, Phe, Val, Lys, Trp, Ala, His, Arg, Cys, Thr, Ser, Gly, Pro, Gln, Asp, or Glu
FXSSALLSX

SEQ ID NO: 94520 - protein, 10 aa, Artificial Sequence
  Description of Artificial Sequence: Synthetic peptide
  Seed: FFSSALLSIF (MAGC1_HUMAN)
  misc_feature (2)..(2): Xaa can be Gln, Tyr, Ala, Ser, Met, Ile, His, Lys, Asp, Thr, Arg, Trp, Pro, Leu, Glu, Phe, Gly, Asn, Val, or Cys
  misc_feature (10)..(10): Xaa can be Met, Phe, Ile, Tyr, Leu, Trp, Val, His, or Ala
FXSSALLSIX

SEQ ID NO: 94521 - protein, 9 aa, Artificial Sequence
  Description of Artificial Sequence: Synthetic peptide
  Seed: FFSYTLASL (MAGC1_HUMAN)
  misc_feature (2)..(2): Xaa can be Met, Leu, Ala, Tyr, Gln, Ile, Thr, Val, Arg, Ser, Phe, Gly, Trp, Cys, Asn, His, Pro, Lys, Glu, or Asp
  misc_feature (9)..(9): Xaa can be Val, Met, Ile, Leu, Tyr, Phe, Ala, Trp, Thr, Cys, Gly, Ser, His, Arg, Gln, Pro, Glu, Lys, Asn, or Asp
FXSYTLASX

SEQ ID NO: 94522 - protein, 10 aa, Artificial Sequence
  Description of Artificial Sequence: Synthetic peptide
  Seed: FFSYTLASLL (MAGC1_HUMAN)
  misc_feature (2)..(2): Xaa can be Tyr, Leu, Gln, Met, Thr, Val, Ile, Ala, Phe, Ser, His, Glu, Gly, Pro, Lys, Asp, Trp, Asn, Cys, or Arg
  misc_feature (10)..(10): Xaa can be Met, Ile, Leu, Phe, Trp, Val, Ala, Tyr, His, Thr, Arg, Gly, Asn, Ser, Pro, Cys, Lys, Glu, Gln, or Asp
FXSYTLASLX

SEQ ID NO: 94523 - protein, 8 aa, Artificial Sequence
  Description of Artificial Sequence: Synthetic peptide
  Seed: FGEPRELL (MAGC1_HUMAN)
  misc_feature (2)..(2): Xaa can be Ala, Ser, Val, Tyr, Ile, Thr, Gly, Arg, His, Trp, Gln, Asn, Leu, Phe, Met, Glu, Asp, Cys, Lys, or Pro
  misc_feature (8)..(8): Xaa can be Leu, Met, Phe, Ile, Val, Tyr, Lys, or Trp
FXEPRELX

SEQ ID NO: 94524 - protein, 8 aa, Artificial Sequence
  Description of Artificial Sequence: Synthetic peptide
  Seed: FGISLREV (MAGC1_HUMAN)
  misc_feature (2)..(2): Xaa can be Gln, Ala, Ser, Val, Gly, Ile, Thr, Pro, Met, Leu, Glu, Phe, Asn, Cys, Asp, Tyr, His, or Ly s
  misc_feature (8)..(8): Xaa can be Leu, Ile, Val, Phe, Met, Tyr, Cys, Trp, Thr, Lys, or Ala
FXISLREX

SEQ ID NO: 94525 - protein, 8 aa, Artificial Sequence
  Description of Artificial Sequence: Synthetic peptide
  Seed: FIEILFGI (MAGC1_HUMAN)
  misc_feature (2)..(2): Xaa can be Met, Leu, Gln, Ile, Val, Thr, Ala, Ser, or Phe
  misc_feature (8)..(8): Xaa can be Val, Leu, Ile, Met, Ala, Thr, or Ser
FXEILFGX

SEQ ID NO: 94526 - protein, 10 aa, Artificial Sequence
  Description of Artificial Sequence: Synthetic peptide
  Seed: FIEILFGISL (MAGC1_HUMAN)
  misc_feature (2)..(2): Xaa can be Arg, Lys, Tyr, Gln, Glu, Ala, Thr, Ser, Met, Gly, His, Leu, Cys, Trp, Pro, Val, Phe, Asp, Asn, or Ile
  misc_feature (10)..(10): Xaa can be Phe, Leu, Met, Val, Ile, Ala, or Thr
FXEILFGISX

SEQ ID NO: 94527 - protein, 11 aa, Artificial Sequence
  Description of Artificial Sequence: Synthetic peptide
  Seed: FIEILFGISLR (MAGC1_HUMAN)
  misc_feature (2)..(2): Xaa can be Thr, Val, Gln, Ser, Phe, Trp, Ala, Lys, Pro, Gly, Ile, Met, His, Glu, Arg, Asp, Tyr, Asn, Cys, or Leu
  misc_feature (11)..(11): Xaa can be Arg, or Lys
FXEILFGISLX

SEQ ID NO: 94528 - protein, 11 aa, Artificial Sequence
  Description of Artificial Sequence: Synthetic peptide
  Seed: FIKGTYASEEV (MAGC1_HUMAN)
  misc_feature (2)..(2): Xaa can be Leu, Met, Ile, Val, or Gln
  misc_feature (11)..(11): Xaa can be Val, Ala, Leu, Met, Ile, or Thr
FXKGTYASEEX

SEQ ID NO: 94529 - protein, 9 aa, Artificial Sequence
  Description of Artificial Sequence: Synthetic peptide
  Seed: FLAMLKNTV (MAGC1_HUMAN)
  misc_feature (2)..(2): Xaa can be Met, Leu, Ala, Gln, Thr, Ser, Val, Ile, Gly, Asn, Phe, Cys, Glu, Tyr, Asp, Trp, or Pro
  misc_feature (9)..(9): Xaa can be Leu, Phe, Tyr, Met, Val, Ile, Arg, Lys, Ala, Trp, Cys, Thr, Ser, Gly, His, or Pro
FXAMLKNTX

SEQ ID NO: 94530 - protein, 10 aa, Artificial Sequence
  Description of Artificial Sequence: Synthetic peptide
  Seed: FLAMLKNTVP (MAGC1_HUMAN)
  misc_feature (2)..(2): Xaa can be Met, Leu, Ile, Gln, Val, Thr, Ser, Phe, or Ala
  misc_feature (10)..(10): Xaa can be Val, Leu, Ile, Met, Ala, Gly, Ser, Thr, Pro, Cys, Phe, Lys, Glu, Arg, Trp, Asn, Tyr, His, Gln, or Asp
FXAMLKNTVX

SEQ ID NO: 94531 - protein, 11 aa, Artificial Sequence
  Description of Artificial Sequence: Synthetic peptide
  Seed: FLAMLKNTVPI (MAGC1_HUMAN)
  misc_feature (2)..(2): Xaa can be Leu, Met, Gly, Tyr, Arg, Trp, Lys, Ser, Cys, Phe, His, Gln, Asp, Asn, Ile, Ala, Thr, Glu, Pro, or Val
  misc_feature (11)..(11): Xaa can be Met, Leu, Thr, Ala, Val, Ile, Ser, Cys, or Phe
FXAMLKNTVPX

SEQ ID NO: 94532 - protein, 8 aa, Artificial Sequence
  Description of Artificial Sequence: Synthetic peptide
  Seed: FLLLKYQV (MAGC1_HUMAN)
  misc_feature (2)..(2): Xaa can be Leu, Met, Pro, Ala, Ile, Val, Gly, Ser, Phe, Gln, Thr, or Asn
  misc_feature (8)..(8): Xaa can be Leu, Met, Ile, Val, Phe, or Ala
FXLLKYQX

SEQ ID NO: 94533 - protein, 9 aa, Artificial Sequence
  Description of Artificial Sequence: Synthetic peptide
  Seed: FLLLKYQVK (MAGC1_HUMAN)
  misc_feature (2)..(2): Xaa can be Leu, Met, Val, Thr, Ala, Ile, Gln, or Ser
  misc_feature (9)..(9): Xaa can be Arg, Lys, or Tyr
FXLLKYQVX

SEQ ID NO: 94534 - protein, 9 aa, Artificial Sequence
  Description of Artificial Sequence: Synthetic peptide
  Seed: FLWGPRAHS (MAGC1_HUMAN)
  misc_feature (2)..(2): Xaa can be Met, Leu, Ile, Val, Gln, Thr, Ala, Ser, Phe, Asn, Gly, Cys, Glu, or Trp
  misc_feature (9)..(9): Xaa can be Val, Leu, Ile, Met, Ala, Thr, Cys, Phe, Gly, Pro, Ser, or Glu
FXWGPRAHX

SEQ ID NO: 94535 - protein, 11 aa, Artificial Sequence
  Description of Artificial Sequence: Synthetic peptide
  Seed: FLWGPRAHSEV (MAGC1_HUMAN)
  misc_feature (2)..(2): Xaa can be Leu, Met, Gln, Ile, Val, Thr, Ser, or Ala
  misc_feature (11)..(11): Xaa can be Val, Ile, Leu, Ala, Met, Thr, or Cys
FXWGPRAHSEX

SEQ ID NO: 94536 - protein, 9 aa, Artificial Sequence
  Description of Artificial Sequence: Synthetic peptide
  Seed: FPESPQSPP (MAGC1_HUMAN)
  misc_feature (2)..(2): Xaa can be Pro, Ala, Val, Phe, Tyr, or Ile
  misc_feature (9)..(9): Xaa can be Leu, Met, Ala, Phe, Ile, Cys, Lys, Gly, Ser, Val, Tyr, Arg, Pro, Trp, Thr, or His
FXESPQSPX

SEQ ID NO: 94537 - protein, 10 aa, Artificial Sequence
  Description of Artificial Sequence: Synthetic peptide
  Seed: FPESPQSPPE (MAGC1_HUMAN)
  misc_feature (2)..(2): Xaa can be Pro, or Ala
  misc_feature (10)..(10): Xaa can be Ala, Leu, Glu, Trp, Gly, Ser, Val, Tyr, Gln, Lys, Ile, Arg, Phe, Thr, Cys, Pro, or Met
FXESPQSPPX

SEQ ID NO: 94538 - protein, 11 aa, Artificial Sequence
  Description of Artificial Sequence: Synthetic peptide
  Seed: FPESPQSPPEG (MAGC1_HUMAN)
  misc_feature (2)..(2): Xaa can be Pro, or Ala
  misc_feature (11)..(11): Xaa can be Leu, Met, Ser, Arg, Pro, Ala, Gly, Val, Lys, Cys, Thr, Tyr, Ile, Trp, or Phe
FXESPQSPPEX

SEQ ID NO: 94539 - protein, 9 aa, Artificial Sequence
  Description of Artificial Sequence: Synthetic peptide
  Seed: FPESSQSPP (MAGC1_HUMAN)
  misc_feature (2)..(2): Xaa can be Pro, or Ala
  misc_feature (9)..(9): Xaa can be Ala, Met, Cys, Ser, Ile, Thr, Pro, Phe, Gly, Tyr, Val, or Leu
FXESSQSPX

SEQ ID NO: 94540 - protein, 11 aa, Artificial Sequence
  Description of Artificial Sequence: Synthetic peptide
  Seed: FPESSQSPPEG (MAGC1_HUMAN)
  misc_feature (2)..(2): Xaa can be , or Pro
  misc_feature (11)..(11): Xaa can be Tyr, Pro, Ile, Phe, Gly, Thr, Cys, Leu, Ser, Ala, Val, or Met
FXESSQSPPEX

SEQ ID NO: 94541 - protein, 8 aa, Artificial Sequence
  Description of Artificial Sequence: Synthetic peptide
  Seed: FPPQGEDF (MAGC1_HUMAN)
  misc_feature (2)..(2): Xaa can be Pro, or Ala
  misc_feature (8)..(8): Xaa can be Tyr, Leu, Met, Val, Phe, or Ile
FXPQGEDX

SEQ ID NO: 94542 - protein, 11 aa, Artificial Sequence
  Description of Artificial Sequence: Synthetic peptide
  Seed: FPPQGEDFQSS (MAGC1_HUMAN)
  misc_feature (2)..(2): Xaa can be , or Pro
  misc_feature (11)..(11): Xaa can be Met, Pro, Ser, Leu, Val, Phe, Gly, Thr, Ala, Ile, or Cys
FXPQGEDFQSX

SEQ ID NO: 94543 - protein, 8 aa, Artificial Sequence
  Description of Artificial Sequence: Synthetic peptide
  Seed: FPQFPPQG (MAGC1_HUMAN)
  misc_feature (2)..(2): Xaa can be , or Pro
  misc_feature (8)..(8): Xaa can be Val, Cys, Ala, Thr, Met, Ser, Pro, Gly, Ile, Phe, Tyr, or Leu
FXQFPPQX

SEQ ID NO: 94544 - protein, 9 aa, Artificial Sequence
  Description of Artificial Sequence: Synthetic peptide
  Seed: FPQFPPQGE (MAGC1_HUMAN)
  misc_feature (2)..(2): Xaa can be Pro, Ala, Ile, Gly, Val, or Ser
  misc_feature (9)..(9): Xaa can be Ala, Leu, Val, Cys, Met, Ile, Phe, Pro, Thr, Ser, Trp, Gly, Tyr, Glu, Asn, His, Lys, Gln, or Arg
FXQFPPQGX

SEQ ID NO: 94545 - protein, 11 aa, Artificial Sequence
  Description of Artificial Sequence: Synthetic peptide
  Seed: FPQFPPQGEDF (MAGC1_HUMAN)
  misc_feature (2)..(2): Xaa can be Pro, Ala, Gln, Val, Ile, Glu, Leu, Met, Thr, Ser, or Gly
  misc_feature (11)..(11): Xaa can be Tyr, Phe, Trp, Thr, Ser, His, Cys, Met, Leu, Val, Ala, Gly, Ile, or Pro
FXQFPPQGEDX

SEQ ID NO: 94546 - protein, 8 aa, Artificial Sequence
  Description of Artificial Sequence: Synthetic peptide
  Seed: FPQSLLQI (MAGC1_HUMAN)
  misc_feature (2)..(2): Xaa can be Pro, Ala, Gln, or Glu
  misc_feature (8)..(8): Xaa can be Ile, Val, Leu, Ala, Ser, Phe, Met, Cys, Pro, or Thr
FXQSLLQX

SEQ ID NO: 94547 - protein, 9 aa, Artificial Sequence
  Description of Artificial Sequence: Synthetic peptide
  Seed: FPQSLLQIP (MAGC1_HUMAN)
  misc_feature (2)..(2): Xaa can be Pro, Ala, Val, Gly, Ser, or Thr
  misc_feature (9)..(9): Xaa can be Ile, Val, Leu, Ala, Cys, Phe, Met, Trp, Gly, Pro, Tyr, Lys, Glu, Gln, Thr, Ser, His, or Ar g
FXQSLLQIX

SEQ ID NO: 94548 - protein, 10 aa, Artificial Sequence
  Description of Artificial Sequence: Synthetic peptide
  Seed: FPQSLLQIPM (MAGC1_HUMAN)
  misc_feature (2)..(2): Xaa can be Pro, Met, Gln, Leu, Ile, Val, Ala, Ser, Thr, Lys, His, Glu, Gly, Tyr, Arg, Asn, Cys, Phe, Trp, or Asp
  misc_feature (10)..(10): Xaa can be Ile, Tyr, Leu, Phe, Met, Ala, Val, Trp, Thr, Ser, Cys, His, Gly, Pro, Gln, Lys, Arg, Glu, or Asn
FXQSLLQIPX

SEQ ID NO: 94549 - protein, 11 aa, Artificial Sequence
  Description of Artificial Sequence: Synthetic peptide
  Seed: FPQSLLQIPMT (MAGC1_HUMAN)
  misc_feature (2)..(2): Xaa can be , or Pro
  misc_feature (11)..(11): Xaa can be Gly, Pro, Asn, Ser, Ile, Asp, Leu, Ala, Phe, Trp, Lys, Cys, His, Gln, Glu, Met, Thr, Arg, Tyr, or Val
FXQSLLQIPMX

SEQ ID NO: 94550 - protein, 9 aa, Artificial Sequence
  Description of Artificial Sequence: Synthetic peptide
  Seed: FPQSPLQGE (MAGC1_HUMAN)
  misc_feature (2)..(2): Xaa can be Pro, Ala, Val, Ile, or Gly
  misc_feature (9)..(9): Xaa can be Ala, Val, Cys, Leu, Met, Ile, Gly, Thr, Asn, Glu, His, Trp, Pro, Phe, Ser, Tyr, Lys, Gln, or Arg
FXQSPLQGX

SEQ ID NO: 94551 - protein, 11 aa, Artificial Sequence
  Description of Artificial Sequence: Synthetic peptide
  Seed: FPQSPLQGEEF (MAGC1_HUMAN)
  misc_feature (2)..(2): Xaa can be Pro, Ala, Ser, Val, Thr, Gly, Met, Gln, Ile, Leu, Glu, Cys, Phe, His, Asp, Trp, Tyr, Lys, or Asn
  misc_feature (11)..(11): Xaa can be Tyr, Phe, Leu, Trp, Met, Ile, Val, Ala, Cys, Thr, His, Lys, Ser, Arg, Gly, or Pro
FXQSPLQGEEX

SEQ ID NO: 94552 - protein, 8 aa, Artificial Sequence
  Description of Artificial Sequence: Synthetic peptide
  Seed: FPQSPLQI (MAGC1_HUMAN)
  misc_feature (2)..(2): Xaa can be Ala, or Pro
  misc_feature (8)..(8): Xaa can be , or Ile
FXQSPLQX

SEQ ID NO: 94553 - protein, 9 aa, Artificial Sequence
  Description of Artificial Sequence: Synthetic peptide
  Seed: FPQSPLQIP (MAGC1_HUMAN)
  misc_feature (2)..(2): Xaa can be , or Pro
  misc_feature (9)..(9): Xaa can be , or Pro
FXQSPLQIX

SEQ ID NO: 94554 - protein, 11 aa, Artificial Sequence
  Description of Artificial Sequence: Synthetic peptide
  Seed: FPQSPLQIPGS (MAGC1_HUMAN)
  misc_feature (2)..(2): Xaa can be , or Pro
  misc_feature (11)..(11): Xaa can be Ile, Ser, Lys, Trp, Met, Val, Ala, Cys, Phe, Arg, Tyr, Gly, Leu, Pro, or Thr
FXQSPLQIPGX

SEQ ID NO: 94555 - protein, 10 aa, Artificial Sequence
  Description of Artificial Sequence: Synthetic peptide
  Seed: FPQSPLQIPM (MAGC1_HUMAN)
  misc_feature (2)..(2): Xaa can be Pro, or Ala
  misc_feature (10)..(10): Xaa can be Val, Gln, or Met
FXQSPLQIPX

SEQ ID NO: 94556 - protein, 11 aa, Artificial Sequence
  Description of Artificial Sequence: Synthetic peptide
  Seed: FPQSPLQIPMT (MAGC1_HUMAN)
  misc_feature (2)..(2): Xaa can be , or Pro
  misc_feature (11)..(11): Xaa can be Arg, Leu, Pro, Gly, His, Met, Val, Phe, Gln, Asn, Cys, Thr, Ser, Glu, Trp, Ile, Lys, Ala, Tyr, or Asp
FXQSPLQIPMX

SEQ ID NO: 94557 - protein, 10 aa, Artificial Sequence
  Description of Artificial Sequence: Synthetic peptide
  Seed: FPQSPLQIPQ (MAGC1_HUMAN)
  misc_feature (2)..(2): Xaa can be Pro, or Thr
  misc_feature (10)..(10): Xaa can be Gly, Met, Ala, or Gln
FXQSPLQIPX

SEQ ID NO: 94558 - protein, 11 aa, Artificial Sequence
  Description of Artificial Sequence: Synthetic peptide
  Seed: FPQSPLQIPQS (MAGC1_HUMAN)
  misc_feature (2)..(2): Xaa can be , or Pro
  misc_feature (11)..(11): Xaa can be Met, Pro, Arg, Cys, Lys, Val, Gly, Thr, Tyr, Ser, Ile, Phe, Trp, Leu, or Ala
FXQSPLQIPQX

SEQ ID NO: 94559 - protein, 10 aa, Artificial Sequence
  Description of Artificial Sequence: Synthetic peptide
  Seed: FPQSPLQIPV (MAGC1_HUMAN)
  misc_feature (2)..(2): Xaa can be Pro, Leu, Met, Gln, Ser, Ile, Val, Thr, Gly, Phe, Cys, Trp, Lys, Ala, Glu, His, Tyr, Asp, Asn, or Arg
  misc_feature (10)..(10): Xaa can be Tyr, Leu, Ile, Val, Met, Ala, Trp, Phe, Thr, Ser, Cys, Pro, Gly, Asn, Lys, His, Arg, Asp, or Glu
FXQSPLQIPX

SEQ ID NO: 94560 - protein, 11 aa, Artificial Sequence
  Description of Artificial Sequence: Synthetic peptide
  Seed: FPQSPLQIPVS (MAGC1_HUMAN)
  misc_feature (2)..(2): Xaa can be Pro, or Ala
  misc_feature (11)..(11): Xaa can be Ala, Phe, Gly, Lys, Thr, Val, Arg, Pro, Leu, Ser, Tyr, Gln, Cys, Met, Trp, or Ile
FXQSPLQIPVX

SEQ ID NO: 94561 - protein, 8 aa, Artificial Sequence
  Description of Artificial Sequence: Synthetic peptide
  Seed: FPQSPPEW (MAGC1_HUMAN)
  misc_feature (2)..(2): Xaa can be Pro, Ala, Val, Ile, Ser, Gln, Trp, Asp, Leu, Asn, Gly, Cys, Tyr, Thr, Phe, or Met
  misc_feature (8)..(8): Xaa can be Trp, Tyr, Val, Leu, Ile, Met, or Phe
FXQSPPEX

SEQ ID NO: 94562 - protein, 11 aa, Artificial Sequence
  Description of Artificial Sequence: Synthetic peptide
  Seed: FPQSPPEWEDS (MAGC1_HUMAN)
  misc_feature (2)..(2): Xaa can be , or Pro
  misc_feature (11)..(11): Xaa can be Thr, Leu, Cys, Phe, Gly, Ile, Met, Ser, Val, Pro, or Ala
FXQSPPEWEDX

SEQ ID NO: 94563 - protein, 8 aa, Artificial Sequence
  Description of Artificial Sequence: Synthetic peptide
  Seed: FPQSPPQG (MAGC1_HUMAN)
  misc_feature (2)..(2): Xaa can be , or Pro
  misc_feature (8)..(8): Xaa can be Val, Leu, Tyr, Cys, Ser, Pro, Gly, Phe, Ile, Thr, Met, or Ala
FXQSPPQX

SEQ ID NO: 94564 - protein, 9 aa, Artificial Sequence
  Description of Artificial Sequence: Synthetic peptide
  Seed: FPQSPPQGE (MAGC1_HUMAN)
  misc_feature (2)..(2): Xaa can be Pro, Ala, Val, Met, Ser, Ile, Gly, or Leu
  misc_feature (9)..(9): Xaa can be Ala, Val, Leu, Thr, Cys, Met, Pro, Ile, Trp, His, Tyr, Arg, Gln, Asn, Glu, Phe, Gly, Asp, Ser, or Lys
FXQSPPQGX

SEQ ID NO: 94565 - protein, 11 aa, Artificial Sequence
  Description of Artificial Sequence: Synthetic peptide
  Seed: FPQSPPQGEDS (MAGC1_HUMAN)
  misc_feature (2)..(2): Xaa can be Pro, or Ala
  misc_feature (11)..(11): Xaa can be Ala, Leu, Met, Gly, Lys, Arg, Phe, Ile, Trp, Ser, Tyr, Val, Cys, Thr, or Pro
FXQSPPQGEDX

SEQ ID NO: 94566 - protein, 10 aa, Artificial Sequence
  Description of Artificial Sequence: Synthetic peptide
  Seed: FPQSPQGEDS (MAGC1_HUMAN)
  misc_feature (2)..(2): Xaa can be , or Pro
  misc_feature (10)..(10): Xaa can be Lys, Tyr, Ser, Leu, Cys, Gly, Val, Ile, Ala, Phe, Thr, Arg, Pro, or Met
FXQSPQGEDX

SEQ ID NO: 94567 - protein, 11 aa, Artificial Sequence
  Description of Artificial Sequence: Synthetic peptide
  Seed: FPQSPQGEDSL (MAGC1_HUMAN)
  misc_feature (2)..(2): Xaa can be Pro, Ala, Thr, Val, Ile, Leu, Arg, Gly, Ser, Phe, Trp, Tyr, Met, Gln, Cys, Glu, His, Asn, Asp, or Lys
  misc_feature (11)..(11): Xaa can be Tyr, Leu, Phe, Met, Ile, Trp, Val, Ala, Cys, Thr, Arg, Pro, Ser, Gly, His, or Lys
FXQSPQGEDSX

SEQ ID NO: 94568 - protein, 8 aa, Artificial Sequence
  Description of Artificial Sequence: Synthetic peptide
  Seed: FPQSVLQI (MAGC1_HUMAN)
  misc_feature (2)..(2): Xaa can be Pro, Glu, Gln, Ala, Asp, or Ser
  misc_feature (8)..(8): Xaa can be Ile, Val, Leu, Phe, Ala, Ser, Met, Thr, Cys, or Pro
FXQSVLQX

SEQ ID NO: 94569 - protein, 9 aa, Artificial Sequence
  Description of Artificial Sequence: Synthetic peptide
  Seed: FPQSVLQIP (MAGC1_HUMAN)
  misc_feature (2)..(2): Xaa can be Pro, Ala, Val, Ser, Gly, Thr, or Ile
  misc_feature (9)..(9): Xaa can be Ile, Val, Leu, Met, Ala, Cys, Phe, Trp, Thr, Pro, Glu, Asn, Gln, Gly, Ser, Arg, Lys, His, or Tyr
FXQSVLQIX

SEQ ID NO: 94570 - protein, 10 aa, Artificial Sequence
  Description of Artificial Sequence: Synthetic peptide
  Seed: FPQSVLQIPV (MAGC1_HUMAN)
  misc_feature (2)..(2): Xaa can be Pro, Met, Leu, Ile, Gln, Val, Thr, Ser, Ala, Gly, Phe, Cys, Asn, His, Lys, Glu, Trp, Tyr, Arg, or Asp
  misc_feature (10)..(10): Xaa can be Met, Ile, Val, Ala, Leu, Tyr, Phe, Thr, Trp, Ser, Cys, Gly, Pro, Asn, Lys, Glu, His, Gln, or Arg
FXQSVLQIPX

SEQ ID NO: 94571 - protein, 11 aa, Artificial Sequence
  Description of Artificial Sequence: Synthetic peptide
  Seed: FPQSVLQIPVS (MAGC1_HUMAN)
  misc_feature (2)..(2): Xaa can be , or Pro
  misc_feature (11)..(11): Xaa can be Val, Tyr, Met, Pro, Ser, Thr, Leu, Ile, Ala, Cys, Gly, or Phe
FXQSVLQIPVX

SEQ ID NO: 94572 - protein, 9 aa, Artificial Sequence
  Description of Artificial Sequence: Synthetic peptide
  Seed: FPSSTSSSL (MAGC1_HUMAN)
  misc_feature (2)..(2): Xaa can be Pro, Ala, Tyr, Phe, Ser, His, Thr, Met, Val, Gln, Gly, Arg, Ile, Asn, Leu, Trp, Cys, Glu, Lys, or Asp
  misc_feature (9)..(9): Xaa can be Tyr, Phe, Leu, Met, Ile, Val, Trp, His, Lys, Ala, Arg, Cys, Thr, Ser, Gln, Gly, Pro, Asn, Glu, or Asp
FXSSTSSSX

SEQ ID NO: 94573 - protein, 10 aa, Artificial Sequence
  Description of Artificial Sequence: Synthetic peptide
  Seed: FPSSTSSSLS (MAGC1_HUMAN)
  misc_feature (2)..(2): Xaa can be Pro, Ala, Met, Ile, Val, Leu, Ser, Thr, Phe, Arg, Lys, Cys, Tyr, Trp, Glu, Asp, Gly, Gln, His, or Asn
  misc_feature (10)..(10): Xaa can be Tyr, Phe, Met, Leu, Trp, Val, Pro, Ile, Glu, Asn, Ala, Lys, Thr, Gln, Asp, His, Arg, Ser, Cys, or Gly
FXSSTSSSLX

SEQ ID NO: 94574 - protein, 11 aa, Artificial Sequence
  Description of Artificial Sequence: Synthetic peptide
  Seed: FPSSTSSSLSK (MAGC1_HUMAN)
  misc_feature (2)..(2): Xaa can be Pro, Ser, Thr, Gly, Ile, Leu, Cys, Met, Gln, Glu, Phe, Trp, or Ala
  misc_feature (11)..(11): Xaa can be Lys, Arg, Leu, Met, Phe, Ile, Tyr, Ala, Val, Gly, Ser, Cys, Pro, Gln, Thr, or Trp
FXSSTSSSLSX

SEQ ID NO: 94575 - protein, 11 aa, Artificial Sequence
  Description of Artificial Sequence: Synthetic peptide
  Seed: FPSSTSSSLSQ (MAGC1_HUMAN)
  misc_feature (2)..(2): Xaa can be Val, Tyr, or Pro
  misc_feature (11)..(11): Xaa can be Lys, Arg, Val, Leu, Met, Phe, Ile, Tyr, or Gln
FXSSTSSSLSX

SEQ ID NO: 94576 - protein, 8 aa, Artificial Sequence
  Description of Artificial Sequence: Synthetic peptide
  Seed: FPSSYKDA (MAGC1_HUMAN)
  misc_feature (2)..(2): Xaa can be , or Pro
  misc_feature (8)..(8): Xaa can be Ala, Val, or Leu
FXSSYKDX

SEQ ID NO: 94577 - protein, 9 aa, Artificial Sequence
  Description of Artificial Sequence: Synthetic peptide
  Seed: FPSSYKDAL (MAGC1_HUMAN)
  misc_feature (2)..(2): Xaa can be Pro, His, Ala, Arg, Gln, Val, Ser, Gly, Ile, Thr, Glu, Lys, Phe, Tyr, Leu, Met, Cys, Trp, Asn, or Asp
  misc_feature (9)..(9): Xaa can be Met, Leu, Phe, Tyr, Ile, Val, Trp, Ala, Cys, Pro, Thr, Gly, Ser, His, Glu, Asn, Gln, Arg, or Lys
FXSSYKDAX

SEQ ID NO: 94578 - protein, 10 aa, Artificial Sequence
  Description of Artificial Sequence: Synthetic peptide
  Seed: FPSSYKDALK (MAGC1_HUMAN)
  misc_feature (2)..(2): Xaa can be Pro, Val, Thr, His, Ser, Phe, Met, Asp, Tyr, Lys, Gln, Cys, Asn, Ala, Trp, Leu, Arg, Gly, Glu, or Ile
  misc_feature (10)..(10): Xaa can be Lys, Arg, Tyr, Ser, Ala, Thr, Met, Phe, Ile, Asp, Pro, Trp, Gln, Leu, His, Asn, Val, Glu, Gly, or Cys
FXSSYKDALX

SEQ ID NO: 94579 - protein, 8 aa, Artificial Sequence
  Description of Artificial Sequence: Synthetic peptide
  Seed: FPVIFRKA (MAGC1_HUMAN)
  misc_feature (2)..(2): Xaa can be Pro, Ala, or Gly
  misc_feature (8)..(8): Xaa can be Ile, Val, Leu, Ala, Pro, Phe, Met, Thr, Cys, or Ser
FXVIFRKX

SEQ ID NO: 94580 - protein, 9 aa, Artificial Sequence
  Description of Artificial Sequence: Synthetic peptide
  Seed: FPVIFRKAR (MAGC1_HUMAN)
  misc_feature (2)..(2): Xaa can be Pro, Ala, Val, Phe, Thr, Tyr, Trp, Leu, Gly, Asp, Asn, Ser, Ile, Glu, Met, Gln, or Cys
  misc_feature (9)..(9): Xaa can be Arg, Lys, Ala, Val, Glu, Leu, Ile, Gly, Ser, Phe, Cys, Gln, Pro, Met, Tyr, or Thr
FXVIFRKAX

SEQ ID NO: 94581 - protein, 11 aa, Artificial Sequence
  Description of Artificial Sequence: Synthetic peptide
  Seed: FPVIFRKAREF (MAGC1_HUMAN)
  misc_feature (2)..(2): Xaa can be , or Pro
  misc_feature (11)..(11): Xaa can be Phe, Val, Leu, Met, Tyr, or Ile
FXVIFRKAREX

SEQ ID NO: 94582 - protein, 9 aa, Artificial Sequence
  Description of Artificial Sequence: Synthetic peptide
  Seed: FQSSLQSPV (MAGC1_HUMAN)
  misc_feature (2)..(2): Xaa can be Leu, Gln, Met, His, Arg, Ala, Thr, Ile, Val, Ser, Lys, Glu, Phe, Gly, Pro, Cys, Tyr, Asn, Trp, or Asp
  misc_feature (9)..(9): Xaa can be Phe, Leu, Tyr, Val, Met, Ile, Trp, Ala, His, Thr, Cys, Ser, Pro, Gly, Asp, Glu, Asn, or Gl n
FXSSLQSPX

SEQ ID NO: 94583 - protein, 10 aa, Artificial Sequence
  Description of Artificial Sequence: Synthetic peptide
  Seed: FQSSLQSPVS (MAGC1_HUMAN)
  misc_feature (2)..(2): Xaa can be Val, Thr, Ile, Leu, Gln, Met, Ala, Ser, or Phe
  misc_feature (10)..(10): Xaa can be Val, Leu, Ile, Ala, Phe, Met, Gly, His, Lys, Pro, Thr, Trp, Tyr, Asn, Gln, Glu, Cys, Ser, Asp, or Arg
FXSSLQSPVX

SEQ ID NO: 94584 - protein, 11 aa, Artificial Sequence
  Description of Artificial Sequence: Synthetic peptide
  Seed: FQSSLQSPVSI (MAGC1_HUMAN)
  misc_feature (2)..(2): Xaa can be Met, Leu, Ile, Gln, Val, Thr, Lys, Glu, Phe, Ala, Arg, His, Tyr, Ser, Trp, Pro, Gly, or As n
  misc_feature (11)..(11): Xaa can be Tyr, Phe, Val, Leu, Ile, Trp, Met, Ala, Asp, Thr, Glu, Arg, Cys, Asn, Gln, Ser, Gly, His, Pro, or Lys
FXSSLQSPVSX

SEQ ID NO: 94585 - protein, 9 aa, Artificial Sequence
  Description of Artificial Sequence: Synthetic peptide
  Seed: FQSSPERTH (MAGC1_HUMAN)
  misc_feature (2)..(2): Xaa can be Ala, Val, Ser, Thr, Ile, Gln, Leu, Gly, Met, Asn, Cys, Glu, Lys, Pro, Arg, Asp, His, Phe, Trp, or Tyr
  misc_feature (9)..(9): Xaa can be Phe, Met, Tyr, Leu, Ile, Trp, His, Val, Lys, Ala, Arg, Cys, Gln, Ser, Thr, Gly, Glu, Pro, or Asn
FXSSPERTX

SEQ ID NO: 94586 - protein, 10 aa, Artificial Sequence
  Description of Artificial Sequence: Synthetic peptide
  Seed: FRKAREFIEI (MAGC1_HUMAN)
  misc_feature (2)..(2): Xaa can be , or Arg
  misc_feature (10)..(10): Xaa can be Met, Phe, Leu, Val, or Ile
FXKAREFIEX

SEQ ID NO: 94587 - protein, 11 aa, Artificial Sequence
  Description of Artificial Sequence: Synthetic peptide
  Seed: FRKAREFIEIL (MAGC1_HUMAN)
  misc_feature (2)..(2): Xaa can be , or Arg
  misc_feature (11)..(11): Xaa can be , or Leu
FXKAREFIEIX

SEQ ID NO: 94588 - protein, 9 aa, Artificial Sequence
  Description of Artificial Sequence: Synthetic peptide
  Seed: FSEESSSPV (MAGC1_HUMAN)
  misc_feature (2)..(2): Xaa can be Leu, Met, Ala, Ser, Ile, Thr, Gln, Val, Tyr, Phe, Gly, Cys, Asn, Pro, Trp, Asp, Glu, Lys, or Arg
  misc_feature (9)..(9): Xaa can be Tyr, Met, Leu, Lys, Phe, Arg, Ile, Val, Trp, His, Ala, Cys, Thr, Ser, or Gly
FXEESSSPX

SEQ ID NO: 94589 - protein, 9 aa, Artificial Sequence
  Description of Artificial Sequence: Synthetic peptide
  Seed: FSERTQSTF (MAGC1_HUMAN)
  misc_feature (2)..(2): Xaa can be Ala, Pro, Thr, Ile, Ser, Val, Met, Gln, Gly, Leu, Cys, Phe, Arg, Trp, Tyr, Asp, His, Asn, Lys, or Glu
  misc_feature (9)..(9): Xaa can be Tyr, Phe, Met, Leu, Trp, Val, Ile, Lys, His, Arg, Ala, Cys, or Gln
FXERTQSTX

SEQ ID NO: 94590 - protein, 8 aa, Artificial Sequence
  Description of Artificial Sequence: Synthetic peptide
  Seed: FSSALLSI (MAGC1_HUMAN)
  misc_feature (2)..(2): Xaa can be Ala, Gly, Ser, Met, Thr, Ile, Gln, Val, Asn, Asp, Glu, Pro, Leu, Phe, or Cys
  misc_feature (8)..(8): Xaa can be Leu, Ile, Val, Met, Phe, Tyr, Lys, Arg, Trp, or His
FXSALLSX

SEQ ID NO: 94591 - protein, 9 aa, Artificial Sequence
  Description of Artificial Sequence: Synthetic peptide
  Seed: FSSALLSIF (MAGC1_HUMAN)
  misc_feature (2)..(2): Xaa can be Pro, Ala, Gln, Ser, Tyr, Val, Gly, Arg, Ile, Thr, Asn, Lys, Met, Glu, Leu, Phe, His, Cys, Trp, or Asp
  misc_feature (9)..(9): Xaa can be Tyr, Phe, Leu, Met, Trp, Ile, Val, His, Lys, Ala, Arg, Thr, Ser, Cys, Gln, Gly, Pro, Asp, Asn, or Glu
FXSALLSIX

SEQ ID NO: 94592 - protein, 10 aa, Artificial Sequence
  Description of Artificial Sequence: Synthetic peptide
  Seed: FSSSTSLSPF (MAGC1_HUMAN)
  misc_feature (2)..(2): Xaa can be Pro, Ala, Val, Gln, Ser, Met, Thr, Gly, Lys, Ile, Leu, His, Asp, Asn, Cys, Phe, Trp, Tyr, Arg, or Glu
  misc_feature (10)..(10): Xaa can be Trp, Phe, Tyr, Leu, Met, His, Lys, Ile, Val, Arg, Ala, Gly, Cys, Gln, Thr, Glu, Ser, or As n
FXSSTSLSPX

SEQ ID NO: 94593 - protein, 8 aa, Artificial Sequence
  Description of Artificial Sequence: Synthetic peptide
  Seed: FSSTLLSI (MAGC1_HUMAN)
  misc_feature (2)..(2): Xaa can be , or Ser
  misc_feature (8)..(8): Xaa can be Leu, or Ile
FXSTLLSX

SEQ ID NO: 94594 - protein, 9 aa, Artificial Sequence
  Description of Artificial Sequence: Synthetic peptide
  Seed: FSSTLLSIF (MAGC1_HUMAN)
  misc_feature (2)..(2): Xaa can be Ala, or Ser
  misc_feature (9)..(9): Xaa can be Arg, Leu, Ala, Cys, or Phe
FXSTLLSIX

SEQ ID NO: 94595 - protein, 9 aa, Artificial Sequence
  Description of Artificial Sequence: Synthetic peptide
  Seed: FSSTLLSIL (MAGC1_HUMAN)
  misc_feature (2)..(2): Xaa can be Pro, Val, Thr, Ala, Ser, Gln, Gly, Ile, Arg, Met, Lys, Asn, Leu, Cys, Tyr, Glu, Phe, Asp, Trp, or His
  misc_feature (9)..(9): Xaa can be Tyr, Leu, Met, Phe, Trp, Ile, Val, His, Lys, Ala, Arg, Thr, Cys, Gly, Gln, Ser, Glu, Pro, Asp, or Asn
FXSTLLSIX

SEQ ID NO: 94596 - protein, 8 aa, Artificial Sequence
  Description of Artificial Sequence: Synthetic peptide
  Seed: FSSTLLSL (MAGC1_HUMAN)
  misc_feature (2)..(2): Xaa can be Ala, Gly, Ser, Asn, Val, Met, Thr, Ile, Gln, Leu, Arg, Asp, Tyr, Cys, Glu, Phe, Pro, His, or Trp
  misc_feature (8)..(8): Xaa can be Leu, Phe, Met, Ile, Tyr, Val, Trp, Lys, His, or Arg
FXSTLLSX

SEQ ID NO: 94597 - protein, 9 aa, Artificial Sequence
  Description of Artificial Sequence: Synthetic peptide
  Seed: FSSTLLSLF (MAGC1_HUMAN)
  misc_feature (2)..(2): Xaa can be Pro, Ile, Met, Leu, Val, Gln, Ser, Thr, Ala, Gly, Arg, Phe, Tyr, Lys, Glu, Asn, His, Cys, Trp, or Asp
  misc_feature (9)..(9): Xaa can be Phe, Val, Trp, Leu, Tyr, Met, Ile, His, Lys, Ala, Cys, Thr, Arg, Gly, Ser, Pro, Glu, Gln, or Asn
FXSTLLSLX

SEQ ID NO: 94598 - protein, 8 aa, Artificial Sequence
  Description of Artificial Sequence: Synthetic peptide
  Seed: FSSTLVSL (MAGC1_HUMAN)
  misc_feature (2)..(2): Xaa can be Ser, Ala, Thr, Gly, Val, Gln, Asn, Ile, Arg, Met, Leu, Tyr, Asp, Phe, His, Cys, Glu, Trp, or Pro
  misc_feature (8)..(8): Xaa can be Leu, Phe, Met, Ile, Tyr, Val, Lys, His, Arg, or Trp
FXSTLVSX

SEQ ID NO: 94599 - protein, 9 aa, Artificial Sequence
  Description of Artificial Sequence: Synthetic peptide
  Seed: FSSTLVSLF (MAGC1_HUMAN)
  misc_feature (2)..(2): Xaa can be Pro, Met, Leu, Gln, Ala, Val, Ile, Ser, Arg, Thr, Tyr, Gly, Phe, Asn, His, Cys, Lys, Glu, Trp, or Asp
  misc_feature (9)..(9): Xaa can be Leu, Met, Tyr, Phe, Trp, Val, Ile, His, Lys, Arg, Ala, Thr, Cys, Ser, Gly, Pro, Gln, Asn, Asp, or Glu
FXSTLVSLX

SEQ ID NO: 94600 - protein, 10 aa, Artificial Sequence
  Description of Artificial Sequence: Synthetic peptide
  Seed: FSSTLVSLFQ (MAGC1_HUMAN)
  misc_feature (2)..(2): Xaa can be Ser, Ala, Thr, Ile, His, Arg, Phe, Trp, Gly, Cys, Val, Met, Tyr, Asp, Pro, Lys, Leu, Asn, Gln, or Glu
  misc_feature (10)..(10): Xaa can be Met, Trp, Phe, Leu, Tyr, Ile, Lys, Gly, Asp, Val, Cys, His, Thr, Gln, Pro, Glu, Ser, Ala, Asn, or Arg
FXSTLVSLFX

SEQ ID NO: 94601 - protein, 8 aa, Artificial Sequence
  Description of Artificial Sequence: Synthetic peptide
  Seed: FSYTLASL (MAGC1_HUMAN)
  misc_feature (2)..(2): Xaa can be Ala, Gln, Ser, Val, Thr, Met, Arg, Ile, Asn, Leu, Gly, Glu, Cys, Asp, Pro, His, Phe, Lys, or Tyr
  misc_feature (8)..(8): Xaa can be Leu, Val, Ile, Met, Phe, Tyr, Trp, Ala, His, Thr, or Cys
FXYTLASX

SEQ ID NO: 94602 - protein, 9 aa, Artificial Sequence
  Description of Artificial Sequence: Synthetic peptide
  Seed: FSYTLASLL (MAGC1_HUMAN)
  misc_feature (2)..(2): Xaa can be Gln, Ala, Met, Tyr, Leu, Arg, Ser, Thr, Ile, Val, Phe, Lys, Gly, Glu, Pro, His, Asn, Cys, Asp, or Trp
  misc_feature (9)..(9): Xaa can be Phe, Tyr, Val, Trp, Met, Leu, Ile, His, Ala, Thr, Cys, Ser, Lys, Gly, Gln, Pro, Arg, Glu, or Asn
FXYTLASLX

SEQ ID NO: 94603 - protein, 8 aa, Artificial Sequence
  Description of Artificial Sequence: Synthetic peptide
  Seed: FSYTLLSL (MAGC1_HUMAN)
  misc_feature (2)..(2): Xaa can be Ala, Gln, Ser, Val, Thr, Arg, Ile, Asn, Leu, His, Gly, Met, Glu, Pro, Tyr, Asp, Phe, Cys, or Lys
  misc_feature (8)..(8): Xaa can be Leu, Met, Phe, Ile, Val, Tyr, Trp, His, Ala, Thr, or Cys
FXYTLLSX

SEQ ID NO: 94604 - protein, 9 aa, Artificial Sequence
  Description of Artificial Sequence: Synthetic peptide
  Seed: FSYTLLSLF (MAGC1_HUMAN)
  misc_feature (2)..(2): Xaa can be Pro, Gln, Ala, Arg, Tyr, Met, Ser, Lys, Val, Thr, Ile, His, Leu, Gly, Phe, Asn, Glu, Cys, Trp, or Asp
  misc_feature (9)..(9): Xaa can be Phe, Met, Tyr, Trp, Ile, Leu, Val, His, Ala, Thr, Cys, Gly, Ser, Lys, Asn, Glu, Gln, or Ar g
FXYTLLSLX

SEQ ID NO: 94605 - protein, 10 aa, Artificial Sequence
  Description of Artificial Sequence: Synthetic peptide
  Seed: FSYTLLSLFQ (MAGC1_HUMAN)
  misc_feature (2)..(2): Xaa can be Ser, Thr, Ala, Val, Met, Gly, or Ile
  misc_feature (10)..(10): Xaa can be Trp, Tyr, Phe, Leu, Met, Ile, Pro, Gln, Thr, Glu, Lys, Val, His, Gly, Arg, Ala, Cys, Asn, Asp, or Ser
FXYTLLSLFX

SEQ ID NO: 94606 - protein, 8 aa, Artificial Sequence
  Description of Artificial Sequence: Synthetic peptide
  Seed: FTYTLDEK (MAGC1_HUMAN)
  misc_feature (2)..(2): Xaa can be Thr, or Val
  misc_feature (8)..(8): Xaa can be , or Lys
FXYTLDEX

SEQ ID NO: 94607 - protein, 9 aa, Artificial Sequence
  Description of Artificial Sequence: Synthetic peptide
  Seed: FTYTLDEKV (MAGC1_HUMAN)
  misc_feature (2)..(2): Xaa can be Leu, Met, Gln, Ile, Thr, Ala, Arg, Val, Ser, Gly, Asn, Glu, Asp, Phe, Cys, Lys, Tyr, Pro, His, or Trp
  misc_feature (9)..(9): Xaa can be Phe, Tyr, Val, Leu, Ile, Trp, Met, Lys, Arg, His, Ala, Thr, Cys, Ser, or Gly
FXYTLDEKX

SEQ ID NO: 94608 - protein, 8 aa, Artificial Sequence
  Description of Artificial Sequence: Synthetic peptide
  Seed: GDDTQSPL (MAGC1_HUMAN)
  misc_feature (2)..(2): Xaa can be Glu, or Asp
  misc_feature (8)..(8): Xaa can be Leu, Met, Phe, Ile, or Val
GXDTQSPX

SEQ ID NO: 94609 - protein, 8 aa, Artificial Sequence
  Description of Artificial Sequence: Synthetic peptide
  Seed: GDKDMPTA (MAGC1_HUMAN)
  misc_feature (2)..(2): Xaa can be Glu, or Asp
  misc_feature (8)..(8): Xaa can be Ile, Val, Leu, Ala, Pro, Met, Cys, Phe, or Thr
GXKDMPTX

SEQ ID NO: 94610 - protein, 9 aa, Artificial Sequence
  Description of Artificial Sequence: Synthetic peptide
  Seed: GDKDMPTAG (MAGC1_HUMAN)
  misc_feature (2)..(2): Xaa can be Glu, Asp, or Gln
  misc_feature (9)..(9): Xaa can be Pro, Met, Val, Ile, Cys, Leu, Ala, Phe, Thr, Ser, Gly, Asn, Gln, Arg, Glu, Trp, Tyr, Lys, or Asp
GXKDMPTAX

SEQ ID NO: 94611 - protein, 10 aa, Artificial Sequence
  Description of Artificial Sequence: Synthetic peptide
  Seed: GDKDMPTAGM (MAGC1_HUMAN)
  misc_feature (2)..(2): Xaa can be Glu, Asp, or Gln
  misc_feature (10)..(10): Xaa can be Leu, Phe, Met, Tyr, Pro, Thr, Ser, Ile, Val, Ala, Cys, or Trp
GXKDMPTAGX

SEQ ID NO: 94612 - protein, 8 aa, Artificial Sequence
  Description of Artificial Sequence: Synthetic peptide
  Seed: GEDFQSSL (MAGC1_HUMAN)
  misc_feature (2)..(2): Xaa can be Glu, or Asp
  misc_feature (8)..(8): Xaa can be Leu, Phe, Val, Ala, Cys, Ile, or Met
GXDFQSSX

SEQ ID NO: 94613 - protein, 10 aa, Artificial Sequence
  Description of Artificial Sequence: Synthetic peptide
  Seed: GEDFQSSLQS (MAGC1_HUMAN)
  misc_feature (2)..(2): Xaa can be Glu, or Asp
  misc_feature (10)..(10): Xaa can be Ala, Thr, Cys, Tyr, Met, Pro, Ile, Val, Phe, Leu, Ser, or Gly
GXDFQSSLQX

SEQ ID NO: 94614 - protein, 11 aa, Artificial Sequence
  Description of Artificial Sequence: Synthetic peptide
  Seed: GEDFQSSLQSP (MAGC1_HUMAN)
  misc_feature (2)..(2): Xaa can be Glu, Gln, or Asp
  misc_feature (11)..(11): Xaa can be Ala, Cys, Leu, Trp, Gly, Thr, Met, Pro, Phe, Val, Ser, Tyr, or Ile
GXDFQSSLQSX

SEQ ID NO: 94615 - protein, 9 aa, Artificial Sequence
  Description of Artificial Sequence: Synthetic peptide
  Seed: GEDSLSPHY (MAGC1_HUMAN)
  misc_feature (2)..(2): Xaa can be Glu, Asp, Gln, Thr, Ser, Ala, Met, Val, Ile, Leu, Phe, Tyr, Gly, Asn, Pro, Arg, Lys, Trp, Cys, or His
  misc_feature (9)..(9): Xaa can be Tyr, Phe, Lys, Arg, Met, Leu, His, Trp, Ile, Val, Cys, Ala, Pro, Gly, Ser, Asp, or Thr
GXDSLSPHX

SEQ ID NO: 94616 - protein, 10 aa, Artificial Sequence
  Description of Artificial Sequence: Synthetic peptide
  Seed: GEDSLSPHYF (MAGC1_HUMAN)
  misc_feature (2)..(2): Xaa can be Glu, Gln, Asp, Arg, Tyr, Met, Ile, Leu, Phe, Ala, Thr, Trp, His, Lys, Val, Ser, Pro, Gly, Asn, or Cys
  misc_feature (10)..(10): Xaa can be Leu, Met, Phe, Tyr, Trp, Ile, Val, Cys, Ala, Lys, Thr, Asp, Glu, His, Arg, Pro, Ser, or Gl y
GXDSLSPHYX

SEQ ID NO: 94617 - protein, 11 aa, Artificial Sequence
  Description of Artificial Sequence: Synthetic peptide
  Seed: GEDSLSPHYFP (MAGC1_HUMAN)
  misc_feature (2)..(2): Xaa can be , or Glu
  misc_feature (11)..(11): Xaa can be Ala, Pro, Ile, Phe, Thr, Leu, Met, Val, or Cys
GXDSLSPHYFX

SEQ ID NO: 94618 - protein, 8 aa, Artificial Sequence
  Description of Artificial Sequence: Synthetic peptide
  Seed: GEDSLSPL (MAGC1_HUMAN)
  misc_feature (2)..(2): Xaa can be Glu, or Asp
  misc_feature (8)..(8): Xaa can be Leu, Ala, Val, Ile, Phe, Thr, Met, Pro, or Cys
GXDSLSPX

SEQ ID NO: 94619 - protein, 9 aa, Artificial Sequence
  Description of Artificial Sequence: Synthetic peptide
  Seed: GEDSLSPLQ (MAGC1_HUMAN)
  misc_feature (2)..(2): Xaa can be Glu, Asp, or Gln
  misc_feature (9)..(9): Xaa can be Cys, Val, Leu, Ile, Ala, Met, Pro, Thr, Gly, Asp, Phe, Ser, Glu, Trp, Tyr, or Gln
GXDSLSPLX

SEQ ID NO: 94620 - protein, 10 aa, Artificial Sequence
  Description of Artificial Sequence: Synthetic peptide
  Seed: GEDSLSPLQI (MAGC1_HUMAN)
  misc_feature (2)..(2): Xaa can be Glu, Gln, Asp, Lys, or Arg
  misc_feature (10)..(10): Xaa can be Trp, Phe, Leu, Met, Ile, Val, Ala, Tyr, Cys, Asp, Thr, Arg, Ser, Pro, His, Gly, Gln, Glu, or Lys
GXDSLSPLQX

SEQ ID NO: 94621 - protein, 11 aa, Artificial Sequence
  Description of Artificial Sequence: Synthetic peptide
  Seed: GEDSLSPLQIP (MAGC1_HUMAN)
  misc_feature (2)..(2): Xaa can be Glu, Gln, or Asp
  misc_feature (11)..(11): Xaa can be Cys, Leu, Gly, Phe, Trp, Ala, Met, Ile, Thr, Tyr, Ser, Pro, or Val
GXDSLSPLQIX

SEQ ID NO: 94622 - protein, 8 aa, Artificial Sequence
  Description of Artificial Sequence: Synthetic peptide
  Seed: GEDSLSSL (MAGC1_HUMAN)
  misc_feature (2)..(2): Xaa can be Glu, or Asp
  misc_feature (8)..(8): Xaa can be Phe, Met, Leu, Pro, Thr, Val, Cys, Ala, or Ile
GXDSLSSX

SEQ ID NO: 94623 - protein, 9 aa, Artificial Sequence
  Description of Artificial Sequence: Synthetic peptide
  Seed: GEDSLSSLH (MAGC1_HUMAN)
  misc_feature (2)..(2): Xaa can be Glu, Asp, or Gln
  misc_feature (9)..(9): Xaa can be Trp, Phe, Tyr, Val, His, Leu, Cys, Met, or Ile
GXDSLSSLX

SEQ ID NO: 94624 - protein, 10 aa, Artificial Sequence
  Description of Artificial Sequence: Synthetic peptide
  Seed: GEDSLSSLHF (MAGC1_HUMAN)
  misc_feature (2)..(2): Xaa can be Glu, Gln, Asp, Met, Leu, Ile, Arg, Val, Ala, Pro, Phe, Lys, or Tyr
  misc_feature (10)..(10): Xaa can be Tyr, Phe, Trp, Leu, Met, Ile, Ala, Val, Lys, Gly, Cys, Ser, Pro, Arg, His, or Thr
GXDSLSSLHX

SEQ ID NO: 94625 - protein, 11 aa, Artificial Sequence
  Description of Artificial Sequence: Synthetic peptide
  Seed: GEDSLSSLHFP (MAGC1_HUMAN)
  misc_feature (2)..(2): Xaa can be , or Glu
  misc_feature (11)..(11): Xaa can be Val, Thr, Ser, Cys, Met, Ala, Gly, Phe, Leu, Pro, or Ile
GXDSLSSLHFX

SEQ ID NO: 94626 - protein, 8 aa, Artificial Sequence
  Description of Artificial Sequence: Synthetic peptide
  Seed: GEDSMSPL (MAGC1_HUMAN)
  misc_feature (2)..(2): Xaa can be Glu, or Asp
  misc_feature (8)..(8): Xaa can be Leu, Met, Ala, Val, Phe, Cys, or Ile
GXDSMSPX

SEQ ID NO: 94627 - protein, 9 aa, Artificial Sequence
  Description of Artificial Sequence: Synthetic peptide
  Seed: GEDSMSPLY (MAGC1_HUMAN)
  misc_feature (2)..(2): Xaa can be Glu, Asp, Thr, Gln, Val, Ser, Ile, Ala, Leu, Met, Phe, Gly, Tyr, Cys, Asn, Trp, Pro, Lys, or Arg
  misc_feature (9)..(9): Xaa can be Tyr, Lys, Phe, Arg, Met, His, Trp, Leu, Val, Ile, Ala, Cys, Pro, Gln, Glu, Thr, Asp, Gly, or Ser
GXDSMSPLX

SEQ ID NO: 94628 - protein, 10 aa, Artificial Sequence
  Description of Artificial Sequence: Synthetic peptide
  Seed: GEDSMSPLYF (MAGC1_HUMAN)
  misc_feature (2)..(2): Xaa can be Glu, Gln, Met, Asp, Leu, Ile, Val, Arg, Lys, Pro, Phe, Tyr, His, or Ala
  misc_feature (10)..(10): Xaa can be Tyr, Phe, Trp, Leu, Met, Ile, Val, Ala, Cys, Lys, Gly, Arg, Thr, Pro, Ser, or His
GXDSMSPLYX

SEQ ID NO: 94629 - protein, 11 aa, Artificial Sequence
  Description of Artificial Sequence: Synthetic peptide
  Seed: GEDSMSPLYFP (MAGC1_HUMAN)
  misc_feature (2)..(2): Xaa can be , or Glu
  misc_feature (11)..(11): Xaa can be Pro, Ala, Met, Thr, Cys, Val, Ile, Leu, or Phe
GXDSMSPLYFX

SEQ ID NO: 94630 - protein, 8 aa, Artificial Sequence
  Description of Artificial Sequence: Synthetic peptide
  Seed: GEDSQSPL (MAGC1_HUMAN)
  misc_feature (2)..(2): Xaa can be , or Glu
  misc_feature (8)..(8): Xaa can be Ile, Met, Ala, Val, Phe, or Leu
GXDSQSPX

SEQ ID NO: 94631 - protein, 9 aa, Artificial Sequence
  Description of Artificial Sequence: Synthetic peptide
  Seed: GEDSQSPLQ (MAGC1_HUMAN)
  misc_feature (2)..(2): Xaa can be Glu, Asp, or Gln
  misc_feature (9)..(9): Xaa can be Ala, Val, Cys, Met, Leu, Ile, Asp, Pro, Gln, Phe, Tyr, Gly, Thr, Ser, or Glu
GXDSQSPLX

SEQ ID NO: 94632 - protein, 10 aa, Artificial Sequence
  Description of Artificial Sequence: Synthetic peptide
  Seed: GEDSQSPLQI (MAGC1_HUMAN)
  misc_feature (2)..(2): Xaa can be Glu, Asp, Gln, Lys, or Arg
  misc_feature (10)..(10): Xaa can be Trp, Met, Leu, Ala, Ile, Cys, Phe, Tyr, Val, Thr, Gly, Ser, His, Arg, Lys, Pro, or Glu
GXDSQSPLQX

SEQ ID NO: 94633 - protein, 11 aa, Artificial Sequence
  Description of Artificial Sequence: Synthetic peptide
  Seed: GEDSQSPLQIP (MAGC1_HUMAN)
  misc_feature (2)..(2): Xaa can be Glu, Asp, or Gln
  misc_feature (11)..(11): Xaa can be Ala, Cys, Leu, Met, Tyr, Ser, Trp, Gly, Phe, Ile, Val, Pro, or Thr
GXDSQSPLQIX

SEQ ID NO: 94634 - protein, 8 aa, Artificial Sequence
  Description of Artificial Sequence: Synthetic peptide
  Seed: GEDSSDPL (MAGC1_HUMAN)
  misc_feature (2)..(2): Xaa can be , or Glu
  misc_feature (8)..(8): Xaa can be Ile, Val, Leu, or Ala
GXDSSDPX

SEQ ID NO: 94635 - protein, 10 aa, Artificial Sequence
  Description of Artificial Sequence: Synthetic peptide
  Seed: GEDSSDPLQR (MAGC1_HUMAN)
  misc_feature (2)..(2): Xaa can be Glu, Thr, Asp, Gln, Val, Met, Leu, Ser, Ile, Ala, Tyr, Phe, Arg, Gly, Cys, Trp, His, Asn, Pro, or Lys
  misc_feature (10)..(10): Xaa can be Tyr, Arg, Lys, Phe, Leu, Met, Trp, His, Gln, Ile, Val, Ala, Glu, Cys, Ser, Asn, Pro, Gly, or Thr
GXDSSDPLQX

SEQ ID NO: 94636 - protein, 11 aa, Artificial Sequence
  Description of Artificial Sequence: Synthetic peptide
  Seed: GEDSSDPLQRP (MAGC1_HUMAN)
  misc_feature (2)..(2): Xaa can be Glu, Gln, or Asp
  misc_feature (11)..(11): Xaa can be Ile, Val, Phe, Met, Leu, Ala, Cys, Thr, Tyr, Ser, Trp, Pro, or Gly
GXDSSDPLQRX

SEQ ID NO: 94637 - protein, 8 aa, Artificial Sequence
  Description of Artificial Sequence: Synthetic peptide
  Seed: GEDVQSPL (MAGC1_HUMAN)
  misc_feature (2)..(2): Xaa can be Glu, or Asp
  misc_feature (8)..(8): Xaa can be Phe, Leu, Cys, Val, Ile, Met, or Ala
GXDVQSPX

SEQ ID NO: 94638 - protein, 9 aa, Artificial Sequence
  Description of Artificial Sequence: Synthetic peptide
  Seed: GEDVQSPLQ (MAGC1_HUMAN)
  misc_feature (2)..(2): Xaa can be Glu, Asp, or Gln
  misc_feature (9)..(9): Xaa can be Val, Cys, Leu, Ala, Ile, Met, Ser, Glu, Thr, Pro, Phe, Gln, Tyr, Asp, or Gly
GXDVQSPLX

SEQ ID NO: 94639 - protein, 11 aa, Artificial Sequence
  Description of Artificial Sequence: Synthetic peptide
  Seed: GEDVQSPLQNP (MAGC1_HUMAN)
  misc_feature (2)..(2): Xaa can be Glu, Asp, or Gln
  misc_feature (11)..(11): Xaa can be Leu, Cys, Thr, Met, Ile, Phe, Val, Trp, Ala, Pro, Ser, Gly, or Tyr
GXDVQSPLQNX

SEQ ID NO: 94640 - protein, 8 aa, Artificial Sequence
  Description of Artificial Sequence: Synthetic peptide
  Seed: GEEFQSSL (MAGC1_HUMAN)
  misc_feature (2)..(2): Xaa can be Glu, or Asp
  misc_feature (8)..(8): Xaa can be Leu, Met, Phe, Ala, Val, or Ile
GXEFQSSX

SEQ ID NO: 94641 - protein, 10 aa, Artificial Sequence
  Description of Artificial Sequence: Synthetic peptide
  Seed: GEEFQSSLQS (MAGC1_HUMAN)
  misc_feature (2)..(2): Xaa can be Glu, or Asp
  misc_feature (10)..(10): Xaa can be Ala, Gly, Val, Met, Phe, Cys, Ile, Pro, Ser, Thr, or Leu
GXEFQSSLQX

SEQ ID NO: 94642 - protein, 11 aa, Artificial Sequence
  Description of Artificial Sequence: Synthetic peptide
  Seed: GEEFQSSLQSP (MAGC1_HUMAN)
  misc_feature (2)..(2): Xaa can be Glu, Asp, or Gln
  misc_feature (11)..(11): Xaa can be Cys, Leu, Val, Phe, Gly, Ser, Pro, Ile, Met, Tyr, Trp, Thr, or Ala
GXEFQSSLQSX

SEQ ID NO: 94643 - protein, 8 aa, Artificial Sequence
  Description of Artificial Sequence: Synthetic peptide
  Seed: GENTHSPL (MAGC1_HUMAN)
  misc_feature (2)..(2): Xaa can be Glu, Asp, Gln, Ala, Tyr, Ser, or Phe
  misc_feature (8)..(8): Xaa can be Leu, Phe, Ile, Val, Met, Ala, or Cys
GXNTHSPX

SEQ ID NO: 94644 - protein, 9 aa, Artificial Sequence
  Description of Artificial Sequence: Synthetic peptide
  Seed: GENTHSPLQ (MAGC1_HUMAN)
  misc_feature (2)..(2): Xaa can be Glu, Asp, or Gln
  misc_feature (9)..(9): Xaa can be Val, Met, Ile, Ala, Cys, Leu, Thr, Pro, Phe, Ser, Asn, Tyr, Asp, Gln, Trp, Glu, or Gly
GXNTHSPLX

SEQ ID NO: 94645 - protein, 10 aa, Artificial Sequence
  Description of Artificial Sequence: Synthetic peptide
  Seed: GENTHSPLQI (MAGC1_HUMAN)
  misc_feature (2)..(2): Xaa can be Glu, Asp, or Gln
  misc_feature (10)..(10): Xaa can be Trp, Phe, Tyr, Val, Ile, Ala, Leu, Met, Cys, Pro, Arg, Thr, Gly, His, Lys, or Ser
GXNTHSPLQX

SEQ ID NO: 94646 - protein, 11 aa, Artificial Sequence
  Description of Artificial Sequence: Synthetic peptide
  Seed: GENTHSPLQIV (MAGC1_HUMAN)
  misc_feature (2)..(2): Xaa can be Glu, or Asp
  misc_feature (11)..(11): Xaa can be Leu, Phe, Ala, Gly, Val, Thr, Trp, Cys, Tyr, Ile, Ser, Pro, or Met
GXNTHSPLQIX

SEQ ID NO: 94647 - protein, 9 aa, Artificial Sequence
  Description of Artificial Sequence: Synthetic peptide
  Seed: GEPRELLTK (MAGC1_HUMAN)
  misc_feature (2)..(2): Xaa can be Arg, Gln, Glu, Gly, Ala, Asn, Met, Ser, Ile, Thr, Leu, Lys, Val, Cys, Asp, Phe, Trp, Tyr, or Pro
  misc_feature (9)..(9): Xaa can be Leu, Phe, Ile, Lys, Met, Arg, Tyr, Val, Trp, Ala, Cys, His, or Gln
GXPRELLTX

SEQ ID NO: 94648 - protein, 10 aa, Artificial Sequence
  Description of Artificial Sequence: Synthetic peptide
  Seed: GEPRELLTKV (MAGC1_HUMAN)
  misc_feature (2)..(2): Xaa can be Glu, or Asp
  misc_feature (10)..(10): Xaa can be Leu, Phe, Ala, Cys, Ile, Val, Met, Gly, Trp, Thr, Tyr, Ser, or Pro
GXPRELLTKX

SEQ ID NO: 94649 - protein, 11 aa, Artificial Sequence
  Description of Artificial Sequence: Synthetic peptide
  Seed: GEPRELLTKVW (MAGC1_HUMAN)
  misc_feature (2)..(2): Xaa can be , or Glu
  misc_feature (11)..(11): Xaa can be Phe, Tyr, or Trp
GXPRELLTKVX

SEQ ID NO: 94650 - protein, 9 aa, Artificial Sequence
  Description of Artificial Sequence: Synthetic peptide
  Seed: GFAQSPLQI (MAGC1_HUMAN)
  misc_feature (2)..(2): Xaa can be Pro, or Phe
  misc_feature (9)..(9): Xaa can be Arg, or Ile
GXAQSPLQX

SEQ ID NO: 94651 - protein, 11 aa, Artificial Sequence
  Description of Artificial Sequence: Synthetic peptide
  Seed: GFAQSPLQIPV (MAGC1_HUMAN)
  misc_feature (2)..(2): Xaa can be Val, Ile, Leu, Gln, Tyr, Met, or Phe
  misc_feature (11)..(11): Xaa can be , or Val
GXAQSPLQIPX

SEQ ID NO: 94652 - protein, 9 aa, Artificial Sequence
  Description of Artificial Sequence: Synthetic peptide
  Seed: GFAQSSLQI (MAGC1_HUMAN)
  misc_feature (2)..(2): Xaa can be Tyr, Phe, Trp, or Met
  misc_feature (9)..(9): Xaa can be Phe, Trp, Tyr, Met, Leu, Ile, or Val
GXAQSSLQX

SEQ ID NO: 94653 - protein, 11 aa, Artificial Sequence
  Description of Artificial Sequence: Synthetic peptide
  Seed: GFAQSSLQIPV (MAGC1_HUMAN)
  misc_feature (2)..(2): Xaa can be Met, Leu, Tyr, Val, Gln, or Phe
  misc_feature (11)..(11): Xaa can be , or Val
GXAQSSLQIPX

SEQ ID NO: 94654 - protein, 9 aa, Artificial Sequence
  Description of Artificial Sequence: Synthetic peptide
  Seed: GFPQSLLQI (MAGC1_HUMAN)
  misc_feature (2)..(2): Xaa can be Arg, Tyr, Ala, Phe, Leu, Trp, Met, Ile, Gly, Glu, Gln, Lys, His, Ser, Asn, Cys, Pro, Val, Thr, or Asp
  misc_feature (9)..(9): Xaa can be Leu, Met, Ile, Phe, Val, Tyr, Trp, Ala, Cys, His, Arg, or Lys
GXPQSLLQX

SEQ ID NO: 94655 - protein, 11 aa, Artificial Sequence
  Description of Artificial Sequence: Synthetic peptide
  Seed: GFPQSLLQIPM (MAGC1_HUMAN)
  misc_feature (2)..(2): Xaa can be Tyr, Met, Phe, or Trp
  misc_feature (11)..(11): Xaa can be Tyr, Phe, Leu, or Met
GXPQSLLQIPX

SEQ ID NO: 94656 - protein, 9 aa, Artificial Sequence
  Description of Artificial Sequence: Synthetic peptide
  Seed: GFPQSPLQI (MAGC1_HUMAN)
  misc_feature (2)..(2): Xaa can be Ala, Arg, Tyr, Ser, Val, Phe, Ile, Thr, Gln, Leu, Met, Gly, Asn, Trp, Glu, His, Pro, Cys, Lys, or Asp
  misc_feature (9)..(9): Xaa can be Met, Leu, Ile, Tyr, Val, Phe, Lys, Arg, Trp, Cys, Ala, His, or Thr
GXPQSPLQX

SEQ ID NO: 94657 - protein, 11 aa, Artificial Sequence
  Description of Artificial Sequence: Synthetic peptide
  Seed: GFPQSPLQIPM (MAGC1_HUMAN)
  misc_feature (2)..(2): Xaa can be , or Phe
  misc_feature (11)..(11): Xaa can be , or Met
GXPQSPLQIPX

SEQ ID NO: 94658 - protein, 11 aa, Artificial Sequence
  Description of Artificial Sequence: Synthetic peptide
  Seed: GFPQSPLQIPV (MAGC1_HUMAN)
  misc_feature (2)..(2): Xaa can be Arg, His, Leu, Met, Tyr, Ala, Phe, or Lys
  misc_feature (11)..(11): Xaa can be Leu, Val, Met, Tyr, Ile, or Phe
GXPQSPLQIPX

SEQ ID NO: 94659 - protein, 9 aa, Artificial Sequence
  Description of Artificial Sequence: Synthetic peptide
  Seed: GFPQSVLQI (MAGC1_HUMAN)
  misc_feature (2)..(2): Xaa can be Ala, Arg, Ser, Tyr, Val, Phe, Ile, Thr, Gln, Gly, Asn, Leu, Trp, Glu, Met, Cys, His, Pro, Lys, or Asp
  misc_feature (9)..(9): Xaa can be Leu, Met, Phe, Tyr, Ile, Val, Lys, Trp, Arg, Cys, Ala, His, or Thr
GXPQSVLQX

SEQ ID NO: 94660 - protein, 9 aa, Artificial Sequence
  Description of Artificial Sequence: Synthetic peptide
  Seed: GMSQNRLLI (MAGC1_HUMAN)
  misc_feature (2)..(2): Xaa can be Arg, Gln, Met, Leu, Glu, Ala, Gly, Ser, Ile, Asn, Lys, Thr, Val, Asp, Trp, Cys, or Phe
  misc_feature (9)..(9): Xaa can be Leu, Phe, Ile, Lys, Val, Trp, Arg, Met, Ala, Tyr, Cys, Thr, His, Glu, Pro, Gln, Ser, Asn, or Gly
GXSQNRLLX

SEQ ID NO: 94661 - protein, 10 aa, Artificial Sequence
  Description of Artificial Sequence: Synthetic peptide
  Seed: GMSQNRLLIL (MAGC1_HUMAN)
  misc_feature (2)..(2): Xaa can be Arg, Gln, Leu, Met, Val, Ile, Glu, Thr, or Gly
  misc_feature (10)..(10): Xaa can be Leu, Trp, Val, Phe, Ile, Ala, Met, Arg, Lys, Tyr, His, or Gln
GXSQNRLLIX

SEQ ID NO: 94662 - protein, 9 aa, Artificial Sequence
  Description of Artificial Sequence: Synthetic peptide
  Seed: GPAQSPLQR (MAGC1_HUMAN)
  misc_feature (2)..(2): Xaa can be Tyr, Trp, Phe, Ser, Met, Lys, Pro, Leu, Ile, His, Thr, Val, Gln, Asp, or Gly
  misc_feature (9)..(9): Xaa can be Met, Leu, Phe, Tyr, Val, Arg, Ile, Trp, His, or Ser
GXAQSPLQX

SEQ ID NO: 94663 - protein, 10 aa, Artificial Sequence
  Description of Artificial Sequence: Synthetic peptide
  Seed: GPAQSPLQRP (MAGC1_HUMAN)
  misc_feature (2)..(2): Xaa can be , or Pro
  misc_feature (10)..(10): Xaa can be Met, Gly, Pro, Phe, Ser, Val, Thr, Ile, Cys, Leu, or Ala
GXAQSPLQRX

SEQ ID NO: 94664 - protein, 11 aa, Artificial Sequence
  Description of Artificial Sequence: Synthetic peptide
  Seed: GPAQSPLQRPV (MAGC1_HUMAN)
  misc_feature (2)..(2): Xaa can be , or Pro
  misc_feature (11)..(11): Xaa can be Ala, Met, Gly, Thr, Val, Cys, Ser, Phe, Ile, Pro, or Leu
GXAQSPLQRPX

SEQ ID NO: 94665 - protein, 9 aa, Artificial Sequence
  Description of Artificial Sequence: Synthetic peptide
  Seed: GPAQSPLQS (MAGC1_HUMAN)
  misc_feature (2)..(2): Xaa can be Ala, Asn, or Pro
  misc_feature (9)..(9): Xaa can be Arg, Lys, or Ser
GXAQSPLQX

SEQ ID NO: 94666 - protein, 10 aa, Artificial Sequence
  Description of Artificial Sequence: Synthetic peptide
  Seed: GPAQSPLQSP (MAGC1_HUMAN)
  misc_feature (2)..(2): Xaa can be Pro, or Ala
  misc_feature (10)..(10): Xaa can be Ala, Leu, Pro, Lys, Ser, Cys, Gln, Ile, Arg, Met, Phe, Tyr, Trp, Thr, Val, or Gly
GXAQSPLQSX

SEQ ID NO: 94667 - protein, 11 aa, Artificial Sequence
  Description of Artificial Sequence: Synthetic peptide
  Seed: GPAQSPLQSPV (MAGC1_HUMAN)
  misc_feature (2)..(2): Xaa can be , or Pro
  misc_feature (11)..(11): Xaa can be Pro, Val, Gly, Met, Leu, Ile, Cys, Trp, Phe, Ser, Ala, Thr, or Tyr
GXAQSPLQSPX

SEQ ID NO: 94668 - protein, 8 aa, Artificial Sequence
  Description of Artificial Sequence: Synthetic peptide
  Seed: GPRAHSEV (MAGC1_HUMAN)
  misc_feature (2)..(2): Xaa can be , or Pro
  misc_feature (8)..(8): Xaa can be Leu, Val, Phe, Ile, Met, or Ala
GXRAHSEX

SEQ ID NO: 94669 - protein, 9 aa, Artificial Sequence
  Description of Artificial Sequence: Synthetic peptide
  Seed: GPRAHSEVI (MAGC1_HUMAN)
  misc_feature (2)..(2): Xaa can be Pro, Ala, Met, Val, Leu, Ile, Thr, or Ser
  misc_feature (9)..(9): Xaa can be Leu, Met, Ile, Ala, Val, Phe, Pro, Gln, Thr, Arg, His, Cys, Ser, Gly, Tyr, or Trp
GXRAHSEVX

SEQ ID NO: 94670 - protein, 9 aa, Artificial Sequence
  Description of Artificial Sequence: Synthetic peptide
  Seed: GPVQSPLHS (MAGC1_HUMAN)
  misc_feature (2)..(2): Xaa can be , or Pro
  misc_feature (9)..(9): Xaa can be Ile, Pro, Gly, Ser, Cys, Leu, Met, Thr, Ala, Phe, or Val
GXVQSPLHX

SEQ ID NO: 94671 - protein, 10 aa, Artificial Sequence
  Description of Artificial Sequence: Synthetic peptide
  Seed: GPVQSPLHSP (MAGC1_HUMAN)
  misc_feature (2)..(2): Xaa can be Pro, or Ala
  misc_feature (10)..(10): Xaa can be Leu, Ala, Gln, Tyr, Val, Ile, Lys, Thr, Gly, Trp, Ser, Phe, Pro, Arg, Cys, or Met
GXVQSPLHSX

SEQ ID NO: 94672 - protein, 11 aa, Artificial Sequence
  Description of Artificial Sequence: Synthetic peptide
  Seed: GREHFAFGEPR (MAGC1_HUMAN)
  misc_feature (2)..(2): Xaa can be , or Arg
  misc_feature (11)..(11): Xaa can be Lys, Arg, Met, Tyr, Val, Phe, Leu, or Ile
GXEHFAFGEPX

SEQ ID NO: 94673 - protein, 9 aa, Artificial Sequence
  Description of Artificial Sequence: Synthetic peptide
  Seed: GSPSFSSTL (MAGC1_HUMAN)
  misc_feature (2)..(2): Xaa can be Tyr, Leu, Ala, Ile, Ser, Met, Gln, Val, Arg, Thr, Phe, Gly, Glu, Trp, Asp, Asn, Cys, Pro, His, or Lys
  misc_feature (9)..(9): Xaa can be Phe, Tyr, Leu, Ile, Met, Val, Trp, Arg, His, Ala, Lys, Cys, or Thr
GXPSFSSTX

SEQ ID NO: 94674 - protein, 10 aa, Artificial Sequence
  Description of Artificial Sequence: Synthetic peptide
  Seed: GSPSFSSTLL (MAGC1_HUMAN)
  misc_feature (2)..(2): Xaa can be Ala, Thr, Ser, Val, Leu, Gly, Ile, Gln, Met, Arg, Glu, Asn, Cys, Phe, Asp, Pro, Lys, His, Tyr, or Trp
  misc_feature (10)..(10): Xaa can be Leu, Met, Phe, Tyr, Lys, Arg, Ile, His, Val, or Trp
GXPSFSSTLX

SEQ ID NO: 94675 - protein, 9 aa, Artificial Sequence
  Description of Artificial Sequence: Synthetic peptide
  Seed: GTYASEEVI (MAGC1_HUMAN)
  misc_feature (2)..(2): Xaa can be Gln, Ala, Thr, Ser, Val, Gly, Ile, Leu, Glu, Met, Asn, Asp, Cys, Pro, His, or Phe
  misc_feature (9)..(9): Xaa can be Trp, Phe, Val, Ile, Leu, Tyr, Met, Lys, Arg, Pro, Cys, Ala, or Thr
GXYASEEVX

SEQ ID NO: 94676 - protein, 10 aa, Artificial Sequence
  Description of Artificial Sequence: Synthetic peptide
  Seed: GTYASEEVIW (MAGC1_HUMAN)
  misc_feature (2)..(2): Xaa can be Gln, Leu, Met, Ser, Thr, Glu, Val, Ile, Ala, Pro, Asn, Gly, or Cys
  misc_feature (10)..(10): Xaa can be Trp, Phe, Leu, Tyr, Met, Ile, or Val
GXYASEEVIX

SEQ ID NO: 94677 - protein, 9 aa, Artificial Sequence
  Description of Artificial Sequence: Synthetic peptide
  Seed: GVRAGREHF (MAGC1_HUMAN)
  misc_feature (2)..(2): Xaa can be Gln, Ala, Ser, Met, Val, Thr, Ile, Leu, Glu, Lys, Arg, Gly, Phe, Asn, Pro, His, Asp, Trp, Tyr, or Cys
  misc_feature (9)..(9): Xaa can be Tyr, Phe, Met, Leu, Trp, His, Val, or Ile
GXRAGREHX

SEQ ID NO: 94678 - protein, 10 aa, Artificial Sequence
  Description of Artificial Sequence: Synthetic peptide
  Seed: GVRAGREHFA (MAGC1_HUMAN)
  misc_feature (2)..(2): Xaa can be Thr, Ser, Val, Tyr, Met, Ile, Phe, Ala, Leu, Gly, Asn, His, Gln, or Trp
  misc_feature (10)..(10): Xaa can be Lys, Ala, Val, Tyr, Ile, Met, Leu, Arg, Ser, Phe, Gly, or Thr
GXRAGREHFX

SEQ ID NO: 94679 - protein, 11 aa, Artificial Sequence
  Description of Artificial Sequence: Synthetic peptide
  Seed: GVRAGREHFAF (MAGC1_HUMAN)
  misc_feature (2)..(2): Xaa can be Val, Gln, Met, Leu, Ile, Ser, Thr, Ala, or Glu
  misc_feature (11)..(11): Xaa can be Tyr, or Phe
GXRAGREHFAX

SEQ ID NO: 94680 - protein, 8 aa, Artificial Sequence
  Description of Artificial Sequence: Synthetic peptide
  Seed: GYFPVIFR (MAGC1_HUMAN)
  misc_feature (2)..(2): Xaa can be Met, Trp, Tyr, Phe, Thr, Val, Ser, Gln, Ile, Asn, Gly, Ala, or Leu
  misc_feature (8)..(8): Xaa can be Arg, or Lys
GXFPVIFX

SEQ ID NO: 94681 - protein, 9 aa, Artificial Sequence
  Description of Artificial Sequence: Synthetic peptide
  Seed: GYFPVIFRK (MAGC1_HUMAN)
  misc_feature (2)..(2): Xaa can be Leu, Met, Thr, Ile, Val, Gln, Ala, Tyr, Ser, Trp, Phe, Asn, Gly, Cys, Pro, Arg, Asp, Lys, His, or Glu
  misc_feature (9)..(9): Xaa can be Arg, Tyr, Lys, Phe, Leu, His, Trp, Met, Val, Ile, Ala, Gln, or Thr
GXFPVIFRX

SEQ ID NO: 94682 - protein, 11 aa, Artificial Sequence
  Description of Artificial Sequence: Synthetic peptide
  Seed: GYFPVIFRKAR (MAGC1_HUMAN)
  misc_feature (2)..(2): Xaa can be Tyr, Ser, Thr, Gln, Ile, Trp, Leu, Met, Phe, Val, Arg, Gly, Ala, or Asn
  misc_feature (11)..(11): Xaa can be Arg, or Lys
GXFPVIFRKAX

SEQ ID NO: 94683 - protein, 8 aa, Artificial Sequence
  Description of Artificial Sequence: Synthetic peptide
  Seed: HESPQSPP (MAGC1_HUMAN)
  misc_feature (2)..(2): Xaa can be Glu, or Asp
  misc_feature (8)..(8): Xaa can be Ala, Val, Leu, Cys, Met, Thr, Phe, Ser, Pro, or Ile
HXSPQSPX

SEQ ID NO: 94684 - protein, 9 aa, Artificial Sequence
  Description of Artificial Sequence: Synthetic peptide
  Seed: HESPQSPPE (MAGC1_HUMAN)
  misc_feature (2)..(2): Xaa can be Glu, Asp, or Gln
  misc_feature (9)..(9): Xaa can be Phe, Cys, Leu, Pro, Met, Ala, Ile, Val, Thr, Ser, Gly, Gln, Asn, Glu, Lys, Asp, Trp, Arg, or Tyr
HXSPQSPPX

SEQ ID NO: 94685 - protein, 10 aa, Artificial Sequence
  Description of Artificial Sequence: Synthetic peptide
  Seed: HESPQSPPEG (MAGC1_HUMAN)
  misc_feature (2)..(2): Xaa can be Glu, Asp, or Gln
  misc_feature (10)..(10): Xaa can be Met, Ile, Leu, Ala, Val, Phe, Cys, Ser, Pro, Arg, Glu, Thr, Trp, Tyr, Lys, Asp, Gln, or Gl y
HXSPQSPPEX

SEQ ID NO: 94686 - protein, 11 aa, Artificial Sequence
  Description of Artificial Sequence: Synthetic peptide
  Seed: HESPQSPPEGP (MAGC1_HUMAN)
  misc_feature (2)..(2): Xaa can be Glu, Asp, or Gln
  misc_feature (11)..(11): Xaa can be Cys, Leu, Ala, Ile, Phe, Met, Val, Pro, Lys, Trp, His, Arg, Thr, Tyr, Ser, Gln, or Gly
HXSPQSPPEGX

SEQ ID NO: 94687 - protein, 8 aa, Artificial Sequence
  Description of Artificial Sequence: Synthetic peptide
  Seed: HFAFGEPR (MAGC1_HUMAN)
  misc_feature (2)..(2): Xaa can be Met, Val, Phe, Tyr, or Thr
  misc_feature (8)..(8): Xaa can be , or Arg
HXAFGEPX

SEQ ID NO: 94688 - protein, 10 aa, Artificial Sequence
  Description of Artificial Sequence: Synthetic peptide
  Seed: HFAFGEPREL (MAGC1_HUMAN)
  misc_feature (2)..(2): Xaa can be Arg, Tyr, Ala, Met, Phe, Glu, Trp, Thr, Gln, Val, His, Ile, Asp, Ser, Pro, Leu, Asn, Gly, Lys, or Cys
  misc_feature (10)..(10): Xaa can be Met, Phe, Leu, Val, Tyr, Ile, Trp, Lys, or Arg
HXAFGEPREX

SEQ ID NO: 94689 - protein, 9 aa, Artificial Sequence
  Description of Artificial Sequence: Synthetic peptide
  Seed: HFPQSPPEW (MAGC1_HUMAN)
  misc_feature (2)..(2): Xaa can be Tyr, Ala, Arg, Phe, Trp, Thr, Ser, Val, Met, Ile, Gln, Leu, Gly, Asn, His, Asp, Pro, Cys, Lys, or Glu
  misc_feature (9)..(9): Xaa can be Phe, Tyr, Val, Leu, Met, Ile, Trp, Lys, Cys, Ala, Arg, His, Thr, Ser, or Gln
HXPQSPPEX

SEQ ID NO: 94690 - protein, 8 aa, Artificial Sequence
  Description of Artificial Sequence: Synthetic peptide
  Seed: HSEVIKRK (MAGC1_HUMAN)
  misc_feature (2)..(2): Xaa can be Thr, Val, Ile, Ser, or Ala
  misc_feature (8)..(8): Xaa can be , or Lys
HXEVIKRX

SEQ ID NO: 94691 - protein, 9 aa, Artificial Sequence
  Description of Artificial Sequence: Synthetic peptide
  Seed: HSEVIKRKV (MAGC1_HUMAN)
  misc_feature (2)..(2): Xaa can be Ala, Ser, Thr, Ile, Phe, Tyr, Val, Met, Leu, Arg, Gln, His, Gly, Glu, Trp, Pro, Asn, Asp, Cys, or Lys
  misc_feature (9)..(9): Xaa can be Leu, Met, Ile, Phe, Val, Tyr, Trp, or Lys
HXEVIKRKX

SEQ ID NO: 94692 - protein, 10 aa, Artificial Sequence
  Description of Artificial Sequence: Synthetic peptide
  Seed: HSPLQIVPSL (MAGC1_HUMAN)
  misc_feature (2)..(2): Xaa can be Ala, Ser, Gly, Val, Ile, Met, Gln, Thr, Leu, Pro, Cys, Asn, Tyr, Phe, Asp, His, Arg, Lys, Trp, or Glu
  misc_feature (10)..(10): Xaa can be Phe, Ile, Leu, Val, Met, Trp, Tyr, Lys, His, or Ala
HXPLQIVPSX

SEQ ID NO: 94693 - protein, 10 aa, Artificial Sequence
  Description of Artificial Sequence: Synthetic peptide
  Seed: HSPQSPPEGM (MAGC1_HUMAN)
  misc_feature (2)..(2): Xaa can be Gly, Ala, Met, Val, Leu, Arg, Gln, Ile, Ser, Pro, Asn, Thr, Tyr, Cys, Phe, Trp, Glu, Lys, His, or Asp
  misc_feature (10)..(10): Xaa can be Lys, Tyr, Leu, Arg, Phe, Met, Trp, Val, Ile, His, Glu, Gln, Asn, Ala, Cys, Pro, Asp, Ser, or Gly
HXPQSPPEGX

SEQ ID NO: 94694 - protein, 11 aa, Artificial Sequence
  Description of Artificial Sequence: Synthetic peptide
  Seed: HSPQSPPEGMH (MAGC1_HUMAN)
  misc_feature (2)..(2): Xaa can be Ala, Val, Ile, Ser, Thr, Met, Leu, Gly, Gln, Asn, or Glu
  misc_feature (11)..(11): Xaa can be Lys, Tyr, Phe, Arg, Met, His, Leu, or Trp
HXPQSPPEGMX

SEQ ID NO: 94695 - protein, 11 aa, Artificial Sequence
  Description of Artificial Sequence: Synthetic peptide
  Seed: HSTFEGFPQSL (MAGC1_HUMAN)
  misc_feature (2)..(2): Xaa can be Ala, Ser, or Thr
  misc_feature (11)..(11): Xaa can be , or Leu
HXTFEGFPQSX

SEQ ID NO: 94696 - protein, 9 aa, Artificial Sequence
  Description of Artificial Sequence: Synthetic peptide
  Seed: HYFPQSPPQ (MAGC1_HUMAN)
  misc_feature (2)..(2): Xaa can be Tyr, Phe, Trp, Met, Ala, Ile, His, Val, Arg, Thr, Gly, Leu, Ser, Gln, or Pro
  misc_feature (9)..(9): Xaa can be Met, Leu, Phe, Tyr, Ile, His, Val, Trp, Lys, Ala, Cys, Arg, Thr, Gln, or Ser
HXFPQSPPX

SEQ ID NO: 94697 - protein, 8 aa, Artificial Sequence
  Description of Artificial Sequence: Synthetic peptide
  Seed: HYLEYREV (MAGC1_HUMAN)
  misc_feature (2)..(2): Xaa can be Arg, Tyr, Phe, Trp, His, Ala, Gln, Ser, Asn, Thr, Gly, Lys, Met, or Glu
  misc_feature (8)..(8): Xaa can be Phe, Tyr, Leu, Met, Ile, Val, Trp, His, or Lys
HXLEYREX

SEQ ID NO: 94698 - protein, 10 aa, Artificial Sequence
  Description of Artificial Sequence: Synthetic peptide
  Seed: ICSSSTPSSL (MAGC1_HUMAN)
  misc_feature (2)..(2): Xaa can be Ala, Gly, Val, Ile, Arg, Met, Leu, Thr, Ser, Pro, Glu, Asn, Asp, Phe, Cys, Gln, Tyr, Trp, His, or Lys
  misc_feature (10)..(10): Xaa can be Phe, Tyr, Trp, Leu, Met, Lys, Arg, Ile, Val, or Ala
IXSSSTPSSX

SEQ ID NO: 94699 - protein, 10 aa, Artificial Sequence
  Description of Artificial Sequence: Synthetic peptide
  Seed: ICSSSTSLSL (MAGC1_HUMAN)
  misc_feature (2)..(2): Xaa can be Thr, Ser, Arg, Val, Ile, Gly, Ala, Met, Gln, Asn, Leu, Phe, Glu, Asp, Pro, His, Trp, Cys, Lys, or Tyr
  misc_feature (10)..(10): Xaa can be Trp, Phe, Met, Ile, Tyr, Leu, Lys, Val, Arg, Cys, or His
IXSSSTSLSX

SEQ ID NO: 94700 - protein, 9 aa, Artificial Sequence
  Description of Artificial Sequence: Synthetic peptide
  Seed: IDTTDDSTA (MAGC1_HUMAN)
  misc_feature (2)..(2): Xaa can be Glu, or Asp
  misc_feature (9)..(9): Xaa can be Ala, Val, Pro, Gly, Ser, Met, Ile, Cys, Phe, Thr, or Leu
IXTTDDSTX

SEQ ID NO: 94701 - protein, 9 aa, Artificial Sequence
  Description of Artificial Sequence: Synthetic peptide
  Seed: IEILFGISL (MAGC1_HUMAN)
  misc_feature (2)..(2): Xaa can be Glu, Gln, His, Arg, Asp, Pro, Lys, Ala, Met, Leu, Asn, Ile, Ser, Gly, Tyr, Val, Thr, Phe, Trp, or Cys
  misc_feature (9)..(9): Xaa can be Phe, Leu, Tyr, Met, Ile, Val, Trp, Ala, His, Cys, Pro, Thr, Ser, Gly, Lys, Arg, Asn, Gln, Glu, or Asp
IXILFGISX

SEQ ID NO: 94702 - protein, 10 aa, Artificial Sequence
  Description of Artificial Sequence: Synthetic peptide
  Seed: IEILFGISLR (MAGC1_HUMAN)
  misc_feature (2)..(2): Xaa can be Glu, Val, Thr, Cys, Asp, Phe, Ser, Trp, Gly, Asn, Leu, Lys, Pro, Gln, Met, Tyr, His, Ala, Ile, or Arg
  misc_feature (10)..(10): Xaa can be Arg, Lys, Tyr, Gln, Cys, Thr, Ser, Pro, Ile, Gly, Phe, Met, Glu, Trp, His, Asp, Leu, Asn, Val, or Ala
IXILFGISLX

SEQ ID NO: 94703 - protein, 8 aa, Artificial Sequence
  Description of Artificial Sequence: Synthetic peptide
  Seed: IESEPLFT (MAGC1_HUMAN)
  misc_feature (2)..(2): Xaa can be , or Glu
  misc_feature (8)..(8): Xaa can be Ile, Phe, Cys, Ala, Pro, Thr, Leu, Val, or Met
IXSEPLFX

SEQ ID NO: 94704 - protein, 9 aa, Artificial Sequence
  Description of Artificial Sequence: Synthetic peptide
  Seed: IESEPLFTY (MAGC1_HUMAN)
  misc_feature (2)..(2): Xaa can be Glu, Ala, Arg, Asp, Thr, Gln, Ser, Val, Tyr, Met, Ile, Leu, Gly, Asn, Phe, Trp, Pro, His, Cys, or Lys
  misc_feature (9)..(9): Xaa can be Ile, Phe, Met, Leu, Trp, Tyr, Val, Lys, His, Arg, Cys, Ala, Thr, Pro, Gln, Ser, Gly, Asn, Glu, or Asp
IXSEPLFTX

SEQ ID NO: 94705 - protein, 10 aa, Artificial Sequence
  Description of Artificial Sequence: Synthetic peptide
  Seed: IESEPLFTYT (MAGC1_HUMAN)
  misc_feature (2)..(2): Xaa can be Glu, or Asp
  misc_feature (10)..(10): Xaa can be Leu, Ser, Tyr, Ala, Phe, Ile, Trp, Gly, Thr, Cys, Val, Met, or Pro
IXSEPLFTYX

SEQ ID NO: 94706 - protein, 11 aa, Artificial Sequence
  Description of Artificial Sequence: Synthetic peptide
  Seed: IESEPLFTYTL (MAGC1_HUMAN)
  misc_feature (2)..(2): Xaa can be Glu, Gln, or Asp
  misc_feature (11)..(11): Xaa can be Trp, Tyr, Leu, Ile, Cys, Phe, Thr, Ala, Val, or Met
IXSEPLFTYTX

SEQ ID NO: 94707 - protein, 9 aa, Artificial Sequence
  Description of Artificial Sequence: Synthetic peptide
  Seed: IFQSSPESA (MAGC1_HUMAN)
  misc_feature (2)..(2): Xaa can be Tyr, Trp, Leu, Met, Val, Ile, Gln, Thr, Ala, or Phe
  misc_feature (9)..(9): Xaa can be Leu, Val, Ile, Met, Phe, Ala, Tyr, His, Cys, Trp, Thr, Lys, or Arg
IXQSSPESX

SEQ ID NO: 94708 - protein, 8 aa, Artificial Sequence
  Description of Artificial Sequence: Synthetic peptide
  Seed: IFRKAREF (MAGC1_HUMAN)
  misc_feature (2)..(2): Xaa can be Ala, Thr, Phe, Ser, Tyr, Trp, Val, Arg, Met, Leu, Gly, Ile, His, or Gln
  misc_feature (8)..(8): Xaa can be Leu, Phe, Tyr, Met, Ile, Val, or Trp
IXRKAREX

SEQ ID NO: 94709 - protein, 9 aa, Artificial Sequence
  Description of Artificial Sequence: Synthetic peptide
  Seed: IFRKAREFI (MAGC1_HUMAN)
  misc_feature (2)..(2): Xaa can be Val, Thr, Ser, Met, Phe, Ile, Tyr, Leu, Trp, Ala, Gln, Gly, Asn, His, Cys, Arg, or Lys
  misc_feature (9)..(9): Xaa can be Lys, Ala, Val, Met, Ile, Tyr, Leu, Ser, Arg, Phe, Gly, Thr, Pro, Glu, Gln, His, Asn, Cys, or Trp
IXRKAREFX

SEQ ID NO: 94710 - protein, 9 aa, Artificial Sequence
  Description of Artificial Sequence: Synthetic peptide
  Seed: IGVRAGREH (MAGC1_HUMAN)
  misc_feature (2)..(2): Xaa can be Ala, Val, Ser, Ile, Thr, Met, Gln, Gly, Leu, Cys, Glu, Asn, Asp, Pro, or Phe
  misc_feature (9)..(9): Xaa can be Tyr, Phe, Met, Leu, His, Val, Ile, Ala, Trp, Thr, Cys, or Lys
IXVRAGREX

SEQ ID NO: 94711 - protein, 9 aa, Artificial Sequence
  Description of Artificial Sequence: Synthetic peptide
  Seed: IIDTTDDST (MAGC1_HUMAN)
  misc_feature (2)..(2): Xaa can be Val, Ser, Ile, Ala, Thr, Leu, Met, Phe, Gln, Gly, Trp, Cys, Asn, Tyr, Pro, Asp, Glu, His, Arg, or Lys
  misc_feature (9)..(9): Xaa can be Leu, Met, Ile, Phe, Val, Tyr, Trp, Ala, Cys, Thr, or Lys
IXDTTDDSX

SEQ ID NO: 94712 - protein, 10 aa, Artificial Sequence
  Description of Artificial Sequence: Synthetic peptide
  Seed: IIDTTDDSTA (MAGC1_HUMAN)
  misc_feature (2)..(2): Xaa can be Ala, Ser, Val, Ile, Met, Thr, Leu, Gln, Gly, Phe, Trp, Asn, Tyr, Cys, Pro, Glu, Asp, or Ly s
  misc_feature (10)..(10): Xaa can be Leu, Phe, Met, Ile, Val, Tyr, Trp, Lys, Cys, Arg, Ala, or Thr
IXDTTDDSTX

SEQ ID NO: 94713 - protein, 11 aa, Artificial Sequence
  Description of Artificial Sequence: Synthetic peptide
  Seed: IIDTTDDSTAT (MAGC1_HUMAN)
  misc_feature (2)..(2): Xaa can be Ala, Thr, Ile, Val, Ser, Leu, Met, Gly, Cys, Phe, Gln, Trp, Tyr, Asn, Glu, Pro, Asp, Lys, Arg, or His
  misc_feature (11)..(11): Xaa can be Met, Phe, Leu, Ile, Val, Trp, Lys, Tyr, Cys, Ala, Arg, Thr, His, Gln, Ser, Gly, Pro, or Gl u
IXDTTDDSTAX

SEQ ID NO: 94714 - protein, 8 aa, Artificial Sequence
  Description of Artificial Sequence: Synthetic peptide
  Seed: IIFIKGTY (MAGC1_HUMAN)
  misc_feature (2)..(2): Xaa can be Ala, Ser, Thr, Val, Gly, Gln, Ile, Met, Leu, Glu, Phe, Asp, Asn, or Pro
  misc_feature (8)..(8): Xaa can be Tyr, Phe, Leu, Met, Ile, or Val
IXFIKGTX

SEQ ID NO: 94715 - protein, 9 aa, Artificial Sequence
  Description of Artificial Sequence: Synthetic peptide
  Seed: IIFIKGTYA (MAGC1_HUMAN)
  misc_feature (2)..(2): Xaa can be Met, Leu, Thr, Ser, Ile, Gln, Ala, Val, Phe, Tyr, Trp, Asn, or Gly
  misc_feature (9)..(9): Xaa can be Lys, Val, Ala, Leu, Ile, Met, Ser, Thr, Arg, Cys, Gly, or Phe
IXFIKGTYX

SEQ ID NO: 94716 - protein, 8 aa, Artificial Sequence
  Description of Artificial Sequence: Synthetic peptide
  Seed: IKRKVVEF (MAGC1_HUMAN)
  misc_feature (2)..(2): Xaa can be Gln, Met, Ile, Val, Lys, Leu, Arg, Glu, Ala, Ser, Gly, Phe, Thr, Asn, His, Tyr, Cys, Pro, Asp, or Trp
  misc_feature (8)..(8): Xaa can be Tyr, Phe, Met, Leu, Val, Ile, Trp, or His
IXRKVVEX

SEQ ID NO: 94717 - protein, 9 aa, Artificial Sequence
  Description of Artificial Sequence: Synthetic peptide
  Seed: IKRKVVEFL (MAGC1_HUMAN)
  misc_feature (2)..(2): Xaa can be Arg, Gln, Glu, Ala, Asn, Lys, Ser, His, Met, Asp, Leu, Thr, Ile, Gly, Val, Tyr, Phe, or Cy s
  misc_feature (9)..(9): Xaa can be Leu, Tyr, Phe, Met, Ile, Val, His, Lys, Trp, or Arg
IXRKVVEFX

SEQ ID NO: 94718 - protein, 11 aa, Artificial Sequence
  Description of Artificial Sequence: Synthetic peptide
  Seed: IKRKVVEFLAM (MAGC1_HUMAN)
  misc_feature (2)..(2): Xaa can be Gln, Met, Lys, Glu, Ser, His, Leu, Asp, Phe, Val, Trp, Arg, Ala, Gly, Pro, Tyr, Cys, Asn, Thr, or Ile
  misc_feature (11)..(11): Xaa can be Phe, Tyr, Met, or Leu
IXRKVVEFLAX

SEQ ID NO: 94719 - protein, 8 aa, Artificial Sequence
  Description of Artificial Sequence: Synthetic peptide
  Seed: ILFGISLR (MAGC1_HUMAN)
  misc_feature (2)..(2): Xaa can be Trp, Tyr, Phe, Met, Ser, Val, Leu, Gln, Thr, Ile, or Ala
  misc_feature (8)..(8): Xaa can be Arg, or Lys
IXFGISLX

SEQ ID NO: 94720 - protein, 10 aa, Artificial Sequence
  Description of Artificial Sequence: Synthetic peptide
  Seed: ILFGISLREV (MAGC1_HUMAN)
  misc_feature (2)..(2): Xaa can be Leu, Met, Gln, Val, Ile, Thr, Ala, Ser, Phe, Glu, Gly, Tyr, or Asn
  misc_feature (10)..(10): Xaa can be Arg, Lys, Val, Ile, Leu, Ala, Met, Tyr, Thr, Phe, Cys, Ser, or Trp
IXFGISLREX

SEQ ID NO: 94721 - protein, 11 aa, Artificial Sequence
  Description of Artificial Sequence: Synthetic peptide
  Seed: ILFGISLREVD (MAGC1_HUMAN)
  misc_feature (2)..(2): Xaa can be Leu, Met, Ile, Gln, or Val
  misc_feature (11)..(11): Xaa can be Val, Leu, Thr, Glu, Trp, His, Met, Ile, Tyr, Phe, Asn, Asp, Gln, Gly, Lys, Cys, Pro, Arg, Ala, or Ser
IXFGISLREVX

SEQ ID NO: 94722 - protein, 9 aa, Artificial Sequence
  Description of Artificial Sequence: Synthetic peptide
  Seed: ILILSIIFI (MAGC1_HUMAN)
  misc_feature (2)..(2): Xaa can be Leu, Met, Gln, Val, Thr, Ile, Ser, Ala, Phe, Gly, Asn, or Glu
  misc_feature (9)..(9): Xaa can be Val, Leu, Ile, Ala, Met, Thr, Ser, Cys, or Phe
IXILSIIFX

SEQ ID NO: 94723 - protein, 10 aa, Artificial Sequence
  Description of Artificial Sequence: Synthetic peptide
  Seed: ILILSIIFIK (MAGC1_HUMAN)
  misc_feature (2)..(2): Xaa can be Ser, Arg, Glu, Ala, Gln, Phe, Trp, Ile, Tyr, Asn, Pro, Met, Lys, His, Gly, Cys, Asp, Leu, Val, or Thr
  misc_feature (10)..(10): Xaa can be Arg, or Lys
IXILSIIFIX

SEQ ID NO: 94724 - protein, 9 aa, Artificial Sequence
  Description of Artificial Sequence: Synthetic peptide
  Seed: ILQSSPESA (MAGC1_HUMAN)
  misc_feature (2)..(2): Xaa can be Phe, or Leu
  misc_feature (9)..(9): Xaa can be , or Ala
IXQSSPESX

SEQ ID NO: 94725 - protein, 11 aa, Artificial Sequence
  Description of Artificial Sequence: Synthetic peptide
  Seed: ILSIIFIKGTY (MAGC1_HUMAN)
  misc_feature (2)..(2): Xaa can be Gln, Met, Lys, Thr, Arg, Ile, Val, Phe, Tyr, Gly, Leu, Ser, or Ala
  misc_feature (11)..(11): Xaa can be Tyr, or Phe
IXSIIFIKGTX

SEQ ID NO: 94726 - protein, 9 aa, Artificial Sequence
  Description of Artificial Sequence: Synthetic peptide
  Seed: IPGSPSFSS (MAGC1_HUMAN)
  misc_feature (2)..(2): Xaa can be Pro, Ala, or Val
  misc_feature (9)..(9): Xaa can be Ala, Met, Leu, Thr, Arg, Tyr, Phe, Trp, Pro, Val, Gly, Gln, Cys, Ser, Lys, or Ile
IXGSPSFSX

SEQ ID NO: 94727 - protein, 10 aa, Artificial Sequence
  Description of Artificial Sequence: Synthetic peptide
  Seed: IPGSPSFSST (MAGC1_HUMAN)
  misc_feature (2)..(2): Xaa can be Pro, or Ala
  misc_feature (10)..(10): Xaa can be Leu, Ala, Val, Tyr, Phe, Thr, Trp, Lys, Ser, Pro, Ile, Arg, Cys, Gly, or Met
IXGSPSFSSX

SEQ ID NO: 94728 - protein, 11 aa, Artificial Sequence
  Description of Artificial Sequence: Synthetic peptide
  Seed: IPGSPSFSSTL (MAGC1_HUMAN)
  misc_feature (2)..(2): Xaa can be Pro, Ala, Ser, Thr, Val, Gly, Ile, Leu, Met, Cys, Asn, Gln, Asp, Lys, Arg, His, Glu, Trp, Phe, or Tyr
  misc_feature (11)..(11): Xaa can be Leu, Met, Phe, Ile, Trp, Tyr, Val, Gly, Pro, Arg, Cys, Thr, Ala, Ser, His, or Lys
IXGSPSFSSTX

SEQ ID NO: 94729 - protein, 9 aa, Artificial Sequence
  Description of Artificial Sequence: Synthetic peptide
  Seed: IPMTSSFSS (MAGC1_HUMAN)
  misc_feature (2)..(2): Xaa can be Pro, Ala, Val, Met, Ile, Ser, Gln, Thr, Leu, Tyr, Gly, Phe, Cys, Glu, Lys, His, Asn, or Tr p
  misc_feature (9)..(9): Xaa can be Tyr, Phe, Met, Leu, Trp, Ala, His, Val, Ile, Ser, Arg, Gly, Asn, Cys, Pro, Thr, Glu, or Gl n
IXMTSSFSX

SEQ ID NO: 94730 - protein, 10 aa, Artificial Sequence
  Description of Artificial Sequence: Synthetic peptide
  Seed: IPMTSSFSST (MAGC1_HUMAN)
  misc_feature (2)..(2): Xaa can be Pro, Ala, Val, or Ile
  misc_feature (10)..(10): Xaa can be Leu, Met, Ala, Ile, Ser, Cys, Gly, Tyr, Phe, Thr, Trp, Pro, or Val
IXMTSSFSSX

SEQ ID NO: 94731 - protein, 11 aa, Artificial Sequence
  Description of Artificial Sequence: Synthetic peptide
  Seed: IPMTSSFSSTL (MAGC1_HUMAN)
  misc_feature (2)..(2): Xaa can be Pro, Ala, Thr, Ser, Gln, Asp, Ile, Val, Gly, Tyr, His, Trp, Phe, Asn, Met, Arg, Glu, Cys, Leu, or Lys
  misc_feature (11)..(11): Xaa can be Met, Phe, Tyr, Trp, Leu, Ile, Val, Thr, Pro, Ala, Cys, Gly, Ser, or His
IXMTSSFSSTX

SEQ ID NO: 94732 - protein, 11 aa, Artificial Sequence
  Description of Artificial Sequence: Synthetic peptide
  Seed: IPQSPPEGENT (MAGC1_HUMAN)
  misc_feature (2)..(2): Xaa can be Pro, or Ala
  misc_feature (11)..(11): Xaa can be Leu, Ala, Thr, Gly, Phe, Cys, Arg, Met, Tyr, Pro, Val, Ser, Lys, Trp, or Ile
IXQSPPEGENX

SEQ ID NO: 94733 - protein, 9 aa, Artificial Sequence
  Description of Artificial Sequence: Synthetic peptide
  Seed: IPVSAASSS (MAGC1_HUMAN)
  misc_feature (2)..(2): Xaa can be Pro, Ala, Val, Ser, Ile, Thr, Gly, Met, Cys, Leu, Gln, Asp, or Phe
  misc_feature (9)..(9): Xaa can be Tyr, Phe, Met, Leu, Ala, Ile, Trp, His, Val, Gly, Gln, Lys, Pro, Ser, Cys, Arg, or Thr
IXVSAASSX

SEQ ID NO: 94734 - protein, 10 aa, Artificial Sequence
  Description of Artificial Sequence: Synthetic peptide
  Seed: IPVSAASSST (MAGC1_HUMAN)
  misc_feature (2)..(2): Xaa can be Pro, or Ala
  misc_feature (10)..(10): Xaa can be Ala, Leu, Gly, Ile, Phe, Arg, Pro, Tyr, Lys, Cys, Ser, Thr, Val, Trp, or Met
IXVSAASSSX

SEQ ID NO: 94735 - protein, 11 aa, Artificial Sequence
  Description of Artificial Sequence: Synthetic peptide
  Seed: IPVSAASSSTL (MAGC1_HUMAN)
  misc_feature (2)..(2): Xaa can be Pro, Ala, Gln, Met, Asn, Ser, Thr, Val, Glu, Ile, Asp, Leu, Cys, Gly, Phe, Trp, Lys, Arg, His, or Tyr
  misc_feature (11)..(11): Xaa can be Ile, Leu, Trp, Met, Tyr, Phe, Lys, Arg, Val, His, Ala, Thr, Gly, Pro, Ser, or Cys
IXVSAASSSTX

SEQ ID NO: 94736 - protein, 9 aa, Artificial Sequence
  Description of Artificial Sequence: Synthetic peptide
  Seed: IPVSPSFSS (MAGC1_HUMAN)
  misc_feature (2)..(2): Xaa can be Pro, Ala, Val, Leu, Phe, Met, Ile, Thr, Ser, Gln, Gly, or Cys
  misc_feature (9)..(9): Xaa can be Tyr, Phe, Met, Leu, Ala, His, Ile, Trp, Val, Arg, Cys, Asn, Pro, Ser, Gly, Glu, Lys, Thr, or Gln
IXVSPSFSX

SEQ ID NO: 94737 - protein, 10 aa, Artificial Sequence
  Description of Artificial Sequence: Synthetic peptide
  Seed: IPVSPSFSST (MAGC1_HUMAN)
  misc_feature (2)..(2): Xaa can be Pro, or Ala
  misc_feature (10)..(10): Xaa can be Ala, Leu, Met, Cys, Pro, Trp, Lys, Phe, Tyr, Val, Gly, Gln, Thr, Arg, Ser, or Ile
IXVSPSFSSX

SEQ ID NO: 94738 - protein, 11 aa, Artificial Sequence
  Description of Artificial Sequence: Synthetic peptide
  Seed: IPVSPSFSSTL (MAGC1_HUMAN)
  misc_feature (2)..(2): Xaa can be Pro, Ala, Ser, Thr, Gly, Val, Gln, Met, Ile, Leu, Asn, Glu, Asp, Cys, His, Tyr, Lys, Arg, Phe, or Trp
  misc_feature (11)..(11): Xaa can be Leu, Lys, Tyr, Phe, Met, Trp, Arg, Ile, Val, Cys, Ala, Thr, Pro, Ser, Gly, or His
IXVSPSFSSTX

SEQ ID NO: 94739 - protein, 8 aa, Artificial Sequence
  Description of Artificial Sequence: Synthetic peptide
  Seed: IPVSPSSS (MAGC1_HUMAN)
  misc_feature (2)..(2): Xaa can be , or Pro
  misc_feature (8)..(8): Xaa can be Val, Met, Cys, Ala, Leu, Ile, Pro, Phe, Ser, or Thr
IXVSPSSX

SEQ ID NO: 94740 - protein, 9 aa, Artificial Sequence
  Description of Artificial Sequence: Synthetic peptide
  Seed: IPVSPSSSS (MAGC1_HUMAN)
  misc_feature (2)..(2): Xaa can be Pro, Ala, Thr, Ser, Val, Ile, Gly, Met, Leu, Cys, Gln, Phe, Tyr, or Asp
  misc_feature (9)..(9): Xaa can be Tyr, Phe, Leu, Met, Ala, His, Cys, Ile, Trp, Val, Arg, Lys, Gly, Pro, Glu, Ser, Asn, Thr, or Gln
IXVSPSSSX

SEQ ID NO: 94741 - protein, 10 aa, Artificial Sequence
  Description of Artificial Sequence: Synthetic peptide
  Seed: IPVSPSSSST (MAGC1_HUMAN)
  misc_feature (2)..(2): Xaa can be Pro, Ala, or Val
  misc_feature (10)..(10): Xaa can be Leu, Ala, Phe, Met, Pro, Thr, Gly, Lys, Tyr, Val, His, Cys, Trp, Ile, Arg, Ser, or Gln
IXVSPSSSSX

SEQ ID NO: 94742 - protein, 11 aa, Artificial Sequence
  Description of Artificial Sequence: Synthetic peptide
  Seed: IPVSPSSSSTL (MAGC1_HUMAN)
  misc_feature (2)..(2): Xaa can be Pro, Ala, Val, Ser, Gly, His, Thr, Ile, Cys, Leu, Met, Gln, Glu, Asn, Arg, Phe, Asp, Trp, Tyr, or Lys
  misc_feature (11)..(11): Xaa can be Phe, Tyr, Leu, Lys, Met, Arg, His, Trp, Ile, Val, Ala, Cys, Gln, Ser, Thr, Asn, Gly, or Pr o
IXVSPSSSSTX

SEQ ID NO: 94743 - protein, 9 aa, Artificial Sequence
  Description of Artificial Sequence: Synthetic peptide
  Seed: IPVSRSFSS (MAGC1_HUMAN)
  misc_feature (2)..(2): Xaa can be Pro, Ala, Val, Leu, Ile, Ser, Met, Thr, Phe, Gln, Cys, or Gly
  misc_feature (9)..(9): Xaa can be Tyr, Phe, Leu, Met, Ala, Val, Ile, Trp, Ser, His, Arg, Gly, Pro, Gln, Thr, or Cys
IXVSRSFSX

SEQ ID NO: 94744 - protein, 10 aa, Artificial Sequence
  Description of Artificial Sequence: Synthetic peptide
  Seed: IPVSRSFSST (MAGC1_HUMAN)
  misc_feature (2)..(2): Xaa can be , or Pro
  misc_feature (10)..(10): Xaa can be Phe, Ala, Thr, Gly, Leu, Met, Val, Tyr, Ser, Cys, Ile, or Pro
IXVSRSFSSX

SEQ ID NO: 94745 - protein, 11 aa, Artificial Sequence
  Description of Artificial Sequence: Synthetic peptide
  Seed: IPVSRSFSSTL (MAGC1_HUMAN)
  misc_feature (2)..(2): Xaa can be Pro, Ser, Thr, Val, Ala, Met, Gly, Cys, His, Asn, Gln, Lys, Leu, Asp, Glu, Phe, Arg, Trp, Tyr, or Ile
  misc_feature (11)..(11): Xaa can be Trp, Phe, Tyr, Met, Leu, Ile, Cys, Pro, Ser, Thr, Ala, or Val
IXVSRSFSSTX

SEQ ID NO: 94746 - protein, 9 aa, Artificial Sequence
  Description of Artificial Sequence: Synthetic peptide
  Seed: IPVSSSFSY (MAGC1_HUMAN)
  misc_feature (2)..(2): Xaa can be Pro, Gln, Met, Ala, Lys, His, Ser, Glu, Leu, Thr, Arg, Val, Ile, Gly, Phe, Asn, Cys, Tyr, Asp, or Trp
  misc_feature (9)..(9): Xaa can be Met, Phe, Tyr, Leu, Trp, Ile, Val, His, Ala, Thr, Gly, Cys, Asn, Ser, Pro, Glu, or Gln
IXVSSSFSX

SEQ ID NO: 94747 - protein, 10 aa, Artificial Sequence
  Description of Artificial Sequence: Synthetic peptide
  Seed: IPVSSSFSYT (MAGC1_HUMAN)
  misc_feature (2)..(2): Xaa can be Pro, Ala, Met, Ile, Val, or Ser
  misc_feature (10)..(10): Xaa can be Tyr, Phe, Met, Lys, Leu, Thr, Trp, Arg, Gly, Pro, Gln, Val, Asp, Asn, Ile, Cys, Ala, His, Glu, or Ser
IXVSSSFSYX

SEQ ID NO: 94748 - protein, 11 aa, Artificial Sequence
  Description of Artificial Sequence: Synthetic peptide
  Seed: IPVSSSFSYTL (MAGC1_HUMAN)
  misc_feature (2)..(2): Xaa can be Pro, Ser, Thr, Asn, Met, Trp, Phe, Lys, Arg, Gln, Glu, Asp, Gly, Ile, His, Cys, Tyr, Leu, Val, or Ala
  misc_feature (11)..(11): Xaa can be Trp, Leu, Met, Phe, Tyr, Ile, Val, Thr, His, Ser, Cys, Pro, Ala, or Gly
IXVSSSFSYTX

SEQ ID NO: 94749 - protein, 9 aa, Artificial Sequence
  Description of Artificial Sequence: Synthetic peptide
  Seed: IPVSSSSSS (MAGC1_HUMAN)
  misc_feature (2)..(2): Xaa can be Pro, Ala, Val, or Ile
  misc_feature (9)..(9): Xaa can be Leu, Met, Ala, Ile, Val, Trp, Phe, Tyr, Pro, Ser, Arg, Lys, Cys, Thr, or Gly
IXVSSSSSX

SEQ ID NO: 94750 - protein, 11 aa, Artificial Sequence
  Description of Artificial Sequence: Synthetic peptide
  Seed: IPVSSSSSSST (MAGC1_HUMAN)
  misc_feature (2)..(2): Xaa can be Pro, or Ala
  misc_feature (11)..(11): Xaa can be Leu, Pro, Thr, Lys, Trp, Ile, Cys, Val, Tyr, Ser, Ala, Phe, Gly, or Met
IXVSSSSSSSX

SEQ ID NO: 94751 - protein, 10 aa, Artificial Sequence
  Description of Artificial Sequence: Synthetic peptide
  Seed: IPVSSSSSST (MAGC1_HUMAN)
  misc_feature (2)..(2): Xaa can be , or Pro
  misc_feature (10)..(10): Xaa can be Ser, Val, Ile, Gly, Phe, Ala, Thr, Pro, Tyr, Leu, Met, or Cys
IXVSSSSSSX

SEQ ID NO: 94752 - protein, 11 aa, Artificial Sequence
  Description of Artificial Sequence: Synthetic peptide
  Seed: IPVSSSSSSTL (MAGC1_HUMAN)
  misc_feature (2)..(2): Xaa can be Pro, Ala, Ser, Met, Thr, Gln, Val, Asp, Phe, Ile, Asn, Leu, Gly, Cys, Glu, Tyr, Trp, His, Arg, or Lys
  misc_feature (11)..(11): Xaa can be Leu, Tyr, Phe, Trp, Met, Lys, Arg, Ile, Val, His, Ala, Cys, Pro, Gly, Ser, or Thr
IXVSSSSSSTX

SEQ ID NO: 94753 - protein, 9 aa, Artificial Sequence
  Description of Artificial Sequence: Synthetic peptide
  Seed: ISFSSSTSL (MAGC1_HUMAN)
  misc_feature (2)..(2): Xaa can be Gln, Met, Ala, Tyr, Pro, Phe, Lys, Ser, Leu, Val, Arg, Ile, Thr, Glu, Trp, Gly, Cys, His, Asn, or Asp
  misc_feature (9)..(9): Xaa can be Leu, Trp, Ile, Met, Tyr, Phe, Val, His, Lys, Arg, Ala, Cys, Thr, Gln, Gly, Ser, Pro, Asn, Glu, or Asp
IXFSSSTSX

SEQ ID NO: 94754 - protein, 11 aa, Artificial Sequence
  Description of Artificial Sequence: Synthetic peptide
  Seed: ISQSPPEGEDV (MAGC1_HUMAN)
  misc_feature (2)..(2): Xaa can be Ala, Ser, Thr, Val, Ile, Leu, Met, Gly, Cys, or Pro
  misc_feature (11)..(11): Xaa can be Leu, Phe, Met, Ile, Val, or Tyr
IXQSPPEGEDX

SEQ ID NO: 94755 - protein, 8 aa, Artificial Sequence
  Description of Artificial Sequence: Synthetic peptide
  Seed: ISRYTGYF (MAGC1_HUMAN)
  misc_feature (2)..(2): Xaa can be Ser, Ala, Thr, Val, or Met
  misc_feature (8)..(8): Xaa can be Trp, Tyr, Phe, Leu, or Met
IXRYTGYX

SEQ ID NO: 94756 - protein, 9 aa, Artificial Sequence
  Description of Artificial Sequence: Synthetic peptide
  Seed: ISRYTGYFP (MAGC1_HUMAN)
  misc_feature (2)..(2): Xaa can be Thr, Ser, Val, Met, Tyr, Ile, Phe, Ala, Gln, Gly, Leu, Trp, Asn, His, Arg, Lys, or Cys
  misc_feature (9)..(9): Xaa can be Lys, Ile, Leu, Ala, Val, Met, Ser, Arg, Gly, Tyr, Thr, Pro, Asn, Phe, His, Gln, Cys, or Gl u
IXRYTGYFX

SEQ ID NO: 94757 - protein, 10 aa, Artificial Sequence
  Description of Artificial Sequence: Synthetic peptide
  Seed: ISRYTGYFPV (MAGC1_HUMAN)
  misc_feature (2)..(2): Xaa can be Met, Thr, Ser, Val, Tyr, Leu, Arg, Lys, Trp, Ile, Ala, His, Pro, Glu, Gly, Asn, Asp, Cys, Phe, or Gln
  misc_feature (10)..(10): Xaa can be Arg, Lys, Val, Met, Ala, Ile, Tyr, Phe, Leu, Ser, Gly, Thr, Trp, His, Cys, or Pro
IXRYTGYFPX

SEQ ID NO: 94758 - protein, 11 aa, Artificial Sequence
  Description of Artificial Sequence: Synthetic peptide
  Seed: ISRYTGYFPVI (MAGC1_HUMAN)
  misc_feature (2)..(2): Xaa can be Ser, Thr, Tyr, Val, Met, Trp, Leu, Gly, Ala, Gln, Ile, Phe, Asn, Asp, Arg, His, Pro, Glu, Lys, or Cys
  misc_feature (11)..(11): Xaa can be Ile, Met, Leu, Phe, Trp, Lys, Ala, or Val
IXRYTGYFPVX

SEQ ID NO: 94759 - protein, 8 aa, Artificial Sequence
  Description of Artificial Sequence: Synthetic peptide
  Seed: ITFPSSYK (MAGC1_HUMAN)
  misc_feature (2)..(2): Xaa can be Val, Ser, Asn, Ile, Trp, Tyr, Leu, Thr, Phe, Gly, Met, Ala, Lys, Arg, Cys, His, or Gln
  misc_feature (8)..(8): Xaa can be Arg, or Lys
IXFPSSYX

SEQ ID NO: 94760 - protein, 11 aa, Artificial Sequence
  Description of Artificial Sequence: Synthetic peptide
  Seed: ITFPSSYKDAL (MAGC1_HUMAN)
  misc_feature (2)..(2): Xaa can be Ala, Thr, Ser, Val, Pro, Gly, Ile, Met, Cys, Leu, Gln, Asn, Glu, Tyr, Lys, Phe, Trp, Arg, Asp, or His
  misc_feature (11)..(11): Xaa can be Leu, Trp, Phe, Tyr, Met, Ile, Val, Lys, or His
IXFPSSYKDAX

SEQ ID NO: 94761 - protein, 10 aa, Artificial Sequence
  Description of Artificial Sequence: Synthetic peptide
  Seed: ITKAEMLTNV (MAGC1_HUMAN)
  misc_feature (2)..(2): Xaa can be Met, Leu, Ile, Val, Gln, Thr, Ser, Ala, Tyr, or Phe
  misc_feature (10)..(10): Xaa can be Lys, Val, Ala, Ile, Leu, Met, Thr, Ser, or Cys
IXKAEMLTNX

SEQ ID NO: 94762 - protein, 8 aa, Artificial Sequence
  Description of Artificial Sequence: Synthetic peptide
  Seed: IVPSLPEW (MAGC1_HUMAN)
  misc_feature (2)..(2): Xaa can be Ser, Thr, Ala, Gln, Asp, Val, Phe, Ile, Asn, Cys, Leu, Met, or Gly
  misc_feature (8)..(8): Xaa can be Trp, Phe, or Leu
IXPSLPEX

SEQ ID NO: 94763 - protein, 8 aa, Artificial Sequence
  Description of Artificial Sequence: Synthetic peptide
  Seed: IWDVLSGI (MAGC1_HUMAN)
  misc_feature (2)..(2): Xaa can be Tyr, Ala, Phe, Thr, Ser, Val, Gly, Met, Gln, Cys, Asn, Trp, Ile, Leu, Pro, His, Asp, or Gl u
  misc_feature (8)..(8): Xaa can be Leu, Phe, Met, Ile, Val, Tyr, or Trp
IXDVLSGX

SEQ ID NO: 94764 - protein, 10 aa, Artificial Sequence
  Description of Artificial Sequence: Synthetic peptide
  Seed: IWDVLSGIGV (MAGC1_HUMAN)
  misc_feature (2)..(2): Xaa can be Tyr, Phe, Trp, Ala, Met, Ile, Gln, Gly, Cys, His, Pro, Leu, Thr, Val, Ser, or Asn
  misc_feature (10)..(10): Xaa can be Leu, Met, Phe, Ile, Trp, Tyr, Val, Cys, Ala, Lys, or Thr
IXDVLSGIGX

SEQ ID NO: 94765 - protein, 11 aa, Artificial Sequence
  Description of Artificial Sequence: Synthetic peptide
  Seed: IWDVLSGIGVR (MAGC1_HUMAN)
  misc_feature (2)..(2): Xaa can be Ala, Thr, Ser, Val, Gly, Met, Phe, Ile, Asn, Leu, His, Trp, Pro, Tyr, Cys, Arg, Lys, Gln, Glu, or Asp
  misc_feature (11)..(11): Xaa can be Arg, Lys, Phe, Leu, Tyr, Met, or Trp
IXDVLSGIGVX

SEQ ID NO: 94766 - protein, 9 aa, Artificial Sequence
  Description of Artificial Sequence: Synthetic peptide
  Seed: KAEMLTNVI (MAGC1_HUMAN)
  misc_feature (2)..(2): Xaa can be Ala, Glu, Ile, Phe, Gln, Val, Thr, Ser, Met, Tyr, Gly, Arg, Leu, His, Asn, Asp, Trp, Cys, Pro, or Lys
  misc_feature (9)..(9): Xaa can be Leu, Met, Trp, Phe, Val, Tyr, Ile, or His
KXEMLTNVX

SEQ ID NO: 94767 - protein, 10 aa, Artificial Sequence
  Description of Artificial Sequence: Synthetic peptide
  Seed: KAEMLTNVIS (MAGC1_HUMAN)
  misc_feature (2)..(2): Xaa can be Lys, Ser, Val, Cys, Ile, Leu, Glu, Asn, Phe, Thr, Trp, Gly, Arg, Asp, Tyr, Met, Pro, Ala, His, or Gln
  misc_feature (10)..(10): Xaa can be Ala, Val, Pro, Ile, Met, Cys, Thr, Ser, or Leu
KXEMLTNVIX

SEQ ID NO: 94768 - protein, 11 aa, Artificial Sequence
  Description of Artificial Sequence: Synthetic peptide
  Seed: KAEMLTNVISR (MAGC1_HUMAN)
  misc_feature (2)..(2): Xaa can be Trp, Phe, Tyr, Thr, Met, Glu, His, Asp, Gly, Lys, Ala, Asn, Val, Pro, Gln, Ser, Ile, Cys, Arg, or Leu
  misc_feature (11)..(11): Xaa can be Arg, or Lys
KXEMLTNVISX

SEQ ID NO: 94769 - protein, 8 aa, Artificial Sequence
  Description of Artificial Sequence: Synthetic peptide
  Seed: KAREFIEI (MAGC1_HUMAN)
  misc_feature (2)..(2): Xaa can be Ala, Gln, Thr, Ser, Val, Ile, Gly, Glu, Asp, Met, Leu, Arg, His, Asn, Cys, Phe, or Tyr
  misc_feature (8)..(8): Xaa can be Leu, Ile, Tyr, Val, Met, Phe, His, Ala, or Lys
KXREFIEX

SEQ ID NO: 94770 - protein, 9 aa, Artificial Sequence
  Description of Artificial Sequence: Synthetic peptide
  Seed: KAREFIEIL (MAGC1_HUMAN)
  misc_feature (2)..(2): Xaa can be Thr, Ser, Val, Met, Pro, Tyr, Ile, Arg, Ala, Gln, Leu, Phe, Trp, Gly, Asn, Glu, Lys, Asp, Cys, or His
  misc_feature (9)..(9): Xaa can be Val, Met, Leu, Trp, Lys, Phe, Ile, Tyr, Arg, His, Ala, Ser, Thr, Gly, Cys, Gln, Pro, Asn, or Glu
KXREFIEIX

SEQ ID NO: 94771 - protein, 10 aa, Artificial Sequence
  Description of Artificial Sequence: Synthetic peptide
  Seed: KAREFIEILF (MAGC1_HUMAN)
  misc_feature (2)..(2): Xaa can be Thr, Ser, Val, Tyr, Met, Ile, Ala, Phe, Gln, Trp, Arg, Leu, Gly, Asn, Lys, His, Glu, Cys, Asp, or Pro
  misc_feature (10)..(10): Xaa can be Leu, Met, Ile, Phe, Tyr, Trp, Lys, Val, Ala, Ser, Gly, Arg, Thr, His, Pro, Gln, Asn, Cys, or Glu
KXREFIEILX

SEQ ID NO: 94772 - protein, 8 aa, Artificial Sequence
  Description of Artificial Sequence: Synthetic peptide
  Seed: KDMPTAGM (MAGC1_HUMAN)
  misc_feature (2)..(2): Xaa can be Glu, or Asp
  misc_feature (8)..(8): Xaa can be Phe, Ile, Val, Leu, or Met
KXMPTAGX

SEQ ID NO: 94773 - protein, 9 aa, Artificial Sequence
  Description of Artificial Sequence: Synthetic peptide
  Seed: KDMPTAGMP (MAGC1_HUMAN)
  misc_feature (2)..(2): Xaa can be Glu, or Asp
  misc_feature (9)..(9): Xaa can be Ile, Pro, Ala, Leu, Cys, Val, Ser, Phe, Thr, Asp, Met, or Gly
KXMPTAGMX

SEQ ID NO: 94774 - protein, 11 aa, Artificial Sequence
  Description of Artificial Sequence: Synthetic peptide
  Seed: KDMPTAGMPSL (MAGC1_HUMAN)
  misc_feature (2)..(2): Xaa can be Glu, Gln, Asp, Pro, Met, Arg, Ile, Leu, Ala, Ser, Val, Thr, His, Asn, Gly, Lys, Cys, Trp, Tyr, or Phe
  misc_feature (11)..(11): Xaa can be Leu, Met, Phe, Ile, Val, Trp, Cys, Ala, Tyr, Thr, Gln, Gly, Arg, Pro, Lys, Asn, Asp, Glu, Ser, or His
KXMPTAGMPSX

SEQ ID NO: 94775 - protein, 9 aa, Artificial Sequence
  Description of Artificial Sequence: Synthetic peptide
  Seed: KDSLSPLEI (MAGC1_HUMAN)
  misc_feature (2)..(2): Xaa can be Glu, Asp, Gln, Leu, Arg, Met, Ile, Thr, Val, Ser, Asn, Ala, Gly, His, Phe, Lys, Tyr, Pro, Trp, or Cys
  misc_feature (9)..(9): Xaa can be Leu, Met, Ile, Val, Phe, Trp, Tyr, Cys, Ala, Pro, Thr, Asp, Ser, Glu, Gln, or Gly
KXSLSPLEX

SEQ ID NO: 94776 - protein, 9 aa, Artificial Sequence
  Description of Artificial Sequence: Synthetic peptide
  Seed: KDSQSPLQI (MAGC1_HUMAN)
  misc_feature (2)..(2): Xaa can be Glu, Gln, Asp, Leu, Met, Ile, Arg, Val, His, Gly, Asn, Thr, Ala, Ser, Lys, Tyr, Phe, Pro, Cys, or Trp
  misc_feature (9)..(9): Xaa can be Met, Leu, Ile, Val, Phe, Trp, Tyr, Ala, Cys, Thr, Pro, Gly, Asp, Arg, Ser, Gln, or Glu
KXSQSPLQX

SEQ ID NO: 94777 - protein, 9 aa, Artificial Sequence
  Description of Artificial Sequence: Synthetic peptide
  Seed: KDVEERAQA (MAGC1_HUMAN)
  misc_feature (2)..(2): Xaa can be Glu, Asp, Gln, Ser, or Ala
  misc_feature (9)..(9): Xaa can be Leu, Met, Tyr, Ile, Cys, Ala, Phe, Val, Trp, Pro, Lys, Thr, Asn, His, Asp, Ser, Gln, Arg, Glu, or Gly
KXVEERAQX

SEQ ID NO: 94778 - protein, 10 aa, Artificial Sequence
  Description of Artificial Sequence: Synthetic peptide
  Seed: KDVEERAQAI (MAGC1_HUMAN)
  misc_feature (2)..(2): Xaa can be Glu, Asp, or Gln
  misc_feature (10)..(10): Xaa can be Leu, Phe, Cys, Tyr, Val, Met, Ile, Ala, Trp, Pro, Thr, Arg, Lys, Gly, Ser, His, Asn, Glu, Asp, or Gln
KXVEERAQAX

SEQ ID NO: 94779 - protein, 9 aa, Artificial Sequence
  Description of Artificial Sequence: Synthetic peptide
  Seed: KGTYASEEV (MAGC1_HUMAN)
  misc_feature (2)..(2): Xaa can be Ser, Thr, Ala, Ile, Val, Gly, Asn, Leu, Met, or Gln
  misc_feature (9)..(9): Xaa can be Leu, Met, Val, Ile, or Phe
KXTYASEEX

SEQ ID NO: 94780 - protein, 10 aa, Artificial Sequence
  Description of Artificial Sequence: Synthetic peptide
  Seed: KGTYASEEVI (MAGC1_HUMAN)
  misc_feature (2)..(2): Xaa can be Met, Glu, Arg, Ile, Phe, Pro, Ala, Gly, Tyr, Trp, Gln, Ser, His, Asn, Asp, Cys, Val, Leu, Thr, or Lys
  misc_feature (10)..(10): Xaa can be Met, Tyr, Leu, Phe, Trp, or Ile
KXTYASEEVX

SEQ ID NO: 94781 - protein, 11 aa, Artificial Sequence
  Description of Artificial Sequence: Synthetic peptide
  Seed: KGTYASEEVIW (MAGC1_HUMAN)
  misc_feature (2)..(2): Xaa can be Thr, Ser, Tyr, Trp, Pro, Glu, His, Asp, Ile, Val, Phe, Arg, Lys, Met, Gln, Gly, Leu, Ala, Cys, or Asn
  misc_feature (11)..(11): Xaa can be Phe, Trp, Leu, Ile, Met, or Tyr
KXTYASEEVIX

SEQ ID NO: 94782 - protein, 9 aa, Artificial Sequence
  Description of Artificial Sequence: Synthetic peptide
  Seed: KQPITKAEM (MAGC1_HUMAN)
  misc_feature (2)..(2): Xaa can be Glu, Phe, Tyr, Arg, Ala, Gln, Ile, Ser, Val, Thr, Leu, Met, Trp, Pro, His, Asp, Asn, Cys, Gly, or Lys
  misc_feature (9)..(9): Xaa can be Tyr, Leu, Phe, Met, Ile, Val, Trp, His, Ala, Cys, Pro, or Thr
KXPITKAEX

SEQ ID NO: 94783 - protein, 10 aa, Artificial Sequence
  Description of Artificial Sequence: Synthetic peptide
  Seed: KQPITKAEML (MAGC1_HUMAN)
  misc_feature (2)..(2): Xaa can be Gln, Met, or Leu
  misc_feature (10)..(10): Xaa can be Phe, Leu, Trp, Val, Ile, or Met
KXPITKAEMX

SEQ ID NO: 94784 - protein, 8 aa, Artificial Sequence
  Description of Artificial Sequence: Synthetic peptide
  Seed: KRKVVEFL (MAGC1_HUMAN)
  misc_feature (2)..(2): Xaa can be Arg, Gln, Asp, or Glu
  misc_feature (8)..(8): Xaa can be Leu, Met, Tyr, Phe, or Ile
KXKVVEFX

SEQ ID NO: 94785 - protein, 9 aa, Artificial Sequence
  Description of Artificial Sequence: Synthetic peptide
  Seed: KRKVVEFLA (MAGC1_HUMAN)
  misc_feature (2)..(2): Xaa can be Arg, Gln, His, Tyr, Lys, Ala, Asn, or Glu
  misc_feature (9)..(9): Xaa can be Leu, Phe, Lys, Tyr, Met, Ile, Arg, Val, Gly, His, Gln, Cys, Thr, Ala, Trp, Asn, or Glu
KXKVVEFLX

SEQ ID NO: 94786 - protein, 10 aa, Artificial Sequence
  Description of Artificial Sequence: Synthetic peptide
  Seed: KRKVVEFLAM (MAGC1_HUMAN)
  misc_feature (2)..(2): Xaa can be Arg, Gln, Met, Ile, Trp, Asn, Cys, Ser, Tyr, Glu, His, Leu, Thr, Val, Ala, Lys, Phe, Asp, Pro, or Gly
  misc_feature (10)..(10): Xaa can be Met, Leu, Phe, Tyr, Ile, His, Trp, Val, Ala, Arg, Gln, Cys, or Lys
KXKVVEFLAX

SEQ ID NO: 94787 - protein, 11 aa, Artificial Sequence
  Description of Artificial Sequence: Synthetic peptide
  Seed: KRKVVEFLAML (MAGC1_HUMAN)
  misc_feature (2)..(2): Xaa can be Arg, Met, Leu, Gln, Ala, Pro, Asn, Ser, Tyr, Cys, Trp, Val, Thr, Lys, Asp, Phe, Glu, Gly, Ile, or His
  misc_feature (11)..(11): Xaa can be Leu, Val, Ala, Ile, Met, Thr, Tyr, Phe, Arg, Lys, or Trp
KXKVVEFLAMX

SEQ ID NO: 94788 - protein, 8 aa, Artificial Sequence
  Description of Artificial Sequence: Synthetic peptide
  Seed: KSSPESPL (MAGC1_HUMAN)
  misc_feature (2)..(2): Xaa can be Ala, Ser, or Thr
  misc_feature (8)..(8): Xaa can be Leu, Phe, Met, or Tyr
KXSPESPX

SEQ ID NO: 94789 - protein, 8 aa, Artificial Sequence
  Description of Artificial Sequence: Synthetic peptide
  Seed: KVDELARF (MAGC1_HUMAN)
  misc_feature (2)..(2): Xaa can be Ile, Val, Ala, Ser, Thr, Phe, Gln, Gly, Asn, Met, Cys, Leu, Asp, Tyr, Pro, Trp, or Glu
  misc_feature (8)..(8): Xaa can be Leu, Trp, Met, Phe, Ile, Val, Tyr, or Lys
KXDELARX

SEQ ID NO: 94790 - protein, 9 aa, Artificial Sequence
  Description of Artificial Sequence: Synthetic peptide
  Seed: KVDELARFL (MAGC1_HUMAN)
  misc_feature (2)..(2): Xaa can be Thr, Ala, Met, Leu, Val, Ser, Ile, Tyr, Gly, Gln, Phe, Glu, Arg, Cys, Trp, Asp, Asn, His, Lys, or Pro
  misc_feature (9)..(9): Xaa can be Leu, Tyr, Phe, Ile, Val, Trp, Met, Arg, Lys, Cys, Ala, His, Thr, Gln, Ser, or Asn
KXDELARFX

SEQ ID NO: 94791 - protein, 10 aa, Artificial Sequence
  Description of Artificial Sequence: Synthetic peptide
  Seed: KVDELARFLL (MAGC1_HUMAN)
  misc_feature (2)..(2): Xaa can be Met, Leu, Gln, Val, Ile, Ala, Thr, Ser, Phe, Tyr, Arg, Cys, Gly, Glu, Trp, His, Asn, Pro, Asp, or Lys
  misc_feature (10)..(10): Xaa can be Leu, Phe, Trp, Met, Val, Ile, Tyr, Lys, Ala, Cys, Arg, Glu, Ser, Pro, His, Gly, Asn, Thr, Asp, or Gln
KXDELARFLX

SEQ ID NO: 94792 - protein, 11 aa, Artificial Sequence
  Description of Artificial Sequence: Synthetic peptide
  Seed: KVDELARFLLL (MAGC1_HUMAN)
  misc_feature (2)..(2): Xaa can be Leu, Met, Glu, Tyr, Phe, Lys, Ile, Pro, Arg, Asp, Trp, Cys, Val, Ala, Ser, Thr, His, Gly, Asn, or Gln
  misc_feature (11)..(11): Xaa can be Val, Met, Leu, Phe, Ile, Ala, or Cys
KXDELARFLLX

SEQ ID NO: 94793 - protein, 9 aa, Artificial Sequence
  Description of Artificial Sequence: Synthetic peptide
  Seed: KVVEFLAML (MAGC1_HUMAN)
  misc_feature (2)..(2): Xaa can be Met, Leu, Gln, Ile, Val, Arg, Ala, Thr, Ser, Gly, Trp, Tyr, Asn, Phe, Cys, Asp, Glu, His, Pro, or Lys
  misc_feature (9)..(9): Xaa can be Arg, Leu, Tyr, Trp, Met, Val, Phe, Ile, Lys, Ala, His, Cys, Thr, Ser, Pro, Gly, Gln, or Gl u
KXVEFLAMX

SEQ ID NO: 94794 - protein, 10 aa, Artificial Sequence
  Description of Artificial Sequence: Synthetic peptide
  Seed: KVVEFLAMLK (MAGC1_HUMAN)
  misc_feature (2)..(2): Xaa can be Thr, Gln, Val, Ile, Leu, Met, Ala, Ser, Trp, Cys, Asn, Phe, Glu, Asp, Tyr, Gly, Lys, His, Arg, or Pro
  misc_feature (10)..(10): Xaa can be Lys, Arg, Val, Tyr, His, Leu, Met, Ile, Ala, Thr, Gly, Ser, Pro, Gln, Cys, Trp, Asp, Asn, Glu, or Phe
KXVEFLAMLX

SEQ ID NO: 94795 - protein, 8 aa, Artificial Sequence
  Description of Artificial Sequence: Synthetic peptide
  Seed: KVWVQEHY (MAGC1_HUMAN)
  misc_feature (2)..(2): Xaa can be Gln, Met, Tyr, Thr, Ala, Leu, Ser, Phe, Glu, Ile, or Val
  misc_feature (8)..(8): Xaa can be Tyr, or Phe
KXWVQEHX

SEQ ID NO: 94796 - protein, 9 aa, Artificial Sequence
  Description of Artificial Sequence: Synthetic peptide
  Seed: KVWVQEHYL (MAGC1_HUMAN)
  misc_feature (2)..(2): Xaa can be Met, Leu, Gln, Thr, Ser, Ile, Val, Ala, Tyr, Phe, Asn, Asp, Glu, Gly, Trp, Cys, Arg, His, Pro, or Lys
  misc_feature (9)..(9): Xaa can be Tyr, Leu, Trp, Met, Phe, Ile, Arg, Val, Lys, His, Cys, Ala, Thr, or Ser
KXWVQEHYX

SEQ ID NO: 94797 - protein, 11 aa, Artificial Sequence
  Description of Artificial Sequence: Synthetic peptide
  Seed: KVWVQEHYLEY (MAGC1_HUMAN)
  misc_feature (2)..(2): Xaa can be Ser, Thr, Gln, Met, Ala, Lys, Leu, Tyr, Ile, Val, Arg, His, Trp, Glu, Asn, Cys, Gly, Pro, Asp, or Phe
  misc_feature (11)..(11): Xaa can be Tyr, Phe, Trp, Met, Leu, or Ile
KXWVQEHYLEX

SEQ ID NO: 94798 - protein, 10 aa, Artificial Sequence
  Description of Artificial Sequence: Synthetic peptide
  Seed: KYQVKQPITK (MAGC1_HUMAN)
  misc_feature (2)..(2): Xaa can be Thr, Ser, Val, Phe, Leu, Met, Trp, Ile, Tyr, Gln, Ala, Gly, Cys, His, or Asn
  misc_feature (10)..(10): Xaa can be Arg, Lys, Ala, Val, or Ile
KXQVKQPITX

SEQ ID NO: 94799 - protein, 8 aa, Artificial Sequence
  Description of Artificial Sequence: Synthetic peptide
  Seed: LAMLKNTV (MAGC1_HUMAN)
  misc_feature (2)..(2): Xaa can be Met, Ala, Pro, Leu, Ser, Ile, Gln, Val, Thr, Gly, Glu, Arg, Phe, Asn, Asp, Trp, Lys, Cys, or His
  misc_feature (8)..(8): Xaa can be Leu, Met, Ile, Val, Phe, Tyr, or Ala
LXMLKNTX

SEQ ID NO: 94800 - protein, 10 aa, Artificial Sequence
  Description of Artificial Sequence: Synthetic peptide
  Seed: LAMLKNTVPI (MAGC1_HUMAN)
  misc_feature (2)..(2): Xaa can be Leu, Met, Gln, Val, Ala, Pro, Phe, Glu, Cys, Ser, Lys, Tyr, Trp, Ile, Asn, Asp, Gly, Thr, His, or Arg
  misc_feature (10)..(10): Xaa can be Ile, Val, Trp, Phe, Tyr, Ala, Leu, Met, His, Thr, Cys, or Ser
LXMLKNTVPX

SEQ ID NO: 94801 - protein, 9 aa, Artificial Sequence
  Description of Artificial Sequence: Synthetic peptide
  Seed: LARFLLLKY (MAGC1_HUMAN)
  misc_feature (2)..(2): Xaa can be Ala, Ser, Thr, Gln, Val, Pro, Met, Leu, Gly, Ile, Lys, Glu, Asn, Asp, Tyr, Cys, Trp, His, Phe, or Arg
  misc_feature (9)..(9): Xaa can be Tyr, Phe, Trp, Leu, Met, Lys, Ile, Arg, Val, His, or Cys
LXRFLLLKX

SEQ ID NO: 94802 - protein, 9 aa, Artificial Sequence
  Description of Artificial Sequence: Synthetic peptide
  Seed: LASLLQSSH (MAGC1_HUMAN)
  misc_feature (2)..(2): Xaa can be Ala, Ser, Val, Thr, Gln, Gly, Ile, Met, Leu, Cys, Asn, Glu, or Pro
  misc_feature (9)..(9): Xaa can be Tyr, Phe, Met, Leu, His, Ile, Val, Ala, or Trp
LXSLLQSSX

SEQ ID NO: 94803 - protein, 8 aa, Artificial Sequence
  Description of Artificial Sequence: Synthetic peptide
  Seed: LDEKVDEL (MAGC1_HUMAN)
  misc_feature (2)..(2): Xaa can be Glu, Asp, or Gln
  misc_feature (8)..(8): Xaa can be Leu, Phe, Met, Val, Ile, Tyr, Ala, Pro, Cys, or Thr
LXEKVDEX

SEQ ID NO: 94804 - protein, 9 aa, Artificial Sequence
  Description of Artificial Sequence: Synthetic peptide
  Seed: LDEKVDELA (MAGC1_HUMAN)
  misc_feature (2)..(2): Xaa can be Glu, Asp, or Gln
  misc_feature (9)..(9): Xaa can be Val, Ala, Leu, Met, Ile, Thr, Gly, Tyr, Phe, Ser, Cys, Trp, or Pro
LXEKVDELX

SEQ ID NO: 94805 - protein, 9 aa, Artificial Sequence
  Description of Artificial Sequence: Synthetic peptide
  Seed: LDLTSEGCL (MAGC1_HUMAN)
  misc_feature (2)..(2): Xaa can be Glu, or Asp
  misc_feature (9)..(9): Xaa can be Met, Phe, Leu, Ile, or Val
LXLTSEGCX

SEQ ID NO: 94806 - protein, 9 aa, Artificial Sequence
  Description of Artificial Sequence: Synthetic peptide
  Seed: LEGEDSLSS (MAGC1_HUMAN)
  misc_feature (2)..(2): Xaa can be Glu, Asp, or Gln
  misc_feature (9)..(9): Xaa can be Ala, Ile, Val, Leu, Pro, Met, Cys, Thr, Ser, Gly, or Phe
LXGEDSLSX

SEQ ID NO: 94807 - protein, 10 aa, Artificial Sequence
  Description of Artificial Sequence: Synthetic peptide
  Seed: LEGEDSLSSL (MAGC1_HUMAN)
  misc_feature (2)..(2): Xaa can be Glu, Asp, Gln, or Val
  misc_feature (10)..(10): Xaa can be Phe, Trp, Leu, Met, Tyr, Cys, Gly, Val, Lys, Pro, Thr, Ala, Ser, or Ile
LXGEDSLSSX

SEQ ID NO: 94808 - protein, 10 aa, Artificial Sequence
  Description of Artificial Sequence: Synthetic peptide
  Seed: LEISQSPPEG (MAGC1_HUMAN)
  misc_feature (2)..(2): Xaa can be Glu, or Asp
  misc_feature (10)..(10): Xaa can be Ala, Val, Leu, Phe, Ser, Gly, Ile, Met, Tyr, Cys, Pro, or Thr
LXISQSPPEX

SEQ ID NO: 94809 - protein, 9 aa, Artificial Sequence
  Description of Artificial Sequence: Synthetic peptide
  Seed: LESDSLTDS (MAGC1_HUMAN)
  misc_feature (2)..(2): Xaa can be Glu, or Asp
  misc_feature (9)..(9): Xaa can be Leu, Ala, Val, Ile, Phe, Cys, Thr, Ser, Pro, Met, or Gly
LXSDSLTDX

SEQ ID NO: 94810 - protein, 9 aa, Artificial Sequence
  Description of Artificial Sequence: Synthetic peptide
  Seed: LEYREVPNS (MAGC1_HUMAN)
  misc_feature (2)..(2): Xaa can be Glu, Asp, or Gln
  misc_feature (9)..(9): Xaa can be Val, Leu, Ile, Phe, Ala, Met, Cys, Thr, Tyr, Pro, Ser, Trp, or Gly
LXYREVPNX

SEQ ID NO: 94811 - protein, 10 aa, Artificial Sequence
  Description of Artificial Sequence: Synthetic peptide
  Seed: LEYREVPNSS (MAGC1_HUMAN)
  misc_feature (2)..(2): Xaa can be , or Glu
  misc_feature (10)..(10): Xaa can be Phe, Ala, Tyr, Cys, Pro, Gly, Val, Thr, Leu, Ile, Ser, or Met
LXYREVPNSX

SEQ ID NO: 94812 - protein, 11 aa, Artificial Sequence
  Description of Artificial Sequence: Synthetic peptide
  Seed: LEYREVPNSSP (MAGC1_HUMAN)
  misc_feature (2)..(2): Xaa can be , or Glu
  misc_feature (11)..(11): Xaa can be Ser, Pro, Leu, Val, Gly, Thr, Cys, Ala, Phe, Met, or Ile
LXYREVPNSSX

SEQ ID NO: 94813 - protein, 9 aa, Artificial Sequence
  Description of Artificial Sequence: Synthetic peptide
  Seed: LFGISLREV (MAGC1_HUMAN)
  misc_feature (2)..(2): Xaa can be Tyr, Phe, Trp, or Met
  misc_feature (9)..(9): Xaa can be Phe, Met, Ile, Leu, Tyr, Val, Trp, or His
LXGISLREX

SEQ ID NO: 94814 - protein, 8 aa, Artificial Sequence
  Description of Artificial Sequence: Synthetic peptide
  Seed: LFQSFSER (MAGC1_HUMAN)
  misc_feature (2)..(2): Xaa can be Phe, or Met
  misc_feature (8)..(8): Xaa can be , or Arg
LXQSFSEX

SEQ ID NO: 94815 - protein, 10 aa, Artificial Sequence
  Description of Artificial Sequence: Synthetic peptide
  Seed: LHFPQSPPEW (MAGC1_HUMAN)
  misc_feature (2)..(2): Xaa can be His, Thr, Ser, Tyr, Ala, Gln, Arg, Trp, Pro, Glu, Gly, Lys, Val, Met, Phe, Cys, Ile, Asp, Asn, or Leu
  misc_feature (10)..(10): Xaa can be Trp, Phe, Tyr, Leu, Met, Ile, Val, Cys, or Ala
LXFPQSPPEX

SEQ ID NO: 94816 - protein, 11 aa, Artificial Sequence
  Description of Artificial Sequence: Synthetic peptide
  Seed: LHSPQSPPEGM (MAGC1_HUMAN)
  misc_feature (2)..(2): Xaa can be Arg, His, Gln, Tyr, Phe, Ala, Gly, Trp, Lys, Thr, Leu, Ser, Asn, Pro, Glu, Val, Ile, or Me t
  misc_feature (11)..(11): Xaa can be Leu, Phe, Met, Tyr, Ile, Trp, Cys, Val, or Ala
LXSPQSPPEGX

SEQ ID NO: 94817 - protein, 10 aa, Artificial Sequence
  Description of Artificial Sequence: Synthetic peptide
  Seed: LIESEPLFTY (MAGC1_HUMAN)
  misc_feature (2)..(2): Xaa can be Thr, Gln, Met, Ser, Ile, Leu, Val, Asn, Phe, Gly, Lys, Ala, Asp, Glu, His, Pro, Trp, Cys, Arg, or Tyr
  misc_feature (10)..(10): Xaa can be Trp, Phe, Tyr, Lys, Arg, Met, His, or Leu
LXESEPLFTX

SEQ ID NO: 94818 - protein, 9 aa, Artificial Sequence
  Description of Artificial Sequence: Synthetic peptide
  Seed: LILILSIIF (MAGC1_HUMAN)
  misc_feature (2)..(2): Xaa can be Ser, Thr, Ala, Met, Gln, Pro, Leu, Val, Ile, Asp, Cys, Gly, Asn, Glu, Lys, Phe, Arg, or Hi s
  misc_feature (9)..(9): Xaa can be Tyr, Phe, Trp, Met, Leu, Ile, or Val
LXLILSIIX

SEQ ID NO: 94819 - protein, 10 aa, Artificial Sequence
  Description of Artificial Sequence: Synthetic peptide
  Seed: LILILSIIFI (MAGC1_HUMAN)
  misc_feature (2)..(2): Xaa can be Met, Phe, Leu, Tyr, Arg, Ile, Thr, Glu, Lys, Ala, Gln, His, Cys, Val, Ser, Pro, Gly, Asn, Trp, or Asp
  misc_feature (10)..(10): Xaa can be Ala, Ile, Leu, Val, Met, or Thr
LXLILSIIFX

SEQ ID NO: 94820 - protein, 9 aa, Artificial Sequence
  Description of Artificial Sequence: Synthetic peptide
  Seed: LILSIIFIK (MAGC1_HUMAN)
  misc_feature (2)..(2): Xaa can be Met, Leu, Thr, Val, Ile, Ser, Trp, Tyr, Asn, Pro, Asp, Cys, Gly, Glu, His, Phe, Gln, Ala, Lys, or Arg
  misc_feature (9)..(9): Xaa can be Arg, Lys, Tyr, His, Val, Leu, Ile, Phe, Met, or Ala
LXLSIIFIX

SEQ ID NO: 94821 - protein, 9 aa, Artificial Sequence
  Description of Artificial Sequence: Synthetic peptide
  Seed: LKNTVPITF (MAGC1_HUMAN)
  misc_feature (2)..(2): Xaa can be Arg, Tyr, Gln, Ala, His, Met, Ser, Gly, Lys, Glu, Asp, Leu, Phe, Trp, Asn, Pro, Ile, Val, Thr, or Cys
  misc_feature (9)..(9): Xaa can be Met, Tyr, Phe, Leu, Ile, Val, Trp, Lys, His, Cys, Arg, Ala, Thr, Gly, Asn, Ser, Glu, Pro, or Gln
LXNTVPITX

SEQ ID NO: 94822 - protein, 9 aa, Artificial Sequence
  Description of Artificial Sequence: Synthetic peptide
  Seed: LKYQVKQPI (MAGC1_HUMAN)
  misc_feature (2)..(2): Xaa can be Gln, Met, Lys, Leu, Ala, His, Glu, Ser, Arg, Val, Ile, Phe, Asn, Tyr, Thr, Trp, Gly, Asp, Cys, or Pro
  misc_feature (9)..(9): Xaa can be Phe, Tyr, Met, Leu, Trp, Ile, His, Val, Ala, Gly, Thr, Cys, Ser, Gln, Asn, or Pro
LXYQVKQPX

SEQ ID NO: 94823 - protein, 8 aa, Artificial Sequence
  Description of Artificial Sequence: Synthetic peptide
  Seed: LLILILSI (MAGC1_HUMAN)
  misc_feature (2)..(2): Xaa can be Gln, Glu, Pro, His, Gly, Met, Ala, Asp, Ser, Asn, Lys, Leu, Val, or Thr
  misc_feature (8)..(8): Xaa can be Ile, Val, Leu, Met, Ala, Phe, or Cys
LXILILSX

SEQ ID NO: 94824 - protein, 9 aa, Artificial Sequence
  Description of Artificial Sequence: Synthetic peptide
  Seed: LLILILSII (MAGC1_HUMAN)
  misc_feature (2)..(2): Xaa can be Gln, Leu, Met, Ile, Thr, Val, Ala, Glu, Ser, Asn, Gly, or Asp
  misc_feature (9)..(9): Xaa can be Val, Ile, Leu, Ala, Met, Thr, Phe, or Cys
LXILILSIX

SEQ ID NO: 94825 - protein, 10 aa, Artificial Sequence
  Description of Artificial Sequence: Synthetic peptide
  Seed: LLKYQVKQPI (MAGC1_HUMAN)
  misc_feature (2)..(2): Xaa can be Leu, Met, Ile, Val, or Gln
  misc_feature (10)..(10): Xaa can be Val, Leu, Ile, or Ala
LXKYQVKQPX

SEQ ID NO: 94826 - protein, 11 aa, Artificial Sequence
  Description of Artificial Sequence: Synthetic peptide
  Seed: LLLKYQVKQPI (MAGC1_HUMAN)
  misc_feature (2)..(2): Xaa can be Leu, Met, Tyr, Ile, or Phe
  misc_feature (11)..(11): Xaa can be Val, Leu, Ile, or Ala
LXLKYQVKQPX

SEQ ID NO: 94827 - protein, 10 aa, Artificial Sequence
  Description of Artificial Sequence: Synthetic peptide
  Seed: LLQIPMTSSF (MAGC1_HUMAN)
  misc_feature (2)..(2): Xaa can be Asp, Tyr, His, Trp, Arg, Phe, Pro, Cys, Met, Ile, Lys, Glu, Gly, Asn, Leu, Thr, Ala, Val, Gln, or Ser
  misc_feature (10)..(10): Xaa can be Leu, His, Val, Trp, Tyr, Ala, Phe, Met, or Ile
LXQIPMTSSX

SEQ ID NO: 94828 - protein, 11 aa, Artificial Sequence
  Description of Artificial Sequence: Synthetic peptide
  Seed: LLQIPMTSSFS (MAGC1_HUMAN)
  misc_feature (2)..(2): Xaa can be Trp, Val, His, Asp, Glu, Thr, Met, Arg, Lys, Leu, Ala, Ser, Gly, Phe, Ile, Cys, Asn, Pro, Tyr, or Gln
  misc_feature (11)..(11): Xaa can be Leu, Trp, Ala, Ser, Gly, Val, Asp, Lys, Thr, Asn, His, Cys, Phe, Gln, Met, Arg, Glu, Pro, Ile, or Tyr
LXQIPMTSSFX

SEQ ID NO: 94829 - protein, 11 aa, Artificial Sequence
  Description of Artificial Sequence: Synthetic peptide
  Seed: LLSIFQSSPER (MAGC1_HUMAN)
  misc_feature (2)..(2): Xaa can be Gly, Val, Ser, Tyr, Gln, His, Met, Lys, Trp, Ile, Arg, Phe, Leu, Thr, or Ala
  misc_feature (11)..(11): Xaa can be , or Arg
LXSIFQSSPEX

SEQ ID NO: 94830 - protein, 8 aa, Artificial Sequence
  Description of Artificial Sequence: Synthetic peptide
  Seed: LLSLFQSF (MAGC1_HUMAN)
  misc_feature (2)..(2): Xaa can be Gln, Met, Lys, His, Leu, Ala, Arg, Ser, Ile, Tyr, or Val
  misc_feature (8)..(8): Xaa can be Tyr, Phe, Met, Leu, or Ile
LXSLFQSX

SEQ ID NO: 94831 - protein, 9 aa, Artificial Sequence
  Description of Artificial Sequence: Synthetic peptide
  Seed: LLSLFQSFS (MAGC1_HUMAN)
  misc_feature (2)..(2): Xaa can be Met, Leu, Ile, Val, Thr, Gln, Ser, Ala, Phe, or Gly
  misc_feature (9)..(9): Xaa can be Val, Leu, Ile, Met, Ala, Thr, Ser, Gly, Phe, Pro, or Cys
LXSLFQSFX

SEQ ID NO: 94832 - protein, 11 aa, Artificial Sequence
  Description of Artificial Sequence: Synthetic peptide
  Seed: LLSLFQSFSER (MAGC1_HUMAN)
  misc_feature (2)..(2): Xaa can be Phe, Thr, Met, Ser, Trp, Gln, Val, Ile, Tyr, Gly, Asn, Arg, His, Cys, Pro, Glu, Asp, Ala, Lys, or Leu
  misc_feature (11)..(11): Xaa can be Arg, or Lys
LXSLFQSFSEX

SEQ ID NO: 94833 - protein, 11 aa, Artificial Sequence
  Description of Artificial Sequence: Synthetic peptide
  Seed: LLSLFQSSPER (MAGC1_HUMAN)
  misc_feature (2)..(2): Xaa can be Lys, Leu, His, Ala, Cys, Tyr, Ser, Gln, Phe, Gly, Thr, Asn, Arg, Trp, Met, or Ile
  misc_feature (11)..(11): Xaa can be , or Arg
LXSLFQSSPEX

SEQ ID NO: 94834 - protein, 8 aa, Artificial Sequence
  Description of Artificial Sequence: Synthetic peptide
  Seed: LPQSFPES (MAGC1_HUMAN)
  misc_feature (2)..(2): Xaa can be , or Pro
  misc_feature (8)..(8): Xaa can be Phe, Ile, Leu, Met, Thr, Ala, Cys, Ser, Val, or Pro
LXQSFPEX

SEQ ID NO: 94835 - protein, 9 aa, Artificial Sequence
  Description of Artificial Sequence: Synthetic peptide
  Seed: LPQSFPESP (MAGC1_HUMAN)
  misc_feature (2)..(2): Xaa can be , or Pro
  misc_feature (9)..(9): Xaa can be Pro, or Ser
LXQSFPESX

SEQ ID NO: 94836 - protein, 11 aa, Artificial Sequence
  Description of Artificial Sequence: Synthetic peptide
  Seed: LPQSFPESPQS (MAGC1_HUMAN)
  misc_feature (2)..(2): Xaa can be , or Pro
  misc_feature (11)..(11): Xaa can be Gly, Thr, Val, Cys, Leu, Ile, Ala, Ser, Pro, Met, Phe, or Tyr
LXQSFPESPQX

SEQ ID NO: 94837 - protein, 9 aa, Artificial Sequence
  Description of Artificial Sequence: Synthetic peptide
  Seed: LPQSFPESS (MAGC1_HUMAN)
  misc_feature (2)..(2): Xaa can be Pro, Ala, Val, Met, or Ile
  misc_feature (9)..(9): Xaa can be Leu, Met, Ala, Ile, Val, Phe, His, Trp, Thr, Arg, Gln, Cys, Tyr, Gly, Lys, or Ser
LXQSFPESX

SEQ ID NO: 94838 - protein, 11 aa, Artificial Sequence
  Description of Artificial Sequence: Synthetic peptide
  Seed: LPQSFPESSQS (MAGC1_HUMAN)
  misc_feature (2)..(2): Xaa can be , or Pro
  misc_feature (11)..(11): Xaa can be Val, Pro, Phe, Ser, Gly, Leu, Cys, Met, Ile, Ala, or Thr
LXQSFPESSQX

SEQ ID NO: 94839 - protein, 10 aa, Artificial Sequence
  Description of Artificial Sequence: Synthetic peptide
  Seed: LQGEEFQSSL (MAGC1_HUMAN)
  misc_feature (2)..(2): Xaa can be Leu, Met, His, Gln, Ile, Val, Lys, Arg, or Thr
  misc_feature (10)..(10): Xaa can be Phe, Val, Trp, Leu, Tyr, Ile, Met, or Ala
LXGEEFQSSX

SEQ ID NO: 94840 - protein, 9 aa, Artificial Sequence
  Description of Artificial Sequence: Synthetic peptide
  Seed: LQIPGSPSF (MAGC1_HUMAN)
  misc_feature (2)..(2): Xaa can be Ala, Pro, Glu, Gln, Arg, Ser, His, Met, Tyr, Val, Leu, Phe, Thr, Ile, Gly, Asp, Cys, Asn, Lys, or Trp
  misc_feature (9)..(9): Xaa can be Met, Trp, Ile, Val, Phe, Leu, Tyr, Lys, His, Ala, Arg, Cys, Thr, Ser, Gln, Gly, Pro, Asn, or Glu
LXIPGSPSX

SEQ ID NO: 94841 - protein, 10 aa, Artificial Sequence
  Description of Artificial Sequence: Synthetic peptide
  Seed: LQIPGSPSFS (MAGC1_HUMAN)
  misc_feature (2)..(2): Xaa can be Ile, Gln, Val, Lys, Leu, Met, His, Arg, Glu, Ala, Thr, Ser, Phe, Tyr, Trp, Cys, Asn, Gly, or Pro
  misc_feature (10)..(10): Xaa can be Tyr, Phe, Met, Trp, Leu, His, Ile, Ala, Pro, Cys, Asp, Gly, Asn, Arg, Ser, Gln, Glu, Lys, Thr, or Val
LXIPGSPSFX

SEQ ID NO: 94842 - protein, 11 aa, Artificial Sequence
  Description of Artificial Sequence: Synthetic peptide
  Seed: LQIPGSPSFSS (MAGC1_HUMAN)
  misc_feature (2)..(2): Xaa can be Gln, Met, Lys, His, Ile, Ser, Ala, Glu, Val, Arg, or Leu
  misc_feature (11)..(11): Xaa can be Tyr, Phe, Met, Leu, Trp, His, Gln, Pro, Arg, Ile, Glu, Cys, Asn, Lys, Gly, Ala, Asp, Ser, Val, or Thr
LXIPGSPSFSX

SEQ ID NO: 94843 - protein, 9 aa, Artificial Sequence
  Description of Artificial Sequence: Synthetic peptide
  Seed: LQIPMTSSF (MAGC1_HUMAN)
  misc_feature (2)..(2): Xaa can be Pro, Gln, Ala, Tyr, Ser, Arg, Met, Glu, Val, Thr, Leu, Ile, Phe, Asp, Gly, His, Asn, Lys, Cys, or Trp
  misc_feature (9)..(9): Xaa can be Tyr, Met, Phe, Ile, Leu, Trp, Val, His, Ala, Lys, Arg, Cys, Thr, Gly, Gln, Ser, Asn, Pro, or Glu
LXIPMTSSX

SEQ ID NO: 94844 - protein, 10 aa, Artificial Sequence
  Description of Artificial Sequence: Synthetic peptide
  Seed: LQIPMTSSFS (MAGC1_HUMAN)
  misc_feature (2)..(2): Xaa can be Gln, Ile, His, Ser, Val, Leu, Met, Lys, Thr, Glu, Ala, Arg, Tyr, Phe, Asp, Gly, Trp, Cys, Pro, or Asn
  misc_feature (10)..(10): Xaa can be Tyr, Phe, Met, Leu, Trp, His, Ile, Ala, Arg, Val, Gly, Gln, Asp, Asn, Ser, Lys, Glu, Cys, Pro, or Thr
LXIPMTSSFX

SEQ ID NO: 94845 - protein, 11 aa, Artificial Sequence
  Description of Artificial Sequence: Synthetic peptide
  Seed: LQIPMTSSFSS (MAGC1_HUMAN)
  misc_feature (2)..(2): Xaa can be Gln, Met, Lys, Leu, Arg, His, Glu, Val, Ser, Tyr, Ala, Thr, Asn, Ile, or Phe
  misc_feature (11)..(11): Xaa can be Phe, Tyr, Met, Leu, Ile, Trp, Val, Ala, Ser, Thr, Lys, Pro, Cys, Gly, Asp, Glu, His, Asn, Gln, or Arg
LXIPMTSSFSX

SEQ ID NO: 94846 - protein, 8 aa, Artificial Sequence
  Description of Artificial Sequence: Synthetic peptide
  Seed: LQIPQSPL (MAGC1_HUMAN)
  misc_feature (2)..(2): Xaa can be Gln, Met, Ala, Glu, Lys, Leu, Ser, His, Arg, Ile, Phe, Tyr, Val, Thr, or Asn
  misc_feature (8)..(8): Xaa can be Phe, Tyr, Leu, Met, Ile, Val, or Trp
LXIPQSPX

SEQ ID NO: 94847 - protein, 8 aa, Artificial Sequence
  Description of Artificial Sequence: Synthetic peptide
  Seed: LQIPVSAA (MAGC1_HUMAN)
  misc_feature (2)..(2): Xaa can be His, Gln, Arg, Ala, Ser, Glu, Thr, Gly, Ile, Leu, Pro, Asn, Asp, Val, Met, or Lys
  misc_feature (8)..(8): Xaa can be Val, Ile, Leu, Met, Ala, Cys, Phe, Pro, Ser, or Thr
LXIPVSAX

SEQ ID NO: 94848 - protein, 9 aa, Artificial Sequence
  Description of Artificial Sequence: Synthetic peptide
  Seed: LQIPVSAAS (MAGC1_HUMAN)
  misc_feature (2)..(2): Xaa can be Gln, Met, Leu, Thr, Lys, Ile, Val, Ala, Ser, His, Arg, Glu, Gly, Asn, Phe, Tyr, Cys, Pro, Asp, or Trp
  misc_feature (9)..(9): Xaa can be Tyr, Met, Leu, Phe, Trp, Val, Ile, His, Ala, Thr, Gly, Cys, Ser, Gln, Pro, Asn, Lys, or Ar g
LXIPVSAAX

SEQ ID NO: 94849 - protein, 9 aa, Artificial Sequence
  Description of Artificial Sequence: Synthetic peptide
  Seed: LQIPVSPSF (MAGC1_HUMAN)
  misc_feature (2)..(2): Xaa can be Pro, Glu, Arg, Ala, Gln, Leu, Met, Ile, Tyr, Thr, Ser, His, Gly, Asp, Phe, Cys, Val, Lys, Asn, or Trp
  misc_feature (9)..(9): Xaa can be Met, Ile, Val, Phe, Leu, Trp, Tyr, His, Lys, Ala, Cys, Arg, Thr, Pro, Gly, Ser, Gln, Asn, or Glu
LXIPVSPSX

SEQ ID NO: 94850 - protein, 10 aa, Artificial Sequence
  Description of Artificial Sequence: Synthetic peptide
  Seed: LQIPVSPSFS (MAGC1_HUMAN)
  misc_feature (2)..(2): Xaa can be Lys, Gln, Met, Leu, His, Ile, Val, Ser, Thr, Glu, Ala, Arg, Asn, Tyr, Gly, Phe, Trp, Cys, or Pro
  misc_feature (10)..(10): Xaa can be Tyr, Phe, Met, Leu, Trp, His, Asp, Ile, Gln, Ala, Ser, Glu, Pro, Lys, Thr, Cys, Val, Arg, Asn, or Gly
LXIPVSPSFX

SEQ ID NO: 94851 - protein, 9 aa, Artificial Sequence
  Description of Artificial Sequence: Synthetic peptide
  Seed: LQIPVSPSS (MAGC1_HUMAN)
  misc_feature (2)..(2): Xaa can be , or Gln
  misc_feature (9)..(9): Xaa can be Ser, or Phe
LXIPVSPSX

SEQ ID NO: 94852 - protein, 9 aa, Artificial Sequence
  Description of Artificial Sequence: Synthetic peptide
  Seed: LQIPVSRSF (MAGC1_HUMAN)
  misc_feature (2)..(2): Xaa can be Ala, Gln, Pro, Glu, Arg, Ser, Thr, Met, Val, Tyr, Ile, Gly, Asp, His, Asn, Phe, Lys, Leu, Cys, or Trp
  misc_feature (9)..(9): Xaa can be Val, Met, Trp, Phe, Tyr, Ile, Leu, His, Ala, Lys, Cys, Arg, Thr, Gln, Pro, Gly, Ser, or As n
LXIPVSRSX

SEQ ID NO: 94853 - protein, 10 aa, Artificial Sequence
  Description of Artificial Sequence: Synthetic peptide
  Seed: LQIPVSRSFS (MAGC1_HUMAN)
  misc_feature (2)..(2): Xaa can be Lys, Gln, Leu, Met, His, Glu, Ser, Val, Ile, Thr, Ala, Arg, Tyr, Phe, Asn, Gly, Pro, or Cy s
  misc_feature (10)..(10): Xaa can be Tyr, Phe, Met, His, Leu, Trp, Ile, Glu, Ser, Gln, Ala, Asp, Pro, Arg, Asn, Thr, Lys, Val, Gly, or Cys
LXIPVSRSFX

SEQ ID NO: 94854 - protein, 9 aa, Artificial Sequence
  Description of Artificial Sequence: Synthetic peptide
  Seed: LQIPVSSSF (MAGC1_HUMAN)
  misc_feature (2)..(2): Xaa can be , or Gln
  misc_feature (9)..(9): Xaa can be , or Phe
LXIPVSSSX

SEQ ID NO: 94855 - protein, 10 aa, Artificial Sequence
  Description of Artificial Sequence: Synthetic peptide
  Seed: LQIPVSSSFS (MAGC1_HUMAN)
  misc_feature (2)..(2): Xaa can be Ile, Val, Lys, Leu, Thr, Gln, Met, Ser, His, Glu, Ala, Arg, Tyr, Phe, Trp, Gly, Cys, Pro, Asn, or Asp
  misc_feature (10)..(10): Xaa can be Tyr, Phe, Met, His, Ile, Trp, Leu, Asn, Glu, Ser, Cys, Asp, Arg, Lys, Pro, Thr, Ala, Gly, Gln, or Val
LXIPVSSSFX

SEQ ID NO: 94856 - protein, 11 aa, Artificial Sequence
  Description of Artificial Sequence: Synthetic peptide
  Seed: LQIPVSSSFSY (MAGC1_HUMAN)
  misc_feature (2)..(2): Xaa can be Met, Gln, Thr, Val, Ser, Ala, Pro, Asn, Gly, Asp, Leu, Ile, Glu, His, Lys, Phe, Arg, Cys, Tyr, or Trp
  misc_feature (11)..(11): Xaa can be Leu, Tyr, Met, Trp, Phe, Lys, His, Arg, Ile, Thr, Cys, Pro, Gln, Glu, Asn, Val, Gly, Ala, Asp, or Ser
LXIPVSSSFSX

SEQ ID NO: 94857 - protein, 9 aa, Artificial Sequence
  Description of Artificial Sequence: Synthetic peptide
  Seed: LQIPVSSSS (MAGC1_HUMAN)
  misc_feature (2)..(2): Xaa can be Pro, Ala, Gln, Met, Glu, Tyr, Arg, Ser, His, Phe, Leu, Thr, Val, Asp, Gly, Ile, Lys, Cys, Asn, or Trp
  misc_feature (9)..(9): Xaa can be Ile, Val, Tyr, Leu, Met, Trp, His, Lys, Phe, Ala, Arg, Cys, Thr, Gly, Gln, Ser, Pro, Asn, or Glu
LXIPVSSSX

SEQ ID NO: 94858 - protein, 9 aa, Artificial Sequence
  Description of Artificial Sequence: Synthetic peptide
  Seed: LQIVPSLPE (MAGC1_HUMAN)
  misc_feature (2)..(2): Xaa can be Gln, Met, Lys, His, Ser, Ala, Leu, Arg, Val, Glu, Thr, Tyr, Asn, Ile, Phe, Gly, Cys, Pro, Trp, or Asp
  misc_feature (9)..(9): Xaa can be Tyr, Phe, Met, Leu, Trp, Ile, His, Val, Ala, Ser, Thr, Gly, Cys, Pro, Asn, Glu, or Gln
LXIVPSLPX

SEQ ID NO: 94859 - protein, 10 aa, Artificial Sequence
  Description of Artificial Sequence: Synthetic peptide
  Seed: LQIVPSLPEW (MAGC1_HUMAN)
  misc_feature (2)..(2): Xaa can be Gln, Met, Ser, Thr, Glu, Lys, Ala, Arg, His, Leu, Ile, Val, Phe, Tyr, Cys, Gly, Asn, Pro, Asp, or Trp
  misc_feature (10)..(10): Xaa can be Tyr, Trp, Phe, Met, Leu, Ile, Val, His, or Ala
LXIVPSLPEX

SEQ ID NO: 94860 - protein, 8 aa, Artificial Sequence
  Description of Artificial Sequence: Synthetic peptide
  Seed: LQNPASSF (MAGC1_HUMAN)
  misc_feature (2)..(2): Xaa can be Ala, Val, Thr, Ser, Gln, Tyr, Arg, Ile, Phe, His, Leu, Gly, Met, Lys, Asn, Pro, Trp, Glu, Asp, or Cys
  misc_feature (8)..(8): Xaa can be Tyr, Phe, Leu, Met, Ile, His, Val, Trp, Lys, Ala, or Arg
LXNPASSX

SEQ ID NO: 94861 - protein, 9 aa, Artificial Sequence
  Description of Artificial Sequence: Synthetic peptide
  Seed: LQNPASSFF (MAGC1_HUMAN)
  misc_feature (2)..(2): Xaa can be Ala, Gln, Pro, Met, Ser, Thr, Arg, Ile, Gly, Leu, Val, His, Glu, Tyr, Lys, Asp, Trp, Phe, Asn, or Cys
  misc_feature (9)..(9): Xaa can be Tyr, Met, Trp, Leu, Phe, Ile, Val, His, Ala, Cys, Lys, Thr, Arg, Ser, Gly, or Gln
LXNPASSFX

SEQ ID NO: 94862 - protein, 10 aa, Artificial Sequence
  Description of Artificial Sequence: Synthetic peptide
  Seed: LQNPASSFFS (MAGC1_HUMAN)
  misc_feature (2)..(2): Xaa can be Met, Leu, Lys, Gln, His, Arg, Val, Ile, Glu, Ser, Thr, Ala, or Gly
  misc_feature (10)..(10): Xaa can be Tyr, Phe, Met, Arg, Gln, Trp, Ser, Thr, Pro, Asp, Val, His, Ala, Ile, Gly, Asn, Leu, Cys, Lys, or Glu
LXNPASSFFX

SEQ ID NO: 94863 - protein, 11 aa, Artificial Sequence
  Description of Artificial Sequence: Synthetic peptide
  Seed: LQNSQSSPEGK (MAGC1_HUMAN)
  misc_feature (2)..(2): Xaa can be Arg, Ala, Gly, Asn, Met, Ile, Ser, Val, Leu, Thr, Asp, Phe, Glu, or Gln
  misc_feature (11)..(11): Xaa can be Lys, Arg, Leu, Met, Phe, Trp, Ile, or Tyr
LXNSQSSPEGX

SEQ ID NO: 94864 - protein, 8 aa, Artificial Sequence
  Description of Artificial Sequence: Synthetic peptide
  Seed: LQRPVSSF (MAGC1_HUMAN)
  misc_feature (2)..(2): Xaa can be Ala, Gln, Ser, Val, Ile, Thr, Gly, Met, Leu, Asn, Glu, Arg, His, Asp, Tyr, Pro, Phe, Lys, Cys, or Trp
  misc_feature (8)..(8): Xaa can be Tyr, Phe, Leu, Val, Met, Ile, His, Lys, Ala, or Trp
LXRPVSSX

SEQ ID NO: 94865 - protein, 9 aa, Artificial Sequence
  Description of Artificial Sequence: Synthetic peptide
  Seed: LQRPVSSFF (MAGC1_HUMAN)
  misc_feature (2)..(2): Xaa can be Ser, Thr, Met, Tyr, Val, Phe, Ala, Gln, Ile, Leu, Gly, Asn, Trp, Arg, Glu, His, Lys, Cys, Asp, or Pro
  misc_feature (9)..(9): Xaa can be Leu, Tyr, Trp, Phe, Met, Ile, Lys, His, Val, Arg, Ala, Ser, Gly, Thr, Pro, Asn, Gln, Cys, or Glu
LXRPVSSFX

SEQ ID NO: 94866 - protein, 10 aa, Artificial Sequence
  Description of Artificial Sequence: Synthetic peptide
  Seed: LQRPVSSFFS (MAGC1_HUMAN)
  misc_feature (2)..(2): Xaa can be Leu, Met, Gln, Lys, His, Glu, Val, Ile, Arg, Ala, Ser, Tyr, Thr, Asn, Phe, or Gly
  misc_feature (10)..(10): Xaa can be Tyr, Phe, Met, Leu, Ser, Ala, Trp, Gln, Thr, Asn, Cys, Asp, Lys, Ile, Arg, His, Val, Glu, Pro, or Gly
LXRPVSSFFX

SEQ ID NO: 94867 - protein, 11 aa, Artificial Sequence
  Description of Artificial Sequence: Synthetic peptide
  Seed: LQRPVSSFFSY (MAGC1_HUMAN)
  misc_feature (2)..(2): Xaa can be Gln, Met, Pro, Ala, Asp, Ser, Trp, Arg, Gly, Ile, Val, Leu, Tyr, Cys, Thr, His, Phe, Glu, Asn, or Lys
  misc_feature (11)..(11): Xaa can be Phe, Tyr, Met, Leu, His, Trp, Val, or Ile
LXRPVSSFFSX

SEQ ID NO: 94868 - protein, 8 aa, Artificial Sequence
  Description of Artificial Sequence: Synthetic peptide
  Seed: LQSPVISF (MAGC1_HUMAN)
  misc_feature (2)..(2): Xaa can be Ala, Gln, Gly, Ser, Val, Ile, Thr, His, Met, Leu, Lys, Arg, Glu, Pro, Tyr, Asn, Phe, Asp, Trp, or Cys
  misc_feature (8)..(8): Xaa can be Tyr, Leu, Phe, Ile, Val, Met, Lys, His, Trp, Ala, Arg, or Cys
LXSPVISX

SEQ ID NO: 94869 - protein, 9 aa, Artificial Sequence
  Description of Artificial Sequence: Synthetic peptide
  Seed: LQSPVISFS (MAGC1_HUMAN)
  misc_feature (2)..(2): Xaa can be Leu, Met, Ile, Gln, Val, Thr, Ala, Ser, Asn, Gly, Cys, Phe, Glu, Asp, His, Trp, Pro, Lys, Arg, or Tyr
  misc_feature (9)..(9): Xaa can be Val, Leu, Ile, Ala, Met, Thr, Phe, Cys, Ser, Gly, or Pro
LXSPVISFX

SEQ ID NO: 94870 - protein, 8 aa, Artificial Sequence
  Description of Artificial Sequence: Synthetic peptide
  Seed: LQSPVSSF (MAGC1_HUMAN)
  misc_feature (2)..(2): Xaa can be Ala, Val, Ser, Ile, Gln, Thr, Met, Gly, Arg, Glu, Pro, Leu, Asn, Tyr, His, Lys, Phe, Asp, or Cys
  misc_feature (8)..(8): Xaa can be Tyr, Phe, Leu, Ile, Met, Val, His, Lys, Trp, Ala, or Arg
LXSPVSSX

SEQ ID NO: 94871 - protein, 9 aa, Artificial Sequence
  Description of Artificial Sequence: Synthetic peptide
  Seed: LSDEQGMSQ (MAGC1_HUMAN)
  misc_feature (2)..(2): Xaa can be Ala, Thr, Val, Ser, Ile, Leu, Phe, Met, Gly, Asn, Gln, Tyr, Cys, Trp, Asp, Pro, Glu, His, Arg, or Lys
  misc_feature (9)..(9): Xaa can be Phe, Val, Tyr, Met, Leu, Ile, Lys, Trp, Cys, Arg, Ala, Thr, His, Ser, Pro, Gln, Gly, Glu, or Asn
LXDEQGMSX

SEQ ID NO: 94872 - protein, 11 aa, Artificial Sequence
  Description of Artificial Sequence: Synthetic peptide
  Seed: LSDEQGMSQNR (MAGC1_HUMAN)
  misc_feature (2)..(2): Xaa can be Thr, Ala, Ile, Val, Ser, Met, Leu, Gln, Gly, Tyr, Phe, Trp, Asp, Asn, Cys, Glu, Pro, or Ly s
  misc_feature (11)..(11): Xaa can be Tyr, Lys, Phe, Arg, Trp, His, Leu, Met, Ile, Gln, or Val
LXDEQGMSQNX

SEQ ID NO: 94873 - protein, 10 aa, Artificial Sequence
  Description of Artificial Sequence: Synthetic peptide
  Seed: LSGIGVRAGR (MAGC1_HUMAN)
  misc_feature (2)..(2): Xaa can be Thr, Ser, Phe, Trp, Ile, Ala, Gln, Asn, Pro, Gly, Tyr, Met, Leu, Val, Glu, Arg, Asp, Cys, Lys, or His
  misc_feature (10)..(10): Xaa can be Arg, Lys, or Tyr
LXGIGVRAGX

SEQ ID NO: 94874 - protein, 10 aa, Artificial Sequence
  Description of Artificial Sequence: Synthetic peptide
  Seed: LSIFQSSPER (MAGC1_HUMAN)
  misc_feature (2)..(2): Xaa can be Val, Met, Ile, Thr, Tyr, Asp, His, Trp, Gln, Leu, Phe, Gly, Arg, Ser, Pro, Lys, Asn, Ala, Cys, or Glu
  misc_feature (10)..(10): Xaa can be Lys, Arg, or Tyr
LXIFQSSPEX

SEQ ID NO: 94875 - protein, 10 aa, Artificial Sequence
  Description of Artificial Sequence: Synthetic peptide
  Seed: LSIIFIKGTY (MAGC1_HUMAN)
  misc_feature (2)..(2): Xaa can be Ser, Thr, Gln, Ala, Met, Val, Ile, Gly, Leu, Cys, Trp, Phe, Pro, Glu, Lys, Asn, Tyr, His, Asp, or Arg
  misc_feature (10)..(10): Xaa can be Tyr, Phe, Trp, Met, Leu, or Ile
LXIIFIKGTX

SEQ ID NO: 94876 - protein, 10 aa, Artificial Sequence
  Description of Artificial Sequence: Synthetic peptide
  Seed: LSKSSPESPL (MAGC1_HUMAN)
  misc_feature (2)..(2): Xaa can be Ala, Val, Ser, Thr, Ile, Met, Leu, Gln, Cys, or Gly
  misc_feature (10)..(10): Xaa can be Tyr, Phe, Trp, Met, Leu, His, Lys, or Arg
LXKSSPESPX

SEQ ID NO: 94877 - protein, 10 aa, Artificial Sequence
  Description of Artificial Sequence: Synthetic peptide
  Seed: LSLFQSFSER (MAGC1_HUMAN)
  misc_feature (2)..(2): Xaa can be Ser, Thr, Val, Ile, Met, Ala, Leu, His, Trp, Glu, Arg, Asn, Pro, Asp, Lys, Phe, Tyr, Gln, Gly, or Cys
  misc_feature (10)..(10): Xaa can be Arg, Lys, or Tyr
LXLFQSFSEX

SEQ ID NO: 94878 - protein, 10 aa, Artificial Sequence
  Description of Artificial Sequence: Synthetic peptide
  Seed: LSLFQSSPER (MAGC1_HUMAN)
  misc_feature (2)..(2): Xaa can be Ile, Val, Thr, Cys, Asn, Leu, Lys, Gly, Pro, Trp, His, Met, Phe, Ser, Asp, Tyr, Ala, Arg, Gln, or Glu
  misc_feature (10)..(10): Xaa can be Arg, Lys, or Tyr
LXLFQSSPEX

SEQ ID NO: 94879 - protein, 9 aa, Artificial Sequence
  Description of Artificial Sequence: Synthetic peptide
  Seed: LSPLHFPQF (MAGC1_HUMAN)
  misc_feature (2)..(2): Xaa can be Gln, Tyr, Ala, Ile, Val, Phe, Gly, Ser, Arg, Thr, Met, Leu, Glu, Pro, Asn, Cys, Trp, His, Asp, or Lys
  misc_feature (9)..(9): Xaa can be Met, Ile, Val, Phe, Tyr, Leu, Trp, Arg, Ala, Cys, Lys, His, or Thr
LXPLHFPQX

SEQ ID NO: 94880 - protein, 11 aa, Artificial Sequence
  Description of Artificial Sequence: Synthetic peptide
  Seed: LSPLQIPQSPL (MAGC1_HUMAN)
  misc_feature (2)..(2): Xaa can be Arg, Pro, Phe, Ser, Ala, Tyr, Trp, His, Met, Lys, or Leu
  misc_feature (11)..(11): Xaa can be Leu, Met, Ile, Val, or Phe
LXPLQIPQSPX

SEQ ID NO: 94881 - protein, 10 aa, Artificial Sequence
  Description of Artificial Sequence: Synthetic peptide
  Seed: LSQSSPVSSF (MAGC1_HUMAN)
  misc_feature (2)..(2): Xaa can be Ala, Thr, Ser, Arg, Ile, Gln, Met, Val, Leu, Gly, Asn, Trp, Lys, Tyr, Phe, Glu, His, Asp, Cys, or Pro
  misc_feature (10)..(10): Xaa can be Leu, Trp, Tyr, Met, Phe, Ile, Lys, His, Arg, Val, or Ala
LXQSSPVSSX

SEQ ID NO: 94882 - protein, 8 aa, Artificial Sequence
  Description of Artificial Sequence: Synthetic peptide
  Seed: LTDSESLI (MAGC1_HUMAN)
  misc_feature (2)..(2): Xaa can be Ser, Ala, Gln, Val, Phe, Gly, Thr, Leu, Ile, Met, Cys, Asn, Tyr, Pro, Asp, Glu, or Trp
  misc_feature (8)..(8): Xaa can be Leu, Ile, Met, Phe, Val, or Tyr
LXDSESLX

SEQ ID NO: 94883 - protein, 9 aa, Artificial Sequence
  Description of Artificial Sequence: Synthetic peptide
  Seed: LTKVWVQEH (MAGC1_HUMAN)
  misc_feature (2)..(2): Xaa can be Ala, Ser, Ile, Val, Gly, Thr, Gln, Met, Asn, Leu, Glu, Cys, Pro, Phe, Asp, Lys, Arg, or Ty r
  misc_feature (9)..(9): Xaa can be Tyr, Phe, Leu, Met, His, Val, Ile, Ala, Trp, Lys, Gln, Thr, or Cys
LXKVWVQEX

SEQ ID NO: 94884 - protein, 10 aa, Artificial Sequence
  Description of Artificial Sequence: Synthetic peptide
  Seed: LTKVWVQEHY (MAGC1_HUMAN)
  misc_feature (2)..(2): Xaa can be Ser, Thr, Gln, Met, Gly, Leu, Glu, Asn, Phe, Val, Ala, Ile, His, Lys, Arg, Cys, Asp, Tyr, Pro, or Trp
  misc_feature (10)..(10): Xaa can be Tyr, Phe, Trp, Met, Ile, or Leu
LXKVWVQEHX

SEQ ID NO: 94885 - protein, 8 aa, Artificial Sequence
  Description of Artificial Sequence: Synthetic peptide
  Seed: LTNVISRY (MAGC1_HUMAN)
  misc_feature (2)..(2): Xaa can be Ala, Thr, Ser, Gly, Val, Phe, Met, Ile, Gln, Tyr, Trp, Leu, or Asp
  misc_feature (8)..(8): Xaa can be Tyr, Leu, Phe, Met, Val, Ile, or His
LXNVISRX

SEQ ID NO: 94886 - protein, 11 aa, Artificial Sequence
  Description of Artificial Sequence: Synthetic peptide
  Seed: LTNVISRYTGY (MAGC1_HUMAN)
  misc_feature (2)..(2): Xaa can be Ser, Thr, Ala, Gln, or Met
  misc_feature (11)..(11): Xaa can be Tyr, Phe, Trp, or Met
LXNVISRYTGX

SEQ ID NO: 94887 - protein, 11 aa, Artificial Sequence
  Description of Artificial Sequence: Synthetic peptide
  Seed: LVSLFQSSPER (MAGC1_HUMAN)
  misc_feature (2)..(2): Xaa can be , or Val
  misc_feature (11)..(11): Xaa can be , or Arg
LXSLFQSSPEX

SEQ ID NO: 94888 - protein, 11 aa, Artificial Sequence
  Description of Artificial Sequence: Synthetic peptide
  Seed: LWGPRAHSEVI (MAGC1_HUMAN)
  misc_feature (2)..(2): Xaa can be Gly, Gln, Val, Asn, Trp, Met, Pro, Tyr, Ser, Glu, Asp, Lys, Ala, His, Arg, Cys, Ile, Thr, Leu, or Phe
  misc_feature (11)..(11): Xaa can be Ile, Met, Phe, Ala, Leu, or Val
LXGPRAHSEVX

SEQ ID NO: 94889 - protein, 8 aa, Artificial Sequence
  Description of Artificial Sequence: Synthetic peptide
  Seed: LYFPQSPL (MAGC1_HUMAN)
  misc_feature (2)..(2): Xaa can be Tyr, Phe, Trp, Arg, or His
  misc_feature (8)..(8): Xaa can be Tyr, Leu, Met, Phe, Ile, Val, or Trp
LXFPQSPX

SEQ ID NO: 94890 - protein, 10 aa, Artificial Sequence
  Description of Artificial Sequence: Synthetic peptide
  Seed: LYPLQSPQSR (MAGC1_HUMAN)
  misc_feature (2)..(2): Xaa can be Tyr, Val, Thr, Ile, Met, Trp, or Phe
  misc_feature (10)..(10): Xaa can be , or Arg
LXPLQSPQSX

SEQ ID NO: 94891 - protein, 9 aa, Artificial Sequence
  Description of Artificial Sequence: Synthetic peptide
  Seed: MGDKDMPTA (MAGC1_HUMAN)
  misc_feature (2)..(2): Xaa can be Ala, Leu, Gly, Ile, Thr, Met, Ser, Val, Phe, Tyr, Trp, Cys, Gln, Asn, Pro, Asp, His, Glu, Lys, or Arg
  misc_feature (9)..(9): Xaa can be Met, Leu, Ile, Val, Phe, Cys, Tyr, Ala, Trp, Thr, Gln, Pro, Ser, or Lys
MXDKDMPTX

SEQ ID NO: 94892 - protein, 11 aa, Artificial Sequence
  Description of Artificial Sequence: Synthetic peptide
  Seed: MGDKDMPTAGM (MAGC1_HUMAN)
  misc_feature (2)..(2): Xaa can be Ala, Val, Thr, Ile, Ser, Gly, Leu, Cys, Met, Phe, Pro, Tyr, Trp, Gln, or Asn
  misc_feature (11)..(11): Xaa can be Phe, Met, Leu, Ile, Val, Tyr, Trp, or Cys
MXDKDMPTAGX

SEQ ID NO: 94893 - protein, 9 aa, Artificial Sequence
  Description of Artificial Sequence: Synthetic peptide
  Seed: MHSQSPLQS (MAGC1_HUMAN)
  misc_feature (2)..(2): Xaa can be His, Arg, Gln, Pro, Glu, or Lys
  misc_feature (9)..(9): Xaa can be Ala, Leu, Val, Met, Ile, Cys, Thr, Pro, Phe, Ser, or Gly
MXSQSPLQX

SEQ ID NO: 94894 - protein, 10 aa, Artificial Sequence
  Description of Artificial Sequence: Synthetic peptide
  Seed: MHSQSPLQSP (MAGC1_HUMAN)
  misc_feature (2)..(2): Xaa can be His, Arg, or Gln
  misc_feature (10)..(10): Xaa can be Val, Cys, Leu, Ala, Ile, Phe, Met, Thr, Pro, Ser, or Gly
MXSQSPLQSX

SEQ ID NO: 94895 - protein, 8 aa, Artificial Sequence
  Description of Artificial Sequence: Synthetic peptide
  Seed: MLKNTVPI (MAGC1_HUMAN)
  misc_feature (2)..(2): Xaa can be Leu, Met, Pro, Ile, Trp, Phe, Ala, Val, Tyr, or Arg
  misc_feature (8)..(8): Xaa can be Leu, Val, Met, Phe, Ile, or Ala
MXKNTVPX

SEQ ID NO: 94896 - protein, 9 aa, Artificial Sequence
  Description of Artificial Sequence: Synthetic peptide
  Seed: MLKNTVPIT (MAGC1_HUMAN)
  misc_feature (2)..(2): Xaa can be Leu, Met, Gln, Ile, Val, or Thr
  misc_feature (9)..(9): Xaa can be Val, Ile, Leu, Ala, Cys, Ser, Thr, or Met
MXKNTVPIX

SEQ ID NO: 94897 - protein, 10 aa, Artificial Sequence
  Description of Artificial Sequence: Synthetic peptide
  Seed: MLKNTVPITF (MAGC1_HUMAN)
  misc_feature (2)..(2): Xaa can be Ala, Arg, Ser, Gln, Thr, Gly, Val, Tyr, Met, Trp, Asn, Phe, Ile, Leu, Lys, Glu, Pro, Cys, Asp, or His
  misc_feature (10)..(10): Xaa can be Tyr, Leu, Trp, Phe, Met, Ile, Val, His, Lys, Cys, Ala, Arg, or Gln
MXKNTVPITX

SEQ ID NO: 94898 - protein, 8 aa, Artificial Sequence
  Description of Artificial Sequence: Synthetic peptide
  Seed: MLTNVISR (MAGC1_HUMAN)
  misc_feature (2)..(2): Xaa can be Phe, Leu, Met, Tyr, Trp, Thr, Ser, or Val
  misc_feature (8)..(8): Xaa can be , or Arg
MXTNVISX

SEQ ID NO: 94899 - protein, 9 aa, Artificial Sequence
  Description of Artificial Sequence: Synthetic peptide
  Seed: MLTNVISRY (MAGC1_HUMAN)
  misc_feature (2)..(2): Xaa can be Pro, Ala, Val, Thr, Met, Gln, Leu, Ile, Gly, Ser, Tyr, Asn, Phe, Glu, Cys, Lys, His, Trp, Asp, or Arg
  misc_feature (9)..(9): Xaa can be Tyr, Phe, Leu, Met, Lys, Arg, Trp, Ile, Val, His, Ala, Cys, Thr, Gln, Ser, or Gly
MXTNVISRX

SEQ ID NO: 94900 - protein, 10 aa, Artificial Sequence
  Description of Artificial Sequence: Synthetic peptide
  Seed: MLTNVISRYT (MAGC1_HUMAN)
  misc_feature (2)..(2): Xaa can be Met, Leu, Ile, Gln, Val, Thr, Ala, Ser, Phe, or Gly
  misc_feature (10)..(10): Xaa can be Val, Leu, Ile, Ala, Met, Thr, Pro, Cys, Ser, Phe, or Gly
MXTNVISRYX

SEQ ID NO: 94901 - protein, 8 aa, Artificial Sequence
  Description of Artificial Sequence: Synthetic peptide
  Seed: MPSLLQSS (MAGC1_HUMAN)
  misc_feature (2)..(2): Xaa can be , or Pro
  misc_feature (8)..(8): Xaa can be Tyr, Ala, Pro, Gly, Leu, Val, Ser, Met, Cys, Ile, Phe, or Thr
MXSLLQSX

SEQ ID NO: 94902 - protein, 9 aa, Artificial Sequence
  Description of Artificial Sequence: Synthetic peptide
  Seed: MPSLLQSSS (MAGC1_HUMAN)
  misc_feature (2)..(2): Xaa can be Pro, Ala, Val, Met, Thr, Ser, Gly, Ile, Leu, Cys, Gln, Phe, Tyr, Glu, Asn, or His
  misc_feature (9)..(9): Xaa can be Tyr, Phe, Met, Leu, Ala, Trp, Ile, His, Val, Cys, Gly, Ser, Gln, Thr, Asp, Arg, Pro, Glu, Asn, or Lys
MXSLLQSSX

SEQ ID NO: 94903 - protein, 11 aa, Artificial Sequence
  Description of Artificial Sequence: Synthetic peptide
  Seed: MPSLLQSSSES (MAGC1_HUMAN)
  misc_feature (2)..(2): Xaa can be , or Pro
  misc_feature (11)..(11): Xaa can be Pro, Ala, Ile, Met, Leu, Phe, Cys, Thr, Gly, Ser, Tyr, or Val
MXSLLQSSSEX

SEQ ID NO: 94904 - protein, 8 aa, Artificial Sequence
  Description of Artificial Sequence: Synthetic peptide
  Seed: MPTAGMPS (MAGC1_HUMAN)
  misc_feature (2)..(2): Xaa can be , or Pro
  misc_feature (8)..(8): Xaa can be Phe, Cys, Leu, Pro, Met, Ala, Ile, Thr, Val, Tyr, Gly, or Ser
MXTAGMPX

SEQ ID NO: 94905 - protein, 9 aa, Artificial Sequence
  Description of Artificial Sequence: Synthetic peptide
  Seed: MPTAGMPSL (MAGC1_HUMAN)
  misc_feature (2)..(2): Xaa can be Pro, Arg, His, Ala, Gln, Ser, Val, Gly, Thr, Ile, Glu, Lys, Asn, Met, Leu, Asp, Cys, Phe, Tyr, or Trp
  misc_feature (9)..(9): Xaa can be Tyr, Leu, Met, Phe, Ile, Val, Trp, Ala, His, Cys, Lys, Arg, Thr, Pro, Ser, Gln, Gly, Asn, Glu, or Asp
MXTAGMPSX

SEQ ID NO: 94906 - protein, 10 aa, Artificial Sequence
  Description of Artificial Sequence: Synthetic peptide
  Seed: MPTAGMPSLL (MAGC1_HUMAN)
  misc_feature (2)..(2): Xaa can be Met, Leu, Pro, Arg, Ser, Cys, Glu, Tyr, Asp, Thr, Ala, Asn, Ile, His, Val, Gly, Trp, Lys, Phe, or Gln
  misc_feature (10)..(10): Xaa can be Val, Leu, Phe, Thr, Trp, Tyr, Met, Ala, Ile, Arg, Lys, His, Asp, Glu, Gln, Asn, Ser, Gly, Cys, or Pro
MXTAGMPSLX

SEQ ID NO: 94907 - protein, 10 aa, Artificial Sequence
  Description of Artificial Sequence: Synthetic peptide
  Seed: MSPLYFPQSP (MAGC1_HUMAN)
  misc_feature (2)..(2): Xaa can be His, Met, Arg, Tyr, Phe, Gly, Glu, Gln, Pro, Ile, Thr, Asn, Leu, Ala, Lys, Ser, Cys, Val, Trp, or Asp
  misc_feature (10)..(10): Xaa can be Val, Thr, Ser, Pro, Ile, Cys, or Ala
MXPLYFPQSX

SEQ ID NO: 94908 - protein, 11 aa, Artificial Sequence
  Description of Artificial Sequence: Synthetic peptide
  Seed: MSPLYFPQSPL (MAGC1_HUMAN)
  misc_feature (2)..(2): Xaa can be Met, Thr, Ala, Ser, Pro, Val, Tyr, Ile, Gly, Arg, Lys, Phe, Leu, His, Trp, Asp, Cys, Gln, Glu, or Asn
  misc_feature (11)..(11): Xaa can be Trp, Ala, Leu, Val, Ile, Met, Phe, Tyr, or Thr
MXPLYFPQSPX

SEQ ID NO: 94909 - protein, 8 aa, Artificial Sequence
  Description of Artificial Sequence: Synthetic peptide
  Seed: MSQNRLLI (MAGC1_HUMAN)
  misc_feature (2)..(2): Xaa can be Thr, Ala, Ser, Val, Phe, Gly, or Ile
  misc_feature (8)..(8): Xaa can be Leu, Phe, Tyr, Met, Val, or Ile
MXQNRLLX

SEQ ID NO: 94910 - protein, 9 aa, Artificial Sequence
  Description of Artificial Sequence: Synthetic peptide
  Seed: MSQNRLLIL (MAGC1_HUMAN)
  misc_feature (2)..(2): Xaa can be Pro, Gln, Arg, Met, Glu, Ser, Thr, Ala, Gly, Leu, Lys, Phe, Ile, Val, Tyr, His, Asp, Asn, Trp, or Cys
  misc_feature (9)..(9): Xaa can be Tyr, Phe, Met, Ile, Val, Leu, Trp, Lys, Ala, Cys, His, Arg, Thr, Ser, Gly, Gln, or Pro
MXQNRLLIX

SEQ ID NO: 94911 - protein, 10 aa, Artificial Sequence
  Description of Artificial Sequence: Synthetic peptide
  Seed: MSQNRLLILI (MAGC1_HUMAN)
  misc_feature (2)..(2): Xaa can be Arg, Gln, Ser, Leu, Met, Asn, Val, Thr, Glu, Gly, Ala, Lys, Tyr, Pro, Ile, His, Phe, Asp, Cys, or Trp
  misc_feature (10)..(10): Xaa can be Phe, Met, Leu, Val, Ile, Trp, Ala, Lys, Tyr, Thr, Ser, Arg, His, or Gly
MXQNRLLILX

SEQ ID NO: 94912 - protein, 11 aa, Artificial Sequence
  Description of Artificial Sequence: Synthetic peptide
  Seed: MSQNRLLILIL (MAGC1_HUMAN)
  misc_feature (2)..(2): Xaa can be Ser, Thr, or Ala
  misc_feature (11)..(11): Xaa can be Tyr, Phe, Trp, Met, or Leu
MXQNRLLILIX

SEQ ID NO: 94913 - protein, 9 aa, Artificial Sequence
  Description of Artificial Sequence: Synthetic peptide
  Seed: MTSSFSSTL (MAGC1_HUMAN)
  misc_feature (2)..(2): Xaa can be Met, Gln, Pro, Ala, Thr, Leu, Tyr, Ser, Lys, Val, Phe, Ile, Arg, Trp, Asn, Gly, Glu, Cys, Asp, or His
  misc_feature (9)..(9): Xaa can be Val, Met, Phe, Leu, Ile, Tyr, Trp, Arg, His, Ala, Lys, Cys, Thr, Ser, Gly, Gln, Asn, Pro, Glu, or Asp
MXSSFSSTX

SEQ ID NO: 94914 - protein, 10 aa, Artificial Sequence
  Description of Artificial Sequence: Synthetic peptide
  Seed: MTSSFSSTLL (MAGC1_HUMAN)
  misc_feature (2)..(2): Xaa can be Gln, Leu, Thr, Ile, Met, Val, Ser, Ala, Gly, Asp, Arg, Lys, Pro, Trp, Tyr, Phe, Glu, Asn, His, or Cys
  misc_feature (10)..(10): Xaa can be Tyr, Leu, Ile, Ala, Trp, Met, Phe, Val, Arg, Lys, Gly, His, Asn, Thr, Cys, Asp, Pro, Ser, Gln, or Glu
MXSSFSSTLX

SEQ ID NO: 94915 - protein, 9 aa, Artificial Sequence
  Description of Artificial Sequence: Synthetic peptide
  Seed: NPASSFFSS (MAGC1_HUMAN)
  misc_feature (2)..(2): Xaa can be Pro, Ala, Thr, Ser, Val, Leu, Ile, Met, Gln, Gly, Cys, Phe, His, Tyr, or Asn
  misc_feature (9)..(9): Xaa can be Tyr, Phe, Met, Leu, Ala, His, Trp, Ile, Val, Ser, Gln, Cys, Thr, Pro, or Gly
NXASSFFSX

SEQ ID NO: 94916 - protein, 10 aa, Artificial Sequence
  Description of Artificial Sequence: Synthetic peptide
  Seed: NPASSFFSSA (MAGC1_HUMAN)
  misc_feature (2)..(2): Xaa can be Pro, Thr, Val, Ser, Ile, Ala, Asn, Gly, Cys, Arg, Leu, Trp, Met, Tyr, Phe, Glu, Lys, His, Gln, or Asp
  misc_feature (10)..(10): Xaa can be Val, Leu, Ala, Ile, Met, Thr, Cys, Ser, Phe, Gly, Tyr, or Pro
NXASSFFSSX

SEQ ID NO: 94917 - protein, 11 aa, Artificial Sequence
  Description of Artificial Sequence: Synthetic peptide
  Seed: NPASSFFSSAL (MAGC1_HUMAN)
  misc_feature (2)..(2): Xaa can be Pro, Ala, Met, Ile, Tyr, Val, or Phe
  misc_feature (11)..(11): Xaa can be Tyr, Phe, Met, Cys, Ala, Val, Thr, Ser, Ile, Leu, Pro, Trp, or Gly
NXASSFFSSAX

SEQ ID NO: 94918 - protein, 8 aa, Artificial Sequence
  Description of Artificial Sequence: Synthetic peptide
  Seed: NRLLILIL (MAGC1_HUMAN)
  misc_feature (2)..(2): Xaa can be His, Arg, or Gln
  misc_feature (8)..(8): Xaa can be Val, Leu, Ile, Ala, Met, Phe, Cys, Pro, Ser, Gly, Thr, or Tyr
NXLLILIX

SEQ ID NO: 94919 - protein, 9 aa, Artificial Sequence
  Description of Artificial Sequence: Synthetic peptide
  Seed: NRLLILILS (MAGC1_HUMAN)
  misc_feature (2)..(2): Xaa can be Arg, His, or Gln
  misc_feature (9)..(9): Xaa can be Ala, Leu, Thr, Ile, Met, Phe, Val, Gly, Pro, Cys, or Ser
NXLLILILX

SEQ ID NO: 94920 - protein, 10 aa, Artificial Sequence
  Description of Artificial Sequence: Synthetic peptide
  Seed: NRLLILILSI (MAGC1_HUMAN)
  misc_feature (2)..(2): Xaa can be Arg, Met, Leu, Phe, Tyr, Asp, Ser, Gly, Asn, Trp, Cys, Glu, Ile, Gln, Val, His, Ala, Lys, Pro, or Thr
  misc_feature (10)..(10): Xaa can be Ile, Leu, Val, Ala, Trp, Tyr, Arg, Met, Phe, Lys, or His
NXLLILILSX

SEQ ID NO: 94921 - protein, 9 aa, Artificial Sequence
  Description of Artificial Sequence: Synthetic peptide
  Seed: NSQSSPEGK (MAGC1_HUMAN)
  misc_feature (2)..(2): Xaa can be Ala, Thr, Val, Ser, Ile, Phe, Met, Gln, Gly, Asn, Leu, Asp, Glu, or Pro
  misc_feature (9)..(9): Xaa can be Lys, Tyr, Arg, Phe, Met, Leu, or His
NXQSSPEGX

SEQ ID NO: 94922 - protein, 9 aa, Artificial Sequence
  Description of Artificial Sequence: Synthetic peptide
  Seed: NSSPPRYEF (MAGC1_HUMAN)
  misc_feature (2)..(2): Xaa can be Ala, Arg, Ser, Tyr, Gln, Ile, Val, Pro, Met, Phe, Thr, Gly, Leu, Asp, His, Trp, Glu, Lys, Cys, or Asn
  misc_feature (9)..(9): Xaa can be Tyr, Met, Val, Trp, Phe, Leu, Ile, His, Lys, Ala, Cys, Arg, Thr, Ser, or Gln
NXSPPRYEX

SEQ ID NO: 94923 - protein, 10 aa, Artificial Sequence
  Description of Artificial Sequence: Synthetic peptide
  Seed: NSSPPRYEFL (MAGC1_HUMAN)
  misc_feature (2)..(2): Xaa can be Thr, Ser, Val, Met, Ala, Ile, Leu, Gly, Cys, Gln, Asp, Pro, Trp, Glu, Phe, or Asn
  misc_feature (10)..(10): Xaa can be Trp, Tyr, Phe, Ile, Val, Leu, Met, or Ala
NXSPPRYEFX

SEQ ID NO: 94924 - protein, 11 aa, Artificial Sequence
  Description of Artificial Sequence: Synthetic peptide
  Seed: NSSPPRYEFLW (MAGC1_HUMAN)
  misc_feature (2)..(2): Xaa can be Ser, Thr, Cys, Val, Met, Ile, Ala, Gly, Pro, Asp, Trp, Asn, Phe, Arg, Gln, Glu, or Leu
  misc_feature (11)..(11): Xaa can be Trp, Phe, Tyr, Ile, Met, or Leu
NXSPPRYEFLX

SEQ ID NO: 94925 - protein, 8 aa, Artificial Sequence
  Description of Artificial Sequence: Synthetic peptide
  Seed: NTHSPLQI (MAGC1_HUMAN)
  misc_feature (2)..(2): Xaa can be Ala, Val, Ser, Thr, Ile, Gly, Phe, Met, Leu, or Asn
  misc_feature (8)..(8): Xaa can be Leu, Tyr, Phe, Met, Lys, Ile, Val, Arg, or Trp
NXHSPLQX

SEQ ID NO: 94926 - protein, 9 aa, Artificial Sequence
  Description of Artificial Sequence: Synthetic peptide
  Seed: NTHSPLQIV (MAGC1_HUMAN)
  misc_feature (2)..(2): Xaa can be Ala, Gln, Ser, Ile, Thr, Val, Leu, Pro, Gly, Asn, Arg, Met, Asp, Glu, Phe, Tyr, Cys, Lys, His, or Trp
  misc_feature (9)..(9): Xaa can be Met, Leu, Val, Tyr, Phe, Ile, Lys, Ala, His, Arg, Trp, Cys, Thr, Ser, or Gln
NXHSPLQIX

SEQ ID NO: 94927 - protein, 11 aa, Artificial Sequence
  Description of Artificial Sequence: Synthetic peptide
  Seed: NTLDLTSEGCL (MAGC1_HUMAN)
  misc_feature (2)..(2): Xaa can be Ser, Thr, Val, Cys, Ala, Gly, Tyr, Glu, Asn, Phe, Trp, Ile, Gln, Leu, Pro, or Met
  misc_feature (11)..(11): Xaa can be Trp, Phe, Tyr, or Leu
NXLDLTSEGCX

SEQ ID NO: 94928 - protein, 9 aa, Artificial Sequence
  Description of Artificial Sequence: Synthetic peptide
  Seed: NTVPITFPS (MAGC1_HUMAN)
  misc_feature (2)..(2): Xaa can be Thr, Ser, Val, Ile, Ala, Met, Leu, Gln, Asn, Gly, Phe, Cys, Pro, Tyr, Asp, Trp, Glu, His, or Lys
  misc_feature (9)..(9): Xaa can be Arg, Lys, Val, Ile, Ala, Leu, Met, Tyr, Thr, Ser, Cys, Phe, Pro, Gly, His, Glu, Gln, Trp, Asn, or Asp
NXVPITFPX

SEQ ID NO: 94929 - protein, 10 aa, Artificial Sequence
  Description of Artificial Sequence: Synthetic peptide
  Seed: NTVPITFPSS (MAGC1_HUMAN)
  misc_feature (2)..(2): Xaa can be Thr, Val, Ala, Ser, Ile, Leu, Met, Gln, Asn, Phe, Gly, Cys, Lys, Glu, Arg, Tyr, His, Pro, Asp, or Trp
  misc_feature (10)..(10): Xaa can be Val, Ile, Ala, Leu, Thr, Met, Ser, Cys, or Phe
NXVPITFPSX

SEQ ID NO: 94930 - protein, 11 aa, Artificial Sequence
  Description of Artificial Sequence: Synthetic peptide
  Seed: NTVPITFPSSY (MAGC1_HUMAN)
  misc_feature (2)..(2): Xaa can be Ser, Thr, Ala, Val, Pro, Met, Gln, Phe, Ile, Glu, Cys, Gly, Leu, Asn, Tyr, Asp, Trp, His, Lys, or Arg
  misc_feature (11)..(11): Xaa can be Tyr, Arg, Trp, Lys, Phe, Met, Leu, His, or Ile
NXVPITFPSSX

SEQ ID NO: 94931 - protein, 9 aa, Artificial Sequence
  Description of Artificial Sequence: Synthetic peptide
  Seed: NVISRYTGY (MAGC1_HUMAN)
  misc_feature (2)..(2): Xaa can be Thr, Val, Ala, Ser, Gln, Leu, Met, Ile, Pro, Glu, Gly, Phe, Cys, Tyr, Asn, Asp, Lys, Trp, His, or Arg
  misc_feature (9)..(9): Xaa can be Tyr, Phe, Arg, Lys, Leu, Met, Trp, His, Val, Ile, or Ala
NXISRYTGX

SEQ ID NO: 94932 - protein, 10 aa, Artificial Sequence
  Description of Artificial Sequence: Synthetic peptide
  Seed: NVISRYTGYF (MAGC1_HUMAN)
  misc_feature (2)..(2): Xaa can be Val, Thr, Ile, Ala, Leu, Met, Ser, or Gln
  misc_feature (10)..(10): Xaa can be Tyr, Arg, Lys, Phe, Met, Trp, Val, Leu, or Ala
NXISRYTGYX

SEQ ID NO: 94933 - protein, 9 aa, Artificial Sequence
  Description of Artificial Sequence: Synthetic peptide
  Seed: PASSFFSSA (MAGC1_HUMAN)
  misc_feature (2)..(2): Xaa can be Pro, or Ala
  misc_feature (9)..(9): Xaa can be Ala, Met, Leu, Pro, Ile, or Val
PXSSFFSSX

SEQ ID NO: 94934 - protein, 10 aa, Artificial Sequence
  Description of Artificial Sequence: Synthetic peptide
  Seed: PEGDDTQSPL (MAGC1_HUMAN)
  misc_feature (2)..(2): Xaa can be , or Glu
  misc_feature (10)..(10): Xaa can be Val, Ile, Ala, or Leu
PXGDDTQSPX

SEQ ID NO: 94935 - protein, 9 aa, Artificial Sequence
  Description of Artificial Sequence: Synthetic peptide
  Seed: PEGEDSLSP (MAGC1_HUMAN)
  misc_feature (2)..(2): Xaa can be , or Glu
  misc_feature (9)..(9): Xaa can be Val, Leu, Pro, Met, Ile, or Ala
PXGEDSLSX

SEQ ID NO: 94936 - protein, 9 aa, Artificial Sequence
  Description of Artificial Sequence: Synthetic peptide
  Seed: PEGEDVQSP (MAGC1_HUMAN)
  misc_feature (2)..(2): Xaa can be , or Glu
  misc_feature (9)..(9): Xaa can be Ala, Leu, Pro, Val, Met, Ile, or Cys
PXGEDVQSX

SEQ ID NO: 94937 - protein, 10 aa, Artificial Sequence
  Description of Artificial Sequence: Synthetic peptide
  Seed: PEGEDVQSPL (MAGC1_HUMAN)
  misc_feature (2)..(2): Xaa can be , or Glu
  misc_feature (10)..(10): Xaa can be Ala, Ile, Val, or Leu
PXGEDVQSPX

SEQ ID NO: 94938 - protein, 9 aa, Artificial Sequence
  Description of Artificial Sequence: Synthetic peptide
  Seed: PEGENTHSP (MAGC1_HUMAN)
  misc_feature (2)..(2): Xaa can be , or Glu
  misc_feature (9)..(9): Xaa can be Val, Ile, Leu, Pro, Ala, Met, Cys, or Thr
PXGENTHSX

SEQ ID NO: 94939 - protein, 9 aa, Artificial Sequence
  Description of Artificial Sequence: Synthetic peptide
  Seed: PEGMHSQSP (MAGC1_HUMAN)
  misc_feature (2)..(2): Xaa can be , or Glu
  misc_feature (9)..(9): Xaa can be Leu, Pro, Ile, Val, or Ala
PXGMHSQSX

SEQ ID NO: 94940 - protein, 9 aa, Artificial Sequence
  Description of Artificial Sequence: Synthetic peptide
  Seed: PEGPAQSPL (MAGC1_HUMAN)
  misc_feature (2)..(2): Xaa can be , or Glu
  misc_feature (9)..(9): Xaa can be Met, Ala, Pro, Ile, Val, or Leu
PXGPAQSPX

SEQ ID NO: 94941 - protein, 9 aa, Artificial Sequence
  Description of Artificial Sequence: Synthetic peptide
  Seed: PEGPVQSPL (MAGC1_HUMAN)
  misc_feature (2)..(2): Xaa can be , or Glu
  misc_feature (9)..(9): Xaa can be Phe, Leu, Pro, Ile, Ala, Cys, Val, or Met
PXGPVQSPX

SEQ ID NO: 94942 - protein, 11 aa, Artificial Sequence
  Description of Artificial Sequence: Synthetic peptide
  Seed: PESAPEGEDSL (MAGC1_HUMAN)
  misc_feature (2)..(2): Xaa can be , or Glu
  misc_feature (11)..(11): Xaa can be Val, Met, Ile, Leu, Cys, Phe, or Ala
PXSAPEGEDSX

SEQ ID NO: 94943 - protein, 11 aa, Artificial Sequence
  Description of Artificial Sequence: Synthetic peptide
  Seed: PESAQSAFEGF (MAGC1_HUMAN)
  misc_feature (2)..(2): Xaa can be , or Glu
  misc_feature (11)..(11): Xaa can be Phe, Trp, or Tyr
PXSAQSAFEGX

SEQ ID NO: 94944 - protein, 11 aa, Artificial Sequence
  Description of Artificial Sequence: Synthetic peptide
  Seed: PESAQSTFEGF (MAGC1_HUMAN)
  misc_feature (2)..(2): Xaa can be , or Glu
  misc_feature (11)..(11): Xaa can be Trp, Phe, or Tyr
PXSAQSTFEGX

SEQ ID NO: 94945 - protein, 9 aa, Artificial Sequence
  Description of Artificial Sequence: Synthetic peptide
  Seed: PESDDTLYP (MAGC1_HUMAN)
  misc_feature (2)..(2): Xaa can be , or Glu
  misc_feature (9)..(9): Xaa can be Met, Ile, Leu, Ala, Val, or Pro
PXSDDTLYX

SEQ ID NO: 94946 - protein, 10 aa, Artificial Sequence
  Description of Artificial Sequence: Synthetic peptide
  Seed: PESDDTLYPL (MAGC1_HUMAN)
  misc_feature (2)..(2): Xaa can be , or Glu
  misc_feature (10)..(10): Xaa can be Val, Ala, Ile, Met, Cys, or Leu
PXSDDTLYPX

SEQ ID NO: 94947 - protein, 9 aa, Artificial Sequence
  Description of Artificial Sequence: Synthetic peptide
  Seed: PESPLQSPV (MAGC1_HUMAN)
  misc_feature (2)..(2): Xaa can be , or Glu
  misc_feature (9)..(9): Xaa can be Leu, Val, Met, Cys, Pro, Ala, Phe, Ile, or Thr
PXSPLQSPX

SEQ ID NO: 94948 - protein, 10 aa, Artificial Sequence
  Description of Artificial Sequence: Synthetic peptide
  Seed: PESPLQSPVI (MAGC1_HUMAN)
  misc_feature (2)..(2): Xaa can be , or Glu
  misc_feature (10)..(10): Xaa can be Val, Met, Ile, Cys, Leu, Pro, Thr, or Ala
PXSPLQSPVX

SEQ ID NO: 94949 - protein, 11 aa, Artificial Sequence
  Description of Artificial Sequence: Synthetic peptide
  Seed: PESTQSPFEGF (MAGC1_HUMAN)
  misc_feature (2)..(2): Xaa can be , or Glu
  misc_feature (11)..(11): Xaa can be Trp, Phe, or Tyr
PXSTQSPFEGX

SEQ ID NO: 94950 - protein, 9 aa, Artificial Sequence
  Description of Artificial Sequence: Synthetic peptide
  Seed: PEWEDSLSP (MAGC1_HUMAN)
  misc_feature (2)..(2): Xaa can be , or Glu
  misc_feature (9)..(9): Xaa can be Leu, Ile, Met, Thr, Ala, Ser, Pro, Val, or Cys
PXWEDSLSX

SEQ ID NO: 94951 - protein, 11 aa, Artificial Sequence
  Description of Artificial Sequence: Synthetic peptide
  Seed: PEWEDSLSPHY (MAGC1_HUMAN)
  misc_feature (2)..(2): Xaa can be Glu, or Gln
  misc_feature (11)..(11): Xaa can be Trp, Tyr, or Phe
PXWEDSLSPHX

SEQ ID NO: 94952 - protein, 10 aa, Artificial Sequence
  Description of Artificial Sequence: Synthetic peptide
  Seed: PEWEDSLSPL (MAGC1_HUMAN)
  misc_feature (2)..(2): Xaa can be , or Glu
  misc_feature (10)..(10): Xaa can be Cys, Met, Leu, Ala, Val, or Ile
PXWEDSLSPX

SEQ ID NO: 94953 - protein, 9 aa, Artificial Sequence
  Description of Artificial Sequence: Synthetic peptide
  Seed: PFEGFPQSV (MAGC1_HUMAN)
  misc_feature (2)..(2): Xaa can be Phe, Trp, Tyr, Arg, Leu, Met, Ala, Gln, Ile, His, Ser, or Val
  misc_feature (9)..(9): Xaa can be Leu, Met, Ile, Phe, or Val
PXEGFPQSX

SEQ ID NO: 94954 - protein, 9 aa, Artificial Sequence
  Description of Artificial Sequence: Synthetic peptide
  Seed: PITFPSSYK (MAGC1_HUMAN)
  misc_feature (2)..(2): Xaa can be Ser, Val, Met, Leu, Ile, Ala, Thr, Gly, Asn, or Gln
  misc_feature (9)..(9): Xaa can be Lys, or Arg
PXTFPSSYX

SEQ ID NO: 94955 - protein, 10 aa, Artificial Sequence
  Description of Artificial Sequence: Synthetic peptide
  Seed: PLFTYTLDEK (MAGC1_HUMAN)
  misc_feature (2)..(2): Xaa can be Ile, Leu, or Met
  misc_feature (10)..(10): Xaa can be , or Lys
PXFTYTLDEX

SEQ ID NO: 94956 - protein, 10 aa, Artificial Sequence
  Description of Artificial Sequence: Synthetic peptide
  Seed: PLQIPGSPSF (MAGC1_HUMAN)
  misc_feature (2)..(2): Xaa can be Arg, Phe, Met, Tyr, Ile, Ser, Leu, Lys, Val, Trp, Ala, His, Asn, Thr, Cys, Gly, Gln, Glu, Asp, or Pro
  misc_feature (10)..(10): Xaa can be Tyr, Phe, Met, Leu, Ile, Trp, or His
PXQIPGSPSX

SEQ ID NO: 94957 - protein, 10 aa, Artificial Sequence
  Description of Artificial Sequence: Synthetic peptide
  Seed: PLQIPMTSSF (MAGC1_HUMAN)
  misc_feature (2)..(2): Xaa can be Arg, Met, Tyr, Trp, Leu, Phe, Ile, Ala, Val, Lys, His, Ser, Gln, Gly, Cys, Asn, Thr, Glu, Pro, or Asp
  misc_feature (10)..(10): Xaa can be Phe, Tyr, Trp, Met, Leu, Ile, or His
PXQIPMTSSX

SEQ ID NO: 94958 - protein, 10 aa, Artificial Sequence
  Description of Artificial Sequence: Synthetic peptide
  Seed: PLQIPVSRSF (MAGC1_HUMAN)
  misc_feature (2)..(2): Xaa can be Ser, Trp, Lys, Tyr, Arg, Met, Phe, Leu, Gly, Gln, Ala, His, Thr, Cys, Ile, Val, Asn, Glu, Pro, or Asp
  misc_feature (10)..(10): Xaa can be Tyr, Phe, Met, or Leu
PXQIPVSRSX

SEQ ID NO: 94959 - protein, 10 aa, Artificial Sequence
  Description of Artificial Sequence: Synthetic peptide
  Seed: PLQIPVSSSF (MAGC1_HUMAN)
  misc_feature (2)..(2): Xaa can be Arg, Met, Phe, Tyr, Ile, Val, Ser, Ala, Thr, Cys, Leu, His, Lys, Trp, Gln, Gly, Asn, Glu, Pro, or Asp
  misc_feature (10)..(10): Xaa can be Phe, Tyr, Trp, Met, Leu, Ile, His, or Val
PXQIPVSSSX

SEQ ID NO: 94960 - protein, 9 aa, Artificial Sequence
  Description of Artificial Sequence: Synthetic peptide
  Seed: PLQNPASSF (MAGC1_HUMAN)
  misc_feature (2)..(2): Xaa can be Val, Ala, Ile, Leu, Met, Gln, Pro, Gly, Thr, Ser, Phe, Glu, Trp, Asn, or Tyr
  misc_feature (9)..(9): Xaa can be Tyr, Phe, or Met
PXQNPASSX

SEQ ID NO: 94961 - protein, 10 aa, Artificial Sequence
  Description of Artificial Sequence: Synthetic peptide
  Seed: PLQNPASSFF (MAGC1_HUMAN)
  misc_feature (2)..(2): Xaa can be Met, Tyr, Arg, Phe, Leu, Ser, His, Ile, Lys, Thr, Val, Trp, Ala, Gln, Asn, Gly, or Cys
  misc_feature (10)..(10): Xaa can be Phe, Tyr, Met, or Leu
PXQNPASSFX

SEQ ID NO: 94962 - protein, 9 aa, Artificial Sequence
  Description of Artificial Sequence: Synthetic peptide
  Seed: PLQRPVSSF (MAGC1_HUMAN)
  misc_feature (2)..(2): Xaa can be Met, Gln, Val, Ala, Leu, Ile, Thr, Phe, Gly, Pro, Ser, Glu, Tyr, or Asn
  misc_feature (9)..(9): Xaa can be Tyr, Phe, or Met
PXQRPVSSX

SEQ ID NO: 94963 - protein, 10 aa, Artificial Sequence
  Description of Artificial Sequence: Synthetic peptide
  Seed: PLQRPVSSFF (MAGC1_HUMAN)
  misc_feature (2)..(2): Xaa can be Met, His, Tyr, Lys, Val, Ile, Phe, Leu, Arg, Trp, Ser, Ala, Cys, Gly, Thr, Gln, Asn, Asp, Pro, or Glu
  misc_feature (10)..(10): Xaa can be Tyr, Phe, Trp, Met, or Leu
PXQRPVSSFX

SEQ ID NO: 94964 - protein, 9 aa, Artificial Sequence
  Description of Artificial Sequence: Synthetic peptide
  Seed: PLQSPVISF (MAGC1_HUMAN)
  misc_feature (2)..(2): Xaa can be Tyr, Ala, Trp, Phe, Ser, Met, Val, Gln, Leu, Ile, Thr, Pro, Asn, Glu, Gly, Cys, Arg, Lys, His, or Asp
  misc_feature (9)..(9): Xaa can be Tyr, Phe, Met, Leu, Ile, Trp, Val, or His
PXQSPVISX

SEQ ID NO: 94965 - protein, 9 aa, Artificial Sequence
  Description of Artificial Sequence: Synthetic peptide
  Seed: PLQSPVSSF (MAGC1_HUMAN)
  misc_feature (2)..(2): Xaa can be Ala, Val, Met, Thr, Ser, Ile, Gln, Leu, Asn, Tyr, Gly, Arg, Phe, Glu, Pro, His, Asp, Cys, Trp, or Lys
  misc_feature (9)..(9): Xaa can be Tyr, Phe, Met, Leu, His, or Val
PXQSPVSSX

SEQ ID NO: 94966 - protein, 9 aa, Artificial Sequence
  Description of Artificial Sequence: Synthetic peptide
  Seed: PLYFPQSPL (MAGC1_HUMAN)
  misc_feature (2)..(2): Xaa can be Leu, or Met
  misc_feature (9)..(9): Xaa can be Leu, or Val
PXYFPQSPX

SEQ ID NO: 94967 - protein, 10 aa, Artificial Sequence
  Description of Artificial Sequence: Synthetic peptide
  Seed: PMTSSFSSTL (MAGC1_HUMAN)
  misc_feature (2)..(2): Xaa can be Glu, Phe, Met, Tyr, His, Trp, Thr, Asn, Ser, Asp, Leu, or Gln
  misc_feature (10)..(10): Xaa can be Val, Ile, Leu, or Ala
PXTSSFSSTX

SEQ ID NO: 94968 - protein, 10 aa, Artificial Sequence
  Description of Artificial Sequence: Synthetic peptide
  Seed: PPEGPAQSPL (MAGC1_HUMAN)
  misc_feature (2)..(2): Xaa can be , or Pro
  misc_feature (10)..(10): Xaa can be Met, Leu, Phe, Ala, or Val
PXEGPAQSPX

SEQ ID NO: 94969 - protein, 10 aa, Artificial Sequence
  Description of Artificial Sequence: Synthetic peptide
  Seed: PPEGPVQSPL (MAGC1_HUMAN)
  misc_feature (2)..(2): Xaa can be , or Pro
  misc_feature (10)..(10): Xaa can be Leu, Ala, Met, Val, or Phe
PXEGPVQSPX

SEQ ID NO: 94970 - protein, 11 aa, Artificial Sequence
  Description of Artificial Sequence: Synthetic peptide
  Seed: PPQGEDFQSSL (MAGC1_HUMAN)
  misc_feature (2)..(2): Xaa can be , or Pro
  misc_feature (11)..(11): Xaa can be Met, or Leu
PXQGEDFQSSX

SEQ ID NO: 94971 - protein, 11 aa, Artificial Sequence
  Description of Artificial Sequence: Synthetic peptide
  Seed: PPQGEDSMSPL (MAGC1_HUMAN)
  misc_feature (2)..(2): Xaa can be , or Pro
  misc_feature (11)..(11): Xaa can be , or Leu
PXQGEDSMSPX

SEQ ID NO: 94972 - protein, 10 aa, Artificial Sequence
  Description of Artificial Sequence: Synthetic peptide
  Seed: PQFPPQGEDF (MAGC1_HUMAN)
  misc_feature (2)..(2): Xaa can be His, Gln, Arg, Met, Leu, Val, Ile, Thr, Ser, Ala, Glu, Pro, Gly, Tyr, Trp, Phe, Asn, or Ly s
  misc_feature (10)..(10): Xaa can be Tyr, Phe, Trp, Leu, Met, Ile, or Val
PXFPPQGEDX

SEQ ID NO: 94973 - protein, 11 aa, Artificial Sequence
  Description of Artificial Sequence: Synthetic peptide
  Seed: PQSPLEGEDSL (MAGC1_HUMAN)
  misc_feature (2)..(2): Xaa can be His, Arg, or Gln
  misc_feature (11)..(11): Xaa can be Leu, Phe, Met, Val, or Ile
PXSPLEGEDSX

SEQ ID NO: 94974 - protein, 10 aa, Artificial Sequence
  Description of Artificial Sequence: Synthetic peptide
  Seed: PQSPLQGEEF (MAGC1_HUMAN)
  misc_feature (2)..(2): Xaa can be Gln, Met, Val, Ile, Leu, Ala, Phe, Gly, Arg, Pro, Thr, Ser, or Glu
  misc_feature (10)..(10): Xaa can be Tyr, Phe, Trp, or Leu
PXSPLQGEEX

SEQ ID NO: 94975 - protein, 9 aa, Artificial Sequence
  Description of Artificial Sequence: Synthetic peptide
  Seed: PQSPLQIPV (MAGC1_HUMAN)
  misc_feature (2)..(2): Xaa can be Gln, Val, Thr, Met, Tyr, or Ser
  misc_feature (9)..(9): Xaa can be Tyr, Phe, Met, Ile, or Val
PXSPLQIPX

SEQ ID NO: 94976 - protein, 11 aa, Artificial Sequence
  Description of Artificial Sequence: Synthetic peptide
  Seed: PQSPPQGEDSL (MAGC1_HUMAN)
  misc_feature (2)..(2): Xaa can be His, Met, Gln, or Arg
  misc_feature (11)..(11): Xaa can be Leu, Phe, Trp, Ile, Met, or Val
PXSPPQGEDSX

SEQ ID NO: 94977 - protein, 11 aa, Artificial Sequence
  Description of Artificial Sequence: Synthetic peptide
  Seed: PQSSPESDDTL (MAGC1_HUMAN)
  misc_feature (2)..(2): Xaa can be His, Arg, or Gln
  misc_feature (11)..(11): Xaa can be Leu, Phe, Met, Ile, or Trp
PXSSPESDDTX

SEQ ID NO: 94978 - protein, 10 aa, Artificial Sequence
  Description of Artificial Sequence: Synthetic peptide
  Seed: PRYEFLWGPR (MAGC1_HUMAN)
  misc_feature (2)..(2): Xaa can be Ile, Leu, Met, Trp, Thr, Val, Ser, Phe, Gln, Tyr, Ala, Arg, Gly, Lys, Asn, or His
  misc_feature (10)..(10): Xaa can be Arg, or Lys
PXYEFLWGPX

SEQ ID NO: 94979 - protein, 10 aa, Artificial Sequence
  Description of Artificial Sequence: Synthetic peptide
  Seed: PSFSSTLLSL (MAGC1_HUMAN)
  misc_feature (2)..(2): Xaa can be Ser, Thr, Ala, Glu, Pro, Asn, Gln, Ile, Cys, Met, Asp, Leu, Gly, or Val
  misc_feature (10)..(10): Xaa can be Trp, Phe, Leu, Met, or Tyr
PXFSSTLLSX

SEQ ID NO: 94980 - protein, 11 aa, Artificial Sequence
  Description of Artificial Sequence: Synthetic peptide
  Seed: PSFSSTLLSLF (MAGC1_HUMAN)
  misc_feature (2)..(2): Xaa can be Ser, Ala, Thr, Gly, Gln, Ile, Met, Asn, Pro, Val, Leu, or Cys
  misc_feature (11)..(11): Xaa can be Trp, or Phe
PXFSSTLLSLX

SEQ ID NO: 94981 - protein, 10 aa, Artificial Sequence
  Description of Artificial Sequence: Synthetic peptide
  Seed: PSFSSTLVSL (MAGC1_HUMAN)
  misc_feature (2)..(2): Xaa can be Ala, or Ser
  misc_feature (10)..(10): Xaa can be , or Leu
PXFSSTLVSX

SEQ ID NO: 94982 - protein, 11 aa, Artificial Sequence
  Description of Artificial Sequence: Synthetic peptide
  Seed: PSFSSTLVSLF (MAGC1_HUMAN)
  misc_feature (2)..(2): Xaa can be Ala, Ser, Thr, Met, Gln, Cys, Val, Gly, Ile, Asn, Leu, or Pro
  misc_feature (11)..(11): Xaa can be Trp, or Phe
PXFSSTLVSLX

SEQ ID NO: 94983 - protein, 8 aa, Artificial Sequence
  Description of Artificial Sequence: Synthetic peptide
  Seed: PSSLPQSF (MAGC1_HUMAN)
  misc_feature (2)..(2): Xaa can be Thr, Ser, Ala, Ile, or Val
  misc_feature (8)..(8): Xaa can be Trp, or Phe
PXSLPQSX

SEQ ID NO: 94984 - protein, 10 aa, Artificial Sequence
  Description of Artificial Sequence: Synthetic peptide
  Seed: PSSSSTLLSL (MAGC1_HUMAN)
  misc_feature (2)..(2): Xaa can be Thr, Ala, Ser, Cys, Val, Gly, Met, Ile, Glu, Leu, Asp, Gln, Pro, or Asn
  misc_feature (10)..(10): Xaa can be Trp, Phe, or Leu
PXSSSTLLSX

SEQ ID NO: 94985 - protein, 11 aa, Artificial Sequence
  Description of Artificial Sequence: Synthetic peptide
  Seed: PSSSSTLLSLF (MAGC1_HUMAN)
  misc_feature (2)..(2): Xaa can be Tyr, Phe, Lys, Arg, Met, Ser, His, Val, Thr, Ala, Ile, Leu, Gln, Pro, Gly, Cys, Trp, Asn, or Asp
  misc_feature (11)..(11): Xaa can be Trp, Phe, or Tyr
PXSSSTLLSLX

SEQ ID NO: 94986 - protein, 8 aa, Artificial Sequence
  Description of Artificial Sequence: Synthetic peptide
  Seed: PSSTSSSL (MAGC1_HUMAN)
  misc_feature (2)..(2): Xaa can be Arg, Met, Gln, Lys, Ala, Ile, Trp, Asn, His, Tyr, Phe, Ser, Thr, Val, or Leu
  misc_feature (8)..(8): Xaa can be Leu, Met, Val, Phe, or Ile
PXSTSSSX

SEQ ID NO: 94987 - protein, 10 aa, Artificial Sequence
  Description of Artificial Sequence: Synthetic peptide
  Seed: PSSTSSSLSK (MAGC1_HUMAN)
  misc_feature (2)..(2): Xaa can be Ala, Ser, or Met
  misc_feature (10)..(10): Xaa can be , or Lys
PXSTSSSLSX

SEQ ID NO: 94988 - protein, 9 aa, Artificial Sequence
  Description of Artificial Sequence: Synthetic peptide
  Seed: PTAGMPSLL (MAGC1_HUMAN)
  misc_feature (2)..(2): Xaa can be Ala, Thr, Ser, Val, Leu, Asp, Cys, Gln, Met, Asn, Pro, Ile, or Gly
  misc_feature (9)..(9): Xaa can be Trp, Phe, Leu, Val, or Met
PXAGMPSLX

SEQ ID NO: 94989 - protein, 10 aa, Artificial Sequence
  Description of Artificial Sequence: Synthetic peptide
  Seed: PVSPSFSSTL (MAGC1_HUMAN)
  misc_feature (2)..(2): Xaa can be Tyr, Phe, Val, Ser, Met, Ile, or Trp
  misc_feature (10)..(10): Xaa can be Leu, or Met
PXSPSFSSTX

SEQ ID NO: 94990 - protein, 10 aa, Artificial Sequence
  Description of Artificial Sequence: Synthetic peptide
  Seed: PVSPSSSSTL (MAGC1_HUMAN)
  misc_feature (2)..(2): Xaa can be Met, Ala, Leu, Val, Thr, Ser, or Ile
  misc_feature (10)..(10): Xaa can be Leu, or Met
PXSPSSSSTX

SEQ ID NO: 94991 - protein, 8 aa, Artificial Sequence
  Description of Artificial Sequence: Synthetic peptide
  Seed: PVSSFFSY (MAGC1_HUMAN)
  misc_feature (2)..(2): Xaa can be Met, Phe, Val, Ile, Ala, Tyr, or Trp
  misc_feature (8)..(8): Xaa can be Tyr, Phe, or Met
PXSSFFSX

SEQ ID NO: 94992 - protein, 8 aa, Artificial Sequence
  Description of Artificial Sequence: Synthetic peptide
  Seed: PVSSSFSY (MAGC1_HUMAN)
  misc_feature (2)..(2): Xaa can be Phe, Trp, Met, Val, Ala, Tyr, or Ile
  misc_feature (8)..(8): Xaa can be Tyr, Met, or Phe
PXSSSFSX

SEQ ID NO: 94993 - protein, 10 aa, Artificial Sequence
  Description of Artificial Sequence: Synthetic peptide
  Seed: QEHYLEYREV (MAGC1_HUMAN)
  misc_feature (2)..(2): Xaa can be Glu, Gln, or Asp
  misc_feature (10)..(10): Xaa can be Tyr, Trp, Phe, Leu, Ala, Cys, Ile, Met, Val, Pro, or Thr
QXHYLEYREX

SEQ ID NO: 94994 - protein, 9 aa, Artificial Sequence
  Description of Artificial Sequence: Synthetic peptide
  Seed: QFPPQGEDF (MAGC1_HUMAN)
  misc_feature (2)..(2): Xaa can be Ala, Val, Gly, Tyr, Phe, Ile, Leu, Thr, Ser, Gln, Arg, Met, Trp, Cys, Asn, Pro, His, Glu, Lys, or Asp
  misc_feature (9)..(9): Xaa can be Leu, Tyr, Phe, Met, Ile, Val, Lys, Arg, Trp, Ala, Cys, or His
QXPPQGEDX

SEQ ID NO: 94995 - protein, 9 aa, Artificial Sequence
  Description of Artificial Sequence: Synthetic peptide
  Seed: QGEDFQSSL (MAGC1_HUMAN)
  misc_feature (2)..(2): Xaa can be His, Leu, Thr, Val, Gln, Met, Ile, Arg, Gly, Ser, Phe, Cys, Ala, Tyr, Trp, Glu, Lys, Asn, Asp, or Pro
  misc_feature (9)..(9): Xaa can be Leu, Met, Phe, Ile, or Val
QXEDFQSSX

SEQ ID NO: 94996 - protein, 10 aa, Artificial Sequence
  Description of Artificial Sequence: Synthetic peptide
  Seed: QGEDSLSPHY (MAGC1_HUMAN)
  misc_feature (2)..(2): Xaa can be Thr, Met, Ile, Val, Leu, Ser, Asn, Ala, Gly, Phe, Gln, Cys, Asp, Lys, Tyr, Trp, or Glu
  misc_feature (10)..(10): Xaa can be Tyr, Lys, Phe, Arg, Trp, or His
QXEDSLSPHX

SEQ ID NO: 94997 - protein, 11 aa, Artificial Sequence
  Description of Artificial Sequence: Synthetic peptide
  Seed: QGEDSLSPHYF (MAGC1_HUMAN)
  misc_feature (2)..(2): Xaa can be Thr, Ser, Cys, Phe, Gly, Ala, Val, Met, Ile, Tyr, Asn, Leu, Gln, Pro, or Trp
  misc_feature (11)..(11): Xaa can be Trp, Phe, or Leu
QXEDSLSPHYX

SEQ ID NO: 94998 - protein, 9 aa, Artificial Sequence
  Description of Artificial Sequence: Synthetic peptide
  Seed: QGEDSMSPL (MAGC1_HUMAN)
  misc_feature (2)..(2): Xaa can be Ala, Ser, Phe, Val, Ile, Leu, Thr, Gly, Cys, or Met
  misc_feature (9)..(9): Xaa can be Leu, Met, Phe, Ile, or Val
QXEDSMSPX

SEQ ID NO: 94999 - protein, 10 aa, Artificial Sequence
  Description of Artificial Sequence: Synthetic peptide
  Seed: QGEDSMSPLY (MAGC1_HUMAN)
  misc_feature (2)..(2): Xaa can be Thr, Ser, Met, Ile, Val, Leu, Asn, Phe, Gln, Ala, Gly, Cys, Arg, Asp, Glu, Trp, Lys, Tyr, Pro, or His
  misc_feature (10)..(10): Xaa can be Phe, Trp, Tyr, Lys, Arg, His, or Met
QXEDSMSPLX

SEQ ID NO: 95000 - protein, 11 aa, Artificial Sequence
  Description of Artificial Sequence: Synthetic peptide
  Seed: QGEDSMSPLYF (MAGC1_HUMAN)
  misc_feature (2)..(2): Xaa can be Thr, Ser, Phe, Ala, Val, Met, Leu, Ile, Cys, Gly, Pro, Asn, Trp, Tyr, or Gln
  misc_feature (11)..(11): Xaa can be Trp, Phe, Leu, Ile, or Met
QXEDSMSPLYX

SEQ ID NO: 95001 - protein, 9 aa, Artificial Sequence
  Description of Artificial Sequence: Synthetic peptide
  Seed: QGEEFQSSL (MAGC1_HUMAN)
  misc_feature (2)..(2): Xaa can be Met, His, Ile, Gln, Leu, Phe, Thr, Ala, Arg, Val, Tyr, Gly, Ser, Glu, Trp, Cys, Lys, Asn, or Asp
  misc_feature (9)..(9): Xaa can be Leu, Met, Phe, Ile, or Val
QXEEFQSSX

SEQ ID NO: 95002 - protein, 9 aa, Artificial Sequence
  Description of Artificial Sequence: Synthetic peptide
  Seed: QGMSQNRLL (MAGC1_HUMAN)
  misc_feature (2)..(2): Xaa can be Arg, Ala, Ser, Thr, Val, Ile, Gln, Met, Lys, Asn, Gly, or Leu
  misc_feature (9)..(9): Xaa can be Leu, Val, Ile, Met, Phe, Lys, Arg, His, Gln, Trp, Ala, or Tyr
QXMSQNRLX

SEQ ID NO: 95003 - protein, 8 aa, Artificial Sequence
  Description of Artificial Sequence: Synthetic peptide
  Seed: QIPGSPSF (MAGC1_HUMAN)
  misc_feature (2)..(2): Xaa can be Phe, Tyr, Ile, Met, Trp, Asn, His, Leu, Ala, Lys, Arg, Gln, Val, or Ser
  misc_feature (8)..(8): Xaa can be Phe, Tyr, Met, or Leu
QXPGSPSX

SEQ ID NO: 95004 - protein, 8 aa, Artificial Sequence
  Description of Artificial Sequence: Synthetic peptide
  Seed: QIPMTSSF (MAGC1_HUMAN)
  misc_feature (2)..(2): Xaa can be Tyr, Phe, Gln, Ile, Trp, Met, Val, Asn, Arg, Lys, Ser, Leu, Ala, His, or Thr
  misc_feature (8)..(8): Xaa can be Tyr, Phe, or Met
QXPMTSSX

SEQ ID NO: 95005 - protein, 8 aa, Artificial Sequence
  Description of Artificial Sequence: Synthetic peptide
  Seed: QIPVSPSF (MAGC1_HUMAN)
  misc_feature (2)..(2): Xaa can be Phe, Met, Tyr, Asn, Val, Leu, Ala, Ile, Arg, His, Trp, Ser, Gln, Thr, or Lys
  misc_feature (8)..(8): Xaa can be Tyr, Phe, or Met
QXPVSPSX

SEQ ID NO: 95006 - protein, 8 aa, Artificial Sequence
  Description of Artificial Sequence: Synthetic peptide
  Seed: QIPVSRSF (MAGC1_HUMAN)
  misc_feature (2)..(2): Xaa can be Tyr, Met, Phe, Val, Ile, Trp, Ala, Gln, Ser, Asn, Arg, His, or Leu
  misc_feature (8)..(8): Xaa can be Phe, Tyr, or Met
QXPVSRSX

SEQ ID NO: 95007 - protein, 8 aa, Artificial Sequence
  Description of Artificial Sequence: Synthetic peptide
  Seed: QIPVSSSF (MAGC1_HUMAN)
  misc_feature (2)..(2): Xaa can be Phe, Tyr, Trp, Met, Gln, His, Ile, Ala, Val, Ser, Arg, Lys, Asn, Thr, or Leu
  misc_feature (8)..(8): Xaa can be Tyr, Phe, or Met
QXPVSSSX

SEQ ID NO: 95008 - protein, 10 aa, Artificial Sequence
  Description of Artificial Sequence: Synthetic peptide
  Seed: QIPVSSSFSY (MAGC1_HUMAN)
  misc_feature (2)..(2): Xaa can be Met, Phe, Leu, Tyr, Thr, Ala, Gln, Ile, His, Val, Ser, Trp, Asn, Cys, Gly, Lys, Arg, Glu, Pro, or Asp
  misc_feature (10)..(10): Xaa can be Tyr, Phe, Met, Lys, Leu, Trp, Ala, His, Ile, Val, or Arg
QXPVSSSFSX

SEQ ID NO: 95009 - protein, 9 aa, Artificial Sequence
  Description of Artificial Sequence: Synthetic peptide
  Seed: QIVPSLPEW (MAGC1_HUMAN)
  misc_feature (2)..(2): Xaa can be Gln, Ala, Glu, Thr, Val, Ser, Met, Ile, Leu, Pro, Asn, Gly, Cys, Lys, Asp, Phe, Arg, Trp, His, or Tyr
  misc_feature (9)..(9): Xaa can be Tyr, Phe, Trp, Met, Leu, Ile, Val, His, Cys, or Ala
QXVPSLPEX

SEQ ID NO: 95010 - protein, 8 aa, Artificial Sequence
  Description of Artificial Sequence: Synthetic peptide
  Seed: QNPASSFF (MAGC1_HUMAN)
  misc_feature (2)..(2): Xaa can be Phe, Tyr, Met, Asn, His, Lys, Trp, Ser, Val, Ile, Gln, Arg, Ala, or Leu
  misc_feature (8)..(8): Xaa can be Tyr, Phe, or Met
QXPASSFX

SEQ ID NO: 95011 - protein, 9 aa, Artificial Sequence
  Description of Artificial Sequence: Synthetic peptide
  Seed: QNRLLILIL (MAGC1_HUMAN)
  misc_feature (2)..(2): Xaa can be Arg, Pro, Gln, Met, Ala, Leu, Ile, Gly, Val, Asn, Thr, Phe, Ser, Lys, or Cys
  misc_feature (9)..(9): Xaa can be Leu, Ile, Met, Phe, Val, Lys, Arg, Tyr, His, or Trp
QXRLLILIX

SEQ ID NO: 95012 - protein, 10 aa, Artificial Sequence
  Description of Artificial Sequence: Synthetic peptide
  Seed: QNSQSSPEGK (MAGC1_HUMAN)
  misc_feature (2)..(2): Xaa can be Val, Thr, Met, Ser, Ile, Leu, Gly, Ala, Asn, Gln, Tyr, or Phe
  misc_feature (10)..(10): Xaa can be Lys, Arg, or Tyr
QXSQSSPEGX

SEQ ID NO: 95013 - protein, 8 aa, Artificial Sequence
  Description of Artificial Sequence: Synthetic peptide
  Seed: QPITKAEM (MAGC1_HUMAN)
  misc_feature (2)..(2): Xaa can be Pro, Leu, Met, Ile, Gly, Val, Gln, Ala, or Ser
  misc_feature (8)..(8): Xaa can be Leu, Met, Ala, Phe, Ile, or Val
QXITKAEX

SEQ ID NO: 95014 - protein, 9 aa, Artificial Sequence
  Description of Artificial Sequence: Synthetic peptide
  Seed: QPITKAEML (MAGC1_HUMAN)
  misc_feature (2)..(2): Xaa can be Pro, Arg, Ala, His, Gln, Val, Met, Ser, Leu, Gly, Ile, Asn, Glu, Phe, Thr, or Lys
  misc_feature (9)..(9): Xaa can be Leu, Met, Ile, Trp, Val, Tyr, Phe, Ala, Cys, Ser, His, Thr, or Pro
QXITKAEMX

SEQ ID NO: 95015 - protein, 8 aa, Artificial Sequence
  Description of Artificial Sequence: Synthetic peptide
  Seed: QRPVSSFF (MAGC1_HUMAN)
  misc_feature (2)..(2): Xaa can be Arg, Tyr, Met, Phe, Trp, Val, His, Ala, Ser, Gln, Asn, Ile, Leu, or Lys
  misc_feature (8)..(8): Xaa can be Tyr, Phe, Met, or Leu
QXPVSSFX

SEQ ID NO: 95016 - protein, 10 aa, Artificial Sequence
  Description of Artificial Sequence: Synthetic peptide
  Seed: QRPVSSFFSY (MAGC1_HUMAN)
  misc_feature (2)..(2): Xaa can be Arg, Met, Gln, Phe, Tyr, His, Lys, Trp, Ser, Asp, Ala, Cys, Ile, Gly, Thr, Leu, Glu, Val, Pro, or Asn
  misc_feature (10)..(10): Xaa can be Phe, Met, Tyr, Leu, Trp, Ala, Ile, Val, His, Arg, or Lys
QXPVSSFFSX

SEQ ID NO: 95017 - protein, 11 aa, Artificial Sequence
  Description of Artificial Sequence: Synthetic peptide
  Seed: QSFSERTQSTF (MAGC1_HUMAN)
  misc_feature (2)..(2): Xaa can be Ser, Ala, Thr, Val, Met, Gln, Leu, Ile, Glu, Cys, Asn, Gly, Pro, Trp, Arg, Asp, Phe, Lys, Tyr, or His
  misc_feature (11)..(11): Xaa can be Tyr, Trp, Phe, Met, Leu, Ile, His, or Val
QXFSERTQSTX

SEQ ID NO: 95018 - protein, 9 aa, Artificial Sequence
  Description of Artificial Sequence: Synthetic peptide
  Seed: QSPLQGEEF (MAGC1_HUMAN)
  misc_feature (2)..(2): Xaa can be Ala, Ser, Val, Glu, Thr, Gly, Met, Gln, Leu, Ile, Tyr, Asn, Phe, Arg, Cys, Trp, Asp, His, Pro, or Lys
  misc_feature (9)..(9): Xaa can be Met, Tyr, Phe, Leu, Ile, Trp, Val, Lys, Arg, His, Cys, or Ala
QXPLQGEEX

SEQ ID NO: 95019 - protein, 8 aa, Artificial Sequence
  Description of Artificial Sequence: Synthetic peptide
  Seed: QSPLQIPV (MAGC1_HUMAN)
  misc_feature (2)..(2): Xaa can be Ala, Ser, or Gln
  misc_feature (8)..(8): Xaa can be Leu, Ile, or Val
QXPLQIPX

SEQ ID NO: 95020 - protein, 10 aa, Artificial Sequence
  Description of Artificial Sequence: Synthetic peptide
  Seed: QSPLQIPVSR (MAGC1_HUMAN)
  misc_feature (2)..(2): Xaa can be Val, Ala, Asn, Ser, Leu, Tyr, Met, Gln, Gly, Thr, Phe, Ile, or Trp
  misc_feature (10)..(10): Xaa can be Arg, or Lys
QXPLQIPVSX

SEQ ID NO: 95021 - protein, 11 aa, Artificial Sequence
  Description of Artificial Sequence: Synthetic peptide
  Seed: QSPLQNPASSF (MAGC1_HUMAN)
  misc_feature (2)..(2): Xaa can be Ala, Leu, Ile, Ser, Met, Val, Gln, Thr, Phe, Pro, Gly, Asn, Cys, Trp, or Glu
  misc_feature (11)..(11): Xaa can be Trp, Tyr, Phe, Leu, His, or Met
QXPLQNPASSX

SEQ ID NO: 95022 - protein, 8 aa, Artificial Sequence
  Description of Artificial Sequence: Synthetic peptide
  Seed: QSPLQRPV (MAGC1_HUMAN)
  misc_feature (2)..(2): Xaa can be Ala, Ser, Gln, or Met
  misc_feature (8)..(8): Xaa can be Ile, Leu, or Val
QXPLQRPX

SEQ ID NO: 95023 - protein, 11 aa, Artificial Sequence
  Description of Artificial Sequence: Synthetic peptide
  Seed: QSPLQRPVSSF (MAGC1_HUMAN)
  misc_feature (2)..(2): Xaa can be Thr, Ser, Val, Gly, Cys, Ala, Met, Leu, or Ile
  misc_feature (11)..(11): Xaa can be Trp, or Phe
QXPLQRPVSSX

SEQ ID NO: 95024 - protein, 11 aa, Artificial Sequence
  Description of Artificial Sequence: Synthetic peptide
  Seed: QSPLQSPVSSF (MAGC1_HUMAN)
  misc_feature (2)..(2): Xaa can be Ala, Ser, Gly, Ile, Met, Val, Leu, Thr, Cys, Gln, Phe, Pro, Trp, Glu, or Asn
  misc_feature (11)..(11): Xaa can be Trp, Tyr, Leu, Met, Phe, Lys, Val, His, or Ile
QXPLQSPVSSX

SEQ ID NO: 95025 - protein, 9 aa, Artificial Sequence
  Description of Artificial Sequence: Synthetic peptide
  Seed: QSPPEGEDV (MAGC1_HUMAN)
  misc_feature (2)..(2): Xaa can be Ala, Ser, Met, Gly, Gln, Val, Ile, Thr, Leu, Tyr, Phe, Arg, Asn, Glu, His, Trp, Cys, Pro, Asp, or Lys
  misc_feature (9)..(9): Xaa can be Leu, Met, Phe, Lys, Ile, Val, Tyr, Arg, Trp, or Ala
QXPPEGEDX

SEQ ID NO: 95026 - protein, 10 aa, Artificial Sequence
  Description of Artificial Sequence: Synthetic peptide
  Seed: QSPPEGENTH (MAGC1_HUMAN)
  misc_feature (2)..(2): Xaa can be Ala, Met, Val, Gln, Leu, Ile, Thr, Ser, Gly, Phe, Glu, Asn, Cys, Lys, Tyr, Pro, or Arg
  misc_feature (10)..(10): Xaa can be Tyr, Phe, Met, Lys, Leu, His, Arg, Trp, Ile, or Val
QXPPEGENTX

SEQ ID NO: 95027 - protein, 10 aa, Artificial Sequence
  Description of Artificial Sequence: Synthetic peptide
  Seed: QSPPEWEDSL (MAGC1_HUMAN)
  misc_feature (2)..(2): Xaa can be Ala, Met, Ile, Val, Leu, Thr, Phe, or Ser
  misc_feature (10)..(10): Xaa can be Leu, Met, or Phe
QXPPEWEDSX

SEQ ID NO: 95028 - protein, 10 aa, Artificial Sequence
  Description of Artificial Sequence: Synthetic peptide
  Seed: QSPPQGEDSL (MAGC1_HUMAN)
  misc_feature (2)..(2): Xaa can be Ala, or Ser
  misc_feature (10)..(10): Xaa can be Leu, Ile, Tyr, Phe, Lys, Val, Met, or Arg
QXPPQGEDSX

SEQ ID NO: 95029 - protein, 10 aa, Artificial Sequence
  Description of Artificial Sequence: Synthetic peptide
  Seed: QSPPQGEDSM (MAGC1_HUMAN)
  misc_feature (2)..(2): Xaa can be Met, Val, Ser, Leu, Ile, Thr, Phe, Gly, Gln, Tyr, Cys, or Trp
  misc_feature (10)..(10): Xaa can be Leu, Met, Tyr, Lys, Phe, Trp, Arg, Ile, or Val
QXPPQGEDSX

SEQ ID NO: 95030 - protein, 9 aa, Artificial Sequence
  Description of Artificial Sequence: Synthetic peptide
  Seed: QSPQGEDSL (MAGC1_HUMAN)
  misc_feature (2)..(2): Xaa can be Ala, Val, Leu, Ile, Gln, Thr, Ser, Met, Glu, Gly, Phe, Arg, Tyr, Asp, Cys, Trp, His, Asn, or Pro
  misc_feature (9)..(9): Xaa can be Leu, Met, Phe, Ile, Tyr, Val, Trp, Lys, Arg, or His
QXPQGEDSX

SEQ ID NO: 95031 - protein, 11 aa, Artificial Sequence
  Description of Artificial Sequence: Synthetic peptide
  Seed: QSSPECTQSTF (MAGC1_HUMAN)
  misc_feature (2)..(2): Xaa can be Val, Thr, Ala, Ser, Leu, Pro, Ile, Gln, Met, Gly, Glu, Cys, Phe, Asn, Trp, His, Asp, Tyr, Arg, or Lys
  misc_feature (11)..(11): Xaa can be Trp, Tyr, Phe, Leu, Met, Ile, Lys, Val, His, Arg, or Cys
QXSPECTQSTX

SEQ ID NO: 95032 - protein, 10 aa, Artificial Sequence
  Description of Artificial Sequence: Synthetic peptide
  Seed: QSSPEGKDSL (MAGC1_HUMAN)
  misc_feature (2)..(2): Xaa can be Ala, Ser, Thr, Val, Ile, Met, Leu, Gly, Cys, Gln, Pro, Glu, Phe, Tyr, Asp, Asn, or Trp
  misc_feature (10)..(10): Xaa can be Trp, Phe, Leu, Tyr, Met, Lys, or Ile
QXSPEGKDSX

SEQ ID NO: 95033 - protein, 11 aa, Artificial Sequence
  Description of Artificial Sequence: Synthetic peptide
  Seed: QSSPERTHSTF (MAGC1_HUMAN)
  misc_feature (2)..(2): Xaa can be Ala, Thr, Ser, Val, Gln, Met, Ile, Leu, Glu, Gly, Asn, Cys, Pro, Phe, Tyr, Lys, Arg, Asp, or Trp
  misc_feature (11)..(11): Xaa can be Trp, Tyr, Phe, Met, Leu, Ile, Val, or His
QXSPERTHSTX

SEQ ID NO: 95034 - protein, 11 aa, Artificial Sequence
  Description of Artificial Sequence: Synthetic peptide
  Seed: QSSPERTQSTF (MAGC1_HUMAN)
  misc_feature (2)..(2): Xaa can be Thr, Ser, Ala, Val, Met, Ile, Gln, Leu, Cys, Phe, Pro, Asn, Gly, Glu, Tyr, Arg, Trp, Lys, His, or Asp
  misc_feature (11)..(11): Xaa can be Trp, Tyr, Phe, Met, Leu, Ile, His, Val, or Cys
QXSPERTQSTX

SEQ ID NO: 95035 - protein, 11 aa, Artificial Sequence
  Description of Artificial Sequence: Synthetic peptide
  Seed: QSSPESAQSAF (MAGC1_HUMAN)
  misc_feature (2)..(2): Xaa can be Ala, Leu, Met, Gln, Ser, Thr, Pro, Val, Ile, Gly, Glu, Asn, Cys, Asp, Trp, Tyr, Phe, Arg, Lys, or His
  misc_feature (11)..(11): Xaa can be Tyr, Trp, Phe, Lys, Arg, Leu, Met, His, Ile, Val, Ala, or Cys
QXSPESAQSAX

SEQ ID NO: 95036 - protein, 11 aa, Artificial Sequence
  Description of Artificial Sequence: Synthetic peptide
  Seed: QSSPESAQSTF (MAGC1_HUMAN)
  misc_feature (2)..(2): Xaa can be Thr, Gln, Ser, Met, Ala, Ile, Val, Leu, Pro, Gly, Glu, Cys, Asn, Asp, Arg, Phe, Trp, Lys, Tyr, or His
  misc_feature (11)..(11): Xaa can be Trp, Phe, Tyr, Lys, Leu, Ile, Met, Arg, His, Val, Cys, or Ala
QXSPESAQSTX

SEQ ID NO: 95037 - protein, 10 aa, Artificial Sequence
  Description of Artificial Sequence: Synthetic peptide
  Seed: QSSPESDDTL (MAGC1_HUMAN)
  misc_feature (2)..(2): Xaa can be Ser, Thr, Ala, Ile, Leu, Met, Cys, Val, Gly, Pro, Asn, Tyr, Glu, Trp, Phe, or Gln
  misc_feature (10)..(10): Xaa can be Trp, Phe, Leu, Tyr, Met, or Ile
QXSPESDDTX

SEQ ID NO: 95038 - protein, 11 aa, Artificial Sequence
  Description of Artificial Sequence: Synthetic peptide
  Seed: QSSPESDDTLY (MAGC1_HUMAN)
  misc_feature (2)..(2): Xaa can be Thr, Ser, Val, Ala, Ile, Pro, Met, Gly, Gln, Leu, Cys, Glu, Trp, Asn, Phe, Tyr, Asp, His, Lys, or Arg
  misc_feature (11)..(11): Xaa can be Trp, Tyr, Lys, Arg, Phe, Met, Leu, His, Ile, Val, Gln, or Cys
QXSPESDDTLX

SEQ ID NO: 95039 - protein, 11 aa, Artificial Sequence
  Description of Artificial Sequence: Synthetic peptide
  Seed: QSSPESTQSPF (MAGC1_HUMAN)
  misc_feature (2)..(2): Xaa can be Ser, Ile, Thr, Val, Ala, Met, Gly, Leu, Gln, Cys, Glu, Asn, Phe, Pro, Asp, Tyr, Trp, His, Lys, or Arg
  misc_feature (11)..(11): Xaa can be Tyr, Trp, Phe, Lys, Met, Leu, His, or Arg
QXSPESTQSPX

SEQ ID NO: 95040 - protein, 8 aa, Artificial Sequence
  Description of Artificial Sequence: Synthetic peptide
  Seed: QSSPVSSF (MAGC1_HUMAN)
  misc_feature (2)..(2): Xaa can be Ala, Ile, Val, Ser, Thr, Met, His, Trp, Phe, Leu, Gln, Tyr, Asn, Gly, Arg, Lys, or Cys
  misc_feature (8)..(8): Xaa can be Tyr, Phe, Met, Trp, Leu, Lys, Ile, Val, or His
QXSPVSSX

SEQ ID NO: 95041 - protein, 8 aa, Artificial Sequence
  Description of Artificial Sequence: Synthetic peptide
  Seed: QVKQPITK (MAGC1_HUMAN)
  misc_feature (2)..(2): Xaa can be Ala, Leu, Ser, Met, Val, Thr, or Ile
  misc_feature (8)..(8): Xaa can be Lys, or Arg
QXKQPITX

SEQ ID NO: 95042 - protein, 9 aa, Artificial Sequence
  Description of Artificial Sequence: Synthetic peptide
  Seed: QVKQPITKA (MAGC1_HUMAN)
  misc_feature (2)..(2): Xaa can be Pro, Ala, Val, Thr, Ile, Ser, Gln, Gly, Leu, Met, Glu, Asn, Cys, Phe, Asp, Tyr, Lys, Trp, or Arg
  misc_feature (9)..(9): Xaa can be Tyr, Lys, Arg, Phe, Met, Leu, His, Ile, Val, Ala, Trp, Gln, Cys, Thr, Pro, Ser, Asn, Gly, or Glu
QXKQPITKX

SEQ ID NO: 95043 - protein, 9 aa, Artificial Sequence
  Description of Artificial Sequence: Synthetic peptide
  Seed: RAGREHFAF (MAGC1_HUMAN)
  misc_feature (2)..(2): Xaa can be Arg, Gln, Met, Leu, Val, Ala, Tyr, Phe, Ser, Thr, Ile, Trp, Glu, Lys, His, Gly, Cys, Asn, Asp, or Pro
  misc_feature (9)..(9): Xaa can be Tyr, Trp, Phe, Leu, Met, Ile, Val, His, or Ala
RXGREHFAX

SEQ ID NO: 95044 - protein, 10 aa, Artificial Sequence
  Description of Artificial Sequence: Synthetic peptide
  Seed: RAGREHFAFG (MAGC1_HUMAN)
  misc_feature (2)..(2): Xaa can be Val, Ser, Thr, Met, Ile, Tyr, Phe, Leu, Ala, Gln, Trp, Asn, Cys, His, Arg, Lys, Glu, Gly, Pro, or Asp
  misc_feature (10)..(10): Xaa can be Ala, Phe, Ser, Tyr, Gly, Lys, His, Arg, Met, Thr, Val, Leu, Gln, Pro, Ile, Cys, Asn, Glu, Trp, or Asp
RXGREHFAFX

SEQ ID NO: 95045 - protein, 9 aa, Artificial Sequence
  Description of Artificial Sequence: Synthetic peptide
  Seed: RAHSEVIKR (MAGC1_HUMAN)
  misc_feature (2)..(2): Xaa can be Arg, Ala, Ser, Thr, Leu, Val, Met, Gln, Ile, Phe, Tyr, Gly, Asn, Lys, Trp, Glu, Cys, His, Asp, or Pro
  misc_feature (9)..(9): Xaa can be Phe, Lys, Tyr, Leu, Arg, Met, Ile, His, Val, Trp, Ala, Cys, Gln, Ser, Thr, Asp, Pro, Asn, Gly, or Glu
RXHSEVIKX

SEQ ID NO: 95046 - protein, 10 aa, Artificial Sequence
  Description of Artificial Sequence: Synthetic peptide
  Seed: RAHSEVIKRK (MAGC1_HUMAN)
  misc_feature (2)..(2): Xaa can be Thr, Val, Ile, Leu, Met, Ser, Gln, Tyr, Ala, Gly, Trp, Phe, or Asn
  misc_feature (10)..(10): Xaa can be Arg, Lys, Tyr, Leu, Met, Phe, Ala, Val, or Ile
RXHSEVIKRX

SEQ ID NO: 95047 - protein, 8 aa, Artificial Sequence
  Description of Artificial Sequence: Synthetic peptide
  Seed: REFIEILF (MAGC1_HUMAN)
  misc_feature (2)..(2): Xaa can be Glu, Asp, Gln, Lys, Arg, Met, or His
  misc_feature (8)..(8): Xaa can be Tyr, Phe, Met, Trp, Leu, Ala, Ile, Val, Ser, Cys, Pro, Gly, Thr, or His
RXFIEILX

SEQ ID NO: 95048 - protein, 9 aa, Artificial Sequence
  Description of Artificial Sequence: Synthetic peptide
  Seed: REFIEILFG (MAGC1_HUMAN)
  misc_feature (2)..(2): Xaa can be Glu, Asp, or Gln
  misc_feature (9)..(9): Xaa can be Leu, Val, Ala, Cys, Ile, Met, Pro, Thr, Phe, Tyr, Ser, Asp, Glu, Trp, Gln, or Gly
RXFIEILFX

SEQ ID NO: 95049 - protein, 10 aa, Artificial Sequence
  Description of Artificial Sequence: Synthetic peptide
  Seed: REFIEILFGI (MAGC1_HUMAN)
  misc_feature (2)..(2): Xaa can be Arg, Glu, Gln, Met, Leu, Ile, Val, Thr, Ser, Ala, Phe, Asp, Tyr, Lys, His, Gly, Trp, Pro, Cys, or Asn
  misc_feature (10)..(10): Xaa can be Leu, Phe, Ile, Val, Trp, Met, Ala, Thr, Ser, Cys, Tyr, Pro, Gly, His, Lys, Asn, Arg, Glu, or Gln
RXFIEILFGX

SEQ ID NO: 95050 - protein, 9 aa, Artificial Sequence
  Description of Artificial Sequence: Synthetic peptide
  Seed: REHFAFGEP (MAGC1_HUMAN)
  misc_feature (2)..(2): Xaa can be Glu, Asp, or Gln
  misc_feature (9)..(9): Xaa can be Leu, Val, Cys, Ile, Met, Phe, Ala, Thr, Pro, Glu, Trp, Asp, Ser, Tyr, or Gly
RXHFAFGEX

SEQ ID NO: 95051 - protein, 10 aa, Artificial Sequence
  Description of Artificial Sequence: Synthetic peptide
  Seed: REHFAFGEPR (MAGC1_HUMAN)
  misc_feature (2)..(2): Xaa can be Trp, Phe, Tyr, Val, Met, Thr, Ile, Ser, Leu, Cys, Gln, Asn, Gly, Ala, Lys, His, Pro, Arg, Asp, or Glu
  misc_feature (10)..(10): Xaa can be Arg, Lys, His, or Tyr
RXHFAFGEPX

SEQ ID NO: 95052 - protein, 8 aa, Artificial Sequence
  Description of Artificial Sequence: Synthetic peptide
  Seed: RELLTKVW (MAGC1_HUMAN)
  misc_feature (2)..(2): Xaa can be Glu, Asp, or Gln
  misc_feature (8)..(8): Xaa can be Trp, Phe, Tyr, Leu, Met, Val, His, or Ile
RXLLTKVX

SEQ ID NO: 95053 - protein, 9 aa, Artificial Sequence
  Description of Artificial Sequence: Synthetic peptide
  Seed: RELLTKVWV (MAGC1_HUMAN)
  misc_feature (2)..(2): Xaa can be Glu, Gln, Asp, Leu, Met, Val, Ala, Ile, Ser, or Thr
  misc_feature (9)..(9): Xaa can be Val, Ile, Leu, Phe, Trp, Ala, Tyr, Met, Cys, Pro, His, Ser, Thr, or Gly
RXLLTKVWX

SEQ ID NO: 95054 - protein, 9 aa, Artificial Sequence
  Description of Artificial Sequence: Synthetic peptide
  Seed: REVDPDDSY (MAGC1_HUMAN)
  misc_feature (2)..(2): Xaa can be Glu, Gln, Arg, Ala, Asp, Met, Leu, Val, Ser, Thr, Ile, Tyr, Asn, Gly, Phe, Lys, Pro, Cys, His, or Trp
  misc_feature (9)..(9): Xaa can be Phe, Met, Tyr, Leu, Trp, Ile, Lys, Arg, Val, His, Cys, Ala, Thr, Pro, Gln, Asn, Asp, Ser, Glu, or Gly
RXVDPDDSX

SEQ ID NO: 95055 - protein, 10 aa, Artificial Sequence
  Description of Artificial Sequence: Synthetic peptide
  Seed: REVDPDDSYV (MAGC1_HUMAN)
  misc_feature (2)..(2): Xaa can be Glu, Gln, Asp, Met, Leu, Arg, Ile, Val, Ala, Asn, Lys, Thr, His, Ser, Gly, Phe, Cys, Tyr, Trp, or Pro
  misc_feature (10)..(10): Xaa can be Trp, Phe, Leu, Met, Ile, Val, Tyr, Cys, Thr, Ala, Arg, Lys, His, Gly, Pro, Ser, Gln, Asp, Asn, or Glu
RXVDPDDSYX

SEQ ID NO: 95056 - protein, 11 aa, Artificial Sequence
  Description of Artificial Sequence: Synthetic peptide
  Seed: REVDPDDSYVF (MAGC1_HUMAN)
  misc_feature (2)..(2): Xaa can be Arg, Glu, Ala, Gln, His, Asp, Ser, Val, Met, Leu, Ile, Thr, Tyr, Gly, Asn, Lys, Trp, Cys, Phe, or Pro
  misc_feature (11)..(11): Xaa can be Met, Trp, Leu, Phe, Lys, Tyr, His, Arg, Ile, Val, Cys, Ala, Gln, Thr, Ser, Pro, Gly, Asn, Glu, or Asp
RXVDPDDSYVX

SEQ ID NO: 95057 - protein, 8 aa, Artificial Sequence
  Description of Artificial Sequence: Synthetic peptide
  Seed: REVPNSSP (MAGC1_HUMAN)
  misc_feature (2)..(2): Xaa can be Glu, or Asp
  misc_feature (8)..(8): Xaa can be Ile, Val, Ala, Leu, Phe, Cys, Pro, Met, Ser, Thr, or Gly
RXVPNSSX

SEQ ID NO: 95058 - protein, 9 aa, Artificial Sequence
  Description of Artificial Sequence: Synthetic peptide
  Seed: REVPNSSPP (MAGC1_HUMAN)
  misc_feature (2)..(2): Xaa can be Glu, Asp, or Gln
  misc_feature (9)..(9): Xaa can be Phe, Val, Ala, Met, Ile, Cys, Leu, Pro, Thr, Asp, Arg, Ser, Gln, Asn, Glu, Gly, Trp, or Ty r
RXVPNSSPX

SEQ ID NO: 95059 - protein, 10 aa, Artificial Sequence
  Description of Artificial Sequence: Synthetic peptide
  Seed: REVPNSSPPR (MAGC1_HUMAN)
  misc_feature (2)..(2): Xaa can be Glu, Gln, Val, Met, Leu, Thr, Ile, Phe, Tyr, Ala, Trp, Asn, Gly, Ser, Arg, Pro, Cys, Asp, His, or Lys
  misc_feature (10)..(10): Xaa can be Arg, Lys, Tyr, Leu, Trp, Phe, or Met
RXVPNSSPPX

SEQ ID NO: 95060 - protein, 11 aa, Artificial Sequence
  Description of Artificial Sequence: Synthetic peptide
  Seed: REVPNSSPPRY (MAGC1_HUMAN)
  misc_feature (2)..(2): Xaa can be Glu, Gln, Val, Met, Asp, Thr, Ala, Leu, Ser, Ile, Tyr, Phe, Trp, Lys, His, Gly, Asn, Arg, Pro, or Cys
  misc_feature (11)..(11): Xaa can be Tyr, Phe, Trp, Leu, Met, Ile, Val, His, Lys, Cys, Arg, Ala, Pro, Thr, Gly, or Ser
RXVPNSSPPRX

SEQ ID NO: 95061 - protein, 9 aa, Artificial Sequence
  Description of Artificial Sequence: Synthetic peptide
  Seed: RFLLLKYQV (MAGC1_HUMAN)
  misc_feature (2)..(2): Xaa can be Tyr, Trp, Phe, Met, Gln, Leu, Ile, Thr, His, Val, Ala, Gly, Ser, or Asn
  misc_feature (9)..(9): Xaa can be Phe, Trp, Ile, Met, Leu, Tyr, Val, Ala, or Cys
RXLLLKYQX

SEQ ID NO: 95062 - protein, 10 aa, Artificial Sequence
  Description of Artificial Sequence: Synthetic peptide
  Seed: RFLLLKYQVK (MAGC1_HUMAN)
  misc_feature (2)..(2): Xaa can be Thr, Ser, Met, Val, Asn, Cys, Arg, Phe, Ile, His, Ala, Gln, Glu, Leu, Tyr, Asp, Trp, Pro, Gly, or Lys
  misc_feature (10)..(10): Xaa can be Arg, Lys, Ala, Val, Tyr, His, or Ile
RXLLLKYQVX

SEQ ID NO: 95063 - protein, 9 aa, Artificial Sequence
  Description of Artificial Sequence: Synthetic peptide
  Seed: RKAREFIEI (MAGC1_HUMAN)
  misc_feature (2)..(2): Xaa can be Arg, Gln, Met, Glu, Lys, Gly, Ala, Leu, Ser, Asp, Val, Asn, Thr, Ile, His, Tyr, Phe, Pro, Cys, or Trp
  misc_feature (9)..(9): Xaa can be Tyr, Leu, Phe, Met, Ile, Val, Arg, Lys, His, Trp, Ala, Gly, Thr, Cys, Ser, Gln, Asn, Glu, or Pro
RXAREFIEX

SEQ ID NO: 95064 - protein, 10 aa, Artificial Sequence
  Description of Artificial Sequence: Synthetic peptide
  Seed: RKAREFIEIL (MAGC1_HUMAN)
  misc_feature (2)..(2): Xaa can be Arg, Gln, Met, Lys, His, Glu, Ala, Leu, Asn, Asp, Val, Ile, Ser, Gly, Cys, Pro, Phe, Thr, Tyr, or Trp
  misc_feature (10)..(10): Xaa can be Phe, Tyr, Met, Leu, Ile, Val, His, Trp, Ser, Ala, Thr, Lys, Cys, or Gly
RXAREFIEIX

SEQ ID NO: 95065 - protein, 11 aa, Artificial Sequence
  Description of Artificial Sequence: Synthetic peptide
  Seed: RKAREFIEILF (MAGC1_HUMAN)
  misc_feature (2)..(2): Xaa can be Arg, Gln, Lys, Met, His, Trp, Ala, Pro, Ile, Ser, Thr, Phe, Cys, Asn, Tyr, Glu, Leu, Asp, Val, or Gly
  misc_feature (11)..(11): Xaa can be Leu, Phe, Met, Tyr, Ile, Val, Glu, Asp, Cys, Arg, His, Ser, Gly, Lys, Gln, Asn, Trp, Thr, Ala, or Pro
RXAREFIEILX

SEQ ID NO: 95066 - protein, 9 aa, Artificial Sequence
  Description of Artificial Sequence: Synthetic peptide
  Seed: RKVVEFLAM (MAGC1_HUMAN)
  misc_feature (2)..(2): Xaa can be Arg, Gln, Met, Lys, Ala, Glu, Ser, His, Leu, Thr, Asn, Val, Gly, Ile, Asp, Tyr, Trp, Pro, Phe, or Cys
  misc_feature (9)..(9): Xaa can be Tyr, Leu, Phe, Met, Ile, Val, Trp, His, Lys, Arg, Ala, Thr, Gly, Cys, Ser, Pro, Gln, Asn, or Glu
RXVVEFLAX

SEQ ID NO: 95067 - protein, 10 aa, Artificial Sequence
  Description of Artificial Sequence: Synthetic peptide
  Seed: RKVVEFLAML (MAGC1_HUMAN)
  misc_feature (2)..(2): Xaa can be Met, Gln, Arg, Leu, Lys, Ile, Phe, Tyr, Pro, Val, Cys, Asn, Ser, Ala, Trp, Asp, Gly, His, Thr, or Glu
  misc_feature (10)..(10): Xaa can be Ile, Tyr, Met, Ala, Phe, Val, Leu, Thr, Ser, Cys, His, Trp, Gly, Lys, Asp, Asn, Glu, Pro, Gln, or Arg
RXVVEFLAMX

SEQ ID NO: 95068 - protein, 11 aa, Artificial Sequence
  Description of Artificial Sequence: Synthetic peptide
  Seed: RKVVEFLAMLK (MAGC1_HUMAN)
  misc_feature (2)..(2): Xaa can be Met, Ser, Thr, Leu, Gln, Tyr, Phe, Ile, Lys, Asp, Asn, Glu, Pro, Trp, Val, Gly, Arg, Ala, His, or Cys
  misc_feature (11)..(11): Xaa can be Lys, Arg, or Tyr
RXVVEFLAMLX

SEQ ID NO: 95069 - protein, 9 aa, Artificial Sequence
  Description of Artificial Sequence: Synthetic peptide
  Seed: RLLILILSI (MAGC1_HUMAN)
  misc_feature (2)..(2): Xaa can be Arg, Gln, Met, Leu, Ser, Ala, Ile, Thr, Val, Asn, Glu, Gly, Tyr, Cys, Lys, Asp, His, Phe, Trp, or Pro
  misc_feature (9)..(9): Xaa can be Tyr, Ile, Leu, Arg, Phe, Met, Lys, Val, Trp, His, Ala, Cys, Thr, Ser, Gly, Gln, Pro, Asn, or Glu
RXLILILSX

SEQ ID NO: 95070 - protein, 10 aa, Artificial Sequence
  Description of Artificial Sequence: Synthetic peptide
  Seed: RLLILILSII (MAGC1_HUMAN)
  misc_feature (2)..(2): Xaa can be Leu, Met, Cys, Trp, Lys, Glu, Thr, Phe, Ser, Arg, Ile, Tyr, Ala, Asp, His, Gly, Gln, Val, Asn, or Pro
  misc_feature (10)..(10): Xaa can be Thr, Ala, Ile, Val, Leu, Arg, Cys, Glu, His, Pro, Ser, Tyr, Trp, Met, Asp, Phe, Gln, Gly, Asn, or Lys
RXLILILSIX

SEQ ID NO: 95071 - protein, 10 aa, Artificial Sequence
  Description of Artificial Sequence: Synthetic peptide
  Seed: RPPEGKDSQS (MAGC1_HUMAN)
  misc_feature (2)..(2): Xaa can be , or Pro
  misc_feature (10)..(10): Xaa can be Ile, Pro, Tyr, Met, Val, Leu, Thr, Ala, Gly, Cys, Ser, or Phe
RXPEGKDSQX

SEQ ID NO: 95072 - protein, 11 aa, Artificial Sequence
  Description of Artificial Sequence: Synthetic peptide
  Seed: RPPEGKDSQSP (MAGC1_HUMAN)
  misc_feature (2)..(2): Xaa can be , or Pro
  misc_feature (11)..(11): Xaa can be Met, Ser, Ala, Tyr, Pro, Cys, Leu, Val, Thr, Ile, Phe, or Gly
RXPEGKDSQSX

SEQ ID NO: 95073 - protein, 9 aa, Artificial Sequence
  Description of Artificial Sequence: Synthetic peptide
  Seed: RPVSSFFSY (MAGC1_HUMAN)
  misc_feature (2)..(2): Xaa can be Gln, Met, Arg, Pro, Lys, Thr, Ser, Leu, Val, Ala, Trp, Ile, Asn, Tyr, Gly, Phe, His, Glu, Cys, or Asp
  misc_feature (9)..(9): Xaa can be Phe, Tyr, Met, Leu, His, Val, Trp, Ile, Arg, Lys, Ala, Cys, Gly, Thr, Gln, Ser, Pro, Asn, or Glu
RXVSSFFSX

SEQ ID NO: 95074 - protein, 10 aa, Artificial Sequence
  Description of Artificial Sequence: Synthetic peptide
  Seed: RPVSSFFSYT (MAGC1_HUMAN)
  misc_feature (2)..(2): Xaa can be Thr, Ser, Pro, Tyr, Met, Ala, Trp, Val, Phe, His, Asn, Arg, Glu, Gly, Gln, Asp, Lys, Ile, Leu, or Cys
  misc_feature (10)..(10): Xaa can be Arg, Ile, Tyr, Leu, Ala, Gly, Lys, His, Thr, Met, Val, Ser, Pro, Phe, Asn, Cys, Gln, Trp, or Glu
RXVSSFFSYX

SEQ ID NO: 95075 - protein, 11 aa, Artificial Sequence
  Description of Artificial Sequence: Synthetic peptide
  Seed: RPVSSFFSYTL (MAGC1_HUMAN)
  misc_feature (2)..(2): Xaa can be Pro, Ser, Tyr, Cys, Asp, Trp, Arg, Ala, Gln, Asn, Gly, Phe, Glu, Val, His, Lys, Leu, Thr, Met, or Ile
  misc_feature (11)..(11): Xaa can be Tyr, Trp, Leu, Ile, Phe, Val, Met, Gly, Cys, Pro, Ala, Thr, or Ser
RXVSSFFSYTX

SEQ ID NO: 95076 - protein, 8 aa, Artificial Sequence
  Description of Artificial Sequence: Synthetic peptide
  Seed: RSFSSTLL (MAGC1_HUMAN)
  misc_feature (2)..(2): Xaa can be Ala, Thr, Ser, Val, Met, Gln, Ile, Leu, Gly, Pro, Asp, Glu, Asn, or Cys
  misc_feature (8)..(8): Xaa can be Ile, Trp, Val, Leu, Phe, Tyr, Met, or His
RXFSSTLX

SEQ ID NO: 95077 - protein, 9 aa, Artificial Sequence
  Description of Artificial Sequence: Synthetic peptide
  Seed: RSFSSTLLS (MAGC1_HUMAN)
  misc_feature (2)..(2): Xaa can be Ser, Thr, Ala, Tyr, Val, Met, Phe, Ile, Leu, Gln, Trp, Gly, Asn, Cys, Pro, Lys, His, Arg, Asp, or Glu
  misc_feature (9)..(9): Xaa can be Trp, Lys, Phe, Tyr, Leu, Met, Ile, Val, Ala, Gly, Ser, His, Arg, Thr, Asn, Cys, Pro, Gln, Glu, or Asp
RXFSSTLLX

SEQ ID NO: 95078 - protein, 10 aa, Artificial Sequence
  Description of Artificial Sequence: Synthetic peptide
  Seed: RSFSSTLLSI (MAGC1_HUMAN)
  misc_feature (2)..(2): Xaa can be Thr, Gln, Ala, Ser, Met, Ile, Tyr, Leu, Val, Phe, Glu, Trp, Arg, Lys, Gly, His, Asn, Pro, Asp, or Cys
  misc_feature (10)..(10): Xaa can be Lys, Ile, Leu, Val, Phe, Tyr, Trp, Met, Ala, His, Arg, Cys, Thr, Gly, Ser, Asn, Pro, Gln, or Asp
RXFSSTLLSX

SEQ ID NO: 95079 - protein, 11 aa, Artificial Sequence
  Description of Artificial Sequence: Synthetic peptide
  Seed: RSFSSTLLSIF (MAGC1_HUMAN)
  misc_feature (2)..(2): Xaa can be Tyr, Gln, Thr, Met, Ser, Ala, Trp, Val, Phe, Ile, Lys, Glu, Leu, Gly, Cys, His, Asn, Pro, Asp, or Arg
  misc_feature (11)..(11): Xaa can be Trp, Met, Phe, Tyr, Leu, Ile, Val, His, Ala, Gly, Thr, Asn, Ser, Lys, Cys, Asp, Gln, Pro, Arg, or Glu
RXFSSTLLSIX

SEQ ID NO: 95080 - protein, 9 aa, Artificial Sequence
  Description of Artificial Sequence: Synthetic peptide
  Seed: RTHSTFEGF (MAGC1_HUMAN)
  misc_feature (2)..(2): Xaa can be Thr, Ser, Val, Arg, Met, Ile, Gln, Tyr, Ala, Leu, Gly, Asn, Phe, Trp, Glu, Lys, Cys, Asp, His, or Pro
  misc_feature (9)..(9): Xaa can be Tyr, Trp, Phe, Leu, Met, Lys, Ile, Arg, Val, Ala, His, Ser, Gly, Cys, Thr, Pro, Gln, Glu, or Asn
RXHSTFEGX

SEQ ID NO: 95081 - protein, 10 aa, Artificial Sequence
  Description of Artificial Sequence: Synthetic peptide
  Seed: RTHSTFEGFP (MAGC1_HUMAN)
  misc_feature (2)..(2): Xaa can be Thr, Val, Ser, Met, Ile, Ala, Tyr, Phe, Leu, Trp, Gln, Gly, Asn, His, Lys, or Cys
  misc_feature (10)..(10): Xaa can be Lys, Ala, Val, Ile, Arg, Leu, Met, Tyr, Ser, Gly, Phe, His, Thr, Cys, Pro, Gln, Asn, or Gl u
RXHSTFEGFX

SEQ ID NO: 95082 - protein, 9 aa, Artificial Sequence
  Description of Artificial Sequence: Synthetic peptide
  Seed: RTQSTFEGF (MAGC1_HUMAN)
  misc_feature (2)..(2): Xaa can be Tyr, Gln, Thr, Ala, Val, Ser, Met, Trp, Phe, Leu, Ile, Glu, Gly, Asn, Lys, His, Asp, Cys, Pro, or Arg
  misc_feature (9)..(9): Xaa can be Phe, Tyr, Trp, Leu, Met, Lys, Ile, Arg, Val, His, Ala, Cys, or Gly
RXQSTFEGX

SEQ ID NO: 95083 - protein, 10 aa, Artificial Sequence
  Description of Artificial Sequence: Synthetic peptide
  Seed: RTQSTFEGFA (MAGC1_HUMAN)
  misc_feature (2)..(2): Xaa can be Thr, Val, Ser, Met, Ile, Tyr, Ala, Phe, Trp, Leu, Cys, Asn, Arg, Lys, Gly, His, or Gln
  misc_feature (10)..(10): Xaa can be Lys, Ala, Ile, Val, Arg, Met, Leu, Tyr, Ser, Gly, Thr, Phe, or His
RXQSTFEGFX

SEQ ID NO: 95084 - protein, 9 aa, Artificial Sequence
  Description of Artificial Sequence: Synthetic peptide
  Seed: RYEFLWGPR (MAGC1_HUMAN)
  misc_feature (2)..(2): Xaa can be Met, Ile, Thr, Gln, Gly, Ser, Trp, Tyr, Phe, Ala, Leu, Val, Asn, His, Cys, or Pro
  misc_feature (9)..(9): Xaa can be Arg, Lys, or His
RXEFLWGPX

SEQ ID NO: 95085 - protein, 10 aa, Artificial Sequence
  Description of Artificial Sequence: Synthetic peptide
  Seed: RYEFLWGPRA (MAGC1_HUMAN)
  misc_feature (2)..(2): Xaa can be Phe, Val, Met, Thr, Tyr, Leu, Trp, Ile, Ser, Gln, Asn, Glu, Gly, Ala, Cys, His, Arg, Pro, Lys, or Asp
  misc_feature (10)..(10): Xaa can be Pro, Met, Phe, Val, Ala, Ile, Leu, Arg, Lys, His, Tyr, Thr, Cys, Asn, Gly, Asp, Gln, Trp, Ser, or Glu
RXEFLWGPRX

SEQ ID NO: 95086 - protein, 8 aa, Artificial Sequence
  Description of Artificial Sequence: Synthetic peptide
  Seed: RYTGYFPV (MAGC1_HUMAN)
  misc_feature (2)..(2): Xaa can be Tyr, Trp, Phe, or Met
  misc_feature (8)..(8): Xaa can be Phe, Trp, Ile, Leu, Met, Tyr, or Val
RXTGYFPX

SEQ ID NO: 95087 - protein, 9 aa, Artificial Sequence
  Description of Artificial Sequence: Synthetic peptide
  Seed: RYTGYFPVI (MAGC1_HUMAN)
  misc_feature (2)..(2): Xaa can be Arg, Tyr, Ala, Val, Thr, Ile, Ser, Gln, Met, Phe, Leu, His, Trp, Asn, Gly, Glu, Asp, Lys, Pro, or Cys
  misc_feature (9)..(9): Xaa can be Tyr, Phe, Leu, Met, Ile, Val, Trp, His, Lys, Arg, Ala, Thr, Cys, Gly, or Gln
RXTGYFPVX

SEQ ID NO: 95088 - protein, 10 aa, Artificial Sequence
  Description of Artificial Sequence: Synthetic peptide
  Seed: RYTGYFPVIF (MAGC1_HUMAN)
  misc_feature (2)..(2): Xaa can be Tyr, Arg, Gln, Met, Trp, Ser, Thr, Val, Leu, Ala, Phe, Lys, Gly, Pro, Asn, Asp, Glu, His, Ile, or Cys
  misc_feature (10)..(10): Xaa can be Trp, Phe, Met, Tyr, Leu, Ile, His, Val, Lys, Ala, Arg, Ser, Gly, Asp, Pro, Glu, Thr, Gln, Asn, or Cys
RXTGYFPVIX

SEQ ID NO: 95089 - protein, 11 aa, Artificial Sequence
  Description of Artificial Sequence: Synthetic peptide
  Seed: RYTGYFPVIFR (MAGC1_HUMAN)
  misc_feature (2)..(2): Xaa can be Trp, Tyr, Phe, Met, Thr, Val, Asn, Gln, Leu, Cys, Gly, Pro, Ser, Asp, Glu, Ala, Ile, His, Arg, or Lys
  misc_feature (11)..(11): Xaa can be Arg, Lys, His, Phe, Leu, Trp, Ile, Met, Ser, Thr, Glu, Gly, Tyr, Pro, Asn, Cys, Gln, Val, Ala, or Asp
RXTGYFPVIFX

SEQ ID NO: 95090 - protein, 8 aa, Artificial Sequence
  Description of Artificial Sequence: Synthetic peptide
  Seed: SAASSSTL (MAGC1_HUMAN)
  misc_feature (2)..(2): Xaa can be Ala, Ile, Ser, Val, Thr, Gln, Met, Phe, Gly, or Arg
  misc_feature (8)..(8): Xaa can be Leu, Tyr, Phe, Met, Ile, Val, His, Lys, or Arg
SXASSSTX

SEQ ID NO: 95091 - protein, 9 aa, Artificial Sequence
  Description of Artificial Sequence: Synthetic peptide
  Seed: SAASSSTLV (MAGC1_HUMAN)
  misc_feature (2)..(2): Xaa can be Ala, Met, Leu, Gln, Val, Thr, Ser, Ile, Pro, Gly, Asn, Glu, Cys, Phe, Arg, Tyr, Asp, His, Trp, or Lys
  misc_feature (9)..(9): Xaa can be Leu, Tyr, Lys, Met, Phe, Ile, Val, Arg, His, Ala, Cys, Thr, Trp, Gln, or Ser
SXASSSTLX

SEQ ID NO: 95092 - protein, 11 aa, Artificial Sequence
  Description of Artificial Sequence: Synthetic peptide
  Seed: SAASSSTLVSI (MAGC1_HUMAN)
  misc_feature (2)..(2): Xaa can be Leu, Ala, Met, Gln, Ile, Thr, Val, Pro, Glu, Gly, Ser, Asn, Cys, Phe, Arg, Tyr, Trp, His, Asp, or Lys
  misc_feature (11)..(11): Xaa can be Leu, Trp, Lys, Phe, Arg, Met, Tyr, Val, Ile, His, Ala, Cys, Thr, or Gln
SXASSSTLVSX

SEQ ID NO: 95093 - protein, 9 aa, Artificial Sequence
  Description of Artificial Sequence: Synthetic peptide
  Seed: SAFEGFPQS (MAGC1_HUMAN)
  misc_feature (2)..(2): Xaa can be Thr, Pro, or Ala
  misc_feature (9)..(9): Xaa can be , or Ser
SXFEGFPQX

SEQ ID NO: 95094 - protein, 10 aa, Artificial Sequence
  Description of Artificial Sequence: Synthetic peptide
  Seed: SAFEGFPQSP (MAGC1_HUMAN)
  misc_feature (2)..(2): Xaa can be Thr, Pro, or Ala
  misc_feature (10)..(10): Xaa can be Pro, or Leu
SXFEGFPQSX

SEQ ID NO: 95095 - protein, 11 aa, Artificial Sequence
  Description of Artificial Sequence: Synthetic peptide
  Seed: SAFEGFPQSPL (MAGC1_HUMAN)
  misc_feature (2)..(2): Xaa can be Pro, Ala, or Thr
  misc_feature (11)..(11): Xaa can be , or Leu
SXFEGFPQSPX

SEQ ID NO: 95096 - protein, 9 aa, Artificial Sequence
  Description of Artificial Sequence: Synthetic peptide
  Seed: SAPEGEDSL (MAGC1_HUMAN)
  misc_feature (2)..(2): Xaa can be Pro, Ala, Leu, Glu, Ser, Val, Tyr, Ile, Thr, Met, Arg, Phe, His, Gln, Gly, Asn, Cys, Trp, Asp, or Lys
  misc_feature (9)..(9): Xaa can be Leu, Met, Ile, Val, Tyr, Phe, Lys, Trp, Arg, Cys, His, Ala, Thr, Pro, or Ser
SXPEGEDSX

SEQ ID NO: 95097 - protein, 9 aa, Artificial Sequence
  Description of Artificial Sequence: Synthetic peptide
  Seed: SAQSAFEGF (MAGC1_HUMAN)
  misc_feature (2)..(2): Xaa can be Glu, Ala, Gln, Ile, Thr, Val, Arg, Ser, Pro, Met, Leu, Asp, Tyr, Phe, Gly, Asn, Trp, His, Cys, or Lys
  misc_feature (9)..(9): Xaa can be Leu, Tyr, Trp, Phe, Met, Lys, Ile, Arg, Val, His, Ala, Thr, or Cys
SXQSAFEGX

SEQ ID NO: 95098 - protein, 9 aa, Artificial Sequence
  Description of Artificial Sequence: Synthetic peptide
  Seed: SAQSTFEGF (MAGC1_HUMAN)
  misc_feature (2)..(2): Xaa can be Ala, Thr, Arg, Ser, Val, Gln, Leu, Met, Ile, Pro, Phe, Tyr, Gly, Glu, Asn, His, Cys, Trp, Asp, or Lys
  misc_feature (9)..(9): Xaa can be Trp, Phe, Tyr, Leu, Lys, Met, Arg, Ile, Val, or His
SXQSTFEGX

SEQ ID NO: 95099 - protein, 9 aa, Artificial Sequence
  Description of Artificial Sequence: Synthetic peptide
  Seed: SASSSVMSP (MAGC1_HUMAN)
  misc_feature (2)..(2): Xaa can be Ala, Ser, Val, Thr, Ile, Gly, Gln, Leu, Glu, Met, Pro, Cys, Asp, Asn, Phe, Tyr, Lys, Arg, or Trp
  misc_feature (9)..(9): Xaa can be Tyr, Phe, Met, Leu, His, Lys, Ile, Arg, Val, Trp, Ala, Cys, Pro, Thr, Gly, Ser, or Gln
SXSSSVMSX

SEQ ID NO: 95100 - protein, 11 aa, Artificial Sequence
  Description of Artificial Sequence: Synthetic peptide
  Seed: SASSSVMSPSF (MAGC1_HUMAN)
  misc_feature (2)..(2): Xaa can be Ala, Ser, Val, Thr, Ile, Met, Pro, Gly, Leu, Gln, Lys, Asn, His, Phe, Tyr, Arg, Trp, Cys, Asp, or Glu
  misc_feature (11)..(11): Xaa can be Tyr, Trp, Phe, Met, Lys, Leu, Arg, His, Ile, or Val
SXSSSVMSPSX

SEQ ID NO: 95101 - protein, 8 aa, Artificial Sequence
  Description of Artificial Sequence: Synthetic peptide
  Seed: SDDTLYPL (MAGC1_HUMAN)
  misc_feature (2)..(2): Xaa can be Glu, Asp, Thr, Ala, Ser, Ile, Val, Arg, Phe, Cys, Gly, Tyr, Gln, His, Leu, Met, Asn, Trp, or Pro
  misc_feature (8)..(8): Xaa can be Leu, Met, Ile, Phe, Val, Ala, Tyr, Trp, Gly, Cys, Ser, Thr, or Pro
SXDTLYPX

SEQ ID NO: 95102 - protein, 11 aa, Artificial Sequence
  Description of Artificial Sequence: Synthetic peptide
  Seed: SDEQGMSQNRL (MAGC1_HUMAN)
  misc_feature (2)..(2): Xaa can be Glu, Gln, or Asp
  misc_feature (11)..(11): Xaa can be Phe, Leu, Met, Ile, Trp, or Val
SXEQGMSQNRX

SEQ ID NO: 95103 - protein, 11 aa, Artificial Sequence
  Description of Artificial Sequence: Synthetic peptide
  Seed: SDPLQRPPEGK (MAGC1_HUMAN)
  misc_feature (2)..(2): Xaa can be Gly, Arg, Ala, Pro, Asn, Ile, Ser, Asp, Val, Glu, or Gln
  misc_feature (11)..(11): Xaa can be Lys, Phe, Asn, Arg, Tyr, Leu, Met, Glu, His, Gln, or Gly
SXPLQRPPEGX

SEQ ID NO: 95104 - protein, 10 aa, Artificial Sequence
  Description of Artificial Sequence: Synthetic peptide
  Seed: SDSLTDSESL (MAGC1_HUMAN)
  misc_feature (2)..(2): Xaa can be Glu, Asp, or Gln
  misc_feature (10)..(10): Xaa can be Leu, Met, Phe, Ile, Cys, Thr, Val, Trp, Lys, Ala, or Tyr
SXSLTDSESX

SEQ ID NO: 95105 - protein, 8 aa, Artificial Sequence
  Description of Artificial Sequence: Synthetic peptide
  Seed: SEESSSPV (MAGC1_HUMAN)
  misc_feature (2)..(2): Xaa can be , or Glu
  misc_feature (8)..(8): Xaa can be Val, Cys, Ala, Met, Phe, Leu, or Ile
SXESSSPX

SEQ ID NO: 95106 - protein, 9 aa, Artificial Sequence
  Description of Artificial Sequence: Synthetic peptide
  Seed: SEESSSPVD (MAGC1_HUMAN)
  misc_feature (2)..(2): Xaa can be Glu, Asp, or Gln
  misc_feature (9)..(9): Xaa can be Val, Cys, Thr, Leu, Met, Ile, Pro, Ala, Phe, Trp, Ser, Tyr, Glu, Gly, Arg, Asn, Gln, Asp, or Lys
SXESSSPVX

SEQ ID NO: 95107 - protein, 11 aa, Artificial Sequence
  Description of Artificial Sequence: Synthetic peptide
  Seed: SEESSSPVDEY (MAGC1_HUMAN)
  misc_feature (2)..(2): Xaa can be Glu, Gln, Asp, Thr, Ser, Ile, Val, Met, Leu, Ala, Asn, Gly, Tyr, Phe, Cys, Trp, Pro, Arg, Lys, or His
  misc_feature (11)..(11): Xaa can be Tyr, Lys, Trp, Phe, Arg, His, Met, Leu, Ala, Ile, Cys, Val, Pro, Gly, Ser, or Thr
SXESSSPVDEX

SEQ ID NO: 95108 - protein, 8 aa, Artificial Sequence
  Description of Artificial Sequence: Synthetic peptide
  Seed: SEEVIWDV (MAGC1_HUMAN)
  misc_feature (2)..(2): Xaa can be Glu, or Asp
  misc_feature (8)..(8): Xaa can be Phe, Leu, Cys, Pro, Ala, Met, Thr, Val, or Ile
SXEVIWDX

SEQ ID NO: 95109 - protein, 9 aa, Artificial Sequence
  Description of Artificial Sequence: Synthetic peptide
  Seed: SEEVIWDVL (MAGC1_HUMAN)
  misc_feature (2)..(2): Xaa can be Glu, Gln, or Asp
  misc_feature (9)..(9): Xaa can be Trp, Ile, Tyr, Met, Phe, Leu, Val, Ala, Cys, Ser, Gln, Gly, Glu, Pro, Arg, Thr, His, or Ly s
SXEVIWDVX

SEQ ID NO: 95110 - protein, 10 aa, Artificial Sequence
  Description of Artificial Sequence: Synthetic peptide
  Seed: SEEVIWDVLS (MAGC1_HUMAN)
  misc_feature (2)..(2): Xaa can be , or Glu
  misc_feature (10)..(10): Xaa can be Leu, Val, Ile, Phe, Pro, Cys, Ala, Thr, Ser, Met, or Gly
SXEVIWDVLX

SEQ ID NO: 95111 - protein, 11 aa, Artificial Sequence
  Description of Artificial Sequence: Synthetic peptide
  Seed: SEEVIWDVLSG (MAGC1_HUMAN)
  misc_feature (2)..(2): Xaa can be , or Glu
  misc_feature (11)..(11): Xaa can be Ala, Gly, Leu, Pro, Thr, Val, Phe, Ser, Cys, Ile, or Met
SXEVIWDVLSX

SEQ ID NO: 95112 - protein, 10 aa, Artificial Sequence
  Description of Artificial Sequence: Synthetic peptide
  Seed: SEGCLSDEQG (MAGC1_HUMAN)
  misc_feature (2)..(2): Xaa can be , or Glu
  misc_feature (10)..(10): Xaa can be Ala, Leu, Cys, Pro, Ser, Thr, Met, Ile, Phe, Val, or Gly
SXGCLSDEQX

SEQ ID NO: 95113 - protein, 11 aa, Artificial Sequence
  Description of Artificial Sequence: Synthetic peptide
  Seed: SEGCLSDEQGM (MAGC1_HUMAN)
  misc_feature (2)..(2): Xaa can be Glu, Gln, or Asp
  misc_feature (11)..(11): Xaa can be Trp, Tyr, Ala, Ile, Phe, Pro, Val, Leu, Met, Cys, or Thr
SXGCLSDEQGX

SEQ ID NO: 95114 - protein, 9 aa, Artificial Sequence
  Description of Artificial Sequence: Synthetic peptide
  Seed: SEGEDSSDP (MAGC1_HUMAN)
  misc_feature (2)..(2): Xaa can be , or Glu
  misc_feature (9)..(9): Xaa can be Cys, Met, Val, Ser, Phe, Ile, Pro, Leu, Ala, or Thr
SXGEDSSDX

SEQ ID NO: 95115 - protein, 10 aa, Artificial Sequence
  Description of Artificial Sequence: Synthetic peptide
  Seed: SEGEDSSDPL (MAGC1_HUMAN)
  misc_feature (2)..(2): Xaa can be Glu, Asp, or Gln
  misc_feature (10)..(10): Xaa can be Trp, Met, Cys, Ile, Ser, Pro, Thr, Phe, Gly, Tyr, Leu, Val, or Ala
SXGEDSSDPX

SEQ ID NO: 95116 - protein, 8 aa, Artificial Sequence
  Description of Artificial Sequence: Synthetic peptide
  Seed: SEPLFTYT (MAGC1_HUMAN)
  misc_feature (2)..(2): Xaa can be , or Glu
  misc_feature (8)..(8): Xaa can be Ile, Val, Met, Cys, Pro, Phe, Leu, Thr, or Ala
SXPLFTYX

SEQ ID NO: 95117 - protein, 9 aa, Artificial Sequence
  Description of Artificial Sequence: Synthetic peptide
  Seed: SEPLFTYTL (MAGC1_HUMAN)
  misc_feature (2)..(2): Xaa can be Arg, Glu, His, Asp, Gln, Ala, Pro, Leu, Lys, Tyr, Met, Phe, Thr, Gly, Val, Ser, Asn, Ile, Trp, or Cys
  misc_feature (9)..(9): Xaa can be Leu, Phe, Met, Ile, Tyr, Val, Ala, Trp, Cys, Thr, Pro, Ser, Gly, His, Lys, or Arg
SXPLFTYTX

SEQ ID NO: 95118 - protein, 8 aa, Artificial Sequence
  Description of Artificial Sequence: Synthetic peptide
  Seed: SERTQSTF (MAGC1_HUMAN)
  misc_feature (2)..(2): Xaa can be Glu, Asp, Gln, Arg, Lys, Met, or His
  misc_feature (8)..(8): Xaa can be Tyr, Phe, Leu, Met, Ile, Trp, Val, Cys, or Ala
SXRTQSTX

SEQ ID NO: 95119 - protein, 10 aa, Artificial Sequence
  Description of Artificial Sequence: Synthetic peptide
  Seed: SERTQSTFEG (MAGC1_HUMAN)
  misc_feature (2)..(2): Xaa can be , or Glu
  misc_feature (10)..(10): Xaa can be Pro, Met, Ala, Ser, Leu, Gly, Val, Cys, Thr, Ile, or Phe
SXRTQSTFEX

SEQ ID NO: 95120 - protein, 11 aa, Artificial Sequence
  Description of Artificial Sequence: Synthetic peptide
  Seed: SERTQSTFEGF (MAGC1_HUMAN)
  misc_feature (2)..(2): Xaa can be Glu, Asp, Gln, or Lys
  misc_feature (11)..(11): Xaa can be Tyr, Phe, Trp, Leu, Thr, Val, Pro, Met, Ala, Ile, or Cys
SXRTQSTFEGX

SEQ ID NO: 95121 - protein, 9 aa, Artificial Sequence
  Description of Artificial Sequence: Synthetic peptide
  Seed: SESLIESEP (MAGC1_HUMAN)
  misc_feature (2)..(2): Xaa can be Glu, Asp, Gln, or Ala
  misc_feature (9)..(9): Xaa can be Leu, Ala, Ile, Pro, Phe, Val, Cys, Met, Thr, Trp, Gln, Asn, Glu, Ser, Lys, Asp, Gly, Arg, or Tyr
SXSLIESEX

SEQ ID NO: 95122 - protein, 10 aa, Artificial Sequence
  Description of Artificial Sequence: Synthetic peptide
  Seed: SESLIESEPL (MAGC1_HUMAN)
  misc_feature (2)..(2): Xaa can be Glu, Asp, or Gln
  misc_feature (10)..(10): Xaa can be Trp, Tyr, Phe, Ala, Thr, Leu, Pro, Ser, Met, Cys, Ile, Val, or Gly
SXSLIESEPX

SEQ ID NO: 95123 - protein, 11 aa, Artificial Sequence
  Description of Artificial Sequence: Synthetic peptide
  Seed: SESLIESEPLF (MAGC1_HUMAN)
  misc_feature (2)..(2): Xaa can be Glu, Asp, or Gln
  misc_feature (11)..(11): Xaa can be Trp, Ser, Met, Tyr, Phe, Gly, Cys, Val, Ala, Pro, Leu, Thr, or Ile
SXSLIESEPLX

SEQ ID NO: 95124 - protein, 8 aa, Artificial Sequence
  Description of Artificial Sequence: Synthetic peptide
  Seed: SESPQSCP (MAGC1_HUMAN)
  misc_feature (2)..(2): Xaa can be , or Glu
  misc_feature (8)..(8): Xaa can be Leu, Cys, Val, Ala, Met, Phe, Thr, Ile, or Pro
SXSPQSCX

SEQ ID NO: 95125 - protein, 9 aa, Artificial Sequence
  Description of Artificial Sequence: Synthetic peptide
  Seed: SESPQSCPE (MAGC1_HUMAN)
  misc_feature (2)..(2): Xaa can be Glu, Asp, or Gln
  misc_feature (9)..(9): Xaa can be Val, Cys, Ala, Ile, Pro, Met, Leu, Gly, Thr, Lys, Trp, Glu, Tyr, Arg, Phe, Asp, Gln, or Se r
SXSPQSCPX

SEQ ID NO: 95126 - protein, 10 aa, Artificial Sequence
  Description of Artificial Sequence: Synthetic peptide
  Seed: SESPQSCPEG (MAGC1_HUMAN)
  misc_feature (2)..(2): Xaa can be Glu, Asp, or Gln
  misc_feature (10)..(10): Xaa can be Ala, Val, Leu, Gly, Met, Tyr, Phe, Ser, Ile, Pro, Cys, or Thr
SXSPQSCPEX

SEQ ID NO: 95127 - protein, 11 aa, Artificial Sequence
  Description of Artificial Sequence: Synthetic peptide
  Seed: SESPQSCPEGE (MAGC1_HUMAN)
  misc_feature (2)..(2): Xaa can be Gly, Arg, Ala, Gln, Val, Met, Asn, Pro, Leu, Asp, Ile, Glu, Lys, Thr, or Ser
  misc_feature (11)..(11): Xaa can be Lys, Phe, Glu, Arg, Tyr, Asn, Leu, His, Met, Gln, Val, Trp, Ile, Asp, Ser, or Gly
SXSPQSCPEGX

SEQ ID NO: 95128 - protein, 8 aa, Artificial Sequence
  Description of Artificial Sequence: Synthetic peptide
  Seed: SEVIKRKV (MAGC1_HUMAN)
  misc_feature (2)..(2): Xaa can be Glu, Asp, Gln, Ala, Gly, Ser, Asn, Met, Arg, or His
  misc_feature (8)..(8): Xaa can be Leu, Ile, Val, Trp, Phe, Met, Tyr, Ala, Cys, His, Ser, Thr, or Pro
SXVIKRKX

SEQ ID NO: 95129 - protein, 9 aa, Artificial Sequence
  Description of Artificial Sequence: Synthetic peptide
  Seed: SEVIKRKVV (MAGC1_HUMAN)
  misc_feature (2)..(2): Xaa can be Glu, Asp, His, Gln, Arg, Pro, Ala, Thr, Met, Ser, Gly, Asn, Lys, Leu, Val, Ile, Tyr, or Ph e
  misc_feature (9)..(9): Xaa can be Leu, Val, Ile, Met, Ala, Phe, Cys, Pro, Tyr, Trp, Thr, Ser, Gly, Lys, Glu, Arg, His, Gln, or Asp
SXVIKRKVX

SEQ ID NO: 95130 - protein, 11 aa, Artificial Sequence
  Description of Artificial Sequence: Synthetic peptide
  Seed: SEVIKRKVVEF (MAGC1_HUMAN)
  misc_feature (2)..(2): Xaa can be Glu, Asp, or Gln
  misc_feature (11)..(11): Xaa can be Trp, Leu, Phe, Cys, Ile, Ala, Pro, Met, Gly, Ser, Thr, Val, or Tyr
SXVIKRKVVEX

SEQ ID NO: 95131 - protein, 8 aa, Artificial Sequence
  Description of Artificial Sequence: Synthetic peptide
  Seed: SFFSSALL (MAGC1_HUMAN)
  misc_feature (2)..(2): Xaa can be Phe, Tyr, or Trp
  misc_feature (8)..(8): Xaa can be Phe, Leu, Met, Tyr, Val, or Ile
SXFSSALX

SEQ ID NO: 95132 - protein, 10 aa, Artificial Sequence
  Description of Artificial Sequence: Synthetic peptide
  Seed: SFFSSALLSI (MAGC1_HUMAN)
  misc_feature (2)..(2): Xaa can be Tyr, Phe, Trp, His, Thr, Lys, Glu, Ser, Asn, Ala, Met, Val, Ile, Gln, Pro, Gly, Leu, Arg, Cys, or Asp
  misc_feature (10)..(10): Xaa can be Leu, Tyr, Phe, Trp, Met, Ile, Val, His, Ala, or Cys
SXFSSALLSX

SEQ ID NO: 95133 - protein, 11 aa, Artificial Sequence
  Description of Artificial Sequence: Synthetic peptide
  Seed: SFFSSALLSIF (MAGC1_HUMAN)
  misc_feature (2)..(2): Xaa can be Tyr, Gln, Ser, Met, Ala, Trp, Phe, Thr, Lys, Val, Arg, Glu, Leu, His, Gly, Asp, Ile, Pro, Cys, or Asn
  misc_feature (11)..(11): Xaa can be Phe, Tyr, Trp, Met, Leu, Ile, His, Val, Ala, Glu, Gln, Cys, Asp, Asn, Gly, Ser, Pro, Thr, Arg, or Lys
SXFSSALLSIX

SEQ ID NO: 95134 - protein, 9 aa, Artificial Sequence
  Description of Artificial Sequence: Synthetic peptide
  Seed: SFFSYTLAS (MAGC1_HUMAN)
  misc_feature (2)..(2): Xaa can be Tyr, Phe, Trp, Met, Ala, Ser, His, Val, Thr, Leu, Gly, Ile, Arg, Gln, Pro, Lys, Cys, or As n
  misc_feature (9)..(9): Xaa can be Phe, Tyr, Met, Leu, Ile, Val, Trp, His, Ala, Thr, Ser, Lys, Cys, Gly, Gln, Asn, Pro, Arg, or Glu
SXFSYTLAX

SEQ ID NO: 95135 - protein, 10 aa, Artificial Sequence
  Description of Artificial Sequence: Synthetic peptide
  Seed: SFFSYTLASL (MAGC1_HUMAN)
  misc_feature (2)..(2): Xaa can be Met, Leu, Arg, Tyr, Ile, Val, Gln, Ala, Thr, Ser, Phe, Trp, Gly, Lys, Asp, Asn, His, Glu, Pro, or Cys
  misc_feature (10)..(10): Xaa can be Phe, Trp, Leu, Tyr, Met, Val, Ile, Ala, Thr, Cys, Gly, His, Ser, Pro, Lys, or Arg
SXFSYTLASX

SEQ ID NO: 95136 - protein, 11 aa, Artificial Sequence
  Description of Artificial Sequence: Synthetic peptide
  Seed: SFFSYTLASLL (MAGC1_HUMAN)
  misc_feature (2)..(2): Xaa can be Tyr, Ser, Phe, Ala, Trp, Thr, Val, Met, Cys, Lys, Asn, Asp, His, Pro, Arg, Gly, Leu, Ile, Glu, or Gln
  misc_feature (11)..(11): Xaa can be Tyr, Met, Trp, Phe, Leu, Ile, Val, Cys, Asn, His, Arg, Asp, Pro, Glu, Ala, Gly, Gln, Ser, Lys, or Thr
SXFSYTLASLX

SEQ ID NO: 95137 - protein, 9 aa, Artificial Sequence
  Description of Artificial Sequence: Synthetic peptide
  Seed: SFPSSTSSS (MAGC1_HUMAN)
  misc_feature (2)..(2): Xaa can be Tyr, Phe, Trp, Leu, Met, Val, Ala, Gln, Ile, His, Arg, Thr, Lys, Gly, Ser, Pro, Cys, or As n
  misc_feature (9)..(9): Xaa can be Met, Phe, Tyr, Leu, Ile, Val, Trp, His, Ala, Ser, Thr, Cys, Gln, Lys, or Gly
SXPSSTSSX

SEQ ID NO: 95138 - protein, 10 aa, Artificial Sequence
  Description of Artificial Sequence: Synthetic peptide
  Seed: SFPSSTSSSL (MAGC1_HUMAN)
  misc_feature (2)..(2): Xaa can be Phe, Ala, Tyr, Ile, Gly, Thr, Val, Trp, Leu, Met, Ser, Arg, Asn, Cys, Gln, Glu, Asp, Pro, Lys, or His
  misc_feature (10)..(10): Xaa can be Thr, Val, Tyr, Ile, Phe, Cys, Ala, Met, Leu, Lys, Arg, Trp, or His
SXPSSTSSSX

SEQ ID NO: 95139 - protein, 11 aa, Artificial Sequence
  Description of Artificial Sequence: Synthetic peptide
  Seed: SFPSSTSSSLS (MAGC1_HUMAN)
  misc_feature (2)..(2): Xaa can be Val, Gly, Tyr, Gln, Cys, Pro, His, Trp, Arg, Ile, Thr, Ala, Lys, Leu, Asn, Phe, Asp, Ser, Glu, or Met
  misc_feature (11)..(11): Xaa can be Ile, Leu, Asp, Lys, Phe, Pro, Val, Ala, Arg, Trp, Met, Glu, Asn, Tyr, Ser, Cys, Gln, Gly, His, or Thr
SXPSSTSSSLX

SEQ ID NO: 95140 - protein, 9 aa, Artificial Sequence
  Description of Artificial Sequence: Synthetic peptide
  Seed: SFSERTQST (MAGC1_HUMAN)
  misc_feature (2)..(2): Xaa can be Tyr, Phe, Trp, Met, Ala, Leu, Val, Ile, Gly, Thr, Gln, Arg, His, Ser, Cys, Asn, or Pro
  misc_feature (9)..(9): Xaa can be Leu, Phe, Met, Tyr, Ile, Val, Ala, Trp, His, Cys, Thr, Arg, Gln, Lys, or Ser
SXSERTQSX

SEQ ID NO: 95141 - protein, 10 aa, Artificial Sequence
  Description of Artificial Sequence: Synthetic peptide
  Seed: SFSERTQSTF (MAGC1_HUMAN)
  misc_feature (2)..(2): Xaa can be Ala, Arg, Tyr, Val, Thr, Trp, Ser, Gln, Met, Ile, Leu, Phe, Glu, His, Lys, Gly, Asn, Cys, Pro, or Asp
  misc_feature (10)..(10): Xaa can be Tyr, Phe, Leu, Met, Trp, Lys, Ile, Val, or Arg
SXSERTQSTX

SEQ ID NO: 95142 - protein, 8 aa, Artificial Sequence
  Description of Artificial Sequence: Synthetic peptide
  Seed: SFSSSTSL (MAGC1_HUMAN)
  misc_feature (2)..(2): Xaa can be Phe, Tyr, Trp, Ser, Ile, or Ala
  misc_feature (8)..(8): Xaa can be Leu, Phe, Tyr, Met, Ile, or Val
SXSSSTSX

SEQ ID NO: 95143 - protein, 11 aa, Artificial Sequence
  Description of Artificial Sequence: Synthetic peptide
  Seed: SFSSSTSLSPF (MAGC1_HUMAN)
  misc_feature (2)..(2): Xaa can be Tyr, Arg, Gln, Trp, Phe, Met, Lys, Ser, Leu, Thr, Asp, Val, His, Asn, Cys, Ile, Gly, Glu, Pro, or Ala
  misc_feature (11)..(11): Xaa can be Phe, Trp, Tyr, Met, Leu, or Ile
SXSSSTSLSPX

SEQ ID NO: 95144 - protein, 9 aa, Artificial Sequence
  Description of Artificial Sequence: Synthetic peptide
  Seed: SFSSTLLSI (MAGC1_HUMAN)
  misc_feature (2)..(2): Xaa can be , or Phe
  misc_feature (9)..(9): Xaa can be Leu, or Ile
SXSSTLLSX

SEQ ID NO: 95145 - protein, 10 aa, Artificial Sequence
  Description of Artificial Sequence: Synthetic peptide
  Seed: SFSSTLLSIF (MAGC1_HUMAN)
  misc_feature (2)..(2): Xaa can be Tyr, Met, Thr, Ser, Trp, Lys, Phe, Pro, Val, Leu, Ile, or His
  misc_feature (10)..(10): Xaa can be Phe, Tyr, Trp, Met, Leu, Ile, Asp, Ser, Asn, Thr, Gln, Glu, Lys, Arg, His, Pro, Val, Ala, Cys, or Gly
SXSSTLLSIX

SEQ ID NO: 95146 - protein, 10 aa, Artificial Sequence
  Description of Artificial Sequence: Synthetic peptide
  Seed: SFSSTLLSIL (MAGC1_HUMAN)
  misc_feature (2)..(2): Xaa can be Gln, Ala, Gly, Asn, Arg, Cys, Asp, Glu, or Phe
  misc_feature (10)..(10): Xaa can be Phe, Tyr, Met, Trp, Leu, Ile, or His
SXSSTLLSIX

SEQ ID NO: 95147 - protein, 9 aa, Artificial Sequence
  Description of Artificial Sequence: Synthetic peptide
  Seed: SFSSTLLSL (MAGC1_HUMAN)
  misc_feature (2)..(2): Xaa can be , or Phe
  misc_feature (9)..(9): Xaa can be Ile, or Leu
SXSSTLLSX

SEQ ID NO: 95148 - protein, 10 aa, Artificial Sequence
  Description of Artificial Sequence: Synthetic peptide
  Seed: SFSSTLLSLF (MAGC1_HUMAN)
  misc_feature (2)..(2): Xaa can be Ser, or Phe
  misc_feature (10)..(10): Xaa can be , or Phe
SXSSTLLSLX

SEQ ID NO: 95149 - protein, 9 aa, Artificial Sequence
  Description of Artificial Sequence: Synthetic peptide
  Seed: SFSSTLVSL (MAGC1_HUMAN)
  misc_feature (2)..(2): Xaa can be Ala, Arg, Leu, Met, Tyr, Gln, Ile, Thr, Val, Phe, Ser, Gly, Glu, Asn, Pro, Trp, Cys, Asp, Lys, or His
  misc_feature (9)..(9): Xaa can be Met, Ile, Phe, Val, Tyr, Leu, Lys, Arg, His, Trp, Ala, Cys, Thr, Gln, Gly, Pro, Ser, or As n
SXSSTLVSX

SEQ ID NO: 95150 - protein, 10 aa, Artificial Sequence
  Description of Artificial Sequence: Synthetic peptide
  Seed: SFSSTLVSLF (MAGC1_HUMAN)
  misc_feature (2)..(2): Xaa can be Tyr, Gln, Ser, Met, Trp, Arg, Leu, Phe, Ala, Lys, Val, Thr, Asn, Ile, Asp, Glu, Pro, Cys, His, or Gly
  misc_feature (10)..(10): Xaa can be Ile, Trp, Met, Tyr, Phe, Leu, His, or Val
SXSSTLVSLX

SEQ ID NO: 95151 - protein, 9 aa, Artificial Sequence
  Description of Artificial Sequence: Synthetic peptide
  Seed: SFSYTLLSL (MAGC1_HUMAN)
  misc_feature (2)..(2): Xaa can be Arg, Ala, Tyr, Phe, Gln, Thr, Trp, Ser, Gly, Val, Met, Ile, His, Asn, Leu, Glu, Lys, Cys, Pro, or Asp
  misc_feature (9)..(9): Xaa can be Met, Leu, Phe, Tyr, Ile, Val, Trp, His, Ala, Lys, Cys, Arg, Thr, or Gln
SXSYTLLSX

SEQ ID NO: 95152 - protein, 10 aa, Artificial Sequence
  Description of Artificial Sequence: Synthetic peptide
  Seed: SFSYTLLSLF (MAGC1_HUMAN)
  misc_feature (2)..(2): Xaa can be Gln, Tyr, Met, Thr, Gly, Asp, His, Pro, Ile, Phe, Glu, Leu, Trp, Val, Lys, Cys, Ser, Arg, Asn, or Ala
  misc_feature (10)..(10): Xaa can be Tyr, Met, Trp, Phe, Leu, Ile, His, Val, Ala, or Cys
SXSYTLLSLX

SEQ ID NO: 95153 - protein, 9 aa, Artificial Sequence
  Description of Artificial Sequence: Synthetic peptide
  Seed: SGIGVRAGR (MAGC1_HUMAN)
  misc_feature (2)..(2): Xaa can be Ala, Thr, Val, Ser, Ile, Met, Leu, Gln, Arg, Gly, Phe, Asn, Cys, Tyr, Glu, Pro, Asp, His, Trp, or Lys
  misc_feature (9)..(9): Xaa can be Arg, Lys, Tyr, Phe, Met, Leu, His, Ile, Val, Ala, Trp, Gln, Glu, Cys, or Thr
SXIGVRAGX

SEQ ID NO: 95154 - protein, 9 aa, Artificial Sequence
  Description of Artificial Sequence: Synthetic peptide
  Seed: SHESPQSPP (MAGC1_HUMAN)
  misc_feature (2)..(2): Xaa can be His, Arg, Gln, or Pro
  misc_feature (9)..(9): Xaa can be Ala, Val, Leu, Cys, Ile, Pro, Met, or Thr
SXESPQSPX

SEQ ID NO: 95155 - protein, 11 aa, Artificial Sequence
  Description of Artificial Sequence: Synthetic peptide
  Seed: SICSSSTPSSL (MAGC1_HUMAN)
  misc_feature (2)..(2): Xaa can be Ala, Met, Gly, Leu, Gln, Val, Ile, Arg, Thr, Ser, Glu, Pro, Phe, Tyr, Cys, Trp, Asn, Asp, His, or Lys
  misc_feature (11)..(11): Xaa can be Tyr, Phe, Lys, Leu, Met, Arg, Trp, Ile, His, Val, Ala, Asn, Cys, Gln, or Glu
SXCSSSTPSSX

SEQ ID NO: 95156 - protein, 9 aa, Artificial Sequence
  Description of Artificial Sequence: Synthetic peptide
  Seed: SICSSSTSL (MAGC1_HUMAN)
  misc_feature (2)..(2): Xaa can be Pro, Ala, Leu, Glu, Met, Arg, Tyr, Gln, Val, Ser, Ile, Thr, Phe, Gly, Asn, Asp, Trp, His, Lys, or Cys
  misc_feature (9)..(9): Xaa can be Tyr, Leu, Met, Phe, Ile, Val, Arg, Trp, Lys, His, Ala, Cys, Thr, Ser, Gln, Pro, or Gly
SXCSSSTSX

SEQ ID NO: 95157 - protein, 11 aa, Artificial Sequence
  Description of Artificial Sequence: Synthetic peptide
  Seed: SICSSSTSLSL (MAGC1_HUMAN)
  misc_feature (2)..(2): Xaa can be Gln, Met, Val, Leu, Thr, Ser, Ile, Ala, Cys, Gly, Glu, Arg, Phe, Pro, Tyr, Asn, His, Trp, Asp, or Lys
  misc_feature (11)..(11): Xaa can be Phe, Trp, Tyr, Lys, Leu, Met, Arg, Ile, Val, His, Ala, or Cys
SXCSSSTSLSX

SEQ ID NO: 95158 - protein, 9 aa, Artificial Sequence
  Description of Artificial Sequence: Synthetic peptide
  Seed: SIFQSSPER (MAGC1_HUMAN)
  misc_feature (2)..(2): Xaa can be Met, Val, Leu, Thr, Ser, Ile, Gly, Phe, Ala, Cys, Tyr, Trp, Pro, Gln, Asn, Glu, Arg, Asp, or His
  misc_feature (9)..(9): Xaa can be Lys, Arg, Tyr, Leu, Met, Phe, Ile, Val, His, Ala, Trp, Cys, Ser, or Thr
SXFQSSPEX

SEQ ID NO: 95159 - protein, 10 aa, Artificial Sequence
  Description of Artificial Sequence: Synthetic peptide
  Seed: SIFQSSPESA (MAGC1_HUMAN)
  misc_feature (2)..(2): Xaa can be Met, Leu, Val, Thr, Ile, Gln, Ala, Ser, or Glu
  misc_feature (10)..(10): Xaa can be Val, Ile, Leu, Ala, Met, Thr, Phe, or Cys
SXFQSSPESX

SEQ ID NO: 95160 - protein, 10 aa, Artificial Sequence
  Description of Artificial Sequence: Synthetic peptide
  Seed: SIFQSSPEST (MAGC1_HUMAN)
  misc_feature (2)..(2): Xaa can be Ile, or Ala
  misc_feature (10)..(10): Xaa can be Ala, or Thr
SXFQSSPESX

SEQ ID NO: 95161 - protein, 9 aa, Artificial Sequence
  Description of Artificial Sequence: Synthetic peptide
  Seed: SIIFIKGTY (MAGC1_HUMAN)
  misc_feature (2)..(2): Xaa can be Gln, Pro, Ala, Thr, Ser, Met, Val, Ile, Gly, Leu, Glu, Cys, Lys, Arg, Asn, Phe, Tyr, Asp, His, or Trp
  misc_feature (9)..(9): Xaa can be Tyr, Phe, Lys, Arg, Met, Trp, Leu, His, Val, Ile, or Ala
SXIFIKGTX

SEQ ID NO: 95162 - protein, 10 aa, Artificial Sequence
  Description of Artificial Sequence: Synthetic peptide
  Seed: SIIFIKGTYA (MAGC1_HUMAN)
  misc_feature (2)..(2): Xaa can be Met, Leu, Thr, Val, Ser, Phe, Gln, Ala, Ile, Tyr, Gly, Arg, Asp, Glu, Trp, His, Pro, Cys, Lys, or Asn
  misc_feature (10)..(10): Xaa can be Ile, Ala, Val, Leu, Met, Thr, or Ser
SXIFIKGTYX

SEQ ID NO: 95163 - protein, 10 aa, Artificial Sequence
  Description of Artificial Sequence: Synthetic peptide
  Seed: SILQSSPESA (MAGC1_HUMAN)
  misc_feature (2)..(2): Xaa can be Met, Leu, Gln, Val, Ile, Thr, Ala, or Ser
  misc_feature (10)..(10): Xaa can be Val, Ile, Leu, Ala, Met, or Thr
SXLQSSPESX

SEQ ID NO: 95164 - protein, 9 aa, Artificial Sequence
  Description of Artificial Sequence: Synthetic peptide
  Seed: SKSSPESPL (MAGC1_HUMAN)
  misc_feature (2)..(2): Xaa can be Gln, Arg, Met, Lys, Ala, Tyr, His, Phe, Ser, Thr, Asn, Glu, Gly, Val, Leu, Ile, Trp, Pro, Asp, or Cys
  misc_feature (9)..(9): Xaa can be Leu, Tyr, Met, Phe, Ile, Val, Trp, His, Ala, or Cys
SXSSPESPX

SEQ ID NO: 95165 - protein, 9 aa, Artificial Sequence
  Description of Artificial Sequence: Synthetic peptide
  Seed: SLFQSFSER (MAGC1_HUMAN)
  misc_feature (2)..(2): Xaa can be Ala, Ser, Val, Thr, Gly, Ile, Leu, Met, Tyr, Phe, Gln, Cys, Glu, Pro, Asn, Trp, Asp, Lys, Arg, or His
  misc_feature (9)..(9): Xaa can be Tyr, Arg, Phe, Lys, Met, Leu, His, Ile, Trp, Val, Ala, Gln, Cys, Thr, Pro, Ser, Gly, or As n
SXFQSFSEX

SEQ ID NO: 95166 - protein, 10 aa, Artificial Sequence
  Description of Artificial Sequence: Synthetic peptide
  Seed: SLFQSFSERT (MAGC1_HUMAN)
  misc_feature (2)..(2): Xaa can be Leu, Val, Trp, Phe, Thr, Ile, Tyr, Met, Ser, Gln, Ala, Cys, His, Lys, Gly, Arg, Asn, Pro, Glu, or Asp
  misc_feature (10)..(10): Xaa can be Lys, Arg, Ile, Leu, Ala, Val, Met, His, Pro, Tyr, Gln, Asp, Glu, Asn, Thr, Cys, Trp, Phe, Ser, or Gly
SXFQSFSERX

SEQ ID NO: 95167 - protein, 10 aa, Artificial Sequence
  Description of Artificial Sequence: Synthetic peptide
  Seed: SLFQSSPECT (MAGC1_HUMAN)
  misc_feature (2)..(2): Xaa can be Leu, Met, Ile, Thr, Gln, Val, Ala, or Ser
  misc_feature (10)..(10): Xaa can be Val, Ile, Leu, Met, Ala, or Thr
SXFQSSPECX

SEQ ID NO: 95168 - protein, 10 aa, Artificial Sequence
  Description of Artificial Sequence: Synthetic peptide
  Seed: SLFQSSPERT (MAGC1_HUMAN)
  misc_feature (2)..(2): Xaa can be Leu, Met, Ile, Gln, Thr, Val, Ala, or Ser
  misc_feature (10)..(10): Xaa can be Val, Leu, Ile, Ala, Met, Phe, Thr, or Cys
SXFQSSPERX

SEQ ID NO: 95169 - protein, 11 aa, Artificial Sequence
  Description of Artificial Sequence: Synthetic peptide
  Seed: SLFQSSPERTH (MAGC1_HUMAN)
  misc_feature (2)..(2): Xaa can be Ala, Val, Ser, Gln, Thr, Ile, Leu, Glu, Met, Gly, Cys, Asp, Asn, Lys, Tyr, Phe, Arg, Pro, His, or Trp
  misc_feature (11)..(11): Xaa can be Tyr, Phe, Met, Leu, His, Lys, Trp, Ile, Val, Arg, Ala, Thr, Cys, or Gln
SXFQSSPERTX

SEQ ID NO: 95170 - protein, 11 aa, Artificial Sequence
  Description of Artificial Sequence: Synthetic peptide
  Seed: SLHFPQSPPEW (MAGC1_HUMAN)
  misc_feature (2)..(2): Xaa can be Tyr, Leu, Cys, Pro, Gln, Gly, Asp, Val, Phe, Arg, Met, Glu, Thr, Ala, Ser, Ile, Asn, Trp, His, or Lys
  misc_feature (11)..(11): Xaa can be Phe, Trp, Ile, Met, or Leu
SXHFPQSPPEX

SEQ ID NO: 95171 - protein, 8 aa, Artificial Sequence
  Description of Artificial Sequence: Synthetic peptide
  Seed: SLIESEPL (MAGC1_HUMAN)
  misc_feature (2)..(2): Xaa can be Met, or Leu
  misc_feature (8)..(8): Xaa can be Ile, Val, or Leu
SXIESEPX

SEQ ID NO: 95172 - protein, 9 aa, Artificial Sequence
  Description of Artificial Sequence: Synthetic peptide
  Seed: SLIESEPLF (MAGC1_HUMAN)
  misc_feature (2)..(2): Xaa can be Met, Leu, Gln, Thr, Ala, Val, Ile, Ser, Tyr, Arg, Phe, Trp, Gly, Asn, Glu, Asp, His, Lys, Cys, or Pro
  misc_feature (9)..(9): Xaa can be Trp, Leu, Phe, Met, Tyr, Lys, Val, Ile, Arg, His, Ala, Cys, Thr, or Ser
SXIESEPLX

SEQ ID NO: 95173 - protein, 10 aa, Artificial Sequence
  Description of Artificial Sequence: Synthetic peptide
  Seed: SLIESEPLFT (MAGC1_HUMAN)
  misc_feature (2)..(2): Xaa can be Leu, Met, Ile, Gln, Val, Thr, Ala, Ser, or Phe
  misc_feature (10)..(10): Xaa can be Val, Ile, Leu, Ala, Met, Thr, Phe, Cys, Ser, or Tyr
SXIESEPLFX

SEQ ID NO: 95174 - protein, 11 aa, Artificial Sequence
  Description of Artificial Sequence: Synthetic peptide
  Seed: SLIESEPLFTY (MAGC1_HUMAN)
  misc_feature (2)..(2): Xaa can be Met, Leu, Ile, Gln, Val, Thr, Ala, Glu, Ser, Gly, Cys, Asn, Pro, Phe, Trp, Tyr, Lys, Asp, His, or Arg
  misc_feature (11)..(11): Xaa can be Tyr, Trp, Phe, Lys, Arg, Leu, Met, His, Ile, Val, Ala, Cys, Thr, or Ser
SXIESEPLFTX

SEQ ID NO: 95175 - protein, 9 aa, Artificial Sequence
  Description of Artificial Sequence: Synthetic peptide
  Seed: SLLQIPMTS (MAGC1_HUMAN)
  misc_feature (2)..(2): Xaa can be , or Leu
  misc_feature (9)..(9): Xaa can be , or Ser
SXLQIPMTX

SEQ ID NO: 95176 - protein, 11 aa, Artificial Sequence
  Description of Artificial Sequence: Synthetic peptide
  Seed: SLLQIPMTSSF (MAGC1_HUMAN)
  misc_feature (2)..(2): Xaa can be Pro, or Leu
  misc_feature (11)..(11): Xaa can be , or Phe
SXLQIPMTSSX

SEQ ID NO: 95177 - protein, 9 aa, Artificial Sequence
  Description of Artificial Sequence: Synthetic peptide
  Seed: SLLQSSHES (MAGC1_HUMAN)
  misc_feature (2)..(2): Xaa can be Met, Leu, Ile, Gln, Val, Thr, Ala, or Phe
  misc_feature (9)..(9): Xaa can be Val, Leu, Ile, Ala, Met, Thr, Phe, Cys, or Ser
SXLQSSHEX

SEQ ID NO: 95178 - protein, 9 aa, Artificial Sequence
  Description of Artificial Sequence: Synthetic peptide
  Seed: SLPEWEDSL (MAGC1_HUMAN)
  misc_feature (2)..(2): Xaa can be Leu, Met, Tyr, Arg, Ala, Val, Thr, Gln, Ile, Phe, Ser, Glu, His, Gly, Cys, Trp, Asn, Pro, Lys, or Asp
  misc_feature (9)..(9): Xaa can be Leu, Met, Ile, Tyr, Phe, Lys, Val, Arg, Trp, His, Ala, Cys, or Thr
SXPEWEDSX

SEQ ID NO: 95179 - protein, 9 aa, Artificial Sequence
  Description of Artificial Sequence: Synthetic peptide
  Seed: SLPQSFPES (MAGC1_HUMAN)
  misc_feature (2)..(2): Xaa can be Leu, Met, Ile, Val, Thr, Gln, Ser, Ala, Gly, Phe, Cys, Glu, Asn, or Tyr
  misc_feature (9)..(9): Xaa can be Val, Leu, Met, Ile, Phe, Ala, Cys, Thr, Tyr, or Ser
SXPQSFPEX

SEQ ID NO: 95180 - protein, 10 aa, Artificial Sequence
  Description of Artificial Sequence: Synthetic peptide
  Seed: SLQIPVSPSF (MAGC1_HUMAN)
  misc_feature (2)..(2): Xaa can be Met, Ala, Arg, Trp, Gln, His, Tyr, Ser, Asn, Pro, Ile, Asp, Val, Leu, Cys, Lys, Thr, Phe, Glu, or Gly
  misc_feature (10)..(10): Xaa can be Trp, Leu, Met, Ile, Phe, Tyr, His, or Val
SXQIPVSPSX

SEQ ID NO: 95181 - protein, 11 aa, Artificial Sequence
  Description of Artificial Sequence: Synthetic peptide
  Seed: SLQIPVSPSFS (MAGC1_HUMAN)
  misc_feature (2)..(2): Xaa can be Asn, Arg, Tyr, Phe, Thr, Ser, Val, Trp, Lys, Gln, Gly, Met, Ala, Asp, Leu, Glu, Ile, Pro, His, or Cys
  misc_feature (11)..(11): Xaa can be Ser, Pro, Ile, Gly, Phe, Glu, Thr, Ala, Val, Lys, Leu, His, Cys, Trp, Asp, Asn, Met, Arg, Tyr, or Gln
SXQIPVSPSFX

SEQ ID NO: 95182 - protein, 11 aa, Artificial Sequence
  Description of Artificial Sequence: Synthetic peptide
  Seed: SLREVDPDDSY (MAGC1_HUMAN)
  misc_feature (2)..(2): Xaa can be Leu, Gln, Ala, Met, Val, Ile, Thr, Ser, Glu, Gly, Pro, Asp, Asn, Cys, Arg, Lys, Phe, Tyr, Trp, or His
  misc_feature (11)..(11): Xaa can be Tyr, Lys, Phe, Trp, Arg, Met, Leu, His, Ile, or Val
SXREVDPDDSX

SEQ ID NO: 95183 - protein, 11 aa, Artificial Sequence
  Description of Artificial Sequence: Synthetic peptide
  Seed: SLSKSSPESPL (MAGC1_HUMAN)
  misc_feature (2)..(2): Xaa can be Met, or Leu
  misc_feature (11)..(11): Xaa can be Val, or Leu
SXSKSSPESPX

SEQ ID NO: 95184 - protein, 8 aa, Artificial Sequence
  Description of Artificial Sequence: Synthetic peptide
  Seed: SLSLPQSF (MAGC1_HUMAN)
  misc_feature (2)..(2): Xaa can be Ala, Thr, Ser, Val, Gly, Ile, Met, Gln, Phe, Leu, Pro, Cys, Glu, or Tyr
  misc_feature (8)..(8): Xaa can be Tyr, Phe, Leu, Met, Lys, Ile, Val, Trp, or Arg
SXSLPQSX

SEQ ID NO: 95185 - protein, 9 aa, Artificial Sequence
  Description of Artificial Sequence: Synthetic peptide
  Seed: SLSPFSEES (MAGC1_HUMAN)
  misc_feature (2)..(2): Xaa can be Met, Leu, Ile, Val, Gln, Thr, Ala, Ser, Gly, Glu, Asn, Cys, or Phe
  misc_feature (9)..(9): Xaa can be Val, Leu, Ile, Ala, Met, Thr, Phe, Cys, Ser, or Gly
SXSPFSEEX

SEQ ID NO: 95186 - protein, 9 aa, Artificial Sequence
  Description of Artificial Sequence: Synthetic peptide
  Seed: SLSPHYFPQ (MAGC1_HUMAN)
  misc_feature (2)..(2): Xaa can be Met, Leu, Val, Ile, Thr, Ala, Ser, Gln, Tyr, Phe, Asp, His, Glu, Trp, Lys, Pro, Gly, Cys, Asn, or Arg
  misc_feature (9)..(9): Xaa can be Arg, Lys, Tyr, His, Leu, Met, Phe, Val, Ile, Ala, Trp, Gln, or Thr
SXSPHYFPX

SEQ ID NO: 95187 - protein, 10 aa, Artificial Sequence
  Description of Artificial Sequence: Synthetic peptide
  Seed: SLSPLHFPQF (MAGC1_HUMAN)
  misc_feature (2)..(2): Xaa can be Leu, Met, Val, Ser, Ala, Ile, Tyr, Gln, Phe, Thr, Trp, Gly, Glu, Lys, His, Asn, Pro, Cys, Arg, or Asp
  misc_feature (10)..(10): Xaa can be Phe, Trp, Tyr, Met, Leu, Arg, Ile, Val, Lys, His, Ala, Thr, or Cys
SXSPLHFPQX

SEQ ID NO: 95188 - protein, 8 aa, Artificial Sequence
  Description of Artificial Sequence: Synthetic peptide
  Seed: SLSQSSPV (MAGC1_HUMAN)
  misc_feature (2)..(2): Xaa can be Met, or Leu
  misc_feature (8)..(8): Xaa can be , or Val
SXSQSSPX

SEQ ID NO: 95189 - protein, 11 aa, Artificial Sequence
  Description of Artificial Sequence: Synthetic peptide
  Seed: SLSQSSPVSSF (MAGC1_HUMAN)
  misc_feature (2)..(2): Xaa can be Ala, Gly, Arg, Val, Ser, Leu, Ile, Tyr, Thr, Gln, Met, Pro, Cys, His, Glu, Phe, Asn, Asp, Trp, or Lys
  misc_feature (11)..(11): Xaa can be Phe, Lys, Met, Tyr, Trp, Leu, Arg, Ile, His, Val, Ala, Gln, Cys, Asn, Gly, Thr, or Glu
SXSQSSPVSSX

SEQ ID NO: 95190 - protein, 9 aa, Artificial Sequence
  Description of Artificial Sequence: Synthetic peptide
  Seed: SLTDSESLI (MAGC1_HUMAN)
  misc_feature (2)..(2): Xaa can be Leu, Met, Gln, Ala, Ile, Val, Ser, Thr, Gly, Glu, Asn, Phe, or Cys
  misc_feature (9)..(9): Xaa can be Leu, Met, Val, Trp, Ile, Phe, Ala, or Tyr
SXTDSESLX

SEQ ID NO: 95191 - protein, 9 aa, Artificial Sequence
  Description of Artificial Sequence: Synthetic peptide
  Seed: SMSPLYFPQ (MAGC1_HUMAN)
  misc_feature (2)..(2): Xaa can be Met, Leu, Ile, Thr, Val, Ala, Gln, Ser, Phe, Trp, Tyr, Gly, Lys, Asn, Asp, Pro, Arg, Glu, Cys, or His
  misc_feature (9)..(9): Xaa can be Lys, Arg, His, Tyr, Leu, Val, Phe, Ile, Met, Ala, Gln, or Thr
SXSPLYFPX

SEQ ID NO: 95192 - protein, 10 aa, Artificial Sequence
  Description of Artificial Sequence: Synthetic peptide
  Seed: SMSPLYFPQS (MAGC1_HUMAN)
  misc_feature (2)..(2): Xaa can be Leu, Met, Ile, Val, Gln, Thr, Ser, or Ala
  misc_feature (10)..(10): Xaa can be Val, Leu, Ile, Ala, Met, Phe, Ser, or Thr
SXSPLYFPQX

SEQ ID NO: 95193 - protein, 9 aa, Artificial Sequence
  Description of Artificial Sequence: Synthetic peptide
  Seed: SPECTQSTF (MAGC1_HUMAN)
  misc_feature (2)..(2): Xaa can be Pro, Gln, Ala, Val, Met, Phe, Ser, Ile, Leu, Tyr, Asn, Trp, Glu, His, Thr, Gly, Asp, Cys, Arg, or Lys
  misc_feature (9)..(9): Xaa can be Tyr, Phe, Met, Trp, Leu, Ile, Thr, Val, His, or Ala
SXECTQSTX

SEQ ID NO: 95194 - protein, 11 aa, Artificial Sequence
  Description of Artificial Sequence: Synthetic peptide
  Seed: SPEGDDTQSPL (MAGC1_HUMAN)
  misc_feature (2)..(2): Xaa can be Pro, Ala, or Val
  misc_feature (11)..(11): Xaa can be Tyr, Trp, Phe, Ile, Met, Leu, Ala, or Val
SXEGDDTQSPX

SEQ ID NO: 95195 - protein, 8 aa, Artificial Sequence
  Description of Artificial Sequence: Synthetic peptide
  Seed: SPEGKDSL (MAGC1_HUMAN)
  misc_feature (2)..(2): Xaa can be , or Pro
  misc_feature (8)..(8): Xaa can be , or Leu
SXEGKDSX

SEQ ID NO: 95196 - protein, 11 aa, Artificial Sequence
  Description of Artificial Sequence: Synthetic peptide
  Seed: SPEGKDSLSPL (MAGC1_HUMAN)
  misc_feature (2)..(2): Xaa can be Pro, or Ala
  misc_feature (11)..(11): Xaa can be Tyr, Phe, Val, Met, Ala, Cys, Ile, Leu, or Trp
SXEGKDSLSPX

SEQ ID NO: 95197 - protein, 9 aa, Artificial Sequence
  Description of Artificial Sequence: Synthetic peptide
  Seed: SPERTHSTF (MAGC1_HUMAN)
  misc_feature (2)..(2): Xaa can be Pro, Ala, His, Val, Gln, Ile, Phe, Met, Ser, Leu, Glu, Arg, Asp, Tyr, Lys, Asn, Gly, Trp, Thr, or Cys
  misc_feature (9)..(9): Xaa can be Tyr, Phe, Met, Leu, Trp, Ala, Thr, Cys, Val, Ile, Pro, or Ser
SXERTHSTX

SEQ ID NO: 95198 - protein, 10 aa, Artificial Sequence
  Description of Artificial Sequence: Synthetic peptide
  Seed: SPERTHSTFE (MAGC1_HUMAN)
  misc_feature (2)..(2): Xaa can be Pro, or Val
  misc_feature (10)..(10): Xaa can be Leu, Pro, Val, Cys, His, Met, Tyr, Ser, Trp, Thr, Glu, Ile, Phe, Gly, or Ala
SXERTHSTFX

SEQ ID NO: 95199 - protein, 9 aa, Artificial Sequence
  Description of Artificial Sequence: Synthetic peptide
  Seed: SPERTQSTF (MAGC1_HUMAN)
  misc_feature (2)..(2): Xaa can be Pro, Gln, Ala, Val, Glu, Met, Phe, Leu, Ile, Thr, His, Tyr, Gly, Trp, Ser, Arg, Asn, Asp, or Cys
  misc_feature (9)..(9): Xaa can be Tyr, Phe, Met, Trp, Leu, Pro, Val, Thr, Ile, Ala, or Cys
SXERTQSTX

SEQ ID NO: 95200 - protein, 8 aa, Artificial Sequence
  Description of Artificial Sequence: Synthetic peptide
  Seed: SPESAQSA (MAGC1_HUMAN)
  misc_feature (2)..(2): Xaa can be , or Pro
  misc_feature (8)..(8): Xaa can be Leu, or Ala
SXESAQSX

SEQ ID NO: 95201 - protein, 9 aa, Artificial Sequence
  Description of Artificial Sequence: Synthetic peptide
  Seed: SPESAQSAF (MAGC1_HUMAN)
  misc_feature (2)..(2): Xaa can be Pro, His, Ala, Gln, Met, Leu, Val, Ile, Phe, Ser, Glu, Arg, Trp, Gly, Thr, Tyr, Asn, Cys, Lys, or Asp
  misc_feature (9)..(9): Xaa can be Tyr, Phe, Met, Leu, Trp, Ile, Ala, Val, Thr, Gly, His, Ser, Pro, or Cys
SXESAQSAX

SEQ ID NO: 95202 - protein, 9 aa, Artificial Sequence
  Description of Artificial Sequence: Synthetic peptide
  Seed: SPESAQSTF (MAGC1_HUMAN)
  misc_feature (2)..(2): Xaa can be Pro, His, Met, Gln, Ala, Ile, Leu, Val, Thr, Arg, Glu, Ser, Phe, Trp, Gly, Tyr, Cys, Asp, Asn, or Lys
  misc_feature (9)..(9): Xaa can be Tyr, Phe, Met, Trp, Leu, Ile, Ala, Val, His, Thr, Pro, Cys, Gly, or Ser
SXESAQSTX

SEQ ID NO: 95203 - protein, 9 aa, Artificial Sequence
  Description of Artificial Sequence: Synthetic peptide
  Seed: SPESDDTLY (MAGC1_HUMAN)
  misc_feature (2)..(2): Xaa can be Thr, Ala, Pro, Met, Val, Ile, Gln, Ser, Leu, Glu, Tyr, Phe, Asn, Asp, Gly, Cys, or Trp
  misc_feature (9)..(9): Xaa can be Tyr, Lys, Arg, Phe, His, Met, Trp, Leu, or Gln
SXESDDTLX

SEQ ID NO: 95204 - protein, 11 aa, Artificial Sequence
  Description of Artificial Sequence: Synthetic peptide
  Seed: SPESDDTLYPL (MAGC1_HUMAN)
  misc_feature (2)..(2): Xaa can be , or Pro
  misc_feature (11)..(11): Xaa can be Phe, Trp, Ile, Val, Ala, Tyr, Met, or Leu
SXESDDTLYPX

SEQ ID NO: 95205 - protein, 9 aa, Artificial Sequence
  Description of Artificial Sequence: Synthetic peptide
  Seed: SPESPLQSP (MAGC1_HUMAN)
  misc_feature (2)..(2): Xaa can be Pro, Ala, Phe, Val, Ile, Trp, Tyr, Met, Leu, or Ser
  misc_feature (9)..(9): Xaa can be Leu, Met, Ala, Phe, Val, Ile, Cys, Lys, Arg, Pro, His, Trp, Thr, Tyr, Gly, or Ser
SXESPLQSX

SEQ ID NO: 95206 - protein, 10 aa, Artificial Sequence
  Description of Artificial Sequence: Synthetic peptide
  Seed: SPESPLQSPV (MAGC1_HUMAN)
  misc_feature (2)..(2): Xaa can be Pro, Glu, Asn, Trp, Met, Ile, Gly, Cys, Gln, Thr, Lys, Ser, Phe, His, Asp, Tyr, Ala, Val, Leu, or Arg
  misc_feature (10)..(10): Xaa can be Met, Phe, Leu, Val, Ile, Pro, Ala, Thr, Tyr, Ser, Cys, or Gly
SXESPLQSPX

SEQ ID NO: 95207 - protein, 11 aa, Artificial Sequence
  Description of Artificial Sequence: Synthetic peptide
  Seed: SPESPLQSPVI (MAGC1_HUMAN)
  misc_feature (2)..(2): Xaa can be , or Pro
  misc_feature (11)..(11): Xaa can be Met, Pro, Leu, Gly, Ile, Cys, Phe, Ser, Ala, Tyr, Thr, or Val
SXESPLQSPVX

SEQ ID NO: 95208 - protein, 9 aa, Artificial Sequence
  Description of Artificial Sequence: Synthetic peptide
  Seed: SPESTQSPF (MAGC1_HUMAN)
  misc_feature (2)..(2): Xaa can be Pro, Gln, Ala, Val, Met, Leu, Phe, Ile, Gly, Trp, Glu, Tyr, Ser, Thr, Asn, Cys, Asp, Arg, or His
  misc_feature (9)..(9): Xaa can be Tyr, Phe, Met, Leu, Trp, Pro, Val, Ser, Cys, His, Ala, Thr, or Ile
SXESTQSPX

SEQ ID NO: 95209 - protein, 9 aa, Artificial Sequence
  Description of Artificial Sequence: Synthetic peptide
  Seed: SPFEGFPQS (MAGC1_HUMAN)
  misc_feature (2)..(2): Xaa can be Ala, or Pro
  misc_feature (9)..(9): Xaa can be , or Ser
SXFEGFPQX

SEQ ID NO: 95210 - protein, 10 aa, Artificial Sequence
  Description of Artificial Sequence: Synthetic peptide
  Seed: SPFEGFPQSV (MAGC1_HUMAN)
  misc_feature (2)..(2): Xaa can be , or Pro
  misc_feature (10)..(10): Xaa can be , or Val
SXFEGFPQSX

SEQ ID NO: 95211 - protein, 11 aa, Artificial Sequence
  Description of Artificial Sequence: Synthetic peptide
  Seed: SPFEGFPQSVL (MAGC1_HUMAN)
  misc_feature (2)..(2): Xaa can be Pro, Ala, Ser, Val, Thr, Arg, Gly, Ile, Gln, Met, Cys, His, Glu, Asn, Phe, Leu, Asp, Tyr, Trp, or Lys
  misc_feature (11)..(11): Xaa can be Lys, Arg, Leu, Met, Trp, Phe, Tyr, Ile, Val, Cys, His, Ala, Gln, Thr, Asn, Pro, Glu, Ser, or Gly
SXFEGFPQSVX

SEQ ID NO: 95212 - protein, 9 aa, Artificial Sequence
  Description of Artificial Sequence: Synthetic peptide
  Seed: SPFSEESSS (MAGC1_HUMAN)
  misc_feature (2)..(2): Xaa can be Pro, Ala, or Val
  misc_feature (9)..(9): Xaa can be Leu, Ala, Ile, Val, Met, Thr, Ser, Arg, Trp, Cys, Gly, Pro, Tyr, Phe, Lys, or His
SXFSEESSX

SEQ ID NO: 95213 - protein, 10 aa, Artificial Sequence
  Description of Artificial Sequence: Synthetic peptide
  Seed: SPFSEESSSP (MAGC1_HUMAN)
  misc_feature (2)..(2): Xaa can be Pro, or Ala
  misc_feature (10)..(10): Xaa can be Ala, Val, Tyr, Ile, Lys, Arg, Phe, Cys, Thr, Pro, Leu, Ser, Gly, or Met
SXFSEESSSX

SEQ ID NO: 95214 - protein, 11 aa, Artificial Sequence
  Description of Artificial Sequence: Synthetic peptide
  Seed: SPFSEESSSPV (MAGC1_HUMAN)
  misc_feature (2)..(2): Xaa can be , or Pro
  misc_feature (11)..(11): Xaa can be Tyr, Lys, Trp, Leu, Gly, Pro, Thr, Ser, Ile, Cys, Gln, Phe, Arg, Val, His, Met, or Ala
SXFSEESSSPX

SEQ ID NO: 95215 - protein, 8 aa, Artificial Sequence
  Description of Artificial Sequence: Synthetic peptide
  Seed: SPHYFPQS (MAGC1_HUMAN)
  misc_feature (2)..(2): Xaa can be , or Pro
  misc_feature (8)..(8): Xaa can be Thr, Leu, Ser, Val, Cys, Phe, Ile, Pro, Ala, or Met
SXHYFPQX

SEQ ID NO: 95216 - protein, 9 aa, Artificial Sequence
  Description of Artificial Sequence: Synthetic peptide
  Seed: SPHYFPQSP (MAGC1_HUMAN)
  misc_feature (2)..(2): Xaa can be Pro, Ala, Val, Ile, Gly, Ser, or Met
  misc_feature (9)..(9): Xaa can be Ala, Leu, Met, Cys, Val, Ile, Phe, Trp, Asn, Thr, Tyr, Ser, Arg, Gln, His, Lys, Gly, Pro, or Glu
SXHYFPQSX

SEQ ID NO: 95217 - protein, 10 aa, Artificial Sequence
  Description of Artificial Sequence: Synthetic peptide
  Seed: SPHYFPQSPP (MAGC1_HUMAN)
  misc_feature (2)..(2): Xaa can be , or Pro
  misc_feature (10)..(10): Xaa can be Ala, Ile, Thr, Leu, Gly, Cys, Ser, Pro, Phe, Met, Tyr, or Val
SXHYFPQSPX

SEQ ID NO: 95218 - protein, 11 aa, Artificial Sequence
  Description of Artificial Sequence: Synthetic peptide
  Seed: SPHYFPQSPQG (MAGC1_HUMAN)
  misc_feature (2)..(2): Xaa can be , or Pro
  misc_feature (11)..(11): Xaa can be Cys, Gly, Met, Ala, Ile, Leu, Thr, Val, Ser, Pro, or Phe
SXHYFPQSPQX

SEQ ID NO: 95219 - protein, 9 aa, Artificial Sequence
  Description of Artificial Sequence: Synthetic peptide
  Seed: SPLEGEDSL (MAGC1_HUMAN)
  misc_feature (2)..(2): Xaa can be Pro, His, Arg, Gln, Glu, Ala, Ser, Val, Thr, Lys, Met, Ile, Asp, Phe, Leu, Gly, Tyr, Asn, Cys, or Trp
  misc_feature (9)..(9): Xaa can be Met, Tyr, Phe, Leu, Ile, Val, Trp, Ala, Cys, Thr, Pro, Ser, Gly, His, Arg, or Lys
SXLEGEDSX

SEQ ID NO: 95220 - protein, 11 aa, Artificial Sequence
  Description of Artificial Sequence: Synthetic peptide
  Seed: SPLEGEDSLSS (MAGC1_HUMAN)
  misc_feature (2)..(2): Xaa can be , or Pro
  misc_feature (11)..(11): Xaa can be Ser, Arg, Ala, Pro, Ile, Lys, Phe, Met, Cys, Thr, Gly, Leu, Trp, Val, or Tyr
SXLEGEDSLSX

SEQ ID NO: 95221 - protein, 8 aa, Artificial Sequence
  Description of Artificial Sequence: Synthetic peptide
  Seed: SPLEISQS (MAGC1_HUMAN)
  misc_feature (2)..(2): Xaa can be , or Pro
  misc_feature (8)..(8): Xaa can be Pro, Phe, Cys, Ala, Leu, Ser, Ile, Thr, Met, or Val
SXLEISQX

SEQ ID NO: 95222 - protein, 9 aa, Artificial Sequence
  Description of Artificial Sequence: Synthetic peptide
  Seed: SPLEISQSP (MAGC1_HUMAN)
  misc_feature (2)..(2): Xaa can be Pro, Ala, Val, Ile, Gly, Ser, Thr, Met, Gln, or Leu
  misc_feature (9)..(9): Xaa can be Leu, Ala, Met, Phe, Val, Ile, Pro, Tyr, Cys, Thr, Gly, Trp, Arg, Asn, His, Glu, Gln, Ser, or Lys
SXLEISQSX

SEQ ID NO: 95223 - protein, 10 aa, Artificial Sequence
  Description of Artificial Sequence: Synthetic peptide
  Seed: SPLEISQSPP (MAGC1_HUMAN)
  misc_feature (2)..(2): Xaa can be , or Pro
  misc_feature (10)..(10): Xaa can be Pro, Gly, Ala, Met, Thr, Tyr, Phe, Ile, Val, Cys, Leu, or Ser
SXLEISQSPX

SEQ ID NO: 95224 - protein, 8 aa, Artificial Sequence
  Description of Artificial Sequence: Synthetic peptide
  Seed: SPLHFPQF (MAGC1_HUMAN)
  misc_feature (2)..(2): Xaa can be Pro, or Ala
  misc_feature (8)..(8): Xaa can be Ile, Leu, Val, Ala, Thr, Tyr, Met, Ser, Phe, Cys, or Pro
SXLHFPQX

SEQ ID NO: 95225 - protein, 9 aa, Artificial Sequence
  Description of Artificial Sequence: Synthetic peptide
  Seed: SPLHFPQFP (MAGC1_HUMAN)
  misc_feature (2)..(2): Xaa can be Pro, or Ala
  misc_feature (9)..(9): Xaa can be Ala, Tyr, Ile, Phe, Gly, Cys, Pro, Val, Thr, Met, Leu, or Ser
SXLHFPQFX

SEQ ID NO: 95226 - protein, 10 aa, Artificial Sequence
  Description of Artificial Sequence: Synthetic peptide
  Seed: SPLHFPQFPP (MAGC1_HUMAN)
  misc_feature (2)..(2): Xaa can be , or Pro
  misc_feature (10)..(10): Xaa can be Pro, Ala, Cys, Tyr, Leu, Thr, Ser, Gly, Phe, Met, Val, or Ile
SXLHFPQFPX

SEQ ID NO: 95227 - protein, 8 aa, Artificial Sequence
  Description of Artificial Sequence: Synthetic peptide
  Seed: SPLHSPQS (MAGC1_HUMAN)
  misc_feature (2)..(2): Xaa can be , or Pro
  misc_feature (8)..(8): Xaa can be Ser, Ala, Phe, Thr, Met, Val, Leu, Pro, Cys, or Ile
SXLHSPQX

SEQ ID NO: 95228 - protein, 9 aa, Artificial Sequence
  Description of Artificial Sequence: Synthetic peptide
  Seed: SPLHSPQSP (MAGC1_HUMAN)
  misc_feature (2)..(2): Xaa can be Pro, Ala, Ile, Val, Gly, Ser, or Met
  misc_feature (9)..(9): Xaa can be Leu, Ala, Met, Ile, Val, Cys, Phe, Thr, His, Gly, Glu, Pro, Lys, Tyr, Ser, Trp, Gln, or Ar g
SXLHSPQSX

SEQ ID NO: 95229 - protein, 10 aa, Artificial Sequence
  Description of Artificial Sequence: Synthetic peptide
  Seed: SPLHSPQSPP (MAGC1_HUMAN)
  misc_feature (2)..(2): Xaa can be , or Pro
  misc_feature (10)..(10): Xaa can be Leu, Gly, Ala, Ser, Met, Thr, Phe, Arg, Ile, Cys, Val, Pro, or Tyr
SXLHSPQSPX

SEQ ID NO: 95230 - protein, 8 aa, Artificial Sequence
  Description of Artificial Sequence: Synthetic peptide
  Seed: SPLQGEEF (MAGC1_HUMAN)
  misc_feature (2)..(2): Xaa can be Pro, Gln, Ala, Leu, Val, Met, Glu, Ser, Ile, Phe, Gly, Asn, Tyr, Thr, or Asp
  misc_feature (8)..(8): Xaa can be Tyr, Phe, Trp, Leu, Met, Ile, Val, or Ala
SXLQGEEX

SEQ ID NO: 95231 - protein, 11 aa, Artificial Sequence
  Description of Artificial Sequence: Synthetic peptide
  Seed: SPLQGEEFQSS (MAGC1_HUMAN)
  misc_feature (2)..(2): Xaa can be , or Pro
  misc_feature (11)..(11): Xaa can be Gly, Tyr, Met, Thr, Leu, Ile, Ser, Phe, Pro, Cys, Val, or Ala
SXLQGEEFQSX

SEQ ID NO: 95232 - protein, 8 aa, Artificial Sequence
  Description of Artificial Sequence: Synthetic peptide
  Seed: SPLQIPGS (MAGC1_HUMAN)
  misc_feature (2)..(2): Xaa can be , or Pro
  misc_feature (8)..(8): Xaa can be Cys, Pro, Leu, Ser, Ile, Gly, Phe, Val, Ala, Thr, or Met
SXLQIPGX

SEQ ID NO: 95233 - protein, 9 aa, Artificial Sequence
  Description of Artificial Sequence: Synthetic peptide
  Seed: SPLQIPGSP (MAGC1_HUMAN)
  misc_feature (2)..(2): Xaa can be Pro, Ala, Val, Ile, Met, Ser, Gly, Thr, or Leu
  misc_feature (9)..(9): Xaa can be Ala, Leu, Met, Val, Thr, Pro, Ile, Phe, Cys, Gly, Tyr, Glu, Lys, Gln, Arg, Trp, His, Asp, Asn, or Ser
SXLQIPGSX

SEQ ID NO: 95234 - protein, 10 aa, Artificial Sequence
  Description of Artificial Sequence: Synthetic peptide
  Seed: SPLQIPGSPS (MAGC1_HUMAN)
  misc_feature (2)..(2): Xaa can be Pro, Val, Ala, Ile, Met, or Thr
  misc_feature (10)..(10): Xaa can be Leu, Met, Ala, Asp, Ile, Arg, Asn, Ser, Trp, Gly, Thr, His, Cys, Lys, Val, Pro, Phe, Gln, Glu, or Tyr
SXLQIPGSPX

SEQ ID NO: 95235 - protein, 11 aa, Artificial Sequence
  Description of Artificial Sequence: Synthetic peptide
  Seed: SPLQIPGSPSF (MAGC1_HUMAN)
  misc_feature (2)..(2): Xaa can be Pro, Ala, Gln, Met, Val, Cys, Thr, Glu, Ile, Ser, Gly, Trp, Tyr, Lys, His, Phe, Arg, Leu, Asn, or Asp
  misc_feature (11)..(11): Xaa can be Leu, Met, Tyr, Phe, Trp, Ile, Ala, His, Cys, Glu, Pro, Asp, Val, Arg, Asn, Ser, Gly, Lys, Thr, or Gln
SXLQIPGSPSX

SEQ ID NO: 95236 - protein, 8 aa, Artificial Sequence
  Description of Artificial Sequence: Synthetic peptide
  Seed: SPLQIPMT (MAGC1_HUMAN)
  misc_feature (2)..(2): Xaa can be , or Pro
  misc_feature (8)..(8): Xaa can be Leu, Met, Cys, Ser, Pro, Gly, Val, Thr, Ile, Phe, or Ala
SXLQIPMX

SEQ ID NO: 95237 - protein, 9 aa, Artificial Sequence
  Description of Artificial Sequence: Synthetic peptide
  Seed: SPLQIPMTS (MAGC1_HUMAN)
  misc_feature (2)..(2): Xaa can be Met, Leu, Ile, Val, Gln, Thr, Ala, Ser, Glu, Phe, Gly, Cys, Asn, Pro, Trp, or Tyr
  misc_feature (9)..(9): Xaa can be Val, Leu, Ile, Met, Ala, Thr, Phe, Gly, Ser, Lys, Cys, or Arg
SXLQIPMTX

SEQ ID NO: 95238 - protein, 10 aa, Artificial Sequence
  Description of Artificial Sequence: Synthetic peptide
  Seed: SPLQIPMTSS (MAGC1_HUMAN)
  misc_feature (2)..(2): Xaa can be Pro, or Ala
  misc_feature (10)..(10): Xaa can be Ala, Ser, His, Phe, Asn, Met, Lys, Ile, Glu, Pro, Tyr, Cys, Trp, Gln, Arg, Val, Thr, Gly, or Leu
SXLQIPMTSX

SEQ ID NO: 95239 - protein, 11 aa, Artificial Sequence
  Description of Artificial Sequence: Synthetic peptide
  Seed: SPLQIPMTSSF (MAGC1_HUMAN)
  misc_feature (2)..(2): Xaa can be Gln, Asn, Ile, Arg, Asp, Ala, Leu, His, Val, Ser, Lys, Tyr, Thr, Pro, Cys, Gly, Phe, Glu, Trp, or Met
  misc_feature (11)..(11): Xaa can be Leu, Tyr, Met, Phe, Trp, Val, Ile, or His
SXLQIPMTSSX

SEQ ID NO: 95240 - protein, 8 aa, Artificial Sequence
  Description of Artificial Sequence: Synthetic peptide
  Seed: SPLQIPQS (MAGC1_HUMAN)
  misc_feature (2)..(2): Xaa can be Pro, or Ala
  misc_feature (8)..(8): Xaa can be Ala, Tyr, Pro, Met, Thr, Cys, Ile, Val, Gly, Phe, Leu, or Ser
SXLQIPQX

SEQ ID NO: 95241 - protein, 9 aa, Artificial Sequence
  Description of Artificial Sequence: Synthetic peptide
  Seed: SPLQIPQSP (MAGC1_HUMAN)
  misc_feature (2)..(2): Xaa can be Pro, Val, Ser, or Thr
  misc_feature (9)..(9): Xaa can be Leu, Ala, Met, Val, Cys, Ile, Phe, Lys, Arg, Asn, His, Gly, Glu, Asp, Thr, Trp, Gln, Tyr, or Pro
SXLQIPQSX

SEQ ID NO: 95242 - protein, 10 aa, Artificial Sequence
  Description of Artificial Sequence: Synthetic peptide
  Seed: SPLQIPQSPL (MAGC1_HUMAN)
  misc_feature (2)..(2): Xaa can be , or Pro
  misc_feature (10)..(10): Xaa can be , or Leu
SXLQIPQSPX

SEQ ID NO: 95243 - protein, 11 aa, Artificial Sequence
  Description of Artificial Sequence: Synthetic peptide
  Seed: SPLQIPQSPLE (MAGC1_HUMAN)
  misc_feature (2)..(2): Xaa can be , or Pro
  misc_feature (11)..(11): Xaa can be Lys, Pro, Ala, Ser, His, Tyr, Met, Gly, Glu, Trp, Phe, Arg, Cys, Val, Asp, Thr, Asn, Leu, Gln, or Ile
SXLQIPQSPLX

SEQ ID NO: 95244 - protein, 10 aa, Artificial Sequence
  Description of Artificial Sequence: Synthetic peptide
  Seed: SPLQIPQSPP (MAGC1_HUMAN)
  misc_feature (2)..(2): Xaa can be Pro, or Ala
  misc_feature (10)..(10): Xaa can be Ala, Val, Trp, Phe, Gly, Arg, Met, Pro, Ser, Ile, Gln, Cys, Tyr, Lys, or Thr
SXLQIPQSPX

SEQ ID NO: 95245 - protein, 9 aa, Artificial Sequence
  Description of Artificial Sequence: Synthetic peptide
  Seed: SPLQIPQSS (MAGC1_HUMAN)
  misc_feature (2)..(2): Xaa can be His, Arg, Gln, Ala, Lys, Glu, Gly, Asn, Ile, Pro, Asp, Met, Leu, or Cys
  misc_feature (9)..(9): Xaa can be Leu, Ala, Val, Met, Ile, Cys, Pro, Phe, Ser, Thr, Gly, Trp, or Tyr
SXLQIPQSX

SEQ ID NO: 95246 - protein, 10 aa, Artificial Sequence
  Description of Artificial Sequence: Synthetic peptide
  Seed: SPLQIPQSSP (MAGC1_HUMAN)
  misc_feature (2)..(2): Xaa can be Pro, or Ala
  misc_feature (10)..(10): Xaa can be Ala, Gly, Arg, Met, Pro, Lys, Trp, Leu, Tyr, Phe, Thr, Ile, Gln, Ser, Val, or Cys
SXLQIPQSSX

SEQ ID NO: 95247 - protein, 8 aa, Artificial Sequence
  Description of Artificial Sequence: Synthetic peptide
  Seed: SPLQIPVS (MAGC1_HUMAN)
  misc_feature (2)..(2): Xaa can be Pro, or Ala
  misc_feature (8)..(8): Xaa can be Ala, Met, Pro, Tyr, Val, Gly, Lys, Phe, Ser, Leu, Thr, Ile, or Cys
SXLQIPVX

SEQ ID NO: 95248 - protein, 9 aa, Artificial Sequence
  Description of Artificial Sequence: Synthetic peptide
  Seed: SPLQIPVSP (MAGC1_HUMAN)
  misc_feature (2)..(2): Xaa can be Pro, or Val
  misc_feature (9)..(9): Xaa can be Pro, Ser, Ala, or Arg
SXLQIPVSX

SEQ ID NO: 95249 - protein, 10 aa, Artificial Sequence
  Description of Artificial Sequence: Synthetic peptide
  Seed: SPLQIPVSPS (MAGC1_HUMAN)
  misc_feature (2)..(2): Xaa can be Pro, or Ala
  misc_feature (10)..(10): Xaa can be Ala, Asn, Cys, Ile, Met, Phe, Tyr, Val, Thr, Ser, Arg, Gly, His, Lys, Trp, Leu, Pro, Gln, or Glu
SXLQIPVSPX

SEQ ID NO: 95250 - protein, 11 aa, Artificial Sequence
  Description of Artificial Sequence: Synthetic peptide
  Seed: SPLQIPVSPSS (MAGC1_HUMAN)
  misc_feature (2)..(2): Xaa can be Pro, Ser, Thr, Ala, Met, Asn, Cys, Ile, Gly, Leu, Val, Arg, His, Asp, Phe, Glu, Gln, Tyr, Trp, or Lys
  misc_feature (11)..(11): Xaa can be Met, Tyr, Leu, Phe, Trp, Ile, Ala, Cys, Gly, His, Lys, Ser, Pro, Thr, Arg, Glu, Val, or Gl n
SXLQIPVSPSX

SEQ ID NO: 95251 - protein, 10 aa, Artificial Sequence
  Description of Artificial Sequence: Synthetic peptide
  Seed: SPLQIPVSRS (MAGC1_HUMAN)
  misc_feature (2)..(2): Xaa can be , or Pro
  misc_feature (10)..(10): Xaa can be Cys, Gly, Met, Ile, Leu, Val, Ser, Phe, Thr, Pro, Tyr, or Ala
SXLQIPVSRX

SEQ ID NO: 95252 - protein, 11 aa, Artificial Sequence
  Description of Artificial Sequence: Synthetic peptide
  Seed: SPLQIPVSRSF (MAGC1_HUMAN)
  misc_feature (2)..(2): Xaa can be Pro, Ala, Lys, Glu, Arg, His, Phe, Asp, Cys, Val, Ile, Ser, Tyr, Leu, Asn, Met, Trp, Gly, Gln, or Thr
  misc_feature (11)..(11): Xaa can be Phe, Met, Tyr, Leu, Trp, Pro, Ile, Ser, Gly, Cys, Thr, Ala, or Val
SXLQIPVSRSX

SEQ ID NO: 95253 - protein, 10 aa, Artificial Sequence
  Description of Artificial Sequence: Synthetic peptide
  Seed: SPLQIPVSSS (MAGC1_HUMAN)
  misc_feature (2)..(2): Xaa can be Pro, or Ala
  misc_feature (10)..(10): Xaa can be Leu, Ala, Gly, Tyr, Thr, Asn, Gln, Arg, Phe, His, Lys, Ile, Trp, Val, Cys, Pro, Met, Glu, or Ser
SXLQIPVSSX

SEQ ID NO: 95254 - protein, 11 aa, Artificial Sequence
  Description of Artificial Sequence: Synthetic peptide
  Seed: SPLQIPVSSSS (MAGC1_HUMAN)
  misc_feature (2)..(2): Xaa can be Pro, His, Ser, Arg, Leu, Tyr, Ile, Thr, Asn, Trp, Met, Asp, Ala, Lys, Cys, Gly, Val, Phe, Glu, or Gln
  misc_feature (11)..(11): Xaa can be Trp, Leu, Phe, Met, Tyr, Ile, Cys, Lys, Ala, Thr, Gly, Ser, Pro, Val, or Arg
SXLQIPVSSSX

SEQ ID NO: 95255 - protein, 8 aa, Artificial Sequence
  Description of Artificial Sequence: Synthetic peptide
  Seed: SPLQIVPS (MAGC1_HUMAN)
  misc_feature (2)..(2): Xaa can be , or Pro
  misc_feature (8)..(8): Xaa can be Thr, Val, Cys, Tyr, Met, Phe, Ala, Ser, Leu, Ile, Gly, or Pro
SXLQIVPX

SEQ ID NO: 95256 - protein, 9 aa, Artificial Sequence
  Description of Artificial Sequence: Synthetic peptide
  Seed: SPLQIVPSL (MAGC1_HUMAN)
  misc_feature (2)..(2): Xaa can be Pro, Arg, Met, Leu, Gln, Ala, His, Val, Thr, Ile, Ser, Glu, Asn, Gly, Asp, Lys, Phe, Cys, Trp, or Tyr
  misc_feature (9)..(9): Xaa can be Ile, Leu, Met, Tyr, Val, Phe, Ala, Trp, Lys, Arg, Cys, Thr, His, Ser, Pro, Gly, Gln, Glu, Asn, or Asp
SXLQIVPSX

SEQ ID NO: 95257 - protein, 10 aa, Artificial Sequence
  Description of Artificial Sequence: Synthetic peptide
  Seed: SPLQIVPSLP (MAGC1_HUMAN)
  misc_feature (2)..(2): Xaa can be , or Pro
  misc_feature (10)..(10): Xaa can be Pro, Val, Leu, Ser, Gly, Tyr, Ile, Met, Glu, Phe, Ala, Trp, Thr, or Cys
SXLQIVPSLX

SEQ ID NO: 95258 - protein, 8 aa, Artificial Sequence
  Description of Artificial Sequence: Synthetic peptide
  Seed: SPLQNPAS (MAGC1_HUMAN)
  misc_feature (2)..(2): Xaa can be Pro, or Ala
  misc_feature (8)..(8): Xaa can be Ala, Phe, Val, Ser, Ile, Thr, Cys, Pro, Gly, Tyr, Met, or Leu
SXLQNPAX

SEQ ID NO: 95259 - protein, 9 aa, Artificial Sequence
  Description of Artificial Sequence: Synthetic peptide
  Seed: SPLQNPASS (MAGC1_HUMAN)
  misc_feature (2)..(2): Xaa can be Pro, Ala, Val, Ile, Leu, Thr, Met, Gly, Ser, or Cys
  misc_feature (9)..(9): Xaa can be Leu, Ala, Met, Ile, Val, Phe, Thr, Cys, Pro, Trp, Ser, His, Gln, Arg, Glu, Asn, Gly, Tyr, or Lys
SXLQNPASX

SEQ ID NO: 95260 - protein, 10 aa, Artificial Sequence
  Description of Artificial Sequence: Synthetic peptide
  Seed: SPLQNPASSF (MAGC1_HUMAN)
  misc_feature (2)..(2): Xaa can be Pro, Arg, Ala, Gln, Ile, Val, Met, His, Gly, Ser, Thr, Leu, Cys, Glu, Asn, Lys, Tyr, Trp, Asp, or Phe
  misc_feature (10)..(10): Xaa can be Met, Tyr, Phe, Trp, Leu, His, Lys, Arg, Ile, Val, Ala, Gln, Ser, Thr, Gly, Pro, or Cys
SXLQNPASSX

SEQ ID NO: 95261 - protein, 11 aa, Artificial Sequence
  Description of Artificial Sequence: Synthetic peptide
  Seed: SPLQNPASSFF (MAGC1_HUMAN)
  misc_feature (2)..(2): Xaa can be Gln, Pro, Met, Ala, Lys, Ser, Thr, Val, Leu, His, Asp, Glu, Gly, Cys, Phe, Tyr, Arg, Asn, Ile, or Trp
  misc_feature (11)..(11): Xaa can be Met, Tyr, Phe, Trp, Leu, Ile, Gly, Cys, Pro, Ala, Thr, Ser, Val, Asp, Arg, His, Asn, Lys, Gln, or Glu
SXLQNPASSFX

SEQ ID NO: 95262 - protein, 9 aa, Artificial Sequence
  Description of Artificial Sequence: Synthetic peptide
  Seed: SPLQNSQSS (MAGC1_HUMAN)
  misc_feature (2)..(2): Xaa can be Pro, Ala, Val, Ile, Ser, Thr, or Met
  misc_feature (9)..(9): Xaa can be Leu, Met, Ala, Ile, Cys, Phe, Val, Lys, Gly, Ser, Thr, Tyr, Arg, Trp, or Pro
SXLQNSQSX

SEQ ID NO: 95263 - protein, 10 aa, Artificial Sequence
  Description of Artificial Sequence: Synthetic peptide
  Seed: SPLQNSQSSP (MAGC1_HUMAN)
  misc_feature (2)..(2): Xaa can be , or Pro
  misc_feature (10)..(10): Xaa can be Phe, Val, Thr, Gly, Ser, Leu, Met, Pro, Tyr, Cys, Ala, or Ile
SXLQNSQSSX

SEQ ID NO: 95264 - protein, 8 aa, Artificial Sequence
  Description of Artificial Sequence: Synthetic peptide
  Seed: SPLQRPVS (MAGC1_HUMAN)
  misc_feature (2)..(2): Xaa can be Pro, or Ala
  misc_feature (8)..(8): Xaa can be Met, Leu, Ala, Thr, Ser, Val, Cys, Gly, Pro, Tyr, Ile, or Phe
SXLQRPVX

SEQ ID NO: 95265 - protein, 9 aa, Artificial Sequence
  Description of Artificial Sequence: Synthetic peptide
  Seed: SPLQRPVSS (MAGC1_HUMAN)
  misc_feature (2)..(2): Xaa can be Pro, Ala, Leu, Met, Val, Ile, Gln, Thr, Phe, Ser, Gly, Cys, Asn, Glu, Asp, Arg, Trp, His, Tyr, or Lys
  misc_feature (9)..(9): Xaa can be Ile, Val, Met, Leu, Phe, Ala, Cys, Thr, Tyr, Ser, Pro, Gly, Arg, His, Lys, Glu, Trp, Asp, Asn, or Gln
SXLQRPVSX

SEQ ID NO: 95266 - protein, 10 aa, Artificial Sequence
  Description of Artificial Sequence: Synthetic peptide
  Seed: SPLQRPVSSF (MAGC1_HUMAN)
  misc_feature (2)..(2): Xaa can be Pro, Met, Leu, Ala, Gln, Val, Ile, Phe, Asn, Gly, Arg, Thr, Ser, Trp, Glu, Tyr, Lys, Cys, His, or Asp
  misc_feature (10)..(10): Xaa can be Tyr, Phe, Met, Leu, Trp, Val, Ala, Ile, His, Thr, Cys, Pro, Gly, or Ser
SXLQRPVSSX

SEQ ID NO: 95267 - protein, 11 aa, Artificial Sequence
  Description of Artificial Sequence: Synthetic peptide
  Seed: SPLQRPVSSFF (MAGC1_HUMAN)
  misc_feature (2)..(2): Xaa can be Gln, Pro, Met, Glu, Ala, His, Ile, Leu, Asp, Arg, Thr, Ser, Asn, Lys, Trp, Tyr, Cys, Val, Phe, or Gly
  misc_feature (11)..(11): Xaa can be Met, Tyr, Phe, Leu, Trp, Thr, Ala, Cys, Ile, Val, Gly, Lys, Pro, Ser, Asn, Arg, His, Glu, Gln, or Asp
SXLQRPVSSFX

SEQ ID NO: 95268 - protein, 8 aa, Artificial Sequence
  Description of Artificial Sequence: Synthetic peptide
  Seed: SPLQSPES (MAGC1_HUMAN)
  misc_feature (2)..(2): Xaa can be , or Pro
  misc_feature (8)..(8): Xaa can be Ala, Thr, Cys, Ser, Ile, Val, Phe, Met, Pro, or Leu
SXLQSPEX

SEQ ID NO: 95269 - protein, 9 aa, Artificial Sequence
  Description of Artificial Sequence: Synthetic peptide
  Seed: SPLQSPESA (MAGC1_HUMAN)
  misc_feature (2)..(2): Xaa can be Pro, His, Gln, Ala, Arg, Ser, Ile, Gly, Val, Leu, Thr, Met, Glu, Lys, Cys, Asn, Phe, or As p
  misc_feature (9)..(9): Xaa can be Leu, Val, Met, Ile, Tyr, Ala, Phe, Cys, Pro, Thr, Trp, Gly, Ser, His, Gln, Lys, Arg, or Gl u
SXLQSPESX

SEQ ID NO: 95270 - protein, 10 aa, Artificial Sequence
  Description of Artificial Sequence: Synthetic peptide
  Seed: SPLQSPESAP (MAGC1_HUMAN)
  misc_feature (2)..(2): Xaa can be Pro, or Ala
  misc_feature (10)..(10): Xaa can be Leu, Ala, Ser, Arg, Met, Pro, Tyr, Phe, Ile, Lys, Gln, Thr, Gly, Trp, Val, or Cys
SXLQSPESAX

SEQ ID NO: 95271 - protein, 8 aa, Artificial Sequence
  Description of Artificial Sequence: Synthetic peptide
  Seed: SPLQSPVI (MAGC1_HUMAN)
  misc_feature (2)..(2): Xaa can be , or Pro
  misc_feature (8)..(8): Xaa can be Ile, or Ser
SXLQSPVX

SEQ ID NO: 95272 - protein, 9 aa, Artificial Sequence
  Description of Artificial Sequence: Synthetic peptide
  Seed: SPLQSPVIS (MAGC1_HUMAN)
  misc_feature (2)..(2): Xaa can be Pro, Ala, Val, Gly, or Ile
  misc_feature (9)..(9): Xaa can be Ala, Leu, Val, Met, Ile, Cys, Thr, Gln, Arg, Glu, Tyr, His, Trp, Lys, Pro, Ser, Phe, Gly, or Asn
SXLQSPVIX

SEQ ID NO: 95273 - protein, 10 aa, Artificial Sequence
  Description of Artificial Sequence: Synthetic peptide
  Seed: SPLQSPVISF (MAGC1_HUMAN)
  misc_feature (2)..(2): Xaa can be Pro, Ala, Gln, Met, Val, Leu, Ile, Ser, Thr, Glu, Cys, Gly, Phe, Trp, Arg, His, Lys, Asn, Tyr, or Asp
  misc_feature (10)..(10): Xaa can be Tyr, Phe, Met, Trp, Leu, Ile, Ala, His, Val, Ser, Pro, Lys, Asn, Cys, Gln, Thr, Glu, Gly, or Arg
SXLQSPVISX

SEQ ID NO: 95274 - protein, 11 aa, Artificial Sequence
  Description of Artificial Sequence: Synthetic peptide
  Seed: SPLQSPVISFS (MAGC1_HUMAN)
  misc_feature (2)..(2): Xaa can be , or Pro
  misc_feature (11)..(11): Xaa can be Phe, Leu, Cys, Ala, Met, Val, Ile, Ser, Thr, Pro, or Gly
SXLQSPVISFX

SEQ ID NO: 95275 - protein, 8 aa, Artificial Sequence
  Description of Artificial Sequence: Synthetic peptide
  Seed: SPLQSPVS (MAGC1_HUMAN)
  misc_feature (2)..(2): Xaa can be Pro, Gln, Ala, Glu, Gly, Ile, Ser, Asn, Leu, Asp, His, Met, Thr, Lys, or Phe
  misc_feature (8)..(8): Xaa can be Ile, Val, Leu, Met, Phe, Cys, Ala, Thr, Pro, Tyr, Gly, or Ser
SXLQSPVX

SEQ ID NO: 95276 - protein, 9 aa, Artificial Sequence
  Description of Artificial Sequence: Synthetic peptide
  Seed: SPLQSPVSS (MAGC1_HUMAN)
  misc_feature (2)..(2): Xaa can be Pro, Ala, Val, Ser, Thr, Leu, Met, Gly, Gln, Ile, Cys, Asp, Asn, Glu, or Phe
  misc_feature (9)..(9): Xaa can be Tyr, Phe, Trp, Leu, Ala, Met, Ile, Val, Cys, Pro, Ser, Thr, Gln, Glu, Lys, Gly, Arg, His, Asn, or Asp
SXLQSPVSX

SEQ ID NO: 95277 - protein, 10 aa, Artificial Sequence
  Description of Artificial Sequence: Synthetic peptide
  Seed: SPLQSPVSSF (MAGC1_HUMAN)
  misc_feature (2)..(2): Xaa can be Pro, Ala, Gln, Ser, His, Val, Gly, Met, Ile, Thr, Leu, Cys, Glu, Lys, Asp, Arg, Phe, Asn, Trp, or Tyr
  misc_feature (10)..(10): Xaa can be Phe, Tyr, Met, Trp, Leu, His, Lys, Arg, Val, Ile, Ala, Cys, Ser, Thr, Gln, Gly, or Pro
SXLQSPVSSX

SEQ ID NO: 95278 - protein, 11 aa, Artificial Sequence
  Description of Artificial Sequence: Synthetic peptide
  Seed: SPLQSPVSSFP (MAGC1_HUMAN)
  misc_feature (2)..(2): Xaa can be , or Pro
  misc_feature (11)..(11): Xaa can be Thr, Ser, Ile, Phe, Met, Val, Pro, Gly, Ala, Cys, or Leu
SXLQSPVSSFX

SEQ ID NO: 95279 - protein, 8 aa, Artificial Sequence
  Description of Artificial Sequence: Synthetic peptide
  Seed: SPLYFPQS (MAGC1_HUMAN)
  misc_feature (2)..(2): Xaa can be , or Pro
  misc_feature (8)..(8): Xaa can be Ala, Thr, Phe, Ile, Pro, Met, Ser, Val, Cys, or Leu
SXLYFPQX

SEQ ID NO: 95280 - protein, 9 aa, Artificial Sequence
  Description of Artificial Sequence: Synthetic peptide
  Seed: SPLYFPQSP (MAGC1_HUMAN)
  misc_feature (2)..(2): Xaa can be Pro, Ala, Val, or Gly
  misc_feature (9)..(9): Xaa can be Ala, Leu, Met, Cys, Ile, Val, Arg, Gln, Gly, Phe, Tyr, Lys, Glu, Ser, His, Pro, Trp, or Th r
SXLYFPQSX

SEQ ID NO: 95281 - protein, 10 aa, Artificial Sequence
  Description of Artificial Sequence: Synthetic peptide
  Seed: SPLYFPQSPL (MAGC1_HUMAN)
  misc_feature (2)..(2): Xaa can be Pro, Phe, Tyr, Met, Leu, Val, Ser, Cys, Lys, Gly, Thr, Glu, Asn, Asp, Trp, Ala, Arg, Gln, Ile, or His
  misc_feature (10)..(10): Xaa can be Ile, Leu, Met, Ala, Thr, Val, Cys, Ser, Pro, Phe, Trp, Tyr, or Gly
SXLYFPQSPX

SEQ ID NO: 95282 - protein, 11 aa, Artificial Sequence
  Description of Artificial Sequence: Synthetic peptide
  Seed: SPLYFPQSPLQ (MAGC1_HUMAN)
  misc_feature (2)..(2): Xaa can be , or Pro
  misc_feature (11)..(11): Xaa can be Gly, Glu, Leu, Lys, Pro, Thr, Phe, Arg, Asn, Ala, Val, Ser, His, Trp, Gln, Met, Cys, Asp, Tyr, or Ile
SXLYFPQSPLX

SEQ ID NO: 95283 - protein, 8 aa, Artificial Sequence
  Description of Artificial Sequence: Synthetic peptide
  Seed: SPPEGEDV (MAGC1_HUMAN)
  misc_feature (2)..(2): Xaa can be , or Pro
  misc_feature (8)..(8): Xaa can be Ile, Leu, or Val
SXPEGEDX

SEQ ID NO: 95284 - protein, 11 aa, Artificial Sequence
  Description of Artificial Sequence: Synthetic peptide
  Seed: SPPEGEDVQSP (MAGC1_HUMAN)
  misc_feature (2)..(2): Xaa can be , or Pro
  misc_feature (11)..(11): Xaa can be Pro, Val, Leu, Ser, Lys, Ala, Gly, Cys, Tyr, Ile, Thr, Phe, or Met
SXPEGEDVQSX

SEQ ID NO: 95285 - protein, 9 aa, Artificial Sequence
  Description of Artificial Sequence: Synthetic peptide
  Seed: SPPEGENTH (MAGC1_HUMAN)
  misc_feature (2)..(2): Xaa can be Ala, Val, Ser, Thr, Ile, Met, Pro, Gly, Leu, Gln, Asn, Glu, Cys, Phe, Asp, Tyr, Lys, Trp, Arg, or His
  misc_feature (9)..(9): Xaa can be Met, Phe, Tyr, Leu, His, Lys, Ile, Val, Trp, Arg, Ala, Cys, Thr, Gln, Gly, Pro, or Ser
SXPEGENTX

SEQ ID NO: 95286 - protein, 10 aa, Artificial Sequence
  Description of Artificial Sequence: Synthetic peptide
  Seed: SPPEGENTHS (MAGC1_HUMAN)
  misc_feature (2)..(2): Xaa can be Pro, or Ala
  misc_feature (10)..(10): Xaa can be Ala, Thr, Cys, Pro, Ile, Ser, Phe, Tyr, Val, Met, or Leu
SXPEGENTHX

SEQ ID NO: 95287 - protein, 11 aa, Artificial Sequence
  Description of Artificial Sequence: Synthetic peptide
  Seed: SPPEGENTHSP (MAGC1_HUMAN)
  misc_feature (2)..(2): Xaa can be Pro, or Ala
  misc_feature (11)..(11): Xaa can be Ala, Leu, Phe, Met, Thr, Pro, Val, Lys, Ile, Tyr, Gly, Ser, or Cys
SXPEGENTHSX

SEQ ID NO: 95288 - protein, 9 aa, Artificial Sequence
  Description of Artificial Sequence: Synthetic peptide
  Seed: SPPEGMHSQ (MAGC1_HUMAN)
  misc_feature (2)..(2): Xaa can be Pro, Ala, Val, Ile, Leu, Ser, Met, Gly, Thr, Gln, Phe, Cys, Tyr, Glu, or Asp
  misc_feature (9)..(9): Xaa can be Leu, Met, Ala, Ile, Val, Phe, Cys, Pro, Tyr, Thr, Ser, Trp, Lys, Arg, Gly, Gln, Asn, Glu, or His
SXPEGMHSX

SEQ ID NO: 95289 - protein, 10 aa, Artificial Sequence
  Description of Artificial Sequence: Synthetic peptide
  Seed: SPPEGMHSQS (MAGC1_HUMAN)
  misc_feature (2)..(2): Xaa can be Pro, or Ala
  misc_feature (10)..(10): Xaa can be Ala, Gly, Met, Val, Pro, Ile, Phe, Cys, Leu, Tyr, Thr, or Ser
SXPEGMHSQX

SEQ ID NO: 95290 - protein, 11 aa, Artificial Sequence
  Description of Artificial Sequence: Synthetic peptide
  Seed: SPPEGMHSQSP (MAGC1_HUMAN)
  misc_feature (2)..(2): Xaa can be , or Pro
  misc_feature (11)..(11): Xaa can be Cys, Ile, Thr, Phe, Pro, Met, Ala, Leu, or Val
SXPEGMHSQSX

SEQ ID NO: 95291 - protein, 9 aa, Artificial Sequence
  Description of Artificial Sequence: Synthetic peptide
  Seed: SPPEGPAQS (MAGC1_HUMAN)
  misc_feature (2)..(2): Xaa can be Pro, Ala, Ile, Val, Ser, Gly, Thr, Met, Leu, Phe, Cys, Gln, Tyr, Trp, Asp, or Glu
  misc_feature (9)..(9): Xaa can be Leu, Met, Ala, Ile, Val, Phe, Cys, Ser, Pro, Thr, Tyr, Gly, Lys, Arg, His, Gln, Asn, Glu, or Trp
SXPEGPAQX

SEQ ID NO: 95292 - protein, 10 aa, Artificial Sequence
  Description of Artificial Sequence: Synthetic peptide
  Seed: SPPEGPAQSP (MAGC1_HUMAN)
  misc_feature (2)..(2): Xaa can be Pro, Ala, Val, Ile, Thr, Gly, Leu, Met, Ser, Gln, Tyr, Phe, Glu, or Cys
  misc_feature (10)..(10): Xaa can be Leu, Met, Ala, Phe, Val, Ile, Cys, Pro, Tyr, Thr, Ser, Asn, Gly, Trp, His, Glu, Lys, Gln, or Arg
SXPEGPAQSX

SEQ ID NO: 95293 - protein, 11 aa, Artificial Sequence
  Description of Artificial Sequence: Synthetic peptide
  Seed: SPPEGPAQSPL (MAGC1_HUMAN)
  misc_feature (2)..(2): Xaa can be Pro, Gly, Ala, Arg, Leu, Ile, Ser, Val, Met, Gln, Asn, Thr, Cys, His, Glu, Phe, Tyr, Trp, Asp, or Lys
  misc_feature (11)..(11): Xaa can be Lys, Leu, Arg, Phe, Met, Asn, Glu, His, Ile, Val, Gln, Tyr, Trp, Ala, Gly, Cys, Pro, Ser, Asp, or Thr
SXPEGPAQSPX

SEQ ID NO: 95294 - protein, 9 aa, Artificial Sequence
  Description of Artificial Sequence: Synthetic peptide
  Seed: SPPEGPVQS (MAGC1_HUMAN)
  misc_feature (2)..(2): Xaa can be Pro, Ala, Val, Thr, Ile, Gly, Ser, Leu, Gln, Cys, Met, Glu, Asp, Phe, Tyr, Trp, or Asn
  misc_feature (9)..(9): Xaa can be Tyr, Met, Phe, Leu, Val, Ile, Ala, Cys, Trp, His, Thr, Pro, Gly, Ser, Asp, Arg, Glu, Lys, Gln, or Asn
SXPEGPVQX

SEQ ID NO: 95295 - protein, 10 aa, Artificial Sequence
  Description of Artificial Sequence: Synthetic peptide
  Seed: SPPEGPVQSP (MAGC1_HUMAN)
  misc_feature (2)..(2): Xaa can be Pro, Ala, Val, Ile, Met, Leu, Ser, Thr, Gly, Gln, Glu, Cys, Phe, or Tyr
  misc_feature (10)..(10): Xaa can be Leu, Met, Ala, Phe, Ile, Val, Cys, Pro, Thr, Tyr, Trp, Ser, Gly, Gln, Arg, Asn, Glu, Lys, or His
SXPEGPVQSX

SEQ ID NO: 95296 - protein, 11 aa, Artificial Sequence
  Description of Artificial Sequence: Synthetic peptide
  Seed: SPPEGPVQSPL (MAGC1_HUMAN)
  misc_feature (2)..(2): Xaa can be Pro, Ala, Arg, Cys, Ser, Ile, Leu, Thr, Met, Val, Tyr, Gly, Gln, His, Phe, Trp, Glu, Lys, or Asn
  misc_feature (11)..(11): Xaa can be Leu, Met, Phe, Ile, Val, Trp, Ala, Tyr, Cys, Gly, Pro, Ser, Thr, Arg, or Lys
SXPEGPVQSPX

SEQ ID NO: 95297 - protein, 9 aa, Artificial Sequence
  Description of Artificial Sequence: Synthetic peptide
  Seed: SPPQGEDSL (MAGC1_HUMAN)
  misc_feature (2)..(2): Xaa can be Arg, Ala, Gly, Ile, Gln, Lys, His, Leu, Cys, Asn, Glu, Met, Asp, or Pro
  misc_feature (9)..(9): Xaa can be Leu, Met, Phe, Tyr, Ile, Val, Trp, Cys, or Ala
SXPQGEDSX

SEQ ID NO: 95298 - protein, 11 aa, Artificial Sequence
  Description of Artificial Sequence: Synthetic peptide
  Seed: SPPQGEDSLSP (MAGC1_HUMAN)
  misc_feature (2)..(2): Xaa can be , or Pro
  misc_feature (11)..(11): Xaa can be Phe, Val, Met, Pro, Leu, Thr, Ser, Ala, Ile, Gly, or Cys
SXPQGEDSLSX

SEQ ID NO: 95299 - protein, 9 aa, Artificial Sequence
  Description of Artificial Sequence: Synthetic peptide
  Seed: SPPQGEDSM (MAGC1_HUMAN)
  misc_feature (2)..(2): Xaa can be Pro, Val, Phe, Ser, Tyr, Thr, Trp, or Met
  misc_feature (9)..(9): Xaa can be Tyr, Val, Leu, Ile, Phe, Met, Trp, Ala, Thr, Pro, or Cys
SXPQGEDSX

SEQ ID NO: 95300 - protein, 11 aa, Artificial Sequence
  Description of Artificial Sequence: Synthetic peptide
  Seed: SPPQGEDSMSP (MAGC1_HUMAN)
  misc_feature (2)..(2): Xaa can be , or Pro
  misc_feature (11)..(11): Xaa can be Pro, Met, Phe, Gly, Thr, Leu, Ile, Cys, Ala, Val, or Ser
SXPQGEDSMSX

SEQ ID NO: 95301 - protein, 8 aa, Artificial Sequence
  Description of Artificial Sequence: Synthetic peptide
  Seed: SPPRYEFL (MAGC1_HUMAN)
  misc_feature (2)..(2): Xaa can be , or Pro
  misc_feature (8)..(8): Xaa can be Val, Leu, or Ile
SXPRYEFX

SEQ ID NO: 95302 - protein, 9 aa, Artificial Sequence
  Description of Artificial Sequence: Synthetic peptide
  Seed: SPPRYEFLW (MAGC1_HUMAN)
  misc_feature (2)..(2): Xaa can be Ala, Thr, Ser, Pro, Leu, Met, Val, Cys, Ile, Gly, Trp, Asn, Glu, Phe, Asp, or Gln
  misc_feature (9)..(9): Xaa can be Trp, Phe, Tyr, Leu, Met, or Ile
SXPRYEFLX

SEQ ID NO: 95303 - protein, 10 aa, Artificial Sequence
  Description of Artificial Sequence: Synthetic peptide
  Seed: SPQGEDSLSP (MAGC1_HUMAN)
  misc_feature (2)..(2): Xaa can be , or Pro
  misc_feature (10)..(10): Xaa can be Cys, Leu, Thr, Met, Ala, Gly, Ser, Val, Phe, Tyr, Ile, or Pro
SXQGEDSLSX

SEQ ID NO: 95304 - protein, 11 aa, Artificial Sequence
  Description of Artificial Sequence: Synthetic peptide
  Seed: SPQGEDSLSPH (MAGC1_HUMAN)
  misc_feature (2)..(2): Xaa can be Pro, Ala, or Val
  misc_feature (11)..(11): Xaa can be Tyr, Phe, His, Met, Leu, or Trp
SXQGEDSLSPX

SEQ ID NO: 95305 - protein, 9 aa, Artificial Sequence
  Description of Artificial Sequence: Synthetic peptide
  Seed: SPQSPPEGM (MAGC1_HUMAN)
  misc_feature (2)..(2): Xaa can be , or Pro
  misc_feature (9)..(9): Xaa can be , or Met
SXQSPPEGX

SEQ ID NO: 95306 - protein, 11 aa, Artificial Sequence
  Description of Artificial Sequence: Synthetic peptide
  Seed: SPQSPPEGMHS (MAGC1_HUMAN)
  misc_feature (2)..(2): Xaa can be Pro, or Ala
  misc_feature (11)..(11): Xaa can be Ala, Leu, Met, Thr, His, Phe, Ser, Tyr, Arg, Cys, Trp, Pro, Ile, Val, Gly, Gln, or Lys
SXQSPPEGMHX

SEQ ID NO: 95307 - protein, 9 aa, Artificial Sequence
  Description of Artificial Sequence: Synthetic peptide
  Seed: SPQSPPEGP (MAGC1_HUMAN)
  misc_feature (2)..(2): Xaa can be Pro, Ala, Val, Ile, Ser, Met, Gly, His, Gln, Leu, Glu, Thr, Arg, Tyr, Phe, Asn, Trp, Cys, Asp, or Lys
  misc_feature (9)..(9): Xaa can be Tyr, Phe, Leu, Met, Ile, Lys, Arg, Val, Trp, Ala, Cys, His, Gln, Ser, Gly, Thr, or Pro
SXQSPPEGX

SEQ ID NO: 95308 - protein, 10 aa, Artificial Sequence
  Description of Artificial Sequence: Synthetic peptide
  Seed: SPQSPPEGPA (MAGC1_HUMAN)
  misc_feature (2)..(2): Xaa can be Pro, or Ala
  misc_feature (10)..(10): Xaa can be Leu, Ala, Ile, Tyr, Cys, Trp, Phe, Pro, Arg, Glu, Gly, Gln, Val, Thr, His, Lys, Ser, or Me t
SXQSPPEGPX

SEQ ID NO: 95309 - protein, 11 aa, Artificial Sequence
  Description of Artificial Sequence: Synthetic peptide
  Seed: SPQSPPEGPAQ (MAGC1_HUMAN)
  misc_feature (2)..(2): Xaa can be Pro, Ala, Val, Gly, Ile, Met, Thr, Ser, Leu, or Cys
  misc_feature (11)..(11): Xaa can be Ala, Leu, Met, Cys, Phe, Val, Ile, Pro, Ser, Gly, Thr, Asp, Glu, Gln, Arg, His, Lys, Tyr, Asn, or Trp
SXQSPPEGPAX

SEQ ID NO: 95310 - protein, 10 aa, Artificial Sequence
  Description of Artificial Sequence: Synthetic peptide
  Seed: SPSFSSTLLS (MAGC1_HUMAN)
  misc_feature (2)..(2): Xaa can be , or Pro
  misc_feature (10)..(10): Xaa can be Cys, Met, Leu, Arg, Lys, Ser, Tyr, Phe, Asp, Glu, Val, Trp, Thr, Gln, Gly, Asn, His, Ile, Ala, or Pro
SXSFSSTLLX

SEQ ID NO: 95311 - protein, 10 aa, Artificial Sequence
  Description of Artificial Sequence: Synthetic peptide
  Seed: SPSFSSTLVS (MAGC1_HUMAN)
  misc_feature (2)..(2): Xaa can be , or Pro
  misc_feature (10)..(10): Xaa can be Tyr, Ala, Gly, Thr, Pro, Cys, Ser, Leu, Met, Phe, Val, or Ile
SXSFSSTLVX

SEQ ID NO: 95312 - protein, 11 aa, Artificial Sequence
  Description of Artificial Sequence: Synthetic peptide
  Seed: SPSFSSTLVSL (MAGC1_HUMAN)
  misc_feature (2)..(2): Xaa can be Pro, Ala, Ser, Val, or Thr
  misc_feature (11)..(11): Xaa can be Leu, Met, Tyr, Trp, Phe, Val, Ile, Ser, Gly, Cys, Pro, Thr, or Ala
SXSFSSTLVSX

SEQ ID NO: 95313 - protein, 9 aa, Artificial Sequence
  Description of Artificial Sequence: Synthetic peptide
  Seed: SPSSSSTLL (MAGC1_HUMAN)
  misc_feature (2)..(2): Xaa can be , or Pro
  misc_feature (9)..(9): Xaa can be , or Leu
SXSSSSTLX

SEQ ID NO: 95314 - protein, 10 aa, Artificial Sequence
  Description of Artificial Sequence: Synthetic peptide
  Seed: SPSSSSTLLS (MAGC1_HUMAN)
  misc_feature (2)..(2): Xaa can be , or Pro
  misc_feature (10)..(10): Xaa can be Gly, Asn, His, Pro, Thr, Asp, Ala, Gln, Phe, Tyr, Ile, Leu, Lys, Val, Arg, Trp, Glu, Cys, Met, or Ser
SXSSSSTLLX

SEQ ID NO: 95315 - protein, 11 aa, Artificial Sequence
  Description of Artificial Sequence: Synthetic peptide
  Seed: SPSSSSTLLSL (MAGC1_HUMAN)
  misc_feature (2)..(2): Xaa can be Ser, or Pro
  misc_feature (11)..(11): Xaa can be , or Leu
SXSSSSTLLSX

SEQ ID NO: 95316 - protein, 9 aa, Artificial Sequence
  Description of Artificial Sequence: Synthetic peptide
  Seed: SPVDEYTSS (MAGC1_HUMAN)
  misc_feature (2)..(2): Xaa can be Pro, Ala, Val, Ile, Ser, Thr, or Gly
  misc_feature (9)..(9): Xaa can be Leu, Ala, Met, Phe, Val, Cys, Tyr, Ile, Glu, Gln, Arg, Lys, Gly, Pro, Thr, Ser, Trp, or Hi s
SXVDEYTSX

SEQ ID NO: 95317 - protein, 10 aa, Artificial Sequence
  Description of Artificial Sequence: Synthetic peptide
  Seed: SPVDEYTSSS (MAGC1_HUMAN)
  misc_feature (2)..(2): Xaa can be , or Pro
  misc_feature (10)..(10): Xaa can be Ile, Val, Ser, Cys, Tyr, Thr, Gly, Phe, Met, Ala, Pro, or Leu
SXVDEYTSSX

SEQ ID NO: 95318 - protein, 9 aa, Artificial Sequence
  Description of Artificial Sequence: Synthetic peptide
  Seed: SPVISFSSS (MAGC1_HUMAN)
  misc_feature (2)..(2): Xaa can be Pro, Ala, Val, or Ile
  misc_feature (9)..(9): Xaa can be Leu, Met, Ala, Val, Ile, His, Ser, Phe, Gly, Arg, Tyr, Lys, Pro, Cys, Thr, or Trp
SXVISFSSX

SEQ ID NO: 95319 - protein, 10 aa, Artificial Sequence
  Description of Artificial Sequence: Synthetic peptide
  Seed: SPVISFSSST (MAGC1_HUMAN)
  misc_feature (2)..(2): Xaa can be , or Pro
  misc_feature (10)..(10): Xaa can be Val, Met, Ser, Tyr, Ile, Ala, Leu, Phe, Pro, Cys, or Thr
SXVISFSSSX

SEQ ID NO: 95320 - protein, 11 aa, Artificial Sequence
  Description of Artificial Sequence: Synthetic peptide
  Seed: SPVISFSSSTS (MAGC1_HUMAN)
  misc_feature (2)..(2): Xaa can be , or Pro
  misc_feature (11)..(11): Xaa can be Leu, Pro, Met, Gly, Val, Thr, Ile, Ala, Ser, Cys, or Phe
SXVISFSSSTX

SEQ ID NO: 95321 - protein, 9 aa, Artificial Sequence
  Description of Artificial Sequence: Synthetic peptide
  Seed: SPVSICSSS (MAGC1_HUMAN)
  misc_feature (2)..(2): Xaa can be Pro, Ala, Val, Ile, or Gly
  misc_feature (9)..(9): Xaa can be Ala, Leu, Met, Cys, Ile, Phe, Val, Gln, Gly, Ser, Tyr, Thr, Lys, Trp, Pro, or Arg
SXVSICSSX

SEQ ID NO: 95322 - protein, 10 aa, Artificial Sequence
  Description of Artificial Sequence: Synthetic peptide
  Seed: SPVSICSSST (MAGC1_HUMAN)
  misc_feature (2)..(2): Xaa can be Pro, or Ala
  misc_feature (10)..(10): Xaa can be Leu, Ala, Ser, Gly, Met, Cys, Thr, Phe, Val, Pro, Ile, Tyr, or Trp
SXVSICSSSX

SEQ ID NO: 95323 - protein, 11 aa, Artificial Sequence
  Description of Artificial Sequence: Synthetic peptide
  Seed: SPVSICSSSTP (MAGC1_HUMAN)
  misc_feature (2)..(2): Xaa can be , or Pro
  misc_feature (11)..(11): Xaa can be Ser, Tyr, Ala, Ile, Pro, Gly, Met, Thr, Cys, Phe, Leu, or Val
SXVSICSSSTX

SEQ ID NO: 95324 - protein, 9 aa, Artificial Sequence
  Description of Artificial Sequence: Synthetic peptide
  Seed: SPVSSFPSS (MAGC1_HUMAN)
  misc_feature (2)..(2): Xaa can be Pro, Ala, Val, Ser, Gly, Ile, Thr, Met, Cys, Gln, Asp, Phe, or Leu
  misc_feature (9)..(9): Xaa can be Tyr, Phe, Leu, Ala, Met, Val, Pro, Ile, His, Trp, Cys, Thr, Gln, Arg, Lys, Gly, Asp, Asn, Glu, or Ser
SXVSSFPSX

SEQ ID NO: 95325 - protein, 10 aa, Artificial Sequence
  Description of Artificial Sequence: Synthetic peptide
  Seed: SPVSSFPSST (MAGC1_HUMAN)
  misc_feature (2)..(2): Xaa can be Pro, or Ala
  misc_feature (10)..(10): Xaa can be Met, Leu, Ala, Val, Trp, Gly, Tyr, Ser, Arg, Pro, Cys, Phe, Thr, Ile, or Lys
SXVSSFPSSX

SEQ ID NO: 95326 - protein, 11 aa, Artificial Sequence
  Description of Artificial Sequence: Synthetic peptide
  Seed: SPVSSFPSSTS (MAGC1_HUMAN)
  misc_feature (2)..(2): Xaa can be Pro, or Ala
  misc_feature (11)..(11): Xaa can be Leu, Ala, Pro, Arg, Lys, Met, Tyr, Val, Trp, Phe, Ile, Thr, Cys, Gly, Ser, or His
SXVSSFPSSTX

SEQ ID NO: 95327 - protein, 8 aa, Artificial Sequence
  Description of Artificial Sequence: Synthetic peptide
  Seed: SQNRLLIL (MAGC1_HUMAN)
  misc_feature (2)..(2): Xaa can be Glu, Asp, Gln, Met, Ser, Ala, His, Arg, Lys, Val, Ile, Asn, Leu, or Tyr
  misc_feature (8)..(8): Xaa can be Tyr, Leu, Ile, Val, Met, Phe, Trp, Thr, Pro, Ser, Ala, or Cys
SXNRLLIX

SEQ ID NO: 95328 - protein, 9 aa, Artificial Sequence
  Description of Artificial Sequence: Synthetic peptide
  Seed: SQNRLLILI (MAGC1_HUMAN)
  misc_feature (2)..(2): Xaa can be Arg, Glu, His, Met, Gln, Asp, Leu, Ala, Ser, Ile, Val, Thr, Gly, Asn, Lys, Pro, Tyr, Phe, Cys, or Trp
  misc_feature (9)..(9): Xaa can be Leu, Tyr, Ile, Phe, Met, Val, Lys, Trp, Ala, Arg, Cys, Thr, Ser, Pro, Gly, His, Gln, Glu, Asp, or Asn
SXNRLLILX

SEQ ID NO: 95329 - protein, 10 aa, Artificial Sequence
  Description of Artificial Sequence: Synthetic peptide
  Seed: SQNRLLILIL (MAGC1_HUMAN)
  misc_feature (2)..(2): Xaa can be Arg, Gln, Met, Val, Leu, Lys, His, Thr, Ile, Ser, Glu, or Ala
  misc_feature (10)..(10): Xaa can be Phe, Tyr, Val, Met, Leu, Ile, Trp, Ala, Cys, Ser, Gln, Gly, Glu, Arg, His, Lys, Thr, Asn, Pro, or Asp
SXNRLLILIX

SEQ ID NO: 95330 - protein, 11 aa, Artificial Sequence
  Description of Artificial Sequence: Synthetic peptide
  Seed: SQSPLQSPESA (MAGC1_HUMAN)
  misc_feature (2)..(2): Xaa can be Glu, His, Gln, Asp, Met, Leu, Arg, or Ile
  misc_feature (11)..(11): Xaa can be Ile, Leu, Val, Ala, Cys, Met, Phe, Pro, Thr, Trp, Tyr, Gly, or Ser
SXSPLQSPESX

SEQ ID NO: 95331 - protein, 10 aa, Artificial Sequence
  Description of Artificial Sequence: Synthetic peptide
  Seed: SQSPPEGEDV (MAGC1_HUMAN)
  misc_feature (2)..(2): Xaa can be Glu, His, Gln, Met, Leu, Asp, Ile, Arg, Val, Lys, Ser, Thr, Ala, Tyr, Phe, or Asn
  misc_feature (10)..(10): Xaa can be Trp, Phe, Leu, Ile, Met, Val, Tyr, Ala, Cys, Thr, Asp, Arg, Asn, Ser, Glu, Gly, Pro, Lys, or Gln
SXSPPEGEDX

SEQ ID NO: 95332 - protein, 11 aa, Artificial Sequence
  Description of Artificial Sequence: Synthetic peptide
  Seed: SQSPPEGEDVQ (MAGC1_HUMAN)
  misc_feature (2)..(2): Xaa can be Arg, Gly, Glu, Val, Gln, Ile, Ala, Leu, Met, Asp, Asn, Ser, Thr, Lys, Pro, Phe, Tyr, Trp, His, or Cys
  misc_feature (11)..(11): Xaa can be Lys, Arg, Phe, Glu, Tyr, Asn, Gln, Leu, Met, Trp, His, Asp, Gly, Ile, Val, or Ala
SXSPPEGEDVX

SEQ ID NO: 95333 - protein, 9 aa, Artificial Sequence
  Description of Artificial Sequence: Synthetic peptide
  Seed: SQSPPEGPV (MAGC1_HUMAN)
  misc_feature (2)..(2): Xaa can be Glu, Ala, Val, Ser, Arg, Asp, Gln, Ile, His, Thr, Met, Leu, Gly, Pro, Cys, Asn, Phe, Tyr, Lys, or Trp
  misc_feature (9)..(9): Xaa can be Phe, Met, Leu, Tyr, Val, Ile, Ala, Lys, Arg, His, Trp, Cys, Thr, Pro, Gln, Gly, Ser, Glu, Asn, or Asp
SXSPPEGPX

SEQ ID NO: 95334 - protein, 11 aa, Artificial Sequence
  Description of Artificial Sequence: Synthetic peptide
  Seed: SQSSPEGKDSL (MAGC1_HUMAN)
  misc_feature (2)..(2): Xaa can be Glu, Arg, Gln, Gly, Asp, Val, Ile, Ala, Met, His, Ser, Leu, Thr, Asn, Pro, Phe, Lys, Tyr, Trp, or Cys
  misc_feature (11)..(11): Xaa can be Tyr, Leu, Phe, Trp, Lys, Met, Arg, Ile, Val, Glu, His, Cys, Ala, Asn, Gln, Gly, Asp, Ser, Pro, or Thr
SXSSPEGKDSX

SEQ ID NO: 95335 - protein, 9 aa, Artificial Sequence
  Description of Artificial Sequence: Synthetic peptide
  Seed: SQSSPVSSF (MAGC1_HUMAN)
  misc_feature (2)..(2): Xaa can be Ala, Glu, Arg, Ser, Val, Tyr, Thr, Gln, Ile, His, Pro, Asp, Met, Leu, Phe, Gly, Lys, Trp, Asn, or Cys
  misc_feature (9)..(9): Xaa can be Phe, Ile, His, Met, Arg, Tyr, Leu, Val, Lys, Trp, Ala, Cys, Thr, Gln, Ser, Pro, Gly, Asn, or Glu
SXSSPVSSX

SEQ ID NO: 95336 - protein, 10 aa, Artificial Sequence
  Description of Artificial Sequence: Synthetic peptide
  Seed: SQSSPVSSFP (MAGC1_HUMAN)
  misc_feature (2)..(2): Xaa can be Lys, Gln, Met, Val, Leu, His, Arg, Ile, Glu, Asp, Asn, Phe, Thr, Tyr, Pro, Cys, Ser, Gly, Trp, or Ala
  misc_feature (10)..(10): Xaa can be Tyr, Phe, Met, Lys, Cys, Ala, Thr, Ser, Asn, Gln, Gly, Glu, Ile, Trp, Asp, Pro, His, Leu, Val, or Arg
SXSSPVSSFX

SEQ ID NO: 95337 - protein, 8 aa, Artificial Sequence
  Description of Artificial Sequence: Synthetic peptide
  Seed: SRSFSSTL (MAGC1_HUMAN)
  misc_feature (2)..(2): Xaa can be Pro, His, Tyr, Arg, or Ala
  misc_feature (8)..(8): Xaa can be Leu, Phe, Val, Tyr, Met, Ile, or Ala
SXSFSSTX

SEQ ID NO: 95338 - protein, 9 aa, Artificial Sequence
  Description of Artificial Sequence: Synthetic peptide
  Seed: SRSFSSTLL (MAGC1_HUMAN)
  misc_feature (2)..(2): Xaa can be His, Arg, Pro, Gln, Ala, Tyr, Thr, Val, Ile, Glu, Phe, Met, Gly, Ser, Lys, Trp, Leu, Asn, or Asp
  misc_feature (9)..(9): Xaa can be Leu, Phe, Tyr, Met, Ile, Val, Ala, Trp, His, Cys, Thr, Pro, Ser, Lys, Gly, or Arg
SXSFSSTLX

SEQ ID NO: 95339 - protein, 11 aa, Artificial Sequence
  Description of Artificial Sequence: Synthetic peptide
  Seed: SRSFSSTLLSI (MAGC1_HUMAN)
  misc_feature (2)..(2): Xaa can be Arg, Pro, Tyr, or Phe
  misc_feature (11)..(11): Xaa can be Phe, Leu, Met, Ile, Tyr, Val, Ala, Cys, Trp, Lys, Arg, or His
SXSFSSTLLSX

SEQ ID NO: 95340 - protein, 9 aa, Artificial Sequence
  Description of Artificial Sequence: Synthetic peptide
  Seed: SRYTGYFPV (MAGC1_HUMAN)
  misc_feature (2)..(2): Xaa can be Gln, Arg, Met, His, Lys, Glu, Val, Ala, Thr, Ile, Leu, Ser, Pro, Asn, Tyr, Gly, Asp, Trp, Phe, or Cys
  misc_feature (9)..(9): Xaa can be Met, Tyr, Phe, Leu, Ile, Trp, Val, Ala, His, Cys, Thr, Gly, Ser, Pro, Asn, Gln, Arg, Lys, Glu, or Asp
SXYTGYFPX

SEQ ID NO: 95341 - protein, 10 aa, Artificial Sequence
  Description of Artificial Sequence: Synthetic peptide
  Seed: SRYTGYFPVI (MAGC1_HUMAN)
  misc_feature (2)..(2): Xaa can be Arg, His, Tyr, Gln, Thr, Glu, Cys, Ala, Asp, Lys, Met, Val, Gly, Ile, Leu, Asn, Trp, Pro, Ser, or Phe
  misc_feature (10)..(10): Xaa can be Val, Trp, Tyr, Ile, Met, Leu, Phe, Cys, Ala, Gly, Thr, Ser, His, Pro, Lys, Asn, Asp, Gln, Arg, or Glu
SXYTGYFPVX

SEQ ID NO: 95342 - protein, 11 aa, Artificial Sequence
  Description of Artificial Sequence: Synthetic peptide
  Seed: SRYTGYFPVIF (MAGC1_HUMAN)
  misc_feature (2)..(2): Xaa can be Tyr, Arg, Gln, Met, Trp, Phe, Lys, Ala, His, Glu, Ser, Thr, Ile, Leu, Val, Asn, or Gly
  misc_feature (11)..(11): Xaa can be Phe, Tyr, Met, Leu, Trp, Ile, His, Ala, Val, Thr, Pro, Cys, Gly, Lys, Ser, Arg, Asp, Asn, Glu, or Gln
SXYTGYFPVIX

SEQ ID NO: 95343 - protein, 8 aa, Artificial Sequence
  Description of Artificial Sequence: Synthetic peptide
  Seed: SSALLSIF (MAGC1_HUMAN)
  misc_feature (2)..(2): Xaa can be Ala, Thr, Ser, or Val
  misc_feature (8)..(8): Xaa can be Trp, Phe, Leu, Tyr, Met, His, Val, or Ile
SXALLSIX

SEQ ID NO: 95344 - protein, 11 aa, Artificial Sequence
  Description of Artificial Sequence: Synthetic peptide
  Seed: SSDTLLESDSL (MAGC1_HUMAN)
  misc_feature (2)..(2): Xaa can be Ala, Ser, Val, Leu, Met, Gly, Thr, Ile, Cys, Phe, Gln, Tyr, Trp, Pro, or Asn
  misc_feature (11)..(11): Xaa can be Trp, Leu, Phe, Met, Ile, Val, Tyr, or Lys
SXDTLLESDSX

SEQ ID NO: 95345 - protein, 8 aa, Artificial Sequence
  Description of Artificial Sequence: Synthetic peptide
  Seed: SSFFSSAL (MAGC1_HUMAN)
  misc_feature (2)..(2): Xaa can be Gln, Met, Ala, Lys, Ser, Glu, Leu, Asn, Thr, Gly, His, Tyr, Ile, Phe, Arg, Val, Asp, Trp, or Cys
  misc_feature (8)..(8): Xaa can be Tyr, Phe, Met, Leu, Ile, Trp, Val, His, Ala, Gly, Cys, Ser, Thr, or Pro
SXFFSSAX

SEQ ID NO: 95346 - protein, 9 aa, Artificial Sequence
  Description of Artificial Sequence: Synthetic peptide
  Seed: SSFFSSALL (MAGC1_HUMAN)
  misc_feature (2)..(2): Xaa can be Met, Gln, Thr, Val, Tyr, Ser, Ala, Ile, Gly, Phe, Leu, His, Lys, Asn, Arg, Trp, Glu, Pro, Cys, or Asp
  misc_feature (9)..(9): Xaa can be Tyr, Val, Leu, Phe, Trp, Ile, Met, Lys, Ala, His, Thr, Arg, Ser, Gly, Cys, Pro, Asn, or Gl n
SXFFSSALX

SEQ ID NO: 95347 - protein, 11 aa, Artificial Sequence
  Description of Artificial Sequence: Synthetic peptide
  Seed: SSFFSSALLSI (MAGC1_HUMAN)
  misc_feature (2)..(2): Xaa can be Ser, Ala, Thr, Val, Met, Ile, Cys, Gly, Pro, Asp, Leu, Asn, Trp, Phe, Glu, or Gln
  misc_feature (11)..(11): Xaa can be Trp, Phe, Tyr, Met, Ile, Val, or Leu
SXFFSSALLSX

SEQ ID NO: 95348 - protein, 8 aa, Artificial Sequence
  Description of Artificial Sequence: Synthetic peptide
  Seed: SSFFSYTL (MAGC1_HUMAN)
  misc_feature (2)..(2): Xaa can be Gln, Ala, Ser, Thr, Glu, Asn, Leu, Met, Val, Gly, Asp, His, Ile, Lys, or Cys
  misc_feature (8)..(8): Xaa can be Ile, Leu, Trp, Val, Met, Phe, Tyr, Ala, or Cys
SXFFSYTX

SEQ ID NO: 95349 - protein, 9 aa, Artificial Sequence
  Description of Artificial Sequence: Synthetic peptide
  Seed: SSFFSYTLA (MAGC1_HUMAN)
  misc_feature (2)..(2): Xaa can be Thr, Ser, Val, Gln, Met, Ala, Ile, Leu, Tyr, Trp, Phe, Gly, Asn, Cys, Pro, His, Arg, or Ly s
  misc_feature (9)..(9): Xaa can be Lys, Val, Ala, Ile, Leu, Met, Arg, Thr, Tyr, Gly, Ser, Cys, His, or Phe
SXFFSYTLX

SEQ ID NO: 95350 - protein, 11 aa, Artificial Sequence
  Description of Artificial Sequence: Synthetic peptide
  Seed: SSFFSYTLASL (MAGC1_HUMAN)
  misc_feature (2)..(2): Xaa can be Ser, Thr, Ala, Val, Met, Gly, or Ile
  misc_feature (11)..(11): Xaa can be Trp, Tyr, Phe, Met, Leu, or Ile
SXFFSYTLASX

SEQ ID NO: 95351 - protein, 9 aa, Artificial Sequence
  Description of Artificial Sequence: Synthetic peptide
  Seed: SSFPSSTSS (MAGC1_HUMAN)
  misc_feature (2)..(2): Xaa can be Ala, Val, Ser, Thr, Ile, Gly, Met, Leu, Gln, Asn, Glu, Pro, Cys, Asp, Phe, Tyr, Lys, Arg, Trp, or His
  misc_feature (9)..(9): Xaa can be Tyr, Met, Phe, Leu, His, Lys, Val, Ile, Arg, Trp, Ala, Cys, Gln, Thr, Ser, Asn, Pro, Gly, or Glu
SXFPSSTSX

SEQ ID NO: 95352 - protein, 10 aa, Artificial Sequence
  Description of Artificial Sequence: Synthetic peptide
  Seed: SSFPSSTSSS (MAGC1_HUMAN)
  misc_feature (2)..(2): Xaa can be Ala, Ser, Thr, Val, Gln, Ile, Met, Leu, Gly, Asn, Cys, Glu, Pro, Asp, Lys, Phe, Tyr, Arg, Trp, or His
  misc_feature (10)..(10): Xaa can be Phe, Tyr, Met, Leu, His, Lys, Trp, Arg, Val, Ile, Cys, Ala, Gln, Thr, Ser, Asn, Gly, Pro, or Glu
SXFPSSTSSX

SEQ ID NO: 95353 - protein, 11 aa, Artificial Sequence
  Description of Artificial Sequence: Synthetic peptide
  Seed: SSFPSSTSSSL (MAGC1_HUMAN)
  misc_feature (2)..(2): Xaa can be Pro, Ala, Arg, Ser, Thr, Val, Tyr, Met, Leu, Gln, Ile, Gly, Trp, Phe, Asn, Glu, Cys, Asp, His, or Lys
  misc_feature (11)..(11): Xaa can be Ile, Lys, Ala, Val, Leu, Trp, Met, Tyr, Phe, His, Arg, Cys, Gln, Thr, Ser, Asn, Gly, Glu, or Pro
SXFPSSTSSSX

SEQ ID NO: 95354 - protein, 8 aa, Artificial Sequence
  Description of Artificial Sequence: Synthetic peptide
  Seed: SSFSSTLL (MAGC1_HUMAN)
  misc_feature (2)..(2): Xaa can be Ala, Gln, Ile, Ser, Thr, Gly, Val, Met, Leu, Tyr, Asp, Phe, Asn, Pro, Glu, His, Arg, or Tr p
  misc_feature (8)..(8): Xaa can be Ile, Leu, Val, Trp, Tyr, Phe, Met, Lys, His, Cys, or Ala
SXFSSTLX

SEQ ID NO: 95355 - protein, 9 aa, Artificial Sequence
  Description of Artificial Sequence: Synthetic peptide
  Seed: SSFSSTLLS (MAGC1_HUMAN)
  misc_feature (2)..(2): Xaa can be Thr, Val, Ser, Met, Tyr, Ala, Ile, Trp, Phe, Gly, Gln, His, Cys, Leu, or Asn
  misc_feature (9)..(9): Xaa can be Lys, Ala, Val, Ile, Arg, Tyr, Leu, Met, Ser, Gly, Thr, or His
SXFSSTLLX

SEQ ID NO: 95356 - protein, 10 aa, Artificial Sequence
  Description of Artificial Sequence: Synthetic peptide
  Seed: SSFSSTLLSI (MAGC1_HUMAN)
  misc_feature (2)..(2): Xaa can be Leu, Met, Ala, Gln, Ser, Ile, Val, Thr, Glu, Asn, Gly, Phe, Asp, Tyr, Pro, Cys, Lys, Trp, His, or Arg
  misc_feature (10)..(10): Xaa can be Trp, Val, Tyr, Phe, Ile, Leu, Lys, Met, Ala, Arg, His, Thr, Cys, Ser, Gly, Pro, or Gln
SXFSSTLLSX

SEQ ID NO: 95357 - protein, 11 aa, Artificial Sequence
  Description of Artificial Sequence: Synthetic peptide
  Seed: SSFSSTLLSIF (MAGC1_HUMAN)
  misc_feature (2)..(2): Xaa can be Ser, Thr, Val, Pro, Tyr, or Trp
  misc_feature (11)..(11): Xaa can be Tyr, Phe, Trp, His, Met, Ile, Lys, Leu, or Val
SXFSSTLLSIX

SEQ ID NO: 95358 - protein, 11 aa, Artificial Sequence
  Description of Artificial Sequence: Synthetic peptide
  Seed: SSFSSTLLSIL (MAGC1_HUMAN)
  misc_feature (2)..(2): Xaa can be Ala, Gln, Gly, Ile, Leu, Arg, Lys, Glu, Met, Phe, Asn, Cys, Asp, His, or Ser
  misc_feature (11)..(11): Xaa can be Phe, Trp, Tyr, His, Leu, Met, Lys, or Ile
SXFSSTLLSIX

SEQ ID NO: 95359 - protein, 8 aa, Artificial Sequence
  Description of Artificial Sequence: Synthetic peptide
  Seed: SSFSYTLL (MAGC1_HUMAN)
  misc_feature (2)..(2): Xaa can be Ser, Ala, Gln, Thr, Val, Glu, Gly, Met, Asp, Asn, Leu, Pro, His, Ile, Phe, or Tyr
  misc_feature (8)..(8): Xaa can be Ile, Val, Trp, Leu, Met, Phe, Tyr, Cys, or Ala
SXFSYTLX

SEQ ID NO: 95360 - protein, 9 aa, Artificial Sequence
  Description of Artificial Sequence: Synthetic peptide
  Seed: SSFSYTLLS (MAGC1_HUMAN)
  misc_feature (2)..(2): Xaa can be Thr, Ser, Val, Met, Ile, Tyr, Ala, Trp, Phe, Gly, Gln, Arg, Asn, His, Leu, Lys, or Cys
  misc_feature (9)..(9): Xaa can be Lys, Ala, Arg, Val, Ile, Tyr, Met, Gly, Leu, Ser, His, or Thr
SXFSYTLLX

SEQ ID NO: 95361 - protein, 10 aa, Artificial Sequence
  Description of Artificial Sequence: Synthetic peptide
  Seed: SSFSYTLLSL (MAGC1_HUMAN)
  misc_feature (2)..(2): Xaa can be Gln, Met, Leu, Val, Ile, Ala, Ser, Thr, Lys, Tyr, Gly, Glu, His, Arg, Trp, Phe, Cys, Asp, Asn, or Pro
  misc_feature (10)..(10): Xaa can be Tyr, Phe, Leu, Met, Trp, Val, Ile, His, Ala, Thr, Cys, Ser, Gly, or Asn
SXFSYTLLSX

SEQ ID NO: 95362 - protein, 11 aa, Artificial Sequence
  Description of Artificial Sequence: Synthetic peptide
  Seed: SSFSYTLLSLF (MAGC1_HUMAN)
  misc_feature (2)..(2): Xaa can be Gln, Ser, Thr, Ala, Met, Val, Ile, Lys, Cys, Arg, Gly, Asp, Asn, Glu, Leu, His, Trp, Pro, Tyr, or Phe
  misc_feature (11)..(11): Xaa can be Trp, Met, Tyr, Phe, Leu, Ile, His, Val, Lys, Pro, Glu, Asp, Gly, Thr, Arg, Ala, Gln, Asn, Ser, or Cys
SXFSYTLLSLX

SEQ ID NO: 95363 - protein, 9 aa, Artificial Sequence
  Description of Artificial Sequence: Synthetic peptide
  Seed: SSHESPQSP (MAGC1_HUMAN)
  misc_feature (2)..(2): Xaa can be Ala, Val, Ser, Ile, Thr, Gln, Met, Leu, Asn, Gly, Glu, Phe, Pro, Cys, Asp, Tyr, Lys, Trp, Arg, or His
  misc_feature (9)..(9): Xaa can be Tyr, Phe, Met, Leu, His, Ile, Val, Trp, Lys, Arg, Ala, Cys, Gln, Thr, Ser, Pro, Gly, Glu, or Asn
SXHESPQSX

SEQ ID NO: 95364 - protein, 9 aa, Artificial Sequence
  Description of Artificial Sequence: Synthetic peptide
  Seed: SSLSQSSPV (MAGC1_HUMAN)
  misc_feature (2)..(2): Xaa can be Ala, Thr, Met, Val, Leu, Ser, Ile, Gln, Gly, Phe, Glu, Asn, Cys, Pro, or Tyr
  misc_feature (9)..(9): Xaa can be Tyr, Phe, Lys, Trp, Leu, Met, Val, Ile, His, Ala, Arg, Thr, or Cys
SXLSQSSPX

SEQ ID NO: 95365 - protein, 9 aa, Artificial Sequence
  Description of Artificial Sequence: Synthetic peptide
  Seed: SSPECTQST (MAGC1_HUMAN)
  misc_feature (2)..(2): Xaa can be Ala, Ile, Val, Ser, Met, Leu, Thr, Gly, Phe, Tyr, Gln, Cys, Pro, Asn, Trp, Glu, His, Arg, Lys, or Asp
  misc_feature (9)..(9): Xaa can be Leu, Val, Met, Phe, Ile, Tyr, Cys, Ala, Trp, Thr, Lys, Ser, His, Gln, Arg, Pro, or Gly
SXPECTQSX

SEQ ID NO: 95366 - protein, 10 aa, Artificial Sequence
  Description of Artificial Sequence: Synthetic peptide
  Seed: SSPECTQSTF (MAGC1_HUMAN)
  misc_feature (2)..(2): Xaa can be Ala, Met, Ile, Val, Thr, Ser, Leu, Gln, Phe, Gly, Glu, Asn, Asp, Cys, Tyr, Arg, Trp, Pro, Lys, or His
  misc_feature (10)..(10): Xaa can be Phe, Ile, Tyr, Met, Trp, Leu, Lys, Val, Arg, His, Cys, or Ala
SXPECTQSTX

SEQ ID NO: 95367 - protein, 9 aa, Artificial Sequence
  Description of Artificial Sequence: Synthetic peptide
  Seed: SSPEGKDSL (MAGC1_HUMAN)
  misc_feature (2)..(2): Xaa can be Ala, Pro, Glu, Val, Leu, Tyr, Thr, Ile, Gln, Gly, Phe, Met, Ser, Arg, Asp, His, Trp, Asn, Cys, or Lys
  misc_feature (9)..(9): Xaa can be Tyr, Leu, Met, Val, Phe, Ile, Trp, Arg, Lys, Cys, Ala, His, Thr, Ser, Pro, or Asn
SXPEGKDSX

SEQ ID NO: 95368 - protein, 9 aa, Artificial Sequence
  Description of Artificial Sequence: Synthetic peptide
  Seed: SSPERTHST (MAGC1_HUMAN)
  misc_feature (2)..(2): Xaa can be Ala, Ser, Ile, Val, Thr, Gln, Met, Leu, Arg, Gly, Phe, Asn, Glu, His, Cys, Tyr, Pro, Asp, Trp, or Lys
  misc_feature (9)..(9): Xaa can be Val, Phe, Met, Tyr, Ala, Ile, Cys, Leu, Trp, His, Thr, Lys, Arg, Ser, Pro, Gln, Gly, Glu, or Asn
SXPERTHSX

SEQ ID NO: 95369 - protein, 10 aa, Artificial Sequence
  Description of Artificial Sequence: Synthetic peptide
  Seed: SSPERTHSTF (MAGC1_HUMAN)
  misc_feature (2)..(2): Xaa can be Ile, Val, Ala, Tyr, Leu, Arg, Ser, Thr, Met, Phe, Gln, Gly, Pro, Asn, Trp, Asp, Glu, Cys, Lys, or His
  misc_feature (10)..(10): Xaa can be Ala, Tyr, Phe, Met, Leu, Val, Ile, Trp, His, Lys, Cys, or Arg
SXPERTHSTX

SEQ ID NO: 95370 - protein, 9 aa, Artificial Sequence
  Description of Artificial Sequence: Synthetic peptide
  Seed: SSPERTQST (MAGC1_HUMAN)
  misc_feature (2)..(2): Xaa can be Ala, Ile, Ser, Val, Thr, Met, Leu, Gln, Gly, Phe, Glu, Asn, Arg, Cys, Tyr, His, Pro, Trp, Asp, or Lys
  misc_feature (9)..(9): Xaa can be Phe, Tyr, Val, Cys, Met, Leu, Ala, Ile, Trp, Thr, His, Lys, Arg, Pro, Ser, Gln, Glu, Gly, or Asn
SXPERTQSX

SEQ ID NO: 95371 - protein, 10 aa, Artificial Sequence
  Description of Artificial Sequence: Synthetic peptide
  Seed: SSPERTQSTF (MAGC1_HUMAN)
  misc_feature (2)..(2): Xaa can be Ala, Met, Val, Ile, Thr, Ser, Tyr, Leu, Gln, Gly, Phe, Arg, Trp, Cys, Pro, Asp, Asn, Glu, Lys, or His
  misc_feature (10)..(10): Xaa can be Ile, Phe, Tyr, Val, Met, Leu, Trp, His, Lys, Arg, Cys, or Ala
SXPERTQSTX

SEQ ID NO: 95372 - protein, 9 aa, Artificial Sequence
  Description of Artificial Sequence: Synthetic peptide
  Seed: SSPESAQSA (MAGC1_HUMAN)
  misc_feature (2)..(2): Xaa can be Ala, Pro, Thr, Ile, Ser, Leu, Gly, Met, Gln, Asn, Phe, Cys, Arg, Glu, Asp, His, Lys, or Tr p
  misc_feature (9)..(9): Xaa can be Leu, Tyr, Val, Phe, Ile, Met, Cys, Ala, Arg, Lys, His, Trp, Thr, Ser, Pro, Gln, or Gly
SXPESAQSX

SEQ ID NO: 95373 - protein, 10 aa, Artificial Sequence
  Description of Artificial Sequence: Synthetic peptide
  Seed: SSPESAQSAF (MAGC1_HUMAN)
  misc_feature (2)..(2): Xaa can be Arg, Val, Tyr, Ala, Met, Leu, Ile, Phe, Thr, Gln, Ser, Pro, Gly, Cys, Asp, Glu, Asn, Trp, His, or Lys
  misc_feature (10)..(10): Xaa can be Val, Leu, Met, Phe, Ile, Tyr, Lys, Trp, Arg, His, Cys, or Ala
SXPESAQSAX

SEQ ID NO: 95374 - protein, 9 aa, Artificial Sequence
  Description of Artificial Sequence: Synthetic peptide
  Seed: SSPESAQST (MAGC1_HUMAN)
  misc_feature (2)..(2): Xaa can be Val, Tyr, Trp, or Ser
  misc_feature (9)..(9): Xaa can be Leu, Ala, Val, Trp, Lys, Tyr, Ile, Phe, Met, Cys, Arg, Thr, Ser, Gln, or His
SXPESAQSX

SEQ ID NO: 95375 - protein, 10 aa, Artificial Sequence
  Description of Artificial Sequence: Synthetic peptide
  Seed: SSPESAQSTF (MAGC1_HUMAN)
  misc_feature (2)..(2): Xaa can be Arg, Met, Tyr, Val, Leu, Ala, Ile, Glu, Ser, Gln, Gly, Phe, Thr, Pro, Cys, Asp, Asn, Trp, His, or Lys
  misc_feature (10)..(10): Xaa can be Ile, Leu, Val, Met, Phe, Tyr, Trp, Lys, Arg, His, Ala, or Cys
SXPESAQSTX

SEQ ID NO: 95376 - protein, 9 aa, Artificial Sequence
  Description of Artificial Sequence: Synthetic peptide
  Seed: SSPESDDTL (MAGC1_HUMAN)
  misc_feature (2)..(2): Xaa can be Ala, Tyr, Val, Ile, Phe, Met, Arg, His, Ser, Leu, Thr, Glu, Trp, Gln, Gly, Cys, Asp, Asn, Pro, or Lys
  misc_feature (9)..(9): Xaa can be Met, Ile, Leu, Tyr, Phe, Lys, Trp, Val, Arg, Ala, His, or Cys
SXPESDDTX

SEQ ID NO: 95377 - protein, 10 aa, Artificial Sequence
  Description of Artificial Sequence: Synthetic peptide
  Seed: SSPESDDTLY (MAGC1_HUMAN)
  misc_feature (2)..(2): Xaa can be Thr, Met, Val, Ser, Ala, Ile, Leu, Gln, Gly, Tyr, Cys, Pro, Phe, Asn, Trp, Glu, Arg, Asp, Lys, or His
  misc_feature (10)..(10): Xaa can be Lys, Arg, Tyr, Trp, Phe, Leu, Met, Val, Ile, His, or Gln
SXPESDDTLX

SEQ ID NO: 95378 - protein, 9 aa, Artificial Sequence
  Description of Artificial Sequence: Synthetic peptide
  Seed: SSPESPLQS (MAGC1_HUMAN)
  misc_feature (2)..(2): Xaa can be Ala, Val, Ile, Ser, Leu, Thr, Gly, Met, Phe, Cys, Pro, Tyr, Gln, Asn, Trp, Lys, Arg, Glu, His, or Asp
  misc_feature (9)..(9): Xaa can be Phe, Ile, Val, Leu, Met, Ala, Cys, Tyr, Thr, Trp, Ser, Pro, Arg, Lys, Gln, His, Asn, Gly, or Glu
SXPESPLQX

SEQ ID NO: 95379 - protein, 11 aa, Artificial Sequence
  Description of Artificial Sequence: Synthetic peptide
  Seed: SSPESPLQSPV (MAGC1_HUMAN)
  misc_feature (2)..(2): Xaa can be Ala, Ser, Val, Ile, Met, Gly, Thr, Leu, Cys, Pro, Tyr, Gln, Phe, or Trp
  misc_feature (11)..(11): Xaa can be Leu, Met, Phe, Ile, Val, or Tyr
SXPESPLQSPX

SEQ ID NO: 95380 - protein, 9 aa, Artificial Sequence
  Description of Artificial Sequence: Synthetic peptide
  Seed: SSPESTQSP (MAGC1_HUMAN)
  misc_feature (2)..(2): Xaa can be Ala, Ser, Val, Ile, Thr, Met, Leu, Gly, Tyr, Cys, Phe, Gln, Asn, Trp, Pro, Asp, Glu, His, Arg, or Lys
  misc_feature (9)..(9): Xaa can be Phe, Leu, Met, Ile, Val, Tyr, Ala, Cys, Trp, Thr, Ser, Lys, His, Gln, Arg, Pro, Gly, or Gl u
SXPESTQSX

SEQ ID NO: 95381 - protein, 10 aa, Artificial Sequence
  Description of Artificial Sequence: Synthetic peptide
  Seed: SSPESTQSPF (MAGC1_HUMAN)
  misc_feature (2)..(2): Xaa can be Met, Ala, Ile, Gly, Gln, Val, Thr, Leu, Ser, Tyr, Cys, Asn, Phe, Arg, Glu, Asp, Trp, Pro, His, or Lys
  misc_feature (10)..(10): Xaa can be Ile, Met, Leu, Phe, Tyr, Val, Lys, Arg, Trp, His, Ala, or Cys
SXPESTQSPX

SEQ ID NO: 95382 - protein, 8 aa, Artificial Sequence
  Description of Artificial Sequence: Synthetic peptide
  Seed: SSPPRYEF (MAGC1_HUMAN)
  misc_feature (2)..(2): Xaa can be Ala, Tyr, Phe, Ser, Arg, Gly, Thr, Met, Ile, Gln, Val, Leu, Asn, His, Trp, Glu, Lys, Cys, Pro, or Asp
  misc_feature (8)..(8): Xaa can be Met, Ile, Leu, Phe, Tyr, Val, Trp, His, Ala, Cys, Lys, or Arg
SXPPRYEX

SEQ ID NO: 95383 - protein, 9 aa, Artificial Sequence
  Description of Artificial Sequence: Synthetic peptide
  Seed: SSPPRYEFL (MAGC1_HUMAN)
  misc_feature (2)..(2): Xaa can be Ala, Met, Tyr, Gly, Phe, Arg, Val, Ser, Ile, Gln, Leu, Thr, Pro, Glu, Asn, His, Asp, Trp, Cys, or Lys
  misc_feature (9)..(9): Xaa can be Phe, Met, Val, Leu, Ile, Tyr, Trp, Arg, Ala, Cys, Lys, His, Thr, or Ser
SXPPRYEFX

SEQ ID NO: 95384 - protein, 10 aa, Artificial Sequence
  Description of Artificial Sequence: Synthetic peptide
  Seed: SSPPRYEFLW (MAGC1_HUMAN)
  misc_feature (2)..(2): Xaa can be Tyr, Phe, Trp, Met, Leu, Gln, Thr, Ser, Ile, Val, Gly, Ala, His, Asn, Cys, Arg, Glu, Asp, or Pro
  misc_feature (10)..(10): Xaa can be Trp, Phe, Ile, Leu, Tyr, Met, Val, Gly, Pro, Thr, Ala, or Cys
SXPPRYEFLX

SEQ ID NO: 95385 - protein, 9 aa, Artificial Sequence
  Description of Artificial Sequence: Synthetic peptide
  Seed: SSSDTLLES (MAGC1_HUMAN)
  misc_feature (2)..(2): Xaa can be Ala, Ser, Val, Ile, Thr, Met, Leu, Gln, Gly, Glu, Asn, Phe, Cys, Asp, Tyr, Pro, Lys, Arg, Trp, or His
  misc_feature (9)..(9): Xaa can be Phe, Tyr, Met, Leu, His, Lys, Arg, Ile, Val, Trp, Ala, Cys, Gln, Thr, Ser, Gly, Asn, Glu, or Pro
SXSDTLLEX

SEQ ID NO: 95386 - protein, 9 aa, Artificial Sequence
  Description of Artificial Sequence: Synthetic peptide
  Seed: SSSESPQSC (MAGC1_HUMAN)
  misc_feature (2)..(2): Xaa can be Ala, Ser, Val, Thr, Ile, Gly, Met, Gln, Leu, Phe, Cys, Tyr, Asn, Pro, Trp, Glu, Asp, Arg, Lys, or His
  misc_feature (9)..(9): Xaa can be Tyr, Phe, Met, Leu, Lys, Arg, Ile, Val, Trp, His, Ala, Cys, Gln, Thr, Ser, Pro, or Gly
SXSESPQSX

SEQ ID NO: 95387 - protein, 8 aa, Artificial Sequence
  Description of Artificial Sequence: Synthetic peptide
  Seed: SSSFSYTL (MAGC1_HUMAN)
  misc_feature (2)..(2): Xaa can be Ala, Ser, Thr, Val, Met, Ile, Asn, Cys, or Gly
  misc_feature (8)..(8): Xaa can be Trp, Met, Leu, Phe, Tyr, Ile, or Val
SXSFSYTX

SEQ ID NO: 95388 - protein, 9 aa, Artificial Sequence
  Description of Artificial Sequence: Synthetic peptide
  Seed: SSSFSYTLL (MAGC1_HUMAN)
  misc_feature (2)..(2): Xaa can be Thr, Val, Ala, Met, Ser, Leu, Gln, Ile, Gly, Asn, Glu, Tyr, Phe, Arg, Cys, Pro, Asp, His, or Trp
  misc_feature (9)..(9): Xaa can be Leu, Trp, Met, Phe, Tyr, Lys, Val, Ile, Ala, His, or Thr
SXSFSYTLX

SEQ ID NO: 95389 - protein, 11 aa, Artificial Sequence
  Description of Artificial Sequence: Synthetic peptide
  Seed: SSSFSYTLLSL (MAGC1_HUMAN)
  misc_feature (2)..(2): Xaa can be Arg, Met, Ser, Lys, Thr, Ala, Ile, His, Val, Tyr, Trp, Leu, Gln, Phe, Gly, Cys, Asn, or Pr o
  misc_feature (11)..(11): Xaa can be Trp, Phe, Tyr, Met, Leu, or Ile
SXSFSYTLLSX

SEQ ID NO: 95390 - protein, 10 aa, Artificial Sequence
  Description of Artificial Sequence: Synthetic peptide
  Seed: SSSLSQSSPV (MAGC1_HUMAN)
  misc_feature (2)..(2): Xaa can be Thr, Val, Ala, Ser, or Ile
  misc_feature (10)..(10): Xaa can be Val, Ile, or Leu
SXSLSQSSPX

SEQ ID NO: 95391 - protein, 8 aa, Artificial Sequence
  Description of Artificial Sequence: Synthetic peptide
  Seed: SSSPVDEY (MAGC1_HUMAN)
  misc_feature (2)..(2): Xaa can be Ala, Ser, Thr, Gln, Val, Ile, Leu, Gly, Met, Phe, Pro, Glu, Asn, or Tyr
  misc_feature (8)..(8): Xaa can be Lys, Arg, Tyr, Phe, Leu, Met, Ile, Val, or His
SXSPVDEX

SEQ ID NO: 95392 - protein, 9 aa, Artificial Sequence
  Description of Artificial Sequence: Synthetic peptide
  Seed: SSSSSSSTL (MAGC1_HUMAN)
  misc_feature (2)..(2): Xaa can be Ala, Gln, Met, Arg, Glu, Leu, Ser, Thr, Ile, Val, Gly, Asp, Lys, Asn, Phe, Tyr, His, Pro, Trp, or Cys
  misc_feature (9)..(9): Xaa can be Tyr, Phe, Met, Leu, Trp, Ile, Val, Lys, Arg, Ala, His, Thr, Cys, Ser, Gly, or Gln
SXSSSSSTX

SEQ ID NO: 95393 - protein, 10 aa, Artificial Sequence
  Description of Artificial Sequence: Synthetic peptide
  Seed: SSSSSSSTLL (MAGC1_HUMAN)
  misc_feature (2)..(2): Xaa can be Ala, Ser, Thr, Val, Ile, Gly, Leu, Met, Asn, Gln, Phe, Glu, Asp, Cys, Lys, Pro, His, Trp, Tyr, or Arg
  misc_feature (10)..(10): Xaa can be Met, Leu, Tyr, Trp, Phe, Lys, Arg, Ile, His, or Val
SXSSSSSTLX

SEQ ID NO: 95394 - protein, 8 aa, Artificial Sequence
  Description of Artificial Sequence: Synthetic peptide
  Seed: SSSSSSTL (MAGC1_HUMAN)
  misc_feature (2)..(2): Xaa can be Pro, or Ser
  misc_feature (8)..(8): Xaa can be Leu, Val, Ala, Met, Ile, or Phe
SXSSSSTX

SEQ ID NO: 95395 - protein, 9 aa, Artificial Sequence
  Description of Artificial Sequence: Synthetic peptide
  Seed: SSSSSSTLL (MAGC1_HUMAN)
  misc_feature (2)..(2): Xaa can be Pro, Ala, Arg, Thr, Val, Gln, His, Ser, Tyr, Phe, Ile, Met, Leu, Cys, Gly, Trp, Glu, Asn, Asp, or Lys
  misc_feature (9)..(9): Xaa can be Tyr, Leu, Phe, Met, Trp, Ile, Val, Ala, His, Thr, Cys, Ser, Gly, or Pro
SXSSSSTLX

SEQ ID NO: 95396 - protein, 11 aa, Artificial Sequence
  Description of Artificial Sequence: Synthetic peptide
  Seed: SSSSSSTLLSL (MAGC1_HUMAN)
  misc_feature (2)..(2): Xaa can be Pro, Ala, Arg, Thr, Ser, Phe, Ile, Val, Asn, Glu, Cys, Met, Asp, Leu, Gln, Gly, Tyr, Trp, Lys, or His
  misc_feature (11)..(11): Xaa can be Tyr, Trp, Leu, Phe, Met, Lys, Arg, Ile, Val, Cys, Ala, Ser, Gly, Thr, His, or Pro
SXSSSSTLLSX

SEQ ID NO: 95397 - protein, 8 aa, Artificial Sequence
  Description of Artificial Sequence: Synthetic peptide
  Seed: SSSSSTLL (MAGC1_HUMAN)
  misc_feature (2)..(2): Xaa can be Ser, Ala, Thr, Val, or Ile
  misc_feature (8)..(8): Xaa can be Leu, Tyr, Phe, Met, or Ile
SXSSSTLX

SEQ ID NO: 95398 - protein, 10 aa, Artificial Sequence
  Description of Artificial Sequence: Synthetic peptide
  Seed: SSSSSTLLSL (MAGC1_HUMAN)
  misc_feature (2)..(2): Xaa can be Arg, Leu, Thr, Met, Gln, Val, Ser, Ala, Ile, Gly, Asn, Asp, Glu, Lys, Cys, Tyr, Phe, His, Pro, or Trp
  misc_feature (10)..(10): Xaa can be Phe, Trp, Val, Leu, Met, Tyr, Ile, Lys, Arg, His, Ala, Cys, Thr, Asn, or Gln
SXSSSTLLSX

SEQ ID NO: 95399 - protein, 11 aa, Artificial Sequence
  Description of Artificial Sequence: Synthetic peptide
  Seed: SSSSSTLLSLF (MAGC1_HUMAN)
  misc_feature (2)..(2): Xaa can be Thr, Ser, Val, Ala, Ile, Gln, Leu, Gly, Met, Lys, Asp, Phe, Arg, Glu, Asn, Tyr, His, Trp, Cys, or Pro
  misc_feature (11)..(11): Xaa can be Trp, Phe, Tyr, Met, Lys, Arg, Leu, His, or Ile
SXSSSTLLSLX

SEQ ID NO: 95400 - protein, 9 aa, Artificial Sequence
  Description of Artificial Sequence: Synthetic peptide
  Seed: SSSSTLLSL (MAGC1_HUMAN)
  misc_feature (2)..(2): Xaa can be Arg, Ala, Leu, Met, Ser, Thr, Val, Gln, Tyr, Ile, Phe, Gly, Lys, Asn, His, Trp, Asp, Glu, Cys, or Pro
  misc_feature (9)..(9): Xaa can be Met, Val, Phe, Tyr, Leu, Ile, Lys, Arg, Trp, Ala, Cys, His, Thr, Gly, Asn, Pro, Glu, Ser, or Gln
SXSSTLLSX

SEQ ID NO: 95401 - protein, 10 aa, Artificial Sequence
  Description of Artificial Sequence: Synthetic peptide
  Seed: SSSSTLLSLF (MAGC1_HUMAN)
  misc_feature (2)..(2): Xaa can be Tyr, Gln, Met, Pro, Asp, His, Ser, Ala, Thr, Asn, Gly, Glu, Ile, Lys, Arg, Val, Leu, Cys, Trp, or Phe
  misc_feature (10)..(10): Xaa can be Met, Leu, Trp, Tyr, Ile, Phe, His, Val, Asp, Thr, Ala, Lys, Ser, Pro, Cys, Arg, Asn, Gln, Glu, or Gly
SXSSTLLSLX

SEQ ID NO: 95402 - protein, 8 aa, Artificial Sequence
  Description of Artificial Sequence: Synthetic peptide
  Seed: SSSTLLSL (MAGC1_HUMAN)
  misc_feature (2)..(2): Xaa can be Ala, Val, Ser, Gly, Thr, Ile, Gln, Asn, Leu, Met, Glu, Asp, Cys, His, Phe, Tyr, or Arg
  misc_feature (8)..(8): Xaa can be Leu, Val, Trp, Ile, Tyr, Phe, Met, Arg, Lys, or His
SXSTLLSX

SEQ ID NO: 95403 - protein, 9 aa, Artificial Sequence
  Description of Artificial Sequence: Synthetic peptide
  Seed: SSSTLLSLF (MAGC1_HUMAN)
  misc_feature (2)..(2): Xaa can be Gln, Ala, Ile, Gly, Met, Ser, Arg, Thr, Val, Tyr, Asn, Leu, Phe, Glu, Cys, Trp, Lys, Asp, Pro, or His
  misc_feature (9)..(9): Xaa can be Trp, Tyr, Leu, Phe, Met, Ile, Val, Lys, Arg, His, Ala, or Cys
SXSTLLSLX

SEQ ID NO: 95404 - protein, 8 aa, Artificial Sequence
  Description of Artificial Sequence: Synthetic peptide
  Seed: SSSTLVSI (MAGC1_HUMAN)
  misc_feature (2)..(2): Xaa can be Thr, Ser, Ala, Gln, Ile, Val, Gly, Leu, Met, Glu, or Asn
  misc_feature (8)..(8): Xaa can be Ile, Val, Leu, Lys, Phe, Met, or Tyr
SXSTLVSX

SEQ ID NO: 95405 - protein, 9 aa, Artificial Sequence
  Description of Artificial Sequence: Synthetic peptide
  Seed: SSSTLVSIF (MAGC1_HUMAN)
  misc_feature (2)..(2): Xaa can be Ala, Gln, Ser, Met, Leu, Ile, Arg, Gly, Thr, Val, Pro, Phe, Asn, Cys, Glu, Tyr, Lys, Asp, His, or Trp
  misc_feature (9)..(9): Xaa can be Met, Leu, Phe, Tyr, Trp, Ile, Lys, Val, Arg, His, Ala, Gly, Gln, Cys, or Thr
SXSTLVSIX

SEQ ID NO: 95406 - protein, 8 aa, Artificial Sequence
  Description of Artificial Sequence: Synthetic peptide
  Seed: SSSTPSSL (MAGC1_HUMAN)
  misc_feature (2)..(2): Xaa can be Ala, Val, Ser, Ile, Thr, Leu, Met, Gly, Phe, Gln, Tyr, His, Asn, Glu, Pro, Asp, Arg, or Cy s
  misc_feature (8)..(8): Xaa can be Leu, Tyr, Phe, Met, Lys, Arg, Val, Ile, His, or Trp
SXSTPSSX

SEQ ID NO: 95407 - protein, 8 aa, Artificial Sequence
  Description of Artificial Sequence: Synthetic peptide
  Seed: SSSTSLSL (MAGC1_HUMAN)
  misc_feature (2)..(2): Xaa can be Ala, Ser, Thr, Val, Ile, Gly, Leu, Gln, Asp, Phe, Asn, Tyr, Glu, Cys, His, Arg, or Met
  misc_feature (8)..(8): Xaa can be Leu, Trp, Tyr, Phe, Ile, Arg, Lys, Met, Val, or His
SXSTSLSX

SEQ ID NO: 95408 - protein, 9 aa, Artificial Sequence
  Description of Artificial Sequence: Synthetic peptide
  Seed: SSSTSLSPF (MAGC1_HUMAN)
  misc_feature (2)..(2): Xaa can be Gln, Ala, Tyr, Val, Phe, Met, Ile, Ser, Pro, Thr, Gly, Leu, Lys, Glu, Asn, Trp, Cys, His, Arg, or Asp
  misc_feature (9)..(9): Xaa can be Tyr, Phe, Trp, Leu, Met, Lys, Ile, Arg, His, Val, Ala, Cys, Thr, Ser, Gln, or Gly
SXSTSLSPX

SEQ ID NO: 95409 - protein, 9 aa, Artificial Sequence
  Description of Artificial Sequence: Synthetic peptide
  Seed: SSSVMSPSF (MAGC1_HUMAN)
  misc_feature (2)..(2): Xaa can be Ala, Gln, Arg, Val, Ile, Ser, Pro, Gly, Thr, Leu, Met, Glu, Asn, Lys, Tyr, Phe, Asp, His, Trp, or Cys
  misc_feature (9)..(9): Xaa can be Leu, Tyr, Met, Phe, Trp, Val, Ile, His, Lys, Arg, Ala, Cys, Gly, or Thr
SXSVMSPSX

SEQ ID NO: 95410 - protein, 8 aa, Artificial Sequence
  Description of Artificial Sequence: Synthetic peptide
  Seed: SSTLLSIF (MAGC1_HUMAN)
  misc_feature (2)..(2): Xaa can be Ala, Ser, or Thr
  misc_feature (8)..(8): Xaa can be Phe, Trp, Met, Tyr, or Leu
SXTLLSIX

SEQ ID NO: 95411 - protein, 8 aa, Artificial Sequence
  Description of Artificial Sequence: Synthetic peptide
  Seed: SSTLLSIL (MAGC1_HUMAN)
  misc_feature (2)..(2): Xaa can be , or Ser
  misc_feature (8)..(8): Xaa can be , or Leu
SXTLLSIX

SEQ ID NO: 95412 - protein, 8 aa, Artificial Sequence
  Description of Artificial Sequence: Synthetic peptide
  Seed: SSTLLSLF (MAGC1_HUMAN)
  misc_feature (2)..(2): Xaa can be Ser, or Tyr
  misc_feature (8)..(8): Xaa can be , or Phe
SXTLLSLX

SEQ ID NO: 95413 - protein, 11 aa, Artificial Sequence
  Description of Artificial Sequence: Synthetic peptide
  Seed: SSTLLSLFQSF (MAGC1_HUMAN)
  misc_feature (2)..(2): Xaa can be Ser, Gln, Met, Thr, Gly, Pro, Tyr, His, Cys, Phe, Trp, Lys, Arg, Asn, Ala, Leu, Ile, Val, Asp, or Glu
  misc_feature (11)..(11): Xaa can be Tyr, Phe, Trp, or Met
SXTLLSLFQSX

SEQ ID NO: 95414 - protein, 8 aa, Artificial Sequence
  Description of Artificial Sequence: Synthetic peptide
  Seed: SSTLVSIF (MAGC1_HUMAN)
  misc_feature (2)..(2): Xaa can be Ala, Ser, or Thr
  misc_feature (8)..(8): Xaa can be Met, Phe, Leu, Trp, Tyr, or Ile
SXTLVSIX

SEQ ID NO: 95415 - protein, 8 aa, Artificial Sequence
  Description of Artificial Sequence: Synthetic peptide
  Seed: SSTLVSLF (MAGC1_HUMAN)
  misc_feature (2)..(2): Xaa can be Ala, Ser, Thr, Asn, Tyr, Gly, Cys, Val, Ile, or Met
  misc_feature (8)..(8): Xaa can be Trp, Leu, Phe, Met, Tyr, Val, or Ile
SXTLVSLX

SEQ ID NO: 95416 - protein, 11 aa, Artificial Sequence
  Description of Artificial Sequence: Synthetic peptide
  Seed: SSTPSSLPQSF (MAGC1_HUMAN)
  misc_feature (2)..(2): Xaa can be Ala, Arg, Thr, Ile, Val, Ser, Gly, Gln, Met, Leu, Pro, Glu, Asp, Cys, Phe, His, Tyr, Asn, Lys, or Trp
  misc_feature (11)..(11): Xaa can be Tyr, Trp, Phe, Leu, Met, Lys, Arg, Ile, His, Val, Cys, or Ala
SXTPSSLPQSX

SEQ ID NO: 95417 - protein, 11 aa, Artificial Sequence
  Description of Artificial Sequence: Synthetic peptide
  Seed: SSTSLSLPQSF (MAGC1_HUMAN)
  misc_feature (2)..(2): Xaa can be Thr, Ser, Ala, Val, Ile, Leu, Phe, Gln, Arg, Tyr, Gly, Lys, Met, Trp, Pro, Glu, Asn, Cys, His, or Asp
  misc_feature (11)..(11): Xaa can be Phe, Trp, Tyr, Lys, Leu, Met, Ile, or His
SXTSLSLPQSX

SEQ ID NO: 95418 - protein, 8 aa, Artificial Sequence
  Description of Artificial Sequence: Synthetic peptide
  Seed: SSTSLSPF (MAGC1_HUMAN)
  misc_feature (2)..(2): Xaa can be Ser, Ala, Thr, Met, Ile, Val, Tyr, or Phe
  misc_feature (8)..(8): Xaa can be Trp, Phe, Leu, Tyr, or Met
SXTSLSPX

SEQ ID NO: 95419 - protein, 9 aa, Artificial Sequence
  Description of Artificial Sequence: Synthetic peptide
  Seed: SSTSSSLSK (MAGC1_HUMAN)
  misc_feature (2)..(2): Xaa can be Ala, Thr, Val, Ile, Ser, Met, Gly, Cys, Tyr, Asn, Leu, Gln, Phe, Pro, Asp, Trp, or Glu
  misc_feature (9)..(9): Xaa can be Tyr, Arg, Lys, Leu, Phe, Met, Ile, Val, His, Trp, Ala, or Cys
SXTSSSLSX

SEQ ID NO: 95420 - protein, 8 aa, Artificial Sequence
  Description of Artificial Sequence: Synthetic peptide
  Seed: SSVMSPSF (MAGC1_HUMAN)
  misc_feature (2)..(2): Xaa can be Ala, Gln, Ser, Met, Thr, Lys, Glu, Phe, Leu, Gly, Val, Ile, His, Arg, Tyr, or Asn
  misc_feature (8)..(8): Xaa can be Tyr, Trp, Phe, Leu, Met, Ile, Val, or His
SXVMSPSX

SEQ ID NO: 95421 - protein, 8 aa, Artificial Sequence
  Description of Artificial Sequence: Synthetic peptide
  Seed: SSYKDALK (MAGC1_HUMAN)
  misc_feature (2)..(2): Xaa can be Val, Ala, Ile, Thr, or Ser
  misc_feature (8)..(8): Xaa can be Lys, or Arg
SXYKDALX

SEQ ID NO: 95422 - protein, 11 aa, Artificial Sequence
  Description of Artificial Sequence: Synthetic peptide
  Seed: STATESASSSV (MAGC1_HUMAN)
  misc_feature (2)..(2): Xaa can be Ser, Met, Ala, Leu, Thr, Val, Ile, or Gly
  misc_feature (11)..(11): Xaa can be Leu, Met, Ile, Val, Phe, or Ala
SXATESASSSX

SEQ ID NO: 95423 - protein, 9 aa, Artificial Sequence
  Description of Artificial Sequence: Synthetic peptide
  Seed: STFEGFAQS (MAGC1_HUMAN)
  misc_feature (2)..(2): Xaa can be Met, Val, Thr, Leu, Ile, Gln, Ser, Ala, Asn, Glu, Gly, Cys, Phe, Pro, Asp, Tyr, Trp, Arg, Lys, or His
  misc_feature (9)..(9): Xaa can be Val, Leu, Ile, Ala, Met, Thr, Cys, Tyr, Phe, Arg, Lys, Pro, Gly, Ser, His, Glu, Trp, or Gl n
SXFEGFAQX

SEQ ID NO: 95424 - protein, 11 aa, Artificial Sequence
  Description of Artificial Sequence: Synthetic peptide
  Seed: STFEGFAQSPL (MAGC1_HUMAN)
  misc_feature (2)..(2): Xaa can be Leu, Met, Gln, Val, Ile, Thr, Ala, Ser, Gly, Asn, Cys, Glu, Asp, Pro, Phe, or His
  misc_feature (11)..(11): Xaa can be Lys, Arg, Tyr, Val, Phe, Leu, Met, Trp, Ala, Ile, His, Thr, Cys, Ser, or Gly
SXFEGFAQSPX

SEQ ID NO: 95425 - protein, 10 aa, Artificial Sequence
  Description of Artificial Sequence: Synthetic peptide
  Seed: STFEGFAQSS (MAGC1_HUMAN)
  misc_feature (2)..(2): Xaa can be Thr, Val, Ser, Ile, Ala, Met, Asn, Gly, or Leu
  misc_feature (10)..(10): Xaa can be Val, Ile, Leu, Ala, Met, Thr, Ser, or Cys
SXFEGFAQSX

SEQ ID NO: 95426 - protein, 11 aa, Artificial Sequence
  Description of Artificial Sequence: Synthetic peptide
  Seed: STFEGFAQSSL (MAGC1_HUMAN)
  misc_feature (2)..(2): Xaa can be Met, Leu, Gln, Ala, Val, Ile, Thr, Ser, Gly, Glu, Asn, Arg, Tyr, Cys, Pro, Phe, Asp, His, Lys, or Trp
  misc_feature (11)..(11): Xaa can be Trp, Lys, Leu, Tyr, Phe, Met, Arg, His, Val, Ile, Ala, Cys, Thr, Ser, or Gln
SXFEGFAQSSX

SEQ ID NO: 95427 - protein, 9 aa, Artificial Sequence
  Description of Artificial Sequence: Synthetic peptide
  Seed: STFEGFPQS (MAGC1_HUMAN)
  misc_feature (2)..(2): Xaa can be Pro, Ala, Val, Gly, Thr, Ser, Ile, Leu, Gln, Cys, Met, Glu, Asp, Phe, Asn, Tyr, or His
  misc_feature (9)..(9): Xaa can be Tyr, Phe, Ile, Val, Leu, Met, Ala, Cys, Trp, Pro, Thr, His, Asn, Arg, Glu, Gln, Gly, Lys, Asp, or Ser
SXFEGFPQX

SEQ ID NO: 95428 - protein, 10 aa, Artificial Sequence
  Description of Artificial Sequence: Synthetic peptide
  Seed: STFEGFPQSL (MAGC1_HUMAN)
  misc_feature (2)..(2): Xaa can be Pro, His, Gln, Val, Ile, Tyr, Glu, Ser, Met, Thr, Phe, Gly, Leu, Lys, Trp, or Ala
  misc_feature (10)..(10): Xaa can be Phe, Ile, Met, Leu, Val, Arg, Lys, Trp, Cys, Tyr, Ala, Gln, Thr, Ser, Pro, His, Gly, Glu, Asp, or Asn
SXFEGFPQSX

SEQ ID NO: 95429 - protein, 11 aa, Artificial Sequence
  Description of Artificial Sequence: Synthetic peptide
  Seed: STFEGFPQSLL (MAGC1_HUMAN)
  misc_feature (2)..(2): Xaa can be Gln, Met, Leu, Ile, Val, Thr, Ala, Ser, Gly, Glu, Cys, Asn, Phe, Pro, Asp, Tyr, Trp, or Hi s
  misc_feature (11)..(11): Xaa can be Lys, Trp, Arg, Tyr, Phe, Leu, Val, Met, His, Ile, Ala, Cys, Thr, Pro, Glu, Gln, Ser, Gly, Asn, or Asp
SXFEGFPQSLX

SEQ ID NO: 95430 - protein, 11 aa, Artificial Sequence
  Description of Artificial Sequence: Synthetic peptide
  Seed: STFEGFPQSPL (MAGC1_HUMAN)
  misc_feature (2)..(2): Xaa can be Pro, Ala, Val, Ser, Thr, Met, Gly, Ile, or Leu
  misc_feature (11)..(11): Xaa can be Tyr, Met, Leu, Phe, Val, Trp, Ile, Ala, Arg, Ser, Asn, Gln, Lys, Cys, Glu, Thr, Gly, Pro, or His
SXFEGFPQSPX

SEQ ID NO: 95431 - protein, 10 aa, Artificial Sequence
  Description of Artificial Sequence: Synthetic peptide
  Seed: STLLSLFQSF (MAGC1_HUMAN)
  misc_feature (2)..(2): Xaa can be Gln, Met, Trp, Tyr, Ser, Thr, Phe, Val, Lys, Glu, Cys, Gly, Asn, Ile, His, Arg, Ala, Leu, Asp, or Pro
  misc_feature (10)..(10): Xaa can be Tyr, Phe, Trp, Met, Ile, Leu, Val, His, or Ala
SXLLSLFQSX

SEQ ID NO: 95432 - protein, 10 aa, Artificial Sequence
  Description of Artificial Sequence: Synthetic peptide
  Seed: STPSSLPQSF (MAGC1_HUMAN)
  misc_feature (2)..(2): Xaa can be Gly, Tyr, Met, Phe, Val, Leu, Arg, Ile, Ser, Ala, Pro, Thr, Gln, Trp, Cys, Glu, Asp, Asn, His, or Lys
  misc_feature (10)..(10): Xaa can be Leu, Tyr, Trp, Phe, Ile, Met, Val, Lys, Arg, His, Ala, Cys, Gln, Asn, Glu, or Thr
SXPSSLPQSX

SEQ ID NO: 95433 - protein, 9 aa, Artificial Sequence
  Description of Artificial Sequence: Synthetic peptide
  Seed: STQSPFEGF (MAGC1_HUMAN)
  misc_feature (2)..(2): Xaa can be Ala, Val, Leu, Ile, Gln, Gly, Met, Thr, Ser, Trp, Phe, Tyr, Asn, Glu, Pro, Cys, Asp, Arg, His, or Lys
  misc_feature (9)..(9): Xaa can be Tyr, Phe, Met, Trp, Lys, Leu, Arg, Val, Ile, His, Ala, or Gln
SXQSPFEGX

SEQ ID NO: 95434 - protein, 10 aa, Artificial Sequence
  Description of Artificial Sequence: Synthetic peptide
  Seed: STSLSLPQSF (MAGC1_HUMAN)
  misc_feature (2)..(2): Xaa can be Ser, Ala, Gln, Met, Thr, Gly, Val, Ile, Leu, Asn, Asp, Lys, Glu, Trp, Cys, Pro, His, Tyr, Arg, or Phe
  misc_feature (10)..(10): Xaa can be Trp, Phe, Met, Tyr, Lys, Arg, Leu, Ile, or His
SXSLSLPQSX

SEQ ID NO: 95435 - protein, 8 aa, Artificial Sequence
  Description of Artificial Sequence: Synthetic peptide
  Seed: STSSSLSK (MAGC1_HUMAN)
  misc_feature (2)..(2): Xaa can be Thr, Val, Ile, Ser, or Ala
  misc_feature (8)..(8): Xaa can be Lys, Tyr, or Arg
SXSSSLSX

SEQ ID NO: 95436 - protein, 9 aa, Artificial Sequence
  Description of Artificial Sequence: Synthetic peptide
  Seed: SVLQIPVSA (MAGC1_HUMAN)
  misc_feature (2)..(2): Xaa can be Pro, Ala, Val, Thr, Met, Leu, Ile, Ser, Gly, Cys, Gln, Asp, Asn, Phe, Tyr, Glu, His, Trp, Arg, or Lys
  misc_feature (9)..(9): Xaa can be Arg, Lys, Tyr, Leu, Met, Phe, Ala, Val, Ile, His, Cys, Gln, Thr, Trp, Asp, Glu, Asn, Pro, Gly, or Ser
SXLQIPVSX

SEQ ID NO: 95437 - protein, 10 aa, Artificial Sequence
  Description of Artificial Sequence: Synthetic peptide
  Seed: SVLQIPVSAA (MAGC1_HUMAN)
  misc_feature (2)..(2): Xaa can be Pro, Leu, Met, Ile, Val, Thr, Gln, Lys, Tyr, Asn, Phe, Arg, Trp, Ala, Glu, Gly, Cys, Ser, Asp, or His
  misc_feature (10)..(10): Xaa can be Leu, Ala, Ile, Val, Met, Thr, Cys, Phe, Arg, His, Trp, Ser, Lys, Asn, Tyr, Gly, Gln, Glu, or Pro
SXLQIPVSAX

SEQ ID NO: 95438 - protein, 9 aa, Artificial Sequence
  Description of Artificial Sequence: Synthetic peptide
  Seed: SYKDALKDV (MAGC1_HUMAN)
  misc_feature (2)..(2): Xaa can be Tyr, Arg, Phe, Trp, Thr, Met, Ala, Val, Ser, Glu, Gln, His, Leu, Ile, Lys, Gly, Asn, or As p
  misc_feature (9)..(9): Xaa can be Met, Leu, Phe, Tyr, Ile, Val, Trp, His, or Ala
SXKDALKDX

SEQ ID NO: 95439 - protein, 8 aa, Artificial Sequence
  Description of Artificial Sequence: Synthetic peptide
  Seed: SYTLASLL (MAGC1_HUMAN)
  misc_feature (2)..(2): Xaa can be Tyr, Phe, or Trp
  misc_feature (8)..(8): Xaa can be Phe, Met, Leu, Tyr, Trp, or Ile
SXTLASLX

SEQ ID NO: 95440 - protein, 8 aa, Artificial Sequence
  Description of Artificial Sequence: Synthetic peptide
  Seed: SYTLLSLF (MAGC1_HUMAN)
  misc_feature (2)..(2): Xaa can be Tyr, Phe, or Trp
  misc_feature (8)..(8): Xaa can be Phe, Leu, Met, Trp, Tyr, or Ile
SXTLLSLX

SEQ ID NO: 95441 - protein, 8 aa, Artificial Sequence
  Description of Artificial Sequence: Synthetic peptide
  Seed: SYVFVNTL (MAGC1_HUMAN)
  misc_feature (2)..(2): Xaa can be Tyr, Trp, Phe, Arg, or His
  misc_feature (8)..(8): Xaa can be Tyr, Phe, Leu, Met, Trp, Ile, or Val
SXVFVNTX

SEQ ID NO: 95442 - protein, 10 aa, Artificial Sequence
  Description of Artificial Sequence: Synthetic peptide
  Seed: SYVFVNTLDL (MAGC1_HUMAN)
  misc_feature (2)..(2): Xaa can be Tyr, Trp, Phe, or Met
  misc_feature (10)..(10): Xaa can be Phe, Trp, Met, Leu, Tyr, Ile, or Val
SXVFVNTLDX

SEQ ID NO: 95443 - protein, 8 aa, Artificial Sequence
  Description of Artificial Sequence: Synthetic peptide
  Seed: TAGMPSLL (MAGC1_HUMAN)
  misc_feature (2)..(2): Xaa can be Ala, Val, Ser, Thr, Ile, Gly, His, Leu, Met, Glu, Asn, Tyr, Arg, Gln, or Phe
  misc_feature (8)..(8): Xaa can be Leu, Tyr, Phe, Val, Ile, Met, Lys, or His
TXGMPSLX

SEQ ID NO: 95444 - protein, 10 aa, Artificial Sequence
  Description of Artificial Sequence: Synthetic peptide
  Seed: TATESASSSV (MAGC1_HUMAN)
  misc_feature (2)..(2): Xaa can be Ala, Thr, Ser, Val, or Ile
  misc_feature (10)..(10): Xaa can be Val, Leu, Ile, Met, or Phe
TXTESASSSX

SEQ ID NO: 95445 - protein, 11 aa, Artificial Sequence
  Description of Artificial Sequence: Synthetic peptide
  Seed: TATESASSSVM (MAGC1_HUMAN)
  misc_feature (2)..(2): Xaa can be Ala, Val, Thr, Ile, Ser, Gly, Met, Gln, Leu, Asp, Phe, Cys, Asn, Glu, or Trp
  misc_feature (11)..(11): Xaa can be Lys, Arg, Phe, Tyr, His, Leu, Met, or Trp
TXTESASSSVX

SEQ ID NO: 95446 - protein, 10 aa, Artificial Sequence
  Description of Artificial Sequence: Synthetic peptide
  Seed: TDDSTATESA (MAGC1_HUMAN)
  misc_feature (2)..(2): Xaa can be Glu, Gln, or Asp
  misc_feature (10)..(10): Xaa can be Met, Ile, Ala, Val, Leu, Cys, Phe, Pro, Thr, Gly, Ser, Tyr, Lys, or Trp
TXDSTATESX

SEQ ID NO: 95447 - protein, 8 aa, Artificial Sequence
  Description of Artificial Sequence: Synthetic peptide
  Seed: TESASSSV (MAGC1_HUMAN)
  misc_feature (2)..(2): Xaa can be Glu, or Asp
  misc_feature (8)..(8): Xaa can be Ile, Leu, Met, Phe, Cys, Ala, or Val
TXSASSSX

SEQ ID NO: 95448 - protein, 9 aa, Artificial Sequence
  Description of Artificial Sequence: Synthetic peptide
  Seed: TESASSSVM (MAGC1_HUMAN)
  misc_feature (2)..(2): Xaa can be Glu, Gln, Asp, Met, Lys, His, Arg, Ala, Val, Ile, Leu, Pro, Ser, Thr, Gly, Asn, Phe, Tyr, Cys, or Trp
  misc_feature (9)..(9): Xaa can be Phe, Tyr, Met, Leu, Trp, Ile, Val, His, Ala, Cys, Thr, Gly, Pro, Lys, Ser, or Glu
TXSASSSVX

SEQ ID NO: 95449 - protein, 10 aa, Artificial Sequence
  Description of Artificial Sequence: Synthetic peptide
  Seed: TESASSSVMS (MAGC1_HUMAN)
  misc_feature (2)..(2): Xaa can be , or Glu
  misc_feature (10)..(10): Xaa can be Gly, Pro, Ala, Thr, Cys, Val, Phe, Ile, Ser, Met, or Leu
TXSASSSVMX

SEQ ID NO: 95450 - protein, 11 aa, Artificial Sequence
  Description of Artificial Sequence: Synthetic peptide
  Seed: TESASSSVMSP (MAGC1_HUMAN)
  misc_feature (2)..(2): Xaa can be Glu, Asp, or Gln
  misc_feature (11)..(11): Xaa can be Met, Cys, Ala, Leu, Val, Phe, Ile, Tyr, Pro, Trp, Gly, Thr, or Ser
TXSASSSVMSX

SEQ ID NO: 95451 - protein, 10 aa, Artificial Sequence
  Description of Artificial Sequence: Synthetic peptide
  Seed: TFEGFAQSPL (MAGC1_HUMAN)
  misc_feature (2)..(2): Xaa can be Glu, Tyr, Phe, His, Ala, Gly, Ile, Val, Asp, Trp, Met, Thr, Gln, Ser, Lys, Asn, Leu, Cys, Pro, or Arg
  misc_feature (10)..(10): Xaa can be Leu, Met, Phe, Tyr, Val, or Ile
TXEGFAQSPX

SEQ ID NO: 95452 - protein, 10 aa, Artificial Sequence
  Description of Artificial Sequence: Synthetic peptide
  Seed: TFEGFAQSSL (MAGC1_HUMAN)
  misc_feature (2)..(2): Xaa can be Trp, Phe, Arg, Tyr, Met, Ala, Gln, Leu, His, Val, or Ile
  misc_feature (10)..(10): Xaa can be Leu, Met, Tyr, or Phe
TXEGFAQSSX

SEQ ID NO: 95453 - protein, 9 aa, Artificial Sequence
  Description of Artificial Sequence: Synthetic peptide
  Seed: TFEGFPQSL (MAGC1_HUMAN)
  misc_feature (2)..(2): Xaa can be Tyr, Phe, Ala, Ile, Arg, Thr, Pro, Ser, Glu, Leu, Met, Val, Trp, Gln, His, Cys, Gly, Asn, Asp, or Lys
  misc_feature (9)..(9): Xaa can be Tyr, Trp, Ile, Phe, Leu, Met, Val, Lys, Arg, Cys, Ala, His, Thr, or Pro
TXEGFPQSX

SEQ ID NO: 95454 - protein, 10 aa, Artificial Sequence
  Description of Artificial Sequence: Synthetic peptide
  Seed: TFEGFPQSLL (MAGC1_HUMAN)
  misc_feature (2)..(2): Xaa can be Arg, Tyr, Phe, or Trp
  misc_feature (10)..(10): Xaa can be Met, Phe, or Leu
TXEGFPQSLX

SEQ ID NO: 95455 - protein, 10 aa, Artificial Sequence
  Description of Artificial Sequence: Synthetic peptide
  Seed: TFEGFPQSPL (MAGC1_HUMAN)
  misc_feature (2)..(2): Xaa can be Tyr, Phe, or Trp
  misc_feature (10)..(10): Xaa can be Phe, Met, Tyr, or Leu
TXEGFPQSPX

SEQ ID NO: 95456 - protein, 10 aa, Artificial Sequence
  Description of Artificial Sequence: Synthetic peptide
  Seed: TFPSSYKDAL (MAGC1_HUMAN)
  misc_feature (2)..(2): Xaa can be Phe, Met, Tyr, Trp, Leu, Pro, Val, Ala, Asn, Lys, Gln, Cys, His, Ser, Ile, Thr, Glu, Arg, Asp, or Gly
  misc_feature (10)..(10): Xaa can be Met, Leu, Phe, Tyr, Val, or Ile
TXPSSYKDAX

SEQ ID NO: 95457 - protein, 8 aa, Artificial Sequence
  Description of Artificial Sequence: Synthetic peptide
  Seed: TGYFPVIF (MAGC1_HUMAN)
  misc_feature (2)..(2): Xaa can be Ala, Thr, Ser, Gly, or Val
  misc_feature (8)..(8): Xaa can be Phe, Tyr, Met, Leu, Val, or Ile
TXYFPVIX

SEQ ID NO: 95458 - protein, 9 aa, Artificial Sequence
  Description of Artificial Sequence: Synthetic peptide
  Seed: TGYFPVIFR (MAGC1_HUMAN)
  misc_feature (2)..(2): Xaa can be Thr, Val, Ile, Leu, Met, Ala, Ser, Asn, Gly, Gln, Trp, Arg, Glu, Asp, His, Cys, Phe, Pro, Lys, or Tyr
  misc_feature (9)..(9): Xaa can be Lys, Arg, His, Tyr, Leu, Phe, Val, Gln, Met, Ile, Glu, Ser, Asn, or Ala
TXYFPVIFX

SEQ ID NO: 95459 - protein, 10 aa, Artificial Sequence
  Description of Artificial Sequence: Synthetic peptide
  Seed: TGYFPVIFRK (MAGC1_HUMAN)
  misc_feature (2)..(2): Xaa can be Met, Val, Leu, Tyr, Thr, Phe, Gln, Trp, Ile, Gly, Ser, Ala, Asn, His, Arg, Lys, Glu, Cys, Pro, or Asp
  misc_feature (10)..(10): Xaa can be Lys, Arg, His, Pro, Gln, Asn, Met, Val, Phe, Thr, Leu, Ala, Trp, Glu, Cys, Ile, Gly, Tyr, Asp, or Ser
TXYFPVIFRX

SEQ ID NO: 95460 - protein, 8 aa, Artificial Sequence
  Description of Artificial Sequence: Synthetic peptide
  Seed: THSPLQIV (MAGC1_HUMAN)
  misc_feature (2)..(2): Xaa can be His, Arg, or Gln
  misc_feature (8)..(8): Xaa can be Val, Leu, Ala, Ile, Phe, Trp, Thr, Cys, Pro, or Met
TXSPLQIX

SEQ ID NO: 95461 - protein, 9 aa, Artificial Sequence
  Description of Artificial Sequence: Synthetic peptide
  Seed: THSPLQIVP (MAGC1_HUMAN)
  misc_feature (2)..(2): Xaa can be His, Arg, Gln, Lys, Glu, Pro, Ala, or Asn
  misc_feature (9)..(9): Xaa can be Ala, Leu, Val, Ile, Met, Cys, Thr, Phe, Pro, Gly, Ser, Trp, or Tyr
TXSPLQIVX

SEQ ID NO: 95462 - protein, 10 aa, Artificial Sequence
  Description of Artificial Sequence: Synthetic peptide
  Seed: THSPLQIVPS (MAGC1_HUMAN)
  misc_feature (2)..(2): Xaa can be His, Arg, or Gln
  misc_feature (10)..(10): Xaa can be Ala, Cys, Val, Met, Thr, Ile, Pro, Ser, or Leu
TXSPLQIVPX

SEQ ID NO: 95463 - protein, 11 aa, Artificial Sequence
  Description of Artificial Sequence: Synthetic peptide
  Seed: THSPLQIVPSL (MAGC1_HUMAN)
  misc_feature (2)..(2): Xaa can be His, Arg, Gln, Ala, Gly, Glu, or Ser
  misc_feature (11)..(11): Xaa can be Leu, Met, Ala, Phe, Ile, Cys, Val, Trp, Thr, or Pro
TXSPLQIVPSX

SEQ ID NO: 95464 - protein, 8 aa, Artificial Sequence
  Description of Artificial Sequence: Synthetic peptide
  Seed: THSTFEGF (MAGC1_HUMAN)
  misc_feature (2)..(2): Xaa can be , or His
  misc_feature (8)..(8): Xaa can be , or Phe
TXSTFEGX

SEQ ID NO: 95465 - protein, 9 aa, Artificial Sequence
  Description of Artificial Sequence: Synthetic peptide
  Seed: TKAEMLTNV (MAGC1_HUMAN)
  misc_feature (2)..(2): Xaa can be His, Arg, Gln, Glu, Pro, or Lys
  misc_feature (9)..(9): Xaa can be Ala, Val, Leu, Cys, Met, Ile, Pro, Thr, Phe, Gly, or Ser
TXAEMLTNX

SEQ ID NO: 95466 - protein, 9 aa, Artificial Sequence
  Description of Artificial Sequence: Synthetic peptide
  Seed: TKVWVQEHY (MAGC1_HUMAN)
  misc_feature (2)..(2): Xaa can be Arg, His, Gln, Tyr, Met, Phe, Ala, Glu, Leu, Lys, Val, Ile, Ser, Pro, Gly, Trp, Asp, Asn, Thr, or Cys
  misc_feature (9)..(9): Xaa can be Tyr, Phe, Met, Leu, Trp, Ile, or Val
TXVWVQEHX

SEQ ID NO: 95467 - protein, 9 aa, Artificial Sequence
  Description of Artificial Sequence: Synthetic peptide
  Seed: TLASLLQSS (MAGC1_HUMAN)
  misc_feature (2)..(2): Xaa can be Leu, Met, Gln, Ile, Val, Thr, Ser, Ala, Gly, Glu, Asn, Cys, or Phe
  misc_feature (9)..(9): Xaa can be Val, Leu, Ile, Met, Ala, Thr, Cys, Phe, Ser, or Gly
TXASLLQSX

SEQ ID NO: 95468 - protein, 9 aa, Artificial Sequence
  Description of Artificial Sequence: Synthetic peptide
  Seed: TLDEKVDEL (MAGC1_HUMAN)
  misc_feature (2)..(2): Xaa can be Tyr, Phe, Ala, Trp, Ser, Thr, Val, Ile, Leu, Met, Gln, Glu, Arg, Pro, Gly, His, Cys, Asn, Asp, or Lys
  misc_feature (9)..(9): Xaa can be Lys, Trp, Met, Ile, Phe, Val, Tyr, Arg, Leu, Cys, Ala, Thr, His, Pro, Ser, Gln, Gly, Glu, or Asn
TXDEKVDEX

SEQ ID NO: 95469 - protein, 10 aa, Artificial Sequence
  Description of Artificial Sequence: Synthetic peptide
  Seed: TLDEKVDELA (MAGC1_HUMAN)
  misc_feature (2)..(2): Xaa can be Met, Leu, Ala, Ile, Val, Thr, Ser, Gln, Phe, Gly, Asn, Tyr, Cys, Trp, Pro, Asp, Glu, Lys, or His
  misc_feature (10)..(10): Xaa can be Met, Leu, Phe, Val, Ile, Tyr, Lys, Trp, Arg, Ala, Cys, or Thr
TXDEKVDELX

SEQ ID NO: 95470 - protein, 11 aa, Artificial Sequence
  Description of Artificial Sequence: Synthetic peptide
  Seed: TLDEKVDELAR (MAGC1_HUMAN)
  misc_feature (2)..(2): Xaa can be Ala, Val, Ile, Thr, Leu, Met, Ser, Gln, Gly, Arg, Asn, Trp, Phe, Tyr, Cys, Glu, Pro, Asp, His, or Lys
  misc_feature (11)..(11): Xaa can be Tyr, Arg, Lys, Leu, Met, Phe, Glu, Val, Ile, Trp, His, Gln, Asn, Cys, Ala, Thr, or Ser
TXDEKVDELAX

SEQ ID NO: 95471 - protein, 9 aa, Artificial Sequence
  Description of Artificial Sequence: Synthetic peptide
  Seed: TLDLTSEGC (MAGC1_HUMAN)
  misc_feature (2)..(2): Xaa can be Ala, Thr, Ile, Val, Ser, Phe, Leu, Met, Gly, Trp, Cys, Gln, Tyr, Asn, Pro, Asp, Glu, His, or Lys
  misc_feature (9)..(9): Xaa can be Leu, Met, Phe, Ile, Val, Tyr, Trp, Cys, Ala, or Thr
TXDLTSEGX

SEQ ID NO: 95472 - protein, 10 aa, Artificial Sequence
  Description of Artificial Sequence: Synthetic peptide
  Seed: TLDLTSEGCL (MAGC1_HUMAN)
  misc_feature (2)..(2): Xaa can be Phe, Tyr, Ala, Ile, Thr, Leu, Met, Ser, Trp, Val, Gly, Gln, or Cys
  misc_feature (10)..(10): Xaa can be Phe, Leu, Met, Ile, Val, Tyr, or Trp
TXDLTSEGCX

SEQ ID NO: 95473 - protein, 9 aa, Artificial Sequence
  Description of Artificial Sequence: Synthetic peptide
  Seed: TLLESDSLT (MAGC1_HUMAN)
  misc_feature (2)..(2): Xaa can be Met, Leu, Val, Ile, Gln, Thr, Ala, or Ser
  misc_feature (9)..(9): Xaa can be Val, Leu, Ile, Ala, Met, or Thr
TXLESDSLX

SEQ ID NO: 95474 - protein, 9 aa, Artificial Sequence
  Description of Artificial Sequence: Synthetic peptide
  Seed: TLLSIFQSS (MAGC1_HUMAN)
  misc_feature (2)..(2): Xaa can be Leu, Met, Ile, Thr, Gln, Val, Ala, Ser, Phe, Asn, Glu, Cys, Gly, or Tyr
  misc_feature (9)..(9): Xaa can be Val, Leu, Ile, Ala, Met, Thr, Phe, Cys, Lys, Ser, or Arg
TXLSIFQSX

SEQ ID NO: 95475 - protein, 9 aa, Artificial Sequence
  Description of Artificial Sequence: Synthetic peptide
  Seed: TLLSILQSS (MAGC1_HUMAN)
  misc_feature (2)..(2): Xaa can be Leu, Met, Gln, Ile, Val, Thr, Ser, Ala, Asn, Glu, Phe, Gly, Cys, Trp, Asp, or Tyr
  misc_feature (9)..(9): Xaa can be Leu, Val, Ile, Met, Ala, Thr, Cys, Phe, Arg, Lys, Ser, Tyr, or Gly
TXLSILQSX

SEQ ID NO: 95476 - protein, 9 aa, Artificial Sequence
  Description of Artificial Sequence: Synthetic peptide
  Seed: TLLSLFQSF (MAGC1_HUMAN)
  misc_feature (2)..(2): Xaa can be Gln, Leu, Tyr, Met, Arg, Thr, Ile, Ser, Ala, Val, Phe, Gly, Glu, Asp, Asn, Trp, Cys, His, Lys, or Pro
  misc_feature (9)..(9): Xaa can be Leu, Trp, Phe, Tyr, Met, Val, Ile, Lys, Arg, His, Ala, Cys, Thr, or Gly
TXLSLFQSX

SEQ ID NO: 95477 - protein, 9 aa, Artificial Sequence
  Description of Artificial Sequence: Synthetic peptide
  Seed: TLVSIFQSS (MAGC1_HUMAN)
  misc_feature (2)..(2): Xaa can be Met, Leu, Ile, Val, Gln, Thr, Ala, Ser, Gly, Cys, Asn, Glu, or Phe
  misc_feature (9)..(9): Xaa can be Val, Leu, Ile, Met, Ala, Thr, Ser, Phe, or Cys
TXVSIFQSX

SEQ ID NO: 95478 - protein, 9 aa, Artificial Sequence
  Description of Artificial Sequence: Synthetic peptide
  Seed: TLVSLFQSS (MAGC1_HUMAN)
  misc_feature (2)..(2): Xaa can be Met, Leu, Gln, Ile, Val, Thr, Ala, or Ser
  misc_feature (9)..(9): Xaa can be Val, Leu, Ala, Ile, Thr, Ser, or Met
TXVSLFQSX

SEQ ID NO: 95479 - protein, 11 aa, Artificial Sequence
  Description of Artificial Sequence: Synthetic peptide
  Seed: TLYPLQSPQSR (MAGC1_HUMAN)
  misc_feature (2)..(2): Xaa can be Met, Leu, Val, Thr, Ile, Ala, Ser, Trp, Asp, Gly, Cys, Tyr, Gln, Asn, Pro, Phe, Glu, or Hi s
  misc_feature (11)..(11): Xaa can be Arg, Lys, Tyr, Leu, Phe, or His
TXYPLQSPQSX

SEQ ID NO: 95480 - protein, 10 aa, Artificial Sequence
  Description of Artificial Sequence: Synthetic peptide
  Seed: TNVISRYTGY (MAGC1_HUMAN)
  misc_feature (2)..(2): Xaa can be Ala, Gln, Met, Val, Thr, Leu, Ile, Ser, Glu, Lys, Cys, Asp, Asn, Gly, Pro, Phe, Tyr, Arg, His, or Trp
  misc_feature (10)..(10): Xaa can be Lys, Arg, Met, Tyr, or Phe
TXVISRYTGX

SEQ ID NO: 95481 - protein, 9 aa, Artificial Sequence
  Description of Artificial Sequence: Synthetic peptide
  Seed: TPSSLPQSF (MAGC1_HUMAN)
  misc_feature (2)..(2): Xaa can be Pro, Ala, Tyr, Arg, Ile, Thr, Val, Gly, Ser, Gln, Leu, Phe, Met, Asn, Asp, Glu, Trp, His, Cys, or Lys
  misc_feature (9)..(9): Xaa can be Ile, Met, Phe, Val, Leu, Tyr, Trp, Lys, Arg, His, Ala, Cys, Thr, Gln, Pro, Ser, or Gly
TXSSLPQSX

SEQ ID NO: 95482 - protein, 10 aa, Artificial Sequence
  Description of Artificial Sequence: Synthetic peptide
  Seed: TPSSLPQSFP (MAGC1_HUMAN)
  misc_feature (2)..(2): Xaa can be , or Pro
  misc_feature (10)..(10): Xaa can be Ala, Leu, Thr, Met, Val, Pro, Cys, Ile, or Phe
TXSSLPQSFX

SEQ ID NO: 95483 - protein, 8 aa, Artificial Sequence
  Description of Artificial Sequence: Synthetic peptide
  Seed: TQSPFEGF (MAGC1_HUMAN)
  misc_feature (2)..(2): Xaa can be Gln, Leu, or Met
  misc_feature (8)..(8): Xaa can be Tyr, or Phe
TXSPFEGX

SEQ ID NO: 95484 - protein, 8 aa, Artificial Sequence
  Description of Artificial Sequence: Synthetic peptide
  Seed: TQSTFEGF (MAGC1_HUMAN)
  misc_feature (2)..(2): Xaa can be Gln, or His
  misc_feature (8)..(8): Xaa can be Tyr, Leu, Ile, or Phe
TXSTFEGX

SEQ ID NO: 95485 - protein, 9 aa, Artificial Sequence
  Description of Artificial Sequence: Synthetic peptide
  Seed: TSLSLPQSF (MAGC1_HUMAN)
  misc_feature (2)..(2): Xaa can be Arg, Ala, Ser, Tyr, Phe, Gln, Val, Thr, Ile, Leu, Gly, Pro, Met, His, Glu, Asn, Asp, Trp, Lys, or Cys
  misc_feature (9)..(9): Xaa can be Trp, Phe, Leu, Tyr, Met, Ile, Val, Lys, His, Arg, Ala, Cys, Thr, or Gln
TXLSLPQSX

SEQ ID NO: 95486 - protein, 8 aa, Artificial Sequence
  Description of Artificial Sequence: Synthetic peptide
  Seed: TSSFSSTL (MAGC1_HUMAN)
  misc_feature (2)..(2): Xaa can be Ser, Ala, Thr, or Val
  misc_feature (8)..(8): Xaa can be Tyr, Met, Phe, or Leu
TXSFSSTX

SEQ ID NO: 95487 - protein, 9 aa, Artificial Sequence
  Description of Artificial Sequence: Synthetic peptide
  Seed: TSSFSSTLL (MAGC1_HUMAN)
  misc_feature (2)..(2): Xaa can be Ala, Val, Ser, Thr, Ile, Leu, Gly, Met, Phe, Gln, Tyr, Arg, Asn, Cys, Asp, Pro, Trp, Glu, or His
  misc_feature (9)..(9): Xaa can be Leu, Trp, Met, Tyr, Phe, Val, Lys, Ile, Arg, Ala, His, or Thr
TXSFSSTLX

SEQ ID NO: 95488 - protein, 11 aa, Artificial Sequence
  Description of Artificial Sequence: Synthetic peptide
  Seed: TSSFSSTLLSI (MAGC1_HUMAN)
  misc_feature (2)..(2): Xaa can be Ala, Ser, Thr, Cys, Ile, Gly, Met, Val, Gln, Pro, Phe, Glu, Asn, Asp, Trp, or Leu
  misc_feature (11)..(11): Xaa can be Trp, Phe, Ile, Met, Leu, Tyr, or Val
TXSFSSTLLSX

SEQ ID NO: 95489 - protein, 9 aa, Artificial Sequence
  Description of Artificial Sequence: Synthetic peptide
  Seed: TTDDSTATE (MAGC1_HUMAN)
  misc_feature (2)..(2): Xaa can be Ala, Val, Ser, Met, Thr, Ile, Leu, Phe, Gly, Asn, Cys, Gln, Tyr, Trp, Asp, Pro, Glu, Lys, His, or Arg
  misc_feature (9)..(9): Xaa can be Met, Val, Tyr, Ile, Leu, Phe, Lys, Cys, Trp, Ala, Arg, Thr, His, Ser, Pro, Gln, Glu, Gly, or Asn
TXDDSTATX

SEQ ID NO: 95490 - protein, 10 aa, Artificial Sequence
  Description of Artificial Sequence: Synthetic peptide
  Seed: TTDDSTATES (MAGC1_HUMAN)
  misc_feature (2)..(2): Xaa can be Ala, Met, Val, Ile, Thr, Ser, Leu, Phe, Trp, Gln, Tyr, Gly, Asn, Cys, Pro, Lys, Glu, Asp, His, or Arg
  misc_feature (10)..(10): Xaa can be Ile, Leu, Val, Tyr, Met, Phe, Lys, Arg, Trp, Cys, His, Thr, Ala, Ser, Gln, Glu, Pro, Gly, or Asn
TXDDSTATEX

SEQ ID NO: 95491 - protein, 11 aa, Artificial Sequence
  Description of Artificial Sequence: Synthetic peptide
  Seed: TTDDSTATESA (MAGC1_HUMAN)
  misc_feature (2)..(2): Xaa can be Ala, Thr, Ser, Val, Ile, Met, Leu, Gly, Phe, Cys, Trp, Asn, Tyr, Gln, Glu, Asp, Pro, Lys, His, or Arg
  misc_feature (11)..(11): Xaa can be Leu, Tyr, Phe, Met, Ile, Lys, Val, Arg, Trp, His, Cys, Ala, Thr, Gln, Ser, Pro, Glu, Asn, or Gly
TXDDSTATESX

SEQ ID NO: 95492 - protein, 10 aa, Artificial Sequence
  Description of Artificial Sequence: Synthetic peptide
  Seed: TVPITFPSSY (MAGC1_HUMAN)
  misc_feature (2)..(2): Xaa can be Gln, Ala, Val, Ser, Met, Thr, Ile, Leu, Phe, Gly, Asn, Tyr, Lys, Trp, Arg, His, Asp, Glu, Cys, or Pro
  misc_feature (10)..(10): Xaa can be Phe, Met, Tyr, Lys, Leu, Arg, His, Trp, or Ile
TXPITFPSSX

SEQ ID NO: 95493 - protein, 11 aa, Artificial Sequence
  Description of Artificial Sequence: Synthetic peptide
  Seed: TVPITFPSSYK (MAGC1_HUMAN)
  misc_feature (2)..(2): Xaa can be Pro, Lys, Asn, His, Val, Gln, Trp, Thr, Ile, Ser, Phe, Tyr, Ala, Gly, Asp, Glu, Leu, Arg, Cys, or Met
  misc_feature (11)..(11): Xaa can be Lys, or Arg
TXPITFPSSYX

SEQ ID NO: 95494 - protein, 9 aa, Artificial Sequence
  Description of Artificial Sequence: Synthetic peptide
  Seed: TYASEEVIW (MAGC1_HUMAN)
  misc_feature (2)..(2): Xaa can be Tyr, Trp, Phe, Ser, Thr, Ala, Cys, Pro, Met, Asp, Asn, Gln, Leu, Val, Gly, or Ile
  misc_feature (9)..(9): Xaa can be Trp, Phe, Leu, Ile, Met, or Val
TXASEEVIX

SEQ ID NO: 95495 - protein, 8 aa, Artificial Sequence
  Description of Artificial Sequence: Synthetic peptide
  Seed: VDELARFL (MAGC1_HUMAN)
  misc_feature (2)..(2): Xaa can be Glu, Ala, Asp, Ser, Thr, Gln, Ile, Val, or Gly
  misc_feature (8)..(8): Xaa can be Leu, Ile, Met, Phe, Val, or Ala
VXELARFX

SEQ ID NO: 95496 - protein, 9 aa, Artificial Sequence
  Description of Artificial Sequence: Synthetic peptide
  Seed: VDELARFLL (MAGC1_HUMAN)
  misc_feature (2)..(2): Xaa can be Glu, Asp, or Gln
  misc_feature (9)..(9): Xaa can be Leu, Phe, Met, Val, Ile, Tyr, Pro, Ala, Trp, Cys, or Thr
VXELARFLX

SEQ ID NO: 95497 - protein, 10 aa, Artificial Sequence
  Description of Artificial Sequence: Synthetic peptide
  Seed: VDELARFLLL (MAGC1_HUMAN)
  misc_feature (2)..(2): Xaa can be Glu, Arg, Trp, Ala, Gly, Asn, Leu, Tyr, Ile, Pro, Thr, Cys, Asp, Phe, Ser, Val, Lys, Met, His, or Gln
  misc_feature (10)..(10): Xaa can be Leu, Ile, Val, Phe, Met, or Ala
VXELARFLLX

SEQ ID NO: 95498 - protein, 11 aa, Artificial Sequence
  Description of Artificial Sequence: Synthetic peptide
  Seed: VDELARFLLLK (MAGC1_HUMAN)
  misc_feature (2)..(2): Xaa can be Glu, Ser, His, Gln, Thr, Phe, Ile, Ala, Gly, Val, Cys, Pro, Asp, Lys, Asn, Arg, Met, Tyr, Trp, or Leu
  misc_feature (11)..(11): Xaa can be , or Lys
VXELARFLLLX

SEQ ID NO: 95499 - protein, 11 aa, Artificial Sequence
  Description of Artificial Sequence: Synthetic peptide
  Seed: VDEYTSSSDTL (MAGC1_HUMAN)
  misc_feature (2)..(2): Xaa can be Ser, Asp, Leu, Pro, Arg, His, Ile, Val, Asn, Glu, Phe, Ala, Cys, Trp, Met, Gln, Gly, Thr, Tyr, or Lys
  misc_feature (11)..(11): Xaa can be Leu, Ile, Phe, or Trp
VXEYTSSSDTX

SEQ ID NO: 95500 - protein, 9 aa, Artificial Sequence
  Description of Artificial Sequence: Synthetic peptide
  Seed: VDPDDSYVF (MAGC1_HUMAN)
  misc_feature (2)..(2): Xaa can be Glu, Asp, Gln, or Ala
  misc_feature (9)..(9): Xaa can be Leu, Met, Phe, Ile, Trp, Val, or Tyr
VXPDDSYVX

SEQ ID NO: 95501 - protein, 8 aa, Artificial Sequence
  Description of Artificial Sequence: Synthetic peptide
  Seed: VEERAQAI (MAGC1_HUMAN)
  misc_feature (2)..(2): Xaa can be Glu, Asp, or Gln
  misc_feature (8)..(8): Xaa can be Ile, Phe, Leu, Met, Tyr, Val, Ala, Gly, Ser, Pro, Thr, Cys, or Trp
VXERAQAX

SEQ ID NO: 95502 - protein, 9 aa, Artificial Sequence
  Description of Artificial Sequence: Synthetic peptide
  Seed: VEERAQAII (MAGC1_HUMAN)
  misc_feature (2)..(2): Xaa can be Glu, Asp, or Gln
  misc_feature (9)..(9): Xaa can be Trp, Ile, Tyr, Phe, Leu, Met, Ala, Val, Cys, Pro, Gly, Ser, or Thr
VXERAQAIX

SEQ ID NO: 95503 - protein, 10 aa, Artificial Sequence
  Description of Artificial Sequence: Synthetic peptide
  Seed: VEFLAMLKNT (MAGC1_HUMAN)
  misc_feature (2)..(2): Xaa can be , or Glu
  misc_feature (10)..(10): Xaa can be Ile, Ala, Val, Leu, Thr, Met, or Cys
VXFLAMLKNX

SEQ ID NO: 95504 - protein, 11 aa, Artificial Sequence
  Description of Artificial Sequence: Synthetic peptide
  Seed: VEFLAMLKNTV (MAGC1_HUMAN)
  misc_feature (2)..(2): Xaa can be Glu, Gln, His, Asn, Gly, Val, Ile, Arg, Cys, Met, Trp, Pro, Leu, Phe, Asp, Lys, Ser, Thr, Tyr, or Ala
  misc_feature (11)..(11): Xaa can be Val, Leu, Phe, Met, Cys, Ala, or Ile
VXFLAMLKNTX

SEQ ID NO: 95505 - protein, 8 aa, Artificial Sequence
  Description of Artificial Sequence: Synthetic peptide
  Seed: VFVNTLDL (MAGC1_HUMAN)
  misc_feature (2)..(2): Xaa can be Tyr, or Phe
  misc_feature (8)..(8): Xaa can be Met, Leu, Phe, Tyr, or Ile
VXVNTLDX

SEQ ID NO: 95506 - protein, 9 aa, Artificial Sequence
  Description of Artificial Sequence: Synthetic peptide
  Seed: VIFRKAREF (MAGC1_HUMAN)
  misc_feature (2)..(2): Xaa can be Ala, Arg, Ser, Tyr, Pro, Thr, Met, Gln, Phe, Val, Asn, Glu, Ile, Leu, Cys, Asp, Trp, Gly, His, or Lys
  misc_feature (9)..(9): Xaa can be Tyr, Phe, Met, Leu, Ile, Val, Trp, His, Ala, Cys, Thr, Arg, or Lys
VXFRKAREX

SEQ ID NO: 95507 - protein, 9 aa, Artificial Sequence
  Description of Artificial Sequence: Synthetic peptide
  Seed: VIKRKVVEF (MAGC1_HUMAN)
  misc_feature (2)..(2): Xaa can be Pro, Ala, Arg, Gln, Gly, Leu, Ile, Ser, Val, Asn, Met, Tyr, Thr, Phe, Glu, Cys, Asp, Lys, Trp, or His
  misc_feature (9)..(9): Xaa can be Tyr, Phe, Ile, Val, Leu, Met, Trp, Ala, Cys, His, Lys, Thr, Arg, Gln, Ser, Pro, or Gly
VXKRKVVEX

SEQ ID NO: 95508 - protein, 10 aa, Artificial Sequence
  Description of Artificial Sequence: Synthetic peptide
  Seed: VIKRKVVEFL (MAGC1_HUMAN)
  misc_feature (2)..(2): Xaa can be Met, Leu, Pro, Ile, or Ala
  misc_feature (10)..(10): Xaa can be Leu, Met, Ile, Val, or Phe
VXKRKVVEFX

SEQ ID NO: 95509 - protein, 10 aa, Artificial Sequence
  Description of Artificial Sequence: Synthetic peptide
  Seed: VISFSSSTSL (MAGC1_HUMAN)
  misc_feature (2)..(2): Xaa can be Met, Gln, Leu, Lys, Ile, His, Thr, Tyr, Pro, Arg, Phe, Glu, Ala, Gly, Trp, Ser, Asn, Asp, Val, or Cys
  misc_feature (10)..(10): Xaa can be Leu, Val, Ile, Phe, Tyr, Met, Trp, Ala, His, Thr, or Gly
VXSFSSSTSX

SEQ ID NO: 95510 - protein, 9 aa, Artificial Sequence
  Description of Artificial Sequence: Synthetic peptide
  Seed: VISRYTGYF (MAGC1_HUMAN)
  misc_feature (2)..(2): Xaa can be Gln, Thr, Ala, Ser, Val, Met, Ile, Leu, Gly, Lys, Arg, Asn, His, Glu, Pro, Cys, Tyr, Phe, Asp, or Trp
  misc_feature (9)..(9): Xaa can be Tyr, Phe, Met, Trp, Leu, His, Ile, Val, or Ala
VXSRYTGYX

SEQ ID NO: 95511 - protein, 11 aa, Artificial Sequence
  Description of Artificial Sequence: Synthetic peptide
  Seed: VISRYTGYFPV (MAGC1_HUMAN)
  misc_feature (2)..(2): Xaa can be Leu, Met, Glu, Pro, Asp, Tyr, Ala, Ile, Gln, Cys, Asn, Val, His, Gly, Phe, Ser, Arg, Trp, Thr, or Lys
  misc_feature (11)..(11): Xaa can be Ile, Phe, Met, Val, Leu, Ala, or Thr
VXSRYTGYFPX

SEQ ID NO: 95512 - protein, 9 aa, Artificial Sequence
  Description of Artificial Sequence: Synthetic peptide
  Seed: VIWDVLSGI (MAGC1_HUMAN)
  misc_feature (2)..(2): Xaa can be Leu, Met, Val, Ile, Gln, Thr, Ala, Ser, Phe, Gly, Asn, Cys, Glu, Tyr, His, Trp, Asp, Lys, Pro, or Arg
  misc_feature (9)..(9): Xaa can be Leu, Arg, Val, Lys, Ile, Trp, Met, Ala, Phe, Tyr, Thr, Cys, His, Ser, Gly, Gln, or Pro
VXWDVLSGX

SEQ ID NO: 95513 - protein, 11 aa, Artificial Sequence
  Description of Artificial Sequence: Synthetic peptide
  Seed: VIWDVLSGIGV (MAGC1_HUMAN)
  misc_feature (2)..(2): Xaa can be Leu, Met, Ile, Val, Thr, Gln, Ala, or Ser
  misc_feature (11)..(11): Xaa can be Val, Leu, Met, Ala, Ile, Thr, Cys, Phe, or Ser
VXWDVLSGIGX

SEQ ID NO: 95514 - protein, 10 aa, Artificial Sequence
  Description of Artificial Sequence: Synthetic peptide
  Seed: VKQPITKAEM (MAGC1_HUMAN)
  misc_feature (2)..(2): Xaa can be Gln, Met, Arg, Lys, Ala, His, Glu, Leu, Ser, Val, or Ile
  misc_feature (10)..(10): Xaa can be Tyr, Phe, Met, Leu, or Trp
VXQPITKAEX

SEQ ID NO: 95515 - protein, 9 aa, Artificial Sequence
  Description of Artificial Sequence: Synthetic peptide
  Seed: VLQIPVSAA (MAGC1_HUMAN)
  misc_feature (2)..(2): Xaa can be Met, Leu, Ile, Val, Gln, Thr, or Ala
  misc_feature (9)..(9): Xaa can be Val, Leu, Ile, Ala, or Met
VXQIPVSAX

SEQ ID NO: 95516 - protein, 8 aa, Artificial Sequence
  Description of Artificial Sequence: Synthetic peptide
  Seed: VLSGIGVR (MAGC1_HUMAN)
  misc_feature (2)..(2): Xaa can be Ala, Ser, Thr, Gln, Asn, Gly, Leu, Ile, Val, Asp, Phe, or Met
  misc_feature (8)..(8): Xaa can be Lys, Arg, Leu, or Met
VXSGIGVX

SEQ ID NO: 95517 - protein, 9 aa, Artificial Sequence
  Description of Artificial Sequence: Synthetic peptide
  Seed: VLSGIGVRA (MAGC1_HUMAN)
  misc_feature (2)..(2): Xaa can be Leu, Met, Ile, Val, Thr, Gln, Ala, Ser, Phe, or Gly
  misc_feature (9)..(9): Xaa can be Val, Ile, Leu, Ala, Met, Thr, Cys, or Phe
VXSGIGVRX

SEQ ID NO: 95518 - protein, 11 aa, Artificial Sequence
  Description of Artificial Sequence: Synthetic peptide
  Seed: VLSGIGVRAGR (MAGC1_HUMAN)
  misc_feature (2)..(2): Xaa can be Ala, Ser, Val, Thr, Gly, Met, Ile, Pro, Glu, Asp, Gln, Cys, Phe, Leu, Asn, Tyr, Trp, Arg, Lys, or His
  misc_feature (11)..(11): Xaa can be Arg, Lys, Leu, Met, Tyr, Phe, Val, or Ile
VXSGIGVRAGX

SEQ ID NO: 95519 - protein, 8 aa, Artificial Sequence
  Description of Artificial Sequence: Synthetic peptide
  Seed: VPITFPSS (MAGC1_HUMAN)
  misc_feature (2)..(2): Xaa can be , or Pro
  misc_feature (8)..(8): Xaa can be Pro, Ser, Val, Leu, Met, Ala, Ile, Phe, Gly, Thr, or Cys
VXITFPSX

SEQ ID NO: 95520 - protein, 9 aa, Artificial Sequence
  Description of Artificial Sequence: Synthetic peptide
  Seed: VPITFPSSY (MAGC1_HUMAN)
  misc_feature (2)..(2): Xaa can be Gln, Pro, Ala, Met, Ser, Arg, Tyr, Ile, Val, Thr, Leu, Gly, Lys, Cys, His, Asn, Glu, Phe, Trp, or Asp
  misc_feature (9)..(9): Xaa can be Met, Tyr, Phe, Leu, Ile, Val, Trp, His, Lys, Arg, Ala, Cys, Ser, Thr, Gly, Gln, Pro, or As n
VXITFPSSX

SEQ ID NO: 95521 - protein, 10 aa, Artificial Sequence
  Description of Artificial Sequence: Synthetic peptide
  Seed: VPITFPSSYK (MAGC1_HUMAN)
  misc_feature (2)..(2): Xaa can be Thr, Val, Met, Ala, Leu, Phe, Ile, Ser, Gln, Pro, Asn, Glu, Cys, Arg, His, Gly, Asp, Trp, Tyr, or Lys
  misc_feature (10)..(10): Xaa can be Lys, Arg, Tyr, or His
VXITFPSSYX

SEQ ID NO: 95522 - protein, 9 aa, Artificial Sequence
  Description of Artificial Sequence: Synthetic peptide
  Seed: VPNSSPPRY (MAGC1_HUMAN)
  misc_feature (2)..(2): Xaa can be Pro, Ala, Val, Ser, Gln, Thr, Ile, Met, Gly, Leu, His, Arg, Phe, Tyr, Trp, Asn, Cys, Glu, Lys, or Asp
  misc_feature (9)..(9): Xaa can be Tyr, Phe, Met, Leu, Ile, His, Trp, Val, Ala, Ser, Gly, Thr, Cys, or Pro
VXNSSPPRX

SEQ ID NO: 95523 - protein, 11 aa, Artificial Sequence
  Description of Artificial Sequence: Synthetic peptide
  Seed: VPNSSPPRYEF (MAGC1_HUMAN)
  misc_feature (2)..(2): Xaa can be Pro, Val, Met, Thr, Leu, Glu, Gln, Ala, Ser, Ile, Asp, Cys, Lys, His, Gly, Trp, Asn, Phe, Arg, or Tyr
  misc_feature (11)..(11): Xaa can be Phe, Trp, Tyr, Ile, Pro, Thr, Leu, Cys, Ser, Gly, Ala, Met, or Val
VXNSSPPRYEX

SEQ ID NO: 95524 - protein, 11 aa, Artificial Sequence
  Description of Artificial Sequence: Synthetic peptide
  Seed: VPSLPEWEDSL (MAGC1_HUMAN)
  misc_feature (2)..(2): Xaa can be , or Pro
  misc_feature (11)..(11): Xaa can be Val, Trp, Leu, Phe, Tyr, Ile, Met, or Ala
VXSLPEWEDSX

SEQ ID NO: 95525 - protein, 8 aa, Artificial Sequence
  Description of Artificial Sequence: Synthetic peptide
  Seed: VQEHYLEY (MAGC1_HUMAN)
  misc_feature (2)..(2): Xaa can be Thr, Val, Gln, Ile, Ser, Asp, Met, Ala, Asn, Leu, Gly, Glu, Cys, Trp, Pro, Phe, or Tyr
  misc_feature (8)..(8): Xaa can be Tyr, Lys, Arg, Phe, Met, or His
VXEHYLEX

SEQ ID NO: 95526 - protein, 9 aa, Artificial Sequence
  Description of Artificial Sequence: Synthetic peptide
  Seed: VQEHYLEYR (MAGC1_HUMAN)
  misc_feature (2)..(2): Xaa can be Thr, Ser, Leu, Met, Ala, Val, Ile, Gln, Tyr, Glu, Asn, Trp, Gly, Phe, Asp, Pro, Cys, or Hi s
  misc_feature (9)..(9): Xaa can be Tyr, Arg, Lys, Phe, His, Met, Leu, Val, or Trp
VXEHYLEYX

SEQ ID NO: 95527 - protein, 9 aa, Artificial Sequence
  Description of Artificial Sequence: Synthetic peptide
  Seed: VQSPLHSPQ (MAGC1_HUMAN)
  misc_feature (2)..(2): Xaa can be Gln, Met, Lys, His, Ala, Ser, Leu, Glu, Arg, Ile, Thr, Asn, Val, Trp, Phe, Tyr, Gly, Cys, or Pro
  misc_feature (9)..(9): Xaa can be Tyr, Phe, Met, Leu, Ile, His, Trp, Val, Ala, Gly, Cys, Asn, Ser, Thr, or Gln
VXSPLHSPX

SEQ ID NO: 95528 - protein, 9 aa, Artificial Sequence
  Description of Artificial Sequence: Synthetic peptide
  Seed: VQSPLQNPA (MAGC1_HUMAN)
  misc_feature (2)..(2): Xaa can be Glu, His, Met, Gln, Arg, Leu, Lys, Asp, Ala, Ile, Val, Thr, Ser, Gly, Pro, Asn, Tyr, or Ph e
  misc_feature (9)..(9): Xaa can be Phe, Tyr, Val, Ile, Leu, Met, Ala, Cys, Thr, Pro, Trp, Ser, Gly, His, Asp, Gln, or Glu
VXSPLQNPX

SEQ ID NO: 95529 - protein, 8 aa, Artificial Sequence
  Description of Artificial Sequence: Synthetic peptide
  Seed: VRAGREHF (MAGC1_HUMAN)
  misc_feature (2)..(2): Xaa can be Arg, Tyr, or Phe
  misc_feature (8)..(8): Xaa can be Phe, Tyr, or Leu
VXAGREHX

SEQ ID NO: 95530 - protein, 9 aa, Artificial Sequence
  Description of Artificial Sequence: Synthetic peptide
  Seed: VRAGREHFA (MAGC1_HUMAN)
  misc_feature (2)..(2): Xaa can be His, Arg, or Gln
  misc_feature (9)..(9): Xaa can be Ile, Leu, Ala, Val, Cys, Pro, Thr, or Met
VXAGREHFX

SEQ ID NO: 95531 - protein, 10 aa, Artificial Sequence
  Description of Artificial Sequence: Synthetic peptide
  Seed: VRAGREHFAF (MAGC1_HUMAN)
  misc_feature (2)..(2): Xaa can be Arg, Gln, Lys, Met, Tyr, Ala, Glu, His, Leu, or Ser
  misc_feature (10)..(10): Xaa can be Phe, Tyr, Met, Leu, Trp, Val, Ile, Lys, or Arg
VXAGREHFAX

SEQ ID NO: 95532 - protein, 9 aa, Artificial Sequence
  Description of Artificial Sequence: Synthetic peptide
  Seed: VSAASSSTL (MAGC1_HUMAN)
  misc_feature (2)..(2): Xaa can be Gln, Ala, Tyr, Met, Leu, Thr, Phe, Ile, Ser, Val, Glu, Gly, Arg, Pro, Lys, Asn, Asp, His, Trp, or Cys
  misc_feature (9)..(9): Xaa can be Tyr, Met, Leu, Trp, Phe, Val, Ile, His, Lys, Arg, Ala, Thr, Cys, Ser, Gln, Gly, or Asn
VXAASSSTX

SEQ ID NO: 95533 - protein, 10 aa, Artificial Sequence
  Description of Artificial Sequence: Synthetic peptide
  Seed: VSAASSSTLV (MAGC1_HUMAN)
  misc_feature (2)..(2): Xaa can be Leu, Met, Ser, Thr, Val, Ala, Ile, Gln, Gly, Asn, Cys, Glu, Tyr, Trp, Phe, Pro, or Asp
  misc_feature (10)..(10): Xaa can be Trp, Phe, Ile, Val, Leu, Met, Ala, or Tyr
VXAASSSTLX

SEQ ID NO: 95534 - protein, 10 aa, Artificial Sequence
  Description of Artificial Sequence: Synthetic peptide
  Seed: VSICSSSTSL (MAGC1_HUMAN)
  misc_feature (2)..(2): Xaa can be Ala, Ser, Thr, Met, Gln, Val, Arg, Gly, Leu, Ile, Asn, Phe, Glu, Tyr, Asp, Pro, Trp, Lys, Cys, or His
  misc_feature (10)..(10): Xaa can be Tyr, Trp, Phe, Lys, Leu, Arg, Met, His, Ile, or Val
VXICSSSTSX

SEQ ID NO: 95535 - protein, 10 aa, Artificial Sequence
  Description of Artificial Sequence: Synthetic peptide
  Seed: VSLFQSSPER (MAGC1_HUMAN)
  misc_feature (2)..(2): Xaa can be Val, Thr, Ile, Arg, Gly, Trp, Pro, Ala, Cys, Phe, Leu, His, Asn, Met, Tyr, Ser, Lys, Glu, Gln, or Asp
  misc_feature (10)..(10): Xaa can be Lys, Arg, or Tyr
VXLFQSSPEX

SEQ ID NO: 95536 - protein, 9 aa, Artificial Sequence
  Description of Artificial Sequence: Synthetic peptide
  Seed: VSPSFSSTL (MAGC1_HUMAN)
  misc_feature (2)..(2): Xaa can be Tyr, Ala, Phe, Leu, Met, Pro, Arg, Ser, Ile, Val, Gln, Gly, Thr, Glu, Asn, Trp, Cys, Asp, His, or Lys
  misc_feature (9)..(9): Xaa can be Val, Leu, Met, Ile, Phe, Tyr, Trp, Arg, Cys, Ala, Lys, His, Thr, Gln, Ser, Pro, Glu, or Gl y
VXPSFSSTX

SEQ ID NO: 95537 - protein, 10 aa, Artificial Sequence
  Description of Artificial Sequence: Synthetic peptide
  Seed: VSPSFSSTLV (MAGC1_HUMAN)
  misc_feature (2)..(2): Xaa can be Met, Ala, Thr, Val, Ser, Leu, Ile, Gln, Gly, Cys, Phe, Tyr, Asn, Pro, Glu, or Trp
  misc_feature (10)..(10): Xaa can be Leu, Met, Tyr, Phe, Lys, Ile, Val, Arg, Ala, Trp, Thr, Gly, Asn, His, Gln, Glu, Pro, Ser, Cys, or Asp
VXPSFSSTLX

SEQ ID NO: 95538 - protein, 9 aa, Artificial Sequence
  Description of Artificial Sequence: Synthetic peptide
  Seed: VSPSSSSTL (MAGC1_HUMAN)
  misc_feature (2)..(2): Xaa can be Ala, Tyr, Pro, Phe, Met, Leu, Val, Thr, Ser, Gln, Ile, Gly, Glu, Asn, Arg, Asp, Trp, Cys, His, or Lys
  misc_feature (9)..(9): Xaa can be Val, Tyr, Phe, Ile, Met, Leu, Trp, Arg, Lys, Cys, Ala, His, Thr, Ser, Gln, or Pro
VXPSSSSTX

SEQ ID NO: 95539 - protein, 10 aa, Artificial Sequence
  Description of Artificial Sequence: Synthetic peptide
  Seed: VSPSSSSTLL (MAGC1_HUMAN)
  misc_feature (2)..(2): Xaa can be Met, Ala, Thr, Ile, Val, Ser, Leu, Gly, Glu, Phe, Gln, Asn, Tyr, Cys, Asp, Trp, Pro, Arg, Lys, or His
  misc_feature (10)..(10): Xaa can be Leu, Phe, Met, Trp, Ile, Tyr, Lys, Arg, Val, His, Asp, Pro, Asn, Glu, Ser, Gln, Cys, Thr, Ala, or Gly
VXPSSSSTLX

SEQ ID NO: 95540 - protein, 9 aa, Artificial Sequence
  Description of Artificial Sequence: Synthetic peptide
  Seed: VSRSFSSTL (MAGC1_HUMAN)
  misc_feature (2)..(2): Xaa can be Gln, Val, Ser, Thr, Met, Tyr, Pro, Ala, Ile, Phe, Leu, Trp, Gly, Asn, Arg, Lys, His, Glu, Asp, or Cys
  misc_feature (9)..(9): Xaa can be Tyr, Trp, Leu, Phe, Met, Val, Ile, Lys, His, Ala, Arg, Ser, Gly, Thr, Pro, Cys, Gln, Asn, or Glu
VXRSFSSTX

SEQ ID NO: 95541 - protein, 10 aa, Artificial Sequence
  Description of Artificial Sequence: Synthetic peptide
  Seed: VSRSFSSTLL (MAGC1_HUMAN)
  misc_feature (2)..(2): Xaa can be Thr, Ser, Val, Met, Ala, Ile, Tyr, Gln, Leu, Gly, Phe, Arg, Cys, Trp, Asn, Asp, Pro, Glu, Lys, or His
  misc_feature (10)..(10): Xaa can be Leu, Lys, Val, Ala, Trp, Ile, Tyr, Phe, Met, Arg, Gly, Ser, His, Thr, Pro, Cys, Asn, or Gl n
VXRSFSSTLX

SEQ ID NO: 95542 - protein, 9 aa, Artificial Sequence
  Description of Artificial Sequence: Synthetic peptide
  Seed: VSSFFSYTL (MAGC1_HUMAN)
  misc_feature (2)..(2): Xaa can be Met, Ser, Gln, Leu, Ala, Thr, Ile, Lys, Val, His, Tyr, Trp, Glu, Arg, Asn, Gly, Phe, Pro, Cys, or Asp
  misc_feature (9)..(9): Xaa can be Phe, Tyr, Leu, Trp, Val, Met, Ile, Ala, His, Thr, Cys, Gly, Ser, Pro, Asn, or Asp
VXSFFSYTX

SEQ ID NO: 95543 - protein, 10 aa, Artificial Sequence
  Description of Artificial Sequence: Synthetic peptide
  Seed: VSSFFSYTLA (MAGC1_HUMAN)
  misc_feature (2)..(2): Xaa can be Thr, Met, Ala, Val, Arg, Ile, Ser, Phe, Leu, Glu, Lys, Asn, Tyr, Gly, Gln, Trp, His, Pro, Cys, or Asp
  misc_feature (10)..(10): Xaa can be Lys, Val, Ile, Ala, Leu, or Met
VXSFFSYTLX

SEQ ID NO: 95544 - protein, 9 aa, Artificial Sequence
  Description of Artificial Sequence: Synthetic peptide
  Seed: VSSSFSYTL (MAGC1_HUMAN)
  misc_feature (2)..(2): Xaa can be Met, Gln, Ala, Leu, Ser, Thr, Tyr, Ile, Val, Lys, His, Gly, Trp, Arg, Phe, Asn, Glu, Cys, Asp, or Pro
  misc_feature (9)..(9): Xaa can be Phe, Met, Val, Trp, Tyr, Leu, Ile, His, Cys, Ala, Thr, Lys, Gly, Arg, Asn, Ser, Pro, or As p
VXSSFSYTX

SEQ ID NO: 95545 - protein, 10 aa, Artificial Sequence
  Description of Artificial Sequence: Synthetic peptide
  Seed: VSSSFSYTLL (MAGC1_HUMAN)
  misc_feature (2)..(2): Xaa can be Ser, Ala, Thr, Gln, Pro, Asn, His, Glu, Phe, Asp, Arg, Gly, Tyr, Trp, Leu, Met, Ile, Cys, Lys, or Val
  misc_feature (10)..(10): Xaa can be Phe, Tyr, Ile, Trp, Met, Leu, Val, Gly, or Asn
VXSSFSYTLX

SEQ ID NO: 95546 - protein, 10 aa, Artificial Sequence
  Description of Artificial Sequence: Synthetic peptide
  Seed: VSSSSSSSTL (MAGC1_HUMAN)
  misc_feature (2)..(2): Xaa can be Ala, Thr, Ser, Val, Ile, Met, Leu, Gly, Gln, Asn, Glu, Asp, Phe, His, Arg, Cys, Pro, Tyr, Lys, or Trp
  misc_feature (10)..(10): Xaa can be Met, Trp, Phe, Tyr, Leu, Ile, Lys, Arg, His, Val, or Ala
VXSSSSSSTX

SEQ ID NO: 95547 - protein, 11 aa, Artificial Sequence
  Description of Artificial Sequence: Synthetic peptide
  Seed: VSSSSSSSTLL (MAGC1_HUMAN)
  misc_feature (2)..(2): Xaa can be Ser, Thr, Ala, Ile, Gly, Val, Asn, Met, Cys, Gln, Asp, Glu, Leu, Pro, Phe, His, Arg, Lys, Tyr, or Trp
  misc_feature (11)..(11): Xaa can be Phe, Trp, Met, Tyr, Leu, Lys, Arg, His, Ile, Val, or Cys
VXSSSSSSTLX

SEQ ID NO: 95548 - protein, 9 aa, Artificial Sequence
  Description of Artificial Sequence: Synthetic peptide
  Seed: VSSSSSSTL (MAGC1_HUMAN)
  misc_feature (2)..(2): Xaa can be Gln, Ala, Met, Ser, Val, Leu, Gly, Thr, Ile, Lys, Phe, Glu, His, Asn, Arg, Asp, Pro, Tyr, Trp, or Cys
  misc_feature (9)..(9): Xaa can be Tyr, Phe, Leu, Trp, Met, Val, Ile, Lys, His, Arg, Ala, Cys, Gly, Thr, Gln, or Ser
VXSSSSSTX

SEQ ID NO: 95549 - protein, 10 aa, Artificial Sequence
  Description of Artificial Sequence: Synthetic peptide
  Seed: VSSSSSSTLL (MAGC1_HUMAN)
  misc_feature (2)..(2): Xaa can be Ser, Ala, Val, Thr, Met, Leu, Asn, Gly, Gln, Ile, Glu, Phe, Asp, Tyr, Trp, Lys, Arg, His, Cys, or Pro
  misc_feature (10)..(10): Xaa can be Ile, Trp, Met, Leu, Phe, Tyr, Lys, Arg, Val, or His
VXSSSSSTLX

SEQ ID NO: 95550 - protein, 9 aa, Artificial Sequence
  Description of Artificial Sequence: Synthetic peptide
  Seed: VVEFLAMLK (MAGC1_HUMAN)
  misc_feature (2)..(2): Xaa can be Thr, Ser, Ile, Ala, Val, Met, Leu, Pro, Gln, Tyr, Gly, Asn, Trp, Phe, Glu, Asp, or Cys
  misc_feature (9)..(9): Xaa can be Tyr, Lys, Arg, Phe, His, Met, Trp, or Leu
VXEFLAMLX

SEQ ID NO: 95551 - protein, 10 aa, Artificial Sequence
  Description of Artificial Sequence: Synthetic peptide
  Seed: VWVQEHYLEY (MAGC1_HUMAN)
  misc_feature (2)..(2): Xaa can be Tyr, Phe, Met, Trp, Gln, Leu, Lys, Arg, His, Cys, Val, Gly, Glu, Pro, Thr, Ile, Ser, Ala, Asn, or Asp
  misc_feature (10)..(10): Xaa can be Tyr, Phe, Met, Leu, Val, or Ile
VXVQEHYLEX

SEQ ID NO: 95552 - protein, 11 aa, Artificial Sequence
  Description of Artificial Sequence: Synthetic peptide
  Seed: VWVQEHYLEYR (MAGC1_HUMAN)
  misc_feature (2)..(2): Xaa can be Met, Phe, Arg, Tyr, Trp, Ala, Leu, Lys, Thr, Gln, Gly, Ile, Ser, Val, Cys, or His
  misc_feature (11)..(11): Xaa can be Arg, or Lys
VXVQEHYLEYX

SEQ ID NO: 95553 - protein, 9 aa, Artificial Sequence
  Description of Artificial Sequence: Synthetic peptide
  Seed: WDVLSGIGV (MAGC1_HUMAN)
  misc_feature (2)..(2): Xaa can be Glu, or Asp
  misc_feature (9)..(9): Xaa can be Ala, Met, Phe, Ile, Val, Leu, Pro, Gly, Cys, Ser, Tyr, or Thr
WXVLSGIGX

SEQ ID NO: 95554 - protein, 10 aa, Artificial Sequence
  Description of Artificial Sequence: Synthetic peptide
  Seed: WDVLSGIGVR (MAGC1_HUMAN)
  misc_feature (2)..(2): Xaa can be Cys, Ile, Val, His, Pro, Met, Thr, Gln, Lys, Leu, Ala, Gly, Ser, Arg, Glu, Phe, Trp, Asn, Asp, or Tyr
  misc_feature (10)..(10): Xaa can be Lys, or Arg
WXVLSGIGVX

SEQ ID NO: 95555 - protein, 9 aa, Artificial Sequence
  Description of Artificial Sequence: Synthetic peptide
  Seed: WEDSLSPHY (MAGC1_HUMAN)
  misc_feature (2)..(2): Xaa can be Thr, Ser, Glu, Val, Ile, Leu, Met, Gln, Ala, Asp, Phe, Tyr, Gly, Trp, Asn, Cys, Pro, Lys, or His
  misc_feature (9)..(9): Xaa can be Tyr, Phe, Lys, Met, Leu, Trp, Arg, His, Ile, Val, Gln, Ala, or Cys
WXDSLSPHX

SEQ ID NO: 95556 - protein, 10 aa, Artificial Sequence
  Description of Artificial Sequence: Synthetic peptide
  Seed: WEDSLSPHYF (MAGC1_HUMAN)
  misc_feature (2)..(2): Xaa can be Glu, Ala, Ile, Leu, Met, Val, Thr, Ser, Gln, Pro, Phe, Tyr, Gly, Trp, Cys, Asn, Asp, His, or Lys
  misc_feature (10)..(10): Xaa can be Leu, Met, Phe, Val, Ile, Tyr, Trp, Cys, Ala, Thr, Ser, Pro, or Gly
WXDSLSPHYX

SEQ ID NO: 95557 - protein, 8 aa, Artificial Sequence
  Description of Artificial Sequence: Synthetic peptide
  Seed: WEDSLSPL (MAGC1_HUMAN)
  misc_feature (2)..(2): Xaa can be Glu, or Gln
  misc_feature (8)..(8): Xaa can be Leu, Val, Ile, Ala, Met, Phe, or Cys
WXDSLSPX

SEQ ID NO: 95558 - protein, 9 aa, Artificial Sequence
  Description of Artificial Sequence: Synthetic peptide
  Seed: WEDSLSPLH (MAGC1_HUMAN)
  misc_feature (2)..(2): Xaa can be , or Glu
  misc_feature (9)..(9): Xaa can be Phe, Leu, His, Tyr, Met, or Trp
WXDSLSPLX

SEQ ID NO: 95559 - protein, 10 aa, Artificial Sequence
  Description of Artificial Sequence: Synthetic peptide
  Seed: WEDSLSPLHF (MAGC1_HUMAN)
  misc_feature (2)..(2): Xaa can be Glu, Gln, Met, Asp, Lys, Ile, Tyr, Ser, Pro, Arg, Trp, Leu, His, Val, Ala, Phe, or Thr
  misc_feature (10)..(10): Xaa can be Tyr, Phe, Met, Trp, Leu, Gly, Cys, Ser, Thr, Ala, Ile, Val, or Pro
WXDSLSPLHX

SEQ ID NO: 95560 - protein, 9 aa, Artificial Sequence
  Description of Artificial Sequence: Synthetic peptide
  Seed: WGPRAHSEV (MAGC1_HUMAN)
  misc_feature (2)..(2): Xaa can be Ala, Thr, Gly, Val, Met, Ile, Ser, Leu, Phe, Cys, Gln, Tyr, Trp, Pro, or Asn
  misc_feature (9)..(9): Xaa can be Leu, Met, Phe, Ile, or Val
WXPRAHSEX

SEQ ID NO: 95561 - protein, 10 aa, Artificial Sequence
  Description of Artificial Sequence: Synthetic peptide
  Seed: WGPRAHSEVI (MAGC1_HUMAN)
  misc_feature (2)..(2): Xaa can be Leu, Arg, Ser, Met, Val, Pro, Ala, Phe, His, Lys, Gly, Cys, Tyr, Asp, Trp, Glu, Thr, Gln, Ile, or Asn
  misc_feature (10)..(10): Xaa can be Phe, Met, Cys, Ile, Ala, Thr, Val, Leu, or Tyr
WXPRAHSEVX

SEQ ID NO: 95562 - protein, 9 aa, Artificial Sequence
  Description of Artificial Sequence: Synthetic peptide
  Seed: WVQEHYLEY (MAGC1_HUMAN)
  misc_feature (2)..(2): Xaa can be Pro, Gln, Tyr, Ala, Phe, Arg, Met, Ser, Val, Ile, Thr, Trp, Gly, Leu, Cys, Lys, Asn, Glu, His, or Asp
  misc_feature (9)..(9): Xaa can be Phe, Tyr, Met, Leu, Trp, Lys, Arg, Ile, Val, His, Ala, Thr, Cys, Gly, Ser, Gln, or Glu
WXQEHYLEX

SEQ ID NO: 95563 - protein, 10 aa, Artificial Sequence
  Description of Artificial Sequence: Synthetic peptide
  Seed: WVQEHYLEYR (MAGC1_HUMAN)
  misc_feature (2)..(2): Xaa can be Met, Leu, Phe, Ile, Ala, Gln, Ser, Thr, Tyr, Trp, Val, Lys, Arg, Gly, Cys, His, or Asn
  misc_feature (10)..(10): Xaa can be Arg, Lys, or Tyr
WXQEHYLEYX

SEQ ID NO: 95564 - protein, 8 aa, Artificial Sequence
  Description of Artificial Sequence: Synthetic peptide
  Seed: YASEEVIW (MAGC1_HUMAN)
  misc_feature (2)..(2): Xaa can be Thr, Ala, Ser, Ile, Gly, Val, Pro, Asn, Met, Leu, Phe, Asp, Cys, Gln, or Glu
  misc_feature (8)..(8): Xaa can be Lys, Trp, Arg, Tyr, Phe, Leu, Met, Val, or Ile
YXSEEVIX

SEQ ID NO: 95565 - protein, 10 aa, Artificial Sequence
  Description of Artificial Sequence: Synthetic peptide
  Seed: YASEEVIWDV (MAGC1_HUMAN)
  misc_feature (2)..(2): Xaa can be Met, Leu, Gln, Ala, Ile, Val, Thr, Ser, Phe, or Trp
  misc_feature (10)..(10): Xaa can be Val, Ala, Met, Leu, Ile, Thr, Phe, Ser, Cys, Gly, or Pro
YXSEEVIWDX

SEQ ID NO: 95566 - protein, 11 aa, Artificial Sequence
  Description of Artificial Sequence: Synthetic peptide
  Seed: YASEEVIWDVL (MAGC1_HUMAN)
  misc_feature (2)..(2): Xaa can be Ala, Glu, Ser, Thr, Val, Gly, Ile, Gln, Met, Leu, Asn, Tyr, Trp, Arg, Asp, His, Phe, Pro, Cys, or Lys
  misc_feature (11)..(11): Xaa can be Leu, Lys, Arg, Phe, Met, Tyr, Ile, or Val
YXSEEVIWDVX

SEQ ID NO: 95567 - protein, 8 aa, Artificial Sequence
  Description of Artificial Sequence: Synthetic peptide
  Seed: YEFLWGPR (MAGC1_HUMAN)
  misc_feature (2)..(2): Xaa can be Glu, Asp, or Gln
  misc_feature (8)..(8): Xaa can be Tyr, Met, Phe, Leu, Gln, Arg, Ala, Trp, Thr, Ser, His, Cys, Lys, Glu, Pro, Val, Ile, or As n
YXFLWGPX

SEQ ID NO: 95568 - protein, 9 aa, Artificial Sequence
  Description of Artificial Sequence: Synthetic peptide
  Seed: YEFLWGPRA (MAGC1_HUMAN)
  misc_feature (2)..(2): Xaa can be Glu, His, Asp, Gln, Pro, Arg, or Lys
  misc_feature (9)..(9): Xaa can be Ala, Leu, Ile, Val, Phe, Cys, Met, Tyr, Thr, Pro, Ser, Gly, Trp, or His
YXFLWGPRX

SEQ ID NO: 95569 - protein, 10 aa, Artificial Sequence
  Description of Artificial Sequence: Synthetic peptide
  Seed: YEFLWGPRAH (MAGC1_HUMAN)
  misc_feature (2)..(2): Xaa can be Gln, Glu, Lys, Met, His, Ala, Ser, Arg, Leu, Asn, Val, Ile, Thr, Tyr, Gly, Phe, Pro, Trp, Asp, or Cys
  misc_feature (10)..(10): Xaa can be Tyr, Phe, Met, Leu, Trp, Ile, His, Val, Ala, Ser, Thr, Gly, Cys, or Asn
YXFLWGPRAX

SEQ ID NO: 95570 - protein, 9 aa, Artificial Sequence
  Description of Artificial Sequence: Synthetic peptide
  Seed: YFPVIFRKA (MAGC1_HUMAN)
  misc_feature (2)..(2): Xaa can be Phe, Tyr, Gln, Met, Leu, Ala, His, Trp, Ser, Val, Ile, Gly, Asn, Thr, Arg, Pro, or Cys
  misc_feature (9)..(9): Xaa can be Met, Phe, Tyr, Leu, Ile, Val, His, Ala, Trp, or Cys
YXPVIFRKX

SEQ ID NO: 95571 - protein, 10 aa, Artificial Sequence
  Description of Artificial Sequence: Synthetic peptide
  Seed: YFPVIFRKAR (MAGC1_HUMAN)
  misc_feature (2)..(2): Xaa can be Tyr, Met, Phe, Val, Thr, Gly, Ile, Ser, Ala, Asn, Trp, or Leu
  misc_feature (10)..(10): Xaa can be Arg, or Lys
YXPVIFRKAX

SEQ ID NO: 95572 - protein, 10 aa, Artificial Sequence
  Description of Artificial Sequence: Synthetic peptide
  Seed: YLEYREVPNS (MAGC1_HUMAN)
  misc_feature (2)..(2): Xaa can be Leu, Met, Gln, Ile, Val, Ala, or Thr
  misc_feature (10)..(10): Xaa can be Val, Leu, Ile, Ala, Cys, Met, Thr, or Ser
YXEYREVPNX

SEQ ID NO: 95573 - protein, 8 aa, Artificial Sequence
  Description of Artificial Sequence: Synthetic peptide
  Seed: YPLQSPQS (MAGC1_HUMAN)
  misc_feature (2)..(2): Xaa can be , or Pro
  misc_feature (8)..(8): Xaa can be Ala, Pro, Ile, Thr, Met, Phe, Val, Leu, Cys, Gly, or Ser
YXLQSPQX

SEQ ID NO: 95574 - protein, 9 aa, Artificial Sequence
  Description of Artificial Sequence: Synthetic peptide
  Seed: YPLQSPQSR (MAGC1_HUMAN)
  misc_feature (2)..(2): Xaa can be Pro, Ala, Val, Ser, Ile, Thr, Gly, Met, Phe, Leu, Tyr, Asp, Cys, Gln, Trp, Glu, Asn, or Hi s
  misc_feature (9)..(9): Xaa can be Arg, Tyr, Phe, Leu, Met, Lys, Ala, Ile, Val, Thr, Trp, Pro, Cys, His, Gly, Gln, Glu, Ser, Asp, or Asn
YXLQSPQSX

SEQ ID NO: 95575 - protein, 10 aa, Artificial Sequence
  Description of Artificial Sequence: Synthetic peptide
  Seed: YPLQSPQSRS (MAGC1_HUMAN)
  misc_feature (2)..(2): Xaa can be , or Pro
  misc_feature (10)..(10): Xaa can be Ser, Ile, Ala, Thr, Cys, Gly, Phe, Pro, Val, Leu, or Met
YXLQSPQSRX

SEQ ID NO: 95576 - protein, 9 aa, Artificial Sequence
  Description of Artificial Sequence: Synthetic peptide
  Seed: YQVKQPITK (MAGC1_HUMAN)
  misc_feature (2)..(2): Xaa can be Ala, Arg, Gln, Ser, Met, Val, Thr, Tyr, Ile, Phe, Leu, His, Gly, Trp, Lys, Asn, Cys, Glu, Asp, or Pro
  misc_feature (9)..(9): Xaa can be Phe, Met, Ile, Tyr, Lys, Val, Leu, Arg, Trp, His, Ala, Cys, Thr, Gln, Ser, Pro, Asn, Gly, or Glu
YXVKQPITX

SEQ ID NO: 95577 - protein, 10 aa, Artificial Sequence
  Description of Artificial Sequence: Synthetic peptide
  Seed: YQVKQPITKA (MAGC1_HUMAN)
  misc_feature (2)..(2): Xaa can be Gln, Val, Met, Leu, Ile, Thr, Ala, Glu, or Ser
  misc_feature (10)..(10): Xaa can be Val, Ile, Leu, Ala, Met, Cys, Trp, or Phe
YXVKQPITKX

SEQ ID NO: 95578 - protein, 9 aa, Artificial Sequence
  Description of Artificial Sequence: Synthetic peptide
  Seed: YREVPNSSP (MAGC1_HUMAN)
  misc_feature (2)..(2): Xaa can be His, Arg, Gln, Pro, Glu, or Lys
  misc_feature (9)..(9): Xaa can be Ala, Val, Leu, Ile, Met, Cys, Pro, Thr, Gly, Phe, or Ser
YXEVPNSSX

SEQ ID NO: 95579 - protein, 10 aa, Artificial Sequence
  Description of Artificial Sequence: Synthetic peptide
  Seed: YREVPNSSPP (MAGC1_HUMAN)
  misc_feature (2)..(2): Xaa can be Glu, Tyr, Pro, Met, Trp, Lys, Asn, Leu, Phe, Gln, Gly, Ala, Val, Thr, Ile, His, Arg, Ser, Cys, or Asp
  misc_feature (10)..(10): Xaa can be Ile, Val, Pro, Ala, or Leu
YXEVPNSSPX

SEQ ID NO: 95580 - protein, 8 aa, Artificial Sequence
  Description of Artificial Sequence: Synthetic peptide
  Seed: YTGYFPVI (MAGC1_HUMAN)
  misc_feature (2)..(2): Xaa can be Ala, Ser, Gly, Thr, Val, Cys, Ile, Met, Phe, Gln, Leu, Pro, or Asn
  misc_feature (8)..(8): Xaa can be Leu, Tyr, Phe, Met, Ile, Val, Trp, or His
YXGYFPVX

SEQ ID NO: 95581 - protein, 9 aa, Artificial Sequence
  Description of Artificial Sequence: Synthetic peptide
  Seed: YTGYFPVIF (MAGC1_HUMAN)
  misc_feature (2)..(2): Xaa can be Ala, Ser, Arg, Gly, Gln, Tyr, Met, Thr, Ile, Val, Asn, Cys, Pro, Trp, Lys, Phe, His, Leu, Asp, or Glu
  misc_feature (9)..(9): Xaa can be Phe, Tyr, Met, Trp, Leu, Ile, Val, His, Lys, Cys, Ala, Arg, or Thr
YXGYFPVIX

SEQ ID NO: 95582 - protein, 10 aa, Artificial Sequence
  Description of Artificial Sequence: Synthetic peptide
  Seed: YTGYFPVIFR (MAGC1_HUMAN)
  misc_feature (2)..(2): Xaa can be Thr, Met, Ser, Val, Ile, Ala, Leu, Tyr, Arg, Pro, Asp, Gly, Asn, Phe, Gln, Glu, Cys, His, Lys, or Trp
  misc_feature (10)..(10): Xaa can be Arg, Lys, Tyr, His, or Gln
YXGYFPVIFX

SEQ ID NO: 95583 - protein, 11 aa, Artificial Sequence
  Description of Artificial Sequence: Synthetic peptide
  Seed: YTGYFPVIFRK (MAGC1_HUMAN)
  misc_feature (2)..(2): Xaa can be Ala, Phe, Thr, Val, Met, Tyr, Trp, Ser, Gly, Arg, Leu, Gln, Cys, Asp, Pro, Glu, His, Lys, Ile, or Asn
  misc_feature (11)..(11): Xaa can be Lys, Arg, His, Thr, Met, Trp, Ile, Asn, Ser, Glu, Gln, Phe, Tyr, Leu, Asp, Gly, Ala, Pro, Val, or Cys
YXGYFPVIFRX

SEQ ID NO: 95584 - protein, 9 aa, Artificial Sequence
  Description of Artificial Sequence: Synthetic peptide
  Seed: YTLASLLQS (MAGC1_HUMAN)
  misc_feature (2)..(2): Xaa can be Gln, Met, Leu, Thr, Val, Ile, Ala, Ser, Gly, Phe, Cys, Trp, Glu, Asn, Lys, Tyr, or Asp
  misc_feature (9)..(9): Xaa can be Val, Ile, Leu, Ala, Met, Thr, Phe, Cys, Ser, Pro, Gly, or Trp
YXLASLLQX

SEQ ID NO: 95585 - protein, 10 aa, Artificial Sequence
  Description of Artificial Sequence: Synthetic peptide
  Seed: YTLASLLQSS (MAGC1_HUMAN)
  misc_feature (2)..(2): Xaa can be Ser, Ile, Phe, Leu, Cys, Gly, Arg, Asp, His, Trp, Gln, Tyr, Lys, Thr, Val, Glu, Ala, Met, Pro, or Asn
  misc_feature (10)..(10): Xaa can be Leu, Phe, Val, Thr, Pro, Gly, Ala, Ile, Met, Cys, or Ser
YXLASLLQSX

SEQ ID NO: 95586 - protein, 10 aa, Artificial Sequence
  Description of Artificial Sequence: Synthetic peptide
  Seed: YTLDEKVDEL (MAGC1_HUMAN)
  misc_feature (2)..(2): Xaa can be Leu, Met, Ala, Thr, Val, Arg, Gly, Ile, Gln, Ser, Cys, Phe, Tyr, Asn, Glu, Trp, Asp, Pro, His, or Lys
  misc_feature (10)..(10): Xaa can be Leu, Trp, Ile, Met, Tyr, Val, Cys, Ala, Thr, Lys, Phe, Arg, His, Gly, or Ser
YXLDEKVDEX

SEQ ID NO: 95587 - protein, 9 aa, Artificial Sequence
  Description of Artificial Sequence: Synthetic peptide
  Seed: YTLLSLFQS (MAGC1_HUMAN)
  misc_feature (2)..(2): Xaa can be Leu, Gln, Met, Thr, Val, Ala, Ser, Ile, Gly, Glu, Asn, Phe, Trp, Tyr, Cys, Lys, Arg, or As p
  misc_feature (9)..(9): Xaa can be Val, Ile, Leu, Ala, Met, Ser, Thr, Phe, Cys, Gly, or Pro
YXLLSLFQX

SEQ ID NO: 95588 - protein, 10 aa, Artificial Sequence
  Description of Artificial Sequence: Synthetic peptide
  Seed: YTLLSLFQSS (MAGC1_HUMAN)
  misc_feature (2)..(2): Xaa can be Gln, Met, Ile, Leu, Val, Thr, Ser, Gly, Phe, Pro, Trp, Tyr, Cys, Arg, Ala, Asn, Asp, His, Lys, or Glu
  misc_feature (10)..(10): Xaa can be Leu, Val, Met, Ile, Ala, Thr, Ser, Phe, Pro, or Cys
YXLLSLFQSX

SEQ ID NO: 95589 - protein, 8 aa, Artificial Sequence
  Description of Artificial Sequence: Synthetic peptide
  Seed: YTSSSDTL (MAGC1_HUMAN)
  misc_feature (2)..(2): Xaa can be Ala, Ser, Thr, Ile, or Val
  misc_feature (8)..(8): Xaa can be Leu, Tyr, Phe, Met, Val, or Ile
YXSSSDTX

SEQ ID NO: 95590 - protein, 9 aa, Artificial Sequence
  Description of Artificial Sequence: Synthetic peptide
  Seed: YTSSSDTLL (MAGC1_HUMAN)
  misc_feature (2)..(2): Xaa can be Leu, Met, Ala, Val, Ile, Thr, Gln, Gly, Ser, Phe, Cys, Tyr, Asn, Glu, Pro, Arg, Trp, Asp, His, or Lys
  misc_feature (9)..(9): Xaa can be Leu, Tyr, Phe, Met, Trp, Lys, Ile, Arg, Val, His, Ala, Thr, Cys, Ser, Gly, or Gln
YXSSSDTLX

SEQ ID NO: 95591 - protein, 9 aa, Artificial Sequence
  Description of Artificial Sequence: Synthetic peptide
  Seed: YVFVNTLDL (MAGC1_HUMAN)
  misc_feature (2)..(2): Xaa can be Pro, Tyr, Ala, Gln, Arg, Met, Leu, Ser, Thr, Phe, Ile, Val, Gly, Asn, Glu, Lys, His, Trp, Asp, or Cys
  misc_feature (9)..(9): Xaa can be Tyr, Met, Val, Phe, Leu, Ile, Trp, His, Ala, Lys, Cys, Thr, Arg, Ser, Gly, Gln, Asn, Pro, Glu, or Asp
YXFVNTLDX

SEQ ID NO: 95592 - protein, 10 aa, Artificial Sequence
  Description of Artificial Sequence: Synthetic peptide
  Seed: YVFVNTLDLT (MAGC1_HUMAN)
  misc_feature (2)..(2): Xaa can be Met, Gln, Leu, Ile, Val, Ala, Ser, Thr, Gly, Trp, Asn, Phe, or Cys
  misc_feature (10)..(10): Xaa can be Val, Leu, Ile, Ala, Met, Thr, Ser, Phe, Cys, Pro, or Gly
YXFVNTLDLX

SEQ ID NO: 95593 - protein, 9 aa, Artificial Sequence
  Description of Artificial Sequence: Synthetic peptide
  Seed: ALDEKVAEL (MAGC3_HUMAN)
AADEKVAEL

SEQ ID NO: 95594 - protein, 9 aa, Artificial Sequence
  Description of Artificial Sequence: Synthetic peptide
  Seed: ALDEKVAEL (MAGC3_HUMAN)
AFDEKVAEL

SEQ ID NO: 95595 - protein, 9 aa, Artificial Sequence
  Description of Artificial Sequence: Synthetic peptide
  Seed: ALDEKVAEL (MAGC3_HUMAN)
AYDEKVAEL

SEQ ID NO: 95596 - protein, 9 aa, Artificial Sequence
  Description of Artificial Sequence: Synthetic peptide
  Seed: ALDEKVAEL (MAGC3_HUMAN)
AYDEKVAEM

SEQ ID NO: 95597 - protein, 10 aa, Artificial Sequence
  Description of Artificial Sequence: Synthetic peptide
  Seed: EVIWEVLSAI (MAGC3_HUMAN)
ETIWEVLSAM

SEQ ID NO: 95598 - protein, 9 aa, Artificial Sequence
  Description of Artificial Sequence: Synthetic peptide
  Seed: EVLSAIGPI (MAGC3_HUMAN)
ETLSAIGPY

SEQ ID NO: 95599 - protein, 10 aa, Artificial Sequence
  Description of Artificial Sequence: Synthetic peptide
  Seed: FFEDTLDLTY (MAGC3_HUMAN)
FMEDTLDLTY

SEQ ID NO: 95600 - protein, 9 aa, Artificial Sequence
  Description of Artificial Sequence: Synthetic peptide
  Seed: FHLGHLREV (MAGC3_HUMAN)
FRLGHLREL

SEQ ID NO: 95601 - protein, 9 aa, Artificial Sequence
  Description of Artificial Sequence: Synthetic peptide
  Seed: FHLGHLREV (MAGC3_HUMAN)
FRLGHLREM

SEQ ID NO: 95602 - protein, 10 aa, Artificial Sequence
  Description of Artificial Sequence: Synthetic peptide
  Seed: FFEDTLDLTY (MAGC3_HUMAN)
FTEDTLDLTY

SEQ ID NO: 95603 - protein, 9 aa, Artificial Sequence
  Description of Artificial Sequence: Synthetic peptide
  Seed: IFGKAHEFI (MAGC3_HUMAN)
IYGKAHEFF

SEQ ID NO: 95604 - protein, 9 aa, Artificial Sequence
  Description of Artificial Sequence: Synthetic peptide
  Seed: KAHEFIELI (MAGC3_HUMAN)
KAHEFIELL

SEQ ID NO: 95605 - protein, 9 aa, Artificial Sequence
  Description of Artificial Sequence: Synthetic peptide
  Seed: KAHEFIELI (MAGC3_HUMAN)
KAHEFIELV

SEQ ID NO: 95606 - protein, 9 aa, Artificial Sequence
  Description of Artificial Sequence: Synthetic peptide
  Seed: KLVQFLLLK (MAGC3_HUMAN)
KSVQFLLLK

SEQ ID NO: 95607 - protein, 9 aa, Artificial Sequence
  Description of Artificial Sequence: Synthetic peptide
  Seed: KVAELVQFL (MAGC3_HUMAN)
KTAELVQFI

SEQ ID NO: 95608 - protein, 9 aa, Artificial Sequence
  Description of Artificial Sequence: Synthetic peptide
  Seed: KLVQFLLLK (MAGC3_HUMAN)
KTVQFLLLK

SEQ ID NO: 95609 - protein, 9 aa, Artificial Sequence
  Description of Artificial Sequence: Synthetic peptide
  Seed: KLSSIIPSA (MAGC3_HUMAN)
KVSSIIPSV

SEQ ID NO: 95610 - protein, 9 aa, Artificial Sequence
  Description of Artificial Sequence: Synthetic peptide
  Seed: LVLCPTYFK (MAGC3_HUMAN)
LMLCPTYFR

SEQ ID NO: 95611 - protein, 10 aa, Artificial Sequence
  Description of Artificial Sequence: Synthetic peptide
  Seed: LDSCSSPLLW (MAGC3_HUMAN)
LSSCSSPLLW

SEQ ID NO: 95612 - protein, 9 aa, Artificial Sequence
  Description of Artificial Sequence: Synthetic peptide
  Seed: MIFGKAHEF (MAGC3_HUMAN)
MAFGKAHEF

SEQ ID NO: 95613 - protein, 9 aa, Artificial Sequence
  Description of Artificial Sequence: Synthetic peptide
  Seed: MIFGKAHEF (MAGC3_HUMAN)
MAFGKAHEL

SEQ ID NO: 95614 - protein, 9 aa, Artificial Sequence
  Description of Artificial Sequence: Synthetic peptide
  Seed: MIFGKAHEF (MAGC3_HUMAN)
MMFGKAHEF

SEQ ID NO: 95615 - protein, 9 aa, Artificial Sequence
  Description of Artificial Sequence: Synthetic peptide
  Seed: MPAAGMPPL (MAGC3_HUMAN)
MPAAGMPPV

SEQ ID NO: 95616 - protein, 9 aa, Artificial Sequence
  Description of Artificial Sequence: Synthetic peptide
  Seed: MQMNVINTY (MAGC3_HUMAN)
MTMNVINTY

SEQ ID NO: 95617 - protein, 9 aa, Artificial Sequence
  Description of Artificial Sequence: Synthetic peptide
  Seed: MQMNVINTY (MAGC3_HUMAN)
MYMNVINTY

SEQ ID NO: 95618 - protein, 9 aa, Artificial Sequence
  Description of Artificial Sequence: Synthetic peptide
  Seed: SESLPRYAL (MAGC3_HUMAN)
SESLPRYAF

SEQ ID NO: 95619 - protein, 9 aa, Artificial Sequence
  Description of Artificial Sequence: Synthetic peptide
  Seed: SAFHLGHLR (MAGC3_HUMAN)
SMFHLGHLR

SEQ ID NO: 95620 - protein, 9 aa, Artificial Sequence
  Description of Artificial Sequence: Synthetic peptide
  Seed: SQPEGKFSL (MAGC3_HUMAN)
SMPEGKFSL

SEQ ID NO: 95621 - protein, 9 aa, Artificial Sequence
  Description of Artificial Sequence: Synthetic peptide
  Seed: SLPESEPLF (MAGC3_HUMAN)
SMPESEPLL

SEQ ID NO: 95622 - protein, 10 aa, Artificial Sequence
  Description of Artificial Sequence: Synthetic peptide
  Seed: TGYFPMIFRK (MAGC3_HUMAN)
TMYFPMIFRR

SEQ ID NO: 95623 - protein, 9 aa, Artificial Sequence
  Description of Artificial Sequence: Synthetic peptide
  Seed: YTGYFPMIF (MAGC3_HUMAN)
YFGYFPMIF

SEQ ID NO: 95624 - protein, 9 aa, Artificial Sequence
  Description of Artificial Sequence: Synthetic peptide
  Seed: YTGYFPMIF (MAGC3_HUMAN)
YMGYFPMIF

SEQ ID NO: 95625 - protein, 9 aa, Homo sapiens
  Native (MAGC3_HUMAN)
ALDEKVAEL

SEQ ID NO: 95626 - protein, 11 aa, Homo sapiens
  Native (MAGC3_HUMAN)
ATFSDGSLGQW

SEQ ID NO: 95627 - protein, 9 aa, Homo sapiens
  Native (MAGC3_HUMAN)
EVLEFLSKL

SEQ ID NO: 95628 - protein, 8 aa, Homo sapiens
  Native (MAGC3_HUMAN)
FADVLSRL

SEQ ID NO: 95629 - protein, 10 aa, Homo sapiens
  Native (MAGC3_HUMAN)
FADVLSRLAL

SEQ ID NO: 95630 - protein, 10 aa, Homo sapiens
  Native (MAGC3_HUMAN)
FFEDTLDLTY

SEQ ID NO: 95631 - protein, 9 aa, Homo sapiens
  Native (MAGC3_HUMAN)
FLSKLSSII

SEQ ID NO: 95632 - protein, 8 aa, Homo sapiens
  Native (MAGC3_HUMAN)
FPMIFRKA

SEQ ID NO: 95633 - protein, 9 aa, Homo sapiens
  Native (MAGC3_HUMAN)
FPSWYMDAL

SEQ ID NO: 95634 - protein, 9 aa, Homo sapiens
  Native (MAGC3_HUMAN)
FSLRRAVSV

SEQ ID NO: 95635 - protein, 10 aa, Homo sapiens
  Native (MAGC3_HUMAN)
HLREVRLFLR

SEQ ID NO: 95636 - protein, 10 aa, Homo sapiens
  Native (MAGC3_HUMAN)
ILFGISLTEV

SEQ ID NO: 95637 - protein, 9 aa, Homo sapiens
  Native (MAGC3_HUMAN)
KAHEFIELI

SEQ ID NO: 95638 - protein, 9 aa, Homo sapiens
  Native (MAGC3_HUMAN)
KLVQFLLLK

SEQ ID NO: 95639 - protein, 9 aa, Homo sapiens
  Native (MAGC3_HUMAN)
KVAELVQFL

SEQ ID NO: 95640 - protein, 9 aa, Homo sapiens
  Native (MAGC3_HUMAN)
KYKDYFPMI

SEQ ID NO: 95641 - protein, 11 aa, Homo sapiens
  Native (MAGC3_HUMAN)
LTDMDPDNHSY

SEQ ID NO: 95642 - protein, 10 aa, Homo sapiens
  Native (MAGC3_HUMAN)
LTEVDPDHFY

SEQ ID NO: 95643 - protein, 9 aa, Homo sapiens
  Native (MAGC3_HUMAN)
LVLCPTYFK

SEQ ID NO: 95644 - protein, 9 aa, Homo sapiens
  Native (MAGC3_HUMAN)
MASASPSVM

SEQ ID NO: 95645 - protein, 9 aa, Homo sapiens
  Native (MAGC3_HUMAN)
MIFGKAHEF

SEQ ID NO: 95646 - protein, 9 aa, Homo sapiens
  Native (MAGC3_HUMAN)
MPAAGMPPL

SEQ ID NO: 95647 - protein, 9 aa, Homo sapiens
  Native (MAGC3_HUMAN)
MQMNVINTY

SEQ ID NO: 95648 - protein, 9 aa, Homo sapiens
  Native (MAGC3_HUMAN)
NTYTGYFPM

SEQ ID NO: 95649 - protein, 9 aa, Homo sapiens
  Native (MAGC3_HUMAN)
NVINTYTGY

SEQ ID NO: 95650 - protein, 9 aa, Homo sapiens
  Native (MAGC3_HUMAN)
SAFHLGHLR

SEQ ID NO: 95651 - protein, 9 aa, Homo sapiens
  Native (MAGC3_HUMAN)
SESLPRYAL

SEQ ID NO: 95652 - protein, 9 aa, Homo sapiens
  Native (MAGC3_HUMAN)
SLRRAVSVK

SEQ ID NO: 95653 - protein, 10 aa, Homo sapiens
  Native (MAGC3_HUMAN)
SLVLCPTYFK

SEQ ID NO: 95654 - protein, 9 aa, Homo sapiens
  Native (MAGC3_HUMAN)
SQPEGKFSL

SEQ ID NO: 95655 - protein, 11 aa, Homo sapiens
  Native (MAGC3_HUMAN)
SSIIPSAFPSW

SEQ ID NO: 95656 - protein, 11 aa, Homo sapiens
  Native (MAGC3_HUMAN)
SSSEEEDTATW

SEQ ID NO: 95657 - protein, 9 aa, Homo sapiens
  Native (MAGC3_HUMAN)
TGYFPMIFR

SEQ ID NO: 95658 - protein, 9 aa, Homo sapiens
  Native (MAGC3_HUMAN)
TLDEKVDKL

SEQ ID NO: 95659 - protein, 9 aa, Homo sapiens
  Native (MAGC3_HUMAN)
TYALSPVVL

SEQ ID NO: 95660 - protein, 9 aa, Homo sapiens
  Native (MAGC3_HUMAN)
TYFKLWRTL

SEQ ID NO: 95661 - protein, 9 aa, Homo sapiens
  Native (MAGC3_HUMAN)
TYTGYFPMI

SEQ ID NO: 95662 - protein, 9 aa, Homo sapiens
  Native (MAGC3_HUMAN)
WESEGPEAF

SEQ ID NO: 95663 - protein, 10 aa, Homo sapiens
  Native (MAGC3_HUMAN)
WEVLNAIGPW

SEQ ID NO: 95664 - protein, 10 aa, Homo sapiens
  Native (MAGC3_HUMAN)
YTGYFPMIFR

SEQ ID NO: 95665 - protein, 10 aa, Artificial Sequence
  Description of Artificial Sequence: Synthetic peptide
  Seed: LSLPAVSPGK (MAGC3_HUMAN)
LLLPAVSPGR

SEQ ID NO: 95666 - protein, 9 aa, Artificial Sequence
  Description of Artificial Sequence: Synthetic peptide
  Seed: LANPQGLAG (MAGC3_HUMAN)
LVNPQGLAL

SEQ ID NO: 95667 - protein, 9 aa, Artificial Sequence
  Description of Artificial Sequence: Synthetic peptide
  Seed: FEDTLDLTY (MAGC3_HUMAN)
FWDTLDLTL

SEQ ID NO: 95668 - protein, 10 aa, Artificial Sequence
  Description of Artificial Sequence: Synthetic peptide
  Seed: SAFHLGHLRE (MAGC3_HUMAN)
SMFHLGHLRS

SEQ ID NO: 95669 - protein, 10 aa, Artificial Sequence
  Description of Artificial Sequence: Synthetic peptide
  Seed: LPQSPPEIPP (MAGC3_HUMAN)
LPQSPPEIPL

SEQ ID NO: 95670 - protein, 9 aa, Artificial Sequence
  Description of Artificial Sequence: Synthetic peptide
  Seed: YALSPVVLP (MAGC3_HUMAN)
YILSPVVLM

SEQ ID NO: 95671 - protein, 9 aa, Artificial Sequence
  Description of Artificial Sequence: Synthetic peptide
  Seed: KAHEFIELI (MAGC3_HUMAN)
KIHEFIELR

SEQ ID NO: 95672 - protein, 10 aa, Artificial Sequence
  Description of Artificial Sequence: Synthetic peptide
  Seed: LWKDSDLPTW (MAGC3_HUMAN)
LTKDSDLPTW

SEQ ID NO: 95673 - protein, 9 aa, Artificial Sequence
  Description of Artificial Sequence: Synthetic peptide
  Seed: TSDQRMDSL (MAGC3_HUMAN)
TIDQRMDSL

SEQ ID NO: 95674 - protein, 10 aa, Artificial Sequence
  Description of Artificial Sequence: Synthetic peptide
  Seed: REVLEFLSKL (MAGC3_HUMAN)
RAVLEFLSKV

SEQ ID NO: 95675 - protein, 10 aa, Artificial Sequence
  Description of Artificial Sequence: Synthetic peptide
  Seed: LDSCSSPLLW (MAGC3_HUMAN)
LFSCSSPLLF

SEQ ID NO: 95676 - protein, 9 aa, Artificial Sequence
  Description of Artificial Sequence: Synthetic peptide
  Seed: VINTYTGYF (MAGC3_HUMAN)
VQNTYTGYF

SEQ ID NO: 95677 - protein, 9 aa, Artificial Sequence
  Description of Artificial Sequence: Synthetic peptide
  Seed: IPPQGPPKI (MAGC3_HUMAN)
ILPQGPPKL

SEQ ID NO: 95678 - protein, 10 aa, Artificial Sequence
  Description of Artificial Sequence: Synthetic peptide
  Seed: FKLWRTLSGS (MAGC3_HUMAN)
FNLWRTLSGM

SEQ ID NO: 95679 - protein, 9 aa, Artificial Sequence
  Description of Artificial Sequence: Synthetic peptide
  Seed: ALDEKVAEL (MAGC3_HUMAN)
AEDEKVAEV

SEQ ID NO: 95680 - protein, 9 aa, Artificial Sequence
  Description of Artificial Sequence: Synthetic peptide
  Seed: KKYKDYFPM (MAGC3_HUMAN)
KRYKDYFPY

SEQ ID NO: 95681 - protein, 9 aa, Artificial Sequence
  Description of Artificial Sequence: Synthetic peptide
  Seed: ALDEKVAEL (MAGC3_HUMAN)
AADEKVAET

SEQ ID NO: 95682 - protein, 11 aa, Artificial Sequence
  Description of Artificial Sequence: Synthetic peptide
  Seed: AEMQMNVINTY (MAGC3_HUMAN)
AAMQMNVINTF

SEQ ID NO: 95683 - protein, 9 aa, Artificial Sequence
  Description of Artificial Sequence: Synthetic peptide
  Seed: FSDGSLGQW (MAGC3_HUMAN)
FCDGSLGQF

SEQ ID NO: 95684 - protein, 9 aa, Artificial Sequence
  Description of Artificial Sequence: Synthetic peptide
  Seed: YSAFHLGHL (MAGC3_HUMAN)
YKAFHLGHM

SEQ ID NO: 95685 - protein, 11 aa, Artificial Sequence
  Description of Artificial Sequence: Synthetic peptide
  Seed: FLSKLSSIIPS (MAGC3_HUMAN)
FMSKLSSIIPM

SEQ ID NO: 95686 - protein, 9 aa, Artificial Sequence
  Description of Artificial Sequence: Synthetic peptide
  Seed: KGSCVPEEV (MAGC3_HUMAN)
KASCVPEEY

SEQ ID NO: 95687 - protein, 10 aa, Artificial Sequence
  Description of Artificial Sequence: Synthetic peptide
  Seed: EEVIWEVLNA (MAGC3_HUMAN)
ESVIWEVLNV

SEQ ID NO: 95688 - protein, 9 aa, Artificial Sequence
  Description of Artificial Sequence: Synthetic peptide
  Seed: MPAAGMPPL (MAGC3_HUMAN)
MLAAGMPPV

SEQ ID NO: 95689 - protein, 10 aa, Artificial Sequence
  Description of Artificial Sequence: Synthetic peptide
  Seed: CVPEEVIWEV (MAGC3_HUMAN)
CMPEEVIWEI

SEQ ID NO: 95690 - protein, 9 aa, Artificial Sequence
  Description of Artificial Sequence: Synthetic peptide
  Seed: WRRGTGYTL (MAGC3_HUMAN)
WSRGTGYTM

SEQ ID NO: 95691 - protein, 9 aa, Artificial Sequence
  Description of Artificial Sequence: Synthetic peptide
  Seed: LSAIGPIQR (MAGC3_HUMAN)
LAAIGPIQM

SEQ ID NO: 95692 - protein, 9 aa, Artificial Sequence
  Description of Artificial Sequence: Synthetic peptide
  Seed: NVINTYTGY (MAGC3_HUMAN)
NLINTYTGY

SEQ ID NO: 95693 - protein, 9 aa, Artificial Sequence
  Description of Artificial Sequence: Synthetic peptide
  Seed: FADVLSRLA (MAGC3_HUMAN)
FTDVLSRLV

SEQ ID NO: 95694 - protein, 9 aa, Artificial Sequence
  Description of Artificial Sequence: Synthetic peptide
  Seed: QTKEPVTKA (MAGC3_HUMAN)
QTKEPVTKY

SEQ ID NO: 95695 - protein, 9 aa, Artificial Sequence
  Description of Artificial Sequence: Synthetic peptide
  Seed: VLPPQPQPR (MAGC3_HUMAN)
VTPPQPQPI

SEQ ID NO: 95696 - protein, 9 aa, Artificial Sequence
  Description of Artificial Sequence: Synthetic peptide
  Seed: AHEFIELIF (MAGC3_HUMAN)
AHEFIELII

SEQ ID NO: 95697 - protein, 9 aa, Artificial Sequence
  Description of Artificial Sequence: Synthetic peptide
  Seed: LSDEQGMPQ (MAGC3_HUMAN)
LADEQGMPM

SEQ ID NO: 95698 - protein, 10 aa, Artificial Sequence
  Description of Artificial Sequence: Synthetic peptide
  Seed: EVIWEVLSAI (MAGC3_HUMAN)
EKIWEVLSAV

SEQ ID NO: 95699 - protein, 10 aa, Artificial Sequence
  Description of Artificial Sequence: Synthetic peptide
  Seed: SEEEDTATWH (MAGC3_HUMAN)
SEEEDTATWF

SEQ ID NO: 95700 - protein, 9 aa, Artificial Sequence
  Description of Artificial Sequence: Synthetic peptide
  Seed: AEMQMNVIN (MAGC3_HUMAN)
AEMQMNVIM

SEQ ID NO: 95701 - protein, 9 aa, Artificial Sequence
  Description of Artificial Sequence: Synthetic peptide
  Seed: IIPSAFPSW (MAGC3_HUMAN)
IVPSAFPSM

SEQ ID NO: 95702 - protein, 9 aa, Artificial Sequence
  Description of Artificial Sequence: Synthetic peptide
  Seed: KGSCVPEEV (MAGC3_HUMAN)
KASCVPEEM

SEQ ID NO: 95703 - protein, 9 aa, Artificial Sequence
  Description of Artificial Sequence: Synthetic peptide
  Seed: FSDGSLGQW (MAGC3_HUMAN)
FQDGSLGQI

SEQ ID NO: 95704 - protein, 9 aa, Artificial Sequence
  Description of Artificial Sequence: Synthetic peptide
  Seed: KDSDLPTWR (MAGC3_HUMAN)
KASDLPTWR

SEQ ID NO: 95705 - protein, 9 aa, Artificial Sequence
  Description of Artificial Sequence: Synthetic peptide
  Seed: RGTGYTLSL (MAGC3_HUMAN)
RITGYTLSM

SEQ ID NO: 95706 - protein, 9 aa, Artificial Sequence
  Description of Artificial Sequence: Synthetic peptide
  Seed: ATDKDYSAF (MAGC3_HUMAN)
AMDKDYSAY

SEQ ID NO: 95707 - protein, 10 aa, Artificial Sequence
  Description of Artificial Sequence: Synthetic peptide
  Seed: FADVLSRLAL (MAGC3_HUMAN)
FPDVLSRLAI

SEQ ID NO: 95708 - protein, 9 aa, Artificial Sequence
  Description of Artificial Sequence: Synthetic peptide
  Seed: LILSVIFIK (MAGC3_HUMAN)
LWLSVIFIR

SEQ ID NO: 95709 - protein, 9 aa, Artificial Sequence
  Description of Artificial Sequence: Synthetic peptide
  Seed: SESLPRYAL (MAGC3_HUMAN)
SESLPRYAM

SEQ ID NO: 95710 - protein, 9 aa, Artificial Sequence
  Description of Artificial Sequence: Synthetic peptide
  Seed: MPAAGMPPL (MAGC3_HUMAN)
MYAAGMPPI

SEQ ID NO: 95711 - protein, 10 aa, Artificial Sequence
  Description of Artificial Sequence: Synthetic peptide
  Seed: REVRLFLRGG (MAGC3_HUMAN)
RWVRLFLRGA

SEQ ID NO: 95712 - protein, 9 aa, Artificial Sequence
  Description of Artificial Sequence: Synthetic peptide
  Seed: YKDYFPMIF (MAGC3_HUMAN)
YRDYFPMIM

SEQ ID NO: 95713 - protein, 9 aa, Artificial Sequence
  Description of Artificial Sequence: Synthetic peptide
  Seed: NTYTGYFPM (MAGC3_HUMAN)
NPYTGYFPF

SEQ ID NO: 95714 - protein, 9 aa, Artificial Sequence
  Description of Artificial Sequence: Synthetic peptide
  Seed: LPAVSPGKR (MAGC3_HUMAN)
LVAVSPGKR

SEQ ID NO: 95715 - protein, 9 aa, Artificial Sequence
  Description of Artificial Sequence: Synthetic peptide
  Seed: KVDKLVQFL (MAGC3_HUMAN)
KLDKLVQFL

SEQ ID NO: 95716 - protein, 9 aa, Artificial Sequence
  Description of Artificial Sequence: Synthetic peptide
  Seed: AIGPIQRPA (MAGC3_HUMAN)
AVGPIQRPV

SEQ ID NO: 95717 - protein, 9 aa, Artificial Sequence
  Description of Artificial Sequence: Synthetic peptide
  Seed: AIIDTTDDA (MAGC3_HUMAN)
AVIDTTDDV

SEQ ID NO: 95718 - protein, 10 aa, Artificial Sequence
  Description of Artificial Sequence: Synthetic peptide
  Seed: SCSSPLLWTR (MAGC3_HUMAN)
SHSSPLLWTR

SEQ ID NO: 95719 - protein, 10 aa, Artificial Sequence
  Description of Artificial Sequence: Synthetic peptide
  Seed: MPAAGMPPLP (MAGC3_HUMAN)
MDAAGMPPLY

SEQ ID NO: 95720 - protein, 8 aa, Artificial Sequence
  Description of Artificial Sequence: Synthetic peptide
  Seed: IFGKAHEF (MAGC3_HUMAN)
ISGKAHEF

SEQ ID NO: 95721 - protein, 9 aa, Artificial Sequence
  Description of Artificial Sequence: Synthetic peptide
  Seed: VPEEVIWEV (MAGC3_HUMAN)
VPEEVIWEY

SEQ ID NO: 95722 - protein, 10 aa, Artificial Sequence
  Description of Artificial Sequence: Synthetic peptide
  Seed: SDQRMDSLVL (MAGC3_HUMAN)
SWQRMDSLVF

SEQ ID NO: 95723 - protein, 9 aa, Artificial Sequence
  Description of Artificial Sequence: Synthetic peptide
  Seed: LILILSMIF (MAGC3_HUMAN)
LALILSMIF

SEQ ID NO: 95724 - protein, 9 aa, Artificial Sequence
  Description of Artificial Sequence: Synthetic peptide
  Seed: KVAELVQFL (MAGC3_HUMAN)
KTAELVQFF

SEQ ID NO: 95725 - protein, 10 aa, Artificial Sequence
  Description of Artificial Sequence: Synthetic peptide
  Seed: ATYALSPVVL (MAGC3_HUMAN)
AIYALSPVVV

SEQ ID NO: 95726 - protein, 10 aa, Artificial Sequence
  Description of Artificial Sequence: Synthetic peptide
  Seed: ATYALSPVVL (MAGC3_HUMAN)
ALYALSPVVF

SEQ ID NO: 95727 - protein, 9 aa, Artificial Sequence
  Description of Artificial Sequence: Synthetic peptide
  Seed: FLSKLSSII (MAGC3_HUMAN)
FASKLSSIM

SEQ ID NO: 95728 - protein, 9 aa, Artificial Sequence
  Description of Artificial Sequence: Synthetic peptide
  Seed: ALDEKVAEL (MAGC3_HUMAN)
AHDEKVAEV

SEQ ID NO: 95729 - protein, 10 aa, Artificial Sequence
  Description of Artificial Sequence: Synthetic peptide
  Seed: KDSDLPTWRR (MAGC3_HUMAN)
KWSDLPTWRR

SEQ ID NO: 95730 - protein, 10 aa, Artificial Sequence
  Description of Artificial Sequence: Synthetic peptide
  Seed: SKLSSIIPSA (MAGC3_HUMAN)
SLLSSIIPSV

SEQ ID NO: 95731 - protein, 9 aa, Artificial Sequence
  Description of Artificial Sequence: Synthetic peptide
  Seed: VINTYTGYF (MAGC3_HUMAN)
VYNTYTGYF

SEQ ID NO: 95732 - protein, 10 aa, Artificial Sequence
  Description of Artificial Sequence: Synthetic peptide
  Seed: KKYKDYFPMI (MAGC3_HUMAN)
KRYKDYFPMM

SEQ ID NO: 95733 - protein, 10 aa, Artificial Sequence
  Description of Artificial Sequence: Synthetic peptide
  Seed: EAFCEESGLR (MAGC3_HUMAN)
ESFCEESGLK

SEQ ID NO: 95734 - protein, 10 aa, Artificial Sequence
  Description of Artificial Sequence: Synthetic peptide
  Seed: TFSDGSLGQW (MAGC3_HUMAN)
TQSDGSLGQW

SEQ ID NO: 95735 - protein, 9 aa, Artificial Sequence
  Description of Artificial Sequence: Synthetic peptide
  Seed: FSLRRAVSV (MAGC3_HUMAN)
FQLRRAVSI

SEQ ID NO: 95736 - protein, 9 aa, Artificial Sequence
  Description of Artificial Sequence: Synthetic peptide
  Seed: VINTYTGYF (MAGC3_HUMAN)
VSNTYTGYW

SEQ ID NO: 95737 - protein, 8 aa, Artificial Sequence
  Description of Artificial Sequence: Synthetic peptide
  Seed: FADVLSRL (MAGC3_HUMAN)
FADVLSRM

SEQ ID NO: 95738 - protein, 9 aa, Artificial Sequence
  Description of Artificial Sequence: Synthetic peptide
  Seed: LIDDQGMPK (MAGC3_HUMAN)
LIDDQGMPV

SEQ ID NO: 95739 - protein, 9 aa, Artificial Sequence
  Description of Artificial Sequence: Synthetic peptide
  Seed: LANPQGLAG (MAGC3_HUMAN)
LINPQGLAY

SEQ ID NO: 95740 - protein, 8 aa, Artificial Sequence
  Description of Artificial Sequence: Synthetic peptide
  Seed: MEDRAQAI (MAGC3_HUMAN)
MFDRAQAL

SEQ ID NO: 95741 - protein, 9 aa, Artificial Sequence
  Description of Artificial Sequence: Synthetic peptide
  Seed: SLRRAVSVK (MAGC3_HUMAN)
SLRRAVSVR

SEQ ID NO: 95742 - protein, 10 aa, Artificial Sequence
  Description of Artificial Sequence: Synthetic peptide
  Seed: KVAELVQFLL (MAGC3_HUMAN)
KMAELVQFLR

SEQ ID NO: 95743 - protein, 11 aa, Artificial Sequence
  Description of Artificial Sequence: Synthetic peptide
  Seed: SSSEEEDTATW (MAGC3_HUMAN)
SLSEEEDTATY

SEQ ID NO: 95744 - protein, 8 aa, Artificial Sequence
  Description of Artificial Sequence: Synthetic peptide
  Seed: KVDKLVQF (MAGC3_HUMAN)
KFDKLVQM

SEQ ID NO: 95745 - protein, 9 aa, Artificial Sequence
  Description of Artificial Sequence: Synthetic peptide
  Seed: RTLSGSPGL (MAGC3_HUMAN)
RGLSGSPGW

SEQ ID NO: 95746 - protein, 9 aa, Artificial Sequence
  Description of Artificial Sequence: Synthetic peptide
  Seed: YSAFHLGHL (MAGC3_HUMAN)
YAAFHLGHW

SEQ ID NO: 95747 - protein, 10 aa, Artificial Sequence
  Description of Artificial Sequence: Synthetic peptide
  Seed: KATDKDYSAF (MAGC3_HUMAN)
KSTDKDYSAF

SEQ ID NO: 95748 - protein, 9 aa, Artificial Sequence
  Description of Artificial Sequence: Synthetic peptide
  Seed: YKDYFPMIF (MAGC3_HUMAN)
YLDYFPMIL

SEQ ID NO: 95749 - protein, 11 aa, Artificial Sequence
  Description of Artificial Sequence: Synthetic peptide
  Seed: RTLSGSPGLQL (MAGC3_HUMAN)
RLLSGSPGLQK

SEQ ID NO: 95750 - protein, 11 aa, Artificial Sequence
  Description of Artificial Sequence: Synthetic peptide
  Seed: LSKLSSIIPSA (MAGC3_HUMAN)
LCKLSSIIPSI

SEQ ID NO: 95751 - protein, 9 aa, Artificial Sequence
  Description of Artificial Sequence: Synthetic peptide
  Seed: VLCPTYFKL (MAGC3_HUMAN)
VICPTYFKV

SEQ ID NO: 95752 - protein, 10 aa, Artificial Sequence
  Description of Artificial Sequence: Synthetic peptide
  Seed: ILILSVIFIK (MAGC3_HUMAN)
INILSVIFIR

SEQ ID NO: 95753 - protein, 9 aa, Artificial Sequence
  Description of Artificial Sequence: Synthetic peptide
  Seed: KLSSIIPSA (MAGC3_HUMAN)
KLSSIIPSI

SEQ ID NO: 95754 - protein, 10 aa, Artificial Sequence
  Description of Artificial Sequence: Synthetic peptide
  Seed: TAMASASPSV (MAGC3_HUMAN)
TKMASASPSV

SEQ ID NO: 95755 - protein, 11 aa, Artificial Sequence
  Description of Artificial Sequence: Synthetic peptide
  Seed: RTLSGSPGLQL (MAGC3_HUMAN)
RALSGSPGLQR

SEQ ID NO: 95756 - protein, 10 aa, Artificial Sequence
  Description of Artificial Sequence: Synthetic peptide
  Seed: YFPMIFRKAR (MAGC3_HUMAN)
YSPMIFRKAR

SEQ ID NO: 95757 - protein, 9 aa, Artificial Sequence
  Description of Artificial Sequence: Synthetic peptide
  Seed: KKYKDYFPM (MAGC3_HUMAN)
KRYKDYFPL

SEQ ID NO: 95758 - protein, 10 aa, Artificial Sequence
  Description of Artificial Sequence: Synthetic peptide
  Seed: VVLPPQPQPR (MAGC3_HUMAN)
VYLPPQPQPR

SEQ ID NO: 95759 - protein, 10 aa, Artificial Sequence
  Description of Artificial Sequence: Synthetic peptide
  Seed: WHALPESESL (MAGC3_HUMAN)
WHALPESESM

SEQ ID NO: 95760 - protein, 9 aa, Artificial Sequence
  Description of Artificial Sequence: Synthetic peptide
  Seed: TTDDATAMA (MAGC3_HUMAN)
TNDDATAMF

SEQ ID NO: 95761 - protein, 9 aa, Artificial Sequence
  Description of Artificial Sequence: Synthetic peptide
  Seed: HLREVRLFL (MAGC3_HUMAN)
HRREVRLFF

SEQ ID NO: 95762 - protein, 9 aa, Artificial Sequence
  Description of Artificial Sequence: Synthetic peptide
  Seed: YSAFHLGHL (MAGC3_HUMAN)
YMAFHLGHV

SEQ ID NO: 95763 - protein, 9 aa, Artificial Sequence
  Description of Artificial Sequence: Synthetic peptide
  Seed: HFYVFVNTL (MAGC3_HUMAN)
HSYVFVNTI

SEQ ID NO: 95764 - protein, 10 aa, Artificial Sequence
  Description of Artificial Sequence: Synthetic peptide
  Seed: MLLPCHWVLD (MAGC3_HUMAN)
MCLPCHWVLV

SEQ ID NO: 95765 - protein, 9 aa, Artificial Sequence
  Description of Artificial Sequence: Synthetic peptide
  Seed: ATDKDYSAF (MAGC3_HUMAN)
AFDKDYSAV

SEQ ID NO: 95766 - protein, 9 aa, Artificial Sequence
  Description of Artificial Sequence: Synthetic peptide
  Seed: LPTWRRGTG (MAGC3_HUMAN)
LPTWRRGTV

SEQ ID NO: 95767 - protein, 11 aa, Artificial Sequence
  Description of Artificial Sequence: Synthetic peptide
  Seed: IIDTTDDATAM (MAGC3_HUMAN)
IADTTDDATAY

SEQ ID NO: 95768 - protein, 10 aa, Artificial Sequence
  Description of Artificial Sequence: Synthetic peptide
  Seed: TTDDATAMAS (MAGC3_HUMAN)
TFDDATAMAM

SEQ ID NO: 95769 - protein, 10 aa, Artificial Sequence
  Description of Artificial Sequence: Synthetic peptide
  Seed: RSAEGSVLDL (MAGC3_HUMAN)
RAAEGSVLDF

SEQ ID NO: 95770 - protein, 10 aa, Artificial Sequence
  Description of Artificial Sequence: Synthetic peptide
  Seed: KYKDYFPMIF (MAGC3_HUMAN)
KYKDYFPMIY

SEQ ID NO: 95771 - protein, 10 aa, Artificial Sequence
  Description of Artificial Sequence: Synthetic peptide
  Seed: MQMNVINTYT (MAGC3_HUMAN)
MKMNVINTYC

SEQ ID NO: 95772 - protein, 9 aa, Artificial Sequence
  Description of Artificial Sequence: Synthetic peptide
  Seed: LIDDQGMPK (MAGC3_HUMAN)
LQDDQGMPV

SEQ ID NO: 95773 - protein, 9 aa, Artificial Sequence
  Description of Artificial Sequence: Synthetic peptide
  Seed: KDSDLPTWR (MAGC3_HUMAN)
KISDLPTWK

SEQ ID NO: 95774 - protein, 9 aa, Artificial Sequence
  Description of Artificial Sequence: Synthetic peptide
  Seed: EFIELIFGI (MAGC3_HUMAN)
EVIELIFGI

SEQ ID NO: 95775 - protein, 11 aa, Artificial Sequence
  Description of Artificial Sequence: Synthetic peptide
  Seed: RTLSGSPGLQL (MAGC3_HUMAN)
RMLSGSPGLQW

SEQ ID NO: 95776 - protein, 10 aa, Artificial Sequence
  Description of Artificial Sequence: Synthetic peptide
  Seed: LNAIGPWSAL (MAGC3_HUMAN)
LFAIGPWSAM

SEQ ID NO: 95777 - protein, 9 aa, Artificial Sequence
  Description of Artificial Sequence: Synthetic peptide
  Seed: VIWEVLNAI (MAGC3_HUMAN)
VSWEVLNAI

SEQ ID NO: 95778 - protein, 11 aa, Artificial Sequence
  Description of Artificial Sequence: Synthetic peptide
  Seed: EVLSAIGPIQR (MAGC3_HUMAN)
ELLSAIGPIQK

SEQ ID NO: 95779 - protein, 11 aa, Artificial Sequence
  Description of Artificial Sequence: Synthetic peptide
  Seed: TDMDPDNHSYF (MAGC3_HUMAN)
TAMDPDNHSYW

SEQ ID NO: 95780 - protein, 10 aa, Artificial Sequence
  Description of Artificial Sequence: Synthetic peptide
  Seed: SAFHLGHLRE (MAGC3_HUMAN)
SSFHLGHLRR

SEQ ID NO: 95781 - protein, 10 aa, Artificial Sequence
  Description of Artificial Sequence: Synthetic peptide
  Seed: FADVLSRLAL (MAGC3_HUMAN)
FPDVLSRLAV

SEQ ID NO: 95782 - protein, 11 aa, Artificial Sequence
  Description of Artificial Sequence: Synthetic peptide
  Seed: TTDDATAMASA (MAGC3_HUMAN)
TGDDATAMASI

SEQ ID NO: 95783 - protein, 9 aa, Artificial Sequence
  Description of Artificial Sequence: Synthetic peptide
  Seed: AMASASPSV (MAGC3_HUMAN)
ASASASPSY

SEQ ID NO: 95784 - protein, 9 aa, Artificial Sequence
  Description of Artificial Sequence: Synthetic peptide
  Seed: LILSMIFIK (MAGC3_HUMAN)
LGLSMIFIR

SEQ ID NO: 95785 - protein, 10 aa, Artificial Sequence
  Description of Artificial Sequence: Synthetic peptide
  Seed: SLPAVSPGKR (MAGC3_HUMAN)
SIPAVSPGKR

SEQ ID NO: 95786 - protein, 9 aa, Artificial Sequence
  Description of Artificial Sequence: Synthetic peptide
  Seed: YSAFHLGHL (MAGC3_HUMAN)
YMAFHLGHA

SEQ ID NO: 95787 - protein, 10 aa, Artificial Sequence
  Description of Artificial Sequence: Synthetic peptide
  Seed: TLSGSPGLQL (MAGC3_HUMAN)
TMSGSPGLQF

SEQ ID NO: 95788 - protein, 9 aa, Artificial Sequence
  Description of Artificial Sequence: Synthetic peptide
  Seed: IELIFGIAL (MAGC3_HUMAN)
IALIFGIAF

SEQ ID NO: 95789 - protein, 9 aa, Artificial Sequence
  Description of Artificial Sequence: Synthetic peptide
  Seed: ASEEVIWEV (MAGC3_HUMAN)
AMEEVIWEW

SEQ ID NO: 95790 - protein, 11 aa, Artificial Sequence
  Description of Artificial Sequence: Synthetic peptide
  Seed: LTDMDPDNHSY (MAGC3_HUMAN)
LADMDPDNHSF

SEQ ID NO: 95791 - protein, 9 aa, Artificial Sequence
  Description of Artificial Sequence: Synthetic peptide
  Seed: ALDEKVAEL (MAGC3_HUMAN)
AADEKVAEY

SEQ ID NO: 95792 - protein, 9 aa, Artificial Sequence
  Description of Artificial Sequence: Synthetic peptide
  Seed: SLVLCPTYF (MAGC3_HUMAN)
SAVLCPTYF

SEQ ID NO: 95793 - protein, 9 aa, Artificial Sequence
  Description of Artificial Sequence: Synthetic peptide
  Seed: YTGYFPMIF (MAGC3_HUMAN)
YAGYFPMIL

SEQ ID NO: 95794 - protein, 9 aa, Artificial Sequence
  Description of Artificial Sequence: Synthetic peptide
  Seed: WRRGTGYTL (MAGC3_HUMAN)
WYRGTGYTI

SEQ ID NO: 95795 - protein, 9 aa, Artificial Sequence
  Description of Artificial Sequence: Synthetic peptide
  Seed: NTYTGYFPM (MAGC3_HUMAN)
NMYTGYFPY

SEQ ID NO: 95796 - protein, 10 aa, Artificial Sequence
  Description of Artificial Sequence: Synthetic peptide
  Seed: IKKYKDYFPM (MAGC3_HUMAN)
IGKYKDYFPY

SEQ ID NO: 95797 - protein, 9 aa, Artificial Sequence
  Description of Artificial Sequence: Synthetic peptide
  Seed: YFFEDTLDL (MAGC3_HUMAN)
YYFEDTLDV

SEQ ID NO: 95798 - protein, 9 aa, Artificial Sequence
  Description of Artificial Sequence: Synthetic peptide
  Seed: YTGYFPMIF (MAGC3_HUMAN)
YYGYFPMIF

SEQ ID NO: 95799 - protein, 10 aa, Artificial Sequence
  Description of Artificial Sequence: Synthetic peptide
  Seed: MQMNVINTYT (MAGC3_HUMAN)
MDMNVINTYL

SEQ ID NO: 95800 - protein, 11 aa, Artificial Sequence
  Description of Artificial Sequence: Synthetic peptide
  Seed: GPIQRPAREVL (MAGC3_HUMAN)
GPIQRPAREVM

SEQ ID NO: 95801 - protein, 9 aa, Artificial Sequence
  Description of Artificial Sequence: Synthetic peptide
  Seed: MIFGKAHEF (MAGC3_HUMAN)
MVFGKAHEM

SEQ ID NO: 95802 - protein, 10 aa, Artificial Sequence
  Description of Artificial Sequence: Synthetic peptide
  Seed: ALDEKVAELV (MAGC3_HUMAN)
AADEKVAELI

SEQ ID NO: 95803 - protein, 9 aa, Artificial Sequence
  Description of Artificial Sequence: Synthetic peptide
  Seed: ALAGFADVL (MAGC3_HUMAN)
AMAGFADVY

SEQ ID NO: 95804 - protein, 9 aa, Artificial Sequence
  Description of Artificial Sequence: Synthetic peptide
  Seed: KKYKDYFPM (MAGC3_HUMAN)
KLYKDYFPY

SEQ ID NO: 95805 - protein, 10 aa, Artificial Sequence
  Description of Artificial Sequence: Synthetic peptide
  Seed: SQPEGKFSLR (MAGC3_HUMAN)
SVPEGKFSLK

SEQ ID NO: 95806 - protein, 9 aa, Artificial Sequence
  Description of Artificial Sequence: Synthetic peptide
  Seed: SLRRAVSVK (MAGC3_HUMAN)
STRRAVSVT

SEQ ID NO: 95807 - protein, 9 aa, Artificial Sequence
  Description of Artificial Sequence: Synthetic peptide
  Seed: TAMASASPS (MAGC3_HUMAN)
TPMASASPL

SEQ ID NO: 95808 - protein, 9 aa, Artificial Sequence
  Description of Artificial Sequence: Synthetic peptide
  Seed: FHLGHLREV (MAGC3_HUMAN)
FYLGHLREL

SEQ ID NO: 95809 - protein, 9 aa, Artificial Sequence
  Description of Artificial Sequence: Synthetic peptide
  Seed: IELIFGIAL (MAGC3_HUMAN)
IKLIFGIAY

SEQ ID NO: 95810 - protein, 9 aa, Artificial Sequence
  Description of Artificial Sequence: Synthetic peptide
  Seed: DMDPDNHSY (MAGC3_HUMAN)
DLDPDNHSI

SEQ ID NO: 95811 - protein, 10 aa, Artificial Sequence
  Description of Artificial Sequence: Synthetic peptide
  Seed: EVIWEVLNAI (MAGC3_HUMAN)
EVIWEVLNAA

SEQ ID NO: 95812 - protein, 9 aa, Artificial Sequence
  Description of Artificial Sequence: Synthetic peptide
  Seed: TEASPQQKK (MAGC3_HUMAN)
TMASPQQKR

SEQ ID NO: 95813 - protein, 10 aa, Artificial Sequence
  Description of Artificial Sequence: Synthetic peptide
  Seed: MDPDNHSYFF (MAGC3_HUMAN)
MWPDNHSYFY

SEQ ID NO: 95814 - protein, 9 aa, Artificial Sequence
  Description of Artificial Sequence: Synthetic peptide
  Seed: ALDEKVAEL (MAGC3_HUMAN)
AFDEKVAEV

SEQ ID NO: 95815 - protein, 9 aa, Artificial Sequence
  Description of Artificial Sequence: Synthetic peptide
  Seed: SPVVLPPQP (MAGC3_HUMAN)
SPVVLPPQA

SEQ ID NO: 95816 - protein, 9 aa, Artificial Sequence
  Description of Artificial Sequence: Synthetic peptide
  Seed: EMLTTVIKK (MAGC3_HUMAN)
EQLTTVIKR

SEQ ID NO: 95817 - protein, 9 aa, Artificial Sequence
  Description of Artificial Sequence: Synthetic peptide
  Seed: CATYALSPV (MAGC3_HUMAN)
CTTYALSPL

SEQ ID NO: 95818 - protein, 10 aa, Artificial Sequence
  Description of Artificial Sequence: Synthetic peptide
  Seed: FLSKLSSIIP (MAGC3_HUMAN)
FMSKLSSIIV

SEQ ID NO: 95819 - protein, 11 aa, Artificial Sequence
  Description of Artificial Sequence: Synthetic peptide
  Seed: IIDTTDDATAM (MAGC3_HUMAN)
IMDTTDDATAF

SEQ ID NO: 95820 - protein, 9 aa, Artificial Sequence
  Description of Artificial Sequence: Synthetic peptide
  Seed: SASPSVMST (MAGC3_HUMAN)
SASPSVMSM

SEQ ID NO: 95821 - protein, 9 aa, Artificial Sequence
  Description of Artificial Sequence: Synthetic peptide
  Seed: SAFHLGHLR (MAGC3_HUMAN)
SMFHLGHLL

SEQ ID NO: 95822 - protein, 9 aa, Artificial Sequence
  Description of Artificial Sequence: Synthetic peptide
  Seed: AIGPWSALA (MAGC3_HUMAN)
ALGPWSALI

SEQ ID NO: 95823 - protein, 10 aa, Artificial Sequence
  Description of Artificial Sequence: Synthetic peptide
  Seed: GSLPESEPLF (MAGC3_HUMAN)
GQLPESEPLY

SEQ ID NO: 95824 - protein, 9 aa, Artificial Sequence
  Description of Artificial Sequence: Synthetic peptide
  Seed: KLWRTLSGS (MAGC3_HUMAN)
KLWRTLSGM

SEQ ID NO: 95825 - protein, 10 aa, Artificial Sequence
  Description of Artificial Sequence: Synthetic peptide
  Seed: FADVLSRLAL (MAGC3_HUMAN)
FADVLSRLAY

SEQ ID NO: 95826 - protein, 9 aa, Artificial Sequence
  Description of Artificial Sequence: Synthetic peptide
  Seed: IQRPAREVL (MAGC3_HUMAN)
IMRPAREVY

SEQ ID NO: 95827 - protein, 9 aa, Artificial Sequence
  Description of Artificial Sequence: Synthetic peptide
  Seed: LSAIGPIQR (MAGC3_HUMAN)
LAAIGPIQL

SEQ ID NO: 95828 - protein, 10 aa, Artificial Sequence
  Description of Artificial Sequence: Synthetic peptide
  Seed: YALDEKVAEL (MAGC3_HUMAN)
YQLDEKVAEL

SEQ ID NO: 95829 - protein, 9 aa, Artificial Sequence
  Description of Artificial Sequence: Synthetic peptide
  Seed: LSSIIPSAF (MAGC3_HUMAN)
LYSIIPSAM

SEQ ID NO: 95830 - protein, 9 aa, Artificial Sequence
  Description of Artificial Sequence: Synthetic peptide
  Seed: MDPDNHSYF (MAGC3_HUMAN)
MFPDNHSYM

SEQ ID NO: 95831 - protein, 10 aa, Artificial Sequence
  Description of Artificial Sequence: Synthetic peptide
  Seed: TTDDATAMAS (MAGC3_HUMAN)
TFDDATAMAY

SEQ ID NO: 95832 - protein, 11 aa, Artificial Sequence
  Description of Artificial Sequence: Synthetic peptide
  Seed: RTLSGSPGLQL (MAGC3_HUMAN)
RILSGSPGLQW

SEQ ID NO: 95833 - protein, 9 aa, Artificial Sequence
  Description of Artificial Sequence: Synthetic peptide
  Seed: LKYQTKEPV (MAGC3_HUMAN)
LNYQTKEPF

SEQ ID NO: 95834 - protein, 10 aa, Artificial Sequence
  Description of Artificial Sequence: Synthetic peptide
  Seed: EFLSKLSSII (MAGC3_HUMAN)
ELLSKLSSIV

SEQ ID NO: 95835 - protein, 9 aa, Artificial Sequence
  Description of Artificial Sequence: Synthetic peptide
  Seed: MDPDNHSYF (MAGC3_HUMAN)
MRPDNHSYF

SEQ ID NO: 95836 - protein, 9 aa, Artificial Sequence
  Description of Artificial Sequence: Synthetic peptide
  Seed: LANPQGLAG (MAGC3_HUMAN)
LANPQGLAA

SEQ ID NO: 95837 - protein, 10 aa, Artificial Sequence
  Description of Artificial Sequence: Synthetic peptide
  Seed: QEDGRRGLTE (MAGC3_HUMAN)
QEDGRRGLTA

SEQ ID NO: 95838 - protein, 9 aa, Artificial Sequence
  Description of Artificial Sequence: Synthetic peptide
  Seed: SPSVMSTNF (MAGC3_HUMAN)
SPSVMSTNM

SEQ ID NO: 95839 - protein, 9 aa, Artificial Sequence
  Description of Artificial Sequence: Synthetic peptide
  Seed: LTEVDPDHF (MAGC3_HUMAN)
LIEVDPDHM

SEQ ID NO: 95840 - protein, 10 aa, Artificial Sequence
  Description of Artificial Sequence: Synthetic peptide
  Seed: SQPEGKFSLR (MAGC3_HUMAN)
SAPEGKFSLR

SEQ ID NO: 95841 - protein, 9 aa, Artificial Sequence
  Description of Artificial Sequence: Synthetic peptide
  Seed: IIDTTDDAT (MAGC3_HUMAN)
IQDTTDDAM

SEQ ID NO: 95842 - protein, 9 aa, Artificial Sequence
  Description of Artificial Sequence: Synthetic peptide
  Seed: KDSDLPTWR (MAGC3_HUMAN)
KLSDLPTWK

SEQ ID NO: 95843 - protein, 9 aa, Artificial Sequence
  Description of Artificial Sequence: Synthetic peptide
  Seed: IIPSAFPSW (MAGC3_HUMAN)
IFPSAFPSM

SEQ ID NO: 95844 - protein, 10 aa, Artificial Sequence
  Description of Artificial Sequence: Synthetic peptide
  Seed: MDSLVLCPTY (MAGC3_HUMAN)
MASLVLCPTW

SEQ ID NO: 95845 - protein, 9 aa, Artificial Sequence
  Description of Artificial Sequence: Synthetic peptide
  Seed: WRRGTGYTL (MAGC3_HUMAN)
WWRGTGYTM

SEQ ID NO: 95846 - protein, 10 aa, Artificial Sequence
  Description of Artificial Sequence: Synthetic peptide
  Seed: YQAKEPLTRA (MAGC3_HUMAN)
YIAKEPLTRI

SEQ ID NO: 95847 - protein, 9 aa, Artificial Sequence
  Description of Artificial Sequence: Synthetic peptide
  Seed: AEMLTTVIK (MAGC3_HUMAN)
AEMLTTVIM

SEQ ID NO: 95848 - protein, 9 aa, Artificial Sequence
  Description of Artificial Sequence: Synthetic peptide
  Seed: IIDTTDDAT (MAGC3_HUMAN)
IADTTDDAF

SEQ ID NO: 95849 - protein, 10 aa, Artificial Sequence
  Description of Artificial Sequence: Synthetic peptide
  Seed: FKLWRTLSGS (MAGC3_HUMAN)
FWLWRTLSGL

SEQ ID NO: 95850 - protein, 9 aa, Artificial Sequence
  Description of Artificial Sequence: Synthetic peptide
  Seed: HFYVFVNTL (MAGC3_HUMAN)
HFYVFVNTF

SEQ ID NO: 95851 - protein, 10 aa, Artificial Sequence
  Description of Artificial Sequence: Synthetic peptide
  Seed: SIIPSAFPSW (MAGC3_HUMAN)
SWIPSAFPSI

SEQ ID NO: 95852 - protein, 9 aa, Artificial Sequence
  Description of Artificial Sequence: Synthetic peptide
  Seed: NAIGPWSAL (MAGC3_HUMAN)
NAIGPWSAV

SEQ ID NO: 95853 - protein, 10 aa, Artificial Sequence
  Description of Artificial Sequence: Synthetic peptide
  Seed: RLLILILSVI (MAGC3_HUMAN)
RELILILSVV

SEQ ID NO: 95854 - protein, 9 aa, Artificial Sequence
  Description of Artificial Sequence: Synthetic peptide
  Seed: TYFKLWRTL (MAGC3_HUMAN)
TYFKLWRTY

SEQ ID NO: 95855 - protein, 10 aa, Artificial Sequence
  Description of Artificial Sequence: Synthetic peptide
  Seed: YALDEKVAEL (MAGC3_HUMAN)
YHLDEKVAEV

SEQ ID NO: 95856 - protein, 9 aa, Artificial Sequence
  Description of Artificial Sequence: Synthetic peptide
  Seed: MIFRKAREF (MAGC3_HUMAN)
MLFRKAREY

SEQ ID NO: 95857 - protein, 10 aa, Artificial Sequence
  Description of Artificial Sequence: Synthetic peptide
  Seed: MQMNVINTYT (MAGC3_HUMAN)
MTMNVINTYL

SEQ ID NO: 95858 - protein, 9 aa, Artificial Sequence
  Description of Artificial Sequence: Synthetic peptide
  Seed: IIPSAFPSW (MAGC3_HUMAN)
IFPSAFPSL

SEQ ID NO: 95859 - protein, 10 aa, Artificial Sequence
  Description of Artificial Sequence: Synthetic peptide
  Seed: IPSAFPSWYM (MAGC3_HUMAN)
IPSAFPSWYL

SEQ ID NO: 95860 - protein, 9 aa, Artificial Sequence
  Description of Artificial Sequence: Synthetic peptide
  Seed: FLSKLSSII (MAGC3_HUMAN)
FMSKLSSII

SEQ ID NO: 95861 - protein, 10 aa, Artificial Sequence
  Description of Artificial Sequence: Synthetic peptide
  Seed: FKLWRTLSGS (MAGC3_HUMAN)
FQLWRTLSGM

SEQ ID NO: 95862 - protein, 9 aa, Artificial Sequence
  Description of Artificial Sequence: Synthetic peptide
  Seed: HALPESESL (MAGC3_HUMAN)
HPLPESESY

SEQ ID NO: 95863 - protein, 9 aa, Artificial Sequence
  Description of Artificial Sequence: Synthetic peptide
  Seed: MPAAGMPPL (MAGC3_HUMAN)
MGAAGMPPL

SEQ ID NO: 95864 - protein, 8 aa, Artificial Sequence
  Description of Artificial Sequence: Synthetic peptide
  Seed: VLSRLALW (MAGC3_HUMAN)
VASRLALW

SEQ ID NO: 95865 - protein, 10 aa, Artificial Sequence
  Description of Artificial Sequence: Synthetic peptide
  Seed: TCATYALSPV (MAGC3_HUMAN)
TTATYALSPV

SEQ ID NO: 95866 - protein, 10 aa, Artificial Sequence
  Description of Artificial Sequence: Synthetic peptide
  Seed: YALSPVVLPP (MAGC3_HUMAN)
YRLSPVVLPA

SEQ ID NO: 95867 - protein, 11 aa, Artificial Sequence
  Description of Artificial Sequence: Synthetic peptide
  Seed: ATFSDGSLGQW (MAGC3_HUMAN)
ALFSDGSLGQL

SEQ ID NO: 95868 - protein, 8 aa, Artificial Sequence
  Description of Artificial Sequence: Synthetic peptide
  Seed: MEDRAQAI (MAGC3_HUMAN)
MLDRAQAL

SEQ ID NO: 95869 - protein, 10 aa, Artificial Sequence
  Description of Artificial Sequence: Synthetic peptide
  Seed: LPQSPPEIPP (MAGC3_HUMAN)
LPQSPPEIPV

SEQ ID NO: 95870 - protein, 9 aa, Artificial Sequence
  Description of Artificial Sequence: Synthetic peptide
  Seed: QTKEPVTKA (MAGC3_HUMAN)
QVKEPVTKL

SEQ ID NO: 95871 - protein, 9 aa, Artificial Sequence
  Description of Artificial Sequence: Synthetic peptide
  Seed: FSLRRAVSV (MAGC3_HUMAN)
FMLRRAVSC

SEQ ID NO: 95872 - protein, 11 aa, Artificial Sequence
  Description of Artificial Sequence: Synthetic peptide
  Seed: FPMIFRKAREF (MAGC3_HUMAN)
FPMIFRKAREV

SEQ ID NO: 95873 - protein, 9 aa, Artificial Sequence
  Description of Artificial Sequence: Synthetic peptide
  Seed: FADVLSRLA (MAGC3_HUMAN)
FVDVLSRLM

SEQ ID NO: 95874 - protein, 10 aa, Artificial Sequence
  Description of Artificial Sequence: Synthetic peptide
  Seed: KYKDYFPMIF (MAGC3_HUMAN)
KMKDYFPMIY

SEQ ID NO: 95875 - protein, 11 aa, Artificial Sequence
  Description of Artificial Sequence: Synthetic peptide
  Seed: IIDTTDDATAM (MAGC3_HUMAN)
IGDTTDDATAF

SEQ ID NO: 95876 - protein, 10 aa, Artificial Sequence
  Description of Artificial Sequence: Synthetic peptide
  Seed: EVDPDHFYVF (MAGC3_HUMAN)
EVDPDHFYVY

SEQ ID NO: 95877 - protein, 10 aa, Artificial Sequence
  Description of Artificial Sequence: Synthetic peptide
  Seed: YTLDEKVDKL (MAGC3_HUMAN)
YELDEKVDKL

SEQ ID NO: 95878 - protein, 9 aa, Artificial Sequence
  Description of Artificial Sequence: Synthetic peptide
  Seed: LIDDQGMPK (MAGC3_HUMAN)
LADDQGMPF

SEQ ID NO: 95879 - protein, 10 aa, Artificial Sequence
  Description of Artificial Sequence: Synthetic peptide
  Seed: SSEEEDTATW (MAGC3_HUMAN)
SVEEEDTATY

SEQ ID NO: 95880 - protein, 9 aa, Artificial Sequence
  Description of Artificial Sequence: Synthetic peptide
  Seed: ALDEKVAEL (MAGC3_HUMAN)
AGDEKVAEY

SEQ ID NO: 95881 - protein, 9 aa, Artificial Sequence
  Description of Artificial Sequence: Synthetic peptide
  Seed: KLSSIIPSA (MAGC3_HUMAN)
KMSSIIPSM

SEQ ID NO: 95882 - protein, 9 aa, Artificial Sequence
  Description of Artificial Sequence: Synthetic peptide
  Seed: CHWVLDATF (MAGC3_HUMAN)
CMWVLDATF

SEQ ID NO: 95883 - protein, 10 aa, Artificial Sequence
  Description of Artificial Sequence: Synthetic peptide
  Seed: TLDEKVDKLV (MAGC3_HUMAN)
TVDEKVDKLF

SEQ ID NO: 95884 - protein, 9 aa, Artificial Sequence
  Description of Artificial Sequence: Synthetic peptide
  Seed: VLCPTYFKL (MAGC3_HUMAN)
VWCPTYFKF

SEQ ID NO: 95885 - protein, 8 aa, Artificial Sequence
  Description of Artificial Sequence: Synthetic peptide
  Seed: SAIGPIQR (MAGC3_HUMAN)
SAIGPIQL

SEQ ID NO: 95886 - protein, 11 aa, Artificial Sequence
  Description of Artificial Sequence: Synthetic peptide
  Seed: IIDTTDDATAM (MAGC3_HUMAN)
ILDTTDDATAY

SEQ ID NO: 95887 - protein, 9 aa, Artificial Sequence
  Description of Artificial Sequence: Synthetic peptide
  Seed: YQTKEPVTK (MAGC3_HUMAN)
YATKEPVTL

SEQ ID NO: 95888 - protein, 9 aa, Artificial Sequence
  Description of Artificial Sequence: Synthetic peptide
  Seed: AMASASPSV (MAGC3_HUMAN)
ATASASPSY

SEQ ID NO: 95889 - protein, 11 aa, Artificial Sequence
  Description of Artificial Sequence: Synthetic peptide
  Seed: AIIDTTDDATA (MAGC3_HUMAN)
AMIDTTDDATM

SEQ ID NO: 95890 - protein, 10 aa, Artificial Sequence
  Description of Artificial Sequence: Synthetic peptide
  Seed: FSDGSLGQWV (MAGC3_HUMAN)
FSDGSLGQWM

SEQ ID NO: 95891 - protein, 9 aa, Artificial Sequence
  Description of Artificial Sequence: Synthetic peptide
  Seed: SLPESEPLF (MAGC3_HUMAN)
SQPESEPLF

SEQ ID NO: 95892 - protein, 10 aa, Artificial Sequence
  Description of Artificial Sequence: Synthetic peptide
  Seed: RLWGEKAGSL (MAGC3_HUMAN)
RMWGEKAGSL

SEQ ID NO: 95893 - protein, 11 aa, Artificial Sequence
  Description of Artificial Sequence: Synthetic peptide
  Seed: TTDDATAMASA (MAGC3_HUMAN)
TMDDATAMASM

SEQ ID NO: 95894 - protein, 10 aa, Artificial Sequence
  Description of Artificial Sequence: Synthetic peptide
  Seed: EEVIWEVLSA (MAGC3_HUMAN)
EYVIWEVLSV

SEQ ID NO: 95895 - protein, 9 aa, Artificial Sequence
  Description of Artificial Sequence: Synthetic peptide
  Seed: HALPESESL (MAGC3_HUMAN)
HRLPESESV

SEQ ID NO: 95896 - protein, 9 aa, Artificial Sequence
  Description of Artificial Sequence: Synthetic peptide
  Seed: FKLWRTLSG (MAGC3_HUMAN)
FQLWRTLSH

SEQ ID NO: 95897 - protein, 9 aa, Artificial Sequence
  Description of Artificial Sequence: Synthetic peptide
  Seed: EVLSAIGPI (MAGC3_HUMAN)
ESLSAIGPY

SEQ ID NO: 95898 - protein, 9 aa, Artificial Sequence
  Description of Artificial Sequence: Synthetic peptide
  Seed: FKLWRTLSG (MAGC3_HUMAN)
FSLWRTLSM

SEQ ID NO: 95899 - protein, 10 aa, Artificial Sequence
  Description of Artificial Sequence: Synthetic peptide
  Seed: MQMNVINTYT (MAGC3_HUMAN)
MKMNVINTYR

SEQ ID NO: 95900 - protein, 9 aa, Artificial Sequence
  Description of Artificial Sequence: Synthetic peptide
  Seed: AIGPIQRPA (MAGC3_HUMAN)
AVGPIQRPY

SEQ ID NO: 95901 - protein, 10 aa, Artificial Sequence
  Description of Artificial Sequence: Synthetic peptide
  Seed: TLDEKVDKLV (MAGC3_HUMAN)
TVDEKVDKLL

SEQ ID NO: 95902 - protein, 9 aa, Artificial Sequence
  Description of Artificial Sequence: Synthetic peptide
  Seed: WESEGPEAF (MAGC3_HUMAN)
WHSEGPEAV

SEQ ID NO: 95903 - protein, 9 aa, Artificial Sequence
  Description of Artificial Sequence: Synthetic peptide
  Seed: EVLEFLSKL (MAGC3_HUMAN)
ETLEFLSKV

SEQ ID NO: 95904 - protein, 9 aa, Artificial Sequence
  Description of Artificial Sequence: Synthetic peptide
  Seed: FSDGSLGQW (MAGC3_HUMAN)
FIDGSLGQV

SEQ ID NO: 95905 - protein, 9 aa, Artificial Sequence
  Description of Artificial Sequence: Synthetic peptide
  Seed: MQMNVINTY (MAGC3_HUMAN)
MTMNVINTL

SEQ ID NO: 95906 - protein, 10 aa, Artificial Sequence
  Description of Artificial Sequence: Synthetic peptide
  Seed: YALDEKVAEL (MAGC3_HUMAN)
YWLDEKVAET

SEQ ID NO: 95907 - protein, 9 aa, Artificial Sequence
  Description of Artificial Sequence: Synthetic peptide
  Seed: VIWEVLNAI (MAGC3_HUMAN)
VIWEVLNAY

SEQ ID NO: 95908 - protein, 9 aa, Artificial Sequence
  Description of Artificial Sequence: Synthetic peptide
  Seed: SLRRAVSVK (MAGC3_HUMAN)
SVRRAVSVR

SEQ ID NO: 95909 - protein, 9 aa, Artificial Sequence
  Description of Artificial Sequence: Synthetic peptide
  Seed: YTGYFPMIF (MAGC3_HUMAN)
YTGYFPMIL

SEQ ID NO: 95910 - protein, 9 aa, Artificial Sequence
  Description of Artificial Sequence: Synthetic peptide
  Seed: RGTGYTLSL (MAGC3_HUMAN)
RTTGYTLSF

SEQ ID NO: 95911 - protein, 10 aa, Artificial Sequence
  Description of Artificial Sequence: Synthetic peptide
  Seed: SVIFIKGNCA (MAGC3_HUMAN)
SVIFIKGNCV

SEQ ID NO: 95912 - protein, 8 aa, Artificial Sequence
  Description of Artificial Sequence: Synthetic peptide
  Seed: TTDDATAM (MAGC3_HUMAN)
TADDATAI

SEQ ID NO: 95913 - protein, 9 aa, Artificial Sequence
  Description of Artificial Sequence: Synthetic peptide
  Seed: KLWRTLSGS (MAGC3_HUMAN)
KLWRTLSGT

SEQ ID NO: 95914 - protein, 9 aa, Artificial Sequence
  Description of Artificial Sequence: Synthetic peptide
  Seed: FKLWRTLSG (MAGC3_HUMAN)
FSLWRTLSF

SEQ ID NO: 95915 - protein, 11 aa, Artificial Sequence
  Description of Artificial Sequence: Synthetic peptide
  Seed: TSDQRMDSLVL (MAGC3_HUMAN)
TSDQRMDSLVF

SEQ ID NO: 95916 - protein, 11 aa, Artificial Sequence
  Description of Artificial Sequence: Synthetic peptide
  Seed: ILFGISLTEVD (MAGC3_HUMAN)
ILFGISLTEVV

SEQ ID NO: 95917 - protein, 10 aa, Artificial Sequence
  Description of Artificial Sequence: Synthetic peptide
  Seed: KFSLRRAVSV (MAGC3_HUMAN)
KASLRRAVSK

SEQ ID NO: 95918 - protein, 9 aa, Artificial Sequence
  Description of Artificial Sequence: Synthetic peptide
  Seed: EVIWEVLSA (MAGC3_HUMAN)
EMIWEVLSR

SEQ ID NO: 95919 - protein, 9 aa, Artificial Sequence
  Description of Artificial Sequence: Synthetic peptide
  Seed: MPAAGMPPL (MAGC3_HUMAN)
MFAAGMPPY

SEQ ID NO: 95920 - protein, 10 aa, Artificial Sequence
  Description of Artificial Sequence: Synthetic peptide
  Seed: FFEDTLDLTY (MAGC3_HUMAN)
FTEDTLDLTL

SEQ ID NO: 95921 - protein, 11 aa, Artificial Sequence
  Description of Artificial Sequence: Synthetic peptide
  Seed: SIIPSAFPSWY (MAGC3_HUMAN)
SAIPSAFPSWK

SEQ ID NO: 95922 - protein, 9 aa, Artificial Sequence
  Description of Artificial Sequence: Synthetic peptide
  Seed: YFFEDTLDL (MAGC3_HUMAN)
YIFEDTLDY

SEQ ID NO: 95923 - protein, 9 aa, Artificial Sequence
  Description of Artificial Sequence: Synthetic peptide
  Seed: AVSPGKRLW (MAGC3_HUMAN)
ALSPGKRLY

SEQ ID NO: 95924 - protein, 9 aa, Artificial Sequence
  Description of Artificial Sequence: Synthetic peptide
  Seed: KVDKLVQFL (MAGC3_HUMAN)
KIDKLVQFV

SEQ ID NO: 95925 - protein, 8 aa, Artificial Sequence
  Description of Artificial Sequence: Synthetic peptide
  Seed: TTDDATAM (MAGC3_HUMAN)
TWDDATAV

SEQ ID NO: 95926 - protein, 9 aa, Artificial Sequence
  Description of Artificial Sequence: Synthetic peptide
  Seed: LSSIIPSAF (MAGC3_HUMAN)
LASIIPSAL

SEQ ID NO: 95927 - protein, 9 aa, Artificial Sequence
  Description of Artificial Sequence: Synthetic peptide
  Seed: YQTKEPVTK (MAGC3_HUMAN)
YGTKEPVTL

SEQ ID NO: 95928 - protein, 10 aa, Artificial Sequence
  Description of Artificial Sequence: Synthetic peptide
  Seed: TDDATAMASA (MAGC3_HUMAN)
TEDATAMASI

SEQ ID NO: 95929 - protein, 9 aa, Artificial Sequence
  Description of Artificial Sequence: Synthetic peptide
  Seed: EFIELIFGI (MAGC3_HUMAN)
EVIELIFGM

SEQ ID NO: 95930 - protein, 9 aa, Artificial Sequence
  Description of Artificial Sequence: Synthetic peptide
  Seed: AGFADVLSR (MAGC3_HUMAN)
ATFADVLSF

SEQ ID NO: 95931 - protein, 10 aa, Artificial Sequence
  Description of Artificial Sequence: Synthetic peptide
  Seed: TTDDATAMAS (MAGC3_HUMAN)
TLDDATAMAV

SEQ ID NO: 95932 - protein, 11 aa, Artificial Sequence
  Description of Artificial Sequence: Synthetic peptide
  Seed: LIDDQGMPKNC (MAGC3_HUMAN)
LTDDQGMPKNL

SEQ ID NO: 95933 - protein, 9 aa, Artificial Sequence
  Description of Artificial Sequence: Synthetic peptide
  Seed: HSYFFEDTL (MAGC3_HUMAN)
HAYFFEDTM

SEQ ID NO: 95934 - protein, 10 aa, Artificial Sequence
  Description of Artificial Sequence: Synthetic peptide
  Seed: KYKDYFPMIF (MAGC3_HUMAN)
KKKDYFPMIF

SEQ ID NO: 95935 - protein, 10 aa, Artificial Sequence
  Description of Artificial Sequence: Synthetic peptide
  Seed: EVIWEVLSAI (MAGC3_HUMAN)
EMIWEVLSAR

SEQ ID NO: 95936 - protein, 10 aa, Artificial Sequence
  Description of Artificial Sequence: Synthetic peptide
  Seed: ALAGFADVLS (MAGC3_HUMAN)
ALAGFADVLM

SEQ ID NO: 95937 - protein, 10 aa, Artificial Sequence
  Description of Artificial Sequence: Synthetic peptide
  Seed: ILILSVIFIK (MAGC3_HUMAN)
IGILSVIFIR

SEQ ID NO: 95938 - protein, 11 aa, Artificial Sequence
  Description of Artificial Sequence: Synthetic peptide
  Seed: LDSCSSPLLWT (MAGC3_HUMAN)
LSSCSSPLLWH

SEQ ID NO: 95939 - protein, 10 aa, Artificial Sequence
  Description of Artificial Sequence: Synthetic peptide
  Seed: YALSPVVLPP (MAGC3_HUMAN)
YILSPVVLPA

SEQ ID NO: 95940 - protein, 9 aa, Artificial Sequence
  Description of Artificial Sequence: Synthetic peptide
  Seed: VLCPTYFKL (MAGC3_HUMAN)
VTCPTYFKL

SEQ ID NO: 95941 - protein, 10 aa, Artificial Sequence
  Description of Artificial Sequence: Synthetic peptide
  Seed: FFEDTLDLTY (MAGC3_HUMAN)
FAEDTLDLTL

SEQ ID NO: 95942 - protein, 9 aa, Artificial Sequence
  Description of Artificial Sequence: Synthetic peptide
  Seed: RGTGYTLSL (MAGC3_HUMAN)
RITGYTLSV

SEQ ID NO: 95943 - protein, 9 aa, Artificial Sequence
  Description of Artificial Sequence: Synthetic peptide
  Seed: WRRGTGYTL (MAGC3_HUMAN)
WLRGTGYTF

SEQ ID NO: 95944 - protein, 9 aa, Artificial Sequence
  Description of Artificial Sequence: Synthetic peptide
  Seed: TYALSPVVL (MAGC3_HUMAN)
TAALSPVVM

SEQ ID NO: 95945 - protein, 10 aa, Artificial Sequence
  Description of Artificial Sequence: Synthetic peptide
  Seed: LTRAEMQMNV (MAGC3_HUMAN)
LLRAEMQMNV

SEQ ID NO: 95946 - protein, 10 aa, Artificial Sequence
  Description of Artificial Sequence: Synthetic peptide
  Seed: KLSSIIPSAF (MAGC3_HUMAN)
KASSIIPSAF

SEQ ID NO: 95947 - protein, 11 aa, Artificial Sequence
  Description of Artificial Sequence: Synthetic peptide
  Seed: KGSCVPEEVIW (MAGC3_HUMAN)
KSSCVPEEVIW

SEQ ID NO: 95948 - protein, 9 aa, Artificial Sequence
  Description of Artificial Sequence: Synthetic peptide
  Seed: QMNVINTYT (MAGC3_HUMAN)
QMNVINTYL

SEQ ID NO: 95949 - protein, 10 aa, Artificial Sequence
  Description of Artificial Sequence: Synthetic peptide
  Seed: YALDEKVAEL (MAGC3_HUMAN)
YKLDEKVAEI

SEQ ID NO: 95950 - protein, 9 aa, Artificial Sequence
  Description of Artificial Sequence: Synthetic peptide
  Seed: HLREVRLFL (MAGC3_HUMAN)
HQREVRLFY

SEQ ID NO: 95951 - protein, 11 aa, Artificial Sequence
  Description of Artificial Sequence: Synthetic peptide
  Seed: KKYKDYFPMIF (MAGC3_HUMAN)
KWYKDYFPMIW

SEQ ID NO: 95952 - protein, 9 aa, Artificial Sequence
  Description of Artificial Sequence: Synthetic peptide
  Seed: NAIGPWSAL (MAGC3_HUMAN)
NTIGPWSAY

SEQ ID NO: 95953 - protein, 9 aa, Artificial Sequence
  Description of Artificial Sequence: Synthetic peptide
  Seed: SASPSVMST (MAGC3_HUMAN)
SNSPSVMSV

SEQ ID NO: 95954 - protein, 9 aa, Artificial Sequence
  Description of Artificial Sequence: Synthetic peptide
  Seed: EVIWEVLSA (MAGC3_HUMAN)
ETIWEVLSL

SEQ ID NO: 95955 - protein, 11 aa, Artificial Sequence
  Description of Artificial Sequence: Synthetic peptide
  Seed: HALPESESLPR (MAGC3_HUMAN)
HTLPESESLPK

SEQ ID NO: 95956 - protein, 9 aa, Artificial Sequence
  Description of Artificial Sequence: Synthetic peptide
  Seed: SEEVIWEVL (MAGC3_HUMAN)
SEEVIWEVA

SEQ ID NO: 95957 - protein, 9 aa, Artificial Sequence
  Description of Artificial Sequence: Synthetic peptide
  Seed: LANPQGLAG (MAGC3_HUMAN)
LVNPQGLAM

SEQ ID NO: 95958 - protein, 9 aa, Artificial Sequence
  Description of Artificial Sequence: Synthetic peptide
  Seed: WVKNTCATY (MAGC3_HUMAN)
WMKNTCATL

SEQ ID NO: 95959 - protein, 11 aa, Artificial Sequence
  Description of Artificial Sequence: Synthetic peptide
  Seed: RGLTEASPQQK (MAGC3_HUMAN)
RALTEASPQQR

SEQ ID NO: 95960 - protein, 9 aa, Artificial Sequence
  Description of Artificial Sequence: Synthetic peptide
  Seed: WVKNTCATY (MAGC3_HUMAN)
WRKNTCATY

SEQ ID NO: 95961 - protein, 9 aa, Artificial Sequence
  Description of Artificial Sequence: Synthetic peptide
  Seed: EFIELIFGI (MAGC3_HUMAN)
EMIELIFGA

SEQ ID NO: 95962 - protein, 9 aa, Artificial Sequence
  Description of Artificial Sequence: Synthetic peptide
  Seed: WEVLNAIGP (MAGC3_HUMAN)
WEVLNAIGL

SEQ ID NO: 95963 - protein, 10 aa, Artificial Sequence
  Description of Artificial Sequence: Synthetic peptide
  Seed: KKYKDYFPMI (MAGC3_HUMAN)
KDYKDYFPMF

SEQ ID NO: 95964 - protein, 10 aa, Artificial Sequence
  Description of Artificial Sequence: Synthetic peptide
  Seed: AEMLTTVIKK (MAGC3_HUMAN)
ATMLTTVIKK

SEQ ID NO: 95965 - protein, 10 aa, Artificial Sequence
  Description of Artificial Sequence: Synthetic peptide
  Seed: EKVAELVQFL (MAGC3_HUMAN)
EVVAELVQFY

SEQ ID NO: 95966 - protein, 10 aa, Artificial Sequence
  Description of Artificial Sequence: Synthetic peptide
  Seed: FLRGGTSDQR (MAGC3_HUMAN)
FTRGGTSDQR

SEQ ID NO: 95967 - protein, 10 aa, Artificial Sequence
  Description of Artificial Sequence: Synthetic peptide
  Seed: IIDTTDDATA (MAGC3_HUMAN)
ITDTTDDATI

SEQ ID NO: 95968 - protein, 9 aa, Artificial Sequence
  Description of Artificial Sequence: Synthetic peptide
  Seed: EVDPDHFYV (MAGC3_HUMAN)
EWDPDHFYM

SEQ ID NO: 95969 - protein, 11 aa, Artificial Sequence
  Description of Artificial Sequence: Synthetic peptide
  Seed: RTLSGSPGLQL (MAGC3_HUMAN)
RALSGSPGLQY

SEQ ID NO: 95970 - protein, 10 aa, Artificial Sequence
  Description of Artificial Sequence: Synthetic peptide
  Seed: TGYFPMIFRK (MAGC3_HUMAN)
TFYFPMIFRK

SEQ ID NO: 95971 - protein, 9 aa, Artificial Sequence
  Description of Artificial Sequence: Synthetic peptide
  Seed: VAELVQFLL (MAGC3_HUMAN)
VSELVQFLF

SEQ ID NO: 95972 - protein, 9 aa, Artificial Sequence
  Description of Artificial Sequence: Synthetic peptide
  Seed: ADVLSRLAL (MAGC3_HUMAN)
AEVLSRLAP

SEQ ID NO: 95973 - protein, 9 aa, Artificial Sequence
  Description of Artificial Sequence: Synthetic peptide
  Seed: HFYVFVNTL (MAGC3_HUMAN)
HVYVFVNTY

SEQ ID NO: 95974 - protein, 9 aa, Artificial Sequence
  Description of Artificial Sequence: Synthetic peptide
  Seed: IPPQGPPKI (MAGC3_HUMAN)
IMPQGPPKM

SEQ ID NO: 95975 - protein, 9 aa, Artificial Sequence
  Description of Artificial Sequence: Synthetic peptide
  Seed: MLLPCHWVL (MAGC3_HUMAN)
MVLPCHWVM

SEQ ID NO: 95976 - protein, 9 aa, Artificial Sequence
  Description of Artificial Sequence: Synthetic peptide
  Seed: VDPDHFYVF (MAGC3_HUMAN)
VQPDHFYVF

SEQ ID NO: 95977 - protein, 9 aa, Artificial Sequence
  Description of Artificial Sequence: Synthetic peptide
  Seed: FLSKLSSII (MAGC3_HUMAN)
FESKLSSIY

SEQ ID NO: 95978 - protein, 9 aa, Artificial Sequence
  Description of Artificial Sequence: Synthetic peptide
  Seed: MLLPCHWVL (MAGC3_HUMAN)
MLLPCHWVI

SEQ ID NO: 95979 - protein, 10 aa, Artificial Sequence
  Description of Artificial Sequence: Synthetic peptide
  Seed: SLIDDQGMPK (MAGC3_HUMAN)
STIDDQGMPY

SEQ ID NO: 95980 - protein, 10 aa, Artificial Sequence
  Description of Artificial Sequence: Synthetic peptide
  Seed: MLLPCHWVLD (MAGC3_HUMAN)
MWLPCHWVLV

SEQ ID NO: 95981 - protein, 9 aa, Artificial Sequence
  Description of Artificial Sequence: Synthetic peptide
  Seed: HSYFFEDTL (MAGC3_HUMAN)
HIYFFEDTF

SEQ ID NO: 95982 - protein, 11 aa, Artificial Sequence
  Description of Artificial Sequence: Synthetic peptide
  Seed: FIELIFGIALT (MAGC3_HUMAN)
FFELIFGIALV

SEQ ID NO: 95983 - protein, 9 aa, Artificial Sequence
  Description of Artificial Sequence: Synthetic peptide
  Seed: ASEEVIWEV (MAGC3_HUMAN)
ATEEVIWEL

SEQ ID NO: 95984 - protein, 10 aa, Artificial Sequence
  Description of Artificial Sequence: Synthetic peptide
  Seed: SALAGFADVL (MAGC3_HUMAN)
SSLAGFADVV

SEQ ID NO: 95985 - protein, 9 aa, Artificial Sequence
  Description of Artificial Sequence: Synthetic peptide
  Seed: LSAIGPIQR (MAGC3_HUMAN)
LAAIGPIQY

SEQ ID NO: 95986 - protein, 10 aa, Artificial Sequence
  Description of Artificial Sequence: Synthetic peptide
  Seed: IPSAFPSWYM (MAGC3_HUMAN)
ICSAFPSWYW

SEQ ID NO: 95987 - protein, 9 aa, Artificial Sequence
  Description of Artificial Sequence: Synthetic peptide
  Seed: SQPEGKFSL (MAGC3_HUMAN)
SRPEGKFSM

SEQ ID NO: 95988 - protein, 9 aa, Artificial Sequence
  Description of Artificial Sequence: Synthetic peptide
  Seed: YSAFHLGHL (MAGC3_HUMAN)
YVAFHLGHA

SEQ ID NO: 95989 - protein, 10 aa, Artificial Sequence
  Description of Artificial Sequence: Synthetic peptide
  Seed: YALSPVVLPP (MAGC3_HUMAN)
YELSPVVLPT

SEQ ID NO: 95990 - protein, 9 aa, Artificial Sequence
  Description of Artificial Sequence: Synthetic peptide
  Seed: YQAKEPLTR (MAGC3_HUMAN)
YAAKEPLTA

SEQ ID NO: 95991 - protein, 10 aa, Artificial Sequence
  Description of Artificial Sequence: Synthetic peptide
  Seed: IELIFGIALT (MAGC3_HUMAN)
ISLIFGIALV

SEQ ID NO: 95992 - protein, 9 aa, Artificial Sequence
  Description of Artificial Sequence: Synthetic peptide
  Seed: MIFGKAHEF (MAGC3_HUMAN)
MYFGKAHEV

SEQ ID NO: 95993 - protein, 9 aa, Artificial Sequence
  Description of Artificial Sequence: Synthetic peptide
  Seed: KQREEPQDW (MAGC3_HUMAN)
KLREEPQDF

SEQ ID NO: 95994 - protein, 9 aa, Artificial Sequence
  Description of Artificial Sequence: Synthetic peptide
  Seed: YSAFHLGHL (MAGC3_HUMAN)
YIAFHLGHR

SEQ ID NO: 95995 - protein, 9 aa, Artificial Sequence
  Description of Artificial Sequence: Synthetic peptide
  Seed: ISPQGPPQS (MAGC3_HUMAN)
IAPQGPPQL

SEQ ID NO: 95996 - protein, 9 aa, Artificial Sequence
  Description of Artificial Sequence: Synthetic peptide
  Seed: QLSDLHFGS (MAGC3_HUMAN)
QLSDLHFGV

SEQ ID NO: 95997 - protein, 9 aa, Artificial Sequence
  Description of Artificial Sequence: Synthetic peptide
  Seed: ATYALSPVV (MAGC3_HUMAN)
ALYALSPVV

SEQ ID NO: 95998 - protein, 9 aa, Artificial Sequence
  Description of Artificial Sequence: Synthetic peptide
  Seed: ALDEKVAEL (MAGC3_HUMAN)
ASDEKVAEC

SEQ ID NO: 95999 - protein, 9 aa, Artificial Sequence
  Description of Artificial Sequence: Synthetic peptide
  Seed: LSDEQGMPQ (MAGC3_HUMAN)
LMDEQGMPI

SEQ ID NO: 96000 - protein, 11 aa, Artificial Sequence
  Description of Artificial Sequence: Synthetic peptide
  Seed: MQMNVINTYTG (MAGC3_HUMAN)
MLMNVINTYTY

SEQ ID NO: 96001 - protein, 9 aa, Artificial Sequence
  Description of Artificial Sequence: Synthetic peptide
  Seed: YSAFHLGHL (MAGC3_HUMAN)
YSAFHLGHV

SEQ ID NO: 96002 - protein, 11 aa, Artificial Sequence
  Description of Artificial Sequence: Synthetic peptide
  Seed: TTDDATAMASA (MAGC3_HUMAN)
TTDDATAMASL

SEQ ID NO: 96003 - protein, 9 aa, Artificial Sequence
  Description of Artificial Sequence: Synthetic peptide
  Seed: CSSPLLWTR (MAGC3_HUMAN)
CASPLLWTK

SEQ ID NO: 96004 - protein, 10 aa, Artificial Sequence
  Description of Artificial Sequence: Synthetic peptide
  Seed: MDPDNHSYFF (MAGC3_HUMAN)
MGPDNHSYFF

SEQ ID NO: 96005 - protein, 9 aa, Artificial Sequence
  Description of Artificial Sequence: Synthetic peptide
  Seed: GKFSLRRAV (MAGC3_HUMAN)
GQFSLRRAM

SEQ ID NO: 96006 - protein, 9 aa, Artificial Sequence
  Description of Artificial Sequence: Synthetic peptide
  Seed: CATYALSPV (MAGC3_HUMAN)
CLTYALSPA

SEQ ID NO: 96007 - protein, 10 aa, Artificial Sequence
  Description of Artificial Sequence: Synthetic peptide
  Seed: AMASASPSVM (MAGC3_HUMAN)
ASASASPSVF

SEQ ID NO: 96008 - protein, 10 aa, Artificial Sequence
  Description of Artificial Sequence: Synthetic peptide
  Seed: TGYFPMIFRK (MAGC3_HUMAN)
TVYFPMIFRL

SEQ ID NO: 96009 - protein, 10 aa, Artificial Sequence
  Description of Artificial Sequence: Synthetic peptide
  Seed: KVAELVQFLL (MAGC3_HUMAN)
KTAELVQFLV

SEQ ID NO: 96010 - protein, 10 aa, Artificial Sequence
  Description of Artificial Sequence: Synthetic peptide
  Seed: ILFGISLTEV (MAGC3_HUMAN)
ITFGISLTEL

SEQ ID NO: 96011 - protein, 10 aa, Artificial Sequence
  Description of Artificial Sequence: Synthetic peptide
  Seed: TDMDPDNHSY (MAGC3_HUMAN)
TAMDPDNHSM

SEQ ID NO: 96012 - protein, 9 aa, Artificial Sequence
  Description of Artificial Sequence: Synthetic peptide
  Seed: SQPEGKFSL (MAGC3_HUMAN)
SQPEGKFSM

SEQ ID NO: 96013 - protein, 9 aa, Artificial Sequence
  Description of Artificial Sequence: Synthetic peptide
  Seed: VLPPQPQPR (MAGC3_HUMAN)
VLPPQPQPI

SEQ ID NO: 96014 - protein, 10 aa, Artificial Sequence
  Description of Artificial Sequence: Synthetic peptide
  Seed: KATDKDYSAF (MAGC3_HUMAN)
KVTDKDYSAW

SEQ ID NO: 96015 - protein, 11 aa, Artificial Sequence
  Description of Artificial Sequence: Synthetic peptide
  Seed: TSDQRMDSLVL (MAGC3_HUMAN)
TLDQRMDSLVY

SEQ ID NO: 96016 - protein, 10 aa, Artificial Sequence
  Description of Artificial Sequence: Synthetic peptide
  Seed: LIFGIALTDM (MAGC3_HUMAN)
LQFGIALTDM

SEQ ID NO: 96017 - protein, 9 aa, Artificial Sequence
  Description of Artificial Sequence: Synthetic peptide
  Seed: FADVLSRLA (MAGC3_HUMAN)
FNDVLSRLF

SEQ ID NO: 96018 - protein, 9 aa, Artificial Sequence
  Description of Artificial Sequence: Synthetic peptide
  Seed: SALAGFADV (MAGC3_HUMAN)
SILAGFADA

SEQ ID NO: 96019 - protein, 9 aa, Artificial Sequence
  Description of Artificial Sequence: Synthetic peptide
  Seed: VLCPTYFKL (MAGC3_HUMAN)
VTCPTYFKK

SEQ ID NO: 96020 - protein, 9 aa, Artificial Sequence
  Description of Artificial Sequence: Synthetic peptide
  Seed: LKYQTKEPV (MAGC3_HUMAN)
LAYQTKEPY

SEQ ID NO: 96021 - protein, 10 aa, Artificial Sequence
  Description of Artificial Sequence: Synthetic peptide
  Seed: MQMNVINTYT (MAGC3_HUMAN)
MPMNVINTYM

SEQ ID NO: 96022 - protein, 10 aa, Artificial Sequence
  Description of Artificial Sequence: Synthetic peptide
  Seed: YTLDEKVDKL (MAGC3_HUMAN)
YQLDEKVDKL

SEQ ID NO: 96023 - protein, 11 aa, Artificial Sequence
  Description of Artificial Sequence: Synthetic peptide
  Seed: LPAVSPGKRLW (MAGC3_HUMAN)
LTAVSPGKRLF

SEQ ID NO: 96024 - protein, 8 aa, Artificial Sequence
  Description of Artificial Sequence: Synthetic peptide
  Seed: SAFPSWYM (MAGC3_HUMAN)
SSFPSWYW

SEQ ID NO: 96025 - protein, 9 aa, Artificial Sequence
  Description of Artificial Sequence: Synthetic peptide
  Seed: MIFGKAHEF (MAGC3_HUMAN)
MQFGKAHEI

SEQ ID NO: 96026 - protein, 9 aa, Artificial Sequence
  Description of Artificial Sequence: Synthetic peptide
  Seed: MQMNVINTY (MAGC3_HUMAN)
MAMNVINTM

SEQ ID NO: 96027 - protein, 9 aa, Artificial Sequence
  Description of Artificial Sequence: Synthetic peptide
  Seed: VIWEVLSAI (MAGC3_HUMAN)
VIWEVLSAA

SEQ ID NO: 96028 - protein, 10 aa, Artificial Sequence
  Description of Artificial Sequence: Synthetic peptide
  Seed: KAEMLTTVIK (MAGC3_HUMAN)
KLEMLTTVIK

SEQ ID NO: 96029 - protein, 9 aa, Artificial Sequence
  Description of Artificial Sequence: Synthetic peptide
  Seed: EVLEFLSKL (MAGC3_HUMAN)
EVLEFLSKF

SEQ ID NO: 96030 - protein, 9 aa, Artificial Sequence
  Description of Artificial Sequence: Synthetic peptide
  Seed: LILILSMIF (MAGC3_HUMAN)
LKLILSMIM

SEQ ID NO: 96031 - protein, 9 aa, Artificial Sequence
  Description of Artificial Sequence: Synthetic peptide
  Seed: IIPSAFPSW (MAGC3_HUMAN)
IGPSAFPSF

SEQ ID NO: 96032 - protein, 9 aa, Artificial Sequence
  Description of Artificial Sequence: Synthetic peptide
  Seed: NAIGPWSAL (MAGC3_HUMAN)
NMIGPWSAY

SEQ ID NO: 96033 - protein, 10 aa, Artificial Sequence
  Description of Artificial Sequence: Synthetic peptide
  Seed: ILILSMIFIK (MAGC3_HUMAN)
IVILSMIFIR

SEQ ID NO: 96034 - protein, 9 aa, Artificial Sequence
  Description of Artificial Sequence: Synthetic peptide
  Seed: FLSKLSSII (MAGC3_HUMAN)
FGSKLSSIF

SEQ ID NO: 96035 - protein, 9 aa, Artificial Sequence
  Description of Artificial Sequence: Synthetic peptide
  Seed: MIFGKAHEF (MAGC3_HUMAN)
MWFGKAHEW

SEQ ID NO: 96036 - protein, 9 aa, Artificial Sequence
  Description of Artificial Sequence: Synthetic peptide
  Seed: FLSKLSSII (MAGC3_HUMAN)
FQSKLSSIF

SEQ ID NO: 96037 - protein, 9 aa, Artificial Sequence
  Description of Artificial Sequence: Synthetic peptide
  Seed: FPSWYMDAL (MAGC3_HUMAN)
FHSWYMDAA

SEQ ID NO: 96038 - protein, 9 aa, Artificial Sequence
  Description of Artificial Sequence: Synthetic peptide
  Seed: EVLEFLSKL (MAGC3_HUMAN)
ETLEFLSKY

SEQ ID NO: 96039 - protein, 9 aa, Artificial Sequence
  Description of Artificial Sequence: Synthetic peptide
  Seed: ATDKDYSAF (MAGC3_HUMAN)
AYDKDYSAM

SEQ ID NO: 96040 - protein, 10 aa, Artificial Sequence
  Description of Artificial Sequence: Synthetic peptide
  Seed: EKVAELVQFL (MAGC3_HUMAN)
EFVAELVQFI

SEQ ID NO: 96041 - protein, 9 aa, Artificial Sequence
  Description of Artificial Sequence: Synthetic peptide
  Seed: TKAEMLTTV (MAGC3_HUMAN)
TIAEMLTTI

SEQ ID NO: 96042 - protein, 9 aa, Artificial Sequence
  Description of Artificial Sequence: Synthetic peptide
  Seed: LIDDQGMPK (MAGC3_HUMAN)
LQDDQGMPM

SEQ ID NO: 96043 - protein, 11 aa, Artificial Sequence
  Description of Artificial Sequence: Synthetic peptide
  Seed: LDSCSSPLLWT (MAGC3_HUMAN)
LTSCSSPLLWF

SEQ ID NO: 96044 - protein, 10 aa, Artificial Sequence
  Description of Artificial Sequence: Synthetic peptide
  Seed: YTLDEKVDKL (MAGC3_HUMAN)
YALDEKVDKM

SEQ ID NO: 96045 - protein, 9 aa, Artificial Sequence
  Description of Artificial Sequence: Synthetic peptide
  Seed: GFADVLSRL (MAGC3_HUMAN)
GTADVLSRM

SEQ ID NO: 96046 - protein, 10 aa, Artificial Sequence
  Description of Artificial Sequence: Synthetic peptide
  Seed: SKLSSIIPSA (MAGC3_HUMAN)
SILSSIIPSM

SEQ ID NO: 96047 - protein, 9 aa, Artificial Sequence
  Description of Artificial Sequence: Synthetic peptide
  Seed: AMASASPSV (MAGC3_HUMAN)
AMASASPSI

SEQ ID NO: 96048 - protein, 9 aa, Artificial Sequence
  Description of Artificial Sequence: Synthetic peptide
  Seed: ALAGFADVL (MAGC3_HUMAN)
AQAGFADVL

SEQ ID NO: 96049 - protein, 9 aa, Artificial Sequence
  Description of Artificial Sequence: Synthetic peptide
  Seed: KVDKLVQFL (MAGC3_HUMAN)
KADKLVQFY

SEQ ID NO: 96050 - protein, 9 aa, Artificial Sequence
  Description of Artificial Sequence: Synthetic peptide
  Seed: SAEGSVLDL (MAGC3_HUMAN)
SSEGSVLDL

SEQ ID NO: 96051 - protein, 9 aa, Artificial Sequence
  Description of Artificial Sequence: Synthetic peptide
  Seed: ATYALSPVV (MAGC3_HUMAN)
AMYALSPVR

SEQ ID NO: 96052 - protein, 10 aa, Artificial Sequence
  Description of Artificial Sequence: Synthetic peptide
  Seed: MPAAGMPPLP (MAGC3_HUMAN)
MWAAGMPPLY

SEQ ID NO: 96053 - protein, 9 aa, Artificial Sequence
  Description of Artificial Sequence: Synthetic peptide
  Seed: IPPQGPPKI (MAGC3_HUMAN)
IRPQGPPKY

SEQ ID NO: 96054 - protein, 9 aa, Artificial Sequence
  Description of Artificial Sequence: Synthetic peptide
  Seed: YFFEDTLDL (MAGC3_HUMAN)
YMFEDTLDT

SEQ ID NO: 96055 - protein, 11 aa, Artificial Sequence
  Description of Artificial Sequence: Synthetic peptide
  Seed: MPAAGMPPLPQ (MAGC3_HUMAN)
MPAAGMPPLPL

SEQ ID NO: 96056 - protein, 10 aa, Artificial Sequence
  Description of Artificial Sequence: Synthetic peptide
  Seed: KKYKDYFPMI (MAGC3_HUMAN)
KTYKDYFPMF

SEQ ID NO: 96057 - protein, 10 aa, Artificial Sequence
  Description of Artificial Sequence: Synthetic peptide
  Seed: EPQDWPLNEK (MAGC3_HUMAN)
EAQDWPLNER

SEQ ID NO: 96058 - protein, 10 aa, Artificial Sequence
  Description of Artificial Sequence: Synthetic peptide
  Seed: SIIPSAFPSW (MAGC3_HUMAN)
SSIPSAFPSF

SEQ ID NO: 96059 - protein, 9 aa, Artificial Sequence
  Description of Artificial Sequence: Synthetic peptide
  Seed: SASPSVMST (MAGC3_HUMAN)
SGSPSVMSV

SEQ ID NO: 96060 - protein, 10 aa, Artificial Sequence
  Description of Artificial Sequence: Synthetic peptide
  Seed: YALSPVVLPP (MAGC3_HUMAN)
YTLSPVVLPM

SEQ ID NO: 96061 - protein, 10 aa, Artificial Sequence
  Description of Artificial Sequence: Synthetic peptide
  Seed: FPSWYMDALK (MAGC3_HUMAN)
FWSWYMDALK

SEQ ID NO: 96062 - protein, 9 aa, Artificial Sequence
  Description of Artificial Sequence: Synthetic peptide
  Seed: KAHEFIELI (MAGC3_HUMAN)
KMHEFIELM

SEQ ID NO: 96063 - protein, 10 aa, Artificial Sequence
  Description of Artificial Sequence: Synthetic peptide
  Seed: MNVINTYTGY (MAGC3_HUMAN)
MLVINTYTGF

SEQ ID NO: 96064 - protein, 9 aa, Artificial Sequence
  Description of Artificial Sequence: Synthetic peptide
  Seed: YKDYFPMIF (MAGC3_HUMAN)
YTDYFPMIM

SEQ ID NO: 96065 - protein, 9 aa, Artificial Sequence
  Description of Artificial Sequence: Synthetic peptide
  Seed: ATYALSPVV (MAGC3_HUMAN)
ALYALSPVR

SEQ ID NO: 96066 - protein, 9 aa, Artificial Sequence
  Description of Artificial Sequence: Synthetic peptide
  Seed: WESEGPEAF (MAGC3_HUMAN)
WHSEGPEAI

SEQ ID NO: 96067 - protein, 9 aa, Artificial Sequence
  Description of Artificial Sequence: Synthetic peptide
  Seed: MIFGKAHEF (MAGC3_HUMAN)
MKFGKAHEF

SEQ ID NO: 96068 - protein, 9 aa, Artificial Sequence
  Description of Artificial Sequence: Synthetic peptide
  Seed: MIFGKAHEF (MAGC3_HUMAN)
MPFGKAHEY

SEQ ID NO: 96069 - protein, 9 aa, Artificial Sequence
  Description of Artificial Sequence: Synthetic peptide
  Seed: MIFRKAREF (MAGC3_HUMAN)
MPFRKAREM

SEQ ID NO: 96070 - protein, 10 aa, Artificial Sequence
  Description of Artificial Sequence: Synthetic peptide
  Seed: WRTLSGSPGL (MAGC3_HUMAN)
WHTLSGSPGL

SEQ ID NO: 96071 - protein, 9 aa, Artificial Sequence
  Description of Artificial Sequence: Synthetic peptide
  Seed: ISPQGPPQS (MAGC3_HUMAN)
IIPQGPPQL

SEQ ID NO: 96072 - protein, 9 aa, Artificial Sequence
  Description of Artificial Sequence: Synthetic peptide
  Seed: ISPQGPPQS (MAGC3_HUMAN)
IAPQGPPQV

SEQ ID NO: 96073 - protein, 9 aa, Artificial Sequence
  Description of Artificial Sequence: Synthetic peptide
  Seed: KDMEDRAQA (MAGC3_HUMAN)
KDMEDRAQL

SEQ ID NO: 96074 - protein, 9 aa, Artificial Sequence
  Description of Artificial Sequence: Synthetic peptide
  Seed: ELVQFLLLK (MAGC3_HUMAN)
EIVQFLLLK

SEQ ID NO: 96075 - protein, 10 aa, Artificial Sequence
  Description of Artificial Sequence: Synthetic peptide
  Seed: SALAGFADVL (MAGC3_HUMAN)
SPLAGFADVL

SEQ ID NO: 96076 - protein, 9 aa, Artificial Sequence
  Description of Artificial Sequence: Synthetic peptide
  Seed: KLVQFLLLK (MAGC3_HUMAN)
KIVQFLLLK

SEQ ID NO: 96077 - protein, 11 aa, Artificial Sequence
  Description of Artificial Sequence: Synthetic peptide
  Seed: IIDTTDDATAM (MAGC3_HUMAN)
IVDTTDDATAI

SEQ ID NO: 96078 - protein, 8 aa, Artificial Sequence
  Description of Artificial Sequence: Synthetic peptide
  Seed: KAHEFIEL (MAGC3_HUMAN)
KYHEFIEY

SEQ ID NO: 96079 - protein, 10 aa, Artificial Sequence
  Description of Artificial Sequence: Synthetic peptide
  Seed: GSLPESEPLF (MAGC3_HUMAN)
GVLPESEPLW

SEQ ID NO: 96080 - protein, 9 aa, Artificial Sequence
  Description of Artificial Sequence: Synthetic peptide
  Seed: KKYKDYFPM (MAGC3_HUMAN)
KQYKDYFPV

SEQ ID NO: 96081 - protein, 9 aa, Artificial Sequence
  Description of Artificial Sequence: Synthetic peptide
  Seed: MPAAGMPPL (MAGC3_HUMAN)
MMAAGMPPL

SEQ ID NO: 96082 - protein, 9 aa, Artificial Sequence
  Description of Artificial Sequence: Synthetic peptide
  Seed: ATDKDYSAF (MAGC3_HUMAN)
AFDKDYSAF

SEQ ID NO: 96083 - protein, 10 aa, Artificial Sequence
  Description of Artificial Sequence: Synthetic peptide
  Seed: LNAIGPWSAL (MAGC3_HUMAN)
LTAIGPWSAM

SEQ ID NO: 96084 - protein, 8 aa, Artificial Sequence
  Description of Artificial Sequence: Synthetic peptide
  Seed: IFGKAHEF (MAGC3_HUMAN)
IAGKAHEW

SEQ ID NO: 96085 - protein, 10 aa, Artificial Sequence
  Description of Artificial Sequence: Synthetic peptide
  Seed: ILFGISLTEV (MAGC3_HUMAN)
ISFGISLTEV

SEQ ID NO: 96086 - protein, 10 aa, Artificial Sequence
  Description of Artificial Sequence: Synthetic peptide
  Seed: KKYKDYFPMI (MAGC3_HUMAN)
KAYKDYFPMK

SEQ ID NO: 96087 - protein, 9 aa, Artificial Sequence
  Description of Artificial Sequence: Synthetic peptide
  Seed: KAHEFIELI (MAGC3_HUMAN)
KGHEFIELL

SEQ ID NO: 96088 - protein, 10 aa, Artificial Sequence
  Description of Artificial Sequence: Synthetic peptide
  Seed: INTYTGYFPM (MAGC3_HUMAN)
IPTYTGYFPW

SEQ ID NO: 96089 - protein, 10 aa, Artificial Sequence
  Description of Artificial Sequence: Synthetic peptide
  Seed: VVLPPQPQPR (MAGC3_HUMAN)
VILPPQPQPY

SEQ ID NO: 96090 - protein, 10 aa, Artificial Sequence
  Description of Artificial Sequence: Synthetic peptide
  Seed: EEVIWEVLSA (MAGC3_HUMAN)
ESVIWEVLSV

SEQ ID NO: 96091 - protein, 9 aa, Artificial Sequence
  Description of Artificial Sequence: Synthetic peptide
  Seed: LVLCPTYFK (MAGC3_HUMAN)
LLLCPTYFR

SEQ ID NO: 96092 - protein, 9 aa, Artificial Sequence
  Description of Artificial Sequence: Synthetic peptide
  Seed: VIWEVLSAI (MAGC3_HUMAN)
VMWEVLSAM

SEQ ID NO: 96093 - protein, 10 aa, Artificial Sequence
  Description of Artificial Sequence: Synthetic peptide
  Seed: ASPSVMSTNF (MAGC3_HUMAN)
AQPSVMSTNF

SEQ ID NO: 96094 - protein, 9 aa, Artificial Sequence
  Description of Artificial Sequence: Synthetic peptide
  Seed: HALPESESL (MAGC3_HUMAN)
HGLPESESY

SEQ ID NO: 96095 - protein, 9 aa, Artificial Sequence
  Description of Artificial Sequence: Synthetic peptide
  Seed: WESEGPEAF (MAGC3_HUMAN)
WHSEGPEAL

SEQ ID NO: 96096 - protein, 10 aa, Artificial Sequence
  Description of Artificial Sequence: Synthetic peptide
  Seed: YALDEKVAEL (MAGC3_HUMAN)
YLLDEKVAEC

SEQ ID NO: 96097 - protein, 9 aa, Artificial Sequence
  Description of Artificial Sequence: Synthetic peptide
  Seed: FGSQPEGKF (MAGC3_HUMAN)
FASQPEGKM

SEQ ID NO: 96098 - protein, 9 aa, Artificial Sequence
  Description of Artificial Sequence: Synthetic peptide
  Seed: KEPVTKAEM (MAGC3_HUMAN)
KRPVTKAEL

SEQ ID NO: 96099 - protein, 10 aa, Artificial Sequence
  Description of Artificial Sequence: Synthetic peptide
  Seed: SDQRMDSLVL (MAGC3_HUMAN)
SCQRMDSLVY

SEQ ID NO: 96100 - protein, 10 aa, Artificial Sequence
  Description of Artificial Sequence: Synthetic peptide
  Seed: VLNAIGPWSA (MAGC3_HUMAN)
VLNAIGPWSL

SEQ ID NO: 96101 - protein, 9 aa, Artificial Sequence
  Description of Artificial Sequence: Synthetic peptide
  Seed: WEVLNAIGP (MAGC3_HUMAN)
WEVLNAIGV

SEQ ID NO: 96102 - protein, 9 aa, Artificial Sequence
  Description of Artificial Sequence: Synthetic peptide
  Seed: MEDRAQAII (MAGC3_HUMAN)
MGDRAQAIF

SEQ ID NO: 96103 - protein, 9 aa, Artificial Sequence
  Description of Artificial Sequence: Synthetic peptide
  Seed: YFFEDTLDL (MAGC3_HUMAN)
YQFEDTLDI

SEQ ID NO: 96104 - protein, 10 aa, Artificial Sequence
  Description of Artificial Sequence: Synthetic peptide
  Seed: KAHEFIELIF (MAGC3_HUMAN)
KMHEFIELIF

SEQ ID NO: 96105 - protein, 9 aa, Artificial Sequence
  Description of Artificial Sequence: Synthetic peptide
  Seed: EVLEFLSKL (MAGC3_HUMAN)
EILEFLSKV

SEQ ID NO: 96106 - protein, 9 aa, Artificial Sequence
  Description of Artificial Sequence: Synthetic peptide
  Seed: MASASPSVM (MAGC3_HUMAN)
MPSASPSVL

SEQ ID NO: 96107 - protein, 9 aa, Artificial Sequence
  Description of Artificial Sequence: Synthetic peptide
  Seed: IPPQGPPKI (MAGC3_HUMAN)
ISPQGPPKV

SEQ ID NO: 96108 - protein, 9 aa, Artificial Sequence
  Description of Artificial Sequence: Synthetic peptide
  Seed: LTDMDPDNH (MAGC3_HUMAN)
LVDMDPDNY

SEQ ID NO: 96109 - protein, 9 aa, Artificial Sequence
  Description of Artificial Sequence: Synthetic peptide
  Seed: YTGYFPMIF (MAGC3_HUMAN)
YPGYFPMIH

SEQ ID NO: 96110 - protein, 9 aa, Artificial Sequence
  Description of Artificial Sequence: Synthetic peptide
  Seed: VDPDHFYVF (MAGC3_HUMAN)
VGPDHFYVL

SEQ ID NO: 96111 - protein, 10 aa, Artificial Sequence
  Description of Artificial Sequence: Synthetic peptide
  Seed: ATYALSPVVL (MAGC3_HUMAN)
ASYALSPVVF

SEQ ID NO: 96112 - protein, 9 aa, Artificial Sequence
  Description of Artificial Sequence: Synthetic peptide
  Seed: AELVQFLLL (MAGC3_HUMAN)
AELVQFLLF

SEQ ID NO: 96113 - protein, 11 aa, Artificial Sequence
  Description of Artificial Sequence: Synthetic peptide
  Seed: VIKKYKDYFPM (MAGC3_HUMAN)
VQKKYKDYFPF

SEQ ID NO: 96114 - protein, 10 aa, Artificial Sequence
  Description of Artificial Sequence: Synthetic peptide
  Seed: KYKDYFPMIF (MAGC3_HUMAN)
KQKDYFPMIY

SEQ ID NO: 96115 - protein, 10 aa, Artificial Sequence
  Description of Artificial Sequence: Synthetic peptide
  Seed: YALSPVVLPP (MAGC3_HUMAN)
YSLSPVVLPA

SEQ ID NO: 96116 - protein, 9 aa, Artificial Sequence
  Description of Artificial Sequence: Synthetic peptide
  Seed: ATYALSPVV (MAGC3_HUMAN)
ASYALSPVL

SEQ ID NO: 96117 - protein, 10 aa, Artificial Sequence
  Description of Artificial Sequence: Synthetic peptide
  Seed: IELIFGIALT (MAGC3_HUMAN)
IGLIFGIALV

SEQ ID NO: 96118 - protein, 9 aa, Artificial Sequence
  Description of Artificial Sequence: Synthetic peptide
  Seed: KAEMLTTVI (MAGC3_HUMAN)
KAEMLTTVY

SEQ ID NO: 96119 - protein, 9 aa, Artificial Sequence
  Description of Artificial Sequence: Synthetic peptide
  Seed: AGFADVLSR (MAGC3_HUMAN)
ANFADVLSK

SEQ ID NO: 96120 - protein, 9 aa, Artificial Sequence
  Description of Artificial Sequence: Synthetic peptide
  Seed: FHLGHLREV (MAGC3_HUMAN)
FLLGHLREL

SEQ ID NO: 96121 - protein, 10 aa, Artificial Sequence
  Description of Artificial Sequence: Synthetic peptide
  Seed: GEDEDMPAAG (MAGC3_HUMAN)
GEDEDMPAAV

SEQ ID NO: 96122 - protein, 9 aa, Artificial Sequence
  Description of Artificial Sequence: Synthetic peptide
  Seed: MDPDNHSYF (MAGC3_HUMAN)
MLPDNHSYY

SEQ ID NO: 96123 - protein, 9 aa, Artificial Sequence
  Description of Artificial Sequence: Synthetic peptide
  Seed: MQMNVINTY (MAGC3_HUMAN)
MVMNVINTW

SEQ ID NO: 96124 - protein, 10 aa, Artificial Sequence
  Description of Artificial Sequence: Synthetic peptide
  Seed: TLWKDSDLPT (MAGC3_HUMAN)
TMWKDSDLPL

SEQ ID NO: 96125 - protein, 9 aa, Artificial Sequence
  Description of Artificial Sequence: Synthetic peptide
  Seed: EIPPQGPPK (MAGC3_HUMAN)
EAPPQGPPK

SEQ ID NO: 96126 - protein, 9 aa, Artificial Sequence
  Description of Artificial Sequence: Synthetic peptide
  Seed: DGSLGQWVK (MAGC3_HUMAN)
DYSLGQWVR

SEQ ID NO: 96127 - protein, 9 aa, Artificial Sequence
  Description of Artificial Sequence: Synthetic peptide
  Seed: MLLPCHWVL (MAGC3_HUMAN)
MALPCHWVW

SEQ ID NO: 96128 - protein, 9 aa, Artificial Sequence
  Description of Artificial Sequence: Synthetic peptide
  Seed: EVLSAIGPI (MAGC3_HUMAN)
EALSAIGPR

SEQ ID NO: 96129 - protein, 10 aa, Artificial Sequence
  Description of Artificial Sequence: Synthetic peptide
  Seed: SIIPSAFPSW (MAGC3_HUMAN)
SKIPSAFPSY

SEQ ID NO: 96130 - protein, 10 aa, Artificial Sequence
  Description of Artificial Sequence: Synthetic peptide
  Seed: TTDDATAMAS (MAGC3_HUMAN)
TQDDATAMAF

SEQ ID NO: 96131 - protein, 9 aa, Artificial Sequence
  Description of Artificial Sequence: Synthetic peptide
  Seed: LVLCPTYFK (MAGC3_HUMAN)
LSLCPTYFR

SEQ ID NO: 96132 - protein, 10 aa, Artificial Sequence
  Description of Artificial Sequence: Synthetic peptide
  Seed: SLPAVSPGKR (MAGC3_HUMAN)
SVPAVSPGKR

SEQ ID NO: 96133 - protein, 10 aa, Artificial Sequence
  Description of Artificial Sequence: Synthetic peptide
  Seed: KLSSIIPSAF (MAGC3_HUMAN)
KQSSIIPSAY

SEQ ID NO: 96134 - protein, 10 aa, Artificial Sequence
  Description of Artificial Sequence: Synthetic peptide
  Seed: EKVAELVQFL (MAGC3_HUMAN)
ERVAELVQFV

SEQ ID NO: 96135 - protein, 9 aa, Artificial Sequence
  Description of Artificial Sequence: Synthetic peptide
  Seed: EVLNAIGPW (MAGC3_HUMAN)
EVLNAIGPF

SEQ ID NO: 96136 - protein, 9 aa, Artificial Sequence
  Description of Artificial Sequence: Synthetic peptide
  Seed: VINTYTGYF (MAGC3_HUMAN)
VANTYTGYL

SEQ ID NO: 96137 - protein, 9 aa, Artificial Sequence
  Description of Artificial Sequence: Synthetic peptide
  Seed: DMDPDNHSY (MAGC3_HUMAN)
DVDPDNHSI

SEQ ID NO: 96138 - protein, 10 aa, Artificial Sequence
  Description of Artificial Sequence: Synthetic peptide
  Seed: FADVLSRLAL (MAGC3_HUMAN)
FTDVLSRLAY

SEQ ID NO: 96139 - protein, 10 aa, Artificial Sequence
  Description of Artificial Sequence: Synthetic peptide
  Seed: MNVINTYTGY (MAGC3_HUMAN)
MGVINTYTGK

SEQ ID NO: 96140 - protein, 9 aa, Artificial Sequence
  Description of Artificial Sequence: Synthetic peptide
  Seed: CATYALSPV (MAGC3_HUMAN)
CQTYALSPI

SEQ ID NO: 96141 - protein, 9 aa, Artificial Sequence
  Description of Artificial Sequence: Synthetic peptide
  Seed: MIFRKAREF (MAGC3_HUMAN)
MTFRKAREY

SEQ ID NO: 96142 - protein, 9 aa, Artificial Sequence
  Description of Artificial Sequence: Synthetic peptide
  Seed: YTGYFPMIF (MAGC3_HUMAN)
YMGYFPMIY

SEQ ID NO: 96143 - protein, 9 aa, Artificial Sequence
  Description of Artificial Sequence: Synthetic peptide
  Seed: NVINTYTGY (MAGC3_HUMAN)
NPINTYTGF

SEQ ID NO: 96144 - protein, 9 aa, Artificial Sequence
  Description of Artificial Sequence: Synthetic peptide
  Seed: AEGSVLDLA (MAGC3_HUMAN)
AEGSVLDLM

SEQ ID NO: 96145 - protein, 11 aa, Artificial Sequence
  Description of Artificial Sequence: Synthetic peptide
  Seed: RTLSGSPGLQL (MAGC3_HUMAN)
RVLSGSPGLQL

SEQ ID NO: 96146 - protein, 10 aa, Artificial Sequence
  Description of Artificial Sequence: Synthetic peptide
  Seed: AELVQFLLLK (MAGC3_HUMAN)
ATLVQFLLLR

SEQ ID NO: 96147 - protein, 9 aa, Artificial Sequence
  Description of Artificial Sequence: Synthetic peptide
  Seed: YQAKEPLTR (MAGC3_HUMAN)
YSAKEPLTR

SEQ ID NO: 96148 - protein, 9 aa, Artificial Sequence
  Description of Artificial Sequence: Synthetic peptide
  Seed: NTYTGYFPM (MAGC3_HUMAN)
NLYTGYFPC

SEQ ID NO: 96149 - protein, 9 aa, Artificial Sequence
  Description of Artificial Sequence: Synthetic peptide
  Seed: EMLTTVIKK (MAGC3_HUMAN)
EFLTTVIKR

SEQ ID NO: 96150 - protein, 11 aa, Artificial Sequence
  Description of Artificial Sequence: Synthetic peptide
  Seed: RMDSLVLCPTY (MAGC3_HUMAN)
RTDSLVLCPTY

SEQ ID NO: 96151 - protein, 10 aa, Artificial Sequence
  Description of Artificial Sequence: Synthetic peptide
  Seed: TGYFPMIFRK (MAGC3_HUMAN)
TTYFPMIFRV

SEQ ID NO: 96152 - protein, 9 aa, Artificial Sequence
  Description of Artificial Sequence: Synthetic peptide
  Seed: ALSPVVLPP (MAGC3_HUMAN)
AMSPVVLPL

SEQ ID NO: 96153 - protein, 10 aa, Artificial Sequence
  Description of Artificial Sequence: Synthetic peptide
  Seed: SAIGPIQRPA (MAGC3_HUMAN)
SAIGPIQRPY

SEQ ID NO: 96154 - protein, 10 aa, Artificial Sequence
  Description of Artificial Sequence: Synthetic peptide
  Seed: MLTTVIKKYK (MAGC3_HUMAN)
METTVIKKYR

SEQ ID NO: 96155 - protein, 10 aa, Artificial Sequence
  Description of Artificial Sequence: Synthetic peptide
  Seed: WVKNTCATYA (MAGC3_HUMAN)
WMKNTCATYM

SEQ ID NO: 96156 - protein, 9 aa, Artificial Sequence
  Description of Artificial Sequence: Synthetic peptide
  Seed: CATYALSPV (MAGC3_HUMAN)
CLTYALSPL

SEQ ID NO: 96157 - protein, 9 aa, Artificial Sequence
  Description of Artificial Sequence: Synthetic peptide
  Seed: IIPSAFPSW (MAGC3_HUMAN)
IYPSAFPSL

SEQ ID NO: 96158 - protein, 9 aa, Artificial Sequence
  Description of Artificial Sequence: Synthetic peptide
  Seed: MIFGKAHEF (MAGC3_HUMAN)
MEFGKAHEV

SEQ ID NO: 96159 - protein, 10 aa, Artificial Sequence
  Description of Artificial Sequence: Synthetic peptide
  Seed: MQMNVINTYT (MAGC3_HUMAN)
MHMNVINTYV

SEQ ID NO: 96160 - protein, 9 aa, Artificial Sequence
  Description of Artificial Sequence: Synthetic peptide
  Seed: ELVQFLLLK (MAGC3_HUMAN)
EYVQFLLLR

SEQ ID NO: 96161 - protein, 9 aa, Artificial Sequence
  Description of Artificial Sequence: Synthetic peptide
  Seed: FEDTLDLTY (MAGC3_HUMAN)
FTDTLDLTL

SEQ ID NO: 96162 - protein, 9 aa, Artificial Sequence
  Description of Artificial Sequence: Synthetic peptide
  Seed: ELIFGIALT (MAGC3_HUMAN)
ETIFGIALT

SEQ ID NO: 96163 - protein, 9 aa, Artificial Sequence
  Description of Artificial Sequence: Synthetic peptide
  Seed: EVLEFLSKL (MAGC3_HUMAN)
EVLEFLSKM

SEQ ID NO: 96164 - protein, 8 aa, Artificial Sequence
  Description of Artificial Sequence: Synthetic peptide
  Seed: FADVLSRL (MAGC3_HUMAN)
FSDVLSRL

SEQ ID NO: 96165 - protein, 8 aa, Artificial Sequence
  Description of Artificial Sequence: Synthetic peptide
  Seed: QSPPQSPL (MAGC3_HUMAN)
QAPPQSPL

SEQ ID NO: 96166 - protein, 9 aa, Artificial Sequence
  Description of Artificial Sequence: Synthetic peptide
  Seed: IIDTTDDAT (MAGC3_HUMAN)
IGDTTDDAI

SEQ ID NO: 96167 - protein, 9 aa, Artificial Sequence
  Description of Artificial Sequence: Synthetic peptide
  Seed: AEMQMNVIN (MAGC3_HUMAN)
AEMQMNVIF

SEQ ID NO: 96168 - protein, 10 aa, Artificial Sequence
  Description of Artificial Sequence: Synthetic peptide
  Seed: KDYFPMIFGK (MAGC3_HUMAN)
KVYFPMIFGK

SEQ ID NO: 96169 - protein, 10 aa, Artificial Sequence
  Description of Artificial Sequence: Synthetic peptide
  Seed: KYKDYFPMIF (MAGC3_HUMAN)
KLKDYFPMIY

SEQ ID NO: 96170 - protein, 11 aa, Artificial Sequence
  Description of Artificial Sequence: Synthetic peptide
  Seed: LSKLSSIIPSA (MAGC3_HUMAN)
LRKLSSIIPSV

SEQ ID NO: 96171 - protein, 10 aa, Artificial Sequence
  Description of Artificial Sequence: Synthetic peptide
  Seed: VLDLANPQGL (MAGC3_HUMAN)
VSDLANPQGF

SEQ ID NO: 96172 - protein, 10 aa, Artificial Sequence
  Description of Artificial Sequence: Synthetic peptide
  Seed: KVAELVQFLL (MAGC3_HUMAN)
KSAELVQFLW

SEQ ID NO: 96173 - protein, 9 aa, Artificial Sequence
  Description of Artificial Sequence: Synthetic peptide
  Seed: AGFADVLSR (MAGC3_HUMAN)
ATFADVLSM

SEQ ID NO: 96174 - protein, 9 aa, Artificial Sequence
  Description of Artificial Sequence: Synthetic peptide
  Seed: KKYKDYFPM (MAGC3_HUMAN)
KEYKDYFPF

SEQ ID NO: 96175 - protein, 10 aa, Artificial Sequence
  Description of Artificial Sequence: Synthetic peptide
  Seed: KDYFPMIFGK (MAGC3_HUMAN)
KYYFPMIFGK

SEQ ID NO: 96176 - protein, 10 aa, Artificial Sequence
  Description of Artificial Sequence: Synthetic peptide
  Seed: RMDSLVLCPT (MAGC3_HUMAN)
RLDSLVLCPM

SEQ ID NO: 96177 - protein, 9 aa, Artificial Sequence
  Description of Artificial Sequence: Synthetic peptide
  Seed: TEASPQQKK (MAGC3_HUMAN)
TTASPQQKY

SEQ ID NO: 96178 - protein, 9 aa, Artificial Sequence
  Description of Artificial Sequence: Synthetic peptide
  Seed: YSAFHLGHL (MAGC3_HUMAN)
YIAFHLGHW

SEQ ID NO: 96179 - protein, 9 aa, Artificial Sequence
  Description of Artificial Sequence: Synthetic peptide
  Seed: EKVDKLVQF (MAGC3_HUMAN)
ERVDKLVQI

SEQ ID NO: 96180 - protein, 9 aa, Artificial Sequence
  Description of Artificial Sequence: Synthetic peptide
  Seed: MIFGKAHEF (MAGC3_HUMAN)
MEFGKAHEI

SEQ ID NO: 96181 - protein, 9 aa, Artificial Sequence
  Description of Artificial Sequence: Synthetic peptide
  Seed: LKYQTKEPV (MAGC3_HUMAN)
LEYQTKEPF

SEQ ID NO: 96182 - protein, 11 aa, Artificial Sequence
  Description of Artificial Sequence: Synthetic peptide
  Seed: TAMASASPSVM (MAGC3_HUMAN)
TIMASASPSVF

SEQ ID NO: 96183 - protein, 9 aa, Artificial Sequence
  Description of Artificial Sequence: Synthetic peptide
  Seed: KAHEFIELI (MAGC3_HUMAN)
KRHEFIELM

SEQ ID NO: 96184 - protein, 10 aa, Artificial Sequence
  Description of Artificial Sequence: Synthetic peptide
  Seed: TGYFPMIFRK (MAGC3_HUMAN)
TTYFPMIFRF

SEQ ID NO: 96185 - protein, 10 aa, Artificial Sequence
  Description of Artificial Sequence: Synthetic peptide
  Seed: MQMNVINTYT (MAGC3_HUMAN)
MQMNVINTYQ

SEQ ID NO: 96186 - protein, 10 aa, Artificial Sequence
  Description of Artificial Sequence: Synthetic peptide
  Seed: TGYFPMIFRK (MAGC3_HUMAN)
TVYFPMIFRS

SEQ ID NO: 96187 - protein, 9 aa, Artificial Sequence
  Description of Artificial Sequence: Synthetic peptide
  Seed: LSSIIPSAF (MAGC3_HUMAN)
LPSIIPSAV

SEQ ID NO: 96188 - protein, 9 aa, Artificial Sequence
  Description of Artificial Sequence: Synthetic peptide
  Seed: SPLDSCSSP (MAGC3_HUMAN)
SPLDSCSSV

SEQ ID NO: 96189 - protein, 9 aa, Artificial Sequence
  Description of Artificial Sequence: Synthetic peptide
  Seed: TLDEKVDKL (MAGC3_HUMAN)
TCDEKVDKI

SEQ ID NO: 96190 - protein, 10 aa, Artificial Sequence
  Description of Artificial Sequence: Synthetic peptide
  Seed: YALDEKVAEL (MAGC3_HUMAN)
YWLDEKVAEY

SEQ ID NO: 96191 - protein, 9 aa, Artificial Sequence
  Description of Artificial Sequence: Synthetic peptide
  Seed: TGYFPMIFR (MAGC3_HUMAN)
TPYFPMIFR

SEQ ID NO: 96192 - protein, 9 aa, Artificial Sequence
  Description of Artificial Sequence: Synthetic peptide
  Seed: MPAAGMPPL (MAGC3_HUMAN)
MLAAGMPPI

SEQ ID NO: 96193 - protein, 9 aa, Artificial Sequence
  Description of Artificial Sequence: Synthetic peptide
  Seed: MIFIKGSCV (MAGC3_HUMAN)
MAFIKGSCM

SEQ ID NO: 96194 - protein, 11 aa, Artificial Sequence
  Description of Artificial Sequence: Synthetic peptide
  Seed: ILFGISLTEVD (MAGC3_HUMAN)
IMFGISLTEVL

SEQ ID NO: 96195 - protein, 9 aa, Artificial Sequence
  Description of Artificial Sequence: Synthetic peptide
  Seed: ASEEVIWEV (MAGC3_HUMAN)
ASEEVIWEM

SEQ ID NO: 96196 - protein, 9 aa, Artificial Sequence
  Description of Artificial Sequence: Synthetic peptide
  Seed: MLTTVIKKY (MAGC3_HUMAN)
MMTTVIKKW

SEQ ID NO: 96197 - protein, 9 aa, Artificial Sequence
  Description of Artificial Sequence: Synthetic peptide
  Seed: LKYQAKEPL (MAGC3_HUMAN)
LQYQAKEPI

SEQ ID NO: 96198 - protein, 11 aa, Artificial Sequence
  Description of Artificial Sequence: Synthetic peptide
  Seed: YALDEKVAELV (MAGC3_HUMAN)
YLLDEKVAELI

SEQ ID NO: 96199 - protein, 9 aa, Artificial Sequence
  Description of Artificial Sequence: Synthetic peptide
  Seed: TLDEKVDKL (MAGC3_HUMAN)
TMDEKVDKV

SEQ ID NO: 96200 - protein, 9 aa, Artificial Sequence
  Description of Artificial Sequence: Synthetic peptide
  Seed: ALDEKVAEL (MAGC3_HUMAN)
AKDEKVAEL

SEQ ID NO: 96201 - protein, 9 aa, Artificial Sequence
  Description of Artificial Sequence: Synthetic peptide
  Seed: MIFGKAHEF (MAGC3_HUMAN)
MNFGKAHEL

SEQ ID NO: 96202 - protein, 9 aa, Artificial Sequence
  Description of Artificial Sequence: Synthetic peptide
  Seed: KAEMLTTVI (MAGC3_HUMAN)
KQEMLTTVI

SEQ ID NO: 96203 - protein, 11 aa, Artificial Sequence
  Description of Artificial Sequence: Synthetic peptide
  Seed: KYKDYFPMIFG (MAGC3_HUMAN)
KYKDYFPMIFI

SEQ ID NO: 96204 - protein, 10 aa, Artificial Sequence
  Description of Artificial Sequence: Synthetic peptide
  Seed: YTLDEKVDKL (MAGC3_HUMAN)
YKLDEKVDKV

SEQ ID NO: 96205 - protein, 10 aa, Artificial Sequence
  Description of Artificial Sequence: Synthetic peptide
  Seed: MQMNVINTYT (MAGC3_HUMAN)
MEMNVINTYI

SEQ ID NO: 96206 - protein, 9 aa, Artificial Sequence
  Description of Artificial Sequence: Synthetic peptide
  Seed: ATYALSPVV (MAGC3_HUMAN)
AAYALSPVM

SEQ ID NO: 96207 - protein, 11 aa, Artificial Sequence
  Description of Artificial Sequence: Synthetic peptide
  Seed: KVAELVQFLLL (MAGC3_HUMAN)
KLAELVQFLLT

SEQ ID NO: 96208 - protein, 9 aa, Artificial Sequence
  Description of Artificial Sequence: Synthetic peptide
  Seed: MQMNVINTY (MAGC3_HUMAN)
MMMNVINTR

SEQ ID NO: 96209 - protein, 10 aa, Artificial Sequence
  Description of Artificial Sequence: Synthetic peptide
  Seed: MQMNVINTYT (MAGC3_HUMAN)
MKMNVINTYV

SEQ ID NO: 96210 - protein, 9 aa, Artificial Sequence
  Description of Artificial Sequence: Synthetic peptide
  Seed: FLSKLSSII (MAGC3_HUMAN)
FMSKLSSIY

SEQ ID NO: 96211 - protein, 9 aa, Artificial Sequence
  Description of Artificial Sequence: Synthetic peptide
  Seed: FADVLSRLA (MAGC3_HUMAN)
FLDVLSRLI

SEQ ID NO: 96212 - protein, 9 aa, Artificial Sequence
  Description of Artificial Sequence: Synthetic peptide
  Seed: MPAAGMPPL (MAGC3_HUMAN)
MYAAGMPPV

SEQ ID NO: 96213 - protein, 9 aa, Artificial Sequence
  Description of Artificial Sequence: Synthetic peptide
  Seed: FADVLSRLA (MAGC3_HUMAN)
FFDVLSRLV

SEQ ID NO: 96214 - protein, 11 aa, Artificial Sequence
  Description of Artificial Sequence: Synthetic peptide
  Seed: MLLPCHWVLDA (MAGC3_HUMAN)
MQLPCHWVLDV

SEQ ID NO: 96215 - protein, 9 aa, Artificial Sequence
  Description of Artificial Sequence: Synthetic peptide
  Seed: HALPESESL (MAGC3_HUMAN)
HMLPESESA

SEQ ID NO: 96216 - protein, 8 aa, Artificial Sequence
  Description of Artificial Sequence: Synthetic peptide
  Seed: FADVLSRL (MAGC3_HUMAN)
FFDVLSRL

SEQ ID NO: 96217 - protein, 8 aa, Artificial Sequence
  Description of Artificial Sequence: Synthetic peptide
  Seed: FADVLSRL (MAGC3_HUMAN)
FLDVLSRL

SEQ ID NO: 96218 - protein, 9 aa, Artificial Sequence
  Description of Artificial Sequence: Synthetic peptide
  Seed: MLLPCHWVL (MAGC3_HUMAN)
MTLPCHWVR

SEQ ID NO: 96219 - protein, 9 aa, Artificial Sequence
  Description of Artificial Sequence: Synthetic peptide
  Seed: YFFEDTLDL (MAGC3_HUMAN)
YAFEDTLDM

SEQ ID NO: 96220 - protein, 9 aa, Artificial Sequence
  Description of Artificial Sequence: Synthetic peptide
  Seed: TKAEMLTTV (MAGC3_HUMAN)
TAAEMLTTI

SEQ ID NO: 96221 - protein, 9 aa, Artificial Sequence
  Description of Artificial Sequence: Synthetic peptide
  Seed: VLPPQPQPR (MAGC3_HUMAN)
VAPPQPQPC

SEQ ID NO: 96222 - protein, 9 aa, Artificial Sequence
  Description of Artificial Sequence: Synthetic peptide
  Seed: HLREVRLFL (MAGC3_HUMAN)
HQREVRLFM

SEQ ID NO: 96223 - protein, 9 aa, Artificial Sequence
  Description of Artificial Sequence: Synthetic peptide
  Seed: VLPPQPQPR (MAGC3_HUMAN)
VSPPQPQPL

SEQ ID NO: 96224 - protein, 10 aa, Artificial Sequence
  Description of Artificial Sequence: Synthetic peptide
  Seed: EEVIWEVLNA (MAGC3_HUMAN)
ECVIWEVLNV

SEQ ID NO: 96225 - protein, 9 aa, Artificial Sequence
  Description of Artificial Sequence: Synthetic peptide
  Seed: VIWEVLNAI (MAGC3_HUMAN)
VMWEVLNAA

SEQ ID NO: 96226 - protein, 10 aa, Artificial Sequence
  Description of Artificial Sequence: Synthetic peptide
  Seed: VLDLANPQGL (MAGC3_HUMAN)
VYDLANPQGF

SEQ ID NO: 96227 - protein, 8 aa, Artificial Sequence
  Description of Artificial Sequence: Synthetic peptide
  Seed: FADVLSRL (MAGC3_HUMAN)
FSDVLSRF

SEQ ID NO: 96228 - protein, 9 aa, Artificial Sequence
  Description of Artificial Sequence: Synthetic peptide
  Seed: KAHEFIELI (MAGC3_HUMAN)
KIHEFIELT

SEQ ID NO: 96229 - protein, 9 aa, Artificial Sequence
  Description of Artificial Sequence: Synthetic peptide
  Seed: HALPESESL (MAGC3_HUMAN)
HKLPESESY

SEQ ID NO: 96230 - protein, 9 aa, Artificial Sequence
  Description of Artificial Sequence: Synthetic peptide
  Seed: MDPDNHSYF (MAGC3_HUMAN)
MIPDNHSYI

SEQ ID NO: 96231 - protein, 11 aa, Artificial Sequence
  Description of Artificial Sequence: Synthetic peptide
  Seed: AEMQMNVINTY (MAGC3_HUMAN)
AWMQMNVINTF

SEQ ID NO: 96232 - protein, 9 aa, Artificial Sequence
  Description of Artificial Sequence: Synthetic peptide
  Seed: HSYFFEDTL (MAGC3_HUMAN)
HHYFFEDTY

SEQ ID NO: 96233 - protein, 9 aa, Artificial Sequence
  Description of Artificial Sequence: Synthetic peptide
  Seed: MIFRKAREF (MAGC3_HUMAN)
MPFRKAREY

SEQ ID NO: 96234 - protein, 11 aa, Artificial Sequence
  Description of Artificial Sequence: Synthetic peptide
  Seed: IIDTTDDATAM (MAGC3_HUMAN)
IYDTTDDATAL

SEQ ID NO: 96235 - protein, 9 aa, Artificial Sequence
  Description of Artificial Sequence: Synthetic peptide
  Seed: DMDPDNHSY (MAGC3_HUMAN)
DYDPDNHSI

SEQ ID NO: 96236 - protein, 9 aa, Artificial Sequence
  Description of Artificial Sequence: Synthetic peptide
  Seed: MIFGKAHEF (MAGC3_HUMAN)
MIFGKAHEK

SEQ ID NO: 96237 - protein, 10 aa, Artificial Sequence
  Description of Artificial Sequence: Synthetic peptide
  Seed: KLSSIIPSAF (MAGC3_HUMAN)
KSSSIIPSAM

SEQ ID NO: 96238 - protein, 8 aa, Artificial Sequence
  Description of Artificial Sequence: Synthetic peptide
  Seed: MEDRAQAI (MAGC3_HUMAN)
MIDRAQAM

SEQ ID NO: 96239 - protein, 8 aa, Artificial Sequence
  Description of Artificial Sequence: Synthetic peptide
  Seed: LTYEGSLI (MAGC3_HUMAN)
LTYEGSLY

SEQ ID NO: 96240 - protein, 9 aa, Artificial Sequence
  Description of Artificial Sequence: Synthetic peptide
  Seed: HALPESESL (MAGC3_HUMAN)
HLLPESESV

SEQ ID NO: 96241 - protein, 9 aa, Artificial Sequence
  Description of Artificial Sequence: Synthetic peptide
  Seed: TSDQRMDSL (MAGC3_HUMAN)
TMDQRMDSV

SEQ ID NO: 96242 - protein, 10 aa, Artificial Sequence
  Description of Artificial Sequence: Synthetic peptide
  Seed: IIPSAFPSWY (MAGC3_HUMAN)
IFPSAFPSWY

SEQ ID NO: 96243 - protein, 9 aa, Artificial Sequence
  Description of Artificial Sequence: Synthetic peptide
  Seed: FSDGSLGQW (MAGC3_HUMAN)
FVDGSLGQV

SEQ ID NO: 96244 - protein, 9 aa, Artificial Sequence
  Description of Artificial Sequence: Synthetic peptide
  Seed: KVDKLVQFL (MAGC3_HUMAN)
KYDKLVQFV

SEQ ID NO: 96245 - protein, 11 aa, Artificial Sequence
  Description of Artificial Sequence: Synthetic peptide
  Seed: LTDMDPDNHSY (MAGC3_HUMAN)
LTDMDPDNHSL

SEQ ID NO: 96246 - protein, 11 aa, Artificial Sequence
  Description of Artificial Sequence: Synthetic peptide
  Seed: FIELIFGIALT (MAGC3_HUMAN)
FAELIFGIALV

SEQ ID NO: 96247 - protein, 9 aa, Artificial Sequence
  Description of Artificial Sequence: Synthetic peptide
  Seed: TYFKLWRTL (MAGC3_HUMAN)
TFFKLWRTL

SEQ ID NO: 96248 - protein, 9 aa, Artificial Sequence
  Description of Artificial Sequence: Synthetic peptide
  Seed: AMASASPSV (MAGC3_HUMAN)
AHASASPSM

SEQ ID NO: 96249 - protein, 10 aa, Artificial Sequence
  Description of Artificial Sequence: Synthetic peptide
  Seed: SDQRMDSLVL (MAGC3_HUMAN)
SAQRMDSLVY

SEQ ID NO: 96250 - protein, 9 aa, Artificial Sequence
  Description of Artificial Sequence: Synthetic peptide
  Seed: ASEEVIWEV (MAGC3_HUMAN)
AMEEVIWEV

SEQ ID NO: 96251 - protein, 9 aa, Artificial Sequence
  Description of Artificial Sequence: Synthetic peptide
  Seed: IPPQGPPKI (MAGC3_HUMAN)
IRPQGPPKV

SEQ ID NO: 96252 - protein, 9 aa, Artificial Sequence
  Description of Artificial Sequence: Synthetic peptide
  Seed: SLRRAVSVK (MAGC3_HUMAN)
STRRAVSVV

SEQ ID NO: 96253 - protein, 9 aa, Artificial Sequence
  Description of Artificial Sequence: Synthetic peptide
  Seed: MIFGKAHEF (MAGC3_HUMAN)
MCFGKAHEL

SEQ ID NO: 96254 - protein, 9 aa, Artificial Sequence
  Description of Artificial Sequence: Synthetic peptide
  Seed: MEDRAQAII (MAGC3_HUMAN)
MADRAQAIL

SEQ ID NO: 96255 - protein, 9 aa, Artificial Sequence
  Description of Artificial Sequence: Synthetic peptide
  Seed: KNCLLILIL (MAGC3_HUMAN)
KACLLILIF

SEQ ID NO: 96256 - protein, 9 aa, Artificial Sequence
  Description of Artificial Sequence: Synthetic peptide
  Seed: MIFGKAHEF (MAGC3_HUMAN)
MVFGKAHER

SEQ ID NO: 96257 - protein, 9 aa, Artificial Sequence
  Description of Artificial Sequence: Synthetic peptide
  Seed: YTGYFPMIF (MAGC3_HUMAN)
YQGYFPMII

SEQ ID NO: 96258 - protein, 9 aa, Artificial Sequence
  Description of Artificial Sequence: Synthetic peptide
  Seed: EKVDKLVQF (MAGC3_HUMAN)
EAVDKLVQF

SEQ ID NO: 96259 - protein, 9 aa, Artificial Sequence
  Description of Artificial Sequence: Synthetic peptide
  Seed: LILILSMIF (MAGC3_HUMAN)
LSLILSMIW

SEQ ID NO: 96260 - protein, 10 aa, Artificial Sequence
  Description of Artificial Sequence: Synthetic peptide
  Seed: ATYALSPVVL (MAGC3_HUMAN)
AFYALSPVVF

SEQ ID NO: 96261 - protein, 8 aa, Artificial Sequence
  Description of Artificial Sequence: Synthetic peptide
  Seed: FADVLSRL (MAGC3_HUMAN)
FGDVLSRM

SEQ ID NO: 96262 - protein, 9 aa, Artificial Sequence
  Description of Artificial Sequence: Synthetic peptide
  Seed: MIFGKAHEF (MAGC3_HUMAN)
MVFGKAHEF

SEQ ID NO: 96263 - protein, 10 aa, Artificial Sequence
  Description of Artificial Sequence: Synthetic peptide
  Seed: TEVDPDHFYV (MAGC3_HUMAN)
TMVDPDHFYM

SEQ ID NO: 96264 - protein, 9 aa, Artificial Sequence
  Description of Artificial Sequence: Synthetic peptide
  Seed: VDPDHFYVF (MAGC3_HUMAN)
VYPDHFYVV

SEQ ID NO: 96265 - protein, 9 aa, Artificial Sequence
  Description of Artificial Sequence: Synthetic peptide
  Seed: EFIELIFGI (MAGC3_HUMAN)
EQIELIFGI

SEQ ID NO: 96266 - protein, 9 aa, Artificial Sequence
  Description of Artificial Sequence: Synthetic peptide
  Seed: TYTGYFPMI (MAGC3_HUMAN)
TFTGYFPMF

SEQ ID NO: 96267 - protein, 9 aa, Artificial Sequence
  Description of Artificial Sequence: Synthetic peptide
  Seed: KDMEDRAQA (MAGC3_HUMAN)
KEMEDRAQL

SEQ ID NO: 96268 - protein, 9 aa, Artificial Sequence
  Description of Artificial Sequence: Synthetic peptide
  Seed: TKAEMLTTV (MAGC3_HUMAN)
TQAEMLTTL

SEQ ID NO: 96269 - protein, 9 aa, Artificial Sequence
  Description of Artificial Sequence: Synthetic peptide
  Seed: ALDEKVAEL (MAGC3_HUMAN)
AMDEKVAEY

SEQ ID NO: 96270 - protein, 8 aa, Artificial Sequence
  Description of Artificial Sequence: Synthetic peptide
  Seed: AEMLTTVI (MAGC3_HUMAN)
AQMLTTVI

SEQ ID NO: 96271 - protein, 10 aa, Artificial Sequence
  Description of Artificial Sequence: Synthetic peptide
  Seed: SDQRMDSLVL (MAGC3_HUMAN)
SRQRMDSLVL

SEQ ID NO: 96272 - protein, 9 aa, Artificial Sequence
  Description of Artificial Sequence: Synthetic peptide
  Seed: LDEKVDKLV (MAGC3_HUMAN)
LEEKVDKLV

SEQ ID NO: 96273 - protein, 9 aa, Artificial Sequence
  Description of Artificial Sequence: Synthetic peptide
  Seed: YTGYFPMIF (MAGC3_HUMAN)
YVGYFPMIY

SEQ ID NO: 96274 - protein, 10 aa, Artificial Sequence
  Description of Artificial Sequence: Synthetic peptide
  Seed: YALDEKVAEL (MAGC3_HUMAN)
YLLDEKVAEW

SEQ ID NO: 96275 - protein, 10 aa, Artificial Sequence
  Description of Artificial Sequence: Synthetic peptide
  Seed: FFEDTLDLTY (MAGC3_HUMAN)
FTEDTLDLTI

SEQ ID NO: 96276 - protein, 10 aa, Artificial Sequence
  Description of Artificial Sequence: Synthetic peptide
  Seed: SKLSSIIPSA (MAGC3_HUMAN)
SYLSSIIPSL

SEQ ID NO: 96277 - protein, 9 aa, Artificial Sequence
  Description of Artificial Sequence: Synthetic peptide
  Seed: ALDEKVAEL (MAGC3_HUMAN)
ASDEKVAEW

SEQ ID NO: 96278 - protein, 9 aa, Artificial Sequence
  Description of Artificial Sequence: Synthetic peptide
  Seed: FADVLSRLA (MAGC3_HUMAN)
FVDVLSRLF

SEQ ID NO: 96279 - protein, 9 aa, Artificial Sequence
  Description of Artificial Sequence: Synthetic peptide
  Seed: VDPDHFYVF (MAGC3_HUMAN)
VWPDHFYVL

SEQ ID NO: 96280 - protein, 10 aa, Artificial Sequence
  Description of Artificial Sequence: Synthetic peptide
  Seed: NTYTGYFPMI (MAGC3_HUMAN)
NWYTGYFPMF

SEQ ID NO: 96281 - protein, 9 aa, Artificial Sequence
  Description of Artificial Sequence: Synthetic peptide
  Seed: EMLTTVIKK (MAGC3_HUMAN)
ETLTTVIKH

SEQ ID NO: 96282 - protein, 9 aa, Artificial Sequence
  Description of Artificial Sequence: Synthetic peptide
  Seed: LKYQTKEPV (MAGC3_HUMAN)
LKYQTKEPY

SEQ ID NO: 96283 - protein, 10 aa, Artificial Sequence
  Description of Artificial Sequence: Synthetic peptide
  Seed: ILFGISLTEV (MAGC3_HUMAN)
IIFGISLTEA

SEQ ID NO: 96284 - protein, 9 aa, Artificial Sequence
  Description of Artificial Sequence: Synthetic peptide
  Seed: MPPLPQSPP (MAGC3_HUMAN)
MPPLPQSPM

SEQ ID NO: 96285 - protein, 9 aa, Artificial Sequence
  Description of Artificial Sequence: Synthetic peptide
  Seed: KEPLTRAEM (MAGC3_HUMAN)
KRPLTRAEF

SEQ ID NO: 96286 - protein, 9 aa, Artificial Sequence
  Description of Artificial Sequence: Synthetic peptide
  Seed: MLLPCHWVL (MAGC3_HUMAN)
MILPCHWVI

SEQ ID NO: 96287 - protein, 9 aa, Artificial Sequence
  Description of Artificial Sequence: Synthetic peptide
  Seed: MIFIKGSCV (MAGC3_HUMAN)
MMFIKGSCM

SEQ ID NO: 96288 - protein, 9 aa, Artificial Sequence
  Description of Artificial Sequence: Synthetic peptide
  Seed: FLSKLSSII (MAGC3_HUMAN)
FLSKLSSIL

SEQ ID NO: 96289 - protein, 9 aa, Artificial Sequence
  Description of Artificial Sequence: Synthetic peptide
  Seed: AGFADVLSR (MAGC3_HUMAN)
ARFADVLSI

SEQ ID NO: 96290 - protein, 8 aa, Artificial Sequence
  Description of Artificial Sequence: Synthetic peptide
  Seed: YTLSLPAV (MAGC3_HUMAN)
YMLSLPAL

SEQ ID NO: 96291 - protein, 10 aa, Artificial Sequence
  Description of Artificial Sequence: Synthetic peptide
  Seed: FKLWRTLSGS (MAGC3_HUMAN)
FWLWRTLSGM

SEQ ID NO: 96292 - protein, 9 aa, Artificial Sequence
  Description of Artificial Sequence: Synthetic peptide
  Seed: QTKEPVTKA (MAGC3_HUMAN)
QAKEPVTKH

SEQ ID NO: 96293 - protein, 9 aa, Artificial Sequence
  Description of Artificial Sequence: Synthetic peptide
  Seed: LKYQAKEPL (MAGC3_HUMAN)
LHYQAKEPL

SEQ ID NO: 96294 - protein, 11 aa, Artificial Sequence
  Description of Artificial Sequence: Synthetic peptide
  Seed: DMDPDNHSYFF (MAGC3_HUMAN)
DADPDNHSYFY

SEQ ID NO: 96295 - protein, 10 aa, Artificial Sequence
  Description of Artificial Sequence: Synthetic peptide
  Seed: SIIPSAFPSW (MAGC3_HUMAN)
SFIPSAFPSW

SEQ ID NO: 96296 - protein, 9 aa, Artificial Sequence
  Description of Artificial Sequence: Synthetic peptide
  Seed: RTLSGSPGL (MAGC3_HUMAN)
RMLSGSPGY

SEQ ID NO: 96297 - protein, 10 aa, Artificial Sequence
  Description of Artificial Sequence: Synthetic peptide
  Seed: MLTTVIKKYK (MAGC3_HUMAN)
MYTTVIKKYR

SEQ ID NO: 96298 - protein, 9 aa, Artificial Sequence
  Description of Artificial Sequence: Synthetic peptide
  Seed: RTLSGSPGL (MAGC3_HUMAN)
RALSGSPGY

SEQ ID NO: 96299 - protein, 9 aa, Artificial Sequence
  Description of Artificial Sequence: Synthetic peptide
  Seed: FHLGHLREV (MAGC3_HUMAN)
FMLGHLREF

SEQ ID NO: 96300 - protein, 9 aa, Artificial Sequence
  Description of Artificial Sequence: Synthetic peptide
  Seed: LKYQAKEPL (MAGC3_HUMAN)
LLYQAKEPM

SEQ ID NO: 96301 - protein, 9 aa, Artificial Sequence
  Description of Artificial Sequence: Synthetic peptide
  Seed: LANPQGLAG (MAGC3_HUMAN)
LANPQGLAL

SEQ ID NO: 96302 - protein, 10 aa, Artificial Sequence
  Description of Artificial Sequence: Synthetic peptide
  Seed: LDSCSSPLLW (MAGC3_HUMAN)
LVSCSSPLLW

SEQ ID NO: 96303 - protein, 10 aa, Artificial Sequence
  Description of Artificial Sequence: Synthetic peptide
  Seed: FSDGSLGQWV (MAGC3_HUMAN)
FADGSLGQWM

SEQ ID NO: 96304 - protein, 11 aa, Artificial Sequence
  Description of Artificial Sequence: Synthetic peptide
  Seed: FIELIFGIALT (MAGC3_HUMAN)
FKELIFGIALI

SEQ ID NO: 96305 - protein, 9 aa, Artificial Sequence
  Description of Artificial Sequence: Synthetic peptide
  Seed: KGSCVPEEV (MAGC3_HUMAN)
KISCVPEEI

SEQ ID NO: 96306 - protein, 9 aa, Artificial Sequence
  Description of Artificial Sequence: Synthetic peptide
  Seed: TKAEMLTTV (MAGC3_HUMAN)
TSAEMLTTL

SEQ ID NO: 96307 - protein, 9 aa, Artificial Sequence
  Description of Artificial Sequence: Synthetic peptide
  Seed: KLSSIIPSA (MAGC3_HUMAN)
KASSIIPSA

SEQ ID NO: 96308 - protein, 10 aa, Artificial Sequence
  Description of Artificial Sequence: Synthetic peptide
  Seed: TYFKLWRTLS (MAGC3_HUMAN)
TYFKLWRTLL

SEQ ID NO: 96309 - protein, 9 aa, Artificial Sequence
  Description of Artificial Sequence: Synthetic peptide
  Seed: HLREVRLFL (MAGC3_HUMAN)
HQREVRLFI

SEQ ID NO: 96310 - protein, 9 aa, Artificial Sequence
  Description of Artificial Sequence: Synthetic peptide
  Seed: NAIGPWSAL (MAGC3_HUMAN)
NVIGPWSAI

SEQ ID NO: 96311 - protein, 10 aa, Artificial Sequence
  Description of Artificial Sequence: Synthetic peptide
  Seed: YALSPVVLPP (MAGC3_HUMAN)
YQLSPVVLPT

SEQ ID NO: 96312 - protein, 9 aa, Artificial Sequence
  Description of Artificial Sequence: Synthetic peptide
  Seed: LRSAEGSVL (MAGC3_HUMAN)
LMSAEGSVL

SEQ ID NO: 96313 - protein, 9 aa, Artificial Sequence
  Description of Artificial Sequence: Synthetic peptide
  Seed: IQRPAREVL (MAGC3_HUMAN)
IVRPAREVL

SEQ ID NO: 96314 - protein, 9 aa, Artificial Sequence
  Description of Artificial Sequence: Synthetic peptide
  Seed: TKAEMLTTV (MAGC3_HUMAN)
TMAEMLTTI

SEQ ID NO: 96315 - protein, 9 aa, Artificial Sequence
  Description of Artificial Sequence: Synthetic peptide
  Seed: NVINTYTGY (MAGC3_HUMAN)
NTINTYTGR

SEQ ID NO: 96316 - protein, 9 aa, Artificial Sequence
  Description of Artificial Sequence: Synthetic peptide
  Seed: NVINTYTGY (MAGC3_HUMAN)
NVINTYTGM

SEQ ID NO: 96317 - protein, 9 aa, Artificial Sequence
  Description of Artificial Sequence: Synthetic peptide
  Seed: ATYALSPVV (MAGC3_HUMAN)
ALYALSPVI

SEQ ID NO: 96318 - protein, 11 aa, Artificial Sequence
  Description of Artificial Sequence: Synthetic peptide
  Seed: MQMNVINTYTG (MAGC3_HUMAN)
MSMNVINTYTY

SEQ ID NO: 96319 - protein, 11 aa, Artificial Sequence
  Description of Artificial Sequence: Synthetic peptide
  Seed: ATAMASASPSV (MAGC3_HUMAN)
AGAMASASPSV

SEQ ID NO: 96320 - protein, 11 aa, Artificial Sequence
  Description of Artificial Sequence: Synthetic peptide
  Seed: KVAELVQFLLL (MAGC3_HUMAN)
KMAELVQFLLQ

SEQ ID NO: 96321 - protein, 9 aa, Artificial Sequence
  Description of Artificial Sequence: Synthetic peptide
  Seed: KYKDYFPMI (MAGC3_HUMAN)
KRKDYFPMY

SEQ ID NO: 96322 - protein, 9 aa, Artificial Sequence
  Description of Artificial Sequence: Synthetic peptide
  Seed: VIWEVLNAI (MAGC3_HUMAN)
VAWEVLNAM

SEQ ID NO: 96323 - protein, 10 aa, Artificial Sequence
  Description of Artificial Sequence: Synthetic peptide
  Seed: LVLCPTYFKL (MAGC3_HUMAN)
LMLCPTYFKK

SEQ ID NO: 96324 - protein, 9 aa, Artificial Sequence
  Description of Artificial Sequence: Synthetic peptide
  Seed: FPMIFRKAR (MAGC3_HUMAN)
FYMIFRKAR

SEQ ID NO: 96325 - protein, 9 aa, Artificial Sequence
  Description of Artificial Sequence: Synthetic peptide
  Seed: GYFPMIFRK (MAGC3_HUMAN)
GFFPMIFRR

SEQ ID NO: 96326 - protein, 11 aa, Artificial Sequence
  Description of Artificial Sequence: Synthetic peptide
  Seed: ILFGISLTEVD (MAGC3_HUMAN)
IMFGISLTEVQ

SEQ ID NO: 96327 - protein, 9 aa, Artificial Sequence
  Description of Artificial Sequence: Synthetic peptide
  Seed: MQMNVINTY (MAGC3_HUMAN)
MTMNVINTM

SEQ ID NO: 96328 - protein, 9 aa, Artificial Sequence
  Description of Artificial Sequence: Synthetic peptide
  Seed: SESLPRYAL (MAGC3_HUMAN)
SQSLPRYAF

SEQ ID NO: 96329 - protein, 11 aa, Artificial Sequence
  Description of Artificial Sequence: Synthetic peptide
  Seed: RTLSGSPGLQL (MAGC3_HUMAN)
RTLSGSPGLQW

SEQ ID NO: 96330 - protein, 9 aa, Artificial Sequence
  Description of Artificial Sequence: Synthetic peptide
  Seed: HFYVFVNTL (MAGC3_HUMAN)
HWYVFVNTY

SEQ ID NO: 96331 - protein, 9 aa, Artificial Sequence
  Description of Artificial Sequence: Synthetic peptide
  Seed: LVLCPTYFK (MAGC3_HUMAN)
LFLCPTYFK

SEQ ID NO: 96332 - protein, 10 aa, Artificial Sequence
  Description of Artificial Sequence: Synthetic peptide
  Seed: GLRSAEGSVL (MAGC3_HUMAN)
GLRSAEGSVY

SEQ ID NO: 96333 - protein, 11 aa, Artificial Sequence
  Description of Artificial Sequence: Synthetic peptide
  Seed: RTLSGSPGLQL (MAGC3_HUMAN)
RTLSGSPGLQY

SEQ ID NO: 96334 - protein, 9 aa, Artificial Sequence
  Description of Artificial Sequence: Synthetic peptide
  Seed: MIFRKAREF (MAGC3_HUMAN)
MRFRKAREL

SEQ ID NO: 96335 - protein, 10 aa, Artificial Sequence
  Description of Artificial Sequence: Synthetic peptide
  Seed: LVLCPTYFKL (MAGC3_HUMAN)
LHLCPTYFKV

SEQ ID NO: 96336 - protein, 11 aa, Artificial Sequence
  Description of Artificial Sequence: Synthetic peptide
  Seed: DSCSSPLLWTR (MAGC3_HUMAN)
DVCSSPLLWTK

SEQ ID NO: 96337 - protein, 10 aa, Artificial Sequence
  Description of Artificial Sequence: Synthetic peptide
  Seed: MIFGKAHEFI (MAGC3_HUMAN)
MIFGKAHEFA

SEQ ID NO: 96338 - protein, 9 aa, Artificial Sequence
  Description of Artificial Sequence: Synthetic peptide
  Seed: VIWEVLNAI (MAGC3_HUMAN)
VAWEVLNAY

SEQ ID NO: 96339 - protein, 11 aa, Artificial Sequence
  Description of Artificial Sequence: Synthetic peptide
  Seed: SASPSVMSTNF (MAGC3_HUMAN)
SMSPSVMSTNW

SEQ ID NO: 96340 - protein, 10 aa, Artificial Sequence
  Description of Artificial Sequence: Synthetic peptide
  Seed: YALSPVVLPP (MAGC3_HUMAN)
YDLSPVVLPL

SEQ ID NO: 96341 - protein, 9 aa, Artificial Sequence
  Description of Artificial Sequence: Synthetic peptide
  Seed: TGYFPMIFR (MAGC3_HUMAN)
TLYFPMIFK

SEQ ID NO: 96342 - protein, 10 aa, Artificial Sequence
  Description of Artificial Sequence: Synthetic peptide
  Seed: SAFHLGHLRE (MAGC3_HUMAN)
STFHLGHLRI

SEQ ID NO: 96343 - protein, 9 aa, Artificial Sequence
  Description of Artificial Sequence: Synthetic peptide
  Seed: ATDKDYSAF (MAGC3_HUMAN)
ASDKDYSAM

SEQ ID NO: 96344 - protein, 10 aa, Artificial Sequence
  Description of Artificial Sequence: Synthetic peptide
  Seed: REVLEFLSKL (MAGC3_HUMAN)
REVLEFLSKV

SEQ ID NO: 96345 - protein, 11 aa, Artificial Sequence
  Description of Artificial Sequence: Synthetic peptide
  Seed: DMDPDNHSYFF (MAGC3_HUMAN)
DTDPDNHSYFY

SEQ ID NO: 96346 - protein, 10 aa, Artificial Sequence
  Description of Artificial Sequence: Synthetic peptide
  Seed: YTGYFPMIFR (MAGC3_HUMAN)
YWGYFPMIFR

SEQ ID NO: 96347 - protein, 9 aa, Artificial Sequence
  Description of Artificial Sequence: Synthetic peptide
  Seed: IPPQGPPKI (MAGC3_HUMAN)
IYPQGPPKL

SEQ ID NO: 96348 - protein, 10 aa, Artificial Sequence
  Description of Artificial Sequence: Synthetic peptide
  Seed: MQMNVINTYT (MAGC3_HUMAN)
MAMNVINTYL

SEQ ID NO: 96349 - protein, 9 aa, Artificial Sequence
  Description of Artificial Sequence: Synthetic peptide
  Seed: YSAFHLGHL (MAGC3_HUMAN)
YFAFHLGHL

SEQ ID NO: 96350 - protein, 9 aa, Artificial Sequence
  Description of Artificial Sequence: Synthetic peptide
  Seed: HLREVRLFL (MAGC3_HUMAN)
HYREVRLFA

SEQ ID NO: 96351 - protein, 9 aa, Artificial Sequence
  Description of Artificial Sequence: Synthetic peptide
  Seed: HLREVRLFL (MAGC3_HUMAN)
HVREVRLFF

SEQ ID NO: 96352 - protein, 10 aa, Artificial Sequence
  Description of Artificial Sequence: Synthetic peptide
  Seed: LNAIGPWSAL (MAGC3_HUMAN)
LCAIGPWSAF

SEQ ID NO: 96353 - protein, 10 aa, Artificial Sequence
  Description of Artificial Sequence: Synthetic peptide
  Seed: KATDKDYSAF (MAGC3_HUMAN)
KLTDKDYSAY

SEQ ID NO: 96354 - protein, 10 aa, Artificial Sequence
  Description of Artificial Sequence: Synthetic peptide
  Seed: IELIFGIALT (MAGC3_HUMAN)
IFLIFGIALA

SEQ ID NO: 96355 - protein, 9 aa, Artificial Sequence
  Description of Artificial Sequence: Synthetic peptide
  Seed: NVINTYTGY (MAGC3_HUMAN)
NAINTYTGM

SEQ ID NO: 96356 - protein, 9 aa, Artificial Sequence
  Description of Artificial Sequence: Synthetic peptide
  Seed: LSGSPGLQL (MAGC3_HUMAN)
LSGSPGLQV

SEQ ID NO: 96357 - protein, 9 aa, Artificial Sequence
  Description of Artificial Sequence: Synthetic peptide
  Seed: EAFCEESGL (MAGC3_HUMAN)
ESFCEESGV

SEQ ID NO: 96358 - protein, 9 aa, Artificial Sequence
  Description of Artificial Sequence: Synthetic peptide
  Seed: WESEGPEAF (MAGC3_HUMAN)
WESEGPEAA

SEQ ID NO: 96359 - protein, 9 aa, Artificial Sequence
  Description of Artificial Sequence: Synthetic peptide
  Seed: KLSSIIPSA (MAGC3_HUMAN)
KTSSIIPSV

SEQ ID NO: 96360 - protein, 11 aa, Artificial Sequence
  Description of Artificial Sequence: Synthetic peptide
  Seed: SLVLCPTYFKL (MAGC3_HUMAN)
SSVLCPTYFKK

SEQ ID NO: 96361 - protein, 9 aa, Artificial Sequence
  Description of Artificial Sequence: Synthetic peptide
  Seed: ATDKDYSAF (MAGC3_HUMAN)
AWDKDYSAL

SEQ ID NO: 96362 - protein, 9 aa, Artificial Sequence
  Description of Artificial Sequence: Synthetic peptide
  Seed: EMLTTVIKK (MAGC3_HUMAN)
ETLTTVIKY

SEQ ID NO: 96363 - protein, 8 aa, Artificial Sequence
  Description of Artificial Sequence: Synthetic peptide
  Seed: MEDRAQAI (MAGC3_HUMAN)
MSDRAQAI

SEQ ID NO: 96364 - protein, 9 aa, Artificial Sequence
  Description of Artificial Sequence: Synthetic peptide
  Seed: IIPSAFPSW (MAGC3_HUMAN)
ITPSAFPSI

SEQ ID NO: 96365 - protein, 9 aa, Artificial Sequence
  Description of Artificial Sequence: Synthetic peptide
  Seed: EVLSAIGPI (MAGC3_HUMAN)
EILSAIGPY

SEQ ID NO: 96366 - protein, 10 aa, Artificial Sequence
  Description of Artificial Sequence: Synthetic peptide
  Seed: VLDLANPQGL (MAGC3_HUMAN)
VVDLANPQGL

SEQ ID NO: 96367 - protein, 9 aa, Artificial Sequence
  Description of Artificial Sequence: Synthetic peptide
  Seed: HALPESESL (MAGC3_HUMAN)
HSLPESESW

SEQ ID NO: 96368 - protein, 8 aa, Artificial Sequence
  Description of Artificial Sequence: Synthetic peptide
  Seed: FADVLSRL (MAGC3_HUMAN)
FSDVLSRI

SEQ ID NO: 96369 - protein, 9 aa, Artificial Sequence
  Description of Artificial Sequence: Synthetic peptide
  Seed: LLILILSMI (MAGC3_HUMAN)
LQILILSMV

SEQ ID NO: 96370 - protein, 9 aa, Artificial Sequence
  Description of Artificial Sequence: Synthetic peptide
  Seed: DMDPDNHSY (MAGC3_HUMAN)
DVDPDNHSF

SEQ ID NO: 96371 - protein, 9 aa, Artificial Sequence
  Description of Artificial Sequence: Synthetic peptide
  Seed: QTKEPVTKA (MAGC3_HUMAN)
QVKEPVTKV

SEQ ID NO: 96372 - protein, 9 aa, Artificial Sequence
  Description of Artificial Sequence: Synthetic peptide
  Seed: MDPDNHSYF (MAGC3_HUMAN)
MIPDNHSYF

SEQ ID NO: 96373 - protein, 9 aa, Artificial Sequence
  Description of Artificial Sequence: Synthetic peptide
  Seed: SAFHLGHLR (MAGC3_HUMAN)
SAFHLGHLH

SEQ ID NO: 96374 - protein, 11 aa, Artificial Sequence
  Description of Artificial Sequence: Synthetic peptide
  Seed: SVLDLANPQGL (MAGC3_HUMAN)
SALDLANPQGF

SEQ ID NO: 96375 - protein, 9 aa, Artificial Sequence
  Description of Artificial Sequence: Synthetic peptide
  Seed: FEDTLDLTY (MAGC3_HUMAN)
FSDTLDLTL

SEQ ID NO: 96376 - protein, 9 aa, Artificial Sequence
  Description of Artificial Sequence: Synthetic peptide
  Seed: GSLPESEPL (MAGC3_HUMAN)
GMLPESEPA

SEQ ID NO: 96377 - protein, 9 aa, Artificial Sequence
  Description of Artificial Sequence: Synthetic peptide
  Seed: VIWEVLNAI (MAGC3_HUMAN)
VIWEVLNAR

SEQ ID NO: 96378 - protein, 10 aa, Artificial Sequence
  Description of Artificial Sequence: Synthetic peptide
  Seed: EKVAELVQFL (MAGC3_HUMAN)
EQVAELVQFV

SEQ ID NO: 96379 - protein, 11 aa, Artificial Sequence
  Description of Artificial Sequence: Synthetic peptide
  Seed: LDSCSSPLLWT (MAGC3_HUMAN)
LSSCSSPLLWT

SEQ ID NO: 96380 - protein, 9 aa, Artificial Sequence
  Description of Artificial Sequence: Synthetic peptide
  Seed: YSAFHLGHL (MAGC3_HUMAN)
YQAFHLGHI

SEQ ID NO: 96381 - protein, 9 aa, Artificial Sequence
  Description of Artificial Sequence: Synthetic peptide
  Seed: SIIPSAFPS (MAGC3_HUMAN)
SQIPSAFPL

SEQ ID NO: 96382 - protein, 9 aa, Artificial Sequence
  Description of Artificial Sequence: Synthetic peptide
  Seed: KYKDYFPMI (MAGC3_HUMAN)
KFKDYFPMY

SEQ ID NO: 96383 - protein, 10 aa, Artificial Sequence
  Description of Artificial Sequence: Synthetic peptide
  Seed: SLVLCPTYFK (MAGC3_HUMAN)
SMVLCPTYFK

SEQ ID NO: 96384 - protein, 9 aa, Artificial Sequence
  Description of Artificial Sequence: Synthetic peptide
  Seed: SAFHLGHLR (MAGC3_HUMAN)
SQFHLGHLK

SEQ ID NO: 96385 - protein, 9 aa, Artificial Sequence
  Description of Artificial Sequence: Synthetic peptide
  Seed: VTKAEMLTT (MAGC3_HUMAN)
VSKAEMLTK

SEQ ID NO: 96386 - protein, 9 aa, Artificial Sequence
  Description of Artificial Sequence: Synthetic peptide
  Seed: AVSPGKRLW (MAGC3_HUMAN)
AMSPGKRLY

SEQ ID NO: 96387 - protein, 9 aa, Artificial Sequence
  Description of Artificial Sequence: Synthetic peptide
  Seed: SEEVIWEVL (MAGC3_HUMAN)
SEEVIWEVV

SEQ ID NO: 96388 - protein, 11 aa, Artificial Sequence
  Description of Artificial Sequence: Synthetic peptide
  Seed: SLPESEPLFTY (MAGC3_HUMAN)
SLPESEPLFTM

SEQ ID NO: 96389 - protein, 9 aa, Artificial Sequence
  Description of Artificial Sequence: Synthetic peptide
  Seed: LILILSMIF (MAGC3_HUMAN)
LQLILSMII

SEQ ID NO: 96390 - protein, 9 aa, Artificial Sequence
  Description of Artificial Sequence: Synthetic peptide
  Seed: HLREVRLFL (MAGC3_HUMAN)
HAREVRLFM

SEQ ID NO: 96391 - protein, 11 aa, Artificial Sequence
  Description of Artificial Sequence: Synthetic peptide
  Seed: LDSCSSPLLWT (MAGC3_HUMAN)
LSSCSSPLLWA

SEQ ID NO: 96392 - protein, 9 aa, Artificial Sequence
  Description of Artificial Sequence: Synthetic peptide
  Seed: ATYALSPVV (MAGC3_HUMAN)
AMYALSPVI

SEQ ID NO: 96393 - protein, 10 aa, Artificial Sequence
  Description of Artificial Sequence: Synthetic peptide
  Seed: TTDDATAMAS (MAGC3_HUMAN)
TADDATAMAI

SEQ ID NO: 96394 - protein, 9 aa, Artificial Sequence
  Description of Artificial Sequence: Synthetic peptide
  Seed: DEKVAELVQ (MAGC3_HUMAN)
DEKVAELVY

SEQ ID NO: 96395 - protein, 9 aa, Artificial Sequence
  Description of Artificial Sequence: Synthetic peptide
  Seed: TAMASASPS (MAGC3_HUMAN)
TAMASASPY

SEQ ID NO: 96396 - protein, 9 aa, Artificial Sequence
  Description of Artificial Sequence: Synthetic peptide
  Seed: EKVDKLVQF (MAGC3_HUMAN)
ERVDKLVQY

SEQ ID NO: 96397 - protein, 10 aa, Artificial Sequence
  Description of Artificial Sequence: Synthetic peptide
  Seed: YTGYFPMIFR (MAGC3_HUMAN)
YPGYFPMIFR

SEQ ID NO: 96398 - protein, 9 aa, Artificial Sequence
  Description of Artificial Sequence: Synthetic peptide
  Seed: KLSSIIPSA (MAGC3_HUMAN)
KQSSIIPSK

SEQ ID NO: 96399 - protein, 11 aa, Artificial Sequence
  Description of Artificial Sequence: Synthetic peptide
  Seed: YFFEDTLDLTY (MAGC3_HUMAN)
YLFEDTLDLTY

SEQ ID NO: 96400 - protein, 10 aa, Artificial Sequence
  Description of Artificial Sequence: Synthetic peptide
  Seed: LWKDSDLPTW (MAGC3_HUMAN)
LWKDSDLPTF

SEQ ID NO: 96401 - protein, 9 aa, Artificial Sequence
  Description of Artificial Sequence: Synthetic peptide
  Seed: SLRRAVSVK (MAGC3_HUMAN)
SVRRAVSVK

SEQ ID NO: 96402 - protein, 9 aa, Artificial Sequence
  Description of Artificial Sequence: Synthetic peptide
  Seed: NVINTYTGY (MAGC3_HUMAN)
NQINTYTGM

SEQ ID NO: 96403 - protein, 11 aa, Artificial Sequence
  Description of Artificial Sequence: Synthetic peptide
  Seed: YALDEKVAELV (MAGC3_HUMAN)
YILDEKVAELV

SEQ ID NO: 96404 - protein, 10 aa, Artificial Sequence
  Description of Artificial Sequence: Synthetic peptide
  Seed: ALDEKVAELV (MAGC3_HUMAN)
ATDEKVAELV

SEQ ID NO: 96405 - protein, 10 aa, Artificial Sequence
  Description of Artificial Sequence: Synthetic peptide
  Seed: REVRLFLRGG (MAGC3_HUMAN)
RKVRLFLRGA

SEQ ID NO: 96406 - protein, 11 aa, Artificial Sequence
  Description of Artificial Sequence: Synthetic peptide
  Seed: IIDTTDDATAM (MAGC3_HUMAN)
IWDTTDDATAL

SEQ ID NO: 96407 - protein, 9 aa, Artificial Sequence
  Description of Artificial Sequence: Synthetic peptide
  Seed: SLVLCPTYF (MAGC3_HUMAN)
SFVLCPTYL

SEQ ID NO: 96408 - protein, 8 aa, Artificial Sequence
  Description of Artificial Sequence: Synthetic peptide
  Seed: IQRPAREV (MAGC3_HUMAN)
IARPAREF

SEQ ID NO: 96409 - protein, 9 aa, Artificial Sequence
  Description of Artificial Sequence: Synthetic peptide
  Seed: HFYVFVNTL (MAGC3_HUMAN)
HWYVFVNTM

SEQ ID NO: 96410 - protein, 9 aa, Artificial Sequence
  Description of Artificial Sequence: Synthetic peptide
  Seed: MQMNVINTY (MAGC3_HUMAN)
MNMNVINTM

SEQ ID NO: 96411 - protein, 9 aa, Artificial Sequence
  Description of Artificial Sequence: Synthetic peptide
  Seed: SLPESEPLF (MAGC3_HUMAN)
SYPESEPLI

SEQ ID NO: 96412 - protein, 9 aa, Artificial Sequence
  Description of Artificial Sequence: Synthetic peptide
  Seed: SLRRAVSVK (MAGC3_HUMAN)
SARRAVSVV

SEQ ID NO: 96413 - protein, 9 aa, Artificial Sequence
  Description of Artificial Sequence: Synthetic peptide
  Seed: FSDGSLGQW (MAGC3_HUMAN)
FTDGSLGQF

SEQ ID NO: 96414 - protein, 9 aa, Artificial Sequence
  Description of Artificial Sequence: Synthetic peptide
  Seed: VDPDHFYVF (MAGC3_HUMAN)
VFPDHFYVY

SEQ ID NO: 96415 - protein, 11 aa, Artificial Sequence
  Description of Artificial Sequence: Synthetic peptide
  Seed: EVLSAIGPIQR (MAGC3_HUMAN)
EWLSAIGPIQR

SEQ ID NO: 96416 - protein, 10 aa, Artificial Sequence
  Description of Artificial Sequence: Synthetic peptide
  Seed: TDMDPDNHSY (MAGC3_HUMAN)
TPMDPDNHSM

SEQ ID NO: 96417 - protein, 8 aa, Artificial Sequence
  Description of Artificial Sequence: Synthetic peptide
  Seed: KVDKLVQF (MAGC3_HUMAN)
KTDKLVQI

SEQ ID NO: 96418 - protein, 9 aa, Artificial Sequence
  Description of Artificial Sequence: Synthetic peptide
  Seed: FADVLSRLA (MAGC3_HUMAN)
FMDVLSRLV

SEQ ID NO: 96419 - protein, 9 aa, Artificial Sequence
  Description of Artificial Sequence: Synthetic peptide
  Seed: TGYFPMIFR (MAGC3_HUMAN)
TYYFPMIFK

SEQ ID NO: 96420 - protein, 11 aa, Artificial Sequence
  Description of Artificial Sequence: Synthetic peptide
  Seed: YFFEDTLDLTY (MAGC3_HUMAN)
YVFEDTLDLTY

SEQ ID NO: 96421 - protein, 9 aa, Artificial Sequence
  Description of Artificial Sequence: Synthetic peptide
  Seed: VLCPTYFKL (MAGC3_HUMAN)
VSCPTYFKF

SEQ ID NO: 96422 - protein, 10 aa, Artificial Sequence
  Description of Artificial Sequence: Synthetic peptide
  Seed: FSDGSLGQWV (MAGC3_HUMAN)
FMDGSLGQWV

SEQ ID NO: 96423 - protein, 9 aa, Artificial Sequence
  Description of Artificial Sequence: Synthetic peptide
  Seed: VIWEVLNAI (MAGC3_HUMAN)
VTWEVLNAY

SEQ ID NO: 96424 - protein, 9 aa, Artificial Sequence
  Description of Artificial Sequence: Synthetic peptide
  Seed: NTYTGYFPM (MAGC3_HUMAN)
NMYTGYFPR

SEQ ID NO: 96425 - protein, 11 aa, Artificial Sequence
  Description of Artificial Sequence: Synthetic peptide
  Seed: AEMQMNVINTY (MAGC3_HUMAN)
AEMQMNVINTF

SEQ ID NO: 96426 - protein, 9 aa, Artificial Sequence
  Description of Artificial Sequence: Synthetic peptide
  Seed: DSLVLCPTY (MAGC3_HUMAN)
DQLVLCPTY

SEQ ID NO: 96427 - protein, 9 aa, Artificial Sequence
  Description of Artificial Sequence: Synthetic peptide
  Seed: MIFRKAREF (MAGC3_HUMAN)
MNFRKAREF

SEQ ID NO: 96428 - protein, 10 aa, Artificial Sequence
  Description of Artificial Sequence: Synthetic peptide
  Seed: SLVLCPTYFK (MAGC3_HUMAN)
SDVLCPTYFR

SEQ ID NO: 96429 - protein, 9 aa, Artificial Sequence
  Description of Artificial Sequence: Synthetic peptide
  Seed: KYKDYFPMI (MAGC3_HUMAN)
KWKDYFPMY

SEQ ID NO: 96430 - protein, 9 aa, Artificial Sequence
  Description of Artificial Sequence: Synthetic peptide
  Seed: TKAEMLTTV (MAGC3_HUMAN)
TTAEMLTTL

SEQ ID NO: 96431 - protein, 9 aa, Artificial Sequence
  Description of Artificial Sequence: Synthetic peptide
  Seed: FPMIFGKAH (MAGC3_HUMAN)
FPMIFGKAT

SEQ ID NO: 96432 - protein, 9 aa, Artificial Sequence
  Description of Artificial Sequence: Synthetic peptide
  Seed: VPEEVIWEV (MAGC3_HUMAN)
VGEEVIWEM

SEQ ID NO: 96433 - protein, 9 aa, Artificial Sequence
  Description of Artificial Sequence: Synthetic peptide
  Seed: ASEEVIWEV (MAGC3_HUMAN)
AAEEVIWEV

SEQ ID NO: 96434 - protein, 11 aa, Artificial Sequence
  Description of Artificial Sequence: Synthetic peptide
  Seed: LDSCSSPLLWT (MAGC3_HUMAN)
LSSCSSPLLWQ

SEQ ID NO: 96435 - protein, 10 aa, Artificial Sequence
  Description of Artificial Sequence: Synthetic peptide
  Seed: SLVLCPTYFK (MAGC3_HUMAN)
SSVLCPTYFK

SEQ ID NO: 96436 - protein, 9 aa, Artificial Sequence
  Description of Artificial Sequence: Synthetic peptide
  Seed: LCPTYFKLW (MAGC3_HUMAN)
LSPTYFKLW

SEQ ID NO: 96437 - protein, 9 aa, Artificial Sequence
  Description of Artificial Sequence: Synthetic peptide
  Seed: MASASPSVM (MAGC3_HUMAN)
MFSASPSVF

SEQ ID NO: 96438 - protein, 11 aa, Artificial Sequence
  Description of Artificial Sequence: Synthetic peptide
  Seed: LPQSPPEIPPQ (MAGC3_HUMAN)
LPQSPPEIPPA

SEQ ID NO: 96439 - protein, 9 aa, Artificial Sequence
  Description of Artificial Sequence: Synthetic peptide
  Seed: TTDDATAMA (MAGC3_HUMAN)
TQDDATAMM

SEQ ID NO: 96440 - protein, 10 aa, Artificial Sequence
  Description of Artificial Sequence: Synthetic peptide
  Seed: KKYKDYFPMI (MAGC3_HUMAN)
KVYKDYFPMW

SEQ ID NO: 96441 - protein, 10 aa, Artificial Sequence
  Description of Artificial Sequence: Synthetic peptide
  Seed: AEMQMNVINT (MAGC3_HUMAN)
AEMQMNVINW

SEQ ID NO: 96442 - protein, 11 aa, Artificial Sequence
  Description of Artificial Sequence: Synthetic peptide
  Seed: RTLSGSPGLQL (MAGC3_HUMAN)
RLLSGSPGLQV

SEQ ID NO: 96443 - protein, 10 aa, Artificial Sequence
  Description of Artificial Sequence: Synthetic peptide
  Seed: SCSSPLLWTR (MAGC3_HUMAN)
SFSSPLLWTR

SEQ ID NO: 96444 - protein, 9 aa, Artificial Sequence
  Description of Artificial Sequence: Synthetic peptide
  Seed: REEPQDWPL (MAGC3_HUMAN)
REEPQDWPV

SEQ ID NO: 96445 - protein, 10 aa, Artificial Sequence
  Description of Artificial Sequence: Synthetic peptide
  Seed: INTYTGYFPM (MAGC3_HUMAN)
ICTYTGYFPF

SEQ ID NO: 96446 - protein, 9 aa, Artificial Sequence
  Description of Artificial Sequence: Synthetic peptide
  Seed: KYKDYFPMI (MAGC3_HUMAN)
KYKDYFPMM

SEQ ID NO: 96447 - protein, 11 aa, Artificial Sequence
  Description of Artificial Sequence: Synthetic peptide
  Seed: RTLSGSPGLQL (MAGC3_HUMAN)
RELSGSPGLQY

SEQ ID NO: 96448 - protein, 9 aa, Artificial Sequence
  Description of Artificial Sequence: Synthetic peptide
  Seed: RPAREVLEF (MAGC3_HUMAN)
RTAREVLEI

SEQ ID NO: 96449 - protein, 10 aa, Artificial Sequence
  Description of Artificial Sequence: Synthetic peptide
  Seed: KKYKDYFPMI (MAGC3_HUMAN)
KLYKDYFPMW

SEQ ID NO: 96450 - protein, 10 aa, Artificial Sequence
  Description of Artificial Sequence: Synthetic peptide
  Seed: KVAELVQFLL (MAGC3_HUMAN)
KTAELVQFLF

SEQ ID NO: 96451 - protein, 9 aa, Artificial Sequence
  Description of Artificial Sequence: Synthetic peptide
  Seed: LKYQTKEPV (MAGC3_HUMAN)
LVYQTKEPF

SEQ ID NO: 96452 - protein, 9 aa, Artificial Sequence
  Description of Artificial Sequence: Synthetic peptide
  Seed: NTYTGYFPM (MAGC3_HUMAN)
NLYTGYFPM

SEQ ID NO: 96453 - protein, 11 aa, Artificial Sequence
  Description of Artificial Sequence: Synthetic peptide
  Seed: IKKYKDYFPMI (MAGC3_HUMAN)
IYKYKDYFPMF

SEQ ID NO: 96454 - protein, 10 aa, Artificial Sequence
  Description of Artificial Sequence: Synthetic peptide
  Seed: SDQRMDSLVL (MAGC3_HUMAN)
SAQRMDSLVF

SEQ ID NO: 96455 - protein, 10 aa, Artificial Sequence
  Description of Artificial Sequence: Synthetic peptide
  Seed: SDQRMDSLVL (MAGC3_HUMAN)
SYQRMDSLVL

SEQ ID NO: 96456 - protein, 10 aa, Artificial Sequence
  Description of Artificial Sequence: Synthetic peptide
  Seed: TYTGYFPMIF (MAGC3_HUMAN)
TYTGYFPMIM

SEQ ID NO: 96457 - protein, 10 aa, Artificial Sequence
  Description of Artificial Sequence: Synthetic peptide
  Seed: KKYKDYFPMI (MAGC3_HUMAN)
KTYKDYFPMV

SEQ ID NO: 96458 - protein, 9 aa, Artificial Sequence
  Description of Artificial Sequence: Synthetic peptide
  Seed: ALDEKVAEL (MAGC3_HUMAN)
AHDEKVAEW

SEQ ID NO: 96459 - protein, 9 aa, Artificial Sequence
  Description of Artificial Sequence: Synthetic peptide
  Seed: NAIGPWSAL (MAGC3_HUMAN)
NKIGPWSAL

SEQ ID NO: 96460 - protein, 9 aa, Artificial Sequence
  Description of Artificial Sequence: Synthetic peptide
  Seed: TTDDATAMA (MAGC3_HUMAN)
TIDDATAMM

SEQ ID NO: 96461 - protein, 10 aa, Artificial Sequence
  Description of Artificial Sequence: Synthetic peptide
  Seed: KDYFPMIFGK (MAGC3_HUMAN)
KNYFPMIFGR

SEQ ID NO: 96462 - protein, 10 aa, Artificial Sequence
  Description of Artificial Sequence: Synthetic peptide
  Seed: ATDKDYSAFH (MAGC3_HUMAN)
AVDKDYSAFY

SEQ ID NO: 96463 - protein, 9 aa, Artificial Sequence
  Description of Artificial Sequence: Synthetic peptide
  Seed: ALSPVVLPP (MAGC3_HUMAN)
AQSPVVLPV

SEQ ID NO: 96464 - protein, 9 aa, Artificial Sequence
  Description of Artificial Sequence: Synthetic peptide
  Seed: VLPPQPQPR (MAGC3_HUMAN)
VTPPQPQPR

SEQ ID NO: 96465 - protein, 10 aa, Artificial Sequence
  Description of Artificial Sequence: Synthetic peptide
  Seed: KLVQFLLLKY (MAGC3_HUMAN)
KTVQFLLLKF

SEQ ID NO: 96466 - protein, 9 aa, Artificial Sequence
  Description of Artificial Sequence: Synthetic peptide
  Seed: NTYTGYFPM (MAGC3_HUMAN)
NIYTGYFPK

SEQ ID NO: 96467 - protein, 9 aa, Artificial Sequence
  Description of Artificial Sequence: Synthetic peptide
  Seed: ALDEKVAEL (MAGC3_HUMAN)
ATDEKVAEV

SEQ ID NO: 96468 - protein, 9 aa, Artificial Sequence
  Description of Artificial Sequence: Synthetic peptide
  Seed: WESEGPEAF (MAGC3_HUMAN)
WASEGPEAF

SEQ ID NO: 96469 - protein, 10 aa, Artificial Sequence
  Description of Artificial Sequence: Synthetic peptide
  Seed: EAFCEESGLR (MAGC3_HUMAN)
EIFCEESGLR

SEQ ID NO: 96470 - protein, 9 aa, Artificial Sequence
  Description of Artificial Sequence: Synthetic peptide
  Seed: MLLPCHWVL (MAGC3_HUMAN)
MWLPCHWVI

SEQ ID NO: 96471 - protein, 10 aa, Artificial Sequence
  Description of Artificial Sequence: Synthetic peptide
  Seed: YQAKEPLTRA (MAGC3_HUMAN)
YIAKEPLTRL

SEQ ID NO: 96472 - protein, 9 aa, Artificial Sequence
  Description of Artificial Sequence: Synthetic peptide
  Seed: KVDKLVQFL (MAGC3_HUMAN)
KNDKLVQFY

SEQ ID NO: 96473 - protein, 9 aa, Artificial Sequence
  Description of Artificial Sequence: Synthetic peptide
  Seed: LSSIIPSAF (MAGC3_HUMAN)
LPSIIPSAM

SEQ ID NO: 96474 - protein, 8 aa, Artificial Sequence
  Description of Artificial Sequence: Synthetic peptide
  Seed: ESLPRYAL (MAGC3_HUMAN)
ELLPRYAL

SEQ ID NO: 96475 - protein, 9 aa, Artificial Sequence
  Description of Artificial Sequence: Synthetic peptide
  Seed: TAMASASPS (MAGC3_HUMAN)
TVMASASPY

SEQ ID NO: 96476 - protein, 10 aa, Artificial Sequence
  Description of Artificial Sequence: Synthetic peptide
  Seed: MLTTVIKKYK (MAGC3_HUMAN)
MFTTVIKKYK

SEQ ID NO: 96477 - protein, 9 aa, Artificial Sequence
  Description of Artificial Sequence: Synthetic peptide
  Seed: AMASASPSV (MAGC3_HUMAN)
ASASASPSV

SEQ ID NO: 96478 - protein, 9 aa, Artificial Sequence
  Description of Artificial Sequence: Synthetic peptide
  Seed: IIPSAFPSW (MAGC3_HUMAN)
IIPSAFPSM

SEQ ID NO: 96479 - protein, 10 aa, Artificial Sequence
  Description of Artificial Sequence: Synthetic peptide
  Seed: VLDLANPQGL (MAGC3_HUMAN)
VADLANPQGI

SEQ ID NO: 96480 - protein, 10 aa, Artificial Sequence
  Description of Artificial Sequence: Synthetic peptide
  Seed: MPAAGMPPLP (MAGC3_HUMAN)
MPAAGMPPLD

SEQ ID NO: 96481 - protein, 10 aa, Artificial Sequence
  Description of Artificial Sequence: Synthetic peptide
  Seed: SIIPSAFPSW (MAGC3_HUMAN)
SSIPSAFPSM

SEQ ID NO: 96482 - protein, 10 aa, Artificial Sequence
  Description of Artificial Sequence: Synthetic peptide
  Seed: ALPESESLPR (MAGC3_HUMAN)
ATPESESLPR

SEQ ID NO: 96483 - protein, 9 aa, Artificial Sequence
  Description of Artificial Sequence: Synthetic peptide
  Seed: HLREVRLFL (MAGC3_HUMAN)
HIREVRLFR

SEQ ID NO: 96484 - protein, 11 aa, Artificial Sequence
  Description of Artificial Sequence: Synthetic peptide
  Seed: SSSEEEDTATW (MAGC3_HUMAN)
SMSEEEDTATI

SEQ ID NO: 96485 - protein, 9 aa, Artificial Sequence
  Description of Artificial Sequence: Synthetic peptide
  Seed: VDPDHFYVF (MAGC3_HUMAN)
VRPDHFYVV

SEQ ID NO: 96486 - protein, 10 aa, Artificial Sequence
  Description of Artificial Sequence: Synthetic peptide
  Seed: MLLPCHWVLD (MAGC3_HUMAN)
MELPCHWVLV

SEQ ID NO: 96487 - protein, 9 aa, Artificial Sequence
  Description of Artificial Sequence: Synthetic peptide
  Seed: IQRPAREVL (MAGC3_HUMAN)
IYRPAREVL

SEQ ID NO: 96488 - protein, 11 aa, Artificial Sequence
  Description of Artificial Sequence: Synthetic peptide
  Seed: FIELIFGIALT (MAGC3_HUMAN)
FDELIFGIALL

SEQ ID NO: 96489 - protein, 10 aa, Artificial Sequence
  Description of Artificial Sequence: Synthetic peptide
  Seed: SKLSSIIPSA (MAGC3_HUMAN)
SALSSIIPSI

SEQ ID NO: 96490 - protein, 9 aa, Artificial Sequence
  Description of Artificial Sequence: Synthetic peptide
  Seed: LIDDQGMPK (MAGC3_HUMAN)
LSDDQGMPF

SEQ ID NO: 96491 - protein, 9 aa, Artificial Sequence
  Description of Artificial Sequence: Synthetic peptide
  Seed: REVLEFLSK (MAGC3_HUMAN)
REVLEFLSF

SEQ ID NO: 96492 - protein, 10 aa, Artificial Sequence
  Description of Artificial Sequence: Synthetic peptide
  Seed: ALDEKVAELV (MAGC3_HUMAN)
AIDEKVAELM

SEQ ID NO: 96493 - protein, 9 aa, Artificial Sequence
  Description of Artificial Sequence: Synthetic peptide
  Seed: EVLEFLSKL (MAGC3_HUMAN)
EGLEFLSKV

SEQ ID NO: 96494 - protein, 9 aa, Artificial Sequence
  Description of Artificial Sequence: Synthetic peptide
  Seed: FSLRRAVSV (MAGC3_HUMAN)
FNLRRAVSM

SEQ ID NO: 96495 - protein, 9 aa, Artificial Sequence
  Description of Artificial Sequence: Synthetic peptide
  Seed: MIFGKAHEF (MAGC3_HUMAN)
MDFGKAHEL

SEQ ID NO: 96496 - protein, 10 aa, Artificial Sequence
  Description of Artificial Sequence: Synthetic peptide
  Seed: IPSAFPSWYM (MAGC3_HUMAN)
IRSAFPSWYF

SEQ ID NO: 96497 - protein, 9 aa, Artificial Sequence
  Description of Artificial Sequence: Synthetic peptide
  Seed: MIFRKAREF (MAGC3_HUMAN)
MMFRKAREW

SEQ ID NO: 96498 - protein, 10 aa, Artificial Sequence
  Description of Artificial Sequence: Synthetic peptide
  Seed: TTDDATAMAS (MAGC3_HUMAN)
TIDDATAMAV

SEQ ID NO: 96499 - protein, 9 aa, Artificial Sequence
  Description of Artificial Sequence: Synthetic peptide
  Seed: MDPDNHSYF (MAGC3_HUMAN)
MYPDNHSYF

SEQ ID NO: 96500 - protein, 9 aa, Artificial Sequence
  Description of Artificial Sequence: Synthetic peptide
  Seed: LIDDQGMPK (MAGC3_HUMAN)
LIDDQGMPF

SEQ ID NO: 96501 - protein, 10 aa, Artificial Sequence
  Description of Artificial Sequence: Synthetic peptide
  Seed: TGYFPMIFRK (MAGC3_HUMAN)
TRYFPMIFRK

SEQ ID NO: 96502 - protein, 9 aa, Artificial Sequence
  Description of Artificial Sequence: Synthetic peptide
  Seed: EKVDKLVQF (MAGC3_HUMAN)
EYVDKLVQM

SEQ ID NO: 96503 - protein, 10 aa, Artificial Sequence
  Description of Artificial Sequence: Synthetic peptide
  Seed: SDQRMDSLVL (MAGC3_HUMAN)
SSQRMDSLVY

SEQ ID NO: 96504 - protein, 9 aa, Artificial Sequence
  Description of Artificial Sequence: Synthetic peptide
  Seed: VLCPTYFKL (MAGC3_HUMAN)
VFCPTYFKL

SEQ ID NO: 96505 - protein, 11 aa, Artificial Sequence
  Description of Artificial Sequence: Synthetic peptide
  Seed: SSSEEEDTATW (MAGC3_HUMAN)
STSEEEDTATW

SEQ ID NO: 96506 - protein, 11 aa, Artificial Sequence
  Description of Artificial Sequence: Synthetic peptide
  Seed: RTLSGSPGLQL (MAGC3_HUMAN)
RILSGSPGLQL

SEQ ID NO: 96507 - protein, 9 aa, Artificial Sequence
  Description of Artificial Sequence: Synthetic peptide
  Seed: IIPSAFPSW (MAGC3_HUMAN)
IVPSAFPSI

SEQ ID NO: 96508 - protein, 9 aa, Artificial Sequence
  Description of Artificial Sequence: Synthetic peptide
  Seed: DSLVLCPTY (MAGC3_HUMAN)
DPLVLCPTY

SEQ ID NO: 96509 - protein, 9 aa, Artificial Sequence
  Description of Artificial Sequence: Synthetic peptide
  Seed: LSDEQGMPQ (MAGC3_HUMAN)
LVDEQGMPI

SEQ ID NO: 96510 - protein, 10 aa, Artificial Sequence
  Description of Artificial Sequence: Synthetic peptide
  Seed: EKVAELVQFL (MAGC3_HUMAN)
EEVAELVQFV

SEQ ID NO: 96511 - protein, 11 aa, Artificial Sequence
  Description of Artificial Sequence: Synthetic peptide
  Seed: TDMDPDNHSYF (MAGC3_HUMAN)
TTMDPDNHSYL

SEQ ID NO: 96512 - protein, 10 aa, Artificial Sequence
  Description of Artificial Sequence: Synthetic peptide
  Seed: SKLSSIIPSA (MAGC3_HUMAN)
SYLSSIIPSA

SEQ ID NO: 96513 - protein, 11 aa, Artificial Sequence
  Description of Artificial Sequence: Synthetic peptide
  Seed: LTDMDPDNHSY (MAGC3_HUMAN)
LSDMDPDNHSW

SEQ ID NO: 96514 - protein, 10 aa, Artificial Sequence
  Description of Artificial Sequence: Synthetic peptide
  Seed: EKVAELVQFL (MAGC3_HUMAN)
EHVAELVQFL

SEQ ID NO: 96515 - protein, 9 aa, Artificial Sequence
  Description of Artificial Sequence: Synthetic peptide
  Seed: KVDKLVQFL (MAGC3_HUMAN)
KMDKLVQFC

SEQ ID NO: 96516 - protein, 9 aa, Artificial Sequence
  Description of Artificial Sequence: Synthetic peptide
  Seed: TSDQRMDSL (MAGC3_HUMAN)
TADQRMDSM

SEQ ID NO: 96517 - protein, 11 aa, Artificial Sequence
  Description of Artificial Sequence: Synthetic peptide
  Seed: RYALDEKVAEL (MAGC3_HUMAN)
RHALDEKVAEV

SEQ ID NO: 96518 - protein, 9 aa, Artificial Sequence
  Description of Artificial Sequence: Synthetic peptide
  Seed: YFFEDTLDL (MAGC3_HUMAN)
YLFEDTLDV

SEQ ID NO: 96519 - protein, 9 aa, Artificial Sequence
  Description of Artificial Sequence: Synthetic peptide
  Seed: SLVLCPTYF (MAGC3_HUMAN)
SKVLCPTYY

SEQ ID NO: 96520 - protein, 10 aa, Artificial Sequence
  Description of Artificial Sequence: Synthetic peptide
  Seed: TLSGSPGLQL (MAGC3_HUMAN)
TQSGSPGLQY

SEQ ID NO: 96521 - protein, 9 aa, Artificial Sequence
  Description of Artificial Sequence: Synthetic peptide
  Seed: MPKNCLLIL (MAGC3_HUMAN)
MPKNCLLIC

SEQ ID NO: 96522 - protein, 9 aa, Artificial Sequence
  Description of Artificial Sequence: Synthetic peptide
  Seed: FHLGHLREV (MAGC3_HUMAN)
FQLGHLREI

SEQ ID NO: 96523 - protein, 9 aa, Artificial Sequence
  Description of Artificial Sequence: Synthetic peptide
  Seed: FHLGHLREV (MAGC3_HUMAN)
FYLGHLREY

SEQ ID NO: 96524 - protein, 9 aa, Artificial Sequence
  Description of Artificial Sequence: Synthetic peptide
  Seed: FSDGSLGQW (MAGC3_HUMAN)
FFDGSLGQY

SEQ ID NO: 96525 - protein, 11 aa, Artificial Sequence
  Description of Artificial Sequence: Synthetic peptide
  Seed: FIELIFGIALT (MAGC3_HUMAN)
FYELIFGIALL

SEQ ID NO: 96526 - protein, 9 aa, Artificial Sequence
  Description of Artificial Sequence: Synthetic peptide
  Seed: VLCPTYFKL (MAGC3_HUMAN)
VVCPTYFKW

SEQ ID NO: 96527 - protein, 9 aa, Artificial Sequence
  Description of Artificial Sequence: Synthetic peptide
  Seed: EKVDKLVQF (MAGC3_HUMAN)
EYVDKLVQF

SEQ ID NO: 96528 - protein, 9 aa, Artificial Sequence
  Description of Artificial Sequence: Synthetic peptide
  Seed: ILILSMIFI (MAGC3_HUMAN)
IMILSMIFA

SEQ ID NO: 96529 - protein, 9 aa, Artificial Sequence
  Description of Artificial Sequence: Synthetic peptide
  Seed: IIPSAFPSW (MAGC3_HUMAN)
IQPSAFPSF

SEQ ID NO: 96530 - protein, 10 aa, Artificial Sequence
  Description of Artificial Sequence: Synthetic peptide
  Seed: IKKYKDYFPM (MAGC3_HUMAN)
IDKYKDYFPF

SEQ ID NO: 96531 - protein, 9 aa, Artificial Sequence
  Description of Artificial Sequence: Synthetic peptide
  Seed: FPSWYMDAL (MAGC3_HUMAN)
FSSWYMDAY

SEQ ID NO: 96532 - protein, 9 aa, Artificial Sequence
  Description of Artificial Sequence: Synthetic peptide
  Seed: KYKDYFPMI (MAGC3_HUMAN)
KAKDYFPMV

SEQ ID NO: 96533 - protein, 9 aa, Artificial Sequence
  Description of Artificial Sequence: Synthetic peptide
  Seed: VDPDHFYVF (MAGC3_HUMAN)
VIPDHFYVF

SEQ ID NO: 96534 - protein, 9 aa, Artificial Sequence
  Description of Artificial Sequence: Synthetic peptide
  Seed: NVINTYTGY (MAGC3_HUMAN)
NMINTYTGY

SEQ ID NO: 96535 - protein, 11 aa, Artificial Sequence
  Description of Artificial Sequence: Synthetic peptide
  Seed: ALWESEGPEAF (MAGC3_HUMAN)
ALWESEGPEAI

SEQ ID NO: 96536 - protein, 9 aa, Artificial Sequence
  Description of Artificial Sequence: Synthetic peptide
  Seed: SLPESEPLF (MAGC3_HUMAN)
SYPESEPLV

SEQ ID NO: 96537 - protein, 10 aa, Artificial Sequence
  Description of Artificial Sequence: Synthetic peptide
  Seed: TGYFPMIFRK (MAGC3_HUMAN)
TVYFPMIFRC

SEQ ID NO: 96538 - protein, 9 aa, Artificial Sequence
  Description of Artificial Sequence: Synthetic peptide
  Seed: FPSWYMDAL (MAGC3_HUMAN)
FVSWYMDAF

SEQ ID NO: 96539 - protein, 9 aa, Artificial Sequence
  Description of Artificial Sequence: Synthetic peptide
  Seed: NTYTGYFPM (MAGC3_HUMAN)
NTYTGYFPI

SEQ ID NO: 96540 - protein, 9 aa, Artificial Sequence
  Description of Artificial Sequence: Synthetic peptide
  Seed: ALDEKVAEL (MAGC3_HUMAN)
AVDEKVAEW

SEQ ID NO: 96541 - protein, 9 aa, Artificial Sequence
  Description of Artificial Sequence: Synthetic peptide
  Seed: VIWEVLSAI (MAGC3_HUMAN)
VAWEVLSAM

SEQ ID NO: 96542 - protein, 10 aa, Artificial Sequence
  Description of Artificial Sequence: Synthetic peptide
  Seed: RLLILILSVI (MAGC3_HUMAN)
RTLILILSVV

SEQ ID NO: 96543 - protein, 9 aa, Artificial Sequence
  Description of Artificial Sequence: Synthetic peptide
  Seed: NVINTYTGY (MAGC3_HUMAN)
NPINTYTGM

SEQ ID NO: 96544 - protein, 9 aa, Artificial Sequence
  Description of Artificial Sequence: Synthetic peptide
  Seed: SAFHLGHLR (MAGC3_HUMAN)
SVFHLGHLL

SEQ ID NO: 96545 - protein, 9 aa, Artificial Sequence
  Description of Artificial Sequence: Synthetic peptide
  Seed: EVIWEVLSA (MAGC3_HUMAN)
EVIWEVLSL

SEQ ID NO: 96546 - protein, 9 aa, Artificial Sequence
  Description of Artificial Sequence: Synthetic peptide
  Seed: HFYVFVNTL (MAGC3_HUMAN)
HRYVFVNTY

SEQ ID NO: 96547 - protein, 9 aa, Artificial Sequence
  Description of Artificial Sequence: Synthetic peptide
  Seed: VLCPTYFKL (MAGC3_HUMAN)
VYCPTYFKY

SEQ ID NO: 96548 - protein, 9 aa, Artificial Sequence
  Description of Artificial Sequence: Synthetic peptide
  Seed: KKYKDYFPM (MAGC3_HUMAN)
KIYKDYFPY

SEQ ID NO: 96549 - protein, 9 aa, Artificial Sequence
  Description of Artificial Sequence: Synthetic peptide
  Seed: KLVQFLLLK (MAGC3_HUMAN)
KMVQFLLLL

SEQ ID NO: 96550 - protein, 10 aa, Artificial Sequence
  Description of Artificial Sequence: Synthetic peptide
  Seed: KLSSIIPSAF (MAGC3_HUMAN)
KTSSIIPSAK

SEQ ID NO: 96551 - protein, 10 aa, Artificial Sequence
  Description of Artificial Sequence: Synthetic peptide
  Seed: EEVIWEVLSA (MAGC3_HUMAN)
ETVIWEVLSA

SEQ ID NO: 96552 - protein, 9 aa, Artificial Sequence
  Description of Artificial Sequence: Synthetic peptide
  Seed: ALAGFADVL (MAGC3_HUMAN)
ALAGFADVY

SEQ ID NO: 96553 - protein, 10 aa, Artificial Sequence
  Description of Artificial Sequence: Synthetic peptide
  Seed: VVLPPQPQPR (MAGC3_HUMAN)
VILPPQPQPK

SEQ ID NO: 96554 - protein, 10 aa, Artificial Sequence
  Description of Artificial Sequence: Synthetic peptide
  Seed: ATYALSPVVL (MAGC3_HUMAN)
AAYALSPVVF

SEQ ID NO: 96555 - protein, 9 aa, Artificial Sequence
  Description of Artificial Sequence: Synthetic peptide
  Seed: LANPQGLAG (MAGC3_HUMAN)
LTNPQGLAL

SEQ ID NO: 96556 - protein, 11 aa, Artificial Sequence
  Description of Artificial Sequence: Synthetic peptide
  Seed: RTLSGSPGLQL (MAGC3_HUMAN)
RALSGSPGLQW

SEQ ID NO: 96557 - protein, 9 aa, Artificial Sequence
  Description of Artificial Sequence: Synthetic peptide
  Seed: KVDKLVQFL (MAGC3_HUMAN)
KGDKLVQFV

SEQ ID NO: 96558 - protein, 11 aa, Artificial Sequence
  Description of Artificial Sequence: Synthetic peptide
  Seed: VINTYTGYFPM (MAGC3_HUMAN)
VTNTYTGYFPW

SEQ ID NO: 96559 - protein, 10 aa, Artificial Sequence
  Description of Artificial Sequence: Synthetic peptide
  Seed: YTLDEKVDKL (MAGC3_HUMAN)
YSLDEKVDKL

SEQ ID NO: 96560 - protein, 9 aa, Artificial Sequence
  Description of Artificial Sequence: Synthetic peptide
  Seed: DYSAFHLGH (MAGC3_HUMAN)
DASAFHLGR

SEQ ID NO: 96561 - protein, 9 aa, Artificial Sequence
  Description of Artificial Sequence: Synthetic peptide
  Seed: SLRRAVSVK (MAGC3_HUMAN)
SSRRAVSVY

SEQ ID NO: 96562 - protein, 9 aa, Artificial Sequence
  Description of Artificial Sequence: Synthetic peptide
  Seed: VLPPQPQPR (MAGC3_HUMAN)
VMPPQPQPF

SEQ ID NO: 96563 - protein, 10 aa, Artificial Sequence
  Description of Artificial Sequence: Synthetic peptide
  Seed: EVIWEVLSAI (MAGC3_HUMAN)
ETIWEVLSAV

SEQ ID NO: 96564 - protein, 9 aa, Artificial Sequence
  Description of Artificial Sequence: Synthetic peptide
  Seed: VDKLVQFLL (MAGC3_HUMAN)
VEKLVQFLL

SEQ ID NO: 96565 - protein, 10 aa, Artificial Sequence
  Description of Artificial Sequence: Synthetic peptide
  Seed: MDPDNHSYFF (MAGC3_HUMAN)
MEPDNHSYFM

SEQ ID NO: 96566 - protein, 9 aa, Artificial Sequence
  Description of Artificial Sequence: Synthetic peptide
  Seed: AMASASPSV (MAGC3_HUMAN)
AQASASPSY

SEQ ID NO: 96567 - protein, 9 aa, Artificial Sequence
  Description of Artificial Sequence: Synthetic peptide
  Seed: IQRPAREVL (MAGC3_HUMAN)
IGRPAREVY

SEQ ID NO: 96568 - protein, 9 aa, Artificial Sequence
  Description of Artificial Sequence: Synthetic peptide
  Seed: IPPQGPPKI (MAGC3_HUMAN)
IVPQGPPKY

SEQ ID NO: 96569 - protein, 11 aa, Artificial Sequence
  Description of Artificial Sequence: Synthetic peptide
  Seed: YTGYFPMIFRK (MAGC3_HUMAN)
YKGYFPMIFRR

SEQ ID NO: 96570 - protein, 10 aa, Artificial Sequence
  Description of Artificial Sequence: Synthetic peptide
  Seed: YALDEKVAEL (MAGC3_HUMAN)
YQLDEKVAEC

SEQ ID NO: 96571 - protein, 9 aa, Artificial Sequence
  Description of Artificial Sequence: Synthetic peptide
  Seed: KYKDYFPMI (MAGC3_HUMAN)
KLKDYFPMY

SEQ ID NO: 96572 - protein, 9 aa, Artificial Sequence
  Description of Artificial Sequence: Synthetic peptide
  Seed: NCASEEVIW (MAGC3_HUMAN)
NSASEEVIW

SEQ ID NO: 96573 - protein, 9 aa, Artificial Sequence
  Description of Artificial Sequence: Synthetic peptide
  Seed: IIPSAFPSW (MAGC3_HUMAN)
ISPSAFPSF

SEQ ID NO: 96574 - protein, 9 aa, Artificial Sequence
  Description of Artificial Sequence: Synthetic peptide
  Seed: HALPESESL (MAGC3_HUMAN)
HDLPESESL

SEQ ID NO: 96575 - protein, 9 aa, Artificial Sequence
  Description of Artificial Sequence: Synthetic peptide
  Seed: TLDEKVDKL (MAGC3_HUMAN)
TADEKVDKV

SEQ ID NO: 96576 - protein, 10 aa, Artificial Sequence
  Description of Artificial Sequence: Synthetic peptide
  Seed: IGPWSALAGF (MAGC3_HUMAN)
IFPWSALAGY

SEQ ID NO: 96577 - protein, 9 aa, Artificial Sequence
  Description of Artificial Sequence: Synthetic peptide
  Seed: AIIDTTDDA (MAGC3_HUMAN)
AMIDTTDDI

SEQ ID NO: 96578 - protein, 10 aa, Artificial Sequence
  Description of Artificial Sequence: Synthetic peptide
  Seed: RLLILILSVI (MAGC3_HUMAN)
RCLILILSVV

SEQ ID NO: 96579 - protein, 9 aa, Artificial Sequence
  Description of Artificial Sequence: Synthetic peptide
  Seed: DYFPMIFGK (MAGC3_HUMAN)
DNFPMIFGK

SEQ ID NO: 96580 - protein, 10 aa, Artificial Sequence
  Description of Artificial Sequence: Synthetic peptide
  Seed: KATDKDYSAF (MAGC3_HUMAN)
KQTDKDYSAL

SEQ ID NO: 96581 - protein, 11 aa, Artificial Sequence
  Description of Artificial Sequence: Synthetic peptide
  Seed: NTYTGYFPMIF (MAGC3_HUMAN)
NRYTGYFPMIF

SEQ ID NO: 96582 - protein, 9 aa, Artificial Sequence
  Description of Artificial Sequence: Synthetic peptide
  Seed: AVSPGKRLW (MAGC3_HUMAN)
AASPGKRLV

SEQ ID NO: 96583 - protein, 10 aa, Artificial Sequence
  Description of Artificial Sequence: Synthetic peptide
  Seed: LANPQGLAGH (MAGC3_HUMAN)
LANPQGLAGF

SEQ ID NO: 96584 - protein, 9 aa, Artificial Sequence
  Description of Artificial Sequence: Synthetic peptide
  Seed: KYKDYFPMI (MAGC3_HUMAN)
KSKDYFPMY

SEQ ID NO: 96585 - protein, 9 aa, Artificial Sequence
  Description of Artificial Sequence: Synthetic peptide
  Seed: SAIGPIQRP (MAGC3_HUMAN)
SAIGPIQRY

SEQ ID NO: 96586 - protein, 9 aa, Artificial Sequence
  Description of Artificial Sequence: Synthetic peptide
  Seed: RTLSGSPGL (MAGC3_HUMAN)
RALSGSPGR

SEQ ID NO: 96587 - protein, 9 aa, Artificial Sequence
  Description of Artificial Sequence: Synthetic peptide
  Seed: RQEDGRRGL (MAGC3_HUMAN)
RQEDGRRGF

SEQ ID NO: 96588 - protein, 9 aa, Artificial Sequence
  Description of Artificial Sequence: Synthetic peptide
  Seed: DGSLGQWVK (MAGC3_HUMAN)
DLSLGQWVR

SEQ ID NO: 96589 - protein, 9 aa, Artificial Sequence
  Description of Artificial Sequence: Synthetic peptide
  Seed: LDEKVAELV (MAGC3_HUMAN)
LEEKVAELV

SEQ ID NO: 96590 - protein, 10 aa, Artificial Sequence
  Description of Artificial Sequence: Synthetic peptide
  Seed: TEVDPDHFYV (MAGC3_HUMAN)
TEVDPDHFYY

SEQ ID NO: 96591 - protein, 9 aa, Artificial Sequence
  Description of Artificial Sequence: Synthetic peptide
  Seed: VINTYTGYF (MAGC3_HUMAN)
VANTYTGYY

SEQ ID NO: 96592 - protein, 9 aa, Artificial Sequence
  Description of Artificial Sequence: Synthetic peptide
  Seed: YKDYFPMIF (MAGC3_HUMAN)
YWDYFPMIF

SEQ ID NO: 96593 - protein, 9 aa, Artificial Sequence
  Description of Artificial Sequence: Synthetic peptide
  Seed: RAEMQMNVI (MAGC3_HUMAN)
RAEMQMNVM

SEQ ID NO: 96594 - protein, 10 aa, Artificial Sequence
  Description of Artificial Sequence: Synthetic peptide
  Seed: WVKNTCATYA (MAGC3_HUMAN)
WMKNTCATYY

SEQ ID NO: 96595 - protein, 9 aa, Artificial Sequence
  Description of Artificial Sequence: Synthetic peptide
  Seed: MIFRKAREF (MAGC3_HUMAN)
MLFRKAREI

SEQ ID NO: 96596 - protein, 9 aa, Artificial Sequence
  Description of Artificial Sequence: Synthetic peptide
  Seed: KVDKLVQFL (MAGC3_HUMAN)
KIDKLVQFM

SEQ ID NO: 96597 - protein, 9 aa, Artificial Sequence
  Description of Artificial Sequence: Synthetic peptide
  Seed: YFFEDTLDL (MAGC3_HUMAN)
YSFEDTLDL

SEQ ID NO: 96598 - protein, 11 aa, Artificial Sequence
  Description of Artificial Sequence: Synthetic peptide
  Seed: TSDQRMDSLVL (MAGC3_HUMAN)
TADQRMDSLVF

SEQ ID NO: 96599 - protein, 9 aa, Artificial Sequence
  Description of Artificial Sequence: Synthetic peptide
  Seed: MLLPCHWVL (MAGC3_HUMAN)
MLLPCHWVA

SEQ ID NO: 96600 - protein, 9 aa, Artificial Sequence
  Description of Artificial Sequence: Synthetic peptide
  Seed: ALDEKVAEL (MAGC3_HUMAN)
ASDEKVAEM

SEQ ID NO: 96601 - protein, 9 aa, Artificial Sequence
  Description of Artificial Sequence: Synthetic peptide
  Seed: FVNTLDLTC (MAGC3_HUMAN)
FTNTLDLTL

SEQ ID NO: 96602 - protein, 9 aa, Artificial Sequence
  Description of Artificial Sequence: Synthetic peptide
  Seed: VLPPQPQPR (MAGC3_HUMAN)
VIPPQPQPM

SEQ ID NO: 96603 - protein, 9 aa, Artificial Sequence
  Description of Artificial Sequence: Synthetic peptide
  Seed: HLREVRLFL (MAGC3_HUMAN)
HLREVRLFK

SEQ ID NO: 96604 - protein, 11 aa, Artificial Sequence
  Description of Artificial Sequence: Synthetic peptide
  Seed: RTLSGSPGLQL (MAGC3_HUMAN)
RQLSGSPGLQV

SEQ ID NO: 96605 - protein, 9 aa, Artificial Sequence
  Description of Artificial Sequence: Synthetic peptide
  Seed: HFYVFVNTL (MAGC3_HUMAN)
HWYVFVNTI

SEQ ID NO: 96606 - protein, 9 aa, Artificial Sequence
  Description of Artificial Sequence: Synthetic peptide
  Seed: MASASPSVM (MAGC3_HUMAN)
MMSASPSVV

SEQ ID NO: 96607 - protein, 10 aa, Artificial Sequence
  Description of Artificial Sequence: Synthetic peptide
  Seed: YALSPVVLPP (MAGC3_HUMAN)
YFLSPVVLPI

SEQ ID NO: 96608 - protein, 10 aa, Artificial Sequence
  Description of Artificial Sequence: Synthetic peptide
  Seed: MDPDNHSYFF (MAGC3_HUMAN)
MYPDNHSYFM

SEQ ID NO: 96609 - protein, 11 aa, Artificial Sequence
  Description of Artificial Sequence: Synthetic peptide
  Seed: IDDQGMPKNCL (MAGC3_HUMAN)
ISDQGMPKNCL

SEQ ID NO: 96610 - protein, 9 aa, Artificial Sequence
  Description of Artificial Sequence: Synthetic peptide
  Seed: SQPEGKFSL (MAGC3_HUMAN)
SMPEGKFSW

SEQ ID NO: 96611 - protein, 9 aa, Artificial Sequence
  Description of Artificial Sequence: Synthetic peptide
  Seed: FPMIFRKAR (MAGC3_HUMAN)
FPMIFRKAM

SEQ ID NO: 96612 - protein, 10 aa, Artificial Sequence
  Description of Artificial Sequence: Synthetic peptide
  Seed: NAIGPWSALA (MAGC3_HUMAN)
NVIGPWSALV

SEQ ID NO: 96613 - protein, 11 aa, Artificial Sequence
  Description of Artificial Sequence: Synthetic peptide
  Seed: LTDMDPDNHSY (MAGC3_HUMAN)
LVDMDPDNHSF

SEQ ID NO: 96614 - protein, 9 aa, Artificial Sequence
  Description of Artificial Sequence: Synthetic peptide
  Seed: SAIGPIQRP (MAGC3_HUMAN)
STIGPIQRL

SEQ ID NO: 96615 - protein, 10 aa, Artificial Sequence
  Description of Artificial Sequence: Synthetic peptide
  Seed: RPAREVLEFL (MAGC3_HUMAN)
RYAREVLEFA

SEQ ID NO: 96616 - protein, 9 aa, Artificial Sequence
  Description of Artificial Sequence: Synthetic peptide
  Seed: SLPESEPLF (MAGC3_HUMAN)
SIPESEPLM

SEQ ID NO: 96617 - protein, 9 aa, Artificial Sequence
  Description of Artificial Sequence: Synthetic peptide
  Seed: MIFGKAHEF (MAGC3_HUMAN)
MYFGKAHEY

SEQ ID NO: 96618 - protein, 9 aa, Artificial Sequence
  Description of Artificial Sequence: Synthetic peptide
  Seed: SEEEDTATW (MAGC3_HUMAN)
SAEEDTATF

SEQ ID NO: 96619 - protein, 9 aa, Artificial Sequence
  Description of Artificial Sequence: Synthetic peptide
  Seed: SAEGSVLDL (MAGC3_HUMAN)
SFEGSVLDM

SEQ ID NO: 96620 - protein, 9 aa, Artificial Sequence
  Description of Artificial Sequence: Synthetic peptide
  Seed: TGYFPMIFR (MAGC3_HUMAN)
TNYFPMIFK

SEQ ID NO: 96621 - protein, 9 aa, Artificial Sequence
  Description of Artificial Sequence: Synthetic peptide
  Seed: KAHEFIELI (MAGC3_HUMAN)
KLHEFIELI

SEQ ID NO: 96622 - protein, 9 aa, Artificial Sequence
  Description of Artificial Sequence: Synthetic peptide
  Seed: KYKDYFPMI (MAGC3_HUMAN)
KLKDYFPMR

SEQ ID NO: 96623 - protein, 10 aa, Artificial Sequence
  Description of Artificial Sequence: Synthetic peptide
  Seed: TTDDATAMAS (MAGC3_HUMAN)
TADDATAMAM

SEQ ID NO: 96624 - protein, 10 aa, Artificial Sequence
  Description of Artificial Sequence: Synthetic peptide
  Seed: EVIWEVLSAI (MAGC3_HUMAN)
ELIWEVLSAM

SEQ ID NO: 96625 - protein, 9 aa, Artificial Sequence
  Description of Artificial Sequence: Synthetic peptide
  Seed: GSLPESEPL (MAGC3_HUMAN)
GQLPESEPV

SEQ ID NO: 96626 - protein, 9 aa, Artificial Sequence
  Description of Artificial Sequence: Synthetic peptide
  Seed: GMPQNRLLI (MAGC3_HUMAN)
GVPQNRLLL

SEQ ID NO: 96627 - protein, 9 aa, Artificial Sequence
  Description of Artificial Sequence: Synthetic peptide
  Seed: ATYALSPVV (MAGC3_HUMAN)
AVYALSPVW

SEQ ID NO: 96628 - protein, 10 aa, Artificial Sequence
  Description of Artificial Sequence: Synthetic peptide
  Seed: REVLEFLSKL (MAGC3_HUMAN)
RFVLEFLSKV

SEQ ID NO: 96629 - protein, 9 aa, Artificial Sequence
  Description of Artificial Sequence: Synthetic peptide
  Seed: LSDEQGMPQ (MAGC3_HUMAN)
LYDEQGMPM

SEQ ID NO: 96630 - protein, 8 aa, Artificial Sequence
  Description of Artificial Sequence: Synthetic peptide
  Seed: MEDRAQAI (MAGC3_HUMAN)
MSDRAQAM

SEQ ID NO: 96631 - protein, 11 aa, Artificial Sequence
  Description of Artificial Sequence: Synthetic peptide
  Seed: EVLSAIGPIQR (MAGC3_HUMAN)
EYLSAIGPIQK

SEQ ID NO: 96632 - protein, 9 aa, Artificial Sequence
  Description of Artificial Sequence: Synthetic peptide
  Seed: FHLGHLREV (MAGC3_HUMAN)
FSLGHLREV

SEQ ID NO: 96633 - protein, 8 aa, Artificial Sequence
  Description of Artificial Sequence: Synthetic peptide
  Seed: IDDQGMPK (MAGC3_HUMAN)
IADQGMPL

SEQ ID NO: 96634 - protein, 9 aa, Artificial Sequence
  Description of Artificial Sequence: Synthetic peptide
  Seed: FADVLSRLA (MAGC3_HUMAN)
FFDVLSRLF

SEQ ID NO: 96635 - protein, 9 aa, Artificial Sequence
  Description of Artificial Sequence: Synthetic peptide
  Seed: MIFGKAHEF (MAGC3_HUMAN)
MNFGKAHEY

SEQ ID NO: 96636 - protein, 10 aa, Artificial Sequence
  Description of Artificial Sequence: Synthetic peptide
  Seed: MPAAGMPPLP (MAGC3_HUMAN)
MRAAGMPPLY

SEQ ID NO: 96637 - protein, 9 aa, Artificial Sequence
  Description of Artificial Sequence: Synthetic peptide
  Seed: LSSIIPSAF (MAGC3_HUMAN)
LRSIIPSAL

SEQ ID NO: 96638 - protein, 10 aa, Artificial Sequence
  Description of Artificial Sequence: Synthetic peptide
  Seed: SIIPSAFPSW (MAGC3_HUMAN)
SYIPSAFPSV

SEQ ID NO: 96639 - protein, 9 aa, Artificial Sequence
  Description of Artificial Sequence: Synthetic peptide
  Seed: LSGSPGLQL (MAGC3_HUMAN)
LIGSPGLQY

SEQ ID NO: 96640 - protein, 10 aa, Artificial Sequence
  Description of Artificial Sequence: Synthetic peptide
  Seed: YALDEKVAEL (MAGC3_HUMAN)
YELDEKVAEM

SEQ ID NO: 96641 - protein, 9 aa, Artificial Sequence
  Description of Artificial Sequence: Synthetic peptide
  Seed: HSYFFEDTL (MAGC3_HUMAN)
HIYFFEDTY

SEQ ID NO: 96642 - protein, 9 aa, Artificial Sequence
  Description of Artificial Sequence: Synthetic peptide
  Seed: YQAKEPLTR (MAGC3_HUMAN)
YSAKEPLTI

SEQ ID NO: 96643 - protein, 9 aa, Artificial Sequence
  Description of Artificial Sequence: Synthetic peptide
  Seed: EVIWEVLSA (MAGC3_HUMAN)
EAIWEVLSK

SEQ ID NO: 96644 - protein, 9 aa, Artificial Sequence
  Description of Artificial Sequence: Synthetic peptide
  Seed: VLPPQPQPR (MAGC3_HUMAN)
VLPPQPQPY

SEQ ID NO: 96645 - protein, 9 aa, Artificial Sequence
  Description of Artificial Sequence: Synthetic peptide
  Seed: FEDTLDLTY (MAGC3_HUMAN)
FEDTLDLTA

SEQ ID NO: 96646 - protein, 9 aa, Artificial Sequence
  Description of Artificial Sequence: Synthetic peptide
  Seed: MQMNVINTY (MAGC3_HUMAN)
MLMNVINTF

SEQ ID NO: 96647 - protein, 9 aa, Artificial Sequence
  Description of Artificial Sequence: Synthetic peptide
  Seed: MQMNVINTY (MAGC3_HUMAN)
MQMNVINTH

SEQ ID NO: 96648 - protein, 9 aa, Artificial Sequence
  Description of Artificial Sequence: Synthetic peptide
  Seed: SLVLCPTYF (MAGC3_HUMAN)
SPVLCPTYY

SEQ ID NO: 96649 - protein, 11 aa, Artificial Sequence
  Description of Artificial Sequence: Synthetic peptide
  Seed: LSKLSSIIPSA (MAGC3_HUMAN)
LWKLSSIIPSL

SEQ ID NO: 96650 - protein, 9 aa, Artificial Sequence
  Description of Artificial Sequence: Synthetic peptide
  Seed: RPAREVLEF (MAGC3_HUMAN)
REAREVLEY

SEQ ID NO: 96651 - protein, 9 aa, Artificial Sequence
  Description of Artificial Sequence: Synthetic peptide
  Seed: HLREVRLFL (MAGC3_HUMAN)
HVREVRLFI

SEQ ID NO: 96652 - protein, 9 aa, Artificial Sequence
  Description of Artificial Sequence: Synthetic peptide
  Seed: WESEGPEAF (MAGC3_HUMAN)
WLSEGPEAY

SEQ ID NO: 96653 - protein, 10 aa, Artificial Sequence
  Description of Artificial Sequence: Synthetic peptide
  Seed: SPLDSCSSPL (MAGC3_HUMAN)
SLLDSCSSPM

SEQ ID NO: 96654 - protein, 11 aa, Artificial Sequence
  Description of Artificial Sequence: Synthetic peptide
  Seed: SLVLCPTYFKL (MAGC3_HUMAN)
SLVLCPTYFKV

SEQ ID NO: 96655 - protein, 10 aa, Artificial Sequence
  Description of Artificial Sequence: Synthetic peptide
  Seed: TGYFPMIFRK (MAGC3_HUMAN)
TMYFPMIFRE

SEQ ID NO: 96656 - protein, 9 aa, Artificial Sequence
  Description of Artificial Sequence: Synthetic peptide
  Seed: TAMASASPS (MAGC3_HUMAN)
TPMASASPI

SEQ ID NO: 96657 - protein, 11 aa, Artificial Sequence
  Description of Artificial Sequence: Synthetic peptide
  Seed: TTDDATAMASA (MAGC3_HUMAN)
TSDDATAMASY

SEQ ID NO: 96658 - protein, 11 aa, Artificial Sequence
  Description of Artificial Sequence: Synthetic peptide
  Seed: AEMQMNVINTY (MAGC3_HUMAN)
AVMQMNVINTY

SEQ ID NO: 96659 - protein, 10 aa, Artificial Sequence
  Description of Artificial Sequence: Synthetic peptide
  Seed: CASEEVIWEV (MAGC3_HUMAN)
CMSEEVIWEM

SEQ ID NO: 96660 - protein, 10 aa, Artificial Sequence
  Description of Artificial Sequence: Synthetic peptide
  Seed: CLLILILSMI (MAGC3_HUMAN)
CMLILILSMV

SEQ ID NO: 96661 - protein, 10 aa, Artificial Sequence
  Description of Artificial Sequence: Synthetic peptide
  Seed: SKLSSIIPSA (MAGC3_HUMAN)
SGLSSIIPSV

SEQ ID NO: 96662 - protein, 9 aa, Artificial Sequence
  Description of Artificial Sequence: Synthetic peptide
  Seed: DYFPMIFGK (MAGC3_HUMAN)
DGFPMIFGR

SEQ ID NO: 96663 - protein, 9 aa, Artificial Sequence
  Description of Artificial Sequence: Synthetic peptide
  Seed: NTYTGYFPM (MAGC3_HUMAN)
NWYTGYFPY

SEQ ID NO: 96664 - protein, 10 aa, Artificial Sequence
  Description of Artificial Sequence: Synthetic peptide
  Seed: KKYKDYFPMI (MAGC3_HUMAN)
KPYKDYFPMK

SEQ ID NO: 96665 - protein, 9 aa, Artificial Sequence
  Description of Artificial Sequence: Synthetic peptide
  Seed: NTYTGYFPM (MAGC3_HUMAN)
NPYTGYFPA

SEQ ID NO: 96666 - protein, 10 aa, Artificial Sequence
  Description of Artificial Sequence: Synthetic peptide
  Seed: SPLDSCSSPL (MAGC3_HUMAN)
STLDSCSSPV

SEQ ID NO: 96667 - protein, 9 aa, Artificial Sequence
  Description of Artificial Sequence: Synthetic peptide
  Seed: SLVLCPTYF (MAGC3_HUMAN)
SAVLCPTYM

SEQ ID NO: 96668 - protein, 11 aa, Artificial Sequence
  Description of Artificial Sequence: Synthetic peptide
  Seed: KVAELVQFLLL (MAGC3_HUMAN)
KTAELVQFLLF

SEQ ID NO: 96669 - protein, 10 aa, Artificial Sequence
  Description of Artificial Sequence: Synthetic peptide
  Seed: RLWGEKAGSL (MAGC3_HUMAN)
RQWGEKAGSI

SEQ ID NO: 96670 - protein, 10 aa, Artificial Sequence
  Description of Artificial Sequence: Synthetic peptide
  Seed: FLSKLSSIIP (MAGC3_HUMAN)
FLSKLSSIIV

SEQ ID NO: 96671 - protein, 9 aa, Artificial Sequence
  Description of Artificial Sequence: Synthetic peptide
  Seed: HSYFFEDTL (MAGC3_HUMAN)
HQYFFEDTF

SEQ ID NO: 96672 - protein, 9 aa, Artificial Sequence
  Description of Artificial Sequence: Synthetic peptide
  Seed: LKYQAKEPL (MAGC3_HUMAN)
LKYQAKEPF

SEQ ID NO: 96673 - protein, 9 aa, Artificial Sequence
  Description of Artificial Sequence: Synthetic peptide
  Seed: MIFGKAHEF (MAGC3_HUMAN)
MQFGKAHEA

SEQ ID NO: 96674 - protein, 10 aa, Artificial Sequence
  Description of Artificial Sequence: Synthetic peptide
  Seed: AELVQFLLLK (MAGC3_HUMAN)
AILVQFLLLK

SEQ ID NO: 96675 - protein, 9 aa, Artificial Sequence
  Description of Artificial Sequence: Synthetic peptide
  Seed: HALPESESL (MAGC3_HUMAN)
HHLPESESV

SEQ ID NO: 96676 - protein, 9 aa, Artificial Sequence
  Description of Artificial Sequence: Synthetic peptide
  Seed: VLPPQPQPR (MAGC3_HUMAN)
VCPPQPQPL

SEQ ID NO: 96677 - protein, 10 aa, Artificial Sequence
  Description of Artificial Sequence: Synthetic peptide
  Seed: IELIFGIALT (MAGC3_HUMAN)
IQLIFGIALL

SEQ ID NO: 96678 - protein, 9 aa, Artificial Sequence
  Description of Artificial Sequence: Synthetic peptide
  Seed: MLLPCHWVL (MAGC3_HUMAN)
MNLPCHWVY

SEQ ID NO: 96679 - protein, 10 aa, Artificial Sequence
  Description of Artificial Sequence: Synthetic peptide
  Seed: SSEEEDTATW (MAGC3_HUMAN)
SEEEEDTATW

SEQ ID NO: 96680 - protein, 10 aa, Artificial Sequence
  Description of Artificial Sequence: Synthetic peptide
  Seed: SIIPSAFPSW (MAGC3_HUMAN)
SQIPSAFPSW

SEQ ID NO: 96681 - protein, 9 aa, Artificial Sequence
  Description of Artificial Sequence: Synthetic peptide
  Seed: FHLGHLREV (MAGC3_HUMAN)
FNLGHLREM

SEQ ID NO: 96682 - protein, 9 aa, Artificial Sequence
  Description of Artificial Sequence: Synthetic peptide
  Seed: SVLDLANPQ (MAGC3_HUMAN)
SSLDLANPR

SEQ ID NO: 96683 - protein, 9 aa, Artificial Sequence
  Description of Artificial Sequence: Synthetic peptide
  Seed: SASPSVMST (MAGC3_HUMAN)
SSSPSVMSL

SEQ ID NO: 96684 - protein, 9 aa, Artificial Sequence
  Description of Artificial Sequence: Synthetic peptide
  Seed: FADVLSRLA (MAGC3_HUMAN)
FGDVLSRLL

SEQ ID NO: 96685 - protein, 10 aa, Artificial Sequence
  Description of Artificial Sequence: Synthetic peptide
  Seed: TLDEKVDKLV (MAGC3_HUMAN)
TIDEKVDKLM

SEQ ID NO: 96686 - protein, 9 aa, Artificial Sequence
  Description of Artificial Sequence: Synthetic peptide
  Seed: LKYQAKEPL (MAGC3_HUMAN)
LFYQAKEPF

SEQ ID NO: 96687 - protein, 9 aa, Artificial Sequence
  Description of Artificial Sequence: Synthetic peptide
  Seed: LSSIIPSAF (MAGC3_HUMAN)
LVSIIPSAL

SEQ ID NO: 96688 - protein, 9 aa, Artificial Sequence
  Description of Artificial Sequence: Synthetic peptide
  Seed: LKYQAKEPL (MAGC3_HUMAN)
LAYQAKEPY

SEQ ID NO: 96689 - protein, 9 aa, Artificial Sequence
  Description of Artificial Sequence: Synthetic peptide
  Seed: MIFRKAREF (MAGC3_HUMAN)
MAFRKAREV

SEQ ID NO: 96690 - protein, 9 aa, Artificial Sequence
  Description of Artificial Sequence: Synthetic peptide
  Seed: NTYTGYFPM (MAGC3_HUMAN)
NMYTGYFPI

SEQ ID NO: 96691 - protein, 10 aa, Artificial Sequence
  Description of Artificial Sequence: Synthetic peptide
  Seed: RSAEGSVLDL (MAGC3_HUMAN)
RGAEGSVLDW

SEQ ID NO: 96692 - protein, 9 aa, Artificial Sequence
  Description of Artificial Sequence: Synthetic peptide
  Seed: MPAAGMPPL (MAGC3_HUMAN)
MQAAGMPPL

SEQ ID NO: 96693 - protein, 9 aa, Artificial Sequence
  Description of Artificial Sequence: Synthetic peptide
  Seed: SPPEIPPQG (MAGC3_HUMAN)
SAPEIPPQV

SEQ ID NO: 96694 - protein, 9 aa, Artificial Sequence
  Description of Artificial Sequence: Synthetic peptide
  Seed: KAHEFIELI (MAGC3_HUMAN)
KLHEFIELC

SEQ ID NO: 96695 - protein, 9 aa, Artificial Sequence
  Description of Artificial Sequence: Synthetic peptide
  Seed: YFFEDTLDL (MAGC3_HUMAN)
YQFEDTLDM

SEQ ID NO: 96696 - protein, 9 aa, Artificial Sequence
  Description of Artificial Sequence: Synthetic peptide
  Seed: SESLPRYAL (MAGC3_HUMAN)
SHSLPRYAI

SEQ ID NO: 96697 - protein, 9 aa, Artificial Sequence
  Description of Artificial Sequence: Synthetic peptide
  Seed: SIIPSAFPS (MAGC3_HUMAN)
SMIPSAFPT

SEQ ID NO: 96698 - protein, 10 aa, Artificial Sequence
  Description of Artificial Sequence: Synthetic peptide
  Seed: EVIWEVLSAI (MAGC3_HUMAN)
ETIWEVLSAY

SEQ ID NO: 96699 - protein, 9 aa, Artificial Sequence
  Description of Artificial Sequence: Synthetic peptide
  Seed: LLILILSVI (MAGC3_HUMAN)
LMILILSVI

SEQ ID NO: 96700 - protein, 9 aa, Artificial Sequence
  Description of Artificial Sequence: Synthetic peptide
  Seed: EVLEFLSKL (MAGC3_HUMAN)
ESLEFLSKR

SEQ ID NO: 96701 - protein, 10 aa, Artificial Sequence
  Description of Artificial Sequence: Synthetic peptide
  Seed: REVRLFLRGG (MAGC3_HUMAN)
RWVRLFLRGK

SEQ ID NO: 96702 - protein, 9 aa, Artificial Sequence
  Description of Artificial Sequence: Synthetic peptide
  Seed: LSDEQGMPQ (MAGC3_HUMAN)
LSDEQGMPM

SEQ ID NO: 96703 - protein, 9 aa, Artificial Sequence
  Description of Artificial Sequence: Synthetic peptide
  Seed: TGYFPMIFR (MAGC3_HUMAN)
TQYFPMIFR

SEQ ID NO: 96704 - protein, 11 aa, Artificial Sequence
  Description of Artificial Sequence: Synthetic peptide
  Seed: TSDQRMDSLVL (MAGC3_HUMAN)
TMDQRMDSLVY

SEQ ID NO: 96705 - protein, 9 aa, Artificial Sequence
  Description of Artificial Sequence: Synthetic peptide
  Seed: MQMNVINTY (MAGC3_HUMAN)
MTMNVINTF

SEQ ID NO: 96706 - protein, 9 aa, Artificial Sequence
  Description of Artificial Sequence: Synthetic peptide
  Seed: MASASPSVM (MAGC3_HUMAN)
MISASPSVW

SEQ ID NO: 96707 - protein, 11 aa, Artificial Sequence
  Description of Artificial Sequence: Synthetic peptide
  Seed: SASPSVMSTNF (MAGC3_HUMAN)
SCSPSVMSTNW

SEQ ID NO: 96708 - protein, 9 aa, Artificial Sequence
  Description of Artificial Sequence: Synthetic peptide
  Seed: DYFPMIFGK (MAGC3_HUMAN)
DMFPMIFGK

SEQ ID NO: 96709 - protein, 9 aa, Artificial Sequence
  Description of Artificial Sequence: Synthetic peptide
  Seed: LVLCPTYFK (MAGC3_HUMAN)
LNLCPTYFR

SEQ ID NO: 96710 - protein, 11 aa, Artificial Sequence
  Description of Artificial Sequence: Synthetic peptide
  Seed: TTDDATAMASA (MAGC3_HUMAN)
TVDDATAMASY

SEQ ID NO: 96711 - protein, 9 aa, Artificial Sequence
  Description of Artificial Sequence: Synthetic peptide
  Seed: YSAFHLGHL (MAGC3_HUMAN)
YLAFHLGHC

SEQ ID NO: 96712 - protein, 10 aa, Artificial Sequence
  Description of Artificial Sequence: Synthetic peptide
  Seed: MDSLVLCPTY (MAGC3_HUMAN)
MKSLVLCPTM

SEQ ID NO: 96713 - protein, 9 aa, Artificial Sequence
  Description of Artificial Sequence: Synthetic peptide
  Seed: YQAKEPLTR (MAGC3_HUMAN)
YSAKEPLTH

SEQ ID NO: 96714 - protein, 9 aa, Artificial Sequence
  Description of Artificial Sequence: Synthetic peptide
  Seed: EVIWEVLSA (MAGC3_HUMAN)
EAIWEVLSR

SEQ ID NO: 96715 - protein, 10 aa, Artificial Sequence
  Description of Artificial Sequence: Synthetic peptide
  Seed: LPTWRRGTGY (MAGC3_HUMAN)
LLTWRRGTGF

SEQ ID NO: 96716 - protein, 10 aa, Artificial Sequence
  Description of Artificial Sequence: Synthetic peptide
  Seed: LLKYQAKEPL (MAGC3_HUMAN)
LGKYQAKEPY

SEQ ID NO: 96717 - protein, 9 aa, Artificial Sequence
  Description of Artificial Sequence: Synthetic peptide
  Seed: LKYQTKEPV (MAGC3_HUMAN)
LRYQTKEPY

SEQ ID NO: 96718 - protein, 9 aa, Artificial Sequence
  Description of Artificial Sequence: Synthetic peptide
  Seed: FLSKLSSII (MAGC3_HUMAN)
FKSKLSSIY

SEQ ID NO: 96719 - protein, 10 aa, Artificial Sequence
  Description of Artificial Sequence: Synthetic peptide
  Seed: KKYKDYFPMI (MAGC3_HUMAN)
KAYKDYFPMW

SEQ ID NO: 96720 - protein, 9 aa, Artificial Sequence
  Description of Artificial Sequence: Synthetic peptide
  Seed: MASASPSVM (MAGC3_HUMAN)
MMSASPSVL

SEQ ID NO: 96721 - protein, 10 aa, Artificial Sequence
  Description of Artificial Sequence: Synthetic peptide
  Seed: SALAGFADVL (MAGC3_HUMAN)
SFLAGFADVL

SEQ ID NO: 96722 - protein, 9 aa, Artificial Sequence
  Description of Artificial Sequence: Synthetic peptide
  Seed: ALSPVVLPP (MAGC3_HUMAN)
AMSPVVLPC

SEQ ID NO: 96723 - protein, 9 aa, Artificial Sequence
  Description of Artificial Sequence: Synthetic peptide
  Seed: MLLPCHWVL (MAGC3_HUMAN)
MYLPCHWVY

SEQ ID NO: 96724 - protein, 9 aa, Artificial Sequence
  Description of Artificial Sequence: Synthetic peptide
  Seed: AIGPWSALA (MAGC3_HUMAN)
AMGPWSALL

SEQ ID NO: 96725 - protein, 9 aa, Artificial Sequence
  Description of Artificial Sequence: Synthetic peptide
  Seed: YQAKEPLTR (MAGC3_HUMAN)
YAAKEPLTY

SEQ ID NO: 96726 - protein, 11 aa, Artificial Sequence
  Description of Artificial Sequence: Synthetic peptide
  Seed: TSDQRMDSLVL (MAGC3_HUMAN)
TIDQRMDSLVF

SEQ ID NO: 96727 - protein, 9 aa, Artificial Sequence
  Description of Artificial Sequence: Synthetic peptide
  Seed: MPAAGMPPL (MAGC3_HUMAN)
MWAAGMPPF

SEQ ID NO: 96728 - protein, 9 aa, Artificial Sequence
  Description of Artificial Sequence: Synthetic peptide
  Seed: ISPQGPPQS (MAGC3_HUMAN)
INPQGPPQL

SEQ ID NO: 96729 - protein, 10 aa, Artificial Sequence
  Description of Artificial Sequence: Synthetic peptide
  Seed: FFEDTLDLTY (MAGC3_HUMAN)
FTEDTLDLTM

SEQ ID NO: 96730 - protein, 9 aa, Artificial Sequence
  Description of Artificial Sequence: Synthetic peptide
  Seed: VDPDHFYVF (MAGC3_HUMAN)
VIPDHFYVM

SEQ ID NO: 96731 - protein, 9 aa, Artificial Sequence
  Description of Artificial Sequence: Synthetic peptide
  Seed: SASPSVMST (MAGC3_HUMAN)
SMSPSVMSM

SEQ ID NO: 96732 - protein, 9 aa, Artificial Sequence
  Description of Artificial Sequence: Synthetic peptide
  Seed: MASASPSVM (MAGC3_HUMAN)
MYSASPSVV

SEQ ID NO: 96733 - protein, 11 aa, Artificial Sequence
  Description of Artificial Sequence: Synthetic peptide
  Seed: SLVLCPTYFKL (MAGC3_HUMAN)
STVLCPTYFKK

SEQ ID NO: 96734 - protein, 9 aa, Artificial Sequence
  Description of Artificial Sequence: Synthetic peptide
  Seed: SQPEGKFSL (MAGC3_HUMAN)
STPEGKFSI

SEQ ID NO: 96735 - protein, 9 aa, Artificial Sequence
  Description of Artificial Sequence: Synthetic peptide
  Seed: FEDTLDLTY (MAGC3_HUMAN)
FLDTLDLTY

SEQ ID NO: 96736 - protein, 10 aa, Artificial Sequence
  Description of Artificial Sequence: Synthetic peptide
  Seed: PTYFKLWRTL (MAGC3_HUMAN)
PTYFKLWRTF

SEQ ID NO: 96737 - protein, 9 aa, Artificial Sequence
  Description of Artificial Sequence: Synthetic peptide
  Seed: LSDEQGMPQ (MAGC3_HUMAN)
LNDEQGMPV

SEQ ID NO: 96738 - protein, 11 aa, Artificial Sequence
  Description of Artificial Sequence: Synthetic peptide
  Seed: EILFGISLTEV (MAGC3_HUMAN)
EFLFGISLTEA

SEQ ID NO: 96739 - protein, 9 aa, Artificial Sequence
  Description of Artificial Sequence: Synthetic peptide
  Seed: ASEEVIWEV (MAGC3_HUMAN)
AAEEVIWEF

SEQ ID NO: 96740 - protein, 9 aa, Artificial Sequence
  Description of Artificial Sequence: Synthetic peptide
  Seed: SLPESEPLF (MAGC3_HUMAN)
STPESEPLL

SEQ ID NO: 96741 - protein, 9 aa, Artificial Sequence
  Description of Artificial Sequence: Synthetic peptide
  Seed: NTYTGYFPM (MAGC3_HUMAN)
NYYTGYFPY

SEQ ID NO: 96742 - protein, 11 aa, Artificial Sequence
  Description of Artificial Sequence: Synthetic peptide
  Seed: KGNCASEEVIW (MAGC3_HUMAN)
KVNCASEEVIW

SEQ ID NO: 96743 - protein, 11 aa, Artificial Sequence
  Description of Artificial Sequence: Synthetic peptide
  Seed: DSLVLCPTYFK (MAGC3_HUMAN)
DMLVLCPTYFR

SEQ ID NO: 96744 - protein, 8 aa, Artificial Sequence
  Description of Artificial Sequence: Synthetic peptide
  Seed: VLCPTYFK (MAGC3_HUMAN)
VMCPTYFR

SEQ ID NO: 96745 - protein, 10 aa, Artificial Sequence
  Description of Artificial Sequence: Synthetic peptide
  Seed: EVIWEVLSAI (MAGC3_HUMAN)
EAIWEVLSAW

SEQ ID NO: 96746 - protein, 10 aa, Artificial Sequence
  Description of Artificial Sequence: Synthetic peptide
  Seed: EVIWEVLSAI (MAGC3_HUMAN)
ELIWEVLSAR

SEQ ID NO: 96747 - protein, 9 aa, Artificial Sequence
  Description of Artificial Sequence: Synthetic peptide
  Seed: SQPEGKFSL (MAGC3_HUMAN)
SGPEGKFSL

SEQ ID NO: 96748 - protein, 9 aa, Artificial Sequence
  Description of Artificial Sequence: Synthetic peptide
  Seed: NAIGPWSAL (MAGC3_HUMAN)
NPIGPWSAW

SEQ ID NO: 96749 - protein, 10 aa, Artificial Sequence
  Description of Artificial Sequence: Synthetic peptide
  Seed: EVIWEVLSAI (MAGC3_HUMAN)
EAIWEVLSAI

SEQ ID NO: 96750 - protein, 9 aa, Artificial Sequence
  Description of Artificial Sequence: Synthetic peptide
  Seed: YALDEKVAE (MAGC3_HUMAN)
YSLDEKVAM

SEQ ID NO: 96751 - protein, 9 aa, Artificial Sequence
  Description of Artificial Sequence: Synthetic peptide
  Seed: ISPQGPPQS (MAGC3_HUMAN)
IQPQGPPQM

SEQ ID NO: 96752 - protein, 9 aa, Artificial Sequence
  Description of Artificial Sequence: Synthetic peptide
  Seed: SLRRAVSVK (MAGC3_HUMAN)
STRRAVSVF

SEQ ID NO: 96753 - protein, 10 aa, Artificial Sequence
  Description of Artificial Sequence: Synthetic peptide
  Seed: VVLPPQPQPR (MAGC3_HUMAN)
VALPPQPQPY

SEQ ID NO: 96754 - protein, 9 aa, Artificial Sequence
  Description of Artificial Sequence: Synthetic peptide
  Seed: CSSPLLWTR (MAGC3_HUMAN)
CQSPLLWTR

SEQ ID NO: 96755 - protein, 10 aa, Artificial Sequence
  Description of Artificial Sequence: Synthetic peptide
  Seed: EKVAELVQFL (MAGC3_HUMAN)
EAVAELVQFI

SEQ ID NO: 96756 - protein, 10 aa, Artificial Sequence
  Description of Artificial Sequence: Synthetic peptide
  Seed: SDQRMDSLVL (MAGC3_HUMAN)
SWQRMDSLVM

SEQ ID NO: 96757 - protein, 10 aa, Artificial Sequence
  Description of Artificial Sequence: Synthetic peptide
  Seed: EPQDWPLNEK (MAGC3_HUMAN)
ETQDWPLNEK

SEQ ID NO: 96758 - protein, 9 aa, Artificial Sequence
  Description of Artificial Sequence: Synthetic peptide
  Seed: YTGYFPMIF (MAGC3_HUMAN)
YYGYFPMIW

SEQ ID NO: 96759 - protein, 9 aa, Artificial Sequence
  Description of Artificial Sequence: Synthetic peptide
  Seed: TLDEKVDKL (MAGC3_HUMAN)
TWDEKVDKM

SEQ ID NO: 96760 - protein, 10 aa, Artificial Sequence
  Description of Artificial Sequence: Synthetic peptide
  Seed: IPSAFPSWYM (MAGC3_HUMAN)
IMSAFPSWYF

SEQ ID NO: 96761 - protein, 10 aa, Artificial Sequence
  Description of Artificial Sequence: Synthetic peptide
  Seed: TAMASASPSV (MAGC3_HUMAN)
TNMASASPSV

SEQ ID NO: 96762 - protein, 9 aa, Artificial Sequence
  Description of Artificial Sequence: Synthetic peptide
  Seed: VLPPQPQPR (MAGC3_HUMAN)
VFPPQPQPY

SEQ ID NO: 96763 - protein, 9 aa, Artificial Sequence
  Description of Artificial Sequence: Synthetic peptide
  Seed: YQAKEPLTR (MAGC3_HUMAN)
YIAKEPLTK

SEQ ID NO: 96764 - protein, 9 aa, Artificial Sequence
  Description of Artificial Sequence: Synthetic peptide
  Seed: FEDTLDLTY (MAGC3_HUMAN)
FIDTLDLTF

SEQ ID NO: 96765 - protein, 10 aa, Artificial Sequence
  Description of Artificial Sequence: Synthetic peptide
  Seed: TTDDATAMAS (MAGC3_HUMAN)
TVDDATAMAI

SEQ ID NO: 96766 - protein, 9 aa, Artificial Sequence
  Description of Artificial Sequence: Synthetic peptide
  Seed: FPSWYMDAL (MAGC3_HUMAN)
FVSWYMDAV

SEQ ID NO: 96767 - protein, 10 aa, Artificial Sequence
  Description of Artificial Sequence: Synthetic peptide
  Seed: EVIWEVLSAI (MAGC3_HUMAN)
EQIWEVLSAV

SEQ ID NO: 96768 - protein, 9 aa, Artificial Sequence
  Description of Artificial Sequence: Synthetic peptide
  Seed: TSDQRMDSL (MAGC3_HUMAN)
TMDQRMDSM

SEQ ID NO: 96769 - protein, 9 aa, Artificial Sequence
  Description of Artificial Sequence: Synthetic peptide
  Seed: KVAELVQFL (MAGC3_HUMAN)
KAAELVQFM

SEQ ID NO: 96770 - protein, 9 aa, Artificial Sequence
  Description of Artificial Sequence: Synthetic peptide
  Seed: LKYQAKEPL (MAGC3_HUMAN)
LRYQAKEPF

SEQ ID NO: 96771 - protein, 8 aa, Artificial Sequence
  Description of Artificial Sequence: Synthetic peptide
  Seed: MEDRAQAI (MAGC3_HUMAN)
MVDRAQAL

SEQ ID NO: 96772 - protein, 11 aa, Artificial Sequence
  Description of Artificial Sequence: Synthetic peptide
  Seed: KVAELVQFLLL (MAGC3_HUMAN)
KLAELVQFLLY

SEQ ID NO: 96773 - protein, 10 aa, Artificial Sequence
  Description of Artificial Sequence: Synthetic peptide
  Seed: AMASASPSVM (MAGC3_HUMAN)
AAASASPSVH

SEQ ID NO: 96774 - protein, 9 aa, Artificial Sequence
  Description of Artificial Sequence: Synthetic peptide
  Seed: NTYTGYFPM (MAGC3_HUMAN)
NLYTGYFPR

SEQ ID NO: 96775 - protein, 9 aa, Artificial Sequence
  Description of Artificial Sequence: Synthetic peptide
  Seed: TTDDATAMA (MAGC3_HUMAN)
TADDATAMY

SEQ ID NO: 96776 - protein, 10 aa, Artificial Sequence
  Description of Artificial Sequence: Synthetic peptide
  Seed: EMQMNVINTY (MAGC3_HUMAN)
ERQMNVINTF

SEQ ID NO: 96777 - protein, 11 aa, Artificial Sequence
  Description of Artificial Sequence: Synthetic peptide
  Seed: TLWKDSDLPTW (MAGC3_HUMAN)
TTWKDSDLPTW

SEQ ID NO: 96778 - protein, 9 aa, Artificial Sequence
  Description of Artificial Sequence: Synthetic peptide
  Seed: HALPESESL (MAGC3_HUMAN)
HVLPESESL

SEQ ID NO: 96779 - protein, 11 aa, Artificial Sequence
  Description of Artificial Sequence: Synthetic peptide
  Seed: KKYKDYFPMIF (MAGC3_HUMAN)
KMYKDYFPMIF

SEQ ID NO: 96780 - protein, 10 aa, Artificial Sequence
  Description of Artificial Sequence: Synthetic peptide
  Seed: MIFGKAHEFI (MAGC3_HUMAN)
MIFGKAHEFV

SEQ ID NO: 96781 - protein, 9 aa, Artificial Sequence
  Description of Artificial Sequence: Synthetic peptide
  Seed: IIDTTDDAT (MAGC3_HUMAN)
IFDTTDDAF

SEQ ID NO: 96782 - protein, 9 aa, Artificial Sequence
  Description of Artificial Sequence: Synthetic peptide
  Seed: NTYTGYFPM (MAGC3_HUMAN)
NQYTGYFPW

SEQ ID NO: 96783 - protein, 9 aa, Artificial Sequence
  Description of Artificial Sequence: Synthetic peptide
  Seed: AVSPGKRLW (MAGC3_HUMAN)
ASSPGKRLV

SEQ ID NO: 96784 - protein, 10 aa, Artificial Sequence
  Description of Artificial Sequence: Synthetic peptide
  Seed: FFEDTLDLTY (MAGC3_HUMAN)
FGEDTLDLTL

SEQ ID NO: 96785 - protein, 9 aa, Artificial Sequence
  Description of Artificial Sequence: Synthetic peptide
  Seed: MLLPCHWVL (MAGC3_HUMAN)
MFLPCHWVL

SEQ ID NO: 96786 - protein, 9 aa, Artificial Sequence
  Description of Artificial Sequence: Synthetic peptide
  Seed: MQMNVINTY (MAGC3_HUMAN)
MYMNVINTV

SEQ ID NO: 96787 - protein, 8 aa, Artificial Sequence
  Description of Artificial Sequence: Synthetic peptide
  Seed: SCSSPLLW (MAGC3_HUMAN)
SLSSPLLW

SEQ ID NO: 96788 - protein, 9 aa, Artificial Sequence
  Description of Artificial Sequence: Synthetic peptide
  Seed: MQMNVINTY (MAGC3_HUMAN)
MIMNVINTT

SEQ ID NO: 96789 - protein, 9 aa, Artificial Sequence
  Description of Artificial Sequence: Synthetic peptide
  Seed: KVAELVQFL (MAGC3_HUMAN)
KSAELVQFW

SEQ ID NO: 96790 - protein, 9 aa, Artificial Sequence
  Description of Artificial Sequence: Synthetic peptide
  Seed: FSDGSLGQW (MAGC3_HUMAN)
FQDGSLGQY

SEQ ID NO: 96791 - protein, 8 aa, Artificial Sequence
  Description of Artificial Sequence: Synthetic peptide
  Seed: KVDKLVQF (MAGC3_HUMAN)
KADKLVQF

SEQ ID NO: 96792 - protein, 10 aa, Artificial Sequence
  Description of Artificial Sequence: Synthetic peptide
  Seed: TFSDGSLGQW (MAGC3_HUMAN)
TQSDGSLGQF

SEQ ID NO: 96793 - protein, 10 aa, Artificial Sequence
  Description of Artificial Sequence: Synthetic peptide
  Seed: FLSKLSSIIP (MAGC3_HUMAN)
FISKLSSIIV

SEQ ID NO: 96794 - protein, 10 aa, Artificial Sequence
  Description of Artificial Sequence: Synthetic peptide
  Seed: MNVINTYTGY (MAGC3_HUMAN)
MNVINTYTGK

SEQ ID NO: 96795 - protein, 9 aa, Artificial Sequence
  Description of Artificial Sequence: Synthetic peptide
  Seed: KVAELVQFL (MAGC3_HUMAN)
KQAELVQFV

SEQ ID NO: 96796 - protein, 10 aa, Artificial Sequence
  Description of Artificial Sequence: Synthetic peptide
  Seed: EVIWEVLSAI (MAGC3_HUMAN)
EMIWEVLSAI

SEQ ID NO: 96797 - protein, 9 aa, Artificial Sequence
  Description of Artificial Sequence: Synthetic peptide
  Seed: YFFEDTLDL (MAGC3_HUMAN)
YYFEDTLDL

SEQ ID NO: 96798 - protein, 9 aa, Artificial Sequence
  Description of Artificial Sequence: Synthetic peptide
  Seed: VDPDHFYVF (MAGC3_HUMAN)
VMPDHFYVW

SEQ ID NO: 96799 - protein, 11 aa, Artificial Sequence
  Description of Artificial Sequence: Synthetic peptide
  Seed: RTLSGSPGLQL (MAGC3_HUMAN)
RILSGSPGLQK

SEQ ID NO: 96800 - protein, 10 aa, Artificial Sequence
  Description of Artificial Sequence: Synthetic peptide
  Seed: LNAIGPWSAL (MAGC3_HUMAN)
LFAIGPWSAF

SEQ ID NO: 96801 - protein, 11 aa, Artificial Sequence
  Description of Artificial Sequence: Synthetic peptide
  Seed: YFFEDTLDLTY (MAGC3_HUMAN)
YQFEDTLDLTM

SEQ ID NO: 96802 - protein, 11 aa, Artificial Sequence
  Description of Artificial Sequence: Synthetic peptide
  Seed: SKLSSIIPSAF (MAGC3_HUMAN)
STLSSIIPSAW

SEQ ID NO: 96803 - protein, 10 aa, Artificial Sequence
  Description of Artificial Sequence: Synthetic peptide
  Seed: NAIGPWSALA (MAGC3_HUMAN)
NTIGPWSALT

SEQ ID NO: 96804 - protein, 9 aa, Artificial Sequence
  Description of Artificial Sequence: Synthetic peptide
  Seed: TYFKLWRTL (MAGC3_HUMAN)
TWFKLWRTI

SEQ ID NO: 96805 - protein, 9 aa, Artificial Sequence
  Description of Artificial Sequence: Synthetic peptide
  Seed: MIFRKAREF (MAGC3_HUMAN)
MLFRKAREW

SEQ ID NO: 96806 - protein, 9 aa, Artificial Sequence
  Description of Artificial Sequence: Synthetic peptide
  Seed: DKDYSAFHL (MAGC3_HUMAN)
DHDYSAFHI

SEQ ID NO: 96807 - protein, 9 aa, Artificial Sequence
  Description of Artificial Sequence: Synthetic peptide
  Seed: ALDEKVAEL (MAGC3_HUMAN)
AMDEKVAEC

SEQ ID NO: 96808 - protein, 9 aa, Artificial Sequence
  Description of Artificial Sequence: Synthetic peptide
  Seed: MIFIKGSCV (MAGC3_HUMAN)
MAFIKGSCF

SEQ ID NO: 96809 - protein, 11 aa, Artificial Sequence
  Description of Artificial Sequence: Synthetic peptide
  Seed: LSKLSSIIPSA (MAGC3_HUMAN)
LLKLSSIIPSI

SEQ ID NO: 96810 - protein, 10 aa, Artificial Sequence
  Description of Artificial Sequence: Synthetic peptide
  Seed: MLLPCHWVLD (MAGC3_HUMAN)
MMLPCHWVLA

SEQ ID NO: 96811 - protein, 9 aa, Artificial Sequence
  Description of Artificial Sequence: Synthetic peptide
  Seed: TSDQRMDSL (MAGC3_HUMAN)
TMDQRMDSI

SEQ ID NO: 96812 - protein, 11 aa, Artificial Sequence
  Description of Artificial Sequence: Synthetic peptide
  Seed: LTDMDPDNHSY (MAGC3_HUMAN)
LVDMDPDNHSM

SEQ ID NO: 96813 - protein, 10 aa, Artificial Sequence
  Description of Artificial Sequence: Synthetic peptide
  Seed: KLVQFLLLKY (MAGC3_HUMAN)
KVVQFLLLKY

SEQ ID NO: 96814 - protein, 9 aa, Artificial Sequence
  Description of Artificial Sequence: Synthetic peptide
  Seed: SASPSVMST (MAGC3_HUMAN)
SPSPSVMST

SEQ ID NO: 96815 - protein, 10 aa, Artificial Sequence
  Description of Artificial Sequence: Synthetic peptide
  Seed: ILILSVIFIK (MAGC3_HUMAN)
ISILSVIFIK

SEQ ID NO: 96816 - protein, 11 aa, Artificial Sequence
  Description of Artificial Sequence: Synthetic peptide
  Seed: FIELIFGIALT (MAGC3_HUMAN)
FGELIFGIALL

SEQ ID NO: 96817 - protein, 9 aa, Artificial Sequence
  Description of Artificial Sequence: Synthetic peptide
  Seed: SAFHLGHLR (MAGC3_HUMAN)
SVFHLGHLR

SEQ ID NO: 96818 - protein, 9 aa, Artificial Sequence
  Description of Artificial Sequence: Synthetic peptide
  Seed: HALPESESL (MAGC3_HUMAN)
HDLPESESM

SEQ ID NO: 96819 - protein, 9 aa, Artificial Sequence
  Description of Artificial Sequence: Synthetic peptide
  Seed: HFYVFVNTL (MAGC3_HUMAN)
HGYVFVNTL

SEQ ID NO: 96820 - protein, 9 aa, Artificial Sequence
  Description of Artificial Sequence: Synthetic peptide
  Seed: MDPDNHSYF (MAGC3_HUMAN)
MIPDNHSYL

SEQ ID NO: 96821 - protein, 9 aa, Artificial Sequence
  Description of Artificial Sequence: Synthetic peptide
  Seed: EMLTTVIKK (MAGC3_HUMAN)
EYLTTVIKK

SEQ ID NO: 96822 - protein, 9 aa, Artificial Sequence
  Description of Artificial Sequence: Synthetic peptide
  Seed: ILILSMIFI (MAGC3_HUMAN)
IQILSMIFI

SEQ ID NO: 96823 - protein, 9 aa, Artificial Sequence
  Description of Artificial Sequence: Synthetic peptide
  Seed: IIDTTDDAT (MAGC3_HUMAN)
ISDTTDDAM

SEQ ID NO: 96824 - protein, 9 aa, Artificial Sequence
  Description of Artificial Sequence: Synthetic peptide
  Seed: MLLPCHWVL (MAGC3_HUMAN)
MMLPCHWVY

SEQ ID NO: 96825 - protein, 10 aa, Artificial Sequence
  Description of Artificial Sequence: Synthetic peptide
  Seed: IELIFGIALT (MAGC3_HUMAN)
IILIFGIALI

SEQ ID NO: 96826 - protein, 9 aa, Artificial Sequence
  Description of Artificial Sequence: Synthetic peptide
  Seed: ALDEKVAEL (MAGC3_HUMAN)
ACDEKVAEM

SEQ ID NO: 96827 - protein, 9 aa, Artificial Sequence
  Description of Artificial Sequence: Synthetic peptide
  Seed: MDPDNHSYF (MAGC3_HUMAN)
MIPDNHSYY

SEQ ID NO: 96828 - protein, 9 aa, Artificial Sequence
  Description of Artificial Sequence: Synthetic peptide
  Seed: KVDKLVQFL (MAGC3_HUMAN)
KLDKLVQFA

SEQ ID NO: 96829 - protein, 10 aa, Artificial Sequence
  Description of Artificial Sequence: Synthetic peptide
  Seed: LPTWRRGTGY (MAGC3_HUMAN)
LHTWRRGTGW

SEQ ID NO: 96830 - protein, 11 aa, Artificial Sequence
  Description of Artificial Sequence: Synthetic peptide
  Seed: IIDTTDDATAM (MAGC3_HUMAN)
ISDTTDDATAY

SEQ ID NO: 96831 - protein, 10 aa, Artificial Sequence
  Description of Artificial Sequence: Synthetic peptide
  Seed: EPQDWPLNEK (MAGC3_HUMAN)
EIQDWPLNEK

SEQ ID NO: 96832 - protein, 10 aa, Artificial Sequence
  Description of Artificial Sequence: Synthetic peptide
  Seed: IELIFGIALT (MAGC3_HUMAN)
IHLIFGIALA

SEQ ID NO: 96833 - protein, 9 aa, Artificial Sequence
  Description of Artificial Sequence: Synthetic peptide
  Seed: FSLRRAVSV (MAGC3_HUMAN)
FGLRRAVSY

SEQ ID NO: 96834 - protein, 9 aa, Artificial Sequence
  Description of Artificial Sequence: Synthetic peptide
  Seed: MPAAGMPPL (MAGC3_HUMAN)
MPAAGMPPC

SEQ ID NO: 96835 - protein, 9 aa, Artificial Sequence
  Description of Artificial Sequence: Synthetic peptide
  Seed: KVAELVQFL (MAGC3_HUMAN)
KQAELVQFM

SEQ ID NO: 96836 - protein, 9 aa, Artificial Sequence
  Description of Artificial Sequence: Synthetic peptide
  Seed: NTYTGYFPM (MAGC3_HUMAN)
NKYTGYFPF

SEQ ID NO: 96837 - protein, 10 aa, Artificial Sequence
  Description of Artificial Sequence: Synthetic peptide
  Seed: GNCASEEVIW (MAGC3_HUMAN)
GTCASEEVIW

SEQ ID NO: 96838 - protein, 11 aa, Artificial Sequence
  Description of Artificial Sequence: Synthetic peptide
  Seed: LTDMDPDNHSY (MAGC3_HUMAN)
LADMDPDNHSV

SEQ ID NO: 96839 - protein, 10 aa, Artificial Sequence
  Description of Artificial Sequence: Synthetic peptide
  Seed: MLTTVIKKYK (MAGC3_HUMAN)
MRTTVIKKYK

SEQ ID NO: 96840 - protein, 8 aa, Artificial Sequence
  Description of Artificial Sequence: Synthetic peptide
  Seed: TTDDATAM (MAGC3_HUMAN)
TYDDATAV

SEQ ID NO: 96841 - protein, 9 aa, Artificial Sequence
  Description of Artificial Sequence: Synthetic peptide
  Seed: AIGPWSALA (MAGC3_HUMAN)
AMGPWSALI

SEQ ID NO: 96842 - protein, 9 aa, Artificial Sequence
  Description of Artificial Sequence: Synthetic peptide
  Seed: VDPDHFYVF (MAGC3_HUMAN)
VPPDHFYVY

SEQ ID NO: 96843 - protein, 9 aa, Artificial Sequence
  Description of Artificial Sequence: Synthetic peptide
  Seed: ATDKDYSAF (MAGC3_HUMAN)
AQDKDYSAI

SEQ ID NO: 96844 - protein, 9 aa, Artificial Sequence
  Description of Artificial Sequence: Synthetic peptide
  Seed: LSSIIPSAF (MAGC3_HUMAN)
LQSIIPSAF

SEQ ID NO: 96845 - protein, 10 aa, Artificial Sequence
  Description of Artificial Sequence: Synthetic peptide
  Seed: YALSPVVLPP (MAGC3_HUMAN)
YSLSPVVLPT

SEQ ID NO: 96846 - protein, 9 aa, Artificial Sequence
  Description of Artificial Sequence: Synthetic peptide
  Seed: REVLEFLSK (MAGC3_HUMAN)
RDVLEFLSL

SEQ ID NO: 96847 - protein, 10 aa, Artificial Sequence
  Description of Artificial Sequence: Synthetic peptide
  Seed: EVIWEVLSAI (MAGC3_HUMAN)
EAIWEVLSAK

SEQ ID NO: 96848 - protein, 9 aa, Artificial Sequence
  Description of Artificial Sequence: Synthetic peptide
  Seed: KEPLTRAEM (MAGC3_HUMAN)
KRPLTRAEL

SEQ ID NO: 96849 - protein, 11 aa, Artificial Sequence
  Description of Artificial Sequence: Synthetic peptide
  Seed: TTDDATAMASA (MAGC3_HUMAN)
TLDDATAMASF

SEQ ID NO: 96850 - protein, 11 aa, Artificial Sequence
  Description of Artificial Sequence: Synthetic peptide
  Seed: RYALDEKVAEL (MAGC3_HUMAN)
RYALDEKVAEW

SEQ ID NO: 96851 - protein, 9 aa, Artificial Sequence
  Description of Artificial Sequence: Synthetic peptide
  Seed: ATDKDYSAF (MAGC3_HUMAN)
ACDKDYSAM

SEQ ID NO: 96852 - protein, 10 aa, Artificial Sequence
  Description of Artificial Sequence: Synthetic peptide
  Seed: PTYFKLWRTL (MAGC3_HUMAN)
PLYFKLWRTF

SEQ ID NO: 96853 - protein, 10 aa, Artificial Sequence
  Description of Artificial Sequence: Synthetic peptide
  Seed: QWVKNTCATY (MAGC3_HUMAN)
QMVKNTCATM

SEQ ID NO: 96854 - protein, 9 aa, Artificial Sequence
  Description of Artificial Sequence: Synthetic peptide
  Seed: NAIGPWSAL (MAGC3_HUMAN)
NPIGPWSAV

SEQ ID NO: 96855 - protein, 11 aa, Artificial Sequence
  Description of Artificial Sequence: Synthetic peptide
  Seed: HALPESESLPR (MAGC3_HUMAN)
HLLPESESLPK

SEQ ID NO: 96856 - protein, 9 aa, Artificial Sequence
  Description of Artificial Sequence: Synthetic peptide
  Seed: IPPQGPPKI (MAGC3_HUMAN)
ICPQGPPKM

SEQ ID NO: 96857 - protein, 9 aa, Artificial Sequence
  Description of Artificial Sequence: Synthetic peptide
  Seed: TEASPQQKK (MAGC3_HUMAN)
TDASPQQKF

SEQ ID NO: 96858 - protein, 9 aa, Artificial Sequence
  Description of Artificial Sequence: Synthetic peptide
  Seed: YKDYFPMIF (MAGC3_HUMAN)
YIDYFPMIL

SEQ ID NO: 96859 - protein, 10 aa, Artificial Sequence
  Description of Artificial Sequence: Synthetic peptide
  Seed: LNAIGPWSAL (MAGC3_HUMAN)
LMAIGPWSAF

SEQ ID NO: 96860 - protein, 10 aa, Artificial Sequence
  Description of Artificial Sequence: Synthetic peptide
  Seed: FPSWYMDALK (MAGC3_HUMAN)
FHSWYMDALR

SEQ ID NO: 96861 - protein, 10 aa, Artificial Sequence
  Description of Artificial Sequence: Synthetic peptide
  Seed: EEVIWEVLSA (MAGC3_HUMAN)
EQVIWEVLSV

SEQ ID NO: 96862 - protein, 11 aa, Artificial Sequence
  Description of Artificial Sequence: Synthetic peptide
  Seed: YFFEDTLDLTY (MAGC3_HUMAN)
YYFEDTLDLTL

SEQ ID NO: 96863 - protein, 9 aa, Artificial Sequence
  Description of Artificial Sequence: Synthetic peptide
  Seed: HFYVFVNTL (MAGC3_HUMAN)
HNYVFVNTL

SEQ ID NO: 96864 - protein, 9 aa, Artificial Sequence
  Description of Artificial Sequence: Synthetic peptide
  Seed: NVINTYTGY (MAGC3_HUMAN)
NTINTYTGM

SEQ ID NO: 96865 - protein, 9 aa, Artificial Sequence
  Description of Artificial Sequence: Synthetic peptide
  Seed: FSDGSLGQW (MAGC3_HUMAN)
FVDGSLGQY

SEQ ID NO: 96866 - protein, 9 aa, Artificial Sequence
  Description of Artificial Sequence: Synthetic peptide
  Seed: HFYVFVNTL (MAGC3_HUMAN)
HQYVFVNTM

SEQ ID NO: 96867 - protein, 9 aa, Artificial Sequence
  Description of Artificial Sequence: Synthetic peptide
  Seed: CPTYFKLWR (MAGC3_HUMAN)
CTTYFKLWR

SEQ ID NO: 96868 - protein, 11 aa, Artificial Sequence
  Description of Artificial Sequence: Synthetic peptide
  Seed: TSDQRMDSLVL (MAGC3_HUMAN)
TWDQRMDSLVY

SEQ ID NO: 96869 - protein, 9 aa, Artificial Sequence
  Description of Artificial Sequence: Synthetic peptide
  Seed: MQMNVINTY (MAGC3_HUMAN)
MFMNVINTV

SEQ ID NO: 96870 - protein, 11 aa, Artificial Sequence
  Description of Artificial Sequence: Synthetic peptide
  Seed: LTDMDPDNHSY (MAGC3_HUMAN)
LIDMDPDNHSF

SEQ ID NO: 96871 - protein, 9 aa, Artificial Sequence
  Description of Artificial Sequence: Synthetic peptide
  Seed: TTDDATAMA (MAGC3_HUMAN)
TTDDATAMI

SEQ ID NO: 96872 - protein, 9 aa, Artificial Sequence
  Description of Artificial Sequence: Synthetic peptide
  Seed: GSLPESEPL (MAGC3_HUMAN)
GTLPESEPW

SEQ ID NO: 96873 - protein, 10 aa, Artificial Sequence
  Description of Artificial Sequence: Synthetic peptide
  Seed: MIFRKAREFI (MAGC3_HUMAN)
MMFRKAREFK

SEQ ID NO: 96874 - protein, 10 aa, Artificial Sequence
  Description of Artificial Sequence: Synthetic peptide
  Seed: SDQRMDSLVL (MAGC3_HUMAN)
SIQRMDSLVF

SEQ ID NO: 96875 - protein, 9 aa, Artificial Sequence
  Description of Artificial Sequence: Synthetic peptide
  Seed: YFFEDTLDL (MAGC3_HUMAN)
YIFEDTLDT

SEQ ID NO: 96876 - protein, 9 aa, Artificial Sequence
  Description of Artificial Sequence: Synthetic peptide
  Seed: EFIELIFGI (MAGC3_HUMAN)
ESIELIFGV

SEQ ID NO: 96877 - protein, 10 aa, Artificial Sequence
  Description of Artificial Sequence: Synthetic peptide
  Seed: YALDEKVAEL (MAGC3_HUMAN)
YPLDEKVAEY

SEQ ID NO: 96878 - protein, 9 aa, Artificial Sequence
  Description of Artificial Sequence: Synthetic peptide
  Seed: RTLSGSPGL (MAGC3_HUMAN)
RYLSGSPGK

SEQ ID NO: 96879 - protein, 10 aa, Artificial Sequence
  Description of Artificial Sequence: Synthetic peptide
  Seed: VVLPPQPQPR (MAGC3_HUMAN)
VSLPPQPQPK

SEQ ID NO: 96880 - protein, 9 aa, Artificial Sequence
  Description of Artificial Sequence: Synthetic peptide
  Seed: HLREVRLFL (MAGC3_HUMAN)
HQREVRLFA

SEQ ID NO: 96881 - protein, 10 aa, Artificial Sequence
  Description of Artificial Sequence: Synthetic peptide
  Seed: ALDEKVAELV (MAGC3_HUMAN)
AYDEKVAELI

SEQ ID NO: 96882 - protein, 9 aa, Artificial Sequence
  Description of Artificial Sequence: Synthetic peptide
  Seed: NVINTYTGY (MAGC3_HUMAN)
NLINTYTGF

SEQ ID NO: 96883 - protein, 9 aa, Artificial Sequence
  Description of Artificial Sequence: Synthetic peptide
  Seed: LTEVDPDHF (MAGC3_HUMAN)
LSEVDPDHL

SEQ ID NO: 96884 - protein, 9 aa, Artificial Sequence
  Description of Artificial Sequence: Synthetic peptide
  Seed: HALPESESL (MAGC3_HUMAN)
HWLPESESL

SEQ ID NO: 96885 - protein, 9 aa, Artificial Sequence
  Description of Artificial Sequence: Synthetic peptide
  Seed: EVLEFLSKL (MAGC3_HUMAN)
EYLEFLSKR

SEQ ID NO: 96886 - protein, 11 aa, Artificial Sequence
  Description of Artificial Sequence: Synthetic peptide
  Seed: TAMASASPSVM (MAGC3_HUMAN)
TMMASASPSVY

SEQ ID NO: 96887 - protein, 9 aa, Artificial Sequence
  Description of Artificial Sequence: Synthetic peptide
  Seed: TLDEKVDKL (MAGC3_HUMAN)
TGDEKVDKV

SEQ ID NO: 96888 - protein, 10 aa, Artificial Sequence
  Description of Artificial Sequence: Synthetic peptide
  Seed: TDMDPDNHSY (MAGC3_HUMAN)
TPMDPDNHSY

SEQ ID NO: 96889 - protein, 9 aa, Artificial Sequence
  Description of Artificial Sequence: Synthetic peptide
  Seed: LRSAEGSVL (MAGC3_HUMAN)
LESAEGSVM

SEQ ID NO: 96890 - protein, 9 aa, Artificial Sequence
  Description of Artificial Sequence: Synthetic peptide
  Seed: EVDPDHFYV (MAGC3_HUMAN)
ESDPDHFYM

SEQ ID NO: 96891 - protein, 9 aa, Artificial Sequence
  Description of Artificial Sequence: Synthetic peptide
  Seed: IIPSAFPSW (MAGC3_HUMAN)
IYPSAFPSW

SEQ ID NO: 96892 - protein, 9 aa, Artificial Sequence
  Description of Artificial Sequence: Synthetic peptide
  Seed: EVLNAIGPW (MAGC3_HUMAN)
ETLNAIGPK

SEQ ID NO: 96893 - protein, 9 aa, Artificial Sequence
  Description of Artificial Sequence: Synthetic peptide
  Seed: FVNTLDLTC (MAGC3_HUMAN)
FLNTLDLTL

SEQ ID NO: 96894 - protein, 9 aa, Artificial Sequence
  Description of Artificial Sequence: Synthetic peptide
  Seed: LSDEQGMPQ (MAGC3_HUMAN)
LGDEQGMPF

SEQ ID NO: 96895 - protein, 10 aa, Artificial Sequence
  Description of Artificial Sequence: Synthetic peptide
  Seed: MIFGKAHEFI (MAGC3_HUMAN)
MLFGKAHEFL

SEQ ID NO: 96896 - protein, 10 aa, Artificial Sequence
  Description of Artificial Sequence: Synthetic peptide
  Seed: SAFHLGHLRE (MAGC3_HUMAN)
STFHLGHLRE

SEQ ID NO: 96897 - protein, 9 aa, Artificial Sequence
  Description of Artificial Sequence: Synthetic peptide
  Seed: VLCPTYFKL (MAGC3_HUMAN)
VMCPTYFKV

SEQ ID NO: 96898 - protein, 8 aa, Artificial Sequence
  Description of Artificial Sequence: Synthetic peptide
  Seed: FADVLSRL (MAGC3_HUMAN)
FFDVLSRV

SEQ ID NO: 96899 - protein, 9 aa, Artificial Sequence
  Description of Artificial Sequence: Synthetic peptide
  Seed: VLPPQPQPR (MAGC3_HUMAN)
VAPPQPQPM

SEQ ID NO: 96900 - protein, 9 aa, Artificial Sequence
  Description of Artificial Sequence: Synthetic peptide
  Seed: TLDEKVDKL (MAGC3_HUMAN)
TWDEKVDKI

SEQ ID NO: 96901 - protein, 9 aa, Artificial Sequence
  Description of Artificial Sequence: Synthetic peptide
  Seed: KVAELVQFL (MAGC3_HUMAN)
KLAELVQFW

SEQ ID NO: 96902 - protein, 10 aa, Artificial Sequence
  Description of Artificial Sequence: Synthetic peptide
  Seed: SAFHLGHLRE (MAGC3_HUMAN)
SMFHLGHLRC

SEQ ID NO: 96903 - protein, 10 aa, Artificial Sequence
  Description of Artificial Sequence: Synthetic peptide
  Seed: ATFSDGSLGQ (MAGC3_HUMAN)
AVFSDGSLGK

SEQ ID NO: 96904 - protein, 9 aa, Artificial Sequence
  Description of Artificial Sequence: Synthetic peptide
  Seed: KYKDYFPMI (MAGC3_HUMAN)
KIKDYFPMK

SEQ ID NO: 96905 - protein, 10 aa, Artificial Sequence
  Description of Artificial Sequence: Synthetic peptide
  Seed: TDMDPDNHSY (MAGC3_HUMAN)
TYMDPDNHSY

SEQ ID NO: 96906 - protein, 10 aa, Artificial Sequence
  Description of Artificial Sequence: Synthetic peptide
  Seed: SKLSSIIPSA (MAGC3_HUMAN)
SKLSSIIPSI

SEQ ID NO: 96907 - protein, 9 aa, Artificial Sequence
  Description of Artificial Sequence: Synthetic peptide
  Seed: NTYTGYFPM (MAGC3_HUMAN)
NFYTGYFPF

SEQ ID NO: 96908 - protein, 9 aa, Artificial Sequence
  Description of Artificial Sequence: Synthetic peptide
  Seed: AVSPGKRLW (MAGC3_HUMAN)
AQSPGKRLV

SEQ ID NO: 96909 - protein, 9 aa, Artificial Sequence
  Description of Artificial Sequence: Synthetic peptide
  Seed: SQPEGKFSL (MAGC3_HUMAN)
SHPEGKFSV

SEQ ID NO: 96910 - protein, 9 aa, Artificial Sequence
  Description of Artificial Sequence: Synthetic peptide
  Seed: ATYALSPVV (MAGC3_HUMAN)
AAYALSPVI

SEQ ID NO: 96911 - protein, 9 aa, Artificial Sequence
  Description of Artificial Sequence: Synthetic peptide
  Seed: ELIFGIALT (MAGC3_HUMAN)
ELIFGIALA

SEQ ID NO: 96912 - protein, 10 aa, Artificial Sequence
  Description of Artificial Sequence: Synthetic peptide
  Seed: EAFCEESGLR (MAGC3_HUMAN)
EVFCEESGLK

SEQ ID NO: 96913 - protein, 9 aa, Artificial Sequence
  Description of Artificial Sequence: Synthetic peptide
  Seed: KLWRTLSGS (MAGC3_HUMAN)
KIWRTLSGL

SEQ ID NO: 96914 - protein, 9 aa, Artificial Sequence
  Description of Artificial Sequence: Synthetic peptide
  Seed: MASASPSVM (MAGC3_HUMAN)
MPSASPSVP

SEQ ID NO: 96915 - protein, 9 aa, Artificial Sequence
  Description of Artificial Sequence: Synthetic peptide
  Seed: REVLEFLSK (MAGC3_HUMAN)
RDVLEFLSF

SEQ ID NO: 96916 - protein, 9 aa, Artificial Sequence
  Description of Artificial Sequence: Synthetic peptide
  Seed: IFGKAHEFI (MAGC3_HUMAN)
IFGKAHEFW

SEQ ID NO: 96917 - protein, 9 aa, Artificial Sequence
  Description of Artificial Sequence: Synthetic peptide
  Seed: TEVDPDHFY (MAGC3_HUMAN)
TAVDPDHFF

SEQ ID NO: 96918 - protein, 10 aa, Artificial Sequence
  Description of Artificial Sequence: Synthetic peptide
  Seed: YALDEKVAEL (MAGC3_HUMAN)
YYLDEKVAET

SEQ ID NO: 96919 - protein, 10 aa, Artificial Sequence
  Description of Artificial Sequence: Synthetic peptide
  Seed: MDPDNHSYFF (MAGC3_HUMAN)
MCPDNHSYFF

SEQ ID NO: 96920 - protein, 9 aa, Artificial Sequence
  Description of Artificial Sequence: Synthetic peptide
  Seed: KAHEFIELI (MAGC3_HUMAN)
KNHEFIELV

SEQ ID NO: 96921 - protein, 9 aa, Artificial Sequence
  Description of Artificial Sequence: Synthetic peptide
  Seed: IQRPAREVL (MAGC3_HUMAN)
IERPAREVM

SEQ ID NO: 96922 - protein, 10 aa, Artificial Sequence
  Description of Artificial Sequence: Synthetic peptide
  Seed: ALDEKVAELV (MAGC3_HUMAN)
ACDEKVAELM

SEQ ID NO: 96923 - protein, 9 aa, Artificial Sequence
  Description of Artificial Sequence: Synthetic peptide
  Seed: ELIFGIALT (MAGC3_HUMAN)
EAIFGIALI

SEQ ID NO: 96924 - protein, 9 aa, Artificial Sequence
  Description of Artificial Sequence: Synthetic peptide
  Seed: CHWVLDATF (MAGC3_HUMAN)
CKWVLDATF

SEQ ID NO: 96925 - protein, 10 aa, Artificial Sequence
  Description of Artificial Sequence: Synthetic peptide
  Seed: WEVLSAIGPI (MAGC3_HUMAN)
WEVLSAIGPL

SEQ ID NO: 96926 - protein, 9 aa, Artificial Sequence
  Description of Artificial Sequence: Synthetic peptide
  Seed: QLSDLHFGS (MAGC3_HUMAN)
QISDLHFGL

SEQ ID NO: 96927 - protein, 11 aa, Artificial Sequence
  Description of Artificial Sequence: Synthetic peptide
  Seed: IIDTTDDATAM (MAGC3_HUMAN)
IIDTTDDATAF

SEQ ID NO: 96928 - protein, 9 aa, Artificial Sequence
  Description of Artificial Sequence: Synthetic peptide
  Seed: IQRPAREVL (MAGC3_HUMAN)
IHRPAREVF

SEQ ID NO: 96929 - protein, 9 aa, Artificial Sequence
  Description of Artificial Sequence: Synthetic peptide
  Seed: EKVDKLVQF (MAGC3_HUMAN)
EAVDKLVQY

SEQ ID NO: 96930 - protein, 10 aa, Artificial Sequence
  Description of Artificial Sequence: Synthetic peptide
  Seed: TEVDPDHFYV (MAGC3_HUMAN)
TEVDPDHFYW

SEQ ID NO: 96931 - protein, 11 aa, Artificial Sequence
  Description of Artificial Sequence: Synthetic peptide
  Seed: LSDEQGMPQNR (MAGC3_HUMAN)
LTDEQGMPQNY

SEQ ID NO: 96932 - protein, 10 aa, Artificial Sequence
  Description of Artificial Sequence: Synthetic peptide
  Seed: FKLWRTLSGS (MAGC3_HUMAN)
FSLWRTLSGL

SEQ ID NO: 96933 - protein, 9 aa, Artificial Sequence
  Description of Artificial Sequence: Synthetic peptide
  Seed: SAIGPIQRP (MAGC3_HUMAN)
SSIGPIQRY

SEQ ID NO: 96934 - protein, 11 aa, Artificial Sequence
  Description of Artificial Sequence: Synthetic peptide
  Seed: INTYTGYFPMI (MAGC3_HUMAN)
ITTYTGYFPMF

SEQ ID NO: 96935 - protein, 11 aa, Artificial Sequence
  Description of Artificial Sequence: Synthetic peptide
  Seed: MQMNVINTYTG (MAGC3_HUMAN)
MMMNVINTYTY

SEQ ID NO: 96936 - protein, 9 aa, Artificial Sequence
  Description of Artificial Sequence: Synthetic peptide
  Seed: VIWEVLSAI (MAGC3_HUMAN)
VTWEVLSAW

SEQ ID NO: 96937 - protein, 9 aa, Artificial Sequence
  Description of Artificial Sequence: Synthetic peptide
  Seed: VDPDHFYVF (MAGC3_HUMAN)
VVPDHFYVF

SEQ ID NO: 96938 - protein, 10 aa, Artificial Sequence
  Description of Artificial Sequence: Synthetic peptide
  Seed: MNVINTYTGY (MAGC3_HUMAN)
MAVINTYTGF

SEQ ID NO: 96939 - protein, 9 aa, Artificial Sequence
  Description of Artificial Sequence: Synthetic peptide
  Seed: LSGSPGLQL (MAGC3_HUMAN)
LAGSPGLQV

SEQ ID NO: 96940 - protein, 9 aa, Artificial Sequence
  Description of Artificial Sequence: Synthetic peptide
  Seed: EFIELIFGI (MAGC3_HUMAN)
EMIELIFGT

SEQ ID NO: 96941 - protein, 9 aa, Artificial Sequence
  Description of Artificial Sequence: Synthetic peptide
  Seed: FSLRRAVSV (MAGC3_HUMAN)
FALRRAVSV

SEQ ID NO: 96942 - protein, 10 aa, Artificial Sequence
  Description of Artificial Sequence: Synthetic peptide
  Seed: EVIWEVLSAI (MAGC3_HUMAN)
ESIWEVLSAI

SEQ ID NO: 96943 - protein, 9 aa, Artificial Sequence
  Description of Artificial Sequence: Synthetic peptide
  Seed: QLSDLHFGS (MAGC3_HUMAN)
QMSDLHFGA

SEQ ID NO: 96944 - protein, 9 aa, Artificial Sequence
  Description of Artificial Sequence: Synthetic peptide
  Seed: LVQFLLLKY (MAGC3_HUMAN)
LVQFLLLKK

SEQ ID NO: 96945 - protein, 10 aa, Artificial Sequence
  Description of Artificial Sequence: Synthetic peptide
  Seed: YALDEKVAEL (MAGC3_HUMAN)
YCLDEKVAEL

SEQ ID NO: 96946 - protein, 9 aa, Artificial Sequence
  Description of Artificial Sequence: Synthetic peptide
  Seed: DTTDDATAM (MAGC3_HUMAN)
DVTDDATAR

SEQ ID NO: 96947 - protein, 10 aa, Artificial Sequence
  Description of Artificial Sequence: Synthetic peptide
  Seed: SLPESEPLFT (MAGC3_HUMAN)
SIPESEPLFV

SEQ ID NO: 96948 - protein, 9 aa, Artificial Sequence
  Description of Artificial Sequence: Synthetic peptide
  Seed: MASASPSVM (MAGC3_HUMAN)
MFSASPSVV

SEQ ID NO: 96949 - protein, 10 aa, Artificial Sequence
  Description of Artificial Sequence: Synthetic peptide
  Seed: LAGFADVLSR (MAGC3_HUMAN)
LVGFADVLSR

SEQ ID NO: 96950 - protein, 10 aa, Artificial Sequence
  Description of Artificial Sequence: Synthetic peptide
  Seed: KVAELVQFLL (MAGC3_HUMAN)
KLAELVQFLW

SEQ ID NO: 96951 - protein, 11 aa, Artificial Sequence
  Description of Artificial Sequence: Synthetic peptide
  Seed: VLDATFSDGSL (MAGC3_HUMAN)
VADATFSDGSM

SEQ ID NO: 96952 - protein, 9 aa, Artificial Sequence
  Description of Artificial Sequence: Synthetic peptide
  Seed: GFADVLSRL (MAGC3_HUMAN)
GVADVLSRM

SEQ ID NO: 96953 - protein, 9 aa, Artificial Sequence
  Description of Artificial Sequence: Synthetic peptide
  Seed: NAIGPWSAL (MAGC3_HUMAN)
NSIGPWSAM

SEQ ID NO: 96954 - protein, 10 aa, Artificial Sequence
  Description of Artificial Sequence: Synthetic peptide
  Seed: EKVAELVQFL (MAGC3_HUMAN)
ESVAELVQFI

SEQ ID NO: 96955 - protein, 10 aa, Artificial Sequence
  Description of Artificial Sequence: Synthetic peptide
  Seed: YALDEKVAEL (MAGC3_HUMAN)
YGLDEKVAEI

SEQ ID NO: 96956 - protein, 9 aa, Artificial Sequence
  Description of Artificial Sequence: Synthetic peptide
  Seed: LSAIGPIQR (MAGC3_HUMAN)
LTAIGPIQK

SEQ ID NO: 96957 - protein, 10 aa, Artificial Sequence
  Description of Artificial Sequence: Synthetic peptide
  Seed: LDSCSSPLLW (MAGC3_HUMAN)
LTSCSSPLLF

SEQ ID NO: 96958 - protein, 9 aa, Artificial Sequence
  Description of Artificial Sequence: Synthetic peptide
  Seed: CSSPLLWTR (MAGC3_HUMAN)
CYSPLLWTR

SEQ ID NO: 96959 - protein, 9 aa, Artificial Sequence
  Description of Artificial Sequence: Synthetic peptide
  Seed: HSYFFEDTL (MAGC3_HUMAN)
HSYFFEDTF

SEQ ID NO: 96960 - protein, 9 aa, Artificial Sequence
  Description of Artificial Sequence: Synthetic peptide
  Seed: RGTGYTLSL (MAGC3_HUMAN)
RRTGYTLSF

SEQ ID NO: 96961 - protein, 9 aa, Artificial Sequence
  Description of Artificial Sequence: Synthetic peptide
  Seed: TAMASASPS (MAGC3_HUMAN)
TMMASASPM

SEQ ID NO: 96962 - protein, 9 aa, Artificial Sequence
  Description of Artificial Sequence: Synthetic peptide
  Seed: GMPQNRLLI (MAGC3_HUMAN)
GAPQNRLLL

SEQ ID NO: 96963 - protein, 9 aa, Artificial Sequence
  Description of Artificial Sequence: Synthetic peptide
  Seed: VDPDHFYVF (MAGC3_HUMAN)
VRPDHFYVY

SEQ ID NO: 96964 - protein, 9 aa, Artificial Sequence
  Description of Artificial Sequence: Synthetic peptide
  Seed: WRRGTGYTL (MAGC3_HUMAN)
WHRGTGYTL

SEQ ID NO: 96965 - protein, 9 aa, Artificial Sequence
  Description of Artificial Sequence: Synthetic peptide
  Seed: LSSIIPSAF (MAGC3_HUMAN)
LGSIIPSAY

SEQ ID NO: 96966 - protein, 10 aa, Artificial Sequence
  Description of Artificial Sequence: Synthetic peptide
  Seed: MNVINTYTGY (MAGC3_HUMAN)
MSVINTYTGL

SEQ ID NO: 96967 - protein, 9 aa, Artificial Sequence
  Description of Artificial Sequence: Synthetic peptide
  Seed: ATDKDYSAF (MAGC3_HUMAN)
AYDKDYSAL

SEQ ID NO: 96968 - protein, 9 aa, Artificial Sequence
  Description of Artificial Sequence: Synthetic peptide
  Seed: MDPDNHSYF (MAGC3_HUMAN)
MTPDNHSYF

SEQ ID NO: 96969 - protein, 9 aa, Artificial Sequence
  Description of Artificial Sequence: Synthetic peptide
  Seed: MASASPSVM (MAGC3_HUMAN)
MMSASPSVH

SEQ ID NO: 96970 - protein, 10 aa, Artificial Sequence
  Description of Artificial Sequence: Synthetic peptide
  Seed: EVIWEVLSAI (MAGC3_HUMAN)
EVIWEVLSAY

SEQ ID NO: 96971 - protein, 9 aa, Artificial Sequence
  Description of Artificial Sequence: Synthetic peptide
  Seed: YKDYFPMIF (MAGC3_HUMAN)
YQDYFPMIF

SEQ ID NO: 96972 - protein, 10 aa, Artificial Sequence
  Description of Artificial Sequence: Synthetic peptide
  Seed: YTLDEKVDKL (MAGC3_HUMAN)
YQLDEKVDKV

SEQ ID NO: 96973 - protein, 8 aa, Artificial Sequence
  Description of Artificial Sequence: Synthetic peptide
  Seed: FPMIFRKA (MAGC3_HUMAN)
FPMIFRKL

SEQ ID NO: 96974 - protein, 9 aa, Artificial Sequence
  Description of Artificial Sequence: Synthetic peptide
  Seed: LIDDQGMPK (MAGC3_HUMAN)
LIDDQGMPM

SEQ ID NO: 96975 - protein, 10 aa, Artificial Sequence
  Description of Artificial Sequence: Synthetic peptide
  Seed: EMQMNVINTY (MAGC3_HUMAN)
EFQMNVINTY

SEQ ID NO: 96976 - protein, 9 aa, Artificial Sequence
  Description of Artificial Sequence: Synthetic peptide
  Seed: VDPDHFYVF (MAGC3_HUMAN)
VMPDHFYVF

SEQ ID NO: 96977 - protein, 9 aa, Artificial Sequence
  Description of Artificial Sequence: Synthetic peptide
  Seed: NTYTGYFPM (MAGC3_HUMAN)
NMYTGYFPF

SEQ ID NO: 96978 - protein, 10 aa, Artificial Sequence
  Description of Artificial Sequence: Synthetic peptide
  Seed: LTEVDPDHFY (MAGC3_HUMAN)
LAEVDPDHFY

SEQ ID NO: 96979 - protein, 10 aa, Artificial Sequence
  Description of Artificial Sequence: Synthetic peptide
  Seed: IELIFGIALT (MAGC3_HUMAN)
IPLIFGIALV

SEQ ID NO: 96980 - protein, 11 aa, Artificial Sequence
  Description of Artificial Sequence: Synthetic peptide
  Seed: KVAELVQFLLL (MAGC3_HUMAN)
KEAELVQFLLL

SEQ ID NO: 96981 - protein, 9 aa, Artificial Sequence
  Description of Artificial Sequence: Synthetic peptide
  Seed: KYKDYFPMI (MAGC3_HUMAN)
KMKDYFPMA

SEQ ID NO: 96982 - protein, 9 aa, Artificial Sequence
  Description of Artificial Sequence: Synthetic peptide
  Seed: KVDKLVQFL (MAGC3_HUMAN)
KMDKLVQFW

SEQ ID NO: 96983 - protein, 8 aa, Artificial Sequence
  Description of Artificial Sequence: Synthetic peptide
  Seed: TTDDATAM (MAGC3_HUMAN)
TGDDATAL

SEQ ID NO: 96984 - protein, 9 aa, Artificial Sequence
  Description of Artificial Sequence: Synthetic peptide
  Seed: YQAKEPLTR (MAGC3_HUMAN)
YRAKEPLTV

SEQ ID NO: 96985 - protein, 10 aa, Artificial Sequence
  Description of Artificial Sequence: Synthetic peptide
  Seed: LPTWRRGTGY (MAGC3_HUMAN)
LMTWRRGTGF

SEQ ID NO: 96986 - protein, 10 aa, Artificial Sequence
  Description of Artificial Sequence: Synthetic peptide
  Seed: YALDEKVAEL (MAGC3_HUMAN)
YVLDEKVAEL

SEQ ID NO: 96987 - protein, 9 aa, Artificial Sequence
  Description of Artificial Sequence: Synthetic peptide
  Seed: KLSSIIPSA (MAGC3_HUMAN)
KTSSIIPSY

SEQ ID NO: 96988 - protein, 10 aa, Artificial Sequence
  Description of Artificial Sequence: Synthetic peptide
  Seed: YSAFHLGHLR (MAGC3_HUMAN)
YGAFHLGHLR

SEQ ID NO: 96989 - protein, 10 aa, Artificial Sequence
  Description of Artificial Sequence: Synthetic peptide
  Seed: LPESESLPRY (MAGC3_HUMAN)
LPESESLPRF

SEQ ID NO: 96990 - protein, 9 aa, Artificial Sequence
  Description of Artificial Sequence: Synthetic peptide
  Seed: CSSPLLWTR (MAGC3_HUMAN)
CSSPLLWTK

SEQ ID NO: 96991 - protein, 10 aa, Artificial Sequence
  Description of Artificial Sequence: Synthetic peptide
  Seed: MPAAGMPPLP (MAGC3_HUMAN)
MVAAGMPPLF

SEQ ID NO: 96992 - protein, 9 aa, Artificial Sequence
  Description of Artificial Sequence: Synthetic peptide
  Seed: ALDEKVAEL (MAGC3_HUMAN)
AWDEKVAEY

SEQ ID NO: 96993 - protein, 9 aa, Artificial Sequence
  Description of Artificial Sequence: Synthetic peptide
  Seed: VIWEVLSAI (MAGC3_HUMAN)
VQWEVLSAL

SEQ ID NO: 96994 - protein, 10 aa, Artificial Sequence
  Description of Artificial Sequence: Synthetic peptide
  Seed: EAFCEESGLR (MAGC3_HUMAN)
EAFCEESGLK

SEQ ID NO: 96995 - protein, 10 aa, Artificial Sequence
  Description of Artificial Sequence: Synthetic peptide
  Seed: FADVLSRLAL (MAGC3_HUMAN)
FPDVLSRLAF

SEQ ID NO: 96996 - protein, 10 aa, Artificial Sequence
  Description of Artificial Sequence: Synthetic peptide
  Seed: FFEDTLDLTY (MAGC3_HUMAN)
FFEDTLDLTM

SEQ ID NO: 96997 - protein, 10 aa, Artificial Sequence
  Description of Artificial Sequence: Synthetic peptide
  Seed: ALDEKVAELV (MAGC3_HUMAN)
AIDEKVAELL

SEQ ID NO: 96998 - protein, 9 aa, Artificial Sequence
  Description of Artificial Sequence: Synthetic peptide
  Seed: HSYFFEDTL (MAGC3_HUMAN)
HLYFFEDTF

SEQ ID NO: 96999 - protein, 9 aa, Artificial Sequence
  Description of Artificial Sequence: Synthetic peptide
  Seed: FADVLSRLA (MAGC3_HUMAN)
FGDVLSRLF

SEQ ID NO: 97000 - protein, 11 aa, Artificial Sequence
  Description of Artificial Sequence: Synthetic peptide
  Seed: YFFEDTLDLTY (MAGC3_HUMAN)
YYFEDTLDLTM

SEQ ID NO: 97001 - protein, 10 aa, Artificial Sequence
  Description of Artificial Sequence: Synthetic peptide
  Seed: AEMQMNVINT (MAGC3_HUMAN)
AEMQMNVINI

SEQ ID NO: 97002 - protein, 9 aa, Artificial Sequence
  Description of Artificial Sequence: Synthetic peptide
  Seed: WRRGTGYTL (MAGC3_HUMAN)
WYRGTGYTY

SEQ ID NO: 97003 - protein, 10 aa, Artificial Sequence
  Description of Artificial Sequence: Synthetic peptide
  Seed: YALDEKVAEL (MAGC3_HUMAN)
YPLDEKVAEL

SEQ ID NO: 97004 - protein, 10 aa, Artificial Sequence
  Description of Artificial Sequence: Synthetic peptide
  Seed: SPQGPPQSPP (MAGC3_HUMAN)
SPQGPPQSPF

SEQ ID NO: 97005 - protein, 10 aa, Artificial Sequence
  Description of Artificial Sequence: Synthetic peptide
  Seed: MIFRKAREFI (MAGC3_HUMAN)
MVFRKAREFI

SEQ ID NO: 97006 - protein, 10 aa, Artificial Sequence
  Description of Artificial Sequence: Synthetic peptide
  Seed: LAGFADVLSR (MAGC3_HUMAN)
LMGFADVLSR

SEQ ID NO: 97007 - protein, 10 aa, Artificial Sequence
  Description of Artificial Sequence: Synthetic peptide
  Seed: LILILSMIFI (MAGC3_HUMAN)
LGLILSMIFV

SEQ ID NO: 97008 - protein, 9 aa, Artificial Sequence
  Description of Artificial Sequence: Synthetic peptide
  Seed: FHLGHLREV (MAGC3_HUMAN)
FALGHLREF

SEQ ID NO: 97009 - protein, 10 aa, Artificial Sequence
  Description of Artificial Sequence: Synthetic peptide
  Seed: MQMNVINTYT (MAGC3_HUMAN)
MPMNVINTYF

SEQ ID NO: 97010 - protein, 10 aa, Artificial Sequence
  Description of Artificial Sequence: Synthetic peptide
  Seed: MIFGKAHEFI (MAGC3_HUMAN)
MTFGKAHEFL

SEQ ID NO: 97011 - protein, 9 aa, Artificial Sequence
  Description of Artificial Sequence: Synthetic peptide
  Seed: SASPSVMST (MAGC3_HUMAN)
SYSPSVMSM

SEQ ID NO: 97012 - protein, 9 aa, Artificial Sequence
  Description of Artificial Sequence: Synthetic peptide
  Seed: MIFGKAHEF (MAGC3_HUMAN)
MCFGKAHEW

SEQ ID NO: 97013 - protein, 10 aa, Artificial Sequence
  Description of Artificial Sequence: Synthetic peptide
  Seed: SCSSPLLWTR (MAGC3_HUMAN)
SDSSPLLWTK

SEQ ID NO: 97014 - protein, 10 aa, Artificial Sequence
  Description of Artificial Sequence: Synthetic peptide
  Seed: EVIWEVLSAI (MAGC3_HUMAN)
ETIWEVLSAW

SEQ ID NO: 97015 - protein, 9 aa, Artificial Sequence
  Description of Artificial Sequence: Synthetic peptide
  Seed: NVINTYTGY (MAGC3_HUMAN)
NVINTYTGF

SEQ ID NO: 97016 - protein, 9 aa, Artificial Sequence
  Description of Artificial Sequence: Synthetic peptide
  Seed: KFSLRRAVS (MAGC3_HUMAN)
KYSLRRAVK

SEQ ID NO: 97017 - protein, 9 aa, Artificial Sequence
  Description of Artificial Sequence: Synthetic peptide
  Seed: KVDKLVQFL (MAGC3_HUMAN)
KIDKLVQFY

SEQ ID NO: 97018 - protein, 10 aa, Artificial Sequence
  Description of Artificial Sequence: Synthetic peptide
  Seed: LPTWRRGTGY (MAGC3_HUMAN)
LATWRRGTGW

SEQ ID NO: 97019 - protein, 10 aa, Artificial Sequence
  Description of Artificial Sequence: Synthetic peptide
  Seed: INTYTGYFPM (MAGC3_HUMAN)
IVTYTGYFPW

SEQ ID NO: 97020 - protein, 9 aa, Artificial Sequence
  Description of Artificial Sequence: Synthetic peptide
  Seed: LRSAEGSVL (MAGC3_HUMAN)
LSSAEGSVY

SEQ ID NO: 97021 - protein, 10 aa, Artificial Sequence
  Description of Artificial Sequence: Synthetic peptide
  Seed: MLTTVIKKYK (MAGC3_HUMAN)
MVTTVIKKYR

SEQ ID NO: 97022 - protein, 10 aa, Artificial Sequence
  Description of Artificial Sequence: Synthetic peptide
  Seed: ATFSDGSLGQ (MAGC3_HUMAN)
ATFSDGSLGY

SEQ ID NO: 97023 - protein, 9 aa, Artificial Sequence
  Description of Artificial Sequence: Synthetic peptide
  Seed: DKDYSAFHL (MAGC3_HUMAN)
DHDYSAFHF

SEQ ID NO: 97024 - protein, 9 aa, Artificial Sequence
  Description of Artificial Sequence: Synthetic peptide
  Seed: HALPESESL (MAGC3_HUMAN)
HLLPESESY

SEQ ID NO: 97025 - protein, 9 aa, Artificial Sequence
  Description of Artificial Sequence: Synthetic peptide
  Seed: LSDEQGMPQ (MAGC3_HUMAN)
LVDEQGMPL

SEQ ID NO: 97026 - protein, 10 aa, Artificial Sequence
  Description of Artificial Sequence: Synthetic peptide
  Seed: LVLCPTYFKL (MAGC3_HUMAN)
LMLCPTYFKM

SEQ ID NO: 97027 - protein, 9 aa, Artificial Sequence
  Description of Artificial Sequence: Synthetic peptide
  Seed: LSSIIPSAF (MAGC3_HUMAN)
LMSIIPSAW

SEQ ID NO: 97028 - protein, 9 aa, Artificial Sequence
  Description of Artificial Sequence: Synthetic peptide
  Seed: YFFEDTLDL (MAGC3_HUMAN)
YEFEDTLDF

SEQ ID NO: 97029 - protein, 10 aa, Artificial Sequence
  Description of Artificial Sequence: Synthetic peptide
  Seed: FSDGSLGQWV (MAGC3_HUMAN)
FVDGSLGQWL

SEQ ID NO: 97030 - protein, 8 aa, Artificial Sequence
  Description of Artificial Sequence: Synthetic peptide
  Seed: YMDALKDM (MAGC3_HUMAN)
YVDALKDL

SEQ ID NO: 97031 - protein, 8 aa, Artificial Sequence
  Description of Artificial Sequence: Synthetic peptide
  Seed: VLSRLALW (MAGC3_HUMAN)
VSSRLALW

SEQ ID NO: 97032 - protein, 10 aa, Artificial Sequence
  Description of Artificial Sequence: Synthetic peptide
  Seed: FFEDTLDLTY (MAGC3_HUMAN)
FIEDTLDLTM

SEQ ID NO: 97033 - protein, 10 aa, Artificial Sequence
  Description of Artificial Sequence: Synthetic peptide
  Seed: MNVINTYTGY (MAGC3_HUMAN)
MIVINTYTGY

SEQ ID NO: 97034 - protein, 11 aa, Artificial Sequence
  Description of Artificial Sequence: Synthetic peptide
  Seed: VINTYTGYFPM (MAGC3_HUMAN)
VMNTYTGYFPW

SEQ ID NO: 97035 - protein, 9 aa, Artificial Sequence
  Description of Artificial Sequence: Synthetic peptide
  Seed: VIWEVLSAI (MAGC3_HUMAN)
VTWEVLSAL

SEQ ID NO: 97036 - protein, 9 aa, Artificial Sequence
  Description of Artificial Sequence: Synthetic peptide
  Seed: WRRGTGYTL (MAGC3_HUMAN)
WMRGTGYTF

SEQ ID NO: 97037 - protein, 9 aa, Artificial Sequence
  Description of Artificial Sequence: Synthetic peptide
  Seed: NVINTYTGY (MAGC3_HUMAN)
NIINTYTGR

SEQ ID NO: 97038 - protein, 9 aa, Artificial Sequence
  Description of Artificial Sequence: Synthetic peptide
  Seed: RTLSGSPGL (MAGC3_HUMAN)
RMLSGSPGK

SEQ ID NO: 97039 - protein, 9 aa, Artificial Sequence
  Description of Artificial Sequence: Synthetic peptide
  Seed: TSDQRMDSL (MAGC3_HUMAN)
TLDQRMDSF

SEQ ID NO: 97040 - protein, 8 aa, Artificial Sequence
  Description of Artificial Sequence: Synthetic peptide
  Seed: YMDALKDM (MAGC3_HUMAN)
YFDALKDF

SEQ ID NO: 97041 - protein, 9 aa, Artificial Sequence
  Description of Artificial Sequence: Synthetic peptide
  Seed: MLLPCHWVL (MAGC3_HUMAN)
MYLPCHWVL

SEQ ID NO: 97042 - protein, 10 aa, Artificial Sequence
  Description of Artificial Sequence: Synthetic peptide
  Seed: RSAEGSVLDL (MAGC3_HUMAN)
RMAEGSVLDI

SEQ ID NO: 97043 - protein, 9 aa, Artificial Sequence
  Description of Artificial Sequence: Synthetic peptide
  Seed: ALDEKVAEL (MAGC3_HUMAN)
AADEKVAEC

SEQ ID NO: 97044 - protein, 10 aa, Artificial Sequence
  Description of Artificial Sequence: Synthetic peptide
  Seed: SIIPSAFPSW (MAGC3_HUMAN)
SMIPSAFPSF

SEQ ID NO: 97045 - protein, 9 aa, Artificial Sequence
  Description of Artificial Sequence: Synthetic peptide
  Seed: VLCPTYFKL (MAGC3_HUMAN)
VYCPTYFKM

SEQ ID NO: 97046 - protein, 10 aa, Artificial Sequence
  Description of Artificial Sequence: Synthetic peptide
  Seed: DMPAAGMPPL (MAGC3_HUMAN)
DYPAAGMPPL

SEQ ID NO: 97047 - protein, 10 aa, Artificial Sequence
  Description of Artificial Sequence: Synthetic peptide
  Seed: SSEEEDTATW (MAGC3_HUMAN)
SMEEEDTATF

SEQ ID NO: 97048 - protein, 9 aa, Artificial Sequence
  Description of Artificial Sequence: Synthetic peptide
  Seed: KYKDYFPMI (MAGC3_HUMAN)
KIKDYFPMV

SEQ ID NO: 97049 - protein, 9 aa, Artificial Sequence
  Description of Artificial Sequence: Synthetic peptide
  Seed: SQPEGKFSL (MAGC3_HUMAN)
SVPEGKFSI

SEQ ID NO: 97050 - protein, 9 aa, Artificial Sequence
  Description of Artificial Sequence: Synthetic peptide
  Seed: FEDTLDLTY (MAGC3_HUMAN)
FFDTLDLTL

SEQ ID NO: 97051 - protein, 9 aa, Artificial Sequence
  Description of Artificial Sequence: Synthetic peptide
  Seed: HLREVRLFL (MAGC3_HUMAN)
HMREVRLFI

SEQ ID NO: 97052 - protein, 9 aa, Artificial Sequence
  Description of Artificial Sequence: Synthetic peptide
  Seed: QGMPKNCLL (MAGC3_HUMAN)
QIMPKNCLW

SEQ ID NO: 97053 - protein, 10 aa, Artificial Sequence
  Description of Artificial Sequence: Synthetic peptide
  Seed: AFPSWYMDAL (MAGC3_HUMAN)
AWPSWYMDAW

SEQ ID NO: 97054 - protein, 9 aa, Artificial Sequence
  Description of Artificial Sequence: Synthetic peptide
  Seed: VIWEVLSAI (MAGC3_HUMAN)
VLWEVLSAM

SEQ ID NO: 97055 - protein, 10 aa, Artificial Sequence
  Description of Artificial Sequence: Synthetic peptide
  Seed: EVIWEVLNAI (MAGC3_HUMAN)
EFIWEVLNAV

SEQ ID NO: 97056 - protein, 9 aa, Artificial Sequence
  Description of Artificial Sequence: Synthetic peptide
  Seed: HALPESESL (MAGC3_HUMAN)
HSLPESESF

SEQ ID NO: 97057 - protein, 10 aa, Artificial Sequence
  Description of Artificial Sequence: Synthetic peptide
  Seed: MQMNVINTYT (MAGC3_HUMAN)
MCMNVINTYL

SEQ ID NO: 97058 - protein, 10 aa, Artificial Sequence
  Description of Artificial Sequence: Synthetic peptide
  Seed: MQMNVINTYT (MAGC3_HUMAN)
MLMNVINTYF

SEQ ID NO: 97059 - protein, 9 aa, Artificial Sequence
  Description of Artificial Sequence: Synthetic peptide
  Seed: RPAREVLEF (MAGC3_HUMAN)
RLAREVLEM

SEQ ID NO: 97060 - protein, 10 aa, Artificial Sequence
  Description of Artificial Sequence: Synthetic peptide
  Seed: EKVAELVQFL (MAGC3_HUMAN)
EDVAELVQFY

SEQ ID NO: 97061 - protein, 9 aa, Artificial Sequence
  Description of Artificial Sequence: Synthetic peptide
  Seed: ILILSMIFI (MAGC3_HUMAN)
ILILSMIFV

SEQ ID NO: 97062 - protein, 9 aa, Artificial Sequence
  Description of Artificial Sequence: Synthetic peptide
  Seed: LFGISLTEV (MAGC3_HUMAN)
LYGISLTEY

SEQ ID NO: 97063 - protein, 8 aa, Artificial Sequence
  Description of Artificial Sequence: Synthetic peptide
  Seed: VDKLVQFL (MAGC3_HUMAN)
VQKLVQFI

SEQ ID NO: 97064 - protein, 9 aa, Artificial Sequence
  Description of Artificial Sequence: Synthetic peptide
  Seed: EAFCEESGL (MAGC3_HUMAN)
EAFCEESGV

SEQ ID NO: 97065 - protein, 10 aa, Artificial Sequence
  Description of Artificial Sequence: Synthetic peptide
  Seed: KLVQFLLLKY (MAGC3_HUMAN)
KTVQFLLLKK

SEQ ID NO: 97066 - protein, 10 aa, Artificial Sequence
  Description of Artificial Sequence: Synthetic peptide
  Seed: TEVDPDHFYV (MAGC3_HUMAN)
TVVDPDHFYI

SEQ ID NO: 97067 - protein, 9 aa, Artificial Sequence
  Description of Artificial Sequence: Synthetic peptide
  Seed: SLRRAVSVK (MAGC3_HUMAN)
SVRRAVSVA

SEQ ID NO: 97068 - protein, 10 aa, Artificial Sequence
  Description of Artificial Sequence: Synthetic peptide
  Seed: FADVLSRLAL (MAGC3_HUMAN)
FYDVLSRLAL

SEQ ID NO: 97069 - protein, 9 aa, Artificial Sequence
  Description of Artificial Sequence: Synthetic peptide
  Seed: FSLRRAVSV (MAGC3_HUMAN)
FILRRAVSF

SEQ ID NO: 97070 - protein, 10 aa, Artificial Sequence
  Description of Artificial Sequence: Synthetic peptide
  Seed: MQMNVINTYT (MAGC3_HUMAN)
MKMNVINTYS

SEQ ID NO: 97071 - protein, 9 aa, Artificial Sequence
  Description of Artificial Sequence: Synthetic peptide
  Seed: MIFRKAREF (MAGC3_HUMAN)
MKFRKAREM

SEQ ID NO: 97072 - protein, 9 aa, Artificial Sequence
  Description of Artificial Sequence: Synthetic peptide
  Seed: VDPDHFYVF (MAGC3_HUMAN)
VAPDHFYVV

SEQ ID NO: 97073 - protein, 10 aa, Artificial Sequence
  Description of Artificial Sequence: Synthetic peptide
  Seed: YALSPVVLPP (MAGC3_HUMAN)
YGLSPVVLPT

SEQ ID NO: 97074 - protein, 9 aa, Artificial Sequence
  Description of Artificial Sequence: Synthetic peptide
  Seed: SIIPSAFPS (MAGC3_HUMAN)
SAIPSAFPI

SEQ ID NO: 97075 - protein, 10 aa, Artificial Sequence
  Description of Artificial Sequence: Synthetic peptide
  Seed: SDQRMDSLVL (MAGC3_HUMAN)
SLQRMDSLVM

SEQ ID NO: 97076 - protein, 9 aa, Artificial Sequence
  Description of Artificial Sequence: Synthetic peptide
  Seed: MQMNVINTY (MAGC3_HUMAN)
MHMNVINTM

SEQ ID NO: 97077 - protein, 9 aa, Artificial Sequence
  Description of Artificial Sequence: Synthetic peptide
  Seed: MPAAGMPPL (MAGC3_HUMAN)
MTAAGMPPT

SEQ ID NO: 97078 - protein, 8 aa, Artificial Sequence
  Description of Artificial Sequence: Synthetic peptide
  Seed: FLSKLSSI (MAGC3_HUMAN)
FQSKLSSV

SEQ ID NO: 97079 - protein, 9 aa, Artificial Sequence
  Description of Artificial Sequence: Synthetic peptide
  Seed: HSYFFEDTL (MAGC3_HUMAN)
HTYFFEDTF

SEQ ID NO: 97080 - protein, 9 aa, Artificial Sequence
  Description of Artificial Sequence: Synthetic peptide
  Seed: KYKDYFPMI (MAGC3_HUMAN)
KGKDYFPMA

SEQ ID NO: 97081 - protein, 10 aa, Artificial Sequence
  Description of Artificial Sequence: Synthetic peptide
  Seed: ILFGISLTEV (MAGC3_HUMAN)
ILFGISLTEL

SEQ ID NO: 97082 - protein, 9 aa, Artificial Sequence
  Description of Artificial Sequence: Synthetic peptide
  Seed: LVLCPTYFK (MAGC3_HUMAN)
LQLCPTYFR

SEQ ID NO: 97083 - protein, 10 aa, Artificial Sequence
  Description of Artificial Sequence: Synthetic peptide
  Seed: AMASASPSVM (MAGC3_HUMAN)
AYASASPSVY

SEQ ID NO: 97084 - protein, 9 aa, Artificial Sequence
  Description of Artificial Sequence: Synthetic peptide
  Seed: AEMLTTVIK (MAGC3_HUMAN)
AEMLTTVIL

SEQ ID NO: 97085 - protein, 9 aa, Artificial Sequence
  Description of Artificial Sequence: Synthetic peptide
  Seed: FSLRRAVSV (MAGC3_HUMAN)
FGLRRAVSM

SEQ ID NO: 97086 - protein, 9 aa, Artificial Sequence
  Description of Artificial Sequence: Synthetic peptide
  Seed: AMASASPSV (MAGC3_HUMAN)
AVASASPSA

SEQ ID NO: 97087 - protein, 9 aa, Artificial Sequence
  Description of Artificial Sequence: Synthetic peptide
  Seed: FEDTLDLTY (MAGC3_HUMAN)
FKDTLDLTF

SEQ ID NO: 97088 - protein, 9 aa, Artificial Sequence
  Description of Artificial Sequence: Synthetic peptide
  Seed: GYTLSLPAV (MAGC3_HUMAN)
GYTLSLPAM

SEQ ID NO: 97089 - protein, 9 aa, Artificial Sequence
  Description of Artificial Sequence: Synthetic peptide
  Seed: DMDPDNHSY (MAGC3_HUMAN)
DWDPDNHSM

SEQ ID NO: 97090 - protein, 11 aa, Artificial Sequence
  Description of Artificial Sequence: Synthetic peptide
  Seed: LTDMDPDNHSY (MAGC3_HUMAN)
LSDMDPDNHSL

SEQ ID NO: 97091 - protein, 9 aa, Artificial Sequence
  Description of Artificial Sequence: Synthetic peptide
  Seed: SLRRAVSVK (MAGC3_HUMAN)
SMRRAVSVI

SEQ ID NO: 97092 - protein, 10 aa, Artificial Sequence
  Description of Artificial Sequence: Synthetic peptide
  Seed: SPLDSCSSPL (MAGC3_HUMAN)
SLLDSCSSPI

SEQ ID NO: 97093 - protein, 10 aa, Artificial Sequence
  Description of Artificial Sequence: Synthetic peptide
  Seed: AMASASPSVM (MAGC3_HUMAN)
ALASASPSVI

SEQ ID NO: 97094 - protein, 9 aa, Artificial Sequence
  Description of Artificial Sequence: Synthetic peptide
  Seed: KLVQFLLLK (MAGC3_HUMAN)
KMVQFLLLY

SEQ ID NO: 97095 - protein, 8 aa, Artificial Sequence
  Description of Artificial Sequence: Synthetic peptide
  Seed: MEDRAQAI (MAGC3_HUMAN)
MSDRAQAL

SEQ ID NO: 97096 - protein, 10 aa, Artificial Sequence
  Description of Artificial Sequence: Synthetic peptide
  Seed: ALAGFADVLS (MAGC3_HUMAN)
AIAGFADVLV

SEQ ID NO: 97097 - protein, 11 aa, Artificial Sequence
  Description of Artificial Sequence: Synthetic peptide
  Seed: LSKLSSIIPSA (MAGC3_HUMAN)
LQKLSSIIPSL

SEQ ID NO: 97098 - protein, 10 aa, Artificial Sequence
  Description of Artificial Sequence: Synthetic peptide
  Seed: SKLSSIIPSA (MAGC3_HUMAN)
SSLSSIIPSA

SEQ ID NO: 97099 - protein, 9 aa, Artificial Sequence
  Description of Artificial Sequence: Synthetic peptide
  Seed: YSAFHLGHL (MAGC3_HUMAN)
YYAFHLGHV

SEQ ID NO: 97100 - protein, 9 aa, Artificial Sequence
  Description of Artificial Sequence: Synthetic peptide
  Seed: GLQLSDLHF (MAGC3_HUMAN)
GKQLSDLHF

SEQ ID NO: 97101 - protein, 9 aa, Artificial Sequence
  Description of Artificial Sequence: Synthetic peptide
  Seed: IFGKAHEFI (MAGC3_HUMAN)
IYGKAHEFV

SEQ ID NO: 97102 - protein, 10 aa, Artificial Sequence
  Description of Artificial Sequence: Synthetic peptide
  Seed: GHLREVRLFL (MAGC3_HUMAN)
GLLREVRLFL

SEQ ID NO: 97103 - protein, 9 aa, Artificial Sequence
  Description of Artificial Sequence: Synthetic peptide
  Seed: GYFPMIFRK (MAGC3_HUMAN)
GVFPMIFRY

SEQ ID NO: 97104 - protein, 9 aa, Artificial Sequence
  Description of Artificial Sequence: Synthetic peptide
  Seed: MEDRAQAII (MAGC3_HUMAN)
MMDRAQAII

SEQ ID NO: 97105 - protein, 9 aa, Artificial Sequence
  Description of Artificial Sequence: Synthetic peptide
  Seed: FPMIFRKAR (MAGC3_HUMAN)
FTMIFRKAR

SEQ ID NO: 97106 - protein, 9 aa, Artificial Sequence
  Description of Artificial Sequence: Synthetic peptide
  Seed: NTYTGYFPM (MAGC3_HUMAN)
NIYTGYFPV

SEQ ID NO: 97107 - protein, 9 aa, Artificial Sequence
  Description of Artificial Sequence: Synthetic peptide
  Seed: EFIELIFGI (MAGC3_HUMAN)
ETIELIFGF

SEQ ID NO: 97108 - protein, 11 aa, Artificial Sequence
  Description of Artificial Sequence: Synthetic peptide
  Seed: KGSCVPEEVIW (MAGC3_HUMAN)
KTSCVPEEVIF

SEQ ID NO: 97109 - protein, 9 aa, Artificial Sequence
  Description of Artificial Sequence: Synthetic peptide
  Seed: MPKNCLLIL (MAGC3_HUMAN)
MIKNCLLIF

SEQ ID NO: 97110 - protein, 10 aa, Artificial Sequence
  Description of Artificial Sequence: Synthetic peptide
  Seed: TGYFPMIFRK (MAGC3_HUMAN)
TVYFPMIFRR

SEQ ID NO: 97111 - protein, 9 aa, Artificial Sequence
  Description of Artificial Sequence: Synthetic peptide
  Seed: EVLEFLSKL (MAGC3_HUMAN)
ELLEFLSKI

SEQ ID NO: 97112 - protein, 9 aa, Artificial Sequence
  Description of Artificial Sequence: Synthetic peptide
  Seed: LSDLHFGSQ (MAGC3_HUMAN)
LLDLHFGSY

SEQ ID NO: 97113 - protein, 9 aa, Artificial Sequence
  Description of Artificial Sequence: Synthetic peptide
  Seed: MASASPSVM (MAGC3_HUMAN)
MASASPSVH

SEQ ID NO: 97114 - protein, 11 aa, Artificial Sequence
  Description of Artificial Sequence: Synthetic peptide
  Seed: LDSCSSPLLWT (MAGC3_HUMAN)
LFSCSSPLLWW

SEQ ID NO: 97115 - protein, 9 aa, Artificial Sequence
  Description of Artificial Sequence: Synthetic peptide
  Seed: FSLRRAVSV (MAGC3_HUMAN)
FLLRRAVST

SEQ ID NO: 97116 - protein, 9 aa, Artificial Sequence
  Description of Artificial Sequence: Synthetic peptide
  Seed: CATYALSPV (MAGC3_HUMAN)
CSTYALSPF

SEQ ID NO: 97117 - protein, 9 aa, Artificial Sequence
  Description of Artificial Sequence: Synthetic peptide
  Seed: MQMNVINTY (MAGC3_HUMAN)
MMMNVINTF

SEQ ID NO: 97118 - protein, 10 aa, Artificial Sequence
  Description of Artificial Sequence: Synthetic peptide
  Seed: EVIWEVLSAI (MAGC3_HUMAN)
EYIWEVLSAL

SEQ ID NO: 97119 - protein, 10 aa, Artificial Sequence
  Description of Artificial Sequence: Synthetic peptide
  Seed: MPAAGMPPLP (MAGC3_HUMAN)
MFAAGMPPLY

SEQ ID NO: 97120 - protein, 9 aa, Artificial Sequence
  Description of Artificial Sequence: Synthetic peptide
  Seed: VLCPTYFKL (MAGC3_HUMAN)
VLCPTYFKA

SEQ ID NO: 97121 - protein, 10 aa, Artificial Sequence
  Description of Artificial Sequence: Synthetic peptide
  Seed: FKLWRTLSGS (MAGC3_HUMAN)
FHLWRTLSGM

SEQ ID NO: 97122 - protein, 9 aa, Artificial Sequence
  Description of Artificial Sequence: Synthetic peptide
  Seed: NTYTGYFPM (MAGC3_HUMAN)
NLYTGYFPL

SEQ ID NO: 97123 - protein, 9 aa, Artificial Sequence
  Description of Artificial Sequence: Synthetic peptide
  Seed: LILSMIFIK (MAGC3_HUMAN)
LYLSMIFIK

SEQ ID NO: 97124 - protein, 9 aa, Artificial Sequence
  Description of Artificial Sequence: Synthetic peptide
  Seed: YTLDEKVDK (MAGC3_HUMAN)
YALDEKVDY

SEQ ID NO: 97125 - protein, 10 aa, Artificial Sequence
  Description of Artificial Sequence: Synthetic peptide
  Seed: MPQNRLLILI (MAGC3_HUMAN)
MPQNRLLILF

SEQ ID NO: 97126 - protein, 9 aa, Artificial Sequence
  Description of Artificial Sequence: Synthetic peptide
  Seed: HFYVFVNTL (MAGC3_HUMAN)
HQYVFVNTL

SEQ ID NO: 97127 - protein, 11 aa, Artificial Sequence
  Description of Artificial Sequence: Synthetic peptide
  Seed: IIDTTDDATAM (MAGC3_HUMAN)
ITDTTDDATAV

SEQ ID NO: 97128 - protein, 10 aa, Artificial Sequence
  Description of Artificial Sequence: Synthetic peptide
  Seed: KDYFPMIFGK (MAGC3_HUMAN)
KMYFPMIFGR

SEQ ID NO: 97129 - protein, 9 aa, Artificial Sequence
  Description of Artificial Sequence: Synthetic peptide
  Seed: KATDKDYSA (MAGC3_HUMAN)
KTTDKDYSM

SEQ ID NO: 97130 - protein, 9 aa, Artificial Sequence
  Description of Artificial Sequence: Synthetic peptide
  Seed: FADVLSRLA (MAGC3_HUMAN)
FYDVLSRLF

SEQ ID NO: 97131 - protein, 9 aa, Artificial Sequence
  Description of Artificial Sequence: Synthetic peptide
  Seed: HALPESESL (MAGC3_HUMAN)
HWLPESESM

SEQ ID NO: 97132 - protein, 9 aa, Artificial Sequence
  Description of Artificial Sequence: Synthetic peptide
  Seed: RTLSGSPGL (MAGC3_HUMAN)
RTLSGSPGY

SEQ ID NO: 97133 - protein, 11 aa, Artificial Sequence
  Description of Artificial Sequence: Synthetic peptide
  Seed: ATAMASASPSV (MAGC3_HUMAN)
AVAMASASPSV

SEQ ID NO: 97134 - protein, 10 aa, Artificial Sequence
  Description of Artificial Sequence: Synthetic peptide
  Seed: MDPDNHSYFF (MAGC3_HUMAN)
MNPDNHSYFW

SEQ ID NO: 97135 - protein, 9 aa, Artificial Sequence
  Description of Artificial Sequence: Synthetic peptide
  Seed: GSLPESEPL (MAGC3_HUMAN)
GMLPESEPI

SEQ ID NO: 97136 - protein, 9 aa, Artificial Sequence
  Description of Artificial Sequence: Synthetic peptide
  Seed: IIDTTDDAT (MAGC3_HUMAN)
ITDTTDDAV

SEQ ID NO: 97137 - protein, 10 aa, Artificial Sequence
  Description of Artificial Sequence: Synthetic peptide
  Seed: MQMNVINTYT (MAGC3_HUMAN)
MIMNVINTYL

SEQ ID NO: 97138 - protein, 9 aa, Artificial Sequence
  Description of Artificial Sequence: Synthetic peptide
  Seed: EFIELIFGI (MAGC3_HUMAN)
EQIELIFGV

SEQ ID NO: 97139 - protein, 9 aa, Artificial Sequence
  Description of Artificial Sequence: Synthetic peptide
  Seed: MIFRKAREF (MAGC3_HUMAN)
MMFRKAREF

SEQ ID NO: 97140 - protein, 9 aa, Artificial Sequence
  Description of Artificial Sequence: Synthetic peptide
  Seed: WESEGPEAF (MAGC3_HUMAN)
WQSEGPEAM

SEQ ID NO: 97141 - protein, 10 aa, Artificial Sequence
  Description of Artificial Sequence: Synthetic peptide
  Seed: NAIGPWSALA (MAGC3_HUMAN)
NTIGPWSALL

SEQ ID NO: 97142 - protein, 9 aa, Artificial Sequence
  Description of Artificial Sequence: Synthetic peptide
  Seed: SLRRAVSVK (MAGC3_HUMAN)
SQRRAVSVK

SEQ ID NO: 97143 - protein, 9 aa, Artificial Sequence
  Description of Artificial Sequence: Synthetic peptide
  Seed: FSLRRAVSV (MAGC3_HUMAN)
FGLRRAVSV

SEQ ID NO: 97144 - protein, 9 aa, Artificial Sequence
  Description of Artificial Sequence: Synthetic peptide
  Seed: QTKEPVTKA (MAGC3_HUMAN)
QIKEPVTKL

SEQ ID NO: 97145 - protein, 10 aa, Artificial Sequence
  Description of Artificial Sequence: Synthetic peptide
  Seed: EVIWEVLNAI (MAGC3_HUMAN)
EVIWEVLNAM

SEQ ID NO: 97146 - protein, 9 aa, Artificial Sequence
  Description of Artificial Sequence: Synthetic peptide
  Seed: EVLNAIGPW (MAGC3_HUMAN)
EMLNAIGPR

SEQ ID NO: 97147 - protein, 10 aa, Artificial Sequence
  Description of Artificial Sequence: Synthetic peptide
  Seed: KAEMLTTVIK (MAGC3_HUMAN)
KMEMLTTVIR

SEQ ID NO: 97148 - protein, 9 aa, Artificial Sequence
  Description of Artificial Sequence: Synthetic peptide
  Seed: TRAEMQMNV (MAGC3_HUMAN)
TRAEMQMNM

SEQ ID NO: 97149 - protein, 8 aa, Artificial Sequence
  Description of Artificial Sequence: Synthetic peptide
  Seed: YTLSLPAV (MAGC3_HUMAN)
YQLSLPAI

SEQ ID NO: 97150 - protein, 9 aa, Artificial Sequence
  Description of Artificial Sequence: Synthetic peptide
  Seed: IQRPAREVL (MAGC3_HUMAN)
IVRPAREVY

SEQ ID NO: 97151 - protein, 11 aa, Artificial Sequence
  Description of Artificial Sequence: Synthetic peptide
  Seed: KVAELVQFLLL (MAGC3_HUMAN)
KMAELVQFLLC

SEQ ID NO: 97152 - protein, 9 aa, Artificial Sequence
  Description of Artificial Sequence: Synthetic peptide
  Seed: KYKDYFPMI (MAGC3_HUMAN)
KGKDYFPMY

SEQ ID NO: 97153 - protein, 9 aa, Artificial Sequence
  Description of Artificial Sequence: Synthetic peptide
  Seed: TLDEKVDKL (MAGC3_HUMAN)
TYDEKVDKV

SEQ ID NO: 97154 - protein, 10 aa, Artificial Sequence
  Description of Artificial Sequence: Synthetic peptide
  Seed: LNAIGPWSAL (MAGC3_HUMAN)
LYAIGPWSAL

SEQ ID NO: 97155 - protein, 10 aa, Artificial Sequence
  Description of Artificial Sequence: Synthetic peptide
  Seed: DMPAAGMPPL (MAGC3_HUMAN)
DWPAAGMPPY

SEQ ID NO: 97156 - protein, 10 aa, Artificial Sequence
  Description of Artificial Sequence: Synthetic peptide
  Seed: LVLCPTYFKL (MAGC3_HUMAN)
LGLCPTYFKV

SEQ ID NO: 97157 - protein, 8 aa, Artificial Sequence
  Description of Artificial Sequence: Synthetic peptide
  Seed: HEFIELIF (MAGC3_HUMAN)
HEFIELIY

SEQ ID NO: 97158 - protein, 9 aa, Artificial Sequence
  Description of Artificial Sequence: Synthetic peptide
  Seed: YFFEDTLDL (MAGC3_HUMAN)
YTFEDTLDL

SEQ ID NO: 97159 - protein, 11 aa, Artificial Sequence
  Description of Artificial Sequence: Synthetic peptide
  Seed: AIIDTTDDATA (MAGC3_HUMAN)
AMIDTTDDATL

SEQ ID NO: 97160 - protein, 9 aa, Artificial Sequence
  Description of Artificial Sequence: Synthetic peptide
  Seed: MPAAGMPPL (MAGC3_HUMAN)
MMAAGMPPV

SEQ ID NO: 97161 - protein, 9 aa, Artificial Sequence
  Description of Artificial Sequence: Synthetic peptide
  Seed: IPPQGPPKI (MAGC3_HUMAN)
ILPQGPPKV

SEQ ID NO: 97162 - protein, 9 aa, Artificial Sequence
  Description of Artificial Sequence: Synthetic peptide
  Seed: FSLRRAVSV (MAGC3_HUMAN)
FLLRRAVSL

SEQ ID NO: 97163 - protein, 10 aa, Artificial Sequence
  Description of Artificial Sequence: Synthetic peptide
  Seed: TGYFPMIFRK (MAGC3_HUMAN)
TSYFPMIFRK

SEQ ID NO: 97164 - protein, 9 aa, Artificial Sequence
  Description of Artificial Sequence: Synthetic peptide
  Seed: YQAKEPLTR (MAGC3_HUMAN)
YMAKEPLTL

SEQ ID NO: 97165 - protein, 9 aa, Artificial Sequence
  Description of Artificial Sequence: Synthetic peptide
  Seed: LRSAEGSVL (MAGC3_HUMAN)
LQSAEGSVY

SEQ ID NO: 97166 - protein, 11 aa, Artificial Sequence
  Description of Artificial Sequence: Synthetic peptide
  Seed: INTYTGYFPMI (MAGC3_HUMAN)
IYTYTGYFPMW

SEQ ID NO: 97167 - protein, 9 aa, Artificial Sequence
  Description of Artificial Sequence: Synthetic peptide
  Seed: CSSPLLWTR (MAGC3_HUMAN)
CWSPLLWTR

SEQ ID NO: 97168 - protein, 10 aa, Artificial Sequence
  Description of Artificial Sequence: Synthetic peptide
  Seed: FSDGSLGQWV (MAGC3_HUMAN)
FVDGSLGQWM

SEQ ID NO: 97169 - protein, 9 aa, Artificial Sequence
  Description of Artificial Sequence: Synthetic peptide
  Seed: DMDPDNHSY (MAGC3_HUMAN)
DSDPDNHSY

SEQ ID NO: 97170 - protein, 10 aa, Artificial Sequence
  Description of Artificial Sequence: Synthetic peptide
  Seed: SALAGFADVL (MAGC3_HUMAN)
SYLAGFADVI

SEQ ID NO: 97171 - protein, 9 aa, Artificial Sequence
  Description of Artificial Sequence: Synthetic peptide
  Seed: QTKEPVTKA (MAGC3_HUMAN)
QQKEPVTKY

SEQ ID NO: 97172 - protein, 9 aa, Artificial Sequence
  Description of Artificial Sequence: Synthetic peptide
  Seed: LPAVSPGKR (MAGC3_HUMAN)
LTAVSPGKR

SEQ ID NO: 97173 - protein, 9 aa, Artificial Sequence
  Description of Artificial Sequence: Synthetic peptide
  Seed: NAIGPWSAL (MAGC3_HUMAN)
NFIGPWSAI

SEQ ID NO: 97174 - protein, 11 aa, Artificial Sequence
  Description of Artificial Sequence: Synthetic peptide
  Seed: SVKQREEPQDW (MAGC3_HUMAN)
STKQREEPQDW

SEQ ID NO: 97175 - protein, 10 aa, Artificial Sequence
  Description of Artificial Sequence: Synthetic peptide
  Seed: ILFGISLTEV (MAGC3_HUMAN)
ITFGISLTER

SEQ ID NO: 97176 - protein, 10 aa, Artificial Sequence
  Description of Artificial Sequence: Synthetic peptide
  Seed: NVINTYTGYF (MAGC3_HUMAN)
NMINTYTGYF

SEQ ID NO: 97177 - protein, 9 aa, Artificial Sequence
  Description of Artificial Sequence: Synthetic peptide
  Seed: NTYTGYFPM (MAGC3_HUMAN)
NMYTGYFPA

SEQ ID NO: 97178 - protein, 10 aa, Artificial Sequence
  Description of Artificial Sequence: Synthetic peptide
  Seed: YALSPVVLPP (MAGC3_HUMAN)
YHLSPVVLPA

SEQ ID NO: 97179 - protein, 11 aa, Artificial Sequence
  Description of Artificial Sequence: Synthetic peptide
  Seed: TDMDPDNHSYF (MAGC3_HUMAN)
TLMDPDNHSYF

SEQ ID NO: 97180 - protein, 10 aa, Artificial Sequence
  Description of Artificial Sequence: Synthetic peptide
  Seed: GPPQSPPQSP (MAGC3_HUMAN)
GPPQSPPQSL

SEQ ID NO: 97181 - protein, 9 aa, Artificial Sequence
  Description of Artificial Sequence: Synthetic peptide
  Seed: EIPPQGPPK (MAGC3_HUMAN)
ELPPQGPPK

SEQ ID NO: 97182 - protein, 9 aa, Artificial Sequence
  Description of Artificial Sequence: Synthetic peptide
  Seed: YFPMIFRKA (MAGC3_HUMAN)
YYPMIFRKM

SEQ ID NO: 97183 - protein, 9 aa, Artificial Sequence
  Description of Artificial Sequence: Synthetic peptide
  Seed: ALDEKVAEL (MAGC3_HUMAN)
ALDEKVAEV

SEQ ID NO: 97184 - protein, 9 aa, Artificial Sequence
  Description of Artificial Sequence: Synthetic peptide
  Seed: MIFGKAHEF (MAGC3_HUMAN)
MHFGKAHEY

SEQ ID NO: 97185 - protein, 9 aa, Artificial Sequence
  Description of Artificial Sequence: Synthetic peptide
  Seed: SQPEGKFSL (MAGC3_HUMAN)
STPEGKFSV

SEQ ID NO: 97186 - protein, 10 aa, Artificial Sequence
  Description of Artificial Sequence: Synthetic peptide
  Seed: LNAIGPWSAL (MAGC3_HUMAN)
LRAIGPWSAF

SEQ ID NO: 97187 - protein, 10 aa, Artificial Sequence
  Description of Artificial Sequence: Synthetic peptide
  Seed: IELIFGIALT (MAGC3_HUMAN)
ICLIFGIALL

SEQ ID NO: 97188 - protein, 9 aa, Artificial Sequence
  Description of Artificial Sequence: Synthetic peptide
  Seed: DMDPDNHSY (MAGC3_HUMAN)
DFDPDNHSL

SEQ ID NO: 97189 - protein, 9 aa, Artificial Sequence
  Description of Artificial Sequence: Synthetic peptide
  Seed: ISPQGPPQS (MAGC3_HUMAN)
IFPQGPPQL

SEQ ID NO: 97190 - protein, 11 aa, Artificial Sequence
  Description of Artificial Sequence: Synthetic peptide
  Seed: MQMNVINTYTG (MAGC3_HUMAN)
MKMNVINTYTF

SEQ ID NO: 97191 - protein, 11 aa, Artificial Sequence
  Description of Artificial Sequence: Synthetic peptide
  Seed: LTDMDPDNHSY (MAGC3_HUMAN)
LTDMDPDNHSM

SEQ ID NO: 97192 - protein, 9 aa, Artificial Sequence
  Description of Artificial Sequence: Synthetic peptide
  Seed: HFYVFVNTL (MAGC3_HUMAN)
HSYVFVNTF

SEQ ID NO: 97193 - protein, 9 aa, Artificial Sequence
  Description of Artificial Sequence: Synthetic peptide
  Seed: QTKEPVTKA (MAGC3_HUMAN)
QSKEPVTKM

SEQ ID NO: 97194 - protein, 9 aa, Artificial Sequence
  Description of Artificial Sequence: Synthetic peptide
  Seed: MIFGKAHEF (MAGC3_HUMAN)
MSFGKAHEW

SEQ ID NO: 97195 - protein, 10 aa, Artificial Sequence
  Description of Artificial Sequence: Synthetic peptide
  Seed: EMQMNVINTY (MAGC3_HUMAN)
EFQMNVINTF

SEQ ID NO: 97196 - protein, 10 aa, Artificial Sequence
  Description of Artificial Sequence: Synthetic peptide
  Seed: RLLILILSVI (MAGC3_HUMAN)
RVLILILSVV

SEQ ID NO: 97197 - protein, 10 aa, Artificial Sequence
  Description of Artificial Sequence: Synthetic peptide
  Seed: LVLCPTYFKL (MAGC3_HUMAN)
LPLCPTYFKV

SEQ ID NO: 97198 - protein, 10 aa, Artificial Sequence
  Description of Artificial Sequence: Synthetic peptide
  Seed: CASEEVIWEV (MAGC3_HUMAN)
CQSEEVIWEV

SEQ ID NO: 97199 - protein, 10 aa, Artificial Sequence
  Description of Artificial Sequence: Synthetic peptide
  Seed: SLPAVSPGKR (MAGC3_HUMAN)
SAPAVSPGKR

SEQ ID NO: 97200 - protein, 10 aa, Artificial Sequence
  Description of Artificial Sequence: Synthetic peptide
  Seed: LEFLSKLSSI (MAGC3_HUMAN)
LEFLSKLSSL

SEQ ID NO: 97201 - protein, 10 aa, Artificial Sequence
  Description of Artificial Sequence: Synthetic peptide
  Seed: TDMDPDNHSY (MAGC3_HUMAN)
TLMDPDNHSF

SEQ ID NO: 97202 - protein, 11 aa, Artificial Sequence
  Description of Artificial Sequence: Synthetic peptide
  Seed: AGSLPESEPLF (MAGC3_HUMAN)
ATSLPESEPLW

SEQ ID NO: 97203 - protein, 9 aa, Artificial Sequence
  Description of Artificial Sequence: Synthetic peptide
  Seed: VLCPTYFKL (MAGC3_HUMAN)
VICPTYFKA

SEQ ID NO: 97204 - protein, 9 aa, Artificial Sequence
  Description of Artificial Sequence: Synthetic peptide
  Seed: MQMNVINTY (MAGC3_HUMAN)
MFMNVINTY

SEQ ID NO: 97205 - protein, 9 aa, Artificial Sequence
  Description of Artificial Sequence: Synthetic peptide
  Seed: KAHEFIELI (MAGC3_HUMAN)
KLHEFIELY

SEQ ID NO: 97206 - protein, 11 aa, Artificial Sequence
  Description of Artificial Sequence: Synthetic peptide
  Seed: RYALDEKVAEL (MAGC3_HUMAN)
RYALDEKVAEV

SEQ ID NO: 97207 - protein, 11 aa, Artificial Sequence
  Description of Artificial Sequence: Synthetic peptide
  Seed: TDMDPDNHSYF (MAGC3_HUMAN)
TAMDPDNHSYL

SEQ ID NO: 97208 - protein, 8 aa, Artificial Sequence
  Description of Artificial Sequence: Synthetic peptide
  Seed: ADVLSRLA (MAGC3_HUMAN)
AEVLSRLA

SEQ ID NO: 97209 - protein, 9 aa, Artificial Sequence
  Description of Artificial Sequence: Synthetic peptide
  Seed: LKYQTKEPV (MAGC3_HUMAN)
LHYQTKEPA

SEQ ID NO: 97210 - protein, 10 aa, Artificial Sequence
  Description of Artificial Sequence: Synthetic peptide
  Seed: KKYKDYFPMI (MAGC3_HUMAN)
KDYKDYFPMW

SEQ ID NO: 97211 - protein, 9 aa, Artificial Sequence
  Description of Artificial Sequence: Synthetic peptide
  Seed: CHWVLDATF (MAGC3_HUMAN)
CQWVLDATL

SEQ ID NO: 97212 - protein, 10 aa, Artificial Sequence
  Description of Artificial Sequence: Synthetic peptide
  Seed: SCSSPLLWTR (MAGC3_HUMAN)
SKSSPLLWTR

SEQ ID NO: 97213 - protein, 9 aa, Artificial Sequence
  Description of Artificial Sequence: Synthetic peptide
  Seed: IIDTTDDAT (MAGC3_HUMAN)
IADTTDDAI

SEQ ID NO: 97214 - protein, 10 aa, Artificial Sequence
  Description of Artificial Sequence: Synthetic peptide
  Seed: VTKAEMLTTV (MAGC3_HUMAN)
VLKAEMLTTM

SEQ ID NO: 97215 - protein, 10 aa, Artificial Sequence
  Description of Artificial Sequence: Synthetic peptide
  Seed: IKKYKDYFPM (MAGC3_HUMAN)
IFKYKDYFPY

SEQ ID NO: 97216 - protein, 9 aa, Artificial Sequence
  Description of Artificial Sequence: Synthetic peptide
  Seed: HALPESESL (MAGC3_HUMAN)
HELPESESI

SEQ ID NO: 97217 - protein, 9 aa, Artificial Sequence
  Description of Artificial Sequence: Synthetic peptide
  Seed: AMASASPSV (MAGC3_HUMAN)
AMASASPSR

SEQ ID NO: 97218 - protein, 9 aa, Artificial Sequence
  Description of Artificial Sequence: Synthetic peptide
  Seed: QGMPQNRLL (MAGC3_HUMAN)
QQMPQNRLI

SEQ ID NO: 97219 - protein, 10 aa, Artificial Sequence
  Description of Artificial Sequence: Synthetic peptide
  Seed: RLWGEKAGSL (MAGC3_HUMAN)
RIWGEKAGSY

SEQ ID NO: 97220 - protein, 11 aa, Artificial Sequence
  Description of Artificial Sequence: Synthetic peptide
  Seed: VIKKYKDYFPM (MAGC3_HUMAN)
VMKKYKDYFPF

SEQ ID NO: 97221 - protein, 9 aa, Artificial Sequence
  Description of Artificial Sequence: Synthetic peptide
  Seed: CHWVLDATF (MAGC3_HUMAN)
CHWVLDATA

SEQ ID NO: 97222 - protein, 9 aa, Artificial Sequence
  Description of Artificial Sequence: Synthetic peptide
  Seed: MQMNVINTY (MAGC3_HUMAN)
MSMNVINTY

SEQ ID NO: 97223 - protein, 10 aa, Artificial Sequence
  Description of Artificial Sequence: Synthetic peptide
  Seed: TTDDATAMAS (MAGC3_HUMAN)
TNDDATAMAM

SEQ ID NO: 97224 - protein, 10 aa, Artificial Sequence
  Description of Artificial Sequence: Synthetic peptide
  Seed: EVLSAIGPIQ (MAGC3_HUMAN)
ETLSAIGPIR

SEQ ID NO: 97225 - protein, 11 aa, Artificial Sequence
  Description of Artificial Sequence: Synthetic peptide
  Seed: SSSEEEDTATW (MAGC3_HUMAN)
SVSEEEDTATF

SEQ ID NO: 97226 - protein, 10 aa, Artificial Sequence
  Description of Artificial Sequence: Synthetic peptide
  Seed: GPPQSPPQSP (MAGC3_HUMAN)
GPPQSPPQSM

SEQ ID NO: 97227 - protein, 9 aa, Artificial Sequence
  Description of Artificial Sequence: Synthetic peptide
  Seed: KLSSIIPSA (MAGC3_HUMAN)
KMSSIIPST

SEQ ID NO: 97228 - protein, 10 aa, Artificial Sequence
  Description of Artificial Sequence: Synthetic peptide
  Seed: KVAELVQFLL (MAGC3_HUMAN)
KSAELVQFLM

SEQ ID NO: 97229 - protein, 9 aa, Artificial Sequence
  Description of Artificial Sequence: Synthetic peptide
  Seed: ILILSVIFI (MAGC3_HUMAN)
IQILSVIFA

SEQ ID NO: 97230 - protein, 9 aa, Artificial Sequence
  Description of Artificial Sequence: Synthetic peptide
  Seed: KKYKDYFPM (MAGC3_HUMAN)
KYYKDYFPF

SEQ ID NO: 97231 - protein, 10 aa, Artificial Sequence
  Description of Artificial Sequence: Synthetic peptide
  Seed: MQMNVINTYT (MAGC3_HUMAN)
MQMNVINTYE

SEQ ID NO: 97232 - protein, 10 aa, Artificial Sequence
  Description of Artificial Sequence: Synthetic peptide
  Seed: TAMASASPSV (MAGC3_HUMAN)
TLMASASPSL

SEQ ID NO: 97233 - protein, 10 aa, Artificial Sequence
  Description of Artificial Sequence: Synthetic peptide
  Seed: KDSDLPTWRR (MAGC3_HUMAN)
KMSDLPTWRR

SEQ ID NO: 97234 - protein, 11 aa, Artificial Sequence
  Description of Artificial Sequence: Synthetic peptide
  Seed: LSKLSSIIPSA (MAGC3_HUMAN)
LFKLSSIIPSV

SEQ ID NO: 97235 - protein, 9 aa, Artificial Sequence
  Description of Artificial Sequence: Synthetic peptide
  Seed: YQAKEPLTR (MAGC3_HUMAN)
YSAKEPLTK

SEQ ID NO: 97236 - protein, 10 aa, Artificial Sequence
  Description of Artificial Sequence: Synthetic peptide
  Seed: MDSLVLCPTY (MAGC3_HUMAN)
MMSLVLCPTF

SEQ ID NO: 97237 - protein, 10 aa, Artificial Sequence
  Description of Artificial Sequence: Synthetic peptide
  Seed: YTLDEKVDKL (MAGC3_HUMAN)
YMLDEKVDKA

SEQ ID NO: 97238 - protein, 9 aa, Artificial Sequence
  Description of Artificial Sequence: Synthetic peptide
  Seed: MIFGKAHEF (MAGC3_HUMAN)
MIFGKAHEL

SEQ ID NO: 97239 - protein, 9 aa, Artificial Sequence
  Description of Artificial Sequence: Synthetic peptide
  Seed: FADVLSRLA (MAGC3_HUMAN)
FADVLSRLY

SEQ ID NO: 97240 - protein, 8 aa, Artificial Sequence
  Description of Artificial Sequence: Synthetic peptide
  Seed: FADVLSRL (MAGC3_HUMAN)
FNDVLSRM

SEQ ID NO: 97241 - protein, 9 aa, Artificial Sequence
  Description of Artificial Sequence: Synthetic peptide
  Seed: ISPQGPPQS (MAGC3_HUMAN)
ILPQGPPQM

SEQ ID NO: 97242 - protein, 9 aa, Artificial Sequence
  Description of Artificial Sequence: Synthetic peptide
  Seed: YTGYFPMIF (MAGC3_HUMAN)
YNGYFPMIY

SEQ ID NO: 97243 - protein, 9 aa, Artificial Sequence
  Description of Artificial Sequence: Synthetic peptide
  Seed: EVLSAIGPI (MAGC3_HUMAN)
EVLSAIGPV

SEQ ID NO: 97244 - protein, 9 aa, Artificial Sequence
  Description of Artificial Sequence: Synthetic peptide
  Seed: EAFCEESGL (MAGC3_HUMAN)
EAFCEESGR

SEQ ID NO: 97245 - protein, 9 aa, Artificial Sequence
  Description of Artificial Sequence: Synthetic peptide
  Seed: KVAELVQFL (MAGC3_HUMAN)
KGAELVQFI

SEQ ID NO: 97246 - protein, 9 aa, Artificial Sequence
  Description of Artificial Sequence: Synthetic peptide
  Seed: QTKEPVTKA (MAGC3_HUMAN)
QVKEPVTKM

SEQ ID NO: 97247 - protein, 8 aa, Artificial Sequence
  Description of Artificial Sequence: Synthetic peptide
  Seed: TTDDATAM (MAGC3_HUMAN)
TFDDATAM

SEQ ID NO: 97248 - protein, 10 aa, Artificial Sequence
  Description of Artificial Sequence: Synthetic peptide
  Seed: IPSAFPSWYM (MAGC3_HUMAN)
IKSAFPSWYF

SEQ ID NO: 97249 - protein, 9 aa, Artificial Sequence
  Description of Artificial Sequence: Synthetic peptide
  Seed: NTYTGYFPM (MAGC3_HUMAN)
NTYTGYFPL

SEQ ID NO: 97250 - protein, 9 aa, Artificial Sequence
  Description of Artificial Sequence: Synthetic peptide
  Seed: REEPQDWPL (MAGC3_HUMAN)
RQEPQDWPL

SEQ ID NO: 97251 - protein, 10 aa, Artificial Sequence
  Description of Artificial Sequence: Synthetic peptide
  Seed: YTLDEKVDKL (MAGC3_HUMAN)
YVLDEKVDKM

SEQ ID NO: 97252 - protein, 9 aa, Artificial Sequence
  Description of Artificial Sequence: Synthetic peptide
  Seed: MIFGKAHEF (MAGC3_HUMAN)
MMFGKAHEA

SEQ ID NO: 97253 - protein, 10 aa, Artificial Sequence
  Description of Artificial Sequence: Synthetic peptide
  Seed: MIFRKAREFI (MAGC3_HUMAN)
MNFRKAREFK

SEQ ID NO: 97254 - protein, 9 aa, Artificial Sequence
  Description of Artificial Sequence: Synthetic peptide
  Seed: FADVLSRLA (MAGC3_HUMAN)
FMDVLSRLL

SEQ ID NO: 97255 - protein, 9 aa, Artificial Sequence
  Description of Artificial Sequence: Synthetic peptide
  Seed: SLPESEPLF (MAGC3_HUMAN)
SMPESEPLF

SEQ ID NO: 97256 - protein, 9 aa, Artificial Sequence
  Description of Artificial Sequence: Synthetic peptide
  Seed: LWGEKAGSL (MAGC3_HUMAN)
LYGEKAGSM

SEQ ID NO: 97257 - protein, 9 aa, Artificial Sequence
  Description of Artificial Sequence: Synthetic peptide
  Seed: SALAGFADV (MAGC3_HUMAN)
STLAGFADV

SEQ ID NO: 97258 - protein, 9 aa, Artificial Sequence
  Description of Artificial Sequence: Synthetic peptide
  Seed: KAHEFIELI (MAGC3_HUMAN)
KDHEFIELF

SEQ ID NO: 97259 - protein, 10 aa, Artificial Sequence
  Description of Artificial Sequence: Synthetic peptide
  Seed: IELIFGIALT (MAGC3_HUMAN)
IYLIFGIALI

SEQ ID NO: 97260 - protein, 9 aa, Artificial Sequence
  Description of Artificial Sequence: Synthetic peptide
  Seed: EVLEFLSKL (MAGC3_HUMAN)
ELLEFLSKL

SEQ ID NO: 97261 - protein, 9 aa, Artificial Sequence
  Description of Artificial Sequence: Synthetic peptide
  Seed: SASPSVMST (MAGC3_HUMAN)
SGSPSVMSL

SEQ ID NO: 97262 - protein, 11 aa, Artificial Sequence
  Description of Artificial Sequence: Synthetic peptide
  Seed: SVLDLANPQGL (MAGC3_HUMAN)
SQLDLANPQGL

SEQ ID NO: 97263 - protein, 10 aa, Artificial Sequence
  Description of Artificial Sequence: Synthetic peptide
  Seed: FLSKLSSIIP (MAGC3_HUMAN)
FLSKLSSIIL

SEQ ID NO: 97264 - protein, 10 aa, Artificial Sequence
  Description of Artificial Sequence: Synthetic peptide
  Seed: EVIWEVLNAI (MAGC3_HUMAN)
ETIWEVLNAA

SEQ ID NO: 97265 - protein, 9 aa, Artificial Sequence
  Description of Artificial Sequence: Synthetic peptide
  Seed: ILILSVIFI (MAGC3_HUMAN)
IQILSVIFV

SEQ ID NO: 97266 - protein, 9 aa, Artificial Sequence
  Description of Artificial Sequence: Synthetic peptide
  Seed: VDPDHFYVF (MAGC3_HUMAN)
VSPDHFYVF

SEQ ID NO: 97267 - protein, 9 aa, Artificial Sequence
  Description of Artificial Sequence: Synthetic peptide
  Seed: HLREVRLFL (MAGC3_HUMAN)
HLREVRLFI

SEQ ID NO: 97268 - protein, 10 aa, Artificial Sequence
  Description of Artificial Sequence: Synthetic peptide
  Seed: TAMASASPSV (MAGC3_HUMAN)
TIMASASPSV

SEQ ID NO: 97269 - protein, 9 aa, Artificial Sequence
  Description of Artificial Sequence: Synthetic peptide
  Seed: VIWEVLSAI (MAGC3_HUMAN)
VTWEVLSAF

SEQ ID NO: 97270 - protein, 9 aa, Artificial Sequence
  Description of Artificial Sequence: Synthetic peptide
  Seed: WVKNTCATY (MAGC3_HUMAN)
WQKNTCATI

SEQ ID NO: 97271 - protein, 10 aa, Artificial Sequence
  Description of Artificial Sequence: Synthetic peptide
  Seed: MDSLVLCPTY (MAGC3_HUMAN)
MHSLVLCPTW

SEQ ID NO: 97272 - protein, 9 aa, Artificial Sequence
  Description of Artificial Sequence: Synthetic peptide
  Seed: SIIPSAFPS (MAGC3_HUMAN)
SIIPSAFPM

SEQ ID NO: 97273 - protein, 9 aa, Artificial Sequence
  Description of Artificial Sequence: Synthetic peptide
  Seed: RPAREVLEF (MAGC3_HUMAN)
RGAREVLEW

SEQ ID NO: 97274 - protein, 9 aa, Artificial Sequence
  Description of Artificial Sequence: Synthetic peptide
  Seed: YTGYFPMIF (MAGC3_HUMAN)
YHGYFPMIY

SEQ ID NO: 97275 - protein, 9 aa, Artificial Sequence
  Description of Artificial Sequence: Synthetic peptide
  Seed: TYFKLWRTL (MAGC3_HUMAN)
TRFKLWRTF

SEQ ID NO: 97276 - protein, 9 aa, Artificial Sequence
  Description of Artificial Sequence: Synthetic peptide
  Seed: TYALSPVVL (MAGC3_HUMAN)
TSALSPVVF

SEQ ID NO: 97277 - protein, 9 aa, Artificial Sequence
  Description of Artificial Sequence: Synthetic peptide
  Seed: HALPESESL (MAGC3_HUMAN)
HQLPESESI

SEQ ID NO: 97278 - protein, 11 aa, Artificial Sequence
  Description of Artificial Sequence: Synthetic peptide
  Seed: YFFEDTLDLTY (MAGC3_HUMAN)
YYFEDTLDLTF

SEQ ID NO: 97279 - protein, 8 aa, Artificial Sequence
  Description of Artificial Sequence: Synthetic peptide
  Seed: FADVLSRL (MAGC3_HUMAN)
FIDVLSRL

SEQ ID NO: 97280 - protein, 11 aa, Artificial Sequence
  Description of Artificial Sequence: Synthetic peptide
  Seed: RTLSGSPGLQL (MAGC3_HUMAN)
RELSGSPGLQF

SEQ ID NO: 97281 - protein, 9 aa, Artificial Sequence
  Description of Artificial Sequence: Synthetic peptide
  Seed: MIFRKAREF (MAGC3_HUMAN)
MAFRKAREI

SEQ ID NO: 97282 - protein, 10 aa, Artificial Sequence
  Description of Artificial Sequence: Synthetic peptide
  Seed: VTKAEMLTTV (MAGC3_HUMAN)
VLKAEMLTTV

SEQ ID NO: 97283 - protein, 8 aa, Artificial Sequence
  Description of Artificial Sequence: Synthetic peptide
  Seed: YMDALKDM (MAGC3_HUMAN)
YSDALKDL

SEQ ID NO: 97284 - protein, 9 aa, Artificial Sequence
  Description of Artificial Sequence: Synthetic peptide
  Seed: EIPPQGPPK (MAGC3_HUMAN)
EVPPQGPPK

SEQ ID NO: 97285 - protein, 11 aa, Artificial Sequence
  Description of Artificial Sequence: Synthetic peptide
  Seed: EVLSAIGPIQR (MAGC3_HUMAN)
EALSAIGPIQR

SEQ ID NO: 97286 - protein, 9 aa, Artificial Sequence
  Description of Artificial Sequence: Synthetic peptide
  Seed: VIWEVLNAI (MAGC3_HUMAN)
VAWEVLNAA

SEQ ID NO: 97287 - protein, 10 aa, Artificial Sequence
  Description of Artificial Sequence: Synthetic peptide
  Seed: RPAREVLEFL (MAGC3_HUMAN)
RSAREVLEFA

SEQ ID NO: 97288 - protein, 9 aa, Artificial Sequence
  Description of Artificial Sequence: Synthetic peptide
  Seed: TAMASASPS (MAGC3_HUMAN)
TSMASASPF

SEQ ID NO: 97289 - protein, 10 aa, Artificial Sequence
  Description of Artificial Sequence: Synthetic peptide
  Seed: TLDEKVDKLV (MAGC3_HUMAN)
TWDEKVDKLM

SEQ ID NO: 97290 - protein, 8 aa, Artificial Sequence
  Description of Artificial Sequence: Synthetic peptide
  Seed: ESLPRYAL (MAGC3_HUMAN)
EMLPRYAL

SEQ ID NO: 97291 - protein, 9 aa, Artificial Sequence
  Description of Artificial Sequence: Synthetic peptide
  Seed: LSSIIPSAF (MAGC3_HUMAN)
LMSIIPSAM

SEQ ID NO: 97292 - protein, 9 aa, Artificial Sequence
  Description of Artificial Sequence: Synthetic peptide
  Seed: QLSDLHFGS (MAGC3_HUMAN)
QVSDLHFGI

SEQ ID NO: 97293 - protein, 9 aa, Artificial Sequence
  Description of Artificial Sequence: Synthetic peptide
  Seed: TLDEKVDKL (MAGC3_HUMAN)
TSDEKVDKI

SEQ ID NO: 97294 - protein, 10 aa, Artificial Sequence
  Description of Artificial Sequence: Synthetic peptide
  Seed: EMQMNVINTY (MAGC3_HUMAN)
EVQMNVINTF

SEQ ID NO: 97295 - protein, 9 aa, Artificial Sequence
  Description of Artificial Sequence: Synthetic peptide
  Seed: NAIGPWSAL (MAGC3_HUMAN)
NMIGPWSAF

SEQ ID NO: 97296 - protein, 10 aa, Artificial Sequence
  Description of Artificial Sequence: Synthetic peptide
  Seed: YTGYFPMIFR (MAGC3_HUMAN)
YTGYFPMIFK

SEQ ID NO: 97297 - protein, 9 aa, Artificial Sequence
  Description of Artificial Sequence: Synthetic peptide
  Seed: VLPPQPQPR (MAGC3_HUMAN)
VIPPQPQPI

SEQ ID NO: 97298 - protein, 9 aa, Artificial Sequence
  Description of Artificial Sequence: Synthetic peptide
  Seed: SAFHLGHLR (MAGC3_HUMAN)
SAFHLGHLM

SEQ ID NO: 97299 - protein, 11 aa, Artificial Sequence
  Description of Artificial Sequence: Synthetic peptide
  Seed: FLSKLSSIIPS (MAGC3_HUMAN)
FMSKLSSIIPL

SEQ ID NO: 97300 - protein, 9 aa, Artificial Sequence
  Description of Artificial Sequence: Synthetic peptide
  Seed: KYKDYFPMI (MAGC3_HUMAN)
KVKDYFPMT

SEQ ID NO: 97301 - protein, 11 aa, Artificial Sequence
  Description of Artificial Sequence: Synthetic peptide
  Seed: ATFSDGSLGQW (MAGC3_HUMAN)
AIFSDGSLGQR

SEQ ID NO: 97302 - protein, 11 aa, Artificial Sequence
  Description of Artificial Sequence: Synthetic peptide
  Seed: TAMASASPSVM (MAGC3_HUMAN)
TQMASASPSVM

SEQ ID NO: 97303 - protein, 9 aa, Artificial Sequence
  Description of Artificial Sequence: Synthetic peptide
  Seed: ATYALSPVV (MAGC3_HUMAN)
AIYALSPVK

SEQ ID NO: 97304 - protein, 9 aa, Artificial Sequence
  Description of Artificial Sequence: Synthetic peptide
  Seed: LILILSMIF (MAGC3_HUMAN)
LRLILSMIY

SEQ ID NO: 97305 - protein, 10 aa, Artificial Sequence
  Description of Artificial Sequence: Synthetic peptide
  Seed: SDQRMDSLVL (MAGC3_HUMAN)
SKQRMDSLVY

SEQ ID NO: 97306 - protein, 9 aa, Artificial Sequence
  Description of Artificial Sequence: Synthetic peptide
  Seed: LRSAEGSVL (MAGC3_HUMAN)
LQSAEGSVM

SEQ ID NO: 97307 - protein, 11 aa, Artificial Sequence
  Description of Artificial Sequence: Synthetic peptide
  Seed: AIIDTTDDATA (MAGC3_HUMAN)
AIIDTTDDATL

SEQ ID NO: 97308 - protein, 10 aa, Artificial Sequence
  Description of Artificial Sequence: Synthetic peptide
  Seed: SIIPSAFPSW (MAGC3_HUMAN)
SIIPSAFPSF

SEQ ID NO: 97309 - protein, 9 aa, Artificial Sequence
  Description of Artificial Sequence: Synthetic peptide
  Seed: EVLSAIGPI (MAGC3_HUMAN)
ESLSAIGPI

SEQ ID NO: 97310 - protein, 9 aa, Artificial Sequence
  Description of Artificial Sequence: Synthetic peptide
  Seed: GQWVKNTCA (MAGC3_HUMAN)
GEWVKNTCL

SEQ ID NO: 97311 - protein, 10 aa, Artificial Sequence
  Description of Artificial Sequence: Synthetic peptide
  Seed: MIFGKAHEFI (MAGC3_HUMAN)
MLFGKAHEFV

SEQ ID NO: 97312 - protein, 9 aa, Artificial Sequence
  Description of Artificial Sequence: Synthetic peptide
  Seed: ALDEKVAEL (MAGC3_HUMAN)
AHDEKVAEY

SEQ ID NO: 97313 - protein, 9 aa, Artificial Sequence
  Description of Artificial Sequence: Synthetic peptide
  Seed: FEDTLDLTY (MAGC3_HUMAN)
FVDTLDLTM

SEQ ID NO: 97314 - protein, 10 aa, Artificial Sequence
  Description of Artificial Sequence: Synthetic peptide
  Seed: LNAIGPWSAL (MAGC3_HUMAN)
LPAIGPWSAY

SEQ ID NO: 97315 - protein, 9 aa, Artificial Sequence
  Description of Artificial Sequence: Synthetic peptide
  Seed: KAHEFIELI (MAGC3_HUMAN)
KCHEFIELW

SEQ ID NO: 97316 - protein, 9 aa, Artificial Sequence
  Description of Artificial Sequence: Synthetic peptide
  Seed: KVAELVQFL (MAGC3_HUMAN)
KRAELVQFV

SEQ ID NO: 97317 - protein, 9 aa, Artificial Sequence
  Description of Artificial Sequence: Synthetic peptide
  Seed: EFIELIFGI (MAGC3_HUMAN)
ECIELIFGV

SEQ ID NO: 97318 - protein, 10 aa, Artificial Sequence
  Description of Artificial Sequence: Synthetic peptide
  Seed: YALDEKVAEL (MAGC3_HUMAN)
YELDEKVAEY

SEQ ID NO: 97319 - protein, 11 aa, Artificial Sequence
  Description of Artificial Sequence: Synthetic peptide
  Seed: ATAMASASPSV (MAGC3_HUMAN)
ACAMASASPSV

SEQ ID NO: 97320 - protein, 9 aa, Artificial Sequence
  Description of Artificial Sequence: Synthetic peptide
  Seed: SALAGFADV (MAGC3_HUMAN)
SVLAGFADL

SEQ ID NO: 97321 - protein, 9 aa, Artificial Sequence
  Description of Artificial Sequence: Synthetic peptide
  Seed: AGFADVLSR (MAGC3_HUMAN)
AIFADVLSR

SEQ ID NO: 97322 - protein, 9 aa, Artificial Sequence
  Description of Artificial Sequence: Synthetic peptide
  Seed: FADVLSRLA (MAGC3_HUMAN)
FIDVLSRLV

SEQ ID NO: 97323 - protein, 9 aa, Artificial Sequence
  Description of Artificial Sequence: Synthetic peptide
  Seed: FGSQPEGKF (MAGC3_HUMAN)
FSSQPEGKW

SEQ ID NO: 97324 - protein, 10 aa, Artificial Sequence
  Description of Artificial Sequence: Synthetic peptide
  Seed: EEVIWEVLSA (MAGC3_HUMAN)
EKVIWEVLSV

SEQ ID NO: 97325 - protein, 9 aa, Artificial Sequence
  Description of Artificial Sequence: Synthetic peptide
  Seed: MIFGKAHEF (MAGC3_HUMAN)
MFFGKAHEI

SEQ ID NO: 97326 - protein, 9 aa, Artificial Sequence
  Description of Artificial Sequence: Synthetic peptide
  Seed: EVIWEVLNA (MAGC3_HUMAN)
ETIWEVLNK

SEQ ID NO: 97327 - protein, 9 aa, Artificial Sequence
  Description of Artificial Sequence: Synthetic peptide
  Seed: HFYVFVNTL (MAGC3_HUMAN)
HQYVFVNTF

SEQ ID NO: 97328 - protein, 9 aa, Artificial Sequence
  Description of Artificial Sequence: Synthetic peptide
  Seed: SLPESEPLF (MAGC3_HUMAN)
SFPESEPLM

SEQ ID NO: 97329 - protein, 10 aa, Artificial Sequence
  Description of Artificial Sequence: Synthetic peptide
  Seed: MQMNVINTYT (MAGC3_HUMAN)
MMMNVINTYQ

SEQ ID NO: 97330 - protein, 9 aa, Artificial Sequence
  Description of Artificial Sequence: Synthetic peptide
  Seed: MQMNVINTY (MAGC3_HUMAN)
MEMNVINTV

SEQ ID NO: 97331 - protein, 9 aa, Artificial Sequence
  Description of Artificial Sequence: Synthetic peptide
  Seed: FPMIFGKAH (MAGC3_HUMAN)
FMMIFGKAY

SEQ ID NO: 97332 - protein, 9 aa, Artificial Sequence
  Description of Artificial Sequence: Synthetic peptide
  Seed: YQAKEPLTR (MAGC3_HUMAN)
YAAKEPLTK

SEQ ID NO: 97333 - protein, 9 aa, Artificial Sequence
  Description of Artificial Sequence: Synthetic peptide
  Seed: TKAEMLTTV (MAGC3_HUMAN)
THAEMLTTV

SEQ ID NO: 97334 - protein, 10 aa, Artificial Sequence
  Description of Artificial Sequence: Synthetic peptide
  Seed: MPPLPQSPPE (MAGC3_HUMAN)
MPPLPQSPPA

SEQ ID NO: 97335 - protein, 9 aa, Artificial Sequence
  Description of Artificial Sequence: Synthetic peptide
  Seed: IQRPAREVL (MAGC3_HUMAN)
IERPAREVI

SEQ ID NO: 97336 - protein, 10 aa, Artificial Sequence
  Description of Artificial Sequence: Synthetic peptide
  Seed: IPSAFPSWYM (MAGC3_HUMAN)
ITSAFPSWYY

SEQ ID NO: 97337 - protein, 10 aa, Artificial Sequence
  Description of Artificial Sequence: Synthetic peptide
  Seed: TTDDATAMAS (MAGC3_HUMAN)
TCDDATAMAV

SEQ ID NO: 97338 - protein, 10 aa, Artificial Sequence
  Description of Artificial Sequence: Synthetic peptide
  Seed: TTDDATAMAS (MAGC3_HUMAN)
TMDDATAMAV

SEQ ID NO: 97339 - protein, 9 aa, Artificial Sequence
  Description of Artificial Sequence: Synthetic peptide
  Seed: VIWEVLNAI (MAGC3_HUMAN)
VTWEVLNAW

SEQ ID NO: 97340 - protein, 9 aa, Artificial Sequence
  Description of Artificial Sequence: Synthetic peptide
  Seed: EFIELIFGI (MAGC3_HUMAN)
EVIELIFGT

SEQ ID NO: 97341 - protein, 9 aa, Artificial Sequence
  Description of Artificial Sequence: Synthetic peptide
  Seed: LTTVIKKYK (MAGC3_HUMAN)
LTTVIKKYR

SEQ ID NO: 97342 - protein, 11 aa, Artificial Sequence
  Description of Artificial Sequence: Synthetic peptide
  Seed: DMDPDNHSYFF (MAGC3_HUMAN)
DLDPDNHSYFY

SEQ ID NO: 97343 - protein, 9 aa, Artificial Sequence
  Description of Artificial Sequence: Synthetic peptide
  Seed: FVNTLDLTC (MAGC3_HUMAN)
FANTLDLTM

SEQ ID NO: 97344 - protein, 10 aa, Artificial Sequence
  Description of Artificial Sequence: Synthetic peptide
  Seed: IKKYKDYFPM (MAGC3_HUMAN)
ITKYKDYFPY

SEQ ID NO: 97345 - protein, 10 aa, Artificial Sequence
  Description of Artificial Sequence: Synthetic peptide
  Seed: SLPAVSPGKR (MAGC3_HUMAN)
SAPAVSPGKK

SEQ ID NO: 97346 - protein, 10 aa, Artificial Sequence
  Description of Artificial Sequence: Synthetic peptide
  Seed: KLVQFLLLKY (MAGC3_HUMAN)
KMVQFLLLKR

SEQ ID NO: 97347 - protein, 8 aa, Artificial Sequence
  Description of Artificial Sequence: Synthetic peptide
  Seed: YMDALKDM (MAGC3_HUMAN)
YGDALKDL

SEQ ID NO: 97348 - protein, 10 aa, Artificial Sequence
  Description of Artificial Sequence: Synthetic peptide
  Seed: AMASASPSVM (MAGC3_HUMAN)
AQASASPSVY

SEQ ID NO: 97349 - protein, 9 aa, Artificial Sequence
  Description of Artificial Sequence: Synthetic peptide
  Seed: LTTVIKKYK (MAGC3_HUMAN)
LYTVIKKYR

SEQ ID NO: 97350 - protein, 8 aa, Artificial Sequence
  Description of Artificial Sequence: Synthetic peptide
  Seed: KVDKLVQF (MAGC3_HUMAN)
KSDKLVQY

SEQ ID NO: 97351 - protein, 9 aa, Artificial Sequence
  Description of Artificial Sequence: Synthetic peptide
  Seed: GYFPMIFRK (MAGC3_HUMAN)
GTFPMIFRK

SEQ ID NO: 97352 - protein, 8 aa, Artificial Sequence
  Description of Artificial Sequence: Synthetic peptide
  Seed: TTDDATAM (MAGC3_HUMAN)
TIDDATAM

SEQ ID NO: 97353 - protein, 8 aa, Artificial Sequence
  Description of Artificial Sequence: Synthetic peptide
  Seed: AEMLTTVI (MAGC3_HUMAN)
ADMLTTVL

SEQ ID NO: 97354 - protein, 10 aa, Artificial Sequence
  Description of Artificial Sequence: Synthetic peptide
  Seed: MDPDNHSYFF (MAGC3_HUMAN)
MRPDNHSYFL

SEQ ID NO: 97355 - protein, 9 aa, Artificial Sequence
  Description of Artificial Sequence: Synthetic peptide
  Seed: AMASASPSV (MAGC3_HUMAN)
ANASASPSY

SEQ ID NO: 97356 - protein, 9 aa, Artificial Sequence
  Description of Artificial Sequence: Synthetic peptide
  Seed: IIDTTDDAT (MAGC3_HUMAN)
IFDTTDDAM

SEQ ID NO: 97357 - protein, 9 aa, Artificial Sequence
  Description of Artificial Sequence: Synthetic peptide
  Seed: TLDEKVDKL (MAGC3_HUMAN)
TYDEKVDKI

SEQ ID NO: 97358 - protein, 9 aa, Artificial Sequence
  Description of Artificial Sequence: Synthetic peptide
  Seed: FLSKLSSII (MAGC3_HUMAN)
FMSKLSSIV

SEQ ID NO: 97359 - protein, 10 aa, Artificial Sequence
  Description of Artificial Sequence: Synthetic peptide
  Seed: FKLWRTLSGS (MAGC3_HUMAN)
FALWRTLSGI

SEQ ID NO: 97360 - protein, 10 aa, Artificial Sequence
  Description of Artificial Sequence: Synthetic peptide
  Seed: QWVKNTCATY (MAGC3_HUMAN)
QQVKNTCATY

SEQ ID NO: 97361 - protein, 9 aa, Artificial Sequence
  Description of Artificial Sequence: Synthetic peptide
  Seed: MQMNVINTY (MAGC3_HUMAN)
MKMNVINTW

SEQ ID NO: 97362 - protein, 11 aa, Artificial Sequence
  Description of Artificial Sequence: Synthetic peptide
  Seed: YALDEKVAELV (MAGC3_HUMAN)
YMLDEKVAELI

SEQ ID NO: 97363 - protein, 9 aa, Artificial Sequence
  Description of Artificial Sequence: Synthetic peptide
  Seed: EAFCEESGL (MAGC3_HUMAN)
EMFCEESGR

SEQ ID NO: 97364 - protein, 10 aa, Artificial Sequence
  Description of Artificial Sequence: Synthetic peptide
  Seed: ELVQFLLLKY (MAGC3_HUMAN)
EAVQFLLLKK

SEQ ID NO: 97365 - protein, 9 aa, Artificial Sequence
  Description of Artificial Sequence: Synthetic peptide
  Seed: SAEGSVLDL (MAGC3_HUMAN)
SFEGSVLDL

SEQ ID NO: 97366 - protein, 10 aa, Artificial Sequence
  Description of Artificial Sequence: Synthetic peptide
  Seed: FPSWYMDALK (MAGC3_HUMAN)
FCSWYMDALR

SEQ ID NO: 97367 - protein, 9 aa, Artificial Sequence
  Description of Artificial Sequence: Synthetic peptide
  Seed: TTDDATAMA (MAGC3_HUMAN)
TCDDATAML

SEQ ID NO: 97368 - protein, 9 aa, Artificial Sequence
  Description of Artificial Sequence: Synthetic peptide
  Seed: YALDEKVAE (MAGC3_HUMAN)
YSLDEKVAF

SEQ ID NO: 97369 - protein, 11 aa, Artificial Sequence
  Description of Artificial Sequence: Synthetic peptide
  Seed: FIELIFGIALT (MAGC3_HUMAN)
FTELIFGIALI

SEQ ID NO: 97370 - protein, 10 aa, Artificial Sequence
  Description of Artificial Sequence: Synthetic peptide
  Seed: EEVIWEVLSA (MAGC3_HUMAN)
EDVIWEVLSV

SEQ ID NO: 97371 - protein, 9 aa, Artificial Sequence
  Description of Artificial Sequence: Synthetic peptide
  Seed: VIWEVLNAI (MAGC3_HUMAN)
VLWEVLNAV

SEQ ID NO: 97372 - protein, 9 aa, Artificial Sequence
  Description of Artificial Sequence: Synthetic peptide
  Seed: MDPDNHSYF (MAGC3_HUMAN)
MFPDNHSYY

SEQ ID NO: 97373 - protein, 9 aa, Artificial Sequence
  Description of Artificial Sequence: Synthetic peptide
  Seed: SIIPSAFPS (MAGC3_HUMAN)
SSIPSAFPI

SEQ ID NO: 97374 - protein, 9 aa, Artificial Sequence
  Description of Artificial Sequence: Synthetic peptide
  Seed: ALDEKVAEL (MAGC3_HUMAN)
AADEKVAEV

SEQ ID NO: 97375 - protein, 9 aa, Artificial Sequence
  Description of Artificial Sequence: Synthetic peptide
  Seed: HALPESESL (MAGC3_HUMAN)
HMLPESESI

SEQ ID NO: 97376 - protein, 9 aa, Artificial Sequence
  Description of Artificial Sequence: Synthetic peptide
  Seed: FLSKLSSII (MAGC3_HUMAN)
FTSKLSSIM

SEQ ID NO: 97377 - protein, 10 aa, Artificial Sequence
  Description of Artificial Sequence: Synthetic peptide
  Seed: TLDEKVDKLV (MAGC3_HUMAN)
TADEKVDKLM

SEQ ID NO: 97378 - protein, 10 aa, Artificial Sequence
  Description of Artificial Sequence: Synthetic peptide
  Seed: MPAAGMPPLP (MAGC3_HUMAN)
MPAAGMPPLH

SEQ ID NO: 97379 - protein, 9 aa, Artificial Sequence
  Description of Artificial Sequence: Synthetic peptide
  Seed: SIIPSAFPS (MAGC3_HUMAN)
SSIPSAFPV

SEQ ID NO: 97380 - protein, 9 aa, Artificial Sequence
  Description of Artificial Sequence: Synthetic peptide
  Seed: TKAEMLTTV (MAGC3_HUMAN)
TQAEMLTTV

SEQ ID NO: 97381 - protein, 10 aa, Artificial Sequence
  Description of Artificial Sequence: Synthetic peptide
  Seed: TLDEKVDKLV (MAGC3_HUMAN)
TTDEKVDKLF

SEQ ID NO: 97382 - protein, 9 aa, Artificial Sequence
  Description of Artificial Sequence: Synthetic peptide
  Seed: IPSAFPSWY (MAGC3_HUMAN)
ITSAFPSWY

SEQ ID NO: 97383 - protein, 10 aa, Artificial Sequence
  Description of Artificial Sequence: Synthetic peptide
  Seed: LVLCPTYFKL (MAGC3_HUMAN)
LDLCPTYFKV

SEQ ID NO: 97384 - protein, 9 aa, Artificial Sequence
  Description of Artificial Sequence: Synthetic peptide
  Seed: EVLSAIGPI (MAGC3_HUMAN)
EALSAIGPL

SEQ ID NO: 97385 - protein, 10 aa, Artificial Sequence
  Description of Artificial Sequence: Synthetic peptide
  Seed: ATDKDYSAFH (MAGC3_HUMAN)
AIDKDYSAFY

SEQ ID NO: 97386 - protein, 9 aa, Artificial Sequence
  Description of Artificial Sequence: Synthetic peptide
  Seed: FLSKLSSII (MAGC3_HUMAN)
FKSKLSSIF

SEQ ID NO: 97387 - protein, 9 aa, Artificial Sequence
  Description of Artificial Sequence: Synthetic peptide
  Seed: FSLRRAVSV (MAGC3_HUMAN)
FSLRRAVSF

SEQ ID NO: 97388 - protein, 9 aa, Artificial Sequence
  Description of Artificial Sequence: Synthetic peptide
  Seed: TKAEMLTTV (MAGC3_HUMAN)
TQAEMLTTA

SEQ ID NO: 97389 - protein, 9 aa, Artificial Sequence
  Description of Artificial Sequence: Synthetic peptide
  Seed: MLLPCHWVL (MAGC3_HUMAN)
MILPCHWVF

SEQ ID NO: 97390 - protein, 9 aa, Artificial Sequence
  Description of Artificial Sequence: Synthetic peptide
  Seed: HEFIELIFG (MAGC3_HUMAN)
HEFIELIFL

SEQ ID NO: 97391 - protein, 9 aa, Artificial Sequence
  Description of Artificial Sequence: Synthetic peptide
  Seed: YALSPVVLP (MAGC3_HUMAN)
YTLSPVVLF

SEQ ID NO: 97392 - protein, 9 aa, Artificial Sequence
  Description of Artificial Sequence: Synthetic peptide
  Seed: FLSKLSSII (MAGC3_HUMAN)
FGSKLSSIY

SEQ ID NO: 97393 - protein, 9 aa, Artificial Sequence
  Description of Artificial Sequence: Synthetic peptide
  Seed: AGFADVLSR (MAGC3_HUMAN)
ATFADVLSI

SEQ ID NO: 97394 - protein, 10 aa, Artificial Sequence
  Description of Artificial Sequence: Synthetic peptide
  Seed: TAMASASPSV (MAGC3_HUMAN)
TRMASASPSI

SEQ ID NO: 97395 - protein, 9 aa, Artificial Sequence
  Description of Artificial Sequence: Synthetic peptide
  Seed: SAFHLGHLR (MAGC3_HUMAN)
STFHLGHLK

SEQ ID NO: 97396 - protein, 9 aa, Artificial Sequence
  Description of Artificial Sequence: Synthetic peptide
  Seed: LSGSPGLQL (MAGC3_HUMAN)
LAGSPGLQL

SEQ ID NO: 97397 - protein, 10 aa, Artificial Sequence
  Description of Artificial Sequence: Synthetic peptide
  Seed: WRTLSGSPGL (MAGC3_HUMAN)
WMTLSGSPGV

SEQ ID NO: 97398 - protein, 9 aa, Artificial Sequence
  Description of Artificial Sequence: Synthetic peptide
  Seed: QPEGKFSLR (MAGC3_HUMAN)
QVEGKFSLR

SEQ ID NO: 97399 - protein, 9 aa, Artificial Sequence
  Description of Artificial Sequence: Synthetic peptide
  Seed: MEDRAQAII (MAGC3_HUMAN)
MQDRAQAIM

SEQ ID NO: 97400 - protein, 9 aa, Artificial Sequence
  Description of Artificial Sequence: Synthetic peptide
  Seed: TTDDATAMA (MAGC3_HUMAN)
TGDDATAMI

SEQ ID NO: 97401 - protein, 9 aa, Artificial Sequence
  Description of Artificial Sequence: Synthetic peptide
  Seed: TSDQRMDSL (MAGC3_HUMAN)
TMDQRMDSF

SEQ ID NO: 97402 - protein, 10 aa, Artificial Sequence
  Description of Artificial Sequence: Synthetic peptide
  Seed: NAIGPWSALA (MAGC3_HUMAN)
NIIGPWSALV

SEQ ID NO: 97403 - protein, 11 aa, Artificial Sequence
  Description of Artificial Sequence: Synthetic peptide
  Seed: SASPSVMSTNF (MAGC3_HUMAN)
SMSPSVMSTNY

SEQ ID NO: 97404 - protein, 9 aa, Artificial Sequence
  Description of Artificial Sequence: Synthetic peptide
  Seed: LILILSVIF (MAGC3_HUMAN)
LQLILSVIY

SEQ ID NO: 97405 - protein, 10 aa, Artificial Sequence
  Description of Artificial Sequence: Synthetic peptide
  Seed: TGYFPMIFRK (MAGC3_HUMAN)
TPYFPMIFRR

SEQ ID NO: 97406 - protein, 10 aa, Artificial Sequence
  Description of Artificial Sequence: Synthetic peptide
  Seed: LVLCPTYFKL (MAGC3_HUMAN)
LWLCPTYFKV

SEQ ID NO: 97407 - protein, 9 aa, Artificial Sequence
  Description of Artificial Sequence: Synthetic peptide
  Seed: RPAREVLEF (MAGC3_HUMAN)
RHAREVLEF

SEQ ID NO: 97408 - protein, 10 aa, Artificial Sequence
  Description of Artificial Sequence: Synthetic peptide
  Seed: GSQPEGKFSL (MAGC3_HUMAN)
GSQPEGKFSW

SEQ ID NO: 97409 - protein, 9 aa, Artificial Sequence
  Description of Artificial Sequence: Synthetic peptide
  Seed: VINTYTGYF (MAGC3_HUMAN)
VLNTYTGYY

SEQ ID NO: 97410 - protein, 9 aa, Artificial Sequence
  Description of Artificial Sequence: Synthetic peptide
  Seed: YFFEDTLDL (MAGC3_HUMAN)
YMFEDTLDS

SEQ ID NO: 97411 - protein, 10 aa, Artificial Sequence
  Description of Artificial Sequence: Synthetic peptide
  Seed: LLILILSMIF (MAGC3_HUMAN)
LMILILSMIY

SEQ ID NO: 97412 - protein, 10 aa, Artificial Sequence
  Description of Artificial Sequence: Synthetic peptide
  Seed: CASEEVIWEV (MAGC3_HUMAN)
CVSEEVIWEV

SEQ ID NO: 97413 - protein, 9 aa, Artificial Sequence
  Description of Artificial Sequence: Synthetic peptide
  Seed: LKYQTKEPV (MAGC3_HUMAN)
LHYQTKEPY

SEQ ID NO: 97414 - protein, 9 aa, Artificial Sequence
  Description of Artificial Sequence: Synthetic peptide
  Seed: YFFEDTLDL (MAGC3_HUMAN)
YLFEDTLDS

SEQ ID NO: 97415 - protein, 10 aa, Artificial Sequence
  Description of Artificial Sequence: Synthetic peptide
  Seed: LLKYQAKEPL (MAGC3_HUMAN)
LCKYQAKEPY

SEQ ID NO: 97416 - protein, 9 aa, Artificial Sequence
  Description of Artificial Sequence: Synthetic peptide
  Seed: HALPESESL (MAGC3_HUMAN)
HSLPESESM

SEQ ID NO: 97417 - protein, 9 aa, Artificial Sequence
  Description of Artificial Sequence: Synthetic peptide
  Seed: KLVQFLLLK (MAGC3_HUMAN)
KTVQFLLLI

SEQ ID NO: 97418 - protein, 9 aa, Artificial Sequence
  Description of Artificial Sequence: Synthetic peptide
  Seed: KYKDYFPMI (MAGC3_HUMAN)
KFKDYFPMW

SEQ ID NO: 97419 - protein, 9 aa, Artificial Sequence
  Description of Artificial Sequence: Synthetic peptide
  Seed: MLLPCHWVL (MAGC3_HUMAN)
MKLPCHWVM

SEQ ID NO: 97420 - protein, 9 aa, Artificial Sequence
  Description of Artificial Sequence: Synthetic peptide
  Seed: NTYTGYFPM (MAGC3_HUMAN)
NYYTGYFPV

SEQ ID NO: 97421 - protein, 11 aa, Artificial Sequence
  Description of Artificial Sequence: Synthetic peptide
  Seed: LSKLSSIIPSA (MAGC3_HUMAN)
LMKLSSIIPSI

SEQ ID NO: 97422 - protein, 9 aa, Artificial Sequence
  Description of Artificial Sequence: Synthetic peptide
  Seed: LSSIIPSAF (MAGC3_HUMAN)
LPSIIPSAA

SEQ ID NO: 97423 - protein, 9 aa, Artificial Sequence
  Description of Artificial Sequence: Synthetic peptide
  Seed: YSAFHLGHL (MAGC3_HUMAN)
YKAFHLGHF

SEQ ID NO: 97424 - protein, 9 aa, Artificial Sequence
  Description of Artificial Sequence: Synthetic peptide
  Seed: ISPQGPPQS (MAGC3_HUMAN)
IMPQGPPQI

SEQ ID NO: 97425 - protein, 9 aa, Artificial Sequence
  Description of Artificial Sequence: Synthetic peptide
  Seed: TSDQRMDSL (MAGC3_HUMAN)
TQDQRMDSM

SEQ ID NO: 97426 - protein, 9 aa, Artificial Sequence
  Description of Artificial Sequence: Synthetic peptide
  Seed: ASEEVIWEV (MAGC3_HUMAN)
ALEEVIWEA

SEQ ID NO: 97427 - protein, 11 aa, Artificial Sequence
  Description of Artificial Sequence: Synthetic peptide
  Seed: ATFSDGSLGQW (MAGC3_HUMAN)
AIFSDGSLGQY

SEQ ID NO: 97428 - protein, 9 aa, Artificial Sequence
  Description of Artificial Sequence: Synthetic peptide
  Seed: NPQGLAGHR (MAGC3_HUMAN)
NLQGLAGHR

SEQ ID NO: 97429 - protein, 9 aa, Artificial Sequence
  Description of Artificial Sequence: Synthetic peptide
  Seed: FSDGSLGQW (MAGC3_HUMAN)
FLDGSLGQI

SEQ ID NO: 97430 - protein, 9 aa, Artificial Sequence
  Description of Artificial Sequence: Synthetic peptide
  Seed: AGFADVLSR (MAGC3_HUMAN)
ASFADVLSY

SEQ ID NO: 97431 - protein, 10 aa, Artificial Sequence
  Description of Artificial Sequence: Synthetic peptide
  Seed: YALDEKVAEL (MAGC3_HUMAN)
YGLDEKVAEL

SEQ ID NO: 97432 - protein, 10 aa, Artificial Sequence
  Description of Artificial Sequence: Synthetic peptide
  Seed: SLPESEPLFT (MAGC3_HUMAN)
SMPESEPLFV

SEQ ID NO: 97433 - protein, 9 aa, Artificial Sequence
  Description of Artificial Sequence: Synthetic peptide
  Seed: LKYQTKEPV (MAGC3_HUMAN)
LLYQTKEPF

SEQ ID NO: 97434 - protein, 9 aa, Artificial Sequence
  Description of Artificial Sequence: Synthetic peptide
  Seed: IIPSAFPSW (MAGC3_HUMAN)
ITPSAFPSV

SEQ ID NO: 97435 - protein, 9 aa, Artificial Sequence
  Description of Artificial Sequence: Synthetic peptide
  Seed: KVDKLVQFL (MAGC3_HUMAN)
KYDKLVQFM

SEQ ID NO: 97436 - protein, 9 aa, Artificial Sequence
  Description of Artificial Sequence: Synthetic peptide
  Seed: FADVLSRLA (MAGC3_HUMAN)
FGDVLSRLI

SEQ ID NO: 97437 - protein, 10 aa, Artificial Sequence
  Description of Artificial Sequence: Synthetic peptide
  Seed: MNVINTYTGY (MAGC3_HUMAN)
MIVINTYTGR

SEQ ID NO: 97438 - protein, 9 aa, Artificial Sequence
  Description of Artificial Sequence: Synthetic peptide
  Seed: EVLNAIGPW (MAGC3_HUMAN)
ETLNAIGPY

SEQ ID NO: 97439 - protein, 9 aa, Artificial Sequence
  Description of Artificial Sequence: Synthetic peptide
  Seed: FPSWYMDAL (MAGC3_HUMAN)
FCSWYMDAY

SEQ ID NO: 97440 - protein, 9 aa, Artificial Sequence
  Description of Artificial Sequence: Synthetic peptide
  Seed: MASASPSVM (MAGC3_HUMAN)
MNSASPSVM

SEQ ID NO: 97441 - protein, 10 aa, Artificial Sequence
  Description of Artificial Sequence: Synthetic peptide
  Seed: MPQNRLLILI (MAGC3_HUMAN)
MPQNRLLILM

SEQ ID NO: 97442 - protein, 10 aa, Artificial Sequence
  Description of Artificial Sequence: Synthetic peptide
  Seed: RLLILILSVI (MAGC3_HUMAN)
RMLILILSVL

SEQ ID NO: 97443 - protein, 10 aa, Artificial Sequence
  Description of Artificial Sequence: Synthetic peptide
  Seed: SKLSSIIPSA (MAGC3_HUMAN)
STLSSIIPSL

SEQ ID NO: 97444 - protein, 9 aa, Artificial Sequence
  Description of Artificial Sequence: Synthetic peptide
  Seed: RTLWKDSDL (MAGC3_HUMAN)
RSLWKDSDW

SEQ ID NO: 97445 - protein, 10 aa, Artificial Sequence
  Description of Artificial Sequence: Synthetic peptide
  Seed: MDPDNHSYFF (MAGC3_HUMAN)
MHPDNHSYFL

SEQ ID NO: 97446 - protein, 9 aa, Artificial Sequence
  Description of Artificial Sequence: Synthetic peptide
  Seed: TTDDATAMA (MAGC3_HUMAN)
TSDDATAMY

SEQ ID NO: 97447 - protein, 9 aa, Artificial Sequence
  Description of Artificial Sequence: Synthetic peptide
  Seed: MIFRKAREF (MAGC3_HUMAN)
MMFRKAREY

SEQ ID NO: 97448 - protein, 9 aa, Artificial Sequence
  Description of Artificial Sequence: Synthetic peptide
  Seed: GFADVLSRL (MAGC3_HUMAN)
GSADVLSRV

SEQ ID NO: 97449 - protein, 10 aa, Artificial Sequence
  Description of Artificial Sequence: Synthetic peptide
  Seed: ADVLSRLALW (MAGC3_HUMAN)
ATVLSRLALW

SEQ ID NO: 97450 - protein, 9 aa, Artificial Sequence
  Description of Artificial Sequence: Synthetic peptide
  Seed: KKYKDYFPM (MAGC3_HUMAN)
KVYKDYFPF

SEQ ID NO: 97451 - protein, 10 aa, Artificial Sequence
  Description of Artificial Sequence: Synthetic peptide
  Seed: PTYFKLWRTL (MAGC3_HUMAN)
PAYFKLWRTF

SEQ ID NO: 97452 - protein, 9 aa, Artificial Sequence
  Description of Artificial Sequence: Synthetic peptide
  Seed: TLDEKVDKL (MAGC3_HUMAN)
TFDEKVDKM

SEQ ID NO: 97453 - protein, 9 aa, Artificial Sequence
  Description of Artificial Sequence: Synthetic peptide
  Seed: KVAELVQFL (MAGC3_HUMAN)
KQAELVQFA

SEQ ID NO: 97454 - protein, 10 aa, Artificial Sequence
  Description of Artificial Sequence: Synthetic peptide
  Seed: LNAIGPWSAL (MAGC3_HUMAN)
LVAIGPWSAL

SEQ ID NO: 97455 - protein, 11 aa, Artificial Sequence
  Description of Artificial Sequence: Synthetic peptide
  Seed: TDMDPDNHSYF (MAGC3_HUMAN)
TTMDPDNHSYY

SEQ ID NO: 97456 - protein, 9 aa, Artificial Sequence
  Description of Artificial Sequence: Synthetic peptide
  Seed: YQAKEPLTR (MAGC3_HUMAN)
YNAKEPLTY

SEQ ID NO: 97457 - protein, 10 aa, Artificial Sequence
  Description of Artificial Sequence: Synthetic peptide
  Seed: LLKYQAKEPL (MAGC3_HUMAN)
LRKYQAKEPY

SEQ ID NO: 97458 - protein, 11 aa, Artificial Sequence
  Description of Artificial Sequence: Synthetic peptide
  Seed: TYTGYFPMIFR (MAGC3_HUMAN)
TTTGYFPMIFK

SEQ ID NO: 97459 - protein, 11 aa, Artificial Sequence
  Description of Artificial Sequence: Synthetic peptide
  Seed: FIELIFGIALT (MAGC3_HUMAN)
FCELIFGIALL

SEQ ID NO: 97460 - protein, 9 aa, Artificial Sequence
  Description of Artificial Sequence: Synthetic peptide
  Seed: HSYFFEDTL (MAGC3_HUMAN)
HPYFFEDTF

SEQ ID NO: 97461 - protein, 9 aa, Artificial Sequence
  Description of Artificial Sequence: Synthetic peptide
  Seed: HSYFFEDTL (MAGC3_HUMAN)
HAYFFEDTW

SEQ ID NO: 97462 - protein, 10 aa, Artificial Sequence
  Description of Artificial Sequence: Synthetic peptide
  Seed: RLWGEKAGSL (MAGC3_HUMAN)
RMWGEKAGSI

SEQ ID NO: 97463 - protein, 10 aa, Artificial Sequence
  Description of Artificial Sequence: Synthetic peptide
  Seed: ILFGISLTEV (MAGC3_HUMAN)
IMFGISLTET

SEQ ID NO: 97464 - protein, 9 aa, Artificial Sequence
  Description of Artificial Sequence: Synthetic peptide
  Seed: SPVVLPPQP (MAGC3_HUMAN)
SAVVLPPQI

SEQ ID NO: 97465 - protein, 10 aa, Artificial Sequence
  Description of Artificial Sequence: Synthetic peptide
  Seed: SPLDSCSSPL (MAGC3_HUMAN)
SPLDSCSSPA

SEQ ID NO: 97466 - protein, 10 aa, Artificial Sequence
  Description of Artificial Sequence: Synthetic peptide
  Seed: YALSPVVLPP (MAGC3_HUMAN)
YWLSPVVLPV

SEQ ID NO: 97467 - protein, 9 aa, Artificial Sequence
  Description of Artificial Sequence: Synthetic peptide
  Seed: TLDEKVDKL (MAGC3_HUMAN)
THDEKVDKW

SEQ ID NO: 97468 - protein, 9 aa, Artificial Sequence
  Description of Artificial Sequence: Synthetic peptide
  Seed: MEDRAQAII (MAGC3_HUMAN)
MHDRAQAIF

SEQ ID NO: 97469 - protein, 10 aa, Artificial Sequence
  Description of Artificial Sequence: Synthetic peptide
  Seed: SKLSSIIPSA (MAGC3_HUMAN)
SMLSSIIPSL

SEQ ID NO: 97470 - protein, 11 aa, Artificial Sequence
  Description of Artificial Sequence: Synthetic peptide
  Seed: YTGYFPMIFRK (MAGC3_HUMAN)
YAGYFPMIFRR

SEQ ID NO: 97471 - protein, 9 aa, Artificial Sequence
  Description of Artificial Sequence: Synthetic peptide
  Seed: KVDKLVQFL (MAGC3_HUMAN)
KIDKLVQFW

SEQ ID NO: 97472 - protein, 10 aa, Artificial Sequence
  Description of Artificial Sequence: Synthetic peptide
  Seed: SDQRMDSLVL (MAGC3_HUMAN)
SVQRMDSLVY

SEQ ID NO: 97473 - protein, 10 aa, Artificial Sequence
  Description of Artificial Sequence: Synthetic peptide
  Seed: KVAELVQFLL (MAGC3_HUMAN)
KMAELVQFLW

SEQ ID NO: 97474 - protein, 10 aa, Artificial Sequence
  Description of Artificial Sequence: Synthetic peptide
  Seed: DMDPDNHSYF (MAGC3_HUMAN)
DMDPDNHSYY

SEQ ID NO: 97475 - protein, 11 aa, Artificial Sequence
  Description of Artificial Sequence: Synthetic peptide
  Seed: ILFGISLTEVD (MAGC3_HUMAN)
ILFGISLTEVN

SEQ ID NO: 97476 - protein, 10 aa, Artificial Sequence
  Description of Artificial Sequence: Synthetic peptide
  Seed: WHALPESESL (MAGC3_HUMAN)
WHALPESESI

SEQ ID NO: 97477 - protein, 10 aa, Artificial Sequence
  Description of Artificial Sequence: Synthetic peptide
  Seed: LNAIGPWSAL (MAGC3_HUMAN)
LDAIGPWSAF

SEQ ID NO: 97478 - protein, 10 aa, Artificial Sequence
  Description of Artificial Sequence: Synthetic peptide
  Seed: KKYKDYFPMI (MAGC3_HUMAN)
KQYKDYFPMK

SEQ ID NO: 97479 - protein, 10 aa, Artificial Sequence
  Description of Artificial Sequence: Synthetic peptide
  Seed: YTGYFPMIFR (MAGC3_HUMAN)
YDGYFPMIFR

SEQ ID NO: 97480 - protein, 9 aa, Artificial Sequence
  Description of Artificial Sequence: Synthetic peptide
  Seed: MEDRAQAII (MAGC3_HUMAN)
MADRAQAII

SEQ ID NO: 97481 - protein, 9 aa, Artificial Sequence
  Description of Artificial Sequence: Synthetic peptide
  Seed: MDPDNHSYF (MAGC3_HUMAN)
MVPDNHSYL

SEQ ID NO: 97482 - protein, 10 aa, Artificial Sequence
  Description of Artificial Sequence: Synthetic peptide
  Seed: SQPEGKFSLR (MAGC3_HUMAN)
SLPEGKFSLR

SEQ ID NO: 97483 - protein, 11 aa, Artificial Sequence
  Description of Artificial Sequence: Synthetic peptide
  Seed: ILFGISLTEVD (MAGC3_HUMAN)
IMFGISLTEVG

SEQ ID NO: 97484 - protein, 11 aa, Artificial Sequence
  Description of Artificial Sequence: Synthetic peptide
  Seed: VINTYTGYFPM (MAGC3_HUMAN)
VANTYTGYFPW

SEQ ID NO: 97485 - protein, 10 aa, Artificial Sequence
  Description of Artificial Sequence: Synthetic peptide
  Seed: KVAELVQFLL (MAGC3_HUMAN)
KVAELVQFLK

SEQ ID NO: 97486 - protein, 9 aa, Artificial Sequence
  Description of Artificial Sequence: Synthetic peptide
  Seed: SQPEGKFSL (MAGC3_HUMAN)
SAPEGKFSY

SEQ ID NO: 97487 - protein, 10 aa, Artificial Sequence
  Description of Artificial Sequence: Synthetic peptide
  Seed: YALSPVVLPP (MAGC3_HUMAN)
YPLSPVVLPT

SEQ ID NO: 97488 - protein, 11 aa, Artificial Sequence
  Description of Artificial Sequence: Synthetic peptide
  Seed: AEMQMNVINTY (MAGC3_HUMAN)
AEMQMNVINTI

SEQ ID NO: 97489 - protein, 10 aa, Artificial Sequence
  Description of Artificial Sequence: Synthetic peptide
  Seed: RLLILILSVI (MAGC3_HUMAN)
RMLILILSVV

SEQ ID NO: 97490 - protein, 9 aa, Artificial Sequence
  Description of Artificial Sequence: Synthetic peptide
  Seed: TTDDATAMA (MAGC3_HUMAN)
TQDDATAMV

SEQ ID NO: 97491 - protein, 9 aa, Artificial Sequence
  Description of Artificial Sequence: Synthetic peptide
  Seed: KLWRTLSGS (MAGC3_HUMAN)
KAWRTLSGV

SEQ ID NO: 97492 - protein, 8 aa, Artificial Sequence
  Description of Artificial Sequence: Synthetic peptide
  Seed: SGSPGLQL (MAGC3_HUMAN)
SASPGLQY

SEQ ID NO: 97493 - protein, 10 aa, Artificial Sequence
  Description of Artificial Sequence: Synthetic peptide
  Seed: FPSWYMDALK (MAGC3_HUMAN)
FISWYMDALK

SEQ ID NO: 97494 - protein, 10 aa, Artificial Sequence
  Description of Artificial Sequence: Synthetic peptide
  Seed: ILILSVIFIK (MAGC3_HUMAN)
IKILSVIFIR

SEQ ID NO: 97495 - protein, 9 aa, Artificial Sequence
  Description of Artificial Sequence: Synthetic peptide
  Seed: NTYTGYFPM (MAGC3_HUMAN)
NPYTGYFPH

SEQ ID NO: 97496 - protein, 9 aa, Artificial Sequence
  Description of Artificial Sequence: Synthetic peptide
  Seed: FADVLSRLA (MAGC3_HUMAN)
FMDVLSRLF

SEQ ID NO: 97497 - protein, 10 aa, Artificial Sequence
  Description of Artificial Sequence: Synthetic peptide
  Seed: FKLWRTLSGS (MAGC3_HUMAN)
FGLWRTLSGM

SEQ ID NO: 97498 - protein, 10 aa, Artificial Sequence
  Description of Artificial Sequence: Synthetic peptide
  Seed: LIFGIALTDM (MAGC3_HUMAN)
LTFGIALTDV

SEQ ID NO: 97499 - protein, 10 aa, Artificial Sequence
  Description of Artificial Sequence: Synthetic peptide
  Seed: REVLEFLSKL (MAGC3_HUMAN)
RQVLEFLSKL

SEQ ID NO: 97500 - protein, 10 aa, Artificial Sequence
  Description of Artificial Sequence: Synthetic peptide
  Seed: INTYTGYFPM (MAGC3_HUMAN)
IGTYTGYFPW

SEQ ID NO: 97501 - protein, 8 aa, Artificial Sequence
  Description of Artificial Sequence: Synthetic peptide
  Seed: MEDRAQAI (MAGC3_HUMAN)
MIDRAQAL

SEQ ID NO: 97502 - protein, 9 aa, Artificial Sequence
  Description of Artificial Sequence: Synthetic peptide
  Seed: TLDEKVDKL (MAGC3_HUMAN)
TQDEKVDKM

SEQ ID NO: 97503 - protein, 10 aa, Artificial Sequence
  Description of Artificial Sequence: Synthetic peptide
  Seed: SAFHLGHLRE (MAGC3_HUMAN)
SVFHLGHLRR

SEQ ID NO: 97504 - protein, 9 aa, Artificial Sequence
  Description of Artificial Sequence: Synthetic peptide
  Seed: SQPEGKFSL (MAGC3_HUMAN)
STPEGKFSY

SEQ ID NO: 97505 - protein, 9 aa, Artificial Sequence
  Description of Artificial Sequence: Synthetic peptide
  Seed: ATDKDYSAF (MAGC3_HUMAN)
AVDKDYSAL

SEQ ID NO: 97506 - protein, 10 aa, Artificial Sequence
  Description of Artificial Sequence: Synthetic peptide
  Seed: TTDDATAMAS (MAGC3_HUMAN)
TLDDATAMAY

SEQ ID NO: 97507 - protein, 11 aa, Artificial Sequence
  Description of Artificial Sequence: Synthetic peptide
  Seed: AEMQMNVINTY (MAGC3_HUMAN)
ADMQMNVINTF

SEQ ID NO: 97508 - protein, 9 aa, Artificial Sequence
  Description of Artificial Sequence: Synthetic peptide
  Seed: MLLPCHWVL (MAGC3_HUMAN)
MGLPCHWVY

SEQ ID NO: 97509 - protein, 10 aa, Artificial Sequence
  Description of Artificial Sequence: Synthetic peptide
  Seed: RLWGEKAGSL (MAGC3_HUMAN)
RQWGEKAGSW

SEQ ID NO: 97510 - protein, 9 aa, Artificial Sequence
  Description of Artificial Sequence: Synthetic peptide
  Seed: VDPDHFYVF (MAGC3_HUMAN)
VLPDHFYVM

SEQ ID NO: 97511 - protein, 9 aa, Artificial Sequence
  Description of Artificial Sequence: Synthetic peptide
  Seed: WESEGPEAF (MAGC3_HUMAN)
WHSEGPEAY

SEQ ID NO: 97512 - protein, 9 aa, Artificial Sequence
  Description of Artificial Sequence: Synthetic peptide
  Seed: ASEEVIWEV (MAGC3_HUMAN)
ALEEVIWEV

SEQ ID NO: 97513 - protein, 10 aa, Artificial Sequence
  Description of Artificial Sequence: Synthetic peptide
  Seed: EMQMNVINTY (MAGC3_HUMAN)
EKQMNVINTM

SEQ ID NO: 97514 - protein, 9 aa, Artificial Sequence
  Description of Artificial Sequence: Synthetic peptide
  Seed: HFYVFVNTL (MAGC3_HUMAN)
HLYVFVNTY

SEQ ID NO: 97515 - protein, 9 aa, Artificial Sequence
  Description of Artificial Sequence: Synthetic peptide
  Seed: WESEGPEAF (MAGC3_HUMAN)
WQSEGPEAL

SEQ ID NO: 97516 - protein, 9 aa, Artificial Sequence
  Description of Artificial Sequence: Synthetic peptide
  Seed: KEPLTRAEM (MAGC3_HUMAN)
KMPLTRAEY

SEQ ID NO: 97517 - protein, 9 aa, Artificial Sequence
  Description of Artificial Sequence: Synthetic peptide
  Seed: FSLRRAVSV (MAGC3_HUMAN)
FMLRRAVST

SEQ ID NO: 97518 - protein, 9 aa, Artificial Sequence
  Description of Artificial Sequence: Synthetic peptide
  Seed: HLREVRLFL (MAGC3_HUMAN)
HIREVRLFV

SEQ ID NO: 97519 - protein, 9 aa, Artificial Sequence
  Description of Artificial Sequence: Synthetic peptide
  Seed: ELIFGIALT (MAGC3_HUMAN)
EIIFGIALA

SEQ ID NO: 97520 - protein, 9 aa, Artificial Sequence
  Description of Artificial Sequence: Synthetic peptide
  Seed: LVQFLLLKY (MAGC3_HUMAN)
LTQFLLLKY

SEQ ID NO: 97521 - protein, 10 aa, Artificial Sequence
  Description of Artificial Sequence: Synthetic peptide
  Seed: KKYKDYFPMI (MAGC3_HUMAN)
KRYKDYFPMA

SEQ ID NO: 97522 - protein, 9 aa, Artificial Sequence
  Description of Artificial Sequence: Synthetic peptide
  Seed: YSAFHLGHL (MAGC3_HUMAN)
YIAFHLGHI

SEQ ID NO: 97523 - protein, 11 aa, Artificial Sequence
  Description of Artificial Sequence: Synthetic peptide
  Seed: FIELIFGIALT (MAGC3_HUMAN)
FPELIFGIALI

SEQ ID NO: 97524 - protein, 10 aa, Artificial Sequence
  Description of Artificial Sequence: Synthetic peptide
  Seed: AEMLTTVIKK (MAGC3_HUMAN)
ANMLTTVIKK

SEQ ID NO: 97525 - protein, 10 aa, Artificial Sequence
  Description of Artificial Sequence: Synthetic peptide
  Seed: YTLDEKVDKL (MAGC3_HUMAN)
YILDEKVDKM

SEQ ID NO: 97526 - protein, 9 aa, Artificial Sequence
  Description of Artificial Sequence: Synthetic peptide
  Seed: KAHEFIELI (MAGC3_HUMAN)
KGHEFIELI

SEQ ID NO: 97527 - protein, 9 aa, Artificial Sequence
  Description of Artificial Sequence: Synthetic peptide
  Seed: QRMDSLVLC (MAGC3_HUMAN)
QRMDSLVLF

SEQ ID NO: 97528 - protein, 11 aa, Artificial Sequence
  Description of Artificial Sequence: Synthetic peptide
  Seed: EILFGISLTEV (MAGC3_HUMAN)
ERLFGISLTEV

SEQ ID NO: 97529 - protein, 9 aa, Artificial Sequence
  Description of Artificial Sequence: Synthetic peptide
  Seed: LTEASPQQK (MAGC3_HUMAN)
LLEASPQQY

SEQ ID NO: 97530 - protein, 10 aa, Artificial Sequence
  Description of Artificial Sequence: Synthetic peptide
  Seed: TAMASASPSV (MAGC3_HUMAN)
TMMASASPSL

SEQ ID NO: 97531 - protein, 8 aa, Artificial Sequence
  Description of Artificial Sequence: Synthetic peptide
  Seed: YTLSLPAV (MAGC3_HUMAN)
YQLSLPAL

SEQ ID NO: 97532 - protein, 8 aa, Artificial Sequence
  Description of Artificial Sequence: Synthetic peptide
  Seed: KAHEFIEL (MAGC3_HUMAN)
KSHEFIEW

SEQ ID NO: 97533 - protein, 10 aa, Artificial Sequence
  Description of Artificial Sequence: Synthetic peptide
  Seed: EKVAELVQFL (MAGC3_HUMAN)
EHVAELVQFV

SEQ ID NO: 97534 - protein, 9 aa, Artificial Sequence
  Description of Artificial Sequence: Synthetic peptide
  Seed: TGYFPMIFR (MAGC3_HUMAN)
TSYFPMIFR

SEQ ID NO: 97535 - protein, 9 aa, Artificial Sequence
  Description of Artificial Sequence: Synthetic peptide
  Seed: KYKDYFPMI (MAGC3_HUMAN)
KNKDYFPMK

SEQ ID NO: 97536 - protein, 10 aa, Artificial Sequence
  Description of Artificial Sequence: Synthetic peptide
  Seed: RPAREVLEFL (MAGC3_HUMAN)
RLAREVLEFK

SEQ ID NO: 97537 - protein, 10 aa, Artificial Sequence
  Description of Artificial Sequence: Synthetic peptide
  Seed: IPSAFPSWYM (MAGC3_HUMAN)
ICSAFPSWYF

SEQ ID NO: 97538 - protein, 9 aa, Artificial Sequence
  Description of Artificial Sequence: Synthetic peptide
  Seed: WESEGPEAF (MAGC3_HUMAN)
WLSEGPEAF

SEQ ID NO: 97539 - protein, 9 aa, Artificial Sequence
  Description of Artificial Sequence: Synthetic peptide
  Seed: MASASPSVM (MAGC3_HUMAN)
MPSASPSVH

SEQ ID NO: 97540 - protein, 10 aa, Artificial Sequence
  Description of Artificial Sequence: Synthetic peptide
  Seed: SAFHLGHLRE (MAGC3_HUMAN)
SWFHLGHLRR

SEQ ID NO: 97541 - protein, 10 aa, Artificial Sequence
  Description of Artificial Sequence: Synthetic peptide
  Seed: SSEEEDTATW (MAGC3_HUMAN)
SQEEEDTATF

SEQ ID NO: 97542 - protein, 8 aa, Artificial Sequence
  Description of Artificial Sequence: Synthetic peptide
  Seed: IFGKAHEF (MAGC3_HUMAN)
IYGKAHEF

SEQ ID NO: 97543 - protein, 10 aa, Artificial Sequence
  Description of Artificial Sequence: Synthetic peptide
  Seed: SAFHLGHLRE (MAGC3_HUMAN)
SMFHLGHLRF

SEQ ID NO: 97544 - protein, 9 aa, Artificial Sequence
  Description of Artificial Sequence: Synthetic peptide
  Seed: DMDPDNHSY (MAGC3_HUMAN)
DADPDNHSM

SEQ ID NO: 97545 - protein, 8 aa, Artificial Sequence
  Description of Artificial Sequence: Synthetic peptide
  Seed: TTDDATAM (MAGC3_HUMAN)
TFDDATAF

SEQ ID NO: 97546 - protein, 8 aa, Artificial Sequence
  Description of Artificial Sequence: Synthetic peptide
  Seed: VDKLVQFL (MAGC3_HUMAN)
VQKLVQFL

SEQ ID NO: 97547 - protein, 10 aa, Artificial Sequence
  Description of Artificial Sequence: Synthetic peptide
  Seed: KKYKDYFPMI (MAGC3_HUMAN)
KRYKDYFPMF

SEQ ID NO: 97548 - protein, 10 aa, Artificial Sequence
  Description of Artificial Sequence: Synthetic peptide
  Seed: KLVQFLLLKY (MAGC3_HUMAN)
KMVQFLLLKF

SEQ ID NO: 97549 - protein, 9 aa, Artificial Sequence
  Description of Artificial Sequence: Synthetic peptide
  Seed: TEVDPDHFY (MAGC3_HUMAN)
TQVDPDHFF

SEQ ID NO: 97550 - protein, 9 aa, Artificial Sequence
  Description of Artificial Sequence: Synthetic peptide
  Seed: SCVPEEVIW (MAGC3_HUMAN)
STVPEEVIW

SEQ ID NO: 97551 - protein, 10 aa, Artificial Sequence
  Description of Artificial Sequence: Synthetic peptide
  Seed: YALSPVVLPP (MAGC3_HUMAN)
YGLSPVVLPA

SEQ ID NO: 97552 - protein, 9 aa, Artificial Sequence
  Description of Artificial Sequence: Synthetic peptide
  Seed: ATYALSPVV (MAGC3_HUMAN)
AQYALSPVI

SEQ ID NO: 97553 - protein, 9 aa, Artificial Sequence
  Description of Artificial Sequence: Synthetic peptide
  Seed: YTGYFPMIF (MAGC3_HUMAN)
YSGYFPMII

SEQ ID NO: 97554 - protein, 10 aa, Artificial Sequence
  Description of Artificial Sequence: Synthetic peptide
  Seed: SLVLCPTYFK (MAGC3_HUMAN)
SYVLCPTYFR

SEQ ID NO: 97555 - protein, 9 aa, Artificial Sequence
  Description of Artificial Sequence: Synthetic peptide
  Seed: LIDDQGMPK (MAGC3_HUMAN)
LNDDQGMPM

SEQ ID NO: 97556 - protein, 11 aa, Artificial Sequence
  Description of Artificial Sequence: Synthetic peptide
  Seed: RGLTEASPQQK (MAGC3_HUMAN)
RTLTEASPQQK

SEQ ID NO: 97557 - protein, 11 aa, Artificial Sequence
  Description of Artificial Sequence: Synthetic peptide
  Seed: KVAELVQFLLL (MAGC3_HUMAN)
KLAELVQFLLS

SEQ ID NO: 97558 - protein, 9 aa, Artificial Sequence
  Description of Artificial Sequence: Synthetic peptide
  Seed: ISPQGPPQS (MAGC3_HUMAN)
INPQGPPQM

SEQ ID NO: 97559 - protein, 9 aa, Artificial Sequence
  Description of Artificial Sequence: Synthetic peptide
  Seed: MPKNCLLIL (MAGC3_HUMAN)
MLKNCLLIY

SEQ ID NO: 97560 - protein, 10 aa, Artificial Sequence
  Description of Artificial Sequence: Synthetic peptide
  Seed: SAFHLGHLRE (MAGC3_HUMAN)
SGFHLGHLRR

SEQ ID NO: 97561 - protein, 11 aa, Artificial Sequence
  Description of Artificial Sequence: Synthetic peptide
  Seed: ALWESEGPEAF (MAGC3_HUMAN)
AIWESEGPEAY

SEQ ID NO: 97562 - protein, 9 aa, Artificial Sequence
  Description of Artificial Sequence: Synthetic peptide
  Seed: ATYALSPVV (MAGC3_HUMAN)
AVYALSPVV

SEQ ID NO: 97563 - protein, 10 aa, Artificial Sequence
  Description of Artificial Sequence: Synthetic peptide
  Seed: MQMNVINTYT (MAGC3_HUMAN)
MQMNVINTYH

SEQ ID NO: 97564 - protein, 11 aa, Artificial Sequence
  Description of Artificial Sequence: Synthetic peptide
  Seed: TEVDPDHFYVF (MAGC3_HUMAN)
TEVDPDHFYVW

SEQ ID NO: 97565 - protein, 9 aa, Artificial Sequence
  Description of Artificial Sequence: Synthetic peptide
  Seed: HLREVRLFL (MAGC3_HUMAN)
HTREVRLFW

SEQ ID NO: 97566 - protein, 9 aa, Artificial Sequence
  Description of Artificial Sequence: Synthetic peptide
  Seed: QPEGKFSLR (MAGC3_HUMAN)
QVEGKFSLK

SEQ ID NO: 97567 - protein, 9 aa, Artificial Sequence
  Description of Artificial Sequence: Synthetic peptide
  Seed: SASPSVMST (MAGC3_HUMAN)
SVSPSVMSH

SEQ ID NO: 97568 - protein, 10 aa, Artificial Sequence
  Description of Artificial Sequence: Synthetic peptide
  Seed: RLLILILSVI (MAGC3_HUMAN)
RSLILILSVV

SEQ ID NO: 97569 - protein, 9 aa, Artificial Sequence
  Description of Artificial Sequence: Synthetic peptide
  Seed: NAIGPWSAL (MAGC3_HUMAN)
NYIGPWSAF

SEQ ID NO: 97570 - protein, 9 aa, Artificial Sequence
  Description of Artificial Sequence: Synthetic peptide
  Seed: NTYTGYFPM (MAGC3_HUMAN)
NVYTGYFPL

SEQ ID NO: 97571 - protein, 10 aa, Artificial Sequence
  Description of Artificial Sequence: Synthetic peptide
  Seed: TGYFPMIFRK (MAGC3_HUMAN)
TVYFPMIFRE

SEQ ID NO: 97572 - protein, 10 aa, Artificial Sequence
  Description of Artificial Sequence: Synthetic peptide
  Seed: EKVAELVQFL (MAGC3_HUMAN)
EKVAELVQFY

SEQ ID NO: 97573 - protein, 9 aa, Artificial Sequence
  Description of Artificial Sequence: Synthetic peptide
  Seed: MIFGKAHEF (MAGC3_HUMAN)
MWFGKAHEL

SEQ ID NO: 97574 - protein, 11 aa, Artificial Sequence
  Description of Artificial Sequence: Synthetic peptide
  Seed: FIELIFGIALT (MAGC3_HUMAN)
FHELIFGIALI

SEQ ID NO: 97575 - protein, 11 aa, Artificial Sequence
  Description of Artificial Sequence: Synthetic peptide
  Seed: RGLTEASPQQK (MAGC3_HUMAN)
RVLTEASPQQR

SEQ ID NO: 97576 - protein, 9 aa, Artificial Sequence
  Description of Artificial Sequence: Synthetic peptide
  Seed: KNCLLILIL (MAGC3_HUMAN)
KACLLILIW

SEQ ID NO: 97577 - protein, 9 aa, Artificial Sequence
  Description of Artificial Sequence: Synthetic peptide
  Seed: YQTKEPVTK (MAGC3_HUMAN)
YATKEPVTI

SEQ ID NO: 97578 - protein, 10 aa, Artificial Sequence
  Description of Artificial Sequence: Synthetic peptide
  Seed: KVAELVQFLL (MAGC3_HUMAN)
KLAELVQFLG

SEQ ID NO: 97579 - protein, 9 aa, Artificial Sequence
  Description of Artificial Sequence: Synthetic peptide
  Seed: KVDKLVQFL (MAGC3_HUMAN)
KSDKLVQFI

SEQ ID NO: 97580 - protein, 10 aa, Artificial Sequence
  Description of Artificial Sequence: Synthetic peptide
  Seed: TLDEKVDKLV (MAGC3_HUMAN)
TIDEKVDKLL

SEQ ID NO: 97581 - protein, 9 aa, Artificial Sequence
  Description of Artificial Sequence: Synthetic peptide
  Seed: TTDDATAMA (MAGC3_HUMAN)
TNDDATAMV

SEQ ID NO: 97582 - protein, 9 aa, Artificial Sequence
  Description of Artificial Sequence: Synthetic peptide
  Seed: KAHEFIELI (MAGC3_HUMAN)
KYHEFIELM

SEQ ID NO: 97583 - protein, 9 aa, Artificial Sequence
  Description of Artificial Sequence: Synthetic peptide
  Seed: KLWRTLSGS (MAGC3_HUMAN)
KLWRTLSGV

SEQ ID NO: 97584 - protein, 8 aa, Artificial Sequence
  Description of Artificial Sequence: Synthetic peptide
  Seed: FADVLSRL (MAGC3_HUMAN)
FLDVLSRM

SEQ ID NO: 97585 - protein, 9 aa, Artificial Sequence
  Description of Artificial Sequence: Synthetic peptide
  Seed: LKYQAKEPL (MAGC3_HUMAN)
LGYQAKEPF

SEQ ID NO: 97586 - protein, 10 aa, Artificial Sequence
  Description of Artificial Sequence: Synthetic peptide
  Seed: LTRAEMQMNV (MAGC3_HUMAN)
LMRAEMQMNM

SEQ ID NO: 97587 - protein, 9 aa, Artificial Sequence
  Description of Artificial Sequence: Synthetic peptide
  Seed: HSYFFEDTL (MAGC3_HUMAN)
HSYFFEDTV

SEQ ID NO: 97588 - protein, 10 aa, Artificial Sequence
  Description of Artificial Sequence: Synthetic peptide
  Seed: REVRLFLRGG (MAGC3_HUMAN)
REVRLFLRGK

SEQ ID NO: 97589 - protein, 9 aa, Artificial Sequence
  Description of Artificial Sequence: Synthetic peptide
  Seed: TKAEMLTTV (MAGC3_HUMAN)
THAEMLTTI

SEQ ID NO: 97590 - protein, 9 aa, Artificial Sequence
  Description of Artificial Sequence: Synthetic peptide
  Seed: FPSWYMDAL (MAGC3_HUMAN)
FISWYMDAI

SEQ ID NO: 97591 - protein, 9 aa, Artificial Sequence
  Description of Artificial Sequence: Synthetic peptide
  Seed: YTGYFPMIF (MAGC3_HUMAN)
YPGYFPMIY

SEQ ID NO: 97592 - protein, 9 aa, Artificial Sequence
  Description of Artificial Sequence: Synthetic peptide
  Seed: ALSPVVLPP (MAGC3_HUMAN)
AMSPVVLPM

SEQ ID NO: 97593 - protein, 11 aa, Artificial Sequence
  Description of Artificial Sequence: Synthetic peptide
  Seed: TSDQRMDSLVL (MAGC3_HUMAN)
TEDQRMDSLVY

SEQ ID NO: 97594 - protein, 10 aa, Artificial Sequence
  Description of Artificial Sequence: Synthetic peptide
  Seed: TTDDATAMAS (MAGC3_HUMAN)
TCDDATAMAM

SEQ ID NO: 97595 - protein, 9 aa, Artificial Sequence
  Description of Artificial Sequence: Synthetic peptide
  Seed: YALSPVVLP (MAGC3_HUMAN)
YILSPVVLL

SEQ ID NO: 97596 - protein, 10 aa, Artificial Sequence
  Description of Artificial Sequence: Synthetic peptide
  Seed: LPTWRRGTGY (MAGC3_HUMAN)
LITWRRGTGF

SEQ ID NO: 97597 - protein, 9 aa, Artificial Sequence
  Description of Artificial Sequence: Synthetic peptide
  Seed: DMDPDNHSY (MAGC3_HUMAN)
DLDPDNHSL

SEQ ID NO: 97598 - protein, 11 aa, Artificial Sequence
  Description of Artificial Sequence: Synthetic peptide
  Seed: LHFGSQPEGKF (MAGC3_HUMAN)
LHFGSQPEGKL

SEQ ID NO: 97599 - protein, 9 aa, Artificial Sequence
  Description of Artificial Sequence: Synthetic peptide
  Seed: MPQNRLLIL (MAGC3_HUMAN)
MPQNRLLIT

SEQ ID NO: 97600 - protein, 9 aa, Artificial Sequence
  Description of Artificial Sequence: Synthetic peptide
  Seed: YKDYFPMIF (MAGC3_HUMAN)
YHDYFPMIM

SEQ ID NO: 97601 - protein, 9 aa, Artificial Sequence
  Description of Artificial Sequence: Synthetic peptide
  Seed: KYKDYFPMI (MAGC3_HUMAN)
KVKDYFPMV

SEQ ID NO: 97602 - protein, 9 aa, Artificial Sequence
  Description of Artificial Sequence: Synthetic peptide
  Seed: SLRRAVSVK (MAGC3_HUMAN)
STRRAVSVC

SEQ ID NO: 97603 - protein, 9 aa, Artificial Sequence
  Description of Artificial Sequence: Synthetic peptide
  Seed: TLDEKVDKL (MAGC3_HUMAN)
THDEKVDKL

SEQ ID NO: 97604 - protein, 9 aa, Artificial Sequence
  Description of Artificial Sequence: Synthetic peptide
  Seed: ALSPVVLPP (MAGC3_HUMAN)
ALSPVVLPA

SEQ ID NO: 97605 - protein, 9 aa, Artificial Sequence
  Description of Artificial Sequence: Synthetic peptide
  Seed: ASEEVIWEV (MAGC3_HUMAN)
ASEEVIWEL

SEQ ID NO: 97606 - protein, 9 aa, Artificial Sequence
  Description of Artificial Sequence: Synthetic peptide
  Seed: MEDRAQAII (MAGC3_HUMAN)
MTDRAQAIM

SEQ ID NO: 97607 - protein, 9 aa, Artificial Sequence
  Description of Artificial Sequence: Synthetic peptide
  Seed: FKLWRTLSG (MAGC3_HUMAN)
FLLWRTLSM

SEQ ID NO: 97608 - protein, 10 aa, Artificial Sequence
  Description of Artificial Sequence: Synthetic peptide
  Seed: KAHEFIELIF (MAGC3_HUMAN)
KRHEFIELIF

SEQ ID NO: 97609 - protein, 9 aa, Artificial Sequence
  Description of Artificial Sequence: Synthetic peptide
  Seed: LRSAEGSVL (MAGC3_HUMAN)
LESAEGSVY

SEQ ID NO: 97610 - protein, 9 aa, Artificial Sequence
  Description of Artificial Sequence: Synthetic peptide
  Seed: VIWEVLSAI (MAGC3_HUMAN)
VVWEVLSAF

SEQ ID NO: 97611 - protein, 10 aa, Artificial Sequence
  Description of Artificial Sequence: Synthetic peptide
  Seed: ILILSVIFIK (MAGC3_HUMAN)
ITILSVIFIR

SEQ ID NO: 97612 - protein, 9 aa, Artificial Sequence
  Description of Artificial Sequence: Synthetic peptide
  Seed: GEDEDMPAA (MAGC3_HUMAN)
GEDEDMPAM

SEQ ID NO: 97613 - protein, 9 aa, Artificial Sequence
  Description of Artificial Sequence: Synthetic peptide
  Seed: EFIELIFGI (MAGC3_HUMAN)
EAIELIFGL

SEQ ID NO: 97614 - protein, 10 aa, Artificial Sequence
  Description of Artificial Sequence: Synthetic peptide
  Seed: LDSCSSPLLW (MAGC3_HUMAN)
LRSCSSPLLF

SEQ ID NO: 97615 - protein, 9 aa, Artificial Sequence
  Description of Artificial Sequence: Synthetic peptide
  Seed: HFYVFVNTL (MAGC3_HUMAN)
HFYVFVNTY

SEQ ID NO: 97616 - protein, 10 aa, Artificial Sequence
  Description of Artificial Sequence: Synthetic peptide
  Seed: YALSPVVLPP (MAGC3_HUMAN)
YFLSPVVLPL

SEQ ID NO: 97617 - protein, 9 aa, Artificial Sequence
  Description of Artificial Sequence: Synthetic peptide
  Seed: EVDPDHFYV (MAGC3_HUMAN)
EGDPDHFYY

SEQ ID NO: 97618 - protein, 9 aa, Artificial Sequence
  Description of Artificial Sequence: Synthetic peptide
  Seed: MIFGKAHEF (MAGC3_HUMAN)
MMFGKAHEW

SEQ ID NO: 97619 - protein, 9 aa, Artificial Sequence
  Description of Artificial Sequence: Synthetic peptide
  Seed: QGMPQNRLL (MAGC3_HUMAN)
QIMPQNRLW

SEQ ID NO: 97620 - protein, 9 aa, Artificial Sequence
  Description of Artificial Sequence: Synthetic peptide
  Seed: YSAFHLGHL (MAGC3_HUMAN)
YTAFHLGHV

SEQ ID NO: 97621 - protein, 11 aa, Artificial Sequence
  Description of Artificial Sequence: Synthetic peptide
  Seed: ALWESEGPEAF (MAGC3_HUMAN)
AMWESEGPEAF

SEQ ID NO: 97622 - protein, 11 aa, Artificial Sequence
  Description of Artificial Sequence: Synthetic peptide
  Seed: IIDTTDDATAM (MAGC3_HUMAN)
IYDTTDDATAV

SEQ ID NO: 97623 - protein, 8 aa, Artificial Sequence
  Description of Artificial Sequence: Synthetic peptide
  Seed: FADVLSRL (MAGC3_HUMAN)
FVDVLSRI

SEQ ID NO: 97624 - protein, 9 aa, Artificial Sequence
  Description of Artificial Sequence: Synthetic peptide
  Seed: ATDKDYSAF (MAGC3_HUMAN)
AVDKDYSAI

SEQ ID NO: 97625 - protein, 9 aa, Artificial Sequence
  Description of Artificial Sequence: Synthetic peptide
  Seed: HFYVFVNTL (MAGC3_HUMAN)
HGYVFVNTM

SEQ ID NO: 97626 - protein, 9 aa, Artificial Sequence
  Description of Artificial Sequence: Synthetic peptide
  Seed: IIPSAFPSW (MAGC3_HUMAN)
IFPSAFPSI

SEQ ID NO: 97627 - protein, 10 aa, Artificial Sequence
  Description of Artificial Sequence: Synthetic peptide
  Seed: EKVAELVQFL (MAGC3_HUMAN)
ETVAELVQFY

SEQ ID NO: 97628 - protein, 9 aa, Artificial Sequence
  Description of Artificial Sequence: Synthetic peptide
  Seed: MASASPSVM (MAGC3_HUMAN)
MKSASPSVF

SEQ ID NO: 97629 - protein, 11 aa, Artificial Sequence
  Description of Artificial Sequence: Synthetic peptide
  Seed: ATFSDGSLGQW (MAGC3_HUMAN)
AAFSDGSLGQH

SEQ ID NO: 97630 - protein, 8 aa, Artificial Sequence
  Description of Artificial Sequence: Synthetic peptide
  Seed: FADVLSRL (MAGC3_HUMAN)
FTDVLSRM

SEQ ID NO: 97631 - protein, 9 aa, Artificial Sequence
  Description of Artificial Sequence: Synthetic peptide
  Seed: MASASPSVM (MAGC3_HUMAN)
MKSASPSVL

SEQ ID NO: 97632 - protein, 9 aa, Artificial Sequence
  Description of Artificial Sequence: Synthetic peptide
  Seed: NAIGPWSAL (MAGC3_HUMAN)
NTIGPWSAW

SEQ ID NO: 97633 - protein, 9 aa, Artificial Sequence
  Description of Artificial Sequence: Synthetic peptide
  Seed: FADVLSRLA (MAGC3_HUMAN)
FTDVLSRLI

SEQ ID NO: 97634 - protein, 10 aa, Artificial Sequence
  Description of Artificial Sequence: Synthetic peptide
  Seed: VLCPTYFKLW (MAGC3_HUMAN)
VWCPTYFKLI

SEQ ID NO: 97635 - protein, 10 aa, Artificial Sequence
  Description of Artificial Sequence: Synthetic peptide
  Seed: WEVLSAIGPI (MAGC3_HUMAN)
WEVLSAIGPM

SEQ ID NO: 97636 - protein, 10 aa, Artificial Sequence
  Description of Artificial Sequence: Synthetic peptide
  Seed: MQMNVINTYT (MAGC3_HUMAN)
MMMNVINTYR

SEQ ID NO: 97637 - protein, 9 aa, Artificial Sequence
  Description of Artificial Sequence: Synthetic peptide
  Seed: GPWSALAGF (MAGC3_HUMAN)
GQWSALAGY

SEQ ID NO: 97638 - protein, 9 aa, Artificial Sequence
  Description of Artificial Sequence: Synthetic peptide
  Seed: KAHEFIELI (MAGC3_HUMAN)
KSHEFIELL

SEQ ID NO: 97639 - protein, 10 aa, Artificial Sequence
  Description of Artificial Sequence: Synthetic peptide
  Seed: IEILFGISLT (MAGC3_HUMAN)
IEILFGISLL

SEQ ID NO: 97640 - protein, 10 aa, Artificial Sequence
  Description of Artificial Sequence: Synthetic peptide
  Seed: FPSWYMDALK (MAGC3_HUMAN)
FQSWYMDALK

SEQ ID NO: 97641 - protein, 10 aa, Artificial Sequence
  Description of Artificial Sequence: Synthetic peptide
  Seed: FFEDTLDLTY (MAGC3_HUMAN)
FFEDTLDLTF

SEQ ID NO: 97642 - protein, 9 aa, Artificial Sequence
  Description of Artificial Sequence: Synthetic peptide
  Seed: KYKDYFPMI (MAGC3_HUMAN)
KLKDYFPMF

SEQ ID NO: 97643 - protein, 9 aa, Artificial Sequence
  Description of Artificial Sequence: Synthetic peptide
  Seed: SAFHLGHLR (MAGC3_HUMAN)
SFFHLGHLF

SEQ ID NO: 97644 - protein, 9 aa, Artificial Sequence
  Description of Artificial Sequence: Synthetic peptide
  Seed: GYFPMIFRK (MAGC3_HUMAN)
GWFPMIFRY

SEQ ID NO: 97645 - protein, 10 aa, Artificial Sequence
  Description of Artificial Sequence: Synthetic peptide
  Seed: VVLPPQPQPR (MAGC3_HUMAN)
VVLPPQPQPL

SEQ ID NO: 97646 - protein, 11 aa, Artificial Sequence
  Description of Artificial Sequence: Synthetic peptide
  Seed: ATAMASASPSV (MAGC3_HUMAN)
AYAMASASPSV

SEQ ID NO: 97647 - protein, 9 aa, Artificial Sequence
  Description of Artificial Sequence: Synthetic peptide
  Seed: WYMDALKDM (MAGC3_HUMAN)
WFMDALKDL

SEQ ID NO: 97648 - protein, 10 aa, Artificial Sequence
  Description of Artificial Sequence: Synthetic peptide
  Seed: RSAEGSVLDL (MAGC3_HUMAN)
RIAEGSVLDL

SEQ ID NO: 97649 - protein, 10 aa, Artificial Sequence
  Description of Artificial Sequence: Synthetic peptide
  Seed: LIFGIALTDM (MAGC3_HUMAN)
LQFGIALTDF

SEQ ID NO: 97650 - protein, 9 aa, Artificial Sequence
  Description of Artificial Sequence: Synthetic peptide
  Seed: SPQGPPQSP (MAGC3_HUMAN)
SPQGPPQSA

SEQ ID NO: 97651 - protein, 9 aa, Artificial Sequence
  Description of Artificial Sequence: Synthetic peptide
  Seed: AMASASPSV (MAGC3_HUMAN)
AFASASPSF

SEQ ID NO: 97652 - protein, 10 aa, Artificial Sequence
  Description of Artificial Sequence: Synthetic peptide
  Seed: EVIWEVLSAI (MAGC3_HUMAN)
EAIWEVLSAM

SEQ ID NO: 97653 - protein, 8 aa, Artificial Sequence
  Description of Artificial Sequence: Synthetic peptide
  Seed: YMDALKDM (MAGC3_HUMAN)
YYDALKDI

SEQ ID NO: 97654 - protein, 9 aa, Artificial Sequence
  Description of Artificial Sequence: Synthetic peptide
  Seed: KAHEFIELI (MAGC3_HUMAN)
KYHEFIELL

SEQ ID NO: 97655 - protein, 10 aa, Artificial Sequence
  Description of Artificial Sequence: Synthetic peptide
  Seed: MPAAGMPPLP (MAGC3_HUMAN)
MPAAGMPPLL

SEQ ID NO: 97656 - protein, 9 aa, Artificial Sequence
  Description of Artificial Sequence: Synthetic peptide
  Seed: EVLEFLSKL (MAGC3_HUMAN)
EQLEFLSKI

SEQ ID NO: 97657 - protein, 10 aa, Artificial Sequence
  Description of Artificial Sequence: Synthetic peptide
  Seed: TAMASASPSV (MAGC3_HUMAN)
TIMASASPSI

SEQ ID NO: 97658 - protein, 10 aa, Artificial Sequence
  Description of Artificial Sequence: Synthetic peptide
  Seed: YALDEKVAEL (MAGC3_HUMAN)
YQLDEKVAEA

SEQ ID NO: 97659 - protein, 9 aa, Artificial Sequence
  Description of Artificial Sequence: Synthetic peptide
  Seed: EFIELIFGI (MAGC3_HUMAN)
EQIELIFGL

SEQ ID NO: 97660 - protein, 9 aa, Artificial Sequence
  Description of Artificial Sequence: Synthetic peptide
  Seed: HLREVRLFL (MAGC3_HUMAN)
HLREVRLFG

SEQ ID NO: 97661 - protein, 11 aa, Artificial Sequence
  Description of Artificial Sequence: Synthetic peptide
  Seed: RTLSGSPGLQL (MAGC3_HUMAN)
RTLSGSPGLQM

SEQ ID NO: 97662 - protein, 9 aa, Artificial Sequence
  Description of Artificial Sequence: Synthetic peptide
  Seed: HLREVRLFL (MAGC3_HUMAN)
HMREVRLFK

SEQ ID NO: 97663 - protein, 9 aa, Artificial Sequence
  Description of Artificial Sequence: Synthetic peptide
  Seed: RTLSGSPGL (MAGC3_HUMAN)
RLLSGSPGK

SEQ ID NO: 97664 - protein, 9 aa, Artificial Sequence
  Description of Artificial Sequence: Synthetic peptide
  Seed: EVIWEVLNA (MAGC3_HUMAN)
ETIWEVLNI

SEQ ID NO: 97665 - protein, 9 aa, Artificial Sequence
  Description of Artificial Sequence: Synthetic peptide
  Seed: KKYKDYFPM (MAGC3_HUMAN)
KRYKDYFPI

SEQ ID NO: 97666 - protein, 10 aa, Artificial Sequence
  Description of Artificial Sequence: Synthetic peptide
  Seed: YALDEKVAEL (MAGC3_HUMAN)
YNLDEKVAEL

SEQ ID NO: 97667 - protein, 10 aa, Artificial Sequence
  Description of Artificial Sequence: Synthetic peptide
  Seed: FLRGGTSDQR (MAGC3_HUMAN)
FVRGGTSDQR

SEQ ID NO: 97668 - protein, 9 aa, Artificial Sequence
  Description of Artificial Sequence: Synthetic peptide
  Seed: KAHEFIELI (MAGC3_HUMAN)
KVHEFIELK

SEQ ID NO: 97669 - protein, 9 aa, Artificial Sequence
  Description of Artificial Sequence: Synthetic peptide
  Seed: YTGYFPMIF (MAGC3_HUMAN)
YEGYFPMIF

SEQ ID NO: 97670 - protein, 9 aa, Artificial Sequence
  Description of Artificial Sequence: Synthetic peptide
  Seed: LVQFLLLKY (MAGC3_HUMAN)
LSQFLLLKK

SEQ ID NO: 97671 - protein, 9 aa, Artificial Sequence
  Description of Artificial Sequence: Synthetic peptide
  Seed: IIDTTDDAT (MAGC3_HUMAN)
ITDTTDDAM

SEQ ID NO: 97672 - protein, 9 aa, Artificial Sequence
  Description of Artificial Sequence: Synthetic peptide
  Seed: HLREVRLFL (MAGC3_HUMAN)
HVREVRLFM

SEQ ID NO: 97673 - protein, 9 aa, Artificial Sequence
  Description of Artificial Sequence: Synthetic peptide
  Seed: NAIGPWSAL (MAGC3_HUMAN)
NYIGPWSAV

SEQ ID NO: 97674 - protein, 10 aa, Artificial Sequence
  Description of Artificial Sequence: Synthetic peptide
  Seed: LLKYQAKEPL (MAGC3_HUMAN)
LIKYQAKEPF

SEQ ID NO: 97675 - protein, 9 aa, Artificial Sequence
  Description of Artificial Sequence: Synthetic peptide
  Seed: RGTGYTLSL (MAGC3_HUMAN)
RVTGYTLSV

SEQ ID NO: 97676 - protein, 9 aa, Artificial Sequence
  Description of Artificial Sequence: Synthetic peptide
  Seed: ATDKDYSAF (MAGC3_HUMAN)
AADKDYSAY

SEQ ID NO: 97677 - protein, 11 aa, Artificial Sequence
  Description of Artificial Sequence: Synthetic peptide
  Seed: DSCSSPLLWTR (MAGC3_HUMAN)
DTCSSPLLWTR

SEQ ID NO: 97678 - protein, 9 aa, Artificial Sequence
  Description of Artificial Sequence: Synthetic peptide
  Seed: REVLEFLSK (MAGC3_HUMAN)
RTVLEFLSK

SEQ ID NO: 97679 - protein, 9 aa, Artificial Sequence
  Description of Artificial Sequence: Synthetic peptide
  Seed: AMASASPSV (MAGC3_HUMAN)
AMASASPSL

SEQ ID NO: 97680 - protein, 8 aa, Artificial Sequence
  Description of Artificial Sequence: Synthetic peptide
  Seed: LDEKVAEL (MAGC3_HUMAN)
LTEKVAEL

SEQ ID NO: 97681 - protein, 9 aa, Artificial Sequence
  Description of Artificial Sequence: Synthetic peptide
  Seed: TLDEKVDKL (MAGC3_HUMAN)
TTDEKVDKW

SEQ ID NO: 97682 - protein, 9 aa, Artificial Sequence
  Description of Artificial Sequence: Synthetic peptide
  Seed: EFIELIFGI (MAGC3_HUMAN)
EVIELIFGS

SEQ ID NO: 97683 - protein, 10 aa, Artificial Sequence
  Description of Artificial Sequence: Synthetic peptide
  Seed: LTEASPQQKK (MAGC3_HUMAN)
LMEASPQQKY

SEQ ID NO: 97684 - protein, 9 aa, Artificial Sequence
  Description of Artificial Sequence: Synthetic peptide
  Seed: SLVLCPTYF (MAGC3_HUMAN)
SLVLCPTYI

SEQ ID NO: 97685 - protein, 9 aa, Artificial Sequence
  Description of Artificial Sequence: Synthetic peptide
  Seed: VLCPTYFKL (MAGC3_HUMAN)
VTCPTYFKV

SEQ ID NO: 97686 - protein, 9 aa, Artificial Sequence
  Description of Artificial Sequence: Synthetic peptide
  Seed: REEPQDWPL (MAGC3_HUMAN)
RQEPQDWPF

SEQ ID NO: 97687 - protein, 9 aa, Artificial Sequence
  Description of Artificial Sequence: Synthetic peptide
  Seed: DYFPMIFGK (MAGC3_HUMAN)
DLFPMIFGR

SEQ ID NO: 97688 - protein, 10 aa, Artificial Sequence
  Description of Artificial Sequence: Synthetic peptide
  Seed: KDYFPMIFGK (MAGC3_HUMAN)
KEYFPMIFGK

SEQ ID NO: 97689 - protein, 9 aa, Artificial Sequence
  Description of Artificial Sequence: Synthetic peptide
  Seed: MIFRKAREF (MAGC3_HUMAN)
MFFRKAREM

SEQ ID NO: 97690 - protein, 11 aa, Artificial Sequence
  Description of Artificial Sequence: Synthetic peptide
  Seed: TYTGYFPMIFR (MAGC3_HUMAN)
TMTGYFPMIFR

SEQ ID NO: 97691 - protein, 9 aa, Artificial Sequence
  Description of Artificial Sequence: Synthetic peptide
  Seed: HSYFFEDTL (MAGC3_HUMAN)
HEYFFEDTM

SEQ ID NO: 97692 - protein, 9 aa, Artificial Sequence
  Description of Artificial Sequence: Synthetic peptide
  Seed: SAFHLGHLR (MAGC3_HUMAN)
SLFHLGHLR

SEQ ID NO: 97693 - protein, 9 aa, Artificial Sequence
  Description of Artificial Sequence: Synthetic peptide
  Seed: NAIGPWSAL (MAGC3_HUMAN)
NAIGPWSAY

SEQ ID NO: 97694 - protein, 10 aa, Artificial Sequence
  Description of Artificial Sequence: Synthetic peptide
  Seed: LDSCSSPLLW (MAGC3_HUMAN)
LKSCSSPLLW

SEQ ID NO: 97695 - protein, 10 aa, Artificial Sequence
  Description of Artificial Sequence: Synthetic peptide
  Seed: AMASASPSVM (MAGC3_HUMAN)
AGASASPSVY

SEQ ID NO: 97696 - protein, 9 aa, Artificial Sequence
  Description of Artificial Sequence: Synthetic peptide
  Seed: FFEDTLDLT (MAGC3_HUMAN)
FWEDTLDLI

SEQ ID NO: 97697 - protein, 10 aa, Artificial Sequence
  Description of Artificial Sequence: Synthetic peptide
  Seed: SALAGFADVL (MAGC3_HUMAN)
SMLAGFADVA

SEQ ID NO: 97698 - protein, 10 aa, Artificial Sequence
  Description of Artificial Sequence: Synthetic peptide
  Seed: REVRLFLRGG (MAGC3_HUMAN)
RYVRLFLRGI

SEQ ID NO: 97699 - protein, 9 aa, Artificial Sequence
  Description of Artificial Sequence: Synthetic peptide
  Seed: MPAAGMPPL (MAGC3_HUMAN)
MGAAGMPPY

SEQ ID NO: 97700 - protein, 10 aa, Artificial Sequence
  Description of Artificial Sequence: Synthetic peptide
  Seed: YALSPVVLPP (MAGC3_HUMAN)
YYLSPVVLPV

SEQ ID NO: 97701 - protein, 9 aa, Artificial Sequence
  Description of Artificial Sequence: Synthetic peptide
  Seed: VIWEVLSAI (MAGC3_HUMAN)
VQWEVLSAA

SEQ ID NO: 97702 - protein, 9 aa, Artificial Sequence
  Description of Artificial Sequence: Synthetic peptide
  Seed: AMASASPSV (MAGC3_HUMAN)
ASASASPSF

SEQ ID NO: 97703 - protein, 10 aa, Artificial Sequence
  Description of Artificial Sequence: Synthetic peptide
  Seed: EEVIWEVLSA (MAGC3_HUMAN)
ECVIWEVLSV

SEQ ID NO: 97704 - protein, 10 aa, Artificial Sequence
  Description of Artificial Sequence: Synthetic peptide
  Seed: YALSPVVLPP (MAGC3_HUMAN)
YFLSPVVLPA

SEQ ID NO: 97705 - protein, 9 aa, Artificial Sequence
  Description of Artificial Sequence: Synthetic peptide
  Seed: KNCLLILIL (MAGC3_HUMAN)
KSCLLILIV

SEQ ID NO: 97706 - protein, 10 aa, Artificial Sequence
  Description of Artificial Sequence: Synthetic peptide
  Seed: SAFHLGHLRE (MAGC3_HUMAN)
SMFHLGHLRN

SEQ ID NO: 97707 - protein, 9 aa, Artificial Sequence
  Description of Artificial Sequence: Synthetic peptide
  Seed: EAFCEESGL (MAGC3_HUMAN)
EIFCEESGR

SEQ ID NO: 97708 - protein, 10 aa, Artificial Sequence
  Description of Artificial Sequence: Synthetic peptide
  Seed: EKVAELVQFL (MAGC3_HUMAN)
ENVAELVQFL

SEQ ID NO: 97709 - protein, 9 aa, Artificial Sequence
  Description of Artificial Sequence: Synthetic peptide
  Seed: SASPSVMST (MAGC3_HUMAN)
SYSPSVMSL

SEQ ID NO: 97710 - protein, 10 aa, Artificial Sequence
  Description of Artificial Sequence: Synthetic peptide
  Seed: AEMLTTVIKK (MAGC3_HUMAN)
ADMLTTVIKK

SEQ ID NO: 97711 - protein, 9 aa, Artificial Sequence
  Description of Artificial Sequence: Synthetic peptide
  Seed: KYKDYFPMI (MAGC3_HUMAN)
KVKDYFPMY

SEQ ID NO: 97712 - protein, 9 aa, Artificial Sequence
  Description of Artificial Sequence: Synthetic peptide
  Seed: KVDKLVQFL (MAGC3_HUMAN)
KMDKLVQFM

SEQ ID NO: 97713 - protein, 10 aa, Artificial Sequence
  Description of Artificial Sequence: Synthetic peptide
  Seed: MDSLVLCPTY (MAGC3_HUMAN)
MISLVLCPTY

SEQ ID NO: 97714 - protein, 9 aa, Artificial Sequence
  Description of Artificial Sequence: Synthetic peptide
  Seed: HSYFFEDTL (MAGC3_HUMAN)
HAYFFEDTV

SEQ ID NO: 97715 - protein, 9 aa, Artificial Sequence
  Description of Artificial Sequence: Synthetic peptide
  Seed: WRRGTGYTL (MAGC3_HUMAN)
WFRGTGYTF

SEQ ID NO: 97716 - protein, 9 aa, Artificial Sequence
  Description of Artificial Sequence: Synthetic peptide
  Seed: LKYQAKEPL (MAGC3_HUMAN)
LMYQAKEPY

SEQ ID NO: 97717 - protein, 9 aa, Artificial Sequence
  Description of Artificial Sequence: Synthetic peptide
  Seed: YKDYFPMIF (MAGC3_HUMAN)
YYDYFPMII

SEQ ID NO: 97718 - protein, 10 aa, Artificial Sequence
  Description of Artificial Sequence: Synthetic peptide
  Seed: LILILSMIFI (MAGC3_HUMAN)
LVLILSMIFV

SEQ ID NO: 97719 - protein, 11 aa, Artificial Sequence
  Description of Artificial Sequence: Synthetic peptide
  Seed: DSLVLCPTYFK (MAGC3_HUMAN)
DRLVLCPTYFR

SEQ ID NO: 97720 - protein, 9 aa, Artificial Sequence
  Description of Artificial Sequence: Synthetic peptide
  Seed: YSAFHLGHL (MAGC3_HUMAN)
YIAFHLGHM

SEQ ID NO: 97721 - protein, 9 aa, Artificial Sequence
  Description of Artificial Sequence: Synthetic peptide
  Seed: DMDPDNHSY (MAGC3_HUMAN)
DLDPDNHSV

SEQ ID NO: 97722 - protein, 9 aa, Artificial Sequence
  Description of Artificial Sequence: Synthetic peptide
  Seed: HSYFFEDTL (MAGC3_HUMAN)
HQYFFEDTW

SEQ ID NO: 97723 - protein, 9 aa, Artificial Sequence
  Description of Artificial Sequence: Synthetic peptide
  Seed: ALAGFADVL (MAGC3_HUMAN)
ALAGFADVF

SEQ ID NO: 97724 - protein, 10 aa, Artificial Sequence
  Description of Artificial Sequence: Synthetic peptide
  Seed: SMIFIKGSCV (MAGC3_HUMAN)
SLIFIKGSCV

SEQ ID NO: 97725 - protein, 9 aa, Artificial Sequence
  Description of Artificial Sequence: Synthetic peptide
  Seed: EVDPDHFYV (MAGC3_HUMAN)
EMDPDHFYI

SEQ ID NO: 97726 - protein, 9 aa, Artificial Sequence
  Description of Artificial Sequence: Synthetic peptide
  Seed: YQAKEPLTR (MAGC3_HUMAN)
YTAKEPLTM

SEQ ID NO: 97727 - protein, 11 aa, Artificial Sequence
  Description of Artificial Sequence: Synthetic peptide
  Seed: LSKLSSIIPSA (MAGC3_HUMAN)
LNKLSSIIPSV

SEQ ID NO: 97728 - protein, 10 aa, Artificial Sequence
  Description of Artificial Sequence: Synthetic peptide
  Seed: LPTWRRGTGY (MAGC3_HUMAN)
LSTWRRGTGW

SEQ ID NO: 97729 - protein, 9 aa, Artificial Sequence
  Description of Artificial Sequence: Synthetic peptide
  Seed: LVQFLLLKY (MAGC3_HUMAN)
LSQFLLLKF

SEQ ID NO: 97730 - protein, 9 aa, Artificial Sequence
  Description of Artificial Sequence: Synthetic peptide
  Seed: VDPDHFYVF (MAGC3_HUMAN)
VLPDHFYVY

SEQ ID NO: 97731 - protein, 10 aa, Artificial Sequence
  Description of Artificial Sequence: Synthetic peptide
  Seed: YALSPVVLPP (MAGC3_HUMAN)
YLLSPVVLPI

SEQ ID NO: 97732 - protein, 9 aa, Artificial Sequence
  Description of Artificial Sequence: Synthetic peptide
  Seed: VLCPTYFKL (MAGC3_HUMAN)
VNCPTYFKW

SEQ ID NO: 97733 - protein, 9 aa, Artificial Sequence
  Description of Artificial Sequence: Synthetic peptide
  Seed: VDPDHFYVF (MAGC3_HUMAN)
VTPDHFYVY

SEQ ID NO: 97734 - protein, 10 aa, Artificial Sequence
  Description of Artificial Sequence: Synthetic peptide
  Seed: AMASASPSVM (MAGC3_HUMAN)
AYASASPSVM

SEQ ID NO: 97735 - protein, 10 aa, Artificial Sequence
  Description of Artificial Sequence: Synthetic peptide
  Seed: FYVFVNTLDL (MAGC3_HUMAN)
FYVFVNTLDM

SEQ ID NO: 97736 - protein, 9 aa, Artificial Sequence
  Description of Artificial Sequence: Synthetic peptide
  Seed: FADVLSRLA (MAGC3_HUMAN)
FLDVLSRLL

SEQ ID NO: 97737 - protein, 10 aa, Artificial Sequence
  Description of Artificial Sequence: Synthetic peptide
  Seed: RPAREVLEFL (MAGC3_HUMAN)
RAAREVLEFK

SEQ ID NO: 97738 - protein, 9 aa, Artificial Sequence
  Description of Artificial Sequence: Synthetic peptide
  Seed: VLCPTYFKL (MAGC3_HUMAN)
VVCPTYFKF

SEQ ID NO: 97739 - protein, 9 aa, Artificial Sequence
  Description of Artificial Sequence: Synthetic peptide
  Seed: FKLWRTLSG (MAGC3_HUMAN)
FMLWRTLSF

SEQ ID NO: 97740 - protein, 9 aa, Artificial Sequence
  Description of Artificial Sequence: Synthetic peptide
  Seed: MASASPSVM (MAGC3_HUMAN)
MYSASPSVY

SEQ ID NO: 97741 - protein, 9 aa, Artificial Sequence
  Description of Artificial Sequence: Synthetic peptide
  Seed: YQTKEPVTK (MAGC3_HUMAN)
YVTKEPVTL

SEQ ID NO: 97742 - protein, 9 aa, Artificial Sequence
  Description of Artificial Sequence: Synthetic peptide
  Seed: IIPSAFPSW (MAGC3_HUMAN)
IYPSAFPSV

SEQ ID NO: 97743 - protein, 10 aa, Artificial Sequence
  Description of Artificial Sequence: Synthetic peptide
  Seed: EKVAELVQFL (MAGC3_HUMAN)
ECVAELVQFI

SEQ ID NO: 97744 - protein, 10 aa, Artificial Sequence
  Description of Artificial Sequence: Synthetic peptide
  Seed: EKVAELVQFL (MAGC3_HUMAN)
EWVAELVQFI

SEQ ID NO: 97745 - protein, 9 aa, Artificial Sequence
  Description of Artificial Sequence: Synthetic peptide
  Seed: KLSSIIPSA (MAGC3_HUMAN)
KISSIIPSL

SEQ ID NO: 97746 - protein, 9 aa, Artificial Sequence
  Description of Artificial Sequence: Synthetic peptide
  Seed: YFFEDTLDL (MAGC3_HUMAN)
YWFEDTLDL

SEQ ID NO: 97747 - protein, 10 aa, Artificial Sequence
  Description of Artificial Sequence: Synthetic peptide
  Seed: KVAELVQFLL (MAGC3_HUMAN)
KLAELVQFLK

SEQ ID NO: 97748 - protein, 9 aa, Artificial Sequence
  Description of Artificial Sequence: Synthetic peptide
  Seed: KVDKLVQFL (MAGC3_HUMAN)
KLDKLVQFV

SEQ ID NO: 97749 - protein, 10 aa, Artificial Sequence
  Description of Artificial Sequence: Synthetic peptide
  Seed: REVLEFLSKL (MAGC3_HUMAN)
RMVLEFLSKV

SEQ ID NO: 97750 - protein, 8 aa, Artificial Sequence
  Description of Artificial Sequence: Synthetic peptide
  Seed: KDYSAFHL (MAGC3_HUMAN)
KQYSAFHV

SEQ ID NO: 97751 - protein, 10 aa, Artificial Sequence
  Description of Artificial Sequence: Synthetic peptide
  Seed: EVIWEVLSAI (MAGC3_HUMAN)
EIIWEVLSAL

SEQ ID NO: 97752 - protein, 10 aa, Artificial Sequence
  Description of Artificial Sequence: Synthetic peptide
  Seed: MLTTVIKKYK (MAGC3_HUMAN)
MLTTVIKKYR

SEQ ID NO: 97753 - protein, 9 aa, Artificial Sequence
  Description of Artificial Sequence: Synthetic peptide
  Seed: SLPAVSPGK (MAGC3_HUMAN)
SAPAVSPGL

SEQ ID NO: 97754 - protein, 10 aa, Artificial Sequence
  Description of Artificial Sequence: Synthetic peptide
  Seed: FFEDTLDLTY (MAGC3_HUMAN)
FSEDTLDLTL

SEQ ID NO: 97755 - protein, 9 aa, Artificial Sequence
  Description of Artificial Sequence: Synthetic peptide
  Seed: MLLPCHWVL (MAGC3_HUMAN)
MQLPCHWVF

SEQ ID NO: 97756 - protein, 10 aa, Artificial Sequence
  Description of Artificial Sequence: Synthetic peptide
  Seed: AELVQFLLLK (MAGC3_HUMAN)
AQLVQFLLLK

SEQ ID NO: 97757 - protein, 9 aa, Artificial Sequence
  Description of Artificial Sequence: Synthetic peptide
  Seed: MASASPSVM (MAGC3_HUMAN)
MWSASPSVY

SEQ ID NO: 97758 - protein, 9 aa, Artificial Sequence
  Description of Artificial Sequence: Synthetic peptide
  Seed: KKYKDYFPM (MAGC3_HUMAN)
KGYKDYFPF

SEQ ID NO: 97759 - protein, 10 aa, Artificial Sequence
  Description of Artificial Sequence: Synthetic peptide
  Seed: REVRLFLRGG (MAGC3_HUMAN)
RQVRLFLRGI

SEQ ID NO: 97760 - protein, 10 aa, Artificial Sequence
  Description of Artificial Sequence: Synthetic peptide
  Seed: TCATYALSPV (MAGC3_HUMAN)
TIATYALSPI

SEQ ID NO: 97761 - protein, 9 aa, Artificial Sequence
  Description of Artificial Sequence: Synthetic peptide
  Seed: FLSKLSSII (MAGC3_HUMAN)
FTSKLSSIF

SEQ ID NO: 97762 - protein, 9 aa, Artificial Sequence
  Description of Artificial Sequence: Synthetic peptide
  Seed: MASASPSVM (MAGC3_HUMAN)
MSSASPSVI

SEQ ID NO: 97763 - protein, 10 aa, Artificial Sequence
  Description of Artificial Sequence: Synthetic peptide
  Seed: AFPSWYMDAL (MAGC3_HUMAN)
AYPSWYMDAI

SEQ ID NO: 97764 - protein, 10 aa, Artificial Sequence
  Description of Artificial Sequence: Synthetic peptide
  Seed: SKLSSIIPSA (MAGC3_HUMAN)
SILSSIIPSA

SEQ ID NO: 97765 - protein, 9 aa, Artificial Sequence
  Description of Artificial Sequence: Synthetic peptide
  Seed: LKYQAKEPL (MAGC3_HUMAN)
LQYQAKEPF

SEQ ID NO: 97766 - protein, 10 aa, Artificial Sequence
  Description of Artificial Sequence: Synthetic peptide
  Seed: NTYTGYFPMI (MAGC3_HUMAN)
NIYTGYFPMF

SEQ ID NO: 97767 - protein, 9 aa, Artificial Sequence
  Description of Artificial Sequence: Synthetic peptide
  Seed: NVINTYTGY (MAGC3_HUMAN)
NPINTYTGY

SEQ ID NO: 97768 - protein, 9 aa, Artificial Sequence
  Description of Artificial Sequence: Synthetic peptide
  Seed: LANPQGLAG (MAGC3_HUMAN)
LVNPQGLAF

SEQ ID NO: 97769 - protein, 10 aa, Artificial Sequence
  Description of Artificial Sequence: Synthetic peptide
  Seed: AELVQFLLLK (MAGC3_HUMAN)
ATLVQFLLLK

SEQ ID NO: 97770 - protein, 10 aa, Artificial Sequence
  Description of Artificial Sequence: Synthetic peptide
  Seed: TGYFPMIFRK (MAGC3_HUMAN)
TTYFPMIFRN

SEQ ID NO: 97771 - protein, 10 aa, Artificial Sequence
  Description of Artificial Sequence: Synthetic peptide
  Seed: ATDKDYSAFH (MAGC3_HUMAN)
ASDKDYSAFY

SEQ ID NO: 97772 - protein, 9 aa, Artificial Sequence
  Description of Artificial Sequence: Synthetic peptide
  Seed: KLWRTLSGS (MAGC3_HUMAN)
KMWRTLSGL

SEQ ID NO: 97773 - protein, 10 aa, Artificial Sequence
  Description of Artificial Sequence: Synthetic peptide
  Seed: ASPSVMSTNF (MAGC3_HUMAN)
AMPSVMSTNY

SEQ ID NO: 97774 - protein, 9 aa, Artificial Sequence
  Description of Artificial Sequence: Synthetic peptide
  Seed: IQRPAREVL (MAGC3_HUMAN)
ILRPAREVM

SEQ ID NO: 97775 - protein, 10 aa, Artificial Sequence
  Description of Artificial Sequence: Synthetic peptide
  Seed: MDSLVLCPTY (MAGC3_HUMAN)
MESLVLCPTW

SEQ ID NO: 97776 - protein, 9 aa, Artificial Sequence
  Description of Artificial Sequence: Synthetic peptide
  Seed: RPAREVLEF (MAGC3_HUMAN)
RKAREVLEY

SEQ ID NO: 97777 - protein, 10 aa, Artificial Sequence
  Description of Artificial Sequence: Synthetic peptide
  Seed: SAFHLGHLRE (MAGC3_HUMAN)
SMFHLGHLRR

SEQ ID NO: 97778 - protein, 10 aa, Artificial Sequence
  Description of Artificial Sequence: Synthetic peptide
  Seed: SLIDDQGMPK (MAGC3_HUMAN)
SAIDDQGMPY

SEQ ID NO: 97779 - protein, 9 aa, Artificial Sequence
  Description of Artificial Sequence: Synthetic peptide
  Seed: YKDYFPMIF (MAGC3_HUMAN)
YMDYFPMIY

SEQ ID NO: 97780 - protein, 10 aa, Artificial Sequence
  Description of Artificial Sequence: Synthetic peptide
  Seed: LTEASPQQKK (MAGC3_HUMAN)
LVEASPQQKY

SEQ ID NO: 97781 - protein, 11 aa, Artificial Sequence
  Description of Artificial Sequence: Synthetic peptide
  Seed: AEMLTTVIKKY (MAGC3_HUMAN)
AEMLTTVIKKF

SEQ ID NO: 97782 - protein, 9 aa, Artificial Sequence
  Description of Artificial Sequence: Synthetic peptide
  Seed: AEMQMNVIN (MAGC3_HUMAN)
AEMQMNVIC

SEQ ID NO: 97783 - protein, 9 aa, Artificial Sequence
  Description of Artificial Sequence: Synthetic peptide
  Seed: SIIPSAFPS (MAGC3_HUMAN)
SQIPSAFPM

SEQ ID NO: 97784 - protein, 10 aa, Artificial Sequence
  Description of Artificial Sequence: Synthetic peptide
  Seed: LNAIGPWSAL (MAGC3_HUMAN)
LKAIGPWSAF

SEQ ID NO: 97785 - protein, 9 aa, Artificial Sequence
  Description of Artificial Sequence: Synthetic peptide
  Seed: NAIGPWSAL (MAGC3_HUMAN)
NVIGPWSAK

SEQ ID NO: 97786 - protein, 9 aa, Artificial Sequence
  Description of Artificial Sequence: Synthetic peptide
  Seed: FSLRRAVSV (MAGC3_HUMAN)
FFLRRAVSM

SEQ ID NO: 97787 - protein, 9 aa, Artificial Sequence
  Description of Artificial Sequence: Synthetic peptide
  Seed: RGTGYTLSL (MAGC3_HUMAN)
RKTGYTLSY

SEQ ID NO: 97788 - protein, 10 aa, Artificial Sequence
  Description of Artificial Sequence: Synthetic peptide
  Seed: IPSAFPSWYM (MAGC3_HUMAN)
IYSAFPSWYF

SEQ ID NO: 97789 - protein, 11 aa, Artificial Sequence
  Description of Artificial Sequence: Synthetic peptide
  Seed: RTLSGSPGLQL (MAGC3_HUMAN)
RLLSGSPGLQW

SEQ ID NO: 97790 - protein, 9 aa, Artificial Sequence
  Description of Artificial Sequence: Synthetic peptide
  Seed: GFADVLSRL (MAGC3_HUMAN)
GVADVLSRV

SEQ ID NO: 97791 - protein, 10 aa, Artificial Sequence
  Description of Artificial Sequence: Synthetic peptide
  Seed: KLSSIIPSAF (MAGC3_HUMAN)
KKSSIIPSAY

SEQ ID NO: 97792 - protein, 9 aa, Artificial Sequence
  Description of Artificial Sequence: Synthetic peptide
  Seed: LSSIIPSAF (MAGC3_HUMAN)
LPSIIPSAL

SEQ ID NO: 97793 - protein, 9 aa, Artificial Sequence
  Description of Artificial Sequence: Synthetic peptide
  Seed: AMASASPSV (MAGC3_HUMAN)
AIASASPSM

SEQ ID NO: 97794 - protein, 9 aa, Artificial Sequence
  Description of Artificial Sequence: Synthetic peptide
  Seed: LLILILSMI (MAGC3_HUMAN)
LTILILSMV

SEQ ID NO: 97795 - protein, 10 aa, Artificial Sequence
  Description of Artificial Sequence: Synthetic peptide
  Seed: MLLPCHWVLD (MAGC3_HUMAN)
MRLPCHWVLV

SEQ ID NO: 97796 - protein, 11 aa, Artificial Sequence
  Description of Artificial Sequence: Synthetic peptide
  Seed: PLDSCSSPLLW (MAGC3_HUMAN)
PYDSCSSPLLW

SEQ ID NO: 97797 - protein, 9 aa, Artificial Sequence
  Description of Artificial Sequence: Synthetic peptide
  Seed: KYKDYFPMI (MAGC3_HUMAN)
KAKDYFPMY

SEQ ID NO: 97798 - protein, 10 aa, Artificial Sequence
  Description of Artificial Sequence: Synthetic peptide
  Seed: LNAIGPWSAL (MAGC3_HUMAN)
LSAIGPWSAL

SEQ ID NO: 97799 - protein, 9 aa, Artificial Sequence
  Description of Artificial Sequence: Synthetic peptide
  Seed: YSAFHLGHL (MAGC3_HUMAN)
YEAFHLGHY

SEQ ID NO: 97800 - protein, 10 aa, Artificial Sequence
  Description of Artificial Sequence: Synthetic peptide
  Seed: VKNTCATYAL (MAGC3_HUMAN)
VQNTCATYAY

SEQ ID NO: 97801 - protein, 9 aa, Artificial Sequence
  Description of Artificial Sequence: Synthetic peptide
  Seed: VDPDHFYVF (MAGC3_HUMAN)
VYPDHFYVI

SEQ ID NO: 97802 - protein, 10 aa, Artificial Sequence
  Description of Artificial Sequence: Synthetic peptide
  Seed: MDPDNHSYFF (MAGC3_HUMAN)
MMPDNHSYFY

SEQ ID NO: 97803 - protein, 9 aa, Artificial Sequence
  Description of Artificial Sequence: Synthetic peptide
  Seed: EVDPDHFYV (MAGC3_HUMAN)
ETDPDHFYI

SEQ ID NO: 97804 - protein, 9 aa, Artificial Sequence
  Description of Artificial Sequence: Synthetic peptide
  Seed: DEQGMPQNR (MAGC3_HUMAN)
DFQGMPQNR

SEQ ID NO: 97805 - protein, 10 aa, Artificial Sequence
  Description of Artificial Sequence: Synthetic peptide
  Seed: REVLEFLSKL (MAGC3_HUMAN)
RWVLEFLSKV

SEQ ID NO: 97806 - protein, 11 aa, Artificial Sequence
  Description of Artificial Sequence: Synthetic peptide
  Seed: SSSEEEDTATW (MAGC3_HUMAN)
SMSEEEDTATY

SEQ ID NO: 97807 - protein, 9 aa, Artificial Sequence
  Description of Artificial Sequence: Synthetic peptide
  Seed: IPPQGPPKI (MAGC3_HUMAN)
IVPQGPPKV

SEQ ID NO: 97808 - protein, 9 aa, Artificial Sequence
  Description of Artificial Sequence: Synthetic peptide
  Seed: YTGYFPMIF (MAGC3_HUMAN)
YTGYFPMIV

SEQ ID NO: 97809 - protein, 10 aa, Artificial Sequence
  Description of Artificial Sequence: Synthetic peptide
  Seed: RPAREVLEFL (MAGC3_HUMAN)
RFAREVLEFA

SEQ ID NO: 97810 - protein, 9 aa, Artificial Sequence
  Description of Artificial Sequence: Synthetic peptide
  Seed: HALPESESL (MAGC3_HUMAN)
HMLPESESM

SEQ ID NO: 97811 - protein, 10 aa, Artificial Sequence
  Description of Artificial Sequence: Synthetic peptide
  Seed: EVIWEVLSAI (MAGC3_HUMAN)
ESIWEVLSAM

SEQ ID NO: 97812 - protein, 10 aa, Artificial Sequence
  Description of Artificial Sequence: Synthetic peptide
  Seed: KVDKLVQFLL (MAGC3_HUMAN)
KTDKLVQFLF

SEQ ID NO: 97813 - protein, 10 aa, Artificial Sequence
  Description of Artificial Sequence: Synthetic peptide
  Seed: QWVKNTCATY (MAGC3_HUMAN)
QMVKNTCATY

SEQ ID NO: 97814 - protein, 9 aa, Artificial Sequence
  Description of Artificial Sequence: Synthetic peptide
  Seed: KGSCVPEEV (MAGC3_HUMAN)
KMSCVPEEI

SEQ ID NO: 97815 - protein, 10 aa, Artificial Sequence
  Description of Artificial Sequence: Synthetic peptide
  Seed: IELIFGIALT (MAGC3_HUMAN)
IKLIFGIALA

SEQ ID NO: 97816 - protein, 10 aa, Artificial Sequence
  Description of Artificial Sequence: Synthetic peptide
  Seed: LDSCSSPLLW (MAGC3_HUMAN)
LSSCSSPLLL

SEQ ID NO: 97817 - protein, 10 aa, Artificial Sequence
  Description of Artificial Sequence: Synthetic peptide
  Seed: EVIWEVLNAI (MAGC3_HUMAN)
ESIWEVLNAI

SEQ ID NO: 97818 - protein, 9 aa, Artificial Sequence
  Description of Artificial Sequence: Synthetic peptide
  Seed: AVSPGKRLW (MAGC3_HUMAN)
AQSPGKRLW

SEQ ID NO: 97819 - protein, 9 aa, Artificial Sequence
  Description of Artificial Sequence: Synthetic peptide
  Seed: LVLCPTYFK (MAGC3_HUMAN)
LTLCPTYFR

SEQ ID NO: 97820 - protein, 9 aa, Artificial Sequence
  Description of Artificial Sequence: Synthetic peptide
  Seed: KAHEFIELI (MAGC3_HUMAN)
KYHEFIELV

SEQ ID NO: 97821 - protein, 9 aa, Artificial Sequence
  Description of Artificial Sequence: Synthetic peptide
  Seed: ATDKDYSAF (MAGC3_HUMAN)
AWDKDYSAI

SEQ ID NO: 97822 - protein, 9 aa, Artificial Sequence
  Description of Artificial Sequence: Synthetic peptide
  Seed: DMDPDNHSY (MAGC3_HUMAN)
DWDPDNHSF

SEQ ID NO: 97823 - protein, 9 aa, Artificial Sequence
  Description of Artificial Sequence: Synthetic peptide
  Seed: LIDDQGMPK (MAGC3_HUMAN)
LNDDQGMPI

SEQ ID NO: 97824 - protein, 10 aa, Artificial Sequence
  Description of Artificial Sequence: Synthetic peptide
  Seed: SALAGFADVL (MAGC3_HUMAN)
SVLAGFADVL

SEQ ID NO: 97825 - protein, 10 aa, Artificial Sequence
  Description of Artificial Sequence: Synthetic peptide
  Seed: YTLDEKVDKL (MAGC3_HUMAN)
YCLDEKVDKV

SEQ ID NO: 97826 - protein, 9 aa, Artificial Sequence
  Description of Artificial Sequence: Synthetic peptide
  Seed: SLRRAVSVK (MAGC3_HUMAN)
SSRRAVSVT

SEQ ID NO: 97827 - protein, 9 aa, Artificial Sequence
  Description of Artificial Sequence: Synthetic peptide
  Seed: MIFRKAREF (MAGC3_HUMAN)
MFFRKAREI

SEQ ID NO: 97828 - protein, 10 aa, Artificial Sequence
  Description of Artificial Sequence: Synthetic peptide
  Seed: SPLDSCSSPL (MAGC3_HUMAN)
SMLDSCSSPV

SEQ ID NO: 97829 - protein, 11 aa, Artificial Sequence
  Description of Artificial Sequence: Synthetic peptide
  Seed: ALWESEGPEAF (MAGC3_HUMAN)
AMWESEGPEAL

SEQ ID NO: 97830 - protein, 9 aa, Artificial Sequence
  Description of Artificial Sequence: Synthetic peptide
  Seed: EVLEFLSKL (MAGC3_HUMAN)
EILEFLSKY

SEQ ID NO: 97831 - protein, 9 aa, Artificial Sequence
  Description of Artificial Sequence: Synthetic peptide
  Seed: MLLPCHWVL (MAGC3_HUMAN)
MHLPCHWVM

SEQ ID NO: 97832 - protein, 10 aa, Artificial Sequence
  Description of Artificial Sequence: Synthetic peptide
  Seed: CASEEVIWEV (MAGC3_HUMAN)
CISEEVIWEL

SEQ ID NO: 97833 - protein, 9 aa, Artificial Sequence
  Description of Artificial Sequence: Synthetic peptide
  Seed: DEQGMPQNR (MAGC3_HUMAN)
DIQGMPQNR

SEQ ID NO: 97834 - protein, 9 aa, Artificial Sequence
  Description of Artificial Sequence: Synthetic peptide
  Seed: HEFIELIFG (MAGC3_HUMAN)
HEFIELIFA

SEQ ID NO: 97835 - protein, 9 aa, Artificial Sequence
  Description of Artificial Sequence: Synthetic peptide
  Seed: LSAIGPIQR (MAGC3_HUMAN)
LSAIGPIQK

SEQ ID NO: 97836 - protein, 9 aa, Artificial Sequence
  Description of Artificial Sequence: Synthetic peptide
  Seed: HLREVRLFL (MAGC3_HUMAN)
HAREVRLFI

SEQ ID NO: 97837 - protein, 9 aa, Artificial Sequence
  Description of Artificial Sequence: Synthetic peptide
  Seed: HALPESESL (MAGC3_HUMAN)
HTLPESESF

SEQ ID NO: 97838 - protein, 9 aa, Artificial Sequence
  Description of Artificial Sequence: Synthetic peptide
  Seed: RTLSGSPGL (MAGC3_HUMAN)
RQLSGSPGW

SEQ ID NO: 97839 - protein, 11 aa, Artificial Sequence
  Description of Artificial Sequence: Synthetic peptide
  Seed: TSDQRMDSLVL (MAGC3_HUMAN)
TPDQRMDSLVY

SEQ ID NO: 97840 - protein, 9 aa, Artificial Sequence
  Description of Artificial Sequence: Synthetic peptide
  Seed: KAHEFIELI (MAGC3_HUMAN)
KLHEFIELT

SEQ ID NO: 97841 - protein, 9 aa, Artificial Sequence
  Description of Artificial Sequence: Synthetic peptide
  Seed: EVLNAIGPW (MAGC3_HUMAN)
EALNAIGPR

SEQ ID NO: 97842 - protein, 8 aa, Artificial Sequence
  Description of Artificial Sequence: Synthetic peptide
  Seed: LTYEGSLI (MAGC3_HUMAN)
LSYEGSLF

SEQ ID NO: 97843 - protein, 10 aa, Artificial Sequence
  Description of Artificial Sequence: Synthetic peptide
  Seed: TTDDATAMAS (MAGC3_HUMAN)
TIDDATAMAF

SEQ ID NO: 97844 - protein, 11 aa, Artificial Sequence
  Description of Artificial Sequence: Synthetic peptide
  Seed: IIDTTDDATAM (MAGC3_HUMAN)
ISDTTDDATAV

SEQ ID NO: 97845 - protein, 10 aa, Artificial Sequence
  Description of Artificial Sequence: Synthetic peptide
  Seed: KLSSIIPSAF (MAGC3_HUMAN)
KISSIIPSAY

SEQ ID NO: 97846 - protein, 9 aa, Artificial Sequence
  Description of Artificial Sequence: Synthetic peptide
  Seed: MLLPCHWVL (MAGC3_HUMAN)
MMLPCHWVV

SEQ ID NO: 97847 - protein, 9 aa, Artificial Sequence
  Description of Artificial Sequence: Synthetic peptide
  Seed: NTYTGYFPM (MAGC3_HUMAN)
NTYTGYFPT

SEQ ID NO: 97848 - protein, 9 aa, Artificial Sequence
  Description of Artificial Sequence: Synthetic peptide
  Seed: FPSWYMDAL (MAGC3_HUMAN)
FGSWYMDAY

SEQ ID NO: 97849 - protein, 9 aa, Artificial Sequence
  Description of Artificial Sequence: Synthetic peptide
  Seed: KYKDYFPMI (MAGC3_HUMAN)
KFKDYFPMK

SEQ ID NO: 97850 - protein, 9 aa, Artificial Sequence
  Description of Artificial Sequence: Synthetic peptide
  Seed: ALDEKVAEL (MAGC3_HUMAN)
APDEKVAEF

SEQ ID NO: 97851 - protein, 10 aa, Artificial Sequence
  Description of Artificial Sequence: Synthetic peptide
  Seed: TFSDGSLGQW (MAGC3_HUMAN)
TQSDGSLGQL

SEQ ID NO: 97852 - protein, 11 aa, Artificial Sequence
  Description of Artificial Sequence: Synthetic peptide
  Seed: TDMDPDNHSYF (MAGC3_HUMAN)
TEMDPDNHSYI

SEQ ID NO: 97853 - protein, 9 aa, Artificial Sequence
  Description of Artificial Sequence: Synthetic peptide
  Seed: ELIFGIALT (MAGC3_HUMAN)
EAIFGIALT

SEQ ID NO: 97854 - protein, 11 aa, Artificial Sequence
  Description of Artificial Sequence: Synthetic peptide
  Seed: ILFGISLTEVD (MAGC3_HUMAN)
IMFGISLTEVV

SEQ ID NO: 97855 - protein, 10 aa, Artificial Sequence
  Description of Artificial Sequence: Synthetic peptide
  Seed: MQMNVINTYT (MAGC3_HUMAN)
MAMNVINTYA

SEQ ID NO: 97856 - protein, 9 aa, Artificial Sequence
  Description of Artificial Sequence: Synthetic peptide
  Seed: IIDTTDDAT (MAGC3_HUMAN)
IMDTTDDAF

SEQ ID NO: 97857 - protein, 11 aa, Artificial Sequence
  Description of Artificial Sequence: Synthetic peptide
  Seed: RTLSGSPGLQL (MAGC3_HUMAN)
RMLSGSPGLQF

SEQ ID NO: 97858 - protein, 9 aa, Artificial Sequence
  Description of Artificial Sequence: Synthetic peptide
  Seed: YTGYFPMIF (MAGC3_HUMAN)
YGGYFPMIY

SEQ ID NO: 97859 - protein, 9 aa, Artificial Sequence
  Description of Artificial Sequence: Synthetic peptide
  Seed: FPSWYMDAL (MAGC3_HUMAN)
FASWYMDAF

SEQ ID NO: 97860 - protein, 10 aa, Artificial Sequence
  Description of Artificial Sequence: Synthetic peptide
  Seed: RMDSLVLCPT (MAGC3_HUMAN)
RMDSLVLCPM

SEQ ID NO: 97861 - protein, 10 aa, Artificial Sequence
  Description of Artificial Sequence: Synthetic peptide
  Seed: KKYKDYFPMI (MAGC3_HUMAN)
KRYKDYFPMV

SEQ ID NO: 97862 - protein, 9 aa, Artificial Sequence
  Description of Artificial Sequence: Synthetic peptide
  Seed: IIPSAFPSW (MAGC3_HUMAN)
IFPSAFPSV

SEQ ID NO: 97863 - protein, 10 aa, Artificial Sequence
  Description of Artificial Sequence: Synthetic peptide
  Seed: FKLWRTLSGS (MAGC3_HUMAN)
FNLWRTLSGL

SEQ ID NO: 97864 - protein, 9 aa, Artificial Sequence
  Description of Artificial Sequence: Synthetic peptide
  Seed: KQREEPQDW (MAGC3_HUMAN)
KLREEPQDY

SEQ ID NO: 97865 - protein, 10 aa, Artificial Sequence
  Description of Artificial Sequence: Synthetic peptide
  Seed: MDPDNHSYFF (MAGC3_HUMAN)
MDPDNHSYFY

SEQ ID NO: 97866 - protein, 11 aa, Artificial Sequence
  Description of Artificial Sequence: Synthetic peptide
  Seed: LDSCSSPLLWT (MAGC3_HUMAN)
LRSCSSPLLWW

SEQ ID NO: 97867 - protein, 9 aa, Artificial Sequence
  Description of Artificial Sequence: Synthetic peptide
  Seed: EVIWEVLSA (MAGC3_HUMAN)
EVIWEVLSM

SEQ ID NO: 97868 - protein, 9 aa, Artificial Sequence
  Description of Artificial Sequence: Synthetic peptide
  Seed: MIFRKAREF (MAGC3_HUMAN)
MSFRKAREV

SEQ ID NO: 97869 - protein, 10 aa, Artificial Sequence
  Description of Artificial Sequence: Synthetic peptide
  Seed: CVPEEVIWEV (MAGC3_HUMAN)
CTPEEVIWEV

SEQ ID NO: 97870 - protein, 9 aa, Artificial Sequence
  Description of Artificial Sequence: Synthetic peptide
  Seed: SQPEGKFSL (MAGC3_HUMAN)
SRPEGKFSL

SEQ ID NO: 97871 - protein, 11 aa, Artificial Sequence
  Description of Artificial Sequence: Synthetic peptide
  Seed: SSSEEEDTATW (MAGC3_HUMAN)
SESEEEDTATF

SEQ ID NO: 97872 - protein, 9 aa, Artificial Sequence
  Description of Artificial Sequence: Synthetic peptide
  Seed: FSLRRAVSV (MAGC3_HUMAN)
FILRRAVSV

SEQ ID NO: 97873 - protein, 10 aa, Artificial Sequence
  Description of Artificial Sequence: Synthetic peptide
  Seed: ILFGISLTEV (MAGC3_HUMAN)
IVFGISLTEV

SEQ ID NO: 97874 - protein, 9 aa, Artificial Sequence
  Description of Artificial Sequence: Synthetic peptide
  Seed: LTTVIKKYK (MAGC3_HUMAN)
LITVIKKYR

SEQ ID NO: 97875 - protein, 9 aa, Artificial Sequence
  Description of Artificial Sequence: Synthetic peptide
  Seed: NAIGPWSAL (MAGC3_HUMAN)
NFIGPWSAF

SEQ ID NO: 97876 - protein, 9 aa, Artificial Sequence
  Description of Artificial Sequence: Synthetic peptide
  Seed: AELVQFLLL (MAGC3_HUMAN)
AELVQFLLW

SEQ ID NO: 97877 - protein, 10 aa, Artificial Sequence
  Description of Artificial Sequence: Synthetic peptide
  Seed: IELIFGIALT (MAGC3_HUMAN)
IALIFGIALI

SEQ ID NO: 97878 - protein, 9 aa, Artificial Sequence
  Description of Artificial Sequence: Synthetic peptide
  Seed: CSSPLLWTR (MAGC3_HUMAN)
CISPLLWTR

SEQ ID NO: 97879 - protein, 9 aa, Artificial Sequence
  Description of Artificial Sequence: Synthetic peptide
  Seed: SASPSVMST (MAGC3_HUMAN)
SISPSVMSH

SEQ ID NO: 97880 - protein, 10 aa, Artificial Sequence
  Description of Artificial Sequence: Synthetic peptide
  Seed: SLVLCPTYFK (MAGC3_HUMAN)
SAVLCPTYFR

SEQ ID NO: 97881 - protein, 11 aa, Artificial Sequence
  Description of Artificial Sequence: Synthetic peptide
  Seed: YALDEKVAELV (MAGC3_HUMAN)
YLLDEKVAELT

SEQ ID NO: 97882 - protein, 9 aa, Artificial Sequence
  Description of Artificial Sequence: Synthetic peptide
  Seed: TTDDATAMA (MAGC3_HUMAN)
TYDDATAMF

SEQ ID NO: 97883 - protein, 10 aa, Artificial Sequence
  Description of Artificial Sequence: Synthetic peptide
  Seed: YTLDEKVDKL (MAGC3_HUMAN)
YQLDEKVDKM

SEQ ID NO: 97884 - protein, 9 aa, Artificial Sequence
  Description of Artificial Sequence: Synthetic peptide
  Seed: LRSAEGSVL (MAGC3_HUMAN)
LLSAEGSVY

SEQ ID NO: 97885 - protein, 9 aa, Artificial Sequence
  Description of Artificial Sequence: Synthetic peptide
  Seed: EVLNAIGPW (MAGC3_HUMAN)
EVLNAIGPY

SEQ ID NO: 97886 - protein, 10 aa, Artificial Sequence
  Description of Artificial Sequence: Synthetic peptide
  Seed: MNVINTYTGY (MAGC3_HUMAN)
MQVINTYTGF

SEQ ID NO: 97887 - protein, 9 aa, Artificial Sequence
  Description of Artificial Sequence: Synthetic peptide
  Seed: AMASASPSV (MAGC3_HUMAN)
ALASASPSR

SEQ ID NO: 97888 - protein, 9 aa, Artificial Sequence
  Description of Artificial Sequence: Synthetic peptide
  Seed: KLVQFLLLK (MAGC3_HUMAN)
KQVQFLLLV

SEQ ID NO: 97889 - protein, 9 aa, Artificial Sequence
  Description of Artificial Sequence: Synthetic peptide
  Seed: SASPSVMST (MAGC3_HUMAN)
SRSPSVMSI

SEQ ID NO: 97890 - protein, 10 aa, Artificial Sequence
  Description of Artificial Sequence: Synthetic peptide
  Seed: LWKDSDLPTW (MAGC3_HUMAN)
LTKDSDLPTF

SEQ ID NO: 97891 - protein, 9 aa, Artificial Sequence
  Description of Artificial Sequence: Synthetic peptide
  Seed: ALDEKVAEL (MAGC3_HUMAN)
ALDEKVAEF

SEQ ID NO: 97892 - protein, 9 aa, Artificial Sequence
  Description of Artificial Sequence: Synthetic peptide
  Seed: YKDYFPMIF (MAGC3_HUMAN)
YWDYFPMIL

SEQ ID NO: 97893 - protein, 11 aa, Artificial Sequence
  Description of Artificial Sequence: Synthetic peptide
  Seed: FIELIFGIALT (MAGC3_HUMAN)
FFELIFGIALI

SEQ ID NO: 97894 - protein, 9 aa, Artificial Sequence
  Description of Artificial Sequence: Synthetic peptide
  Seed: MEDRAQAII (MAGC3_HUMAN)
MHDRAQAIV

SEQ ID NO: 97895 - protein, 10 aa, Artificial Sequence
  Description of Artificial Sequence: Synthetic peptide
  Seed: MLTTVIKKYK (MAGC3_HUMAN)
MNTTVIKKYK

SEQ ID NO: 97896 - protein, 10 aa, Artificial Sequence
  Description of Artificial Sequence: Synthetic peptide
  Seed: SAFHLGHLRE (MAGC3_HUMAN)
SYFHLGHLRK

SEQ ID NO: 97897 - protein, 10 aa, Artificial Sequence
  Description of Artificial Sequence: Synthetic peptide
  Seed: EMQMNVINTY (MAGC3_HUMAN)
EAQMNVINTF

SEQ ID NO: 97898 - protein, 9 aa, Artificial Sequence
  Description of Artificial Sequence: Synthetic peptide
  Seed: MLLPCHWVL (MAGC3_HUMAN)
MALPCHWVL

SEQ ID NO: 97899 - protein, 9 aa, Artificial Sequence
  Description of Artificial Sequence: Synthetic peptide
  Seed: KVDKLVQFL (MAGC3_HUMAN)
KSDKLVQFF

SEQ ID NO: 97900 - protein, 9 aa, Artificial Sequence
  Description of Artificial Sequence: Synthetic peptide
  Seed: TLDEKVDKL (MAGC3_HUMAN)
TNDEKVDKV

SEQ ID NO: 97901 - protein, 9 aa, Artificial Sequence
  Description of Artificial Sequence: Synthetic peptide
  Seed: GPPQSPPQS (MAGC3_HUMAN)
GPPQSPPQA

SEQ ID NO: 97902 - protein, 9 aa, Artificial Sequence
  Description of Artificial Sequence: Synthetic peptide
  Seed: FADVLSRLA (MAGC3_HUMAN)
FIDVLSRLF

SEQ ID NO: 97903 - protein, 9 aa, Artificial Sequence
  Description of Artificial Sequence: Synthetic peptide
  Seed: KKYKDYFPM (MAGC3_HUMAN)
KKYKDYFPL

SEQ ID NO: 97904 - protein, 9 aa, Artificial Sequence
  Description of Artificial Sequence: Synthetic peptide
  Seed: YKDYFPMIF (MAGC3_HUMAN)
YSDYFPMIL

SEQ ID NO: 97905 - protein, 9 aa, Artificial Sequence
  Description of Artificial Sequence: Synthetic peptide
  Seed: DYSAFHLGH (MAGC3_HUMAN)
DMSAFHLGR

SEQ ID NO: 97906 - protein, 9 aa, Artificial Sequence
  Description of Artificial Sequence: Synthetic peptide
  Seed: MEDRAQAII (MAGC3_HUMAN)
MYDRAQAIL

SEQ ID NO: 97907 - protein, 9 aa, Artificial Sequence
  Description of Artificial Sequence: Synthetic peptide
  Seed: MQMNVINTY (MAGC3_HUMAN)
MGMNVINTW

SEQ ID NO: 97908 - protein, 9 aa, Artificial Sequence
  Description of Artificial Sequence: Synthetic peptide
  Seed: IQRPAREVL (MAGC3_HUMAN)
ISRPAREVM

SEQ ID NO: 97909 - protein, 9 aa, Artificial Sequence
  Description of Artificial Sequence: Synthetic peptide
  Seed: GFADVLSRL (MAGC3_HUMAN)
GLADVLSRV

SEQ ID NO: 97910 - protein, 10 aa, Artificial Sequence
  Description of Artificial Sequence: Synthetic peptide
  Seed: TGYFPMIFRK (MAGC3_HUMAN)
TMYFPMIFRK

SEQ ID NO: 97911 - protein, 9 aa, Artificial Sequence
  Description of Artificial Sequence: Synthetic peptide
  Seed: LKYQAKEPL (MAGC3_HUMAN)
LVYQAKEPF

SEQ ID NO: 97912 - protein, 11 aa, Artificial Sequence
  Description of Artificial Sequence: Synthetic peptide
  Seed: RYALDEKVAEL (MAGC3_HUMAN)
RSALDEKVAEV

SEQ ID NO: 97913 - protein, 9 aa, Artificial Sequence
  Description of Artificial Sequence: Synthetic peptide
  Seed: GSLPESEPL (MAGC3_HUMAN)
GMLPESEPL

SEQ ID NO: 97914 - protein, 8 aa, Artificial Sequence
  Description of Artificial Sequence: Synthetic peptide
  Seed: YMDALKDM (MAGC3_HUMAN)
YMDALKDL

SEQ ID NO: 97915 - protein, 9 aa, Artificial Sequence
  Description of Artificial Sequence: Synthetic peptide
  Seed: MIFGKAHEF (MAGC3_HUMAN)
MQFGKAHEW

SEQ ID NO: 97916 - protein, 9 aa, Artificial Sequence
  Description of Artificial Sequence: Synthetic peptide
  Seed: LRSAEGSVL (MAGC3_HUMAN)
LNSAEGSVF

SEQ ID NO: 97917 - protein, 10 aa, Artificial Sequence
  Description of Artificial Sequence: Synthetic peptide
  Seed: VVLPPQPQPR (MAGC3_HUMAN)
VMLPPQPQPK

SEQ ID NO: 97918 - protein, 10 aa, Artificial Sequence
  Description of Artificial Sequence: Synthetic peptide
  Seed: TGYFPMIFRK (MAGC3_HUMAN)
TTYFPMIFRW

SEQ ID NO: 97919 - protein, 9 aa, Artificial Sequence
  Description of Artificial Sequence: Synthetic peptide
  Seed: KKYKDYFPM (MAGC3_HUMAN)
KQYKDYFPH

SEQ ID NO: 97920 - protein, 10 aa, Artificial Sequence
  Description of Artificial Sequence: Synthetic peptide
  Seed: SDQRMDSLVL (MAGC3_HUMAN)
SHQRMDSLVY

SEQ ID NO: 97921 - protein, 9 aa, Artificial Sequence
  Description of Artificial Sequence: Synthetic peptide
  Seed: TKAEMLTTV (MAGC3_HUMAN)
TAAEMLTTV

SEQ ID NO: 97922 - protein, 10 aa, Artificial Sequence
  Description of Artificial Sequence: Synthetic peptide
  Seed: EVIWEVLNAI (MAGC3_HUMAN)
EIIWEVLNAK

SEQ ID NO: 97923 - protein, 9 aa, Artificial Sequence
  Description of Artificial Sequence: Synthetic peptide
  Seed: GFADVLSRL (MAGC3_HUMAN)
GWADVLSRF

SEQ ID NO: 97924 - protein, 9 aa, Artificial Sequence
  Description of Artificial Sequence: Synthetic peptide
  Seed: EVLEFLSKL (MAGC3_HUMAN)
EPLEFLSKV

SEQ ID NO: 97925 - protein, 9 aa, Artificial Sequence
  Description of Artificial Sequence: Synthetic peptide
  Seed: TSDQRMDSL (MAGC3_HUMAN)
TFDQRMDSI

SEQ ID NO: 97926 - protein, 9 aa, Artificial Sequence
  Description of Artificial Sequence: Synthetic peptide
  Seed: HALPESESL (MAGC3_HUMAN)
HYLPESESF

SEQ ID NO: 97927 - protein, 10 aa, Artificial Sequence
  Description of Artificial Sequence: Synthetic peptide
  Seed: LNAIGPWSAL (MAGC3_HUMAN)
LRAIGPWSAY

SEQ ID NO: 97928 - protein, 10 aa, Artificial Sequence
  Description of Artificial Sequence: Synthetic peptide
  Seed: SESLPRYALD (MAGC3_HUMAN)
SESLPRYALL

SEQ ID NO: 97929 - protein, 9 aa, Artificial Sequence
  Description of Artificial Sequence: Synthetic peptide
  Seed: EVLNAIGPW (MAGC3_HUMAN)
EALNAIGPW

SEQ ID NO: 97930 - protein, 10 aa, Artificial Sequence
  Description of Artificial Sequence: Synthetic peptide
  Seed: NTYTGYFPMI (MAGC3_HUMAN)
NMYTGYFPMV

SEQ ID NO: 97931 - protein, 9 aa, Artificial Sequence
  Description of Artificial Sequence: Synthetic peptide
  Seed: KLSSIIPSA (MAGC3_HUMAN)
KMSSIIPSK

SEQ ID NO: 97932 - protein, 9 aa, Artificial Sequence
  Description of Artificial Sequence: Synthetic peptide
  Seed: AIGPIQRPA (MAGC3_HUMAN)
ASGPIQRPF

SEQ ID NO: 97933 - protein, 9 aa, Artificial Sequence
  Description of Artificial Sequence: Synthetic peptide
  Seed: KVAELVQFL (MAGC3_HUMAN)
KLAELVQFT

SEQ ID NO: 97934 - protein, 11 aa, Artificial Sequence
  Description of Artificial Sequence: Synthetic peptide
  Seed: TDMDPDNHSYF (MAGC3_HUMAN)
TSMDPDNHSYW

SEQ ID NO: 97935 - protein, 10 aa, Artificial Sequence
  Description of Artificial Sequence: Synthetic peptide
  Seed: KVAELVQFLL (MAGC3_HUMAN)
KLAELVQFLH

SEQ ID NO: 97936 - protein, 9 aa, Artificial Sequence
  Description of Artificial Sequence: Synthetic peptide
  Seed: REEPQDWPL (MAGC3_HUMAN)
REEPQDWPM

SEQ ID NO: 97937 - protein, 9 aa, Artificial Sequence
  Description of Artificial Sequence: Synthetic peptide
  Seed: KVDKLVQFL (MAGC3_HUMAN)
KCDKLVQFM

SEQ ID NO: 97938 - protein, 10 aa, Artificial Sequence
  Description of Artificial Sequence: Synthetic peptide
  Seed: YTLDEKVDKL (MAGC3_HUMAN)
YSLDEKVDKV

SEQ ID NO: 97939 - protein, 8 aa, Artificial Sequence
  Description of Artificial Sequence: Synthetic peptide
  Seed: AEMLTTVI (MAGC3_HUMAN)
AEMLTTVL

SEQ ID NO: 97940 - protein, 9 aa, Artificial Sequence
  Description of Artificial Sequence: Synthetic peptide
  Seed: YKDYFPMIF (MAGC3_HUMAN)
YTDYFPMIL

SEQ ID NO: 97941 - protein, 9 aa, Artificial Sequence
  Description of Artificial Sequence: Synthetic peptide
  Seed: KFSLRRAVS (MAGC3_HUMAN)
KQSLRRAVK

SEQ ID NO: 97942 - protein, 10 aa, Artificial Sequence
  Description of Artificial Sequence: Synthetic peptide
  Seed: PTYFKLWRTL (MAGC3_HUMAN)
PWYFKLWRTF

SEQ ID NO: 97943 - protein, 9 aa, Artificial Sequence
  Description of Artificial Sequence: Synthetic peptide
  Seed: MLTTVIKKY (MAGC3_HUMAN)
MVTTVIKKY

SEQ ID NO: 97944 - protein, 10 aa, Artificial Sequence
  Description of Artificial Sequence: Synthetic peptide
  Seed: AMASASPSVM (MAGC3_HUMAN)
AVASASPSVV

SEQ ID NO: 97945 - protein, 9 aa, Artificial Sequence
  Description of Artificial Sequence: Synthetic peptide
  Seed: SLRRAVSVK (MAGC3_HUMAN)
SFRRAVSVR

SEQ ID NO: 97946 - protein, 9 aa, Artificial Sequence
  Description of Artificial Sequence: Synthetic peptide
  Seed: GPWSALAGF (MAGC3_HUMAN)
GIWSALAGY

SEQ ID NO: 97947 - protein, 8 aa, Artificial Sequence
  Description of Artificial Sequence: Synthetic peptide
  Seed: IFGKAHEF (MAGC3_HUMAN)
ITGKAHEL

SEQ ID NO: 97948 - protein, 10 aa, Artificial Sequence
  Description of Artificial Sequence: Synthetic peptide
  Seed: IELIFGIALT (MAGC3_HUMAN)
IDLIFGIALV

SEQ ID NO: 97949 - protein, 9 aa, Artificial Sequence
  Description of Artificial Sequence: Synthetic peptide
  Seed: KYKDYFPMI (MAGC3_HUMAN)
KSKDYFPMF

SEQ ID NO: 97950 - protein, 9 aa, Artificial Sequence
  Description of Artificial Sequence: Synthetic peptide
  Seed: CPTYFKLWR (MAGC3_HUMAN)
CATYFKLWR

SEQ ID NO: 97951 - protein, 10 aa, Artificial Sequence
  Description of Artificial Sequence: Synthetic peptide
  Seed: FKLWRTLSGS (MAGC3_HUMAN)
FRLWRTLSGL

SEQ ID NO: 97952 - protein, 10 aa, Artificial Sequence
  Description of Artificial Sequence: Synthetic peptide
  Seed: ILFGISLTEV (MAGC3_HUMAN)
ILFGISLTEA

SEQ ID NO: 97953 - protein, 10 aa, Artificial Sequence
  Description of Artificial Sequence: Synthetic peptide
  Seed: KKYKDYFPMI (MAGC3_HUMAN)
KWYKDYFPMW

SEQ ID NO: 97954 - protein, 9 aa, Artificial Sequence
  Description of Artificial Sequence: Synthetic peptide
  Seed: QAKEPLTRA (MAGC3_HUMAN)
QPKEPLTRV

SEQ ID NO: 97955 - protein, 9 aa, Artificial Sequence
  Description of Artificial Sequence: Synthetic peptide
  Seed: VLCPTYFKL (MAGC3_HUMAN)
VVCPTYFKI

SEQ ID NO: 97956 - protein, 9 aa, Artificial Sequence
  Description of Artificial Sequence: Synthetic peptide
  Seed: LSSIIPSAF (MAGC3_HUMAN)
LVSIIPSAW

SEQ ID NO: 97957 - protein, 9 aa, Artificial Sequence
  Description of Artificial Sequence: Synthetic peptide
  Seed: VIWEVLNAI (MAGC3_HUMAN)
VTWEVLNAV

SEQ ID NO: 97958 - protein, 9 aa, Artificial Sequence
  Description of Artificial Sequence: Synthetic peptide
  Seed: SIIPSAFPS (MAGC3_HUMAN)
SQIPSAFPT

SEQ ID NO: 97959 - protein, 11 aa, Artificial Sequence
  Description of Artificial Sequence: Synthetic peptide
  Seed: RYALDEKVAEL (MAGC3_HUMAN)
RLALDEKVAEI

SEQ ID NO: 97960 - protein, 10 aa, Artificial Sequence
  Description of Artificial Sequence: Synthetic peptide
  Seed: MQMNVINTYT (MAGC3_HUMAN)
MYMNVINTYV

SEQ ID NO: 97961 - protein, 10 aa, Artificial Sequence
  Description of Artificial Sequence: Synthetic peptide
  Seed: YFPMIFGKAH (MAGC3_HUMAN)
YFPMIFGKAM

SEQ ID NO: 97962 - protein, 10 aa, Artificial Sequence
  Description of Artificial Sequence: Synthetic peptide
  Seed: YALDEKVAEL (MAGC3_HUMAN)
YQLDEKVAEI

SEQ ID NO: 97963 - protein, 11 aa, Artificial Sequence
  Description of Artificial Sequence: Synthetic peptide
  Seed: EILFGISLTEV (MAGC3_HUMAN)
EYLFGISLTEV

SEQ ID NO: 97964 - protein, 9 aa, Artificial Sequence
  Description of Artificial Sequence: Synthetic peptide
  Seed: KLWRTLSGS (MAGC3_HUMAN)
KMWRTLSGI

SEQ ID NO: 97965 - protein, 9 aa, Artificial Sequence
  Description of Artificial Sequence: Synthetic peptide
  Seed: DYSAFHLGH (MAGC3_HUMAN)
DFSAFHLGR

SEQ ID NO: 97966 - protein, 11 aa, Artificial Sequence
  Description of Artificial Sequence: Synthetic peptide
  Seed: SLPESEPLFTY (MAGC3_HUMAN)
SLPESEPLFTV

SEQ ID NO: 97967 - protein, 9 aa, Artificial Sequence
  Description of Artificial Sequence: Synthetic peptide
  Seed: YQAKEPLTR (MAGC3_HUMAN)
YKAKEPLTF

SEQ ID NO: 97968 - protein, 9 aa, Artificial Sequence
  Description of Artificial Sequence: Synthetic peptide
  Seed: SQPEGKFSL (MAGC3_HUMAN)
SAPEGKFSI

SEQ ID NO: 97969 - protein, 9 aa, Artificial Sequence
  Description of Artificial Sequence: Synthetic peptide
  Seed: LPQSPPEIP (MAGC3_HUMAN)
LPQSPPEIM

SEQ ID NO: 97970 - protein, 9 aa, Artificial Sequence
  Description of Artificial Sequence: Synthetic peptide
  Seed: LSDEQGMPQ (MAGC3_HUMAN)
LMDEQGMPF

SEQ ID NO: 97971 - protein, 10 aa, Artificial Sequence
  Description of Artificial Sequence: Synthetic peptide
  Seed: EKVAELVQFL (MAGC3_HUMAN)
EEVAELVQFY

SEQ ID NO: 97972 - protein, 9 aa, Artificial Sequence
  Description of Artificial Sequence: Synthetic peptide
  Seed: LLILILSMI (MAGC3_HUMAN)
LQILILSMA

SEQ ID NO: 97973 - protein, 9 aa, Artificial Sequence
  Description of Artificial Sequence: Synthetic peptide
  Seed: MIFGKAHEF (MAGC3_HUMAN)
MKFGKAHEY

SEQ ID NO: 97974 - protein, 9 aa, Artificial Sequence
  Description of Artificial Sequence: Synthetic peptide
  Seed: MIFRKAREF (MAGC3_HUMAN)
MFFRKAREF

SEQ ID NO: 97975 - protein, 10 aa, Artificial Sequence
  Description of Artificial Sequence: Synthetic peptide
  Seed: MNVINTYTGY (MAGC3_HUMAN)
MNVINTYTGR

SEQ ID NO: 97976 - protein, 10 aa, Artificial Sequence
  Description of Artificial Sequence: Synthetic peptide
  Seed: YALDEKVAEL (MAGC3_HUMAN)
YPLDEKVAEC

SEQ ID NO: 97977 - protein, 9 aa, Artificial Sequence
  Description of Artificial Sequence: Synthetic peptide
  Seed: ATYALSPVV (MAGC3_HUMAN)
AMYALSPVK

SEQ ID NO: 97978 - protein, 10 aa, Artificial Sequence
  Description of Artificial Sequence: Synthetic peptide
  Seed: FPSWYMDALK (MAGC3_HUMAN)
FDSWYMDALR

SEQ ID NO: 97979 - protein, 10 aa, Artificial Sequence
  Description of Artificial Sequence: Synthetic peptide
  Seed: FPSWYMDALK (MAGC3_HUMAN)
FESWYMDALK

SEQ ID NO: 97980 - protein, 11 aa, Artificial Sequence
  Description of Artificial Sequence: Synthetic peptide
  Seed: AEMQMNVINTY (MAGC3_HUMAN)
AQMQMNVINTF

SEQ ID NO: 97981 - protein, 10 aa, Artificial Sequence
  Description of Artificial Sequence: Synthetic peptide
  Seed: SKLSSIIPSA (MAGC3_HUMAN)
SVLSSIIPSA

SEQ ID NO: 97982 - protein, 9 aa, Artificial Sequence
  Description of Artificial Sequence: Synthetic peptide
  Seed: LSSIIPSAF (MAGC3_HUMAN)
LPSIIPSAH

SEQ ID NO: 97983 - protein, 9 aa, Artificial Sequence
  Description of Artificial Sequence: Synthetic peptide
  Seed: FSDGSLGQW (MAGC3_HUMAN)
FCDGSLGQL

SEQ ID NO: 97984 - protein, 9 aa, Artificial Sequence
  Description of Artificial Sequence: Synthetic peptide
  Seed: FADVLSRLA (MAGC3_HUMAN)
FADVLSRLV

SEQ ID NO: 97985 - protein, 9 aa, Artificial Sequence
  Description of Artificial Sequence: Synthetic peptide
  Seed: SLVLCPTYF (MAGC3_HUMAN)
SVVLCPTYV

SEQ ID NO: 97986 - protein, 9 aa, Artificial Sequence
  Description of Artificial Sequence: Synthetic peptide
  Seed: TLDEKVDKL (MAGC3_HUMAN)
TNDEKVDKL

SEQ ID NO: 97987 - protein, 10 aa, Artificial Sequence
  Description of Artificial Sequence: Synthetic peptide
  Seed: IELIFGIALT (MAGC3_HUMAN)
IPLIFGIALI

SEQ ID NO: 97988 - protein, 9 aa, Artificial Sequence
  Description of Artificial Sequence: Synthetic peptide
  Seed: VLPPQPQPR (MAGC3_HUMAN)
VPPPQPQPM

SEQ ID NO: 97989 - protein, 10 aa, Artificial Sequence
  Description of Artificial Sequence: Synthetic peptide
  Seed: ALAGFADVLS (MAGC3_HUMAN)
ALAGFADVLV

SEQ ID NO: 97990 - protein, 9 aa, Artificial Sequence
  Description of Artificial Sequence: Synthetic peptide
  Seed: SPVVLPPQP (MAGC3_HUMAN)
SAVVLPPQV

SEQ ID NO: 97991 - protein, 11 aa, Artificial Sequence
  Description of Artificial Sequence: Synthetic peptide
  Seed: TTDDATAMASA (MAGC3_HUMAN)
TIDDATAMASV

SEQ ID NO: 97992 - protein, 9 aa, Artificial Sequence
  Description of Artificial Sequence: Synthetic peptide
  Seed: HALPESESL (MAGC3_HUMAN)
HMLPESESV

SEQ ID NO: 97993 - protein, 10 aa, Artificial Sequence
  Description of Artificial Sequence: Synthetic peptide
  Seed: EVIWEVLNAI (MAGC3_HUMAN)
ETIWEVLNAF

SEQ ID NO: 97994 - protein, 9 aa, Artificial Sequence
  Description of Artificial Sequence: Synthetic peptide
  Seed: KLVQFLLLK (MAGC3_HUMAN)
KAVQFLLLR

SEQ ID NO: 97995 - protein, 10 aa, Artificial Sequence
  Description of Artificial Sequence: Synthetic peptide
  Seed: SDQRMDSLVL (MAGC3_HUMAN)
SHQRMDSLVL

SEQ ID NO: 97996 - protein, 9 aa, Artificial Sequence
  Description of Artificial Sequence: Synthetic peptide
  Seed: YFFEDTLDL (MAGC3_HUMAN)
YQFEDTLDH

SEQ ID NO: 97997 - protein, 11 aa, Artificial Sequence
  Description of Artificial Sequence: Synthetic peptide
  Seed: INTYTGYFPMI (MAGC3_HUMAN)
IWTYTGYFPMF

SEQ ID NO: 97998 - protein, 10 aa, Artificial Sequence
  Description of Artificial Sequence: Synthetic peptide
  Seed: KLVQFLLLKY (MAGC3_HUMAN)
KVVQFLLLKR

SEQ ID NO: 97999 - protein, 10 aa, Artificial Sequence
  Description of Artificial Sequence: Synthetic peptide
  Seed: LNAIGPWSAL (MAGC3_HUMAN)
LIAIGPWSAF

SEQ ID NO: 98000 - protein, 8 aa, Artificial Sequence
  Description of Artificial Sequence: Synthetic peptide
  Seed: LDEKVAEL (MAGC3_HUMAN)
LEEKVAEL

SEQ ID NO: 98001 - protein, 9 aa, Artificial Sequence
  Description of Artificial Sequence: Synthetic peptide
  Seed: SALAGFADV (MAGC3_HUMAN)
SLLAGFADI

SEQ ID NO: 98002 - protein, 9 aa, Artificial Sequence
  Description of Artificial Sequence: Synthetic peptide
  Seed: VIWEVLNAI (MAGC3_HUMAN)
VQWEVLNAA

SEQ ID NO: 98003 - protein, 10 aa, Artificial Sequence
  Description of Artificial Sequence: Synthetic peptide
  Seed: FFEDTLDLTY (MAGC3_HUMAN)
FFEDTLDLTL

SEQ ID NO: 98004 - protein, 9 aa, Artificial Sequence
  Description of Artificial Sequence: Synthetic peptide
  Seed: YFFEDTLDL (MAGC3_HUMAN)
YRFEDTLDM

SEQ ID NO: 98005 - protein, 9 aa, Artificial Sequence
  Description of Artificial Sequence: Synthetic peptide
  Seed: VDPDHFYVF (MAGC3_HUMAN)
VVPDHFYVY

SEQ ID NO: 98006 - protein, 10 aa, Artificial Sequence
  Description of Artificial Sequence: Synthetic peptide
  Seed: TAMASASPSV (MAGC3_HUMAN)
TQMASASPSV

SEQ ID NO: 98007 - protein, 9 aa, Artificial Sequence
  Description of Artificial Sequence: Synthetic peptide
  Seed: EVLEFLSKL (MAGC3_HUMAN)
ETLEFLSKH

SEQ ID NO: 98008 - protein, 9 aa, Artificial Sequence
  Description of Artificial Sequence: Synthetic peptide
  Seed: MQMNVINTY (MAGC3_HUMAN)
MGMNVINTM

SEQ ID NO: 98009 - protein, 9 aa, Artificial Sequence
  Description of Artificial Sequence: Synthetic peptide
  Seed: NTYTGYFPM (MAGC3_HUMAN)
NVYTGYFPI

SEQ ID NO: 98010 - protein, 9 aa, Artificial Sequence
  Description of Artificial Sequence: Synthetic peptide
  Seed: MDPDNHSYF (MAGC3_HUMAN)
MRPDNHSYY

SEQ ID NO: 98011 - protein, 10 aa, Artificial Sequence
  Description of Artificial Sequence: Synthetic peptide
  Seed: TDMDPDNHSY (MAGC3_HUMAN)
TIMDPDNHSM

SEQ ID NO: 98012 - protein, 10 aa, Artificial Sequence
  Description of Artificial Sequence: Synthetic peptide
  Seed: SKLSSIIPSA (MAGC3_HUMAN)
SDLSSIIPSV

SEQ ID NO: 98013 - protein, 10 aa, Artificial Sequence
  Description of Artificial Sequence: Synthetic peptide
  Seed: KLSSIIPSAF (MAGC3_HUMAN)
KLSSIIPSAI

SEQ ID NO: 98014 - protein, 9 aa, Artificial Sequence
  Description of Artificial Sequence: Synthetic peptide
  Seed: EKVDKLVQF (MAGC3_HUMAN)
EHVDKLVQY

SEQ ID NO: 98015 - protein, 9 aa, Artificial Sequence
  Description of Artificial Sequence: Synthetic peptide
  Seed: VIWEVLSAI (MAGC3_HUMAN)
VLWEVLSAF

SEQ ID NO: 98016 - protein, 11 aa, Artificial Sequence
  Description of Artificial Sequence: Synthetic peptide
  Seed: AIGPWSALAGF (MAGC3_HUMAN)
ATGPWSALAGR

SEQ ID NO: 98017 - protein, 9 aa, Artificial Sequence
  Description of Artificial Sequence: Synthetic peptide
  Seed: EMLTTVIKK (MAGC3_HUMAN)
ENLTTVIKR

SEQ ID NO: 98018 - protein, 9 aa, Artificial Sequence
  Description of Artificial Sequence: Synthetic peptide
  Seed: KGSCVPEEV (MAGC3_HUMAN)
KISCVPEEL

SEQ ID NO: 98019 - protein, 9 aa, Artificial Sequence
  Description of Artificial Sequence: Synthetic peptide
  Seed: QMNVINTYT (MAGC3_HUMAN)
QLNVINTYA

SEQ ID NO: 98020 - protein, 10 aa, Artificial Sequence
  Description of Artificial Sequence: Synthetic peptide
  Seed: LNAIGPWSAL (MAGC3_HUMAN)
LHAIGPWSAL

SEQ ID NO: 98021 - protein, 10 aa, Artificial Sequence
  Description of Artificial Sequence: Synthetic peptide
  Seed: VKNTCATYAL (MAGC3_HUMAN)
VQNTCATYAF

SEQ ID NO: 98022 - protein, 10 aa, Artificial Sequence
  Description of Artificial Sequence: Synthetic peptide
  Seed: IPPQGPPKIS (MAGC3_HUMAN)
IPPQGPPKIM

SEQ ID NO: 98023 - protein, 9 aa, Artificial Sequence
  Description of Artificial Sequence: Synthetic peptide
  Seed: ELVQFLLLK (MAGC3_HUMAN)
ETVQFLLLR

SEQ ID NO: 98024 - protein, 9 aa, Artificial Sequence
  Description of Artificial Sequence: Synthetic peptide
  Seed: TGYFPMIFR (MAGC3_HUMAN)
TWYFPMIFK

SEQ ID NO: 98025 - protein, 9 aa, Artificial Sequence
  Description of Artificial Sequence: Synthetic peptide
  Seed: MQMNVINTY (MAGC3_HUMAN)
MQMNVINTL

SEQ ID NO: 98026 - protein, 9 aa, Artificial Sequence
  Description of Artificial Sequence: Synthetic peptide
  Seed: SAFHLGHLR (MAGC3_HUMAN)
SIFHLGHLF

SEQ ID NO: 98027 - protein, 10 aa, Artificial Sequence
  Description of Artificial Sequence: Synthetic peptide
  Seed: YALDEKVAEL (MAGC3_HUMAN)
YMLDEKVAEY

SEQ ID NO: 98028 - protein, 9 aa, Artificial Sequence
  Description of Artificial Sequence: Synthetic peptide
  Seed: REVLEFLSK (MAGC3_HUMAN)
RVVLEFLSR

SEQ ID NO: 98029 - protein, 9 aa, Artificial Sequence
  Description of Artificial Sequence: Synthetic peptide
  Seed: MASASPSVM (MAGC3_HUMAN)
MPSASPSVM

SEQ ID NO: 98030 - protein, 9 aa, Artificial Sequence
  Description of Artificial Sequence: Synthetic peptide
  Seed: RPAREVLEF (MAGC3_HUMAN)
RVAREVLEY

SEQ ID NO: 98031 - protein, 9 aa, Artificial Sequence
  Description of Artificial Sequence: Synthetic peptide
  Seed: ISPQGPPQS (MAGC3_HUMAN)
IMPQGPPQL

SEQ ID NO: 98032 - protein, 9 aa, Artificial Sequence
  Description of Artificial Sequence: Synthetic peptide
  Seed: TLDEKVDKL (MAGC3_HUMAN)
TSDEKVDKY

SEQ ID NO: 98033 - protein, 10 aa, Artificial Sequence
  Description of Artificial Sequence: Synthetic peptide
  Seed: MQMNVINTYT (MAGC3_HUMAN)
MRMNVINTYY

SEQ ID NO: 98034 - protein, 9 aa, Artificial Sequence
  Description of Artificial Sequence: Synthetic peptide
  Seed: EAFCEESGL (MAGC3_HUMAN)
EIFCEESGV

SEQ ID NO: 98035 - protein, 11 aa, Artificial Sequence
  Description of Artificial Sequence: Synthetic peptide
  Seed: FIELIFGIALT (MAGC3_HUMAN)
FAELIFGIALI

SEQ ID NO: 98036 - protein, 10 aa, Artificial Sequence
  Description of Artificial Sequence: Synthetic peptide
  Seed: KKYKDYFPMI (MAGC3_HUMAN)
KWYKDYFPMF

SEQ ID NO: 98037 - protein, 9 aa, Artificial Sequence
  Description of Artificial Sequence: Synthetic peptide
  Seed: VIWEVLSAI (MAGC3_HUMAN)
VIWEVLSAV

SEQ ID NO: 98038 - protein, 10 aa, Artificial Sequence
  Description of Artificial Sequence: Synthetic peptide
  Seed: SLVLCPTYFK (MAGC3_HUMAN)
SNVLCPTYFK

SEQ ID NO: 98039 - protein, 9 aa, Artificial Sequence
  Description of Artificial Sequence: Synthetic peptide
  Seed: KVAELVQFL (MAGC3_HUMAN)
KVAELVQFA

SEQ ID NO: 98040 - protein, 10 aa, Artificial Sequence
  Description of Artificial Sequence: Synthetic peptide
  Seed: SALAGFADVL (MAGC3_HUMAN)
SGLAGFADVV

SEQ ID NO: 98041 - protein, 10 aa, Artificial Sequence
  Description of Artificial Sequence: Synthetic peptide
  Seed: SQPEGKFSLR (MAGC3_HUMAN)
SMPEGKFSLK

SEQ ID NO: 98042 - protein, 9 aa, Artificial Sequence
  Description of Artificial Sequence: Synthetic peptide
  Seed: MLLPCHWVL (MAGC3_HUMAN)
MMLPCHWVM

SEQ ID NO: 98043 - protein, 9 aa, Artificial Sequence
  Description of Artificial Sequence: Synthetic peptide
  Seed: VLCPTYFKL (MAGC3_HUMAN)
VVCPTYFKK

SEQ ID NO: 98044 - protein, 10 aa, Artificial Sequence
  Description of Artificial Sequence: Synthetic peptide
  Seed: MLLPCHWVLD (MAGC3_HUMAN)
MMLPCHWVLI

SEQ ID NO: 98045 - protein, 10 aa, Artificial Sequence
  Description of Artificial Sequence: Synthetic peptide
  Seed: TGYFPMIFRK (MAGC3_HUMAN)
TIYFPMIFRK

SEQ ID NO: 98046 - protein, 9 aa, Artificial Sequence
  Description of Artificial Sequence: Synthetic peptide
  Seed: IIPSAFPSW (MAGC3_HUMAN)
IWPSAFPSF

SEQ ID NO: 98047 - protein, 10 aa, Artificial Sequence
  Description of Artificial Sequence: Synthetic peptide
  Seed: ILFGISLTEV (MAGC3_HUMAN)
ILFGISLTET

SEQ ID NO: 98048 - protein, 9 aa, Artificial Sequence
  Description of Artificial Sequence: Synthetic peptide
  Seed: HLREVRLFL (MAGC3_HUMAN)
HSREVRLFS

SEQ ID NO: 98049 - protein, 9 aa, Artificial Sequence
  Description of Artificial Sequence: Synthetic peptide
  Seed: KVAELVQFL (MAGC3_HUMAN)
KAAELVQFI

SEQ ID NO: 98050 - protein, 9 aa, Artificial Sequence
  Description of Artificial Sequence: Synthetic peptide
  Seed: LVLCPTYFK (MAGC3_HUMAN)
LGLCPTYFK

SEQ ID NO: 98051 - protein, 9 aa, Artificial Sequence
  Description of Artificial Sequence: Synthetic peptide
  Seed: RTLSGSPGL (MAGC3_HUMAN)
RALSGSPGV

SEQ ID NO: 98052 - protein, 9 aa, Artificial Sequence
  Description of Artificial Sequence: Synthetic peptide
  Seed: RGTGYTLSL (MAGC3_HUMAN)
RTTGYTLSY

SEQ ID NO: 98053 - protein, 10 aa, Artificial Sequence
  Description of Artificial Sequence: Synthetic peptide
  Seed: EPQDWPLNEK (MAGC3_HUMAN)
EMQDWPLNEK

SEQ ID NO: 98054 - protein, 9 aa, Artificial Sequence
  Description of Artificial Sequence: Synthetic peptide
  Seed: SIIPSAFPS (MAGC3_HUMAN)
SQIPSAFPI

SEQ ID NO: 98055 - protein, 11 aa, Artificial Sequence
  Description of Artificial Sequence: Synthetic peptide
  Seed: YALDEKVAELV (MAGC3_HUMAN)
YLLDEKVAELQ

SEQ ID NO: 98056 - protein, 9 aa, Artificial Sequence
  Description of Artificial Sequence: Synthetic peptide
  Seed: EVDPDHFYV (MAGC3_HUMAN)
EIDPDHFYI

SEQ ID NO: 98057 - protein, 9 aa, Artificial Sequence
  Description of Artificial Sequence: Synthetic peptide
  Seed: DTTDDATAM (MAGC3_HUMAN)
DVTDDATAW

SEQ ID NO: 98058 - protein, 9 aa, Artificial Sequence
  Description of Artificial Sequence: Synthetic peptide
  Seed: WRRGTGYTL (MAGC3_HUMAN)
WKRGTGYTY

SEQ ID NO: 98059 - protein, 9 aa, Artificial Sequence
  Description of Artificial Sequence: Synthetic peptide
  Seed: TSDQRMDSL (MAGC3_HUMAN)
TIDQRMDSY

SEQ ID NO: 98060 - protein, 10 aa, Artificial Sequence
  Description of Artificial Sequence: Synthetic peptide
  Seed: KVAELVQFLL (MAGC3_HUMAN)
KFAELVQFLW

SEQ ID NO: 98061 - protein, 9 aa, Artificial Sequence
  Description of Artificial Sequence: Synthetic peptide
  Seed: TYALSPVVL (MAGC3_HUMAN)
TYALSPVVV

SEQ ID NO: 98062 - protein, 9 aa, Artificial Sequence
  Description of Artificial Sequence: Synthetic peptide
  Seed: IPPQGPPKI (MAGC3_HUMAN)
ITPQGPPKI

SEQ ID NO: 98063 - protein, 9 aa, Artificial Sequence
  Description of Artificial Sequence: Synthetic peptide
  Seed: FSLRRAVSV (MAGC3_HUMAN)
FNLRRAVSL

SEQ ID NO: 98064 - protein, 10 aa, Artificial Sequence
  Description of Artificial Sequence: Synthetic peptide
  Seed: EEVIWEVLSA (MAGC3_HUMAN)
EGVIWEVLSV

SEQ ID NO: 98065 - protein, 9 aa, Artificial Sequence
  Description of Artificial Sequence: Synthetic peptide
  Seed: YQAKEPLTR (MAGC3_HUMAN)
YRAKEPLTL

SEQ ID NO: 98066 - protein, 10 aa, Artificial Sequence
  Description of Artificial Sequence: Synthetic peptide
  Seed: DMPAAGMPPL (MAGC3_HUMAN)
DFPAAGMPPF

SEQ ID NO: 98067 - protein, 9 aa, Artificial Sequence
  Description of Artificial Sequence: Synthetic peptide
  Seed: VINTYTGYF (MAGC3_HUMAN)
VSNTYTGYM

SEQ ID NO: 98068 - protein, 9 aa, Artificial Sequence
  Description of Artificial Sequence: Synthetic peptide
  Seed: KAHEFIELI (MAGC3_HUMAN)
KNHEFIELY

SEQ ID NO: 98069 - protein, 9 aa, Artificial Sequence
  Description of Artificial Sequence: Synthetic peptide
  Seed: EKVDKLVQF (MAGC3_HUMAN)
EYVDKLVQL

SEQ ID NO: 98070 - protein, 9 aa, Artificial Sequence
  Description of Artificial Sequence: Synthetic peptide
  Seed: HALPESESL (MAGC3_HUMAN)
HALPESESI

SEQ ID NO: 98071 - protein, 9 aa, Artificial Sequence
  Description of Artificial Sequence: Synthetic peptide
  Seed: EVIWEVLNA (MAGC3_HUMAN)
ESIWEVLNV

SEQ ID NO: 98072 - protein, 10 aa, Artificial Sequence
  Description of Artificial Sequence: Synthetic peptide
  Seed: MLTTVIKKYK (MAGC3_HUMAN)
MGTTVIKKYR

SEQ ID NO: 98073 - protein, 9 aa, Artificial Sequence
  Description of Artificial Sequence: Synthetic peptide
  Seed: LSDEQGMPQ (MAGC3_HUMAN)
LFDEQGMPM

SEQ ID NO: 98074 - protein, 11 aa, Artificial Sequence
  Description of Artificial Sequence: Synthetic peptide
  Seed: LTEVDPDHFYV (MAGC3_HUMAN)
LLEVDPDHFYI

SEQ ID NO: 98075 - protein, 10 aa, Artificial Sequence
  Description of Artificial Sequence: Synthetic peptide
  Seed: TCATYALSPV (MAGC3_HUMAN)
TVATYALSPL

SEQ ID NO: 98076 - protein, 9 aa, Artificial Sequence
  Description of Artificial Sequence: Synthetic peptide
  Seed: IPPQGPPKI (MAGC3_HUMAN)
IYPQGPPKM

SEQ ID NO: 98077 - protein, 9 aa, Artificial Sequence
  Description of Artificial Sequence: Synthetic peptide
  Seed: FEDTLDLTY (MAGC3_HUMAN)
FEDTLDLTF

SEQ ID NO: 98078 - protein, 9 aa, Artificial Sequence
  Description of Artificial Sequence: Synthetic peptide
  Seed: GSLPESEPL (MAGC3_HUMAN)
GLLPESEPA

SEQ ID NO: 98079 - protein, 9 aa, Artificial Sequence
  Description of Artificial Sequence: Synthetic peptide
  Seed: IIDTTDDAT (MAGC3_HUMAN)
IADTTDDAV

SEQ ID NO: 98080 - protein, 9 aa, Artificial Sequence
  Description of Artificial Sequence: Synthetic peptide
  Seed: EVLSAIGPI (MAGC3_HUMAN)
EMLSAIGPV

SEQ ID NO: 98081 - protein, 9 aa, Artificial Sequence
  Description of Artificial Sequence: Synthetic peptide
  Seed: SLRRAVSVK (MAGC3_HUMAN)
STRRAVSVI

SEQ ID NO: 98082 - protein, 9 aa, Artificial Sequence
  Description of Artificial Sequence: Synthetic peptide
  Seed: VPEEVIWEV (MAGC3_HUMAN)
VMEEVIWEM

SEQ ID NO: 98083 - protein, 9 aa, Artificial Sequence
  Description of Artificial Sequence: Synthetic peptide
  Seed: QTKEPVTKA (MAGC3_HUMAN)
QLKEPVTKY

SEQ ID NO: 98084 - protein, 11 aa, Artificial Sequence
  Description of Artificial Sequence: Synthetic peptide
  Seed: RTLSGSPGLQL (MAGC3_HUMAN)
RTLSGSPGLQK

SEQ ID NO: 98085 - protein, 11 aa, Artificial Sequence
  Description of Artificial Sequence: Synthetic peptide
  Seed: KKYKDYFPMIF (MAGC3_HUMAN)
KMYKDYFPMIM

SEQ ID NO: 98086 - protein, 9 aa, Artificial Sequence
  Description of Artificial Sequence: Synthetic peptide
  Seed: SLRRAVSVK (MAGC3_HUMAN)
SMRRAVSVM

SEQ ID NO: 98087 - protein, 10 aa, Artificial Sequence
  Description of Artificial Sequence: Synthetic peptide
  Seed: SLIDDQGMPK (MAGC3_HUMAN)
STIDDQGMPK

SEQ ID NO: 98088 - protein, 10 aa, Artificial Sequence
  Description of Artificial Sequence: Synthetic peptide
  Seed: YTGYFPMIFR (MAGC3_HUMAN)
YGGYFPMIFK

SEQ ID NO: 98089 - protein, 9 aa, Artificial Sequence
  Description of Artificial Sequence: Synthetic peptide
  Seed: AMASASPSV (MAGC3_HUMAN)
AAASASPSL

SEQ ID NO: 98090 - protein, 10 aa, Artificial Sequence
  Description of Artificial Sequence: Synthetic peptide
  Seed: SCSSPLLWTR (MAGC3_HUMAN)
SESSPLLWTK

SEQ ID NO: 98091 - protein, 10 aa, Artificial Sequence
  Description of Artificial Sequence: Synthetic peptide
  Seed: YTLDEKVDKL (MAGC3_HUMAN)
YALDEKVDKW

SEQ ID NO: 98092 - protein, 8 aa, Artificial Sequence
  Description of Artificial Sequence: Synthetic peptide
  Seed: YTLSLPAV (MAGC3_HUMAN)
YMLSLPAV

SEQ ID NO: 98093 - protein, 9 aa, Artificial Sequence
  Description of Artificial Sequence: Synthetic peptide
  Seed: VIWEVLSAI (MAGC3_HUMAN)
VVWEVLSAR

SEQ ID NO: 98094 - protein, 9 aa, Artificial Sequence
  Description of Artificial Sequence: Synthetic peptide
  Seed: GKAHEFIEL (MAGC3_HUMAN)
GQAHEFIEY

SEQ ID NO: 98095 - protein, 11 aa, Artificial Sequence
  Description of Artificial Sequence: Synthetic peptide
  Seed: FIELIFGIALT (MAGC3_HUMAN)
FTELIFGIALL

SEQ ID NO: 98096 - protein, 9 aa, Artificial Sequence
  Description of Artificial Sequence: Synthetic peptide
  Seed: HFYVFVNTL (MAGC3_HUMAN)
HHYVFVNTF

SEQ ID NO: 98097 - protein, 9 aa, Artificial Sequence
  Description of Artificial Sequence: Synthetic peptide
  Seed: HFYVFVNTL (MAGC3_HUMAN)
HTYVFVNTY

SEQ ID NO: 98098 - protein, 9 aa, Artificial Sequence
  Description of Artificial Sequence: Synthetic peptide
  Seed: VLCPTYFKL (MAGC3_HUMAN)
VLCPTYFKF

SEQ ID NO: 98099 - protein, 10 aa, Artificial Sequence
  Description of Artificial Sequence: Synthetic peptide
  Seed: TGYFPMIFRK (MAGC3_HUMAN)
TTYFPMIFRG

SEQ ID NO: 98100 - protein, 10 aa, Artificial Sequence
  Description of Artificial Sequence: Synthetic peptide
  Seed: LTRAEMQMNV (MAGC3_HUMAN)
LLRAEMQMNM

SEQ ID NO: 98101 - protein, 10 aa, Artificial Sequence
  Description of Artificial Sequence: Synthetic peptide
  Seed: MIFRKAREFI (MAGC3_HUMAN)
MYFRKAREFK

SEQ ID NO: 98102 - protein, 10 aa, Artificial Sequence
  Description of Artificial Sequence: Synthetic peptide
  Seed: LIFGIALTDM (MAGC3_HUMAN)
LLFGIALTDV

SEQ ID NO: 98103 - protein, 9 aa, Artificial Sequence
  Description of Artificial Sequence: Synthetic peptide
  Seed: QTKEPVTKA (MAGC3_HUMAN)
QAKEPVTKI

SEQ ID NO: 98104 - protein, 9 aa, Artificial Sequence
  Description of Artificial Sequence: Synthetic peptide
  Seed: LANPQGLAG (MAGC3_HUMAN)
LSNPQGLAH

SEQ ID NO: 98105 - protein, 10 aa, Artificial Sequence
  Description of Artificial Sequence: Synthetic peptide
  Seed: AEMLTTVIKK (MAGC3_HUMAN)
ASMLTTVIKK

SEQ ID NO: 98106 - protein, 9 aa, Artificial Sequence
  Description of Artificial Sequence: Synthetic peptide
  Seed: LKYQAKEPL (MAGC3_HUMAN)
LEYQAKEPY

SEQ ID NO: 98107 - protein, 9 aa, Artificial Sequence
  Description of Artificial Sequence: Synthetic peptide
  Seed: TEASPQQKK (MAGC3_HUMAN)
TAASPQQKL

SEQ ID NO: 98108 - protein, 9 aa, Artificial Sequence
  Description of Artificial Sequence: Synthetic peptide
  Seed: WVKNTCATY (MAGC3_HUMAN)
WTKNTCATR

SEQ ID NO: 98109 - protein, 9 aa, Artificial Sequence
  Description of Artificial Sequence: Synthetic peptide
  Seed: FSLRRAVSV (MAGC3_HUMAN)
FMLRRAVSF

SEQ ID NO: 98110 - protein, 8 aa, Artificial Sequence
  Description of Artificial Sequence: Synthetic peptide
  Seed: FADVLSRL (MAGC3_HUMAN)
FTDVLSRI

SEQ ID NO: 98111 - protein, 10 aa, Artificial Sequence
  Description of Artificial Sequence: Synthetic peptide
  Seed: LNAIGPWSAL (MAGC3_HUMAN)
LQAIGPWSAY

SEQ ID NO: 98112 - protein, 9 aa, Artificial Sequence
  Description of Artificial Sequence: Synthetic peptide
  Seed: KDMEDRAQA (MAGC3_HUMAN)
KDMEDRAQM

SEQ ID NO: 98113 - protein, 10 aa, Artificial Sequence
  Description of Artificial Sequence: Synthetic peptide
  Seed: TTDDATAMAS (MAGC3_HUMAN)
TGDDATAMAV

SEQ ID NO: 98114 - protein, 10 aa, Artificial Sequence
  Description of Artificial Sequence: Synthetic peptide
  Seed: TDMDPDNHSY (MAGC3_HUMAN)
TQMDPDNHSY

SEQ ID NO: 98115 - protein, 9 aa, Artificial Sequence
  Description of Artificial Sequence: Synthetic peptide
  Seed: ASEEVIWEV (MAGC3_HUMAN)
AVEEVIWEA

SEQ ID NO: 98116 - protein, 9 aa, Artificial Sequence
  Description of Artificial Sequence: Synthetic peptide
  Seed: KLVQFLLLK (MAGC3_HUMAN)
KMVQFLLLV

SEQ ID NO: 98117 - protein, 9 aa, Artificial Sequence
  Description of Artificial Sequence: Synthetic peptide
  Seed: YSAFHLGHL (MAGC3_HUMAN)
YMAFHLGHS

SEQ ID NO: 98118 - protein, 10 aa, Artificial Sequence
  Description of Artificial Sequence: Synthetic peptide
  Seed: REVRLFLRGG (MAGC3_HUMAN)
RQVRLFLRGA

SEQ ID NO: 98119 - protein, 9 aa, Artificial Sequence
  Description of Artificial Sequence: Synthetic peptide
  Seed: EVIWEVLSA (MAGC3_HUMAN)
EIIWEVLSR

SEQ ID NO: 98120 - protein, 9 aa, Artificial Sequence
  Description of Artificial Sequence: Synthetic peptide
  Seed: YSAFHLGHL (MAGC3_HUMAN)
YQAFHLGHV

SEQ ID NO: 98121 - protein, 9 aa, Artificial Sequence
  Description of Artificial Sequence: Synthetic peptide
  Seed: KVAELVQFL (MAGC3_HUMAN)
KQAELVQFW

SEQ ID NO: 98122 - protein, 10 aa, Artificial Sequence
  Description of Artificial Sequence: Synthetic peptide
  Seed: FPSWYMDALK (MAGC3_HUMAN)
FNSWYMDALR

SEQ ID NO: 98123 - protein, 9 aa, Artificial Sequence
  Description of Artificial Sequence: Synthetic peptide
  Seed: MQMNVINTY (MAGC3_HUMAN)
MWMNVINTL

SEQ ID NO: 98124 - protein, 9 aa, Artificial Sequence
  Description of Artificial Sequence: Synthetic peptide
  Seed: KDMEDRAQA (MAGC3_HUMAN)
KEMEDRAQF

SEQ ID NO: 98125 - protein, 9 aa, Artificial Sequence
  Description of Artificial Sequence: Synthetic peptide
  Seed: SASPSVMST (MAGC3_HUMAN)
SPSPSVMSC

SEQ ID NO: 98126 - protein, 11 aa, Artificial Sequence
  Description of Artificial Sequence: Synthetic peptide
  Seed: TTDDATAMASA (MAGC3_HUMAN)
TLDDATAMASY

SEQ ID NO: 98127 - protein, 11 aa, Artificial Sequence
  Description of Artificial Sequence: Synthetic peptide
  Seed: LSLPAVSPGKR (MAGC3_HUMAN)
LILPAVSPGKR

SEQ ID NO: 98128 - protein, 10 aa, Artificial Sequence
  Description of Artificial Sequence: Synthetic peptide
  Seed: KVAELVQFLL (MAGC3_HUMAN)
KLAELVQFLR

SEQ ID NO: 98129 - protein, 9 aa, Artificial Sequence
  Description of Artificial Sequence: Synthetic peptide
  Seed: YTGYFPMIF (MAGC3_HUMAN)
YFGYFPMIW

SEQ ID NO: 98130 - protein, 9 aa, Artificial Sequence
  Description of Artificial Sequence: Synthetic peptide
  Seed: GPPKISPQG (MAGC3_HUMAN)
GPPKISPQA

SEQ ID NO: 98131 - protein, 9 aa, Artificial Sequence
  Description of Artificial Sequence: Synthetic peptide
  Seed: DEQGMPQNR (MAGC3_HUMAN)
DAQGMPQNR

SEQ ID NO: 98132 - protein, 11 aa, Artificial Sequence
  Description of Artificial Sequence: Synthetic peptide
  Seed: MQMNVINTYTG (MAGC3_HUMAN)
MAMNVINTYTY

SEQ ID NO: 98133 - protein, 9 aa, Artificial Sequence
  Description of Artificial Sequence: Synthetic peptide
  Seed: LIDDQGMPK (MAGC3_HUMAN)
LTDDQGMPM

SEQ ID NO: 98134 - protein, 9 aa, Artificial Sequence
  Description of Artificial Sequence: Synthetic peptide
  Seed: IPPQGPPKI (MAGC3_HUMAN)
IPPQGPPKY

SEQ ID NO: 98135 - protein, 10 aa, Artificial Sequence
  Description of Artificial Sequence: Synthetic peptide
  Seed: MQMNVINTYT (MAGC3_HUMAN)
MMMNVINTYA

SEQ ID NO: 98136 - protein, 9 aa, Artificial Sequence
  Description of Artificial Sequence: Synthetic peptide
  Seed: AIGPIQRPA (MAGC3_HUMAN)
AIGPIQRPY

SEQ ID NO: 98137 - protein, 9 aa, Artificial Sequence
  Description of Artificial Sequence: Synthetic peptide
  Seed: LILSVIFIK (MAGC3_HUMAN)
LSLSVIFIK

SEQ ID NO: 98138 - protein, 9 aa, Artificial Sequence
  Description of Artificial Sequence: Synthetic peptide
  Seed: LKYQAKEPL (MAGC3_HUMAN)
LAYQAKEPF

SEQ ID NO: 98139 - protein, 10 aa, Artificial Sequence
  Description of Artificial Sequence: Synthetic peptide
  Seed: MDPDNHSYFF (MAGC3_HUMAN)
MFPDNHSYFL

SEQ ID NO: 98140 - protein, 10 aa, Artificial Sequence
  Description of Artificial Sequence: Synthetic peptide
  Seed: FPSWYMDALK (MAGC3_HUMAN)
FVSWYMDALK

SEQ ID NO: 98141 - protein, 10 aa, Artificial Sequence
  Description of Artificial Sequence: Synthetic peptide
  Seed: MQMNVINTYT (MAGC3_HUMAN)
MKMNVINTYE

SEQ ID NO: 98142 - protein, 9 aa, Artificial Sequence
  Description of Artificial Sequence: Synthetic peptide
  Seed: EVLNAIGPW (MAGC3_HUMAN)
EVLNAIGPK

SEQ ID NO: 98143 - protein, 9 aa, Artificial Sequence
  Description of Artificial Sequence: Synthetic peptide
  Seed: RGTGYTLSL (MAGC3_HUMAN)
RYTGYTLSM

SEQ ID NO: 98144 - protein, 10 aa, Artificial Sequence
  Description of Artificial Sequence: Synthetic peptide
  Seed: REVLEFLSKL (MAGC3_HUMAN)
REVLEFLSKM

SEQ ID NO: 98145 - protein, 9 aa, Artificial Sequence
  Description of Artificial Sequence: Synthetic peptide
  Seed: LSAIGPIQR (MAGC3_HUMAN)
LVAIGPIQM

SEQ ID NO: 98146 - protein, 10 aa, Artificial Sequence
  Description of Artificial Sequence: Synthetic peptide
  Seed: YTGYFPMIFR (MAGC3_HUMAN)
YSGYFPMIFR

SEQ ID NO: 98147 - protein, 9 aa, Artificial Sequence
  Description of Artificial Sequence: Synthetic peptide
  Seed: TLDEKVDKL (MAGC3_HUMAN)
TPDEKVDKL

SEQ ID NO: 98148 - protein, 11 aa, Artificial Sequence
  Description of Artificial Sequence: Synthetic peptide
  Seed: INTYTGYFPMI (MAGC3_HUMAN)
IHTYTGYFPMF

SEQ ID NO: 98149 - protein, 10 aa, Artificial Sequence
  Description of Artificial Sequence: Synthetic peptide
  Seed: SIIPSAFPSW (MAGC3_HUMAN)
SGIPSAFPSW

SEQ ID NO: 98150 - protein, 9 aa, Artificial Sequence
  Description of Artificial Sequence: Synthetic peptide
  Seed: KKYKDYFPM (MAGC3_HUMAN)
KQYKDYFPW

SEQ ID NO: 98151 - protein, 9 aa, Artificial Sequence
  Description of Artificial Sequence: Synthetic peptide
  Seed: VIWEVLNAI (MAGC3_HUMAN)
VAWEVLNAV

SEQ ID NO: 98152 - protein, 9 aa, Artificial Sequence
  Description of Artificial Sequence: Synthetic peptide
  Seed: VINTYTGYF (MAGC3_HUMAN)
VQNTYTGYY

SEQ ID NO: 98153 - protein, 9 aa, Artificial Sequence
  Description of Artificial Sequence: Synthetic peptide
  Seed: MDPDNHSYF (MAGC3_HUMAN)
MSPDNHSYI

SEQ ID NO: 98154 - protein, 10 aa, Artificial Sequence
  Description of Artificial Sequence: Synthetic peptide
  Seed: MNVINTYTGY (MAGC3_HUMAN)
MPVINTYTGM

SEQ ID NO: 98155 - protein, 9 aa, Artificial Sequence
  Description of Artificial Sequence: Synthetic peptide
  Seed: SLPESEPLF (MAGC3_HUMAN)
SLPESEPLL

SEQ ID NO: 98156 - protein, 9 aa, Artificial Sequence
  Description of Artificial Sequence: Synthetic peptide
  Seed: ATYALSPVV (MAGC3_HUMAN)
ATYALSPVK

SEQ ID NO: 98157 - protein, 10 aa, Artificial Sequence
  Description of Artificial Sequence: Synthetic peptide
  Seed: YALSPVVLPP (MAGC3_HUMAN)
YLLSPVVLPT

SEQ ID NO: 98158 - protein, 10 aa, Artificial Sequence
  Description of Artificial Sequence: Synthetic peptide
  Seed: AEMQMNVINT (MAGC3_HUMAN)
AEMQMNVINV

SEQ ID NO: 98159 - protein, 10 aa, Artificial Sequence
  Description of Artificial Sequence: Synthetic peptide
  Seed: DMDPDNHSYF (MAGC3_HUMAN)
DTDPDNHSYY

SEQ ID NO: 98160 - protein, 11 aa, Artificial Sequence
  Description of Artificial Sequence: Synthetic peptide
  Seed: KVAELVQFLLL (MAGC3_HUMAN)
KMAELVQFLLY

SEQ ID NO: 98161 - protein, 11 aa, Artificial Sequence
  Description of Artificial Sequence: Synthetic peptide
  Seed: ALWESEGPEAF (MAGC3_HUMAN)
AMWESEGPEAR

SEQ ID NO: 98162 - protein, 10 aa, Artificial Sequence
  Description of Artificial Sequence: Synthetic peptide
  Seed: TGYFPMIFRK (MAGC3_HUMAN)
TAYFPMIFRC

SEQ ID NO: 98163 - protein, 10 aa, Artificial Sequence
  Description of Artificial Sequence: Synthetic peptide
  Seed: FFEDTLDLTY (MAGC3_HUMAN)
FYEDTLDLTM

SEQ ID NO: 98164 - protein, 10 aa, Artificial Sequence
  Description of Artificial Sequence: Synthetic peptide
  Seed: EMQMNVINTY (MAGC3_HUMAN)
EHQMNVINTY

SEQ ID NO: 98165 - protein, 9 aa, Artificial Sequence
  Description of Artificial Sequence: Synthetic peptide
  Seed: KAHEFIELI (MAGC3_HUMAN)
KTHEFIELM

SEQ ID NO: 98166 - protein, 9 aa, Artificial Sequence
  Description of Artificial Sequence: Synthetic peptide
  Seed: ALDEKVAEL (MAGC3_HUMAN)
APDEKVAEM

SEQ ID NO: 98167 - protein, 9 aa, Artificial Sequence
  Description of Artificial Sequence: Synthetic peptide
  Seed: FSDGSLGQW (MAGC3_HUMAN)
FADGSLGQY

SEQ ID NO: 98168 - protein, 10 aa, Artificial Sequence
  Description of Artificial Sequence: Synthetic peptide
  Seed: REVRLFLRGG (MAGC3_HUMAN)
RPVRLFLRGA

SEQ ID NO: 98169 - protein, 9 aa, Artificial Sequence
  Description of Artificial Sequence: Synthetic peptide
  Seed: TRAEMQMNV (MAGC3_HUMAN)
TRAEMQMNI

SEQ ID NO: 98170 - protein, 9 aa, Artificial Sequence
  Description of Artificial Sequence: Synthetic peptide
  Seed: HSYFFEDTL (MAGC3_HUMAN)
HSYFFEDTY

SEQ ID NO: 98171 - protein, 10 aa, Artificial Sequence
  Description of Artificial Sequence: Synthetic peptide
  Seed: IELIFGIALT (MAGC3_HUMAN)
IRLIFGIALL

SEQ ID NO: 98172 - protein, 9 aa, Artificial Sequence
  Description of Artificial Sequence: Synthetic peptide
  Seed: DYFPMIFGK (MAGC3_HUMAN)
DWFPMIFGK

SEQ ID NO: 98173 - protein, 9 aa, Artificial Sequence
  Description of Artificial Sequence: Synthetic peptide
  Seed: QPQPRKKAT (MAGC3_HUMAN)
QLQPRKKAM

SEQ ID NO: 98174 - protein, 11 aa, Artificial Sequence
  Description of Artificial Sequence: Synthetic peptide
  Seed: DSCSSPLLWTR (MAGC3_HUMAN)
DVCSSPLLWTR

SEQ ID NO: 98175 - protein, 10 aa, Artificial Sequence
  Description of Artificial Sequence: Synthetic peptide
  Seed: SAFHLGHLRE (MAGC3_HUMAN)
STFHLGHLRG

SEQ ID NO: 98176 - protein, 9 aa, Artificial Sequence
  Description of Artificial Sequence: Synthetic peptide
  Seed: ALDEKVAEL (MAGC3_HUMAN)
AFDEKVAEW

SEQ ID NO: 98177 - protein, 9 aa, Artificial Sequence
  Description of Artificial Sequence: Synthetic peptide
  Seed: NAIGPWSAL (MAGC3_HUMAN)
NPIGPWSAY

SEQ ID NO: 98178 - protein, 9 aa, Artificial Sequence
  Description of Artificial Sequence: Synthetic peptide
  Seed: EVLEFLSKL (MAGC3_HUMAN)
ESLEFLSKL

SEQ ID NO: 98179 - protein, 10 aa, Artificial Sequence
  Description of Artificial Sequence: Synthetic peptide
  Seed: LIFGIALTDM (MAGC3_HUMAN)
LMFGIALTDM

SEQ ID NO: 98180 - protein, 9 aa, Artificial Sequence
  Description of Artificial Sequence: Synthetic peptide
  Seed: LIDDQGMPK (MAGC3_HUMAN)
LADDQGMPL

SEQ ID NO: 98181 - protein, 9 aa, Artificial Sequence
  Description of Artificial Sequence: Synthetic peptide
  Seed: WVKNTCATY (MAGC3_HUMAN)
WYKNTCATF

SEQ ID NO: 98182 - protein, 9 aa, Artificial Sequence
  Description of Artificial Sequence: Synthetic peptide
  Seed: FPMIFGKAH (MAGC3_HUMAN)
FPMIFGKAY

SEQ ID NO: 98183 - protein, 8 aa, Artificial Sequence
  Description of Artificial Sequence: Synthetic peptide
  Seed: FADVLSRL (MAGC3_HUMAN)
FFDVLSRI

SEQ ID NO: 98184 - protein, 9 aa, Artificial Sequence
  Description of Artificial Sequence: Synthetic peptide
  Seed: MLLPCHWVL (MAGC3_HUMAN)
MLLPCHWVR

SEQ ID NO: 98185 - protein, 9 aa, Artificial Sequence
  Description of Artificial Sequence: Synthetic peptide
  Seed: LILSVIFIK (MAGC3_HUMAN)
LVLSVIFIR

SEQ ID NO: 98186 - protein, 10 aa, Artificial Sequence
  Description of Artificial Sequence: Synthetic peptide
  Seed: IELIFGIALT (MAGC3_HUMAN)
IFLIFGIALI

SEQ ID NO: 98187 - protein, 9 aa, Artificial Sequence
  Description of Artificial Sequence: Synthetic peptide
  Seed: MIFGKAHEF (MAGC3_HUMAN)
MTFGKAHEF

SEQ ID NO: 98188 - protein, 11 aa, Artificial Sequence
  Description of Artificial Sequence: Synthetic peptide
  Seed: TLWKDSDLPTW (MAGC3_HUMAN)
TQWKDSDLPTW

SEQ ID NO: 98189 - protein, 10 aa, Artificial Sequence
  Description of Artificial Sequence: Synthetic peptide
  Seed: TLDEKVDKLV (MAGC3_HUMAN)
TTDEKVDKLL

SEQ ID NO: 98190 - protein, 9 aa, Artificial Sequence
  Description of Artificial Sequence: Synthetic peptide
  Seed: YALSPVVLP (MAGC3_HUMAN)
YTLSPVVLY

SEQ ID NO: 98191 - protein, 9 aa, Artificial Sequence
  Description of Artificial Sequence: Synthetic peptide
  Seed: KAHEFIELI (MAGC3_HUMAN)
KVHEFIELL

SEQ ID NO: 98192 - protein, 9 aa, Artificial Sequence
  Description of Artificial Sequence: Synthetic peptide
  Seed: LSSIIPSAF (MAGC3_HUMAN)
LASIIPSAY

SEQ ID NO: 98193 - protein, 9 aa, Artificial Sequence
  Description of Artificial Sequence: Synthetic peptide
  Seed: TYALSPVVL (MAGC3_HUMAN)
TWALSPVVL

SEQ ID NO: 98194 - protein, 9 aa, Artificial Sequence
  Description of Artificial Sequence: Synthetic peptide
  Seed: LSSIIPSAF (MAGC3_HUMAN)
LNSIIPSAF

SEQ ID NO: 98195 - protein, 9 aa, Artificial Sequence
  Description of Artificial Sequence: Synthetic peptide
  Seed: HALPESESL (MAGC3_HUMAN)
HTLPESESV

SEQ ID NO: 98196 - protein, 9 aa, Artificial Sequence
  Description of Artificial Sequence: Synthetic peptide
  Seed: LTEVDPDHF (MAGC3_HUMAN)
LVEVDPDHL

SEQ ID NO: 98197 - protein, 10 aa, Artificial Sequence
  Description of Artificial Sequence: Synthetic peptide
  Seed: TGYFPMIFRK (MAGC3_HUMAN)
TVYFPMIFRF

SEQ ID NO: 98198 - protein, 9 aa, Artificial Sequence
  Description of Artificial Sequence: Synthetic peptide
  Seed: FEDTLDLTY (MAGC3_HUMAN)
FSDTLDLTF

SEQ ID NO: 98199 - protein, 9 aa, Artificial Sequence
  Description of Artificial Sequence: Synthetic peptide
  Seed: GSCVPEEVI (MAGC3_HUMAN)
GTCVPEEVW

SEQ ID NO: 98200 - protein, 9 aa, Artificial Sequence
  Description of Artificial Sequence: Synthetic peptide
  Seed: LTEVDPDHF (MAGC3_HUMAN)
LIEVDPDHL

SEQ ID NO: 98201 - protein, 10 aa, Artificial Sequence
  Description of Artificial Sequence: Synthetic peptide
  Seed: LDLTYEGSLI (MAGC3_HUMAN)
LMLTYEGSLV

SEQ ID NO: 98202 - protein, 10 aa, Artificial Sequence
  Description of Artificial Sequence: Synthetic peptide
  Seed: FADVLSRLAL (MAGC3_HUMAN)
FSDVLSRLAL

SEQ ID NO: 98203 - protein, 10 aa, Artificial Sequence
  Description of Artificial Sequence: Synthetic peptide
  Seed: PTYFKLWRTL (MAGC3_HUMAN)
PFYFKLWRTF

SEQ ID NO: 98204 - protein, 9 aa, Artificial Sequence
  Description of Artificial Sequence: Synthetic peptide
  Seed: KNCLLILIL (MAGC3_HUMAN)
KACLLILIV

SEQ ID NO: 98205 - protein, 9 aa, Artificial Sequence
  Description of Artificial Sequence: Synthetic peptide
  Seed: HALPESESL (MAGC3_HUMAN)
HLLPESESL

SEQ ID NO: 98206 - protein, 10 aa, Artificial Sequence
  Description of Artificial Sequence: Synthetic peptide
  Seed: FSLRRAVSVK (MAGC3_HUMAN)
FTLRRAVSVR

SEQ ID NO: 98207 - protein, 9 aa, Artificial Sequence
  Description of Artificial Sequence: Synthetic peptide
  Seed: LSDEQGMPQ (MAGC3_HUMAN)
LWDEQGMPM

SEQ ID NO: 98208 - protein, 11 aa, Artificial Sequence
  Description of Artificial Sequence: Synthetic peptide
  Seed: EILFGISLTEV (MAGC3_HUMAN)
EALFGISLTEV

SEQ ID NO: 98209 - protein, 10 aa, Artificial Sequence
  Description of Artificial Sequence: Synthetic peptide
  Seed: MNVINTYTGY (MAGC3_HUMAN)
MIVINTYTGK

SEQ ID NO: 98210 - protein, 9 aa, Artificial Sequence
  Description of Artificial Sequence: Synthetic peptide
  Seed: IPPQGPPKI (MAGC3_HUMAN)
IVPQGPPKI

SEQ ID NO: 98211 - protein, 9 aa, Artificial Sequence
  Description of Artificial Sequence: Synthetic peptide
  Seed: LANPQGLAG (MAGC3_HUMAN)
LANPQGLAF

SEQ ID NO: 98212 - protein, 9 aa, Artificial Sequence
  Description of Artificial Sequence: Synthetic peptide
  Seed: GLQLSDLHF (MAGC3_HUMAN)
GQQLSDLHL

SEQ ID NO: 98213 - protein, 9 aa, Artificial Sequence
  Description of Artificial Sequence: Synthetic peptide
  Seed: VIWEVLSAI (MAGC3_HUMAN)
VIWEVLSAY

SEQ ID NO: 98214 - protein, 9 aa, Artificial Sequence
  Description of Artificial Sequence: Synthetic peptide
  Seed: GPWSALAGF (MAGC3_HUMAN)
GAWSALAGF

SEQ ID NO: 98215 - protein, 9 aa, Artificial Sequence
  Description of Artificial Sequence: Synthetic peptide
  Seed: GKAHEFIEL (MAGC3_HUMAN)
GRAHEFIEF

SEQ ID NO: 98216 - protein, 9 aa, Artificial Sequence
  Description of Artificial Sequence: Synthetic peptide
  Seed: MQMNVINTY (MAGC3_HUMAN)
MWMNVINTM

SEQ ID NO: 98217 - protein, 10 aa, Artificial Sequence
  Description of Artificial Sequence: Synthetic peptide
  Seed: TLWKDSDLPT (MAGC3_HUMAN)
TLWKDSDLPI

SEQ ID NO: 98218 - protein, 9 aa, Artificial Sequence
  Description of Artificial Sequence: Synthetic peptide
  Seed: LILILSVIF (MAGC3_HUMAN)
LMLILSVIY

SEQ ID NO: 98219 - protein, 10 aa, Artificial Sequence
  Description of Artificial Sequence: Synthetic peptide
  Seed: NTYTGYFPMI (MAGC3_HUMAN)
NNYTGYFPMF

SEQ ID NO: 98220 - protein, 10 aa, Artificial Sequence
  Description of Artificial Sequence: Synthetic peptide
  Seed: YTGYFPMIFR (MAGC3_HUMAN)
YKGYFPMIFR

SEQ ID NO: 98221 - protein, 9 aa, Artificial Sequence
  Description of Artificial Sequence: Synthetic peptide
  Seed: IPSAFPSWY (MAGC3_HUMAN)
IASAFPSWY

SEQ ID NO: 98222 - protein, 10 aa, Artificial Sequence
  Description of Artificial Sequence: Synthetic peptide
  Seed: IPSAFPSWYM (MAGC3_HUMAN)
IISAFPSWYW

SEQ ID NO: 98223 - protein, 9 aa, Artificial Sequence
  Description of Artificial Sequence: Synthetic peptide
  Seed: YSAFHLGHL (MAGC3_HUMAN)
YMAFHLGHT

SEQ ID NO: 98224 - protein, 10 aa, Artificial Sequence
  Description of Artificial Sequence: Synthetic peptide
  Seed: MDPDNHSYFF (MAGC3_HUMAN)
MIPDNHSYFL

SEQ ID NO: 98225 - protein, 10 aa, Artificial Sequence
  Description of Artificial Sequence: Synthetic peptide
  Seed: KVAELVQFLL (MAGC3_HUMAN)
KLAELVQFLQ

SEQ ID NO: 98226 - protein, 10 aa, Artificial Sequence
  Description of Artificial Sequence: Synthetic peptide
  Seed: FSDGSLGQWV (MAGC3_HUMAN)
FIDGSLGQWL

SEQ ID NO: 98227 - protein, 9 aa, Artificial Sequence
  Description of Artificial Sequence: Synthetic peptide
  Seed: NTYTGYFPM (MAGC3_HUMAN)
NLYTGYFPI

SEQ ID NO: 98228 - protein, 9 aa, Artificial Sequence
  Description of Artificial Sequence: Synthetic peptide
  Seed: FFEDTLDLT (MAGC3_HUMAN)
FFEDTLDLL

SEQ ID NO: 98229 - protein, 10 aa, Artificial Sequence
  Description of Artificial Sequence: Synthetic peptide
  Seed: EKVAELVQFL (MAGC3_HUMAN)
ESVAELVQFA

SEQ ID NO: 98230 - protein, 9 aa, Artificial Sequence
  Description of Artificial Sequence: Synthetic peptide
  Seed: YKDYFPMIF (MAGC3_HUMAN)
YWDYFPMII

SEQ ID NO: 98231 - protein, 9 aa, Artificial Sequence
  Description of Artificial Sequence: Synthetic peptide
  Seed: EAFCEESGL (MAGC3_HUMAN)
ETFCEESGI

SEQ ID NO: 98232 - protein, 9 aa, Artificial Sequence
  Description of Artificial Sequence: Synthetic peptide
  Seed: IELIFGIAL (MAGC3_HUMAN)
IELIFGIAY

SEQ ID NO: 98233 - protein, 10 aa, Artificial Sequence
  Description of Artificial Sequence: Synthetic peptide
  Seed: KDYFPMIFGK (MAGC3_HUMAN)
KQYFPMIFGK

SEQ ID NO: 98234 - protein, 9 aa, Artificial Sequence
  Description of Artificial Sequence: Synthetic peptide
  Seed: MIFGKAHEF (MAGC3_HUMAN)
MGFGKAHEY

SEQ ID NO: 98235 - protein, 10 aa, Artificial Sequence
  Description of Artificial Sequence: Synthetic peptide
  Seed: LDSCSSPLLW (MAGC3_HUMAN)
LQSCSSPLLW

SEQ ID NO: 98236 - protein, 10 aa, Artificial Sequence
  Description of Artificial Sequence: Synthetic peptide
  Seed: MQMNVINTYT (MAGC3_HUMAN)
MVMNVINTYA

SEQ ID NO: 98237 - protein, 9 aa, Artificial Sequence
  Description of Artificial Sequence: Synthetic peptide
  Seed: DEQGMPQNR (MAGC3_HUMAN)
DTQGMPQNR

SEQ ID NO: 98238 - protein, 10 aa, Artificial Sequence
  Description of Artificial Sequence: Synthetic peptide
  Seed: FKLWRTLSGS (MAGC3_HUMAN)
FNLWRTLSGV

SEQ ID NO: 98239 - protein, 10 aa, Artificial Sequence
  Description of Artificial Sequence: Synthetic peptide
  Seed: MPAAGMPPLP (MAGC3_HUMAN)
MSAAGMPPLY

SEQ ID NO: 98240 - protein, 9 aa, Artificial Sequence
  Description of Artificial Sequence: Synthetic peptide
  Seed: LPQSPPEIP (MAGC3_HUMAN)
LPQSPPEIF

SEQ ID NO: 98241 - protein, 10 aa, Artificial Sequence
  Description of Artificial Sequence: Synthetic peptide
  Seed: LDSCSSPLLW (MAGC3_HUMAN)
LTSCSSPLLM

SEQ ID NO: 98242 - protein, 9 aa, Artificial Sequence
  Description of Artificial Sequence: Synthetic peptide
  Seed: MLLPCHWVL (MAGC3_HUMAN)
MSLPCHWVM

SEQ ID NO: 98243 - protein, 9 aa, Artificial Sequence
  Description of Artificial Sequence: Synthetic peptide
  Seed: EKVDKLVQF (MAGC3_HUMAN)
EQVDKLVQM

SEQ ID NO: 98244 - protein, 9 aa, Artificial Sequence
  Description of Artificial Sequence: Synthetic peptide
  Seed: SALAGFADV (MAGC3_HUMAN)
SILAGFADV

SEQ ID NO: 98245 - protein, 9 aa, Artificial Sequence
  Description of Artificial Sequence: Synthetic peptide
  Seed: FPSWYMDAL (MAGC3_HUMAN)
FRSWYMDAM

SEQ ID NO: 98246 - protein, 9 aa, Artificial Sequence
  Description of Artificial Sequence: Synthetic peptide
  Seed: HSYFFEDTL (MAGC3_HUMAN)
HEYFFEDTV

SEQ ID NO: 98247 - protein, 9 aa, Artificial Sequence
  Description of Artificial Sequence: Synthetic peptide
  Seed: TYFKLWRTL (MAGC3_HUMAN)
TRFKLWRTL

SEQ ID NO: 98248 - protein, 9 aa, Artificial Sequence
  Description of Artificial Sequence: Synthetic peptide
  Seed: YQAKEPLTR (MAGC3_HUMAN)
YTAKEPLTY

SEQ ID NO: 98249 - protein, 10 aa, Artificial Sequence
  Description of Artificial Sequence: Synthetic peptide
  Seed: EAFCEESGLR (MAGC3_HUMAN)
ETFCEESGLR

SEQ ID NO: 98250 - protein, 10 aa, Artificial Sequence
  Description of Artificial Sequence: Synthetic peptide
  Seed: CASEEVIWEV (MAGC3_HUMAN)
CMSEEVIWEI

SEQ ID NO: 98251 - protein, 10 aa, Artificial Sequence
  Description of Artificial Sequence: Synthetic peptide
  Seed: DMPAAGMPPL (MAGC3_HUMAN)
DYPAAGMPPM

SEQ ID NO: 98252 - protein, 9 aa, Artificial Sequence
  Description of Artificial Sequence: Synthetic peptide
  Seed: HALPESESL (MAGC3_HUMAN)
HLLPESESW

SEQ ID NO: 98253 - protein, 10 aa, Artificial Sequence
  Description of Artificial Sequence: Synthetic peptide
  Seed: YALSPVVLPP (MAGC3_HUMAN)
YQLSPVVLPV

SEQ ID NO: 98254 - protein, 10 aa, Artificial Sequence
  Description of Artificial Sequence: Synthetic peptide
  Seed: IIDTTDDATA (MAGC3_HUMAN)
ITDTTDDATF

SEQ ID NO: 98255 - protein, 10 aa, Artificial Sequence
  Description of Artificial Sequence: Synthetic peptide
  Seed: MNVINTYTGY (MAGC3_HUMAN)
MWVINTYTGK

SEQ ID NO: 98256 - protein, 9 aa, Artificial Sequence
  Description of Artificial Sequence: Synthetic peptide
  Seed: VDPDHFYVF (MAGC3_HUMAN)
VSPDHFYVI

SEQ ID NO: 98257 - protein, 11 aa, Artificial Sequence
  Description of Artificial Sequence: Synthetic peptide
  Seed: SIIPSAFPSWY (MAGC3_HUMAN)
SIIPSAFPSWK

SEQ ID NO: 98258 - protein, 9 aa, Artificial Sequence
  Description of Artificial Sequence: Synthetic peptide
  Seed: LILSMIFIK (MAGC3_HUMAN)
LQLSMIFIK

SEQ ID NO: 98259 - protein, 11 aa, Artificial Sequence
  Description of Artificial Sequence: Synthetic peptide
  Seed: KGSCVPEEVIW (MAGC3_HUMAN)
KISCVPEEVIW

SEQ ID NO: 98260 - protein, 9 aa, Artificial Sequence
  Description of Artificial Sequence: Synthetic peptide
  Seed: NTYTGYFPM (MAGC3_HUMAN)
NSYTGYFPM

SEQ ID NO: 98261 - protein, 10 aa, Artificial Sequence
  Description of Artificial Sequence: Synthetic peptide
  Seed: TGYFPMIFRK (MAGC3_HUMAN)
TTYFPMIFRT

SEQ ID NO: 98262 - protein, 9 aa, Artificial Sequence
  Description of Artificial Sequence: Synthetic peptide
  Seed: TYALSPVVL (MAGC3_HUMAN)
TWALSPVVW

SEQ ID NO: 98263 - protein, 9 aa, Artificial Sequence
  Description of Artificial Sequence: Synthetic peptide
  Seed: KGSCVPEEV (MAGC3_HUMAN)
KTSCVPEEM

SEQ ID NO: 98264 - protein, 11 aa, Artificial Sequence
  Description of Artificial Sequence: Synthetic peptide
  Seed: ATFSDGSLGQW (MAGC3_HUMAN)
AMFSDGSLGQW

SEQ ID NO: 98265 - protein, 9 aa, Artificial Sequence
  Description of Artificial Sequence: Synthetic peptide
  Seed: VDPDHFYVF (MAGC3_HUMAN)
VQPDHFYVY

SEQ ID NO: 98266 - protein, 10 aa, Artificial Sequence
  Description of Artificial Sequence: Synthetic peptide
  Seed: SAFHLGHLRE (MAGC3_HUMAN)
STFHLGHLRQ

SEQ ID NO: 98267 - protein, 8 aa, Artificial Sequence
  Description of Artificial Sequence: Synthetic peptide
  Seed: IQRPAREV (MAGC3_HUMAN)
IQRPAREY

SEQ ID NO: 98268 - protein, 9 aa, Artificial Sequence
  Description of Artificial Sequence: Synthetic peptide
  Seed: EVDPDHFYV (MAGC3_HUMAN)
EADPDHFYL

SEQ ID NO: 98269 - protein, 10 aa, Artificial Sequence
  Description of Artificial Sequence: Synthetic peptide
  Seed: TAMASASPSV (MAGC3_HUMAN)
TFMASASPSL

SEQ ID NO: 98270 - protein, 8 aa, Artificial Sequence
  Description of Artificial Sequence: Synthetic peptide
  Seed: MEDRAQAI (MAGC3_HUMAN)
MIDRAQAV

SEQ ID NO: 98271 - protein, 9 aa, Artificial Sequence
  Description of Artificial Sequence: Synthetic peptide
  Seed: QPEGKFSLR (MAGC3_HUMAN)
QIEGKFSLR

SEQ ID NO: 98272 - protein, 10 aa, Artificial Sequence
  Description of Artificial Sequence: Synthetic peptide
  Seed: YALDEKVAEL (MAGC3_HUMAN)
YILDEKVAEV

SEQ ID NO: 98273 - protein, 10 aa, Artificial Sequence
  Description of Artificial Sequence: Synthetic peptide
  Seed: SDQRMDSLVL (MAGC3_HUMAN)
SPQRMDSLVM

SEQ ID NO: 98274 - protein, 9 aa, Artificial Sequence
  Description of Artificial Sequence: Synthetic peptide
  Seed: IFGKAHEFI (MAGC3_HUMAN)
IWGKAHEFL

SEQ ID NO: 98275 - protein, 10 aa, Artificial Sequence
  Description of Artificial Sequence: Synthetic peptide
  Seed: TDMDPDNHSY (MAGC3_HUMAN)
TAMDPDNHSY

SEQ ID NO: 98276 - protein, 9 aa, Artificial Sequence
  Description of Artificial Sequence: Synthetic peptide
  Seed: KAEMLTTVI (MAGC3_HUMAN)
KTEMLTTVF

SEQ ID NO: 98277 - protein, 11 aa, Artificial Sequence
  Description of Artificial Sequence: Synthetic peptide
  Seed: KVAELVQFLLL (MAGC3_HUMAN)
KLAELVQFLLE

SEQ ID NO: 98278 - protein, 9 aa, Artificial Sequence
  Description of Artificial Sequence: Synthetic peptide
  Seed: LKYQAKEPL (MAGC3_HUMAN)
LMYQAKEPF

SEQ ID NO: 98279 - protein, 9 aa, Artificial Sequence
  Description of Artificial Sequence: Synthetic peptide
  Seed: YSAFHLGHL (MAGC3_HUMAN)
YYAFHLGHY

SEQ ID NO: 98280 - protein, 9 aa, Artificial Sequence
  Description of Artificial Sequence: Synthetic peptide
  Seed: SLRRAVSVK (MAGC3_HUMAN)
SSRRAVSVA

SEQ ID NO: 98281 - protein, 10 aa, Artificial Sequence
  Description of Artificial Sequence: Synthetic peptide
  Seed: FKLWRTLSGS (MAGC3_HUMAN)
FYLWRTLSGA

SEQ ID NO: 98282 - protein, 11 aa, Artificial Sequence
  Description of Artificial Sequence: Synthetic peptide
  Seed: MQMNVINTYTG (MAGC3_HUMAN)
MRMNVINTYTF

SEQ ID NO: 98283 - protein, 9 aa, Artificial Sequence
  Description of Artificial Sequence: Synthetic peptide
  Seed: LIDDQGMPK (MAGC3_HUMAN)
LYDDQGMPM

SEQ ID NO: 98284 - protein, 9 aa, Artificial Sequence
  Description of Artificial Sequence: Synthetic peptide
  Seed: YSAFHLGHL (MAGC3_HUMAN)
YSAFHLGHR

SEQ ID NO: 98285 - protein, 9 aa, Artificial Sequence
  Description of Artificial Sequence: Synthetic peptide
  Seed: SLVLCPTYF (MAGC3_HUMAN)
SHVLCPTYF

SEQ ID NO: 98286 - protein, 9 aa, Artificial Sequence
  Description of Artificial Sequence: Synthetic peptide
  Seed: VLCPTYFKL (MAGC3_HUMAN)
VMCPTYFKM

SEQ ID NO: 98287 - protein, 10 aa, Artificial Sequence
  Description of Artificial Sequence: Synthetic peptide
  Seed: KDYFPMIFGK (MAGC3_HUMAN)
KIYFPMIFGK

SEQ ID NO: 98288 - protein, 9 aa, Artificial Sequence
  Description of Artificial Sequence: Synthetic peptide
  Seed: SPQGPPQSP (MAGC3_HUMAN)
SAQGPPQSF

SEQ ID NO: 98289 - protein, 9 aa, Artificial Sequence
  Description of Artificial Sequence: Synthetic peptide
  Seed: DMDPDNHSY (MAGC3_HUMAN)
DMDPDNHSM

SEQ ID NO: 98290 - protein, 9 aa, Artificial Sequence
  Description of Artificial Sequence: Synthetic peptide
  Seed: NAIGPWSAL (MAGC3_HUMAN)
NKIGPWSAF

SEQ ID NO: 98291 - protein, 9 aa, Artificial Sequence
  Description of Artificial Sequence: Synthetic peptide
  Seed: TLDEKVDKL (MAGC3_HUMAN)
TTDEKVDKM

SEQ ID NO: 98292 - protein, 9 aa, Artificial Sequence
  Description of Artificial Sequence: Synthetic peptide
  Seed: VINTYTGYF (MAGC3_HUMAN)
VINTYTGYW

SEQ ID NO: 98293 - protein, 10 aa, Artificial Sequence
  Description of Artificial Sequence: Synthetic peptide
  Seed: YTLDEKVDKL (MAGC3_HUMAN)
YPLDEKVDKL

SEQ ID NO: 98294 - protein, 9 aa, Artificial Sequence
  Description of Artificial Sequence: Synthetic peptide
  Seed: WRRGTGYTL (MAGC3_HUMAN)
WFRGTGYTY

SEQ ID NO: 98295 - protein, 10 aa, Artificial Sequence
  Description of Artificial Sequence: Synthetic peptide
  Seed: SQPEGKFSLR (MAGC3_HUMAN)
SYPEGKFSLR

SEQ ID NO: 98296 - protein, 9 aa, Artificial Sequence
  Description of Artificial Sequence: Synthetic peptide
  Seed: LTEASPQQK (MAGC3_HUMAN)
LSEASPQQY

SEQ ID NO: 98297 - protein, 11 aa, Artificial Sequence
  Description of Artificial Sequence: Synthetic peptide
  Seed: TYTGYFPMIFR (MAGC3_HUMAN)
TSTGYFPMIFR

SEQ ID NO: 98298 - protein, 9 aa, Artificial Sequence
  Description of Artificial Sequence: Synthetic peptide
  Seed: SLPESEPLF (MAGC3_HUMAN)
SYPESEPLW

SEQ ID NO: 98299 - protein, 11 aa, Artificial Sequence
  Description of Artificial Sequence: Synthetic peptide
  Seed: SKLSSIIPSAF (MAGC3_HUMAN)
SMLSSIIPSAF

SEQ ID NO: 98300 - protein, 11 aa, Artificial Sequence
  Description of Artificial Sequence: Synthetic peptide
  Seed: EPQDWPLNEKR (MAGC3_HUMAN)
ETQDWPLNEKR

SEQ ID NO: 98301 - protein, 11 aa, Artificial Sequence
  Description of Artificial Sequence: Synthetic peptide
  Seed: AEMQMNVINTY (MAGC3_HUMAN)
AWMQMNVINTY

SEQ ID NO: 98302 - protein, 11 aa, Artificial Sequence
  Description of Artificial Sequence: Synthetic peptide
  Seed: KKYKDYFPMIF (MAGC3_HUMAN)
KYYKDYFPMIL

SEQ ID NO: 98303 - protein, 11 aa, Artificial Sequence
  Description of Artificial Sequence: Synthetic peptide
  Seed: LTDMDPDNHSY (MAGC3_HUMAN)
LADMDPDNHSW

SEQ ID NO: 98304 - protein, 9 aa, Artificial Sequence
  Description of Artificial Sequence: Synthetic peptide
  Seed: HFYVFVNTL (MAGC3_HUMAN)
HYYVFVNTY

SEQ ID NO: 98305 - protein, 10 aa, Artificial Sequence
  Description of Artificial Sequence: Synthetic peptide
  Seed: ASEEVIWEVL (MAGC3_HUMAN)
AEEEVIWEVL

SEQ ID NO: 98306 - protein, 9 aa, Artificial Sequence
  Description of Artificial Sequence: Synthetic peptide
  Seed: SLVLCPTYF (MAGC3_HUMAN)
SYVLCPTYM

SEQ ID NO: 98307 - protein, 9 aa, Artificial Sequence
  Description of Artificial Sequence: Synthetic peptide
  Seed: KYKDYFPMI (MAGC3_HUMAN)
KLKDYFPMA

SEQ ID NO: 98308 - protein, 9 aa, Artificial Sequence
  Description of Artificial Sequence: Synthetic peptide
  Seed: RPAREVLEF (MAGC3_HUMAN)
RIAREVLEF

SEQ ID NO: 98309 - protein, 10 aa, Artificial Sequence
  Description of Artificial Sequence: Synthetic peptide
  Seed: YTGYFPMIFR (MAGC3_HUMAN)
YVGYFPMIFR

SEQ ID NO: 98310 - protein, 9 aa, Artificial Sequence
  Description of Artificial Sequence: Synthetic peptide
  Seed: SAFHLGHLR (MAGC3_HUMAN)
SNFHLGHLK

SEQ ID NO: 98311 - protein, 9 aa, Artificial Sequence
  Description of Artificial Sequence: Synthetic peptide
  Seed: TKAEMLTTV (MAGC3_HUMAN)
TRAEMLTTY

SEQ ID NO: 98312 - protein, 9 aa, Artificial Sequence
  Description of Artificial Sequence: Synthetic peptide
  Seed: TGYFPMIFR (MAGC3_HUMAN)
TLYFPMIFR

SEQ ID NO: 98313 - protein, 9 aa, Artificial Sequence
  Description of Artificial Sequence: Synthetic peptide
  Seed: MPKNCLLIL (MAGC3_HUMAN)
MIKNCLLIY

SEQ ID NO: 98314 - protein, 9 aa, Artificial Sequence
  Description of Artificial Sequence: Synthetic peptide
  Seed: KEPVTKAEM (MAGC3_HUMAN)
KIPVTKAEY

SEQ ID NO: 98315 - protein, 11 aa, Artificial Sequence
  Description of Artificial Sequence: Synthetic peptide
  Seed: LDSCSSPLLWT (MAGC3_HUMAN)
LASCSSPLLWW

SEQ ID NO: 98316 - protein, 9 aa, Artificial Sequence
  Description of Artificial Sequence: Synthetic peptide
  Seed: KLVQFLLLK (MAGC3_HUMAN)
KTVQFLLLV

SEQ ID NO: 98317 - protein, 11 aa, Artificial Sequence
  Description of Artificial Sequence: Synthetic peptide
  Seed: SSSEEEDTATW (MAGC3_HUMAN)
SSSEEEDTATF

SEQ ID NO: 98318 - protein, 10 aa, Artificial Sequence
  Description of Artificial Sequence: Synthetic peptide
  Seed: SAFHLGHLRE (MAGC3_HUMAN)
SLFHLGHLRR

SEQ ID NO: 98319 - protein, 9 aa, Artificial Sequence
  Description of Artificial Sequence: Synthetic peptide
  Seed: VIWEVLNAI (MAGC3_HUMAN)
VPWEVLNAI

SEQ ID NO: 98320 - protein, 9 aa, Artificial Sequence
  Description of Artificial Sequence: Synthetic peptide
  Seed: VLCPTYFKL (MAGC3_HUMAN)
VSCPTYFKR

SEQ ID NO: 98321 - protein, 9 aa, Artificial Sequence
  Description of Artificial Sequence: Synthetic peptide
  Seed: ALAGFADVL (MAGC3_HUMAN)
AMAGFADVV

SEQ ID NO: 98322 - protein, 10 aa, Artificial Sequence
  Description of Artificial Sequence: Synthetic peptide
  Seed: KLSSIIPSAF (MAGC3_HUMAN)
KISSIIPSAK

SEQ ID NO: 98323 - protein, 9 aa, Artificial Sequence
  Description of Artificial Sequence: Synthetic peptide
  Seed: YALDEKVAE (MAGC3_HUMAN)
YALDEKVAV

SEQ ID NO: 98324 - protein, 10 aa, Artificial Sequence
  Description of Artificial Sequence: Synthetic peptide
  Seed: SCSSPLLWTR (MAGC3_HUMAN)
SASSPLLWTK

SEQ ID NO: 98325 - protein, 9 aa, Artificial Sequence
  Description of Artificial Sequence: Synthetic peptide
  Seed: WVKNTCATY (MAGC3_HUMAN)
WQKNTCATL

SEQ ID NO: 98326 - protein, 9 aa, Artificial Sequence
  Description of Artificial Sequence: Synthetic peptide
  Seed: LEFLSKLSS (MAGC3_HUMAN)
LEFLSKLSV

SEQ ID NO: 98327 - protein, 10 aa, Artificial Sequence
  Description of Artificial Sequence: Synthetic peptide
  Seed: REVLEFLSKL (MAGC3_HUMAN)
RQVLEFLSKI

SEQ ID NO: 98328 - protein, 10 aa, Artificial Sequence
  Description of Artificial Sequence: Synthetic peptide
  Seed: YALSPVVLPP (MAGC3_HUMAN)
YELSPVVLPI

SEQ ID NO: 98329 - protein, 9 aa, Artificial Sequence
  Description of Artificial Sequence: Synthetic peptide
  Seed: NAIGPWSAL (MAGC3_HUMAN)
NYIGPWSAI

SEQ ID NO: 98330 - protein, 11 aa, Artificial Sequence
  Description of Artificial Sequence: Synthetic peptide
  Seed: FLSKLSSIIPS (MAGC3_HUMAN)
FISKLSSIIPL

SEQ ID NO: 98331 - protein, 10 aa, Artificial Sequence
  Description of Artificial Sequence: Synthetic peptide
  Seed: LTEVDPDHFY (MAGC3_HUMAN)
LSEVDPDHFY

SEQ ID NO: 98332 - protein, 9 aa, Artificial Sequence
  Description of Artificial Sequence: Synthetic peptide
  Seed: KYKDYFPMI (MAGC3_HUMAN)
KLKDYFPML

SEQ ID NO: 98333 - protein, 10 aa, Artificial Sequence
  Description of Artificial Sequence: Synthetic peptide
  Seed: MQMNVINTYT (MAGC3_HUMAN)
MLMNVINTYY

SEQ ID NO: 98334 - protein, 10 aa, Artificial Sequence
  Description of Artificial Sequence: Synthetic peptide
  Seed: TAMASASPSV (MAGC3_HUMAN)
TAMASASPSL

SEQ ID NO: 98335 - protein, 9 aa, Artificial Sequence
  Description of Artificial Sequence: Synthetic peptide
  Seed: IPPQGPPKI (MAGC3_HUMAN)
ILPQGPPKI

SEQ ID NO: 98336 - protein, 9 aa, Artificial Sequence
  Description of Artificial Sequence: Synthetic peptide
  Seed: WRRGTGYTL (MAGC3_HUMAN)
WLRGTGYTM

SEQ ID NO: 98337 - protein, 10 aa, Artificial Sequence
  Description of Artificial Sequence: Synthetic peptide
  Seed: AELVQFLLLK (MAGC3_HUMAN)
AVLVQFLLLK

SEQ ID NO: 98338 - protein, 10 aa, Artificial Sequence
  Description of Artificial Sequence: Synthetic peptide
  Seed: YFPMIFRKAR (MAGC3_HUMAN)
YYPMIFRKAR

SEQ ID NO: 98339 - protein, 9 aa, Artificial Sequence
  Description of Artificial Sequence: Synthetic peptide
  Seed: TTDDATAMA (MAGC3_HUMAN)
TVDDATAMI

SEQ ID NO: 98340 - protein, 11 aa, Artificial Sequence
  Description of Artificial Sequence: Synthetic peptide
  Seed: TDMDPDNHSYF (MAGC3_HUMAN)
TVMDPDNHSYM

SEQ ID NO: 98341 - protein, 9 aa, Artificial Sequence
  Description of Artificial Sequence: Synthetic peptide
  Seed: LILSMIFIK (MAGC3_HUMAN)
LMLSMIFIR

SEQ ID NO: 98342 - protein, 10 aa, Artificial Sequence
  Description of Artificial Sequence: Synthetic peptide
  Seed: RPAREVLEFL (MAGC3_HUMAN)
RRAREVLEFK

SEQ ID NO: 98343 - protein, 9 aa, Artificial Sequence
  Description of Artificial Sequence: Synthetic peptide
  Seed: MIFGKAHEF (MAGC3_HUMAN)
MHFGKAHEL

SEQ ID NO: 98344 - protein, 9 aa, Artificial Sequence
  Description of Artificial Sequence: Synthetic peptide
  Seed: ATYALSPVV (MAGC3_HUMAN)
ALYALSPVF

SEQ ID NO: 98345 - protein, 10 aa, Artificial Sequence
  Description of Artificial Sequence: Synthetic peptide
  Seed: KLSSIIPSAF (MAGC3_HUMAN)
KSSSIIPSAY

SEQ ID NO: 98346 - protein, 8 aa, Artificial Sequence
  Description of Artificial Sequence: Synthetic peptide
  Seed: AEMLTTVI (MAGC3_HUMAN)
AEMLTTVV

SEQ ID NO: 98347 - protein, 10 aa, Artificial Sequence
  Description of Artificial Sequence: Synthetic peptide
  Seed: EVDPDHFYVF (MAGC3_HUMAN)
EMDPDHFYVY

SEQ ID NO: 98348 - protein, 9 aa, Artificial Sequence
  Description of Artificial Sequence: Synthetic peptide
  Seed: KVDKLVQFL (MAGC3_HUMAN)
KVDKLVQFW

SEQ ID NO: 98349 - protein, 10 aa, Artificial Sequence
  Description of Artificial Sequence: Synthetic peptide
  Seed: EVIWEVLSAI (MAGC3_HUMAN)
ENIWEVLSAV

SEQ ID NO: 98350 - protein, 10 aa, Artificial Sequence
  Description of Artificial Sequence: Synthetic peptide
  Seed: KLVQFLLLKY (MAGC3_HUMAN)
KAVQFLLLKK

SEQ ID NO: 98351 - protein, 9 aa, Artificial Sequence
  Description of Artificial Sequence: Synthetic peptide
  Seed: SLRRAVSVK (MAGC3_HUMAN)
STRRAVSVL

SEQ ID NO: 98352 - protein, 10 aa, Artificial Sequence
  Description of Artificial Sequence: Synthetic peptide
  Seed: IKKYKDYFPM (MAGC3_HUMAN)
IEKYKDYFPF

SEQ ID NO: 98353 - protein, 9 aa, Artificial Sequence
  Description of Artificial Sequence: Synthetic peptide
  Seed: YFFEDTLDL (MAGC3_HUMAN)
YVFEDTLDF

SEQ ID NO: 98354 - protein, 10 aa, Artificial Sequence
  Description of Artificial Sequence: Synthetic peptide
  Seed: EKVAELVQFL (MAGC3_HUMAN)
ELVAELVQFV

SEQ ID NO: 98355 - protein, 9 aa, Artificial Sequence
  Description of Artificial Sequence: Synthetic peptide
  Seed: QPQPRKKAT (MAGC3_HUMAN)
QPQPRKKAV

SEQ ID NO: 98356 - protein, 9 aa, Artificial Sequence
  Description of Artificial Sequence: Synthetic peptide
  Seed: YSAFHLGHL (MAGC3_HUMAN)
YYAFHLGHI

SEQ ID NO: 98357 - protein, 9 aa, Artificial Sequence
  Description of Artificial Sequence: Synthetic peptide
  Seed: FEDTLDLTY (MAGC3_HUMAN)
FTDTLDLTY

SEQ ID NO: 98358 - protein, 10 aa, Artificial Sequence
  Description of Artificial Sequence: Synthetic peptide
  Seed: WRTLSGSPGL (MAGC3_HUMAN)
WQTLSGSPGV

SEQ ID NO: 98359 - protein, 9 aa, Artificial Sequence
  Description of Artificial Sequence: Synthetic peptide
  Seed: YSAFHLGHL (MAGC3_HUMAN)
YVAFHLGHV

SEQ ID NO: 98360 - protein, 9 aa, Artificial Sequence
  Description of Artificial Sequence: Synthetic peptide
  Seed: FHLGHLREV (MAGC3_HUMAN)
FQLGHLREF

SEQ ID NO: 98361 - protein, 10 aa, Artificial Sequence
  Description of Artificial Sequence: Synthetic peptide
  Seed: INTYTGYFPM (MAGC3_HUMAN)
ISTYTGYFPF

SEQ ID NO: 98362 - protein, 9 aa, Artificial Sequence
  Description of Artificial Sequence: Synthetic peptide
  Seed: MEDRAQAII (MAGC3_HUMAN)
MLDRAQAIF

SEQ ID NO: 98363 - protein, 10 aa, Artificial Sequence
  Description of Artificial Sequence: Synthetic peptide
  Seed: MDSLVLCPTY (MAGC3_HUMAN)
MVSLVLCPTF

SEQ ID NO: 98364 - protein, 9 aa, Artificial Sequence
  Description of Artificial Sequence: Synthetic peptide
  Seed: YSAFHLGHL (MAGC3_HUMAN)
YYAFHLGHL

SEQ ID NO: 98365 - protein, 9 aa, Artificial Sequence
  Description of Artificial Sequence: Synthetic peptide
  Seed: ADVLSRLAL (MAGC3_HUMAN)
AEVLSRLAF

SEQ ID NO: 98366 - protein, 9 aa, Artificial Sequence
  Description of Artificial Sequence: Synthetic peptide
  Seed: TLDEKVDKL (MAGC3_HUMAN)
TMDEKVDKM

SEQ ID NO: 98367 - protein, 9 aa, Artificial Sequence
  Description of Artificial Sequence: Synthetic peptide
  Seed: HLREVRLFL (MAGC3_HUMAN)
HMREVRLFL

SEQ ID NO: 98368 - protein, 10 aa, Artificial Sequence
  Description of Artificial Sequence: Synthetic peptide
  Seed: AEMLTTVIKK (MAGC3_HUMAN)
ASMLTTVIKR

SEQ ID NO: 98369 - protein, 9 aa, Artificial Sequence
  Description of Artificial Sequence: Synthetic peptide
  Seed: LANPQGLAG (MAGC3_HUMAN)
LGNPQGLAF

SEQ ID NO: 98370 - protein, 11 aa, Artificial Sequence
  Description of Artificial Sequence: Synthetic peptide
  Seed: FIELIFGIALT (MAGC3_HUMAN)
FAELIFGIALL

SEQ ID NO: 98371 - protein, 9 aa, Artificial Sequence
  Description of Artificial Sequence: Synthetic peptide
  Seed: NAIGPWSAL (MAGC3_HUMAN)
NIIGPWSAF

SEQ ID NO: 98372 - protein, 9 aa, Artificial Sequence
  Description of Artificial Sequence: Synthetic peptide
  Seed: ALDEKVAEL (MAGC3_HUMAN)
AEDEKVAEF

SEQ ID NO: 98373 - protein, 10 aa, Artificial Sequence
  Description of Artificial Sequence: Synthetic peptide
  Seed: IELIFGIALT (MAGC3_HUMAN)
IYLIFGIALV

SEQ ID NO: 98374 - protein, 10 aa, Artificial Sequence
  Description of Artificial Sequence: Synthetic peptide
  Seed: SIIPSAFPSW (MAGC3_HUMAN)
SGIPSAFPSY

SEQ ID NO: 98375 - protein, 10 aa, Artificial Sequence
  Description of Artificial Sequence: Synthetic peptide
  Seed: YALSPVVLPP (MAGC3_HUMAN)
YMLSPVVLPL

SEQ ID NO: 98376 - protein, 9 aa, Artificial Sequence
  Description of Artificial Sequence: Synthetic peptide
  Seed: SIIPSAFPS (MAGC3_HUMAN)
SGIPSAFPV

SEQ ID NO: 98377 - protein, 9 aa, Artificial Sequence
  Description of Artificial Sequence: Synthetic peptide
  Seed: VIWEVLNAI (MAGC3_HUMAN)
VVWEVLNAA

SEQ ID NO: 98378 - protein, 8 aa, Artificial Sequence
  Description of Artificial Sequence: Synthetic peptide
  Seed: HEFIELIF (MAGC3_HUMAN)
HEFIELIL

SEQ ID NO: 98379 - protein, 9 aa, Artificial Sequence
  Description of Artificial Sequence: Synthetic peptide
  Seed: VLPPQPQPR (MAGC3_HUMAN)
VVPPQPQPM

SEQ ID NO: 98380 - protein, 9 aa, Artificial Sequence
  Description of Artificial Sequence: Synthetic peptide
  Seed: MIFRKAREF (MAGC3_HUMAN)
MQFRKAREW

SEQ ID NO: 98381 - protein, 10 aa, Artificial Sequence
  Description of Artificial Sequence: Synthetic peptide
  Seed: REVRLFLRGG (MAGC3_HUMAN)
RYVRLFLRGA

SEQ ID NO: 98382 - protein, 9 aa, Artificial Sequence
  Description of Artificial Sequence: Synthetic peptide
  Seed: YFFEDTLDL (MAGC3_HUMAN)
YMFEDTLDL

SEQ ID NO: 98383 - protein, 11 aa, Artificial Sequence
  Description of Artificial Sequence: Synthetic peptide
  Seed: RTLSGSPGLQL (MAGC3_HUMAN)
RMLSGSPGLQI

SEQ ID NO: 98384 - protein, 9 aa, Artificial Sequence
  Description of Artificial Sequence: Synthetic peptide
  Seed: LKYQAKEPL (MAGC3_HUMAN)
LSYQAKEPY

SEQ ID NO: 98385 - protein, 10 aa, Artificial Sequence
  Description of Artificial Sequence: Synthetic peptide
  Seed: SIIPSAFPSW (MAGC3_HUMAN)
SLIPSAFPSM

SEQ ID NO: 98386 - protein, 10 aa, Artificial Sequence
  Description of Artificial Sequence: Synthetic peptide
  Seed: SAFHLGHLRE (MAGC3_HUMAN)
STFHLGHLRP

SEQ ID NO: 98387 - protein, 9 aa, Artificial Sequence
  Description of Artificial Sequence: Synthetic peptide
  Seed: SLPESEPLF (MAGC3_HUMAN)
SWPESEPLF

SEQ ID NO: 98388 - protein, 9 aa, Artificial Sequence
  Description of Artificial Sequence: Synthetic peptide
  Seed: VIWEVLNAI (MAGC3_HUMAN)
VAWEVLNAI

SEQ ID NO: 98389 - protein, 10 aa, Artificial Sequence
  Description of Artificial Sequence: Synthetic peptide
  Seed: TLWKDSDLPT (MAGC3_HUMAN)
TIWKDSDLPV

SEQ ID NO: 98390 - protein, 9 aa, Artificial Sequence
  Description of Artificial Sequence: Synthetic peptide
  Seed: SQPEGKFSL (MAGC3_HUMAN)
SLPEGKFSR

SEQ ID NO: 98391 - protein, 9 aa, Artificial Sequence
  Description of Artificial Sequence: Synthetic peptide
  Seed: FEDTLDLTY (MAGC3_HUMAN)
FNDTLDLTY

SEQ ID NO: 98392 - protein, 10 aa, Artificial Sequence
  Description of Artificial Sequence: Synthetic peptide
  Seed: IIDTTDDATA (MAGC3_HUMAN)
IMDTTDDATF

SEQ ID NO: 98393 - protein, 8 aa, Artificial Sequence
  Description of Artificial Sequence: Synthetic peptide
  Seed: IFGKAHEF (MAGC3_HUMAN)
IAGKAHEI

SEQ ID NO: 98394 - protein, 10 aa, Artificial Sequence
  Description of Artificial Sequence: Synthetic peptide
  Seed: ALDEKVAELV (MAGC3_HUMAN)
AFDEKVAELF

SEQ ID NO: 98395 - protein, 9 aa, Artificial Sequence
  Description of Artificial Sequence: Synthetic peptide
  Seed: MIFGKAHEF (MAGC3_HUMAN)
MGFGKAHEL

SEQ ID NO: 98396 - protein, 10 aa, Artificial Sequence
  Description of Artificial Sequence: Synthetic peptide
  Seed: MLTTVIKKYK (MAGC3_HUMAN)
MQTTVIKKYK

SEQ ID NO: 98397 - protein, 9 aa, Artificial Sequence
  Description of Artificial Sequence: Synthetic peptide
  Seed: FGSQPEGKF (MAGC3_HUMAN)
FVSQPEGKL

SEQ ID NO: 98398 - protein, 10 aa, Artificial Sequence
  Description of Artificial Sequence: Synthetic peptide
  Seed: MPAAGMPPLP (MAGC3_HUMAN)
MPAAGMPPLN

SEQ ID NO: 98399 - protein, 9 aa, Artificial Sequence
  Description of Artificial Sequence: Synthetic peptide
  Seed: MIFGKAHEF (MAGC3_HUMAN)
MIFGKAHER

SEQ ID NO: 98400 - protein, 10 aa, Artificial Sequence
  Description of Artificial Sequence: Synthetic peptide
  Seed: MNVINTYTGY (MAGC3_HUMAN)
MFVINTYTGY

SEQ ID NO: 98401 - protein, 11 aa, Artificial Sequence
  Description of Artificial Sequence: Synthetic peptide
  Seed: YFFEDTLDLTY (MAGC3_HUMAN)
YQFEDTLDLTF

SEQ ID NO: 98402 - protein, 10 aa, Artificial Sequence
  Description of Artificial Sequence: Synthetic peptide
  Seed: KFSLRRAVSV (MAGC3_HUMAN)
KMSLRRAVSK

SEQ ID NO: 98403 - protein, 9 aa, Artificial Sequence
  Description of Artificial Sequence: Synthetic peptide
  Seed: RPAREVLEF (MAGC3_HUMAN)
RRAREVLEF

SEQ ID NO: 98404 - protein, 10 aa, Artificial Sequence
  Description of Artificial Sequence: Synthetic peptide
  Seed: ADVLSRLALW (MAGC3_HUMAN)
ASVLSRLALF

SEQ ID NO: 98405 - protein, 9 aa, Artificial Sequence
  Description of Artificial Sequence: Synthetic peptide
  Seed: LSGSPGLQL (MAGC3_HUMAN)
LAGSPGLQF

SEQ ID NO: 98406 - protein, 10 aa, Artificial Sequence
  Description of Artificial Sequence: Synthetic peptide
  Seed: ALDEKVAELV (MAGC3_HUMAN)
AGDEKVAELL

SEQ ID NO: 98407 - protein, 10 aa, Artificial Sequence
  Description of Artificial Sequence: Synthetic peptide
  Seed: AMASASPSVM (MAGC3_HUMAN)
AHASASPSVF

SEQ ID NO: 98408 - protein, 9 aa, Artificial Sequence
  Description of Artificial Sequence: Synthetic peptide
  Seed: AIIDTTDDA (MAGC3_HUMAN)
AIIDTTDDV

SEQ ID NO: 98409 - protein, 10 aa, Artificial Sequence
  Description of Artificial Sequence: Synthetic peptide
  Seed: FPSWYMDALK (MAGC3_HUMAN)
FSSWYMDALK

SEQ ID NO: 98410 - protein, 9 aa, Artificial Sequence
  Description of Artificial Sequence: Synthetic peptide
  Seed: ATYALSPVV (MAGC3_HUMAN)
AVYALSPVL

SEQ ID NO: 98411 - protein, 9 aa, Artificial Sequence
  Description of Artificial Sequence: Synthetic peptide
  Seed: FHLGHLREV (MAGC3_HUMAN)
FGLGHLREV

SEQ ID NO: 98412 - protein, 10 aa, Artificial Sequence
  Description of Artificial Sequence: Synthetic peptide
  Seed: PTYFKLWRTL (MAGC3_HUMAN)
PHYFKLWRTF

SEQ ID NO: 98413 - protein, 9 aa, Artificial Sequence
  Description of Artificial Sequence: Synthetic peptide
  Seed: FEDTLDLTY (MAGC3_HUMAN)
FYDTLDLTV

SEQ ID NO: 98414 - protein, 10 aa, Artificial Sequence
  Description of Artificial Sequence: Synthetic peptide
  Seed: SSEEEDTATW (MAGC3_HUMAN)
SMEEEDTATW

SEQ ID NO: 98415 - protein, 9 aa, Artificial Sequence
  Description of Artificial Sequence: Synthetic peptide
  Seed: TLDEKVDKL (MAGC3_HUMAN)
TCDEKVDKF

SEQ ID NO: 98416 - protein, 9 aa, Artificial Sequence
  Description of Artificial Sequence: Synthetic peptide
  Seed: TSDQRMDSL (MAGC3_HUMAN)
TYDQRMDSI

SEQ ID NO: 98417 - protein, 10 aa, Artificial Sequence
  Description of Artificial Sequence: Synthetic peptide
  Seed: MIFGKAHEFI (MAGC3_HUMAN)
MMFGKAHEFI

SEQ ID NO: 98418 - protein, 8 aa, Artificial Sequence
  Description of Artificial Sequence: Synthetic peptide
  Seed: KVDKLVQF (MAGC3_HUMAN)
KWDKLVQL

SEQ ID NO: 98419 - protein, 10 aa, Artificial Sequence
  Description of Artificial Sequence: Synthetic peptide
  Seed: LNAIGPWSAL (MAGC3_HUMAN)
LHAIGPWSAF

SEQ ID NO: 98420 - protein, 9 aa, Artificial Sequence
  Description of Artificial Sequence: Synthetic peptide
  Seed: FLSKLSSII (MAGC3_HUMAN)
FTSKLSSII

SEQ ID NO: 98421 - protein, 11 aa, Artificial Sequence
  Description of Artificial Sequence: Synthetic peptide
  Seed: SSSEEEDTATW (MAGC3_HUMAN)
SGSEEEDTATW

SEQ ID NO: 98422 - protein, 9 aa, Artificial Sequence
  Description of Artificial Sequence: Synthetic peptide
  Seed: LRSAEGSVL (MAGC3_HUMAN)
LQSAEGSVW

SEQ ID NO: 98423 - protein, 10 aa, Artificial Sequence
  Description of Artificial Sequence: Synthetic peptide
  Seed: TTDDATAMAS (MAGC3_HUMAN)
TYDDATAMAM

SEQ ID NO: 98424 - protein, 11 aa, Artificial Sequence
  Description of Artificial Sequence: Synthetic peptide
  Seed: FLSKLSSIIPS (MAGC3_HUMAN)
FLSKLSSIIPA

SEQ ID NO: 98425 - protein, 10 aa, Artificial Sequence
  Description of Artificial Sequence: Synthetic peptide
  Seed: SALAGFADVL (MAGC3_HUMAN)
SLLAGFADVL

SEQ ID NO: 98426 - protein, 9 aa, Artificial Sequence
  Description of Artificial Sequence: Synthetic peptide
  Seed: EKVDKLVQF (MAGC3_HUMAN)
ERVDKLVQL

SEQ ID NO: 98427 - protein, 9 aa, Artificial Sequence
  Description of Artificial Sequence: Synthetic peptide
  Seed: KGSCVPEEV (MAGC3_HUMAN)
KQSCVPEEI

SEQ ID NO: 98428 - protein, 9 aa, Artificial Sequence
  Description of Artificial Sequence: Synthetic peptide
  Seed: TEVDPDHFY (MAGC3_HUMAN)
TEVDPDHFI

SEQ ID NO: 98429 - protein, 9 aa, Artificial Sequence
  Description of Artificial Sequence: Synthetic peptide
  Seed: MLLPCHWVL (MAGC3_HUMAN)
MLLPCHWVV

SEQ ID NO: 98430 - protein, 11 aa, Artificial Sequence
  Description of Artificial Sequence: Synthetic peptide
  Seed: YALDEKVAELV (MAGC3_HUMAN)
YLLDEKVAELW

SEQ ID NO: 98431 - protein, 10 aa, Artificial Sequence
  Description of Artificial Sequence: Synthetic peptide
  Seed: RSAEGSVLDL (MAGC3_HUMAN)
RQAEGSVLDI

SEQ ID NO: 98432 - protein, 9 aa, Artificial Sequence
  Description of Artificial Sequence: Synthetic peptide
  Seed: MEDRAQAII (MAGC3_HUMAN)
MFDRAQAIF

SEQ ID NO: 98433 - protein, 10 aa, Artificial Sequence
  Description of Artificial Sequence: Synthetic peptide
  Seed: YQAKEPLTRA (MAGC3_HUMAN)
YIAKEPLTRA

SEQ ID NO: 98434 - protein, 9 aa, Artificial Sequence
  Description of Artificial Sequence: Synthetic peptide
  Seed: MQMNVINTY (MAGC3_HUMAN)
MGMNVINTF

SEQ ID NO: 98435 - protein, 9 aa, Artificial Sequence
  Description of Artificial Sequence: Synthetic peptide
  Seed: KVAELVQFL (MAGC3_HUMAN)
KCAELVQFW

SEQ ID NO: 98436 - protein, 9 aa, Artificial Sequence
  Description of Artificial Sequence: Synthetic peptide
  Seed: FKLWRTLSG (MAGC3_HUMAN)
FELWRTLSF

SEQ ID NO: 98437 - protein, 11 aa, Artificial Sequence
  Description of Artificial Sequence: Synthetic peptide
  Seed: EVLSAIGPIQR (MAGC3_HUMAN)
EYLSAIGPIQR

SEQ ID NO: 98438 - protein, 9 aa, Artificial Sequence
  Description of Artificial Sequence: Synthetic peptide
  Seed: MPAAGMPPL (MAGC3_HUMAN)
MRAAGMPPL

SEQ ID NO: 98439 - protein, 9 aa, Artificial Sequence
  Description of Artificial Sequence: Synthetic peptide
  Seed: HEFIELIFG (MAGC3_HUMAN)
HEFIELIFI

SEQ ID NO: 98440 - protein, 9 aa, Artificial Sequence
  Description of Artificial Sequence: Synthetic peptide
  Seed: LTTVIKKYK (MAGC3_HUMAN)
LVTVIKKYR

SEQ ID NO: 98441 - protein, 10 aa, Artificial Sequence
  Description of Artificial Sequence: Synthetic peptide
  Seed: TAMASASPSV (MAGC3_HUMAN)
TVMASASPSL

SEQ ID NO: 98442 - protein, 11 aa, Artificial Sequence
  Description of Artificial Sequence: Synthetic peptide
  Seed: IIDTTDDATAM (MAGC3_HUMAN)
ISDTTDDATAI

SEQ ID NO: 98443 - protein, 10 aa, Artificial Sequence
  Description of Artificial Sequence: Synthetic peptide
  Seed: DMPAAGMPPL (MAGC3_HUMAN)
DRPAAGMPPM

SEQ ID NO: 98444 - protein, 9 aa, Artificial Sequence
  Description of Artificial Sequence: Synthetic peptide
  Seed: FSLRRAVSV (MAGC3_HUMAN)
FLLRRAVSV

SEQ ID NO: 98445 - protein, 10 aa, Artificial Sequence
  Description of Artificial Sequence: Synthetic peptide
  Seed: MDSLVLCPTY (MAGC3_HUMAN)
MSSLVLCPTF

SEQ ID NO: 98446 - protein, 10 aa, Artificial Sequence
  Description of Artificial Sequence: Synthetic peptide
  Seed: WEVLNAIGPW (MAGC3_HUMAN)
WSVLNAIGPW

SEQ ID NO: 98447 - protein, 9 aa, Artificial Sequence
  Description of Artificial Sequence: Synthetic peptide
  Seed: SAIGPIQRP (MAGC3_HUMAN)
SGIGPIQRY

SEQ ID NO: 98448 - protein, 10 aa, Artificial Sequence
  Description of Artificial Sequence: Synthetic peptide
  Seed: AEMQMNVINT (MAGC3_HUMAN)
AEMQMNVINC

SEQ ID NO: 98449 - protein, 9 aa, Artificial Sequence
  Description of Artificial Sequence: Synthetic peptide
  Seed: TTDDATAMA (MAGC3_HUMAN)
TYDDATAMM

SEQ ID NO: 98450 - protein, 11 aa, Artificial Sequence
  Description of Artificial Sequence: Synthetic peptide
  Seed: YFFEDTLDLTY (MAGC3_HUMAN)
YRFEDTLDLTM

SEQ ID NO: 98451 - protein, 9 aa, Artificial Sequence
  Description of Artificial Sequence: Synthetic peptide
  Seed: VLCPTYFKL (MAGC3_HUMAN)
VCCPTYFKW

SEQ ID NO: 98452 - protein, 9 aa, Artificial Sequence
  Description of Artificial Sequence: Synthetic peptide
  Seed: EMLTTVIKK (MAGC3_HUMAN)
ESLTTVIKR

SEQ ID NO: 98453 - protein, 9 aa, Artificial Sequence
  Description of Artificial Sequence: Synthetic peptide
  Seed: KVDKLVQFL (MAGC3_HUMAN)
KVDKLVQFF

SEQ ID NO: 98454 - protein, 9 aa, Artificial Sequence
  Description of Artificial Sequence: Synthetic peptide
  Seed: MQMNVINTY (MAGC3_HUMAN)
MHMNVINTF

SEQ ID NO: 98455 - protein, 9 aa, Artificial Sequence
  Description of Artificial Sequence: Synthetic peptide
  Seed: KLSSIIPSA (MAGC3_HUMAN)
KVSSIIPSA

SEQ ID NO: 98456 - protein, 10 aa, Artificial Sequence
  Description of Artificial Sequence: Synthetic peptide
  Seed: YALSPVVLPP (MAGC3_HUMAN)
YALSPVVLPL

SEQ ID NO: 98457 - protein, 9 aa, Artificial Sequence
  Description of Artificial Sequence: Synthetic peptide
  Seed: MIFRKAREF (MAGC3_HUMAN)
MAFRKAREF

SEQ ID NO: 98458 - protein, 9 aa, Artificial Sequence
  Description of Artificial Sequence: Synthetic peptide
  Seed: KVAELVQFL (MAGC3_HUMAN)
KYAELVQFF

SEQ ID NO: 98459 - protein, 10 aa, Artificial Sequence
  Description of Artificial Sequence: Synthetic peptide
  Seed: KVAELVQFLL (MAGC3_HUMAN)
KLAELVQFLE

SEQ ID NO: 98460 - protein, 9 aa, Artificial Sequence
  Description of Artificial Sequence: Synthetic peptide
  Seed: LSAIGPIQR (MAGC3_HUMAN)
LTAIGPIQM

SEQ ID NO: 98461 - protein, 9 aa, Artificial Sequence
  Description of Artificial Sequence: Synthetic peptide
  Seed: LVLCPTYFK (MAGC3_HUMAN)
LVLCPTYFR

SEQ ID NO: 98462 - protein, 10 aa, Artificial Sequence
  Description of Artificial Sequence: Synthetic peptide
  Seed: REVRLFLRGG (MAGC3_HUMAN)
RNVRLFLRGA

SEQ ID NO: 98463 - protein, 9 aa, Artificial Sequence
  Description of Artificial Sequence: Synthetic peptide
  Seed: LVLCPTYFK (MAGC3_HUMAN)
LYLCPTYFK

SEQ ID NO: 98464 - protein, 9 aa, Artificial Sequence
  Description of Artificial Sequence: Synthetic peptide
  Seed: VINTYTGYF (MAGC3_HUMAN)
VTNTYTGYL

SEQ ID NO: 98465 - protein, 9 aa, Artificial Sequence
  Description of Artificial Sequence: Synthetic peptide
  Seed: TAMASASPS (MAGC3_HUMAN)
TPMASASPV

SEQ ID NO: 98466 - protein, 8 aa, Artificial Sequence
  Description of Artificial Sequence: Synthetic peptide
  Seed: FIELIFGI (MAGC3_HUMAN)
FLELIFGA

SEQ ID NO: 98467 - protein, 10 aa, Artificial Sequence
  Description of Artificial Sequence: Synthetic peptide
  Seed: YALDEKVAEL (MAGC3_HUMAN)
YTLDEKVAEL

SEQ ID NO: 98468 - protein, 11 aa, Artificial Sequence
  Description of Artificial Sequence: Synthetic peptide
  Seed: FIELIFGIALT (MAGC3_HUMAN)
FGELIFGIALV

SEQ ID NO: 98469 - protein, 9 aa, Artificial Sequence
  Description of Artificial Sequence: Synthetic peptide
  Seed: TYFKLWRTL (MAGC3_HUMAN)
TFFKLWRTI

SEQ ID NO: 98470 - protein, 10 aa, Artificial Sequence
  Description of Artificial Sequence: Synthetic peptide
  Seed: INTYTGYFPM (MAGC3_HUMAN)
IQTYTGYFPL

SEQ ID NO: 98471 - protein, 10 aa, Artificial Sequence
  Description of Artificial Sequence: Synthetic peptide
  Seed: EPQDWPLNEK (MAGC3_HUMAN)
EIQDWPLNER

SEQ ID NO: 98472 - protein, 9 aa, Artificial Sequence
  Description of Artificial Sequence: Synthetic peptide
  Seed: HLREVRLFL (MAGC3_HUMAN)
HMREVRLFS

SEQ ID NO: 98473 - protein, 10 aa, Artificial Sequence
  Description of Artificial Sequence: Synthetic peptide
  Seed: EMLTTVIKKY (MAGC3_HUMAN)
ETLTTVIKKK

SEQ ID NO: 98474 - protein, 9 aa, Artificial Sequence
  Description of Artificial Sequence: Synthetic peptide
  Seed: YKDYFPMIF (MAGC3_HUMAN)
YTDYFPMIF

SEQ ID NO: 98475 - protein, 9 aa, Artificial Sequence
  Description of Artificial Sequence: Synthetic peptide
  Seed: ALDEKVAEL (MAGC3_HUMAN)
AWDEKVAEM

SEQ ID NO: 98476 - protein, 9 aa, Artificial Sequence
  Description of Artificial Sequence: Synthetic peptide
  Seed: HALPESESL (MAGC3_HUMAN)
HALPESESV

SEQ ID NO: 98477 - protein, 10 aa, Artificial Sequence
  Description of Artificial Sequence: Synthetic peptide
  Seed: WEVLSAIGPI (MAGC3_HUMAN)
WLVLSAIGPI

SEQ ID NO: 98478 - protein, 9 aa, Artificial Sequence
  Description of Artificial Sequence: Synthetic peptide
  Seed: DMDPDNHSY (MAGC3_HUMAN)
DVDPDNHSM

SEQ ID NO: 98479 - protein, 9 aa, Artificial Sequence
  Description of Artificial Sequence: Synthetic peptide
  Seed: LILILSMIF (MAGC3_HUMAN)
LRLILSMIF

SEQ ID NO: 98480 - protein, 10 aa, Artificial Sequence
  Description of Artificial Sequence: Synthetic peptide
  Seed: YALSPVVLPP (MAGC3_HUMAN)
YQLSPVVLPA

SEQ ID NO: 98481 - protein, 9 aa, Artificial Sequence
  Description of Artificial Sequence: Synthetic peptide
  Seed: AVSPGKRLW (MAGC3_HUMAN)
AFSPGKRLY

SEQ ID NO: 98482 - protein, 9 aa, Artificial Sequence
  Description of Artificial Sequence: Synthetic peptide
  Seed: FSLRRAVSV (MAGC3_HUMAN)
FTLRRAVSF

SEQ ID NO: 98483 - protein, 9 aa, Artificial Sequence
  Description of Artificial Sequence: Synthetic peptide
  Seed: DYSAFHLGH (MAGC3_HUMAN)
DGSAFHLGR

SEQ ID NO: 98484 - protein, 9 aa, Artificial Sequence
  Description of Artificial Sequence: Synthetic peptide
  Seed: AMASASPSV (MAGC3_HUMAN)
AKASASPSM

SEQ ID NO: 98485 - protein, 9 aa, Artificial Sequence
  Description of Artificial Sequence: Synthetic peptide
  Seed: AVSPGKRLW (MAGC3_HUMAN)
ATSPGKRLF

SEQ ID NO: 98486 - protein, 10 aa, Artificial Sequence
  Description of Artificial Sequence: Synthetic peptide
  Seed: KKYKDYFPMI (MAGC3_HUMAN)
KYYKDYFPMI

SEQ ID NO: 98487 - protein, 9 aa, Artificial Sequence
  Description of Artificial Sequence: Synthetic peptide
  Seed: TGYTLSLPA (MAGC3_HUMAN)
TPYTLSLPL

SEQ ID NO: 98488 - protein, 10 aa, Artificial Sequence
  Description of Artificial Sequence: Synthetic peptide
  Seed: SDQRMDSLVL (MAGC3_HUMAN)
SFQRMDSLVM

SEQ ID NO: 98489 - protein, 9 aa, Artificial Sequence
  Description of Artificial Sequence: Synthetic peptide
  Seed: EVLEFLSKL (MAGC3_HUMAN)
ELLEFLSKR

SEQ ID NO: 98490 - protein, 10 aa, Artificial Sequence
  Description of Artificial Sequence: Synthetic peptide
  Seed: FYVFVNTLDL (MAGC3_HUMAN)
FYVFVNTLDI

SEQ ID NO: 98491 - protein, 9 aa, Artificial Sequence
  Description of Artificial Sequence: Synthetic peptide
  Seed: FHLGHLREV (MAGC3_HUMAN)
FHLGHLREF

SEQ ID NO: 98492 - protein, 10 aa, Artificial Sequence
  Description of Artificial Sequence: Synthetic peptide
  Seed: KDSDLPTWRR (MAGC3_HUMAN)
KASDLPTWRR

SEQ ID NO: 98493 - protein, 9 aa, Artificial Sequence
  Description of Artificial Sequence: Synthetic peptide
  Seed: WESEGPEAF (MAGC3_HUMAN)
WESEGPEAL

SEQ ID NO: 98494 - protein, 9 aa, Artificial Sequence
  Description of Artificial Sequence: Synthetic peptide
  Seed: GSLPESEPL (MAGC3_HUMAN)
GQLPESEPY

SEQ ID NO: 98495 - protein, 9 aa, Artificial Sequence
  Description of Artificial Sequence: Synthetic peptide
  Seed: EAFCEESGL (MAGC3_HUMAN)
EVFCEESGV

SEQ ID NO: 98496 - protein, 9 aa, Artificial Sequence
  Description of Artificial Sequence: Synthetic peptide
  Seed: TLDEKVDKL (MAGC3_HUMAN)
TYDEKVDKF

SEQ ID NO: 98497 - protein, 9 aa, Artificial Sequence
  Description of Artificial Sequence: Synthetic peptide
  Seed: MIFRKAREF (MAGC3_HUMAN)
MRFRKAREM

SEQ ID NO: 98498 - protein, 9 aa, Artificial Sequence
  Description of Artificial Sequence: Synthetic peptide
  Seed: ALDEKVAEL (MAGC3_HUMAN)
AEDEKVAEA

SEQ ID NO: 98499 - protein, 9 aa, Artificial Sequence
  Description of Artificial Sequence: Synthetic peptide
  Seed: ATYALSPVV (MAGC3_HUMAN)
AIYALSPVF

SEQ ID NO: 98500 - protein, 10 aa, Artificial Sequence
  Description of Artificial Sequence: Synthetic peptide
  Seed: SLPAVSPGKR (MAGC3_HUMAN)
SSPAVSPGKR

SEQ ID NO: 98501 - protein, 10 aa, Artificial Sequence
  Description of Artificial Sequence: Synthetic peptide
  Seed: REVRLFLRGG (MAGC3_HUMAN)
RPVRLFLRGV

SEQ ID NO: 98502 - protein, 9 aa, Artificial Sequence
  Description of Artificial Sequence: Synthetic peptide
  Seed: VIWEVLSAI (MAGC3_HUMAN)
VLWEVLSAL

SEQ ID NO: 98503 - protein, 9 aa, Artificial Sequence
  Description of Artificial Sequence: Synthetic peptide
  Seed: HLREVRLFL (MAGC3_HUMAN)
HQREVRLFV

SEQ ID NO: 98504 - protein, 9 aa, Artificial Sequence
  Description of Artificial Sequence: Synthetic peptide
  Seed: MIFIKGSCV (MAGC3_HUMAN)
MLFIKGSCL

SEQ ID NO: 98505 - protein, 9 aa, Artificial Sequence
  Description of Artificial Sequence: Synthetic peptide
  Seed: REVLEFLSK (MAGC3_HUMAN)
RIVLEFLSR

SEQ ID NO: 98506 - protein, 9 aa, Artificial Sequence
  Description of Artificial Sequence: Synthetic peptide
  Seed: RGTGYTLSL (MAGC3_HUMAN)
RMTGYTLSY

SEQ ID NO: 98507 - protein, 9 aa, Artificial Sequence
  Description of Artificial Sequence: Synthetic peptide
  Seed: MQMNVINTY (MAGC3_HUMAN)
MAMNVINTL

SEQ ID NO: 98508 - protein, 9 aa, Artificial Sequence
  Description of Artificial Sequence: Synthetic peptide
  Seed: LSGSPGLQL (MAGC3_HUMAN)
LAGSPGLQM

SEQ ID NO: 98509 - protein, 11 aa, Artificial Sequence
  Description of Artificial Sequence: Synthetic peptide
  Seed: LTDMDPDNHSY (MAGC3_HUMAN)
LIDMDPDNHSY

SEQ ID NO: 98510 - protein, 9 aa, Artificial Sequence
  Description of Artificial Sequence: Synthetic peptide
  Seed: AMASASPSV (MAGC3_HUMAN)
AVASASPSM

SEQ ID NO: 98511 - protein, 10 aa, Artificial Sequence
  Description of Artificial Sequence: Synthetic peptide
  Seed: IELIFGIALT (MAGC3_HUMAN)
IGLIFGIALA

SEQ ID NO: 98512 - protein, 10 aa, Artificial Sequence
  Description of Artificial Sequence: Synthetic peptide
  Seed: YSAFHLGHLR (MAGC3_HUMAN)
YVAFHLGHLK

SEQ ID NO: 98513 - protein, 9 aa, Artificial Sequence
  Description of Artificial Sequence: Synthetic peptide
  Seed: EVLEFLSKL (MAGC3_HUMAN)
EVLEFLSKK

SEQ ID NO: 98514 - protein, 9 aa, Artificial Sequence
  Description of Artificial Sequence: Synthetic peptide
  Seed: NTYTGYFPM (MAGC3_HUMAN)
NAYTGYFPM

SEQ ID NO: 98515 - protein, 9 aa, Artificial Sequence
  Description of Artificial Sequence: Synthetic peptide
  Seed: MASASPSVM (MAGC3_HUMAN)
MESASPSVM

SEQ ID NO: 98516 - protein, 9 aa, Artificial Sequence
  Description of Artificial Sequence: Synthetic peptide
  Seed: FSDGSLGQW (MAGC3_HUMAN)
FPDGSLGQF

SEQ ID NO: 98517 - protein, 9 aa, Artificial Sequence
  Description of Artificial Sequence: Synthetic peptide
  Seed: GMPKNCLLI (MAGC3_HUMAN)
GLPKNCLLV

SEQ ID NO: 98518 - protein, 9 aa, Artificial Sequence
  Description of Artificial Sequence: Synthetic peptide
  Seed: LSGSPGLQL (MAGC3_HUMAN)
LSGSPGLQM

SEQ ID NO: 98519 - protein, 9 aa, Artificial Sequence
  Description of Artificial Sequence: Synthetic peptide
  Seed: LRSAEGSVL (MAGC3_HUMAN)
LHSAEGSVM

SEQ ID NO: 98520 - protein, 10 aa, Artificial Sequence
  Description of Artificial Sequence: Synthetic peptide
  Seed: ILILSMIFIK (MAGC3_HUMAN)
ITILSMIFIR

SEQ ID NO: 98521 - protein, 9 aa, Artificial Sequence
  Description of Artificial Sequence: Synthetic peptide
  Seed: SDLHFGSQP (MAGC3_HUMAN)
SELHFGSQC

SEQ ID NO: 98522 - protein, 9 aa, Artificial Sequence
  Description of Artificial Sequence: Synthetic peptide
  Seed: LSDEQGMPQ (MAGC3_HUMAN)
LGDEQGMPM

SEQ ID NO: 98523 - protein, 10 aa, Artificial Sequence
  Description of Artificial Sequence: Synthetic peptide
  Seed: YALDEKVAEL (MAGC3_HUMAN)
YSLDEKVAET

SEQ ID NO: 98524 - protein, 9 aa, Artificial Sequence
  Description of Artificial Sequence: Synthetic peptide
  Seed: MLLPCHWVL (MAGC3_HUMAN)
MRLPCHWVM

SEQ ID NO: 98525 - protein, 11 aa, Artificial Sequence
  Description of Artificial Sequence: Synthetic peptide
  Seed: SASPSVMSTNF (MAGC3_HUMAN)
SLSPSVMSTNW

SEQ ID NO: 98526 - protein, 9 aa, Artificial Sequence
  Description of Artificial Sequence: Synthetic peptide
  Seed: SQPEGKFSL (MAGC3_HUMAN)
SVPEGKFSF

SEQ ID NO: 98527 - protein, 9 aa, Artificial Sequence
  Description of Artificial Sequence: Synthetic peptide
  Seed: HLREVRLFL (MAGC3_HUMAN)
HVREVRLFW

SEQ ID NO: 98528 - protein, 10 aa, Artificial Sequence
  Description of Artificial Sequence: Synthetic peptide
  Seed: SCSSPLLWTR (MAGC3_HUMAN)
SWSSPLLWTR

SEQ ID NO: 98529 - protein, 9 aa, Artificial Sequence
  Description of Artificial Sequence: Synthetic peptide
  Seed: MPAAGMPPL (MAGC3_HUMAN)
MPAAGMPPF

SEQ ID NO: 98530 - protein, 9 aa, Artificial Sequence
  Description of Artificial Sequence: Synthetic peptide
  Seed: TSDQRMDSL (MAGC3_HUMAN)
TGDQRMDSL

SEQ ID NO: 98531 - protein, 10 aa, Artificial Sequence
  Description of Artificial Sequence: Synthetic peptide
  Seed: KDYFPMIFGK (MAGC3_HUMAN)
KAYFPMIFGK

SEQ ID NO: 98532 - protein, 9 aa, Artificial Sequence
  Description of Artificial Sequence: Synthetic peptide
  Seed: KQREEPQDW (MAGC3_HUMAN)
KQREEPQDY

SEQ ID NO: 98533 - protein, 9 aa, Artificial Sequence
  Description of Artificial Sequence: Synthetic peptide
  Seed: SDQRMDSLV (MAGC3_HUMAN)
SEQRMDSLM

SEQ ID NO: 98534 - protein, 9 aa, Artificial Sequence
  Description of Artificial Sequence: Synthetic peptide
  Seed: MASASPSVM (MAGC3_HUMAN)
MQSASPSVM

SEQ ID NO: 98535 - protein, 10 aa, Artificial Sequence
  Description of Artificial Sequence: Synthetic peptide
  Seed: EEVIWEVLSA (MAGC3_HUMAN)
EPVIWEVLSV

SEQ ID NO: 98536 - protein, 9 aa, Artificial Sequence
  Description of Artificial Sequence: Synthetic peptide
  Seed: DYFPMIFGK (MAGC3_HUMAN)
DLFPMIFGK

SEQ ID NO: 98537 - protein, 9 aa, Artificial Sequence
  Description of Artificial Sequence: Synthetic peptide
  Seed: EVLEFLSKL (MAGC3_HUMAN)
ESLEFLSKA

SEQ ID NO: 98538 - protein, 9 aa, Artificial Sequence
  Description of Artificial Sequence: Synthetic peptide
  Seed: LILILSMIF (MAGC3_HUMAN)
LSLILSMIF

SEQ ID NO: 98539 - protein, 9 aa, Artificial Sequence
  Description of Artificial Sequence: Synthetic peptide
  Seed: ALAGFADVL (MAGC3_HUMAN)
AIAGFADVI

SEQ ID NO: 98540 - protein, 10 aa, Artificial Sequence
  Description of Artificial Sequence: Synthetic peptide
  Seed: YALDEKVAEL (MAGC3_HUMAN)
YQLDEKVAEW

SEQ ID NO: 98541 - protein, 10 aa, Artificial Sequence
  Description of Artificial Sequence: Synthetic peptide
  Seed: FKLWRTLSGS (MAGC3_HUMAN)
FELWRTLSGL

SEQ ID NO: 98542 - protein, 10 aa, Artificial Sequence
  Description of Artificial Sequence: Synthetic peptide
  Seed: MPAAGMPPLP (MAGC3_HUMAN)
MPAAGMPPLG

SEQ ID NO: 98543 - protein, 10 aa, Artificial Sequence
  Description of Artificial Sequence: Synthetic peptide
  Seed: RMDSLVLCPT (MAGC3_HUMAN)
RMDSLVLCPI

SEQ ID NO: 98544 - protein, 9 aa, Artificial Sequence
  Description of Artificial Sequence: Synthetic peptide
  Seed: MLLPCHWVL (MAGC3_HUMAN)
MKLPCHWVY

SEQ ID NO: 98545 - protein, 9 aa, Artificial Sequence
  Description of Artificial Sequence: Synthetic peptide
  Seed: IPPQGPPKI (MAGC3_HUMAN)
ISPQGPPKL

SEQ ID NO: 98546 - protein, 9 aa, Artificial Sequence
  Description of Artificial Sequence: Synthetic peptide
  Seed: MLLPCHWVL (MAGC3_HUMAN)
MMLPCHWVI

SEQ ID NO: 98547 - protein, 10 aa, Artificial Sequence
  Description of Artificial Sequence: Synthetic peptide
  Seed: FKLWRTLSGS (MAGC3_HUMAN)
FWLWRTLSGV

SEQ ID NO: 98548 - protein, 8 aa, Artificial Sequence
  Description of Artificial Sequence: Synthetic peptide
  Seed: LTYEGSLI (MAGC3_HUMAN)
LSYEGSLY

SEQ ID NO: 98549 - protein, 9 aa, Artificial Sequence
  Description of Artificial Sequence: Synthetic peptide
  Seed: LLILILSVI (MAGC3_HUMAN)
LTILILSVV

SEQ ID NO: 98550 - protein, 9 aa, Artificial Sequence
  Description of Artificial Sequence: Synthetic peptide
  Seed: VLCPTYFKL (MAGC3_HUMAN)
VACPTYFKW

SEQ ID NO: 98551 - protein, 9 aa, Artificial Sequence
  Description of Artificial Sequence: Synthetic peptide
  Seed: LRSAEGSVL (MAGC3_HUMAN)
LHSAEGSVF

SEQ ID NO: 98552 - protein, 11 aa, Artificial Sequence
  Description of Artificial Sequence: Synthetic peptide
  Seed: TLWKDSDLPTW (MAGC3_HUMAN)
TQWKDSDLPTL

SEQ ID NO: 98553 - protein, 9 aa, Artificial Sequence
  Description of Artificial Sequence: Synthetic peptide
  Seed: YQAKEPLTR (MAGC3_HUMAN)
YIAKEPLTL

SEQ ID NO: 98554 - protein, 9 aa, Artificial Sequence
  Description of Artificial Sequence: Synthetic peptide
  Seed: EMLTTVIKK (MAGC3_HUMAN)
EGLTTVIKR

SEQ ID NO: 98555 - protein, 9 aa, Artificial Sequence
  Description of Artificial Sequence: Synthetic peptide
  Seed: SQPEGKFSL (MAGC3_HUMAN)
SGPEGKFSI

SEQ ID NO: 98556 - protein, 10 aa, Artificial Sequence
  Description of Artificial Sequence: Synthetic peptide
  Seed: LTEVDPDHFY (MAGC3_HUMAN)
LMEVDPDHFY

SEQ ID NO: 98557 - protein, 10 aa, Artificial Sequence
  Description of Artificial Sequence: Synthetic peptide
  Seed: NTYTGYFPMI (MAGC3_HUMAN)
NWYTGYFPMW

SEQ ID NO: 98558 - protein, 9 aa, Artificial Sequence
  Description of Artificial Sequence: Synthetic peptide
  Seed: VLPPQPQPR (MAGC3_HUMAN)
VTPPQPQPY

SEQ ID NO: 98559 - protein, 9 aa, Artificial Sequence
  Description of Artificial Sequence: Synthetic peptide
  Seed: YFFEDTLDL (MAGC3_HUMAN)
YRFEDTLDF

SEQ ID NO: 98560 - protein, 9 aa, Artificial Sequence
  Description of Artificial Sequence: Synthetic peptide
  Seed: SAFHLGHLR (MAGC3_HUMAN)
SFFHLGHLY

SEQ ID NO: 98561 - protein, 9 aa, Artificial Sequence
  Description of Artificial Sequence: Synthetic peptide
  Seed: LRSAEGSVL (MAGC3_HUMAN)
LHSAEGSVI

SEQ ID NO: 98562 - protein, 9 aa, Artificial Sequence
  Description of Artificial Sequence: Synthetic peptide
  Seed: VINTYTGYF (MAGC3_HUMAN)
VSNTYTGYY

SEQ ID NO: 98563 - protein, 10 aa, Artificial Sequence
  Description of Artificial Sequence: Synthetic peptide
  Seed: SDQRMDSLVL (MAGC3_HUMAN)
SWQRMDSLVL

SEQ ID NO: 98564 - protein, 9 aa, Artificial Sequence
  Description of Artificial Sequence: Synthetic peptide
  Seed: IQRPAREVL (MAGC3_HUMAN)
IFRPAREVM

SEQ ID NO: 98565 - protein, 9 aa, Artificial Sequence
  Description of Artificial Sequence: Synthetic peptide
  Seed: KAHEFIELI (MAGC3_HUMAN)
KQHEFIELW

SEQ ID NO: 98566 - protein, 9 aa, Artificial Sequence
  Description of Artificial Sequence: Synthetic peptide
  Seed: YFFEDTLDL (MAGC3_HUMAN)
YMFEDTLDY

SEQ ID NO: 98567 - protein, 9 aa, Artificial Sequence
  Description of Artificial Sequence: Synthetic peptide
  Seed: ALAGFADVL (MAGC3_HUMAN)
AAAGFADVF

SEQ ID NO: 98568 - protein, 9 aa, Artificial Sequence
  Description of Artificial Sequence: Synthetic peptide
  Seed: TYFKLWRTL (MAGC3_HUMAN)
TQFKLWRTY

SEQ ID NO: 98569 - protein, 10 aa, Artificial Sequence
  Description of Artificial Sequence: Synthetic peptide
  Seed: INTYTGYFPM (MAGC3_HUMAN)
IVTYTGYFPF

SEQ ID NO: 98570 - protein, 9 aa, Artificial Sequence
  Description of Artificial Sequence: Synthetic peptide
  Seed: AIGPIQRPA (MAGC3_HUMAN)
ALGPIQRPA

SEQ ID NO: 98571 - protein, 11 aa, Artificial Sequence
  Description of Artificial Sequence: Synthetic peptide
  Seed: SSSEEEDTATW (MAGC3_HUMAN)
SISEEEDTATF

SEQ ID NO: 98572 - protein, 10 aa, Artificial Sequence
  Description of Artificial Sequence: Synthetic peptide
  Seed: SKLSSIIPSA (MAGC3_HUMAN)
SLLSSIIPSI

SEQ ID NO: 98573 - protein, 11 aa, Artificial Sequence
  Description of Artificial Sequence: Synthetic peptide
  Seed: ATFSDGSLGQW (MAGC3_HUMAN)
AMFSDGSLGQR

SEQ ID NO: 98574 - protein, 10 aa, Artificial Sequence
  Description of Artificial Sequence: Synthetic peptide
  Seed: MPKNCLLILI (MAGC3_HUMAN)
MPKNCLLILW

SEQ ID NO: 98575 - protein, 10 aa, Artificial Sequence
  Description of Artificial Sequence: Synthetic peptide
  Seed: KDSDLPTWRR (MAGC3_HUMAN)
KTSDLPTWRR

SEQ ID NO: 98576 - protein, 10 aa, Artificial Sequence
  Description of Artificial Sequence: Synthetic peptide
  Seed: YALDEKVAEL (MAGC3_HUMAN)
YPLDEKVAEF

SEQ ID NO: 98577 - protein, 10 aa, Artificial Sequence
  Description of Artificial Sequence: Synthetic peptide
  Seed: FPSWYMDALK (MAGC3_HUMAN)
FESWYMDALR

SEQ ID NO: 98578 - protein, 9 aa, Artificial Sequence
  Description of Artificial Sequence: Synthetic peptide
  Seed: IIPSAFPSW (MAGC3_HUMAN)
ITPSAFPSM

SEQ ID NO: 98579 - protein, 9 aa, Artificial Sequence
  Description of Artificial Sequence: Synthetic peptide
  Seed: VINTYTGYF (MAGC3_HUMAN)
VWNTYTGYY

SEQ ID NO: 98580 - protein, 9 aa, Artificial Sequence
  Description of Artificial Sequence: Synthetic peptide
  Seed: AIGPIQRPA (MAGC3_HUMAN)
AAGPIQRPF

SEQ ID NO: 98581 - protein, 10 aa, Artificial Sequence
  Description of Artificial Sequence: Synthetic peptide
  Seed: YALDEKVAEL (MAGC3_HUMAN)
YNLDEKVAET

SEQ ID NO: 98582 - protein, 9 aa, Artificial Sequence
  Description of Artificial Sequence: Synthetic peptide
  Seed: NVINTYTGY (MAGC3_HUMAN)
NWINTYTGY

SEQ ID NO: 98583 - protein, 10 aa, Artificial Sequence
  Description of Artificial Sequence: Synthetic peptide
  Seed: IPSAFPSWYM (MAGC3_HUMAN)
IESAFPSWYW

SEQ ID NO: 98584 - protein, 10 aa, Artificial Sequence
  Description of Artificial Sequence: Synthetic peptide
  Seed: SPLDSCSSPL (MAGC3_HUMAN)
SCLDSCSSPV

SEQ ID NO: 98585 - protein, 10 aa, Artificial Sequence
  Description of Artificial Sequence: Synthetic peptide
  Seed: MNVINTYTGY (MAGC3_HUMAN)
MTVINTYTGK

SEQ ID NO: 98586 - protein, 11 aa, Artificial Sequence
  Description of Artificial Sequence: Synthetic peptide
  Seed: SSEEEDTATWH (MAGC3_HUMAN)
SLEEEDTATWY

SEQ ID NO: 98587 - protein, 11 aa, Artificial Sequence
  Description of Artificial Sequence: Synthetic peptide
  Seed: LTEVDPDHFYV (MAGC3_HUMAN)
LLEVDPDHFYL

SEQ ID NO: 98588 - protein, 11 aa, Artificial Sequence
  Description of Artificial Sequence: Synthetic peptide
  Seed: LDSCSSPLLWT (MAGC3_HUMAN)
LTSCSSPLLWW

SEQ ID NO: 98589 - protein, 9 aa, Artificial Sequence
  Description of Artificial Sequence: Synthetic peptide
  Seed: KAHEFIELI (MAGC3_HUMAN)
KIHEFIELI

SEQ ID NO: 98590 - protein, 9 aa, Artificial Sequence
  Description of Artificial Sequence: Synthetic peptide
  Seed: KATDKDYSA (MAGC3_HUMAN)
KATDKDYSM

SEQ ID NO: 98591 - protein, 9 aa, Artificial Sequence
  Description of Artificial Sequence: Synthetic peptide
  Seed: TTDDATAMA (MAGC3_HUMAN)
TQDDATAMY

SEQ ID NO: 98592 - protein, 9 aa, Artificial Sequence
  Description of Artificial Sequence: Synthetic peptide
  Seed: QLSDLHFGS (MAGC3_HUMAN)
QQSDLHFGV

SEQ ID NO: 98593 - protein, 10 aa, Artificial Sequence
  Description of Artificial Sequence: Synthetic peptide
  Seed: MDSLVLCPTY (MAGC3_HUMAN)
MVSLVLCPTY

SEQ ID NO: 98594 - protein, 9 aa, Artificial Sequence
  Description of Artificial Sequence: Synthetic peptide
  Seed: AVSPGKRLW (MAGC3_HUMAN)
AQSPGKRLY

SEQ ID NO: 98595 - protein, 9 aa, Artificial Sequence
  Description of Artificial Sequence: Synthetic peptide
  Seed: FSDGSLGQW (MAGC3_HUMAN)
FYDGSLGQM

SEQ ID NO: 98596 - protein, 9 aa, Artificial Sequence
  Description of Artificial Sequence: Synthetic peptide
  Seed: MQMNVINTY (MAGC3_HUMAN)
MHMNVINTY

SEQ ID NO: 98597 - protein, 9 aa, Artificial Sequence
  Description of Artificial Sequence: Synthetic peptide
  Seed: DMDPDNHSY (MAGC3_HUMAN)
DYDPDNHSL

SEQ ID NO: 98598 - protein, 8 aa, Artificial Sequence
  Description of Artificial Sequence: Synthetic peptide
  Seed: SSIIPSAF (MAGC3_HUMAN)
SMIIPSAF

SEQ ID NO: 98599 - protein, 9 aa, Artificial Sequence
  Description of Artificial Sequence: Synthetic peptide
  Seed: KLSSIIPSA (MAGC3_HUMAN)
KTSSIIPSA

SEQ ID NO: 98600 - protein, 9 aa, Artificial Sequence
  Description of Artificial Sequence: Synthetic peptide
  Seed: YFFEDTLDL (MAGC3_HUMAN)
YWFEDTLDY

SEQ ID NO: 98601 - protein, 9 aa, Artificial Sequence
  Description of Artificial Sequence: Synthetic peptide
  Seed: HALPESESL (MAGC3_HUMAN)
HYLPESESM

SEQ ID NO: 98602 - protein, 9 aa, Artificial Sequence
  Description of Artificial Sequence: Synthetic peptide
  Seed: TSDQRMDSL (MAGC3_HUMAN)
TYDQRMDSY

SEQ ID NO: 98603 - protein, 9 aa, Artificial Sequence
  Description of Artificial Sequence: Synthetic peptide
  Seed: VLCPTYFKL (MAGC3_HUMAN)
VTCPTYFKY

SEQ ID NO: 98604 - protein, 9 aa, Artificial Sequence
  Description of Artificial Sequence: Synthetic peptide
  Seed: TGYFPMIFR (MAGC3_HUMAN)
TIYFPMIFK

SEQ ID NO: 98605 - protein, 10 aa, Artificial Sequence
  Description of Artificial Sequence: Synthetic peptide
  Seed: LNAIGPWSAL (MAGC3_HUMAN)
LRAIGPWSAL

SEQ ID NO: 98606 - protein, 9 aa, Artificial Sequence
  Description of Artificial Sequence: Synthetic peptide
  Seed: EVLEFLSKL (MAGC3_HUMAN)
EWLEFLSKR

SEQ ID NO: 98607 - protein, 9 aa, Artificial Sequence
  Description of Artificial Sequence: Synthetic peptide
  Seed: MIFGKAHEF (MAGC3_HUMAN)
MLFGKAHEK

SEQ ID NO: 98608 - protein, 10 aa, Artificial Sequence
  Description of Artificial Sequence: Synthetic peptide
  Seed: KLSSIIPSAF (MAGC3_HUMAN)
KQSSIIPSAI

SEQ ID NO: 98609 - protein, 10 aa, Artificial Sequence
  Description of Artificial Sequence: Synthetic peptide
  Seed: YALSPVVLPP (MAGC3_HUMAN)
YYLSPVVLPT

SEQ ID NO: 98610 - protein, 10 aa, Artificial Sequence
  Description of Artificial Sequence: Synthetic peptide
  Seed: MIFGKAHEFI (MAGC3_HUMAN)
MTFGKAHEFV

SEQ ID NO: 98611 - protein, 9 aa, Artificial Sequence
  Description of Artificial Sequence: Synthetic peptide
  Seed: CSSPLLWTR (MAGC3_HUMAN)
CVSPLLWTR

SEQ ID NO: 98612 - protein, 9 aa, Artificial Sequence
  Description of Artificial Sequence: Synthetic peptide
  Seed: YQTKEPVTK (MAGC3_HUMAN)
YRTKEPVTY

SEQ ID NO: 98613 - protein, 9 aa, Artificial Sequence
  Description of Artificial Sequence: Synthetic peptide
  Seed: GKAHEFIEL (MAGC3_HUMAN)
GMAHEFIEM

SEQ ID NO: 98614 - protein, 9 aa, Artificial Sequence
  Description of Artificial Sequence: Synthetic peptide
  Seed: RGTGYTLSL (MAGC3_HUMAN)
RQTGYTLSI

SEQ ID NO: 98615 - protein, 9 aa, Artificial Sequence
  Description of Artificial Sequence: Synthetic peptide
  Seed: MASASPSVM (MAGC3_HUMAN)
MSSASPSVV

SEQ ID NO: 98616 - protein, 9 aa, Artificial Sequence
  Description of Artificial Sequence: Synthetic peptide
  Seed: VIWEVLNAI (MAGC3_HUMAN)
VGWEVLNAY

SEQ ID NO: 98617 - protein, 11 aa, Artificial Sequence
  Description of Artificial Sequence: Synthetic peptide
  Seed: KKYKDYFPMIF (MAGC3_HUMAN)
KQYKDYFPMIM

SEQ ID NO: 98618 - protein, 11 aa, Artificial Sequence
  Description of Artificial Sequence: Synthetic peptide
  Seed: LDSCSSPLLWT (MAGC3_HUMAN)
LSSCSSPLLWY

SEQ ID NO: 98619 - protein, 10 aa, Artificial Sequence
  Description of Artificial Sequence: Synthetic peptide
  Seed: KLSSIIPSAF (MAGC3_HUMAN)
KTSSIIPSAW

SEQ ID NO: 98620 - protein, 11 aa, Artificial Sequence
  Description of Artificial Sequence: Synthetic peptide
  Seed: HSYFFEDTLDL (MAGC3_HUMAN)
HSYFFEDTLDW

SEQ ID NO: 98621 - protein, 9 aa, Artificial Sequence
  Description of Artificial Sequence: Synthetic peptide
  Seed: FVNTLDLTC (MAGC3_HUMAN)
FINTLDLTM

SEQ ID NO: 98622 - protein, 9 aa, Artificial Sequence
  Description of Artificial Sequence: Synthetic peptide
  Seed: YFFEDTLDL (MAGC3_HUMAN)
YYFEDTLDF

SEQ ID NO: 98623 - protein, 9 aa, Artificial Sequence
  Description of Artificial Sequence: Synthetic peptide
  Seed: FHLGHLREV (MAGC3_HUMAN)
FFLGHLREY

SEQ ID NO: 98624 - protein, 10 aa, Artificial Sequence
  Description of Artificial Sequence: Synthetic peptide
  Seed: ILFGISLTEV (MAGC3_HUMAN)
IAFGISLTEI

SEQ ID NO: 98625 - protein, 10 aa, Artificial Sequence
  Description of Artificial Sequence: Synthetic peptide
  Seed: NTYTGYFPMI (MAGC3_HUMAN)
NDYTGYFPMF

SEQ ID NO: 98626 - protein, 9 aa, Artificial Sequence
  Description of Artificial Sequence: Synthetic peptide
  Seed: MQMNVINTY (MAGC3_HUMAN)
MLMNVINTW

SEQ ID NO: 98627 - protein, 9 aa, Artificial Sequence
  Description of Artificial Sequence: Synthetic peptide
  Seed: SQPEGKFSL (MAGC3_HUMAN)
SSPEGKFSL

SEQ ID NO: 98628 - protein, 10 aa, Artificial Sequence
  Description of Artificial Sequence: Synthetic peptide
  Seed: FKLWRTLSGS (MAGC3_HUMAN)
FDLWRTLSGL

SEQ ID NO: 98629 - protein, 8 aa, Artificial Sequence
  Description of Artificial Sequence: Synthetic peptide
  Seed: YFKLWRTL (MAGC3_HUMAN)
YYKLWRTF

SEQ ID NO: 98630 - protein, 10 aa, Artificial Sequence
  Description of Artificial Sequence: Synthetic peptide
  Seed: SCSSPLLWTR (MAGC3_HUMAN)
SISSPLLWTR

SEQ ID NO: 98631 - protein, 11 aa, Artificial Sequence
  Description of Artificial Sequence: Synthetic peptide
  Seed: TAMASASPSVM (MAGC3_HUMAN)
TVMASASPSVY

SEQ ID NO: 98632 - protein, 9 aa, Artificial Sequence
  Description of Artificial Sequence: Synthetic peptide
  Seed: SAFHLGHLR (MAGC3_HUMAN)
SAFHLGHLL

SEQ ID NO: 98633 - protein, 9 aa, Artificial Sequence
  Description of Artificial Sequence: Synthetic peptide
  Seed: KVDKLVQFL (MAGC3_HUMAN)
KGDKLVQFF

SEQ ID NO: 98634 - protein, 9 aa, Artificial Sequence
  Description of Artificial Sequence: Synthetic peptide
  Seed: SIIPSAFPS (MAGC3_HUMAN)
SIIPSAFPV

SEQ ID NO: 98635 - protein, 9 aa, Artificial Sequence
  Description of Artificial Sequence: Synthetic peptide
  Seed: MDPDNHSYF (MAGC3_HUMAN)
MGPDNHSYV

SEQ ID NO: 98636 - protein, 10 aa, Artificial Sequence
  Description of Artificial Sequence: Synthetic peptide
  Seed: KVAELVQFLL (MAGC3_HUMAN)
KCAELVQFLW

SEQ ID NO: 98637 - protein, 10 aa, Artificial Sequence
  Description of Artificial Sequence: Synthetic peptide
  Seed: ILILSMIFIK (MAGC3_HUMAN)
INILSMIFIR

SEQ ID NO: 98638 - protein, 10 aa, Artificial Sequence
  Description of Artificial Sequence: Synthetic peptide
  Seed: LNAIGPWSAL (MAGC3_HUMAN)
LMAIGPWSAL

SEQ ID NO: 98639 - protein, 9 aa, Artificial Sequence
  Description of Artificial Sequence: Synthetic peptide
  Seed: REVRLFLRG (MAGC3_HUMAN)
REVRLFLRM

SEQ ID NO: 98640 - protein, 10 aa, Artificial Sequence
  Description of Artificial Sequence: Synthetic peptide
  Seed: KKYKDYFPMI (MAGC3_HUMAN)
KTYKDYFPMA

SEQ ID NO: 98641 - protein, 10 aa, Artificial Sequence
  Description of Artificial Sequence: Synthetic peptide
  Seed: AEMQMNVINT (MAGC3_HUMAN)
AEMQMNVINA

SEQ ID NO: 98642 - protein, 9 aa, Artificial Sequence
  Description of Artificial Sequence: Synthetic peptide
  Seed: ASEEVIWEV (MAGC3_HUMAN)
AIEEVIWEI

SEQ ID NO: 98643 - protein, 9 aa, Artificial Sequence
  Description of Artificial Sequence: Synthetic peptide
  Seed: WYMDALKDM (MAGC3_HUMAN)
WFMDALKDM

SEQ ID NO: 98644 - protein, 9 aa, Artificial Sequence
  Description of Artificial Sequence: Synthetic peptide
  Seed: ATDKDYSAF (MAGC3_HUMAN)
AWDKDYSAM

SEQ ID NO: 98645 - protein, 9 aa, Artificial Sequence
  Description of Artificial Sequence: Synthetic peptide
  Seed: EVLEFLSKL (MAGC3_HUMAN)
EILEFLSKW

SEQ ID NO: 98646 - protein, 10 aa, Artificial Sequence
  Description of Artificial Sequence: Synthetic peptide
  Seed: SSEEEDTATW (MAGC3_HUMAN)
STEEEDTATW

SEQ ID NO: 98647 - protein, 11 aa, Artificial Sequence
  Description of Artificial Sequence: Synthetic peptide
  Seed: RTLSGSPGLQL (MAGC3_HUMAN)
RVLSGSPGLQI

SEQ ID NO: 98648 - protein, 9 aa, Artificial Sequence
  Description of Artificial Sequence: Synthetic peptide
  Seed: AMASASPSV (MAGC3_HUMAN)
ALASASPSI

SEQ ID NO: 98649 - protein, 9 aa, Artificial Sequence
  Description of Artificial Sequence: Synthetic peptide
  Seed: SESLPRYAL (MAGC3_HUMAN)
SESLPRYAV

SEQ ID NO: 98650 - protein, 10 aa, Artificial Sequence
  Description of Artificial Sequence: Synthetic peptide
  Seed: FPSWYMDALK (MAGC3_HUMAN)
FQSWYMDALR

SEQ ID NO: 98651 - protein, 9 aa, Artificial Sequence
  Description of Artificial Sequence: Synthetic peptide
  Seed: CSSPLLWTR (MAGC3_HUMAN)
CNSPLLWTR

SEQ ID NO: 98652 - protein, 10 aa, Artificial Sequence
  Description of Artificial Sequence: Synthetic peptide
  Seed: KLVQFLLLKY (MAGC3_HUMAN)
KWVQFLLLKK

SEQ ID NO: 98653 - protein, 9 aa, Artificial Sequence
  Description of Artificial Sequence: Synthetic peptide
  Seed: CLLILILSM (MAGC3_HUMAN)
CMLILILSF

SEQ ID NO: 98654 - protein, 11 aa, Artificial Sequence
  Description of Artificial Sequence: Synthetic peptide
  Seed: TDMDPDNHSYF (MAGC3_HUMAN)
TAMDPDNHSYY

SEQ ID NO: 98655 - protein, 9 aa, Artificial Sequence
  Description of Artificial Sequence: Synthetic peptide
  Seed: KAHEFIELI (MAGC3_HUMAN)
KVHEFIELT

SEQ ID NO: 98656 - protein, 9 aa, Artificial Sequence
  Description of Artificial Sequence: Synthetic peptide
  Seed: WVKNTCATY (MAGC3_HUMAN)
WSKNTCATY

SEQ ID NO: 98657 - protein, 10 aa, Artificial Sequence
  Description of Artificial Sequence: Synthetic peptide
  Seed: MDSLVLCPTY (MAGC3_HUMAN)
MYSLVLCPTY

SEQ ID NO: 98658 - protein, 10 aa, Artificial Sequence
  Description of Artificial Sequence: Synthetic peptide
  Seed: MNVINTYTGY (MAGC3_HUMAN)
MRVINTYTGK

SEQ ID NO: 98659 - protein, 10 aa, Artificial Sequence
  Description of Artificial Sequence: Synthetic peptide
  Seed: LTRAEMQMNV (MAGC3_HUMAN)
LLRAEMQMNL

SEQ ID NO: 98660 - protein, 9 aa, Artificial Sequence
  Description of Artificial Sequence: Synthetic peptide
  Seed: MQMNVINTY (MAGC3_HUMAN)
MVMNVINTR

SEQ ID NO: 98661 - protein, 9 aa, Artificial Sequence
  Description of Artificial Sequence: Synthetic peptide
  Seed: HFYVFVNTL (MAGC3_HUMAN)
HHYVFVNTM

SEQ ID NO: 98662 - protein, 9 aa, Artificial Sequence
  Description of Artificial Sequence: Synthetic peptide
  Seed: DTTDDATAM (MAGC3_HUMAN)
DVTDDATAK

SEQ ID NO: 98663 - protein, 9 aa, Artificial Sequence
  Description of Artificial Sequence: Synthetic peptide
  Seed: SCVPEEVIW (MAGC3_HUMAN)
SPVPEEVIF

SEQ ID NO: 98664 - protein, 10 aa, Artificial Sequence
  Description of Artificial Sequence: Synthetic peptide
  Seed: MNVINTYTGY (MAGC3_HUMAN)
MEVINTYTGR

SEQ ID NO: 98665 - protein, 10 aa, Artificial Sequence
  Description of Artificial Sequence: Synthetic peptide
  Seed: ATYALSPVVL (MAGC3_HUMAN)
ALYALSPVVL

SEQ ID NO: 98666 - protein, 9 aa, Artificial Sequence
  Description of Artificial Sequence: Synthetic peptide
  Seed: RGTGYTLSL (MAGC3_HUMAN)
RETGYTLSY

SEQ ID NO: 98667 - protein, 11 aa, Artificial Sequence
  Description of Artificial Sequence: Synthetic peptide
  Seed: TLWKDSDLPTW (MAGC3_HUMAN)
TSWKDSDLPTW

SEQ ID NO: 98668 - protein, 9 aa, Artificial Sequence
  Description of Artificial Sequence: Synthetic peptide
  Seed: QRMDSLVLC (MAGC3_HUMAN)
QHMDSLVLI

SEQ ID NO: 98669 - protein, 9 aa, Artificial Sequence
  Description of Artificial Sequence: Synthetic peptide
  Seed: EMLTTVIKK (MAGC3_HUMAN)
ESLTTVIKK

SEQ ID NO: 98670 - protein, 9 aa, Artificial Sequence
  Description of Artificial Sequence: Synthetic peptide
  Seed: FSLRRAVSV (MAGC3_HUMAN)
FGLRRAVSI

SEQ ID NO: 98671 - protein, 9 aa, Artificial Sequence
  Description of Artificial Sequence: Synthetic peptide
  Seed: GSLPESEPL (MAGC3_HUMAN)
GVLPESEPY

SEQ ID NO: 98672 - protein, 9 aa, Artificial Sequence
  Description of Artificial Sequence: Synthetic peptide
  Seed: LIDDQGMPK (MAGC3_HUMAN)
LSDDQGMPY

SEQ ID NO: 98673 - protein, 9 aa, Artificial Sequence
  Description of Artificial Sequence: Synthetic peptide
  Seed: MIFGKAHEF (MAGC3_HUMAN)
MRFGKAHEV

SEQ ID NO: 98674 - protein, 9 aa, Artificial Sequence
  Description of Artificial Sequence: Synthetic peptide
  Seed: ATDKDYSAF (MAGC3_HUMAN)
ALDKDYSAV

SEQ ID NO: 98675 - protein, 9 aa, Artificial Sequence
  Description of Artificial Sequence: Synthetic peptide
  Seed: TTDDATAMA (MAGC3_HUMAN)
TQDDATAMF

SEQ ID NO: 98676 - protein, 10 aa, Artificial Sequence
  Description of Artificial Sequence: Synthetic peptide
  Seed: IIDTTDDATA (MAGC3_HUMAN)
IVDTTDDATL

SEQ ID NO: 98677 - protein, 11 aa, Artificial Sequence
  Description of Artificial Sequence: Synthetic peptide
  Seed: FLSKLSSIIPS (MAGC3_HUMAN)
FMSKLSSIIPA

SEQ ID NO: 98678 - protein, 10 aa, Artificial Sequence
  Description of Artificial Sequence: Synthetic peptide
  Seed: TLDEKVDKLV (MAGC3_HUMAN)
TMDEKVDKLL

SEQ ID NO: 98679 - protein, 10 aa, Artificial Sequence
  Description of Artificial Sequence: Synthetic peptide
  Seed: TLDEKVDKLV (MAGC3_HUMAN)
TYDEKVDKLM

SEQ ID NO: 98680 - protein, 9 aa, Artificial Sequence
  Description of Artificial Sequence: Synthetic peptide
  Seed: KAHEFIELI (MAGC3_HUMAN)
KRHEFIELI

SEQ ID NO: 98681 - protein, 11 aa, Artificial Sequence
  Description of Artificial Sequence: Synthetic peptide
  Seed: RTLSGSPGLQL (MAGC3_HUMAN)
RILSGSPGLQF

SEQ ID NO: 98682 - protein, 9 aa, Artificial Sequence
  Description of Artificial Sequence: Synthetic peptide
  Seed: MIFRKAREF (MAGC3_HUMAN)
MKFRKAREF

SEQ ID NO: 98683 - protein, 9 aa, Artificial Sequence
  Description of Artificial Sequence: Synthetic peptide
  Seed: DSCSSPLLW (MAGC3_HUMAN)
DACSSPLLW

SEQ ID NO: 98684 - protein, 11 aa, Artificial Sequence
  Description of Artificial Sequence: Synthetic peptide
  Seed: FIELIFGIALT (MAGC3_HUMAN)
FEELIFGIALV

SEQ ID NO: 98685 - protein, 9 aa, Artificial Sequence
  Description of Artificial Sequence: Synthetic peptide
  Seed: QPQPRKKAT (MAGC3_HUMAN)
QLQPRKKAI

SEQ ID NO: 98686 - protein, 9 aa, Artificial Sequence
  Description of Artificial Sequence: Synthetic peptide
  Seed: IIPSAFPSW (MAGC3_HUMAN)
IWPSAFPSY

SEQ ID NO: 98687 - protein, 9 aa, Artificial Sequence
  Description of Artificial Sequence: Synthetic peptide
  Seed: GMPKNCLLI (MAGC3_HUMAN)
GYPKNCLLF

SEQ ID NO: 98688 - protein, 9 aa, Artificial Sequence
  Description of Artificial Sequence: Synthetic peptide
  Seed: VAELVQFLL (MAGC3_HUMAN)
VSELVQFLW

SEQ ID NO: 98689 - protein, 9 aa, Artificial Sequence
  Description of Artificial Sequence: Synthetic peptide
  Seed: SEEEDTATW (MAGC3_HUMAN)
SEEEDTATA

SEQ ID NO: 98690 - protein, 9 aa, Artificial Sequence
  Description of Artificial Sequence: Synthetic peptide
  Seed: RQEDGRRGL (MAGC3_HUMAN)
REEDGRRGL

SEQ ID NO: 98691 - protein, 9 aa, Artificial Sequence
  Description of Artificial Sequence: Synthetic peptide
  Seed: MQMNVINTY (MAGC3_HUMAN)
MPMNVINTS

SEQ ID NO: 98692 - protein, 11 aa, Artificial Sequence
  Description of Artificial Sequence: Synthetic peptide
  Seed: MQMNVINTYTG (MAGC3_HUMAN)
MAMNVINTYTF

SEQ ID NO: 98693 - protein, 9 aa, Artificial Sequence
  Description of Artificial Sequence: Synthetic peptide
  Seed: YQAKEPLTR (MAGC3_HUMAN)
YFAKEPLTM

SEQ ID NO: 98694 - protein, 9 aa, Artificial Sequence
  Description of Artificial Sequence: Synthetic peptide
  Seed: AMASASPSV (MAGC3_HUMAN)
ALASASPSV

SEQ ID NO: 98695 - protein, 10 aa, Artificial Sequence
  Description of Artificial Sequence: Synthetic peptide
  Seed: EMQMNVINTY (MAGC3_HUMAN)
EGQMNVINTF

SEQ ID NO: 98696 - protein, 10 aa, Artificial Sequence
  Description of Artificial Sequence: Synthetic peptide
  Seed: IELIFGIALT (MAGC3_HUMAN)
IVLIFGIALV

SEQ ID NO: 98697 - protein, 9 aa, Artificial Sequence
  Description of Artificial Sequence: Synthetic peptide
  Seed: RGTGYTLSL (MAGC3_HUMAN)
RNTGYTLSV

SEQ ID NO: 98698 - protein, 9 aa, Artificial Sequence
  Description of Artificial Sequence: Synthetic peptide
  Seed: WVKNTCATY (MAGC3_HUMAN)
WQKNTCATW

SEQ ID NO: 98699 - protein, 9 aa, Artificial Sequence
  Description of Artificial Sequence: Synthetic peptide
  Seed: EVLEFLSKL (MAGC3_HUMAN)
EVLEFLSKA

SEQ ID NO: 98700 - protein, 9 aa, Artificial Sequence
  Description of Artificial Sequence: Synthetic peptide
  Seed: VIWEVLSAI (MAGC3_HUMAN)
VLWEVLSAA

SEQ ID NO: 98701 - protein, 9 aa, Artificial Sequence
  Description of Artificial Sequence: Synthetic peptide
  Seed: AELVQFLLL (MAGC3_HUMAN)
AQLVQFLLL

SEQ ID NO: 98702 - protein, 9 aa, Artificial Sequence
  Description of Artificial Sequence: Synthetic peptide
  Seed: YQAKEPLTR (MAGC3_HUMAN)
YIAKEPLTM

SEQ ID NO: 98703 - protein, 11 aa, Artificial Sequence
  Description of Artificial Sequence: Synthetic peptide
  Seed: FLSKLSSIIPS (MAGC3_HUMAN)
FLSKLSSIIPT

SEQ ID NO: 98704 - protein, 9 aa, Artificial Sequence
  Description of Artificial Sequence: Synthetic peptide
  Seed: GYFPMIFRK (MAGC3_HUMAN)
GYFPMIFRR

SEQ ID NO: 98705 - protein, 11 aa, Artificial Sequence
  Description of Artificial Sequence: Synthetic peptide
  Seed: SVLDLANPQGL (MAGC3_HUMAN)
SQLDLANPQGF

SEQ ID NO: 98706 - protein, 10 aa, Artificial Sequence
  Description of Artificial Sequence: Synthetic peptide
  Seed: MQMNVINTYT (MAGC3_HUMAN)
MVMNVINTYF

SEQ ID NO: 98707 - protein, 9 aa, Artificial Sequence
  Description of Artificial Sequence: Synthetic peptide
  Seed: LPQSPPEIP (MAGC3_HUMAN)
LPQSPPEII

SEQ ID NO: 98708 - protein, 9 aa, Artificial Sequence
  Description of Artificial Sequence: Synthetic peptide
  Seed: YTLDEKVDK (MAGC3_HUMAN)
YALDEKVDF

SEQ ID NO: 98709 - protein, 10 aa, Artificial Sequence
  Description of Artificial Sequence: Synthetic peptide
  Seed: TTDDATAMAS (MAGC3_HUMAN)
TNDDATAMAY

SEQ ID NO: 98710 - protein, 9 aa, Artificial Sequence
  Description of Artificial Sequence: Synthetic peptide
  Seed: KGSCVPEEV (MAGC3_HUMAN)
KMSCVPEEW

SEQ ID NO: 98711 - protein, 10 aa, Artificial Sequence
  Description of Artificial Sequence: Synthetic peptide
  Seed: RPAREVLEFL (MAGC3_HUMAN)
RDAREVLEFK

SEQ ID NO: 98712 - protein, 9 aa, Artificial Sequence
  Description of Artificial Sequence: Synthetic peptide
  Seed: MQMNVINTY (MAGC3_HUMAN)
MPMNVINTL

SEQ ID NO: 98713 - protein, 9 aa, Artificial Sequence
  Description of Artificial Sequence: Synthetic peptide
  Seed: SQPEGKFSL (MAGC3_HUMAN)
SEPEGKFSP

SEQ ID NO: 98714 - protein, 9 aa, Artificial Sequence
  Description of Artificial Sequence: Synthetic peptide
  Seed: VAELVQFLL (MAGC3_HUMAN)
VAELVQFLW

SEQ ID NO: 98715 - protein, 10 aa, Artificial Sequence
  Description of Artificial Sequence: Synthetic peptide
  Seed: ATDKDYSAFH (MAGC3_HUMAN)
AADKDYSAFY

SEQ ID NO: 98716 - protein, 9 aa, Artificial Sequence
  Description of Artificial Sequence: Synthetic peptide
  Seed: HFYVFVNTL (MAGC3_HUMAN)
HPYVFVNTF

SEQ ID NO: 98717 - protein, 11 aa, Artificial Sequence
  Description of Artificial Sequence: Synthetic peptide
  Seed: HALPESESLPR (MAGC3_HUMAN)
HMLPESESLPR

SEQ ID NO: 98718 - protein, 9 aa, Artificial Sequence
  Description of Artificial Sequence: Synthetic peptide
  Seed: ISPQGPPQS (MAGC3_HUMAN)
IMPQGPPQV

SEQ ID NO: 98719 - protein, 9 aa, Artificial Sequence
  Description of Artificial Sequence: Synthetic peptide
  Seed: SQPEGKFSL (MAGC3_HUMAN)
SGPEGKFSM

SEQ ID NO: 98720 - protein, 9 aa, Artificial Sequence
  Description of Artificial Sequence: Synthetic peptide
  Seed: FHLGHLREV (MAGC3_HUMAN)
FGLGHLREI

SEQ ID NO: 98721 - protein, 10 aa, Artificial Sequence
  Description of Artificial Sequence: Synthetic peptide
  Seed: MDPDNHSYFF (MAGC3_HUMAN)
MFPDNHSYFY

SEQ ID NO: 98722 - protein, 9 aa, Artificial Sequence
  Description of Artificial Sequence: Synthetic peptide
  Seed: NVINTYTGY (MAGC3_HUMAN)
NSINTYTGR

SEQ ID NO: 98723 - protein, 11 aa, Artificial Sequence
  Description of Artificial Sequence: Synthetic peptide
  Seed: IIDTTDDATAM (MAGC3_HUMAN)
ITDTTDDATAF

SEQ ID NO: 98724 - protein, 10 aa, Artificial Sequence
  Description of Artificial Sequence: Synthetic peptide
  Seed: MLLPCHWVLD (MAGC3_HUMAN)
MILPCHWVLL

SEQ ID NO: 98725 - protein, 9 aa, Artificial Sequence
  Description of Artificial Sequence: Synthetic peptide
  Seed: HALPESESL (MAGC3_HUMAN)
HNLPESESY

SEQ ID NO: 98726 - protein, 10 aa, Artificial Sequence
  Description of Artificial Sequence: Synthetic peptide
  Seed: ILILSMIFIK (MAGC3_HUMAN)
ITILSMIFIK

SEQ ID NO: 98727 - protein, 9 aa, Artificial Sequence
  Description of Artificial Sequence: Synthetic peptide
  Seed: SEEEDTATW (MAGC3_HUMAN)
SMEEDTATL

SEQ ID NO: 98728 - protein, 10 aa, Artificial Sequence
  Description of Artificial Sequence: Synthetic peptide
  Seed: INTYTGYFPM (MAGC3_HUMAN)
IKTYTGYFPM

SEQ ID NO: 98729 - protein, 11 aa, Artificial Sequence
  Description of Artificial Sequence: Synthetic peptide
  Seed: SASPSVMSTNF (MAGC3_HUMAN)
SQSPSVMSTNF

SEQ ID NO: 98730 - protein, 9 aa, Artificial Sequence
  Description of Artificial Sequence: Synthetic peptide
  Seed: KLSSIIPSA (MAGC3_HUMAN)
KFSSIIPSK

SEQ ID NO: 98731 - protein, 9 aa, Artificial Sequence
  Description of Artificial Sequence: Synthetic peptide
  Seed: SEEEDTATW (MAGC3_HUMAN)
SLEEDTATY

SEQ ID NO: 98732 - protein, 10 aa, Artificial Sequence
  Description of Artificial Sequence: Synthetic peptide
  Seed: RPAREVLEFL (MAGC3_HUMAN)
RPAREVLEFF

SEQ ID NO: 98733 - protein, 9 aa, Artificial Sequence
  Description of Artificial Sequence: Synthetic peptide
  Seed: KDSDLPTWR (MAGC3_HUMAN)
KYSDLPTWR

SEQ ID NO: 98734 - protein, 8 aa, Artificial Sequence
  Description of Artificial Sequence: Synthetic peptide
  Seed: YMDALKDM (MAGC3_HUMAN)
YIDALKDL

SEQ ID NO: 98735 - protein, 9 aa, Artificial Sequence
  Description of Artificial Sequence: Synthetic peptide
  Seed: ASEEVIWEV (MAGC3_HUMAN)
AQEEVIWEL

SEQ ID NO: 98736 - protein, 8 aa, Artificial Sequence
  Description of Artificial Sequence: Synthetic peptide
  Seed: TTDDATAM (MAGC3_HUMAN)
TMDDATAL

SEQ ID NO: 98737 - protein, 9 aa, Artificial Sequence
  Description of Artificial Sequence: Synthetic peptide
  Seed: EFIELIFGI (MAGC3_HUMAN)
ESIELIFGM

SEQ ID NO: 98738 - protein, 9 aa, Artificial Sequence
  Description of Artificial Sequence: Synthetic peptide
  Seed: QTKEPVTKA (MAGC3_HUMAN)
QPKEPVTKT

SEQ ID NO: 98739 - protein, 11 aa, Artificial Sequence
  Description of Artificial Sequence: Synthetic peptide
  Seed: LSKLSSIIPSA (MAGC3_HUMAN)
LNKLSSIIPSI

SEQ ID NO: 98740 - protein, 11 aa, Artificial Sequence
  Description of Artificial Sequence: Synthetic peptide
  Seed: TTDDATAMASA (MAGC3_HUMAN)
TVDDATAMASL

SEQ ID NO: 98741 - protein, 10 aa, Artificial Sequence
  Description of Artificial Sequence: Synthetic peptide
  Seed: AMASASPSVM (MAGC3_HUMAN)
AYASASPSVF

SEQ ID NO: 98742 - protein, 10 aa, Artificial Sequence
  Description of Artificial Sequence: Synthetic peptide
  Seed: KKYKDYFPMI (MAGC3_HUMAN)
KIYKDYFPMF

SEQ ID NO: 98743 - protein, 10 aa, Artificial Sequence
  Description of Artificial Sequence: Synthetic peptide
  Seed: MNVINTYTGY (MAGC3_HUMAN)
MRVINTYTGF

SEQ ID NO: 98744 - protein, 9 aa, Artificial Sequence
  Description of Artificial Sequence: Synthetic peptide
  Seed: ASEEVIWEV (MAGC3_HUMAN)
AQEEVIWEI

SEQ ID NO: 98745 - protein, 11 aa, Artificial Sequence
  Description of Artificial Sequence: Synthetic peptide
  Seed: ATAMASASPSV (MAGC3_HUMAN)
ARAMASASPSV

SEQ ID NO: 98746 - protein, 11 aa, Artificial Sequence
  Description of Artificial Sequence: Synthetic peptide
  Seed: KVAELVQFLLL (MAGC3_HUMAN)
KMAELVQFLLP

SEQ ID NO: 98747 - protein, 10 aa, Artificial Sequence
  Description of Artificial Sequence: Synthetic peptide
  Seed: LLKYQAKEPL (MAGC3_HUMAN)
LEKYQAKEPY

SEQ ID NO: 98748 - protein, 10 aa, Artificial Sequence
  Description of Artificial Sequence: Synthetic peptide
  Seed: LPTWRRGTGY (MAGC3_HUMAN)
LMTWRRGTGY

SEQ ID NO: 98749 - protein, 9 aa, Artificial Sequence
  Description of Artificial Sequence: Synthetic peptide
  Seed: HLREVRLFL (MAGC3_HUMAN)
HQREVRLFL

SEQ ID NO: 98750 - protein, 9 aa, Artificial Sequence
  Description of Artificial Sequence: Synthetic peptide
  Seed: MPAAGMPPL (MAGC3_HUMAN)
MHAAGMPPM

SEQ ID NO: 98751 - protein, 9 aa, Artificial Sequence
  Description of Artificial Sequence: Synthetic peptide
  Seed: SALAGFADV (MAGC3_HUMAN)
SMLAGFADL

SEQ ID NO: 98752 - protein, 9 aa, Artificial Sequence
  Description of Artificial Sequence: Synthetic peptide
  Seed: MEDRAQAII (MAGC3_HUMAN)
MTDRAQAIF

SEQ ID NO: 98753 - protein, 9 aa, Artificial Sequence
  Description of Artificial Sequence: Synthetic peptide
  Seed: GPWSALAGF (MAGC3_HUMAN)
GVWSALAGY

SEQ ID NO: 98754 - protein, 9 aa, Artificial Sequence
  Description of Artificial Sequence: Synthetic peptide
  Seed: SEEVIWEVL (MAGC3_HUMAN)
SEEVIWEVW

SEQ ID NO: 98755 - protein, 10 aa, Artificial Sequence
  Description of Artificial Sequence: Synthetic peptide
  Seed: KKYKDYFPMI (MAGC3_HUMAN)
KVYKDYFPMF

SEQ ID NO: 98756 - protein, 10 aa, Artificial Sequence
  Description of Artificial Sequence: Synthetic peptide
  Seed: YALSPVVLPP (MAGC3_HUMAN)
YDLSPVVLPI

SEQ ID NO: 98757 - protein, 10 aa, Artificial Sequence
  Description of Artificial Sequence: Synthetic peptide
  Seed: YALDEKVAEL (MAGC3_HUMAN)
YPLDEKVAET

SEQ ID NO: 98758 - protein, 11 aa, Artificial Sequence
  Description of Artificial Sequence: Synthetic peptide
  Seed: YTGYFPMIFRK (MAGC3_HUMAN)
YYGYFPMIFRR

SEQ ID NO: 98759 - protein, 9 aa, Artificial Sequence
  Description of Artificial Sequence: Synthetic peptide
  Seed: AGFADVLSR (MAGC3_HUMAN)
AAFADVLSI

SEQ ID NO: 98760 - protein, 9 aa, Artificial Sequence
  Description of Artificial Sequence: Synthetic peptide
  Seed: FADVLSRLA (MAGC3_HUMAN)
FNDVLSRLM

SEQ ID NO: 98761 - protein, 9 aa, Artificial Sequence
  Description of Artificial Sequence: Synthetic peptide
  Seed: SASPSVMST (MAGC3_HUMAN)
SPSPSVMSS

SEQ ID NO: 98762 - protein, 9 aa, Artificial Sequence
  Description of Artificial Sequence: Synthetic peptide
  Seed: TGYFPMIFR (MAGC3_HUMAN)
TFYFPMIFK

SEQ ID NO: 98763 - protein, 9 aa, Artificial Sequence
  Description of Artificial Sequence: Synthetic peptide
  Seed: VIWEVLSAI (MAGC3_HUMAN)
VTWEVLSAV

SEQ ID NO: 98764 - protein, 9 aa, Artificial Sequence
  Description of Artificial Sequence: Synthetic peptide
  Seed: IQRPAREVL (MAGC3_HUMAN)
ITRPAREVF

SEQ ID NO: 98765 - protein, 11 aa, Artificial Sequence
  Description of Artificial Sequence: Synthetic peptide
  Seed: ILFGISLTEVD (MAGC3_HUMAN)
ILFGISLTEVL

SEQ ID NO: 98766 - protein, 10 aa, Artificial Sequence
  Description of Artificial Sequence: Synthetic peptide
  Seed: TAMASASPSV (MAGC3_HUMAN)
TGMASASPSV

SEQ ID NO: 98767 - protein, 11 aa, Artificial Sequence
  Description of Artificial Sequence: Synthetic peptide
  Seed: EVLSAIGPIQR (MAGC3_HUMAN)
ESLSAIGPIQR

SEQ ID NO: 98768 - protein, 9 aa, Artificial Sequence
  Description of Artificial Sequence: Synthetic peptide
  Seed: KDMEDRAQA (MAGC3_HUMAN)
KEMEDRAQC

SEQ ID NO: 98769 - protein, 9 aa, Artificial Sequence
  Description of Artificial Sequence: Synthetic peptide
  Seed: KLSSIIPSA (MAGC3_HUMAN)
KNSSIIPSK

SEQ ID NO: 98770 - protein, 9 aa, Artificial Sequence
  Description of Artificial Sequence: Synthetic peptide
  Seed: KAHEFIELI (MAGC3_HUMAN)
KSHEFIELV

SEQ ID NO: 98771 - protein, 9 aa, Artificial Sequence
  Description of Artificial Sequence: Synthetic peptide
  Seed: FVNTLDLTC (MAGC3_HUMAN)
FTNTLDLTM

SEQ ID NO: 98772 - protein, 10 aa, Artificial Sequence
  Description of Artificial Sequence: Synthetic peptide
  Seed: SQPEGKFSLR (MAGC3_HUMAN)
SSPEGKFSLK

SEQ ID NO: 98773 - protein, 9 aa, Artificial Sequence
  Description of Artificial Sequence: Synthetic peptide
  Seed: MPAAGMPPL (MAGC3_HUMAN)
MSAAGMPPY

SEQ ID NO: 98774 - protein, 9 aa, Artificial Sequence
  Description of Artificial Sequence: Synthetic peptide
  Seed: QDWPLNEKR (MAGC3_HUMAN)
QVWPLNEKK

SEQ ID NO: 98775 - protein, 9 aa, Artificial Sequence
  Description of Artificial Sequence: Synthetic peptide
  Seed: SIIPSAFPS (MAGC3_HUMAN)
SLIPSAFPI

SEQ ID NO: 98776 - protein, 10 aa, Artificial Sequence
  Description of Artificial Sequence: Synthetic peptide
  Seed: EIPPQGPPKI (MAGC3_HUMAN)
EMPPQGPPKL

SEQ ID NO: 98777 - protein, 9 aa, Artificial Sequence
  Description of Artificial Sequence: Synthetic peptide
  Seed: SPLDSCSSP (MAGC3_HUMAN)
SPLDSCSSA

SEQ ID NO: 98778 - protein, 9 aa, Artificial Sequence
  Description of Artificial Sequence: Synthetic peptide
  Seed: LKYQAKEPL (MAGC3_HUMAN)
LMYQAKEPM

SEQ ID NO: 98779 - protein, 10 aa, Artificial Sequence
  Description of Artificial Sequence: Synthetic peptide
  Seed: FSDGSLGQWV (MAGC3_HUMAN)
FLDGSLGQWA

SEQ ID NO: 98780 - protein, 9 aa, Artificial Sequence
  Description of Artificial Sequence: Synthetic peptide
  Seed: HALPESESL (MAGC3_HUMAN)
HWLPESESF

SEQ ID NO: 98781 - protein, 9 aa, Artificial Sequence
  Description of Artificial Sequence: Synthetic peptide
  Seed: HLREVRLFL (MAGC3_HUMAN)
HWREVRLFV

SEQ ID NO: 98782 - protein, 10 aa, Artificial Sequence
  Description of Artificial Sequence: Synthetic peptide
  Seed: RSAEGSVLDL (MAGC3_HUMAN)
RTAEGSVLDW

SEQ ID NO: 98783 - protein, 10 aa, Artificial Sequence
  Description of Artificial Sequence: Synthetic peptide
  Seed: TYTGYFPMIF (MAGC3_HUMAN)
TYTGYFPMIW

SEQ ID NO: 98784 - protein, 11 aa, Artificial Sequence
  Description of Artificial Sequence: Synthetic peptide
  Seed: TTDDATAMASA (MAGC3_HUMAN)
TSDDATAMASL

SEQ ID NO: 98785 - protein, 9 aa, Artificial Sequence
  Description of Artificial Sequence: Synthetic peptide
  Seed: FEDTLDLTY (MAGC3_HUMAN)
FSDTLDLTY

SEQ ID NO: 98786 - protein, 9 aa, Artificial Sequence
  Description of Artificial Sequence: Synthetic peptide
  Seed: SDLHFGSQP (MAGC3_HUMAN)
SELHFGSQA

SEQ ID NO: 98787 - protein, 9 aa, Artificial Sequence
  Description of Artificial Sequence: Synthetic peptide
  Seed: LKYQTKEPV (MAGC3_HUMAN)
LMYQTKEPM

SEQ ID NO: 98788 - protein, 10 aa, Artificial Sequence
  Description of Artificial Sequence: Synthetic peptide
  Seed: HLREVRLFLR (MAGC3_HUMAN)
HGREVRLFLR

SEQ ID NO: 98789 - protein, 10 aa, Artificial Sequence
  Description of Artificial Sequence: Synthetic peptide
  Seed: INTYTGYFPM (MAGC3_HUMAN)
IDTYTGYFPY

SEQ ID NO: 98790 - protein, 10 aa, Artificial Sequence
  Description of Artificial Sequence: Synthetic peptide
  Seed: YQAKEPLTRA (MAGC3_HUMAN)
YLAKEPLTRL

SEQ ID NO: 98791 - protein, 11 aa, Artificial Sequence
  Description of Artificial Sequence: Synthetic peptide
  Seed: TTDDATAMASA (MAGC3_HUMAN)
TTDDATAMASI

SEQ ID NO: 98792 - protein, 9 aa, Artificial Sequence
  Description of Artificial Sequence: Synthetic peptide
  Seed: LSGSPGLQL (MAGC3_HUMAN)
LIGSPGLQW

SEQ ID NO: 98793 - protein, 9 aa, Artificial Sequence
  Description of Artificial Sequence: Synthetic peptide
  Seed: FHLGHLREV (MAGC3_HUMAN)
FQLGHLREV

SEQ ID NO: 98794 - protein, 9 aa, Artificial Sequence
  Description of Artificial Sequence: Synthetic peptide
  Seed: YTGYFPMIF (MAGC3_HUMAN)
YPGYFPMIL

SEQ ID NO: 98795 - protein, 10 aa, Artificial Sequence
  Description of Artificial Sequence: Synthetic peptide
  Seed: TGYFPMIFRK (MAGC3_HUMAN)
TTYFPMIFRD

SEQ ID NO: 98796 - protein, 9 aa, Artificial Sequence
  Description of Artificial Sequence: Synthetic peptide
  Seed: SLVLCPTYF (MAGC3_HUMAN)
SSVLCPTYW

SEQ ID NO: 98797 - protein, 9 aa, Artificial Sequence
  Description of Artificial Sequence: Synthetic peptide
  Seed: YALDEKVAE (MAGC3_HUMAN)
YALDEKVAM

SEQ ID NO: 98798 - protein, 9 aa, Artificial Sequence
  Description of Artificial Sequence: Synthetic peptide
  Seed: MPAAGMPPL (MAGC3_HUMAN)
MTAAGMPPL

SEQ ID NO: 98799 - protein, 9 aa, Artificial Sequence
  Description of Artificial Sequence: Synthetic peptide
  Seed: WVKNTCATY (MAGC3_HUMAN)
WFKNTCATY

SEQ ID NO: 98800 - protein, 9 aa, Artificial Sequence
  Description of Artificial Sequence: Synthetic peptide
  Seed: AIGPIQRPA (MAGC3_HUMAN)
ALGPIQRPV

SEQ ID NO: 98801 - protein, 9 aa, Artificial Sequence
  Description of Artificial Sequence: Synthetic peptide
  Seed: IFGKAHEFI (MAGC3_HUMAN)
IFGKAHEFL

SEQ ID NO: 98802 - protein, 9 aa, Artificial Sequence
  Description of Artificial Sequence: Synthetic peptide
  Seed: KKYKDYFPM (MAGC3_HUMAN)
KEYKDYFPM

SEQ ID NO: 98803 - protein, 9 aa, Artificial Sequence
  Description of Artificial Sequence: Synthetic peptide
  Seed: LVLCPTYFK (MAGC3_HUMAN)
LSLCPTYFK

SEQ ID NO: 98804 - protein, 9 aa, Artificial Sequence
  Description of Artificial Sequence: Synthetic peptide
  Seed: GFADVLSRL (MAGC3_HUMAN)
GIADVLSRV

SEQ ID NO: 98805 - protein, 10 aa, Artificial Sequence
  Description of Artificial Sequence: Synthetic peptide
  Seed: MDPDNHSYFF (MAGC3_HUMAN)
MTPDNHSYFL

SEQ ID NO: 98806 - protein, 9 aa, Artificial Sequence
  Description of Artificial Sequence: Synthetic peptide
  Seed: IIDTTDDAT (MAGC3_HUMAN)
IMDTTDDAM

SEQ ID NO: 98807 - protein, 9 aa, Artificial Sequence
  Description of Artificial Sequence: Synthetic peptide
  Seed: CATYALSPV (MAGC3_HUMAN)
CATYALSPF

SEQ ID NO: 98808 - protein, 9 aa, Artificial Sequence
  Description of Artificial Sequence: Synthetic peptide
  Seed: NAIGPWSAL (MAGC3_HUMAN)
NSIGPWSAL

SEQ ID NO: 98809 - protein, 11 aa, Artificial Sequence
  Description of Artificial Sequence: Synthetic peptide
  Seed: ALWESEGPEAF (MAGC3_HUMAN)
AAWESEGPEAL

SEQ ID NO: 98810 - protein, 9 aa, Artificial Sequence
  Description of Artificial Sequence: Synthetic peptide
  Seed: MIFRKAREF (MAGC3_HUMAN)
MLFRKAREV

SEQ ID NO: 98811 - protein, 10 aa, Artificial Sequence
  Description of Artificial Sequence: Synthetic peptide
  Seed: MNVINTYTGY (MAGC3_HUMAN)
MGVINTYTGY

SEQ ID NO: 98812 - protein, 9 aa, Artificial Sequence
  Description of Artificial Sequence: Synthetic peptide
  Seed: KGSCVPEEV (MAGC3_HUMAN)
KISCVPEEW

SEQ ID NO: 98813 - protein, 9 aa, Artificial Sequence
  Description of Artificial Sequence: Synthetic peptide
  Seed: WEVLNAIGP (MAGC3_HUMAN)
WEVLNAIGF

SEQ ID NO: 98814 - protein, 9 aa, Artificial Sequence
  Description of Artificial Sequence: Synthetic peptide
  Seed: ALDEKVAEL (MAGC3_HUMAN)
AMDEKVAEM

SEQ ID NO: 98815 - protein, 10 aa, Artificial Sequence
  Description of Artificial Sequence: Synthetic peptide
  Seed: MDSLVLCPTY (MAGC3_HUMAN)
MASLVLCPTY

SEQ ID NO: 98816 - protein, 9 aa, Artificial Sequence
  Description of Artificial Sequence: Synthetic peptide
  Seed: FPSWYMDAL (MAGC3_HUMAN)
FHSWYMDAL

SEQ ID NO: 98817 - protein, 9 aa, Artificial Sequence
  Description of Artificial Sequence: Synthetic peptide
  Seed: SEEEDTATW (MAGC3_HUMAN)
SQEEDTATY

SEQ ID NO: 98818 - protein, 10 aa, Artificial Sequence
  Description of Artificial Sequence: Synthetic peptide
  Seed: MDPDNHSYFF (MAGC3_HUMAN)
MSPDNHSYFL

SEQ ID NO: 98819 - protein, 8 aa, Artificial Sequence
  Description of Artificial Sequence: Synthetic peptide
  Seed: MASASPSV (MAGC3_HUMAN)
MASASPSF

SEQ ID NO: 98820 - protein, 9 aa, Artificial Sequence
  Description of Artificial Sequence: Synthetic peptide
  Seed: QRMDSLVLC (MAGC3_HUMAN)
QHMDSLVLV

SEQ ID NO: 98821 - protein, 11 aa, Artificial Sequence
  Description of Artificial Sequence: Synthetic peptide
  Seed: INTYTGYFPMI (MAGC3_HUMAN)
IYTYTGYFPML

SEQ ID NO: 98822 - protein, 10 aa, Artificial Sequence
  Description of Artificial Sequence: Synthetic peptide
  Seed: FKLWRTLSGS (MAGC3_HUMAN)
FHLWRTLSGI

SEQ ID NO: 98823 - protein, 9 aa, Artificial Sequence
  Description of Artificial Sequence: Synthetic peptide
  Seed: VINTYTGYF (MAGC3_HUMAN)
VMNTYTGYY

SEQ ID NO: 98824 - protein, 10 aa, Artificial Sequence
  Description of Artificial Sequence: Synthetic peptide
  Seed: EKVAELVQFL (MAGC3_HUMAN)
ERVAELVQFL

SEQ ID NO: 98825 - protein, 10 aa, Artificial Sequence
  Description of Artificial Sequence: Synthetic peptide
  Seed: SAFHLGHLRE (MAGC3_HUMAN)
SMFHLGHLRK

SEQ ID NO: 98826 - protein, 9 aa, Artificial Sequence
  Description of Artificial Sequence: Synthetic peptide
  Seed: QTKEPVTKA (MAGC3_HUMAN)
QPKEPVTKL

SEQ ID NO: 98827 - protein, 9 aa, Artificial Sequence
  Description of Artificial Sequence: Synthetic peptide
  Seed: YKDYFPMIF (MAGC3_HUMAN)
YHDYFPMII

SEQ ID NO: 98828 - protein, 10 aa, Artificial Sequence
  Description of Artificial Sequence: Synthetic peptide
  Seed: SKLSSIIPSA (MAGC3_HUMAN)
SRLSSIIPSM

SEQ ID NO: 98829 - protein, 9 aa, Artificial Sequence
  Description of Artificial Sequence: Synthetic peptide
  Seed: NTYTGYFPM (MAGC3_HUMAN)
NLYTGYFPV

SEQ ID NO: 98830 - protein, 9 aa, Artificial Sequence
  Description of Artificial Sequence: Synthetic peptide
  Seed: SQPEGKFSL (MAGC3_HUMAN)
SFPEGKFSW

SEQ ID NO: 98831 - protein, 10 aa, Artificial Sequence
  Description of Artificial Sequence: Synthetic peptide
  Seed: REVLEFLSKL (MAGC3_HUMAN)
RPVLEFLSKV

SEQ ID NO: 98832 - protein, 9 aa, Artificial Sequence
  Description of Artificial Sequence: Synthetic peptide
  Seed: NAIGPWSAL (MAGC3_HUMAN)
NMIGPWSAV

SEQ ID NO: 98833 - protein, 9 aa, Artificial Sequence
  Description of Artificial Sequence: Synthetic peptide
  Seed: KAHEFIELI (MAGC3_HUMAN)
KTHEFIELL

SEQ ID NO: 98834 - protein, 9 aa, Artificial Sequence
  Description of Artificial Sequence: Synthetic peptide
  Seed: SESLPRYAL (MAGC3_HUMAN)
SESLPRYAY

SEQ ID NO: 98835 - protein, 10 aa, Artificial Sequence
  Description of Artificial Sequence: Synthetic peptide
  Seed: SSEEEDTATW (MAGC3_HUMAN)
SMEEEDTATY

SEQ ID NO: 98836 - protein, 10 aa, Artificial Sequence
  Description of Artificial Sequence: Synthetic peptide
  Seed: MLLPCHWVLD (MAGC3_HUMAN)
MTLPCHWVLV

SEQ ID NO: 98837 - protein, 9 aa, Artificial Sequence
  Description of Artificial Sequence: Synthetic peptide
  Seed: HLREVRLFL (MAGC3_HUMAN)
HSREVRLFT

SEQ ID NO: 98838 - protein, 10 aa, Artificial Sequence
  Description of Artificial Sequence: Synthetic peptide
  Seed: VLCPTYFKLW (MAGC3_HUMAN)
VSCPTYFKLF

SEQ ID NO: 98839 - protein, 9 aa, Artificial Sequence
  Description of Artificial Sequence: Synthetic peptide
  Seed: WESEGPEAF (MAGC3_HUMAN)
WESEGPEAW

SEQ ID NO: 98840 - protein, 9 aa, Artificial Sequence
  Description of Artificial Sequence: Synthetic peptide
  Seed: IIPSAFPSW (MAGC3_HUMAN)
IAPSAFPSI

SEQ ID NO: 98841 - protein, 9 aa, Artificial Sequence
  Description of Artificial Sequence: Synthetic peptide
  Seed: EVLSAIGPI (MAGC3_HUMAN)
EVLSAIGPR

SEQ ID NO: 98842 - protein, 9 aa, Artificial Sequence
  Description of Artificial Sequence: Synthetic peptide
  Seed: HLREVRLFL (MAGC3_HUMAN)
HTREVRLFM

SEQ ID NO: 98843 - protein, 9 aa, Artificial Sequence
  Description of Artificial Sequence: Synthetic peptide
  Seed: IPPQGPPKI (MAGC3_HUMAN)
IQPQGPPKY

SEQ ID NO: 98844 - protein, 11 aa, Artificial Sequence
  Description of Artificial Sequence: Synthetic peptide
  Seed: NTYTGYFPMIF (MAGC3_HUMAN)
NYYTGYFPMIW

SEQ ID NO: 98845 - protein, 10 aa, Artificial Sequence
  Description of Artificial Sequence: Synthetic peptide
  Seed: MQMNVINTYT (MAGC3_HUMAN)
MSMNVINTYV

SEQ ID NO: 98846 - protein, 9 aa, Artificial Sequence
  Description of Artificial Sequence: Synthetic peptide
  Seed: AEMLTTVIK (MAGC3_HUMAN)
AEMLTTVIT

SEQ ID NO: 98847 - protein, 11 aa, Artificial Sequence
  Description of Artificial Sequence: Synthetic peptide
  Seed: MQMNVINTYTG (MAGC3_HUMAN)
MTMNVINTYTY

SEQ ID NO: 98848 - protein, 9 aa, Artificial Sequence
  Description of Artificial Sequence: Synthetic peptide
  Seed: KVAELVQFL (MAGC3_HUMAN)
KNAELVQFY

SEQ ID NO: 98849 - protein, 9 aa, Artificial Sequence
  Description of Artificial Sequence: Synthetic peptide
  Seed: TTDDATAMA (MAGC3_HUMAN)
TMDDATAMY

SEQ ID NO: 98850 - protein, 9 aa, Artificial Sequence
  Description of Artificial Sequence: Synthetic peptide
  Seed: IIPSAFPSW (MAGC3_HUMAN)
IFPSAFPSW

SEQ ID NO: 98851 - protein, 10 aa, Artificial Sequence
  Description of Artificial Sequence: Synthetic peptide
  Seed: IKKYKDYFPM (MAGC3_HUMAN)
IEKYKDYFPY

SEQ ID NO: 98852 - protein, 9 aa, Artificial Sequence
  Description of Artificial Sequence: Synthetic peptide
  Seed: WYMDALKDM (MAGC3_HUMAN)
WFMDALKDF

SEQ ID NO: 98853 - protein, 10 aa, Artificial Sequence
  Description of Artificial Sequence: Synthetic peptide
  Seed: KLVQFLLLKY (MAGC3_HUMAN)
KEVQFLLLKK

SEQ ID NO: 98854 - protein, 9 aa, Artificial Sequence
  Description of Artificial Sequence: Synthetic peptide
  Seed: IQRPAREVL (MAGC3_HUMAN)
IKRPAREVF

SEQ ID NO: 98855 - protein, 9 aa, Artificial Sequence
  Description of Artificial Sequence: Synthetic peptide
  Seed: HLREVRLFL (MAGC3_HUMAN)
HTREVRLFQ

SEQ ID NO: 98856 - protein, 10 aa, Artificial Sequence
  Description of Artificial Sequence: Synthetic peptide
  Seed: TAMASASPSV (MAGC3_HUMAN)
TWMASASPSV

SEQ ID NO: 98857 - protein, 10 aa, Artificial Sequence
  Description of Artificial Sequence: Synthetic peptide
  Seed: CASEEVIWEV (MAGC3_HUMAN)
CMSEEVIWEL

SEQ ID NO: 98858 - protein, 10 aa, Artificial Sequence
  Description of Artificial Sequence: Synthetic peptide
  Seed: VTKAEMLTTV (MAGC3_HUMAN)
VMKAEMLTTM

SEQ ID NO: 98859 - protein, 9 aa, Artificial Sequence
  Description of Artificial Sequence: Synthetic peptide
  Seed: TEASPQQKK (MAGC3_HUMAN)
TVASPQQKL

SEQ ID NO: 98860 - protein, 10 aa, Artificial Sequence
  Description of Artificial Sequence: Synthetic peptide
  Seed: YSAFHLGHLR (MAGC3_HUMAN)
YIAFHLGHLK

SEQ ID NO: 98861 - protein, 10 aa, Artificial Sequence
  Description of Artificial Sequence: Synthetic peptide
  Seed: MIFGKAHEFI (MAGC3_HUMAN)
MLFGKAHEFM

SEQ ID NO: 98862 - protein, 9 aa, Artificial Sequence
  Description of Artificial Sequence: Synthetic peptide
  Seed: DYFPMIFGK (MAGC3_HUMAN)
DTFPMIFGK

SEQ ID NO: 98863 - protein, 9 aa, Artificial Sequence
  Description of Artificial Sequence: Synthetic peptide
  Seed: MLLPCHWVL (MAGC3_HUMAN)
MGLPCHWVW

SEQ ID NO: 98864 - protein, 9 aa, Artificial Sequence
  Description of Artificial Sequence: Synthetic peptide
  Seed: QGMPQNRLL (MAGC3_HUMAN)
QSMPQNRLF

SEQ ID NO: 98865 - protein, 11 aa, Artificial Sequence
  Description of Artificial Sequence: Synthetic peptide
  Seed: FIELIFGIALT (MAGC3_HUMAN)
FNELIFGIALL

SEQ ID NO: 98866 - protein, 10 aa, Artificial Sequence
  Description of Artificial Sequence: Synthetic peptide
  Seed: LILILSMIFI (MAGC3_HUMAN)
LHLILSMIFV

SEQ ID NO: 98867 - protein, 10 aa, Artificial Sequence
  Description of Artificial Sequence: Synthetic peptide
  Seed: YALSPVVLPP (MAGC3_HUMAN)
YNLSPVVLPL

SEQ ID NO: 98868 - protein, 9 aa, Artificial Sequence
  Description of Artificial Sequence: Synthetic peptide
  Seed: SASPSVMST (MAGC3_HUMAN)
SASPSVMSV

SEQ ID NO: 98869 - protein, 10 aa, Artificial Sequence
  Description of Artificial Sequence: Synthetic peptide
  Seed: ATYALSPVVL (MAGC3_HUMAN)
AYYALSPVVM

SEQ ID NO: 98870 - protein, 11 aa, Artificial Sequence
  Description of Artificial Sequence: Synthetic peptide
  Seed: SIIPSAFPSWY (MAGC3_HUMAN)
SQIPSAFPSWY

SEQ ID NO: 98871 - protein, 9 aa, Artificial Sequence
  Description of Artificial Sequence: Synthetic peptide
  Seed: AEMLTTVIK (MAGC3_HUMAN)
AEMLTTVIF

SEQ ID NO: 98872 - protein, 9 aa, Artificial Sequence
  Description of Artificial Sequence: Synthetic peptide
  Seed: AMASASPSV (MAGC3_HUMAN)
ASASASPSL

SEQ ID NO: 98873 - protein, 9 aa, Artificial Sequence
  Description of Artificial Sequence: Synthetic peptide
  Seed: VLPPQPQPR (MAGC3_HUMAN)
VLPPQPQPL

SEQ ID NO: 98874 - protein, 9 aa, Artificial Sequence
  Description of Artificial Sequence: Synthetic peptide
  Seed: KQREEPQDW (MAGC3_HUMAN)
KEREEPQDW

SEQ ID NO: 98875 - protein, 9 aa, Artificial Sequence
  Description of Artificial Sequence: Synthetic peptide
  Seed: WRRGTGYTL (MAGC3_HUMAN)
WQRGTGYTH

SEQ ID NO: 98876 - protein, 9 aa, Artificial Sequence
  Description of Artificial Sequence: Synthetic peptide
  Seed: CPTYFKLWR (MAGC3_HUMAN)
CMTYFKLWR

SEQ ID NO: 98877 - protein, 9 aa, Artificial Sequence
  Description of Artificial Sequence: Synthetic peptide
  Seed: FEDTLDLTY (MAGC3_HUMAN)
FLDTLDLTF

SEQ ID NO: 98878 - protein, 10 aa, Artificial Sequence
  Description of Artificial Sequence: Synthetic peptide
  Seed: AFPSWYMDAL (MAGC3_HUMAN)
AFPSWYMDAF

SEQ ID NO: 98879 - protein, 9 aa, Artificial Sequence
  Description of Artificial Sequence: Synthetic peptide
  Seed: FSLRRAVSV (MAGC3_HUMAN)
FALRRAVSL

SEQ ID NO: 98880 - protein, 10 aa, Artificial Sequence
  Description of Artificial Sequence: Synthetic peptide
  Seed: KYQTKEPVTK (MAGC3_HUMAN)
KTQTKEPVTK

SEQ ID NO: 98881 - protein, 9 aa, Artificial Sequence
  Description of Artificial Sequence: Synthetic peptide
  Seed: YFFEDTLDL (MAGC3_HUMAN)
YVFEDTLDI

SEQ ID NO: 98882 - protein, 9 aa, Artificial Sequence
  Description of Artificial Sequence: Synthetic peptide
  Seed: SLPESEPLF (MAGC3_HUMAN)
STPESEPLW

SEQ ID NO: 98883 - protein, 10 aa, Artificial Sequence
  Description of Artificial Sequence: Synthetic peptide
  Seed: SIIPSAFPSW (MAGC3_HUMAN)
SLIPSAFPSW

SEQ ID NO: 98884 - protein, 10 aa, Artificial Sequence
  Description of Artificial Sequence: Synthetic peptide
  Seed: VLSAIGPIQR (MAGC3_HUMAN)
VSSAIGPIQK

SEQ ID NO: 98885 - protein, 9 aa, Artificial Sequence
  Description of Artificial Sequence: Synthetic peptide
  Seed: SAFHLGHLR (MAGC3_HUMAN)
SFFHLGHLR

SEQ ID NO: 98886 - protein, 10 aa, Artificial Sequence
  Description of Artificial Sequence: Synthetic peptide
  Seed: MLLPCHWVLD (MAGC3_HUMAN)
MLLPCHWVLV

SEQ ID NO: 98887 - protein, 9 aa, Artificial Sequence
  Description of Artificial Sequence: Synthetic peptide
  Seed: LSGSPGLQL (MAGC3_HUMAN)
LIGSPGLQF

SEQ ID NO: 98888 - protein, 10 aa, Artificial Sequence
  Description of Artificial Sequence: Synthetic peptide
  Seed: EAFCEESGLR (MAGC3_HUMAN)
EMFCEESGLR

SEQ ID NO: 98889 - protein, 9 aa, Artificial Sequence
  Description of Artificial Sequence: Synthetic peptide
  Seed: AVSPGKRLW (MAGC3_HUMAN)
AISPGKRLY

SEQ ID NO: 98890 - protein, 10 aa, Artificial Sequence
  Description of Artificial Sequence: Synthetic peptide
  Seed: REVRLFLRGG (MAGC3_HUMAN)
RRVRLFLRGA

SEQ ID NO: 98891 - protein, 9 aa, Artificial Sequence
  Description of Artificial Sequence: Synthetic peptide
  Seed: VIKKYKDYF (MAGC3_HUMAN)
VQKKYKDYF

SEQ ID NO: 98892 - protein, 10 aa, Artificial Sequence
  Description of Artificial Sequence: Synthetic peptide
  Seed: ILILSVIFIK (MAGC3_HUMAN)
ILILSVIFIR

SEQ ID NO: 98893 - protein, 10 aa, Artificial Sequence
  Description of Artificial Sequence: Synthetic peptide
  Seed: SIIPSAFPSW (MAGC3_HUMAN)
SVIPSAFPSF

SEQ ID NO: 98894 - protein, 9 aa, Artificial Sequence
  Description of Artificial Sequence: Synthetic peptide
  Seed: MQMNVINTY (MAGC3_HUMAN)
MTMNVINTW

SEQ ID NO: 98895 - protein, 9 aa, Artificial Sequence
  Description of Artificial Sequence: Synthetic peptide
  Seed: KYKDYFPMI (MAGC3_HUMAN)
KWKDYFPMM

SEQ ID NO: 98896 - protein, 9 aa, Artificial Sequence
  Description of Artificial Sequence: Synthetic peptide
  Seed: FSLRRAVSV (MAGC3_HUMAN)
FMLRRAVSM

SEQ ID NO: 98897 - protein, 10 aa, Artificial Sequence
  Description of Artificial Sequence: Synthetic peptide
  Seed: LANPQGLAGH (MAGC3_HUMAN)
LANPQGLAGY

SEQ ID NO: 98898 - protein, 9 aa, Artificial Sequence
  Description of Artificial Sequence: Synthetic peptide
  Seed: VIWEVLSAI (MAGC3_HUMAN)
VMWEVLSAS

SEQ ID NO: 98899 - protein, 11 aa, Artificial Sequence
  Description of Artificial Sequence: Synthetic peptide
  Seed: DYSAFHLGHLR (MAGC3_HUMAN)
DTSAFHLGHLK

SEQ ID NO: 98900 - protein, 10 aa, Artificial Sequence
  Description of Artificial Sequence: Synthetic peptide
  Seed: TEVDPDHFYV (MAGC3_HUMAN)
TSVDPDHFYV

SEQ ID NO: 98901 - protein, 9 aa, Artificial Sequence
  Description of Artificial Sequence: Synthetic peptide
  Seed: MIFGKAHEF (MAGC3_HUMAN)
MSFGKAHEF

SEQ ID NO: 98902 - protein, 10 aa, Artificial Sequence
  Description of Artificial Sequence: Synthetic peptide
  Seed: KDMEDRAQAI (MAGC3_HUMAN)
KEMEDRAQAM

SEQ ID NO: 98903 - protein, 10 aa, Artificial Sequence
  Description of Artificial Sequence: Synthetic peptide
  Seed: YALDEKVAEL (MAGC3_HUMAN)
YGLDEKVAET

SEQ ID NO: 98904 - protein, 9 aa, Artificial Sequence
  Description of Artificial Sequence: Synthetic peptide
  Seed: ASEEVIWEV (MAGC3_HUMAN)
AAEEVIWEW

SEQ ID NO: 98905 - protein, 9 aa, Artificial Sequence
  Description of Artificial Sequence: Synthetic peptide
  Seed: YFFEDTLDL (MAGC3_HUMAN)
YPFEDTLDA

SEQ ID NO: 98906 - protein, 9 aa, Artificial Sequence
  Description of Artificial Sequence: Synthetic peptide
  Seed: HFYVFVNTL (MAGC3_HUMAN)
HHYVFVNTV

SEQ ID NO: 98907 - protein, 9 aa, Artificial Sequence
  Description of Artificial Sequence: Synthetic peptide
  Seed: KAHEFIELI (MAGC3_HUMAN)
KVHEFIELM

SEQ ID NO: 98908 - protein, 9 aa, Artificial Sequence
  Description of Artificial Sequence: Synthetic peptide
  Seed: DYSAFHLGH (MAGC3_HUMAN)
DNSAFHLGR

SEQ ID NO: 98909 - protein, 10 aa, Artificial Sequence
  Description of Artificial Sequence: Synthetic peptide
  Seed: MDSLVLCPTY (MAGC3_HUMAN)
MTSLVLCPTW

SEQ ID NO: 98910 - protein, 9 aa, Artificial Sequence
  Description of Artificial Sequence: Synthetic peptide
  Seed: VLCPTYFKL (MAGC3_HUMAN)
VWCPTYFKL

SEQ ID NO: 98911 - protein, 10 aa, Artificial Sequence
  Description of Artificial Sequence: Synthetic peptide
  Seed: KLSSIIPSAF (MAGC3_HUMAN)
KLSSIIPSAR

SEQ ID NO: 98912 - protein, 9 aa, Artificial Sequence
  Description of Artificial Sequence: Synthetic peptide
  Seed: SEEEDTATW (MAGC3_HUMAN)
SAEEDTATY

SEQ ID NO: 98913 - protein, 10 aa, Artificial Sequence
  Description of Artificial Sequence: Synthetic peptide
  Seed: EMQMNVINTY (MAGC3_HUMAN)
EAQMNVINTY

SEQ ID NO: 98914 - protein, 9 aa, Artificial Sequence
  Description of Artificial Sequence: Synthetic peptide
  Seed: IIPSAFPSW (MAGC3_HUMAN)
IVPSAFPSF

SEQ ID NO: 98915 - protein, 9 aa, Artificial Sequence
  Description of Artificial Sequence: Synthetic peptide
  Seed: KYKDYFPMI (MAGC3_HUMAN)
KVKDYFPMF

SEQ ID NO: 98916 - protein, 9 aa, Artificial Sequence
  Description of Artificial Sequence: Synthetic peptide
  Seed: KLVQFLLLK (MAGC3_HUMAN)
KNVQFLLLY

SEQ ID NO: 98917 - protein, 9 aa, Artificial Sequence
  Description of Artificial Sequence: Synthetic peptide
  Seed: ATDKDYSAF (MAGC3_HUMAN)
ATDKDYSAV

SEQ ID NO: 98918 - protein, 11 aa, Artificial Sequence
  Description of Artificial Sequence: Synthetic peptide
  Seed: ALWESEGPEAF (MAGC3_HUMAN)
AQWESEGPEAM

SEQ ID NO: 98919 - protein, 9 aa, Artificial Sequence
  Description of Artificial Sequence: Synthetic peptide
  Seed: AMASASPSV (MAGC3_HUMAN)
AVASASPSL

SEQ ID NO: 98920 - protein, 10 aa, Artificial Sequence
  Description of Artificial Sequence: Synthetic peptide
  Seed: KVAELVQFLL (MAGC3_HUMAN)
KMAELVQFLI

SEQ ID NO: 98921 - protein, 10 aa, Artificial Sequence
  Description of Artificial Sequence: Synthetic peptide
  Seed: YALDEKVAEL (MAGC3_HUMAN)
YMLDEKVAEI

SEQ ID NO: 98922 - protein, 9 aa, Artificial Sequence
  Description of Artificial Sequence: Synthetic peptide
  Seed: EVLSAIGPI (MAGC3_HUMAN)
EVLSAIGPA

SEQ ID NO: 98923 - protein, 9 aa, Artificial Sequence
  Description of Artificial Sequence: Synthetic peptide
  Seed: QTKEPVTKA (MAGC3_HUMAN)
QQKEPVTKK

SEQ ID NO: 98924 - protein, 11 aa, Artificial Sequence
  Description of Artificial Sequence: Synthetic peptide
  Seed: TTDDATAMASA (MAGC3_HUMAN)
TGDDATAMASF

SEQ ID NO: 98925 - protein, 9 aa, Artificial Sequence
  Description of Artificial Sequence: Synthetic peptide
  Seed: KYKDYFPMI (MAGC3_HUMAN)
KTKDYFPMY

SEQ ID NO: 98926 - protein, 9 aa, Artificial Sequence
  Description of Artificial Sequence: Synthetic peptide
  Seed: LSRLALWES (MAGC3_HUMAN)
LSRLALWEK

SEQ ID NO: 98927 - protein, 11 aa, Artificial Sequence
  Description of Artificial Sequence: Synthetic peptide
  Seed: YALDEKVAELV (MAGC3_HUMAN)
YMLDEKVAELM

SEQ ID NO: 98928 - protein, 10 aa, Artificial Sequence
  Description of Artificial Sequence: Synthetic peptide
  Seed: LDSCSSPLLW (MAGC3_HUMAN)
LESCSSPLLF

SEQ ID NO: 98929 - protein, 10 aa, Artificial Sequence
  Description of Artificial Sequence: Synthetic peptide
  Seed: SALAGFADVL (MAGC3_HUMAN)
SILAGFADVV

SEQ ID NO: 98930 - protein, 9 aa, Artificial Sequence
  Description of Artificial Sequence: Synthetic peptide
  Seed: ASEEVIWEV (MAGC3_HUMAN)
AAEEVIWEM

SEQ ID NO: 98931 - protein, 9 aa, Artificial Sequence
  Description of Artificial Sequence: Synthetic peptide
  Seed: FFEDTLDLT (MAGC3_HUMAN)
FWEDTLDLL

SEQ ID NO: 98932 - protein, 9 aa, Artificial Sequence
  Description of Artificial Sequence: Synthetic peptide
  Seed: TSDQRMDSL (MAGC3_HUMAN)
TADQRMDSV

SEQ ID NO: 98933 - protein, 10 aa, Artificial Sequence
  Description of Artificial Sequence: Synthetic peptide
  Seed: KAHEFIELIF (MAGC3_HUMAN)
KMHEFIELIW

SEQ ID NO: 98934 - protein, 9 aa, Artificial Sequence
  Description of Artificial Sequence: Synthetic peptide
  Seed: AIIDTTDDA (MAGC3_HUMAN)
AVIDTTDDL

SEQ ID NO: 98935 - protein, 9 aa, Artificial Sequence
  Description of Artificial Sequence: Synthetic peptide
  Seed: VIWEVLSAI (MAGC3_HUMAN)
VMWEVLSAI

SEQ ID NO: 98936 - protein, 10 aa, Artificial Sequence
  Description of Artificial Sequence: Synthetic peptide
  Seed: SKLSSIIPSA (MAGC3_HUMAN)
SMLSSIIPSI

SEQ ID NO: 98937 - protein, 10 aa, Artificial Sequence
  Description of Artificial Sequence: Synthetic peptide
  Seed: ATYALSPVVL (MAGC3_HUMAN)
ATYALSPVVM

SEQ ID NO: 98938 - protein, 9 aa, Artificial Sequence
  Description of Artificial Sequence: Synthetic peptide
  Seed: LKYQTKEPV (MAGC3_HUMAN)
LNYQTKEPY

SEQ ID NO: 98939 - protein, 10 aa, Artificial Sequence
  Description of Artificial Sequence: Synthetic peptide
  Seed: EVIWEVLSAI (MAGC3_HUMAN)
ETIWEVLSAA

SEQ ID NO: 98940 - protein, 11 aa, Artificial Sequence
  Description of Artificial Sequence: Synthetic peptide
  Seed: TSDQRMDSLVL (MAGC3_HUMAN)
TGDQRMDSLVF

SEQ ID NO: 98941 - protein, 9 aa, Artificial Sequence
  Description of Artificial Sequence: Synthetic peptide
  Seed: YTGYFPMIF (MAGC3_HUMAN)
YVGYFPMIF

SEQ ID NO: 98942 - protein, 9 aa, Artificial Sequence
  Description of Artificial Sequence: Synthetic peptide
  Seed: KVAELVQFL (MAGC3_HUMAN)
KQAELVQFK

SEQ ID NO: 98943 - protein, 11 aa, Artificial Sequence
  Description of Artificial Sequence: Synthetic peptide
  Seed: ALWESEGPEAF (MAGC3_HUMAN)
AQWESEGPEAI

SEQ ID NO: 98944 - protein, 9 aa, Artificial Sequence
  Description of Artificial Sequence: Synthetic peptide
  Seed: VPEEVIWEV (MAGC3_HUMAN)
VSEEVIWEV

SEQ ID NO: 98945 - protein, 10 aa, Artificial Sequence
  Description of Artificial Sequence: Synthetic peptide
  Seed: CASEEVIWEV (MAGC3_HUMAN)
CLSEEVIWEA

SEQ ID NO: 98946 - protein, 10 aa, Artificial Sequence
  Description of Artificial Sequence: Synthetic peptide
  Seed: FSDGSLGQWV (MAGC3_HUMAN)
FLDGSLGQWM

SEQ ID NO: 98947 - protein, 8 aa, Artificial Sequence
  Description of Artificial Sequence: Synthetic peptide
  Seed: FADVLSRL (MAGC3_HUMAN)
FGDVLSRI

SEQ ID NO: 98948 - protein, 11 aa, Artificial Sequence
  Description of Artificial Sequence: Synthetic peptide
  Seed: EVLSAIGPIQR (MAGC3_HUMAN)
ETLSAIGPIQR

SEQ ID NO: 98949 - protein, 9 aa, Artificial Sequence
  Description of Artificial Sequence: Synthetic peptide
  Seed: FEDTLDLTY (MAGC3_HUMAN)
FYDTLDLTL

SEQ ID NO: 98950 - protein, 9 aa, Artificial Sequence
  Description of Artificial Sequence: Synthetic peptide
  Seed: EVLNAIGPW (MAGC3_HUMAN)
ETLNAIGPW

SEQ ID NO: 98951 - protein, 9 aa, Artificial Sequence
  Description of Artificial Sequence: Synthetic peptide
  Seed: SPSVMSTNF (MAGC3_HUMAN)
SMSVMSTNF

SEQ ID NO: 98952 - protein, 9 aa, Artificial Sequence
  Description of Artificial Sequence: Synthetic peptide
  Seed: RTLSGSPGL (MAGC3_HUMAN)
RCLSGSPGW

SEQ ID NO: 98953 - protein, 9 aa, Artificial Sequence
  Description of Artificial Sequence: Synthetic peptide
  Seed: YSAFHLGHL (MAGC3_HUMAN)
YQAFHLGHA

SEQ ID NO: 98954 - protein, 9 aa, Artificial Sequence
  Description of Artificial Sequence: Synthetic peptide
  Seed: FKLWRTLSG (MAGC3_HUMAN)
FQLWRTLSI

SEQ ID NO: 98955 - protein, 9 aa, Artificial Sequence
  Description of Artificial Sequence: Synthetic peptide
  Seed: FSDGSLGQW (MAGC3_HUMAN)
FGDGSLGQL

SEQ ID NO: 98956 - protein, 9 aa, Artificial Sequence
  Description of Artificial Sequence: Synthetic peptide
  Seed: FFEDTLDLT (MAGC3_HUMAN)
FYEDTLDLI

SEQ ID NO: 98957 - protein, 9 aa, Artificial Sequence
  Description of Artificial Sequence: Synthetic peptide
  Seed: KATDKDYSA (MAGC3_HUMAN)
KATDKDYSL

SEQ ID NO: 98958 - protein, 9 aa, Artificial Sequence
  Description of Artificial Sequence: Synthetic peptide
  Seed: WESEGPEAF (MAGC3_HUMAN)
WESEGPEAT

SEQ ID NO: 98959 - protein, 10 aa, Artificial Sequence
  Description of Artificial Sequence: Synthetic peptide
  Seed: KVAELVQFLL (MAGC3_HUMAN)
KLAELVQFLD

SEQ ID NO: 98960 - protein, 10 aa, Artificial Sequence
  Description of Artificial Sequence: Synthetic peptide
  Seed: LTRAEMQMNV (MAGC3_HUMAN)
LSRAEMQMNK

SEQ ID NO: 98961 - protein, 8 aa, Artificial Sequence
  Description of Artificial Sequence: Synthetic peptide
  Seed: KVDKLVQF (MAGC3_HUMAN)
KSDKLVQV

SEQ ID NO: 98962 - protein, 10 aa, Artificial Sequence
  Description of Artificial Sequence: Synthetic peptide
  Seed: RLLILILSVI (MAGC3_HUMAN)
RPLILILSVV

SEQ ID NO: 98963 - protein, 11 aa, Artificial Sequence
  Description of Artificial Sequence: Synthetic peptide
  Seed: FSDGSLGQWVK (MAGC3_HUMAN)
FIDGSLGQWVY

SEQ ID NO: 98964 - protein, 9 aa, Artificial Sequence
  Description of Artificial Sequence: Synthetic peptide
  Seed: GFADVLSRL (MAGC3_HUMAN)
GVADVLSRL

SEQ ID NO: 98965 - protein, 10 aa, Artificial Sequence
  Description of Artificial Sequence: Synthetic peptide
  Seed: KLVQFLLLKY (MAGC3_HUMAN)
KNVQFLLLKY

SEQ ID NO: 98966 - protein, 9 aa, Artificial Sequence
  Description of Artificial Sequence: Synthetic peptide
  Seed: LSDEQGMPQ (MAGC3_HUMAN)
LADEQGMPY

SEQ ID NO: 98967 - protein, 9 aa, Artificial Sequence
  Description of Artificial Sequence: Synthetic peptide
  Seed: IIPSAFPSW (MAGC3_HUMAN)
IMPSAFPSL

SEQ ID NO: 98968 - protein, 9 aa, Artificial Sequence
  Description of Artificial Sequence: Synthetic peptide
  Seed: TEVDPDHFY (MAGC3_HUMAN)
TVVDPDHFY

SEQ ID NO: 98969 - protein, 9 aa, Artificial Sequence
  Description of Artificial Sequence: Synthetic peptide
  Seed: FSDGSLGQW (MAGC3_HUMAN)
FPDGSLGQW

SEQ ID NO: 98970 - protein, 9 aa, Artificial Sequence
  Description of Artificial Sequence: Synthetic peptide
  Seed: TSDQRMDSL (MAGC3_HUMAN)
TLDQRMDSL

SEQ ID NO: 98971 - protein, 9 aa, Artificial Sequence
  Description of Artificial Sequence: Synthetic peptide
  Seed: VDPDHFYVF (MAGC3_HUMAN)
VAPDHFYVY

SEQ ID NO: 98972 - protein, 9 aa, Artificial Sequence
  Description of Artificial Sequence: Synthetic peptide
  Seed: RGTGYTLSL (MAGC3_HUMAN)
RITGYTLSL

SEQ ID NO: 98973 - protein, 10 aa, Artificial Sequence
  Description of Artificial Sequence: Synthetic peptide
  Seed: SALAGFADVL (MAGC3_HUMAN)
SQLAGFADVL

SEQ ID NO: 98974 - protein, 10 aa, Artificial Sequence
  Description of Artificial Sequence: Synthetic peptide
  Seed: VLSAIGPIQR (MAGC3_HUMAN)
VASAIGPIQR

SEQ ID NO: 98975 - protein, 8 aa, Artificial Sequence
  Description of Artificial Sequence: Synthetic peptide
  Seed: SCSSPLLW (MAGC3_HUMAN)
STSSPLLW

SEQ ID NO: 98976 - protein, 11 aa, Artificial Sequence
  Description of Artificial Sequence: Synthetic peptide
  Seed: IIDTTDDATAM (MAGC3_HUMAN)
IGDTTDDATAM

SEQ ID NO: 98977 - protein, 10 aa, Artificial Sequence
  Description of Artificial Sequence: Synthetic peptide
  Seed: LPTWRRGTGY (MAGC3_HUMAN)
LFTWRRGTGW

SEQ ID NO: 98978 - protein, 11 aa, Artificial Sequence
  Description of Artificial Sequence: Synthetic peptide
  Seed: TDMDPDNHSYF (MAGC3_HUMAN)
TSMDPDNHSYF

SEQ ID NO: 98979 - protein, 10 aa, Artificial Sequence
  Description of Artificial Sequence: Synthetic peptide
  Seed: LDSCSSPLLW (MAGC3_HUMAN)
LVSCSSPLLY

SEQ ID NO: 98980 - protein, 10 aa, Artificial Sequence
  Description of Artificial Sequence: Synthetic peptide
  Seed: SLVLCPTYFK (MAGC3_HUMAN)
SIVLCPTYFR

SEQ ID NO: 98981 - protein, 9 aa, Artificial Sequence
  Description of Artificial Sequence: Synthetic peptide
  Seed: KLVQFLLLK (MAGC3_HUMAN)
KIVQFLLLM

SEQ ID NO: 98982 - protein, 9 aa, Artificial Sequence
  Description of Artificial Sequence: Synthetic peptide
  Seed: VIKKYKDYF (MAGC3_HUMAN)
VSKKYKDYW

SEQ ID NO: 98983 - protein, 9 aa, Artificial Sequence
  Description of Artificial Sequence: Synthetic peptide
  Seed: ATYALSPVV (MAGC3_HUMAN)
AVYALSPVY

SEQ ID NO: 98984 - protein, 9 aa, Artificial Sequence
  Description of Artificial Sequence: Synthetic peptide
  Seed: YSAFHLGHL (MAGC3_HUMAN)
YIAFHLGHF

SEQ ID NO: 98985 - protein, 9 aa, Artificial Sequence
  Description of Artificial Sequence: Synthetic peptide
  Seed: MEDRAQAII (MAGC3_HUMAN)
MFDRAQAIV

SEQ ID NO: 98986 - protein, 10 aa, Artificial Sequence
  Description of Artificial Sequence: Synthetic peptide
  Seed: SWYMDALKDM (MAGC3_HUMAN)
SRYMDALKDF

SEQ ID NO: 98987 - protein, 10 aa, Artificial Sequence
  Description of Artificial Sequence: Synthetic peptide
  Seed: MDPDNHSYFF (MAGC3_HUMAN)
MQPDNHSYFY

SEQ ID NO: 98988 - protein, 10 aa, Artificial Sequence
  Description of Artificial Sequence: Synthetic peptide
  Seed: TGYFPMIFRK (MAGC3_HUMAN)
TAYFPMIFRD

SEQ ID NO: 98989 - protein, 10 aa, Artificial Sequence
  Description of Artificial Sequence: Synthetic peptide
  Seed: AMASASPSVM (MAGC3_HUMAN)
AFASASPSVY

SEQ ID NO: 98990 - protein, 9 aa, Artificial Sequence
  Description of Artificial Sequence: Synthetic peptide
  Seed: LLILILSMI (MAGC3_HUMAN)
LMILILSMI

SEQ ID NO: 98991 - protein, 9 aa, Artificial Sequence
  Description of Artificial Sequence: Synthetic peptide
  Seed: YQTKEPVTK (MAGC3_HUMAN)
YVTKEPVTM

SEQ ID NO: 98992 - protein, 10 aa, Artificial Sequence
  Description of Artificial Sequence: Synthetic peptide
  Seed: YALDEKVAEL (MAGC3_HUMAN)
YTLDEKVAEY

SEQ ID NO: 98993 - protein, 10 aa, Artificial Sequence
  Description of Artificial Sequence: Synthetic peptide
  Seed: IIDTTDDATA (MAGC3_HUMAN)
IIDTTDDATF

SEQ ID NO: 98994 - protein, 11 aa, Artificial Sequence
  Description of Artificial Sequence: Synthetic peptide
  Seed: EILFGISLTEV (MAGC3_HUMAN)
ESLFGISLTEV

SEQ ID NO: 98995 - protein, 9 aa, Artificial Sequence
  Description of Artificial Sequence: Synthetic peptide
  Seed: TYALSPVVL (MAGC3_HUMAN)
TSALSPVVM

SEQ ID NO: 98996 - protein, 9 aa, Artificial Sequence
  Description of Artificial Sequence: Synthetic peptide
  Seed: TEVDPDHFY (MAGC3_HUMAN)
TIVDPDHFY

SEQ ID NO: 98997 - protein, 10 aa, Artificial Sequence
  Description of Artificial Sequence: Synthetic peptide
  Seed: EVIWEVLNAI (MAGC3_HUMAN)
ELIWEVLNAY

SEQ ID NO: 98998 - protein, 9 aa, Artificial Sequence
  Description of Artificial Sequence: Synthetic peptide
  Seed: FEDTLDLTY (MAGC3_HUMAN)
FFDTLDLTY

SEQ ID NO: 98999 - protein, 11 aa, Artificial Sequence
  Description of Artificial Sequence: Synthetic peptide
  Seed: SSSEEEDTATW (MAGC3_HUMAN)
SLSEEEDTATF

SEQ ID NO: 99000 - protein, 9 aa, Artificial Sequence
  Description of Artificial Sequence: Synthetic peptide
  Seed: EVLSAIGPI (MAGC3_HUMAN)
ETLSAIGPA

SEQ ID NO: 99001 - protein, 9 aa, Artificial Sequence
  Description of Artificial Sequence: Synthetic peptide
  Seed: GSLPESEPL (MAGC3_HUMAN)
GMLPESEPV

SEQ ID NO: 99002 - protein, 9 aa, Artificial Sequence
  Description of Artificial Sequence: Synthetic peptide
  Seed: TTDDATAMA (MAGC3_HUMAN)
TTDDATAMF

SEQ ID NO: 99003 - protein, 9 aa, Artificial Sequence
  Description of Artificial Sequence: Synthetic peptide
  Seed: WRRGTGYTL (MAGC3_HUMAN)
WHRGTGYTM

SEQ ID NO: 99004 - protein, 9 aa, Artificial Sequence
  Description of Artificial Sequence: Synthetic peptide
  Seed: YFPMIFRKA (MAGC3_HUMAN)
YYPMIFRKI

SEQ ID NO: 99005 - protein, 10 aa, Artificial Sequence
  Description of Artificial Sequence: Synthetic peptide
  Seed: SLPESEPLFT (MAGC3_HUMAN)
SMPESEPLFL

SEQ ID NO: 99006 - protein, 10 aa, Artificial Sequence
  Description of Artificial Sequence: Synthetic peptide
  Seed: IPSAFPSWYM (MAGC3_HUMAN)
IQSAFPSWYF

SEQ ID NO: 99007 - protein, 10 aa, Artificial Sequence
  Description of Artificial Sequence: Synthetic peptide
  Seed: SWYMDALKDM (MAGC3_HUMAN)
SFYMDALKDF

SEQ ID NO: 99008 - protein, 10 aa, Artificial Sequence
  Description of Artificial Sequence: Synthetic peptide
  Seed: TGYFPMIFRK (MAGC3_HUMAN)
TEYFPMIFRR

SEQ ID NO: 99009 - protein, 11 aa, Artificial Sequence
  Description of Artificial Sequence: Synthetic peptide
  Seed: INTYTGYFPMI (MAGC3_HUMAN)
ICTYTGYFPMF

SEQ ID NO: 99010 - protein, 11 aa, Artificial Sequence
  Description of Artificial Sequence: Synthetic peptide
  Seed: ILFGISLTEVD (MAGC3_HUMAN)
ILFGISLTEVY

SEQ ID NO: 99011 - protein, 10 aa, Artificial Sequence
  Description of Artificial Sequence: Synthetic peptide
  Seed: TGYFPMIFRK (MAGC3_HUMAN)
TMYFPMIFRQ

SEQ ID NO: 99012 - protein, 9 aa, Artificial Sequence
  Description of Artificial Sequence: Synthetic peptide
  Seed: EFLSKLSSI (MAGC3_HUMAN)
EVLSKLSSL

SEQ ID NO: 99013 - protein, 9 aa, Artificial Sequence
  Description of Artificial Sequence: Synthetic peptide
  Seed: NTYTGYFPM (MAGC3_HUMAN)
NAYTGYFPK

SEQ ID NO: 99014 - protein, 9 aa, Artificial Sequence
  Description of Artificial Sequence: Synthetic peptide
  Seed: KAHEFIELI (MAGC3_HUMAN)
KAHEFIELR

SEQ ID NO: 99015 - protein, 8 aa, Artificial Sequence
  Description of Artificial Sequence: Synthetic peptide
  Seed: LTYEGSLI (MAGC3_HUMAN)
LAYEGSLL

SEQ ID NO: 99016 - protein, 9 aa, Artificial Sequence
  Description of Artificial Sequence: Synthetic peptide
  Seed: YFFEDTLDL (MAGC3_HUMAN)
YRFEDTLDL

SEQ ID NO: 99017 - protein, 9 aa, Artificial Sequence
  Description of Artificial Sequence: Synthetic peptide
  Seed: MEDRAQAII (MAGC3_HUMAN)
MVDRAQAII

SEQ ID NO: 99018 - protein, 9 aa, Artificial Sequence
  Description of Artificial Sequence: Synthetic peptide
  Seed: YKDYFPMIF (MAGC3_HUMAN)
YVDYFPMIM

SEQ ID NO: 99019 - protein, 9 aa, Artificial Sequence
  Description of Artificial Sequence: Synthetic peptide
  Seed: TAMASASPS (MAGC3_HUMAN)
TTMASASPM

SEQ ID NO: 99020 - protein, 9 aa, Artificial Sequence
  Description of Artificial Sequence: Synthetic peptide
  Seed: FEDTLDLTY (MAGC3_HUMAN)
FEDTLDLTV

SEQ ID NO: 99021 - protein, 9 aa, Artificial Sequence
  Description of Artificial Sequence: Synthetic peptide
  Seed: MASASPSVM (MAGC3_HUMAN)
MWSASPSVF

SEQ ID NO: 99022 - protein, 9 aa, Artificial Sequence
  Description of Artificial Sequence: Synthetic peptide
  Seed: LSDEQGMPQ (MAGC3_HUMAN)
LFDEQGMPF

SEQ ID NO: 99023 - protein, 9 aa, Artificial Sequence
  Description of Artificial Sequence: Synthetic peptide
  Seed: ATDKDYSAF (MAGC3_HUMAN)
AFDKDYSAM

SEQ ID NO: 99024 - protein, 9 aa, Artificial Sequence
  Description of Artificial Sequence: Synthetic peptide
  Seed: QTKEPVTKA (MAGC3_HUMAN)
QMKEPVTKY

SEQ ID NO: 99025 - protein, 8 aa, Artificial Sequence
  Description of Artificial Sequence: Synthetic peptide
  Seed: YMDALKDM (MAGC3_HUMAN)
YIDALKDM

SEQ ID NO: 99026 - protein, 8 aa, Artificial Sequence
  Description of Artificial Sequence: Synthetic peptide
  Seed: YALSPVVL (MAGC3_HUMAN)
YYLSPVVM

SEQ ID NO: 99027 - protein, 10 aa, Artificial Sequence
  Description of Artificial Sequence: Synthetic peptide
  Seed: NAIGPWSALA (MAGC3_HUMAN)
NVIGPWSALL

SEQ ID NO: 99028 - protein, 9 aa, Artificial Sequence
  Description of Artificial Sequence: Synthetic peptide
  Seed: ELVQFLLLK (MAGC3_HUMAN)
EMVQFLLLK

SEQ ID NO: 99029 - protein, 11 aa, Artificial Sequence
  Description of Artificial Sequence: Synthetic peptide
  Seed: FIELIFGIALT (MAGC3_HUMAN)
FMELIFGIALL

SEQ ID NO: 99030 - protein, 9 aa, Artificial Sequence
  Description of Artificial Sequence: Synthetic peptide
  Seed: VLPPQPQPR (MAGC3_HUMAN)
VMPPQPQPV

SEQ ID NO: 99031 - protein, 9 aa, Artificial Sequence
  Description of Artificial Sequence: Synthetic peptide
  Seed: NAIGPWSAL (MAGC3_HUMAN)
NSIGPWSAK

SEQ ID NO: 99032 - protein, 10 aa, Artificial Sequence
  Description of Artificial Sequence: Synthetic peptide
  Seed: VTKAEMLTTV (MAGC3_HUMAN)
VIKAEMLTTI

SEQ ID NO: 99033 - protein, 10 aa, Artificial Sequence
  Description of Artificial Sequence: Synthetic peptide
  Seed: KYKDYFPMIF (MAGC3_HUMAN)
KMKDYFPMIM

SEQ ID NO: 99034 - protein, 9 aa, Artificial Sequence
  Description of Artificial Sequence: Synthetic peptide
  Seed: LSRLALWES (MAGC3_HUMAN)
LTRLALWEA

SEQ ID NO: 99035 - protein, 9 aa, Artificial Sequence
  Description of Artificial Sequence: Synthetic peptide
  Seed: HALPESESL (MAGC3_HUMAN)
HELPESESA

SEQ ID NO: 99036 - protein, 9 aa, Artificial Sequence
  Description of Artificial Sequence: Synthetic peptide
  Seed: MEDRAQAII (MAGC3_HUMAN)
MVDRAQAIL

SEQ ID NO: 99037 - protein, 9 aa, Artificial Sequence
  Description of Artificial Sequence: Synthetic peptide
  Seed: EVDPDHFYV (MAGC3_HUMAN)
EVDPDHFYI

SEQ ID NO: 99038 - protein, 10 aa, Artificial Sequence
  Description of Artificial Sequence: Synthetic peptide
  Seed: IPSAFPSWYM (MAGC3_HUMAN)
IMSAFPSWYW

SEQ ID NO: 99039 - protein, 10 aa, Artificial Sequence
  Description of Artificial Sequence: Synthetic peptide
  Seed: TGYFPMIFRK (MAGC3_HUMAN)
TMYFPMIFRG

SEQ ID NO: 99040 - protein, 11 aa, Artificial Sequence
  Description of Artificial Sequence: Synthetic peptide
  Seed: IIDTTDDATAM (MAGC3_HUMAN)
ILDTTDDATAL

SEQ ID NO: 99041 - protein, 9 aa, Artificial Sequence
  Description of Artificial Sequence: Synthetic peptide
  Seed: SPPEIPPQG (MAGC3_HUMAN)
SPPEIPPQA

SEQ ID NO: 99042 - protein, 9 aa, Artificial Sequence
  Description of Artificial Sequence: Synthetic peptide
  Seed: MIFRKAREF (MAGC3_HUMAN)
MWFRKAREL

SEQ ID NO: 99043 - protein, 10 aa, Artificial Sequence
  Description of Artificial Sequence: Synthetic peptide
  Seed: RMDSLVLCPT (MAGC3_HUMAN)
RMDSLVLCPA

SEQ ID NO: 99044 - protein, 10 aa, Artificial Sequence
  Description of Artificial Sequence: Synthetic peptide
  Seed: TAMASASPSV (MAGC3_HUMAN)
TYMASASPSV

SEQ ID NO: 99045 - protein, 10 aa, Artificial Sequence
  Description of Artificial Sequence: Synthetic peptide
  Seed: INTYTGYFPM (MAGC3_HUMAN)
IATYTGYFPF

SEQ ID NO: 99046 - protein, 10 aa, Artificial Sequence
  Description of Artificial Sequence: Synthetic peptide
  Seed: KAHEFIELIF (MAGC3_HUMAN)
KAHEFIELIY

SEQ ID NO: 99047 - protein, 9 aa, Artificial Sequence
  Description of Artificial Sequence: Synthetic peptide
  Seed: EVLEFLSKL (MAGC3_HUMAN)
ELLEFLSKF

SEQ ID NO: 99048 - protein, 9 aa, Artificial Sequence
  Description of Artificial Sequence: Synthetic peptide
  Seed: LILILSMIF (MAGC3_HUMAN)
LALILSMIY

SEQ ID NO: 99049 - protein, 10 aa, Artificial Sequence
  Description of Artificial Sequence: Synthetic peptide
  Seed: LLKYQAKEPL (MAGC3_HUMAN)
LFKYQAKEPY

SEQ ID NO: 99050 - protein, 9 aa, Artificial Sequence
  Description of Artificial Sequence: Synthetic peptide
  Seed: MLLPCHWVL (MAGC3_HUMAN)
MFLPCHWVM

SEQ ID NO: 99051 - protein, 9 aa, Artificial Sequence
  Description of Artificial Sequence: Synthetic peptide
  Seed: KYKDYFPMI (MAGC3_HUMAN)
KYKDYFPMY

SEQ ID NO: 99052 - protein, 11 aa, Artificial Sequence
  Description of Artificial Sequence: Synthetic peptide
  Seed: FIELIFGIALT (MAGC3_HUMAN)
FFELIFGIALL

SEQ ID NO: 99053 - protein, 10 aa, Artificial Sequence
  Description of Artificial Sequence: Synthetic peptide
  Seed: MDSLVLCPTY (MAGC3_HUMAN)
MLSLVLCPTW

SEQ ID NO: 99054 - protein, 9 aa, Artificial Sequence
  Description of Artificial Sequence: Synthetic peptide
  Seed: FADVLSRLA (MAGC3_HUMAN)
FGDVLSRLM

SEQ ID NO: 99055 - protein, 11 aa, Artificial Sequence
  Description of Artificial Sequence: Synthetic peptide
  Seed: LSKLSSIIPSA (MAGC3_HUMAN)
LVKLSSIIPSV

SEQ ID NO: 99056 - protein, 9 aa, Artificial Sequence
  Description of Artificial Sequence: Synthetic peptide
  Seed: SQPEGKFSL (MAGC3_HUMAN)
SRPEGKFSI

SEQ ID NO: 99057 - protein, 9 aa, Artificial Sequence
  Description of Artificial Sequence: Synthetic peptide
  Seed: RGTGYTLSL (MAGC3_HUMAN)
RQTGYTLSV

SEQ ID NO: 99058 - protein, 9 aa, Artificial Sequence
  Description of Artificial Sequence: Synthetic peptide
  Seed: LSSIIPSAF (MAGC3_HUMAN)
LKSIIPSAF

SEQ ID NO: 99059 - protein, 10 aa, Artificial Sequence
  Description of Artificial Sequence: Synthetic peptide
  Seed: MQMNVINTYT (MAGC3_HUMAN)
MKMNVINTYF

SEQ ID NO: 99060 - protein, 10 aa, Artificial Sequence
  Description of Artificial Sequence: Synthetic peptide
  Seed: LVLCPTYFKL (MAGC3_HUMAN)
LLLCPTYFKK

SEQ ID NO: 99061 - protein, 8 aa, Artificial Sequence
  Description of Artificial Sequence: Synthetic peptide
  Seed: YTLSLPAV (MAGC3_HUMAN)
YALSLPAL

SEQ ID NO: 99062 - protein, 11 aa, Artificial Sequence
  Description of Artificial Sequence: Synthetic peptide
  Seed: YFFEDTLDLTY (MAGC3_HUMAN)
YPFEDTLDLTF

SEQ ID NO: 99063 - protein, 10 aa, Artificial Sequence
  Description of Artificial Sequence: Synthetic peptide
  Seed: MNVINTYTGY (MAGC3_HUMAN)
MKVINTYTGY

SEQ ID NO: 99064 - protein, 9 aa, Artificial Sequence
  Description of Artificial Sequence: Synthetic peptide
  Seed: SPPEIPPQG (MAGC3_HUMAN)
SPPEIPPQI

SEQ ID NO: 99065 - protein, 10 aa, Artificial Sequence
  Description of Artificial Sequence: Synthetic peptide
  Seed: CVPEEVIWEV (MAGC3_HUMAN)
CIPEEVIWEV

SEQ ID NO: 99066 - protein, 10 aa, Artificial Sequence
  Description of Artificial Sequence: Synthetic peptide
  Seed: INTYTGYFPM (MAGC3_HUMAN)
IRTYTGYFPF

SEQ ID NO: 99067 - protein, 11 aa, Artificial Sequence
  Description of Artificial Sequence: Synthetic peptide
  Seed: LSKLSSIIPSA (MAGC3_HUMAN)
LTKLSSIIPSL

SEQ ID NO: 99068 - protein, 10 aa, Artificial Sequence
  Description of Artificial Sequence: Synthetic peptide
  Seed: LLKYQAKEPL (MAGC3_HUMAN)
LWKYQAKEPY

SEQ ID NO: 99069 - protein, 9 aa, Artificial Sequence
  Description of Artificial Sequence: Synthetic peptide
  Seed: RTLSGSPGL (MAGC3_HUMAN)
RILSGSPGL

SEQ ID NO: 99070 - protein, 9 aa, Artificial Sequence
  Description of Artificial Sequence: Synthetic peptide
  Seed: KAHEFIELI (MAGC3_HUMAN)
KTHEFIELV

SEQ ID NO: 99071 - protein, 11 aa, Artificial Sequence
  Description of Artificial Sequence: Synthetic peptide
  Seed: TLWKDSDLPTW (MAGC3_HUMAN)
TIWKDSDLPTW

SEQ ID NO: 99072 - protein, 9 aa, Artificial Sequence
  Description of Artificial Sequence: Synthetic peptide
  Seed: WRRGTGYTL (MAGC3_HUMAN)
WMRGTGYTL

SEQ ID NO: 99073 - protein, 9 aa, Artificial Sequence
  Description of Artificial Sequence: Synthetic peptide
  Seed: SALAGFADV (MAGC3_HUMAN)
SQLAGFADA

SEQ ID NO: 99074 - protein, 10 aa, Artificial Sequence
  Description of Artificial Sequence: Synthetic peptide
  Seed: EVIWEVLSAI (MAGC3_HUMAN)
EIIWEVLSAF

SEQ ID NO: 99075 - protein, 9 aa, Artificial Sequence
  Description of Artificial Sequence: Synthetic peptide
  Seed: HALPESESL (MAGC3_HUMAN)
HVLPESESM

SEQ ID NO: 99076 - protein, 10 aa, Artificial Sequence
  Description of Artificial Sequence: Synthetic peptide
  Seed: KYKDYFPMIF (MAGC3_HUMAN)
KFKDYFPMIY

SEQ ID NO: 99077 - protein, 9 aa, Artificial Sequence
  Description of Artificial Sequence: Synthetic peptide
  Seed: IQRPAREVL (MAGC3_HUMAN)
IVRPAREVM

SEQ ID NO: 99078 - protein, 9 aa, Artificial Sequence
  Description of Artificial Sequence: Synthetic peptide
  Seed: VDPDHFYVF (MAGC3_HUMAN)
VGPDHFYVI

SEQ ID NO: 99079 - protein, 11 aa, Artificial Sequence
  Description of Artificial Sequence: Synthetic peptide
  Seed: ILFGISLTEVD (MAGC3_HUMAN)
ILFGISLTEVQ

SEQ ID NO: 99080 - protein, 10 aa, Artificial Sequence
  Description of Artificial Sequence: Synthetic peptide
  Seed: LDLANPQGLA (MAGC3_HUMAN)
LWLANPQGLV

SEQ ID NO: 99081 - protein, 9 aa, Artificial Sequence
  Description of Artificial Sequence: Synthetic peptide
  Seed: GFADVLSRL (MAGC3_HUMAN)
GVADVLSRT

SEQ ID NO: 99082 - protein, 10 aa, Artificial Sequence
  Description of Artificial Sequence: Synthetic peptide
  Seed: IPSAFPSWYM (MAGC3_HUMAN)
IYSAFPSWYW

SEQ ID NO: 99083 - protein, 9 aa, Artificial Sequence
  Description of Artificial Sequence: Synthetic peptide
  Seed: KYKDYFPMI (MAGC3_HUMAN)
KTKDYFPML

SEQ ID NO: 99084 - protein, 9 aa, Artificial Sequence
  Description of Artificial Sequence: Synthetic peptide
  Seed: SLPESEPLF (MAGC3_HUMAN)
SYPESEPLF

SEQ ID NO: 99085 - protein, 11 aa, Artificial Sequence
  Description of Artificial Sequence: Synthetic peptide
  Seed: LSKLSSIIPSA (MAGC3_HUMAN)
LRKLSSIIPSL

SEQ ID NO: 99086 - protein, 10 aa, Artificial Sequence
  Description of Artificial Sequence: Synthetic peptide
  Seed: RLLILILSVI (MAGC3_HUMAN)
RYLILILSVV

SEQ ID NO: 99087 - protein, 10 aa, Artificial Sequence
  Description of Artificial Sequence: Synthetic peptide
  Seed: YALSPVVLPP (MAGC3_HUMAN)
YSLSPVVLPM

SEQ ID NO: 99088 - protein, 11 aa, Artificial Sequence
  Description of Artificial Sequence: Synthetic peptide
  Seed: VIKKYKDYFPM (MAGC3_HUMAN)
VQKKYKDYFPY

SEQ ID NO: 99089 - protein, 11 aa, Artificial Sequence
  Description of Artificial Sequence: Synthetic peptide
  Seed: HALPESESLPR (MAGC3_HUMAN)
HSLPESESLPR

SEQ ID NO: 99090 - protein, 8 aa, Artificial Sequence
  Description of Artificial Sequence: Synthetic peptide
  Seed: FADVLSRL (MAGC3_HUMAN)
FADVLSRV

SEQ ID NO: 99091 - protein, 9 aa, Artificial Sequence
  Description of Artificial Sequence: Synthetic peptide
  Seed: NTYTGYFPM (MAGC3_HUMAN)
NTYTGYFPR

SEQ ID NO: 99092 - protein, 9 aa, Artificial Sequence
  Description of Artificial Sequence: Synthetic peptide
  Seed: VINTYTGYF (MAGC3_HUMAN)
VTNTYTGYF

SEQ ID NO: 99093 - protein, 10 aa, Artificial Sequence
  Description of Artificial Sequence: Synthetic peptide
  Seed: VLDLANPQGL (MAGC3_HUMAN)
VTDLANPQGF

SEQ ID NO: 99094 - protein, 10 aa, Artificial Sequence
  Description of Artificial Sequence: Synthetic peptide
  Seed: KKYKDYFPMI (MAGC3_HUMAN)
KMYKDYFPMW

SEQ ID NO: 99095 - protein, 11 aa, Artificial Sequence
  Description of Artificial Sequence: Synthetic peptide
  Seed: HALPESESLPR (MAGC3_HUMAN)
HTLPESESLPR

SEQ ID NO: 99096 - protein, 9 aa, Artificial Sequence
  Description of Artificial Sequence: Synthetic peptide
  Seed: MLTTVIKKY (MAGC3_HUMAN)
MKTTVIKKY

SEQ ID NO: 99097 - protein, 10 aa, Artificial Sequence
  Description of Artificial Sequence: Synthetic peptide
  Seed: KYKDYFPMIF (MAGC3_HUMAN)
KWKDYFPMIY

SEQ ID NO: 99098 - protein, 10 aa, Artificial Sequence
  Description of Artificial Sequence: Synthetic peptide
  Seed: MDPDNHSYFF (MAGC3_HUMAN)
MPPDNHSYFM

SEQ ID NO: 99099 - protein, 9 aa, Artificial Sequence
  Description of Artificial Sequence: Synthetic peptide
  Seed: SQPEGKFSL (MAGC3_HUMAN)
SEPEGKFSF

SEQ ID NO: 99100 - protein, 9 aa, Artificial Sequence
  Description of Artificial Sequence: Synthetic peptide
  Seed: YTGYFPMIF (MAGC3_HUMAN)
YTGYFPMIY

SEQ ID NO: 99101 - protein, 10 aa, Artificial Sequence
  Description of Artificial Sequence: Synthetic peptide
  Seed: MLTTVIKKYK (MAGC3_HUMAN)
MTTTVIKKYR

SEQ ID NO: 99102 - protein, 11 aa, Artificial Sequence
  Description of Artificial Sequence: Synthetic peptide
  Seed: IIDTTDDATAM (MAGC3_HUMAN)
IMDTTDDATAI

SEQ ID NO: 99103 - protein, 11 aa, Artificial Sequence
  Description of Artificial Sequence: Synthetic peptide
  Seed: AEMQMNVINTY (MAGC3_HUMAN)
ACMQMNVINTY

SEQ ID NO: 99104 - protein, 9 aa, Artificial Sequence
  Description of Artificial Sequence: Synthetic peptide
  Seed: SQPEGKFSL (MAGC3_HUMAN)
STPEGKFSM

SEQ ID NO: 99105 - protein, 10 aa, Artificial Sequence
  Description of Artificial Sequence: Synthetic peptide
  Seed: LVLCPTYFKL (MAGC3_HUMAN)
LILCPTYFKK

SEQ ID NO: 99106 - protein, 9 aa, Artificial Sequence
  Description of Artificial Sequence: Synthetic peptide
  Seed: AELVQFLLL (MAGC3_HUMAN)
AELVQFLLM

SEQ ID NO: 99107 - protein, 9 aa, Artificial Sequence
  Description of Artificial Sequence: Synthetic peptide
  Seed: QMNVINTYT (MAGC3_HUMAN)
QINVINTYL

SEQ ID NO: 99108 - protein, 9 aa, Artificial Sequence
  Description of Artificial Sequence: Synthetic peptide
  Seed: ASEEVIWEV (MAGC3_HUMAN)
ATEEVIWEI

SEQ ID NO: 99109 - protein, 9 aa, Artificial Sequence
  Description of Artificial Sequence: Synthetic peptide
  Seed: LVLCPTYFK (MAGC3_HUMAN)
LYLCPTYFR

SEQ ID NO: 99110 - protein, 10 aa, Artificial Sequence
  Description of Artificial Sequence: Synthetic peptide
  Seed: SIIPSAFPSW (MAGC3_HUMAN)
SSIPSAFPSY

SEQ ID NO: 99111 - protein, 9 aa, Artificial Sequence
  Description of Artificial Sequence: Synthetic peptide
  Seed: ALDEKVAEL (MAGC3_HUMAN)
AADEKVAEA

SEQ ID NO: 99112 - protein, 9 aa, Artificial Sequence
  Description of Artificial Sequence: Synthetic peptide
  Seed: TRAEMQMNV (MAGC3_HUMAN)
THAEMQMNI

SEQ ID NO: 99113 - protein, 10 aa, Artificial Sequence
  Description of Artificial Sequence: Synthetic peptide
  Seed: YALDEKVAEL (MAGC3_HUMAN)
YHLDEKVAEA

SEQ ID NO: 99114 - protein, 9 aa, Artificial Sequence
  Description of Artificial Sequence: Synthetic peptide
  Seed: WVKNTCATY (MAGC3_HUMAN)
WTKNTCATF

SEQ ID NO: 99115 - protein, 10 aa, Artificial Sequence
  Description of Artificial Sequence: Synthetic peptide
  Seed: IPSAFPSWYM (MAGC3_HUMAN)
ITSAFPSWYM

SEQ ID NO: 99116 - protein, 10 aa, Artificial Sequence
  Description of Artificial Sequence: Synthetic peptide
  Seed: EAFCEESGLR (MAGC3_HUMAN)
EVFCEESGLR

SEQ ID NO: 99117 - protein, 9 aa, Artificial Sequence
  Description of Artificial Sequence: Synthetic peptide
  Seed: NTYTGYFPM (MAGC3_HUMAN)
NGYTGYFPY

SEQ ID NO: 99118 - protein, 9 aa, Artificial Sequence
  Description of Artificial Sequence: Synthetic peptide
  Seed: MIFGKAHEF (MAGC3_HUMAN)
MIFGKAHEM

SEQ ID NO: 99119 - protein, 10 aa, Artificial Sequence
  Description of Artificial Sequence: Synthetic peptide
  Seed: VLNAIGPWSA (MAGC3_HUMAN)
VMNAIGPWSL

SEQ ID NO: 99120 - protein, 9 aa, Artificial Sequence
  Description of Artificial Sequence: Synthetic peptide
  Seed: LSDEQGMPQ (MAGC3_HUMAN)
LTDEQGMPM

SEQ ID NO: 99121 - protein, 9 aa, Artificial Sequence
  Description of Artificial Sequence: Synthetic peptide
  Seed: VIWEVLNAI (MAGC3_HUMAN)
VLWEVLNAI

SEQ ID NO: 99122 - protein, 8 aa, Artificial Sequence
  Description of Artificial Sequence: Synthetic peptide
  Seed: YALSPVVL (MAGC3_HUMAN)
YSLSPVVL

SEQ ID NO: 99123 - protein, 10 aa, Artificial Sequence
  Description of Artificial Sequence: Synthetic peptide
  Seed: LDSCSSPLLW (MAGC3_HUMAN)
LSSCSSPLLM

SEQ ID NO: 99124 - protein, 9 aa, Artificial Sequence
  Description of Artificial Sequence: Synthetic peptide
  Seed: HLREVRLFL (MAGC3_HUMAN)
HYREVRLFY

SEQ ID NO: 99125 - protein, 9 aa, Artificial Sequence
  Description of Artificial Sequence: Synthetic peptide
  Seed: MDPDNHSYF (MAGC3_HUMAN)
MTPDNHSYV

SEQ ID NO: 99126 - protein, 9 aa, Artificial Sequence
  Description of Artificial Sequence: Synthetic peptide
  Seed: IIPSAFPSW (MAGC3_HUMAN)
IYPSAFPSI

SEQ ID NO: 99127 - protein, 9 aa, Artificial Sequence
  Description of Artificial Sequence: Synthetic peptide
  Seed: ALAGFADVL (MAGC3_HUMAN)
ALAGFADVW

SEQ ID NO: 99128 - protein, 11 aa, Artificial Sequence
  Description of Artificial Sequence: Synthetic peptide
  Seed: ATAMASASPSV (MAGC3_HUMAN)
ASAMASASPSV

SEQ ID NO: 99129 - protein, 9 aa, Artificial Sequence
  Description of Artificial Sequence: Synthetic peptide
  Seed: FADVLSRLA (MAGC3_HUMAN)
FYDVLSRLM

SEQ ID NO: 99130 - protein, 11 aa, Artificial Sequence
  Description of Artificial Sequence: Synthetic peptide
  Seed: RTLSGSPGLQL (MAGC3_HUMAN)
RQLSGSPGLQI

SEQ ID NO: 99131 - protein, 10 aa, Artificial Sequence
  Description of Artificial Sequence: Synthetic peptide
  Seed: FADVLSRLAL (MAGC3_HUMAN)
FSDVLSRLAY

SEQ ID NO: 99132 - protein, 9 aa, Artificial Sequence
  Description of Artificial Sequence: Synthetic peptide
  Seed: VINTYTGYF (MAGC3_HUMAN)
VFNTYTGYY

SEQ ID NO: 99133 - protein, 8 aa, Artificial Sequence
  Description of Artificial Sequence: Synthetic peptide
  Seed: ASASPSVM (MAGC3_HUMAN)
AAASPSVL

SEQ ID NO: 99134 - protein, 11 aa, Artificial Sequence
  Description of Artificial Sequence: Synthetic peptide
  Seed: IIDTTDDATAM (MAGC3_HUMAN)
ICDTTDDATAM

SEQ ID NO: 99135 - protein, 9 aa, Artificial Sequence
  Description of Artificial Sequence: Synthetic peptide
  Seed: QTKEPVTKA (MAGC3_HUMAN)
QSKEPVTKY

SEQ ID NO: 99136 - protein, 9 aa, Artificial Sequence
  Description of Artificial Sequence: Synthetic peptide
  Seed: NAIGPWSAL (MAGC3_HUMAN)
NRIGPWSAL

SEQ ID NO: 99137 - protein, 9 aa, Artificial Sequence
  Description of Artificial Sequence: Synthetic peptide
  Seed: VIWEVLNAI (MAGC3_HUMAN)
VLWEVLNAR

SEQ ID NO: 99138 - protein, 11 aa, Artificial Sequence
  Description of Artificial Sequence: Synthetic peptide
  Seed: TDMDPDNHSYF (MAGC3_HUMAN)
TSMDPDNHSYY

SEQ ID NO: 99139 - protein, 10 aa, Artificial Sequence
  Description of Artificial Sequence: Synthetic peptide
  Seed: LLKYQAKEPL (MAGC3_HUMAN)
LFKYQAKEPF

SEQ ID NO: 99140 - protein, 9 aa, Artificial Sequence
  Description of Artificial Sequence: Synthetic peptide
  Seed: KYKDYFPMI (MAGC3_HUMAN)
KIKDYFPMA

SEQ ID NO: 99141 - protein, 9 aa, Artificial Sequence
  Description of Artificial Sequence: Synthetic peptide
  Seed: RTLSGSPGL (MAGC3_HUMAN)
RMLSGSPGL

SEQ ID NO: 99142 - protein, 9 aa, Artificial Sequence
  Description of Artificial Sequence: Synthetic peptide
  Seed: VINTYTGYF (MAGC3_HUMAN)
VVNTYTGYW

SEQ ID NO: 99143 - protein, 11 aa, Artificial Sequence
  Description of Artificial Sequence: Synthetic peptide
  Seed: AIIDTTDDATA (MAGC3_HUMAN)
AMIDTTDDATI

SEQ ID NO: 99144 - protein, 9 aa, Artificial Sequence
  Description of Artificial Sequence: Synthetic peptide
  Seed: MIFGKAHEF (MAGC3_HUMAN)
MAFGKAHER

SEQ ID NO: 99145 - protein, 9 aa, Artificial Sequence
  Description of Artificial Sequence: Synthetic peptide
  Seed: TLDEKVDKL (MAGC3_HUMAN)
TVDEKVDKW

SEQ ID NO: 99146 - protein, 10 aa, Artificial Sequence
  Description of Artificial Sequence: Synthetic peptide
  Seed: EVIWEVLSAI (MAGC3_HUMAN)
EMIWEVLSAV

SEQ ID NO: 99147 - protein, 9 aa, Artificial Sequence
  Description of Artificial Sequence: Synthetic peptide
  Seed: TLDEKVDKL (MAGC3_HUMAN)
THDEKVDKI

SEQ ID NO: 99148 - protein, 9 aa, Artificial Sequence
  Description of Artificial Sequence: Synthetic peptide
  Seed: AMASASPSV (MAGC3_HUMAN)
AVASASPSV

SEQ ID NO: 99149 - protein, 9 aa, Artificial Sequence
  Description of Artificial Sequence: Synthetic peptide
  Seed: KVDKLVQFL (MAGC3_HUMAN)
KLDKLVQFC

SEQ ID NO: 99150 - protein, 10 aa, Artificial Sequence
  Description of Artificial Sequence: Synthetic peptide
  Seed: AMASASPSVM (MAGC3_HUMAN)
ALASASPSVL

SEQ ID NO: 99151 - protein, 9 aa, Artificial Sequence
  Description of Artificial Sequence: Synthetic peptide
  Seed: KLVQFLLLK (MAGC3_HUMAN)
KSVQFLLLR

SEQ ID NO: 99152 - protein, 10 aa, Artificial Sequence
  Description of Artificial Sequence: Synthetic peptide
  Seed: KKYKDYFPMI (MAGC3_HUMAN)
KSYKDYFPMK

SEQ ID NO: 99153 - protein, 11 aa, Artificial Sequence
  Description of Artificial Sequence: Synthetic peptide
  Seed: AIIDTTDDATA (MAGC3_HUMAN)
ALIDTTDDATM

SEQ ID NO: 99154 - protein, 10 aa, Artificial Sequence
  Description of Artificial Sequence: Synthetic peptide
  Seed: EEVIWEVLNA (MAGC3_HUMAN)
EVVIWEVLNV

SEQ ID NO: 99155 - protein, 10 aa, Artificial Sequence
  Description of Artificial Sequence: Synthetic peptide
  Seed: YTLDEKVDKL (MAGC3_HUMAN)
YALDEKVDKL

SEQ ID NO: 99156 - protein, 8 aa, Artificial Sequence
  Description of Artificial Sequence: Synthetic peptide
  Seed: FADVLSRL (MAGC3_HUMAN)
FIDVLSRF

SEQ ID NO: 99157 - protein, 11 aa, Artificial Sequence
  Description of Artificial Sequence: Synthetic peptide
  Seed: SKLSSIIPSAF (MAGC3_HUMAN)
SQLSSIIPSAM

SEQ ID NO: 99158 - protein, 9 aa, Artificial Sequence
  Description of Artificial Sequence: Synthetic peptide
  Seed: AGFADVLSR (MAGC3_HUMAN)
ALFADVLSK

SEQ ID NO: 99159 - protein, 9 aa, Artificial Sequence
  Description of Artificial Sequence: Synthetic peptide
  Seed: GPWSALAGF (MAGC3_HUMAN)
GQWSALAGF

SEQ ID NO: 99160 - protein, 9 aa, Artificial Sequence
  Description of Artificial Sequence: Synthetic peptide
  Seed: REVRLFLRG (MAGC3_HUMAN)
REVRLFLRV

SEQ ID NO: 99161 - protein, 9 aa, Artificial Sequence
  Description of Artificial Sequence: Synthetic peptide
  Seed: YQAKEPLTR (MAGC3_HUMAN)
YYAKEPLTY

SEQ ID NO: 99162 - protein, 11 aa, Artificial Sequence
  Description of Artificial Sequence: Synthetic peptide
  Seed: ILFGISLTEVD (MAGC3_HUMAN)
IMFGISLTEVN

SEQ ID NO: 99163 - protein, 9 aa, Artificial Sequence
  Description of Artificial Sequence: Synthetic peptide
  Seed: LKYQTKEPV (MAGC3_HUMAN)
LTYQTKEPF

SEQ ID NO: 99164 - protein, 9 aa, Artificial Sequence
  Description of Artificial Sequence: Synthetic peptide
  Seed: EIPPQGPPK (MAGC3_HUMAN)
ESPPQGPPR

SEQ ID NO: 99165 - protein, 10 aa, Artificial Sequence
  Description of Artificial Sequence: Synthetic peptide
  Seed: SAFHLGHLRE (MAGC3_HUMAN)
STFHLGHLRK

SEQ ID NO: 99166 - protein, 9 aa, Artificial Sequence
  Description of Artificial Sequence: Synthetic peptide
  Seed: HFYVFVNTL (MAGC3_HUMAN)
HSYVFVNTM

SEQ ID NO: 99167 - protein, 11 aa, Artificial Sequence
  Description of Artificial Sequence: Synthetic peptide
  Seed: LPQSPPEIPPQ (MAGC3_HUMAN)
LPQSPPEIPPV

SEQ ID NO: 99168 - protein, 9 aa, Artificial Sequence
  Description of Artificial Sequence: Synthetic peptide
  Seed: VLPPQPQPR (MAGC3_HUMAN)
VSPPQPQPF

SEQ ID NO: 99169 - protein, 8 aa, Artificial Sequence
  Description of Artificial Sequence: Synthetic peptide
  Seed: FADVLSRL (MAGC3_HUMAN)
FWDVLSRF

SEQ ID NO: 99170 - protein, 9 aa, Artificial Sequence
  Description of Artificial Sequence: Synthetic peptide
  Seed: YALDEKVAE (MAGC3_HUMAN)
YVLDEKVAL

SEQ ID NO: 99171 - protein, 8 aa, Artificial Sequence
  Description of Artificial Sequence: Synthetic peptide
  Seed: KAHEFIEL (MAGC3_HUMAN)
KYHEFIEL

SEQ ID NO: 99172 - protein, 9 aa, Artificial Sequence
  Description of Artificial Sequence: Synthetic peptide
  Seed: VIKKYKDYF (MAGC3_HUMAN)
VIKKYKDYY

SEQ ID NO: 99173 - protein, 10 aa, Artificial Sequence
  Description of Artificial Sequence: Synthetic peptide
  Seed: VLNAIGPWSA (MAGC3_HUMAN)
VMNAIGPWSA

SEQ ID NO: 99174 - protein, 9 aa, Artificial Sequence
  Description of Artificial Sequence: Synthetic peptide
  Seed: SLVLCPTYF (MAGC3_HUMAN)
SVVLCPTYW

SEQ ID NO: 99175 - protein, 11 aa, Artificial Sequence
  Description of Artificial Sequence: Synthetic peptide
  Seed: KVAELVQFLLL (MAGC3_HUMAN)
KLAELVQFLLH

SEQ ID NO: 99176 - protein, 10 aa, Artificial Sequence
  Description of Artificial Sequence: Synthetic peptide
  Seed: IELIFGIALT (MAGC3_HUMAN)
ICLIFGIALI

SEQ ID NO: 99177 - protein, 10 aa, Artificial Sequence
  Description of Artificial Sequence: Synthetic peptide
  Seed: VLCPTYFKLW (MAGC3_HUMAN)
VYCPTYFKLF

SEQ ID NO: 99178 - protein, 9 aa, Artificial Sequence
  Description of Artificial Sequence: Synthetic peptide
  Seed: EVIWEVLSA (MAGC3_HUMAN)
EMIWEVLSV

SEQ ID NO: 99179 - protein, 10 aa, Artificial Sequence
  Description of Artificial Sequence: Synthetic peptide
  Seed: FSDGSLGQWV (MAGC3_HUMAN)
FSDGSLGQWI

SEQ ID NO: 99180 - protein, 10 aa, Artificial Sequence
  Description of Artificial Sequence: Synthetic peptide
  Seed: KDSDLPTWRR (MAGC3_HUMAN)
KLSDLPTWRR

SEQ ID NO: 99181 - protein, 10 aa, Artificial Sequence
  Description of Artificial Sequence: Synthetic peptide
  Seed: TAMASASPSV (MAGC3_HUMAN)
TCMASASPSI

SEQ ID NO: 99182 - protein, 11 aa, Artificial Sequence
  Description of Artificial Sequence: Synthetic peptide
  Seed: ALWESEGPEAF (MAGC3_HUMAN)
AVWESEGPEAV

SEQ ID NO: 99183 - protein, 9 aa, Artificial Sequence
  Description of Artificial Sequence: Synthetic peptide
  Seed: SASPSVMST (MAGC3_HUMAN)
SCSPSVMSL

SEQ ID NO: 99184 - protein, 9 aa, Artificial Sequence
  Description of Artificial Sequence: Synthetic peptide
  Seed: LILSMIFIK (MAGC3_HUMAN)
LTLSMIFIR

SEQ ID NO: 99185 - protein, 9 aa, Artificial Sequence
  Description of Artificial Sequence: Synthetic peptide
  Seed: YQTKEPVTK (MAGC3_HUMAN)
YGTKEPVTY

SEQ ID NO: 99186 - protein, 10 aa, Artificial Sequence
  Description of Artificial Sequence: Synthetic peptide
  Seed: YTGYFPMIFR (MAGC3_HUMAN)
YEGYFPMIFR

SEQ ID NO: 99187 - protein, 8 aa, Artificial Sequence
  Description of Artificial Sequence: Synthetic peptide
  Seed: KVDKLVQF (MAGC3_HUMAN)
KYDKLVQM

SEQ ID NO: 99188 - protein, 10 aa, Artificial Sequence
  Description of Artificial Sequence: Synthetic peptide
  Seed: TTDDATAMAS (MAGC3_HUMAN)
TTDDATAMAV

SEQ ID NO: 99189 - protein, 10 aa, Artificial Sequence
  Description of Artificial Sequence: Synthetic peptide
  Seed: ILILSMIFIK (MAGC3_HUMAN)
IKILSMIFIR

SEQ ID NO: 99190 - protein, 11 aa, Artificial Sequence
  Description of Artificial Sequence: Synthetic peptide
  Seed: KVAELVQFLLL (MAGC3_HUMAN)
KMAELVQFLLI

SEQ ID NO: 99191 - protein, 9 aa, Artificial Sequence
  Description of Artificial Sequence: Synthetic peptide
  Seed: MIFRKAREF (MAGC3_HUMAN)
MSFRKAREM

SEQ ID NO: 99192 - protein, 10 aa, Artificial Sequence
  Description of Artificial Sequence: Synthetic peptide
  Seed: SIIPSAFPSW (MAGC3_HUMAN)
SAIPSAFPSY

SEQ ID NO: 99193 - protein, 10 aa, Artificial Sequence
  Description of Artificial Sequence: Synthetic peptide
  Seed: YTLDEKVDKL (MAGC3_HUMAN)
YFLDEKVDKV

SEQ ID NO: 99194 - protein, 10 aa, Artificial Sequence
  Description of Artificial Sequence: Synthetic peptide
  Seed: FKLWRTLSGS (MAGC3_HUMAN)
FVLWRTLSGL

SEQ ID NO: 99195 - protein, 9 aa, Artificial Sequence
  Description of Artificial Sequence: Synthetic peptide
  Seed: LDLANPQGL (MAGC3_HUMAN)
LELANPQGA

SEQ ID NO: 99196 - protein, 11 aa, Artificial Sequence
  Description of Artificial Sequence: Synthetic peptide
  Seed: YKDYFPMIFGK (MAGC3_HUMAN)
YSDYFPMIFGR

SEQ ID NO: 99197 - protein, 9 aa, Artificial Sequence
  Description of Artificial Sequence: Synthetic peptide
  Seed: NAIGPWSAL (MAGC3_HUMAN)
NTIGPWSAR

SEQ ID NO: 99198 - protein, 9 aa, Artificial Sequence
  Description of Artificial Sequence: Synthetic peptide
  Seed: HLREVRLFL (MAGC3_HUMAN)
HCREVRLFK

SEQ ID NO: 99199 - protein, 9 aa, Artificial Sequence
  Description of Artificial Sequence: Synthetic peptide
  Seed: ATYALSPVV (MAGC3_HUMAN)
AIYALSPVR

SEQ ID NO: 99200 - protein, 10 aa, Artificial Sequence
  Description of Artificial Sequence: Synthetic peptide
  Seed: YALSPVVLPP (MAGC3_HUMAN)
YALSPVVLPA

SEQ ID NO: 99201 - protein, 9 aa, Artificial Sequence
  Description of Artificial Sequence: Synthetic peptide
  Seed: DMDPDNHSY (MAGC3_HUMAN)
DTDPDNHSL

SEQ ID NO: 99202 - protein, 9 aa, Artificial Sequence
  Description of Artificial Sequence: Synthetic peptide
  Seed: YALDEKVAE (MAGC3_HUMAN)
YTLDEKVAY

SEQ ID NO: 99203 - protein, 9 aa, Artificial Sequence
  Description of Artificial Sequence: Synthetic peptide
  Seed: FPSWYMDAL (MAGC3_HUMAN)
FKSWYMDAL

SEQ ID NO: 99204 - protein, 10 aa, Artificial Sequence
  Description of Artificial Sequence: Synthetic peptide
  Seed: FPSWYMDALK (MAGC3_HUMAN)
FMSWYMDALY

SEQ ID NO: 99205 - protein, 10 aa, Artificial Sequence
  Description of Artificial Sequence: Synthetic peptide
  Seed: CSSPLLWTRL (MAGC3_HUMAN)
CTSPLLWTRF

SEQ ID NO: 99206 - protein, 10 aa, Artificial Sequence
  Description of Artificial Sequence: Synthetic peptide
  Seed: AMASASPSVM (MAGC3_HUMAN)
AAASASPSVL

SEQ ID NO: 99207 - protein, 10 aa, Artificial Sequence
  Description of Artificial Sequence: Synthetic peptide
  Seed: IIDTTDDATA (MAGC3_HUMAN)
IGDTTDDATL

SEQ ID NO: 99208 - protein, 9 aa, Artificial Sequence
  Description of Artificial Sequence: Synthetic peptide
  Seed: HLREVRLFL (MAGC3_HUMAN)
HSREVRLFP

SEQ ID NO: 99209 - protein, 9 aa, Artificial Sequence
  Description of Artificial Sequence: Synthetic peptide
  Seed: EVDPDHFYV (MAGC3_HUMAN)
EFDPDHFYI

SEQ ID NO: 99210 - protein, 10 aa, Artificial Sequence
  Description of Artificial Sequence: Synthetic peptide
  Seed: TGYFPMIFRK (MAGC3_HUMAN)
TAYFPMIFRS

SEQ ID NO: 99211 - protein, 9 aa, Artificial Sequence
  Description of Artificial Sequence: Synthetic peptide
  Seed: AIGPWSALA (MAGC3_HUMAN)
AMGPWSALA

SEQ ID NO: 99212 - protein, 8 aa, Artificial Sequence
  Description of Artificial Sequence: Synthetic peptide
  Seed: TTDDATAM (MAGC3_HUMAN)
TFDDATAI

SEQ ID NO: 99213 - protein, 9 aa, Artificial Sequence
  Description of Artificial Sequence: Synthetic peptide
  Seed: SEEVIWEVL (MAGC3_HUMAN)
SHEVIWEVF

SEQ ID NO: 99214 - protein, 9 aa, Artificial Sequence
  Description of Artificial Sequence: Synthetic peptide
  Seed: RTLSGSPGL (MAGC3_HUMAN)
RALSGSPGW

SEQ ID NO: 99215 - protein, 10 aa, Artificial Sequence
  Description of Artificial Sequence: Synthetic peptide
  Seed: YTLDEKVDKL (MAGC3_HUMAN)
YILDEKVDKF

SEQ ID NO: 99216 - protein, 9 aa, Artificial Sequence
  Description of Artificial Sequence: Synthetic peptide
  Seed: DMDPDNHSY (MAGC3_HUMAN)
DADPDNHSF

SEQ ID NO: 99217 - protein, 9 aa, Artificial Sequence
  Description of Artificial Sequence: Synthetic peptide
  Seed: SLPESEPLF (MAGC3_HUMAN)
SFPESEPLW

SEQ ID NO: 99218 - protein, 8 aa, Artificial Sequence
  Description of Artificial Sequence: Synthetic peptide
  Seed: YMDALKDM (MAGC3_HUMAN)
YLDALKDL

SEQ ID NO: 99219 - protein, 9 aa, Artificial Sequence
  Description of Artificial Sequence: Synthetic peptide
  Seed: ELIFGIALT (MAGC3_HUMAN)
ECIFGIALV

SEQ ID NO: 99220 - protein, 10 aa, Artificial Sequence
  Description of Artificial Sequence: Synthetic peptide
  Seed: SCSSPLLWTR (MAGC3_HUMAN)
SDSSPLLWTR

SEQ ID NO: 99221 - protein, 9 aa, Artificial Sequence
  Description of Artificial Sequence: Synthetic peptide
  Seed: NAIGPWSAL (MAGC3_HUMAN)
NMIGPWSAL

SEQ ID NO: 99222 - protein, 9 aa, Artificial Sequence
  Description of Artificial Sequence: Synthetic peptide
  Seed: EIPPQGPPK (MAGC3_HUMAN)
EAPPQGPPY

SEQ ID NO: 99223 - protein, 10 aa, Artificial Sequence
  Description of Artificial Sequence: Synthetic peptide
  Seed: LPTWRRGTGY (MAGC3_HUMAN)
LGTWRRGTGW

SEQ ID NO: 99224 - protein, 9 aa, Artificial Sequence
  Description of Artificial Sequence: Synthetic peptide
  Seed: QRMDSLVLC (MAGC3_HUMAN)
QRMDSLVLM

SEQ ID NO: 99225 - protein, 10 aa, Artificial Sequence
  Description of Artificial Sequence: Synthetic peptide
  Seed: TEVDPDHFYV (MAGC3_HUMAN)
TEVDPDHFYA

SEQ ID NO: 99226 - protein, 9 aa, Artificial Sequence
  Description of Artificial Sequence: Synthetic peptide
  Seed: TLDEKVDKL (MAGC3_HUMAN)
TGDEKVDKF

SEQ ID NO: 99227 - protein, 11 aa, Artificial Sequence
  Description of Artificial Sequence: Synthetic peptide
  Seed: GPPQSPPQSPL (MAGC3_HUMAN)
GAPQSPPQSPL

SEQ ID NO: 99228 - protein, 9 aa, Artificial Sequence
  Description of Artificial Sequence: Synthetic peptide
  Seed: IIPSAFPSW (MAGC3_HUMAN)
ILPSAFPSF

SEQ ID NO: 99229 - protein, 10 aa, Artificial Sequence
  Description of Artificial Sequence: Synthetic peptide
  Seed: SDQRMDSLVL (MAGC3_HUMAN)
SFQRMDSLVY

SEQ ID NO: 99230 - protein, 10 aa, Artificial Sequence
  Description of Artificial Sequence: Synthetic peptide
  Seed: YSAFHLGHLR (MAGC3_HUMAN)
YWAFHLGHLK

SEQ ID NO: 99231 - protein, 10 aa, Artificial Sequence
  Description of Artificial Sequence: Synthetic peptide
  Seed: KLVQFLLLKY (MAGC3_HUMAN)
KIVQFLLLKY

SEQ ID NO: 99232 - protein, 9 aa, Artificial Sequence
  Description of Artificial Sequence: Synthetic peptide
  Seed: FKLWRTLSG (MAGC3_HUMAN)
FHLWRTLSF

SEQ ID NO: 99233 - protein, 9 aa, Artificial Sequence
  Description of Artificial Sequence: Synthetic peptide
  Seed: NAIGPWSAL (MAGC3_HUMAN)
NPIGPWSAI

SEQ ID NO: 99234 - protein, 9 aa, Artificial Sequence
  Description of Artificial Sequence: Synthetic peptide
  Seed: MQMNVINTY (MAGC3_HUMAN)
MAMNVINTK

SEQ ID NO: 99235 - protein, 8 aa, Artificial Sequence
  Description of Artificial Sequence: Synthetic peptide
  Seed: AEMQMNVI (MAGC3_HUMAN)
AEMQMNVM

SEQ ID NO: 99236 - protein, 10 aa, Artificial Sequence
  Description of Artificial Sequence: Synthetic peptide
  Seed: MDSLVLCPTY (MAGC3_HUMAN)
MTSLVLCPTY

SEQ ID NO: 99237 - protein, 11 aa, Artificial Sequence
  Description of Artificial Sequence: Synthetic peptide
  Seed: DLANPQGLAGH (MAGC3_HUMAN)
DSANPQGLAGK

SEQ ID NO: 99238 - protein, 9 aa, Artificial Sequence
  Description of Artificial Sequence: Synthetic peptide
  Seed: SQPEGKFSL (MAGC3_HUMAN)
SWPEGKFSL

SEQ ID NO: 99239 - protein, 10 aa, Artificial Sequence
  Description of Artificial Sequence: Synthetic peptide
  Seed: VVLPPQPQPR (MAGC3_HUMAN)
VSLPPQPQPL

SEQ ID NO: 99240 - protein, 9 aa, Artificial Sequence
  Description of Artificial Sequence: Synthetic peptide
  Seed: RGTGYTLSL (MAGC3_HUMAN)
RHTGYTLSY

SEQ ID NO: 99241 - protein, 9 aa, Artificial Sequence
  Description of Artificial Sequence: Synthetic peptide
  Seed: HLREVRLFL (MAGC3_HUMAN)
HSREVRLFF

SEQ ID NO: 99242 - protein, 10 aa, Artificial Sequence
  Description of Artificial Sequence: Synthetic peptide
  Seed: TCATYALSPV (MAGC3_HUMAN)
TTATYALSPI

SEQ ID NO: 99243 - protein, 9 aa, Artificial Sequence
  Description of Artificial Sequence: Synthetic peptide
  Seed: MPKNCLLIL (MAGC3_HUMAN)
MAKNCLLIY

SEQ ID NO: 99244 - protein, 9 aa, Artificial Sequence
  Description of Artificial Sequence: Synthetic peptide
  Seed: HFYVFVNTL (MAGC3_HUMAN)
HYYVFVNTM

SEQ ID NO: 99245 - protein, 10 aa, Artificial Sequence
  Description of Artificial Sequence: Synthetic peptide
  Seed: DMDPDNHSYF (MAGC3_HUMAN)
DLDPDNHSYY

SEQ ID NO: 99246 - protein, 9 aa, Artificial Sequence
  Description of Artificial Sequence: Synthetic peptide
  Seed: FSDGSLGQW (MAGC3_HUMAN)
FFDGSLGQM

SEQ ID NO: 99247 - protein, 10 aa, Artificial Sequence
  Description of Artificial Sequence: Synthetic peptide
  Seed: LILILSMIFI (MAGC3_HUMAN)
LALILSMIFV

SEQ ID NO: 99248 - protein, 9 aa, Artificial Sequence
  Description of Artificial Sequence: Synthetic peptide
  Seed: HLREVRLFL (MAGC3_HUMAN)
HIREVRLFM

SEQ ID NO: 99249 - protein, 9 aa, Artificial Sequence
  Description of Artificial Sequence: Synthetic peptide
  Seed: TKAEMLTTV (MAGC3_HUMAN)
TLAEMLTTL

SEQ ID NO: 99250 - protein, 10 aa, Artificial Sequence
  Description of Artificial Sequence: Synthetic peptide
  Seed: YQAKEPLTRA (MAGC3_HUMAN)
YIAKEPLTRV

SEQ ID NO: 99251 - protein, 9 aa, Artificial Sequence
  Description of Artificial Sequence: Synthetic peptide
  Seed: HFYVFVNTL (MAGC3_HUMAN)
HIYVFVNTI

SEQ ID NO: 99252 - protein, 9 aa, Artificial Sequence
  Description of Artificial Sequence: Synthetic peptide
  Seed: TYTGYFPMI (MAGC3_HUMAN)
TFTGYFPML

SEQ ID NO: 99253 - protein, 9 aa, Artificial Sequence
  Description of Artificial Sequence: Synthetic peptide
  Seed: WESEGPEAF (MAGC3_HUMAN)
WKSEGPEAY

SEQ ID NO: 99254 - protein, 11 aa, Artificial Sequence
  Description of Artificial Sequence: Synthetic peptide
  Seed: DLANPQGLAGH (MAGC3_HUMAN)
DMANPQGLAGR

SEQ ID NO: 99255 - protein, 9 aa, Artificial Sequence
  Description of Artificial Sequence: Synthetic peptide
  Seed: YSAFHLGHL (MAGC3_HUMAN)
YSAFHLGHI

SEQ ID NO: 99256 - protein, 10 aa, Artificial Sequence
  Description of Artificial Sequence: Synthetic peptide
  Seed: REVRLFLRGG (MAGC3_HUMAN)
REVRLFLRGV

SEQ ID NO: 99257 - protein, 10 aa, Artificial Sequence
  Description of Artificial Sequence: Synthetic peptide
  Seed: KVAELVQFLL (MAGC3_HUMAN)
KMAELVQFLY

SEQ ID NO: 99258 - protein, 9 aa, Artificial Sequence
  Description of Artificial Sequence: Synthetic peptide
  Seed: HALPESESL (MAGC3_HUMAN)
HKLPESESF

SEQ ID NO: 99259 - protein, 9 aa, Artificial Sequence
  Description of Artificial Sequence: Synthetic peptide
  Seed: SASPSVMST (MAGC3_HUMAN)
SASPSVMSF

SEQ ID NO: 99260 - protein, 9 aa, Artificial Sequence
  Description of Artificial Sequence: Synthetic peptide
  Seed: HSYFFEDTL (MAGC3_HUMAN)
HLYFFEDTL

SEQ ID NO: 99261 - protein, 11 aa, Artificial Sequence
  Description of Artificial Sequence: Synthetic peptide
  Seed: LDSCSSPLLWT (MAGC3_HUMAN)
LSSCSSPLLWG

SEQ ID NO: 99262 - protein, 9 aa, Artificial Sequence
  Description of Artificial Sequence: Synthetic peptide
  Seed: LANPQGLAG (MAGC3_HUMAN)
LINPQGLAL

SEQ ID NO: 99263 - protein, 9 aa, Artificial Sequence
  Description of Artificial Sequence: Synthetic peptide
  Seed: MIFGKAHEF (MAGC3_HUMAN)
MNFGKAHEW

SEQ ID NO: 99264 - protein, 9 aa, Artificial Sequence
  Description of Artificial Sequence: Synthetic peptide
  Seed: LLILILSVI (MAGC3_HUMAN)
LIILILSVV

SEQ ID NO: 99265 - protein, 10 aa, Artificial Sequence
  Description of Artificial Sequence: Synthetic peptide
  Seed: KLSSIIPSAF (MAGC3_HUMAN)
KWSSIIPSAF

SEQ ID NO: 99266 - protein, 10 aa, Artificial Sequence
  Description of Artificial Sequence: Synthetic peptide
  Seed: MQMNVINTYT (MAGC3_HUMAN)
MNMNVINTYV

SEQ ID NO: 99267 - protein, 10 aa, Artificial Sequence
  Description of Artificial Sequence: Synthetic peptide
  Seed: KYKDYFPMIF (MAGC3_HUMAN)
KWKDYFPMIW

SEQ ID NO: 99268 - protein, 10 aa, Artificial Sequence
  Description of Artificial Sequence: Synthetic peptide
  Seed: TTDDATAMAS (MAGC3_HUMAN)
TMDDATAMAL

SEQ ID NO: 99269 - protein, 10 aa, Artificial Sequence
  Description of Artificial Sequence: Synthetic peptide
  Seed: SLIDDQGMPK (MAGC3_HUMAN)
SIIDDQGMPK

SEQ ID NO: 99270 - protein, 10 aa, Artificial Sequence
  Description of Artificial Sequence: Synthetic peptide
  Seed: EPQDWPLNEK (MAGC3_HUMAN)
EVQDWPLNEK

SEQ ID NO: 99271 - protein, 11 aa, Artificial Sequence
  Description of Artificial Sequence: Synthetic peptide
  Seed: LDSCSSPLLWT (MAGC3_HUMAN)
LLSCSSPLLWW

SEQ ID NO: 99272 - protein, 11 aa, Artificial Sequence
  Description of Artificial Sequence: Synthetic peptide
  Seed: FSDGSLGQWVK (MAGC3_HUMAN)
FVDGSLGQWVY

SEQ ID NO: 99273 - protein, 9 aa, Artificial Sequence
  Description of Artificial Sequence: Synthetic peptide
  Seed: SAIGPIQRP (MAGC3_HUMAN)
SVIGPIQRY

SEQ ID NO: 99274 - protein, 9 aa, Artificial Sequence
  Description of Artificial Sequence: Synthetic peptide
  Seed: VDPDHFYVF (MAGC3_HUMAN)
VAPDHFYVI

SEQ ID NO: 99275 - protein, 9 aa, Artificial Sequence
  Description of Artificial Sequence: Synthetic peptide
  Seed: ATDKDYSAF (MAGC3_HUMAN)
AVDKDYSAY

SEQ ID NO: 99276 - protein, 10 aa, Artificial Sequence
  Description of Artificial Sequence: Synthetic peptide
  Seed: SKLSSIIPSA (MAGC3_HUMAN)
SQLSSIIPSI

SEQ ID NO: 99277 - protein, 9 aa, Artificial Sequence
  Description of Artificial Sequence: Synthetic peptide
  Seed: KAHEFIELI (MAGC3_HUMAN)
KRHEFIELF

SEQ ID NO: 99278 - protein, 9 aa, Artificial Sequence
  Description of Artificial Sequence: Synthetic peptide
  Seed: TEASPQQKK (MAGC3_HUMAN)
TEASPQQKY

SEQ ID NO: 99279 - protein, 11 aa, Artificial Sequence
  Description of Artificial Sequence: Synthetic peptide
  Seed: IIDTTDDATAM (MAGC3_HUMAN)
IVDTTDDATAY

SEQ ID NO: 99280 - protein, 9 aa, Artificial Sequence
  Description of Artificial Sequence: Synthetic peptide
  Seed: SIIPSAFPS (MAGC3_HUMAN)
SLIPSAFPL

SEQ ID NO: 99281 - protein, 9 aa, Artificial Sequence
  Description of Artificial Sequence: Synthetic peptide
  Seed: ALAGFADVL (MAGC3_HUMAN)
AAAGFADVM

SEQ ID NO: 99282 - protein, 9 aa, Artificial Sequence
  Description of Artificial Sequence: Synthetic peptide
  Seed: FSDGSLGQW (MAGC3_HUMAN)
FADGSLGQV

SEQ ID NO: 99283 - protein, 9 aa, Artificial Sequence
  Description of Artificial Sequence: Synthetic peptide
  Seed: MEDRAQAII (MAGC3_HUMAN)
MADRAQAIV

SEQ ID NO: 99284 - protein, 10 aa, Artificial Sequence
  Description of Artificial Sequence: Synthetic peptide
  Seed: LLKYQAKEPL (MAGC3_HUMAN)
LLKYQAKEPY

SEQ ID NO: 99285 - protein, 10 aa, Artificial Sequence
  Description of Artificial Sequence: Synthetic peptide
  Seed: ILILSMIFIK (MAGC3_HUMAN)
IIILSMIFIR

SEQ ID NO: 99286 - protein, 9 aa, Artificial Sequence
  Description of Artificial Sequence: Synthetic peptide
  Seed: FADVLSRLA (MAGC3_HUMAN)
FLDVLSRLF

SEQ ID NO: 99287 - protein, 9 aa, Artificial Sequence
  Description of Artificial Sequence: Synthetic peptide
  Seed: FPSWYMDAL (MAGC3_HUMAN)
FTSWYMDAV

SEQ ID NO: 99288 - protein, 9 aa, Artificial Sequence
  Description of Artificial Sequence: Synthetic peptide
  Seed: MIFIKGSCV (MAGC3_HUMAN)
MVFIKGSCL

SEQ ID NO: 99289 - protein, 9 aa, Artificial Sequence
  Description of Artificial Sequence: Synthetic peptide
  Seed: IIDTTDDAT (MAGC3_HUMAN)
IVDTTDDAL

SEQ ID NO: 99290 - protein, 10 aa, Artificial Sequence
  Description of Artificial Sequence: Synthetic peptide
  Seed: YTGYFPMIFR (MAGC3_HUMAN)
YIGYFPMIFR

SEQ ID NO: 99291 - protein, 10 aa, Artificial Sequence
  Description of Artificial Sequence: Synthetic peptide
  Seed: LVLCPTYFKL (MAGC3_HUMAN)
LMLCPTYFKA

SEQ ID NO: 99292 - protein, 10 aa, Artificial Sequence
  Description of Artificial Sequence: Synthetic peptide
  Seed: HLREVRLFLR (MAGC3_HUMAN)
HMREVRLFLR

SEQ ID NO: 99293 - protein, 9 aa, Artificial Sequence
  Description of Artificial Sequence: Synthetic peptide
  Seed: KVAELVQFL (MAGC3_HUMAN)
KVAELVQFM

SEQ ID NO: 99294 - protein, 11 aa, Artificial Sequence
  Description of Artificial Sequence: Synthetic peptide
  Seed: AEMQMNVINTY (MAGC3_HUMAN)
AEMQMNVINTL

SEQ ID NO: 99295 - protein, 11 aa, Artificial Sequence
  Description of Artificial Sequence: Synthetic peptide
  Seed: TTDDATAMASA (MAGC3_HUMAN)
TADDATAMASF

SEQ ID NO: 99296 - protein, 9 aa, Artificial Sequence
  Description of Artificial Sequence: Synthetic peptide
  Seed: VLCPTYFKL (MAGC3_HUMAN)
VFCPTYFKW

SEQ ID NO: 99297 - protein, 9 aa, Artificial Sequence
  Description of Artificial Sequence: Synthetic peptide
  Seed: YKDYFPMIF (MAGC3_HUMAN)
YRDYFPMIL

SEQ ID NO: 99298 - protein, 11 aa, Artificial Sequence
  Description of Artificial Sequence: Synthetic peptide
  Seed: NTLDLTCEGSL (MAGC3_HUMAN)
NTLDLTCEGSW

SEQ ID NO: 99299 - protein, 9 aa, Artificial Sequence
  Description of Artificial Sequence: Synthetic peptide
  Seed: SAFHLGHLR (MAGC3_HUMAN)
SMFHLGHLK

SEQ ID NO: 99300 - protein, 9 aa, Artificial Sequence
  Description of Artificial Sequence: Synthetic peptide
  Seed: YFFEDTLDL (MAGC3_HUMAN)
YTFEDTLDI

SEQ ID NO: 99301 - protein, 10 aa, Artificial Sequence
  Description of Artificial Sequence: Synthetic peptide
  Seed: EVIWEVLNAI (MAGC3_HUMAN)
ESIWEVLNAL

SEQ ID NO: 99302 - protein, 9 aa, Artificial Sequence
  Description of Artificial Sequence: Synthetic peptide
  Seed: FSLRRAVSV (MAGC3_HUMAN)
FLLRRAVSI

SEQ ID NO: 99303 - protein, 10 aa, Artificial Sequence
  Description of Artificial Sequence: Synthetic peptide
  Seed: GEKAGSLPES (MAGC3_HUMAN)
GEKAGSLPEI

SEQ ID NO: 99304 - protein, 11 aa, Artificial Sequence
  Description of Artificial Sequence: Synthetic peptide
  Seed: RYALDEKVAEL (MAGC3_HUMAN)
RRALDEKVAEV

SEQ ID NO: 99305 - protein, 9 aa, Artificial Sequence
  Description of Artificial Sequence: Synthetic peptide
  Seed: MPAAGMPPL (MAGC3_HUMAN)
MAAAGMPPH

SEQ ID NO: 99306 - protein, 9 aa, Artificial Sequence
  Description of Artificial Sequence: Synthetic peptide
  Seed: KLVQFLLLK (MAGC3_HUMAN)
KLVQFLLLI

SEQ ID NO: 99307 - protein, 9 aa, Artificial Sequence
  Description of Artificial Sequence: Synthetic peptide
  Seed: NAIGPWSAL (MAGC3_HUMAN)
NVIGPWSAM

SEQ ID NO: 99308 - protein, 11 aa, Artificial Sequence
  Description of Artificial Sequence: Synthetic peptide
  Seed: ATFSDGSLGQW (MAGC3_HUMAN)
AAFSDGSLGQM

SEQ ID NO: 99309 - protein, 9 aa, Artificial Sequence
  Description of Artificial Sequence: Synthetic peptide
  Seed: YSAFHLGHL (MAGC3_HUMAN)
YMAFHLGHI
